United States Patent 12,031,154 (UNIVERSAL DONOR STEM CELLS AND RELATED METHODS) - sequence listing, part 5

SEQ ID NO: 83873 - DNA, 20 bp, synthetic construct
  misc_feature 1..20: note = CRISPR gRNA sequence
  source 1..20: mol_type = other DNA
attttcaatgaaaaatatag

SEQ ID NO: 83874 - DNA, 20 bp, synthetic construct
  misc_feature 1..20: note = CRISPR gRNA sequence
  source 1..20: mol_type = other DNA
tcaatgaaaaatatagagtt

SEQ ID NO: 83875 - DNA, 20 bp, synthetic construct
  misc_feature 1..20: note = CRISPR gRNA sequence
  source 1..20: mol_type = other DNA
caatgaaaaatatagagttt

SEQ ID NO: 83876 - DNA, 20 bp, synthetic construct
  misc_feature 1..20: note = CRISPR gRNA sequence
  source 1..20: mol_type = other DNA
aatgaaaaatatagagttta

SEQ ID NO: 83877 - DNA, 20 bp, synthetic construct
  misc_feature 1..20: note = CRISPR gRNA sequence
  source 1..20: mol_type = other DNA
ataatattttcttcccactt

SEQ ID NO: 83878 - DNA, 20 bp, synthetic construct
  misc_feature 1..20: note = CRISPR gRNA sequence
  source 1..20: mol_type = other DNA
taatattttcttcccacttc

SEQ ID NO: 83879 - DNA, 20 bp, synthetic construct
  misc_feature 1..20: note = CRISPR gRNA sequence
  source 1..20: mol_type = other DNA
tcttcccacttccccatgga

SEQ ID NO: 83880 - DNA, 20 bp, synthetic construct
  misc_feature 1..20: note = CRISPR gRNA sequence
  source 1..20: mol_type = other DNA
cttcccacttccccatggat

SEQ ID NO: 83881 - DNA, 20 bp, synthetic construct
  misc_feature 1..20: note = CRISPR gRNA sequence
  source 1..20: mol_type = other DNA
ttcccacttccccatggatg

SEQ ID NO: 83882 - DNA, 20 bp, synthetic construct
  misc_feature 1..20: note = CRISPR gRNA sequence
  source 1..20: mol_type = other DNA
cccacttccccatggatggt

SEQ ID NO: 83883 - DNA, 20 bp, synthetic construct
  misc_feature 1..20: note = CRISPR gRNA sequence
  source 1..20: mol_type = other DNA
ccacttccccatggatggtc

SEQ ID NO: 83884 - DNA, 20 bp, synthetic construct
  misc_feature 1..20: note = CRISPR gRNA sequence
  source 1..20: mol_type = other DNA
ccccatggatggtctagtca

SEQ ID NO: 83885 - DNA, 20 bp, synthetic construct
  misc_feature 1..20: note = CRISPR gRNA sequence
  source 1..20: mol_type = other DNA
cccatggatggtctagtcat

SEQ ID NO: 83886 - DNA, 20 bp, synthetic construct
  misc_feature 1..20: note = CRISPR gRNA sequence
  source 1..20: mol_type = other DNA
gtcatgcctctcattttgga

SEQ ID NO: 83887 - DNA, 20 bp, synthetic construct
  misc_feature 1..20: note = CRISPR gRNA sequence
  source 1..20: mol_type = other DNA
tcattttggaaagtactgtt

SEQ ID NO: 83888 - DNA, 20 bp, synthetic construct
  misc_feature 1..20: note = CRISPR gRNA sequence
  source 1..20: mol_type = other DNA
attttggaaagtactgtttc

SEQ ID NO: 83889 - DNA, 20 bp, synthetic construct
  misc_feature 1..20: note = CRISPR gRNA sequence
  source 1..20: mol_type = other DNA
tggaaagtactgtttctgaa

SEQ ID NO: 83890 - DNA, 20 bp, synthetic construct
  misc_feature 1..20: note = CRISPR gRNA sequence
  source 1..20: mol_type = other DNA
ggaaagtactgtttctgaaa

SEQ ID NO: 83891 - DNA, 20 bp, synthetic construct
  misc_feature 1..20: note = CRISPR gRNA sequence
  source 1..20: mol_type = other DNA
gaaagtactgtttctgaaac

SEQ ID NO: 83892 - DNA, 20 bp, synthetic construct
  misc_feature 1..20: note = CRISPR gRNA sequence
  source 1..20: mol_type = other DNA
tttctgaaacattaggcaat

SEQ ID NO: 83893 - DNA, 20 bp, synthetic construct
  misc_feature 1..20: note = CRISPR gRNA sequence
  source 1..20: mol_type = other DNA
ctgaaacattaggcaatata

SEQ ID NO: 83894 - DNA, 20 bp, synthetic construct
  misc_feature 1..20: note = CRISPR gRNA sequence
  source 1..20: mol_type = other DNA
tgaaacattaggcaatatat

SEQ ID NO: 83895 - DNA, 20 bp, synthetic construct
  misc_feature 1..20: note = CRISPR gRNA sequence
  source 1..20: mol_type = other DNA
aaacattaggcaatatattc

SEQ ID NO: 83896 - DNA, 20 bp, synthetic construct
  misc_feature 1..20: note = CRISPR gRNA sequence
  source 1..20: mol_type = other DNA
ggcaatatattcccaacctg

SEQ ID NO: 83897 - DNA, 20 bp, synthetic construct
  misc_feature 1..20: note = CRISPR gRNA sequence
  source 1..20: mol_type = other DNA
ccaacctggctagtttacag

SEQ ID NO: 83898 - DNA, 20 bp, synthetic construct
  misc_feature 1..20: note = CRISPR gRNA sequence
  source 1..20: mol_type = other DNA
gctagtttacagcaatcacc

SEQ ID NO: 83899 - DNA, 20 bp, synthetic construct
  misc_feature 1..20: note = CRISPR gRNA sequence
  source 1..20: mol_type = other DNA
gtttacagcaatcacctgtg

SEQ ID NO: 83900 - DNA, 20 bp, synthetic construct
  misc_feature 1..20: note = CRISPR gRNA sequence
  source 1..20: mol_type = other DNA
acagcaatcacctgtggatg

SEQ ID NO: 83901 - DNA, 20 bp, synthetic construct
  misc_feature 1..20: note = CRISPR gRNA sequence
  source 1..20: mol_type = other DNA
cagcaatcacctgtggatgc

SEQ ID NO: 83902 - DNA, 20 bp, synthetic construct
  misc_feature 1..20: note = CRISPR gRNA sequence
  source 1..20: mol_type = other DNA
tggatgctaattaaaacgca

SEQ ID NO: 83903 - DNA, 20 bp, synthetic construct
  misc_feature 1..20: note = CRISPR gRNA sequence
  source 1..20: mol_type = other DNA
attaaaacgcaaatcccact

SEQ ID NO: 83904 - DNA, 20 bp, synthetic construct
  misc_feature 1..20: note = CRISPR gRNA sequence
  source 1..20: mol_type = other DNA
aaacgcaaatcccactgtca

SEQ ID NO: 83905 - DNA, 20 bp, synthetic construct
  misc_feature 1..20: note = CRISPR gRNA sequence
  source 1..20: mol_type = other DNA
tcacatgcattactccattt

SEQ ID NO: 83906 - DNA, 20 bp, synthetic construct
  misc_feature 1..20: note = CRISPR gRNA sequence
  source 1..20: mol_type = other DNA
ctccatttgatcataatgga

SEQ ID NO: 83907 - DNA, 20 bp, synthetic construct
  misc_feature 1..20: note = CRISPR gRNA sequence
  source 1..20: mol_type = other DNA
catttgatcataatggaaag

SEQ ID NO: 83908 - DNA, 20 bp, synthetic construct
  misc_feature 1..20: note = CRISPR gRNA sequence
  source 1..20: mol_type = other DNA
gatcataatggaaagtatgt

SEQ ID NO: 83909 - DNA, 20 bp, synthetic construct
  misc_feature 1..20: note = CRISPR gRNA sequence
  source 1..20: mol_type = other DNA
atcataatggaaagtatgtt

SEQ ID NO: 83910 - DNA, 20 bp, synthetic construct
  misc_feature 1..20: note = CRISPR gRNA sequence
  source 1..20: mol_type = other DNA
tgtcccatttgccatagtcc

SEQ ID NO: 83911 - DNA, 20 bp, synthetic construct
  misc_feature 1..20: note = CRISPR gRNA sequence
  source 1..20: mol_type = other DNA
tcccatttgccatagtcctc

SEQ ID NO: 83912 - DNA, 20 bp, synthetic construct
  misc_feature 1..20: note = CRISPR gRNA sequence
  source 1..20: mol_type = other DNA
gccatagtcctcacctatcc

SEQ ID NO: 83913 - DNA, 20 bp, synthetic construct
  misc_feature 1..20: note = CRISPR gRNA sequence
  source 1..20: mol_type = other DNA
ccatagtcctcacctatccc

SEQ ID NO: 83914 - DNA, 20 bp, synthetic construct
  misc_feature 1..20: note = CRISPR gRNA sequence
  source 1..20: mol_type = other DNA
acctatccctgttgtatttt

SEQ ID NO: 83915 - DNA, 20 bp, synthetic construct
  misc_feature 1..20: note = CRISPR gRNA sequence
  source 1..20: mol_type = other DNA
tccctgttgtattttatcgg

SEQ ID NO: 83916 - DNA, 20 bp, synthetic construct
  misc_feature 1..20: note = CRISPR gRNA sequence
  source 1..20: mol_type = other DNA
ttgtattttatcgggtccaa

SEQ ID NO: 83917 - DNA, 20 bp, synthetic construct
  misc_feature 1..20: note = CRISPR gRNA sequence
  source 1..20: mol_type = other DNA
tattttatcgggtccaactc

SEQ ID NO: 83918 - DNA, 20 bp, synthetic construct
  misc_feature 1..20: note = CRISPR gRNA sequence
  source 1..20: mol_type = other DNA
tatcgggtccaactcaacca

SEQ ID NO: 83919 - DNA, 20 bp, synthetic construct
  misc_feature 1..20: note = CRISPR gRNA sequence
  source 1..20: mol_type = other DNA
atcgggtccaactcaaccat

SEQ ID NO: 83920 - DNA, 20 bp, synthetic construct
  misc_feature 1..20: note = CRISPR gRNA sequence
  source 1..20: mol_type = other DNA
tcgggtccaactcaaccatt

SEQ ID NO: 83921 - DNA, 20 bp, synthetic construct
  misc_feature 1..20: note = CRISPR gRNA sequence
  source 1..20: mol_type = other DNA
aaccatttaaggtatttgcc

SEQ ID NO: 83922 - DNA, 20 bp, synthetic construct
  misc_feature 1..20: note = CRISPR gRNA sequence
  source 1..20: mol_type = other DNA
aaggtatttgccagctcttg

SEQ ID NO: 83923 - DNA, 20 bp, synthetic construct
  misc_feature 1..20: note = CRISPR gRNA sequence
  source 1..20: mol_type = other DNA
aggtatttgccagctcttgt

SEQ ID NO: 83924 - DNA, 20 bp, synthetic construct
  misc_feature 1..20: note = CRISPR gRNA sequence
  source 1..20: mol_type = other DNA
gccagctcttgtatgcattt

SEQ ID NO: 83925 - DNA, 20 bp, synthetic construct
  misc_feature 1..20: note = CRISPR gRNA sequence
  source 1..20: mol_type = other DNA
ccagctcttgtatgcattta

SEQ ID NO: 83926 - DNA, 20 bp, synthetic construct
  misc_feature 1..20: note = CRISPR gRNA sequence
  source 1..20: mol_type = other DNA
ttgtatgcatttaggttttg

SEQ ID NO: 83927 - DNA, 20 bp, synthetic construct
  misc_feature 1..20: note = CRISPR gRNA sequence
  source 1..20: mol_type = other DNA
gtatgcatttaggttttgtt

SEQ ID NO: 83928 - DNA, 20 bp, synthetic construct
  misc_feature 1..20: note = CRISPR gRNA sequence
  source 1..20: mol_type = other DNA
tatgcatttaggttttgttt

SEQ ID NO: 83929 - DNA, 20 bp, synthetic construct
  misc_feature 1..20: note = CRISPR gRNA sequence
  source 1..20: mol_type = other DNA
aggttttgtttctttgtttt

SEQ ID NO: 83930 - DNA, 20 bp, synthetic construct
  misc_feature 1..20: note = CRISPR gRNA sequence
  source 1..20: mol_type = other DNA
ggttttgtttctttgttttt

SEQ ID NO: 83931 - DNA, 20 bp, synthetic construct
  misc_feature 1..20: note = CRISPR gRNA sequence
  source 1..20: mol_type = other DNA
tgtttctttgttttttagct

SEQ ID NO: 83932 - DNA, 20 bp, synthetic construct
  misc_feature 1..20: note = CRISPR gRNA sequence
  source 1..20: mol_type = other DNA
gtttctttgttttttagctc

SEQ ID NO: 83933 - DNA, 20 bp, synthetic construct
  misc_feature 1..20: note = CRISPR gRNA sequence
  source 1..20: mol_type = other DNA
tttctttgttttttagctca

SEQ ID NO: 83934 - DNA, 20 bp, synthetic construct
  misc_feature 1..20: note = CRISPR gRNA sequence
  source 1..20: mol_type = other DNA
ctttgttttttagctcatga

SEQ ID NO: 83935 - DNA, 20 bp, synthetic construct
  misc_feature 1..20: note = CRISPR gRNA sequence
  source 1..20: mol_type = other DNA
tttgttttttagctcatgaa

SEQ ID NO: 83936 - DNA, 20 bp, synthetic construct
  misc_feature 1..20: note = CRISPR gRNA sequence
  source 1..20: mol_type = other DNA
tgttttttagctcatgaaat

SEQ ID NO: 83937 - DNA, 20 bp, synthetic construct
  misc_feature 1..20: note = CRISPR gRNA sequence
  source 1..20: mol_type = other DNA
gttttttagctcatgaaatt

SEQ ID NO: 83938 - DNA, 20 bp, synthetic construct
  misc_feature 1..20: note = CRISPR gRNA sequence
  source 1..20: mol_type = other DNA
ttttttagctcatgaaatta

SEQ ID NO: 83939 - DNA, 20 bp, synthetic construct
  misc_feature 1..20: note = CRISPR gRNA sequence
  source 1..20: mol_type = other DNA
tttagctcatgaaattaggt

SEQ ID NO: 83940 - DNA, 20 bp, synthetic construct
  misc_feature 1..20: note = CRISPR gRNA sequence
  source 1..20: mol_type = other DNA
ttagctcatgaaattaggta

SEQ ID NO: 83941 - DNA, 20 bp, synthetic construct
  misc_feature 1..20: note = CRISPR gRNA sequence
  source 1..20: mol_type = other DNA
tagctcatgaaattaggtac

SEQ ID NO: 83942 - DNA, 20 bp, synthetic construct
  misc_feature 1..20: note = CRISPR gRNA sequence
  source 1..20: mol_type = other DNA
agctcatgaaattaggtaca

SEQ ID NO: 83943 - DNA, 20 bp, synthetic construct
  misc_feature 1..20: note = CRISPR gRNA sequence
  source 1..20: mol_type = other DNA
gctcatgaaattaggtacaa

SEQ ID NO: 83944 - DNA, 20 bp, synthetic construct
  misc_feature 1..20: note = CRISPR gRNA sequence
  source 1..20: mol_type = other DNA
atgaaattaggtacaaagtc

SEQ ID NO: 83945 - DNA, 20 bp, synthetic construct
  misc_feature 1..20: note = CRISPR gRNA sequence
  source 1..20: mol_type = other DNA
ggtacaaagtcagagagggg

SEQ ID NO: 83946 - DNA, 20 bp, synthetic construct
  misc_feature 1..20: note = CRISPR gRNA sequence
  source 1..20: mol_type = other DNA
gcatataaaacctcagcaga

SEQ ID NO: 83947 - DNA, 20 bp, synthetic construct
  misc_feature 1..20: note = CRISPR gRNA sequence
  source 1..20: mol_type = other DNA
agcagaaataaagaggtttt

SEQ ID NO: 83948 - DNA, 20 bp, synthetic construct
  misc_feature 1..20: note = CRISPR gRNA sequence
  source 1..20: mol_type = other DNA
tgttgtttggtaagaacata

SEQ ID NO: 83949 - DNA, 20 bp, synthetic construct
  misc_feature 1..20: note = CRISPR gRNA sequence
  source 1..20: mol_type = other DNA
gttgtttggtaagaacatac

SEQ ID NO: 83950 - DNA, 20 bp, synthetic construct
  misc_feature 1..20: note = CRISPR gRNA sequence
  source 1..20: mol_type = other DNA
ttgtttggtaagaacatacc

SEQ ID NO: 83951 - DNA, 20 bp, synthetic construct
  misc_feature 1..20: note = CRISPR gRNA sequence
  source 1..20: mol_type = other DNA
tttggtaagaacataccttg

SEQ ID NO: 83952 - DNA, 20 bp, synthetic construct
  misc_feature 1..20: note = CRISPR gRNA sequence
  source 1..20: mol_type = other DNA
ggtaagaacataccttgggt

SEQ ID NO: 83953 - DNA, 20 bp, synthetic construct
  misc_feature 1..20: note = CRISPR gRNA sequence
  source 1..20: mol_type = other DNA
gtaagaacataccttgggtt

SEQ ID NO: 83954 - DNA, 20 bp, synthetic construct
  misc_feature 1..20: note = CRISPR gRNA sequence
  source 1..20: mol_type = other DNA
gggttggttgggcacggtgg

SEQ ID NO: 83955 - DNA, 20 bp, synthetic construct
  misc_feature 1..20: note = CRISPR gRNA sequence
  source 1..20: mol_type = other DNA
ggttggttgggcacggtggc

SEQ ID NO: 83956 - DNA, 20 bp, synthetic construct
  misc_feature 1..20: note = CRISPR gRNA sequence
  source 1..20: mol_type = other DNA
gttgggcacggtggctcgtg

SEQ ID NO: 83957 - DNA, 20 bp, synthetic construct
  misc_feature 1..20: note = CRISPR gRNA sequence
  source 1..20: mol_type = other DNA
ggcacggtggctcgtgcctg

SEQ ID NO: 83958 - DNA, 20 bp, synthetic construct
  misc_feature 1..20: note = CRISPR gRNA sequence
  source 1..20: mol_type = other DNA
gtgcctgtaatcccaacact

SEQ ID NO: 83959 - DNA, 20 bp, synthetic construct
  misc_feature 1..20: note = CRISPR gRNA sequence
  source 1..20: mol_type = other DNA
taatcccaacactttgggag

SEQ ID NO: 83960 - DNA, 20 bp, synthetic construct
  misc_feature 1..20: note = CRISPR gRNA sequence
  source 1..20: mol_type = other DNA
tgggaggccaaggcaggctg

SEQ ID NO: 83961 - DNA, 20 bp, synthetic construct
  misc_feature 1..20: note = CRISPR gRNA sequence
  source 1..20: mol_type = other DNA
gggaggccaaggcaggctga

SEQ ID NO: 83962 - DNA, 20 bp, synthetic construct
  misc_feature 1..20: note = CRISPR gRNA sequence
  source 1..20: mol_type = other DNA
ggaggccaaggcaggctgat

SEQ ID NO: 83963 - DNA, 20 bp, synthetic construct
  misc_feature 1..20: note = CRISPR gRNA sequence
  source 1..20: mol_type = other DNA
atcacttgaagttgggagtt

SEQ ID NO: 83964 - DNA, 20 bp, synthetic construct
  misc_feature 1..20: note = CRISPR gRNA sequence
  source 1..20: mol_type = other DNA
gaagttgggagttcaagacc

SEQ ID NO: 83965 - DNA, 20 bp, synthetic construct
  misc_feature 1..20: note = CRISPR gRNA sequence
  source 1..20: mol_type = other DNA
aagttgggagttcaagacca

SEQ ID NO: 83966 - DNA, 20 bp, synthetic construct
  misc_feature 1..20: note = CRISPR gRNA sequence
  source 1..20: mol_type = other DNA
ggagttcaagaccagcctgg

SEQ ID NO: 83967 - DNA, 20 bp, synthetic construct
  misc_feature 1..20: note = CRISPR gRNA sequence
  source 1..20: mol_type = other DNA
aagaccagcctggccaacat

SEQ ID NO: 83968 - DNA, 20 bp, synthetic construct
  misc_feature 1..20: note = CRISPR gRNA sequence
  source 1..20: mol_type = other DNA
gccaacatggtgaaatcccg

SEQ ID NO: 83969 - DNA, 20 bp, synthetic construct
  misc_feature 1..20: note = CRISPR gRNA sequence
  source 1..20: mol_type = other DNA
tactgaaaatacaaaaatta

SEQ ID NO: 83970 - DNA, 20 bp, synthetic construct
  misc_feature 1..20: note = CRISPR gRNA sequence
  source 1..20: mol_type = other DNA
ctgaaaatacaaaaattaac

SEQ ID NO: 83971 - DNA, 20 bp, synthetic construct
  misc_feature 1..20: note = CRISPR gRNA sequence
  source 1..20: mol_type = other DNA
aaaatacaaaaattaaccag

SEQ ID NO: 83972 - DNA, 20 bp, synthetic construct
  misc_feature 1..20: note = CRISPR gRNA sequence
  source 1..20: mol_type = other DNA
accaggcatggtggtgtgtg

SEQ ID NO: 83973 - DNA, 20 bp, synthetic construct
  misc_feature 1..20: note = CRISPR gRNA sequence
  source 1..20: mol_type = other DNA
tagtcccaggaatcacttga

SEQ ID NO: 83974 - DNA, 20 bp, synthetic construct
  misc_feature 1..20: note = CRISPR gRNA sequence
  source 1..20: mol_type = other DNA
gaacccaggaggcggaggtt

SEQ ID NO: 83975 - DNA, 20 bp, synthetic construct
  misc_feature 1..20: note = CRISPR gRNA sequence
  source 1..20: mol_type = other DNA
aacccaggaggcggaggttg

SEQ ID NO: 83976 - DNA, 20 bp, synthetic construct
  misc_feature 1..20: note = CRISPR gRNA sequence
  source 1..20: mol_type = other DNA
cagtgagctgagatctcacc

SEQ ID NO: 83977 - DNA, 20 bp, synthetic construct
  misc_feature 1..20: note = CRISPR gRNA sequence
  source 1..20: mol_type = other DNA
agatctcaccactgcacact

SEQ ID NO: 83978 - DNA, 20 bp, synthetic construct
  misc_feature 1..20: note = CRISPR gRNA sequence
  source 1..20: mol_type = other DNA
accactgcacactgcactcc

SEQ ID NO: 83979 - DNA, 20 bp, synthetic construct
  misc_feature 1..20: note = CRISPR gRNA sequence
  source 1..20: mol_type = other DNA
cacactgcactccagcctgg

SEQ ID NO: 83980 - DNA, 20 bp, synthetic construct
  misc_feature 1..20: note = CRISPR gRNA sequence
  source 1..20: mol_type = other DNA
cactccagcctgggcaatgg

SEQ ID NO: 83981 - DNA, 20 bp, synthetic construct
  misc_feature 1..20: note = CRISPR gRNA sequence
  source 1..20: mol_type = other DNA
cagcctgggcaatggaatga

SEQ ID NO: 83982 - DNA, 20 bp, synthetic construct
  misc_feature 1..20: note = CRISPR gRNA sequence
  source 1..20: mol_type = other DNA
ggcaatggaatgagattcca

SEQ ID NO: 83983 - DNA, 20 bp, synthetic construct
  misc_feature 1..20: note = CRISPR gRNA sequence
  source 1..20: mol_type = other DNA
catcccaaaaaataaaaaaa

SEQ ID NO: 83984 - DNA, 20 bp, synthetic construct
  misc_feature 1..20: note = CRISPR gRNA sequence
  source 1..20: mol_type = other DNA
gggttgatccacttaggaac

SEQ ID NO: 83985 - DNA, 20 bp, synthetic construct
  misc_feature 1..20: note = CRISPR gRNA sequence
  source 1..20: mol_type = other DNA
ggttgatccacttaggaacc

SEQ ID NO: 83986 - DNA, 20 bp, synthetic construct
  misc_feature 1..20: note = CRISPR gRNA sequence
  source 1..20: mol_type = other DNA
atccacttaggaacctcaga

SEQ ID NO: 83987 - DNA, 20 bp, synthetic construct
  misc_feature 1..20: note = CRISPR gRNA sequence
  source 1..20: mol_type = other DNA
aggaacctcagataataaca

SEQ ID NO: 83988 - DNA, 20 bp, synthetic construct
  misc_feature 1..20: note = CRISPR gRNA sequence
  source 1..20: mol_type = other DNA
ggaacctcagataataacat

SEQ ID NO: 83989 - DNA, 20 bp, synthetic construct
  misc_feature 1..20: note = CRISPR gRNA sequence
  source 1..20: mol_type = other DNA
agataataacatctgccacg

SEQ ID NO: 83990 - DNA, 20 bp, synthetic construct
  misc_feature 1..20: note = CRISPR gRNA sequence
  source 1..20: mol_type = other DNA
ccacgtatagagcaattgct

SEQ ID NO: 83991 - DNA, 20 bp, synthetic construct
  misc_feature 1..20: note = CRISPR gRNA sequence
  source 1..20: mol_type = other DNA
ctatgtcccaggcactctac

SEQ ID NO: 83992 - DNA, 20 bp, synthetic construct
  misc_feature 1..20: note = CRISPR gRNA sequence
  source 1..20: mol_type = other DNA
tgtcccaggcactctactag

SEQ ID NO: 83993 - DNA, 20 bp, synthetic construct
  misc_feature 1..20: note = CRISPR gRNA sequence
  source 1..20: mol_type = other DNA
tactagacacttcatacagt

SEQ ID NO: 83994 - DNA, 20 bp, synthetic construct
  misc_feature 1..20: note = CRISPR gRNA sequence
  source 1..20: mol_type = other DNA
ctagacacttcatacagttt

SEQ ID NO: 83995 - DNA, 20 bp, synthetic construct
  misc_feature 1..20: note = CRISPR gRNA sequence
  source 1..20: mol_type = other DNA
gacacttcatacagtttaga

SEQ ID NO: 83996 - DNA, 20 bp, synthetic construct
  misc_feature 1..20: note = CRISPR gRNA sequence
  source 1..20: mol_type = other DNA
catacagtttagaaaatcag

SEQ ID NO: 83997 - DNA, 20 bp, synthetic construct
  misc_feature 1..20: note = CRISPR gRNA sequence
  source 1..20: mol_type = other DNA
atacagtttagaaaatcaga

SEQ ID NO: 83998 - DNA, 20 bp, synthetic construct
  misc_feature 1..20: note = CRISPR gRNA sequence
  source 1..20: mol_type = other DNA
agaaaatcagatgggtgtag

SEQ ID NO: 83999 - DNA, 20 bp, synthetic construct
  misc_feature 1..20: note = CRISPR gRNA sequence
  source 1..20: mol_type = other DNA
gaaaatcagatgggtgtaga

SEQ ID NO: 84000 - DNA, 20 bp, synthetic construct
  misc_feature 1..20: note = CRISPR gRNA sequence
  source 1..20: mol_type = other DNA
gatgggggctattatgaact

SEQ ID NO: 84001 - DNA, 20 bp, synthetic construct
  misc_feature 1..20: note = CRISPR gRNA sequence
  source 1..20: mol_type = other DNA
atgggggctattatgaactg

SEQ ID NO: 84002 - DNA, 20 bp, synthetic construct
  misc_feature 1..20: note = CRISPR gRNA sequence
  source 1..20: mol_type = other DNA
ttatgaactgagaaatgaac

SEQ ID NO: 84003 - DNA, 20 bp, synthetic construct
  misc_feature 1..20: note = CRISPR gRNA sequence
  source 1..20: mol_type = other DNA
tgaactgagaaatgaacttt

SEQ ID NO: 84004 - DNA, 20 bp, synthetic construct
  misc_feature 1..20: note = CRISPR gRNA sequence
  source 1..20: mol_type = other DNA
agaaatgaactttgaaaagt

SEQ ID NO: 84005 - DNA, 20 bp, synthetic construct
  misc_feature 1..20: note = CRISPR gRNA sequence
  source 1..20: mol_type = other DNA
tgaaaagtatcttggggcca

SEQ ID NO: 84006 - DNA, 20 bp, synthetic construct
  misc_feature 1..20: note = CRISPR gRNA sequence
  source 1..20: mol_type = other DNA
gaaaagtatcttggggccaa

SEQ ID NO: 84007 - DNA, 20 bp, synthetic construct
  misc_feature 1..20: note = CRISPR gRNA sequence
  source 1..20: mol_type = other DNA
aaaagtatcttggggccaaa

SEQ ID NO: 84008 - DNA, 20 bp, synthetic construct
  misc_feature 1..20: note = CRISPR gRNA sequence
  source 1..20: mol_type = other DNA
ggggccaaatcatgtagact

SEQ ID NO: 84009 - DNA, 20 bp, synthetic construct
  misc_feature 1..20: note = CRISPR gRNA sequence
  source 1..20: mol_type = other DNA
gggccaaatcatgtagactc

SEQ ID NO: 84010 - DNA, 20 bp, synthetic construct
  misc_feature 1..20: note = CRISPR gRNA sequence
  source 1..20: mol_type = other DNA
ttgagtgatgtgttaaggaa

SEQ ID NO: 84011 - DNA, 20 bp, synthetic construct
  misc_feature 1..20: note = CRISPR gRNA sequence
  source 1..20: mol_type = other DNA
gagtgatgtgttaaggaatg

SEQ ID NO: 84012 - DNA, 20 bp, synthetic construct
  misc_feature 1..20: note = CRISPR gRNA sequence
  source 1..20: mol_type = other DNA
agtgatgtgttaaggaatgc

SEQ ID NO: 84013 - DNA, 20 bp, synthetic construct
  misc_feature 1..20: note = CRISPR gRNA sequence
  source 1..20: mol_type = other DNA
aggaatgctatgagtgctga

SEQ ID NO: 84014 - DNA, 20 bp, synthetic construct
  misc_feature 1..20: note = CRISPR gRNA sequence
  source 1..20: mol_type = other DNA
tgagtgctgagagggcatca

SEQ ID NO: 84015 - DNA, 20 bp, synthetic construct
  misc_feature 1..20: note = CRISPR gRNA sequence
  source 1..20: mol_type = other DNA
agagggcatcagaagtcctt

SEQ ID NO: 84016 - DNA, 20 bp, synthetic construct
  misc_feature 1..20: note = CRISPR gRNA sequence
  source 1..20: mol_type = other DNA
gagagcctccagagaaaggc

SEQ ID NO: 84017 - DNA, 20 bp, synthetic construct
  misc_feature 1..20: note = CRISPR gRNA sequence
  source 1..20: mol_type = other DNA
agagcctccagagaaaggct

SEQ ID NO: 84018 - DNA, 20 bp, synthetic construct
  misc_feature 1..20: note = CRISPR gRNA sequence
  source 1..20: mol_type = other DNA
cagagaaaggctcttaaaaa

SEQ ID NO: 84019 - DNA, 20 bp, synthetic construct
  misc_feature 1..20: note = CRISPR gRNA sequence
  source 1..20: mol_type = other DNA
ttaaaaatgcagcgcaatct

SEQ ID NO: 84020 - DNA, 20 bp, synthetic construct
  misc_feature 1..20: note = CRISPR gRNA sequence
  source 1..20: mol_type = other DNA
aaaaatgcagcgcaatctcc

SEQ ID NO: 84021 - DNA, 20 bp, synthetic construct
  misc_feature 1..20: note = CRISPR gRNA sequence
  source 1..20: mol_type = other DNA
aaaatgcagcgcaatctcca

SEQ ID NO: 84022 - DNA, 20 bp, synthetic construct
  misc_feature 1..20: note = CRISPR gRNA sequence
  source 1..20: mol_type = other DNA
cagtgacagaagatactgct

SEQ ID NO: 84023 - DNA, 20 bp, synthetic construct
  misc_feature 1..20: note = CRISPR gRNA sequence
  source 1..20: mol_type = other DNA
ctagaaatctgctagaaaaa

SEQ ID NO: 84024 - DNA, 20 bp, synthetic construct
  misc_feature 1..20: note = CRISPR gRNA sequence
  source 1..20: mol_type = other DNA
gaaatctgctagaaaaaaaa

SEQ ID NO: 84025 - DNA, 20 bp, synthetic construct
  misc_feature 1..20: note = CRISPR gRNA sequence
  source 1..20: mol_type = other DNA
ctagaaaaaaaacaaaaaag

SEQ ID NO: 84026 - DNA, 20 bp, synthetic construct
  misc_feature 1..20: note = CRISPR gRNA sequence
  source 1..20: mol_type = other DNA
gaaaaaaaacaaaaaaggca

SEQ ID NO: 84027 - DNA, 20 bp, synthetic construct
  misc_feature 1..20: note = CRISPR gRNA sequence
  source 1..20: mol_type = other DNA
tgagggaaagataccaagtc

SEQ ID NO: 84028 - DNA, 20 bp, synthetic construct
  misc_feature 1..20: note = CRISPR gRNA sequence
  source 1..20: mol_type = other DNA
attcttcaaaatggaggtgg

SEQ ID NO: 84029 - DNA, 20 bp, synthetic construct
  misc_feature 1..20: note = CRISPR gRNA sequence
  source 1..20: mol_type = other DNA
ttcttcaaaatggaggtggc

SEQ ID NO: 84030 - DNA, 20 bp, synthetic construct
  misc_feature 1..20: note = CRISPR gRNA sequence
  source 1..20: mol_type = other DNA
ttcaaaatggaggtggcttg

SEQ ID NO: 84031 - DNA, 20 bp, synthetic construct
  misc_feature 1..20: note = CRISPR gRNA sequence
  source 1..20: mol_type = other DNA
caaaatggaggtggcttgtt

SEQ ID NO: 84032 - DNA, 20 bp, synthetic construct
  misc_feature 1..20: note = CRISPR gRNA sequence
  source 1..20: mol_type = other DNA
aaaatggaggtggcttgttg

SEQ ID NO: 84033 - DNA, 20 bp, synthetic construct
  misc_feature 1..20: note = CRISPR gRNA sequence
  source 1..20: mol_type = other DNA
gttgggaaggtggaagctca

SEQ ID NO: 84034 - DNA, 20 bp, synthetic construct
  misc_feature 1..20: note = CRISPR gRNA sequence
  source 1..20: mol_type = other DNA
ttgggaaggtggaagctcat

SEQ ID NO: 84035 - DNA, 20 bp, synthetic construct
  misc_feature 1..20: note = CRISPR gRNA sequence
  source 1..20: mol_type = other DNA
ggaaggtggaagctcatttg

SEQ ID NO: 84036 - DNA, 20 bp, synthetic construct
  misc_feature 1..20: note = CRISPR gRNA sequence
  source 1..20: mol_type = other DNA
atttggccagagtggaaatg

SEQ ID NO: 84037 - DNA, 20 bp, synthetic construct
  misc_feature 1..20: note = CRISPR gRNA sequence
  source 1..20: mol_type = other DNA
ggccagagtggaaatggaat

SEQ ID NO: 84038 - DNA, 20 bp, synthetic construct
  misc_feature 1..20: note = CRISPR gRNA sequence
  source 1..20: mol_type = other DNA
gccagagtggaaatggaatt

SEQ ID NO: 84039 - DNA, 20 bp, synthetic construct
  misc_feature 1..20: note = CRISPR gRNA sequence
  source 1..20: mol_type = other DNA
ggagaaatcgatgaccaaat

SEQ ID NO: 84040 - DNA, 20 bp, synthetic construct
  misc_feature 1..20: note = CRISPR gRNA sequence
  source 1..20: mol_type = other DNA
ggtgcctgatatagcttgac

SEQ ID NO: 84041 - DNA, 20 bp, synthetic construct
  misc_feature 1..20: note = CRISPR gRNA sequence
  source 1..20: mol_type = other DNA
gtgcctgatatagcttgaca

SEQ ID NO: 84042 - DNA, 20 bp, synthetic construct
  misc_feature 1..20: note = CRISPR gRNA sequence
  source 1..20: mol_type = other DNA
atatagcttgacaccaagtt

SEQ ID NO: 84043 - DNA, 20 bp, synthetic construct
  misc_feature 1..20: note = CRISPR gRNA sequence
  source 1..20: mol_type = other DNA
gacaccaagttagccccaag

SEQ ID NO: 84044 - DNA, 20 bp, synthetic construct
  misc_feature 1..20: note = CRISPR gRNA sequence
  source 1..20: mol_type = other DNA
acaccaagttagccccaagt

SEQ ID NO: 84045 - DNA, 20 bp, synthetic construct
  misc_feature 1..20: note = CRISPR gRNA sequence
  source 1..20: mol_type = other DNA
gccccaagtgaaataccctg

SEQ ID NO: 84046 - DNA, 20 bp, synthetic construct
  misc_feature 1..20: note = CRISPR gRNA sequence
  source 1..20: mol_type = other DNA
gcaatattaatgtgtctttt

SEQ ID NO: 84047 - DNA, 20 bp, synthetic construct
  misc_feature 1..20: note = CRISPR gRNA sequence
  source 1..20: mol_type = other DNA
atgtgtcttttcccgatatt

SEQ ID NO: 84048 - DNA, 20 bp, synthetic construct
  misc_feature 1..20: note = CRISPR gRNA sequence
  source 1..20: mol_type = other DNA
ttcccgatattcctcaggta

SEQ ID NO: 84049 - DNA, 20 bp, synthetic construct
  misc_feature 1..20: note = CRISPR gRNA sequence
  source 1..20: mol_type = other DNA
tcccgatattcctcaggtac

SEQ ID NO: 84050 - DNA, 20 bp, synthetic construct
  misc_feature 1..20: note = CRISPR gRNA sequence
  source 1..20: mol_type = other DNA
cccgatattcctcaggtact

SEQ ID NO: 84051 - DNA, 20 bp, synthetic construct
  misc_feature 1..20: note = CRISPR gRNA sequence
  source 1..20: mol_type = other DNA
ccgatattcctcaggtactc

SEQ ID NO: 84052 - DNA, 20 bp, synthetic construct
  misc_feature 1..20: note = CRISPR gRNA sequence
  source 1..20: mol_type = other DNA
ctcaggtactccaaagattc

SEQ ID NO: 84053 - DNA, 20 bp, synthetic construct
  misc_feature 1..20: note = CRISPR gRNA sequence
  source 1..20: mol_type = other DNA
aggtactccaaagattcagg

SEQ ID NO: 84054 - DNA, 20 bp, synthetic construct
  misc_feature 1..20: note = CRISPR gRNA sequence
  source 1..20: mol_type = other DNA
caaagattcaggtttactca

SEQ ID NO: 84055 - DNA, 20 bp, synthetic construct
  misc_feature 1..20: note = CRISPR gRNA sequence
  source 1..20: mol_type = other DNA
aggtttactcacgtcatcca

SEQ ID NO: 84056 - DNA, 20 bp, synthetic construct
  misc_feature 1..20: note = CRISPR gRNA sequence
  source 1..20: mol_type = other DNA
actcacgtcatccagcagag

SEQ ID NO: 84057 - DNA, 20 bp, synthetic construct
  misc_feature 1..20: note = CRISPR gRNA sequence
  source 1..20: mol_type = other DNA
ctcacgtcatccagcagaga

SEQ ID NO: 84058 - DNA, 20 bp, synthetic construct
  misc_feature 1..20: note = CRISPR gRNA sequence
  source 1..20: mol_type = other DNA
acgtcatccagcagagaatg

SEQ ID NO: 84059 - DNA, 20 bp, synthetic construct
  misc_feature 1..20: note = CRISPR gRNA sequence
  source 1..20: mol_type = other DNA
cctgaattgctatgtgtctg

SEQ ID NO: 84060 - DNA, 20 bp, synthetic construct
  misc_feature 1..20: note = CRISPR gRNA sequence
  source 1..20: mol_type = other DNA
ctgaattgctatgtgtctgg

SEQ ID NO: 84061 - DNA, 20 bp, synthetic construct
  misc_feature 1..20: note = CRISPR gRNA sequence
  source 1..20: mol_type = other DNA
aattgctatgtgtctgggtt

SEQ ID NO: 84062 - DNA, 20 bp, synthetic construct
  misc_feature 1..20: note = CRISPR gRNA sequence
  source 1..20: mol_type = other DNA
ctatgtgtctgggtttcatc

SEQ ID NO: 84063 - DNA, 20 bp, synthetic construct
  misc_feature 1..20: note = CRISPR gRNA sequence
  source 1..20: mol_type = other DNA
tgtgtctgggtttcatccat

SEQ ID NO: 84064 - DNA, 20 bp, synthetic construct
  misc_feature 1..20: note = CRISPR gRNA sequence
  source 1..20: mol_type = other DNA
ggtttcatccatccgacatt

SEQ ID NO: 84065 - DNA, 20 bp, synthetic construct
  misc_feature 1..20: note = CRISPR gRNA sequence
  source 1..20: mol_type = other DNA
catccatccgacattgaagt

SEQ ID NO: 84066 - DNA, 20 bp, synthetic construct
  misc_feature 1..20: note = CRISPR gRNA sequence
  source 1..20: mol_type = other DNA
atccatccgacattgaagtt

SEQ ID NO: 84067 - DNA, 20 bp, synthetic construct
  misc_feature 1..20: note = CRISPR gRNA sequence
  source 1..20: mol_type = other DNA
aagttgacttactgaagaat

SEQ ID NO: 84068 - DNA, 20 bp, synthetic construct
  misc_feature 1..20: note = CRISPR gRNA sequence
  source 1..20: mol_type = other DNA
acttactgaagaatggagag

SEQ ID NO: 84069 - DNA, 20 bp, synthetic construct
  misc_feature 1..20: note = CRISPR gRNA sequence
  source 1..20: mol_type = other DNA
actgaagaatggagagagaa

SEQ ID NO: 84070 - DNA, 20 bp, synthetic construct
  misc_feature 1..20: note = CRISPR gRNA sequence
  source 1..20: mol_type = other DNA
ctgaagaatggagagagaat

SEQ ID NO: 84071 - DNA, 20 bp, synthetic construct
  misc_feature 1..20: note = CRISPR gRNA sequence
  source 1..20: mol_type = other DNA
aagaatggagagagaattga

SEQ ID NO: 84072 - DNA, 20 bp, synthetic construct
  misc_feature 1..20: note = CRISPR gRNA sequence
  source 1..20: mol_type = other DNA
aaaaagtggagcattcagac

SEQ ID NO: 84073 - DNA, 20 bp, synthetic construct
  misc_feature 1..20: note = CRISPR gRNA sequence
  source 1..20: mol_type = other DNA
agacttgtctttcagcaagg

SEQ ID NO: 84074 - DNA, 20 bp, synthetic construct
  misc_feature 1..20: note = CRISPR gRNA sequence
  source 1..20: mol_type = other DNA
gtctttcagcaaggactggt

SEQ ID NO: 84075 - DNA, 20 bp, synthetic construct
  misc_feature 1..20: note = CRISPR gRNA sequence
  source 1..20: mol_type = other DNA
tctttcagcaaggactggtc

SEQ ID NO: 84076 - DNA, 20 bp, synthetic construct
  misc_feature 1..20: note = CRISPR gRNA sequence
  source 1..20: mol_type = other DNA
tcagcaaggactggtctttc

SEQ ID NO: 84077 - DNA, 20 bp, synthetic construct
  misc_feature 1..20: note = CRISPR gRNA sequence
  source 1..20: mol_type = other DNA
cagcaaggactggtctttct

SEQ ID NO: 84078 - DNA, 20 bp, synthetic construct
  misc_feature 1..20: note = CRISPR gRNA sequence
  source 1..20: mol_type = other DNA
agcaaggactggtctttcta

SEQ ID NO: 84079 - DNA, 20 bp, synthetic construct
  misc_feature 1..20: note = CRISPR gRNA sequence
  source 1..20: mol_type = other DNA
gtctttctatctcttgtact

SEQ ID NO: 84080 - DNA, 20 bp, synthetic construct
  misc_feature 1..20: note = CRISPR gRNA sequence
  source 1..20: mol_type = other DNA
tctatctcttgtactacact

SEQ ID NO: 84081 - DNA, 20 bp, synthetic construct
  misc_feature 1..20: note = CRISPR gRNA sequence
  source 1..20: mol_type = other DNA
ctatctcttgtactacactg

SEQ ID NO: 84082 - DNA, 20 bp, synthetic construct
  misc_feature 1..20: note = CRISPR gRNA sequence
  source 1..20: mol_type = other DNA
tatctcttgtactacactga

SEQ ID NO: 84083 - DNA, 20 bp, synthetic construct
  misc_feature 1..20: note = CRISPR gRNA sequence
  source 1..20: mol_type = other DNA
tctcttgtactacactgaat

SEQ ID NO: 84084 - DNA, 20 bp, synthetic construct
  misc_feature 1..20: note = CRISPR gRNA sequence
  source 1..20: mol_type = other DNA
ttgtactacactgaattcac

SEQ ID NO: 84085 - DNA, 20 bp, synthetic construct
  misc_feature 1..20: note = CRISPR gRNA sequence
  source 1..20: mol_type = other DNA
gtactacactgaattcaccc

SEQ ID NO: 84086 - DNA, 20 bp, synthetic construct
  misc_feature 1..20: note = CRISPR gRNA sequence
  source 1..20: mol_type = other DNA
tactacactgaattcacccc

SEQ ID NO: 84087 - DNA, 20 bp, synthetic construct
  misc_feature 1..20: note = CRISPR gRNA sequence
  source 1..20: mol_type = other DNA
cactgaattcacccccactg

SEQ ID NO: 84088 - DNA, 20 bp, synthetic construct
  misc_feature 1..20: note = CRISPR gRNA sequence
  source 1..20: mol_type = other DNA
aattcacccccactgaaaaa

SEQ ID NO: 84089 - DNA, 20 bp, synthetic construct
  misc_feature 1..20: note = CRISPR gRNA sequence
  source 1..20: mol_type = other DNA
acccccactgaaaaagatga

SEQ ID NO: 84090 - DNA, 20 bp, synthetic construct
  misc_feature 1..20: note = CRISPR gRNA sequence
  source 1..20: mol_type = other DNA
aaaaagatgagtatgcctgc

SEQ ID NO: 84091 - DNA, 20 bp, synthetic construct
  misc_feature 1..20: note = CRISPR gRNA sequence
  source 1..20: mol_type = other DNA
ccgtgtgaaccatgtgactt

SEQ ID NO: 84092 - DNA, 20 bp, synthetic construct
  misc_feature 1..20: note = CRISPR gRNA sequence
  source 1..20: mol_type = other DNA
tgtcacagcccaagatagtt

SEQ ID NO: 84093 - DNA, 20 bp, synthetic construct
  misc_feature 1..20: note = CRISPR gRNA sequence
  source 1..20: mol_type = other DNA
gtcacagcccaagatagtta

SEQ ID NO: 84094 - DNA, 20 bp, synthetic construct
  misc_feature 1..20: note = CRISPR gRNA sequence
  source 1..20: mol_type = other DNA
tcacagcccaagatagttaa

SEQ ID NO: 84095 - DNA, 20 bp, synthetic construct
  misc_feature 1..20: note = CRISPR gRNA sequence
  source 1..20: mol_type = other DNA
agtggggtaagtcttacatt

SEQ ID NO: 84096 - DNA, 20 bp, synthetic construct
  misc_feature 1..20: note = CRISPR gRNA sequence
  source 1..20: mol_type = other DNA
acattcttttgtaagctgct

SEQ ID NO: 84097 - DNA, 20 bp, synthetic construct
  misc_feature 1..20: note = CRISPR gRNA sequence
  source 1..20: mol_type = other DNA
cattcttttgtaagctgctg

SEQ ID NO: 84098 - DNA, 20 bp, synthetic construct
  misc_feature 1..20: note = CRISPR gRNA sequence
  source 1..20: mol_type = other DNA
ttttgtaagctgctgaaagt

SEQ ID NO: 84099 - DNA, 20 bp, synthetic construct
  misc_feature 1..20: note = CRISPR gRNA sequence
  source 1..20: mol_type = other DNA
ttgtaagctgctgaaagttg

SEQ ID NO: 84100 - DNA, 20 bp, synthetic construct
  misc_feature 1..20: note = CRISPR gRNA sequence
  source 1..20: mol_type = other DNA
tgtaagctgctgaaagttgt

SEQ ID NO: 84101 - DNA, 20 bp, synthetic construct
  misc_feature 1..20: note = CRISPR gRNA sequence
  source 1..20: mol_type = other DNA
gtaagctgctgaaagttgtg

SEQ ID NO: 84102 - DNA, 20 bp, synthetic construct
  misc_feature 1..20: note = CRISPR gRNA sequence
  source 1..20: mol_type = other DNA
taagctgctgaaagttgtgt

SEQ ID NO: 84103 - DNA, 20 bp, synthetic construct
  misc_feature 1..20: note = CRISPR gRNA sequence
  source 1..20: mol_type = other DNA
ctgaaagttgtgtatgagta

SEQ ID NO: 84104 - DNA, 20 bp, synthetic construct
  misc_feature 1..20: note = CRISPR gRNA sequence
  source 1..20: mol_type = other DNA
aaagttgtgtatgagtagtc

SEQ ID NO: 84105 - DNA, 20 bp, synthetic construct
  misc_feature 1..20: note = CRISPR gRNA sequence
  source 1..20: mol_type = other DNA
tgtatgagtagtcatatcat

SEQ ID NO: 84106 - DNA, 20 bp, synthetic construct
  misc_feature 1..20: note = CRISPR gRNA sequence
  source 1..20: mol_type = other DNA
ctttgatataaaaaaggtct

SEQ ID NO: 84107 - DNA, 20 bp, synthetic construct
  misc_feature 1..20: note = CRISPR gRNA sequence
  source 1..20: mol_type = other DNA
tgatataaaaaaggtctatg

SEQ ID NO: 84108 - DNA, 20 bp, synthetic construct
  misc_feature 1..20: note = CRISPR gRNA sequence
  source 1..20: mol_type = other DNA
gatataaaaaaggtctatgg

SEQ ID NO: 84109 - DNA, 20 bp, synthetic construct
  misc_feature 1..20: note = CRISPR gRNA sequence
  source 1..20: mol_type = other DNA
atataaaaaaggtctatggc

SEQ ID NO: 84110 - DNA, 20 bp, synthetic construct
  misc_feature 1..20: note = CRISPR gRNA sequence
  source 1..20: mol_type = other DNA
tggccatactaccctgaatg

SEQ ID NO: 84111 - DNA, 20 bp, synthetic construct
  misc_feature 1..20: note = CRISPR gRNA sequence
  source 1..20: mol_type = other DNA
ccctgaatgagtcccatccc

SEQ ID NO: 84112 - DNA, 20 bp, synthetic construct
  misc_feature 1..20: note = CRISPR gRNA sequence
  source 1..20: mol_type = other DNA
aatgagtcccatcccatctg

SEQ ID NO: 84113 - DNA, 20 bp, synthetic construct
  misc_feature 1..20: note = CRISPR gRNA sequence
  source 1..20: mol_type = other DNA
atataaacaatctgcatatt

SEQ ID NO: 84114 - DNA, 20 bp, synthetic construct
  misc_feature 1..20: note = CRISPR gRNA sequence
  source 1..20: mol_type = other DNA
catattgggattgtcaggga

SEQ ID NO: 84115 - DNA, 20 bp, synthetic construct
  misc_feature 1..20: note = CRISPR gRNA sequence
  source 1..20: mol_type = other DNA
ggattgtcagggaatgttct

SEQ ID NO: 84116 - DNA, 20 bp, synthetic construct
  misc_feature 1..20: note = CRISPR gRNA sequence
  source 1..20: mol_type = other DNA
tcagggaatgttcttaaaga

SEQ ID NO: 84117 - DNA, 20 bp, synthetic construct
  misc_feature 1..20: note = CRISPR gRNA sequence
  source 1..20: mol_type = other DNA
ttaaagatcagattagtggc

SEQ ID NO: 84118 - DNA, 20 bp, synthetic construct
  misc_feature 1..20: note = CRISPR gRNA sequence
  source 1..20: mol_type = other DNA
aaagatcagattagtggcac

SEQ ID NO: 84119 - DNA, 20 bp, synthetic construct
  misc_feature 1..20: note = CRISPR gRNA sequence
  source 1..20: mol_type = other DNA
aagatcagattagtggcacc

SEQ ID NO: 84120 - DNA, 20 bp, synthetic construct
  misc_feature 1..20: note = CRISPR gRNA sequence
  source 1..20: mol_type = other DNA
gtggcacctgctgagatact

SEQ ID NO: 84121 - DNA, 20 bp, synthetic construct
  misc_feature 1..20: note = CRISPR gRNA sequence
  source 1..20: mol_type = other DNA
ctgagatactgatgcacagc

SEQ ID NO: 84122 - DNA, 20 bp, synthetic construct
  misc_feature 1..20: note = CRISPR gRNA sequence
  source 1..20: mol_type = other DNA
agatactgatgcacagcatg

SEQ ID NO: 84123 - DNA, 20 bp, synthetic construct
  misc_feature 1..20: note = CRISPR gRNA sequence
  source 1..20: mol_type = other DNA
atgcacagcatggtttctga

SEQ ID NO: 84124 - DNA, 20 bp, synthetic construct
  misc_feature 1..20: note = CRISPR gRNA sequence
  source 1..20: mol_type = other DNA
ctgaaccagtagtttccctg

SEQ ID NO: 84125 - DNA, 20 bp, synthetic construct
  misc_feature 1..20: note = CRISPR gRNA sequence
  source 1..20: mol_type = other DNA
tgaaccagtagtttccctgc

SEQ ID NO: 84126 - DNA, 20 bp, synthetic construct
  misc_feature 1..20: note = CRISPR gRNA sequence
  source 1..20: mol_type = other DNA
aaccagtagtttccctgcag

SEQ ID NO: 84127 - DNA, 20 bp, synthetic construct
  misc_feature 1..20: note = CRISPR gRNA sequence
  source 1..20: mol_type = other DNA
ccctgcagttgagcagggag

SEQ ID NO: 84128 - DNA, 20 bp, synthetic construct
  misc_feature 1..20: note = CRISPR gRNA sequence
  source 1..20: mol_type = other DNA
cctgcagttgagcagggagc

SEQ ID NO: 84129 - DNA, 20 bp, synthetic construct
  misc_feature 1..20: note = CRISPR gRNA sequence
  source 1..20: mol_type = other DNA
cagttgagcagggagcagca

SEQ ID NO: 84130 - DNA, 20 bp, synthetic construct
  misc_feature 1..20: note = CRISPR gRNA sequence
  source 1..20: mol_type = other DNA
agcagggagcagcagcagca

SEQ ID NO: 84131 - DNA, 20 bp, synthetic construct
  misc_feature 1..20: note = CRISPR gRNA sequence
  source 1..20: mol_type = other DNA
gcacaaatacatatacactc

SEQ ID NO: 84132 - DNA, 20 bp, synthetic construct
  misc_feature 1..20: note = CRISPR gRNA sequence
  source 1..20: mol_type = other DNA
cacaaatacatatacactct

SEQ ID NO: 84133 - DNA, 20 bp, synthetic construct
  misc_feature 1..20: note = CRISPR gRNA sequence
  source 1..20: mol_type = other DNA
ttaacacttcttacctactg

SEQ ID NO: 84134 - DNA, 20 bp, synthetic construct
  misc_feature 1..20: note = CRISPR gRNA sequence
  source 1..20: mol_type = other DNA
aacacttcttacctactggc

SEQ ID NO: 84135 - DNA, 20 bp, synthetic construct
  misc_feature 1..20: note = CRISPR gRNA sequence
  source 1..20: mol_type = other DNA
acacttcttacctactggct

SEQ ID NO: 84136 - DNA, 20 bp, synthetic construct
  misc_feature 1..20: note = CRISPR gRNA sequence
  source 1..20: mol_type = other DNA
cttacctactggcttcctct

SEQ ID NO: 84137 - DNA, 20 bp, synthetic construct
  misc_feature 1..20: note = CRISPR gRNA sequence
  source 1..20: mol_type = other DNA
ttacctactggcttcctcta

SEQ ID NO: 84138 - DNA, 20 bp, synthetic construct
  misc_feature 1..20: note = CRISPR gRNA sequence
  source 1..20: mol_type = other DNA
acctactggcttcctctagc

SEQ ID NO: 84139 - DNA, 20 bp, synthetic construct
  misc_feature 1..20: note = CRISPR gRNA sequence
  source 1..20: mol_type = other DNA
cctactggcttcctctagct

SEQ ID NO: 84140 - DNA, 20 bp, synthetic construct
  misc_feature 1..20: note = CRISPR gRNA sequence
  source 1..20: mol_type = other DNA
ctggcttcctctagcttttg

SEQ ID NO: 84141 - DNA, 20 bp, synthetic construct
  misc_feature 1..20: note = CRISPR gRNA sequence
  source 1..20: mol_type = other DNA
gcttcctctagcttttgtgg

SEQ ID NO: 84142 - DNA, 20 bp, synthetic construct
  misc_feature 1..20: note = CRISPR gRNA sequence
  source 1..20: mol_type = other DNA
cctctagcttttgtggcagc

SEQ ID NO: 84143 - DNA, 20 bp, synthetic construct
  misc_feature 1..20: note = CRISPR gRNA sequence
  source 1..20: mol_type = other DNA
ctctagcttttgtggcagct

SEQ ID NO: 84144 - DNA, 20 bp, synthetic construct
  misc_feature 1..20: note = CRISPR gRNA sequence
  source 1..20: mol_type = other DNA
tagcttttgtggcagcttca

SEQ ID NO: 84145 - DNA, 20 bp, synthetic construct
  misc_feature 1..20: note = CRISPR gRNA sequence
  source 1..20: mol_type = other DNA
gcttttgtggcagcttcagg

SEQ ID NO: 84146 - DNA, 20 bp, synthetic construct
  misc_feature 1..20: note = CRISPR gRNA sequence
  source 1..20: mol_type = other DNA
ttgtggcagcttcaggtata

SEQ ID NO: 84147 - DNA, 20 bp, synthetic construct
  misc_feature 1..20: note = CRISPR gRNA sequence
  source 1..20: mol_type = other DNA
tgtggcagcttcaggtatat

SEQ ID NO: 84148 - DNA, 20 bp, synthetic construct
  misc_feature 1..20: note = CRISPR gRNA sequence
  source 1..20: mol_type = other DNA
gtggcagcttcaggtatatt

SEQ ID NO: 84149 - DNA, 20 bp, synthetic construct
  misc_feature 1..20: note = CRISPR gRNA sequence
  source 1..20: mol_type = other DNA
tggcagcttcaggtatattt

SEQ ID NO: 84150 - DNA, 20 bp, synthetic construct
  misc_feature 1..20: note = CRISPR gRNA sequence
  source 1..20: mol_type = other DNA
caggtatatttagcactgaa

SEQ ID NO: 84151 - DNA, 20 bp, synthetic construct
  misc_feature 1..20: note = CRISPR gRNA sequence
  source 1..20: mol_type = other DNA
aggtatatttagcactgaac

SEQ ID NO: 84152 - DNA, 20 bp, synthetic construct
  misc_feature 1..20: note = CRISPR gRNA sequence
  source 1..20: mol_type = other DNA
agcactgaacgaacatctca

SEQ ID NO: 84153 - DNA, 20 bp, synthetic construct
  misc_feature 1..20: note = CRISPR gRNA sequence
  source 1..20: mol_type = other DNA
gcactgaacgaacatctcaa

SEQ ID NO: 84154 - DNA, 20 bp, synthetic construct
  misc_feature 1..20: note = CRISPR gRNA sequence
  source 1..20: mol_type = other DNA
aacgaacatctcaagaaggt

SEQ ID NO: 84155 - DNA, 20 bp, synthetic construct
  misc_feature 1..20: note = CRISPR gRNA sequence
  source 1..20: mol_type = other DNA
aagaaggtataggcctttgt

SEQ ID NO: 84156 - DNA, 20 bp, synthetic construct
  misc_feature 1..20: note = CRISPR gRNA sequence
  source 1..20: mol_type = other DNA
tgtttgtaagtcctgctgtc

SEQ ID NO: 84157 - DNA, 20 bp, synthetic construct
  misc_feature 1..20: note = CRISPR gRNA sequence
  source 1..20: mol_type = other DNA
gtttgtaagtcctgctgtcc

SEQ ID NO: 84158 - DNA, 20 bp, synthetic construct
  misc_feature 1..20: note = CRISPR gRNA sequence
  source 1..20: mol_type = other DNA
tttgtaagtcctgctgtcct

SEQ ID NO: 84159 - DNA, 20 bp, synthetic construct
  misc_feature 1..20: note = CRISPR gRNA sequence
  source 1..20: mol_type = other DNA
gtaagtcctgctgtcctagc

SEQ ID NO: 84160 - DNA, 20 bp, synthetic construct
  misc_feature 1..20: note = CRISPR gRNA sequence
  source 1..20: mol_type = other DNA
taagtcctgctgtcctagca

SEQ ID NO: 84161 - DNA, 20 bp, synthetic construct
  misc_feature 1..20: note = CRISPR gRNA sequence
  source 1..20: mol_type = other DNA
ctgtcctagcatcctataat

SEQ ID NO: 84162 - DNA, 20 bp, synthetic construct
  misc_feature 1..20: note = CRISPR gRNA sequence
  source 1..20: mol_type = other DNA
tcctagcatcctataatcct

SEQ ID NO: 84163 - DNA, 20 bp, synthetic construct
  misc_feature 1..20: note = CRISPR gRNA sequence
  source 1..20: mol_type = other DNA
gcatcctataatcctggact

SEQ ID NO: 84164 - DNA, 20 bp, synthetic construct
  misc_feature 1..20: note = CRISPR gRNA sequence
  source 1..20: mol_type = other DNA
taatcctggacttctccagt

SEQ ID NO: 84165 - DNA, 20 bp, synthetic construct
  misc_feature 1..20: note = CRISPR gRNA sequence
  source 1..20: mol_type = other DNA
gacttctccagtactttctg

SEQ ID NO: 84166 - DNA, 20 bp, synthetic construct
  misc_feature 1..20: note = CRISPR gRNA sequence
  source 1..20: mol_type = other DNA
ctccagtactttctggctgg

SEQ ID NO: 84167 - DNA, 20 bp, synthetic construct
  misc_feature 1..20: note = CRISPR gRNA sequence
  source 1..20: mol_type = other DNA
tccagtactttctggctgga

SEQ ID NO: 84168 - DNA, 20 bp, synthetic construct
  misc_feature 1..20: note = CRISPR gRNA sequence
  source 1..20: mol_type = other DNA
cagtactttctggctggatt

SEQ ID NO: 84169 - DNA, 20 bp, synthetic construct
  misc_feature 1..20: note = CRISPR gRNA sequence
  source 1..20: mol_type = other DNA
tctggctggattggtatctg

SEQ ID NO: 84170 - DNA, 20 bp, synthetic construct
  misc_feature 1..20: note = CRISPR gRNA sequence
  source 1..20: mol_type = other DNA
ctggctggattggtatctga

SEQ ID NO: 84171 - DNA, 20 bp, synthetic construct
  misc_feature 1..20: note = CRISPR gRNA sequence
  source 1..20: mol_type = other DNA
tggctggattggtatctgag

SEQ ID NO: 84172 - DNA, 20 bp, synthetic construct
  misc_feature 1..20: note = CRISPR gRNA sequence
  source 1..20: mol_type = other DNA
gctggattggtatctgaggc

SEQ ID NO: 84173 - DNA, 20 bp, synthetic construct
  misc_feature 1..20: note = CRISPR gRNA sequence
  source 1..20: mol_type = other DNA
gattggtatctgaggctagt

SEQ ID NO: 84174 - DNA, 20 bp, synthetic construct
  misc_feature 1..20: note = CRISPR gRNA sequence
  source 1..20: mol_type = other DNA
gtatctgaggctagtaggaa

SEQ ID NO: 84175 - DNA, 20 bp, synthetic construct
  misc_feature 1..20: note = CRISPR gRNA sequence
  source 1..20: mol_type = other DNA
aggctagtaggaagggcttg

SEQ ID NO: 84176 - DNA, 20 bp, synthetic construct
  misc_feature 1..20: note = CRISPR gRNA sequence
  source 1..20: mol_type = other DNA
gtaggaagggcttgttcctg

SEQ ID NO: 84177 - DNA, 20 bp, synthetic construct
  misc_feature 1..20: note = CRISPR gRNA sequence
  source 1..20: mol_type = other DNA
gttcctgctgggtagctcta

SEQ ID NO: 84178 - DNA, 20 bp, synthetic construct
  misc_feature 1..20: note = CRISPR gRNA sequence
  source 1..20: mol_type = other DNA
ttcctgctgggtagctctaa

SEQ ID NO: 84179 - DNA, 20 bp, synthetic construct
  misc_feature 1..20: note = CRISPR gRNA sequence
  source 1..20: mol_type = other DNA
ctgctgggtagctctaaaca

SEQ ID NO: 84180 - DNA, 20 bp, synthetic construct
  misc_feature 1..20: note = CRISPR gRNA sequence
  source 1..20: mol_type = other DNA
ctgggtagctctaaacaatg

SEQ ID NO: 84181 - DNA, 20 bp, synthetic construct
  misc_feature 1..20: note = CRISPR gRNA sequence
  source 1..20: mol_type = other DNA
ggtagctctaaacaatgtat

SEQ ID NO: 84182 - DNA, 20 bp, synthetic construct
  misc_feature 1..20: note = CRISPR gRNA sequence
  source 1..20: mol_type = other DNA
taaacaatgtattcatgggt

SEQ ID NO: 84183 - DNA, 20 bp, synthetic construct
  misc_feature 1..20: note = CRISPR gRNA sequence
  source 1..20: mol_type = other DNA
aacaatgtattcatgggtag

SEQ ID NO: 84184 - DNA, 20 bp, synthetic construct
  misc_feature 1..20: note = CRISPR gRNA sequence
  source 1..20: mol_type = other DNA
atgggtaggaacagcagcct

SEQ ID NO: 84185 - DNA, 20 bp, synthetic construct
  misc_feature 1..20: note = CRISPR gRNA sequence
  source 1..20: mol_type = other DNA
ttctgccagccttatttcta

SEQ ID NO: 84186 - DNA, 20 bp, synthetic construct
  misc_feature 1..20: note = CRISPR gRNA sequence
  source 1..20: mol_type = other DNA
tgccagccttatttctaacc

SEQ ID NO: 84187 - DNA, 20 bp, synthetic construct
  misc_feature 1..20: note = CRISPR gRNA sequence
  source 1..20: mol_type = other DNA
ccagccttatttctaaccat

SEQ ID NO: 84188 - DNA, 20 bp, synthetic construct
  misc_feature 1..20: note = CRISPR gRNA sequence
  source 1..20: mol_type = other DNA
atttctaaccattttagaca

SEQ ID NO: 84189 - DNA, 20 bp, synthetic construct
  misc_feature 1..20: note = CRISPR gRNA sequence
  source 1..20: mol_type = other DNA
tttctaaccattttagacat

SEQ ID NO: 84190 - DNA, 20 bp, synthetic construct
  misc_feature 1..20: note = CRISPR gRNA sequence
  source 1..20: mol_type = other DNA
ctaaccattttagacatttg

SEQ ID NO: 84191 - DNA, 20 bp, synthetic construct
  misc_feature 1..20: note = CRISPR gRNA sequence
  source 1..20: mol_type = other DNA
taaccattttagacatttgt

SEQ ID NO: 84192 - DNA, 20 bp, synthetic construct
  misc_feature 1..20: note = CRISPR gRNA sequence
  source 1..20: mol_type = other DNA
accattttagacatttgtta

SEQ ID NO: 84193 - DNA, 20 bp, synthetic construct
  misc_feature 1..20: note = CRISPR gRNA sequence
  source 1..20: mol_type = other DNA
tagacatttgttagtacatg

SEQ ID NO: 84194 - DNA, 20 bp, synthetic construct
  misc_feature 1..20: note = CRISPR gRNA sequence
  source 1..20: mol_type = other DNA
agacatttgttagtacatgg

SEQ ID NO: 84195 - DNA, 20 bp, synthetic construct
  misc_feature 1..20: note = CRISPR gRNA sequence
  source 1..20: mol_type = other DNA
gacatttgttagtacatggt

SEQ ID NO: 84196 - DNA, 20 bp, synthetic construct
  misc_feature 1..20: note = CRISPR gRNA sequence
  source 1..20: mol_type = other DNA
gttagtacatggtattttaa

SEQ ID NO: 84197 - DNA, 20 bp, synthetic construct
  misc_feature 1..20: note = CRISPR gRNA sequence
  source 1..20: mol_type = other DNA
ttagtacatggtattttaaa

SEQ ID NO: 84198 - DNA, 20 bp, synthetic construct
  misc_feature 1..20: note = CRISPR gRNA sequence
  source 1..20: mol_type = other DNA
gtacatggtattttaaaagt

SEQ ID NO: 84199 - DNA, 20 bp, synthetic construct
  misc_feature 1..20: note = CRISPR gRNA sequence
  source 1..20: mol_type = other DNA
taaaagtaaaacttaatgtc

SEQ ID NO: 84200 - DNA, 20 bp, synthetic construct
  misc_feature 1..20: note = CRISPR gRNA sequence
  source 1..20: mol_type = other DNA
aaaagtaaaacttaatgtct

SEQ ID NO: 84201 - DNA, 20 bp, synthetic construct
  misc_feature 1..20: note = CRISPR gRNA sequence
  source 1..20: mol_type = other DNA
aaagtaaaacttaatgtctt

SEQ ID NO: 84202 - DNA, 20 bp, synthetic construct
  misc_feature 1..20: note = CRISPR gRNA sequence
  source 1..20: mol_type = other DNA
aatgtcttccttttttttct

SEQ ID NO: 84203 - DNA, 20 bp, synthetic construct
  misc_feature 1..20: note = CRISPR gRNA sequence
  source 1..20: mol_type = other DNA
atgtcttccttttttttctc

SEQ ID NO: 84204 - DNA, 20 bp, synthetic construct
  misc_feature 1..20: note = CRISPR gRNA sequence
  source 1..20: mol_type = other DNA
ccttttttttctccactgtc

SEQ ID NO: 84205 - DNA, 20 bp, synthetic construct
  misc_feature 1..20: note = CRISPR gRNA sequence
  source 1..20: mol_type = other DNA
cttttttttctccactgtct

SEQ ID NO: 84206 - DNA, 20 bp, synthetic construct
  misc_feature 1..20: note = CRISPR gRNA sequence
  source 1..20: mol_type = other DNA
ttttttctccactgtctttt

SEQ ID NO: 84207 - DNA, 20 bp, synthetic construct
  misc_feature 1..20: note = CRISPR gRNA sequence
  source 1..20: mol_type = other DNA
tttttctccactgtcttttt

SEQ ID NO: 84208 - DNA, 20 bp, synthetic construct
  misc_feature 1..20: note = CRISPR gRNA sequence
  source 1..20: mol_type = other DNA
ttttctccactgtctttttc

SEQ ID NO: 84209 - DNA, 20 bp, synthetic construct
  misc_feature 1..20: note = CRISPR gRNA sequence
  source 1..20: mol_type = other DNA
tttctccactgtctttttca

SEQ ID NO: 84210 - DNA, 20 bp, synthetic construct
  misc_feature 1..20: note = CRISPR gRNA sequence
  source 1..20: mol_type = other DNA
ttctccactgtctttttcat

SEQ ID NO: 84211 - DNA, 20 bp, synthetic construct
  misc_feature 1..20: note = CRISPR gRNA sequence
  source 1..20: mol_type = other DNA
tctccactgtctttttcata

SEQ ID NO: 84212 - DNA, 20 bp, synthetic construct
  misc_feature 1..20: note = CRISPR gRNA sequence
  source 1..20: mol_type = other DNA
ctccactgtctttttcatag

SEQ ID NO: 84213 - DNA, 20 bp, synthetic construct
  misc_feature 1..20: note = CRISPR gRNA sequence
  source 1..20: mol_type = other DNA
tccactgtctttttcataga

SEQ ID NO: 84214 - DNA, 20 bp, synthetic construct
  misc_feature 1..20: note = CRISPR gRNA sequence
  source 1..20: mol_type = other DNA
cactgtctttttcatagatc

SEQ ID NO: 84215 - DNA, 20 bp, synthetic construct
  misc_feature 1..20: note = CRISPR gRNA sequence
  source 1..20: mol_type = other DNA
tctttttcatagatcgagac

SEQ ID NO: 84216 - DNA, 20 bp, synthetic construct
  misc_feature 1..20: note = CRISPR gRNA sequence
  source 1..20: mol_type = other DNA
tttcatagatcgagacatgt

SEQ ID NO: 84217 - DNA, 20 bp, synthetic construct
  misc_feature 1..20: note = CRISPR gRNA sequence
  source 1..20: mol_type = other DNA
ttcatagatcgagacatgta

SEQ ID NO: 84218 - DNA, 20 bp, synthetic construct
  misc_feature 1..20: note = CRISPR gRNA sequence
  source 1..20: mol_type = other DNA
tcatagatcgagacatgtaa

SEQ ID NO: 84219 - DNA, 20 bp, synthetic construct
  misc_feature 1..20: note = CRISPR gRNA sequence
  source 1..20: mol_type = other DNA
catagatcgagacatgtaag

SEQ ID NO: 84220 - DNA, 20 bp, synthetic construct
  misc_feature 1..20: note = CRISPR gRNA sequence
  source 1..20: mol_type = other DNA
atagatcgagacatgtaagc

SEQ ID NO: 84221 - DNA, 20 bp, synthetic construct
  misc_feature 1..20: note = CRISPR gRNA sequence
  source 1..20: mol_type = other DNA
ttgaccttgagaaaatgttt

SEQ ID NO: 84222 - DNA, 20 bp, synthetic construct
  misc_feature 1..20: note = CRISPR gRNA sequence
  source 1..20: mol_type = other DNA
tgaccttgagaaaatgtttt

SEQ ID NO: 84223 - DNA, 20 bp, synthetic construct
  misc_feature 1..20: note = CRISPR gRNA sequence
  source 1..20: mol_type = other DNA
gaccttgagaaaatgttttt

SEQ ID NO: 84224 - DNA, 20 bp, synthetic construct
  misc_feature 1..20: note = CRISPR gRNA sequence
  source 1..20: mol_type = other DNA
accttgagaaaatgtttttg

SEQ ID NO: 84225 - DNA, 20 bp, synthetic construct
  misc_feature 1..20: note = CRISPR gRNA sequence
  source 1..20: mol_type = other DNA
gagaaaatgtttttgtttca

SEQ ID NO: 84226 - DNA, 20 bp, synthetic construct
  misc_feature 1..20: note = CRISPR gRNA sequence
  source 1..20: mol_type = other DNA
agaaaatgtttttgtttcac

SEQ ID NO: 84227 - DNA, 20 bp, synthetic construct
  misc_feature 1..20: note = CRISPR gRNA sequence
  source 1..20: mol_type = other DNA
ttgtttcactgtcctgagga

SEQ ID NO: 84228 - DNA, 20 bp, synthetic construct
  misc_feature 1..20: note = CRISPR gRNA sequence
  source 1..20: mol_type = other DNA
tgtttcactgtcctgaggac

SEQ ID NO: 84229 - DNA, 20 bp, synthetic construct
  misc_feature 1..20: note = CRISPR gRNA sequence
  source 1..20: mol_type = other DNA
gtttcactgtcctgaggact

SEQ ID NO: 84230 - DNA, 20 bp, synthetic construct
  misc_feature 1..20: note = CRISPR gRNA sequence
  source 1..20: mol_type = other DNA
tttcactgtcctgaggacta

SEQ ID NO: 84231 - DNA, 20 bp, synthetic construct
  misc_feature 1..20: note = CRISPR gRNA sequence
  source 1..20: mol_type = other DNA
cactgtcctgaggactattt

SEQ ID NO: 84232 - DNA, 20 bp, synthetic construct
  misc_feature 1..20: note = CRISPR gRNA sequence
  source 1..20: mol_type = other DNA
actgtcctgaggactattta

SEQ ID NO: 84233 - DNA, 20 bp, synthetic construct
  misc_feature 1..20: note = CRISPR gRNA sequence
  source 1..20: mol_type = other DNA
tcctgaggactatttataga

SEQ ID NO: 84234 - DNA, 20 bp, synthetic construct
  misc_feature 1..20: note = CRISPR gRNA sequence
  source 1..20: mol_type = other DNA
aggactatttatagacagct

SEQ ID NO: 84235 - DNA, 20 bp, synthetic construct
  misc_feature 1..20: note = CRISPR gRNA sequence
  source 1..20: mol_type = other DNA
tttatagacagctctaacat

SEQ ID NO: 84236 - DNA, 20 bp, synthetic construct
  misc_feature 1..20: note = CRISPR gRNA sequence
  source 1..20: mol_type = other DNA
atagacagctctaacatgat

SEQ ID NO: 84237 - DNA, 20 bp, synthetic construct
  misc_feature 1..20: note = CRISPR gRNA sequence
  source 1..20: mol_type = other DNA
tagacagctctaacatgata

SEQ ID NO: 84238 - DNA, 20 bp, synthetic construct
  misc_feature 1..20: note = CRISPR gRNA sequence
  source 1..20: mol_type = other DNA
taacatgataaccctcacta

SEQ ID NO: 84239 - DNA, 20 bp, synthetic construct
  misc_feature 1..20: note = CRISPR gRNA sequence
  source 1..20: mol_type = other DNA
acatgataaccctcactatg

SEQ ID NO: 84240 - DNA, 20 bp, synthetic construct
  misc_feature 1..20: note = CRISPR gRNA sequence
  source 1..20: mol_type = other DNA
actatgtggagaacattgac

SEQ ID NO: 84241 - DNA, 20 bp, synthetic construct
  misc_feature 1..20: note = CRISPR gRNA sequence
  source 1..20: mol_type = other DNA
tgtggagaacattgacagag

SEQ ID NO: 84242 - DNA, 20 bp, synthetic construct
  misc_feature 1..20: note = CRISPR gRNA sequence
  source 1..20: mol_type = other DNA
acagagtaacattttagcag

SEQ ID NO: 84243 - DNA, 20 bp, synthetic construct
  misc_feature 1..20: note = CRISPR gRNA sequence
  source 1..20: mol_type = other DNA
tagcagggaaagaagaatcc

SEQ ID NO: 84244 - DNA, 20 bp, synthetic construct
  misc_feature 1..20: note = CRISPR gRNA sequence
  source 1..20: mol_type = other DNA
agcagggaaagaagaatcct

SEQ ID NO: 84245 - DNA, 20 bp, synthetic construct
  misc_feature 1..20: note = CRISPR gRNA sequence
  source 1..20: mol_type = other DNA
gcagggaaagaagaatccta

SEQ ID NO: 84246 - DNA, 20 bp, synthetic construct
  misc_feature 1..20: note = CRISPR gRNA sequence
  source 1..20: mol_type = other DNA
cagggtcatgttcccttctc

SEQ ID NO: 84247 - DNA, 20 bp, synthetic construct
  misc_feature 1..20: note = CRISPR gRNA sequence
  source 1..20: mol_type = other DNA
ccttctcctgtggagtggca

SEQ ID NO: 84248 - DNA, 20 bp, synthetic construct
  misc_feature 1..20: note = CRISPR gRNA sequence
  source 1..20: mol_type = other DNA
ctcctgtggagtggcatgaa

SEQ ID NO: 84249 - DNA, 20 bp, synthetic construct
  misc_feature 1..20: note = CRISPR gRNA sequence
  source 1..20: mol_type = other DNA
tcctgtggagtggcatgaag

SEQ ID NO: 84250 - DNA, 20 bp, synthetic construct
  misc_feature 1..20: note = CRISPR gRNA sequence
  source 1..20: mol_type = other DNA
ctgtggagtggcatgaagaa

SEQ ID NO: 84251 - DNA, 20 bp, synthetic construct
  misc_feature 1..20: note = CRISPR gRNA sequence
  source 1..20: mol_type = other DNA
tggagtggcatgaagaaggt

SEQ ID NO: 84252 - DNA, 20 bp, synthetic construct
  misc_feature 1..20: note = CRISPR gRNA sequence
  source 1..20: mol_type = other DNA
ctgaccctctacagagaggg

SEQ ID NO: 84253 - DNA, 20 bp, synthetic construct
  misc_feature 1..20: note = CRISPR gRNA sequence
  source 1..20: mol_type = other DNA
accctctacagagagggcaa

SEQ ID NO: 84254 - DNA, 20 bp, synthetic construct
  misc_feature 1..20: note = CRISPR gRNA sequence
  source 1..20: mol_type = other DNA
tacagagagggcaaaggaac

SEQ ID NO: 84255 - DNA, 20 bp, synthetic construct
  misc_feature 1..20: note = CRISPR gRNA sequence
  source 1..20: mol_type = other DNA
cagagagggcaaaggaactg

SEQ ID NO: 84256 - DNA, 20 bp, synthetic construct
  misc_feature 1..20: note = CRISPR gRNA sequence
  source 1..20: mol_type = other DNA
ccagtatggtattgcaggat

SEQ ID NO: 84257 - DNA, 20 bp, synthetic construct
  misc_feature 1..20: note = CRISPR gRNA sequence
  source 1..20: mol_type = other DNA
caggataaaggcaggtggtt

SEQ ID NO: 84258 - DNA, 20 bp, synthetic construct
  misc_feature 1..20: note = CRISPR gRNA sequence
  source 1..20: mol_type = other DNA
cccacattacctgcaaggct

SEQ ID NO: 84259 - DNA, 20 bp, synthetic construct
  misc_feature 1..20: note = CRISPR gRNA sequence
  source 1..20: mol_type = other DNA
cctgcaaggctttgatcttt

SEQ ID NO: 84260 - DNA, 20 bp, synthetic construct
  misc_feature 1..20: note = CRISPR gRNA sequence
  source 1..20: mol_type = other DNA
caaggctttgatctttcttc

SEQ ID NO: 84261 - DNA, 20 bp, synthetic construct
  misc_feature 1..20: note = CRISPR gRNA sequence
  source 1..20: mol_type = other DNA
tgatctttcttctgccattt

SEQ ID NO: 84262 - DNA, 20 bp, synthetic construct
  misc_feature 1..20: note = CRISPR gRNA sequence
  source 1..20: mol_type = other DNA
gatctttcttctgccatttc

SEQ ID NO: 84263 - DNA, 20 bp, synthetic construct
  misc_feature 1..20: note = CRISPR gRNA sequence
  source 1..20: mol_type = other DNA
atctttcttctgccatttcc

SEQ ID NO: 84264 - DNA, 20 bp, synthetic construct
  misc_feature 1..20: note = CRISPR gRNA sequence
  source 1..20: mol_type = other DNA
tcttctgccatttccacatt

SEQ ID NO: 84265 - DNA, 20 bp, synthetic construct
  misc_feature 1..20: note = CRISPR gRNA sequence
  source 1..20: mol_type = other DNA
cttctgccatttccacattg

SEQ ID NO: 84266 - DNA, 20 bp, synthetic construct
  misc_feature 1..20: note = CRISPR gRNA sequence
  source 1..20: mol_type = other DNA
ttctgccatttccacattgg

SEQ ID NO: 84267 - DNA, 20 bp, synthetic construct
  misc_feature 1..20: note = CRISPR gRNA sequence
  source 1..20: mol_type = other DNA
ctgccatttccacattggac

SEQ ID NO: 84268 - DNA, 20 bp, synthetic construct
  misc_feature 1..20: note = CRISPR gRNA sequence
  source 1..20: mol_type = other DNA
tgccatttccacattggaca

SEQ ID NO: 84269 - DNA, 20 bp, synthetic construct
  misc_feature 1..20: note = CRISPR gRNA sequence
  source 1..20: mol_type = other DNA
ccatttccacattggacatc

SEQ ID NO: 84270 - DNA, 20 bp, synthetic construct
  misc_feature 1..20: note = CRISPR gRNA sequence
  source 1..20: mol_type = other DNA
ccacattggacatctctgct

SEQ ID NO: 84271 - DNA, 20 bp, synthetic construct
  misc_feature 1..20: note = CRISPR gRNA sequence
  source 1..20: mol_type = other DNA
cacattggacatctctgctg

SEQ ID NO: 84272 - DNA, 20 bp, synthetic construct
  misc_feature 1..20: note = CRISPR gRNA sequence
  source 1..20: mol_type = other DNA
gacatctctgctgaggagag

SEQ ID NO: 84273 - DNA, 20 bp, synthetic construct
  misc_feature 1..20: note = CRISPR gRNA sequence
  source 1..20: mol_type = other DNA
tgctgaggagagaaaatgaa

SEQ ID NO: 84274 - DNA, 20 bp, synthetic construct
  misc_feature 1..20: note = CRISPR gRNA sequence
  source 1..20: mol_type = other DNA
ctgaggagagaaaatgaacc

SEQ ID NO: 84275 - DNA, 20 bp, synthetic construct
  misc_feature 1..20: note = CRISPR gRNA sequence
  source 1..20: mol_type = other DNA
aggagagaaaatgaaccact

SEQ ID NO: 84276 - DNA, 20 bp, synthetic construct
  misc_feature 1..20: note = CRISPR gRNA sequence
  source 1..20: mol_type = other DNA
ttttcctttgtataatgttg

SEQ ID NO: 84277 - DNA, 20 bp, synthetic construct
  misc_feature 1..20: note = CRISPR gRNA sequence
  source 1..20: mol_type = other DNA
ttcctttgtataatgttgtt

SEQ ID NO: 84278 - DNA, 20 bp, synthetic construct
  misc_feature 1..20: note = CRISPR gRNA sequence
  source 1..20: mol_type = other DNA
tcctttgtataatgttgttt

SEQ ID NO: 84279 - DNA, 20 bp, synthetic construct
  misc_feature 1..20: note = CRISPR gRNA sequence
  source 1..20: mol_type = other DNA
cctttgtataatgttgtttt

SEQ ID NO: 84280 - DNA, 20 bp, synthetic construct
  misc_feature 1..20: note = CRISPR gRNA sequence
  source 1..20: mol_type = other DNA
ctttgtataatgttgtttta

SEQ ID NO: 84281 - DNA, 20 bp, synthetic construct
  misc_feature 1..20: note = CRISPR gRNA sequence
  source 1..20: mol_type = other DNA
tgtataatgttgttttattc

SEQ ID NO: 84282 - DNA, 20 bp, synthetic construct
  misc_feature 1..20: note = CRISPR gRNA sequence
  source 1..20: mol_type = other DNA
gtataatgttgttttattct

SEQ ID NO: 84283 - DNA, 20 bp, synthetic construct
  misc_feature 1..20: note = CRISPR gRNA sequence
  source 1..20: mol_type = other DNA
tataatgttgttttattctt

SEQ ID NO: 84284 - DNA, 20 bp, synthetic construct
  misc_feature 1..20: note = CRISPR gRNA sequence
  source 1..20: mol_type = other DNA
ttttattcttcagacagaag

SEQ ID NO: 84285 - DNA, 20 bp, synthetic construct
  misc_feature 1..20: note = CRISPR gRNA sequence
  source 1..20: mol_type = other DNA
tattcttcagacagaagaga

SEQ ID NO: 84286 - DNA, 20 bp, synthetic construct
  misc_feature 1..20: note = CRISPR gRNA sequence
  source 1..20: mol_type = other DNA
attcttcagacagaagagag

SEQ ID NO: 84287 - DNA, 20 bp, synthetic construct
  misc_feature 1..20: note = CRISPR gRNA sequence
  source 1..20: mol_type = other DNA
ttcttcagacagaagagagg

SEQ ID NO: 84288 - DNA, 20 bp, synthetic construct
  misc_feature 1..20: note = CRISPR gRNA sequence
  source 1..20: mol_type = other DNA
ttcagacagaagagaggagt

SEQ ID NO: 84289 - DNA, 20 bp, synthetic construct
  misc_feature 1..20: note = CRISPR gRNA sequence
  source 1..20: mol_type = other DNA
cagacagaagagaggagtta

SEQ ID NO: 84290 - DNA, 20 bp, synthetic construct
  misc_feature 1..20: note = CRISPR gRNA sequence
  source 1..20: mol_type = other DNA
agacagaagagaggagttat

SEQ ID NO: 84291 - DNA, 20 bp, synthetic construct
  misc_feature 1..20: note = CRISPR gRNA sequence
  source 1..20: mol_type = other DNA
tacagctctgcagacatccc

SEQ ID NO: 84292 - DNA, 20 bp, synthetic construct
  misc_feature 1..20: note = CRISPR gRNA sequence
  source 1..20: mol_type = other DNA
tgcagacatcccattcctgt

SEQ ID NO: 84293 - DNA, 20 bp, synthetic construct
  misc_feature 1..20: note = CRISPR gRNA sequence
  source 1..20: mol_type = other DNA
cagacatcccattcctgtat

SEQ ID NO: 84294 - DNA, 20 bp, synthetic construct
  misc_feature 1..20: note = CRISPR gRNA sequence
  source 1..20: mol_type = other DNA
ctgtatggggactgtgtttg

SEQ ID NO: 84295 - DNA, 20 bp, synthetic construct
  misc_feature 1..20: note = CRISPR gRNA sequence
  source 1..20: mol_type = other DNA
tatggggactgtgtttgcct

SEQ ID NO: 84296 - DNA, 20 bp, synthetic construct
  misc_feature 1..20: note = CRISPR gRNA sequence
  source 1..20: mol_type = other DNA
tgtttgcctcttagaggttc

SEQ ID NO: 84297 - DNA, 20 bp, synthetic construct
  misc_feature 1..20: note = CRISPR gRNA sequence
  source 1..20: mol_type = other DNA
gcctcttagaggttcccagg

SEQ ID NO: 84298 - DNA, 20 bp, synthetic construct
  misc_feature 1..20: note = CRISPR gRNA sequence
  source 1..20: mol_type = other DNA
cctcttagaggttcccaggc

SEQ ID NO: 84299 - DNA, 20 bp, synthetic construct
  misc_feature 1..20: note = CRISPR gRNA sequence
  source 1..20: mol_type = other DNA
ttagaggttcccaggccact

SEQ ID NO: 84300 - DNA, 20 bp, synthetic construct
  misc_feature 1..20: note = CRISPR gRNA sequence
  source 1..20: mol_type = other DNA
agaggttcccaggccactag

SEQ ID NO: 84301 - DNA, 20 bp, synthetic construct
  misc_feature 1..20: note = CRISPR gRNA sequence
  source 1..20: mol_type = other DNA
gaggttcccaggccactaga

SEQ ID NO: 84302 - DNA, 20 bp, synthetic construct
  misc_feature 1..20: note = CRISPR gRNA sequence
  source 1..20: mol_type = other DNA
ccaggccactagaggagata

SEQ ID NO: 84303 - DNA, 20 bp, synthetic construct
  misc_feature 1..20: note = CRISPR gRNA sequence
  source 1..20: mol_type = other DNA
gaggagataaagggaaacag

SEQ ID NO: 84304 - DNA, 20 bp, synthetic construct
  misc_feature 1..20: note = CRISPR gRNA sequence
  source 1..20: mol_type = other DNA
ttataacttgatataatgat

SEQ ID NO: 84305 - DNA, 20 bp, synthetic construct
  misc_feature 1..20: note = CRISPR gRNA sequence
  source 1..20: mol_type = other DNA
taacttgatataatgatact

SEQ ID NO: 84306 - DNA, 20 bp, synthetic construct
  misc_feature 1..20: note = CRISPR gRNA sequence
  source 1..20: mol_type = other DNA
gatataatgatactataata

SEQ ID NO: 84307 - DNA, 20 bp, synthetic construct
  misc_feature 1..20: note = CRISPR gRNA sequence
  source 1..20: mol_type = other DNA
atataatgatactataatag

SEQ ID NO: 84308 - DNA, 20 bp, synthetic construct
  misc_feature 1..20: note = CRISPR gRNA sequence
  source 1..20: mol_type = other DNA
taatagatgtaactacaagg

SEQ ID NO: 84309 - DNA, 20 bp, synthetic construct
  misc_feature 1..20: note = CRISPR gRNA sequence
  source 1..20: mol_type = other DNA
caaggagctccagaagcaag

SEQ ID NO: 84310 - DNA, 20 bp, synthetic construct
  misc_feature 1..20: note = CRISPR gRNA sequence
  source 1..20: mol_type = other DNA
cagaagcaagagagagggag

SEQ ID NO: 84311 - DNA, 20 bp, synthetic construct
  misc_feature 1..20: note = CRISPR gRNA sequence
  source 1..20: mol_type = other DNA
ggacttctctgcatctttag

SEQ ID NO: 84312 - DNA, 20 bp, synthetic construct
  misc_feature 1..20: note = CRISPR gRNA sequence
  source 1..20: mol_type = other DNA
gacttctctgcatctttagt

SEQ ID NO: 84313 - DNA, 20 bp, synthetic construct
  misc_feature 1..20: note = CRISPR gRNA sequence
  source 1..20: mol_type = other DNA
ctctgcatctttagttggag

SEQ ID NO: 84314 - DNA, 20 bp, synthetic construct
  misc_feature 1..20: note = CRISPR gRNA sequence
  source 1..20: mol_type = other DNA
tctgcatctttagttggagt

SEQ ID NO: 84315 - DNA, 20 bp, synthetic construct
  misc_feature 1..20: note = CRISPR gRNA sequence
  source 1..20: mol_type = other DNA
tgcatctttagttggagtcc

SEQ ID NO: 84316 - DNA, 20 bp, synthetic construct
  misc_feature 1..20: note = CRISPR gRNA sequence
  source 1..20: mol_type = other DNA
catctttagttggagtccaa

SEQ ID NO: 84317 - DNA, 20 bp, synthetic construct
  misc_feature 1..20: note = CRISPR gRNA sequence
  source 1..20: mol_type = other DNA
tagttggagtccaaaggctt

SEQ ID NO: 84318 - DNA, 20 bp, synthetic construct
  misc_feature 1..20: note = CRISPR gRNA sequence
  source 1..20: mol_type = other DNA
agttggagtccaaaggcttt

SEQ ID NO: 84319 - DNA, 20 bp, synthetic construct
  misc_feature 1..20: note = CRISPR gRNA sequence
  source 1..20: mol_type = other DNA
gttggagtccaaaggctttt

SEQ ID NO: 84320 - DNA, 20 bp, synthetic construct
  misc_feature 1..20: note = CRISPR gRNA sequence
  source 1..20: mol_type = other DNA
gagtccaaaggcttttcaat

SEQ ID NO: 84321 - DNA, 20 bp, synthetic construct
  misc_feature 1..20: note = CRISPR gRNA sequence
  source 1..20: mol_type = other DNA
ttcaatgaaattctactgcc

SEQ ID NO: 84322 - DNA, 20 bp, synthetic construct
  misc_feature 1..20: note = CRISPR gRNA sequence
  source 1..20: mol_type = other DNA
tcaatgaaattctactgccc

SEQ ID NO: 84323 - DNA, 20 bp, synthetic construct
  misc_feature 1..20: note = CRISPR gRNA sequence
  source 1..20: mol_type = other DNA
caatgaaattctactgccca

SEQ ID NO: 84324 - DNA, 20 bp, synthetic construct
  misc_feature 1..20: note = CRISPR gRNA sequence
  source 1..20: mol_type = other DNA
aatgaaattctactgcccag

SEQ ID NO: 84325 - DNA, 20 bp, synthetic construct
  misc_feature 1..20: note = CRISPR gRNA sequence
  source 1..20: mol_type = other DNA
tactgcccagggtacattga

SEQ ID NO: 84326 - DNA, 20 bp, synthetic construct
  misc_feature 1..20: note = CRISPR gRNA sequence
  source 1..20: mol_type = other DNA
ctgcccagggtacattgatg

SEQ ID NO: 84327 - DNA, 20 bp, synthetic construct
  misc_feature 1..20: note = CRISPR gRNA sequence
  source 1..20: mol_type = other DNA
cccagggtacattgatgctg

SEQ ID NO: 84328 - DNA, 20 bp, synthetic construct
  misc_feature 1..20: note = CRISPR gRNA sequence
  source 1..20: mol_type = other DNA
atgctgaaaccccattcaaa

SEQ ID NO: 84329 - DNA, 20 bp, synthetic construct
  misc_feature 1..20: note = CRISPR gRNA sequence
  source 1..20: mol_type = other DNA
aaaccccattcaaatctcct

SEQ ID NO: 84330 - DNA, 20 bp, synthetic construct
  misc_feature 1..20: note = CRISPR gRNA sequence
  source 1..20: mol_type = other DNA
aaatctcctgttatattcta

SEQ ID NO: 84331 - DNA, 20 bp, synthetic construct
  misc_feature 1..20: note = CRISPR gRNA sequence
  source 1..20: mol_type = other DNA
ctgttatattctagaacagg

SEQ ID NO: 84332 - DNA, 20 bp, synthetic construct
  misc_feature 1..20: note = CRISPR gRNA sequence
  source 1..20: mol_type = other DNA
ttatattctagaacagggaa

SEQ ID NO: 84333 - DNA, 20 bp, synthetic construct
  misc_feature 1..20: note = CRISPR gRNA sequence
  source 1..20: mol_type = other DNA
tattctagaacagggaattg

SEQ ID NO: 84334 - DNA, 20 bp, synthetic construct
  misc_feature 1..20: note = CRISPR gRNA sequence
  source 1..20: mol_type = other DNA
tagaacagggaattgatttg

SEQ ID NO: 84335 - DNA, 20 bp, synthetic construct
  misc_feature 1..20: note = CRISPR gRNA sequence
  source 1..20: mol_type = other DNA
gaacagggaattgatttggg

SEQ ID NO: 84336 - DNA, 20 bp, synthetic construct
  misc_feature 1..20: note = CRISPR gRNA sequence
  source 1..20: mol_type = other DNA
atttgggagagcatcaggaa

SEQ ID NO: 84337 - DNA, 20 bp, synthetic construct
  misc_feature 1..20: note = CRISPR gRNA sequence
  source 1..20: mol_type = other DNA
gggagagcatcaggaaggtg

SEQ ID NO: 84338 - DNA, 20 bp, synthetic construct
  misc_feature 1..20: note = CRISPR gRNA sequence
  source 1..20: mol_type = other DNA
ggagagcatcaggaaggtgg

SEQ ID NO: 84339 - DNA, 20 bp, synthetic construct
  misc_feature 1..20: note = CRISPR gRNA sequence
  source 1..20: mol_type = other DNA
cccagtcacactgttagtaa

SEQ ID NO: 84340 - DNA, 20 bp, synthetic construct
  misc_feature 1..20: note = CRISPR gRNA sequence
  source 1..20: mol_type = other DNA
ttagtaaattgtagagccag

SEQ ID NO: 84341 - DNA, 20 bp, synthetic construct
  misc_feature 1..20: note = CRISPR gRNA sequence
  source 1..20: mol_type = other DNA
gtaaattgtagagccaggac

SEQ ID NO: 84342 - DNA, 20 bp, synthetic construct
  misc_feature 1..20: note = CRISPR gRNA sequence
  source 1..20: mol_type = other DNA
tagagccaggacctgaactc

SEQ ID NO: 84343 - DNA, 20 bp, synthetic construct
  misc_feature 1..20: note = CRISPR gRNA sequence
  source 1..20: mol_type = other DNA
aactctaatatagtcatgtg

SEQ ID NO: 84344 - DNA, 20 bp, synthetic construct
  misc_feature 1..20: note = CRISPR gRNA sequence
  source 1..20: mol_type = other DNA
taatatagtcatgtgttact

SEQ ID NO: 84345 - DNA, 20 bp, synthetic construct
  misc_feature 1..20: note = CRISPR gRNA sequence
  source 1..20: mol_type = other DNA
atatagtcatgtgttactta

SEQ ID NO: 84346 - DNA, 20 bp, synthetic construct
  misc_feature 1..20: note = CRISPR gRNA sequence
  source 1..20: mol_type = other DNA
cttaatgacggggacatgtt

SEQ ID NO: 84347 - DNA, 20 bp, synthetic construct
  misc_feature 1..20: note = CRISPR gRNA sequence
  source 1..20: mol_type = other DNA
aatgacggggacatgttctg

SEQ ID NO: 84348 - DNA, 20 bp, synthetic construct
  misc_feature 1..20: note = CRISPR gRNA sequence
  source 1..20: mol_type = other DNA
atgacggggacatgttctga

SEQ ID NO: 84349 - DNA, 20 bp, synthetic construct
  misc_feature 1..20: note = CRISPR gRNA sequence
  source 1..20: mol_type = other DNA
tgagaaatgcttacacaaac

SEQ ID NO: 84350 - DNA, 20 bp, synthetic construct
  misc_feature 1..20: note = CRISPR gRNA sequence
  source 1..20: mol_type = other DNA
agaaatgcttacacaaacct

SEQ ID NO: 84351 - DNA, 20 bp, synthetic construct
  misc_feature 1..20: note = CRISPR gRNA sequence
  source 1..20: mol_type = other DNA
acacaaacctaggtgttgta

SEQ ID NO: 84352 - DNA, 20 bp, synthetic construct
  misc_feature 1..20: note = CRISPR gRNA sequence
  source 1..20: mol_type = other DNA
cacaaacctaggtgttgtag

SEQ ID NO: 84353 - DNA, 20 bp, synthetic construct
  misc_feature 1..20: note = CRISPR gRNA sequence
  source 1..20: mol_type = other DNA
ggtgttgtagcctactacac

SEQ ID NO: 84354 - DNA, 20 bp, synthetic construct
  misc_feature 1..20: note = CRISPR gRNA sequence
  source 1..20: mol_type = other DNA
tagcctactacacgcatagg

SEQ ID NO: 84355 - DNA, 20 bp, synthetic construct
  misc_feature 1..20: note = CRISPR gRNA sequence
  source 1..20: mol_type = other DNA
ctacacgcataggctacatg

SEQ ID NO: 84356 - DNA, 20 bp, synthetic construct
  misc_feature 1..20: note = CRISPR gRNA sequence
  source 1..20: mol_type = other DNA
cacgcataggctacatggta

SEQ ID NO: 84357 - DNA, 20 bp, synthetic construct
  misc_feature 1..20: note = CRISPR gRNA sequence
  source 1..20: mol_type = other DNA
catggtatagcctattgctc

SEQ ID NO: 84358 - DNA, 20 bp, synthetic construct
  misc_feature 1..20: note = CRISPR gRNA sequence
  source 1..20: mol_type = other DNA
ttgctcctagactacaaacc

SEQ ID NO: 84359 - DNA, 20 bp, synthetic construct
  misc_feature 1..20: note = CRISPR gRNA sequence
  source 1..20: mol_type = other DNA
ctcctagactacaaacctgt

SEQ ID NO: 84360 - DNA, 20 bp, synthetic construct
  misc_feature 1..20: note = CRISPR gRNA sequence
  source 1..20: mol_type = other DNA
ctagactacaaacctgtaca

SEQ ID NO: 84361 - DNA, 20 bp, synthetic construct
  misc_feature 1..20: note = CRISPR gRNA sequence
  source 1..20: mol_type = other DNA
gactacaaacctgtacagcc

SEQ ID NO: 84362 - DNA, 20 bp, synthetic construct
  misc_feature 1..20: note = CRISPR gRNA sequence
  source 1..20: mol_type = other DNA
caaacctgtacagcctgtta

SEQ ID NO: 84363 - DNA, 20 bp, synthetic construct
  misc_feature 1..20: note = CRISPR gRNA sequence
  source 1..20: mol_type = other DNA
tacagcctgttactgtactg

SEQ ID NO: 84364 - DNA, 20 bp, synthetic construct
  misc_feature 1..20: note = CRISPR gRNA sequence
  source 1..20: mol_type = other DNA
ttactgtactgaatactgtg

SEQ ID NO: 84365 - DNA, 20 bp, synthetic construct
  misc_feature 1..20: note = CRISPR gRNA sequence
  source 1..20: mol_type = other DNA
ctgtactgaatactgtgggc

SEQ ID NO: 84366 - DNA, 20 bp, synthetic construct
  misc_feature 1..20: note = CRISPR gRNA sequence
  source 1..20: mol_type = other DNA
tactgaatactgtgggcagt

SEQ ID NO: 84367 - DNA, 20 bp, synthetic construct
  misc_feature 1..20: note = CRISPR gRNA sequence
  source 1..20: mol_type = other DNA
aatactgtgggcagttgtaa

SEQ ID NO: 84368 - DNA, 20 bp, synthetic construct
  misc_feature 1..20: note = CRISPR gRNA sequence
  source 1..20: mol_type = other DNA
tgggcagttgtaacacaatg

SEQ ID NO: 84369 - DNA, 20 bp, synthetic construct
  misc_feature 1..20: note = CRISPR gRNA sequence
  source 1..20: mol_type = other DNA
taacacaatggtaagtattt

SEQ ID NO: 84370 - DNA, 20 bp, synthetic construct
  misc_feature 1..20: note = CRISPR gRNA sequence
  source 1..20: mol_type = other DNA
gtgtatctaaacatagaagt

SEQ ID NO: 84371 - DNA, 20 bp, synthetic construct
  misc_feature 1..20: note = CRISPR gRNA sequence
  source 1..20: mol_type = other DNA
tgtatctaaacatagaagtt

SEQ ID NO: 84372 - DNA, 20 bp, synthetic construct
  misc_feature 1..20: note = CRISPR gRNA sequence
  source 1..20: mol_type = other DNA
aacatagaagttgcagtaaa

SEQ ID NO: 84373 - DNA, 20 bp, synthetic construct
  misc_feature 1..20: note = CRISPR gRNA sequence
  source 1..20: mol_type = other DNA
cagtaaaaatatgctatttt

SEQ ID NO: 84374 - DNA, 20 bp, synthetic construct
  misc_feature 1..20: note = CRISPR gRNA sequence
  source 1..20: mol_type = other DNA
ttttaatcttatgagaccac

SEQ ID NO: 84375 - DNA, 20 bp, synthetic construct
  misc_feature 1..20: note = CRISPR gRNA sequence
  source 1..20: mol_type = other DNA
taatcttatgagaccactgt

SEQ ID NO: 84376 - DNA, 20 bp, synthetic construct
  misc_feature 1..20: note = CRISPR gRNA sequence
  source 1..20: mol_type = other DNA
aatcttatgagaccactgtc

SEQ ID NO: 84377 - DNA, 20 bp, synthetic construct
  misc_feature 1..20: note = CRISPR gRNA sequence
  source 1..20: mol_type = other DNA
atcttatgagaccactgtca

SEQ ID NO: 84378 - DNA, 20 bp, synthetic construct
  misc_feature 1..20: note = CRISPR gRNA sequence
  source 1..20: mol_type = other DNA
atgagaccactgtcatatat

SEQ ID NO: 84379 - DNA, 20 bp, synthetic construct
  misc_feature 1..20: note = CRISPR gRNA sequence
  source 1..20: mol_type = other DNA
tgagaccactgtcatatata

SEQ ID NO: 84380 - DNA, 20 bp, synthetic construct
  misc_feature 1..20: note = CRISPR gRNA sequence
  source 1..20: mol_type = other DNA
tcatatatacagtccatcat

SEQ ID NO: 84381 - DNA, 20 bp, synthetic construct
  misc_feature 1..20: note = CRISPR gRNA sequence
  source 1..20: mol_type = other DNA
accaaaacatcatatcagca

SEQ ID NO: 84382 - DNA, 20 bp, synthetic construct
  misc_feature 1..20: note = CRISPR gRNA sequence
  source 1..20: mol_type = other DNA
tttcttctaagattttggga

SEQ ID NO: 84383 - DNA, 20 bp, synthetic construct
  misc_feature 1..20: note = CRISPR gRNA sequence
  source 1..20: mol_type = other DNA
ttcttctaagattttgggag

SEQ ID NO: 84384 - DNA, 20 bp, synthetic construct
  misc_feature 1..20: note = CRISPR gRNA sequence
  source 1..20: mol_type = other DNA
tcttctaagattttgggagc

SEQ ID NO: 84385 - DNA, 20 bp, synthetic construct
  misc_feature 1..20: note = CRISPR gRNA sequence
  source 1..20: mol_type = other DNA
cttctaagattttgggagca

SEQ ID NO: 84386 - DNA, 20 bp, synthetic construct
  misc_feature 1..20: note = CRISPR gRNA sequence
  source 1..20: mol_type = other DNA
ttctaagattttgggagcac

SEQ ID NO: 84387 - DNA, 20 bp, synthetic construct
  misc_feature 1..20: note = CRISPR gRNA sequence
  source 1..20: mol_type = other DNA
ctaagattttgggagcacca

SEQ ID NO: 84388 - DNA, 20 bp, synthetic construct
  misc_feature 1..20: note = CRISPR gRNA sequence
  source 1..20: mol_type = other DNA
taagattttgggagcaccaa

SEQ ID NO: 84389 - DNA, 20 bp, synthetic construct
  misc_feature 1..20: note = CRISPR gRNA sequence
  source 1..20: mol_type = other DNA
agattttgggagcaccaaag

SEQ ID NO: 84390 - DNA, 20 bp, synthetic construct
  misc_feature 1..20: note = CRISPR gRNA sequence
  source 1..20: mol_type = other DNA
tgggagcaccaaagggatac

SEQ ID NO: 84391 - DNA, 20 bp, synthetic construct
  misc_feature 1..20: note = CRISPR gRNA sequence
  source 1..20: mol_type = other DNA
gggagcaccaaagggataca

SEQ ID NO: 84392 - DNA, 20 bp, synthetic construct
  misc_feature 1..20: note = CRISPR gRNA sequence
  source 1..20: mol_type = other DNA
ggagcaccaaagggatacac

SEQ ID NO: 84393 - DNA, 20 bp, synthetic construct
  misc_feature 1..20: note = CRISPR gRNA sequence
  source 1..20: mol_type = other DNA
acaggatatactctttataa

SEQ ID NO: 84394 - DNA, 20 bp, synthetic construct
  misc_feature 1..20: note = CRISPR gRNA sequence
  source 1..20: mol_type = other DNA
tttataatgggtttggagaa

SEQ ID NO: 84395 - DNA, 20 bp, synthetic construct
  misc_feature 1..20: note = CRISPR gRNA sequence
  source 1..20: mol_type = other DNA
tataatgggtttggagaact

SEQ ID NO: 84396 - DNA, 20 bp, synthetic construct
  misc_feature 1..20: note = CRISPR gRNA sequence
  source 1..20: mol_type = other DNA
ataatgggtttggagaactg

SEQ ID NO: 84397 - DNA, 20 bp, synthetic construct
  misc_feature 1..20: note = CRISPR gRNA sequence
  source 1..20: mol_type = other DNA
taatgggtttggagaactgt

SEQ ID NO: 84398 - DNA, 20 bp, synthetic construct
  misc_feature 1..20: note = CRISPR gRNA sequence
  source 1..20: mol_type = other DNA
ggagaactgtctgcagctac

SEQ ID NO: 84399 - DNA, 20 bp, synthetic construct
  misc_feature 1..20: note = CRISPR gRNA sequence
  source 1..20: mol_type = other DNA
gagaactgtctgcagctact

SEQ ID NO: 84400 - DNA, 20 bp, synthetic construct
  misc_feature 1..20: note = CRISPR gRNA sequence
  source 1..20: mol_type = other DNA
tctgcagctacttcttttaa

SEQ ID NO: 84401 - DNA, 20 bp, synthetic construct
  misc_feature 1..20: note = CRISPR gRNA sequence
  source 1..20: mol_type = other DNA
cagctacttcttttaaaaag

SEQ ID NO: 84402 - DNA, 20 bp, synthetic construct
  misc_feature 1..20: note = CRISPR gRNA sequence
  source 1..20: mol_type = other DNA
cttcttttaaaaaggtgatc

SEQ ID NO: 84403 - DNA, 20 bp, synthetic construct
  misc_feature 1..20: note = CRISPR gRNA sequence
  source 1..20: mol_type = other DNA
cttttaaaaaggtgatctac

SEQ ID NO: 84404 - DNA, 20 bp, synthetic construct
  misc_feature 1..20: note = CRISPR gRNA sequence
  source 1..20: mol_type = other DNA
ttttaaaaaggtgatctaca

SEQ ID NO: 84405 - DNA, 20 bp, synthetic construct
  misc_feature 1..20: note = CRISPR gRNA sequence
  source 1..20: mol_type = other DNA
ttaaaaaggtgatctacaca

SEQ ID NO: 84406 - DNA, 20 bp, synthetic construct
  misc_feature 1..20: note = CRISPR gRNA sequence
  source 1..20: mol_type = other DNA
taaaaaggtgatctacacag

SEQ ID NO: 84407 - DNA, 20 bp, synthetic construct
  misc_feature 1..20: note = CRISPR gRNA sequence
  source 1..20: mol_type = other DNA
aaaaaggtgatctacacagt

SEQ ID NO: 84408 - DNA, 20 bp, synthetic construct
  misc_feature 1..20: note = CRISPR gRNA sequence
  source 1..20: mol_type = other DNA
aaaaggtgatctacacagta

SEQ ID NO: 84409 - DNA, 20 bp, synthetic construct
  misc_feature 1..20: note = CRISPR gRNA sequence
  source 1..20: mol_type = other DNA
cacagtagaaattagacaag

SEQ ID NO: 84410 - DNA, 20 bp, synthetic construct
  misc_feature 1..20: note = CRISPR gRNA sequence
  source 1..20: mol_type = other DNA
gacaagtttggtaatgagat

SEQ ID NO: 84411 - DNA, 20 bp, synthetic construct
  misc_feature 1..20: note = CRISPR gRNA sequence
  source 1..20: mol_type = other DNA
ggtaatgagatctgcaatcc

SEQ ID NO: 84412 - DNA, 20 bp, synthetic construct
  misc_feature 1..20: note = CRISPR gRNA sequence
  source 1..20: mol_type = other DNA
gtaatgagatctgcaatcca

SEQ ID NO: 84413 - DNA, 20 bp, synthetic construct
  misc_feature 1..20: note = CRISPR gRNA sequence
  source 1..20: mol_type = other DNA
caatccaaataaaataaatt

SEQ ID NO: 84414 - DNA, 20 bp, synthetic construct
  misc_feature 1..20: note = CRISPR gRNA sequence
  source 1..20: mol_type = other DNA
attgctaacctttttctttt

SEQ ID NO: 84415 - DNA, 20 bp, synthetic construct
  misc_feature 1..20: note = CRISPR gRNA sequence
  source 1..20: mol_type = other DNA
ctaacctttttcttttcttt

SEQ ID NO: 84416 - DNA, 20 bp, synthetic construct
  misc_feature 1..20: note = CRISPR gRNA sequence
  source 1..20: mol_type = other DNA
acctttttcttttcttttca

SEQ ID NO: 84417 - DNA, 20 bp, synthetic construct
  misc_feature 1..20: note = CRISPR gRNA sequence
  source 1..20: mol_type = other DNA
tttcttttcttttcaggttt

SEQ ID NO: 84418 - DNA, 20 bp, synthetic construct
  misc_feature 1..20: note = CRISPR gRNA sequence
  source 1..20: mol_type = other DNA
ttcttttcttttcaggtttg

SEQ ID NO: 84419 - DNA, 20 bp, synthetic construct
  misc_feature 1..20: note = CRISPR gRNA sequence
  source 1..20: mol_type = other DNA
tcttttcttttcaggtttga

SEQ ID NO: 84420 - DNA, 20 bp, synthetic construct
  misc_feature 1..20: note = CRISPR gRNA sequence
  source 1..20: mol_type = other DNA
cttttcttttcaggtttgaa

SEQ ID NO: 84421 - DNA, 20 bp, synthetic construct
  misc_feature 1..20: note = CRISPR gRNA sequence
  source 1..20: mol_type = other DNA
ttttcttttcaggtttgaag

SEQ ID NO: 84422 - DNA, 20 bp, synthetic construct
  misc_feature 1..20: note = CRISPR gRNA sequence
  source 1..20: mol_type = other DNA
ttcttttcaggtttgaagat

SEQ ID NO: 84423 - DNA, 20 bp, synthetic construct
  misc_feature 1..20: note = CRISPR gRNA sequence
  source 1..20: mol_type = other DNA
tcttttcaggtttgaagatg

SEQ ID NO: 84424 - DNA, 20 bp, synthetic construct
  misc_feature 1..20: note = CRISPR gRNA sequence
  source 1..20: mol_type = other DNA
cttttcaggtttgaagatgc

SEQ ID NO: 84425 - DNA, 20 bp, synthetic construct
  misc_feature 1..20: note = CRISPR gRNA sequence
  source 1..20: mol_type = other DNA
ttttcaggtttgaagatgcc

SEQ ID NO: 84426 - DNA, 20 bp, synthetic construct
  misc_feature 1..20: note = CRISPR gRNA sequence
  source 1..20: mol_type = other DNA
ttcaggtttgaagatgccgc

SEQ ID NO: 84427 - DNA, 20 bp, synthetic construct
  misc_feature 1..20: note = CRISPR gRNA sequence
  source 1..20: mol_type = other DNA
tcaggtttgaagatgccgca

SEQ ID NO: 84428 - DNA, 20 bp, synthetic construct
  misc_feature 1..20: note = CRISPR gRNA sequence
  source 1..20: mol_type = other DNA
caggtttgaagatgccgcat

SEQ ID NO: 84429 - DNA, 20 bp, synthetic construct
  misc_feature 1..20: note = CRISPR gRNA sequence
  source 1..20: mol_type = other DNA
aggtttgaagatgccgcatt

SEQ ID NO: 84430 - DNA, 20 bp, synthetic construct
  misc_feature 1..20: note = CRISPR gRNA sequence
  source 1..20: mol_type = other DNA
gaagatgccgcatttggatt

SEQ ID NO: 84431 - DNA, 20 bp, synthetic construct
  misc_feature 1..20: note = CRISPR gRNA sequence
  source 1..20: mol_type = other DNA
aagatgccgcatttggattg

SEQ ID NO: 84432 - DNA, 20 bp, synthetic construct
  misc_feature 1..20: note = CRISPR gRNA sequence
  source 1..20: mol_type = other DNA
ggattggatgaattccaaat

SEQ ID NO: 84433 - DNA, 20 bp, synthetic construct
  misc_feature 1..20: note = CRISPR gRNA sequence
  source 1..20: mol_type = other DNA
gattggatgaattccaaatt

SEQ ID NO: 84434 - DNA, 20 bp, synthetic construct
  misc_feature 1..20: note = CRISPR gRNA sequence
  source 1..20: mol_type = other DNA
gatgaattccaaattctgct

SEQ ID NO: 84435 - DNA, 20 bp, synthetic construct
  misc_feature 1..20: note = CRISPR gRNA sequence
  source 1..20: mol_type = other DNA
caaattctgcttgcttgctt

SEQ ID NO: 84436 - DNA, 20 bp, synthetic construct
  misc_feature 1..20: note = CRISPR gRNA sequence
  source 1..20: mol_type = other DNA
tgcttgcttgctttttaata

SEQ ID NO: 84437 - DNA, 20 bp, synthetic construct
  misc_feature 1..20: note = CRISPR gRNA sequence
  source 1..20: mol_type = other DNA
cttgcttgctttttaatatt

SEQ ID NO: 84438 - DNA, 20 bp, synthetic construct
  misc_feature 1..20: note = CRISPR gRNA sequence
  source 1..20: mol_type = other DNA
gcttgctttttaatattgat

SEQ ID NO: 84439 - DNA, 20 bp, synthetic construct
  misc_feature 1..20: note = CRISPR gRNA sequence
  source 1..20: mol_type = other DNA
cttgctttttaatattgata

SEQ ID NO: 84440 - DNA, 20 bp, synthetic construct
  misc_feature 1..20: note = CRISPR gRNA sequence
  source 1..20: mol_type = other DNA
gctttttaatattgatatgc

SEQ ID NO: 84441 - DNA, 20 bp, synthetic construct
  misc_feature 1..20: note = CRISPR gRNA sequence
  source 1..20: mol_type = other DNA
ctttttaatattgatatgct

SEQ ID NO: 84442 - DNA, 20 bp, synthetic construct
  misc_feature 1..20: note = CRISPR gRNA sequence
  source 1..20: mol_type = other DNA
tttaatattgatatgcttat

SEQ ID NO: 84443 - DNA, 20 bp, synthetic construct
  misc_feature 1..20: note = CRISPR gRNA sequence
  source 1..20: mol_type = other DNA
ttaatattgatatgcttata

SEQ ID NO: 84444 - DNA, 20 bp, synthetic construct
  misc_feature 1..20: note = CRISPR gRNA sequence
  source 1..20: mol_type = other DNA
taatattgatatgcttatac

SEQ ID NO: 84445 - DNA, 20 bp, synthetic construct
  misc_feature 1..20: note = CRISPR gRNA sequence
  source 1..20: mol_type = other DNA
aatattgatatgcttataca

SEQ ID NO: 84446 - DNA, 20 bp, synthetic construct
  misc_feature 1..20: note = CRISPR gRNA sequence
  source 1..20: mol_type = other DNA
atattgatatgcttatacac

SEQ ID NO: 84447 - DNA, 20 bp, synthetic construct
  misc_feature 1..20: note = CRISPR gRNA sequence
  source 1..20: mol_type = other DNA
atatgcttatacacttacac

SEQ ID NO: 84448 - DNA, 20 bp, synthetic construct
  misc_feature 1..20: note = CRISPR gRNA sequence
  source 1..20: mol_type = other DNA
atacacttacactttatgca

SEQ ID NO: 84449 - DNA, 20 bp, synthetic construct
  misc_feature 1..20: note = CRISPR gRNA sequence
  source 1..20: mol_type = other DNA
tacacttacactttatgcac

SEQ ID NO: 84450 - DNA, 20 bp, synthetic construct
  misc_feature 1..20: note = CRISPR gRNA sequence
  source 1..20: mol_type = other DNA
acactttatgcacaaaatgt

SEQ ID NO: 84451 - DNA, 20 bp, synthetic construct
  misc_feature 1..20: note = CRISPR gRNA sequence
  source 1..20: mol_type = other DNA
cactttatgcacaaaatgta

SEQ ID NO: 84452 - DNA, 20 bp, synthetic construct
  misc_feature 1..20: note = CRISPR gRNA sequence
  source 1..20: mol_type = other DNA
tatgcacaaaatgtagggtt

SEQ ID NO: 84453 - DNA, 20 bp, synthetic construct
  misc_feature 1..20: note = CRISPR gRNA sequence
  source 1..20: mol_type = other DNA
atgcacaaaatgtagggtta

SEQ ID NO: 84454 - DNA, 20 bp, synthetic construct
  misc_feature 1..20: note = CRISPR gRNA sequence
  source 1..20: mol_type = other DNA
tgcacaaaatgtagggttat

SEQ ID NO: 84455 - DNA, 20 bp, synthetic construct
  misc_feature 1..20: note = CRISPR gRNA sequence
  source 1..20: mol_type = other DNA
taataatgttaacatggaca

SEQ ID NO: 84456 - DNA, 20 bp, synthetic construct
  misc_feature 1..20: note = CRISPR gRNA sequence
  source 1..20: mol_type = other DNA
acatggacatgatcttcttt

SEQ ID NO: 84457 - DNA, 20 bp, synthetic construct
  misc_feature 1..20: note = CRISPR gRNA sequence
  source 1..20: mol_type = other DNA
ctttataattctactttgag

SEQ ID NO: 84458 - DNA, 20 bp, synthetic construct
  misc_feature 1..20: note = CRISPR gRNA sequence
  source 1..20: mol_type = other DNA
tttataattctactttgagt

SEQ ID NO: 84459 - DNA, 20 bp, synthetic construct
  misc_feature 1..20: note = CRISPR gRNA sequence
  source 1..20: mol_type = other DNA
tataattctactttgagtgc

SEQ ID NO: 84460 - DNA, 20 bp, synthetic construct
  misc_feature 1..20: note = CRISPR gRNA sequence
  source 1..20: mol_type = other DNA
ataattctactttgagtgct

SEQ ID NO: 84461 - DNA, 20 bp, synthetic construct
  misc_feature 1..20: note = CRISPR gRNA sequence
  source 1..20: mol_type = other DNA
taattctactttgagtgctg

SEQ ID NO: 84462 - DNA, 20 bp, synthetic construct
  misc_feature 1..20: note = CRISPR gRNA sequence
  source 1..20: mol_type = other DNA
tactttgagtgctgtctcca

SEQ ID NO: 84463 - DNA, 20 bp, synthetic construct
  misc_feature 1..20: note = CRISPR gRNA sequence
  source 1..20: mol_type = other DNA
ctttgagtgctgtctccatg

SEQ ID NO: 84464 - DNA, 20 bp, synthetic construct
  misc_feature 1..20: note = CRISPR gRNA sequence
  source 1..20: mol_type = other DNA
tgagtgctgtctccatgttt

SEQ ID NO: 84465 - DNA, 20 bp, synthetic construct
  misc_feature 1..20: note = CRISPR gRNA sequence
  source 1..20: mol_type = other DNA
gagtgctgtctccatgtttg

SEQ ID NO: 84466 - DNA, 20 bp, synthetic construct
  misc_feature 1..20: note = CRISPR gRNA sequence
  source 1..20: mol_type = other DNA
agtgctgtctccatgtttga

SEQ ID NO: 84467 - DNA, 20 bp, synthetic construct
  misc_feature 1..20: note = CRISPR gRNA sequence
  source 1..20: mol_type = other DNA
tctccatgtttgatgtatct

SEQ ID NO: 84468 - DNA, 20 bp, synthetic construct
  misc_feature 1..20: note = CRISPR gRNA sequence
  source 1..20: mol_type = other DNA
catgtttgatgtatctgagc

SEQ ID NO: 84469 - DNA, 20 bp, synthetic construct
  misc_feature 1..20: note = CRISPR gRNA sequence
  source 1..20: mol_type = other DNA
gatgtatctgagcaggttgc

SEQ ID NO: 84470 - DNA, 20 bp, synthetic construct
  misc_feature 1..20: note = CRISPR gRNA sequence
  source 1..20: mol_type = other DNA
atgtatctgagcaggttgct

SEQ ID NO: 84471 - DNA, 20 bp, synthetic construct
  misc_feature 1..20: note = CRISPR gRNA sequence
  source 1..20: mol_type = other DNA
agcaggttgctccacaggta

SEQ ID NO: 84472 - DNA, 20 bp, synthetic construct
  misc_feature 1..20: note = CRISPR gRNA sequence
  source 1..20: mol_type = other DNA
ctccacaggtagctctagga

SEQ ID NO: 84473 - DNA, 20 bp, synthetic construct
  misc_feature 1..20: note = CRISPR gRNA sequence
  source 1..20: mol_type = other DNA
cacaggtagctctaggaggg

SEQ ID NO: 84474 - DNA, 20 bp, synthetic construct
  misc_feature 1..20: note = CRISPR gRNA sequence
  source 1..20: mol_type = other DNA
taggagggctggcaacttag

SEQ ID NO: 84475 - DNA, 20 bp, synthetic construct
  misc_feature 1..20: note = CRISPR gRNA sequence
  source 1..20: mol_type = other DNA
ggagggctggcaacttagag

SEQ ID NO: 84476 - DNA, 20 bp, synthetic construct
  misc_feature 1..20: note = CRISPR gRNA sequence
  source 1..20: mol_type = other DNA
gcaacttagaggtggggagc

SEQ ID NO: 84477 - DNA, 20 bp, synthetic construct
  misc_feature 1..20: note = CRISPR gRNA sequence
  source 1..20: mol_type = other DNA
agaggtggggagcagagaat

SEQ ID NO: 84478 - DNA, 20 bp, synthetic construct
  misc_feature 1..20: note = CRISPR gRNA sequence
  source 1..20: mol_type = other DNA
gaggtggggagcagagaatt

SEQ ID NO: 84479 - DNA, 20 bp, synthetic construct
  misc_feature 1..20: note = CRISPR gRNA sequence
  source 1..20: mol_type = other DNA
tcttatccaacatcaacatc

SEQ ID NO: 84480 - DNA, 20 bp, synthetic construct
  misc_feature 1..20: note = CRISPR gRNA sequence
  source 1..20: mol_type = other DNA
ttatccaacatcaacatctt

SEQ ID NO: 84481 - DNA, 20 bp, synthetic construct
  misc_feature 1..20: note = CRISPR gRNA sequence
  source 1..20: mol_type = other DNA
atccaacatcaacatcttgg

SEQ ID NO: 84482 - DNA, 20 bp, synthetic construct
  misc_feature 1..20: note = CRISPR gRNA sequence
  source 1..20: mol_type = other DNA
tccaacatcaacatcttggt

SEQ ID NO: 84483 - DNA, 20 bp, synthetic construct
  misc_feature 1..20: note = CRISPR gRNA sequence
  source 1..20: mol_type = other DNA
ggtcagatttgaactcttca

SEQ ID NO: 84484 - DNA, 20 bp, synthetic construct
  misc_feature 1..20: note = CRISPR gRNA sequence
  source 1..20: mol_type = other DNA
gtcagatttgaactcttcaa

SEQ ID NO: 84485 - DNA, 20 bp, synthetic construct
  misc_feature 1..20: note = CRISPR gRNA sequence
  source 1..20: mol_type = other DNA
gaactcttcaatctcttgca

SEQ ID NO: 84486 - DNA, 20 bp, synthetic construct
  misc_feature 1..20: note = CRISPR gRNA sequence
  source 1..20: mol_type = other DNA
aactcttcaatctcttgcac

SEQ ID NO: 84487 - DNA, 20 bp, synthetic construct
  misc_feature 1..20: note = CRISPR gRNA sequence
  source 1..20: mol_type = other DNA
ttcaatctcttgcactcaaa

SEQ ID NO: 84488 - DNA, 20 bp, synthetic construct
  misc_feature 1..20: note = CRISPR gRNA sequence
  source 1..20: mol_type = other DNA
caatctcttgcactcaaagc

SEQ ID NO: 84489 - DNA, 20 bp, synthetic construct
  misc_feature 1..20: note = CRISPR gRNA sequence
  source 1..20: mol_type = other DNA
aatctcttgcactcaaagct

SEQ ID NO: 84490 - DNA, 20 bp, synthetic construct
  misc_feature 1..20: note = CRISPR gRNA sequence
  source 1..20: mol_type = other DNA
ttgcactcaaagcttgttaa

SEQ ID NO: 84491 - DNA, 20 bp, synthetic construct
  misc_feature 1..20: note = CRISPR gRNA sequence
  source 1..20: mol_type = other DNA
gcactcaaagcttgttaaga

SEQ ID NO: 84492 - DNA, 20 bp, synthetic construct
  misc_feature 1..20: note = CRISPR gRNA sequence
  source 1..20: mol_type = other DNA
cactcaaagcttgttaagat

SEQ ID NO: 84493 - DNA, 20 bp, synthetic construct
  misc_feature 1..20: note = CRISPR gRNA sequence
  source 1..20: mol_type = other DNA
aaagcttgttaagatagtta

SEQ ID NO: 84494 - DNA, 20 bp, synthetic construct
  misc_feature 1..20: note = CRISPR gRNA sequence
  source 1..20: mol_type = other DNA
gttaagatagttaagcgtgc

SEQ ID NO: 84495 - DNA, 20 bp, synthetic construct
  misc_feature 1..20: note = CRISPR gRNA sequence
  source 1..20: mol_type = other DNA
ttaagatagttaagcgtgca

SEQ ID NO: 84496 - DNA, 20 bp, synthetic construct
  misc_feature 1..20: note = CRISPR gRNA sequence
  source 1..20: mol_type = other DNA
agatagttaagcgtgcataa

SEQ ID NO: 84497 - DNA, 20 bp, synthetic construct
  misc_feature 1..20: note = CRISPR gRNA sequence
  source 1..20: mol_type = other DNA
agcgtgcataagttaacttc

SEQ ID NO: 84498 - DNA, 20 bp, synthetic construct
  misc_feature 1..20: note = CRISPR gRNA sequence
  source 1..20: mol_type = other DNA
acttccaatttacatactct

SEQ ID NO: 84499 - DNA, 20 bp, synthetic construct
  misc_feature 1..20: note = CRISPR gRNA sequence
  source 1..20: mol_type = other DNA
ccaatttacatactctgctt

SEQ ID NO: 84500 - DNA, 20 bp, synthetic construct
  misc_feature 1..20: note = CRISPR gRNA sequence
  source 1..20: mol_type = other DNA
caatttacatactctgctta

SEQ ID NO: 84501 - DNA, 20 bp, synthetic construct
  misc_feature 1..20: note = CRISPR gRNA sequence
  source 1..20: mol_type = other DNA
acatactctgcttagaattt

SEQ ID NO: 84502 - DNA, 20 bp, synthetic construct
  misc_feature 1..20: note = CRISPR gRNA sequence
  source 1..20: mol_type = other DNA
catactctgcttagaatttg

SEQ ID NO: 84503 - DNA, 20 bp, synthetic construct
  misc_feature 1..20: note = CRISPR gRNA sequence
  source 1..20: mol_type = other DNA
tgcttagaatttgggggaaa

SEQ ID NO: 84504 - DNA, 20 bp, synthetic construct
  misc_feature 1..20: note = CRISPR gRNA sequence
  source 1..20: mol_type = other DNA
cttagaatttgggggaaaat

SEQ ID NO: 84505 - DNA, 20 bp, synthetic construct
  misc_feature 1..20: note = CRISPR gRNA sequence
  source 1..20: mol_type = other DNA
agaatttgggggaaaattta

SEQ ID NO: 84506 - DNA, 20 bp, synthetic construct
  misc_feature 1..20: note = CRISPR gRNA sequence
  source 1..20: mol_type = other DNA
gaatttgggggaaaatttag

SEQ ID NO: 84507 - DNA, 20 bp, synthetic construct
  misc_feature 1..20: note = CRISPR gRNA sequence
  source 1..20: mol_type = other DNA
gggggaaaatttagaaatat

SEQ ID NO: 84508 - DNA, 20 bp, synthetic construct
  misc_feature 1..20: note = CRISPR gRNA sequence
  source 1..20: mol_type = other DNA
ggggaaaatttagaaatata

SEQ ID NO: 84509 - DNA, 20 bp, synthetic construct
  misc_feature 1..20: note = CRISPR gRNA sequence
  source 1..20: mol_type = other DNA
agaaatataattgacaggat

SEQ ID NO: 84510 - DNA, 20 bp, synthetic construct
  misc_feature 1..20: note = CRISPR gRNA sequence
  source 1..20: mol_type = other DNA
gaaatataattgacaggatt

SEQ ID NO: 84511 - DNA, 20 bp, synthetic construct
  misc_feature 1..20: note = CRISPR gRNA sequence
  source 1..20: mol_type = other DNA
acaggattattggaaatttg

SEQ ID NO: 84512 - DNA, 20 bp, synthetic construct
  misc_feature 1..20: note = CRISPR gRNA sequence
  source 1..20: mol_type = other DNA
ttggaaatttgttataatga

SEQ ID NO: 84513 - DNA, 20 bp, synthetic construct
  misc_feature 1..20: note = CRISPR gRNA sequence
  source 1..20: mol_type = other DNA
gaaatttgttataatgaatg

SEQ ID NO: 84514 - DNA, 20 bp, synthetic construct
  misc_feature 1..20: note = CRISPR gRNA sequence
  source 1..20: mol_type = other DNA
gttataatgaatgaaacatt

SEQ ID NO: 84515 - DNA, 20 bp, synthetic construct
  misc_feature 1..20: note = CRISPR gRNA sequence
  source 1..20: mol_type = other DNA
ttataatgaatgaaacattt

SEQ ID NO: 84516 - DNA, 20 bp, synthetic construct
  misc_feature 1..20: note = CRISPR gRNA sequence
  source 1..20: mol_type = other DNA
taatgaatgaaacattttgt

SEQ ID NO: 84517 - DNA, 20 bp, synthetic construct
  misc_feature 1..20: note = CRISPR gRNA sequence
  source 1..20: mol_type = other DNA
tgtcatataagattcatatt

SEQ ID NO: 84518 - DNA, 20 bp, synthetic construct
  misc_feature 1..20: note = CRISPR gRNA sequence
  source 1..20: mol_type = other DNA
gtcatataagattcatattt

SEQ ID NO: 84519 - DNA, 20 bp, synthetic construct
  misc_feature 1..20: note = CRISPR gRNA sequence
  source 1..20: mol_type = other DNA
tcatataagattcatattta

SEQ ID NO: 84520 - DNA, 20 bp, synthetic construct
  misc_feature 1..20: note = CRISPR gRNA sequence
  source 1..20: mol_type = other DNA
atatttacttcttatacatt

SEQ ID NO: 84521 - DNA, 20 bp, synthetic construct
  misc_feature 1..20: note = CRISPR gRNA sequence
  source 1..20: mol_type = other DNA
acttcttatacatttgataa

SEQ ID NO: 84522 - DNA, 20 bp, synthetic construct
  misc_feature 1..20: note = CRISPR gRNA sequence
  source 1..20: mol_type = other DNA
cttcttatacatttgataaa

SEQ ID NO: 84523 - DNA, 20 bp, synthetic construct
  misc_feature 1..20: note = CRISPR gRNA sequence
  source 1..20: mol_type = other DNA
cttatacatttgataaagta

SEQ ID NO: 84524 - DNA, 20 bp, synthetic construct
  misc_feature 1..20: note = CRISPR gRNA sequence
  source 1..20: mol_type = other DNA
ttatacatttgataaagtaa

SEQ ID NO: 84525 - DNA, 20 bp, synthetic construct
  misc_feature 1..20: note = CRISPR gRNA sequence
  source 1..20: mol_type = other DNA
atacatttgataaagtaagg

SEQ ID NO: 84526 - DNA, 20 bp, synthetic construct
  misc_feature 1..20: note = CRISPR gRNA sequence
  source 1..20: mol_type = other DNA
tacatttgataaagtaaggc

SEQ ID NO: 84527 - DNA, 20 bp, synthetic construct
  misc_feature 1..20: note = CRISPR gRNA sequence
  source 1..20: mol_type = other DNA
gataaagtaaggcatggttg

SEQ ID NO: 84528 - DNA, 20 bp, synthetic construct
  misc_feature 1..20: note = CRISPR gRNA sequence
  source 1..20: mol_type = other DNA
ataaagtaaggcatggttgt

SEQ ID NO: 84529 - DNA, 20 bp, synthetic construct
  misc_feature 1..20: note = CRISPR gRNA sequence
  source 1..20: mol_type = other DNA
tggttaatctggtttatttt

SEQ ID NO: 84530 - DNA, 20 bp, synthetic construct
  misc_feature 1..20: note = CRISPR gRNA sequence
  source 1..20: mol_type = other DNA
atctggtttatttttgttcc

SEQ ID NO: 84531 - DNA, 20 bp, synthetic construct
  misc_feature 1..20: note = CRISPR gRNA sequence
  source 1..20: mol_type = other DNA
gtttatttttgttccacaag

SEQ ID NO: 84532 - DNA, 20 bp, synthetic construct
  misc_feature 1..20: note = CRISPR gRNA sequence
  source 1..20: mol_type = other DNA
atttttgttccacaagttaa

SEQ ID NO: 84533 - DNA, 20 bp, synthetic construct
  misc_feature 1..20: note = CRISPR gRNA sequence
  source 1..20: mol_type = other DNA
tttttgttccacaagttaaa

SEQ ID NO: 84534 - DNA, 20 bp, synthetic construct
  misc_feature 1..20: note = CRISPR gRNA sequence
  source 1..20: mol_type = other DNA
ttgttccacaagttaaataa

SEQ ID NO: 84535 - DNA, 20 bp, synthetic construct
  misc_feature 1..20: note = CRISPR gRNA sequence
  source 1..20: mol_type = other DNA
tgttccacaagttaaataaa

SEQ ID NO: 84536 - DNA, 20 bp, synthetic construct
  misc_feature 1..20: note = CRISPR gRNA sequence
  source 1..20: mol_type = other DNA
gttccacaagttaaataaat

SEQ ID NO: 84537 - DNA, 20 bp, synthetic construct
  misc_feature 1..20: note = CRISPR gRNA sequence
  source 1..20: mol_type = other DNA
ttccacaagttaaataaatc

SEQ ID NO: 84538 - DNA, 20 bp, synthetic construct
  misc_feature 1..20: note = CRISPR gRNA sequence
  source 1..20: mol_type = other DNA
cacaagttaaataaatcata

SEQ ID NO: 84539 - DNA, 20 bp, synthetic construct
  misc_feature 1..20: note = CRISPR gRNA sequence
  source 1..20: mol_type = other DNA
aataaatcataaaacttgat

SEQ ID NO: 84540 - DNA, 20 bp, synthetic construct
  misc_feature 1..20: note = CRISPR gRNA sequence
  source 1..20: mol_type = other DNA
gatgtgttatctcttatatc

SEQ ID NO: 84541 - DNA, 20 bp, synthetic construct
  misc_feature 1..20: note = CRISPR gRNA sequence
  source 1..20: mol_type = other DNA
atgtgttatctcttatatct

SEQ ID NO: 84542 - DNA, 20 bp, synthetic construct
  misc_feature 1..20: note = CRISPR gRNA sequence
  source 1..20: mol_type = other DNA
tctcttatatctcactccca

SEQ ID NO: 84543 - DNA, 20 bp, synthetic construct
  misc_feature 1..20: note = CRISPR gRNA sequence
  source 1..20: mol_type = other DNA
ttatatctcactcccactat

SEQ ID NO: 84544 - DNA, 20 bp, synthetic construct
  misc_feature 1..20: note = CRISPR gRNA sequence
  source 1..20: mol_type = other DNA
atatctcactcccactatta

SEQ ID NO: 84545 - DNA, 20 bp, synthetic construct
  misc_feature 1..20: note = CRISPR gRNA sequence
  source 1..20: mol_type = other DNA
tatctcactcccactattac

SEQ ID NO: 84546 - DNA, 20 bp, synthetic construct
  misc_feature 1..20: note = CRISPR gRNA sequence
  source 1..20: mol_type = other DNA
actcccactattaccccttt

SEQ ID NO: 84547 - DNA, 20 bp, synthetic construct
  misc_feature 1..20: note = CRISPR gRNA sequence
  source 1..20: mol_type = other DNA
ccactattacccctttattt

SEQ ID NO: 84548 - DNA, 20 bp, synthetic construct
  misc_feature 1..20: note = CRISPR gRNA sequence
  source 1..20: mol_type = other DNA
ttacccctttattttcaaac

SEQ ID NO: 84549 - DNA, 20 bp, synthetic construct
  misc_feature 1..20: note = CRISPR gRNA sequence
  source 1..20: mol_type = other DNA
cccctttattttcaaacagg

SEQ ID NO: 84550 - DNA, 20 bp, synthetic construct
  misc_feature 1..20: note = CRISPR gRNA sequence
  source 1..20: mol_type = other DNA
tattttcaaacagggaaaca

SEQ ID NO: 84551 - DNA, 20 bp, synthetic construct
  misc_feature 1..20: note = CRISPR gRNA sequence
  source 1..20: mol_type = other DNA
attttcaaacagggaaacag

SEQ ID NO: 84552 - DNA, 20 bp, synthetic construct
  misc_feature 1..20: note = CRISPR gRNA sequence
  source 1..20: mol_type = other DNA
ttttcaaacagggaaacagt

SEQ ID NO: 84553 - DNA, 20 bp, synthetic construct
  misc_feature 1..20: note = CRISPR gRNA sequence
  source 1..20: mol_type = other DNA
tcaaacagggaaacagtctt

SEQ ID NO: 84554 - DNA, 20 bp, synthetic construct
  misc_feature 1..20: note = CRISPR gRNA sequence
  source 1..20: mol_type = other DNA
caaacagggaaacagtcttc

SEQ ID NO: 84555 - DNA, 20 bp, synthetic construct
  misc_feature 1..20: note = CRISPR gRNA sequence
  source 1..20: mol_type = other DNA
aaacagggaaacagtcttca

SEQ ID NO: 84556 - DNA, 20 bp, synthetic construct
  misc_feature 1..20: note = CRISPR gRNA sequence
  source 1..20: mol_type = other DNA
caagttccacttggtaaaaa

SEQ ID NO: 84557 - DNA, 20 bp, synthetic construct
  misc_feature 1..20: note = CRISPR gRNA sequence
  source 1..20: mol_type = other DNA
aagttccacttggtaaaaaa

SEQ ID NO: 84558 - DNA, 20 bp, synthetic construct
  misc_feature 1..20: note = CRISPR gRNA sequence
  source 1..20: mol_type = other DNA
cacttggtaaaaaatgtgaa

SEQ ID NO: 84559 - DNA, 20 bp, synthetic construct
  misc_feature 1..20: note = CRISPR gRNA sequence
  source 1..20: mol_type = other DNA
ggtaaaaaatgtgaacccct

SEQ ID NO: 84560 - DNA, 20 bp, synthetic construct
  misc_feature 1..20: note = CRISPR gRNA sequence
  source 1..20: mol_type = other DNA
gtaaaaaatgtgaacccctt

SEQ ID NO: 84561 - DNA, 20 bp, synthetic construct
  misc_feature 1..20: note = CRISPR gRNA sequence
  source 1..20: mol_type = other DNA
tatatacaaggggttcacat

SEQ ID NO: 84562 - DNA, 20 bp, synthetic construct
  misc_feature 1..20: note = CRISPR gRNA sequence
  source 1..20: mol_type = other DNA
tatacaaggggttcacattt

SEQ ID NO: 84563 - DNA, 20 bp, synthetic construct
  misc_feature 1..20: note = CRISPR gRNA sequence
  source 1..20: mol_type = other DNA
acattttttaccaagtggaa

SEQ ID NO: 84564 - DNA, 20 bp, synthetic construct
  misc_feature 1..20: note = CRISPR gRNA sequence
  source 1..20: mol_type = other DNA
tttaccaagtggaacttgaa

SEQ ID NO: 84565 - DNA, 20 bp, synthetic construct
  misc_feature 1..20: note = CRISPR gRNA sequence
  source 1..20: mol_type = other DNA
ttaccaagtggaacttgaag

SEQ ID NO: 84566 - DNA, 20 bp, synthetic construct
  misc_feature 1..20: note = CRISPR gRNA sequence
  source 1..20: mol_type = other DNA
taccaagtggaacttgaaga

SEQ ID NO: 84567 - DNA, 20 bp, synthetic construct
  misc_feature 1..20: note = CRISPR gRNA sequence
  source 1..20: mol_type = other DNA
accaagtggaacttgaagac

SEQ ID NO: 84568 - DNA, 20 bp, synthetic construct
  misc_feature 1..20: note = CRISPR gRNA sequence
  source 1..20: mol_type = other DNA
ccaagtggaacttgaagact

SEQ ID NO: 84569 - DNA, 20 bp, synthetic construct
  misc_feature 1..20: note = CRISPR gRNA sequence
  source 1..20: mol_type = other DNA
gaagactgtttccctgtttg

SEQ ID NO: 84570 - DNA, 20 bp, synthetic construct
  misc_feature 1..20: note = CRISPR gRNA sequence
  source 1..20: mol_type = other DNA
aagactgtttccctgtttga

SEQ ID NO: 84571 - DNA, 20 bp, synthetic construct
  misc_feature 1..20: note = CRISPR gRNA sequence
  source 1..20: mol_type = other DNA
tttccctgtttgaaaataaa

SEQ ID NO: 84572 - DNA, 20 bp, synthetic construct
  misc_feature 1..20: note = CRISPR gRNA sequence
  source 1..20: mol_type = other DNA
ccctgtttgaaaataaaggg

SEQ ID NO: 84573 - DNA, 20 bp, synthetic construct
  misc_feature 1..20: note = CRISPR gRNA sequence
  source 1..20: mol_type = other DNA
cctgtttgaaaataaagggg

SEQ ID NO: 84574 - DNA, 20 bp, synthetic construct
  misc_feature 1..20: note = CRISPR gRNA sequence
  source 1..20: mol_type = other DNA
tttgaaaataaaggggtaat

SEQ ID NO: 84575 - DNA, 20 bp, synthetic construct
  misc_feature 1..20: note = CRISPR gRNA sequence
  source 1..20: mol_type = other DNA
gaaaataaaggggtaatagt

SEQ ID NO: 84576 - DNA, 20 bp, synthetic construct
  misc_feature 1..20: note = CRISPR gRNA sequence
  source 1..20: mol_type = other DNA
aaaataaaggggtaatagtg

SEQ ID NO: 84577 - DNA, 20 bp, synthetic construct
  misc_feature 1..20: note = CRISPR gRNA sequence
  source 1..20: mol_type = other DNA
tatgatttatttaacttgtg

SEQ ID NO: 84578 - DNA, 20 bp, synthetic construct
  misc_feature 1..20: note = CRISPR gRNA sequence
  source 1..20: mol_type = other DNA
atgatttatttaacttgtgg

SEQ ID NO: 84579 - DNA, 20 bp, synthetic construct
  misc_feature 1..20: note = CRISPR gRNA sequence
  source 1..20: mol_type = other DNA
tgatttatttaacttgtgga

SEQ ID NO: 84580 - DNA, 20 bp, synthetic construct
  misc_feature 1..20: note = CRISPR gRNA sequence
  source 1..20: mol_type = other DNA
atttaacttgtggaacaaaa

SEQ ID NO: 84581 - DNA, 20 bp, synthetic construct
  misc_feature 1..20: note = CRISPR gRNA sequence
  source 1..20: mol_type = other DNA
tttaacttgtggaacaaaaa

SEQ ID NO: 84582 - DNA, 20 bp, synthetic construct
  misc_feature 1..20: note = CRISPR gRNA sequence
  source 1..20: mol_type = other DNA
aacttgtggaacaaaaataa

SEQ ID NO: 84583 - DNA, 20 bp, synthetic construct
  misc_feature 1..20: note = CRISPR gRNA sequence
  source 1..20: mol_type = other DNA
acttgtggaacaaaaataaa

SEQ ID NO: 84584 - DNA, 20 bp, synthetic construct
  misc_feature 1..20: note = CRISPR gRNA sequence
  source 1..20: mol_type = other DNA
gtggaacaaaaataaaccag

SEQ ID NO: 84585 - DNA, 20 bp, synthetic construct
  misc_feature 1..20: note = CRISPR gRNA sequence
  source 1..20: mol_type = other DNA
tggaacaaaaataaaccaga

SEQ ID NO: 84586 - DNA, 20 bp, synthetic construct
  misc_feature 1..20: note = CRISPR gRNA sequence
  source 1..20: mol_type = other DNA
accacaaccatgccttactt

SEQ ID NO: 84587 - DNA, 20 bp, synthetic construct
  misc_feature 1..20: note = CRISPR gRNA sequence
  source 1..20: mol_type = other DNA
actttatcaaatgtataaga

SEQ ID NO: 84588 - DNA, 20 bp, synthetic construct
  misc_feature 1..20: note = CRISPR gRNA sequence
  source 1..20: mol_type = other DNA
ctttatcaaatgtataagaa

SEQ ID NO: 84589 - DNA, 20 bp, synthetic construct
  misc_feature 1..20: note = CRISPR gRNA sequence
  source 1..20: mol_type = other DNA
tatcaaatgtataagaagta

SEQ ID NO: 84590 - DNA, 20 bp, synthetic construct
  misc_feature 1..20: note = CRISPR gRNA sequence
  source 1..20: mol_type = other DNA
atcaaatgtataagaagtaa

SEQ ID NO: 84591 - DNA, 20 bp, synthetic construct
  misc_feature 1..20: note = CRISPR gRNA sequence
  source 1..20: mol_type = other DNA
tcaaatgtataagaagtaaa

SEQ ID NO: 84592 - DNA, 20 bp, synthetic construct
  misc_feature 1..20: note = CRISPR gRNA sequence
  source 1..20: mol_type = other DNA
atatgacaaaatgtttcatt

SEQ ID NO: 84593 - DNA, 20 bp, synthetic construct
  misc_feature 1..20: note = CRISPR gRNA sequence
  source 1..20: mol_type = other DNA
tatgacaaaatgtttcattc

SEQ ID NO: 84594 - DNA, 20 bp, synthetic construct
  misc_feature 1..20: note = CRISPR gRNA sequence
  source 1..20: mol_type = other DNA
cattcattataacaaatttc

SEQ ID NO: 84595 - DNA, 20 bp, synthetic construct
  misc_feature 1..20: note = CRISPR gRNA sequence
  source 1..20: mol_type = other DNA
attcattataacaaatttcc

SEQ ID NO: 84596 - DNA, 20 bp, synthetic construct
  misc_feature 1..20: note = CRISPR gRNA sequence
  source 1..20: mol_type = other DNA
attataacaaatttccaata

SEQ ID NO: 84597 - DNA, 20 bp, synthetic construct
  misc_feature 1..20: note = CRISPR gRNA sequence
  source 1..20: mol_type = other DNA
taacaaatttccaataatcc

SEQ ID NO: 84598 - DNA, 20 bp, synthetic construct
  misc_feature 1..20: note = CRISPR gRNA sequence
  source 1..20: mol_type = other DNA
ccaataatcctgtcaattat

SEQ ID NO: 84599 - DNA, 20 bp, synthetic construct
  misc_feature 1..20: note = CRISPR gRNA sequence
  source 1..20: mol_type = other DNA
caataatcctgtcaattata

SEQ ID NO: 84600 - DNA, 20 bp, synthetic construct
  misc_feature 1..20: note = CRISPR gRNA sequence
  source 1..20: mol_type = other DNA
tcaattatatttctaaattt

SEQ ID NO: 84601 - DNA, 20 bp, synthetic construct
  misc_feature 1..20: note = CRISPR gRNA sequence
  source 1..20: mol_type = other DNA
tatttctaaattttccccca

SEQ ID NO: 84602 - DNA, 20 bp, synthetic construct
  misc_feature 1..20: note = CRISPR gRNA sequence
  source 1..20: mol_type = other DNA
ctaaattttcccccaaattc

SEQ ID NO: 84603 - DNA, 20 bp, synthetic construct
  misc_feature 1..20: note = CRISPR gRNA sequence
  source 1..20: mol_type = other DNA
taaattttcccccaaattct

SEQ ID NO: 84604 - DNA, 20 bp, synthetic construct
  misc_feature 1..20: note = CRISPR gRNA sequence
  source 1..20: mol_type = other DNA
aattttcccccaaattctaa

SEQ ID NO: 84605 - DNA, 20 bp, synthetic construct
  misc_feature 1..20: note = CRISPR gRNA sequence
  source 1..20: mol_type = other DNA
tcccccaaattctaagcaga

SEQ ID NO: 84606 - DNA, 20 bp, synthetic construct
  misc_feature 1..20: note = CRISPR gRNA sequence
  source 1..20: mol_type = other DNA
cccccaaattctaagcagag

SEQ ID NO: 84607 - DNA, 20 bp, synthetic construct
  misc_feature 1..20: note = CRISPR gRNA sequence
  source 1..20: mol_type = other DNA
ccccaaattctaagcagagt

SEQ ID NO: 84608 - DNA, 20 bp, synthetic construct
  misc_feature 1..20: note = CRISPR gRNA sequence
  source 1..20: mol_type = other DNA
taagcagagtatgtaaattg

SEQ ID NO: 84609 - DNA, 20 bp, synthetic construct
  misc_feature 1..20: note = CRISPR gRNA sequence
  source 1..20: mol_type = other DNA
agcagagtatgtaaattgga

SEQ ID NO: 84610 - DNA, 20 bp, synthetic construct
  misc_feature 1..20: note = CRISPR gRNA sequence
  source 1..20: mol_type = other DNA
gaagttaacttatgcacgct

SEQ ID NO: 84611 - DNA, 20 bp, synthetic construct
  misc_feature 1..20: note = CRISPR gRNA sequence
  source 1..20: mol_type = other DNA
acttatgcacgcttaactat

SEQ ID NO: 84612 - DNA, 20 bp, synthetic construct
  misc_feature 1..20: note = CRISPR gRNA sequence
  source 1..20: mol_type = other DNA
atgcacgcttaactatctta

SEQ ID NO: 84613 - DNA, 20 bp, synthetic construct
  misc_feature 1..20: note = CRISPR gRNA sequence
  source 1..20: mol_type = other DNA
tgcacgcttaactatcttaa

SEQ ID NO: 84614 - DNA, 20 bp, synthetic construct
  misc_feature 1..20: note = CRISPR gRNA sequence
  source 1..20: mol_type = other DNA
aactatcttaacaagctttg

SEQ ID NO: 84615 - DNA, 20 bp, synthetic construct
  misc_feature 1..20: note = CRISPR gRNA sequence
  source 1..20: mol_type = other DNA
actatcttaacaagctttga

SEQ ID NO: 84616 - DNA, 20 bp, synthetic construct
  misc_feature 1..20: note = CRISPR gRNA sequence
  source 1..20: mol_type = other DNA
tcttaacaagctttgagtgc

SEQ ID NO: 84617 - DNA, 20 bp, synthetic construct
  misc_feature 1..20: note = CRISPR gRNA sequence
  source 1..20: mol_type = other DNA
aacaagctttgagtgcaaga

SEQ ID NO: 84618 - DNA, 20 bp, synthetic construct
  misc_feature 1..20: note = CRISPR gRNA sequence
  source 1..20: mol_type = other DNA
acaagctttgagtgcaagag

SEQ ID NO: 84619 - DNA, 20 bp, synthetic construct
  misc_feature 1..20: note = CRISPR gRNA sequence
  source 1..20: mol_type = other DNA
tgagtgcaagagattgaaga

SEQ ID NO: 84620 - DNA, 20 bp, synthetic construct
  misc_feature 1..20: note = CRISPR gRNA sequence
  source 1..20: mol_type = other DNA
gagtgcaagagattgaagag

SEQ ID NO: 84621 - DNA, 20 bp, synthetic construct
  misc_feature 1..20: note = CRISPR gRNA sequence
  source 1..20: mol_type = other DNA
agtgcaagagattgaagagt

SEQ ID NO: 84622 - DNA, 20 bp, synthetic construct
  misc_feature 1..20: note = CRISPR gRNA sequence
  source 1..20: mol_type = other DNA
aagagttcaaatctgaccaa

SEQ ID NO: 84623 - DNA, 20 bp, synthetic construct
  misc_feature 1..20: note = CRISPR gRNA sequence
  source 1..20: mol_type = other DNA
aaatctgaccaagatgttga

SEQ ID NO: 84624 - DNA, 20 bp, synthetic construct
  misc_feature 1..20: note = CRISPR gRNA sequence
  source 1..20: mol_type = other DNA
accaagatgttgatgttgga

SEQ ID NO: 84625 - DNA, 20 bp, synthetic construct
  misc_feature 1..20: note = CRISPR gRNA sequence
  source 1..20: mol_type = other DNA
atgttggataagagaattct

SEQ ID NO: 84626 - DNA, 20 bp, synthetic construct
  misc_feature 1..20: note = CRISPR gRNA sequence
  source 1..20: mol_type = other DNA
gataagagaattctctgctc

SEQ ID NO: 84627 - DNA, 20 bp, synthetic construct
  misc_feature 1..20: note = CRISPR gRNA sequence
  source 1..20: mol_type = other DNA
tctgctccccacctctaagt

SEQ ID NO: 84628 - DNA, 20 bp, synthetic construct
  misc_feature 1..20: note = CRISPR gRNA sequence
  source 1..20: mol_type = other DNA
tgctccccacctctaagttg

SEQ ID NO: 84629 - DNA, 20 bp, synthetic construct
  misc_feature 1..20: note = CRISPR gRNA sequence
  source 1..20: mol_type = other DNA
ctccccacctctaagttgcc

SEQ ID NO: 84630 - DNA, 20 bp, synthetic construct
  misc_feature 1..20: note = CRISPR gRNA sequence
  source 1..20: mol_type = other DNA
cccacctctaagttgccagc

SEQ ID NO: 84631 - DNA, 20 bp, synthetic construct
  misc_feature 1..20: note = CRISPR gRNA sequence
  source 1..20: mol_type = other DNA
taagttgccagccctcctag

SEQ ID NO: 84632 - DNA, 20 bp, synthetic construct
  misc_feature 1..20: note = CRISPR gRNA sequence
  source 1..20: mol_type = other DNA
agttgccagccctcctagag

SEQ ID NO: 84633 - DNA, 20 bp, synthetic construct
  misc_feature 1..20: note = CRISPR gRNA sequence
  source 1..20: mol_type = other DNA
ccagccctcctagagctacc

SEQ ID NO: 84634 - DNA, 20 bp, synthetic construct
  misc_feature 1..20: note = CRISPR gRNA sequence
  source 1..20: mol_type = other DNA
ctagagctacctgtggagca

SEQ ID NO: 84635 - DNA, 20 bp, synthetic construct
  misc_feature 1..20: note = CRISPR gRNA sequence
  source 1..20: mol_type = other DNA
gagctacctgtggagcaacc

SEQ ID NO: 84636 - DNA, 20 bp, synthetic construct
  misc_feature 1..20: note = CRISPR gRNA sequence
  source 1..20: mol_type = other DNA
cctgtggagcaacctgctca

SEQ ID NO: 84637 - DNA, 20 bp, synthetic construct
  misc_feature 1..20: note = CRISPR gRNA sequence
  source 1..20: mol_type = other DNA
tggagcaacctgctcagata

SEQ ID NO: 84638 - DNA, 20 bp, synthetic construct
  misc_feature 1..20: note = CRISPR gRNA sequence
  source 1..20: mol_type = other DNA
ctcagatacatcaaacatgg

SEQ ID NO: 84639 - DNA, 20 bp, synthetic construct
  misc_feature 1..20: note = CRISPR gRNA sequence
  source 1..20: mol_type = other DNA
agatacatcaaacatggaga

SEQ ID NO: 84640 - DNA, 20 bp, synthetic construct
  misc_feature 1..20: note = CRISPR gRNA sequence
  source 1..20: mol_type = other DNA
aaagtagaattataaagaag

SEQ ID NO: 84641 - DNA, 20 bp, synthetic construct
  misc_feature 1..20: note = CRISPR gRNA sequence
  source 1..20: mol_type = other DNA
taaagaagatcatgtccatg

SEQ ID NO: 84642 - DNA, 20 bp, synthetic construct
  misc_feature 1..20: note = CRISPR gRNA sequence
  source 1..20: mol_type = other DNA
acattattataaccctacat

SEQ ID NO: 84643 - DNA, 20 bp, synthetic construct
  misc_feature 1..20: note = CRISPR gRNA sequence
  source 1..20: mol_type = other DNA
ttataaccctacattttgtg

SEQ ID NO: 84644 - DNA, 20 bp, synthetic construct
  misc_feature 1..20: note = CRISPR gRNA sequence
  source 1..20: mol_type = other DNA
taaccctacattttgtgcat

SEQ ID NO: 84645 - DNA, 20 bp, synthetic construct
  misc_feature 1..20: note = CRISPR gRNA sequence
  source 1..20: mol_type = other DNA
cattttgtgcataaagtgta

SEQ ID NO: 84646 - DNA, 20 bp, synthetic construct
  misc_feature 1..20: note = CRISPR gRNA sequence
  source 1..20: mol_type = other DNA
tgtgcataaagtgtaagtgt

SEQ ID NO: 84647 - DNA, 20 bp, synthetic construct
  misc_feature 1..20: note = CRISPR gRNA sequence
  source 1..20: mol_type = other DNA
gtgcataaagtgtaagtgta

SEQ ID NO: 84648 - DNA, 20 bp, synthetic construct
  misc_feature 1..20: note = CRISPR gRNA sequence
  source 1..20: mol_type = other DNA
tgcataaagtgtaagtgtat

SEQ ID NO: 84649 - DNA, 20 bp, synthetic construct
  misc_feature 1..20: note = CRISPR gRNA sequence
  source 1..20: mol_type = other DNA
aaaagcaagcaagcagaatt

SEQ ID NO: 84650 - DNA, 20 bp, synthetic construct
  misc_feature 1..20: note = CRISPR gRNA sequence
  source 1..20: mol_type = other DNA
ggaattcatccaatccaaat

SEQ ID NO: 84651 - DNA, 20 bp, synthetic construct
  misc_feature 1..20: note = CRISPR gRNA sequence
  source 1..20: mol_type = other DNA
gaattcatccaatccaaatg

SEQ ID NO: 84652 - DNA, 20 bp, synthetic construct
  misc_feature 1..20: note = CRISPR gRNA sequence
  source 1..20: mol_type = other DNA
atccaatccaaatgcggcat

SEQ ID NO: 84653 - DNA, 20 bp, synthetic construct
  misc_feature 1..20: note = CRISPR gRNA sequence
  source 1..20: mol_type = other DNA
caaacctgaaaagaaaagaa

SEQ ID NO: 84654 - DNA, 20 bp, synthetic construct
  misc_feature 1..20: note = CRISPR gRNA sequence
  source 1..20: mol_type = other DNA
aaacctgaaaagaaaagaaa

SEQ ID NO: 84655 - DNA, 20 bp, synthetic construct
  misc_feature 1..20: note = CRISPR gRNA sequence
  source 1..20: mol_type = other DNA
aaaagaaaagaaaaaggtta

SEQ ID NO: 84656 - DNA, 20 bp, synthetic construct
  misc_feature 1..20: note = CRISPR gRNA sequence
  source 1..20: mol_type = other DNA
gcaatgaatttattttattt

SEQ ID NO: 84657 - DNA, 20 bp, synthetic construct
  misc_feature 1..20: note = CRISPR gRNA sequence
  source 1..20: mol_type = other DNA
attttatttggattgcagat

SEQ ID NO: 84658 - DNA, 20 bp, synthetic construct
  misc_feature 1..20: note = CRISPR gRNA sequence
  source 1..20: mol_type = other DNA
ttttatttggattgcagatc

SEQ ID NO: 84659 - DNA, 20 bp, synthetic construct
  misc_feature 1..20: note = CRISPR gRNA sequence
  source 1..20: mol_type = other DNA
tatttggattgcagatctca

SEQ ID NO: 84660 - DNA, 20 bp, synthetic construct
  misc_feature 1..20: note = CRISPR gRNA sequence
  source 1..20: mol_type = other DNA
atttggattgcagatctcat

SEQ ID NO: 84661 - DNA, 20 bp, synthetic construct
  misc_feature 1..20: note = CRISPR gRNA sequence
  source 1..20: mol_type = other DNA
tttggattgcagatctcatt

SEQ ID NO: 84662 - DNA, 20 bp, synthetic construct
  misc_feature 1..20: note = CRISPR gRNA sequence
  source 1..20: mol_type = other DNA
ggattgcagatctcattacc

SEQ ID NO: 84663 - DNA, 20 bp, synthetic construct
  misc_feature 1..20: note = CRISPR gRNA sequence
  source 1..20: mol_type = other DNA
gattgcagatctcattacca

SEQ ID NO: 84664 - DNA, 20 bp, synthetic construct
  misc_feature 1..20: note = CRISPR gRNA sequence
  source 1..20: mol_type = other DNA
cagatctcattaccaaactt

SEQ ID NO: 84665 - DNA, 20 bp, synthetic construct
  misc_feature 1..20: note = CRISPR gRNA sequence
  source 1..20: mol_type = other DNA
attaccaaacttgtctaatt

SEQ ID NO: 84666 - DNA, 20 bp, synthetic construct
  misc_feature 1..20: note = CRISPR gRNA sequence
  source 1..20: mol_type = other DNA
ccaaacttgtctaatttcta

SEQ ID NO: 84667 - DNA, 20 bp, synthetic construct
  misc_feature 1..20: note = CRISPR gRNA sequence
  source 1..20: mol_type = other DNA
gtctaatttctactgtgtag

SEQ ID NO: 84668 - DNA, 20 bp, synthetic construct
  misc_feature 1..20: note = CRISPR gRNA sequence
  source 1..20: mol_type = other DNA
tctaatttctactgtgtaga

SEQ ID NO: 84669 - DNA, 20 bp, synthetic construct
  misc_feature 1..20: note = CRISPR gRNA sequence
  source 1..20: mol_type = other DNA
atttctactgtgtagatcac

SEQ ID NO: 84670 - DNA, 20 bp, synthetic construct
  misc_feature 1..20: note = CRISPR gRNA sequence
  source 1..20: mol_type = other DNA
ctactgtgtagatcaccttt

SEQ ID NO: 84671 - DNA, 20 bp, synthetic construct
  misc_feature 1..20: note = CRISPR gRNA sequence
  source 1..20: mol_type = other DNA
tactgtgtagatcacctttt

SEQ ID NO: 84672 - DNA, 20 bp, synthetic construct
  misc_feature 1..20: note = CRISPR gRNA sequence
  source 1..20: mol_type = other DNA
ctgtgtagatcaccttttta

SEQ ID NO: 84673 - DNA, 20 bp, synthetic construct
  misc_feature 1..20: note = CRISPR gRNA sequence
  source 1..20: mol_type = other DNA
tgtagatcacctttttaaaa

SEQ ID NO: 84674 - DNA, 20 bp, synthetic construct
  misc_feature 1..20: note = CRISPR gRNA sequence
  source 1..20: mol_type = other DNA
tttaaaagaagtagctgcag

SEQ ID NO: 84675 - DNA, 20 bp, synthetic construct
  misc_feature 1..20: note = CRISPR gRNA sequence
  source 1..20: mol_type = other DNA
ttaaaagaagtagctgcaga

SEQ ID NO: 84676 - DNA, 20 bp, synthetic construct
  misc_feature 1..20: note = CRISPR gRNA sequence
  source 1..20: mol_type = other DNA
taaaagaagtagctgcagac

SEQ ID NO: 84677 - DNA, 20 bp, synthetic construct
  misc_feature 1..20: note = CRISPR gRNA sequence
  source 1..20: mol_type = other DNA
aaaagaagtagctgcagaca

SEQ ID NO: 84678 - DNA, 20 bp, synthetic construct
  misc_feature 1..20: note = CRISPR gRNA sequence
  source 1..20: mol_type = other DNA
aaagaagtagctgcagacag

SEQ ID NO: 84679 - DNA, 20 bp, synthetic construct
  misc_feature 1..20: note = CRISPR gRNA sequence
  source 1..20: mol_type = other DNA
cagacagttctccaaaccca

SEQ ID NO: 84680 - DNA, 20 bp, synthetic construct
  misc_feature 1..20: note = CRISPR gRNA sequence
  source 1..20: mol_type = other DNA
tccaaacccattataaagag

SEQ ID NO: 84681 - DNA, 20 bp, synthetic construct
  misc_feature 1..20: note = CRISPR gRNA sequence
  source 1..20: mol_type = other DNA
caaacccattataaagagta

SEQ ID NO: 84682 - DNA, 20 bp, synthetic construct
  misc_feature 1..20: note = CRISPR gRNA sequence
  source 1..20: mol_type = other DNA
taaagagtatatcctgttag

SEQ ID NO: 84683 - DNA, 20 bp, synthetic construct
  misc_feature 1..20: note = CRISPR gRNA sequence
  source 1..20: mol_type = other DNA
ttagtgtatccctttggtgc

SEQ ID NO: 84684 - DNA, 20 bp, synthetic construct
  misc_feature 1..20: note = CRISPR gRNA sequence
  source 1..20: mol_type = other DNA
gtgtatccctttggtgctcc

SEQ ID NO: 84685 - DNA, 20 bp, synthetic construct
  misc_feature 1..20: note = CRISPR gRNA sequence
  source 1..20: mol_type = other DNA
tggtgctcccaaaatcttag

SEQ ID NO: 84686 - DNA, 20 bp, synthetic construct
  misc_feature 1..20: note = CRISPR gRNA sequence
  source 1..20: mol_type = other DNA
ggtgctcccaaaatcttaga

SEQ ID NO: 84687 - DNA, 20 bp, synthetic construct
  misc_feature 1..20: note = CRISPR gRNA sequence
  source 1..20: mol_type = other DNA
gtgctcccaaaatcttagaa

SEQ ID NO: 84688 - DNA, 20 bp, synthetic construct
  misc_feature 1..20: note = CRISPR gRNA sequence
  source 1..20: mol_type = other DNA
ccaaaatcttagaagaaaaa

SEQ ID NO: 84689 - DNA, 20 bp, synthetic construct
  misc_feature 1..20: note = CRISPR gRNA sequence
  source 1..20: mol_type = other DNA
agaagaaaaaatgctgatat

SEQ ID NO: 84690 - DNA, 20 bp, synthetic construct
  misc_feature 1..20: note = CRISPR gRNA sequence
  source 1..20: mol_type = other DNA
gaagaaaaaatgctgatatg

SEQ ID NO: 84691 - DNA, 20 bp, synthetic construct
  misc_feature 1..20: note = CRISPR gRNA sequence
  source 1..20: mol_type = other DNA
atatgatgttttggtcaatg

SEQ ID NO: 84692 - DNA, 20 bp, synthetic construct
  misc_feature 1..20: note = CRISPR gRNA sequence
  source 1..20: mol_type = other DNA
tggtcaatgatggactgtat

SEQ ID NO: 84693 - DNA, 20 bp, synthetic construct
  misc_feature 1..20: note = CRISPR gRNA sequence
  source 1..20: mol_type = other DNA
ggtcaatgatggactgtata

SEQ ID NO: 84694 - DNA, 20 bp, synthetic construct
  misc_feature 1..20: note = CRISPR gRNA sequence
  source 1..20: mol_type = other DNA
gtcaatgatggactgtatat

SEQ ID NO: 84695 - DNA, 20 bp, synthetic construct
  misc_feature 1..20: note = CRISPR gRNA sequence
  source 1..20: mol_type = other DNA
tatatatgacagtggtctca

SEQ ID NO: 84696 - DNA, 20 bp, synthetic construct
  misc_feature 1..20: note = CRISPR gRNA sequence
  source 1..20: mol_type = other DNA
ataagattaaaatagcatat

SEQ ID NO: 84697 - DNA, 20 bp, synthetic construct
  misc_feature 1..20: note = CRISPR gRNA sequence
  source 1..20: mol_type = other DNA
aaatagcatatttttactgc

SEQ ID NO: 84698 - DNA, 20 bp, synthetic construct
  misc_feature 1..20: note = CRISPR gRNA sequence
  source 1..20: mol_type = other DNA
ttactgcaacttctatgttt

SEQ ID NO: 84699 - DNA, 20 bp, synthetic construct
  misc_feature 1..20: note = CRISPR gRNA sequence
  source 1..20: mol_type = other DNA
tactgcaacttctatgttta

SEQ ID NO: 84700 - DNA, 20 bp, synthetic construct
  misc_feature 1..20: note = CRISPR gRNA sequence
  source 1..20: mol_type = other DNA
actgcaacttctatgtttag

SEQ ID NO: 84701 - DNA, 20 bp, synthetic construct
  misc_feature 1..20: note = CRISPR gRNA sequence
  source 1..20: mol_type = other DNA
ctgcaacttctatgtttaga

SEQ ID NO: 84702 - DNA, 20 bp, synthetic construct
  misc_feature 1..20: note = CRISPR gRNA sequence
  source 1..20: mol_type = other DNA
caacttctatgtttagatac

SEQ ID NO: 84703 - DNA, 20 bp, synthetic construct
  misc_feature 1..20: note = CRISPR gRNA sequence
  source 1..20: mol_type = other DNA
ctatgtttagatacacaaat

SEQ ID NO: 84704 - DNA, 20 bp, synthetic construct
  misc_feature 1..20: note = CRISPR gRNA sequence
  source 1..20: mol_type = other DNA
tatgtttagatacacaaata

SEQ ID NO: 84705 - DNA, 20 bp, synthetic construct
  misc_feature 1..20: note = CRISPR gRNA sequence
  source 1..20: mol_type = other DNA
tgtttagatacacaaatact

SEQ ID NO: 84706 - DNA, 20 bp, synthetic construct
  misc_feature 1..20: note = CRISPR gRNA sequence
  source 1..20: mol_type = other DNA
agatacacaaatacttacca

SEQ ID NO: 84707 - DNA, 20 bp, synthetic construct
  misc_feature 1..20: note = CRISPR gRNA sequence
  source 1..20: mol_type = other DNA
gatacacaaatacttaccat

SEQ ID NO: 84708 - DNA, 20 bp, synthetic construct
  misc_feature 1..20: note = CRISPR gRNA sequence
  source 1..20: mol_type = other DNA
accattgtgttacaactgcc

SEQ ID NO: 84709 - DNA, 20 bp, synthetic construct
  misc_feature 1..20: note = CRISPR gRNA sequence
  source 1..20: mol_type = other DNA
ccattgtgttacaactgccc

SEQ ID NO: 84710 - DNA, 20 bp, synthetic construct
  misc_feature 1..20: note = CRISPR gRNA sequence
  source 1..20: mol_type = other DNA
tgttacaactgcccacagta

SEQ ID NO: 84711 - DNA, 20 bp, synthetic construct
  misc_feature 1..20: note = CRISPR gRNA sequence
  source 1..20: mol_type = other DNA
caactgcccacagtattcag

SEQ ID NO: 84712 - DNA, 20 bp, synthetic construct
  misc_feature 1..20: note = CRISPR gRNA sequence
  source 1..20: mol_type = other DNA
cccacagtattcagtacagt

SEQ ID NO: 84713 - DNA, 20 bp, synthetic construct
  misc_feature 1..20: note = CRISPR gRNA sequence
  source 1..20: mol_type = other DNA
agtacagtaacaggctgtac

SEQ ID NO: 84714 - DNA, 20 bp, synthetic construct
  misc_feature 1..20: note = CRISPR gRNA sequence
  source 1..20: mol_type = other DNA
tacaggtttgtagtctagga

SEQ ID NO: 84715 - DNA, 20 bp, synthetic construct
  misc_feature 1..20: note = CRISPR gRNA sequence
  source 1..20: mol_type = other DNA
gtagtctaggagcaataggc

SEQ ID NO: 84716 - DNA, 20 bp, synthetic construct
  misc_feature 1..20: note = CRISPR gRNA sequence
  source 1..20: mol_type = other DNA
tagtctaggagcaataggct

SEQ ID NO: 84717 - DNA, 20 bp, synthetic construct
  misc_feature 1..20: note = CRISPR gRNA sequence
  source 1..20: mol_type = other DNA
ggagcaataggctataccat

SEQ ID NO: 84718 - DNA, 20 bp, synthetic construct
  misc_feature 1..20: note = CRISPR gRNA sequence
  source 1..20: mol_type = other DNA
taccatgtagcctatgcgtg

SEQ ID NO: 84719 - DNA, 20 bp, synthetic construct
  misc_feature 1..20: note = CRISPR gRNA sequence
  source 1..20: mol_type = other DNA
tgcgtgtagtaggctacaac

SEQ ID NO: 84720 - DNA, 20 bp, synthetic construct
  misc_feature 1..20: note = CRISPR gRNA sequence
  source 1..20: mol_type = other DNA
caacacctaggtttgtgtaa

SEQ ID NO: 84721 - DNA, 20 bp, synthetic construct
  misc_feature 1..20: note = CRISPR gRNA sequence
  source 1..20: mol_type = other DNA
ggtttgtgtaagcatttctc

SEQ ID NO: 84722 - DNA, 20 bp, synthetic construct
  misc_feature 1..20: note = CRISPR gRNA sequence
  source 1..20: mol_type = other DNA
gtgtaagcatttctcagaac

SEQ ID NO: 84723 - DNA, 20 bp, synthetic construct
  misc_feature 1..20: note = CRISPR gRNA sequence
  source 1..20: mol_type = other DNA
tgtaagcatttctcagaaca

SEQ ID NO: 84724 - DNA, 20 bp, synthetic construct
  misc_feature 1..20: note = CRISPR gRNA sequence
  source 1..20: mol_type = other DNA
ctcagaacatgtccccgtca

SEQ ID NO: 84725 - DNA, 20 bp, synthetic construct
  misc_feature 1..20: note = CRISPR gRNA sequence
  source 1..20: mol_type = other DNA
tcagaacatgtccccgtcat

SEQ ID NO: 84726 - DNA, 20 bp, synthetic construct
  misc_feature 1..20: note = CRISPR gRNA sequence
  source 1..20: mol_type = other DNA
agaacatgtccccgtcatta

SEQ ID NO: 84727 - DNA, 20 bp, synthetic construct
  misc_feature 1..20: note = CRISPR gRNA sequence
  source 1..20: mol_type = other DNA
agtaacacatgactatatta

SEQ ID NO: 84728 - DNA, 20 bp, synthetic construct
  misc_feature 1..20: note = CRISPR gRNA sequence
  source 1..20: mol_type = other DNA
tattagagttcaggtcctgg

SEQ ID NO: 84729 - DNA, 20 bp, synthetic construct
  misc_feature 1..20: note = CRISPR gRNA sequence
  source 1..20: mol_type = other DNA
gagttcaggtcctggctcta

SEQ ID NO: 84730 - DNA, 20 bp, synthetic construct
  misc_feature 1..20: note = CRISPR gRNA sequence
  source 1..20: mol_type = other DNA
aggtcctggctctacaattt

SEQ ID NO: 84731 - DNA, 20 bp, synthetic construct
  misc_feature 1..20: note = CRISPR gRNA sequence
  source 1..20: mol_type = other DNA
gctctacaatttactaacag

SEQ ID NO: 84732 - DNA, 20 bp, synthetic construct
  misc_feature 1..20: note = CRISPR gRNA sequence
  source 1..20: mol_type = other DNA
tacaatttactaacagtgtg

SEQ ID NO: 84733 - DNA, 20 bp, synthetic construct
  misc_feature 1..20: note = CRISPR gRNA sequence
  source 1..20: mol_type = other DNA
caatttactaacagtgtgac

SEQ ID NO: 84734 - DNA, 20 bp, synthetic construct
  misc_feature 1..20: note = CRISPR gRNA sequence
  source 1..20: mol_type = other DNA
actaacagtgtgactgggca

SEQ ID NO: 84735 - DNA, 20 bp, synthetic construct
  misc_feature 1..20: note = CRISPR gRNA sequence
  source 1..20: mol_type = other DNA
ctaacagtgtgactgggcag

SEQ ID NO: 84736 - DNA, 20 bp, synthetic construct
  misc_feature 1..20: note = CRISPR gRNA sequence
  source 1..20: mol_type = other DNA
acagtgtgactgggcagatc

SEQ ID NO: 84737 - DNA, 20 bp, synthetic construct
  misc_feature 1..20: note = CRISPR gRNA sequence
  source 1..20: mol_type = other DNA
ggcagatcatccaccttcct

SEQ ID NO: 84738 - DNA, 20 bp, synthetic construct
  misc_feature 1..20: note = CRISPR gRNA sequence
  source 1..20: mol_type = other DNA
cctgatgctctcccaaatca

SEQ ID NO: 84739 - DNA, 20 bp, synthetic construct
  misc_feature 1..20: note = CRISPR gRNA sequence
  source 1..20: mol_type = other DNA
ctgatgctctcccaaatcaa

SEQ ID NO: 84740 - DNA, 20 bp, synthetic construct
  misc_feature 1..20: note = CRISPR gRNA sequence
  source 1..20: mol_type = other DNA
atgctctcccaaatcaattc

SEQ ID NO: 84741 - DNA, 20 bp, synthetic construct
  misc_feature 1..20: note = CRISPR gRNA sequence
  source 1..20: mol_type = other DNA
tcccaaatcaattccctgtt

SEQ ID NO: 84742 - DNA, 20 bp, synthetic construct
  misc_feature 1..20: note = CRISPR gRNA sequence
  source 1..20: mol_type = other DNA
ccaaatcaattccctgttct

SEQ ID NO: 84743 - DNA, 20 bp, synthetic construct
  misc_feature 1..20: note = CRISPR gRNA sequence
  source 1..20: mol_type = other DNA
cctgttctagaatataacag

SEQ ID NO: 84744 - DNA, 20 bp, synthetic construct
  misc_feature 1..20: note = CRISPR gRNA sequence
  source 1..20: mol_type = other DNA
ttctagaatataacaggaga

SEQ ID NO: 84745 - DNA, 20 bp, synthetic construct
  misc_feature 1..20: note = CRISPR gRNA sequence
  source 1..20: mol_type = other DNA
tagaatataacaggagattt

SEQ ID NO: 84746 - DNA, 20 bp, synthetic construct
  misc_feature 1..20: note = CRISPR gRNA sequence
  source 1..20: mol_type = other DNA
gaatataacaggagatttga

SEQ ID NO: 84747 - DNA, 20 bp, synthetic construct
  misc_feature 1..20: note = CRISPR gRNA sequence
  source 1..20: mol_type = other DNA
gaatggggtttcagcatcaa

SEQ ID NO: 84748 - DNA, 20 bp, synthetic construct
  misc_feature 1..20: note = CRISPR gRNA sequence
  source 1..20: mol_type = other DNA
aatggggtttcagcatcaat

SEQ ID NO: 84749 - DNA, 20 bp, synthetic construct
  misc_feature 1..20: note = CRISPR gRNA sequence
  source 1..20: mol_type = other DNA
cagcatcaatgtaccctggg

SEQ ID NO: 84750 - DNA, 20 bp, synthetic construct
  misc_feature 1..20: note = CRISPR gRNA sequence
  source 1..20: mol_type = other DNA
agcatcaatgtaccctgggc

SEQ ID NO: 84751 - DNA, 20 bp, synthetic construct
  misc_feature 1..20: note = CRISPR gRNA sequence
  source 1..20: mol_type = other DNA
ggcagtagaatttcattgaa

SEQ ID NO: 84752 - DNA, 20 bp, synthetic construct
  misc_feature 1..20: note = CRISPR gRNA sequence
  source 1..20: mol_type = other DNA
cattgaaaagcctttggact

SEQ ID NO: 84753 - DNA, 20 bp, synthetic construct
  misc_feature 1..20: note = CRISPR gRNA sequence
  source 1..20: mol_type = other DNA
attgaaaagcctttggactc

SEQ ID NO: 84754 - DNA, 20 bp, synthetic construct
  misc_feature 1..20: note = CRISPR gRNA sequence
  source 1..20: mol_type = other DNA
aaaagcctttggactccaac

SEQ ID NO: 84755 - DNA, 20 bp, synthetic construct
  misc_feature 1..20: note = CRISPR gRNA sequence
  source 1..20: mol_type = other DNA
tggactccaactaaagatgc

SEQ ID NO: 84756 - DNA, 20 bp, synthetic construct
  misc_feature 1..20: note = CRISPR gRNA sequence
  source 1..20: mol_type = other DNA
ggactccaactaaagatgca

SEQ ID NO: 84757 - DNA, 20 bp, synthetic construct
  misc_feature 1..20: note = CRISPR gRNA sequence
  source 1..20: mol_type = other DNA
gactccaactaaagatgcag

SEQ ID NO: 84758 - DNA, 20 bp, synthetic construct
  misc_feature 1..20: note = CRISPR gRNA sequence
  source 1..20: mol_type = other DNA
caactaaagatgcagagaag

SEQ ID NO: 84759 - DNA, 20 bp, synthetic construct
  misc_feature 1..20: note = CRISPR gRNA sequence
  source 1..20: mol_type = other DNA
aagatgcagagaagtccaag

SEQ ID NO: 84760 - DNA, 20 bp, synthetic construct
  misc_feature 1..20: note = CRISPR gRNA sequence
  source 1..20: mol_type = other DNA
ctccctctctcttgcttctg

SEQ ID NO: 84761 - DNA, 20 bp, synthetic construct
  misc_feature 1..20: note = CRISPR gRNA sequence
  source 1..20: mol_type = other DNA
cctctctcttgcttctggag

SEQ ID NO: 84762 - DNA, 20 bp, synthetic construct
  misc_feature 1..20: note = CRISPR gRNA sequence
  source 1..20: mol_type = other DNA
tctcttgcttctggagctcc

SEQ ID NO: 84763 - DNA, 20 bp, synthetic construct
  misc_feature 1..20: note = CRISPR gRNA sequence
  source 1..20: mol_type = other DNA
tcttgcttctggagctcctt

SEQ ID NO: 84764 - DNA, 20 bp, synthetic construct
  misc_feature 1..20: note = CRISPR gRNA sequence
  source 1..20: mol_type = other DNA
ttgcttctggagctccttgt

SEQ ID NO: 84765 - DNA, 20 bp, synthetic construct
  misc_feature 1..20: note = CRISPR gRNA sequence
  source 1..20: mol_type = other DNA
gcttctggagctccttgtag

SEQ ID NO: 84766 - DNA, 20 bp, synthetic construct
  misc_feature 1..20: note = CRISPR gRNA sequence
  source 1..20: mol_type = other DNA
cttctggagctccttgtagt

SEQ ID NO: 84767 - DNA, 20 bp, synthetic construct
  misc_feature 1..20: note = CRISPR gRNA sequence
  source 1..20: mol_type = other DNA
ctggagctccttgtagttac

SEQ ID NO: 84768 - DNA, 20 bp, synthetic construct
  misc_feature 1..20: note = CRISPR gRNA sequence
  source 1..20: mol_type = other DNA
tggagctccttgtagttaca

SEQ ID NO: 84769 - DNA, 20 bp, synthetic construct
  misc_feature 1..20: note = CRISPR gRNA sequence
  source 1..20: mol_type = other DNA
gagctccttgtagttacatc

SEQ ID NO: 84770 - DNA, 20 bp, synthetic construct
  misc_feature 1..20: note = CRISPR gRNA sequence
  source 1..20: mol_type = other DNA
cttgtagttacatctattat

SEQ ID NO: 84771 - DNA, 20 bp, synthetic construct
  misc_feature 1..20: note = CRISPR gRNA sequence
  source 1..20: mol_type = other DNA
gtagttacatctattatagt

SEQ ID NO: 84772 - DNA, 20 bp, synthetic construct
  misc_feature 1..20: note = CRISPR gRNA sequence
  source 1..20: mol_type = other DNA
tagttacatctattatagta

SEQ ID NO: 84773 - DNA, 20 bp, synthetic construct
  misc_feature 1..20: note = CRISPR gRNA sequence
  source 1..20: mol_type = other DNA
catctattatagtatcatta

SEQ ID NO: 84774 - DNA, 20 bp, synthetic construct
  misc_feature 1..20: note = CRISPR gRNA sequence
  source 1..20: mol_type = other DNA
ttatagtatcattatatcaa

SEQ ID NO: 84775 - DNA, 20 bp, synthetic construct
  misc_feature 1..20: note = CRISPR gRNA sequence
  source 1..20: mol_type = other DNA
tagtatcattatatcaagtt

SEQ ID NO: 84776 - DNA, 20 bp, synthetic construct
  misc_feature 1..20: note = CRISPR gRNA sequence
  source 1..20: mol_type = other DNA
tatcaagttataacaatctg

SEQ ID NO: 84777 - DNA, 20 bp, synthetic construct
  misc_feature 1..20: note = CRISPR gRNA sequence
  source 1..20: mol_type = other DNA
taacaatctgtttcccttta

SEQ ID NO: 84778 - DNA, 20 bp, synthetic construct
  misc_feature 1..20: note = CRISPR gRNA sequence
  source 1..20: mol_type = other DNA
tttccctttatctcctctag

SEQ ID NO: 84779 - DNA, 20 bp, synthetic construct
  misc_feature 1..20: note = CRISPR gRNA sequence
  source 1..20: mol_type = other DNA
ccctttatctcctctagtgg

SEQ ID NO: 84780 - DNA, 20 bp, synthetic construct
  misc_feature 1..20: note = CRISPR gRNA sequence
  source 1..20: mol_type = other DNA
cctttatctcctctagtggc

SEQ ID NO: 84781 - DNA, 20 bp, synthetic construct
  misc_feature 1..20: note = CRISPR gRNA sequence
  source 1..20: mol_type = other DNA
tatctcctctagtggcctgg

SEQ ID NO: 84782 - DNA, 20 bp, synthetic construct
  misc_feature 1..20: note = CRISPR gRNA sequence
  source 1..20: mol_type = other DNA
atctcctctagtggcctggg

SEQ ID NO: 84783 - DNA, 20 bp, synthetic construct
  misc_feature 1..20: note = CRISPR gRNA sequence
  source 1..20: mol_type = other DNA
tctcctctagtggcctggga

SEQ ID NO: 84784 - DNA, 20 bp, synthetic construct
  misc_feature 1..20: note = CRISPR gRNA sequence
  source 1..20: mol_type = other DNA
ctctagtggcctgggaacct

SEQ ID NO: 84785 - DNA, 20 bp, synthetic construct
  misc_feature 1..20: note = CRISPR gRNA sequence
  source 1..20: mol_type = other DNA
tagtggcctgggaacctcta

SEQ ID NO: 84786 - DNA, 20 bp, synthetic construct
  misc_feature 1..20: note = CRISPR gRNA sequence
  source 1..20: mol_type = other DNA
gtggcctgggaacctctaag

SEQ ID NO: 84787 - DNA, 20 bp, synthetic construct
  misc_feature 1..20: note = CRISPR gRNA sequence
  source 1..20: mol_type = other DNA
ggaacctctaagaggcaaac

SEQ ID NO: 84788 - DNA, 20 bp, synthetic construct
  misc_feature 1..20: note = CRISPR gRNA sequence
  source 1..20: mol_type = other DNA
taagaggcaaacacagtccc

SEQ ID NO: 84789 - DNA, 20 bp, synthetic construct
  misc_feature 1..20: note = CRISPR gRNA sequence
  source 1..20: mol_type = other DNA
agaggcaaacacagtcccca

SEQ ID NO: 84790 - DNA, 20 bp, synthetic construct
  misc_feature 1..20: note = CRISPR gRNA sequence
  source 1..20: mol_type = other DNA
cagagctgtataactcctct

SEQ ID NO: 84791 - DNA, 20 bp, synthetic construct
  misc_feature 1..20: note = CRISPR gRNA sequence
  source 1..20: mol_type = other DNA
tataactcctctcttctgtc

SEQ ID NO: 84792 - DNA, 20 bp, synthetic construct
  misc_feature 1..20: note = CRISPR gRNA sequence
  source 1..20: mol_type = other DNA
ctctcttctgtctgaagaat

SEQ ID NO: 84793 - DNA, 20 bp, synthetic construct
  misc_feature 1..20: note = CRISPR gRNA sequence
  source 1..20: mol_type = other DNA
tcttctgtctgaagaataaa

SEQ ID NO: 84794 - DNA, 20 bp, synthetic construct
  misc_feature 1..20: note = CRISPR gRNA sequence
  source 1..20: mol_type = other DNA
ttctgtctgaagaataaaac

SEQ ID NO: 84795 - DNA, 20 bp, synthetic construct
  misc_feature 1..20: note = CRISPR gRNA sequence
  source 1..20: mol_type = other DNA
ctgtctgaagaataaaacaa

SEQ ID NO: 84796 - DNA, 20 bp, synthetic construct
  misc_feature 1..20: note = CRISPR gRNA sequence
  source 1..20: mol_type = other DNA
tgtctgaagaataaaacaac

SEQ ID NO: 84797 - DNA, 20 bp, synthetic construct
  misc_feature 1..20: note = CRISPR gRNA sequence
  source 1..20: mol_type = other DNA
tctgaagaataaaacaacat

SEQ ID NO: 84798 - DNA, 20 bp, synthetic construct
  misc_feature 1..20: note = CRISPR gRNA sequence
  source 1..20: mol_type = other DNA
aagaataaaacaacattata

SEQ ID NO: 84799 - DNA, 20 bp, synthetic construct
  misc_feature 1..20: note = CRISPR gRNA sequence
  source 1..20: mol_type = other DNA
tacaaaggaaaagagtggtt

SEQ ID NO: 84800 - DNA, 20 bp, synthetic construct
  misc_feature 1..20: note = CRISPR gRNA sequence
  source 1..20: mol_type = other DNA
attttctctcctcagcagag

SEQ ID NO: 84801 - DNA, 20 bp, synthetic construct
  misc_feature 1..20: note = CRISPR gRNA sequence
  source 1..20: mol_type = other DNA
tctctcctcagcagagatgt

SEQ ID NO: 84802 - DNA, 20 bp, synthetic construct
  misc_feature 1..20: note = CRISPR gRNA sequence
  source 1..20: mol_type = other DNA
ctctcctcagcagagatgtc

SEQ ID NO: 84803 - DNA, 20 bp, synthetic construct
  misc_feature 1..20: note = CRISPR gRNA sequence
  source 1..20: mol_type = other DNA
tctcctcagcagagatgtcc

SEQ ID NO: 84804 - DNA, 20 bp, synthetic construct
  misc_feature 1..20: note = CRISPR gRNA sequence
  source 1..20: mol_type = other DNA
tcctcagcagagatgtccaa

SEQ ID NO: 84805 - DNA, 20 bp, synthetic construct
  misc_feature 1..20: note = CRISPR gRNA sequence
  source 1..20: mol_type = other DNA
ctcagcagagatgtccaatg

SEQ ID NO: 84806 - DNA, 20 bp, synthetic construct
  misc_feature 1..20: note = CRISPR gRNA sequence
  source 1..20: mol_type = other DNA
agcagagatgtccaatgtgg

SEQ ID NO: 84807 - DNA, 20 bp, synthetic construct
  misc_feature 1..20: note = CRISPR gRNA sequence
  source 1..20: mol_type = other DNA
gcaggtaatgtgggtaacca

SEQ ID NO: 84808 - DNA, 20 bp, synthetic construct
  misc_feature 1..20: note = CRISPR gRNA sequence
  source 1..20: mol_type = other DNA
caggtaatgtgggtaaccac

SEQ ID NO: 84809 - DNA, 20 bp, synthetic construct
  misc_feature 1..20: note = CRISPR gRNA sequence
  source 1..20: mol_type = other DNA
cctttatcctgcaataccat

SEQ ID NO: 84810 - DNA, 20 bp, synthetic construct
  misc_feature 1..20: note = CRISPR gRNA sequence
  source 1..20: mol_type = other DNA
tatcctgcaataccatactg

SEQ ID NO: 84811 - DNA, 20 bp, synthetic construct
  misc_feature 1..20: note = CRISPR gRNA sequence
  source 1..20: mol_type = other DNA
atcctgcaataccatactgg

SEQ ID NO: 84812 - DNA, 20 bp, synthetic construct
  misc_feature 1..20: note = CRISPR gRNA sequence
  source 1..20: mol_type = other DNA
tcctgcaataccatactggc

SEQ ID NO: 84813 - DNA, 20 bp, synthetic construct
  misc_feature 1..20: note = CRISPR gRNA sequence
  source 1..20: mol_type = other DNA
caataccatactggcagttc

SEQ ID NO: 84814 - DNA, 20 bp, synthetic construct
  misc_feature 1..20: note = CRISPR gRNA sequence
  source 1..20: mol_type = other DNA
gcagttcctttgccctctct

SEQ ID NO: 84815 - DNA, 20 bp, synthetic construct
  misc_feature 1..20: note = CRISPR gRNA sequence
  source 1..20: mol_type = other DNA
ctttgccctctctgtagagg

SEQ ID NO: 84816 - DNA, 20 bp, synthetic construct
  misc_feature 1..20: note = CRISPR gRNA sequence
  source 1..20: mol_type = other DNA
tgccctctctgtagagggtc

SEQ ID NO: 84817 - DNA, 20 bp, synthetic construct
  misc_feature 1..20: note = CRISPR gRNA sequence
  source 1..20: mol_type = other DNA
gccctctctgtagagggtca

SEQ ID NO: 84818 - DNA, 20 bp, synthetic construct
  misc_feature 1..20: note = CRISPR gRNA sequence
  source 1..20: mol_type = other DNA
ccctctctgtagagggtcag

SEQ ID NO: 84819 - DNA, 20 bp, synthetic construct
  misc_feature 1..20: note = CRISPR gRNA sequence
  source 1..20: mol_type = other DNA
tctgtagagggtcagtaata

SEQ ID NO: 84820 - DNA, 20 bp, synthetic construct
  misc_feature 1..20: note = CRISPR gRNA sequence
  source 1..20: mol_type = other DNA
tgtagagggtcagtaatatg

SEQ ID NO: 84821 - DNA, 20 bp, synthetic construct
  misc_feature 1..20: note = CRISPR gRNA sequence
  source 1..20: mol_type = other DNA
tagagggtcagtaatatggc

SEQ ID NO: 84822 - DNA, 20 bp, synthetic construct
  misc_feature 1..20: note = CRISPR gRNA sequence
  source 1..20: mol_type = other DNA
gggccatacaccttcttcat

SEQ ID NO: 84823 - DNA, 20 bp, synthetic construct
  misc_feature 1..20: note = CRISPR gRNA sequence
  source 1..20: mol_type = other DNA
cttcatgccactccacagga

SEQ ID NO: 84824 - DNA, 20 bp, synthetic construct
  misc_feature 1..20: note = CRISPR gRNA sequence
  source 1..20: mol_type = other DNA
ttcatgccactccacaggag

SEQ ID NO: 84825 - DNA, 20 bp, synthetic construct
  misc_feature 1..20: note = CRISPR gRNA sequence
  source 1..20: mol_type = other DNA
catgccactccacaggagaa

SEQ ID NO: 84826 - DNA, 20 bp, synthetic construct
  misc_feature 1..20: note = CRISPR gRNA sequence
  source 1..20: mol_type = other DNA
atgccactccacaggagaag

SEQ ID NO: 84827 - DNA, 20 bp, synthetic construct
  misc_feature 1..20: note = CRISPR gRNA sequence
  source 1..20: mol_type = other DNA
cacaggagaagggaacatga

SEQ ID NO: 84828 - DNA, 20 bp, synthetic construct
  misc_feature 1..20: note = CRISPR gRNA sequence
  source 1..20: mol_type = other DNA
taggattcttctttccctgc

SEQ ID NO: 84829 - DNA, 20 bp, synthetic construct
  misc_feature 1..20: note = CRISPR gRNA sequence
  source 1..20: mol_type = other DNA
ttctttccctgctaaaatgt

SEQ ID NO: 84830 - DNA, 20 bp, synthetic construct
  misc_feature 1..20: note = CRISPR gRNA sequence
  source 1..20: mol_type = other DNA
ctttccctgctaaaatgtta

SEQ ID NO: 84831 - DNA, 20 bp, synthetic construct
  misc_feature 1..20: note = CRISPR gRNA sequence
  source 1..20: mol_type = other DNA
tttccctgctaaaatgttac

SEQ ID NO: 84832 - DNA, 20 bp, synthetic construct
  misc_feature 1..20: note = CRISPR gRNA sequence
  source 1..20: mol_type = other DNA
tccctgctaaaatgttactc

SEQ ID NO: 84833 - DNA, 20 bp, synthetic construct
  misc_feature 1..20: note = CRISPR gRNA sequence
  source 1..20: mol_type = other DNA
ccctgctaaaatgttactct

SEQ ID NO: 84834 - DNA, 20 bp, synthetic construct
  misc_feature 1..20: note = CRISPR gRNA sequence
  source 1..20: mol_type = other DNA
cctgctaaaatgttactctg

SEQ ID NO: 84835 - DNA, 20 bp, synthetic construct
  misc_feature 1..20: note = CRISPR gRNA sequence
  source 1..20: mol_type = other DNA
ctaaaatgttactctgtcaa

SEQ ID NO: 84836 - DNA, 20 bp, synthetic construct
  misc_feature 1..20: note = CRISPR gRNA sequence
  source 1..20: mol_type = other DNA
aaatgttactctgtcaatgt

SEQ ID NO: 84837 - DNA, 20 bp, synthetic construct
  misc_feature 1..20: note = CRISPR gRNA sequence
  source 1..20: mol_type = other DNA
ctctgtcaatgttctccaca

SEQ ID NO: 84838 - DNA, 20 bp, synthetic construct
  misc_feature 1..20: note = CRISPR gRNA sequence
  source 1..20: mol_type = other DNA
tgtcaatgttctccacatag

SEQ ID NO: 84839 - DNA, 20 bp, synthetic construct
  misc_feature 1..20: note = CRISPR gRNA sequence
  source 1..20: mol_type = other DNA
tcaatgttctccacatagtg

SEQ ID NO: 84840 - DNA, 20 bp, synthetic construct
  misc_feature 1..20: note = CRISPR gRNA sequence
  source 1..20: mol_type = other DNA
tccacatagtgagggttatc

SEQ ID NO: 84841 - DNA, 20 bp, synthetic construct
  misc_feature 1..20: note = CRISPR gRNA sequence
  source 1..20: mol_type = other DNA
cacatagtgagggttatcat

SEQ ID NO: 84842 - DNA, 20 bp, synthetic construct
  misc_feature 1..20: note = CRISPR gRNA sequence
  source 1..20: mol_type = other DNA
tcatgttagagctgtctata

SEQ ID NO: 84843 - DNA, 20 bp, synthetic construct
  misc_feature 1..20: note = CRISPR gRNA sequence
  source 1..20: mol_type = other DNA
gagctgtctataaatagtcc

SEQ ID NO: 84844 - DNA, 20 bp, synthetic construct
  misc_feature 1..20: note = CRISPR gRNA sequence
  source 1..20: mol_type = other DNA
tctataaatagtcctcagga

SEQ ID NO: 84845 - DNA, 20 bp, synthetic construct
  misc_feature 1..20: note = CRISPR gRNA sequence
  source 1..20: mol_type = other DNA
taaatagtcctcaggacagt

SEQ ID NO: 84846 - DNA, 20 bp, synthetic construct
  misc_feature 1..20: note = CRISPR gRNA sequence
  source 1..20: mol_type = other DNA
aggacagtgaaacaaaaaca

SEQ ID NO: 84847 - DNA, 20 bp, synthetic construct
  misc_feature 1..20: note = CRISPR gRNA sequence
  source 1..20: mol_type = other DNA
tctcaaggtcaaaaacttac

SEQ ID NO: 84848 - DNA, 20 bp, synthetic construct
  misc_feature 1..20: note = CRISPR gRNA sequence
  source 1..20: mol_type = other DNA
ctcaaggtcaaaaacttacc

SEQ ID NO: 84849 - DNA, 20 bp, synthetic construct
  misc_feature 1..20: note = CRISPR gRNA sequence
  source 1..20: mol_type = other DNA
tcaaggtcaaaaacttacct

SEQ ID NO: 84850 - DNA, 20 bp, synthetic construct
  misc_feature 1..20: note = CRISPR gRNA sequence
  source 1..20: mol_type = other DNA
aaggtcaaaaacttacctcc

SEQ ID NO: 84851 - DNA, 20 bp, synthetic construct
  misc_feature 1..20: note = CRISPR gRNA sequence
  source 1..20: mol_type = other DNA
acctccatgatgctgcttac

SEQ ID NO: 84852 - DNA, 20 bp, synthetic construct
  misc_feature 1..20: note = CRISPR gRNA sequence
  source 1..20: mol_type = other DNA
cctccatgatgctgcttaca

SEQ ID NO: 84853 - DNA, 20 bp, synthetic construct
  misc_feature 1..20: note = CRISPR gRNA sequence
  source 1..20: mol_type = other DNA
catgatgctgcttacatgtc

SEQ ID NO: 84854 - DNA, 20 bp, synthetic construct
  misc_feature 1..20: note = CRISPR gRNA sequence
  source 1..20: mol_type = other DNA
cttacatgtctcgatctatg

SEQ ID NO: 84855 - DNA, 20 bp, synthetic construct
  misc_feature 1..20: note = CRISPR gRNA sequence
  source 1..20: mol_type = other DNA
acatgtctcgatctatgaaa

SEQ ID NO: 84856 - DNA, 20 bp, synthetic construct
  misc_feature 1..20: note = CRISPR gRNA sequence
  source 1..20: mol_type = other DNA
catgtctcgatctatgaaaa

SEQ ID NO: 84857 - DNA, 20 bp, synthetic construct
  misc_feature 1..20: note = CRISPR gRNA sequence
  source 1..20: mol_type = other DNA
gatctatgaaaaagacagtg

SEQ ID NO: 84858 - DNA, 20 bp, synthetic construct
  misc_feature 1..20: note = CRISPR gRNA sequence
  source 1..20: mol_type = other DNA
tgaaaaagacagtggagaaa

SEQ ID NO: 84859 - DNA, 20 bp, synthetic construct
  misc_feature 1..20: note = CRISPR gRNA sequence
  source 1..20: mol_type = other DNA
agttttacttttaaaatacc

SEQ ID NO: 84860 - DNA, 20 bp, synthetic construct
  misc_feature 1..20: note = CRISPR gRNA sequence
  source 1..20: mol_type = other DNA
tacttttaaaataccatgta

SEQ ID NO: 84861 - DNA, 20 bp, synthetic construct
  misc_feature 1..20: note = CRISPR gRNA sequence
  source 1..20: mol_type = other DNA
acttttaaaataccatgtac

SEQ ID NO: 84862 - DNA, 20 bp, synthetic construct
  misc_feature 1..20: note = CRISPR gRNA sequence
  source 1..20: mol_type = other DNA
cttttaaaataccatgtact

SEQ ID NO: 84863 - DNA, 20 bp, synthetic construct
  misc_feature 1..20: note = CRISPR gRNA sequence
  source 1..20: mol_type = other DNA
ttaaaataccatgtactaac

SEQ ID NO: 84864 - DNA, 20 bp, synthetic construct
  misc_feature 1..20: note = CRISPR gRNA sequence
  source 1..20: mol_type = other DNA
taaaataccatgtactaaca

SEQ ID NO: 84865 - DNA, 20 bp, synthetic construct
  misc_feature 1..20: note = CRISPR gRNA sequence
  source 1..20: mol_type = other DNA
aaaataccatgtactaacaa

SEQ ID NO: 84866 - DNA, 20 bp, synthetic construct
  misc_feature 1..20: note = CRISPR gRNA sequence
  source 1..20: mol_type = other DNA
aaataccatgtactaacaaa

SEQ ID NO: 84867 - DNA, 20 bp, synthetic construct
  misc_feature 1..20: note = CRISPR gRNA sequence
  source 1..20: mol_type = other DNA
acaaatgtctaaaatggtta

SEQ ID NO: 84868 - DNA, 20 bp, synthetic construct
  misc_feature 1..20: note = CRISPR gRNA sequence
  source 1..20: mol_type = other DNA
aaatggttagaaataaggct

SEQ ID NO: 84869 - DNA, 20 bp, synthetic construct
  misc_feature 1..20: note = CRISPR gRNA sequence
  source 1..20: mol_type = other DNA
gaaataaggctggcagaata

SEQ ID NO: 84870 - DNA, 20 bp, synthetic construct
  misc_feature 1..20: note = CRISPR gRNA sequence
  source 1..20: mol_type = other DNA
gcagaataggctgctgttcc

SEQ ID NO: 84871 - DNA, 20 bp, synthetic construct
  misc_feature 1..20: note = CRISPR gRNA sequence
  source 1..20: mol_type = other DNA
ctgttcctacccatgaatac

SEQ ID NO: 84872 - DNA, 20 bp, synthetic construct
  misc_feature 1..20: note = CRISPR gRNA sequence
  source 1..20: mol_type = other DNA
ttcctacccatgaatacatt

SEQ ID NO: 84873 - DNA, 20 bp, synthetic construct
  misc_feature 1..20: note = CRISPR gRNA sequence
  source 1..20: mol_type = other DNA
ctacccatgaatacattgtt

SEQ ID NO: 84874 - DNA, 20 bp, synthetic construct
  misc_feature 1..20: note = CRISPR gRNA sequence
  source 1..20: mol_type = other DNA
cccatgaatacattgtttag

SEQ ID NO: 84875 - DNA, 20 bp, synthetic construct
  misc_feature 1..20: note = CRISPR gRNA sequence
  source 1..20: mol_type = other DNA
tttagagctacccagcagga

SEQ ID NO: 84876 - DNA, 20 bp, synthetic construct
  misc_feature 1..20: note = CRISPR gRNA sequence
  source 1..20: mol_type = other DNA
agagctacccagcaggaaca

SEQ ID NO: 84877 - DNA, 20 bp, synthetic construct
  misc_feature 1..20: note = CRISPR gRNA sequence
  source 1..20: mol_type = other DNA
gagctacccagcaggaacaa

SEQ ID NO: 84878 - DNA, 20 bp, synthetic construct
  misc_feature 1..20: note = CRISPR gRNA sequence
  source 1..20: mol_type = other DNA
cccagcaggaacaagccctt

SEQ ID NO: 84879 - DNA, 20 bp, synthetic construct
  misc_feature 1..20: note = CRISPR gRNA sequence
  source 1..20: mol_type = other DNA
cctactagcctcagatacca

SEQ ID NO: 84880 - DNA, 20 bp, synthetic construct
  misc_feature 1..20: note = CRISPR gRNA sequence
  source 1..20: mol_type = other DNA
ctactagcctcagataccaa

SEQ ID NO: 84881 - DNA, 20 bp, synthetic construct
  misc_feature 1..20: note = CRISPR gRNA sequence
  source 1..20: mol_type = other DNA
ctagcctcagataccaatcc

SEQ ID NO: 84882 - DNA, 20 bp, synthetic construct
  misc_feature 1..20: note = CRISPR gRNA sequence
  source 1..20: mol_type = other DNA
gcctcagataccaatccagc

SEQ ID NO: 84883 - DNA, 20 bp, synthetic construct
  misc_feature 1..20: note = CRISPR gRNA sequence
  source 1..20: mol_type = other DNA
agataccaatccagccagaa

SEQ ID NO: 84884 - DNA, 20 bp, synthetic construct
  misc_feature 1..20: note = CRISPR gRNA sequence
  source 1..20: mol_type = other DNA
gagaagtccaggattatagg

SEQ ID NO: 84885 - DNA, 20 bp, synthetic construct
  misc_feature 1..20: note = CRISPR gRNA sequence
  source 1..20: mol_type = other DNA
taggatgctaggacagcagg

SEQ ID NO: 84886 - DNA, 20 bp, synthetic construct
  misc_feature 1..20: note = CRISPR gRNA sequence
  source 1..20: mol_type = other DNA
ggacagcaggacttacaaac

SEQ ID NO: 84887 - DNA, 20 bp, synthetic construct
  misc_feature 1..20: note = CRISPR gRNA sequence
  source 1..20: mol_type = other DNA
acaaacaaaggcctatacct

SEQ ID NO: 84888 - DNA, 20 bp, synthetic construct
  misc_feature 1..20: note = CRISPR gRNA sequence
  source 1..20: mol_type = other DNA
caaacaaaggcctatacctt

SEQ ID NO: 84889 - DNA, 20 bp, synthetic construct
  misc_feature 1..20: note = CRISPR gRNA sequence
  source 1..20: mol_type = other DNA
taccttcttgagatgttcgt

SEQ ID NO: 84890 - DNA, 20 bp, synthetic construct
  misc_feature 1..20: note = CRISPR gRNA sequence
  source 1..20: mol_type = other DNA
cttgagatgttcgttcagtg

SEQ ID NO: 84891 - DNA, 20 bp, synthetic construct
  misc_feature 1..20: note = CRISPR gRNA sequence
  source 1..20: mol_type = other DNA
ttgagatgttcgttcagtgc

SEQ ID NO: 84892 - DNA, 20 bp, synthetic construct
  misc_feature 1..20: note = CRISPR gRNA sequence
  source 1..20: mol_type = other DNA
gagatgttcgttcagtgcta

SEQ ID NO: 84893 - DNA, 20 bp, synthetic construct
  misc_feature 1..20: note = CRISPR gRNA sequence
  source 1..20: mol_type = other DNA
agatgttcgttcagtgctaa

SEQ ID NO: 84894 - DNA, 20 bp, synthetic construct
  misc_feature 1..20: note = CRISPR gRNA sequence
  source 1..20: mol_type = other DNA
gttcagtgctaaatatacct

SEQ ID NO: 84895 - DNA, 20 bp, synthetic construct
  misc_feature 1..20: note = CRISPR gRNA sequence
  source 1..20: mol_type = other DNA
agtgctaaatatacctgaag

SEQ ID NO: 84896 - DNA, 20 bp, synthetic construct
  misc_feature 1..20: note = CRISPR gRNA sequence
  source 1..20: mol_type = other DNA
aatatacctgaagctgccac

SEQ ID NO: 84897 - DNA, 20 bp, synthetic construct
  misc_feature 1..20: note = CRISPR gRNA sequence
  source 1..20: mol_type = other DNA
aagctgccacaaaagctaga

SEQ ID NO: 84898 - DNA, 20 bp, synthetic construct
  misc_feature 1..20: note = CRISPR gRNA sequence
  source 1..20: mol_type = other DNA
ccacaaaagctagaggaagc

SEQ ID NO: 84899 - DNA, 20 bp, synthetic construct
  misc_feature 1..20: note = CRISPR gRNA sequence
  source 1..20: mol_type = other DNA
gaggaagccagtaggtaaga

SEQ ID NO: 84900 - DNA, 20 bp, synthetic construct
  misc_feature 1..20: note = CRISPR gRNA sequence
  source 1..20: mol_type = other DNA
agagtgtatatgtatttgtg

SEQ ID NO: 84901 - DNA, 20 bp, synthetic construct
  misc_feature 1..20: note = CRISPR gRNA sequence
  source 1..20: mol_type = other DNA
gtgcaagtgctgctgctgct

SEQ ID NO: 84902 - DNA, 20 bp, synthetic construct
  misc_feature 1..20: note = CRISPR gRNA sequence
  source 1..20: mol_type = other DNA
tgcaagtgctgctgctgctc

SEQ ID NO: 84903 - DNA, 20 bp, synthetic construct
  misc_feature 1..20: note = CRISPR gRNA sequence
  source 1..20: mol_type = other DNA
ctgctgctccctgctcaact

SEQ ID NO: 84904 - DNA, 20 bp, synthetic construct
  misc_feature 1..20: note = CRISPR gRNA sequence
  source 1..20: mol_type = other DNA
ctgctccctgctcaactgca

SEQ ID NO: 84905 - DNA, 20 bp, synthetic construct
  misc_feature 1..20: note = CRISPR gRNA sequence
  source 1..20: mol_type = other DNA
ctccctgctcaactgcaggg

SEQ ID NO: 84906 - DNA, 20 bp, synthetic construct
  misc_feature 1..20: note = CRISPR gRNA sequence
  source 1..20: mol_type = other DNA
cctgctcaactgcagggaaa

SEQ ID NO: 84907 - DNA, 20 bp, synthetic construct
  misc_feature 1..20: note = CRISPR gRNA sequence
  source 1..20: mol_type = other DNA
ctcaactgcagggaaactac

SEQ ID NO: 84908 - DNA, 20 bp, synthetic construct
  misc_feature 1..20: note = CRISPR gRNA sequence
  source 1..20: mol_type = other DNA
aactgcagggaaactactgg

SEQ ID NO: 84909 - DNA, 20 bp, synthetic construct
  misc_feature 1..20: note = CRISPR gRNA sequence
  source 1..20: mol_type = other DNA
cagggaaactactggttcag

SEQ ID NO: 84910 - DNA, 20 bp, synthetic construct
  misc_feature 1..20: note = CRISPR gRNA sequence
  source 1..20: mol_type = other DNA
ctggttcagaaaccatgctg

SEQ ID NO: 84911 - DNA, 20 bp, synthetic construct
  misc_feature 1..20: note = CRISPR gRNA sequence
  source 1..20: mol_type = other DNA
gttcagaaaccatgctgtgc

SEQ ID NO: 84912 - DNA, 20 bp, synthetic construct
  misc_feature 1..20: note = CRISPR gRNA sequence
  source 1..20: mol_type = other DNA
agaaaccatgctgtgcatca

SEQ ID NO: 84913 - DNA, 20 bp, synthetic construct
  misc_feature 1..20: note = CRISPR gRNA sequence
  source 1..20: mol_type = other DNA
tgcatcagtatctcagcagg

SEQ ID NO: 84914 - DNA, 20 bp, synthetic construct
  misc_feature 1..20: note = CRISPR gRNA sequence
  source 1..20: mol_type = other DNA
agcaggtgccactaatctga

SEQ ID NO: 84915 - DNA, 20 bp, synthetic construct
  misc_feature 1..20: note = CRISPR gRNA sequence
  source 1..20: mol_type = other DNA
atctgatctttaagaacatt

SEQ ID NO: 84916 - DNA, 20 bp, synthetic construct
  misc_feature 1..20: note = CRISPR gRNA sequence
  source 1..20: mol_type = other DNA
atctttaagaacattccctg

SEQ ID NO: 84917 - DNA, 20 bp, synthetic construct
  misc_feature 1..20: note = CRISPR gRNA sequence
  source 1..20: mol_type = other DNA
taagaacattccctgacaat

SEQ ID NO: 84918 - DNA, 20 bp, synthetic construct
  misc_feature 1..20: note = CRISPR gRNA sequence
  source 1..20: mol_type = other DNA
aagaacattccctgacaatc

SEQ ID NO: 84919 - DNA, 20 bp, synthetic construct
  misc_feature 1..20: note = CRISPR gRNA sequence
  source 1..20: mol_type = other DNA
agaacattccctgacaatcc

SEQ ID NO: 84920 - DNA, 20 bp, synthetic construct
  misc_feature 1..20: note = CRISPR gRNA sequence
  source 1..20: mol_type = other DNA
cctgacaatcccaatatgca

SEQ ID NO: 84921 - DNA, 20 bp, synthetic construct
  misc_feature 1..20: note = CRISPR gRNA sequence
  source 1..20: mol_type = other DNA
acaatcccaatatgcagatt

SEQ ID NO: 84922 - DNA, 20 bp, synthetic construct
  misc_feature 1..20: note = CRISPR gRNA sequence
  source 1..20: mol_type = other DNA
tttatatcagatgggatggg

SEQ ID NO: 84923 - DNA, 20 bp, synthetic construct
  misc_feature 1..20: note = CRISPR gRNA sequence
  source 1..20: mol_type = other DNA
atatcagatgggatgggact

SEQ ID NO: 84924 - DNA, 20 bp, synthetic construct
  misc_feature 1..20: note = CRISPR gRNA sequence
  source 1..20: mol_type = other DNA
tatcagatgggatgggactc

SEQ ID NO: 84925 - DNA, 20 bp, synthetic construct
  misc_feature 1..20: note = CRISPR gRNA sequence
  source 1..20: mol_type = other DNA
attcagggtagtatggccat

SEQ ID NO: 84926 - DNA, 20 bp, synthetic construct
  misc_feature 1..20: note = CRISPR gRNA sequence
  source 1..20: mol_type = other DNA
agggtagtatggccatagac

SEQ ID NO: 84927 - DNA, 20 bp, synthetic construct
  misc_feature 1..20: note = CRISPR gRNA sequence
  source 1..20: mol_type = other DNA
ttttatatcaaagcagcttt

SEQ ID NO: 84928 - DNA, 20 bp, synthetic construct
  misc_feature 1..20: note = CRISPR gRNA sequence
  source 1..20: mol_type = other DNA
tttatatcaaagcagcttta

SEQ ID NO: 84929 - DNA, 20 bp, synthetic construct
  misc_feature 1..20: note = CRISPR gRNA sequence
  source 1..20: mol_type = other DNA
ttatatcaaagcagctttat

SEQ ID NO: 84930 - DNA, 20 bp, synthetic construct
  misc_feature 1..20: note = CRISPR gRNA sequence
  source 1..20: mol_type = other DNA
tatatcaaagcagctttatg

SEQ ID NO: 84931 - DNA, 20 bp, synthetic construct
  misc_feature 1..20: note = CRISPR gRNA sequence
  source 1..20: mol_type = other DNA
atatcaaagcagctttatga

SEQ ID NO: 84932 - DNA, 20 bp, synthetic construct
  misc_feature 1..20: note = CRISPR gRNA sequence
  source 1..20: mol_type = other DNA
tatcaaagcagctttatgat

SEQ ID NO: 84933 - DNA, 20 bp, synthetic construct
  misc_feature 1..20: note = CRISPR gRNA sequence
  source 1..20: mol_type = other DNA
tatgatatgactactcatac

SEQ ID NO: 84934 - DNA, 20 bp, synthetic construct
  misc_feature 1..20: note = CRISPR gRNA sequence
  source 1..20: mol_type = other DNA
atgatatgactactcataca

SEQ ID NO: 84935 - DNA, 20 bp, synthetic construct
  misc_feature 1..20: note = CRISPR gRNA sequence
  source 1..20: mol_type = other DNA
tgatatgactactcatacac

SEQ ID NO: 84936 - DNA, 20 bp, synthetic construct
  misc_feature 1..20: note = CRISPR gRNA sequence
  source 1..20: mol_type = other DNA
ctcatacacaactttcagca

SEQ ID NO: 84937 - DNA, 20 bp, synthetic construct
  misc_feature 1..20: note = CRISPR gRNA sequence
  source 1..20: mol_type = other DNA
atacacaactttcagcagct

SEQ ID NO: 84938 - DNA, 20 bp, synthetic construct
  misc_feature 1..20: note = CRISPR gRNA sequence
  source 1..20: mol_type = other DNA
tcagcagcttacaaaagaat

SEQ ID NO: 84939 - DNA, 20 bp, synthetic construct
  misc_feature 1..20: note = CRISPR gRNA sequence
  source 1..20: mol_type = other DNA
cagcagcttacaaaagaatg

SEQ ID NO: 84940 - DNA, 20 bp, synthetic construct
  misc_feature 1..20: note = CRISPR gRNA sequence
  source 1..20: mol_type = other DNA
agcagcttacaaaagaatgt

SEQ ID NO: 84941 - DNA, 20 bp, synthetic construct
  misc_feature 1..20: note = CRISPR gRNA sequence
  source 1..20: mol_type = other DNA
acaaaagaatgtaagactta

SEQ ID NO: 84942 - DNA, 20 bp, synthetic construct
  misc_feature 1..20: note = CRISPR gRNA sequence
  source 1..20: mol_type = other DNA
caaaagaatgtaagacttac

SEQ ID NO: 84943 - DNA, 20 bp, synthetic construct
  misc_feature 1..20: note = CRISPR gRNA sequence
  source 1..20: mol_type = other DNA
accccacttaactatcttgg

SEQ ID NO: 84944 - DNA, 20 bp, synthetic construct
  misc_feature 1..20: note = CRISPR gRNA sequence
  source 1..20: mol_type = other DNA
ccccacttaactatcttggg

SEQ ID NO: 84945 - DNA, 20 bp, synthetic construct
  misc_feature 1..20: note = CRISPR gRNA sequence
  source 1..20: mol_type = other DNA
aactatcttgggctgtgaca

SEQ ID NO: 84946 - DNA, 20 bp, synthetic construct
  misc_feature 1..20: note = CRISPR gRNA sequence
  source 1..20: mol_type = other DNA
actatcttgggctgtgacaa

SEQ ID NO: 84947 - DNA, 20 bp, synthetic construct
  misc_feature 1..20: note = CRISPR gRNA sequence
  source 1..20: mol_type = other DNA
tcttgggctgtgacaaagtc

SEQ ID NO: 84948 - DNA, 20 bp, synthetic construct
  misc_feature 1..20: note = CRISPR gRNA sequence
  source 1..20: mol_type = other DNA
gggctgtgacaaagtcacat

SEQ ID NO: 84949 - DNA, 20 bp, synthetic construct
  misc_feature 1..20: note = CRISPR gRNA sequence
  source 1..20: mol_type = other DNA
ggctgtgacaaagtcacatg

SEQ ID NO: 84950 - DNA, 20 bp, synthetic construct
  misc_feature 1..20: note = CRISPR gRNA sequence
  source 1..20: mol_type = other DNA
tgacaaagtcacatggttca

SEQ ID NO: 84951 - DNA, 20 bp, synthetic construct
  misc_feature 1..20: note = CRISPR gRNA sequence
  source 1..20: mol_type = other DNA
acacggcaggcatactcatc

SEQ ID NO: 84952 - DNA, 20 bp, synthetic construct
  misc_feature 1..20: note = CRISPR gRNA sequence
  source 1..20: mol_type = other DNA
atctttttcagtgggggtga

SEQ ID NO: 84953 - DNA, 20 bp, synthetic construct
  misc_feature 1..20: note = CRISPR gRNA sequence
  source 1..20: mol_type = other DNA
tttcagtgggggtgaattca

SEQ ID NO: 84954 - DNA, 20 bp, synthetic construct
  misc_feature 1..20: note = CRISPR gRNA sequence
  source 1..20: mol_type = other DNA
ttcagtgggggtgaattcag

SEQ ID NO: 84955 - DNA, 20 bp, synthetic construct
  misc_feature 1..20: note = CRISPR gRNA sequence
  source 1..20: mol_type = other DNA
tcagtgggggtgaattcagt

SEQ ID NO: 84956 - DNA, 20 bp, synthetic construct
  misc_feature 1..20: note = CRISPR gRNA sequence
  source 1..20: mol_type = other DNA
cagtgggggtgaattcagtg

SEQ ID NO: 84957 - DNA, 20 bp, synthetic construct
  misc_feature 1..20: note = CRISPR gRNA sequence
  source 1..20: mol_type = other DNA
agtgggggtgaattcagtgt

SEQ ID NO: 84958 - DNA, 20 bp, synthetic construct
  misc_feature 1..20: note = CRISPR gRNA sequence
  source 1..20: mol_type = other DNA
agtgtagtacaagagataga

SEQ ID NO: 84959 - DNA, 20 bp, synthetic construct
  misc_feature 1..20: note = CRISPR gRNA sequence
  source 1..20: mol_type = other DNA
gctgaaagacaagtctgaat

SEQ ID NO: 84960 - DNA, 20 bp, synthetic construct
  misc_feature 1..20: note = CRISPR gRNA sequence
  source 1..20: mol_type = other DNA
ctgaaagacaagtctgaatg

SEQ ID NO: 84961 - DNA, 20 bp, synthetic construct
  misc_feature 1..20: note = CRISPR gRNA sequence
  source 1..20: mol_type = other DNA
aaagacaagtctgaatgctc

SEQ ID NO: 84962 - DNA, 20 bp, synthetic construct
  misc_feature 1..20: note = CRISPR gRNA sequence
  source 1..20: mol_type = other DNA
aatgctccactttttcaatt

SEQ ID NO: 84963 - DNA, 20 bp, synthetic construct
  misc_feature 1..20: note = CRISPR gRNA sequence
  source 1..20: mol_type = other DNA
cactttttcaattctctctc

SEQ ID NO: 84964 - DNA, 20 bp, synthetic construct
  misc_feature 1..20: note = CRISPR gRNA sequence
  source 1..20: mol_type = other DNA
tttcaattctctctccattc

SEQ ID NO: 84965 - DNA, 20 bp, synthetic construct
  misc_feature 1..20: note = CRISPR gRNA sequence
  source 1..20: mol_type = other DNA
ttcaattctctctccattct

SEQ ID NO: 84966 - DNA, 20 bp, synthetic construct
  misc_feature 1..20: note = CRISPR gRNA sequence
  source 1..20: mol_type = other DNA
tcaattctctctccattctt

SEQ ID NO: 84967 - DNA, 20 bp, synthetic construct
  misc_feature 1..20: note = CRISPR gRNA sequence
  source 1..20: mol_type = other DNA
caattctctctccattcttc

SEQ ID NO: 84968 - DNA, 20 bp, synthetic construct
  misc_feature 1..20: note = CRISPR gRNA sequence
  source 1..20: mol_type = other DNA
aattctctctccattcttca

SEQ ID NO: 84969 - DNA, 20 bp, synthetic construct
  misc_feature 1..20: note = CRISPR gRNA sequence
  source 1..20: mol_type = other DNA
tctctccattcttcagtaag

SEQ ID NO: 84970 - DNA, 20 bp, synthetic construct
  misc_feature 1..20: note = CRISPR gRNA sequence
  source 1..20: mol_type = other DNA
tctccattcttcagtaagtc

SEQ ID NO: 84971 - DNA, 20 bp, synthetic construct
  misc_feature 1..20: note = CRISPR gRNA sequence
  source 1..20: mol_type = other DNA
tccattcttcagtaagtcaa

SEQ ID NO: 84972 - DNA, 20 bp, synthetic construct
  misc_feature 1..20: note = CRISPR gRNA sequence
  source 1..20: mol_type = other DNA
cattcttcagtaagtcaact

SEQ ID NO: 84973 - DNA, 20 bp, synthetic construct
  misc_feature 1..20: note = CRISPR gRNA sequence
  source 1..20: mol_type = other DNA
ttcagtaagtcaacttcaat

SEQ ID NO: 84974 - DNA, 20 bp, synthetic construct
  misc_feature 1..20: note = CRISPR gRNA sequence
  source 1..20: mol_type = other DNA
cagtaagtcaacttcaatgt

SEQ ID NO: 84975 - DNA, 20 bp, synthetic construct
  misc_feature 1..20: note = CRISPR gRNA sequence
  source 1..20: mol_type = other DNA
agtaagtcaacttcaatgtc

SEQ ID NO: 84976 - DNA, 20 bp, synthetic construct
  misc_feature 1..20: note = CRISPR gRNA sequence
  source 1..20: mol_type = other DNA
caatgtcggatggatgaaac

SEQ ID NO: 84977 - DNA, 20 bp, synthetic construct
  misc_feature 1..20: note = CRISPR gRNA sequence
  source 1..20: mol_type = other DNA
aatgtcggatggatgaaacc

SEQ ID NO: 84978 - DNA, 20 bp, synthetic construct
  misc_feature 1..20: note = CRISPR gRNA sequence
  source 1..20: mol_type = other DNA
aggaaatttgactttccatt

SEQ ID NO: 84979 - DNA, 20 bp, synthetic construct
  misc_feature 1..20: note = CRISPR gRNA sequence
  source 1..20: mol_type = other DNA
gactttccattctctgctgg

SEQ ID NO: 84980 - DNA, 20 bp, synthetic construct
  misc_feature 1..20: note = CRISPR gRNA sequence
  source 1..20: mol_type = other DNA
actttccattctctgctgga

SEQ ID NO: 84981 - DNA, 20 bp, synthetic construct
  misc_feature 1..20: note = CRISPR gRNA sequence
  source 1..20: mol_type = other DNA
tccattctctgctggatgac

SEQ ID NO: 84982 - DNA, 20 bp, synthetic construct
  misc_feature 1..20: note = CRISPR gRNA sequence
  source 1..20: mol_type = other DNA
ccattctctgctggatgacg

SEQ ID NO: 84983 - DNA, 20 bp, synthetic construct
  misc_feature 1..20: note = CRISPR gRNA sequence
  source 1..20: mol_type = other DNA
cattctctgctggatgacgt

SEQ ID NO: 84984 - DNA, 20 bp, synthetic construct
  misc_feature 1..20: note = CRISPR gRNA sequence
  source 1..20: mol_type = other DNA
tctgctggatgacgtgagta

SEQ ID NO: 84985 - DNA, 20 bp, synthetic construct
  misc_feature 1..20: note = CRISPR gRNA sequence
  source 1..20: mol_type = other DNA
tgctggatgacgtgagtaaa

SEQ ID NO: 84986 - DNA, 20 bp, synthetic construct
  misc_feature 1..20: note = CRISPR gRNA sequence
  source 1..20: mol_type = other DNA
ctggatgacgtgagtaaacc

SEQ ID NO: 84987 - DNA, 20 bp, synthetic construct
  misc_feature 1..20: note = CRISPR gRNA sequence
  source 1..20: mol_type = other DNA
gatgacgtgagtaaacctga

SEQ ID NO: 84988 - DNA, 20 bp, synthetic construct
  misc_feature 1..20: note = CRISPR gRNA sequence
  source 1..20: mol_type = other DNA
aatctttggagtacctgagg

SEQ ID NO: 84989 - DNA, 20 bp, synthetic construct
  misc_feature 1..20: note = CRISPR gRNA sequence
  source 1..20: mol_type = other DNA
tggagtacctgaggaatatc

SEQ ID NO: 84990 - DNA, 20 bp, synthetic construct
  misc_feature 1..20: note = CRISPR gRNA sequence
  source 1..20: mol_type = other DNA
ggagtacctgaggaatatcg

SEQ ID NO: 84991 - DNA, 20 bp, synthetic construct
  misc_feature 1..20: note = CRISPR gRNA sequence
  source 1..20: mol_type = other DNA
gagtacctgaggaatatcgg

SEQ ID NO: 84992 - DNA, 20 bp, synthetic construct
  misc_feature 1..20: note = CRISPR gRNA sequence
  source 1..20: mol_type = other DNA
aggaatatcgggaaaagaca

SEQ ID NO: 84993 - DNA, 20 bp, synthetic construct
  misc_feature 1..20: note = CRISPR gRNA sequence
  source 1..20: mol_type = other DNA
atattgccagggtatttcac

SEQ ID NO: 84994 - DNA, 20 bp, synthetic construct
  misc_feature 1..20: note = CRISPR gRNA sequence
  source 1..20: mol_type = other DNA
ccagggtatttcacttgggg

SEQ ID NO: 84995 - DNA, 20 bp, synthetic construct
  misc_feature 1..20: note = CRISPR gRNA sequence
  source 1..20: mol_type = other DNA
cacttggggctaacttggtg

SEQ ID NO: 84996 - DNA, 20 bp, synthetic construct
  misc_feature 1..20: note = CRISPR gRNA sequence
  source 1..20: mol_type = other DNA
acttggggctaacttggtgt

SEQ ID NO: 84997 - DNA, 20 bp, synthetic construct
  misc_feature 1..20: note = CRISPR gRNA sequence
  source 1..20: mol_type = other DNA
ggggctaacttggtgtcaag

SEQ ID NO: 84998 - DNA, 20 bp, synthetic construct
  misc_feature 1..20: note = CRISPR gRNA sequence
  source 1..20: mol_type = other DNA
gggctaacttggtgtcaagc

SEQ ID NO: 84999 - DNA, 20 bp, synthetic construct
  misc_feature 1..20: note = CRISPR gRNA sequence
  source 1..20: mol_type = other DNA
acttggtgtcaagctatatc

SEQ ID NO: 85000 - DNA, 20 bp, synthetic construct
  misc_feature 1..20: note = CRISPR gRNA sequence
  source 1..20: mol_type = other DNA
ggtgtcaagctatatcaggc

SEQ ID NO: 85001 - DNA, 20 bp, synthetic construct
  misc_feature 1..20: note = CRISPR gRNA sequence
  source 1..20: mol_type = other DNA
gtgtcaagctatatcaggca

SEQ ID NO: 85002 - DNA, 20 bp, synthetic construct
  misc_feature 1..20: note = CRISPR gRNA sequence
  source 1..20: mol_type = other DNA
tatcaggcaccaagtgttta

SEQ ID NO: 85003 - DNA, 20 bp, synthetic construct
  misc_feature 1..20: note = CRISPR gRNA sequence
  source 1..20: mol_type = other DNA
acatttggtcatcgatttct

SEQ ID NO: 85004 - DNA, 20 bp, synthetic construct
  misc_feature 1..20: note = CRISPR gRNA sequence
  source 1..20: mol_type = other DNA
catttggtcatcgatttctc

SEQ ID NO: 85005 - DNA, 20 bp, synthetic construct
  misc_feature 1..20: note = CRISPR gRNA sequence
  source 1..20: mol_type = other DNA
ggtcatcgatttctcccaat

SEQ ID NO: 85006 - DNA, 20 bp, synthetic construct
  misc_feature 1..20: note = CRISPR gRNA sequence
  source 1..20: mol_type = other DNA
gtcatcgatttctcccaatt

SEQ ID NO: 85007 - DNA, 20 bp, synthetic construct
  misc_feature 1..20: note = CRISPR gRNA sequence
  source 1..20: mol_type = other DNA
ctcccaattccatttccact

SEQ ID NO: 85008 - DNA, 20 bp, synthetic construct
  misc_feature 1..20: note = CRISPR gRNA sequence
  source 1..20: mol_type = other DNA
tcccaattccatttccactc

SEQ ID NO: 85009 - DNA, 20 bp, synthetic construct
  misc_feature 1..20: note = CRISPR gRNA sequence
  source 1..20: mol_type = other DNA
ccaattccatttccactctg

SEQ ID NO: 85010 - DNA, 20 bp, synthetic construct
  misc_feature 1..20: note = CRISPR gRNA sequence
  source 1..20: mol_type = other DNA
catttccactctggccaaat

SEQ ID NO: 85011 - DNA, 20 bp, synthetic construct
  misc_feature 1..20: note = CRISPR gRNA sequence
  source 1..20: mol_type = other DNA
ccactctggccaaatgagct

SEQ ID NO: 85012 - DNA, 20 bp, synthetic construct
  misc_feature 1..20: note = CRISPR gRNA sequence
  source 1..20: mol_type = other DNA
cactctggccaaatgagctt

SEQ ID NO: 85013 - DNA, 20 bp, synthetic construct
  misc_feature 1..20: note = CRISPR gRNA sequence
  source 1..20: mol_type = other DNA
tggccaaatgagcttccacc

SEQ ID NO: 85014 - DNA, 20 bp, synthetic construct
  misc_feature 1..20: note = CRISPR gRNA sequence
  source 1..20: mol_type = other DNA
gccaaatgagcttccacctt

SEQ ID NO: 85015 - DNA, 20 bp, synthetic construct
  misc_feature 1..20: note = CRISPR gRNA sequence
  source 1..20: mol_type = other DNA
ccaccttcccaacaagccac

SEQ ID NO: 85016 - DNA, 20 bp, synthetic construct
  misc_feature 1..20: note = CRISPR gRNA sequence
  source 1..20: mol_type = other DNA
caccttcccaacaagccacc

SEQ ID NO: 85017 - DNA, 20 bp, synthetic construct
  misc_feature 1..20: note = CRISPR gRNA sequence
  source 1..20: mol_type = other DNA
cccaacaagccacctccatt

SEQ ID NO: 85018 - DNA, 20 bp, synthetic construct
  misc_feature 1..20: note = CRISPR gRNA sequence
  source 1..20: mol_type = other DNA
ccaacaagccacctccattt

SEQ ID NO: 85019 - DNA, 20 bp, synthetic construct
  misc_feature 1..20: note = CRISPR gRNA sequence
  source 1..20: mol_type = other DNA
cattttgaagaataaaccgt

SEQ ID NO: 85020 - DNA, 20 bp, synthetic construct
  misc_feature 1..20: note = CRISPR gRNA sequence
  source 1..20: mol_type = other DNA
tgaagaataaaccgtgactt

SEQ ID NO: 85021 - DNA, 20 bp, synthetic construct
  misc_feature 1..20: note = CRISPR gRNA sequence
  source 1..20: mol_type = other DNA
gaagaataaaccgtgacttg

SEQ ID NO: 85022 - DNA, 20 bp, synthetic construct
  misc_feature 1..20: note = CRISPR gRNA sequence
  source 1..20: mol_type = other DNA
aagaataaaccgtgacttgg

SEQ ID NO: 85023 - DNA, 20 bp, synthetic construct
  misc_feature 1..20: note = CRISPR gRNA sequence
  source 1..20: mol_type = other DNA
ggtatctttccctcataatt

SEQ ID NO: 85024 - DNA, 20 bp, synthetic construct
  misc_feature 1..20: note = CRISPR gRNA sequence
  source 1..20: mol_type = other DNA
gtatctttccctcataattc

SEQ ID NO: 85025 - DNA, 20 bp, synthetic construct
  misc_feature 1..20: note = CRISPR gRNA sequence
  source 1..20: mol_type = other DNA
tccctcataattcctctata

SEQ ID NO: 85026 - DNA, 20 bp, synthetic construct
  misc_feature 1..20: note = CRISPR gRNA sequence
  source 1..20: mol_type = other DNA
ccctcataattcctctatac

SEQ ID NO: 85027 - DNA, 20 bp, synthetic construct
  misc_feature 1..20: note = CRISPR gRNA sequence
  source 1..20: mol_type = other DNA
cctcataattcctctataca

SEQ ID NO: 85028 - DNA, 20 bp, synthetic construct
  misc_feature 1..20: note = CRISPR gRNA sequence
  source 1..20: mol_type = other DNA
ataattcctctatacatgcc

SEQ ID NO: 85029 - DNA, 20 bp, synthetic construct
  misc_feature 1..20: note = CRISPR gRNA sequence
  source 1..20: mol_type = other DNA
ctctatacatgccttttttg

SEQ ID NO: 85030 - DNA, 20 bp, synthetic construct
  misc_feature 1..20: note = CRISPR gRNA sequence
  source 1..20: mol_type = other DNA
tatacatgccttttttgttt

SEQ ID NO: 85031 - DNA, 20 bp, synthetic construct
  misc_feature 1..20: note = CRISPR gRNA sequence
  source 1..20: mol_type = other DNA
tacatgccttttttgttttt

SEQ ID NO: 85032 - DNA, 20 bp, synthetic construct
  misc_feature 1..20: note = CRISPR gRNA sequence
  source 1..20: mol_type = other DNA
ttttgttttttttctagcag

SEQ ID NO: 85033 - DNA, 20 bp, synthetic construct
  misc_feature 1..20: note = CRISPR gRNA sequence
  source 1..20: mol_type = other DNA
tttgttttttttctagcaga

SEQ ID NO: 85034 - DNA, 20 bp, synthetic construct
  misc_feature 1..20: note = CRISPR gRNA sequence
  source 1..20: mol_type = other DNA
ttgttttttttctagcagat

SEQ ID NO: 85035 - DNA, 20 bp, synthetic construct
  misc_feature 1..20: note = CRISPR gRNA sequence
  source 1..20: mol_type = other DNA
tgttttttttctagcagatt

SEQ ID NO: 85036 - DNA, 20 bp, synthetic construct
  misc_feature 1..20: note = CRISPR gRNA sequence
  source 1..20: mol_type = other DNA
gttttttttctagcagattt

SEQ ID NO: 85037 - DNA, 20 bp, synthetic construct
  misc_feature 1..20: note = CRISPR gRNA sequence
  source 1..20: mol_type = other DNA
ttttttttctagcagatttc

SEQ ID NO: 85038 - DNA, 20 bp, synthetic construct
  misc_feature 1..20: note = CRISPR gRNA sequence
  source 1..20: mol_type = other DNA
tttttctagcagatttctag

SEQ ID NO: 85039 - DNA, 20 bp, synthetic construct
  misc_feature 1..20: note = CRISPR gRNA sequence
  source 1..20: mol_type = other DNA
ttttctagcagatttctagc

SEQ ID NO: 85040 - DNA, 20 bp, synthetic construct
  misc_feature 1..20: note = CRISPR gRNA sequence
  source 1..20: mol_type = other DNA
tttctagcagatttctagca

SEQ ID NO: 85041 - DNA, 20 bp, synthetic construct
  misc_feature 1..20: note = CRISPR gRNA sequence
  source 1..20: mol_type = other DNA
ttctagcagatttctagcag

SEQ ID NO: 85042 - DNA, 20 bp, synthetic construct
  misc_feature 1..20: note = CRISPR gRNA sequence
  source 1..20: mol_type = other DNA
tctagcagatttctagcagt

SEQ ID NO: 85043 - DNA, 20 bp, synthetic construct
  misc_feature 1..20: note = CRISPR gRNA sequence
  source 1..20: mol_type = other DNA
ctagcagatttctagcagta

SEQ ID NO: 85044 - DNA, 20 bp, synthetic construct
  misc_feature 1..20: note = CRISPR gRNA sequence
  source 1..20: mol_type = other DNA
tagcagatttctagcagtat

SEQ ID NO: 85045 - DNA, 20 bp, synthetic construct
  misc_feature 1..20: note = CRISPR gRNA sequence
  source 1..20: mol_type = other DNA
gcagatttctagcagtatct

SEQ ID NO: 85046 - DNA, 20 bp, synthetic construct
  misc_feature 1..20: note = CRISPR gRNA sequence
  source 1..20: mol_type = other DNA
ctagcagtatcttctgtcac

SEQ ID NO: 85047 - DNA, 20 bp, synthetic construct
  misc_feature 1..20: note = CRISPR gRNA sequence
  source 1..20: mol_type = other DNA
tagcagtatcttctgtcact

SEQ ID NO: 85048 - DNA, 20 bp, synthetic construct
  misc_feature 1..20: note = CRISPR gRNA sequence
  source 1..20: mol_type = other DNA
gcagtatcttctgtcactgg

SEQ ID NO: 85049 - DNA, 20 bp, synthetic construct
  misc_feature 1..20: note = CRISPR gRNA sequence
  source 1..20: mol_type = other DNA
ctgtcactggagattgcgct

SEQ ID NO: 85050 - DNA, 20 bp, synthetic construct
  misc_feature 1..20: note = CRISPR gRNA sequence
  source 1..20: mol_type = other DNA
tgtcactggagattgcgctg

SEQ ID NO: 85051 - DNA, 20 bp, synthetic construct
  misc_feature 1..20: note = CRISPR gRNA sequence
  source 1..20: mol_type = other DNA
tcactggagattgcgctgca

SEQ ID NO: 85052 - DNA, 20 bp, synthetic construct
  misc_feature 1..20: note = CRISPR gRNA sequence
  source 1..20: mol_type = other DNA
gagattgcgctgcattttta

SEQ ID NO: 85053 - DNA, 20 bp, synthetic construct
  misc_feature 1..20: note = CRISPR gRNA sequence
  source 1..20: mol_type = other DNA
cgctgcatttttaagagcct

SEQ ID NO: 85054 - DNA, 20 bp, synthetic construct
  misc_feature 1..20: note = CRISPR gRNA sequence
  source 1..20: mol_type = other DNA
catttttaagagcctttctc

SEQ ID NO: 85055 - DNA, 20 bp, synthetic construct
  misc_feature 1..20: note = CRISPR gRNA sequence
  source 1..20: mol_type = other DNA
ttaagagcctttctctggag

SEQ ID NO: 85056 - DNA, 20 bp, synthetic construct
  misc_feature 1..20: note = CRISPR gRNA sequence
  source 1..20: mol_type = other DNA
taagagcctttctctggagg

SEQ ID NO: 85057 - DNA, 20 bp, synthetic construct
  misc_feature 1..20: note = CRISPR gRNA sequence
  source 1..20: mol_type = other DNA
aagagcctttctctggaggc

SEQ ID NO: 85058 - DNA, 20 bp, synthetic construct
  misc_feature 1..20: note = CRISPR gRNA sequence
  source 1..20: mol_type = other DNA
agagcctttctctggaggct

SEQ ID NO: 85059 - DNA, 20 bp, synthetic construct
  misc_feature 1..20: note = CRISPR gRNA sequence
  source 1..20: mol_type = other DNA
tctctggaggctctcaagga

SEQ ID NO: 85060 - DNA, 20 bp, synthetic construct
  misc_feature 1..20: note = CRISPR gRNA sequence
  source 1..20: mol_type = other DNA
ctctggaggctctcaaggac

SEQ ID NO: 85061 - DNA, 20 bp, synthetic construct
  misc_feature 1..20: note = CRISPR gRNA sequence
  source 1..20: mol_type = other DNA
tctggaggctctcaaggact

SEQ ID NO: 85062 - DNA, 20 bp, synthetic construct
  misc_feature 1..20: note = CRISPR gRNA sequence
  source 1..20: mol_type = other DNA
tggaggctctcaaggacttc

SEQ ID NO: 85063 - DNA, 20 bp, synthetic construct
  misc_feature 1..20: note = CRISPR gRNA sequence
  source 1..20: mol_type = other DNA
gaggctctcaaggacttctg

SEQ ID NO: 85064 - DNA, 20 bp, synthetic construct
  misc_feature 1..20: note = CRISPR gRNA sequence
  source 1..20: mol_type = other DNA
tcaaggacttctgatgccct

SEQ ID NO: 85065 - DNA, 20 bp, synthetic construct
  misc_feature 1..20: note = CRISPR gRNA sequence
  source 1..20: mol_type = other DNA
aaggacttctgatgccctct

SEQ ID NO: 85066 - DNA, 20 bp, synthetic construct
  misc_feature 1..20: note = CRISPR gRNA sequence
  source 1..20: mol_type = other DNA
ctgatgccctctcagcactc

SEQ ID NO: 85067 - DNA, 20 bp, synthetic construct
  misc_feature 1..20: note = CRISPR gRNA sequence
  source 1..20: mol_type = other DNA
tgatgccctctcagcactca

SEQ ID NO: 85068 - DNA, 20 bp, synthetic construct
  misc_feature 1..20: note = CRISPR gRNA sequence
  source 1..20: mol_type = other DNA
atgccctctcagcactcata

SEQ ID NO: 85069 - DNA, 20 bp, synthetic construct
  misc_feature 1..20: note = CRISPR gRNA sequence
  source 1..20: mol_type = other DNA
tcagcactcatagcattcct

SEQ ID NO: 85070 - DNA, 20 bp, synthetic construct
  misc_feature 1..20: note = CRISPR gRNA sequence
  source 1..20: mol_type = other DNA
agcactcatagcattcctta

SEQ ID NO: 85071 - DNA, 20 bp, synthetic construct
  misc_feature 1..20: note = CRISPR gRNA sequence
  source 1..20: mol_type = other DNA
atagcattccttaacacatc

SEQ ID NO: 85072 - DNA, 20 bp, synthetic construct
  misc_feature 1..20: note = CRISPR gRNA sequence
  source 1..20: mol_type = other DNA
cttaacacatcactcaagag

SEQ ID NO: 85073 - DNA, 20 bp, synthetic construct
  misc_feature 1..20: note = CRISPR gRNA sequence
  source 1..20: mol_type = other DNA
aacacatcactcaagagtct

SEQ ID NO: 85074 - DNA, 20 bp, synthetic construct
  misc_feature 1..20: note = CRISPR gRNA sequence
  source 1..20: mol_type = other DNA
acacatcactcaagagtcta

SEQ ID NO: 85075 - DNA, 20 bp, synthetic construct
  misc_feature 1..20: note = CRISPR gRNA sequence
  source 1..20: mol_type = other DNA
aagagtctacatgatttggc

SEQ ID NO: 85076 - DNA, 20 bp, synthetic construct
  misc_feature 1..20: note = CRISPR gRNA sequence
  source 1..20: mol_type = other DNA
catgatttggccccaagata

SEQ ID NO: 85077 - DNA, 20 bp, synthetic construct
  misc_feature 1..20: note = CRISPR gRNA sequence
  source 1..20: mol_type = other DNA
ggccccaagatacttttcaa

SEQ ID NO: 85078 - DNA, 20 bp, synthetic construct
  misc_feature 1..20: note = CRISPR gRNA sequence
  source 1..20: mol_type = other DNA
gccccaagatacttttcaaa

SEQ ID NO: 85079 - DNA, 20 bp, synthetic construct
  misc_feature 1..20: note = CRISPR gRNA sequence
  source 1..20: mol_type = other DNA
ttcaaagttcatttctcagt

SEQ ID NO: 85080 - DNA, 20 bp, synthetic construct
  misc_feature 1..20: note = CRISPR gRNA sequence
  source 1..20: mol_type = other DNA
tcaaagttcatttctcagtt

SEQ ID NO: 85081 - DNA, 20 bp, synthetic construct
  misc_feature 1..20: note = CRISPR gRNA sequence
  source 1..20: mol_type = other DNA
caaagttcatttctcagttc

SEQ ID NO: 85082 - DNA, 20 bp, synthetic construct
  misc_feature 1..20: note = CRISPR gRNA sequence
  source 1..20: mol_type = other DNA
aaagttcatttctcagttca

SEQ ID NO: 85083 - DNA, 20 bp, synthetic construct
  misc_feature 1..20: note = CRISPR gRNA sequence
  source 1..20: mol_type = other DNA
atttctcagttcataatagc

SEQ ID NO: 85084 - DNA, 20 bp, synthetic construct
  misc_feature 1..20: note = CRISPR gRNA sequence
  source 1..20: mol_type = other DNA
ctcagttcataatagccccc

SEQ ID NO: 85085 - DNA, 20 bp, synthetic construct
  misc_feature 1..20: note = CRISPR gRNA sequence
  source 1..20: mol_type = other DNA
tcagttcataatagccccca

SEQ ID NO: 85086 - DNA, 20 bp, synthetic construct
  misc_feature 1..20: note = CRISPR gRNA sequence
  source 1..20: mol_type = other DNA
agttcataatagcccccatc

SEQ ID NO: 85087 - DNA, 20 bp, synthetic construct
  misc_feature 1..20: note = CRISPR gRNA sequence
  source 1..20: mol_type = other DNA
ataatagcccccatcaaatt

SEQ ID NO: 85088 - DNA, 20 bp, synthetic construct
  misc_feature 1..20: note = CRISPR gRNA sequence
  source 1..20: mol_type = other DNA
ctcatgttattgtactctgt

SEQ ID NO: 85089 - DNA, 20 bp, synthetic construct
  misc_feature 1..20: note = CRISPR gRNA sequence
  source 1..20: mol_type = other DNA
atgttattgtactctgtttc

SEQ ID NO: 85090 - DNA, 20 bp, synthetic construct
  misc_feature 1..20: note = CRISPR gRNA sequence
  source 1..20: mol_type = other DNA
ttgtactctgtttccacccc

SEQ ID NO: 85091 - DNA, 20 bp, synthetic construct
  misc_feature 1..20: note = CRISPR gRNA sequence
  source 1..20: mol_type = other DNA
tactctgtttccaccccttc

SEQ ID NO: 85092 - DNA, 20 bp, synthetic construct
  misc_feature 1..20: note = CRISPR gRNA sequence
  source 1..20: mol_type = other DNA
tgtttccaccccttccattt

SEQ ID NO: 85093 - DNA, 20 bp, synthetic construct
  misc_feature 1..20: note = CRISPR gRNA sequence
  source 1..20: mol_type = other DNA
tttccaccccttccattttt

SEQ ID NO: 85094 - DNA, 20 bp, synthetic construct
  misc_feature 1..20: note = CRISPR gRNA sequence
  source 1..20: mol_type = other DNA
ccaccccttccatttttttt

SEQ ID NO: 85095 - DNA, 20 bp, synthetic construct
  misc_feature 1..20: note = CRISPR gRNA sequence
  source 1..20: mol_type = other DNA
caccccttccattttttttc

SEQ ID NO: 85096 - DNA, 20 bp, synthetic construct
  misc_feature 1..20: note = CRISPR gRNA sequence
  source 1..20: mol_type = other DNA
ccattttttttcttatgttt

SEQ ID NO: 85097 - DNA, 20 bp, synthetic construct
  misc_feature 1..20: note = CRISPR gRNA sequence
  source 1..20: mol_type = other DNA
cattttttttcttatgttta

SEQ ID NO: 85098 - DNA, 20 bp, synthetic construct
  misc_feature 1..20: note = CRISPR gRNA sequence
  source 1..20: mol_type = other DNA
tttttcttatgtttatgcct

SEQ ID NO: 85099 - DNA, 20 bp, synthetic construct
  misc_feature 1..20: note = CRISPR gRNA sequence
  source 1..20: mol_type = other DNA
ttttcttatgtttatgcctt

SEQ ID NO: 85100 - DNA, 20 bp, synthetic construct
  misc_feature 1..20: note = CRISPR gRNA sequence
  source 1..20: mol_type = other DNA
tttcttatgtttatgccttt

SEQ ID NO: 85101 - DNA, 20 bp, synthetic construct
  misc_feature 1..20: note = CRISPR gRNA sequence
  source 1..20: mol_type = other DNA
ttcttatgtttatgcctttc

SEQ ID NO: 85102 - DNA, 20 bp, synthetic construct
  misc_feature 1..20: note = CRISPR gRNA sequence
  source 1..20: mol_type = other DNA
tcttatgtttatgcctttct

SEQ ID NO: 85103 - DNA, 20 bp, synthetic construct
  misc_feature 1..20: note = CRISPR gRNA sequence
  source 1..20: mol_type = other DNA
cttatgtttatgcctttctt

SEQ ID NO: 85104 - DNA, 20 bp, synthetic construct
  misc_feature 1..20: note = CRISPR gRNA sequence
  source 1..20: mol_type = other DNA
ttatgtttatgcctttcttt

SEQ ID NO: 85105 - DNA, 20 bp, synthetic construct
  misc_feature 1..20: note = CRISPR gRNA sequence
  source 1..20: mol_type = other DNA
atgtttatgcctttcttttt

SEQ ID NO: 85106 - DNA, 20 bp, synthetic construct
  misc_feature 1..20: note = CRISPR gRNA sequence
  source 1..20: mol_type = other DNA
tgtttatgcctttctttttg

SEQ ID NO: 85107 - DNA, 20 bp, synthetic construct
  misc_feature 1..20: note = CRISPR gRNA sequence
  source 1..20: mol_type = other DNA
atgcctttctttttggttcc

SEQ ID NO: 85108 - DNA, 20 bp, synthetic construct
  misc_feature 1..20: note = CRISPR gRNA sequence
  source 1..20: mol_type = other DNA
tgcctttctttttggttcct

SEQ ID NO: 85109 - DNA, 20 bp, synthetic construct
  misc_feature 1..20: note = CRISPR gRNA sequence
  source 1..20: mol_type = other DNA
tctttttggttcctgctcct

SEQ ID NO: 85110 - DNA, 20 bp, synthetic construct
  misc_feature 1..20: note = CRISPR gRNA sequence
  source 1..20: mol_type = other DNA
ctttttggttcctgctcctg

SEQ ID NO: 85111 - DNA, 20 bp, synthetic construct
  misc_feature 1..20: note = CRISPR gRNA sequence
  source 1..20: mol_type = other DNA
tttttggttcctgctcctgc

SEQ ID NO: 85112 - DNA, 20 bp, synthetic construct
  misc_feature 1..20: note = CRISPR gRNA sequence
  source 1..20: mol_type = other DNA
tttggttcctgctcctgcct

SEQ ID NO: 85113 - DNA, 20 bp, synthetic construct
  misc_feature 1..20: note = CRISPR gRNA sequence
  source 1..20: mol_type = other DNA
ttggttcctgctcctgcctt

SEQ ID NO: 85114 - DNA, 20 bp, synthetic construct
  misc_feature 1..20: note = CRISPR gRNA sequence
  source 1..20: mol_type = other DNA
tggttcctgctcctgccttg

SEQ ID NO: 85115 - DNA, 20 bp, synthetic construct
  misc_feature 1..20: note = CRISPR gRNA sequence
  source 1..20: mol_type = other DNA
ggttcctgctcctgccttga

SEQ ID NO: 85116 - DNA, 20 bp, synthetic construct
  misc_feature 1..20: note = CRISPR gRNA sequence
  source 1..20: mol_type = other DNA
gttcctgctcctgccttgat

SEQ ID NO: 85117 - DNA, 20 bp, synthetic construct
  misc_feature 1..20: note = CRISPR gRNA sequence
  source 1..20: mol_type = other DNA
ctgctcctgccttgatctac

SEQ ID NO: 85118 - DNA, 20 bp, synthetic construct
  misc_feature 1..20: note = CRISPR gRNA sequence
  source 1..20: mol_type = other DNA
ctcctgccttgatctacacc

SEQ ID NO: 85119 - DNA, 20 bp, synthetic construct
  misc_feature 1..20: note = CRISPR gRNA sequence
  source 1..20: mol_type = other DNA
ctgccttgatctacacccat

SEQ ID NO: 85120 - DNA, 20 bp, synthetic construct
  misc_feature 1..20: note = CRISPR gRNA sequence
  source 1..20: mol_type = other DNA
ccttgatctacacccatctg

SEQ ID NO: 85121 - DNA, 20 bp, synthetic construct
  misc_feature 1..20: note = CRISPR gRNA sequence
  source 1..20: mol_type = other DNA
gatctacacccatctgattt

SEQ ID NO: 85122 - DNA, 20 bp, synthetic construct
  misc_feature 1..20: note = CRISPR gRNA sequence
  source 1..20: mol_type = other DNA
atctacacccatctgatttt

SEQ ID NO: 85123 - DNA, 20 bp, synthetic construct
  misc_feature 1..20: note = CRISPR gRNA sequence
  source 1..20: mol_type = other DNA
cacccatctgattttctaaa

SEQ ID NO: 85124 - DNA, 20 bp, synthetic construct
  misc_feature 1..20: note = CRISPR gRNA sequence
  source 1..20: mol_type = other DNA
attttctaaactgtatgaag

SEQ ID NO: 85125 - DNA, 20 bp, synthetic construct
  misc_feature 1..20: note = CRISPR gRNA sequence
  source 1..20: mol_type = other DNA
tctaaactgtatgaagtgtc

SEQ ID NO: 85126 - DNA, 20 bp, synthetic construct
  misc_feature 1..20: note = CRISPR gRNA sequence
  source 1..20: mol_type = other DNA
ctaaactgtatgaagtgtct

SEQ ID NO: 85127 - DNA, 20 bp, synthetic construct
  misc_feature 1..20: note = CRISPR gRNA sequence
  source 1..20: mol_type = other DNA
taaactgtatgaagtgtcta

SEQ ID NO: 85128 - DNA, 20 bp, synthetic construct
  misc_feature 1..20: note = CRISPR gRNA sequence
  source 1..20: mol_type = other DNA
aactgtatgaagtgtctagt

SEQ ID NO: 85129 - DNA, 20 bp, synthetic construct
  misc_feature 1..20: note = CRISPR gRNA sequence
  source 1..20: mol_type = other DNA
tatgaagtgtctagtagagt

SEQ ID NO: 85130 - DNA, 20 bp, synthetic construct
  misc_feature 1..20: note = CRISPR gRNA sequence
  source 1..20: mol_type = other DNA
gtagagtgcctgggacatag

SEQ ID NO: 85131 - DNA, 20 bp, synthetic construct
  misc_feature 1..20: note = CRISPR gRNA sequence
  source 1..20: mol_type = other DNA
ggacatagcaattgctctat

SEQ ID NO: 85132 - DNA, 20 bp, synthetic construct
  misc_feature 1..20: note = CRISPR gRNA sequence
  source 1..20: mol_type = other DNA
ctctatacgtggcagatgtt

SEQ ID NO: 85133 - DNA, 20 bp, synthetic construct
  misc_feature 1..20: note = CRISPR gRNA sequence
  source 1..20: mol_type = other DNA
tatacgtggcagatgttatt

SEQ ID NO: 85134 - DNA, 20 bp, synthetic construct
  misc_feature 1..20: note = CRISPR gRNA sequence
  source 1..20: mol_type = other DNA
tacgtggcagatgttattat

SEQ ID NO: 85135 - DNA, 20 bp, synthetic construct
  misc_feature 1..20: note = CRISPR gRNA sequence
  source 1..20: mol_type = other DNA
ttatctgaggttcctaagtg

SEQ ID NO: 85136 - DNA, 20 bp, synthetic construct
  misc_feature 1..20: note = CRISPR gRNA sequence
  source 1..20: mol_type = other DNA
tctgaggttcctaagtggat

SEQ ID NO: 85137 - DNA, 20 bp, synthetic construct
  misc_feature 1..20: note = CRISPR gRNA sequence
  source 1..20: mol_type = other DNA
aggttcctaagtggatcaac

SEQ ID NO: 85138 - DNA, 20 bp, synthetic construct
  misc_feature 1..20: note = CRISPR gRNA sequence
  source 1..20: mol_type = other DNA
ctaagtggatcaacccaagg

SEQ ID NO: 85139 - DNA, 20 bp, synthetic construct
  misc_feature 1..20: note = CRISPR gRNA sequence
  source 1..20: mol_type = other DNA
agtggatcaacccaaggtat

SEQ ID NO: 85140 - DNA, 20 bp, synthetic construct
  misc_feature 1..20: note = CRISPR gRNA sequence
  source 1..20: mol_type = other DNA
tttatttttttattttttta

SEQ ID NO: 85141 - DNA, 20 bp, synthetic construct
  misc_feature 1..20: note = CRISPR gRNA sequence
  source 1..20: mol_type = other DNA
tatttttttatttttttatt

SEQ ID NO: 85142 - DNA, 20 bp, synthetic construct
  misc_feature 1..20: note = CRISPR gRNA sequence
  source 1..20: mol_type = other DNA
atttttttatttttttattt

SEQ ID NO: 85143 - DNA, 20 bp, synthetic construct
  misc_feature 1..20: note = CRISPR gRNA sequence
  source 1..20: mol_type = other DNA
tttttttatttttttatttt

SEQ ID NO: 85144 - DNA, 20 bp, synthetic construct
  misc_feature 1..20: note = CRISPR gRNA sequence
  source 1..20: mol_type = other DNA
ttttatttttttattttttg

SEQ ID NO: 85145 - DNA, 20 bp, synthetic construct
  misc_feature 1..20: note = CRISPR gRNA sequence
  source 1..20: mol_type = other DNA
tttatttttttattttttgg

SEQ ID NO: 85146 - DNA, 20 bp, synthetic construct
  misc_feature 1..20: note = CRISPR gRNA sequence
  source 1..20: mol_type = other DNA
ttatttttttattttttggg

SEQ ID NO: 85147 - DNA, 20 bp, synthetic construct
  misc_feature 1..20: note = CRISPR gRNA sequence
  source 1..20: mol_type = other DNA
tatttttttattttttggga

SEQ ID NO: 85148 - DNA, 20 bp, synthetic construct
  misc_feature 1..20: note = CRISPR gRNA sequence
  source 1..20: mol_type = other DNA
atttttttattttttgggat

SEQ ID NO: 85149 - DNA, 20 bp, synthetic construct
  misc_feature 1..20: note = CRISPR gRNA sequence
  source 1..20: mol_type = other DNA
tttttttattttttgggatg

SEQ ID NO: 85150 - DNA, 20 bp, synthetic construct
  misc_feature 1..20: note = CRISPR gRNA sequence
  source 1..20: mol_type = other DNA
ttttattttttgggatggaa

SEQ ID NO: 85151 - DNA, 20 bp, synthetic construct
  misc_feature 1..20: note = CRISPR gRNA sequence
  source 1..20: mol_type = other DNA
tttattttttgggatggaat

SEQ ID NO: 85152 - DNA, 20 bp, synthetic construct
  misc_feature 1..20: note = CRISPR gRNA sequence
  source 1..20: mol_type = other DNA
ttattttttgggatggaatc

SEQ ID NO: 85153 - DNA, 20 bp, synthetic construct
  misc_feature 1..20: note = CRISPR gRNA sequence
  source 1..20: mol_type = other DNA
tattttttgggatggaatct

SEQ ID NO: 85154 - DNA, 20 bp, synthetic construct
  misc_feature 1..20: note = CRISPR gRNA sequence
  source 1..20: mol_type = other DNA
attttttgggatggaatctc

SEQ ID NO: 85155 - DNA, 20 bp, synthetic construct
  misc_feature 1..20: note = CRISPR gRNA sequence
  source 1..20: mol_type = other DNA
ttttttgggatggaatctca

SEQ ID NO: 85156 - DNA, 20 bp, synthetic construct
  misc_feature 1..20: note = CRISPR gRNA sequence
  source 1..20: mol_type = other DNA
tttgggatggaatctcattc

SEQ ID NO: 85157 - DNA, 20 bp, synthetic construct
  misc_feature 1..20: note = CRISPR gRNA sequence
  source 1..20: mol_type = other DNA
ttgggatggaatctcattcc

SEQ ID NO: 85158 - DNA, 20 bp, synthetic construct
  misc_feature 1..20: note = CRISPR gRNA sequence
  source 1..20: mol_type = other DNA
tgggatggaatctcattcca

SEQ ID NO: 85159 - DNA, 20 bp, synthetic construct
  misc_feature 1..20: note = CRISPR gRNA sequence
  source 1..20: mol_type = other DNA
gggatggaatctcattccat

SEQ ID NO: 85160 - DNA, 20 bp, synthetic construct
  misc_feature 1..20: note = CRISPR gRNA sequence
  source 1..20: mol_type = other DNA
ggatggaatctcattccatt

SEQ ID NO: 85161 - DNA, 20 bp, synthetic construct
  misc_feature 1..20: note = CRISPR gRNA sequence
  source 1..20: mol_type = other DNA
attccattgcccaggctgga

SEQ ID NO: 85162 - DNA, 20 bp, synthetic construct
  misc_feature 1..20: note = CRISPR gRNA sequence
  source 1..20: mol_type = other DNA
cattgcccaggctggagtgc

SEQ ID NO: 85163 - DNA, 20 bp, synthetic construct
  misc_feature 1..20: note = CRISPR gRNA sequence
  source 1..20: mol_type = other DNA
cccaggctggagtgcagtgt

SEQ ID NO: 85164 - DNA, 20 bp, synthetic construct
  misc_feature 1..20: note = CRISPR gRNA sequence
  source 1..20: mol_type = other DNA
gagtgcagtgtgcagtggtg

SEQ ID NO: 85165 - DNA, 20 bp, synthetic construct
  misc_feature 1..20: note = CRISPR gRNA sequence
  source 1..20: mol_type = other DNA
agctcactgcaacctccgcc

SEQ ID NO: 85166 - DNA, 20 bp, synthetic construct
  misc_feature 1..20: note = CRISPR gRNA sequence
  source 1..20: mol_type = other DNA
actgcaacctccgcctcctg

SEQ ID NO: 85167 - DNA, 20 bp, synthetic construct
  misc_feature 1..20: note = CRISPR gRNA sequence
  source 1..20: mol_type = other DNA
caacctccgcctcctgggtt

SEQ ID NO: 85168 - DNA, 20 bp, synthetic construct
  misc_feature 1..20: note = CRISPR gRNA sequence
  source 1..20: mol_type = other DNA
cgcctcctgggttcaagtga

SEQ ID NO: 85169 - DNA, 20 bp, synthetic construct
  misc_feature 1..20: note = CRISPR gRNA sequence
  source 1..20: mol_type = other DNA
ctgggttcaagtgattcctg

SEQ ID NO: 85170 - DNA, 20 bp, synthetic construct
  misc_feature 1..20: note = CRISPR gRNA sequence
  source 1..20: mol_type = other DNA
ggttcaagtgattcctggga

SEQ ID NO: 85171 - DNA, 20 bp, synthetic construct
  misc_feature 1..20: note = CRISPR gRNA sequence
  source 1..20: mol_type = other DNA
aagtgattcctgggactaca

SEQ ID NO: 85172 - DNA, 20 bp, synthetic construct
  misc_feature 1..20: note = CRISPR gRNA sequence
  source 1..20: mol_type = other DNA
ctgggactacaggcacacac

SEQ ID NO: 85173 - DNA, 20 bp, synthetic construct
  misc_feature 1..20: note = CRISPR gRNA sequence
  source 1..20: mol_type = other DNA
ggactacaggcacacaccac

SEQ ID NO: 85174 - DNA, 20 bp, synthetic construct
  misc_feature 1..20: note = CRISPR gRNA sequence
  source 1..20: mol_type = other DNA
caggcacacaccaccatgcc

SEQ ID NO: 85175 - DNA, 20 bp, synthetic construct
  misc_feature 1..20: note = CRISPR gRNA sequence
  source 1..20: mol_type = other DNA
gttaatttttgtattttcag

SEQ ID NO: 85176 - DNA, 20 bp, synthetic construct
  misc_feature 1..20: note = CRISPR gRNA sequence
  source 1..20: mol_type = other DNA
atttttgtattttcagtaga

SEQ ID NO: 85177 - DNA, 20 bp, synthetic construct
  misc_feature 1..20: note = CRISPR gRNA sequence
  source 1..20: mol_type = other DNA
ttgtattttcagtagagacg

SEQ ID NO: 85178 - DNA, 20 bp, synthetic construct
  misc_feature 1..20: note = CRISPR gRNA sequence
  source 1..20: mol_type = other DNA
tgtattttcagtagagacgg

SEQ ID NO: 85179 - DNA, 20 bp, synthetic construct
  misc_feature 1..20: note = CRISPR gRNA sequence
  source 1..20: mol_type = other DNA
gtattttcagtagagacggg

SEQ ID NO: 85180 - DNA, 20 bp, synthetic construct
  misc_feature 1..20: note = CRISPR gRNA sequence
  source 1..20: mol_type = other DNA
tattttcagtagagacggga

SEQ ID NO: 85181 - DNA, 20 bp, synthetic construct
  misc_feature 1..20: note = CRISPR gRNA sequence
  source 1..20: mol_type = other DNA
tcagtagagacgggatttca

SEQ ID NO: 85182 - DNA, 20 bp, synthetic construct
  misc_feature 1..20: note = CRISPR gRNA sequence
  source 1..20: mol_type = other DNA
cagtagagacgggatttcac

SEQ ID NO: 85183 - DNA, 20 bp, synthetic construct
  misc_feature 1..20: note = CRISPR gRNA sequence
  source 1..20: mol_type = other DNA
agtagagacgggatttcacc

SEQ ID NO: 85184 - DNA, 20 bp, synthetic construct
  misc_feature 1..20: note = CRISPR gRNA sequence
  source 1..20: mol_type = other DNA
caccatgttggccaggctgg

SEQ ID NO: 85185 - DNA, 20 bp, synthetic construct
  misc_feature 1..20: note = CRISPR gRNA sequence
  source 1..20: mol_type = other DNA
accatgttggccaggctggt

SEQ ID NO: 85186 - DNA, 20 bp, synthetic construct
  misc_feature 1..20: note = CRISPR gRNA sequence
  source 1..20: mol_type = other DNA
gccaggctggtcttgaactc

SEQ ID NO: 85187 - DNA, 20 bp, synthetic construct
  misc_feature 1..20: note = CRISPR gRNA sequence
  source 1..20: mol_type = other DNA
gtcttgaactcccaacttca

SEQ ID NO: 85188 - DNA, 20 bp, synthetic construct
  misc_feature 1..20: note = CRISPR gRNA sequence
  source 1..20: mol_type = other DNA
gaactcccaacttcaagtga

SEQ ID NO: 85189 - DNA, 20 bp, synthetic construct
  misc_feature 1..20: note = CRISPR gRNA sequence
  source 1..20: mol_type = other DNA
aactcccaacttcaagtgat

SEQ ID NO: 85190 - DNA, 20 bp, synthetic construct
  misc_feature 1..20: note = CRISPR gRNA sequence
  source 1..20: mol_type = other DNA
ccaacttcaagtgatcagcc

SEQ ID NO: 85191 - DNA, 20 bp, synthetic construct
  misc_feature 1..20: note = CRISPR gRNA sequence
  source 1..20: mol_type = other DNA
caagtgatcagcctgccttg

SEQ ID NO: 85192 - DNA, 20 bp, synthetic construct
  misc_feature 1..20: note = CRISPR gRNA sequence
  source 1..20: mol_type = other DNA
aagtgatcagcctgccttgg

SEQ ID NO: 85193 - DNA, 20 bp, synthetic construct
  misc_feature 1..20: note = CRISPR gRNA sequence
  source 1..20: mol_type = other DNA
ccttggcctcccaaagtgtt

SEQ ID NO: 85194 - DNA, 20 bp, synthetic construct
  misc_feature 1..20: note = CRISPR gRNA sequence
  source 1..20: mol_type = other DNA
ggcctcccaaagtgttggga

SEQ ID NO: 85195 - DNA, 20 bp, synthetic construct
  misc_feature 1..20: note = CRISPR gRNA sequence
  source 1..20: mol_type = other DNA
gcctcccaaagtgttgggat

SEQ ID NO: 85196 - DNA, 20 bp, synthetic construct
  misc_feature 1..20: note = CRISPR gRNA sequence
  source 1..20: mol_type = other DNA
ccaaagtgttgggattacag

SEQ ID NO: 85197 - DNA, 20 bp, synthetic construct
  misc_feature 1..20: note = CRISPR gRNA sequence
  source 1..20: mol_type = other DNA
ggattacaggcacgagccac

SEQ ID NO: 85198 - DNA, 20 bp, synthetic construct
  misc_feature 1..20: note = CRISPR gRNA sequence
  source 1..20: mol_type = other DNA
caggcacgagccaccgtgcc

SEQ ID NO: 85199 - DNA, 20 bp, synthetic construct
  misc_feature 1..20: note = CRISPR gRNA sequence
  source 1..20: mol_type = other DNA
ttaccaaacaacaaaacctc

SEQ ID NO: 85200 - DNA, 20 bp, synthetic construct
  misc_feature 1..20: note = CRISPR gRNA sequence
  source 1..20: mol_type = other DNA
accaaacaacaaaacctctt

SEQ ID NO: 85201 - DNA, 20 bp, synthetic construct
  misc_feature 1..20: note = CRISPR gRNA sequence
  source 1..20: mol_type = other DNA
ccaaacaacaaaacctcttt

SEQ ID NO: 85202 - DNA, 20 bp, synthetic construct
  misc_feature 1..20: note = CRISPR gRNA sequence
  source 1..20: mol_type = other DNA
tttatttctgctgaggtttt

SEQ ID NO: 85203 - DNA, 20 bp, synthetic construct
  misc_feature 1..20: note = CRISPR gRNA sequence
  source 1..20: mol_type = other DNA
tatttctgctgaggttttat

SEQ ID NO: 85204 - DNA, 20 bp, synthetic construct
  misc_feature 1..20: note = CRISPR gRNA sequence
  source 1..20: mol_type = other DNA
atttctgctgaggttttata

SEQ ID NO: 85205 - DNA, 20 bp, synthetic construct
  misc_feature 1..20: note = CRISPR gRNA sequence
  source 1..20: mol_type = other DNA
tttctgctgaggttttatat

SEQ ID NO: 85206 - DNA, 20 bp, synthetic construct
  misc_feature 1..20: note = CRISPR gRNA sequence
  source 1..20: mol_type = other DNA
ctgctgaggttttatatgcc

SEQ ID NO: 85207 - DNA, 20 bp, synthetic construct
  misc_feature 1..20: note = CRISPR gRNA sequence
  source 1..20: mol_type = other DNA
tgctgaggttttatatgcca

SEQ ID NO: 85208 - DNA, 20 bp, synthetic construct
  misc_feature 1..20: note = CRISPR gRNA sequence
  source 1..20: mol_type = other DNA
ctgaggttttatatgccaga

SEQ ID NO: 85209 - DNA, 20 bp, synthetic construct
  misc_feature 1..20: note = CRISPR gRNA sequence
  source 1..20: mol_type = other DNA
aggttttatatgccagaccc

SEQ ID NO: 85210 - DNA, 20 bp, synthetic construct
  misc_feature 1..20: note = CRISPR gRNA sequence
  source 1..20: mol_type = other DNA
tatatgccagacccctctct

SEQ ID NO: 85211 - DNA, 20 bp, synthetic construct
  misc_feature 1..20: note = CRISPR gRNA sequence
  source 1..20: mol_type = other DNA
atatgccagacccctctctg

SEQ ID NO: 85212 - DNA, 20 bp, synthetic construct
  misc_feature 1..20: note = CRISPR gRNA sequence
  source 1..20: mol_type = other DNA
tatgccagacccctctctga

SEQ ID NO: 85213 - DNA, 20 bp, synthetic construct
  misc_feature 1..20: note = CRISPR gRNA sequence
  source 1..20: mol_type = other DNA
tctgactttgtacctaattt

SEQ ID NO: 85214 - DNA, 20 bp, synthetic construct
  misc_feature 1..20: note = CRISPR gRNA sequence
  source 1..20: mol_type = other DNA
tgactttgtacctaatttca

SEQ ID NO: 85215 - DNA, 20 bp, synthetic construct
  misc_feature 1..20: note = CRISPR gRNA sequence
  source 1..20: mol_type = other DNA
actttgtacctaatttcatg

SEQ ID NO: 85216 - DNA, 20 bp, synthetic construct
  misc_feature 1..20: note = CRISPR gRNA sequence
  source 1..20: mol_type = other DNA
tgtacctaatttcatgagct

SEQ ID NO: 85217 - DNA, 20 bp, synthetic construct
  misc_feature 1..20: note = CRISPR gRNA sequence
  source 1..20: mol_type = other DNA
gtacctaatttcatgagcta

SEQ ID NO: 85218 - DNA, 20 bp, synthetic construct
  misc_feature 1..20: note = CRISPR gRNA sequence
  source 1..20: mol_type = other DNA
tacctaatttcatgagctaa

SEQ ID NO: 85219 - DNA, 20 bp, synthetic construct
  misc_feature 1..20: note = CRISPR gRNA sequence
  source 1..20: mol_type = other DNA
atttcatgagctaaaaaaca

SEQ ID NO: 85220 - DNA, 20 bp, synthetic construct
  misc_feature 1..20: note = CRISPR gRNA sequence
  source 1..20: mol_type = other DNA
catgagctaaaaaacaaaga

SEQ ID NO: 85221 - DNA, 20 bp, synthetic construct
  misc_feature 1..20: note = CRISPR gRNA sequence
  source 1..20: mol_type = other DNA
atgagctaaaaaacaaagaa

SEQ ID NO: 85222 - DNA, 20 bp, synthetic construct
  misc_feature 1..20: note = CRISPR gRNA sequence
  source 1..20: mol_type = other DNA
aaaaacaaagaaacaaaacc

SEQ ID NO: 85223 - DNA, 20 bp, synthetic construct
  misc_feature 1..20: note = CRISPR gRNA sequence
  source 1..20: mol_type = other DNA
aatgcatacaagagctggca

SEQ ID NO: 85224 - DNA, 20 bp, synthetic construct
  misc_feature 1..20: note = CRISPR gRNA sequence
  source 1..20: mol_type = other DNA
gcaaataccttaaatggttg

SEQ ID NO: 85225 - DNA, 20 bp, synthetic construct
  misc_feature 1..20: note = CRISPR gRNA sequence
  source 1..20: mol_type = other DNA
aaatggttgagttggacccg

SEQ ID NO: 85226 - DNA, 20 bp, synthetic construct
  misc_feature 1..20: note = CRISPR gRNA sequence
  source 1..20: mol_type = other DNA
aatggttgagttggacccga

SEQ ID NO: 85227 - DNA, 20 bp, synthetic construct
  misc_feature 1..20: note = CRISPR gRNA sequence
  source 1..20: mol_type = other DNA
agttggacccgataaaatac

SEQ ID NO: 85228 - DNA, 20 bp, synthetic construct
  misc_feature 1..20: note = CRISPR gRNA sequence
  source 1..20: mol_type = other DNA
gacccgataaaatacaacag

SEQ ID NO: 85229 - DNA, 20 bp, synthetic construct
  misc_feature 1..20: note = CRISPR gRNA sequence
  source 1..20: mol_type = other DNA
tggcaaatgggacagaacat

SEQ ID NO: 85230 - DNA, 20 bp, synthetic construct
  misc_feature 1..20: note = CRISPR gRNA sequence
  source 1..20: mol_type = other DNA
tccattatgatcaaatggag

SEQ ID NO: 85231 - DNA, 20 bp, synthetic construct
  misc_feature 1..20: note = CRISPR gRNA sequence
  source 1..20: mol_type = other DNA
ccattatgatcaaatggagt

SEQ ID NO: 85232 - DNA, 20 bp, synthetic construct
  misc_feature 1..20: note = CRISPR gRNA sequence
  source 1..20: mol_type = other DNA
cattatgatcaaatggagta

SEQ ID NO: 85233 - DNA, 20 bp, synthetic construct
  misc_feature 1..20: note = CRISPR gRNA sequence
  source 1..20: mol_type = other DNA
tgatcaaatggagtaatgca

SEQ ID NO: 85234 - DNA, 20 bp, synthetic construct
  misc_feature 1..20: note = CRISPR gRNA sequence
  source 1..20: mol_type = other DNA
gcgttttaattagcatccac

SEQ ID NO: 85235 - DNA, 20 bp, synthetic construct
  misc_feature 1..20: note = CRISPR gRNA sequence
  source 1..20: mol_type = other DNA
cgttttaattagcatccaca

SEQ ID NO: 85236 - DNA, 20 bp, synthetic construct
  misc_feature 1..20: note = CRISPR gRNA sequence
  source 1..20: mol_type = other DNA
taattagcatccacaggtga

SEQ ID NO: 85237 - DNA, 20 bp, synthetic construct
  misc_feature 1..20: note = CRISPR gRNA sequence
  source 1..20: mol_type = other DNA
aattagcatccacaggtgat

SEQ ID NO: 85238 - DNA, 20 bp, synthetic construct
  misc_feature 1..20: note = CRISPR gRNA sequence
  source 1..20: mol_type = other DNA
attagcatccacaggtgatt

SEQ ID NO: 85239 - DNA, 20 bp, synthetic construct
  misc_feature 1..20: note = CRISPR gRNA sequence
  source 1..20: mol_type = other DNA
gcatccacaggtgattgctg

SEQ ID NO: 85240 - DNA, 20 bp, synthetic construct
  misc_feature 1..20: note = CRISPR gRNA sequence
  source 1..20: mol_type = other DNA
ctgtaaactagccaggttgg

SEQ ID NO: 85241 - DNA, 20 bp, synthetic construct
  misc_feature 1..20: note = CRISPR gRNA sequence
  source 1..20: mol_type = other DNA
taaactagccaggttgggaa

SEQ ID NO: 85242 - DNA, 20 bp, synthetic construct
  misc_feature 1..20: note = CRISPR gRNA sequence
  source 1..20: mol_type = other DNA
gccaggttgggaatatattg

SEQ ID NO: 85243 - DNA, 20 bp, synthetic construct
  misc_feature 1..20: note = CRISPR gRNA sequence
  source 1..20: mol_type = other DNA
ggaatatattgcctaatgtt

SEQ ID NO: 85244 - DNA, 20 bp, synthetic construct
  misc_feature 1..20: note = CRISPR gRNA sequence
  source 1..20: mol_type = other DNA
cctaatgtttcagaaacagt

SEQ ID NO: 85245 - DNA, 20 bp, synthetic construct
  misc_feature 1..20: note = CRISPR gRNA sequence
  source 1..20: mol_type = other DNA
atgtttcagaaacagtactt

SEQ ID NO: 85246 - DNA, 20 bp, synthetic construct
  misc_feature 1..20: note = CRISPR gRNA sequence
  source 1..20: mol_type = other DNA
cagaaacagtactttccaaa

SEQ ID NO: 85247 - DNA, 20 bp, synthetic construct
  misc_feature 1..20: note = CRISPR gRNA sequence
  source 1..20: mol_type = other DNA
agaaacagtactttccaaaa

SEQ ID NO: 85248 - DNA, 20 bp, synthetic construct
  misc_feature 1..20: note = CRISPR gRNA sequence
  source 1..20: mol_type = other DNA
tccaaaatgagaggcatgac

SEQ ID NO: 85249 - DNA, 20 bp, synthetic construct
  misc_feature 1..20: note = CRISPR gRNA sequence
  source 1..20: mol_type = other DNA
ccaaaatgagaggcatgact

SEQ ID NO: 85250 - DNA, 20 bp, synthetic construct
  misc_feature 1..20: note = CRISPR gRNA sequence
  source 1..20: mol_type = other DNA
caaaatgagaggcatgacta

SEQ ID NO: 85251 - DNA, 20 bp, synthetic construct
  misc_feature 1..20: note = CRISPR gRNA sequence
  source 1..20: mol_type = other DNA
gaccatccatggggaagtgg

SEQ ID NO: 85252 - DNA, 20 bp, synthetic construct
  misc_feature 1..20: note = CRISPR gRNA sequence
  source 1..20: mol_type = other DNA
taaactctatatttttcatt

SEQ ID NO: 85253 - DNA, 20 bp, synthetic construct
  misc_feature 1..20: note = CRISPR gRNA sequence
  source 1..20: mol_type = other DNA
tatatttttcattgaaaatg

SEQ ID NO: 85254 - DNA, 20 bp, synthetic construct
  misc_feature 1..20: note = CRISPR gRNA sequence
  source 1..20: mol_type = other DNA
tatttttcattgaaaatgaa

SEQ ID NO: 85255 - DNA, 20 bp, synthetic construct
  misc_feature 1..20: note = CRISPR gRNA sequence
  source 1..20: mol_type = other DNA
ttcattgaaaatgaagagaa

SEQ ID NO: 85256 - DNA, 20 bp, synthetic construct
  misc_feature 1..20: note = CRISPR gRNA sequence
  source 1..20: mol_type = other DNA
tcattgaaaatgaagagaag

SEQ ID NO: 85257 - DNA, 20 bp, synthetic construct
  misc_feature 1..20: note = CRISPR gRNA sequence
  source 1..20: mol_type = other DNA
cattgaaaatgaagagaagt

SEQ ID NO: 85258 - DNA, 20 bp, synthetic construct
  misc_feature 1..20: note = CRISPR gRNA sequence
  source 1..20: mol_type = other DNA
attgaaaatgaagagaagtg

SEQ ID NO: 85259 - DNA, 20 bp, synthetic construct
  misc_feature 1..20: note = CRISPR gRNA sequence
  source 1..20: mol_type = other DNA
aaaatgaagagaagtgttag

SEQ ID NO: 85260 - DNA, 20 bp, synthetic construct
  misc_feature 1..20: note = CRISPR gRNA sequence
  source 1..20: mol_type = other DNA
gtgctactaaatatacagat

SEQ ID NO: 85261 - DNA, 20 bp, synthetic construct
  misc_feature 1..20: note = CRISPR gRNA sequence
  source 1..20: mol_type = other DNA
ctaaatatacagattgacac

SEQ ID NO: 85262 - DNA, 20 bp, synthetic construct
  misc_feature 1..20: note = CRISPR gRNA sequence
  source 1..20: mol_type = other DNA
aatatacagattgacactaa

SEQ ID NO: 85263 - DNA, 20 bp, synthetic construct
  misc_feature 1..20: note = CRISPR gRNA sequence
  source 1..20: mol_type = other DNA
acactaaatatatgtgtata

SEQ ID NO: 85264 - DNA, 20 bp, synthetic construct
  misc_feature 1..20: note = CRISPR gRNA sequence
  source 1..20: mol_type = other DNA
aatatatgtgtataaaattc

SEQ ID NO: 85265 - DNA, 20 bp, synthetic construct
  misc_feature 1..20: note = CRISPR gRNA sequence
  source 1..20: mol_type = other DNA
ttttaaatacacttatattc

SEQ ID NO: 85266 - DNA, 20 bp, synthetic construct
  misc_feature 1..20: note = CRISPR gRNA sequence
  source 1..20: mol_type = other DNA
ttaaatacacttatattcag

SEQ ID NO: 85267 - DNA, 20 bp, synthetic construct
  misc_feature 1..20: note = CRISPR gRNA sequence
  source 1..20: mol_type = other DNA
taaatacacttatattcagg

SEQ ID NO: 85268 - DNA, 20 bp, synthetic construct
  misc_feature 1..20: note = CRISPR gRNA sequence
  source 1..20: mol_type = other DNA
aaatacacttatattcaggg

SEQ ID NO: 85269 - DNA, 20 bp, synthetic construct
  misc_feature 1..20: note = CRISPR gRNA sequence
  source 1..20: mol_type = other DNA
aatacacttatattcagggt

SEQ ID NO: 85270 - DNA, 20 bp, synthetic construct
  misc_feature 1..20: note = CRISPR gRNA sequence
  source 1..20: mol_type = other DNA
atattcagggtacatgatca

SEQ ID NO: 85271 - DNA, 20 bp, synthetic construct
  misc_feature 1..20: note = CRISPR gRNA sequence
  source 1..20: mol_type = other DNA
tattcagggtacatgatcac

SEQ ID NO: 85272 - DNA, 20 bp, synthetic construct
  misc_feature 1..20: note = CRISPR gRNA sequence
  source 1..20: mol_type = other DNA
agggtacatgatcactaaaa

SEQ ID NO: 85273 - DNA, 20 bp, synthetic construct
  misc_feature 1..20: note = CRISPR gRNA sequence
  source 1..20: mol_type = other DNA
aaaggcagctactcctcctt

SEQ ID NO: 85274 - DNA, 20 bp, synthetic construct
  misc_feature 1..20: note = CRISPR gRNA sequence
  source 1..20: mol_type = other DNA
ctcctccttgtctgggaggc

SEQ ID NO: 85275 - DNA, 20 bp, synthetic construct
  misc_feature 1..20: note = CRISPR gRNA sequence
  source 1..20: mol_type = other DNA
ctccttgtctgggaggctgt

SEQ ID NO: 85276 - DNA, 20 bp, synthetic construct
  misc_feature 1..20: note = CRISPR gRNA sequence
  source 1..20: mol_type = other DNA
cttgtctgggaggctgtggg

SEQ ID NO: 85277 - DNA, 20 bp, synthetic construct
  misc_feature 1..20: note = CRISPR gRNA sequence
  source 1..20: mol_type = other DNA
gtctgggaggctgtggggag

SEQ ID NO: 85278 - DNA, 20 bp, synthetic construct
  misc_feature 1..20: note = CRISPR gRNA sequence
  source 1..20: mol_type = other DNA
tctgggaggctgtggggaga

SEQ ID NO: 85279 - DNA, 20 bp, synthetic construct
  misc_feature 1..20: note = CRISPR gRNA sequence
  source 1..20: mol_type = other DNA
ggaggctgtggggagaagga

SEQ ID NO: 85280 - DNA, 20 bp, synthetic construct
  misc_feature 1..20: note = CRISPR gRNA sequence
  source 1..20: mol_type = other DNA
tggggagaaggaggagtacc

SEQ ID NO: 85281 - DNA, 20 bp, synthetic construct
  misc_feature 1..20: note = CRISPR gRNA sequence
  source 1..20: mol_type = other DNA
gaccagatatatctctctag

SEQ ID NO: 85282 - DNA, 20 bp, synthetic construct
  misc_feature 1..20: note = CRISPR gRNA sequence
  source 1..20: mol_type = other DNA
accagatatatctctctaga

SEQ ID NO: 85283 - DNA, 20 bp, synthetic construct
  misc_feature 1..20: note = CRISPR gRNA sequence
  source 1..20: mol_type = other DNA
tctagaaacaccctatcatt

SEQ ID NO: 85284 - DNA, 20 bp, synthetic construct
  misc_feature 1..20: note = CRISPR gRNA sequence
  source 1..20: mol_type = other DNA
tagaaacaccctatcattaa

SEQ ID NO: 85285 - DNA, 20 bp, synthetic construct
  misc_feature 1..20: note = CRISPR gRNA sequence
  source 1..20: mol_type = other DNA
gaaacaccctatcattaagg

SEQ ID NO: 85286 - DNA, 20 bp, synthetic construct
  misc_feature 1..20: note = CRISPR gRNA sequence
  source 1..20: mol_type = other DNA
tcattaaggaaaggctacta

SEQ ID NO: 85287 - DNA, 20 bp, synthetic construct
  misc_feature 1..20: note = CRISPR gRNA sequence
  source 1..20: mol_type = other DNA
aggaaaggctactagcccca

SEQ ID NO: 85288 - DNA, 20 bp, synthetic construct
  misc_feature 1..20: note = CRISPR gRNA sequence
  source 1..20: mol_type = other DNA
ctagccccatcaagaggtgg

SEQ ID NO: 85289 - DNA, 20 bp, synthetic construct
  misc_feature 1..20: note = CRISPR gRNA sequence
  source 1..20: mol_type = other DNA
gccccatcaagaggtggatt

SEQ ID NO: 85290 - DNA, 20 bp, synthetic construct
  misc_feature 1..20: note = CRISPR gRNA sequence
  source 1..20: mol_type = other DNA
gggaatctaatgaagacctg

SEQ ID NO: 85291 - DNA, 20 bp, synthetic construct
  misc_feature 1..20: note = CRISPR gRNA sequence
  source 1..20: mol_type = other DNA
atgaagacctgatttttttc

SEQ ID NO: 85292 - DNA, 20 bp, synthetic construct
  misc_feature 1..20: note = CRISPR gRNA sequence
  source 1..20: mol_type = other DNA
atttttttcataacattaaa

SEQ ID NO: 85293 - DNA, 20 bp, synthetic construct
  misc_feature 1..20: note = CRISPR gRNA sequence
  source 1..20: mol_type = other DNA
ttttcataacattaaaagct

SEQ ID NO: 85294 - DNA, 20 bp, synthetic construct
  misc_feature 1..20: note = CRISPR gRNA sequence
  source 1..20: mol_type = other DNA
tttcataacattaaaagcta

SEQ ID NO: 85295 - DNA, 20 bp, synthetic construct
  misc_feature 1..20: note = CRISPR gRNA sequence
  source 1..20: mol_type = other DNA
ttcataacattaaaagctaa

SEQ ID NO: 85296 - DNA, 20 bp, synthetic construct
  misc_feature 1..20: note = CRISPR gRNA sequence
  source 1..20: mol_type = other DNA
tcataacattaaaagctaag

SEQ ID NO: 85297 - DNA, 20 bp, synthetic construct
  misc_feature 1..20: note = CRISPR gRNA sequence
  source 1..20: mol_type = other DNA
cataacattaaaagctaaga

SEQ ID NO: 85298 - DNA, 20 bp, synthetic construct
  misc_feature 1..20: note = CRISPR gRNA sequence
  source 1..20: mol_type = other DNA
ataacattaaaagctaagag

SEQ ID NO: 85299 - DNA, 20 bp, synthetic construct
  misc_feature 1..20: note = CRISPR gRNA sequence
  source 1..20: mol_type = other DNA
aaagctaagagagctctttg

SEQ ID NO: 85300 - DNA, 20 bp, synthetic construct
  misc_feature 1..20: note = CRISPR gRNA sequence
  source 1..20: mol_type = other DNA
agagagctctttgcatctga

SEQ ID NO: 85301 - DNA, 20 bp, synthetic construct
  misc_feature 1..20: note = CRISPR gRNA sequence
  source 1..20: mol_type = other DNA
tttgcatctgagcttctaat

SEQ ID NO: 85302 - DNA, 20 bp, synthetic construct
  misc_feature 1..20: note = CRISPR gRNA sequence
  source 1..20: mol_type = other DNA
tgcatctgagcttctaataa

SEQ ID NO: 85303 - DNA, 20 bp, synthetic construct
  misc_feature 1..20: note = CRISPR gRNA sequence
  source 1..20: mol_type = other DNA
gcatctgagcttctaataat

SEQ ID NO: 85304 - DNA, 20 bp, synthetic construct
  misc_feature 1..20: note = CRISPR gRNA sequence
  source 1..20: mol_type = other DNA
catctgagcttctaataata

SEQ ID NO: 85305 - DNA, 20 bp, synthetic construct
  misc_feature 1..20: note = CRISPR gRNA sequence
  source 1..20: mol_type = other DNA
agcttctaataataagaaca

SEQ ID NO: 85306 - DNA, 20 bp, synthetic construct
  misc_feature 1..20: note = CRISPR gRNA sequence
  source 1..20: mol_type = other DNA
ctaataataagaacatatta

SEQ ID NO: 85307 - DNA, 20 bp, synthetic construct
  misc_feature 1..20: note = CRISPR gRNA sequence
  source 1..20: mol_type = other DNA
taataataagaacatattaa

SEQ ID NO: 85308 - DNA, 20 bp, synthetic construct
  misc_feature 1..20: note = CRISPR gRNA sequence
  source 1..20: mol_type = other DNA
ataataagaacatattaaat

SEQ ID NO: 85309 - DNA, 20 bp, synthetic construct
  misc_feature 1..20: note = CRISPR gRNA sequence
  source 1..20: mol_type = other DNA
aatgcctcagggatcagagc

SEQ ID NO: 85310 - DNA, 20 bp, synthetic construct
  misc_feature 1..20: note = CRISPR gRNA sequence
  source 1..20: mol_type = other DNA
agggatcagagcacagattc

SEQ ID NO: 85311 - DNA, 20 bp, synthetic construct
  misc_feature 1..20: note = CRISPR gRNA sequence
  source 1..20: mol_type = other DNA
atcctgcctggaactctctg

SEQ ID NO: 85312 - DNA, 20 bp, synthetic construct
  misc_feature 1..20: note = CRISPR gRNA sequence
  source 1..20: mol_type = other DNA
cctggaactctctgtttgag

SEQ ID NO: 85313 - DNA, 20 bp, synthetic construct
  misc_feature 1..20: note = CRISPR gRNA sequence
  source 1..20: mol_type = other DNA
gaactctctgtttgagggaa

SEQ ID NO: 85314 - DNA, 20 bp, synthetic construct
  misc_feature 1..20: note = CRISPR gRNA sequence
  source 1..20: mol_type = other DNA
tctgtttgagggaaggcggc

SEQ ID NO: 85315 - DNA, 20 bp, synthetic construct
  misc_feature 1..20: note = CRISPR gRNA sequence
  source 1..20: mol_type = other DNA
tgtttgagggaaggcggcaa

SEQ ID NO: 85316 - DNA, 20 bp, synthetic construct
  misc_feature 1..20: note = CRISPR gRNA sequence
  source 1..20: mol_type = other DNA
tttgagggaaggcggcaaga

SEQ ID NO: 85317 - DNA, 20 bp, synthetic construct
  misc_feature 1..20: note = CRISPR gRNA sequence
  source 1..20: mol_type = other DNA
gagggaaggcggcaagattt

SEQ ID NO: 85318 - DNA, 20 bp, synthetic construct
  misc_feature 1..20: note = CRISPR gRNA sequence
  source 1..20: mol_type = other DNA
agggaaggcggcaagatttt

SEQ ID NO: 85319 - DNA, 20 bp, synthetic construct
  misc_feature 1..20: note = CRISPR gRNA sequence
  source 1..20: mol_type = other DNA
tgtgagagcatcactgtaat

SEQ ID NO: 85320 - DNA, 20 bp, synthetic construct
  misc_feature 1..20: note = CRISPR gRNA sequence
  source 1..20: mol_type = other DNA
gtgagagcatcactgtaatc

SEQ ID NO: 85321 - DNA, 20 bp, synthetic construct
  misc_feature 1..20: note = CRISPR gRNA sequence
  source 1..20: mol_type = other DNA
tgagagcatcactgtaatct

SEQ ID NO: 85322 - DNA, 20 bp, synthetic construct
  misc_feature 1..20: note = CRISPR gRNA sequence
  source 1..20: mol_type = other DNA
taatcttttctaagaagagg

SEQ ID NO: 85323 - DNA, 20 bp, synthetic construct
  misc_feature 1..20: note = CRISPR gRNA sequence
  source 1..20: mol_type = other DNA
ttctaagaagaggacaagta

SEQ ID NO: 85324 - DNA, 20 bp, synthetic construct
  misc_feature 1..20: note = CRISPR gRNA sequence
  source 1..20: mol_type = other DNA
tctaagaagaggacaagtat

SEQ ID NO: 85325 - DNA, 20 bp, synthetic construct
  misc_feature 1..20: note = CRISPR gRNA sequence
  source 1..20: mol_type = other DNA
ctaagaagaggacaagtatc

SEQ ID NO: 85326 - DNA, 20 bp, synthetic construct
  misc_feature 1..20: note = CRISPR gRNA sequence
  source 1..20: mol_type = other DNA
taagaagaggacaagtatca

SEQ ID NO: 85327 - DNA, 20 bp, synthetic construct
  misc_feature 1..20: note = CRISPR gRNA sequence
  source 1..20: mol_type = other DNA
agaagaggacaagtatcaga

SEQ ID NO: 85328 - DNA, 20 bp, synthetic construct
  misc_feature 1..20: note = CRISPR gRNA sequence
  source 1..20: mol_type = other DNA
ggtttgaatttgggctcaac

SEQ ID NO: 85329 - DNA, 20 bp, synthetic construct
  misc_feature 1..20: note = CRISPR gRNA sequence
  source 1..20: mol_type = other DNA
gaatttgggctcaaccagtt

SEQ ID NO: 85330 - DNA, 20 bp, synthetic construct
  misc_feature 1..20: note = CRISPR gRNA sequence
  source 1..20: mol_type = other DNA
aatttgggctcaaccagtta

SEQ ID NO: 85331 - DNA, 20 bp, synthetic construct
  misc_feature 1..20: note = CRISPR gRNA sequence
  source 1..20: mol_type = other DNA
gggctcaaccagttactggc

SEQ ID NO: 85332 - DNA, 20 bp, synthetic construct
  misc_feature 1..20: note = CRISPR gRNA sequence
  source 1..20: mol_type = other DNA
ggctcaaccagttactggct

SEQ ID NO: 85333 - DNA, 20 bp, synthetic construct
  misc_feature 1..20: note = CRISPR gRNA sequence
  source 1..20: mol_type = other DNA
aaccagttactggctttatg

SEQ ID NO: 85334 - DNA, 20 bp, synthetic construct
  misc_feature 1..20: note = CRISPR gRNA sequence
  source 1..20: mol_type = other DNA
ctggctttatgacttttgga

SEQ ID NO: 85335 - DNA, 20 bp, synthetic construct
  misc_feature 1..20: note = CRISPR gRNA sequence
  source 1..20: mol_type = other DNA
gctttatgacttttggagag

SEQ ID NO: 85336 - DNA, 20 bp, synthetic construct
  misc_feature 1..20: note = CRISPR gRNA sequence
  source 1..20: mol_type = other DNA
tatgacttttggagagttat

SEQ ID NO: 85337 - DNA, 20 bp, synthetic construct
  misc_feature 1..20: note = CRISPR gRNA sequence
  source 1..20: mol_type = other DNA
atgacttttggagagttatt

SEQ ID NO: 85338 - DNA, 20 bp, synthetic construct
  misc_feature 1..20: note = CRISPR gRNA sequence
  source 1..20: mol_type = other DNA
tgacttttggagagttattt

SEQ ID NO: 85339 - DNA, 20 bp, synthetic construct
  misc_feature 1..20: note = CRISPR gRNA sequence
  source 1..20: mol_type = other DNA
ttggagagttatttaagctt

SEQ ID NO: 85340 - DNA, 20 bp, synthetic construct
  misc_feature 1..20: note = CRISPR gRNA sequence
  source 1..20: mol_type = other DNA
tggagagttatttaagcttc

SEQ ID NO: 85341 - DNA, 20 bp, synthetic construct
  misc_feature 1..20: note = CRISPR gRNA sequence
  source 1..20: mol_type = other DNA
ggagagttatttaagcttcc

SEQ ID NO: 85342 - DNA, 20 bp, synthetic construct
  misc_feature 1..20: note = CRISPR gRNA sequence
  source 1..20: mol_type = other DNA
gagagttatttaagcttcca

SEQ ID NO: 85343 - DNA, 20 bp, synthetic construct
  misc_feature 1..20: note = CRISPR gRNA sequence
  source 1..20: mol_type = other DNA
tttaagcttccaaaacttaa

SEQ ID NO: 85344 - DNA, 20 bp, synthetic construct
  misc_feature 1..20: note = CRISPR gRNA sequence
  source 1..20: mol_type = other DNA
aagcttccaaaacttaactg

SEQ ID NO: 85345 - DNA, 20 bp, synthetic construct
  misc_feature 1..20: note = CRISPR gRNA sequence
  source 1..20: mol_type = other DNA
agcttccaaaacttaactga

SEQ ID NO: 85346 - DNA, 20 bp, synthetic construct
  misc_feature 1..20: note = CRISPR gRNA sequence
  source 1..20: mol_type = other DNA
ccaaaacttaactgaaaaat

SEQ ID NO: 85347 - DNA, 20 bp, synthetic construct
  misc_feature 1..20: note = CRISPR gRNA sequence
  source 1..20: mol_type = other DNA
caaaacttaactgaaaaatt

SEQ ID NO: 85348 - DNA, 20 bp, synthetic construct
  misc_feature 1..20: note = CRISPR gRNA sequence
  source 1..20: mol_type = other DNA
aactgaaaaattaatttatg

SEQ ID NO: 85349 - DNA, 20 bp, synthetic construct
  misc_feature 1..20: note = CRISPR gRNA sequence
  source 1..20: mol_type = other DNA
actgaaaaattaatttatgc

SEQ ID NO: 85350 - DNA, 20 bp, synthetic construct
  misc_feature 1..20: note = CRISPR gRNA sequence
  source 1..20: mol_type = other DNA
aaaaattaatttatgcccac

SEQ ID NO: 85351 - DNA, 20 bp, synthetic construct
  misc_feature 1..20: note = CRISPR gRNA sequence
  source 1..20: mol_type = other DNA
atttatgcccacagtaaaac

SEQ ID NO: 85352 - DNA, 20 bp, synthetic construct
  misc_feature 1..20: note = CRISPR gRNA sequence
  source 1..20: mol_type = other DNA
atgcccacagtaaaacaaaa

SEQ ID NO: 85353 - DNA, 20 bp, synthetic construct
  misc_feature 1..20: note = CRISPR gRNA sequence
  source 1..20: mol_type = other DNA
tgcccacagtaaaacaaaaa

SEQ ID NO: 85354 - DNA, 20 bp, synthetic construct
  misc_feature 1..20: note = CRISPR gRNA sequence
  source 1..20: mol_type = other DNA
cagaggcaatcatcattaca

SEQ ID NO: 85355 - DNA, 20 bp, synthetic construct
  misc_feature 1..20: note = CRISPR gRNA sequence
  source 1..20: mol_type = other DNA
agaggcaatcatcattacat

SEQ ID NO: 85356 - DNA, 20 bp, synthetic construct
  misc_feature 1..20: note = CRISPR gRNA sequence
  source 1..20: mol_type = other DNA
catgtttcttgtggtatctt

SEQ ID NO: 85357 - DNA, 20 bp, synthetic construct
  misc_feature 1..20: note = CRISPR gRNA sequence
  source 1..20: mol_type = other DNA
cttgtggtatcttccagaaa

SEQ ID NO: 85358 - DNA, 20 bp, synthetic construct
  misc_feature 1..20: note = CRISPR gRNA sequence
  source 1..20: mol_type = other DNA
ttgtggtatcttccagaaat

SEQ ID NO: 85359 - DNA, 20 bp, synthetic construct
  misc_feature 1..20: note = CRISPR gRNA sequence
  source 1..20: mol_type = other DNA
gtggtatcttccagaaatgg

SEQ ID NO: 85360 - DNA, 20 bp, synthetic construct
  misc_feature 1..20: note = CRISPR gRNA sequence
  source 1..20: mol_type = other DNA
tggtatcttccagaaatggt

SEQ ID NO: 85361 - DNA, 20 bp, synthetic construct
  misc_feature 1..20: note = CRISPR gRNA sequence
  source 1..20: mol_type = other DNA
ccagaaatggtctatgcatg

SEQ ID NO: 85362 - DNA, 20 bp, synthetic construct
  misc_feature 1..20: note = CRISPR gRNA sequence
  source 1..20: mol_type = other DNA
cagaaatggtctatgcatgg

SEQ ID NO: 85363 - DNA, 20 bp, synthetic construct
  misc_feature 1..20: note = CRISPR gRNA sequence
  source 1..20: mol_type = other DNA
tgcatggcatgtattacttt

SEQ ID NO: 85364 - DNA, 20 bp, synthetic construct
  misc_feature 1..20: note = CRISPR gRNA sequence
  source 1..20: mol_type = other DNA
ctttggaaattttcaaaata

SEQ ID NO: 85365 - DNA, 20 bp, synthetic construct
  misc_feature 1..20: note = CRISPR gRNA sequence
  source 1..20: mol_type = other DNA
tggaaattttcaaaataaga

SEQ ID NO: 85366 - DNA, 20 bp, synthetic construct
  misc_feature 1..20: note = CRISPR gRNA sequence
  source 1..20: mol_type = other DNA
ggaaattttcaaaataagat

SEQ ID NO: 85367 - DNA, 20 bp, synthetic construct
  misc_feature 1..20: note = CRISPR gRNA sequence
  source 1..20: mol_type = other DNA
gaaattttcaaaataagatt

SEQ ID NO: 85368 - DNA, 20 bp, synthetic construct
  misc_feature 1..20: note = CRISPR gRNA sequence
  source 1..20: mol_type = other DNA
tcaaaataagattttttttt

SEQ ID NO: 85369 - DNA, 20 bp, synthetic construct
  misc_feature 1..20: note = CRISPR gRNA sequence
  source 1..20: mol_type = other DNA
caaaataagattttttttta

SEQ ID NO: 85370 - DNA, 20 bp, synthetic construct
  misc_feature 1..20: note = CRISPR gRNA sequence
  source 1..20: mol_type = other DNA
aaaataagatttttttttaa

SEQ ID NO: 85371 - DNA, 20 bp, synthetic construct
  misc_feature 1..20: note = CRISPR gRNA sequence
  source 1..20: mol_type = other DNA
ttttttaaatatcagattgt

SEQ ID NO: 85372 - DNA, 20 bp, synthetic construct
  misc_feature 1..20: note = CRISPR gRNA sequence
  source 1..20: mol_type = other DNA
tttttaaatatcagattgtt

SEQ ID NO: 85373 - DNA, 20 bp, synthetic construct
  misc_feature 1..20: note = CRISPR gRNA sequence
  source 1..20: mol_type = other DNA
ttttaaatatcagattgtta

SEQ ID NO: 85374 - DNA, 20 bp, synthetic construct
  misc_feature 1..20: note = CRISPR gRNA sequence
  source 1..20: mol_type = other DNA
tttaaatatcagattgttat

SEQ ID NO: 85375 - DNA, 20 bp, synthetic construct
  misc_feature 1..20: note = CRISPR gRNA sequence
  source 1..20: mol_type = other DNA
ttaaatatcagattgttatt

SEQ ID NO: 85376 - DNA, 20 bp, synthetic construct
  misc_feature 1..20: note = CRISPR gRNA sequence
  source 1..20: mol_type = other DNA
taaatatcagattgttattt

SEQ ID NO: 85377 - DNA, 20 bp, synthetic construct
  misc_feature 1..20: note = CRISPR gRNA sequence
  source 1..20: mol_type = other DNA
aaatatcagattgttatttt

SEQ ID NO: 85378 - DNA, 20 bp, synthetic construct
  misc_feature 1..20: note = CRISPR gRNA sequence
  source 1..20: mol_type = other DNA
aatatcagattgttattttt

SEQ ID NO: 85379 - DNA, 20 bp, synthetic construct
  misc_feature 1..20: note = CRISPR gRNA sequence
  source 1..20: mol_type = other DNA
ttattttttaaaatgacatc

SEQ ID NO: 85380 - DNA, 20 bp, synthetic construct
  misc_feature 1..20: note = CRISPR gRNA sequence
  source 1..20: mol_type = other DNA
ttttttaaaatgacatctaa

SEQ ID NO: 85381 - DNA, 20 bp, synthetic construct
  misc_feature 1..20: note = CRISPR gRNA sequence
  source 1..20: mol_type = other DNA
tttaaaatgacatctaacat

SEQ ID NO: 85382 - DNA, 20 bp, synthetic construct
  misc_feature 1..20: note = CRISPR gRNA sequence
  source 1..20: mol_type = other DNA
ttaaaatgacatctaacata

SEQ ID NO: 85383 - DNA, 20 bp, synthetic construct
  misc_feature 1..20: note = CRISPR gRNA sequence
  source 1..20: mol_type = other DNA
taaaatgacatctaacataa

SEQ ID NO: 85384 - DNA, 20 bp, synthetic construct
  misc_feature 1..20: note = CRISPR gRNA sequence
  source 1..20: mol_type = other DNA
aaaatgacatctaacataac

SEQ ID NO: 85385 - DNA, 20 bp, synthetic construct
  misc_feature 1..20: note = CRISPR gRNA sequence
  source 1..20: mol_type = other DNA
aaatgacatctaacataacc

SEQ ID NO: 85386 - DNA, 20 bp, synthetic construct
  misc_feature 1..20: note = CRISPR gRNA sequence
  source 1..20: mol_type = other DNA
acataaccagcaaataccag

SEQ ID NO: 85387 - DNA, 20 bp, synthetic construct
  misc_feature 1..20: note = CRISPR gRNA sequence
  source 1..20: mol_type = other DNA
tcctttatgttgtaaataaa

SEQ ID NO: 85388 - DNA, 20 bp, synthetic construct
  misc_feature 1..20: note = CRISPR gRNA sequence
  source 1..20: mol_type = other DNA
tatgttgtaaataaattgta

SEQ ID NO: 85389 - DNA, 20 bp, synthetic construct
  misc_feature 1..20: note = CRISPR gRNA sequence
  source 1..20: mol_type = other DNA
atgttgtaaataaattgtat

SEQ ID NO: 85390 - DNA, 20 bp, synthetic construct
  misc_feature 1..20: note = CRISPR gRNA sequence
  source 1..20: mol_type = other DNA
tgttgtaaataaattgtatt

SEQ ID NO: 85391 - DNA, 20 bp, synthetic construct
  misc_feature 1..20: note = CRISPR gRNA sequence
  source 1..20: mol_type = other DNA
taaataaattgtattcaaat

SEQ ID NO: 85392 - DNA, 20 bp, synthetic construct
  misc_feature 1..20: note = CRISPR gRNA sequence
  source 1..20: mol_type = other DNA
tattcaaattaaatgcaatt

SEQ ID NO: 85393 - DNA, 20 bp, synthetic construct
  misc_feature 1..20: note = CRISPR gRNA sequence
  source 1..20: mol_type = other DNA
aaattaaatgcaattttctc

SEQ ID NO: 85394 - DNA, 20 bp, synthetic construct
  misc_feature 1..20: note = CRISPR gRNA sequence
  source 1..20: mol_type = other DNA
aatgcaattttctcatgatc

SEQ ID NO: 85395 - DNA, 20 bp, synthetic construct
  misc_feature 1..20: note = CRISPR gRNA sequence
  source 1..20: mol_type = other DNA
tctcatgatcaaaacattct

SEQ ID NO: 85396 - DNA, 20 bp, synthetic construct
  misc_feature 1..20: note = CRISPR gRNA sequence
  source 1..20: mol_type = other DNA
ctcatgatcaaaacattctg

SEQ ID NO: 85397 - DNA, 20 bp, synthetic construct
  misc_feature 1..20: note = CRISPR gRNA sequence
  source 1..20: mol_type = other DNA
tcatgatcaaaacattctgc

SEQ ID NO: 85398 - DNA, 20 bp, synthetic construct
  misc_feature 1..20: note = CRISPR gRNA sequence
  source 1..20: mol_type = other DNA
atgatcaaaacattctgctt

SEQ ID NO: 85399 - DNA, 20 bp, synthetic construct
  misc_feature 1..20: note = CRISPR gRNA sequence
  source 1..20: mol_type = other DNA
tgctttcgatcatgttttgc

SEQ ID NO: 85400 - DNA, 20 bp, synthetic construct
  misc_feature 1..20: note = CRISPR gRNA sequence
  source 1..20: mol_type = other DNA
ctttcgatcatgttttgcca

SEQ ID NO: 85401 - DNA, 20 bp, synthetic construct
  misc_feature 1..20: note = CRISPR gRNA sequence
  source 1..20: mol_type = other DNA
tcgatcatgttttgccagag

SEQ ID NO: 85402 - DNA, 20 bp, synthetic construct
  misc_feature 1..20: note = CRISPR gRNA sequence
  source 1..20: mol_type = other DNA
cgatcatgttttgccagagg

SEQ ID NO: 85403 - DNA, 20 bp, synthetic construct
  misc_feature 1..20: note = CRISPR gRNA sequence
  source 1..20: mol_type = other DNA
gatcatgttttgccagagga

SEQ ID NO: 85404 - DNA, 20 bp, synthetic construct
  misc_feature 1..20: note = CRISPR gRNA sequence
  source 1..20: mol_type = other DNA
tgccagaggaaaaggtgagc

SEQ ID NO: 85405 - DNA, 20 bp, synthetic construct
  misc_feature 1..20: note = CRISPR gRNA sequence
  source 1..20: mol_type = other DNA
gccagaggaaaaggtgagcg

SEQ ID NO: 85406 - DNA, 20 bp, synthetic construct
  misc_feature 1..20: note = CRISPR gRNA sequence
  source 1..20: mol_type = other DNA
ccagaggaaaaggtgagcgc

SEQ ID NO: 85407 - DNA, 20 bp, synthetic construct
  misc_feature 1..20: note = CRISPR gRNA sequence
  source 1..20: mol_type = other DNA
agtgtattgccaggtactta

SEQ ID NO: 85408 - DNA, 20 bp, synthetic construct
  misc_feature 1..20: note = CRISPR gRNA sequence
  source 1..20: mol_type = other DNA
gtgtattgccaggtacttag

SEQ ID NO: 85409 - DNA, 20 bp, synthetic construct
  misc_feature 1..20: note = CRISPR gRNA sequence
  source 1..20: mol_type = other DNA
ccaggtacttagaaagtgct

SEQ ID NO: 85410 - DNA, 20 bp, synthetic construct
  misc_feature 1..20: note = CRISPR gRNA sequence
  source 1..20: mol_type = other DNA
agaaagtgctcaagatctct

SEQ ID NO: 85411 - DNA, 20 bp, synthetic construct
  misc_feature 1..20: note = CRISPR gRNA sequence
  source 1..20: mol_type = other DNA
gaaagtgctcaagatctctg

SEQ ID NO: 85412 - DNA, 20 bp, synthetic construct
  misc_feature 1..20: note = CRISPR gRNA sequence
  source 1..20: mol_type = other DNA
aagatctctggcgtcctcaa

SEQ ID NO: 85413 - DNA, 20 bp, synthetic construct
  misc_feature 1..20: note = CRISPR gRNA sequence
  source 1..20: mol_type = other DNA
tggcgtcctcaacagtcttg

SEQ ID NO: 85414 - DNA, 20 bp, synthetic construct
  misc_feature 1..20: note = CRISPR gRNA sequence
  source 1..20: mol_type = other DNA
gcgtcctcaacagtcttggt

SEQ ID NO: 85415 - DNA, 20 bp, synthetic construct
  misc_feature 1..20: note = CRISPR gRNA sequence
  source 1..20: mol_type = other DNA
aacagtcttggtaaccatct

SEQ ID NO: 85416 - DNA, 20 bp, synthetic construct
  misc_feature 1..20: note = CRISPR gRNA sequence
  source 1..20: mol_type = other DNA
ggtaaccatcttggattatc

SEQ ID NO: 85417 - DNA, 20 bp, synthetic construct
  misc_feature 1..20: note = CRISPR gRNA sequence
  source 1..20: mol_type = other DNA
gtaaccatcttggattatct

SEQ ID NO: 85418 - DNA, 20 bp, synthetic construct
  misc_feature 1..20: note = CRISPR gRNA sequence
  source 1..20: mol_type = other DNA
ggattatctttattaatggt

SEQ ID NO: 85419 - DNA, 20 bp, synthetic construct
  misc_feature 1..20: note = CRISPR gRNA sequence
  source 1..20: mol_type = other DNA
gattatctttattaatggtt

SEQ ID NO: 85420 - DNA, 20 bp, synthetic construct
  misc_feature 1..20: note = CRISPR gRNA sequence
  source 1..20: mol_type = other DNA
tctttattaatggttttaca

SEQ ID NO: 85421 - DNA, 20 bp, synthetic construct
  misc_feature 1..20: note = CRISPR gRNA sequence
  source 1..20: mol_type = other DNA
tattaatggttttacagctc

SEQ ID NO: 85422 - DNA, 20 bp, synthetic construct
  misc_feature 1..20: note = CRISPR gRNA sequence
  source 1..20: mol_type = other DNA
attaatggttttacagctcc

SEQ ID NO: 85423 - DNA, 20 bp, synthetic construct
  misc_feature 1..20: note = CRISPR gRNA sequence
  source 1..20: mol_type = other DNA
ttaatggttttacagctccc

SEQ ID NO: 85424 - DNA, 20 bp, synthetic construct
  misc_feature 1..20: note = CRISPR gRNA sequence
  source 1..20: mol_type = other DNA
atggttttacagctcccctg

SEQ ID NO: 85425 - DNA, 20 bp, synthetic construct
  misc_feature 1..20: note = CRISPR gRNA sequence
  source 1..20: mol_type = other DNA
tacagctcccctgactgaca

SEQ ID NO: 85426 - DNA, 20 bp, synthetic construct
  misc_feature 1..20: note = CRISPR gRNA sequence
  source 1..20: mol_type = other DNA
acagctcccctgactgacaa

SEQ ID NO: 85427 - DNA, 20 bp, synthetic construct
  misc_feature 1..20: note = CRISPR gRNA sequence
  source 1..20: mol_type = other DNA
cagctcccctgactgacaaa

SEQ ID NO: 85428 - DNA, 20 bp, synthetic construct
  misc_feature 1..20: note = CRISPR gRNA sequence
  source 1..20: mol_type = other DNA
ccctgactgacaaaccttca

SEQ ID NO: 85429 - DNA, 20 bp, synthetic construct
  misc_feature 1..20: note = CRISPR gRNA sequence
  source 1..20: mol_type = other DNA
actgacaaaccttcacttct

SEQ ID NO: 85430 - DNA, 20 bp, synthetic construct
  misc_feature 1..20: note = CRISPR gRNA sequence
  source 1..20: mol_type = other DNA
acaaaccttcacttctttct

SEQ ID NO: 85431 - DNA, 20 bp, synthetic construct
  misc_feature 1..20: note = CRISPR gRNA sequence
  source 1..20: mol_type = other DNA
cacttctttctttcttttct

SEQ ID NO: 85432 - DNA, 20 bp, synthetic construct
  misc_feature 1..20: note = CRISPR gRNA sequence
  source 1..20: mol_type = other DNA
acttctttctttcttttctt

SEQ ID NO: 85433 - DNA, 20 bp, synthetic construct
  misc_feature 1..20: note = CRISPR gRNA sequence
  source 1..20: mol_type = other DNA
ctttctttcttttcttttct

SEQ ID NO: 85434 - DNA, 20 bp, synthetic construct
  misc_feature 1..20: note = CRISPR gRNA sequence
  source 1..20: mol_type = other DNA
tttctttcttttcttttctc

SEQ ID NO: 85435 - DNA, 20 bp, synthetic construct
  misc_feature 1..20: note = CRISPR gRNA sequence
  source 1..20: mol_type = other DNA
tctttcttttcttttctctt

SEQ ID NO: 85436 - DNA, 20 bp, synthetic construct
  misc_feature 1..20: note = CRISPR gRNA sequence
  source 1..20: mol_type = other DNA
ctttcttttcttttctcttt

SEQ ID NO: 85437 - DNA, 20 bp, synthetic construct
  misc_feature 1..20: note = CRISPR gRNA sequence
  source 1..20: mol_type = other DNA
tttcttttcttttctctttc

SEQ ID NO: 85438 - DNA, 20 bp, synthetic construct
  misc_feature 1..20: note = CRISPR gRNA sequence
  source 1..20: mol_type = other DNA
tcttttcttttctctttctt

SEQ ID NO: 85439 - DNA, 20 bp, synthetic construct
  misc_feature 1..20: note = CRISPR gRNA sequence
  source 1..20: mol_type = other DNA
cttttcttttctctttcttt

SEQ ID NO: 85440 - DNA, 20 bp, synthetic construct
  misc_feature 1..20: note = CRISPR gRNA sequence
  source 1..20: mol_type = other DNA
ttttcttttctctttctttt

SEQ ID NO: 85441 - DNA, 20 bp, synthetic construct
  misc_feature 1..20: note = CRISPR gRNA sequence
  source 1..20: mol_type = other DNA
ttcttttctctttctttttt

SEQ ID NO: 85442 - DNA, 20 bp, synthetic construct
  misc_feature 1..20: note = CRISPR gRNA sequence
  source 1..20: mol_type = other DNA
tcttttctctttcttttttt

SEQ ID NO: 85443 - DNA, 20 bp, synthetic construct
  misc_feature 1..20: note = CRISPR gRNA sequence
  source 1..20: mol_type = other DNA
cttttctctttctttttttt

SEQ ID NO: 85444 - DNA, 20 bp, synthetic construct
  misc_feature 1..20: note = CRISPR gRNA sequence
  source 1..20: mol_type = other DNA
ttttctctttcttttttttt

SEQ ID NO: 85445 - DNA, 20 bp, synthetic construct
  misc_feature 1..20: note = CRISPR gRNA sequence
  source 1..20: mol_type = other DNA
ttctctttcttttttttttt

SEQ ID NO: 85446 - DNA, 20 bp, synthetic construct
  misc_feature 1..20: note = CRISPR gRNA sequence
  source 1..20: mol_type = other DNA
tctctttctttttttttttt

SEQ ID NO: 85447 - DNA, 20 bp, synthetic construct
  misc_feature 1..20: note = CRISPR gRNA sequence
  source 1..20: mol_type = other DNA
ctctttcttttttttttttt

SEQ ID NO: 85448 - DNA, 20 bp, synthetic construct
  misc_feature 1..20: note = CRISPR gRNA sequence
  source 1..20: mol_type = other DNA
tctttctttttttttttttt

SEQ ID NO: 85449 - DNA, 20 bp, synthetic construct
  misc_feature 1..20: note = CRISPR gRNA sequence
  source 1..20: mol_type = other DNA
tttctttttttttttttttc

SEQ ID NO: 85450 - DNA, 20 bp, synthetic construct
  misc_feature 1..20: note = CRISPR gRNA sequence
  source 1..20: mol_type = other DNA
tctttttttttttttttctt

SEQ ID NO: 85451 - DNA, 20 bp, synthetic construct
  misc_feature 1..20: note = CRISPR gRNA sequence
  source 1..20: mol_type = other DNA
ctttttttttttttttcttt

SEQ ID NO: 85452 - DNA, 20 bp, synthetic construct
  misc_feature 1..20: note = CRISPR gRNA sequence
  source 1..20: mol_type = other DNA
tttttttttttttttctttt

SEQ ID NO: 85453 - DNA, 20 bp, synthetic construct
  misc_feature 1..20: note = CRISPR gRNA sequence
  source 1..20: mol_type = other DNA
tttttttttttttctttttt

SEQ ID NO: 85454 - DNA, 20 bp, synthetic construct
  misc_feature 1..20: note = CRISPR gRNA sequence
  source 1..20: mol_type = other DNA
ttttttttttttcttttttg

SEQ ID NO: 85455 - DNA, 20 bp, synthetic construct
  misc_feature 1..20: note = CRISPR gRNA sequence
  source 1..20: mol_type = other DNA
tttttttttttcttttttga

SEQ ID NO: 85456 - DNA, 20 bp, synthetic construct
  misc_feature 1..20: note = CRISPR gRNA sequence
  source 1..20: mol_type = other DNA
ttttttttttcttttttgag

SEQ ID NO: 85457 - DNA, 20 bp, synthetic construct
  misc_feature 1..20: note = CRISPR gRNA sequence
  source 1..20: mol_type = other DNA
tttttttttcttttttgaga

SEQ ID NO: 85458 - DNA, 20 bp, synthetic construct
  misc_feature 1..20: note = CRISPR gRNA sequence
  source 1..20: mol_type = other DNA
ttttttttcttttttgagag

SEQ ID NO: 85459 - DNA, 20 bp, synthetic construct
  misc_feature 1..20: note = CRISPR gRNA sequence
  source 1..20: mol_type = other DNA
tttttttcttttttgagaga

SEQ ID NO: 85460 - DNA, 20 bp, synthetic construct
  misc_feature 1..20: note = CRISPR gRNA sequence
  source 1..20: mol_type = other DNA
ttttttcttttttgagagac

SEQ ID NO: 85461 - DNA, 20 bp, synthetic construct
  misc_feature 1..20: note = CRISPR gRNA sequence
  source 1..20: mol_type = other DNA
tttttcttttttgagagaca

SEQ ID NO: 85462 - DNA, 20 bp, synthetic construct
  misc_feature 1..20: note = CRISPR gRNA sequence
  source 1..20: mol_type = other DNA
ttttcttttttgagagacag

SEQ ID NO: 85463 - DNA, 20 bp, synthetic construct
  misc_feature 1..20: note = CRISPR gRNA sequence
  source 1..20: mol_type = other DNA
tttcttttttgagagacagg

SEQ ID NO: 85464 - DNA, 20 bp, synthetic construct
  misc_feature 1..20: note = CRISPR gRNA sequence
  source 1..20: mol_type = other DNA
ttcttttttgagagacaggg

SEQ ID NO: 85465 - DNA, 20 bp, synthetic construct
  misc_feature 1..20: note = CRISPR gRNA sequence
  source 1..20: mol_type = other DNA
tcttttttgagagacagggt

SEQ ID NO: 85466 - DNA, 20 bp, synthetic construct
  misc_feature 1..20: note = CRISPR gRNA sequence
  source 1..20: mol_type = other DNA
cttttttgagagacagggtc

SEQ ID NO: 85467 - DNA, 20 bp, synthetic construct
  misc_feature 1..20: note = CRISPR gRNA sequence
  source 1..20: mol_type = other DNA
ttttttgagagacagggtct

SEQ ID NO: 85468 - DNA, 20 bp, synthetic construct
  misc_feature 1..20: note = CRISPR gRNA sequence
  source 1..20: mol_type = other DNA
ttttgagagacagggtctcg

SEQ ID NO: 85469 - DNA, 20 bp, synthetic construct
  misc_feature 1..20: note = CRISPR gRNA sequence
  source 1..20: mol_type = other DNA
tttgagagacagggtctcgc

SEQ ID NO: 85470 - DNA, 20 bp, synthetic construct
  misc_feature 1..20: note = CRISPR gRNA sequence
  source 1..20: mol_type = other DNA
ttgagagacagggtctcgct

SEQ ID NO: 85471 - DNA, 20 bp, synthetic construct
  misc_feature 1..20: note = CRISPR gRNA sequence
  source 1..20: mol_type = other DNA
tgagagacagggtctcgctc

SEQ ID NO: 85472 - DNA, 20 bp, synthetic construct
  misc_feature 1..20: note = CRISPR gRNA sequence
  source 1..20: mol_type = other DNA
gagagacagggtctcgctct

SEQ ID NO: 85473 - DNA, 20 bp, synthetic construct
  misc_feature 1..20: note = CRISPR gRNA sequence
  source 1..20: mol_type = other DNA
agagacagggtctcgctctg

SEQ ID NO: 85474 - DNA, 20 bp, synthetic construct
  misc_feature 1..20: note = CRISPR gRNA sequence
  source 1..20: mol_type = other DNA
gctctgttgcccacgctgga

SEQ ID NO: 85475 - DNA, 20 bp, synthetic construct
  misc_feature 1..20: note = CRISPR gRNA sequence
  source 1..20: mol_type = other DNA
tgttgcccacgctggagtgc

SEQ ID NO: 85476 - DNA, 20 bp, synthetic construct
  misc_feature 1..20: note = CRISPR gRNA sequence
  source 1..20: mol_type = other DNA
ttgcccacgctggagtgcac

SEQ ID NO: 85477 - DNA, 20 bp, synthetic construct
  misc_feature 1..20: note = CRISPR gRNA sequence
  source 1..20: mol_type = other DNA
cccacgctggagtgcactgg

SEQ ID NO: 85478 - DNA, 20 bp, synthetic construct
  misc_feature 1..20: note = CRISPR gRNA sequence
  source 1..20: mol_type = other DNA
gagtgcactggcgccatgat

SEQ ID NO: 85479 - DNA, 20 bp, synthetic construct
  misc_feature 1..20: note = CRISPR gRNA sequence
  source 1..20: mol_type = other DNA
gcgccatgatagctcaaaag

SEQ ID NO: 85480 - DNA, 20 bp, synthetic construct
  misc_feature 1..20: note = CRISPR gRNA sequence
  source 1..20: mol_type = other DNA
aaaagcctaagctcaagaga

SEQ ID NO: 85481 - DNA, 20 bp, synthetic construct
  misc_feature 1..20: note = CRISPR gRNA sequence
  source 1..20: mol_type = other DNA
agctcaagagatcctcccgc

SEQ ID NO: 85482 - DNA, 20 bp, synthetic construct
  misc_feature 1..20: note = CRISPR gRNA sequence
  source 1..20: mol_type = other DNA
aagagatcctcccgcctcag

SEQ ID NO: 85483 - DNA, 20 bp, synthetic construct
  misc_feature 1..20: note = CRISPR gRNA sequence
  source 1..20: mol_type = other DNA
ccgcctcagccaccggagca

SEQ ID NO: 85484 - DNA, 20 bp, synthetic construct
  misc_feature 1..20: note = CRISPR gRNA sequence
  source 1..20: mol_type = other DNA
agccaccggagcagctggga

SEQ ID NO: 85485 - DNA, 20 bp, synthetic construct
  misc_feature 1..20: note = CRISPR gRNA sequence
  source 1..20: mol_type = other DNA
ggaccacaggcacgagccac

SEQ ID NO: 85486 - DNA, 20 bp, synthetic construct
  misc_feature 1..20: note = CRISPR gRNA sequence
  source 1..20: mol_type = other DNA
atttttgttattattttttg

SEQ ID NO: 85487 - DNA, 20 bp, synthetic construct
  misc_feature 1..20: note = CRISPR gRNA sequence
  source 1..20: mol_type = other DNA
ttgttattattttttgtaga

SEQ ID NO: 85488 - DNA, 20 bp, synthetic construct
  misc_feature 1..20: note = CRISPR gRNA sequence
  source 1..20: mol_type = other DNA
tgttattattttttgtagag

SEQ ID NO: 85489 - DNA, 20 bp, synthetic construct
  misc_feature 1..20: note = CRISPR gRNA sequence
  source 1..20: mol_type = other DNA
gttattattttttgtagaga

SEQ ID NO: 85490 - DNA, 20 bp, synthetic construct
  misc_feature 1..20: note = CRISPR gRNA sequence
  source 1..20: mol_type = other DNA
ttattattttttgtagagac

SEQ ID NO: 85491 - DNA, 20 bp, synthetic construct
  misc_feature 1..20: note = CRISPR gRNA sequence
  source 1..20: mol_type = other DNA
ttattttttgtagagaccag

SEQ ID NO: 85492 - DNA, 20 bp, synthetic construct
  misc_feature 1..20: note = CRISPR gRNA sequence
  source 1..20: mol_type = other DNA
ttttttgtagagaccaggct

SEQ ID NO: 85493 - DNA, 20 bp, synthetic construct
  misc_feature 1..20: note = CRISPR gRNA sequence
  source 1..20: mol_type = other DNA
tttgtagagaccaggcttca

SEQ ID NO: 85494 - DNA, 20 bp, synthetic construct
  misc_feature 1..20: note = CRISPR gRNA sequence
  source 1..20: mol_type = other DNA
ttgtagagaccaggcttcac

SEQ ID NO: 85495 - DNA, 20 bp, synthetic construct
  misc_feature 1..20: note = CRISPR gRNA sequence
  source 1..20: mol_type = other DNA
tgtagagaccaggcttcacc

SEQ ID NO: 85496 - DNA, 20 bp, synthetic construct
  misc_feature 1..20: note = CRISPR gRNA sequence
  source 1..20: mol_type = other DNA
gtagagaccaggcttcacca

SEQ ID NO: 85497 - DNA, 20 bp, synthetic construct
  misc_feature 1..20: note = CRISPR gRNA sequence
  source 1..20: mol_type = other DNA
tagagaccaggcttcaccat

SEQ ID NO: 85498 - DNA, 20 bp, synthetic construct
  misc_feature 1..20: note = CRISPR gRNA sequence
  source 1..20: mol_type = other DNA
caccatgttggccaggctgg

SEQ ID NO: 85499 - DNA, 20 bp, synthetic construct
  misc_feature 1..20: note = CRISPR gRNA sequence
  source 1..20: mol_type = other DNA
accatgttggccaggctggt

SEQ ID NO: 85500 - DNA, 20 bp, synthetic construct
  misc_feature 1..20: note = CRISPR gRNA sequence
  source 1..20: mol_type = other DNA
gccaggctggtctcaactac

SEQ ID NO: 85501 - DNA, 20 bp, synthetic construct
  misc_feature 1..20: note = CRISPR gRNA sequence
  source 1..20: mol_type = other DNA
gtctcaactacggacctcaa

SEQ ID NO: 85502 - DNA, 20 bp, synthetic construct
  misc_feature 1..20: note = CRISPR gRNA sequence
  source 1..20: mol_type = other DNA
aactacggacctcaagccat

SEQ ID NO: 85503 - DNA, 20 bp, synthetic construct
  misc_feature 1..20: note = CRISPR gRNA sequence
  source 1..20: mol_type = other DNA
cggacctcaagccatcctcc

SEQ ID NO: 85504 - DNA, 20 bp, synthetic construct
  misc_feature 1..20: note = CRISPR gRNA sequence
  source 1..20: mol_type = other DNA
aagccatcctcccgcctcgg

SEQ ID NO: 85505 - DNA, 20 bp, synthetic construct
  misc_feature 1..20: note = CRISPR gRNA sequence
  source 1..20: mol_type = other DNA
ccgcctcggcctccctaagt

SEQ ID NO: 85506 - DNA, 20 bp, synthetic construct
  misc_feature 1..20: note = CRISPR gRNA sequence
  source 1..20: mol_type = other DNA
ggcctccctaagtgctggga

SEQ ID NO: 85507 - DNA, 20 bp, synthetic construct
  misc_feature 1..20: note = CRISPR gRNA sequence
  source 1..20: mol_type = other DNA
cctaagtgctgggattacag

SEQ ID NO: 85508 - DNA, 20 bp, synthetic construct
  misc_feature 1..20: note = CRISPR gRNA sequence
  source 1..20: mol_type = other DNA
agtgctgggattacaggcgt

SEQ ID NO: 85509 - DNA, 20 bp, synthetic construct
  misc_feature 1..20: note = CRISPR gRNA sequence
  source 1..20: mol_type = other DNA
ggattacaggcgtaagctac

SEQ ID NO: 85510 - DNA, 20 bp, synthetic construct
  misc_feature 1..20: note = CRISPR gRNA sequence
  source 1..20: mol_type = other DNA
caggcgtaagctaccacgcc

SEQ ID NO: 85511 - DNA, 20 bp, synthetic construct
  misc_feature 1..20: note = CRISPR gRNA sequence
  source 1..20: mol_type = other DNA
ccacgcccaaccccctcatg

SEQ ID NO: 85512 - DNA, 20 bp, synthetic construct
  misc_feature 1..20: note = CRISPR gRNA sequence
  source 1..20: mol_type = other DNA
atgttttcaaaaccgaaagt

SEQ ID NO: 85513 - DNA, 20 bp, synthetic construct
  misc_feature 1..20: note = CRISPR gRNA sequence
  source 1..20: mol_type = other DNA
tcaaaaccgaaagtaagagg

SEQ ID NO: 85514 - DNA, 20 bp, synthetic construct
  misc_feature 1..20: note = CRISPR gRNA sequence
  source 1..20: mol_type = other DNA
caaaaccgaaagtaagaggc

SEQ ID NO: 85515 - DNA, 20 bp, synthetic construct
  misc_feature 1..20: note = CRISPR gRNA sequence
  source 1..20: mol_type = other DNA
aaaaccgaaagtaagaggca

SEQ ID NO: 85516 - DNA, 20 bp, synthetic construct
  misc_feature 1..20: note = CRISPR gRNA sequence
  source 1..20: mol_type = other DNA
ggaaacaaccaggcaaagag

SEQ ID NO: 85517 - DNA, 20 bp, synthetic construct
  misc_feature 1..20: note = CRISPR gRNA sequence
  source 1..20: mol_type = other DNA
gaaacaaccaggcaaagagc

SEQ ID NO: 85518 - DNA, 20 bp, synthetic construct
  misc_feature 1..20: note = CRISPR gRNA sequence
  source 1..20: mol_type = other DNA
tgtacgaaaagaccacaggg

SEQ ID NO: 85519 - DNA, 20 bp, synthetic construct
  misc_feature 1..20: note = CRISPR gRNA sequence
  source 1..20: mol_type = other DNA
tacgaaaagaccacagggcc

SEQ ID NO: 85520 - DNA, 20 bp, synthetic construct
  misc_feature 1..20: note = CRISPR gRNA sequence
  source 1..20: mol_type = other DNA
gctctggagaatctcacgca

SEQ ID NO: 85521 - DNA, 20 bp, synthetic construct
  misc_feature 1..20: note = CRISPR gRNA sequence
  source 1..20: mol_type = other DNA
ctctggagaatctcacgcag

SEQ ID NO: 85522 - DNA, 20 bp, synthetic construct
  misc_feature 1..20: note = CRISPR gRNA sequence
  source 1..20: mol_type = other DNA
tggagaatctcacgcagaag

SEQ ID NO: 85523 - DNA, 20 bp, synthetic construct
  misc_feature 1..20: note = CRISPR gRNA sequence
  source 1..20: mol_type = other DNA
gagaatctcacgcagaaggc

SEQ ID NO: 85524 - DNA, 20 bp, synthetic construct
  misc_feature 1..20: note = CRISPR gRNA sequence
  source 1..20: mol_type = other DNA
acgcagaaggcaggcgtttt

SEQ ID NO: 85525 - DNA, 20 bp, synthetic construct
  misc_feature 1..20: note = CRISPR gRNA sequence
  source 1..20: mol_type = other DNA
ttcttaaaaaaaaatgcacg

SEQ ID NO: 85526 - DNA, 20 bp, synthetic construct
  misc_feature 1..20: note = CRISPR gRNA sequence
  source 1..20: mol_type = other DNA
tcttaaaaaaaaatgcacga

SEQ ID NO: 85527 - DNA, 20 bp, synthetic construct
  misc_feature 1..20: note = CRISPR gRNA sequence
  source 1..20: mol_type = other DNA
cttaaaaaaaaatgcacgaa

SEQ ID NO: 85528 - DNA, 20 bp, synthetic construct
  misc_feature 1..20: note = CRISPR gRNA sequence
  source 1..20: mol_type = other DNA
ttaaaaaaaaatgcacgaat

SEQ ID NO: 85529 - DNA, 20 bp, synthetic construct
  misc_feature 1..20: note = CRISPR gRNA sequence
  source 1..20: mol_type = other DNA
aaaaaaaaatgcacgaatta

SEQ ID NO: 85530 - DNA, 20 bp, synthetic construct
  misc_feature 1..20: note = CRISPR gRNA sequence
  source 1..20: mol_type = other DNA
aaaaaaaatgcacgaattac

SEQ ID NO: 85531 - DNA, 20 bp, synthetic construct
  misc_feature 1..20: note = CRISPR gRNA sequence
  source 1..20: mol_type = other DNA
cagccaaaaggcatgcgctc

SEQ ID NO: 85532 - DNA, 20 bp, synthetic construct
  misc_feature 1..20: note = CRISPR gRNA sequence
  source 1..20: mol_type = other DNA
ccgcaaaagccctggttagg

SEQ ID NO: 85533 - DNA, 20 bp, synthetic construct
  misc_feature 1..20: note = CRISPR gRNA sequence
  source 1..20: mol_type = other DNA
gttaggcttgacttcaatct

SEQ ID NO: 85534 - DNA, 20 bp, synthetic construct
  misc_feature 1..20: note = CRISPR gRNA sequence
  source 1..20: mol_type = other DNA
ggcttgacttcaatctcgat

SEQ ID NO: 85535 - DNA, 20 bp, synthetic construct
  misc_feature 1..20: note = CRISPR gRNA sequence
  source 1..20: mol_type = other DNA
gacttcaatctcgattgctg

SEQ ID NO: 85536 - DNA, 20 bp, synthetic construct
  misc_feature 1..20: note = CRISPR gRNA sequence
  source 1..20: mol_type = other DNA
acttcaatctcgattgctgc

SEQ ID NO: 85537 - DNA, 20 bp, synthetic construct
  misc_feature 1..20: note = CRISPR gRNA sequence
  source 1..20: mol_type = other DNA
caatctcgattgctgccatt

SEQ ID NO: 85538 - DNA, 20 bp, synthetic construct
  misc_feature 1..20: note = CRISPR gRNA sequence
  source 1..20: mol_type = other DNA
aatctcgattgctgccattt

SEQ ID NO: 85539 - DNA, 20 bp, synthetic construct
  misc_feature 1..20: note = CRISPR gRNA sequence
  source 1..20: mol_type = other DNA
gattgctgccatttatcccc

SEQ ID NO: 85540 - DNA, 20 bp, synthetic construct
  misc_feature 1..20: note = CRISPR gRNA sequence
  source 1..20: mol_type = other DNA
ctgccatttatcccctgtgt

SEQ ID NO: 85541 - DNA, 20 bp, synthetic construct
  misc_feature 1..20: note = CRISPR gRNA sequence
  source 1..20: mol_type = other DNA
ccatttatcccctgtgtaat

SEQ ID NO: 85542 - DNA, 20 bp, synthetic construct
  misc_feature 1..20: note = CRISPR gRNA sequence
  source 1..20: mol_type = other DNA
atcccctgtgtaattaagtt

SEQ ID NO: 85543 - DNA, 20 bp, synthetic construct
  misc_feature 1..20: note = CRISPR gRNA sequence
  source 1..20: mol_type = other DNA
tcccctgtgtaattaagttt

SEQ ID NO: 85544 - DNA, 20 bp, synthetic construct
  misc_feature 1..20: note = CRISPR gRNA sequence
  source 1..20: mol_type = other DNA
tgtaattaagtttcttaaaa

SEQ ID NO: 85545 - DNA, 20 bp, synthetic construct
  misc_feature 1..20: note = CRISPR gRNA sequence
  source 1..20: mol_type = other DNA
agtttcttaaaatctcggtg

SEQ ID NO: 85546 - DNA, 20 bp, synthetic construct
  misc_feature 1..20: note = CRISPR gRNA sequence
  source 1..20: mol_type = other DNA
cttaaaatctcggtgcctta

SEQ ID NO: 85547 - DNA, 20 bp, synthetic construct
  misc_feature 1..20: note = CRISPR gRNA sequence
  source 1..20: mol_type = other DNA
ttaaaatctcggtgccttag

SEQ ID NO: 85548 - DNA, 20 bp, synthetic construct
  misc_feature 1..20: note = CRISPR gRNA sequence
  source 1..20: mol_type = other DNA
aaaatctcggtgccttagtt

SEQ ID NO: 85549 - DNA, 20 bp, synthetic construct
  misc_feature 1..20: note = CRISPR gRNA sequence
  source 1..20: mol_type = other DNA
aaatctcggtgccttagttt

SEQ ID NO: 85550 - DNA, 20 bp, synthetic construct
  misc_feature 1..20: note = CRISPR gRNA sequence
  source 1..20: mol_type = other DNA
ggtgccttagtttcttcatc

SEQ ID NO: 85551 - DNA, 20 bp, synthetic construct
  misc_feature 1..20: note = CRISPR gRNA sequence
  source 1..20: mol_type = other DNA
agtttcttcatctgtgagag

SEQ ID NO: 85552 - DNA, 20 bp, synthetic construct
  misc_feature 1..20: note = CRISPR gRNA sequence
  source 1..20: mol_type = other DNA
gtttcttcatctgtgagagg

SEQ ID NO: 85553 - DNA, 20 bp, synthetic construct
  misc_feature 1..20: note = CRISPR gRNA sequence
  source 1..20: mol_type = other DNA
cttcatctgtgagaggcaga

SEQ ID NO: 85554 - DNA, 20 bp, synthetic construct
  misc_feature 1..20: note = CRISPR gRNA sequence
  source 1..20: mol_type = other DNA
ttcatctgtgagaggcagaa

SEQ ID NO: 85555 - DNA, 20 bp, synthetic construct
  misc_feature 1..20: note = CRISPR gRNA sequence
  source 1..20: mol_type = other DNA
catctgtgagaggcagaaga

SEQ ID NO: 85556 - DNA, 20 bp, synthetic construct
  misc_feature 1..20: note = CRISPR gRNA sequence
  source 1..20: mol_type = other DNA
atctgtgagaggcagaagat

SEQ ID NO: 85557 - DNA, 20 bp, synthetic construct
  misc_feature 1..20: note = CRISPR gRNA sequence
  source 1..20: mol_type = other DNA
tgagaggcagaagataacca

SEQ ID NO: 85558 - DNA, 20 bp, synthetic construct
  misc_feature 1..20: note = CRISPR gRNA sequence
  source 1..20: mol_type = other DNA
tctatggcggaagataactg

SEQ ID NO: 85559 - DNA, 20 bp, synthetic construct
  misc_feature 1..20: note = CRISPR gRNA sequence
  source 1..20: mol_type = other DNA
tggcggaagataactgtttt

SEQ ID NO: 85560 - DNA, 20 bp, synthetic construct
  misc_feature 1..20: note = CRISPR gRNA sequence
  source 1..20: mol_type = other DNA
ttttcaaaattaaatgacgc

SEQ ID NO: 85561 - DNA, 20 bp, synthetic construct
  misc_feature 1..20: note = CRISPR gRNA sequence
  source 1..20: mol_type = other DNA
tcaaaattaaatgacgcaaa

SEQ ID NO: 85562 - DNA, 20 bp, synthetic construct
  misc_feature 1..20: note = CRISPR gRNA sequence
  source 1..20: mol_type = other DNA
caaaattaaatgacgcaaag

SEQ ID NO: 85563 - DNA, 20 bp, synthetic construct
  misc_feature 1..20: note = CRISPR gRNA sequence
  source 1..20: mol_type = other DNA
aaaattaaatgacgcaaagc

SEQ ID NO: 85564 - DNA, 20 bp, synthetic construct
  misc_feature 1..20: note = CRISPR gRNA sequence
  source 1..20: mol_type = other DNA
aatgacgcaaagcacataaa

SEQ ID NO: 85565 - DNA, 20 bp, synthetic construct
  misc_feature 1..20: note = CRISPR gRNA sequence
  source 1..20: mol_type = other DNA
ggcacacagaaagatgtcaa

SEQ ID NO: 85566 - DNA, 20 bp, synthetic construct
  misc_feature 1..20: note = CRISPR gRNA sequence
  source 1..20: mol_type = other DNA
gcacacagaaagatgtcaat

SEQ ID NO: 85567 - DNA, 20 bp, synthetic construct
  misc_feature 1..20: note = CRISPR gRNA sequence
  source 1..20: mol_type = other DNA
ttataattttttaaaagtga

SEQ ID NO: 85568 - DNA, 20 bp, synthetic construct
  misc_feature 1..20: note = CRISPR gRNA sequence
  source 1..20: mol_type = other DNA
ataattttttaaaagtgaca

SEQ ID NO: 85569 - DNA, 20 bp, synthetic construct
  misc_feature 1..20: note = CRISPR gRNA sequence
  source 1..20: mol_type = other DNA
taattttttaaaagtgacat

SEQ ID NO: 85570 - DNA, 20 bp, synthetic construct
  misc_feature 1..20: note = CRISPR gRNA sequence
  source 1..20: mol_type = other DNA
tttaaaagtgacatgtgatg

SEQ ID NO: 85571 - DNA, 20 bp, synthetic construct
  misc_feature 1..20: note = CRISPR gRNA sequence
  source 1..20: mol_type = other DNA
ttaaaagtgacatgtgatgg

SEQ ID NO: 85572 - DNA, 20 bp, synthetic construct
  misc_feature 1..20: note = CRISPR gRNA sequence
  source 1..20: mol_type = other DNA
taaaagtgacatgtgatggg

SEQ ID NO: 85573 - DNA, 20 bp, synthetic construct
  misc_feature 1..20: note = CRISPR gRNA sequence
  source 1..20: mol_type = other DNA
aaaagtgacatgtgatggga

SEQ ID NO: 85574 - DNA, 20 bp, synthetic construct
  misc_feature 1..20: note = CRISPR gRNA sequence
  source 1..20: mol_type = other DNA
aaagtgacatgtgatgggaa

SEQ ID NO: 85575 - DNA, 20 bp, synthetic construct
  misc_feature 1..20: note = CRISPR gRNA sequence
  source 1..20: mol_type = other DNA
attattcgaaaccgctttgt

SEQ ID NO: 85576 - DNA, 20 bp, synthetic construct
  misc_feature 1..20: note = CRISPR gRNA sequence
  source 1..20: mol_type = other DNA
ttcgaaaccgctttgtatca

SEQ ID NO: 85577 - DNA, 20 bp, synthetic construct
  misc_feature 1..20: note = CRISPR gRNA sequence
  source 1..20: mol_type = other DNA
gaaaccgctttgtatcacag

SEQ ID NO: 85578 - DNA, 20 bp, synthetic construct
  misc_feature 1..20: note = CRISPR gRNA sequence
  source 1..20: mol_type = other DNA
tgtatcacagccaagcattc

SEQ ID NO: 85579 - DNA, 20 bp, synthetic construct
  misc_feature 1..20: note = CRISPR gRNA sequence
  source 1..20: mol_type = other DNA
gtatcacagccaagcattct

SEQ ID NO: 85580 - DNA, 20 bp, synthetic construct
  misc_feature 1..20: note = CRISPR gRNA sequence
  source 1..20: mol_type = other DNA
tatcacagccaagcattcta

SEQ ID NO: 85581 - DNA, 20 bp, synthetic construct
  misc_feature 1..20: note = CRISPR gRNA sequence
  source 1..20: mol_type = other DNA
tacaaacgtcgcgtgctgtt

SEQ ID NO: 85582 - DNA, 20 bp, synthetic construct
  misc_feature 1..20: note = CRISPR gRNA sequence
  source 1..20: mol_type = other DNA
caaacgtcgcgtgctgtttc

SEQ ID NO: 85583 - DNA, 20 bp, synthetic construct
  misc_feature 1..20: note = CRISPR gRNA sequence
  source 1..20: mol_type = other DNA
tttcctccccacggtgtggc

SEQ ID NO: 85584 - DNA, 20 bp, synthetic construct
  misc_feature 1..20: note = CRISPR gRNA sequence
  source 1..20: mol_type = other DNA
cctccccacggtgtggcccc

SEQ ID NO: 85585 - DNA, 20 bp, synthetic construct
  misc_feature 1..20: note = CRISPR gRNA sequence
  source 1..20: mol_type = other DNA
ctccccacggtgtggcccca

SEQ ID NO: 85586 - DNA, 20 bp, synthetic construct
  misc_feature 1..20: note = CRISPR gRNA sequence
  source 1..20: mol_type = other DNA
cccacggtgtggccccacat

SEQ ID NO: 85587 - DNA, 20 bp, synthetic construct
  misc_feature 1..20: note = CRISPR gRNA sequence
  source 1..20: mol_type = other DNA
ggacatgcgaacttagcggg

SEQ ID NO: 85588 - DNA, 20 bp, synthetic construct
  misc_feature 1..20: note = CRISPR gRNA sequence
  source 1..20: mol_type = other DNA
agcgggcgcctagacgaagt

SEQ ID NO: 85589 - DNA, 20 bp, synthetic construct
  misc_feature 1..20: note = CRISPR gRNA sequence
  source 1..20: mol_type = other DNA
gcgggcgcctagacgaagtc

SEQ ID NO: 85590 - DNA, 20 bp, synthetic construct
  misc_feature 1..20: note = CRISPR gRNA sequence
  source 1..20: mol_type = other DNA
gacgaagtccacagctctcc

SEQ ID NO: 85591 - DNA, 20 bp, synthetic construct
  misc_feature 1..20: note = CRISPR gRNA sequence
  source 1..20: mol_type = other DNA
tccagtctaagggaagcaga

SEQ ID NO: 85592 - DNA, 20 bp, synthetic construct
  misc_feature 1..20: note = CRISPR gRNA sequence
  source 1..20: mol_type = other DNA
cagtctaagggaagcagagc

SEQ ID NO: 85593 - DNA, 20 bp, synthetic construct
  misc_feature 1..20: note = CRISPR gRNA sequence
  source 1..20: mol_type = other DNA
agggaagcagagccgcagca

SEQ ID NO: 85594 - DNA, 20 bp, synthetic construct
  misc_feature 1..20: note = CRISPR gRNA sequence
  source 1..20: mol_type = other DNA
acccgggcgacgcctccccc

SEQ ID NO: 85595 - DNA, 20 bp, synthetic construct
  misc_feature 1..20: note = CRISPR gRNA sequence
  source 1..20: mol_type = other DNA
cccgggcgacgcctccccca

SEQ ID NO: 85596 - DNA, 20 bp, synthetic construct
  misc_feature 1..20: note = CRISPR gRNA sequence
  source 1..20: mol_type = other DNA
ccccagaccccaagcgcccc

SEQ ID NO: 85597 - DNA, 20 bp, synthetic construct
  misc_feature 1..20: note = CRISPR gRNA sequence
  source 1..20: mol_type = other DNA
cacgcgttcacaaacctcag

SEQ ID NO: 85598 - DNA, 20 bp, synthetic construct
  misc_feature 1..20: note = CRISPR gRNA sequence
  source 1..20: mol_type = other DNA
acaaacctcagcgccgcgcc

SEQ ID NO: 85599 - DNA, 20 bp, synthetic construct
  misc_feature 1..20: note = CRISPR gRNA sequence
  source 1..20: mol_type = other DNA
agcgccgcgcctttgggacg

SEQ ID NO: 85600 - DNA, 20 bp, synthetic construct
  misc_feature 1..20: note = CRISPR gRNA sequence
  source 1..20: mol_type = other DNA
tgggacgagcctacccgtcc

SEQ ID NO: 85601 - DNA, 20 bp, synthetic construct
  misc_feature 1..20: note = CRISPR gRNA sequence
  source 1..20: mol_type = other DNA
gggacgagcctacccgtccc

SEQ ID NO: 85602 - DNA, 20 bp, synthetic construct
  misc_feature 1..20: note = CRISPR gRNA sequence
  source 1..20: mol_type = other DNA
ggacgagcctacccgtcccc

SEQ ID NO: 85603 - DNA, 20 bp, synthetic construct
  misc_feature 1..20: note = CRISPR gRNA sequence
  source 1..20: mol_type = other DNA
cccgtcccccactccagctg

SEQ ID NO: 85604 - DNA, 20 bp, synthetic construct
  misc_feature 1..20: note = CRISPR gRNA sequence
  source 1..20: mol_type = other DNA
cagctgcgctgggggagcca

SEQ ID NO: 85605 - DNA, 20 bp, synthetic construct
  misc_feature 1..20: note = CRISPR gRNA sequence
  source 1..20: mol_type = other DNA
cgctgggggagccagaggcc

SEQ ID NO: 85606 - DNA, 20 bp, synthetic construct
  misc_feature 1..20: note = CRISPR gRNA sequence
  source 1..20: mol_type = other DNA
ggggagccagaggccccgcg

SEQ ID NO: 85607 - DNA, 20 bp, synthetic construct
  misc_feature 1..20: note = CRISPR gRNA sequence
  source 1..20: mol_type = other DNA
ccccaacctcggcgctctga

SEQ ID NO: 85608 - DNA, 20 bp, synthetic construct
  misc_feature 1..20: note = CRISPR gRNA sequence
  source 1..20: mol_type = other DNA
ggcgctctgacgcttatcga

SEQ ID NO: 85609 - DNA, 20 bp, synthetic construct
  misc_feature 1..20: note = CRISPR gRNA sequence
  source 1..20: mol_type = other DNA
tgacgcttatcgacgcccta

SEQ ID NO: 85610 - DNA, 20 bp, synthetic construct
  misc_feature 1..20: note = CRISPR gRNA sequence
  source 1..20: mol_type = other DNA
acgcttatcgacgccctaaa

SEQ ID NO: 85611 - DNA, 20 bp, synthetic construct
  misc_feature 1..20: note = CRISPR gRNA sequence
  source 1..20: mol_type = other DNA
atcgacgccctaaactttgt

SEQ ID NO: 85612 - DNA, 20 bp, synthetic construct
  misc_feature 1..20: note = CRISPR gRNA sequence
  source 1..20: mol_type = other DNA
tcgacgccctaaactttgtc

SEQ ID NO: 85613 - DNA, 20 bp, synthetic construct
  misc_feature 1..20: note = CRISPR gRNA sequence
  source 1..20: mol_type = other DNA
aactttgtcccgaccctccc

SEQ ID NO: 85614 - DNA, 20 bp, synthetic construct
  misc_feature 1..20: note = CRISPR gRNA sequence
  source 1..20: mol_type = other DNA
tgtcccgaccctcccgtcgc

SEQ ID NO: 85615 - DNA, 20 bp, synthetic construct
  misc_feature 1..20: note = CRISPR gRNA sequence
  source 1..20: mol_type = other DNA
gtcccgaccctcccgtcgcc

SEQ ID NO: 85616 - DNA, 20 bp, synthetic construct
  misc_feature 1..20: note = CRISPR gRNA sequence
  source 1..20: mol_type = other DNA
tcccgaccctcccgtcgccg

SEQ ID NO: 85617 - DNA, 20 bp, synthetic construct
  misc_feature 1..20: note = CRISPR gRNA sequence
  source 1..20: mol_type = other DNA
ccgtcgccgtaggccaaagg

SEQ ID NO: 85618 - DNA, 20 bp, synthetic construct
  misc_feature 1..20: note = CRISPR gRNA sequence
  source 1..20: mol_type = other DNA
ccctgctccccgccgaaagg

SEQ ID NO: 85619 - DNA, 20 bp, synthetic construct
  misc_feature 1..20: note = CRISPR gRNA sequence
  source 1..20: mol_type = other DNA
ctccccgccgaaaggggcaa

SEQ ID NO: 85620 - DNA, 20 bp, synthetic construct
  misc_feature 1..20: note = CRISPR gRNA sequence
  source 1..20: mol_type = other DNA
cccgccgaaaggggcaagta

SEQ ID NO: 85621 - DNA, 20 bp, synthetic construct
  misc_feature 1..20: note = CRISPR gRNA sequence
  source 1..20: mol_type = other DNA
ccccactcccaggccacccc

SEQ ID NO: 85622 - DNA, 20 bp, synthetic construct
  misc_feature 1..20: note = CRISPR gRNA sequence
  source 1..20: mol_type = other DNA
cccactcccaggccaccccg

SEQ ID NO: 85623 - DNA, 20 bp, synthetic construct
  misc_feature 1..20: note = CRISPR gRNA sequence
  source 1..20: mol_type = other DNA
ccaggccaccccgccgcttc

SEQ ID NO: 85624 - DNA, 20 bp, synthetic construct
  misc_feature 1..20: note = CRISPR gRNA sequence
  source 1..20: mol_type = other DNA
ccccgagatccagccctgga

SEQ ID NO: 85625 - DNA, 20 bp, synthetic construct
  misc_feature 1..20: note = CRISPR gRNA sequence
  source 1..20: mol_type = other DNA
cccgagatccagccctggac

SEQ ID NO: 85626 - DNA, 20 bp, synthetic construct
  misc_feature 1..20: note = CRISPR gRNA sequence
  source 1..20: mol_type = other DNA
gactagccccacggcgggcc

SEQ ID NO: 85627 - DNA, 20 bp, synthetic construct
  misc_feature 1..20: note = CRISPR gRNA sequence
  source 1..20: mol_type = other DNA
gccccacggcgggccaccaa

SEQ ID NO: 85628 - DNA, 20 bp, synthetic construct
  misc_feature 1..20: note = CRISPR gRNA sequence
  source 1..20: mol_type = other DNA
ggagaagggaagtcacggag

SEQ ID NO: 85629 - DNA, 20 bp, synthetic construct
  misc_feature 1..20: note = CRISPR gRNA sequence
  source 1..20: mol_type = other DNA
gagaagggaagtcacggagc

SEQ ID NO: 85630 - DNA, 20 bp, synthetic construct
  misc_feature 1..20: note = CRISPR gRNA sequence
  source 1..20: mol_type = other DNA
acgctggatagcctccaggc

SEQ ID NO: 85631 - DNA, 20 bp, synthetic construct
  misc_feature 1..20: note = CRISPR gRNA sequence
  source 1..20: mol_type = other DNA
gatagcctccaggccagaaa

SEQ ID NO: 85632 - DNA, 20 bp, synthetic construct
  misc_feature 1..20: note = CRISPR gRNA sequence
  source 1..20: mol_type = other DNA
caggccagaaagagagagta

SEQ ID NO: 85633 - DNA, 20 bp, synthetic construct
  misc_feature 1..20: note = CRISPR gRNA sequence
  source 1..20: mol_type = other DNA
aggccacggagcgagacatc

SEQ ID NO: 85634 - DNA, 20 bp, synthetic construct
  misc_feature 1..20: note = CRISPR gRNA sequence
  source 1..20: mol_type = other DNA
ggcccgaatgctgtcagctt

SEQ ID NO: 85635 - DNA, 20 bp, synthetic construct
  misc_feature 1..20: note = CRISPR gRNA sequence
  source 1..20: mol_type = other DNA
tcagcttcaggaatgcccgc

SEQ ID NO: 85636 - DNA, 20 bp, synthetic construct
  misc_feature 1..20: note = CRISPR gRNA sequence
  source 1..20: mol_type = other DNA
caggaatgcccgccagcgcg

SEQ ID NO: 85637 - DNA, 20 bp, synthetic construct
  misc_feature 1..20: note = CRISPR gRNA sequence
  source 1..20: mol_type = other DNA
aggaatgcccgccagcgcga

SEQ ID NO: 85638 - DNA, 20 bp, synthetic construct
  misc_feature 1..20: note = CRISPR gRNA sequence
  source 1..20: mol_type = other DNA
cacttatattaaacgcgtgc

SEQ ID NO: 85639 - DNA, 20 bp, synthetic construct
  misc_feature 1..20: note = CRISPR gRNA sequence
  source 1..20: mol_type = other DNA
atattaaacgcgtgcccagc

SEQ ID NO: 85640 - DNA, 20 bp, synthetic construct
  misc_feature 1..20: note = CRISPR gRNA sequence
  source 1..20: mol_type = other DNA
tattaaacgcgtgcccagcc

SEQ ID NO: 85641 - DNA, 20 bp, synthetic construct
  misc_feature 1..20: note = CRISPR gRNA sequence
  source 1..20: mol_type = other DNA
aacgcgtgcccagccaatca

SEQ ID NO: 85642 - DNA, 20 bp, synthetic construct
  misc_feature 1..20: note = CRISPR gRNA sequence
  source 1..20: mol_type = other DNA
tctccaagccagcgacgcag

SEQ ID NO: 85643 - DNA, 20 bp, synthetic construct
  misc_feature 1..20: note = CRISPR gRNA sequence
  source 1..20: mol_type = other DNA
caagccagcgacgcagtgcc

SEQ ID NO: 85644 - DNA, 20 bp, synthetic construct
  misc_feature 1..20: note = CRISPR gRNA sequence
  source 1..20: mol_type = other DNA
gagagagggactttcccgtt

SEQ ID NO: 85645 - DNA, 20 bp, synthetic construct
  misc_feature 1..20: note = CRISPR gRNA sequence
  source 1..20: mol_type = other DNA
aaaatatctatagcagataa

SEQ ID NO: 85646 - DNA, 20 bp, synthetic construct
  misc_feature 1..20: note = CRISPR gRNA sequence
  source 1..20: mol_type = other DNA
agataatagacacgaaaatt

SEQ ID NO: 85647 - DNA, 20 bp, synthetic construct
  misc_feature 1..20: note = CRISPR gRNA sequence
  source 1..20: mol_type = other DNA
gataatagacacgaaaatta

SEQ ID NO: 85648 - DNA, 20 bp, synthetic construct
  misc_feature 1..20: note = CRISPR gRNA sequence
  source 1..20: mol_type = other DNA
atagacacgaaaattaagga

SEQ ID NO: 85649 - DNA, 20 bp, synthetic construct
  misc_feature 1..20: note = CRISPR gRNA sequence
  source 1..20: mol_type = other DNA
gacacgaaaattaaggacag

SEQ ID NO: 85650 - DNA, 20 bp, synthetic construct
  misc_feature 1..20: note = CRISPR gRNA sequence
  source 1..20: mol_type = other DNA
taaggacagtggttaccgct

SEQ ID NO: 85651 - DNA, 20 bp, synthetic construct
  misc_feature 1..20: note = CRISPR gRNA sequence
  source 1..20: mol_type = other DNA
ggacagtggttaccgctaag

SEQ ID NO: 85652 - DNA, 20 bp, synthetic construct
  misc_feature 1..20: note = CRISPR gRNA sequence
  source 1..20: mol_type = other DNA
acagtggttaccgctaagaa

SEQ ID NO: 85653 - DNA, 20 bp, synthetic construct
  misc_feature 1..20: note = CRISPR gRNA sequence
  source 1..20: mol_type = other DNA
cagtggttaccgctaagaag

SEQ ID NO: 85654 - DNA, 20 bp, synthetic construct
  misc_feature 1..20: note = CRISPR gRNA sequence
  source 1..20: mol_type = other DNA
tggttaccgctaagaagagg

SEQ ID NO: 85655 - DNA, 20 bp, synthetic construct
  misc_feature 1..20: note = CRISPR gRNA sequence
  source 1..20: mol_type = other DNA
ggttaccgctaagaagaggc

SEQ ID NO: 85656 - DNA, 20 bp, synthetic construct
  misc_feature 1..20: note = CRISPR gRNA sequence
  source 1..20: mol_type = other DNA
gttaccgctaagaagaggcg

SEQ ID NO: 85657 - DNA, 20 bp, synthetic construct
  misc_feature 1..20: note = CRISPR gRNA sequence
  source 1..20: mol_type = other DNA
ttaccgctaagaagaggcgg

SEQ ID NO: 85658 - DNA, 20 bp, synthetic construct
  misc_feature 1..20: note = CRISPR gRNA sequence
  source 1..20: mol_type = other DNA
cgctaagaagaggcggggga

SEQ ID NO: 85659 - DNA, 20 bp, synthetic construct
  misc_feature 1..20: note = CRISPR gRNA sequence
  source 1..20: mol_type = other DNA
gctaagaagaggcgggggac

SEQ ID NO: 85660 - DNA, 20 bp, synthetic construct
  misc_feature 1..20: note = CRISPR gRNA sequence
  source 1..20: mol_type = other DNA
agaagaggcgggggacaggc

SEQ ID NO: 85661 - DNA, 20 bp, synthetic construct
  misc_feature 1..20: note = CRISPR gRNA sequence
  source 1..20: mol_type = other DNA
gaagaggcgggggacaggct

SEQ ID NO: 85662 - DNA, 20 bp, synthetic construct
  misc_feature 1..20: note = CRISPR gRNA sequence
  source 1..20: mol_type = other DNA
aagaggcgggggacaggcta

SEQ ID NO: 85663 - DNA, 20 bp, synthetic construct
  misc_feature 1..20: note = CRISPR gRNA sequence
  source 1..20: mol_type = other DNA
gaggcgggggacaggctagg

SEQ ID NO: 85664 - DNA, 20 bp, synthetic construct
  misc_feature 1..20: note = CRISPR gRNA sequence
  source 1..20: mol_type = other DNA
aggcgggggacaggctaggg

SEQ ID NO: 85665 - DNA, 20 bp, synthetic construct
  misc_feature 1..20: note = CRISPR gRNA sequence
  source 1..20: mol_type = other DNA
agggaggaacacaaacacaa

SEQ ID NO: 85666 - DNA, 20 bp, synthetic construct
  misc_feature 1..20: note = CRISPR gRNA sequence
  source 1..20: mol_type = other DNA
gttttaatgtatatgtgtta

SEQ ID NO: 85667 - DNA, 20 bp, synthetic construct
  misc_feature 1..20: note = CRISPR gRNA sequence
  source 1..20: mol_type = other DNA
ttttaatgtatatgtgttat

SEQ ID NO: 85668 - DNA, 20 bp, synthetic construct
  misc_feature 1..20: note = CRISPR gRNA sequence
  source 1..20: mol_type = other DNA
tgtatatgtgttatgggtca

SEQ ID NO: 85669 - DNA, 20 bp, synthetic construct
  misc_feature 1..20: note = CRISPR gRNA sequence
  source 1..20: mol_type = other DNA
gtatatgtgttatgggtcat

SEQ ID NO: 85670 - DNA, 20 bp, synthetic construct
  misc_feature 1..20: note = CRISPR gRNA sequence
  source 1..20: mol_type = other DNA
tatgggtcataggtactcat

SEQ ID NO: 85671 - DNA, 20 bp, synthetic construct
  misc_feature 1..20: note = CRISPR gRNA sequence
  source 1..20: mol_type = other DNA
gcttcataatttattcacgt

SEQ ID NO: 85672 - DNA, 20 bp, synthetic construct
  misc_feature 1..20: note = CRISPR gRNA sequence
  source 1..20: mol_type = other DNA
cacgttagatatactcttta

SEQ ID NO: 85673 - DNA, 20 bp, synthetic construct
  misc_feature 1..20: note = CRISPR gRNA sequence
  source 1..20: mol_type = other DNA
taatttcttaaaatctgctg

SEQ ID NO: 85674 - DNA, 20 bp, synthetic construct
  misc_feature 1..20: note = CRISPR gRNA sequence
  source 1..20: mol_type = other DNA
tttcttaaaatctgctgtgg

SEQ ID NO: 85675 - DNA, 20 bp, synthetic construct
  misc_feature 1..20: note = CRISPR gRNA sequence
  source 1..20: mol_type = other DNA
tggaaataaatgaacacatg

SEQ ID NO: 85676 - DNA, 20 bp, synthetic construct
  misc_feature 1..20: note = CRISPR gRNA sequence
  source 1..20: mol_type = other DNA
aacacatgaagtctccctga

SEQ ID NO: 85677 - DNA, 20 bp, synthetic construct
  misc_feature 1..20: note = CRISPR gRNA sequence
  source 1..20: mol_type = other DNA
aagtctccctgaaagaaaat

SEQ ID NO: 85678 - DNA, 20 bp, synthetic construct
  misc_feature 1..20: note = CRISPR gRNA sequence
  source 1..20: mol_type = other DNA
gaaagaaaatcagtgtttct

SEQ ID NO: 85679 - DNA, 20 bp, synthetic construct
  misc_feature 1..20: note = CRISPR gRNA sequence
  source 1..20: mol_type = other DNA
aaagaaaatcagtgtttctt

SEQ ID NO: 85680 - DNA, 20 bp, synthetic construct
  misc_feature 1..20: note = CRISPR gRNA sequence
  source 1..20: mol_type = other DNA
gaaaatcagtgtttcttggg

SEQ ID NO: 85681 - DNA, 20 bp, synthetic construct
  misc_feature 1..20: note = CRISPR gRNA sequence
  source 1..20: mol_type = other DNA
agtgtttcttgggaagaacc

SEQ ID NO: 85682 - DNA, 20 bp, synthetic construct
  misc_feature 1..20: note = CRISPR gRNA sequence
  source 1..20: mol_type = other DNA
gaagaaccaagattccctga

SEQ ID NO: 85683 - DNA, 20 bp, synthetic construct
  misc_feature 1..20: note = CRISPR gRNA sequence
  source 1..20: mol_type = other DNA
gaaccaagattccctgacag

SEQ ID NO: 85684 - DNA, 20 bp, synthetic construct
  misc_feature 1..20: note = CRISPR gRNA sequence
  source 1..20: mol_type = other DNA
ctgacagaagctaccctatg

SEQ ID NO: 85685 - DNA, 20 bp, synthetic construct
  misc_feature 1..20: note = CRISPR gRNA sequence
  source 1..20: mol_type = other DNA
gacagaagctaccctatgta

SEQ ID NO: 85686 - DNA, 20 bp, synthetic construct
  misc_feature 1..20: note = CRISPR gRNA sequence
  source 1..20: mol_type = other DNA
acagaagctaccctatgtag

SEQ ID NO: 85687 - DNA, 20 bp, synthetic construct
  misc_feature 1..20: note = CRISPR gRNA sequence
  source 1..20: mol_type = other DNA
gctaccctatgtagaggaca

SEQ ID NO: 85688 - DNA, 20 bp, synthetic construct
  misc_feature 1..20: note = CRISPR gRNA sequence
  source 1..20: mol_type = other DNA
accctatgtagaggacaaag

SEQ ID NO: 85689 - DNA, 20 bp, synthetic construct
  misc_feature 1..20: note = CRISPR gRNA sequence
  source 1..20: mol_type = other DNA
ccctatgtagaggacaaagt

SEQ ID NO: 85690 - DNA, 20 bp, synthetic construct
  misc_feature 1..20: note = CRISPR gRNA sequence
  source 1..20: mol_type = other DNA
agtaggtcttcaataaatat

SEQ ID NO: 85691 - DNA, 20 bp, synthetic construct
  misc_feature 1..20: note = CRISPR gRNA sequence
  source 1..20: mol_type = other DNA
ggtcttcaataaatattagt

SEQ ID NO: 85692 - DNA, 20 bp, synthetic construct
  misc_feature 1..20: note = CRISPR gRNA sequence
  source 1..20: mol_type = other DNA
gttggtttactgcttttccc

SEQ ID NO: 85693 - DNA, 20 bp, synthetic construct
  misc_feature 1..20: note = CRISPR gRNA sequence
  source 1..20: mol_type = other DNA
ttggtttactgcttttccca

SEQ ID NO: 85694 - DNA, 20 bp, synthetic construct
  misc_feature 1..20: note = CRISPR gRNA sequence
  source 1..20: mol_type = other DNA
gcttttcccaaggatacatc

SEQ ID NO: 85695 - DNA, 20 bp, synthetic construct
  misc_feature 1..20: note = CRISPR gRNA sequence
  source 1..20: mol_type = other DNA
ttttcccaaggatacatctg

SEQ ID NO: 85696 - DNA, 20 bp, synthetic construct
  misc_feature 1..20: note = CRISPR gRNA sequence
  source 1..20: mol_type = other DNA
tttcccaaggatacatctgg

SEQ ID NO: 85697 - DNA, 20 bp, synthetic construct
  misc_feature 1..20: note = CRISPR gRNA sequence
  source 1..20: mol_type = other DNA
ttcccaaggatacatctgga

SEQ ID NO: 85698 - DNA, 20 bp, synthetic construct
  misc_feature 1..20: note = CRISPR gRNA sequence
  source 1..20: mol_type = other DNA
ggtctgcattcctttctcat

SEQ ID NO: 85699 - DNA, 20 bp, synthetic construct
  misc_feature 1..20: note = CRISPR gRNA sequence
  source 1..20: mol_type = other DNA
tcattggtgccgcctgacca

SEQ ID NO: 85700 - DNA, 20 bp, synthetic construct
  misc_feature 1..20: note = CRISPR gRNA sequence
  source 1..20: mol_type = other DNA
gtgccgcctgaccacagaac

SEQ ID NO: 85701 - DNA, 20 bp, synthetic construct
  misc_feature 1..20: note = CRISPR gRNA sequence
  source 1..20: mol_type = other DNA
gacatctaacctaaaccccg

SEQ ID NO: 85702 - DNA, 20 bp, synthetic construct
  misc_feature 1..20: note = CRISPR gRNA sequence
  source 1..20: mol_type = other DNA
aacctaaaccccgcagtcct

SEQ ID NO: 85703 - DNA, 20 bp, synthetic construct
  misc_feature 1..20: note = CRISPR gRNA sequence
  source 1..20: mol_type = other DNA
taagtcctgacacgtatgac

SEQ ID NO: 85704 - DNA, 20 bp, synthetic construct
  misc_feature 1..20: note = CRISPR gRNA sequence
  source 1..20: mol_type = other DNA
tatgacaagatgctgccacc

SEQ ID NO: 85705 - DNA, 20 bp, synthetic construct
  misc_feature 1..20: note = CRISPR gRNA sequence
  source 1..20: mol_type = other DNA
gacaagatgctgccacctgg

SEQ ID NO: 85706 - DNA, 20 bp, synthetic construct
  misc_feature 1..20: note = CRISPR gRNA sequence
  source 1..20: mol_type = other DNA
atgctgccacctggtggata

SEQ ID NO: 85707 - DNA, 20 bp, synthetic construct
  misc_feature 1..20: note = CRISPR gRNA sequence
  source 1..20: mol_type = other DNA
gccacctggtggatacagaa

SEQ ID NO: 85708 - DNA, 20 bp, synthetic construct
  misc_feature 1..20: note = CRISPR gRNA sequence
  source 1..20: mol_type = other DNA
acagaatagatttaatgaaa

SEQ ID NO: 85709 - DNA, 20 bp, synthetic construct
  misc_feature 1..20: note = CRISPR gRNA sequence
  source 1..20: mol_type = other DNA
aatagatttaatgaaatggc

SEQ ID NO: 85710 - DNA, 20 bp, synthetic construct
  misc_feature 1..20: note = CRISPR gRNA sequence
  source 1..20: mol_type = other DNA
atagatttaatgaaatggct

SEQ ID NO: 85711 - DNA, 20 bp, synthetic construct
  misc_feature 1..20: note = CRISPR gRNA sequence
  source 1..20: mol_type = other DNA
gatttaatgaaatggctagg

SEQ ID NO: 85712 - DNA, 20 bp, synthetic construct
  misc_feature 1..20: note = CRISPR gRNA sequence
  source 1..20: mol_type = other DNA
ggctaggaagtctttcactc

SEQ ID NO: 85713 - DNA, 20 bp, synthetic construct
  misc_feature 1..20: note = CRISPR gRNA sequence
  source 1..20: mol_type = other DNA
aggaagtctttcactctagt

SEQ ID NO: 85714 - DNA, 20 bp, synthetic construct
  misc_feature 1..20: note = CRISPR gRNA sequence
  source 1..20: mol_type = other DNA
aagtctttcactctagttgg

SEQ ID NO: 85715 - DNA, 20 bp, synthetic construct
  misc_feature 1..20: note = CRISPR gRNA sequence
  source 1..20: mol_type = other DNA
ttcactctagttggtggaac

SEQ ID NO: 85716 - DNA, 20 bp, synthetic construct
  misc_feature 1..20: note = CRISPR gRNA sequence
  source 1..20: mol_type = other DNA
ctagttggtggaactggcaa

SEQ ID NO: 85717 - DNA, 20 bp, synthetic construct
  misc_feature 1..20: note = CRISPR gRNA sequence
  source 1..20: mol_type = other DNA
tagttggtggaactggcaat

SEQ ID NO: 85718 - DNA, 20 bp, synthetic construct
  misc_feature 1..20: note = CRISPR gRNA sequence
  source 1..20: mol_type = other DNA
agttggtggaactggcaata

SEQ ID NO: 85719 - DNA, 20 bp, synthetic construct
  misc_feature 1..20: note = CRISPR gRNA sequence
  source 1..20: mol_type = other DNA
ggtggaactggcaatagggt

SEQ ID NO: 85720 - DNA, 20 bp, synthetic construct
  misc_feature 1..20: note = CRISPR gRNA sequence
  source 1..20: mol_type = other DNA
tggaactggcaatagggtga

SEQ ID NO: 85721 - DNA, 20 bp, synthetic construct
  misc_feature 1..20: note = CRISPR gRNA sequence
  source 1..20: mol_type = other DNA
ggaactggcaatagggtgag

SEQ ID NO: 85722 - DNA, 20 bp, synthetic construct
  misc_feature 1..20: note = CRISPR gRNA sequence
  source 1..20: mol_type = other DNA
gaactggcaatagggtgaga

SEQ ID NO: 85723 - DNA, 20 bp, synthetic construct
  misc_feature 1..20: note = CRISPR gRNA sequence
  source 1..20: mol_type = other DNA
ctggcaatagggtgagaggg

SEQ ID NO: 85724 - DNA, 20 bp, synthetic construct
  misc_feature 1..20: note = CRISPR gRNA sequence
  source 1..20: mol_type = other DNA
gcaatagggtgagagggaag

SEQ ID NO: 85725 - DNA, 20 bp, synthetic construct
  misc_feature 1..20: note = CRISPR gRNA sequence
  source 1..20: mol_type = other DNA
caatagggtgagagggaagc

SEQ ID NO: 85726 - DNA, 20 bp, synthetic construct
  misc_feature 1..20: note = CRISPR gRNA sequence
  source 1..20: mol_type = other DNA
ggtgagagggaagcaggaat

SEQ ID NO: 85727 - DNA, 20 bp, synthetic construct
  misc_feature 1..20: note = CRISPR gRNA sequence
  source 1..20: mol_type = other DNA
gagagggaagcaggaatgag

SEQ ID NO: 85728 - DNA, 20 bp, synthetic construct
  misc_feature 1..20: note = CRISPR gRNA sequence
  source 1..20: mol_type = other DNA
ggaatgagaagacaaaaatt

SEQ ID NO: 85729 - DNA, 20 bp, synthetic construct
  misc_feature 1..20: note = CRISPR gRNA sequence
  source 1..20: mol_type = other DNA
agaagacaaaaattaagaaa

SEQ ID NO: 85730 - DNA, 20 bp, synthetic construct
  misc_feature 1..20: note = CRISPR gRNA sequence
  source 1..20: mol_type = other DNA
gaagacaaaaattaagaaac

SEQ ID NO: 85731 - DNA, 20 bp, synthetic construct
  misc_feature 1..20: note = CRISPR gRNA sequence
  source 1..20: mol_type = other DNA
caaaaattaagaaacaggaa

SEQ ID NO: 85732 - DNA, 20 bp, synthetic construct
  misc_feature 1..20: note = CRISPR gRNA sequence
  source 1..20: mol_type = other DNA
aaaaattaagaaacaggaaa

SEQ ID NO: 85733 - DNA, 20 bp, synthetic construct
  misc_feature 1..20: note = CRISPR gRNA sequence
  source 1..20: mol_type = other DNA
aattaagaaacaggaaaagg

SEQ ID NO: 85734 - DNA, 20 bp, synthetic construct
  misc_feature 1..20: note = CRISPR gRNA sequence
  source 1..20: mol_type = other DNA
attaagaaacaggaaaagga

SEQ ID NO: 85735 - DNA, 20 bp, synthetic construct
  misc_feature 1..20: note = CRISPR gRNA sequence
  source 1..20: mol_type = other DNA
taagaaacaggaaaaggaag

SEQ ID NO: 85736 - DNA, 20 bp, synthetic construct
  misc_feature 1..20: note = CRISPR gRNA sequence
  source 1..20: mol_type = other DNA
aaggagctccatctctaata

SEQ ID NO: 85737 - DNA, 20 bp, synthetic construct
  misc_feature 1..20: note = CRISPR gRNA sequence
  source 1..20: mol_type = other DNA
ggagctccatctctaatatg

SEQ ID NO: 85738 - DNA, 20 bp, synthetic construct
  misc_feature 1..20: note = CRISPR gRNA sequence
  source 1..20: mol_type = other DNA
gagctccatctctaatatgg

SEQ ID NO: 85739 - DNA, 20 bp, synthetic construct
  misc_feature 1..20: note = CRISPR gRNA sequence
  source 1..20: mol_type = other DNA
ctccatctctaatatggagg

SEQ ID NO: 85740 - DNA, 20 bp, synthetic construct
  misc_feature 1..20: note = CRISPR gRNA sequence
  source 1..20: mol_type = other DNA
ctaatatggaggtagaaaaa

SEQ ID NO: 85741 - DNA, 20 bp, synthetic construct
  misc_feature 1..20: note = CRISPR gRNA sequence
  source 1..20: mol_type = other DNA
taatatggaggtagaaaaaa

SEQ ID NO: 85742 - DNA, 20 bp, synthetic construct
  misc_feature 1..20: note = CRISPR gRNA sequence
  source 1..20: mol_type = other DNA
aatatggaggtagaaaaaaa

SEQ ID NO: 85743 - DNA, 20 bp, synthetic construct
  misc_feature 1..20: note = CRISPR gRNA sequence
  source 1..20: mol_type = other DNA
aaagggactatcatctaaat

SEQ ID NO: 85744 - DNA, 20 bp, synthetic construct
  misc_feature 1..20: note = CRISPR gRNA sequence
  source 1..20: mol_type = other DNA
ctatcatctaaatgagactg

SEQ ID NO: 85745 - DNA, 20 bp, synthetic construct
  misc_feature 1..20: note = CRISPR gRNA sequence
  source 1..20: mol_type = other DNA
atcatctaaatgagactgaa

SEQ ID NO: 85746 - DNA, 20 bp, synthetic construct
  misc_feature 1..20: note = CRISPR gRNA sequence
  source 1..20: mol_type = other DNA
aaatgagactgaagagtccc

SEQ ID NO: 85747 - DNA, 20 bp, synthetic construct
  misc_feature 1..20: note = CRISPR gRNA sequence
  source 1..20: mol_type = other DNA
atgagactgaagagtcccta

SEQ ID NO: 85748 - DNA, 20 bp, synthetic construct
  misc_feature 1..20: note = CRISPR gRNA sequence
  source 1..20: mol_type = other DNA
tgagactgaagagtccctag

SEQ ID NO: 85749 - DNA, 20 bp, synthetic construct
  misc_feature 1..20: note = CRISPR gRNA sequence
  source 1..20: mol_type = other DNA
agactgaagagtccctagag

SEQ ID NO: 85750 - DNA, 20 bp, synthetic construct
  misc_feature 1..20: note = CRISPR gRNA sequence
  source 1..20: mol_type = other DNA
gaagagtccctagaggagaa

SEQ ID NO: 85751 - DNA, 20 bp, synthetic construct
  misc_feature 1..20: note = CRISPR gRNA sequence
  source 1..20: mol_type = other DNA
gcttccctctccttccttct

SEQ ID NO: 85752 - DNA, 20 bp, synthetic construct
  misc_feature 1..20: note = CRISPR gRNA sequence
  source 1..20: mol_type = other DNA
cctctccttccttctgagac

SEQ ID NO: 85753 - DNA, 20 bp, synthetic construct
  misc_feature 1..20: note = CRISPR gRNA sequence
  source 1..20: mol_type = other DNA
ttccttctgagactagaaac

SEQ ID NO: 85754 - DNA, 20 bp, synthetic construct
  misc_feature 1..20: note = CRISPR gRNA sequence
  source 1..20: mol_type = other DNA
tccttctgagactagaaacg

SEQ ID NO: 85755 - DNA, 20 bp, synthetic construct
  misc_feature 1..20: note = CRISPR gRNA sequence
  source 1..20: mol_type = other DNA
tctgagactagaaacgagga

SEQ ID NO: 85756 - DNA, 20 bp, synthetic construct
  misc_feature 1..20: note = CRISPR gRNA sequence
  source 1..20: mol_type = other DNA
tgagactagaaacgaggaaa

SEQ ID NO: 85757 - DNA, 20 bp, synthetic construct
  misc_feature 1..20: note = CRISPR gRNA sequence
  source 1..20: mol_type = other DNA
gagactagaaacgaggaaag

SEQ ID NO: 85758 - DNA, 20 bp, synthetic construct
  misc_feature 1..20: note = CRISPR gRNA sequence
  source 1..20: mol_type = other DNA
agaaacgaggaaagaggcta

SEQ ID NO: 85759 - DNA, 20 bp, synthetic construct
  misc_feature 1..20: note = CRISPR gRNA sequence
  source 1..20: mol_type = other DNA
aagaggctacagcttgtatt

SEQ ID NO: 85760 - DNA, 20 bp, synthetic construct
  misc_feature 1..20: note = CRISPR gRNA sequence
  source 1..20: mol_type = other DNA
agaggctacagcttgtattg

SEQ ID NO: 85761 - DNA, 20 bp, synthetic construct
  misc_feature 1..20: note = CRISPR gRNA sequence
  source 1..20: mol_type = other DNA
gaggctacagcttgtattga

SEQ ID NO: 85762 - DNA, 20 bp, synthetic construct
  misc_feature 1..20: note = CRISPR gRNA sequence
  source 1..20: mol_type = other DNA
gcttgtattgagggaaatgc

SEQ ID NO: 85763 - DNA, 20 bp, synthetic construct
  misc_feature 1..20: note = CRISPR gRNA sequence
  source 1..20: mol_type = other DNA
attgagggaaatgcaagact

SEQ ID NO: 85764 - DNA, 20 bp, synthetic construct
  misc_feature 1..20: note = CRISPR gRNA sequence
  source 1..20: mol_type = other DNA
ttgagggaaatgcaagactg

SEQ ID NO: 85765 - DNA, 20 bp, synthetic construct
  misc_feature 1..20: note = CRISPR gRNA sequence
  source 1..20: mol_type = other DNA
gagggaaatgcaagactgag

SEQ ID NO: 85766 - DNA, 20 bp, synthetic construct
  misc_feature 1..20: note = CRISPR gRNA sequence
  source 1..20: mol_type = other DNA
aaatgcaagactgaggagaa

SEQ ID NO: 85767 - DNA, 20 bp, synthetic construct
  misc_feature 1..20: note = CRISPR gRNA sequence
  source 1..20: mol_type = other DNA
gcaagactgaggagaaaaga

SEQ ID NO: 85768 - DNA, 20 bp, synthetic construct
  misc_feature 1..20: note = CRISPR gRNA sequence
  source 1..20: mol_type = other DNA
agactgaggagaaaagaaag

SEQ ID NO: 85769 - DNA, 20 bp, synthetic construct
  misc_feature 1..20: note = CRISPR gRNA sequence
  source 1..20: mol_type = other DNA
gactgaggagaaaagaaagc

SEQ ID NO: 85770 - DNA, 20 bp, synthetic construct
  misc_feature 1..20: note = CRISPR gRNA sequence
  source 1..20: mol_type = other DNA
aggagaaaagaaagcaggtc

SEQ ID NO: 85771 - DNA, 20 bp, synthetic construct
  misc_feature 1..20: note = CRISPR gRNA sequence
  source 1..20: mol_type = other DNA
aggtctagctgatctcaact

SEQ ID NO: 85772 - DNA, 20 bp, synthetic construct
  misc_feature 1..20: note = CRISPR gRNA sequence
  source 1..20: mol_type = other DNA
ctagctgatctcaacttagc

SEQ ID NO: 85773 - DNA, 20 bp, synthetic construct
  misc_feature 1..20: note = CRISPR gRNA sequence
  source 1..20: mol_type = other DNA
tcaacttagcaagctaaaat

SEQ ID NO: 85774 - DNA, 20 bp, synthetic construct
  misc_feature 1..20: note = CRISPR gRNA sequence
  source 1..20: mol_type = other DNA
aacttagcaagctaaaataa

SEQ ID NO: 85775 - DNA, 20 bp, synthetic construct
  misc_feature 1..20: note = CRISPR gRNA sequence
  source 1..20: mol_type = other DNA
ttagcaagctaaaataagag

SEQ ID NO: 85776 - DNA, 20 bp, synthetic construct
  misc_feature 1..20: note = CRISPR gRNA sequence
  source 1..20: mol_type = other DNA
aagctaaaataagagtagcc

SEQ ID NO: 85777 - DNA, 20 bp, synthetic construct
  misc_feature 1..20: note = CRISPR gRNA sequence
  source 1..20: mol_type = other DNA
aaataagagtagcctggtgt

SEQ ID NO: 85778 - DNA, 20 bp, synthetic construct
  misc_feature 1..20: note = CRISPR gRNA sequence
  source 1..20: mol_type = other DNA
taagagtagcctggtgttag

SEQ ID NO: 85779 - DNA, 20 bp, synthetic construct
  misc_feature 1..20: note = CRISPR gRNA sequence
  source 1..20: mol_type = other DNA
cctggtgttagcggccaccc

SEQ ID NO: 85780 - DNA, 20 bp, synthetic construct
  misc_feature 1..20: note = CRISPR gRNA sequence
  source 1..20: mol_type = other DNA
cccaagcaactccctgctcc

SEQ ID NO: 85781 - DNA, 20 bp, synthetic construct
  misc_feature 1..20: note = CRISPR gRNA sequence
  source 1..20: mol_type = other DNA
ccctgctcctagtttccact

SEQ ID NO: 85782 - DNA, 20 bp, synthetic construct
  misc_feature 1..20: note = CRISPR gRNA sequence
  source 1..20: mol_type = other DNA
cctgctcctagtttccactt

SEQ ID NO: 85783 - DNA, 20 bp, synthetic construct
  misc_feature 1..20: note = CRISPR gRNA sequence
  source 1..20: mol_type = other DNA
ctgctcctagtttccacttg

SEQ ID NO: 85784 - DNA, 20 bp, synthetic construct
  misc_feature 1..20: note = CRISPR gRNA sequence
  source 1..20: mol_type = other DNA
ttggggaatccatgtgattt

SEQ ID NO: 85785 - DNA, 20 bp, synthetic construct
  misc_feature 1..20: note = CRISPR gRNA sequence
  source 1..20: mol_type = other DNA
tggggaatccatgtgatttt

SEQ ID NO: 85786 - DNA, 20 bp, synthetic construct
  misc_feature 1..20: note = CRISPR gRNA sequence
  source 1..20: mol_type = other DNA
ggggaatccatgtgattttg

SEQ ID NO: 85787 - DNA, 20 bp, synthetic construct
  misc_feature 1..20: note = CRISPR gRNA sequence
  source 1..20: mol_type = other DNA
ggaatccatgtgattttggg

SEQ ID NO: 85788 - DNA, 20 bp, synthetic construct
  misc_feature 1..20: note = CRISPR gRNA sequence
  source 1..20: mol_type = other DNA
gaatccatgtgattttgggg

SEQ ID NO: 85789 - DNA, 20 bp, synthetic construct
  misc_feature 1..20: note = CRISPR gRNA sequence
  source 1..20: mol_type = other DNA
gacccccacccttttcccca

SEQ ID NO: 85790 - DNA, 20 bp, synthetic construct
  misc_feature 1..20: note = CRISPR gRNA sequence
  source 1..20: mol_type = other DNA
acccccacccttttccccaa

SEQ ID NO: 85791 - DNA, 20 bp, synthetic construct
  misc_feature 1..20: note = CRISPR gRNA sequence
  source 1..20: mol_type = other DNA
caaaggtgttgtccatgata

SEQ ID NO: 85792 - DNA, 20 bp, synthetic construct
  misc_feature 1..20: note = CRISPR gRNA sequence
  source 1..20: mol_type = other DNA
tgttgtccatgatatagaat

SEQ ID NO: 85793 - DNA, 20 bp, synthetic construct
  misc_feature 1..20: note = CRISPR gRNA sequence
  source 1..20: mol_type = other DNA
atgatatagaataagcaaat

SEQ ID NO: 85794 - DNA, 20 bp, synthetic construct
  misc_feature 1..20: note = CRISPR gRNA sequence
  source 1..20: mol_type = other DNA
attagcatgtatcatcctcc

SEQ ID NO: 85795 - DNA, 20 bp, synthetic construct
  misc_feature 1..20: note = CRISPR gRNA sequence
  source 1..20: mol_type = other DNA
atgtatcatcctcctggcca

SEQ ID NO: 85796 - DNA, 20 bp, synthetic construct
  misc_feature 1..20: note = CRISPR gRNA sequence
  source 1..20: mol_type = other DNA
atcctcctggccacagtgat

SEQ ID NO: 85797 - DNA, 20 bp, synthetic construct
  misc_feature 1..20: note = CRISPR gRNA sequence
  source 1..20: mol_type = other DNA
tcctggccacagtgattggt

SEQ ID NO: 85798 - DNA, 20 bp, synthetic construct
  misc_feature 1..20: note = CRISPR gRNA sequence
  source 1..20: mol_type = other DNA
cctggccacagtgattggtc

SEQ ID NO: 85799 - DNA, 20 bp, synthetic construct
  misc_feature 1..20: note = CRISPR gRNA sequence
  source 1..20: mol_type = other DNA
ctggccacagtgattggtca

SEQ ID NO: 85800 - DNA, 20 bp, synthetic construct
  misc_feature 1..20: note = CRISPR gRNA sequence
  source 1..20: mol_type = other DNA
gccacagtgattggtcaggg

SEQ ID NO: 85801 - DNA, 20 bp, synthetic construct
  misc_feature 1..20: note = CRISPR gRNA sequence
  source 1..20: mol_type = other DNA
gtcagggtggacatgtgacc

SEQ ID NO: 85802 - DNA, 20 bp, synthetic construct
  misc_feature 1..20: note = CRISPR gRNA sequence
  source 1..20: mol_type = other DNA
tcagggtggacatgtgaccc

SEQ ID NO: 85803 - DNA, 20 bp, synthetic construct
  misc_feature 1..20: note = CRISPR gRNA sequence
  source 1..20: mol_type = other DNA
acatgtgacccaggcctaat

SEQ ID NO: 85804 - DNA, 20 bp, synthetic construct
  misc_feature 1..20: note = CRISPR gRNA sequence
  source 1..20: mol_type = other DNA
ggcctaatcagtgtgaatat

SEQ ID NO: 85805 - DNA, 20 bp, synthetic construct
  misc_feature 1..20: note = CRISPR gRNA sequence
  source 1..20: mol_type = other DNA
gcctaatcagtgtgaatatt

SEQ ID NO: 85806 - DNA, 20 bp, synthetic construct
  misc_feature 1..20: note = CRISPR gRNA sequence
  source 1..20: mol_type = other DNA
cctaatcagtgtgaatatta

SEQ ID NO: 85807 - DNA, 20 bp, synthetic construct
  misc_feature 1..20: note = CRISPR gRNA sequence
  source 1..20: mol_type = other DNA
tgaatattagggcttttgct

SEQ ID NO: 85808 - DNA, 20 bp, synthetic construct
  misc_feature 1..20: note = CRISPR gRNA sequence
  source 1..20: mol_type = other DNA
agggcttttgctgagatttc

SEQ ID NO: 85809 - DNA, 20 bp, synthetic construct
  misc_feature 1..20: note = CRISPR gRNA sequence
  source 1..20: mol_type = other DNA
ttgctgagatttctggtaca

SEQ ID NO: 85810 - DNA, 20 bp, synthetic construct
  misc_feature 1..20: note = CRISPR gRNA sequence
  source 1..20: mol_type = other DNA
agatgccttctttttctgat

SEQ ID NO: 85811 - DNA, 20 bp, synthetic construct
  misc_feature 1..20: note = CRISPR gRNA sequence
  source 1..20: mol_type = other DNA
tttttctgattggacataaa

SEQ ID NO: 85812 - DNA, 20 bp, synthetic construct
  misc_feature 1..20: note = CRISPR gRNA sequence
  source 1..20: mol_type = other DNA
ttttctgattggacataaat

SEQ ID NO: 85813 - DNA, 20 bp, synthetic construct
  misc_feature 1..20: note = CRISPR gRNA sequence
  source 1..20: mol_type = other DNA
tttctgattggacataaatg

SEQ ID NO: 85814 - DNA, 20 bp, synthetic construct
  misc_feature 1..20: note = CRISPR gRNA sequence
  source 1..20: mol_type = other DNA
gattggacataaatggggaa

SEQ ID NO: 85815 - DNA, 20 bp, synthetic construct
  misc_feature 1..20: note = CRISPR gRNA sequence
  source 1..20: mol_type = other DNA
aatggggaaaagtgtaatct

SEQ ID NO: 85816 - DNA, 20 bp, synthetic construct
  misc_feature 1..20: note = CRISPR gRNA sequence
  source 1..20: mol_type = other DNA
atggggaaaagtgtaatctt

SEQ ID NO: 85817 - DNA, 20 bp, synthetic construct
  misc_feature 1..20: note = CRISPR gRNA sequence
  source 1..20: mol_type = other DNA
aagtgtaatcttaggaatgc

SEQ ID NO: 85818 - DNA, 20 bp, synthetic construct
  misc_feature 1..20: note = CRISPR gRNA sequence
  source 1..20: mol_type = other DNA
tgtaatcttaggaatgctgg

SEQ ID NO: 85819 - DNA, 20 bp, synthetic construct
  misc_feature 1..20: note = CRISPR gRNA sequence
  source 1..20: mol_type = other DNA
taggaatgctggcagccatt

SEQ ID NO: 85820 - DNA, 20 bp, synthetic construct
  misc_feature 1..20: note = CRISPR gRNA sequence
  source 1..20: mol_type = other DNA
gaatgctggcagccattaag

SEQ ID NO: 85821 - DNA, 20 bp, synthetic construct
  misc_feature 1..20: note = CRISPR gRNA sequence
  source 1..20: mol_type = other DNA
ctggcagccattaagtggcc

SEQ ID NO: 85822 - DNA, 20 bp, synthetic construct
  misc_feature 1..20: note = CRISPR gRNA sequence
  source 1..20: mol_type = other DNA
ttaagtggcccagacttaaa

SEQ ID NO: 85823 - DNA, 20 bp, synthetic construct
  misc_feature 1..20: note = CRISPR gRNA sequence
  source 1..20: mol_type = other DNA
cccagacttaaatggtccta

SEQ ID NO: 85824 - DNA, 20 bp, synthetic construct
  misc_feature 1..20: note = CRISPR gRNA sequence
  source 1..20: mol_type = other DNA
agacttaaatggtcctacag

SEQ ID NO: 85825 - DNA, 20 bp, synthetic construct
  misc_feature 1..20: note = CRISPR gRNA sequence
  source 1..20: mol_type = other DNA
tggtcctacagaagatgcaa

SEQ ID NO: 85826 - DNA, 20 bp, synthetic construct
  misc_feature 1..20: note = CRISPR gRNA sequence
  source 1..20: mol_type = other DNA
cctacagaagatgcaacagt

SEQ ID NO: 85827 - DNA, 20 bp, synthetic construct
  misc_feature 1..20: note = CRISPR gRNA sequence
  source 1..20: mol_type = other DNA
aagatgcaacagtgagaaaa

SEQ ID NO: 85828 - DNA, 20 bp, synthetic construct
  misc_feature 1..20: note = CRISPR gRNA sequence
  source 1..20: mol_type = other DNA
tgcaacagtgagaaaaaagt

SEQ ID NO: 85829 - DNA, 20 bp, synthetic construct
  misc_feature 1..20: note = CRISPR gRNA sequence
  source 1..20: mol_type = other DNA
cagtgagaaaaaagtcagtc

SEQ ID NO: 85830 - DNA, 20 bp, synthetic construct
  misc_feature 1..20: note = CRISPR gRNA sequence
  source 1..20: mol_type = other DNA
aaaaaagtcagtccggtatt

SEQ ID NO: 85831 - DNA, 20 bp, synthetic construct
  misc_feature 1..20: note = CRISPR gRNA sequence
  source 1..20: mol_type = other DNA
aaaagtcagtccggtattta

SEQ ID NO: 85832 - DNA, 20 bp, synthetic construct
  misc_feature 1..20: note = CRISPR gRNA sequence
  source 1..20: mol_type = other DNA
ttagagacatactgaactac

SEQ ID NO: 85833 - DNA, 20 bp, synthetic construct
  misc_feature 1..20: note = CRISPR gRNA sequence
  source 1..20: mol_type = other DNA
tagagacatactgaactact

SEQ ID NO: 85834 - DNA, 20 bp, synthetic construct
  misc_feature 1..20: note = CRISPR gRNA sequence
  source 1..20: mol_type = other DNA
acatactgaactactgggtc

SEQ ID NO: 85835 - DNA, 20 bp, synthetic construct
  misc_feature 1..20: note = CRISPR gRNA sequence
  source 1..20: mol_type = other DNA
tactgggtcaagtcttcacc

SEQ ID NO: 85836 - DNA, 20 bp, synthetic construct
  misc_feature 1..20: note = CRISPR gRNA sequence
  source 1..20: mol_type = other DNA
ctgggtcaagtcttcacctg

SEQ ID NO: 85837 - DNA, 20 bp, synthetic construct
  misc_feature 1..20: note = CRISPR gRNA sequence
  source 1..20: mol_type = other DNA
gtcaagtcttcacctggagc

SEQ ID NO: 85838 - DNA, 20 bp, synthetic construct
  misc_feature 1..20: note = CRISPR gRNA sequence
  source 1..20: mol_type = other DNA
cctggagccagcactaccta

SEQ ID NO: 85839 - DNA, 20 bp, synthetic construct
  misc_feature 1..20: note = CRISPR gRNA sequence
  source 1..20: mol_type = other DNA
agcactacctatggactttc

SEQ ID NO: 85840 - DNA, 20 bp, synthetic construct
  misc_feature 1..20: note = CRISPR gRNA sequence
  source 1..20: mol_type = other DNA
caataaatcctttttatttt

SEQ ID NO: 85841 - DNA, 20 bp, synthetic construct
  misc_feature 1..20: note = CRISPR gRNA sequence
  source 1..20: mol_type = other DNA
aaatcctttttattttaagc

SEQ ID NO: 85842 - DNA, 20 bp, synthetic construct
  misc_feature 1..20: note = CRISPR gRNA sequence
  source 1..20: mol_type = other DNA
tattttaagccagtttgaat

SEQ ID NO: 85843 - DNA, 20 bp, synthetic construct
  misc_feature 1..20: note = CRISPR gRNA sequence
  source 1..20: mol_type = other DNA
attttaagccagtttgaatt

SEQ ID NO: 85844 - DNA, 20 bp, synthetic construct
  misc_feature 1..20: note = CRISPR gRNA sequence
  source 1..20: mol_type = other DNA
tttctgtgatttaaaaccaa

SEQ ID NO: 85845 - DNA, 20 bp, synthetic construct
  misc_feature 1..20: note = CRISPR gRNA sequence
  source 1..20: mol_type = other DNA
acctatatattcatcatact

SEQ ID NO: 85846 - DNA, 20 bp, synthetic construct
  misc_feature 1..20: note = CRISPR gRNA sequence
  source 1..20: mol_type = other DNA
agcccattcctaccttccca

SEQ ID NO: 85847 - DNA, 20 bp, synthetic construct
  misc_feature 1..20: note = CRISPR gRNA sequence
  source 1..20: mol_type = other DNA
gcccattcctaccttcccac

SEQ ID NO: 85848 - DNA, 20 bp, synthetic construct
  misc_feature 1..20: note = CRISPR gRNA sequence
  source 1..20: mol_type = other DNA
attcctaccttcccacagga

SEQ ID NO: 85849 - DNA, 20 bp, synthetic construct
  misc_feature 1..20: note = CRISPR gRNA sequence
  source 1..20: mol_type = other DNA
taccttcccacaggatagca

SEQ ID NO: 85850 - DNA, 20 bp, synthetic construct
  misc_feature 1..20: note = CRISPR gRNA sequence
  source 1..20: mol_type = other DNA
accttcccacaggatagcac

SEQ ID NO: 85851 - DNA, 20 bp, synthetic construct
  misc_feature 1..20: note = CRISPR gRNA sequence
  source 1..20: mol_type = other DNA
ccttcccacaggatagcaca

SEQ ID NO: 85852 - DNA, 20 bp, synthetic construct
  misc_feature 1..20: note = CRISPR gRNA sequence
  source 1..20: mol_type = other DNA
acaggatagcacagggaata

SEQ ID NO: 85853 - DNA, 20 bp, synthetic construct
  misc_feature 1..20: note = CRISPR gRNA sequence
  source 1..20: mol_type = other DNA
caggatagcacagggaatac

SEQ ID NO: 85854 - DNA, 20 bp, synthetic construct
  misc_feature 1..20: note = CRISPR gRNA sequence
  source 1..20: mol_type = other DNA
atagcacagggaatacaggt

SEQ ID NO: 85855 - DNA, 20 bp, synthetic construct
  misc_feature 1..20: note = CRISPR gRNA sequence
  source 1..20: mol_type = other DNA
tagcacagggaatacaggta

SEQ ID NO: 85856 - DNA, 20 bp, synthetic construct
  misc_feature 1..20: note = CRISPR gRNA sequence
  source 1..20: mol_type = other DNA
gaatacaggtaaggtcacta

SEQ ID NO: 85857 - DNA, 20 bp, synthetic construct
  misc_feature 1..20: note = CRISPR gRNA sequence
  source 1..20: mol_type = other DNA
taaggtcactacagatttat

SEQ ID NO: 85858 - DNA, 20 bp, synthetic construct
  misc_feature 1..20: note = CRISPR gRNA sequence
  source 1..20: mol_type = other DNA
cagatttattggttacacta

SEQ ID NO: 85859 - DNA, 20 bp, synthetic construct
  misc_feature 1..20: note = CRISPR gRNA sequence
  source 1..20: mol_type = other DNA
ttattggttacactaaagcc

SEQ ID NO: 85860 - DNA, 20 bp, synthetic construct
  misc_feature 1..20: note = CRISPR gRNA sequence
  source 1..20: mol_type = other DNA
tattggttacactaaagccc

SEQ ID NO: 85861 - DNA, 20 bp, synthetic construct
  misc_feature 1..20: note = CRISPR gRNA sequence
  source 1..20: mol_type = other DNA
attggttacactaaagccca

SEQ ID NO: 85862 - DNA, 20 bp, synthetic construct
  misc_feature 1..20: note = CRISPR gRNA sequence
  source 1..20: mol_type = other DNA
acactaaagcccagggtatc

SEQ ID NO: 85863 - DNA, 20 bp, synthetic construct
  misc_feature 1..20: note = CRISPR gRNA sequence
  source 1..20: mol_type = other DNA
gcccagggtatcaagctgaa

SEQ ID NO: 85864 - DNA, 20 bp, synthetic construct
  misc_feature 1..20: note = CRISPR gRNA sequence
  source 1..20: mol_type = other DNA
cccagggtatcaagctgaaa

SEQ ID NO: 85865 - DNA, 20 bp, synthetic construct
  misc_feature 1..20: note = CRISPR gRNA sequence
  source 1..20: mol_type = other DNA
gggtatcaagctgaaaaggt

SEQ ID NO: 85866 - DNA, 20 bp, synthetic construct
  misc_feature 1..20: note = CRISPR gRNA sequence
  source 1..20: mol_type = other DNA
gtatcaagctgaaaaggtca

SEQ ID NO: 85867 - DNA, 20 bp, synthetic construct
  misc_feature 1..20: note = CRISPR gRNA sequence
  source 1..20: mol_type = other DNA
tatcaagctgaaaaggtcag

SEQ ID NO: 85868 - DNA, 20 bp, synthetic construct
  misc_feature 1..20: note = CRISPR gRNA sequence
  source 1..20: mol_type = other DNA
caagctgaaaaggtcagagg

SEQ ID NO: 85869 - DNA, 20 bp, synthetic construct
  misc_feature 1..20: note = CRISPR gRNA sequence
  source 1..20: mol_type = other DNA
aaaaggtcagaggcagcaac

SEQ ID NO: 85870 - DNA, 20 bp, synthetic construct
  misc_feature 1..20: note = CRISPR gRNA sequence
  source 1..20: mol_type = other DNA
aaaggtcagaggcagcaacc

SEQ ID NO: 85871 - DNA, 20 bp, synthetic construct
  misc_feature 1..20: note = CRISPR gRNA sequence
  source 1..20: mol_type = other DNA
agaggcagcaaccaggtact

SEQ ID NO: 85872 - DNA, 20 bp, synthetic construct
  misc_feature 1..20: note = CRISPR gRNA sequence
  source 1..20: mol_type = other DNA
ggcagcaaccaggtactaag

SEQ ID NO: 85873 - DNA, 20 bp, synthetic construct
  misc_feature 1..20: note = CRISPR gRNA sequence
  source 1..20: mol_type = other DNA
caaccaggtactaagtagac

SEQ ID NO: 85874 - DNA, 20 bp, synthetic construct
  misc_feature 1..20: note = CRISPR gRNA sequence
  source 1..20: mol_type = other DNA
aaccaggtactaagtagact

SEQ ID NO: 85875 - DNA, 20 bp, synthetic construct
  misc_feature 1..20: note = CRISPR gRNA sequence
  source 1..20: mol_type = other DNA
actaagtagactgggtgact

SEQ ID NO: 85876 - DNA, 20 bp, synthetic construct
  misc_feature 1..20: note = CRISPR gRNA sequence
  source 1..20: mol_type = other DNA
gggtgactcagctgtctgta

SEQ ID NO: 85877 - DNA, 20 bp, synthetic construct
  misc_feature 1..20: note = CRISPR gRNA sequence
  source 1..20: mol_type = other DNA
gtgactcagctgtctgtaca

SEQ ID NO: 85878 - DNA, 20 bp, synthetic construct
  misc_feature 1..20: note = CRISPR gRNA sequence
  source 1..20: mol_type = other DNA
tgactcagctgtctgtacag

SEQ ID NO: 85879 - DNA, 20 bp, synthetic construct
  misc_feature 1..20: note = CRISPR gRNA sequence
  source 1..20: mol_type = other DNA
actcagctgtctgtacagag

SEQ ID NO: 85880 - DNA, 20 bp, synthetic construct
  misc_feature 1..20: note = CRISPR gRNA sequence
  source 1..20: mol_type = other DNA
gctgtctgtacagaggagaa

SEQ ID NO: 85881 - DNA, 20 bp, synthetic construct
  misc_feature 1..20: note = CRISPR gRNA sequence
  source 1..20: mol_type = other DNA
cagaggagaatggacttcct

SEQ ID NO: 85882 - DNA, 20 bp, synthetic construct
  misc_feature 1..20: note = CRISPR gRNA sequence
  source 1..20: mol_type = other DNA
agaggagaatggacttcctt

SEQ ID NO: 85883 - DNA, 20 bp, synthetic construct
  misc_feature 1..20: note = CRISPR gRNA sequence
  source 1..20: mol_type = other DNA
agaatggacttccttaggaa

SEQ ID NO: 85884 - DNA, 20 bp, synthetic construct
  misc_feature 1..20: note = CRISPR gRNA sequence
  source 1..20: mol_type = other DNA
ggacttccttaggaaaagaa

SEQ ID NO: 85885 - DNA, 20 bp, synthetic construct
  misc_feature 1..20: note = CRISPR gRNA sequence
  source 1..20: mol_type = other DNA
taggaaaagaatagccaaat

SEQ ID NO: 85886 - DNA, 20 bp, synthetic construct
  misc_feature 1..20: note = CRISPR gRNA sequence
  source 1..20: mol_type = other DNA
gaaaagaatagccaaatgag

SEQ ID NO: 85887 - DNA, 20 bp, synthetic construct
  misc_feature 1..20: note = CRISPR gRNA sequence
  source 1..20: mol_type = other DNA
agaatagccaaatgagaagc

SEQ ID NO: 85888 - DNA, 20 bp, synthetic construct
  misc_feature 1..20: note = CRISPR gRNA sequence
  source 1..20: mol_type = other DNA
ccaaatgagaagcaagtgca

SEQ ID NO: 85889 - DNA, 20 bp, synthetic construct
  misc_feature 1..20: note = CRISPR gRNA sequence
  source 1..20: mol_type = other DNA
aatgagaagcaagtgcaaag

SEQ ID NO: 85890 - DNA, 20 bp, synthetic construct
  misc_feature 1..20: note = CRISPR gRNA sequence
  source 1..20: mol_type = other DNA
atgagaagcaagtgcaaaga

SEQ ID NO: 85891 - DNA, 20 bp, synthetic construct
  misc_feature 1..20: note = CRISPR gRNA sequence
  source 1..20: mol_type = other DNA
tgagaagcaagtgcaaagaa

SEQ ID NO: 85892 - DNA, 20 bp, synthetic construct
  misc_feature 1..20: note = CRISPR gRNA sequence
  source 1..20: mol_type = other DNA
gtgcaaagaagggcctctac

SEQ ID NO: 85893 - DNA, 20 bp, synthetic construct
  misc_feature 1..20: note = CRISPR gRNA sequence
  source 1..20: mol_type = other DNA
tgcaaagaagggcctctact

SEQ ID NO: 85894 - DNA, 20 bp, synthetic construct
  misc_feature 1..20: note = CRISPR gRNA sequence
  source 1..20: mol_type = other DNA
agaagggcctctactaggca

SEQ ID NO: 85895 - DNA, 20 bp, synthetic construct
  misc_feature 1..20: note = CRISPR gRNA sequence
  source 1..20: mol_type = other DNA
tctactaggcaaagttaacg

SEQ ID NO: 85896 - DNA, 20 bp, synthetic construct
  misc_feature 1..20: note = CRISPR gRNA sequence
  source 1..20: mol_type = other DNA
ctactaggcaaagttaacgt

SEQ ID NO: 85897 - DNA, 20 bp, synthetic construct
  misc_feature 1..20: note = CRISPR gRNA sequence
  source 1..20: mol_type = other DNA
tactaggcaaagttaacgta

SEQ ID NO: 85898 - DNA, 20 bp, synthetic construct
  misc_feature 1..20: note = CRISPR gRNA sequence
  source 1..20: mol_type = other DNA
gatataaacactcttcccca

SEQ ID NO: 85899 - DNA, 20 bp, synthetic construct
  misc_feature 1..20: note = CRISPR gRNA sequence
  source 1..20: mol_type = other DNA
ttccccacagacctgtatca

SEQ ID NO: 85900 - DNA, 20 bp, synthetic construct
  misc_feature 1..20: note = CRISPR gRNA sequence
  source 1..20: mol_type = other DNA
tccccacagacctgtatcat

SEQ ID NO: 85901 - DNA, 20 bp, synthetic construct
  misc_feature 1..20: note = CRISPR gRNA sequence
  source 1..20: mol_type = other DNA
ccccacagacctgtatcatg

SEQ ID NO: 85902 - DNA, 20 bp, synthetic construct
  misc_feature 1..20: note = CRISPR gRNA sequence
  source 1..20: mol_type = other DNA
cccacagacctgtatcatgg

SEQ ID NO: 85903 - DNA, 20 bp, synthetic construct
  misc_feature 1..20: note = CRISPR gRNA sequence
  source 1..20: mol_type = other DNA
tatcatgggggtgttgcttt

SEQ ID NO: 85904 - DNA, 20 bp, synthetic construct
  misc_feature 1..20: note = CRISPR gRNA sequence
  source 1..20: mol_type = other DNA
atcatgggggtgttgctttt

SEQ ID NO: 85905 - DNA, 20 bp, synthetic construct
  misc_feature 1..20: note = CRISPR gRNA sequence
  source 1..20: mol_type = other DNA
cttttgggtctttatgctcc

SEQ ID NO: 85906 - DNA, 20 bp, synthetic construct
  misc_feature 1..20: note = CRISPR gRNA sequence
  source 1..20: mol_type = other DNA
ttttgggtctttatgctcct

SEQ ID NO: 85907 - DNA, 20 bp, synthetic construct
  misc_feature 1..20: note = CRISPR gRNA sequence
  source 1..20: mol_type = other DNA
ggtctttatgctcctgggat

SEQ ID NO: 85908 - DNA, 20 bp, synthetic construct
  misc_feature 1..20: note = CRISPR gRNA sequence
  source 1..20: mol_type = other DNA
gtctttatgctcctgggata

SEQ ID NO: 85909 - DNA, 20 bp, synthetic construct
  misc_feature 1..20: note = CRISPR gRNA sequence
  source 1..20: mol_type = other DNA
tcctgggataaggaactttg

SEQ ID NO: 85910 - DNA, 20 bp, synthetic construct
  misc_feature 1..20: note = CRISPR gRNA sequence
  source 1..20: mol_type = other DNA
tttgaagcacatgctccttt

SEQ ID NO: 85911 - DNA, 20 bp, synthetic construct
  misc_feature 1..20: note = CRISPR gRNA sequence
  source 1..20: mol_type = other DNA
tttaagtctttattaccctg

SEQ ID NO: 85912 - DNA, 20 bp, synthetic construct
  misc_feature 1..20: note = CRISPR gRNA sequence
  source 1..20: mol_type = other DNA
gtctttattaccctgtggtg

SEQ ID NO: 85913 - DNA, 20 bp, synthetic construct
  misc_feature 1..20: note = CRISPR gRNA sequence
  source 1..20: mol_type = other DNA
gtctacctctccctttgcca

SEQ ID NO: 85914 - DNA, 20 bp, synthetic construct
  misc_feature 1..20: note = CRISPR gRNA sequence
  source 1..20: mol_type = other DNA
tctacctctccctttgccaa

SEQ ID NO: 85915 - DNA, 20 bp, synthetic construct
  misc_feature 1..20: note = CRISPR gRNA sequence
  source 1..20: mol_type = other DNA
ctctccctttgccaaaggaa

SEQ ID NO: 85916 - DNA, 20 bp, synthetic construct
  misc_feature 1..20: note = CRISPR gRNA sequence
  source 1..20: mol_type = other DNA
ccaaaggaaaagcctccttt

SEQ ID NO: 85917 - DNA, 20 bp, synthetic construct
  misc_feature 1..20: note = CRISPR gRNA sequence
  source 1..20: mol_type = other DNA
ccttgatgacactcactttt

SEQ ID NO: 85918 - DNA, 20 bp, synthetic construct
  misc_feature 1..20: note = CRISPR gRNA sequence
  source 1..20: mol_type = other DNA
cttgatgacactcacttttg

SEQ ID NO: 85919 - DNA, 20 bp, synthetic construct
  misc_feature 1..20: note = CRISPR gRNA sequence
  source 1..20: mol_type = other DNA
ttgatgacactcacttttga

SEQ ID NO: 85920 - DNA, 20 bp, synthetic construct
  misc_feature 1..20: note = CRISPR gRNA sequence
  source 1..20: mol_type = other DNA
tgatgacactcacttttgag

SEQ ID NO: 85921 - DNA, 20 bp, synthetic construct
  misc_feature 1..20: note = CRISPR gRNA sequence
  source 1..20: mol_type = other DNA
cactcacttttgaggggacc

SEQ ID NO: 85922 - DNA, 20 bp, synthetic construct
  misc_feature 1..20: note = CRISPR gRNA sequence
  source 1..20: mol_type = other DNA
actcacttttgaggggacca

SEQ ID NO: 85923 - DNA, 20 bp, synthetic construct
  misc_feature 1..20: note = CRISPR gRNA sequence
  source 1..20: mol_type = other DNA
ctcacttttgaggggaccaa

SEQ ID NO: 85924 - DNA, 20 bp, synthetic construct
  misc_feature 1..20: note = CRISPR gRNA sequence
  source 1..20: mol_type = other DNA
aattttatcttctgcttctt

SEQ ID NO: 85925 - DNA, 20 bp, synthetic construct
  misc_feature 1..20: note = CRISPR gRNA sequence
  source 1..20: mol_type = other DNA
cttctgcttctttggtatgc

SEQ ID NO: 85926 - DNA, 20 bp, synthetic construct
  misc_feature 1..20: note = CRISPR gRNA sequence
  source 1..20: mol_type = other DNA
ttctgcttctttggtatgct

SEQ ID NO: 85927 - DNA, 20 bp, synthetic construct
  misc_feature 1..20: note = CRISPR gRNA sequence
  source 1..20: mol_type = other DNA
ttctttggtatgctgggaac

SEQ ID NO: 85928 - DNA, 20 bp, synthetic construct
  misc_feature 1..20: note = CRISPR gRNA sequence
  source 1..20: mol_type = other DNA
tctttggtatgctgggaacc

SEQ ID NO: 85929 - DNA, 20 bp, synthetic construct
  misc_feature 1..20: note = CRISPR gRNA sequence
  source 1..20: mol_type = other DNA
ctttggtatgctgggaaccg

SEQ ID NO: 85930 - DNA, 20 bp, synthetic construct
  misc_feature 1..20: note = CRISPR gRNA sequence
  source 1..20: mol_type = other DNA
accggggccccttcctcctt

SEQ ID NO: 85931 - DNA, 20 bp, synthetic construct
  misc_feature 1..20: note = CRISPR gRNA sequence
  source 1..20: mol_type = other DNA
gccccttcctcctttggaaa

SEQ ID NO: 85932 - DNA, 20 bp, synthetic construct
  misc_feature 1..20: note = CRISPR gRNA sequence
  source 1..20: mol_type = other DNA
cagtaccatctccctgaccc

SEQ ID NO: 85933 - DNA, 20 bp, synthetic construct
  misc_feature 1..20: note = CRISPR gRNA sequence
  source 1..20: mol_type = other DNA
agtaccatctccctgaccct

SEQ ID NO: 85934 - DNA, 20 bp, synthetic construct
  misc_feature 1..20: note = CRISPR gRNA sequence
  source 1..20: mol_type = other DNA
ccatctccctgaccctgggc

SEQ ID NO: 85935 - DNA, 20 bp, synthetic construct
  misc_feature 1..20: note = CRISPR gRNA sequence
  source 1..20: mol_type = other DNA
ggcaagtactgccccctttt

SEQ ID NO: 85936 - DNA, 20 bp, synthetic construct
  misc_feature 1..20: note = CRISPR gRNA sequence
  source 1..20: mol_type = other DNA
cccttttcagcctctcccat

SEQ ID NO: 85937 - DNA, 20 bp, synthetic construct
  misc_feature 1..20: note = CRISPR gRNA sequence
  source 1..20: mol_type = other DNA
tcagcctctcccattggccc

SEQ ID NO: 85938 - DNA, 20 bp, synthetic construct
  misc_feature 1..20: note = CRISPR gRNA sequence
  source 1..20: mol_type = other DNA
ccctggcctctctgcccctc

SEQ ID NO: 85939 - DNA, 20 bp, synthetic construct
  misc_feature 1..20: note = CRISPR gRNA sequence
  source 1..20: mol_type = other DNA
gcctctctgcccctccagct

SEQ ID NO: 85940 - DNA, 20 bp, synthetic construct
  misc_feature 1..20: note = CRISPR gRNA sequence
  source 1..20: mol_type = other DNA
ctgagttgccttcccctcct

SEQ ID NO: 85941 - DNA, 20 bp, synthetic construct
  misc_feature 1..20: note = CRISPR gRNA sequence
  source 1..20: mol_type = other DNA
cctgagccccatgtctccca

SEQ ID NO: 85942 - DNA, 20 bp, synthetic construct
  misc_feature 1..20: note = CRISPR gRNA sequence
  source 1..20: mol_type = other DNA
atgtctcccatggtaacctt

SEQ ID NO: 85943 - DNA, 20 bp, synthetic construct
  misc_feature 1..20: note = CRISPR gRNA sequence
  source 1..20: mol_type = other DNA
tgtctcccatggtaaccttg

SEQ ID NO: 85944 - DNA, 20 bp, synthetic construct
  misc_feature 1..20: note = CRISPR gRNA sequence
  source 1..20: mol_type = other DNA
cccatggtaaccttgaggac

SEQ ID NO: 85945 - DNA, 20 bp, synthetic construct
  misc_feature 1..20: note = CRISPR gRNA sequence
  source 1..20: mol_type = other DNA
ccatggtaaccttgaggact

SEQ ID NO: 85946 - DNA, 20 bp, synthetic construct
  misc_feature 1..20: note = CRISPR gRNA sequence
  source 1..20: mol_type = other DNA
tggtaaccttgaggactggg

SEQ ID NO: 85947 - DNA, 20 bp, synthetic construct
  misc_feature 1..20: note = CRISPR gRNA sequence
  source 1..20: mol_type = other DNA
tgaggactgggcagattcca

SEQ ID NO: 85948 - DNA, 20 bp, synthetic construct
  misc_feature 1..20: note = CRISPR gRNA sequence
  source 1..20: mol_type = other DNA
ggactgggcagattccatgg

SEQ ID NO: 85949 - DNA, 20 bp, synthetic construct
  misc_feature 1..20: note = CRISPR gRNA sequence
  source 1..20: mol_type = other DNA
tccatggcagctgctgactt

SEQ ID NO: 85950 - DNA, 20 bp, synthetic construct
  misc_feature 1..20: note = CRISPR gRNA sequence
  source 1..20: mol_type = other DNA
catggcagctgctgacttga

SEQ ID NO: 85951 - DNA, 20 bp, synthetic construct
  misc_feature 1..20: note = CRISPR gRNA sequence
  source 1..20: mol_type = other DNA
atggcagctgctgacttgag

SEQ ID NO: 85952 - DNA, 20 bp, synthetic construct
  misc_feature 1..20: note = CRISPR gRNA sequence
  source 1..20: mol_type = other DNA
tggcagctgctgacttgaga

SEQ ID NO: 85953 - DNA, 20 bp, synthetic construct
  misc_feature 1..20: note = CRISPR gRNA sequence
  source 1..20: mol_type = other DNA
ggcagctgctgacttgagag

SEQ ID NO: 85954 - DNA, 20 bp, synthetic construct
  misc_feature 1..20: note = CRISPR gRNA sequence
  source 1..20: mol_type = other DNA
agctgctgacttgagagggg

SEQ ID NO: 85955 - DNA, 20 bp, synthetic construct
  misc_feature 1..20: note = CRISPR gRNA sequence
  source 1..20: mol_type = other DNA
acttccacctgacttttttc

SEQ ID NO: 85956 - DNA, 20 bp, synthetic construct
  misc_feature 1..20: note = CRISPR gRNA sequence
  source 1..20: mol_type = other DNA
cttccacctgacttttttcg

SEQ ID NO: 85957 - DNA, 20 bp, synthetic construct
  misc_feature 1..20: note = CRISPR gRNA sequence
  source 1..20: mol_type = other DNA
ttccacctgacttttttcga

SEQ ID NO: 85958 - DNA, 20 bp, synthetic construct
  misc_feature 1..20: note = CRISPR gRNA sequence
  source 1..20: mol_type = other DNA
agggcgcccccgtttccttt

SEQ ID NO: 85959 - DNA, 20 bp, synthetic construct
  misc_feature 1..20: note = CRISPR gRNA sequence
  source 1..20: mol_type = other DNA
tatatcctgctttgctgctt

SEQ ID NO: 85960 - DNA, 20 bp, synthetic construct
  misc_feature 1..20: note = CRISPR gRNA sequence
  source 1..20: mol_type = other DNA
tcctgctttgctgctttagc

SEQ ID NO: 85961 - DNA, 20 bp, synthetic construct
  misc_feature 1..20: note = CRISPR gRNA sequence
  source 1..20: mol_type = other DNA
tgctttgctgctttagctgg

SEQ ID NO: 85962 - DNA, 20 bp, synthetic construct
  misc_feature 1..20: note = CRISPR gRNA sequence
  source 1..20: mol_type = other DNA
ctttgctgctttagctggtg

SEQ ID NO: 85963 - DNA, 20 bp, synthetic construct
  misc_feature 1..20: note = CRISPR gRNA sequence
  source 1..20: mol_type = other DNA
agctggtggagcctgcccac

SEQ ID NO: 85964 - DNA, 20 bp, synthetic construct
  misc_feature 1..20: note = CRISPR gRNA sequence
  source 1..20: mol_type = other DNA
ctgcccactggcctcactca

SEQ ID NO: 85965 - DNA, 20 bp, synthetic construct
  misc_feature 1..20: note = CRISPR gRNA sequence
  source 1..20: mol_type = other DNA
tgcccactggcctcactcac

SEQ ID NO: 85966 - DNA, 20 bp, synthetic construct
  misc_feature 1..20: note = CRISPR gRNA sequence
  source 1..20: mol_type = other DNA
ggcctcactcacaggtactt

SEQ ID NO: 85967 - DNA, 20 bp, synthetic construct
  misc_feature 1..20: note = CRISPR gRNA sequence
  source 1..20: mol_type = other DNA
ctcttgacacccttgtcatg

SEQ ID NO: 85968 - DNA, 20 bp, synthetic construct
  misc_feature 1..20: note = CRISPR gRNA sequence
  source 1..20: mol_type = other DNA
cacccttgtcatgtggtcct

SEQ ID NO: 85969 - DNA, 20 bp, synthetic construct
  misc_feature 1..20: note = CRISPR gRNA sequence
  source 1..20: mol_type = other DNA
cctctctgttctctgtgccc

SEQ ID NO: 85970 - DNA, 20 bp, synthetic construct
  misc_feature 1..20: note = CRISPR gRNA sequence
  source 1..20: mol_type = other DNA
ctctctgttctctgtgcccc

SEQ ID NO: 85971 - DNA, 20 bp, synthetic construct
  misc_feature 1..20: note = CRISPR gRNA sequence
  source 1..20: mol_type = other DNA
tctctgttctctgtgccccg

SEQ ID NO: 85972 - DNA, 20 bp, synthetic construct
  misc_feature 1..20: note = CRISPR gRNA sequence
  source 1..20: mol_type = other DNA
gttctctgtgccccggggct

SEQ ID NO: 85973 - DNA, 20 bp, synthetic construct
  misc_feature 1..20: note = CRISPR gRNA sequence
  source 1..20: mol_type = other DNA
tctgtgccccggggctgagt

SEQ ID NO: 85974 - DNA, 20 bp, synthetic construct
  misc_feature 1..20: note = CRISPR gRNA sequence
  source 1..20: mol_type = other DNA
ccggggctgagtgagtcccc

SEQ ID NO: 85975 - DNA, 20 bp, synthetic construct
  misc_feature 1..20: note = CRISPR gRNA sequence
  source 1..20: mol_type = other DNA
cggggctgagtgagtccccc

SEQ ID NO: 85976 - DNA, 20 bp, synthetic construct
  misc_feature 1..20: note = CRISPR gRNA sequence
  source 1..20: mol_type = other DNA
ggctgagtgagtcccccagg

SEQ ID NO: 85977 - DNA, 20 bp, synthetic construct
  misc_feature 1..20: note = CRISPR gRNA sequence
  source 1..20: mol_type = other DNA
ctgagtgagtcccccaggtg

SEQ ID NO: 85978 - DNA, 20 bp, synthetic construct
  misc_feature 1..20: note = CRISPR gRNA sequence
  source 1..20: mol_type = other DNA
tcccccaggtggagctcgcc

SEQ ID NO: 85979 - DNA, 20 bp, synthetic construct
  misc_feature 1..20: note = CRISPR gRNA sequence
  source 1..20: mol_type = other DNA
cccccaggtggagctcgccc

SEQ ID NO: 85980 - DNA, 20 bp, synthetic construct
  misc_feature 1..20: note = CRISPR gRNA sequence
  source 1..20: mol_type = other DNA
aggtggagctcgcccaggcc

SEQ ID NO: 85981 - DNA, 20 bp, synthetic construct
  misc_feature 1..20: note = CRISPR gRNA sequence
  source 1..20: mol_type = other DNA
ggtggagctcgcccaggccc

SEQ ID NO: 85982 - DNA, 20 bp, synthetic construct
  misc_feature 1..20: note = CRISPR gRNA sequence
  source 1..20: mol_type = other DNA
agctcgcccaggcccaggtc

SEQ ID NO: 85983 - DNA, 20 bp, synthetic construct
  misc_feature 1..20: note = CRISPR gRNA sequence
  source 1..20: mol_type = other DNA
gctcgcccaggcccaggtcc

SEQ ID NO: 85984 - DNA, 20 bp, synthetic construct
  misc_feature 1..20: note = CRISPR gRNA sequence
  source 1..20: mol_type = other DNA
cccaggcccaggtccaggtc

SEQ ID NO: 85985 - DNA, 20 bp, synthetic construct
  misc_feature 1..20: note = CRISPR gRNA sequence
  source 1..20: mol_type = other DNA
ccaggcccaggtccaggtcc

SEQ ID NO: 85986 - DNA, 20 bp, synthetic construct
  misc_feature 1..20: note = CRISPR gRNA sequence
  source 1..20: mol_type = other DNA
cccaggtccaggtccaggca

SEQ ID NO: 85987 - DNA, 20 bp, synthetic construct
  misc_feature 1..20: note = CRISPR gRNA sequence
  source 1..20: mol_type = other DNA
aggtccaggtccaggcaaag

SEQ ID NO: 85988 - DNA, 20 bp, synthetic construct
  misc_feature 1..20: note = CRISPR gRNA sequence
  source 1..20: mol_type = other DNA
ggtccaggtccaggcaaagc

SEQ ID NO: 85989 - DNA, 20 bp, synthetic construct
  misc_feature 1..20: note = CRISPR gRNA sequence
  source 1..20: mol_type = other DNA
aggtccaggcaaagcaggaa

SEQ ID NO: 85990 - DNA, 20 bp, synthetic construct
  misc_feature 1..20: note = CRISPR gRNA sequence
  source 1..20: mol_type = other DNA
ccaggcaaagcaggaacagt

SEQ ID NO: 85991 - DNA, 20 bp, synthetic construct
  misc_feature 1..20: note = CRISPR gRNA sequence
  source 1..20: mol_type = other DNA
gcaaagcaggaacagttggt

SEQ ID NO: 85992 - DNA, 20 bp, synthetic construct
  misc_feature 1..20: note = CRISPR gRNA sequence
  source 1..20: mol_type = other DNA
tggtaagatcatgttaatga

SEQ ID NO: 85993 - DNA, 20 bp, synthetic construct
  misc_feature 1..20: note = CRISPR gRNA sequence
  source 1..20: mol_type = other DNA
ggtaagatcatgttaatgat

SEQ ID NO: 85994 - DNA, 20 bp, synthetic construct
  misc_feature 1..20: note = CRISPR gRNA sequence
  source 1..20: mol_type = other DNA
gatcatgttaatgatgggca

SEQ ID NO: 85995 - DNA, 20 bp, synthetic construct
  misc_feature 1..20: note = CRISPR gRNA sequence
  source 1..20: mol_type = other DNA
ttaatgatgggcacagctgc

SEQ ID NO: 85996 - DNA, 20 bp, synthetic construct
  misc_feature 1..20: note = CRISPR gRNA sequence
  source 1..20: mol_type = other DNA
taatgatgggcacagctgct

SEQ ID NO: 85997 - DNA, 20 bp, synthetic construct
  misc_feature 1..20: note = CRISPR gRNA sequence
  source 1..20: mol_type = other DNA
aatgatgggcacagctgctg

SEQ ID NO: 85998 - DNA, 20 bp, synthetic construct
  misc_feature 1..20: note = CRISPR gRNA sequence
  source 1..20: mol_type = other DNA
atgatgggcacagctgctgg

SEQ ID NO: 85999 - DNA, 20 bp, synthetic construct
  misc_feature 1..20: note = CRISPR gRNA sequence
  source 1..20: mol_type = other DNA
cacagctgctgggggtgccc

SEQ ID NO: 86000 - DNA, 20 bp, synthetic construct
  misc_feature 1..20: note = CRISPR gRNA sequence
  source 1..20: mol_type = other DNA
tgggggtgccccggccctac

SEQ ID NO: 86001 - DNA, 20 bp, synthetic construct
  misc_feature 1..20: note = CRISPR gRNA sequence
  source 1..20: mol_type = other DNA
ggtgccccggccctactaga

SEQ ID NO: 86002 - DNA, 20 bp, synthetic construct
  misc_feature 1..20: note = CRISPR gRNA sequence
  source 1..20: mol_type = other DNA
tgccccggccctactagaca

SEQ ID NO: 86003 - DNA, 20 bp, synthetic construct
  misc_feature 1..20: note = CRISPR gRNA sequence
  source 1..20: mol_type = other DNA
gccccggccctactagacag

SEQ ID NO: 86004 - DNA, 20 bp, synthetic construct
  misc_feature 1..20: note = CRISPR gRNA sequence
  source 1..20: mol_type = other DNA
ccggccctactagacagagg

SEQ ID NO: 86005 - DNA, 20 bp, synthetic construct
  misc_feature 1..20: note = CRISPR gRNA sequence
  source 1..20: mol_type = other DNA
cctactagacagaggcagtg

SEQ ID NO: 86006 - DNA, 20 bp, synthetic construct
  misc_feature 1..20: note = CRISPR gRNA sequence
  source 1..20: mol_type = other DNA
agaggcagtgtagccacttt

SEQ ID NO: 86007 - DNA, 20 bp, synthetic construct
  misc_feature 1..20: note = CRISPR gRNA sequence
  source 1..20: mol_type = other DNA
gaggcagtgtagccactttc

SEQ ID NO: 86008 - DNA, 20 bp, synthetic construct
  misc_feature 1..20: note = CRISPR gRNA sequence
  source 1..20: mol_type = other DNA
aggcagtgtagccactttca

SEQ ID NO: 86009 - DNA, 20 bp, synthetic construct
  misc_feature 1..20: note = CRISPR gRNA sequence
  source 1..20: mol_type = other DNA
agccactttcagggcacctg

SEQ ID NO: 86010 - DNA, 20 bp, synthetic construct
  misc_feature 1..20: note = CRISPR gRNA sequence
  source 1..20: mol_type = other DNA
actttcagggcacctgaaga

SEQ ID NO: 86011 - DNA, 20 bp, synthetic construct
  misc_feature 1..20: note = CRISPR gRNA sequence
  source 1..20: mol_type = other DNA
cagggcacctgaagaaagcc

SEQ ID NO: 86012 - DNA, 20 bp, synthetic construct
  misc_feature 1..20: note = CRISPR gRNA sequence
  source 1..20: mol_type = other DNA
agggcacctgaagaaagcct

SEQ ID NO: 86013 - DNA, 20 bp, synthetic construct
  misc_feature 1..20: note = CRISPR gRNA sequence
  source 1..20: mol_type = other DNA
gggcacctgaagaaagcctg

SEQ ID NO: 86014 - DNA, 20 bp, synthetic construct
  misc_feature 1..20: note = CRISPR gRNA sequence
  source 1..20: mol_type = other DNA
ggcacctgaagaaagcctgg

SEQ ID NO: 86015 - DNA, 20 bp, synthetic construct
  misc_feature 1..20: note = CRISPR gRNA sequence
  source 1..20: mol_type = other DNA
cctgaagaaagcctgggggc

SEQ ID NO: 86016 - DNA, 20 bp, synthetic construct
  misc_feature 1..20: note = CRISPR gRNA sequence
  source 1..20: mol_type = other DNA
agaaagcctgggggccagaa

SEQ ID NO: 86017 - DNA, 20 bp, synthetic construct
  misc_feature 1..20: note = CRISPR gRNA sequence
  source 1..20: mol_type = other DNA
gaaagcctgggggccagaat

SEQ ID NO: 86018 - DNA, 20 bp, synthetic construct
  misc_feature 1..20: note = CRISPR gRNA sequence
  source 1..20: mol_type = other DNA
agcctgggggccagaatagg

SEQ ID NO: 86019 - DNA, 20 bp, synthetic construct
  misc_feature 1..20: note = CRISPR gRNA sequence
  source 1..20: mol_type = other DNA
cctgggggccagaataggtg

SEQ ID NO: 86020 - DNA, 20 bp, synthetic construct
  misc_feature 1..20: note = CRISPR gRNA sequence
  source 1..20: mol_type = other DNA
tgggggccagaataggtgga

SEQ ID NO: 86021 - DNA, 20 bp, synthetic construct
  misc_feature 1..20: note = CRISPR gRNA sequence
  source 1..20: mol_type = other DNA
gccagaataggtggagagac

SEQ ID NO: 86022 - DNA, 20 bp, synthetic construct
  misc_feature 1..20: note = CRISPR gRNA sequence
  source 1..20: mol_type = other DNA
ccagaataggtggagagact

SEQ ID NO: 86023 - DNA, 20 bp, synthetic construct
  misc_feature 1..20: note = CRISPR gRNA sequence
  source 1..20: mol_type = other DNA
ataggtggagagactgggat

SEQ ID NO: 86024 - DNA, 20 bp, synthetic construct
  misc_feature 1..20: note = CRISPR gRNA sequence
  source 1..20: mol_type = other DNA
ggtggagagactgggattgg

SEQ ID NO: 86025 - DNA, 20 bp, synthetic construct
  misc_feature 1..20: note = CRISPR gRNA sequence
  source 1..20: mol_type = other DNA
gagactgggattggcggaat

SEQ ID NO: 86026 - DNA, 20 bp, synthetic construct
  misc_feature 1..20: note = CRISPR gRNA sequence
  source 1..20: mol_type = other DNA
ctgggattggcggaattagt

SEQ ID NO: 86027 - DNA, 20 bp, synthetic construct
  misc_feature 1..20: note = CRISPR gRNA sequence
  source 1..20: mol_type = other DNA
gattggcggaattagtgagc

SEQ ID NO: 86028 - DNA, 20 bp, synthetic construct
  misc_feature 1..20: note = CRISPR gRNA sequence
  source 1..20: mol_type = other DNA
attggcggaattagtgagcg

SEQ ID NO: 86029 - DNA, 20 bp, synthetic construct
  misc_feature 1..20: note = CRISPR gRNA sequence
  source 1..20: mol_type = other DNA
ttggcggaattagtgagcga

SEQ ID NO: 86030 - DNA, 20 bp, synthetic construct
  misc_feature 1..20: note = CRISPR gRNA sequence
  source 1..20: mol_type = other DNA
tggcggaattagtgagcgag

SEQ ID NO: 86031 - DNA, 20 bp, synthetic construct
  misc_feature 1..20: note = CRISPR gRNA sequence
  source 1..20: mol_type = other DNA
gaattagtgagcgaggggcc

SEQ ID NO: 86032 - DNA, 20 bp, synthetic construct
  misc_feature 1..20: note = CRISPR gRNA sequence
  source 1..20: mol_type = other DNA
aattagtgagcgaggggccc

SEQ ID NO: 86033 - DNA, 20 bp, synthetic construct
  misc_feature 1..20: note = CRISPR gRNA sequence
  source 1..20: mol_type = other DNA
attagtgagcgaggggcccg

SEQ ID NO: 86034 - DNA, 20 bp, synthetic construct
  misc_feature 1..20: note = CRISPR gRNA sequence
  source 1..20: mol_type = other DNA
agtgagcgaggggcccgggg

SEQ ID NO: 86035 - DNA, 20 bp, synthetic construct
  misc_feature 1..20: note = CRISPR gRNA sequence
  source 1..20: mol_type = other DNA
gtgagcgaggggcccgggga

SEQ ID NO: 86036 - DNA, 20 bp, synthetic construct
  misc_feature 1..20: note = CRISPR gRNA sequence
  source 1..20: mol_type = other DNA
gagcgaggggcccggggaag

SEQ ID NO: 86037 - DNA, 20 bp, synthetic construct
  misc_feature 1..20: note = CRISPR gRNA sequence
  source 1..20: mol_type = other DNA
cgaggggcccggggaaggag

SEQ ID NO: 86038 - DNA, 20 bp, synthetic construct
  misc_feature 1..20: note = CRISPR gRNA sequence
  source 1..20: mol_type = other DNA
aggggcccggggaaggagca

SEQ ID NO: 86039 - DNA, 20 bp, synthetic construct
  misc_feature 1..20: note = CRISPR gRNA sequence
  source 1..20: mol_type = other DNA
ggggcccggggaaggagcag

SEQ ID NO: 86040 - DNA, 20 bp, synthetic construct
  misc_feature 1..20: note = CRISPR gRNA sequence
  source 1..20: mol_type = other DNA
gcccggggaaggagcagagg

SEQ ID NO: 86041 - DNA, 20 bp, synthetic construct
  misc_feature 1..20: note = CRISPR gRNA sequence
  source 1..20: mol_type = other DNA
gggaaggagcagaggcagcc

SEQ ID NO: 86042 - DNA, 20 bp, synthetic construct
  misc_feature 1..20: note = CRISPR gRNA sequence
  source 1..20: mol_type = other DNA
agcagaggcagccgagccac

SEQ ID NO: 86043 - DNA, 20 bp, synthetic construct
  misc_feature 1..20: note = CRISPR gRNA sequence
  source 1..20: mol_type = other DNA
gcagaggcagccgagccact

SEQ ID NO: 86044 - DNA, 20 bp, synthetic construct
  misc_feature 1..20: note = CRISPR gRNA sequence
  source 1..20: mol_type = other DNA
cagaggcagccgagccacta

SEQ ID NO: 86045 - DNA, 20 bp, synthetic construct
  misc_feature 1..20: note = CRISPR gRNA sequence
  source 1..20: mol_type = other DNA
gccactagggcattaacctg

SEQ ID NO: 86046 - DNA, 20 bp, synthetic construct
  misc_feature 1..20: note = CRISPR gRNA sequence
  source 1..20: mol_type = other DNA
ccactagggcattaacctgc

SEQ ID NO: 86047 - DNA, 20 bp, synthetic construct
  misc_feature 1..20: note = CRISPR gRNA sequence
  source 1..20: mol_type = other DNA
ggcattaacctgcaggttat

SEQ ID NO: 86048 - DNA, 20 bp, synthetic construct
  misc_feature 1..20: note = CRISPR gRNA sequence
  source 1..20: mol_type = other DNA
acctgcaggttattggctcc

SEQ ID NO: 86049 - DNA, 20 bp, synthetic construct
  misc_feature 1..20: note = CRISPR gRNA sequence
  source 1..20: mol_type = other DNA
cctgcaggttattggctcct

SEQ ID NO: 86050 - DNA, 20 bp, synthetic construct
  misc_feature 1..20: note = CRISPR gRNA sequence
  source 1..20: mol_type = other DNA
ctgcaggttattggctcctg

SEQ ID NO: 86051 - DNA, 20 bp, synthetic construct
  misc_feature 1..20: note = CRISPR gRNA sequence
  source 1..20: mol_type = other DNA
ggttattggctcctggggcc

SEQ ID NO: 86052 - DNA, 20 bp, synthetic construct
  misc_feature 1..20: note = CRISPR gRNA sequence
  source 1..20: mol_type = other DNA
ttcttccgctctccacgtgc

SEQ ID NO: 86053 - DNA, 20 bp, synthetic construct
  misc_feature 1..20: note = CRISPR gRNA sequence
  source 1..20: mol_type = other DNA
cttccgctctccacgtgcga

SEQ ID NO: 86054 - DNA, 20 bp, synthetic construct
  misc_feature 1..20: note = CRISPR gRNA sequence
  source 1..20: mol_type = other DNA
ttccgctctccacgtgcgag

SEQ ID NO: 86055 - DNA, 20 bp, synthetic construct
  misc_feature 1..20: note = CRISPR gRNA sequence
  source 1..20: mol_type = other DNA
ctctccacgtgcgagaggac

SEQ ID NO: 86056 - DNA, 20 bp, synthetic construct
  misc_feature 1..20: note = CRISPR gRNA sequence
  source 1..20: mol_type = other DNA
acgtgcgagaggaccggccc

SEQ ID NO: 86057 - DNA, 20 bp, synthetic construct
  misc_feature 1..20: note = CRISPR gRNA sequence
  source 1..20: mol_type = other DNA
cgagaggaccggccccagtt

SEQ ID NO: 86058 - DNA, 20 bp, synthetic construct
  misc_feature 1..20: note = CRISPR gRNA sequence
  source 1..20: mol_type = other DNA
gagaggaccggccccagttc

SEQ ID NO: 86059 - DNA, 20 bp, synthetic construct
  misc_feature 1..20: note = CRISPR gRNA sequence
  source 1..20: mol_type = other DNA
ccggccccagttcgggcttc

SEQ ID NO: 86060 - DNA, 20 bp, synthetic construct
  misc_feature 1..20: note = CRISPR gRNA sequence
  source 1..20: mol_type = other DNA
agttcgggcttccagatcct

SEQ ID NO: 86061 - DNA, 20 bp, synthetic construct
  misc_feature 1..20: note = CRISPR gRNA sequence
  source 1..20: mol_type = other DNA
gttcgggcttccagatcctt

SEQ ID NO: 86062 - DNA, 20 bp, synthetic construct
  misc_feature 1..20: note = CRISPR gRNA sequence
  source 1..20: mol_type = other DNA
tcgggcttccagatccttag

SEQ ID NO: 86063 - DNA, 20 bp, synthetic construct
  misc_feature 1..20: note = CRISPR gRNA sequence
  source 1..20: mol_type = other DNA
cgggcttccagatccttagg

SEQ ID NO: 86064 - DNA, 20 bp, synthetic construct
  misc_feature 1..20: note = CRISPR gRNA sequence
  source 1..20: mol_type = other DNA
cagatccttaggaggctaaa

SEQ ID NO: 86065 - DNA, 20 bp, synthetic construct
  misc_feature 1..20: note = CRISPR gRNA sequence
  source 1..20: mol_type = other DNA
ccttaggaggctaaaaagta

SEQ ID NO: 86066 - DNA, 20 bp, synthetic construct
  misc_feature 1..20: note = CRISPR gRNA sequence
  source 1..20: mol_type = other DNA
ttaggaggctaaaaagtaaa

SEQ ID NO: 86067 - DNA, 20 bp, synthetic construct
  misc_feature 1..20: note = CRISPR gRNA sequence
  source 1..20: mol_type = other DNA
aggaggctaaaaagtaaaga

SEQ ID NO: 86068 - DNA, 20 bp, synthetic construct
  misc_feature 1..20: note = CRISPR gRNA sequence
  source 1..20: mol_type = other DNA
ggaggctaaaaagtaaagag

SEQ ID NO: 86069 - DNA, 20 bp, synthetic construct
  misc_feature 1..20: note = CRISPR gRNA sequence
  source 1..20: mol_type = other DNA
aaaaagtaaagagaggaaca

SEQ ID NO: 86070 - DNA, 20 bp, synthetic construct
  misc_feature 1..20: note = CRISPR gRNA sequence
  source 1..20: mol_type = other DNA
agtaaagagaggaacacagt

SEQ ID NO: 86071 - DNA, 20 bp, synthetic construct
  misc_feature 1..20: note = CRISPR gRNA sequence
  source 1..20: mol_type = other DNA
gtaaagagaggaacacagta

SEQ ID NO: 86072 - DNA, 20 bp, synthetic construct
  misc_feature 1..20: note = CRISPR gRNA sequence
  source 1..20: mol_type = other DNA
gaggaacacagtaaggtgtg

SEQ ID NO: 86073 - DNA, 20 bp, synthetic construct
  misc_feature 1..20: note = CRISPR gRNA sequence
  source 1..20: mol_type = other DNA
cacagtaaggtgtgaagaat

SEQ ID NO: 86074 - DNA, 20 bp, synthetic construct
  misc_feature 1..20: note = CRISPR gRNA sequence
  source 1..20: mol_type = other DNA
aaggtgtgaagaatgagtat

SEQ ID NO: 86075 - DNA, 20 bp, synthetic construct
  misc_feature 1..20: note = CRISPR gRNA sequence
  source 1..20: mol_type = other DNA
aggtgtgaagaatgagtatt

SEQ ID NO: 86076 - DNA, 20 bp, synthetic construct
  misc_feature 1..20: note = CRISPR gRNA sequence
  source 1..20: mol_type = other DNA
ggtgtgaagaatgagtattg

SEQ ID NO: 86077 - DNA, 20 bp, synthetic construct
  misc_feature 1..20: note = CRISPR gRNA sequence
  source 1..20: mol_type = other DNA
gtgtgaagaatgagtattgg

SEQ ID NO: 86078 - DNA, 20 bp, synthetic construct
  misc_feature 1..20: note = CRISPR gRNA sequence
  source 1..20: mol_type = other DNA
aatgagtattgggggaaaca

SEQ ID NO: 86079 - DNA, 20 bp, synthetic construct
  misc_feature 1..20: note = CRISPR gRNA sequence
  source 1..20: mol_type = other DNA
attgggggaaacatagacgc

SEQ ID NO: 86080 - DNA, 20 bp, synthetic construct
  misc_feature 1..20: note = CRISPR gRNA sequence
  source 1..20: mol_type = other DNA
tgggggaaacatagacgcca

SEQ ID NO: 86081 - DNA, 20 bp, synthetic construct
  misc_feature 1..20: note = CRISPR gRNA sequence
  source 1..20: mol_type = other DNA
gggggaaacatagacgccag

SEQ ID NO: 86082 - DNA, 20 bp, synthetic construct
  misc_feature 1..20: note = CRISPR gRNA sequence
  source 1..20: mol_type = other DNA
aaacatagacgccagaggca

SEQ ID NO: 86083 - DNA, 20 bp, synthetic construct
  misc_feature 1..20: note = CRISPR gRNA sequence
  source 1..20: mol_type = other DNA
aacatagacgccagaggcac

SEQ ID NO: 86084 - DNA, 20 bp, synthetic construct
  misc_feature 1..20: note = CRISPR gRNA sequence
  source 1..20: mol_type = other DNA
catagacgccagaggcacag

SEQ ID NO: 86085 - DNA, 20 bp, synthetic construct
  misc_feature 1..20: note = CRISPR gRNA sequence
  source 1..20: mol_type = other DNA
atagacgccagaggcacagg

SEQ ID NO: 86086 - DNA, 20 bp, synthetic construct
  misc_feature 1..20: note = CRISPR gRNA sequence
  source 1..20: mol_type = other DNA
gacgccagaggcacaggagg

SEQ ID NO: 86087 - DNA, 20 bp, synthetic construct
  misc_feature 1..20: note = CRISPR gRNA sequence
  source 1..20: mol_type = other DNA
cagaggcacaggaggtggaa

SEQ ID NO: 86088 - DNA, 20 bp, synthetic construct
  misc_feature 1..20: note = CRISPR gRNA sequence
  source 1..20: mol_type = other DNA
ggcacaggaggtggaaaagc

SEQ ID NO: 86089 - DNA, 20 bp, synthetic construct
  misc_feature 1..20: note = CRISPR gRNA sequence
  source 1..20: mol_type = other DNA
gcacaggaggtggaaaagca

SEQ ID NO: 86090 - DNA, 20 bp, synthetic construct
  misc_feature 1..20: note = CRISPR gRNA sequence
  source 1..20: mol_type = other DNA
cacaggaggtggaaaagcaa

SEQ ID NO: 86091 - DNA, 20 bp, synthetic construct
  misc_feature 1..20: note = CRISPR gRNA sequence
  source 1..20: mol_type = other DNA
ggaaaagcaagggacccaat

SEQ ID NO: 86092 - DNA, 20 bp, synthetic construct
  misc_feature 1..20: note = CRISPR gRNA sequence
  source 1..20: mol_type = other DNA
aaaagcaagggacccaattg

SEQ ID NO: 86093 - DNA, 20 bp, synthetic construct
  misc_feature 1..20: note = CRISPR gRNA sequence
  source 1..20: mol_type = other DNA
agcaagggacccaattggag

SEQ ID NO: 86094 - DNA, 20 bp, synthetic construct
  misc_feature 1..20: note = CRISPR gRNA sequence
  source 1..20: mol_type = other DNA
gcaagggacccaattggaga

SEQ ID NO: 86095 - DNA, 20 bp, synthetic construct
  misc_feature 1..20: note = CRISPR gRNA sequence
  source 1..20: mol_type = other DNA
caattggagaaggatatact

SEQ ID NO: 86096 - DNA, 20 bp, synthetic construct
  misc_feature 1..20: note = CRISPR gRNA sequence
  source 1..20: mol_type = other DNA
agaaggatatactaagcccc

SEQ ID NO: 86097 - DNA, 20 bp, synthetic construct
  misc_feature 1..20: note = CRISPR gRNA sequence
  source 1..20: mol_type = other DNA
gatatactaagcccccagcc

SEQ ID NO: 86098 - DNA, 20 bp, synthetic construct
  misc_feature 1..20: note = CRISPR gRNA sequence
  source 1..20: mol_type = other DNA
atatactaagcccccagccc

SEQ ID NO: 86099 - DNA, 20 bp, synthetic construct
  misc_feature 1..20: note = CRISPR gRNA sequence
  source 1..20: mol_type = other DNA
actaagcccccagcccagga

SEQ ID NO: 86100 - DNA, 20 bp, synthetic construct
  misc_feature 1..20: note = CRISPR gRNA sequence
  source 1..20: mol_type = other DNA
gcccccagcccaggacagca

SEQ ID NO: 86101 - DNA, 20 bp, synthetic construct
  misc_feature 1..20: note = CRISPR gRNA sequence
  source 1..20: mol_type = other DNA
ccagcccaggacagcaaagt

SEQ ID NO: 86102 - DNA, 20 bp, synthetic construct
  misc_feature 1..20: note = CRISPR gRNA sequence
  source 1..20: mol_type = other DNA
cagcccaggacagcaaagtc

SEQ ID NO: 86103 - DNA, 20 bp, synthetic construct
  misc_feature 1..20: note = CRISPR gRNA sequence
  source 1..20: mol_type = other DNA
agcccaggacagcaaagtca

SEQ ID NO: 86104 - DNA, 20 bp, synthetic construct
  misc_feature 1..20: note = CRISPR gRNA sequence
  source 1..20: mol_type = other DNA
gggccactgacttccttacc

SEQ ID NO: 86105 - DNA, 20 bp, synthetic construct
  misc_feature 1..20: note = CRISPR gRNA sequence
  source 1..20: mol_type = other DNA
ggccactgacttccttacct

SEQ ID NO: 86106 - DNA, 20 bp, synthetic construct
  misc_feature 1..20: note = CRISPR gRNA sequence
  source 1..20: mol_type = other DNA
actgacttccttacctgggc

SEQ ID NO: 86107 - DNA, 20 bp, synthetic construct
  misc_feature 1..20: note = CRISPR gRNA sequence
  source 1..20: mol_type = other DNA
cttacctgggccagtctctc

SEQ ID NO: 86108 - DNA, 20 bp, synthetic construct
  misc_feature 1..20: note = CRISPR gRNA sequence
  source 1..20: mol_type = other DNA
ccagtctctctggcttcttg

SEQ ID NO: 86109 - DNA, 20 bp, synthetic construct
  misc_feature 1..20: note = CRISPR gRNA sequence
  source 1..20: mol_type = other DNA
cagtctctctggcttcttgt

SEQ ID NO: 86110 - DNA, 20 bp, synthetic construct
  misc_feature 1..20: note = CRISPR gRNA sequence
  source 1..20: mol_type = other DNA
ttcttgtgggctccaccctc

SEQ ID NO: 86111 - DNA, 20 bp, synthetic construct
  misc_feature 1..20: note = CRISPR gRNA sequence
  source 1..20: mol_type = other DNA
tcttgtgggctccaccctct

SEQ ID NO: 86112 - DNA, 20 bp, synthetic construct
  misc_feature 1..20: note = CRISPR gRNA sequence
  source 1..20: mol_type = other DNA
gggttctctaaaccattctt

SEQ ID NO: 86113 - DNA, 20 bp, synthetic construct
  misc_feature 1..20: note = CRISPR gRNA sequence
  source 1..20: mol_type = other DNA
ctctaaaccattctttggtt

SEQ ID NO: 86114 - DNA, 20 bp, synthetic construct
  misc_feature 1..20: note = CRISPR gRNA sequence
  source 1..20: mol_type = other DNA
tggtttagatgaccgttccc

SEQ ID NO: 86115 - DNA, 20 bp, synthetic construct
  misc_feature 1..20: note = CRISPR gRNA sequence
  source 1..20: mol_type = other DNA
ggtttagatgaccgttcccg

SEQ ID NO: 86116 - DNA, 20 bp, synthetic construct
  misc_feature 1..20: note = CRISPR gRNA sequence
  source 1..20: mol_type = other DNA
tgcatgttcgtcctcttctg

SEQ ID NO: 86117 - DNA, 20 bp, synthetic construct
  misc_feature 1..20: note = CRISPR gRNA sequence
  source 1..20: mol_type = other DNA
catgttcgtcctcttctgca

SEQ ID NO: 86118 - DNA, 20 bp, synthetic construct
  misc_feature 1..20: note = CRISPR gRNA sequence
  source 1..20: mol_type = other DNA
atgttcgtcctcttctgcag

SEQ ID NO: 86119 - DNA, 20 bp, synthetic construct
  misc_feature 1..20: note = CRISPR gRNA sequence
  source 1..20: mol_type = other DNA
tcttctgcagaggtaccaaa

SEQ ID NO: 86120 - DNA, 20 bp, synthetic construct
  misc_feature 1..20: note = CRISPR gRNA sequence
  source 1..20: mol_type = other DNA
cttctgcagaggtaccaaaa

SEQ ID NO: 86121 - DNA, 20 bp, synthetic construct
  misc_feature 1..20: note = CRISPR gRNA sequence
  source 1..20: mol_type = other DNA
cagaggtaccaaaaaggtaa

SEQ ID NO: 86122 - DNA, 20 bp, synthetic construct
  misc_feature 1..20: note = CRISPR gRNA sequence
  source 1..20: mol_type = other DNA
gaggtaccaaaaaggtaata

SEQ ID NO: 86123 - DNA, 20 bp, synthetic construct
  misc_feature 1..20: note = CRISPR gRNA sequence
  source 1..20: mol_type = other DNA
accaaaaaggtaatagagtg

SEQ ID NO: 86124 - DNA, 20 bp, synthetic construct
  misc_feature 1..20: note = CRISPR gRNA sequence
  source 1..20: mol_type = other DNA
ccaaaaaggtaatagagtga

SEQ ID NO: 86125 - DNA, 20 bp, synthetic construct
  misc_feature 1..20: note = CRISPR gRNA sequence
  source 1..20: mol_type = other DNA
aaaggtaatagagtgaaggt

SEQ ID NO: 86126 - DNA, 20 bp, synthetic construct
  misc_feature 1..20: note = CRISPR gRNA sequence
  source 1..20: mol_type = other DNA
aaggtaatagagtgaaggtg

SEQ ID NO: 86127 - DNA, 20 bp, synthetic construct
  misc_feature 1..20: note = CRISPR gRNA sequence
  source 1..20: mol_type = other DNA
ggtaatagagtgaaggtgag

SEQ ID NO: 86128 - DNA, 20 bp, synthetic construct
  misc_feature 1..20: note = CRISPR gRNA sequence
  source 1..20: mol_type = other DNA
gtaatagagtgaaggtgagg

SEQ ID NO: 86129 - DNA, 20 bp, synthetic construct
  misc_feature 1..20: note = CRISPR gRNA sequence
  source 1..20: mol_type = other DNA
gtgaaggtgaggaggaaact

SEQ ID NO: 86130 - DNA, 20 bp, synthetic construct
  misc_feature 1..20: note = CRISPR gRNA sequence
  source 1..20: mol_type = other DNA
tgaaggtgaggaggaaactg

SEQ ID NO: 86131 - DNA, 20 bp, synthetic construct
  misc_feature 1..20: note = CRISPR gRNA sequence
  source 1..20: mol_type = other DNA
gtgaggaggaaactgaggaa

SEQ ID NO: 86132 - DNA, 20 bp, synthetic construct
  misc_feature 1..20: note = CRISPR gRNA sequence
  source 1..20: mol_type = other DNA
tgaggaggaaactgaggaat

SEQ ID NO: 86133 - DNA, 20 bp, synthetic construct
  misc_feature 1..20: note = CRISPR gRNA sequence
  source 1..20: mol_type = other DNA
gaggaggaaactgaggaata

SEQ ID NO: 86134 - DNA, 20 bp, synthetic construct
  misc_feature 1..20: note = CRISPR gRNA sequence
  source 1..20: mol_type = other DNA
aggaggaaactgaggaatag

SEQ ID NO: 86135 - DNA, 20 bp, synthetic construct
  misc_feature 1..20: note = CRISPR gRNA sequence
  source 1..20: mol_type = other DNA
gaggaaactgaggaataggg

SEQ ID NO: 86136 - DNA, 20 bp, synthetic construct
  misc_feature 1..20: note = CRISPR gRNA sequence
  source 1..20: mol_type = other DNA
aaactgaggaataggggagt

SEQ ID NO: 86137 - DNA, 20 bp, synthetic construct
  misc_feature 1..20: note = CRISPR gRNA sequence
  source 1..20: mol_type = other DNA
aactgaggaataggggagtg

SEQ ID NO: 86138 - DNA, 20 bp, synthetic construct
  misc_feature 1..20: note = CRISPR gRNA sequence
  source 1..20: mol_type = other DNA
ggcaattctgattgactgac

SEQ ID NO: 86139 - DNA, 20 bp, synthetic construct
  misc_feature 1..20: note = CRISPR gRNA sequence
  source 1..20: mol_type = other DNA
aattctgattgactgactgg

SEQ ID NO: 86140 - DNA, 20 bp, synthetic construct
  misc_feature 1..20: note = CRISPR gRNA sequence
  source 1..20: mol_type = other DNA
ttctgattgactgactggta

SEQ ID NO: 86141 - DNA, 20 bp, synthetic construct
  misc_feature 1..20: note = CRISPR gRNA sequence
  source 1..20: mol_type = other DNA
gattgactgactggtagaga

SEQ ID NO: 86142 - DNA, 20 bp, synthetic construct
  misc_feature 1..20: note = CRISPR gRNA sequence
  source 1..20: mol_type = other DNA
attgactgactggtagagac

SEQ ID NO: 86143 - DNA, 20 bp, synthetic construct
  misc_feature 1..20: note = CRISPR gRNA sequence
  source 1..20: mol_type = other DNA
tgactggtagagacaggaaa

SEQ ID NO: 86144 - DNA, 20 bp, synthetic construct
  misc_feature 1..20: note = CRISPR gRNA sequence
  source 1..20: mol_type = other DNA
gactggtagagacaggaaat

SEQ ID NO: 86145 - DNA, 20 bp, synthetic construct
  misc_feature 1..20: note = CRISPR gRNA sequence
  source 1..20: mol_type = other DNA
actggtagagacaggaaatg

SEQ ID NO: 86146 - DNA, 20 bp, synthetic construct
  misc_feature 1..20: note = CRISPR gRNA sequence
  source 1..20: mol_type = other DNA
agacaggaaatggggtgcta

SEQ ID NO: 86147 - DNA, 20 bp, synthetic construct
  misc_feature 1..20: note = CRISPR gRNA sequence
  source 1..20: mol_type = other DNA
tggggtgctaaagcatgtct

SEQ ID NO: 86148 - DNA, 20 bp, synthetic construct
  misc_feature 1..20: note = CRISPR gRNA sequence
  source 1..20: mol_type = other DNA
ggtgctaaagcatgtcttag

SEQ ID NO: 86149 - DNA, 20 bp, synthetic construct
  misc_feature 1..20: note = CRISPR gRNA sequence
  source 1..20: mol_type = other DNA
gtgctaaagcatgtcttaga

SEQ ID NO: 86150 - DNA, 20 bp, synthetic construct
  misc_feature 1..20: note = CRISPR gRNA sequence
  source 1..20: mol_type = other DNA
tgctaaagcatgtcttagaa

SEQ ID NO: 86151 - DNA, 20 bp, synthetic construct
  misc_feature 1..20: note = CRISPR gRNA sequence
  source 1..20: mol_type = other DNA
gcatgtcttagaagggtctc

SEQ ID NO: 86152 - DNA, 20 bp, synthetic construct
  misc_feature 1..20: note = CRISPR gRNA sequence
  source 1..20: mol_type = other DNA
catgtcttagaagggtctcc

SEQ ID NO: 86153 - DNA, 20 bp, synthetic construct
  misc_feature 1..20: note = CRISPR gRNA sequence
  source 1..20: mol_type = other DNA
gtcttagaagggtctccagg

SEQ ID NO: 86154 - DNA, 20 bp, synthetic construct
  misc_feature 1..20: note = CRISPR gRNA sequence
  source 1..20: mol_type = other DNA
cttagaagggtctccaggaa

SEQ ID NO: 86155 - DNA, 20 bp, synthetic construct
  misc_feature 1..20: note = CRISPR gRNA sequence
  source 1..20: mol_type = other DNA
ttagaagggtctccaggaag

SEQ ID NO: 86156 - DNA, 20 bp, synthetic construct
  misc_feature 1..20: note = CRISPR gRNA sequence
  source 1..20: mol_type = other DNA
tagaagggtctccaggaaga

SEQ ID NO: 86157 - DNA, 20 bp, synthetic construct
  misc_feature 1..20: note = CRISPR gRNA sequence
  source 1..20: mol_type = other DNA
agaagggtctccaggaagag

SEQ ID NO: 86158 - DNA, 20 bp, synthetic construct
  misc_feature 1..20: note = CRISPR gRNA sequence
  source 1..20: mol_type = other DNA
gaagggtctccaggaagagg

SEQ ID NO: 86159 - DNA, 20 bp, synthetic construct
  misc_feature 1..20: note = CRISPR gRNA sequence
  source 1..20: mol_type = other DNA
caggaagagggggcaaatcc

SEQ ID NO: 86160 - DNA, 20 bp, synthetic construct
  misc_feature 1..20: note = CRISPR gRNA sequence
  source 1..20: mol_type = other DNA
aggaagagggggcaaatcca

SEQ ID NO: 86161 - DNA, 20 bp, synthetic construct
  misc_feature 1..20: note = CRISPR gRNA sequence
  source 1..20: mol_type = other DNA
aatccaaggtgtctctattc

SEQ ID NO: 86162 - DNA, 20 bp, synthetic construct
  misc_feature 1..20: note = CRISPR gRNA sequence
  source 1..20: mol_type = other DNA
ggtgtctctattctagtgtg

SEQ ID NO: 86163 - DNA, 20 bp, synthetic construct
  misc_feature 1..20: note = CRISPR gRNA sequence
  source 1..20: mol_type = other DNA
gtgtctctattctagtgtgt

SEQ ID NO: 86164 - DNA, 20 bp, synthetic construct
  misc_feature 1..20: note = CRISPR gRNA sequence
  source 1..20: mol_type = other DNA
gtctctattctagtgtgtgg

SEQ ID NO: 86165 - DNA, 20 bp, synthetic construct
  misc_feature 1..20: note = CRISPR gRNA sequence
  source 1..20: mol_type = other DNA
tctctattctagtgtgtggg

SEQ ID NO: 86166 - DNA, 20 bp, synthetic construct
  misc_feature 1..20: note = CRISPR gRNA sequence
  source 1..20: mol_type = other DNA
ctctattctagtgtgtggga

SEQ ID NO: 86167 - DNA, 20 bp, synthetic construct
  misc_feature 1..20: note = CRISPR gRNA sequence
  source 1..20: mol_type = other DNA
agtgtgtgggagggccactg

SEQ ID NO: 86168 - DNA, 20 bp, synthetic construct
  misc_feature 1..20: note = CRISPR gRNA sequence
  source 1..20: mol_type = other DNA
gggagggccactgaagctga

SEQ ID NO: 86169 - DNA, 20 bp, synthetic construct
  misc_feature 1..20: note = CRISPR gRNA sequence
  source 1..20: mol_type = other DNA
agggccactgaagctgaaag

SEQ ID NO: 86170 - DNA, 20 bp, synthetic construct
  misc_feature 1..20: note = CRISPR gRNA sequence
  source 1..20: mol_type = other DNA
cactgaagctgaaagtggct

SEQ ID NO: 86171 - DNA, 20 bp, synthetic construct
  misc_feature 1..20: note = CRISPR gRNA sequence
  source 1..20: mol_type = other DNA
actgaagctgaaagtggctc

SEQ ID NO: 86172 - DNA, 20 bp, synthetic construct
  misc_feature 1..20: note = CRISPR gRNA sequence
  source 1..20: mol_type = other DNA
ctgaagctgaaagtggctca

SEQ ID NO: 86173 - DNA, 20 bp, synthetic construct
  misc_feature 1..20: note = CRISPR gRNA sequence
  source 1..20: mol_type = other DNA
gaaagtggctcagggttgct

SEQ ID NO: 86174 - DNA, 20 bp, synthetic construct
  misc_feature 1..20: note = CRISPR gRNA sequence
  source 1..20: mol_type = other DNA
gctcagggttgctgagacat

SEQ ID NO: 86175 - DNA, 20 bp, synthetic construct
  misc_feature 1..20: note = CRISPR gRNA sequence
  source 1..20: mol_type = other DNA
tcagggttgctgagacataa

SEQ ID NO: 86176 - DNA, 20 bp, synthetic construct
  misc_feature 1..20: note = CRISPR gRNA sequence
  source 1..20: mol_type = other DNA
agggttgctgagacataaga

SEQ ID NO: 86177 - DNA, 20 bp, synthetic construct
  misc_feature 1..20: note = CRISPR gRNA sequence
  source 1..20: mol_type = other DNA
gggttgctgagacataagag

SEQ ID NO: 86178 - DNA, 20 bp, synthetic construct
  misc_feature 1..20: note = CRISPR gRNA sequence
  source 1..20: mol_type = other DNA
ggttgctgagacataagaga

SEQ ID NO: 86179 - DNA, 20 bp, synthetic construct
  misc_feature 1..20: note = CRISPR gRNA sequence
  source 1..20: mol_type = other DNA
ataagagagggtcaacacac

SEQ ID NO: 86180 - DNA, 20 bp, synthetic construct
  misc_feature 1..20: note = CRISPR gRNA sequence
  source 1..20: mol_type = other DNA
gagagggtcaacacaccagc

SEQ ID NO: 86181 - DNA, 20 bp, synthetic construct
  misc_feature 1..20: note = CRISPR gRNA sequence
  source 1..20: mol_type = other DNA
caacacaccagcgagcccca

SEQ ID NO: 86182 - DNA, 20 bp, synthetic construct
  misc_feature 1..20: note = CRISPR gRNA sequence
  source 1..20: mol_type = other DNA
ccagcgagccccatggcctt

SEQ ID NO: 86183 - DNA, 20 bp, synthetic construct
  misc_feature 1..20: note = CRISPR gRNA sequence
  source 1..20: mol_type = other DNA
gccccatggccttaagcaca

SEQ ID NO: 86184 - DNA, 20 bp, synthetic construct
  misc_feature 1..20: note = CRISPR gRNA sequence
  source 1..20: mol_type = other DNA
ccccatggccttaagcacat

SEQ ID NO: 86185 - DNA, 20 bp, synthetic construct
  misc_feature 1..20: note = CRISPR gRNA sequence
  source 1..20: mol_type = other DNA
cttaagcacatgggcatgtg

SEQ ID NO: 86186 - DNA, 20 bp, synthetic construct
  misc_feature 1..20: note = CRISPR gRNA sequence
  source 1..20: mol_type = other DNA
gcacatgggcatgtgcagat

SEQ ID NO: 86187 - DNA, 20 bp, synthetic construct
  misc_feature 1..20: note = CRISPR gRNA sequence
  source 1..20: mol_type = other DNA
cacatgggcatgtgcagatc

SEQ ID NO: 86188 - DNA, 20 bp, synthetic construct
  misc_feature 1..20: note = CRISPR gRNA sequence
  source 1..20: mol_type = other DNA
atgggcatgtgcagatcggg

SEQ ID NO: 86189 - DNA, 20 bp, synthetic construct
  misc_feature 1..20: note = CRISPR gRNA sequence
  source 1..20: mol_type = other DNA
gggcatgtgcagatcgggca

SEQ ID NO: 86190 - DNA, 20 bp, synthetic construct
  misc_feature 1..20: note = CRISPR gRNA sequence
  source 1..20: mol_type = other DNA
tgtgcagatcgggcagagat

SEQ ID NO: 86191 - DNA, 20 bp, synthetic construct
  misc_feature 1..20: note = CRISPR gRNA sequence
  source 1..20: mol_type = other DNA
gcagagatgagatgctgctg

SEQ ID NO: 86192 - DNA, 20 bp, synthetic construct
  misc_feature 1..20: note = CRISPR gRNA sequence
  source 1..20: mol_type = other DNA
gagatgagatgctgctgtag

SEQ ID NO: 86193 - DNA, 20 bp, synthetic construct
  misc_feature 1..20: note = CRISPR gRNA sequence
  source 1..20: mol_type = other DNA
agatgagatgctgctgtagc

SEQ ID NO: 86194 - DNA, 20 bp, synthetic construct
  misc_feature 1..20: note = CRISPR gRNA sequence
  source 1..20: mol_type = other DNA
tgagatgctgctgtagcagg

SEQ ID NO: 86195 - DNA, 20 bp, synthetic construct
  misc_feature 1..20: note = CRISPR gRNA sequence
  source 1..20: mol_type = other DNA
gatgctgctgtagcaggaag

SEQ ID NO: 86196 - DNA, 20 bp, synthetic construct
  misc_feature 1..20: note = CRISPR gRNA sequence
  source 1..20: mol_type = other DNA
atgctgctgtagcaggaagc

SEQ ID NO: 86197 - DNA, 20 bp, synthetic construct
  misc_feature 1..20: note = CRISPR gRNA sequence
  source 1..20: mol_type = other DNA
gaagcgggcgacctcaacga

SEQ ID NO: 86198 - DNA, 20 bp, synthetic construct
  misc_feature 1..20: note = CRISPR gRNA sequence
  source 1..20: mol_type = other DNA
cgacctcaacgatggaactg

SEQ ID NO: 86199 - DNA, 20 bp, synthetic construct
  misc_feature 1..20: note = CRISPR gRNA sequence
  source 1..20: mol_type = other DNA
gacctcaacgatggaactga

SEQ ID NO: 86200 - DNA, 20 bp, synthetic construct
  misc_feature 1..20: note = CRISPR gRNA sequence
  source 1..20: mol_type = other DNA
atggaactgaaggaccgttt

SEQ ID NO: 86201 - DNA, 20 bp, synthetic construct
  misc_feature 1..20: note = CRISPR gRNA sequence
  source 1..20: mol_type = other DNA
tggaactgaaggaccgtttc

SEQ ID NO: 86202 - DNA, 20 bp, synthetic construct
  misc_feature 1..20: note = CRISPR gRNA sequence
  source 1..20: mol_type = other DNA
gtttcaggatccgctctgcc

SEQ ID NO: 86203 - DNA, 20 bp, synthetic construct
  misc_feature 1..20: note = CRISPR gRNA sequence
  source 1..20: mol_type = other DNA
ggatccgctctgcccagtca

SEQ ID NO: 86204 - DNA, 20 bp, synthetic construct
  misc_feature 1..20: note = CRISPR gRNA sequence
  source 1..20: mol_type = other DNA
gatccgctctgcccagtcac

SEQ ID NO: 86205 - DNA, 20 bp, synthetic construct
  misc_feature 1..20: note = CRISPR gRNA sequence
  source 1..20: mol_type = other DNA
cgctctgcccagtcacaggt

SEQ ID NO: 86206 - DNA, 20 bp, synthetic construct
  misc_feature 1..20: note = CRISPR gRNA sequence
  source 1..20: mol_type = other DNA
gctctgcccagtcacaggtc

SEQ ID NO: 86207 - DNA, 20 bp, synthetic construct
  misc_feature 1..20: note = CRISPR gRNA sequence
  source 1..20: mol_type = other DNA
ctctgcccagtcacaggtca

SEQ ID NO: 86208 - DNA, 20 bp, synthetic construct
  misc_feature 1..20: note = CRISPR gRNA sequence
  source 1..20: mol_type = other DNA
agggcacacgctgcctccac

SEQ ID NO: 86209 - DNA, 20 bp, synthetic construct
  misc_feature 1..20: note = CRISPR gRNA sequence
  source 1..20: mol_type = other DNA
tgcctccaccagttcatctc

SEQ ID NO: 86210 - DNA, 20 bp, synthetic construct
  misc_feature 1..20: note = CRISPR gRNA sequence
  source 1..20: mol_type = other DNA
gcctccaccagttcatctcg

SEQ ID NO: 86211 - DNA, 20 bp, synthetic construct
  misc_feature 1..20: note = CRISPR gRNA sequence
  source 1..20: mol_type = other DNA
accagttcatctcgaggtgc

SEQ ID NO: 86212 - DNA, 20 bp, synthetic construct
  misc_feature 1..20: note = CRISPR gRNA sequence
  source 1..20: mol_type = other DNA
ccagttcatctcgaggtgct

SEQ ID NO: 86213 - DNA, 20 bp, synthetic construct
  misc_feature 1..20: note = CRISPR gRNA sequence
  source 1..20: mol_type = other DNA
cagttcatctcgaggtgctg

SEQ ID NO: 86214 - DNA, 20 bp, synthetic construct
  misc_feature 1..20: note = CRISPR gRNA sequence
  source 1..20: mol_type = other DNA
cgaggtgctggggttacttc

SEQ ID NO: 86215 - DNA, 20 bp, synthetic construct
  misc_feature 1..20: note = CRISPR gRNA sequence
  source 1..20: mol_type = other DNA
gaggtgctggggttacttct

SEQ ID NO: 86216 - DNA, 20 bp, synthetic construct
  misc_feature 1..20: note = CRISPR gRNA sequence
  source 1..20: mol_type = other DNA
gttacttctgggcccatttc

SEQ ID NO: 86217 - DNA, 20 bp, synthetic construct
  misc_feature 1..20: note = CRISPR gRNA sequence
  source 1..20: mol_type = other DNA
tctgggcccatttctggctg

SEQ ID NO: 86218 - DNA, 20 bp, synthetic construct
  misc_feature 1..20: note = CRISPR gRNA sequence
  source 1..20: mol_type = other DNA
gggcccatttctggctgaag

SEQ ID NO: 86219 - DNA, 20 bp, synthetic construct
  misc_feature 1..20: note = CRISPR gRNA sequence
  source 1..20: mol_type = other DNA
ggcccatttctggctgaagt

SEQ ID NO: 86220 - DNA, 20 bp, synthetic construct
  misc_feature 1..20: note = CRISPR gRNA sequence
  source 1..20: mol_type = other DNA
gcccatttctggctgaagtg

SEQ ID NO: 86221 - DNA, 20 bp, synthetic construct
  misc_feature 1..20: note = CRISPR gRNA sequence
  source 1..20: mol_type = other DNA
catttctggctgaagtgggg

SEQ ID NO: 86222 - DNA, 20 bp, synthetic construct
  misc_feature 1..20: note = CRISPR gRNA sequence
  source 1..20: mol_type = other DNA
atttctggctgaagtgggga

SEQ ID NO: 86223 - DNA, 20 bp, synthetic construct
  misc_feature 1..20: note = CRISPR gRNA sequence
  source 1..20: mol_type = other DNA
cccaatcacactccaaatta

SEQ ID NO: 86224 - DNA, 20 bp, synthetic construct
  misc_feature 1..20: note = CRISPR gRNA sequence
  source 1..20: mol_type = other DNA
acccttgcctcctctcttgt

SEQ ID NO: 86225 - DNA, 20 bp, synthetic construct
  misc_feature 1..20: note = CRISPR gRNA sequence
  source 1..20: mol_type = other DNA
ccttgcctcctctcttgtca

SEQ ID NO: 86226 - DNA, 20 bp, synthetic construct
  misc_feature 1..20: note = CRISPR gRNA sequence
  source 1..20: mol_type = other DNA
tcctctcttgtcagagatca

SEQ ID NO: 86227 - DNA, 20 bp, synthetic construct
  misc_feature 1..20: note = CRISPR gRNA sequence
  source 1..20: mol_type = other DNA
agatcaaagactattgacca

SEQ ID NO: 86228 - DNA, 20 bp, synthetic construct
  misc_feature 1..20: note = CRISPR gRNA sequence
  source 1..20: mol_type = other DNA
aaagactattgaccaaagct

SEQ ID NO: 86229 - DNA, 20 bp, synthetic construct
  misc_feature 1..20: note = CRISPR gRNA sequence
  source 1..20: mol_type = other DNA
ctattgaccaaagctgagac

SEQ ID NO: 86230 - DNA, 20 bp, synthetic construct
  misc_feature 1..20: note = CRISPR gRNA sequence
  source 1..20: mol_type = other DNA
gaccaaagctgagaccagac

SEQ ID NO: 86231 - DNA, 20 bp, synthetic construct
  misc_feature 1..20: note = CRISPR gRNA sequence
  source 1..20: mol_type = other DNA
accaaagctgagaccagact

SEQ ID NO: 86232 - DNA, 20 bp, synthetic construct
  misc_feature 1..20: note = CRISPR gRNA sequence
  source 1..20: mol_type = other DNA
ccaaagctgagaccagactg

SEQ ID NO: 86233 - DNA, 20 bp, synthetic construct
  misc_feature 1..20: note = CRISPR gRNA sequence
  source 1..20: mol_type = other DNA
agctgagaccagactgggga

SEQ ID NO: 86234 - DNA, 20 bp, synthetic construct
  misc_feature 1..20: note = CRISPR gRNA sequence
  source 1..20: mol_type = other DNA
gctgagaccagactggggat

SEQ ID NO: 86235 - DNA, 20 bp, synthetic construct
  misc_feature 1..20: note = CRISPR gRNA sequence
  source 1..20: mol_type = other DNA
tgagaccagactggggatgg

SEQ ID NO: 86236 - DNA, 20 bp, synthetic construct
  misc_feature 1..20: note = CRISPR gRNA sequence
  source 1..20: mol_type = other DNA
gaccagactggggatgggag

SEQ ID NO: 86237 - DNA, 20 bp, synthetic construct
  misc_feature 1..20: note = CRISPR gRNA sequence
  source 1..20: mol_type = other DNA
agcctctacctatcccattg

SEQ ID NO: 86238 - DNA, 20 bp, synthetic construct
  misc_feature 1..20: note = CRISPR gRNA sequence
  source 1..20: mol_type = other DNA
ctctacctatcccattgcag

SEQ ID NO: 86239 - DNA, 20 bp, synthetic construct
  misc_feature 1..20: note = CRISPR gRNA sequence
  source 1..20: mol_type = other DNA
atcccattgcagaagcccac

SEQ ID NO: 86240 - DNA, 20 bp, synthetic construct
  misc_feature 1..20: note = CRISPR gRNA sequence
  source 1..20: mol_type = other DNA
gttctcttcatcctctgcct

SEQ ID NO: 86241 - DNA, 20 bp, synthetic construct
  misc_feature 1..20: note = CRISPR gRNA sequence
  source 1..20: mol_type = other DNA
ttcatcctctgcctcagcta

SEQ ID NO: 86242 - DNA, 20 bp, synthetic construct
  misc_feature 1..20: note = CRISPR gRNA sequence
  source 1..20: mol_type = other DNA
tcatcctctgcctcagctac

SEQ ID NO: 86243 - DNA, 20 bp, synthetic construct
  misc_feature 1..20: note = CRISPR gRNA sequence
  source 1..20: mol_type = other DNA
catcctctgcctcagctaca

SEQ ID NO: 86244 - DNA, 20 bp, synthetic construct
  misc_feature 1..20: note = CRISPR gRNA sequence
  source 1..20: mol_type = other DNA
ctctgcctcagctacagggt

SEQ ID NO: 86245 - DNA, 20 bp, synthetic construct
  misc_feature 1..20: note = CRISPR gRNA sequence
  source 1..20: mol_type = other DNA
tgcctcagctacagggttgg

SEQ ID NO: 86246 - DNA, 20 bp, synthetic construct
  misc_feature 1..20: note = CRISPR gRNA sequence
  source 1..20: mol_type = other DNA
ctcagctacagggttggcag

SEQ ID NO: 86247 - DNA, 20 bp, synthetic construct
  misc_feature 1..20: note = CRISPR gRNA sequence
  source 1..20: mol_type = other DNA
tcagctacagggttggcaga

SEQ ID NO: 86248 - DNA, 20 bp, synthetic construct
  misc_feature 1..20: note = CRISPR gRNA sequence
  source 1..20: mol_type = other DNA
cagctacagggttggcagaa

SEQ ID NO: 86249 - DNA, 20 bp, synthetic construct
  misc_feature 1..20: note = CRISPR gRNA sequence
  source 1..20: mol_type = other DNA
gcagaagggaacatcatacc

SEQ ID NO: 86250 - DNA, 20 bp, synthetic construct
  misc_feature 1..20: note = CRISPR gRNA sequence
  source 1..20: mol_type = other DNA
gaagggaacatcatacctag

SEQ ID NO: 86251 - DNA, 20 bp, synthetic construct
  misc_feature 1..20: note = CRISPR gRNA sequence
  source 1..20: mol_type = other DNA
aagctatgtacataatgact

SEQ ID NO: 86252 - DNA, 20 bp, synthetic construct
  misc_feature 1..20: note = CRISPR gRNA sequence
  source 1..20: mol_type = other DNA
agctatgtacataatgactg

SEQ ID NO: 86253 - DNA, 20 bp, synthetic construct
  misc_feature 1..20: note = CRISPR gRNA sequence
  source 1..20: mol_type = other DNA
tacataatgactgaggctgt

SEQ ID NO: 86254 - DNA, 20 bp, synthetic construct
  misc_feature 1..20: note = CRISPR gRNA sequence
  source 1..20: mol_type = other DNA
agccctcaaaacatgcccca

SEQ ID NO: 86255 - DNA, 20 bp, synthetic construct
  misc_feature 1..20: note = CRISPR gRNA sequence
  source 1..20: mol_type = other DNA
aaagacctctgacttttacc

SEQ ID NO: 86256 - DNA, 20 bp, synthetic construct
  misc_feature 1..20: note = CRISPR gRNA sequence
  source 1..20: mol_type = other DNA
aagacctctgacttttacct

SEQ ID NO: 86257 - DNA, 20 bp, synthetic construct
  misc_feature 1..20: note = CRISPR gRNA sequence
  source 1..20: mol_type = other DNA
gacctctgacttttacctgg

SEQ ID NO: 86258 - DNA, 20 bp, synthetic construct
  misc_feature 1..20: note = CRISPR gRNA sequence
  source 1..20: mol_type = other DNA
cctctgacttttacctggga

SEQ ID NO: 86259 - DNA, 20 bp, synthetic construct
  misc_feature 1..20: note = CRISPR gRNA sequence
  source 1..20: mol_type = other DNA
ctgacttttacctgggagag

SEQ ID NO: 86260 - DNA, 20 bp, synthetic construct
  misc_feature 1..20: note = CRISPR gRNA sequence
  source 1..20: mol_type = other DNA
gacttttacctgggagagaa

SEQ ID NO: 86261 - DNA, 20 bp, synthetic construct
  misc_feature 1..20: note = CRISPR gRNA sequence
  source 1..20: mol_type = other DNA
ttttacctgggagagaagag

SEQ ID NO: 86262 - DNA, 20 bp, synthetic construct
  misc_feature 1..20: note = CRISPR gRNA sequence
  source 1..20: mol_type = other DNA
ctgggagagaagagtggaat

SEQ ID NO: 86263 - DNA, 20 bp, synthetic construct
  misc_feature 1..20: note = CRISPR gRNA sequence
  source 1..20: mol_type = other DNA
ggagagaagagtggaattgg

SEQ ID NO: 86264 - DNA, 20 bp, synthetic construct
  misc_feature 1..20: note = CRISPR gRNA sequence
  source 1..20: mol_type = other DNA
gagagaagagtggaattgga

SEQ ID NO: 86265 - DNA, 20 bp, synthetic construct
  misc_feature 1..20: note = CRISPR gRNA sequence
  source 1..20: mol_type = other DNA
agtggaattggaaggtgatt

SEQ ID NO: 86266 - DNA, 20 bp, synthetic construct
  misc_feature 1..20: note = CRISPR gRNA sequence
  source 1..20: mol_type = other DNA
tgatttggtacttacactct

SEQ ID NO: 86267 - DNA, 20 bp, synthetic construct
  misc_feature 1..20: note = CRISPR gRNA sequence
  source 1..20: mol_type = other DNA
cttacactctcagaaccctt

SEQ ID NO: 86268 - DNA, 20 bp, synthetic construct
  misc_feature 1..20: note = CRISPR gRNA sequence
  source 1..20: mol_type = other DNA
ttacactctcagaacccttt

SEQ ID NO: 86269 - DNA, 20 bp, synthetic construct
  misc_feature 1..20: note = CRISPR gRNA sequence
  source 1..20: mol_type = other DNA
ctctcagaaccctttaggtc

SEQ ID NO: 86270 - DNA, 20 bp, synthetic construct
  misc_feature 1..20: note = CRISPR gRNA sequence
  source 1..20: mol_type = other DNA
agaaccctttaggtcaagtc

SEQ ID NO: 86271 - DNA, 20 bp, synthetic construct
  misc_feature 1..20: note = CRISPR gRNA sequence
  source 1..20: mol_type = other DNA
gaaccctttaggtcaagtcc

SEQ ID NO: 86272 - DNA, 20 bp, synthetic construct
  misc_feature 1..20: note = CRISPR gRNA sequence
  source 1..20: mol_type = other DNA
ccctttaggtcaagtccagg

SEQ ID NO: 86273 - DNA, 20 bp, synthetic construct
  misc_feature 1..20: note = CRISPR gRNA sequence
  source 1..20: mol_type = other DNA
cctttaggtcaagtccaggc

SEQ ID NO: 86274 - DNA, 20 bp, synthetic construct
  misc_feature 1..20: note = CRISPR gRNA sequence
  source 1..20: mol_type = other DNA
ctttaggtcaagtccaggca

SEQ ID NO: 86275 - DNA, 20 bp, synthetic construct
  misc_feature 1..20: note = CRISPR gRNA sequence
  source 1..20: mol_type = other DNA
tttaggtcaagtccaggcag

SEQ ID NO: 86276 - DNA, 20 bp, synthetic construct
  misc_feature 1..20: note = CRISPR gRNA sequence
  source 1..20: mol_type = other DNA
aggtcaagtccaggcagggg

SEQ ID NO: 86277 - DNA, 20 bp, synthetic construct
  misc_feature 1..20: note = CRISPR gRNA sequence
  source 1..20: mol_type = other DNA
aagtccaggcaggggtggca

SEQ ID NO: 86278 - DNA, 20 bp, synthetic construct
  misc_feature 1..20: note = CRISPR gRNA sequence
  source 1..20: mol_type = other DNA
gcaggggtggcatagacacc

SEQ ID NO: 86279 - DNA, 20 bp, synthetic construct
  misc_feature 1..20: note = CRISPR gRNA sequence
  source 1..20: mol_type = other DNA
caggggtggcatagacacca

SEQ ID NO: 86280 - DNA, 20 bp, synthetic construct
  misc_feature 1..20: note = CRISPR gRNA sequence
  source 1..20: mol_type = other DNA
tcttcctccttatgccactg

SEQ ID NO: 86281 - DNA, 20 bp, synthetic construct
  misc_feature 1..20: note = CRISPR gRNA sequence
  source 1..20: mol_type = other DNA
actgtagcaatatctgatgc

SEQ ID NO: 86282 - DNA, 20 bp, synthetic construct
  misc_feature 1..20: note = CRISPR gRNA sequence
  source 1..20: mol_type = other DNA
gcaatatctgatgcaagtta

SEQ ID NO: 86283 - DNA, 20 bp, synthetic construct
  misc_feature 1..20: note = CRISPR gRNA sequence
  source 1..20: mol_type = other DNA
aatatctgatgcaagttaaa

SEQ ID NO: 86284 - DNA, 20 bp, synthetic construct
  misc_feature 1..20: note = CRISPR gRNA sequence
  source 1..20: mol_type = other DNA
atctgatgcaagttaaagag

SEQ ID NO: 86285 - DNA, 20 bp, synthetic construct
  misc_feature 1..20: note = CRISPR gRNA sequence
  source 1..20: mol_type = other DNA
gttaaagagcagccaacaca

SEQ ID NO: 86286 - DNA, 20 bp, synthetic construct
  misc_feature 1..20: note = CRISPR gRNA sequence
  source 1..20: mol_type = other DNA
gccaacacatggcgatctcc

SEQ ID NO: 86287 - DNA, 20 bp, synthetic construct
  misc_feature 1..20: note = CRISPR gRNA sequence
  source 1..20: mol_type = other DNA
tggcgatctccaagcccctc

SEQ ID NO: 86288 - DNA, 20 bp, synthetic construct
  misc_feature 1..20: note = CRISPR gRNA sequence
  source 1..20: mol_type = other DNA
gatctccaagcccctcgagc

SEQ ID NO: 86289 - DNA, 20 bp, synthetic construct
  misc_feature 1..20: note = CRISPR gRNA sequence
  source 1..20: mol_type = other DNA
ccaagcccctcgagcaagtt

SEQ ID NO: 86290 - DNA, 20 bp, synthetic construct
  misc_feature 1..20: note = CRISPR gRNA sequence
  source 1..20: mol_type = other DNA
ctccttgctctccacatcct

SEQ ID NO: 86291 - DNA, 20 bp, synthetic construct
  misc_feature 1..20: note = CRISPR gRNA sequence
  source 1..20: mol_type = other DNA
cacatcctaagtcttcctcc

SEQ ID NO: 86292 - DNA, 20 bp, synthetic construct
  misc_feature 1..20: note = CRISPR gRNA sequence
  source 1..20: mol_type = other DNA
acatcctaagtcttcctccc

SEQ ID NO: 86293 - DNA, 20 bp, synthetic construct
  misc_feature 1..20: note = CRISPR gRNA sequence
  source 1..20: mol_type = other DNA
tcctccacccccaacctctc

SEQ ID NO: 86294 - DNA, 20 bp, synthetic construct
  misc_feature 1..20: note = CRISPR gRNA sequence
  source 1..20: mol_type = other DNA
cacccccaacctctctagtc

SEQ ID NO: 86295 - DNA, 20 bp, synthetic construct
  misc_feature 1..20: note = CRISPR gRNA sequence
  source 1..20: mol_type = other DNA
acccccaacctctctagtca

SEQ ID NO: 86296 - DNA, 20 bp, synthetic construct
  misc_feature 1..20: note = CRISPR gRNA sequence
  source 1..20: mol_type = other DNA
cctctctagtcaaggatact

SEQ ID NO: 86297 - DNA, 20 bp, synthetic construct
  misc_feature 1..20: note = CRISPR gRNA sequence
  source 1..20: mol_type = other DNA
ctagtcaaggatacttggac

SEQ ID NO: 86298 - DNA, 20 bp, synthetic construct
  misc_feature 1..20: note = CRISPR gRNA sequence
  source 1..20: mol_type = other DNA
aaggatacttggactggccc

SEQ ID NO: 86299 - DNA, 20 bp, synthetic construct
  misc_feature 1..20: note = CRISPR gRNA sequence
  source 1..20: mol_type = other DNA
ttggactggccccggccacc

SEQ ID NO: 86300 - DNA, 20 bp, synthetic construct
  misc_feature 1..20: note = CRISPR gRNA sequence
  source 1..20: mol_type = other DNA
gccccggccaccaagccttc

SEQ ID NO: 86301 - DNA, 20 bp, synthetic construct
  misc_feature 1..20: note = CRISPR gRNA sequence
  source 1..20: mol_type = other DNA
aagccttcgagctttgatgt

SEQ ID NO: 86302 - DNA, 20 bp, synthetic construct
  misc_feature 1..20: note = CRISPR gRNA sequence
  source 1..20: mol_type = other DNA
agccttcgagctttgatgtc

SEQ ID NO: 86303 - DNA, 20 bp, synthetic construct
  misc_feature 1..20: note = CRISPR gRNA sequence
  source 1..20: mol_type = other DNA
gccttcgagctttgatgtca

SEQ ID NO: 86304 - DNA, 20 bp, synthetic construct
  misc_feature 1..20: note = CRISPR gRNA sequence
  source 1..20: mol_type = other DNA
ttcgagctttgatgtcaggg

SEQ ID NO: 86305 - DNA, 20 bp, synthetic construct
  misc_feature 1..20: note = CRISPR gRNA sequence
  source 1..20: mol_type = other DNA
tctctctgatgatcttgcca

SEQ ID NO: 86306 - DNA, 20 bp, synthetic construct
  misc_feature 1..20: note = CRISPR gRNA sequence
  source 1..20: mol_type = other DNA
tctgatgatcttgccaaagt

SEQ ID NO: 86307 - DNA, 20 bp, synthetic construct
  misc_feature 1..20: note = CRISPR gRNA sequence
  source 1..20: mol_type = other DNA
ttgccaaagttggctgtgct

SEQ ID NO: 86308 - DNA, 20 bp, synthetic construct
  misc_feature 1..20: note = CRISPR gRNA sequence
  source 1..20: mol_type = other DNA
ccaaagttggctgtgctgag

SEQ ID NO: 86309 - DNA, 20 bp, synthetic construct
  misc_feature 1..20: note = CRISPR gRNA sequence
  source 1..20: mol_type = other DNA
caaagttggctgtgctgagt

SEQ ID NO: 86310 - DNA, 20 bp, synthetic construct
  misc_feature 1..20: note = CRISPR gRNA sequence
  source 1..20: mol_type = other DNA
agttggctgtgctgagtggg

SEQ ID NO: 86311 - DNA, 20 bp, synthetic construct
  misc_feature 1..20: note = CRISPR gRNA sequence
  source 1..20: mol_type = other DNA
ctgtgctgagtgggcggcaa

SEQ ID NO: 86312 - DNA, 20 bp, synthetic construct
  misc_feature 1..20: note = CRISPR gRNA sequence
  source 1..20: mol_type = other DNA
tgtgctgagtgggcggcaac

SEQ ID NO: 86313 - DNA, 20 bp, synthetic construct
  misc_feature 1..20: note = CRISPR gRNA sequence
  source 1..20: mol_type = other DNA
ctgagtgggcggcaacaggc

SEQ ID NO: 86314 - DNA, 20 bp, synthetic construct
  misc_feature 1..20: note = CRISPR gRNA sequence
  source 1..20: mol_type = other DNA
ggcaacaggcaagactctca

SEQ ID NO: 86315 - DNA, 20 bp, synthetic construct
  misc_feature 1..20: note = CRISPR gRNA sequence
  source 1..20: mol_type = other DNA
agactctcacagtacttcct

SEQ ID NO: 86316 - DNA, 20 bp, synthetic construct
  misc_feature 1..20: note = CRISPR gRNA sequence
  source 1..20: mol_type = other DNA
tctcacagtacttcctgagt

SEQ ID NO: 86317 - DNA, 20 bp, synthetic construct
  misc_feature 1..20: note = CRISPR gRNA sequence
  source 1..20: mol_type = other DNA
tcacagtacttcctgagtga

SEQ ID NO: 86318 - DNA, 20 bp, synthetic construct
  misc_feature 1..20: note = CRISPR gRNA sequence
  source 1..20: mol_type = other DNA
cacagtacttcctgagtgag

SEQ ID NO: 86319 - DNA, 20 bp, synthetic construct
  misc_feature 1..20: note = CRISPR gRNA sequence
  source 1..20: mol_type = other DNA
acagtacttcctgagtgaga

SEQ ID NO: 86320 - DNA, 20 bp, synthetic construct
  misc_feature 1..20: note = CRISPR gRNA sequence
  source 1..20: mol_type = other DNA
cagtacttcctgagtgagag

SEQ ID NO: 86321 - DNA, 20 bp, synthetic construct
  misc_feature 1..20: note = CRISPR gRNA sequence
  source 1..20: mol_type = other DNA
gtacttcctgagtgagaggg

SEQ ID NO: 86322 - DNA, 20 bp, synthetic construct
  misc_feature 1..20: note = CRISPR gRNA sequence
  source 1..20: mol_type = other DNA
cttcctgagtgagaggggag

SEQ ID NO: 86323 - DNA, 20 bp, synthetic construct
  misc_feature 1..20: note = CRISPR gRNA sequence
  source 1..20: mol_type = other DNA
tcctgagtgagaggggagca

SEQ ID NO: 86324 - DNA, 20 bp, synthetic construct
  misc_feature 1..20: note = CRISPR gRNA sequence
  source 1..20: mol_type = other DNA
tgagtgagaggggagcagag

SEQ ID NO: 86325 - DNA, 20 bp, synthetic construct
  misc_feature 1..20: note = CRISPR gRNA sequence
  source 1..20: mol_type = other DNA
gagtgagaggggagcagagt

SEQ ID NO: 86326 - DNA, 20 bp, synthetic construct
  misc_feature 1..20: note = CRISPR gRNA sequence
  source 1..20: mol_type = other DNA
tgagaggggagcagagtggg

SEQ ID NO: 86327 - DNA, 20 bp, synthetic construct
  misc_feature 1..20: note = CRISPR gRNA sequence
  source 1..20: mol_type = other DNA
gagcagagtgggaagatact

SEQ ID NO: 86328 - DNA, 20 bp, synthetic construct
  misc_feature 1..20: note = CRISPR gRNA sequence
  source 1..20: mol_type = other DNA
gcagagtgggaagatactca

SEQ ID NO: 86329 - DNA, 20 bp, synthetic construct
  misc_feature 1..20: note = CRISPR gRNA sequence
  source 1..20: mol_type = other DNA
gagtgggaagatactcagag

SEQ ID NO: 86330 - DNA, 20 bp, synthetic construct
  misc_feature 1..20: note = CRISPR gRNA sequence
  source 1..20: mol_type = other DNA
agtgggaagatactcagaga

SEQ ID NO: 86331 - DNA, 20 bp, synthetic construct
  misc_feature 1..20: note = CRISPR gRNA sequence
  source 1..20: mol_type = other DNA
tgggaagatactcagagaag

SEQ ID NO: 86332 - DNA, 20 bp, synthetic construct
  misc_feature 1..20: note = CRISPR gRNA sequence
  source 1..20: mol_type = other DNA
gggaagatactcagagaagg

SEQ ID NO: 86333 - DNA, 20 bp, synthetic construct
  misc_feature 1..20: note = CRISPR gRNA sequence
  source 1..20: mol_type = other DNA
atactcagagaaggaggcca

SEQ ID NO: 86334 - DNA, 20 bp, synthetic construct
  misc_feature 1..20: note = CRISPR gRNA sequence
  source 1..20: mol_type = other DNA
tactcagagaaggaggccat

SEQ ID NO: 86335 - DNA, 20 bp, synthetic construct
  misc_feature 1..20: note = CRISPR gRNA sequence
  source 1..20: mol_type = other DNA
tcagagaaggaggccatggg

SEQ ID NO: 86336 - DNA, 20 bp, synthetic construct
  misc_feature 1..20: note = CRISPR gRNA sequence
  source 1..20: mol_type = other DNA
cagagaaggaggccatgggt

SEQ ID NO: 86337 - DNA, 20 bp, synthetic construct
  misc_feature 1..20: note = CRISPR gRNA sequence
  source 1..20: mol_type = other DNA
ggaggccatgggtaggctcg

SEQ ID NO: 86338 - DNA, 20 bp, synthetic construct
  misc_feature 1..20: note = CRISPR gRNA sequence
  source 1..20: mol_type = other DNA
aggccatgggtaggctcgaa

SEQ ID NO: 86339 - DNA, 20 bp, synthetic construct
  misc_feature 1..20: note = CRISPR gRNA sequence
  source 1..20: mol_type = other DNA
gggtaggctcgaagagtccc

SEQ ID NO: 86340 - DNA, 20 bp, synthetic construct
  misc_feature 1..20: note = CRISPR gRNA sequence
  source 1..20: mol_type = other DNA
ggtaggctcgaagagtccct

SEQ ID NO: 86341 - DNA, 20 bp, synthetic construct
  misc_feature 1..20: note = CRISPR gRNA sequence
  source 1..20: mol_type = other DNA
gtaggctcgaagagtcccta

SEQ ID NO: 86342 - DNA, 20 bp, synthetic construct
  misc_feature 1..20: note = CRISPR gRNA sequence
  source 1..20: mol_type = other DNA
tcgaagagtccctagggatc

SEQ ID NO: 86343 - DNA, 20 bp, synthetic construct
  misc_feature 1..20: note = CRISPR gRNA sequence
  source 1..20: mol_type = other DNA
agtccctagggatcaagtgt

SEQ ID NO: 86344 - DNA, 20 bp, synthetic construct
  misc_feature 1..20: note = CRISPR gRNA sequence
  source 1..20: mol_type = other DNA
gtccctagggatcaagtgtg

SEQ ID NO: 86345 - DNA, 20 bp, synthetic construct
  misc_feature 1..20: note = CRISPR gRNA sequence
  source 1..20: mol_type = other DNA
tcaagtgtgaggaacccttt

SEQ ID NO: 86346 - DNA, 20 bp, synthetic construct
  misc_feature 1..20: note = CRISPR gRNA sequence
  source 1..20: mol_type = other DNA
agtgtgaggaaccctttaag

SEQ ID NO: 86347 - DNA, 20 bp, synthetic construct
  misc_feature 1..20: note = CRISPR gRNA sequence
  source 1..20: mol_type = other DNA
gtgtgaggaaccctttaaga

SEQ ID NO: 86348 - DNA, 20 bp, synthetic construct
  misc_feature 1..20: note = CRISPR gRNA sequence
  source 1..20: mol_type = other DNA
tgaggaaccctttaagaagg

SEQ ID NO: 86349 - DNA, 20 bp, synthetic construct
  misc_feature 1..20: note = CRISPR gRNA sequence
  source 1..20: mol_type = other DNA
gaggaaccctttaagaaggc

SEQ ID NO: 86350 - DNA, 20 bp, synthetic construct
  misc_feature 1..20: note = CRISPR gRNA sequence
  source 1..20: mol_type = other DNA
ttaagaaggcaggctttatc

SEQ ID NO: 86351 - DNA, 20 bp, synthetic construct
  misc_feature 1..20: note = CRISPR gRNA sequence
  source 1..20: mol_type = other DNA
taagaaggcaggctttatca

SEQ ID NO: 86352 - DNA, 20 bp, synthetic construct
  misc_feature 1..20: note = CRISPR gRNA sequence
  source 1..20: mol_type = other DNA
gaaggcaggctttatcaagg

SEQ ID NO: 86353 - DNA, 20 bp, synthetic construct
  misc_feature 1..20: note = CRISPR gRNA sequence
  source 1..20: mol_type = other DNA
aaggcaggctttatcaaggc

SEQ ID NO: 86354 - DNA, 20 bp, synthetic construct
  misc_feature 1..20: note = CRISPR gRNA sequence
  source 1..20: mol_type = other DNA
gcaggctttatcaaggcagg

SEQ ID NO: 86355 - DNA, 20 bp, synthetic construct
  misc_feature 1..20: note = CRISPR gRNA sequence
  source 1..20: mol_type = other DNA
tcaaggcaggaagctcttca

SEQ ID NO: 86356 - DNA, 20 bp, synthetic construct
  misc_feature 1..20: note = CRISPR gRNA sequence
  source 1..20: mol_type = other DNA
caaggcaggaagctcttcat

SEQ ID NO: 86357 - DNA, 20 bp, synthetic construct
  misc_feature 1..20: note = CRISPR gRNA sequence
  source 1..20: mol_type = other DNA
gcaggaagctcttcatgggt

SEQ ID NO: 86358 - DNA, 20 bp, synthetic construct
  misc_feature 1..20: note = CRISPR gRNA sequence
  source 1..20: mol_type = other DNA
caggaagctcttcatgggtg

SEQ ID NO: 86359 - DNA, 20 bp, synthetic construct
  misc_feature 1..20: note = CRISPR gRNA sequence
  source 1..20: mol_type = other DNA
aggaagctcttcatgggtga

SEQ ID NO: 86360 - DNA, 20 bp, synthetic construct
  misc_feature 1..20: note = CRISPR gRNA sequence
  source 1..20: mol_type = other DNA
ggaagctcttcatgggtgag

SEQ ID NO: 86361 - DNA, 20 bp, synthetic construct
  misc_feature 1..20: note = CRISPR gRNA sequence
  source 1..20: mol_type = other DNA
gaagctcttcatgggtgagg

SEQ ID NO: 86362 - DNA, 20 bp, synthetic construct
  misc_feature 1..20: note = CRISPR gRNA sequence
  source 1..20: mol_type = other DNA
cccacccctccacccaccga

SEQ ID NO: 86363 - DNA, 20 bp, synthetic construct
  misc_feature 1..20: note = CRISPR gRNA sequence
  source 1..20: mol_type = other DNA
ccacccctccacccaccgat

SEQ ID NO: 86364 - DNA, 20 bp, synthetic construct
  misc_feature 1..20: note = CRISPR gRNA sequence
  source 1..20: mol_type = other DNA
gcatcataaacactttgctt

SEQ ID NO: 86365 - DNA, 20 bp, synthetic construct
  misc_feature 1..20: note = CRISPR gRNA sequence
  source 1..20: mol_type = other DNA
tcataaacactttgctttgg

SEQ ID NO: 86366 - DNA, 20 bp, synthetic construct
  misc_feature 1..20: note = CRISPR gRNA sequence
  source 1..20: mol_type = other DNA
aaacactttgctttggcaga

SEQ ID NO: 86367 - DNA, 20 bp, synthetic construct
  misc_feature 1..20: note = CRISPR gRNA sequence
  source 1..20: mol_type = other DNA
aacactttgctttggcagac

SEQ ID NO: 86368 - DNA, 20 bp, synthetic construct
  misc_feature 1..20: note = CRISPR gRNA sequence
  source 1..20: mol_type = other DNA
ttgctttggcagacaggtgt

SEQ ID NO: 86369 - DNA, 20 bp, synthetic construct
  misc_feature 1..20: note = CRISPR gRNA sequence
  source 1..20: mol_type = other DNA
caggtgtcagtgtgctcttc

SEQ ID NO: 86370 - DNA, 20 bp, synthetic construct
  misc_feature 1..20: note = CRISPR gRNA sequence
  source 1..20: mol_type = other DNA
aggtgtcagtgtgctcttcc

SEQ ID NO: 86371 - DNA, 20 bp, synthetic construct
  misc_feature 1..20: note = CRISPR gRNA sequence
  source 1..20: mol_type = other DNA
tgtcagtgtgctcttccagg

SEQ ID NO: 86372 - DNA, 20 bp, synthetic construct
  misc_feature 1..20: note = CRISPR gRNA sequence
  source 1..20: mol_type = other DNA
tgtgctcttccaggtggttg

SEQ ID NO: 86373 - DNA, 20 bp, synthetic construct
  misc_feature 1..20: note = CRISPR gRNA sequence
  source 1..20: mol_type = other DNA
ggtggttgcggatccaccta

SEQ ID NO: 86374 - DNA, 20 bp, synthetic construct
  misc_feature 1..20: note = CRISPR gRNA sequence
  source 1..20: mol_type = other DNA
gtggttgcggatccacctat

SEQ ID NO: 86375 - DNA, 20 bp, synthetic construct
  misc_feature 1..20: note = CRISPR gRNA sequence
  source 1..20: mol_type = other DNA
tacatgtactcctcattgct

SEQ ID NO: 86376 - DNA, 20 bp, synthetic construct
  misc_feature 1..20: note = CRISPR gRNA sequence
  source 1..20: mol_type = other DNA
tcctcattgctcagtgtact

SEQ ID NO: 86377 - DNA, 20 bp, synthetic construct
  misc_feature 1..20: note = CRISPR gRNA sequence
  source 1..20: mol_type = other DNA
tgctcagtgtacttggctct

SEQ ID NO: 86378 - DNA, 20 bp, synthetic construct
  misc_feature 1..20: note = CRISPR gRNA sequence
  source 1..20: mol_type = other DNA
gtgtacttggctctgagcta

SEQ ID NO: 86379 - DNA, 20 bp, synthetic construct
  misc_feature 1..20: note = CRISPR gRNA sequence
  source 1..20: mol_type = other DNA
gctctgagctacagaaacaa

SEQ ID NO: 86380 - DNA, 20 bp, synthetic construct
  misc_feature 1..20: note = CRISPR gRNA sequence
  source 1..20: mol_type = other DNA
ctctgagctacagaaacaaa

SEQ ID NO: 86381 - DNA, 20 bp, synthetic construct
  misc_feature 1..20: note = CRISPR gRNA sequence
  source 1..20: mol_type = other DNA
gctacagaaacaaaaggaac

SEQ ID NO: 86382 - DNA, 20 bp, synthetic construct
  misc_feature 1..20: note = CRISPR gRNA sequence
  source 1..20: mol_type = other DNA
caaaaggaacaagcattact

SEQ ID NO: 86383 - DNA, 20 bp, synthetic construct
  misc_feature 1..20: note = CRISPR gRNA sequence
  source 1..20: mol_type = other DNA
aagcattactaagaccctaa

SEQ ID NO: 86384 - DNA, 20 bp, synthetic construct
  misc_feature 1..20: note = CRISPR gRNA sequence
  source 1..20: mol_type = other DNA
taagaccctaacagttgtcc

SEQ ID NO: 86385 - DNA, 20 bp, synthetic construct
  misc_feature 1..20: note = CRISPR gRNA sequence
  source 1..20: mol_type = other DNA
ttcttcccaaactaccactt

SEQ ID NO: 86386 - DNA, 20 bp, synthetic construct
  misc_feature 1..20: note = CRISPR gRNA sequence
  source 1..20: mol_type = other DNA
ttcccaaactaccacttcag

SEQ ID NO: 86387 - DNA, 20 bp, synthetic construct
  misc_feature 1..20: note = CRISPR gRNA sequence
  source 1..20: mol_type = other DNA
aactaccacttcagtagtgc

SEQ ID NO: 86388 - DNA, 20 bp, synthetic construct
  misc_feature 1..20: note = CRISPR gRNA sequence
  source 1..20: mol_type = other DNA
cagtagtgctggaccaaatt

SEQ ID NO: 86389 - DNA, 20 bp, synthetic construct
  misc_feature 1..20: note = CRISPR gRNA sequence
  source 1..20: mol_type = other DNA
tggaccaaatttagttcacc

SEQ ID NO: 86390 - DNA, 20 bp, synthetic construct
  misc_feature 1..20: note = CRISPR gRNA sequence
  source 1..20: mol_type = other DNA
acccagaatctaactttccc

SEQ ID NO: 86391 - DNA, 20 bp, synthetic construct
  misc_feature 1..20: note = CRISPR gRNA sequence
  source 1..20: mol_type = other DNA
ctaactttccctggtaaacc

SEQ ID NO: 86392 - DNA, 20 bp, synthetic construct
  misc_feature 1..20: note = CRISPR gRNA sequence
  source 1..20: mol_type = other DNA
ctttccctggtaaaccaagt

SEQ ID NO: 86393 - DNA, 20 bp, synthetic construct
  misc_feature 1..20: note = CRISPR gRNA sequence
  source 1..20: mol_type = other DNA
tttccctggtaaaccaagtc

SEQ ID NO: 86394 - DNA, 20 bp, synthetic construct
  misc_feature 1..20: note = CRISPR gRNA sequence
  source 1..20: mol_type = other DNA
ttccctggtaaaccaagtca

SEQ ID NO: 86395 - DNA, 20 bp, synthetic construct
  misc_feature 1..20: note = CRISPR gRNA sequence
  source 1..20: mol_type = other DNA
ctggtaaaccaagtcagggc

SEQ ID NO: 86396 - DNA, 20 bp, synthetic construct
  misc_feature 1..20: note = CRISPR gRNA sequence
  source 1..20: mol_type = other DNA
tggtaaaccaagtcagggcg

SEQ ID NO: 86397 - DNA, 20 bp, synthetic construct
  misc_feature 1..20: note = CRISPR gRNA sequence
  source 1..20: mol_type = other DNA
gaggacctttcctcttcatc

SEQ ID NO: 86398 - DNA, 20 bp, synthetic construct
  misc_feature 1..20: note = CRISPR gRNA sequence
  source 1..20: mol_type = other DNA
aggacctttcctcttcatca

SEQ ID NO: 86399 - DNA, 20 bp, synthetic construct
  misc_feature 1..20: note = CRISPR gRNA sequence
  source 1..20: mol_type = other DNA
cctttcctcttcatcaagga

SEQ ID NO: 86400 - DNA, 20 bp, synthetic construct
  misc_feature 1..20: note = CRISPR gRNA sequence
  source 1..20: mol_type = other DNA
tcatcaaggacagcatttac

SEQ ID NO: 86401 - DNA, 20 bp, synthetic construct
  misc_feature 1..20: note = CRISPR gRNA sequence
  source 1..20: mol_type = other DNA
ctattcacctcaccccttcc

SEQ ID NO: 86402 - DNA, 20 bp, synthetic construct
  misc_feature 1..20: note = CRISPR gRNA sequence
  source 1..20: mol_type = other DNA
ttcccagtgaacctttctct

SEQ ID NO: 86403 - DNA, 20 bp, synthetic construct
  misc_feature 1..20: note = CRISPR gRNA sequence
  source 1..20: mol_type = other DNA
gtgaacctttctctaagaat

SEQ ID NO: 86404 - DNA, 20 bp, synthetic construct
  misc_feature 1..20: note = CRISPR gRNA sequence
  source 1..20: mol_type = other DNA
tcaaacctaccttttgtctc

SEQ ID NO: 86405 - DNA, 20 bp, synthetic construct
  misc_feature 1..20: note = CRISPR gRNA sequence
  source 1..20: mol_type = other DNA
aacctaccttttgtctccag

SEQ ID NO: 86406 - DNA, 20 bp, synthetic construct
  misc_feature 1..20: note = CRISPR gRNA sequence
  source 1..20: mol_type = other DNA
ctaccttttgtctccagtgg

SEQ ID NO: 86407 - DNA, 20 bp, synthetic construct
  misc_feature 1..20: note = CRISPR gRNA sequence
  source 1..20: mol_type = other DNA
taccttttgtctccagtggt

SEQ ID NO: 86408 - DNA, 20 bp, synthetic construct
  misc_feature 1..20: note = CRISPR gRNA sequence
  source 1..20: mol_type = other DNA
tgtctccagtggtgggtcct

SEQ ID NO: 86409 - DNA, 20 bp, synthetic construct
  misc_feature 1..20: note = CRISPR gRNA sequence
  source 1..20: mol_type = other DNA
gtctccagtggtgggtcctg

SEQ ID NO: 86410 - DNA, 20 bp, synthetic construct
  misc_feature 1..20: note = CRISPR gRNA sequence
  source 1..20: mol_type = other DNA
tctccagtggtgggtcctga

SEQ ID NO: 86411 - DNA, 20 bp, synthetic construct
  misc_feature 1..20: note = CRISPR gRNA sequence
  source 1..20: mol_type = other DNA
ctccagtggtgggtcctgag

SEQ ID NO: 86412 - DNA, 20 bp, synthetic construct
  misc_feature 1..20: note = CRISPR gRNA sequence
  source 1..20: mol_type = other DNA
ccagtggtgggtcctgaggg

SEQ ID NO: 86413 - DNA, 20 bp, synthetic construct
  misc_feature 1..20: note = CRISPR gRNA sequence
  source 1..20: mol_type = other DNA
gtgggtcctgaggggagctg

SEQ ID NO: 86414 - DNA, 20 bp, synthetic construct
  misc_feature 1..20: note = CRISPR gRNA sequence
  source 1..20: mol_type = other DNA
tgggtcctgaggggagctga

SEQ ID NO: 86415 - DNA, 20 bp, synthetic construct
  misc_feature 1..20: note = CRISPR gRNA sequence
  source 1..20: mol_type = other DNA
gtcctgaggggagctgaagg

SEQ ID NO: 86416 - DNA, 20 bp, synthetic construct
  misc_feature 1..20: note = CRISPR gRNA sequence
  source 1..20: mol_type = other DNA
cctgaggggagctgaaggta

SEQ ID NO: 86417 - DNA, 20 bp, synthetic construct
  misc_feature 1..20: note = CRISPR gRNA sequence
  source 1..20: mol_type = other DNA
gggagctgaaggtagagata

SEQ ID NO: 86418 - DNA, 20 bp, synthetic construct
  misc_feature 1..20: note = CRISPR gRNA sequence
  source 1..20: mol_type = other DNA
gagatacagcttgtcattgt

SEQ ID NO: 86419 - DNA, 20 bp, synthetic construct
  misc_feature 1..20: note = CRISPR gRNA sequence
  source 1..20: mol_type = other DNA
aaatttctgtacatcttgct

SEQ ID NO: 86420 - DNA, 20 bp, synthetic construct
  misc_feature 1..20: note = CRISPR gRNA sequence
  source 1..20: mol_type = other DNA
aatttctgtacatcttgctg

SEQ ID NO: 86421 - DNA, 20 bp, synthetic construct
  misc_feature 1..20: note = CRISPR gRNA sequence
  source 1..20: mol_type = other DNA
ttctgtacatcttgctgagg

SEQ ID NO: 86422 - DNA, 20 bp, synthetic construct
  misc_feature 1..20: note = CRISPR gRNA sequence
  source 1..20: mol_type = other DNA
tctgtacatcttgctgaggt

SEQ ID NO: 86423 - DNA, 20 bp, synthetic construct
  misc_feature 1..20: note = CRISPR gRNA sequence
  source 1..20: mol_type = other DNA
tgtacatcttgctgaggtag

SEQ ID NO: 86424 - DNA, 20 bp, synthetic construct
  misc_feature 1..20: note = CRISPR gRNA sequence
  source 1..20: mol_type = other DNA
tacatcttgctgaggtagga

SEQ ID NO: 86425 - DNA, 20 bp, synthetic construct
  misc_feature 1..20: note = CRISPR gRNA sequence
  source 1..20: mol_type = other DNA
cttgctgaggtaggagagaa

SEQ ID NO: 86426 - DNA, 20 bp, synthetic construct
  misc_feature 1..20: note = CRISPR gRNA sequence
  source 1..20: mol_type = other DNA
tgctgaggtaggagagaaca

SEQ ID NO: 86427 - DNA, 20 bp, synthetic construct
  misc_feature 1..20: note = CRISPR gRNA sequence
  source 1..20: mol_type = other DNA
gctgaggtaggagagaacag

SEQ ID NO: 86428 - DNA, 20 bp, synthetic construct
  misc_feature 1..20: note = CRISPR gRNA sequence
  source 1..20: mol_type = other DNA
gaggtaggagagaacagagg

SEQ ID NO: 86429 - DNA, 20 bp, synthetic construct
  misc_feature 1..20: note = CRISPR gRNA sequence
  source 1..20: mol_type = other DNA
aggtaggagagaacagaggc

SEQ ID NO: 86430 - DNA, 20 bp, synthetic construct
  misc_feature 1..20: note = CRISPR gRNA sequence
  source 1..20: mol_type = other DNA
gtaggagagaacagaggcag

SEQ ID NO: 86431 - DNA, 20 bp, synthetic construct
  misc_feature 1..20: note = CRISPR gRNA sequence
  source 1..20: mol_type = other DNA
acagaggcaggagaaataat

SEQ ID NO: 86432 - DNA, 20 bp, synthetic construct
  misc_feature 1..20: note = CRISPR gRNA sequence
  source 1..20: mol_type = other DNA
cagaggcaggagaaataata

SEQ ID NO: 86433 - DNA, 20 bp, synthetic construct
  misc_feature 1..20: note = CRISPR gRNA sequence
  source 1..20: mol_type = other DNA
gcaggagaaataataaggcc

SEQ ID NO: 86434 - DNA, 20 bp, synthetic construct
  misc_feature 1..20: note = CRISPR gRNA sequence
  source 1..20: mol_type = other DNA
ggagaaataataaggccaag

SEQ ID NO: 86435 - DNA, 20 bp, synthetic construct
  misc_feature 1..20: note = CRISPR gRNA sequence
  source 1..20: mol_type = other DNA
gagaaataataaggccaaga

SEQ ID NO: 86436 - DNA, 20 bp, synthetic construct
  misc_feature 1..20: note = CRISPR gRNA sequence
  source 1..20: mol_type = other DNA
aggccaagaaggacccaata

SEQ ID NO: 86437 - DNA, 20 bp, synthetic construct
  misc_feature 1..20: note = CRISPR gRNA sequence
  source 1..20: mol_type = other DNA
ggccaagaaggacccaatat

SEQ ID NO: 86438 - DNA, 20 bp, synthetic construct
  misc_feature 1..20: note = CRISPR gRNA sequence
  source 1..20: mol_type = other DNA
accctctgatccccacacca

SEQ ID NO: 86439 - DNA, 20 bp, synthetic construct
  misc_feature 1..20: note = CRISPR gRNA sequence
  source 1..20: mol_type = other DNA
ctgatccccacaccaaagtc

SEQ ID NO: 86440 - DNA, 20 bp, synthetic construct
  misc_feature 1..20: note = CRISPR gRNA sequence
  source 1..20: mol_type = other DNA
accaaagtctagctgactta

SEQ ID NO: 86441 - DNA, 20 bp, synthetic construct
  misc_feature 1..20: note = CRISPR gRNA sequence
  source 1..20: mol_type = other DNA
ccaaagtctagctgacttac

SEQ ID NO: 86442 - DNA, 20 bp, synthetic construct
  misc_feature 1..20: note = CRISPR gRNA sequence
  source 1..20: mol_type = other DNA
caaagtctagctgacttaca

SEQ ID NO: 86443 - DNA, 20 bp, synthetic construct
  misc_feature 1..20: note = CRISPR gRNA sequence
  source 1..20: mol_type = other DNA
ctagctgacttacagggtgt

SEQ ID NO: 86444 - DNA, 20 bp, synthetic construct
  misc_feature 1..20: note = CRISPR gRNA sequence
  source 1..20: mol_type = other DNA
tacagggtgtcagactgaaa

SEQ ID NO: 86445 - DNA, 20 bp, synthetic construct
  misc_feature 1..20: note = CRISPR gRNA sequence
  source 1..20: mol_type = other DNA
acagggtgtcagactgaaaa

SEQ ID NO: 86446 - DNA, 20 bp, synthetic construct
  misc_feature 1..20: note = CRISPR gRNA sequence
  source 1..20: mol_type = other DNA
gtcagactgaaaaaggacct

SEQ ID NO: 86447 - DNA, 20 bp, synthetic construct
  misc_feature 1..20: note = CRISPR gRNA sequence
  source 1..20: mol_type = other DNA
gaccttagaaattatttgac

SEQ ID NO: 86448 - DNA, 20 bp, synthetic construct
  misc_feature 1..20: note = CRISPR gRNA sequence
  source 1..20: mol_type = other DNA
accttagaaattatttgaca

SEQ ID NO: 86449 - DNA, 20 bp, synthetic construct
  misc_feature 1..20: note = CRISPR gRNA sequence
  source 1..20: mol_type = other DNA
tagaaattatttgacaaggc

SEQ ID NO: 86450 - DNA, 20 bp, synthetic construct
  misc_feature 1..20: note = CRISPR gRNA sequence
  source 1..20: mol_type = other DNA
agaaattatttgacaaggcc

SEQ ID NO: 86451 - DNA, 20 bp, synthetic construct
  misc_feature 1..20: note = CRISPR gRNA sequence
  source 1..20: mol_type = other DNA
ttatttgacaaggccgggca

SEQ ID NO: 86452 - DNA, 20 bp, synthetic construct
  misc_feature 1..20: note = CRISPR gRNA sequence
  source 1..20: mol_type = other DNA
tttgacaaggccgggcacgg

SEQ ID NO: 86453 - DNA, 20 bp, synthetic construct
  misc_feature 1..20: note = CRISPR gRNA sequence
  source 1..20: mol_type = other DNA
gtggctcacgcctacaatcc

SEQ ID NO: 86454 - DNA, 20 bp, synthetic construct
  misc_feature 1..20: note = CRISPR gRNA sequence
  source 1..20: mol_type = other DNA
cgcctacaatcccagcactt

SEQ ID NO: 86455 - DNA, 20 bp, synthetic construct
  misc_feature 1..20: note = CRISPR gRNA sequence
  source 1..20: mol_type = other DNA
ctacaatcccagcactttgg

SEQ ID NO: 86456 - DNA, 20 bp, synthetic construct
  misc_feature 1..20: note = CRISPR gRNA sequence
  source 1..20: mol_type = other DNA
tacaatcccagcactttgga

SEQ ID NO: 86457 - DNA, 20 bp, synthetic construct
  misc_feature 1..20: note = CRISPR gRNA sequence
  source 1..20: mol_type = other DNA
tcccagcactttggaaggcc

SEQ ID NO: 86458 - DNA, 20 bp, synthetic construct
  misc_feature 1..20: note = CRISPR gRNA sequence
  source 1..20: mol_type = other DNA
cccagcactttggaaggcca

SEQ ID NO: 86459 - DNA, 20 bp, synthetic construct
  misc_feature 1..20: note = CRISPR gRNA sequence
  source 1..20: mol_type = other DNA
agcactttggaaggccaagg

SEQ ID NO: 86460 - DNA, 20 bp, synthetic construct
  misc_feature 1..20: note = CRISPR gRNA sequence
  source 1..20: mol_type = other DNA
gcactttggaaggccaaggc

SEQ ID NO: 86461 - DNA, 20 bp, synthetic construct
  misc_feature 1..20: note = CRISPR gRNA sequence
  source 1..20: mol_type = other DNA
ggccaaggcaggctgatcac

SEQ ID NO: 86462 - DNA, 20 bp, synthetic construct
  misc_feature 1..20: note = CRISPR gRNA sequence
  source 1..20: mol_type = other DNA
gccaaggcaggctgatcaca

SEQ ID NO: 86463 - DNA, 20 bp, synthetic construct
  misc_feature 1..20: note = CRISPR gRNA sequence
  source 1..20: mol_type = other DNA
aggcaggctgatcacaaggt

SEQ ID NO: 86464 - DNA, 20 bp, synthetic construct
  misc_feature 1..20: note = CRISPR gRNA sequence
  source 1..20: mol_type = other DNA
ggcaggctgatcacaaggtc

SEQ ID NO: 86465 - DNA, 20 bp, synthetic construct
  misc_feature 1..20: note = CRISPR gRNA sequence
  source 1..20: mol_type = other DNA
caggctgatcacaaggtcag

SEQ ID NO: 86466 - DNA, 20 bp, synthetic construct
  misc_feature 1..20: note = CRISPR gRNA sequence
  source 1..20: mol_type = other DNA
gatcacaaggtcaggagatc

SEQ ID NO: 86467 - DNA, 20 bp, synthetic construct
  misc_feature 1..20: note = CRISPR gRNA sequence
  source 1..20: mol_type = other DNA
tcaggagatcgagaccatcc

SEQ ID NO: 86468 - DNA, 20 bp, synthetic construct
  misc_feature 1..20: note = CRISPR gRNA sequence
  source 1..20: mol_type = other DNA
cgagaccatcctggctaaca

SEQ ID NO: 86469 - DNA, 20 bp, synthetic construct
  misc_feature 1..20: note = CRISPR gRNA sequence
  source 1..20: mol_type = other DNA
ctaaaaatacaaaaaaaaat

SEQ ID NO: 86470 - DNA, 20 bp, synthetic construct
  misc_feature 1..20: note = CRISPR gRNA sequence
  source 1..20: mol_type = other DNA
aaatacaaaaaaaaattagc

SEQ ID NO: 86471 - DNA, 20 bp, synthetic construct
  misc_feature 1..20: note = CRISPR gRNA sequence
  source 1..20: mol_type = other DNA
aatacaaaaaaaaattagct

SEQ ID NO: 86472 - DNA, 20 bp, synthetic construct
  misc_feature 1..20: note = CRISPR gRNA sequence
  source 1..20: mol_type = other DNA
aaaaaaaaattagctgggtg

SEQ ID NO: 86473 - DNA, 20 bp, synthetic construct
  misc_feature 1..20: note = CRISPR gRNA sequence
  source 1..20: mol_type = other DNA
aaattagctgggtgtggtga

SEQ ID NO: 86474 - DNA, 20 bp, synthetic construct
  misc_feature 1..20: note = CRISPR gRNA sequence
  source 1..20: mol_type = other DNA
aattagctgggtgtggtgac

SEQ ID NO: 86475 - DNA, 20 bp, synthetic construct
  misc_feature 1..20: note = CRISPR gRNA sequence
  source 1..20: mol_type = other DNA
ggtgtggtgacgggcgcctg

SEQ ID NO: 86476 - DNA, 20 bp, synthetic construct
  misc_feature 1..20: note = CRISPR gRNA sequence
  source 1..20: mol_type = other DNA
gtgacgggcgcctgtagtcc

SEQ ID NO: 86477 - DNA, 20 bp, synthetic construct
  misc_feature 1..20: note = CRISPR gRNA sequence
  source 1..20: mol_type = other DNA
cgcctgtagtcccagctact

SEQ ID NO: 86478 - DNA, 20 bp, synthetic construct
  misc_feature 1..20: note = CRISPR gRNA sequence
  source 1..20: mol_type = other DNA
gcctgtagtcccagctactt

SEQ ID NO: 86479 - DNA, 20 bp, synthetic construct
  misc_feature 1..20: note = CRISPR gRNA sequence
  source 1..20: mol_type = other DNA
ctgtagtcccagctacttgg

SEQ ID NO: 86480 - DNA, 20 bp, synthetic construct
  misc_feature 1..20: note = CRISPR gRNA sequence
  source 1..20: mol_type = other DNA
tgtagtcccagctacttggg

SEQ ID NO: 86481 - DNA, 20 bp, synthetic construct
  misc_feature 1..20: note = CRISPR gRNA sequence
  source 1..20: mol_type = other DNA
tcccagctacttgggaggct

SEQ ID NO: 86482 - DNA, 20 bp, synthetic construct
  misc_feature 1..20: note = CRISPR gRNA sequence
  source 1..20: mol_type = other DNA
cccagctacttgggaggctg

SEQ ID NO: 86483 - DNA, 20 bp, synthetic construct
  misc_feature 1..20: note = CRISPR gRNA sequence
  source 1..20: mol_type = other DNA
agctacttgggaggctgagg

SEQ ID NO: 86484 - DNA, 20 bp, synthetic construct
  misc_feature 1..20: note = CRISPR gRNA sequence
  source 1..20: mol_type = other DNA
gctacttgggaggctgaggc

SEQ ID NO: 86485 - DNA, 20 bp, synthetic construct
  misc_feature 1..20: note = CRISPR gRNA sequence
  source 1..20: mol_type = other DNA
tacttgggaggctgaggcag

SEQ ID NO: 86486 - DNA, 20 bp, synthetic construct
  misc_feature 1..20: note = CRISPR gRNA sequence
  source 1..20: mol_type = other DNA
gggaggctgaggcaggagaa

SEQ ID NO: 86487 - DNA, 20 bp, synthetic construct
  misc_feature 1..20: note = CRISPR gRNA sequence
  source 1..20: mol_type = other DNA
gcaggagaatggcgtgaacc

SEQ ID NO: 86488 - DNA, 20 bp, synthetic construct
  misc_feature 1..20: note = CRISPR gRNA sequence
  source 1..20: mol_type = other DNA
caggagaatggcgtgaacct

SEQ ID NO: 86489 - DNA, 20 bp, synthetic construct
  misc_feature 1..20: note = CRISPR gRNA sequence
  source 1..20: mol_type = other DNA
ggagaatggcgtgaacctgg

SEQ ID NO: 86490 - DNA, 20 bp, synthetic construct
  misc_feature 1..20: note = CRISPR gRNA sequence
  source 1..20: mol_type = other DNA
gagaatggcgtgaacctggg

SEQ ID NO: 86491 - DNA, 20 bp, synthetic construct
  misc_feature 1..20: note = CRISPR gRNA sequence
  source 1..20: mol_type = other DNA
aatggcgtgaacctgggagg

SEQ ID NO: 86492 - DNA, 20 bp, synthetic construct
  misc_feature 1..20: note = CRISPR gRNA sequence
  source 1..20: mol_type = other DNA
tggcgtgaacctgggaggcg

SEQ ID NO: 86493 - DNA, 20 bp, synthetic construct
  misc_feature 1..20: note = CRISPR gRNA sequence
  source 1..20: mol_type = other DNA
aacctgggaggcggagcttg

SEQ ID NO: 86494 - DNA, 20 bp, synthetic construct
  misc_feature 1..20: note = CRISPR gRNA sequence
  source 1..20: mol_type = other DNA
tgggaggcggagcttgcagt

SEQ ID NO: 86495 - DNA, 20 bp, synthetic construct
  misc_feature 1..20: note = CRISPR gRNA sequence
  source 1..20: mol_type = other DNA
ggcggagcttgcagtgagcc

SEQ ID NO: 86496 - DNA, 20 bp, synthetic construct
  misc_feature 1..20: note = CRISPR gRNA sequence
  source 1..20: mol_type = other DNA
gagattgcgccactgcactc

SEQ ID NO: 86497 - DNA, 20 bp, synthetic construct
  misc_feature 1..20: note = CRISPR gRNA sequence
  source 1..20: mol_type = other DNA
tgcgccactgcactccagcc

SEQ ID NO: 86498 - DNA, 20 bp, synthetic construct
  misc_feature 1..20: note = CRISPR gRNA sequence
  source 1..20: mol_type = other DNA
gcgccactgcactccagcct

SEQ ID NO: 86499 - DNA, 20 bp, synthetic construct
  misc_feature 1..20: note = CRISPR gRNA sequence
  source 1..20: mol_type = other DNA
ctgcactccagcctaggcga

SEQ ID NO: 86500 - DNA, 20 bp, synthetic construct
  misc_feature 1..20: note = CRISPR gRNA sequence
  source 1..20: mol_type = other DNA
gcactccagcctaggcgaca

SEQ ID NO: 86501 - DNA, 20 bp, synthetic construct
  misc_feature 1..20: note = CRISPR gRNA sequence
  source 1..20: mol_type = other DNA
tccagcctaggcgacagagt

SEQ ID NO: 86502 - DNA, 20 bp, synthetic construct
  misc_feature 1..20: note = CRISPR gRNA sequence
  source 1..20: mol_type = other DNA
tctcaaaaaaaaaaaaaaaa

SEQ ID NO: 86503 - DNA, 20 bp, synthetic construct
  misc_feature 1..20: note = CRISPR gRNA sequence
  source 1..20: mol_type = other DNA
aaaaaaaaaaaaaaaaaaga

SEQ ID NO: 86504 - DNA, 20 bp, synthetic construct
  misc_feature 1..20: note = CRISPR gRNA sequence
  source 1..20: mol_type = other DNA
agaaagaaattatttgatgc

SEQ ID NO: 86505 - DNA, 20 bp, synthetic construct
  misc_feature 1..20: note = CRISPR gRNA sequence
  source 1..20: mol_type = other DNA
gaaagaaattatttgatgct

SEQ ID NO: 86506 - DNA, 20 bp, synthetic construct
  misc_feature 1..20: note = CRISPR gRNA sequence
  source 1..20: mol_type = other DNA
tatttgatgctaggtgctct

SEQ ID NO: 86507 - DNA, 20 bp, synthetic construct
  misc_feature 1..20: note = CRISPR gRNA sequence
  source 1..20: mol_type = other DNA
atttgatgctaggtgctctg

SEQ ID NO: 86508 - DNA, 20 bp, synthetic construct
  misc_feature 1..20: note = CRISPR gRNA sequence
  source 1..20: mol_type = other DNA
ttgatgctaggtgctctgag

SEQ ID NO: 86509 - DNA, 20 bp, synthetic construct
  misc_feature 1..20: note = CRISPR gRNA sequence
  source 1..20: mol_type = other DNA
aggtgctctgaggagcccta

SEQ ID NO: 86510 - DNA, 20 bp, synthetic construct
  misc_feature 1..20: note = CRISPR gRNA sequence
  source 1..20: mol_type = other DNA
ggtgctctgaggagccctat

SEQ ID NO: 86511 - DNA, 20 bp, synthetic construct
  misc_feature 1..20: note = CRISPR gRNA sequence
  source 1..20: mol_type = other DNA
aggagccctataggctacca

SEQ ID NO: 86512 - DNA, 20 bp, synthetic construct
  misc_feature 1..20: note = CRISPR gRNA sequence
  source 1..20: mol_type = other DNA
gagccctataggctaccatg

SEQ ID NO: 86513 - DNA, 20 bp, synthetic construct
  misc_feature 1..20: note = CRISPR gRNA sequence
  source 1..20: mol_type = other DNA
gccctataggctaccatgga

SEQ ID NO: 86514 - DNA, 20 bp, synthetic construct
  misc_feature 1..20: note = CRISPR gRNA sequence
  source 1..20: mol_type = other DNA
ccctataggctaccatggag

SEQ ID NO: 86515 - DNA, 20 bp, synthetic construct
  misc_feature 1..20: note = CRISPR gRNA sequence
  source 1..20: mol_type = other DNA
ctataggctaccatggagag

SEQ ID NO: 86516 - DNA, 20 bp, synthetic construct
  misc_feature 1..20: note = CRISPR gRNA sequence
  source 1..20: mol_type = other DNA
tataggctaccatggagagg

SEQ ID NO: 86517 - DNA, 20 bp, synthetic construct
  misc_feature 1..20: note = CRISPR gRNA sequence
  source 1..20: mol_type = other DNA
ataggctaccatggagagga

SEQ ID NO: 86518 - DNA, 20 bp, synthetic construct
  misc_feature 1..20: note = CRISPR gRNA sequence
  source 1..20: mol_type = other DNA
ggctaccatggagaggaggg

SEQ ID NO: 86519 - DNA, 20 bp, synthetic construct
  misc_feature 1..20: note = CRISPR gRNA sequence
  source 1..20: mol_type = other DNA
taccatggagaggagggaag

SEQ ID NO: 86520 - DNA, 20 bp, synthetic construct
  misc_feature 1..20: note = CRISPR gRNA sequence
  source 1..20: mol_type = other DNA
ccatggagaggagggaagta

SEQ ID NO: 86521 - DNA, 20 bp, synthetic construct
  misc_feature 1..20: note = CRISPR gRNA sequence
  source 1..20: mol_type = other DNA
catggagaggagggaagtag

SEQ ID NO: 86522 - DNA, 20 bp, synthetic construct
  misc_feature 1..20: note = CRISPR gRNA sequence
  source 1..20: mol_type = other DNA
atggagaggagggaagtaga

SEQ ID NO: 86523 - DNA, 20 bp, synthetic construct
  misc_feature 1..20: note = CRISPR gRNA sequence
  source 1..20: mol_type = other DNA
tggagaggagggaagtagag

SEQ ID NO: 86524 - DNA, 20 bp, synthetic construct
  misc_feature 1..20: note = CRISPR gRNA sequence
  source 1..20: mol_type = other DNA
aggagggaagtagaggggat

SEQ ID NO: 86525 - DNA, 20 bp, synthetic construct
  misc_feature 1..20: note = CRISPR gRNA sequence
  source 1..20: mol_type = other DNA
agctctgacttcatctctgc

SEQ ID NO: 86526 - DNA, 20 bp, synthetic construct
  misc_feature 1..20: note = CRISPR gRNA sequence
  source 1..20: mol_type = other DNA
gctctgacttcatctctgct

SEQ ID NO: 86527 - DNA, 20 bp, synthetic construct
  misc_feature 1..20: note = CRISPR gRNA sequence
  source 1..20: mol_type = other DNA
tctctgctgggcttctatgc

SEQ ID NO: 86528 - DNA, 20 bp, synthetic construct
  misc_feature 1..20: note = CRISPR gRNA sequence
  source 1..20: mol_type = other DNA
ggcttctatgcaagtgctca

SEQ ID NO: 86529 - DNA, 20 bp, synthetic construct
  misc_feature 1..20: note = CRISPR gRNA sequence
  source 1..20: mol_type = other DNA
cttctatgcaagtgctcaca

SEQ ID NO: 86530 - DNA, 20 bp, synthetic construct
  misc_feature 1..20: note = CRISPR gRNA sequence
  source 1..20: mol_type = other DNA
tgcaagtgctcacagagatc

SEQ ID NO: 86531 - DNA, 20 bp, synthetic construct
  misc_feature 1..20: note = CRISPR gRNA sequence
  source 1..20: mol_type = other DNA
agtgctcacagagatcaagt

SEQ ID NO: 86532 - DNA, 20 bp, synthetic construct
  misc_feature 1..20: note = CRISPR gRNA sequence
  source 1..20: mol_type = other DNA
tgctcacagagatcaagtga

SEQ ID NO: 86533 - DNA, 20 bp, synthetic construct
  misc_feature 1..20: note = CRISPR gRNA sequence
  source 1..20: mol_type = other DNA
gctcacagagatcaagtgag

SEQ ID NO: 86534 - DNA, 20 bp, synthetic construct
  misc_feature 1..20: note = CRISPR gRNA sequence
  source 1..20: mol_type = other DNA
gagatcaagtgagaggcaca

SEQ ID NO: 86535 - DNA, 20 bp, synthetic construct
  misc_feature 1..20: note = CRISPR gRNA sequence
  source 1..20: mol_type = other DNA
tgagaggcacaaagtcaaac

SEQ ID NO: 86536 - DNA, 20 bp, synthetic construct
  misc_feature 1..20: note = CRISPR gRNA sequence
  source 1..20: mol_type = other DNA
gaggcacaaagtcaaactgg

SEQ ID NO: 86537 - DNA, 20 bp, synthetic construct
  misc_feature 1..20: note = CRISPR gRNA sequence
  source 1..20: mol_type = other DNA
cacaaagtcaaactggcagc

SEQ ID NO: 86538 - DNA, 20 bp, synthetic construct
  misc_feature 1..20: note = CRISPR gRNA sequence
  source 1..20: mol_type = other DNA
aaactggcagcaagtttgca

SEQ ID NO: 86539 - DNA, 20 bp, synthetic construct
  misc_feature 1..20: note = CRISPR gRNA sequence
  source 1..20: mol_type = other DNA
aaagccaactatcttctgac

SEQ ID NO: 86540 - DNA, 20 bp, synthetic construct
  misc_feature 1..20: note = CRISPR gRNA sequence
  source 1..20: mol_type = other DNA
aagccaactatcttctgaca

SEQ ID NO: 86541 - DNA, 20 bp, synthetic construct
  misc_feature 1..20: note = CRISPR gRNA sequence
  source 1..20: mol_type = other DNA
ccaactatcttctgacaagg

SEQ ID NO: 86542 - DNA, 20 bp, synthetic construct
  misc_feature 1..20: note = CRISPR gRNA sequence
  source 1..20: mol_type = other DNA
aactatcttctgacaaggca

SEQ ID NO: 86543 - DNA, 20 bp, synthetic construct
  misc_feature 1..20: note = CRISPR gRNA sequence
  source 1..20: mol_type = other DNA
actatcttctgacaaggcag

SEQ ID NO: 86544 - DNA, 20 bp, synthetic construct
  misc_feature 1..20: note = CRISPR gRNA sequence
  source 1..20: mol_type = other DNA
atcctcacatcctcctccct

SEQ ID NO: 86545 - DNA, 20 bp, synthetic construct
  misc_feature 1..20: note = CRISPR gRNA sequence
  source 1..20: mol_type = other DNA
ctcttccccaacacacttac

SEQ ID NO: 86546 - DNA, 20 bp, synthetic construct
  misc_feature 1..20: note = CRISPR gRNA sequence
  source 1..20: mol_type = other DNA
tcttccccaacacacttacc

SEQ ID NO: 86547 - DNA, 20 bp, synthetic construct
  misc_feature 1..20: note = CRISPR gRNA sequence
  source 1..20: mol_type = other DNA
cccctctactttgttctgca

SEQ ID NO: 86548 - DNA, 20 bp, synthetic construct
  misc_feature 1..20: note = CRISPR gRNA sequence
  source 1..20: mol_type = other DNA
tgttctgcacggccttgctg

SEQ ID NO: 86549 - DNA, 20 bp, synthetic construct
  misc_feature 1..20: note = CRISPR gRNA sequence
  source 1..20: mol_type = other DNA
gttctgcacggccttgctgt

SEQ ID NO: 86550 - DNA, 20 bp, synthetic construct
  misc_feature 1..20: note = CRISPR gRNA sequence
  source 1..20: mol_type = other DNA
ttctgcacggccttgctgtg

SEQ ID NO: 86551 - DNA, 20 bp, synthetic construct
  misc_feature 1..20: note = CRISPR gRNA sequence
  source 1..20: mol_type = other DNA
tgcacggccttgctgtgggg

SEQ ID NO: 86552 - DNA, 20 bp, synthetic construct
  misc_feature 1..20: note = CRISPR gRNA sequence
  source 1..20: mol_type = other DNA
cacggccttgctgtggggaa

SEQ ID NO: 86553 - DNA, 20 bp, synthetic construct
  misc_feature 1..20: note = CRISPR gRNA sequence
  source 1..20: mol_type = other DNA
acggccttgctgtggggaag

SEQ ID NO: 86554 - DNA, 20 bp, synthetic construct
  misc_feature 1..20: note = CRISPR gRNA sequence
  source 1..20: mol_type = other DNA
ggccttgctgtggggaagag

SEQ ID NO: 86555 - DNA, 20 bp, synthetic construct
  misc_feature 1..20: note = CRISPR gRNA sequence
  source 1..20: mol_type = other DNA
ttgctgtggggaagaggaga

SEQ ID NO: 86556 - DNA, 20 bp, synthetic construct
  misc_feature 1..20: note = CRISPR gRNA sequence
  source 1..20: mol_type = other DNA
tgtggggaagaggagaaagc

SEQ ID NO: 86557 - DNA, 20 bp, synthetic construct
  misc_feature 1..20: note = CRISPR gRNA sequence
  source 1..20: mol_type = other DNA
tggggaagaggagaaagctg

SEQ ID NO: 86558 - DNA, 20 bp, synthetic construct
  misc_feature 1..20: note = CRISPR gRNA sequence
  source 1..20: mol_type = other DNA
ggggaagaggagaaagctgg

SEQ ID NO: 86559 - DNA, 20 bp, synthetic construct
  misc_feature 1..20: note = CRISPR gRNA sequence
  source 1..20: mol_type = other DNA
gaaagctggaggtcacacac

SEQ ID NO: 86560 - DNA, 20 bp, synthetic construct
  misc_feature 1..20: note = CRISPR gRNA sequence
  source 1..20: mol_type = other DNA
ctgtctctttatctgactgc

SEQ ID NO: 86561 - DNA, 20 bp, synthetic construct
  misc_feature 1..20: note = CRISPR gRNA sequence
  source 1..20: mol_type = other DNA
tgtctctttatctgactgct

SEQ ID NO: 86562 - DNA, 20 bp, synthetic construct
  misc_feature 1..20: note = CRISPR gRNA sequence
  source 1..20: mol_type = other DNA
gtctctttatctgactgcta

SEQ ID NO: 86563 - DNA, 20 bp, synthetic construct
  misc_feature 1..20: note = CRISPR gRNA sequence
  source 1..20: mol_type = other DNA
ctctttatctgactgctagg

SEQ ID NO: 86564 - DNA, 20 bp, synthetic construct
  misc_feature 1..20: note = CRISPR gRNA sequence
  source 1..20: mol_type = other DNA
tctttatctgactgctaggg

SEQ ID NO: 86565 - DNA, 20 bp, synthetic construct
  misc_feature 1..20: note = CRISPR gRNA sequence
  source 1..20: mol_type = other DNA
ctttatctgactgctaggga

SEQ ID NO: 86566 - DNA, 20 bp, synthetic construct
  misc_feature 1..20: note = CRISPR gRNA sequence
  source 1..20: mol_type = other DNA
tctgactgctagggagggaa

SEQ ID NO: 86567 - DNA, 20 bp, synthetic construct
  misc_feature 1..20: note = CRISPR gRNA sequence
  source 1..20: mol_type = other DNA
ctgactgctagggagggaaa

SEQ ID NO: 86568 - DNA, 20 bp, synthetic construct
  misc_feature 1..20: note = CRISPR gRNA sequence
  source 1..20: mol_type = other DNA
gggaaaaggactgaaatgcc

SEQ ID NO: 86569 - DNA, 20 bp, synthetic construct
  misc_feature 1..20: note = CRISPR gRNA sequence
  source 1..20: mol_type = other DNA
aaaaggactgaaatgcccag

SEQ ID NO: 86570 - DNA, 20 bp, synthetic construct
  misc_feature 1..20: note = CRISPR gRNA sequence
  source 1..20: mol_type = other DNA
aaaggactgaaatgcccagc

SEQ ID NO: 86571 - DNA, 20 bp, synthetic construct
  misc_feature 1..20: note = CRISPR gRNA sequence
  source 1..20: mol_type = other DNA
gaaatgcccagcaggtgctc

SEQ ID NO: 86572 - DNA, 20 bp, synthetic construct
  misc_feature 1..20: note = CRISPR gRNA sequence
  source 1..20: mol_type = other DNA
gtgctcaagaattgctacca

SEQ ID NO: 86573 - DNA, 20 bp, synthetic construct
  misc_feature 1..20: note = CRISPR gRNA sequence
  source 1..20: mol_type = other DNA
tctgctcccatgcccttgct

SEQ ID NO: 86574 - DNA, 20 bp, synthetic construct
  misc_feature 1..20: note = CRISPR gRNA sequence
  source 1..20: mol_type = other DNA
tgctcccatgcccttgctga

SEQ ID NO: 86575 - DNA, 20 bp, synthetic construct
  misc_feature 1..20: note = CRISPR gRNA sequence
  source 1..20: mol_type = other DNA
gctcccatgcccttgctgag

SEQ ID NO: 86576 - DNA, 20 bp, synthetic construct
  misc_feature 1..20: note = CRISPR gRNA sequence
  source 1..20: mol_type = other DNA
cccatgcccttgctgagagg

SEQ ID NO: 86577 - DNA, 20 bp, synthetic construct
  misc_feature 1..20: note = CRISPR gRNA sequence
  source 1..20: mol_type = other DNA
gctgagaggcagttcatcta

SEQ ID NO: 86578 - DNA, 20 bp, synthetic construct
  misc_feature 1..20: note = CRISPR gRNA sequence
  source 1..20: mol_type = other DNA
aggcagttcatctacagcca

SEQ ID NO: 86579 - DNA, 20 bp, synthetic construct
  misc_feature 1..20: note = CRISPR gRNA sequence
  source 1..20: mol_type = other DNA
gttcatctacagccaaagtg

SEQ ID NO: 86580 - DNA, 20 bp, synthetic construct
  misc_feature 1..20: note = CRISPR gRNA sequence
  source 1..20: mol_type = other DNA
acagccaaagtgaagtgctg

SEQ ID NO: 86581 - DNA, 20 bp, synthetic construct
  misc_feature 1..20: note = CRISPR gRNA sequence
  source 1..20: mol_type = other DNA
cagccaaagtgaagtgctgc

SEQ ID NO: 86582 - DNA, 20 bp, synthetic construct
  misc_feature 1..20: note = CRISPR gRNA sequence
  source 1..20: mol_type = other DNA
agccaaagtgaagtgctgca

SEQ ID NO: 86583 - DNA, 20 bp, synthetic construct
  misc_feature 1..20: note = CRISPR gRNA sequence
  source 1..20: mol_type = other DNA
gtgctgcagggatctatact

SEQ ID NO: 86584 - DNA, 20 bp, synthetic construct
  misc_feature 1..20: note = CRISPR gRNA sequence
  source 1..20: mol_type = other DNA
tgctgcagggatctatactc

SEQ ID NO: 86585 - DNA, 20 bp, synthetic construct
  misc_feature 1..20: note = CRISPR gRNA sequence
  source 1..20: mol_type = other DNA
agggatctatactcaggtct

SEQ ID NO: 86586 - DNA, 20 bp, synthetic construct
  misc_feature 1..20: note = CRISPR gRNA sequence
  source 1..20: mol_type = other DNA
atctatactcaggtcttgga

SEQ ID NO: 86587 - DNA, 20 bp, synthetic construct
  misc_feature 1..20: note = CRISPR gRNA sequence
  source 1..20: mol_type = other DNA
tctatactcaggtcttggac

SEQ ID NO: 86588 - DNA, 20 bp, synthetic construct
  misc_feature 1..20: note = CRISPR gRNA sequence
  source 1..20: mol_type = other DNA
ctcaggtcttggacaggact

SEQ ID NO: 86589 - DNA, 20 bp, synthetic construct
  misc_feature 1..20: note = CRISPR gRNA sequence
  source 1..20: mol_type = other DNA
caggtcttggacaggacttg

SEQ ID NO: 86590 - DNA, 20 bp, synthetic construct
  misc_feature 1..20: note = CRISPR gRNA sequence
  source 1..20: mol_type = other DNA
acaggacttggagatgtgat

SEQ ID NO: 86591 - DNA, 20 bp, synthetic construct
  misc_feature 1..20: note = CRISPR gRNA sequence
  source 1..20: mol_type = other DNA
tgtgatgagtacttacgaaa

SEQ ID NO: 86592 - DNA, 20 bp, synthetic construct
  misc_feature 1..20: note = CRISPR gRNA sequence
  source 1..20: mol_type = other DNA
gtacttacgaaatggtacct

SEQ ID NO: 86593 - DNA, 20 bp, synthetic construct
  misc_feature 1..20: note = CRISPR gRNA sequence
  source 1..20: mol_type = other DNA
acttacgaaatggtacctcg

SEQ ID NO: 86594 - DNA, 20 bp, synthetic construct
  misc_feature 1..20: note = CRISPR gRNA sequence
  source 1..20: mol_type = other DNA
atggtacctcggagcctctg

SEQ ID NO: 86595 - DNA, 20 bp, synthetic construct
  misc_feature 1..20: note = CRISPR gRNA sequence
  source 1..20: mol_type = other DNA
gtacctcggagcctctgaag

SEQ ID NO: 86596 - DNA, 20 bp, synthetic construct
  misc_feature 1..20: note = CRISPR gRNA sequence
  source 1..20: mol_type = other DNA
tacctcggagcctctgaaga

SEQ ID NO: 86597 - DNA, 20 bp, synthetic construct
  misc_feature 1..20: note = CRISPR gRNA sequence
  source 1..20: mol_type = other DNA
acctcggagcctctgaagaa

SEQ ID NO: 86598 - DNA, 20 bp, synthetic construct
  misc_feature 1..20: note = CRISPR gRNA sequence
  source 1..20: mol_type = other DNA
tcggagcctctgaagaaggg

SEQ ID NO: 86599 - DNA, 20 bp, synthetic construct
  misc_feature 1..20: note = CRISPR gRNA sequence
  source 1..20: mol_type = other DNA
gagcctctgaagaagggtgg

SEQ ID NO: 86600 - DNA, 20 bp, synthetic construct
  misc_feature 1..20: note = CRISPR gRNA sequence
  source 1..20: mol_type = other DNA
agcctctgaagaagggtggt

SEQ ID NO: 86601 - DNA, 20 bp, synthetic construct
  misc_feature 1..20: note = CRISPR gRNA sequence
  source 1..20: mol_type = other DNA
aagaagggtggtaggttccc

SEQ ID NO: 86602 - DNA, 20 bp, synthetic construct
  misc_feature 1..20: note = CRISPR gRNA sequence
  source 1..20: mol_type = other DNA
ggtggtaggttccccagcct

SEQ ID NO: 86603 - DNA, 20 bp, synthetic construct
  misc_feature 1..20: note = CRISPR gRNA sequence
  source 1..20: mol_type = other DNA
tccccagcctcagcaccacc

SEQ ID NO: 86604 - DNA, 20 bp, synthetic construct
  misc_feature 1..20: note = CRISPR gRNA sequence
  source 1..20: mol_type = other DNA
ccccagcctcagcaccacct

SEQ ID NO: 86605 - DNA, 20 bp, synthetic construct
  misc_feature 1..20: note = CRISPR gRNA sequence
  source 1..20: mol_type = other DNA
cccagcctcagcaccacctg

SEQ ID NO: 86606 - DNA, 20 bp, synthetic construct
  misc_feature 1..20: note = CRISPR gRNA sequence
  source 1..20: mol_type = other DNA
ccagcctcagcaccacctgg

SEQ ID NO: 86607 - DNA, 20 bp, synthetic construct
  misc_feature 1..20: note = CRISPR gRNA sequence
  source 1..20: mol_type = other DNA
cagcctcagcaccacctggg

SEQ ID NO: 86608 - DNA, 20 bp, synthetic construct
  misc_feature 1..20: note = CRISPR gRNA sequence
  source 1..20: mol_type = other DNA
agcctcagcaccacctgggg

SEQ ID NO: 86609 - DNA, 20 bp, synthetic construct
  misc_feature 1..20: note = CRISPR gRNA sequence
  source 1..20: mol_type = other DNA
acctgggggggcccttcccc

SEQ ID NO: 86610 - DNA, 20 bp, synthetic construct
  misc_feature 1..20: note = CRISPR gRNA sequence
  source 1..20: mol_type = other DNA
gggggcccttcccccagtct

SEQ ID NO: 86611 - DNA, 20 bp, synthetic construct
  misc_feature 1..20: note = CRISPR gRNA sequence
  source 1..20: mol_type = other DNA
ggggcccttcccccagtctt

SEQ ID NO: 86612 - DNA, 20 bp, synthetic construct
  misc_feature 1..20: note = CRISPR gRNA sequence
  source 1..20: mol_type = other DNA
gggcccttcccccagtcttg

SEQ ID NO: 86613 - DNA, 20 bp, synthetic construct
  misc_feature 1..20: note = CRISPR gRNA sequence
  source 1..20: mol_type = other DNA
tcccccagtcttggggctct

SEQ ID NO: 86614 - DNA, 20 bp, synthetic construct
  misc_feature 1..20: note = CRISPR gRNA sequence
  source 1..20: mol_type = other DNA
agtcttggggctcttagcat

SEQ ID NO: 86615 - DNA, 20 bp, synthetic construct
  misc_feature 1..20: note = CRISPR gRNA sequence
  source 1..20: mol_type = other DNA
gtcttggggctcttagcatc

SEQ ID NO: 86616 - DNA, 20 bp, synthetic construct
  misc_feature 1..20: note = CRISPR gRNA sequence
  source 1..20: mol_type = other DNA
aggctcatcttctgccatcc

SEQ ID NO: 86617 - DNA, 20 bp, synthetic construct
  misc_feature 1..20: note = CRISPR gRNA sequence
  source 1..20: mol_type = other DNA
atcttctgccatcccggcat

SEQ ID NO: 86618 - DNA, 20 bp, synthetic construct
  misc_feature 1..20: note = CRISPR gRNA sequence
  source 1..20: mol_type = other DNA
tcttctgccatcccggcatg

SEQ ID NO: 86619 - DNA, 20 bp, synthetic construct
  misc_feature 1..20: note = CRISPR gRNA sequence
  source 1..20: mol_type = other DNA
cttctgccatcccggcatga

SEQ ID NO: 86620 - DNA, 20 bp, synthetic construct
  misc_feature 1..20: note = CRISPR gRNA sequence
  source 1..20: mol_type = other DNA
tgccatcccggcatgagggc

SEQ ID NO: 86621 - DNA, 20 bp, synthetic construct
  misc_feature 1..20: note = CRISPR gRNA sequence
  source 1..20: mol_type = other DNA
ccggcatgagggctagaatt

SEQ ID NO: 86622 - DNA, 20 bp, synthetic construct
  misc_feature 1..20: note = CRISPR gRNA sequence
  source 1..20: mol_type = other DNA
ggcatgagggctagaattga

SEQ ID NO: 86623 - DNA, 20 bp, synthetic construct
  misc_feature 1..20: note = CRISPR gRNA sequence
  source 1..20: mol_type = other DNA
gcatgagggctagaattgag

SEQ ID NO: 86624 - DNA, 20 bp, synthetic construct
  misc_feature 1..20: note = CRISPR gRNA sequence
  source 1..20: mol_type = other DNA
catgagggctagaattgaga

SEQ ID NO: 86625 - DNA, 20 bp, synthetic construct
  misc_feature 1..20: note = CRISPR gRNA sequence
  source 1..20: mol_type = other DNA
agggctagaattgagaggga

SEQ ID NO: 86626 - DNA, 20 bp, synthetic construct
  misc_feature 1..20: note = CRISPR gRNA sequence
  source 1..20: mol_type = other DNA
gggctagaattgagagggac

SEQ ID NO: 86627 - DNA, 20 bp, synthetic construct
  misc_feature 1..20: note = CRISPR gRNA sequence
  source 1..20: mol_type = other DNA
aattgagagggacaggcata

SEQ ID NO: 86628 - DNA, 20 bp, synthetic construct
  misc_feature 1..20: note = CRISPR gRNA sequence
  source 1..20: mol_type = other DNA
cataaagatgtaactcacac

SEQ ID NO: 86629 - DNA, 20 bp, synthetic construct
  misc_feature 1..20: note = CRISPR gRNA sequence
  source 1..20: mol_type = other DNA
cacactggccttcccttccc

SEQ ID NO: 86630 - DNA, 20 bp, synthetic construct
  misc_feature 1..20: note = CRISPR gRNA sequence
  source 1..20: mol_type = other DNA
actggccttcccttccccag

SEQ ID NO: 86631 - DNA, 20 bp, synthetic construct
  misc_feature 1..20: note = CRISPR gRNA sequence
  source 1..20: mol_type = other DNA
ctggccttcccttccccaga

SEQ ID NO: 86632 - DNA, 20 bp, synthetic construct
  misc_feature 1..20: note = CRISPR gRNA sequence
  source 1..20: mol_type = other DNA
ttcccttccccagaaggccc

SEQ ID NO: 86633 - DNA, 20 bp, synthetic construct
  misc_feature 1..20: note = CRISPR gRNA sequence
  source 1..20: mol_type = other DNA
tcccttccccagaaggcccc

SEQ ID NO: 86634 - DNA, 20 bp, synthetic construct
  misc_feature 1..20: note = CRISPR gRNA sequence
  source 1..20: mol_type = other DNA
cccttccccagaaggcccca

SEQ ID NO: 86635 - DNA, 20 bp, synthetic construct
  misc_feature 1..20: note = CRISPR gRNA sequence
  source 1..20: mol_type = other DNA
gcactcctcatctctttacc

SEQ ID NO: 86636 - DNA, 20 bp, synthetic construct
  misc_feature 1..20: note = CRISPR gRNA sequence
  source 1..20: mol_type = other DNA
tcctcatctctttacccaga

SEQ ID NO: 86637 - DNA, 20 bp, synthetic construct
  misc_feature 1..20: note = CRISPR gRNA sequence
  source 1..20: mol_type = other DNA
cctcatctctttacccagaa

SEQ ID NO: 86638 - DNA, 20 bp, synthetic construct
  misc_feature 1..20: note = CRISPR gRNA sequence
  source 1..20: mol_type = other DNA
catctctttacccagaaagg

SEQ ID NO: 86639 - DNA, 20 bp, synthetic construct
  misc_feature 1..20: note = CRISPR gRNA sequence
  source 1..20: mol_type = other DNA
tctctttacccagaaaggca

SEQ ID NO: 86640 - DNA, 20 bp, synthetic construct
  misc_feature 1..20: note = CRISPR gRNA sequence
  source 1..20: mol_type = other DNA
tacccagaaaggcagagaaa

SEQ ID NO: 86641 - DNA, 20 bp, synthetic construct
  misc_feature 1..20: note = CRISPR gRNA sequence
  source 1..20: mol_type = other DNA
aaggcagagaaacagaaaca

SEQ ID NO: 86642 - DNA, 20 bp, synthetic construct
  misc_feature 1..20: note = CRISPR gRNA sequence
  source 1..20: mol_type = other DNA
acaaagcctccgaatttccc

SEQ ID NO: 86643 - DNA, 20 bp, synthetic construct
  misc_feature 1..20: note = CRISPR gRNA sequence
  source 1..20: mol_type = other DNA
aagcctccgaatttccccgg

SEQ ID NO: 86644 - DNA, 20 bp, synthetic construct
  misc_feature 1..20: note = CRISPR gRNA sequence
  source 1..20: mol_type = other DNA
cacttgccttctccgaaaat

SEQ ID NO: 86645 - DNA, 20 bp, synthetic construct
  misc_feature 1..20: note = CRISPR gRNA sequence
  source 1..20: mol_type = other DNA
aaattattccattacttcgc

SEQ ID NO: 86646 - DNA, 20 bp, synthetic construct
  misc_feature 1..20: note = CRISPR gRNA sequence
  source 1..20: mol_type = other DNA
aattattccattacttcgcc

SEQ ID NO: 86647 - DNA, 20 bp, synthetic construct
  misc_feature 1..20: note = CRISPR gRNA sequence
  source 1..20: mol_type = other DNA
gccaggcccatatatgccca

SEQ ID NO: 86648 - DNA, 20 bp, synthetic construct
  misc_feature 1..20: note = CRISPR gRNA sequence
  source 1..20: mol_type = other DNA
caggcccatatatgcccaaa

SEQ ID NO: 86649 - DNA, 20 bp, synthetic construct
  misc_feature 1..20: note = CRISPR gRNA sequence
  source 1..20: mol_type = other DNA
ctatctgccccacctttctg

SEQ ID NO: 86650 - DNA, 20 bp, synthetic construct
  misc_feature 1..20: note = CRISPR gRNA sequence
  source 1..20: mol_type = other DNA
tttctgaagtctcctaaatc

SEQ ID NO: 86651 - DNA, 20 bp, synthetic construct
  misc_feature 1..20: note = CRISPR gRNA sequence
  source 1..20: mol_type = other DNA
cctaaatctggaaaactgta

SEQ ID NO: 86652 - DNA, 20 bp, synthetic construct
  misc_feature 1..20: note = CRISPR gRNA sequence
  source 1..20: mol_type = other DNA
ctaaatctggaaaactgtaa

SEQ ID NO: 86653 - DNA, 20 bp, synthetic construct
  misc_feature 1..20: note = CRISPR gRNA sequence
  source 1..20: mol_type = other DNA
aatctggaaaactgtaaagg

SEQ ID NO: 86654 - DNA, 20 bp, synthetic construct
  misc_feature 1..20: note = CRISPR gRNA sequence
  source 1..20: mol_type = other DNA
tctggaaaactgtaaaggaa

SEQ ID NO: 86655 - DNA, 20 bp, synthetic construct
  misc_feature 1..20: note = CRISPR gRNA sequence
  source 1..20: mol_type = other DNA
gaaaactgtaaaggaagaga

SEQ ID NO: 86656 - DNA, 20 bp, synthetic construct
  misc_feature 1..20: note = CRISPR gRNA sequence
  source 1..20: mol_type = other DNA
aaaactgtaaaggaagagat

SEQ ID NO: 86657 - DNA, 20 bp, synthetic construct
  misc_feature 1..20: note = CRISPR gRNA sequence
  source 1..20: mol_type = other DNA
aaactgtaaaggaagagata

SEQ ID NO: 86658 - DNA, 20 bp, synthetic construct
  misc_feature 1..20: note = CRISPR gRNA sequence
  source 1..20: mol_type = other DNA
aactgtaaaggaagagatag

SEQ ID NO: 86659 - DNA, 20 bp, synthetic construct
  misc_feature 1..20: note = CRISPR gRNA sequence
  source 1..20: mol_type = other DNA
actgtaaaggaagagatagg

SEQ ID NO: 86660 - DNA, 20 bp, synthetic construct
  misc_feature 1..20: note = CRISPR gRNA sequence
  source 1..20: mol_type = other DNA
aaaggaagagatagggggat

SEQ ID NO: 86661 - DNA, 20 bp, synthetic construct
  misc_feature 1..20: note = CRISPR gRNA sequence
  source 1..20: mol_type = other DNA
aaggaagagatagggggatt

SEQ ID NO: 86662 - DNA, 20 bp, synthetic construct
  misc_feature 1..20: note = CRISPR gRNA sequence
  source 1..20: mol_type = other DNA
gggggattgggaatccatgt

SEQ ID NO: 86663 - DNA, 20 bp, synthetic construct
  misc_feature 1..20: note = CRISPR gRNA sequence
  source 1..20: mol_type = other DNA
gattgggaatccatgttagc

SEQ ID NO: 86664 - DNA, 20 bp, synthetic construct
  misc_feature 1..20: note = CRISPR gRNA sequence
  source 1..20: mol_type = other DNA
cccctcaaaaacaacaataa

SEQ ID NO: 86665 - DNA, 20 bp, synthetic construct
  misc_feature 1..20: note = CRISPR gRNA sequence
  source 1..20: mol_type = other DNA
acaataacagccacaaaaca

SEQ ID NO: 86666 - DNA, 20 bp, synthetic construct
  misc_feature 1..20: note = CRISPR gRNA sequence
  source 1..20: mol_type = other DNA
tcctcaccattgcatatgcc

SEQ ID NO: 86667 - DNA, 20 bp, synthetic construct
  misc_feature 1..20: note = CRISPR gRNA sequence
  source 1..20: mol_type = other DNA
cctcaccattgcatatgcct

SEQ ID NO: 86668 - DNA, 20 bp, synthetic construct
  misc_feature 1..20: note = CRISPR gRNA sequence
  source 1..20: mol_type = other DNA
tcaccattgcatatgcctgg

SEQ ID NO: 86669 - DNA, 20 bp, synthetic construct
  misc_feature 1..20: note = CRISPR gRNA sequence
  source 1..20: mol_type = other DNA
caccattgcatatgcctggg

SEQ ID NO: 86670 - DNA, 20 bp, synthetic construct
  misc_feature 1..20: note = CRISPR gRNA sequence
  source 1..20: mol_type = other DNA
attgcatatgcctgggaggt

SEQ ID NO: 86671 - DNA, 20 bp, synthetic construct
  misc_feature 1..20: note = CRISPR gRNA sequence
  source 1..20: mol_type = other DNA
catatgcctgggaggtcaga

SEQ ID NO: 86672 - DNA, 20 bp, synthetic construct
  misc_feature 1..20: note = CRISPR gRNA sequence
  source 1..20: mol_type = other DNA
atatgcctgggaggtcagaa

SEQ ID NO: 86673 - DNA, 20 bp, synthetic construct
  misc_feature 1..20: note = CRISPR gRNA sequence
  source 1..20: mol_type = other DNA
acgaacatattctgcccttc

SEQ ID NO: 86674 - DNA, 20 bp, synthetic construct
  misc_feature 1..20: note = CRISPR gRNA sequence
  source 1..20: mol_type = other DNA
cgaacatattctgcccttct

SEQ ID NO: 86675 - DNA, 20 bp, synthetic construct
  misc_feature 1..20: note = CRISPR gRNA sequence
  source 1..20: mol_type = other DNA
atattctgcccttctaggct

SEQ ID NO: 86676 - DNA, 20 bp, synthetic construct
  misc_feature 1..20: note = CRISPR gRNA sequence
  source 1..20: mol_type = other DNA
tctaggcttggaaaaaaaac

SEQ ID NO: 86677 - DNA, 20 bp, synthetic construct
  misc_feature 1..20: note = CRISPR gRNA sequence
  source 1..20: mol_type = other DNA
ctaggcttggaaaaaaaact

SEQ ID NO: 86678 - DNA, 20 bp, synthetic construct
  misc_feature 1..20: note = CRISPR gRNA sequence
  source 1..20: mol_type = other DNA
ttggaaaaaaaactgggccc

SEQ ID NO: 86679 - DNA, 20 bp, synthetic construct
  misc_feature 1..20: note = CRISPR gRNA sequence
  source 1..20: mol_type = other DNA
gctccccctccccacgtcgc

SEQ ID NO: 86680 - DNA, 20 bp, synthetic construct
  misc_feature 1..20: note = CRISPR gRNA sequence
  source 1..20: mol_type = other DNA
ccctacgtcatctcccacaa

SEQ ID NO: 86681 - DNA, 20 bp, synthetic construct
  misc_feature 1..20: note = CRISPR gRNA sequence
  source 1..20: mol_type = other DNA
ctcccacaacagcccatcct

SEQ ID NO: 86682 - DNA, 20 bp, synthetic construct
  misc_feature 1..20: note = CRISPR gRNA sequence
  source 1..20: mol_type = other DNA
tcccacaacagcccatcctg

SEQ ID NO: 86683 - DNA, 20 bp, synthetic construct
  misc_feature 1..20: note = CRISPR gRNA sequence
  source 1..20: mol_type = other DNA
ttccccctccattcaatccc

SEQ ID NO: 86684 - DNA, 20 bp, synthetic construct
  misc_feature 1..20: note = CRISPR gRNA sequence
  source 1..20: mol_type = other DNA
ttcaatccccggtttctgca

SEQ ID NO: 86685 - DNA, 20 bp, synthetic construct
  misc_feature 1..20: note = CRISPR gRNA sequence
  source 1..20: mol_type = other DNA
aatccccggtttctgcaaag

SEQ ID NO: 86686 - DNA, 20 bp, synthetic construct
  misc_feature 1..20: note = CRISPR gRNA sequence
  source 1..20: mol_type = other DNA
tccccggtttctgcaaagtg

SEQ ID NO: 86687 - DNA, 20 bp, synthetic construct
  misc_feature 1..20: note = CRISPR gRNA sequence
  source 1..20: mol_type = other DNA
ccggtttctgcaaagtggag

SEQ ID NO: 86688 - DNA, 20 bp, synthetic construct
  misc_feature 1..20: note = CRISPR gRNA sequence
  source 1..20: mol_type = other DNA
cggtttctgcaaagtggagc

SEQ ID NO: 86689 - DNA, 20 bp, synthetic construct
  misc_feature 1..20: note = CRISPR gRNA sequence
  source 1..20: mol_type = other DNA
ggtttctgcaaagtggagcg

SEQ ID NO: 86690 - DNA, 20 bp, synthetic construct
  misc_feature 1..20: note = CRISPR gRNA sequence
  source 1..20: mol_type = other DNA
gtttctgcaaagtggagcgg

SEQ ID NO: 86691 - DNA, 20 bp, synthetic construct
  misc_feature 1..20: note = CRISPR gRNA sequence
  source 1..20: mol_type = other DNA
tctgcaaagtggagcggggg

SEQ ID NO: 86692 - DNA, 20 bp, synthetic construct
  misc_feature 1..20: note = CRISPR gRNA sequence
  source 1..20: mol_type = other DNA
ctgcaaagtggagcgggggt

SEQ ID NO: 86693 - DNA, 20 bp, synthetic construct
  misc_feature 1..20: note = CRISPR gRNA sequence
  source 1..20: mol_type = other DNA
tgcaaagtggagcgggggtg

SEQ ID NO: 86694 - DNA, 20 bp, synthetic construct
  misc_feature 1..20: note = CRISPR gRNA sequence
  source 1..20: mol_type = other DNA
cccacccccgctccactttg

SEQ ID NO: 86695 - DNA, 20 bp, synthetic construct
  misc_feature 1..20: note = CRISPR gRNA sequence
  source 1..20: mol_type = other DNA
ccgctccactttgcagaaac

SEQ ID NO: 86696 - DNA, 20 bp, synthetic construct
  misc_feature 1..20: note = CRISPR gRNA sequence
  source 1..20: mol_type = other DNA
cgctccactttgcagaaacc

SEQ ID NO: 86697 - DNA, 20 bp, synthetic construct
  misc_feature 1..20: note = CRISPR gRNA sequence
  source 1..20: mol_type = other DNA
gctccactttgcagaaaccg

SEQ ID NO: 86698 - DNA, 20 bp, synthetic construct
  misc_feature 1..20: note = CRISPR gRNA sequence
  source 1..20: mol_type = other DNA
tgcagaaaccggggattgaa

SEQ ID NO: 86699 - DNA, 20 bp, synthetic construct
  misc_feature 1..20: note = CRISPR gRNA sequence
  source 1..20: mol_type = other DNA
cagaaaccggggattgaatg

SEQ ID NO: 86700 - DNA, 20 bp, synthetic construct
  misc_feature 1..20: note = CRISPR gRNA sequence
  source 1..20: mol_type = other DNA
agaaaccggggattgaatgg

SEQ ID NO: 86701 - DNA, 20 bp, synthetic construct
  misc_feature 1..20: note = CRISPR gRNA sequence
  source 1..20: mol_type = other DNA
gaaaccggggattgaatgga

SEQ ID NO: 86702 - DNA, 20 bp, synthetic construct
  misc_feature 1..20: note = CRISPR gRNA sequence
  source 1..20: mol_type = other DNA
aaaccggggattgaatggag

SEQ ID NO: 86703 - DNA, 20 bp, synthetic construct
  misc_feature 1..20: note = CRISPR gRNA sequence
  source 1..20: mol_type = other DNA
aaccggggattgaatggagg

SEQ ID NO: 86704 - DNA, 20 bp, synthetic construct
  misc_feature 1..20: note = CRISPR gRNA sequence
  source 1..20: mol_type = other DNA
cggggattgaatggaggggg

SEQ ID NO: 86705 - DNA, 20 bp, synthetic construct
  misc_feature 1..20: note = CRISPR gRNA sequence
  source 1..20: mol_type = other DNA
ggggattgaatggaggggga

SEQ ID NO: 86706 - DNA, 20 bp, synthetic construct
  misc_feature 1..20: note = CRISPR gRNA sequence
  source 1..20: mol_type = other DNA
gggattgaatggagggggaa

SEQ ID NO: 86707 - DNA, 20 bp, synthetic construct
  misc_feature 1..20: note = CRISPR gRNA sequence
  source 1..20: mol_type = other DNA
attgaatggagggggaaggg

SEQ ID NO: 86708 - DNA, 20 bp, synthetic construct
  misc_feature 1..20: note = CRISPR gRNA sequence
  source 1..20: mol_type = other DNA
ttgaatggagggggaaggga

SEQ ID NO: 86709 - DNA, 20 bp, synthetic construct
  misc_feature 1..20: note = CRISPR gRNA sequence
  source 1..20: mol_type = other DNA
gaatggagggggaagggaag

SEQ ID NO: 86710 - DNA, 20 bp, synthetic construct
  misc_feature 1..20: note = CRISPR gRNA sequence
  source 1..20: mol_type = other DNA
aatggagggggaagggaagg

SEQ ID NO: 86711 - DNA, 20 bp, synthetic construct
  misc_feature 1..20: note = CRISPR gRNA sequence
  source 1..20: mol_type = other DNA
ggagggggaagggaaggagg

SEQ ID NO: 86712 - DNA, 20 bp, synthetic construct
  misc_feature 1..20: note = CRISPR gRNA sequence
  source 1..20: mol_type = other DNA
gagggggaagggaaggaggt

SEQ ID NO: 86713 - DNA, 20 bp, synthetic construct
  misc_feature 1..20: note = CRISPR gRNA sequence
  source 1..20: mol_type = other DNA
agggggaagggaaggaggtg

SEQ ID NO: 86714 - DNA, 20 bp, synthetic construct
  misc_feature 1..20: note = CRISPR gRNA sequence
  source 1..20: mol_type = other DNA
gggggaagggaaggaggtgg

SEQ ID NO: 86715 - DNA, 20 bp, synthetic construct
  misc_feature 1..20: note = CRISPR gRNA sequence
  source 1..20: mol_type = other DNA
aaggaggtgggggcgcgcct

SEQ ID NO: 86716 - DNA, 20 bp, synthetic construct
  misc_feature 1..20: note = CRISPR gRNA sequence
  source 1..20: mol_type = other DNA
aggaggtgggggcgcgcctc

SEQ ID NO: 86717 - DNA, 20 bp, synthetic construct
  misc_feature 1..20: note = CRISPR gRNA sequence
  source 1..20: mol_type = other DNA
ggtgggggcgcgcctcagga

SEQ ID NO: 86718 - DNA, 20 bp, synthetic construct
  misc_feature 1..20: note = CRISPR gRNA sequence
  source 1..20: mol_type = other DNA
gtgggggcgcgcctcaggat

SEQ ID NO: 86719 - DNA, 20 bp, synthetic construct
  misc_feature 1..20: note = CRISPR gRNA sequence
  source 1..20: mol_type = other DNA
cgcctcaggatgggctgttg

SEQ ID NO: 86720 - DNA, 20 bp, synthetic construct
  misc_feature 1..20: note = CRISPR gRNA sequence
  source 1..20: mol_type = other DNA
gcctcaggatgggctgttgt

SEQ ID NO: 86721 - DNA, 20 bp, synthetic construct
  misc_feature 1..20: note = CRISPR gRNA sequence
  source 1..20: mol_type = other DNA
ctcaggatgggctgttgtgg

SEQ ID NO: 86722 - DNA, 20 bp, synthetic construct
  misc_feature 1..20: note = CRISPR gRNA sequence
  source 1..20: mol_type = other DNA
ggctgttgtgggagatgacg

SEQ ID NO: 86723 - DNA, 20 bp, synthetic construct
  misc_feature 1..20: note = CRISPR gRNA sequence
  source 1..20: mol_type = other DNA
gctgttgtgggagatgacgt

SEQ ID NO: 86724 - DNA, 20 bp, synthetic construct
  misc_feature 1..20: note = CRISPR gRNA sequence
  source 1..20: mol_type = other DNA
ctgttgtgggagatgacgta

SEQ ID NO: 86725 - DNA, 20 bp, synthetic construct
  misc_feature 1..20: note = CRISPR gRNA sequence
  source 1..20: mol_type = other DNA
tgttgtgggagatgacgtag

SEQ ID NO: 86726 - DNA, 20 bp, synthetic construct
  misc_feature 1..20: note = CRISPR gRNA sequence
  source 1..20: mol_type = other DNA
gtgggagatgacgtaggggc

SEQ ID NO: 86727 - DNA, 20 bp, synthetic construct
  misc_feature 1..20: note = CRISPR gRNA sequence
  source 1..20: mol_type = other DNA
tgacgtaggggccggcgacg

SEQ ID NO: 86728 - DNA, 20 bp, synthetic construct
  misc_feature 1..20: note = CRISPR gRNA sequence
  source 1..20: mol_type = other DNA
gacgtaggggccggcgacgt

SEQ ID NO: 86729 - DNA, 20 bp, synthetic construct
  misc_feature 1..20: note = CRISPR gRNA sequence
  source 1..20: mol_type = other DNA
acgtaggggccggcgacgtg

SEQ ID NO: 86730 - DNA, 20 bp, synthetic construct
  misc_feature 1..20: note = CRISPR gRNA sequence
  source 1..20: mol_type = other DNA
gtaggggccggcgacgtggg

SEQ ID NO: 86731 - DNA, 20 bp, synthetic construct
  misc_feature 1..20: note = CRISPR gRNA sequence
  source 1..20: mol_type = other DNA
taggggccggcgacgtgggg

SEQ ID NO: 86732 - DNA, 20 bp, synthetic construct
  misc_feature 1..20: note = CRISPR gRNA sequence
  source 1..20: mol_type = other DNA
aggggccggcgacgtgggga

SEQ ID NO: 86733 - DNA, 20 bp, synthetic construct
  misc_feature 1..20: note = CRISPR gRNA sequence
  source 1..20: mol_type = other DNA
ggggccggcgacgtggggag

SEQ ID NO: 86734 - DNA, 20 bp, synthetic construct
  misc_feature 1..20: note = CRISPR gRNA sequence
  source 1..20: mol_type = other DNA
gggccggcgacgtggggagg

SEQ ID NO: 86735 - DNA, 20 bp, synthetic construct
  misc_feature 1..20: note = CRISPR gRNA sequence
  source 1..20: mol_type = other DNA
gccggcgacgtggggagggg

SEQ ID NO: 86736 - DNA, 20 bp, synthetic construct
  misc_feature 1..20: note = CRISPR gRNA sequence
  source 1..20: mol_type = other DNA
ggcgacgtggggagggggag

SEQ ID NO: 86737 - DNA, 20 bp, synthetic construct
  misc_feature 1..20: note = CRISPR gRNA sequence
  source 1..20: mol_type = other DNA
gacgtggggagggggagcag

SEQ ID NO: 86738 - DNA, 20 bp, synthetic construct
  misc_feature 1..20: note = CRISPR gRNA sequence
  source 1..20: mol_type = other DNA
acgtggggagggggagcagc

SEQ ID NO: 86739 - DNA, 20 bp, synthetic construct
  misc_feature 1..20: note = CRISPR gRNA sequence
  source 1..20: mol_type = other DNA
cgtggggagggggagcagcg

SEQ ID NO: 86740 - DNA, 20 bp, synthetic construct
  misc_feature 1..20: note = CRISPR gRNA sequence
  source 1..20: mol_type = other DNA
gtggggagggggagcagcgg

SEQ ID NO: 86741 - DNA, 20 bp, synthetic construct
  misc_feature 1..20: note = CRISPR gRNA sequence
  source 1..20: mol_type = other DNA
gggagggggagcagcggggg

SEQ ID NO: 86742 - DNA, 20 bp, synthetic construct
  misc_feature 1..20: note = CRISPR gRNA sequence
  source 1..20: mol_type = other DNA
gggagcagcgggggaagtcg

SEQ ID NO: 86743 - DNA, 20 bp, synthetic construct
  misc_feature 1..20: note = CRISPR gRNA sequence
  source 1..20: mol_type = other DNA
gcagcgggggaagtcgtggc

SEQ ID NO: 86744 - DNA, 20 bp, synthetic construct
  misc_feature 1..20: note = CRISPR gRNA sequence
  source 1..20: mol_type = other DNA
ggggaagtcgtggcgagatt

SEQ ID NO: 86745 - DNA, 20 bp, synthetic construct
  misc_feature 1..20: note = CRISPR gRNA sequence
  source 1..20: mol_type = other DNA
tcgtggcgagattaagtaat

SEQ ID NO: 86746 - DNA, 20 bp, synthetic construct
  misc_feature 1..20: note = CRISPR gRNA sequence
  source 1..20: mol_type = other DNA
gagattaagtaatgagaact

SEQ ID NO: 86747 - DNA, 20 bp, synthetic construct
  misc_feature 1..20: note = CRISPR gRNA sequence
  source 1..20: mol_type = other DNA
agattaagtaatgagaactt

SEQ ID NO: 86748 - DNA, 20 bp, synthetic construct
  misc_feature 1..20: note = CRISPR gRNA sequence
  source 1..20: mol_type = other DNA
aagtaatgagaacttgggcc

SEQ ID NO: 86749 - DNA, 20 bp, synthetic construct
  misc_feature 1..20: note = CRISPR gRNA sequence
  source 1..20: mol_type = other DNA
ttgggcccagttttttttcc

SEQ ID NO: 86750 - DNA, 20 bp, synthetic construct
  misc_feature 1..20: note = CRISPR gRNA sequence
  source 1..20: mol_type = other DNA
cccagttttttttccaagcc

SEQ ID NO: 86751 - DNA, 20 bp, synthetic construct
  misc_feature 1..20: note = CRISPR gRNA sequence
  source 1..20: mol_type = other DNA
agttttttttccaagcctag

SEQ ID NO: 86752 - DNA, 20 bp, synthetic construct
  misc_feature 1..20: note = CRISPR gRNA sequence
  source 1..20: mol_type = other DNA
gttttttttccaagcctaga

SEQ ID NO: 86753 - DNA, 20 bp, synthetic construct
  misc_feature 1..20: note = CRISPR gRNA sequence
  source 1..20: mol_type = other DNA
ttttttttccaagcctagaa

SEQ ID NO: 86754 - DNA, 20 bp, synthetic construct
  misc_feature 1..20: note = CRISPR gRNA sequence
  source 1..20: mol_type = other DNA
tttttccaagcctagaaggg

SEQ ID NO: 86755 - DNA, 20 bp, synthetic construct
  misc_feature 1..20: note = CRISPR gRNA sequence
  source 1..20: mol_type = other DNA
tcgtatcctttctgacctcc

SEQ ID NO: 86756 - DNA, 20 bp, synthetic construct
  misc_feature 1..20: note = CRISPR gRNA sequence
  source 1..20: mol_type = other DNA
cgtatcctttctgacctccc

SEQ ID NO: 86757 - DNA, 20 bp, synthetic construct
  misc_feature 1..20: note = CRISPR gRNA sequence
  source 1..20: mol_type = other DNA
gacctcccaggcatatgcaa

SEQ ID NO: 86758 - DNA, 20 bp, synthetic construct
  misc_feature 1..20: note = CRISPR gRNA sequence
  source 1..20: mol_type = other DNA
tcccaggcatatgcaatggt

SEQ ID NO: 86759 - DNA, 20 bp, synthetic construct
  misc_feature 1..20: note = CRISPR gRNA sequence
  source 1..20: mol_type = other DNA
cccaggcatatgcaatggtg

SEQ ID NO: 86760 - DNA, 20 bp, synthetic construct
  misc_feature 1..20: note = CRISPR gRNA sequence
  source 1..20: mol_type = other DNA
caggcatatgcaatggtgag

SEQ ID NO: 86761 - DNA, 20 bp, synthetic construct
  misc_feature 1..20: note = CRISPR gRNA sequence
  source 1..20: mol_type = other DNA
caatggtgaggagtattttt

SEQ ID NO: 86762 - DNA, 20 bp, synthetic construct
  misc_feature 1..20: note = CRISPR gRNA sequence
  source 1..20: mol_type = other DNA
tgaggagtatttttgagaat

SEQ ID NO: 86763 - DNA, 20 bp, synthetic construct
  misc_feature 1..20: note = CRISPR gRNA sequence
  source 1..20: mol_type = other DNA
aggagtatttttgagaatta

SEQ ID NO: 86764 - DNA, 20 bp, synthetic construct
  misc_feature 1..20: note = CRISPR gRNA sequence
  source 1..20: mol_type = other DNA
aattagagaactttgttttg

SEQ ID NO: 86765 - DNA, 20 bp, synthetic construct
  misc_feature 1..20: note = CRISPR gRNA sequence
  source 1..20: mol_type = other DNA
tggctgttattgttgttttt

SEQ ID NO: 86766 - DNA, 20 bp, synthetic construct
  misc_feature 1..20: note = CRISPR gRNA sequence
  source 1..20: mol_type = other DNA
ggctgttattgttgtttttg

SEQ ID NO: 86767 - DNA, 20 bp, synthetic construct
  misc_feature 1..20: note = CRISPR gRNA sequence
  source 1..20: mol_type = other DNA
gctgttattgttgtttttga

SEQ ID NO: 86768 - DNA, 20 bp, synthetic construct
  misc_feature 1..20: note = CRISPR gRNA sequence
  source 1..20: mol_type = other DNA
ctgttattgttgtttttgag

SEQ ID NO: 86769 - DNA, 20 bp, synthetic construct
  misc_feature 1..20: note = CRISPR gRNA sequence
  source 1..20: mol_type = other DNA
tgttattgttgtttttgagg

SEQ ID NO: 86770 - DNA, 20 bp, synthetic construct
  misc_feature 1..20: note = CRISPR gRNA sequence
  source 1..20: mol_type = other DNA
ttattgttgtttttgagggg

SEQ ID NO: 86771 - DNA, 20 bp, synthetic construct
  misc_feature 1..20: note = CRISPR gRNA sequence
  source 1..20: mol_type = other DNA
tattgttgtttttgaggggg

SEQ ID NO: 86772 - DNA, 20 bp, synthetic construct
  misc_feature 1..20: note = CRISPR gRNA sequence
  source 1..20: mol_type = other DNA
ttgttgtttttgagggggag

SEQ ID NO: 86773 - DNA, 20 bp, synthetic construct
  misc_feature 1..20: note = CRISPR gRNA sequence
  source 1..20: mol_type = other DNA
tgttgtttttgagggggagg

SEQ ID NO: 86774 - DNA, 20 bp, synthetic construct
  misc_feature 1..20: note = CRISPR gRNA sequence
  source 1..20: mol_type = other DNA
gttgtttttgagggggagga

SEQ ID NO: 86775 - DNA, 20 bp, synthetic construct
  misc_feature 1..20: note = CRISPR gRNA sequence
  source 1..20: mol_type = other DNA
gtttttgagggggaggaggg

SEQ ID NO: 86776 - DNA, 20 bp, synthetic construct
  misc_feature 1..20: note = CRISPR gRNA sequence
  source 1..20: mol_type = other DNA
tgagggggaggagggcagta

SEQ ID NO: 86777 - DNA, 20 bp, synthetic construct
  misc_feature 1..20: note = CRISPR gRNA sequence
  source 1..20: mol_type = other DNA
gagggggaggagggcagtat

SEQ ID NO: 86778 - DNA, 20 bp, synthetic construct
  misc_feature 1..20: note = CRISPR gRNA sequence
  source 1..20: mol_type = other DNA
agggggaggagggcagtatg

SEQ ID NO: 86779 - DNA, 20 bp, synthetic construct
  misc_feature 1..20: note = CRISPR gRNA sequence
  source 1..20: mol_type = other DNA
ggaggagggcagtatggggt

SEQ ID NO: 86780 - DNA, 20 bp, synthetic construct
  misc_feature 1..20: note = CRISPR gRNA sequence
  source 1..20: mol_type = other DNA
aggagggcagtatggggtca

SEQ ID NO: 86781 - DNA, 20 bp, synthetic construct
  misc_feature 1..20: note = CRISPR gRNA sequence
  source 1..20: mol_type = other DNA
ggagggcagtatggggtcag

SEQ ID NO: 86782 - DNA, 20 bp, synthetic construct
  misc_feature 1..20: note = CRISPR gRNA sequence
  source 1..20: mol_type = other DNA
gggcagtatggggtcagagg

SEQ ID NO: 86783 - DNA, 20 bp, synthetic construct
  misc_feature 1..20: note = CRISPR gRNA sequence
  source 1..20: mol_type = other DNA
atgaaaatttcttgctaaca

SEQ ID NO: 86784 - DNA, 20 bp, synthetic construct
  misc_feature 1..20: note = CRISPR gRNA sequence
  source 1..20: mol_type = other DNA
tccccctatctcttccttta

SEQ ID NO: 86785 - DNA, 20 bp, synthetic construct
  misc_feature 1..20: note = CRISPR gRNA sequence
  source 1..20: mol_type = other DNA
tctcttcctttacagttttc

SEQ ID NO: 86786 - DNA, 20 bp, synthetic construct
  misc_feature 1..20: note = CRISPR gRNA sequence
  source 1..20: mol_type = other DNA
cctttacagttttccagatt

SEQ ID NO: 86787 - DNA, 20 bp, synthetic construct
  misc_feature 1..20: note = CRISPR gRNA sequence
  source 1..20: mol_type = other DNA
ctttacagttttccagattt

SEQ ID NO: 86788 - DNA, 20 bp, synthetic construct
  misc_feature 1..20: note = CRISPR gRNA sequence
  source 1..20: mol_type = other DNA
ttacagttttccagatttag

SEQ ID NO: 86789 - DNA, 20 bp, synthetic construct
  misc_feature 1..20: note = CRISPR gRNA sequence
  source 1..20: mol_type = other DNA
tttccagatttaggagactt

SEQ ID NO: 86790 - DNA, 20 bp, synthetic construct
  misc_feature 1..20: note = CRISPR gRNA sequence
  source 1..20: mol_type = other DNA
cagatttaggagacttcaga

SEQ ID NO: 86791 - DNA, 20 bp, synthetic construct
  misc_feature 1..20: note = CRISPR gRNA sequence
  source 1..20: mol_type = other DNA
agatttaggagacttcagaa

SEQ ID NO: 86792 - DNA, 20 bp, synthetic construct
  misc_feature 1..20: note = CRISPR gRNA sequence
  source 1..20: mol_type = other DNA
tttaggagacttcagaaagg

SEQ ID NO: 86793 - DNA, 20 bp, synthetic construct
  misc_feature 1..20: note = CRISPR gRNA sequence
  source 1..20: mol_type = other DNA
ttaggagacttcagaaaggt

SEQ ID NO: 86794 - DNA, 20 bp, synthetic construct
  misc_feature 1..20: note = CRISPR gRNA sequence
  source 1..20: mol_type = other DNA
taggagacttcagaaaggtg

SEQ ID NO: 86795 - DNA, 20 bp, synthetic construct
  misc_feature 1..20: note = CRISPR gRNA sequence
  source 1..20: mol_type = other DNA
gagacttcagaaaggtgggg

SEQ ID NO: 86796 - DNA, 20 bp, synthetic construct
  misc_feature 1..20: note = CRISPR gRNA sequence
  source 1..20: mol_type = other DNA
cttcagaaaggtggggcaga

SEQ ID NO: 86797 - DNA, 20 bp, synthetic construct
  misc_feature 1..20: note = CRISPR gRNA sequence
  source 1..20: mol_type = other DNA
gaaaggtggggcagatagaa

SEQ ID NO: 86798 - DNA, 20 bp, synthetic construct
  misc_feature 1..20: note = CRISPR gRNA sequence
  source 1..20: mol_type = other DNA
aaggtggggcagatagaatg

SEQ ID NO: 86799 - DNA, 20 bp, synthetic construct
  misc_feature 1..20: note = CRISPR gRNA sequence
  source 1..20: mol_type = other DNA
tggggcagatagaatggaga

SEQ ID NO: 86800 - DNA, 20 bp, synthetic construct
  misc_feature 1..20: note = CRISPR gRNA sequence
  source 1..20: mol_type = other DNA
cagatagaatggagatggca

SEQ ID NO: 86801 - DNA, 20 bp, synthetic construct
  misc_feature 1..20: note = CRISPR gRNA sequence
  source 1..20: mol_type = other DNA
ggagatggcaaagatctctt

SEQ ID NO: 86802 - DNA, 20 bp, synthetic construct
  misc_feature 1..20: note = CRISPR gRNA sequence
  source 1..20: mol_type = other DNA
gagatggcaaagatctcttt

SEQ ID NO: 86803 - DNA, 20 bp, synthetic construct
  misc_feature 1..20: note = CRISPR gRNA sequence
  source 1..20: mol_type = other DNA
aagatctctttgggcatata

SEQ ID NO: 86804 - DNA, 20 bp, synthetic construct
  misc_feature 1..20: note = CRISPR gRNA sequence
  source 1..20: mol_type = other DNA
agatctctttgggcatatat

SEQ ID NO: 86805 - DNA, 20 bp, synthetic construct
  misc_feature 1..20: note = CRISPR gRNA sequence
  source 1..20: mol_type = other DNA
tctttgggcatatatgggcc

SEQ ID NO: 86806 - DNA, 20 bp, synthetic construct
  misc_feature 1..20: note = CRISPR gRNA sequence
  source 1..20: mol_type = other DNA
gggcatatatgggcctggcg

SEQ ID NO: 86807 - DNA, 20 bp, synthetic construct
  misc_feature 1..20: note = CRISPR gRNA sequence
  source 1..20: mol_type = other DNA
atatgggcctggcgaagtaa

SEQ ID NO: 86808 - DNA, 20 bp, synthetic construct
  misc_feature 1..20: note = CRISPR gRNA sequence
  source 1..20: mol_type = other DNA
atggaataatttctaatttt

SEQ ID NO: 86809 - DNA, 20 bp, synthetic construct
  misc_feature 1..20: note = CRISPR gRNA sequence
  source 1..20: mol_type = other DNA
ggaataatttctaattttcg

SEQ ID NO: 86810 - DNA, 20 bp, synthetic construct
  misc_feature 1..20: note = CRISPR gRNA sequence
  source 1..20: mol_type = other DNA
ataatttctaattttcggag

SEQ ID NO: 86811 - DNA, 20 bp, synthetic construct
  misc_feature 1..20: note = CRISPR gRNA sequence
  source 1..20: mol_type = other DNA
taatttctaattttcggaga

SEQ ID NO: 86812 - DNA, 20 bp, synthetic construct
  misc_feature 1..20: note = CRISPR gRNA sequence
  source 1..20: mol_type = other DNA
ttctaattttcggagaaggc

SEQ ID NO: 86813 - DNA, 20 bp, synthetic construct
  misc_feature 1..20: note = CRISPR gRNA sequence
  source 1..20: mol_type = other DNA
taattttcggagaaggcaag

SEQ ID NO: 86814 - DNA, 20 bp, synthetic construct
  misc_feature 1..20: note = CRISPR gRNA sequence
  source 1..20: mol_type = other DNA
tttcggagaaggcaagtggt

SEQ ID NO: 86815 - DNA, 20 bp, synthetic construct
  misc_feature 1..20: note = CRISPR gRNA sequence
  source 1..20: mol_type = other DNA
agaaggcaagtggtgagaaa

SEQ ID NO: 86816 - DNA, 20 bp, synthetic construct
  misc_feature 1..20: note = CRISPR gRNA sequence
  source 1..20: mol_type = other DNA
agtggtgagaaaaagaccac

SEQ ID NO: 86817 - DNA, 20 bp, synthetic construct
  misc_feature 1..20: note = CRISPR gRNA sequence
  source 1..20: mol_type = other DNA
gtggtgagaaaaagaccacc

SEQ ID NO: 86818 - DNA, 20 bp, synthetic construct
  misc_feature 1..20: note = CRISPR gRNA sequence
  source 1..20: mol_type = other DNA
tggtgagaaaaagaccaccg

SEQ ID NO: 86819 - DNA, 20 bp, synthetic construct
  misc_feature 1..20: note = CRISPR gRNA sequence
  source 1..20: mol_type = other DNA
aaaagaccaccggggaaatt

SEQ ID NO: 86820 - DNA, 20 bp, synthetic construct
  misc_feature 1..20: note = CRISPR gRNA sequence
  source 1..20: mol_type = other DNA
aagaccaccggggaaattcg

SEQ ID NO: 86821 - DNA, 20 bp, synthetic construct
  misc_feature 1..20: note = CRISPR gRNA sequence
  source 1..20: mol_type = other DNA
agaccaccggggaaattcgg

SEQ ID NO: 86822 - DNA, 20 bp, synthetic construct
  misc_feature 1..20: note = CRISPR gRNA sequence
  source 1..20: mol_type = other DNA
tttctgtttctctgcctttc

SEQ ID NO: 86823 - DNA, 20 bp, synthetic construct
  misc_feature 1..20: note = CRISPR gRNA sequence
  source 1..20: mol_type = other DNA
ttctgtttctctgcctttct

SEQ ID NO: 86824 - DNA, 20 bp, synthetic construct
  misc_feature 1..20: note = CRISPR gRNA sequence
  source 1..20: mol_type = other DNA
tttctctgcctttctgggta

SEQ ID NO: 86825 - DNA, 20 bp, synthetic construct
  misc_feature 1..20: note = CRISPR gRNA sequence
  source 1..20: mol_type = other DNA
tctctgcctttctgggtaaa

SEQ ID NO: 86826 - DNA, 20 bp, synthetic construct
  misc_feature 1..20: note = CRISPR gRNA sequence
  source 1..20: mol_type = other DNA
gcctttctgggtaaagagat

SEQ ID NO: 86827 - DNA, 20 bp, synthetic construct
  misc_feature 1..20: note = CRISPR gRNA sequence
  source 1..20: mol_type = other DNA
cctttctgggtaaagagatg

SEQ ID NO: 86828 - DNA, 20 bp, synthetic construct
  misc_feature 1..20: note = CRISPR gRNA sequence
  source 1..20: mol_type = other DNA
tttctgggtaaagagatgag

SEQ ID NO: 86829 - DNA, 20 bp, synthetic construct
  misc_feature 1..20: note = CRISPR gRNA sequence
  source 1..20: mol_type = other DNA
taaagagatgaggagtgccc

SEQ ID NO: 86830 - DNA, 20 bp, synthetic construct
  misc_feature 1..20: note = CRISPR gRNA sequence
  source 1..20: mol_type = other DNA
aaagagatgaggagtgccct

SEQ ID NO: 86831 - DNA, 20 bp, synthetic construct
  misc_feature 1..20: note = CRISPR gRNA sequence
  source 1..20: mol_type = other DNA
aagagatgaggagtgccctg

SEQ ID NO: 86832 - DNA, 20 bp, synthetic construct
  misc_feature 1..20: note = CRISPR gRNA sequence
  source 1..20: mol_type = other DNA
aggagtgccctggggccttc

SEQ ID NO: 86833 - DNA, 20 bp, synthetic construct
  misc_feature 1..20: note = CRISPR gRNA sequence
  source 1..20: mol_type = other DNA
ggagtgccctggggccttct

SEQ ID NO: 86834 - DNA, 20 bp, synthetic construct
  misc_feature 1..20: note = CRISPR gRNA sequence
  source 1..20: mol_type = other DNA
gagtgccctggggccttctg

SEQ ID NO: 86835 - DNA, 20 bp, synthetic construct
  misc_feature 1..20: note = CRISPR gRNA sequence
  source 1..20: mol_type = other DNA
tgccctggggccttctgggg

SEQ ID NO: 86836 - DNA, 20 bp, synthetic construct
  misc_feature 1..20: note = CRISPR gRNA sequence
  source 1..20: mol_type = other DNA
gccctggggccttctgggga

SEQ ID NO: 86837 - DNA, 20 bp, synthetic construct
  misc_feature 1..20: note = CRISPR gRNA sequence
  source 1..20: mol_type = other DNA
ccctggggccttctggggaa

SEQ ID NO: 86838 - DNA, 20 bp, synthetic construct
  misc_feature 1..20: note = CRISPR gRNA sequence
  source 1..20: mol_type = other DNA
tggggccttctggggaaggg

SEQ ID NO: 86839 - DNA, 20 bp, synthetic construct
  misc_feature 1..20: note = CRISPR gRNA sequence
  source 1..20: mol_type = other DNA
ggggccttctggggaaggga

SEQ ID NO: 86840 - DNA, 20 bp, synthetic construct
  misc_feature 1..20: note = CRISPR gRNA sequence
  source 1..20: mol_type = other DNA
ccttctggggaagggaaggc

SEQ ID NO: 86841 - DNA, 20 bp, synthetic construct
  misc_feature 1..20: note = CRISPR gRNA sequence
  source 1..20: mol_type = other DNA
ggggaagggaaggccagtgt

SEQ ID NO: 86842 - DNA, 20 bp, synthetic construct
  misc_feature 1..20: note = CRISPR gRNA sequence
  source 1..20: mol_type = other DNA
atgcctgtccctctcaattc

SEQ ID NO: 86843 - DNA, 20 bp, synthetic construct
  misc_feature 1..20: note = CRISPR gRNA sequence
  source 1..20: mol_type = other DNA
ctcaattctagccctcatgc

SEQ ID NO: 86844 - DNA, 20 bp, synthetic construct
  misc_feature 1..20: note = CRISPR gRNA sequence
  source 1..20: mol_type = other DNA
tcaattctagccctcatgcc

SEQ ID NO: 86845 - DNA, 20 bp, synthetic construct
  misc_feature 1..20: note = CRISPR gRNA sequence
  source 1..20: mol_type = other DNA
ttctagccctcatgccggga

SEQ ID NO: 86846 - DNA, 20 bp, synthetic construct
  misc_feature 1..20: note = CRISPR gRNA sequence
  source 1..20: mol_type = other DNA
tagccctcatgccgggatgg

SEQ ID NO: 86847 - DNA, 20 bp, synthetic construct
  misc_feature 1..20: note = CRISPR gRNA sequence
  source 1..20: mol_type = other DNA
ccctcatgccgggatggcag

SEQ ID NO: 86848 - DNA, 20 bp, synthetic construct
  misc_feature 1..20: note = CRISPR gRNA sequence
  source 1..20: mol_type = other DNA
atgccgggatggcagaagat

SEQ ID NO: 86849 - DNA, 20 bp, synthetic construct
  misc_feature 1..20: note = CRISPR gRNA sequence
  source 1..20: mol_type = other DNA
cagaagatgagcctgatgct

SEQ ID NO: 86850 - DNA, 20 bp, synthetic construct
  misc_feature 1..20: note = CRISPR gRNA sequence
  source 1..20: mol_type = other DNA
gaagatgagcctgatgctaa

SEQ ID NO: 86851 - DNA, 20 bp, synthetic construct
  misc_feature 1..20: note = CRISPR gRNA sequence
  source 1..20: mol_type = other DNA
agcctgatgctaagagcccc

SEQ ID NO: 86852 - DNA, 20 bp, synthetic construct
  misc_feature 1..20: note = CRISPR gRNA sequence
  source 1..20: mol_type = other DNA
gatgctaagagccccaagac

SEQ ID NO: 86853 - DNA, 20 bp, synthetic construct
  misc_feature 1..20: note = CRISPR gRNA sequence
  source 1..20: mol_type = other DNA
atgctaagagccccaagact

SEQ ID NO: 86854 - DNA, 20 bp, synthetic construct
  misc_feature 1..20: note = CRISPR gRNA sequence
  source 1..20: mol_type = other DNA
tgctaagagccccaagactg

SEQ ID NO: 86855 - DNA, 20 bp, synthetic construct
  misc_feature 1..20: note = CRISPR gRNA sequence
  source 1..20: mol_type = other DNA
gctaagagccccaagactgg

SEQ ID NO: 86856 - DNA, 20 bp, synthetic construct
  misc_feature 1..20: note = CRISPR gRNA sequence
  source 1..20: mol_type = other DNA
aagagccccaagactggggg

SEQ ID NO: 86857 - DNA, 20 bp, synthetic construct
  misc_feature 1..20: note = CRISPR gRNA sequence
  source 1..20: mol_type = other DNA
agagccccaagactggggga

SEQ ID NO: 86858 - DNA, 20 bp, synthetic construct
  misc_feature 1..20: note = CRISPR gRNA sequence
  source 1..20: mol_type = other DNA
gagccccaagactgggggaa

SEQ ID NO: 86859 - DNA, 20 bp, synthetic construct
  misc_feature 1..20: note = CRISPR gRNA sequence
  source 1..20: mol_type = other DNA
gactgggggaagggcccccc

SEQ ID NO: 86860 - DNA, 20 bp, synthetic construct
  misc_feature 1..20: note = CRISPR gRNA sequence
  source 1..20: mol_type = other DNA
actgggggaagggccccccc

SEQ ID NO: 86861 - DNA, 20 bp, synthetic construct
  misc_feature 1..20: note = CRISPR gRNA sequence
  source 1..20: mol_type = other DNA
gggggaagggcccccccagg

SEQ ID NO: 86862 - DNA, 20 bp, synthetic construct
  misc_feature 1..20: note = CRISPR gRNA sequence
  source 1..20: mol_type = other DNA
gggcccccccaggtggtgct

SEQ ID NO: 86863 - DNA, 20 bp, synthetic construct
  misc_feature 1..20: note = CRISPR gRNA sequence
  source 1..20: mol_type = other DNA
ggcccccccaggtggtgctg

SEQ ID NO: 86864 - DNA, 20 bp, synthetic construct
  misc_feature 1..20: note = CRISPR gRNA sequence
  source 1..20: mol_type = other DNA
cccccaggtggtgctgaggc

SEQ ID NO: 86865 - DNA, 20 bp, synthetic construct
  misc_feature 1..20: note = CRISPR gRNA sequence
  source 1..20: mol_type = other DNA
ccccaggtggtgctgaggct

SEQ ID NO: 86866 - DNA, 20 bp, synthetic construct
  misc_feature 1..20: note = CRISPR gRNA sequence
  source 1..20: mol_type = other DNA
cccaggtggtgctgaggctg

SEQ ID NO: 86867 - DNA, 20 bp, synthetic construct
  misc_feature 1..20: note = CRISPR gRNA sequence
  source 1..20: mol_type = other DNA
gggaacctaccacccttctt

SEQ ID NO: 86868 - DNA, 20 bp, synthetic construct
  misc_feature 1..20: note = CRISPR gRNA sequence
  source 1..20: mol_type = other DNA
gaacctaccacccttcttca

SEQ ID NO: 86869 - DNA, 20 bp, synthetic construct
  misc_feature 1..20: note = CRISPR gRNA sequence
  source 1..20: mol_type = other DNA
aacctaccacccttcttcag

SEQ ID NO: 86870 - DNA, 20 bp, synthetic construct
  misc_feature 1..20: note = CRISPR gRNA sequence
  source 1..20: mol_type = other DNA
cacccttcttcagaggctcc

SEQ ID NO: 86871 - DNA, 20 bp, synthetic construct
  misc_feature 1..20: note = CRISPR gRNA sequence
  source 1..20: mol_type = other DNA
acccttcttcagaggctccg

SEQ ID NO: 86872 - DNA, 20 bp, synthetic construct
  misc_feature 1..20: note = CRISPR gRNA sequence
  source 1..20: mol_type = other DNA
gctccgaggtaccatttcgt

SEQ ID NO: 86873 - DNA, 20 bp, synthetic construct
  misc_feature 1..20: note = CRISPR gRNA sequence
  source 1..20: mol_type = other DNA
taagtactcatcacatctcc

SEQ ID NO: 86874 - DNA, 20 bp, synthetic construct
  misc_feature 1..20: note = CRISPR gRNA sequence
  source 1..20: mol_type = other DNA
cacatctccaagtcctgtcc

SEQ ID NO: 86875 - DNA, 20 bp, synthetic construct
  misc_feature 1..20: note = CRISPR gRNA sequence
  source 1..20: mol_type = other DNA
ccaagtcctgtccaagacct

SEQ ID NO: 86876 - DNA, 20 bp, synthetic construct
  misc_feature 1..20: note = CRISPR gRNA sequence
  source 1..20: mol_type = other DNA
tcctgtccaagacctgagta

SEQ ID NO: 86877 - DNA, 20 bp, synthetic construct
  misc_feature 1..20: note = CRISPR gRNA sequence
  source 1..20: mol_type = other DNA
gacctgagtatagatccctg

SEQ ID NO: 86878 - DNA, 20 bp, synthetic construct
  misc_feature 1..20: note = CRISPR gRNA sequence
  source 1..20: mol_type = other DNA
atccctgcagcacttcactt

SEQ ID NO: 86879 - DNA, 20 bp, synthetic construct
  misc_feature 1..20: note = CRISPR gRNA sequence
  source 1..20: mol_type = other DNA
gcagcacttcactttggctg

SEQ ID NO: 86880 - DNA, 20 bp, synthetic construct
  misc_feature 1..20: note = CRISPR gRNA sequence
  source 1..20: mol_type = other DNA
gctgtagatgaactgcctct

SEQ ID NO: 86881 - DNA, 20 bp, synthetic construct
  misc_feature 1..20: note = CRISPR gRNA sequence
  source 1..20: mol_type = other DNA
tagatgaactgcctctcagc

SEQ ID NO: 86882 - DNA, 20 bp, synthetic construct
  misc_feature 1..20: note = CRISPR gRNA sequence
  source 1..20: mol_type = other DNA
agatgaactgcctctcagca

SEQ ID NO: 86883 - DNA, 20 bp, synthetic construct
  misc_feature 1..20: note = CRISPR gRNA sequence
  source 1..20: mol_type = other DNA
gatgaactgcctctcagcaa

SEQ ID NO: 86884 - DNA, 20 bp, synthetic construct
  misc_feature 1..20: note = CRISPR gRNA sequence
  source 1..20: mol_type = other DNA
actgcctctcagcaagggca

SEQ ID NO: 86885 - DNA, 20 bp, synthetic construct
  misc_feature 1..20: note = CRISPR gRNA sequence
  source 1..20: mol_type = other DNA
ctgcctctcagcaagggcat

SEQ ID NO: 86886 - DNA, 20 bp, synthetic construct
  misc_feature 1..20: note = CRISPR gRNA sequence
  source 1..20: mol_type = other DNA
gcctctcagcaagggcatgg

SEQ ID NO: 86887 - DNA, 20 bp, synthetic construct
  misc_feature 1..20: note = CRISPR gRNA sequence
  source 1..20: mol_type = other DNA
tctcagcaagggcatgggag

SEQ ID NO: 86888 - DNA, 20 bp, synthetic construct
  misc_feature 1..20: note = CRISPR gRNA sequence
  source 1..20: mol_type = other DNA
tcagcaagggcatgggagca

SEQ ID NO: 86889 - DNA, 20 bp, synthetic construct
  misc_feature 1..20: note = CRISPR gRNA sequence
  source 1..20: mol_type = other DNA
cagcaagggcatgggagcag

SEQ ID NO: 86890 - DNA, 20 bp, synthetic construct
  misc_feature 1..20: note = CRISPR gRNA sequence
  source 1..20: mol_type = other DNA
agcaagggcatgggagcaga

SEQ ID NO: 86891 - DNA, 20 bp, synthetic construct
  misc_feature 1..20: note = CRISPR gRNA sequence
  source 1..20: mol_type = other DNA
caagggcatgggagcagagg

SEQ ID NO: 86892 - DNA, 20 bp, synthetic construct
  misc_feature 1..20: note = CRISPR gRNA sequence
  source 1..20: mol_type = other DNA
tgggagcagagggagatttt

SEQ ID NO: 86893 - DNA, 20 bp, synthetic construct
  misc_feature 1..20: note = CRISPR gRNA sequence
  source 1..20: mol_type = other DNA
cagagggagatttttggcca

SEQ ID NO: 86894 - DNA, 20 bp, synthetic construct
  misc_feature 1..20: note = CRISPR gRNA sequence
  source 1..20: mol_type = other DNA
agggagatttttggccatgg

SEQ ID NO: 86895 - DNA, 20 bp, synthetic construct
  misc_feature 1..20: note = CRISPR gRNA sequence
  source 1..20: mol_type = other DNA
tggccatggtagcaattctt

SEQ ID NO: 86896 - DNA, 20 bp, synthetic construct
  misc_feature 1..20: note = CRISPR gRNA sequence
  source 1..20: mol_type = other DNA
agcaattcttgagcacctgc

SEQ ID NO: 86897 - DNA, 20 bp, synthetic construct
  misc_feature 1..20: note = CRISPR gRNA sequence
  source 1..20: mol_type = other DNA
gcaattcttgagcacctgct

SEQ ID NO: 86898 - DNA, 20 bp, synthetic construct
  misc_feature 1..20: note = CRISPR gRNA sequence
  source 1..20: mol_type = other DNA
tgagcacctgctgggcattt

SEQ ID NO: 86899 - DNA, 20 bp, synthetic construct
  misc_feature 1..20: note = CRISPR gRNA sequence
  source 1..20: mol_type = other DNA
tttcagtccttttccctccc

SEQ ID NO: 86900 - DNA, 20 bp, synthetic construct
  misc_feature 1..20: note = CRISPR gRNA sequence
  source 1..20: mol_type = other DNA
cagtccttttccctccctag

SEQ ID NO: 86901 - DNA, 20 bp, synthetic construct
  misc_feature 1..20: note = CRISPR gRNA sequence
  source 1..20: mol_type = other DNA
ccttttccctccctagcagt

SEQ ID NO: 86902 - DNA, 20 bp, synthetic construct
  misc_feature 1..20: note = CRISPR gRNA sequence
  source 1..20: mol_type = other DNA
ccctccctagcagtcagata

SEQ ID NO: 86903 - DNA, 20 bp, synthetic construct
  misc_feature 1..20: note = CRISPR gRNA sequence
  source 1..20: mol_type = other DNA
ctccctagcagtcagataaa

SEQ ID NO: 86904 - DNA, 20 bp, synthetic construct
  misc_feature 1..20: note = CRISPR gRNA sequence
  source 1..20: mol_type = other DNA
ctagcagtcagataaagaga

SEQ ID NO: 86905 - DNA, 20 bp, synthetic construct
  misc_feature 1..20: note = CRISPR gRNA sequence
  source 1..20: mol_type = other DNA
tagcagtcagataaagagac

SEQ ID NO: 86906 - DNA, 20 bp, synthetic construct
  misc_feature 1..20: note = CRISPR gRNA sequence
  source 1..20: mol_type = other DNA
agcagtcagataaagagaca

SEQ ID NO: 86907 - DNA, 20 bp, synthetic construct
  misc_feature 1..20: note = CRISPR gRNA sequence
  source 1..20: mol_type = other DNA
aaaatcttgtgtgtgacctc

SEQ ID NO: 86908 - DNA, 20 bp, synthetic construct
  misc_feature 1..20: note = CRISPR gRNA sequence
  source 1..20: mol_type = other DNA
cagctttctcctcttcccca

SEQ ID NO: 86909 - DNA, 20 bp, synthetic construct
  misc_feature 1..20: note = CRISPR gRNA sequence
  source 1..20: mol_type = other DNA
tttctcctcttccccacagc

SEQ ID NO: 86910 - DNA, 20 bp, synthetic construct
  misc_feature 1..20: note = CRISPR gRNA sequence
  source 1..20: mol_type = other DNA
ttctcctcttccccacagca

SEQ ID NO: 86911 - DNA, 20 bp, synthetic construct
  misc_feature 1..20: note = CRISPR gRNA sequence
  source 1..20: mol_type = other DNA
ttccccacagcaaggccgtg

SEQ ID NO: 86912 - DNA, 20 bp, synthetic construct
  misc_feature 1..20: note = CRISPR gRNA sequence
  source 1..20: mol_type = other DNA
cagcaaggccgtgcagaaca

SEQ ID NO: 86913 - DNA, 20 bp, synthetic construct
  misc_feature 1..20: note = CRISPR gRNA sequence
  source 1..20: mol_type = other DNA
caaggccgtgcagaacaaag

SEQ ID NO: 86914 - DNA, 20 bp, synthetic construct
  misc_feature 1..20: note = CRISPR gRNA sequence
  source 1..20: mol_type = other DNA
aggccgtgcagaacaaagta

SEQ ID NO: 86915 - DNA, 20 bp, synthetic construct
  misc_feature 1..20: note = CRISPR gRNA sequence
  source 1..20: mol_type = other DNA
ggccgtgcagaacaaagtag

SEQ ID NO: 86916 - DNA, 20 bp, synthetic construct
  misc_feature 1..20: note = CRISPR gRNA sequence
  source 1..20: mol_type = other DNA
gccgtgcagaacaaagtaga

SEQ ID NO: 86917 - DNA, 20 bp, synthetic construct
  misc_feature 1..20: note = CRISPR gRNA sequence
  source 1..20: mol_type = other DNA
ccgtgcagaacaaagtagag

SEQ ID NO: 86918 - DNA, 20 bp, synthetic construct
  misc_feature 1..20: note = CRISPR gRNA sequence
  source 1..20: mol_type = other DNA
gaacaaagtagaggggatcc

SEQ ID NO: 86919 - DNA, 20 bp, synthetic construct
  misc_feature 1..20: note = CRISPR gRNA sequence
  source 1..20: mol_type = other DNA
aaagtagaggggatcctggt

SEQ ID NO: 86920 - DNA, 20 bp, synthetic construct
  misc_feature 1..20: note = CRISPR gRNA sequence
  source 1..20: mol_type = other DNA
ggggatcctggtaagtgtgt

SEQ ID NO: 86921 - DNA, 20 bp, synthetic construct
  misc_feature 1..20: note = CRISPR gRNA sequence
  source 1..20: mol_type = other DNA
gggatcctggtaagtgtgtt

SEQ ID NO: 86922 - DNA, 20 bp, synthetic construct
  misc_feature 1..20: note = CRISPR gRNA sequence
  source 1..20: mol_type = other DNA
ggatcctggtaagtgtgttg

SEQ ID NO: 86923 - DNA, 20 bp, synthetic construct
  misc_feature 1..20: note = CRISPR gRNA sequence
  source 1..20: mol_type = other DNA
tcctggtaagtgtgttgggg

SEQ ID NO: 86924 - DNA, 20 bp, synthetic construct
  misc_feature 1..20: note = CRISPR gRNA sequence
  source 1..20: mol_type = other DNA
ctggtaagtgtgttggggaa

SEQ ID NO: 86925 - DNA, 20 bp, synthetic construct
  misc_feature 1..20: note = CRISPR gRNA sequence
  source 1..20: mol_type = other DNA
tggtaagtgtgttggggaag

SEQ ID NO: 86926 - DNA, 20 bp, synthetic construct
  misc_feature 1..20: note = CRISPR gRNA sequence
  source 1..20: mol_type = other DNA
ggtaagtgtgttggggaaga

SEQ ID NO: 86927 - DNA, 20 bp, synthetic construct
  misc_feature 1..20: note = CRISPR gRNA sequence
  source 1..20: mol_type = other DNA
agtgtgttggggaagagggc

SEQ ID NO: 86928 - DNA, 20 bp, synthetic construct
  misc_feature 1..20: note = CRISPR gRNA sequence
  source 1..20: mol_type = other DNA
tgtgttggggaagagggcaa

SEQ ID NO: 86929 - DNA, 20 bp, synthetic construct
  misc_feature 1..20: note = CRISPR gRNA sequence
  source 1..20: mol_type = other DNA
tgttggggaagagggcaaga

SEQ ID NO: 86930 - DNA, 20 bp, synthetic construct
  misc_feature 1..20: note = CRISPR gRNA sequence
  source 1..20: mol_type = other DNA
gttggggaagagggcaagag

SEQ ID NO: 86931 - DNA, 20 bp, synthetic construct
  misc_feature 1..20: note = CRISPR gRNA sequence
  source 1..20: mol_type = other DNA
ttggggaagagggcaagaga

SEQ ID NO: 86932 - DNA, 20 bp, synthetic construct
  misc_feature 1..20: note = CRISPR gRNA sequence
  source 1..20: mol_type = other DNA
ggaagagggcaagagaggga

SEQ ID NO: 86933 - DNA, 20 bp, synthetic construct
  misc_feature 1..20: note = CRISPR gRNA sequence
  source 1..20: mol_type = other DNA
aagagagggatggaaatgct

SEQ ID NO: 86934 - DNA, 20 bp, synthetic construct
  misc_feature 1..20: note = CRISPR gRNA sequence
  source 1..20: mol_type = other DNA
agagagggatggaaatgctg

SEQ ID NO: 86935 - DNA, 20 bp, synthetic construct
  misc_feature 1..20: note = CRISPR gRNA sequence
  source 1..20: mol_type = other DNA
gagagggatggaaatgctga

SEQ ID NO: 86936 - DNA, 20 bp, synthetic construct
  misc_feature 1..20: note = CRISPR gRNA sequence
  source 1..20: mol_type = other DNA
gagggatggaaatgctgagg

SEQ ID NO: 86937 - DNA, 20 bp, synthetic construct
  misc_feature 1..20: note = CRISPR gRNA sequence
  source 1..20: mol_type = other DNA
agggatggaaatgctgaggg

SEQ ID NO: 86938 - DNA, 20 bp, synthetic construct
  misc_feature 1..20: note = CRISPR gRNA sequence
  source 1..20: mol_type = other DNA
ggatggaaatgctgagggag

SEQ ID NO: 86939 - DNA, 20 bp, synthetic construct
  misc_feature 1..20: note = CRISPR gRNA sequence
  source 1..20: mol_type = other DNA
gatggaaatgctgagggagg

SEQ ID NO: 86940 - DNA, 20 bp, synthetic construct
  misc_feature 1..20: note = CRISPR gRNA sequence
  source 1..20: mol_type = other DNA
atgctgagggaggaggatgt

SEQ ID NO: 86941 - DNA, 20 bp, synthetic construct
  misc_feature 1..20: note = CRISPR gRNA sequence
  source 1..20: mol_type = other DNA
tgctgagggaggaggatgtg

SEQ ID NO: 86942 - DNA, 20 bp, synthetic construct
  misc_feature 1..20: note = CRISPR gRNA sequence
  source 1..20: mol_type = other DNA
ggaggaggatgtgaggatga

SEQ ID NO: 86943 - DNA, 20 bp, synthetic construct
  misc_feature 1..20: note = CRISPR gRNA sequence
  source 1..20: mol_type = other DNA
gaggaggatgtgaggatgat

SEQ ID NO: 86944 - DNA, 20 bp, synthetic construct
  misc_feature 1..20: note = CRISPR gRNA sequence
  source 1..20: mol_type = other DNA
gcatcaacaaaacattgatg

SEQ ID NO: 86945 - DNA, 20 bp, synthetic construct
  misc_feature 1..20: note = CRISPR gRNA sequence
  source 1..20: mol_type = other DNA
catcaacaaaacattgatgt

SEQ ID NO: 86946 - DNA, 20 bp, synthetic construct
  misc_feature 1..20: note = CRISPR gRNA sequence
  source 1..20: mol_type = other DNA
tcaacaaaacattgatgtgg

SEQ ID NO: 86947 - DNA, 20 bp, synthetic construct
  misc_feature 1..20: note = CRISPR gRNA sequence
  source 1..20: mol_type = other DNA
aacaaaacattgatgtggga

SEQ ID NO: 86948 - DNA, 20 bp, synthetic construct
  misc_feature 1..20: note = CRISPR gRNA sequence
  source 1..20: mol_type = other DNA
acaaaacattgatgtgggag

SEQ ID NO: 86949 - DNA, 20 bp, synthetic construct
  misc_feature 1..20: note = CRISPR gRNA sequence
  source 1..20: mol_type = other DNA
aaacattgatgtgggagagg

SEQ ID NO: 86950 - DNA, 20 bp, synthetic construct
  misc_feature 1..20: note = CRISPR gRNA sequence
  source 1..20: mol_type = other DNA
aacattgatgtgggagaggt

SEQ ID NO: 86951 - DNA, 20 bp, synthetic construct
  misc_feature 1..20: note = CRISPR gRNA sequence
  source 1..20: mol_type = other DNA
acattgatgtgggagaggta

SEQ ID NO: 86952 - DNA, 20 bp, synthetic construct
  misc_feature 1..20: note = CRISPR gRNA sequence
  source 1..20: mol_type = other DNA
ggtagggtcctctgccttgt

SEQ ID NO: 86953 - DNA, 20 bp, synthetic construct
  misc_feature 1..20: note = CRISPR gRNA sequence
  source 1..20: mol_type = other DNA
agggtcctctgccttgtcag

SEQ ID NO: 86954 - DNA, 20 bp, synthetic construct
  misc_feature 1..20: note = CRISPR gRNA sequence
  source 1..20: mol_type = other DNA
tcctctgccttgtcagaaga

SEQ ID NO: 86955 - DNA, 20 bp, synthetic construct
  misc_feature 1..20: note = CRISPR gRNA sequence
  source 1..20: mol_type = other DNA
ctgccttgtcagaagatagt

SEQ ID NO: 86956 - DNA, 20 bp, synthetic construct
  misc_feature 1..20: note = CRISPR gRNA sequence
  source 1..20: mol_type = other DNA
tggctttgcaaacttgctgc

SEQ ID NO: 86957 - DNA, 20 bp, synthetic construct
  misc_feature 1..20: note = CRISPR gRNA sequence
  source 1..20: mol_type = other DNA
gcctctcacttgatctctgt

SEQ ID NO: 86958 - DNA, 20 bp, synthetic construct
  misc_feature 1..20: note = CRISPR gRNA sequence
  source 1..20: mol_type = other DNA
gatctctgtgagcacttgca

SEQ ID NO: 86959 - DNA, 20 bp, synthetic construct
  misc_feature 1..20: note = CRISPR gRNA sequence
  source 1..20: mol_type = other DNA
ctctgtgagcacttgcatag

SEQ ID NO: 86960 - DNA, 20 bp, synthetic construct
  misc_feature 1..20: note = CRISPR gRNA sequence
  source 1..20: mol_type = other DNA
tgagcacttgcatagaagcc

SEQ ID NO: 86961 - DNA, 20 bp, synthetic construct
  misc_feature 1..20: note = CRISPR gRNA sequence
  source 1..20: mol_type = other DNA
gcacttgcatagaagcccag

SEQ ID NO: 86962 - DNA, 20 bp, synthetic construct
  misc_feature 1..20: note = CRISPR gRNA sequence
  source 1..20: mol_type = other DNA
acttgcatagaagcccagca

SEQ ID NO: 86963 - DNA, 20 bp, synthetic construct
  misc_feature 1..20: note = CRISPR gRNA sequence
  source 1..20: mol_type = other DNA
atagaagcccagcagagatg

SEQ ID NO: 86964 - DNA, 20 bp, synthetic construct
  misc_feature 1..20: note = CRISPR gRNA sequence
  source 1..20: mol_type = other DNA
aagcccagcagagatgaagt

SEQ ID NO: 86965 - DNA, 20 bp, synthetic construct
  misc_feature 1..20: note = CRISPR gRNA sequence
  source 1..20: mol_type = other DNA
gcccagcagagatgaagtca

SEQ ID NO: 86966 - DNA, 20 bp, synthetic construct
  misc_feature 1..20: note = CRISPR gRNA sequence
  source 1..20: mol_type = other DNA
ctctacttccctcctctcca

SEQ ID NO: 86967 - DNA, 20 bp, synthetic construct
  misc_feature 1..20: note = CRISPR gRNA sequence
  source 1..20: mol_type = other DNA
tacttccctcctctccatgg

SEQ ID NO: 86968 - DNA, 20 bp, synthetic construct
  misc_feature 1..20: note = CRISPR gRNA sequence
  source 1..20: mol_type = other DNA
ctcctctccatggtagccta

SEQ ID NO: 86969 - DNA, 20 bp, synthetic construct
  misc_feature 1..20: note = CRISPR gRNA sequence
  source 1..20: mol_type = other DNA
tcctctccatggtagcctat

SEQ ID NO: 86970 - DNA, 20 bp, synthetic construct
  misc_feature 1..20: note = CRISPR gRNA sequence
  source 1..20: mol_type = other DNA
cctctccatggtagcctata

SEQ ID NO: 86971 - DNA, 20 bp, synthetic construct
  misc_feature 1..20: note = CRISPR gRNA sequence
  source 1..20: mol_type = other DNA
tggtagcctatagggctcct

SEQ ID NO: 86972 - DNA, 20 bp, synthetic construct
  misc_feature 1..20: note = CRISPR gRNA sequence
  source 1..20: mol_type = other DNA
gtagcctatagggctcctca

SEQ ID NO: 86973 - DNA, 20 bp, synthetic construct
  misc_feature 1..20: note = CRISPR gRNA sequence
  source 1..20: mol_type = other DNA
atagggctcctcagagcacc

SEQ ID NO: 86974 - DNA, 20 bp, synthetic construct
  misc_feature 1..20: note = CRISPR gRNA sequence
  source 1..20: mol_type = other DNA
tctttttttttttttttttt

SEQ ID NO: 86975 - DNA, 20 bp, synthetic construct
  misc_feature 1..20: note = CRISPR gRNA sequence
  source 1..20: mol_type = other DNA
ttttttttttttttttgaga

SEQ ID NO: 86976 - DNA, 20 bp, synthetic construct
  misc_feature 1..20: note = CRISPR gRNA sequence
  source 1..20: mol_type = other DNA
ttttttttttttttgagatg

SEQ ID NO: 86977 - DNA, 20 bp, synthetic construct
  misc_feature 1..20: note = CRISPR gRNA sequence
  source 1..20: mol_type = other DNA
tggagtctcactctgtcgcc

SEQ ID NO: 86978 - DNA, 20 bp, synthetic construct
  misc_feature 1..20: note = CRISPR gRNA sequence
  source 1..20: mol_type = other DNA
ggagtctcactctgtcgcct

SEQ ID NO: 86979 - DNA, 20 bp, synthetic construct
  misc_feature 1..20: note = CRISPR gRNA sequence
  source 1..20: mol_type = other DNA
tctcactctgtcgcctaggc

SEQ ID NO: 86980 - DNA, 20 bp, synthetic construct
  misc_feature 1..20: note = CRISPR gRNA sequence
  source 1..20: mol_type = other DNA
tcactctgtcgcctaggctg

SEQ ID NO: 86981 - DNA, 20 bp, synthetic construct
  misc_feature 1..20: note = CRISPR gRNA sequence
  source 1..20: mol_type = other DNA
ctgtcgcctaggctggagtg

SEQ ID NO: 86982 - DNA, 20 bp, synthetic construct
  misc_feature 1..20: note = CRISPR gRNA sequence
  source 1..20: mol_type = other DNA
tcgcctaggctggagtgcag

SEQ ID NO: 86983 - DNA, 20 bp, synthetic construct
  misc_feature 1..20: note = CRISPR gRNA sequence
  source 1..20: mol_type = other DNA
ggagtgcagtggcgcaatct

SEQ ID NO: 86984 - DNA, 20 bp, synthetic construct
  misc_feature 1..20: note = CRISPR gRNA sequence
  source 1..20: mol_type = other DNA
gcgcaatctcggctcactgc

SEQ ID NO: 86985 - DNA, 20 bp, synthetic construct
  misc_feature 1..20: note = CRISPR gRNA sequence
  source 1..20: mol_type = other DNA
tcactgcaagctccgcctcc

SEQ ID NO: 86986 - DNA, 20 bp, synthetic construct
  misc_feature 1..20: note = CRISPR gRNA sequence
  source 1..20: mol_type = other DNA
cactgcaagctccgcctccc

SEQ ID NO: 86987 - DNA, 20 bp, synthetic construct
  misc_feature 1..20: note = CRISPR gRNA sequence
  source 1..20: mol_type = other DNA
ttcacgccattctcctgcct

SEQ ID NO: 86988 - DNA, 20 bp, synthetic construct
  misc_feature 1..20: note = CRISPR gRNA sequence
  source 1..20: mol_type = other DNA
ttctcctgcctcagcctccc

SEQ ID NO: 86989 - DNA, 20 bp, synthetic construct
  misc_feature 1..20: note = CRISPR gRNA sequence
  source 1..20: mol_type = other DNA
tcctgcctcagcctcccaag

SEQ ID NO: 86990 - DNA, 20 bp, synthetic construct
  misc_feature 1..20: note = CRISPR gRNA sequence
  source 1..20: mol_type = other DNA
gcctcagcctcccaagtagc

SEQ ID NO: 86991 - DNA, 20 bp, synthetic construct
  misc_feature 1..20: note = CRISPR gRNA sequence
  source 1..20: mol_type = other DNA
cctcagcctcccaagtagct

SEQ ID NO: 86992 - DNA, 20 bp, synthetic construct
  misc_feature 1..20: note = CRISPR gRNA sequence
  source 1..20: mol_type = other DNA
ctcccaagtagctgggacta

SEQ ID NO: 86993 - DNA, 20 bp, synthetic construct
  misc_feature 1..20: note = CRISPR gRNA sequence
  source 1..20: mol_type = other DNA
tcccaagtagctgggactac

SEQ ID NO: 86994 - DNA, 20 bp, synthetic construct
  misc_feature 1..20: note = CRISPR gRNA sequence
  source 1..20: mol_type = other DNA
caggcgcccgtcaccacacc

SEQ ID NO: 86995 - DNA, 20 bp, synthetic construct
  misc_feature 1..20: note = CRISPR gRNA sequence
  source 1..20: mol_type = other DNA
ctaatttttttttgtatttt

SEQ ID NO: 86996 - DNA, 20 bp, synthetic construct
  misc_feature 1..20: note = CRISPR gRNA sequence
  source 1..20: mol_type = other DNA
atttttttttgtatttttag

SEQ ID NO: 86997 - DNA, 20 bp, synthetic construct
  misc_feature 1..20: note = CRISPR gRNA sequence
  source 1..20: mol_type = other DNA
ttttgtatttttagtagaaa

SEQ ID NO: 86998 - DNA, 20 bp, synthetic construct
  misc_feature 1..20: note = CRISPR gRNA sequence
  source 1..20: mol_type = other DNA
tttgtatttttagtagaaac

SEQ ID NO: 86999 - DNA, 20 bp, synthetic construct
  misc_feature 1..20: note = CRISPR gRNA sequence
  source 1..20: mol_type = other DNA
ttgtatttttagtagaaacg

SEQ ID NO: 87000 - DNA, 20 bp, synthetic construct
  misc_feature 1..20: note = CRISPR gRNA sequence
  source 1..20: mol_type = other DNA
gaaacggggtttcaccatgt

SEQ ID NO: 87001 - DNA, 20 bp, synthetic construct
  misc_feature 1..20: note = CRISPR gRNA sequence
  source 1..20: mol_type = other DNA
cggggtttcaccatgttagc

SEQ ID NO: 87002 - DNA, 20 bp, synthetic construct
  misc_feature 1..20: note = CRISPR gRNA sequence
  source 1..20: mol_type = other DNA
ggggtttcaccatgttagcc

SEQ ID NO: 87003 - DNA, 20 bp, synthetic construct
  misc_feature 1..20: note = CRISPR gRNA sequence
  source 1..20: mol_type = other DNA
tttcaccatgttagccagga

SEQ ID NO: 87004 - DNA, 20 bp, synthetic construct
  misc_feature 1..20: note = CRISPR gRNA sequence
  source 1..20: mol_type = other DNA
cgatctcctgaccttgtgat

SEQ ID NO: 87005 - DNA, 20 bp, synthetic construct
  misc_feature 1..20: note = CRISPR gRNA sequence
  source 1..20: mol_type = other DNA
accttgtgatcagcctgcct

SEQ ID NO: 87006 - DNA, 20 bp, synthetic construct
  misc_feature 1..20: note = CRISPR gRNA sequence
  source 1..20: mol_type = other DNA
cagcctgccttggccttcca

SEQ ID NO: 87007 - DNA, 20 bp, synthetic construct
  misc_feature 1..20: note = CRISPR gRNA sequence
  source 1..20: mol_type = other DNA
gccttggccttccaaagtgc

SEQ ID NO: 87008 - DNA, 20 bp, synthetic construct
  misc_feature 1..20: note = CRISPR gRNA sequence
  source 1..20: mol_type = other DNA
ccttggccttccaaagtgct

SEQ ID NO: 87009 - DNA, 20 bp, synthetic construct
  misc_feature 1..20: note = CRISPR gRNA sequence
  source 1..20: mol_type = other DNA
cttccaaagtgctgggattg

SEQ ID NO: 87010 - DNA, 20 bp, synthetic construct
  misc_feature 1..20: note = CRISPR gRNA sequence
  source 1..20: mol_type = other DNA
ttccaaagtgctgggattgt

SEQ ID NO: 87011 - DNA, 20 bp, synthetic construct
  misc_feature 1..20: note = CRISPR gRNA sequence
  source 1..20: mol_type = other DNA
agtgctgggattgtaggcgt

SEQ ID NO: 87012 - DNA, 20 bp, synthetic construct
  misc_feature 1..20: note = CRISPR gRNA sequence
  source 1..20: mol_type = other DNA
taggcgtgagccaccgtgcc

SEQ ID NO: 87013 - DNA, 20 bp, synthetic construct
  misc_feature 1..20: note = CRISPR gRNA sequence
  source 1..20: mol_type = other DNA
ggccttgtcaaataatttct

SEQ ID NO: 87014 - DNA, 20 bp, synthetic construct
  misc_feature 1..20: note = CRISPR gRNA sequence
  source 1..20: mol_type = other DNA
gccttgtcaaataatttcta

SEQ ID NO: 87015 - DNA, 20 bp, synthetic construct
  misc_feature 1..20: note = CRISPR gRNA sequence
  source 1..20: mol_type = other DNA
taatttctaaggtccttttt

SEQ ID NO: 87016 - DNA, 20 bp, synthetic construct
  misc_feature 1..20: note = CRISPR gRNA sequence
  source 1..20: mol_type = other DNA
ttttcagtctgacaccctgt

SEQ ID NO: 87017 - DNA, 20 bp, synthetic construct
  misc_feature 1..20: note = CRISPR gRNA sequence
  source 1..20: mol_type = other DNA
cagtctgacaccctgtaagt

SEQ ID NO: 87018 - DNA, 20 bp, synthetic construct
  misc_feature 1..20: note = CRISPR gRNA sequence
  source 1..20: mol_type = other DNA
ctgacaccctgtaagtcagc

SEQ ID NO: 87019 - DNA, 20 bp, synthetic construct
  misc_feature 1..20: note = CRISPR gRNA sequence
  source 1..20: mol_type = other DNA
cctgtaagtcagctagactt

SEQ ID NO: 87020 - DNA, 20 bp, synthetic construct
  misc_feature 1..20: note = CRISPR gRNA sequence
  source 1..20: mol_type = other DNA
aagtcagctagactttggtg

SEQ ID NO: 87021 - DNA, 20 bp, synthetic construct
  misc_feature 1..20: note = CRISPR gRNA sequence
  source 1..20: mol_type = other DNA
agtcagctagactttggtgt

SEQ ID NO: 87022 - DNA, 20 bp, synthetic construct
  misc_feature 1..20: note = CRISPR gRNA sequence
  source 1..20: mol_type = other DNA
gtcagctagactttggtgtg

SEQ ID NO: 87023 - DNA, 20 bp, synthetic construct
  misc_feature 1..20: note = CRISPR gRNA sequence
  source 1..20: mol_type = other DNA
ctagactttggtgtggggat

SEQ ID NO: 87024 - DNA, 20 bp, synthetic construct
  misc_feature 1..20: note = CRISPR gRNA sequence
  source 1..20: mol_type = other DNA
agactttggtgtggggatca

SEQ ID NO: 87025 - DNA, 20 bp, synthetic construct
  misc_feature 1..20: note = CRISPR gRNA sequence
  source 1..20: mol_type = other DNA
gactttggtgtggggatcag

SEQ ID NO: 87026 - DNA, 20 bp, synthetic construct
  misc_feature 1..20: note = CRISPR gRNA sequence
  source 1..20: mol_type = other DNA
actttggtgtggggatcaga

SEQ ID NO: 87027 - DNA, 20 bp, synthetic construct
  misc_feature 1..20: note = CRISPR gRNA sequence
  source 1..20: mol_type = other DNA
gggatcagagggtcctatat

SEQ ID NO: 87028 - DNA, 20 bp, synthetic construct
  misc_feature 1..20: note = CRISPR gRNA sequence
  source 1..20: mol_type = other DNA
ggatcagagggtcctatatt

SEQ ID NO: 87029 - DNA, 20 bp, synthetic construct
  misc_feature 1..20: note = CRISPR gRNA sequence
  source 1..20: mol_type = other DNA
gtcctatattgggtccttct

SEQ ID NO: 87030 - DNA, 20 bp, synthetic construct
  misc_feature 1..20: note = CRISPR gRNA sequence
  source 1..20: mol_type = other DNA
gcctctgttctctcctacct

SEQ ID NO: 87031 - DNA, 20 bp, synthetic construct
  misc_feature 1..20: note = CRISPR gRNA sequence
  source 1..20: mol_type = other DNA
ctgttctctcctacctcagc

SEQ ID NO: 87032 - DNA, 20 bp, synthetic construct
  misc_feature 1..20: note = CRISPR gRNA sequence
  source 1..20: mol_type = other DNA
tcctacctcagcaagatgta

SEQ ID NO: 87033 - DNA, 20 bp, synthetic construct
  misc_feature 1..20: note = CRISPR gRNA sequence
  source 1..20: mol_type = other DNA
agaaattttctgacaatgac

SEQ ID NO: 87034 - DNA, 20 bp, synthetic construct
  misc_feature 1..20: note = CRISPR gRNA sequence
  source 1..20: mol_type = other DNA
acaagctgtatctctacctt

SEQ ID NO: 87035 - DNA, 20 bp, synthetic construct
  misc_feature 1..20: note = CRISPR gRNA sequence
  source 1..20: mol_type = other DNA
tctctaccttcagctcccct

SEQ ID NO: 87036 - DNA, 20 bp, synthetic construct
  misc_feature 1..20: note = CRISPR gRNA sequence
  source 1..20: mol_type = other DNA
ctctaccttcagctcccctc

SEQ ID NO: 87037 - DNA, 20 bp, synthetic construct
  misc_feature 1..20: note = CRISPR gRNA sequence
  source 1..20: mol_type = other DNA
ctcccctcaggacccaccac

SEQ ID NO: 87038 - DNA, 20 bp, synthetic construct
  misc_feature 1..20: note = CRISPR gRNA sequence
  source 1..20: mol_type = other DNA
cccctcaggacccaccactg

SEQ ID NO: 87039 - DNA, 20 bp, synthetic construct
  misc_feature 1..20: note = CRISPR gRNA sequence
  source 1..20: mol_type = other DNA
ggacccaccactggagacaa

SEQ ID NO: 87040 - DNA, 20 bp, synthetic construct
  misc_feature 1..20: note = CRISPR gRNA sequence
  source 1..20: mol_type = other DNA
gacccaccactggagacaaa

SEQ ID NO: 87041 - DNA, 20 bp, synthetic construct
  misc_feature 1..20: note = CRISPR gRNA sequence
  source 1..20: mol_type = other DNA
ccaccactggagacaaaagg

SEQ ID NO: 87042 - DNA, 20 bp, synthetic construct
  misc_feature 1..20: note = CRISPR gRNA sequence
  source 1..20: mol_type = other DNA
caccactggagacaaaaggt

SEQ ID NO: 87043 - DNA, 20 bp, synthetic construct
  misc_feature 1..20: note = CRISPR gRNA sequence
  source 1..20: mol_type = other DNA
gagacaaaaggtaggtttga

SEQ ID NO: 87044 - DNA, 20 bp, synthetic construct
  misc_feature 1..20: note = CRISPR gRNA sequence
  source 1..20: mol_type = other DNA
acaaaaggtaggtttgatag

SEQ ID NO: 87045 - DNA, 20 bp, synthetic construct
  misc_feature 1..20: note = CRISPR gRNA sequence
  source 1..20: mol_type = other DNA
ggtaggtttgatagtagttt

SEQ ID NO: 87046 - DNA, 20 bp, synthetic construct
  misc_feature 1..20: note = CRISPR gRNA sequence
  source 1..20: mol_type = other DNA
ggtttgatagtagttttaga

SEQ ID NO: 87047 - DNA, 20 bp, synthetic construct
  misc_feature 1..20: note = CRISPR gRNA sequence
  source 1..20: mol_type = other DNA
ttgatagtagttttagatgg

SEQ ID NO: 87048 - DNA, 20 bp, synthetic construct
  misc_feature 1..20: note = CRISPR gRNA sequence
  source 1..20: mol_type = other DNA
gatagtagttttagatggca

SEQ ID NO: 87049 - DNA, 20 bp, synthetic construct
  misc_feature 1..20: note = CRISPR gRNA sequence
  source 1..20: mol_type = other DNA
atagtagttttagatggcag

SEQ ID NO: 87050 - DNA, 20 bp, synthetic construct
  misc_feature 1..20: note = CRISPR gRNA sequence
  source 1..20: mol_type = other DNA
atggcagaggttctgattct

SEQ ID NO: 87051 - DNA, 20 bp, synthetic construct
  misc_feature 1..20: note = CRISPR gRNA sequence
  source 1..20: mol_type = other DNA
ggcagaggttctgattctta

SEQ ID NO: 87052 - DNA, 20 bp, synthetic construct
  misc_feature 1..20: note = CRISPR gRNA sequence
  source 1..20: mol_type = other DNA
gaggttctgattcttagaga

SEQ ID NO: 87053 - DNA, 20 bp, synthetic construct
  misc_feature 1..20: note = CRISPR gRNA sequence
  source 1..20: mol_type = other DNA
aggttctgattcttagagaa

SEQ ID NO: 87054 - DNA, 20 bp, synthetic construct
  misc_feature 1..20: note = CRISPR gRNA sequence
  source 1..20: mol_type = other DNA
attcttagagaaaggttcac

SEQ ID NO: 87055 - DNA, 20 bp, synthetic construct
  misc_feature 1..20: note = CRISPR gRNA sequence
  source 1..20: mol_type = other DNA
ttcttagagaaaggttcact

SEQ ID NO: 87056 - DNA, 20 bp, synthetic construct
  misc_feature 1..20: note = CRISPR gRNA sequence
  source 1..20: mol_type = other DNA
ttagagaaaggttcactggg

SEQ ID NO: 87057 - DNA, 20 bp, synthetic construct
  misc_feature 1..20: note = CRISPR gRNA sequence
  source 1..20: mol_type = other DNA
tagagaaaggttcactggga

SEQ ID NO: 87058 - DNA, 20 bp, synthetic construct
  misc_feature 1..20: note = CRISPR gRNA sequence
  source 1..20: mol_type = other DNA
agagaaaggttcactgggaa

SEQ ID NO: 87059 - DNA, 20 bp, synthetic construct
  misc_feature 1..20: note = CRISPR gRNA sequence
  source 1..20: mol_type = other DNA
gagaaaggttcactgggaag

SEQ ID NO: 87060 - DNA, 20 bp, synthetic construct
  misc_feature 1..20: note = CRISPR gRNA sequence
  source 1..20: mol_type = other DNA
aaggttcactgggaaggggt

SEQ ID NO: 87061 - DNA, 20 bp, synthetic construct
  misc_feature 1..20: note = CRISPR gRNA sequence
  source 1..20: mol_type = other DNA
aggttcactgggaaggggtg

SEQ ID NO: 87062 - DNA, 20 bp, synthetic construct
  misc_feature 1..20: note = CRISPR gRNA sequence
  source 1..20: mol_type = other DNA
ctgggaaggggtgaggtgaa

SEQ ID NO: 87063 - DNA, 20 bp, synthetic construct
  misc_feature 1..20: note = CRISPR gRNA sequence
  source 1..20: mol_type = other DNA
tgggaaggggtgaggtgaat

SEQ ID NO: 87064 - DNA, 20 bp, synthetic construct
  misc_feature 1..20: note = CRISPR gRNA sequence
  source 1..20: mol_type = other DNA
cgtaaatgctgtccttgatg

SEQ ID NO: 87065 - DNA, 20 bp, synthetic construct
  misc_feature 1..20: note = CRISPR gRNA sequence
  source 1..20: mol_type = other DNA
taaatgctgtccttgatgaa

SEQ ID NO: 87066 - DNA, 20 bp, synthetic construct
  misc_feature 1..20: note = CRISPR gRNA sequence
  source 1..20: mol_type = other DNA
aaatgctgtccttgatgaag

SEQ ID NO: 87067 - DNA, 20 bp, synthetic construct
  misc_feature 1..20: note = CRISPR gRNA sequence
  source 1..20: mol_type = other DNA
gctgtccttgatgaagagga

SEQ ID NO: 87068 - DNA, 20 bp, synthetic construct
  misc_feature 1..20: note = CRISPR gRNA sequence
  source 1..20: mol_type = other DNA
ctgtccttgatgaagaggaa

SEQ ID NO: 87069 - DNA, 20 bp, synthetic construct
  misc_feature 1..20: note = CRISPR gRNA sequence
  source 1..20: mol_type = other DNA
gaaaggtcctcgccctgact

SEQ ID NO: 87070 - DNA, 20 bp, synthetic construct
  misc_feature 1..20: note = CRISPR gRNA sequence
  source 1..20: mol_type = other DNA
ctcgccctgacttggtttac

SEQ ID NO: 87071 - DNA, 20 bp, synthetic construct
  misc_feature 1..20: note = CRISPR gRNA sequence
  source 1..20: mol_type = other DNA
tcgccctgacttggtttacc

SEQ ID NO: 87072 - DNA, 20 bp, synthetic construct
  misc_feature 1..20: note = CRISPR gRNA sequence
  source 1..20: mol_type = other DNA
cgccctgacttggtttacca

SEQ ID NO: 87073 - DNA, 20 bp, synthetic construct
  misc_feature 1..20: note = CRISPR gRNA sequence
  source 1..20: mol_type = other DNA
ctgacttggtttaccaggga

SEQ ID NO: 87074 - DNA, 20 bp, synthetic construct
  misc_feature 1..20: note = CRISPR gRNA sequence
  source 1..20: mol_type = other DNA
cttggtttaccagggaaagt

SEQ ID NO: 87075 - DNA, 20 bp, synthetic construct
  misc_feature 1..20: note = CRISPR gRNA sequence
  source 1..20: mol_type = other DNA
taccagggaaagttagattc

SEQ ID NO: 87076 - DNA, 20 bp, synthetic construct
  misc_feature 1..20: note = CRISPR gRNA sequence
  source 1..20: mol_type = other DNA
accagggaaagttagattct

SEQ ID NO: 87077 - DNA, 20 bp, synthetic construct
  misc_feature 1..20: note = CRISPR gRNA sequence
  source 1..20: mol_type = other DNA
gattctgggtgaactaaatt

SEQ ID NO: 87078 - DNA, 20 bp, synthetic construct
  misc_feature 1..20: note = CRISPR gRNA sequence
  source 1..20: mol_type = other DNA
tgggtgaactaaatttggtc

SEQ ID NO: 87079 - DNA, 20 bp, synthetic construct
  misc_feature 1..20: note = CRISPR gRNA sequence
  source 1..20: mol_type = other DNA
aatttggtccagcactactg

SEQ ID NO: 87080 - DNA, 20 bp, synthetic construct
  misc_feature 1..20: note = CRISPR gRNA sequence
  source 1..20: mol_type = other DNA
ttggtccagcactactgaag

SEQ ID NO: 87081 - DNA, 20 bp, synthetic construct
  misc_feature 1..20: note = CRISPR gRNA sequence
  source 1..20: mol_type = other DNA
gtccagcactactgaagtgg

SEQ ID NO: 87082 - DNA, 20 bp, synthetic construct
  misc_feature 1..20: note = CRISPR gRNA sequence
  source 1..20: mol_type = other DNA
gcactactgaagtggtagtt

SEQ ID NO: 87083 - DNA, 20 bp, synthetic construct
  misc_feature 1..20: note = CRISPR gRNA sequence
  source 1..20: mol_type = other DNA
cactactgaagtggtagttt

SEQ ID NO: 87084 - DNA, 20 bp, synthetic construct
  misc_feature 1..20: note = CRISPR gRNA sequence
  source 1..20: mol_type = other DNA
tactgaagtggtagtttggg

SEQ ID NO: 87085 - DNA, 20 bp, synthetic construct
  misc_feature 1..20: note = CRISPR gRNA sequence
  source 1..20: mol_type = other DNA
agtggtagtttgggaagaac

SEQ ID NO: 87086 - DNA, 20 bp, synthetic construct
  misc_feature 1..20: note = CRISPR gRNA sequence
  source 1..20: mol_type = other DNA
gtggtagtttgggaagaacc

SEQ ID NO: 87087 - DNA, 20 bp, synthetic construct
  misc_feature 1..20: note = CRISPR gRNA sequence
  source 1..20: mol_type = other DNA
ggaagaaccaggacaactgt

SEQ ID NO: 87088 - DNA, 20 bp, synthetic construct
  misc_feature 1..20: note = CRISPR gRNA sequence
  source 1..20: mol_type = other DNA
gaagaaccaggacaactgtt

SEQ ID NO: 87089 - DNA, 20 bp, synthetic construct
  misc_feature 1..20: note = CRISPR gRNA sequence
  source 1..20: mol_type = other DNA
aagaaccaggacaactgtta

SEQ ID NO: 87090 - DNA, 20 bp, synthetic construct
  misc_feature 1..20: note = CRISPR gRNA sequence
  source 1..20: mol_type = other DNA
caggacaactgttagggtct

SEQ ID NO: 87091 - DNA, 20 bp, synthetic construct
  misc_feature 1..20: note = CRISPR gRNA sequence
  source 1..20: mol_type = other DNA
gcttgttccttttgtttctg

SEQ ID NO: 87092 - DNA, 20 bp, synthetic construct
  misc_feature 1..20: note = CRISPR gRNA sequence
  source 1..20: mol_type = other DNA
ttccttttgtttctgtagct

SEQ ID NO: 87093 - DNA, 20 bp, synthetic construct
  misc_feature 1..20: note = CRISPR gRNA sequence
  source 1..20: mol_type = other DNA
ccttttgtttctgtagctca

SEQ ID NO: 87094 - DNA, 20 bp, synthetic construct
  misc_feature 1..20: note = CRISPR gRNA sequence
  source 1..20: mol_type = other DNA
tgtttctgtagctcagagcc

SEQ ID NO: 87095 - DNA, 20 bp, synthetic construct
  misc_feature 1..20: note = CRISPR gRNA sequence
  source 1..20: mol_type = other DNA
agctcagagccaagtacact

SEQ ID NO: 87096 - DNA, 20 bp, synthetic construct
  misc_feature 1..20: note = CRISPR gRNA sequence
  source 1..20: mol_type = other DNA
agccaagtacactgagcaat

SEQ ID NO: 87097 - DNA, 20 bp, synthetic construct
  misc_feature 1..20: note = CRISPR gRNA sequence
  source 1..20: mol_type = other DNA
gccaagtacactgagcaatg

SEQ ID NO: 87098 - DNA, 20 bp, synthetic construct
  misc_feature 1..20: note = CRISPR gRNA sequence
  source 1..20: mol_type = other DNA
caagtacactgagcaatgag

SEQ ID NO: 87099 - DNA, 20 bp, synthetic construct
  misc_feature 1..20: note = CRISPR gRNA sequence
  source 1..20: mol_type = other DNA
gaggagtacatgtatgccta

SEQ ID NO: 87100 - DNA, 20 bp, synthetic construct
  misc_feature 1..20: note = CRISPR gRNA sequence
  source 1..20: mol_type = other DNA
aggagtacatgtatgcctat

SEQ ID NO: 87101 - DNA, 20 bp, synthetic construct
  misc_feature 1..20: note = CRISPR gRNA sequence
  source 1..20: mol_type = other DNA
agtacatgtatgcctatagg

SEQ ID NO: 87102 - DNA, 20 bp, synthetic construct
  misc_feature 1..20: note = CRISPR gRNA sequence
  source 1..20: mol_type = other DNA
taggtggatccgcaaccacc

SEQ ID NO: 87103 - DNA, 20 bp, synthetic construct
  misc_feature 1..20: note = CRISPR gRNA sequence
  source 1..20: mol_type = other DNA
gtggatccgcaaccacctgg

SEQ ID NO: 87104 - DNA, 20 bp, synthetic construct
  misc_feature 1..20: note = CRISPR gRNA sequence
  source 1..20: mol_type = other DNA
ggatccgcaaccacctggaa

SEQ ID NO: 87105 - DNA, 20 bp, synthetic construct
  misc_feature 1..20: note = CRISPR gRNA sequence
  source 1..20: mol_type = other DNA
acactgacacctgtctgcca

SEQ ID NO: 87106 - DNA, 20 bp, synthetic construct
  misc_feature 1..20: note = CRISPR gRNA sequence
  source 1..20: mol_type = other DNA
gacacctgtctgccaaagca

SEQ ID NO: 87107 - DNA, 20 bp, synthetic construct
  misc_feature 1..20: note = CRISPR gRNA sequence
  source 1..20: mol_type = other DNA
aaagtgtttatgatgcctat

SEQ ID NO: 87108 - DNA, 20 bp, synthetic construct
  misc_feature 1..20: note = CRISPR gRNA sequence
  source 1..20: mol_type = other DNA
gtgtttatgatgcctatcgg

SEQ ID NO: 87109 - DNA, 20 bp, synthetic construct
  misc_feature 1..20: note = CRISPR gRNA sequence
  source 1..20: mol_type = other DNA
tgtttatgatgcctatcggt

SEQ ID NO: 87110 - DNA, 20 bp, synthetic construct
  misc_feature 1..20: note = CRISPR gRNA sequence
  source 1..20: mol_type = other DNA
ttatgatgcctatcggtggg

SEQ ID NO: 87111 - DNA, 20 bp, synthetic construct
  misc_feature 1..20: note = CRISPR gRNA sequence
  source 1..20: mol_type = other DNA
atgatgcctatcggtgggtg

SEQ ID NO: 87112 - DNA, 20 bp, synthetic construct
  misc_feature 1..20: note = CRISPR gRNA sequence
  source 1..20: mol_type = other DNA
tgatgcctatcggtgggtgg

SEQ ID NO: 87113 - DNA, 20 bp, synthetic construct
  misc_feature 1..20: note = CRISPR gRNA sequence
  source 1..20: mol_type = other DNA
gatgcctatcggtgggtgga

SEQ ID NO: 87114 - DNA, 20 bp, synthetic construct
  misc_feature 1..20: note = CRISPR gRNA sequence
  source 1..20: mol_type = other DNA
atgcctatcggtgggtggag

SEQ ID NO: 87115 - DNA, 20 bp, synthetic construct
  misc_feature 1..20: note = CRISPR gRNA sequence
  source 1..20: mol_type = other DNA
cctatcggtgggtggagggg

SEQ ID NO: 87116 - DNA, 20 bp, synthetic construct
  misc_feature 1..20: note = CRISPR gRNA sequence
  source 1..20: mol_type = other DNA
ctatcggtgggtggaggggt

SEQ ID NO: 87117 - DNA, 20 bp, synthetic construct
  misc_feature 1..20: note = CRISPR gRNA sequence
  source 1..20: mol_type = other DNA
tcggtgggtggaggggtggg

SEQ ID NO: 87118 - DNA, 20 bp, synthetic construct
  misc_feature 1..20: note = CRISPR gRNA sequence
  source 1..20: mol_type = other DNA
gtgggtggaggggtgggtgg

SEQ ID NO: 87119 - DNA, 20 bp, synthetic construct
  misc_feature 1..20: note = CRISPR gRNA sequence
  source 1..20: mol_type = other DNA
tgggtggaggggtgggtggt

SEQ ID NO: 87120 - DNA, 20 bp, synthetic construct
  misc_feature 1..20: note = CRISPR gRNA sequence
  source 1..20: mol_type = other DNA
ggaggggtgggtggtgggat

SEQ ID NO: 87121 - DNA, 20 bp, synthetic construct
  misc_feature 1..20: note = CRISPR gRNA sequence
  source 1..20: mol_type = other DNA
ggggtgggtggtgggatgag

SEQ ID NO: 87122 - DNA, 20 bp, synthetic construct
  misc_feature 1..20: note = CRISPR gRNA sequence
  source 1..20: mol_type = other DNA
gggtggtgggatgagtggat

SEQ ID NO: 87123 - DNA, 20 bp, synthetic construct
  misc_feature 1..20: note = CRISPR gRNA sequence
  source 1..20: mol_type = other DNA
tggtgggatgagtggattgg

SEQ ID NO: 87124 - DNA, 20 bp, synthetic construct
  misc_feature 1..20: note = CRISPR gRNA sequence
  source 1..20: mol_type = other DNA
ggtgggatgagtggattggt

SEQ ID NO: 87125 - DNA, 20 bp, synthetic construct
  misc_feature 1..20: note = CRISPR gRNA sequence
  source 1..20: mol_type = other DNA
gatgagtggattggtgggca

SEQ ID NO: 87126 - DNA, 20 bp, synthetic construct
  misc_feature 1..20: note = CRISPR gRNA sequence
  source 1..20: mol_type = other DNA
atgagtggattggtgggcat

SEQ ID NO: 87127 - DNA, 20 bp, synthetic construct
  misc_feature 1..20: note = CRISPR gRNA sequence
  source 1..20: mol_type = other DNA
ataggaccccctcacccatg

SEQ ID NO: 87128 - DNA, 20 bp, synthetic construct
  misc_feature 1..20: note = CRISPR gRNA sequence
  source 1..20: mol_type = other DNA
aggaccccctcacccatgaa

SEQ ID NO: 87129 - DNA, 20 bp, synthetic construct
  misc_feature 1..20: note = CRISPR gRNA sequence
  source 1..20: mol_type = other DNA
aagagcttcctgccttgata

SEQ ID NO: 87130 - DNA, 20 bp, synthetic construct
  misc_feature 1..20: note = CRISPR gRNA sequence
  source 1..20: mol_type = other DNA
tgataaagcctgccttctta

SEQ ID NO: 87131 - DNA, 20 bp, synthetic construct
  misc_feature 1..20: note = CRISPR gRNA sequence
  source 1..20: mol_type = other DNA
gataaagcctgccttcttaa

SEQ ID NO: 87132 - DNA, 20 bp, synthetic construct
  misc_feature 1..20: note = CRISPR gRNA sequence
  source 1..20: mol_type = other DNA
ataaagcctgccttcttaaa

SEQ ID NO: 87133 - DNA, 20 bp, synthetic construct
  misc_feature 1..20: note = CRISPR gRNA sequence
  source 1..20: mol_type = other DNA
ggttcctcacacttgatccc

SEQ ID NO: 87134 - DNA, 20 bp, synthetic construct
  misc_feature 1..20: note = CRISPR gRNA sequence
  source 1..20: mol_type = other DNA
gttcctcacacttgatccct

SEQ ID NO: 87135 - DNA, 20 bp, synthetic construct
  misc_feature 1..20: note = CRISPR gRNA sequence
  source 1..20: mol_type = other DNA
ttcctcacacttgatcccta

SEQ ID NO: 87136 - DNA, 20 bp, synthetic construct
  misc_feature 1..20: note = CRISPR gRNA sequence
  source 1..20: mol_type = other DNA
ttgatccctagggactcttc

SEQ ID NO: 87137 - DNA, 20 bp, synthetic construct
  misc_feature 1..20: note = CRISPR gRNA sequence
  source 1..20: mol_type = other DNA
ggactcttcgagcctaccca

SEQ ID NO: 87138 - DNA, 20 bp, synthetic construct
  misc_feature 1..20: note = CRISPR gRNA sequence
  source 1..20: mol_type = other DNA
tacccatggcctccttctct

SEQ ID NO: 87139 - DNA, 20 bp, synthetic construct
  misc_feature 1..20: note = CRISPR gRNA sequence
  source 1..20: mol_type = other DNA
cactctgctcccctctcact

SEQ ID NO: 87140 - DNA, 20 bp, synthetic construct
  misc_feature 1..20: note = CRISPR gRNA sequence
  source 1..20: mol_type = other DNA
actctgctcccctctcactc

SEQ ID NO: 87141 - DNA, 20 bp, synthetic construct
  misc_feature 1..20: note = CRISPR gRNA sequence
  source 1..20: mol_type = other DNA
ctgctcccctctcactcagg

SEQ ID NO: 87142 - DNA, 20 bp, synthetic construct
  misc_feature 1..20: note = CRISPR gRNA sequence
  source 1..20: mol_type = other DNA
tctcactcaggaagtactgt

SEQ ID NO: 87143 - DNA, 20 bp, synthetic construct
  misc_feature 1..20: note = CRISPR gRNA sequence
  source 1..20: mol_type = other DNA
tcactcaggaagtactgtga

SEQ ID NO: 87144 - DNA, 20 bp, synthetic construct
  misc_feature 1..20: note = CRISPR gRNA sequence
  source 1..20: mol_type = other DNA
cttgcctgttgccgcccact

SEQ ID NO: 87145 - DNA, 20 bp, synthetic construct
  misc_feature 1..20: note = CRISPR gRNA sequence
  source 1..20: mol_type = other DNA
ctgttgccgcccactcagca

SEQ ID NO: 87146 - DNA, 20 bp, synthetic construct
  misc_feature 1..20: note = CRISPR gRNA sequence
  source 1..20: mol_type = other DNA
ccactcagcacagccaactt

SEQ ID NO: 87147 - DNA, 20 bp, synthetic construct
  misc_feature 1..20: note = CRISPR gRNA sequence
  source 1..20: mol_type = other DNA
tcagcacagccaactttggc

SEQ ID NO: 87148 - DNA, 20 bp, synthetic construct
  misc_feature 1..20: note = CRISPR gRNA sequence
  source 1..20: mol_type = other DNA
gccaactttggcaagatcat

SEQ ID NO: 87149 - DNA, 20 bp, synthetic construct
  misc_feature 1..20: note = CRISPR gRNA sequence
  source 1..20: mol_type = other DNA
caactttggcaagatcatca

SEQ ID NO: 87150 - DNA, 20 bp, synthetic construct
  misc_feature 1..20: note = CRISPR gRNA sequence
  source 1..20: mol_type = other DNA
actttggcaagatcatcaga

SEQ ID NO: 87151 - DNA, 20 bp, synthetic construct
  misc_feature 1..20: note = CRISPR gRNA sequence
  source 1..20: mol_type = other DNA
agagatcttccctgacatca

SEQ ID NO: 87152 - DNA, 20 bp, synthetic construct
  misc_feature 1..20: note = CRISPR gRNA sequence
  source 1..20: mol_type = other DNA
ttccctgacatcaaagctcg

SEQ ID NO: 87153 - DNA, 20 bp, synthetic construct
  misc_feature 1..20: note = CRISPR gRNA sequence
  source 1..20: mol_type = other DNA
tccctgacatcaaagctcga

SEQ ID NO: 87154 - DNA, 20 bp, synthetic construct
  misc_feature 1..20: note = CRISPR gRNA sequence
  source 1..20: mol_type = other DNA
gacatcaaagctcgaaggct

SEQ ID NO: 87155 - DNA, 20 bp, synthetic construct
  misc_feature 1..20: note = CRISPR gRNA sequence
  source 1..20: mol_type = other DNA
atcaaagctcgaaggcttgg

SEQ ID NO: 87156 - DNA, 20 bp, synthetic construct
  misc_feature 1..20: note = CRISPR gRNA sequence
  source 1..20: mol_type = other DNA
aagctcgaaggcttggtggc

SEQ ID NO: 87157 - DNA, 20 bp, synthetic construct
  misc_feature 1..20: note = CRISPR gRNA sequence
  source 1..20: mol_type = other DNA
agctcgaaggcttggtggcc

SEQ ID NO: 87158 - DNA, 20 bp, synthetic construct
  misc_feature 1..20: note = CRISPR gRNA sequence
  source 1..20: mol_type = other DNA
gctcgaaggcttggtggccg

SEQ ID NO: 87159 - DNA, 20 bp, synthetic construct
  misc_feature 1..20: note = CRISPR gRNA sequence
  source 1..20: mol_type = other DNA
gaaggcttggtggccggggc

SEQ ID NO: 87160 - DNA, 20 bp, synthetic construct
  misc_feature 1..20: note = CRISPR gRNA sequence
  source 1..20: mol_type = other DNA
ttggtggccggggccagtcc

SEQ ID NO: 87161 - DNA, 20 bp, synthetic construct
  misc_feature 1..20: note = CRISPR gRNA sequence
  source 1..20: mol_type = other DNA
ccagtccaagtatccttgac

SEQ ID NO: 87162 - DNA, 20 bp, synthetic construct
  misc_feature 1..20: note = CRISPR gRNA sequence
  source 1..20: mol_type = other DNA
agtccaagtatccttgacta

SEQ ID NO: 87163 - DNA, 20 bp, synthetic construct
  misc_feature 1..20: note = CRISPR gRNA sequence
  source 1..20: mol_type = other DNA
tccaagtatccttgactaga

SEQ ID NO: 87164 - DNA, 20 bp, synthetic construct
  misc_feature 1..20: note = CRISPR gRNA sequence
  source 1..20: mol_type = other DNA
ccaagtatccttgactagag

SEQ ID NO: 87165 - DNA, 20 bp, synthetic construct
  misc_feature 1..20: note = CRISPR gRNA sequence
  source 1..20: mol_type = other DNA
gtatccttgactagagaggt

SEQ ID NO: 87166 - DNA, 20 bp, synthetic construct
  misc_feature 1..20: note = CRISPR gRNA sequence
  source 1..20: mol_type = other DNA
tatccttgactagagaggtt

SEQ ID NO: 87167 - DNA, 20 bp, synthetic construct
  misc_feature 1..20: note = CRISPR gRNA sequence
  source 1..20: mol_type = other DNA
atccttgactagagaggttg

SEQ ID NO: 87168 - DNA, 20 bp, synthetic construct
  misc_feature 1..20: note = CRISPR gRNA sequence
  source 1..20: mol_type = other DNA
tccttgactagagaggttgg

SEQ ID NO: 87169 - DNA, 20 bp, synthetic construct
  misc_feature 1..20: note = CRISPR gRNA sequence
  source 1..20: mol_type = other DNA
ttgactagagaggttggggg

SEQ ID NO: 87170 - DNA, 20 bp, synthetic construct
  misc_feature 1..20: note = CRISPR gRNA sequence
  source 1..20: mol_type = other DNA
gactagagaggttgggggtg

SEQ ID NO: 87171 - DNA, 20 bp, synthetic construct
  misc_feature 1..20: note = CRISPR gRNA sequence
  source 1..20: mol_type = other DNA
actagagaggttgggggtgg

SEQ ID NO: 87172 - DNA, 20 bp, synthetic construct
  misc_feature 1..20: note = CRISPR gRNA sequence
  source 1..20: mol_type = other DNA
gaggttgggggtggaggacc

SEQ ID NO: 87173 - DNA, 20 bp, synthetic construct
  misc_feature 1..20: note = CRISPR gRNA sequence
  source 1..20: mol_type = other DNA
aggttgggggtggaggacct

SEQ ID NO: 87174 - DNA, 20 bp, synthetic construct
  misc_feature 1..20: note = CRISPR gRNA sequence
  source 1..20: mol_type = other DNA
gttgggggtggaggacctgg

SEQ ID NO: 87175 - DNA, 20 bp, synthetic construct
  misc_feature 1..20: note = CRISPR gRNA sequence
  source 1..20: mol_type = other DNA
ttgggggtggaggacctggg

SEQ ID NO: 87176 - DNA, 20 bp, synthetic construct
  misc_feature 1..20: note = CRISPR gRNA sequence
  source 1..20: mol_type = other DNA
ggggtggaggacctgggagg

SEQ ID NO: 87177 - DNA, 20 bp, synthetic construct
  misc_feature 1..20: note = CRISPR gRNA sequence
  source 1..20: mol_type = other DNA
gaggacctgggaggaagact

SEQ ID NO: 87178 - DNA, 20 bp, synthetic construct
  misc_feature 1..20: note = CRISPR gRNA sequence
  source 1..20: mol_type = other DNA
aggacctgggaggaagactt

SEQ ID NO: 87179 - DNA, 20 bp, synthetic construct
  misc_feature 1..20: note = CRISPR gRNA sequence
  source 1..20: mol_type = other DNA
tgggaggaagacttaggatg

SEQ ID NO: 87180 - DNA, 20 bp, synthetic construct
  misc_feature 1..20: note = CRISPR gRNA sequence
  source 1..20: mol_type = other DNA
ggaggaagacttaggatgtg

SEQ ID NO: 87181 - DNA, 20 bp, synthetic construct
  misc_feature 1..20: note = CRISPR gRNA sequence
  source 1..20: mol_type = other DNA
aggaagacttaggatgtgga

SEQ ID NO: 87182 - DNA, 20 bp, synthetic construct
  misc_feature 1..20: note = CRISPR gRNA sequence
  source 1..20: mol_type = other DNA
agacttaggatgtggagagc

SEQ ID NO: 87183 - DNA, 20 bp, synthetic construct
  misc_feature 1..20: note = CRISPR gRNA sequence
  source 1..20: mol_type = other DNA
gacttaggatgtggagagca

SEQ ID NO: 87184 - DNA, 20 bp, synthetic construct
  misc_feature 1..20: note = CRISPR gRNA sequence
  source 1..20: mol_type = other DNA
cttaggatgtggagagcaag

SEQ ID NO: 87185 - DNA, 20 bp, synthetic construct
  misc_feature 1..20: note = CRISPR gRNA sequence
  source 1..20: mol_type = other DNA
aggatgtggagagcaaggag

SEQ ID NO: 87186 - DNA, 20 bp, synthetic construct
  misc_feature 1..20: note = CRISPR gRNA sequence
  source 1..20: mol_type = other DNA
gtggagagcaaggagtggaa

SEQ ID NO: 87187 - DNA, 20 bp, synthetic construct
  misc_feature 1..20: note = CRISPR gRNA sequence
  source 1..20: mol_type = other DNA
tggaacagcttaacttgctc

SEQ ID NO: 87188 - DNA, 20 bp, synthetic construct
  misc_feature 1..20: note = CRISPR gRNA sequence
  source 1..20: mol_type = other DNA
ggaacagcttaacttgctcg

SEQ ID NO: 87189 - DNA, 20 bp, synthetic construct
  misc_feature 1..20: note = CRISPR gRNA sequence
  source 1..20: mol_type = other DNA
gaacagcttaacttgctcga

SEQ ID NO: 87190 - DNA, 20 bp, synthetic construct
  misc_feature 1..20: note = CRISPR gRNA sequence
  source 1..20: mol_type = other DNA
aacagcttaacttgctcgag

SEQ ID NO: 87191 - DNA, 20 bp, synthetic construct
  misc_feature 1..20: note = CRISPR gRNA sequence
  source 1..20: mol_type = other DNA
cttaacttgctcgaggggct

SEQ ID NO: 87192 - DNA, 20 bp, synthetic construct
  misc_feature 1..20: note = CRISPR gRNA sequence
  source 1..20: mol_type = other DNA
taacttgctcgaggggcttg

SEQ ID NO: 87193 - DNA, 20 bp, synthetic construct
  misc_feature 1..20: note = CRISPR gRNA sequence
  source 1..20: mol_type = other DNA
gcttggagatcgccatgtgt

SEQ ID NO: 87194 - DNA, 20 bp, synthetic construct
  misc_feature 1..20: note = CRISPR gRNA sequence
  source 1..20: mol_type = other DNA
ggctgctctttaacttgcat

SEQ ID NO: 87195 - DNA, 20 bp, synthetic construct
  misc_feature 1..20: note = CRISPR gRNA sequence
  source 1..20: mol_type = other DNA
acttgcatcagatattgcta

SEQ ID NO: 87196 - DNA, 20 bp, synthetic construct
  misc_feature 1..20: note = CRISPR gRNA sequence
  source 1..20: mol_type = other DNA
tgcatcagatattgctacag

SEQ ID NO: 87197 - DNA, 20 bp, synthetic construct
  misc_feature 1..20: note = CRISPR gRNA sequence
  source 1..20: mol_type = other DNA
agatattgctacagtggcat

SEQ ID NO: 87198 - DNA, 20 bp, synthetic construct
  misc_feature 1..20: note = CRISPR gRNA sequence
  source 1..20: mol_type = other DNA
gatattgctacagtggcata

SEQ ID NO: 87199 - DNA, 20 bp, synthetic construct
  misc_feature 1..20: note = CRISPR gRNA sequence
  source 1..20: mol_type = other DNA
tattgctacagtggcataag

SEQ ID NO: 87200 - DNA, 20 bp, synthetic construct
  misc_feature 1..20: note = CRISPR gRNA sequence
  source 1..20: mol_type = other DNA
attgctacagtggcataagg

SEQ ID NO: 87201 - DNA, 20 bp, synthetic construct
  misc_feature 1..20: note = CRISPR gRNA sequence
  source 1..20: mol_type = other DNA
gctacagtggcataaggagg

SEQ ID NO: 87202 - DNA, 20 bp, synthetic construct
  misc_feature 1..20: note = CRISPR gRNA sequence
  source 1..20: mol_type = other DNA
tggcataaggaggaagacct

SEQ ID NO: 87203 - DNA, 20 bp, synthetic construct
  misc_feature 1..20: note = CRISPR gRNA sequence
  source 1..20: mol_type = other DNA
gtgtctatgccacccctgcc

SEQ ID NO: 87204 - DNA, 20 bp, synthetic construct
  misc_feature 1..20: note = CRISPR gRNA sequence
  source 1..20: mol_type = other DNA
ccctgcctggacttgaccta

SEQ ID NO: 87205 - DNA, 20 bp, synthetic construct
  misc_feature 1..20: note = CRISPR gRNA sequence
  source 1..20: mol_type = other DNA
cctgcctggacttgacctaa

SEQ ID NO: 87206 - DNA, 20 bp, synthetic construct
  misc_feature 1..20: note = CRISPR gRNA sequence
  source 1..20: mol_type = other DNA
ctgcctggacttgacctaaa

SEQ ID NO: 87207 - DNA, 20 bp, synthetic construct
  misc_feature 1..20: note = CRISPR gRNA sequence
  source 1..20: mol_type = other DNA
gacttgacctaaagggttct

SEQ ID NO: 87208 - DNA, 20 bp, synthetic construct
  misc_feature 1..20: note = CRISPR gRNA sequence
  source 1..20: mol_type = other DNA
cttgacctaaagggttctga

SEQ ID NO: 87209 - DNA, 20 bp, synthetic construct
  misc_feature 1..20: note = CRISPR gRNA sequence
  source 1..20: mol_type = other DNA
ctaaagggttctgagagtgt

SEQ ID NO: 87210 - DNA, 20 bp, synthetic construct
  misc_feature 1..20: note = CRISPR gRNA sequence
  source 1..20: mol_type = other DNA
ccaattccactcttctctcc

SEQ ID NO: 87211 - DNA, 20 bp, synthetic construct
  misc_feature 1..20: note = CRISPR gRNA sequence
  source 1..20: mol_type = other DNA
caattccactcttctctccc

SEQ ID NO: 87212 - DNA, 20 bp, synthetic construct
  misc_feature 1..20: note = CRISPR gRNA sequence
  source 1..20: mol_type = other DNA
cactcttctctcccaggtaa

SEQ ID NO: 87213 - DNA, 20 bp, synthetic construct
  misc_feature 1..20: note = CRISPR gRNA sequence
  source 1..20: mol_type = other DNA
cttctctcccaggtaaaagt

SEQ ID NO: 87214 - DNA, 20 bp, synthetic construct
  misc_feature 1..20: note = CRISPR gRNA sequence
  source 1..20: mol_type = other DNA
tctctcccaggtaaaagtca

SEQ ID NO: 87215 - DNA, 20 bp, synthetic construct
  misc_feature 1..20: note = CRISPR gRNA sequence
  source 1..20: mol_type = other DNA
ctctcccaggtaaaagtcag

SEQ ID NO: 87216 - DNA, 20 bp, synthetic construct
  misc_feature 1..20: note = CRISPR gRNA sequence
  source 1..20: mol_type = other DNA
aggtaaaagtcagaggtctt

SEQ ID NO: 87217 - DNA, 20 bp, synthetic construct
  misc_feature 1..20: note = CRISPR gRNA sequence
  source 1..20: mol_type = other DNA
ggtaaaagtcagaggtcttt

SEQ ID NO: 87218 - DNA, 20 bp, synthetic construct
  misc_feature 1..20: note = CRISPR gRNA sequence
  source 1..20: mol_type = other DNA
gtaaaagtcagaggtctttg

SEQ ID NO: 87219 - DNA, 20 bp, synthetic construct
  misc_feature 1..20: note = CRISPR gRNA sequence
  source 1..20: mol_type = other DNA
aggtctttggggcatgtttt

SEQ ID NO: 87220 - DNA, 20 bp, synthetic construct
  misc_feature 1..20: note = CRISPR gRNA sequence
  source 1..20: mol_type = other DNA
ggtctttggggcatgttttg

SEQ ID NO: 87221 - DNA, 20 bp, synthetic construct
  misc_feature 1..20: note = CRISPR gRNA sequence
  source 1..20: mol_type = other DNA
gtctttggggcatgttttga

SEQ ID NO: 87222 - DNA, 20 bp, synthetic construct
  misc_feature 1..20: note = CRISPR gRNA sequence
  source 1..20: mol_type = other DNA
gggcatgttttgagggctaa

SEQ ID NO: 87223 - DNA, 20 bp, synthetic construct
  misc_feature 1..20: note = CRISPR gRNA sequence
  source 1..20: mol_type = other DNA
gttttgagggctaacagcct

SEQ ID NO: 87224 - DNA, 20 bp, synthetic construct
  misc_feature 1..20: note = CRISPR gRNA sequence
  source 1..20: mol_type = other DNA
agcctcagtcattatgtaca

SEQ ID NO: 87225 - DNA, 20 bp, synthetic construct
  misc_feature 1..20: note = CRISPR gRNA sequence
  source 1..20: mol_type = other DNA
gtcattatgtacatagcttc

SEQ ID NO: 87226 - DNA, 20 bp, synthetic construct
  misc_feature 1..20: note = CRISPR gRNA sequence
  source 1..20: mol_type = other DNA
tcattatgtacatagcttct

SEQ ID NO: 87227 - DNA, 20 bp, synthetic construct
  misc_feature 1..20: note = CRISPR gRNA sequence
  source 1..20: mol_type = other DNA
gttcccttctgccaaccctg

SEQ ID NO: 87228 - DNA, 20 bp, synthetic construct
  misc_feature 1..20: note = CRISPR gRNA sequence
  source 1..20: mol_type = other DNA
cttctgccaaccctgtagct

SEQ ID NO: 87229 - DNA, 20 bp, synthetic construct
  misc_feature 1..20: note = CRISPR gRNA sequence
  source 1..20: mol_type = other DNA
ttctgccaaccctgtagctg

SEQ ID NO: 87230 - DNA, 20 bp, synthetic construct
  misc_feature 1..20: note = CRISPR gRNA sequence
  source 1..20: mol_type = other DNA
tgccaaccctgtagctgagg

SEQ ID NO: 87231 - DNA, 20 bp, synthetic construct
  misc_feature 1..20: note = CRISPR gRNA sequence
  source 1..20: mol_type = other DNA
ccaaccctgtagctgaggca

SEQ ID NO: 87232 - DNA, 20 bp, synthetic construct
  misc_feature 1..20: note = CRISPR gRNA sequence
  source 1..20: mol_type = other DNA
caaccctgtagctgaggcag

SEQ ID NO: 87233 - DNA, 20 bp, synthetic construct
  misc_feature 1..20: note = CRISPR gRNA sequence
  source 1..20: mol_type = other DNA
tgtagctgaggcagaggatg

SEQ ID NO: 87234 - DNA, 20 bp, synthetic construct
  misc_feature 1..20: note = CRISPR gRNA sequence
  source 1..20: mol_type = other DNA
tagctgaggcagaggatgaa

SEQ ID NO: 87235 - DNA, 20 bp, synthetic construct
  misc_feature 1..20: note = CRISPR gRNA sequence
  source 1..20: mol_type = other DNA
cagaggatgaagagaacttg

SEQ ID NO: 87236 - DNA, 20 bp, synthetic construct
  misc_feature 1..20: note = CRISPR gRNA sequence
  source 1..20: mol_type = other DNA
agaggatgaagagaacttgt

SEQ ID NO: 87237 - DNA, 20 bp, synthetic construct
  misc_feature 1..20: note = CRISPR gRNA sequence
  source 1..20: mol_type = other DNA
gaacttgtgggcttctgcaa

SEQ ID NO: 87238 - DNA, 20 bp, synthetic construct
  misc_feature 1..20: note = CRISPR gRNA sequence
  source 1..20: mol_type = other DNA
aacttgtgggcttctgcaat

SEQ ID NO: 87239 - DNA, 20 bp, synthetic construct
  misc_feature 1..20: note = CRISPR gRNA sequence
  source 1..20: mol_type = other DNA
tgtgggcttctgcaatggga

SEQ ID NO: 87240 - DNA, 20 bp, synthetic construct
  misc_feature 1..20: note = CRISPR gRNA sequence
  source 1..20: mol_type = other DNA
gtgggcttctgcaatgggat

SEQ ID NO: 87241 - DNA, 20 bp, synthetic construct
  misc_feature 1..20: note = CRISPR gRNA sequence
  source 1..20: mol_type = other DNA
ggcttctgcaatgggatagg

SEQ ID NO: 87242 - DNA, 20 bp, synthetic construct
  misc_feature 1..20: note = CRISPR gRNA sequence
  source 1..20: mol_type = other DNA
cttctgcaatgggataggta

SEQ ID NO: 87243 - DNA, 20 bp, synthetic construct
  misc_feature 1..20: note = CRISPR gRNA sequence
  source 1..20: mol_type = other DNA
ttctgcaatgggataggtag

SEQ ID NO: 87244 - DNA, 20 bp, synthetic construct
  misc_feature 1..20: note = CRISPR gRNA sequence
  source 1..20: mol_type = other DNA
gtagaggctactcccatccc

SEQ ID NO: 87245 - DNA, 20 bp, synthetic construct
  misc_feature 1..20: note = CRISPR gRNA sequence
  source 1..20: mol_type = other DNA
ggctactcccatccccagtc

SEQ ID NO: 87246 - DNA, 20 bp, synthetic construct
  misc_feature 1..20: note = CRISPR gRNA sequence
  source 1..20: mol_type = other DNA
tcccatccccagtctggtct

SEQ ID NO: 87247 - DNA, 20 bp, synthetic construct
  misc_feature 1..20: note = CRISPR gRNA sequence
  source 1..20: mol_type = other DNA
ccccagtctggtctcagctt

SEQ ID NO: 87248 - DNA, 20 bp, synthetic construct
  misc_feature 1..20: note = CRISPR gRNA sequence
  source 1..20: mol_type = other DNA
ctggtctcagctttggtcaa

SEQ ID NO: 87249 - DNA, 20 bp, synthetic construct
  misc_feature 1..20: note = CRISPR gRNA sequence
  source 1..20: mol_type = other DNA
aatagtctttgatctctgac

SEQ ID NO: 87250 - DNA, 20 bp, synthetic construct
  misc_feature 1..20: note = CRISPR gRNA sequence
  source 1..20: mol_type = other DNA
tagtctttgatctctgacaa

SEQ ID NO: 87251 - DNA, 20 bp, synthetic construct
  misc_feature 1..20: note = CRISPR gRNA sequence
  source 1..20: mol_type = other DNA
gtctttgatctctgacaaga

SEQ ID NO: 87252 - DNA, 20 bp, synthetic construct
  misc_feature 1..20: note = CRISPR gRNA sequence
  source 1..20: mol_type = other DNA
tctttgatctctgacaagag

SEQ ID NO: 87253 - DNA, 20 bp, synthetic construct
  misc_feature 1..20: note = CRISPR gRNA sequence
  source 1..20: mol_type = other DNA
tttgatctctgacaagagag

SEQ ID NO: 87254 - DNA, 20 bp, synthetic construct
  misc_feature 1..20: note = CRISPR gRNA sequence
  source 1..20: mol_type = other DNA
ttgatctctgacaagagagg

SEQ ID NO: 87255 - DNA, 20 bp, synthetic construct
  misc_feature 1..20: note = CRISPR gRNA sequence
  source 1..20: mol_type = other DNA
tctctgacaagagaggaggc

SEQ ID NO: 87256 - DNA, 20 bp, synthetic construct
  misc_feature 1..20: note = CRISPR gRNA sequence
  source 1..20: mol_type = other DNA
ctctgacaagagaggaggca

SEQ ID NO: 87257 - DNA, 20 bp, synthetic construct
  misc_feature 1..20: note = CRISPR gRNA sequence
  source 1..20: mol_type = other DNA
tctgacaagagaggaggcaa

SEQ ID NO: 87258 - DNA, 20 bp, synthetic construct
  misc_feature 1..20: note = CRISPR gRNA sequence
  source 1..20: mol_type = other DNA
gaggcaagggttctttaatt

SEQ ID NO: 87259 - DNA, 20 bp, synthetic construct
  misc_feature 1..20: note = CRISPR gRNA sequence
  source 1..20: mol_type = other DNA
ggcaagggttctttaatttg

SEQ ID NO: 87260 - DNA, 20 bp, synthetic construct
  misc_feature 1..20: note = CRISPR gRNA sequence
  source 1..20: mol_type = other DNA
tctttaatttggagtgtgat

SEQ ID NO: 87261 - DNA, 20 bp, synthetic construct
  misc_feature 1..20: note = CRISPR gRNA sequence
  source 1..20: mol_type = other DNA
ctttaatttggagtgtgatt

SEQ ID NO: 87262 - DNA, 20 bp, synthetic construct
  misc_feature 1..20: note = CRISPR gRNA sequence
  source 1..20: mol_type = other DNA
gggcatgtccttccccactt

SEQ ID NO: 87263 - DNA, 20 bp, synthetic construct
  misc_feature 1..20: note = CRISPR gRNA sequence
  source 1..20: mol_type = other DNA
atgtccttccccacttcagc

SEQ ID NO: 87264 - DNA, 20 bp, synthetic construct
  misc_feature 1..20: note = CRISPR gRNA sequence
  source 1..20: mol_type = other DNA
ttccccacttcagccagaaa

SEQ ID NO: 87265 - DNA, 20 bp, synthetic construct
  misc_feature 1..20: note = CRISPR gRNA sequence
  source 1..20: mol_type = other DNA
tccccacttcagccagaaat

SEQ ID NO: 87266 - DNA, 20 bp, synthetic construct
  misc_feature 1..20: note = CRISPR gRNA sequence
  source 1..20: mol_type = other DNA
acttcagccagaaatgggcc

SEQ ID NO: 87267 - DNA, 20 bp, synthetic construct
  misc_feature 1..20: note = CRISPR gRNA sequence
  source 1..20: mol_type = other DNA
tcagccagaaatgggcccag

SEQ ID NO: 87268 - DNA, 20 bp, synthetic construct
  misc_feature 1..20: note = CRISPR gRNA sequence
  source 1..20: mol_type = other DNA
aatgggcccagaagtaaccc

SEQ ID NO: 87269 - DNA, 20 bp, synthetic construct
  misc_feature 1..20: note = CRISPR gRNA sequence
  source 1..20: mol_type = other DNA
agaagtaaccccagcacctc

SEQ ID NO: 87270 - DNA, 20 bp, synthetic construct
  misc_feature 1..20: note = CRISPR gRNA sequence
  source 1..20: mol_type = other DNA
cccagcacctcgagatgaac

SEQ ID NO: 87271 - DNA, 20 bp, synthetic construct
  misc_feature 1..20: note = CRISPR gRNA sequence
  source 1..20: mol_type = other DNA
agcacctcgagatgaactgg

SEQ ID NO: 87272 - DNA, 20 bp, synthetic construct
  misc_feature 1..20: note = CRISPR gRNA sequence
  source 1..20: mol_type = other DNA
cacctcgagatgaactggtg

SEQ ID NO: 87273 - DNA, 20 bp, synthetic construct
  misc_feature 1..20: note = CRISPR gRNA sequence
  source 1..20: mol_type = other DNA
acctcgagatgaactggtgg

SEQ ID NO: 87274 - DNA, 20 bp, synthetic construct
  misc_feature 1..20: note = CRISPR gRNA sequence
  source 1..20: mol_type = other DNA
tcgagatgaactggtggagg

SEQ ID NO: 87275 - DNA, 20 bp, synthetic construct
  misc_feature 1..20: note = CRISPR gRNA sequence
  source 1..20: mol_type = other DNA
cgtgtgccctgacctgtgac

SEQ ID NO: 87276 - DNA, 20 bp, synthetic construct
  misc_feature 1..20: note = CRISPR gRNA sequence
  source 1..20: mol_type = other DNA
gtgtgccctgacctgtgact

SEQ ID NO: 87277 - DNA, 20 bp, synthetic construct
  misc_feature 1..20: note = CRISPR gRNA sequence
  source 1..20: mol_type = other DNA
tgccctgacctgtgactggg

SEQ ID NO: 87278 - DNA, 20 bp, synthetic construct
  misc_feature 1..20: note = CRISPR gRNA sequence
  source 1..20: mol_type = other DNA
ccctgacctgtgactgggca

SEQ ID NO: 87279 - DNA, 20 bp, synthetic construct
  misc_feature 1..20: note = CRISPR gRNA sequence
  source 1..20: mol_type = other DNA
tgacctgtgactgggcagag

SEQ ID NO: 87280 - DNA, 20 bp, synthetic construct
  misc_feature 1..20: note = CRISPR gRNA sequence
  source 1..20: mol_type = other DNA
gggcagagcggatcctgaaa

SEQ ID NO: 87281 - DNA, 20 bp, synthetic construct
  misc_feature 1..20: note = CRISPR gRNA sequence
  source 1..20: mol_type = other DNA
cggatcctgaaacggtcctt

SEQ ID NO: 87282 - DNA, 20 bp, synthetic construct
  misc_feature 1..20: note = CRISPR gRNA sequence
  source 1..20: mol_type = other DNA
ggtccttcagttccatcgtt

SEQ ID NO: 87283 - DNA, 20 bp, synthetic construct
  misc_feature 1..20: note = CRISPR gRNA sequence
  source 1..20: mol_type = other DNA
gtccttcagttccatcgttg

SEQ ID NO: 87284 - DNA, 20 bp, synthetic construct
  misc_feature 1..20: note = CRISPR gRNA sequence
  source 1..20: mol_type = other DNA
aggtcgcccgcttcctgcta

SEQ ID NO: 87285 - DNA, 20 bp, synthetic construct
  misc_feature 1..20: note = CRISPR gRNA sequence
  source 1..20: mol_type = other DNA
tcgcccgcttcctgctacag

SEQ ID NO: 87286 - DNA, 20 bp, synthetic construct
  misc_feature 1..20: note = CRISPR gRNA sequence
  source 1..20: mol_type = other DNA
ctgcacatgcccatgtgctt

SEQ ID NO: 87287 - DNA, 20 bp, synthetic construct
  misc_feature 1..20: note = CRISPR gRNA sequence
  source 1..20: mol_type = other DNA
tgcacatgcccatgtgctta

SEQ ID NO: 87288 - DNA, 20 bp, synthetic construct
  misc_feature 1..20: note = CRISPR gRNA sequence
  source 1..20: mol_type = other DNA
tgcccatgtgcttaaggcca

SEQ ID NO: 87289 - DNA, 20 bp, synthetic construct
  misc_feature 1..20: note = CRISPR gRNA sequence
  source 1..20: mol_type = other DNA
gcccatgtgcttaaggccat

SEQ ID NO: 87290 - DNA, 20 bp, synthetic construct
  misc_feature 1..20: note = CRISPR gRNA sequence
  source 1..20: mol_type = other DNA
cccatgtgcttaaggccatg

SEQ ID NO: 87291 - DNA, 20 bp, synthetic construct
  misc_feature 1..20: note = CRISPR gRNA sequence
  source 1..20: mol_type = other DNA
cttaaggccatggggctcgc

SEQ ID NO: 87292 - DNA, 20 bp, synthetic construct
  misc_feature 1..20: note = CRISPR gRNA sequence
  source 1..20: mol_type = other DNA
gttgaccctctcttatgtct

SEQ ID NO: 87293 - DNA, 20 bp, synthetic construct
  misc_feature 1..20: note = CRISPR gRNA sequence
  source 1..20: mol_type = other DNA
tcttatgtctcagcaaccct

SEQ ID NO: 87294 - DNA, 20 bp, synthetic construct
  misc_feature 1..20: note = CRISPR gRNA sequence
  source 1..20: mol_type = other DNA
cagcaaccctgagccacttt

SEQ ID NO: 87295 - DNA, 20 bp, synthetic construct
  misc_feature 1..20: note = CRISPR gRNA sequence
  source 1..20: mol_type = other DNA
ccctgagccactttcagctt

SEQ ID NO: 87296 - DNA, 20 bp, synthetic construct
  misc_feature 1..20: note = CRISPR gRNA sequence
  source 1..20: mol_type = other DNA
tgagccactttcagcttcag

SEQ ID NO: 87297 - DNA, 20 bp, synthetic construct
  misc_feature 1..20: note = CRISPR gRNA sequence
  source 1..20: mol_type = other DNA
tcagtggccctcccacacac

SEQ ID NO: 87298 - DNA, 20 bp, synthetic construct
  misc_feature 1..20: note = CRISPR gRNA sequence
  source 1..20: mol_type = other DNA
ggccctcccacacactagaa

SEQ ID NO: 87299 - DNA, 20 bp, synthetic construct
  misc_feature 1..20: note = CRISPR gRNA sequence
  source 1..20: mol_type = other DNA
ccctcccacacactagaata

SEQ ID NO: 87300 - DNA, 20 bp, synthetic construct
  misc_feature 1..20: note = CRISPR gRNA sequence
  source 1..20: mol_type = other DNA
acactagaatagagacacct

SEQ ID NO: 87301 - DNA, 20 bp, synthetic construct
  misc_feature 1..20: note = CRISPR gRNA sequence
  source 1..20: mol_type = other DNA
ttggatttgccccctcttcc

SEQ ID NO: 87302 - DNA, 20 bp, synthetic construct
  misc_feature 1..20: note = CRISPR gRNA sequence
  source 1..20: mol_type = other DNA
ggatttgccccctcttcctg

SEQ ID NO: 87303 - DNA, 20 bp, synthetic construct
  misc_feature 1..20: note = CRISPR gRNA sequence
  source 1..20: mol_type = other DNA
ctcttcctggagacccttct

SEQ ID NO: 87304 - DNA, 20 bp, synthetic construct
  misc_feature 1..20: note = CRISPR gRNA sequence
  source 1..20: mol_type = other DNA
gacccttctaagacatgctt

SEQ ID NO: 87305 - DNA, 20 bp, synthetic construct
  misc_feature 1..20: note = CRISPR gRNA sequence
  source 1..20: mol_type = other DNA
accccatttcctgtctctac

SEQ ID NO: 87306 - DNA, 20 bp, synthetic construct
  misc_feature 1..20: note = CRISPR gRNA sequence
  source 1..20: mol_type = other DNA
catttcctgtctctaccagt

SEQ ID NO: 87307 - DNA, 20 bp, synthetic construct
  misc_feature 1..20: note = CRISPR gRNA sequence
  source 1..20: mol_type = other DNA
gtctctaccagtcagtcaat

SEQ ID NO: 87308 - DNA, 20 bp, synthetic construct
  misc_feature 1..20: note = CRISPR gRNA sequence
  source 1..20: mol_type = other DNA
tgcctcactcccctattcct

SEQ ID NO: 87309 - DNA, 20 bp, synthetic construct
  misc_feature 1..20: note = CRISPR gRNA sequence
  source 1..20: mol_type = other DNA
ccttcactctattacctttt

SEQ ID NO: 87310 - DNA, 20 bp, synthetic construct
  misc_feature 1..20: note = CRISPR gRNA sequence
  source 1..20: mol_type = other DNA
ttacctttttggtacctctg

SEQ ID NO: 87311 - DNA, 20 bp, synthetic construct
  misc_feature 1..20: note = CRISPR gRNA sequence
  source 1..20: mol_type = other DNA
cctttttggtacctctgcag

SEQ ID NO: 87312 - DNA, 20 bp, synthetic construct
  misc_feature 1..20: note = CRISPR gRNA sequence
  source 1..20: mol_type = other DNA
tttttggtacctctgcagaa

SEQ ID NO: 87313 - DNA, 20 bp, synthetic construct
  misc_feature 1..20: note = CRISPR gRNA sequence
  source 1..20: mol_type = other DNA
ttttggtacctctgcagaag

SEQ ID NO: 87314 - DNA, 20 bp, synthetic construct
  misc_feature 1..20: note = CRISPR gRNA sequence
  source 1..20: mol_type = other DNA
aagaggacgaacatgcacct

SEQ ID NO: 87315 - DNA, 20 bp, synthetic construct
  misc_feature 1..20: note = CRISPR gRNA sequence
  source 1..20: mol_type = other DNA
agaggacgaacatgcacctc

SEQ ID NO: 87316 - DNA, 20 bp, synthetic construct
  misc_feature 1..20: note = CRISPR gRNA sequence
  source 1..20: mol_type = other DNA
acgaacatgcacctcgggaa

SEQ ID NO: 87317 - DNA, 20 bp, synthetic construct
  misc_feature 1..20: note = CRISPR gRNA sequence
  source 1..20: mol_type = other DNA
gggaacggtcatctaaacca

SEQ ID NO: 87318 - DNA, 20 bp, synthetic construct
  misc_feature 1..20: note = CRISPR gRNA sequence
  source 1..20: mol_type = other DNA
cggtcatctaaaccaaagaa

SEQ ID NO: 87319 - DNA, 20 bp, synthetic construct
  misc_feature 1..20: note = CRISPR gRNA sequence
  source 1..20: mol_type = other DNA
atctaaaccaaagaatggtt

SEQ ID NO: 87320 - DNA, 20 bp, synthetic construct
  misc_feature 1..20: note = CRISPR gRNA sequence
  source 1..20: mol_type = other DNA
ctaaaccaaagaatggttta

SEQ ID NO: 87321 - DNA, 20 bp, synthetic construct
  misc_feature 1..20: note = CRISPR gRNA sequence
  source 1..20: mol_type = other DNA
aaagaatggtttagagaacc

SEQ ID NO: 87322 - DNA, 20 bp, synthetic construct
  misc_feature 1..20: note = CRISPR gRNA sequence
  source 1..20: mol_type = other DNA
agaatggtttagagaaccca

SEQ ID NO: 87323 - DNA, 20 bp, synthetic construct
  misc_feature 1..20: note = CRISPR gRNA sequence
  source 1..20: mol_type = other DNA
gaatggtttagagaacccag

SEQ ID NO: 87324 - DNA, 20 bp, synthetic construct
  misc_feature 1..20: note = CRISPR gRNA sequence
  source 1..20: mol_type = other DNA
aatggtttagagaacccaga

SEQ ID NO: 87325 - DNA, 20 bp, synthetic construct
  misc_feature 1..20: note = CRISPR gRNA sequence
  source 1..20: mol_type = other DNA
ggtttagagaacccagaggg

SEQ ID NO: 87326 - DNA, 20 bp, synthetic construct
  misc_feature 1..20: note = CRISPR gRNA sequence
  source 1..20: mol_type = other DNA
tttagagaacccagagggtg

SEQ ID NO: 87327 - DNA, 20 bp, synthetic construct
  misc_feature 1..20: note = CRISPR gRNA sequence
  source 1..20: mol_type = other DNA
acccagagggtggagcccac

SEQ ID NO: 87328 - DNA, 20 bp, synthetic construct
  misc_feature 1..20: note = CRISPR gRNA sequence
  source 1..20: mol_type = other DNA
cagagggtggagcccacaag

SEQ ID NO: 87329 - DNA, 20 bp, synthetic construct
  misc_feature 1..20: note = CRISPR gRNA sequence
  source 1..20: mol_type = other DNA
gggtggagcccacaagaagc

SEQ ID NO: 87330 - DNA, 20 bp, synthetic construct
  misc_feature 1..20: note = CRISPR gRNA sequence
  source 1..20: mol_type = other DNA
gtggagcccacaagaagcca

SEQ ID NO: 87331 - DNA, 20 bp, synthetic construct
  misc_feature 1..20: note = CRISPR gRNA sequence
  source 1..20: mol_type = other DNA
ggagcccacaagaagccaga

SEQ ID NO: 87332 - DNA, 20 bp, synthetic construct
  misc_feature 1..20: note = CRISPR gRNA sequence
  source 1..20: mol_type = other DNA
ccacaagaagccagagagac

SEQ ID NO: 87333 - DNA, 20 bp, synthetic construct
  misc_feature 1..20: note = CRISPR gRNA sequence
  source 1..20: mol_type = other DNA
agaagccagagagactggcc

SEQ ID NO: 87334 - DNA, 20 bp, synthetic construct
  misc_feature 1..20: note = CRISPR gRNA sequence
  source 1..20: mol_type = other DNA
gaagccagagagactggccc

SEQ ID NO: 87335 - DNA, 20 bp, synthetic construct
  misc_feature 1..20: note = CRISPR gRNA sequence
  source 1..20: mol_type = other DNA
ccagagagactggcccaggt

SEQ ID NO: 87336 - DNA, 20 bp, synthetic construct
  misc_feature 1..20: note = CRISPR gRNA sequence
  source 1..20: mol_type = other DNA
cagagagactggcccaggta

SEQ ID NO: 87337 - DNA, 20 bp, synthetic construct
  misc_feature 1..20: note = CRISPR gRNA sequence
  source 1..20: mol_type = other DNA
agagactggcccaggtaagg

SEQ ID NO: 87338 - DNA, 20 bp, synthetic construct
  misc_feature 1..20: note = CRISPR gRNA sequence
  source 1..20: mol_type = other DNA
actggcccaggtaaggaagt

SEQ ID NO: 87339 - DNA, 20 bp, synthetic construct
  misc_feature 1..20: note = CRISPR gRNA sequence
  source 1..20: mol_type = other DNA
ggcccaggtaaggaagtcag

SEQ ID NO: 87340 - DNA, 20 bp, synthetic construct
  misc_feature 1..20: note = CRISPR gRNA sequence
  source 1..20: mol_type = other DNA
tggccctgactttgctgtcc

SEQ ID NO: 87341 - DNA, 20 bp, synthetic construct
  misc_feature 1..20: note = CRISPR gRNA sequence
  source 1..20: mol_type = other DNA
ggccctgactttgctgtcct

SEQ ID NO: 87342 - DNA, 20 bp, synthetic construct
  misc_feature 1..20: note = CRISPR gRNA sequence
  source 1..20: mol_type = other DNA
ctgactttgctgtcctgggc

SEQ ID NO: 87343 - DNA, 20 bp, synthetic construct
  misc_feature 1..20: note = CRISPR gRNA sequence
  source 1..20: mol_type = other DNA
tgactttgctgtcctgggct

SEQ ID NO: 87344 - DNA, 20 bp, synthetic construct
  misc_feature 1..20: note = CRISPR gRNA sequence
  source 1..20: mol_type = other DNA
gactttgctgtcctgggctg

SEQ ID NO: 87345 - DNA, 20 bp, synthetic construct
  misc_feature 1..20: note = CRISPR gRNA sequence
  source 1..20: mol_type = other DNA
actttgctgtcctgggctgg

SEQ ID NO: 87346 - DNA, 20 bp, synthetic construct
  misc_feature 1..20: note = CRISPR gRNA sequence
  source 1..20: mol_type = other DNA
gctgtcctgggctgggggct

SEQ ID NO: 87347 - DNA, 20 bp, synthetic construct
  misc_feature 1..20: note = CRISPR gRNA sequence
  source 1..20: mol_type = other DNA
ttagtatatccttctccaat

SEQ ID NO: 87348 - DNA, 20 bp, synthetic construct
  misc_feature 1..20: note = CRISPR gRNA sequence
  source 1..20: mol_type = other DNA
tagtatatccttctccaatt

SEQ ID NO: 87349 - DNA, 20 bp, synthetic construct
  misc_feature 1..20: note = CRISPR gRNA sequence
  source 1..20: mol_type = other DNA
ttttccacctcctgtgcctc

SEQ ID NO: 87350 - DNA, 20 bp, synthetic construct
  misc_feature 1..20: note = CRISPR gRNA sequence
  source 1..20: mol_type = other DNA
gtgttcctctctttactttt

SEQ ID NO: 87351 - DNA, 20 bp, synthetic construct
  misc_feature 1..20: note = CRISPR gRNA sequence
  source 1..20: mol_type = other DNA
tctttactttttagcctcct

SEQ ID NO: 87352 - DNA, 20 bp, synthetic construct
  misc_feature 1..20: note = CRISPR gRNA sequence
  source 1..20: mol_type = other DNA
ctttactttttagcctccta

SEQ ID NO: 87353 - DNA, 20 bp, synthetic construct
  misc_feature 1..20: note = CRISPR gRNA sequence
  source 1..20: mol_type = other DNA
tttttagcctcctaaggatc

SEQ ID NO: 87354 - DNA, 20 bp, synthetic construct
  misc_feature 1..20: note = CRISPR gRNA sequence
  source 1..20: mol_type = other DNA
ttagcctcctaaggatctgg

SEQ ID NO: 87355 - DNA, 20 bp, synthetic construct
  misc_feature 1..20: note = CRISPR gRNA sequence
  source 1..20: mol_type = other DNA
aaggatctggaagcccgaac

SEQ ID NO: 87356 - DNA, 20 bp, synthetic construct
  misc_feature 1..20: note = CRISPR gRNA sequence
  source 1..20: mol_type = other DNA
aggatctggaagcccgaact

SEQ ID NO: 87357 - DNA, 20 bp, synthetic construct
  misc_feature 1..20: note = CRISPR gRNA sequence
  source 1..20: mol_type = other DNA
ggatctggaagcccgaactg

SEQ ID NO: 87358 - DNA, 20 bp, synthetic construct
  misc_feature 1..20: note = CRISPR gRNA sequence
  source 1..20: mol_type = other DNA
ctggaagcccgaactggggc

SEQ ID NO: 87359 - DNA, 20 bp, synthetic construct
  misc_feature 1..20: note = CRISPR gRNA sequence
  source 1..20: mol_type = other DNA
ggggccggtcctctcgcacg

SEQ ID NO: 87360 - DNA, 20 bp, synthetic construct
  misc_feature 1..20: note = CRISPR gRNA sequence
  source 1..20: mol_type = other DNA
ggccggtcctctcgcacgtg

SEQ ID NO: 87361 - DNA, 20 bp, synthetic construct
  misc_feature 1..20: note = CRISPR gRNA sequence
  source 1..20: mol_type = other DNA
ccggtcctctcgcacgtgga

SEQ ID NO: 87362 - DNA, 20 bp, synthetic construct
  misc_feature 1..20: note = CRISPR gRNA sequence
  source 1..20: mol_type = other DNA
gtcctctcgcacgtggagag

SEQ ID NO: 87363 - DNA, 20 bp, synthetic construct
  misc_feature 1..20: note = CRISPR gRNA sequence
  source 1..20: mol_type = other DNA
ctctcgcacgtggagagcgg

SEQ ID NO: 87364 - DNA, 20 bp, synthetic construct
  misc_feature 1..20: note = CRISPR gRNA sequence
  source 1..20: mol_type = other DNA
tcgcacgtggagagcggaag

SEQ ID NO: 87365 - DNA, 20 bp, synthetic construct
  misc_feature 1..20: note = CRISPR gRNA sequence
  source 1..20: mol_type = other DNA
gcacgtggagagcggaagaa

SEQ ID NO: 87366 - DNA, 20 bp, synthetic construct
  misc_feature 1..20: note = CRISPR gRNA sequence
  source 1..20: mol_type = other DNA
tggagagcggaagaagagtg

SEQ ID NO: 87367 - DNA, 20 bp, synthetic construct
  misc_feature 1..20: note = CRISPR gRNA sequence
  source 1..20: mol_type = other DNA
agcggaagaagagtgtagtt

SEQ ID NO: 87368 - DNA, 20 bp, synthetic construct
  misc_feature 1..20: note = CRISPR gRNA sequence
  source 1..20: mol_type = other DNA
cggaagaagagtgtagttga

SEQ ID NO: 87369 - DNA, 20 bp, synthetic construct
  misc_feature 1..20: note = CRISPR gRNA sequence
  source 1..20: mol_type = other DNA
gaagagtgtagttgagagct

SEQ ID NO: 87370 - DNA, 20 bp, synthetic construct
  misc_feature 1..20: note = CRISPR gRNA sequence
  source 1..20: mol_type = other DNA
tgtagttgagagctcggccc

SEQ ID NO: 87371 - DNA, 20 bp, synthetic construct
  misc_feature 1..20: note = CRISPR gRNA sequence
  source 1..20: mol_type = other DNA
gtagttgagagctcggcccc

SEQ ID NO: 87372 - DNA, 20 bp, synthetic construct
  misc_feature 1..20: note = CRISPR gRNA sequence
  source 1..20: mol_type = other DNA
agttgagagctcggccccag

SEQ ID NO: 87373 - DNA, 20 bp, synthetic construct
  misc_feature 1..20: note = CRISPR gRNA sequence
  source 1..20: mol_type = other DNA
ccccaggagccaataacctg

SEQ ID NO: 87374 - DNA, 20 bp, synthetic construct
  misc_feature 1..20: note = CRISPR gRNA sequence
  source 1..20: mol_type = other DNA
cccaggagccaataacctgc

SEQ ID NO: 87375 - DNA, 20 bp, synthetic construct
  misc_feature 1..20: note = CRISPR gRNA sequence
  source 1..20: mol_type = other DNA
taacctgcaggttaatgccc

SEQ ID NO: 87376 - DNA, 20 bp, synthetic construct
  misc_feature 1..20: note = CRISPR gRNA sequence
  source 1..20: mol_type = other DNA
cctgcaggttaatgccctag

SEQ ID NO: 87377 - DNA, 20 bp, synthetic construct
  misc_feature 1..20: note = CRISPR gRNA sequence
  source 1..20: mol_type = other DNA
aggttaatgccctagtggct

SEQ ID NO: 87378 - DNA, 20 bp, synthetic construct
  misc_feature 1..20: note = CRISPR gRNA sequence
  source 1..20: mol_type = other DNA
ggctgcctctgctccttccc

SEQ ID NO: 87379 - DNA, 20 bp, synthetic construct
  misc_feature 1..20: note = CRISPR gRNA sequence
  source 1..20: mol_type = other DNA
gctgcctctgctccttcccc

SEQ ID NO: 87380 - DNA, 20 bp, synthetic construct
  misc_feature 1..20: note = CRISPR gRNA sequence
  source 1..20: mol_type = other DNA
ctcactaattccgccaatcc

SEQ ID NO: 87381 - DNA, 20 bp, synthetic construct
  misc_feature 1..20: note = CRISPR gRNA sequence
  source 1..20: mol_type = other DNA
cccagtctctccacctattc

SEQ ID NO: 87382 - DNA, 20 bp, synthetic construct
  misc_feature 1..20: note = CRISPR gRNA sequence
  source 1..20: mol_type = other DNA
tctccacctattctggcccc

SEQ ID NO: 87383 - DNA, 20 bp, synthetic construct
  misc_feature 1..20: note = CRISPR gRNA sequence
  source 1..20: mol_type = other DNA
ctccacctattctggccccc

SEQ ID NO: 87384 - DNA, 20 bp, synthetic construct
  misc_feature 1..20: note = CRISPR gRNA sequence
  source 1..20: mol_type = other DNA
tctggcccccaggctttctt

SEQ ID NO: 87385 - DNA, 20 bp, synthetic construct
  misc_feature 1..20: note = CRISPR gRNA sequence
  source 1..20: mol_type = other DNA
ctggcccccaggctttcttc

SEQ ID NO: 87386 - DNA, 20 bp, synthetic construct
  misc_feature 1..20: note = CRISPR gRNA sequence
  source 1..20: mol_type = other DNA
gctttcttcaggtgccctga

SEQ ID NO: 87387 - DNA, 20 bp, synthetic construct
  misc_feature 1..20: note = CRISPR gRNA sequence
  source 1..20: mol_type = other DNA
ttcttcaggtgccctgaaag

SEQ ID NO: 87388 - DNA, 20 bp, synthetic construct
  misc_feature 1..20: note = CRISPR gRNA sequence
  source 1..20: mol_type = other DNA
gtggctacactgcctctgtc

SEQ ID NO: 87389 - DNA, 20 bp, synthetic construct
  misc_feature 1..20: note = CRISPR gRNA sequence
  source 1..20: mol_type = other DNA
gctacactgcctctgtctag

SEQ ID NO: 87390 - DNA, 20 bp, synthetic construct
  misc_feature 1..20: note = CRISPR gRNA sequence
  source 1..20: mol_type = other DNA
ctacactgcctctgtctagt

SEQ ID NO: 87391 - DNA, 20 bp, synthetic construct
  misc_feature 1..20: note = CRISPR gRNA sequence
  source 1..20: mol_type = other DNA
tacactgcctctgtctagta

SEQ ID NO: 87392 - DNA, 20 bp, synthetic construct
  misc_feature 1..20: note = CRISPR gRNA sequence
  source 1..20: mol_type = other DNA
ctgcctctgtctagtagggc

SEQ ID NO: 87393 - DNA, 20 bp, synthetic construct
  misc_feature 1..20: note = CRISPR gRNA sequence
  source 1..20: mol_type = other DNA
tgcctctgtctagtagggcc

SEQ ID NO: 87394 - DNA, 20 bp, synthetic construct
  misc_feature 1..20: note = CRISPR gRNA sequence
  source 1..20: mol_type = other DNA
gcctctgtctagtagggccg

SEQ ID NO: 87395 - DNA, 20 bp, synthetic construct
  misc_feature 1..20: note = CRISPR gRNA sequence
  source 1..20: mol_type = other DNA
tagtagggccggggcacccc

SEQ ID NO: 87396 - DNA, 20 bp, synthetic construct
  misc_feature 1..20: note = CRISPR gRNA sequence
  source 1..20: mol_type = other DNA
tagggccggggcacccccag

SEQ ID NO: 87397 - DNA, 20 bp, synthetic construct
  misc_feature 1..20: note = CRISPR gRNA sequence
  source 1..20: mol_type = other DNA
ccaactgttcctgctttgcc

SEQ ID NO: 87398 - DNA, 20 bp, synthetic construct
  misc_feature 1..20: note = CRISPR gRNA sequence
  source 1..20: mol_type = other DNA
gttcctgctttgcctggacc

SEQ ID NO: 87399 - DNA, 20 bp, synthetic construct
  misc_feature 1..20: note = CRISPR gRNA sequence
  source 1..20: mol_type = other DNA
gctttgcctggacctggacc

SEQ ID NO: 87400 - DNA, 20 bp, synthetic construct
  misc_feature 1..20: note = CRISPR gRNA sequence
  source 1..20: mol_type = other DNA
ctttgcctggacctggacct

SEQ ID NO: 87401 - DNA, 20 bp, synthetic construct
  misc_feature 1..20: note = CRISPR gRNA sequence
  source 1..20: mol_type = other DNA
cctggacctggacctgggcc

SEQ ID NO: 87402 - DNA, 20 bp, synthetic construct
  misc_feature 1..20: note = CRISPR gRNA sequence
  source 1..20: mol_type = other DNA
ctggacctggacctgggcct

SEQ ID NO: 87403 - DNA, 20 bp, synthetic construct
  misc_feature 1..20: note = CRISPR gRNA sequence
  source 1..20: mol_type = other DNA
acctggacctgggcctgggc

SEQ ID NO: 87404 - DNA, 20 bp, synthetic construct
  misc_feature 1..20: note = CRISPR gRNA sequence
  source 1..20: mol_type = other DNA
gggcctgggcgagctccacc

SEQ ID NO: 87405 - DNA, 20 bp, synthetic construct
  misc_feature 1..20: note = CRISPR gRNA sequence
  source 1..20: mol_type = other DNA
ggcctgggcgagctccacct

SEQ ID NO: 87406 - DNA, 20 bp, synthetic construct
  misc_feature 1..20: note = CRISPR gRNA sequence
  source 1..20: mol_type = other DNA
gcctgggcgagctccacctg

SEQ ID NO: 87407 - DNA, 20 bp, synthetic construct
  misc_feature 1..20: note = CRISPR gRNA sequence
  source 1..20: mol_type = other DNA
cctgggcgagctccacctgg

SEQ ID NO: 87408 - DNA, 20 bp, synthetic construct
  misc_feature 1..20: note = CRISPR gRNA sequence
  source 1..20: mol_type = other DNA
ctccacctgggggactcact

SEQ ID NO: 87409 - DNA, 20 bp, synthetic construct
  misc_feature 1..20: note = CRISPR gRNA sequence
  source 1..20: mol_type = other DNA
ctgggggactcactcagccc

SEQ ID NO: 87410 - DNA, 20 bp, synthetic construct
  misc_feature 1..20: note = CRISPR gRNA sequence
  source 1..20: mol_type = other DNA
tgggggactcactcagcccc

SEQ ID NO: 87411 - DNA, 20 bp, synthetic construct
  misc_feature 1..20: note = CRISPR gRNA sequence
  source 1..20: mol_type = other DNA
gggggactcactcagccccg

SEQ ID NO: 87412 - DNA, 20 bp, synthetic construct
  misc_feature 1..20: note = CRISPR gRNA sequence
  source 1..20: mol_type = other DNA
actcactcagccccggggca

SEQ ID NO: 87413 - DNA, 20 bp, synthetic construct
  misc_feature 1..20: note = CRISPR gRNA sequence
  source 1..20: mol_type = other DNA
tcactcagccccggggcaca

SEQ ID NO: 87414 - DNA, 20 bp, synthetic construct
  misc_feature 1..20: note = CRISPR gRNA sequence
  source 1..20: mol_type = other DNA
cagccccggggcacagagaa

SEQ ID NO: 87415 - DNA, 20 bp, synthetic construct
  misc_feature 1..20: note = CRISPR gRNA sequence
  source 1..20: mol_type = other DNA
gccccggggcacagagaaca

SEQ ID NO: 87416 - DNA, 20 bp, synthetic construct
  misc_feature 1..20: note = CRISPR gRNA sequence
  source 1..20: mol_type = other DNA
cccggggcacagagaacaga

SEQ ID NO: 87417 - DNA, 20 bp, synthetic construct
  misc_feature 1..20: note = CRISPR gRNA sequence
  source 1..20: mol_type = other DNA
ccggggcacagagaacagag

SEQ ID NO: 87418 - DNA, 20 bp, synthetic construct
  misc_feature 1..20: note = CRISPR gRNA sequence
  source 1..20: mol_type = other DNA
gggcacagagaacagagagg

SEQ ID NO: 87419 - DNA, 20 bp, synthetic construct
  misc_feature 1..20: note = CRISPR gRNA sequence
  source 1..20: mol_type = other DNA
ggcacagagaacagagaggt

SEQ ID NO: 87420 - DNA, 20 bp, synthetic construct
  misc_feature 1..20: note = CRISPR gRNA sequence
  source 1..20: mol_type = other DNA
agagaacagagaggtaggca

SEQ ID NO: 87421 - DNA, 20 bp, synthetic construct
  misc_feature 1..20: note = CRISPR gRNA sequence
  source 1..20: mol_type = other DNA
gagaacagagaggtaggcat

SEQ ID NO: 87422 - DNA, 20 bp, synthetic construct
  misc_feature 1..20: note = CRISPR gRNA sequence
  source 1..20: mol_type = other DNA
aacagagaggtaggcatagg

SEQ ID NO: 87423 - DNA, 20 bp, synthetic construct
  misc_feature 1..20: note = CRISPR gRNA sequence
  source 1..20: mol_type = other DNA
ggtaggcataggtggtgacc

SEQ ID NO: 87424 - DNA, 20 bp, synthetic construct
  misc_feature 1..20: note = CRISPR gRNA sequence
  source 1..20: mol_type = other DNA
gtaggcataggtggtgacca

SEQ ID NO: 87425 - DNA, 20 bp, synthetic construct
  misc_feature 1..20: note = CRISPR gRNA sequence
  source 1..20: mol_type = other DNA
gtgaccaaggaccacatgac

SEQ ID NO: 87426 - DNA, 20 bp, synthetic construct
  misc_feature 1..20: note = CRISPR gRNA sequence
  source 1..20: mol_type = other DNA
tgaccaaggaccacatgaca

SEQ ID NO: 87427 - DNA, 20 bp, synthetic construct
  misc_feature 1..20: note = CRISPR gRNA sequence
  source 1..20: mol_type = other DNA
gaccaaggaccacatgacaa

SEQ ID NO: 87428 - DNA, 20 bp, synthetic construct
  misc_feature 1..20: note = CRISPR gRNA sequence
  source 1..20: mol_type = other DNA
gaccacatgacaagggtgtc

SEQ ID NO: 87429 - DNA, 20 bp, synthetic construct
  misc_feature 1..20: note = CRISPR gRNA sequence
  source 1..20: mol_type = other DNA
ccacatgacaagggtgtcaa

SEQ ID NO: 87430 - DNA, 20 bp, synthetic construct
  misc_feature 1..20: note = CRISPR gRNA sequence
  source 1..20: mol_type = other DNA
cacatgacaagggtgtcaag

SEQ ID NO: 87431 - DNA, 20 bp, synthetic construct
  misc_feature 1..20: note = CRISPR gRNA sequence
  source 1..20: mol_type = other DNA
tgacaagggtgtcaagagga

SEQ ID NO: 87432 - DNA, 20 bp, synthetic construct
  misc_feature 1..20: note = CRISPR gRNA sequence
  source 1..20: mol_type = other DNA
gggtgtcaagaggacagctg

SEQ ID NO: 87433 - DNA, 20 bp, synthetic construct
  misc_feature 1..20: note = CRISPR gRNA sequence
  source 1..20: mol_type = other DNA
aggacagctgaagtacctgt

SEQ ID NO: 87434 - DNA, 20 bp, synthetic construct
  misc_feature 1..20: note = CRISPR gRNA sequence
  source 1..20: mol_type = other DNA
cagctgaagtacctgtgagt

SEQ ID NO: 87435 - DNA, 20 bp, synthetic construct
  misc_feature 1..20: note = CRISPR gRNA sequence
  source 1..20: mol_type = other DNA
agctgaagtacctgtgagtg

SEQ ID NO: 87436 - DNA, 20 bp, synthetic construct
  misc_feature 1..20: note = CRISPR gRNA sequence
  source 1..20: mol_type = other DNA
gaagtacctgtgagtgaggc

SEQ ID NO: 87437 - DNA, 20 bp, synthetic construct
  misc_feature 1..20: note = CRISPR gRNA sequence
  source 1..20: mol_type = other DNA
gtacctgtgagtgaggccag

SEQ ID NO: 87438 - DNA, 20 bp, synthetic construct
  misc_feature 1..20: note = CRISPR gRNA sequence
  source 1..20: mol_type = other DNA
tacctgtgagtgaggccagt

SEQ ID NO: 87439 - DNA, 20 bp, synthetic construct
  misc_feature 1..20: note = CRISPR gRNA sequence
  source 1..20: mol_type = other DNA
ctgtgagtgaggccagtggg

SEQ ID NO: 87440 - DNA, 20 bp, synthetic construct
  misc_feature 1..20: note = CRISPR gRNA sequence
  source 1..20: mol_type = other DNA
tgtgagtgaggccagtgggc

SEQ ID NO: 87441 - DNA, 20 bp, synthetic construct
  misc_feature 1..20: note = CRISPR gRNA sequence
  source 1..20: mol_type = other DNA
ggccagtgggcaggctccac

SEQ ID NO: 87442 - DNA, 20 bp, synthetic construct
  misc_feature 1..20: note = CRISPR gRNA sequence
  source 1..20: mol_type = other DNA
tgggcaggctccaccagcta

SEQ ID NO: 87443 - DNA, 20 bp, synthetic construct
  misc_feature 1..20: note = CRISPR gRNA sequence
  source 1..20: mol_type = other DNA
gcaggctccaccagctaaag

SEQ ID NO: 87444 - DNA, 20 bp, synthetic construct
  misc_feature 1..20: note = CRISPR gRNA sequence
  source 1..20: mol_type = other DNA
ctccaccagctaaagcagca

SEQ ID NO: 87445 - DNA, 20 bp, synthetic construct
  misc_feature 1..20: note = CRISPR gRNA sequence
  source 1..20: mol_type = other DNA
caccagctaaagcagcaaag

SEQ ID NO: 87446 - DNA, 20 bp, synthetic construct
  misc_feature 1..20: note = CRISPR gRNA sequence
  source 1..20: mol_type = other DNA
accagctaaagcagcaaagc

SEQ ID NO: 87447 - DNA, 20 bp, synthetic construct
  misc_feature 1..20: note = CRISPR gRNA sequence
  source 1..20: mol_type = other DNA
taaagcagcaaagcaggata

SEQ ID NO: 87448 - DNA, 20 bp, synthetic construct
  misc_feature 1..20: note = CRISPR gRNA sequence
  source 1..20: mol_type = other DNA
aagcagcaaagcaggatata

SEQ ID NO: 87449 - DNA, 20 bp, synthetic construct
  misc_feature 1..20: note = CRISPR gRNA sequence
  source 1..20: mol_type = other DNA
agcagcaaagcaggatatag

SEQ ID NO: 87450 - DNA, 20 bp, synthetic construct
  misc_feature 1..20: note = CRISPR gRNA sequence
  source 1..20: mol_type = other DNA
aaagcaggatatagaggata

SEQ ID NO: 87451 - DNA, 20 bp, synthetic construct
  misc_feature 1..20: note = CRISPR gRNA sequence
  source 1..20: mol_type = other DNA
caggatatagaggatacagc

SEQ ID NO: 87452 - DNA, 20 bp, synthetic construct
  misc_feature 1..20: note = CRISPR gRNA sequence
  source 1..20: mol_type = other DNA
gatacagcaagtgatgccaa

SEQ ID NO: 87453 - DNA, 20 bp, synthetic construct
  misc_feature 1..20: note = CRISPR gRNA sequence
  source 1..20: mol_type = other DNA
atacagcaagtgatgccaaa

SEQ ID NO: 87454 - DNA, 20 bp, synthetic construct
  misc_feature 1..20: note = CRISPR gRNA sequence
  source 1..20: mol_type = other DNA
caagtgatgccaaaaggaaa

SEQ ID NO: 87455 - DNA, 20 bp, synthetic construct
  misc_feature 1..20: note = CRISPR gRNA sequence
  source 1..20: mol_type = other DNA
aagtgatgccaaaaggaaac

SEQ ID NO: 87456 - DNA, 20 bp, synthetic construct
  misc_feature 1..20: note = CRISPR gRNA sequence
  source 1..20: mol_type = other DNA
agtgatgccaaaaggaaacg

SEQ ID NO: 87457 - DNA, 20 bp, synthetic construct
  misc_feature 1..20: note = CRISPR gRNA sequence
  source 1..20: mol_type = other DNA
gtgatgccaaaaggaaacgg

SEQ ID NO: 87458 - DNA, 20 bp, synthetic construct
  misc_feature 1..20: note = CRISPR gRNA sequence
  source 1..20: mol_type = other DNA
aacgggggcgccctcgaaaa

SEQ ID NO: 87459 - DNA, 20 bp, synthetic construct
  misc_feature 1..20: note = CRISPR gRNA sequence
  source 1..20: mol_type = other DNA
ggggcgccctcgaaaaaagt

SEQ ID NO: 87460 - DNA, 20 bp, synthetic construct
  misc_feature 1..20: note = CRISPR gRNA sequence
  source 1..20: mol_type = other DNA
gggcgccctcgaaaaaagtc

SEQ ID NO: 87461 - DNA, 20 bp, synthetic construct
  misc_feature 1..20: note = CRISPR gRNA sequence
  source 1..20: mol_type = other DNA
cgccctcgaaaaaagtcagg

SEQ ID NO: 87462 - DNA, 20 bp, synthetic construct
  misc_feature 1..20: note = CRISPR gRNA sequence
  source 1..20: mol_type = other DNA
cctcgaaaaaagtcaggtgg

SEQ ID NO: 87463 - DNA, 20 bp, synthetic construct
  misc_feature 1..20: note = CRISPR gRNA sequence
  source 1..20: mol_type = other DNA
cgaaaaaagtcaggtggaag

SEQ ID NO: 87464 - DNA, 20 bp, synthetic construct
  misc_feature 1..20: note = CRISPR gRNA sequence
  source 1..20: mol_type = other DNA
gaaaaaagtcaggtggaagt

SEQ ID NO: 87465 - DNA, 20 bp, synthetic construct
  misc_feature 1..20: note = CRISPR gRNA sequence
  source 1..20: mol_type = other DNA
aaaaaagtcaggtggaagtg

SEQ ID NO: 87466 - DNA, 20 bp, synthetic construct
  misc_feature 1..20: note = CRISPR gRNA sequence
  source 1..20: mol_type = other DNA
aagtcaggtggaagtgggga

SEQ ID NO: 87467 - DNA, 20 bp, synthetic construct
  misc_feature 1..20: note = CRISPR gRNA sequence
  source 1..20: mol_type = other DNA
agtcaggtggaagtggggaa

SEQ ID NO: 87468 - DNA, 20 bp, synthetic construct
  misc_feature 1..20: note = CRISPR gRNA sequence
  source 1..20: mol_type = other DNA
aaaggaattctacccctctc

SEQ ID NO: 87469 - DNA, 20 bp, synthetic construct
  misc_feature 1..20: note = CRISPR gRNA sequence
  source 1..20: mol_type = other DNA
gaattctacccctctcaagt

SEQ ID NO: 87470 - DNA, 20 bp, synthetic construct
  misc_feature 1..20: note = CRISPR gRNA sequence
  source 1..20: mol_type = other DNA
ttctacccctctcaagtcag

SEQ ID NO: 87471 - DNA, 20 bp, synthetic construct
  misc_feature 1..20: note = CRISPR gRNA sequence
  source 1..20: mol_type = other DNA
tctcaagtcagcagctgcca

SEQ ID NO: 87472 - DNA, 20 bp, synthetic construct
  misc_feature 1..20: note = CRISPR gRNA sequence
  source 1..20: mol_type = other DNA
cagctgccatggaatctgcc

SEQ ID NO: 87473 - DNA, 20 bp, synthetic construct
  misc_feature 1..20: note = CRISPR gRNA sequence
  source 1..20: mol_type = other DNA
atggaatctgcccagtcctc

SEQ ID NO: 87474 - DNA, 20 bp, synthetic construct
  misc_feature 1..20: note = CRISPR gRNA sequence
  source 1..20: mol_type = other DNA
tggaatctgcccagtcctca

SEQ ID NO: 87475 - DNA, 20 bp, synthetic construct
  misc_feature 1..20: note = CRISPR gRNA sequence
  source 1..20: mol_type = other DNA
cccagtcctcaaggttacca

SEQ ID NO: 87476 - DNA, 20 bp, synthetic construct
  misc_feature 1..20: note = CRISPR gRNA sequence
  source 1..20: mol_type = other DNA
ccagtcctcaaggttaccat

SEQ ID NO: 87477 - DNA, 20 bp, synthetic construct
  misc_feature 1..20: note = CRISPR gRNA sequence
  source 1..20: mol_type = other DNA
agtcctcaaggttaccatgg

SEQ ID NO: 87478 - DNA, 20 bp, synthetic construct
  misc_feature 1..20: note = CRISPR gRNA sequence
  source 1..20: mol_type = other DNA
caaggttaccatgggagaca

SEQ ID NO: 87479 - DNA, 20 bp, synthetic construct
  misc_feature 1..20: note = CRISPR gRNA sequence
  source 1..20: mol_type = other DNA
aaggttaccatgggagacat

SEQ ID NO: 87480 - DNA, 20 bp, synthetic construct
  misc_feature 1..20: note = CRISPR gRNA sequence
  source 1..20: mol_type = other DNA
aggttaccatgggagacatg

SEQ ID NO: 87481 - DNA, 20 bp, synthetic construct
  misc_feature 1..20: note = CRISPR gRNA sequence
  source 1..20: mol_type = other DNA
accatgggagacatggggct

SEQ ID NO: 87482 - DNA, 20 bp, synthetic construct
  misc_feature 1..20: note = CRISPR gRNA sequence
  source 1..20: mol_type = other DNA
ccatgggagacatggggctc

SEQ ID NO: 87483 - DNA, 20 bp, synthetic construct
  misc_feature 1..20: note = CRISPR gRNA sequence
  source 1..20: mol_type = other DNA
atgggagacatggggctcag

SEQ ID NO: 87484 - DNA, 20 bp, synthetic construct
  misc_feature 1..20: note = CRISPR gRNA sequence
  source 1..20: mol_type = other DNA
tgggagacatggggctcagg

SEQ ID NO: 87485 - DNA, 20 bp, synthetic construct
  misc_feature 1..20: note = CRISPR gRNA sequence
  source 1..20: mol_type = other DNA
gggagacatggggctcagga

SEQ ID NO: 87486 - DNA, 20 bp, synthetic construct
  misc_feature 1..20: note = CRISPR gRNA sequence
  source 1..20: mol_type = other DNA
ggagacatggggctcaggag

SEQ ID NO: 87487 - DNA, 20 bp, synthetic construct
  misc_feature 1..20: note = CRISPR gRNA sequence
  source 1..20: mol_type = other DNA
gacatggggctcaggagggg

SEQ ID NO: 87488 - DNA, 20 bp, synthetic construct
  misc_feature 1..20: note = CRISPR gRNA sequence
  source 1..20: mol_type = other DNA
acatggggctcaggagggga

SEQ ID NO: 87489 - DNA, 20 bp, synthetic construct
  misc_feature 1..20: note = CRISPR gRNA sequence
  source 1..20: mol_type = other DNA
ctcaggaggggaaggcaact

SEQ ID NO: 87490 - DNA, 20 bp, synthetic construct
  misc_feature 1..20: note = CRISPR gRNA sequence
  source 1..20: mol_type = other DNA
ggaggggaaggcaactcagc

SEQ ID NO: 87491 - DNA, 20 bp, synthetic construct
  misc_feature 1..20: note = CRISPR gRNA sequence
  source 1..20: mol_type = other DNA
aggggaaggcaactcagctg

SEQ ID NO: 87492 - DNA, 20 bp, synthetic construct
  misc_feature 1..20: note = CRISPR gRNA sequence
  source 1..20: mol_type = other DNA
ggggaaggcaactcagctgg

SEQ ID NO: 87493 - DNA, 20 bp, synthetic construct
  misc_feature 1..20: note = CRISPR gRNA sequence
  source 1..20: mol_type = other DNA
gggaaggcaactcagctgga

SEQ ID NO: 87494 - DNA, 20 bp, synthetic construct
  misc_feature 1..20: note = CRISPR gRNA sequence
  source 1..20: mol_type = other DNA
ggaaggcaactcagctggag

SEQ ID NO: 87495 - DNA, 20 bp, synthetic construct
  misc_feature 1..20: note = CRISPR gRNA sequence
  source 1..20: mol_type = other DNA
aggcaactcagctggagggg

SEQ ID NO: 87496 - DNA, 20 bp, synthetic construct
  misc_feature 1..20: note = CRISPR gRNA sequence
  source 1..20: mol_type = other DNA
gcaactcagctggaggggca

SEQ ID NO: 87497 - DNA, 20 bp, synthetic construct
  misc_feature 1..20: note = CRISPR gRNA sequence
  source 1..20: mol_type = other DNA
aactcagctggaggggcaga

SEQ ID NO: 87498 - DNA, 20 bp, synthetic construct
  misc_feature 1..20: note = CRISPR gRNA sequence
  source 1..20: mol_type = other DNA
actcagctggaggggcagag

SEQ ID NO: 87499 - DNA, 20 bp, synthetic construct
  misc_feature 1..20: note = CRISPR gRNA sequence
  source 1..20: mol_type = other DNA
agctggaggggcagagaggc

SEQ ID NO: 87500 - DNA, 20 bp, synthetic construct
  misc_feature 1..20: note = CRISPR gRNA sequence
  source 1..20: mol_type = other DNA
gctggaggggcagagaggcc

SEQ ID NO: 87501 - DNA, 20 bp, synthetic construct
  misc_feature 1..20: note = CRISPR gRNA sequence
  source 1..20: mol_type = other DNA
ctggaggggcagagaggcca

SEQ ID NO: 87502 - DNA, 20 bp, synthetic construct
  misc_feature 1..20: note = CRISPR gRNA sequence
  source 1..20: mol_type = other DNA
ggcagagaggccagggccaa

SEQ ID NO: 87503 - DNA, 20 bp, synthetic construct
  misc_feature 1..20: note = CRISPR gRNA sequence
  source 1..20: mol_type = other DNA
gcagagaggccagggccaat

SEQ ID NO: 87504 - DNA, 20 bp, synthetic construct
  misc_feature 1..20: note = CRISPR gRNA sequence
  source 1..20: mol_type = other DNA
agagaggccagggccaatgg

SEQ ID NO: 87505 - DNA, 20 bp, synthetic construct
  misc_feature 1..20: note = CRISPR gRNA sequence
  source 1..20: mol_type = other DNA
agaggccagggccaatggga

SEQ ID NO: 87506 - DNA, 20 bp, synthetic construct
  misc_feature 1..20: note = CRISPR gRNA sequence
  source 1..20: mol_type = other DNA
gaggccagggccaatgggag

SEQ ID NO: 87507 - DNA, 20 bp, synthetic construct
  misc_feature 1..20: note = CRISPR gRNA sequence
  source 1..20: mol_type = other DNA
ggccaatgggagaggctgaa

SEQ ID NO: 87508 - DNA, 20 bp, synthetic construct
  misc_feature 1..20: note = CRISPR gRNA sequence
  source 1..20: mol_type = other DNA
gccaatgggagaggctgaaa

SEQ ID NO: 87509 - DNA, 20 bp, synthetic construct
  misc_feature 1..20: note = CRISPR gRNA sequence
  source 1..20: mol_type = other DNA
ccaatgggagaggctgaaaa

SEQ ID NO: 87510 - DNA, 20 bp, synthetic construct
  misc_feature 1..20: note = CRISPR gRNA sequence
  source 1..20: mol_type = other DNA
caatgggagaggctgaaaag

SEQ ID NO: 87511 - DNA, 20 bp, synthetic construct
  misc_feature 1..20: note = CRISPR gRNA sequence
  source 1..20: mol_type = other DNA
aatgggagaggctgaaaagg

SEQ ID NO: 87512 - DNA, 20 bp, synthetic construct
  misc_feature 1..20: note = CRISPR gRNA sequence
  source 1..20: mol_type = other DNA
gggagaggctgaaaaggggg

SEQ ID NO: 87513 - DNA, 20 bp, synthetic construct
  misc_feature 1..20: note = CRISPR gRNA sequence
  source 1..20: mol_type = other DNA
aaaagggggcagtacttgcc

SEQ ID NO: 87514 - DNA, 20 bp, synthetic construct
  misc_feature 1..20: note = CRISPR gRNA sequence
  source 1..20: mol_type = other DNA
aaagggggcagtacttgccc

SEQ ID NO: 87515 - DNA, 20 bp, synthetic construct
  misc_feature 1..20: note = CRISPR gRNA sequence
  source 1..20: mol_type = other DNA
aagggggcagtacttgccca

SEQ ID NO: 87516 - DNA, 20 bp, synthetic construct
  misc_feature 1..20: note = CRISPR gRNA sequence
  source 1..20: mol_type = other DNA
gggcagtacttgcccagggt

SEQ ID NO: 87517 - DNA, 20 bp, synthetic construct
  misc_feature 1..20: note = CRISPR gRNA sequence
  source 1..20: mol_type = other DNA
ggcagtacttgcccagggtc

SEQ ID NO: 87518 - DNA, 20 bp, synthetic construct
  misc_feature 1..20: note = CRISPR gRNA sequence
  source 1..20: mol_type = other DNA
gcagtacttgcccagggtca

SEQ ID NO: 87519 - DNA, 20 bp, synthetic construct
  misc_feature 1..20: note = CRISPR gRNA sequence
  source 1..20: mol_type = other DNA
agtacttgcccagggtcagg

SEQ ID NO: 87520 - DNA, 20 bp, synthetic construct
  misc_feature 1..20: note = CRISPR gRNA sequence
  source 1..20: mol_type = other DNA
cttgcccagggtcagggaga

SEQ ID NO: 87521 - DNA, 20 bp, synthetic construct
  misc_feature 1..20: note = CRISPR gRNA sequence
  source 1..20: mol_type = other DNA
gggagatggtactgtttcca

SEQ ID NO: 87522 - DNA, 20 bp, synthetic construct
  misc_feature 1..20: note = CRISPR gRNA sequence
  source 1..20: mol_type = other DNA
ggagatggtactgtttccaa

SEQ ID NO: 87523 - DNA, 20 bp, synthetic construct
  misc_feature 1..20: note = CRISPR gRNA sequence
  source 1..20: mol_type = other DNA
agatggtactgtttccaaag

SEQ ID NO: 87524 - DNA, 20 bp, synthetic construct
  misc_feature 1..20: note = CRISPR gRNA sequence
  source 1..20: mol_type = other DNA
gatggtactgtttccaaagg

SEQ ID NO: 87525 - DNA, 20 bp, synthetic construct
  misc_feature 1..20: note = CRISPR gRNA sequence
  source 1..20: mol_type = other DNA
ggtactgtttccaaaggagg

SEQ ID NO: 87526 - DNA, 20 bp, synthetic construct
  misc_feature 1..20: note = CRISPR gRNA sequence
  source 1..20: mol_type = other DNA
gtactgtttccaaaggagga

SEQ ID NO: 87527 - DNA, 20 bp, synthetic construct
  misc_feature 1..20: note = CRISPR gRNA sequence
  source 1..20: mol_type = other DNA
tactgtttccaaaggaggaa

SEQ ID NO: 87528 - DNA, 20 bp, synthetic construct
  misc_feature 1..20: note = CRISPR gRNA sequence
  source 1..20: mol_type = other DNA
actgtttccaaaggaggaag

SEQ ID NO: 87529 - DNA, 20 bp, synthetic construct
  misc_feature 1..20: note = CRISPR gRNA sequence
  source 1..20: mol_type = other DNA
tccaaaggaggaaggggccc

SEQ ID NO: 87530 - DNA, 20 bp, synthetic construct
  misc_feature 1..20: note = CRISPR gRNA sequence
  source 1..20: mol_type = other DNA
gaggaaggggccccggttcc

SEQ ID NO: 87531 - DNA, 20 bp, synthetic construct
  misc_feature 1..20: note = CRISPR gRNA sequence
  source 1..20: mol_type = other DNA
ccccggttcccagcatacca

SEQ ID NO: 87532 - DNA, 20 bp, synthetic construct
  misc_feature 1..20: note = CRISPR gRNA sequence
  source 1..20: mol_type = other DNA
cggttcccagcataccaaag

SEQ ID NO: 87533 - DNA, 20 bp, synthetic construct
  misc_feature 1..20: note = CRISPR gRNA sequence
  source 1..20: mol_type = other DNA
ttcccagcataccaaagaag

SEQ ID NO: 87534 - DNA, 20 bp, synthetic construct
  misc_feature 1..20: note = CRISPR gRNA sequence
  source 1..20: mol_type = other DNA
ccagcataccaaagaagcag

SEQ ID NO: 87535 - DNA, 20 bp, synthetic construct
  misc_feature 1..20: note = CRISPR gRNA sequence
  source 1..20: mol_type = other DNA
agcagaagataaaattccct

SEQ ID NO: 87536 - DNA, 20 bp, synthetic construct
  misc_feature 1..20: note = CRISPR gRNA sequence
  source 1..20: mol_type = other DNA
aattcccttggtcccctcaa

SEQ ID NO: 87537 - DNA, 20 bp, synthetic construct
  misc_feature 1..20: note = CRISPR gRNA sequence
  source 1..20: mol_type = other DNA
cccttggtcccctcaaaagt

SEQ ID NO: 87538 - DNA, 20 bp, synthetic construct
  misc_feature 1..20: note = CRISPR gRNA sequence
  source 1..20: mol_type = other DNA
cctcaaaagtgagtgtcatc

SEQ ID NO: 87539 - DNA, 20 bp, synthetic construct
  misc_feature 1..20: note = CRISPR gRNA sequence
  source 1..20: mol_type = other DNA
ctcaaaagtgagtgtcatca

SEQ ID NO: 87540 - DNA, 20 bp, synthetic construct
  misc_feature 1..20: note = CRISPR gRNA sequence
  source 1..20: mol_type = other DNA
tcaaaagtgagtgtcatcaa

SEQ ID NO: 87541 - DNA, 20 bp, synthetic construct
  misc_feature 1..20: note = CRISPR gRNA sequence
  source 1..20: mol_type = other DNA
aaagtgagtgtcatcaaggg

SEQ ID NO: 87542 - DNA, 20 bp, synthetic construct
  misc_feature 1..20: note = CRISPR gRNA sequence
  source 1..20: mol_type = other DNA
gtgagtgtcatcaagggcag

SEQ ID NO: 87543 - DNA, 20 bp, synthetic construct
  misc_feature 1..20: note = CRISPR gRNA sequence
  source 1..20: mol_type = other DNA
agtgtcatcaagggcagcag

SEQ ID NO: 87544 - DNA, 20 bp, synthetic construct
  misc_feature 1..20: note = CRISPR gRNA sequence
  source 1..20: mol_type = other DNA
tcaagggcagcagaagccaa

SEQ ID NO: 87545 - DNA, 20 bp, synthetic construct
  misc_feature 1..20: note = CRISPR gRNA sequence
  source 1..20: mol_type = other DNA
caagggcagcagaagccaaa

SEQ ID NO: 87546 - DNA, 20 bp, synthetic construct
  misc_feature 1..20: note = CRISPR gRNA sequence
  source 1..20: mol_type = other DNA
agggcagcagaagccaaaag

SEQ ID NO: 87547 - DNA, 20 bp, synthetic construct
  misc_feature 1..20: note = CRISPR gRNA sequence
  source 1..20: mol_type = other DNA
gggcagcagaagccaaaagg

SEQ ID NO: 87548 - DNA, 20 bp, synthetic construct
  misc_feature 1..20: note = CRISPR gRNA sequence
  source 1..20: mol_type = other DNA
ccaaaaggaggcttttcctt

SEQ ID NO: 87549 - DNA, 20 bp, synthetic construct
  misc_feature 1..20: note = CRISPR gRNA sequence
  source 1..20: mol_type = other DNA
aggaggcttttcctttggca

SEQ ID NO: 87550 - DNA, 20 bp, synthetic construct
  misc_feature 1..20: note = CRISPR gRNA sequence
  source 1..20: mol_type = other DNA
ggaggcttttcctttggcaa

SEQ ID NO: 87551 - DNA, 20 bp, synthetic construct
  misc_feature 1..20: note = CRISPR gRNA sequence
  source 1..20: mol_type = other DNA
gaggcttttcctttggcaaa

SEQ ID NO: 87552 - DNA, 20 bp, synthetic construct
  misc_feature 1..20: note = CRISPR gRNA sequence
  source 1..20: mol_type = other DNA
ggcttttcctttggcaaagg

SEQ ID NO: 87553 - DNA, 20 bp, synthetic construct
  misc_feature 1..20: note = CRISPR gRNA sequence
  source 1..20: mol_type = other DNA
cttttcctttggcaaaggga

SEQ ID NO: 87554 - DNA, 20 bp, synthetic construct
  misc_feature 1..20: note = CRISPR gRNA sequence
  source 1..20: mol_type = other DNA
ttttcctttggcaaagggag

SEQ ID NO: 87555 - DNA, 20 bp, synthetic construct
  misc_feature 1..20: note = CRISPR gRNA sequence
  source 1..20: mol_type = other DNA
tcctttggcaaagggagagg

SEQ ID NO: 87556 - DNA, 20 bp, synthetic construct
  misc_feature 1..20: note = CRISPR gRNA sequence
  source 1..20: mol_type = other DNA
gagaggtagacactgcacca

SEQ ID NO: 87557 - DNA, 20 bp, synthetic construct
  misc_feature 1..20: note = CRISPR gRNA sequence
  source 1..20: mol_type = other DNA
agaggtagacactgcaccac

SEQ ID NO: 87558 - DNA, 20 bp, synthetic construct
  misc_feature 1..20: note = CRISPR gRNA sequence
  source 1..20: mol_type = other DNA
gaggtagacactgcaccaca

SEQ ID NO: 87559 - DNA, 20 bp, synthetic construct
  misc_feature 1..20: note = CRISPR gRNA sequence
  source 1..20: mol_type = other DNA
cactgcaccacagggtaata

SEQ ID NO: 87560 - DNA, 20 bp, synthetic construct
  misc_feature 1..20: note = CRISPR gRNA sequence
  source 1..20: mol_type = other DNA
cacagggtaataaagactta

SEQ ID NO: 87561 - DNA, 20 bp, synthetic construct
  misc_feature 1..20: note = CRISPR gRNA sequence
  source 1..20: mol_type = other DNA
acagggtaataaagacttaa

SEQ ID NO: 87562 - DNA, 20 bp, synthetic construct
  misc_feature 1..20: note = CRISPR gRNA sequence
  source 1..20: mol_type = other DNA
agggtaataaagacttaaag

SEQ ID NO: 87563 - DNA, 20 bp, synthetic construct
  misc_feature 1..20: note = CRISPR gRNA sequence
  source 1..20: mol_type = other DNA
ttaaaggagcatgtgcttca

SEQ ID NO: 87564 - DNA, 20 bp, synthetic construct
  misc_feature 1..20: note = CRISPR gRNA sequence
  source 1..20: mol_type = other DNA
tgcttcaaagttccttatcc

SEQ ID NO: 87565 - DNA, 20 bp, synthetic construct
  misc_feature 1..20: note = CRISPR gRNA sequence
  source 1..20: mol_type = other DNA
gcttcaaagttccttatccc

SEQ ID NO: 87566 - DNA, 20 bp, synthetic construct
  misc_feature 1..20: note = CRISPR gRNA sequence
  source 1..20: mol_type = other DNA
ttcaaagttccttatcccag

SEQ ID NO: 87567 - DNA, 20 bp, synthetic construct
  misc_feature 1..20: note = CRISPR gRNA sequence
  source 1..20: mol_type = other DNA
ttccttatcccaggagcata

SEQ ID NO: 87568 - DNA, 20 bp, synthetic construct
  misc_feature 1..20: note = CRISPR gRNA sequence
  source 1..20: mol_type = other DNA
ccaggagcataaagacccaa

SEQ ID NO: 87569 - DNA, 20 bp, synthetic construct
  misc_feature 1..20: note = CRISPR gRNA sequence
  source 1..20: mol_type = other DNA
aaagcaacacccccatgata

SEQ ID NO: 87570 - DNA, 20 bp, synthetic construct
  misc_feature 1..20: note = CRISPR gRNA sequence
  source 1..20: mol_type = other DNA
aagcaacacccccatgatac

SEQ ID NO: 87571 - DNA, 20 bp, synthetic construct
  misc_feature 1..20: note = CRISPR gRNA sequence
  source 1..20: mol_type = other DNA
acccccatgatacaggtctg

SEQ ID NO: 87572 - DNA, 20 bp, synthetic construct
  misc_feature 1..20: note = CRISPR gRNA sequence
  source 1..20: mol_type = other DNA
cccccatgatacaggtctgt

SEQ ID NO: 87573 - DNA, 20 bp, synthetic construct
  misc_feature 1..20: note = CRISPR gRNA sequence
  source 1..20: mol_type = other DNA
ccccatgatacaggtctgtg

SEQ ID NO: 87574 - DNA, 20 bp, synthetic construct
  misc_feature 1..20: note = CRISPR gRNA sequence
  source 1..20: mol_type = other DNA
catgatacaggtctgtgggg

SEQ ID NO: 87575 - DNA, 20 bp, synthetic construct
  misc_feature 1..20: note = CRISPR gRNA sequence
  source 1..20: mol_type = other DNA
tgatacaggtctgtggggaa

SEQ ID NO: 87576 - DNA, 20 bp, synthetic construct
  misc_feature 1..20: note = CRISPR gRNA sequence
  source 1..20: mol_type = other DNA
atccctacgttaactttgcc

SEQ ID NO: 87577 - DNA, 20 bp, synthetic construct
  misc_feature 1..20: note = CRISPR gRNA sequence
  source 1..20: mol_type = other DNA
cctacgttaactttgcctag

SEQ ID NO: 87578 - DNA, 20 bp, synthetic construct
  misc_feature 1..20: note = CRISPR gRNA sequence
  source 1..20: mol_type = other DNA
tacgttaactttgcctagta

SEQ ID NO: 87579 - DNA, 20 bp, synthetic construct
  misc_feature 1..20: note = CRISPR gRNA sequence
  source 1..20: mol_type = other DNA
acgttaactttgcctagtag

SEQ ID NO: 87580 - DNA, 20 bp, synthetic construct
  misc_feature 1..20: note = CRISPR gRNA sequence
  source 1..20: mol_type = other DNA
ctttgcacttgcttctcatt

SEQ ID NO: 87581 - DNA, 20 bp, synthetic construct
  misc_feature 1..20: note = CRISPR gRNA sequence
  source 1..20: mol_type = other DNA
catttggctattcttttcct

SEQ ID NO: 87582 - DNA, 20 bp, synthetic construct
  misc_feature 1..20: note = CRISPR gRNA sequence
  source 1..20: mol_type = other DNA
atttggctattcttttccta

SEQ ID NO: 87583 - DNA, 20 bp, synthetic construct
  misc_feature 1..20: note = CRISPR gRNA sequence
  source 1..20: mol_type = other DNA
tggctattcttttcctaagg

SEQ ID NO: 87584 - DNA, 20 bp, synthetic construct
  misc_feature 1..20: note = CRISPR gRNA sequence
  source 1..20: mol_type = other DNA
gaagtccattctcctctgta

SEQ ID NO: 87585 - DNA, 20 bp, synthetic construct
  misc_feature 1..20: note = CRISPR gRNA sequence
  source 1..20: mol_type = other DNA
tccattctcctctgtacaga

SEQ ID NO: 87586 - DNA, 20 bp, synthetic construct
  misc_feature 1..20: note = CRISPR gRNA sequence
  source 1..20: mol_type = other DNA
tctcctctgtacagacagct

SEQ ID NO: 87587 - DNA, 20 bp, synthetic construct
  misc_feature 1..20: note = CRISPR gRNA sequence
  source 1..20: mol_type = other DNA
gtacagacagctgagtcacc

SEQ ID NO: 87588 - DNA, 20 bp, synthetic construct
  misc_feature 1..20: note = CRISPR gRNA sequence
  source 1..20: mol_type = other DNA
gctgagtcacccagtctact

SEQ ID NO: 87589 - DNA, 20 bp, synthetic construct
  misc_feature 1..20: note = CRISPR gRNA sequence
  source 1..20: mol_type = other DNA
cacccagtctacttagtacc

SEQ ID NO: 87590 - DNA, 20 bp, synthetic construct
  misc_feature 1..20: note = CRISPR gRNA sequence
  source 1..20: mol_type = other DNA
gttgctgcctctgacctttt

SEQ ID NO: 87591 - DNA, 20 bp, synthetic construct
  misc_feature 1..20: note = CRISPR gRNA sequence
  source 1..20: mol_type = other DNA
accttttcagcttgataccc

SEQ ID NO: 87592 - DNA, 20 bp, synthetic construct
  misc_feature 1..20: note = CRISPR gRNA sequence
  source 1..20: mol_type = other DNA
ccttttcagcttgataccct

SEQ ID NO: 87593 - DNA, 20 bp, synthetic construct
  misc_feature 1..20: note = CRISPR gRNA sequence
  source 1..20: mol_type = other DNA
cagcttgataccctgggctt

SEQ ID NO: 87594 - DNA, 20 bp, synthetic construct
  misc_feature 1..20: note = CRISPR gRNA sequence
  source 1..20: mol_type = other DNA
tagtgtaaccaataaatctg

SEQ ID NO: 87595 - DNA, 20 bp, synthetic construct
  misc_feature 1..20: note = CRISPR gRNA sequence
  source 1..20: mol_type = other DNA
gtattccctgtgctatcctg

SEQ ID NO: 87596 - DNA, 20 bp, synthetic construct
  misc_feature 1..20: note = CRISPR gRNA sequence
  source 1..20: mol_type = other DNA
tattccctgtgctatcctgt

SEQ ID NO: 87597 - DNA, 20 bp, synthetic construct
  misc_feature 1..20: note = CRISPR gRNA sequence
  source 1..20: mol_type = other DNA
tccctgtgctatcctgtggg

SEQ ID NO: 87598 - DNA, 20 bp, synthetic construct
  misc_feature 1..20: note = CRISPR gRNA sequence
  source 1..20: mol_type = other DNA
ccctgtgctatcctgtggga

SEQ ID NO: 87599 - DNA, 20 bp, synthetic construct
  misc_feature 1..20: note = CRISPR gRNA sequence
  source 1..20: mol_type = other DNA
tgtgctatcctgtgggaagg

SEQ ID NO: 87600 - DNA, 20 bp, synthetic construct
  misc_feature 1..20: note = CRISPR gRNA sequence
  source 1..20: mol_type = other DNA
gtgctatcctgtgggaaggt

SEQ ID NO: 87601 - DNA, 20 bp, synthetic construct
  misc_feature 1..20: note = CRISPR gRNA sequence
  source 1..20: mol_type = other DNA
atcctgtgggaaggtaggaa

SEQ ID NO: 87602 - DNA, 20 bp, synthetic construct
  misc_feature 1..20: note = CRISPR gRNA sequence
  source 1..20: mol_type = other DNA
tcctgtgggaaggtaggaat

SEQ ID NO: 87603 - DNA, 20 bp, synthetic construct
  misc_feature 1..20: note = CRISPR gRNA sequence
  source 1..20: mol_type = other DNA
tgggaaggtaggaatgggct

SEQ ID NO: 87604 - DNA, 20 bp, synthetic construct
  misc_feature 1..20: note = CRISPR gRNA sequence
  source 1..20: mol_type = other DNA
ggctaagtatgatgaatata

SEQ ID NO: 87605 - DNA, 20 bp, synthetic construct
  misc_feature 1..20: note = CRISPR gRNA sequence
  source 1..20: mol_type = other DNA
gctaagtatgatgaatatat

SEQ ID NO: 87606 - DNA, 20 bp, synthetic construct
  misc_feature 1..20: note = CRISPR gRNA sequence
  source 1..20: mol_type = other DNA
agtatgatgaatatataggt

SEQ ID NO: 87607 - DNA, 20 bp, synthetic construct
  misc_feature 1..20: note = CRISPR gRNA sequence
  source 1..20: mol_type = other DNA
gtatgatgaatatataggtt

SEQ ID NO: 87608 - DNA, 20 bp, synthetic construct
  misc_feature 1..20: note = CRISPR gRNA sequence
  source 1..20: mol_type = other DNA
tatgatgaatatataggtta

SEQ ID NO: 87609 - DNA, 20 bp, synthetic construct
  misc_feature 1..20: note = CRISPR gRNA sequence
  source 1..20: mol_type = other DNA
tatataggttagggatcttt

SEQ ID NO: 87610 - DNA, 20 bp, synthetic construct
  misc_feature 1..20: note = CRISPR gRNA sequence
  source 1..20: mol_type = other DNA
gatcttttggttttaaatca

SEQ ID NO: 87611 - DNA, 20 bp, synthetic construct
  misc_feature 1..20: note = CRISPR gRNA sequence
  source 1..20: mol_type = other DNA
acagaaaacctaattcaaac

SEQ ID NO: 87612 - DNA, 20 bp, synthetic construct
  misc_feature 1..20: note = CRISPR gRNA sequence
  source 1..20: mol_type = other DNA
tcaaactggcttaaaataaa

SEQ ID NO: 87613 - DNA, 20 bp, synthetic construct
  misc_feature 1..20: note = CRISPR gRNA sequence
  source 1..20: mol_type = other DNA
caaactggcttaaaataaaa

SEQ ID NO: 87614 - DNA, 20 bp, synthetic construct
  misc_feature 1..20: note = CRISPR gRNA sequence
  source 1..20: mol_type = other DNA
ttaaaataaaaaggatttat

SEQ ID NO: 87615 - DNA, 20 bp, synthetic construct
  misc_feature 1..20: note = CRISPR gRNA sequence
  source 1..20: mol_type = other DNA
gatttattggttcatgtaac

SEQ ID NO: 87616 - DNA, 20 bp, synthetic construct
  misc_feature 1..20: note = CRISPR gRNA sequence
  source 1..20: mol_type = other DNA
tattggttcatgtaactaga

SEQ ID NO: 87617 - DNA, 20 bp, synthetic construct
  misc_feature 1..20: note = CRISPR gRNA sequence
  source 1..20: mol_type = other DNA
tcatgtaactagaaagtcca

SEQ ID NO: 87618 - DNA, 20 bp, synthetic construct
  misc_feature 1..20: note = CRISPR gRNA sequence
  source 1..20: mol_type = other DNA
catgtaactagaaagtccat

SEQ ID NO: 87619 - DNA, 20 bp, synthetic construct
  misc_feature 1..20: note = CRISPR gRNA sequence
  source 1..20: mol_type = other DNA
gtaactagaaagtccatagg

SEQ ID NO: 87620 - DNA, 20 bp, synthetic construct
  misc_feature 1..20: note = CRISPR gRNA sequence
  source 1..20: mol_type = other DNA
agaaagtccataggtagtgc

SEQ ID NO: 87621 - DNA, 20 bp, synthetic construct
  misc_feature 1..20: note = CRISPR gRNA sequence
  source 1..20: mol_type = other DNA
tccataggtagtgctggctc

SEQ ID NO: 87622 - DNA, 20 bp, synthetic construct
  misc_feature 1..20: note = CRISPR gRNA sequence
  source 1..20: mol_type = other DNA
ccataggtagtgctggctcc

SEQ ID NO: 87623 - DNA, 20 bp, synthetic construct
  misc_feature 1..20: note = CRISPR gRNA sequence
  source 1..20: mol_type = other DNA
ggtagtgctggctccaggtg

SEQ ID NO: 87624 - DNA, 20 bp, synthetic construct
  misc_feature 1..20: note = CRISPR gRNA sequence
  source 1..20: mol_type = other DNA
ctccaggtgaagacttgacc

SEQ ID NO: 87625 - DNA, 20 bp, synthetic construct
  misc_feature 1..20: note = CRISPR gRNA sequence
  source 1..20: mol_type = other DNA
caggtgaagacttgacccag

SEQ ID NO: 87626 - DNA, 20 bp, synthetic construct
  misc_feature 1..20: note = CRISPR gRNA sequence
  source 1..20: mol_type = other DNA
gaagacttgacccagtagtt

SEQ ID NO: 87627 - DNA, 20 bp, synthetic construct
  misc_feature 1..20: note = CRISPR gRNA sequence
  source 1..20: mol_type = other DNA
ttcagtatgtctctaaatac

SEQ ID NO: 87628 - DNA, 20 bp, synthetic construct
  misc_feature 1..20: note = CRISPR gRNA sequence
  source 1..20: mol_type = other DNA
tctcactgttgcatcttctg

SEQ ID NO: 87629 - DNA, 20 bp, synthetic construct
  misc_feature 1..20: note = CRISPR gRNA sequence
  source 1..20: mol_type = other DNA
ctcactgttgcatcttctgt

SEQ ID NO: 87630 - DNA, 20 bp, synthetic construct
  misc_feature 1..20: note = CRISPR gRNA sequence
  source 1..20: mol_type = other DNA
catcttctgtaggaccattt

SEQ ID NO: 87631 - DNA, 20 bp, synthetic construct
  misc_feature 1..20: note = CRISPR gRNA sequence
  source 1..20: mol_type = other DNA
tctgtaggaccatttaagtc

SEQ ID NO: 87632 - DNA, 20 bp, synthetic construct
  misc_feature 1..20: note = CRISPR gRNA sequence
  source 1..20: mol_type = other DNA
ctgtaggaccatttaagtct

SEQ ID NO: 87633 - DNA, 20 bp, synthetic construct
  misc_feature 1..20: note = CRISPR gRNA sequence
  source 1..20: mol_type = other DNA
tttaagtctgggccacttaa

SEQ ID NO: 87634 - DNA, 20 bp, synthetic construct
  misc_feature 1..20: note = CRISPR gRNA sequence
  source 1..20: mol_type = other DNA
ctgggccacttaatggctgc

SEQ ID NO: 87635 - DNA, 20 bp, synthetic construct
  misc_feature 1..20: note = CRISPR gRNA sequence
  source 1..20: mol_type = other DNA
taatggctgccagcattcct

SEQ ID NO: 87636 - DNA, 20 bp, synthetic construct
  misc_feature 1..20: note = CRISPR gRNA sequence
  source 1..20: mol_type = other DNA
tttccccatttatgtccaat

SEQ ID NO: 87637 - DNA, 20 bp, synthetic construct
  misc_feature 1..20: note = CRISPR gRNA sequence
  source 1..20: mol_type = other DNA
catttatgtccaatcagaaa

SEQ ID NO: 87638 - DNA, 20 bp, synthetic construct
  misc_feature 1..20: note = CRISPR gRNA sequence
  source 1..20: mol_type = other DNA
ttatgtccaatcagaaaaag

SEQ ID NO: 87639 - DNA, 20 bp, synthetic construct
  misc_feature 1..20: note = CRISPR gRNA sequence
  source 1..20: mol_type = other DNA
tatgtccaatcagaaaaaga

SEQ ID NO: 87640 - DNA, 20 bp, synthetic construct
  misc_feature 1..20: note = CRISPR gRNA sequence
  source 1..20: mol_type = other DNA
aaaagaaggcatctttgtac

SEQ ID NO: 87641 - DNA, 20 bp, synthetic construct
  misc_feature 1..20: note = CRISPR gRNA sequence
  source 1..20: mol_type = other DNA
catctttgtaccagaaatct

SEQ ID NO: 87642 - DNA, 20 bp, synthetic construct
  misc_feature 1..20: note = CRISPR gRNA sequence
  source 1..20: mol_type = other DNA
tgtaccagaaatctcagcaa

SEQ ID NO: 87643 - DNA, 20 bp, synthetic construct
  misc_feature 1..20: note = CRISPR gRNA sequence
  source 1..20: mol_type = other DNA
gccctaatattcacactgat

SEQ ID NO: 87644 - DNA, 20 bp, synthetic construct
  misc_feature 1..20: note = CRISPR gRNA sequence
  source 1..20: mol_type = other DNA
ccctaatattcacactgatt

SEQ ID NO: 87645 - DNA, 20 bp, synthetic construct
  misc_feature 1..20: note = CRISPR gRNA sequence
  source 1..20: mol_type = other DNA
atattcacactgattaggcc

SEQ ID NO: 87646 - DNA, 20 bp, synthetic construct
  misc_feature 1..20: note = CRISPR gRNA sequence
  source 1..20: mol_type = other DNA
tattcacactgattaggcct

SEQ ID NO: 87647 - DNA, 20 bp, synthetic construct
  misc_feature 1..20: note = CRISPR gRNA sequence
  source 1..20: mol_type = other DNA
tccaccctgaccaatcactg

SEQ ID NO: 87648 - DNA, 20 bp, synthetic construct
  misc_feature 1..20: note = CRISPR gRNA sequence
  source 1..20: mol_type = other DNA
ccctgaccaatcactgtggc

SEQ ID NO: 87649 - DNA, 20 bp, synthetic construct
  misc_feature 1..20: note = CRISPR gRNA sequence
  source 1..20: mol_type = other DNA
cctgaccaatcactgtggcc

SEQ ID NO: 87650 - DNA, 20 bp, synthetic construct
  misc_feature 1..20: note = CRISPR gRNA sequence
  source 1..20: mol_type = other DNA
tgaccaatcactgtggccag

SEQ ID NO: 87651 - DNA, 20 bp, synthetic construct
  misc_feature 1..20: note = CRISPR gRNA sequence
  source 1..20: mol_type = other DNA
gaccaatcactgtggccagg

SEQ ID NO: 87652 - DNA, 20 bp, synthetic construct
  misc_feature 1..20: note = CRISPR gRNA sequence
  source 1..20: mol_type = other DNA
aatttgcttattctatatca

SEQ ID NO: 87653 - DNA, 20 bp, synthetic construct
  misc_feature 1..20: note = CRISPR gRNA sequence
  source 1..20: mol_type = other DNA
tatatcatggacaacacctt

SEQ ID NO: 87654 - DNA, 20 bp, synthetic construct
  misc_feature 1..20: note = CRISPR gRNA sequence
  source 1..20: mol_type = other DNA
atatcatggacaacaccttt

SEQ ID NO: 87655 - DNA, 20 bp, synthetic construct
  misc_feature 1..20: note = CRISPR gRNA sequence
  source 1..20: mol_type = other DNA
tatcatggacaacacctttg

SEQ ID NO: 87656 - DNA, 20 bp, synthetic construct
  misc_feature 1..20: note = CRISPR gRNA sequence
  source 1..20: mol_type = other DNA
tggacaacacctttggggaa

SEQ ID NO: 87657 - DNA, 20 bp, synthetic construct
  misc_feature 1..20: note = CRISPR gRNA sequence
  source 1..20: mol_type = other DNA
ggacaacacctttggggaaa

SEQ ID NO: 87658 - DNA, 20 bp, synthetic construct
  misc_feature 1..20: note = CRISPR gRNA sequence
  source 1..20: mol_type = other DNA
gacaacacctttggggaaaa

SEQ ID NO: 87659 - DNA, 20 bp, synthetic construct
  misc_feature 1..20: note = CRISPR gRNA sequence
  source 1..20: mol_type = other DNA
aacacctttggggaaaaggg

SEQ ID NO: 87660 - DNA, 20 bp, synthetic construct
  misc_feature 1..20: note = CRISPR gRNA sequence
  source 1..20: mol_type = other DNA
acacctttggggaaaagggt

SEQ ID NO: 87661 - DNA, 20 bp, synthetic construct
  misc_feature 1..20: note = CRISPR gRNA sequence
  source 1..20: mol_type = other DNA
cacctttggggaaaagggtg

SEQ ID NO: 87662 - DNA, 20 bp, synthetic construct
  misc_feature 1..20: note = CRISPR gRNA sequence
  source 1..20: mol_type = other DNA
acctttggggaaaagggtgg

SEQ ID NO: 87663 - DNA, 20 bp, synthetic construct
  misc_feature 1..20: note = CRISPR gRNA sequence
  source 1..20: mol_type = other DNA
ttggggaaaagggtgggggt

SEQ ID NO: 87664 - DNA, 20 bp, synthetic construct
  misc_feature 1..20: note = CRISPR gRNA sequence
  source 1..20: mol_type = other DNA
tcagcctccccaaaatcaca

SEQ ID NO: 87665 - DNA, 20 bp, synthetic construct
  misc_feature 1..20: note = CRISPR gRNA sequence
  source 1..20: mol_type = other DNA
caaaatcacatggattcccc

SEQ ID NO: 87666 - DNA, 20 bp, synthetic construct
  misc_feature 1..20: note = CRISPR gRNA sequence
  source 1..20: mol_type = other DNA
aatcacatggattccccaag

SEQ ID NO: 87667 - DNA, 20 bp, synthetic construct
  misc_feature 1..20: note = CRISPR gRNA sequence
  source 1..20: mol_type = other DNA
tggattccccaagtggaaac

SEQ ID NO: 87668 - DNA, 20 bp, synthetic construct
  misc_feature 1..20: note = CRISPR gRNA sequence
  source 1..20: mol_type = other DNA
ggattccccaagtggaaact

SEQ ID NO: 87669 - DNA, 20 bp, synthetic construct
  misc_feature 1..20: note = CRISPR gRNA sequence
  source 1..20: mol_type = other DNA
attccccaagtggaaactag

SEQ ID NO: 87670 - DNA, 20 bp, synthetic construct
  misc_feature 1..20: note = CRISPR gRNA sequence
  source 1..20: mol_type = other DNA
ccccaagtggaaactaggag

SEQ ID NO: 87671 - DNA, 20 bp, synthetic construct
  misc_feature 1..20: note = CRISPR gRNA sequence
  source 1..20: mol_type = other DNA
cccaagtggaaactaggagc

SEQ ID NO: 87672 - DNA, 20 bp, synthetic construct
  misc_feature 1..20: note = CRISPR gRNA sequence
  source 1..20: mol_type = other DNA
ccaagtggaaactaggagca

SEQ ID NO: 87673 - DNA, 20 bp, synthetic construct
  misc_feature 1..20: note = CRISPR gRNA sequence
  source 1..20: mol_type = other DNA
aagtggaaactaggagcagg

SEQ ID NO: 87674 - DNA, 20 bp, synthetic construct
  misc_feature 1..20: note = CRISPR gRNA sequence
  source 1..20: mol_type = other DNA
actaggagcagggagttgct

SEQ ID NO: 87675 - DNA, 20 bp, synthetic construct
  misc_feature 1..20: note = CRISPR gRNA sequence
  source 1..20: mol_type = other DNA
ctaggagcagggagttgctt

SEQ ID NO: 87676 - DNA, 20 bp, synthetic construct
  misc_feature 1..20: note = CRISPR gRNA sequence
  source 1..20: mol_type = other DNA
ggagcagggagttgcttggg

SEQ ID NO: 87677 - DNA, 20 bp, synthetic construct
  misc_feature 1..20: note = CRISPR gRNA sequence
  source 1..20: mol_type = other DNA
gcttgggtggccgctaacac

SEQ ID NO: 87678 - DNA, 20 bp, synthetic construct
  misc_feature 1..20: note = CRISPR gRNA sequence
  source 1..20: mol_type = other DNA
cttgggtggccgctaacacc

SEQ ID NO: 87679 - DNA, 20 bp, synthetic construct
  misc_feature 1..20: note = CRISPR gRNA sequence
  source 1..20: mol_type = other DNA
acaccaggctactcttattt

SEQ ID NO: 87680 - DNA, 20 bp, synthetic construct
  misc_feature 1..20: note = CRISPR gRNA sequence
  source 1..20: mol_type = other DNA
tactcttattttagcttgct

SEQ ID NO: 87681 - DNA, 20 bp, synthetic construct
  misc_feature 1..20: note = CRISPR gRNA sequence
  source 1..20: mol_type = other DNA
ttattttagcttgctaagtt

SEQ ID NO: 87682 - DNA, 20 bp, synthetic construct
  misc_feature 1..20: note = CRISPR gRNA sequence
  source 1..20: mol_type = other DNA
ttagcttgctaagttgagat

SEQ ID NO: 87683 - DNA, 20 bp, synthetic construct
  misc_feature 1..20: note = CRISPR gRNA sequence
  source 1..20: mol_type = other DNA
cttgctaagttgagatcagc

SEQ ID NO: 87684 - DNA, 20 bp, synthetic construct
  misc_feature 1..20: note = CRISPR gRNA sequence
  source 1..20: mol_type = other DNA
gacctgctttcttttctcct

SEQ ID NO: 87685 - DNA, 20 bp, synthetic construct
  misc_feature 1..20: note = CRISPR gRNA sequence
  source 1..20: mol_type = other DNA
tcttgcatttccctcaatac

SEQ ID NO: 87686 - DNA, 20 bp, synthetic construct
  misc_feature 1..20: note = CRISPR gRNA sequence
  source 1..20: mol_type = other DNA
atttccctcaatacaagctg

SEQ ID NO: 87687 - DNA, 20 bp, synthetic construct
  misc_feature 1..20: note = CRISPR gRNA sequence
  source 1..20: mol_type = other DNA
gtagcctctttcctcgtttc

SEQ ID NO: 87688 - DNA, 20 bp, synthetic construct
  misc_feature 1..20: note = CRISPR gRNA sequence
  source 1..20: mol_type = other DNA
tctttcctcgtttctagtct

SEQ ID NO: 87689 - DNA, 20 bp, synthetic construct
  misc_feature 1..20: note = CRISPR gRNA sequence
  source 1..20: mol_type = other DNA
ttcctcgtttctagtctcag

SEQ ID NO: 87690 - DNA, 20 bp, synthetic construct
  misc_feature 1..20: note = CRISPR gRNA sequence
  source 1..20: mol_type = other DNA
tcctcgtttctagtctcaga

SEQ ID NO: 87691 - DNA, 20 bp, synthetic construct
  misc_feature 1..20: note = CRISPR gRNA sequence
  source 1..20: mol_type = other DNA
tcgtttctagtctcagaagg

SEQ ID NO: 87692 - DNA, 20 bp, synthetic construct
  misc_feature 1..20: note = CRISPR gRNA sequence
  source 1..20: mol_type = other DNA
cgtttctagtctcagaagga

SEQ ID NO: 87693 - DNA, 20 bp, synthetic construct
  misc_feature 1..20: note = CRISPR gRNA sequence
  source 1..20: mol_type = other DNA
tttctagtctcagaaggaag

SEQ ID NO: 87694 - DNA, 20 bp, synthetic construct
  misc_feature 1..20: note = CRISPR gRNA sequence
  source 1..20: mol_type = other DNA
tctagtctcagaaggaagga

SEQ ID NO: 87695 - DNA, 20 bp, synthetic construct
  misc_feature 1..20: note = CRISPR gRNA sequence
  source 1..20: mol_type = other DNA
ctagtctcagaaggaaggag

SEQ ID NO: 87696 - DNA, 20 bp, synthetic construct
  misc_feature 1..20: note = CRISPR gRNA sequence
  source 1..20: mol_type = other DNA
tagtctcagaaggaaggaga

SEQ ID NO: 87697 - DNA, 20 bp, synthetic construct
  misc_feature 1..20: note = CRISPR gRNA sequence
  source 1..20: mol_type = other DNA
tctcagaaggaaggagaggg

SEQ ID NO: 87698 - DNA, 20 bp, synthetic construct
  misc_feature 1..20: note = CRISPR gRNA sequence
  source 1..20: mol_type = other DNA
agagggaagccattctcctc

SEQ ID NO: 87699 - DNA, 20 bp, synthetic construct
  misc_feature 1..20: note = CRISPR gRNA sequence
  source 1..20: mol_type = other DNA
gagggaagccattctcctct

SEQ ID NO: 87700 - DNA, 20 bp, synthetic construct
  misc_feature 1..20: note = CRISPR gRNA sequence
  source 1..20: mol_type = other DNA
agggaagccattctcctcta

SEQ ID NO: 87701 - DNA, 20 bp, synthetic construct
  misc_feature 1..20: note = CRISPR gRNA sequence
  source 1..20: mol_type = other DNA
attctcctctagggactctt

SEQ ID NO: 87702 - DNA, 20 bp, synthetic construct
  misc_feature 1..20: note = CRISPR gRNA sequence
  source 1..20: mol_type = other DNA
agggactcttcagtctcatt

SEQ ID NO: 87703 - DNA, 20 bp, synthetic construct
  misc_feature 1..20: note = CRISPR gRNA sequence
  source 1..20: mol_type = other DNA
cttcagtctcatttagatga

SEQ ID NO: 87704 - DNA, 20 bp, synthetic construct
  misc_feature 1..20: note = CRISPR gRNA sequence
  source 1..20: mol_type = other DNA
ctttttttctacctccatat

SEQ ID NO: 87705 - DNA, 20 bp, synthetic construct
  misc_feature 1..20: note = CRISPR gRNA sequence
  source 1..20: mol_type = other DNA
ttttttctacctccatatta

SEQ ID NO: 87706 - DNA, 20 bp, synthetic construct
  misc_feature 1..20: note = CRISPR gRNA sequence
  source 1..20: mol_type = other DNA
ttctacctccatattagaga

SEQ ID NO: 87707 - DNA, 20 bp, synthetic construct
  misc_feature 1..20: note = CRISPR gRNA sequence
  source 1..20: mol_type = other DNA
ctacctccatattagagatg

SEQ ID NO: 87708 - DNA, 20 bp, synthetic construct
  misc_feature 1..20: note = CRISPR gRNA sequence
  source 1..20: mol_type = other DNA
cttccctctcaccctattgc

SEQ ID NO: 87709 - DNA, 20 bp, synthetic construct
  misc_feature 1..20: note = CRISPR gRNA sequence
  source 1..20: mol_type = other DNA
ctattgccagttccaccaac

SEQ ID NO: 87710 - DNA, 20 bp, synthetic construct
  misc_feature 1..20: note = CRISPR gRNA sequence
  source 1..20: mol_type = other DNA
attgccagttccaccaacta

SEQ ID NO: 87711 - DNA, 20 bp, synthetic construct
  misc_feature 1..20: note = CRISPR gRNA sequence
  source 1..20: mol_type = other DNA
agttccaccaactagagtga

SEQ ID NO: 87712 - DNA, 20 bp, synthetic construct
  misc_feature 1..20: note = CRISPR gRNA sequence
  source 1..20: mol_type = other DNA
aactagagtgaaagacttcc

SEQ ID NO: 87713 - DNA, 20 bp, synthetic construct
  misc_feature 1..20: note = CRISPR gRNA sequence
  source 1..20: mol_type = other DNA
taaatctattctgtatccac

SEQ ID NO: 87714 - DNA, 20 bp, synthetic construct
  misc_feature 1..20: note = CRISPR gRNA sequence
  source 1..20: mol_type = other DNA
aaatctattctgtatccacc

SEQ ID NO: 87715 - DNA, 20 bp, synthetic construct
  misc_feature 1..20: note = CRISPR gRNA sequence
  source 1..20: mol_type = other DNA
tctattctgtatccaccagg

SEQ ID NO: 87716 - DNA, 20 bp, synthetic construct
  misc_feature 1..20: note = CRISPR gRNA sequence
  source 1..20: mol_type = other DNA
attctgtatccaccaggtgg

SEQ ID NO: 87717 - DNA, 20 bp, synthetic construct
  misc_feature 1..20: note = CRISPR gRNA sequence
  source 1..20: mol_type = other DNA
cagcatcttgtcatacgtgt

SEQ ID NO: 87718 - DNA, 20 bp, synthetic construct
  misc_feature 1..20: note = CRISPR gRNA sequence
  source 1..20: mol_type = other DNA
agcatcttgtcatacgtgtc

SEQ ID NO: 87719 - DNA, 20 bp, synthetic construct
  misc_feature 1..20: note = CRISPR gRNA sequence
  source 1..20: mol_type = other DNA
ttgtcatacgtgtcaggact

SEQ ID NO: 87720 - DNA, 20 bp, synthetic construct
  misc_feature 1..20: note = CRISPR gRNA sequence
  source 1..20: mol_type = other DNA
tgtcatacgtgtcaggactt

SEQ ID NO: 87721 - DNA, 20 bp, synthetic construct
  misc_feature 1..20: note = CRISPR gRNA sequence
  source 1..20: mol_type = other DNA
cgtgtcaggacttaggactg

SEQ ID NO: 87722 - DNA, 20 bp, synthetic construct
  misc_feature 1..20: note = CRISPR gRNA sequence
  source 1..20: mol_type = other DNA
gtgtcaggacttaggactgc

SEQ ID NO: 87723 - DNA, 20 bp, synthetic construct
  misc_feature 1..20: note = CRISPR gRNA sequence
  source 1..20: mol_type = other DNA
tgtcaggacttaggactgcg

SEQ ID NO: 87724 - DNA, 20 bp, synthetic construct
  misc_feature 1..20: note = CRISPR gRNA sequence
  source 1..20: mol_type = other DNA
ggacttaggactgcggggtt

SEQ ID NO: 87725 - DNA, 20 bp, synthetic construct
  misc_feature 1..20: note = CRISPR gRNA sequence
  source 1..20: mol_type = other DNA
gacttaggactgcggggttt

SEQ ID NO: 87726 - DNA, 20 bp, synthetic construct
  misc_feature 1..20: note = CRISPR gRNA sequence
  source 1..20: mol_type = other DNA
taggactgcggggtttaggt

SEQ ID NO: 87727 - DNA, 20 bp, synthetic construct
  misc_feature 1..20: note = CRISPR gRNA sequence
  source 1..20: mol_type = other DNA
ggggtttaggttagatgtca

SEQ ID NO: 87728 - DNA, 20 bp, synthetic construct
  misc_feature 1..20: note = CRISPR gRNA sequence
  source 1..20: mol_type = other DNA
taggttagatgtcacggaaa

SEQ ID NO: 87729 - DNA, 20 bp, synthetic construct
  misc_feature 1..20: note = CRISPR gRNA sequence
  source 1..20: mol_type = other DNA
ttagatgtcacggaaaaagc

SEQ ID NO: 87730 - DNA, 20 bp, synthetic construct
  misc_feature 1..20: note = CRISPR gRNA sequence
  source 1..20: mol_type = other DNA
cacggaaaaagctagttctg

SEQ ID NO: 87731 - DNA, 20 bp, synthetic construct
  misc_feature 1..20: note = CRISPR gRNA sequence
  source 1..20: mol_type = other DNA
gaaaaagctagttctgtggt

SEQ ID NO: 87732 - DNA, 20 bp, synthetic construct
  misc_feature 1..20: note = CRISPR gRNA sequence
  source 1..20: mol_type = other DNA
aaaaagctagttctgtggtc

SEQ ID NO: 87733 - DNA, 20 bp, synthetic construct
  misc_feature 1..20: note = CRISPR gRNA sequence
  source 1..20: mol_type = other DNA
aagctagttctgtggtcagg

SEQ ID NO: 87734 - DNA, 20 bp, synthetic construct
  misc_feature 1..20: note = CRISPR gRNA sequence
  source 1..20: mol_type = other DNA
tgtggtcaggcggcaccaat

SEQ ID NO: 87735 - DNA, 20 bp, synthetic construct
  misc_feature 1..20: note = CRISPR gRNA sequence
  source 1..20: mol_type = other DNA
gtcaggcggcaccaatgaga

SEQ ID NO: 87736 - DNA, 20 bp, synthetic construct
  misc_feature 1..20: note = CRISPR gRNA sequence
  source 1..20: mol_type = other DNA
tcaggcggcaccaatgagaa

SEQ ID NO: 87737 - DNA, 20 bp, synthetic construct
  misc_feature 1..20: note = CRISPR gRNA sequence
  source 1..20: mol_type = other DNA
gcaccaatgagaaaggaatg

SEQ ID NO: 87738 - DNA, 20 bp, synthetic construct
  misc_feature 1..20: note = CRISPR gRNA sequence
  source 1..20: mol_type = other DNA
agaaaggaatgcagaccctc

SEQ ID NO: 87739 - DNA, 20 bp, synthetic construct
  misc_feature 1..20: note = CRISPR gRNA sequence
  source 1..20: mol_type = other DNA
agaccctccagatgtatcct

SEQ ID NO: 87740 - DNA, 20 bp, synthetic construct
  misc_feature 1..20: note = CRISPR gRNA sequence
  source 1..20: mol_type = other DNA
gaccctccagatgtatcctt

SEQ ID NO: 87741 - DNA, 20 bp, synthetic construct
  misc_feature 1..20: note = CRISPR gRNA sequence
  source 1..20: mol_type = other DNA
tccagatgtatccttgggaa

SEQ ID NO: 87742 - DNA, 20 bp, synthetic construct
  misc_feature 1..20: note = CRISPR gRNA sequence
  source 1..20: mol_type = other DNA
agatgtatccttgggaaaag

SEQ ID NO: 87743 - DNA, 20 bp, synthetic construct
  misc_feature 1..20: note = CRISPR gRNA sequence
  source 1..20: mol_type = other DNA
aaaccaactaatatttattg

SEQ ID NO: 87744 - DNA, 20 bp, synthetic construct
  misc_feature 1..20: note = CRISPR gRNA sequence
  source 1..20: mol_type = other DNA
gacctactttgtcctctaca

SEQ ID NO: 87745 - DNA, 20 bp, synthetic construct
  misc_feature 1..20: note = CRISPR gRNA sequence
  source 1..20: mol_type = other DNA
acctactttgtcctctacat

SEQ ID NO: 87746 - DNA, 20 bp, synthetic construct
  misc_feature 1..20: note = CRISPR gRNA sequence
  source 1..20: mol_type = other DNA
cctactttgtcctctacata

SEQ ID NO: 87747 - DNA, 20 bp, synthetic construct
  misc_feature 1..20: note = CRISPR gRNA sequence
  source 1..20: mol_type = other DNA
actttgtcctctacataggg

SEQ ID NO: 87748 - DNA, 20 bp, synthetic construct
  misc_feature 1..20: note = CRISPR gRNA sequence
  source 1..20: mol_type = other DNA
ctacatagggtagcttctgt

SEQ ID NO: 87749 - DNA, 20 bp, synthetic construct
  misc_feature 1..20: note = CRISPR gRNA sequence
  source 1..20: mol_type = other DNA
tacatagggtagcttctgtc

SEQ ID NO: 87750 - DNA, 20 bp, synthetic construct
  misc_feature 1..20: note = CRISPR gRNA sequence
  source 1..20: mol_type = other DNA
acatagggtagcttctgtca

SEQ ID NO: 87751 - DNA, 20 bp, synthetic construct
  misc_feature 1..20: note = CRISPR gRNA sequence
  source 1..20: mol_type = other DNA
tagcttctgtcagggaatct

SEQ ID NO: 87752 - DNA, 20 bp, synthetic construct
  misc_feature 1..20: note = CRISPR gRNA sequence
  source 1..20: mol_type = other DNA
agggaatcttggttcttccc

SEQ ID NO: 87753 - DNA, 20 bp, synthetic construct
  misc_feature 1..20: note = CRISPR gRNA sequence
  source 1..20: mol_type = other DNA
aagaaacactgattttcttt

SEQ ID NO: 87754 - DNA, 20 bp, synthetic construct
  misc_feature 1..20: note = CRISPR gRNA sequence
  source 1..20: mol_type = other DNA
agaaacactgattttctttc

SEQ ID NO: 87755 - DNA, 20 bp, synthetic construct
  misc_feature 1..20: note = CRISPR gRNA sequence
  source 1..20: mol_type = other DNA
gaaacactgattttctttca

SEQ ID NO: 87756 - DNA, 20 bp, synthetic construct
  misc_feature 1..20: note = CRISPR gRNA sequence
  source 1..20: mol_type = other DNA
aacactgattttctttcagg

SEQ ID NO: 87757 - DNA, 20 bp, synthetic construct
  misc_feature 1..20: note = CRISPR gRNA sequence
  source 1..20: mol_type = other DNA
gtgttcatttatttccacca

SEQ ID NO: 87758 - DNA, 20 bp, synthetic construct
  misc_feature 1..20: note = CRISPR gRNA sequence
  source 1..20: mol_type = other DNA
ttcatttatttccaccacag

SEQ ID NO: 87759 - DNA, 20 bp, synthetic construct
  misc_feature 1..20: note = CRISPR gRNA sequence
  source 1..20: mol_type = other DNA
tttccaccacagcagatttt

SEQ ID NO: 87760 - DNA, 20 bp, synthetic construct
  misc_feature 1..20: note = CRISPR gRNA sequence
  source 1..20: mol_type = other DNA
tgtaatatttgatatctata

SEQ ID NO: 87761 - DNA, 20 bp, synthetic construct
  misc_feature 1..20: note = CRISPR gRNA sequence
  source 1..20: mol_type = other DNA
taatatttgatatctataaa

SEQ ID NO: 87762 - DNA, 20 bp, synthetic construct
  misc_feature 1..20: note = CRISPR gRNA sequence
  source 1..20: mol_type = other DNA
tctaacgtgaataaattatg

SEQ ID NO: 87763 - DNA, 20 bp, synthetic construct
  misc_feature 1..20: note = CRISPR gRNA sequence
  source 1..20: mol_type = other DNA
aaattatgaagcatactaat

SEQ ID NO: 87764 - DNA, 20 bp, synthetic construct
  misc_feature 1..20: note = CRISPR gRNA sequence
  source 1..20: mol_type = other DNA
attgtgtttgtgttcctccc

SEQ ID NO: 87765 - DNA, 20 bp, synthetic construct
  misc_feature 1..20: note = CRISPR gRNA sequence
  source 1..20: mol_type = other DNA
gcctgtcccccgcctcttct

SEQ ID NO: 87766 - DNA, 20 bp, synthetic construct
  misc_feature 1..20: note = CRISPR gRNA sequence
  source 1..20: mol_type = other DNA
tgtcccccgcctcttcttag

SEQ ID NO: 87767 - DNA, 20 bp, synthetic construct
  misc_feature 1..20: note = CRISPR gRNA sequence
  source 1..20: mol_type = other DNA
ttcgtgtctattatctgcta

SEQ ID NO: 87768 - DNA, 20 bp, synthetic construct
  misc_feature 1..20: note = CRISPR gRNA sequence
  source 1..20: mol_type = other DNA
tgttttaatgtatatgtgtt

SEQ ID NO: 87769 - DNA, 20 bp, synthetic construct
  misc_feature 1..20: note = CRISPR gRNA sequence
  source 1..20: mol_type = other DNA
gttggtttactgcttttccc

SEQ ID NO: 87770 - DNA, 20 bp, synthetic construct
  misc_feature 1..20: note = CRISPR gRNA sequence
  source 1..20: mol_type = other DNA
ttttcccaaggatacatctg

SEQ ID NO: 87771 - DNA, 20 bp, synthetic construct
  misc_feature 1..20: note = CRISPR gRNA sequence
  source 1..20: mol_type = other DNA
tgacaagatgctgccacctg

SEQ ID NO: 87772 - DNA, 20 bp, synthetic construct
  misc_feature 1..20: note = CRISPR gRNA sequence
  source 1..20: mol_type = other DNA
atgctgccacctggtggata

SEQ ID NO: 87773 - DNA, 20 bp, synthetic construct
  misc_feature 1..20: note = CRISPR gRNA sequence
  source 1..20: mol_type = other DNA
ctagttggtggaactggcaa

SEQ ID NO: 87774 - DNA, 20 bp, synthetic construct
  misc_feature 1..20: note = CRISPR gRNA sequence
  source 1..20: mol_type = other DNA
caatagggtgagagggaagc

SEQ ID NO: 87775 - DNA, 20 bp, synthetic construct
  misc_feature 1..20: note = CRISPR gRNA sequence
  source 1..20: mol_type = other DNA
ctatcatctaaatgagactg

SEQ ID NO: 87776 - DNA, 20 bp, synthetic construct
  misc_feature 1..20: note = CRISPR gRNA sequence
  source 1..20: mol_type = other DNA
agactgaagagtccctagag

SEQ ID NO: 87777 - DNA, 20 bp, synthetic construct
  misc_feature 1..20: note = CRISPR gRNA sequence
  source 1..20: mol_type = other DNA
tcaacttagcaagctaaaat

SEQ ID NO: 87778 - DNA, 20 bp, synthetic construct
  misc_feature 1..20: note = CRISPR gRNA sequence
  source 1..20: mol_type = other DNA
ctgctcctagtttccacttg

SEQ ID NO: 87779 - DNA, 20 bp, synthetic construct
  misc_feature 1..20: note = CRISPR gRNA sequence
  source 1..20: mol_type = other DNA
caaaggtgttgtccatgata

SEQ ID NO: 87780 - DNA, 20 bp, synthetic construct
  misc_feature 1..20: note = CRISPR gRNA sequence
  source 1..20: mol_type = other DNA
tcctggccacagtgattggt

SEQ ID NO: 87781 - DNA, 20 bp, synthetic construct
  misc_feature 1..20: note = CRISPR gRNA sequence
  source 1..20: mol_type = other DNA
gtgacccaggcctaatcagt

SEQ ID NO: 87782 - DNA, 20 bp, synthetic construct
  misc_feature 1..20: note = CRISPR gRNA sequence
  source 1..20: mol_type = other DNA
atggggaaaagtgtaatctt

SEQ ID NO: 87783 - DNA, 20 bp, synthetic construct
  misc_feature 1..20: note = CRISPR gRNA sequence
  source 1..20: mol_type = other DNA
tttagagacatactgaacta

SEQ ID NO: 87784 - DNA, 20 bp, synthetic construct
  misc_feature 1..20: note = CRISPR gRNA sequence
  source 1..20: mol_type = other DNA
cctttttattttaagccagt

SEQ ID NO: 87785 - DNA, 20 bp, synthetic construct
  misc_feature 1..20: note = CRISPR gRNA sequence
  source 1..20: mol_type = other DNA
agcccattcctaccttccca

SEQ ID NO: 87786 - DNA, 20 bp, synthetic construct
  misc_feature 1..20: note = CRISPR gRNA sequence
  source 1..20: mol_type = other DNA
ccttcccacaggatagcaca

SEQ ID NO: 87787 - DNA, 20 bp, synthetic construct
  misc_feature 1..20: note = CRISPR gRNA sequence
  source 1..20: mol_type = other DNA
ttattggttacactaaagcc

SEQ ID NO: 87788 - DNA, 20 bp, synthetic construct
  misc_feature 1..20: note = CRISPR gRNA sequence
  source 1..20: mol_type = other DNA
gcaaccaggtactaagtaga

SEQ ID NO: 87789 - DNA, 20 bp, synthetic construct
  misc_feature 1..20: note = CRISPR gRNA sequence
  source 1..20: mol_type = other DNA
actcagctgtctgtacagag

SEQ ID NO: 87790 - DNA, 20 bp, synthetic construct
  misc_feature 1..20: note = CRISPR gRNA sequence
  source 1..20: mol_type = other DNA
agaatggacttccttaggaa

SEQ ID NO: 87791 - DNA, 20 bp, synthetic construct
  misc_feature 1..20: note = CRISPR gRNA sequence
  source 1..20: mol_type = other DNA
ctactaggcaaagttaacgt

SEQ ID NO: 87792 - DNA, 20 bp, synthetic construct
  misc_feature 1..20: note = CRISPR gRNA sequence
  source 1..20: mol_type = other DNA
tccccacagacctgtatcat

SEQ ID NO: 87793 - DNA, 20 bp, synthetic construct
  misc_feature 1..20: note = CRISPR gRNA sequence
  source 1..20: mol_type = other DNA
gtatcatgggggtgttgctt

SEQ ID NO: 87794 - DNA, 20 bp, synthetic construct
  misc_feature 1..20: note = CRISPR gRNA sequence
  source 1..20: mol_type = other DNA
cttttgggtctttatgctcc

SEQ ID NO: 87795 - DNA, 20 bp, synthetic construct
  misc_feature 1..20: note = CRISPR gRNA sequence
  source 1..20: mol_type = other DNA
ctcacttttgaggggaccaa

SEQ ID NO: 87796 - DNA, 20 bp, synthetic construct
  misc_feature 1..20: note = CRISPR gRNA sequence
  source 1..20: mol_type = other DNA
tggcctctctgcccctccag

SEQ ID NO: 87797 - DNA, 20 bp, synthetic construct
  misc_feature 1..20: note = CRISPR gRNA sequence
  source 1..20: mol_type = other DNA
atggcagctgctgacttgag

SEQ ID NO: 87798 - DNA, 20 bp, synthetic construct
  misc_feature 1..20: note = CRISPR gRNA sequence
  source 1..20: mol_type = other DNA
agctgctgacttgagagggg

SEQ ID NO: 87799 - DNA, 20 bp, synthetic construct
  misc_feature 1..20: note = CRISPR gRNA sequence
  source 1..20: mol_type = other DNA
ctgttctctgtgccccgggg

SEQ ID NO: 87800 - DNA, 20 bp, synthetic construct
  misc_feature 1..20: note = CRISPR gRNA sequence
  source 1..20: mol_type = other DNA
tctctgtgccccggggctga

SEQ ID NO: 87801 - DNA, 20 bp, synthetic construct
  misc_feature 1..20: note = CRISPR gRNA sequence
  source 1..20: mol_type = other DNA
taatgatgggcacagctgct

SEQ ID NO: 87802 - DNA, 20 bp, synthetic construct
  misc_feature 1..20: note = CRISPR gRNA sequence
  source 1..20: mol_type = other DNA
cctgaagaaagcctgggggc

SEQ ID NO: 87803 - DNA, 20 bp, synthetic construct
  misc_feature 1..20: note = CRISPR gRNA sequence
  source 1..20: mol_type = other DNA
gccagaataggtggagagac

SEQ ID NO: 87804 - DNA, 20 bp, synthetic construct
  misc_feature 1..20: note = CRISPR gRNA sequence
  source 1..20: mol_type = other DNA
ggtggagagactgggattgg

SEQ ID NO: 87805 - DNA, 20 bp, synthetic construct
  misc_feature 1..20: note = CRISPR gRNA sequence
  source 1..20: mol_type = other DNA
gaggaacacagtaaggtgtg

SEQ ID NO: 87806 - DNA, 20 bp, synthetic construct
  misc_feature 1..20: note = CRISPR gRNA sequence
  source 1..20: mol_type = other DNA
aacacagtaaggtgtgaaga

SEQ ID NO: 87807 - DNA, 20 bp, synthetic construct
  misc_feature 1..20: note = CRISPR gRNA sequence
  source 1..20: mol_type = other DNA
agcaagggacccaattggag

SEQ ID NO: 87808 - DNA, 20 bp, synthetic construct
  misc_feature 1..20: note = CRISPR gRNA sequence
  source 1..20: mol_type = other DNA
cttcttgtgggctccaccct

SEQ ID NO: 87809 - DNA, 20 bp, synthetic construct
  misc_feature 1..20: note = CRISPR gRNA sequence
  source 1..20: mol_type = other DNA
cagaggtaccaaaaaggtaa

SEQ ID NO: 87810 - DNA, 20 bp, synthetic construct
  misc_feature 1..20: note = CRISPR gRNA sequence
  source 1..20: mol_type = other DNA
tgaaggtgaggaggaaactg

SEQ ID NO: 87811 - DNA, 20 bp, synthetic construct
  misc_feature 1..20: note = CRISPR gRNA sequence
  source 1..20: mol_type = other DNA
aggaggaaactgaggaatag

SEQ ID NO: 87812 - DNA, 20 bp, synthetic construct
  misc_feature 1..20: note = CRISPR gRNA sequence
  source 1..20: mol_type = other DNA
tgactggtagagacaggaaa

SEQ ID NO: 87813 - DNA, 20 bp, synthetic construct
  misc_feature 1..20: note = CRISPR gRNA sequence
  source 1..20: mol_type = other DNA
ggtgctaaagcatgtcttag

SEQ ID NO: 87814 - DNA, 20 bp, synthetic construct
  misc_feature 1..20: note = CRISPR gRNA sequence
  source 1..20: mol_type = other DNA
cactgaagctgaaagtggct

SEQ ID NO: 87815 - DNA, 20 bp, synthetic construct
  misc_feature 1..20: note = CRISPR gRNA sequence
  source 1..20: mol_type = other DNA
agggttgctgagacataaga

SEQ ID NO: 87816 - DNA, 20 bp, synthetic construct
  misc_feature 1..20: note = CRISPR gRNA sequence
  source 1..20: mol_type = other DNA
atggaactgaaggaccgttt

SEQ ID NO: 87817 - DNA, 20 bp, synthetic construct
  misc_feature 1..20: note = CRISPR gRNA sequence
  source 1..20: mol_type = other DNA
accagttcatctcgaggtgc

SEQ ID NO: 87818 - DNA, 20 bp, synthetic construct
  misc_feature 1..20: note = CRISPR gRNA sequence
  source 1..20: mol_type = other DNA
accaaagctgagaccagact

SEQ ID NO: 87819 - DNA, 20 bp, synthetic construct
  misc_feature 1..20: note = CRISPR gRNA sequence
  source 1..20: mol_type = other DNA
gctgagaccagactggggat

SEQ ID NO: 87820 - DNA, 20 bp, synthetic construct
  misc_feature 1..20: note = CRISPR gRNA sequence
  source 1..20: mol_type = other DNA
ttcatcctctgcctcagcta

SEQ ID NO: 87821 - DNA, 20 bp, synthetic construct
  misc_feature 1..20: note = CRISPR gRNA sequence
  source 1..20: mol_type = other DNA
ctgacttttacctgggagag

SEQ ID NO: 87822 - DNA, 20 bp, synthetic construct
  misc_feature 1..20: note = CRISPR gRNA sequence
  source 1..20: mol_type = other DNA
ttttacctgggagagaagag

SEQ ID NO: 87823 - DNA, 20 bp, synthetic construct
  misc_feature 1..20: note = CRISPR gRNA sequence
  source 1..20: mol_type = other DNA
cctttaggtcaagtccaggc

SEQ ID NO: 87824 - DNA, 20 bp, synthetic construct
  misc_feature 1..20: note = CRISPR gRNA sequence
  source 1..20: mol_type = other DNA
cacccccaacctctctagtc

SEQ ID NO: 87825 - DNA, 20 bp, synthetic construct
  misc_feature 1..20: note = CRISPR gRNA sequence
  source 1..20: mol_type = other DNA
tcttgccaaagttggctgtg

SEQ ID NO: 87826 - DNA, 20 bp, synthetic construct
  misc_feature 1..20: note = CRISPR gRNA sequence
  source 1..20: mol_type = other DNA
caagactctcacagtacttc

SEQ ID NO: 87827 - DNA, 20 bp, synthetic construct
  misc_feature 1..20: note = CRISPR gRNA sequence
  source 1..20: mol_type = other DNA
cttcctgagtgagaggggag

SEQ ID NO: 87828 - DNA, 20 bp, synthetic construct
  misc_feature 1..20: note = CRISPR gRNA sequence
  source 1..20: mol_type = other DNA
gatactcagagaaggaggcc

SEQ ID NO: 87829 - DNA, 20 bp, synthetic construct
  misc_feature 1..20: note = CRISPR gRNA sequence
  source 1..20: mol_type = other DNA
ggaggccatgggtaggctcg

SEQ ID NO: 87830 - DNA, 20 bp, synthetic construct
  misc_feature 1..20: note = CRISPR gRNA sequence
  source 1..20: mol_type = other DNA
ggtaggctcgaagagtccct

SEQ ID NO: 87831 - DNA, 20 bp, synthetic construct
  misc_feature 1..20: note = CRISPR gRNA sequence
  source 1..20: mol_type = other DNA
atcaaggcaggaagctcttc

SEQ ID NO: 87832 - DNA, 20 bp, synthetic construct
  misc_feature 1..20: note = CRISPR gRNA sequence
  source 1..20: mol_type = other DNA
aggaagctcttcatgggtga

SEQ ID NO: 87833 - DNA, 20 bp, synthetic construct
  misc_feature 1..20: note = CRISPR gRNA sequence
  source 1..20: mol_type = other DNA
gtgtgctcttccaggtggtt

SEQ ID NO: 87834 - DNA, 20 bp, synthetic construct
  misc_feature 1..20: note = CRISPR gRNA sequence
  source 1..20: mol_type = other DNA
tggaccaaatttagttcacc

SEQ ID NO: 87835 - DNA, 20 bp, synthetic construct
  misc_feature 1..20: note = CRISPR gRNA sequence
  source 1..20: mol_type = other DNA
cttcatcaaggacagcattt

SEQ ID NO: 87836 - DNA, 20 bp, synthetic construct
  misc_feature 1..20: note = CRISPR gRNA sequence
  source 1..20: mol_type = other DNA
ttcccagtgaacctttctct

SEQ ID NO: 87837 - DNA, 20 bp, synthetic construct
  misc_feature 1..20: note = CRISPR gRNA sequence
  source 1..20: mol_type = other DNA
cctaccttttgtctccagtg

SEQ ID NO: 87838 - DNA, 20 bp, synthetic construct
  misc_feature 1..20: note = CRISPR gRNA sequence
  source 1..20: mol_type = other DNA
accaaagtctagctgactta

SEQ ID NO: 87839 - DNA, 20 bp, synthetic construct
  misc_feature 1..20: note = CRISPR gRNA sequence
  source 1..20: mol_type = other DNA
aaaatacaaaaaaaaattag

SEQ ID NO: 87840 - DNA, 20 bp, synthetic construct
  misc_feature 1..20: note = CRISPR gRNA sequence
  source 1..20: mol_type = other DNA
tacttgggaggctgaggcag

SEQ ID NO: 87841 - DNA, 20 bp, synthetic construct
  misc_feature 1..20: note = CRISPR gRNA sequence
  source 1..20: mol_type = other DNA
ctgcactccagcctaggcga

SEQ ID NO: 87842 - DNA, 20 bp, synthetic construct
  misc_feature 1..20: note = CRISPR gRNA sequence
  source 1..20: mol_type = other DNA
atggagaggagggaagtaga

SEQ ID NO: 87843 - DNA, 20 bp, synthetic construct
  misc_feature 1..20: note = CRISPR gRNA sequence
  source 1..20: mol_type = other DNA
ctcttccccaacacacttac

SEQ ID NO: 87844 - DNA, 20 bp, synthetic construct
  misc_feature 1..20: note = CRISPR gRNA sequence
  source 1..20: mol_type = other DNA
gaaatgcccagcaggtgctc

SEQ ID NO: 87845 - DNA, 20 bp, synthetic construct
  misc_feature 1..20: note = CRISPR gRNA sequence
  source 1..20: mol_type = other DNA
cagccaaagtgaagtgctgc

SEQ ID NO: 87846 - DNA, 20 bp, synthetic construct
  misc_feature 1..20: note = CRISPR gRNA sequence
  source 1..20: mol_type = other DNA
ggacaggacttggagatgtg

SEQ ID NO: 87847 - DNA, 20 bp, synthetic construct
  misc_feature 1..20: note = CRISPR gRNA sequence
  source 1..20: mol_type = other DNA
gtacctcggagcctctgaag

SEQ ID NO: 87848 - DNA, 20 bp, synthetic construct
  misc_feature 1..20: note = CRISPR gRNA sequence
  source 1..20: mol_type = other DNA
tgccatcccggcatgagggc

SEQ ID NO: 87849 - DNA, 20 bp, synthetic construct
  misc_feature 1..20: note = CRISPR gRNA sequence
  source 1..20: mol_type = other DNA
gagaaacagaaacaaagcct

SEQ ID NO: 87850 - DNA, 20 bp, synthetic construct
  misc_feature 1..20: note = CRISPR gRNA sequence
  source 1..20: mol_type = other DNA
aactgtaaaggaagagatag

SEQ ID NO: 87851 - DNA, 20 bp, synthetic construct
  misc_feature 1..20: note = CRISPR gRNA sequence
  source 1..20: mol_type = other DNA
aaggaagagatagggggatt

SEQ ID NO: 87852 - DNA, 20 bp, synthetic construct
  misc_feature 1..20: note = CRISPR gRNA sequence
  source 1..20: mol_type = other DNA
catatgcctgggaggtcaga

SEQ ID NO: 87853 - DNA, 20 bp, synthetic construct
  misc_feature 1..20: note = CRISPR gRNA sequence
  source 1..20: mol_type = other DNA
cggtttctgcaaagtggagc

SEQ ID NO: 87854 - DNA, 20 bp, synthetic construct
  misc_feature 1..20: note = CRISPR gRNA sequence
  source 1..20: mol_type = other DNA
cgctccactttgcagaaacc

SEQ ID NO: 87855 - DNA, 20 bp, synthetic construct
  misc_feature 1..20: note = CRISPR gRNA sequence
  source 1..20: mol_type = other DNA
cactttgcagaaaccgggga

SEQ ID NO: 87856 - DNA, 20 bp, synthetic construct
  misc_feature 1..20: note = CRISPR gRNA sequence
  source 1..20: mol_type = other DNA
aaggaggtgggggcgcgcct

SEQ ID NO: 87857 - DNA, 20 bp, synthetic construct
  misc_feature 1..20: note = CRISPR gRNA sequence
  source 1..20: mol_type = other DNA
tttttccaagcctagaaggg

SEQ ID NO: 87858 - DNA, 20 bp, synthetic construct
  misc_feature 1..20: note = CRISPR gRNA sequence
  source 1..20: mol_type = other DNA
cccaggcatatgcaatggtg

SEQ ID NO: 87859 - DNA, 20 bp, synthetic construct
  misc_feature 1..20: note = CRISPR gRNA sequence
  source 1..20: mol_type = other DNA
caatggtgaggagtattttt

SEQ ID NO: 87860 - DNA, 20 bp, synthetic construct
  misc_feature 1..20: note = CRISPR gRNA sequence
  source 1..20: mol_type = other DNA
tgagggggaggagggcagta

SEQ ID NO: 87861 - DNA, 20 bp, synthetic construct
  misc_feature 1..20: note = CRISPR gRNA sequence
  source 1..20: mol_type = other DNA
aatgaaaatttcttgctaac

SEQ ID NO: 87862 - DNA, 20 bp, synthetic construct
  misc_feature 1..20: note = CRISPR gRNA sequence
  source 1..20: mol_type = other DNA
cttcagaaaggtggggcaga

SEQ ID NO: 87863 - DNA, 20 bp, synthetic construct
  misc_feature 1..20: note = CRISPR gRNA sequence
  source 1..20: mol_type = other DNA
atatgggcctggcgaagtaa

SEQ ID NO: 87864 - DNA, 20 bp, synthetic construct
  misc_feature 1..20: note = CRISPR gRNA sequence
  source 1..20: mol_type = other DNA
gtttctgtttctctgccttt

SEQ ID NO: 87865 - DNA, 20 bp, synthetic construct
  misc_feature 1..20: note = CRISPR gRNA sequence
  source 1..20: mol_type = other DNA
cctttctgggtaaagagatg

SEQ ID NO: 87866 - DNA, 20 bp, synthetic construct
  misc_feature 1..20: note = CRISPR gRNA sequence
  source 1..20: mol_type = other DNA
ctggggaagggaaggccagt

SEQ ID NO: 87867 - DNA, 20 bp, synthetic construct
  misc_feature 1..20: note = CRISPR gRNA sequence
  source 1..20: mol_type = other DNA
ctcaattctagccctcatgc

SEQ ID NO: 87868 - DNA, 20 bp, synthetic construct
  misc_feature 1..20: note = CRISPR gRNA sequence
  source 1..20: mol_type = other DNA
ctccaagtcctgtccaagac

SEQ ID NO: 87869 - DNA, 20 bp, synthetic construct
  misc_feature 1..20: note = CRISPR gRNA sequence
  source 1..20: mol_type = other DNA
gccgtgcagaacaaagtaga

SEQ ID NO: 87870 - DNA, 20 bp, synthetic construct
  misc_feature 1..20: note = CRISPR gRNA sequence
  source 1..20: mol_type = other DNA
gttggggaagagggcaagag

SEQ ID NO: 87871 - DNA, 20 bp, synthetic construct
  misc_feature 1..20: note = CRISPR gRNA sequence
  source 1..20: mol_type = other DNA
ggatggaaatgctgagggag

SEQ ID NO: 87872 - DNA, 20 bp, synthetic construct
  misc_feature 1..20: note = CRISPR gRNA sequence
  source 1..20: mol_type = other DNA
atgctgagggaggaggatgt

SEQ ID NO: 87873 - DNA, 20 bp, synthetic construct
  misc_feature 1..20: note = CRISPR gRNA sequence
  source 1..20: mol_type = other DNA
aaacattgatgtgggagagg

SEQ ID NO: 87874 - DNA, 20 bp, synthetic construct
  misc_feature 1..20: note = CRISPR gRNA sequence
  source 1..20: mol_type = other DNA
ttttttttttttttttgaga

SEQ ID NO: 87875 - DNA, 20 bp, synthetic construct
  misc_feature 1..20: note = CRISPR gRNA sequence
  source 1..20: mol_type = other DNA
tctcactctgtcgcctaggc

SEQ ID NO: 87876 - DNA, 20 bp, synthetic construct
  misc_feature 1..20: note = CRISPR gRNA sequence
  source 1..20: mol_type = other DNA
ttttgtatttttagtagaaa

SEQ ID NO: 87877 - DNA, 20 bp, synthetic construct
  misc_feature 1..20: note = CRISPR gRNA sequence
  source 1..20: mol_type = other DNA
cggggtttcaccatgttagc

SEQ ID NO: 87878 - DNA, 20 bp, synthetic construct
  misc_feature 1..20: note = CRISPR gRNA sequence
  source 1..20: mol_type = other DNA
gccttggccttccaaagtgc

SEQ ID NO: 87879 - DNA, 20 bp, synthetic construct
  misc_feature 1..20: note = CRISPR gRNA sequence
  source 1..20: mol_type = other DNA
agtcagctagactttggtgt

SEQ ID NO: 87880 - DNA, 20 bp, synthetic construct
  misc_feature 1..20: note = CRISPR gRNA sequence
  source 1..20: mol_type = other DNA
agactttggtgtggggatca

SEQ ID NO: 87881 - DNA, 20 bp, synthetic construct
  misc_feature 1..20: note = CRISPR gRNA sequence
  source 1..20: mol_type = other DNA
ggggatcagagggtcctata

SEQ ID NO: 87882 - DNA, 20 bp, synthetic construct
  misc_feature 1..20: note = CRISPR gRNA sequence
  source 1..20: mol_type = other DNA
tagagaaaggttcactggga

SEQ ID NO: 87883 - DNA, 20 bp, synthetic construct
  misc_feature 1..20: note = CRISPR gRNA sequence
  source 1..20: mol_type = other DNA
gttcactgggaaggggtgag

SEQ ID NO: 87884 - DNA, 20 bp, synthetic construct
  misc_feature 1..20: note = CRISPR gRNA sequence
  source 1..20: mol_type = other DNA
tgggaaggggtgaggtgaat

SEQ ID NO: 87885 - DNA, 20 bp, synthetic construct
  misc_feature 1..20: note = CRISPR gRNA sequence
  source 1..20: mol_type = other DNA
ttaccagggaaagttagatt

SEQ ID NO: 87886 - DNA, 20 bp, synthetic construct
  misc_feature 1..20: note = CRISPR gRNA sequence
  source 1..20: mol_type = other DNA
ggaagaaccaggacaactgt

SEQ ID NO: 87887 - DNA, 20 bp, synthetic construct
  misc_feature 1..20: note = CRISPR gRNA sequence
  source 1..20: mol_type = other DNA
gccaagtacactgagcaatg

SEQ ID NO: 87888 - DNA, 20 bp, synthetic construct
  misc_feature 1..20: note = CRISPR gRNA sequence
  source 1..20: mol_type = other DNA
gagtacatgtatgcctatag

SEQ ID NO: 87889 - DNA, 20 bp, synthetic construct
  misc_feature 1..20: note = CRISPR gRNA sequence
  source 1..20: mol_type = other DNA
agtgtttatgatgcctatcg

SEQ ID NO: 87890 - DNA, 20 bp, synthetic construct
  misc_feature 1..20: note = CRISPR gRNA sequence
  source 1..20: mol_type = other DNA
tgatgcctatcggtgggtgg

SEQ ID NO: 87891 - DNA, 20 bp, synthetic construct
  misc_feature 1..20: note = CRISPR gRNA sequence
  source 1..20: mol_type = other DNA
gcctatcggtgggtggaggg

SEQ ID NO: 87892 - DNA, 20 bp, synthetic construct
  misc_feature 1..20: note = CRISPR gRNA sequence
  source 1..20: mol_type = other DNA
gtgggtggaggggtgggtgg

SEQ ID NO: 87893 - DNA, 20 bp, synthetic construct
  misc_feature 1..20: note = CRISPR gRNA sequence
  source 1..20: mol_type = other DNA
gtggaggggtgggtggtggg

SEQ ID NO: 87894 - DNA, 20 bp, synthetic construct
  misc_feature 1..20: note = CRISPR gRNA sequence
  source 1..20: mol_type = other DNA
aggggtgggtggtgggatga

SEQ ID NO: 87895 - DNA, 20 bp, synthetic construct
  misc_feature 1..20: note = CRISPR gRNA sequence
  source 1..20: mol_type = other DNA
tgataaagcctgccttctta

SEQ ID NO: 87896 - DNA, 20 bp, synthetic construct
  misc_feature 1..20: note = CRISPR gRNA sequence
  source 1..20: mol_type = other DNA
cctacccatggcctccttct

SEQ ID NO: 87897 - DNA, 20 bp, synthetic construct
  misc_feature 1..20: note = CRISPR gRNA sequence
  source 1..20: mol_type = other DNA
tctcactcaggaagtactgt

SEQ ID NO: 87898 - DNA, 20 bp, synthetic construct
  misc_feature 1..20: note = CRISPR gRNA sequence
  source 1..20: mol_type = other DNA
tatccttgactagagaggtt

SEQ ID NO: 87899 - DNA, 20 bp, synthetic construct
  misc_feature 1..20: note = CRISPR gRNA sequence
  source 1..20: mol_type = other DNA
gaggacctgggaggaagact

SEQ ID NO: 87900 - DNA, 20 bp, synthetic construct
  misc_feature 1..20: note = CRISPR gRNA sequence
  source 1..20: mol_type = other DNA
gacttaggatgtggagagca

SEQ ID NO: 87901 - DNA, 20 bp, synthetic construct
  misc_feature 1..20: note = CRISPR gRNA sequence
  source 1..20: mol_type = other DNA
ccctgcctggacttgaccta

SEQ ID NO: 87902 - DNA, 20 bp, synthetic construct
  misc_feature 1..20: note = CRISPR gRNA sequence
  source 1..20: mol_type = other DNA
gacttgacctaaagggttct

SEQ ID NO: 87903 - DNA, 20 bp, synthetic construct
  misc_feature 1..20: note = CRISPR gRNA sequence
  source 1..20: mol_type = other DNA
ccaaccctgtagctgaggca

SEQ ID NO: 87904 - DNA, 20 bp, synthetic construct
  misc_feature 1..20: note = CRISPR gRNA sequence
  source 1..20: mol_type = other DNA
gaacttgtgggcttctgcaa

SEQ ID NO: 87905 - DNA, 20 bp, synthetic construct
  misc_feature 1..20: note = CRISPR gRNA sequence
  source 1..20: mol_type = other DNA
tctctgacaagagaggaggc

SEQ ID NO: 87906 - DNA, 20 bp, synthetic construct
  misc_feature 1..20: note = CRISPR gRNA sequence
  source 1..20: mol_type = other DNA
gaggcaagggttctttaatt

SEQ ID NO: 87907 - DNA, 20 bp, synthetic construct
  misc_feature 1..20: note = CRISPR gRNA sequence
  source 1..20: mol_type = other DNA
ctgacctgtgactgggcaga

SEQ ID NO: 87908 - DNA, 20 bp, synthetic construct
  misc_feature 1..20: note = CRISPR gRNA sequence
  source 1..20: mol_type = other DNA
tcagtggccctcccacacac

SEQ ID NO: 87909 - DNA, 20 bp, synthetic construct
  misc_feature 1..20: note = CRISPR gRNA sequence
  source 1..20: mol_type = other DNA
cacactagaatagagacacc

SEQ ID NO: 87910 - DNA, 20 bp, synthetic construct
  misc_feature 1..20: note = CRISPR gRNA sequence
  source 1..20: mol_type = other DNA
gtctctaccagtcagtcaat

SEQ ID NO: 87911 - DNA, 20 bp, synthetic construct
  misc_feature 1..20: note = CRISPR gRNA sequence
  source 1..20: mol_type = other DNA
gggaacggtcatctaaacca

SEQ ID NO: 87912 - DNA, 20 bp, synthetic construct
  misc_feature 1..20: note = CRISPR gRNA sequence
  source 1..20: mol_type = other DNA
agaatggtttagagaaccca

SEQ ID NO: 87913 - DNA, 20 bp, synthetic construct
  misc_feature 1..20: note = CRISPR gRNA sequence
  source 1..20: mol_type = other DNA
cttagtatatccttctccaa

SEQ ID NO: 87914 - DNA, 20 bp, synthetic construct
  misc_feature 1..20: note = CRISPR gRNA sequence
  source 1..20: mol_type = other DNA
tctttactttttagcctcct

SEQ ID NO: 87915 - DNA, 20 bp, synthetic construct
  misc_feature 1..20: note = CRISPR gRNA sequence
  source 1..20: mol_type = other DNA
tcgcacgtggagagcggaag

SEQ ID NO: 87916 - DNA, 20 bp, synthetic construct
  misc_feature 1..20: note = CRISPR gRNA sequence
  source 1..20: mol_type = other DNA
gtgaccaaggaccacatgac

SEQ ID NO: 87917 - DNA, 20 bp, synthetic construct
  misc_feature 1..20: note = CRISPR gRNA sequence
  source 1..20: mol_type = other DNA
agaggacagctgaagtacct

SEQ ID NO: 87918 - DNA, 20 bp, synthetic construct
  misc_feature 1..20: note = CRISPR gRNA sequence
  source 1..20: mol_type = other DNA
caccagctaaagcagcaaag

SEQ ID NO: 87919 - DNA, 20 bp, synthetic construct
  misc_feature 1..20: note = CRISPR gRNA sequence
  source 1..20: mol_type = other DNA
aagcagcaaagcaggatata

SEQ ID NO: 87920 - DNA, 20 bp, synthetic construct
  misc_feature 1..20: note = CRISPR gRNA sequence
  source 1..20: mol_type = other DNA
agtcaggtggaagtggggaa

SEQ ID NO: 87921 - DNA, 20 bp, synthetic construct
  misc_feature 1..20: note = CRISPR gRNA sequence
  source 1..20: mol_type = other DNA
tctcaagtcagcagctgcca

SEQ ID NO: 87922 - DNA, 20 bp, synthetic construct
  misc_feature 1..20: note = CRISPR gRNA sequence
  source 1..20: mol_type = other DNA
aaaagggggcagtacttgcc

SEQ ID NO: 87923 - DNA, 20 bp, synthetic construct
  misc_feature 1..20: note = CRISPR gRNA sequence
  source 1..20: mol_type = other DNA
ttcccttggtcccctcaaaa

SEQ ID NO: 87924 - DNA, 20 bp, synthetic construct
  misc_feature 1..20: note = CRISPR gRNA sequence
  source 1..20: mol_type = other DNA
gagaggtagacactgcacca

SEQ ID NO: 87925 - DNA, 20 bp, synthetic construct
  misc_feature 1..20: note = CRISPR gRNA sequence
  source 1..20: mol_type = other DNA
catgatacaggtctgtgggg

SEQ ID NO: 87926 - DNA, 20 bp, synthetic construct
  misc_feature 1..20: note = CRISPR gRNA sequence
  source 1..20: mol_type = other DNA
attctcctctgtacagacag

SEQ ID NO: 87927 - DNA, 20 bp, synthetic construct
  misc_feature 1..20: note = CRISPR gRNA sequence
  source 1..20: mol_type = other DNA
gtgctatcctgtgggaaggt

SEQ ID NO: 87928 - DNA, 20 bp, synthetic construct
  misc_feature 1..20: note = CRISPR gRNA sequence
  source 1..20: mol_type = other DNA
gtaggaatgggctaagtatg

SEQ ID NO: 87929 - DNA, 20 bp, synthetic construct
  misc_feature 1..20: note = CRISPR gRNA sequence
  source 1..20: mol_type = other DNA
gtatgatgaatatataggtt

SEQ ID NO: 87930 - DNA, 20 bp, synthetic construct
  misc_feature 1..20: note = CRISPR gRNA sequence
  source 1..20: mol_type = other DNA
tcaaactggcttaaaataaa

SEQ ID NO: 87931 - DNA, 20 bp, synthetic construct
  misc_feature 1..20: note = CRISPR gRNA sequence
  source 1..20: mol_type = other DNA
aatattcacactgattaggc

SEQ ID NO: 87932 - DNA, 20 bp, synthetic construct
  misc_feature 1..20: note = CRISPR gRNA sequence
  source 1..20: mol_type = other DNA
tgaccaatcactgtggccag

SEQ ID NO: 87933 - DNA, 20 bp, synthetic construct
  misc_feature 1..20: note = CRISPR gRNA sequence
  source 1..20: mol_type = other DNA
tggacaacacctttggggaa

SEQ ID NO: 87934 - DNA, 20 bp, synthetic construct
  misc_feature 1..20: note = CRISPR gRNA sequence
  source 1..20: mol_type = other DNA
acacctttggggaaaagggt

SEQ ID NO: 87935 - DNA, 20 bp, synthetic construct
  misc_feature 1..20: note = CRISPR gRNA sequence
  source 1..20: mol_type = other DNA
gtcagcctccccaaaatcac

SEQ ID NO: 87936 - DNA, 20 bp, synthetic construct
  misc_feature 1..20: note = CRISPR gRNA sequence
  source 1..20: mol_type = other DNA
ccaagtggaaactaggagca

SEQ ID NO: 87937 - DNA, 20 bp, synthetic construct
  misc_feature 1..20: note = CRISPR gRNA sequence
  source 1..20: mol_type = other DNA
aactaggagcagggagttgc

SEQ ID NO: 87938 - DNA, 20 bp, synthetic construct
  misc_feature 1..20: note = CRISPR gRNA sequence
  source 1..20: mol_type = other DNA
ctattgccagttccaccaac

SEQ ID NO: 87939 - DNA, 20 bp, synthetic construct
  misc_feature 1..20: note = CRISPR gRNA sequence
  source 1..20: mol_type = other DNA
cgtgtcaggacttaggactg

SEQ ID NO: 87940 - DNA, 20 bp, synthetic construct
  misc_feature 1..20: note = CRISPR gRNA sequence
  source 1..20: mol_type = other DNA
tcaggcggcaccaatgagaa

SEQ ID NO: 87941 - DNA, 20 bp, synthetic construct
  misc_feature 1..20: note = CRISPR gRNA sequence
  source 1..20: mol_type = other DNA
gacctactttgtcctctaca

SEQ ID NO: 87942 - DNA, 20 bp, synthetic construct
  misc_feature 1..20: note = CRISPR gRNA sequence
  source 1..20: mol_type = other DNA
acatagggtagcttctgtca

SEQ ID NO: 87943 - DNA, 20 bp, synthetic construct
  misc_feature 1..20: note = CRISPR gRNA sequence
  source 1..20: mol_type = other DNA
tgtaatatttgatatctata

SEQ ID NO: 87944 - DNA, 20 bp, synthetic construct
  misc_feature 1..20: note = CRISPR gRNA sequence
  source 1..20: mol_type = other DNA
ctataaagagtatatctaac

SEQ ID NO: 87945 - DNA, 20 bp, synthetic construct
  misc_feature 1..20: note = CRISPR gRNA sequence
  source 1..20: mol_type = other DNA
ataaattatgaagcatacta

SEQ ID NO: 87946 - DNA, 20 bp, synthetic construct
  misc_feature 1..20: note = CRISPR gRNA sequence
  source 1..20: mol_type = other DNA
cacaaacacaatggtattta

SEQ ID NO: 87947 - DNA, 20 bp, synthetic construct
  misc_feature 1..20: note = CRISPR gRNA sequence
  source 1..20: mol_type = other DNA
tgggtcataggtactcatta

SEQ ID NO: 87948 - DNA, 20 bp, synthetic construct
  misc_feature 1..20: note = CRISPR gRNA sequence
  source 1..20: mol_type = other DNA
aagtctccctgaaagaaaat

SEQ ID NO: 87949 - DNA, 20 bp, synthetic construct
  misc_feature 1..20: note = CRISPR gRNA sequence
  source 1..20: mol_type = other DNA
tcagtgtttcttgggaagaa

SEQ ID NO: 87950 - DNA, 20 bp, synthetic construct
  misc_feature 1..20: note = CRISPR gRNA sequence
  source 1..20: mol_type = other DNA
taggtcttcaataaatatta

SEQ ID NO: 87951 - DNA, 20 bp, synthetic construct
  misc_feature 1..20: note = CRISPR gRNA sequence
  source 1..20: mol_type = other DNA
tcaataaatattagttggtt

SEQ ID NO: 87952 - DNA, 20 bp, synthetic construct
  misc_feature 1..20: note = CRISPR gRNA sequence
  source 1..20: mol_type = other DNA
tggtgccgcctgaccacaga

SEQ ID NO: 87953 - DNA, 20 bp, synthetic construct
  misc_feature 1..20: note = CRISPR gRNA sequence
  source 1..20: mol_type = other DNA
ctgccacctggtggatacag

SEQ ID NO: 87954 - DNA, 20 bp, synthetic construct
  misc_feature 1..20: note = CRISPR gRNA sequence
  source 1..20: mol_type = other DNA
ctgaagagtccctagaggag

SEQ ID NO: 87955 - DNA, 20 bp, synthetic construct
  misc_feature 1..20: note = CRISPR gRNA sequence
  source 1..20: mol_type = other DNA
ctagaaacgaggaaagaggc

SEQ ID NO: 87956 - DNA, 20 bp, synthetic construct
  misc_feature 1..20: note = CRISPR gRNA sequence
  source 1..20: mol_type = other DNA
cacccaagcaactccctgct

SEQ ID NO: 87957 - DNA, 20 bp, synthetic construct
  misc_feature 1..20: note = CRISPR gRNA sequence
  source 1..20: mol_type = other DNA
agtttccacttggggaatcc

SEQ ID NO: 87958 - DNA, 20 bp, synthetic construct
  misc_feature 1..20: note = CRISPR gRNA sequence
  source 1..20: mol_type = other DNA
atgtatcatcctcctggcca

SEQ ID NO: 87959 - DNA, 20 bp, synthetic construct
  misc_feature 1..20: note = CRISPR gRNA sequence
  source 1..20: mol_type = other DNA
ggcctaatcagtgtgaatat

SEQ ID NO: 87960 - DNA, 20 bp, synthetic construct
  misc_feature 1..20: note = CRISPR gRNA sequence
  source 1..20: mol_type = other DNA
tgtgaatattagggcttttg

SEQ ID NO: 87961 - DNA, 20 bp, synthetic construct
  misc_feature 1..20: note = CRISPR gRNA sequence
  source 1..20: mol_type = other DNA
ggtacaaagatgccttcttt

SEQ ID NO: 87962 - DNA, 20 bp, synthetic construct
  misc_feature 1..20: note = CRISPR gRNA sequence
  source 1..20: mol_type = other DNA
ataaatcctttttattttaa

SEQ ID NO: 87963 - DNA, 20 bp, synthetic construct
  misc_feature 1..20: note = CRISPR gRNA sequence
  source 1..20: mol_type = other DNA
ttattttaagccagtttgaa

SEQ ID NO: 87964 - DNA, 20 bp, synthetic construct
  misc_feature 1..20: note = CRISPR gRNA sequence
  source 1..20: mol_type = other DNA
gccagtttgaattaggtttt

SEQ ID NO: 87965 - DNA, 20 bp, synthetic construct
  misc_feature 1..20: note = CRISPR gRNA sequence
  source 1..20: mol_type = other DNA
gggaatacaggtaaggtcac

SEQ ID NO: 87966 - DNA, 20 bp, synthetic construct
  misc_feature 1..20: note = CRISPR gRNA sequence
  source 1..20: mol_type = other DNA
acagacctgtatcatggggg

SEQ ID NO: 87967 - DNA, 20 bp, synthetic construct
  misc_feature 1..20: note = CRISPR gRNA sequence
  source 1..20: mol_type = other DNA
tgccaaaggaaaagcctcct

SEQ ID NO: 87968 - DNA, 20 bp, synthetic construct
  misc_feature 1..20: note = CRISPR gRNA sequence
  source 1..20: mol_type = other DNA
gggaccaagggaattttatc

SEQ ID NO: 87969 - DNA, 20 bp, synthetic construct
  misc_feature 1..20: note = CRISPR gRNA sequence
  source 1..20: mol_type = other DNA
catggtaaccttgaggactg

SEQ ID NO: 87970 - DNA, 20 bp, synthetic construct
  misc_feature 1..20: note = CRISPR gRNA sequence
  source 1..20: mol_type = other DNA
ctgacttttttcgagggcgc

SEQ ID NO: 87971 - DNA, 20 bp, synthetic construct
  misc_feature 1..20: note = CRISPR gRNA sequence
  source 1..20: mol_type = other DNA
cacttgctgtatcctctata

SEQ ID NO: 87972 - DNA, 20 bp, synthetic construct
  misc_feature 1..20: note = CRISPR gRNA sequence
  source 1..20: mol_type = other DNA
gtatcctctatatcctgctt

SEQ ID NO: 87973 - DNA, 20 bp, synthetic construct
  misc_feature 1..20: note = CRISPR gRNA sequence
  source 1..20: mol_type = other DNA
ggccagaataggtggagaga

SEQ ID NO: 87974 - DNA, 20 bp, synthetic construct
  misc_feature 1..20: note = CRISPR gRNA sequence
  source 1..20: mol_type = other DNA
gcgagaggaccggccccagt

SEQ ID NO: 87975 - DNA, 20 bp, synthetic construct
  misc_feature 1..20: note = CRISPR gRNA sequence
  source 1..20: mol_type = other DNA
tccttacctgggccagtctc

SEQ ID NO: 87976 - DNA, 20 bp, synthetic construct
  misc_feature 1..20: note = CRISPR gRNA sequence
  source 1..20: mol_type = other DNA
ctgggttctctaaaccattc

SEQ ID NO: 87977 - DNA, 20 bp, synthetic construct
  misc_feature 1..20: note = CRISPR gRNA sequence
  source 1..20: mol_type = other DNA
ggaataggggagtgaggcaa

SEQ ID NO: 87978 - DNA, 20 bp, synthetic construct
  misc_feature 1..20: note = CRISPR gRNA sequence
  source 1..20: mol_type = other DNA
cctcaacgatggaactgaag

SEQ ID NO: 87979 - DNA, 20 bp, synthetic construct
  misc_feature 1..20: note = CRISPR gRNA sequence
  source 1..20: mol_type = other DNA
gagagaagagtggaattgga

SEQ ID NO: 87980 - DNA, 20 bp, synthetic construct
  misc_feature 1..20: note = CRISPR gRNA sequence
  source 1..20: mol_type = other DNA
tggccccggccaccaagcct

SEQ ID NO: 87981 - DNA, 20 bp, synthetic construct
  misc_feature 1..20: note = CRISPR gRNA sequence
  source 1..20: mol_type = other DNA
gtgaggaaccctttaagaag

SEQ ID NO: 87982 - DNA, 20 bp, synthetic construct
  misc_feature 1..20: note = CRISPR gRNA sequence
  source 1..20: mol_type = other DNA
accgataggcatcataaaca

SEQ ID NO: 87983 - DNA, 20 bp, synthetic construct
  misc_feature 1..20: note = CRISPR gRNA sequence
  source 1..20: mol_type = other DNA
aggggagctgaaggtagaga

SEQ ID NO: 87984 - DNA, 20 bp, synthetic construct
  misc_feature 1..20: note = CRISPR gRNA sequence
  source 1..20: mol_type = other DNA
tcctggctaacatggtgaaa

SEQ ID NO: 87985 - DNA, 20 bp, synthetic construct
  misc_feature 1..20: note = CRISPR gRNA sequence
  source 1..20: mol_type = other DNA
aatggcgtgaacctgggagg

SEQ ID NO: 87986 - DNA, 20 bp, synthetic construct
  misc_feature 1..20: note = CRISPR gRNA sequence
  source 1..20: mol_type = other DNA
gaggcggagcttgcagtgag

SEQ ID NO: 87987 - DNA, 20 bp, synthetic construct
  misc_feature 1..20: note = CRISPR gRNA sequence
  source 1..20: mol_type = other DNA
cagctctgacttcatctctg

SEQ ID NO: 87988 - DNA, 20 bp, synthetic construct
  misc_feature 1..20: note = CRISPR gRNA sequence
  source 1..20: mol_type = other DNA
ggcacaaagtcaaactggca

SEQ ID NO: 87989 - DNA, 20 bp, synthetic construct
  misc_feature 1..20: note = CRISPR gRNA sequence
  source 1..20: mol_type = other DNA
ggaccctacctctcccacat

SEQ ID NO: 87990 - DNA, 20 bp, synthetic construct
  misc_feature 1..20: note = CRISPR gRNA sequence
  source 1..20: mol_type = other DNA
gagaaagctggaggtcacac

SEQ ID NO: 87991 - DNA, 20 bp, synthetic construct
  misc_feature 1..20: note = CRISPR gRNA sequence
  source 1..20: mol_type = other DNA
aaactgtaaaggaagagata

SEQ ID NO: 87992 - DNA, 20 bp, synthetic construct
  misc_feature 1..20: note = CRISPR gRNA sequence
  source 1..20: mol_type = other DNA
tacgaacatattctgccctt

SEQ ID NO: 87993 - DNA, 20 bp, synthetic construct
  misc_feature 1..20: note = CRISPR gRNA sequence
  source 1..20: mol_type = other DNA
ccttccccctccattcaatc

SEQ ID NO: 87994 - DNA, 20 bp, synthetic construct
  misc_feature 1..20: note = CRISPR gRNA sequence
  source 1..20: mol_type = other DNA
ccgctccactttgcagaaac

SEQ ID NO: 87995 - DNA, 20 bp, synthetic construct
  misc_feature 1..20: note = CRISPR gRNA sequence
  source 1..20: mol_type = other DNA
gagcagcgggggaagtcgtg

SEQ ID NO: 87996 - DNA, 20 bp, synthetic construct
  misc_feature 1..20: note = CRISPR gRNA sequence
  source 1..20: mol_type = other DNA
ttaagtaatgagaacttggg

SEQ ID NO: 87997 - DNA, 20 bp, synthetic construct
  misc_feature 1..20: note = CRISPR gRNA sequence
  source 1..20: mol_type = other DNA
tatttttgagaattagagaa

SEQ ID NO: 87998 - DNA, 20 bp, synthetic construct
  misc_feature 1..20: note = CRISPR gRNA sequence
  source 1..20: mol_type = other DNA
ctttgttttgtggctgttat

SEQ ID NO: 87999 - DNA, 20 bp, synthetic construct
  misc_feature 1..20: note = CRISPR gRNA sequence
  source 1..20: mol_type = other DNA
aaatgaaaatttcttgctaa

SEQ ID NO: 88000 - DNA, 20 bp, synthetic construct
  misc_feature 1..20: note = CRISPR gRNA sequence
  source 1..20: mol_type = other DNA
aatccccctatctcttcctt

SEQ ID NO: 88001 - DNA, 20 bp, synthetic construct
  misc_feature 1..20: note = CRISPR gRNA sequence
  source 1..20: mol_type = other DNA
tatctcttcctttacagttt

SEQ ID NO: 88002 - DNA, 20 bp, synthetic construct
  misc_feature 1..20: note = CRISPR gRNA sequence
  source 1..20: mol_type = other DNA
aaagaccaccggggaaattc

SEQ ID NO: 88003 - DNA, 20 bp, synthetic construct
  misc_feature 1..20: note = CRISPR gRNA sequence
  source 1..20: mol_type = other DNA
ccaccggggaaattcggagg

SEQ ID NO: 88004 - DNA, 20 bp, synthetic construct
  misc_feature 1..20: note = CRISPR gRNA sequence
  source 1..20: mol_type = other DNA
gggaaattcggaggctttgt

SEQ ID NO: 88005 - DNA, 20 bp, synthetic construct
  misc_feature 1..20: note = CRISPR gRNA sequence
  source 1..20: mol_type = other DNA
agcaagggcatgggagcaga

SEQ ID NO: 88006 - DNA, 20 bp, synthetic construct
  misc_feature 1..20: note = CRISPR gRNA sequence
  source 1..20: mol_type = other DNA
ggaaaatcttgtgtgtgacc

SEQ ID NO: 88007 - DNA, 20 bp, synthetic construct
  misc_feature 1..20: note = CRISPR gRNA sequence
  source 1..20: mol_type = other DNA
ctctgccttgtcagaagata

SEQ ID NO: 88008 - DNA, 20 bp, synthetic construct
  misc_feature 1..20: note = CRISPR gRNA sequence
  source 1..20: mol_type = other DNA
gttggctttgcaaacttgct

SEQ ID NO: 88009 - DNA, 20 bp, synthetic construct
  misc_feature 1..20: note = CRISPR gRNA sequence
  source 1..20: mol_type = other DNA
ttttgtatttttagtagaaa

SEQ ID NO: 88010 - DNA, 20 bp, synthetic construct
  misc_feature 1..20: note = CRISPR gRNA sequence
  source 1..20: mol_type = other DNA
tgccttggccttccaaagtg

SEQ ID NO: 88011 - DNA, 20 bp, synthetic construct
  misc_feature 1..20: note = CRISPR gRNA sequence
  source 1..20: mol_type = other DNA
cccaccactggagacaaaag

SEQ ID NO: 88012 - DNA, 20 bp, synthetic construct
  misc_feature 1..20: note = CRISPR gRNA sequence
  source 1..20: mol_type = other DNA
agacaaaaggtaggtttgat

SEQ ID NO: 88013 - DNA, 20 bp, synthetic construct
  misc_feature 1..20: note = CRISPR gRNA sequence
  source 1..20: mol_type = other DNA
gtagttttagatggcagagg

SEQ ID NO: 88014 - DNA, 20 bp, synthetic construct
  misc_feature 1..20: note = CRISPR gRNA sequence
  source 1..20: mol_type = other DNA
aggaaaggtcctcgccctga

SEQ ID NO: 88015 - DNA, 20 bp, synthetic construct
  misc_feature 1..20: note = CRISPR gRNA sequence
  source 1..20: mol_type = other DNA
gacttggtttaccagggaaa

SEQ ID NO: 88016 - DNA, 20 bp, synthetic construct
  misc_feature 1..20: note = CRISPR gRNA sequence
  source 1..20: mol_type = other DNA
tggtccagcactactgaagt

SEQ ID NO: 88017 - DNA, 20 bp, synthetic construct
  misc_feature 1..20: note = CRISPR gRNA sequence
  source 1..20: mol_type = other DNA
gacaactgttagggtcttag

SEQ ID NO: 88018 - DNA, 20 bp, synthetic construct
  misc_feature 1..20: note = CRISPR gRNA sequence
  source 1..20: mol_type = other DNA
gtcttagtaatgcttgttcc

SEQ ID NO: 88019 - DNA, 20 bp, synthetic construct
  misc_feature 1..20: note = CRISPR gRNA sequence
  source 1..20: mol_type = other DNA
gacacctgtctgccaaagca

SEQ ID NO: 88020 - DNA, 20 bp, synthetic construct
  misc_feature 1..20: note = CRISPR gRNA sequence
  source 1..20: mol_type = other DNA
gaggggtgggtggtgggatg

SEQ ID NO: 88021 - DNA, 20 bp, synthetic construct
  misc_feature 1..20: note = CRISPR gRNA sequence
  source 1..20: mol_type = other DNA
ataggaccccctcacccatg

SEQ ID NO: 88022 - DNA, 20 bp, synthetic construct
  misc_feature 1..20: note = CRISPR gRNA sequence
  source 1..20: mol_type = other DNA
cttccctgacatcaaagctc

SEQ ID NO: 88023 - DNA, 20 bp, synthetic construct
  misc_feature 1..20: note = CRISPR gRNA sequence
  source 1..20: mol_type = other DNA
atgtggagagcaaggagtgg

SEQ ID NO: 88024 - DNA, 20 bp, synthetic construct
  misc_feature 1..20: note = CRISPR gRNA sequence
  source 1..20: mol_type = other DNA
ggaacagcttaacttgctcg

SEQ ID NO: 88025 - DNA, 20 bp, synthetic construct
  misc_feature 1..20: note = CRISPR gRNA sequence
  source 1..20: mol_type = other DNA
aaaagtcagaggtctttggg

SEQ ID NO: 88026 - DNA, 20 bp, synthetic construct
  misc_feature 1..20: note = CRISPR gRNA sequence
  source 1..20: mol_type = other DNA
acagcctcagtcattatgta

SEQ ID NO: 88027 - DNA, 20 bp, synthetic construct
  misc_feature 1..20: note = CRISPR gRNA sequence
  source 1..20: mol_type = other DNA
gcagaggatgaagagaactt

SEQ ID NO: 88028 - DNA, 20 bp, synthetic construct
  misc_feature 1..20: note = CRISPR gRNA sequence
  source 1..20: mol_type = other DNA
actcccatccccagtctggt

SEQ ID NO: 88029 - DNA, 20 bp, synthetic construct
  misc_feature 1..20: note = CRISPR gRNA sequence
  source 1..20: mol_type = other DNA
caagggttctttaatttgga

SEQ ID NO: 88030 - DNA, 20 bp, synthetic construct
  misc_feature 1..20: note = CRISPR gRNA sequence
  source 1..20: mol_type = other DNA
tcagttccatcgttgaggtc

SEQ ID NO: 88031 - DNA, 20 bp, synthetic construct
  misc_feature 1..20: note = CRISPR gRNA sequence
  source 1..20: mol_type = other DNA
tgcccgatctgcacatgccc

SEQ ID NO: 88032 - DNA, 20 bp, synthetic construct
  misc_feature 1..20: note = CRISPR gRNA sequence
  source 1..20: mol_type = other DNA
ctcagcaaccctgagccact

SEQ ID NO: 88033 - DNA, 20 bp, synthetic construct
  misc_feature 1..20: note = CRISPR gRNA sequence
  source 1..20: mol_type = other DNA
acacactagaatagagacac

SEQ ID NO: 88034 - DNA, 20 bp, synthetic construct
  misc_feature 1..20: note = CRISPR gRNA sequence
  source 1..20: mol_type = other DNA
ttcctggagacccttctaag

SEQ ID NO: 88035 - DNA, 20 bp, synthetic construct
  misc_feature 1..20: note = CRISPR gRNA sequence
  source 1..20: mol_type = other DNA
attgcctcactcccctattc

SEQ ID NO: 88036 - DNA, 20 bp, synthetic construct
  misc_feature 1..20: note = CRISPR gRNA sequence
  source 1..20: mol_type = other DNA
aacggtcatctaaaccaaag

SEQ ID NO: 88037 - DNA, 20 bp, synthetic construct
  misc_feature 1..20: note = CRISPR gRNA sequence
  source 1..20: mol_type = other DNA
tgactttgctgtcctgggct

SEQ ID NO: 88038 - DNA, 20 bp, synthetic construct
  misc_feature 1..20: note = CRISPR gRNA sequence
  source 1..20: mol_type = other DNA
tatccttctccaattgggtc

SEQ ID NO: 88039 - DNA, 20 bp, synthetic construct
  misc_feature 1..20: note = CRISPR gRNA sequence
  source 1..20: mol_type = other DNA
acctcctgtgcctctggcgt

SEQ ID NO: 88040 - DNA, 20 bp, synthetic construct
  misc_feature 1..20: note = CRISPR gRNA sequence
  source 1..20: mol_type = other DNA
ctctccacctattctggccc

SEQ ID NO: 88041 - DNA, 20 bp, synthetic construct
  misc_feature 1..20: note = CRISPR gRNA sequence
  source 1..20: mol_type = other DNA
aacatgatcttaccaactgt

SEQ ID NO: 88042 - DNA, 20 bp, synthetic construct
  misc_feature 1..20: note = CRISPR gRNA sequence
  source 1..20: mol_type = other DNA
gcccagggtcagggagatgg

SEQ ID NO: 88043 - DNA, 20 bp, synthetic construct
  misc_feature 1..20: note = CRISPR gRNA sequence
  source 1..20: mol_type = other DNA
aagggcagcagaagccaaaa

SEQ ID NO: 88044 - DNA, 20 bp, synthetic construct
  misc_feature 1..20: note = CRISPR gRNA sequence
  source 1..20: mol_type = other DNA
taataaagacttaaaggagc

SEQ ID NO: 88045 - DNA, 20 bp, synthetic construct
  misc_feature 1..20: note = CRISPR gRNA sequence
  source 1..20: mol_type = other DNA
tgatacaggtctgtggggaa

SEQ ID NO: 88046 - DNA, 20 bp, synthetic construct
  misc_feature 1..20: note = CRISPR gRNA sequence
  source 1..20: mol_type = other DNA
tagtagaggcccttctttgc

SEQ ID NO: 88047 - DNA, 20 bp, synthetic construct
  misc_feature 1..20: note = CRISPR gRNA sequence
  source 1..20: mol_type = other DNA
tggttgctgcctctgacctt

SEQ ID NO: 88048 - DNA, 20 bp, synthetic construct
  misc_feature 1..20: note = CRISPR gRNA sequence
  source 1..20: mol_type = other DNA
gaccttttcagcttgatacc

SEQ ID NO: 88049 - DNA, 20 bp, synthetic construct
  misc_feature 1..20: note = CRISPR gRNA sequence
  source 1..20: mol_type = other DNA
aatatataggttagggatct

SEQ ID NO: 88050 - DNA, 20 bp, synthetic construct
  misc_feature 1..20: note = CRISPR gRNA sequence
  source 1..20: mol_type = other DNA
tcacagaaaacctaattcaa

SEQ ID NO: 88051 - DNA, 20 bp, synthetic construct
  misc_feature 1..20: note = CRISPR gRNA sequence
  source 1..20: mol_type = other DNA
ttcaaactggcttaaaataa

SEQ ID NO: 88052 - DNA, 20 bp, synthetic construct
  misc_feature 1..20: note = CRISPR gRNA sequence
  source 1..20: mol_type = other DNA
cttaatggctgccagcattc

SEQ ID NO: 88053 - DNA, 20 bp, synthetic construct
  misc_feature 1..20: note = CRISPR gRNA sequence
  source 1..20: mol_type = other DNA
agcaaaagccctaatattca

SEQ ID NO: 88054 - DNA, 20 bp, synthetic construct
  misc_feature 1..20: note = CRISPR gRNA sequence
  source 1..20: mol_type = other DNA
caggaggatgatacatgcta

SEQ ID NO: 88055 - DNA, 20 bp, synthetic construct
  misc_feature 1..20: note = CRISPR gRNA sequence
  source 1..20: mol_type = other DNA
ggtcagcctccccaaaatca

SEQ ID NO: 88056 - DNA, 20 bp, synthetic construct
  misc_feature 1..20: note = CRISPR gRNA sequence
  source 1..20: mol_type = other DNA
agtggaaactaggagcaggg

SEQ ID NO: 88057 - DNA, 20 bp, synthetic construct
  misc_feature 1..20: note = CRISPR gRNA sequence
  source 1..20: mol_type = other DNA
taacaccaggctactcttat

SEQ ID NO: 88058 - DNA, 20 bp, synthetic construct
  misc_feature 1..20: note = CRISPR gRNA sequence
  source 1..20: mol_type = other DNA
gctaagttgagatcagctag

SEQ ID NO: 88059 - DNA, 20 bp, synthetic construct
  misc_feature 1..20: note = CRISPR gRNA sequence
  source 1..20: mol_type = other DNA
atacaagctgtagcctcttt

SEQ ID NO: 88060 - DNA, 20 bp, synthetic construct
  misc_feature 1..20: note = CRISPR gRNA sequence
  source 1..20: mol_type = other DNA
gagatggagctccttccttt

SEQ ID NO: 88061 - DNA, 20 bp, synthetic construct
  misc_feature 1..20: note = CRISPR gRNA sequence
  source 1..20: mol_type = other DNA
cttaatttttgtcttctcat

SEQ ID NO: 88062 - DNA, 20 bp, synthetic construct
  misc_feature 1..20: note = CRISPR gRNA sequence
  source 1..20: mol_type = other DNA
cgtgtcaggacttaggactg

SEQ ID NO: 88063 - DNA, 20 bp, synthetic construct
  misc_feature 1..20: note = CRISPR gRNA sequence
  source 1..20: mol_type = other DNA
ctactttgtcctctacatag

SEQ ID NO: 88064 - DNA, 20 bp, synthetic construct
  misc_feature 1..20: note = CRISPR gRNA sequence
  source 1..20: mol_type = other DNA
tcttggttcttcccaagaaa

SEQ ID NO: 88065 - DNA, 20 bp, synthetic construct
  misc_feature 1..20: note = CRISPR gRNA sequence
  source 1..20: mol_type = other DNA
tgttcatttatttccaccac

SEQ ID NO: 88066 - DNA, 20 bp, synthetic construct
  misc_feature 1..20: note = CRISPR gRNA sequence
  source 1..20: mol_type = other DNA
ttaaaacattttaaatacca

SEQ ID NO: 88067 - DNA, 20 bp, synthetic construct
  misc_feature 1..20: note = CRISPR gRNA sequence
  source 1..20: mol_type = other DNA
gaacacatgaagtctccctg

SEQ ID NO: 88068 - DNA, 20 bp, synthetic construct
  misc_feature 1..20: note = CRISPR gRNA sequence
  source 1..20: mol_type = other DNA
gatgctgccacctggtggat

SEQ ID NO: 88069 - DNA, 20 bp, synthetic construct
  misc_feature 1..20: note = CRISPR gRNA sequence
  source 1..20: mol_type = other DNA
aggaatgagaagacaaaaat

SEQ ID NO: 88070 - DNA, 20 bp, synthetic construct
  misc_feature 1..20: note = CRISPR gRNA sequence
  source 1..20: mol_type = other DNA
gctccatctctaatatggag

SEQ ID NO: 88071 - DNA, 20 bp, synthetic construct
  misc_feature 1..20: note = CRISPR gRNA sequence
  source 1..20: mol_type = other DNA
gagactgaagagtccctaga

SEQ ID NO: 88072 - DNA, 20 bp, synthetic construct
  misc_feature 1..20: note = CRISPR gRNA sequence
  source 1..20: mol_type = other DNA
ccctctccttccttctgaga

SEQ ID NO: 88073 - DNA, 20 bp, synthetic construct
  misc_feature 1..20: note = CRISPR gRNA sequence
  source 1..20: mol_type = other DNA
tgagggaaatgcaagactga

SEQ ID NO: 88074 - DNA, 20 bp, synthetic construct
  misc_feature 1..20: note = CRISPR gRNA sequence
  source 1..20: mol_type = other DNA
gaaatgcaagactgaggaga

SEQ ID NO: 88075 - DNA, 20 bp, synthetic construct
  misc_feature 1..20: note = CRISPR gRNA sequence
  source 1..20: mol_type = other DNA
ccaaaggtgttgtccatgat

SEQ ID NO: 88076 - DNA, 20 bp, synthetic construct
  misc_feature 1..20: note = CRISPR gRNA sequence
  source 1..20: mol_type = other DNA
tcctacagaagatgcaacag

SEQ ID NO: 88077 - DNA, 20 bp, synthetic construct
  misc_feature 1..20: note = CRISPR gRNA sequence
  source 1..20: mol_type = other DNA
gactcagctgtctgtacaga

SEQ ID NO: 88078 - DNA, 20 bp, synthetic construct
  misc_feature 1..20: note = CRISPR gRNA sequence
  source 1..20: mol_type = other DNA
gagaatggacttccttagga

SEQ ID NO: 88079 - DNA, 20 bp, synthetic construct
  misc_feature 1..20: note = CRISPR gRNA sequence
  source 1..20: mol_type = other DNA
cagctgctgacttgagaggg

SEQ ID NO: 88080 - DNA, 20 bp, synthetic construct
  misc_feature 1..20: note = CRISPR gRNA sequence
  source 1..20: mol_type = other DNA
tagccactttcagggcacct

SEQ ID NO: 88081 - DNA, 20 bp, synthetic construct
  misc_feature 1..20: note = CRISPR gRNA sequence
  source 1..20: mol_type = other DNA
acctgaagaaagcctggggg

SEQ ID NO: 88082 - DNA, 20 bp, synthetic construct
  misc_feature 1..20: note = CRISPR gRNA sequence
  source 1..20: mol_type = other DNA
agaggaacacagtaaggtgt

SEQ ID NO: 88083 - DNA, 20 bp, synthetic construct
  misc_feature 1..20: note = CRISPR gRNA sequence
  source 1..20: mol_type = other DNA
agtgtacttggctctgagct

SEQ ID NO: 88084 - DNA, 20 bp, synthetic construct
  misc_feature 1..20: note = CRISPR gRNA sequence
  source 1..20: mol_type = other DNA
ctggaccaaatttagttcac

SEQ ID NO: 88085 - DNA, 20 bp, synthetic construct
  misc_feature 1..20: note = CRISPR gRNA sequence
  source 1..20: mol_type = other DNA
cttcccagtgaacctttctc

SEQ ID NO: 88086 - DNA, 20 bp, synthetic construct
  misc_feature 1..20: note = CRISPR gRNA sequence
  source 1..20: mol_type = other DNA
agagatacagcttgtcattg

SEQ ID NO: 88087 - DNA, 20 bp, synthetic construct
  misc_feature 1..20: note = CRISPR gRNA sequence
  source 1..20: mol_type = other DNA
ggtaggagagaacagaggca

SEQ ID NO: 88088 - DNA, 20 bp, synthetic construct
  misc_feature 1..20: note = CRISPR gRNA sequence
  source 1..20: mol_type = other DNA
tgtcagactgaaaaaggacc

SEQ ID NO: 88089 - DNA, 20 bp, synthetic construct
  misc_feature 1..20: note = CRISPR gRNA sequence
  source 1..20: mol_type = other DNA
ctacttgggaggctgaggca

SEQ ID NO: 88090 - DNA, 20 bp, synthetic construct
  misc_feature 1..20: note = CRISPR gRNA sequence
  source 1..20: mol_type = other DNA
atctcaaaaaaaaaaaaaaa

SEQ ID NO: 88091 - DNA, 20 bp, synthetic construct
  misc_feature 1..20: note = CRISPR gRNA sequence
  source 1..20: mol_type = other DNA
caaaaaaaaaaaaaaaaaag

SEQ ID NO: 88092 - DNA, 20 bp, synthetic construct
  misc_feature 1..20: note = CRISPR gRNA sequence
  source 1..20: mol_type = other DNA
cggccttgctgtggggaaga

SEQ ID NO: 88093 - DNA, 20 bp, synthetic construct
  misc_feature 1..20: note = CRISPR gRNA sequence
  source 1..20: mol_type = other DNA
tgaaatgcccagcaggtgct

SEQ ID NO: 88094 - DNA, 20 bp, synthetic construct
  misc_feature 1..20: note = CRISPR gRNA sequence
  source 1..20: mol_type = other DNA
ctgccatcccggcatgaggg

SEQ ID NO: 88095 - DNA, 20 bp, synthetic construct
  misc_feature 1..20: note = CRISPR gRNA sequence
  source 1..20: mol_type = other DNA
ggcactcctcatctctttac

SEQ ID NO: 88096 - DNA, 20 bp, synthetic construct
  misc_feature 1..20: note = CRISPR gRNA sequence
  source 1..20: mol_type = other DNA
atctctttacccagaaaggc

SEQ ID NO: 88097 - DNA, 20 bp, synthetic construct
  misc_feature 1..20: note = CRISPR gRNA sequence
  source 1..20: mol_type = other DNA
ttacccagaaaggcagagaa

SEQ ID NO: 88098 - DNA, 20 bp, synthetic construct
  misc_feature 1..20: note = CRISPR gRNA sequence
  source 1..20: mol_type = other DNA
ccacttgccttctccgaaaa

SEQ ID NO: 88099 - DNA, 20 bp, synthetic construct
  misc_feature 1..20: note = CRISPR gRNA sequence
  source 1..20: mol_type = other DNA
ggattgggaatccatgttag

SEQ ID NO: 88100 - DNA, 20 bp, synthetic construct
  misc_feature 1..20: note = CRISPR gRNA sequence
  source 1..20: mol_type = other DNA
cattgcatatgcctgggagg

SEQ ID NO: 88101 - DNA, 20 bp, synthetic construct
  misc_feature 1..20: note = CRISPR gRNA sequence
  source 1..20: mol_type = other DNA
ccccacccccgctccacttt

SEQ ID NO: 88102 - DNA, 20 bp, synthetic construct
  misc_feature 1..20: note = CRISPR gRNA sequence
  source 1..20: mol_type = other DNA
ttttttccaagcctagaagg

SEQ ID NO: 88103 - DNA, 20 bp, synthetic construct
  misc_feature 1..20: note = CRISPR gRNA sequence
  source 1..20: mol_type = other DNA
gcaatggtgaggagtatttt

SEQ ID NO: 88104 - DNA, 20 bp, synthetic construct
  misc_feature 1..20: note = CRISPR gRNA sequence
  source 1..20: mol_type = other DNA
agggcagtatggggtcagag

SEQ ID NO: 88105 - DNA, 20 bp, synthetic construct
  misc_feature 1..20: note = CRISPR gRNA sequence
  source 1..20: mol_type = other DNA
ttttccagatttaggagact

SEQ ID NO: 88106 - DNA, 20 bp, synthetic construct
  misc_feature 1..20: note = CRISPR gRNA sequence
  source 1..20: mol_type = other DNA
acttcagaaaggtggggcag

SEQ ID NO: 88107 - DNA, 20 bp, synthetic construct
  misc_feature 1..20: note = CRISPR gRNA sequence
  source 1..20: mol_type = other DNA
ttttcggagaaggcaagtgg

SEQ ID NO: 88108 - DNA, 20 bp, synthetic construct
  misc_feature 1..20: note = CRISPR gRNA sequence
  source 1..20: mol_type = other DNA
aatttttttttgtattttta

SEQ ID NO: 88109 - DNA, 20 bp, synthetic construct
  misc_feature 1..20: note = CRISPR gRNA sequence
  source 1..20: mol_type = other DNA
ctcctacctcagcaagatgt

SEQ ID NO: 88110 - DNA, 20 bp, synthetic construct
  misc_feature 1..20: note = CRISPR gRNA sequence
  source 1..20: mol_type = other DNA
tggcagaggttctgattctt

SEQ ID NO: 88111 - DNA, 20 bp, synthetic construct
  misc_feature 1..20: note = CRISPR gRNA sequence
  source 1..20: mol_type = other DNA
catgtccttccccacttcag

SEQ ID NO: 88112 - DNA, 20 bp, synthetic construct
  misc_feature 1..20: note = CRISPR gRNA sequence
  source 1..20: mol_type = other DNA
ttcagtggccctcccacaca

SEQ ID NO: 88113 - DNA, 20 bp, synthetic construct
  misc_feature 1..20: note = CRISPR gRNA sequence
  source 1..20: mol_type = other DNA
tgtctctaccagtcagtcaa

SEQ ID NO: 88114 - DNA, 20 bp, synthetic construct
  misc_feature 1..20: note = CRISPR gRNA sequence
  source 1..20: mol_type = other DNA
cgggaacggtcatctaaacc

SEQ ID NO: 88115 - DNA, 20 bp, synthetic construct
  misc_feature 1..20: note = CRISPR gRNA sequence
  source 1..20: mol_type = other DNA
ggatcttttggttttaaatc

SEQ ID NO: 88116 - DNA, 20 bp, synthetic construct
  misc_feature 1..20: note = CRISPR gRNA sequence
  source 1..20: mol_type = other DNA
ggatttattggttcatgtaa

SEQ ID NO: 88117 - DNA, 20 bp, synthetic construct
  misc_feature 1..20: note = CRISPR gRNA sequence
  source 1..20: mol_type = other DNA
ttttccccatttatgtccaa

SEQ ID NO: 88118 - DNA, 20 bp, synthetic construct
  misc_feature 1..20: note = CRISPR gRNA sequence
  source 1..20: mol_type = other DNA
aaaaagaaggcatctttgta

SEQ ID NO: 88119 - DNA, 20 bp, synthetic construct
  misc_feature 1..20: note = CRISPR gRNA sequence
  source 1..20: mol_type = other DNA
ctgtggtcaggcggcaccaa

SEQ ID NO: 88120 - DNA, 20 bp, synthetic construct
  misc_feature 1..20: note = CRISPR gRNA sequence
  source 1..20: mol_type = other DNA
cagggaatcttggttcttcc

SEQ ID NO: 88121 - DNA, 20 bp, synthetic construct
  misc_feature 1..20: note = CRISPR gRNA sequence
  source 1..20: mol_type = other DNA
atttccaccacagcagattt

SEQ ID NO: 88122 - DNA, 20 bp, synthetic construct
  misc_feature 1..20: note = CRISPR gRNA sequence
  source 1..20: mol_type = other DNA
gaattaggttttctgtgatt

SEQ ID NO: 88123 - DNA, 20 bp, synthetic construct
  misc_feature 1..20: note = CRISPR gRNA sequence
  source 1..20: mol_type = other DNA
tgactgaggctgttagccct

SEQ ID NO: 88124 - DNA, 20 bp, synthetic construct
  misc_feature 1..20: note = CRISPR gRNA sequence
  source 1..20: mol_type = other DNA
gaatcagaacctctgccatc

SEQ ID NO: 88125 - DNA, 20 bp, synthetic construct
  misc_feature 1..20: note = CRISPR gRNA sequence
  source 1..20: mol_type = other DNA
tctgaagtctcctaaatctg

SEQ ID NO: 88126 - DNA, 20 bp, synthetic construct
  misc_feature 1..20: note = CRISPR gRNA sequence
  source 1..20: mol_type = other DNA
atactgccctcctccccctc

SEQ ID NO: 88127 - DNA, 20 bp, synthetic construct
  misc_feature 1..20: note = CRISPR gRNA sequence
  source 1..20: mol_type = other DNA
aaaaacaacaataacagcca

SEQ ID NO: 88128 - DNA, 20 bp, synthetic construct
  misc_feature 1..20: note = CRISPR gRNA sequence
  source 1..20: mol_type = other DNA
tgcccttctaggcttggaaa

SEQ ID NO: 88129 - DNA, 20 bp, synthetic construct
  misc_feature 1..20: note = CRISPR gRNA sequence
  source 1..20: mol_type = other DNA
gtgaggatgatgggcatcaa

SEQ ID NO: 88130 - DNA, 20 bp, synthetic construct
  misc_feature 1..20: note = CRISPR gRNA sequence
  source 1..20: mol_type = other DNA
tcttttggttttaaatcaca

SEQ ID NO: 88131 - DNA, 20 bp, synthetic construct
  misc_feature 1..20: note = CRISPR gRNA sequence
  source 1..20: mol_type = other DNA
gacccataacacatatacat

SEQ ID NO: 88132 - DNA, 20 bp, synthetic construct
  misc_feature 1..20: note = CRISPR gRNA sequence
  source 1..20: mol_type = other DNA
aaaaatatctatagcagata

SEQ ID NO: 88133 - DNA, 20 bp, synthetic construct
  misc_feature 1..20: note = CRISPR gRNA sequence
  source 1..20: mol_type = other DNA
tagcagataatagacacgaa

SEQ ID NO: 88134 - DNA, 20 bp, synthetic construct
  misc_feature 1..20: note = CRISPR gRNA sequence
  source 1..20: mol_type = other DNA
aggacagtggttaccgctaa

SEQ ID NO: 88135 - DNA, 20 bp, synthetic construct
  misc_feature 1..20: note = CRISPR gRNA sequence
  source 1..20: mol_type = other DNA
ccgctaagaagaggcggggg

SEQ ID NO: 88136 - DNA, 20 bp, synthetic construct
  misc_feature 1..20: note = CRISPR gRNA sequence
  source 1..20: mol_type = other DNA
agaagaggcgggggacaggc

SEQ ID NO: 88137 - DNA, 20 bp, synthetic construct
  misc_feature 1..20: note = CRISPR gRNA sequence
  source 1..20: mol_type = other DNA
gggaggaacacaaacacaat

SEQ ID NO: 88138 - DNA, 20 bp, synthetic construct
  misc_feature 1..20: note = CRISPR gRNA sequence
  source 1..20: mol_type = other DNA
aaaatgttttaatgtatatg

SEQ ID NO: 88139 - DNA, 20 bp, synthetic construct
  misc_feature 1..20: note = CRISPR gRNA sequence
  source 1..20: mol_type = other DNA
aaatgttttaatgtatatgt

SEQ ID NO: 88140 - DNA, 20 bp, synthetic construct
  misc_feature 1..20: note = CRISPR gRNA sequence
  source 1..20: mol_type = other DNA
taatgtatatgtgttatggg

SEQ ID NO: 88141 - DNA, 20 bp, synthetic construct
  misc_feature 1..20: note = CRISPR gRNA sequence
  source 1..20: mol_type = other DNA
aatgtatatgtgttatgggt

SEQ ID NO: 88142 - DNA, 20 bp, synthetic construct
  misc_feature 1..20: note = CRISPR gRNA sequence
  source 1..20: mol_type = other DNA
atgtatatgtgttatgggtc

SEQ ID NO: 88143 - DNA, 20 bp, synthetic construct
  misc_feature 1..20: note = CRISPR gRNA sequence
  source 1..20: mol_type = other DNA
tgggtcataggtactcatta

SEQ ID NO: 88144 - DNA, 20 bp, synthetic construct
  misc_feature 1..20: note = CRISPR gRNA sequence
  source 1..20: mol_type = other DNA
attagtatgcttcataattt

SEQ ID NO: 88145 - DNA, 20 bp, synthetic construct
  misc_feature 1..20: note = CRISPR gRNA sequence
  source 1..20: mol_type = other DNA
gtatgcttcataatttattc

SEQ ID NO: 88146 - DNA, 20 bp, synthetic construct
  misc_feature 1..20: note = CRISPR gRNA sequence
  source 1..20: mol_type = other DNA
cataatttattcacgttaga

SEQ ID NO: 88147 - DNA, 20 bp, synthetic construct
  misc_feature 1..20: note = CRISPR gRNA sequence
  source 1..20: mol_type = other DNA
ataatttattcacgttagat

SEQ ID NO: 88148 - DNA, 20 bp, synthetic construct
  misc_feature 1..20: note = CRISPR gRNA sequence
  source 1..20: mol_type = other DNA
attcacgttagatatactct

SEQ ID NO: 88149 - DNA, 20 bp, synthetic construct
  misc_feature 1..20: note = CRISPR gRNA sequence
  source 1..20: mol_type = other DNA
ttcacgttagatatactctt

SEQ ID NO: 88150 - DNA, 20 bp, synthetic construct
  misc_feature 1..20: note = CRISPR gRNA sequence
  source 1..20: mol_type = other DNA
acgttagatatactctttat

SEQ ID NO: 88151 - DNA, 20 bp, synthetic construct
  misc_feature 1..20: note = CRISPR gRNA sequence
  source 1..20: mol_type = other DNA
gatatactctttatagatat

SEQ ID NO: 88152 - DNA, 20 bp, synthetic construct
  misc_feature 1..20: note = CRISPR gRNA sequence
  source 1..20: mol_type = other DNA
tttatagatatcaaatatta

SEQ ID NO: 88153 - DNA, 20 bp, synthetic construct
  misc_feature 1..20: note = CRISPR gRNA sequence
  source 1..20: mol_type = other DNA
tatagatatcaaatattaca

SEQ ID NO: 88154 - DNA, 20 bp, synthetic construct
  misc_feature 1..20: note = CRISPR gRNA sequence
  source 1..20: mol_type = other DNA
atagatatcaaatattacat

SEQ ID NO: 88155 - DNA, 20 bp, synthetic construct
  misc_feature 1..20: note = CRISPR gRNA sequence
  source 1..20: mol_type = other DNA
tagatatcaaatattacata

SEQ ID NO: 88156 - DNA, 20 bp, synthetic construct
  misc_feature 1..20: note = CRISPR gRNA sequence
  source 1..20: mol_type = other DNA
catattataatttcttaaaa

SEQ ID NO: 88157 - DNA, 20 bp, synthetic construct
  misc_feature 1..20: note = CRISPR gRNA sequence
  source 1..20: mol_type = other DNA
taatttcttaaaatctgctg

SEQ ID NO: 88158 - DNA, 20 bp, synthetic construct
  misc_feature 1..20: note = CRISPR gRNA sequence
  source 1..20: mol_type = other DNA
cttaaaatctgctgtggtgg

SEQ ID NO: 88159 - DNA, 20 bp, synthetic construct
  misc_feature 1..20: note = CRISPR gRNA sequence
  source 1..20: mol_type = other DNA
ttaaaatctgctgtggtgga

SEQ ID NO: 88160 - DNA, 20 bp, synthetic construct
  misc_feature 1..20: note = CRISPR gRNA sequence
  source 1..20: mol_type = other DNA
aaaatctgctgtggtggaaa

SEQ ID NO: 88161 - DNA, 20 bp, synthetic construct
  misc_feature 1..20: note = CRISPR gRNA sequence
  source 1..20: mol_type = other DNA
aaatctgctgtggtggaaat

SEQ ID NO: 88162 - DNA, 20 bp, synthetic construct
  misc_feature 1..20: note = CRISPR gRNA sequence
  source 1..20: mol_type = other DNA
ctgtggtggaaataaatgaa

SEQ ID NO: 88163 - DNA, 20 bp, synthetic construct
  misc_feature 1..20: note = CRISPR gRNA sequence
  source 1..20: mol_type = other DNA
tggtggaaataaatgaacac

SEQ ID NO: 88164 - DNA, 20 bp, synthetic construct
  misc_feature 1..20: note = CRISPR gRNA sequence
  source 1..20: mol_type = other DNA
cctgaaagaaaatcagtgtt

SEQ ID NO: 88165 - DNA, 20 bp, synthetic construct
  misc_feature 1..20: note = CRISPR gRNA sequence
  source 1..20: mol_type = other DNA
aaagaaaatcagtgtttctt

SEQ ID NO: 88166 - DNA, 20 bp, synthetic construct
  misc_feature 1..20: note = CRISPR gRNA sequence
  source 1..20: mol_type = other DNA
cttgggaagaaccaagattc

SEQ ID NO: 88167 - DNA, 20 bp, synthetic construct
  misc_feature 1..20: note = CRISPR gRNA sequence
  source 1..20: mol_type = other DNA
ttgggaagaaccaagattcc

SEQ ID NO: 88168 - DNA, 20 bp, synthetic construct
  misc_feature 1..20: note = CRISPR gRNA sequence
  source 1..20: mol_type = other DNA
gggaagaaccaagattccct

SEQ ID NO: 88169 - DNA, 20 bp, synthetic construct
  misc_feature 1..20: note = CRISPR gRNA sequence
  source 1..20: mol_type = other DNA
ggaagaaccaagattccctg

SEQ ID NO: 88170 - DNA, 20 bp, synthetic construct
  misc_feature 1..20: note = CRISPR gRNA sequence
  source 1..20: mol_type = other DNA
cctgacagaagctaccctat

SEQ ID NO: 88171 - DNA, 20 bp, synthetic construct
  misc_feature 1..20: note = CRISPR gRNA sequence
  source 1..20: mol_type = other DNA
acagaagctaccctatgtag

SEQ ID NO: 88172 - DNA, 20 bp, synthetic construct
  misc_feature 1..20: note = CRISPR gRNA sequence
  source 1..20: mol_type = other DNA
ccctatgtagaggacaaagt

SEQ ID NO: 88173 - DNA, 20 bp, synthetic construct
  misc_feature 1..20: note = CRISPR gRNA sequence
  source 1..20: mol_type = other DNA
tgtagaggacaaagtaggtc

SEQ ID NO: 88174 - DNA, 20 bp, synthetic construct
  misc_feature 1..20: note = CRISPR gRNA sequence
  source 1..20: mol_type = other DNA
caataaatattagttggttt

SEQ ID NO: 88175 - DNA, 20 bp, synthetic construct
  misc_feature 1..20: note = CRISPR gRNA sequence
  source 1..20: mol_type = other DNA
aataaatattagttggttta

SEQ ID NO: 88176 - DNA, 20 bp, synthetic construct
  misc_feature 1..20: note = CRISPR gRNA sequence
  source 1..20: mol_type = other DNA
gttggtttactgcttttccc

SEQ ID NO: 88177 - DNA, 20 bp, synthetic construct
  misc_feature 1..20: note = CRISPR gRNA sequence
  source 1..20: mol_type = other DNA
gtttactgcttttcccaagg

SEQ ID NO: 88178 - DNA, 20 bp, synthetic construct
  misc_feature 1..20: note = CRISPR gRNA sequence
  source 1..20: mol_type = other DNA
actgcttttcccaaggatac

SEQ ID NO: 88179 - DNA, 20 bp, synthetic construct
  misc_feature 1..20: note = CRISPR gRNA sequence
  source 1..20: mol_type = other DNA
ctgcttttcccaaggataca

SEQ ID NO: 88180 - DNA, 20 bp, synthetic construct
  misc_feature 1..20: note = CRISPR gRNA sequence
  source 1..20: mol_type = other DNA
cttttcccaaggatacatct

SEQ ID NO: 88181 - DNA, 20 bp, synthetic construct
  misc_feature 1..20: note = CRISPR gRNA sequence
  source 1..20: mol_type = other DNA
ttcccaaggatacatctgga

SEQ ID NO: 88182 - DNA, 20 bp, synthetic construct
  misc_feature 1..20: note = CRISPR gRNA sequence
  source 1..20: mol_type = other DNA
tcccaaggatacatctggag

SEQ ID NO: 88183 - DNA, 20 bp, synthetic construct
  misc_feature 1..20: note = CRISPR gRNA sequence
  source 1..20: mol_type = other DNA
cccaaggatacatctggagg

SEQ ID NO: 88184 - DNA, 20 bp, synthetic construct
  misc_feature 1..20: note = CRISPR gRNA sequence
  source 1..20: mol_type = other DNA
ccaaggatacatctggaggg

SEQ ID NO: 88185 - DNA, 20 bp, synthetic construct
  misc_feature 1..20: note = CRISPR gRNA sequence
  source 1..20: mol_type = other DNA
gagggtctgcattcctttct

SEQ ID NO: 88186 - DNA, 20 bp, synthetic construct
  misc_feature 1..20: note = CRISPR gRNA sequence
  source 1..20: mol_type = other DNA
cattcctttctcattggtgc

SEQ ID NO: 88187 - DNA, 20 bp, synthetic construct
  misc_feature 1..20: note = CRISPR gRNA sequence
  source 1..20: mol_type = other DNA
ctttctcattggtgccgcct

SEQ ID NO: 88188 - DNA, 20 bp, synthetic construct
  misc_feature 1..20: note = CRISPR gRNA sequence
  source 1..20: mol_type = other DNA
tctcattggtgccgcctgac

SEQ ID NO: 88189 - DNA, 20 bp, synthetic construct
  misc_feature 1..20: note = CRISPR gRNA sequence
  source 1..20: mol_type = other DNA
ctcattggtgccgcctgacc

SEQ ID NO: 88190 - DNA, 20 bp, synthetic construct
  misc_feature 1..20: note = CRISPR gRNA sequence
  source 1..20: mol_type = other DNA
tcattggtgccgcctgacca

SEQ ID NO: 88191 - DNA, 20 bp, synthetic construct
  misc_feature 1..20: note = CRISPR gRNA sequence
  source 1..20: mol_type = other DNA
attggtgccgcctgaccaca

SEQ ID NO: 88192 - DNA, 20 bp, synthetic construct
  misc_feature 1..20: note = CRISPR gRNA sequence
  source 1..20: mol_type = other DNA
gtgccgcctgaccacagaac

SEQ ID NO: 88193 - DNA, 20 bp, synthetic construct
  misc_feature 1..20: note = CRISPR gRNA sequence
  source 1..20: mol_type = other DNA
accacagaactagctttttc

SEQ ID NO: 88194 - DNA, 20 bp, synthetic construct
  misc_feature 1..20: note = CRISPR gRNA sequence
  source 1..20: mol_type = other DNA
gctttttccgtgacatctaa

SEQ ID NO: 88195 - DNA, 20 bp, synthetic construct
  misc_feature 1..20: note = CRISPR gRNA sequence
  source 1..20: mol_type = other DNA
tttccgtgacatctaaccta

SEQ ID NO: 88196 - DNA, 20 bp, synthetic construct
  misc_feature 1..20: note = CRISPR gRNA sequence
  source 1..20: mol_type = other DNA
ttccgtgacatctaacctaa

SEQ ID NO: 88197 - DNA, 20 bp, synthetic construct
  misc_feature 1..20: note = CRISPR gRNA sequence
  source 1..20: mol_type = other DNA
tccgtgacatctaacctaaa

SEQ ID NO: 88198 - DNA, 20 bp, synthetic construct
  misc_feature 1..20: note = CRISPR gRNA sequence
  source 1..20: mol_type = other DNA
ccgtgacatctaacctaaac

SEQ ID NO: 88199 - DNA, 20 bp, synthetic construct
  misc_feature 1..20: note = CRISPR gRNA sequence
  source 1..20: mol_type = other DNA
cgtgacatctaacctaaacc

SEQ ID NO: 88200 - DNA, 20 bp, synthetic construct
  misc_feature 1..20: note = CRISPR gRNA sequence
  source 1..20: mol_type = other DNA
acctaaaccccgcagtccta

SEQ ID NO: 88201 - DNA, 20 bp, synthetic construct
  misc_feature 1..20: note = CRISPR gRNA sequence
  source 1..20: mol_type = other DNA
aaccccgcagtcctaagtcc

SEQ ID NO: 88202 - DNA, 20 bp, synthetic construct
  misc_feature 1..20: note = CRISPR gRNA sequence
  source 1..20: mol_type = other DNA
agtcctgacacgtatgacaa

SEQ ID NO: 88203 - DNA, 20 bp, synthetic construct
  misc_feature 1..20: note = CRISPR gRNA sequence
  source 1..20: mol_type = other DNA
acacgtatgacaagatgctg

SEQ ID NO: 88204 - DNA, 20 bp, synthetic construct
  misc_feature 1..20: note = CRISPR gRNA sequence
  source 1..20: mol_type = other DNA
ccacctggtggatacagaat

SEQ ID NO: 88205 - DNA, 20 bp, synthetic construct
  misc_feature 1..20: note = CRISPR gRNA sequence
  source 1..20: mol_type = other DNA
gtggatacagaatagattta

SEQ ID NO: 88206 - DNA, 20 bp, synthetic construct
  misc_feature 1..20: note = CRISPR gRNA sequence
  source 1..20: mol_type = other DNA
aatgaaatggctaggaagtc

SEQ ID NO: 88207 - DNA, 20 bp, synthetic construct
  misc_feature 1..20: note = CRISPR gRNA sequence
  source 1..20: mol_type = other DNA
atgaaatggctaggaagtct

SEQ ID NO: 88208 - DNA, 20 bp, synthetic construct
  misc_feature 1..20: note = CRISPR gRNA sequence
  source 1..20: mol_type = other DNA
ggaagtctttcactctagtt

SEQ ID NO: 88209 - DNA, 20 bp, synthetic construct
  misc_feature 1..20: note = CRISPR gRNA sequence
  source 1..20: mol_type = other DNA
tcactctagttggtggaact

SEQ ID NO: 88210 - DNA, 20 bp, synthetic construct
  misc_feature 1..20: note = CRISPR gRNA sequence
  source 1..20: mol_type = other DNA
cactctagttggtggaactg

SEQ ID NO: 88211 - DNA, 20 bp, synthetic construct
  misc_feature 1..20: note = CRISPR gRNA sequence
  source 1..20: mol_type = other DNA
actctagttggtggaactgg

SEQ ID NO: 88212 - DNA, 20 bp, synthetic construct
  misc_feature 1..20: note = CRISPR gRNA sequence
  source 1..20: mol_type = other DNA
tagttggtggaactggcaat

SEQ ID NO: 88213 - DNA, 20 bp, synthetic construct
  misc_feature 1..20: note = CRISPR gRNA sequence
  source 1..20: mol_type = other DNA
gttggtggaactggcaatag

SEQ ID NO: 88214 - DNA, 20 bp, synthetic construct
  misc_feature 1..20: note = CRISPR gRNA sequence
  source 1..20: mol_type = other DNA
gtggaactggcaatagggtg

SEQ ID NO: 88215 - DNA, 20 bp, synthetic construct
  misc_feature 1..20: note = CRISPR gRNA sequence
  source 1..20: mol_type = other DNA
gcaatagggtgagagggaag

SEQ ID NO: 88216 - DNA, 20 bp, synthetic construct
  misc_feature 1..20: note = CRISPR gRNA sequence
  source 1..20: mol_type = other DNA
agaaacaggaaaaggaagga

SEQ ID NO: 88217 - DNA, 20 bp, synthetic construct
  misc_feature 1..20: note = CRISPR gRNA sequence
  source 1..20: mol_type = other DNA
catctctaatatggaggtag

SEQ ID NO: 88218 - DNA, 20 bp, synthetic construct
  misc_feature 1..20: note = CRISPR gRNA sequence
  source 1..20: mol_type = other DNA
taatatggaggtagaaaaaa

SEQ ID NO: 88219 - DNA, 20 bp, synthetic construct
  misc_feature 1..20: note = CRISPR gRNA sequence
  source 1..20: mol_type = other DNA
atatggaggtagaaaaaaag

SEQ ID NO: 88220 - DNA, 20 bp, synthetic construct
  misc_feature 1..20: note = CRISPR gRNA sequence
  source 1..20: mol_type = other DNA
tcatctaaatgagactgaag

SEQ ID NO: 88221 - DNA, 20 bp, synthetic construct
  misc_feature 1..20: note = CRISPR gRNA sequence
  source 1..20: mol_type = other DNA
aatgagactgaagagtccct

SEQ ID NO: 88222 - DNA, 20 bp, synthetic construct
  misc_feature 1..20: note = CRISPR gRNA sequence
  source 1..20: mol_type = other DNA
aagagtccctagaggagaat

SEQ ID NO: 88223 - DNA, 20 bp, synthetic construct
  misc_feature 1..20: note = CRISPR gRNA sequence
  source 1..20: mol_type = other DNA
gaggagaatggcttccctct

SEQ ID NO: 88224 - DNA, 20 bp, synthetic construct
  misc_feature 1..20: note = CRISPR gRNA sequence
  source 1..20: mol_type = other DNA
ccctctccttccttctgaga

SEQ ID NO: 88225 - DNA, 20 bp, synthetic construct
  misc_feature 1..20: note = CRISPR gRNA sequence
  source 1..20: mol_type = other DNA
cctctccttccttctgagac

SEQ ID NO: 88226 - DNA, 20 bp, synthetic construct
  misc_feature 1..20: note = CRISPR gRNA sequence
  source 1..20: mol_type = other DNA
tccttccttctgagactaga

SEQ ID NO: 88227 - DNA, 20 bp, synthetic construct
  misc_feature 1..20: note = CRISPR gRNA sequence
  source 1..20: mol_type = other DNA
cttccttctgagactagaaa

SEQ ID NO: 88228 - DNA, 20 bp, synthetic construct
  misc_feature 1..20: note = CRISPR gRNA sequence
  source 1..20: mol_type = other DNA
ccttctgagactagaaacga

SEQ ID NO: 88229 - DNA, 20 bp, synthetic construct
  misc_feature 1..20: note = CRISPR gRNA sequence
  source 1..20: mol_type = other DNA
cttctgagactagaaacgag

SEQ ID NO: 88230 - DNA, 20 bp, synthetic construct
  misc_feature 1..20: note = CRISPR gRNA sequence
  source 1..20: mol_type = other DNA
ctgagactagaaacgaggaa

SEQ ID NO: 88231 - DNA, 20 bp, synthetic construct
  misc_feature 1..20: note = CRISPR gRNA sequence
  source 1..20: mol_type = other DNA
tgagactagaaacgaggaaa

SEQ ID NO: 88232 - DNA, 20 bp, synthetic construct
  misc_feature 1..20: note = CRISPR gRNA sequence
  source 1..20: mol_type = other DNA
agactagaaacgaggaaaga

SEQ ID NO: 88233 - DNA, 20 bp, synthetic construct
  misc_feature 1..20: note = CRISPR gRNA sequence
  source 1..20: mol_type = other DNA
gaaacgaggaaagaggctac

SEQ ID NO: 88234 - DNA, 20 bp, synthetic construct
  misc_feature 1..20: note = CRISPR gRNA sequence
  source 1..20: mol_type = other DNA
cagcttgtattgagggaaat

SEQ ID NO: 88235 - DNA, 20 bp, synthetic construct
  misc_feature 1..20: note = CRISPR gRNA sequence
  source 1..20: mol_type = other DNA
gtattgagggaaatgcaaga

SEQ ID NO: 88236 - DNA, 20 bp, synthetic construct
  misc_feature 1..20: note = CRISPR gRNA sequence
  source 1..20: mol_type = other DNA
tattgagggaaatgcaagac

SEQ ID NO: 88237 - DNA, 20 bp, synthetic construct
  misc_feature 1..20: note = CRISPR gRNA sequence
  source 1..20: mol_type = other DNA
agggaaatgcaagactgagg

SEQ ID NO: 88238 - DNA, 20 bp, synthetic construct
  misc_feature 1..20: note = CRISPR gRNA sequence
  source 1..20: mol_type = other DNA
aggagaaaagaaagcaggtc

SEQ ID NO: 88239 - DNA, 20 bp, synthetic construct
  misc_feature 1..20: note = CRISPR gRNA sequence
  source 1..20: mol_type = other DNA
gctgatctcaacttagcaag

SEQ ID NO: 88240 - DNA, 20 bp, synthetic construct
  misc_feature 1..20: note = CRISPR gRNA sequence
  source 1..20: mol_type = other DNA
atctcaacttagcaagctaa

SEQ ID NO: 88241 - DNA, 20 bp, synthetic construct
  misc_feature 1..20: note = CRISPR gRNA sequence
  source 1..20: mol_type = other DNA
aacttagcaagctaaaataa

SEQ ID NO: 88242 - DNA, 20 bp, synthetic construct
  misc_feature 1..20: note = CRISPR gRNA sequence
  source 1..20: mol_type = other DNA
agcaagctaaaataagagta

SEQ ID NO: 88243 - DNA, 20 bp, synthetic construct
  misc_feature 1..20: note = CRISPR gRNA sequence
  source 1..20: mol_type = other DNA
gcaagctaaaataagagtag

SEQ ID NO: 88244 - DNA, 20 bp, synthetic construct
  misc_feature 1..20: note = CRISPR gRNA sequence
  source 1..20: mol_type = other DNA
aaataagagtagcctggtgt

SEQ ID NO: 88245 - DNA, 20 bp, synthetic construct
  misc_feature 1..20: note = CRISPR gRNA sequence
  source 1..20: mol_type = other DNA
gtgttagcggccacccaagc

SEQ ID NO: 88246 - DNA, 20 bp, synthetic construct
  misc_feature 1..20: note = CRISPR gRNA sequence
  source 1..20: mol_type = other DNA
gcggccacccaagcaactcc

SEQ ID NO: 88247 - DNA, 20 bp, synthetic construct
  misc_feature 1..20: note = CRISPR gRNA sequence
  source 1..20: mol_type = other DNA
cctgctcctagtttccactt

SEQ ID NO: 88248 - DNA, 20 bp, synthetic construct
  misc_feature 1..20: note = CRISPR gRNA sequence
  source 1..20: mol_type = other DNA
ctcctagtttccacttgggg

SEQ ID NO: 88249 - DNA, 20 bp, synthetic construct
  misc_feature 1..20: note = CRISPR gRNA sequence
  source 1..20: mol_type = other DNA
ctagtttccacttggggaat

SEQ ID NO: 88250 - DNA, 20 bp, synthetic construct
  misc_feature 1..20: note = CRISPR gRNA sequence
  source 1..20: mol_type = other DNA
gtttccacttggggaatcca

SEQ ID NO: 88251 - DNA, 20 bp, synthetic construct
  misc_feature 1..20: note = CRISPR gRNA sequence
  source 1..20: mol_type = other DNA
ccacttggggaatccatgtg

SEQ ID NO: 88252 - DNA, 20 bp, synthetic construct
  misc_feature 1..20: note = CRISPR gRNA sequence
  source 1..20: mol_type = other DNA
cacttggggaatccatgtga

SEQ ID NO: 88253 - DNA, 20 bp, synthetic construct
  misc_feature 1..20: note = CRISPR gRNA sequence
  source 1..20: mol_type = other DNA
ggggaatccatgtgattttg

SEQ ID NO: 88254 - DNA, 20 bp, synthetic construct
  misc_feature 1..20: note = CRISPR gRNA sequence
  source 1..20: mol_type = other DNA
gggaatccatgtgattttgg

SEQ ID NO: 88255 - DNA, 20 bp, synthetic construct
  misc_feature 1..20: note = CRISPR gRNA sequence
  source 1..20: mol_type = other DNA
tggggaggctgacccccacc

SEQ ID NO: 88256 - DNA, 20 bp, synthetic construct
  misc_feature 1..20: note = CRISPR gRNA sequence
  source 1..20: mol_type = other DNA
ggggaggctgacccccaccc

SEQ ID NO: 88257 - DNA, 20 bp, synthetic construct
  misc_feature 1..20: note = CRISPR gRNA sequence
  source 1..20: mol_type = other DNA
gggaggctgacccccaccct

SEQ ID NO: 88258 - DNA, 20 bp, synthetic construct
  misc_feature 1..20: note = CRISPR gRNA sequence
  source 1..20: mol_type = other DNA
acccccacccttttccccaa

SEQ ID NO: 88259 - DNA, 20 bp, synthetic construct
  misc_feature 1..20: note = CRISPR gRNA sequence
  source 1..20: mol_type = other DNA
ttccccaaaggtgttgtcca

SEQ ID NO: 88260 - DNA, 20 bp, synthetic construct
  misc_feature 1..20: note = CRISPR gRNA sequence
  source 1..20: mol_type = other DNA
tccccaaaggtgttgtccat

SEQ ID NO: 88261 - DNA, 20 bp, synthetic construct
  misc_feature 1..20: note = CRISPR gRNA sequence
  source 1..20: mol_type = other DNA
ccccaaaggtgttgtccatg

SEQ ID NO: 88262 - DNA, 20 bp, synthetic construct
  misc_feature 1..20: note = CRISPR gRNA sequence
  source 1..20: mol_type = other DNA
cccaaaggtgttgtccatga

SEQ ID NO: 88263 - DNA, 20 bp, synthetic construct
  misc_feature 1..20: note = CRISPR gRNA sequence
  source 1..20: mol_type = other DNA
tccatgatatagaataagca

SEQ ID NO: 88264 - DNA, 20 bp, synthetic construct
  misc_feature 1..20: note = CRISPR gRNA sequence
  source 1..20: mol_type = other DNA
gcatgtatcatcctcctggc

SEQ ID NO: 88265 - DNA, 20 bp, synthetic construct
  misc_feature 1..20: note = CRISPR gRNA sequence
  source 1..20: mol_type = other DNA
ctggccacagtgattggtca

SEQ ID NO: 88266 - DNA, 20 bp, synthetic construct
  misc_feature 1..20: note = CRISPR gRNA sequence
  source 1..20: mol_type = other DNA
gccacagtgattggtcaggg

SEQ ID NO: 88267 - DNA, 20 bp, synthetic construct
  misc_feature 1..20: note = CRISPR gRNA sequence
  source 1..20: mol_type = other DNA
gtcagggtggacatgtgacc

SEQ ID NO: 88268 - DNA, 20 bp, synthetic construct
  misc_feature 1..20: note = CRISPR gRNA sequence
  source 1..20: mol_type = other DNA
atcagtgtgaatattagggc

SEQ ID NO: 88269 - DNA, 20 bp, synthetic construct
  misc_feature 1..20: note = CRISPR gRNA sequence
  source 1..20: mol_type = other DNA
gggcttttgctgagatttct

SEQ ID NO: 88270 - DNA, 20 bp, synthetic construct
  misc_feature 1..20: note = CRISPR gRNA sequence
  source 1..20: mol_type = other DNA
ttgctgagatttctggtaca

SEQ ID NO: 88271 - DNA, 20 bp, synthetic construct
  misc_feature 1..20: note = CRISPR gRNA sequence
  source 1..20: mol_type = other DNA
tgctgagatttctggtacaa

SEQ ID NO: 88272 - DNA, 20 bp, synthetic construct
  misc_feature 1..20: note = CRISPR gRNA sequence
  source 1..20: mol_type = other DNA
gctgagatttctggtacaaa

SEQ ID NO: 88273 - DNA, 20 bp, synthetic construct
  misc_feature 1..20: note = CRISPR gRNA sequence
  source 1..20: mol_type = other DNA
ctgagatttctggtacaaag

SEQ ID NO: 88274 - DNA, 20 bp, synthetic construct
  misc_feature 1..20: note = CRISPR gRNA sequence
  source 1..20: mol_type = other DNA
agatttctggtacaaagatg

SEQ ID NO: 88275 - DNA, 20 bp, synthetic construct
  misc_feature 1..20: note = CRISPR gRNA sequence
  source 1..20: mol_type = other DNA
ctggtacaaagatgccttct

SEQ ID NO: 88276 - DNA, 20 bp, synthetic construct
  misc_feature 1..20: note = CRISPR gRNA sequence
  source 1..20: mol_type = other DNA
tggtacaaagatgccttctt

SEQ ID NO: 88277 - DNA, 20 bp, synthetic construct
  misc_feature 1..20: note = CRISPR gRNA sequence
  source 1..20: mol_type = other DNA
gtacaaagatgccttctttt

SEQ ID NO: 88278 - DNA, 20 bp, synthetic construct
  misc_feature 1..20: note = CRISPR gRNA sequence
  source 1..20: mol_type = other DNA
ctttttctgattggacataa

SEQ ID NO: 88279 - DNA, 20 bp, synthetic construct
  misc_feature 1..20: note = CRISPR gRNA sequence
  source 1..20: mol_type = other DNA
tttttctgattggacataaa

SEQ ID NO: 88280 - DNA, 20 bp, synthetic construct
  misc_feature 1..20: note = CRISPR gRNA sequence
  source 1..20: mol_type = other DNA
tttctgattggacataaatg

SEQ ID NO: 88281 - DNA, 20 bp, synthetic construct
  misc_feature 1..20: note = CRISPR gRNA sequence
  source 1..20: mol_type = other DNA
ttctgattggacataaatgg

SEQ ID NO: 88282 - DNA, 20 bp, synthetic construct
  misc_feature 1..20: note = CRISPR gRNA sequence
  source 1..20: mol_type = other DNA
tctgattggacataaatggg

SEQ ID NO: 88283 - DNA, 20 bp, synthetic construct
  misc_feature 1..20: note = CRISPR gRNA sequence
  source 1..20: mol_type = other DNA
ctgattggacataaatgggg

SEQ ID NO: 88284 - DNA, 20 bp, synthetic construct
  misc_feature 1..20: note = CRISPR gRNA sequence
  source 1..20: mol_type = other DNA
tgattggacataaatgggga

SEQ ID NO: 88285 - DNA, 20 bp, synthetic construct
  misc_feature 1..20: note = CRISPR gRNA sequence
  source 1..20: mol_type = other DNA
attggacataaatggggaaa

SEQ ID NO: 88286 - DNA, 20 bp, synthetic construct
  misc_feature 1..20: note = CRISPR gRNA sequence
  source 1..20: mol_type = other DNA
gacataaatggggaaaagtg

SEQ ID NO: 88287 - DNA, 20 bp, synthetic construct
  misc_feature 1..20: note = CRISPR gRNA sequence
  source 1..20: mol_type = other DNA
aggaatgctggcagccatta

SEQ ID NO: 88288 - DNA, 20 bp, synthetic construct
  misc_feature 1..20: note = CRISPR gRNA sequence
  source 1..20: mol_type = other DNA
ggaatgctggcagccattaa

SEQ ID NO: 88289 - DNA, 20 bp, synthetic construct
  misc_feature 1..20: note = CRISPR gRNA sequence
  source 1..20: mol_type = other DNA
gcagccattaagtggcccag

SEQ ID NO: 88290 - DNA, 20 bp, synthetic construct
  misc_feature 1..20: note = CRISPR gRNA sequence
  source 1..20: mol_type = other DNA
agtggcccagacttaaatgg

SEQ ID NO: 88291 - DNA, 20 bp, synthetic construct
  misc_feature 1..20: note = CRISPR gRNA sequence
  source 1..20: mol_type = other DNA
aaatggtcctacagaagatg

SEQ ID NO: 88292 - DNA, 20 bp, synthetic construct
  misc_feature 1..20: note = CRISPR gRNA sequence
  source 1..20: mol_type = other DNA
aatggtcctacagaagatgc

SEQ ID NO: 88293 - DNA, 20 bp, synthetic construct
  misc_feature 1..20: note = CRISPR gRNA sequence
  source 1..20: mol_type = other DNA
cagaagatgcaacagtgaga

SEQ ID NO: 88294 - DNA, 20 bp, synthetic construct
  misc_feature 1..20: note = CRISPR gRNA sequence
  source 1..20: mol_type = other DNA
agagacatactgaactactg

SEQ ID NO: 88295 - DNA, 20 bp, synthetic construct
  misc_feature 1..20: note = CRISPR gRNA sequence
  source 1..20: mol_type = other DNA
gagacatactgaactactgg

SEQ ID NO: 88296 - DNA, 20 bp, synthetic construct
  misc_feature 1..20: note = CRISPR gRNA sequence
  source 1..20: mol_type = other DNA
aactactgggtcaagtcttc

SEQ ID NO: 88297 - DNA, 20 bp, synthetic construct
  misc_feature 1..20: note = CRISPR gRNA sequence
  source 1..20: mol_type = other DNA
ctgggtcaagtcttcacctg

SEQ ID NO: 88298 - DNA, 20 bp, synthetic construct
  misc_feature 1..20: note = CRISPR gRNA sequence
  source 1..20: mol_type = other DNA
ggtcaagtcttcacctggag

SEQ ID NO: 88299 - DNA, 20 bp, synthetic construct
  misc_feature 1..20: note = CRISPR gRNA sequence
  source 1..20: mol_type = other DNA
cacctggagccagcactacc

SEQ ID NO: 88300 - DNA, 20 bp, synthetic construct
  misc_feature 1..20: note = CRISPR gRNA sequence
  source 1..20: mol_type = other DNA
acctggagccagcactacct

SEQ ID NO: 88301 - DNA, 20 bp, synthetic construct
  misc_feature 1..20: note = CRISPR gRNA sequence
  source 1..20: mol_type = other DNA
gagccagcactacctatgga

SEQ ID NO: 88302 - DNA, 20 bp, synthetic construct
  misc_feature 1..20: note = CRISPR gRNA sequence
  source 1..20: mol_type = other DNA
cctatggactttctagttac

SEQ ID NO: 88303 - DNA, 20 bp, synthetic construct
  misc_feature 1..20: note = CRISPR gRNA sequence
  source 1..20: mol_type = other DNA
tggactttctagttacatga

SEQ ID NO: 88304 - DNA, 20 bp, synthetic construct
  misc_feature 1..20: note = CRISPR gRNA sequence
  source 1..20: mol_type = other DNA
tctagttacatgaaccaata

SEQ ID NO: 88305 - DNA, 20 bp, synthetic construct
  misc_feature 1..20: note = CRISPR gRNA sequence
  source 1..20: mol_type = other DNA
ctagttacatgaaccaataa

SEQ ID NO: 88306 - DNA, 20 bp, synthetic construct
  misc_feature 1..20: note = CRISPR gRNA sequence
  source 1..20: mol_type = other DNA
tagttacatgaaccaataaa

SEQ ID NO: 88307 - DNA, 20 bp, synthetic construct
  misc_feature 1..20: note = CRISPR gRNA sequence
  source 1..20: mol_type = other DNA
gttacatgaaccaataaatc

SEQ ID NO: 88308 - DNA, 20 bp, synthetic construct
  misc_feature 1..20: note = CRISPR gRNA sequence
  source 1..20: mol_type = other DNA
catgaaccaataaatccttt

SEQ ID NO: 88309 - DNA, 20 bp, synthetic construct
  misc_feature 1..20: note = CRISPR gRNA sequence
  source 1..20: mol_type = other DNA
tttattttaagccagtttga

SEQ ID NO: 88310 - DNA, 20 bp, synthetic construct
  misc_feature 1..20: note = CRISPR gRNA sequence
  source 1..20: mol_type = other DNA
ttattttaagccagtttgaa

SEQ ID NO: 88311 - DNA, 20 bp, synthetic construct
  misc_feature 1..20: note = CRISPR gRNA sequence
  source 1..20: mol_type = other DNA
tattttaagccagtttgaat

SEQ ID NO: 88312 - DNA, 20 bp, synthetic construct
  misc_feature 1..20: note = CRISPR gRNA sequence
  source 1..20: mol_type = other DNA
attttaagccagtttgaatt

SEQ ID NO: 88313 - DNA, 20 bp, synthetic construct
  misc_feature 1..20: note = CRISPR gRNA sequence
  source 1..20: mol_type = other DNA
ttttaagccagtttgaatta

SEQ ID NO: 88314 - DNA, 20 bp, synthetic construct
  misc_feature 1..20: note = CRISPR gRNA sequence
  source 1..20: mol_type = other DNA
taagccagtttgaattaggt

SEQ ID NO: 88315 - DNA, 20 bp, synthetic construct
  misc_feature 1..20: note = CRISPR gRNA sequence
  source 1..20: mol_type = other DNA
aagccagtttgaattaggtt

SEQ ID NO: 88316 - DNA, 20 bp, synthetic construct
  misc_feature 1..20: note = CRISPR gRNA sequence
  source 1..20: mol_type = other DNA
agccagtttgaattaggttt

SEQ ID NO: 88317 - DNA, 20 bp, synthetic construct
  misc_feature 1..20: note = CRISPR gRNA sequence
  source 1..20: mol_type = other DNA
gaattaggttttctgtgatt

SEQ ID NO: 88318 - DNA, 20 bp, synthetic construct
  misc_feature 1..20: note = CRISPR gRNA sequence
  source 1..20: mol_type = other DNA
aattaggttttctgtgattt

SEQ ID NO: 88319 - DNA, 20 bp, synthetic construct
  misc_feature 1..20: note = CRISPR gRNA sequence
  source 1..20: mol_type = other DNA
ggttttctgtgatttaaaac

SEQ ID NO: 88320 - DNA, 20 bp, synthetic construct
  misc_feature 1..20: note = CRISPR gRNA sequence
  source 1..20: mol_type = other DNA
tctgtgatttaaaaccaaaa

SEQ ID NO: 88321 - DNA, 20 bp, synthetic construct
  misc_feature 1..20: note = CRISPR gRNA sequence
  source 1..20: mol_type = other DNA
ctgtgatttaaaaccaaaag

SEQ ID NO: 88322 - DNA, 20 bp, synthetic construct
  misc_feature 1..20: note = CRISPR gRNA sequence
  source 1..20: mol_type = other DNA
tgtgatttaaaaccaaaaga

SEQ ID NO: 88323 - DNA, 20 bp, synthetic construct
  misc_feature 1..20: note = CRISPR gRNA sequence
  source 1..20: mol_type = other DNA
tgatttaaaaccaaaagatc

SEQ ID NO: 88324 - DNA, 20 bp, synthetic construct
  misc_feature 1..20: note = CRISPR gRNA sequence
  source 1..20: mol_type = other DNA
aaaaccaaaagatccctaac

SEQ ID NO: 88325 - DNA, 20 bp, synthetic construct
  misc_feature 1..20: note = CRISPR gRNA sequence
  source 1..20: mol_type = other DNA
aaaccaaaagatccctaacc

SEQ ID NO: 88326 - DNA, 20 bp, synthetic construct
  misc_feature 1..20: note = CRISPR gRNA sequence
  source 1..20: mol_type = other DNA
acctatatattcatcatact

SEQ ID NO: 88327 - DNA, 20 bp, synthetic construct
  misc_feature 1..20: note = CRISPR gRNA sequence
  source 1..20: mol_type = other DNA
tatattcatcatacttagcc

SEQ ID NO: 88328 - DNA, 20 bp, synthetic construct
  misc_feature 1..20: note = CRISPR gRNA sequence
  source 1..20: mol_type = other DNA
atcatacttagcccattcct

SEQ ID NO: 88329 - DNA, 20 bp, synthetic construct
  misc_feature 1..20: note = CRISPR gRNA sequence
  source 1..20: mol_type = other DNA
agcccattcctaccttccca

SEQ ID NO: 88330 - DNA, 20 bp, synthetic construct
  misc_feature 1..20: note = CRISPR gRNA sequence
  source 1..20: mol_type = other DNA
gcccattcctaccttcccac

SEQ ID NO: 88331 - DNA, 20 bp, synthetic construct
  misc_feature 1..20: note = CRISPR gRNA sequence
  source 1..20: mol_type = other DNA
ctaccttcccacaggatagc

SEQ ID NO: 88332 - DNA, 20 bp, synthetic construct
  misc_feature 1..20: note = CRISPR gRNA sequence
  source 1..20: mol_type = other DNA
ccttcccacaggatagcaca

SEQ ID NO: 88333 - DNA, 20 bp, synthetic construct
  misc_feature 1..20: note = CRISPR gRNA sequence
  source 1..20: mol_type = other DNA
cccacaggatagcacaggga

SEQ ID NO: 88334 - DNA, 20 bp, synthetic construct
  misc_feature 1..20: note = CRISPR gRNA sequence
  source 1..20: mol_type = other DNA
ccacaggatagcacagggaa

SEQ ID NO: 88335 - DNA, 20 bp, synthetic construct
  misc_feature 1..20: note = CRISPR gRNA sequence
  source 1..20: mol_type = other DNA
cagatttattggttacacta

SEQ ID NO: 88336 - DNA, 20 bp, synthetic construct
  misc_feature 1..20: note = CRISPR gRNA sequence
  source 1..20: mol_type = other DNA
attggttacactaaagccca

SEQ ID NO: 88337 - DNA, 20 bp, synthetic construct
  misc_feature 1..20: note = CRISPR gRNA sequence
  source 1..20: mol_type = other DNA
ttggttacactaaagcccag

SEQ ID NO: 88338 - DNA, 20 bp, synthetic construct
  misc_feature 1..20: note = CRISPR gRNA sequence
  source 1..20: mol_type = other DNA
gttacactaaagcccagggt

SEQ ID NO: 88339 - DNA, 20 bp, synthetic construct
  misc_feature 1..20: note = CRISPR gRNA sequence
  source 1..20: mol_type = other DNA
cactaaagcccagggtatca

SEQ ID NO: 88340 - DNA, 20 bp, synthetic construct
  misc_feature 1..20: note = CRISPR gRNA sequence
  source 1..20: mol_type = other DNA
aagcccagggtatcaagctg

SEQ ID NO: 88341 - DNA, 20 bp, synthetic construct
  misc_feature 1..20: note = CRISPR gRNA sequence
  source 1..20: mol_type = other DNA
aaaaggtcagaggcagcaac

SEQ ID NO: 88342 - DNA, 20 bp, synthetic construct
  misc_feature 1..20: note = CRISPR gRNA sequence
  source 1..20: mol_type = other DNA
agtagactgggtgactcagc

SEQ ID NO: 88343 - DNA, 20 bp, synthetic construct
  misc_feature 1..20: note = CRISPR gRNA sequence
  source 1..20: mol_type = other DNA
ggtgactcagctgtctgtac

SEQ ID NO: 88344 - DNA, 20 bp, synthetic construct
  misc_feature 1..20: note = CRISPR gRNA sequence
  source 1..20: mol_type = other DNA
agctgtctgtacagaggaga

SEQ ID NO: 88345 - DNA, 20 bp, synthetic construct
  misc_feature 1..20: note = CRISPR gRNA sequence
  source 1..20: mol_type = other DNA
tctgtacagaggagaatgga

SEQ ID NO: 88346 - DNA, 20 bp, synthetic construct
  misc_feature 1..20: note = CRISPR gRNA sequence
  source 1..20: mol_type = other DNA
tacagaggagaatggacttc

SEQ ID NO: 88347 - DNA, 20 bp, synthetic construct
  misc_feature 1..20: note = CRISPR gRNA sequence
  source 1..20: mol_type = other DNA
ccttaggaaaagaatagcca

SEQ ID NO: 88348 - DNA, 20 bp, synthetic construct
  misc_feature 1..20: note = CRISPR gRNA sequence
  source 1..20: mol_type = other DNA
cttaggaaaagaatagccaa

SEQ ID NO: 88349 - DNA, 20 bp, synthetic construct
  misc_feature 1..20: note = CRISPR gRNA sequence
  source 1..20: mol_type = other DNA
aggaaaagaatagccaaatg

SEQ ID NO: 88350 - DNA, 20 bp, synthetic construct
  misc_feature 1..20: note = CRISPR gRNA sequence
  source 1..20: mol_type = other DNA
ggaaaagaatagccaaatga

SEQ ID NO: 88351 - DNA, 20 bp, synthetic construct
  misc_feature 1..20: note = CRISPR gRNA sequence
  source 1..20: mol_type = other DNA
tactaggcaaagttaacgta

SEQ ID NO: 88352 - DNA, 20 bp, synthetic construct
  misc_feature 1..20: note = CRISPR gRNA sequence
  source 1..20: mol_type = other DNA
ctaggcaaagttaacgtagg

SEQ ID NO: 88353 - DNA, 20 bp, synthetic construct
  misc_feature 1..20: note = CRISPR gRNA sequence
  source 1..20: mol_type = other DNA
ggcaaagttaacgtagggat

SEQ ID NO: 88354 - DNA, 20 bp, synthetic construct
  misc_feature 1..20: note = CRISPR gRNA sequence
  source 1..20: mol_type = other DNA
acgtagggatataaacactc

SEQ ID NO: 88355 - DNA, 20 bp, synthetic construct
  misc_feature 1..20: note = CRISPR gRNA sequence
  source 1..20: mol_type = other DNA
ttccccacagacctgtatca

SEQ ID NO: 88356 - DNA, 20 bp, synthetic construct
  misc_feature 1..20: note = CRISPR gRNA sequence
  source 1..20: mol_type = other DNA
ccccacagacctgtatcatg

SEQ ID NO: 88357 - DNA, 20 bp, synthetic construct
  misc_feature 1..20: note = CRISPR gRNA sequence
  source 1..20: mol_type = other DNA
cccacagacctgtatcatgg

SEQ ID NO: 88358 - DNA, 20 bp, synthetic construct
  misc_feature 1..20: note = CRISPR gRNA sequence
  source 1..20: mol_type = other DNA
tatcatgggggtgttgcttt

SEQ ID NO: 88359 - DNA, 20 bp, synthetic construct
  misc_feature 1..20: note = CRISPR gRNA sequence
  source 1..20: mol_type = other DNA
cttttgggtctttatgctcc

SEQ ID NO: 88360 - DNA, 20 bp, synthetic construct
  misc_feature 1..20: note = CRISPR gRNA sequence
  source 1..20: mol_type = other DNA
ttgggtctttatgctcctgg

SEQ ID NO: 88361 - DNA, 20 bp, synthetic construct
  misc_feature 1..20: note = CRISPR gRNA sequence
  source 1..20: mol_type = other DNA
tgggtctttatgctcctggg

SEQ ID NO: 88362 - DNA, 20 bp, synthetic construct
  misc_feature 1..20: note = CRISPR gRNA sequence
  source 1..20: mol_type = other DNA
gggtctttatgctcctggga

SEQ ID NO: 88363 - DNA, 20 bp, synthetic construct
  misc_feature 1..20: note = CRISPR gRNA sequence
  source 1..20: mol_type = other DNA
ggtctttatgctcctgggat

SEQ ID NO: 88364 - DNA, 20 bp, synthetic construct
  misc_feature 1..20: note = CRISPR gRNA sequence
  source 1..20: mol_type = other DNA
tatgctcctgggataaggaa

SEQ ID NO: 88365 - DNA, 20 bp, synthetic construct
  misc_feature 1..20: note = CRISPR gRNA sequence
  source 1..20: mol_type = other DNA
atgctcctgggataaggaac

SEQ ID NO: 88366 - DNA, 20 bp, synthetic construct
  misc_feature 1..20: note = CRISPR gRNA sequence
  source 1..20: mol_type = other DNA
tgctcctgggataaggaact

SEQ ID NO: 88367 - DNA, 20 bp, synthetic construct
  misc_feature 1..20: note = CRISPR gRNA sequence
  source 1..20: mol_type = other DNA
ctgggataaggaactttgaa

SEQ ID NO: 88368 - DNA, 20 bp, synthetic construct
  misc_feature 1..20: note = CRISPR gRNA sequence
  source 1..20: mol_type = other DNA
ggataaggaactttgaagca

SEQ ID NO: 88369 - DNA, 20 bp, synthetic construct
  misc_feature 1..20: note = CRISPR gRNA sequence
  source 1..20: mol_type = other DNA
tgaagcacatgctcctttaa

SEQ ID NO: 88370 - DNA, 20 bp, synthetic construct
  misc_feature 1..20: note = CRISPR gRNA sequence
  source 1..20: mol_type = other DNA
gaagcacatgctcctttaag

SEQ ID NO: 88371 - DNA, 20 bp, synthetic construct
  misc_feature 1..20: note = CRISPR gRNA sequence
  source 1..20: mol_type = other DNA
aagcacatgctcctttaagt

SEQ ID NO: 88372 - DNA, 20 bp, synthetic construct
  misc_feature 1..20: note = CRISPR gRNA sequence
  source 1..20: mol_type = other DNA
ctttaagtctttattaccct

SEQ ID NO: 88373 - DNA, 20 bp, synthetic construct
  misc_feature 1..20: note = CRISPR gRNA sequence
  source 1..20: mol_type = other DNA
taagtctttattaccctgtg

SEQ ID NO: 88374 - DNA, 20 bp, synthetic construct
  misc_feature 1..20: note = CRISPR gRNA sequence
  source 1..20: mol_type = other DNA
aagtctttattaccctgtgg

SEQ ID NO: 88375 - DNA, 20 bp, synthetic construct
  misc_feature 1..20: note = CRISPR gRNA sequence
  source 1..20: mol_type = other DNA
agtctttattaccctgtggt

SEQ ID NO: 88376 - DNA, 20 bp, synthetic construct
  misc_feature 1..20: note = CRISPR gRNA sequence
  source 1..20: mol_type = other DNA
tattaccctgtggtgcagtg

SEQ ID NO: 88377 - DNA, 20 bp, synthetic construct
  misc_feature 1..20: note = CRISPR gRNA sequence
  source 1..20: mol_type = other DNA
attaccctgtggtgcagtgt

SEQ ID NO: 88378 - DNA, 20 bp, synthetic construct
  misc_feature 1..20: note = CRISPR gRNA sequence
  source 1..20: mol_type = other DNA
ttaccctgtggtgcagtgtc

SEQ ID NO: 88379 - DNA, 20 bp, synthetic construct
  misc_feature 1..20: note = CRISPR gRNA sequence
  source 1..20: mol_type = other DNA
ccctgtggtgcagtgtctac

SEQ ID NO: 88380 - DNA, 20 bp, synthetic construct
  misc_feature 1..20: note = CRISPR gRNA sequence
  source 1..20: mol_type = other DNA
tggtgcagtgtctacctctc

SEQ ID NO: 88381 - DNA, 20 bp, synthetic construct
  misc_feature 1..20: note = CRISPR gRNA sequence
  source 1..20: mol_type = other DNA
cctctccctttgccaaagga

SEQ ID NO: 88382 - DNA, 20 bp, synthetic construct
  misc_feature 1..20: note = CRISPR gRNA sequence
  source 1..20: mol_type = other DNA
tccctttgccaaaggaaaag

SEQ ID NO: 88383 - DNA, 20 bp, synthetic construct
  misc_feature 1..20: note = CRISPR gRNA sequence
  source 1..20: mol_type = other DNA
cctttgccaaaggaaaagcc

SEQ ID NO: 88384 - DNA, 20 bp, synthetic construct
  misc_feature 1..20: note = CRISPR gRNA sequence
  source 1..20: mol_type = other DNA
tgccaaaggaaaagcctcct

SEQ ID NO: 88385 - DNA, 20 bp, synthetic construct
  misc_feature 1..20: note = CRISPR gRNA sequence
  source 1..20: mol_type = other DNA
gccaaaggaaaagcctcctt

SEQ ID NO: 88386 - DNA, 20 bp, synthetic construct
  misc_feature 1..20: note = CRISPR gRNA sequence
  source 1..20: mol_type = other DNA
ccaaaggaaaagcctccttt

SEQ ID NO: 88387 - DNA, 20 bp, synthetic construct
  misc_feature 1..20: note = CRISPR gRNA sequence
  source 1..20: mol_type = other DNA
cttttggcttctgctgccct

SEQ ID NO: 88388 - DNA, 20 bp, synthetic construct
  misc_feature 1..20: note = CRISPR gRNA sequence
  source 1..20: mol_type = other DNA
ttggcttctgctgcccttga

SEQ ID NO: 88389 - DNA, 20 bp, synthetic construct
  misc_feature 1..20: note = CRISPR gRNA sequence
  source 1..20: mol_type = other DNA
tggcttctgctgcccttgat

SEQ ID NO: 88390 - DNA, 20 bp, synthetic construct
  misc_feature 1..20: note = CRISPR gRNA sequence
  source 1..20: mol_type = other DNA
ggcttctgctgcccttgatg

SEQ ID NO: 88391 - DNA, 20 bp, synthetic construct
  misc_feature 1..20: note = CRISPR gRNA sequence
  source 1..20: mol_type = other DNA
gcttctgctgcccttgatga

SEQ ID NO: 88392 - DNA, 20 bp, synthetic construct
  misc_feature 1..20: note = CRISPR gRNA sequence
  source 1..20: mol_type = other DNA
ctgctgcccttgatgacact

SEQ ID NO: 88393 - DNA, 20 bp, synthetic construct
  misc_feature 1..20: note = CRISPR gRNA sequence
  source 1..20: mol_type = other DNA
tgctgcccttgatgacactc

SEQ ID NO: 88394 - DNA, 20 bp, synthetic construct
  misc_feature 1..20: note = CRISPR gRNA sequence
  source 1..20: mol_type = other DNA
ctgcccttgatgacactcac

SEQ ID NO: 88395 - DNA, 20 bp, synthetic construct
  misc_feature 1..20: note = CRISPR gRNA sequence
  source 1..20: mol_type = other DNA
cccttgatgacactcacttt

SEQ ID NO: 88396 - DNA, 20 bp, synthetic construct
  misc_feature 1..20: note = CRISPR gRNA sequence
  source 1..20: mol_type = other DNA
gatgacactcacttttgagg

SEQ ID NO: 88397 - DNA, 20 bp, synthetic construct
  misc_feature 1..20: note = CRISPR gRNA sequence
  source 1..20: mol_type = other DNA
atgacactcacttttgaggg

SEQ ID NO: 88398 - DNA, 20 bp, synthetic construct
  misc_feature 1..20: note = CRISPR gRNA sequence
  source 1..20: mol_type = other DNA
acttttgaggggaccaaggg

SEQ ID NO: 88399 - DNA, 20 bp, synthetic construct
  misc_feature 1..20: note = CRISPR gRNA sequence
  source 1..20: mol_type = other DNA
ttgaggggaccaagggaatt

SEQ ID NO: 88400 - DNA, 20 bp, synthetic construct
  misc_feature 1..20: note = CRISPR gRNA sequence
  source 1..20: mol_type = other DNA
tgaggggaccaagggaattt

SEQ ID NO: 88401 - DNA, 20 bp, synthetic construct
  misc_feature 1..20: note = CRISPR gRNA sequence
  source 1..20: mol_type = other DNA
gaggggaccaagggaatttt

SEQ ID NO: 88402 - DNA, 20 bp, synthetic construct
  misc_feature 1..20: note = CRISPR gRNA sequence
  source 1..20: mol_type = other DNA
aggggaccaagggaatttta

SEQ ID NO: 88403 - DNA, 20 bp, synthetic construct
  misc_feature 1..20: note = CRISPR gRNA sequence
  source 1..20: mol_type = other DNA
tatcttctgcttctttggta

SEQ ID NO: 88404 - DNA, 20 bp, synthetic construct
  misc_feature 1..20: note = CRISPR gRNA sequence
  source 1..20: mol_type = other DNA
atcttctgcttctttggtat

SEQ ID NO: 88405 - DNA, 20 bp, synthetic construct
  misc_feature 1..20: note = CRISPR gRNA sequence
  source 1..20: mol_type = other DNA
tcttctgcttctttggtatg

SEQ ID NO: 88406 - DNA, 20 bp, synthetic construct
  misc_feature 1..20: note = CRISPR gRNA sequence
  source 1..20: mol_type = other DNA
ctgcttctttggtatgctgg

SEQ ID NO: 88407 - DNA, 20 bp, synthetic construct
  misc_feature 1..20: note = CRISPR gRNA sequence
  source 1..20: mol_type = other DNA
tgcttctttggtatgctggg

SEQ ID NO: 88408 - DNA, 20 bp, synthetic construct
  misc_feature 1..20: note = CRISPR gRNA sequence
  source 1..20: mol_type = other DNA
cttctttggtatgctgggaa

SEQ ID NO: 88409 - DNA, 20 bp, synthetic construct
  misc_feature 1..20: note = CRISPR gRNA sequence
  source 1..20: mol_type = other DNA
ctttggtatgctgggaaccg

SEQ ID NO: 88410 - DNA, 20 bp, synthetic construct
  misc_feature 1..20: note = CRISPR gRNA sequence
  source 1..20: mol_type = other DNA
tttggtatgctgggaaccgg

SEQ ID NO: 88411 - DNA, 20 bp, synthetic construct
  misc_feature 1..20: note = CRISPR gRNA sequence
  source 1..20: mol_type = other DNA
tggtatgctgggaaccgggg

SEQ ID NO: 88412 - DNA, 20 bp, synthetic construct
  misc_feature 1..20: note = CRISPR gRNA sequence
  source 1..20: mol_type = other DNA
ggtatgctgggaaccggggc

SEQ ID NO: 88413 - DNA, 20 bp, synthetic construct
  misc_feature 1..20: note = CRISPR gRNA sequence
  source 1..20: mol_type = other DNA
gtatgctgggaaccggggcc

SEQ ID NO: 88414 - DNA, 20 bp, synthetic construct
  misc_feature 1..20: note = CRISPR gRNA sequence
  source 1..20: mol_type = other DNA
ggaaccggggccccttcctc

SEQ ID NO: 88415 - DNA, 20 bp, synthetic construct
  misc_feature 1..20: note = CRISPR gRNA sequence
  source 1..20: mol_type = other DNA
cctcctttggaaacagtacc

SEQ ID NO: 88416 - DNA, 20 bp, synthetic construct
  misc_feature 1..20: note = CRISPR gRNA sequence
  source 1..20: mol_type = other DNA
ctcctttggaaacagtacca

SEQ ID NO: 88417 - DNA, 20 bp, synthetic construct
  misc_feature 1..20: note = CRISPR gRNA sequence
  source 1..20: mol_type = other DNA
ctttggaaacagtaccatct

SEQ ID NO: 88418 - DNA, 20 bp, synthetic construct
  misc_feature 1..20: note = CRISPR gRNA sequence
  source 1..20: mol_type = other DNA
tggaaacagtaccatctccc

SEQ ID NO: 88419 - DNA, 20 bp, synthetic construct
  misc_feature 1..20: note = CRISPR gRNA sequence
  source 1..20: mol_type = other DNA
ggaaacagtaccatctccct

SEQ ID NO: 88420 - DNA, 20 bp, synthetic construct
  misc_feature 1..20: note = CRISPR gRNA sequence
  source 1..20: mol_type = other DNA
gaaacagtaccatctccctg

SEQ ID NO: 88421 - DNA, 20 bp, synthetic construct
  misc_feature 1..20: note = CRISPR gRNA sequence
  source 1..20: mol_type = other DNA
cctgaccctgggcaagtact

SEQ ID NO: 88422 - DNA, 20 bp, synthetic construct
  misc_feature 1..20: note = CRISPR gRNA sequence
  source 1..20: mol_type = other DNA
accctgggcaagtactgccc

SEQ ID NO: 88423 - DNA, 20 bp, synthetic construct
  misc_feature 1..20: note = CRISPR gRNA sequence
  source 1..20: mol_type = other DNA
ggcaagtactgccccctttt

SEQ ID NO: 88424 - DNA, 20 bp, synthetic construct
  misc_feature 1..20: note = CRISPR gRNA sequence
  source 1..20: mol_type = other DNA
cccccttttcagcctctccc

SEQ ID NO: 88425 - DNA, 20 bp, synthetic construct
  misc_feature 1..20: note = CRISPR gRNA sequence
  source 1..20: mol_type = other DNA
ttcagcctctcccattggcc

SEQ ID NO: 88426 - DNA, 20 bp, synthetic construct
  misc_feature 1..20: note = CRISPR gRNA sequence
  source 1..20: mol_type = other DNA
tcagcctctcccattggccc

SEQ ID NO: 88427 - DNA, 20 bp, synthetic construct
  misc_feature 1..20: note = CRISPR gRNA sequence
  source 1..20: mol_type = other DNA
cagcctctcccattggccct

SEQ ID NO: 88428 - DNA, 20 bp, synthetic construct
  misc_feature 1..20: note = CRISPR gRNA sequence
  source 1..20: mol_type = other DNA
agcctctcccattggccctg

SEQ ID NO: 88429 - DNA, 20 bp, synthetic construct
  misc_feature 1..20: note = CRISPR gRNA sequence
  source 1..20: mol_type = other DNA
tcccattggccctggcctct

SEQ ID NO: 88430 - DNA, 20 bp, synthetic construct
  misc_feature 1..20: note = CRISPR gRNA sequence
  source 1..20: mol_type = other DNA
ccattggccctggcctctct

SEQ ID NO: 88431 - DNA, 20 bp, synthetic construct
  misc_feature 1..20: note = CRISPR gRNA sequence
  source 1..20: mol_type = other DNA
gccctggcctctctgcccct

SEQ ID NO: 88432 - DNA, 20 bp, synthetic construct
  misc_feature 1..20: note = CRISPR gRNA sequence
  source 1..20: mol_type = other DNA
gcctctctgcccctccagct

SEQ ID NO: 88433 - DNA, 20 bp, synthetic construct
  misc_feature 1..20: note = CRISPR gRNA sequence
  source 1..20: mol_type = other DNA
tctgcccctccagctgagtt

SEQ ID NO: 88434 - DNA, 20 bp, synthetic construct
  misc_feature 1..20: note = CRISPR gRNA sequence
  source 1..20: mol_type = other DNA
tgcccctccagctgagttgc

SEQ ID NO: 88435 - DNA, 20 bp, synthetic construct
  misc_feature 1..20: note = CRISPR gRNA sequence
  source 1..20: mol_type = other DNA
cccctccagctgagttgcct

SEQ ID NO: 88436 - DNA, 20 bp, synthetic construct
  misc_feature 1..20: note = CRISPR gRNA sequence
  source 1..20: mol_type = other DNA
cagctgagttgccttcccct

SEQ ID NO: 88437 - DNA, 20 bp, synthetic construct
  misc_feature 1..20: note = CRISPR gRNA sequence
  source 1..20: mol_type = other DNA
agttgccttcccctcctgag

SEQ ID NO: 88438 - DNA, 20 bp, synthetic construct
  misc_feature 1..20: note = CRISPR gRNA sequence
  source 1..20: mol_type = other DNA
ccttcccctcctgagcccca

SEQ ID NO: 88439 - DNA, 20 bp, synthetic construct
  misc_feature 1..20: note = CRISPR gRNA sequence
  source 1..20: mol_type = other DNA
cccctcctgagccccatgtc

SEQ ID NO: 88440 - DNA, 20 bp, synthetic construct
  misc_feature 1..20: note = CRISPR gRNA sequence
  source 1..20: mol_type = other DNA
ccctcctgagccccatgtct

SEQ ID NO: 88441 - DNA, 20 bp, synthetic construct
  misc_feature 1..20: note = CRISPR gRNA sequence
  source 1..20: mol_type = other DNA
ctgagccccatgtctcccat

SEQ ID NO: 88442 - DNA, 20 bp, synthetic construct
  misc_feature 1..20: note = CRISPR gRNA sequence
  source 1..20: mol_type = other DNA
agccccatgtctcccatggt

SEQ ID NO: 88443 - DNA, 20 bp, synthetic construct
  misc_feature 1..20: note = CRISPR gRNA sequence
  source 1..20: mol_type = other DNA
ccatggtaaccttgaggact

SEQ ID NO: 88444 - DNA, 20 bp, synthetic construct
  misc_feature 1..20: note = CRISPR gRNA sequence
  source 1..20: mol_type = other DNA
gaggactgggcagattccat

SEQ ID NO: 88445 - DNA, 20 bp, synthetic construct
  misc_feature 1..20: note = CRISPR gRNA sequence
  source 1..20: mol_type = other DNA
aggactgggcagattccatg

SEQ ID NO: 88446 - DNA, 20 bp, synthetic construct
  misc_feature 1..20: note = CRISPR gRNA sequence
  source 1..20: mol_type = other DNA
ggcagattccatggcagctg

SEQ ID NO: 88447 - DNA, 20 bp, synthetic construct
  misc_feature 1..20: note = CRISPR gRNA sequence
  source 1..20: mol_type = other DNA
catggcagctgctgacttga

SEQ ID NO: 88448 - DNA, 20 bp, synthetic construct
  misc_feature 1..20: note = CRISPR gRNA sequence
  source 1..20: mol_type = other DNA
ctgacttgagaggggtagaa

SEQ ID NO: 88449 - DNA, 20 bp, synthetic construct
  misc_feature 1..20: note = CRISPR gRNA sequence
  source 1..20: mol_type = other DNA
acttgagaggggtagaattc

SEQ ID NO: 88450 - DNA, 20 bp, synthetic construct
  misc_feature 1..20: note = CRISPR gRNA sequence
  source 1..20: mol_type = other DNA
gagaggggtagaattccttt

SEQ ID NO: 88451 - DNA, 20 bp, synthetic construct
  misc_feature 1..20: note = CRISPR gRNA sequence
  source 1..20: mol_type = other DNA
agaggggtagaattcctttc

SEQ ID NO: 88452 - DNA, 20 bp, synthetic construct
  misc_feature 1..20: note = CRISPR gRNA sequence
  source 1..20: mol_type = other DNA
ctttccccacttccacctga

SEQ ID NO: 88453 - DNA, 20 bp, synthetic construct
  misc_feature 1..20: note = CRISPR gRNA sequence
  source 1..20: mol_type = other DNA
tccccacttccacctgactt

SEQ ID NO: 88454 - DNA, 20 bp, synthetic construct
  misc_feature 1..20: note = CRISPR gRNA sequence
  source 1..20: mol_type = other DNA
ccccacttccacctgacttt

SEQ ID NO: 88455 - DNA, 20 bp, synthetic construct
  misc_feature 1..20: note = CRISPR gRNA sequence
  source 1..20: mol_type = other DNA
cccacttccacctgactttt

SEQ ID NO: 88456 - DNA, 20 bp, synthetic construct
  misc_feature 1..20: note = CRISPR gRNA sequence
  source 1..20: mol_type = other DNA
ccacctgacttttttcgagg

SEQ ID NO: 88457 - DNA, 20 bp, synthetic construct
  misc_feature 1..20: note = CRISPR gRNA sequence
  source 1..20: mol_type = other DNA
cacctgacttttttcgaggg

SEQ ID NO: 88458 - DNA, 20 bp, synthetic construct
  misc_feature 1..20: note = CRISPR gRNA sequence
  source 1..20: mol_type = other DNA
acttttttcgagggcgcccc

SEQ ID NO: 88459 - DNA, 20 bp, synthetic construct
  misc_feature 1..20: note = CRISPR gRNA sequence
  source 1..20: mol_type = other DNA
ttttcgagggcgcccccgtt

SEQ ID NO: 88460 - DNA, 20 bp, synthetic construct
  misc_feature 1..20: note = CRISPR gRNA sequence
  source 1..20: mol_type = other DNA
tttcgagggcgcccccgttt

SEQ ID NO: 88461 - DNA, 20 bp, synthetic construct
  misc_feature 1..20: note = CRISPR gRNA sequence
  source 1..20: mol_type = other DNA
ttcgagggcgcccccgtttc

SEQ ID NO: 88462 - DNA, 20 bp, synthetic construct
  misc_feature 1..20: note = CRISPR gRNA sequence
  source 1..20: mol_type = other DNA
tcgagggcgcccccgtttcc

SEQ ID NO: 88463 - DNA, 20 bp, synthetic construct
  misc_feature 1..20: note = CRISPR gRNA sequence
  source 1..20: mol_type = other DNA
cgagggcgcccccgtttcct

SEQ ID NO: 88464 - DNA, 20 bp, synthetic construct
  misc_feature 1..20: note = CRISPR gRNA sequence
  source 1..20: mol_type = other DNA
gagggcgcccccgtttcctt

SEQ ID NO: 88465 - DNA, 20 bp, synthetic construct
  misc_feature 1..20: note = CRISPR gRNA sequence
  source 1..20: mol_type = other DNA
ccttttggcatcacttgctg

SEQ ID NO: 88466 - DNA, 20 bp, synthetic construct
  misc_feature 1..20: note = CRISPR gRNA sequence
  source 1..20: mol_type = other DNA
cttttggcatcacttgctgt

SEQ ID NO: 88467 - DNA, 20 bp, synthetic construct
  misc_feature 1..20: note = CRISPR gRNA sequence
  source 1..20: mol_type = other DNA
ttggcatcacttgctgtatc

SEQ ID NO: 88468 - DNA, 20 bp, synthetic construct
  misc_feature 1..20: note = CRISPR gRNA sequence
  source 1..20: mol_type = other DNA
tggcatcacttgctgtatcc

SEQ ID NO: 88469 - DNA, 20 bp, synthetic construct
  misc_feature 1..20: note = CRISPR gRNA sequence
  source 1..20: mol_type = other DNA
ggcatcacttgctgtatcct

SEQ ID NO: 88470 - DNA, 20 bp, synthetic construct
  misc_feature 1..20: note = CRISPR gRNA sequence
  source 1..20: mol_type = other DNA
gcatcacttgctgtatcctc

SEQ ID NO: 88471 - DNA, 20 bp, synthetic construct
  misc_feature 1..20: note = CRISPR gRNA sequence
  source 1..20: mol_type = other DNA
gctgtatcctctatatcctg

SEQ ID NO: 88472 - DNA, 20 bp, synthetic construct
  misc_feature 1..20: note = CRISPR gRNA sequence
  source 1..20: mol_type = other DNA
ctgtatcctctatatcctgc

SEQ ID NO: 88473 - DNA, 20 bp, synthetic construct
  misc_feature 1..20: note = CRISPR gRNA sequence
  source 1..20: mol_type = other DNA
tatcctctatatcctgcttt

SEQ ID NO: 88474 - DNA, 20 bp, synthetic construct
  misc_feature 1..20: note = CRISPR gRNA sequence
  source 1..20: mol_type = other DNA
tatatcctgctttgctgctt

SEQ ID NO: 88475 - DNA, 20 bp, synthetic construct
  misc_feature 1..20: note = CRISPR gRNA sequence
  source 1..20: mol_type = other DNA
tatcctgctttgctgcttta

SEQ ID NO: 88476 - DNA, 20 bp, synthetic construct
  misc_feature 1..20: note = CRISPR gRNA sequence
  source 1..20: mol_type = other DNA
ctttgctgctttagctggtg

SEQ ID NO: 88477 - DNA, 20 bp, synthetic construct
  misc_feature 1..20: note = CRISPR gRNA sequence
  source 1..20: mol_type = other DNA
tgctgctttagctggtggag

SEQ ID NO: 88478 - DNA, 20 bp, synthetic construct
  misc_feature 1..20: note = CRISPR gRNA sequence
  source 1..20: mol_type = other DNA
gctgctttagctggtggagc

SEQ ID NO: 88479 - DNA, 20 bp, synthetic construct
  misc_feature 1..20: note = CRISPR gRNA sequence
  source 1..20: mol_type = other DNA
ctgctttagctggtggagcc

SEQ ID NO: 88480 - DNA, 20 bp, synthetic construct
  misc_feature 1..20: note = CRISPR gRNA sequence
  source 1..20: mol_type = other DNA
ctttagctggtggagcctgc

SEQ ID NO: 88481 - DNA, 20 bp, synthetic construct
  misc_feature 1..20: note = CRISPR gRNA sequence
  source 1..20: mol_type = other DNA
tagctggtggagcctgccca

SEQ ID NO: 88482 - DNA, 20 bp, synthetic construct
  misc_feature 1..20: note = CRISPR gRNA sequence
  source 1..20: mol_type = other DNA
agctggtggagcctgcccac

SEQ ID NO: 88483 - DNA, 20 bp, synthetic construct
  misc_feature 1..20: note = CRISPR gRNA sequence
  source 1..20: mol_type = other DNA
gctggtggagcctgcccact

SEQ ID NO: 88484 - DNA, 20 bp, synthetic construct
  misc_feature 1..20: note = CRISPR gRNA sequence
  source 1..20: mol_type = other DNA
gtggagcctgcccactggcc

SEQ ID NO: 88485 - DNA, 20 bp, synthetic construct
  misc_feature 1..20: note = CRISPR gRNA sequence
  source 1..20: mol_type = other DNA
cccactggcctcactcacag

SEQ ID NO: 88486 - DNA, 20 bp, synthetic construct
  misc_feature 1..20: note = CRISPR gRNA sequence
  source 1..20: mol_type = other DNA
gcctcactcacaggtacttc

SEQ ID NO: 88487 - DNA, 20 bp, synthetic construct
  misc_feature 1..20: note = CRISPR gRNA sequence
  source 1..20: mol_type = other DNA
actcacaggtacttcagctg

SEQ ID NO: 88488 - DNA, 20 bp, synthetic construct
  misc_feature 1..20: note = CRISPR gRNA sequence
  source 1..20: mol_type = other DNA
acaggtacttcagctgtcct

SEQ ID NO: 88489 - DNA, 20 bp, synthetic construct
  misc_feature 1..20: note = CRISPR gRNA sequence
  source 1..20: mol_type = other DNA
cagctgtcctcttgacaccc

SEQ ID NO: 88490 - DNA, 20 bp, synthetic construct
  misc_feature 1..20: note = CRISPR gRNA sequence
  source 1..20: mol_type = other DNA
agctgtcctcttgacaccct

SEQ ID NO: 88491 - DNA, 20 bp, synthetic construct
  misc_feature 1..20: note = CRISPR gRNA sequence
  source 1..20: mol_type = other DNA
tcctcttgacacccttgtca

SEQ ID NO: 88492 - DNA, 20 bp, synthetic construct
  misc_feature 1..20: note = CRISPR gRNA sequence
  source 1..20: mol_type = other DNA
ttgacacccttgtcatgtgg

SEQ ID NO: 88493 - DNA, 20 bp, synthetic construct
  misc_feature 1..20: note = CRISPR gRNA sequence
  source 1..20: mol_type = other DNA
gacacccttgtcatgtggtc

SEQ ID NO: 88494 - DNA, 20 bp, synthetic construct
  misc_feature 1..20: note = CRISPR gRNA sequence
  source 1..20: mol_type = other DNA
acacccttgtcatgtggtcc

SEQ ID NO: 88495 - DNA, 20 bp, synthetic construct
  misc_feature 1..20: note = CRISPR gRNA sequence
  source 1..20: mol_type = other DNA
gtcatgtggtccttggtcac

SEQ ID NO: 88496 - DNA, 20 bp, synthetic construct
  misc_feature 1..20: note = CRISPR gRNA sequence
  source 1..20: mol_type = other DNA
tcatgtggtccttggtcacc

SEQ ID NO: 88497 - DNA, 20 bp, synthetic construct
  misc_feature 1..20: note = CRISPR gRNA sequence
  source 1..20: mol_type = other DNA
ggtcaccacctatgcctacc

SEQ ID NO: 88498 - DNA, 20 bp, synthetic construct
  misc_feature 1..20: note = CRISPR gRNA sequence
  source 1..20: mol_type = other DNA
gtcaccacctatgcctacct

SEQ ID NO: 88499 - DNA, 20 bp, synthetic construct
  misc_feature 1..20: note = CRISPR gRNA sequence
  source 1..20: mol_type = other DNA
tgcctacctctctgttctct

SEQ ID NO: 88500 - DNA, 20 bp, synthetic construct
  misc_feature 1..20: note = CRISPR gRNA sequence
  source 1..20: mol_type = other DNA
cctctctgttctctgtgccc

SEQ ID NO: 88501 - DNA, 20 bp, synthetic construct
  misc_feature 1..20: note = CRISPR gRNA sequence
  source 1..20: mol_type = other DNA
tctgttctctgtgccccggg

SEQ ID NO: 88502 - DNA, 20 bp, synthetic construct
  misc_feature 1..20: note = CRISPR gRNA sequence
  source 1..20: mol_type = other DNA
tgttctctgtgccccggggc

SEQ ID NO: 88503 - DNA, 20 bp, synthetic construct
  misc_feature 1..20: note = CRISPR gRNA sequence
  source 1..20: mol_type = other DNA
ttctctgtgccccggggctg

SEQ ID NO: 88504 - DNA, 20 bp, synthetic construct
  misc_feature 1..20: note = CRISPR gRNA sequence
  source 1..20: mol_type = other DNA
tctgtgccccggggctgagt

SEQ ID NO: 88505 - DNA, 20 bp, synthetic construct
  misc_feature 1..20: note = CRISPR gRNA sequence
  source 1..20: mol_type = other DNA
tgtgccccggggctgagtga

SEQ ID NO: 88506 - DNA, 20 bp, synthetic construct
  misc_feature 1..20: note = CRISPR gRNA sequence
  source 1..20: mol_type = other DNA
tgccccggggctgagtgagt

SEQ ID NO: 88507 - DNA, 20 bp, synthetic construct
  misc_feature 1..20: note = CRISPR gRNA sequence
  source 1..20: mol_type = other DNA
agtgagtcccccaggtggag

SEQ ID NO: 88508 - DNA, 20 bp, synthetic construct
  misc_feature 1..20: note = CRISPR gRNA sequence
  source 1..20: mol_type = other DNA
gcccaggcccaggtccaggt

SEQ ID NO: 88509 - DNA, 20 bp, synthetic construct
  misc_feature 1..20: note = CRISPR gRNA sequence
  source 1..20: mol_type = other DNA
gtaagatcatgttaatgatg

SEQ ID NO: 88510 - DNA, 20 bp, synthetic construct
  misc_feature 1..20: note = CRISPR gRNA sequence
  source 1..20: mol_type = other DNA
atgatgggcacagctgctgg

SEQ ID NO: 88511 - DNA, 20 bp, synthetic construct
  misc_feature 1..20: note = CRISPR gRNA sequence
  source 1..20: mol_type = other DNA
ctgggggtgccccggcccta

SEQ ID NO: 88512 - DNA, 20 bp, synthetic construct
  misc_feature 1..20: note = CRISPR gRNA sequence
  source 1..20: mol_type = other DNA
ggggtgccccggccctacta

SEQ ID NO: 88513 - DNA, 20 bp, synthetic construct
  misc_feature 1..20: note = CRISPR gRNA sequence
  source 1..20: mol_type = other DNA
ctagacagaggcagtgtagc

SEQ ID NO: 88514 - DNA, 20 bp, synthetic construct
  misc_feature 1..20: note = CRISPR gRNA sequence
  source 1..20: mol_type = other DNA
gacagaggcagtgtagccac

SEQ ID NO: 88515 - DNA, 20 bp, synthetic construct
  misc_feature 1..20: note = CRISPR gRNA sequence
  source 1..20: mol_type = other DNA
tcagggcacctgaagaaagc

SEQ ID NO: 88516 - DNA, 20 bp, synthetic construct
  misc_feature 1..20: note = CRISPR gRNA sequence
  source 1..20: mol_type = other DNA
cagggcacctgaagaaagcc

SEQ ID NO: 88517 - DNA, 20 bp, synthetic construct
  misc_feature 1..20: note = CRISPR gRNA sequence
  source 1..20: mol_type = other DNA
agggcacctgaagaaagcct

SEQ ID NO: 88518 - DNA, 20 bp, synthetic construct
  misc_feature 1..20: note = CRISPR gRNA sequence
  source 1..20: mol_type = other DNA
aagaaagcctgggggccaga

SEQ ID NO: 88519 - DNA, 20 bp, synthetic construct
  misc_feature 1..20: note = CRISPR gRNA sequence
  source 1..20: mol_type = other DNA
ggggccagaataggtggaga

SEQ ID NO: 88520 - DNA, 20 bp, synthetic construct
  misc_feature 1..20: note = CRISPR gRNA sequence
  source 1..20: mol_type = other DNA
ggattggcggaattagtgag

SEQ ID NO: 88521 - DNA, 20 bp, synthetic construct
  misc_feature 1..20: note = CRISPR gRNA sequence
  source 1..20: mol_type = other DNA
gcggaattagtgagcgaggg

SEQ ID NO: 88522 - DNA, 20 bp, synthetic construct
  misc_feature 1..20: note = CRISPR gRNA sequence
  source 1..20: mol_type = other DNA
gtgagcgaggggcccgggga

SEQ ID NO: 88523 - DNA, 20 bp, synthetic construct
  misc_feature 1..20: note = CRISPR gRNA sequence
  source 1..20: mol_type = other DNA
gggcattaacctgcaggtta

SEQ ID NO: 88524 - DNA, 20 bp, synthetic construct
  misc_feature 1..20: note = CRISPR gRNA sequence
  source 1..20: mol_type = other DNA
acctgcaggttattggctcc

SEQ ID NO: 88525 - DNA, 20 bp, synthetic construct
  misc_feature 1..20: note = CRISPR gRNA sequence
  source 1..20: mol_type = other DNA
caggttattggctcctgggg

SEQ ID NO: 88526 - DNA, 20 bp, synthetic construct
  misc_feature 1..20: note = CRISPR gRNA sequence
  source 1..20: mol_type = other DNA
ttggctcctggggccgagct

SEQ ID NO: 88527 - DNA, 20 bp, synthetic construct
  misc_feature 1..20: note = CRISPR gRNA sequence
  source 1..20: mol_type = other DNA
gctcctggggccgagctctc

SEQ ID NO: 88528 - DNA, 20 bp, synthetic construct
  misc_feature 1..20: note = CRISPR gRNA sequence
  source 1..20: mol_type = other DNA
ctggggccgagctctcaact

SEQ ID NO: 88529 - DNA, 20 bp, synthetic construct
  misc_feature 1..20: note = CRISPR gRNA sequence
  source 1..20: mol_type = other DNA
gggccgagctctcaactaca

SEQ ID NO: 88530 - DNA, 20 bp, synthetic construct
  misc_feature 1..20: note = CRISPR gRNA sequence
  source 1..20: mol_type = other DNA
tcaactacactcttcttccg

SEQ ID NO: 88531 - DNA, 20 bp, synthetic construct
  misc_feature 1..20: note = CRISPR gRNA sequence
  source 1..20: mol_type = other DNA
aactacactcttcttccgct

SEQ ID NO: 88532 - DNA, 20 bp, synthetic construct
  misc_feature 1..20: note = CRISPR gRNA sequence
  source 1..20: mol_type = other DNA
cactcttcttccgctctcca

SEQ ID NO: 88533 - DNA, 20 bp, synthetic construct
  misc_feature 1..20: note = CRISPR gRNA sequence
  source 1..20: mol_type = other DNA
ttcttccgctctccacgtgc

SEQ ID NO: 88534 - DNA, 20 bp, synthetic construct
  misc_feature 1..20: note = CRISPR gRNA sequence
  source 1..20: mol_type = other DNA
cttccgctctccacgtgcga

SEQ ID NO: 88535 - DNA, 20 bp, synthetic construct
  misc_feature 1..20: note = CRISPR gRNA sequence
  source 1..20: mol_type = other DNA
ttccgctctccacgtgcgag

SEQ ID NO: 88536 - DNA, 20 bp, synthetic construct
  misc_feature 1..20: note = CRISPR gRNA sequence
  source 1..20: mol_type = other DNA
ccgctctccacgtgcgagag

SEQ ID NO: 88537 - DNA, 20 bp, synthetic construct
  misc_feature 1..20: note = CRISPR gRNA sequence
  source 1..20: mol_type = other DNA
cgctctccacgtgcgagagg

SEQ ID NO: 88538 - DNA, 20 bp, synthetic construct
  misc_feature 1..20: note = CRISPR gRNA sequence
  source 1..20: mol_type = other DNA
tccacgtgcgagaggaccgg

SEQ ID NO: 88539 - DNA, 20 bp, synthetic construct
  misc_feature 1..20: note = CRISPR gRNA sequence
  source 1..20: mol_type = other DNA
cacgtgcgagaggaccggcc

SEQ ID NO: 88540 - DNA, 20 bp, synthetic construct
  misc_feature 1..20: note = CRISPR gRNA sequence
  source 1..20: mol_type = other DNA
gggcttccagatccttagga

SEQ ID NO: 88541 - DNA, 20 bp, synthetic construct
  misc_feature 1..20: note = CRISPR gRNA sequence
  source 1..20: mol_type = other DNA
ccagatccttaggaggctaa

SEQ ID NO: 88542 - DNA, 20 bp, synthetic construct
  misc_feature 1..20: note = CRISPR gRNA sequence
  source 1..20: mol_type = other DNA
cagatccttaggaggctaaa

SEQ ID NO: 88543 - DNA, 20 bp, synthetic construct
  misc_feature 1..20: note = CRISPR gRNA sequence
  source 1..20: mol_type = other DNA
aggaggctaaaaagtaaaga

SEQ ID NO: 88544 - DNA, 20 bp, synthetic construct
  misc_feature 1..20: note = CRISPR gRNA sequence
  source 1..20: mol_type = other DNA
ggaggctaaaaagtaaagag

SEQ ID NO: 88545 - DNA, 20 bp, synthetic construct
  misc_feature 1..20: note = CRISPR gRNA sequence
  source 1..20: mol_type = other DNA
aaaagtaaagagaggaacac

SEQ ID NO: 88546 - DNA, 20 bp, synthetic construct
  misc_feature 1..20: note = CRISPR gRNA sequence
  source 1..20: mol_type = other DNA
ggggaaacatagacgccaga

SEQ ID NO: 88547 - DNA, 20 bp, synthetic construct
  misc_feature 1..20: note = CRISPR gRNA sequence
  source 1..20: mol_type = other DNA
gagaaggatatactaagccc

SEQ ID NO: 88548 - DNA, 20 bp, synthetic construct
  misc_feature 1..20: note = CRISPR gRNA sequence
  source 1..20: mol_type = other DNA
agcccccagcccaggacagc

SEQ ID NO: 88549 - DNA, 20 bp, synthetic construct
  misc_feature 1..20: note = CRISPR gRNA sequence
  source 1..20: mol_type = other DNA
acttccttacctgggccagt

SEQ ID NO: 88550 - DNA, 20 bp, synthetic construct
  misc_feature 1..20: note = CRISPR gRNA sequence
  source 1..20: mol_type = other DNA
ccttacctgggccagtctct

SEQ ID NO: 88551 - DNA, 20 bp, synthetic construct
  misc_feature 1..20: note = CRISPR gRNA sequence
  source 1..20: mol_type = other DNA
cttacctgggccagtctctc

SEQ ID NO: 88552 - DNA, 20 bp, synthetic construct
  misc_feature 1..20: note = CRISPR gRNA sequence
  source 1..20: mol_type = other DNA
acctgggccagtctctctgg

SEQ ID NO: 88553 - DNA, 20 bp, synthetic construct
  misc_feature 1..20: note = CRISPR gRNA sequence
  source 1..20: mol_type = other DNA
cctgggccagtctctctggc

SEQ ID NO: 88554 - DNA, 20 bp, synthetic construct
  misc_feature 1..20: note = CRISPR gRNA sequence
  source 1..20: mol_type = other DNA
ggccagtctctctggcttct

SEQ ID NO: 88555 - DNA, 20 bp, synthetic construct
  misc_feature 1..20: note = CRISPR gRNA sequence
  source 1..20: mol_type = other DNA
tctggcttcttgtgggctcc

SEQ ID NO: 88556 - DNA, 20 bp, synthetic construct
  misc_feature 1..20: note = CRISPR gRNA sequence
  source 1..20: mol_type = other DNA
tggcttcttgtgggctccac

SEQ ID NO: 88557 - DNA, 20 bp, synthetic construct
  misc_feature 1..20: note = CRISPR gRNA sequence
  source 1..20: mol_type = other DNA
gcttcttgtgggctccaccc

SEQ ID NO: 88558 - DNA, 20 bp, synthetic construct
  misc_feature 1..20: note = CRISPR gRNA sequence
  source 1..20: mol_type = other DNA
cttgtgggctccaccctctg

SEQ ID NO: 88559 - DNA, 20 bp, synthetic construct
  misc_feature 1..20: note = CRISPR gRNA sequence
  source 1..20: mol_type = other DNA
ttgtgggctccaccctctgg

SEQ ID NO: 88560 - DNA, 20 bp, synthetic construct
  misc_feature 1..20: note = CRISPR gRNA sequence
  source 1..20: mol_type = other DNA
gtgggctccaccctctgggt

SEQ ID NO: 88561 - DNA, 20 bp, synthetic construct
  misc_feature 1..20: note = CRISPR gRNA sequence
  source 1..20: mol_type = other DNA
tgggctccaccctctgggtt

SEQ ID NO: 88562 - DNA, 20 bp, synthetic construct
  misc_feature 1..20: note = CRISPR gRNA sequence
  source 1..20: mol_type = other DNA
caccctctgggttctctaaa

SEQ ID NO: 88563 - DNA, 20 bp, synthetic construct
  misc_feature 1..20: note = CRISPR gRNA sequence
  source 1..20: mol_type = other DNA
tgggttctctaaaccattct

SEQ ID NO: 88564 - DNA, 20 bp, synthetic construct
  misc_feature 1..20: note = CRISPR gRNA sequence
  source 1..20: mol_type = other DNA
ggttctctaaaccattcttt

SEQ ID NO: 88565 - DNA, 20 bp, synthetic construct
  misc_feature 1..20: note = CRISPR gRNA sequence
  source 1..20: mol_type = other DNA
tctaaaccattctttggttt

SEQ ID NO: 88566 - DNA, 20 bp, synthetic construct
  misc_feature 1..20: note = CRISPR gRNA sequence
  source 1..20: mol_type = other DNA
taaaccattctttggtttag

SEQ ID NO: 88567 - DNA, 20 bp, synthetic construct
  misc_feature 1..20: note = CRISPR gRNA sequence
  source 1..20: mol_type = other DNA
aaccattctttggtttagat

SEQ ID NO: 88568 - DNA, 20 bp, synthetic construct
  misc_feature 1..20: note = CRISPR gRNA sequence
  source 1..20: mol_type = other DNA
tttggtttagatgaccgttc

SEQ ID NO: 88569 - DNA, 20 bp, synthetic construct
  misc_feature 1..20: note = CRISPR gRNA sequence
  source 1..20: mol_type = other DNA
tggtttagatgaccgttccc

SEQ ID NO: 88570 - DNA, 20 bp, synthetic construct
  misc_feature 1..20: note = CRISPR gRNA sequence
  source 1..20: mol_type = other DNA
ggtttagatgaccgttcccg

SEQ ID NO: 88571 - DNA, 20 bp, synthetic construct
  misc_feature 1..20: note = CRISPR gRNA sequence
  source 1..20: mol_type = other DNA
gtttagatgaccgttcccga

SEQ ID NO: 88572 - DNA, 20 bp, synthetic construct
  misc_feature 1..20: note = CRISPR gRNA sequence
  source 1..20: mol_type = other DNA
agatgaccgttcccgaggtg

SEQ ID NO: 88573 - DNA, 20 bp, synthetic construct
  misc_feature 1..20: note = CRISPR gRNA sequence
  source 1..20: mol_type = other DNA
gatgaccgttcccgaggtgc

SEQ ID NO: 88574 - DNA, 20 bp, synthetic construct
  misc_feature 1..20: note = CRISPR gRNA sequence
  source 1..20: mol_type = other DNA
ccgaggtgcatgttcgtcct

SEQ ID NO: 88575 - DNA, 20 bp, synthetic construct
  misc_feature 1..20: note = CRISPR gRNA sequence
  source 1..20: mol_type = other DNA
gtcctcttctgcagaggtac

SEQ ID NO: 88576 - DNA, 20 bp, synthetic construct
  misc_feature 1..20: note = CRISPR gRNA sequence
  source 1..20: mol_type = other DNA
ttctgcagaggtaccaaaaa

SEQ ID NO: 88577 - DNA, 20 bp, synthetic construct
  misc_feature 1..20: note = CRISPR gRNA sequence
  source 1..20: mol_type = other DNA
ctgcagaggtaccaaaaagg

SEQ ID NO: 88578 - DNA, 20 bp, synthetic construct
  misc_feature 1..20: note = CRISPR gRNA sequence
  source 1..20: mol_type = other DNA
tgcagaggtaccaaaaaggt

SEQ ID NO: 88579 - DNA, 20 bp, synthetic construct
  misc_feature 1..20: note = CRISPR gRNA sequence
  source 1..20: mol_type = other DNA
cagaggtaccaaaaaggtaa

SEQ ID NO: 88580 - DNA, 20 bp, synthetic construct
  misc_feature 1..20: note = CRISPR gRNA sequence
  source 1..20: mol_type = other DNA
aggaataggggagtgaggca

SEQ ID NO: 88581 - DNA, 20 bp, synthetic construct
  misc_feature 1..20: note = CRISPR gRNA sequence
  source 1..20: mol_type = other DNA
tgattgactgactggtagag

SEQ ID NO: 88582 - DNA, 20 bp, synthetic construct
  misc_feature 1..20: note = CRISPR gRNA sequence
  source 1..20: mol_type = other DNA
attgactgactggtagagac

SEQ ID NO: 88583 - DNA, 20 bp, synthetic construct
  misc_feature 1..20: note = CRISPR gRNA sequence
  source 1..20: mol_type = other DNA
actgactggtagagacagga

SEQ ID NO: 88584 - DNA, 20 bp, synthetic construct
  misc_feature 1..20: note = CRISPR gRNA sequence
  source 1..20: mol_type = other DNA
actggtagagacaggaaatg

SEQ ID NO: 88585 - DNA, 20 bp, synthetic construct
  misc_feature 1..20: note = CRISPR gRNA sequence
  source 1..20: mol_type = other DNA
gtagagacaggaaatggggt

SEQ ID NO: 88586 - DNA, 20 bp, synthetic construct
  misc_feature 1..20: note = CRISPR gRNA sequence
  source 1..20: mol_type = other DNA
aagcatgtcttagaagggtc

SEQ ID NO: 88587 - DNA, 20 bp, synthetic construct
  misc_feature 1..20: note = CRISPR gRNA sequence
  source 1..20: mol_type = other DNA
agaagggtctccaggaagag

SEQ ID NO: 88588 - DNA, 20 bp, synthetic construct
  misc_feature 1..20: note = CRISPR gRNA sequence
  source 1..20: mol_type = other DNA
gaagggtctccaggaagagg

SEQ ID NO: 88589 - DNA, 20 bp, synthetic construct
  misc_feature 1..20: note = CRISPR gRNA sequence
  source 1..20: mol_type = other DNA
caggaagagggggcaaatcc

SEQ ID NO: 88590 - DNA, 20 bp, synthetic construct
  misc_feature 1..20: note = CRISPR gRNA sequence
  source 1..20: mol_type = other DNA
tattctagtgtgtgggaggg

SEQ ID NO: 88591 - DNA, 20 bp, synthetic construct
  misc_feature 1..20: note = CRISPR gRNA sequence
  source 1..20: mol_type = other DNA
ttctagtgtgtgggagggcc

SEQ ID NO: 88592 - DNA, 20 bp, synthetic construct
  misc_feature 1..20: note = CRISPR gRNA sequence
  source 1..20: mol_type = other DNA
tagtgtgtgggagggccact

SEQ ID NO: 88593 - DNA, 20 bp, synthetic construct
  misc_feature 1..20: note = CRISPR gRNA sequence
  source 1..20: mol_type = other DNA
gtgtgtgggagggccactga

SEQ ID NO: 88594 - DNA, 20 bp, synthetic construct
  misc_feature 1..20: note = CRISPR gRNA sequence
  source 1..20: mol_type = other DNA
aagctgaaagtggctcaggg

SEQ ID NO: 88595 - DNA, 20 bp, synthetic construct
  misc_feature 1..20: note = CRISPR gRNA sequence
  source 1..20: mol_type = other DNA
aaagtggctcagggttgctg

SEQ ID NO: 88596 - DNA, 20 bp, synthetic construct
  misc_feature 1..20: note = CRISPR gRNA sequence
  source 1..20: mol_type = other DNA
agggttgctgagacataaga

SEQ ID NO: 88597 - DNA, 20 bp, synthetic construct
  misc_feature 1..20: note = CRISPR gRNA sequence
  source 1..20: mol_type = other DNA
ctgagacataagagagggtc

SEQ ID NO: 88598 - DNA, 20 bp, synthetic construct
  misc_feature 1..20: note = CRISPR gRNA sequence
  source 1..20: mol_type = other DNA
agacataagagagggtcaac

SEQ ID NO: 88599 - DNA, 20 bp, synthetic construct
  misc_feature 1..20: note = CRISPR gRNA sequence
  source 1..20: mol_type = other DNA
aagcacatgggcatgtgcag

SEQ ID NO: 88600 - DNA, 20 bp, synthetic construct
  misc_feature 1..20: note = CRISPR gRNA sequence
  source 1..20: mol_type = other DNA
agcacatgggcatgtgcaga

SEQ ID NO: 88601 - DNA, 20 bp, synthetic construct
  misc_feature 1..20: note = CRISPR gRNA sequence
  source 1..20: mol_type = other DNA
ctgtagcaggaagcgggcga

SEQ ID NO: 88602 - DNA, 20 bp, synthetic construct
  misc_feature 1..20: note = CRISPR gRNA sequence
  source 1..20: mol_type = other DNA
tagcaggaagcgggcgacct

SEQ ID NO: 88603 - DNA, 20 bp, synthetic construct
  misc_feature 1..20: note = CRISPR gRNA sequence
  source 1..20: mol_type = other DNA
aacgatggaactgaaggacc

SEQ ID NO: 88604 - DNA, 20 bp, synthetic construct
  misc_feature 1..20: note = CRISPR gRNA sequence
  source 1..20: mol_type = other DNA
aaggaccgtttcaggatccg

SEQ ID NO: 88605 - DNA, 20 bp, synthetic construct
  misc_feature 1..20: note = CRISPR gRNA sequence
  source 1..20: mol_type = other DNA
caggatccgctctgcccagt

SEQ ID NO: 88606 - DNA, 20 bp, synthetic construct
  misc_feature 1..20: note = CRISPR gRNA sequence
  source 1..20: mol_type = other DNA
aggatccgctctgcccagtc

SEQ ID NO: 88607 - DNA, 20 bp, synthetic construct
  misc_feature 1..20: note = CRISPR gRNA sequence
  source 1..20: mol_type = other DNA
tgcccagtcacaggtcaggg

SEQ ID NO: 88608 - DNA, 20 bp, synthetic construct
  misc_feature 1..20: note = CRISPR gRNA sequence
  source 1..20: mol_type = other DNA
cccagtcacaggtcagggca

SEQ ID NO: 88609 - DNA, 20 bp, synthetic construct
  misc_feature 1..20: note = CRISPR gRNA sequence
  source 1..20: mol_type = other DNA
cctccaccagttcatctcga

SEQ ID NO: 88610 - DNA, 20 bp, synthetic construct
  misc_feature 1..20: note = CRISPR gRNA sequence
  source 1..20: mol_type = other DNA
caccagttcatctcgaggtg

SEQ ID NO: 88611 - DNA, 20 bp, synthetic construct
  misc_feature 1..20: note = CRISPR gRNA sequence
  source 1..20: mol_type = other DNA
atctcgaggtgctggggtta

SEQ ID NO: 88612 - DNA, 20 bp, synthetic construct
  misc_feature 1..20: note = CRISPR gRNA sequence
  source 1..20: mol_type = other DNA
gaggtgctggggttacttct

SEQ ID NO: 88613 - DNA, 20 bp, synthetic construct
  misc_feature 1..20: note = CRISPR gRNA sequence
  source 1..20: mol_type = other DNA
gggttacttctgggcccatt

SEQ ID NO: 88614 - DNA, 20 bp, synthetic construct
  misc_feature 1..20: note = CRISPR gRNA sequence
  source 1..20: mol_type = other DNA
cttctgggcccatttctggc

SEQ ID NO: 88615 - DNA, 20 bp, synthetic construct
  misc_feature 1..20: note = CRISPR gRNA sequence
  source 1..20: mol_type = other DNA
ctgggcccatttctggctga

SEQ ID NO: 88616 - DNA, 20 bp, synthetic construct
  misc_feature 1..20: note = CRISPR gRNA sequence
  source 1..20: mol_type = other DNA
tgggcccatttctggctgaa

SEQ ID NO: 88617 - DNA, 20 bp, synthetic construct
  misc_feature 1..20: note = CRISPR gRNA sequence
  source 1..20: mol_type = other DNA
ggcccatttctggctgaagt

SEQ ID NO: 88618 - DNA, 20 bp, synthetic construct
  misc_feature 1..20: note = CRISPR gRNA sequence
  source 1..20: mol_type = other DNA
ctggctgaagtggggaagga

SEQ ID NO: 88619 - DNA, 20 bp, synthetic construct
  misc_feature 1..20: note = CRISPR gRNA sequence
  source 1..20: mol_type = other DNA
tggctgaagtggggaaggac

SEQ ID NO: 88620 - DNA, 20 bp, synthetic construct
  misc_feature 1..20: note = CRISPR gRNA sequence
  source 1..20: mol_type = other DNA
gctgaagtggggaaggacat

SEQ ID NO: 88621 - DNA, 20 bp, synthetic construct
  misc_feature 1..20: note = CRISPR gRNA sequence
  source 1..20: mol_type = other DNA
aagtggggaaggacatgccc

SEQ ID NO: 88622 - DNA, 20 bp, synthetic construct
  misc_feature 1..20: note = CRISPR gRNA sequence
  source 1..20: mol_type = other DNA
caaattaaagaacccttgcc

SEQ ID NO: 88623 - DNA, 20 bp, synthetic construct
  misc_feature 1..20: note = CRISPR gRNA sequence
  source 1..20: mol_type = other DNA
aagaacccttgcctcctctc

SEQ ID NO: 88624 - DNA, 20 bp, synthetic construct
  misc_feature 1..20: note = CRISPR gRNA sequence
  source 1..20: mol_type = other DNA
gcctcctctcttgtcagaga

SEQ ID NO: 88625 - DNA, 20 bp, synthetic construct
  misc_feature 1..20: note = CRISPR gRNA sequence
  source 1..20: mol_type = other DNA
cctcctctcttgtcagagat

SEQ ID NO: 88626 - DNA, 20 bp, synthetic construct
  misc_feature 1..20: note = CRISPR gRNA sequence
  source 1..20: mol_type = other DNA
ctctcttgtcagagatcaaa

SEQ ID NO: 88627 - DNA, 20 bp, synthetic construct
  misc_feature 1..20: note = CRISPR gRNA sequence
  source 1..20: mol_type = other DNA
tcttgtcagagatcaaagac

SEQ ID NO: 88628 - DNA, 20 bp, synthetic construct
  misc_feature 1..20: note = CRISPR gRNA sequence
  source 1..20: mol_type = other DNA
ttgtcagagatcaaagacta

SEQ ID NO: 88629 - DNA, 20 bp, synthetic construct
  misc_feature 1..20: note = CRISPR gRNA sequence
  source 1..20: mol_type = other DNA
gtcagagatcaaagactatt

SEQ ID NO: 88630 - DNA, 20 bp, synthetic construct
  misc_feature 1..20: note = CRISPR gRNA sequence
  source 1..20: mol_type = other DNA
tcagagatcaaagactattg

SEQ ID NO: 88631 - DNA, 20 bp, synthetic construct
  misc_feature 1..20: note = CRISPR gRNA sequence
  source 1..20: mol_type = other DNA
ttgaccaaagctgagaccag

SEQ ID NO: 88632 - DNA, 20 bp, synthetic construct
  misc_feature 1..20: note = CRISPR gRNA sequence
  source 1..20: mol_type = other DNA
accaaagctgagaccagact

SEQ ID NO: 88633 - DNA, 20 bp, synthetic construct
  misc_feature 1..20: note = CRISPR gRNA sequence
  source 1..20: mol_type = other DNA
agaccagactggggatggga

SEQ ID NO: 88634 - DNA, 20 bp, synthetic construct
  misc_feature 1..20: note = CRISPR gRNA sequence
  source 1..20: mol_type = other DNA
gggatgggagtagcctctac

SEQ ID NO: 88635 - DNA, 20 bp, synthetic construct
  misc_feature 1..20: note = CRISPR gRNA sequence
  source 1..20: mol_type = other DNA
tacctatcccattgcagaag

SEQ ID NO: 88636 - DNA, 20 bp, synthetic construct
  misc_feature 1..20: note = CRISPR gRNA sequence
  source 1..20: mol_type = other DNA
cctatcccattgcagaagcc

SEQ ID NO: 88637 - DNA, 20 bp, synthetic construct
  misc_feature 1..20: note = CRISPR gRNA sequence
  source 1..20: mol_type = other DNA
tcccattgcagaagcccaca

SEQ ID NO: 88638 - DNA, 20 bp, synthetic construct
  misc_feature 1..20: note = CRISPR gRNA sequence
  source 1..20: mol_type = other DNA
cagaagcccacaagttctct

SEQ ID NO: 88639 - DNA, 20 bp, synthetic construct
  misc_feature 1..20: note = CRISPR gRNA sequence
  source 1..20: mol_type = other DNA
tcttcatcctctgcctcagc

SEQ ID NO: 88640 - DNA, 20 bp, synthetic construct
  misc_feature 1..20: note = CRISPR gRNA sequence
  source 1..20: mol_type = other DNA
ttcatcctctgcctcagcta

SEQ ID NO: 88641 - DNA, 20 bp, synthetic construct
  misc_feature 1..20: note = CRISPR gRNA sequence
  source 1..20: mol_type = other DNA
catcctctgcctcagctaca

SEQ ID NO: 88642 - DNA, 20 bp, synthetic construct
  misc_feature 1..20: note = CRISPR gRNA sequence
  source 1..20: mol_type = other DNA
atcctctgcctcagctacag

SEQ ID NO: 88643 - DNA, 20 bp, synthetic construct
  misc_feature 1..20: note = CRISPR gRNA sequence
  source 1..20: mol_type = other DNA
tgcctcagctacagggttgg

SEQ ID NO: 88644 - DNA, 20 bp, synthetic construct
  misc_feature 1..20: note = CRISPR gRNA sequence
  source 1..20: mol_type = other DNA
cctcagctacagggttggca

SEQ ID NO: 88645 - DNA, 20 bp, synthetic construct
  misc_feature 1..20: note = CRISPR gRNA sequence
  source 1..20: mol_type = other DNA
agctacagggttggcagaag

SEQ ID NO: 88646 - DNA, 20 bp, synthetic construct
  misc_feature 1..20: note = CRISPR gRNA sequence
  source 1..20: mol_type = other DNA
cagggttggcagaagggaac

SEQ ID NO: 88647 - DNA, 20 bp, synthetic construct
  misc_feature 1..20: note = CRISPR gRNA sequence
  source 1..20: mol_type = other DNA
gcagaagggaacatcatacc

SEQ ID NO: 88648 - DNA, 20 bp, synthetic construct
  misc_feature 1..20: note = CRISPR gRNA sequence
  source 1..20: mol_type = other DNA
gaagctatgtacataatgac

SEQ ID NO: 88649 - DNA, 20 bp, synthetic construct
  misc_feature 1..20: note = CRISPR gRNA sequence
  source 1..20: mol_type = other DNA
tgtacataatgactgaggct

SEQ ID NO: 88650 - DNA, 20 bp, synthetic construct
  misc_feature 1..20: note = CRISPR gRNA sequence
  source 1..20: mol_type = other DNA
aggctgttagccctcaaaac

SEQ ID NO: 88651 - DNA, 20 bp, synthetic construct
  misc_feature 1..20: note = CRISPR gRNA sequence
  source 1..20: mol_type = other DNA
ttagccctcaaaacatgccc

SEQ ID NO: 88652 - DNA, 20 bp, synthetic construct
  misc_feature 1..20: note = CRISPR gRNA sequence
  source 1..20: mol_type = other DNA
gccctcaaaacatgccccaa

SEQ ID NO: 88653 - DNA, 20 bp, synthetic construct
  misc_feature 1..20: note = CRISPR gRNA sequence
  source 1..20: mol_type = other DNA
aaaacatgccccaaagacct

SEQ ID NO: 88654 - DNA, 20 bp, synthetic construct
  misc_feature 1..20: note = CRISPR gRNA sequence
  source 1..20: mol_type = other DNA
tgacttttacctgggagaga

SEQ ID NO: 88655 - DNA, 20 bp, synthetic construct
  misc_feature 1..20: note = CRISPR gRNA sequence
  source 1..20: mol_type = other DNA
acttttacctgggagagaag

SEQ ID NO: 88656 - DNA, 20 bp, synthetic construct
  misc_feature 1..20: note = CRISPR gRNA sequence
  source 1..20: mol_type = other DNA
ttacctgggagagaagagtg

SEQ ID NO: 88657 - DNA, 20 bp, synthetic construct
  misc_feature 1..20: note = CRISPR gRNA sequence
  source 1..20: mol_type = other DNA
tacctgggagagaagagtgg

SEQ ID NO: 88658 - DNA, 20 bp, synthetic construct
  misc_feature 1..20: note = CRISPR gRNA sequence
  source 1..20: mol_type = other DNA
acctgggagagaagagtgga

SEQ ID NO: 88659 - DNA, 20 bp, synthetic construct
  misc_feature 1..20: note = CRISPR gRNA sequence
  source 1..20: mol_type = other DNA
cctgggagagaagagtggaa

SEQ ID NO: 88660 - DNA, 20 bp, synthetic construct
  misc_feature 1..20: note = CRISPR gRNA sequence
  source 1..20: mol_type = other DNA
ggagagaagagtggaattgg

SEQ ID NO: 88661 - DNA, 20 bp, synthetic construct
  misc_feature 1..20: note = CRISPR gRNA sequence
  source 1..20: mol_type = other DNA
gaaggtgatttggtacttac

SEQ ID NO: 88662 - DNA, 20 bp, synthetic construct
  misc_feature 1..20: note = CRISPR gRNA sequence
  source 1..20: mol_type = other DNA
ggtacttacactctcagaac

SEQ ID NO: 88663 - DNA, 20 bp, synthetic construct
  misc_feature 1..20: note = CRISPR gRNA sequence
  source 1..20: mol_type = other DNA
gtacttacactctcagaacc

SEQ ID NO: 88664 - DNA, 20 bp, synthetic construct
  misc_feature 1..20: note = CRISPR gRNA sequence
  source 1..20: mol_type = other DNA
acactctcagaaccctttag

SEQ ID NO: 88665 - DNA, 20 bp, synthetic construct
  misc_feature 1..20: note = CRISPR gRNA sequence
  source 1..20: mol_type = other DNA
cactctcagaaccctttagg

SEQ ID NO: 88666 - DNA, 20 bp, synthetic construct
  misc_feature 1..20: note = CRISPR gRNA sequence
  source 1..20: mol_type = other DNA
tcagaaccctttaggtcaag

SEQ ID NO: 88667 - DNA, 20 bp, synthetic construct
  misc_feature 1..20: note = CRISPR gRNA sequence
  source 1..20: mol_type = other DNA
agaaccctttaggtcaagtc

SEQ ID NO: 88668 - DNA, 20 bp, synthetic construct
  misc_feature 1..20: note = CRISPR gRNA sequence
  source 1..20: mol_type = other DNA
taggtcaagtccaggcaggg

SEQ ID NO: 88669 - DNA, 20 bp, synthetic construct
  misc_feature 1..20: note = CRISPR gRNA sequence
  source 1..20: mol_type = other DNA
aggtcaagtccaggcagggg

SEQ ID NO: 88670 - DNA, 20 bp, synthetic construct
  misc_feature 1..20: note = CRISPR gRNA sequence
  source 1..20: mol_type = other DNA
ggtcaagtccaggcaggggt

SEQ ID NO: 88671 - DNA, 20 bp, synthetic construct
  misc_feature 1..20: note = CRISPR gRNA sequence
  source 1..20: mol_type = other DNA
cctccttatgccactgtagc

SEQ ID NO: 88672 - DNA, 20 bp, synthetic construct
  misc_feature 1..20: note = CRISPR gRNA sequence
  source 1..20: mol_type = other DNA
ctccttatgccactgtagca

SEQ ID NO: 88673 - DNA, 20 bp, synthetic construct
  misc_feature 1..20: note = CRISPR gRNA sequence
  source 1..20: mol_type = other DNA
cttatgccactgtagcaata

SEQ ID NO: 88674 - DNA, 20 bp, synthetic construct
  misc_feature 1..20: note = CRISPR gRNA sequence
  source 1..20: mol_type = other DNA
atgccactgtagcaatatct

SEQ ID NO: 88675 - DNA, 20 bp, synthetic construct
  misc_feature 1..20: note = CRISPR gRNA sequence
  source 1..20: mol_type = other DNA
tgccactgtagcaatatctg

SEQ ID NO: 88676 - DNA, 20 bp, synthetic construct
  misc_feature 1..20: note = CRISPR gRNA sequence
  source 1..20: mol_type = other DNA
tagcaatatctgatgcaagt

SEQ ID NO: 88677 - DNA, 20 bp, synthetic construct
  misc_feature 1..20: note = CRISPR gRNA sequence
  source 1..20: mol_type = other DNA
atgcaagttaaagagcagcc

SEQ ID NO: 88678 - DNA, 20 bp, synthetic construct
  misc_feature 1..20: note = CRISPR gRNA sequence
  source 1..20: mol_type = other DNA
aagagcagccaacacatggc

SEQ ID NO: 88679 - DNA, 20 bp, synthetic construct
  misc_feature 1..20: note = CRISPR gRNA sequence
  source 1..20: mol_type = other DNA
caagcccctcgagcaagtta

SEQ ID NO: 88680 - DNA, 20 bp, synthetic construct
  misc_feature 1..20: note = CRISPR gRNA sequence
  source 1..20: mol_type = other DNA
gagcaagttaagctgttcca

SEQ ID NO: 88681 - DNA, 20 bp, synthetic construct
  misc_feature 1..20: note = CRISPR gRNA sequence
  source 1..20: mol_type = other DNA
agctgttccactccttgctc

SEQ ID NO: 88682 - DNA, 20 bp, synthetic construct
  misc_feature 1..20: note = CRISPR gRNA sequence
  source 1..20: mol_type = other DNA
ttccactccttgctctccac

SEQ ID NO: 88683 - DNA, 20 bp, synthetic construct
  misc_feature 1..20: note = CRISPR gRNA sequence
  source 1..20: mol_type = other DNA
cactccttgctctccacatc

SEQ ID NO: 88684 - DNA, 20 bp, synthetic construct
  misc_feature 1..20: note = CRISPR gRNA sequence
  source 1..20: mol_type = other DNA
cttgctctccacatcctaag

SEQ ID NO: 88685 - DNA, 20 bp, synthetic construct
  misc_feature 1..20: note = CRISPR gRNA sequence
  source 1..20: mol_type = other DNA
gctctccacatcctaagtct

SEQ ID NO: 88686 - DNA, 20 bp, synthetic construct
  misc_feature 1..20: note = CRISPR gRNA sequence
  source 1..20: mol_type = other DNA
ctctccacatcctaagtctt

SEQ ID NO: 88687 - DNA, 20 bp, synthetic construct
  misc_feature 1..20: note = CRISPR gRNA sequence
  source 1..20: mol_type = other DNA
tccacatcctaagtcttcct

SEQ ID NO: 88688 - DNA, 20 bp, synthetic construct
  misc_feature 1..20: note = CRISPR gRNA sequence
  source 1..20: mol_type = other DNA
cacatcctaagtcttcctcc

SEQ ID NO: 88689 - DNA, 20 bp, synthetic construct
  misc_feature 1..20: note = CRISPR gRNA sequence
  source 1..20: mol_type = other DNA
agtcttcctcccaggtcctc

SEQ ID NO: 88690 - DNA, 20 bp, synthetic construct
  misc_feature 1..20: note = CRISPR gRNA sequence
  source 1..20: mol_type = other DNA
cctcccaggtcctccacccc

SEQ ID NO: 88691 - DNA, 20 bp, synthetic construct
  misc_feature 1..20: note = CRISPR gRNA sequence
  source 1..20: mol_type = other DNA
ctcccaggtcctccaccccc

SEQ ID NO: 88692 - DNA, 20 bp, synthetic construct
  misc_feature 1..20: note = CRISPR gRNA sequence
  source 1..20: mol_type = other DNA
ccaggtcctccacccccaac

SEQ ID NO: 88693 - DNA, 20 bp, synthetic construct
  misc_feature 1..20: note = CRISPR gRNA sequence
  source 1..20: mol_type = other DNA
cacccccaacctctctagtc

SEQ ID NO: 88694 - DNA, 20 bp, synthetic construct
  misc_feature 1..20: note = CRISPR gRNA sequence
  source 1..20: mol_type = other DNA
tctagtcaaggatacttgga

SEQ ID NO: 88695 - DNA, 20 bp, synthetic construct
  misc_feature 1..20: note = CRISPR gRNA sequence
  source 1..20: mol_type = other DNA
tagtcaaggatacttggact

SEQ ID NO: 88696 - DNA, 20 bp, synthetic construct
  misc_feature 1..20: note = CRISPR gRNA sequence
  source 1..20: mol_type = other DNA
gtcaaggatacttggactgg

SEQ ID NO: 88697 - DNA, 20 bp, synthetic construct
  misc_feature 1..20: note = CRISPR gRNA sequence
  source 1..20: mol_type = other DNA
ggactggccccggccaccaa

SEQ ID NO: 88698 - DNA, 20 bp, synthetic construct
  misc_feature 1..20: note = CRISPR gRNA sequence
  source 1..20: mol_type = other DNA
gactggccccggccaccaag

SEQ ID NO: 88699 - DNA, 20 bp, synthetic construct
  misc_feature 1..20: note = CRISPR gRNA sequence
  source 1..20: mol_type = other DNA
gccccggccaccaagccttc

SEQ ID NO: 88700 - DNA, 20 bp, synthetic construct
  misc_feature 1..20: note = CRISPR gRNA sequence
  source 1..20: mol_type = other DNA
cgagctttgatgtcagggaa

SEQ ID NO: 88701 - DNA, 20 bp, synthetic construct
  misc_feature 1..20: note = CRISPR gRNA sequence
  source 1..20: mol_type = other DNA
gagctttgatgtcagggaag

SEQ ID NO: 88702 - DNA, 20 bp, synthetic construct
  misc_feature 1..20: note = CRISPR gRNA sequence
  source 1..20: mol_type = other DNA
tgatgtcagggaagatctct

SEQ ID NO: 88703 - DNA, 20 bp, synthetic construct
  misc_feature 1..20: note = CRISPR gRNA sequence
  source 1..20: mol_type = other DNA
gatgtcagggaagatctctc

SEQ ID NO: 88704 - DNA, 20 bp, synthetic construct
  misc_feature 1..20: note = CRISPR gRNA sequence
  source 1..20: mol_type = other DNA
atgtcagggaagatctctct

SEQ ID NO: 88705 - DNA, 20 bp, synthetic construct
  misc_feature 1..20: note = CRISPR gRNA sequence
  source 1..20: mol_type = other DNA
tctgatgatcttgccaaagt

SEQ ID NO: 88706 - DNA, 20 bp, synthetic construct
  misc_feature 1..20: note = CRISPR gRNA sequence
  source 1..20: mol_type = other DNA
tgatgatcttgccaaagttg

SEQ ID NO: 88707 - DNA, 20 bp, synthetic construct
  misc_feature 1..20: note = CRISPR gRNA sequence
  source 1..20: mol_type = other DNA
atgatcttgccaaagttggc

SEQ ID NO: 88708 - DNA, 20 bp, synthetic construct
  misc_feature 1..20: note = CRISPR gRNA sequence
  source 1..20: mol_type = other DNA
gccaaagttggctgtgctga

SEQ ID NO: 88709 - DNA, 20 bp, synthetic construct
  misc_feature 1..20: note = CRISPR gRNA sequence
  source 1..20: mol_type = other DNA
ccaaagttggctgtgctgag

SEQ ID NO: 88710 - DNA, 20 bp, synthetic construct
  misc_feature 1..20: note = CRISPR gRNA sequence
  source 1..20: mol_type = other DNA
gctgtgctgagtgggcggca

SEQ ID NO: 88711 - DNA, 20 bp, synthetic construct
  misc_feature 1..20: note = CRISPR gRNA sequence
  source 1..20: mol_type = other DNA
tgctgagtgggcggcaacag

SEQ ID NO: 88712 - DNA, 20 bp, synthetic construct
  misc_feature 1..20: note = CRISPR gRNA sequence
  source 1..20: mol_type = other DNA
agtgggcggcaacaggcaag

SEQ ID NO: 88713 - DNA, 20 bp, synthetic construct
  misc_feature 1..20: note = CRISPR gRNA sequence
  source 1..20: mol_type = other DNA
tcacagtacttcctgagtga

SEQ ID NO: 88714 - DNA, 20 bp, synthetic construct
  misc_feature 1..20: note = CRISPR gRNA sequence
  source 1..20: mol_type = other DNA
acagtacttcctgagtgaga

SEQ ID NO: 88715 - DNA, 20 bp, synthetic construct
  misc_feature 1..20: note = CRISPR gRNA sequence
  source 1..20: mol_type = other DNA
cctgagtgagaggggagcag

SEQ ID NO: 88716 - DNA, 20 bp, synthetic construct
  misc_feature 1..20: note = CRISPR gRNA sequence
  source 1..20: mol_type = other DNA
ctgagtgagaggggagcaga

SEQ ID NO: 88717 - DNA, 20 bp, synthetic construct
  misc_feature 1..20: note = CRISPR gRNA sequence
  source 1..20: mol_type = other DNA
agtgagaggggagcagagtg

SEQ ID NO: 88718 - DNA, 20 bp, synthetic construct
  misc_feature 1..20: note = CRISPR gRNA sequence
  source 1..20: mol_type = other DNA
agagaaggaggccatgggta

SEQ ID NO: 88719 - DNA, 20 bp, synthetic construct
  misc_feature 1..20: note = CRISPR gRNA sequence
  source 1..20: mol_type = other DNA
gaagagtccctagggatcaa

SEQ ID NO: 88720 - DNA, 20 bp, synthetic construct
  misc_feature 1..20: note = CRISPR gRNA sequence
  source 1..20: mol_type = other DNA
gggatcaagtgtgaggaacc

SEQ ID NO: 88721 - DNA, 20 bp, synthetic construct
  misc_feature 1..20: note = CRISPR gRNA sequence
  source 1..20: mol_type = other DNA
taagaaggcaggctttatca

SEQ ID NO: 88722 - DNA, 20 bp, synthetic construct
  misc_feature 1..20: note = CRISPR gRNA sequence
  source 1..20: mol_type = other DNA
aagaaggcaggctttatcaa

SEQ ID NO: 88723 - DNA, 20 bp, synthetic construct
  misc_feature 1..20: note = CRISPR gRNA sequence
  source 1..20: mol_type = other DNA
agaaggcaggctttatcaag

SEQ ID NO: 88724 - DNA, 20 bp, synthetic construct
  misc_feature 1..20: note = CRISPR gRNA sequence
  source 1..20: mol_type = other DNA
tatcaaggcaggaagctctt

SEQ ID NO: 88725 - DNA, 20 bp, synthetic construct
  misc_feature 1..20: note = CRISPR gRNA sequence
  source 1..20: mol_type = other DNA
atcaaggcaggaagctcttc

SEQ ID NO: 88726 - DNA, 20 bp, synthetic construct
  misc_feature 1..20: note = CRISPR gRNA sequence
  source 1..20: mol_type = other DNA
tcaaggcaggaagctcttca

SEQ ID NO: 88727 - DNA, 20 bp, synthetic construct
  misc_feature 1..20: note = CRISPR gRNA sequence
  source 1..20: mol_type = other DNA
ttcatgggtgagggggtcct

SEQ ID NO: 88728 - DNA, 20 bp, synthetic construct
  misc_feature 1..20: note = CRISPR gRNA sequence
  source 1..20: mol_type = other DNA
catgggtgagggggtcctat

SEQ ID NO: 88729 - DNA, 20 bp, synthetic construct
  misc_feature 1..20: note = CRISPR gRNA sequence
  source 1..20: mol_type = other DNA
atgggtgagggggtcctatg

SEQ ID NO: 88730 - DNA, 20 bp, synthetic construct
  misc_feature 1..20: note = CRISPR gRNA sequence
  source 1..20: mol_type = other DNA
tgcccaccaatccactcatc

SEQ ID NO: 88731 - DNA, 20 bp, synthetic construct
  misc_feature 1..20: note = CRISPR gRNA sequence
  source 1..20: mol_type = other DNA
atcccaccacccacccctcc

SEQ ID NO: 88732 - DNA, 20 bp, synthetic construct
  misc_feature 1..20: note = CRISPR gRNA sequence
  source 1..20: mol_type = other DNA
cacccaccgataggcatcat

SEQ ID NO: 88733 - DNA, 20 bp, synthetic construct
  misc_feature 1..20: note = CRISPR gRNA sequence
  source 1..20: mol_type = other DNA
tgctttggcagacaggtgtc

SEQ ID NO: 88734 - DNA, 20 bp, synthetic construct
  misc_feature 1..20: note = CRISPR gRNA sequence
  source 1..20: mol_type = other DNA
gctttggcagacaggtgtca

SEQ ID NO: 88735 - DNA, 20 bp, synthetic construct
  misc_feature 1..20: note = CRISPR gRNA sequence
  source 1..20: mol_type = other DNA
ctttggcagacaggtgtcag

SEQ ID NO: 88736 - DNA, 20 bp, synthetic construct
  misc_feature 1..20: note = CRISPR gRNA sequence
  source 1..20: mol_type = other DNA
tggcagacaggtgtcagtgt

SEQ ID NO: 88737 - DNA, 20 bp, synthetic construct
  misc_feature 1..20: note = CRISPR gRNA sequence
  source 1..20: mol_type = other DNA
ggcagacaggtgtcagtgtg

SEQ ID NO: 88738 - DNA, 20 bp, synthetic construct
  misc_feature 1..20: note = CRISPR gRNA sequence
  source 1..20: mol_type = other DNA
gcagacaggtgtcagtgtgc

SEQ ID NO: 88739 - DNA, 20 bp, synthetic construct
  misc_feature 1..20: note = CRISPR gRNA sequence
  source 1..20: mol_type = other DNA
ttccaggtggttgcggatcc

SEQ ID NO: 88740 - DNA, 20 bp, synthetic construct
  misc_feature 1..20: note = CRISPR gRNA sequence
  source 1..20: mol_type = other DNA
ccaggtggttgcggatccac

SEQ ID NO: 88741 - DNA, 20 bp, synthetic construct
  misc_feature 1..20: note = CRISPR gRNA sequence
  source 1..20: mol_type = other DNA
caggtggttgcggatccacc

SEQ ID NO: 88742 - DNA, 20 bp, synthetic construct
  misc_feature 1..20: note = CRISPR gRNA sequence
  source 1..20: mol_type = other DNA
cggatccacctataggcata

SEQ ID NO: 88743 - DNA, 20 bp, synthetic construct
  misc_feature 1..20: note = CRISPR gRNA sequence
  source 1..20: mol_type = other DNA
taggcatacatgtactcctc

SEQ ID NO: 88744 - DNA, 20 bp, synthetic construct
  misc_feature 1..20: note = CRISPR gRNA sequence
  source 1..20: mol_type = other DNA
ctcattgctcagtgtacttg

SEQ ID NO: 88745 - DNA, 20 bp, synthetic construct
  misc_feature 1..20: note = CRISPR gRNA sequence
  source 1..20: mol_type = other DNA
attgctcagtgtacttggct

SEQ ID NO: 88746 - DNA, 20 bp, synthetic construct
  misc_feature 1..20: note = CRISPR gRNA sequence
  source 1..20: mol_type = other DNA
ctcagtgtacttggctctga

SEQ ID NO: 88747 - DNA, 20 bp, synthetic construct
  misc_feature 1..20: note = CRISPR gRNA sequence
  source 1..20: mol_type = other DNA
agtgtacttggctctgagct

SEQ ID NO: 88748 - DNA, 20 bp, synthetic construct
  misc_feature 1..20: note = CRISPR gRNA sequence
  source 1..20: mol_type = other DNA
ggctctgagctacagaaaca

SEQ ID NO: 88749 - DNA, 20 bp, synthetic construct
  misc_feature 1..20: note = CRISPR gRNA sequence
  source 1..20: mol_type = other DNA
gctctgagctacagaaacaa

SEQ ID NO: 88750 - DNA, 20 bp, synthetic construct
  misc_feature 1..20: note = CRISPR gRNA sequence
  source 1..20: mol_type = other DNA
tgagctacagaaacaaaagg

SEQ ID NO: 88751 - DNA, 20 bp, synthetic construct
  misc_feature 1..20: note = CRISPR gRNA sequence
  source 1..20: mol_type = other DNA
agctacagaaacaaaaggaa

SEQ ID NO: 88752 - DNA, 20 bp, synthetic construct
  misc_feature 1..20: note = CRISPR gRNA sequence
  source 1..20: mol_type = other DNA
cagaaacaaaaggaacaagc

SEQ ID NO: 88753 - DNA, 20 bp, synthetic construct
  misc_feature 1..20: note = CRISPR gRNA sequence
  source 1..20: mol_type = other DNA
ctaagaccctaacagttgtc

SEQ ID NO: 88754 - DNA, 20 bp, synthetic construct
  misc_feature 1..20: note = CRISPR gRNA sequence
  source 1..20: mol_type = other DNA
agaccctaacagttgtcctg

SEQ ID NO: 88755 - DNA, 20 bp, synthetic construct
  misc_feature 1..20: note = CRISPR gRNA sequence
  source 1..20: mol_type = other DNA
acagttgtcctggttcttcc

SEQ ID NO: 88756 - DNA, 20 bp, synthetic construct
  misc_feature 1..20: note = CRISPR gRNA sequence
  source 1..20: mol_type = other DNA
tcctggttcttcccaaacta

SEQ ID NO: 88757 - DNA, 20 bp, synthetic construct
  misc_feature 1..20: note = CRISPR gRNA sequence
  source 1..20: mol_type = other DNA
gttcttcccaaactaccact

SEQ ID NO: 88758 - DNA, 20 bp, synthetic construct
  misc_feature 1..20: note = CRISPR gRNA sequence
  source 1..20: mol_type = other DNA
ttcccaaactaccacttcag

SEQ ID NO: 88759 - DNA, 20 bp, synthetic construct
  misc_feature 1..20: note = CRISPR gRNA sequence
  source 1..20: mol_type = other DNA
cccaaactaccacttcagta

SEQ ID NO: 88760 - DNA, 20 bp, synthetic construct
  misc_feature 1..20: note = CRISPR gRNA sequence
  source 1..20: mol_type = other DNA
ccaaactaccacttcagtag

SEQ ID NO: 88761 - DNA, 20 bp, synthetic construct
  misc_feature 1..20: note = CRISPR gRNA sequence
  source 1..20: mol_type = other DNA
ccacttcagtagtgctggac

SEQ ID NO: 88762 - DNA, 20 bp, synthetic construct
  misc_feature 1..20: note = CRISPR gRNA sequence
  source 1..20: mol_type = other DNA
cagtagtgctggaccaaatt

SEQ ID NO: 88763 - DNA, 20 bp, synthetic construct
  misc_feature 1..20: note = CRISPR gRNA sequence
  source 1..20: mol_type = other DNA
agtagtgctggaccaaattt

SEQ ID NO: 88764 - DNA, 20 bp, synthetic construct
  misc_feature 1..20: note = CRISPR gRNA sequence
  source 1..20: mol_type = other DNA
gaccaaatttagttcaccca

SEQ ID NO: 88765 - DNA, 20 bp, synthetic construct
  misc_feature 1..20: note = CRISPR gRNA sequence
  source 1..20: mol_type = other DNA
agttcacccagaatctaact

SEQ ID NO: 88766 - DNA, 20 bp, synthetic construct
  misc_feature 1..20: note = CRISPR gRNA sequence
  source 1..20: mol_type = other DNA
gttcacccagaatctaactt

SEQ ID NO: 88767 - DNA, 20 bp, synthetic construct
  misc_feature 1..20: note = CRISPR gRNA sequence
  source 1..20: mol_type = other DNA
acccagaatctaactttccc

SEQ ID NO: 88768 - DNA, 20 bp, synthetic construct
  misc_feature 1..20: note = CRISPR gRNA sequence
  source 1..20: mol_type = other DNA
actttccctggtaaaccaag

SEQ ID NO: 88769 - DNA, 20 bp, synthetic construct
  misc_feature 1..20: note = CRISPR gRNA sequence
  source 1..20: mol_type = other DNA
tccctggtaaaccaagtcag

SEQ ID NO: 88770 - DNA, 20 bp, synthetic construct
  misc_feature 1..20: note = CRISPR gRNA sequence
  source 1..20: mol_type = other DNA
ccctggtaaaccaagtcagg

SEQ ID NO: 88771 - DNA, 20 bp, synthetic construct
  misc_feature 1..20: note = CRISPR gRNA sequence
  source 1..20: mol_type = other DNA
cctggtaaaccaagtcaggg

SEQ ID NO: 88772 - DNA, 20 bp, synthetic construct
  misc_feature 1..20: note = CRISPR gRNA sequence
  source 1..20: mol_type = other DNA
gtaaaccaagtcagggcgag

SEQ ID NO: 88773 - DNA, 20 bp, synthetic construct
  misc_feature 1..20: note = CRISPR gRNA sequence
  source 1..20: mol_type = other DNA
tcctcttcatcaaggacagc

SEQ ID NO: 88774 - DNA, 20 bp, synthetic construct
  misc_feature 1..20: note = CRISPR gRNA sequence
  source 1..20: mol_type = other DNA
cctcttcatcaaggacagca

SEQ ID NO: 88775 - DNA, 20 bp, synthetic construct
  misc_feature 1..20: note = CRISPR gRNA sequence
  source 1..20: mol_type = other DNA
ctcttcatcaaggacagcat

SEQ ID NO: 88776 - DNA, 20 bp, synthetic construct
  misc_feature 1..20: note = CRISPR gRNA sequence
  source 1..20: mol_type = other DNA
ttcatcaaggacagcattta

SEQ ID NO: 88777 - DNA, 20 bp, synthetic construct
  misc_feature 1..20: note = CRISPR gRNA sequence
  source 1..20: mol_type = other DNA
catcaaggacagcatttacg

SEQ ID NO: 88778 - DNA, 20 bp, synthetic construct
  misc_feature 1..20: note = CRISPR gRNA sequence
  source 1..20: mol_type = other DNA
atcaaggacagcatttacga

SEQ ID NO: 88779 - DNA, 20 bp, synthetic construct
  misc_feature 1..20: note = CRISPR gRNA sequence
  source 1..20: mol_type = other DNA
acgagtattcctattcacct

SEQ ID NO: 88780 - DNA, 20 bp, synthetic construct
  misc_feature 1..20: note = CRISPR gRNA sequence
  source 1..20: mol_type = other DNA
cgagtattcctattcacctc

SEQ ID NO: 88781 - DNA, 20 bp, synthetic construct
  misc_feature 1..20: note = CRISPR gRNA sequence
  source 1..20: mol_type = other DNA
ctattcacctcaccccttcc

SEQ ID NO: 88782 - DNA, 20 bp, synthetic construct
  misc_feature 1..20: note = CRISPR gRNA sequence
  source 1..20: mol_type = other DNA
ttcacctcaccccttcccag

SEQ ID NO: 88783 - DNA, 20 bp, synthetic construct
  misc_feature 1..20: note = CRISPR gRNA sequence
  source 1..20: mol_type = other DNA
acctcaccccttcccagtga

SEQ ID NO: 88784 - DNA, 20 bp, synthetic construct
  misc_feature 1..20: note = CRISPR gRNA sequence
  source 1..20: mol_type = other DNA
accccttcccagtgaacctt

SEQ ID NO: 88785 - DNA, 20 bp, synthetic construct
  misc_feature 1..20: note = CRISPR gRNA sequence
  source 1..20: mol_type = other DNA
cccagtgaacctttctctaa

SEQ ID NO: 88786 - DNA, 20 bp, synthetic construct
  misc_feature 1..20: note = CRISPR gRNA sequence
  source 1..20: mol_type = other DNA
ccagtgaacctttctctaag

SEQ ID NO: 88787 - DNA, 20 bp, synthetic construct
  misc_feature 1..20: note = CRISPR gRNA sequence
  source 1..20: mol_type = other DNA
tctctaagaatcagaacctc

SEQ ID NO: 88788 - DNA, 20 bp, synthetic construct
  misc_feature 1..20: note = CRISPR gRNA sequence
  source 1..20: mol_type = other DNA
ctctaagaatcagaacctct

SEQ ID NO: 88789 - DNA, 20 bp, synthetic construct
  misc_feature 1..20: note = CRISPR gRNA sequence
  source 1..20: mol_type = other DNA
tctaagaatcagaacctctg

SEQ ID NO: 88790 - DNA, 20 bp, synthetic construct
  misc_feature 1..20: note = CRISPR gRNA sequence
  source 1..20: mol_type = other DNA
taagaatcagaacctctgcc

SEQ ID NO: 88791 - DNA, 20 bp, synthetic construct
  misc_feature 1..20: note = CRISPR gRNA sequence
  source 1..20: mol_type = other DNA
agaatcagaacctctgccat

SEQ ID NO: 88792 - DNA, 20 bp, synthetic construct
  misc_feature 1..20: note = CRISPR gRNA sequence
  source 1..20: mol_type = other DNA
tgccatctaaaactactatc

SEQ ID NO: 88793 - DNA, 20 bp, synthetic construct
  misc_feature 1..20: note = CRISPR gRNA sequence
  source 1..20: mol_type = other DNA
ccatctaaaactactatcaa

SEQ ID NO: 88794 - DNA, 20 bp, synthetic construct
  misc_feature 1..20: note = CRISPR gRNA sequence
  source 1..20: mol_type = other DNA
aaactactatcaaacctacc

SEQ ID NO: 88795 - DNA, 20 bp, synthetic construct
  misc_feature 1..20: note = CRISPR gRNA sequence
  source 1..20: mol_type = other DNA
ctatcaaacctaccttttgt

SEQ ID NO: 88796 - DNA, 20 bp, synthetic construct
  misc_feature 1..20: note = CRISPR gRNA sequence
  source 1..20: mol_type = other DNA
tcaaacctaccttttgtctc

SEQ ID NO: 88797 - DNA, 20 bp, synthetic construct
  misc_feature 1..20: note = CRISPR gRNA sequence
  source 1..20: mol_type = other DNA
ccttttgtctccagtggtgg

SEQ ID NO: 88798 - DNA, 20 bp, synthetic construct
  misc_feature 1..20: note = CRISPR gRNA sequence
  source 1..20: mol_type = other DNA
ttgtctccagtggtgggtcc

SEQ ID NO: 88799 - DNA, 20 bp, synthetic construct
  misc_feature 1..20: note = CRISPR gRNA sequence
  source 1..20: mol_type = other DNA
tgtctccagtggtgggtcct

SEQ ID NO: 88800 - DNA, 20 bp, synthetic construct
  misc_feature 1..20: note = CRISPR gRNA sequence
  source 1..20: mol_type = other DNA
gtctccagtggtgggtcctg

SEQ ID NO: 88801 - DNA, 20 bp, synthetic construct
  misc_feature 1..20: note = CRISPR gRNA sequence
  source 1..20: mol_type = other DNA
tctccagtggtgggtcctga

SEQ ID NO: 88802 - DNA, 20 bp, synthetic construct
  misc_feature 1..20: note = CRISPR gRNA sequence
  source 1..20: mol_type = other DNA
cagtggtgggtcctgagggg

SEQ ID NO: 88803 - DNA, 20 bp, synthetic construct
  misc_feature 1..20: note = CRISPR gRNA sequence
  source 1..20: mol_type = other DNA
aggggagctgaaggtagaga

SEQ ID NO: 88804 - DNA, 20 bp, synthetic construct
  misc_feature 1..20: note = CRISPR gRNA sequence
  source 1..20: mol_type = other DNA
aaggtagagatacagcttgt

SEQ ID NO: 88805 - DNA, 20 bp, synthetic construct
  misc_feature 1..20: note = CRISPR gRNA sequence
  source 1..20: mol_type = other DNA
gtcattgtcagaaaatttct

SEQ ID NO: 88806 - DNA, 20 bp, synthetic construct
  misc_feature 1..20: note = CRISPR gRNA sequence
  source 1..20: mol_type = other DNA
tcattgtcagaaaatttctg

SEQ ID NO: 88807 - DNA, 20 bp, synthetic construct
  misc_feature 1..20: note = CRISPR gRNA sequence
  source 1..20: mol_type = other DNA
tcagaaaatttctgtacatc

SEQ ID NO: 88808 - DNA, 20 bp, synthetic construct
  misc_feature 1..20: note = CRISPR gRNA sequence
  source 1..20: mol_type = other DNA
ctgtacatcttgctgaggta

SEQ ID NO: 88809 - DNA, 20 bp, synthetic construct
  misc_feature 1..20: note = CRISPR gRNA sequence
  source 1..20: mol_type = other DNA
tgtacatcttgctgaggtag

SEQ ID NO: 88810 - DNA, 20 bp, synthetic construct
  misc_feature 1..20: note = CRISPR gRNA sequence
  source 1..20: mol_type = other DNA
tacatcttgctgaggtagga

SEQ ID NO: 88811 - DNA, 20 bp, synthetic construct
  misc_feature 1..20: note = CRISPR gRNA sequence
  source 1..20: mol_type = other DNA
gctgaggtaggagagaacag

SEQ ID NO: 88812 - DNA, 20 bp, synthetic construct
  misc_feature 1..20: note = CRISPR gRNA sequence
  source 1..20: mol_type = other DNA
ctgaggtaggagagaacaga

SEQ ID NO: 88813 - DNA, 20 bp, synthetic construct
  misc_feature 1..20: note = CRISPR gRNA sequence
  source 1..20: mol_type = other DNA
aggtaggagagaacagaggc

SEQ ID NO: 88814 - DNA, 20 bp, synthetic construct
  misc_feature 1..20: note = CRISPR gRNA sequence
  source 1..20: mol_type = other DNA
tgatccccacaccaaagtct

SEQ ID NO: 88815 - DNA, 20 bp, synthetic construct
  misc_feature 1..20: note = CRISPR gRNA sequence
  source 1..20: mol_type = other DNA
atccccacaccaaagtctag

SEQ ID NO: 88816 - DNA, 20 bp, synthetic construct
  misc_feature 1..20: note = CRISPR gRNA sequence
  source 1..20: mol_type = other DNA
gctgacttacagggtgtcag

SEQ ID NO: 88817 - DNA, 20 bp, synthetic construct
  misc_feature 1..20: note = CRISPR gRNA sequence
  source 1..20: mol_type = other DNA
acttacagggtgtcagactg

SEQ ID NO: 88818 - DNA, 20 bp, synthetic construct
  misc_feature 1..20: note = CRISPR gRNA sequence
  source 1..20: mol_type = other DNA
acagggtgtcagactgaaaa

SEQ ID NO: 88819 - DNA, 20 bp, synthetic construct
  misc_feature 1..20: note = CRISPR gRNA sequence
  source 1..20: mol_type = other DNA
cagggtgtcagactgaaaaa

SEQ ID NO: 88820 - DNA, 20 bp, synthetic construct
  misc_feature 1..20: note = CRISPR gRNA sequence
  source 1..20: mol_type = other DNA
aaaaaggaccttagaaatta

SEQ ID NO: 88821 - DNA, 20 bp, synthetic construct
  misc_feature 1..20: note = CRISPR gRNA sequence
  source 1..20: mol_type = other DNA
agaaattatttgacaaggcc

SEQ ID NO: 88822 - DNA, 20 bp, synthetic construct
  misc_feature 1..20: note = CRISPR gRNA sequence
  source 1..20: mol_type = other DNA
gaaattatttgacaaggccg

SEQ ID NO: 88823 - DNA, 20 bp, synthetic construct
  misc_feature 1..20: note = CRISPR gRNA sequence
  source 1..20: mol_type = other DNA
tttgacaaggccgggcacgg

SEQ ID NO: 88824 - DNA, 20 bp, synthetic construct
  misc_feature 1..20: note = CRISPR gRNA sequence
  source 1..20: mol_type = other DNA
gacaaggccgggcacggtgg

SEQ ID NO: 88825 - DNA, 20 bp, synthetic construct
  misc_feature 1..20: note = CRISPR gRNA sequence
  source 1..20: mol_type = other DNA
acaaggccgggcacggtggc

SEQ ID NO: 88826 - DNA, 20 bp, synthetic construct
  misc_feature 1..20: note = CRISPR gRNA sequence
  source 1..20: mol_type = other DNA
acgcctacaatcccagcact

SEQ ID NO: 88827 - DNA, 20 bp, synthetic construct
  misc_feature 1..20: note = CRISPR gRNA sequence
  source 1..20: mol_type = other DNA
caatcccagcactttggaag

SEQ ID NO: 88828 - DNA, 20 bp, synthetic construct
  misc_feature 1..20: note = CRISPR gRNA sequence
  source 1..20: mol_type = other DNA
tggaaggccaaggcaggctg

SEQ ID NO: 88829 - DNA, 20 bp, synthetic construct
  misc_feature 1..20: note = CRISPR gRNA sequence
  source 1..20: mol_type = other DNA
ggaaggccaaggcaggctga

SEQ ID NO: 88830 - DNA, 20 bp, synthetic construct
  misc_feature 1..20: note = CRISPR gRNA sequence
  source 1..20: mol_type = other DNA
gaaggccaaggcaggctgat

SEQ ID NO: 88831 - DNA, 20 bp, synthetic construct
  misc_feature 1..20: note = CRISPR gRNA sequence
  source 1..20: mol_type = other DNA
atcacaaggtcaggagatcg

SEQ ID NO: 88832 - DNA, 20 bp, synthetic construct
  misc_feature 1..20: note = CRISPR gRNA sequence
  source 1..20: mol_type = other DNA
gctaacatggtgaaaccccg

SEQ ID NO: 88833 - DNA, 20 bp, synthetic construct
  misc_feature 1..20: note = CRISPR gRNA sequence
  source 1..20: mol_type = other DNA
acatggtgaaaccccgtttc

SEQ ID NO: 88834 - DNA, 20 bp, synthetic construct
  misc_feature 1..20: note = CRISPR gRNA sequence
  source 1..20: mol_type = other DNA
ctactaaaaatacaaaaaaa

SEQ ID NO: 88835 - DNA, 20 bp, synthetic construct
  misc_feature 1..20: note = CRISPR gRNA sequence
  source 1..20: mol_type = other DNA
tactaaaaatacaaaaaaaa

SEQ ID NO: 88836 - DNA, 20 bp, synthetic construct
  misc_feature 1..20: note = CRISPR gRNA sequence
  source 1..20: mol_type = other DNA
ctaaaaatacaaaaaaaaat

SEQ ID NO: 88837 - DNA, 20 bp, synthetic construct
  misc_feature 1..20: note = CRISPR gRNA sequence
  source 1..20: mol_type = other DNA
aaaatacaaaaaaaaattag

SEQ ID NO: 88838 - DNA, 20 bp, synthetic construct
  misc_feature 1..20: note = CRISPR gRNA sequence
  source 1..20: mol_type = other DNA
gctgggtgtggtgacgggcg

SEQ ID NO: 88839 - DNA, 20 bp, synthetic construct
  misc_feature 1..20: note = CRISPR gRNA sequence
  source 1..20: mol_type = other DNA
ggtgtggtgacgggcgcctg

SEQ ID NO: 88840 - DNA, 20 bp, synthetic construct
  misc_feature 1..20: note = CRISPR gRNA sequence
  source 1..20: mol_type = other DNA
tagtcccagctacttgggag

SEQ ID NO: 88841 - DNA, 20 bp, synthetic construct
  misc_feature 1..20: note = CRISPR gRNA sequence
  source 1..20: mol_type = other DNA
cttgggaggctgaggcagga

SEQ ID NO: 88842 - DNA, 20 bp, synthetic construct
  misc_feature 1..20: note = CRISPR gRNA sequence
  source 1..20: mol_type = other DNA
gggaggctgaggcaggagaa

SEQ ID NO: 88843 - DNA, 20 bp, synthetic construct
  misc_feature 1..20: note = CRISPR gRNA sequence
  source 1..20: mol_type = other DNA
ggaggctgaggcaggagaat

SEQ ID NO: 88844 - DNA, 20 bp, synthetic construct
  misc_feature 1..20: note = CRISPR gRNA sequence
  source 1..20: mol_type = other DNA
aggcaggagaatggcgtgaa

SEQ ID NO: 88845 - DNA, 20 bp, synthetic construct
  misc_feature 1..20: note = CRISPR gRNA sequence
  source 1..20: mol_type = other DNA
ggaggcggagcttgcagtga

SEQ ID NO: 88846 - DNA, 20 bp, synthetic construct
  misc_feature 1..20: note = CRISPR gRNA sequence
  source 1..20: mol_type = other DNA
gcagtgagccgagattgcgc

SEQ ID NO: 88847 - DNA, 20 bp, synthetic construct
  misc_feature 1..20: note = CRISPR gRNA sequence
  source 1..20: mol_type = other DNA
cagtgagccgagattgcgcc

SEQ ID NO: 88848 - DNA, 20 bp, synthetic construct
  misc_feature 1..20: note = CRISPR gRNA sequence
  source 1..20: mol_type = other DNA
cgccactgcactccagccta

SEQ ID NO: 88849 - DNA, 20 bp, synthetic construct
  misc_feature 1..20: note = CRISPR gRNA sequence
  source 1..20: mol_type = other DNA
cactccagcctaggcgacag

SEQ ID NO: 88850 - DNA, 20 bp, synthetic construct
  misc_feature 1..20: note = CRISPR gRNA sequence
  source 1..20: mol_type = other DNA
cagcctaggcgacagagtga

SEQ ID NO: 88851 - DNA, 20 bp, synthetic construct
  misc_feature 1..20: note = CRISPR gRNA sequence
  source 1..20: mol_type = other DNA
ggcgacagagtgagactcca

SEQ ID NO: 88852 - DNA, 20 bp, synthetic construct
  misc_feature 1..20: note = CRISPR gRNA sequence
  source 1..20: mol_type = other DNA
catctcaaaaaaaaaaaaaa

SEQ ID NO: 88853 - DNA, 20 bp, synthetic construct
  misc_feature 1..20: note = CRISPR gRNA sequence
  source 1..20: mol_type = other DNA
aaaaaaaaaaaaaaaaaaga

SEQ ID NO: 88854 - DNA, 20 bp, synthetic construct
  misc_feature 1..20: note = CRISPR gRNA sequence
  source 1..20: mol_type = other DNA
tttgatgctaggtgctctga

SEQ ID NO: 88855 - DNA, 20 bp, synthetic construct
  misc_feature 1..20: note = CRISPR gRNA sequence
  source 1..20: mol_type = other DNA
gatgctaggtgctctgagga

SEQ ID NO: 88856 - DNA, 20 bp, synthetic construct
  misc_feature 1..20: note = CRISPR gRNA sequence
  source 1..20: mol_type = other DNA
atgctaggtgctctgaggag

SEQ ID NO: 88857 - DNA, 20 bp, synthetic construct
  misc_feature 1..20: note = CRISPR gRNA sequence
  source 1..20: mol_type = other DNA
ggtgctctgaggagccctat

SEQ ID NO: 88858 - DNA, 20 bp, synthetic construct
  misc_feature 1..20: note = CRISPR gRNA sequence
  source 1..20: mol_type = other DNA
tgaggagccctataggctac

SEQ ID NO: 88859 - DNA, 20 bp, synthetic construct
  misc_feature 1..20: note = CRISPR gRNA sequence
  source 1..20: mol_type = other DNA
aggagccctataggctacca

SEQ ID NO: 88860 - DNA, 20 bp, synthetic construct
  misc_feature 1..20: note = CRISPR gRNA sequence
  source 1..20: mol_type = other DNA
taggctaccatggagaggag

SEQ ID NO: 88861 - DNA, 20 bp, synthetic construct
  misc_feature 1..20: note = CRISPR gRNA sequence
  source 1..20: mol_type = other DNA
ccatggagaggagggaagta

SEQ ID NO: 88862 - DNA, 20 bp, synthetic construct
  misc_feature 1..20: note = CRISPR gRNA sequence
  source 1..20: mol_type = other DNA
tgacttcatctctgctgggc

SEQ ID NO: 88863 - DNA, 20 bp, synthetic construct
  misc_feature 1..20: note = CRISPR gRNA sequence
  source 1..20: mol_type = other DNA
acttcatctctgctgggctt

SEQ ID NO: 88864 - DNA, 20 bp, synthetic construct
  misc_feature 1..20: note = CRISPR gRNA sequence
  source 1..20: mol_type = other DNA
catctctgctgggcttctat

SEQ ID NO: 88865 - DNA, 20 bp, synthetic construct
  misc_feature 1..20: note = CRISPR gRNA sequence
  source 1..20: mol_type = other DNA
atctctgctgggcttctatg

SEQ ID NO: 88866 - DNA, 20 bp, synthetic construct
  misc_feature 1..20: note = CRISPR gRNA sequence
  source 1..20: mol_type = other DNA
tgctgggcttctatgcaagt

SEQ ID NO: 88867 - DNA, 20 bp, synthetic construct
  misc_feature 1..20: note = CRISPR gRNA sequence
  source 1..20: mol_type = other DNA
ctgggcttctatgcaagtgc

SEQ ID NO: 88868 - DNA, 20 bp, synthetic construct
  misc_feature 1..20: note = CRISPR gRNA sequence
  source 1..20: mol_type = other DNA
ggcttctatgcaagtgctca

SEQ ID NO: 88869 - DNA, 20 bp, synthetic construct
  misc_feature 1..20: note = CRISPR gRNA sequence
  source 1..20: mol_type = other DNA
ctatgcaagtgctcacagag

SEQ ID NO: 88870 - DNA, 20 bp, synthetic construct
  misc_feature 1..20: note = CRISPR gRNA sequence
  source 1..20: mol_type = other DNA
tatgcaagtgctcacagaga

SEQ ID NO: 88871 - DNA, 20 bp, synthetic construct
  misc_feature 1..20: note = CRISPR gRNA sequence
  source 1..20: mol_type = other DNA
tgcaagtgctcacagagatc

SEQ ID NO: 88872 - DNA, 20 bp, synthetic construct
  misc_feature 1..20: note = CRISPR gRNA sequence
  source 1..20: mol_type = other DNA
acagagatcaagtgagaggc

SEQ ID NO: 88873 - DNA, 20 bp, synthetic construct
  misc_feature 1..20: note = CRISPR gRNA sequence
  source 1..20: mol_type = other DNA
gcagcaagtttgcaaagcca

SEQ ID NO: 88874 - DNA, 20 bp, synthetic construct
  misc_feature 1..20: note = CRISPR gRNA sequence
  source 1..20: mol_type = other DNA
gcaaagccaactatcttctg

SEQ ID NO: 88875 - DNA, 20 bp, synthetic construct
  misc_feature 1..20: note = CRISPR gRNA sequence
  source 1..20: mol_type = other DNA
caaagccaactatcttctga

SEQ ID NO: 88876 - DNA, 20 bp, synthetic construct
  misc_feature 1..20: note = CRISPR gRNA sequence
  source 1..20: mol_type = other DNA
tcttctgacaaggcagagga

SEQ ID NO: 88877 - DNA, 20 bp, synthetic construct
  misc_feature 1..20: note = CRISPR gRNA sequence
  source 1..20: mol_type = other DNA
ctgacaaggcagaggaccct

SEQ ID NO: 88878 - DNA, 20 bp, synthetic construct
  misc_feature 1..20: note = CRISPR gRNA sequence
  source 1..20: mol_type = other DNA
tgacaaggcagaggacccta

SEQ ID NO: 88879 - DNA, 20 bp, synthetic construct
  misc_feature 1..20: note = CRISPR gRNA sequence
  source 1..20: mol_type = other DNA
acaaggcagaggaccctacc

SEQ ID NO: 88880 - DNA, 20 bp, synthetic construct
  misc_feature 1..20: note = CRISPR gRNA sequence
  source 1..20: mol_type = other DNA
cctctcccacatcaatgttt

SEQ ID NO: 88881 - DNA, 20 bp, synthetic construct
  misc_feature 1..20: note = CRISPR gRNA sequence
  source 1..20: mol_type = other DNA
tcccacatcaatgttttgtt

SEQ ID NO: 88882 - DNA, 20 bp, synthetic construct
  misc_feature 1..20: note = CRISPR gRNA sequence
  source 1..20: mol_type = other DNA
ccacatcaatgttttgttga

SEQ ID NO: 88883 - DNA, 20 bp, synthetic construct
  misc_feature 1..20: note = CRISPR gRNA sequence
  source 1..20: mol_type = other DNA
tgttgatgcccatcatcctc

SEQ ID NO: 88884 - DNA, 20 bp, synthetic construct
  misc_feature 1..20: note = CRISPR gRNA sequence
  source 1..20: mol_type = other DNA
gttgatgcccatcatcctca

SEQ ID NO: 88885 - DNA, 20 bp, synthetic construct
  misc_feature 1..20: note = CRISPR gRNA sequence
  source 1..20: mol_type = other DNA
ttgatgcccatcatcctcac

SEQ ID NO: 88886 - DNA, 20 bp, synthetic construct
  misc_feature 1..20: note = CRISPR gRNA sequence
  source 1..20: mol_type = other DNA
atgcccatcatcctcacatc

SEQ ID NO: 88887 - DNA, 20 bp, synthetic construct
  misc_feature 1..20: note = CRISPR gRNA sequence
  source 1..20: mol_type = other DNA
acatcctcctccctcagcat

SEQ ID NO: 88888 - DNA, 20 bp, synthetic construct
  misc_feature 1..20: note = CRISPR gRNA sequence
  source 1..20: mol_type = other DNA
ctccctcagcatttccatcc

SEQ ID NO: 88889 - DNA, 20 bp, synthetic construct
  misc_feature 1..20: note = CRISPR gRNA sequence
  source 1..20: mol_type = other DNA
cctcagcatttccatccctc

SEQ ID NO: 88890 - DNA, 20 bp, synthetic construct
  misc_feature 1..20: note = CRISPR gRNA sequence
  source 1..20: mol_type = other DNA
agcatttccatccctctctt

SEQ ID NO: 88891 - DNA, 20 bp, synthetic construct
  misc_feature 1..20: note = CRISPR gRNA sequence
  source 1..20: mol_type = other DNA
ccatccctctcttgccctct

SEQ ID NO: 88892 - DNA, 20 bp, synthetic construct
  misc_feature 1..20: note = CRISPR gRNA sequence
  source 1..20: mol_type = other DNA
catccctctcttgccctctt

SEQ ID NO: 88893 - DNA, 20 bp, synthetic construct
  misc_feature 1..20: note = CRISPR gRNA sequence
  source 1..20: mol_type = other DNA
tcttgccctcttccccaaca

SEQ ID NO: 88894 - DNA, 20 bp, synthetic construct
  misc_feature 1..20: note = CRISPR gRNA sequence
  source 1..20: mol_type = other DNA
ttgccctcttccccaacaca

SEQ ID NO: 88895 - DNA, 20 bp, synthetic construct
  misc_feature 1..20: note = CRISPR gRNA sequence
  source 1..20: mol_type = other DNA
gccctcttccccaacacact

SEQ ID NO: 88896 - DNA, 20 bp, synthetic construct
  misc_feature 1..20: note = CRISPR gRNA sequence
  source 1..20: mol_type = other DNA
ccctcttccccaacacactt

SEQ ID NO: 88897 - DNA, 20 bp, synthetic construct
  misc_feature 1..20: note = CRISPR gRNA sequence
  source 1..20: mol_type = other DNA
ttccccaacacacttaccag

SEQ ID NO: 88898 - DNA, 20 bp, synthetic construct
  misc_feature 1..20: note = CRISPR gRNA sequence
  source 1..20: mol_type = other DNA
ccccaacacacttaccagga

SEQ ID NO: 88899 - DNA, 20 bp, synthetic construct
  misc_feature 1..20: note = CRISPR gRNA sequence
  source 1..20: mol_type = other DNA
cccaacacacttaccaggat

SEQ ID NO: 88900 - DNA, 20 bp, synthetic construct
  misc_feature 1..20: note = CRISPR gRNA sequence
  source 1..20: mol_type = other DNA
accaggatcccctctacttt

SEQ ID NO: 88901 - DNA, 20 bp, synthetic construct
  misc_feature 1..20: note = CRISPR gRNA sequence
  source 1..20: mol_type = other DNA
ccaggatcccctctactttg

SEQ ID NO: 88902 - DNA, 20 bp, synthetic construct
  misc_feature 1..20: note = CRISPR gRNA sequence
  source 1..20: mol_type = other DNA
tactttgttctgcacggcct

SEQ ID NO: 88903 - DNA, 20 bp, synthetic construct
  misc_feature 1..20: note = CRISPR gRNA sequence
  source 1..20: mol_type = other DNA
ctttgttctgcacggccttg

SEQ ID NO: 88904 - DNA, 20 bp, synthetic construct
  misc_feature 1..20: note = CRISPR gRNA sequence
  source 1..20: mol_type = other DNA
tgttctgcacggccttgctg

SEQ ID NO: 88905 - DNA, 20 bp, synthetic construct
  misc_feature 1..20: note = CRISPR gRNA sequence
  source 1..20: mol_type = other DNA
gttctgcacggccttgctgt

SEQ ID NO: 88906 - DNA, 20 bp, synthetic construct
  misc_feature 1..20: note = CRISPR gRNA sequence
  source 1..20: mol_type = other DNA
ttctgcacggccttgctgtg

SEQ ID NO: 88907 - DNA, 20 bp, synthetic construct
  misc_feature 1..20: note = CRISPR gRNA sequence
  source 1..20: mol_type = other DNA
tgcacggccttgctgtgggg

SEQ ID NO: 88908 - DNA, 20 bp, synthetic construct
  misc_feature 1..20: note = CRISPR gRNA sequence
  source 1..20: mol_type = other DNA
cacggccttgctgtggggaa

SEQ ID NO: 88909 - DNA, 20 bp, synthetic construct
  misc_feature 1..20: note = CRISPR gRNA sequence
  source 1..20: mol_type = other DNA
gctgtggggaagaggagaaa

SEQ ID NO: 88910 - DNA, 20 bp, synthetic construct
  misc_feature 1..20: note = CRISPR gRNA sequence
  source 1..20: mol_type = other DNA
ctgtggggaagaggagaaag

SEQ ID NO: 88911 - DNA, 20 bp, synthetic construct
  misc_feature 1..20: note = CRISPR gRNA sequence
  source 1..20: mol_type = other DNA
tggggaagaggagaaagctg

SEQ ID NO: 88912 - DNA, 20 bp, synthetic construct
  misc_feature 1..20: note = CRISPR gRNA sequence
  source 1..20: mol_type = other DNA
gaggtcacacacaagatttt

SEQ ID NO: 88913 - DNA, 20 bp, synthetic construct
  misc_feature 1..20: note = CRISPR gRNA sequence
  source 1..20: mol_type = other DNA
tccctgtctctttatctgac

SEQ ID NO: 88914 - DNA, 20 bp, synthetic construct
  misc_feature 1..20: note = CRISPR gRNA sequence
  source 1..20: mol_type = other DNA
ccctgtctctttatctgact

SEQ ID NO: 88915 - DNA, 20 bp, synthetic construct
  misc_feature 1..20: note = CRISPR gRNA sequence
  source 1..20: mol_type = other DNA
cctgtctctttatctgactg

SEQ ID NO: 88916 - DNA, 20 bp, synthetic construct
  misc_feature 1..20: note = CRISPR gRNA sequence
  source 1..20: mol_type = other DNA
tctctttatctgactgctag

SEQ ID NO: 88917 - DNA, 20 bp, synthetic construct
  misc_feature 1..20: note = CRISPR gRNA sequence
  source 1..20: mol_type = other DNA
tttatctgactgctagggag

SEQ ID NO: 88918 - DNA, 20 bp, synthetic construct
  misc_feature 1..20: note = CRISPR gRNA sequence
  source 1..20: mol_type = other DNA
tatctgactgctagggaggg

SEQ ID NO: 88919 - DNA, 20 bp, synthetic construct
  misc_feature 1..20: note = CRISPR gRNA sequence
  source 1..20: mol_type = other DNA
atctgactgctagggaggga

SEQ ID NO: 88920 - DNA, 20 bp, synthetic construct
  misc_feature 1..20: note = CRISPR gRNA sequence
  source 1..20: mol_type = other DNA
tctgactgctagggagggaa

SEQ ID NO: 88921 - DNA, 20 bp, synthetic construct
  misc_feature 1..20: note = CRISPR gRNA sequence
  source 1..20: mol_type = other DNA
actgctagggagggaaaagg

SEQ ID NO: 88922 - DNA, 20 bp, synthetic construct
  misc_feature 1..20: note = CRISPR gRNA sequence
  source 1..20: mol_type = other DNA
ctagggagggaaaaggactg

SEQ ID NO: 88923 - DNA, 20 bp, synthetic construct
  misc_feature 1..20: note = CRISPR gRNA sequence
  source 1..20: mol_type = other DNA
gggagggaaaaggactgaaa

SEQ ID NO: 88924 - DNA, 20 bp, synthetic construct
  misc_feature 1..20: note = CRISPR gRNA sequence
  source 1..20: mol_type = other DNA
aaatgcccagcaggtgctca

SEQ ID NO: 88925 - DNA, 20 bp, synthetic construct
  misc_feature 1..20: note = CRISPR gRNA sequence
  source 1..20: mol_type = other DNA
aagaattgctaccatggcca

SEQ ID NO: 88926 - DNA, 20 bp, synthetic construct
  misc_feature 1..20: note = CRISPR gRNA sequence
  source 1..20: mol_type = other DNA
ctaccatggccaaaaatctc

SEQ ID NO: 88927 - DNA, 20 bp, synthetic construct
  misc_feature 1..20: note = CRISPR gRNA sequence
  source 1..20: mol_type = other DNA
ccatggccaaaaatctccct

SEQ ID NO: 88928 - DNA, 20 bp, synthetic construct
  misc_feature 1..20: note = CRISPR gRNA sequence
  source 1..20: mol_type = other DNA
cctctgctcccatgcccttg

SEQ ID NO: 88929 - DNA, 20 bp, synthetic construct
  misc_feature 1..20: note = CRISPR gRNA sequence
  source 1..20: mol_type = other DNA
tgctcccatgcccttgctga

SEQ ID NO: 88930 - DNA, 20 bp, synthetic construct
  misc_feature 1..20: note = CRISPR gRNA sequence
  source 1..20: mol_type = other DNA
ctcccatgcccttgctgaga

SEQ ID NO: 88931 - DNA, 20 bp, synthetic construct
  misc_feature 1..20: note = CRISPR gRNA sequence
  source 1..20: mol_type = other DNA
ccatgcccttgctgagaggc

SEQ ID NO: 88932 - DNA, 20 bp, synthetic construct
  misc_feature 1..20: note = CRISPR gRNA sequence
  source 1..20: mol_type = other DNA
gctgagaggcagttcatcta

SEQ ID NO: 88933 - DNA, 20 bp, synthetic construct
  misc_feature 1..20: note = CRISPR gRNA sequence
  source 1..20: mol_type = other DNA
ctgagaggcagttcatctac

SEQ ID NO: 88934 - DNA, 20 bp, synthetic construct
  misc_feature 1..20: note = CRISPR gRNA sequence
  source 1..20: mol_type = other DNA
agaggcagttcatctacagc

SEQ ID NO: 88935 - DNA, 20 bp, synthetic construct
  misc_feature 1..20: note = CRISPR gRNA sequence
  source 1..20: mol_type = other DNA
atctacagccaaagtgaagt

SEQ ID NO: 88936 - DNA, 20 bp, synthetic construct
  misc_feature 1..20: note = CRISPR gRNA sequence
  source 1..20: mol_type = other DNA
cagccaaagtgaagtgctgc

SEQ ID NO: 88937 - DNA, 20 bp, synthetic construct
  misc_feature 1..20: note = CRISPR gRNA sequence
  source 1..20: mol_type = other DNA
cagggatctatactcaggtc

SEQ ID NO: 88938 - DNA, 20 bp, synthetic construct
  misc_feature 1..20: note = CRISPR gRNA sequence
  source 1..20: mol_type = other DNA
tactcaggtcttggacagga

SEQ ID NO: 88939 - DNA, 20 bp, synthetic construct
  misc_feature 1..20: note = CRISPR gRNA sequence
  source 1..20: mol_type = other DNA
aggtcttggacaggacttgg

SEQ ID NO: 88940 - DNA, 20 bp, synthetic construct
  misc_feature 1..20: note = CRISPR gRNA sequence
  source 1..20: mol_type = other DNA
ggacaggacttggagatgtg

SEQ ID NO: 88941 - DNA, 20 bp, synthetic construct
  misc_feature 1..20: note = CRISPR gRNA sequence
  source 1..20: mol_type = other DNA
gacaggacttggagatgtga

SEQ ID NO: 88942 - DNA, 20 bp, synthetic construct
  misc_feature 1..20: note = CRISPR gRNA sequence
  source 1..20: mol_type = other DNA
ggagatgtgatgagtactta

SEQ ID NO: 88943 - DNA, 20 bp, synthetic construct
  misc_feature 1..20: note = CRISPR gRNA sequence
  source 1..20: mol_type = other DNA
gagatgtgatgagtacttac

SEQ ID NO: 88944 - DNA, 20 bp, synthetic construct
  misc_feature 1..20: note = CRISPR gRNA sequence
  source 1..20: mol_type = other DNA
acgaaatggtacctcggagc

SEQ ID NO: 88945 - DNA, 20 bp, synthetic construct
  misc_feature 1..20: note = CRISPR gRNA sequence
  source 1..20: mol_type = other DNA
cgaaatggtacctcggagcc

SEQ ID NO: 88946 - DNA, 20 bp, synthetic construct
  misc_feature 1..20: note = CRISPR gRNA sequence
  source 1..20: mol_type = other DNA
ggagcctctgaagaagggtg

SEQ ID NO: 88947 - DNA, 20 bp, synthetic construct
  misc_feature 1..20: note = CRISPR gRNA sequence
  source 1..20: mol_type = other DNA
tgaagaagggtggtaggttc

SEQ ID NO: 88948 - DNA, 20 bp, synthetic construct
  misc_feature 1..20: note = CRISPR gRNA sequence
  source 1..20: mol_type = other DNA
aagaagggtggtaggttccc

SEQ ID NO: 88949 - DNA, 20 bp, synthetic construct
  misc_feature 1..20: note = CRISPR gRNA sequence
  source 1..20: mol_type = other DNA
cccagcctcagcaccacctg

SEQ ID NO: 88950 - DNA, 20 bp, synthetic construct
  misc_feature 1..20: note = CRISPR gRNA sequence
  source 1..20: mol_type = other DNA
agcaccacctgggggggccc

SEQ ID NO: 88951 - DNA, 20 bp, synthetic construct
  misc_feature 1..20: note = CRISPR gRNA sequence
  source 1..20: mol_type = other DNA
ggggggcccttcccccagtc

SEQ ID NO: 88952 - DNA, 20 bp, synthetic construct
  misc_feature 1..20: note = CRISPR gRNA sequence
  source 1..20: mol_type = other DNA
cccccagtcttggggctctt

SEQ ID NO: 88953 - DNA, 20 bp, synthetic construct
  misc_feature 1..20: note = CRISPR gRNA sequence
  source 1..20: mol_type = other DNA
ccccagtcttggggctctta

SEQ ID NO: 88954 - DNA, 20 bp, synthetic construct
  misc_feature 1..20: note = CRISPR gRNA sequence
  source 1..20: mol_type = other DNA
ggggctcttagcatcaggct

SEQ ID NO: 88955 - DNA, 20 bp, synthetic construct
  misc_feature 1..20: note = CRISPR gRNA sequence
  source 1..20: mol_type = other DNA
gggctcttagcatcaggctc

SEQ ID NO: 88956 - DNA, 20 bp, synthetic construct
  misc_feature 1..20: note = CRISPR gRNA sequence
  source 1..20: mol_type = other DNA
ttagcatcaggctcatcttc

SEQ ID NO: 88957 - DNA, 20 bp, synthetic construct
  misc_feature 1..20: note = CRISPR gRNA sequence
  source 1..20: mol_type = other DNA
agcatcaggctcatcttctg

SEQ ID NO: 88958 - DNA, 20 bp, synthetic construct
  misc_feature 1..20: note = CRISPR gRNA sequence
  source 1..20: mol_type = other DNA
gcatcaggctcatcttctgc

SEQ ID NO: 88959 - DNA, 20 bp, synthetic construct
  misc_feature 1..20: note = CRISPR gRNA sequence
  source 1..20: mol_type = other DNA
atcttctgccatcccggcat

SEQ ID NO: 88960 - DNA, 20 bp, synthetic construct
  misc_feature 1..20: note = CRISPR gRNA sequence
  source 1..20: mol_type = other DNA
ctgccatcccggcatgaggg

SEQ ID NO: 88961 - DNA, 20 bp, synthetic construct
  misc_feature 1..20: note = CRISPR gRNA sequence
  source 1..20: mol_type = other DNA
tgccatcccggcatgagggc

SEQ ID NO: 88962 - DNA, 20 bp, synthetic construct
  misc_feature 1..20: note = CRISPR gRNA sequence
  source 1..20: mol_type = other DNA
ccatcccggcatgagggcta

SEQ ID NO: 88963 - DNA, 20 bp, synthetic construct
  misc_feature 1..20: note = CRISPR gRNA sequence
  source 1..20: mol_type = other DNA
gaattgagagggacaggcat

SEQ ID NO: 88964 - DNA, 20 bp, synthetic construct
  misc_feature 1..20: note = CRISPR gRNA sequence
  source 1..20: mol_type = other DNA
agagggacaggcataaagat

SEQ ID NO: 88965 - DNA, 20 bp, synthetic construct
  misc_feature 1..20: note = CRISPR gRNA sequence
  source 1..20: mol_type = other DNA
acactggccttcccttcccc

SEQ ID NO: 88966 - DNA, 20 bp, synthetic construct
  misc_feature 1..20: note = CRISPR gRNA sequence
  source 1..20: mol_type = other DNA
gccttcccttccccagaagg

SEQ ID NO: 88967 - DNA, 20 bp, synthetic construct
  misc_feature 1..20: note = CRISPR gRNA sequence
  source 1..20: mol_type = other DNA
cccttccccagaaggcccca

SEQ ID NO: 88968 - DNA, 20 bp, synthetic construct
  misc_feature 1..20: note = CRISPR gRNA sequence
  source 1..20: mol_type = other DNA
ccttccccagaaggccccag

SEQ ID NO: 88969 - DNA, 20 bp, synthetic construct
  misc_feature 1..20: note = CRISPR gRNA sequence
  source 1..20: mol_type = other DNA
ccccagaaggccccagggca

SEQ ID NO: 88970 - DNA, 20 bp, synthetic construct
  misc_feature 1..20: note = CRISPR gRNA sequence
  source 1..20: mol_type = other DNA
cccagaaggccccagggcac

SEQ ID NO: 88971 - DNA, 20 bp, synthetic construct
  misc_feature 1..20: note = CRISPR gRNA sequence
  source 1..20: mol_type = other DNA
ctcatctctttacccagaaa

SEQ ID NO: 88972 - DNA, 20 bp, synthetic construct
  misc_feature 1..20: note = CRISPR gRNA sequence
  source 1..20: mol_type = other DNA
atctctttacccagaaaggc

SEQ ID NO: 88973 - DNA, 20 bp, synthetic construct
  misc_feature 1..20: note = CRISPR gRNA sequence
  source 1..20: mol_type = other DNA
tttacccagaaaggcagaga

SEQ ID NO: 88974 - DNA, 20 bp, synthetic construct
  misc_feature 1..20: note = CRISPR gRNA sequence
  source 1..20: mol_type = other DNA
tacccagaaaggcagagaaa

SEQ ID NO: 88975 - DNA, 20 bp, synthetic construct
  misc_feature 1..20: note = CRISPR gRNA sequence
  source 1..20: mol_type = other DNA
acccagaaaggcagagaaac

SEQ ID NO: 88976 - DNA, 20 bp, synthetic construct
  misc_feature 1..20: note = CRISPR gRNA sequence
  source 1..20: mol_type = other DNA
cccagaaaggcagagaaaca

SEQ ID NO: 88977 - DNA, 20 bp, synthetic construct
  misc_feature 1..20: note = CRISPR gRNA sequence
  source 1..20: mol_type = other DNA
cgaatttccccggtggtctt

SEQ ID NO: 88978 - DNA, 20 bp, synthetic construct
  misc_feature 1..20: note = CRISPR gRNA sequence
  source 1..20: mol_type = other DNA
ccccggtggtctttttctca

SEQ ID NO: 88979 - DNA, 20 bp, synthetic construct
  misc_feature 1..20: note = CRISPR gRNA sequence
  source 1..20: mol_type = other DNA
cccggtggtctttttctcac

SEQ ID NO: 88980 - DNA, 20 bp, synthetic construct
  misc_feature 1..20: note = CRISPR gRNA sequence
  source 1..20: mol_type = other DNA
tttctcaccacttgccttct

SEQ ID NO: 88981 - DNA, 20 bp, synthetic construct
  misc_feature 1..20: note = CRISPR gRNA sequence
  source 1..20: mol_type = other DNA
ttctcaccacttgccttctc

SEQ ID NO: 88982 - DNA, 20 bp, synthetic construct
  misc_feature 1..20: note = CRISPR gRNA sequence
  source 1..20: mol_type = other DNA
tctcaccacttgccttctcc

SEQ ID NO: 88983 - DNA, 20 bp, synthetic construct
  misc_feature 1..20: note = CRISPR gRNA sequence
  source 1..20: mol_type = other DNA
ctcaccacttgccttctccg

SEQ ID NO: 88984 - DNA, 20 bp, synthetic construct
  misc_feature 1..20: note = CRISPR gRNA sequence
  source 1..20: mol_type = other DNA
tcaccacttgccttctccga

SEQ ID NO: 88985 - DNA, 20 bp, synthetic construct
  misc_feature 1..20: note = CRISPR gRNA sequence
  source 1..20: mol_type = other DNA
accacttgccttctccgaaa

SEQ ID NO: 88986 - DNA, 20 bp, synthetic construct
  misc_feature 1..20: note = CRISPR gRNA sequence
  source 1..20: mol_type = other DNA
gccttctccgaaaattagaa

SEQ ID NO: 88987 - DNA, 20 bp, synthetic construct
  misc_feature 1..20: note = CRISPR gRNA sequence
  source 1..20: mol_type = other DNA
ccttctccgaaaattagaaa

SEQ ID NO: 88988 - DNA, 20 bp, synthetic construct
  misc_feature 1..20: note = CRISPR gRNA sequence
  source 1..20: mol_type = other DNA
ctccgaaaattagaaattat

SEQ ID NO: 88989 - DNA, 20 bp, synthetic construct
  misc_feature 1..20: note = CRISPR gRNA sequence
  source 1..20: mol_type = other DNA
tccgaaaattagaaattatt

SEQ ID NO: 88990 - DNA, 20 bp, synthetic construct
  misc_feature 1..20: note = CRISPR gRNA sequence
  source 1..20: mol_type = other DNA
cgaaaattagaaattattcc

SEQ ID NO: 88991 - DNA, 20 bp, synthetic construct
  misc_feature 1..20: note = CRISPR gRNA sequence
  source 1..20: mol_type = other DNA
gaaattattccattacttcg

SEQ ID NO: 88992 - DNA, 20 bp, synthetic construct
  misc_feature 1..20: note = CRISPR gRNA sequence
  source 1..20: mol_type = other DNA
ttccattacttcgccaggcc

SEQ ID NO: 88993 - DNA, 20 bp, synthetic construct
  misc_feature 1..20: note = CRISPR gRNA sequence
  source 1..20: mol_type = other DNA
cattacttcgccaggcccat

SEQ ID NO: 88994 - DNA, 20 bp, synthetic construct
  misc_feature 1..20: note = CRISPR gRNA sequence
  source 1..20: mol_type = other DNA
cttcgccaggcccatatatg

SEQ ID NO: 88995 - DNA, 20 bp, synthetic construct
  misc_feature 1..20: note = CRISPR gRNA sequence
  source 1..20: mol_type = other DNA
cgccaggcccatatatgccc

SEQ ID NO: 88996 - DNA, 20 bp, synthetic construct
  misc_feature 1..20: note = CRISPR gRNA sequence
  source 1..20: mol_type = other DNA
gccaggcccatatatgccca

SEQ ID NO: 88997 - DNA, 20 bp, synthetic construct
  misc_feature 1..20: note = CRISPR gRNA sequence
  source 1..20: mol_type = other DNA
tgccatctccattctatctg

SEQ ID NO: 88998 - DNA, 20 bp, synthetic construct
  misc_feature 1..20: note = CRISPR gRNA sequence
  source 1..20: mol_type = other DNA
gccatctccattctatctgc

SEQ ID NO: 88999 - DNA, 20 bp, synthetic construct
  misc_feature 1..20: note = CRISPR gRNA sequence
  source 1..20: mol_type = other DNA
ccatctccattctatctgcc

SEQ ID NO: 89000 - DNA, 20 bp, synthetic construct
  misc_feature 1..20: note = CRISPR gRNA sequence
  source 1..20: mol_type = other DNA
cattctatctgccccacctt

SEQ ID NO: 89001 - DNA, 20 bp, synthetic construct
  misc_feature 1..20: note = CRISPR gRNA sequence
  source 1..20: mol_type = other DNA
tatctgccccacctttctga

SEQ ID NO: 89002 - DNA, 20 bp, synthetic construct
  misc_feature 1..20: note = CRISPR gRNA sequence
  source 1..20: mol_type = other DNA
tctgccccacctttctgaag

SEQ ID NO: 89003 - DNA, 20 bp, synthetic construct
  misc_feature 1..20: note = CRISPR gRNA sequence
  source 1..20: mol_type = other DNA
ccccacctttctgaagtctc

SEQ ID NO: 89004 - DNA, 20 bp, synthetic construct
  misc_feature 1..20: note = CRISPR gRNA sequence
  source 1..20: mol_type = other DNA
tctgaagtctcctaaatctg

SEQ ID NO: 89005 - DNA, 20 bp, synthetic construct
  misc_feature 1..20: note = CRISPR gRNA sequence
  source 1..20: mol_type = other DNA
ctgaagtctcctaaatctgg

SEQ ID NO: 89006 - DNA, 20 bp, synthetic construct
  misc_feature 1..20: note = CRISPR gRNA sequence
  source 1..20: mol_type = other DNA
tgaagtctcctaaatctgga

SEQ ID NO: 89007 - DNA, 20 bp, synthetic construct
  misc_feature 1..20: note = CRISPR gRNA sequence
  source 1..20: mol_type = other DNA
aagtctcctaaatctggaaa

SEQ ID NO: 89008 - DNA, 20 bp, synthetic construct
  misc_feature 1..20: note = CRISPR gRNA sequence
  source 1..20: mol_type = other DNA
ctaaatctggaaaactgtaa

SEQ ID NO: 89009 - DNA, 20 bp, synthetic construct
  misc_feature 1..20: note = CRISPR gRNA sequence
  source 1..20: mol_type = other DNA
aatctggaaaactgtaaagg

SEQ ID NO: 89010 - DNA, 20 bp, synthetic construct
  misc_feature 1..20: note = CRISPR gRNA sequence
  source 1..20: mol_type = other DNA
gaaaactgtaaaggaagaga

SEQ ID NO: 89011 - DNA, 20 bp, synthetic construct
  misc_feature 1..20: note = CRISPR gRNA sequence
  source 1..20: mol_type = other DNA
taaaggaagagataggggga

SEQ ID NO: 89012 - DNA, 20 bp, synthetic construct
  misc_feature 1..20: note = CRISPR gRNA sequence
  source 1..20: mol_type = other DNA
ggaatccatgttagcaagaa

SEQ ID NO: 89013 - DNA, 20 bp, synthetic construct
  misc_feature 1..20: note = CRISPR gRNA sequence
  source 1..20: mol_type = other DNA
gcaagaaattttcatttctg

SEQ ID NO: 89014 - DNA, 20 bp, synthetic construct
  misc_feature 1..20: note = CRISPR gRNA sequence
  source 1..20: mol_type = other DNA
tcatttctgcctctgacccc

SEQ ID NO: 89015 - DNA, 20 bp, synthetic construct
  misc_feature 1..20: note = CRISPR gRNA sequence
  source 1..20: mol_type = other DNA
catttctgcctctgacccca

SEQ ID NO: 89016 - DNA, 20 bp, synthetic construct
  misc_feature 1..20: note = CRISPR gRNA sequence
  source 1..20: mol_type = other DNA
atttctgcctctgaccccat

SEQ ID NO: 89017 - DNA, 20 bp, synthetic construct
  misc_feature 1..20: note = CRISPR gRNA sequence
  source 1..20: mol_type = other DNA
ctgcctctgaccccatactg

SEQ ID NO: 89018 - DNA, 20 bp, synthetic construct
  misc_feature 1..20: note = CRISPR gRNA sequence
  source 1..20: mol_type = other DNA
tgcctctgaccccatactgc

SEQ ID NO: 89019 - DNA, 20 bp, synthetic construct
  misc_feature 1..20: note = CRISPR gRNA sequence
  source 1..20: mol_type = other DNA
cctctgaccccatactgccc

SEQ ID NO: 89020 - DNA, 20 bp, synthetic construct
  misc_feature 1..20: note = CRISPR gRNA sequence
  source 1..20: mol_type = other DNA
tgaccccatactgccctcct

SEQ ID NO: 89021 - DNA, 20 bp, synthetic construct
  misc_feature 1..20: note = CRISPR gRNA sequence
  source 1..20: mol_type = other DNA
accccatactgccctcctcc

SEQ ID NO: 89022 - DNA, 20 bp, synthetic construct
  misc_feature 1..20: note = CRISPR gRNA sequence
  source 1..20: mol_type = other DNA
ccctcctccccctcaaaaac

SEQ ID NO: 89023 - DNA, 20 bp, synthetic construct
  misc_feature 1..20: note = CRISPR gRNA sequence
  source 1..20: mol_type = other DNA
ctccccctcaaaaacaacaa

SEQ ID NO: 89024 - DNA, 20 bp, synthetic construct
  misc_feature 1..20: note = CRISPR gRNA sequence
  source 1..20: mol_type = other DNA
cccctcaaaaacaacaataa

SEQ ID NO: 89025 - DNA, 20 bp, synthetic construct
  misc_feature 1..20: note = CRISPR gRNA sequence
  source 1..20: mol_type = other DNA
aaaaacaacaataacagcca

SEQ ID NO: 89026 - DNA, 20 bp, synthetic construct
  misc_feature 1..20: note = CRISPR gRNA sequence
  source 1..20: mol_type = other DNA
tctaattctcaaaaatactc

SEQ ID NO: 89027 - DNA, 20 bp, synthetic construct
  misc_feature 1..20: note = CRISPR gRNA sequence
  source 1..20: mol_type = other DNA
taattctcaaaaatactcct

SEQ ID NO: 89028 - DNA, 20 bp, synthetic construct
  misc_feature 1..20: note = CRISPR gRNA sequence
  source 1..20: mol_type = other DNA
attctcaaaaatactcctca

SEQ ID NO: 89029 - DNA, 20 bp, synthetic construct
  misc_feature 1..20: note = CRISPR gRNA sequence
  source 1..20: mol_type = other DNA
tcaaaaatactcctcaccat

SEQ ID NO: 89030 - DNA, 20 bp, synthetic construct
  misc_feature 1..20: note = CRISPR gRNA sequence
  source 1..20: mol_type = other DNA
aaaaatactcctcaccattg

SEQ ID NO: 89031 - DNA, 20 bp, synthetic construct
  misc_feature 1..20: note = CRISPR gRNA sequence
  source 1..20: mol_type = other DNA
ctcaccattgcatatgcctg

SEQ ID NO: 89032 - DNA, 20 bp, synthetic construct
  misc_feature 1..20: note = CRISPR gRNA sequence
  source 1..20: mol_type = other DNA
accattgcatatgcctggga

SEQ ID NO: 89033 - DNA, 20 bp, synthetic construct
  misc_feature 1..20: note = CRISPR gRNA sequence
  source 1..20: mol_type = other DNA
catatgcctgggaggtcaga

SEQ ID NO: 89034 - DNA, 20 bp, synthetic construct
  misc_feature 1..20: note = CRISPR gRNA sequence
  source 1..20: mol_type = other DNA
ggaggtcagaaaggatacga

SEQ ID NO: 89035 - DNA, 20 bp, synthetic construct
  misc_feature 1..20: note = CRISPR gRNA sequence
  source 1..20: mol_type = other DNA
tgcccttctaggcttggaaa

SEQ ID NO: 89036 - DNA, 20 bp, synthetic construct
  misc_feature 1..20: note = CRISPR gRNA sequence
  source 1..20: mol_type = other DNA
cccttctaggcttggaaaaa

SEQ ID NO: 89037 - DNA, 20 bp, synthetic construct
  misc_feature 1..20: note = CRISPR gRNA sequence
  source 1..20: mol_type = other DNA
ctaggcttggaaaaaaaact

SEQ ID NO: 89038 - DNA, 20 bp, synthetic construct
  misc_feature 1..20: note = CRISPR gRNA sequence
  source 1..20: mol_type = other DNA
taggcttggaaaaaaaactg

SEQ ID NO: 89039 - DNA, 20 bp, synthetic construct
  misc_feature 1..20: note = CRISPR gRNA sequence
  source 1..20: mol_type = other DNA
ggcttggaaaaaaaactggg

SEQ ID NO: 89040 - DNA, 20 bp, synthetic construct
  misc_feature 1..20: note = CRISPR gRNA sequence
  source 1..20: mol_type = other DNA
ggaaaaaaaactgggcccaa

SEQ ID NO: 89041 - DNA, 20 bp, synthetic construct
  misc_feature 1..20: note = CRISPR gRNA sequence
  source 1..20: mol_type = other DNA
gaaaaaaaactgggcccaag

SEQ ID NO: 89042 - DNA, 20 bp, synthetic construct
  misc_feature 1..20: note = CRISPR gRNA sequence
  source 1..20: mol_type = other DNA
ggcccaagttctcattactt

SEQ ID NO: 89043 - DNA, 20 bp, synthetic construct
  misc_feature 1..20: note = CRISPR gRNA sequence
  source 1..20: mol_type = other DNA
tcattacttaatctcgccac

SEQ ID NO: 89044 - DNA, 20 bp, synthetic construct
  misc_feature 1..20: note = CRISPR gRNA sequence
  source 1..20: mol_type = other DNA
attacttaatctcgccacga

SEQ ID NO: 89045 - DNA, 20 bp, synthetic construct
  misc_feature 1..20: note = CRISPR gRNA sequence
  source 1..20: mol_type = other DNA
cttaatctcgccacgacttc

SEQ ID NO: 89046 - DNA, 20 bp, synthetic construct
  misc_feature 1..20: note = CRISPR gRNA sequence
  source 1..20: mol_type = other DNA
aatctcgccacgacttcccc

SEQ ID NO: 89047 - DNA, 20 bp, synthetic construct
  misc_feature 1..20: note = CRISPR gRNA sequence
  source 1..20: mol_type = other DNA
atctcgccacgacttccccc

SEQ ID NO: 89048 - DNA, 20 bp, synthetic construct
  misc_feature 1..20: note = CRISPR gRNA sequence
  source 1..20: mol_type = other DNA
gccacgacttcccccgctgc

SEQ ID NO: 89049 - DNA, 20 bp, synthetic construct
  misc_feature 1..20: note = CRISPR gRNA sequence
  source 1..20: mol_type = other DNA
cccccgctgctccccctccc

SEQ ID NO: 89050 - DNA, 20 bp, synthetic construct
  misc_feature 1..20: note = CRISPR gRNA sequence
  source 1..20: mol_type = other DNA
ccccgctgctccccctcccc

SEQ ID NO: 89051 - DNA, 20 bp, synthetic construct
  misc_feature 1..20: note = CRISPR gRNA sequence
  source 1..20: mol_type = other DNA
ctccccctccccacgtcgcc

SEQ ID NO: 89052 - DNA, 20 bp, synthetic construct
  misc_feature 1..20: note = CRISPR gRNA sequence
  source 1..20: mol_type = other DNA
cccctccccacgtcgccggc

SEQ ID NO: 89053 - DNA, 20 bp, synthetic construct
  misc_feature 1..20: note = CRISPR gRNA sequence
  source 1..20: mol_type = other DNA
cccacgtcgccggcccctac

SEQ ID NO: 89054 - DNA, 20 bp, synthetic construct
  misc_feature 1..20: note = CRISPR gRNA sequence
  source 1..20: mol_type = other DNA
cgtcatctcccacaacagcc

SEQ ID NO: 89055 - DNA, 20 bp, synthetic construct
  misc_feature 1..20: note = CRISPR gRNA sequence
  source 1..20: mol_type = other DNA
ccacaacagcccatcctgag

SEQ ID NO: 89056 - DNA, 20 bp, synthetic construct
  misc_feature 1..20: note = CRISPR gRNA sequence
  source 1..20: mol_type = other DNA
aggcgcgcccccacctcctt

SEQ ID NO: 89057 - DNA, 20 bp, synthetic construct
  misc_feature 1..20: note = CRISPR gRNA sequence
  source 1..20: mol_type = other DNA
cttcccttccccctccattc

SEQ ID NO: 89058 - DNA, 20 bp, synthetic construct
  misc_feature 1..20: note = CRISPR gRNA sequence
  source 1..20: mol_type = other DNA
cccttccccctccattcaat

SEQ ID NO: 89059 - DNA, 20 bp, synthetic construct
  misc_feature 1..20: note = CRISPR gRNA sequence
  source 1..20: mol_type = other DNA
ccttccccctccattcaatc

SEQ ID NO: 89060 - DNA, 20 bp, synthetic construct
  misc_feature 1..20: note = CRISPR gRNA sequence
  source 1..20: mol_type = other DNA
ccccctccattcaatccccg

SEQ ID NO: 89061 - DNA, 20 bp, synthetic construct
  misc_feature 1..20: note = CRISPR gRNA sequence
  source 1..20: mol_type = other DNA
cccctccattcaatccccgg

SEQ ID NO: 89062 - DNA, 20 bp, synthetic construct
  misc_feature 1..20: note = CRISPR gRNA sequence
  source 1..20: mol_type = other DNA
cattcaatccccggtttctg

SEQ ID NO: 89063 - DNA, 20 bp, synthetic construct
  misc_feature 1..20: note = CRISPR gRNA sequence
  source 1..20: mol_type = other DNA
aatccccggtttctgcaaag

SEQ ID NO: 89064 - DNA, 20 bp, synthetic construct
  misc_feature 1..20: note = CRISPR gRNA sequence
  source 1..20: mol_type = other DNA
ctgcaaagtggagcgggggt

SEQ ID NO: 89065 - DNA, 20 bp, synthetic construct
  misc_feature 1..20: note = CRISPR gRNA sequence
  source 1..20: mol_type = other DNA
tgcaaagtggagcgggggtg

SEQ ID NO: 89066 - DNA, 20 bp, synthetic construct
  misc_feature 1..20: note = CRISPR gRNA sequence
  source 1..20: mol_type = other DNA
caaagtggagcgggggtggg

SEQ ID NO: 89067 - DNA, 20 bp, synthetic construct
  misc_feature 1..20: note = CRISPR gRNA sequence
  source 1..20: mol_type = other DNA
cactttgcagaaaccgggga

SEQ ID NO: 89068 - DNA, 20 bp, synthetic construct
  misc_feature 1..20: note = CRISPR gRNA sequence
  source 1..20: mol_type = other DNA
tgcagaaaccggggattgaa

SEQ ID NO: 89069 - DNA, 20 bp, synthetic construct
  misc_feature 1..20: note = CRISPR gRNA sequence
  source 1..20: mol_type = other DNA
gcagaaaccggggattgaat

SEQ ID NO: 89070 - DNA, 20 bp, synthetic construct
  misc_feature 1..20: note = CRISPR gRNA sequence
  source 1..20: mol_type = other DNA
cagaaaccggggattgaatg

SEQ ID NO: 89071 - DNA, 20 bp, synthetic construct
  misc_feature 1..20: note = CRISPR gRNA sequence
  source 1..20: mol_type = other DNA
aatggagggggaagggaagg

SEQ ID NO: 89072 - DNA, 20 bp, synthetic construct
  misc_feature 1..20: note = CRISPR gRNA sequence
  source 1..20: mol_type = other DNA
aggatgggctgttgtgggag

SEQ ID NO: 89073 - DNA, 20 bp, synthetic construct
  misc_feature 1..20: note = CRISPR gRNA sequence
  source 1..20: mol_type = other DNA
ttgtgggagatgacgtaggg

SEQ ID NO: 89074 - DNA, 20 bp, synthetic construct
  misc_feature 1..20: note = CRISPR gRNA sequence
  source 1..20: mol_type = other DNA
tgggagatgacgtaggggcc

SEQ ID NO: 89075 - DNA, 20 bp, synthetic construct
  misc_feature 1..20: note = CRISPR gRNA sequence
  source 1..20: mol_type = other DNA
agtaatgagaacttgggccc

SEQ ID NO: 89076 - DNA, 20 bp, synthetic construct
  misc_feature 1..20: note = CRISPR gRNA sequence
  source 1..20: mol_type = other DNA
gggcccagttttttttccaa

SEQ ID NO: 89077 - DNA, 20 bp, synthetic construct
  misc_feature 1..20: note = CRISPR gRNA sequence
  source 1..20: mol_type = other DNA
ggcccagttttttttccaag

SEQ ID NO: 89078 - DNA, 20 bp, synthetic construct
  misc_feature 1..20: note = CRISPR gRNA sequence
  source 1..20: mol_type = other DNA
tttttccaagcctagaaggg

SEQ ID NO: 89079 - DNA, 20 bp, synthetic construct
  misc_feature 1..20: note = CRISPR gRNA sequence
  source 1..20: mol_type = other DNA
ttttccaagcctagaagggc

SEQ ID NO: 89080 - DNA, 20 bp, synthetic construct
  misc_feature 1..20: note = CRISPR gRNA sequence
  source 1..20: mol_type = other DNA
tttccaagcctagaagggca

SEQ ID NO: 89081 - DNA, 20 bp, synthetic construct
  misc_feature 1..20: note = CRISPR gRNA sequence
  source 1..20: mol_type = other DNA
ttccaagcctagaagggcag

SEQ ID NO: 89082 - DNA, 20 bp, synthetic construct
  misc_feature 1..20: note = CRISPR gRNA sequence
  source 1..20: mol_type = other DNA
tccaagcctagaagggcaga

SEQ ID NO: 89083 - DNA, 20 bp, synthetic construct
  misc_feature 1..20: note = CRISPR gRNA sequence
  source 1..20: mol_type = other DNA
ccaagcctagaagggcagaa

SEQ ID NO: 89084 - DNA, 20 bp, synthetic construct
  misc_feature 1..20: note = CRISPR gRNA sequence
  source 1..20: mol_type = other DNA
caagcctagaagggcagaat

SEQ ID NO: 89085 - DNA, 20 bp, synthetic construct
  misc_feature 1..20: note = CRISPR gRNA sequence
  source 1..20: mol_type = other DNA
gaagggcagaatatgttcgt

SEQ ID NO: 89086 - DNA, 20 bp, synthetic construct
  misc_feature 1..20: note = CRISPR gRNA sequence
  source 1..20: mol_type = other DNA
gtatcctttctgacctccca

SEQ ID NO: 89087 - DNA, 20 bp, synthetic construct
  misc_feature 1..20: note = CRISPR gRNA sequence
  source 1..20: mol_type = other DNA
tctgacctcccaggcatatg

SEQ ID NO: 89088 - DNA, 20 bp, synthetic construct
  misc_feature 1..20: note = CRISPR gRNA sequence
  source 1..20: mol_type = other DNA
ctgacctcccaggcatatgc

SEQ ID NO: 89089 - DNA, 20 bp, synthetic construct
  misc_feature 1..20: note = CRISPR gRNA sequence
  source 1..20: mol_type = other DNA
tgacctcccaggcatatgca

SEQ ID NO: 89090 - DNA, 20 bp, synthetic construct
  misc_feature 1..20: note = CRISPR gRNA sequence
  source 1..20: mol_type = other DNA
acctcccaggcatatgcaat

SEQ ID NO: 89091 - DNA, 20 bp, synthetic construct
  misc_feature 1..20: note = CRISPR gRNA sequence
  source 1..20: mol_type = other DNA
ccaggcatatgcaatggtga

SEQ ID NO: 89092 - DNA, 20 bp, synthetic construct
  misc_feature 1..20: note = CRISPR gRNA sequence
  source 1..20: mol_type = other DNA
ttgagaattagagaactttg

SEQ ID NO: 89093 - DNA, 20 bp, synthetic construct
  misc_feature 1..20: note = CRISPR gRNA sequence
  source 1..20: mol_type = other DNA
tgagaattagagaactttgt

SEQ ID NO: 89094 - DNA, 20 bp, synthetic construct
  misc_feature 1..20: note = CRISPR gRNA sequence
  source 1..20: mol_type = other DNA
gagaattagagaactttgtt

SEQ ID NO: 89095 - DNA, 20 bp, synthetic construct
  misc_feature 1..20: note = CRISPR gRNA sequence
  source 1..20: mol_type = other DNA
agaattagagaactttgttt

SEQ ID NO: 89096 - DNA, 20 bp, synthetic construct
  misc_feature 1..20: note = CRISPR gRNA sequence
  source 1..20: mol_type = other DNA
gagaactttgttttgtggct

SEQ ID NO: 89097 - DNA, 20 bp, synthetic construct
  misc_feature 1..20: note = CRISPR gRNA sequence
  source 1..20: mol_type = other DNA
tgttttgtggctgttattgt

SEQ ID NO: 89098 - DNA, 20 bp, synthetic construct
  misc_feature 1..20: note = CRISPR gRNA sequence
  source 1..20: mol_type = other DNA
gttttgtggctgttattgtt

SEQ ID NO: 89099 - DNA, 20 bp, synthetic construct
  misc_feature 1..20: note = CRISPR gRNA sequence
  source 1..20: mol_type = other DNA
ttttgtggctgttattgttg

SEQ ID NO: 89100 - DNA, 20 bp, synthetic construct
  misc_feature 1..20: note = CRISPR gRNA sequence
  source 1..20: mol_type = other DNA
tgtggctgttattgttgttt

SEQ ID NO: 89101 - DNA, 20 bp, synthetic construct
  misc_feature 1..20: note = CRISPR gRNA sequence
  source 1..20: mol_type = other DNA
gtggctgttattgttgtttt

SEQ ID NO: 89102 - DNA, 20 bp, synthetic construct
  misc_feature 1..20: note = CRISPR gRNA sequence
  source 1..20: mol_type = other DNA
tggctgttattgttgttttt

SEQ ID NO: 89103 - DNA, 20 bp, synthetic construct
  misc_feature 1..20: note = CRISPR gRNA sequence
  source 1..20: mol_type = other DNA
ttattgttgtttttgagggg

SEQ ID NO: 89104 - DNA, 20 bp, synthetic construct
  misc_feature 1..20: note = CRISPR gRNA sequence
  source 1..20: mol_type = other DNA
ttgttgtttttgagggggag

SEQ ID NO: 89105 - DNA, 20 bp, synthetic construct
  misc_feature 1..20: note = CRISPR gRNA sequence
  source 1..20: mol_type = other DNA
ttgtttttgagggggaggag

SEQ ID NO: 89106 - DNA, 20 bp, synthetic construct
  misc_feature 1..20: note = CRISPR gRNA sequence
  source 1..20: mol_type = other DNA
tttttgagggggaggagggc

SEQ ID NO: 89107 - DNA, 20 bp, synthetic construct
  misc_feature 1..20: note = CRISPR gRNA sequence
  source 1..20: mol_type = other DNA
ttgagggggaggagggcagt

SEQ ID NO: 89108 - DNA, 20 bp, synthetic construct
  misc_feature 1..20: note = CRISPR gRNA sequence
  source 1..20: mol_type = other DNA
tgagggggaggagggcagta

SEQ ID NO: 89109 - DNA, 20 bp, synthetic construct
  misc_feature 1..20: note = CRISPR gRNA sequence
  source 1..20: mol_type = other DNA
gagggggaggagggcagtat

SEQ ID NO: 89110 - DNA, 20 bp, synthetic construct
  misc_feature 1..20: note = CRISPR gRNA sequence
  source 1..20: mol_type = other DNA
agggggaggagggcagtatg

SEQ ID NO: 89111 - DNA, 20 bp, synthetic construct
  misc_feature 1..20: note = CRISPR gRNA sequence
  source 1..20: mol_type = other DNA
cttgctaacatggattccca

SEQ ID NO: 89112 - DNA, 20 bp, synthetic construct
  misc_feature 1..20: note = CRISPR gRNA sequence
  source 1..20: mol_type = other DNA
ttgctaacatggattcccaa

SEQ ID NO: 89113 - DNA, 20 bp, synthetic construct
  misc_feature 1..20: note = CRISPR gRNA sequence
  source 1..20: mol_type = other DNA
gctaacatggattcccaatc

SEQ ID NO: 89114 - DNA, 20 bp, synthetic construct
  misc_feature 1..20: note = CRISPR gRNA sequence
  source 1..20: mol_type = other DNA
ctaacatggattcccaatcc

SEQ ID NO: 89115 - DNA, 20 bp, synthetic construct
  misc_feature 1..20: note = CRISPR gRNA sequence
  source 1..20: mol_type = other DNA
acatggattcccaatccccc

SEQ ID NO: 89116 - DNA, 20 bp, synthetic construct
  misc_feature 1..20: note = CRISPR gRNA sequence
  source 1..20: mol_type = other DNA
ccaatccccctatctcttcc

SEQ ID NO: 89117 - DNA, 20 bp, synthetic construct
  misc_feature 1..20: note = CRISPR gRNA sequence
  source 1..20: mol_type = other DNA
tctcttcctttacagttttc

SEQ ID NO: 89118 - DNA, 20 bp, synthetic construct
  misc_feature 1..20: note = CRISPR gRNA sequence
  source 1..20: mol_type = other DNA
ttcctttacagttttccaga

SEQ ID NO: 89119 - DNA, 20 bp, synthetic construct
  misc_feature 1..20: note = CRISPR gRNA sequence
  source 1..20: mol_type = other DNA
cctttacagttttccagatt

SEQ ID NO: 89120 - DNA, 20 bp, synthetic construct
  misc_feature 1..20: note = CRISPR gRNA sequence
  source 1..20: mol_type = other DNA
ctttacagttttccagattt

SEQ ID NO: 89121 - DNA, 20 bp, synthetic construct
  misc_feature 1..20: note = CRISPR gRNA sequence
  source 1..20: mol_type = other DNA
tacagttttccagatttagg

SEQ ID NO: 89122 - DNA, 20 bp, synthetic construct
  misc_feature 1..20: note = CRISPR gRNA sequence
  source 1..20: mol_type = other DNA
acagttttccagatttagga

SEQ ID NO: 89123 - DNA, 20 bp, synthetic construct
  misc_feature 1..20: note = CRISPR gRNA sequence
  source 1..20: mol_type = other DNA
cagttttccagatttaggag

SEQ ID NO: 89124 - DNA, 20 bp, synthetic construct
  misc_feature 1..20: note = CRISPR gRNA sequence
  source 1..20: mol_type = other DNA
tccagatttaggagacttca

SEQ ID NO: 89125 - DNA, 20 bp, synthetic construct
  misc_feature 1..20: note = CRISPR gRNA sequence
  source 1..20: mol_type = other DNA
ccagatttaggagacttcag

SEQ ID NO: 89126 - DNA, 20 bp, synthetic construct
  misc_feature 1..20: note = CRISPR gRNA sequence
  source 1..20: mol_type = other DNA
cagatttaggagacttcaga

SEQ ID NO: 89127 - DNA, 20 bp, synthetic construct
  misc_feature 1..20: note = CRISPR gRNA sequence
  source 1..20: mol_type = other DNA
aggagacttcagaaaggtgg

SEQ ID NO: 89128 - DNA, 20 bp, synthetic construct
  misc_feature 1..20: note = CRISPR gRNA sequence
  source 1..20: mol_type = other DNA
ggagacttcagaaaggtggg

SEQ ID NO: 89129 - DNA, 20 bp, synthetic construct
  misc_feature 1..20: note = CRISPR gRNA sequence
  source 1..20: mol_type = other DNA
cagaaaggtggggcagatag

SEQ ID NO: 89130 - DNA, 20 bp, synthetic construct
  misc_feature 1..20: note = CRISPR gRNA sequence
  source 1..20: mol_type = other DNA
agaaaggtggggcagataga

SEQ ID NO: 89131 - DNA, 20 bp, synthetic construct
  misc_feature 1..20: note = CRISPR gRNA sequence
  source 1..20: mol_type = other DNA
tttgggcatatatgggcctg

SEQ ID NO: 89132 - DNA, 20 bp, synthetic construct
  misc_feature 1..20: note = CRISPR gRNA sequence
  source 1..20: mol_type = other DNA
tgggcatatatgggcctggc

SEQ ID NO: 89133 - DNA, 20 bp, synthetic construct
  misc_feature 1..20: note = CRISPR gRNA sequence
  source 1..20: mol_type = other DNA
gggcatatatgggcctggcg

SEQ ID NO: 89134 - DNA, 20 bp, synthetic construct
  misc_feature 1..20: note = CRISPR gRNA sequence
  source 1..20: mol_type = other DNA
ggcatatatgggcctggcga

SEQ ID NO: 89135 - DNA, 20 bp, synthetic construct
  misc_feature 1..20: note = CRISPR gRNA sequence
  source 1..20: mol_type = other DNA
gcgaagtaatggaataattt

SEQ ID NO: 89136 - DNA, 20 bp, synthetic construct
  misc_feature 1..20: note = CRISPR gRNA sequence
  source 1..20: mol_type = other DNA
ctaattttcggagaaggcaa

SEQ ID NO: 89137 - DNA, 20 bp, synthetic construct
  misc_feature 1..20: note = CRISPR gRNA sequence
  source 1..20: mol_type = other DNA
taattttcggagaaggcaag

SEQ ID NO: 89138 - DNA, 20 bp, synthetic construct
  misc_feature 1..20: note = CRISPR gRNA sequence
  source 1..20: mol_type = other DNA
attttcggagaaggcaagtg

SEQ ID NO: 89139 - DNA, 20 bp, synthetic construct
  misc_feature 1..20: note = CRISPR gRNA sequence
  source 1..20: mol_type = other DNA
tcggagaaggcaagtggtga

SEQ ID NO: 89140 - DNA, 20 bp, synthetic construct
  misc_feature 1..20: note = CRISPR gRNA sequence
  source 1..20: mol_type = other DNA
cggagaaggcaagtggtgag

SEQ ID NO: 89141 - DNA, 20 bp, synthetic construct
  misc_feature 1..20: note = CRISPR gRNA sequence
  source 1..20: mol_type = other DNA
ggagaaggcaagtggtgaga

SEQ ID NO: 89142 - DNA, 20 bp, synthetic construct
  misc_feature 1..20: note = CRISPR gRNA sequence
  source 1..20: mol_type = other DNA
ggaggctttgtttctgtttc

SEQ ID NO: 89143 - DNA, 20 bp, synthetic construct
  misc_feature 1..20: note = CRISPR gRNA sequence
  source 1..20: mol_type = other DNA
tgtttctgtttctctgcctt

SEQ ID NO: 89144 - DNA, 20 bp, synthetic construct
  misc_feature 1..20: note = CRISPR gRNA sequence
  source 1..20: mol_type = other DNA
gtttctgtttctctgccttt

SEQ ID NO: 89145 - DNA, 20 bp, synthetic construct
  misc_feature 1..20: note = CRISPR gRNA sequence
  source 1..20: mol_type = other DNA
tttctgtttctctgcctttc

SEQ ID NO: 89146 - DNA, 20 bp, synthetic construct
  misc_feature 1..20: note = CRISPR gRNA sequence
  source 1..20: mol_type = other DNA
ctgtttctctgcctttctgg

SEQ ID NO: 89147 - DNA, 20 bp, synthetic construct
  misc_feature 1..20: note = CRISPR gRNA sequence
  source 1..20: mol_type = other DNA
tgtttctctgcctttctggg

SEQ ID NO: 89148 - DNA, 20 bp, synthetic construct
  misc_feature 1..20: note = CRISPR gRNA sequence
  source 1..20: mol_type = other DNA
tttctctgcctttctgggta

SEQ ID NO: 89149 - DNA, 20 bp, synthetic construct
  misc_feature 1..20: note = CRISPR gRNA sequence
  source 1..20: mol_type = other DNA
ctctgcctttctgggtaaag

SEQ ID NO: 89150 - DNA, 20 bp, synthetic construct
  misc_feature 1..20: note = CRISPR gRNA sequence
  source 1..20: mol_type = other DNA
tctgcctttctgggtaaaga

SEQ ID NO: 89151 - DNA, 20 bp, synthetic construct
  misc_feature 1..20: note = CRISPR gRNA sequence
  source 1..20: mol_type = other DNA
tgcctttctgggtaaagaga

SEQ ID NO: 89152 - DNA, 20 bp, synthetic construct
  misc_feature 1..20: note = CRISPR gRNA sequence
  source 1..20: mol_type = other DNA
cctttctgggtaaagagatg

SEQ ID NO: 89153 - DNA, 20 bp, synthetic construct
  misc_feature 1..20: note = CRISPR gRNA sequence
  source 1..20: mol_type = other DNA
tctgggtaaagagatgagga

SEQ ID NO: 89154 - DNA, 20 bp, synthetic construct
  misc_feature 1..20: note = CRISPR gRNA sequence
  source 1..20: mol_type = other DNA
ctgggtaaagagatgaggag

SEQ ID NO: 89155 - DNA, 20 bp, synthetic construct
  misc_feature 1..20: note = CRISPR gRNA sequence
  source 1..20: mol_type = other DNA
tgggtaaagagatgaggagt

SEQ ID NO: 89156 - DNA, 20 bp, synthetic construct
  misc_feature 1..20: note = CRISPR gRNA sequence
  source 1..20: mol_type = other DNA
ggtaaagagatgaggagtgc

SEQ ID NO: 89157 - DNA, 20 bp, synthetic construct
  misc_feature 1..20: note = CRISPR gRNA sequence
  source 1..20: mol_type = other DNA
gggccttctggggaagggaa

SEQ ID NO: 89158 - DNA, 20 bp, synthetic construct
  misc_feature 1..20: note = CRISPR gRNA sequence
  source 1..20: mol_type = other DNA
ctggggaagggaaggccagt

SEQ ID NO: 89159 - DNA, 20 bp, synthetic construct
  misc_feature 1..20: note = CRISPR gRNA sequence
  source 1..20: mol_type = other DNA
tggggaagggaaggccagtg

SEQ ID NO: 89160 - DNA, 20 bp, synthetic construct
  misc_feature 1..20: note = CRISPR gRNA sequence
  source 1..20: mol_type = other DNA
gggaagggaaggccagtgtg

SEQ ID NO: 89161 - DNA, 20 bp, synthetic construct
  misc_feature 1..20: note = CRISPR gRNA sequence
  source 1..20: mol_type = other DNA
catctttatgcctgtccctc

SEQ ID NO: 89162 - DNA, 20 bp, synthetic construct
  misc_feature 1..20: note = CRISPR gRNA sequence
  source 1..20: mol_type = other DNA
tatgcctgtccctctcaatt

SEQ ID NO: 89163 - DNA, 20 bp, synthetic construct
  misc_feature 1..20: note = CRISPR gRNA sequence
  source 1..20: mol_type = other DNA
atgcctgtccctctcaattc

SEQ ID NO: 89164 - DNA, 20 bp, synthetic construct
  misc_feature 1..20: note = CRISPR gRNA sequence
  source 1..20: mol_type = other DNA
tgcctgtccctctcaattct

SEQ ID NO: 89165 - DNA, 20 bp, synthetic construct
  misc_feature 1..20: note = CRISPR gRNA sequence
  source 1..20: mol_type = other DNA
tccctctcaattctagccct

SEQ ID NO: 89166 - DNA, 20 bp, synthetic construct
  misc_feature 1..20: note = CRISPR gRNA sequence
  source 1..20: mol_type = other DNA
tcaattctagccctcatgcc

SEQ ID NO: 89167 - DNA, 20 bp, synthetic construct
  misc_feature 1..20: note = CRISPR gRNA sequence
  source 1..20: mol_type = other DNA
aattctagccctcatgccgg

SEQ ID NO: 89168 - DNA, 20 bp, synthetic construct
  misc_feature 1..20: note = CRISPR gRNA sequence
  source 1..20: mol_type = other DNA
tagccctcatgccgggatgg

SEQ ID NO: 89169 - DNA, 20 bp, synthetic construct
  misc_feature 1..20: note = CRISPR gRNA sequence
  source 1..20: mol_type = other DNA
gccctcatgccgggatggca

SEQ ID NO: 89170 - DNA, 20 bp, synthetic construct
  misc_feature 1..20: note = CRISPR gRNA sequence
  source 1..20: mol_type = other DNA
atgccgggatggcagaagat

SEQ ID NO: 89171 - DNA, 20 bp, synthetic construct
  misc_feature 1..20: note = CRISPR gRNA sequence
  source 1..20: mol_type = other DNA
atgctaagagccccaagact

SEQ ID NO: 89172 - DNA, 20 bp, synthetic construct
  misc_feature 1..20: note = CRISPR gRNA sequence
  source 1..20: mol_type = other DNA
agagccccaagactggggga

SEQ ID NO: 89173 - DNA, 20 bp, synthetic construct
  misc_feature 1..20: note = CRISPR gRNA sequence
  source 1..20: mol_type = other DNA
ggggaagggcccccccaggt

SEQ ID NO: 89174 - DNA, 20 bp, synthetic construct
  misc_feature 1..20: note = CRISPR gRNA sequence
  source 1..20: mol_type = other DNA
aggctggggaacctaccacc

SEQ ID NO: 89175 - DNA, 20 bp, synthetic construct
  misc_feature 1..20: note = CRISPR gRNA sequence
  source 1..20: mol_type = other DNA
gggaacctaccacccttctt

SEQ ID NO: 89176 - DNA, 20 bp, synthetic construct
  misc_feature 1..20: note = CRISPR gRNA sequence
  source 1..20: mol_type = other DNA
ccacccttcttcagaggctc

SEQ ID NO: 89177 - DNA, 20 bp, synthetic construct
  misc_feature 1..20: note = CRISPR gRNA sequence
  source 1..20: mol_type = other DNA
cttcagaggctccgaggtac

SEQ ID NO: 89178 - DNA, 20 bp, synthetic construct
  misc_feature 1..20: note = CRISPR gRNA sequence
  source 1..20: mol_type = other DNA
ttcagaggctccgaggtacc

SEQ ID NO: 89179 - DNA, 20 bp, synthetic construct
  misc_feature 1..20: note = CRISPR gRNA sequence
  source 1..20: mol_type = other DNA
cagaggctccgaggtaccat

SEQ ID NO: 89180 - DNA, 20 bp, synthetic construct
  misc_feature 1..20: note = CRISPR gRNA sequence
  source 1..20: mol_type = other DNA
agaggctccgaggtaccatt

SEQ ID NO: 89181 - DNA, 20 bp, synthetic construct
  misc_feature 1..20: note = CRISPR gRNA sequence
  source 1..20: mol_type = other DNA
cgaggtaccatttcgtaagt

SEQ ID NO: 89182 - DNA, 20 bp, synthetic construct
  misc_feature 1..20: note = CRISPR gRNA sequence
  source 1..20: mol_type = other DNA
cgtaagtactcatcacatct

SEQ ID NO: 89183 - DNA, 20 bp, synthetic construct
  misc_feature 1..20: note = CRISPR gRNA sequence
  source 1..20: mol_type = other DNA
gtaagtactcatcacatctc

SEQ ID NO: 89184 - DNA, 20 bp, synthetic construct
  misc_feature 1..20: note = CRISPR gRNA sequence
  source 1..20: mol_type = other DNA
atcacatctccaagtcctgt

SEQ ID NO: 89185 - DNA, 20 bp, synthetic construct
  misc_feature 1..20: note = CRISPR gRNA sequence
  source 1..20: mol_type = other DNA
caagtcctgtccaagacctg

SEQ ID NO: 89186 - DNA, 20 bp, synthetic construct
  misc_feature 1..20: note = CRISPR gRNA sequence
  source 1..20: mol_type = other DNA
tccaagacctgagtatagat

SEQ ID NO: 89187 - DNA, 20 bp, synthetic construct
  misc_feature 1..20: note = CRISPR gRNA sequence
  source 1..20: mol_type = other DNA
agtatagatccctgcagcac

SEQ ID NO: 89188 - DNA, 20 bp, synthetic construct
  misc_feature 1..20: note = CRISPR gRNA sequence
  source 1..20: mol_type = other DNA
cagcacttcactttggctgt

SEQ ID NO: 89189 - DNA, 20 bp, synthetic construct
  misc_feature 1..20: note = CRISPR gRNA sequence
  source 1..20: mol_type = other DNA
cactttggctgtagatgaac

SEQ ID NO: 89190 - DNA, 20 bp, synthetic construct
  misc_feature 1..20: note = CRISPR gRNA sequence
  source 1..20: mol_type = other DNA
actttggctgtagatgaact

SEQ ID NO: 89191 - DNA, 20 bp, synthetic construct
  misc_feature 1..20: note = CRISPR gRNA sequence
  source 1..20: mol_type = other DNA
tggctgtagatgaactgcct

SEQ ID NO: 89192 - DNA, 20 bp, synthetic construct
  misc_feature 1..20: note = CRISPR gRNA sequence
  source 1..20: mol_type = other DNA
ggctgtagatgaactgcctc

SEQ ID NO: 89193 - DNA, 20 bp, synthetic construct
  misc_feature 1..20: note = CRISPR gRNA sequence
  source 1..20: mol_type = other DNA
gctgtagatgaactgcctct

SEQ ID NO: 89194 - DNA, 20 bp, synthetic construct
  misc_feature 1..20: note = CRISPR gRNA sequence
  source 1..20: mol_type = other DNA
tagatgaactgcctctcagc

SEQ ID NO: 89195 - DNA, 20 bp, synthetic construct
  misc_feature 1..20: note = CRISPR gRNA sequence
  source 1..20: mol_type = other DNA
cctctcagcaagggcatggg

SEQ ID NO: 89196 - DNA, 20 bp, synthetic construct
  misc_feature 1..20: note = CRISPR gRNA sequence
  source 1..20: mol_type = other DNA
tcagcaagggcatgggagca

SEQ ID NO: 89197 - DNA, 20 bp, synthetic construct
  misc_feature 1..20: note = CRISPR gRNA sequence
  source 1..20: mol_type = other DNA
agcaagggcatgggagcaga

SEQ ID NO: 89198 - DNA, 20 bp, synthetic construct
  misc_feature 1..20: note = CRISPR gRNA sequence
  source 1..20: mol_type = other DNA
ttggccatggtagcaattct

SEQ ID NO: 89199 - DNA, 20 bp, synthetic construct
  misc_feature 1..20: note = CRISPR gRNA sequence
  source 1..20: mol_type = other DNA
tggccatggtagcaattctt

SEQ ID NO: 89200 - DNA, 20 bp, synthetic construct
  misc_feature 1..20: note = CRISPR gRNA sequence
  source 1..20: mol_type = other DNA
ggccatggtagcaattcttg

SEQ ID NO: 89201 - DNA, 20 bp, synthetic construct
  misc_feature 1..20: note = CRISPR gRNA sequence
  source 1..20: mol_type = other DNA
gccatggtagcaattcttga

SEQ ID NO: 89202 - DNA, 20 bp, synthetic construct
  misc_feature 1..20: note = CRISPR gRNA sequence
  source 1..20: mol_type = other DNA
ttgagcacctgctgggcatt

SEQ ID NO: 89203 - DNA, 20 bp, synthetic construct
  misc_feature 1..20: note = CRISPR gRNA sequence
  source 1..20: mol_type = other DNA
gagcacctgctgggcatttc

SEQ ID NO: 89204 - DNA, 20 bp, synthetic construct
  misc_feature 1..20: note = CRISPR gRNA sequence
  source 1..20: mol_type = other DNA
agcacctgctgggcatttca

SEQ ID NO: 89205 - DNA, 20 bp, synthetic construct
  misc_feature 1..20: note = CRISPR gRNA sequence
  source 1..20: mol_type = other DNA
ctgggcatttcagtcctttt

SEQ ID NO: 89206 - DNA, 20 bp, synthetic construct
  misc_feature 1..20: note = CRISPR gRNA sequence
  source 1..20: mol_type = other DNA
ggcatttcagtccttttccc

SEQ ID NO: 89207 - DNA, 20 bp, synthetic construct
  misc_feature 1..20: note = CRISPR gRNA sequence
  source 1..20: mol_type = other DNA
cagtccttttccctccctag

SEQ ID NO: 89208 - DNA, 20 bp, synthetic construct
  misc_feature 1..20: note = CRISPR gRNA sequence
  source 1..20: mol_type = other DNA
agtccttttccctccctagc

SEQ ID NO: 89209 - DNA, 20 bp, synthetic construct
  misc_feature 1..20: note = CRISPR gRNA sequence
  source 1..20: mol_type = other DNA
ttccctccctagcagtcaga

SEQ ID NO: 89210 - DNA, 20 bp, synthetic construct
  misc_feature 1..20: note = CRISPR gRNA sequence
  source 1..20: mol_type = other DNA
tccctccctagcagtcagat

SEQ ID NO: 89211 - DNA, 20 bp, synthetic construct
  misc_feature 1..20: note = CRISPR gRNA sequence
  source 1..20: mol_type = other DNA
ccctccctagcagtcagata

SEQ ID NO: 89212 - DNA, 20 bp, synthetic construct
  misc_feature 1..20: note = CRISPR gRNA sequence
  source 1..20: mol_type = other DNA
cctccctagcagtcagataa

SEQ ID NO: 89213 - DNA, 20 bp, synthetic construct
  misc_feature 1..20: note = CRISPR gRNA sequence
  source 1..20: mol_type = other DNA
cctagcagtcagataaagag

SEQ ID NO: 89214 - DNA, 20 bp, synthetic construct
  misc_feature 1..20: note = CRISPR gRNA sequence
  source 1..20: mol_type = other DNA
gcagtcagataaagagacag

SEQ ID NO: 89215 - DNA, 20 bp, synthetic construct
  misc_feature 1..20: note = CRISPR gRNA sequence
  source 1..20: mol_type = other DNA
gtgtgtgacctccagctttc

SEQ ID NO: 89216 - DNA, 20 bp, synthetic construct
  misc_feature 1..20: note = CRISPR gRNA sequence
  source 1..20: mol_type = other DNA
tgtgtgacctccagctttct

SEQ ID NO: 89217 - DNA, 20 bp, synthetic construct
  misc_feature 1..20: note = CRISPR gRNA sequence
  source 1..20: mol_type = other DNA
cagctttctcctcttcccca

SEQ ID NO: 89218 - DNA, 20 bp, synthetic construct
  misc_feature 1..20: note = CRISPR gRNA sequence
  source 1..20: mol_type = other DNA
tctcctcttccccacagcaa

SEQ ID NO: 89219 - DNA, 20 bp, synthetic construct
  misc_feature 1..20: note = CRISPR gRNA sequence
  source 1..20: mol_type = other DNA
ctcctcttccccacagcaag

SEQ ID NO: 89220 - DNA, 20 bp, synthetic construct
  misc_feature 1..20: note = CRISPR gRNA sequence
  source 1..20: mol_type = other DNA
tcctcttccccacagcaagg

SEQ ID NO: 89221 - DNA, 20 bp, synthetic construct
  misc_feature 1..20: note = CRISPR gRNA sequence
  source 1..20: mol_type = other DNA
ctcttccccacagcaaggcc

SEQ ID NO: 89222 - DNA, 20 bp, synthetic construct
  misc_feature 1..20: note = CRISPR gRNA sequence
  source 1..20: mol_type = other DNA
ttccccacagcaaggccgtg

SEQ ID NO: 89223 - DNA, 20 bp, synthetic construct
  misc_feature 1..20: note = CRISPR gRNA sequence
  source 1..20: mol_type = other DNA
ccccacagcaaggccgtgca

SEQ ID NO: 89224 - DNA, 20 bp, synthetic construct
  misc_feature 1..20: note = CRISPR gRNA sequence
  source 1..20: mol_type = other DNA
cccacagcaaggccgtgcag

SEQ ID NO: 89225 - DNA, 20 bp, synthetic construct
  misc_feature 1..20: note = CRISPR gRNA sequence
  source 1..20: mol_type = other DNA
gtaagtgtgttggggaagag

SEQ ID NO: 89226 - DNA, 20 bp, synthetic construct
  misc_feature 1..20: note = CRISPR gRNA sequence
  source 1..20: mol_type = other DNA
gggaagagggcaagagaggg

SEQ ID NO: 89227 - DNA, 20 bp, synthetic construct
  misc_feature 1..20: note = CRISPR gRNA sequence
  source 1..20: mol_type = other DNA
agggaggaggatgtgaggat

SEQ ID NO: 89228 - DNA, 20 bp, synthetic construct
  misc_feature 1..20: note = CRISPR gRNA sequence
  source 1..20: mol_type = other DNA
atgtgggagaggtagggtcc

SEQ ID NO: 89229 - DNA, 20 bp, synthetic construct
  misc_feature 1..20: note = CRISPR gRNA sequence
  source 1..20: mol_type = other DNA
tgccttgtcagaagatagtt

SEQ ID NO: 89230 - DNA, 20 bp, synthetic construct
  misc_feature 1..20: note = CRISPR gRNA sequence
  source 1..20: mol_type = other DNA
ccttgtcagaagatagttgg

SEQ ID NO: 89231 - DNA, 20 bp, synthetic construct
  misc_feature 1..20: note = CRISPR gRNA sequence
  source 1..20: mol_type = other DNA
gtcagaagatagttggcttt

SEQ ID NO: 89232 - DNA, 20 bp, synthetic construct
  misc_feature 1..20: note = CRISPR gRNA sequence
  source 1..20: mol_type = other DNA
tcagaagatagttggctttg

SEQ ID NO: 89233 - DNA, 20 bp, synthetic construct
  misc_feature 1..20: note = CRISPR gRNA sequence
  source 1..20: mol_type = other DNA
gctttgcaaacttgctgcca

SEQ ID NO: 89234 - DNA, 20 bp, synthetic construct
  misc_feature 1..20: note = CRISPR gRNA sequence
  source 1..20: mol_type = other DNA
tgcaaacttgctgccagttt

SEQ ID NO: 89235 - DNA, 20 bp, synthetic construct
  misc_feature 1..20: note = CRISPR gRNA sequence
  source 1..20: mol_type = other DNA
gcaaacttgctgccagtttg

SEQ ID NO: 89236 - DNA, 20 bp, synthetic construct
  misc_feature 1..20: note = CRISPR gRNA sequence
  source 1..20: mol_type = other DNA
caaacttgctgccagtttga

SEQ ID NO: 89237 - DNA, 20 bp, synthetic construct
  misc_feature 1..20: note = CRISPR gRNA sequence
  source 1..20: mol_type = other DNA
gctgccagtttgactttgtg

SEQ ID NO: 89238 - DNA, 20 bp, synthetic construct
  misc_feature 1..20: note = CRISPR gRNA sequence
  source 1..20: mol_type = other DNA
ctgccagtttgactttgtgc

SEQ ID NO: 89239 - DNA, 20 bp, synthetic construct
  misc_feature 1..20: note = CRISPR gRNA sequence
  source 1..20: mol_type = other DNA
ccagtttgactttgtgcctc

SEQ ID NO: 89240 - DNA, 20 bp, synthetic construct
  misc_feature 1..20: note = CRISPR gRNA sequence
  source 1..20: mol_type = other DNA
gactttgtgcctctcacttg

SEQ ID NO: 89241 - DNA, 20 bp, synthetic construct
  misc_feature 1..20: note = CRISPR gRNA sequence
  source 1..20: mol_type = other DNA
actttgtgcctctcacttga

SEQ ID NO: 89242 - DNA, 20 bp, synthetic construct
  misc_feature 1..20: note = CRISPR gRNA sequence
  source 1..20: mol_type = other DNA
tgtgcctctcacttgatctc

SEQ ID NO: 89243 - DNA, 20 bp, synthetic construct
  misc_feature 1..20: note = CRISPR gRNA sequence
  source 1..20: mol_type = other DNA
gtgcctctcacttgatctct

SEQ ID NO: 89244 - DNA, 20 bp, synthetic construct
  misc_feature 1..20: note = CRISPR gRNA sequence
  source 1..20: mol_type = other DNA
tgcctctcacttgatctctg

SEQ ID NO: 89245 - DNA, 20 bp, synthetic construct
  misc_feature 1..20: note = CRISPR gRNA sequence
  source 1..20: mol_type = other DNA
tcacttgatctctgtgagca

SEQ ID NO: 89246 - DNA, 20 bp, synthetic construct
  misc_feature 1..20: note = CRISPR gRNA sequence
  source 1..20: mol_type = other DNA
acttgatctctgtgagcact

SEQ ID NO: 89247 - DNA, 20 bp, synthetic construct
  misc_feature 1..20: note = CRISPR gRNA sequence
  source 1..20: mol_type = other DNA
gatctctgtgagcacttgca

SEQ ID NO: 89248 - DNA, 20 bp, synthetic construct
  misc_feature 1..20: note = CRISPR gRNA sequence
  source 1..20: mol_type = other DNA
atctctgtgagcacttgcat

SEQ ID NO: 89249 - DNA, 20 bp, synthetic construct
  misc_feature 1..20: note = CRISPR gRNA sequence
  source 1..20: mol_type = other DNA
tgtgagcacttgcatagaag

SEQ ID NO: 89250 - DNA, 20 bp, synthetic construct
  misc_feature 1..20: note = CRISPR gRNA sequence
  source 1..20: mol_type = other DNA
tgagcacttgcatagaagcc

SEQ ID NO: 89251 - DNA, 20 bp, synthetic construct
  misc_feature 1..20: note = CRISPR gRNA sequence
  source 1..20: mol_type = other DNA
gcatagaagcccagcagaga

SEQ ID NO: 89252 - DNA, 20 bp, synthetic construct
  misc_feature 1..20: note = CRISPR gRNA sequence
  source 1..20: mol_type = other DNA
catagaagcccagcagagat

SEQ ID NO: 89253 - DNA, 20 bp, synthetic construct
  misc_feature 1..20: note = CRISPR gRNA sequence
  source 1..20: mol_type = other DNA
atcccctctacttccctcct

SEQ ID NO: 89254 - DNA, 20 bp, synthetic construct
  misc_feature 1..20: note = CRISPR gRNA sequence
  source 1..20: mol_type = other DNA
tacttccctcctctccatgg

SEQ ID NO: 89255 - DNA, 20 bp, synthetic construct
  misc_feature 1..20: note = CRISPR gRNA sequence
  source 1..20: mol_type = other DNA
cttccctcctctccatggta

SEQ ID NO: 89256 - DNA, 20 bp, synthetic construct
  misc_feature 1..20: note = CRISPR gRNA sequence
  source 1..20: mol_type = other DNA
ccctcctctccatggtagcc

SEQ ID NO: 89257 - DNA, 20 bp, synthetic construct
  misc_feature 1..20: note = CRISPR gRNA sequence
  source 1..20: mol_type = other DNA
cctcctctccatggtagcct

SEQ ID NO: 89258 - DNA, 20 bp, synthetic construct
  misc_feature 1..20: note = CRISPR gRNA sequence
  source 1..20: mol_type = other DNA
ctctccatggtagcctatag

SEQ ID NO: 89259 - DNA, 20 bp, synthetic construct
  misc_feature 1..20: note = CRISPR gRNA sequence
  source 1..20: mol_type = other DNA
tccatggtagcctatagggc

SEQ ID NO: 89260 - DNA, 20 bp, synthetic construct
  misc_feature 1..20: note = CRISPR gRNA sequence
  source 1..20: mol_type = other DNA
catggtagcctatagggctc

SEQ ID NO: 89261 - DNA, 20 bp, synthetic construct
  misc_feature 1..20: note = CRISPR gRNA sequence
  source 1..20: mol_type = other DNA
tagggctcctcagagcacct

SEQ ID NO: 89262 - DNA, 20 bp, synthetic construct
  misc_feature 1..20: note = CRISPR gRNA sequence
  source 1..20: mol_type = other DNA
ctcagagcacctagcatcaa

SEQ ID NO: 89263 - DNA, 20 bp, synthetic construct
  misc_feature 1..20: note = CRISPR gRNA sequence
  source 1..20: mol_type = other DNA
agagcacctagcatcaaata

SEQ ID NO: 89264 - DNA, 20 bp, synthetic construct
  misc_feature 1..20: note = CRISPR gRNA sequence
  source 1..20: mol_type = other DNA
gcatcaaataatttctttct

SEQ ID NO: 89265 - DNA, 20 bp, synthetic construct
  misc_feature 1..20: note = CRISPR gRNA sequence
  source 1..20: mol_type = other DNA
ctttcttttttttttttttt

SEQ ID NO: 89266 - DNA, 20 bp, synthetic construct
  misc_feature 1..20: note = CRISPR gRNA sequence
  source 1..20: mol_type = other DNA
tttctttttttttttttttt

SEQ ID NO: 89267 - DNA, 20 bp, synthetic construct
  misc_feature 1..20: note = CRISPR gRNA sequence
  source 1..20: mol_type = other DNA
tctttttttttttttttttt

SEQ ID NO: 89268 - DNA, 20 bp, synthetic construct
  misc_feature 1..20: note = CRISPR gRNA sequence
  source 1..20: mol_type = other DNA
cttttttttttttttttttg

SEQ ID NO: 89269 - DNA, 20 bp, synthetic construct
  misc_feature 1..20: note = CRISPR gRNA sequence
  source 1..20: mol_type = other DNA
ttttttttttttttttttga

SEQ ID NO: 89270 - DNA, 20 bp, synthetic construct
  misc_feature 1..20: note = CRISPR gRNA sequence
  source 1..20: mol_type = other DNA
ttttttttttttttttgaga

SEQ ID NO: 89271 - DNA, 20 bp, synthetic construct
  misc_feature 1..20: note = CRISPR gRNA sequence
  source 1..20: mol_type = other DNA
tttttttttttttttgagat

SEQ ID NO: 89272 - DNA, 20 bp, synthetic construct
  misc_feature 1..20: note = CRISPR gRNA sequence
  source 1..20: mol_type = other DNA
ttttttttttttttgagatg

SEQ ID NO: 89273 - DNA, 20 bp, synthetic construct
  misc_feature 1..20: note = CRISPR gRNA sequence
  source 1..20: mol_type = other DNA
tttttttttttttgagatgg

SEQ ID NO: 89274 - DNA, 20 bp, synthetic construct
  misc_feature 1..20: note = CRISPR gRNA sequence
  source 1..20: mol_type = other DNA
ttttttttttttgagatgga

SEQ ID NO: 89275 - DNA, 20 bp, synthetic construct
  misc_feature 1..20: note = CRISPR gRNA sequence
  source 1..20: mol_type = other DNA
tttttttttttgagatggag

SEQ ID NO: 89276 - DNA, 20 bp, synthetic construct
  misc_feature 1..20: note = CRISPR gRNA sequence
  source 1..20: mol_type = other DNA
ttttttttttgagatggagt

SEQ ID NO: 89277 - DNA, 20 bp, synthetic construct
  misc_feature 1..20: note = CRISPR gRNA sequence
  source 1..20: mol_type = other DNA
tttttttttgagatggagtc

SEQ ID NO: 89278 - DNA, 20 bp, synthetic construct
  misc_feature 1..20: note = CRISPR gRNA sequence
  source 1..20: mol_type = other DNA
ttttttttgagatggagtct

SEQ ID NO: 89279 - DNA, 20 bp, synthetic construct
  misc_feature 1..20: note = CRISPR gRNA sequence
  source 1..20: mol_type = other DNA
tttttttgagatggagtctc

SEQ ID NO: 89280 - DNA, 20 bp, synthetic construct
  misc_feature 1..20: note = CRISPR gRNA sequence
  source 1..20: mol_type = other DNA
ttttttgagatggagtctca

SEQ ID NO: 89281 - DNA, 20 bp, synthetic construct
  misc_feature 1..20: note = CRISPR gRNA sequence
  source 1..20: mol_type = other DNA
tttttgagatggagtctcac

SEQ ID NO: 89282 - DNA, 20 bp, synthetic construct
  misc_feature 1..20: note = CRISPR gRNA sequence
  source 1..20: mol_type = other DNA
ttttgagatggagtctcact

SEQ ID NO: 89283 - DNA, 20 bp, synthetic construct
  misc_feature 1..20: note = CRISPR gRNA sequence
  source 1..20: mol_type = other DNA
tttgagatggagtctcactc

SEQ ID NO: 89284 - DNA, 20 bp, synthetic construct
  misc_feature 1..20: note = CRISPR gRNA sequence
  source 1..20: mol_type = other DNA
ttgagatggagtctcactct

SEQ ID NO: 89285 - DNA, 20 bp, synthetic construct
  misc_feature 1..20: note = CRISPR gRNA sequence
  source 1..20: mol_type = other DNA
tgagatggagtctcactctg

SEQ ID NO: 89286 - DNA, 20 bp, synthetic construct
  misc_feature 1..20: note = CRISPR gRNA sequence
  source 1..20: mol_type = other DNA
gagatggagtctcactctgt

SEQ ID NO: 89287 - DNA, 20 bp, synthetic construct
  misc_feature 1..20: note = CRISPR gRNA sequence
  source 1..20: mol_type = other DNA
agatggagtctcactctgtc

SEQ ID NO: 89288 - DNA, 20 bp, synthetic construct
  misc_feature 1..20: note = CRISPR gRNA sequence
  source 1..20: mol_type = other DNA
actctgtcgcctaggctgga

SEQ ID NO: 89289 - DNA, 20 bp, synthetic construct
  misc_feature 1..20: note = CRISPR gRNA sequence
  source 1..20: mol_type = other DNA
tgtcgcctaggctggagtgc

SEQ ID NO: 89290 - DNA, 20 bp, synthetic construct
  misc_feature 1..20: note = CRISPR gRNA sequence
  source 1..20: mol_type = other DNA
tcgcctaggctggagtgcag

SEQ ID NO: 89291 - DNA, 20 bp, synthetic construct
  misc_feature 1..20: note = CRISPR gRNA sequence
  source 1..20: mol_type = other DNA
ggctggagtgcagtggcgca

SEQ ID NO: 89292 - DNA, 20 bp, synthetic construct
  misc_feature 1..20: note = CRISPR gRNA sequence
  source 1..20: mol_type = other DNA
gagtgcagtggcgcaatctc

SEQ ID NO: 89293 - DNA, 20 bp, synthetic construct
  misc_feature 1..20: note = CRISPR gRNA sequence
  source 1..20: mol_type = other DNA
ggctcactgcaagctccgcc

SEQ ID NO: 89294 - DNA, 20 bp, synthetic construct
  misc_feature 1..20: note = CRISPR gRNA sequence
  source 1..20: mol_type = other DNA
actgcaagctccgcctccca

SEQ ID NO: 89295 - DNA, 20 bp, synthetic construct
  misc_feature 1..20: note = CRISPR gRNA sequence
  source 1..20: mol_type = other DNA
caagctccgcctcccaggtt

SEQ ID NO: 89296 - DNA, 20 bp, synthetic construct
  misc_feature 1..20: note = CRISPR gRNA sequence
  source 1..20: mol_type = other DNA
cgcctcccaggttcacgcca

SEQ ID NO: 89297 - DNA, 20 bp, synthetic construct
  misc_feature 1..20: note = CRISPR gRNA sequence
  source 1..20: mol_type = other DNA
ccaggttcacgccattctcc

SEQ ID NO: 89298 - DNA, 20 bp, synthetic construct
  misc_feature 1..20: note = CRISPR gRNA sequence
  source 1..20: mol_type = other DNA
acgccattctcctgcctcag

SEQ ID NO: 89299 - DNA, 20 bp, synthetic construct
  misc_feature 1..20: note = CRISPR gRNA sequence
  source 1..20: mol_type = other DNA
tcctgcctcagcctcccaag

SEQ ID NO: 89300 - DNA, 20 bp, synthetic construct
  misc_feature 1..20: note = CRISPR gRNA sequence
  source 1..20: mol_type = other DNA
ctgcctcagcctcccaagta

SEQ ID NO: 89301 - DNA, 20 bp, synthetic construct
  misc_feature 1..20: note = CRISPR gRNA sequence
  source 1..20: mol_type = other DNA
cctcagcctcccaagtagct

SEQ ID NO: 89302 - DNA, 20 bp, synthetic construct
  misc_feature 1..20: note = CRISPR gRNA sequence
  source 1..20: mol_type = other DNA
agcctcccaagtagctggga

SEQ ID NO: 89303 - DNA, 20 bp, synthetic construct
  misc_feature 1..20: note = CRISPR gRNA sequence
  source 1..20: mol_type = other DNA
ccaagtagctgggactacag

SEQ ID NO: 89304 - DNA, 20 bp, synthetic construct
  misc_feature 1..20: note = CRISPR gRNA sequence
  source 1..20: mol_type = other DNA
ggactacaggcgcccgtcac

SEQ ID NO: 89305 - DNA, 20 bp, synthetic construct
  misc_feature 1..20: note = CRISPR gRNA sequence
  source 1..20: mol_type = other DNA
caggcgcccgtcaccacacc

SEQ ID NO: 89306 - DNA, 20 bp, synthetic construct
  misc_feature 1..20: note = CRISPR gRNA sequence
  source 1..20: mol_type = other DNA
atttttttttgtatttttag

SEQ ID NO: 89307 - DNA, 20 bp, synthetic construct
  misc_feature 1..20: note = CRISPR gRNA sequence
  source 1..20: mol_type = other DNA
ttttttgtatttttagtaga

SEQ ID NO: 89308 - DNA, 20 bp, synthetic construct
  misc_feature 1..20: note = CRISPR gRNA sequence
  source 1..20: mol_type = other DNA
tttttgtatttttagtagaa

SEQ ID NO: 89309 - DNA, 20 bp, synthetic construct
  misc_feature 1..20: note = CRISPR gRNA sequence
  source 1..20: mol_type = other DNA
ttttgtatttttagtagaaa

SEQ ID NO: 89310 - DNA, 20 bp, synthetic construct
  misc_feature 1..20: note = CRISPR gRNA sequence
  source 1..20: mol_type = other DNA
tttgtatttttagtagaaac

SEQ ID NO: 89311 - DNA, 20 bp, synthetic construct
  misc_feature 1..20: note = CRISPR gRNA sequence
  source 1..20: mol_type = other DNA
ttgtatttttagtagaaacg

SEQ ID NO: 89312 - DNA, 20 bp, synthetic construct
  misc_feature 1..20: note = CRISPR gRNA sequence
  source 1..20: mol_type = other DNA
tgtatttttagtagaaacgg

SEQ ID NO: 89313 - DNA, 20 bp, synthetic construct
  misc_feature 1..20: note = CRISPR gRNA sequence
  source 1..20: mol_type = other DNA
gtatttttagtagaaacggg

SEQ ID NO: 89314 - DNA, 20 bp, synthetic construct
  misc_feature 1..20: note = CRISPR gRNA sequence
  source 1..20: mol_type = other DNA
tatttttagtagaaacgggg

SEQ ID NO: 89315 - DNA, 20 bp, synthetic construct
  misc_feature 1..20: note = CRISPR gRNA sequence
  source 1..20: mol_type = other DNA
ttagtagaaacggggtttca

SEQ ID NO: 89316 - DNA, 20 bp, synthetic construct
  misc_feature 1..20: note = CRISPR gRNA sequence
  source 1..20: mol_type = other DNA
tagtagaaacggggtttcac

SEQ ID NO: 89317 - DNA, 20 bp, synthetic construct
  misc_feature 1..20: note = CRISPR gRNA sequence
  source 1..20: mol_type = other DNA
agtagaaacggggtttcacc

SEQ ID NO: 89318 - DNA, 20 bp, synthetic construct
  misc_feature 1..20: note = CRISPR gRNA sequence
  source 1..20: mol_type = other DNA
gtagaaacggggtttcacca

SEQ ID NO: 89319 - DNA, 20 bp, synthetic construct
  misc_feature 1..20: note = CRISPR gRNA sequence
  source 1..20: mol_type = other DNA
caccatgttagccaggatgg

SEQ ID NO: 89320 - DNA, 20 bp, synthetic construct
  misc_feature 1..20: note = CRISPR gRNA sequence
  source 1..20: mol_type = other DNA
accatgttagccaggatggt

SEQ ID NO: 89321 - DNA, 20 bp, synthetic construct
  misc_feature 1..20: note = CRISPR gRNA sequence
  source 1..20: mol_type = other DNA
gccaggatggtctcgatctc

SEQ ID NO: 89322 - DNA, 20 bp, synthetic construct
  misc_feature 1..20: note = CRISPR gRNA sequence
  source 1..20: mol_type = other DNA
gatctcctgaccttgtgatc

SEQ ID NO: 89323 - DNA, 20 bp, synthetic construct
  misc_feature 1..20: note = CRISPR gRNA sequence
  source 1..20: mol_type = other DNA
ctgaccttgtgatcagcctg

SEQ ID NO: 89324 - DNA, 20 bp, synthetic construct
  misc_feature 1..20: note = CRISPR gRNA sequence
  source 1..20: mol_type = other DNA
accttgtgatcagcctgcct

SEQ ID NO: 89325 - DNA, 20 bp, synthetic construct
  misc_feature 1..20: note = CRISPR gRNA sequence
  source 1..20: mol_type = other DNA
gtgatcagcctgccttggcc

SEQ ID NO: 89326 - DNA, 20 bp, synthetic construct
  misc_feature 1..20: note = CRISPR gRNA sequence
  source 1..20: mol_type = other DNA
tgatcagcctgccttggcct

SEQ ID NO: 89327 - DNA, 20 bp, synthetic construct
  misc_feature 1..20: note = CRISPR gRNA sequence
  source 1..20: mol_type = other DNA
ccttggccttccaaagtgct

SEQ ID NO: 89328 - DNA, 20 bp, synthetic construct
  misc_feature 1..20: note = CRISPR gRNA sequence
  source 1..20: mol_type = other DNA
ggccttccaaagtgctggga

SEQ ID NO: 89329 - DNA, 20 bp, synthetic construct
  misc_feature 1..20: note = CRISPR gRNA sequence
  source 1..20: mol_type = other DNA
gccttccaaagtgctgggat

SEQ ID NO: 89330 - DNA, 20 bp, synthetic construct
  misc_feature 1..20: note = CRISPR gRNA sequence
  source 1..20: mol_type = other DNA
ccaaagtgctgggattgtag

SEQ ID NO: 89331 - DNA, 20 bp, synthetic construct
  misc_feature 1..20: note = CRISPR gRNA sequence
  source 1..20: mol_type = other DNA
caaagtgctgggattgtagg

SEQ ID NO: 89332 - DNA, 20 bp, synthetic construct
  misc_feature 1..20: note = CRISPR gRNA sequence
  source 1..20: mol_type = other DNA
ggattgtaggcgtgagccac

SEQ ID NO: 89333 - DNA, 20 bp, synthetic construct
  misc_feature 1..20: note = CRISPR gRNA sequence
  source 1..20: mol_type = other DNA
taggcgtgagccaccgtgcc

SEQ ID NO: 89334 - DNA, 20 bp, synthetic construct
  misc_feature 1..20: note = CRISPR gRNA sequence
  source 1..20: mol_type = other DNA
gtcaaataatttctaaggtc

SEQ ID NO: 89335 - DNA, 20 bp, synthetic construct
  misc_feature 1..20: note = CRISPR gRNA sequence
  source 1..20: mol_type = other DNA
tcaaataatttctaaggtcc

SEQ ID NO: 89336 - DNA, 20 bp, synthetic construct
  misc_feature 1..20: note = CRISPR gRNA sequence
  source 1..20: mol_type = other DNA
ctaaggtcctttttcagtct

SEQ ID NO: 89337 - DNA, 20 bp, synthetic construct
  misc_feature 1..20: note = CRISPR gRNA sequence
  source 1..20: mol_type = other DNA
taaggtcctttttcagtctg

SEQ ID NO: 89338 - DNA, 20 bp, synthetic construct
  misc_feature 1..20: note = CRISPR gRNA sequence
  source 1..20: mol_type = other DNA
aggtcctttttcagtctgac

SEQ ID NO: 89339 - DNA, 20 bp, synthetic construct
  misc_feature 1..20: note = CRISPR gRNA sequence
  source 1..20: mol_type = other DNA
tttcagtctgacaccctgta

SEQ ID NO: 89340 - DNA, 20 bp, synthetic construct
  misc_feature 1..20: note = CRISPR gRNA sequence
  source 1..20: mol_type = other DNA
ttcagtctgacaccctgtaa

SEQ ID NO: 89341 - DNA, 20 bp, synthetic construct
  misc_feature 1..20: note = CRISPR gRNA sequence
  source 1..20: mol_type = other DNA
tcagtctgacaccctgtaag

SEQ ID NO: 89342 - DNA, 20 bp, synthetic construct
  misc_feature 1..20: note = CRISPR gRNA sequence
  source 1..20: mol_type = other DNA
cagtctgacaccctgtaagt

SEQ ID NO: 89343 - DNA, 20 bp, synthetic construct
  misc_feature 1..20: note = CRISPR gRNA sequence
  source 1..20: mol_type = other DNA
agtctgacaccctgtaagtc

SEQ ID NO: 89344 - DNA, 20 bp, synthetic construct
  misc_feature 1..20: note = CRISPR gRNA sequence
  source 1..20: mol_type = other DNA
acaccctgtaagtcagctag

SEQ ID NO: 89345 - DNA, 20 bp, synthetic construct
  misc_feature 1..20: note = CRISPR gRNA sequence
  source 1..20: mol_type = other DNA
taagtcagctagactttggt

SEQ ID NO: 89346 - DNA, 20 bp, synthetic construct
  misc_feature 1..20: note = CRISPR gRNA sequence
  source 1..20: mol_type = other DNA
gactttggtgtggggatcag

SEQ ID NO: 89347 - DNA, 20 bp, synthetic construct
  misc_feature 1..20: note = CRISPR gRNA sequence
  source 1..20: mol_type = other DNA
tggtgtggggatcagagggt

SEQ ID NO: 89348 - DNA, 20 bp, synthetic construct
  misc_feature 1..20: note = CRISPR gRNA sequence
  source 1..20: mol_type = other DNA
ggtgtggggatcagagggtc

SEQ ID NO: 89349 - DNA, 20 bp, synthetic construct
  misc_feature 1..20: note = CRISPR gRNA sequence
  source 1..20: mol_type = other DNA
gtgtggggatcagagggtcc

SEQ ID NO: 89350 - DNA, 20 bp, synthetic construct
  misc_feature 1..20: note = CRISPR gRNA sequence
  source 1..20: mol_type = other DNA
tattgggtccttcttggcct

SEQ ID NO: 89351 - DNA, 20 bp, synthetic construct
  misc_feature 1..20: note = CRISPR gRNA sequence
  source 1..20: mol_type = other DNA
ggtccttcttggccttatta

SEQ ID NO: 89352 - DNA, 20 bp, synthetic construct
  misc_feature 1..20: note = CRISPR gRNA sequence
  source 1..20: mol_type = other DNA
cttggccttattatttctcc

SEQ ID NO: 89353 - DNA, 20 bp, synthetic construct
  misc_feature 1..20: note = CRISPR gRNA sequence
  source 1..20: mol_type = other DNA
ttggccttattatttctcct

SEQ ID NO: 89354 - DNA, 20 bp, synthetic construct
  misc_feature 1..20: note = CRISPR gRNA sequence
  source 1..20: mol_type = other DNA
ggccttattatttctcctgc

SEQ ID NO: 89355 - DNA, 20 bp, synthetic construct
  misc_feature 1..20: note = CRISPR gRNA sequence
  source 1..20: mol_type = other DNA
gccttattatttctcctgcc

SEQ ID NO: 89356 - DNA, 20 bp, synthetic construct
  misc_feature 1..20: note = CRISPR gRNA sequence
  source 1..20: mol_type = other DNA
attatttctcctgcctctgt

SEQ ID NO: 89357 - DNA, 20 bp, synthetic construct
  misc_feature 1..20: note = CRISPR gRNA sequence
  source 1..20: mol_type = other DNA
ttatttctcctgcctctgtt

SEQ ID NO: 89358 - DNA, 20 bp, synthetic construct
  misc_feature 1..20: note = CRISPR gRNA sequence
  source 1..20: mol_type = other DNA
tttctcctgcctctgttctc

SEQ ID NO: 89359 - DNA, 20 bp, synthetic construct
  misc_feature 1..20: note = CRISPR gRNA sequence
  source 1..20: mol_type = other DNA
ctcctgcctctgttctctcc

SEQ ID NO: 89360 - DNA, 20 bp, synthetic construct
  misc_feature 1..20: note = CRISPR gRNA sequence
  source 1..20: mol_type = other DNA
tcctgcctctgttctctcct

SEQ ID NO: 89361 - DNA, 20 bp, synthetic construct
  misc_feature 1..20: note = CRISPR gRNA sequence
  source 1..20: mol_type = other DNA
ctgcctctgttctctcctac

SEQ ID NO: 89362 - DNA, 20 bp, synthetic construct
  misc_feature 1..20: note = CRISPR gRNA sequence
  source 1..20: mol_type = other DNA
cctctgttctctcctacctc

SEQ ID NO: 89363 - DNA, 20 bp, synthetic construct
  misc_feature 1..20: note = CRISPR gRNA sequence
  source 1..20: mol_type = other DNA
tgttctctcctacctcagca

SEQ ID NO: 89364 - DNA, 20 bp, synthetic construct
  misc_feature 1..20: note = CRISPR gRNA sequence
  source 1..20: mol_type = other DNA
ttctctcctacctcagcaag

SEQ ID NO: 89365 - DNA, 20 bp, synthetic construct
  misc_feature 1..20: note = CRISPR gRNA sequence
  source 1..20: mol_type = other DNA
tctcctacctcagcaagatg

SEQ ID NO: 89366 - DNA, 20 bp, synthetic construct
  misc_feature 1..20: note = CRISPR gRNA sequence
  source 1..20: mol_type = other DNA
tcctacctcagcaagatgta

SEQ ID NO: 89367 - DNA, 20 bp, synthetic construct
  misc_feature 1..20: note = CRISPR gRNA sequence
  source 1..20: mol_type = other DNA
ctacctcagcaagatgtaca

SEQ ID NO: 89368 - DNA, 20 bp, synthetic construct
  misc_feature 1..20: note = CRISPR gRNA sequence
  source 1..20: mol_type = other DNA
cctcagcaagatgtacagaa

SEQ ID NO: 89369 - DNA, 20 bp, synthetic construct
  misc_feature 1..20: note = CRISPR gRNA sequence
  source 1..20: mol_type = other DNA
agcaagatgtacagaaattt

SEQ ID NO: 89370 - DNA, 20 bp, synthetic construct
  misc_feature 1..20: note = CRISPR gRNA sequence
  source 1..20: mol_type = other DNA
tctgacaatgacaagctgta

SEQ ID NO: 89371 - DNA, 20 bp, synthetic construct
  misc_feature 1..20: note = CRISPR gRNA sequence
  source 1..20: mol_type = other DNA
ctgacaatgacaagctgtat

SEQ ID NO: 89372 - DNA, 20 bp, synthetic construct
  misc_feature 1..20: note = CRISPR gRNA sequence
  source 1..20: mol_type = other DNA
tgacaatgacaagctgtatc

SEQ ID NO: 89373 - DNA, 20 bp, synthetic construct
  misc_feature 1..20: note = CRISPR gRNA sequence
  source 1..20: mol_type = other DNA
acaatgacaagctgtatctc

SEQ ID NO: 89374 - DNA, 20 bp, synthetic construct
  misc_feature 1..20: note = CRISPR gRNA sequence
  source 1..20: mol_type = other DNA
tatctctaccttcagctccc

SEQ ID NO: 89375 - DNA, 20 bp, synthetic construct
  misc_feature 1..20: note = CRISPR gRNA sequence
  source 1..20: mol_type = other DNA
taccttcagctcccctcagg

SEQ ID NO: 89376 - DNA, 20 bp, synthetic construct
  misc_feature 1..20: note = CRISPR gRNA sequence
  source 1..20: mol_type = other DNA
ccttcagctcccctcaggac

SEQ ID NO: 89377 - DNA, 20 bp, synthetic construct
  misc_feature 1..20: note = CRISPR gRNA sequence
  source 1..20: mol_type = other DNA
cagctcccctcaggacccac

SEQ ID NO: 89378 - DNA, 20 bp, synthetic construct
  misc_feature 1..20: note = CRISPR gRNA sequence
  source 1..20: mol_type = other DNA
agctcccctcaggacccacc

SEQ ID NO: 89379 - DNA, 20 bp, synthetic construct
  misc_feature 1..20: note = CRISPR gRNA sequence
  source 1..20: mol_type = other DNA
ccctcaggacccaccactgg

SEQ ID NO: 89380 - DNA, 20 bp, synthetic construct
  misc_feature 1..20: note = CRISPR gRNA sequence
  source 1..20: mol_type = other DNA
aggacccaccactggagaca

SEQ ID NO: 89381 - DNA, 20 bp, synthetic construct
  misc_feature 1..20: note = CRISPR gRNA sequence
  source 1..20: mol_type = other DNA
gagacaaaaggtaggtttga

SEQ ID NO: 89382 - DNA, 20 bp, synthetic construct
  misc_feature 1..20: note = CRISPR gRNA sequence
  source 1..20: mol_type = other DNA
gatagtagttttagatggca

SEQ ID NO: 89383 - DNA, 20 bp, synthetic construct
  misc_feature 1..20: note = CRISPR gRNA sequence
  source 1..20: mol_type = other DNA
atagtagttttagatggcag

SEQ ID NO: 89384 - DNA, 20 bp, synthetic construct
  misc_feature 1..20: note = CRISPR gRNA sequence
  source 1..20: mol_type = other DNA
tagatggcagaggttctgat

SEQ ID NO: 89385 - DNA, 20 bp, synthetic construct
  misc_feature 1..20: note = CRISPR gRNA sequence
  source 1..20: mol_type = other DNA
agatggcagaggttctgatt

SEQ ID NO: 89386 - DNA, 20 bp, synthetic construct
  misc_feature 1..20: note = CRISPR gRNA sequence
  source 1..20: mol_type = other DNA
gatggcagaggttctgattc

SEQ ID NO: 89387 - DNA, 20 bp, synthetic construct
  misc_feature 1..20: note = CRISPR gRNA sequence
  source 1..20: mol_type = other DNA
tgattcttagagaaaggttc

SEQ ID NO: 89388 - DNA, 20 bp, synthetic construct
  misc_feature 1..20: note = CRISPR gRNA sequence
  source 1..20: mol_type = other DNA
attcttagagaaaggttcac

SEQ ID NO: 89389 - DNA, 20 bp, synthetic construct
  misc_feature 1..20: note = CRISPR gRNA sequence
  source 1..20: mol_type = other DNA
ttagagaaaggttcactggg

SEQ ID NO: 89390 - DNA, 20 bp, synthetic construct
  misc_feature 1..20: note = CRISPR gRNA sequence
  source 1..20: mol_type = other DNA
agagaaaggttcactgggaa

SEQ ID NO: 89391 - DNA, 20 bp, synthetic construct
  misc_feature 1..20: note = CRISPR gRNA sequence
  source 1..20: mol_type = other DNA
gagaaaggttcactgggaag

SEQ ID NO: 89392 - DNA, 20 bp, synthetic construct
  misc_feature 1..20: note = CRISPR gRNA sequence
  source 1..20: mol_type = other DNA
actgggaaggggtgaggtga

SEQ ID NO: 89393 - DNA, 20 bp, synthetic construct
  misc_feature 1..20: note = CRISPR gRNA sequence
  source 1..20: mol_type = other DNA
ggaaggggtgaggtgaatag

SEQ ID NO: 89394 - DNA, 20 bp, synthetic construct
  misc_feature 1..20: note = CRISPR gRNA sequence
  source 1..20: mol_type = other DNA
gtaaatgctgtccttgatga

SEQ ID NO: 89395 - DNA, 20 bp, synthetic construct
  misc_feature 1..20: note = CRISPR gRNA sequence
  source 1..20: mol_type = other DNA
tccttgatgaagaggaaagg

SEQ ID NO: 89396 - DNA, 20 bp, synthetic construct
  misc_feature 1..20: note = CRISPR gRNA sequence
  source 1..20: mol_type = other DNA
gatgaagaggaaaggtcctc

SEQ ID NO: 89397 - DNA, 20 bp, synthetic construct
  misc_feature 1..20: note = CRISPR gRNA sequence
  source 1..20: mol_type = other DNA
atgaagaggaaaggtcctcg

SEQ ID NO: 89398 - DNA, 20 bp, synthetic construct
  misc_feature 1..20: note = CRISPR gRNA sequence
  source 1..20: mol_type = other DNA
gccctgacttggtttaccag

SEQ ID NO: 89399 - DNA, 20 bp, synthetic construct
  misc_feature 1..20: note = CRISPR gRNA sequence
  source 1..20: mol_type = other DNA
acttggtttaccagggaaag

SEQ ID NO: 89400 - DNA, 20 bp, synthetic construct
  misc_feature 1..20: note = CRISPR gRNA sequence
  source 1..20: mol_type = other DNA
ggtttaccagggaaagttag

SEQ ID NO: 89401 - DNA, 20 bp, synthetic construct
  misc_feature 1..20: note = CRISPR gRNA sequence
  source 1..20: mol_type = other DNA
gtttaccagggaaagttaga

SEQ ID NO: 89402 - DNA, 20 bp, synthetic construct
  misc_feature 1..20: note = CRISPR gRNA sequence
  source 1..20: mol_type = other DNA
accagggaaagttagattct

SEQ ID NO: 89403 - DNA, 20 bp, synthetic construct
  misc_feature 1..20: note = CRISPR gRNA sequence
  source 1..20: mol_type = other DNA
ccagggaaagttagattctg

SEQ ID NO: 89404 - DNA, 20 bp, synthetic construct
  misc_feature 1..20: note = CRISPR gRNA sequence
  source 1..20: mol_type = other DNA
gattctgggtgaactaaatt

SEQ ID NO: 89405 - DNA, 20 bp, synthetic construct
  misc_feature 1..20: note = CRISPR gRNA sequence
  source 1..20: mol_type = other DNA
tgggtgaactaaatttggtc

SEQ ID NO: 89406 - DNA, 20 bp, synthetic construct
  misc_feature 1..20: note = CRISPR gRNA sequence
  source 1..20: mol_type = other DNA
ggtgaactaaatttggtcca

SEQ ID NO: 89407 - DNA, 20 bp, synthetic construct
  misc_feature 1..20: note = CRISPR gRNA sequence
  source 1..20: mol_type = other DNA
aatttggtccagcactactg

SEQ ID NO: 89408 - DNA, 20 bp, synthetic construct
  misc_feature 1..20: note = CRISPR gRNA sequence
  source 1..20: mol_type = other DNA
ggtccagcactactgaagtg

SEQ ID NO: 89409 - DNA, 20 bp, synthetic construct
  misc_feature 1..20: note = CRISPR gRNA sequence
  source 1..20: mol_type = other DNA
gtccagcactactgaagtgg

SEQ ID NO: 89410 - DNA, 20 bp, synthetic construct
  misc_feature 1..20: note = CRISPR gRNA sequence
  source 1..20: mol_type = other DNA
ctgaagtggtagtttgggaa

SEQ ID NO: 89411 - DNA, 20 bp, synthetic construct
  misc_feature 1..20: note = CRISPR gRNA sequence
  source 1..20: mol_type = other DNA
aagtggtagtttgggaagaa

SEQ ID NO: 89412 - DNA, 20 bp, synthetic construct
  misc_feature 1..20: note = CRISPR gRNA sequence
  source 1..20: mol_type = other DNA
gggaagaaccaggacaactg

SEQ ID NO: 89413 - DNA, 20 bp, synthetic construct
  misc_feature 1..20: note = CRISPR gRNA sequence
  source 1..20: mol_type = other DNA
ggaagaaccaggacaactgt

SEQ ID NO: 89414 - DNA, 20 bp, synthetic construct
  misc_feature 1..20: note = CRISPR gRNA sequence
  source 1..20: mol_type = other DNA
ttagggtcttagtaatgctt

SEQ ID NO: 89415 - DNA, 20 bp, synthetic construct
  misc_feature 1..20: note = CRISPR gRNA sequence
  source 1..20: mol_type = other DNA
gggtcttagtaatgcttgtt

SEQ ID NO: 89416 - DNA, 20 bp, synthetic construct
  misc_feature 1..20: note = CRISPR gRNA sequence
  source 1..20: mol_type = other DNA
agtaatgcttgttccttttg

SEQ ID NO: 89417 - DNA, 20 bp, synthetic construct
  misc_feature 1..20: note = CRISPR gRNA sequence
  source 1..20: mol_type = other DNA
gtaatgcttgttccttttgt

SEQ ID NO: 89418 - DNA, 20 bp, synthetic construct
  misc_feature 1..20: note = CRISPR gRNA sequence
  source 1..20: mol_type = other DNA
gttccttttgtttctgtagc

SEQ ID NO: 89419 - DNA, 20 bp, synthetic construct
  misc_feature 1..20: note = CRISPR gRNA sequence
  source 1..20: mol_type = other DNA
ttccttttgtttctgtagct

SEQ ID NO: 89420 - DNA, 20 bp, synthetic construct
  misc_feature 1..20: note = CRISPR gRNA sequence
  source 1..20: mol_type = other DNA
cttttgtttctgtagctcag

SEQ ID NO: 89421 - DNA, 20 bp, synthetic construct
  misc_feature 1..20: note = CRISPR gRNA sequence
  source 1..20: mol_type = other DNA
ttgtttctgtagctcagagc

SEQ ID NO: 89422 - DNA, 20 bp, synthetic construct
  misc_feature 1..20: note = CRISPR gRNA sequence
  source 1..20: mol_type = other DNA
tgtttctgtagctcagagcc

SEQ ID NO: 89423 - DNA, 20 bp, synthetic construct
  misc_feature 1..20: note = CRISPR gRNA sequence
  source 1..20: mol_type = other DNA
gtttctgtagctcagagcca

SEQ ID NO: 89424 - DNA, 20 bp, synthetic construct
  misc_feature 1..20: note = CRISPR gRNA sequence
  source 1..20: mol_type = other DNA
tttctgtagctcagagccaa

SEQ ID NO: 89425 - DNA, 20 bp, synthetic construct
  misc_feature 1..20: note = CRISPR gRNA sequence
  source 1..20: mol_type = other DNA
ctgtagctcagagccaagta

SEQ ID NO: 89426 - DNA, 20 bp, synthetic construct
  misc_feature 1..20: note = CRISPR gRNA sequence
  source 1..20: mol_type = other DNA
tgtagctcagagccaagtac

SEQ ID NO: 89427 - DNA, 20 bp, synthetic construct
  misc_feature 1..20: note = CRISPR gRNA sequence
  source 1..20: mol_type = other DNA
tagctcagagccaagtacac

SEQ ID NO: 89428 - DNA, 20 bp, synthetic construct
  misc_feature 1..20: note = CRISPR gRNA sequence
  source 1..20: mol_type = other DNA
agagccaagtacactgagca

SEQ ID NO: 89429 - DNA, 20 bp, synthetic construct
  misc_feature 1..20: note = CRISPR gRNA sequence
  source 1..20: mol_type = other DNA
agcaatgaggagtacatgta

SEQ ID NO: 89430 - DNA, 20 bp, synthetic construct
  misc_feature 1..20: note = CRISPR gRNA sequence
  source 1..20: mol_type = other DNA
taggtggatccgcaaccacc

SEQ ID NO: 89431 - DNA, 20 bp, synthetic construct
  misc_feature 1..20: note = CRISPR gRNA sequence
  source 1..20: mol_type = other DNA
gaagagcacactgacacctg

SEQ ID NO: 89432 - DNA, 20 bp, synthetic construct
  misc_feature 1..20: note = CRISPR gRNA sequence
  source 1..20: mol_type = other DNA
acacctgtctgccaaagcaa

SEQ ID NO: 89433 - DNA, 20 bp, synthetic construct
  misc_feature 1..20: note = CRISPR gRNA sequence
  source 1..20: mol_type = other DNA
tctgccaaagcaaagtgttt

SEQ ID NO: 89434 - DNA, 20 bp, synthetic construct
  misc_feature 1..20: note = CRISPR gRNA sequence
  source 1..20: mol_type = other DNA
ccaaagcaaagtgtttatga

SEQ ID NO: 89435 - DNA, 20 bp, synthetic construct
  misc_feature 1..20: note = CRISPR gRNA sequence
  source 1..20: mol_type = other DNA
atgatgcctatcggtgggtg

SEQ ID NO: 89436 - DNA, 20 bp, synthetic construct
  misc_feature 1..20: note = CRISPR gRNA sequence
  source 1..20: mol_type = other DNA
tgatgcctatcggtgggtgg

SEQ ID NO: 89437 - DNA, 20 bp, synthetic construct
  misc_feature 1..20: note = CRISPR gRNA sequence
  source 1..20: mol_type = other DNA
tcggtgggtggaggggtggg

SEQ ID NO: 89438 - DNA, 20 bp, synthetic construct
  misc_feature 1..20: note = CRISPR gRNA sequence
  source 1..20: mol_type = other DNA
gtgggcataggaccccctca

SEQ ID NO: 89439 - DNA, 20 bp, synthetic construct
  misc_feature 1..20: note = CRISPR gRNA sequence
  source 1..20: mol_type = other DNA
acccatgaagagcttcctgc

SEQ ID NO: 89440 - DNA, 20 bp, synthetic construct
  misc_feature 1..20: note = CRISPR gRNA sequence
  source 1..20: mol_type = other DNA
cctgccttgataaagcctgc

SEQ ID NO: 89441 - DNA, 20 bp, synthetic construct
  misc_feature 1..20: note = CRISPR gRNA sequence
  source 1..20: mol_type = other DNA
ctgccttgataaagcctgcc

SEQ ID NO: 89442 - DNA, 20 bp, synthetic construct
  misc_feature 1..20: note = CRISPR gRNA sequence
  source 1..20: mol_type = other DNA
ccttgataaagcctgccttc

SEQ ID NO: 89443 - DNA, 20 bp, synthetic construct
  misc_feature 1..20: note = CRISPR gRNA sequence
  source 1..20: mol_type = other DNA
gataaagcctgccttcttaa

SEQ ID NO: 89444 - DNA, 20 bp, synthetic construct
  misc_feature 1..20: note = CRISPR gRNA sequence
  source 1..20: mol_type = other DNA
ataaagcctgccttcttaaa

SEQ ID NO: 89445 - DNA, 20 bp, synthetic construct
  misc_feature 1..20: note = CRISPR gRNA sequence
  source 1..20: mol_type = other DNA
ccttcttaaagggttcctca

SEQ ID NO: 89446 - DNA, 20 bp, synthetic construct
  misc_feature 1..20: note = CRISPR gRNA sequence
  source 1..20: mol_type = other DNA
cttaaagggttcctcacact

SEQ ID NO: 89447 - DNA, 20 bp, synthetic construct
  misc_feature 1..20: note = CRISPR gRNA sequence
  source 1..20: mol_type = other DNA
ttaaagggttcctcacactt

SEQ ID NO: 89448 - DNA, 20 bp, synthetic construct
  misc_feature 1..20: note = CRISPR gRNA sequence
  source 1..20: mol_type = other DNA
aaagggttcctcacacttga

SEQ ID NO: 89449 - DNA, 20 bp, synthetic construct
  misc_feature 1..20: note = CRISPR gRNA sequence
  source 1..20: mol_type = other DNA
aagggttcctcacacttgat

SEQ ID NO: 89450 - DNA, 20 bp, synthetic construct
  misc_feature 1..20: note = CRISPR gRNA sequence
  source 1..20: mol_type = other DNA
ctcacacttgatccctaggg

SEQ ID NO: 89451 - DNA, 20 bp, synthetic construct
  misc_feature 1..20: note = CRISPR gRNA sequence
  source 1..20: mol_type = other DNA
acacttgatccctagggact

SEQ ID NO: 89452 - DNA, 20 bp, synthetic construct
  misc_feature 1..20: note = CRISPR gRNA sequence
  source 1..20: mol_type = other DNA
gatccctagggactcttcga

SEQ ID NO: 89453 - DNA, 20 bp, synthetic construct
  misc_feature 1..20: note = CRISPR gRNA sequence
  source 1..20: mol_type = other DNA
atccctagggactcttcgag

SEQ ID NO: 89454 - DNA, 20 bp, synthetic construct
  misc_feature 1..20: note = CRISPR gRNA sequence
  source 1..20: mol_type = other DNA
gggactcttcgagcctaccc

SEQ ID NO: 89455 - DNA, 20 bp, synthetic construct
  misc_feature 1..20: note = CRISPR gRNA sequence
  source 1..20: mol_type = other DNA
ttcgagcctacccatggcct

SEQ ID NO: 89456 - DNA, 20 bp, synthetic construct
  misc_feature 1..20: note = CRISPR gRNA sequence
  source 1..20: mol_type = other DNA
cgagcctacccatggcctcc

SEQ ID NO: 89457 - DNA, 20 bp, synthetic construct
  misc_feature 1..20: note = CRISPR gRNA sequence
  source 1..20: mol_type = other DNA
gagcctacccatggcctcct

SEQ ID NO: 89458 - DNA, 20 bp, synthetic construct
  misc_feature 1..20: note = CRISPR gRNA sequence
  source 1..20: mol_type = other DNA
cccatggcctccttctctga

SEQ ID NO: 89459 - DNA, 20 bp, synthetic construct
  misc_feature 1..20: note = CRISPR gRNA sequence
  source 1..20: mol_type = other DNA
cttctctgagtatcttccca

SEQ ID NO: 89460 - DNA, 20 bp, synthetic construct
  misc_feature 1..20: note = CRISPR gRNA sequence
  source 1..20: mol_type = other DNA
ctctgagtatcttcccactc

SEQ ID NO: 89461 - DNA, 20 bp, synthetic construct
  misc_feature 1..20: note = CRISPR gRNA sequence
  source 1..20: mol_type = other DNA
tctgagtatcttcccactct

SEQ ID NO: 89462 - DNA, 20 bp, synthetic construct
  misc_feature 1..20: note = CRISPR gRNA sequence
  source 1..20: mol_type = other DNA
tgagtatcttcccactctgc

SEQ ID NO: 89463 - DNA, 20 bp, synthetic construct
  misc_feature 1..20: note = CRISPR gRNA sequence
  source 1..20: mol_type = other DNA
agtatcttcccactctgctc

SEQ ID NO: 89464 - DNA, 20 bp, synthetic construct
  misc_feature 1..20: note = CRISPR gRNA sequence
  source 1..20: mol_type = other DNA
cccactctgctcccctctca

SEQ ID NO: 89465 - DNA, 20 bp, synthetic construct
  misc_feature 1..20: note = CRISPR gRNA sequence
  source 1..20: mol_type = other DNA
ccactctgctcccctctcac

SEQ ID NO: 89466 - DNA, 20 bp, synthetic construct
  misc_feature 1..20: note = CRISPR gRNA sequence
  source 1..20: mol_type = other DNA
tgctcccctctcactcagga

SEQ ID NO: 89467 - DNA, 20 bp, synthetic construct
  misc_feature 1..20: note = CRISPR gRNA sequence
  source 1..20: mol_type = other DNA
ctcccctctcactcaggaag

SEQ ID NO: 89468 - DNA, 20 bp, synthetic construct
  misc_feature 1..20: note = CRISPR gRNA sequence
  source 1..20: mol_type = other DNA
ccctctcactcaggaagtac

SEQ ID NO: 89469 - DNA, 20 bp, synthetic construct
  misc_feature 1..20: note = CRISPR gRNA sequence
  source 1..20: mol_type = other DNA
tcactcaggaagtactgtga

SEQ ID NO: 89470 - DNA, 20 bp, synthetic construct
  misc_feature 1..20: note = CRISPR gRNA sequence
  source 1..20: mol_type = other DNA
actcaggaagtactgtgaga

SEQ ID NO: 89471 - DNA, 20 bp, synthetic construct
  misc_feature 1..20: note = CRISPR gRNA sequence
  source 1..20: mol_type = other DNA
aggaagtactgtgagagtct

SEQ ID NO: 89472 - DNA, 20 bp, synthetic construct
  misc_feature 1..20: note = CRISPR gRNA sequence
  source 1..20: mol_type = other DNA
tgagagtcttgcctgttgcc

SEQ ID NO: 89473 - DNA, 20 bp, synthetic construct
  misc_feature 1..20: note = CRISPR gRNA sequence
  source 1..20: mol_type = other DNA
gcctgttgccgcccactcag

SEQ ID NO: 89474 - DNA, 20 bp, synthetic construct
  misc_feature 1..20: note = CRISPR gRNA sequence
  source 1..20: mol_type = other DNA
cctgttgccgcccactcagc

SEQ ID NO: 89475 - DNA, 20 bp, synthetic construct
  misc_feature 1..20: note = CRISPR gRNA sequence
  source 1..20: mol_type = other DNA
ttgccgcccactcagcacag

SEQ ID NO: 89476 - DNA, 20 bp, synthetic construct
  misc_feature 1..20: note = CRISPR gRNA sequence
  source 1..20: mol_type = other DNA
ccgcccactcagcacagcca

SEQ ID NO: 89477 - DNA, 20 bp, synthetic construct
  misc_feature 1..20: note = CRISPR gRNA sequence
  source 1..20: mol_type = other DNA
agcacagccaactttggcaa

SEQ ID NO: 89478 - DNA, 20 bp, synthetic construct
  misc_feature 1..20: note = CRISPR gRNA sequence
  source 1..20: mol_type = other DNA
tggcaagatcatcagagaga

SEQ ID NO: 89479 - DNA, 20 bp, synthetic construct
  misc_feature 1..20: note = CRISPR gRNA sequence
  source 1..20: mol_type = other DNA
ggcaagatcatcagagagat

SEQ ID NO: 89480 - DNA, 20 bp, synthetic construct
  misc_feature 1..20: note = CRISPR gRNA sequence
  source 1..20: mol_type = other DNA
gcaagatcatcagagagatc

SEQ ID NO: 89481 - DNA, 20 bp, synthetic construct
  misc_feature 1..20: note = CRISPR gRNA sequence
  source 1..20: mol_type = other DNA
ccctgacatcaaagctcgaa

SEQ ID NO: 89482 - DNA, 20 bp, synthetic construct
  misc_feature 1..20: note = CRISPR gRNA sequence
  source 1..20: mol_type = other DNA
cctgacatcaaagctcgaag

SEQ ID NO: 89483 - DNA, 20 bp, synthetic construct
  misc_feature 1..20: note = CRISPR gRNA sequence
  source 1..20: mol_type = other DNA
acatcaaagctcgaaggctt

SEQ ID NO: 89484 - DNA, 20 bp, synthetic construct
  misc_feature 1..20: note = CRISPR gRNA sequence
  source 1..20: mol_type = other DNA
gaaggcttggtggccggggc

SEQ ID NO: 89485 - DNA, 20 bp, synthetic construct
  misc_feature 1..20: note = CRISPR gRNA sequence
  source 1..20: mol_type = other DNA
ggtggccggggccagtccaa

SEQ ID NO: 89486 - DNA, 20 bp, synthetic construct
  misc_feature 1..20: note = CRISPR gRNA sequence
  source 1..20: mol_type = other DNA
gtggccggggccagtccaag

SEQ ID NO: 89487 - DNA, 20 bp, synthetic construct
  misc_feature 1..20: note = CRISPR gRNA sequence
  source 1..20: mol_type = other DNA
gactagagaggttgggggtg

SEQ ID NO: 89488 - DNA, 20 bp, synthetic construct
  misc_feature 1..20: note = CRISPR gRNA sequence
  source 1..20: mol_type = other DNA
actagagaggttgggggtgg

SEQ ID NO: 89489 - DNA, 20 bp, synthetic construct
  misc_feature 1..20: note = CRISPR gRNA sequence
  source 1..20: mol_type = other DNA
gagaggttgggggtggagga

SEQ ID NO: 89490 - DNA, 20 bp, synthetic construct
  misc_feature 1..20: note = CRISPR gRNA sequence
  source 1..20: mol_type = other DNA
ggggtggaggacctgggagg

SEQ ID NO: 89491 - DNA, 20 bp, synthetic construct
  misc_feature 1..20: note = CRISPR gRNA sequence
  source 1..20: mol_type = other DNA
ggaggaagacttaggatgtg

SEQ ID NO: 89492 - DNA, 20 bp, synthetic construct
  misc_feature 1..20: note = CRISPR gRNA sequence
  source 1..20: mol_type = other DNA
aggatgtggagagcaaggag

SEQ ID NO: 89493 - DNA, 20 bp, synthetic construct
  misc_feature 1..20: note = CRISPR gRNA sequence
  source 1..20: mol_type = other DNA
ggatgtggagagcaaggagt

SEQ ID NO: 89494 - DNA, 20 bp, synthetic construct
  misc_feature 1..20: note = CRISPR gRNA sequence
  source 1..20: mol_type = other DNA
aacttgctcgaggggcttgg

SEQ ID NO: 89495 - DNA, 20 bp, synthetic construct
  misc_feature 1..20: note = CRISPR gRNA sequence
  source 1..20: mol_type = other DNA
acttgctcgaggggcttgga

SEQ ID NO: 89496 - DNA, 20 bp, synthetic construct
  misc_feature 1..20: note = CRISPR gRNA sequence
  source 1..20: mol_type = other DNA
gctcgaggggcttggagatc

SEQ ID NO: 89497 - DNA, 20 bp, synthetic construct
  misc_feature 1..20: note = CRISPR gRNA sequence
  source 1..20: mol_type = other DNA
ctcgaggggcttggagatcg

SEQ ID NO: 89498 - DNA, 20 bp, synthetic construct
  misc_feature 1..20: note = CRISPR gRNA sequence
  source 1..20: mol_type = other DNA
gaggggcttggagatcgcca

SEQ ID NO: 89499 - DNA, 20 bp, synthetic construct
  misc_feature 1..20: note = CRISPR gRNA sequence
  source 1..20: mol_type = other DNA
ggagatcgccatgtgttggc

SEQ ID NO: 89500 - DNA, 20 bp, synthetic construct
  misc_feature 1..20: note = CRISPR gRNA sequence
  source 1..20: mol_type = other DNA
gagatcgccatgtgttggct

SEQ ID NO: 89501 - DNA, 20 bp, synthetic construct
  misc_feature 1..20: note = CRISPR gRNA sequence
  source 1..20: mol_type = other DNA
gctgctctttaacttgcatc

SEQ ID NO: 89502 - DNA, 20 bp, synthetic construct
  misc_feature 1..20: note = CRISPR gRNA sequence
  source 1..20: mol_type = other DNA
ctctttaacttgcatcagat

SEQ ID NO: 89503 - DNA, 20 bp, synthetic construct
  misc_feature 1..20: note = CRISPR gRNA sequence
  source 1..20: mol_type = other DNA
tttaacttgcatcagatatt

SEQ ID NO: 89504 - DNA, 20 bp, synthetic construct
  misc_feature 1..20: note = CRISPR gRNA sequence
  source 1..20: mol_type = other DNA
taacttgcatcagatattgc

SEQ ID NO: 89505 - DNA, 20 bp, synthetic construct
  misc_feature 1..20: note = CRISPR gRNA sequence
  source 1..20: mol_type = other DNA
aacttgcatcagatattgct

SEQ ID NO: 89506 - DNA, 20 bp, synthetic construct
  misc_feature 1..20: note = CRISPR gRNA sequence
  source 1..20: mol_type = other DNA
acttgcatcagatattgcta

SEQ ID NO: 89507 - DNA, 20 bp, synthetic construct
  misc_feature 1..20: note = CRISPR gRNA sequence
  source 1..20: mol_type = other DNA
gcatcagatattgctacagt

SEQ ID NO: 89508 - DNA, 20 bp, synthetic construct
  misc_feature 1..20: note = CRISPR gRNA sequence
  source 1..20: mol_type = other DNA
catcagatattgctacagtg

SEQ ID NO: 89509 - DNA, 20 bp, synthetic construct
  misc_feature 1..20: note = CRISPR gRNA sequence
  source 1..20: mol_type = other DNA
ctacagtggcataaggagga

SEQ ID NO: 89510 - DNA, 20 bp, synthetic construct
  misc_feature 1..20: note = CRISPR gRNA sequence
  source 1..20: mol_type = other DNA
cagtggcataaggaggaaga

SEQ ID NO: 89511 - DNA, 20 bp, synthetic construct
  misc_feature 1..20: note = CRISPR gRNA sequence
  source 1..20: mol_type = other DNA
ggtgtctatgccacccctgc

SEQ ID NO: 89512 - DNA, 20 bp, synthetic construct
  misc_feature 1..20: note = CRISPR gRNA sequence
  source 1..20: mol_type = other DNA
gtgtctatgccacccctgcc

SEQ ID NO: 89513 - DNA, 20 bp, synthetic construct
  misc_feature 1..20: note = CRISPR gRNA sequence
  source 1..20: mol_type = other DNA
tgccacccctgcctggactt

SEQ ID NO: 89514 - DNA, 20 bp, synthetic construct
  misc_feature 1..20: note = CRISPR gRNA sequence
  source 1..20: mol_type = other DNA
cctggacttgacctaaaggg

SEQ ID NO: 89515 - DNA, 20 bp, synthetic construct
  misc_feature 1..20: note = CRISPR gRNA sequence
  source 1..20: mol_type = other DNA
gacttgacctaaagggttct

SEQ ID NO: 89516 - DNA, 20 bp, synthetic construct
  misc_feature 1..20: note = CRISPR gRNA sequence
  source 1..20: mol_type = other DNA
gacctaaagggttctgagag

SEQ ID NO: 89517 - DNA, 20 bp, synthetic construct
  misc_feature 1..20: note = CRISPR gRNA sequence
  source 1..20: mol_type = other DNA
acctaaagggttctgagagt

SEQ ID NO: 89518 - DNA, 20 bp, synthetic construct
  misc_feature 1..20: note = CRISPR gRNA sequence
  source 1..20: mol_type = other DNA
aagggttctgagagtgtaag

SEQ ID NO: 89519 - DNA, 20 bp, synthetic construct
  misc_feature 1..20: note = CRISPR gRNA sequence
  source 1..20: mol_type = other DNA
tgagagtgtaagtaccaaat

SEQ ID NO: 89520 - DNA, 20 bp, synthetic construct
  misc_feature 1..20: note = CRISPR gRNA sequence
  source 1..20: mol_type = other DNA
agagtgtaagtaccaaatca

SEQ ID NO: 89521 - DNA, 20 bp, synthetic construct
  misc_feature 1..20: note = CRISPR gRNA sequence
  source 1..20: mol_type = other DNA
ccaattccactcttctctcc

SEQ ID NO: 89522 - DNA, 20 bp, synthetic construct
  misc_feature 1..20: note = CRISPR gRNA sequence
  source 1..20: mol_type = other DNA
caattccactcttctctccc

SEQ ID NO: 89523 - DNA, 20 bp, synthetic construct
  misc_feature 1..20: note = CRISPR gRNA sequence
  source 1..20: mol_type = other DNA
cactcttctctcccaggtaa

SEQ ID NO: 89524 - DNA, 20 bp, synthetic construct
  misc_feature 1..20: note = CRISPR gRNA sequence
  source 1..20: mol_type = other DNA
ttctctcccaggtaaaagtc

SEQ ID NO: 89525 - DNA, 20 bp, synthetic construct
  misc_feature 1..20: note = CRISPR gRNA sequence
  source 1..20: mol_type = other DNA
ctctcccaggtaaaagtcag

SEQ ID NO: 89526 - DNA, 20 bp, synthetic construct
  misc_feature 1..20: note = CRISPR gRNA sequence
  source 1..20: mol_type = other DNA
tctcccaggtaaaagtcaga

SEQ ID NO: 89527 - DNA, 20 bp, synthetic construct
  misc_feature 1..20: note = CRISPR gRNA sequence
  source 1..20: mol_type = other DNA
tcccaggtaaaagtcagagg

SEQ ID NO: 89528 - DNA, 20 bp, synthetic construct
  misc_feature 1..20: note = CRISPR gRNA sequence
  source 1..20: mol_type = other DNA
ccaggtaaaagtcagaggtc

SEQ ID NO: 89529 - DNA, 20 bp, synthetic construct
  misc_feature 1..20: note = CRISPR gRNA sequence
  source 1..20: mol_type = other DNA
tggggcatgttttgagggct

SEQ ID NO: 89530 - DNA, 20 bp, synthetic construct
  misc_feature 1..20: note = CRISPR gRNA sequence
  source 1..20: mol_type = other DNA
ggggcatgttttgagggcta

SEQ ID NO: 89531 - DNA, 20 bp, synthetic construct
  misc_feature 1..20: note = CRISPR gRNA sequence
  source 1..20: mol_type = other DNA
gggcatgttttgagggctaa

SEQ ID NO: 89532 - DNA, 20 bp, synthetic construct
  misc_feature 1..20: note = CRISPR gRNA sequence
  source 1..20: mol_type = other DNA
tgagggctaacagcctcagt

SEQ ID NO: 89533 - DNA, 20 bp, synthetic construct
  misc_feature 1..20: note = CRISPR gRNA sequence
  source 1..20: mol_type = other DNA
gagggctaacagcctcagtc

SEQ ID NO: 89534 - DNA, 20 bp, synthetic construct
  misc_feature 1..20: note = CRISPR gRNA sequence
  source 1..20: mol_type = other DNA
agggctaacagcctcagtca

SEQ ID NO: 89535 - DNA, 20 bp, synthetic construct
  misc_feature 1..20: note = CRISPR gRNA sequence
  source 1..20: mol_type = other DNA
acagcctcagtcattatgta

SEQ ID NO: 89536 - DNA, 20 bp, synthetic construct
  misc_feature 1..20: note = CRISPR gRNA sequence
  source 1..20: mol_type = other DNA
agtcattatgtacatagctt

SEQ ID NO: 89537 - DNA, 20 bp, synthetic construct
  misc_feature 1..20: note = CRISPR gRNA sequence
  source 1..20: mol_type = other DNA
tgtacatagcttctaggtat

SEQ ID NO: 89538 - DNA, 20 bp, synthetic construct
  misc_feature 1..20: note = CRISPR gRNA sequence
  source 1..20: mol_type = other DNA
ctaggtatgatgttcccttc

SEQ ID NO: 89539 - DNA, 20 bp, synthetic construct
  misc_feature 1..20: note = CRISPR gRNA sequence
  source 1..20: mol_type = other DNA
taggtatgatgttcccttct

SEQ ID NO: 89540 - DNA, 20 bp, synthetic construct
  misc_feature 1..20: note = CRISPR gRNA sequence
  source 1..20: mol_type = other DNA
ggtatgatgttcccttctgc

SEQ ID NO: 89541 - DNA, 20 bp, synthetic construct
  misc_feature 1..20: note = CRISPR gRNA sequence
  source 1..20: mol_type = other DNA
ccttctgccaaccctgtagc

SEQ ID NO: 89542 - DNA, 20 bp, synthetic construct
  misc_feature 1..20: note = CRISPR gRNA sequence
  source 1..20: mol_type = other DNA
ctgccaaccctgtagctgag

SEQ ID NO: 89543 - DNA, 20 bp, synthetic construct
  misc_feature 1..20: note = CRISPR gRNA sequence
  source 1..20: mol_type = other DNA
tgccaaccctgtagctgagg

SEQ ID NO: 89544 - DNA, 20 bp, synthetic construct
  misc_feature 1..20: note = CRISPR gRNA sequence
  source 1..20: mol_type = other DNA
ccaaccctgtagctgaggca

SEQ ID NO: 89545 - DNA, 20 bp, synthetic construct
  misc_feature 1..20: note = CRISPR gRNA sequence
  source 1..20: mol_type = other DNA
tagctgaggcagaggatgaa

SEQ ID NO: 89546 - DNA, 20 bp, synthetic construct
  misc_feature 1..20: note = CRISPR gRNA sequence
  source 1..20: mol_type = other DNA
aggcagaggatgaagagaac

SEQ ID NO: 89547 - DNA, 20 bp, synthetic construct
  misc_feature 1..20: note = CRISPR gRNA sequence
  source 1..20: mol_type = other DNA
gtgggcttctgcaatgggat

SEQ ID NO: 89548 - DNA, 20 bp, synthetic construct
  misc_feature 1..20: note = CRISPR gRNA sequence
  source 1..20: mol_type = other DNA
tgggcttctgcaatgggata

SEQ ID NO: 89549 - DNA, 20 bp, synthetic construct
  misc_feature 1..20: note = CRISPR gRNA sequence
  source 1..20: mol_type = other DNA
ctgcaatgggataggtagag

SEQ ID NO: 89550 - DNA, 20 bp, synthetic construct
  misc_feature 1..20: note = CRISPR gRNA sequence
  source 1..20: mol_type = other DNA
tgcaatgggataggtagagg

SEQ ID NO: 89551 - DNA, 20 bp, synthetic construct
  misc_feature 1..20: note = CRISPR gRNA sequence
  source 1..20: mol_type = other DNA
caatgggataggtagaggct

SEQ ID NO: 89552 - DNA, 20 bp, synthetic construct
  misc_feature 1..20: note = CRISPR gRNA sequence
  source 1..20: mol_type = other DNA
ctcccatccccagtctggtc

SEQ ID NO: 89553 - DNA, 20 bp, synthetic construct
  misc_feature 1..20: note = CRISPR gRNA sequence
  source 1..20: mol_type = other DNA
ccatccccagtctggtctca

SEQ ID NO: 89554 - DNA, 20 bp, synthetic construct
  misc_feature 1..20: note = CRISPR gRNA sequence
  source 1..20: mol_type = other DNA
gtctcagctttggtcaatag

SEQ ID NO: 89555 - DNA, 20 bp, synthetic construct
  misc_feature 1..20: note = CRISPR gRNA sequence
  source 1..20: mol_type = other DNA
agctttggtcaatagtcttt

SEQ ID NO: 89556 - DNA, 20 bp, synthetic construct
  misc_feature 1..20: note = CRISPR gRNA sequence
  source 1..20: mol_type = other DNA
tggtcaatagtctttgatct

SEQ ID NO: 89557 - DNA, 20 bp, synthetic construct
  misc_feature 1..20: note = CRISPR gRNA sequence
  source 1..20: mol_type = other DNA
ggtcaatagtctttgatctc

SEQ ID NO: 89558 - DNA, 20 bp, synthetic construct
  misc_feature 1..20: note = CRISPR gRNA sequence
  source 1..20: mol_type = other DNA
gtcaatagtctttgatctct

SEQ ID NO: 89559 - DNA, 20 bp, synthetic construct
  misc_feature 1..20: note = CRISPR gRNA sequence
  source 1..20: mol_type = other DNA
tgatctctgacaagagagga

SEQ ID NO: 89560 - DNA, 20 bp, synthetic construct
  misc_feature 1..20: note = CRISPR gRNA sequence
  source 1..20: mol_type = other DNA
gatctctgacaagagaggag

SEQ ID NO: 89561 - DNA, 20 bp, synthetic construct
  misc_feature 1..20: note = CRISPR gRNA sequence
  source 1..20: mol_type = other DNA
atctctgacaagagaggagg

SEQ ID NO: 89562 - DNA, 20 bp, synthetic construct
  misc_feature 1..20: note = CRISPR gRNA sequence
  source 1..20: mol_type = other DNA
tgacaagagaggaggcaagg

SEQ ID NO: 89563 - DNA, 20 bp, synthetic construct
  misc_feature 1..20: note = CRISPR gRNA sequence
  source 1..20: mol_type = other DNA
acaagagaggaggcaagggt

SEQ ID NO: 89564 - DNA, 20 bp, synthetic construct
  misc_feature 1..20: note = CRISPR gRNA sequence
  source 1..20: mol_type = other DNA
tttaatttggagtgtgattg

SEQ ID NO: 89565 - DNA, 20 bp, synthetic construct
  misc_feature 1..20: note = CRISPR gRNA sequence
  source 1..20: mol_type = other DNA
taatttggagtgtgattggg

SEQ ID NO: 89566 - DNA, 20 bp, synthetic construct
  misc_feature 1..20: note = CRISPR gRNA sequence
  source 1..20: mol_type = other DNA
aatttggagtgtgattgggc

SEQ ID NO: 89567 - DNA, 20 bp, synthetic construct
  misc_feature 1..20: note = CRISPR gRNA sequence
  source 1..20: mol_type = other DNA
atttggagtgtgattgggca

SEQ ID NO: 89568 - DNA, 20 bp, synthetic construct
  misc_feature 1..20: note = CRISPR gRNA sequence
  source 1..20: mol_type = other DNA
ggagtgtgattgggcatgtc

SEQ ID NO: 89569 - DNA, 20 bp, synthetic construct
  misc_feature 1..20: note = CRISPR gRNA sequence
  source 1..20: mol_type = other DNA
gagtgtgattgggcatgtcc

SEQ ID NO: 89570 - DNA, 20 bp, synthetic construct
  misc_feature 1..20: note = CRISPR gRNA sequence
  source 1..20: mol_type = other DNA
ggcatgtccttccccacttc

SEQ ID NO: 89571 - DNA, 20 bp, synthetic construct
  misc_feature 1..20: note = CRISPR gRNA sequence
  source 1..20: mol_type = other DNA
ccccacttcagccagaaatg

SEQ ID NO: 89572 - DNA, 20 bp, synthetic construct
  misc_feature 1..20: note = CRISPR gRNA sequence
  source 1..20: mol_type = other DNA
cccacttcagccagaaatgg

SEQ ID NO: 89573 - DNA, 20 bp, synthetic construct
  misc_feature 1..20: note = CRISPR gRNA sequence
  source 1..20: mol_type = other DNA
cagccagaaatgggcccaga

SEQ ID NO: 89574 - DNA, 20 bp, synthetic construct
  misc_feature 1..20: note = CRISPR gRNA sequence
  source 1..20: mol_type = other DNA
agccagaaatgggcccagaa

SEQ ID NO: 89575 - DNA, 20 bp, synthetic construct
  misc_feature 1..20: note = CRISPR gRNA sequence
  source 1..20: mol_type = other DNA
gagatgaactggtggaggca

SEQ ID NO: 89576 - DNA, 20 bp, synthetic construct
  misc_feature 1..20: note = CRISPR gRNA sequence
  source 1..20: mol_type = other DNA
gtggaggcagcgtgtgccct

SEQ ID NO: 89577 - DNA, 20 bp, synthetic construct
  misc_feature 1..20: note = CRISPR gRNA sequence
  source 1..20: mol_type = other DNA
acctgtgactgggcagagcg

SEQ ID NO: 89578 - DNA, 20 bp, synthetic construct
  misc_feature 1..20: note = CRISPR gRNA sequence
  source 1..20: mol_type = other DNA
tgactgggcagagcggatcc

SEQ ID NO: 89579 - DNA, 20 bp, synthetic construct
  misc_feature 1..20: note = CRISPR gRNA sequence
  source 1..20: mol_type = other DNA
ggcagagcggatcctgaaac

SEQ ID NO: 89580 - DNA, 20 bp, synthetic construct
  misc_feature 1..20: note = CRISPR gRNA sequence
  source 1..20: mol_type = other DNA
aaacggtccttcagttccat

SEQ ID NO: 89581 - DNA, 20 bp, synthetic construct
  misc_feature 1..20: note = CRISPR gRNA sequence
  source 1..20: mol_type = other DNA
cagttccatcgttgaggtcg

SEQ ID NO: 89582 - DNA, 20 bp, synthetic construct
  misc_feature 1..20: note = CRISPR gRNA sequence
  source 1..20: mol_type = other DNA
agttccatcgttgaggtcgc

SEQ ID NO: 89583 - DNA, 20 bp, synthetic construct
  misc_feature 1..20: note = CRISPR gRNA sequence
  source 1..20: mol_type = other DNA
catcgttgaggtcgcccgct

SEQ ID NO: 89584 - DNA, 20 bp, synthetic construct
  misc_feature 1..20: note = CRISPR gRNA sequence
  source 1..20: mol_type = other DNA
aggtcgcccgcttcctgcta

SEQ ID NO: 89585 - DNA, 20 bp, synthetic construct
  misc_feature 1..20: note = CRISPR gRNA sequence
  source 1..20: mol_type = other DNA
cctgctacagcagcatctca

SEQ ID NO: 89586 - DNA, 20 bp, synthetic construct
  misc_feature 1..20: note = CRISPR gRNA sequence
  source 1..20: mol_type = other DNA
ctgctacagcagcatctcat

SEQ ID NO: 89587 - DNA, 20 bp, synthetic construct
  misc_feature 1..20: note = CRISPR gRNA sequence
  source 1..20: mol_type = other DNA
ctacagcagcatctcatctc

SEQ ID NO: 89588 - DNA, 20 bp, synthetic construct
  misc_feature 1..20: note = CRISPR gRNA sequence
  source 1..20: mol_type = other DNA
cagcagcatctcatctctgc

SEQ ID NO: 89589 - DNA, 20 bp, synthetic construct
  misc_feature 1..20: note = CRISPR gRNA sequence
  source 1..20: mol_type = other DNA
atctctgcccgatctgcaca

SEQ ID NO: 89590 - DNA, 20 bp, synthetic construct
  misc_feature 1..20: note = CRISPR gRNA sequence
  source 1..20: mol_type = other DNA
tgcccgatctgcacatgccc

SEQ ID NO: 89591 - DNA, 20 bp, synthetic construct
  misc_feature 1..20: note = CRISPR gRNA sequence
  source 1..20: mol_type = other DNA
cccgatctgcacatgcccat

SEQ ID NO: 89592 - DNA, 20 bp, synthetic construct
  misc_feature 1..20: note = CRISPR gRNA sequence
  source 1..20: mol_type = other DNA
cacatgcccatgtgcttaag

SEQ ID NO: 89593 - DNA, 20 bp, synthetic construct
  misc_feature 1..20: note = CRISPR gRNA sequence
  source 1..20: mol_type = other DNA
aaggccatggggctcgctgg

SEQ ID NO: 89594 - DNA, 20 bp, synthetic construct
  misc_feature 1..20: note = CRISPR gRNA sequence
  source 1..20: mol_type = other DNA
aggccatggggctcgctggt

SEQ ID NO: 89595 - DNA, 20 bp, synthetic construct
  misc_feature 1..20: note = CRISPR gRNA sequence
  source 1..20: mol_type = other DNA
gctggtgtgttgaccctctc

SEQ ID NO: 89596 - DNA, 20 bp, synthetic construct
  misc_feature 1..20: note = CRISPR gRNA sequence
  source 1..20: mol_type = other DNA
gtgtgttgaccctctcttat

SEQ ID NO: 89597 - DNA, 20 bp, synthetic construct
  misc_feature 1..20: note = CRISPR gRNA sequence
  source 1..20: mol_type = other DNA
accctctcttatgtctcagc

SEQ ID NO: 89598 - DNA, 20 bp, synthetic construct
  misc_feature 1..20: note = CRISPR gRNA sequence
  source 1..20: mol_type = other DNA
tcttatgtctcagcaaccct

SEQ ID NO: 89599 - DNA, 20 bp, synthetic construct
  misc_feature 1..20: note = CRISPR gRNA sequence
  source 1..20: mol_type = other DNA
ttatgtctcagcaaccctga

SEQ ID NO: 89600 - DNA, 20 bp, synthetic construct
  misc_feature 1..20: note = CRISPR gRNA sequence
  source 1..20: mol_type = other DNA
atgtctcagcaaccctgagc

SEQ ID NO: 89601 - DNA, 20 bp, synthetic construct
  misc_feature 1..20: note = CRISPR gRNA sequence
  source 1..20: mol_type = other DNA
tgtctcagcaaccctgagcc

SEQ ID NO: 89602 - DNA, 20 bp, synthetic construct
  misc_feature 1..20: note = CRISPR gRNA sequence
  source 1..20: mol_type = other DNA
agcaaccctgagccactttc

SEQ ID NO: 89603 - DNA, 20 bp, synthetic construct
  misc_feature 1..20: note = CRISPR gRNA sequence
  source 1..20: mol_type = other DNA
agccactttcagcttcagtg

SEQ ID NO: 89604 - DNA, 20 bp, synthetic construct
  misc_feature 1..20: note = CRISPR gRNA sequence
  source 1..20: mol_type = other DNA
tcagcttcagtggccctccc

SEQ ID NO: 89605 - DNA, 20 bp, synthetic construct
  misc_feature 1..20: note = CRISPR gRNA sequence
  source 1..20: mol_type = other DNA
cagcttcagtggccctccca

SEQ ID NO: 89606 - DNA, 20 bp, synthetic construct
  misc_feature 1..20: note = CRISPR gRNA sequence
  source 1..20: mol_type = other DNA
agcttcagtggccctcccac

SEQ ID NO: 89607 - DNA, 20 bp, synthetic construct
  misc_feature 1..20: note = CRISPR gRNA sequence
  source 1..20: mol_type = other DNA
cagtggccctcccacacact

SEQ ID NO: 89608 - DNA, 20 bp, synthetic construct
  misc_feature 1..20: note = CRISPR gRNA sequence
  source 1..20: mol_type = other DNA
agtggccctcccacacacta

SEQ ID NO: 89609 - DNA, 20 bp, synthetic construct
  misc_feature 1..20: note = CRISPR gRNA sequence
  source 1..20: mol_type = other DNA
ccacacactagaatagagac

SEQ ID NO: 89610 - DNA, 20 bp, synthetic construct
  misc_feature 1..20: note = CRISPR gRNA sequence
  source 1..20: mol_type = other DNA
gaatagagacaccttggatt

SEQ ID NO: 89611 - DNA, 20 bp, synthetic construct
  misc_feature 1..20: note = CRISPR gRNA sequence
  source 1..20: mol_type = other DNA
ggatttgccccctcttcctg

SEQ ID NO: 89612 - DNA, 20 bp, synthetic construct
  misc_feature 1..20: note = CRISPR gRNA sequence
  source 1..20: mol_type = other DNA
gatttgccccctcttcctgg

SEQ ID NO: 89613 - DNA, 20 bp, synthetic construct
  misc_feature 1..20: note = CRISPR gRNA sequence
  source 1..20: mol_type = other DNA
gccccctcttcctggagacc

SEQ ID NO: 89614 - DNA, 20 bp, synthetic construct
  misc_feature 1..20: note = CRISPR gRNA sequence
  source 1..20: mol_type = other DNA
ccccctcttcctggagaccc

SEQ ID NO: 89615 - DNA, 20 bp, synthetic construct
  misc_feature 1..20: note = CRISPR gRNA sequence
  source 1..20: mol_type = other DNA
ttcctggagacccttctaag

SEQ ID NO: 89616 - DNA, 20 bp, synthetic construct
  misc_feature 1..20: note = CRISPR gRNA sequence
  source 1..20: mol_type = other DNA
cctggagacccttctaagac

SEQ ID NO: 89617 - DNA, 20 bp, synthetic construct
  misc_feature 1..20: note = CRISPR gRNA sequence
  source 1..20: mol_type = other DNA
ctggagacccttctaagaca

SEQ ID NO: 89618 - DNA, 20 bp, synthetic construct
  misc_feature 1..20: note = CRISPR gRNA sequence
  source 1..20: mol_type = other DNA
gagacccttctaagacatgc

SEQ ID NO: 89619 - DNA, 20 bp, synthetic construct
  misc_feature 1..20: note = CRISPR gRNA sequence
  source 1..20: mol_type = other DNA
ctaagacatgctttagcacc

SEQ ID NO: 89620 - DNA, 20 bp, synthetic construct
  misc_feature 1..20: note = CRISPR gRNA sequence
  source 1..20: mol_type = other DNA
taagacatgctttagcaccc

SEQ ID NO: 89621 - DNA, 20 bp, synthetic construct
  misc_feature 1..20: note = CRISPR gRNA sequence
  source 1..20: mol_type = other DNA
agacatgctttagcacccca

SEQ ID NO: 89622 - DNA, 20 bp, synthetic construct
  misc_feature 1..20: note = CRISPR gRNA sequence
  source 1..20: mol_type = other DNA
tagcaccccatttcctgtct

SEQ ID NO: 89623 - DNA, 20 bp, synthetic construct
  misc_feature 1..20: note = CRISPR gRNA sequence
  source 1..20: mol_type = other DNA
agcaccccatttcctgtctc

SEQ ID NO: 89624 - DNA, 20 bp, synthetic construct
  misc_feature 1..20: note = CRISPR gRNA sequence
  source 1..20: mol_type = other DNA
gcaccccatttcctgtctct

SEQ ID NO: 89625 - DNA, 20 bp, synthetic construct
  misc_feature 1..20: note = CRISPR gRNA sequence
  source 1..20: mol_type = other DNA
cctgtctctaccagtcagtc

SEQ ID NO: 89626 - DNA, 20 bp, synthetic construct
  misc_feature 1..20: note = CRISPR gRNA sequence
  source 1..20: mol_type = other DNA
ctgtctctaccagtcagtca

SEQ ID NO: 89627 - DNA, 20 bp, synthetic construct
  misc_feature 1..20: note = CRISPR gRNA sequence
  source 1..20: mol_type = other DNA
tctctaccagtcagtcaatc

SEQ ID NO: 89628 - DNA, 20 bp, synthetic construct
  misc_feature 1..20: note = CRISPR gRNA sequence
  source 1..20: mol_type = other DNA
taccagtcagtcaatcagaa

SEQ ID NO: 89629 - DNA, 20 bp, synthetic construct
  misc_feature 1..20: note = CRISPR gRNA sequence
  source 1..20: mol_type = other DNA
ccagtcagtcaatcagaatt

SEQ ID NO: 89630 - DNA, 20 bp, synthetic construct
  misc_feature 1..20: note = CRISPR gRNA sequence
  source 1..20: mol_type = other DNA
cctcactcccctattcctca

SEQ ID NO: 89631 - DNA, 20 bp, synthetic construct
  misc_feature 1..20: note = CRISPR gRNA sequence
  source 1..20: mol_type = other DNA
actcccctattcctcagttt

SEQ ID NO: 89632 - DNA, 20 bp, synthetic construct
  misc_feature 1..20: note = CRISPR gRNA sequence
  source 1..20: mol_type = other DNA
ccctattcctcagtttcctc

SEQ ID NO: 89633 - DNA, 20 bp, synthetic construct
  misc_feature 1..20: note = CRISPR gRNA sequence
  source 1..20: mol_type = other DNA
ttcctcagtttcctcctcac

SEQ ID NO: 89634 - DNA, 20 bp, synthetic construct
  misc_feature 1..20: note = CRISPR gRNA sequence
  source 1..20: mol_type = other DNA
ctcagtttcctcctcacctt

SEQ ID NO: 89635 - DNA, 20 bp, synthetic construct
  misc_feature 1..20: note = CRISPR gRNA sequence
  source 1..20: mol_type = other DNA
agtttcctcctcaccttcac

SEQ ID NO: 89636 - DNA, 20 bp, synthetic construct
  misc_feature 1..20: note = CRISPR gRNA sequence
  source 1..20: mol_type = other DNA
cctcctcaccttcactctat

SEQ ID NO: 89637 - DNA, 20 bp, synthetic construct
  misc_feature 1..20: note = CRISPR gRNA sequence
  source 1..20: mol_type = other DNA
ctcctcaccttcactctatt

SEQ ID NO: 89638 - DNA, 20 bp, synthetic construct
  misc_feature 1..20: note = CRISPR gRNA sequence
  source 1..20: mol_type = other DNA
ctcaccttcactctattacc

SEQ ID NO: 89639 - DNA, 20 bp, synthetic construct
  misc_feature 1..20: note = CRISPR gRNA sequence
  source 1..20: mol_type = other DNA
accttcactctattaccttt

SEQ ID NO: 89640 - DNA, 20 bp, synthetic construct
  misc_feature 1..20: note = CRISPR gRNA sequence
  source 1..20: mol_type = other DNA
cactctattacctttttggt

SEQ ID NO: 89641 - DNA, 20 bp, synthetic construct
  misc_feature 1..20: note = CRISPR gRNA sequence
  source 1..20: mol_type = other DNA
actctattacctttttggta

SEQ ID NO: 89642 - DNA, 20 bp, synthetic construct
  misc_feature 1..20: note = CRISPR gRNA sequence
  source 1..20: mol_type = other DNA
tattacctttttggtacctc

SEQ ID NO: 89643 - DNA, 20 bp, synthetic construct
  misc_feature 1..20: note = CRISPR gRNA sequence
  source 1..20: mol_type = other DNA
ttacctttttggtacctctg

SEQ ID NO: 89644 - DNA, 20 bp, synthetic construct
  misc_feature 1..20: note = CRISPR gRNA sequence
  source 1..20: mol_type = other DNA
cctttttggtacctctgcag

SEQ ID NO: 89645 - DNA, 20 bp, synthetic construct
  misc_feature 1..20: note = CRISPR gRNA sequence
  source 1..20: mol_type = other DNA
tttggtacctctgcagaaga

SEQ ID NO: 89646 - DNA, 20 bp, synthetic construct
  misc_feature 1..20: note = CRISPR gRNA sequence
  source 1..20: mol_type = other DNA
ttggtacctctgcagaagag

SEQ ID NO: 89647 - DNA, 20 bp, synthetic construct
  misc_feature 1..20: note = CRISPR gRNA sequence
  source 1..20: mol_type = other DNA
tggtacctctgcagaagagg

SEQ ID NO: 89648 - DNA, 20 bp, synthetic construct
  misc_feature 1..20: note = CRISPR gRNA sequence
  source 1..20: mol_type = other DNA
ggtacctctgcagaagagga

SEQ ID NO: 89649 - DNA, 20 bp, synthetic construct
  misc_feature 1..20: note = CRISPR gRNA sequence
  source 1..20: mol_type = other DNA
gtacctctgcagaagaggac

SEQ ID NO: 89650 - DNA, 20 bp, synthetic construct
  misc_feature 1..20: note = CRISPR gRNA sequence
  source 1..20: mol_type = other DNA
tgcagaagaggacgaacatg

SEQ ID NO: 89651 - DNA, 20 bp, synthetic construct
  misc_feature 1..20: note = CRISPR gRNA sequence
  source 1..20: mol_type = other DNA
cagaagaggacgaacatgca

SEQ ID NO: 89652 - DNA, 20 bp, synthetic construct
  misc_feature 1..20: note = CRISPR gRNA sequence
  source 1..20: mol_type = other DNA
gggaacggtcatctaaacca

SEQ ID NO: 89653 - DNA, 20 bp, synthetic construct
  misc_feature 1..20: note = CRISPR gRNA sequence
  source 1..20: mol_type = other DNA
aaccaaagaatggtttagag

SEQ ID NO: 89654 - DNA, 20 bp, synthetic construct
  misc_feature 1..20: note = CRISPR gRNA sequence
  source 1..20: mol_type = other DNA
agagaacccagagggtggag

SEQ ID NO: 89655 - DNA, 20 bp, synthetic construct
  misc_feature 1..20: note = CRISPR gRNA sequence
  source 1..20: mol_type = other DNA
gagaacccagagggtggagc

SEQ ID NO: 89656 - DNA, 20 bp, synthetic construct
  misc_feature 1..20: note = CRISPR gRNA sequence
  source 1..20: mol_type = other DNA
gcccaggtaaggaagtcagt

SEQ ID NO: 89657 - DNA, 20 bp, synthetic construct
  misc_feature 1..20: note = CRISPR gRNA sequence
  source 1..20: mol_type = other DNA
actttgctgtcctgggctgg

SEQ ID NO: 89658 - DNA, 20 bp, synthetic construct
  misc_feature 1..20: note = CRISPR gRNA sequence
  source 1..20: mol_type = other DNA
tgctgtcctgggctgggggc

SEQ ID NO: 89659 - DNA, 20 bp, synthetic construct
  misc_feature 1..20: note = CRISPR gRNA sequence
  source 1..20: mol_type = other DNA
gctgtcctgggctgggggct

SEQ ID NO: 89660 - DNA, 20 bp, synthetic construct
  misc_feature 1..20: note = CRISPR gRNA sequence
  source 1..20: mol_type = other DNA
ctgtcctgggctgggggctt

SEQ ID NO: 89661 - DNA, 20 bp, synthetic construct
  misc_feature 1..20: note = CRISPR gRNA sequence
  source 1..20: mol_type = other DNA
tcctgggctgggggcttagt

SEQ ID NO: 89662 - DNA, 20 bp, synthetic construct
  misc_feature 1..20: note = CRISPR gRNA sequence
  source 1..20: mol_type = other DNA
ggctgggggcttagtatatc

SEQ ID NO: 89663 - DNA, 20 bp, synthetic construct
  misc_feature 1..20: note = CRISPR gRNA sequence
  source 1..20: mol_type = other DNA
ggggcttagtatatccttct

SEQ ID NO: 89664 - DNA, 20 bp, synthetic construct
  misc_feature 1..20: note = CRISPR gRNA sequence
  source 1..20: mol_type = other DNA
agtatatccttctccaattg

SEQ ID NO: 89665 - DNA, 20 bp, synthetic construct
  misc_feature 1..20: note = CRISPR gRNA sequence
  source 1..20: mol_type = other DNA
gtatatccttctccaattgg

SEQ ID NO: 89666 - DNA, 20 bp, synthetic construct
  misc_feature 1..20: note = CRISPR gRNA sequence
  source 1..20: mol_type = other DNA
ctccaattgggtcccttgct

SEQ ID NO: 89667 - DNA, 20 bp, synthetic construct
  misc_feature 1..20: note = CRISPR gRNA sequence
  source 1..20: mol_type = other DNA
tccaattgggtcccttgctt

SEQ ID NO: 89668 - DNA, 20 bp, synthetic construct
  misc_feature 1..20: note = CRISPR gRNA sequence
  source 1..20: mol_type = other DNA
caattgggtcccttgctttt

SEQ ID NO: 89669 - DNA, 20 bp, synthetic construct
  misc_feature 1..20: note = CRISPR gRNA sequence
  source 1..20: mol_type = other DNA
ggtcccttgcttttccacct

SEQ ID NO: 89670 - DNA, 20 bp, synthetic construct
  misc_feature 1..20: note = CRISPR gRNA sequence
  source 1..20: mol_type = other DNA
gcttttccacctcctgtgcc

SEQ ID NO: 89671 - DNA, 20 bp, synthetic construct
  misc_feature 1..20: note = CRISPR gRNA sequence
  source 1..20: mol_type = other DNA
cttttccacctcctgtgcct

SEQ ID NO: 89672 - DNA, 20 bp, synthetic construct
  misc_feature 1..20: note = CRISPR gRNA sequence
  source 1..20: mol_type = other DNA
ttccacctcctgtgcctctg

SEQ ID NO: 89673 - DNA, 20 bp, synthetic construct
  misc_feature 1..20: note = CRISPR gRNA sequence
  source 1..20: mol_type = other DNA
tccacctcctgtgcctctgg

SEQ ID NO: 89674 - DNA, 20 bp, synthetic construct
  misc_feature 1..20: note = CRISPR gRNA sequence
  source 1..20: mol_type = other DNA
ccacctcctgtgcctctggc

SEQ ID NO: 89675 - DNA, 20 bp, synthetic construct
  misc_feature 1..20: note = CRISPR gRNA sequence
  source 1..20: mol_type = other DNA
cacctcctgtgcctctggcg

SEQ ID NO: 89676 - DNA, 20 bp, synthetic construct
  misc_feature 1..20: note = CRISPR gRNA sequence
  source 1..20: mol_type = other DNA
ctgtgcctctggcgtctatg

SEQ ID NO: 89677 - DNA, 20 bp, synthetic construct
  misc_feature 1..20: note = CRISPR gRNA sequence
  source 1..20: mol_type = other DNA
tgcctctggcgtctatgttt

SEQ ID NO: 89678 - DNA, 20 bp, synthetic construct
  misc_feature 1..20: note = CRISPR gRNA sequence
  source 1..20: mol_type = other DNA
tggcgtctatgtttccccca

SEQ ID NO: 89679 - DNA, 20 bp, synthetic construct
  misc_feature 1..20: note = CRISPR gRNA sequence
  source 1..20: mol_type = other DNA
gcgtctatgtttcccccaat

SEQ ID NO: 89680 - DNA, 20 bp, synthetic construct
  misc_feature 1..20: note = CRISPR gRNA sequence
  source 1..20: mol_type = other DNA
tgtttcccccaatactcatt

SEQ ID NO: 89681 - DNA, 20 bp, synthetic construct
  misc_feature 1..20: note = CRISPR gRNA sequence
  source 1..20: mol_type = other DNA
cccccaatactcattcttca

SEQ ID NO: 89682 - DNA, 20 bp, synthetic construct
  misc_feature 1..20: note = CRISPR gRNA sequence
  source 1..20: mol_type = other DNA
ccccaatactcattcttcac

SEQ ID NO: 89683 - DNA, 20 bp, synthetic construct
  misc_feature 1..20: note = CRISPR gRNA sequence
  source 1..20: mol_type = other DNA
attcttcacaccttactgtg

SEQ ID NO: 89684 - DNA, 20 bp, synthetic construct
  misc_feature 1..20: note = CRISPR gRNA sequence
  source 1..20: mol_type = other DNA
ttcacaccttactgtgttcc

SEQ ID NO: 89685 - DNA, 20 bp, synthetic construct
  misc_feature 1..20: note = CRISPR gRNA sequence
  source 1..20: mol_type = other DNA
cacaccttactgtgttcctc

SEQ ID NO: 89686 - DNA, 20 bp, synthetic construct
  misc_feature 1..20: note = CRISPR gRNA sequence
  source 1..20: mol_type = other DNA
acaccttactgtgttcctct

SEQ ID NO: 89687 - DNA, 20 bp, synthetic construct
  misc_feature 1..20: note = CRISPR gRNA sequence
  source 1..20: mol_type = other DNA
actgtgttcctctctttact

SEQ ID NO: 89688 - DNA, 20 bp, synthetic construct
  misc_feature 1..20: note = CRISPR gRNA sequence
  source 1..20: mol_type = other DNA
ctgtgttcctctctttactt

SEQ ID NO: 89689 - DNA, 20 bp, synthetic construct
  misc_feature 1..20: note = CRISPR gRNA sequence
  source 1..20: mol_type = other DNA
tgttcctctctttacttttt

SEQ ID NO: 89690 - DNA, 20 bp, synthetic construct
  misc_feature 1..20: note = CRISPR gRNA sequence
  source 1..20: mol_type = other DNA
ctctctttactttttagcct

SEQ ID NO: 89691 - DNA, 20 bp, synthetic construct
  misc_feature 1..20: note = CRISPR gRNA sequence
  source 1..20: mol_type = other DNA
tctttactttttagcctcct

SEQ ID NO: 89692 - DNA, 20 bp, synthetic construct
  misc_feature 1..20: note = CRISPR gRNA sequence
  source 1..20: mol_type = other DNA
tttactttttagcctcctaa

SEQ ID NO: 89693 - DNA, 20 bp, synthetic construct
  misc_feature 1..20: note = CRISPR gRNA sequence
  source 1..20: mol_type = other DNA
tactttttagcctcctaagg

SEQ ID NO: 89694 - DNA, 20 bp, synthetic construct
  misc_feature 1..20: note = CRISPR gRNA sequence
  source 1..20: mol_type = other DNA
actttttagcctcctaagga

SEQ ID NO: 89695 - DNA, 20 bp, synthetic construct
  misc_feature 1..20: note = CRISPR gRNA sequence
  source 1..20: mol_type = other DNA
ctttttagcctcctaaggat

SEQ ID NO: 89696 - DNA, 20 bp, synthetic construct
  misc_feature 1..20: note = CRISPR gRNA sequence
  source 1..20: mol_type = other DNA
tttagcctcctaaggatctg

SEQ ID NO: 89697 - DNA, 20 bp, synthetic construct
  misc_feature 1..20: note = CRISPR gRNA sequence
  source 1..20: mol_type = other DNA
ttagcctcctaaggatctgg

SEQ ID NO: 89698 - DNA, 20 bp, synthetic construct
  misc_feature 1..20: note = CRISPR gRNA sequence
  source 1..20: mol_type = other DNA
tagcctcctaaggatctgga

SEQ ID NO: 89699 - DNA, 20 bp, synthetic construct
  misc_feature 1..20: note = CRISPR gRNA sequence
  source 1..20: mol_type = other DNA
agcctcctaaggatctggaa

SEQ ID NO: 89700 - DNA, 20 bp, synthetic construct
  misc_feature 1..20: note = CRISPR gRNA sequence
  source 1..20: mol_type = other DNA
gcctcctaaggatctggaag

SEQ ID NO: 89701 - DNA, 20 bp, synthetic construct
  misc_feature 1..20: note = CRISPR gRNA sequence
  source 1..20: mol_type = other DNA
ctaaggatctggaagcccga

SEQ ID NO: 89702 - DNA, 20 bp, synthetic construct
  misc_feature 1..20: note = CRISPR gRNA sequence
  source 1..20: mol_type = other DNA
aggatctggaagcccgaact

SEQ ID NO: 89703 - DNA, 20 bp, synthetic construct
  misc_feature 1..20: note = CRISPR gRNA sequence
  source 1..20: mol_type = other DNA
gaagcccgaactggggccgg

SEQ ID NO: 89704 - DNA, 20 bp, synthetic construct
  misc_feature 1..20: note = CRISPR gRNA sequence
  source 1..20: mol_type = other DNA
gggccggtcctctcgcacgt

SEQ ID NO: 89705 - DNA, 20 bp, synthetic construct
  misc_feature 1..20: note = CRISPR gRNA sequence
  source 1..20: mol_type = other DNA
tcgcacgtggagagcggaag

SEQ ID NO: 89706 - DNA, 20 bp, synthetic construct
  misc_feature 1..20: note = CRISPR gRNA sequence
  source 1..20: mol_type = other DNA
gcacgtggagagcggaagaa

SEQ ID NO: 89707 - DNA, 20 bp, synthetic construct
  misc_feature 1..20: note = CRISPR gRNA sequence
  source 1..20: mol_type = other DNA
agagctcggccccaggagcc

SEQ ID NO: 89708 - DNA, 20 bp, synthetic construct
  misc_feature 1..20: note = CRISPR gRNA sequence
  source 1..20: mol_type = other DNA
ggccccaggagccaataacc

SEQ ID NO: 89709 - DNA, 20 bp, synthetic construct
  misc_feature 1..20: note = CRISPR gRNA sequence
  source 1..20: mol_type = other DNA
caggttaatgccctagtggc

SEQ ID NO: 89710 - DNA, 20 bp, synthetic construct
  misc_feature 1..20: note = CRISPR gRNA sequence
  source 1..20: mol_type = other DNA
atgccctagtggctcggctg

SEQ ID NO: 89711 - DNA, 20 bp, synthetic construct
  misc_feature 1..20: note = CRISPR gRNA sequence
  source 1..20: mol_type = other DNA
gtggctcggctgcctctgct

SEQ ID NO: 89712 - DNA, 20 bp, synthetic construct
  misc_feature 1..20: note = CRISPR gRNA sequence
  source 1..20: mol_type = other DNA
ggctgcctctgctccttccc

SEQ ID NO: 89713 - DNA, 20 bp, synthetic construct
  misc_feature 1..20: note = CRISPR gRNA sequence
  source 1..20: mol_type = other DNA
cctctgctccttccccgggc

SEQ ID NO: 89714 - DNA, 20 bp, synthetic construct
  misc_feature 1..20: note = CRISPR gRNA sequence
  source 1..20: mol_type = other DNA
tgctccttccccgggcccct

SEQ ID NO: 89715 - DNA, 20 bp, synthetic construct
  misc_feature 1..20: note = CRISPR gRNA sequence
  source 1..20: mol_type = other DNA
ctccttccccgggcccctcg

SEQ ID NO: 89716 - DNA, 20 bp, synthetic construct
  misc_feature 1..20: note = CRISPR gRNA sequence
  source 1..20: mol_type = other DNA
cttccccgggcccctcgctc

SEQ ID NO: 89717 - DNA, 20 bp, synthetic construct
  misc_feature 1..20: note = CRISPR gRNA sequence
  source 1..20: mol_type = other DNA
ccccgggcccctcgctcact

SEQ ID NO: 89718 - DNA, 20 bp, synthetic construct
  misc_feature 1..20: note = CRISPR gRNA sequence
  source 1..20: mol_type = other DNA
cccgggcccctcgctcacta

SEQ ID NO: 89719 - DNA, 20 bp, synthetic construct
  misc_feature 1..20: note = CRISPR gRNA sequence
  source 1..20: mol_type = other DNA
gctcactaattccgccaatc

SEQ ID NO: 89720 - DNA, 20 bp, synthetic construct
  misc_feature 1..20: note = CRISPR gRNA sequence
  source 1..20: mol_type = other DNA
actaattccgccaatcccag

SEQ ID NO: 89721 - DNA, 20 bp, synthetic construct
  misc_feature 1..20: note = CRISPR gRNA sequence
  source 1..20: mol_type = other DNA
attccgccaatcccagtctc

SEQ ID NO: 89722 - DNA, 20 bp, synthetic construct
  misc_feature 1..20: note = CRISPR gRNA sequence
  source 1..20: mol_type = other DNA
cgccaatcccagtctctcca

SEQ ID NO: 89723 - DNA, 20 bp, synthetic construct
  misc_feature 1..20: note = CRISPR gRNA sequence
  source 1..20: mol_type = other DNA
tccacctattctggccccca

SEQ ID NO: 89724 - DNA, 20 bp, synthetic construct
  misc_feature 1..20: note = CRISPR gRNA sequence
  source 1..20: mol_type = other DNA
cacctattctggcccccagg

SEQ ID NO: 89725 - DNA, 20 bp, synthetic construct
  misc_feature 1..20: note = CRISPR gRNA sequence
  source 1..20: mol_type = other DNA
ttctggcccccaggctttct

SEQ ID NO: 89726 - DNA, 20 bp, synthetic construct
  misc_feature 1..20: note = CRISPR gRNA sequence
  source 1..20: mol_type = other DNA
tggcccccaggctttcttca

SEQ ID NO: 89727 - DNA, 20 bp, synthetic construct
  misc_feature 1..20: note = CRISPR gRNA sequence
  source 1..20: mol_type = other DNA
gcccccaggctttcttcagg

SEQ ID NO: 89728 - DNA, 20 bp, synthetic construct
  misc_feature 1..20: note = CRISPR gRNA sequence
  source 1..20: mol_type = other DNA
tcttcaggtgccctgaaagt

SEQ ID NO: 89729 - DNA, 20 bp, synthetic construct
  misc_feature 1..20: note = CRISPR gRNA sequence
  source 1..20: mol_type = other DNA
cttcaggtgccctgaaagtg

SEQ ID NO: 89730 - DNA, 20 bp, synthetic construct
  misc_feature 1..20: note = CRISPR gRNA sequence
  source 1..20: mol_type = other DNA
ttcaggtgccctgaaagtgg

SEQ ID NO: 89731 - DNA, 20 bp, synthetic construct
  misc_feature 1..20: note = CRISPR gRNA sequence
  source 1..20: mol_type = other DNA
caggtgccctgaaagtggct

SEQ ID NO: 89732 - DNA, 20 bp, synthetic construct
  misc_feature 1..20: note = CRISPR gRNA sequence
  source 1..20: mol_type = other DNA
aggtgccctgaaagtggcta

SEQ ID NO: 89733 - DNA, 20 bp, synthetic construct
  misc_feature 1..20: note = CRISPR gRNA sequence
  source 1..20: mol_type = other DNA
aaagtggctacactgcctct

SEQ ID NO: 89734 - DNA, 20 bp, synthetic construct
  misc_feature 1..20: note = CRISPR gRNA sequence
  source 1..20: mol_type = other DNA
cactgcctctgtctagtagg

SEQ ID NO: 89735 - DNA, 20 bp, synthetic construct
  misc_feature 1..20: note = CRISPR gRNA sequence
  source 1..20: mol_type = other DNA
cctctgtctagtagggccgg

SEQ ID NO: 89736 - DNA, 20 bp, synthetic construct
  misc_feature 1..20: note = CRISPR gRNA sequence
  source 1..20: mol_type = other DNA
tgtctagtagggccggggca

SEQ ID NO: 89737 - DNA, 20 bp, synthetic construct
  misc_feature 1..20: note = CRISPR gRNA sequence
  source 1..20: mol_type = other DNA
tctagtagggccggggcacc

SEQ ID NO: 89738 - DNA, 20 bp, synthetic construct
  misc_feature 1..20: note = CRISPR gRNA sequence
  source 1..20: mol_type = other DNA
gtagggccggggcaccccca

SEQ ID NO: 89739 - DNA, 20 bp, synthetic construct
  misc_feature 1..20: note = CRISPR gRNA sequence
  source 1..20: mol_type = other DNA
tgcccatcattaacatgatc

SEQ ID NO: 89740 - DNA, 20 bp, synthetic construct
  misc_feature 1..20: note = CRISPR gRNA sequence
  source 1..20: mol_type = other DNA
acatgatcttaccaactgtt

SEQ ID NO: 89741 - DNA, 20 bp, synthetic construct
  misc_feature 1..20: note = CRISPR gRNA sequence
  source 1..20: mol_type = other DNA
accaactgttcctgctttgc

SEQ ID NO: 89742 - DNA, 20 bp, synthetic construct
  misc_feature 1..20: note = CRISPR gRNA sequence
  source 1..20: mol_type = other DNA
ccaactgttcctgctttgcc

SEQ ID NO: 89743 - DNA, 20 bp, synthetic construct
  misc_feature 1..20: note = CRISPR gRNA sequence
  source 1..20: mol_type = other DNA
ttcctgctttgcctggacct

SEQ ID NO: 89744 - DNA, 20 bp, synthetic construct
  misc_feature 1..20: note = CRISPR gRNA sequence
  source 1..20: mol_type = other DNA
ctgctttgcctggacctgga

SEQ ID NO: 89745 - DNA, 20 bp, synthetic construct
  misc_feature 1..20: note = CRISPR gRNA sequence
  source 1..20: mol_type = other DNA
ctttgcctggacctggacct

SEQ ID NO: 89746 - DNA, 20 bp, synthetic construct
  misc_feature 1..20: note = CRISPR gRNA sequence
  source 1..20: mol_type = other DNA
tgcctggacctggacctggg

SEQ ID NO: 89747 - DNA, 20 bp, synthetic construct
  misc_feature 1..20: note = CRISPR gRNA sequence
  source 1..20: mol_type = other DNA
gcctggacctggacctgggc

SEQ ID NO: 89748 - DNA, 20 bp, synthetic construct
  misc_feature 1..20: note = CRISPR gRNA sequence
  source 1..20: mol_type = other DNA
cctggacctggacctgggcc

SEQ ID NO: 89749 - DNA, 20 bp, synthetic construct
  misc_feature 1..20: note = CRISPR gRNA sequence
  source 1..20: mol_type = other DNA
gacctggacctgggcctggg

SEQ ID NO: 89750 - DNA, 20 bp, synthetic construct
  misc_feature 1..20: note = CRISPR gRNA sequence
  source 1..20: mol_type = other DNA
gacctgggcctgggcgagct

SEQ ID NO: 89751 - DNA, 20 bp, synthetic construct
  misc_feature 1..20: note = CRISPR gRNA sequence
  source 1..20: mol_type = other DNA
ggcctgggcgagctccacct

SEQ ID NO: 89752 - DNA, 20 bp, synthetic construct
  misc_feature 1..20: note = CRISPR gRNA sequence
  source 1..20: mol_type = other DNA
ggcgagctccacctggggga

SEQ ID NO: 89753 - DNA, 20 bp, synthetic construct
  misc_feature 1..20: note = CRISPR gRNA sequence
  source 1..20: mol_type = other DNA
cacctgggggactcactcag

SEQ ID NO: 89754 - DNA, 20 bp, synthetic construct
  misc_feature 1..20: note = CRISPR gRNA sequence
  source 1..20: mol_type = other DNA
ggggactcactcagccccgg

SEQ ID NO: 89755 - DNA, 20 bp, synthetic construct
  misc_feature 1..20: note = CRISPR gRNA sequence
  source 1..20: mol_type = other DNA
actcagccccggggcacaga

SEQ ID NO: 89756 - DNA, 20 bp, synthetic construct
  misc_feature 1..20: note = CRISPR gRNA sequence
  source 1..20: mol_type = other DNA
agccccggggcacagagaac

SEQ ID NO: 89757 - DNA, 20 bp, synthetic construct
  misc_feature 1..20: note = CRISPR gRNA sequence
  source 1..20: mol_type = other DNA
aagtacctgtgagtgaggcc

SEQ ID NO: 89758 - DNA, 20 bp, synthetic construct
  misc_feature 1..20: note = CRISPR gRNA sequence
  source 1..20: mol_type = other DNA
tgagtgaggccagtgggcag

SEQ ID NO: 89759 - DNA, 20 bp, synthetic construct
  misc_feature 1..20: note = CRISPR gRNA sequence
  source 1..20: mol_type = other DNA
caccagctaaagcagcaaag

SEQ ID NO: 89760 - DNA, 20 bp, synthetic construct
  misc_feature 1..20: note = CRISPR gRNA sequence
  source 1..20: mol_type = other DNA
aagcagcaaagcaggatata

SEQ ID NO: 89761 - DNA, 20 bp, synthetic construct
  misc_feature 1..20: note = CRISPR gRNA sequence
  source 1..20: mol_type = other DNA
gaaaaaagtcaggtggaagt

SEQ ID NO: 89762 - DNA, 20 bp, synthetic construct
  misc_feature 1..20: note = CRISPR gRNA sequence
  source 1..20: mol_type = other DNA
tacccctctcaagtcagcag

SEQ ID NO: 89763 - DNA, 20 bp, synthetic construct
  misc_feature 1..20: note = CRISPR gRNA sequence
  source 1..20: mol_type = other DNA
cccctctcaagtcagcagct

SEQ ID NO: 89764 - DNA, 20 bp, synthetic construct
  misc_feature 1..20: note = CRISPR gRNA sequence
  source 1..20: mol_type = other DNA
tcaagtcagcagctgccatg

SEQ ID NO: 89765 - DNA, 20 bp, synthetic construct
  misc_feature 1..20: note = CRISPR gRNA sequence
  source 1..20: mol_type = other DNA
aagtcagcagctgccatgga

SEQ ID NO: 89766 - DNA, 20 bp, synthetic construct
  misc_feature 1..20: note = CRISPR gRNA sequence
  source 1..20: mol_type = other DNA
ccatggaatctgcccagtcc

SEQ ID NO: 89767 - DNA, 20 bp, synthetic construct
  misc_feature 1..20: note = CRISPR gRNA sequence
  source 1..20: mol_type = other DNA
cccagtcctcaaggttacca

SEQ ID NO: 89768 - DNA, 20 bp, synthetic construct
  misc_feature 1..20: note = CRISPR gRNA sequence
  source 1..20: mol_type = other DNA
aaggttaccatgggagacat

SEQ ID NO: 89769 - DNA, 20 bp, synthetic construct
  misc_feature 1..20: note = CRISPR gRNA sequence
  source 1..20: mol_type = other DNA
ccatgggagacatggggctc

SEQ ID NO: 89770 - DNA, 20 bp, synthetic construct
  misc_feature 1..20: note = CRISPR gRNA sequence
  source 1..20: mol_type = other DNA
aggaggggaaggcaactcag

SEQ ID NO: 89771 - DNA, 20 bp, synthetic construct
  misc_feature 1..20: note = CRISPR gRNA sequence
  source 1..20: mol_type = other DNA
agctggaggggcagagaggc

SEQ ID NO: 89772 - DNA, 20 bp, synthetic construct
  misc_feature 1..20: note = CRISPR gRNA sequence
  source 1..20: mol_type = other DNA
gaggggcagagaggccaggg

SEQ ID NO: 89773 - DNA, 20 bp, synthetic construct
  misc_feature 1..20: note = CRISPR gRNA sequence
  source 1..20: mol_type = other DNA
aaaagggggcagtacttgcc

SEQ ID NO: 89774 - DNA, 20 bp, synthetic construct
  misc_feature 1..20: note = CRISPR gRNA sequence
  source 1..20: mol_type = other DNA
gcccagggtcagggagatgg

SEQ ID NO: 89775 - DNA, 20 bp, synthetic construct
  misc_feature 1..20: note = CRISPR gRNA sequence
  source 1..20: mol_type = other DNA
cccagggtcagggagatggt

SEQ ID NO: 89776 - DNA, 20 bp, synthetic construct
  misc_feature 1..20: note = CRISPR gRNA sequence
  source 1..20: mol_type = other DNA
tttccaaaggaggaaggggc

SEQ ID NO: 89777 - DNA, 20 bp, synthetic construct
  misc_feature 1..20: note = CRISPR gRNA sequence
  source 1..20: mol_type = other DNA
ccaaaggaggaaggggcccc

SEQ ID NO: 89778 - DNA, 20 bp, synthetic construct
  misc_feature 1..20: note = CRISPR gRNA sequence
  source 1..20: mol_type = other DNA
caaaggaggaaggggccccg

SEQ ID NO: 89779 - DNA, 20 bp, synthetic construct
  misc_feature 1..20: note = CRISPR gRNA sequence
  source 1..20: mol_type = other DNA
ccagcataccaaagaagcag

SEQ ID NO: 89780 - DNA, 20 bp, synthetic construct
  misc_feature 1..20: note = CRISPR gRNA sequence
  source 1..20: mol_type = other DNA
ccttggtcccctcaaaagtg

SEQ ID NO: 89781 - DNA, 20 bp, synthetic construct
  misc_feature 1..20: note = CRISPR gRNA sequence
  source 1..20: mol_type = other DNA
ggtcccctcaaaagtgagtg

SEQ ID NO: 89782 - DNA, 20 bp, synthetic construct
  misc_feature 1..20: note = CRISPR gRNA sequence
  source 1..20: mol_type = other DNA
gtcccctcaaaagtgagtgt

SEQ ID NO: 89783 - DNA, 20 bp, synthetic construct
  misc_feature 1..20: note = CRISPR gRNA sequence
  source 1..20: mol_type = other DNA
aaaagtgagtgtcatcaagg

SEQ ID NO: 89784 - DNA, 20 bp, synthetic construct
  misc_feature 1..20: note = CRISPR gRNA sequence
  source 1..20: mol_type = other DNA
ttcctttggcaaagggagag

SEQ ID NO: 89785 - DNA, 20 bp, synthetic construct
  misc_feature 1..20: note = CRISPR gRNA sequence
  source 1..20: mol_type = other DNA
tcctttggcaaagggagagg

SEQ ID NO: 89786 - DNA, 20 bp, synthetic construct
  misc_feature 1..20: note = CRISPR gRNA sequence
  source 1..20: mol_type = other DNA
cctttggcaaagggagaggt

SEQ ID NO: 89787 - DNA, 20 bp, synthetic construct
  misc_feature 1..20: note = CRISPR gRNA sequence
  source 1..20: mol_type = other DNA
ctttggcaaagggagaggta

SEQ ID NO: 89788 - DNA, 20 bp, synthetic construct
  misc_feature 1..20: note = CRISPR gRNA sequence
  source 1..20: mol_type = other DNA
tggcaaagggagaggtagac

SEQ ID NO: 89789 - DNA, 20 bp, synthetic construct
  misc_feature 1..20: note = CRISPR gRNA sequence
  source 1..20: mol_type = other DNA
ggcaaagggagaggtagaca

SEQ ID NO: 89790 - DNA, 20 bp, synthetic construct
  misc_feature 1..20: note = CRISPR gRNA sequence
  source 1..20: mol_type = other DNA
gcaaagggagaggtagacac

SEQ ID NO: 89791 - DNA, 20 bp, synthetic construct
  misc_feature 1..20: note = CRISPR gRNA sequence
  source 1..20: mol_type = other DNA
caccacagggtaataaagac

SEQ ID NO: 89792 - DNA, 20 bp, synthetic construct
  misc_feature 1..20: note = CRISPR gRNA sequence
  source 1..20: mol_type = other DNA
aaaggagcatgtgcttcaaa

SEQ ID NO: 89793 - DNA, 20 bp, synthetic construct
  misc_feature 1..20: note = CRISPR gRNA sequence
  source 1..20: mol_type = other DNA
aaggagcatgtgcttcaaag

SEQ ID NO: 89794 - DNA, 20 bp, synthetic construct
  misc_feature 1..20: note = CRISPR gRNA sequence
  source 1..20: mol_type = other DNA
caaagttccttatcccagga

SEQ ID NO: 89795 - DNA, 20 bp, synthetic construct
  misc_feature 1..20: note = CRISPR gRNA sequence
  source 1..20: mol_type = other DNA
aaagttccttatcccaggag

SEQ ID NO: 89796 - DNA, 20 bp, synthetic construct
  misc_feature 1..20: note = CRISPR gRNA sequence
  source 1..20: mol_type = other DNA
cttatcccaggagcataaag

SEQ ID NO: 89797 - DNA, 20 bp, synthetic construct
  misc_feature 1..20: note = CRISPR gRNA sequence
  source 1..20: mol_type = other DNA
atcccaggagcataaagacc

SEQ ID NO: 89798 - DNA, 20 bp, synthetic construct
  misc_feature 1..20: note = CRISPR gRNA sequence
  source 1..20: mol_type = other DNA
tcccaggagcataaagaccc

SEQ ID NO: 89799 - DNA, 20 bp, synthetic construct
  misc_feature 1..20: note = CRISPR gRNA sequence
  source 1..20: mol_type = other DNA
tggggaagagtgtttatatc

SEQ ID NO: 89800 - DNA, 20 bp, synthetic construct
  misc_feature 1..20: note = CRISPR gRNA sequence
  source 1..20: mol_type = other DNA
atatccctacgttaactttg

SEQ ID NO: 89801 - DNA, 20 bp, synthetic construct
  misc_feature 1..20: note = CRISPR gRNA sequence
  source 1..20: mol_type = other DNA
tatccctacgttaactttgc

SEQ ID NO: 89802 - DNA, 20 bp, synthetic construct
  misc_feature 1..20: note = CRISPR gRNA sequence
  source 1..20: mol_type = other DNA
cgttaactttgcctagtaga

SEQ ID NO: 89803 - DNA, 20 bp, synthetic construct
  misc_feature 1..20: note = CRISPR gRNA sequence
  source 1..20: mol_type = other DNA
actttgcctagtagaggccc

SEQ ID NO: 89804 - DNA, 20 bp, synthetic construct
  misc_feature 1..20: note = CRISPR gRNA sequence
  source 1..20: mol_type = other DNA
tgcctagtagaggcccttct

SEQ ID NO: 89805 - DNA, 20 bp, synthetic construct
  misc_feature 1..20: note = CRISPR gRNA sequence
  source 1..20: mol_type = other DNA
gcctagtagaggcccttctt

SEQ ID NO: 89806 - DNA, 20 bp, synthetic construct
  misc_feature 1..20: note = CRISPR gRNA sequence
  source 1..20: mol_type = other DNA
cctagtagaggcccttcttt

SEQ ID NO: 89807 - DNA, 20 bp, synthetic construct
  misc_feature 1..20: note = CRISPR gRNA sequence
  source 1..20: mol_type = other DNA
gtagaggcccttctttgcac

SEQ ID NO: 89808 - DNA, 20 bp, synthetic construct
  misc_feature 1..20: note = CRISPR gRNA sequence
  source 1..20: mol_type = other DNA
ctttgcacttgcttctcatt

SEQ ID NO: 89809 - DNA, 20 bp, synthetic construct
  misc_feature 1..20: note = CRISPR gRNA sequence
  source 1..20: mol_type = other DNA
tttgcacttgcttctcattt

SEQ ID NO: 89810 - DNA, 20 bp, synthetic construct
  misc_feature 1..20: note = CRISPR gRNA sequence
  source 1..20: mol_type = other DNA
tgcacttgcttctcatttgg

SEQ ID NO: 89811 - DNA, 20 bp, synthetic construct
  misc_feature 1..20: note = CRISPR gRNA sequence
  source 1..20: mol_type = other DNA
gcacttgcttctcatttggc

SEQ ID NO: 89812 - DNA, 20 bp, synthetic construct
  misc_feature 1..20: note = CRISPR gRNA sequence
  source 1..20: mol_type = other DNA
cacttgcttctcatttggct

SEQ ID NO: 89813 - DNA, 20 bp, synthetic construct
  misc_feature 1..20: note = CRISPR gRNA sequence
  source 1..20: mol_type = other DNA
gcttctcatttggctattct

SEQ ID NO: 89814 - DNA, 20 bp, synthetic construct
  misc_feature 1..20: note = CRISPR gRNA sequence
  source 1..20: mol_type = other DNA
cttctcatttggctattctt

SEQ ID NO: 89815 - DNA, 20 bp, synthetic construct
  misc_feature 1..20: note = CRISPR gRNA sequence
  source 1..20: mol_type = other DNA
ctcatttggctattcttttc

SEQ ID NO: 89816 - DNA, 20 bp, synthetic construct
  misc_feature 1..20: note = CRISPR gRNA sequence
  source 1..20: mol_type = other DNA
tcatttggctattcttttcc

SEQ ID NO: 89817 - DNA, 20 bp, synthetic construct
  misc_feature 1..20: note = CRISPR gRNA sequence
  source 1..20: mol_type = other DNA
atttggctattcttttccta

SEQ ID NO: 89818 - DNA, 20 bp, synthetic construct
  misc_feature 1..20: note = CRISPR gRNA sequence
  source 1..20: mol_type = other DNA
ggctattcttttcctaagga

SEQ ID NO: 89819 - DNA, 20 bp, synthetic construct
  misc_feature 1..20: note = CRISPR gRNA sequence
  source 1..20: mol_type = other DNA
gctattcttttcctaaggaa

SEQ ID NO: 89820 - DNA, 20 bp, synthetic construct
  misc_feature 1..20: note = CRISPR gRNA sequence
  source 1..20: mol_type = other DNA
ttcttttcctaaggaagtcc

SEQ ID NO: 89821 - DNA, 20 bp, synthetic construct
  misc_feature 1..20: note = CRISPR gRNA sequence
  source 1..20: mol_type = other DNA
ttttcctaaggaagtccatt

SEQ ID NO: 89822 - DNA, 20 bp, synthetic construct
  misc_feature 1..20: note = CRISPR gRNA sequence
  source 1..20: mol_type = other DNA
ttcctaaggaagtccattct

SEQ ID NO: 89823 - DNA, 20 bp, synthetic construct
  misc_feature 1..20: note = CRISPR gRNA sequence
  source 1..20: mol_type = other DNA
tcctaaggaagtccattctc

SEQ ID NO: 89824 - DNA, 20 bp, synthetic construct
  misc_feature 1..20: note = CRISPR gRNA sequence
  source 1..20: mol_type = other DNA
cctaaggaagtccattctcc

SEQ ID NO: 89825 - DNA, 20 bp, synthetic construct
  misc_feature 1..20: note = CRISPR gRNA sequence
  source 1..20: mol_type = other DNA
ctaaggaagtccattctcct

SEQ ID NO: 89826 - DNA, 20 bp, synthetic construct
  misc_feature 1..20: note = CRISPR gRNA sequence
  source 1..20: mol_type = other DNA
aggaagtccattctcctctg

SEQ ID NO: 89827 - DNA, 20 bp, synthetic construct
  misc_feature 1..20: note = CRISPR gRNA sequence
  source 1..20: mol_type = other DNA
tcctctgtacagacagctga

SEQ ID NO: 89828 - DNA, 20 bp, synthetic construct
  misc_feature 1..20: note = CRISPR gRNA sequence
  source 1..20: mol_type = other DNA
ctctgtacagacagctgagt

SEQ ID NO: 89829 - DNA, 20 bp, synthetic construct
  misc_feature 1..20: note = CRISPR gRNA sequence
  source 1..20: mol_type = other DNA
tgtacagacagctgagtcac

SEQ ID NO: 89830 - DNA, 20 bp, synthetic construct
  misc_feature 1..20: note = CRISPR gRNA sequence
  source 1..20: mol_type = other DNA
tacagacagctgagtcaccc

SEQ ID NO: 89831 - DNA, 20 bp, synthetic construct
  misc_feature 1..20: note = CRISPR gRNA sequence
  source 1..20: mol_type = other DNA
agtcacccagtctacttagt

SEQ ID NO: 89832 - DNA, 20 bp, synthetic construct
  misc_feature 1..20: note = CRISPR gRNA sequence
  source 1..20: mol_type = other DNA
cttagtacctggttgctgcc

SEQ ID NO: 89833 - DNA, 20 bp, synthetic construct
  misc_feature 1..20: note = CRISPR gRNA sequence
  source 1..20: mol_type = other DNA
agtacctggttgctgcctct

SEQ ID NO: 89834 - DNA, 20 bp, synthetic construct
  misc_feature 1..20: note = CRISPR gRNA sequence
  source 1..20: mol_type = other DNA
gtacctggttgctgcctctg

SEQ ID NO: 89835 - DNA, 20 bp, synthetic construct
  misc_feature 1..20: note = CRISPR gRNA sequence
  source 1..20: mol_type = other DNA
gttgctgcctctgacctttt

SEQ ID NO: 89836 - DNA, 20 bp, synthetic construct
  misc_feature 1..20: note = CRISPR gRNA sequence
  source 1..20: mol_type = other DNA
ctgcctctgaccttttcagc

SEQ ID NO: 89837 - DNA, 20 bp, synthetic construct
  misc_feature 1..20: note = CRISPR gRNA sequence
  source 1..20: mol_type = other DNA
cctctgaccttttcagcttg

SEQ ID NO: 89838 - DNA, 20 bp, synthetic construct
  misc_feature 1..20: note = CRISPR gRNA sequence
  source 1..20: mol_type = other DNA
tgaccttttcagcttgatac

SEQ ID NO: 89839 - DNA, 20 bp, synthetic construct
  misc_feature 1..20: note = CRISPR gRNA sequence
  source 1..20: mol_type = other DNA
accttttcagcttgataccc

SEQ ID NO: 89840 - DNA, 20 bp, synthetic construct
  misc_feature 1..20: note = CRISPR gRNA sequence
  source 1..20: mol_type = other DNA
ttcagcttgataccctgggc

SEQ ID NO: 89841 - DNA, 20 bp, synthetic construct
  misc_feature 1..20: note = CRISPR gRNA sequence
  source 1..20: mol_type = other DNA
tcagcttgataccctgggct

SEQ ID NO: 89842 - DNA, 20 bp, synthetic construct
  misc_feature 1..20: note = CRISPR gRNA sequence
  source 1..20: mol_type = other DNA
cagcttgataccctgggctt

SEQ ID NO: 89843 - DNA, 20 bp, synthetic construct
  misc_feature 1..20: note = CRISPR gRNA sequence
  source 1..20: mol_type = other DNA
agcttgataccctgggcttt

SEQ ID NO: 89844 - DNA, 20 bp, synthetic construct
  misc_feature 1..20: note = CRISPR gRNA sequence
  source 1..20: mol_type = other DNA
gataccctgggctttagtgt

SEQ ID NO: 89845 - DNA, 20 bp, synthetic construct
  misc_feature 1..20: note = CRISPR gRNA sequence
  source 1..20: mol_type = other DNA
ataccctgggctttagtgta

SEQ ID NO: 89846 - DNA, 20 bp, synthetic construct
  misc_feature 1..20: note = CRISPR gRNA sequence
  source 1..20: mol_type = other DNA
ggctttagtgtaaccaataa

SEQ ID NO: 89847 - DNA, 20 bp, synthetic construct
  misc_feature 1..20: note = CRISPR gRNA sequence
  source 1..20: mol_type = other DNA
tagtgtaaccaataaatctg

SEQ ID NO: 89848 - DNA, 20 bp, synthetic construct
  misc_feature 1..20: note = CRISPR gRNA sequence
  source 1..20: mol_type = other DNA
agtgtaaccaataaatctgt

SEQ ID NO: 89849 - DNA, 20 bp, synthetic construct
  misc_feature 1..20: note = CRISPR gRNA sequence
  source 1..20: mol_type = other DNA
gtgtaaccaataaatctgta

SEQ ID NO: 89850 - DNA, 20 bp, synthetic construct
  misc_feature 1..20: note = CRISPR gRNA sequence
  source 1..20: mol_type = other DNA
tagtgaccttacctgtattc

SEQ ID NO: 89851 - DNA, 20 bp, synthetic construct
  misc_feature 1..20: note = CRISPR gRNA sequence
  source 1..20: mol_type = other DNA
acctgtattccctgtgctat

SEQ ID NO: 89852 - DNA, 20 bp, synthetic construct
  misc_feature 1..20: note = CRISPR gRNA sequence
  source 1..20: mol_type = other DNA
cctgtattccctgtgctatc

SEQ ID NO: 89853 - DNA, 20 bp, synthetic construct
  misc_feature 1..20: note = CRISPR gRNA sequence
  source 1..20: mol_type = other DNA
tattccctgtgctatcctgt

SEQ ID NO: 89854 - DNA, 20 bp, synthetic construct
  misc_feature 1..20: note = CRISPR gRNA sequence
  source 1..20: mol_type = other DNA
cctgtgctatcctgtgggaa

SEQ ID NO: 89855 - DNA, 20 bp, synthetic construct
  misc_feature 1..20: note = CRISPR gRNA sequence
  source 1..20: mol_type = other DNA
tgctatcctgtgggaaggta

SEQ ID NO: 89856 - DNA, 20 bp, synthetic construct
  misc_feature 1..20: note = CRISPR gRNA sequence
  source 1..20: mol_type = other DNA
tcctgtgggaaggtaggaat

SEQ ID NO: 89857 - DNA, 20 bp, synthetic construct
  misc_feature 1..20: note = CRISPR gRNA sequence
  source 1..20: mol_type = other DNA
tgggaaggtaggaatgggct

SEQ ID NO: 89858 - DNA, 20 bp, synthetic construct
  misc_feature 1..20: note = CRISPR gRNA sequence
  source 1..20: mol_type = other DNA
agtatgatgaatatataggt

SEQ ID NO: 89859 - DNA, 20 bp, synthetic construct
  misc_feature 1..20: note = CRISPR gRNA sequence
  source 1..20: mol_type = other DNA
gggatcttttggttttaaat

SEQ ID NO: 89860 - DNA, 20 bp, synthetic construct
  misc_feature 1..20: note = CRISPR gRNA sequence
  source 1..20: mol_type = other DNA
ttggttttaaatcacagaaa

SEQ ID NO: 89861 - DNA, 20 bp, synthetic construct
  misc_feature 1..20: note = CRISPR gRNA sequence
  source 1..20: mol_type = other DNA
tggttttaaatcacagaaaa

SEQ ID NO: 89862 - DNA, 20 bp, synthetic construct
  misc_feature 1..20: note = CRISPR gRNA sequence
  source 1..20: mol_type = other DNA
ggttttaaatcacagaaaac

SEQ ID NO: 89863 - DNA, 20 bp, synthetic construct
  misc_feature 1..20: note = CRISPR gRNA sequence
  source 1..20: mol_type = other DNA
gttttaaatcacagaaaacc

SEQ ID NO: 89864 - DNA, 20 bp, synthetic construct
  misc_feature 1..20: note = CRISPR gRNA sequence
  source 1..20: mol_type = other DNA
taaatcacagaaaacctaat

SEQ ID NO: 89865 - DNA, 20 bp, synthetic construct
  misc_feature 1..20: note = CRISPR gRNA sequence
  source 1..20: mol_type = other DNA
aaatcacagaaaacctaatt

SEQ ID NO: 89866 - DNA, 20 bp, synthetic construct
  misc_feature 1..20: note = CRISPR gRNA sequence
  source 1..20: mol_type = other DNA
aatcacagaaaacctaattc

SEQ ID NO: 89867 - DNA, 20 bp, synthetic construct
  misc_feature 1..20: note = CRISPR gRNA sequence
  source 1..20: mol_type = other DNA
attcaaactggcttaaaata

SEQ ID NO: 89868 - DNA, 20 bp, synthetic construct
  misc_feature 1..20: note = CRISPR gRNA sequence
  source 1..20: mol_type = other DNA
aaactggcttaaaataaaaa

SEQ ID NO: 89869 - DNA, 20 bp, synthetic construct
  misc_feature 1..20: note = CRISPR gRNA sequence
  source 1..20: mol_type = other DNA
gcttaaaataaaaaggattt

SEQ ID NO: 89870 - DNA, 20 bp, synthetic construct
  misc_feature 1..20: note = CRISPR gRNA sequence
  source 1..20: mol_type = other DNA
aaaataaaaaggatttattg

SEQ ID NO: 89871 - DNA, 20 bp, synthetic construct
  misc_feature 1..20: note = CRISPR gRNA sequence
  source 1..20: mol_type = other DNA
aaataaaaaggatttattgg

SEQ ID NO: 89872 - DNA, 20 bp, synthetic construct
  misc_feature 1..20: note = CRISPR gRNA sequence
  source 1..20: mol_type = other DNA
attggttcatgtaactagaa

SEQ ID NO: 89873 - DNA, 20 bp, synthetic construct
  misc_feature 1..20: note = CRISPR gRNA sequence
  source 1..20: mol_type = other DNA
ttggttcatgtaactagaaa

SEQ ID NO: 89874 - DNA, 20 bp, synthetic construct
  misc_feature 1..20: note = CRISPR gRNA sequence
  source 1..20: mol_type = other DNA
gttcatgtaactagaaagtc

SEQ ID NO: 89875 - DNA, 20 bp, synthetic construct
  misc_feature 1..20: note = CRISPR gRNA sequence
  source 1..20: mol_type = other DNA
atgtaactagaaagtccata

SEQ ID NO: 89876 - DNA, 20 bp, synthetic construct
  misc_feature 1..20: note = CRISPR gRNA sequence
  source 1..20: mol_type = other DNA
gaaagtccataggtagtgct

SEQ ID NO: 89877 - DNA, 20 bp, synthetic construct
  misc_feature 1..20: note = CRISPR gRNA sequence
  source 1..20: mol_type = other DNA
gctccaggtgaagacttgac

SEQ ID NO: 89878 - DNA, 20 bp, synthetic construct
  misc_feature 1..20: note = CRISPR gRNA sequence
  source 1..20: mol_type = other DNA
caggtgaagacttgacccag

SEQ ID NO: 89879 - DNA, 20 bp, synthetic construct
  misc_feature 1..20: note = CRISPR gRNA sequence
  source 1..20: mol_type = other DNA
gacccagtagttcagtatgt

SEQ ID NO: 89880 - DNA, 20 bp, synthetic construct
  misc_feature 1..20: note = CRISPR gRNA sequence
  source 1..20: mol_type = other DNA
acccagtagttcagtatgtc

SEQ ID NO: 89881 - DNA, 20 bp, synthetic construct
  misc_feature 1..20: note = CRISPR gRNA sequence
  source 1..20: mol_type = other DNA
agtatgtctctaaataccgg

SEQ ID NO: 89882 - DNA, 20 bp, synthetic construct
  misc_feature 1..20: note = CRISPR gRNA sequence
  source 1..20: mol_type = other DNA
taaataccggactgactttt

SEQ ID NO: 89883 - DNA, 20 bp, synthetic construct
  misc_feature 1..20: note = CRISPR gRNA sequence
  source 1..20: mol_type = other DNA
aataccggactgactttttt

SEQ ID NO: 89884 - DNA, 20 bp, synthetic construct
  misc_feature 1..20: note = CRISPR gRNA sequence
  source 1..20: mol_type = other DNA
acttttttctcactgttgca

SEQ ID NO: 89885 - DNA, 20 bp, synthetic construct
  misc_feature 1..20: note = CRISPR gRNA sequence
  source 1..20: mol_type = other DNA
ttttctcactgttgcatctt

SEQ ID NO: 89886 - DNA, 20 bp, synthetic construct
  misc_feature 1..20: note = CRISPR gRNA sequence
  source 1..20: mol_type = other DNA
tttctcactgttgcatcttc

SEQ ID NO: 89887 - DNA, 20 bp, synthetic construct
  misc_feature 1..20: note = CRISPR gRNA sequence
  source 1..20: mol_type = other DNA
ttctcactgttgcatcttct

SEQ ID NO: 89888 - DNA, 20 bp, synthetic construct
  misc_feature 1..20: note = CRISPR gRNA sequence
  source 1..20: mol_type = other DNA
tctcactgttgcatcttctg

SEQ ID NO: 89889 - DNA, 20 bp, synthetic construct
  misc_feature 1..20: note = CRISPR gRNA sequence
  source 1..20: mol_type = other DNA
ctcactgttgcatcttctgt

SEQ ID NO: 89890 - DNA, 20 bp, synthetic construct
  misc_feature 1..20: note = CRISPR gRNA sequence
  source 1..20: mol_type = other DNA
tcactgttgcatcttctgta

SEQ ID NO: 89891 - DNA, 20 bp, synthetic construct
  misc_feature 1..20: note = CRISPR gRNA sequence
  source 1..20: mol_type = other DNA
actgttgcatcttctgtagg

SEQ ID NO: 89892 - DNA, 20 bp, synthetic construct
  misc_feature 1..20: note = CRISPR gRNA sequence
  source 1..20: mol_type = other DNA
ttgcatcttctgtaggacca

SEQ ID NO: 89893 - DNA, 20 bp, synthetic construct
  misc_feature 1..20: note = CRISPR gRNA sequence
  source 1..20: mol_type = other DNA
catcttctgtaggaccattt

SEQ ID NO: 89894 - DNA, 20 bp, synthetic construct
  misc_feature 1..20: note = CRISPR gRNA sequence
  source 1..20: mol_type = other DNA
ctgtaggaccatttaagtct

SEQ ID NO: 89895 - DNA, 20 bp, synthetic construct
  misc_feature 1..20: note = CRISPR gRNA sequence
  source 1..20: mol_type = other DNA
tgtaggaccatttaagtctg

SEQ ID NO: 89896 - DNA, 20 bp, synthetic construct
  misc_feature 1..20: note = CRISPR gRNA sequence
  source 1..20: mol_type = other DNA
taggaccatttaagtctggg

SEQ ID NO: 89897 - DNA, 20 bp, synthetic construct
  misc_feature 1..20: note = CRISPR gRNA sequence
  source 1..20: mol_type = other DNA
aagtctgggccacttaatgg

SEQ ID NO: 89898 - DNA, 20 bp, synthetic construct
  misc_feature 1..20: note = CRISPR gRNA sequence
  source 1..20: mol_type = other DNA
agtctgggccacttaatggc

SEQ ID NO: 89899 - DNA, 20 bp, synthetic construct
  misc_feature 1..20: note = CRISPR gRNA sequence
  source 1..20: mol_type = other DNA
ggccacttaatggctgccag

SEQ ID NO: 89900 - DNA, 20 bp, synthetic construct
  misc_feature 1..20: note = CRISPR gRNA sequence
  source 1..20: mol_type = other DNA
aatggctgccagcattccta

SEQ ID NO: 89901 - DNA, 20 bp, synthetic construct
  misc_feature 1..20: note = CRISPR gRNA sequence
  source 1..20: mol_type = other DNA
atggctgccagcattcctaa

SEQ ID NO: 89902 - DNA, 20 bp, synthetic construct
  misc_feature 1..20: note = CRISPR gRNA sequence
  source 1..20: mol_type = other DNA
ccagcattcctaagattaca

SEQ ID NO: 89903 - DNA, 20 bp, synthetic construct
  misc_feature 1..20: note = CRISPR gRNA sequence
  source 1..20: mol_type = other DNA
ctaagattacacttttcccc

SEQ ID NO: 89904 - DNA, 20 bp, synthetic construct
  misc_feature 1..20: note = CRISPR gRNA sequence
  source 1..20: mol_type = other DNA
agattacacttttccccatt

SEQ ID NO: 89905 - DNA, 20 bp, synthetic construct
  misc_feature 1..20: note = CRISPR gRNA sequence
  source 1..20: mol_type = other DNA
cacttttccccatttatgtc

SEQ ID NO: 89906 - DNA, 20 bp, synthetic construct
  misc_feature 1..20: note = CRISPR gRNA sequence
  source 1..20: mol_type = other DNA
ttccccatttatgtccaatc

SEQ ID NO: 89907 - DNA, 20 bp, synthetic construct
  misc_feature 1..20: note = CRISPR gRNA sequence
  source 1..20: mol_type = other DNA
tccccatttatgtccaatca

SEQ ID NO: 89908 - DNA, 20 bp, synthetic construct
  misc_feature 1..20: note = CRISPR gRNA sequence
  source 1..20: mol_type = other DNA
ccccatttatgtccaatcag

SEQ ID NO: 89909 - DNA, 20 bp, synthetic construct
  misc_feature 1..20: note = CRISPR gRNA sequence
  source 1..20: mol_type = other DNA
cccatttatgtccaatcaga

SEQ ID NO: 89910 - DNA, 20 bp, synthetic construct
  misc_feature 1..20: note = CRISPR gRNA sequence
  source 1..20: mol_type = other DNA
atgtccaatcagaaaaagaa

SEQ ID NO: 89911 - DNA, 20 bp, synthetic construct
  misc_feature 1..20: note = CRISPR gRNA sequence
  source 1..20: mol_type = other DNA
tgtccaatcagaaaaagaag

SEQ ID NO: 89912 - DNA, 20 bp, synthetic construct
  misc_feature 1..20: note = CRISPR gRNA sequence
  source 1..20: mol_type = other DNA
tgtaccagaaatctcagcaa

SEQ ID NO: 89913 - DNA, 20 bp, synthetic construct
  misc_feature 1..20: note = CRISPR gRNA sequence
  source 1..20: mol_type = other DNA
gtaccagaaatctcagcaaa

SEQ ID NO: 89914 - DNA, 20 bp, synthetic construct
  misc_feature 1..20: note = CRISPR gRNA sequence
  source 1..20: mol_type = other DNA
taccagaaatctcagcaaaa

SEQ ID NO: 89915 - DNA, 20 bp, synthetic construct
  misc_feature 1..20: note = CRISPR gRNA sequence
  source 1..20: mol_type = other DNA
agcaaaagccctaatattca

SEQ ID NO: 89916 - DNA, 20 bp, synthetic construct
  misc_feature 1..20: note = CRISPR gRNA sequence
  source 1..20: mol_type = other DNA
atattcacactgattaggcc

SEQ ID NO: 89917 - DNA, 20 bp, synthetic construct
  misc_feature 1..20: note = CRISPR gRNA sequence
  source 1..20: mol_type = other DNA
acactgattaggcctgggtc

SEQ ID NO: 89918 - DNA, 20 bp, synthetic construct
  misc_feature 1..20: note = CRISPR gRNA sequence
  source 1..20: mol_type = other DNA
attaggcctgggtcacatgt

SEQ ID NO: 89919 - DNA, 20 bp, synthetic construct
  misc_feature 1..20: note = CRISPR gRNA sequence
  source 1..20: mol_type = other DNA
ggcctgggtcacatgtccac

SEQ ID NO: 89920 - DNA, 20 bp, synthetic construct
  misc_feature 1..20: note = CRISPR gRNA sequence
  source 1..20: mol_type = other DNA
ggtcacatgtccaccctgac

SEQ ID NO: 89921 - DNA, 20 bp, synthetic construct
  misc_feature 1..20: note = CRISPR gRNA sequence
  source 1..20: mol_type = other DNA
accaatcactgtggccagga

SEQ ID NO: 89922 - DNA, 20 bp, synthetic construct
  misc_feature 1..20: note = CRISPR gRNA sequence
  source 1..20: mol_type = other DNA
tggccaggaggatgatacat

SEQ ID NO: 89923 - DNA, 20 bp, synthetic construct
  misc_feature 1..20: note = CRISPR gRNA sequence
  source 1..20: mol_type = other DNA
atttgcttattctatatcat

SEQ ID NO: 89924 - DNA, 20 bp, synthetic construct
  misc_feature 1..20: note = CRISPR gRNA sequence
  source 1..20: mol_type = other DNA
gcttattctatatcatggac

SEQ ID NO: 89925 - DNA, 20 bp, synthetic construct
  misc_feature 1..20: note = CRISPR gRNA sequence
  source 1..20: mol_type = other DNA
cttattctatatcatggaca

SEQ ID NO: 89926 - DNA, 20 bp, synthetic construct
  misc_feature 1..20: note = CRISPR gRNA sequence
  source 1..20: mol_type = other DNA
attctatatcatggacaaca

SEQ ID NO: 89927 - DNA, 20 bp, synthetic construct
  misc_feature 1..20: note = CRISPR gRNA sequence
  source 1..20: mol_type = other DNA
ttctatatcatggacaacac

SEQ ID NO: 89928 - DNA, 20 bp, synthetic construct
  misc_feature 1..20: note = CRISPR gRNA sequence
  source 1..20: mol_type = other DNA
tatatcatggacaacacctt

SEQ ID NO: 89929 - DNA, 20 bp, synthetic construct
  misc_feature 1..20: note = CRISPR gRNA sequence
  source 1..20: mol_type = other DNA
tatcatggacaacacctttg

SEQ ID NO: 89930 - DNA, 20 bp, synthetic construct
  misc_feature 1..20: note = CRISPR gRNA sequence
  source 1..20: mol_type = other DNA
tggggaaaagggtgggggtc

SEQ ID NO: 89931 - DNA, 20 bp, synthetic construct
  misc_feature 1..20: note = CRISPR gRNA sequence
  source 1..20: mol_type = other DNA
ggggaaaagggtgggggtca

SEQ ID NO: 89932 - DNA, 20 bp, synthetic construct
  misc_feature 1..20: note = CRISPR gRNA sequence
  source 1..20: mol_type = other DNA
gggaaaagggtgggggtcag

SEQ ID NO: 89933 - DNA, 20 bp, synthetic construct
  misc_feature 1..20: note = CRISPR gRNA sequence
  source 1..20: mol_type = other DNA
cccaaaatcacatggattcc

SEQ ID NO: 89934 - DNA, 20 bp, synthetic construct
  misc_feature 1..20: note = CRISPR gRNA sequence
  source 1..20: mol_type = other DNA
cccaagtggaaactaggagc

SEQ ID NO: 89935 - DNA, 20 bp, synthetic construct
  misc_feature 1..20: note = CRISPR gRNA sequence
  source 1..20: mol_type = other DNA
ggagcagggagttgcttggg

SEQ ID NO: 89936 - DNA, 20 bp, synthetic construct
  misc_feature 1..20: note = CRISPR gRNA sequence
  source 1..20: mol_type = other DNA
cttgggtggccgctaacacc

SEQ ID NO: 89937 - DNA, 20 bp, synthetic construct
  misc_feature 1..20: note = CRISPR gRNA sequence
  source 1..20: mol_type = other DNA
gggtggccgctaacaccagg

SEQ ID NO: 89938 - DNA, 20 bp, synthetic construct
  misc_feature 1..20: note = CRISPR gRNA sequence
  source 1..20: mol_type = other DNA
ggtggccgctaacaccaggc

SEQ ID NO: 89939 - DNA, 20 bp, synthetic construct
  misc_feature 1..20: note = CRISPR gRNA sequence
  source 1..20: mol_type = other DNA
acaccaggctactcttattt

SEQ ID NO: 89940 - DNA, 20 bp, synthetic construct
  misc_feature 1..20: note = CRISPR gRNA sequence
  source 1..20: mol_type = other DNA
ctcttattttagcttgctaa

SEQ ID NO: 89941 - DNA, 20 bp, synthetic construct
  misc_feature 1..20: note = CRISPR gRNA sequence
  source 1..20: mol_type = other DNA
ttattttagcttgctaagtt

SEQ ID NO: 89942 - DNA, 20 bp, synthetic construct
  misc_feature 1..20: note = CRISPR gRNA sequence
  source 1..20: mol_type = other DNA
attttagcttgctaagttga

SEQ ID NO: 89943 - DNA, 20 bp, synthetic construct
  misc_feature 1..20: note = CRISPR gRNA sequence
  source 1..20: mol_type = other DNA
ttttagcttgctaagttgag

SEQ ID NO: 89944 - DNA, 20 bp, synthetic construct
  misc_feature 1..20: note = CRISPR gRNA sequence
  source 1..20: mol_type = other DNA
tagcttgctaagttgagatc

SEQ ID NO: 89945 - DNA, 20 bp, synthetic construct
  misc_feature 1..20: note = CRISPR gRNA sequence
  source 1..20: mol_type = other DNA
agcttgctaagttgagatca

SEQ ID NO: 89946 - DNA, 20 bp, synthetic construct
  misc_feature 1..20: note = CRISPR gRNA sequence
  source 1..20: mol_type = other DNA
gcttgctaagttgagatcag

SEQ ID NO: 89947 - DNA, 20 bp, synthetic construct
  misc_feature 1..20: note = CRISPR gRNA sequence
  source 1..20: mol_type = other DNA
gctaagttgagatcagctag

SEQ ID NO: 89948 - DNA, 20 bp, synthetic construct
  misc_feature 1..20: note = CRISPR gRNA sequence
  source 1..20: mol_type = other DNA
ctaagttgagatcagctaga

SEQ ID NO: 89949 - DNA, 20 bp, synthetic construct
  misc_feature 1..20: note = CRISPR gRNA sequence
  source 1..20: mol_type = other DNA
agttgagatcagctagacct

SEQ ID NO: 89950 - DNA, 20 bp, synthetic construct
  misc_feature 1..20: note = CRISPR gRNA sequence
  source 1..20: mol_type = other DNA
agatcagctagacctgcttt

SEQ ID NO: 89951 - DNA, 20 bp, synthetic construct
  misc_feature 1..20: note = CRISPR gRNA sequence
  source 1..20: mol_type = other DNA
gacctgctttcttttctcct

SEQ ID NO: 89952 - DNA, 20 bp, synthetic construct
  misc_feature 1..20: note = CRISPR gRNA sequence
  source 1..20: mol_type = other DNA
ctttcttttctcctcagtct

SEQ ID NO: 89953 - DNA, 20 bp, synthetic construct
  misc_feature 1..20: note = CRISPR gRNA sequence
  source 1..20: mol_type = other DNA
tcttttctcctcagtcttgc

SEQ ID NO: 89954 - DNA, 20 bp, synthetic construct
  misc_feature 1..20: note = CRISPR gRNA sequence
  source 1..20: mol_type = other DNA
cttttctcctcagtcttgca

SEQ ID NO: 89955 - DNA, 20 bp, synthetic construct
  misc_feature 1..20: note = CRISPR gRNA sequence
  source 1..20: mol_type = other DNA
ttttctcctcagtcttgcat

SEQ ID NO: 89956 - DNA, 20 bp, synthetic construct
  misc_feature 1..20: note = CRISPR gRNA sequence
  source 1..20: mol_type = other DNA
ttctcctcagtcttgcattt

SEQ ID NO: 89957 - DNA, 20 bp, synthetic construct
  misc_feature 1..20: note = CRISPR gRNA sequence
  source 1..20: mol_type = other DNA
tctcctcagtcttgcatttc

SEQ ID NO: 89958 - DNA, 20 bp, synthetic construct
  misc_feature 1..20: note = CRISPR gRNA sequence
  source 1..20: mol_type = other DNA
ctcctcagtcttgcatttcc

SEQ ID NO: 89959 - DNA, 20 bp, synthetic construct
  misc_feature 1..20: note = CRISPR gRNA sequence
  source 1..20: mol_type = other DNA
tcctcagtcttgcatttccc

SEQ ID NO: 89960 - DNA, 20 bp, synthetic construct
  misc_feature 1..20: note = CRISPR gRNA sequence
  source 1..20: mol_type = other DNA
ctcagtcttgcatttccctc

SEQ ID NO: 89961 - DNA, 20 bp, synthetic construct
  misc_feature 1..20: note = CRISPR gRNA sequence
  source 1..20: mol_type = other DNA
agtcttgcatttccctcaat

SEQ ID NO: 89962 - DNA, 20 bp, synthetic construct
  misc_feature 1..20: note = CRISPR gRNA sequence
  source 1..20: mol_type = other DNA
gcatttccctcaatacaagc

SEQ ID NO: 89963 - DNA, 20 bp, synthetic construct
  misc_feature 1..20: note = CRISPR gRNA sequence
  source 1..20: mol_type = other DNA
catttccctcaatacaagct

SEQ ID NO: 89964 - DNA, 20 bp, synthetic construct
  misc_feature 1..20: note = CRISPR gRNA sequence
  source 1..20: mol_type = other DNA
ccctcaatacaagctgtagc

SEQ ID NO: 89965 - DNA, 20 bp, synthetic construct
  misc_feature 1..20: note = CRISPR gRNA sequence
  source 1..20: mol_type = other DNA
cctcaatacaagctgtagcc

SEQ ID NO: 89966 - DNA, 20 bp, synthetic construct
  misc_feature 1..20: note = CRISPR gRNA sequence
  source 1..20: mol_type = other DNA
aatacaagctgtagcctctt

SEQ ID NO: 89967 - DNA, 20 bp, synthetic construct
  misc_feature 1..20: note = CRISPR gRNA sequence
  source 1..20: mol_type = other DNA
tagcctctttcctcgtttct

SEQ ID NO: 89968 - DNA, 20 bp, synthetic construct
  misc_feature 1..20: note = CRISPR gRNA sequence
  source 1..20: mol_type = other DNA
tttcctcgtttctagtctca

SEQ ID NO: 89969 - DNA, 20 bp, synthetic construct
  misc_feature 1..20: note = CRISPR gRNA sequence
  source 1..20: mol_type = other DNA
tcctcgtttctagtctcaga

SEQ ID NO: 89970 - DNA, 20 bp, synthetic construct
  misc_feature 1..20: note = CRISPR gRNA sequence
  source 1..20: mol_type = other DNA
cctcgtttctagtctcagaa

SEQ ID NO: 89971 - DNA, 20 bp, synthetic construct
  misc_feature 1..20: note = CRISPR gRNA sequence
  source 1..20: mol_type = other DNA
ctcgtttctagtctcagaag

SEQ ID NO: 89972 - DNA, 20 bp, synthetic construct
  misc_feature 1..20: note = CRISPR gRNA sequence
  source 1..20: mol_type = other DNA
gtttctagtctcagaaggaa

SEQ ID NO: 89973 - DNA, 20 bp, synthetic construct
  misc_feature 1..20: note = CRISPR gRNA sequence
  source 1..20: mol_type = other DNA
ctagtctcagaaggaaggag

SEQ ID NO: 89974 - DNA, 20 bp, synthetic construct
  misc_feature 1..20: note = CRISPR gRNA sequence
  source 1..20: mol_type = other DNA
tagtctcagaaggaaggaga

SEQ ID NO: 89975 - DNA, 20 bp, synthetic construct
  misc_feature 1..20: note = CRISPR gRNA sequence
  source 1..20: mol_type = other DNA
gtctcagaaggaaggagagg

SEQ ID NO: 89976 - DNA, 20 bp, synthetic construct
  misc_feature 1..20: note = CRISPR gRNA sequence
  source 1..20: mol_type = other DNA
agaaggaaggagagggaagc

SEQ ID NO: 89977 - DNA, 20 bp, synthetic construct
  misc_feature 1..20: note = CRISPR gRNA sequence
  source 1..20: mol_type = other DNA
tcctctagggactcttcagt

SEQ ID NO: 89978 - DNA, 20 bp, synthetic construct
  misc_feature 1..20: note = CRISPR gRNA sequence
  source 1..20: mol_type = other DNA
ctctagggactcttcagtct

SEQ ID NO: 89979 - DNA, 20 bp, synthetic construct
  misc_feature 1..20: note = CRISPR gRNA sequence
  source 1..20: mol_type = other DNA
tagggactcttcagtctcat

SEQ ID NO: 89980 - DNA, 20 bp, synthetic construct
  misc_feature 1..20: note = CRISPR gRNA sequence
  source 1..20: mol_type = other DNA
gggactcttcagtctcattt

SEQ ID NO: 89981 - DNA, 20 bp, synthetic construct
  misc_feature 1..20: note = CRISPR gRNA sequence
  source 1..20: mol_type = other DNA
ttcagtctcatttagatgat

SEQ ID NO: 89982 - DNA, 20 bp, synthetic construct
  misc_feature 1..20: note = CRISPR gRNA sequence
  source 1..20: mol_type = other DNA
cagtctcatttagatgatag

SEQ ID NO: 89983 - DNA, 20 bp, synthetic construct
  misc_feature 1..20: note = CRISPR gRNA sequence
  source 1..20: mol_type = other DNA
agtctcatttagatgatagt

SEQ ID NO: 89984 - DNA, 20 bp, synthetic construct
  misc_feature 1..20: note = CRISPR gRNA sequence
  source 1..20: mol_type = other DNA
atttagatgatagtcccttt

SEQ ID NO: 89985 - DNA, 20 bp, synthetic construct
  misc_feature 1..20: note = CRISPR gRNA sequence
  source 1..20: mol_type = other DNA
agatgatagtcccttttttt

SEQ ID NO: 89986 - DNA, 20 bp, synthetic construct
  misc_feature 1..20: note = CRISPR gRNA sequence
  source 1..20: mol_type = other DNA
gatgatagtccctttttttc

SEQ ID NO: 89987 - DNA, 20 bp, synthetic construct
  misc_feature 1..20: note = CRISPR gRNA sequence
  source 1..20: mol_type = other DNA
tttttctacctccatattag

SEQ ID NO: 89988 - DNA, 20 bp, synthetic construct
  misc_feature 1..20: note = CRISPR gRNA sequence
  source 1..20: mol_type = other DNA
ttttctacctccatattaga

SEQ ID NO: 89989 - DNA, 20 bp, synthetic construct
  misc_feature 1..20: note = CRISPR gRNA sequence
  source 1..20: mol_type = other DNA
tttctacctccatattagag

SEQ ID NO: 89990 - DNA, 20 bp, synthetic construct
  misc_feature 1..20: note = CRISPR gRNA sequence
  source 1..20: mol_type = other DNA
ttctacctccatattagaga

SEQ ID NO: 89991 - DNA, 20 bp, synthetic construct
  misc_feature 1..20: note = CRISPR gRNA sequence
  source 1..20: mol_type = other DNA
tctacctccatattagagat

SEQ ID NO: 89992 - DNA, 20 bp, synthetic construct
  misc_feature 1..20: note = CRISPR gRNA sequence
  source 1..20: mol_type = other DNA
ctacctccatattagagatg

SEQ ID NO: 89993 - DNA, 20 bp, synthetic construct
  misc_feature 1..20: note = CRISPR gRNA sequence
  source 1..20: mol_type = other DNA
tacctccatattagagatgg

SEQ ID NO: 89994 - DNA, 20 bp, synthetic construct
  misc_feature 1..20: note = CRISPR gRNA sequence
  source 1..20: mol_type = other DNA
cctccatattagagatggag

SEQ ID NO: 89995 - DNA, 20 bp, synthetic construct
  misc_feature 1..20: note = CRISPR gRNA sequence
  source 1..20: mol_type = other DNA
catattagagatggagctcc

SEQ ID NO: 89996 - DNA, 20 bp, synthetic construct
  misc_feature 1..20: note = CRISPR gRNA sequence
  source 1..20: mol_type = other DNA
gagatggagctccttccttt

SEQ ID NO: 89997 - DNA, 20 bp, synthetic construct
  misc_feature 1..20: note = CRISPR gRNA sequence
  source 1..20: mol_type = other DNA
cttccttttcctgtttctta

SEQ ID NO: 89998 - DNA, 20 bp, synthetic construct
  misc_feature 1..20: note = CRISPR gRNA sequence
  source 1..20: mol_type = other DNA
ccttttcctgtttcttaatt

SEQ ID NO: 89999 - DNA, 20 bp, synthetic construct
  misc_feature 1..20: note = CRISPR gRNA sequence
  source 1..20: mol_type = other DNA
cttttcctgtttcttaattt

SEQ ID NO: 90000 - DNA, 20 bp, synthetic construct
  misc_feature 1..20: note = CRISPR gRNA sequence
  source 1..20: mol_type = other DNA
ttcctgtttcttaatttttg

SEQ ID NO: 90001 - DNA, 20 bp, synthetic construct
  misc_feature 1..20: note = CRISPR gRNA sequence
  source 1..20: mol_type = other DNA
tcctgtttcttaatttttgt

SEQ ID NO: 90002 - DNA, 20 bp, synthetic construct
  misc_feature 1..20: note = CRISPR gRNA sequence
  source 1..20: mol_type = other DNA
cctgtttcttaatttttgtc

SEQ ID NO: 90003 - DNA, 20 bp, synthetic construct
  misc_feature 1..20: note = CRISPR gRNA sequence
  source 1..20: mol_type = other DNA
ctgtttcttaatttttgtct

SEQ ID NO: 90004 - DNA, 20 bp, synthetic construct
  misc_feature 1..20: note = CRISPR gRNA sequence
  source 1..20: mol_type = other DNA
tttcttaatttttgtcttct

SEQ ID NO: 90005 - DNA, 20 bp, synthetic construct
  misc_feature 1..20: note = CRISPR gRNA sequence
  source 1..20: mol_type = other DNA
cttaatttttgtcttctcat

SEQ ID NO: 90006 - DNA, 20 bp, synthetic construct
  misc_feature 1..20: note = CRISPR gRNA sequence
  source 1..20: mol_type = other DNA
ttaatttttgtcttctcatt

SEQ ID NO: 90007 - DNA, 20 bp, synthetic construct
  misc_feature 1..20: note = CRISPR gRNA sequence
  source 1..20: mol_type = other DNA
aatttttgtcttctcattcc

SEQ ID NO: 90008 - DNA, 20 bp, synthetic construct
  misc_feature 1..20: note = CRISPR gRNA sequence
  source 1..20: mol_type = other DNA
atttttgtcttctcattcct

SEQ ID NO: 90009 - DNA, 20 bp, synthetic construct
  misc_feature 1..20: note = CRISPR gRNA sequence
  source 1..20: mol_type = other DNA
ttgtcttctcattcctgctt

SEQ ID NO: 90010 - DNA, 20 bp, synthetic construct
  misc_feature 1..20: note = CRISPR gRNA sequence
  source 1..20: mol_type = other DNA
tgtcttctcattcctgcttc

SEQ ID NO: 90011 - DNA, 20 bp, synthetic construct
  misc_feature 1..20: note = CRISPR gRNA sequence
  source 1..20: mol_type = other DNA
gtcttctcattcctgcttcc

SEQ ID NO: 90012 - DNA, 20 bp, synthetic construct
  misc_feature 1..20: note = CRISPR gRNA sequence
  source 1..20: mol_type = other DNA
tcttctcattcctgcttccc

SEQ ID NO: 90013 - DNA, 20 bp, synthetic construct
  misc_feature 1..20: note = CRISPR gRNA sequence
  source 1..20: mol_type = other DNA
ctcattcctgcttccctctc

SEQ ID NO: 90014 - DNA, 20 bp, synthetic construct
  misc_feature 1..20: note = CRISPR gRNA sequence
  source 1..20: mol_type = other DNA
tcattcctgcttccctctca

SEQ ID NO: 90015 - DNA, 20 bp, synthetic construct
  misc_feature 1..20: note = CRISPR gRNA sequence
  source 1..20: mol_type = other DNA
attcctgcttccctctcacc

SEQ ID NO: 90016 - DNA, 20 bp, synthetic construct
  misc_feature 1..20: note = CRISPR gRNA sequence
  source 1..20: mol_type = other DNA
ctgcttccctctcaccctat

SEQ ID NO: 90017 - DNA, 20 bp, synthetic construct
  misc_feature 1..20: note = CRISPR gRNA sequence
  source 1..20: mol_type = other DNA
cttccctctcaccctattgc

SEQ ID NO: 90018 - DNA, 20 bp, synthetic construct
  misc_feature 1..20: note = CRISPR gRNA sequence
  source 1..20: mol_type = other DNA
ccctctcaccctattgccag

SEQ ID NO: 90019 - DNA, 20 bp, synthetic construct
  misc_feature 1..20: note = CRISPR gRNA sequence
  source 1..20: mol_type = other DNA
cctctcaccctattgccagt

SEQ ID NO: 90020 - DNA, 20 bp, synthetic construct
  misc_feature 1..20: note = CRISPR gRNA sequence
  source 1..20: mol_type = other DNA
tcaccctattgccagttcca

SEQ ID NO: 90021 - DNA, 20 bp, synthetic construct
  misc_feature 1..20: note = CRISPR gRNA sequence
  source 1..20: mol_type = other DNA
accctattgccagttccacc

SEQ ID NO: 90022 - DNA, 20 bp, synthetic construct
  misc_feature 1..20: note = CRISPR gRNA sequence
  source 1..20: mol_type = other DNA
ttgccagttccaccaactag

SEQ ID NO: 90023 - DNA, 20 bp, synthetic construct
  misc_feature 1..20: note = CRISPR gRNA sequence
  source 1..20: mol_type = other DNA
ccagttccaccaactagagt

SEQ ID NO: 90024 - DNA, 20 bp, synthetic construct
  misc_feature 1..20: note = CRISPR gRNA sequence
  source 1..20: mol_type = other DNA
caccaactagagtgaaagac

SEQ ID NO: 90025 - DNA, 20 bp, synthetic construct
  misc_feature 1..20: note = CRISPR gRNA sequence
  source 1..20: mol_type = other DNA
gagtgaaagacttcctagcc

SEQ ID NO: 90026 - DNA, 20 bp, synthetic construct
  misc_feature 1..20: note = CRISPR gRNA sequence
  source 1..20: mol_type = other DNA
cctagccatttcattaaatc

SEQ ID NO: 90027 - DNA, 20 bp, synthetic construct
  misc_feature 1..20: note = CRISPR gRNA sequence
  source 1..20: mol_type = other DNA
ctagccatttcattaaatct

SEQ ID NO: 90028 - DNA, 20 bp, synthetic construct
  misc_feature 1..20: note = CRISPR gRNA sequence
  source 1..20: mol_type = other DNA
gccatttcattaaatctatt

SEQ ID NO: 90029 - DNA, 20 bp, synthetic construct
  misc_feature 1..20: note = CRISPR gRNA sequence
  source 1..20: mol_type = other DNA
cattaaatctattctgtatc

SEQ ID NO: 90030 - DNA, 20 bp, synthetic construct
  misc_feature 1..20: note = CRISPR gRNA sequence
  source 1..20: mol_type = other DNA
attaaatctattctgtatcc

SEQ ID NO: 90031 - DNA, 20 bp, synthetic construct
  misc_feature 1..20: note = CRISPR gRNA sequence
  source 1..20: mol_type = other DNA
aatctattctgtatccacca

SEQ ID NO: 90032 - DNA, 20 bp, synthetic construct
  misc_feature 1..20: note = CRISPR gRNA sequence
  source 1..20: mol_type = other DNA
ttctgtatccaccaggtggc

SEQ ID NO: 90033 - DNA, 20 bp, synthetic construct
  misc_feature 1..20: note = CRISPR gRNA sequence
  source 1..20: mol_type = other DNA
tgtatccaccaggtggcagc

SEQ ID NO: 90034 - DNA, 20 bp, synthetic construct
  misc_feature 1..20: note = CRISPR gRNA sequence
  source 1..20: mol_type = other DNA
tatccaccaggtggcagcat

SEQ ID NO: 90035 - DNA, 20 bp, synthetic construct
  misc_feature 1..20: note = CRISPR gRNA sequence
  source 1..20: mol_type = other DNA
gtcatacgtgtcaggactta

SEQ ID NO: 90036 - DNA, 20 bp, synthetic construct
  misc_feature 1..20: note = CRISPR gRNA sequence
  source 1..20: mol_type = other DNA
tcatacgtgtcaggacttag

SEQ ID NO: 90037 - DNA, 20 bp, synthetic construct
  misc_feature 1..20: note = CRISPR gRNA sequence
  source 1..20: mol_type = other DNA
aggactgcggggtttaggtt

SEQ ID NO: 90038 - DNA, 20 bp, synthetic construct
  misc_feature 1..20: note = CRISPR gRNA sequence
  source 1..20: mol_type = other DNA
ggactgcggggtttaggtta

SEQ ID NO: 90039 - DNA, 20 bp, synthetic construct
  misc_feature 1..20: note = CRISPR gRNA sequence
  source 1..20: mol_type = other DNA
cggggtttaggttagatgtc

SEQ ID NO: 90040 - DNA, 20 bp, synthetic construct
  misc_feature 1..20: note = CRISPR gRNA sequence
  source 1..20: mol_type = other DNA
aggttagatgtcacggaaaa

SEQ ID NO: 90041 - DNA, 20 bp, synthetic construct
  misc_feature 1..20: note = CRISPR gRNA sequence
  source 1..20: mol_type = other DNA
ggttagatgtcacggaaaaa

SEQ ID NO: 90042 - DNA, 20 bp, synthetic construct
  misc_feature 1..20: note = CRISPR gRNA sequence
  source 1..20: mol_type = other DNA
gatgtcacggaaaaagctag

SEQ ID NO: 90043 - DNA, 20 bp, synthetic construct
  misc_feature 1..20: note = CRISPR gRNA sequence
  source 1..20: mol_type = other DNA
gttctgtggtcaggcggcac

SEQ ID NO: 90044 - DNA, 20 bp, synthetic construct
  misc_feature 1..20: note = CRISPR gRNA sequence
  source 1..20: mol_type = other DNA
tgtggtcaggcggcaccaat

SEQ ID NO: 90045 - DNA, 20 bp, synthetic construct
  misc_feature 1..20: note = CRISPR gRNA sequence
  source 1..20: mol_type = other DNA
tggtcaggcggcaccaatga

SEQ ID NO: 90046 - DNA, 20 bp, synthetic construct
  misc_feature 1..20: note = CRISPR gRNA sequence
  source 1..20: mol_type = other DNA
cagatgtatccttgggaaaa

SEQ ID NO: 90047 - DNA, 20 bp, synthetic construct
  misc_feature 1..20: note = CRISPR gRNA sequence
  source 1..20: mol_type = other DNA
gggaaaagcagtaaaccaac

SEQ ID NO: 90048 - DNA, 20 bp, synthetic construct
  misc_feature 1..20: note = CRISPR gRNA sequence
  source 1..20: mol_type = other DNA
ggaaaagcagtaaaccaact

SEQ ID NO: 90049 - DNA, 20 bp, synthetic construct
  misc_feature 1..20: note = CRISPR gRNA sequence
  source 1..20: mol_type = other DNA
atatttattgaagacctact

SEQ ID NO: 90050 - DNA, 20 bp, synthetic construct
  misc_feature 1..20: note = CRISPR gRNA sequence
  source 1..20: mol_type = other DNA
attgaagacctactttgtcc

SEQ ID NO: 90051 - DNA, 20 bp, synthetic construct
  misc_feature 1..20: note = CRISPR gRNA sequence
  source 1..20: mol_type = other DNA
ttgaagacctactttgtcct

SEQ ID NO: 90052 - DNA, 20 bp, synthetic construct
  misc_feature 1..20: note = CRISPR gRNA sequence
  source 1..20: mol_type = other DNA
aagacctactttgtcctcta

SEQ ID NO: 90053 - DNA, 20 bp, synthetic construct
  misc_feature 1..20: note = CRISPR gRNA sequence
  source 1..20: mol_type = other DNA
ctttgtcctctacatagggt

SEQ ID NO: 90054 - DNA, 20 bp, synthetic construct
  misc_feature 1..20: note = CRISPR gRNA sequence
  source 1..20: mol_type = other DNA
tgtcctctacatagggtagc

SEQ ID NO: 90055 - DNA, 20 bp, synthetic construct
  misc_feature 1..20: note = CRISPR gRNA sequence
  source 1..20: mol_type = other DNA
gtcctctacatagggtagct

SEQ ID NO: 90056 - DNA, 20 bp, synthetic construct
  misc_feature 1..20: note = CRISPR gRNA sequence
  source 1..20: mol_type = other DNA
tcctctacatagggtagctt

SEQ ID NO: 90057 - DNA, 20 bp, synthetic construct
  misc_feature 1..20: note = CRISPR gRNA sequence
  source 1..20: mol_type = other DNA
tacatagggtagcttctgtc

SEQ ID NO: 90058 - DNA, 20 bp, synthetic construct
  misc_feature 1..20: note = CRISPR gRNA sequence
  source 1..20: mol_type = other DNA
catagggtagcttctgtcag

SEQ ID NO: 90059 - DNA, 20 bp, synthetic construct
  misc_feature 1..20: note = CRISPR gRNA sequence
  source 1..20: mol_type = other DNA
ctgtcagggaatcttggttc

SEQ ID NO: 90060 - DNA, 20 bp, synthetic construct
  misc_feature 1..20: note = CRISPR gRNA sequence
  source 1..20: mol_type = other DNA
tgtcagggaatcttggttct

SEQ ID NO: 90061 - DNA, 20 bp, synthetic construct
  misc_feature 1..20: note = CRISPR gRNA sequence
  source 1..20: mol_type = other DNA
tcagggaatcttggttcttc

SEQ ID NO: 90062 - DNA, 20 bp, synthetic construct
  misc_feature 1..20: note = CRISPR gRNA sequence
  source 1..20: mol_type = other DNA
ggttcttcccaagaaacact

SEQ ID NO: 90063 - DNA, 20 bp, synthetic construct
  misc_feature 1..20: note = CRISPR gRNA sequence
  source 1..20: mol_type = other DNA
gttcttcccaagaaacactg

SEQ ID NO: 90064 - DNA, 20 bp, synthetic construct
  misc_feature 1..20: note = CRISPR gRNA sequence
  source 1..20: mol_type = other DNA
ttcccaagaaacactgattt

SEQ ID NO: 90065 - DNA, 20 bp, synthetic construct
  misc_feature 1..20: note = CRISPR gRNA sequence
  source 1..20: mol_type = other DNA
cccaagaaacactgattttc

SEQ ID NO: 90066 - DNA, 20 bp, synthetic construct
  misc_feature 1..20: note = CRISPR gRNA sequence
  source 1..20: mol_type = other DNA
ccaagaaacactgattttct

SEQ ID NO: 90067 - DNA, 20 bp, synthetic construct
  misc_feature 1..20: note = CRISPR gRNA sequence
  source 1..20: mol_type = other DNA
attttctttcagggagactt

SEQ ID NO: 90068 - DNA, 20 bp, synthetic construct
  misc_feature 1..20: note = CRISPR gRNA sequence
  source 1..20: mol_type = other DNA
tctttcagggagacttcatg

SEQ ID NO: 90069 - DNA, 20 bp, synthetic construct
  misc_feature 1..20: note = CRISPR gRNA sequence
  source 1..20: mol_type = other DNA
ctttcagggagacttcatgt

SEQ ID NO: 90070 - DNA, 20 bp, synthetic construct
  misc_feature 1..20: note = CRISPR gRNA sequence
  source 1..20: mol_type = other DNA
tttcagggagacttcatgtg

SEQ ID NO: 90071 - DNA, 20 bp, synthetic construct
  misc_feature 1..20: note = CRISPR gRNA sequence
  source 1..20: mol_type = other DNA
tcagggagacttcatgtgtt

SEQ ID NO: 90072 - DNA, 20 bp, synthetic construct
  misc_feature 1..20: note = CRISPR gRNA sequence
  source 1..20: mol_type = other DNA
cagggagacttcatgtgttc

SEQ ID NO: 90073 - DNA, 20 bp, synthetic construct
  misc_feature 1..20: note = CRISPR gRNA sequence
  source 1..20: mol_type = other DNA
agggagacttcatgtgttca

SEQ ID NO: 90074 - DNA, 20 bp, synthetic construct
  misc_feature 1..20: note = CRISPR gRNA sequence
  source 1..20: mol_type = other DNA
catgtgttcatttatttcca

SEQ ID NO: 90075 - DNA, 20 bp, synthetic construct
  misc_feature 1..20: note = CRISPR gRNA sequence
  source 1..20: mol_type = other DNA
atgtgttcatttatttccac

SEQ ID NO: 90076 - DNA, 20 bp, synthetic construct
  misc_feature 1..20: note = CRISPR gRNA sequence
  source 1..20: mol_type = other DNA
atttatttccaccacagcag

SEQ ID NO: 90077 - DNA, 20 bp, synthetic construct
  misc_feature 1..20: note = CRISPR gRNA sequence
  source 1..20: mol_type = other DNA
atttccaccacagcagattt

SEQ ID NO: 90078 - DNA, 20 bp, synthetic construct
  misc_feature 1..20: note = CRISPR gRNA sequence
  source 1..20: mol_type = other DNA
tttccaccacagcagatttt

SEQ ID NO: 90079 - DNA, 20 bp, synthetic construct
  misc_feature 1..20: note = CRISPR gRNA sequence
  source 1..20: mol_type = other DNA
ccaccacagcagattttaag

SEQ ID NO: 90080 - DNA, 20 bp, synthetic construct
  misc_feature 1..20: note = CRISPR gRNA sequence
  source 1..20: mol_type = other DNA
caccacagcagattttaaga

SEQ ID NO: 90081 - DNA, 20 bp, synthetic construct
  misc_feature 1..20: note = CRISPR gRNA sequence
  source 1..20: mol_type = other DNA
taagaaattataatatgtaa

SEQ ID NO: 90082 - DNA, 20 bp, synthetic construct
  misc_feature 1..20: note = CRISPR gRNA sequence
  source 1..20: mol_type = other DNA
aagaaattataatatgtaat

SEQ ID NO: 90083 - DNA, 20 bp, synthetic construct
  misc_feature 1..20: note = CRISPR gRNA sequence
  source 1..20: mol_type = other DNA
agaaattataatatgtaata

SEQ ID NO: 90084 - DNA, 20 bp, synthetic construct
  misc_feature 1..20: note = CRISPR gRNA sequence
  source 1..20: mol_type = other DNA
taatatgtaatatttgatat

SEQ ID NO: 90085 - DNA, 20 bp, synthetic construct
  misc_feature 1..20: note = CRISPR gRNA sequence
  source 1..20: mol_type = other DNA
gatatctataaagagtatat

SEQ ID NO: 90086 - DNA, 20 bp, synthetic construct
  misc_feature 1..20: note = CRISPR gRNA sequence
  source 1..20: mol_type = other DNA
atatctataaagagtatatc

SEQ ID NO: 90087 - DNA, 20 bp, synthetic construct
  misc_feature 1..20: note = CRISPR gRNA sequence
  source 1..20: mol_type = other DNA
taaagagtatatctaacgtg

SEQ ID NO: 90088 - DNA, 20 bp, synthetic construct
  misc_feature 1..20: note = CRISPR gRNA sequence
  source 1..20: mol_type = other DNA
acgtgaataaattatgaagc

SEQ ID NO: 90089 - DNA, 20 bp, synthetic construct
  misc_feature 1..20: note = CRISPR gRNA sequence
  source 1..20: mol_type = other DNA
tgaagcatactaatgagtac

SEQ ID NO: 90090 - DNA, 20 bp, synthetic construct
  misc_feature 1..20: note = CRISPR gRNA sequence
  source 1..20: mol_type = other DNA
atgagtacctatgacccata

SEQ ID NO: 90091 - DNA, 20 bp, synthetic construct
  misc_feature 1..20: note = CRISPR gRNA sequence
  source 1..20: mol_type = other DNA
tgacccataacacatataca

SEQ ID NO: 90092 - DNA, 20 bp, synthetic construct
  misc_feature 1..20: note = CRISPR gRNA sequence
  source 1..20: mol_type = other DNA
aaacattttaaataccattg

SEQ ID NO: 90093 - DNA, 20 bp, synthetic construct
  misc_feature 1..20: note = CRISPR gRNA sequence
  source 1..20: mol_type = other DNA
taaataccattgtgtttgtg

SEQ ID NO: 90094 - DNA, 20 bp, synthetic construct
  misc_feature 1..20: note = CRISPR gRNA sequence
  source 1..20: mol_type = other DNA
aaataccattgtgtttgtgt

SEQ ID NO: 90095 - DNA, 20 bp, synthetic construct
  misc_feature 1..20: note = CRISPR gRNA sequence
  source 1..20: mol_type = other DNA
aataccattgtgtttgtgtt

SEQ ID NO: 90096 - DNA, 20 bp, synthetic construct
  misc_feature 1..20: note = CRISPR gRNA sequence
  source 1..20: mol_type = other DNA
tgtttgtgttcctccctagc

SEQ ID NO: 90097 - DNA, 20 bp, synthetic construct
  misc_feature 1..20: note = CRISPR gRNA sequence
  source 1..20: mol_type = other DNA
gtgttcctccctagcctgtc

SEQ ID NO: 90098 - DNA, 20 bp, synthetic construct
  misc_feature 1..20: note = CRISPR gRNA sequence
  source 1..20: mol_type = other DNA
tgttcctccctagcctgtcc

SEQ ID NO: 90099 - DNA, 20 bp, synthetic construct
  misc_feature 1..20: note = CRISPR gRNA sequence
  source 1..20: mol_type = other DNA
ctccctagcctgtcccccgc

SEQ ID NO: 90100 - DNA, 20 bp, synthetic construct
  misc_feature 1..20: note = CRISPR gRNA sequence
  source 1..20: mol_type = other DNA
cctagcctgtcccccgcctc

SEQ ID NO: 90101 - DNA, 20 bp, synthetic construct
  misc_feature 1..20: note = CRISPR gRNA sequence
  source 1..20: mol_type = other DNA
gcctgtcccccgcctcttct

SEQ ID NO: 90102 - DNA, 20 bp, synthetic construct
  misc_feature 1..20: note = CRISPR gRNA sequence
  source 1..20: mol_type = other DNA
tcccccgcctcttcttagcg

SEQ ID NO: 90103 - DNA, 20 bp, synthetic construct
  misc_feature 1..20: note = CRISPR gRNA sequence
  source 1..20: mol_type = other DNA
ttcttagcggtaaccactgt

SEQ ID NO: 90104 - DNA, 20 bp, synthetic construct
  misc_feature 1..20: note = CRISPR gRNA sequence
  source 1..20: mol_type = other DNA
cttagcggtaaccactgtcc

SEQ ID NO: 90105 - DNA, 20 bp, synthetic construct
  misc_feature 1..20: note = CRISPR gRNA sequence
  source 1..20: mol_type = other DNA
ttagcggtaaccactgtcct

SEQ ID NO: 90106 - DNA, 20 bp, synthetic construct
  misc_feature 1..20: note = CRISPR gRNA sequence
  source 1..20: mol_type = other DNA
agcggtaaccactgtcctta

SEQ ID NO: 90107 - DNA, 20 bp, synthetic construct
  misc_feature 1..20: note = CRISPR gRNA sequence
  source 1..20: mol_type = other DNA
gcggtaaccactgtccttaa

SEQ ID NO: 90108 - DNA, 20 bp, synthetic construct
  misc_feature 1..20: note = CRISPR gRNA sequence
  source 1..20: mol_type = other DNA
tccttaattttcgtgtctat

SEQ ID NO: 90109 - DNA, 20 bp, synthetic construct
  misc_feature 1..20: note = CRISPR gRNA sequence
  source 1..20: mol_type = other DNA
aattttcgtgtctattatct

SEQ ID NO: 90110 - DNA, 20 bp, synthetic construct
  misc_feature 1..20: note = CRISPR gRNA sequence
  source 1..20: mol_type = other DNA
attttcgtgtctattatctg

SEQ ID NO: 90111 - DNA, 20 bp, synthetic construct
  misc_feature 1..20: note = CRISPR gRNA sequence
  source 1..20: mol_type = other DNA
tcgtgtctattatctgctat

SEQ ID NO: 90112 - DNA, 20 bp, synthetic construct
  misc_feature 1..20: note = CRISPR gRNA sequence
  source 1..20: mol_type = other DNA
cgtgtctattatctgctata

SEQ ID NO: 90113 - DNA, 20 bp, synthetic construct
  misc_feature 1..20: note = CRISPR gRNA sequence
  source 1..20: mol_type = other DNA
gtgtctattatctgctatag

SEQ ID NO: 90114 - DNA, 20 bp, synthetic construct
  misc_feature 1..20: note = CRISPR gRNA sequence
  source 1..20: mol_type = other DNA
ttatctgctatagatatttt

SEQ ID NO: 90115 - DNA, 20 bp, synthetic construct
  misc_feature 1..20: note = CRISPR gRNA sequence
  source 1..20: mol_type = other DNA
tctgctatagatatttttta

SEQ ID NO: 90116 - DNA, 20 bp, synthetic construct
  misc_feature 1..20: note = CRISPR gRNA sequence
  source 1..20: mol_type = other DNA
cccagcgtgtcctgagtctt

SEQ ID NO: 90117 - DNA, 20 bp, synthetic construct
  misc_feature 1..20: note = CRISPR gRNA sequence
  source 1..20: mol_type = other DNA
tcctgagtctttggttcgcg

SEQ ID NO: 90118 - DNA, 20 bp, synthetic construct
  misc_feature 1..20: note = CRISPR gRNA sequence
  source 1..20: mol_type = other DNA
tttggttcgcgaagtgccgt

SEQ ID NO: 90119 - DNA, 20 bp, synthetic construct
  misc_feature 1..20: note = CRISPR gRNA sequence
  source 1..20: mol_type = other DNA
ttggttcgcgaagtgccgtt

SEQ ID NO: 90120 - DNA, 20 bp, synthetic construct
  misc_feature 1..20: note = CRISPR gRNA sequence
  source 1..20: mol_type = other DNA
tcgcgaagtgccgttaggcc

SEQ ID NO: 90121 - DNA, 20 bp, synthetic construct
  misc_feature 1..20: note = CRISPR gRNA sequence
  source 1..20: mol_type = other DNA
cgaagtgccgttaggccaag

SEQ ID NO: 90122 - DNA, 20 bp, synthetic construct
  misc_feature 1..20: note = CRISPR gRNA sequence
  source 1..20: mol_type = other DNA
gaagtgccgttaggccaagc

SEQ ID NO: 90123 - DNA, 20 bp, synthetic construct
  misc_feature 1..20: note = CRISPR gRNA sequence
  source 1..20: mol_type = other DNA
ttaggccaagcaggtgctaa

SEQ ID NO: 90124 - DNA, 20 bp, synthetic construct
  misc_feature 1..20: note = CRISPR gRNA sequence
  source 1..20: mol_type = other DNA
ccaagcaggtgctaaaagcc

SEQ ID NO: 90125 - DNA, 20 bp, synthetic construct
  misc_feature 1..20: note = CRISPR gRNA sequence
  source 1..20: mol_type = other DNA
caagcaggtgctaaaagccc

SEQ ID NO: 90126 - DNA, 20 bp, synthetic construct
  misc_feature 1..20: note = CRISPR gRNA sequence
  source 1..20: mol_type = other DNA
aagcaggtgctaaaagcccg

SEQ ID NO: 90127 - DNA, 20 bp, synthetic construct
  misc_feature 1..20: note = CRISPR gRNA sequence
  source 1..20: mol_type = other DNA
gtgctaaaagcccggggtcg

SEQ ID NO: 90128 - DNA, 20 bp, synthetic construct
  misc_feature 1..20: note = CRISPR gRNA sequence
  source 1..20: mol_type = other DNA
aagcccggggtcgtggaccc

SEQ ID NO: 90129 - DNA, 20 bp, synthetic construct
  misc_feature 1..20: note = CRISPR gRNA sequence
  source 1..20: mol_type = other DNA
ccggggtcgtggaccccggc

SEQ ID NO: 90130 - DNA, 20 bp, synthetic construct
  misc_feature 1..20: note = CRISPR gRNA sequence
  source 1..20: mol_type = other DNA
cggggtcgtggaccccggcc

SEQ ID NO: 90131 - DNA, 20 bp, synthetic construct
  misc_feature 1..20: note = CRISPR gRNA sequence
  source 1..20: mol_type = other DNA
cgtggaccccggccaggtct

SEQ ID NO: 90132 - DNA, 20 bp, synthetic construct
  misc_feature 1..20: note = CRISPR gRNA sequence
  source 1..20: mol_type = other DNA
ggaccccggccaggtcttag

SEQ ID NO: 90133 - DNA, 20 bp, synthetic construct
  misc_feature 1..20: note = CRISPR gRNA sequence
  source 1..20: mol_type = other DNA
ccggccaggtcttagcagca

SEQ ID NO: 90134 - DNA, 20 bp, synthetic construct
  misc_feature 1..20: note = CRISPR gRNA sequence
  source 1..20: mol_type = other DNA
ggccaggtcttagcagcatg

SEQ ID NO: 90135 - DNA, 20 bp, synthetic construct
  misc_feature 1..20: note = CRISPR gRNA sequence
  source 1..20: mol_type = other DNA
gccaggtcttagcagcatgg

SEQ ID NO: 90136 - DNA, 20 bp, synthetic construct
  misc_feature 1..20: note = CRISPR gRNA sequence
  source 1..20: mol_type = other DNA
gtcttagcagcatggaggcg

SEQ ID NO: 90137 - DNA, 20 bp, synthetic construct
  misc_feature 1..20: note = CRISPR gRNA sequence
  source 1..20: mol_type = other DNA
tcttagcagcatggaggcgc

SEQ ID NO: 90138 - DNA, 20 bp, synthetic construct
  misc_feature 1..20: note = CRISPR gRNA sequence
  source 1..20: mol_type = other DNA
cttagcagcatggaggcgca

SEQ ID NO: 90139 - DNA, 20 bp, synthetic construct
  misc_feature 1..20: note = CRISPR gRNA sequence
  source 1..20: mol_type = other DNA
cagcatggaggcgcagggtg

SEQ ID NO: 90140 - DNA, 20 bp, synthetic construct
  misc_feature 1..20: note = CRISPR gRNA sequence
  source 1..20: mol_type = other DNA
catggaggcgcagggtgtag

SEQ ID NO: 90141 - DNA, 20 bp, synthetic construct
  misc_feature 1..20: note = CRISPR gRNA sequence
  source 1..20: mol_type = other DNA
tggaggcgcagggtgtagcg

SEQ ID NO: 90142 - DNA, 20 bp, synthetic construct
  misc_feature 1..20: note = CRISPR gRNA sequence
  source 1..20: mol_type = other DNA
ggaggcgcagggtgtagcgg

SEQ ID NO: 90143 - DNA, 20 bp, synthetic construct
  misc_feature 1..20: note = CRISPR gRNA sequence
  source 1..20: mol_type = other DNA
gaggcgcagggtgtagcgga

SEQ ID NO: 90144 - DNA, 20 bp, synthetic construct
  misc_feature 1..20: note = CRISPR gRNA sequence
  source 1..20: mol_type = other DNA
gcagggtgtagcggagggcg

SEQ ID NO: 90145 - DNA, 20 bp, synthetic construct
  misc_feature 1..20: note = CRISPR gRNA sequence
  source 1..20: mol_type = other DNA
cagggtgtagcggagggcgc

SEQ ID NO: 90146 - DNA, 20 bp, synthetic construct
  misc_feature 1..20: note = CRISPR gRNA sequence
  source 1..20: mol_type = other DNA
agggtgtagcggagggcgcg

SEQ ID NO: 90147 - DNA, 20 bp, synthetic construct
  misc_feature 1..20: note = CRISPR gRNA sequence
  source 1..20: mol_type = other DNA
tgtagcggagggcgcggggc

SEQ ID NO: 90148 - DNA, 20 bp, synthetic construct
  misc_feature 1..20: note = CRISPR gRNA sequence
  source 1..20: mol_type = other DNA
gtagcggagggcgcggggcc

SEQ ID NO: 90149 - DNA, 20 bp, synthetic construct
  misc_feature 1..20: note = CRISPR gRNA sequence
  source 1..20: mol_type = other DNA
ggcgcggggccgggcgccgc

SEQ ID NO: 90150 - DNA, 20 bp, synthetic construct
  misc_feature 1..20: note = CRISPR gRNA sequence
  source 1..20: mol_type = other DNA
gcggggccgggcgccgccag

SEQ ID NO: 90151 - DNA, 20 bp, synthetic construct
  misc_feature 1..20: note = CRISPR gRNA sequence
  source 1..20: mol_type = other DNA
cagcggcgtgccccaccccg

SEQ ID NO: 90152 - DNA, 20 bp, synthetic construct
  misc_feature 1..20: note = CRISPR gRNA sequence
  source 1..20: mol_type = other DNA
cgtgccccaccccgcggccc

SEQ ID NO: 90153 - DNA, 20 bp, synthetic construct
  misc_feature 1..20: note = CRISPR gRNA sequence
  source 1..20: mol_type = other DNA
ccaccccgcggccctagccc

SEQ ID NO: 90154 - DNA, 20 bp, synthetic construct
  misc_feature 1..20: note = CRISPR gRNA sequence
  source 1..20: mol_type = other DNA
cgcggccctagccccggctg

SEQ ID NO: 90155 - DNA, 20 bp, synthetic construct
  misc_feature 1..20: note = CRISPR gRNA sequence
  source 1..20: mol_type = other DNA
cccggctgcggctcccacct

SEQ ID NO: 90156 - DNA, 20 bp, synthetic construct
  misc_feature 1..20: note = CRISPR gRNA sequence
  source 1..20: mol_type = other DNA
tgcggctcccaccttggcgc

SEQ ID NO: 90157 - DNA, 20 bp, synthetic construct
  misc_feature 1..20: note = CRISPR gRNA sequence
  source 1..20: mol_type = other DNA
tcccaccttggcgccagcct

SEQ ID NO: 90158 - DNA, 20 bp, synthetic construct
  misc_feature 1..20: note = CRISPR gRNA sequence
  source 1..20: mol_type = other DNA
caccttggcgccagcctcgg

SEQ ID NO: 90159 - DNA, 20 bp, synthetic construct
  misc_feature 1..20: note = CRISPR gRNA sequence
  source 1..20: mol_type = other DNA
cttggcgccagcctcggtgg

SEQ ID NO: 90160 - DNA, 20 bp, synthetic construct
  misc_feature 1..20: note = CRISPR gRNA sequence
  source 1..20: mol_type = other DNA
gccagcctcggtggcggccg

SEQ ID NO: 90161 - DNA, 20 bp, synthetic construct
  misc_feature 1..20: note = CRISPR gRNA sequence
  source 1..20: mol_type = other DNA
ggcctctcaattcaccctgc

SEQ ID NO: 90162 - DNA, 20 bp, synthetic construct
  misc_feature 1..20: note = CRISPR gRNA sequence
  source 1..20: mol_type = other DNA
ctagtgatgcaaccctgtgc

SEQ ID NO: 90163 - DNA, 20 bp, synthetic construct
  misc_feature 1..20: note = CRISPR gRNA sequence
  source 1..20: mol_type = other DNA
tagtgatgcaaccctgtgct

SEQ ID NO: 90164 - DNA, 20 bp, synthetic construct
  misc_feature 1..20: note = CRISPR gRNA sequence
  source 1..20: mol_type = other DNA
tgatgcaaccctgtgctggg

SEQ ID NO: 90165 - DNA, 20 bp, synthetic construct
  misc_feature 1..20: note = CRISPR gRNA sequence
  source 1..20: mol_type = other DNA
gatgcaaccctgtgctgggc

SEQ ID NO: 90166 - DNA, 20 bp, synthetic construct
  misc_feature 1..20: note = CRISPR gRNA sequence
  source 1..20: mol_type = other DNA
aaccctgtgctgggcaggac

SEQ ID NO: 90167 - DNA, 20 bp, synthetic construct
  misc_feature 1..20: note = CRISPR gRNA sequence
  source 1..20: mol_type = other DNA
accctgtgctgggcaggacg

SEQ ID NO: 90168 - DNA, 20 bp, synthetic construct
  misc_feature 1..20: note = CRISPR gRNA sequence
  source 1..20: mol_type = other DNA
tgctgggcaggacgaggctg

SEQ ID NO: 90169 - DNA, 20 bp, synthetic construct
  misc_feature 1..20: note = CRISPR gRNA sequence
  source 1..20: mol_type = other DNA
caggacgaggctgcggcccc

SEQ ID NO: 90170 - DNA, 20 bp, synthetic construct
  misc_feature 1..20: note = CRISPR gRNA sequence
  source 1..20: mol_type = other DNA
aggacgaggctgcggccccc

SEQ ID NO: 90171 - DNA, 20 bp, synthetic construct
  misc_feature 1..20: note = CRISPR gRNA sequence
  source 1..20: mol_type = other DNA
ggacgaggctgcggcccccg

SEQ ID NO: 90172 - DNA, 20 bp, synthetic construct
  misc_feature 1..20: note = CRISPR gRNA sequence
  source 1..20: mol_type = other DNA
gacgaggctgcggcccccgg

SEQ ID NO: 90173 - DNA, 20 bp, synthetic construct
  misc_feature 1..20: note = CRISPR gRNA sequence
  source 1..20: mol_type = other DNA
gaggctgcggcccccggggg

SEQ ID NO: 90174 - DNA, 20 bp, synthetic construct
  misc_feature 1..20: note = CRISPR gRNA sequence
  source 1..20: mol_type = other DNA
gcggcccccgggggcagcgt

SEQ ID NO: 90175 - DNA, 20 bp, synthetic construct
  misc_feature 1..20: note = CRISPR gRNA sequence
  source 1..20: mol_type = other DNA
cggcccccgggggcagcgtt

SEQ ID NO: 90176 - DNA, 20 bp, synthetic construct
  misc_feature 1..20: note = CRISPR gRNA sequence
  source 1..20: mol_type = other DNA
ggcccccgggggcagcgttg

SEQ ID NO: 90177 - DNA, 20 bp, synthetic construct
  misc_feature 1..20: note = CRISPR gRNA sequence
  source 1..20: mol_type = other DNA
ccccgggggcagcgttgggg

SEQ ID NO: 90178 - DNA, 20 bp, synthetic construct
  misc_feature 1..20: note = CRISPR gRNA sequence
  source 1..20: mol_type = other DNA
cccgggggcagcgttggggc

SEQ ID NO: 90179 - DNA, 20 bp, synthetic construct
  misc_feature 1..20: note = CRISPR gRNA sequence
  source 1..20: mol_type = other DNA
ggggcagcgttggggcgggc

SEQ ID NO: 90180 - DNA, 20 bp, synthetic construct
  misc_feature 1..20: note = CRISPR gRNA sequence
  source 1..20: mol_type = other DNA
gttggggcgggcaagcccgt

SEQ ID NO: 90181 - DNA, 20 bp, synthetic construct
  misc_feature 1..20: note = CRISPR gRNA sequence
  source 1..20: mol_type = other DNA
ttggggcgggcaagcccgtt

SEQ ID NO: 90182 - DNA, 20 bp, synthetic construct
  misc_feature 1..20: note = CRISPR gRNA sequence
  source 1..20: mol_type = other DNA
gcccgttaggtacctgtgcg

SEQ ID NO: 90183 - DNA, 20 bp, synthetic construct
  misc_feature 1..20: note = CRISPR gRNA sequence
  source 1..20: mol_type = other DNA
cccgttaggtacctgtgcga

SEQ ID NO: 90184 - DNA, 20 bp, synthetic construct
  misc_feature 1..20: note = CRISPR gRNA sequence
  source 1..20: mol_type = other DNA
ccgttaggtacctgtgcgaa

SEQ ID NO: 90185 - DNA, 20 bp, synthetic construct
  misc_feature 1..20: note = CRISPR gRNA sequence
  source 1..20: mol_type = other DNA
cgttaggtacctgtgcgaag

SEQ ID NO: 90186 - DNA, 20 bp, synthetic construct
  misc_feature 1..20: note = CRISPR gRNA sequence
  source 1..20: mol_type = other DNA
aggtacctgtgcgaaggggc

SEQ ID NO: 90187 - DNA, 20 bp, synthetic construct
  misc_feature 1..20: note = CRISPR gRNA sequence
  source 1..20: mol_type = other DNA
ggtacctgtgcgaaggggcc

SEQ ID NO: 90188 - DNA, 20 bp, synthetic construct
  misc_feature 1..20: note = CRISPR gRNA sequence
  source 1..20: mol_type = other DNA
gtacctgtgcgaaggggccg

SEQ ID NO: 90189 - DNA, 20 bp, synthetic construct
  misc_feature 1..20: note = CRISPR gRNA sequence
  source 1..20: mol_type = other DNA
ctgtgcgaaggggccgggga

SEQ ID NO: 90190 - DNA, 20 bp, synthetic construct
  misc_feature 1..20: note = CRISPR gRNA sequence
  source 1..20: mol_type = other DNA
cgaaggggccggggatggcg

SEQ ID NO: 90191 - DNA, 20 bp, synthetic construct
  misc_feature 1..20: note = CRISPR gRNA sequence
  source 1..20: mol_type = other DNA
aaggggccggggatggcgaa

SEQ ID NO: 90192 - DNA, 20 bp, synthetic construct
  misc_feature 1..20: note = CRISPR gRNA sequence
  source 1..20: mol_type = other DNA
aggggccggggatggcgaag

SEQ ID NO: 90193 - DNA, 20 bp, synthetic construct
  misc_feature 1..20: note = CRISPR gRNA sequence
  source 1..20: mol_type = other DNA
gggccggggatggcgaagag

SEQ ID NO: 90194 - DNA, 20 bp, synthetic construct
  misc_feature 1..20: note = CRISPR gRNA sequence
  source 1..20: mol_type = other DNA
ggccggggatggcgaagagg

SEQ ID NO: 90195 - DNA, 20 bp, synthetic construct
  misc_feature 1..20: note = CRISPR gRNA sequence
  source 1..20: mol_type = other DNA
ggggatggcgaagaggaggc

SEQ ID NO: 90196 - DNA, 20 bp, synthetic construct
  misc_feature 1..20: note = CRISPR gRNA sequence
  source 1..20: mol_type = other DNA
gggatggcgaagaggaggct

SEQ ID NO: 90197 - DNA, 20 bp, synthetic construct
  misc_feature 1..20: note = CRISPR gRNA sequence
  source 1..20: mol_type = other DNA
ggatggcgaagaggaggctg

SEQ ID NO: 90198 - DNA, 20 bp, synthetic construct
  misc_feature 1..20: note = CRISPR gRNA sequence
  source 1..20: mol_type = other DNA
atggcgaagaggaggctggg

SEQ ID NO: 90199 - DNA, 20 bp, synthetic construct
  misc_feature 1..20: note = CRISPR gRNA sequence
  source 1..20: mol_type = other DNA
tggcgaagaggaggctgggg

SEQ ID NO: 90200 - DNA, 20 bp, synthetic construct
  misc_feature 1..20: note = CRISPR gRNA sequence
  source 1..20: mol_type = other DNA
aagaggaggctggggaggac

SEQ ID NO: 90201 - DNA, 20 bp, synthetic construct
  misc_feature 1..20: note = CRISPR gRNA sequence
  source 1..20: mol_type = other DNA
agaggaggctggggaggacg

SEQ ID NO: 90202 - DNA, 20 bp, synthetic construct
  misc_feature 1..20: note = CRISPR gRNA sequence
  source 1..20: mol_type = other DNA
ggaggctggggaggacgagg

SEQ ID NO: 90203 - DNA, 20 bp, synthetic construct
  misc_feature 1..20: note = CRISPR gRNA sequence
  source 1..20: mol_type = other DNA
ggaggacgaggcggacctgt

SEQ ID NO: 90204 - DNA, 20 bp, synthetic construct
  misc_feature 1..20: note = CRISPR gRNA sequence
  source 1..20: mol_type = other DNA
ggcggacctgttagacactt

SEQ ID NO: 90205 - DNA, 20 bp, synthetic construct
  misc_feature 1..20: note = CRISPR gRNA sequence
  source 1..20: mol_type = other DNA
gttagacacttcggaccctc

SEQ ID NO: 90206 - DNA, 20 bp, synthetic construct
  misc_feature 1..20: note = CRISPR gRNA sequence
  source 1..20: mol_type = other DNA
ttagacacttcggaccctcc

SEQ ID NO: 90207 - DNA, 20 bp, synthetic construct
  misc_feature 1..20: note = CRISPR gRNA sequence
  source 1..20: mol_type = other DNA
tagacacttcggaccctccg

SEQ ID NO: 90208 - DNA, 20 bp, synthetic construct
  misc_feature 1..20: note = CRISPR gRNA sequence
  source 1..20: mol_type = other DNA
agacacttcggaccctccgg

SEQ ID NO: 90209 - DNA, 20 bp, synthetic construct
  misc_feature 1..20: note = CRISPR gRNA sequence
  source 1..20: mol_type = other DNA
gacacttcggaccctccggg

SEQ ID NO: 90210 - DNA, 20 bp, synthetic construct
  misc_feature 1..20: note = CRISPR gRNA sequence
  source 1..20: mol_type = other DNA
cacttcggaccctccggggg

SEQ ID NO: 90211 - DNA, 20 bp, synthetic construct
  misc_feature 1..20: note = CRISPR gRNA sequence
  source 1..20: mol_type = other DNA
acttcggaccctccgggggg

SEQ ID NO: 90212 - DNA, 20 bp, synthetic construct
  misc_feature 1..20: note = CRISPR gRNA sequence
  source 1..20: mol_type = other DNA
cggaccctccggggggaggc

SEQ ID NO: 90213 - DNA, 20 bp, synthetic construct
  misc_feature 1..20: note = CRISPR gRNA sequence
  source 1..20: mol_type = other DNA
gaccctccggggggaggcga

SEQ ID NO: 90214 - DNA, 20 bp, synthetic construct
  misc_feature 1..20: note = CRISPR gRNA sequence
  source 1..20: mol_type = other DNA
tccggggggaggcgagagcg

SEQ ID NO: 90215 - DNA, 20 bp, synthetic construct
  misc_feature 1..20: note = CRISPR gRNA sequence
  source 1..20: mol_type = other DNA
gggggaggcgagagcgcggc

SEQ ID NO: 90216 - DNA, 20 bp, synthetic construct
  misc_feature 1..20: note = CRISPR gRNA sequence
  source 1..20: mol_type = other DNA
aggcgagagcgcggctagtt

SEQ ID NO: 90217 - DNA, 20 bp, synthetic construct
  misc_feature 1..20: note = CRISPR gRNA sequence
  source 1..20: mol_type = other DNA
gcgagagcgcggctagtttg

SEQ ID NO: 90218 - DNA, 20 bp, synthetic construct
  misc_feature 1..20: note = CRISPR gRNA sequence
  source 1..20: mol_type = other DNA
cgagagcgcggctagtttgg

SEQ ID NO: 90219 - DNA, 20 bp, synthetic construct
  misc_feature 1..20: note = CRISPR gRNA sequence
  source 1..20: mol_type = other DNA
cgcggctagtttggaggatc

SEQ ID NO: 90220 - DNA, 20 bp, synthetic construct
  misc_feature 1..20: note = CRISPR gRNA sequence
  source 1..20: mol_type = other DNA
cggctagtttggaggatcta

SEQ ID NO: 90221 - DNA, 20 bp, synthetic construct
  misc_feature 1..20: note = CRISPR gRNA sequence
  source 1..20: mol_type = other DNA
ggctagtttggaggatctag

SEQ ID NO: 90222 - DNA, 20 bp, synthetic construct
  misc_feature 1..20: note = CRISPR gRNA sequence
  source 1..20: mol_type = other DNA
gtttggaggatctagaggac

SEQ ID NO: 90223 - DNA, 20 bp, synthetic construct
  misc_feature 1..20: note = CRISPR gRNA sequence
  source 1..20: mol_type = other DNA
tttggaggatctagaggacg

SEQ ID NO: 90224 - DNA, 20 bp, synthetic construct
  misc_feature 1..20: note = CRISPR gRNA sequence
  source 1..20: mol_type = other DNA
tggaggatctagaggacgag

SEQ ID NO: 90225 - DNA, 20 bp, synthetic construct
  misc_feature 1..20: note = CRISPR gRNA sequence
  source 1..20: mol_type = other DNA
agaggacgaggagactcact

SEQ ID NO: 90226 - DNA, 20 bp, synthetic construct
  misc_feature 1..20: note = CRISPR gRNA sequence
  source 1..20: mol_type = other DNA
gaggacgaggagactcactc

SEQ ID NO: 90227 - DNA, 20 bp, synthetic construct
  misc_feature 1..20: note = CRISPR gRNA sequence
  source 1..20: mol_type = other DNA
aggacgaggagactcactcg

SEQ ID NO: 90228 - DNA, 20 bp, synthetic construct
  misc_feature 1..20: note = CRISPR gRNA sequence
  source 1..20: mol_type = other DNA
ggacgaggagactcactcgg

SEQ ID NO: 90229 - DNA, 20 bp, synthetic construct
  misc_feature 1..20: note = CRISPR gRNA sequence
  source 1..20: mol_type = other DNA
gacgaggagactcactcggg

SEQ ID NO: 90230 - DNA, 20 bp, synthetic construct
  misc_feature 1..20: note = CRISPR gRNA sequence
  source 1..20: mol_type = other DNA
aggagactcactcggggggc

SEQ ID NO: 90231 - DNA, 20 bp, synthetic construct
  misc_feature 1..20: note = CRISPR gRNA sequence
  source 1..20: mol_type = other DNA
ggagactcactcggggggcg

SEQ ID NO: 90232 - DNA, 20 bp, synthetic construct
  misc_feature 1..20: note = CRISPR gRNA sequence
  source 1..20: mol_type = other DNA
gagactcactcggggggcga

SEQ ID NO: 90233 - DNA, 20 bp, synthetic construct
  misc_feature 1..20: note = CRISPR gRNA sequence
  source 1..20: mol_type = other DNA
actcactcggggggcgaggg

SEQ ID NO: 90234 - DNA, 20 bp, synthetic construct
  misc_feature 1..20: note = CRISPR gRNA sequence
  source 1..20: mol_type = other DNA
cactcggggggcgagggcag

SEQ ID NO: 90235 - DNA, 20 bp, synthetic construct
  misc_feature 1..20: note = CRISPR gRNA sequence
  source 1..20: mol_type = other DNA
tcggggggcgagggcagcag

SEQ ID NO: 90236 - DNA, 20 bp, synthetic construct
  misc_feature 1..20: note = CRISPR gRNA sequence
  source 1..20: mol_type = other DNA
cggggggcgagggcagcagc

SEQ ID NO: 90237 - DNA, 20 bp, synthetic construct
  misc_feature 1..20: note = CRISPR gRNA sequence
  source 1..20: mol_type = other DNA
ggggggcgagggcagcagcg

SEQ ID NO: 90238 - DNA, 20 bp, synthetic construct
  misc_feature 1..20: note = CRISPR gRNA sequence
  source 1..20: mol_type = other DNA
gggggcgagggcagcagcgg

SEQ ID NO: 90239 - DNA, 20 bp, synthetic construct
  misc_feature 1..20: note = CRISPR gRNA sequence
  source 1..20: mol_type = other DNA
agggcagcagcgggggcgcc

SEQ ID NO: 90240 - DNA, 20 bp, synthetic construct
  misc_feature 1..20: note = CRISPR gRNA sequence
  source 1..20: mol_type = other DNA
ggcagcagcgggggcgcccg

SEQ ID NO: 90241 - DNA, 20 bp, synthetic construct
  misc_feature 1..20: note = CRISPR gRNA sequence
  source 1..20: mol_type = other DNA
gcagcagcgggggcgcccgg

SEQ ID NO: 90242 - DNA, 20 bp, synthetic construct
  misc_feature 1..20: note = CRISPR gRNA sequence
  source 1..20: mol_type = other DNA
gcagcgggggcgcccggagg

SEQ ID NO: 90243 - DNA, 20 bp, synthetic construct
  misc_feature 1..20: note = CRISPR gRNA sequence
  source 1..20: mol_type = other DNA
cagcgggggcgcccggaggc

SEQ ID NO: 90244 - DNA, 20 bp, synthetic construct
  misc_feature 1..20: note = CRISPR gRNA sequence
  source 1..20: mol_type = other DNA
agcgggggcgcccggaggcg

SEQ ID NO: 90245 - DNA, 20 bp, synthetic construct
  misc_feature 1..20: note = CRISPR gRNA sequence
  source 1..20: mol_type = other DNA
gggggcgcccggaggcgggg

SEQ ID NO: 90246 - DNA, 20 bp, synthetic construct
  misc_feature 1..20: note = CRISPR gRNA sequence
  source 1..20: mol_type = other DNA
ggcgcccggaggcggggcag

SEQ ID NO: 90247 - DNA, 20 bp, synthetic construct
  misc_feature 1..20: note = CRISPR gRNA sequence
  source 1..20: mol_type = other DNA
gcccggaggcggggcagcgg

SEQ ID NO: 90248 - DNA, 20 bp, synthetic construct
  misc_feature 1..20: note = CRISPR gRNA sequence
  source 1..20: mol_type = other DNA
cccggaggcggggcagcggt

SEQ ID NO: 90249 - DNA, 20 bp, synthetic construct
  misc_feature 1..20: note = CRISPR gRNA sequence
  source 1..20: mol_type = other DNA
ccggaggcggggcagcggtg

SEQ ID NO: 90250 - DNA, 20 bp, synthetic construct
  misc_feature 1..20: note = CRISPR gRNA sequence
  source 1..20: mol_type = other DNA
cggaggcggggcagcggtgg

SEQ ID NO: 90251 - DNA, 20 bp, synthetic construct
  misc_feature 1..20: note = CRISPR gRNA sequence
  source 1..20: mol_type = other DNA
aggcggggcagcggtggggg

SEQ ID NO: 90252 - DNA, 20 bp, synthetic construct
  misc_feature 1..20: note = CRISPR gRNA sequence
  source 1..20: mol_type = other DNA
ggcagcggtgggggcagcat

SEQ ID NO: 90253 - DNA, 20 bp, synthetic construct
  misc_feature 1..20: note = CRISPR gRNA sequence
  source 1..20: mol_type = other DNA
gcggtgggggcagcatgagc

SEQ ID NO: 90254 - DNA, 20 bp, synthetic construct
  misc_feature 1..20: note = CRISPR gRNA sequence
  source 1..20: mol_type = other DNA
gagcaagacctgcacctacg

SEQ ID NO: 90255 - DNA, 20 bp, synthetic construct
  misc_feature 1..20: note = CRISPR gRNA sequence
  source 1..20: mol_type = other DNA
agcaagacctgcacctacga

SEQ ID NO: 90256 - DNA, 20 bp, synthetic construct
  misc_feature 1..20: note = CRISPR gRNA sequence
  source 1..20: mol_type = other DNA
acctgcacctacgaaggctg

SEQ ID NO: 90257 - DNA, 20 bp, synthetic construct
  misc_feature 1..20: note = CRISPR gRNA sequence
  source 1..20: mol_type = other DNA
gcacctacgaaggctgcagc

SEQ ID NO: 90258 - DNA, 20 bp, synthetic construct
  misc_feature 1..20: note = CRISPR gRNA sequence
  source 1..20: mol_type = other DNA
gaaggctgcagcgagaccac

SEQ ID NO: 90259 - DNA, 20 bp, synthetic construct
  misc_feature 1..20: note = CRISPR gRNA sequence
  source 1..20: mol_type = other DNA
gctgcagcgagaccacgagc

SEQ ID NO: 90260 - DNA, 20 bp, synthetic construct
  misc_feature 1..20: note = CRISPR gRNA sequence
  source 1..20: mol_type = other DNA
ctgcagcgagaccacgagcc

SEQ ID NO: 90261 - DNA, 20 bp, synthetic construct
  misc_feature 1..20: note = CRISPR gRNA sequence
  source 1..20: mol_type = other DNA
cagcgagaccacgagccagg

SEQ ID NO: 90262 - DNA, 20 bp, synthetic construct
  misc_feature 1..20: note = CRISPR gRNA sequence
  source 1..20: mol_type = other DNA
agaccacgagccaggtggcc

SEQ ID NO: 90263 - DNA, 20 bp, synthetic construct
  misc_feature 1..20: note = CRISPR gRNA sequence
  source 1..20: mol_type = other DNA
ccacgagccaggtggccaag

SEQ ID NO: 90264 - DNA, 20 bp, synthetic construct
  misc_feature 1..20: note = CRISPR gRNA sequence
  source 1..20: mol_type = other DNA
tggccaagcagcgcaaaccg

SEQ ID NO: 90265 - DNA, 20 bp, synthetic construct
  misc_feature 1..20: note = CRISPR gRNA sequence
  source 1..20: mol_type = other DNA
agcgcaaaccgtggatgtgc

SEQ ID NO: 90266 - DNA, 20 bp, synthetic construct
  misc_feature 1..20: note = CRISPR gRNA sequence
  source 1..20: mol_type = other DNA
tgtgcaagaaacaccgcaac

SEQ ID NO: 90267 - DNA, 20 bp, synthetic construct
  misc_feature 1..20: note = CRISPR gRNA sequence
  source 1..20: mol_type = other DNA
aacaccgcaacaagatgtac

SEQ ID NO: 90268 - DNA, 20 bp, synthetic construct
  misc_feature 1..20: note = CRISPR gRNA sequence
  source 1..20: mol_type = other DNA
acaccgcaacaagatgtaca

SEQ ID NO: 90269 - DNA, 20 bp, synthetic construct
  misc_feature 1..20: note = CRISPR gRNA sequence
  source 1..20: mol_type = other DNA
gcaacaagatgtacaaggac

SEQ ID NO: 90270 - DNA, 20 bp, synthetic construct
  misc_feature 1..20: note = CRISPR gRNA sequence
  source 1..20: mol_type = other DNA
tgtacaaggacaagtataaa

SEQ ID NO: 90271 - DNA, 20 bp, synthetic construct
  misc_feature 1..20: note = CRISPR gRNA sequence
  source 1..20: mol_type = other DNA
acaaggacaagtataaaaag

SEQ ID NO: 90272 - DNA, 20 bp, synthetic construct
  misc_feature 1..20: note = CRISPR gRNA sequence
  source 1..20: mol_type = other DNA
aggacaagtataaaaagaag

SEQ ID NO: 90273 - DNA, 20 bp, synthetic construct
  misc_feature 1..20: note = CRISPR gRNA sequence
  source 1..20: mol_type = other DNA
gacaagtataaaaagaagaa

SEQ ID NO: 90274 - DNA, 20 bp, synthetic construct
  misc_feature 1..20: note = CRISPR gRNA sequence
  source 1..20: mol_type = other DNA
ataaaaagaagaagagcgac

SEQ ID NO: 90275 - DNA, 20 bp, synthetic construct
  misc_feature 1..20: note = CRISPR gRNA sequence
  source 1..20: mol_type = other DNA
taaaaagaagaagagcgacc

SEQ ID NO: 90276 - DNA, 20 bp, synthetic construct
  misc_feature 1..20: note = CRISPR gRNA sequence
  source 1..20: mol_type = other DNA
agcgaccaggccctgaactg

SEQ ID NO: 90277 - DNA, 20 bp, synthetic construct
  misc_feature 1..20: note = CRISPR gRNA sequence
  source 1..20: mol_type = other DNA
gaccaggccctgaactgcgg

SEQ ID NO: 90278 - DNA, 20 bp, synthetic construct
  misc_feature 1..20: note = CRISPR gRNA sequence
  source 1..20: mol_type = other DNA
accaggccctgaactgcggt

SEQ ID NO: 90279 - DNA, 20 bp, synthetic construct
  misc_feature 1..20: note = CRISPR gRNA sequence
  source 1..20: mol_type = other DNA
tgcggtgggactgcctcgac

SEQ ID NO: 90280 - DNA, 20 bp, synthetic construct
  misc_feature 1..20: note = CRISPR gRNA sequence
  source 1..20: mol_type = other DNA
ggtgggactgcctcgactgg

SEQ ID NO: 90281 - DNA, 20 bp, synthetic construct
  misc_feature 1..20: note = CRISPR gRNA sequence
  source 1..20: mol_type = other DNA
gactgcctcgactggcagcg

SEQ ID NO: 90282 - DNA, 20 bp, synthetic construct
  misc_feature 1..20: note = CRISPR gRNA sequence
  source 1..20: mol_type = other DNA
actgcctcgactggcagcgc

SEQ ID NO: 90283 - DNA, 20 bp, synthetic construct
  misc_feature 1..20: note = CRISPR gRNA sequence
  source 1..20: mol_type = other DNA
gcgcgggaaacgtcaaactc

SEQ ID NO: 90284 - DNA, 20 bp, synthetic construct
  misc_feature 1..20: note = CRISPR gRNA sequence
  source 1..20: mol_type = other DNA
cgcgggaaacgtcaaactcg

SEQ ID NO: 90285 - DNA, 20 bp, synthetic construct
  misc_feature 1..20: note = CRISPR gRNA sequence
  source 1..20: mol_type = other DNA
aaacgtcaaactcgaggtat

SEQ ID NO: 90286 - DNA, 20 bp, synthetic construct
  misc_feature 1..20: note = CRISPR gRNA sequence
  source 1..20: mol_type = other DNA
caaactcgaggtatcagact

SEQ ID NO: 90287 - DNA, 20 bp, synthetic construct
  misc_feature 1..20: note = CRISPR gRNA sequence
  source 1..20: mol_type = other DNA
tcgaggtatcagacttagct

SEQ ID NO: 90288 - DNA, 20 bp, synthetic construct
  misc_feature 1..20: note = CRISPR gRNA sequence
  source 1..20: mol_type = other DNA
cgaggtatcagacttagctg

SEQ ID NO: 90289 - DNA, 20 bp, synthetic construct
  misc_feature 1..20: note = CRISPR gRNA sequence
  source 1..20: mol_type = other DNA
tatcagacttagctgaggcc

SEQ ID NO: 90290 - DNA, 20 bp, synthetic construct
  misc_feature 1..20: note = CRISPR gRNA sequence
  source 1..20: mol_type = other DNA
atcagacttagctgaggcct

SEQ ID NO: 90291 - DNA, 20 bp, synthetic construct
  misc_feature 1..20: note = CRISPR gRNA sequence
  source 1..20: mol_type = other DNA
tcagacttagctgaggcctg

SEQ ID NO: 90292 - DNA, 20 bp, synthetic construct
  misc_feature 1..20: note = CRISPR gRNA sequence
  source 1..20: mol_type = other DNA
acttagctgaggcctgggga

SEQ ID NO: 90293 - DNA, 20 bp, synthetic construct
  misc_feature 1..20: note = CRISPR gRNA sequence
  source 1..20: mol_type = other DNA
cttagctgaggcctggggat

SEQ ID NO: 90294 - DNA, 20 bp, synthetic construct
  misc_feature 1..20: note = CRISPR gRNA sequence
  source 1..20: mol_type = other DNA
tagctgaggcctggggatgg

SEQ ID NO: 90295 - DNA, 20 bp, synthetic construct
  misc_feature 1..20: note = CRISPR gRNA sequence
  source 1..20: mol_type = other DNA
agctgaggcctggggatggg

SEQ ID NO: 90296 - DNA, 20 bp, synthetic construct
  misc_feature 1..20: note = CRISPR gRNA sequence
  source 1..20: mol_type = other DNA
tgaggcctggggatgggagg

SEQ ID NO: 90297 - DNA, 20 bp, synthetic construct
  misc_feature 1..20: note = CRISPR gRNA sequence
  source 1..20: mol_type = other DNA
ggcctggggatgggaggtgg

SEQ ID NO: 90298 - DNA, 20 bp, synthetic construct
  misc_feature 1..20: note = CRISPR gRNA sequence
  source 1..20: mol_type = other DNA
ctggggatgggaggtggaag

SEQ ID NO: 90299 - DNA, 20 bp, synthetic construct
  misc_feature 1..20: note = CRISPR gRNA sequence
  source 1..20: mol_type = other DNA
cttaacgcaaaccgcatctg

SEQ ID NO: 90300 - DNA, 20 bp, synthetic construct
  misc_feature 1..20: note = CRISPR gRNA sequence
  source 1..20: mol_type = other DNA
ttaacgcaaaccgcatctgc

SEQ ID NO: 90301 - DNA, 20 bp, synthetic construct
  misc_feature 1..20: note = CRISPR gRNA sequence
  source 1..20: mol_type = other DNA
taacgcaaaccgcatctgca

SEQ ID NO: 90302 - DNA, 20 bp, synthetic construct
  misc_feature 1..20: note = CRISPR gRNA sequence
  source 1..20: mol_type = other DNA
cctgcctccccacttccaaa

SEQ ID NO: 90303 - DNA, 20 bp, synthetic construct
  misc_feature 1..20: note = CRISPR gRNA sequence
  source 1..20: mol_type = other DNA
ctgcctccccacttccaaat

SEQ ID NO: 90304 - DNA, 20 bp, synthetic construct
  misc_feature 1..20: note = CRISPR gRNA sequence
  source 1..20: mol_type = other DNA
ctccccacttccaaatgggc

SEQ ID NO: 90305 - DNA, 20 bp, synthetic construct
  misc_feature 1..20: note = CRISPR gRNA sequence
  source 1..20: mol_type = other DNA
cttccaaatgggccggtttg

SEQ ID NO: 90306 - DNA, 20 bp, synthetic construct
  misc_feature 1..20: note = CRISPR gRNA sequence
  source 1..20: mol_type = other DNA
atgggccggtttgcagtgac

SEQ ID NO: 90307 - DNA, 20 bp, synthetic construct
  misc_feature 1..20: note = CRISPR gRNA sequence
  source 1..20: mol_type = other DNA
tgggccggtttgcagtgact

SEQ ID NO: 90308 - DNA, 20 bp, synthetic construct
  misc_feature 1..20: note = CRISPR gRNA sequence
  source 1..20: mol_type = other DNA
ccggtttgcagtgactgggt

SEQ ID NO: 90309 - DNA, 20 bp, synthetic construct
  misc_feature 1..20: note = CRISPR gRNA sequence
  source 1..20: mol_type = other DNA
gtttgcagtgactgggttag

SEQ ID NO: 90310 - DNA, 20 bp, synthetic construct
  misc_feature 1..20: note = CRISPR gRNA sequence
  source 1..20: mol_type = other DNA
cagtgactgggttagtggtt

SEQ ID NO: 90311 - DNA, 20 bp, synthetic construct
  misc_feature 1..20: note = CRISPR gRNA sequence
  source 1..20: mol_type = other DNA
ctgggttagtggttgagaat

SEQ ID NO: 90312 - DNA, 20 bp, synthetic construct
  misc_feature 1..20: note = CRISPR gRNA sequence
  source 1..20: mol_type = other DNA
gggttagtggttgagaatta

SEQ ID NO: 90313 - DNA, 20 bp, synthetic construct
  misc_feature 1..20: note = CRISPR gRNA sequence
  source 1..20: mol_type = other DNA
agagtgtttgccctaaatta

SEQ ID NO: 90314 - DNA, 20 bp, synthetic construct
  misc_feature 1..20: note = CRISPR gRNA sequence
  source 1..20: mol_type = other DNA
agtttataccaacatgtgca

SEQ ID NO: 90315 - DNA, 20 bp, synthetic construct
  misc_feature 1..20: note = CRISPR gRNA sequence
  source 1..20: mol_type = other DNA
caacatgtgcaaagcaataa

SEQ ID NO: 90316 - DNA, 20 bp, synthetic construct
  misc_feature 1..20: note = CRISPR gRNA sequence
  source 1..20: mol_type = other DNA
cagttctgttgaactcatga

SEQ ID NO: 90317 - DNA, 20 bp, synthetic construct
  misc_feature 1..20: note = CRISPR gRNA sequence
  source 1..20: mol_type = other DNA
agttctgttgaactcatgat

SEQ ID NO: 90318 - DNA, 20 bp, synthetic construct
  misc_feature 1..20: note = CRISPR gRNA sequence
  source 1..20: mol_type = other DNA
tgttgaactcatgataggtg

SEQ ID NO: 90319 - DNA, 20 bp, synthetic construct
  misc_feature 1..20: note = CRISPR gRNA sequence
  source 1..20: mol_type = other DNA
catgataggtgcagaaattt

SEQ ID NO: 90320 - DNA, 20 bp, synthetic construct
  misc_feature 1..20: note = CRISPR gRNA sequence
  source 1..20: mol_type = other DNA
cagtaaaaataatgtgacat

SEQ ID NO: 90321 - DNA, 20 bp, synthetic construct
  misc_feature 1..20: note = CRISPR gRNA sequence
  source 1..20: mol_type = other DNA
taaaaataatgtgacatcgg

SEQ ID NO: 90322 - DNA, 20 bp, synthetic construct
  misc_feature 1..20: note = CRISPR gRNA sequence
  source 1..20: mol_type = other DNA
aaaataatgtgacatcggca

SEQ ID NO: 90323 - DNA, 20 bp, synthetic construct
  misc_feature 1..20: note = CRISPR gRNA sequence
  source 1..20: mol_type = other DNA
tgacatcggcagagctgtca

SEQ ID NO: 90324 - DNA, 20 bp, synthetic construct
  misc_feature 1..20: note = CRISPR gRNA sequence
  source 1..20: mol_type = other DNA
cggcagagctgtcatagatc

SEQ ID NO: 90325 - DNA, 20 bp, synthetic construct
  misc_feature 1..20: note = CRISPR gRNA sequence
  source 1..20: mol_type = other DNA
ggcagagctgtcatagatct

SEQ ID NO: 90326 - DNA, 20 bp, synthetic construct
  misc_feature 1..20: note = CRISPR gRNA sequence
  source 1..20: mol_type = other DNA
gctgtcatagatctgggata

SEQ ID NO: 90327 - DNA, 20 bp, synthetic construct
  misc_feature 1..20: note = CRISPR gRNA sequence
  source 1..20: mol_type = other DNA
tcatagatctgggatatggc

SEQ ID NO: 90328 - DNA, 20 bp, synthetic construct
  misc_feature 1..20: note = CRISPR gRNA sequence
  source 1..20: mol_type = other DNA
tagatctgggatatggctgg

SEQ ID NO: 90329 - DNA, 20 bp, synthetic construct
  misc_feature 1..20: note = CRISPR gRNA sequence
  source 1..20: mol_type = other DNA
agatctgggatatggctgga

SEQ ID NO: 90330 - DNA, 20 bp, synthetic construct
  misc_feature 1..20: note = CRISPR gRNA sequence
  source 1..20: mol_type = other DNA
gggatatggctggaaggaca

SEQ ID NO: 90331 - DNA, 20 bp, synthetic construct
  misc_feature 1..20: note = CRISPR gRNA sequence
  source 1..20: mol_type = other DNA
gatatggctggaaggacata

SEQ ID NO: 90332 - DNA, 20 bp, synthetic construct
  misc_feature 1..20: note = CRISPR gRNA sequence
  source 1..20: mol_type = other DNA
aaggacatagagtaaatgat

SEQ ID NO: 90333 - DNA, 20 bp, synthetic construct
  misc_feature 1..20: note = CRISPR gRNA sequence
  source 1..20: mol_type = other DNA
catagagtaaatgatcggtc

SEQ ID NO: 90334 - DNA, 20 bp, synthetic construct
  misc_feature 1..20: note = CRISPR gRNA sequence
  source 1..20: mol_type = other DNA
atcggtctggttcatcgcta

SEQ ID NO: 90335 - DNA, 20 bp, synthetic construct
  misc_feature 1..20: note = CRISPR gRNA sequence
  source 1..20: mol_type = other DNA
tcggtctggttcatcgctaa

SEQ ID NO: 90336 - DNA, 20 bp, synthetic construct
  misc_feature 1..20: note = CRISPR gRNA sequence
  source 1..20: mol_type = other DNA
ggtctggttcatcgctaaag

SEQ ID NO: 90337 - DNA, 20 bp, synthetic construct
  misc_feature 1..20: note = CRISPR gRNA sequence
  source 1..20: mol_type = other DNA
gttcatcgctaaaggagact

SEQ ID NO: 90338 - DNA, 20 bp, synthetic construct
  misc_feature 1..20: note = CRISPR gRNA sequence
  source 1..20: mol_type = other DNA
ttcatcgctaaaggagactt

SEQ ID NO: 90339 - DNA, 20 bp, synthetic construct
  misc_feature 1..20: note = CRISPR gRNA sequence
  source 1..20: mol_type = other DNA
ctaaaggagacttaggaacc

SEQ ID NO: 90340 - DNA, 20 bp, synthetic construct
  misc_feature 1..20: note = CRISPR gRNA sequence
  source 1..20: mol_type = other DNA
gagacttaggaacctagatg

SEQ ID NO: 90341 - DNA, 20 bp, synthetic construct
  misc_feature 1..20: note = CRISPR gRNA sequence
  source 1..20: mol_type = other DNA
cttaggaacctagatgaagt

SEQ ID NO: 90342 - DNA, 20 bp, synthetic construct
  misc_feature 1..20: note = CRISPR gRNA sequence
  source 1..20: mol_type = other DNA
tagatgaagttggtacttct

SEQ ID NO: 90343 - DNA, 20 bp, synthetic construct
  misc_feature 1..20: note = CRISPR gRNA sequence
  source 1..20: mol_type = other DNA
tgaagttggtacttctgaga

SEQ ID NO: 90344 - DNA, 20 bp, synthetic construct
  misc_feature 1..20: note = CRISPR gRNA sequence
  source 1..20: mol_type = other DNA
tgttttcactactctattct

SEQ ID NO: 90345 - DNA, 20 bp, synthetic construct
  misc_feature 1..20: note = CRISPR gRNA sequence
  source 1..20: mol_type = other DNA
actactctattctcagtatc

SEQ ID NO: 90346 - DNA, 20 bp, synthetic construct
  misc_feature 1..20: note = CRISPR gRNA sequence
  source 1..20: mol_type = other DNA
tattctcagtatccagttct

SEQ ID NO: 90347 - DNA, 20 bp, synthetic construct
  misc_feature 1..20: note = CRISPR gRNA sequence
  source 1..20: mol_type = other DNA
agtatccagttctcagtacc

SEQ ID NO: 90348 - DNA, 20 bp, synthetic construct
  misc_feature 1..20: note = CRISPR gRNA sequence
  source 1..20: mol_type = other DNA
agttctcagtacccagttct

SEQ ID NO: 90349 - DNA, 20 bp, synthetic construct
  misc_feature 1..20: note = CRISPR gRNA sequence
  source 1..20: mol_type = other DNA
atttgtaatactcctgtatt

SEQ ID NO: 90350 - DNA, 20 bp, synthetic construct
  misc_feature 1..20: note = CRISPR gRNA sequence
  source 1..20: mol_type = other DNA
tgtatttagtactttgtttt

SEQ ID NO: 90351 - DNA, 20 bp, synthetic construct
  misc_feature 1..20: note = CRISPR gRNA sequence
  source 1..20: mol_type = other DNA
tgttctgttaaccctcttcc

SEQ ID NO: 90352 - DNA, 20 bp, synthetic construct
  misc_feature 1..20: note = CRISPR gRNA sequence
  source 1..20: mol_type = other DNA
tcttcctagtaccgtatttt

SEQ ID NO: 90353 - DNA, 20 bp, synthetic construct
  misc_feature 1..20: note = CRISPR gRNA sequence
  source 1..20: mol_type = other DNA
atttttagtactgctatact

SEQ ID NO: 90354 - DNA, 20 bp, synthetic construct
  misc_feature 1..20: note = CRISPR gRNA sequence
  source 1..20: mol_type = other DNA
tatactcagttgcctgtctg

SEQ ID NO: 90355 - DNA, 20 bp, synthetic construct
  misc_feature 1..20: note = CRISPR gRNA sequence
  source 1..20: mol_type = other DNA
gtctgtagtacccctgtacg

SEQ ID NO: 90356 - DNA, 20 bp, synthetic construct
  misc_feature 1..20: note = CRISPR gRNA sequence
  source 1..20: mol_type = other DNA
ttttcttacaactctgttcc

SEQ ID NO: 90357 - DNA, 20 bp, synthetic construct
  misc_feature 1..20: note = CRISPR gRNA sequence
  source 1..20: mol_type = other DNA
gttcccagtacccctatgtt

SEQ ID NO: 90358 - DNA, 20 bp, synthetic construct
  misc_feature 1..20: note = CRISPR gRNA sequence
  source 1..20: mol_type = other DNA
tacttaatatactttgttct

SEQ ID NO: 90359 - DNA, 20 bp, synthetic construct
  misc_feature 1..20: note = CRISPR gRNA sequence
  source 1..20: mol_type = other DNA
gttctcagtatccttgttgt

SEQ ID NO: 90360 - DNA, 20 bp, synthetic construct
  misc_feature 1..20: note = CRISPR gRNA sequence
  source 1..20: mol_type = other DNA
gttctcactaccccttttct

SEQ ID NO: 90361 - DNA, 20 bp, synthetic construct
  misc_feature 1..20: note = CRISPR gRNA sequence
  source 1..20: mol_type = other DNA
ccccttttcttagtacccct

SEQ ID NO: 90362 - DNA, 20 bp, synthetic construct
  misc_feature 1..20: note = CRISPR gRNA sequence
  source 1..20: mol_type = other DNA
cccttttcttagtacccctg

SEQ ID NO: 90363 - DNA, 20 bp, synthetic construct
  misc_feature 1..20: note = CRISPR gRNA sequence
  source 1..20: mol_type = other DNA
ccttttcttagtacccctga

SEQ ID NO: 90364 - DNA, 20 bp, synthetic construct
  misc_feature 1..20: note = CRISPR gRNA sequence
  source 1..20: mol_type = other DNA
cttttcttagtacccctgag

SEQ ID NO: 90365 - DNA, 20 bp, synthetic construct
  misc_feature 1..20: note = CRISPR gRNA sequence
  source 1..20: mol_type = other DNA
ttttcttagtacccctgagg

SEQ ID NO: 90366 - DNA, 20 bp, synthetic construct
  misc_feature 1..20: note = CRISPR gRNA sequence
  source 1..20: mol_type = other DNA
tttcttagtacccctgaggg

SEQ ID NO: 90367 - DNA, 20 bp, synthetic construct
  misc_feature 1..20: note = CRISPR gRNA sequence
  source 1..20: mol_type = other DNA
tacccctgaggggggaaaaa

SEQ ID NO: 90368 - DNA, 20 bp, synthetic construct
  misc_feature 1..20: note = CRISPR gRNA sequence
  source 1..20: mol_type = other DNA
acccctgaggggggaaaaaa

SEQ ID NO: 90369 - DNA, 20 bp, synthetic construct
  misc_feature 1..20: note = CRISPR gRNA sequence
  source 1..20: mol_type = other DNA
ggggaaaaaaaggatgataa

SEQ ID NO: 90370 - DNA, 20 bp, synthetic construct
  misc_feature 1..20: note = CRISPR gRNA sequence
  source 1..20: mol_type = other DNA
gggaaaaaaaggatgataat

SEQ ID NO: 90371 - DNA, 20 bp, synthetic construct
  misc_feature 1..20: note = CRISPR gRNA sequence
  source 1..20: mol_type = other DNA
ggaaaaaaaggatgataatg

SEQ ID NO: 90372 - DNA, 20 bp, synthetic construct
  misc_feature 1..20: note = CRISPR gRNA sequence
  source 1..20: mol_type = other DNA
aaaggatgataatggggtat

SEQ ID NO: 90373 - DNA, 20 bp, synthetic construct
  misc_feature 1..20: note = CRISPR gRNA sequence
  source 1..20: mol_type = other DNA
tataagtctcaaaaaacttt

SEQ ID NO: 90374 - DNA, 20 bp, synthetic construct
  misc_feature 1..20: note = CRISPR gRNA sequence
  source 1..20: mol_type = other DNA
tggattgtttgatttgaact

SEQ ID NO: 90375 - DNA, 20 bp, synthetic construct
  misc_feature 1..20: note = CRISPR gRNA sequence
  source 1..20: mol_type = other DNA
gtttgatttgaactgagtca

SEQ ID NO: 90376 - DNA, 20 bp, synthetic construct
  misc_feature 1..20: note = CRISPR gRNA sequence
  source 1..20: mol_type = other DNA
tttgatttgaactgagtcaa

SEQ ID NO: 90377 - DNA, 20 bp, synthetic construct
  misc_feature 1..20: note = CRISPR gRNA sequence
  source 1..20: mol_type = other DNA
aactgagtcaaaggtaaaac

SEQ ID NO: 90378 - DNA, 20 bp, synthetic construct
  misc_feature 1..20: note = CRISPR gRNA sequence
  source 1..20: mol_type = other DNA
caaaggtaaaaccagtgttc

SEQ ID NO: 90379 - DNA, 20 bp, synthetic construct
  misc_feature 1..20: note = CRISPR gRNA sequence
  source 1..20: mol_type = other DNA
aaggtaaaaccagtgttctg

SEQ ID NO: 90380 - DNA, 20 bp, synthetic construct
  misc_feature 1..20: note = CRISPR gRNA sequence
  source 1..20: mol_type = other DNA
gtgttctggagttcgacttc

SEQ ID NO: 90381 - DNA, 20 bp, synthetic construct
  misc_feature 1..20: note = CRISPR gRNA sequence
  source 1..20: mol_type = other DNA
tgttctggagttcgacttct

SEQ ID NO: 90382 - DNA, 20 bp, synthetic construct
  misc_feature 1..20: note = CRISPR gRNA sequence
  source 1..20: mol_type = other DNA
atccctgttgcatcatttac

SEQ ID NO: 90383 - DNA, 20 bp, synthetic construct
  misc_feature 1..20: note = CRISPR gRNA sequence
  source 1..20: mol_type = other DNA
tgcatcatttactggccttg

SEQ ID NO: 90384 - DNA, 20 bp, synthetic construct
  misc_feature 1..20: note = CRISPR gRNA sequence
  source 1..20: mol_type = other DNA
tactggccttgtggcttgaa

SEQ ID NO: 90385 - DNA, 20 bp, synthetic construct
  misc_feature 1..20: note = CRISPR gRNA sequence
  source 1..20: mol_type = other DNA
actggccttgtggcttgaat

SEQ ID NO: 90386 - DNA, 20 bp, synthetic construct
  misc_feature 1..20: note = CRISPR gRNA sequence
  source 1..20: mol_type = other DNA
ggttattaaactctgtaaaa

SEQ ID NO: 90387 - DNA, 20 bp, synthetic construct
  misc_feature 1..20: note = CRISPR gRNA sequence
  source 1..20: mol_type = other DNA
gttattaaactctgtaaaat

SEQ ID NO: 90388 - DNA, 20 bp, synthetic construct
  misc_feature 1..20: note = CRISPR gRNA sequence
  source 1..20: mol_type = other DNA
ttaaaatcgtgtgtcattca

SEQ ID NO: 90389 - DNA, 20 bp, synthetic construct
  misc_feature 1..20: note = CRISPR gRNA sequence
  source 1..20: mol_type = other DNA
tagtgttgctgtgaatatgt

SEQ ID NO: 90390 - DNA, 20 bp, synthetic construct
  misc_feature 1..20: note = CRISPR gRNA sequence
  source 1..20: mol_type = other DNA
tatgtgagccattccatatt

SEQ ID NO: 90391 - DNA, 20 bp, synthetic construct
  misc_feature 1..20: note = CRISPR gRNA sequence
  source 1..20: mol_type = other DNA
atgtgagccattccatattg

SEQ ID NO: 90392 - DNA, 20 bp, synthetic construct
  misc_feature 1..20: note = CRISPR gRNA sequence
  source 1..20: mol_type = other DNA
tgtgagccattccatattga

SEQ ID NO: 90393 - DNA, 20 bp, synthetic construct
  misc_feature 1..20: note = CRISPR gRNA sequence
  source 1..20: mol_type = other DNA
ttccatattgagggttcaca

SEQ ID NO: 90394 - DNA, 20 bp, synthetic construct
  misc_feature 1..20: note = CRISPR gRNA sequence
  source 1..20: mol_type = other DNA
ttgagggttcacacagtgtc

SEQ ID NO: 90395 - DNA, 20 bp, synthetic construct
  misc_feature 1..20: note = CRISPR gRNA sequence
  source 1..20: mol_type = other DNA
ttcacacagtgtccagcaac

SEQ ID NO: 90396 - DNA, 20 bp, synthetic construct
  misc_feature 1..20: note = CRISPR gRNA sequence
  source 1..20: mol_type = other DNA
cagtgtccagcaactggcta

SEQ ID NO: 90397 - DNA, 20 bp, synthetic construct
  misc_feature 1..20: note = CRISPR gRNA sequence
  source 1..20: mol_type = other DNA
cccattattattgtcattgt

SEQ ID NO: 90398 - DNA, 20 bp, synthetic construct
  misc_feature 1..20: note = CRISPR gRNA sequence
  source 1..20: mol_type = other DNA
attattattgtcattgttag

SEQ ID NO: 90399 - DNA, 20 bp, synthetic construct
  misc_feature 1..20: note = CRISPR gRNA sequence
  source 1..20: mol_type = other DNA
cattgttagtggtatacttt

SEQ ID NO: 90400 - DNA, 20 bp, synthetic construct
  misc_feature 1..20: note = CRISPR gRNA sequence
  source 1..20: mol_type = other DNA
attgttagtggtatactttg

SEQ ID NO: 90401 - DNA, 20 bp, synthetic construct
  misc_feature 1..20: note = CRISPR gRNA sequence
  source 1..20: mol_type = other DNA
actttgaggctgtcacaaat

SEQ ID NO: 90402 - DNA, 20 bp, synthetic construct
  misc_feature 1..20: note = CRISPR gRNA sequence
  source 1..20: mol_type = other DNA
ttgaggctgtcacaaataag

SEQ ID NO: 90403 - DNA, 20 bp, synthetic construct
  misc_feature 1..20: note = CRISPR gRNA sequence
  source 1..20: mol_type = other DNA
aagcagatatttcttcttgt

SEQ ID NO: 90404 - DNA, 20 bp, synthetic construct
  misc_feature 1..20: note = CRISPR gRNA sequence
  source 1..20: mol_type = other DNA
gcagatatttcttcttgtga

SEQ ID NO: 90405 - DNA, 20 bp, synthetic construct
  misc_feature 1..20: note = CRISPR gRNA sequence
  source 1..20: mol_type = other DNA
gtgagagctatataatccct

SEQ ID NO: 90406 - DNA, 20 bp, synthetic construct
  misc_feature 1..20: note = CRISPR gRNA sequence
  source 1..20: mol_type = other DNA
agctatataatcccttagtg

SEQ ID NO: 90407 - DNA, 20 bp, synthetic construct
  misc_feature 1..20: note = CRISPR gRNA sequence
  source 1..20: mol_type = other DNA
ctatataatcccttagtgta

SEQ ID NO: 90408 - DNA, 20 bp, synthetic construct
  misc_feature 1..20: note = CRISPR gRNA sequence
  source 1..20: mol_type = other DNA
gaaaaatttaattttgttac

SEQ ID NO: 90409 - DNA, 20 bp, synthetic construct
  misc_feature 1..20: note = CRISPR gRNA sequence
  source 1..20: mol_type = other DNA
aattttgttacaagtgatcc

SEQ ID NO: 90410 - DNA, 20 bp, synthetic construct
  misc_feature 1..20: note = CRISPR gRNA sequence
  source 1..20: mol_type = other DNA
ttgttacaagtgatccaagc

SEQ ID NO: 90411 - DNA, 20 bp, synthetic construct
  misc_feature 1..20: note = CRISPR gRNA sequence
  source 1..20: mol_type = other DNA
tgttacaagtgatccaagcc

SEQ ID NO: 90412 - DNA, 20 bp, synthetic construct
  misc_feature 1..20: note = CRISPR gRNA sequence
  source 1..20: mol_type = other DNA
caagtgatccaagccaggta

SEQ ID NO: 90413 - DNA, 20 bp, synthetic construct
  misc_feature 1..20: note = CRISPR gRNA sequence
  source 1..20: mol_type = other DNA
gtgatccaagccaggtatgg

SEQ ID NO: 90414 - DNA, 20 bp, synthetic construct
  misc_feature 1..20: note = CRISPR gRNA sequence
  source 1..20: mol_type = other DNA
tccaagccaggtatggtggc

SEQ ID NO: 90415 - DNA, 20 bp, synthetic construct
  misc_feature 1..20: note = CRISPR gRNA sequence
  source 1..20: mol_type = other DNA
gtggcaagtgcctgtatacc

SEQ ID NO: 90416 - DNA, 20 bp, synthetic construct
  misc_feature 1..20: note = CRISPR gRNA sequence
  source 1..20: mol_type = other DNA
cctgtatacccagctgtact

SEQ ID NO: 90417 - DNA, 20 bp, synthetic construct
  misc_feature 1..20: note = CRISPR gRNA sequence
  source 1..20: mol_type = other DNA
ctgtatacccagctgtactt

SEQ ID NO: 90418 - DNA, 20 bp, synthetic construct
  misc_feature 1..20: note = CRISPR gRNA sequence
  source 1..20: mol_type = other DNA
gtatacccagctgtacttgg

SEQ ID NO: 90419 - DNA, 20 bp, synthetic construct
  misc_feature 1..20: note = CRISPR gRNA sequence
  source 1..20: mol_type = other DNA
tatacccagctgtacttggg

SEQ ID NO: 90420 - DNA, 20 bp, synthetic construct
  misc_feature 1..20: note = CRISPR gRNA sequence
  source 1..20: mol_type = other DNA
atacccagctgtacttggga

SEQ ID NO: 90421 - DNA, 20 bp, synthetic construct
  misc_feature 1..20: note = CRISPR gRNA sequence
  source 1..20: mol_type = other DNA
cagctgtacttgggagggtg

SEQ ID NO: 90422 - DNA, 20 bp, synthetic construct
  misc_feature 1..20: note = CRISPR gRNA sequence
  source 1..20: mol_type = other DNA
ctgtacttgggagggtgaag

SEQ ID NO: 90423 - DNA, 20 bp, synthetic construct
  misc_feature 1..20: note = CRISPR gRNA sequence
  source 1..20: mol_type = other DNA
tgtacttgggagggtgaagt

SEQ ID NO: 90424 - DNA, 20 bp, synthetic construct
  misc_feature 1..20: note = CRISPR gRNA sequence
  source 1..20: mol_type = other DNA
acttgggagggtgaagtggg

SEQ ID NO: 90425 - DNA, 20 bp, synthetic construct
  misc_feature 1..20: note = CRISPR gRNA sequence
  source 1..20: mol_type = other DNA
gtgaagtgggaagattgctt

SEQ ID NO: 90426 - DNA, 20 bp, synthetic construct
  misc_feature 1..20: note = CRISPR gRNA sequence
  source 1..20: mol_type = other DNA
gtgggaagattgcttgagac

SEQ ID NO: 90427 - DNA, 20 bp, synthetic construct
  misc_feature 1..20: note = CRISPR gRNA sequence
  source 1..20: mol_type = other DNA
tgggaagattgcttgagacc

SEQ ID NO: 90428 - DNA, 20 bp, synthetic construct
  misc_feature 1..20: note = CRISPR gRNA sequence
  source 1..20: mol_type = other DNA
gggaagattgcttgagacca

SEQ ID NO: 90429 - DNA, 20 bp, synthetic construct
  misc_feature 1..20: note = CRISPR gRNA sequence
  source 1..20: mol_type = other DNA
ggaagattgcttgagaccag

SEQ ID NO: 90430 - DNA, 20 bp, synthetic construct
  misc_feature 1..20: note = CRISPR gRNA sequence
  source 1..20: mol_type = other DNA
ttgcttgagaccaggggttc

SEQ ID NO: 90431 - DNA, 20 bp, synthetic construct
  misc_feature 1..20: note = CRISPR gRNA sequence
  source 1..20: mol_type = other DNA
tgcttgagaccaggggttcg

SEQ ID NO: 90432 - DNA, 20 bp, synthetic construct
  misc_feature 1..20: note = CRISPR gRNA sequence
  source 1..20: mol_type = other DNA
caggggttcgaggctgccgt

SEQ ID NO: 90433 - DNA, 20 bp, synthetic construct
  misc_feature 1..20: note = CRISPR gRNA sequence
  source 1..20: mol_type = other DNA
ttgtttgcatcactgcattc

SEQ ID NO: 90434 - DNA, 20 bp, synthetic construct
  misc_feature 1..20: note = CRISPR gRNA sequence
  source 1..20: mol_type = other DNA
tgcatcactgcattccagcc

SEQ ID NO: 90435 - DNA, 20 bp, synthetic construct
  misc_feature 1..20: note = CRISPR gRNA sequence
  source 1..20: mol_type = other DNA
gcattccagcctggatgaca

SEQ ID NO: 90436 - DNA, 20 bp, synthetic construct
  misc_feature 1..20: note = CRISPR gRNA sequence
  source 1..20: mol_type = other DNA
tccagcctggatgacatagc

SEQ ID NO: 90437 - DNA, 20 bp, synthetic construct
  misc_feature 1..20: note = CRISPR gRNA sequence
  source 1..20: mol_type = other DNA
aaaaaattttttttaactgc

SEQ ID NO: 90438 - DNA, 20 bp, synthetic construct
  misc_feature 1..20: note = CRISPR gRNA sequence
  source 1..20: mol_type = other DNA
tttttaactgcaagctgtct

SEQ ID NO: 90439 - DNA, 20 bp, synthetic construct
  misc_feature 1..20: note = CRISPR gRNA sequence
  source 1..20: mol_type = other DNA
ttttaactgcaagctgtctt

SEQ ID NO: 90440 - DNA, 20 bp, synthetic construct
  misc_feature 1..20: note = CRISPR gRNA sequence
  source 1..20: mol_type = other DNA
tttaactgcaagctgtctta

SEQ ID NO: 90441 - DNA, 20 bp, synthetic construct
  misc_feature 1..20: note = CRISPR gRNA sequence
  source 1..20: mol_type = other DNA
tgcaagctgtcttagggtcc

SEQ ID NO: 90442 - DNA, 20 bp, synthetic construct
  misc_feature 1..20: note = CRISPR gRNA sequence
  source 1..20: mol_type = other DNA
gcaagctgtcttagggtcct

SEQ ID NO: 90443 - DNA, 20 bp, synthetic construct
  misc_feature 1..20: note = CRISPR gRNA sequence
  source 1..20: mol_type = other DNA
agggtcctaggatgtattct

SEQ ID NO: 90444 - DNA, 20 bp, synthetic construct
  misc_feature 1..20: note = CRISPR gRNA sequence
  source 1..20: mol_type = other DNA
ttctaagtctttaaatttct

SEQ ID NO: 90445 - DNA, 20 bp, synthetic construct
  misc_feature 1..20: note = CRISPR gRNA sequence
  source 1..20: mol_type = other DNA
gtctttaaatttcttagttt

SEQ ID NO: 90446 - DNA, 20 bp, synthetic construct
  misc_feature 1..20: note = CRISPR gRNA sequence
  source 1..20: mol_type = other DNA
tctttaaatttcttagtttc

SEQ ID NO: 90447 - DNA, 20 bp, synthetic construct
  misc_feature 1..20: note = CRISPR gRNA sequence
  source 1..20: mol_type = other DNA
ttagtttcaggctgaacttg

SEQ ID NO: 90448 - DNA, 20 bp, synthetic construct
  misc_feature 1..20: note = CRISPR gRNA sequence
  source 1..20: mol_type = other DNA
gtgctccatcactaaaatat

SEQ ID NO: 90449 - DNA, 20 bp, synthetic construct
  misc_feature 1..20: note = CRISPR gRNA sequence
  source 1..20: mol_type = other DNA
tgtttacaaatgtaatgttc

SEQ ID NO: 90450 - DNA, 20 bp, synthetic construct
  misc_feature 1..20: note = CRISPR gRNA sequence
  source 1..20: mol_type = other DNA
gtttacaaatgtaatgttct

SEQ ID NO: 90451 - DNA, 20 bp, synthetic construct
  misc_feature 1..20: note = CRISPR gRNA sequence
  source 1..20: mol_type = other DNA
acaaatgtaatgttctaggc

SEQ ID NO: 90452 - DNA, 20 bp, synthetic construct
  misc_feature 1..20: note = CRISPR gRNA sequence
  source 1..20: mol_type = other DNA
caaatgtaatgttctaggcc

SEQ ID NO: 90453 - DNA, 20 bp, synthetic construct
  misc_feature 1..20: note = CRISPR gRNA sequence
  source 1..20: mol_type = other DNA
gtaatgttctaggccaggct

SEQ ID NO: 90454 - DNA, 20 bp, synthetic construct
  misc_feature 1..20: note = CRISPR gRNA sequence
  source 1..20: mol_type = other DNA
atgttctaggccaggctcag

SEQ ID NO: 90455 - DNA, 20 bp, synthetic construct
  misc_feature 1..20: note = CRISPR gRNA sequence
  source 1..20: mol_type = other DNA
gctcagtggctaatacctgt

SEQ ID NO: 90456 - DNA, 20 bp, synthetic construct
  misc_feature 1..20: note = CRISPR gRNA sequence
  source 1..20: mol_type = other DNA
gtggctaatacctgtaagcc

SEQ ID NO: 90457 - DNA, 20 bp, synthetic construct
  misc_feature 1..20: note = CRISPR gRNA sequence
  source 1..20: mol_type = other DNA
atacctgtaagcccagaact

SEQ ID NO: 90458 - DNA, 20 bp, synthetic construct
  misc_feature 1..20: note = CRISPR gRNA sequence
  source 1..20: mol_type = other DNA
tacctgtaagcccagaactt

SEQ ID NO: 90459 - DNA, 20 bp, synthetic construct
  misc_feature 1..20: note = CRISPR gRNA sequence
  source 1..20: mol_type = other DNA
acctgtaagcccagaacttg

SEQ ID NO: 90460 - DNA, 20 bp, synthetic construct
  misc_feature 1..20: note = CRISPR gRNA sequence
  source 1..20: mol_type = other DNA
ctgtaagcccagaacttggg

SEQ ID NO: 90461 - DNA, 20 bp, synthetic construct
  misc_feature 1..20: note = CRISPR gRNA sequence
  source 1..20: mol_type = other DNA
tgtaagcccagaacttgggg

SEQ ID NO: 90462 - DNA, 20 bp, synthetic construct
  misc_feature 1..20: note = CRISPR gRNA sequence
  source 1..20: mol_type = other DNA
gcccagaacttggggaggcc

SEQ ID NO: 90463 - DNA, 20 bp, synthetic construct
  misc_feature 1..20: note = CRISPR gRNA sequence
  source 1..20: mol_type = other DNA
cccagaacttggggaggcct

SEQ ID NO: 90464 - DNA, 20 bp, synthetic construct
  misc_feature 1..20: note = CRISPR gRNA sequence
  source 1..20: mol_type = other DNA
cagaacttggggaggcctag

SEQ ID NO: 90465 - DNA, 20 bp, synthetic construct
  misc_feature 1..20: note = CRISPR gRNA sequence
  source 1..20: mol_type = other DNA
agaacttggggaggcctagg

SEQ ID NO: 90466 - DNA, 20 bp, synthetic construct
  misc_feature 1..20: note = CRISPR gRNA sequence
  source 1..20: mol_type = other DNA
gaacttggggaggcctagga

SEQ ID NO: 90467 - DNA, 20 bp, synthetic construct
  misc_feature 1..20: note = CRISPR gRNA sequence
  source 1..20: mol_type = other DNA
acttggggaggcctaggagg

SEQ ID NO: 90468 - DNA, 20 bp, synthetic construct
  misc_feature 1..20: note = CRISPR gRNA sequence
  source 1..20: mol_type = other DNA
cttggggaggcctaggaggg

SEQ ID NO: 90469 - DNA, 20 bp, synthetic construct
  misc_feature 1..20: note = CRISPR gRNA sequence
  source 1..20: mol_type = other DNA
cctaggagggaggatcgctt

SEQ ID NO: 90470 - DNA, 20 bp, synthetic construct
  misc_feature 1..20: note = CRISPR gRNA sequence
  source 1..20: mol_type = other DNA
gagggaggatcgcttgagcc

SEQ ID NO: 90471 - DNA, 20 bp, synthetic construct
  misc_feature 1..20: note = CRISPR gRNA sequence
  source 1..20: mol_type = other DNA
ggaggatcgcttgagcccgg

SEQ ID NO: 90472 - DNA, 20 bp, synthetic construct
  misc_feature 1..20: note = CRISPR gRNA sequence
  source 1..20: mol_type = other DNA
tcgcttgagcccggaagttt

SEQ ID NO: 90473 - DNA, 20 bp, synthetic construct
  misc_feature 1..20: note = CRISPR gRNA sequence
  source 1..20: mol_type = other DNA
tgagcccggaagtttgagac

SEQ ID NO: 90474 - DNA, 20 bp, synthetic construct
  misc_feature 1..20: note = CRISPR gRNA sequence
  source 1..20: mol_type = other DNA
ccggaagtttgagaccagcc

SEQ ID NO: 90475 - DNA, 20 bp, synthetic construct
  misc_feature 1..20: note = CRISPR gRNA sequence
  source 1..20: mol_type = other DNA
cggaagtttgagaccagcct

SEQ ID NO: 90476 - DNA, 20 bp, synthetic construct
  misc_feature 1..20: note = CRISPR gRNA sequence
  source 1..20: mol_type = other DNA
tgagaccagcctgggtaaca

SEQ ID NO: 90477 - DNA, 20 bp, synthetic construct
  misc_feature 1..20: note = CRISPR gRNA sequence
  source 1..20: mol_type = other DNA
gagaccagcctgggtaacat

SEQ ID NO: 90478 - DNA, 20 bp, synthetic construct
  misc_feature 1..20: note = CRISPR gRNA sequence
  source 1..20: mol_type = other DNA
agaccagcctgggtaacata

SEQ ID NO: 90479 - DNA, 20 bp, synthetic construct
  misc_feature 1..20: note = CRISPR gRNA sequence
  source 1..20: mol_type = other DNA
accagcctgggtaacatagg

SEQ ID NO: 90480 - DNA, 20 bp, synthetic construct
  misc_feature 1..20: note = CRISPR gRNA sequence
  source 1..20: mol_type = other DNA
aacaaaaaaattttaaaaat

SEQ ID NO: 90481 - DNA, 20 bp, synthetic construct
  misc_feature 1..20: note = CRISPR gRNA sequence
  source 1..20: mol_type = other DNA
aaaaaattttaaaaattagc

SEQ ID NO: 90482 - DNA, 20 bp, synthetic construct
  misc_feature 1..20: note = CRISPR gRNA sequence
  source 1..20: mol_type = other DNA
aaaaattttaaaaattagcc

SEQ ID NO: 90483 - DNA, 20 bp, synthetic construct
  misc_feature 1..20: note = CRISPR gRNA sequence
  source 1..20: mol_type = other DNA
taaaaattagccaggtatgt

SEQ ID NO: 90484 - DNA, 20 bp, synthetic construct
  misc_feature 1..20: note = CRISPR gRNA sequence
  source 1..20: mol_type = other DNA
ggtatgttggcacatgcctg

SEQ ID NO: 90485 - DNA, 20 bp, synthetic construct
  misc_feature 1..20: note = CRISPR gRNA sequence
  source 1..20: mol_type = other DNA
ttggcacatgcctgtggtcc

SEQ ID NO: 90486 - DNA, 20 bp, synthetic construct
  misc_feature 1..20: note = CRISPR gRNA sequence
  source 1..20: mol_type = other DNA
tgcctgtggtcctagctact

SEQ ID NO: 90487 - DNA, 20 bp, synthetic construct
  misc_feature 1..20: note = CRISPR gRNA sequence
  source 1..20: mol_type = other DNA
gcctgtggtcctagctactc

SEQ ID NO: 90488 - DNA, 20 bp, synthetic construct
  misc_feature 1..20: note = CRISPR gRNA sequence
  source 1..20: mol_type = other DNA
ctgtggtcctagctactcgg

SEQ ID NO: 90489 - DNA, 20 bp, synthetic construct
  misc_feature 1..20: note = CRISPR gRNA sequence
  source 1..20: mol_type = other DNA
tgtggtcctagctactcggg

SEQ ID NO: 90490 - DNA, 20 bp, synthetic construct
  misc_feature 1..20: note = CRISPR gRNA sequence
  source 1..20: mol_type = other DNA
tcctagctactcgggaggct

SEQ ID NO: 90491 - DNA, 20 bp, synthetic construct
  misc_feature 1..20: note = CRISPR gRNA sequence
  source 1..20: mol_type = other DNA
cctagctactcgggaggctg

SEQ ID NO: 90492 - DNA, 20 bp, synthetic construct
  misc_feature 1..20: note = CRISPR gRNA sequence
  source 1..20: mol_type = other DNA
agctactcgggaggctgagg

SEQ ID NO: 90493 - DNA, 20 bp, synthetic construct
  misc_feature 1..20: note = CRISPR gRNA sequence
  source 1..20: mol_type = other DNA
tactcgggaggctgaggtgg

SEQ ID NO: 90494 - DNA, 20 bp, synthetic construct
  misc_feature 1..20: note = CRISPR gRNA sequence
  source 1..20: mol_type = other DNA
actcgggaggctgaggtgga

SEQ ID NO: 90495 - DNA, 20 bp, synthetic construct
  misc_feature 1..20: note = CRISPR gRNA sequence
  source 1..20: mol_type = other DNA
gctgaggtggaaggatcatt

SEQ ID NO: 90496 - DNA, 20 bp, synthetic construct
  misc_feature 1..20: note = CRISPR gRNA sequence
  source 1..20: mol_type = other DNA
ggtggaaggatcattgagcc

SEQ ID NO: 90497 - DNA, 20 bp, synthetic construct
  misc_feature 1..20: note = CRISPR gRNA sequence
  source 1..20: mol_type = other DNA
gtggaaggatcattgagccc

SEQ ID NO: 90498 - DNA, 20 bp, synthetic construct
  misc_feature 1..20: note = CRISPR gRNA sequence
  source 1..20: mol_type = other DNA
ggaaggatcattgagcccag

SEQ ID NO: 90499 - DNA, 20 bp, synthetic construct
  misc_feature 1..20: note = CRISPR gRNA sequence
  source 1..20: mol_type = other DNA
atcattgagcccaggagatt

SEQ ID NO: 90500 - DNA, 20 bp, synthetic construct
  misc_feature 1..20: note = CRISPR gRNA sequence
  source 1..20: mol_type = other DNA
tcattgagcccaggagattg

SEQ ID NO: 90501 - DNA, 20 bp, synthetic construct
  misc_feature 1..20: note = CRISPR gRNA sequence
  source 1..20: mol_type = other DNA
agcccaggagattgaggctg

SEQ ID NO: 90502 - DNA, 20 bp, synthetic construct
  misc_feature 1..20: note = CRISPR gRNA sequence
  source 1..20: mol_type = other DNA
caggagattgaggctgcagt

SEQ ID NO: 90503 - DNA, 20 bp, synthetic construct
  misc_feature 1..20: note = CRISPR gRNA sequence
  source 1..20: mol_type = other DNA
attgaggctgcagtgagcca

SEQ ID NO: 90504 - DNA, 20 bp, synthetic construct
  misc_feature 1..20: note = CRISPR gRNA sequence
  source 1..20: mol_type = other DNA
atggttgtgctacttcactc

SEQ ID NO: 90505 - DNA, 20 bp, synthetic construct
  misc_feature 1..20: note = CRISPR gRNA sequence
  source 1..20: mol_type = other DNA
tgtgctacttcactccagcc

SEQ ID NO: 90506 - DNA, 20 bp, synthetic construct
  misc_feature 1..20: note = CRISPR gRNA sequence
  source 1..20: mol_type = other DNA
gtgctacttcactccagcct

SEQ ID NO: 90507 - DNA, 20 bp, synthetic construct
  misc_feature 1..20: note = CRISPR gRNA sequence
  source 1..20: mol_type = other DNA
cttcactccagcctgggtga

SEQ ID NO: 90508 - DNA, 20 bp, synthetic construct
  misc_feature 1..20: note = CRISPR gRNA sequence
  source 1..20: mol_type = other DNA
tcactccagcctgggtgaca

SEQ ID NO: 90509 - DNA, 20 bp, synthetic construct
  misc_feature 1..20: note = CRISPR gRNA sequence
  source 1..20: mol_type = other DNA
tccagcctgggtgacagagc

SEQ ID NO: 90510 - DNA, 20 bp, synthetic construct
  misc_feature 1..20: note = CRISPR gRNA sequence
  source 1..20: mol_type = other DNA
gactttgtctcaaaaacaaa

SEQ ID NO: 90511 - DNA, 20 bp, synthetic construct
  misc_feature 1..20: note = CRISPR gRNA sequence
  source 1..20: mol_type = other DNA
ctaaatatttctaaaatttg

SEQ ID NO: 90512 - DNA, 20 bp, synthetic construct
  misc_feature 1..20: note = CRISPR gRNA sequence
  source 1..20: mol_type = other DNA
tttctaaaatttgcagttgc

SEQ ID NO: 90513 - DNA, 20 bp, synthetic construct
  misc_feature 1..20: note = CRISPR gRNA sequence
  source 1..20: mol_type = other DNA
gtgtcatacttaattcacac

SEQ ID NO: 90514 - DNA, 20 bp, synthetic construct
  misc_feature 1..20: note = CRISPR gRNA sequence
  source 1..20: mol_type = other DNA
catacttaattcacactggt

SEQ ID NO: 90515 - DNA, 20 bp, synthetic construct
  misc_feature 1..20: note = CRISPR gRNA sequence
  source 1..20: mol_type = other DNA
atacttaattcacactggtt

SEQ ID NO: 90516 - DNA, 20 bp, synthetic construct
  misc_feature 1..20: note = CRISPR gRNA sequence
  source 1..20: mol_type = other DNA
aattcacactggttaggact

SEQ ID NO: 90517 - DNA, 20 bp, synthetic construct
  misc_feature 1..20: note = CRISPR gRNA sequence
  source 1..20: mol_type = other DNA
gagtgacttctctttccctt

SEQ ID NO: 90518 - DNA, 20 bp, synthetic construct
  misc_feature 1..20: note = CRISPR gRNA sequence
  source 1..20: mol_type = other DNA
tcccttaagttttactcttt

SEQ ID NO: 90519 - DNA, 20 bp, synthetic construct
  misc_feature 1..20: note = CRISPR gRNA sequence
  source 1..20: mol_type = other DNA
ccttaagttttactcttttg

SEQ ID NO: 90520 - DNA, 20 bp, synthetic construct
  misc_feature 1..20: note = CRISPR gRNA sequence
  source 1..20: mol_type = other DNA
aagttttactcttttggagt

SEQ ID NO: 90521 - DNA, 20 bp, synthetic construct
  misc_feature 1..20: note = CRISPR gRNA sequence
  source 1..20: mol_type = other DNA
gttttactcttttggagtaa

SEQ ID NO: 90522 - DNA, 20 bp, synthetic construct
  misc_feature 1..20: note = CRISPR gRNA sequence
  source 1..20: mol_type = other DNA
ttttactcttttggagtaag

SEQ ID NO: 90523 - DNA, 20 bp, synthetic construct
  misc_feature 1..20: note = CRISPR gRNA sequence
  source 1..20: mol_type = other DNA
tggagtaagaggacttcttt

SEQ ID NO: 90524 - DNA, 20 bp, synthetic construct
  misc_feature 1..20: note = CRISPR gRNA sequence
  source 1..20: mol_type = other DNA
ggagtaagaggacttctttg

SEQ ID NO: 90525 - DNA, 20 bp, synthetic construct
  misc_feature 1..20: note = CRISPR gRNA sequence
  source 1..20: mol_type = other DNA
gagtaagaggacttctttga

SEQ ID NO: 90526 - DNA, 20 bp, synthetic construct
  misc_feature 1..20: note = CRISPR gRNA sequence
  source 1..20: mol_type = other DNA
agaggacttctttgagggtc

SEQ ID NO: 90527 - DNA, 20 bp, synthetic construct
  misc_feature 1..20: note = CRISPR gRNA sequence
  source 1..20: mol_type = other DNA
gagggtctggtgacttaatg

SEQ ID NO: 90528 - DNA, 20 bp, synthetic construct
  misc_feature 1..20: note = CRISPR gRNA sequence
  source 1..20: mol_type = other DNA
gacttaatgaagactcttcc

SEQ ID NO: 90529 - DNA, 20 bp, synthetic construct
  misc_feature 1..20: note = CRISPR gRNA sequence
  source 1..20: mol_type = other DNA
taattttgcatactaattaa

SEQ ID NO: 90530 - DNA, 20 bp, synthetic construct
  misc_feature 1..20: note = CRISPR gRNA sequence
  source 1..20: mol_type = other DNA
aattttgcatactaattaat

SEQ ID NO: 90531 - DNA, 20 bp, synthetic construct
  misc_feature 1..20: note = CRISPR gRNA sequence
  source 1..20: mol_type = other DNA
tgcatactaattaatgggct

SEQ ID NO: 90532 - DNA, 20 bp, synthetic construct
  misc_feature 1..20: note = CRISPR gRNA sequence
  source 1..20: mol_type = other DNA
gcatactaattaatgggctc

SEQ ID NO: 90533 - DNA, 20 bp, synthetic construct
  misc_feature 1..20: note = CRISPR gRNA sequence
  source 1..20: mol_type = other DNA
gctcaggacttctgtaatct

SEQ ID NO: 90534 - DNA, 20 bp, synthetic construct
  misc_feature 1..20: note = CRISPR gRNA sequence
  source 1..20: mol_type = other DNA
cccctcaatccatattctta

SEQ ID NO: 90535 - DNA, 20 bp, synthetic construct
  misc_feature 1..20: note = CRISPR gRNA sequence
  source 1..20: mol_type = other DNA
ttttaccaaatctctgatta

SEQ ID NO: 90536 - DNA, 20 bp, synthetic construct
  misc_feature 1..20: note = CRISPR gRNA sequence
  source 1..20: mol_type = other DNA
tttaccaaatctctgattac

SEQ ID NO: 90537 - DNA, 20 bp, synthetic construct
  misc_feature 1..20: note = CRISPR gRNA sequence
  source 1..20: mol_type = other DNA
ttaccaaatctctgattacg

SEQ ID NO: 90538 - DNA, 20 bp, synthetic construct
  misc_feature 1..20: note = CRISPR gRNA sequence
  source 1..20: mol_type = other DNA
aatctctgattacggggatt

SEQ ID NO: 90539 - DNA, 20 bp, synthetic construct
  misc_feature 1..20: note = CRISPR gRNA sequence
  source 1..20: mol_type = other DNA
atctctgattacggggattt

SEQ ID NO: 90540 - DNA, 20 bp, synthetic construct
  misc_feature 1..20: note = CRISPR gRNA sequence
  source 1..20: mol_type = other DNA
tctctgattacggggattta

SEQ ID NO: 90541 - DNA, 20 bp, synthetic construct
  misc_feature 1..20: note = CRISPR gRNA sequence
  source 1..20: mol_type = other DNA
ttacggggatttagggaaat

SEQ ID NO: 90542 - DNA, 20 bp, synthetic construct
  misc_feature 1..20: note = CRISPR gRNA sequence
  source 1..20: mol_type = other DNA
gatttagggaaataagcatc

SEQ ID NO: 90543 - DNA, 20 bp, synthetic construct
  misc_feature 1..20: note = CRISPR gRNA sequence
  source 1..20: mol_type = other DNA
agggaaataagcatctggaa

SEQ ID NO: 90544 - DNA, 20 bp, synthetic construct
  misc_feature 1..20: note = CRISPR gRNA sequence
  source 1..20: mol_type = other DNA
aagcatctggaaaagaatga

SEQ ID NO: 90545 - DNA, 20 bp, synthetic construct
  misc_feature 1..20: note = CRISPR gRNA sequence
  source 1..20: mol_type = other DNA
atctggaaaagaatgaaagt

SEQ ID NO: 90546 - DNA, 20 bp, synthetic construct
  misc_feature 1..20: note = CRISPR gRNA sequence
  source 1..20: mol_type = other DNA
gaaaagaatgaaagttagta

SEQ ID NO: 90547 - DNA, 20 bp, synthetic construct
  misc_feature 1..20: note = CRISPR gRNA sequence
  source 1..20: mol_type = other DNA
aaaagaatgaaagttagtaa

SEQ ID NO: 90548 - DNA, 20 bp, synthetic construct
  misc_feature 1..20: note = CRISPR gRNA sequence
  source 1..20: mol_type = other DNA
gaaagttagtaaaggtgatc

SEQ ID NO: 90549 - DNA, 20 bp, synthetic construct
  misc_feature 1..20: note = CRISPR gRNA sequence
  source 1..20: mol_type = other DNA
aggtgatcaagtttcttcct

SEQ ID NO: 90550 - DNA, 20 bp, synthetic construct
  misc_feature 1..20: note = CRISPR gRNA sequence
  source 1..20: mol_type = other DNA
ttcttcctcagtatgttcca

SEQ ID NO: 90551 - DNA, 20 bp, synthetic construct
  misc_feature 1..20: note = CRISPR gRNA sequence
  source 1..20: mol_type = other DNA
tcttcctcagtatgttccac

SEQ ID NO: 90552 - DNA, 20 bp, synthetic construct
  misc_feature 1..20: note = CRISPR gRNA sequence
  source 1..20: mol_type = other DNA
ccacaggtgcccattcactt

SEQ ID NO: 90553 - DNA, 20 bp, synthetic construct
  misc_feature 1..20: note = CRISPR gRNA sequence
  source 1..20: mol_type = other DNA
ccattcacttcagaattctt

SEQ ID NO: 90554 - DNA, 20 bp, synthetic construct
  misc_feature 1..20: note = CRISPR gRNA sequence
  source 1..20: mol_type = other DNA
attcacttcagaattcttta

SEQ ID NO: 90555 - DNA, 20 bp, synthetic construct
  misc_feature 1..20: note = CRISPR gRNA sequence
  source 1..20: mol_type = other DNA
tcacttcagaattctttaga

SEQ ID NO: 90556 - DNA, 20 bp, synthetic construct
  misc_feature 1..20: note = CRISPR gRNA sequence
  source 1..20: mol_type = other DNA
cacttcagaattctttagag

SEQ ID NO: 90557 - DNA, 20 bp, synthetic construct
  misc_feature 1..20: note = CRISPR gRNA sequence
  source 1..20: mol_type = other DNA
acttcagaattctttagaga

SEQ ID NO: 90558 - DNA, 20 bp, synthetic construct
  misc_feature 1..20: note = CRISPR gRNA sequence
  source 1..20: mol_type = other DNA
ttcagaattctttagagagg

SEQ ID NO: 90559 - DNA, 20 bp, synthetic construct
  misc_feature 1..20: note = CRISPR gRNA sequence
  source 1..20: mol_type = other DNA
tttctttctttttttttttt

SEQ ID NO: 90560 - DNA, 20 bp, synthetic construct
  misc_feature 1..20: note = CRISPR gRNA sequence
  source 1..20: mol_type = other DNA
tttcttttttttttttgaga

SEQ ID NO: 90561 - DNA, 20 bp, synthetic construct
  misc_feature 1..20: note = CRISPR gRNA sequence
  source 1..20: mol_type = other DNA
tcttttttttttttgagaca

SEQ ID NO: 90562 - DNA, 20 bp, synthetic construct
  misc_feature 1..20: note = CRISPR gRNA sequence
  source 1..20: mol_type = other DNA
gagtcttactctgtgtcgct

SEQ ID NO: 90563 - DNA, 20 bp, synthetic construct
  misc_feature 1..20: note = CRISPR gRNA sequence
  source 1..20: mol_type = other DNA
agtcttactctgtgtcgctc

SEQ ID NO: 90564 - DNA, 20 bp, synthetic construct
  misc_feature 1..20: note = CRISPR gRNA sequence
  source 1..20: mol_type = other DNA
ttactctgtgtcgctcaggc

SEQ ID NO: 90565 - DNA, 20 bp, synthetic construct
  misc_feature 1..20: note = CRISPR gRNA sequence
  source 1..20: mol_type = other DNA
actctgtgtcgctcaggctg

SEQ ID NO: 90566 - DNA, 20 bp, synthetic construct
  misc_feature 1..20: note = CRISPR gRNA sequence
  source 1..20: mol_type = other DNA
gtgtcgctcaggctggagtg

SEQ ID NO: 90567 - DNA, 20 bp, synthetic construct
  misc_feature 1..20: note = CRISPR gRNA sequence
  source 1..20: mol_type = other DNA
tcgctcaggctggagtgcag

SEQ ID NO: 90568 - DNA, 20 bp, synthetic construct
  misc_feature 1..20: note = CRISPR gRNA sequence
  source 1..20: mol_type = other DNA
ggagtgcagtggtgcgatct

SEQ ID NO: 90569 - DNA, 20 bp, synthetic construct
  misc_feature 1..20: note = CRISPR gRNA sequence
  source 1..20: mol_type = other DNA
ccactacaacctccacctcc

SEQ ID NO: 90570 - DNA, 20 bp, synthetic construct
  misc_feature 1..20: note = CRISPR gRNA sequence
  source 1..20: mol_type = other DNA
cactacaacctccacctcct

SEQ ID NO: 90571 - DNA, 20 bp, synthetic construct
  misc_feature 1..20: note = CRISPR gRNA sequence
  source 1..20: mol_type = other DNA
aacctccacctcctgggttc

SEQ ID NO: 90572 - DNA, 20 bp, synthetic construct
  misc_feature 1..20: note = CRISPR gRNA sequence
  source 1..20: mol_type = other DNA
ctccacctcctgggttcaag

SEQ ID NO: 90573 - DNA, 20 bp, synthetic construct
  misc_feature 1..20: note = CRISPR gRNA sequence
  source 1..20: mol_type = other DNA
ttcaagcagttcttgtgcct

SEQ ID NO: 90574 - DNA, 20 bp, synthetic construct
  misc_feature 1..20: note = CRISPR gRNA sequence
  source 1..20: mol_type = other DNA
ttcttgtgcctcagcctcct

SEQ ID NO: 90575 - DNA, 20 bp, synthetic construct
  misc_feature 1..20: note = CRISPR gRNA sequence
  source 1..20: mol_type = other DNA
ttgtgcctcagcctcctgag

SEQ ID NO: 90576 - DNA, 20 bp, synthetic construct
  misc_feature 1..20: note = CRISPR gRNA sequence
  source 1..20: mol_type = other DNA
gcctcagcctcctgagtagc

SEQ ID NO: 90577 - DNA, 20 bp, synthetic construct
  misc_feature 1..20: note = CRISPR gRNA sequence
  source 1..20: mol_type = other DNA
cctcagcctcctgagtagct

SEQ ID NO: 90578 - DNA, 20 bp, synthetic construct
  misc_feature 1..20: note = CRISPR gRNA sequence
  source 1..20: mol_type = other DNA
ctcctgagtagctgggatta

SEQ ID NO: 90579 - DNA, 20 bp, synthetic construct
  misc_feature 1..20: note = CRISPR gRNA sequence
  source 1..20: mol_type = other DNA
tcctgagtagctgggattac

SEQ ID NO: 90580 - DNA, 20 bp, synthetic construct
  misc_feature 1..20: note = CRISPR gRNA sequence
  source 1..20: mol_type = other DNA
caggcatgcaccaccacgcc

SEQ ID NO: 90581 - DNA, 20 bp, synthetic construct
  misc_feature 1..20: note = CRISPR gRNA sequence
  source 1..20: mol_type = other DNA
ccggctaatttttgtatttt

SEQ ID NO: 90582 - DNA, 20 bp, synthetic construct
  misc_feature 1..20: note = CRISPR gRNA sequence
  source 1..20: mol_type = other DNA
gctaatttttgtatttttag

SEQ ID NO: 90583 - DNA, 20 bp, synthetic construct
  misc_feature 1..20: note = CRISPR gRNA sequence
  source 1..20: mol_type = other DNA
taatttttgtatttttagta

SEQ ID NO: 90584 - DNA, 20 bp, synthetic construct
  misc_feature 1..20: note = CRISPR gRNA sequence
  source 1..20: mol_type = other DNA
ttgtatttttagtagagacg

SEQ ID NO: 90585 - DNA, 20 bp, synthetic construct
  misc_feature 1..20: note = CRISPR gRNA sequence
  source 1..20: mol_type = other DNA
gagacgcggttttgccatgt

SEQ ID NO: 90586 - DNA, 20 bp, synthetic construct
  misc_feature 1..20: note = CRISPR gRNA sequence
  source 1..20: mol_type = other DNA
cgcggttttgccatgttggc

SEQ ID NO: 90587 - DNA, 20 bp, synthetic construct
  misc_feature 1..20: note = CRISPR gRNA sequence
  source 1..20: mol_type = other DNA
ttttgccatgttggccagtc

SEQ ID NO: 90588 - DNA, 20 bp, synthetic construct
  misc_feature 1..20: note = CRISPR gRNA sequence
  source 1..20: mol_type = other DNA
aactcctgatcctcccacct

SEQ ID NO: 90589 - DNA, 20 bp, synthetic construct
  misc_feature 1..20: note = CRISPR gRNA sequence
  source 1..20: mol_type = other DNA
cctcccacctcagcctcctg

SEQ ID NO: 90590 - DNA, 20 bp, synthetic construct
  misc_feature 1..20: note = CRISPR gRNA sequence
  source 1..20: mol_type = other DNA
acctcagcctcctgaagtgc

SEQ ID NO: 90591 - DNA, 20 bp, synthetic construct
  misc_feature 1..20: note = CRISPR gRNA sequence
  source 1..20: mol_type = other DNA
cctcagcctcctgaagtgct

SEQ ID NO: 90592 - DNA, 20 bp, synthetic construct
  misc_feature 1..20: note = CRISPR gRNA sequence
  source 1..20: mol_type = other DNA
ctcctgaagtgctgggatta

SEQ ID NO: 90593 - DNA, 20 bp, synthetic construct
  misc_feature 1..20: note = CRISPR gRNA sequence
  source 1..20: mol_type = other DNA
tcctgaagtgctgggattac

SEQ ID NO: 90594 - DNA, 20 bp, synthetic construct
  misc_feature 1..20: note = CRISPR gRNA sequence
  source 1..20: mol_type = other DNA
gaagtgctgggattacgggt

SEQ ID NO: 90595 - DNA, 20 bp, synthetic construct
  misc_feature 1..20: note = CRISPR gRNA sequence
  source 1..20: mol_type = other DNA
acgggtgagacccaccacgc

SEQ ID NO: 90596 - DNA, 20 bp, synthetic construct
  misc_feature 1..20: note = CRISPR gRNA sequence
  source 1..20: mol_type = other DNA
gcctaataatacttattttc

SEQ ID NO: 90597 - DNA, 20 bp, synthetic construct
  misc_feature 1..20: note = CRISPR gRNA sequence
  source 1..20: mol_type = other DNA
aataatacttattttcaaga

SEQ ID NO: 90598 - DNA, 20 bp, synthetic construct
  misc_feature 1..20: note = CRISPR gRNA sequence
  source 1..20: mol_type = other DNA
aatacttattttcaagaaag

SEQ ID NO: 90599 - DNA, 20 bp, synthetic construct
  misc_feature 1..20: note = CRISPR gRNA sequence
  source 1..20: mol_type = other DNA
acttattttcaagaaagaag

SEQ ID NO: 90600 - DNA, 20 bp, synthetic construct
  misc_feature 1..20: note = CRISPR gRNA sequence
  source 1..20: mol_type = other DNA
agaaagaagtagttaaccta

SEQ ID NO: 90601 - DNA, 20 bp, synthetic construct
  misc_feature 1..20: note = CRISPR gRNA sequence
  source 1..20: mol_type = other DNA
ctacctaacatttacatcta

SEQ ID NO: 90602 - DNA, 20 bp, synthetic construct
  misc_feature 1..20: note = CRISPR gRNA sequence
  source 1..20: mol_type = other DNA
ctaacatttacatctacagt

SEQ ID NO: 90603 - DNA, 20 bp, synthetic construct
  misc_feature 1..20: note = CRISPR gRNA sequence
  source 1..20: mol_type = other DNA
taacatttacatctacagtg

SEQ ID NO: 90604 - DNA, 20 bp, synthetic construct
  misc_feature 1..20: note = CRISPR gRNA sequence
  source 1..20: mol_type = other DNA
acagtgaggaaaatgtataa

SEQ ID NO: 90605 - DNA, 20 bp, synthetic construct
  misc_feature 1..20: note = CRISPR gRNA sequence
  source 1..20: mol_type = other DNA
cagtgaggaaaatgtataaa

SEQ ID NO: 90606 - DNA, 20 bp, synthetic construct
  misc_feature 1..20: note = CRISPR gRNA sequence
  source 1..20: mol_type = other DNA
tgaggaaaatgtataaaagg

SEQ ID NO: 90607 - DNA, 20 bp, synthetic construct
  misc_feature 1..20: note = CRISPR gRNA sequence
  source 1..20: mol_type = other DNA
gaaaatgtataaaaggcaga

SEQ ID NO: 90608 - DNA, 20 bp, synthetic construct
  misc_feature 1..20: note = CRISPR gRNA sequence
  source 1..20: mol_type = other DNA
aaggcagatagatactgaat

SEQ ID NO: 90609 - DNA, 20 bp, synthetic construct
  misc_feature 1..20: note = CRISPR gRNA sequence
  source 1..20: mol_type = other DNA
ccctctgcacctcccacaaa

SEQ ID NO: 90610 - DNA, 20 bp, synthetic construct
  misc_feature 1..20: note = CRISPR gRNA sequence
  source 1..20: mol_type = other DNA
tatttacttatctaattttt

SEQ ID NO: 90611 - DNA, 20 bp, synthetic construct
  misc_feature 1..20: note = CRISPR gRNA sequence
  source 1..20: mol_type = other DNA
tttacttatctaatttttta

SEQ ID NO: 90612 - DNA, 20 bp, synthetic construct
  misc_feature 1..20: note = CRISPR gRNA sequence
  source 1..20: mol_type = other DNA
cttatctaattttttagaga

SEQ ID NO: 90613 - DNA, 20 bp, synthetic construct
  misc_feature 1..20: note = CRISPR gRNA sequence
  source 1..20: mol_type = other DNA
ttatctaattttttagagat

SEQ ID NO: 90614 - DNA, 20 bp, synthetic construct
  misc_feature 1..20: note = CRISPR gRNA sequence
  source 1..20: mol_type = other DNA
ttttttagagatgggtctca

SEQ ID NO: 90615 - DNA, 20 bp, synthetic construct
  misc_feature 1..20: note = CRISPR gRNA sequence
  source 1..20: mol_type = other DNA
atgggtctcacagtgttgcc

SEQ ID NO: 90616 - DNA, 20 bp, synthetic construct
  misc_feature 1..20: note = CRISPR gRNA sequence
  source 1..20: mol_type = other DNA
tgggtctcacagtgttgccc

SEQ ID NO: 90617 - DNA, 20 bp, synthetic construct
  misc_feature 1..20: note = CRISPR gRNA sequence
  source 1..20: mol_type = other DNA
tctcacagtgttgcccaggc

SEQ ID NO: 90618 - DNA, 20 bp, synthetic construct
  misc_feature 1..20: note = CRISPR gRNA sequence
  source 1..20: mol_type = other DNA
ccaggctggcctcgaattcc

SEQ ID NO: 90619 - DNA, 20 bp, synthetic construct
  misc_feature 1..20: note = CRISPR gRNA sequence
  source 1..20: mol_type = other DNA
caggctggcctcgaattcct

SEQ ID NO: 90620 - DNA, 20 bp, synthetic construct
  misc_feature 1..20: note = CRISPR gRNA sequence
  source 1..20: mol_type = other DNA
ggcctcgaattcctgggctc

SEQ ID NO: 90621 - DNA, 20 bp, synthetic construct
  misc_feature 1..20: note = CRISPR gRNA sequence
  source 1..20: mol_type = other DNA
ctcaagtgatcctcctgcct

SEQ ID NO: 90622 - DNA, 20 bp, synthetic construct
  misc_feature 1..20: note = CRISPR gRNA sequence
  source 1..20: mol_type = other DNA
gatcctcctgcctcagcctt

SEQ ID NO: 90623 - DNA, 20 bp, synthetic construct
  misc_feature 1..20: note = CRISPR gRNA sequence
  source 1..20: mol_type = other DNA
tcctcctgcctcagccttca

SEQ ID NO: 90624 - DNA, 20 bp, synthetic construct
  misc_feature 1..20: note = CRISPR gRNA sequence
  source 1..20: mol_type = other DNA
gcctcagccttcagagtaac

SEQ ID NO: 90625 - DNA, 20 bp, synthetic construct
  misc_feature 1..20: note = CRISPR gRNA sequence
  source 1..20: mol_type = other DNA
cctcagccttcagagtaact

SEQ ID NO: 90626 - DNA, 20 bp, synthetic construct
  misc_feature 1..20: note = CRISPR gRNA sequence
  source 1..20: mol_type = other DNA
gattatttcaccactgcacc

SEQ ID NO: 90627 - DNA, 20 bp, synthetic construct
  misc_feature 1..20: note = CRISPR gRNA sequence
  source 1..20: mol_type = other DNA
ataatttgcatgacttttta

SEQ ID NO: 90628 - DNA, 20 bp, synthetic construct
  misc_feature 1..20: note = CRISPR gRNA sequence
  source 1..20: mol_type = other DNA
atttgcatgactttttatgg

SEQ ID NO: 90629 - DNA, 20 bp, synthetic construct
  misc_feature 1..20: note = CRISPR gRNA sequence
  source 1..20: mol_type = other DNA
tttgcatgactttttatgga

SEQ ID NO: 90630 - DNA, 20 bp, synthetic construct
  misc_feature 1..20: note = CRISPR gRNA sequence
  source 1..20: mol_type = other DNA
ttgcatgactttttatggaa

SEQ ID NO: 90631 - DNA, 20 bp, synthetic construct
  misc_feature 1..20: note = CRISPR gRNA sequence
  source 1..20: mol_type = other DNA
ggaagggaattaattgctat

SEQ ID NO: 90632 - DNA, 20 bp, synthetic construct
  misc_feature 1..20: note = CRISPR gRNA sequence
  source 1..20: mol_type = other DNA
taagcaacaaataatactaa

SEQ ID NO: 90633 - DNA, 20 bp, synthetic construct
  misc_feature 1..20: note = CRISPR gRNA sequence
  source 1..20: mol_type = other DNA
aatactaatagtttactatc

SEQ ID NO: 90634 - DNA, 20 bp, synthetic construct
  misc_feature 1..20: note = CRISPR gRNA sequence
  source 1..20: mol_type = other DNA
atccagtttgtcttatattt

SEQ ID NO: 90635 - DNA, 20 bp, synthetic construct
  misc_feature 1..20: note = CRISPR gRNA sequence
  source 1..20: mol_type = other DNA
tccagtttgtcttatatttt

SEQ ID NO: 90636 - DNA, 20 bp, synthetic construct
  misc_feature 1..20: note = CRISPR gRNA sequence
  source 1..20: mol_type = other DNA
tatattttgggatactttat

SEQ ID NO: 90637 - DNA, 20 bp, synthetic construct
  misc_feature 1..20: note = CRISPR gRNA sequence
  source 1..20: mol_type = other DNA
tgggatactttatcagttct

SEQ ID NO: 90638 - DNA, 20 bp, synthetic construct
  misc_feature 1..20: note = CRISPR gRNA sequence
  source 1..20: mol_type = other DNA
gggatactttatcagttctg

SEQ ID NO: 90639 - DNA, 20 bp, synthetic construct
  misc_feature 1..20: note = CRISPR gRNA sequence
  source 1..20: mol_type = other DNA
gatactttatcagttctgag

SEQ ID NO: 90640 - DNA, 20 bp, synthetic construct
  misc_feature 1..20: note = CRISPR gRNA sequence
  source 1..20: mol_type = other DNA
atactttatcagttctgagg

SEQ ID NO: 90641 - DNA, 20 bp, synthetic construct
  misc_feature 1..20: note = CRISPR gRNA sequence
  source 1..20: mol_type = other DNA
atcagttctgaggaggtaac

SEQ ID NO: 90642 - DNA, 20 bp, synthetic construct
  misc_feature 1..20: note = CRISPR gRNA sequence
  source 1..20: mol_type = other DNA
atctttatctttgttaaact

SEQ ID NO: 90643 - DNA, 20 bp, synthetic construct
  misc_feature 1..20: note = CRISPR gRNA sequence
  source 1..20: mol_type = other DNA
tctttgttaaactgagtgta

SEQ ID NO: 90644 - DNA, 20 bp, synthetic construct
  misc_feature 1..20: note = CRISPR gRNA sequence
  source 1..20: mol_type = other DNA
actgagtgtaaagaaaataa

SEQ ID NO: 90645 - DNA, 20 bp, synthetic construct
  misc_feature 1..20: note = CRISPR gRNA sequence
  source 1..20: mol_type = other DNA
tgtaaagaaaataacagtgc

SEQ ID NO: 90646 - DNA, 20 bp, synthetic construct
  misc_feature 1..20: note = CRISPR gRNA sequence
  source 1..20: mol_type = other DNA
aagaaaataacagtgccagc

SEQ ID NO: 90647 - DNA, 20 bp, synthetic construct
  misc_feature 1..20: note = CRISPR gRNA sequence
  source 1..20: mol_type = other DNA
agaaaataacagtgccagcc

SEQ ID NO: 90648 - DNA, 20 bp, synthetic construct
  misc_feature 1..20: note = CRISPR gRNA sequence
  source 1..20: mol_type = other DNA
agtgccagccaggatataat

SEQ ID NO: 90649 - DNA, 20 bp, synthetic construct
  misc_feature 1..20: note = CRISPR gRNA sequence
  source 1..20: mol_type = other DNA
tgccagccaggatataataa

SEQ ID NO: 90650 - DNA, 20 bp, synthetic construct
  misc_feature 1..20: note = CRISPR gRNA sequence
  source 1..20: mol_type = other DNA
tataataagagccaactgta

SEQ ID NO: 90651 - DNA, 20 bp, synthetic construct
  misc_feature 1..20: note = CRISPR gRNA sequence
  source 1..20: mol_type = other DNA
taagagccaactgtatagtc

SEQ ID NO: 90652 - DNA, 20 bp, synthetic construct
  misc_feature 1..20: note = CRISPR gRNA sequence
  source 1..20: mol_type = other DNA
ccaactgtatagtccggttt

SEQ ID NO: 90653 - DNA, 20 bp, synthetic construct
  misc_feature 1..20: note = CRISPR gRNA sequence
  source 1..20: mol_type = other DNA
actgtatagtccggttttag

SEQ ID NO: 90654 - DNA, 20 bp, synthetic construct
  misc_feature 1..20: note = CRISPR gRNA sequence
  source 1..20: mol_type = other DNA
atagtccggttttagtagtt

SEQ ID NO: 90655 - DNA, 20 bp, synthetic construct
  misc_feature 1..20: note = CRISPR gRNA sequence
  source 1..20: mol_type = other DNA
agtccggttttagtagttca

SEQ ID NO: 90656 - DNA, 20 bp, synthetic construct
  misc_feature 1..20: note = CRISPR gRNA sequence
  source 1..20: mol_type = other DNA
gtccggttttagtagttcag

SEQ ID NO: 90657 - DNA, 20 bp, synthetic construct
  misc_feature 1..20: note = CRISPR gRNA sequence
  source 1..20: mol_type = other DNA
ccggttttagtagttcagag

SEQ ID NO: 90658 - DNA, 20 bp, synthetic construct
  misc_feature 1..20: note = CRISPR gRNA sequence
  source 1..20: mol_type = other DNA
cggttttagtagttcagagg

SEQ ID NO: 90659 - DNA, 20 bp, synthetic construct
  misc_feature 1..20: note = CRISPR gRNA sequence
  source 1..20: mol_type = other DNA
tttagtagttcagaggagga

SEQ ID NO: 90660 - DNA, 20 bp, synthetic construct
  misc_feature 1..20: note = CRISPR gRNA sequence
  source 1..20: mol_type = other DNA
cagaggaggatagatcattg

SEQ ID NO: 90661 - DNA, 20 bp, synthetic construct
  misc_feature 1..20: note = CRISPR gRNA sequence
  source 1..20: mol_type = other DNA
agaggaggatagatcattgt

SEQ ID NO: 90662 - DNA, 20 bp, synthetic construct
  misc_feature 1..20: note = CRISPR gRNA sequence
  source 1..20: mol_type = other DNA
aggatagatcattgtaggct

SEQ ID NO: 90663 - DNA, 20 bp, synthetic construct
  misc_feature 1..20: note = CRISPR gRNA sequence
  source 1..20: mol_type = other DNA
cattgtaggctgagatactc

SEQ ID NO: 90664 - DNA, 20 bp, synthetic construct
  misc_feature 1..20: note = CRISPR gRNA sequence
  source 1..20: mol_type = other DNA
gtaggctgagatactccaga

SEQ ID NO: 90665 - DNA, 20 bp, synthetic construct
  misc_feature 1..20: note = CRISPR gRNA sequence
  source 1..20: mol_type = other DNA
taggctgagatactccagaa

SEQ ID NO: 90666 - DNA, 20 bp, synthetic construct
  misc_feature 1..20: note = CRISPR gRNA sequence
  source 1..20: mol_type = other DNA
gatactccagaaaggctttg

SEQ ID NO: 90667 - DNA, 20 bp, synthetic construct
  misc_feature 1..20: note = CRISPR gRNA sequence
  source 1..20: mol_type = other DNA
tactccagaaaggctttgca

SEQ ID NO: 90668 - DNA, 20 bp, synthetic construct
  misc_feature 1..20: note = CRISPR gRNA sequence
  source 1..20: mol_type = other DNA
actccagaaaggctttgcag

SEQ ID NO: 90669 - DNA, 20 bp, synthetic construct
  misc_feature 1..20: note = CRISPR gRNA sequence
  source 1..20: mol_type = other DNA
tttgcagaggaaacgtgact

SEQ ID NO: 90670 - DNA, 20 bp, synthetic construct
  misc_feature 1..20: note = CRISPR gRNA sequence
  source 1..20: mol_type = other DNA
aaacgtgactcagtataaac

SEQ ID NO: 90671 - DNA, 20 bp, synthetic construct
  misc_feature 1..20: note = CRISPR gRNA sequence
  source 1..20: mol_type = other DNA
gtgactcagtataaaccaga

SEQ ID NO: 90672 - DNA, 20 bp, synthetic construct
  misc_feature 1..20: note = CRISPR gRNA sequence
  source 1..20: mol_type = other DNA
tgactcagtataaaccagaa

SEQ ID NO: 90673 - DNA, 20 bp, synthetic construct
  misc_feature 1..20: note = CRISPR gRNA sequence
  source 1..20: mol_type = other DNA
tcagtataaaccagaaagga

SEQ ID NO: 90674 - DNA, 20 bp, synthetic construct
  misc_feature 1..20: note = CRISPR gRNA sequence
  source 1..20: mol_type = other DNA
cagtataaaccagaaaggat

SEQ ID NO: 90675 - DNA, 20 bp, synthetic construct
  misc_feature 1..20: note = CRISPR gRNA sequence
  source 1..20: mol_type = other DNA
aaaccagaaaggatgggcaa

SEQ ID NO: 90676 - DNA, 20 bp, synthetic construct
  misc_feature 1..20: note = CRISPR gRNA sequence
  source 1..20: mol_type = other DNA
ggcaatagtttacgcttaat

SEQ ID NO: 90677 - DNA, 20 bp, synthetic construct
  misc_feature 1..20: note = CRISPR gRNA sequence
  source 1..20: mol_type = other DNA
tagtttacgcttaatgagct

SEQ ID NO: 90678 - DNA, 20 bp, synthetic construct
  misc_feature 1..20: note = CRISPR gRNA sequence
  source 1..20: mol_type = other DNA
agctgagtttcttatgtgtc

SEQ ID NO: 90679 - DNA, 20 bp, synthetic construct
  misc_feature 1..20: note = CRISPR gRNA sequence
  source 1..20: mol_type = other DNA
tatgtgtcaagcactgtgtt

SEQ ID NO: 90680 - DNA, 20 bp, synthetic construct
  misc_feature 1..20: note = CRISPR gRNA sequence
  source 1..20: mol_type = other DNA
gcactgtgttaagctataaa

SEQ ID NO: 90681 - DNA, 20 bp, synthetic construct
  misc_feature 1..20: note = CRISPR gRNA sequence
  source 1..20: mol_type = other DNA
actgtgttaagctataaatg

SEQ ID NO: 90682 - DNA, 20 bp, synthetic construct
  misc_feature 1..20: note = CRISPR gRNA sequence
  source 1..20: mol_type = other DNA
aatggagtctcacaaccctt

SEQ ID NO: 90683 - DNA, 20 bp, synthetic construct
  misc_feature 1..20: note = CRISPR gRNA sequence
  source 1..20: mol_type = other DNA
gtctcacaacccttcagcaa

SEQ ID NO: 90684 - DNA, 20 bp, synthetic construct
  misc_feature 1..20: note = CRISPR gRNA sequence
  source 1..20: mol_type = other DNA
tctcacaacccttcagcaat

SEQ ID NO: 90685 - DNA, 20 bp, synthetic construct
  misc_feature 1..20: note = CRISPR gRNA sequence
  source 1..20: mol_type = other DNA
acaacccttcagcaatggga

SEQ ID NO: 90686 - DNA, 20 bp, synthetic construct
  misc_feature 1..20: note = CRISPR gRNA sequence
  source 1..20: mol_type = other DNA
gatactatattttacataca

SEQ ID NO: 90687 - DNA, 20 bp, synthetic construct
  misc_feature 1..20: note = CRISPR gRNA sequence
  source 1..20: mol_type = other DNA
attttacatacatggaaact

SEQ ID NO: 90688 - DNA, 20 bp, synthetic construct
  misc_feature 1..20: note = CRISPR gRNA sequence
  source 1..20: mol_type = other DNA
ttttacatacatggaaactg

SEQ ID NO: 90689 - DNA, 20 bp, synthetic construct
  misc_feature 1..20: note = CRISPR gRNA sequence
  source 1..20: mol_type = other DNA
catacatggaaactgaggca

SEQ ID NO: 90690 - DNA, 20 bp, synthetic construct
  misc_feature 1..20: note = CRISPR gRNA sequence
  source 1..20: mol_type = other DNA
tacatggaaactgaggcaca

SEQ ID NO: 90691 - DNA, 20 bp, synthetic construct
  misc_feature 1..20: note = CRISPR gRNA sequence
  source 1..20: mol_type = other DNA
catggaaactgaggcacaga

SEQ ID NO: 90692 - DNA, 20 bp, synthetic construct
  misc_feature 1..20: note = CRISPR gRNA sequence
  source 1..20: mol_type = other DNA
atggaaactgaggcacagag

SEQ ID NO: 90693 - DNA, 20 bp, synthetic construct
  misc_feature 1..20: note = CRISPR gRNA sequence
  source 1..20: mol_type = other DNA
actgaggcacagagaggcta

SEQ ID NO: 90694 - DNA, 20 bp, synthetic construct
  misc_feature 1..20: note = CRISPR gRNA sequence
  source 1..20: mol_type = other DNA
cacagagaggctaaagaatt

SEQ ID NO: 90695 - DNA, 20 bp, synthetic construct
  misc_feature 1..20: note = CRISPR gRNA sequence
  source 1..20: mol_type = other DNA
agaggctaaagaatttggcc

SEQ ID NO: 90696 - DNA, 20 bp, synthetic construct
  misc_feature 1..20: note = CRISPR gRNA sequence
  source 1..20: mol_type = other DNA
gaggctaaagaatttggcct

SEQ ID NO: 90697 - DNA, 20 bp, synthetic construct
  misc_feature 1..20: note = CRISPR gRNA sequence
  source 1..20: mol_type = other DNA
agaatttggcctaggtcata

SEQ ID NO: 90698 - DNA, 20 bp, synthetic construct
  misc_feature 1..20: note = CRISPR gRNA sequence
  source 1..20: mol_type = other DNA
tttggcctaggtcatacagc

SEQ ID NO: 90699 - DNA, 20 bp, synthetic construct
  misc_feature 1..20: note = CRISPR gRNA sequence
  source 1..20: mol_type = other DNA
gcctaggtcatacagccagc

SEQ ID NO: 90700 - DNA, 20 bp, synthetic construct
  misc_feature 1..20: note = CRISPR gRNA sequence
  source 1..20: mol_type = other DNA
caagtattgtactcaaacgc

SEQ ID NO: 90701 - DNA, 20 bp, synthetic construct
  misc_feature 1..20: note = CRISPR gRNA sequence
  source 1..20: mol_type = other DNA
gtattgtactcaaacgcaag

SEQ ID NO: 90702 - DNA, 20 bp, synthetic construct
  misc_feature 1..20: note = CRISPR gRNA sequence
  source 1..20: mol_type = other DNA
aaacgcaagcagtcttattc

SEQ ID NO: 90703 - DNA, 20 bp, synthetic construct
  misc_feature 1..20: note = CRISPR gRNA sequence
  source 1..20: mol_type = other DNA
acgcaagcagtcttattcta

SEQ ID NO: 90704 - DNA, 20 bp, synthetic construct
  misc_feature 1..20: note = CRISPR gRNA sequence
  source 1..20: mol_type = other DNA
tccttactatactgcttccc

SEQ ID NO: 90705 - DNA, 20 bp, synthetic construct
  misc_feature 1..20: note = CRISPR gRNA sequence
  source 1..20: mol_type = other DNA
atactgcttccctagaattc

SEQ ID NO: 90706 - DNA, 20 bp, synthetic construct
  misc_feature 1..20: note = CRISPR gRNA sequence
  source 1..20: mol_type = other DNA
ctgcttccctagaattctgg

SEQ ID NO: 90707 - DNA, 20 bp, synthetic construct
  misc_feature 1..20: note = CRISPR gRNA sequence
  source 1..20: mol_type = other DNA
cctagaattctggtagataa

SEQ ID NO: 90708 - DNA, 20 bp, synthetic construct
  misc_feature 1..20: note = CRISPR gRNA sequence
  source 1..20: mol_type = other DNA
ctagaattctggtagataaa

SEQ ID NO: 90709 - DNA, 20 bp, synthetic construct
  misc_feature 1..20: note = CRISPR gRNA sequence
  source 1..20: mol_type = other DNA
aattctggtagataaaagga

SEQ ID NO: 90710 - DNA, 20 bp, synthetic construct
  misc_feature 1..20: note = CRISPR gRNA sequence
  source 1..20: mol_type = other DNA
ttctggtagataaaaggaaa

SEQ ID NO: 90711 - DNA, 20 bp, synthetic construct
  misc_feature 1..20: note = CRISPR gRNA sequence
  source 1..20: mol_type = other DNA
tggtagataaaaggaaagag

SEQ ID NO: 90712 - DNA, 20 bp, synthetic construct
  misc_feature 1..20: note = CRISPR gRNA sequence
  source 1..20: mol_type = other DNA
aaggaaagagaagcacattt

SEQ ID NO: 90713 - DNA, 20 bp, synthetic construct
  misc_feature 1..20: note = CRISPR gRNA sequence
  source 1..20: mol_type = other DNA
aagagaagcacattttagta

SEQ ID NO: 90714 - DNA, 20 bp, synthetic construct
  misc_feature 1..20: note = CRISPR gRNA sequence
  source 1..20: mol_type = other DNA
gaagcacattttagtaaaga

SEQ ID NO: 90715 - DNA, 20 bp, synthetic construct
  misc_feature 1..20: note = CRISPR gRNA sequence
  source 1..20: mol_type = other DNA
agcacattttagtaaagaaa

SEQ ID NO: 90716 - DNA, 20 bp, synthetic construct
  misc_feature 1..20: note = CRISPR gRNA sequence
  source 1..20: mol_type = other DNA
acattttagtaaagaaagag

SEQ ID NO: 90717 - DNA, 20 bp, synthetic construct
  misc_feature 1..20: note = CRISPR gRNA sequence
  source 1..20: mol_type = other DNA
ttttagtaaagaaagagaag

SEQ ID NO: 90718 - DNA, 20 bp, synthetic construct
  misc_feature 1..20: note = CRISPR gRNA sequence
  source 1..20: mol_type = other DNA
tttagtaaagaaagagaagt

SEQ ID NO: 90719 - DNA, 20 bp, synthetic construct
  misc_feature 1..20: note = CRISPR gRNA sequence
  source 1..20: mol_type = other DNA
aagaaagagaagtaggaata

SEQ ID NO: 90720 - DNA, 20 bp, synthetic construct
  misc_feature 1..20: note = CRISPR gRNA sequence
  source 1..20: mol_type = other DNA
atacagaaaacacttttgtg

SEQ ID NO: 90721 - DNA, 20 bp, synthetic construct
  misc_feature 1..20: note = CRISPR gRNA sequence
  source 1..20: mol_type = other DNA
agaaaacacttttgtgaaga

SEQ ID NO: 90722 - DNA, 20 bp, synthetic construct
  misc_feature 1..20: note = CRISPR gRNA sequence
  source 1..20: mol_type = other DNA
aacacttttgtgaagatagc

SEQ ID NO: 90723 - DNA, 20 bp, synthetic construct
  misc_feature 1..20: note = CRISPR gRNA sequence
  source 1..20: mol_type = other DNA
acttttgtgaagatagcaag

SEQ ID NO: 90724 - DNA, 20 bp, synthetic construct
  misc_feature 1..20: note = CRISPR gRNA sequence
  source 1..20: mol_type = other DNA
agatagcaagtggactattc

SEQ ID NO: 90725 - DNA, 20 bp, synthetic construct
  misc_feature 1..20: note = CRISPR gRNA sequence
  source 1..20: mol_type = other DNA
gtggactattctagctaaaa

SEQ ID NO: 90726 - DNA, 20 bp, synthetic construct
  misc_feature 1..20: note = CRISPR gRNA sequence
  source 1..20: mol_type = other DNA
ctattctagctaaaatagtt

SEQ ID NO: 90727 - DNA, 20 bp, synthetic construct
  misc_feature 1..20: note = CRISPR gRNA sequence
  source 1..20: mol_type = other DNA
ttctagctaaaatagttgag

SEQ ID NO: 90728 - DNA, 20 bp, synthetic construct
  misc_feature 1..20: note = CRISPR gRNA sequence
  source 1..20: mol_type = other DNA
tagttgagtggaaaattcat

SEQ ID NO: 90729 - DNA, 20 bp, synthetic construct
  misc_feature 1..20: note = CRISPR gRNA sequence
  source 1..20: mol_type = other DNA
gttgagtggaaaattcatga

SEQ ID NO: 90730 - DNA, 20 bp, synthetic construct
  misc_feature 1..20: note = CRISPR gRNA sequence
  source 1..20: mol_type = other DNA
tgagtggaaaattcatgaga

SEQ ID NO: 90731 - DNA, 20 bp, synthetic construct
  misc_feature 1..20: note = CRISPR gRNA sequence
  source 1..20: mol_type = other DNA
aaattcatgagagagaaatt

SEQ ID NO: 90732 - DNA, 20 bp, synthetic construct
  misc_feature 1..20: note = CRISPR gRNA sequence
  source 1..20: mol_type = other DNA
tcatgagagagaaatttgga

SEQ ID NO: 90733 - DNA, 20 bp, synthetic construct
  misc_feature 1..20: note = CRISPR gRNA sequence
  source 1..20: mol_type = other DNA
gagagagaaatttggaaaga

SEQ ID NO: 90734 - DNA, 20 bp, synthetic construct
  misc_feature 1..20: note = CRISPR gRNA sequence
  source 1..20: mol_type = other DNA
agagagaaatttggaaagat

SEQ ID NO: 90735 - DNA, 20 bp, synthetic construct
  misc_feature 1..20: note = CRISPR gRNA sequence
  source 1..20: mol_type = other DNA
aaatttggaaagataggttg

SEQ ID NO: 90736 - DNA, 20 bp, synthetic construct
  misc_feature 1..20: note = CRISPR gRNA sequence
  source 1..20: mol_type = other DNA
ttggaaagataggttgaagc

SEQ ID NO: 90737 - DNA, 20 bp, synthetic construct
  misc_feature 1..20: note = CRISPR gRNA sequence
  source 1..20: mol_type = other DNA
aggttgaagccagtttttta

SEQ ID NO: 90738 - DNA, 20 bp, synthetic construct
  misc_feature 1..20: note = CRISPR gRNA sequence
  source 1..20: mol_type = other DNA
ttttttatagtattgaatgc

SEQ ID NO: 90739 - DNA, 20 bp, synthetic construct
  misc_feature 1..20: note = CRISPR gRNA sequence
  source 1..20: mol_type = other DNA
tttttatagtattgaatgcc

SEQ ID NO: 90740 - DNA, 20 bp, synthetic construct
  misc_feature 1..20: note = CRISPR gRNA sequence
  source 1..20: mol_type = other DNA
tagtattgaatgccaggcta

SEQ ID NO: 90741 - DNA, 20 bp, synthetic construct
  misc_feature 1..20: note = CRISPR gRNA sequence
  source 1..20: mol_type = other DNA
agtattgaatgccaggctat

SEQ ID NO: 90742 - DNA, 20 bp, synthetic construct
  misc_feature 1..20: note = CRISPR gRNA sequence
  source 1..20: mol_type = other DNA
gaatgccaggctatgggatt

SEQ ID NO: 90743 - DNA, 20 bp, synthetic construct
  misc_feature 1..20: note = CRISPR gRNA sequence
  source 1..20: mol_type = other DNA
caggctatgggatttggatt

SEQ ID NO: 90744 - DNA, 20 bp, synthetic construct
  misc_feature 1..20: note = CRISPR gRNA sequence
  source 1..20: mol_type = other DNA
ggctatgggatttggatttg

SEQ ID NO: 90745 - DNA, 20 bp, synthetic construct
  misc_feature 1..20: note = CRISPR gRNA sequence
  source 1..20: mol_type = other DNA
tttaaatgaaatgatctaat

SEQ ID NO: 90746 - DNA, 20 bp, synthetic construct
  misc_feature 1..20: note = CRISPR gRNA sequence
  source 1..20: mol_type = other DNA
ttaaatgaaatgatctaatt

SEQ ID NO: 90747 - DNA, 20 bp, synthetic construct
  misc_feature 1..20: note = CRISPR gRNA sequence
  source 1..20: mol_type = other DNA
aatgaaatgatctaattagg

SEQ ID NO: 90748 - DNA, 20 bp, synthetic construct
  misc_feature 1..20: note = CRISPR gRNA sequence
  source 1..20: mol_type = other DNA
gaaatgatctaattaggaag

SEQ ID NO: 90749 - DNA, 20 bp, synthetic construct
  misc_feature 1..20: note = CRISPR gRNA sequence
  source 1..20: mol_type = other DNA
atgatctaattaggaagtag

SEQ ID NO: 90750 - DNA, 20 bp, synthetic construct
  misc_feature 1..20: note = CRISPR gRNA sequence
  source 1..20: mol_type = other DNA
gatctaattaggaagtagca

SEQ ID NO: 90751 - DNA, 20 bp, synthetic construct
  misc_feature 1..20: note = CRISPR gRNA sequence
  source 1..20: mol_type = other DNA
atctaattaggaagtagcag

SEQ ID NO: 90752 - DNA, 20 bp, synthetic construct
  misc_feature 1..20: note = CRISPR gRNA sequence
  source 1..20: mol_type = other DNA
agcagaggatcctaccctga

SEQ ID NO: 90753 - DNA, 20 bp, synthetic construct
  misc_feature 1..20: note = CRISPR gRNA sequence
  source 1..20: mol_type = other DNA
cagaggatcctaccctgatg

SEQ ID NO: 90754 - DNA, 20 bp, synthetic construct
  misc_feature 1..20: note = CRISPR gRNA sequence
  source 1..20: mol_type = other DNA
aggatcctaccctgatggag

SEQ ID NO: 90755 - DNA, 20 bp, synthetic construct
  misc_feature 1..20: note = CRISPR gRNA sequence
  source 1..20: mol_type = other DNA
ggatcctaccctgatggagt

SEQ ID NO: 90756 - DNA, 20 bp, synthetic construct
  misc_feature 1..20: note = CRISPR gRNA sequence
  source 1..20: mol_type = other DNA
taccctgatggagtgggtta

SEQ ID NO: 90757 - DNA, 20 bp, synthetic construct
  misc_feature 1..20: note = CRISPR gRNA sequence
  source 1..20: mol_type = other DNA
tgatggagtgggttaaagtt

SEQ ID NO: 90758 - DNA, 20 bp, synthetic construct
  misc_feature 1..20: note = CRISPR gRNA sequence
  source 1..20: mol_type = other DNA
atggagtgggttaaagttga

SEQ ID NO: 90759 - DNA, 20 bp, synthetic construct
  misc_feature 1..20: note = CRISPR gRNA sequence
  source 1..20: mol_type = other DNA
gggttaaagttgagagccta

SEQ ID NO: 90760 - DNA, 20 bp, synthetic construct
  misc_feature 1..20: note = CRISPR gRNA sequence
  source 1..20: mol_type = other DNA
gttgagagcctatagatttt

SEQ ID NO: 90761 - DNA, 20 bp, synthetic construct
  misc_feature 1..20: note = CRISPR gRNA sequence
  source 1..20: mol_type = other DNA
tagattttgagactctttcg

SEQ ID NO: 90762 - DNA, 20 bp, synthetic construct
  misc_feature 1..20: note = CRISPR gRNA sequence
  source 1..20: mol_type = other DNA
gactctttcgaagattatta

SEQ ID NO: 90763 - DNA, 20 bp, synthetic construct
  misc_feature 1..20: note = CRISPR gRNA sequence
  source 1..20: mol_type = other DNA
tctttcgaagattattatag

SEQ ID NO: 90764 - DNA, 20 bp, synthetic construct
  misc_feature 1..20: note = CRISPR gRNA sequence
  source 1..20: mol_type = other DNA
ctttcgaagattattatagt

SEQ ID NO: 90765 - DNA, 20 bp, synthetic construct
  misc_feature 1..20: note = CRISPR gRNA sequence
  source 1..20: mol_type = other DNA
gattattatagtaggactga

SEQ ID NO: 90766 - DNA, 20 bp, synthetic construct
  misc_feature 1..20: note = CRISPR gRNA sequence
  source 1..20: mol_type = other DNA
attattatagtaggactgac

SEQ ID NO: 90767 - DNA, 20 bp, synthetic construct
  misc_feature 1..20: note = CRISPR gRNA sequence
  source 1..20: mol_type = other DNA
gtaggactgacaggtgatga

SEQ ID NO: 90768 - DNA, 20 bp, synthetic construct
  misc_feature 1..20: note = CRISPR gRNA sequence
  source 1..20: mol_type = other DNA
ggtgtcttctgctatgttgt

SEQ ID NO: 90769 - DNA, 20 bp, synthetic construct
  misc_feature 1..20: note = CRISPR gRNA sequence
  source 1..20: mol_type = other DNA
gtcttctgctatgttgtgag

SEQ ID NO: 90770 - DNA, 20 bp, synthetic construct
  misc_feature 1..20: note = CRISPR gRNA sequence
  source 1..20: mol_type = other DNA
tctgctatgttgtgagcagc

SEQ ID NO: 90771 - DNA, 20 bp, synthetic construct
  misc_feature 1..20: note = CRISPR gRNA sequence
  source 1..20: mol_type = other DNA
tatgttgtgagcagcaagat

SEQ ID NO: 90772 - DNA, 20 bp, synthetic construct
  misc_feature 1..20: note = CRISPR gRNA sequence
  source 1..20: mol_type = other DNA
gagcagcaagattagaaatt

SEQ ID NO: 90773 - DNA, 20 bp, synthetic construct
  misc_feature 1..20: note = CRISPR gRNA sequence
  source 1..20: mol_type = other DNA
ttaagttctctattccaatg

SEQ ID NO: 90774 - DNA, 20 bp, synthetic construct
  misc_feature 1..20: note = CRISPR gRNA sequence
  source 1..20: mol_type = other DNA
attccaatgaagaatttatt

SEQ ID NO: 90775 - DNA, 20 bp, synthetic construct
  misc_feature 1..20: note = CRISPR gRNA sequence
  source 1..20: mol_type = other DNA
ttccaatgaagaatttatta

SEQ ID NO: 90776 - DNA, 20 bp, synthetic construct
  misc_feature 1..20: note = CRISPR gRNA sequence
  source 1..20: mol_type = other DNA
ttattaaggtaaaaaaatta

SEQ ID NO: 90777 - DNA, 20 bp, synthetic construct
  misc_feature 1..20: note = CRISPR gRNA sequence
  source 1..20: mol_type = other DNA
gtaaaaaaattaaagaaatt

SEQ ID NO: 90778 - DNA, 20 bp, synthetic construct
  misc_feature 1..20: note = CRISPR gRNA sequence
  source 1..20: mol_type = other DNA
taaaaaaattaaagaaatta

SEQ ID NO: 90779 - DNA, 20 bp, synthetic construct
  misc_feature 1..20: note = CRISPR gRNA sequence
  source 1..20: mol_type = other DNA
aaaattaatatttcttacac

SEQ ID NO: 90780 - DNA, 20 bp, synthetic construct
  misc_feature 1..20: note = CRISPR gRNA sequence
  source 1..20: mol_type = other DNA
taatatttcttacacaagtc

SEQ ID NO: 90781 - DNA, 20 bp, synthetic construct
  misc_feature 1..20: note = CRISPR gRNA sequence
  source 1..20: mol_type = other DNA
aatatttcttacacaagtca

SEQ ID NO: 90782 - DNA, 20 bp, synthetic construct
  misc_feature 1..20: note = CRISPR gRNA sequence
  source 1..20: mol_type = other DNA
tacacaagtcaaggttaaat

SEQ ID NO: 90783 - DNA, 20 bp, synthetic construct
  misc_feature 1..20: note = CRISPR gRNA sequence
  source 1..20: mol_type = other DNA
acacaagtcaaggttaaatg

SEQ ID NO: 90784 - DNA, 20 bp, synthetic construct
  misc_feature 1..20: note = CRISPR gRNA sequence
  source 1..20: mol_type = other DNA
aatgtctactccaccaatct

SEQ ID NO: 90785 - DNA, 20 bp, synthetic construct
  misc_feature 1..20: note = CRISPR gRNA sequence
  source 1..20: mol_type = other DNA
atctaagaactatgctatat

SEQ ID NO: 90786 - DNA, 20 bp, synthetic construct
  misc_feature 1..20: note = CRISPR gRNA sequence
  source 1..20: mol_type = other DNA
ctaagaactatgctatatga

SEQ ID NO: 90787 - DNA, 20 bp, synthetic construct
  misc_feature 1..20: note = CRISPR gRNA sequence
  source 1..20: mol_type = other DNA
tgctatatgagagacacata

SEQ ID NO: 90788 - DNA, 20 bp, synthetic construct
  misc_feature 1..20: note = CRISPR gRNA sequence
  source 1..20: mol_type = other DNA
gctatatgagagacacataa

SEQ ID NO: 90789 - DNA, 20 bp, synthetic construct
  misc_feature 1..20: note = CRISPR gRNA sequence
  source 1..20: mol_type = other DNA
ctatatgagagacacataaa

SEQ ID NO: 90790 - DNA, 20 bp, synthetic construct
  misc_feature 1..20: note = CRISPR gRNA sequence
  source 1..20: mol_type = other DNA
tgagagacacataaagggac

SEQ ID NO: 90791 - DNA, 20 bp, synthetic construct
  misc_feature 1..20: note = CRISPR gRNA sequence
  source 1..20: mol_type = other DNA
gagagacacataaagggact

SEQ ID NO: 90792 - DNA, 20 bp, synthetic construct
  misc_feature 1..20: note = CRISPR gRNA sequence
  source 1..20: mol_type = other DNA
agagacacataaagggacta

SEQ ID NO: 90793 - DNA, 20 bp, synthetic construct
  misc_feature 1..20: note = CRISPR gRNA sequence
  source 1..20: mol_type = other DNA
ataaatgaattgacctctgc

SEQ ID NO: 90794 - DNA, 20 bp, synthetic construct
  misc_feature 1..20: note = CRISPR gRNA sequence
  source 1..20: mol_type = other DNA
aatgaattgacctctgctgg

SEQ ID NO: 90795 - DNA, 20 bp, synthetic construct
  misc_feature 1..20: note = CRISPR gRNA sequence
  source 1..20: mol_type = other DNA
atgaattgacctctgctggt

SEQ ID NO: 90796 - DNA, 20 bp, synthetic construct
  misc_feature 1..20: note = CRISPR gRNA sequence
  source 1..20: mol_type = other DNA
gttcttattaaatatctaaa

SEQ ID NO: 90797 - DNA, 20 bp, synthetic construct
  misc_feature 1..20: note = CRISPR gRNA sequence
  source 1..20: mol_type = other DNA
tatctaaaaagctatcattt

SEQ ID NO: 90798 - DNA, 20 bp, synthetic construct
  misc_feature 1..20: note = CRISPR gRNA sequence
  source 1..20: mol_type = other DNA
tctaaaaagctatcatttaa

SEQ ID NO: 90799 - DNA, 20 bp, synthetic construct
  misc_feature 1..20: note = CRISPR gRNA sequence
  source 1..20: mol_type = other DNA
aaaaagctatcatttaagag

SEQ ID NO: 90800 - DNA, 20 bp, synthetic construct
  misc_feature 1..20: note = CRISPR gRNA sequence
  source 1..20: mol_type = other DNA
aagctatcatttaagagaag

SEQ ID NO: 90801 - DNA, 20 bp, synthetic construct
  misc_feature 1..20: note = CRISPR gRNA sequence
  source 1..20: mol_type = other DNA
ctatcatttaagagaagcag

SEQ ID NO: 90802 - DNA, 20 bp, synthetic construct
  misc_feature 1..20: note = CRISPR gRNA sequence
  source 1..20: mol_type = other DNA
agagaagcagtagacttata

SEQ ID NO: 90803 - DNA, 20 bp, synthetic construct
  misc_feature 1..20: note = CRISPR gRNA sequence
  source 1..20: mol_type = other DNA
gacttatatggcatgattct

SEQ ID NO: 90804 - DNA, 20 bp, synthetic construct
  misc_feature 1..20: note = CRISPR gRNA sequence
  source 1..20: mol_type = other DNA
acttatatggcatgattctg

SEQ ID NO: 90805 - DNA, 20 bp, synthetic construct
  misc_feature 1..20: note = CRISPR gRNA sequence
  source 1..20: mol_type = other DNA
tggcatgattctgaggtaac

SEQ ID NO: 90806 - DNA, 20 bp, synthetic construct
  misc_feature 1..20: note = CRISPR gRNA sequence
  source 1..20: mol_type = other DNA
ggcatgattctgaggtaact

SEQ ID NO: 90807 - DNA, 20 bp, synthetic construct
  misc_feature 1..20: note = CRISPR gRNA sequence
  source 1..20: mol_type = other DNA
tctgaggtaactaggactct

SEQ ID NO: 90808 - DNA, 20 bp, synthetic construct
  misc_feature 1..20: note = CRISPR gRNA sequence
  source 1..20: mol_type = other DNA
ctgaggtaactaggactctt

SEQ ID NO: 90809 - DNA, 20 bp, synthetic construct
  misc_feature 1..20: note = CRISPR gRNA sequence
  source 1..20: mol_type = other DNA
gactcttaggcataaatcac

SEQ ID NO: 90810 - DNA, 20 bp, synthetic construct
  misc_feature 1..20: note = CRISPR gRNA sequence
  source 1..20: mol_type = other DNA
actcttaggcataaatcaca

SEQ ID NO: 90811 - DNA, 20 bp, synthetic construct
  misc_feature 1..20: note = CRISPR gRNA sequence
  source 1..20: mol_type = other DNA
tcttaggcataaatcacaag

SEQ ID NO: 90812 - DNA, 20 bp, synthetic construct
  misc_feature 1..20: note = CRISPR gRNA sequence
  source 1..20: mol_type = other DNA
atcacaaggagtatgtattt

SEQ ID NO: 90813 - DNA, 20 bp, synthetic construct
  misc_feature 1..20: note = CRISPR gRNA sequence
  source 1..20: mol_type = other DNA
aaggagtatgtatttcagct

SEQ ID NO: 90814 - DNA, 20 bp, synthetic construct
  misc_feature 1..20: note = CRISPR gRNA sequence
  source 1..20: mol_type = other DNA
tatgtatttcagctcagctt

SEQ ID NO: 90815 - DNA, 20 bp, synthetic construct
  misc_feature 1..20: note = CRISPR gRNA sequence
  source 1..20: mol_type = other DNA
atttcagctcagcttaagta

SEQ ID NO: 90816 - DNA, 20 bp, synthetic construct
  misc_feature 1..20: note = CRISPR gRNA sequence
  source 1..20: mol_type = other DNA
ctaacattctaccgaaatgt

SEQ ID NO: 90817 - DNA, 20 bp, synthetic construct
  misc_feature 1..20: note = CRISPR gRNA sequence
  source 1..20: mol_type = other DNA
aacattctaccgaaatgtta

SEQ ID NO: 90818 - DNA, 20 bp, synthetic construct
  misc_feature 1..20: note = CRISPR gRNA sequence
  source 1..20: mol_type = other DNA
attcaaaaccaaatgaaatg

SEQ ID NO: 90819 - DNA, 20 bp, synthetic construct
  misc_feature 1..20: note = CRISPR gRNA sequence
  source 1..20: mol_type = other DNA
aaccaaatgaaatgtggcaa

SEQ ID NO: 90820 - DNA, 20 bp, synthetic construct
  misc_feature 1..20: note = CRISPR gRNA sequence
  source 1..20: mol_type = other DNA
aaatgaaatgtggcaaaagt

SEQ ID NO: 90821 - DNA, 20 bp, synthetic construct
  misc_feature 1..20: note = CRISPR gRNA sequence
  source 1..20: mol_type = other DNA
gcaaaagttggtaaactctg

SEQ ID NO: 90822 - DNA, 20 bp, synthetic construct
  misc_feature 1..20: note = CRISPR gRNA sequence
  source 1..20: mol_type = other DNA
caaaagttggtaaactctgt

SEQ ID NO: 90823 - DNA, 20 bp, synthetic construct
  misc_feature 1..20: note = CRISPR gRNA sequence
  source 1..20: mol_type = other DNA
ggtaaactctgtaggacaaa

SEQ ID NO: 90824 - DNA, 20 bp, synthetic construct
  misc_feature 1..20: note = CRISPR gRNA sequence
  source 1..20: mol_type = other DNA
ctgtaggacaaaaagcattg

SEQ ID NO: 90825 - DNA, 20 bp, synthetic construct
  misc_feature 1..20: note = CRISPR gRNA sequence
  source 1..20: mol_type = other DNA
tgtaggacaaaaagcattgc

SEQ ID NO: 90826 - DNA, 20 bp, synthetic construct
  misc_feature 1..20: note = CRISPR gRNA sequence
  source 1..20: mol_type = other DNA
agcattgcaggtttttgaaa

SEQ ID NO: 90827 - DNA, 20 bp, synthetic construct
  misc_feature 1..20: note = CRISPR gRNA sequence
  source 1..20: mol_type = other DNA
aagaattccaacatctgtac

SEQ ID NO: 90828 - DNA, 20 bp, synthetic construct
  misc_feature 1..20: note = CRISPR gRNA sequence
  source 1..20: mol_type = other DNA
ttccaacatctgtacaagtt

SEQ ID NO: 90829 - DNA, 20 bp, synthetic construct
  misc_feature 1..20: note = CRISPR gRNA sequence
  source 1..20: mol_type = other DNA
acatctgtacaagtttggac

SEQ ID NO: 90830 - DNA, 20 bp, synthetic construct
  misc_feature 1..20: note = CRISPR gRNA sequence
  source 1..20: mol_type = other DNA
aagtttggactagatgacta

SEQ ID NO: 90831 - DNA, 20 bp, synthetic construct
  misc_feature 1..20: note = CRISPR gRNA sequence
  source 1..20: mol_type = other DNA
agtttggactagatgactaa

SEQ ID NO: 90832 - DNA, 20 bp, synthetic construct
  misc_feature 1..20: note = CRISPR gRNA sequence
  source 1..20: mol_type = other DNA
ctaaaggttattttcactac

SEQ ID NO: 90833 - DNA, 20 bp, synthetic construct
  misc_feature 1..20: note = CRISPR gRNA sequence
  source 1..20: mol_type = other DNA
acaagcttctttatctaatt

SEQ ID NO: 90834 - DNA, 20 bp, synthetic construct
  misc_feature 1..20: note = CRISPR gRNA sequence
  source 1..20: mol_type = other DNA
attaaccttttgaatttcca

SEQ ID NO: 90835 - DNA, 20 bp, synthetic construct
  misc_feature 1..20: note = CRISPR gRNA sequence
  source 1..20: mol_type = other DNA
aaccttttgaatttccatag

SEQ ID NO: 90836 - DNA, 20 bp, synthetic construct
  misc_feature 1..20: note = CRISPR gRNA sequence
  source 1..20: mol_type = other DNA
accttttgaatttccatagt

SEQ ID NO: 90837 - DNA, 20 bp, synthetic construct
  misc_feature 1..20: note = CRISPR gRNA sequence
  source 1..20: mol_type = other DNA
ccttttgaatttccatagtg

SEQ ID NO: 90838 - DNA, 20 bp, synthetic construct
  misc_feature 1..20: note = CRISPR gRNA sequence
  source 1..20: mol_type = other DNA
aatttccatagtggggttgt

SEQ ID NO: 90839 - DNA, 20 bp, synthetic construct
  misc_feature 1..20: note = CRISPR gRNA sequence
  source 1..20: mol_type = other DNA
atttccatagtggggttgtg

SEQ ID NO: 90840 - DNA, 20 bp, synthetic construct
  misc_feature 1..20: note = CRISPR gRNA sequence
  source 1..20: mol_type = other DNA
tttccatagtggggttgtga

SEQ ID NO: 90841 - DNA, 20 bp, synthetic construct
  misc_feature 1..20: note = CRISPR gRNA sequence
  source 1..20: mol_type = other DNA
ccatagtggggttgtgaggg

SEQ ID NO: 90842 - DNA, 20 bp, synthetic construct
  misc_feature 1..20: note = CRISPR gRNA sequence
  source 1..20: mol_type = other DNA
atagtggggttgtgagggca

SEQ ID NO: 90843 - DNA, 20 bp, synthetic construct
  misc_feature 1..20: note = CRISPR gRNA sequence
  source 1..20: mol_type = other DNA
tagtggggttgtgagggcag

SEQ ID NO: 90844 - DNA, 20 bp, synthetic construct
  misc_feature 1..20: note = CRISPR gRNA sequence
  source 1..20: mol_type = other DNA
agtggggttgtgagggcaga

SEQ ID NO: 90845 - DNA, 20 bp, synthetic construct
  misc_feature 1..20: note = CRISPR gRNA sequence
  source 1..20: mol_type = other DNA
gcagagggtactgtaccatc

SEQ ID NO: 90846 - DNA, 20 bp, synthetic construct
  misc_feature 1..20: note = CRISPR gRNA sequence
  source 1..20: mol_type = other DNA
ctgtaccatcaagtcaattt

SEQ ID NO: 90847 - DNA, 20 bp, synthetic construct
  misc_feature 1..20: note = CRISPR gRNA sequence
  source 1..20: mol_type = other DNA
tatcttgcacataaaaatga

SEQ ID NO: 90848 - DNA, 20 bp, synthetic construct
  misc_feature 1..20: note = CRISPR gRNA sequence
  source 1..20: mol_type = other DNA
tctcataaataaaatcaact

SEQ ID NO: 90849 - DNA, 20 bp, synthetic construct
  misc_feature 1..20: note = CRISPR gRNA sequence
  source 1..20: mol_type = other DNA
ctcataaataaaatcaactt

SEQ ID NO: 90850 - DNA, 20 bp, synthetic construct
  misc_feature 1..20: note = CRISPR gRNA sequence
  source 1..20: mol_type = other DNA
tcataaataaaatcaacttg

SEQ ID NO: 90851 - DNA, 20 bp, synthetic construct
  misc_feature 1..20: note = CRISPR gRNA sequence
  source 1..20: mol_type = other DNA
cataaataaaatcaacttgg

SEQ ID NO: 90852 - DNA, 20 bp, synthetic construct
  misc_feature 1..20: note = CRISPR gRNA sequence
  source 1..20: mol_type = other DNA
aaaatcaacttgggggttgc

SEQ ID NO: 90853 - DNA, 20 bp, synthetic construct
  misc_feature 1..20: note = CRISPR gRNA sequence
  source 1..20: mol_type = other DNA
aatcaacttgggggttgctg

SEQ ID NO: 90854 - DNA, 20 bp, synthetic construct
  misc_feature 1..20: note = CRISPR gRNA sequence
  source 1..20: mol_type = other DNA
atcaacttgggggttgctgg

SEQ ID NO: 90855 - DNA, 20 bp, synthetic construct
  misc_feature 1..20: note = CRISPR gRNA sequence
  source 1..20: mol_type = other DNA
caacttgggggttgctggag

SEQ ID NO: 90856 - DNA, 20 bp, synthetic construct
  misc_feature 1..20: note = CRISPR gRNA sequence
  source 1..20: mol_type = other DNA
aacttgggggttgctggagg

SEQ ID NO: 90857 - DNA, 20 bp, synthetic construct
  misc_feature 1..20: note = CRISPR gRNA sequence
  source 1..20: mol_type = other DNA
ttgggggttgctggaggagg

SEQ ID NO: 90858 - DNA, 20 bp, synthetic construct
  misc_feature 1..20: note = CRISPR gRNA sequence
  source 1..20: mol_type = other DNA
gaaattatttttgtttcctc

SEQ ID NO: 90859 - DNA, 20 bp, synthetic construct
  misc_feature 1..20: note = CRISPR gRNA sequence
  source 1..20: mol_type = other DNA
aaattatttttgtttcctct

SEQ ID NO: 90860 - DNA, 20 bp, synthetic construct
  misc_feature 1..20: note = CRISPR gRNA sequence
  source 1..20: mol_type = other DNA
tttttgtttcctctgggtat

SEQ ID NO: 90861 - DNA, 20 bp, synthetic construct
  misc_feature 1..20: note = CRISPR gRNA sequence
  source 1..20: mol_type = other DNA
gtattagaattttcttttta

SEQ ID NO: 90862 - DNA, 20 bp, synthetic construct
  misc_feature 1..20: note = CRISPR gRNA sequence
  source 1..20: mol_type = other DNA
ttttacagtttttatatgtt

SEQ ID NO: 90863 - DNA, 20 bp, synthetic construct
  misc_feature 1..20: note = CRISPR gRNA sequence
  source 1..20: mol_type = other DNA
tttacagtttttatatgttg

SEQ ID NO: 90864 - DNA, 20 bp, synthetic construct
  misc_feature 1..20: note = CRISPR gRNA sequence
  source 1..20: mol_type = other DNA
atgttgaggcctaaaatgtt

SEQ ID NO: 90865 - DNA, 20 bp, synthetic construct
  misc_feature 1..20: note = CRISPR gRNA sequence
  source 1..20: mol_type = other DNA
tgttgaggcctaaaatgttt

SEQ ID NO: 90866 - DNA, 20 bp, synthetic construct
  misc_feature 1..20: note = CRISPR gRNA sequence
  source 1..20: mol_type = other DNA
gttgaggcctaaaatgttta

SEQ ID NO: 90867 - DNA, 20 bp, synthetic construct
  misc_feature 1..20: note = CRISPR gRNA sequence
  source 1..20: mol_type = other DNA
ttgaggcctaaaatgtttag

SEQ ID NO: 90868 - DNA, 20 bp, synthetic construct
  misc_feature 1..20: note = CRISPR gRNA sequence
  source 1..20: mol_type = other DNA
gtgaaatatttttgtaatat

SEQ ID NO: 90869 - DNA, 20 bp, synthetic construct
  misc_feature 1..20: note = CRISPR gRNA sequence
  source 1..20: mol_type = other DNA
tgaaatatttttgtaatatc

SEQ ID NO: 90870 - DNA, 20 bp, synthetic construct
  misc_feature 1..20: note = CRISPR gRNA sequence
  source 1..20: mol_type = other DNA
atatttttgtaatatcaggt

SEQ ID NO: 90871 - DNA, 20 bp, synthetic construct
  misc_feature 1..20: note = CRISPR gRNA sequence
  source 1..20: mol_type = other DNA
tggtaaacttctcataatga

SEQ ID NO: 90872 - DNA, 20 bp, synthetic construct
  misc_feature 1..20: note = CRISPR gRNA sequence
  source 1..20: mol_type = other DNA
ttctcataatgaaagaaatt

SEQ ID NO: 90873 - DNA, 20 bp, synthetic construct
  misc_feature 1..20: note = CRISPR gRNA sequence
  source 1..20: mol_type = other DNA
tctcataatgaaagaaatta

SEQ ID NO: 90874 - DNA, 20 bp, synthetic construct
  misc_feature 1..20: note = CRISPR gRNA sequence
  source 1..20: mol_type = other DNA
ctcataatgaaagaaattaa

SEQ ID NO: 90875 - DNA, 20 bp, synthetic construct
  misc_feature 1..20: note = CRISPR gRNA sequence
  source 1..20: mol_type = other DNA
tcataatgaaagaaattaag

SEQ ID NO: 90876 - DNA, 20 bp, synthetic construct
  misc_feature 1..20: note = CRISPR gRNA sequence
  source 1..20: mol_type = other DNA
aaattaaggggatattctca

SEQ ID NO: 90877 - DNA, 20 bp, synthetic construct
  misc_feature 1..20: note = CRISPR gRNA sequence
  source 1..20: mol_type = other DNA
ggatattctcatagataact

SEQ ID NO: 90878 - DNA, 20 bp, synthetic construct
  misc_feature 1..20: note = CRISPR gRNA sequence
  source 1..20: mol_type = other DNA
atattctcatagataactca

SEQ ID NO: 90879 - DNA, 20 bp, synthetic construct
  misc_feature 1..20: note = CRISPR gRNA sequence
  source 1..20: mol_type = other DNA
tattctcatagataactcag

SEQ ID NO: 90880 - DNA, 20 bp, synthetic construct
  misc_feature 1..20: note = CRISPR gRNA sequence
  source 1..20: mol_type = other DNA
ctcatagataactcagaggc

SEQ ID NO: 90881 - DNA, 20 bp, synthetic construct
  misc_feature 1..20: note = CRISPR gRNA sequence
  source 1..20: mol_type = other DNA
atagataactcagaggccag

SEQ ID NO: 90882 - DNA, 20 bp, synthetic construct
  misc_feature 1..20: note = CRISPR gRNA sequence
  source 1..20: mol_type = other DNA
ataactcagaggccagtaga

SEQ ID NO: 90883 - DNA, 20 bp, synthetic construct
  misc_feature 1..20: note = CRISPR gRNA sequence
  source 1..20: mol_type = other DNA
actcagaggccagtagaaag

SEQ ID NO: 90884 - DNA, 20 bp, synthetic construct
  misc_feature 1..20: note = CRISPR gRNA sequence
  source 1..20: mol_type = other DNA
aggccagtagaaagaagccc

SEQ ID NO: 90885 - DNA, 20 bp, synthetic construct
  misc_feature 1..20: note = CRISPR gRNA sequence
  source 1..20: mol_type = other DNA
gccagtagaaagaagcccaa

SEQ ID NO: 90886 - DNA, 20 bp, synthetic construct
  misc_feature 1..20: note = CRISPR gRNA sequence
  source 1..20: mol_type = other DNA
aagaagcccaagagaaaaaa

SEQ ID NO: 90887 - DNA, 20 bp, synthetic construct
  misc_feature 1..20: note = CRISPR gRNA sequence
  source 1..20: mol_type = other DNA
gcccaagagaaaaaacagca

SEQ ID NO: 90888 - DNA, 20 bp, synthetic construct
  misc_feature 1..20: note = CRISPR gRNA sequence
  source 1..20: mol_type = other DNA
aacagcatagataatattct

SEQ ID NO: 90889 - DNA, 20 bp, synthetic construct
  misc_feature 1..20: note = CRISPR gRNA sequence
  source 1..20: mol_type = other DNA
catagataatattctaagta

SEQ ID NO: 90890 - DNA, 20 bp, synthetic construct
  misc_feature 1..20: note = CRISPR gRNA sequence
  source 1..20: mol_type = other DNA
aatattctaagtaaagaaca

SEQ ID NO: 90891 - DNA, 20 bp, synthetic construct
  misc_feature 1..20: note = CRISPR gRNA sequence
  source 1..20: mol_type = other DNA
tattctaagtaaagaacaaa

SEQ ID NO: 90892 - DNA, 20 bp, synthetic construct
  misc_feature 1..20: note = CRISPR gRNA sequence
  source 1..20: mol_type = other DNA
attctaagtaaagaacaaag

SEQ ID NO: 90893 - DNA, 20 bp, synthetic construct
  misc_feature 1..20: note = CRISPR gRNA sequence
  source 1..20: mol_type = other DNA
caaagaggttaaattcatgt

SEQ ID NO: 90894 - DNA, 20 bp, synthetic construct
  misc_feature 1..20: note = CRISPR gRNA sequence
  source 1..20: mol_type = other DNA
aaagaggttaaattcatgta

SEQ ID NO: 90895 - DNA, 20 bp, synthetic construct
  misc_feature 1..20: note = CRISPR gRNA sequence
  source 1..20: mol_type = other DNA
ggttaaattcatgtaaggta

SEQ ID NO: 90896 - DNA, 20 bp, synthetic construct
  misc_feature 1..20: note = CRISPR gRNA sequence
  source 1..20: mol_type = other DNA
tcatgtaaggtatggctttc

SEQ ID NO: 90897 - DNA, 20 bp, synthetic construct
  misc_feature 1..20: note = CRISPR gRNA sequence
  source 1..20: mol_type = other DNA
taattttatatttgctactt

SEQ ID NO: 90898 - DNA, 20 bp, synthetic construct
  misc_feature 1..20: note = CRISPR gRNA sequence
  source 1..20: mol_type = other DNA
tttatatttgctactttagt

SEQ ID NO: 90899 - DNA, 20 bp, synthetic construct
  misc_feature 1..20: note = CRISPR gRNA sequence
  source 1..20: mol_type = other DNA
tgctactttagtaagaattt

SEQ ID NO: 90900 - DNA, 20 bp, synthetic construct
  misc_feature 1..20: note = CRISPR gRNA sequence
  source 1..20: mol_type = other DNA
tttagtaagaattttggatg

SEQ ID NO: 90901 - DNA, 20 bp, synthetic construct
  misc_feature 1..20: note = CRISPR gRNA sequence
  source 1..20: mol_type = other DNA
gaattttggatgtggtattg

SEQ ID NO: 90902 - DNA, 20 bp, synthetic construct
  misc_feature 1..20: note = CRISPR gRNA sequence
  source 1..20: mol_type = other DNA
ttggatgtggtattgtggca

SEQ ID NO: 90903 - DNA, 20 bp, synthetic construct
  misc_feature 1..20: note = CRISPR gRNA sequence
  source 1..20: mol_type = other DNA
gtattgtggcatagttttgt

SEQ ID NO: 90904 - DNA, 20 bp, synthetic construct
  misc_feature 1..20: note = CRISPR gRNA sequence
  source 1..20: mol_type = other DNA
attgtggcatagttttgtaa

SEQ ID NO: 90905 - DNA, 20 bp, synthetic construct
  misc_feature 1..20: note = CRISPR gRNA sequence
  source 1..20: mol_type = other DNA
tggcatagttttgtaagagt

SEQ ID NO: 90906 - DNA, 20 bp, synthetic construct
  misc_feature 1..20: note = CRISPR gRNA sequence
  source 1..20: mol_type = other DNA
ttgtaagagtcagaatattt

SEQ ID NO: 90907 - DNA, 20 bp, synthetic construct
  misc_feature 1..20: note = CRISPR gRNA sequence
  source 1..20: mol_type = other DNA
taaacaatattttgttatgc

SEQ ID NO: 90908 - DNA, 20 bp, synthetic construct
  misc_feature 1..20: note = CRISPR gRNA sequence
  source 1..20: mol_type = other DNA
tgttatgccagcaaaattac

SEQ ID NO: 90909 - DNA, 20 bp, synthetic construct
  misc_feature 1..20: note = CRISPR gRNA sequence
  source 1..20: mol_type = other DNA
cagcaaaattacaagtattt

SEQ ID NO: 90910 - DNA, 20 bp, synthetic construct
  misc_feature 1..20: note = CRISPR gRNA sequence
  source 1..20: mol_type = other DNA
acaagtatttaagatgctgt

SEQ ID NO: 90911 - DNA, 20 bp, synthetic construct
  misc_feature 1..20: note = CRISPR gRNA sequence
  source 1..20: mol_type = other DNA
caagtatttaagatgctgtc

SEQ ID NO: 90912 - DNA, 20 bp, synthetic construct
  misc_feature 1..20: note = CRISPR gRNA sequence
  source 1..20: mol_type = other DNA
ttaagatgctgtcaggtaac

SEQ ID NO: 90913 - DNA, 20 bp, synthetic construct
  misc_feature 1..20: note = CRISPR gRNA sequence
  source 1..20: mol_type = other DNA
taagatgctgtcaggtaact

SEQ ID NO: 90914 - DNA, 20 bp, synthetic construct
  misc_feature 1..20: note = CRISPR gRNA sequence
  source 1..20: mol_type = other DNA
aagatgctgtcaggtaactg

SEQ ID NO: 90915 - DNA, 20 bp, synthetic construct
  misc_feature 1..20: note = CRISPR gRNA sequence
  source 1..20: mol_type = other DNA
agatgctgtcaggtaactgg

SEQ ID NO: 90916 - DNA, 20 bp, synthetic construct
  misc_feature 1..20: note = CRISPR gRNA sequence
  source 1..20: mol_type = other DNA
ggtaactgggggtacatatt

SEQ ID NO: 90917 - DNA, 20 bp, synthetic construct
  misc_feature 1..20: note = CRISPR gRNA sequence
  source 1..20: mol_type = other DNA
gggggtacatatttggtaat

SEQ ID NO: 90918 - DNA, 20 bp, synthetic construct
  misc_feature 1..20: note = CRISPR gRNA sequence
  source 1..20: mol_type = other DNA
agtgctgctgattttgtttt

SEQ ID NO: 90919 - DNA, 20 bp, synthetic construct
  misc_feature 1..20: note = CRISPR gRNA sequence
  source 1..20: mol_type = other DNA
gtgctgctgattttgttttt

SEQ ID NO: 90920 - DNA, 20 bp, synthetic construct
  misc_feature 1..20: note = CRISPR gRNA sequence
  source 1..20: mol_type = other DNA
ctgctgattttgtttttggg

SEQ ID NO: 90921 - DNA, 20 bp, synthetic construct
  misc_feature 1..20: note = CRISPR gRNA sequence
  source 1..20: mol_type = other DNA
gtttttgggcagtgaaatct

SEQ ID NO: 90922 - DNA, 20 bp, synthetic construct
  misc_feature 1..20: note = CRISPR gRNA sequence
  source 1..20: mol_type = other DNA
tttttgggcagtgaaatctc

SEQ ID NO: 90923 - DNA, 20 bp, synthetic construct
  misc_feature 1..20: note = CRISPR gRNA sequence
  source 1..20: mol_type = other DNA
ttttgggcagtgaaatctca

SEQ ID NO: 90924 - DNA, 20 bp, synthetic construct
  misc_feature 1..20: note = CRISPR gRNA sequence
  source 1..20: mol_type = other DNA
gcagtgaaatctcagggtaa

SEQ ID NO: 90925 - DNA, 20 bp, synthetic construct
  misc_feature 1..20: note = CRISPR gRNA sequence
  source 1..20: mol_type = other DNA
tcagggtaatggtatcattt

SEQ ID NO: 90926 - DNA, 20 bp, synthetic construct
  misc_feature 1..20: note = CRISPR gRNA sequence
  source 1..20: mol_type = other DNA
cagggtaatggtatcatttt

SEQ ID NO: 90927 - DNA, 20 bp, synthetic construct
  misc_feature 1..20: note = CRISPR gRNA sequence
  source 1..20: mol_type = other DNA
acttacctgttttgttcata

SEQ ID NO: 90928 - DNA, 20 bp, synthetic construct
  misc_feature 1..20: note = CRISPR gRNA sequence
  source 1..20: mol_type = other DNA
acctgttttgttcatacagt

SEQ ID NO: 90929 - DNA, 20 bp, synthetic construct
  misc_feature 1..20: note = CRISPR gRNA sequence
  source 1..20: mol_type = other DNA
tgttttgttcatacagttgg

SEQ ID NO: 90930 - DNA, 20 bp, synthetic construct
  misc_feature 1..20: note = CRISPR gRNA sequence
  source 1..20: mol_type = other DNA
gttttgttcatacagttggc

SEQ ID NO: 90931 - DNA, 20 bp, synthetic construct
  misc_feature 1..20: note = CRISPR gRNA sequence
  source 1..20: mol_type = other DNA
tttgttcatacagttggcag

SEQ ID NO: 90932 - DNA, 20 bp, synthetic construct
  misc_feature 1..20: note = CRISPR gRNA sequence
  source 1..20: mol_type = other DNA
tggcaggagactatttatac

SEQ ID NO: 90933 - DNA, 20 bp, synthetic construct
  misc_feature 1..20: note = CRISPR gRNA sequence
  source 1..20: mol_type = other DNA
atttatactagtgctttttc

SEQ ID NO: 90934 - DNA, 20 bp, synthetic construct
  misc_feature 1..20: note = CRISPR gRNA sequence
  source 1..20: mol_type = other DNA
atactagtgctttttcaagc

SEQ ID NO: 90935 - DNA, 20 bp, synthetic construct
  misc_feature 1..20: note = CRISPR gRNA sequence
  source 1..20: mol_type = other DNA
caagtttatctaaattttga

SEQ ID NO: 90936 - DNA, 20 bp, synthetic construct
  misc_feature 1..20: note = CRISPR gRNA sequence
  source 1..20: mol_type = other DNA
tatctaaattttgaaagctt

SEQ ID NO: 90937 - DNA, 20 bp, synthetic construct
  misc_feature 1..20: note = CRISPR gRNA sequence
  source 1..20: mol_type = other DNA
attttgaaagctttggttat

SEQ ID NO: 90938 - DNA, 20 bp, synthetic construct
  misc_feature 1..20: note = CRISPR gRNA sequence
  source 1..20: mol_type = other DNA
tactactcccccatttgttt

SEQ ID NO: 90939 - DNA, 20 bp, synthetic construct
  misc_feature 1..20: note = CRISPR gRNA sequence
  source 1..20: mol_type = other DNA
catttgttttggttgccaac

SEQ ID NO: 90940 - DNA, 20 bp, synthetic construct
  misc_feature 1..20: note = CRISPR gRNA sequence
  source 1..20: mol_type = other DNA
atttgttttggttgccaact

SEQ ID NO: 90941 - DNA, 20 bp, synthetic construct
  misc_feature 1..20: note = CRISPR gRNA sequence
  source 1..20: mol_type = other DNA
ttggttgccaactgggtaaa

SEQ ID NO: 90942 - DNA, 20 bp, synthetic construct
  misc_feature 1..20: note = CRISPR gRNA sequence
  source 1..20: mol_type = other DNA
ccaactgggtaaaaagctat

SEQ ID NO: 90943 - DNA, 20 bp, synthetic construct
  misc_feature 1..20: note = CRISPR gRNA sequence
  source 1..20: mol_type = other DNA
aagctatcagatatcttatt

SEQ ID NO: 90944 - DNA, 20 bp, synthetic construct
  misc_feature 1..20: note = CRISPR gRNA sequence
  source 1..20: mol_type = other DNA
ctatcagatatcttattgag

SEQ ID NO: 90945 - DNA, 20 bp, synthetic construct
  misc_feature 1..20: note = CRISPR gRNA sequence
  source 1..20: mol_type = other DNA
gcagtatataatttgcctct

SEQ ID NO: 90946 - DNA, 20 bp, synthetic construct
  misc_feature 1..20: note = CRISPR gRNA sequence
  source 1..20: mol_type = other DNA
gagttcatatatttcatcca

SEQ ID NO: 90947 - DNA, 20 bp, synthetic construct
  misc_feature 1..20: note = CRISPR gRNA sequence
  source 1..20: mol_type = other DNA
agttcatatatttcatccaa

SEQ ID NO: 90948 - DNA, 20 bp, synthetic construct
  misc_feature 1..20: note = CRISPR gRNA sequence
  source 1..20: mol_type = other DNA
catatatttcatccaaaggc

SEQ ID NO: 90949 - DNA, 20 bp, synthetic construct
  misc_feature 1..20: note = CRISPR gRNA sequence
  source 1..20: mol_type = other DNA
atatttcatccaaaggcaag

SEQ ID NO: 90950 - DNA, 20 bp, synthetic construct
  misc_feature 1..20: note = CRISPR gRNA sequence
  source 1..20: mol_type = other DNA
aaggcaagcagattatgttt

SEQ ID NO: 90951 - DNA, 20 bp, synthetic construct
  misc_feature 1..20: note = CRISPR gRNA sequence
  source 1..20: mol_type = other DNA
aagcagattatgtttcggcc

SEQ ID NO: 90952 - DNA, 20 bp, synthetic construct
  misc_feature 1..20: note = CRISPR gRNA sequence
  source 1..20: mol_type = other DNA
agattatgtttcggcctgga

SEQ ID NO: 90953 - DNA, 20 bp, synthetic construct
  misc_feature 1..20: note = CRISPR gRNA sequence
  source 1..20: mol_type = other DNA
ggcctggatagcattatata

SEQ ID NO: 90954 - DNA, 20 bp, synthetic construct
  misc_feature 1..20: note = CRISPR gRNA sequence
  source 1..20: mol_type = other DNA
cctggatagcattatataaa

SEQ ID NO: 90955 - DNA, 20 bp, synthetic construct
  misc_feature 1..20: note = CRISPR gRNA sequence
  source 1..20: mol_type = other DNA
atagcattatataaagagaa

SEQ ID NO: 90956 - DNA, 20 bp, synthetic construct
  misc_feature 1..20: note = CRISPR gRNA sequence
  source 1..20: mol_type = other DNA
agagaatggtcaattccact

SEQ ID NO: 90957 - DNA, 20 bp, synthetic construct
  misc_feature 1..20: note = CRISPR gRNA sequence
  source 1..20: mol_type = other DNA
attttttgtaatattgaaaa

SEQ ID NO: 90958 - DNA, 20 bp, synthetic construct
  misc_feature 1..20: note = CRISPR gRNA sequence
  source 1..20: mol_type = other DNA
taatattgaaaatagctcac

SEQ ID NO: 90959 - DNA, 20 bp, synthetic construct
  misc_feature 1..20: note = CRISPR gRNA sequence
  source 1..20: mol_type = other DNA
aagtaactctgcctcaatct

SEQ ID NO: 90960 - DNA, 20 bp, synthetic construct
  misc_feature 1..20: note = CRISPR gRNA sequence
  source 1..20: mol_type = other DNA
taactctgcctcaatcttag

SEQ ID NO: 90961 - DNA, 20 bp, synthetic construct
  misc_feature 1..20: note = CRISPR gRNA sequence
  source 1..20: mol_type = other DNA
tcttagtggcccacctctca

SEQ ID NO: 90962 - DNA, 20 bp, synthetic construct
  misc_feature 1..20: note = CRISPR gRNA sequence
  source 1..20: mol_type = other DNA
tcacacacactattaatttt

SEQ ID NO: 90963 - DNA, 20 bp, synthetic construct
  misc_feature 1..20: note = CRISPR gRNA sequence
  source 1..20: mol_type = other DNA
tattaattttgagacctgcc

SEQ ID NO: 90964 - DNA, 20 bp, synthetic construct
  misc_feature 1..20: note = CRISPR gRNA sequence
  source 1..20: mol_type = other DNA
ttaattttgagacctgccaa

SEQ ID NO: 90965 - DNA, 20 bp, synthetic construct
  misc_feature 1..20: note = CRISPR gRNA sequence
  source 1..20: mol_type = other DNA
tgagacctgccaagagacta

SEQ ID NO: 90966 - DNA, 20 bp, synthetic construct
  misc_feature 1..20: note = CRISPR gRNA sequence
  source 1..20: mol_type = other DNA
tgccaagagactaaagaacc

SEQ ID NO: 90967 - DNA, 20 bp, synthetic construct
  misc_feature 1..20: note = CRISPR gRNA sequence
  source 1..20: mol_type = other DNA
gccaagagactaaagaaccc

SEQ ID NO: 90968 - DNA, 20 bp, synthetic construct
  misc_feature 1..20: note = CRISPR gRNA sequence
  source 1..20: mol_type = other DNA
aagaacccaggttgaaaatc

SEQ ID NO: 90969 - DNA, 20 bp, synthetic construct
  misc_feature 1..20: note = CRISPR gRNA sequence
  source 1..20: mol_type = other DNA
agaacccaggttgaaaatct

SEQ ID NO: 90970 - DNA, 20 bp, synthetic construct
  misc_feature 1..20: note = CRISPR gRNA sequence
  source 1..20: mol_type = other DNA
gaacccaggttgaaaatctg

SEQ ID NO: 90971 - DNA, 20 bp, synthetic construct
  misc_feature 1..20: note = CRISPR gRNA sequence
  source 1..20: mol_type = other DNA
aacccaggttgaaaatctgg

SEQ ID NO: 90972 - DNA, 20 bp, synthetic construct
  misc_feature 1..20: note = CRISPR gRNA sequence
  source 1..20: mol_type = other DNA
acccaggttgaaaatctggg

SEQ ID NO: 90973 - DNA, 20 bp, synthetic construct
  misc_feature 1..20: note = CRISPR gRNA sequence
  source 1..20: mol_type = other DNA
ccaggttgaaaatctggggg

SEQ ID NO: 90974 - DNA, 20 bp, synthetic construct
  misc_feature 1..20: note = CRISPR gRNA sequence
  source 1..20: mol_type = other DNA
aggttgaaaatctgggggga

SEQ ID NO: 90975 - DNA, 20 bp, synthetic construct
  misc_feature 1..20: note = CRISPR gRNA sequence
  source 1..20: mol_type = other DNA
ggttgaaaatctggggggag

SEQ ID NO: 90976 - DNA, 20 bp, synthetic construct
  misc_feature 1..20: note = CRISPR gRNA sequence
  source 1..20: mol_type = other DNA
gttgaaaatctggggggaga

SEQ ID NO: 90977 - DNA, 20 bp, synthetic construct
  misc_feature 1..20: note = CRISPR gRNA sequence
  source 1..20: mol_type = other DNA
tgaaaatctggggggagagg

SEQ ID NO: 90978 - DNA, 20 bp, synthetic construct
  misc_feature 1..20: note = CRISPR gRNA sequence
  source 1..20: mol_type = other DNA
aatctggggggagagggagc

SEQ ID NO: 90979 - DNA, 20 bp, synthetic construct
  misc_feature 1..20: note = CRISPR gRNA sequence
  source 1..20: mol_type = other DNA
atctggggggagagggagcg

SEQ ID NO: 90980 - DNA, 20 bp, synthetic construct
  misc_feature 1..20: note = CRISPR gRNA sequence
  source 1..20: mol_type = other DNA
ctggggggagagggagcgag

SEQ ID NO: 90981 - DNA, 20 bp, synthetic construct
  misc_feature 1..20: note = CRISPR gRNA sequence
  source 1..20: mol_type = other DNA
tggggggagagggagcgagg

SEQ ID NO: 90982 - DNA, 20 bp, synthetic construct
  misc_feature 1..20: note = CRISPR gRNA sequence
  source 1..20: mol_type = other DNA
atactttgcctatgataatg

SEQ ID NO: 90983 - DNA, 20 bp, synthetic construct
  misc_feature 1..20: note = CRISPR gRNA sequence
  source 1..20: mol_type = other DNA
atgataatgaagaactttcc

SEQ ID NO: 90984 - DNA, 20 bp, synthetic construct
  misc_feature 1..20: note = CRISPR gRNA sequence
  source 1..20: mol_type = other DNA
gataatgaagaactttccca

SEQ ID NO: 90985 - DNA, 20 bp, synthetic construct
  misc_feature 1..20: note = CRISPR gRNA sequence
  source 1..20: mol_type = other DNA
agaactttcccagagttgcc

SEQ ID NO: 90986 - DNA, 20 bp, synthetic construct
  misc_feature 1..20: note = CRISPR gRNA sequence
  source 1..20: mol_type = other DNA
aactttcccagagttgccca

SEQ ID NO: 90987 - DNA, 20 bp, synthetic construct
  misc_feature 1..20: note = CRISPR gRNA sequence
  source 1..20: mol_type = other DNA
tcccagagttgcccagagac

SEQ ID NO: 90988 - DNA, 20 bp, synthetic construct
  misc_feature 1..20: note = CRISPR gRNA sequence
  source 1..20: mol_type = other DNA
cccagagttgcccagagact

SEQ ID NO: 90989 - DNA, 20 bp, synthetic construct
  misc_feature 1..20: note = CRISPR gRNA sequence
  source 1..20: mol_type = other DNA
gagttgcccagagactgggc

SEQ ID NO: 90990 - DNA, 20 bp, synthetic construct
  misc_feature 1..20: note = CRISPR gRNA sequence
  source 1..20: mol_type = other DNA
ttgcccagagactgggcaag

SEQ ID NO: 90991 - DNA, 20 bp, synthetic construct
  misc_feature 1..20: note = CRISPR gRNA sequence
  source 1..20: mol_type = other DNA
cccagagactgggcaagaag

SEQ ID NO: 90992 - DNA, 20 bp, synthetic construct
  misc_feature 1..20: note = CRISPR gRNA sequence
  source 1..20: mol_type = other DNA
ccagagactgggcaagaaga

SEQ ID NO: 90993 - DNA, 20 bp, synthetic construct
  misc_feature 1..20: note = CRISPR gRNA sequence
  source 1..20: mol_type = other DNA
gagactgggcaagaagaagg

SEQ ID NO: 90994 - DNA, 20 bp, synthetic construct
  misc_feature 1..20: note = CRISPR gRNA sequence
  source 1..20: mol_type = other DNA
aagaagaaggaagaaatgca

SEQ ID NO: 90995 - DNA, 20 bp, synthetic construct
  misc_feature 1..20: note = CRISPR gRNA sequence
  source 1..20: mol_type = other DNA
tgcatttttatcatttatcc

SEQ ID NO: 90996 - DNA, 20 bp, synthetic construct
  misc_feature 1..20: note = CRISPR gRNA sequence
  source 1..20: mol_type = other DNA
gcatttttatcatttatccc

SEQ ID NO: 90997 - DNA, 20 bp, synthetic construct
  misc_feature 1..20: note = CRISPR gRNA sequence
  source 1..20: mol_type = other DNA
ttttatcatttatcccagga

SEQ ID NO: 90998 - DNA, 20 bp, synthetic construct
  misc_feature 1..20: note = CRISPR gRNA sequence
  source 1..20: mol_type = other DNA
tcatttatcccaggaaagtg

SEQ ID NO: 90999 - DNA, 20 bp, synthetic construct
  misc_feature 1..20: note = CRISPR gRNA sequence
  source 1..20: mol_type = other DNA
atactctccattgttaaaca

SEQ ID NO: 91000 - DNA, 20 bp, synthetic construct
  misc_feature 1..20: note = CRISPR gRNA sequence
  source 1..20: mol_type = other DNA
ctccattgttaaacaaagaa

SEQ ID NO: 91001 - DNA, 20 bp, synthetic construct
  misc_feature 1..20: note = CRISPR gRNA sequence
  source 1..20: mol_type = other DNA
tccattgttaaacaaagaac

SEQ ID NO: 91002 - DNA, 20 bp, synthetic construct
  misc_feature 1..20: note = CRISPR gRNA sequence
  source 1..20: mol_type = other DNA
aaacaaagaacaggatcttt

SEQ ID NO: 91003 - DNA, 20 bp, synthetic construct
  misc_feature 1..20: note = CRISPR gRNA sequence
  source 1..20: mol_type = other DNA
aacaaagaacaggatctttt

SEQ ID NO: 91004 - DNA, 20 bp, synthetic construct
  misc_feature 1..20: note = CRISPR gRNA sequence
  source 1..20: mol_type = other DNA
acaaagaacaggatcttttg

SEQ ID NO: 91005 - DNA, 20 bp, synthetic construct
  misc_feature 1..20: note = CRISPR gRNA sequence
  source 1..20: mol_type = other DNA
tcttttggggatcgtcctgc

SEQ ID NO: 91006 - DNA, 20 bp, synthetic construct
  misc_feature 1..20: note = CRISPR gRNA sequence
  source 1..20: mol_type = other DNA
tcctgcaagacctactcttt

SEQ ID NO: 91007 - DNA, 20 bp, synthetic construct
  misc_feature 1..20: note = CRISPR gRNA sequence
  source 1..20: mol_type = other DNA
aagacctactcttttagaac

SEQ ID NO: 91008 - DNA, 20 bp, synthetic construct
  misc_feature 1..20: note = CRISPR gRNA sequence
  source 1..20: mol_type = other DNA
gaacaagtgttaaatcaaaa

SEQ ID NO: 91009 - DNA, 20 bp, synthetic construct
  misc_feature 1..20: note = CRISPR gRNA sequence
  source 1..20: mol_type = other DNA
agtgttaaatcaaaaaagac

SEQ ID NO: 91010 - DNA, 20 bp, synthetic construct
  misc_feature 1..20: note = CRISPR gRNA sequence
  source 1..20: mol_type = other DNA
gtaaatatctgtttgtaaat

SEQ ID NO: 91011 - DNA, 20 bp, synthetic construct
  misc_feature 1..20: note = CRISPR gRNA sequence
  source 1..20: mol_type = other DNA
taacaaacgtttgttataaa

SEQ ID NO: 91012 - DNA, 20 bp, synthetic construct
  misc_feature 1..20: note = CRISPR gRNA sequence
  source 1..20: mol_type = other DNA
ttgttataaatggaacaatt

SEQ ID NO: 91013 - DNA, 20 bp, synthetic construct
  misc_feature 1..20: note = CRISPR gRNA sequence
  source 1..20: mol_type = other DNA
atggaacaattgagattttt

SEQ ID NO: 91014 - DNA, 20 bp, synthetic construct
  misc_feature 1..20: note = CRISPR gRNA sequence
  source 1..20: mol_type = other DNA
attgagatttttgagatttt

SEQ ID NO: 91015 - DNA, 20 bp, synthetic construct
  misc_feature 1..20: note = CRISPR gRNA sequence
  source 1..20: mol_type = other DNA
catcaaaataaattcctaat

SEQ ID NO: 91016 - DNA, 20 bp, synthetic construct
  misc_feature 1..20: note = CRISPR gRNA sequence
  source 1..20: mol_type = other DNA
ataagtcaaaattttaaaaa

SEQ ID NO: 91017 - DNA, 20 bp, synthetic construct
  misc_feature 1..20: note = CRISPR gRNA sequence
  source 1..20: mol_type = other DNA
caaaattttaaaaaaagaat

SEQ ID NO: 91018 - DNA, 20 bp, synthetic construct
  misc_feature 1..20: note = CRISPR gRNA sequence
  source 1..20: mol_type = other DNA
ctttacctcaaaaatgtaat

SEQ ID NO: 91019 - DNA, 20 bp, synthetic construct
  misc_feature 1..20: note = CRISPR gRNA sequence
  source 1..20: mol_type = other DNA
aaatgtaatgagattttttt

SEQ ID NO: 91020 - DNA, 20 bp, synthetic construct
  misc_feature 1..20: note = CRISPR gRNA sequence
  source 1..20: mol_type = other DNA
gagattttttttagcttata

SEQ ID NO: 91021 - DNA, 20 bp, synthetic construct
  misc_feature 1..20: note = CRISPR gRNA sequence
  source 1..20: mol_type = other DNA
agcttatatagacaaaatca

SEQ ID NO: 91022 - DNA, 20 bp, synthetic construct
  misc_feature 1..20: note = CRISPR gRNA sequence
  source 1..20: mol_type = other DNA
cttatatagacaaaatcaca

SEQ ID NO: 91023 - DNA, 20 bp, synthetic construct
  misc_feature 1..20: note = CRISPR gRNA sequence
  source 1..20: mol_type = other DNA
atagacaaaatcacagagaa

SEQ ID NO: 91024 - DNA, 20 bp, synthetic construct
  misc_feature 1..20: note = CRISPR gRNA sequence
  source 1..20: mol_type = other DNA
ctacataaaaatgaatgcta

SEQ ID NO: 91025 - DNA, 20 bp, synthetic construct
  misc_feature 1..20: note = CRISPR gRNA sequence
  source 1..20: mol_type = other DNA
atgaatgctatagtcaaaaa

SEQ ID NO: 91026 - DNA, 20 bp, synthetic construct
  misc_feature 1..20: note = CRISPR gRNA sequence
  source 1..20: mol_type = other DNA
aatgctatagtcaaaaatgg

SEQ ID NO: 91027 - DNA, 20 bp, synthetic construct
  misc_feature 1..20: note = CRISPR gRNA sequence
  source 1..20: mol_type = other DNA
tggcaaattgcacaatgacc

SEQ ID NO: 91028 - DNA, 20 bp, synthetic construct
  misc_feature 1..20: note = CRISPR gRNA sequence
  source 1..20: mol_type = other DNA
gcaaattgcacaatgaccta

SEQ ID NO: 91029 - DNA, 20 bp, synthetic construct
  misc_feature 1..20: note = CRISPR gRNA sequence
  source 1..20: mol_type = other DNA
aatatgtacaacaaatataa

SEQ ID NO: 91030 - DNA, 20 bp, synthetic construct
  misc_feature 1..20: note = CRISPR gRNA sequence
  source 1..20: mol_type = other DNA
acaacaaatataaaagacta

SEQ ID NO: 91031 - DNA, 20 bp, synthetic construct
  misc_feature 1..20: note = CRISPR gRNA sequence
  source 1..20: mol_type = other DNA
aagactatggttaacgtgtc

SEQ ID NO: 91032 - DNA, 20 bp, synthetic construct
  misc_feature 1..20: note = CRISPR gRNA sequence
  source 1..20: mol_type = other DNA
tttatcacataaaatattcc

SEQ ID NO: 91033 - DNA, 20 bp, synthetic construct
  misc_feature 1..20: note = CRISPR gRNA sequence
  source 1..20: mol_type = other DNA
tcacataaaatattcctggt

SEQ ID NO: 91034 - DNA, 20 bp, synthetic construct
  misc_feature 1..20: note = CRISPR gRNA sequence
  source 1..20: mol_type = other DNA
cacataaaatattcctggtt

SEQ ID NO: 91035 - DNA, 20 bp, synthetic construct
  misc_feature 1..20: note = CRISPR gRNA sequence
  source 1..20: mol_type = other DNA
atattcctggttgggcattg

SEQ ID NO: 91036 - DNA, 20 bp, synthetic construct
  misc_feature 1..20: note = CRISPR gRNA sequence
  source 1..20: mol_type = other DNA
gtggttcatgcctgtaatcc

SEQ ID NO: 91037 - DNA, 20 bp, synthetic construct
  misc_feature 1..20: note = CRISPR gRNA sequence
  source 1..20: mol_type = other DNA
tgcctgtaatcctagcactt

SEQ ID NO: 91038 - DNA, 20 bp, synthetic construct
  misc_feature 1..20: note = CRISPR gRNA sequence
  source 1..20: mol_type = other DNA
gcctgtaatcctagcacttt

SEQ ID NO: 91039 - DNA, 20 bp, synthetic construct
  misc_feature 1..20: note = CRISPR gRNA sequence
  source 1..20: mol_type = other DNA
ctgtaatcctagcactttgg

SEQ ID NO: 91040 - DNA, 20 bp, synthetic construct
  misc_feature 1..20: note = CRISPR gRNA sequence
  source 1..20: mol_type = other DNA
tgtaatcctagcactttggg

SEQ ID NO: 91041 - DNA, 20 bp, synthetic construct
  misc_feature 1..20: note = CRISPR gRNA sequence
  source 1..20: mol_type = other DNA
atcctagcactttgggaggc

SEQ ID NO: 91042 - DNA, 20 bp, synthetic construct
  misc_feature 1..20: note = CRISPR gRNA sequence
  source 1..20: mol_type = other DNA
tcctagcactttgggaggcc

SEQ ID NO: 91043 - DNA, 20 bp, synthetic construct
  misc_feature 1..20: note = CRISPR gRNA sequence
  source 1..20: mol_type = other DNA
tagcactttgggaggccagg

SEQ ID NO: 91044 - DNA, 20 bp, synthetic construct
  misc_feature 1..20: note = CRISPR gRNA sequence
  source 1..20: mol_type = other DNA
agcactttgggaggccaggt

SEQ ID NO: 91045 - DNA, 20 bp, synthetic construct
  misc_feature 1..20: note = CRISPR gRNA sequence
  source 1..20: mol_type = other DNA
cactttgggaggccaggtgg

SEQ ID NO: 91046 - DNA, 20 bp, synthetic construct
  misc_feature 1..20: note = CRISPR gRNA sequence
  source 1..20: mol_type = other DNA
actttgggaggccaggtggg

SEQ ID NO: 91047 - DNA, 20 bp, synthetic construct
  misc_feature 1..20: note = CRISPR gRNA sequence
  source 1..20: mol_type = other DNA
gccaggtgggaggatcactt

SEQ ID NO: 91048 - DNA, 20 bp, synthetic construct
  misc_feature 1..20: note = CRISPR gRNA sequence
  source 1..20: mol_type = other DNA
ccaggtgggaggatcacttg

SEQ ID NO: 91049 - DNA, 20 bp, synthetic construct
  misc_feature 1..20: note = CRISPR gRNA sequence
  source 1..20: mol_type = other DNA
gtgggaggatcacttgaggc

SEQ ID NO: 91050 - DNA, 20 bp, synthetic construct
  misc_feature 1..20: note = CRISPR gRNA sequence
  source 1..20: mol_type = other DNA
tgggaggatcacttgaggct

SEQ ID NO: 91051 - DNA, 20 bp, synthetic construct
  misc_feature 1..20: note = CRISPR gRNA sequence
  source 1..20: mol_type = other DNA
tcacttgaggctgggaattt

SEQ ID NO: 91052 - DNA, 20 bp, synthetic construct
  misc_feature 1..20: note = CRISPR gRNA sequence
  source 1..20: mol_type = other DNA
ctgggaatttgagaccattc

SEQ ID NO: 91053 - DNA, 20 bp, synthetic construct
  misc_feature 1..20: note = CRISPR gRNA sequence
  source 1..20: mol_type = other DNA
tgggaatttgagaccattct

SEQ ID NO: 91054 - DNA, 20 bp, synthetic construct
  misc_feature 1..20: note = CRISPR gRNA sequence
  source 1..20: mol_type = other DNA
tgagaccattctgggcaacg

SEQ ID NO: 91055 - DNA, 20 bp, synthetic construct
  misc_feature 1..20: note = CRISPR gRNA sequence
  source 1..20: mol_type = other DNA
accattctgggcaacgtagc

SEQ ID NO: 91056 - DNA, 20 bp, synthetic construct
  misc_feature 1..20: note = CRISPR gRNA sequence
  source 1..20: mol_type = other DNA
ctacaaaaaaatttaaaaat

SEQ ID NO: 91057 - DNA, 20 bp, synthetic construct
  misc_feature 1..20: note = CRISPR gRNA sequence
  source 1..20: mol_type = other DNA
aaaaaatttaaaaattagcc

SEQ ID NO: 91058 - DNA, 20 bp, synthetic construct
  misc_feature 1..20: note = CRISPR gRNA sequence
  source 1..20: mol_type = other DNA
taaaaattagccgagtgtga

SEQ ID NO: 91059 - DNA, 20 bp, synthetic construct
  misc_feature 1..20: note = CRISPR gRNA sequence
  source 1..20: mol_type = other DNA
tagccgagtgtgatggtatg

SEQ ID NO: 91060 - DNA, 20 bp, synthetic construct
  misc_feature 1..20: note = CRISPR gRNA sequence
  source 1..20: mol_type = other DNA
agtgtgatggtatgtagctg

SEQ ID NO: 91061 - DNA, 20 bp, synthetic construct
  misc_feature 1..20: note = CRISPR gRNA sequence
  source 1..20: mol_type = other DNA
atggtatgtagctgtagtcc

SEQ ID NO: 91062 - DNA, 20 bp, synthetic construct
  misc_feature 1..20: note = CRISPR gRNA sequence
  source 1..20: mol_type = other DNA
agctgtagtcctggctactc

SEQ ID NO: 91063 - DNA, 20 bp, synthetic construct
  misc_feature 1..20: note = CRISPR gRNA sequence
  source 1..20: mol_type = other DNA
ctgtagtcctggctactcaa

SEQ ID NO: 91064 - DNA, 20 bp, synthetic construct
  misc_feature 1..20: note = CRISPR gRNA sequence
  source 1..20: mol_type = other DNA
tgtagtcctggctactcaag

SEQ ID NO: 91065 - DNA, 20 bp, synthetic construct
  misc_feature 1..20: note = CRISPR gRNA sequence
  source 1..20: mol_type = other DNA
ggctactcaagaggctgaaa

SEQ ID NO: 91066 - DNA, 20 bp, synthetic construct
  misc_feature 1..20: note = CRISPR gRNA sequence
  source 1..20: mol_type = other DNA
gctactcaagaggctgaaac

SEQ ID NO: 91067 - DNA, 20 bp, synthetic construct
  misc_feature 1..20: note = CRISPR gRNA sequence
  source 1..20: mol_type = other DNA
tactcaagaggctgaaacag

SEQ ID NO: 91068 - DNA, 20 bp, synthetic construct
  misc_feature 1..20: note = CRISPR gRNA sequence
  source 1..20: mol_type = other DNA
actcaagaggctgaaacagg

SEQ ID NO: 91069 - DNA, 20 bp, synthetic construct
  misc_feature 1..20: note = CRISPR gRNA sequence
  source 1..20: mol_type = other DNA
ctgaaacaggaggattgctt

SEQ ID NO: 91070 - DNA, 20 bp, synthetic construct
  misc_feature 1..20: note = CRISPR gRNA sequence
  source 1..20: mol_type = other DNA
acaggaggattgcttgagtc

SEQ ID NO: 91071 - DNA, 20 bp, synthetic construct
  misc_feature 1..20: note = CRISPR gRNA sequence
  source 1..20: mol_type = other DNA
caggaggattgcttgagtcc

SEQ ID NO: 91072 - DNA, 20 bp, synthetic construct
  misc_feature 1..20: note = CRISPR gRNA sequence
  source 1..20: mol_type = other DNA
ttgcttgagtccaggaattc

SEQ ID NO: 91073 - DNA, 20 bp, synthetic construct
  misc_feature 1..20: note = CRISPR gRNA sequence
  source 1..20: mol_type = other DNA
tgcttgagtccaggaattcg

SEQ ID NO: 91074 - DNA, 20 bp, synthetic construct
  misc_feature 1..20: note = CRISPR gRNA sequence
  source 1..20: mol_type = other DNA
caggaattcgaggctgcaat

SEQ ID NO: 91075 - DNA, 20 bp, synthetic construct
  misc_feature 1..20: note = CRISPR gRNA sequence
  source 1..20: mol_type = other DNA
atgatcataccactgtactc

SEQ ID NO: 91076 - DNA, 20 bp, synthetic construct
  misc_feature 1..20: note = CRISPR gRNA sequence
  source 1..20: mol_type = other DNA
cataccactgtactccagcc

SEQ ID NO: 91077 - DNA, 20 bp, synthetic construct
  misc_feature 1..20: note = CRISPR gRNA sequence
  source 1..20: mol_type = other DNA
ataccactgtactccagcct

SEQ ID NO: 91078 - DNA, 20 bp, synthetic construct
  misc_feature 1..20: note = CRISPR gRNA sequence
  source 1..20: mol_type = other DNA
ctgtactccagcctaggcaa

SEQ ID NO: 91079 - DNA, 20 bp, synthetic construct
  misc_feature 1..20: note = CRISPR gRNA sequence
  source 1..20: mol_type = other DNA
gtactccagcctaggcaaca

SEQ ID NO: 91080 - DNA, 20 bp, synthetic construct
  misc_feature 1..20: note = CRISPR gRNA sequence
  source 1..20: mol_type = other DNA
tataaatcattaaacatgat

SEQ ID NO: 91081 - DNA, 20 bp, synthetic construct
  misc_feature 1..20: note = CRISPR gRNA sequence
  source 1..20: mol_type = other DNA
aaatatgtttgcctctttga

SEQ ID NO: 91082 - DNA, 20 bp, synthetic construct
  misc_feature 1..20: note = CRISPR gRNA sequence
  source 1..20: mol_type = other DNA
gtttgcctctttgacagctt

SEQ ID NO: 91083 - DNA, 20 bp, synthetic construct
  misc_feature 1..20: note = CRISPR gRNA sequence
  source 1..20: mol_type = other DNA
cagcttcagtcttaactgca

SEQ ID NO: 91084 - DNA, 20 bp, synthetic construct
  misc_feature 1..20: note = CRISPR gRNA sequence
  source 1..20: mol_type = other DNA
ttcagtcttaactgcaaaga

SEQ ID NO: 91085 - DNA, 20 bp, synthetic construct
  misc_feature 1..20: note = CRISPR gRNA sequence
  source 1..20: mol_type = other DNA
aaaaattcctgtaatttgat

SEQ ID NO: 91086 - DNA, 20 bp, synthetic construct
  misc_feature 1..20: note = CRISPR gRNA sequence
  source 1..20: mol_type = other DNA
aaaattcctgtaatttgatg

SEQ ID NO: 91087 - DNA, 20 bp, synthetic construct
  misc_feature 1..20: note = CRISPR gRNA sequence
  source 1..20: mol_type = other DNA
aatttgatgaggaaaacctt

SEQ ID NO: 91088 - DNA, 20 bp, synthetic construct
  misc_feature 1..20: note = CRISPR gRNA sequence
  source 1..20: mol_type = other DNA
ttggcttcaatacattgcaa

SEQ ID NO: 91089 - DNA, 20 bp, synthetic construct
  misc_feature 1..20: note = CRISPR gRNA sequence
  source 1..20: mol_type = other DNA
cttcaatacattgcaaaaga

SEQ ID NO: 91090 - DNA, 20 bp, synthetic construct
  misc_feature 1..20: note = CRISPR gRNA sequence
  source 1..20: mol_type = other DNA
tacattgcaaaagatagaaa

SEQ ID NO: 91091 - DNA, 20 bp, synthetic construct
  misc_feature 1..20: note = CRISPR gRNA sequence
  source 1..20: mol_type = other DNA
aaagatagaaacagaaaaaa

SEQ ID NO: 91092 - DNA, 20 bp, synthetic construct
  misc_feature 1..20: note = CRISPR gRNA sequence
  source 1..20: mol_type = other DNA
aagatagaaacagaaaaaaa

SEQ ID NO: 91093 - DNA, 20 bp, synthetic construct
  misc_feature 1..20: note = CRISPR gRNA sequence
  source 1..20: mol_type = other DNA
atagaaacagaaaaaaaagg

SEQ ID NO: 91094 - DNA, 20 bp, synthetic construct
  misc_feature 1..20: note = CRISPR gRNA sequence
  source 1..20: mol_type = other DNA
cagaataccattaaatgata

SEQ ID NO: 91095 - DNA, 20 bp, synthetic construct
  misc_feature 1..20: note = CRISPR gRNA sequence
  source 1..20: mol_type = other DNA
ataccattaaatgatatgga

SEQ ID NO: 91096 - DNA, 20 bp, synthetic construct
  misc_feature 1..20: note = CRISPR gRNA sequence
  source 1..20: mol_type = other DNA
taccattaaatgatatggaa

SEQ ID NO: 91097 - DNA, 20 bp, synthetic construct
  misc_feature 1..20: note = CRISPR gRNA sequence
  source 1..20: mol_type = other DNA
tatggaaaggtattcaatat

SEQ ID NO: 91098 - DNA, 20 bp, synthetic construct
  misc_feature 1..20: note = CRISPR gRNA sequence
  source 1..20: mol_type = other DNA
tatcagtaaaaataaacaaa

SEQ ID NO: 91099 - DNA, 20 bp, synthetic construct
  misc_feature 1..20: note = CRISPR gRNA sequence
  source 1..20: mol_type = other DNA
aacgattacgcacaatgatg

SEQ ID NO: 91100 - DNA, 20 bp, synthetic construct
  misc_feature 1..20: note = CRISPR gRNA sequence
  source 1..20: mol_type = other DNA
cgcacaatgatgcagtgatg

SEQ ID NO: 91101 - DNA, 20 bp, synthetic construct
  misc_feature 1..20: note = CRISPR gRNA sequence
  source 1..20: mol_type = other DNA
cacaatgatgcagtgatgtg

SEQ ID NO: 91102 - DNA, 20 bp, synthetic construct
  misc_feature 1..20: note = CRISPR gRNA sequence
  source 1..20: mol_type = other DNA
atgtggagactttcatgaaa

SEQ ID NO: 91103 - DNA, 20 bp, synthetic construct
  misc_feature 1..20: note = CRISPR gRNA sequence
  source 1..20: mol_type = other DNA
ttcatgaaatggacattctc

SEQ ID NO: 91104 - DNA, 20 bp, synthetic construct
  misc_feature 1..20: note = CRISPR gRNA sequence
  source 1..20: mol_type = other DNA
atgaaatggacattctcaag

SEQ ID NO: 91105 - DNA, 20 bp, synthetic construct
  misc_feature 1..20: note = CRISPR gRNA sequence
  source 1..20: mol_type = other DNA
ggacattctcaagtagttaa

SEQ ID NO: 91106 - DNA, 20 bp, synthetic construct
  misc_feature 1..20: note = CRISPR gRNA sequence
  source 1..20: mol_type = other DNA
tagttaatggcattatatat

SEQ ID NO: 91107 - DNA, 20 bp, synthetic construct
  misc_feature 1..20: note = CRISPR gRNA sequence
  source 1..20: mol_type = other DNA
aatggcattatatattggta

SEQ ID NO: 91108 - DNA, 20 bp, synthetic construct
  misc_feature 1..20: note = CRISPR gRNA sequence
  source 1..20: mol_type = other DNA
atatattggtatggcacttt

SEQ ID NO: 91109 - DNA, 20 bp, synthetic construct
  misc_feature 1..20: note = CRISPR gRNA sequence
  source 1..20: mol_type = other DNA
attggtatggcactttcaga

SEQ ID NO: 91110 - DNA, 20 bp, synthetic construct
  misc_feature 1..20: note = CRISPR gRNA sequence
  source 1..20: mol_type = other DNA
ggtatggcactttcagaaag

SEQ ID NO: 91111 - DNA, 20 bp, synthetic construct
  misc_feature 1..20: note = CRISPR gRNA sequence
  source 1..20: mol_type = other DNA
tggcactttcagaaagcagt

SEQ ID NO: 91112 - DNA, 20 bp, synthetic construct
  misc_feature 1..20: note = CRISPR gRNA sequence
  source 1..20: mol_type = other DNA
ggcactttcagaaagcagtt

SEQ ID NO: 91113 - DNA, 20 bp, synthetic construct
  misc_feature 1..20: note = CRISPR gRNA sequence
  source 1..20: mol_type = other DNA
agcagttgggcaatatgtac

SEQ ID NO: 91114 - DNA, 20 bp, synthetic construct
  misc_feature 1..20: note = CRISPR gRNA sequence
  source 1..20: mol_type = other DNA
gcagttgggcaatatgtacc

SEQ ID NO: 91115 - DNA, 20 bp, synthetic construct
  misc_feature 1..20: note = CRISPR gRNA sequence
  source 1..20: mol_type = other DNA
agttgggcaatatgtaccag

SEQ ID NO: 91116 - DNA, 20 bp, synthetic construct
  misc_feature 1..20: note = CRISPR gRNA sequence
  source 1..20: mol_type = other DNA
aggagtcatccctttcaact

SEQ ID NO: 91117 - DNA, 20 bp, synthetic construct
  misc_feature 1..20: note = CRISPR gRNA sequence
  source 1..20: mol_type = other DNA
cagacatcacatttaatatg

SEQ ID NO: 91118 - DNA, 20 bp, synthetic construct
  misc_feature 1..20: note = CRISPR gRNA sequence
  source 1..20: mol_type = other DNA
atttaatatgaagacattta

SEQ ID NO: 91119 - DNA, 20 bp, synthetic construct
  misc_feature 1..20: note = CRISPR gRNA sequence
  source 1..20: mol_type = other DNA
cagaatgtaaatcctaaata

SEQ ID NO: 91120 - DNA, 20 bp, synthetic construct
  misc_feature 1..20: note = CRISPR gRNA sequence
  source 1..20: mol_type = other DNA
atgtaaatcctaaatatgga

SEQ ID NO: 91121 - DNA, 20 bp, synthetic construct
  misc_feature 1..20: note = CRISPR gRNA sequence
  source 1..20: mol_type = other DNA
gtaaatcctaaatatggata

SEQ ID NO: 91122 - DNA, 20 bp, synthetic construct
  misc_feature 1..20: note = CRISPR gRNA sequence
  source 1..20: mol_type = other DNA
tatggatagagttaaacata

SEQ ID NO: 91123 - DNA, 20 bp, synthetic construct
  misc_feature 1..20: note = CRISPR gRNA sequence
  source 1..20: mol_type = other DNA
atggatagagttaaacataa

SEQ ID NO: 91124 - DNA, 20 bp, synthetic construct
  misc_feature 1..20: note = CRISPR gRNA sequence
  source 1..20: mol_type = other DNA
gttaaacataaaggtattgc

SEQ ID NO: 91125 - DNA, 20 bp, synthetic construct
  misc_feature 1..20: note = CRISPR gRNA sequence
  source 1..20: mol_type = other DNA
ttaaacataaaggtattgcc

SEQ ID NO: 91126 - DNA, 20 bp, synthetic construct
  misc_feature 1..20: note = CRISPR gRNA sequence
  source 1..20: mol_type = other DNA
aggaatatatttctcataaa

SEQ ID NO: 91127 - DNA, 20 bp, synthetic construct
  misc_feature 1..20: note = CRISPR gRNA sequence
  source 1..20: mol_type = other DNA
atttctcataaatagtaaaa

SEQ ID NO: 91128 - DNA, 20 bp, synthetic construct
  misc_feature 1..20: note = CRISPR gRNA sequence
  source 1..20: mol_type = other DNA
tttctcataaatagtaaaaa

SEQ ID NO: 91129 - DNA, 20 bp, synthetic construct
  misc_feature 1..20: note = CRISPR gRNA sequence
  source 1..20: mol_type = other DNA
ctcataaatagtaaaaaagg

SEQ ID NO: 91130 - DNA, 20 bp, synthetic construct
  misc_feature 1..20: note = CRISPR gRNA sequence
  source 1..20: mol_type = other DNA
agtaaaaaaggtagttgaaa

SEQ ID NO: 91131 - DNA, 20 bp, synthetic construct
  misc_feature 1..20: note = CRISPR gRNA sequence
  source 1..20: mol_type = other DNA
gaaacagcctaaatgtccaa

SEQ ID NO: 91132 - DNA, 20 bp, synthetic construct
  misc_feature 1..20: note = CRISPR gRNA sequence
  source 1..20: mol_type = other DNA
aatgtccaacagtgtcataa

SEQ ID NO: 91133 - DNA, 20 bp, synthetic construct
  misc_feature 1..20: note = CRISPR gRNA sequence
  source 1..20: mol_type = other DNA
ccaacagtgtcataacagct

SEQ ID NO: 91134 - DNA, 20 bp, synthetic construct
  misc_feature 1..20: note = CRISPR gRNA sequence
  source 1..20: mol_type = other DNA
aaataaaactgtttaataaa

SEQ ID NO: 91135 - DNA, 20 bp, synthetic construct
  misc_feature 1..20: note = CRISPR gRNA sequence
  source 1..20: mol_type = other DNA
taataaatagaaaatgtact

SEQ ID NO: 91136 - DNA, 20 bp, synthetic construct
  misc_feature 1..20: note = CRISPR gRNA sequence
  source 1..20: mol_type = other DNA
atataatacatataatctga

SEQ ID NO: 91137 - DNA, 20 bp, synthetic construct
  misc_feature 1..20: note = CRISPR gRNA sequence
  source 1..20: mol_type = other DNA
aatacatataatctgaaagt

SEQ ID NO: 91138 - DNA, 20 bp, synthetic construct
  misc_feature 1..20: note = CRISPR gRNA sequence
  source 1..20: mol_type = other DNA
tgaaagtcagtatttaatga

SEQ ID NO: 91139 - DNA, 20 bp, synthetic construct
  misc_feature 1..20: note = CRISPR gRNA sequence
  source 1..20: mol_type = other DNA
gatagtatgttcactttatt

SEQ ID NO: 91140 - DNA, 20 bp, synthetic construct
  misc_feature 1..20: note = CRISPR gRNA sequence
  source 1..20: mol_type = other DNA
ttattcagtttatctttttg

SEQ ID NO: 91141 - DNA, 20 bp, synthetic construct
  misc_feature 1..20: note = CRISPR gRNA sequence
  source 1..20: mol_type = other DNA
tttatctttttgcagcttat

SEQ ID NO: 91142 - DNA, 20 bp, synthetic construct
  misc_feature 1..20: note = CRISPR gRNA sequence
  source 1..20: mol_type = other DNA
ttatctttttgcagcttatt

SEQ ID NO: 91143 - DNA, 20 bp, synthetic construct
  misc_feature 1..20: note = CRISPR gRNA sequence
  source 1..20: mol_type = other DNA
tatctttttgcagcttattg

SEQ ID NO: 91144 - DNA, 20 bp, synthetic construct
  misc_feature 1..20: note = CRISPR gRNA sequence
  source 1..20: mol_type = other DNA
tttgcagcttattggggcca

SEQ ID NO: 91145 - DNA, 20 bp, synthetic construct
  misc_feature 1..20: note = CRISPR gRNA sequence
  source 1..20: mol_type = other DNA
ttttctctataaatttatgt

SEQ ID NO: 91146 - DNA, 20 bp, synthetic construct
  misc_feature 1..20: note = CRISPR gRNA sequence
  source 1..20: mol_type = other DNA
tttattataaaaacctatta

SEQ ID NO: 91147 - DNA, 20 bp, synthetic construct
  misc_feature 1..20: note = CRISPR gRNA sequence
  source 1..20: mol_type = other DNA
ttattataaaaacctattac

SEQ ID NO: 91148 - DNA, 20 bp, synthetic construct
  misc_feature 1..20: note = CRISPR gRNA sequence
  source 1..20: mol_type = other DNA
attataaaaacctattacag

SEQ ID NO: 91149 - DNA, 20 bp, synthetic construct
  misc_feature 1..20: note = CRISPR gRNA sequence
  source 1..20: mol_type = other DNA
aaacctattacaggagactg

SEQ ID NO: 91150 - DNA, 20 bp, synthetic construct
  misc_feature 1..20: note = CRISPR gRNA sequence
  source 1..20: mol_type = other DNA
cctattacaggagactgtgg

SEQ ID NO: 91151 - DNA, 20 bp, synthetic construct
  misc_feature 1..20: note = CRISPR gRNA sequence
  source 1..20: mol_type = other DNA
ctattacaggagactgtggc

SEQ ID NO: 91152 - DNA, 20 bp, synthetic construct
  misc_feature 1..20: note = CRISPR gRNA sequence
  source 1..20: mol_type = other DNA
ctgtggcaggatgattgctt

SEQ ID NO: 91153 - DNA, 20 bp, synthetic construct
  misc_feature 1..20: note = CRISPR gRNA sequence
  source 1..20: mol_type = other DNA
gcaggatgattgcttgagcc

SEQ ID NO: 91154 - DNA, 20 bp, synthetic construct
  misc_feature 1..20: note = CRISPR gRNA sequence
  source 1..20: mol_type = other DNA
caggatgattgcttgagccg

SEQ ID NO: 91155 - DNA, 20 bp, synthetic construct
  misc_feature 1..20: note = CRISPR gRNA sequence
  source 1..20: mol_type = other DNA
ggatgattgcttgagccgag

SEQ ID NO: 91156 - DNA, 20 bp, synthetic construct
  misc_feature 1..20: note = CRISPR gRNA sequence
  source 1..20: mol_type = other DNA
ttgcttgagccgaggagttc

SEQ ID NO: 91157 - DNA, 20 bp, synthetic construct
  misc_feature 1..20: note = CRISPR gRNA sequence
  source 1..20: mol_type = other DNA
agccgaggagttcaagactg

SEQ ID NO: 91158 - DNA, 20 bp, synthetic construct
  misc_feature 1..20: note = CRISPR gRNA sequence
  source 1..20: mol_type = other DNA
gaggagttcaagactgcagt

SEQ ID NO: 91159 - DNA, 20 bp, synthetic construct
  misc_feature 1..20: note = CRISPR gRNA sequence
  source 1..20: mol_type = other DNA
atgctcacgccactgcactc

SEQ ID NO: 91160 - DNA, 20 bp, synthetic construct
  misc_feature 1..20: note = CRISPR gRNA sequence
  source 1..20: mol_type = other DNA
cacgccactgcactccagcg

SEQ ID NO: 91161 - DNA, 20 bp, synthetic construct
  misc_feature 1..20: note = CRISPR gRNA sequence
  source 1..20: mol_type = other DNA
acgccactgcactccagcgt

SEQ ID NO: 91162 - DNA, 20 bp, synthetic construct
  misc_feature 1..20: note = CRISPR gRNA sequence
  source 1..20: mol_type = other DNA
cgccactgcactccagcgtg

SEQ ID NO: 91163 - DNA, 20 bp, synthetic construct
  misc_feature 1..20: note = CRISPR gRNA sequence
  source 1..20: mol_type = other DNA
ctgcactccagcgtggggaa

SEQ ID NO: 91164 - DNA, 20 bp, synthetic construct
  misc_feature 1..20: note = CRISPR gRNA sequence
  source 1..20: mol_type = other DNA
gcactccagcgtggggaaca

SEQ ID NO: 91165 - DNA, 20 bp, synthetic construct
  misc_feature 1..20: note = CRISPR gRNA sequence
  source 1..20: mol_type = other DNA
tccagcgtggggaacagagt

SEQ ID NO: 91166 - DNA, 20 bp, synthetic construct
  misc_feature 1..20: note = CRISPR gRNA sequence
  source 1..20: mol_type = other DNA
taataataatatgttaatca

SEQ ID NO: 91167 - DNA, 20 bp, synthetic construct
  misc_feature 1..20: note = CRISPR gRNA sequence
  source 1..20: mol_type = other DNA
attattacaactatatttta

SEQ ID NO: 91168 - DNA, 20 bp, synthetic construct
  misc_feature 1..20: note = CRISPR gRNA sequence
  source 1..20: mol_type = other DNA
caactatattttaaagtgat

SEQ ID NO: 91169 - DNA, 20 bp, synthetic construct
  misc_feature 1..20: note = CRISPR gRNA sequence
  source 1..20: mol_type = other DNA
taaagtgatgagtgtacaaa

SEQ ID NO: 91170 - DNA, 20 bp, synthetic construct
  misc_feature 1..20: note = CRISPR gRNA sequence
  source 1..20: mol_type = other DNA
aaagtgatgagtgtacaaaa

SEQ ID NO: 91171 - DNA, 20 bp, synthetic construct
  misc_feature 1..20: note = CRISPR gRNA sequence
  source 1..20: mol_type = other DNA
atgagtgtacaaaaaggtat

SEQ ID NO: 91172 - DNA, 20 bp, synthetic construct
  misc_feature 1..20: note = CRISPR gRNA sequence
  source 1..20: mol_type = other DNA
caaaaaggtattggatgttt

SEQ ID NO: 91173 - DNA, 20 bp, synthetic construct
  misc_feature 1..20: note = CRISPR gRNA sequence
  source 1..20: mol_type = other DNA
aaaaggtattggatgtttta

SEQ ID NO: 91174 - DNA, 20 bp, synthetic construct
  misc_feature 1..20: note = CRISPR gRNA sequence
  source 1..20: mol_type = other DNA
aggtattggatgttttagag

SEQ ID NO: 91175 - DNA, 20 bp, synthetic construct
  misc_feature 1..20: note = CRISPR gRNA sequence
  source 1..20: mol_type = other DNA
tatattttttcctgaaattt

SEQ ID NO: 91176 - DNA, 20 bp, synthetic construct
  misc_feature 1..20: note = CRISPR gRNA sequence
  source 1..20: mol_type = other DNA
caatttttaatttctttatg

SEQ ID NO: 91177 - DNA, 20 bp, synthetic construct
  misc_feature 1..20: note = CRISPR gRNA sequence
  source 1..20: mol_type = other DNA
ttaatttctttatgaagact

SEQ ID NO: 91178 - DNA, 20 bp, synthetic construct
  misc_feature 1..20: note = CRISPR gRNA sequence
  source 1..20: mol_type = other DNA
tgaagacttagttgcctaat

SEQ ID NO: 91179 - DNA, 20 bp, synthetic construct
  misc_feature 1..20: note = CRISPR gRNA sequence
  source 1..20: mol_type = other DNA
ctaatgagaaacttgacttc

SEQ ID NO: 91180 - DNA, 20 bp, synthetic construct
  misc_feature 1..20: note = CRISPR gRNA sequence
  source 1..20: mol_type = other DNA
agaaacttgacttctagcac

SEQ ID NO: 91181 - DNA, 20 bp, synthetic construct
  misc_feature 1..20: note = CRISPR gRNA sequence
  source 1..20: mol_type = other DNA
gtttgtatgtatgtacaaac

SEQ ID NO: 91182 - DNA, 20 bp, synthetic construct
  misc_feature 1..20: note = CRISPR gRNA sequence
  source 1..20: mol_type = other DNA
tgtatgtacaaactggcatt

SEQ ID NO: 91183 - DNA, 20 bp, synthetic construct
  misc_feature 1..20: note = CRISPR gRNA sequence
  source 1..20: mol_type = other DNA
ttagctgctattttcacatg

SEQ ID NO: 91184 - DNA, 20 bp, synthetic construct
  misc_feature 1..20: note = CRISPR gRNA sequence
  source 1..20: mol_type = other DNA
tttttttcttgctataatcc

SEQ ID NO: 91185 - DNA, 20 bp, synthetic construct
  misc_feature 1..20: note = CRISPR gRNA sequence
  source 1..20: mol_type = other DNA
ttttttcttgctataatcct

SEQ ID NO: 91186 - DNA, 20 bp, synthetic construct
  misc_feature 1..20: note = CRISPR gRNA sequence
  source 1..20: mol_type = other DNA
ttcttgctataatcctgggt

SEQ ID NO: 91187 - DNA, 20 bp, synthetic construct
  misc_feature 1..20: note = CRISPR gRNA sequence
  source 1..20: mol_type = other DNA
tcctgggtcagtgctacttt

SEQ ID NO: 91188 - DNA, 20 bp, synthetic construct
  misc_feature 1..20: note = CRISPR gRNA sequence
  source 1..20: mol_type = other DNA
tctttgttcttacatatttc

SEQ ID NO: 91189 - DNA, 20 bp, synthetic construct
  misc_feature 1..20: note = CRISPR gRNA sequence
  source 1..20: mol_type = other DNA
tttgttcttacatatttcaa

SEQ ID NO: 91190 - DNA, 20 bp, synthetic construct
  misc_feature 1..20: note = CRISPR gRNA sequence
  source 1..20: mol_type = other DNA
tgttcttacatatttcaaga

SEQ ID NO: 91191 - DNA, 20 bp, synthetic construct
  misc_feature 1..20: note = CRISPR gRNA sequence
  source 1..20: mol_type = other DNA
tttcaagagagtatatttgc

SEQ ID NO: 91192 - DNA, 20 bp, synthetic construct
  misc_feature 1..20: note = CRISPR gRNA sequence
  source 1..20: mol_type = other DNA
gagtatatttgctggcatat

SEQ ID NO: 91193 - DNA, 20 bp, synthetic construct
  misc_feature 1..20: note = CRISPR gRNA sequence
  source 1..20: mol_type = other DNA
gtatatttgctggcatatta

SEQ ID NO: 91194 - DNA, 20 bp, synthetic construct
  misc_feature 1..20: note = CRISPR gRNA sequence
  source 1..20: mol_type = other DNA
tatttgctggcatattagag

SEQ ID NO: 91195 - DNA, 20 bp, synthetic construct
  misc_feature 1..20: note = CRISPR gRNA sequence
  source 1..20: mol_type = other DNA
atttgctggcatattagaga

SEQ ID NO: 91196 - DNA, 20 bp, synthetic construct
  misc_feature 1..20: note = CRISPR gRNA sequence
  source 1..20: mol_type = other DNA
aggtgtttcctttttacaca

SEQ ID NO: 91197 - DNA, 20 bp, synthetic construct
  misc_feature 1..20: note = CRISPR gRNA sequence
  source 1..20: mol_type = other DNA
ttacacaaagtcaccaataa

SEQ ID NO: 91198 - DNA, 20 bp, synthetic construct
  misc_feature 1..20: note = CRISPR gRNA sequence
  source 1..20: mol_type = other DNA
cagacttcacccgttatttt

SEQ ID NO: 91199 - DNA, 20 bp, synthetic construct
  misc_feature 1..20: note = CRISPR gRNA sequence
  source 1..20: mol_type = other DNA
agacttcacccgttattttt

SEQ ID NO: 91200 - DNA, 20 bp, synthetic construct
  misc_feature 1..20: note = CRISPR gRNA sequence
  source 1..20: mol_type = other DNA
cacccgttatttttaggttt

SEQ ID NO: 91201 - DNA, 20 bp, synthetic construct
  misc_feature 1..20: note = CRISPR gRNA sequence
  source 1..20: mol_type = other DNA
gtgtgacatcacattatttt

SEQ ID NO: 91202 - DNA, 20 bp, synthetic construct
  misc_feature 1..20: note = CRISPR gRNA sequence
  source 1..20: mol_type = other DNA
atcacattatttttagtttg

SEQ ID NO: 91203 - DNA, 20 bp, synthetic construct
  misc_feature 1..20: note = CRISPR gRNA sequence
  source 1..20: mol_type = other DNA
attatttttagtttgcagct

SEQ ID NO: 91204 - DNA, 20 bp, synthetic construct
  misc_feature 1..20: note = CRISPR gRNA sequence
  source 1..20: mol_type = other DNA
tttagtttgcagcttagttg

SEQ ID NO: 91205 - DNA, 20 bp, synthetic construct
  misc_feature 1..20: note = CRISPR gRNA sequence
  source 1..20: mol_type = other DNA
ttgcagtgcatccgatgtaa

SEQ ID NO: 91206 - DNA, 20 bp, synthetic construct
  misc_feature 1..20: note = CRISPR gRNA sequence
  source 1..20: mol_type = other DNA
atgtaaaagtgcttttgatt

SEQ ID NO: 91207 - DNA, 20 bp, synthetic construct
  misc_feature 1..20: note = CRISPR gRNA sequence
  source 1..20: mol_type = other DNA
tgtaaaagtgcttttgattc

SEQ ID NO: 91208 - DNA, 20 bp, synthetic construct
  misc_feature 1..20: note = CRISPR gRNA sequence
  source 1..20: mol_type = other DNA
tgaacatattgtatcatatg

SEQ ID NO: 91209 - DNA, 20 bp, synthetic construct
  misc_feature 1..20: note = CRISPR gRNA sequence
  source 1..20: mol_type = other DNA
gaacatattgtatcatatgt

SEQ ID NO: 91210 - DNA, 20 bp, synthetic construct
  misc_feature 1..20: note = CRISPR gRNA sequence
  source 1..20: mol_type = other DNA
aacatattgtatcatatgta

SEQ ID NO: 91211 - DNA, 20 bp, synthetic construct
  misc_feature 1..20: note = CRISPR gRNA sequence
  source 1..20: mol_type = other DNA
tatcatatgtagggacacat

SEQ ID NO: 91212 - DNA, 20 bp, synthetic construct
  misc_feature 1..20: note = CRISPR gRNA sequence
  source 1..20: mol_type = other DNA
tcatatgtagggacacatca

SEQ ID NO: 91213 - DNA, 20 bp, synthetic construct
  misc_feature 1..20: note = CRISPR gRNA sequence
  source 1..20: mol_type = other DNA
tagggacacatcagagtaat

SEQ ID NO: 91214 - DNA, 20 bp, synthetic construct
  misc_feature 1..20: note = CRISPR gRNA sequence
  source 1..20: mol_type = other DNA
cagagtaattagcatgaaaa

SEQ ID NO: 91215 - DNA, 20 bp, synthetic construct
  misc_feature 1..20: note = CRISPR gRNA sequence
  source 1..20: mol_type = other DNA
atgaaaacagtctaatgaca

SEQ ID NO: 91216 - DNA, 20 bp, synthetic construct
  misc_feature 1..20: note = CRISPR gRNA sequence
  source 1..20: mol_type = other DNA
aatttttttcttttctttct

SEQ ID NO: 91217 - DNA, 20 bp, synthetic construct
  misc_feature 1..20: note = CRISPR gRNA sequence
  source 1..20: mol_type = other DNA
tttctttctaagtcgttact

SEQ ID NO: 91218 - DNA, 20 bp, synthetic construct
  misc_feature 1..20: note = CRISPR gRNA sequence
  source 1..20: mol_type = other DNA
ctttctaagtcgttactaag

SEQ ID NO: 91219 - DNA, 20 bp, synthetic construct
  misc_feature 1..20: note = CRISPR gRNA sequence
  source 1..20: mol_type = other DNA
taagtcgttactaagaagtc

SEQ ID NO: 91220 - DNA, 20 bp, synthetic construct
  misc_feature 1..20: note = CRISPR gRNA sequence
  source 1..20: mol_type = other DNA
gtcgttactaagaagtccag

SEQ ID NO: 91221 - DNA, 20 bp, synthetic construct
  misc_feature 1..20: note = CRISPR gRNA sequence
  source 1..20: mol_type = other DNA
gttactaagaagtccagaag

SEQ ID NO: 91222 - DNA, 20 bp, synthetic construct
  misc_feature 1..20: note = CRISPR gRNA sequence
  source 1..20: mol_type = other DNA
cagaagtagtgcaattttta

SEQ ID NO: 91223 - DNA, 20 bp, synthetic construct
  misc_feature 1..20: note = CRISPR gRNA sequence
  source 1..20: mol_type = other DNA
tagtgcaatttttacagaaa

SEQ ID NO: 91224 - DNA, 20 bp, synthetic construct
  misc_feature 1..20: note = CRISPR gRNA sequence
  source 1..20: mol_type = other DNA
aatttttacagaaacagcaa

SEQ ID NO: 91225 - DNA, 20 bp, synthetic construct
  misc_feature 1..20: note = CRISPR gRNA sequence
  source 1..20: mol_type = other DNA
aacagcaacagctattaaat

SEQ ID NO: 91226 - DNA, 20 bp, synthetic construct
  misc_feature 1..20: note = CRISPR gRNA sequence
  source 1..20: mol_type = other DNA
gcaacagctattaaatcagc

SEQ ID NO: 91227 - DNA, 20 bp, synthetic construct
  misc_feature 1..20: note = CRISPR gRNA sequence
  source 1..20: mol_type = other DNA
gctattaaatcagcaagttt

SEQ ID NO: 91228 - DNA, 20 bp, synthetic construct
  misc_feature 1..20: note = CRISPR gRNA sequence
  source 1..20: mol_type = other DNA
tattaaatcagcaagttttg

SEQ ID NO: 91229 - DNA, 20 bp, synthetic construct
  misc_feature 1..20: note = CRISPR gRNA sequence
  source 1..20: mol_type = other DNA
aatcagcaagttttggagca

SEQ ID NO: 91230 - DNA, 20 bp, synthetic construct
  misc_feature 1..20: note = CRISPR gRNA sequence
  source 1..20: mol_type = other DNA
aagttttggagcaaagacaa

SEQ ID NO: 91231 - DNA, 20 bp, synthetic construct
  misc_feature 1..20: note = CRISPR gRNA sequence
  source 1..20: mol_type = other DNA
ttttggagcaaagacaacag

SEQ ID NO: 91232 - DNA, 20 bp, synthetic construct
  misc_feature 1..20: note = CRISPR gRNA sequence
  source 1..20: mol_type = other DNA
gcaaagacaacagcagtttc

SEQ ID NO: 91233 - DNA, 20 bp, synthetic construct
  misc_feature 1..20: note = CRISPR gRNA sequence
  source 1..20: mol_type = other DNA
caaagacaacagcagtttcc

SEQ ID NO: 91234 - DNA, 20 bp, synthetic construct
  misc_feature 1..20: note = CRISPR gRNA sequence
  source 1..20: mol_type = other DNA
gtttccaggaacatcaatgt

SEQ ID NO: 91235 - DNA, 20 bp, synthetic construct
  misc_feature 1..20: note = CRISPR gRNA sequence
  source 1..20: mol_type = other DNA
tttccaggaacatcaatgtg

SEQ ID NO: 91236 - DNA, 20 bp, synthetic construct
  misc_feature 1..20: note = CRISPR gRNA sequence
  source 1..20: mol_type = other DNA
ttccaggaacatcaatgtga

SEQ ID NO: 91237 - DNA, 20 bp, synthetic construct
  misc_feature 1..20: note = CRISPR gRNA sequence
  source 1..20: mol_type = other DNA
tcaatgtgagggaacttacc

SEQ ID NO: 91238 - DNA, 20 bp, synthetic construct
  misc_feature 1..20: note = CRISPR gRNA sequence
  source 1..20: mol_type = other DNA
acttaccaagaacatctaca

SEQ ID NO: 91239 - DNA, 20 bp, synthetic construct
  misc_feature 1..20: note = CRISPR gRNA sequence
  source 1..20: mol_type = other DNA
ggttttttatcttattgtaa

SEQ ID NO: 91240 - DNA, 20 bp, synthetic construct
  misc_feature 1..20: note = CRISPR gRNA sequence
  source 1..20: mol_type = other DNA
tttatcttattgtaatagat

SEQ ID NO: 91241 - DNA, 20 bp, synthetic construct
  misc_feature 1..20: note = CRISPR gRNA sequence
  source 1..20: mol_type = other DNA
agatgagcatatttttttac

SEQ ID NO: 91242 - DNA, 20 bp, synthetic construct
  misc_feature 1..20: note = CRISPR gRNA sequence
  source 1..20: mol_type = other DNA
atttttttaccagacataaa

SEQ ID NO: 91243 - DNA, 20 bp, synthetic construct
  misc_feature 1..20: note = CRISPR gRNA sequence
  source 1..20: mol_type = other DNA
tttttttaccagacataaat

SEQ ID NO: 91244 - DNA, 20 bp, synthetic construct
  misc_feature 1..20: note = CRISPR gRNA sequence
  source 1..20: mol_type = other DNA
ttttttaccagacataaatg

SEQ ID NO: 91245 - DNA, 20 bp, synthetic construct
  misc_feature 1..20: note = CRISPR gRNA sequence
  source 1..20: mol_type = other DNA
ggggtaataatctatgcctg

SEQ ID NO: 91246 - DNA, 20 bp, synthetic construct
  misc_feature 1..20: note = CRISPR gRNA sequence
  source 1..20: mol_type = other DNA
attattaccccatttatgtc

SEQ ID NO: 91247 - DNA, 20 bp, synthetic construct
  misc_feature 1..20: note = CRISPR gRNA sequence
  source 1..20: mol_type = other DNA
atatgctcatctattacaat

SEQ ID NO: 91248 - DNA, 20 bp, synthetic construct
  misc_feature 1..20: note = CRISPR gRNA sequence
  source 1..20: mol_type = other DNA
caataagataaaaaaccatg

SEQ ID NO: 91249 - DNA, 20 bp, synthetic construct
  misc_feature 1..20: note = CRISPR gRNA sequence
  source 1..20: mol_type = other DNA
aaaaaccatgtagatgttct

SEQ ID NO: 91250 - DNA, 20 bp, synthetic construct
  misc_feature 1..20: note = CRISPR gRNA sequence
  source 1..20: mol_type = other DNA
accatgtagatgttcttggt

SEQ ID NO: 91251 - DNA, 20 bp, synthetic construct
  misc_feature 1..20: note = CRISPR gRNA sequence
  source 1..20: mol_type = other DNA
ttccctcacattgatgttcc

SEQ ID NO: 91252 - DNA, 20 bp, synthetic construct
  misc_feature 1..20: note = CRISPR gRNA sequence
  source 1..20: mol_type = other DNA
tccaaaacttgctgatttaa

SEQ ID NO: 91253 - DNA, 20 bp, synthetic construct
  misc_feature 1..20: note = CRISPR gRNA sequence
  source 1..20: mol_type = other DNA
tgtaaaaattgcactacttc

SEQ ID NO: 91254 - DNA, 20 bp, synthetic construct
  misc_feature 1..20: note = CRISPR gRNA sequence
  source 1..20: mol_type = other DNA
tgcactacttctggacttct

SEQ ID NO: 91255 - DNA, 20 bp, synthetic construct
  misc_feature 1..20: note = CRISPR gRNA sequence
  source 1..20: mol_type = other DNA
tggacttcttagtaacgact

SEQ ID NO: 91256 - DNA, 20 bp, synthetic construct
  misc_feature 1..20: note = CRISPR gRNA sequence
  source 1..20: mol_type = other DNA
cttcttagtaacgacttaga

SEQ ID NO: 91257 - DNA, 20 bp, synthetic construct
  misc_feature 1..20: note = CRISPR gRNA sequence
  source 1..20: mol_type = other DNA
tagtaacgacttagaaagaa

SEQ ID NO: 91258 - DNA, 20 bp, synthetic construct
  misc_feature 1..20: note = CRISPR gRNA sequence
  source 1..20: mol_type = other DNA
gaaaagaaaaaaattattaa

SEQ ID NO: 91259 - DNA, 20 bp, synthetic construct
  misc_feature 1..20: note = CRISPR gRNA sequence
  source 1..20: mol_type = other DNA
atagcattaatctatgtcat

SEQ ID NO: 91260 - DNA, 20 bp, synthetic construct
  misc_feature 1..20: note = CRISPR gRNA sequence
  source 1..20: mol_type = other DNA
atatgatacaatatgttcac

SEQ ID NO: 91261 - DNA, 20 bp, synthetic construct
  misc_feature 1..20: note = CRISPR gRNA sequence
  source 1..20: mol_type = other DNA
caagaatatgcctgaatcaa

SEQ ID NO: 91262 - DNA, 20 bp, synthetic construct
  misc_feature 1..20: note = CRISPR gRNA sequence
  source 1..20: mol_type = other DNA
aatcaaaagcacttttacat

SEQ ID NO: 91263 - DNA, 20 bp, synthetic construct
  misc_feature 1..20: note = CRISPR gRNA sequence
  source 1..20: mol_type = other DNA
acatcggatgcactgcaact

SEQ ID NO: 91264 - DNA, 20 bp, synthetic construct
  misc_feature 1..20: note = CRISPR gRNA sequence
  source 1..20: mol_type = other DNA
atactaaaacctaaaaataa

SEQ ID NO: 91265 - DNA, 20 bp, synthetic construct
  misc_feature 1..20: note = CRISPR gRNA sequence
  source 1..20: mol_type = other DNA
tactaaaacctaaaaataac

SEQ ID NO: 91266 - DNA, 20 bp, synthetic construct
  misc_feature 1..20: note = CRISPR gRNA sequence
  source 1..20: mol_type = other DNA
aaacctaaaaataacgggtg

SEQ ID NO: 91267 - DNA, 20 bp, synthetic construct
  misc_feature 1..20: note = CRISPR gRNA sequence
  source 1..20: mol_type = other DNA
taacgggtgaagtctgttat

SEQ ID NO: 91268 - DNA, 20 bp, synthetic construct
  misc_feature 1..20: note = CRISPR gRNA sequence
  source 1..20: mol_type = other DNA
tattggtgactttgtgtaaa

SEQ ID NO: 91269 - DNA, 20 bp, synthetic construct
  misc_feature 1..20: note = CRISPR gRNA sequence
  source 1..20: mol_type = other DNA
attggtgactttgtgtaaaa

SEQ ID NO: 91270 - DNA, 20 bp, synthetic construct
  misc_feature 1..20: note = CRISPR gRNA sequence
  source 1..20: mol_type = other DNA
aaacaccttctctaatatgc

SEQ ID NO: 91271 - DNA, 20 bp, synthetic construct
  misc_feature 1..20: note = CRISPR gRNA sequence
  source 1..20: mol_type = other DNA
tatactctcttgaaatatgt

SEQ ID NO: 91272 - DNA, 20 bp, synthetic construct
  misc_feature 1..20: note = CRISPR gRNA sequence
  source 1..20: mol_type = other DNA
tcttgaaatatgtaagaaca

SEQ ID NO: 91273 - DNA, 20 bp, synthetic construct
  misc_feature 1..20: note = CRISPR gRNA sequence
  source 1..20: mol_type = other DNA
ttgaaatatgtaagaacaaa

SEQ ID NO: 91274 - DNA, 20 bp, synthetic construct
  misc_feature 1..20: note = CRISPR gRNA sequence
  source 1..20: mol_type = other DNA
atgtaagaacaaagagctaa

SEQ ID NO: 91275 - DNA, 20 bp, synthetic construct
  misc_feature 1..20: note = CRISPR gRNA sequence
  source 1..20: mol_type = other DNA
taagaacaaagagctaaaag

SEQ ID NO: 91276 - DNA, 20 bp, synthetic construct
  misc_feature 1..20: note = CRISPR gRNA sequence
  source 1..20: mol_type = other DNA
agctaaaagtagcactgacc

SEQ ID NO: 91277 - DNA, 20 bp, synthetic construct
  misc_feature 1..20: note = CRISPR gRNA sequence
  source 1..20: mol_type = other DNA
gctaaaagtagcactgaccc

SEQ ID NO: 91278 - DNA, 20 bp, synthetic construct
  misc_feature 1..20: note = CRISPR gRNA sequence
  source 1..20: mol_type = other DNA
gtagcactgacccaggatta

SEQ ID NO: 91279 - DNA, 20 bp, synthetic construct
  misc_feature 1..20: note = CRISPR gRNA sequence
  source 1..20: mol_type = other DNA
cactgacccaggattatagc

SEQ ID NO: 91280 - DNA, 20 bp, synthetic construct
  misc_feature 1..20: note = CRISPR gRNA sequence
  source 1..20: mol_type = other DNA
gattatagcaagaaaaaaaa

SEQ ID NO: 91281 - DNA, 20 bp, synthetic construct
  misc_feature 1..20: note = CRISPR gRNA sequence
  source 1..20: mol_type = other DNA
ttatagcaagaaaaaaaatg

SEQ ID NO: 91282 - DNA, 20 bp, synthetic construct
  misc_feature 1..20: note = CRISPR gRNA sequence
  source 1..20: mol_type = other DNA
aagaaaaaaaatggagatga

SEQ ID NO: 91283 - DNA, 20 bp, synthetic construct
  misc_feature 1..20: note = CRISPR gRNA sequence
  source 1..20: mol_type = other DNA
agaaaaaaaatggagatgaa

SEQ ID NO: 91284 - DNA, 20 bp, synthetic construct
  misc_feature 1..20: note = CRISPR gRNA sequence
  source 1..20: mol_type = other DNA
gaaaaaaaatggagatgaaa

SEQ ID NO: 91285 - DNA, 20 bp, synthetic construct
  misc_feature 1..20: note = CRISPR gRNA sequence
  source 1..20: mol_type = other DNA
aaaaaaaatggagatgaaag

SEQ ID NO: 91286 - DNA, 20 bp, synthetic construct
  misc_feature 1..20: note = CRISPR gRNA sequence
  source 1..20: mol_type = other DNA
aaaaaaatggagatgaaagg

SEQ ID NO: 91287 - DNA, 20 bp, synthetic construct
  misc_feature 1..20: note = CRISPR gRNA sequence
  source 1..20: mol_type = other DNA
aagggggccacatgtgaaaa

SEQ ID NO: 91288 - DNA, 20 bp, synthetic construct
  misc_feature 1..20: note = CRISPR gRNA sequence
  source 1..20: mol_type = other DNA
ggggccacatgtgaaaatag

SEQ ID NO: 91289 - DNA, 20 bp, synthetic construct
  misc_feature 1..20: note = CRISPR gRNA sequence
  source 1..20: mol_type = other DNA
tgaaaatagcagctaaatgc

SEQ ID NO: 91290 - DNA, 20 bp, synthetic construct
  misc_feature 1..20: note = CRISPR gRNA sequence
  source 1..20: mol_type = other DNA
gtttgtacatacatacaaac

SEQ ID NO: 91291 - DNA, 20 bp, synthetic construct
  misc_feature 1..20: note = CRISPR gRNA sequence
  source 1..20: mol_type = other DNA
acatacatacaaactagtgc

SEQ ID NO: 91292 - DNA, 20 bp, synthetic construct
  misc_feature 1..20: note = CRISPR gRNA sequence
  source 1..20: mol_type = other DNA
tacatacaaactagtgctag

SEQ ID NO: 91293 - DNA, 20 bp, synthetic construct
  misc_feature 1..20: note = CRISPR gRNA sequence
  source 1..20: mol_type = other DNA
acaaactagtgctagaagtc

SEQ ID NO: 91294 - DNA, 20 bp, synthetic construct
  misc_feature 1..20: note = CRISPR gRNA sequence
  source 1..20: mol_type = other DNA
ctagaagtcaagtttctcat

SEQ ID NO: 91295 - DNA, 20 bp, synthetic construct
  misc_feature 1..20: note = CRISPR gRNA sequence
  source 1..20: mol_type = other DNA
tagaagtcaagtttctcatt

SEQ ID NO: 91296 - DNA, 20 bp, synthetic construct
  misc_feature 1..20: note = CRISPR gRNA sequence
  source 1..20: mol_type = other DNA
aagtttctcattaggcaact

SEQ ID NO: 91297 - DNA, 20 bp, synthetic construct
  misc_feature 1..20: note = CRISPR gRNA sequence
  source 1..20: mol_type = other DNA
taggcaactaagtcttcata

SEQ ID NO: 91298 - DNA, 20 bp, synthetic construct
  misc_feature 1..20: note = CRISPR gRNA sequence
  source 1..20: mol_type = other DNA
gaaattaaaaattgtgtgta

SEQ ID NO: 91299 - DNA, 20 bp, synthetic construct
  misc_feature 1..20: note = CRISPR gRNA sequence
  source 1..20: mol_type = other DNA
aaattaaaaattgtgtgtat

SEQ ID NO: 91300 - DNA, 20 bp, synthetic construct
  misc_feature 1..20: note = CRISPR gRNA sequence
  source 1..20: mol_type = other DNA
atatatatgtacatatatat

SEQ ID NO: 91301 - DNA, 20 bp, synthetic construct
  misc_feature 1..20: note = CRISPR gRNA sequence
  source 1..20: mol_type = other DNA
atcggtatataccaaaattt

SEQ ID NO: 91302 - DNA, 20 bp, synthetic construct
  misc_feature 1..20: note = CRISPR gRNA sequence
  source 1..20: mol_type = other DNA
tcggtatataccaaaatttc

SEQ ID NO: 91303 - DNA, 20 bp, synthetic construct
  misc_feature 1..20: note = CRISPR gRNA sequence
  source 1..20: mol_type = other DNA
acactcatcactttaaaata

SEQ ID NO: 91304 - DNA, 20 bp, synthetic construct
  misc_feature 1..20: note = CRISPR gRNA sequence
  source 1..20: mol_type = other DNA
taataatataacaaatataa

SEQ ID NO: 91305 - DNA, 20 bp, synthetic construct
  misc_feature 1..20: note = CRISPR gRNA sequence
  source 1..20: mol_type = other DNA
tatgattaacatattattat

SEQ ID NO: 91306 - DNA, 20 bp, synthetic construct
  misc_feature 1..20: note = CRISPR gRNA sequence
  source 1..20: mol_type = other DNA
tgattaacatattattatta

SEQ ID NO: 91307 - DNA, 20 bp, synthetic construct
  misc_feature 1..20: note = CRISPR gRNA sequence
  source 1..20: mol_type = other DNA
taacatattattattagaga

SEQ ID NO: 91308 - DNA, 20 bp, synthetic construct
  misc_feature 1..20: note = CRISPR gRNA sequence
  source 1..20: mol_type = other DNA
aacatattattattagagac

SEQ ID NO: 91309 - DNA, 20 bp, synthetic construct
  misc_feature 1..20: note = CRISPR gRNA sequence
  source 1..20: mol_type = other DNA
acatattattattagagaca

SEQ ID NO: 91310 - DNA, 20 bp, synthetic construct
  misc_feature 1..20: note = CRISPR gRNA sequence
  source 1..20: mol_type = other DNA
tctcactctgttccccacgc

SEQ ID NO: 91311 - DNA, 20 bp, synthetic construct
  misc_feature 1..20: note = CRISPR gRNA sequence
  source 1..20: mol_type = other DNA
tcactctgttccccacgctg

SEQ ID NO: 91312 - DNA, 20 bp, synthetic construct
  misc_feature 1..20: note = CRISPR gRNA sequence
  source 1..20: mol_type = other DNA
ctgttccccacgctggagtg

SEQ ID NO: 91313 - DNA, 20 bp, synthetic construct
  misc_feature 1..20: note = CRISPR gRNA sequence
  source 1..20: mol_type = other DNA
ttccccacgctggagtgcag

SEQ ID NO: 91314 - DNA, 20 bp, synthetic construct
  misc_feature 1..20: note = CRISPR gRNA sequence
  source 1..20: mol_type = other DNA
acgctggagtgcagtggcgt

SEQ ID NO: 91315 - DNA, 20 bp, synthetic construct
  misc_feature 1..20: note = CRISPR gRNA sequence
  source 1..20: mol_type = other DNA
ggagtgcagtggcgtgagca

SEQ ID NO: 91316 - DNA, 20 bp, synthetic construct
  misc_feature 1..20: note = CRISPR gRNA sequence
  source 1..20: mol_type = other DNA
ggcgtgagcatagctcactg

SEQ ID NO: 91317 - DNA, 20 bp, synthetic construct
  misc_feature 1..20: note = CRISPR gRNA sequence
  source 1..20: mol_type = other DNA
cactgcagtcttgaactcct

SEQ ID NO: 91318 - DNA, 20 bp, synthetic construct
  misc_feature 1..20: note = CRISPR gRNA sequence
  source 1..20: mol_type = other DNA
agtcttgaactcctcggctc

SEQ ID NO: 91319 - DNA, 20 bp, synthetic construct
  misc_feature 1..20: note = CRISPR gRNA sequence
  source 1..20: mol_type = other DNA
ctcaagcaatcatcctgcca

SEQ ID NO: 91320 - DNA, 20 bp, synthetic construct
  misc_feature 1..20: note = CRISPR gRNA sequence
  source 1..20: mol_type = other DNA
cctgccacagtctcctgtaa

SEQ ID NO: 91321 - DNA, 20 bp, synthetic construct
  misc_feature 1..20: note = CRISPR gRNA sequence
  source 1..20: mol_type = other DNA
ctgccacagtctcctgtaat

SEQ ID NO: 91322 - DNA, 20 bp, synthetic construct
  misc_feature 1..20: note = CRISPR gRNA sequence
  source 1..20: mol_type = other DNA
aaaatacttacataaattta

SEQ ID NO: 91323 - DNA, 20 bp, synthetic construct
  misc_feature 1..20: note = CRISPR gRNA sequence
  source 1..20: mol_type = other DNA
aatacttacataaatttata

SEQ ID NO: 91324 - DNA, 20 bp, synthetic construct
  misc_feature 1..20: note = CRISPR gRNA sequence
  source 1..20: mol_type = other DNA
tttatagagaaaaaaatctt

SEQ ID NO: 91325 - DNA, 20 bp, synthetic construct
  misc_feature 1..20: note = CRISPR gRNA sequence
  source 1..20: mol_type = other DNA
aaaaaatctttggccccaat

SEQ ID NO: 91326 - DNA, 20 bp, synthetic construct
  misc_feature 1..20: note = CRISPR gRNA sequence
  source 1..20: mol_type = other DNA
tggccccaataagctgcaaa

SEQ ID NO: 91327 - DNA, 20 bp, synthetic construct
  misc_feature 1..20: note = CRISPR gRNA sequence
  source 1..20: mol_type = other DNA
gcaaaaagataaactgaata

SEQ ID NO: 91328 - DNA, 20 bp, synthetic construct
  misc_feature 1..20: note = CRISPR gRNA sequence
  source 1..20: mol_type = other DNA
tatcattaaatactgacttt

SEQ ID NO: 91329 - DNA, 20 bp, synthetic construct
  misc_feature 1..20: note = CRISPR gRNA sequence
  source 1..20: mol_type = other DNA
agattatatgtattatatct

SEQ ID NO: 91330 - DNA, 20 bp, synthetic construct
  misc_feature 1..20: note = CRISPR gRNA sequence
  source 1..20: mol_type = other DNA
tacattttctatttattaaa

SEQ ID NO: 91331 - DNA, 20 bp, synthetic construct
  misc_feature 1..20: note = CRISPR gRNA sequence
  source 1..20: mol_type = other DNA
gttttatttaaaaatcatct

SEQ ID NO: 91332 - DNA, 20 bp, synthetic construct
  misc_feature 1..20: note = CRISPR gRNA sequence
  source 1..20: mol_type = other DNA
cttagctgttatgacactgt

SEQ ID NO: 91333 - DNA, 20 bp, synthetic construct
  misc_feature 1..20: note = CRISPR gRNA sequence
  source 1..20: mol_type = other DNA
ttatgacactgttggacatt

SEQ ID NO: 91334 - DNA, 20 bp, synthetic construct
  misc_feature 1..20: note = CRISPR gRNA sequence
  source 1..20: mol_type = other DNA
tatgacactgttggacattt

SEQ ID NO: 91335 - DNA, 20 bp, synthetic construct
  misc_feature 1..20: note = CRISPR gRNA sequence
  source 1..20: mol_type = other DNA
ctaccttttttactatttat

SEQ ID NO: 91336 - DNA, 20 bp, synthetic construct
  misc_feature 1..20: note = CRISPR gRNA sequence
  source 1..20: mol_type = other DNA
atttatgagaaatatattcc

SEQ ID NO: 91337 - DNA, 20 bp, synthetic construct
  misc_feature 1..20: note = CRISPR gRNA sequence
  source 1..20: mol_type = other DNA
tgtttaactctatccatatt

SEQ ID NO: 91338 - DNA, 20 bp, synthetic construct
  misc_feature 1..20: note = CRISPR gRNA sequence
  source 1..20: mol_type = other DNA
gtttaactctatccatattt

SEQ ID NO: 91339 - DNA, 20 bp, synthetic construct
  misc_feature 1..20: note = CRISPR gRNA sequence
  source 1..20: mol_type = other DNA
tcatattaaatgtgatgtct

SEQ ID NO: 91340 - DNA, 20 bp, synthetic construct
  misc_feature 1..20: note = CRISPR gRNA sequence
  source 1..20: mol_type = other DNA
aaatgtgatgtctgagttga

SEQ ID NO: 91341 - DNA, 20 bp, synthetic construct
  misc_feature 1..20: note = CRISPR gRNA sequence
  source 1..20: mol_type = other DNA
aatgtgatgtctgagttgaa

SEQ ID NO: 91342 - DNA, 20 bp, synthetic construct
  misc_feature 1..20: note = CRISPR gRNA sequence
  source 1..20: mol_type = other DNA
atgtgatgtctgagttgaaa

SEQ ID NO: 91343 - DNA, 20 bp, synthetic construct
  misc_feature 1..20: note = CRISPR gRNA sequence
  source 1..20: mol_type = other DNA
gagttgaaagggatgactcc

SEQ ID NO: 91344 - DNA, 20 bp, synthetic construct
  misc_feature 1..20: note = CRISPR gRNA sequence
  source 1..20: mol_type = other DNA
attgcccaactgctttctga

SEQ ID NO: 91345 - DNA, 20 bp, synthetic construct
  misc_feature 1..20: note = CRISPR gRNA sequence
  source 1..20: mol_type = other DNA
tataatgccattaactactt

SEQ ID NO: 91346 - DNA, 20 bp, synthetic construct
  misc_feature 1..20: note = CRISPR gRNA sequence
  source 1..20: mol_type = other DNA
tgagaatgtccatttcatga

SEQ ID NO: 91347 - DNA, 20 bp, synthetic construct
  misc_feature 1..20: note = CRISPR gRNA sequence
  source 1..20: mol_type = other DNA
tacctttccatatcatttaa

SEQ ID NO: 91348 - DNA, 20 bp, synthetic construct
  misc_feature 1..20: note = CRISPR gRNA sequence
  source 1..20: mol_type = other DNA
ctatcttttgcaatgtattg

SEQ ID NO: 91349 - DNA, 20 bp, synthetic construct
  misc_feature 1..20: note = CRISPR gRNA sequence
  source 1..20: mol_type = other DNA
tttgcaatgtattgaagcca

SEQ ID NO: 91350 - DNA, 20 bp, synthetic construct
  misc_feature 1..20: note = CRISPR gRNA sequence
  source 1..20: mol_type = other DNA
ttgcaatgtattgaagccaa

SEQ ID NO: 91351 - DNA, 20 bp, synthetic construct
  misc_feature 1..20: note = CRISPR gRNA sequence
  source 1..20: mol_type = other DNA
aggttttcctcatcaaatta

SEQ ID NO: 91352 - DNA, 20 bp, synthetic construct
  misc_feature 1..20: note = CRISPR gRNA sequence
  source 1..20: mol_type = other DNA
ggttttcctcatcaaattac

SEQ ID NO: 91353 - DNA, 20 bp, synthetic construct
  misc_feature 1..20: note = CRISPR gRNA sequence
  source 1..20: mol_type = other DNA
tttgtaataaactttctttg

SEQ ID NO: 91354 - DNA, 20 bp, synthetic construct
  misc_feature 1..20: note = CRISPR gRNA sequence
  source 1..20: mol_type = other DNA
aataaactttctttgcagtt

SEQ ID NO: 91355 - DNA, 20 bp, synthetic construct
  misc_feature 1..20: note = CRISPR gRNA sequence
  source 1..20: mol_type = other DNA
tttctttgcagttaagactg

SEQ ID NO: 91356 - DNA, 20 bp, synthetic construct
  misc_feature 1..20: note = CRISPR gRNA sequence
  source 1..20: mol_type = other DNA
agttaagactgaagctgtca

SEQ ID NO: 91357 - DNA, 20 bp, synthetic construct
  misc_feature 1..20: note = CRISPR gRNA sequence
  source 1..20: mol_type = other DNA
ttaagactgaagctgtcaaa

SEQ ID NO: 91358 - DNA, 20 bp, synthetic construct
  misc_feature 1..20: note = CRISPR gRNA sequence
  source 1..20: mol_type = other DNA
taagactgaagctgtcaaag

SEQ ID NO: 91359 - DNA, 20 bp, synthetic construct
  misc_feature 1..20: note = CRISPR gRNA sequence
  source 1..20: mol_type = other DNA
aacatattttatatatatgt

SEQ ID NO: 91360 - DNA, 20 bp, synthetic construct
  misc_feature 1..20: note = CRISPR gRNA sequence
  source 1..20: mol_type = other DNA
acatattttatatatatgta

SEQ ID NO: 91361 - DNA, 20 bp, synthetic construct
  misc_feature 1..20: note = CRISPR gRNA sequence
  source 1..20: mol_type = other DNA
tgatcatgtttaatgattta

SEQ ID NO: 91362 - DNA, 20 bp, synthetic construct
  misc_feature 1..20: note = CRISPR gRNA sequence
  source 1..20: mol_type = other DNA
gatcatgtttaatgatttat

SEQ ID NO: 91363 - DNA, 20 bp, synthetic construct
  misc_feature 1..20: note = CRISPR gRNA sequence
  source 1..20: mol_type = other DNA
atcatgtttaatgatttata

SEQ ID NO: 91364 - DNA, 20 bp, synthetic construct
  misc_feature 1..20: note = CRISPR gRNA sequence
  source 1..20: mol_type = other DNA
ttatagggtgctctgttgcc

SEQ ID NO: 91365 - DNA, 20 bp, synthetic construct
  misc_feature 1..20: note = CRISPR gRNA sequence
  source 1..20: mol_type = other DNA
tatagggtgctctgttgcct

SEQ ID NO: 91366 - DNA, 20 bp, synthetic construct
  misc_feature 1..20: note = CRISPR gRNA sequence
  source 1..20: mol_type = other DNA
gggtgctctgttgcctaggc

SEQ ID NO: 91367 - DNA, 20 bp, synthetic construct
  misc_feature 1..20: note = CRISPR gRNA sequence
  source 1..20: mol_type = other DNA
gtgctctgttgcctaggctg

SEQ ID NO: 91368 - DNA, 20 bp, synthetic construct
  misc_feature 1..20: note = CRISPR gRNA sequence
  source 1..20: mol_type = other DNA
ctgttgcctaggctggagta

SEQ ID NO: 91369 - DNA, 20 bp, synthetic construct
  misc_feature 1..20: note = CRISPR gRNA sequence
  source 1..20: mol_type = other DNA
ttgcctaggctggagtacag

SEQ ID NO: 91370 - DNA, 20 bp, synthetic construct
  misc_feature 1..20: note = CRISPR gRNA sequence
  source 1..20: mol_type = other DNA
ggagtacagtggtatgatca

SEQ ID NO: 91371 - DNA, 20 bp, synthetic construct
  misc_feature 1..20: note = CRISPR gRNA sequence
  source 1..20: mol_type = other DNA
ggtatgatcatagctcattg

SEQ ID NO: 91372 - DNA, 20 bp, synthetic construct
  misc_feature 1..20: note = CRISPR gRNA sequence
  source 1..20: mol_type = other DNA
tcattgcagcctcgaattcc

SEQ ID NO: 91373 - DNA, 20 bp, synthetic construct
  misc_feature 1..20: note = CRISPR gRNA sequence
  source 1..20: mol_type = other DNA
agcctcgaattcctggactc

SEQ ID NO: 91374 - DNA, 20 bp, synthetic construct
  misc_feature 1..20: note = CRISPR gRNA sequence
  source 1..20: mol_type = other DNA
ctcaagcaatcctcctgttt

SEQ ID NO: 91375 - DNA, 20 bp, synthetic construct
  misc_feature 1..20: note = CRISPR gRNA sequence
  source 1..20: mol_type = other DNA
tcctcctgtttcagcctctt

SEQ ID NO: 91376 - DNA, 20 bp, synthetic construct
  misc_feature 1..20: note = CRISPR gRNA sequence
  source 1..20: mol_type = other DNA
tcctgtttcagcctcttgag

SEQ ID NO: 91377 - DNA, 20 bp, synthetic construct
  misc_feature 1..20: note = CRISPR gRNA sequence
  source 1..20: mol_type = other DNA
gtttcagcctcttgagtagc

SEQ ID NO: 91378 - DNA, 20 bp, synthetic construct
  misc_feature 1..20: note = CRISPR gRNA sequence
  source 1..20: mol_type = other DNA
tttcagcctcttgagtagcc

SEQ ID NO: 91379 - DNA, 20 bp, synthetic construct
  misc_feature 1..20: note = CRISPR gRNA sequence
  source 1..20: mol_type = other DNA
ctcttgagtagccaggacta

SEQ ID NO: 91380 - DNA, 20 bp, synthetic construct
  misc_feature 1..20: note = CRISPR gRNA sequence
  source 1..20: mol_type = other DNA
cagctacataccatcacact

SEQ ID NO: 91381 - DNA, 20 bp, synthetic construct
  misc_feature 1..20: note = CRISPR gRNA sequence
  source 1..20: mol_type = other DNA
ctaatttttaaatttttttg

SEQ ID NO: 91382 - DNA, 20 bp, synthetic construct
  misc_feature 1..20: note = CRISPR gRNA sequence
  source 1..20: mol_type = other DNA
tttttaaatttttttgtaga

SEQ ID NO: 91383 - DNA, 20 bp, synthetic construct
  misc_feature 1..20: note = CRISPR gRNA sequence
  source 1..20: mol_type = other DNA
ttttaaatttttttgtagat

SEQ ID NO: 91384 - DNA, 20 bp, synthetic construct
  misc_feature 1..20: note = CRISPR gRNA sequence
  source 1..20: mol_type = other DNA
tttaaatttttttgtagatg

SEQ ID NO: 91385 - DNA, 20 bp, synthetic construct
  misc_feature 1..20: note = CRISPR gRNA sequence
  source 1..20: mol_type = other DNA
tggggtctcgctacgttgcc

SEQ ID NO: 91386 - DNA, 20 bp, synthetic construct
  misc_feature 1..20: note = CRISPR gRNA sequence
  source 1..20: mol_type = other DNA
tctcgctacgttgcccagaa

SEQ ID NO: 91387 - DNA, 20 bp, synthetic construct
  misc_feature 1..20: note = CRISPR gRNA sequence
  source 1..20: mol_type = other DNA
ccagaatggtctcaaattcc

SEQ ID NO: 91388 - DNA, 20 bp, synthetic construct
  misc_feature 1..20: note = CRISPR gRNA sequence
  source 1..20: mol_type = other DNA
ggtctcaaattcccagcctc

SEQ ID NO: 91389 - DNA, 20 bp, synthetic construct
  misc_feature 1..20: note = CRISPR gRNA sequence
  source 1..20: mol_type = other DNA
cctcaagtgatcctcccacc

SEQ ID NO: 91390 - DNA, 20 bp, synthetic construct
  misc_feature 1..20: note = CRISPR gRNA sequence
  source 1..20: mol_type = other DNA
tcctcccacctggcctccca

SEQ ID NO: 91391 - DNA, 20 bp, synthetic construct
  misc_feature 1..20: note = CRISPR gRNA sequence
  source 1..20: mol_type = other DNA
cacctggcctcccaaagtgc

SEQ ID NO: 91392 - DNA, 20 bp, synthetic construct
  misc_feature 1..20: note = CRISPR gRNA sequence
  source 1..20: mol_type = other DNA
acctggcctcccaaagtgct

SEQ ID NO: 91393 - DNA, 20 bp, synthetic construct
  misc_feature 1..20: note = CRISPR gRNA sequence
  source 1..20: mol_type = other DNA
ctcccaaagtgctaggatta

SEQ ID NO: 91394 - DNA, 20 bp, synthetic construct
  misc_feature 1..20: note = CRISPR gRNA sequence
  source 1..20: mol_type = other DNA
tcccaaagtgctaggattac

SEQ ID NO: 91395 - DNA, 20 bp, synthetic construct
  misc_feature 1..20: note = CRISPR gRNA sequence
  source 1..20: mol_type = other DNA
catgaaccacaatgcccaac

SEQ ID NO: 91396 - DNA, 20 bp, synthetic construct
  misc_feature 1..20: note = CRISPR gRNA sequence
  source 1..20: mol_type = other DNA
atgaaccacaatgcccaacc

SEQ ID NO: 91397 - DNA, 20 bp, synthetic construct
  misc_feature 1..20: note = CRISPR gRNA sequence
  source 1..20: mol_type = other DNA
tattttatgtgataaaatac

SEQ ID NO: 91398 - DNA, 20 bp, synthetic construct
  misc_feature 1..20: note = CRISPR gRNA sequence
  source 1..20: mol_type = other DNA
aataccagacacgttaacca

SEQ ID NO: 91399 - DNA, 20 bp, synthetic construct
  misc_feature 1..20: note = CRISPR gRNA sequence
  source 1..20: mol_type = other DNA
tgttgtacatatttttgctc

SEQ ID NO: 91400 - DNA, 20 bp, synthetic construct
  misc_feature 1..20: note = CRISPR gRNA sequence
  source 1..20: mol_type = other DNA
gttgtacatatttttgctct

SEQ ID NO: 91401 - DNA, 20 bp, synthetic construct
  misc_feature 1..20: note = CRISPR gRNA sequence
  source 1..20: mol_type = other DNA
tttgccaccatttttgacta

SEQ ID NO: 91402 - DNA, 20 bp, synthetic construct
  misc_feature 1..20: note = CRISPR gRNA sequence
  source 1..20: mol_type = other DNA
ctatagcattcatttttatg

SEQ ID NO: 91403 - DNA, 20 bp, synthetic construct
  misc_feature 1..20: note = CRISPR gRNA sequence
  source 1..20: mol_type = other DNA
gcattcatttttatgtagtc

SEQ ID NO: 91404 - DNA, 20 bp, synthetic construct
  misc_feature 1..20: note = CRISPR gRNA sequence
  source 1..20: mol_type = other DNA
ctctgtgattttgtctatat

SEQ ID NO: 91405 - DNA, 20 bp, synthetic construct
  misc_feature 1..20: note = CRISPR gRNA sequence
  source 1..20: mol_type = other DNA
aaaaatctcattacattttt

SEQ ID NO: 91406 - DNA, 20 bp, synthetic construct
  misc_feature 1..20: note = CRISPR gRNA sequence
  source 1..20: mol_type = other DNA
aaaatctcattacatttttg

SEQ ID NO: 91407 - DNA, 20 bp, synthetic construct
  misc_feature 1..20: note = CRISPR gRNA sequence
  source 1..20: mol_type = other DNA
ctcattacatttttgaggta

SEQ ID NO: 91408 - DNA, 20 bp, synthetic construct
  misc_feature 1..20: note = CRISPR gRNA sequence
  source 1..20: mol_type = other DNA
tttttaaaattttgacttat

SEQ ID NO: 91409 - DNA, 20 bp, synthetic construct
  misc_feature 1..20: note = CRISPR gRNA sequence
  source 1..20: mol_type = other DNA
ttttaaaattttgacttatt

SEQ ID NO: 91410 - DNA, 20 bp, synthetic construct
  misc_feature 1..20: note = CRISPR gRNA sequence
  source 1..20: mol_type = other DNA
taggaatttattttgatgta

SEQ ID NO: 91411 - DNA, 20 bp, synthetic construct
  misc_feature 1..20: note = CRISPR gRNA sequence
  source 1..20: mol_type = other DNA
gatgtatagtgtgatgtcat

SEQ ID NO: 91412 - DNA, 20 bp, synthetic construct
  misc_feature 1..20: note = CRISPR gRNA sequence
  source 1..20: mol_type = other DNA
atttataactgatttacaaa

SEQ ID NO: 91413 - DNA, 20 bp, synthetic construct
  misc_feature 1..20: note = CRISPR gRNA sequence
  source 1..20: mol_type = other DNA
atttacaaacagatatttac

SEQ ID NO: 91414 - DNA, 20 bp, synthetic construct
  misc_feature 1..20: note = CRISPR gRNA sequence
  source 1..20: mol_type = other DNA
tgatttaacacttgttctaa

SEQ ID NO: 91415 - DNA, 20 bp, synthetic construct
  misc_feature 1..20: note = CRISPR gRNA sequence
  source 1..20: mol_type = other DNA
atttaacacttgttctaaaa

SEQ ID NO: 91416 - DNA, 20 bp, synthetic construct
  misc_feature 1..20: note = CRISPR gRNA sequence
  source 1..20: mol_type = other DNA
taacacttgttctaaaagag

SEQ ID NO: 91417 - DNA, 20 bp, synthetic construct
  misc_feature 1..20: note = CRISPR gRNA sequence
  source 1..20: mol_type = other DNA
aacacttgttctaaaagagt

SEQ ID NO: 91418 - DNA, 20 bp, synthetic construct
  misc_feature 1..20: note = CRISPR gRNA sequence
  source 1..20: mol_type = other DNA
ttctaaaagagtaggtcttg

SEQ ID NO: 91419 - DNA, 20 bp, synthetic construct
  misc_feature 1..20: note = CRISPR gRNA sequence
  source 1..20: mol_type = other DNA
tctaaaagagtaggtcttgc

SEQ ID NO: 91420 - DNA, 20 bp, synthetic construct
  misc_feature 1..20: note = CRISPR gRNA sequence
  source 1..20: mol_type = other DNA
tcttgcaggacgatccccaa

SEQ ID NO: 91421 - DNA, 20 bp, synthetic construct
  misc_feature 1..20: note = CRISPR gRNA sequence
  source 1..20: mol_type = other DNA
tcctgttctttgtttaacaa

SEQ ID NO: 91422 - DNA, 20 bp, synthetic construct
  misc_feature 1..20: note = CRISPR gRNA sequence
  source 1..20: mol_type = other DNA
ctgttctttgtttaacaatg

SEQ ID NO: 91423 - DNA, 20 bp, synthetic construct
  misc_feature 1..20: note = CRISPR gRNA sequence
  source 1..20: mol_type = other DNA
gttctttgtttaacaatgga

SEQ ID NO: 91424 - DNA, 20 bp, synthetic construct
  misc_feature 1..20: note = CRISPR gRNA sequence
  source 1..20: mol_type = other DNA
gtatgttatctgcactttcc

SEQ ID NO: 91425 - DNA, 20 bp, synthetic construct
  misc_feature 1..20: note = CRISPR gRNA sequence
  source 1..20: mol_type = other DNA
tatgttatctgcactttcct

SEQ ID NO: 91426 - DNA, 20 bp, synthetic construct
  misc_feature 1..20: note = CRISPR gRNA sequence
  source 1..20: mol_type = other DNA
ataaatgataaaaatgcaaa

SEQ ID NO: 91427 - DNA, 20 bp, synthetic construct
  misc_feature 1..20: note = CRISPR gRNA sequence
  source 1..20: mol_type = other DNA
taaaaatgcaaatagataaa

SEQ ID NO: 91428 - DNA, 20 bp, synthetic construct
  misc_feature 1..20: note = CRISPR gRNA sequence
  source 1..20: mol_type = other DNA
agataaacagttaacgtaat

SEQ ID NO: 91429 - DNA, 20 bp, synthetic construct
  misc_feature 1..20: note = CRISPR gRNA sequence
  source 1..20: mol_type = other DNA
aacgtaataagtcatgatta

SEQ ID NO: 91430 - DNA, 20 bp, synthetic construct
  misc_feature 1..20: note = CRISPR gRNA sequence
  source 1..20: mol_type = other DNA
acgtaataagtcatgattac

SEQ ID NO: 91431 - DNA, 20 bp, synthetic construct
  misc_feature 1..20: note = CRISPR gRNA sequence
  source 1..20: mol_type = other DNA
tcatgattacaggtatttca

SEQ ID NO: 91432 - DNA, 20 bp, synthetic construct
  misc_feature 1..20: note = CRISPR gRNA sequence
  source 1..20: mol_type = other DNA
tatttcaaagatgtaatgaa

SEQ ID NO: 91433 - DNA, 20 bp, synthetic construct
  misc_feature 1..20: note = CRISPR gRNA sequence
  source 1..20: mol_type = other DNA
atttcaaagatgtaatgaac

SEQ ID NO: 91434 - DNA, 20 bp, synthetic construct
  misc_feature 1..20: note = CRISPR gRNA sequence
  source 1..20: mol_type = other DNA
atttcttccttcttcttgcc

SEQ ID NO: 91435 - DNA, 20 bp, synthetic construct
  misc_feature 1..20: note = CRISPR gRNA sequence
  source 1..20: mol_type = other DNA
ccttcttcttgcccagtctc

SEQ ID NO: 91436 - DNA, 20 bp, synthetic construct
  misc_feature 1..20: note = CRISPR gRNA sequence
  source 1..20: mol_type = other DNA
cttcttcttgcccagtctct

SEQ ID NO: 91437 - DNA, 20 bp, synthetic construct
  misc_feature 1..20: note = CRISPR gRNA sequence
  source 1..20: mol_type = other DNA
gcccagtctctgggcaactc

SEQ ID NO: 91438 - DNA, 20 bp, synthetic construct
  misc_feature 1..20: note = CRISPR gRNA sequence
  source 1..20: mol_type = other DNA
cccagtctctgggcaactct

SEQ ID NO: 91439 - DNA, 20 bp, synthetic construct
  misc_feature 1..20: note = CRISPR gRNA sequence
  source 1..20: mol_type = other DNA
gtctctgggcaactctggga

SEQ ID NO: 91440 - DNA, 20 bp, synthetic construct
  misc_feature 1..20: note = CRISPR gRNA sequence
  source 1..20: mol_type = other DNA
gggaaagttcttcattatca

SEQ ID NO: 91441 - DNA, 20 bp, synthetic construct
  misc_feature 1..20: note = CRISPR gRNA sequence
  source 1..20: mol_type = other DNA
ggaaagttcttcattatcat

SEQ ID NO: 91442 - DNA, 20 bp, synthetic construct
  misc_feature 1..20: note = CRISPR gRNA sequence
  source 1..20: mol_type = other DNA
gttcttcattatcataggca

SEQ ID NO: 91443 - DNA, 20 bp, synthetic construct
  misc_feature 1..20: note = CRISPR gRNA sequence
  source 1..20: mol_type = other DNA
cattatcataggcaaagtat

SEQ ID NO: 91444 - DNA, 20 bp, synthetic construct
  misc_feature 1..20: note = CRISPR gRNA sequence
  source 1..20: mol_type = other DNA
tatcataggcaaagtattgg

SEQ ID NO: 91445 - DNA, 20 bp, synthetic construct
  misc_feature 1..20: note = CRISPR gRNA sequence
  source 1..20: mol_type = other DNA
ctcctcgctccctctccccc

SEQ ID NO: 91446 - DNA, 20 bp, synthetic construct
  misc_feature 1..20: note = CRISPR gRNA sequence
  source 1..20: mol_type = other DNA
ctccccccagattttcaacc

SEQ ID NO: 91447 - DNA, 20 bp, synthetic construct
  misc_feature 1..20: note = CRISPR gRNA sequence
  source 1..20: mol_type = other DNA
tccccccagattttcaacct

SEQ ID NO: 91448 - DNA, 20 bp, synthetic construct
  misc_feature 1..20: note = CRISPR gRNA sequence
  source 1..20: mol_type = other DNA
gattttcaacctgggttctt

SEQ ID NO: 91449 - DNA, 20 bp, synthetic construct
  misc_feature 1..20: note = CRISPR gRNA sequence
  source 1..20: mol_type = other DNA
acctgggttctttagtctct

SEQ ID NO: 91450 - DNA, 20 bp, synthetic construct
  misc_feature 1..20: note = CRISPR gRNA sequence
  source 1..20: mol_type = other DNA
tgggttctttagtctcttgg

SEQ ID NO: 91451 - DNA, 20 bp, synthetic construct
  misc_feature 1..20: note = CRISPR gRNA sequence
  source 1..20: mol_type = other DNA
gggttctttagtctcttggc

SEQ ID NO: 91452 - DNA, 20 bp, synthetic construct
  misc_feature 1..20: note = CRISPR gRNA sequence
  source 1..20: mol_type = other DNA
ttggcaggtctcaaaattaa

SEQ ID NO: 91453 - DNA, 20 bp, synthetic construct
  misc_feature 1..20: note = CRISPR gRNA sequence
  source 1..20: mol_type = other DNA
aaaattaatagtgtgtgtga

SEQ ID NO: 91454 - DNA, 20 bp, synthetic construct
  misc_feature 1..20: note = CRISPR gRNA sequence
  source 1..20: mol_type = other DNA
aattaatagtgtgtgtgata

SEQ ID NO: 91455 - DNA, 20 bp, synthetic construct
  misc_feature 1..20: note = CRISPR gRNA sequence
  source 1..20: mol_type = other DNA
gtgtgtgatagagtgtgata

SEQ ID NO: 91456 - DNA, 20 bp, synthetic construct
  misc_feature 1..20: note = CRISPR gRNA sequence
  source 1..20: mol_type = other DNA
gtgtgatatagtaatactgt

SEQ ID NO: 91457 - DNA, 20 bp, synthetic construct
  misc_feature 1..20: note = CRISPR gRNA sequence
  source 1..20: mol_type = other DNA
gtgatatagtaatactgtga

SEQ ID NO: 91458 - DNA, 20 bp, synthetic construct
  misc_feature 1..20: note = CRISPR gRNA sequence
  source 1..20: mol_type = other DNA
tgatatagtaatactgtgag

SEQ ID NO: 91459 - DNA, 20 bp, synthetic construct
  misc_feature 1..20: note = CRISPR gRNA sequence
  source 1..20: mol_type = other DNA
tatagtaatactgtgagagg

SEQ ID NO: 91460 - DNA, 20 bp, synthetic construct
  misc_feature 1..20: note = CRISPR gRNA sequence
  source 1..20: mol_type = other DNA
atagtaatactgtgagaggt

SEQ ID NO: 91461 - DNA, 20 bp, synthetic construct
  misc_feature 1..20: note = CRISPR gRNA sequence
  source 1..20: mol_type = other DNA
actgtgagaggtgggccact

SEQ ID NO: 91462 - DNA, 20 bp, synthetic construct
  misc_feature 1..20: note = CRISPR gRNA sequence
  source 1..20: mol_type = other DNA
agaggtgggccactaagatt

SEQ ID NO: 91463 - DNA, 20 bp, synthetic construct
  misc_feature 1..20: note = CRISPR gRNA sequence
  source 1..20: mol_type = other DNA
gaggtgggccactaagattg

SEQ ID NO: 91464 - DNA, 20 bp, synthetic construct
  misc_feature 1..20: note = CRISPR gRNA sequence
  source 1..20: mol_type = other DNA
gtgggccactaagattgagg

SEQ ID NO: 91465 - DNA, 20 bp, synthetic construct
  misc_feature 1..20: note = CRISPR gRNA sequence
  source 1..20: mol_type = other DNA
gggccactaagattgaggca

SEQ ID NO: 91466 - DNA, 20 bp, synthetic construct
  misc_feature 1..20: note = CRISPR gRNA sequence
  source 1..20: mol_type = other DNA
attgaggcagagttacttgt

SEQ ID NO: 91467 - DNA, 20 bp, synthetic construct
  misc_feature 1..20: note = CRISPR gRNA sequence
  source 1..20: mol_type = other DNA
tcaatattacaaaaaatgcc

SEQ ID NO: 91468 - DNA, 20 bp, synthetic construct
  misc_feature 1..20: note = CRISPR gRNA sequence
  source 1..20: mol_type = other DNA
atattacaaaaaatgccaag

SEQ ID NO: 91469 - DNA, 20 bp, synthetic construct
  misc_feature 1..20: note = CRISPR gRNA sequence
  source 1..20: mol_type = other DNA
tctctttatataatgctatc

SEQ ID NO: 91470 - DNA, 20 bp, synthetic construct
  misc_feature 1..20: note = CRISPR gRNA sequence
  source 1..20: mol_type = other DNA
ctctttatataatgctatcc

SEQ ID NO: 91471 - DNA, 20 bp, synthetic construct
  misc_feature 1..20: note = CRISPR gRNA sequence
  source 1..20: mol_type = other DNA
aaacataatctgcttgcctt

SEQ ID NO: 91472 - DNA, 20 bp, synthetic construct
  misc_feature 1..20: note = CRISPR gRNA sequence
  source 1..20: mol_type = other DNA
ttggatgaaatatatgaact

SEQ ID NO: 91473 - DNA, 20 bp, synthetic construct
  misc_feature 1..20: note = CRISPR gRNA sequence
  source 1..20: mol_type = other DNA
ggatgaaatatatgaactca

SEQ ID NO: 91474 - DNA, 20 bp, synthetic construct
  misc_feature 1..20: note = CRISPR gRNA sequence
  source 1..20: mol_type = other DNA
gatgaaatatatgaactcag

SEQ ID NO: 91475 - DNA, 20 bp, synthetic construct
  misc_feature 1..20: note = CRISPR gRNA sequence
  source 1..20: mol_type = other DNA
caaattatatactgctcaat

SEQ ID NO: 91476 - DNA, 20 bp, synthetic construct
  misc_feature 1..20: note = CRISPR gRNA sequence
  source 1..20: mol_type = other DNA
ctgctcaataagatatctga

SEQ ID NO: 91477 - DNA, 20 bp, synthetic construct
  misc_feature 1..20: note = CRISPR gRNA sequence
  source 1..20: mol_type = other DNA
atatctgatagctttttacc

SEQ ID NO: 91478 - DNA, 20 bp, synthetic construct
  misc_feature 1..20: note = CRISPR gRNA sequence
  source 1..20: mol_type = other DNA
ctgatagctttttacccagt

SEQ ID NO: 91479 - DNA, 20 bp, synthetic construct
  misc_feature 1..20: note = CRISPR gRNA sequence
  source 1..20: mol_type = other DNA
cagttggcaaccaaaacaaa

SEQ ID NO: 91480 - DNA, 20 bp, synthetic construct
  misc_feature 1..20: note = CRISPR gRNA sequence
  source 1..20: mol_type = other DNA
agttggcaaccaaaacaaat

SEQ ID NO: 91481 - DNA, 20 bp, synthetic construct
  misc_feature 1..20: note = CRISPR gRNA sequence
  source 1..20: mol_type = other DNA
gttggcaaccaaaacaaatg

SEQ ID NO: 91482 - DNA, 20 bp, synthetic construct
  misc_feature 1..20: note = CRISPR gRNA sequence
  source 1..20: mol_type = other DNA
ttggcaaccaaaacaaatgg

SEQ ID NO: 91483 - DNA, 20 bp, synthetic construct
  misc_feature 1..20: note = CRISPR gRNA sequence
  source 1..20: mol_type = other DNA
ggcaaccaaaacaaatgggg

SEQ ID NO: 91484 - DNA, 20 bp, synthetic construct
  misc_feature 1..20: note = CRISPR gRNA sequence
  source 1..20: mol_type = other DNA
aaccaaaacaaatgggggag

SEQ ID NO: 91485 - DNA, 20 bp, synthetic construct
  misc_feature 1..20: note = CRISPR gRNA sequence
  source 1..20: mol_type = other DNA
gagtagtaaaatattgttta

SEQ ID NO: 91486 - DNA, 20 bp, synthetic construct
  misc_feature 1..20: note = CRISPR gRNA sequence
  source 1..20: mol_type = other DNA
tagtaaaatattgtttaaag

SEQ ID NO: 91487 - DNA, 20 bp, synthetic construct
  misc_feature 1..20: note = CRISPR gRNA sequence
  source 1..20: mol_type = other DNA
aaagaagcaactgataacca

SEQ ID NO: 91488 - DNA, 20 bp, synthetic construct
  misc_feature 1..20: note = CRISPR gRNA sequence
  source 1..20: mol_type = other DNA
taaccaaagctttcaaaatt

SEQ ID NO: 91489 - DNA, 20 bp, synthetic construct
  misc_feature 1..20: note = CRISPR gRNA sequence
  source 1..20: mol_type = other DNA
ttagataaacttgcttgaaa

SEQ ID NO: 91490 - DNA, 20 bp, synthetic construct
  misc_feature 1..20: note = CRISPR gRNA sequence
  source 1..20: mol_type = other DNA
aaacttgcttgaaaaagcac

SEQ ID NO: 91491 - DNA, 20 bp, synthetic construct
  misc_feature 1..20: note = CRISPR gRNA sequence
  source 1..20: mol_type = other DNA
tgaaaaagcactagtataaa

SEQ ID NO: 91492 - DNA, 20 bp, synthetic construct
  misc_feature 1..20: note = CRISPR gRNA sequence
  source 1..20: mol_type = other DNA
tgccaactgtatgaacaaaa

SEQ ID NO: 91493 - DNA, 20 bp, synthetic construct
  misc_feature 1..20: note = CRISPR gRNA sequence
  source 1..20: mol_type = other DNA
gccaactgtatgaacaaaac

SEQ ID NO: 91494 - DNA, 20 bp, synthetic construct
  misc_feature 1..20: note = CRISPR gRNA sequence
  source 1..20: mol_type = other DNA
actgtatgaacaaaacaggt

SEQ ID NO: 91495 - DNA, 20 bp, synthetic construct
  misc_feature 1..20: note = CRISPR gRNA sequence
  source 1..20: mol_type = other DNA
taaaatgataccattaccct

SEQ ID NO: 91496 - DNA, 20 bp, synthetic construct
  misc_feature 1..20: note = CRISPR gRNA sequence
  source 1..20: mol_type = other DNA
tcactgcccaaaaacaaaat

SEQ ID NO: 91497 - DNA, 20 bp, synthetic construct
  misc_feature 1..20: note = CRISPR gRNA sequence
  source 1..20: mol_type = other DNA
ctgcccaaaaacaaaatcag

SEQ ID NO: 91498 - DNA, 20 bp, synthetic construct
  misc_feature 1..20: note = CRISPR gRNA sequence
  source 1..20: mol_type = other DNA
tattaccaaatatgtacccc

SEQ ID NO: 91499 - DNA, 20 bp, synthetic construct
  misc_feature 1..20: note = CRISPR gRNA sequence
  source 1..20: mol_type = other DNA
atgtacccccagttacctga

SEQ ID NO: 91500 - DNA, 20 bp, synthetic construct
  misc_feature 1..20: note = CRISPR gRNA sequence
  source 1..20: mol_type = other DNA
ttaaatacttgtaattttgc

SEQ ID NO: 91501 - DNA, 20 bp, synthetic construct
  misc_feature 1..20: note = CRISPR gRNA sequence
  source 1..20: mol_type = other DNA
tggcataacaaaatattgtt

SEQ ID NO: 91502 - DNA, 20 bp, synthetic construct
  misc_feature 1..20: note = CRISPR gRNA sequence
  source 1..20: mol_type = other DNA
cacatccaaaattcttacta

SEQ ID NO: 91503 - DNA, 20 bp, synthetic construct
  misc_feature 1..20: note = CRISPR gRNA sequence
  source 1..20: mol_type = other DNA
atccaaaattcttactaaag

SEQ ID NO: 91504 - DNA, 20 bp, synthetic construct
  misc_feature 1..20: note = CRISPR gRNA sequence
  source 1..20: mol_type = other DNA
taaaattataaatgttttac

SEQ ID NO: 91505 - DNA, 20 bp, synthetic construct
  misc_feature 1..20: note = CRISPR gRNA sequence
  source 1..20: mol_type = other DNA
attataaatgttttaccgga

SEQ ID NO: 91506 - DNA, 20 bp, synthetic construct
  misc_feature 1..20: note = CRISPR gRNA sequence
  source 1..20: mol_type = other DNA
taacctctttgttctttact

SEQ ID NO: 91507 - DNA, 20 bp, synthetic construct
  misc_feature 1..20: note = CRISPR gRNA sequence
  source 1..20: mol_type = other DNA
atctatgctgttttttctct

SEQ ID NO: 91508 - DNA, 20 bp, synthetic construct
  misc_feature 1..20: note = CRISPR gRNA sequence
  source 1..20: mol_type = other DNA
tctatgctgttttttctctt

SEQ ID NO: 91509 - DNA, 20 bp, synthetic construct
  misc_feature 1..20: note = CRISPR gRNA sequence
  source 1..20: mol_type = other DNA
tctcttgggcttctttctac

SEQ ID NO: 91510 - DNA, 20 bp, synthetic construct
  misc_feature 1..20: note = CRISPR gRNA sequence
  source 1..20: mol_type = other DNA
gcttctttctactggcctct

SEQ ID NO: 91511 - DNA, 20 bp, synthetic construct
  misc_feature 1..20: note = CRISPR gRNA sequence
  source 1..20: mol_type = other DNA
ctggcctctgagttatctat

SEQ ID NO: 91512 - DNA, 20 bp, synthetic construct
  misc_feature 1..20: note = CRISPR gRNA sequence
  source 1..20: mol_type = other DNA
cccttaatttctttcattat

SEQ ID NO: 91513 - DNA, 20 bp, synthetic construct
  misc_feature 1..20: note = CRISPR gRNA sequence
  source 1..20: mol_type = other DNA
ttaatttctttcattatgag

SEQ ID NO: 91514 - DNA, 20 bp, synthetic construct
  misc_feature 1..20: note = CRISPR gRNA sequence
  source 1..20: mol_type = other DNA
tatttcacccctaaacattt

SEQ ID NO: 91515 - DNA, 20 bp, synthetic construct
  misc_feature 1..20: note = CRISPR gRNA sequence
  source 1..20: mol_type = other DNA
atttcacccctaaacatttt

SEQ ID NO: 91516 - DNA, 20 bp, synthetic construct
  misc_feature 1..20: note = CRISPR gRNA sequence
  source 1..20: mol_type = other DNA
caacatataaaaactgtaaa

SEQ ID NO: 91517 - DNA, 20 bp, synthetic construct
  misc_feature 1..20: note = CRISPR gRNA sequence
  source 1..20: mol_type = other DNA
aaaaagaaaattctaatacc

SEQ ID NO: 91518 - DNA, 20 bp, synthetic construct
  misc_feature 1..20: note = CRISPR gRNA sequence
  source 1..20: mol_type = other DNA
aaagaaaattctaataccca

SEQ ID NO: 91519 - DNA, 20 bp, synthetic construct
  misc_feature 1..20: note = CRISPR gRNA sequence
  source 1..20: mol_type = other DNA
aagaaaattctaatacccag

SEQ ID NO: 91520 - DNA, 20 bp, synthetic construct
  misc_feature 1..20: note = CRISPR gRNA sequence
  source 1..20: mol_type = other DNA
aaaataatttcttcctcctc

SEQ ID NO: 91521 - DNA, 20 bp, synthetic construct
  misc_feature 1..20: note = CRISPR gRNA sequence
  source 1..20: mol_type = other DNA
ttcctcctccagcaaccccc

SEQ ID NO: 91522 - DNA, 20 bp, synthetic construct
  misc_feature 1..20: note = CRISPR gRNA sequence
  source 1..20: mol_type = other DNA
cccaagttgattttatttat

SEQ ID NO: 91523 - DNA, 20 bp, synthetic construct
  misc_feature 1..20: note = CRISPR gRNA sequence
  source 1..20: mol_type = other DNA
attctttcatttttatgtgc

SEQ ID NO: 91524 - DNA, 20 bp, synthetic construct
  misc_feature 1..20: note = CRISPR gRNA sequence
  source 1..20: mol_type = other DNA
catttttatgtgcaagataa

SEQ ID NO: 91525 - DNA, 20 bp, synthetic construct
  misc_feature 1..20: note = CRISPR gRNA sequence
  source 1..20: mol_type = other DNA
gaatgctgaaattgacttga

SEQ ID NO: 91526 - DNA, 20 bp, synthetic construct
  misc_feature 1..20: note = CRISPR gRNA sequence
  source 1..20: mol_type = other DNA
ctgaaattgacttgatggta

SEQ ID NO: 91527 - DNA, 20 bp, synthetic construct
  misc_feature 1..20: note = CRISPR gRNA sequence
  source 1..20: mol_type = other DNA
ctgccctcacaaccccacta

SEQ ID NO: 91528 - DNA, 20 bp, synthetic construct
  misc_feature 1..20: note = CRISPR gRNA sequence
  source 1..20: mol_type = other DNA
accccactatggaaattcaa

SEQ ID NO: 91529 - DNA, 20 bp, synthetic construct
  misc_feature 1..20: note = CRISPR gRNA sequence
  source 1..20: mol_type = other DNA
ccccactatggaaattcaaa

SEQ ID NO: 91530 - DNA, 20 bp, synthetic construct
  misc_feature 1..20: note = CRISPR gRNA sequence
  source 1..20: mol_type = other DNA
aaggttaattcacaaaatat

SEQ ID NO: 91531 - DNA, 20 bp, synthetic construct
  misc_feature 1..20: note = CRISPR gRNA sequence
  source 1..20: mol_type = other DNA
caaaatattagatactgaat

SEQ ID NO: 91532 - DNA, 20 bp, synthetic construct
  misc_feature 1..20: note = CRISPR gRNA sequence
  source 1..20: mol_type = other DNA
attagatactgaattagata

SEQ ID NO: 91533 - DNA, 20 bp, synthetic construct
  misc_feature 1..20: note = CRISPR gRNA sequence
  source 1..20: mol_type = other DNA
agatactgaattagataaag

SEQ ID NO: 91534 - DNA, 20 bp, synthetic construct
  misc_feature 1..20: note = CRISPR gRNA sequence
  source 1..20: mol_type = other DNA
gaattagataaagaagcttg

SEQ ID NO: 91535 - DNA, 20 bp, synthetic construct
  misc_feature 1..20: note = CRISPR gRNA sequence
  source 1..20: mol_type = other DNA
cttgtagtgaaaataacctt

SEQ ID NO: 91536 - DNA, 20 bp, synthetic construct
  misc_feature 1..20: note = CRISPR gRNA sequence
  source 1..20: mol_type = other DNA
gaaaataacctttagtcatc

SEQ ID NO: 91537 - DNA, 20 bp, synthetic construct
  misc_feature 1..20: note = CRISPR gRNA sequence
  source 1..20: mol_type = other DNA
tcatctagtccaaacttgta

SEQ ID NO: 91538 - DNA, 20 bp, synthetic construct
  misc_feature 1..20: note = CRISPR gRNA sequence
  source 1..20: mol_type = other DNA
gtccaaacttgtacagatgt

SEQ ID NO: 91539 - DNA, 20 bp, synthetic construct
  misc_feature 1..20: note = CRISPR gRNA sequence
  source 1..20: mol_type = other DNA
ctgcaatgctttttgtccta

SEQ ID NO: 91540 - DNA, 20 bp, synthetic construct
  misc_feature 1..20: note = CRISPR gRNA sequence
  source 1..20: mol_type = other DNA
gcaatgctttttgtcctaca

SEQ ID NO: 91541 - DNA, 20 bp, synthetic construct
  misc_feature 1..20: note = CRISPR gRNA sequence
  source 1..20: mol_type = other DNA
aacttttgccacatttcatt

SEQ ID NO: 91542 - DNA, 20 bp, synthetic construct
  misc_feature 1..20: note = CRISPR gRNA sequence
  source 1..20: mol_type = other DNA
acatttcatttggttttgaa

SEQ ID NO: 91543 - DNA, 20 bp, synthetic construct
  misc_feature 1..20: note = CRISPR gRNA sequence
  source 1..20: mol_type = other DNA
tttgaatagctctaacattt

SEQ ID NO: 91544 - DNA, 20 bp, synthetic construct
  misc_feature 1..20: note = CRISPR gRNA sequence
  source 1..20: mol_type = other DNA
gaatagctctaacatttcgg

SEQ ID NO: 91545 - DNA, 20 bp, synthetic construct
  misc_feature 1..20: note = CRISPR gRNA sequence
  source 1..20: mol_type = other DNA
ctaacatttcggtagaatgt

SEQ ID NO: 91546 - DNA, 20 bp, synthetic construct
  misc_feature 1..20: note = CRISPR gRNA sequence
  source 1..20: mol_type = other DNA
taacatttcggtagaatgtt

SEQ ID NO: 91547 - DNA, 20 bp, synthetic construct
  misc_feature 1..20: note = CRISPR gRNA sequence
  source 1..20: mol_type = other DNA
catttcggtagaatgttagg

SEQ ID NO: 91548 - DNA, 20 bp, synthetic construct
  misc_feature 1..20: note = CRISPR gRNA sequence
  source 1..20: mol_type = other DNA
aatgttaggtagctttactt

SEQ ID NO: 91549 - DNA, 20 bp, synthetic construct
  misc_feature 1..20: note = CRISPR gRNA sequence
  source 1..20: mol_type = other DNA
taggtagctttacttaagct

SEQ ID NO: 91550 - DNA, 20 bp, synthetic construct
  misc_feature 1..20: note = CRISPR gRNA sequence
  source 1..20: mol_type = other DNA
actccttgtgatttatgcct

SEQ ID NO: 91551 - DNA, 20 bp, synthetic construct
  misc_feature 1..20: note = CRISPR gRNA sequence
  source 1..20: mol_type = other DNA
tccttgtgatttatgcctaa

SEQ ID NO: 91552 - DNA, 20 bp, synthetic construct
  misc_feature 1..20: note = CRISPR gRNA sequence
  source 1..20: mol_type = other DNA
tgatttatgcctaagagtcc

SEQ ID NO: 91553 - DNA, 20 bp, synthetic construct
  misc_feature 1..20: note = CRISPR gRNA sequence
  source 1..20: mol_type = other DNA
cctaagagtcctagttacct

SEQ ID NO: 91554 - DNA, 20 bp, synthetic construct
  misc_feature 1..20: note = CRISPR gRNA sequence
  source 1..20: mol_type = other DNA
acctcagaatcatgccatat

SEQ ID NO: 91555 - DNA, 20 bp, synthetic construct
  misc_feature 1..20: note = CRISPR gRNA sequence
  source 1..20: mol_type = other DNA
ctactgcttctcttaaatga

SEQ ID NO: 91556 - DNA, 20 bp, synthetic construct
  misc_feature 1..20: note = CRISPR gRNA sequence
  source 1..20: mol_type = other DNA
tctcttaaatgatagctttt

SEQ ID NO: 91557 - DNA, 20 bp, synthetic construct
  misc_feature 1..20: note = CRISPR gRNA sequence
  source 1..20: mol_type = other DNA
tagctttttagatatttaat

SEQ ID NO: 91558 - DNA, 20 bp, synthetic construct
  misc_feature 1..20: note = CRISPR gRNA sequence
  source 1..20: mol_type = other DNA
tttaataagaacaatcccac

SEQ ID NO: 91559 - DNA, 20 bp, synthetic construct
  misc_feature 1..20: note = CRISPR gRNA sequence
  source 1..20: mol_type = other DNA
aataagaacaatcccaccag

SEQ ID NO: 91560 - DNA, 20 bp, synthetic construct
  misc_feature 1..20: note = CRISPR gRNA sequence
  source 1..20: mol_type = other DNA
taagaacaatcccaccagca

SEQ ID NO: 91561 - DNA, 20 bp, synthetic construct
  misc_feature 1..20: note = CRISPR gRNA sequence
  source 1..20: mol_type = other DNA
aagaacaatcccaccagcag

SEQ ID NO: 91562 - DNA, 20 bp, synthetic construct
  misc_feature 1..20: note = CRISPR gRNA sequence
  source 1..20: mol_type = other DNA
gaggtcaattcatttatccc

SEQ ID NO: 91563 - DNA, 20 bp, synthetic construct
  misc_feature 1..20: note = CRISPR gRNA sequence
  source 1..20: mol_type = other DNA
ccctttatgtgtctctcata

SEQ ID NO: 91564 - DNA, 20 bp, synthetic construct
  misc_feature 1..20: note = CRISPR gRNA sequence
  source 1..20: mol_type = other DNA
tatgtgtctctcatatagca

SEQ ID NO: 91565 - DNA, 20 bp, synthetic construct
  misc_feature 1..20: note = CRISPR gRNA sequence
  source 1..20: mol_type = other DNA
ctctcatatagcatagttct

SEQ ID NO: 91566 - DNA, 20 bp, synthetic construct
  misc_feature 1..20: note = CRISPR gRNA sequence
  source 1..20: mol_type = other DNA
atatagcatagttcttagat

SEQ ID NO: 91567 - DNA, 20 bp, synthetic construct
  misc_feature 1..20: note = CRISPR gRNA sequence
  source 1..20: mol_type = other DNA
tagcatagttcttagattgg

SEQ ID NO: 91568 - DNA, 20 bp, synthetic construct
  misc_feature 1..20: note = CRISPR gRNA sequence
  source 1..20: mol_type = other DNA
gcatagttcttagattggtg

SEQ ID NO: 91569 - DNA, 20 bp, synthetic construct
  misc_feature 1..20: note = CRISPR gRNA sequence
  source 1..20: mol_type = other DNA
tagttcttagattggtggag

SEQ ID NO: 91570 - DNA, 20 bp, synthetic construct
  misc_feature 1..20: note = CRISPR gRNA sequence
  source 1..20: mol_type = other DNA
catttaaccttgacttgtgt

SEQ ID NO: 91571 - DNA, 20 bp, synthetic construct
  misc_feature 1..20: note = CRISPR gRNA sequence
  source 1..20: mol_type = other DNA
tgtgtaagaaatattaattt

SEQ ID NO: 91572 - DNA, 20 bp, synthetic construct
  misc_feature 1..20: note = CRISPR gRNA sequence
  source 1..20: mol_type = other DNA
taccttaataaattcttcat

SEQ ID NO: 91573 - DNA, 20 bp, synthetic construct
  misc_feature 1..20: note = CRISPR gRNA sequence
  source 1..20: mol_type = other DNA
taataaattcttcattggaa

SEQ ID NO: 91574 - DNA, 20 bp, synthetic construct
  misc_feature 1..20: note = CRISPR gRNA sequence
  source 1..20: mol_type = other DNA
ataaattcttcattggaata

SEQ ID NO: 91575 - DNA, 20 bp, synthetic construct
  misc_feature 1..20: note = CRISPR gRNA sequence
  source 1..20: mol_type = other DNA
taatcttgctgctcacaaca

SEQ ID NO: 91576 - DNA, 20 bp, synthetic construct
  misc_feature 1..20: note = CRISPR gRNA sequence
  source 1..20: mol_type = other DNA
tcttgctgctcacaacatag

SEQ ID NO: 91577 - DNA, 20 bp, synthetic construct
  misc_feature 1..20: note = CRISPR gRNA sequence
  source 1..20: mol_type = other DNA
tgctgctcacaacatagcag

SEQ ID NO: 91578 - DNA, 20 bp, synthetic construct
  misc_feature 1..20: note = CRISPR gRNA sequence
  source 1..20: mol_type = other DNA
aagacaccatcatcacctgt

SEQ ID NO: 91579 - DNA, 20 bp, synthetic construct
  misc_feature 1..20: note = CRISPR gRNA sequence
  source 1..20: mol_type = other DNA
cctactataataatcttcga

SEQ ID NO: 91580 - DNA, 20 bp, synthetic construct
  misc_feature 1..20: note = CRISPR gRNA sequence
  source 1..20: mol_type = other DNA
tactataataatcttcgaaa

SEQ ID NO: 91581 - DNA, 20 bp, synthetic construct
  misc_feature 1..20: note = CRISPR gRNA sequence
  source 1..20: mol_type = other DNA
cgaaagagtctcaaaatcta

SEQ ID NO: 91582 - DNA, 20 bp, synthetic construct
  misc_feature 1..20: note = CRISPR gRNA sequence
  source 1..20: mol_type = other DNA
gaaagagtctcaaaatctat

SEQ ID NO: 91583 - DNA, 20 bp, synthetic construct
  misc_feature 1..20: note = CRISPR gRNA sequence
  source 1..20: mol_type = other DNA
tcaactttaacccactccat

SEQ ID NO: 91584 - DNA, 20 bp, synthetic construct
  misc_feature 1..20: note = CRISPR gRNA sequence
  source 1..20: mol_type = other DNA
caactttaacccactccatc

SEQ ID NO: 91585 - DNA, 20 bp, synthetic construct
  misc_feature 1..20: note = CRISPR gRNA sequence
  source 1..20: mol_type = other DNA
aactttaacccactccatca

SEQ ID NO: 91586 - DNA, 20 bp, synthetic construct
  misc_feature 1..20: note = CRISPR gRNA sequence
  source 1..20: mol_type = other DNA
tttaacccactccatcaggg

SEQ ID NO: 91587 - DNA, 20 bp, synthetic construct
  misc_feature 1..20: note = CRISPR gRNA sequence
  source 1..20: mol_type = other DNA
ttaacccactccatcagggt

SEQ ID NO: 91588 - DNA, 20 bp, synthetic construct
  misc_feature 1..20: note = CRISPR gRNA sequence
  source 1..20: mol_type = other DNA
atcctctgctacttcctaat

SEQ ID NO: 91589 - DNA, 20 bp, synthetic construct
  misc_feature 1..20: note = CRISPR gRNA sequence
  source 1..20: mol_type = other DNA
taattagatcatttcattta

SEQ ID NO: 91590 - DNA, 20 bp, synthetic construct
  misc_feature 1..20: note = CRISPR gRNA sequence
  source 1..20: mol_type = other DNA
gactccaaatccaaatccca

SEQ ID NO: 91591 - DNA, 20 bp, synthetic construct
  misc_feature 1..20: note = CRISPR gRNA sequence
  source 1..20: mol_type = other DNA
caaatccaaatcccatagcc

SEQ ID NO: 91592 - DNA, 20 bp, synthetic construct
  misc_feature 1..20: note = CRISPR gRNA sequence
  source 1..20: mol_type = other DNA
cattcaatactataaaaaac

SEQ ID NO: 91593 - DNA, 20 bp, synthetic construct
  misc_feature 1..20: note = CRISPR gRNA sequence
  source 1..20: mol_type = other DNA
aattttccactcaactattt

SEQ ID NO: 91594 - DNA, 20 bp, synthetic construct
  misc_feature 1..20: note = CRISPR gRNA sequence
  source 1..20: mol_type = other DNA
ttccactcaactattttagc

SEQ ID NO: 91595 - DNA, 20 bp, synthetic construct
  misc_feature 1..20: note = CRISPR gRNA sequence
  source 1..20: mol_type = other DNA
ctcaactattttagctagaa

SEQ ID NO: 91596 - DNA, 20 bp, synthetic construct
  misc_feature 1..20: note = CRISPR gRNA sequence
  source 1..20: mol_type = other DNA
tccacttgctatcttcacaa

SEQ ID NO: 91597 - DNA, 20 bp, synthetic construct
  misc_feature 1..20: note = CRISPR gRNA sequence
  source 1..20: mol_type = other DNA
ttctctttccttttatctac

SEQ ID NO: 91598 - DNA, 20 bp, synthetic construct
  misc_feature 1..20: note = CRISPR gRNA sequence
  source 1..20: mol_type = other DNA
ccttttatctaccagaattc

SEQ ID NO: 91599 - DNA, 20 bp, synthetic construct
  misc_feature 1..20: note = CRISPR gRNA sequence
  source 1..20: mol_type = other DNA
cttttatctaccagaattct

SEQ ID NO: 91600 - DNA, 20 bp, synthetic construct
  misc_feature 1..20: note = CRISPR gRNA sequence
  source 1..20: mol_type = other DNA
ttttatctaccagaattcta

SEQ ID NO: 91601 - DNA, 20 bp, synthetic construct
  misc_feature 1..20: note = CRISPR gRNA sequence
  source 1..20: mol_type = other DNA
tatctaccagaattctaggg

SEQ ID NO: 91602 - DNA, 20 bp, synthetic construct
  misc_feature 1..20: note = CRISPR gRNA sequence
  source 1..20: mol_type = other DNA
ctaccagaattctagggaag

SEQ ID NO: 91603 - DNA, 20 bp, synthetic construct
  misc_feature 1..20: note = CRISPR gRNA sequence
  source 1..20: mol_type = other DNA
agaattctagggaagcagta

SEQ ID NO: 91604 - DNA, 20 bp, synthetic construct
  misc_feature 1..20: note = CRISPR gRNA sequence
  source 1..20: mol_type = other DNA
ttctagggaagcagtatagt

SEQ ID NO: 91605 - DNA, 20 bp, synthetic construct
  misc_feature 1..20: note = CRISPR gRNA sequence
  source 1..20: mol_type = other DNA
tctagggaagcagtatagta

SEQ ID NO: 91606 - DNA, 20 bp, synthetic construct
  misc_feature 1..20: note = CRISPR gRNA sequence
  source 1..20: mol_type = other DNA
tagggaagcagtatagtaag

SEQ ID NO: 91607 - DNA, 20 bp, synthetic construct
  misc_feature 1..20: note = CRISPR gRNA sequence
  source 1..20: mol_type = other DNA
agggaagcagtatagtaagg

SEQ ID NO: 91608 - DNA, 20 bp, synthetic construct
  misc_feature 1..20: note = CRISPR gRNA sequence
  source 1..20: mol_type = other DNA
gcagtatagtaaggaggtaa

SEQ ID NO: 91609 - DNA, 20 bp, synthetic construct
  misc_feature 1..20: note = CRISPR gRNA sequence
  source 1..20: mol_type = other DNA
tagtaaggaggtaaaagtga

SEQ ID NO: 91610 - DNA, 20 bp, synthetic construct
  misc_feature 1..20: note = CRISPR gRNA sequence
  source 1..20: mol_type = other DNA
ggaggtaaaagtgaaagctc

SEQ ID NO: 91611 - DNA, 20 bp, synthetic construct
  misc_feature 1..20: note = CRISPR gRNA sequence
  source 1..20: mol_type = other DNA
aaaagtgaaagctctagaat

SEQ ID NO: 91612 - DNA, 20 bp, synthetic construct
  misc_feature 1..20: note = CRISPR gRNA sequence
  source 1..20: mol_type = other DNA
gaataagactgcttgcgttt

SEQ ID NO: 91613 - DNA, 20 bp, synthetic construct
  misc_feature 1..20: note = CRISPR gRNA sequence
  source 1..20: mol_type = other DNA
cgtttgagtacaatacttgc

SEQ ID NO: 91614 - DNA, 20 bp, synthetic construct
  misc_feature 1..20: note = CRISPR gRNA sequence
  source 1..20: mol_type = other DNA
tacttgctggctgtatgacc

SEQ ID NO: 91615 - DNA, 20 bp, synthetic construct
  misc_feature 1..20: note = CRISPR gRNA sequence
  source 1..20: mol_type = other DNA
acttgctggctgtatgacct

SEQ ID NO: 91616 - DNA, 20 bp, synthetic construct
  misc_feature 1..20: note = CRISPR gRNA sequence
  source 1..20: mol_type = other DNA
atgacctaggccaaattctt

SEQ ID NO: 91617 - DNA, 20 bp, synthetic construct
  misc_feature 1..20: note = CRISPR gRNA sequence
  source 1..20: mol_type = other DNA
tctttagcctctctgtgcct

SEQ ID NO: 91618 - DNA, 20 bp, synthetic construct
  misc_feature 1..20: note = CRISPR gRNA sequence
  source 1..20: mol_type = other DNA
gtttccatgtatgtaaaata

SEQ ID NO: 91619 - DNA, 20 bp, synthetic construct
  misc_feature 1..20: note = CRISPR gRNA sequence
  source 1..20: mol_type = other DNA
tagtatctatcccattgctg

SEQ ID NO: 91620 - DNA, 20 bp, synthetic construct
  misc_feature 1..20: note = CRISPR gRNA sequence
  source 1..20: mol_type = other DNA
agtatctatcccattgctga

SEQ ID NO: 91621 - DNA, 20 bp, synthetic construct
  misc_feature 1..20: note = CRISPR gRNA sequence
  source 1..20: mol_type = other DNA
gtatctatcccattgctgaa

SEQ ID NO: 91622 - DNA, 20 bp, synthetic construct
  misc_feature 1..20: note = CRISPR gRNA sequence
  source 1..20: mol_type = other DNA
tcccattgctgaagggttgt

SEQ ID NO: 91623 - DNA, 20 bp, synthetic construct
  misc_feature 1..20: note = CRISPR gRNA sequence
  source 1..20: mol_type = other DNA
gggttgtgagactccattta

SEQ ID NO: 91624 - DNA, 20 bp, synthetic construct
  misc_feature 1..20: note = CRISPR gRNA sequence
  source 1..20: mol_type = other DNA
actccatttatagcttaaca

SEQ ID NO: 91625 - DNA, 20 bp, synthetic construct
  misc_feature 1..20: note = CRISPR gRNA sequence
  source 1..20: mol_type = other DNA
taacacagtgcttgacacat

SEQ ID NO: 91626 - DNA, 20 bp, synthetic construct
  misc_feature 1..20: note = CRISPR gRNA sequence
  source 1..20: mol_type = other DNA
tgcttgacacataagaaact

SEQ ID NO: 91627 - DNA, 20 bp, synthetic construct
  misc_feature 1..20: note = CRISPR gRNA sequence
  source 1..20: mol_type = other DNA
cataagaaactcagctcatt

SEQ ID NO: 91628 - DNA, 20 bp, synthetic construct
  misc_feature 1..20: note = CRISPR gRNA sequence
  source 1..20: mol_type = other DNA
aaactattgcccatcctttc

SEQ ID NO: 91629 - DNA, 20 bp, synthetic construct
  misc_feature 1..20: note = CRISPR gRNA sequence
  source 1..20: mol_type = other DNA
catcctttctggtttatact

SEQ ID NO: 91630 - DNA, 20 bp, synthetic construct
  misc_feature 1..20: note = CRISPR gRNA sequence
  source 1..20: mol_type = other DNA
tgagtcacgtttcctctgca

SEQ ID NO: 91631 - DNA, 20 bp, synthetic construct
  misc_feature 1..20: note = CRISPR gRNA sequence
  source 1..20: mol_type = other DNA
tttcctctgcaaagcctttc

SEQ ID NO: 91632 - DNA, 20 bp, synthetic construct
  misc_feature 1..20: note = CRISPR gRNA sequence
  source 1..20: mol_type = other DNA
tcctctgcaaagcctttctg

SEQ ID NO: 91633 - DNA, 20 bp, synthetic construct
  misc_feature 1..20: note = CRISPR gRNA sequence
  source 1..20: mol_type = other DNA
aaagcctttctggagtatct

SEQ ID NO: 91634 - DNA, 20 bp, synthetic construct
  misc_feature 1..20: note = CRISPR gRNA sequence
  source 1..20: mol_type = other DNA
ctcctctgaactactaaaac

SEQ ID NO: 91635 - DNA, 20 bp, synthetic construct
  misc_feature 1..20: note = CRISPR gRNA sequence
  source 1..20: mol_type = other DNA
actactaaaaccggactata

SEQ ID NO: 91636 - DNA, 20 bp, synthetic construct
  misc_feature 1..20: note = CRISPR gRNA sequence
  source 1..20: mol_type = other DNA
ctaaaaccggactatacagt

SEQ ID NO: 91637 - DNA, 20 bp, synthetic construct
  misc_feature 1..20: note = CRISPR gRNA sequence
  source 1..20: mol_type = other DNA
agttggctcttattatatcc

SEQ ID NO: 91638 - DNA, 20 bp, synthetic construct
  misc_feature 1..20: note = CRISPR gRNA sequence
  source 1..20: mol_type = other DNA
ggctcttattatatcctggc

SEQ ID NO: 91639 - DNA, 20 bp, synthetic construct
  misc_feature 1..20: note = CRISPR gRNA sequence
  source 1..20: mol_type = other DNA
actgttattttctttacact

SEQ ID NO: 91640 - DNA, 20 bp, synthetic construct
  misc_feature 1..20: note = CRISPR gRNA sequence
  source 1..20: mol_type = other DNA
tctttacactcagtttaaca

SEQ ID NO: 91641 - DNA, 20 bp, synthetic construct
  misc_feature 1..20: note = CRISPR gRNA sequence
  source 1..20: mol_type = other DNA
cactcagtttaacaaagata

SEQ ID NO: 91642 - DNA, 20 bp, synthetic construct
  misc_feature 1..20: note = CRISPR gRNA sequence
  source 1..20: mol_type = other DNA
ttaacaaagataaagattta

SEQ ID NO: 91643 - DNA, 20 bp, synthetic construct
  misc_feature 1..20: note = CRISPR gRNA sequence
  source 1..20: mol_type = other DNA
tacagatcttgttacctcct

SEQ ID NO: 91644 - DNA, 20 bp, synthetic construct
  misc_feature 1..20: note = CRISPR gRNA sequence
  source 1..20: mol_type = other DNA
ttacctcctcagaactgata

SEQ ID NO: 91645 - DNA, 20 bp, synthetic construct
  misc_feature 1..20: note = CRISPR gRNA sequence
  source 1..20: mol_type = other DNA
gataaagtatcccaaaatat

SEQ ID NO: 91646 - DNA, 20 bp, synthetic construct
  misc_feature 1..20: note = CRISPR gRNA sequence
  source 1..20: mol_type = other DNA
tcccaaaatataagacaaac

SEQ ID NO: 91647 - DNA, 20 bp, synthetic construct
  misc_feature 1..20: note = CRISPR gRNA sequence
  source 1..20: mol_type = other DNA
aaaatataagacaaactgga

SEQ ID NO: 91648 - DNA, 20 bp, synthetic construct
  misc_feature 1..20: note = CRISPR gRNA sequence
  source 1..20: mol_type = other DNA
caaactggatagtaaactat

SEQ ID NO: 91649 - DNA, 20 bp, synthetic construct
  misc_feature 1..20: note = CRISPR gRNA sequence
  source 1..20: mol_type = other DNA
ttagtattatttgttgctta

SEQ ID NO: 91650 - DNA, 20 bp, synthetic construct
  misc_feature 1..20: note = CRISPR gRNA sequence
  source 1..20: mol_type = other DNA
aattaattcccttccataaa

SEQ ID NO: 91651 - DNA, 20 bp, synthetic construct
  misc_feature 1..20: note = CRISPR gRNA sequence
  source 1..20: mol_type = other DNA
tcatgcaaattattttaaaa

SEQ ID NO: 91652 - DNA, 20 bp, synthetic construct
  misc_feature 1..20: note = CRISPR gRNA sequence
  source 1..20: mol_type = other DNA
caaattattttaaaatagtg

SEQ ID NO: 91653 - DNA, 20 bp, synthetic construct
  misc_feature 1..20: note = CRISPR gRNA sequence
  source 1..20: mol_type = other DNA
ttattttaaaatagtgaagc

SEQ ID NO: 91654 - DNA, 20 bp, synthetic construct
  misc_feature 1..20: note = CRISPR gRNA sequence
  source 1..20: mol_type = other DNA
tattttaaaatagtgaagct

SEQ ID NO: 91655 - DNA, 20 bp, synthetic construct
  misc_feature 1..20: note = CRISPR gRNA sequence
  source 1..20: mol_type = other DNA
taaaatagtgaagctaggtg

SEQ ID NO: 91656 - DNA, 20 bp, synthetic construct
  misc_feature 1..20: note = CRISPR gRNA sequence
  source 1..20: mol_type = other DNA
aatagtgaagctaggtgcag

SEQ ID NO: 91657 - DNA, 20 bp, synthetic construct
  misc_feature 1..20: note = CRISPR gRNA sequence
  source 1..20: mol_type = other DNA
gtgcagtggtgaaataatcc

SEQ ID NO: 91658 - DNA, 20 bp, synthetic construct
  misc_feature 1..20: note = CRISPR gRNA sequence
  source 1..20: mol_type = other DNA
aaataatcccagttactctg

SEQ ID NO: 91659 - DNA, 20 bp, synthetic construct
  misc_feature 1..20: note = CRISPR gRNA sequence
  source 1..20: mol_type = other DNA
aataatcccagttactctga

SEQ ID NO: 91660 - DNA, 20 bp, synthetic construct
  misc_feature 1..20: note = CRISPR gRNA sequence
  source 1..20: mol_type = other DNA
tcccagttactctgaaggct

SEQ ID NO: 91661 - DNA, 20 bp, synthetic construct
  misc_feature 1..20: note = CRISPR gRNA sequence
  source 1..20: mol_type = other DNA
cccagttactctgaaggctg

SEQ ID NO: 91662 - DNA, 20 bp, synthetic construct
  misc_feature 1..20: note = CRISPR gRNA sequence
  source 1..20: mol_type = other DNA
agttactctgaaggctgagg

SEQ ID NO: 91663 - DNA, 20 bp, synthetic construct
  misc_feature 1..20: note = CRISPR gRNA sequence
  source 1..20: mol_type = other DNA
gttactctgaaggctgaggc

SEQ ID NO: 91664 - DNA, 20 bp, synthetic construct
  misc_feature 1..20: note = CRISPR gRNA sequence
  source 1..20: mol_type = other DNA
tactctgaaggctgaggcag

SEQ ID NO: 91665 - DNA, 20 bp, synthetic construct
  misc_feature 1..20: note = CRISPR gRNA sequence
  source 1..20: mol_type = other DNA
actctgaaggctgaggcagg

SEQ ID NO: 91666 - DNA, 20 bp, synthetic construct
  misc_feature 1..20: note = CRISPR gRNA sequence
  source 1..20: mol_type = other DNA
ctgaggcaggaggatcactt

SEQ ID NO: 91667 - DNA, 20 bp, synthetic construct
  misc_feature 1..20: note = CRISPR gRNA sequence
  source 1..20: mol_type = other DNA
gcaggaggatcacttgagcc

SEQ ID NO: 91668 - DNA, 20 bp, synthetic construct
  misc_feature 1..20: note = CRISPR gRNA sequence
  source 1..20: mol_type = other DNA
caggaggatcacttgagccc

SEQ ID NO: 91669 - DNA, 20 bp, synthetic construct
  misc_feature 1..20: note = CRISPR gRNA sequence
  source 1..20: mol_type = other DNA
tcacttgagcccaggaattc

SEQ ID NO: 91670 - DNA, 20 bp, synthetic construct
  misc_feature 1..20: note = CRISPR gRNA sequence
  source 1..20: mol_type = other DNA
cacttgagcccaggaattcg

SEQ ID NO: 91671 - DNA, 20 bp, synthetic construct
  misc_feature 1..20: note = CRISPR gRNA sequence
  source 1..20: mol_type = other DNA
tgagcccaggaattcgaggc

SEQ ID NO: 91672 - DNA, 20 bp, synthetic construct
  misc_feature 1..20: note = CRISPR gRNA sequence
  source 1..20: mol_type = other DNA
ccaggaattcgaggccagcc

SEQ ID NO: 91673 - DNA, 20 bp, synthetic construct
  misc_feature 1..20: note = CRISPR gRNA sequence
  source 1..20: mol_type = other DNA
caggaattcgaggccagcct

SEQ ID NO: 91674 - DNA, 20 bp, synthetic construct
  misc_feature 1..20: note = CRISPR gRNA sequence
  source 1..20: mol_type = other DNA
gccagcctgggcaacactgt

SEQ ID NO: 91675 - DNA, 20 bp, synthetic construct
  misc_feature 1..20: note = CRISPR gRNA sequence
  source 1..20: mol_type = other DNA
gagacccatctctaaaaaat

SEQ ID NO: 91676 - DNA, 20 bp, synthetic construct
  misc_feature 1..20: note = CRISPR gRNA sequence
  source 1..20: mol_type = other DNA
ccatctctaaaaaattagat

SEQ ID NO: 91677 - DNA, 20 bp, synthetic construct
  misc_feature 1..20: note = CRISPR gRNA sequence
  source 1..20: mol_type = other DNA
taagtaaataaataacaaaa

SEQ ID NO: 91678 - DNA, 20 bp, synthetic construct
  misc_feature 1..20: note = CRISPR gRNA sequence
  source 1..20: mol_type = other DNA
ataaataacaaaatagtaat

SEQ ID NO: 91679 - DNA, 20 bp, synthetic construct
  misc_feature 1..20: note = CRISPR gRNA sequence
  source 1..20: mol_type = other DNA
taaataacaaaatagtaata

SEQ ID NO: 91680 - DNA, 20 bp, synthetic construct
  misc_feature 1..20: note = CRISPR gRNA sequence
  source 1..20: mol_type = other DNA
tagtaataaggttctttttg

SEQ ID NO: 91681 - DNA, 20 bp, synthetic construct
  misc_feature 1..20: note = CRISPR gRNA sequence
  source 1..20: mol_type = other DNA
agtaataaggttctttttgt

SEQ ID NO: 91682 - DNA, 20 bp, synthetic construct
  misc_feature 1..20: note = CRISPR gRNA sequence
  source 1..20: mol_type = other DNA
taataaggttctttttgtgg

SEQ ID NO: 91683 - DNA, 20 bp, synthetic construct
  misc_feature 1..20: note = CRISPR gRNA sequence
  source 1..20: mol_type = other DNA
aataaggttctttttgtggg

SEQ ID NO: 91684 - DNA, 20 bp, synthetic construct
  misc_feature 1..20: note = CRISPR gRNA sequence
  source 1..20: mol_type = other DNA
ggttctttttgtgggaggtg

SEQ ID NO: 91685 - DNA, 20 bp, synthetic construct
  misc_feature 1..20: note = CRISPR gRNA sequence
  source 1..20: mol_type = other DNA
ttctttttgtgggaggtgca

SEQ ID NO: 91686 - DNA, 20 bp, synthetic construct
  misc_feature 1..20: note = CRISPR gRNA sequence
  source 1..20: mol_type = other DNA
tctttttgtgggaggtgcag

SEQ ID NO: 91687 - DNA, 20 bp, synthetic construct
  misc_feature 1..20: note = CRISPR gRNA sequence
  source 1..20: mol_type = other DNA
ctttttgtgggaggtgcaga

SEQ ID NO: 91688 - DNA, 20 bp, synthetic construct
  misc_feature 1..20: note = CRISPR gRNA sequence
  source 1..20: mol_type = other DNA
ttttgtgggaggtgcagagg

SEQ ID NO: 91689 - DNA, 20 bp, synthetic construct
  misc_feature 1..20: note = CRISPR gRNA sequence
  source 1..20: mol_type = other DNA
tgcagagggagacgctaatt

SEQ ID NO: 91690 - DNA, 20 bp, synthetic construct
  misc_feature 1..20: note = CRISPR gRNA sequence
  source 1..20: mol_type = other DNA
tttatacattttcctcactg

SEQ ID NO: 91691 - DNA, 20 bp, synthetic construct
  misc_feature 1..20: note = CRISPR gRNA sequence
  source 1..20: mol_type = other DNA
ctcactgtagatgtaaatgt

SEQ ID NO: 91692 - DNA, 20 bp, synthetic construct
  misc_feature 1..20: note = CRISPR gRNA sequence
  source 1..20: mol_type = other DNA
tcactgtagatgtaaatgtt

SEQ ID NO: 91693 - DNA, 20 bp, synthetic construct
  misc_feature 1..20: note = CRISPR gRNA sequence
  source 1..20: mol_type = other DNA
ctgtagatgtaaatgttagg

SEQ ID NO: 91694 - DNA, 20 bp, synthetic construct
  misc_feature 1..20: note = CRISPR gRNA sequence
  source 1..20: mol_type = other DNA
taggtagtttaaaaaaaaaa

SEQ ID NO: 91695 - DNA, 20 bp, synthetic construct
  misc_feature 1..20: note = CRISPR gRNA sequence
  source 1..20: mol_type = other DNA
tagtttaaaaaaaaaaaagt

SEQ ID NO: 91696 - DNA, 20 bp, synthetic construct
  misc_feature 1..20: note = CRISPR gRNA sequence
  source 1..20: mol_type = other DNA
tttaaaaaaaaaaaagtaag

SEQ ID NO: 91697 - DNA, 20 bp, synthetic construct
  misc_feature 1..20: note = CRISPR gRNA sequence
  source 1..20: mol_type = other DNA
aaaaaaaaagtaagcagcca

SEQ ID NO: 91698 - DNA, 20 bp, synthetic construct
  misc_feature 1..20: note = CRISPR gRNA sequence
  source 1..20: mol_type = other DNA
aaaaaaaagtaagcagccat

SEQ ID NO: 91699 - DNA, 20 bp, synthetic construct
  misc_feature 1..20: note = CRISPR gRNA sequence
  source 1..20: mol_type = other DNA
actacttctttcttgaaaat

SEQ ID NO: 91700 - DNA, 20 bp, synthetic construct
  misc_feature 1..20: note = CRISPR gRNA sequence
  source 1..20: mol_type = other DNA
ttcttgaaaataagtattat

SEQ ID NO: 91701 - DNA, 20 bp, synthetic construct
  misc_feature 1..20: note = CRISPR gRNA sequence
  source 1..20: mol_type = other DNA
tcttgaaaataagtattatt

SEQ ID NO: 91702 - DNA, 20 bp, synthetic construct
  misc_feature 1..20: note = CRISPR gRNA sequence
  source 1..20: mol_type = other DNA
gaaaataagtattattaggc

SEQ ID NO: 91703 - DNA, 20 bp, synthetic construct
  misc_feature 1..20: note = CRISPR gRNA sequence
  source 1..20: mol_type = other DNA
taagtattattaggccggcg

SEQ ID NO: 91704 - DNA, 20 bp, synthetic construct
  misc_feature 1..20: note = CRISPR gRNA sequence
  source 1..20: mol_type = other DNA
gtattattaggccggcgtgg

SEQ ID NO: 91705 - DNA, 20 bp, synthetic construct
  misc_feature 1..20: note = CRISPR gRNA sequence
  source 1..20: mol_type = other DNA
tattattaggccggcgtggt

SEQ ID NO: 91706 - DNA, 20 bp, synthetic construct
  misc_feature 1..20: note = CRISPR gRNA sequence
  source 1..20: mol_type = other DNA
gtgggtctcacccgtaatcc

SEQ ID NO: 91707 - DNA, 20 bp, synthetic construct
  misc_feature 1..20: note = CRISPR gRNA sequence
  source 1..20: mol_type = other DNA
cacccgtaatcccagcactt

SEQ ID NO: 91708 - DNA, 20 bp, synthetic construct
  misc_feature 1..20: note = CRISPR gRNA sequence
  source 1..20: mol_type = other DNA
acccgtaatcccagcacttc

SEQ ID NO: 91709 - DNA, 20 bp, synthetic construct
  misc_feature 1..20: note = CRISPR gRNA sequence
  source 1..20: mol_type = other DNA
ccgtaatcccagcacttcag

SEQ ID NO: 91710 - DNA, 20 bp, synthetic construct
  misc_feature 1..20: note = CRISPR gRNA sequence
  source 1..20: mol_type = other DNA
cgtaatcccagcacttcagg

SEQ ID NO: 91711 - DNA, 20 bp, synthetic construct
  misc_feature 1..20: note = CRISPR gRNA sequence
  source 1..20: mol_type = other DNA
tcccagcacttcaggaggct

SEQ ID NO: 91712 - DNA, 20 bp, synthetic construct
  misc_feature 1..20: note = CRISPR gRNA sequence
  source 1..20: mol_type = other DNA
cccagcacttcaggaggctg

SEQ ID NO: 91713 - DNA, 20 bp, synthetic construct
  misc_feature 1..20: note = CRISPR gRNA sequence
  source 1..20: mol_type = other DNA
agcacttcaggaggctgagg

SEQ ID NO: 91714 - DNA, 20 bp, synthetic construct
  misc_feature 1..20: note = CRISPR gRNA sequence
  source 1..20: mol_type = other DNA
gcacttcaggaggctgaggt

SEQ ID NO: 91715 - DNA, 20 bp, synthetic construct
  misc_feature 1..20: note = CRISPR gRNA sequence
  source 1..20: mol_type = other DNA
acttcaggaggctgaggtgg

SEQ ID NO: 91716 - DNA, 20 bp, synthetic construct
  misc_feature 1..20: note = CRISPR gRNA sequence
  source 1..20: mol_type = other DNA
cttcaggaggctgaggtggg

SEQ ID NO: 91717 - DNA, 20 bp, synthetic construct
  misc_feature 1..20: note = CRISPR gRNA sequence
  source 1..20: mol_type = other DNA
ggaggctgaggtgggaggat

SEQ ID NO: 91718 - DNA, 20 bp, synthetic construct
  misc_feature 1..20: note = CRISPR gRNA sequence
  source 1..20: mol_type = other DNA
gaggctgaggtgggaggatc

SEQ ID NO: 91719 - DNA, 20 bp, synthetic construct
  misc_feature 1..20: note = CRISPR gRNA sequence
  source 1..20: mol_type = other DNA
ggctgaggtgggaggatcag

SEQ ID NO: 91720 - DNA, 20 bp, synthetic construct
  misc_feature 1..20: note = CRISPR gRNA sequence
  source 1..20: mol_type = other DNA
ggtgggaggatcaggagttc

SEQ ID NO: 91721 - DNA, 20 bp, synthetic construct
  misc_feature 1..20: note = CRISPR gRNA sequence
  source 1..20: mol_type = other DNA
gaggatcaggagttcgagac

SEQ ID NO: 91722 - DNA, 20 bp, synthetic construct
  misc_feature 1..20: note = CRISPR gRNA sequence
  source 1..20: mol_type = other DNA
tcaggagttcgagaccagac

SEQ ID NO: 91723 - DNA, 20 bp, synthetic construct
  misc_feature 1..20: note = CRISPR gRNA sequence
  source 1..20: mol_type = other DNA
cgagaccagactggccaaca

SEQ ID NO: 91724 - DNA, 20 bp, synthetic construct
  misc_feature 1..20: note = CRISPR gRNA sequence
  source 1..20: mol_type = other DNA
tctactaaaaatacaaaaat

SEQ ID NO: 91725 - DNA, 20 bp, synthetic construct
  misc_feature 1..20: note = CRISPR gRNA sequence
  source 1..20: mol_type = other DNA
ctaaaaatacaaaaattagc

SEQ ID NO: 91726 - DNA, 20 bp, synthetic construct
  misc_feature 1..20: note = CRISPR gRNA sequence
  source 1..20: mol_type = other DNA
taaaaatacaaaaattagcc

SEQ ID NO: 91727 - DNA, 20 bp, synthetic construct
  misc_feature 1..20: note = CRISPR gRNA sequence
  source 1..20: mol_type = other DNA
atacaaaaattagccgggcg

SEQ ID NO: 91728 - DNA, 20 bp, synthetic construct
  misc_feature 1..20: note = CRISPR gRNA sequence
  source 1..20: mol_type = other DNA
caaaaattagccgggcgtgg

SEQ ID NO: 91729 - DNA, 20 bp, synthetic construct
  misc_feature 1..20: note = CRISPR gRNA sequence
  source 1..20: mol_type = other DNA
gtggtgcatgcctgtaatcc

SEQ ID NO: 91730 - DNA, 20 bp, synthetic construct
  misc_feature 1..20: note = CRISPR gRNA sequence
  source 1..20: mol_type = other DNA
tgcctgtaatcccagctact

SEQ ID NO: 91731 - DNA, 20 bp, synthetic construct
  misc_feature 1..20: note = CRISPR gRNA sequence
  source 1..20: mol_type = other DNA
gcctgtaatcccagctactc

SEQ ID NO: 91732 - DNA, 20 bp, synthetic construct
  misc_feature 1..20: note = CRISPR gRNA sequence
  source 1..20: mol_type = other DNA
ctgtaatcccagctactcag

SEQ ID NO: 91733 - DNA, 20 bp, synthetic construct
  misc_feature 1..20: note = CRISPR gRNA sequence
  source 1..20: mol_type = other DNA
tgtaatcccagctactcagg

SEQ ID NO: 91734 - DNA, 20 bp, synthetic construct
  misc_feature 1..20: note = CRISPR gRNA sequence
  source 1..20: mol_type = other DNA
tcccagctactcaggaggct

SEQ ID NO: 91735 - DNA, 20 bp, synthetic construct
  misc_feature 1..20: note = CRISPR gRNA sequence
  source 1..20: mol_type = other DNA
cccagctactcaggaggctg

SEQ ID NO: 91736 - DNA, 20 bp, synthetic construct
  misc_feature 1..20: note = CRISPR gRNA sequence
  source 1..20: mol_type = other DNA
tactcaggaggctgaggcac

SEQ ID NO: 91737 - DNA, 20 bp, synthetic construct
  misc_feature 1..20: note = CRISPR gRNA sequence
  source 1..20: mol_type = other DNA
gcacaagaactgcttgaacc

SEQ ID NO: 91738 - DNA, 20 bp, synthetic construct
  misc_feature 1..20: note = CRISPR gRNA sequence
  source 1..20: mol_type = other DNA
cacaagaactgcttgaaccc

SEQ ID NO: 91739 - DNA, 20 bp, synthetic construct
  misc_feature 1..20: note = CRISPR gRNA sequence
  source 1..20: mol_type = other DNA
caagaactgcttgaacccag

SEQ ID NO: 91740 - DNA, 20 bp, synthetic construct
  misc_feature 1..20: note = CRISPR gRNA sequence
  source 1..20: mol_type = other DNA
aagaactgcttgaacccagg

SEQ ID NO: 91741 - DNA, 20 bp, synthetic construct
  misc_feature 1..20: note = CRISPR gRNA sequence
  source 1..20: mol_type = other DNA
aactgcttgaacccaggagg

SEQ ID NO: 91742 - DNA, 20 bp, synthetic construct
  misc_feature 1..20: note = CRISPR gRNA sequence
  source 1..20: mol_type = other DNA
ctgcttgaacccaggaggtg

SEQ ID NO: 91743 - DNA, 20 bp, synthetic construct
  misc_feature 1..20: note = CRISPR gRNA sequence
  source 1..20: mol_type = other DNA
tgcttgaacccaggaggtgg

SEQ ID NO: 91744 - DNA, 20 bp, synthetic construct
  misc_feature 1..20: note = CRISPR gRNA sequence
  source 1..20: mol_type = other DNA
aacccaggaggtggaggttg

SEQ ID NO: 91745 - DNA, 20 bp, synthetic construct
  misc_feature 1..20: note = CRISPR gRNA sequence
  source 1..20: mol_type = other DNA
ccaggaggtggaggttgtag

SEQ ID NO: 91746 - DNA, 20 bp, synthetic construct
  misc_feature 1..20: note = CRISPR gRNA sequence
  source 1..20: mol_type = other DNA
caggaggtggaggttgtagt

SEQ ID NO: 91747 - DNA, 20 bp, synthetic construct
  misc_feature 1..20: note = CRISPR gRNA sequence
  source 1..20: mol_type = other DNA
ggtggaggttgtagtgggcc

SEQ ID NO: 91748 - DNA, 20 bp, synthetic construct
  misc_feature 1..20: note = CRISPR gRNA sequence
  source 1..20: mol_type = other DNA
gagatcgcaccactgcactc

SEQ ID NO: 91749 - DNA, 20 bp, synthetic construct
  misc_feature 1..20: note = CRISPR gRNA sequence
  source 1..20: mol_type = other DNA
gcaccactgcactccagcct

SEQ ID NO: 91750 - DNA, 20 bp, synthetic construct
  misc_feature 1..20: note = CRISPR gRNA sequence
  source 1..20: mol_type = other DNA
gcactccagcctgagcgaca

SEQ ID NO: 91751 - DNA, 20 bp, synthetic construct
  misc_feature 1..20: note = CRISPR gRNA sequence
  source 1..20: mol_type = other DNA
actccagcctgagcgacaca

SEQ ID NO: 91752 - DNA, 20 bp, synthetic construct
  misc_feature 1..20: note = CRISPR gRNA sequence
  source 1..20: mol_type = other DNA
cagcctgagcgacacagagt

SEQ ID NO: 91753 - DNA, 20 bp, synthetic construct
  misc_feature 1..20: note = CRISPR gRNA sequence
  source 1..20: mol_type = other DNA
actctgtctcaaaaaaaaaa

SEQ ID NO: 91754 - DNA, 20 bp, synthetic construct
  misc_feature 1..20: note = CRISPR gRNA sequence
  source 1..20: mol_type = other DNA
tgtctcaaaaaaaaaaaaga

SEQ ID NO: 91755 - DNA, 20 bp, synthetic construct
  misc_feature 1..20: note = CRISPR gRNA sequence
  source 1..20: mol_type = other DNA
aaaaaaaaaagaaagaaaaa

SEQ ID NO: 91756 - DNA, 20 bp, synthetic construct
  misc_feature 1..20: note = CRISPR gRNA sequence
  source 1..20: mol_type = other DNA
attatttttctccctctcta

SEQ ID NO: 91757 - DNA, 20 bp, synthetic construct
  misc_feature 1..20: note = CRISPR gRNA sequence
  source 1..20: mol_type = other DNA
tccctctctaaagaattctg

SEQ ID NO: 91758 - DNA, 20 bp, synthetic construct
  misc_feature 1..20: note = CRISPR gRNA sequence
  source 1..20: mol_type = other DNA
ctaaagaattctgaagtgaa

SEQ ID NO: 91759 - DNA, 20 bp, synthetic construct
  misc_feature 1..20: note = CRISPR gRNA sequence
  source 1..20: mol_type = other DNA
taaagaattctgaagtgaat

SEQ ID NO: 91760 - DNA, 20 bp, synthetic construct
  misc_feature 1..20: note = CRISPR gRNA sequence
  source 1..20: mol_type = other DNA
ctgaagtgaatgggcacctg

SEQ ID NO: 91761 - DNA, 20 bp, synthetic construct
  misc_feature 1..20: note = CRISPR gRNA sequence
  source 1..20: mol_type = other DNA
gggcacctgtggaacatact

SEQ ID NO: 91762 - DNA, 20 bp, synthetic construct
  misc_feature 1..20: note = CRISPR gRNA sequence
  source 1..20: mol_type = other DNA
ggcacctgtggaacatactg

SEQ ID NO: 91763 - DNA, 20 bp, synthetic construct
  misc_feature 1..20: note = CRISPR gRNA sequence
  source 1..20: mol_type = other DNA
acctgtggaacatactgagg

SEQ ID NO: 91764 - DNA, 20 bp, synthetic construct
  misc_feature 1..20: note = CRISPR gRNA sequence
  source 1..20: mol_type = other DNA
tactaactttcattcttttc

SEQ ID NO: 91765 - DNA, 20 bp, synthetic construct
  misc_feature 1..20: note = CRISPR gRNA sequence
  source 1..20: mol_type = other DNA
tttccctaaatccccgtaat

SEQ ID NO: 91766 - DNA, 20 bp, synthetic construct
  misc_feature 1..20: note = CRISPR gRNA sequence
  source 1..20: mol_type = other DNA
tccctaaatccccgtaatca

SEQ ID NO: 91767 - DNA, 20 bp, synthetic construct
  misc_feature 1..20: note = CRISPR gRNA sequence
  source 1..20: mol_type = other DNA
aatccccgtaatcagagatt

SEQ ID NO: 91768 - DNA, 20 bp, synthetic construct
  misc_feature 1..20: note = CRISPR gRNA sequence
  source 1..20: mol_type = other DNA
gatttggtaaaacatactat

SEQ ID NO: 91769 - DNA, 20 bp, synthetic construct
  misc_feature 1..20: note = CRISPR gRNA sequence
  source 1..20: mol_type = other DNA
taaaacatactataagaata

SEQ ID NO: 91770 - DNA, 20 bp, synthetic construct
  misc_feature 1..20: note = CRISPR gRNA sequence
  source 1..20: mol_type = other DNA
atactataagaatatggatt

SEQ ID NO: 91771 - DNA, 20 bp, synthetic construct
  misc_feature 1..20: note = CRISPR gRNA sequence
  source 1..20: mol_type = other DNA
tactataagaatatggattg

SEQ ID NO: 91772 - DNA, 20 bp, synthetic construct
  misc_feature 1..20: note = CRISPR gRNA sequence
  source 1..20: mol_type = other DNA
actataagaatatggattga

SEQ ID NO: 91773 - DNA, 20 bp, synthetic construct
  misc_feature 1..20: note = CRISPR gRNA sequence
  source 1..20: mol_type = other DNA
ctataagaatatggattgag

SEQ ID NO: 91774 - DNA, 20 bp, synthetic construct
  misc_feature 1..20: note = CRISPR gRNA sequence
  source 1..20: mol_type = other DNA
tataagaatatggattgagg

SEQ ID NO: 91775 - DNA, 20 bp, synthetic construct
  misc_feature 1..20: note = CRISPR gRNA sequence
  source 1..20: mol_type = other DNA
attgagggggtttttaaact

SEQ ID NO: 91776 - DNA, 20 bp, synthetic construct
  misc_feature 1..20: note = CRISPR gRNA sequence
  source 1..20: mol_type = other DNA
gggtttttaaactaagatta

SEQ ID NO: 91777 - DNA, 20 bp, synthetic construct
  misc_feature 1..20: note = CRISPR gRNA sequence
  source 1..20: mol_type = other DNA
tttttaaactaagattacag

SEQ ID NO: 91778 - DNA, 20 bp, synthetic construct
  misc_feature 1..20: note = CRISPR gRNA sequence
  source 1..20: mol_type = other DNA
actaagattacagaagtcct

SEQ ID NO: 91779 - DNA, 20 bp, synthetic construct
  misc_feature 1..20: note = CRISPR gRNA sequence
  source 1..20: mol_type = other DNA
gaagtcctgagcccattaat

SEQ ID NO: 91780 - DNA, 20 bp, synthetic construct
  misc_feature 1..20: note = CRISPR gRNA sequence
  source 1..20: mol_type = other DNA
ttaattagtatgcaaaatta

SEQ ID NO: 91781 - DNA, 20 bp, synthetic construct
  misc_feature 1..20: note = CRISPR gRNA sequence
  source 1..20: mol_type = other DNA
tatgcaaaattaaagttaca

SEQ ID NO: 91782 - DNA, 20 bp, synthetic construct
  misc_feature 1..20: note = CRISPR gRNA sequence
  source 1..20: mol_type = other DNA
gcaaaattaaagttacatag

SEQ ID NO: 91783 - DNA, 20 bp, synthetic construct
  misc_feature 1..20: note = CRISPR gRNA sequence
  source 1..20: mol_type = other DNA
agttacatagtggatttttc

SEQ ID NO: 91784 - DNA, 20 bp, synthetic construct
  misc_feature 1..20: note = CRISPR gRNA sequence
  source 1..20: mol_type = other DNA
gttacatagtggatttttct

SEQ ID NO: 91785 - DNA, 20 bp, synthetic construct
  misc_feature 1..20: note = CRISPR gRNA sequence
  source 1..20: mol_type = other DNA
acatagtggatttttctagg

SEQ ID NO: 91786 - DNA, 20 bp, synthetic construct
  misc_feature 1..20: note = CRISPR gRNA sequence
  source 1..20: mol_type = other DNA
atagtggatttttctaggaa

SEQ ID NO: 91787 - DNA, 20 bp, synthetic construct
  misc_feature 1..20: note = CRISPR gRNA sequence
  source 1..20: mol_type = other DNA
ttctaggaagagtcttcatt

SEQ ID NO: 91788 - DNA, 20 bp, synthetic construct
  misc_feature 1..20: note = CRISPR gRNA sequence
  source 1..20: mol_type = other DNA
aagagtcttcattaagtcac

SEQ ID NO: 91789 - DNA, 20 bp, synthetic construct
  misc_feature 1..20: note = CRISPR gRNA sequence
  source 1..20: mol_type = other DNA
attaagtcaccagaccctca

SEQ ID NO: 91790 - DNA, 20 bp, synthetic construct
  misc_feature 1..20: note = CRISPR gRNA sequence
  source 1..20: mol_type = other DNA
aagtcaccagaccctcaaag

SEQ ID NO: 91791 - DNA, 20 bp, synthetic construct
  misc_feature 1..20: note = CRISPR gRNA sequence
  source 1..20: mol_type = other DNA
aagaagtcctcttactccaa

SEQ ID NO: 91792 - DNA, 20 bp, synthetic construct
  misc_feature 1..20: note = CRISPR gRNA sequence
  source 1..20: mol_type = other DNA
gaagtcctcttactccaaaa

SEQ ID NO: 91793 - DNA, 20 bp, synthetic construct
  misc_feature 1..20: note = CRISPR gRNA sequence
  source 1..20: mol_type = other DNA
actccaaaagagtaaaactt

SEQ ID NO: 91794 - DNA, 20 bp, synthetic construct
  misc_feature 1..20: note = CRISPR gRNA sequence
  source 1..20: mol_type = other DNA
ctccaaaagagtaaaactta

SEQ ID NO: 91795 - DNA, 20 bp, synthetic construct
  misc_feature 1..20: note = CRISPR gRNA sequence
  source 1..20: mol_type = other DNA
tccaaaagagtaaaacttaa

SEQ ID NO: 91796 - DNA, 20 bp, synthetic construct
  misc_feature 1..20: note = CRISPR gRNA sequence
  source 1..20: mol_type = other DNA
aaagagtaaaacttaaggga

SEQ ID NO: 91797 - DNA, 20 bp, synthetic construct
  misc_feature 1..20: note = CRISPR gRNA sequence
  source 1..20: mol_type = other DNA
agagtaaaacttaagggaaa

SEQ ID NO: 91798 - DNA, 20 bp, synthetic construct
  misc_feature 1..20: note = CRISPR gRNA sequence
  source 1..20: mol_type = other DNA
gtaaaacttaagggaaagag

SEQ ID NO: 91799 - DNA, 20 bp, synthetic construct
  misc_feature 1..20: note = CRISPR gRNA sequence
  source 1..20: mol_type = other DNA
taagggaaagagaagtcact

SEQ ID NO: 91800 - DNA, 20 bp, synthetic construct
  misc_feature 1..20: note = CRISPR gRNA sequence
  source 1..20: mol_type = other DNA
agaagtcactcagtcctaac

SEQ ID NO: 91801 - DNA, 20 bp, synthetic construct
  misc_feature 1..20: note = CRISPR gRNA sequence
  source 1..20: mol_type = other DNA
agtcctaaccagtgtgaatt

SEQ ID NO: 91802 - DNA, 20 bp, synthetic construct
  misc_feature 1..20: note = CRISPR gRNA sequence
  source 1..20: mol_type = other DNA
gtgaattaagtatgacacac

SEQ ID NO: 91803 - DNA, 20 bp, synthetic construct
  misc_feature 1..20: note = CRISPR gRNA sequence
  source 1..20: mol_type = other DNA
acactggcaactgcaaattt

SEQ ID NO: 91804 - DNA, 20 bp, synthetic construct
  misc_feature 1..20: note = CRISPR gRNA sequence
  source 1..20: mol_type = other DNA
ctgcaaattttagaaatatt

SEQ ID NO: 91805 - DNA, 20 bp, synthetic construct
  misc_feature 1..20: note = CRISPR gRNA sequence
  source 1..20: mol_type = other DNA
atattatactttttgttttt

SEQ ID NO: 91806 - DNA, 20 bp, synthetic construct
  misc_feature 1..20: note = CRISPR gRNA sequence
  source 1..20: mol_type = other DNA
tactttttgtttttgagaca

SEQ ID NO: 91807 - DNA, 20 bp, synthetic construct
  misc_feature 1..20: note = CRISPR gRNA sequence
  source 1..20: mol_type = other DNA
caaagtcttgctctgtcacc

SEQ ID NO: 91808 - DNA, 20 bp, synthetic construct
  misc_feature 1..20: note = CRISPR gRNA sequence
  source 1..20: mol_type = other DNA
aaagtcttgctctgtcaccc

SEQ ID NO: 91809 - DNA, 20 bp, synthetic construct
  misc_feature 1..20: note = CRISPR gRNA sequence
  source 1..20: mol_type = other DNA
tcttgctctgtcacccaggc

SEQ ID NO: 91810 - DNA, 20 bp, synthetic construct
  misc_feature 1..20: note = CRISPR gRNA sequence
  source 1..20: mol_type = other DNA
ttgctctgtcacccaggctg

SEQ ID NO: 91811 - DNA, 20 bp, synthetic construct
  misc_feature 1..20: note = CRISPR gRNA sequence
  source 1..20: mol_type = other DNA
ctgtcacccaggctggagtg

SEQ ID NO: 91812 - DNA, 20 bp, synthetic construct
  misc_feature 1..20: note = CRISPR gRNA sequence
  source 1..20: mol_type = other DNA
tcacccaggctggagtgaag

SEQ ID NO: 91813 - DNA, 20 bp, synthetic construct
  misc_feature 1..20: note = CRISPR gRNA sequence
  source 1..20: mol_type = other DNA
ggagtgaagtagcacaacca

SEQ ID NO: 91814 - DNA, 20 bp, synthetic construct
  misc_feature 1..20: note = CRISPR gRNA sequence
  source 1..20: mol_type = other DNA
agcacaaccatggctcactg

SEQ ID NO: 91815 - DNA, 20 bp, synthetic construct
  misc_feature 1..20: note = CRISPR gRNA sequence
  source 1..20: mol_type = other DNA
tcactgcagcctcaatctcc

SEQ ID NO: 91816 - DNA, 20 bp, synthetic construct
  misc_feature 1..20: note = CRISPR gRNA sequence
  source 1..20: mol_type = other DNA
cactgcagcctcaatctcct

SEQ ID NO: 91817 - DNA, 20 bp, synthetic construct
  misc_feature 1..20: note = CRISPR gRNA sequence
  source 1..20: mol_type = other DNA
gctcaatgatccttccacct

SEQ ID NO: 91818 - DNA, 20 bp, synthetic construct
  misc_feature 1..20: note = CRISPR gRNA sequence
  source 1..20: mol_type = other DNA
tccttccacctcagcctccc

SEQ ID NO: 91819 - DNA, 20 bp, synthetic construct
  misc_feature 1..20: note = CRISPR gRNA sequence
  source 1..20: mol_type = other DNA
ttccacctcagcctcccgag

SEQ ID NO: 91820 - DNA, 20 bp, synthetic construct
  misc_feature 1..20: note = CRISPR gRNA sequence
  source 1..20: mol_type = other DNA
acctcagcctcccgagtagc

SEQ ID NO: 91821 - DNA, 20 bp, synthetic construct
  misc_feature 1..20: note = CRISPR gRNA sequence
  source 1..20: mol_type = other DNA
cctcagcctcccgagtagct

SEQ ID NO: 91822 - DNA, 20 bp, synthetic construct
  misc_feature 1..20: note = CRISPR gRNA sequence
  source 1..20: mol_type = other DNA
ctcccgagtagctaggacca

SEQ ID NO: 91823 - DNA, 20 bp, synthetic construct
  misc_feature 1..20: note = CRISPR gRNA sequence
  source 1..20: mol_type = other DNA
tcccgagtagctaggaccac

SEQ ID NO: 91824 - DNA, 20 bp, synthetic construct
  misc_feature 1..20: note = CRISPR gRNA sequence
  source 1..20: mol_type = other DNA
caggcatgtgccaacatacc

SEQ ID NO: 91825 - DNA, 20 bp, synthetic construct
  misc_feature 1..20: note = CRISPR gRNA sequence
  source 1..20: mol_type = other DNA
atttttaaaatttttttgtt

SEQ ID NO: 91826 - DNA, 20 bp, synthetic construct
  misc_feature 1..20: note = CRISPR gRNA sequence
  source 1..20: mol_type = other DNA
ttaaaatttttttgttgaga

SEQ ID NO: 91827 - DNA, 20 bp, synthetic construct
  misc_feature 1..20: note = CRISPR gRNA sequence
  source 1..20: mol_type = other DNA
taaaatttttttgttgagat

SEQ ID NO: 91828 - DNA, 20 bp, synthetic construct
  misc_feature 1..20: note = CRISPR gRNA sequence
  source 1..20: mol_type = other DNA
aaaatttttttgttgagatg

SEQ ID NO: 91829 - DNA, 20 bp, synthetic construct
  misc_feature 1..20: note = CRISPR gRNA sequence
  source 1..20: mol_type = other DNA
tggggtctccctatgttacc

SEQ ID NO: 91830 - DNA, 20 bp, synthetic construct
  misc_feature 1..20: note = CRISPR gRNA sequence
  source 1..20: mol_type = other DNA
ggggtctccctatgttaccc

SEQ ID NO: 91831 - DNA, 20 bp, synthetic construct
  misc_feature 1..20: note = CRISPR gRNA sequence
  source 1..20: mol_type = other DNA
tctccctatgttacccaggc

SEQ ID NO: 91832 - DNA, 20 bp, synthetic construct
  misc_feature 1..20: note = CRISPR gRNA sequence
  source 1..20: mol_type = other DNA
ccaggctggtctcaaacttc

SEQ ID NO: 91833 - DNA, 20 bp, synthetic construct
  misc_feature 1..20: note = CRISPR gRNA sequence
  source 1..20: mol_type = other DNA
caggctggtctcaaacttcc

SEQ ID NO: 91834 - DNA, 20 bp, synthetic construct
  misc_feature 1..20: note = CRISPR gRNA sequence
  source 1..20: mol_type = other DNA
ggtctcaaacttccgggctc

SEQ ID NO: 91835 - DNA, 20 bp, synthetic construct
  misc_feature 1..20: note = CRISPR gRNA sequence
  source 1..20: mol_type = other DNA
gctcaagcgatcctccctcc

SEQ ID NO: 91836 - DNA, 20 bp, synthetic construct
  misc_feature 1..20: note = CRISPR gRNA sequence
  source 1..20: mol_type = other DNA
ctcaagcgatcctccctcct

SEQ ID NO: 91837 - DNA, 20 bp, synthetic construct
  misc_feature 1..20: note = CRISPR gRNA sequence
  source 1..20: mol_type = other DNA
cctccctcctaggcctcccc

SEQ ID NO: 91838 - DNA, 20 bp, synthetic construct
  misc_feature 1..20: note = CRISPR gRNA sequence
  source 1..20: mol_type = other DNA
tcctaggcctccccaagttc

SEQ ID NO: 91839 - DNA, 20 bp, synthetic construct
  misc_feature 1..20: note = CRISPR gRNA sequence
  source 1..20: mol_type = other DNA
cctaggcctccccaagttct

SEQ ID NO: 91840 - DNA, 20 bp, synthetic construct
  misc_feature 1..20: note = CRISPR gRNA sequence
  source 1..20: mol_type = other DNA
ctccccaagttctgggctta

SEQ ID NO: 91841 - DNA, 20 bp, synthetic construct
  misc_feature 1..20: note = CRISPR gRNA sequence
  source 1..20: mol_type = other DNA
tccccaagttctgggcttac

SEQ ID NO: 91842 - DNA, 20 bp, synthetic construct
  misc_feature 1..20: note = CRISPR gRNA sequence
  source 1..20: mol_type = other DNA
agttctgggcttacaggtat

SEQ ID NO: 91843 - DNA, 20 bp, synthetic construct
  misc_feature 1..20: note = CRISPR gRNA sequence
  source 1..20: mol_type = other DNA
gcttacaggtattagccact

SEQ ID NO: 91844 - DNA, 20 bp, synthetic construct
  misc_feature 1..20: note = CRISPR gRNA sequence
  source 1..20: mol_type = other DNA
caggtattagccactgagcc

SEQ ID NO: 91845 - DNA, 20 bp, synthetic construct
  misc_feature 1..20: note = CRISPR gRNA sequence
  source 1..20: mol_type = other DNA
attagccactgagcctggcc

SEQ ID NO: 91846 - DNA, 20 bp, synthetic construct
  misc_feature 1..20: note = CRISPR gRNA sequence
  source 1..20: mol_type = other DNA
ttacatttgtaaacaattac

SEQ ID NO: 91847 - DNA, 20 bp, synthetic construct
  misc_feature 1..20: note = CRISPR gRNA sequence
  source 1..20: mol_type = other DNA
tacatttgtaaacaattaca

SEQ ID NO: 91848 - DNA, 20 bp, synthetic construct
  misc_feature 1..20: note = CRISPR gRNA sequence
  source 1..20: mol_type = other DNA
aattacaaggtctaatattt

SEQ ID NO: 91849 - DNA, 20 bp, synthetic construct
  misc_feature 1..20: note = CRISPR gRNA sequence
  source 1..20: mol_type = other DNA
aaggtctaatattttagtga

SEQ ID NO: 91850 - DNA, 20 bp, synthetic construct
  misc_feature 1..20: note = CRISPR gRNA sequence
  source 1..20: mol_type = other DNA
ggtctaatattttagtgatg

SEQ ID NO: 91851 - DNA, 20 bp, synthetic construct
  misc_feature 1..20: note = CRISPR gRNA sequence
  source 1..20: mol_type = other DNA
ttttagtgatggagcacttc

SEQ ID NO: 91852 - DNA, 20 bp, synthetic construct
  misc_feature 1..20: note = CRISPR gRNA sequence
  source 1..20: mol_type = other DNA
gtgatggagcacttcaagtt

SEQ ID NO: 91853 - DNA, 20 bp, synthetic construct
  misc_feature 1..20: note = CRISPR gRNA sequence
  source 1..20: mol_type = other DNA
ttcaagttcagcctgaaact

SEQ ID NO: 91854 - DNA, 20 bp, synthetic construct
  misc_feature 1..20: note = CRISPR gRNA sequence
  source 1..20: mol_type = other DNA
gcctgaaactaagaaattta

SEQ ID NO: 91855 - DNA, 20 bp, synthetic construct
  misc_feature 1..20: note = CRISPR gRNA sequence
  source 1..20: mol_type = other DNA
aactaagaaatttaaagact

SEQ ID NO: 91856 - DNA, 20 bp, synthetic construct
  misc_feature 1..20: note = CRISPR gRNA sequence
  source 1..20: mol_type = other DNA
taaagacttagaatacatcc

SEQ ID NO: 91857 - DNA, 20 bp, synthetic construct
  misc_feature 1..20: note = CRISPR gRNA sequence
  source 1..20: mol_type = other DNA
aaagacttagaatacatcct

SEQ ID NO: 91858 - DNA, 20 bp, synthetic construct
  misc_feature 1..20: note = CRISPR gRNA sequence
  source 1..20: mol_type = other DNA
agaatacatcctaggaccct

SEQ ID NO: 91859 - DNA, 20 bp, synthetic construct
  misc_feature 1..20: note = CRISPR gRNA sequence
  source 1..20: mol_type = other DNA
tacatcctaggaccctaaga

SEQ ID NO: 91860 - DNA, 20 bp, synthetic construct
  misc_feature 1..20: note = CRISPR gRNA sequence
  source 1..20: mol_type = other DNA
taggaccctaagacagcttg

SEQ ID NO: 91861 - DNA, 20 bp, synthetic construct
  misc_feature 1..20: note = CRISPR gRNA sequence
  source 1..20: mol_type = other DNA
tttttttttttttttttttt

SEQ ID NO: 91862 - DNA, 20 bp, synthetic construct
  misc_feature 1..20: note = CRISPR gRNA sequence
  source 1..20: mol_type = other DNA
ttttttttttttttttttta

SEQ ID NO: 91863 - DNA, 20 bp, synthetic construct
  misc_feature 1..20: note = CRISPR gRNA sequence
  source 1..20: mol_type = other DNA
tttttttttttttttttaag

SEQ ID NO: 91864 - DNA, 20 bp, synthetic construct
  misc_feature 1..20: note = CRISPR gRNA sequence
  source 1..20: mol_type = other DNA
tttttttttttttaaggaga

SEQ ID NO: 91865 - DNA, 20 bp, synthetic construct
  misc_feature 1..20: note = CRISPR gRNA sequence
  source 1..20: mol_type = other DNA
ttttttttttttaaggagac

SEQ ID NO: 91866 - DNA, 20 bp, synthetic construct
  misc_feature 1..20: note = CRISPR gRNA sequence
  source 1..20: mol_type = other DNA
tttttttttttaaggagaca

SEQ ID NO: 91867 - DNA, 20 bp, synthetic construct
  misc_feature 1..20: note = CRISPR gRNA sequence
  source 1..20: mol_type = other DNA
cagggtcttgctatgtcatc

SEQ ID NO: 91868 - DNA, 20 bp, synthetic construct
  misc_feature 1..20: note = CRISPR gRNA sequence
  source 1..20: mol_type = other DNA
agggtcttgctatgtcatcc

SEQ ID NO: 91869 - DNA, 20 bp, synthetic construct
  misc_feature 1..20: note = CRISPR gRNA sequence
  source 1..20: mol_type = other DNA
tcttgctatgtcatccaggc

SEQ ID NO: 91870 - DNA, 20 bp, synthetic construct
  misc_feature 1..20: note = CRISPR gRNA sequence
  source 1..20: mol_type = other DNA
atgtcatccaggctggaatg

SEQ ID NO: 91871 - DNA, 20 bp, synthetic construct
  misc_feature 1..20: note = CRISPR gRNA sequence
  source 1..20: mol_type = other DNA
tggaatgcagtgatgcaaac

SEQ ID NO: 91872 - DNA, 20 bp, synthetic construct
  misc_feature 1..20: note = CRISPR gRNA sequence
  source 1..20: mol_type = other DNA
ggaatgcagtgatgcaaaca

SEQ ID NO: 91873 - DNA, 20 bp, synthetic construct
  misc_feature 1..20: note = CRISPR gRNA sequence
  source 1..20: mol_type = other DNA
agtgatgcaaacaaggctca

SEQ ID NO: 91874 - DNA, 20 bp, synthetic construct
  misc_feature 1..20: note = CRISPR gRNA sequence
  source 1..20: mol_type = other DNA
gatgcaaacaaggctcacgg

SEQ ID NO: 91875 - DNA, 20 bp, synthetic construct
  misc_feature 1..20: note = CRISPR gRNA sequence
  source 1..20: mol_type = other DNA
tcacggcagcctcgaacccc

SEQ ID NO: 91876 - DNA, 20 bp, synthetic construct
  misc_feature 1..20: note = CRISPR gRNA sequence
  source 1..20: mol_type = other DNA
agcctcgaacccctggtctc

SEQ ID NO: 91877 - DNA, 20 bp, synthetic construct
  misc_feature 1..20: note = CRISPR gRNA sequence
  source 1..20: mol_type = other DNA
tcttcccacttcaccctccc

SEQ ID NO: 91878 - DNA, 20 bp, synthetic construct
  misc_feature 1..20: note = CRISPR gRNA sequence
  source 1..20: mol_type = other DNA
ccacttcaccctcccaagta

SEQ ID NO: 91879 - DNA, 20 bp, synthetic construct
  misc_feature 1..20: note = CRISPR gRNA sequence
  source 1..20: mol_type = other DNA
ttcaccctcccaagtacagc

SEQ ID NO: 91880 - DNA, 20 bp, synthetic construct
  misc_feature 1..20: note = CRISPR gRNA sequence
  source 1..20: mol_type = other DNA
tcaccctcccaagtacagct

SEQ ID NO: 91881 - DNA, 20 bp, synthetic construct
  misc_feature 1..20: note = CRISPR gRNA sequence
  source 1..20: mol_type = other DNA
cccaagtacagctgggtata

SEQ ID NO: 91882 - DNA, 20 bp, synthetic construct
  misc_feature 1..20: note = CRISPR gRNA sequence
  source 1..20: mol_type = other DNA
ccaagtacagctgggtatac

SEQ ID NO: 91883 - DNA, 20 bp, synthetic construct
  misc_feature 1..20: note = CRISPR gRNA sequence
  source 1..20: mol_type = other DNA
caggcacttgccaccatacc

SEQ ID NO: 91884 - DNA, 20 bp, synthetic construct
  misc_feature 1..20: note = CRISPR gRNA sequence
  source 1..20: mol_type = other DNA
acttgccaccatacctggct

SEQ ID NO: 91885 - DNA, 20 bp, synthetic construct
  misc_feature 1..20: note = CRISPR gRNA sequence
  source 1..20: mol_type = other DNA
attaaatttttctctacact

SEQ ID NO: 91886 - DNA, 20 bp, synthetic construct
  misc_feature 1..20: note = CRISPR gRNA sequence
  source 1..20: mol_type = other DNA
ttaaatttttctctacacta

SEQ ID NO: 91887 - DNA, 20 bp, synthetic construct
  misc_feature 1..20: note = CRISPR gRNA sequence
  source 1..20: mol_type = other DNA
taaatttttctctacactaa

SEQ ID NO: 91888 - DNA, 20 bp, synthetic construct
  misc_feature 1..20: note = CRISPR gRNA sequence
  source 1..20: mol_type = other DNA
ctctacactaagggattata

SEQ ID NO: 91889 - DNA, 20 bp, synthetic construct
  misc_feature 1..20: note = CRISPR gRNA sequence
  source 1..20: mol_type = other DNA
agggattatatagctctcac

SEQ ID NO: 91890 - DNA, 20 bp, synthetic construct
  misc_feature 1..20: note = CRISPR gRNA sequence
  source 1..20: mol_type = other DNA
gattatatagctctcacaag

SEQ ID NO: 91891 - DNA, 20 bp, synthetic construct
  misc_feature 1..20: note = CRISPR gRNA sequence
  source 1..20: mol_type = other DNA
aaatatctgcttatttgtga

SEQ ID NO: 91892 - DNA, 20 bp, synthetic construct
  misc_feature 1..20: note = CRISPR gRNA sequence
  source 1..20: mol_type = other DNA
gcttatttgtgacagcctca

SEQ ID NO: 91893 - DNA, 20 bp, synthetic construct
  misc_feature 1..20: note = CRISPR gRNA sequence
  source 1..20: mol_type = other DNA
actaacaatgacaataataa

SEQ ID NO: 91894 - DNA, 20 bp, synthetic construct
  misc_feature 1..20: note = CRISPR gRNA sequence
  source 1..20: mol_type = other DNA
ctaacaatgacaataataat

SEQ ID NO: 91895 - DNA, 20 bp, synthetic construct
  misc_feature 1..20: note = CRISPR gRNA sequence
  source 1..20: mol_type = other DNA
caatgacaataataatgggt

SEQ ID NO: 91896 - DNA, 20 bp, synthetic construct
  misc_feature 1..20: note = CRISPR gRNA sequence
  source 1..20: mol_type = other DNA
aatgacaataataatgggta

SEQ ID NO: 91897 - DNA, 20 bp, synthetic construct
  misc_feature 1..20: note = CRISPR gRNA sequence
  source 1..20: mol_type = other DNA
tgggtaaggtttgcaaactt

SEQ ID NO: 91898 - DNA, 20 bp, synthetic construct
  misc_feature 1..20: note = CRISPR gRNA sequence
  source 1..20: mol_type = other DNA
taaggtttgcaaactttagc

SEQ ID NO: 91899 - DNA, 20 bp, synthetic construct
  misc_feature 1..20: note = CRISPR gRNA sequence
  source 1..20: mol_type = other DNA
tgcaaactttagccagttgc

SEQ ID NO: 91900 - DNA, 20 bp, synthetic construct
  misc_feature 1..20: note = CRISPR gRNA sequence
  source 1..20: mol_type = other DNA
cactgtgtgaaccctcaata

SEQ ID NO: 91901 - DNA, 20 bp, synthetic construct
  misc_feature 1..20: note = CRISPR gRNA sequence
  source 1..20: mol_type = other DNA
tgtgaaccctcaatatggaa

SEQ ID NO: 91902 - DNA, 20 bp, synthetic construct
  misc_feature 1..20: note = CRISPR gRNA sequence
  source 1..20: mol_type = other DNA
tggaatggctcacatattca

SEQ ID NO: 91903 - DNA, 20 bp, synthetic construct
  misc_feature 1..20: note = CRISPR gRNA sequence
  source 1..20: mol_type = other DNA
cgattttaatgcccatttta

SEQ ID NO: 91904 - DNA, 20 bp, synthetic construct
  misc_feature 1..20: note = CRISPR gRNA sequence
  source 1..20: mol_type = other DNA
attttaatgcccattttaca

SEQ ID NO: 91905 - DNA, 20 bp, synthetic construct
  misc_feature 1..20: note = CRISPR gRNA sequence
  source 1..20: mol_type = other DNA
cagagtttaataacctattc

SEQ ID NO: 91906 - DNA, 20 bp, synthetic construct
  misc_feature 1..20: note = CRISPR gRNA sequence
  source 1..20: mol_type = other DNA
taataacctattcaagccac

SEQ ID NO: 91907 - DNA, 20 bp, synthetic construct
  misc_feature 1..20: note = CRISPR gRNA sequence
  source 1..20: mol_type = other DNA
aataacctattcaagccaca

SEQ ID NO: 91908 - DNA, 20 bp, synthetic construct
  misc_feature 1..20: note = CRISPR gRNA sequence
  source 1..20: mol_type = other DNA
acctattcaagccacaaggc

SEQ ID NO: 91909 - DNA, 20 bp, synthetic construct
  misc_feature 1..20: note = CRISPR gRNA sequence
  source 1..20: mol_type = other DNA
aaggccagtaaatgatgcaa

SEQ ID NO: 91910 - DNA, 20 bp, synthetic construct
  misc_feature 1..20: note = CRISPR gRNA sequence
  source 1..20: mol_type = other DNA
aggccagtaaatgatgcaac

SEQ ID NO: 91911 - DNA, 20 bp, synthetic construct
  misc_feature 1..20: note = CRISPR gRNA sequence
  source 1..20: mol_type = other DNA
ggccagtaaatgatgcaaca

SEQ ID NO: 91912 - DNA, 20 bp, synthetic construct
  misc_feature 1..20: note = CRISPR gRNA sequence
  source 1..20: mol_type = other DNA
atgcaacagggatttgcacc

SEQ ID NO: 91913 - DNA, 20 bp, synthetic construct
  misc_feature 1..20: note = CRISPR gRNA sequence
  source 1..20: mol_type = other DNA
caacagggatttgcacccag

SEQ ID NO: 91914 - DNA, 20 bp, synthetic construct
  misc_feature 1..20: note = CRISPR gRNA sequence
  source 1..20: mol_type = other DNA
tgcacccagaagtcgaactc

SEQ ID NO: 91915 - DNA, 20 bp, synthetic construct
  misc_feature 1..20: note = CRISPR gRNA sequence
  source 1..20: mol_type = other DNA
gaagtcgaactccagaacac

SEQ ID NO: 91916 - DNA, 20 bp, synthetic construct
  misc_feature 1..20: note = CRISPR gRNA sequence
  source 1..20: mol_type = other DNA
cactggttttacctttgact

SEQ ID NO: 91917 - DNA, 20 bp, synthetic construct
  misc_feature 1..20: note = CRISPR gRNA sequence
  source 1..20: mol_type = other DNA
gttcaaatcaaacaatccaa

SEQ ID NO: 91918 - DNA, 20 bp, synthetic construct
  misc_feature 1..20: note = CRISPR gRNA sequence
  source 1..20: mol_type = other DNA
aaacaatccaaaagtttttt

SEQ ID NO: 91919 - DNA, 20 bp, synthetic construct
  misc_feature 1..20: note = CRISPR gRNA sequence
  source 1..20: mol_type = other DNA
tcatcctttttttcccccct

SEQ ID NO: 91920 - DNA, 20 bp, synthetic construct
  misc_feature 1..20: note = CRISPR gRNA sequence
  source 1..20: mol_type = other DNA
catcctttttttcccccctc

SEQ ID NO: 91921 - DNA, 20 bp, synthetic construct
  misc_feature 1..20: note = CRISPR gRNA sequence
  source 1..20: mol_type = other DNA
atcctttttttcccccctca

SEQ ID NO: 91922 - DNA, 20 bp, synthetic construct
  misc_feature 1..20: note = CRISPR gRNA sequence
  source 1..20: mol_type = other DNA
tcctttttttcccccctcag

SEQ ID NO: 91923 - DNA, 20 bp, synthetic construct
  misc_feature 1..20: note = CRISPR gRNA sequence
  source 1..20: mol_type = other DNA
tttcccccctcaggggtact

SEQ ID NO: 91924 - DNA, 20 bp, synthetic construct
  misc_feature 1..20: note = CRISPR gRNA sequence
  source 1..20: mol_type = other DNA
cccctcaggggtactaagaa

SEQ ID NO: 91925 - DNA, 20 bp, synthetic construct
  misc_feature 1..20: note = CRISPR gRNA sequence
  source 1..20: mol_type = other DNA
ccctcaggggtactaagaaa

SEQ ID NO: 91926 - DNA, 20 bp, synthetic construct
  misc_feature 1..20: note = CRISPR gRNA sequence
  source 1..20: mol_type = other DNA
cctcaggggtactaagaaaa

SEQ ID NO: 91927 - DNA, 20 bp, synthetic construct
  misc_feature 1..20: note = CRISPR gRNA sequence
  source 1..20: mol_type = other DNA
ctcaggggtactaagaaaag

SEQ ID NO: 91928 - DNA, 20 bp, synthetic construct
  misc_feature 1..20: note = CRISPR gRNA sequence
  source 1..20: mol_type = other DNA
aggggtactaagaaaagggg

SEQ ID NO: 91929 - DNA, 20 bp, synthetic construct
  misc_feature 1..20: note = CRISPR gRNA sequence
  source 1..20: mol_type = other DNA
gtactaagaaaaggggtagt

SEQ ID NO: 91930 - DNA, 20 bp, synthetic construct
  misc_feature 1..20: note = CRISPR gRNA sequence
  source 1..20: mol_type = other DNA
aagaaaaggggtagtgagaa

SEQ ID NO: 91931 - DNA, 20 bp, synthetic construct
  misc_feature 1..20: note = CRISPR gRNA sequence
  source 1..20: mol_type = other DNA
agaaaaggggtagtgagaac

SEQ ID NO: 91932 - DNA, 20 bp, synthetic construct
  misc_feature 1..20: note = CRISPR gRNA sequence
  source 1..20: mol_type = other DNA
gaaaaggggtagtgagaaca

SEQ ID NO: 91933 - DNA, 20 bp, synthetic construct
  misc_feature 1..20: note = CRISPR gRNA sequence
  source 1..20: mol_type = other DNA
gagaacagggtactaacaac

SEQ ID NO: 91934 - DNA, 20 bp, synthetic construct
  misc_feature 1..20: note = CRISPR gRNA sequence
  source 1..20: mol_type = other DNA
agaacagggtactaacaaca

SEQ ID NO: 91935 - DNA, 20 bp, synthetic construct
  misc_feature 1..20: note = CRISPR gRNA sequence
  source 1..20: mol_type = other DNA
gtactaacaacaaggatact

SEQ ID NO: 91936 - DNA, 20 bp, synthetic construct
  misc_feature 1..20: note = CRISPR gRNA sequence
  source 1..20: mol_type = other DNA
caacaaggatactgagaaca

SEQ ID NO: 91937 - DNA, 20 bp, synthetic construct
  misc_feature 1..20: note = CRISPR gRNA sequence
  source 1..20: mol_type = other DNA
tactgagaacaaagtatatt

SEQ ID NO: 91938 - DNA, 20 bp, synthetic construct
  misc_feature 1..20: note = CRISPR gRNA sequence
  source 1..20: mol_type = other DNA
gaacaaagtatattaagtat

SEQ ID NO: 91939 - DNA, 20 bp, synthetic construct
  misc_feature 1..20: note = CRISPR gRNA sequence
  source 1..20: mol_type = other DNA
aacaaagtatattaagtatt

SEQ ID NO: 91940 - DNA, 20 bp, synthetic construct
  misc_feature 1..20: note = CRISPR gRNA sequence
  source 1..20: mol_type = other DNA
acaaagtatattaagtattg

SEQ ID NO: 91941 - DNA, 20 bp, synthetic construct
  misc_feature 1..20: note = CRISPR gRNA sequence
  source 1..20: mol_type = other DNA
aagtatattaagtattgggg

SEQ ID NO: 91942 - DNA, 20 bp, synthetic construct
  misc_feature 1..20: note = CRISPR gRNA sequence
  source 1..20: mol_type = other DNA
atattaagtattggggtagt

SEQ ID NO: 91943 - DNA, 20 bp, synthetic construct
  misc_feature 1..20: note = CRISPR gRNA sequence
  source 1..20: mol_type = other DNA
tattggggtagtgagaacat

SEQ ID NO: 91944 - DNA, 20 bp, synthetic construct
  misc_feature 1..20: note = CRISPR gRNA sequence
  source 1..20: mol_type = other DNA
ggtagtgagaacatgagaac

SEQ ID NO: 91945 - DNA, 20 bp, synthetic construct
  misc_feature 1..20: note = CRISPR gRNA sequence
  source 1..20: mol_type = other DNA
gtagtgagaacatgagaaca

SEQ ID NO: 91946 - DNA, 20 bp, synthetic construct
  misc_feature 1..20: note = CRISPR gRNA sequence
  source 1..20: mol_type = other DNA
tagtgagaacatgagaacaa

SEQ ID NO: 91947 - DNA, 20 bp, synthetic construct
  misc_feature 1..20: note = CRISPR gRNA sequence
  source 1..20: mol_type = other DNA
tgagaacaagggactaaaca

SEQ ID NO: 91948 - DNA, 20 bp, synthetic construct
  misc_feature 1..20: note = CRISPR gRNA sequence
  source 1..20: mol_type = other DNA
gagaacaagggactaaacat

SEQ ID NO: 91949 - DNA, 20 bp, synthetic construct
  misc_feature 1..20: note = CRISPR gRNA sequence
  source 1..20: mol_type = other DNA
agaacaagggactaaacata

SEQ ID NO: 91950 - DNA, 20 bp, synthetic construct
  misc_feature 1..20: note = CRISPR gRNA sequence
  source 1..20: mol_type = other DNA
gaacaagggactaaacatag

SEQ ID NO: 91951 - DNA, 20 bp, synthetic construct
  misc_feature 1..20: note = CRISPR gRNA sequence
  source 1..20: mol_type = other DNA
gggactaaacataggggtac

SEQ ID NO: 91952 - DNA, 20 bp, synthetic construct
  misc_feature 1..20: note = CRISPR gRNA sequence
  source 1..20: mol_type = other DNA
ggactaaacataggggtact

SEQ ID NO: 91953 - DNA, 20 bp, synthetic construct
  misc_feature 1..20: note = CRISPR gRNA sequence
  source 1..20: mol_type = other DNA
aaacataggggtactgggaa

SEQ ID NO: 91954 - DNA, 20 bp, synthetic construct
  misc_feature 1..20: note = CRISPR gRNA sequence
  source 1..20: mol_type = other DNA
acataggggtactgggaaca

SEQ ID NO: 91955 - DNA, 20 bp, synthetic construct
  misc_feature 1..20: note = CRISPR gRNA sequence
  source 1..20: mol_type = other DNA
ggtactgggaacagagttgt

SEQ ID NO: 91956 - DNA, 20 bp, synthetic construct
  misc_feature 1..20: note = CRISPR gRNA sequence
  source 1..20: mol_type = other DNA
tgggaacagagttgtaagaa

SEQ ID NO: 91957 - DNA, 20 bp, synthetic construct
  misc_feature 1..20: note = CRISPR gRNA sequence
  source 1..20: mol_type = other DNA
ggaacagagttgtaagaaaa

SEQ ID NO: 91958 - DNA, 20 bp, synthetic construct
  misc_feature 1..20: note = CRISPR gRNA sequence
  source 1..20: mol_type = other DNA
taagaaaagagtactacgta

SEQ ID NO: 91959 - DNA, 20 bp, synthetic construct
  misc_feature 1..20: note = CRISPR gRNA sequence
  source 1..20: mol_type = other DNA
aagaaaagagtactacgtac

SEQ ID NO: 91960 - DNA, 20 bp, synthetic construct
  misc_feature 1..20: note = CRISPR gRNA sequence
  source 1..20: mol_type = other DNA
agaaaagagtactacgtaca

SEQ ID NO: 91961 - DNA, 20 bp, synthetic construct
  misc_feature 1..20: note = CRISPR gRNA sequence
  source 1..20: mol_type = other DNA
gaaaagagtactacgtacag

SEQ ID NO: 91962 - DNA, 20 bp, synthetic construct
  misc_feature 1..20: note = CRISPR gRNA sequence
  source 1..20: mol_type = other DNA
tactacgtacaggggtacta

SEQ ID NO: 91963 - DNA, 20 bp, synthetic construct
  misc_feature 1..20: note = CRISPR gRNA sequence
  source 1..20: mol_type = other DNA
acgtacaggggtactacaga

SEQ ID NO: 91964 - DNA, 20 bp, synthetic construct
  misc_feature 1..20: note = CRISPR gRNA sequence
  source 1..20: mol_type = other DNA
cgtacaggggtactacagac

SEQ ID NO: 91965 - DNA, 20 bp, synthetic construct
  misc_feature 1..20: note = CRISPR gRNA sequence
  source 1..20: mol_type = other DNA
ggtactacagacaggcaact

SEQ ID NO: 91966 - DNA, 20 bp, synthetic construct
  misc_feature 1..20: note = CRISPR gRNA sequence
  source 1..20: mol_type = other DNA
tacagacaggcaactgagta

SEQ ID NO: 91967 - DNA, 20 bp, synthetic construct
  misc_feature 1..20: note = CRISPR gRNA sequence
  source 1..20: mol_type = other DNA
agacaggcaactgagtatag

SEQ ID NO: 91968 - DNA, 20 bp, synthetic construct
  misc_feature 1..20: note = CRISPR gRNA sequence
  source 1..20: mol_type = other DNA
gtatagcagtactaaaaata

SEQ ID NO: 91969 - DNA, 20 bp, synthetic construct
  misc_feature 1..20: note = CRISPR gRNA sequence
  source 1..20: mol_type = other DNA
cagtactaaaaatacggtac

SEQ ID NO: 91970 - DNA, 20 bp, synthetic construct
  misc_feature 1..20: note = CRISPR gRNA sequence
  source 1..20: mol_type = other DNA
agtactaaaaatacggtact

SEQ ID NO: 91971 - DNA, 20 bp, synthetic construct
  misc_feature 1..20: note = CRISPR gRNA sequence
  source 1..20: mol_type = other DNA
actaaaaatacggtactagg

SEQ ID NO: 91972 - DNA, 20 bp, synthetic construct
  misc_feature 1..20: note = CRISPR gRNA sequence
  source 1..20: mol_type = other DNA
taaaaatacggtactaggaa

SEQ ID NO: 91973 - DNA, 20 bp, synthetic construct
  misc_feature 1..20: note = CRISPR gRNA sequence
  source 1..20: mol_type = other DNA
aaaaatacggtactaggaag

SEQ ID NO: 91974 - DNA, 20 bp, synthetic construct
  misc_feature 1..20: note = CRISPR gRNA sequence
  source 1..20: mol_type = other DNA
aaaatacggtactaggaaga

SEQ ID NO: 91975 - DNA, 20 bp, synthetic construct
  misc_feature 1..20: note = CRISPR gRNA sequence
  source 1..20: mol_type = other DNA
ggtactaggaagagggttaa

SEQ ID NO: 91976 - DNA, 20 bp, synthetic construct
  misc_feature 1..20: note = CRISPR gRNA sequence
  source 1..20: mol_type = other DNA
taggaagagggttaacagaa

SEQ ID NO: 91977 - DNA, 20 bp, synthetic construct
  misc_feature 1..20: note = CRISPR gRNA sequence
  source 1..20: mol_type = other DNA
aggaagagggttaacagaac

SEQ ID NO: 91978 - DNA, 20 bp, synthetic construct
  misc_feature 1..20: note = CRISPR gRNA sequence
  source 1..20: mol_type = other DNA
agaacaggacactaaaaaca

SEQ ID NO: 91979 - DNA, 20 bp, synthetic construct
  misc_feature 1..20: note = CRISPR gRNA sequence
  source 1..20: mol_type = other DNA
taaaaacaaagtactaaata

SEQ ID NO: 91980 - DNA, 20 bp, synthetic construct
  misc_feature 1..20: note = CRISPR gRNA sequence
  source 1..20: mol_type = other DNA
aaaaacaaagtactaaatac

SEQ ID NO: 91981 - DNA, 20 bp, synthetic construct
  misc_feature 1..20: note = CRISPR gRNA sequence
  source 1..20: mol_type = other DNA
aaacaaagtactaaatacag

SEQ ID NO: 91982 - DNA, 20 bp, synthetic construct
  misc_feature 1..20: note = CRISPR gRNA sequence
  source 1..20: mol_type = other DNA
aaatacaggagtattacaaa

SEQ ID NO: 91983 - DNA, 20 bp, synthetic construct
  misc_feature 1..20: note = CRISPR gRNA sequence
  source 1..20: mol_type = other DNA
atacaggagtattacaaata

SEQ ID NO: 91984 - DNA, 20 bp, synthetic construct
  misc_feature 1..20: note = CRISPR gRNA sequence
  source 1..20: mol_type = other DNA
tacaggagtattacaaatag

SEQ ID NO: 91985 - DNA, 20 bp, synthetic construct
  misc_feature 1..20: note = CRISPR gRNA sequence
  source 1..20: mol_type = other DNA
gtattacaaatagaggtact

SEQ ID NO: 91986 - DNA, 20 bp, synthetic construct
  misc_feature 1..20: note = CRISPR gRNA sequence
  source 1..20: mol_type = other DNA
caaatagaggtactgagaac

SEQ ID NO: 91987 - DNA, 20 bp, synthetic construct
  misc_feature 1..20: note = CRISPR gRNA sequence
  source 1..20: mol_type = other DNA
aaatagaggtactgagaact

SEQ ID NO: 91988 - DNA, 20 bp, synthetic construct
  misc_feature 1..20: note = CRISPR gRNA sequence
  source 1..20: mol_type = other DNA
ggtactgagaactgggtact

SEQ ID NO: 91989 - DNA, 20 bp, synthetic construct
  misc_feature 1..20: note = CRISPR gRNA sequence
  source 1..20: mol_type = other DNA
gagaactgggtactgagaac

SEQ ID NO: 91990 - DNA, 20 bp, synthetic construct
  misc_feature 1..20: note = CRISPR gRNA sequence
  source 1..20: mol_type = other DNA
ggtactgagaactggatact

SEQ ID NO: 91991 - DNA, 20 bp, synthetic construct
  misc_feature 1..20: note = CRISPR gRNA sequence
  source 1..20: mol_type = other DNA
tgagaactggatactgagaa

SEQ ID NO: 91992 - DNA, 20 bp, synthetic construct
  misc_feature 1..20: note = CRISPR gRNA sequence
  source 1..20: mol_type = other DNA
agaactggatactgagaata

SEQ ID NO: 91993 - DNA, 20 bp, synthetic construct
  misc_feature 1..20: note = CRISPR gRNA sequence
  source 1..20: mol_type = other DNA
actggatactgagaatagag

SEQ ID NO: 91994 - DNA, 20 bp, synthetic construct
  misc_feature 1..20: note = CRISPR gRNA sequence
  source 1..20: mol_type = other DNA
tgagaatagagtagtgaaaa

SEQ ID NO: 91995 - DNA, 20 bp, synthetic construct
  misc_feature 1..20: note = CRISPR gRNA sequence
  source 1..20: mol_type = other DNA
aatagagtagtgaaaacaga

SEQ ID NO: 91996 - DNA, 20 bp, synthetic construct
  misc_feature 1..20: note = CRISPR gRNA sequence
  source 1..20: mol_type = other DNA
tagagtagtgaaaacagaaa

SEQ ID NO: 91997 - DNA, 20 bp, synthetic construct
  misc_feature 1..20: note = CRISPR gRNA sequence
  source 1..20: mol_type = other DNA
acagaaagagatgactttct

SEQ ID NO: 91998 - DNA, 20 bp, synthetic construct
  misc_feature 1..20: note = CRISPR gRNA sequence
  source 1..20: mol_type = other DNA
gaaagagatgactttctcag

SEQ ID NO: 91999 - DNA, 20 bp, synthetic construct
  misc_feature 1..20: note = CRISPR gRNA sequence
  source 1..20: mol_type = other DNA
tcagaagtaccaacttcatc

SEQ ID NO: 92000 - DNA, 20 bp, synthetic construct
  misc_feature 1..20: note = CRISPR gRNA sequence
  source 1..20: mol_type = other DNA
cagaagtaccaacttcatct

SEQ ID NO: 92001 - DNA, 20 bp, synthetic construct
  misc_feature 1..20: note = CRISPR gRNA sequence
  source 1..20: mol_type = other DNA
ccaacttcatctaggttcct

SEQ ID NO: 92002 - DNA, 20 bp, synthetic construct
  misc_feature 1..20: note = CRISPR gRNA sequence
  source 1..20: mol_type = other DNA
ctaggttcctaagtctcctt

SEQ ID NO: 92003 - DNA, 20 bp, synthetic construct
  misc_feature 1..20: note = CRISPR gRNA sequence
  source 1..20: mol_type = other DNA
agtctcctttagcgatgaac

SEQ ID NO: 92004 - DNA, 20 bp, synthetic construct
  misc_feature 1..20: note = CRISPR gRNA sequence
  source 1..20: mol_type = other DNA
tcatttactctatgtccttc

SEQ ID NO: 92005 - DNA, 20 bp, synthetic construct
  misc_feature 1..20: note = CRISPR gRNA sequence
  source 1..20: mol_type = other DNA
atgtccttccagccatatcc

SEQ ID NO: 92006 - DNA, 20 bp, synthetic construct
  misc_feature 1..20: note = CRISPR gRNA sequence
  source 1..20: mol_type = other DNA
gccatatcccagatctatga

SEQ ID NO: 92007 - DNA, 20 bp, synthetic construct
  misc_feature 1..20: note = CRISPR gRNA sequence
  source 1..20: mol_type = other DNA
gaaatttctgcacctatcat

SEQ ID NO: 92008 - DNA, 20 bp, synthetic construct
  misc_feature 1..20: note = CRISPR gRNA sequence
  source 1..20: mol_type = other DNA
tgcacctatcatgagttcaa

SEQ ID NO: 92009 - DNA, 20 bp, synthetic construct
  misc_feature 1..20: note = CRISPR gRNA sequence
  source 1..20: mol_type = other DNA
tgttattgctttgcacatgt

SEQ ID NO: 92010 - DNA, 20 bp, synthetic construct
  misc_feature 1..20: note = CRISPR gRNA sequence
  source 1..20: mol_type = other DNA
tgttggtataaactttaatt

SEQ ID NO: 92011 - DNA, 20 bp, synthetic construct
  misc_feature 1..20: note = CRISPR gRNA sequence
  source 1..20: mol_type = other DNA
gttggtataaactttaattt

SEQ ID NO: 92012 - DNA, 20 bp, synthetic construct
  misc_feature 1..20: note = CRISPR gRNA sequence
  source 1..20: mol_type = other DNA
ttggtataaactttaattta

SEQ ID NO: 92013 - DNA, 20 bp, synthetic construct
  misc_feature 1..20: note = CRISPR gRNA sequence
  source 1..20: mol_type = other DNA
ctaattctcaaccactaacc

SEQ ID NO: 92014 - DNA, 20 bp, synthetic construct
  misc_feature 1..20: note = CRISPR gRNA sequence
  source 1..20: mol_type = other DNA
ctaacccagtcactgcaaac

SEQ ID NO: 92015 - DNA, 20 bp, synthetic construct
  misc_feature 1..20: note = CRISPR gRNA sequence
  source 1..20: mol_type = other DNA
tcactgcaaaccggcccatt

SEQ ID NO: 92016 - DNA, 20 bp, synthetic construct
  misc_feature 1..20: note = CRISPR gRNA sequence
  source 1..20: mol_type = other DNA
ctgcaaaccggcccatttgg

SEQ ID NO: 92017 - DNA, 20 bp, synthetic construct
  misc_feature 1..20: note = CRISPR gRNA sequence
  source 1..20: mol_type = other DNA
caaaccggcccatttggaag

SEQ ID NO: 92018 - DNA, 20 bp, synthetic construct
  misc_feature 1..20: note = CRISPR gRNA sequence
  source 1..20: mol_type = other DNA
aaaccggcccatttggaagt

SEQ ID NO: 92019 - DNA, 20 bp, synthetic construct
  misc_feature 1..20: note = CRISPR gRNA sequence
  source 1..20: mol_type = other DNA
aaccggcccatttggaagtg

SEQ ID NO: 92020 - DNA, 20 bp, synthetic construct
  misc_feature 1..20: note = CRISPR gRNA sequence
  source 1..20: mol_type = other DNA
ccggcccatttggaagtggg

SEQ ID NO: 92021 - DNA, 20 bp, synthetic construct
  misc_feature 1..20: note = CRISPR gRNA sequence
  source 1..20: mol_type = other DNA
cggcccatttggaagtgggg

SEQ ID NO: 92022 - DNA, 20 bp, synthetic construct
  misc_feature 1..20: note = CRISPR gRNA sequence
  source 1..20: mol_type = other DNA
cccatttggaagtggggagg

SEQ ID NO: 92023 - DNA, 20 bp, synthetic construct
  misc_feature 1..20: note = CRISPR gRNA sequence
  source 1..20: mol_type = other DNA
ccatttggaagtggggaggc

SEQ ID NO: 92024 - DNA, 20 bp, synthetic construct
  misc_feature 1..20: note = CRISPR gRNA sequence
  source 1..20: mol_type = other DNA
aagtggggaggcaggccctg

SEQ ID NO: 92025 - DNA, 20 bp, synthetic construct
  misc_feature 1..20: note = CRISPR gRNA sequence
  source 1..20: mol_type = other DNA
ggaggcaggccctgcagatg

SEQ ID NO: 92026 - DNA, 20 bp, synthetic construct
  misc_feature 1..20: note = CRISPR gRNA sequence
  source 1..20: mol_type = other DNA
ctgcagatgcggtttgcgtt

SEQ ID NO: 92027 - DNA, 20 bp, synthetic construct
  misc_feature 1..20: note = CRISPR gRNA sequence
  source 1..20: mol_type = other DNA
gatgcggtttgcgttaagat

SEQ ID NO: 92028 - DNA, 20 bp, synthetic construct
  misc_feature 1..20: note = CRISPR gRNA sequence
  source 1..20: mol_type = other DNA
atgcggtttgcgttaagatc

SEQ ID NO: 92029 - DNA, 20 bp, synthetic construct
  misc_feature 1..20: note = CRISPR gRNA sequence
  source 1..20: mol_type = other DNA
cttcttccacctcccatccc

SEQ ID NO: 92030 - DNA, 20 bp, synthetic construct
  misc_feature 1..20: note = CRISPR gRNA sequence
  source 1..20: mol_type = other DNA
ttcttccacctcccatcccc

SEQ ID NO: 92031 - DNA, 20 bp, synthetic construct
  misc_feature 1..20: note = CRISPR gRNA sequence
  source 1..20: mol_type = other DNA
cacctcccatccccaggcct

SEQ ID NO: 92032 - DNA, 20 bp, synthetic construct
  misc_feature 1..20: note = CRISPR gRNA sequence
  source 1..20: mol_type = other DNA
cccatccccaggcctcagct

SEQ ID NO: 92033 - DNA, 20 bp, synthetic construct
  misc_feature 1..20: note = CRISPR gRNA sequence
  source 1..20: mol_type = other DNA
tcagctaagtctgatacctc

SEQ ID NO: 92034 - DNA, 20 bp, synthetic construct
  misc_feature 1..20: note = CRISPR gRNA sequence
  source 1..20: mol_type = other DNA
tttgacgtttcccgcgctgc

SEQ ID NO: 92035 - DNA, 20 bp, synthetic construct
  misc_feature 1..20: note = CRISPR gRNA sequence
  source 1..20: mol_type = other DNA
cgtttcccgcgctgccagtc

SEQ ID NO: 92036 - DNA, 20 bp, synthetic construct
  misc_feature 1..20: note = CRISPR gRNA sequence
  source 1..20: mol_type = other DNA
gtttcccgcgctgccagtcg

SEQ ID NO: 92037 - DNA, 20 bp, synthetic construct
  misc_feature 1..20: note = CRISPR gRNA sequence
  source 1..20: mol_type = other DNA
tcccgcgctgccagtcgagg

SEQ ID NO: 92038 - DNA, 20 bp, synthetic construct
  misc_feature 1..20: note = CRISPR gRNA sequence
  source 1..20: mol_type = other DNA
cagtcgaggcagtcccaccg

SEQ ID NO: 92039 - DNA, 20 bp, synthetic construct
  misc_feature 1..20: note = CRISPR gRNA sequence
  source 1..20: mol_type = other DNA
gaggcagtcccaccgcagtt

SEQ ID NO: 92040 - DNA, 20 bp, synthetic construct
  misc_feature 1..20: note = CRISPR gRNA sequence
  source 1..20: mol_type = other DNA
aggcagtcccaccgcagttc

SEQ ID NO: 92041 - DNA, 20 bp, synthetic construct
  misc_feature 1..20: note = CRISPR gRNA sequence
  source 1..20: mol_type = other DNA
ggcagtcccaccgcagttca

SEQ ID NO: 92042 - DNA, 20 bp, synthetic construct
  misc_feature 1..20: note = CRISPR gRNA sequence
  source 1..20: mol_type = other DNA
tcccaccgcagttcagggcc

SEQ ID NO: 92043 - DNA, 20 bp, synthetic construct
  misc_feature 1..20: note = CRISPR gRNA sequence
  source 1..20: mol_type = other DNA
tgtccttgtacatcttgttg

SEQ ID NO: 92044 - DNA, 20 bp, synthetic construct
  misc_feature 1..20: note = CRISPR gRNA sequence
  source 1..20: mol_type = other DNA
cggtgtttcttgcacatcca

SEQ ID NO: 92045 - DNA, 20 bp, synthetic construct
  misc_feature 1..20: note = CRISPR gRNA sequence
  source 1..20: mol_type = other DNA
catccacggtttgcgctgct

SEQ ID NO: 92046 - DNA, 20 bp, synthetic construct
  misc_feature 1..20: note = CRISPR gRNA sequence
  source 1..20: mol_type = other DNA
gtttgcgctgcttggccacc

SEQ ID NO: 92047 - DNA, 20 bp, synthetic construct
  misc_feature 1..20: note = CRISPR gRNA sequence
  source 1..20: mol_type = other DNA
ctgcttggccacctggctcg

SEQ ID NO: 92048 - DNA, 20 bp, synthetic construct
  misc_feature 1..20: note = CRISPR gRNA sequence
  source 1..20: mol_type = other DNA
cctggctcgtggtctcgctg

SEQ ID NO: 92049 - DNA, 20 bp, synthetic construct
  misc_feature 1..20: note = CRISPR gRNA sequence
  source 1..20: mol_type = other DNA
tggtctcgctgcagccttcg

SEQ ID NO: 92050 - DNA, 20 bp, synthetic construct
  misc_feature 1..20: note = CRISPR gRNA sequence
  source 1..20: mol_type = other DNA
ggtctcgctgcagccttcgt

SEQ ID NO: 92051 - DNA, 20 bp, synthetic construct
  misc_feature 1..20: note = CRISPR gRNA sequence
  source 1..20: mol_type = other DNA
cgctgcagccttcgtaggtg

SEQ ID NO: 92052 - DNA, 20 bp, synthetic construct
  misc_feature 1..20: note = CRISPR gRNA sequence
  source 1..20: mol_type = other DNA
gctgcagccttcgtaggtgc

SEQ ID NO: 92053 - DNA, 20 bp, synthetic construct
  misc_feature 1..20: note = CRISPR gRNA sequence
  source 1..20: mol_type = other DNA
ccccaccgctgccccgcctc

SEQ ID NO: 92054 - DNA, 20 bp, synthetic construct
  misc_feature 1..20: note = CRISPR gRNA sequence
  source 1..20: mol_type = other DNA
cccaccgctgccccgcctcc

SEQ ID NO: 92055 - DNA, 20 bp, synthetic construct
  misc_feature 1..20: note = CRISPR gRNA sequence
  source 1..20: mol_type = other DNA
cgctgctgccctcgcccccc

SEQ ID NO: 92056 - DNA, 20 bp, synthetic construct
  misc_feature 1..20: note = CRISPR gRNA sequence
  source 1..20: mol_type = other DNA
gctgccctcgccccccgagt

SEQ ID NO: 92057 - DNA, 20 bp, synthetic construct
  misc_feature 1..20: note = CRISPR gRNA sequence
  source 1..20: mol_type = other DNA
gagtgagtctcctcgtcctc

SEQ ID NO: 92058 - DNA, 20 bp, synthetic construct
  misc_feature 1..20: note = CRISPR gRNA sequence
  source 1..20: mol_type = other DNA
gtcctctagatcctccaaac

SEQ ID NO: 92059 - DNA, 20 bp, synthetic construct
  misc_feature 1..20: note = CRISPR gRNA sequence
  source 1..20: mol_type = other DNA
gccgcgctctcgcctccccc

SEQ ID NO: 92060 - DNA, 20 bp, synthetic construct
  misc_feature 1..20: note = CRISPR gRNA sequence
  source 1..20: mol_type = other DNA
cgcgctctcgcctccccccg

SEQ ID NO: 92061 - DNA, 20 bp, synthetic construct
  misc_feature 1..20: note = CRISPR gRNA sequence
  source 1..20: mol_type = other DNA
gcgctctcgcctccccccgg

SEQ ID NO: 92062 - DNA, 20 bp, synthetic construct
  misc_feature 1..20: note = CRISPR gRNA sequence
  source 1..20: mol_type = other DNA
cgctctcgcctccccccgga

SEQ ID NO: 92063 - DNA, 20 bp, synthetic construct
  misc_feature 1..20: note = CRISPR gRNA sequence
  source 1..20: mol_type = other DNA
gcctccccccggagggtccg

SEQ ID NO: 92064 - DNA, 20 bp, synthetic construct
  misc_feature 1..20: note = CRISPR gRNA sequence
  source 1..20: mol_type = other DNA
ggagggtccgaagtgtctaa

SEQ ID NO: 92065 - DNA, 20 bp, synthetic construct
  misc_feature 1..20: note = CRISPR gRNA sequence
  source 1..20: mol_type = other DNA
gagggtccgaagtgtctaac

SEQ ID NO: 92066 - DNA, 20 bp, synthetic construct
  misc_feature 1..20: note = CRISPR gRNA sequence
  source 1..20: mol_type = other DNA
caggtccgcctcgtcctccc

SEQ ID NO: 92067 - DNA, 20 bp, synthetic construct
  misc_feature 1..20: note = CRISPR gRNA sequence
  source 1..20: mol_type = other DNA
agcctcctcttcgccatccc

SEQ ID NO: 92068 - DNA, 20 bp, synthetic construct
  misc_feature 1..20: note = CRISPR gRNA sequence
  source 1..20: mol_type = other DNA
ccatccccggccccttcgca

SEQ ID NO: 92069 - DNA, 20 bp, synthetic construct
  misc_feature 1..20: note = CRISPR gRNA sequence
  source 1..20: mol_type = other DNA
catccccggccccttcgcac

SEQ ID NO: 92070 - DNA, 20 bp, synthetic construct
  misc_feature 1..20: note = CRISPR gRNA sequence
  source 1..20: mol_type = other DNA
cccttcgcacaggtacctaa

SEQ ID NO: 92071 - DNA, 20 bp, synthetic construct
  misc_feature 1..20: note = CRISPR gRNA sequence
  source 1..20: mol_type = other DNA
ccttcgcacaggtacctaac

SEQ ID NO: 92072 - DNA, 20 bp, synthetic construct
  misc_feature 1..20: note = CRISPR gRNA sequence
  source 1..20: mol_type = other DNA
gcccgccccaacgctgcccc

SEQ ID NO: 92073 - DNA, 20 bp, synthetic construct
  misc_feature 1..20: note = CRISPR gRNA sequence
  source 1..20: mol_type = other DNA
cccgccccaacgctgccccc

SEQ ID NO: 92074 - DNA, 20 bp, synthetic construct
  misc_feature 1..20: note = CRISPR gRNA sequence
  source 1..20: mol_type = other DNA
ccgccccaacgctgcccccg

SEQ ID NO: 92075 - DNA, 20 bp, synthetic construct
  misc_feature 1..20: note = CRISPR gRNA sequence
  source 1..20: mol_type = other DNA
cgccccaacgctgcccccgg

SEQ ID NO: 92076 - DNA, 20 bp, synthetic construct
  misc_feature 1..20: note = CRISPR gRNA sequence
  source 1..20: mol_type = other DNA
aacgctgcccccgggggccg

SEQ ID NO: 92077 - DNA, 20 bp, synthetic construct
  misc_feature 1..20: note = CRISPR gRNA sequence
  source 1..20: mol_type = other DNA
ggccgcagcctcgtcctgcc

SEQ ID NO: 92078 - DNA, 20 bp, synthetic construct
  misc_feature 1..20: note = CRISPR gRNA sequence
  source 1..20: mol_type = other DNA
cagcctcgtcctgcccagca

SEQ ID NO: 92079 - DNA, 20 bp, synthetic construct
  misc_feature 1..20: note = CRISPR gRNA sequence
  source 1..20: mol_type = other DNA
agcctcgtcctgcccagcac

SEQ ID NO: 92080 - DNA, 20 bp, synthetic construct
  misc_feature 1..20: note = CRISPR gRNA sequence
  source 1..20: mol_type = other DNA
gcctcgtcctgcccagcaca

SEQ ID NO: 92081 - DNA, 20 bp, synthetic construct
  misc_feature 1..20: note = CRISPR gRNA sequence
  source 1..20: mol_type = other DNA
ccagcacagggttgcatcac

SEQ ID NO: 92082 - DNA, 20 bp, synthetic construct
  misc_feature 1..20: note = CRISPR gRNA sequence
  source 1..20: mol_type = other DNA
gcacagggttgcatcactag

SEQ ID NO: 92083 - DNA, 20 bp, synthetic construct
  misc_feature 1..20: note = CRISPR gRNA sequence
  source 1..20: mol_type = other DNA
cacagggttgcatcactagc

SEQ ID NO: 92084 - DNA, 20 bp, synthetic construct
  misc_feature 1..20: note = CRISPR gRNA sequence
  source 1..20: mol_type = other DNA
acagggttgcatcactagca

SEQ ID NO: 92085 - DNA, 20 bp, synthetic construct
  misc_feature 1..20: note = CRISPR gRNA sequence
  source 1..20: mol_type = other DNA
catcactagcagggtgaatt

SEQ ID NO: 92086 - DNA, 20 bp, synthetic construct
  misc_feature 1..20: note = CRISPR gRNA sequence
  source 1..20: mol_type = other DNA
tcactagcagggtgaattga

SEQ ID NO: 92087 - DNA, 20 bp, synthetic construct
  misc_feature 1..20: note = CRISPR gRNA sequence
  source 1..20: mol_type = other DNA
cactagcagggtgaattgag

SEQ ID NO: 92088 - DNA, 20 bp, synthetic construct
  misc_feature 1..20: note = CRISPR gRNA sequence
  source 1..20: mol_type = other DNA
cagggtgaattgagaggccg

SEQ ID NO: 92089 - DNA, 20 bp, synthetic construct
  misc_feature 1..20: note = CRISPR gRNA sequence
  source 1..20: mol_type = other DNA
gagaggccgcggccgccacc

SEQ ID NO: 92090 - DNA, 20 bp, synthetic construct
  misc_feature 1..20: note = CRISPR gRNA sequence
  source 1..20: mol_type = other DNA
agaggccgcggccgccaccg

SEQ ID NO: 92091 - DNA, 20 bp, synthetic construct
  misc_feature 1..20: note = CRISPR gRNA sequence
  source 1..20: mol_type = other DNA
gccgcggccgccaccgaggc

SEQ ID NO: 92092 - DNA, 20 bp, synthetic construct
  misc_feature 1..20: note = CRISPR gRNA sequence
  source 1..20: mol_type = other DNA
ccgccaccgaggctggcgcc

SEQ ID NO: 92093 - DNA, 20 bp, synthetic construct
  misc_feature 1..20: note = CRISPR gRNA sequence
  source 1..20: mol_type = other DNA
cgccaccgaggctggcgcca

SEQ ID NO: 92094 - DNA, 20 bp, synthetic construct
  misc_feature 1..20: note = CRISPR gRNA sequence
  source 1..20: mol_type = other DNA
caccgaggctggcgccaagg

SEQ ID NO: 92095 - DNA, 20 bp, synthetic construct
  misc_feature 1..20: note = CRISPR gRNA sequence
  source 1..20: mol_type = other DNA
accgaggctggcgccaaggt

SEQ ID NO: 92096 - DNA, 20 bp, synthetic construct
  misc_feature 1..20: note = CRISPR gRNA sequence
  source 1..20: mol_type = other DNA
cgaggctggcgccaaggtgg

SEQ ID NO: 92097 - DNA, 20 bp, synthetic construct
  misc_feature 1..20: note = CRISPR gRNA sequence
  source 1..20: mol_type = other DNA
tggcgccaaggtgggagccg

SEQ ID NO: 92098 - DNA, 20 bp, synthetic construct
  misc_feature 1..20: note = CRISPR gRNA sequence
  source 1..20: mol_type = other DNA
gccaaggtgggagccgcagc

SEQ ID NO: 92099 - DNA, 20 bp, synthetic construct
  misc_feature 1..20: note = CRISPR gRNA sequence
  source 1..20: mol_type = other DNA
ccaaggtgggagccgcagcc

SEQ ID NO: 92100 - DNA, 20 bp, synthetic construct
  misc_feature 1..20: note = CRISPR gRNA sequence
  source 1..20: mol_type = other DNA
caaggtgggagccgcagccg

SEQ ID NO: 92101 - DNA, 20 bp, synthetic construct
  misc_feature 1..20: note = CRISPR gRNA sequence
  source 1..20: mol_type = other DNA
gtgggagccgcagccggggc

SEQ ID NO: 92102 - DNA, 20 bp, synthetic construct
  misc_feature 1..20: note = CRISPR gRNA sequence
  source 1..20: mol_type = other DNA
tgggagccgcagccggggct

SEQ ID NO: 92103 - DNA, 20 bp, synthetic construct
  misc_feature 1..20: note = CRISPR gRNA sequence
  source 1..20: mol_type = other DNA
gggagccgcagccggggcta

SEQ ID NO: 92104 - DNA, 20 bp, synthetic construct
  misc_feature 1..20: note = CRISPR gRNA sequence
  source 1..20: mol_type = other DNA
cgcagccggggctagggccg

SEQ ID NO: 92105 - DNA, 20 bp, synthetic construct
  misc_feature 1..20: note = CRISPR gRNA sequence
  source 1..20: mol_type = other DNA
gcagccggggctagggccgc

SEQ ID NO: 92106 - DNA, 20 bp, synthetic construct
  misc_feature 1..20: note = CRISPR gRNA sequence
  source 1..20: mol_type = other DNA
cagccggggctagggccgcg

SEQ ID NO: 92107 - DNA, 20 bp, synthetic construct
  misc_feature 1..20: note = CRISPR gRNA sequence
  source 1..20: mol_type = other DNA
ccggggctagggccgcgggg

SEQ ID NO: 92108 - DNA, 20 bp, synthetic construct
  misc_feature 1..20: note = CRISPR gRNA sequence
  source 1..20: mol_type = other DNA
cggggctagggccgcggggt

SEQ ID NO: 92109 - DNA, 20 bp, synthetic construct
  misc_feature 1..20: note = CRISPR gRNA sequence
  source 1..20: mol_type = other DNA
ggggctagggccgcggggtg

SEQ ID NO: 92110 - DNA, 20 bp, synthetic construct
  misc_feature 1..20: note = CRISPR gRNA sequence
  source 1..20: mol_type = other DNA
cgcggggtggggcacgccgc

SEQ ID NO: 92111 - DNA, 20 bp, synthetic construct
  misc_feature 1..20: note = CRISPR gRNA sequence
  source 1..20: mol_type = other DNA
ggggtggggcacgccgctgg

SEQ ID NO: 92112 - DNA, 20 bp, synthetic construct
  misc_feature 1..20: note = CRISPR gRNA sequence
  source 1..20: mol_type = other DNA
ggcacgccgctggcggcgcc

SEQ ID NO: 92113 - DNA, 20 bp, synthetic construct
  misc_feature 1..20: note = CRISPR gRNA sequence
  source 1..20: mol_type = other DNA
ccctgcgcctccatgctgct

SEQ ID NO: 92114 - DNA, 20 bp, synthetic construct
  misc_feature 1..20: note = CRISPR gRNA sequence
  source 1..20: mol_type = other DNA
gcctccatgctgctaagacc

SEQ ID NO: 92115 - DNA, 20 bp, synthetic construct
  misc_feature 1..20: note = CRISPR gRNA sequence
  source 1..20: mol_type = other DNA
ccatgctgctaagacctggc

SEQ ID NO: 92116 - DNA, 20 bp, synthetic construct
  misc_feature 1..20: note = CRISPR gRNA sequence
  source 1..20: mol_type = other DNA
catgctgctaagacctggcc

SEQ ID NO: 92117 - DNA, 20 bp, synthetic construct
  misc_feature 1..20: note = CRISPR gRNA sequence
  source 1..20: mol_type = other DNA
atgctgctaagacctggccg

SEQ ID NO: 92118 - DNA, 20 bp, synthetic construct
  misc_feature 1..20: note = CRISPR gRNA sequence
  source 1..20: mol_type = other DNA
ctggccggggtccacgaccc

SEQ ID NO: 92119 - DNA, 20 bp, synthetic construct
  misc_feature 1..20: note = CRISPR gRNA sequence
  source 1..20: mol_type = other DNA
tggccggggtccacgacccc

SEQ ID NO: 92120 - DNA, 20 bp, synthetic construct
  misc_feature 1..20: note = CRISPR gRNA sequence
  source 1..20: mol_type = other DNA
ggtccacgaccccgggcttt

SEQ ID NO: 92121 - DNA, 20 bp, synthetic construct
  misc_feature 1..20: note = CRISPR gRNA sequence
  source 1..20: mol_type = other DNA
ccgggcttttagcacctgct

SEQ ID NO: 92122 - DNA, 20 bp, synthetic construct
  misc_feature 1..20: note = CRISPR gRNA sequence
  source 1..20: mol_type = other DNA
ttagcacctgcttggcctaa

SEQ ID NO: 92123 - DNA, 20 bp, synthetic construct
  misc_feature 1..20: note = CRISPR gRNA sequence
  source 1..20: mol_type = other DNA
taacggcacttcgcgaacca

SEQ ID NO: 92124 - DNA, 20 bp, synthetic construct
  misc_feature 1..20: note = CRISPR gRNA sequence
  source 1..20: mol_type = other DNA
cacttcgcgaaccaaagact

SEQ ID NO: 92125 - DNA, 20 bp, synthetic construct
  misc_feature 1..20: note = CRISPR gRNA sequence
  source 1..20: mol_type = other DNA
acttcgcgaaccaaagactc

SEQ ID NO: 92126 - DNA, 20 bp, synthetic construct
  misc_feature 1..20: note = CRISPR gRNA sequence
  source 1..20: mol_type = other DNA
accaaagactcaggacacgc

SEQ ID NO: 92127 - DNA, 20 bp, synthetic construct
  misc_feature 1..20: note = CRISPR gRNA sequence
  source 1..20: mol_type = other DNA
ccaaagactcaggacacgct

SEQ ID NO: 92128 - DNA, 20 bp, synthetic construct
  misc_feature 1..20: note = CRISPR gRNA sequence
  source 1..20: mol_type = other DNA
caaagactcaggacacgctg

SEQ ID NO: 92129 - DNA, 20 bp, synthetic construct
  misc_feature 1..20: note = CRISPR gRNA sequence
  source 1..20: mol_type = other DNA
ccaagcaggtgctaaaagcc

SEQ ID NO: 92130 - DNA, 20 bp, synthetic construct
  misc_feature 1..20: note = CRISPR gRNA sequence
  source 1..20: mol_type = other DNA
gtcttagcagcatggaggcg

SEQ ID NO: 92131 - DNA, 20 bp, synthetic construct
  misc_feature 1..20: note = CRISPR gRNA sequence
  source 1..20: mol_type = other DNA
ggtacctgtgcgaaggggcc

SEQ ID NO: 92132 - DNA, 20 bp, synthetic construct
  misc_feature 1..20: note = CRISPR gRNA sequence
  source 1..20: mol_type = other DNA
gcgagagcgcggctagtttg

SEQ ID NO: 92133 - DNA, 20 bp, synthetic construct
  misc_feature 1..20: note = CRISPR gRNA sequence
  source 1..20: mol_type = other DNA
gtggccaagcagcgcaaacc

SEQ ID NO: 92134 - DNA, 20 bp, synthetic construct
  misc_feature 1..20: note = CRISPR gRNA sequence
  source 1..20: mol_type = other DNA
atcagacttagctgaggcct

SEQ ID NO: 92135 - DNA, 20 bp, synthetic construct
  misc_feature 1..20: note = CRISPR gRNA sequence
  source 1..20: mol_type = other DNA
aatgggccggtttgcagtga

SEQ ID NO: 92136 - DNA, 20 bp, synthetic construct
  misc_feature 1..20: note = CRISPR gRNA sequence
  source 1..20: mol_type = other DNA
cagtgactgggttagtggtt

SEQ ID NO: 92137 - DNA, 20 bp, synthetic construct
  misc_feature 1..20: note = CRISPR gRNA sequence
  source 1..20: mol_type = other DNA
ctgggttagtggttgagaat

SEQ ID NO: 92138 - DNA, 20 bp, synthetic construct
  misc_feature 1..20: note = CRISPR gRNA sequence
  source 1..20: mol_type = other DNA
cggcagagctgtcatagatc

SEQ ID NO: 92139 - DNA, 20 bp, synthetic construct
  misc_feature 1..20: note = CRISPR gRNA sequence
  source 1..20: mol_type = other DNA
gggatatggctggaaggaca

SEQ ID NO: 92140 - DNA, 20 bp, synthetic construct
  misc_feature 1..20: note = CRISPR gRNA sequence
  source 1..20: mol_type = other DNA
tacccctgaggggggaaaaa

SEQ ID NO: 92141 - DNA, 20 bp, synthetic construct
  misc_feature 1..20: note = CRISPR gRNA sequence
  source 1..20: mol_type = other DNA
ggggaaaaaaaggatgataa

SEQ ID NO: 92142 - DNA, 20 bp, synthetic construct
  misc_feature 1..20: note = CRISPR gRNA sequence
  source 1..20: mol_type = other DNA
gtataagtctcaaaaaactt

SEQ ID NO: 92143 - DNA, 20 bp, synthetic construct
  misc_feature 1..20: note = CRISPR gRNA sequence
  source 1..20: mol_type = other DNA
tttggattgtttgatttgaa

SEQ ID NO: 92144 - DNA, 20 bp, synthetic construct
  misc_feature 1..20: note = CRISPR gRNA sequence
  source 1..20: mol_type = other DNA
caaaggtaaaaccagtgttc

SEQ ID NO: 92145 - DNA, 20 bp, synthetic construct
  misc_feature 1..20: note = CRISPR gRNA sequence
  source 1..20: mol_type = other DNA
agtgttctggagttcgactt

SEQ ID NO: 92146 - DNA, 20 bp, synthetic construct
  misc_feature 1..20: note = CRISPR gRNA sequence
  source 1..20: mol_type = other DNA
tcatttactggccttgtggc

SEQ ID NO: 92147 - DNA, 20 bp, synthetic construct
  misc_feature 1..20: note = CRISPR gRNA sequence
  source 1..20: mol_type = other DNA
gtgtcattcatagtgttgct

SEQ ID NO: 92148 - DNA, 20 bp, synthetic construct
  misc_feature 1..20: note = CRISPR gRNA sequence
  source 1..20: mol_type = other DNA
tatgtgagccattccatatt

SEQ ID NO: 92149 - DNA, 20 bp, synthetic construct
  misc_feature 1..20: note = CRISPR gRNA sequence
  source 1..20: mol_type = other DNA
gtatacccagctgtacttgg

SEQ ID NO: 92150 - DNA, 20 bp, synthetic construct
  misc_feature 1..20: note = CRISPR gRNA sequence
  source 1..20: mol_type = other DNA
tgggaagattgcttgagacc

SEQ ID NO: 92151 - DNA, 20 bp, synthetic construct
  misc_feature 1..20: note = CRISPR gRNA sequence
  source 1..20: mol_type = other DNA
ttgcatcactgcattccagc

SEQ ID NO: 92152 - DNA, 20 bp, synthetic construct
  misc_feature 1..20: note = CRISPR gRNA sequence
  source 1..20: mol_type = other DNA
tttttaactgcaagctgtct

SEQ ID NO: 92153 - DNA, 20 bp, synthetic construct
  misc_feature 1..20: note = CRISPR gRNA sequence
  source 1..20: mol_type = other DNA
tgcaagctgtcttagggtcc

SEQ ID NO: 92154 - DNA, 20 bp, synthetic construct
  misc_feature 1..20: note = CRISPR gRNA sequence
  source 1..20: mol_type = other DNA
acttggggaggcctaggagg

SEQ ID NO: 92155 - DNA, 20 bp, synthetic construct
  misc_feature 1..20: note = CRISPR gRNA sequence
  source 1..20: mol_type = other DNA
cccggaagtttgagaccagc

SEQ ID NO: 92156 - DNA, 20 bp, synthetic construct
  misc_feature 1..20: note = CRISPR gRNA sequence
  source 1..20: mol_type = other DNA
tactcgggaggctgaggtgg

SEQ ID NO: 92157 - DNA, 20 bp, synthetic construct
  misc_feature 1..20: note = CRISPR gRNA sequence
  source 1..20: mol_type = other DNA
ttgtgctacttcactccagc

SEQ ID NO: 92158 - DNA, 20 bp, synthetic construct
  misc_feature 1..20: note = CRISPR gRNA sequence
  source 1..20: mol_type = other DNA
ttaattcacactggttagga

SEQ ID NO: 92159 - DNA, 20 bp, synthetic construct
  misc_feature 1..20: note = CRISPR gRNA sequence
  source 1..20: mol_type = other DNA
tcccttaagttttactcttt

SEQ ID NO: 92160 - DNA, 20 bp, synthetic construct
  misc_feature 1..20: note = CRISPR gRNA sequence
  source 1..20: mol_type = other DNA
tggagtaagaggacttcttt

SEQ ID NO: 92161 - DNA, 20 bp, synthetic construct
  misc_feature 1..20: note = CRISPR gRNA sequence
  source 1..20: mol_type = other DNA
tttaccaaatctctgattac

SEQ ID NO: 92162 - DNA, 20 bp, synthetic construct
  misc_feature 1..20: note = CRISPR gRNA sequence
  source 1..20: mol_type = other DNA
agggaaataagcatctggaa

SEQ ID NO: 92163 - DNA, 20 bp, synthetic construct
  misc_feature 1..20: note = CRISPR gRNA sequence
  source 1..20: mol_type = other DNA
ccacaggtgcccattcactt

SEQ ID NO: 92164 - DNA, 20 bp, synthetic construct
  misc_feature 1..20: note = CRISPR gRNA sequence
  source 1..20: mol_type = other DNA
tttcttttttttttttgaga

SEQ ID NO: 92165 - DNA, 20 bp, synthetic construct
  misc_feature 1..20: note = CRISPR gRNA sequence
  source 1..20: mol_type = other DNA
ttactctgtgtcgctcaggc

SEQ ID NO: 92166 - DNA, 20 bp, synthetic construct
  misc_feature 1..20: note = CRISPR gRNA sequence
  source 1..20: mol_type = other DNA
cccactacaacctccacctc

SEQ ID NO: 92167 - DNA, 20 bp, synthetic construct
  misc_feature 1..20: note = CRISPR gRNA sequence
  source 1..20: mol_type = other DNA
agttcttgtgcctcagcctc

SEQ ID NO: 92168 - DNA, 20 bp, synthetic construct
  misc_feature 1..20: note = CRISPR gRNA sequence
  source 1..20: mol_type = other DNA
gcctcagcctcctgagtagc

SEQ ID NO: 92169 - DNA, 20 bp, synthetic construct
  misc_feature 1..20: note = CRISPR gRNA sequence
  source 1..20: mol_type = other DNA
acctcagcctcctgaagtgc

SEQ ID NO: 92170 - DNA, 20 bp, synthetic construct
  misc_feature 1..20: note = CRISPR gRNA sequence
  source 1..20: mol_type = other DNA
cctcctgaagtgctgggatt

SEQ ID NO: 92171 - DNA, 20 bp, synthetic construct
  misc_feature 1..20: note = CRISPR gRNA sequence
  source 1..20: mol_type = other DNA
gtataaaaggcagatagata

SEQ ID NO: 92172 - DNA, 20 bp, synthetic construct
  misc_feature 1..20: note = CRISPR gRNA sequence
  source 1..20: mol_type = other DNA
acttatctaattttttagag

SEQ ID NO: 92173 - DNA, 20 bp, synthetic construct
  misc_feature 1..20: note = CRISPR gRNA sequence
  source 1..20: mol_type = other DNA
cagtgttgcccaggctggcc

SEQ ID NO: 92174 - DNA, 20 bp, synthetic construct
  misc_feature 1..20: note = CRISPR gRNA sequence
  source 1..20: mol_type = other DNA
gatcctcctgcctcagcctt

SEQ ID NO: 92175 - DNA, 20 bp, synthetic construct
  misc_feature 1..20: note = CRISPR gRNA sequence
  source 1..20: mol_type = other DNA
gcctcagccttcagagtaac

SEQ ID NO: 92176 - DNA, 20 bp, synthetic construct
  misc_feature 1..20: note = CRISPR gRNA sequence
  source 1..20: mol_type = other DNA
ttgcatgactttttatggaa

SEQ ID NO: 92177 - DNA, 20 bp, synthetic construct
  misc_feature 1..20: note = CRISPR gRNA sequence
  source 1..20: mol_type = other DNA
atccagtttgtcttatattt

SEQ ID NO: 92178 - DNA, 20 bp, synthetic construct
  misc_feature 1..20: note = CRISPR gRNA sequence
  source 1..20: mol_type = other DNA
aaatctttatctttgttaaa

SEQ ID NO: 92179 - DNA, 20 bp, synthetic construct
  misc_feature 1..20: note = CRISPR gRNA sequence
  source 1..20: mol_type = other DNA
aagaaaataacagtgccagc

SEQ ID NO: 92180 - DNA, 20 bp, synthetic construct
  misc_feature 1..20: note = CRISPR gRNA sequence
  source 1..20: mol_type = other DNA
ccggttttagtagttcagag

SEQ ID NO: 92181 - DNA, 20 bp, synthetic construct
  misc_feature 1..20: note = CRISPR gRNA sequence
  source 1..20: mol_type = other DNA
gtgactcagtataaaccaga

SEQ ID NO: 92182 - DNA, 20 bp, synthetic construct
  misc_feature 1..20: note = CRISPR gRNA sequence
  source 1..20: mol_type = other DNA
aatagtttacgcttaatgag

SEQ ID NO: 92183 - DNA, 20 bp, synthetic construct
  misc_feature 1..20: note = CRISPR gRNA sequence
  source 1..20: mol_type = other DNA
gcactgtgttaagctataaa

SEQ ID NO: 92184 - DNA, 20 bp, synthetic construct
  misc_feature 1..20: note = CRISPR gRNA sequence
  source 1..20: mol_type = other DNA
gtctcacaacccttcagcaa

SEQ ID NO: 92185 - DNA, 20 bp, synthetic construct
  misc_feature 1..20: note = CRISPR gRNA sequence
  source 1..20: mol_type = other DNA
actgaggcacagagaggcta

SEQ ID NO: 92186 - DNA, 20 bp, synthetic construct
  misc_feature 1..20: note = CRISPR gRNA sequence
  source 1..20: mol_type = other DNA
tccttactatactgcttccc

SEQ ID NO: 92187 - DNA, 20 bp, synthetic construct
  misc_feature 1..20: note = CRISPR gRNA sequence
  source 1..20: mol_type = other DNA
tttagtaaagaaagagaagt

SEQ ID NO: 92188 - DNA, 20 bp, synthetic construct
  misc_feature 1..20: note = CRISPR gRNA sequence
  source 1..20: mol_type = other DNA
gactattctagctaaaatag

SEQ ID NO: 92189 - DNA, 20 bp, synthetic construct
  misc_feature 1..20: note = CRISPR gRNA sequence
  source 1..20: mol_type = other DNA
gaagccagttttttatagta

SEQ ID NO: 92190 - DNA, 20 bp, synthetic construct
  misc_feature 1..20: note = CRISPR gRNA sequence
  source 1..20: mol_type = other DNA
tagtattgaatgccaggcta

SEQ ID NO: 92191 - DNA, 20 bp, synthetic construct
  misc_feature 1..20: note = CRISPR gRNA sequence
  source 1..20: mol_type = other DNA
tgaatgccaggctatgggat

SEQ ID NO: 92192 - DNA, 20 bp, synthetic construct
  misc_feature 1..20: note = CRISPR gRNA sequence
  source 1..20: mol_type = other DNA
caggctatgggatttggatt

SEQ ID NO: 92193 - DNA, 20 bp, synthetic construct
  misc_feature 1..20: note = CRISPR gRNA sequence
  source 1..20: mol_type = other DNA
gatctaattaggaagtagca

SEQ ID NO: 92194 - DNA, 20 bp, synthetic construct
  misc_feature 1..20: note = CRISPR gRNA sequence
  source 1..20: mol_type = other DNA
agcagaggatcctaccctga

SEQ ID NO: 92195 - DNA, 20 bp, synthetic construct
  misc_feature 1..20: note = CRISPR gRNA sequence
  source 1..20: mol_type = other DNA
gaggatcctaccctgatgga

SEQ ID NO: 92196 - DNA, 20 bp, synthetic construct
  misc_feature 1..20: note = CRISPR gRNA sequence
  source 1..20: mol_type = other DNA
ttaagttctctattccaatg

SEQ ID NO: 92197 - DNA, 20 bp, synthetic construct
  misc_feature 1..20: note = CRISPR gRNA sequence
  source 1..20: mol_type = other DNA
gagagacacataaagggact

SEQ ID NO: 92198 - DNA, 20 bp, synthetic construct
  misc_feature 1..20: note = CRISPR gRNA sequence
  source 1..20: mol_type = other DNA
cataaagggactagggataa

SEQ ID NO: 92199 - DNA, 20 bp, synthetic construct
  misc_feature 1..20: note = CRISPR gRNA sequence
  source 1..20: mol_type = other DNA
aatgaattgacctctgctgg

SEQ ID NO: 92200 - DNA, 20 bp, synthetic construct
  misc_feature 1..20: note = CRISPR gRNA sequence
  source 1..20: mol_type = other DNA
actcttaggcataaatcaca

SEQ ID NO: 92201 - DNA, 20 bp, synthetic construct
  misc_feature 1..20: note = CRISPR gRNA sequence
  source 1..20: mol_type = other DNA
agcattgcaggtttttgaaa

SEQ ID NO: 92202 - DNA, 20 bp, synthetic construct
  misc_feature 1..20: note = CRISPR gRNA sequence
  source 1..20: mol_type = other DNA
aattcagtatctaatatttt

SEQ ID NO: 92203 - DNA, 20 bp, synthetic construct
  misc_feature 1..20: note = CRISPR gRNA sequence
  source 1..20: mol_type = other DNA
atattttgtgaattaacctt

SEQ ID NO: 92204 - DNA, 20 bp, synthetic construct
  misc_feature 1..20: note = CRISPR gRNA sequence
  source 1..20: mol_type = other DNA
aaccttttgaatttccatag

SEQ ID NO: 92205 - DNA, 20 bp, synthetic construct
  misc_feature 1..20: note = CRISPR gRNA sequence
  source 1..20: mol_type = other DNA
atagtggggttgtgagggca

SEQ ID NO: 92206 - DNA, 20 bp, synthetic construct
  misc_feature 1..20: note = CRISPR gRNA sequence
  source 1..20: mol_type = other DNA
tatcttgcacataaaaatga

SEQ ID NO: 92207 - DNA, 20 bp, synthetic construct
  misc_feature 1..20: note = CRISPR gRNA sequence
  source 1..20: mol_type = other DNA
ctcataaataaaatcaactt

SEQ ID NO: 92208 - DNA, 20 bp, synthetic construct
  misc_feature 1..20: note = CRISPR gRNA sequence
  source 1..20: mol_type = other DNA
agaaattatttttgtttcct

SEQ ID NO: 92209 - DNA, 20 bp, synthetic construct
  misc_feature 1..20: note = CRISPR gRNA sequence
  source 1..20: mol_type = other DNA
tttttgtttcctctgggtat

SEQ ID NO: 92210 - DNA, 20 bp, synthetic construct
  misc_feature 1..20: note = CRISPR gRNA sequence
  source 1..20: mol_type = other DNA
tgttgaggcctaaaatgttt

SEQ ID NO: 92211 - DNA, 20 bp, synthetic construct
  misc_feature 1..20: note = CRISPR gRNA sequence
  source 1..20: mol_type = other DNA
ctcataatgaaagaaattaa

SEQ ID NO: 92212 - DNA, 20 bp, synthetic construct
  misc_feature 1..20: note = CRISPR gRNA sequence
  source 1..20: mol_type = other DNA
tttatatttgctactttagt

SEQ ID NO: 92213 - DNA, 20 bp, synthetic construct
  misc_feature 1..20: note = CRISPR gRNA sequence
  source 1..20: mol_type = other DNA
ttgctactttagtaagaatt

SEQ ID NO: 92214 - DNA, 20 bp, synthetic construct
  misc_feature 1..20: note = CRISPR gRNA sequence
  source 1..20: mol_type = other DNA
gtattgtggcatagttttgt

SEQ ID NO: 92215 - DNA, 20 bp, synthetic construct
  misc_feature 1..20: note = CRISPR gRNA sequence
  source 1..20: mol_type = other DNA
tggcatagttttgtaagagt

SEQ ID NO: 92216 - DNA, 20 bp, synthetic construct
  misc_feature 1..20: note = CRISPR gRNA sequence
  source 1..20: mol_type = other DNA
taagatgctgtcaggtaact

SEQ ID NO: 92217 - DNA, 20 bp, synthetic construct
  misc_feature 1..20: note = CRISPR gRNA sequence
  source 1..20: mol_type = other DNA
gtttttgggcagtgaaatct

SEQ ID NO: 92218 - DNA, 20 bp, synthetic construct
  misc_feature 1..20: note = CRISPR gRNA sequence
  source 1..20: mol_type = other DNA
ccatttgttttggttgccaa

SEQ ID NO: 92219 - DNA, 20 bp, synthetic construct
  misc_feature 1..20: note = CRISPR gRNA sequence
  source 1..20: mol_type = other DNA
gagcagtatataatttgcct

SEQ ID NO: 92220 - DNA, 20 bp, synthetic construct
  misc_feature 1..20: note = CRISPR gRNA sequence
  source 1..20: mol_type = other DNA
caagcagattatgtttcggc

SEQ ID NO: 92221 - DNA, 20 bp, synthetic construct
  misc_feature 1..20: note = CRISPR gRNA sequence
  source 1..20: mol_type = other DNA
cctggatagcattatataaa

SEQ ID NO: 92222 - DNA, 20 bp, synthetic construct
  misc_feature 1..20: note = CRISPR gRNA sequence
  source 1..20: mol_type = other DNA
tggggggagagggagcgagg

SEQ ID NO: 92223 - DNA, 20 bp, synthetic construct
  misc_feature 1..20: note = CRISPR gRNA sequence
  source 1..20: mol_type = other DNA
atgataatgaagaactttcc

SEQ ID NO: 92224 - DNA, 20 bp, synthetic construct
  misc_feature 1..20: note = CRISPR gRNA sequence
  source 1..20: mol_type = other DNA
ctccattgttaaacaaagaa

SEQ ID NO: 92225 - DNA, 20 bp, synthetic construct
  misc_feature 1..20: note = CRISPR gRNA sequence
  source 1..20: mol_type = other DNA
aacaaagaacaggatctttt

SEQ ID NO: 92226 - DNA, 20 bp, synthetic construct
  misc_feature 1..20: note = CRISPR gRNA sequence
  source 1..20: mol_type = other DNA
ataagtcaaaattttaaaaa

SEQ ID NO: 92227 - DNA, 20 bp, synthetic construct
  misc_feature 1..20: note = CRISPR gRNA sequence
  source 1..20: mol_type = other DNA
ataaacttgactacataaaa

SEQ ID NO: 92228 - DNA, 20 bp, synthetic construct
  misc_feature 1..20: note = CRISPR gRNA sequence
  source 1..20: mol_type = other DNA
cactttgggaggccaggtgg

SEQ ID NO: 92229 - DNA, 20 bp, synthetic construct
  misc_feature 1..20: note = CRISPR gRNA sequence
  source 1..20: mol_type = other DNA
tgggaggatcacttgaggct

SEQ ID NO: 92230 - DNA, 20 bp, synthetic construct
  misc_feature 1..20: note = CRISPR gRNA sequence
  source 1..20: mol_type = other DNA
caaaaaaatttaaaaattag

SEQ ID NO: 92231 - DNA, 20 bp, synthetic construct
  misc_feature 1..20: note = CRISPR gRNA sequence
  source 1..20: mol_type = other DNA
tactcaagaggctgaaacag

SEQ ID NO: 92232 - DNA, 20 bp, synthetic construct
  misc_feature 1..20: note = CRISPR gRNA sequence
  source 1..20: mol_type = other DNA
ggctgaaacaggaggattgc

SEQ ID NO: 92233 - DNA, 20 bp, synthetic construct
  misc_feature 1..20: note = CRISPR gRNA sequence
  source 1..20: mol_type = other DNA
caggaggattgcttgagtcc

SEQ ID NO: 92234 - DNA, 20 bp, synthetic construct
  misc_feature 1..20: note = CRISPR gRNA sequence
  source 1..20: mol_type = other DNA
atagaaacagaaaaaaaagg

SEQ ID NO: 92235 - DNA, 20 bp, synthetic construct
  misc_feature 1..20: note = CRISPR gRNA sequence
  source 1..20: mol_type = other DNA
gcagttgggcaatatgtacc

SEQ ID NO: 92236 - DNA, 20 bp, synthetic construct
  misc_feature 1..20: note = CRISPR gRNA sequence
  source 1..20: mol_type = other DNA
atttaatatgaagacattta

SEQ ID NO: 92237 - DNA, 20 bp, synthetic construct
  misc_feature 1..20: note = CRISPR gRNA sequence
  source 1..20: mol_type = other DNA
acagaatgtaaatcctaaat

SEQ ID NO: 92238 - DNA, 20 bp, synthetic construct
  misc_feature 1..20: note = CRISPR gRNA sequence
  source 1..20: mol_type = other DNA
atgtaaatcctaaatatgga

SEQ ID NO: 92239 - DNA, 20 bp, synthetic construct
  misc_feature 1..20: note = CRISPR gRNA sequence
  source 1..20: mol_type = other DNA
ttaaacataaaggtattgcc

SEQ ID NO: 92240 - DNA, 20 bp, synthetic construct
  misc_feature 1..20: note = CRISPR gRNA sequence
  source 1..20: mol_type = other DNA
cctattacaggagactgtgg

SEQ ID NO: 92241 - DNA, 20 bp, synthetic construct
  misc_feature 1..20: note = CRISPR gRNA sequence
  source 1..20: mol_type = other DNA
caggatgattgcttgagccg

SEQ ID NO: 92242 - DNA, 20 bp, synthetic construct
  misc_feature 1..20: note = CRISPR gRNA sequence
  source 1..20: mol_type = other DNA
ctgcactccagcgtggggaa

SEQ ID NO: 92243 - DNA, 20 bp, synthetic construct
  misc_feature 1..20: note = CRISPR gRNA sequence
  source 1..20: mol_type = other DNA
tacaactatattttaaagtg

SEQ ID NO: 92244 - DNA, 20 bp, synthetic construct
  misc_feature 1..20: note = CRISPR gRNA sequence
  source 1..20: mol_type = other DNA
gatgagtgtacaaaaaggta

SEQ ID NO: 92245 - DNA, 20 bp, synthetic construct
  misc_feature 1..20: note = CRISPR gRNA sequence
  source 1..20: mol_type = other DNA
ttttttttcttgctataatc

SEQ ID NO: 92246 - DNA, 20 bp, synthetic construct
  misc_feature 1..20: note = CRISPR gRNA sequence
  source 1..20: mol_type = other DNA
tttgttcttacatatttcaa

SEQ ID NO: 92247 - DNA, 20 bp, synthetic construct
  misc_feature 1..20: note = CRISPR gRNA sequence
  source 1..20: mol_type = other DNA
tatcatatgtagggacacat

SEQ ID NO: 92248 - DNA, 20 bp, synthetic construct
  misc_feature 1..20: note = CRISPR gRNA sequence
  source 1..20: mol_type = other DNA
atttttttaccagacataaa

SEQ ID NO: 92249 - DNA, 20 bp, synthetic construct
  misc_feature 1..20: note = CRISPR gRNA sequence
  source 1..20: mol_type = other DNA
atatgatacaatatgttcac

SEQ ID NO: 92250 - DNA, 20 bp, synthetic construct
  misc_feature 1..20: note = CRISPR gRNA sequence
  source 1..20: mol_type = other DNA
atatgttcacaagaatatgc

SEQ ID NO: 92251 - DNA, 20 bp, synthetic construct
  misc_feature 1..20: note = CRISPR gRNA sequence
  source 1..20: mol_type = other DNA
gaatcaaaagcacttttaca

SEQ ID NO: 92252 - DNA, 20 bp, synthetic construct
  misc_feature 1..20: note = CRISPR gRNA sequence
  source 1..20: mol_type = other DNA
aatactaaaacctaaaaata

SEQ ID NO: 92253 - DNA, 20 bp, synthetic construct
  misc_feature 1..20: note = CRISPR gRNA sequence
  source 1..20: mol_type = other DNA
agctaaaagtagcactgacc

SEQ ID NO: 92254 - DNA, 20 bp, synthetic construct
  misc_feature 1..20: note = CRISPR gRNA sequence
  source 1..20: mol_type = other DNA
taacatattattattagaga

SEQ ID NO: 92255 - DNA, 20 bp, synthetic construct
  misc_feature 1..20: note = CRISPR gRNA sequence
  source 1..20: mol_type = other DNA
tctcactctgttccccacgc

SEQ ID NO: 92256 - DNA, 20 bp, synthetic construct
  misc_feature 1..20: note = CRISPR gRNA sequence
  source 1..20: mol_type = other DNA
ataagctgcaaaaagataaa

SEQ ID NO: 92257 - DNA, 20 bp, synthetic construct
  misc_feature 1..20: note = CRISPR gRNA sequence
  source 1..20: mol_type = other DNA
tgtttaactctatccatatt

SEQ ID NO: 92258 - DNA, 20 bp, synthetic construct
  misc_feature 1..20: note = CRISPR gRNA sequence
  source 1..20: mol_type = other DNA
cttcatattaaatgtgatgt

SEQ ID NO: 92259 - DNA, 20 bp, synthetic construct
  misc_feature 1..20: note = CRISPR gRNA sequence
  source 1..20: mol_type = other DNA
aatgtgatgtctgagttgaa

SEQ ID NO: 92260 - DNA, 20 bp, synthetic construct
  misc_feature 1..20: note = CRISPR gRNA sequence
  source 1..20: mol_type = other DNA
tataatgccattaactactt

SEQ ID NO: 92261 - DNA, 20 bp, synthetic construct
  misc_feature 1..20: note = CRISPR gRNA sequence
  source 1..20: mol_type = other DNA
tttgtttatttttactgata

SEQ ID NO: 92262 - DNA, 20 bp, synthetic construct
  misc_feature 1..20: note = CRISPR gRNA sequence
  source 1..20: mol_type = other DNA
ggttttcctcatcaaattac

SEQ ID NO: 92263 - DNA, 20 bp, synthetic construct
  misc_feature 1..20: note = CRISPR gRNA sequence
  source 1..20: mol_type = other DNA
tgatcatgtttaatgattta

SEQ ID NO: 92264 - DNA, 20 bp, synthetic construct
  misc_feature 1..20: note = CRISPR gRNA sequence
  source 1..20: mol_type = other DNA
gggtgctctgttgcctaggc

SEQ ID NO: 92265 - DNA, 20 bp, synthetic construct
  misc_feature 1..20: note = CRISPR gRNA sequence
  source 1..20: mol_type = other DNA
gatcatagctcattgcagcc

SEQ ID NO: 92266 - DNA, 20 bp, synthetic construct
  misc_feature 1..20: note = CRISPR gRNA sequence
  source 1..20: mol_type = other DNA
aatcctcctgtttcagcctc

SEQ ID NO: 92267 - DNA, 20 bp, synthetic construct
  misc_feature 1..20: note = CRISPR gRNA sequence
  source 1..20: mol_type = other DNA
tttttaaatttttttgtaga

SEQ ID NO: 92268 - DNA, 20 bp, synthetic construct
  misc_feature 1..20: note = CRISPR gRNA sequence
  source 1..20: mol_type = other DNA
tggggtctcgctacgttgcc

SEQ ID NO: 92269 - DNA, 20 bp, synthetic construct
  misc_feature 1..20: note = CRISPR gRNA sequence
  source 1..20: mol_type = other DNA
cacctggcctcccaaagtgc

SEQ ID NO: 92270 - DNA, 20 bp, synthetic construct
  misc_feature 1..20: note = CRISPR gRNA sequence
  source 1..20: mol_type = other DNA
atgaaccacaatgcccaacc

SEQ ID NO: 92271 - DNA, 20 bp, synthetic construct
  misc_feature 1..20: note = CRISPR gRNA sequence
  source 1..20: mol_type = other DNA
ttttaaaattttgacttatt

SEQ ID NO: 92272 - DNA, 20 bp, synthetic construct
  misc_feature 1..20: note = CRISPR gRNA sequence
  source 1..20: mol_type = other DNA
tgatttaacacttgttctaa

SEQ ID NO: 92273 - DNA, 20 bp, synthetic construct
  misc_feature 1..20: note = CRISPR gRNA sequence
  source 1..20: mol_type = other DNA
ctgttctttgtttaacaatg

SEQ ID NO: 92274 - DNA, 20 bp, synthetic construct
  misc_feature 1..20: note = CRISPR gRNA sequence
  source 1..20: mol_type = other DNA
gtatgttatctgcactttcc

SEQ ID NO: 92275 - DNA, 20 bp, synthetic construct
  misc_feature 1..20: note = CRISPR gRNA sequence
  source 1..20: mol_type = other DNA
tctccccccagattttcaac

SEQ ID NO: 92276 - DNA, 20 bp, synthetic construct
  misc_feature 1..20: note = CRISPR gRNA sequence
  source 1..20: mol_type = other DNA
aaaattaatagtgtgtgtga

SEQ ID NO: 92277 - DNA, 20 bp, synthetic construct
  misc_feature 1..20: note = CRISPR gRNA sequence
  source 1..20: mol_type = other DNA
gtgggccactaagattgagg

SEQ ID NO: 92278 - DNA, 20 bp, synthetic construct
  misc_feature 1..20: note = CRISPR gRNA sequence
  source 1..20: mol_type = other DNA
atattacaaaaaatgccaag

SEQ ID NO: 92279 - DNA, 20 bp, synthetic construct
  misc_feature 1..20: note = CRISPR gRNA sequence
  source 1..20: mol_type = other DNA
gaaacataatctgcttgcct

SEQ ID NO: 92280 - DNA, 20 bp, synthetic construct
  misc_feature 1..20: note = CRISPR gRNA sequence
  source 1..20: mol_type = other DNA
ttggcaaccaaaacaaatgg

SEQ ID NO: 92281 - DNA, 20 bp, synthetic construct
  misc_feature 1..20: note = CRISPR gRNA sequence
  source 1..20: mol_type = other DNA
accggaaagccataccttac

SEQ ID NO: 92282 - DNA, 20 bp, synthetic construct
  misc_feature 1..20: note = CRISPR gRNA sequence
  source 1..20: mol_type = other DNA
taacctctttgttctttact

SEQ ID NO: 92283 - DNA, 20 bp, synthetic construct
  misc_feature 1..20: note = CRISPR gRNA sequence
  source 1..20: mol_type = other DNA
gggcttctttctactggcct

SEQ ID NO: 92284 - DNA, 20 bp, synthetic construct
  misc_feature 1..20: note = CRISPR gRNA sequence
  source 1..20: mol_type = other DNA
ctggcctctgagttatctat

SEQ ID NO: 92285 - DNA, 20 bp, synthetic construct
  misc_feature 1..20: note = CRISPR gRNA sequence
  source 1..20: mol_type = other DNA
catttttatgtgcaagataa

SEQ ID NO: 92286 - DNA, 20 bp, synthetic construct
  misc_feature 1..20: note = CRISPR gRNA sequence
  source 1..20: mol_type = other DNA
aattcacaaaatattagata

SEQ ID NO: 92287 - DNA, 20 bp, synthetic construct
  misc_feature 1..20: note = CRISPR gRNA sequence
  source 1..20: mol_type = other DNA
gtccaaacttgtacagatgt

SEQ ID NO: 92288 - DNA, 20 bp, synthetic construct
  misc_feature 1..20: note = CRISPR gRNA sequence
  source 1..20: mol_type = other DNA
ctgcaatgctttttgtccta

SEQ ID NO: 92289 - DNA, 20 bp, synthetic construct
  misc_feature 1..20: note = CRISPR gRNA sequence
  source 1..20: mol_type = other DNA
ttgccacatttcatttggtt

SEQ ID NO: 92290 - DNA, 20 bp, synthetic construct
  misc_feature 1..20: note = CRISPR gRNA sequence
  source 1..20: mol_type = other DNA
gaatagctctaacatttcgg

SEQ ID NO: 92291 - DNA, 20 bp, synthetic construct
  misc_feature 1..20: note = CRISPR gRNA sequence
  source 1..20: mol_type = other DNA
actccttgtgatttatgcct

SEQ ID NO: 92292 - DNA, 20 bp, synthetic construct
  misc_feature 1..20: note = CRISPR gRNA sequence
  source 1..20: mol_type = other DNA
cctaagagtcctagttacct

SEQ ID NO: 92293 - DNA, 20 bp, synthetic construct
  misc_feature 1..20: note = CRISPR gRNA sequence
  source 1..20: mol_type = other DNA
tagcatagttcttagattgg

SEQ ID NO: 92294 - DNA, 20 bp, synthetic construct
  misc_feature 1..20: note = CRISPR gRNA sequence
  source 1..20: mol_type = other DNA
taccttaataaattcttcat

SEQ ID NO: 92295 - DNA, 20 bp, synthetic construct
  misc_feature 1..20: note = CRISPR gRNA sequence
  source 1..20: mol_type = other DNA
cctactataataatcttcga

SEQ ID NO: 92296 - DNA, 20 bp, synthetic construct
  misc_feature 1..20: note = CRISPR gRNA sequence
  source 1..20: mol_type = other DNA
tcaactttaacccactccat

SEQ ID NO: 92297 - DNA, 20 bp, synthetic construct
  misc_feature 1..20: note = CRISPR gRNA sequence
  source 1..20: mol_type = other DNA
tttaacccactccatcaggg

SEQ ID NO: 92298 - DNA, 20 bp, synthetic construct
  misc_feature 1..20: note = CRISPR gRNA sequence
  source 1..20: mol_type = other DNA
tctttccaaatttctctctc

SEQ ID NO: 92299 - DNA, 20 bp, synthetic construct
  misc_feature 1..20: note = CRISPR gRNA sequence
  source 1..20: mol_type = other DNA
ttccactcaactattttagc

SEQ ID NO: 92300 - DNA, 20 bp, synthetic construct
  misc_feature 1..20: note = CRISPR gRNA sequence
  source 1..20: mol_type = other DNA
ttctctttccttttatctac

SEQ ID NO: 92301 - DNA, 20 bp, synthetic construct
  misc_feature 1..20: note = CRISPR gRNA sequence
  source 1..20: mol_type = other DNA
ggaggtaaaagtgaaagctc

SEQ ID NO: 92302 - DNA, 20 bp, synthetic construct
  misc_feature 1..20: note = CRISPR gRNA sequence
  source 1..20: mol_type = other DNA
tagaataagactgcttgcgt

SEQ ID NO: 92303 - DNA, 20 bp, synthetic construct
  misc_feature 1..20: note = CRISPR gRNA sequence
  source 1..20: mol_type = other DNA
tagtatctatcccattgctg

SEQ ID NO: 92304 - DNA, 20 bp, synthetic construct
  misc_feature 1..20: note = CRISPR gRNA sequence
  source 1..20: mol_type = other DNA
cccatcctttctggtttata

SEQ ID NO: 92305 - DNA, 20 bp, synthetic construct
  misc_feature 1..20: note = CRISPR gRNA sequence
  source 1..20: mol_type = other DNA
tttcctctgcaaagcctttc

SEQ ID NO: 92306 - DNA, 20 bp, synthetic construct
  misc_feature 1..20: note = CRISPR gRNA sequence
  source 1..20: mol_type = other DNA
atcccaaaatataagacaaa

SEQ ID NO: 92307 - DNA, 20 bp, synthetic construct
  misc_feature 1..20: note = CRISPR gRNA sequence
  source 1..20: mol_type = other DNA
tactctgaaggctgaggcag

SEQ ID NO: 92308 - DNA, 20 bp, synthetic construct
  misc_feature 1..20: note = CRISPR gRNA sequence
  source 1..20: mol_type = other DNA
caggaggatcacttgagccc

SEQ ID NO: 92309 - DNA, 20 bp, synthetic construct
  misc_feature 1..20: note = CRISPR gRNA sequence
  source 1..20: mol_type = other DNA
agtattattaggccggcgtg

SEQ ID NO: 92310 - DNA, 20 bp, synthetic construct
  misc_feature 1..20: note = CRISPR gRNA sequence
  source 1..20: mol_type = other DNA
acttcaggaggctgaggtgg

SEQ ID NO: 92311 - DNA, 20 bp, synthetic construct
  misc_feature 1..20: note = CRISPR gRNA sequence
  source 1..20: mol_type = other DNA
gaggctgaggtgggaggatc

SEQ ID NO: 92312 - DNA, 20 bp, synthetic construct
  misc_feature 1..20: note = CRISPR gRNA sequence
  source 1..20: mol_type = other DNA
gcactccagcctgagcgaca

SEQ ID NO: 92313 - DNA, 20 bp, synthetic construct
  misc_feature 1..20: note = CRISPR gRNA sequence
  source 1..20: mol_type = other DNA
attatttttctccctctcta

SEQ ID NO: 92314 - DNA, 20 bp, synthetic construct
  misc_feature 1..20: note = CRISPR gRNA sequence
  source 1..20: mol_type = other DNA
cctctctaaagaattctgaa

SEQ ID NO: 92315 - DNA, 20 bp, synthetic construct
  misc_feature 1..20: note = CRISPR gRNA sequence
  source 1..20: mol_type = other DNA
gatttggtaaaacatactat

SEQ ID NO: 92316 - DNA, 20 bp, synthetic construct
  misc_feature 1..20: note = CRISPR gRNA sequence
  source 1..20: mol_type = other DNA
gtaaaacatactataagaat

SEQ ID NO: 92317 - DNA, 20 bp, synthetic construct
  misc_feature 1..20: note = CRISPR gRNA sequence
  source 1..20: mol_type = other DNA
actataagaatatggattga

SEQ ID NO: 92318 - DNA, 20 bp, synthetic construct
  misc_feature 1..20: note = CRISPR gRNA sequence
  source 1..20: mol_type = other DNA
tgcaaaattaaagttacata

SEQ ID NO: 92319 - DNA, 20 bp, synthetic construct
  misc_feature 1..20: note = CRISPR gRNA sequence
  source 1..20: mol_type = other DNA
acatagtggatttttctagg

SEQ ID NO: 92320 - DNA, 20 bp, synthetic construct
  misc_feature 1..20: note = CRISPR gRNA sequence
  source 1..20: mol_type = other DNA
aagaagtcctcttactccaa

SEQ ID NO: 92321 - DNA, 20 bp, synthetic construct
  misc_feature 1..20: note = CRISPR gRNA sequence
  source 1..20: mol_type = other DNA
gtcactcagtcctaaccagt

SEQ ID NO: 92322 - DNA, 20 bp, synthetic construct
  misc_feature 1..20: note = CRISPR gRNA sequence
  source 1..20: mol_type = other DNA
ctgcaaattttagaaatatt

SEQ ID NO: 92323 - DNA, 20 bp, synthetic construct
  misc_feature 1..20: note = CRISPR gRNA sequence
  source 1..20: mol_type = other DNA
tcttgctctgtcacccaggc

SEQ ID NO: 92324 - DNA, 20 bp, synthetic construct
  misc_feature 1..20: note = CRISPR gRNA sequence
  source 1..20: mol_type = other DNA
gatccttccacctcagcctc

SEQ ID NO: 92325 - DNA, 20 bp, synthetic construct
  misc_feature 1..20: note = CRISPR gRNA sequence
  source 1..20: mol_type = other DNA
ttaaaatttttttgttgaga

SEQ ID NO: 92326 - DNA, 20 bp, synthetic construct
  misc_feature 1..20: note = CRISPR gRNA sequence
  source 1..20: mol_type = other DNA
aactaagaaatttaaagact

SEQ ID NO: 92327 - DNA, 20 bp, synthetic construct
  misc_feature 1..20: note = CRISPR gRNA sequence
  source 1..20: mol_type = other DNA
tttttttttttttaaggaga

SEQ ID NO: 92328 - DNA, 20 bp, synthetic construct
  misc_feature 1..20: note = CRISPR gRNA sequence
  source 1..20: mol_type = other DNA
tcttgctatgtcatccaggc

SEQ ID NO: 92329 - DNA, 20 bp, synthetic construct
  misc_feature 1..20: note = CRISPR gRNA sequence
  source 1..20: mol_type = other DNA
cttcaccctcccaagtacag

SEQ ID NO: 92330 - DNA, 20 bp, synthetic construct
  misc_feature 1..20: note = CRISPR gRNA sequence
  source 1..20: mol_type = other DNA
cacttgccaccatacctggc

SEQ ID NO: 92331 - DNA, 20 bp, synthetic construct
  misc_feature 1..20: note = CRISPR gRNA sequence
  source 1..20: mol_type = other DNA
ttaaatttttctctacacta

SEQ ID NO: 92332 - DNA, 20 bp, synthetic construct
  misc_feature 1..20: note = CRISPR gRNA sequence
  source 1..20: mol_type = other DNA
cactaacaatgacaataata

SEQ ID NO: 92333 - DNA, 20 bp, synthetic construct
  misc_feature 1..20: note = CRISPR gRNA sequence
  source 1..20: mol_type = other DNA
cactgtgtgaaccctcaata

SEQ ID NO: 92334 - DNA, 20 bp, synthetic construct
  misc_feature 1..20: note = CRISPR gRNA sequence
  source 1..20: mol_type = other DNA
cacatattcacagcaacact

SEQ ID NO: 92335 - DNA, 20 bp, synthetic construct
  misc_feature 1..20: note = CRISPR gRNA sequence
  source 1..20: mol_type = other DNA
cgattttaatgcccatttta

SEQ ID NO: 92336 - DNA, 20 bp, synthetic construct
  misc_feature 1..20: note = CRISPR gRNA sequence
  source 1..20: mol_type = other DNA
aggccagtaaatgatgcaac

SEQ ID NO: 92337 - DNA, 20 bp, synthetic construct
  misc_feature 1..20: note = CRISPR gRNA sequence
  source 1..20: mol_type = other DNA
catcctttttttcccccctc

SEQ ID NO: 92338 - DNA, 20 bp, synthetic construct
  misc_feature 1..20: note = CRISPR gRNA sequence
  source 1..20: mol_type = other DNA
ccctcaggggtactaagaaa

SEQ ID NO: 92339 - DNA, 20 bp, synthetic construct
  misc_feature 1..20: note = CRISPR gRNA sequence
  source 1..20: mol_type = other DNA
aagaaaaggggtagtgagaa

SEQ ID NO: 92340 - DNA, 20 bp, synthetic construct
  misc_feature 1..20: note = CRISPR gRNA sequence
  source 1..20: mol_type = other DNA
gagaacagggtactaacaac

SEQ ID NO: 92341 - DNA, 20 bp, synthetic construct
  misc_feature 1..20: note = CRISPR gRNA sequence
  source 1..20: mol_type = other DNA
gaacaaagtatattaagtat

SEQ ID NO: 92342 - DNA, 20 bp, synthetic construct
  misc_feature 1..20: note = CRISPR gRNA sequence
  source 1..20: mol_type = other DNA
gagaacaagggactaaacat

SEQ ID NO: 92343 - DNA, 20 bp, synthetic construct
  misc_feature 1..20: note = CRISPR gRNA sequence
  source 1..20: mol_type = other DNA
aaacataggggtactgggaa

SEQ ID NO: 92344 - DNA, 20 bp, synthetic construct
  misc_feature 1..20: note = CRISPR gRNA sequence
  source 1..20: mol_type = other DNA
tgggaacagagttgtaagaa

SEQ ID NO: 92345 - DNA, 20 bp, synthetic construct
  misc_feature 1..20: note = CRISPR gRNA sequence
  source 1..20: mol_type = other DNA
aagaaaagagtactacgtac

SEQ ID NO: 92346 - DNA, 20 bp, synthetic construct
  misc_feature 1..20: note = CRISPR gRNA sequence
  source 1..20: mol_type = other DNA
ggggtactacagacaggcaa

SEQ ID NO: 92347 - DNA, 20 bp, synthetic construct
  misc_feature 1..20: note = CRISPR gRNA sequence
  source 1..20: mol_type = other DNA
taaaaatacggtactaggaa

SEQ ID NO: 92348 - DNA, 20 bp, synthetic construct
  misc_feature 1..20: note = CRISPR gRNA sequence
  source 1..20: mol_type = other DNA
aaaaacaaagtactaaatac

SEQ ID NO: 92349 - DNA, 20 bp, synthetic construct
  misc_feature 1..20: note = CRISPR gRNA sequence
  source 1..20: mol_type = other DNA
acaaatagaggtactgagaa

SEQ ID NO: 92350 - DNA, 20 bp, synthetic construct
  misc_feature 1..20: note = CRISPR gRNA sequence
  source 1..20: mol_type = other DNA
tgagaactgggtactgagaa

SEQ ID NO: 92351 - DNA, 20 bp, synthetic construct
  misc_feature 1..20: note = CRISPR gRNA sequence
  source 1..20: mol_type = other DNA
ggtactgagaactggatact

SEQ ID NO: 92352 - DNA, 20 bp, synthetic construct
  misc_feature 1..20: note = CRISPR gRNA sequence
  source 1..20: mol_type = other DNA
tgagaactggatactgagaa

SEQ ID NO: 92353 - DNA, 20 bp, synthetic construct
  misc_feature 1..20: note = CRISPR gRNA sequence
  source 1..20: mol_type = other DNA
ctgaaatttctgcacctatc

SEQ ID NO: 92354 - DNA, 20 bp, synthetic construct
  misc_feature 1..20: note = CRISPR gRNA sequence
  source 1..20: mol_type = other DNA
agatgcggtttgcgttaaga

SEQ ID NO: 92355 - DNA, 20 bp, synthetic construct
  misc_feature 1..20: note = CRISPR gRNA sequence
  source 1..20: mol_type = other DNA
cctcagctaagtctgatacc

SEQ ID NO: 92356 - DNA, 20 bp, synthetic construct
  misc_feature 1..20: note = CRISPR gRNA sequence
  source 1..20: mol_type = other DNA
cccgctgctgccctcgcccc

SEQ ID NO: 92357 - DNA, 20 bp, synthetic construct
  misc_feature 1..20: note = CRISPR gRNA sequence
  source 1..20: mol_type = other DNA
ctgctgccctcgccccccga

SEQ ID NO: 92358 - DNA, 20 bp, synthetic construct
  misc_feature 1..20: note = CRISPR gRNA sequence
  source 1..20: mol_type = other DNA
cgcgctctcgcctccccccg

SEQ ID NO: 92359 - DNA, 20 bp, synthetic construct
  misc_feature 1..20: note = CRISPR gRNA sequence
  source 1..20: mol_type = other DNA
cagcctcgtcctgcccagca

SEQ ID NO: 92360 - DNA, 20 bp, synthetic construct
  misc_feature 1..20: note = CRISPR gRNA sequence
  source 1..20: mol_type = other DNA
gcacagggttgcatcactag

SEQ ID NO: 92361 - DNA, 20 bp, synthetic construct
  misc_feature 1..20: note = CRISPR gRNA sequence
  source 1..20: mol_type = other DNA
agggttgcatcactagcagg

SEQ ID NO: 92362 - DNA, 20 bp, synthetic construct
  misc_feature 1..20: note = CRISPR gRNA sequence
  source 1..20: mol_type = other DNA
cgcagccggggctagggccg

SEQ ID NO: 92363 - DNA, 20 bp, synthetic construct
  misc_feature 1..20: note = CRISPR gRNA sequence
  source 1..20: mol_type = other DNA
ccatgctgctaagacctggc

SEQ ID NO: 92364 - DNA, 20 bp, synthetic construct
  misc_feature 1..20: note = CRISPR gRNA sequence
  source 1..20: mol_type = other DNA
accaaagactcaggacacgc

SEQ ID NO: 92365 - DNA, 20 bp, synthetic construct
  misc_feature 1..20: note = CRISPR gRNA sequence
  source 1..20: mol_type = other DNA
cggggggaggcgagagcgcg

SEQ ID NO: 92366 - DNA, 20 bp, synthetic construct
  misc_feature 1..20: note = CRISPR gRNA sequence
  source 1..20: mol_type = other DNA
gcctccccacttccaaatgg

SEQ ID NO: 92367 - DNA, 20 bp, synthetic construct
  misc_feature 1..20: note = CRISPR gRNA sequence
  source 1..20: mol_type = other DNA
gggttagtggttgagaatta

SEQ ID NO: 92368 - DNA, 20 bp, synthetic construct
  misc_feature 1..20: note = CRISPR gRNA sequence
  source 1..20: mol_type = other DNA
ttagagtgtttgccctaaat

SEQ ID NO: 92369 - DNA, 20 bp, synthetic construct
  misc_feature 1..20: note = CRISPR gRNA sequence
  source 1..20: mol_type = other DNA
cttctgagaaagtcatctct

SEQ ID NO: 92370 - DNA, 20 bp, synthetic construct
  misc_feature 1..20: note = CRISPR gRNA sequence
  source 1..20: mol_type = other DNA
taatactcctgtatttagta

SEQ ID NO: 92371 - DNA, 20 bp, synthetic construct
  misc_feature 1..20: note = CRISPR gRNA sequence
  source 1..20: mol_type = other DNA
caactctgttcccagtaccc

SEQ ID NO: 92372 - DNA, 20 bp, synthetic construct
  misc_feature 1..20: note = CRISPR gRNA sequence
  source 1..20: mol_type = other DNA
ggtataagtctcaaaaaact

SEQ ID NO: 92373 - DNA, 20 bp, synthetic construct
  misc_feature 1..20: note = CRISPR gRNA sequence
  source 1..20: mol_type = other DNA
taagtctcaaaaaacttttg

SEQ ID NO: 92374 - DNA, 20 bp, synthetic construct
  misc_feature 1..20: note = CRISPR gRNA sequence
  source 1..20: mol_type = other DNA
tctcaaaaaacttttggatt

SEQ ID NO: 92375 - DNA, 20 bp, synthetic construct
  misc_feature 1..20: note = CRISPR gRNA sequence
  source 1..20: mol_type = other DNA
gttgcatcatttactggcct

SEQ ID NO: 92376 - DNA, 20 bp, synthetic construct
  misc_feature 1..20: note = CRISPR gRNA sequence
  source 1..20: mol_type = other DNA
cacagtgtccagcaactggc

SEQ ID NO: 92377 - DNA, 20 bp, synthetic construct
  misc_feature 1..20: note = CRISPR gRNA sequence
  source 1..20: mol_type = other DNA
gtacttgggagggtgaagtg

SEQ ID NO: 92378 - DNA, 20 bp, synthetic construct
  misc_feature 1..20: note = CRISPR gRNA sequence
  source 1..20: mol_type = other DNA
ttgggagggtgaagtgggaa

SEQ ID NO: 92379 - DNA, 20 bp, synthetic construct
  misc_feature 1..20: note = CRISPR gRNA sequence
  source 1..20: mol_type = other DNA
gggttcgaggctgccgtgag

SEQ ID NO: 92380 - DNA, 20 bp, synthetic construct
  misc_feature 1..20: note = CRISPR gRNA sequence
  source 1..20: mol_type = other DNA
tattctaagtctttaaattt

SEQ ID NO: 92381 - DNA, 20 bp, synthetic construct
  misc_feature 1..20: note = CRISPR gRNA sequence
  source 1..20: mol_type = other DNA
actaaaatattagaccttgt

SEQ ID NO: 92382 - DNA, 20 bp, synthetic construct
  misc_feature 1..20: note = CRISPR gRNA sequence
  source 1..20: mol_type = other DNA
tggggaggcctaggagggag

SEQ ID NO: 92383 - DNA, 20 bp, synthetic construct
  misc_feature 1..20: note = CRISPR gRNA sequence
  source 1..20: mol_type = other DNA
agggaggatcgcttgagccc

SEQ ID NO: 92384 - DNA, 20 bp, synthetic construct
  misc_feature 1..20: note = CRISPR gRNA sequence
  source 1..20: mol_type = other DNA
gtggaaggatcattgagccc

SEQ ID NO: 92385 - DNA, 20 bp, synthetic construct
  misc_feature 1..20: note = CRISPR gRNA sequence
  source 1..20: mol_type = other DNA
ctgagtgacttctctttccc

SEQ ID NO: 92386 - DNA, 20 bp, synthetic construct
  misc_feature 1..20: note = CRISPR gRNA sequence
  source 1..20: mol_type = other DNA
gggctcaggacttctgtaat

SEQ ID NO: 92387 - DNA, 20 bp, synthetic construct
  misc_feature 1..20: note = CRISPR gRNA sequence
  source 1..20: mol_type = other DNA
cctcaatccatattcttata

SEQ ID NO: 92388 - DNA, 20 bp, synthetic construct
  misc_feature 1..20: note = CRISPR gRNA sequence
  source 1..20: mol_type = other DNA
tatagtatgttttaccaaat

SEQ ID NO: 92389 - DNA, 20 bp, synthetic construct
  misc_feature 1..20: note = CRISPR gRNA sequence
  source 1..20: mol_type = other DNA
ttttaccaaatctctgatta

SEQ ID NO: 92390 - DNA, 20 bp, synthetic construct
  misc_feature 1..20: note = CRISPR gRNA sequence
  source 1..20: mol_type = other DNA
atgaaagttagtaaaggtga

SEQ ID NO: 92391 - DNA, 20 bp, synthetic construct
  misc_feature 1..20: note = CRISPR gRNA sequence
  source 1..20: mol_type = other DNA
tgcctcagcctcctgagtag

SEQ ID NO: 92392 - DNA, 20 bp, synthetic construct
  misc_feature 1..20: note = CRISPR gRNA sequence
  source 1..20: mol_type = other DNA
ttttgtatttttagtagaga

SEQ ID NO: 92393 - DNA, 20 bp, synthetic construct
  misc_feature 1..20: note = CRISPR gRNA sequence
  source 1..20: mol_type = other DNA
cacctcagcctcctgaagtg

SEQ ID NO: 92394 - DNA, 20 bp, synthetic construct
  misc_feature 1..20: note = CRISPR gRNA sequence
  source 1..20: mol_type = other DNA
gaaagaagtagttaacctat

SEQ ID NO: 92395 - DNA, 20 bp, synthetic construct
  misc_feature 1..20: note = CRISPR gRNA sequence
  source 1..20: mol_type = other DNA
tgcctcagccttcagagtaa

SEQ ID NO: 92396 - DNA, 20 bp, synthetic construct
  misc_feature 1..20: note = CRISPR gRNA sequence
  source 1..20: mol_type = other DNA
gggattatttcaccactgca

SEQ ID NO: 92397 - DNA, 20 bp, synthetic construct
  misc_feature 1..20: note = CRISPR gRNA sequence
  source 1..20: mol_type = other DNA
tataagcaacaaataatact

SEQ ID NO: 92398 - DNA, 20 bp, synthetic construct
  misc_feature 1..20: note = CRISPR gRNA sequence
  source 1..20: mol_type = other DNA
ataatactaatagtttacta

SEQ ID NO: 92399 - DNA, 20 bp, synthetic construct
  misc_feature 1..20: note = CRISPR gRNA sequence
  source 1..20: mol_type = other DNA
aataagagccaactgtatag

SEQ ID NO: 92400 - DNA, 20 bp, synthetic construct
  misc_feature 1..20: note = CRISPR gRNA sequence
  source 1..20: mol_type = other DNA
tgtaggctgagatactccag

SEQ ID NO: 92401 - DNA, 20 bp, synthetic construct
  misc_feature 1..20: note = CRISPR gRNA sequence
  source 1..20: mol_type = other DNA
ataaaccagaaaggatgggc

SEQ ID NO: 92402 - DNA, 20 bp, synthetic construct
  misc_feature 1..20: note = CRISPR gRNA sequence
  source 1..20: mol_type = other DNA
cagaaaggatgggcaatagt

SEQ ID NO: 92403 - DNA, 20 bp, synthetic construct
  misc_feature 1..20: note = CRISPR gRNA sequence
  source 1..20: mol_type = other DNA
aatagtttacgcttaatgag

SEQ ID NO: 92404 - DNA, 20 bp, synthetic construct
  misc_feature 1..20: note = CRISPR gRNA sequence
  source 1..20: mol_type = other DNA
aaacgcaagcagtcttattc

SEQ ID NO: 92405 - DNA, 20 bp, synthetic construct
  misc_feature 1..20: note = CRISPR gRNA sequence
  source 1..20: mol_type = other DNA
tcacttttacctccttacta

SEQ ID NO: 92406 - DNA, 20 bp, synthetic construct
  misc_feature 1..20: note = CRISPR gRNA sequence
  source 1..20: mol_type = other DNA
atttggaaagataggttgaa

SEQ ID NO: 92407 - DNA, 20 bp, synthetic construct
  misc_feature 1..20: note = CRISPR gRNA sequence
  source 1..20: mol_type = other DNA
atagtattgaatgccaggct

SEQ ID NO: 92408 - DNA, 20 bp, synthetic construct
  misc_feature 1..20: note = CRISPR gRNA sequence
  source 1..20: mol_type = other DNA
ttgaatgccaggctatggga

SEQ ID NO: 92409 - DNA, 20 bp, synthetic construct
  misc_feature 1..20: note = CRISPR gRNA sequence
  source 1..20: mol_type = other DNA
gtgggttaaagttgagagcc

SEQ ID NO: 92410 - DNA, 20 bp, synthetic construct
  misc_feature 1..20: note = CRISPR gRNA sequence
  source 1..20: mol_type = other DNA
tatagattttgagactcttt

SEQ ID NO: 92411 - DNA, 20 bp, synthetic construct
  misc_feature 1..20: note = CRISPR gRNA sequence
  source 1..20: mol_type = other DNA
cttctgctatgttgtgagca

SEQ ID NO: 92412 - DNA, 20 bp, synthetic construct
  misc_feature 1..20: note = CRISPR gRNA sequence
  source 1..20: mol_type = other DNA
aaatgaattgacctctgctg

SEQ ID NO: 92413 - DNA, 20 bp, synthetic construct
  misc_feature 1..20: note = CRISPR gRNA sequence
  source 1..20: mol_type = other DNA
agaagcagtagacttatatg

SEQ ID NO: 92414 - DNA, 20 bp, synthetic construct
  misc_feature 1..20: note = CRISPR gRNA sequence
  source 1..20: mol_type = other DNA
acaaggagtatgtatttcag

SEQ ID NO: 92415 - DNA, 20 bp, synthetic construct
  misc_feature 1..20: note = CRISPR gRNA sequence
  source 1..20: mol_type = other DNA
tctgtaggacaaaaagcatt

SEQ ID NO: 92416 - DNA, 20 bp, synthetic construct
  misc_feature 1..20: note = CRISPR gRNA sequence
  source 1..20: mol_type = other DNA
aaaagaattccaacatctgt

SEQ ID NO: 92417 - DNA, 20 bp, synthetic construct
  misc_feature 1..20: note = CRISPR gRNA sequence
  source 1..20: mol_type = other DNA
gactaaaggttattttcact

SEQ ID NO: 92418 - DNA, 20 bp, synthetic construct
  misc_feature 1..20: note = CRISPR gRNA sequence
  source 1..20: mol_type = other DNA
ctggaggaggaagaaattat

SEQ ID NO: 92419 - DNA, 20 bp, synthetic construct
  misc_feature 1..20: note = CRISPR gRNA sequence
  source 1..20: mol_type = other DNA
gggtattagaattttctttt

SEQ ID NO: 92420 - DNA, 20 bp, synthetic construct
  misc_feature 1..20: note = CRISPR gRNA sequence
  source 1..20: mol_type = other DNA
tttttatatgttgaggccta

SEQ ID NO: 92421 - DNA, 20 bp, synthetic construct
  misc_feature 1..20: note = CRISPR gRNA sequence
  source 1..20: mol_type = other DNA
gaggttaaattcatgtaagg

SEQ ID NO: 92422 - DNA, 20 bp, synthetic construct
  misc_feature 1..20: note = CRISPR gRNA sequence
  source 1..20: mol_type = other DNA
ttttggatgtggtattgtgg

SEQ ID NO: 92423 - DNA, 20 bp, synthetic construct
  misc_feature 1..20: note = CRISPR gRNA sequence
  source 1..20: mol_type = other DNA
acatatttggtaataagtgc

SEQ ID NO: 92424 - DNA, 20 bp, synthetic construct
  misc_feature 1..20: note = CRISPR gRNA sequence
  source 1..20: mol_type = other DNA
ttggtaataagtgctgctga

SEQ ID NO: 92425 - DNA, 20 bp, synthetic construct
  misc_feature 1..20: note = CRISPR gRNA sequence
  source 1..20: mol_type = other DNA
atggtatcattttaggactt

SEQ ID NO: 92426 - DNA, 20 bp, synthetic construct
  misc_feature 1..20: note = CRISPR gRNA sequence
  source 1..20: mol_type = other DNA
tggcaggagactatttatac

SEQ ID NO: 92427 - DNA, 20 bp, synthetic construct
  misc_feature 1..20: note = CRISPR gRNA sequence
  source 1..20: mol_type = other DNA
ttatactagtgctttttcaa

SEQ ID NO: 92428 - DNA, 20 bp, synthetic construct
  misc_feature 1..20: note = CRISPR gRNA sequence
  source 1..20: mol_type = other DNA
agcaagtttatctaaatttt

SEQ ID NO: 92429 - DNA, 20 bp, synthetic construct
  misc_feature 1..20: note = CRISPR gRNA sequence
  source 1..20: mol_type = other DNA
ttttgaaagctttggttatc

SEQ ID NO: 92430 - DNA, 20 bp, synthetic construct
  misc_feature 1..20: note = CRISPR gRNA sequence
  source 1..20: mol_type = other DNA
caatattttactactccccc

SEQ ID NO: 92431 - DNA, 20 bp, synthetic construct
  misc_feature 1..20: note = CRISPR gRNA sequence
  source 1..20: mol_type = other DNA
atatatttcatccaaaggca

SEQ ID NO: 92432 - DNA, 20 bp, synthetic construct
  misc_feature 1..20: note = CRISPR gRNA sequence
  source 1..20: mol_type = other DNA
ttcatccaaaggcaagcaga

SEQ ID NO: 92433 - DNA, 20 bp, synthetic construct
  misc_feature 1..20: note = CRISPR gRNA sequence
  source 1..20: mol_type = other DNA
taatcatgacttattacgtt

SEQ ID NO: 92434 - DNA, 20 bp, synthetic construct
  misc_feature 1..20: note = CRISPR gRNA sequence
  source 1..20: mol_type = other DNA
atcaaaaaagactggtaaat

SEQ ID NO: 92435 - DNA, 20 bp, synthetic construct
  misc_feature 1..20: note = CRISPR gRNA sequence
  source 1..20: mol_type = other DNA
tcagttataaatgtgttaac

SEQ ID NO: 92436 - DNA, 20 bp, synthetic construct
  misc_feature 1..20: note = CRISPR gRNA sequence
  source 1..20: mol_type = other DNA
gtttgttataaatggaacaa

SEQ ID NO: 92437 - DNA, 20 bp, synthetic construct
  misc_feature 1..20: note = CRISPR gRNA sequence
  source 1..20: mol_type = other DNA
aaatggaacaattgagattt

SEQ ID NO: 92438 - DNA, 20 bp, synthetic construct
  misc_feature 1..20: note = CRISPR gRNA sequence
  source 1..20: mol_type = other DNA
aactttacctcaaaaatgta

SEQ ID NO: 92439 - DNA, 20 bp, synthetic construct
  misc_feature 1..20: note = CRISPR gRNA sequence
  source 1..20: mol_type = other DNA
aaaaatgtaatgagattttt

SEQ ID NO: 92440 - DNA, 20 bp, synthetic construct
  misc_feature 1..20: note = CRISPR gRNA sequence
  source 1..20: mol_type = other DNA
atatagacaaaatcacagag

SEQ ID NO: 92441 - DNA, 20 bp, synthetic construct
  misc_feature 1..20: note = CRISPR gRNA sequence
  source 1..20: mol_type = other DNA
ctactcaagaggctgaaaca

SEQ ID NO: 92442 - DNA, 20 bp, synthetic construct
  misc_feature 1..20: note = CRISPR gRNA sequence
  source 1..20: mol_type = other DNA
tcaagaggctgaaacaggag

SEQ ID NO: 92443 - DNA, 20 bp, synthetic construct
  misc_feature 1..20: note = CRISPR gRNA sequence
  source 1..20: mol_type = other DNA
cctataaatcattaaacatg

SEQ ID NO: 92444 - DNA, 20 bp, synthetic construct
  misc_feature 1..20: note = CRISPR gRNA sequence
  source 1..20: mol_type = other DNA
tttccttacatatatataaa

SEQ ID NO: 92445 - DNA, 20 bp, synthetic construct
  misc_feature 1..20: note = CRISPR gRNA sequence
  source 1..20: mol_type = other DNA
taaaatatgtttgcctcttt

SEQ ID NO: 92446 - DNA, 20 bp, synthetic construct
  misc_feature 1..20: note = CRISPR gRNA sequence
  source 1..20: mol_type = other DNA
gcttcagtcttaactgcaaa

SEQ ID NO: 92447 - DNA, 20 bp, synthetic construct
  misc_feature 1..20: note = CRISPR gRNA sequence
  source 1..20: mol_type = other DNA
gtaatttgatgaggaaaacc

SEQ ID NO: 92448 - DNA, 20 bp, synthetic construct
  misc_feature 1..20: note = CRISPR gRNA sequence
  source 1..20: mol_type = other DNA
acaaaaagtgaaaattattt

SEQ ID NO: 92449 - DNA, 20 bp, synthetic construct
  misc_feature 1..20: note = CRISPR gRNA sequence
  source 1..20: mol_type = other DNA
caacagtgtcataacagcta

SEQ ID NO: 92450 - DNA, 20 bp, synthetic construct
  misc_feature 1..20: note = CRISPR gRNA sequence
  source 1..20: mol_type = other DNA
ctaagatgatttttaaataa

SEQ ID NO: 92451 - DNA, 20 bp, synthetic construct
  misc_feature 1..20: note = CRISPR gRNA sequence
  source 1..20: mol_type = other DNA
atgatagtatgttcacttta

SEQ ID NO: 92452 - DNA, 20 bp, synthetic construct
  misc_feature 1..20: note = CRISPR gRNA sequence
  source 1..20: mol_type = other DNA
ctttattcagtttatctttt

SEQ ID NO: 92453 - DNA, 20 bp, synthetic construct
  misc_feature 1..20: note = CRISPR gRNA sequence
  source 1..20: mol_type = other DNA
tttttgcagcttattggggc

SEQ ID NO: 92454 - DNA, 20 bp, synthetic construct
  misc_feature 1..20: note = CRISPR gRNA sequence
  source 1..20: mol_type = other DNA
tattacaggagactgtggca

SEQ ID NO: 92455 - DNA, 20 bp, synthetic construct
  misc_feature 1..20: note = CRISPR gRNA sequence
  source 1..20: mol_type = other DNA
acaggagactgtggcaggat

SEQ ID NO: 92456 - DNA, 20 bp, synthetic construct
  misc_feature 1..20: note = CRISPR gRNA sequence
  source 1..20: mol_type = other DNA
tgagtgtacaaaaaggtatt

SEQ ID NO: 92457 - DNA, 20 bp, synthetic construct
  misc_feature 1..20: note = CRISPR gRNA sequence
  source 1..20: mol_type = other DNA
tgagaaacttgacttctagc

SEQ ID NO: 92458 - DNA, 20 bp, synthetic construct
  misc_feature 1..20: note = CRISPR gRNA sequence
  source 1..20: mol_type = other DNA
atttgctggcatattagaga

SEQ ID NO: 92459 - DNA, 20 bp, synthetic construct
  misc_feature 1..20: note = CRISPR gRNA sequence
  source 1..20: mol_type = other DNA
acagacttcacccgttattt

SEQ ID NO: 92460 - DNA, 20 bp, synthetic construct
  misc_feature 1..20: note = CRISPR gRNA sequence
  source 1..20: mol_type = other DNA
atgtgtgacatcacattatt

SEQ ID NO: 92461 - DNA, 20 bp, synthetic construct
  misc_feature 1..20: note = CRISPR gRNA sequence
  source 1..20: mol_type = other DNA
acatcacattatttttagtt

SEQ ID NO: 92462 - DNA, 20 bp, synthetic construct
  misc_feature 1..20: note = CRISPR gRNA sequence
  source 1..20: mol_type = other DNA
ttgcagtgcatccgatgtaa

SEQ ID NO: 92463 - DNA, 20 bp, synthetic construct
  misc_feature 1..20: note = CRISPR gRNA sequence
  source 1..20: mol_type = other DNA
tgcatccgatgtaaaagtgc

SEQ ID NO: 92464 - DNA, 20 bp, synthetic construct
  misc_feature 1..20: note = CRISPR gRNA sequence
  source 1..20: mol_type = other DNA
gcatgaaaacagtctaatga

SEQ ID NO: 92465 - DNA, 20 bp, synthetic construct
  misc_feature 1..20: note = CRISPR gRNA sequence
  source 1..20: mol_type = other DNA
cagcaacagctattaaatca

SEQ ID NO: 92466 - DNA, 20 bp, synthetic construct
  misc_feature 1..20: note = CRISPR gRNA sequence
  source 1..20: mol_type = other DNA
agttttggagcaaagacaac

SEQ ID NO: 92467 - DNA, 20 bp, synthetic construct
  misc_feature 1..20: note = CRISPR gRNA sequence
  source 1..20: mol_type = other DNA
gaacttaccaagaacatcta

SEQ ID NO: 92468 - DNA, 20 bp, synthetic construct
  misc_feature 1..20: note = CRISPR gRNA sequence
  source 1..20: mol_type = other DNA
gttgtctttgctccaaaact

SEQ ID NO: 92469 - DNA, 20 bp, synthetic construct
  misc_feature 1..20: note = CRISPR gRNA sequence
  source 1..20: mol_type = other DNA
cttgctgatttaatagctgt

SEQ ID NO: 92470 - DNA, 20 bp, synthetic construct
  misc_feature 1..20: note = CRISPR gRNA sequence
  source 1..20: mol_type = other DNA
agcattaatctatgtcatta

SEQ ID NO: 92471 - DNA, 20 bp, synthetic construct
  misc_feature 1..20: note = CRISPR gRNA sequence
  source 1..20: mol_type = other DNA
gagctaaaagtagcactgac

SEQ ID NO: 92472 - DNA, 20 bp, synthetic construct
  misc_feature 1..20: note = CRISPR gRNA sequence
  source 1..20: mol_type = other DNA
tgtgaaaatagcagctaaat

SEQ ID NO: 92473 - DNA, 20 bp, synthetic construct
  misc_feature 1..20: note = CRISPR gRNA sequence
  source 1..20: mol_type = other DNA
atacaaactagtgctagaag

SEQ ID NO: 92474 - DNA, 20 bp, synthetic construct
  misc_feature 1..20: note = CRISPR gRNA sequence
  source 1..20: mol_type = other DNA
aatataacaaatataacaga

SEQ ID NO: 92475 - DNA, 20 bp, synthetic construct
  misc_feature 1..20: note = CRISPR gRNA sequence
  source 1..20: mol_type = other DNA
tcctgccacagtctcctgta

SEQ ID NO: 92476 - DNA, 20 bp, synthetic construct
  misc_feature 1..20: note = CRISPR gRNA sequence
  source 1..20: mol_type = other DNA
actatcattaaatactgact

SEQ ID NO: 92477 - DNA, 20 bp, synthetic construct
  misc_feature 1..20: note = CRISPR gRNA sequence
  source 1..20: mol_type = other DNA
agtacattttctatttatta

SEQ ID NO: 92478 - DNA, 20 bp, synthetic construct
  misc_feature 1..20: note = CRISPR gRNA sequence
  source 1..20: mol_type = other DNA
atgacactgttggacattta

SEQ ID NO: 92479 - DNA, 20 bp, synthetic construct
  misc_feature 1..20: note = CRISPR gRNA sequence
  source 1..20: mol_type = other DNA
atatattcctggcaatacct

SEQ ID NO: 92480 - DNA, 20 bp, synthetic construct
  misc_feature 1..20: note = CRISPR gRNA sequence
  source 1..20: mol_type = other DNA
atgtttaactctatccatat

SEQ ID NO: 92481 - DNA, 20 bp, synthetic construct
  misc_feature 1..20: note = CRISPR gRNA sequence
  source 1..20: mol_type = other DNA
actcctggtacatattgccc

SEQ ID NO: 92482 - DNA, 20 bp, synthetic construct
  misc_feature 1..20: note = CRISPR gRNA sequence
  source 1..20: mol_type = other DNA
atcactgcatcattgtgcgt

SEQ ID NO: 92483 - DNA, 20 bp, synthetic construct
  misc_feature 1..20: note = CRISPR gRNA sequence
  source 1..20: mol_type = other DNA
tcgtttaaataattttcact

SEQ ID NO: 92484 - DNA, 20 bp, synthetic construct
  misc_feature 1..20: note = CRISPR gRNA sequence
  source 1..20: mol_type = other DNA
aatggtattctgcctttttt

SEQ ID NO: 92485 - DNA, 20 bp, synthetic construct
  misc_feature 1..20: note = CRISPR gRNA sequence
  source 1..20: mol_type = other DNA
ttttgcaatgtattgaagcc

SEQ ID NO: 92486 - DNA, 20 bp, synthetic construct
  misc_feature 1..20: note = CRISPR gRNA sequence
  source 1..20: mol_type = other DNA
tatatatgtaaggaaactga

SEQ ID NO: 92487 - DNA, 20 bp, synthetic construct
  misc_feature 1..20: note = CRISPR gRNA sequence
  source 1..20: mol_type = other DNA
gtaaggaaactgatcatgtt

SEQ ID NO: 92488 - DNA, 20 bp, synthetic construct
  misc_feature 1..20: note = CRISPR gRNA sequence
  source 1..20: mol_type = other DNA
ttcctggactcaagcaatcc

SEQ ID NO: 92489 - DNA, 20 bp, synthetic construct
  misc_feature 1..20: note = CRISPR gRNA sequence
  source 1..20: mol_type = other DNA
ccacctggcctcccaaagtg

SEQ ID NO: 92490 - DNA, 20 bp, synthetic construct
  misc_feature 1..20: note = CRISPR gRNA sequence
  source 1..20: mol_type = other DNA
tagcattcatttttatgtag

SEQ ID NO: 92491 - DNA, 20 bp, synthetic construct
  misc_feature 1..20: note = CRISPR gRNA sequence
  source 1..20: mol_type = other DNA
tcaagtttataatcttttct

SEQ ID NO: 92492 - DNA, 20 bp, synthetic construct
  misc_feature 1..20: note = CRISPR gRNA sequence
  source 1..20: mol_type = other DNA
attacatttttgaggtaaag

SEQ ID NO: 92493 - DNA, 20 bp, synthetic construct
  misc_feature 1..20: note = CRISPR gRNA sequence
  source 1..20: mol_type = other DNA
tcaattgttccatttataac

SEQ ID NO: 92494 - DNA, 20 bp, synthetic construct
  misc_feature 1..20: note = CRISPR gRNA sequence
  source 1..20: mol_type = other DNA
acgtttgttaacacatttat

SEQ ID NO: 92495 - DNA, 20 bp, synthetic construct
  misc_feature 1..20: note = CRISPR gRNA sequence
  source 1..20: mol_type = other DNA
aacagatatttaccagtctt

SEQ ID NO: 92496 - DNA, 20 bp, synthetic construct
  misc_feature 1..20: note = CRISPR gRNA sequence
  source 1..20: mol_type = other DNA
gatccccaaaagatcctgtt

SEQ ID NO: 92497 - DNA, 20 bp, synthetic construct
  misc_feature 1..20: note = CRISPR gRNA sequence
  source 1..20: mol_type = other DNA
taaacagttaacgtaataag

SEQ ID NO: 92498 - DNA, 20 bp, synthetic construct
  misc_feature 1..20: note = CRISPR gRNA sequence
  source 1..20: mol_type = other DNA
tcctcctcgctccctctccc

SEQ ID NO: 92499 - DNA, 20 bp, synthetic construct
  misc_feature 1..20: note = CRISPR gRNA sequence
  source 1..20: mol_type = other DNA
atactgtgagaggtgggcca

SEQ ID NO: 92500 - DNA, 20 bp, synthetic construct
  misc_feature 1..20: note = CRISPR gRNA sequence
  source 1..20: mol_type = other DNA
gctatccaggccgaaacata

SEQ ID NO: 92501 - DNA, 20 bp, synthetic construct
  misc_feature 1..20: note = CRISPR gRNA sequence
  source 1..20: mol_type = other DNA
tactgctcaataagatatct

SEQ ID NO: 92502 - DNA, 20 bp, synthetic construct
  misc_feature 1..20: note = CRISPR gRNA sequence
  source 1..20: mol_type = other DNA
caaatgggggagtagtaaaa

SEQ ID NO: 92503 - DNA, 20 bp, synthetic construct
  misc_feature 1..20: note = CRISPR gRNA sequence
  source 1..20: mol_type = other DNA
ttaaagaagcaactgataac

SEQ ID NO: 92504 - DNA, 20 bp, synthetic construct
  misc_feature 1..20: note = CRISPR gRNA sequence
  source 1..20: mol_type = other DNA
agctttcaaaatttagataa

SEQ ID NO: 92505 - DNA, 20 bp, synthetic construct
  misc_feature 1..20: note = CRISPR gRNA sequence
  source 1..20: mol_type = other DNA
cctaaaatgataccattacc

SEQ ID NO: 92506 - DNA, 20 bp, synthetic construct
  misc_feature 1..20: note = CRISPR gRNA sequence
  source 1..20: mol_type = other DNA
attttgctggcataacaaaa

SEQ ID NO: 92507 - DNA, 20 bp, synthetic construct
  misc_feature 1..20: note = CRISPR gRNA sequence
  source 1..20: mol_type = other DNA
agtagcaaatataaaattat

SEQ ID NO: 92508 - DNA, 20 bp, synthetic construct
  misc_feature 1..20: note = CRISPR gRNA sequence
  source 1..20: mol_type = other DNA
tttacttagaatattatcta

SEQ ID NO: 92509 - DNA, 20 bp, synthetic construct
  misc_feature 1..20: note = CRISPR gRNA sequence
  source 1..20: mol_type = other DNA
tatctatgctgttttttctc

SEQ ID NO: 92510 - DNA, 20 bp, synthetic construct
  misc_feature 1..20: note = CRISPR gRNA sequence
  source 1..20: mol_type = other DNA
ccttaatttctttcattatg

SEQ ID NO: 92511 - DNA, 20 bp, synthetic construct
  misc_feature 1..20: note = CRISPR gRNA sequence
  source 1..20: mol_type = other DNA
tcctcctccagcaaccccca

SEQ ID NO: 92512 - DNA, 20 bp, synthetic construct
  misc_feature 1..20: note = CRISPR gRNA sequence
  source 1..20: mol_type = other DNA
cccccaagttgattttattt

SEQ ID NO: 92513 - DNA, 20 bp, synthetic construct
  misc_feature 1..20: note = CRISPR gRNA sequence
  source 1..20: mol_type = other DNA
ttagatactgaattagataa

SEQ ID NO: 92514 - DNA, 20 bp, synthetic construct
  misc_feature 1..20: note = CRISPR gRNA sequence
  source 1..20: mol_type = other DNA
aattctttttcaaaaacctg

SEQ ID NO: 92515 - DNA, 20 bp, synthetic construct
  misc_feature 1..20: note = CRISPR gRNA sequence
  source 1..20: mol_type = other DNA
ctgcaatgctttttgtccta

SEQ ID NO: 92516 - DNA, 20 bp, synthetic construct
  misc_feature 1..20: note = CRISPR gRNA sequence
  source 1..20: mol_type = other DNA
ccaacttttgccacatttca

SEQ ID NO: 92517 - DNA, 20 bp, synthetic construct
  misc_feature 1..20: note = CRISPR gRNA sequence
  source 1..20: mol_type = other DNA
aacatttcggtagaatgtta

SEQ ID NO: 92518 - DNA, 20 bp, synthetic construct
  misc_feature 1..20: note = CRISPR gRNA sequence
  source 1..20: mol_type = other DNA
tgagctgaaatacatactcc

SEQ ID NO: 92519 - DNA, 20 bp, synthetic construct
  misc_feature 1..20: note = CRISPR gRNA sequence
  source 1..20: mol_type = other DNA
agaatcatgccatataagtc

SEQ ID NO: 92520 - DNA, 20 bp, synthetic construct
  misc_feature 1..20: note = CRISPR gRNA sequence
  source 1..20: mol_type = other DNA
gtctactgcttctcttaaat

SEQ ID NO: 92521 - DNA, 20 bp, synthetic construct
  misc_feature 1..20: note = CRISPR gRNA sequence
  source 1..20: mol_type = other DNA
gtctctcatatagcatagtt

SEQ ID NO: 92522 - DNA, 20 bp, synthetic construct
  misc_feature 1..20: note = CRISPR gRNA sequence
  source 1..20: mol_type = other DNA
ggcattcaatactataaaaa

SEQ ID NO: 92523 - DNA, 20 bp, synthetic construct
  misc_feature 1..20: note = CRISPR gRNA sequence
  source 1..20: mol_type = other DNA
tccacttgctatcttcacaa

SEQ ID NO: 92524 - DNA, 20 bp, synthetic construct
  misc_feature 1..20: note = CRISPR gRNA sequence
  source 1..20: mol_type = other DNA
acttctctttctttactaaa

SEQ ID NO: 92525 - DNA, 20 bp, synthetic construct
  misc_feature 1..20: note = CRISPR gRNA sequence
  source 1..20: mol_type = other DNA
aagtgaaagctctagaataa

SEQ ID NO: 92526 - DNA, 20 bp, synthetic construct
  misc_feature 1..20: note = CRISPR gRNA sequence
  source 1..20: mol_type = other DNA
aagctctagaataagactgc

SEQ ID NO: 92527 - DNA, 20 bp, synthetic construct
  misc_feature 1..20: note = CRISPR gRNA sequence
  source 1..20: mol_type = other DNA
attctttagcctctctgtgc

SEQ ID NO: 92528 - DNA, 20 bp, synthetic construct
  misc_feature 1..20: note = CRISPR gRNA sequence
  source 1..20: mol_type = other DNA
aagggttgtgagactccatt

SEQ ID NO: 92529 - DNA, 20 bp, synthetic construct
  misc_feature 1..20: note = CRISPR gRNA sequence
  source 1..20: mol_type = other DNA
actccatttatagcttaaca

SEQ ID NO: 92530 - DNA, 20 bp, synthetic construct
  misc_feature 1..20: note = CRISPR gRNA sequence
  source 1..20: mol_type = other DNA
gtaaactattgcccatcctt

SEQ ID NO: 92531 - DNA, 20 bp, synthetic construct
  misc_feature 1..20: note = CRISPR gRNA sequence
  source 1..20: mol_type = other DNA
cctttctggtttatactgag

SEQ ID NO: 92532 - DNA, 20 bp, synthetic construct
  misc_feature 1..20: note = CRISPR gRNA sequence
  source 1..20: mol_type = other DNA
gcactgttattttctttaca

SEQ ID NO: 92533 - DNA, 20 bp, synthetic construct
  misc_feature 1..20: note = CRISPR gRNA sequence
  source 1..20: mol_type = other DNA
tacactcagtttaacaaaga

SEQ ID NO: 92534 - DNA, 20 bp, synthetic construct
  misc_feature 1..20: note = CRISPR gRNA sequence
  source 1..20: mol_type = other DNA
agtaaactattagtattatt

SEQ ID NO: 92535 - DNA, 20 bp, synthetic construct
  misc_feature 1..20: note = CRISPR gRNA sequence
  source 1..20: mol_type = other DNA
cactgtagatgtaaatgtta

SEQ ID NO: 92536 - DNA, 20 bp, synthetic construct
  misc_feature 1..20: note = CRISPR gRNA sequence
  source 1..20: mol_type = other DNA
tcaggaggctgaggcacaag

SEQ ID NO: 92537 - DNA, 20 bp, synthetic construct
  misc_feature 1..20: note = CRISPR gRNA sequence
  source 1..20: mol_type = other DNA
actaactttcattcttttcc

SEQ ID NO: 92538 - DNA, 20 bp, synthetic construct
  misc_feature 1..20: note = CRISPR gRNA sequence
  source 1..20: mol_type = other DNA
tttccctaaatccccgtaat

SEQ ID NO: 92539 - DNA, 20 bp, synthetic construct
  misc_feature 1..20: note = CRISPR gRNA sequence
  source 1..20: mol_type = other DNA
ggtaaaacatactataagaa

SEQ ID NO: 92540 - DNA, 20 bp, synthetic construct
  misc_feature 1..20: note = CRISPR gRNA sequence
  source 1..20: mol_type = other DNA
actataagaatatggattga

SEQ ID NO: 92541 - DNA, 20 bp, synthetic construct
  misc_feature 1..20: note = CRISPR gRNA sequence
  source 1..20: mol_type = other DNA
ggattgagggggtttttaaa

SEQ ID NO: 92542 - DNA, 20 bp, synthetic construct
  misc_feature 1..20: note = CRISPR gRNA sequence
  source 1..20: mol_type = other DNA
atgcaaaattaaagttacat

SEQ ID NO: 92543 - DNA, 20 bp, synthetic construct
  misc_feature 1..20: note = CRISPR gRNA sequence
  source 1..20: mol_type = other DNA
aatatttagaatattatact

SEQ ID NO: 92544 - DNA, 20 bp, synthetic construct
  misc_feature 1..20: note = CRISPR gRNA sequence
  source 1..20: mol_type = other DNA
ctcctaggcctccccaagtt

SEQ ID NO: 92545 - DNA, 20 bp, synthetic construct
  misc_feature 1..20: note = CRISPR gRNA sequence
  source 1..20: mol_type = other DNA
aatacatcctaggaccctaa

SEQ ID NO: 92546 - DNA, 20 bp, synthetic construct
  misc_feature 1..20: note = CRISPR gRNA sequence
  source 1..20: mol_type = other DNA
tacaggcacttgccaccata

SEQ ID NO: 92547 - DNA, 20 bp, synthetic construct
  misc_feature 1..20: note = CRISPR gRNA sequence
  source 1..20: mol_type = other DNA
attaaatttttctctacact

SEQ ID NO: 92548 - DNA, 20 bp, synthetic construct
  misc_feature 1..20: note = CRISPR gRNA sequence
  source 1..20: mol_type = other DNA
tagctctcacaagaagaaat

SEQ ID NO: 92549 - DNA, 20 bp, synthetic construct
  misc_feature 1..20: note = CRISPR gRNA sequence
  source 1..20: mol_type = other DNA
acaatgacaataataatggg

SEQ ID NO: 92550 - DNA, 20 bp, synthetic construct
  misc_feature 1..20: note = CRISPR gRNA sequence
  source 1..20: mol_type = other DNA
acagcaacactatgaatgac

SEQ ID NO: 92551 - DNA, 20 bp, synthetic construct
  misc_feature 1..20: note = CRISPR gRNA sequence
  source 1..20: mol_type = other DNA
cgattttaatgcccatttta

SEQ ID NO: 92552 - DNA, 20 bp, synthetic construct
  misc_feature 1..20: note = CRISPR gRNA sequence
  source 1..20: mol_type = other DNA
aaggccagtaaatgatgcaa

SEQ ID NO: 92553 - DNA, 20 bp, synthetic construct
  misc_feature 1..20: note = CRISPR gRNA sequence
  source 1..20: mol_type = other DNA
cagaagtcgaactccagaac

SEQ ID NO: 92554 - DNA, 20 bp, synthetic construct
  misc_feature 1..20: note = CRISPR gRNA sequence
  source 1..20: mol_type = other DNA
cagttcaaatcaaacaatcc

SEQ ID NO: 92555 - DNA, 20 bp, synthetic construct
  misc_feature 1..20: note = CRISPR gRNA sequence
  source 1..20: mol_type = other DNA
catgagttcaacagaactgt

SEQ ID NO: 92556 - DNA, 20 bp, synthetic construct
  misc_feature 1..20: note = CRISPR gRNA sequence
  source 1..20: mol_type = other DNA
ggggaggcaggccctgcaga

SEQ ID NO: 92557 - DNA, 20 bp, synthetic construct
  misc_feature 1..20: note = CRISPR gRNA sequence
  source 1..20: mol_type = other DNA
agatgcggtttgcgttaaga

SEQ ID NO: 92558 - DNA, 20 bp, synthetic construct
  misc_feature 1..20: note = CRISPR gRNA sequence
  source 1..20: mol_type = other DNA
cctcagctaagtctgatacc

SEQ ID NO: 92559 - DNA, 20 bp, synthetic construct
  misc_feature 1..20: note = CRISPR gRNA sequence
  source 1..20: mol_type = other DNA
taagtctgatacctcgagtt

SEQ ID NO: 92560 - DNA, 20 bp, synthetic construct
  misc_feature 1..20: note = CRISPR gRNA sequence
  source 1..20: mol_type = other DNA
tgtccttgtacatcttgttg

SEQ ID NO: 92561 - DNA, 20 bp, synthetic construct
  misc_feature 1..20: note = CRISPR gRNA sequence
  source 1..20: mol_type = other DNA
tgcggtgtttcttgcacatc

SEQ ID NO: 92562 - DNA, 20 bp, synthetic construct
  misc_feature 1..20: note = CRISPR gRNA sequence
  source 1..20: mol_type = other DNA
tcttgcacatccacggtttg

SEQ ID NO: 92563 - DNA, 20 bp, synthetic construct
  misc_feature 1..20: note = CRISPR gRNA sequence
  source 1..20: mol_type = other DNA
ccccttcgcacaggtaccta

SEQ ID NO: 92564 - DNA, 20 bp, synthetic construct
  misc_feature 1..20: note = CRISPR gRNA sequence
  source 1..20: mol_type = other DNA
cctggccggggtccacgacc

SEQ ID NO: 92565 - DNA, 20 bp, synthetic construct
  misc_feature 1..20: note = CRISPR gRNA sequence
  source 1..20: mol_type = other DNA
cacgaccccgggcttttagc

SEQ ID NO: 92566 - DNA, 20 bp, synthetic construct
  misc_feature 1..20: note = CRISPR gRNA sequence
  source 1..20: mol_type = other DNA
cagcgcaaaccgtggatgtg

SEQ ID NO: 92567 - DNA, 20 bp, synthetic construct
  misc_feature 1..20: note = CRISPR gRNA sequence
  source 1..20: mol_type = other DNA
cctggggatgggaggtggaa

SEQ ID NO: 92568 - DNA, 20 bp, synthetic construct
  misc_feature 1..20: note = CRISPR gRNA sequence
  source 1..20: mol_type = other DNA
gcagtgactgggttagtggt

SEQ ID NO: 92569 - DNA, 20 bp, synthetic construct
  misc_feature 1..20: note = CRISPR gRNA sequence
  source 1..20: mol_type = other DNA
ctgttgaactcatgataggt

SEQ ID NO: 92570 - DNA, 20 bp, synthetic construct
  misc_feature 1..20: note = CRISPR gRNA sequence
  source 1..20: mol_type = other DNA
ctagatgaagttggtacttc

SEQ ID NO: 92571 - DNA, 20 bp, synthetic construct
  misc_feature 1..20: note = CRISPR gRNA sequence
  source 1..20: mol_type = other DNA
gctatataatcccttagtgt

SEQ ID NO: 92572 - DNA, 20 bp, synthetic construct
  misc_feature 1..20: note = CRISPR gRNA sequence
  source 1..20: mol_type = other DNA
tgacttaatgaagactcttc

SEQ ID NO: 92573 - DNA, 20 bp, synthetic construct
  misc_feature 1..20: note = CRISPR gRNA sequence
  source 1..20: mol_type = other DNA
tagggaaataagcatctgga

SEQ ID NO: 92574 - DNA, 20 bp, synthetic construct
  misc_feature 1..20: note = CRISPR gRNA sequence
  source 1..20: mol_type = other DNA
tccacaggtgcccattcact

SEQ ID NO: 92575 - DNA, 20 bp, synthetic construct
  misc_feature 1..20: note = CRISPR gRNA sequence
  source 1..20: mol_type = other DNA
cttcagaattctttagagag

SEQ ID NO: 92576 - DNA, 20 bp, synthetic construct
  misc_feature 1..20: note = CRISPR gRNA sequence
  source 1..20: mol_type = other DNA
ggcctaataatacttatttt

SEQ ID NO: 92577 - DNA, 20 bp, synthetic construct
  misc_feature 1..20: note = CRISPR gRNA sequence
  source 1..20: mol_type = other DNA
atctttgttaaactgagtgt

SEQ ID NO: 92578 - DNA, 20 bp, synthetic construct
  misc_feature 1..20: note = CRISPR gRNA sequence
  source 1..20: mol_type = other DNA
tcattgtaggctgagatact

SEQ ID NO: 92579 - DNA, 20 bp, synthetic construct
  misc_feature 1..20: note = CRISPR gRNA sequence
  source 1..20: mol_type = other DNA
gaaacgtgactcagtataaa

SEQ ID NO: 92580 - DNA, 20 bp, synthetic construct
  misc_feature 1..20: note = CRISPR gRNA sequence
  source 1..20: mol_type = other DNA
aactgaggcacagagaggct

SEQ ID NO: 92581 - DNA, 20 bp, synthetic construct
  misc_feature 1..20: note = CRISPR gRNA sequence
  source 1..20: mol_type = other DNA
ctccttactatactgcttcc

SEQ ID NO: 92582 - DNA, 20 bp, synthetic construct
  misc_feature 1..20: note = CRISPR gRNA sequence
  source 1..20: mol_type = other DNA
aaagagaagcacattttagt

SEQ ID NO: 92583 - DNA, 20 bp, synthetic construct
  misc_feature 1..20: note = CRISPR gRNA sequence
  source 1..20: mol_type = other DNA
aaagaaagagaagtaggaat

SEQ ID NO: 92584 - DNA, 20 bp, synthetic construct
  misc_feature 1..20: note = CRISPR gRNA sequence
  source 1..20: mol_type = other DNA
ttgagtggaaaattcatgag

SEQ ID NO: 92585 - DNA, 20 bp, synthetic construct
  misc_feature 1..20: note = CRISPR gRNA sequence
  source 1..20: mol_type = other DNA
ctatgttgtgagcagcaaga

SEQ ID NO: 92586 - DNA, 20 bp, synthetic construct
  misc_feature 1..20: note = CRISPR gRNA sequence
  source 1..20: mol_type = other DNA
attaagttctctattccaat

SEQ ID NO: 92587 - DNA, 20 bp, synthetic construct
  misc_feature 1..20: note = CRISPR gRNA sequence
  source 1..20: mol_type = other DNA
tttattaaggtaaaaaaatt

SEQ ID NO: 92588 - DNA, 20 bp, synthetic construct
  misc_feature 1..20: note = CRISPR gRNA sequence
  source 1..20: mol_type = other DNA
aagcattgcaggtttttgaa

SEQ ID NO: 92589 - DNA, 20 bp, synthetic construct
  misc_feature 1..20: note = CRISPR gRNA sequence
  source 1..20: mol_type = other DNA
ttatcttgcacataaaaatg

SEQ ID NO: 92590 - DNA, 20 bp, synthetic construct
  misc_feature 1..20: note = CRISPR gRNA sequence
  source 1..20: mol_type = other DNA
cttgggggttgctggaggag

SEQ ID NO: 92591 - DNA, 20 bp, synthetic construct
  misc_feature 1..20: note = CRISPR gRNA sequence
  source 1..20: mol_type = other DNA
atttttgtttcctctgggta

SEQ ID NO: 92592 - DNA, 20 bp, synthetic construct
  misc_feature 1..20: note = CRISPR gRNA sequence
  source 1..20: mol_type = other DNA
ttggtaaacttctcataatg

SEQ ID NO: 92593 - DNA, 20 bp, synthetic construct
  misc_feature 1..20: note = CRISPR gRNA sequence
  source 1..20: mol_type = other DNA
catagataactcagaggcca

SEQ ID NO: 92594 - DNA, 20 bp, synthetic construct
  misc_feature 1..20: note = CRISPR gRNA sequence
  source 1..20: mol_type = other DNA
ggccagtagaaagaagccca

SEQ ID NO: 92595 - DNA, 20 bp, synthetic construct
  misc_feature 1..20: note = CRISPR gRNA sequence
  source 1..20: mol_type = other DNA
ttttatatttgctactttag

SEQ ID NO: 92596 - DNA, 20 bp, synthetic construct
  misc_feature 1..20: note = CRISPR gRNA sequence
  source 1..20: mol_type = other DNA
gtggcatagttttgtaagag

SEQ ID NO: 92597 - DNA, 20 bp, synthetic construct
  misc_feature 1..20: note = CRISPR gRNA sequence
  source 1..20: mol_type = other DNA
gcctggatagcattatataa

SEQ ID NO: 92598 - DNA, 20 bp, synthetic construct
  misc_feature 1..20: note = CRISPR gRNA sequence
  source 1..20: mol_type = other DNA
agagactgggcaagaagaag

SEQ ID NO: 92599 - DNA, 20 bp, synthetic construct
  misc_feature 1..20: note = CRISPR gRNA sequence
  source 1..20: mol_type = other DNA
aataagtcaaaattttaaaa

SEQ ID NO: 92600 - DNA, 20 bp, synthetic construct
  misc_feature 1..20: note = CRISPR gRNA sequence
  source 1..20: mol_type = other DNA
gcttatatagacaaaatcac

SEQ ID NO: 92601 - DNA, 20 bp, synthetic construct
  misc_feature 1..20: note = CRISPR gRNA sequence
  source 1..20: mol_type = other DNA
acagcttcagtcttaactgc

SEQ ID NO: 92602 - DNA, 20 bp, synthetic construct
  misc_feature 1..20: note = CRISPR gRNA sequence
  source 1..20: mol_type = other DNA
gcttcaatacattgcaaaag

SEQ ID NO: 92603 - DNA, 20 bp, synthetic construct
  misc_feature 1..20: note = CRISPR gRNA sequence
  source 1..20: mol_type = other DNA
atacattgcaaaagatagaa

SEQ ID NO: 92604 - DNA, 20 bp, synthetic construct
  misc_feature 1..20: note = CRISPR gRNA sequence
  source 1..20: mol_type = other DNA
gatagaaacagaaaaaaaag

SEQ ID NO: 92605 - DNA, 20 bp, synthetic construct
  misc_feature 1..20: note = CRISPR gRNA sequence
  source 1..20: mol_type = other DNA
tatatattggtatggcactt

SEQ ID NO: 92606 - DNA, 20 bp, synthetic construct
  misc_feature 1..20: note = CRISPR gRNA sequence
  source 1..20: mol_type = other DNA
catttaatatgaagacattt

SEQ ID NO: 92607 - DNA, 20 bp, synthetic construct
  misc_feature 1..20: note = CRISPR gRNA sequence
  source 1..20: mol_type = other DNA
taaataaaactgtttaataa

SEQ ID NO: 92608 - DNA, 20 bp, synthetic construct
  misc_feature 1..20: note = CRISPR gRNA sequence
  source 1..20: mol_type = other DNA
atgaagacttagttgcctaa

SEQ ID NO: 92609 - DNA, 20 bp, synthetic construct
  misc_feature 1..20: note = CRISPR gRNA sequence
  source 1..20: mol_type = other DNA
ccagaagtagtgcaattttt

SEQ ID NO: 92610 - DNA, 20 bp, synthetic construct
  misc_feature 1..20: note = CRISPR gRNA sequence
  source 1..20: mol_type = other DNA
ctggacttcttagtaacgac

SEQ ID NO: 92611 - DNA, 20 bp, synthetic construct
  misc_feature 1..20: note = CRISPR gRNA sequence
  source 1..20: mol_type = other DNA
acttcttagtaacgacttag

SEQ ID NO: 92612 - DNA, 20 bp, synthetic construct
  misc_feature 1..20: note = CRISPR gRNA sequence
  source 1..20: mol_type = other DNA
ttagtaacgacttagaaaga

SEQ ID NO: 92613 - DNA, 20 bp, synthetic construct
  misc_feature 1..20: note = CRISPR gRNA sequence
  source 1..20: mol_type = other DNA
catatgatacaatatgttca

SEQ ID NO: 92614 - DNA, 20 bp, synthetic construct
  misc_feature 1..20: note = CRISPR gRNA sequence
  source 1..20: mol_type = other DNA
gcactgacccaggattatag

SEQ ID NO: 92615 - DNA, 20 bp, synthetic construct
  misc_feature 1..20: note = CRISPR gRNA sequence
  source 1..20: mol_type = other DNA
ttaggcaactaagtcttcat

SEQ ID NO: 92616 - DNA, 20 bp, synthetic construct
  misc_feature 1..20: note = CRISPR gRNA sequence
  source 1..20: mol_type = other DNA
aaatacttacataaatttat

SEQ ID NO: 92617 - DNA, 20 bp, synthetic construct
  misc_feature 1..20: note = CRISPR gRNA sequence
  source 1..20: mol_type = other DNA
actaccttttttactattta

SEQ ID NO: 92618 - DNA, 20 bp, synthetic construct
  misc_feature 1..20: note = CRISPR gRNA sequence
  source 1..20: mol_type = other DNA
atataatgccattaactact

SEQ ID NO: 92619 - DNA, 20 bp, synthetic construct
  misc_feature 1..20: note = CRISPR gRNA sequence
  source 1..20: mol_type = other DNA
atggggtctcgctacgttgc

SEQ ID NO: 92620 - DNA, 20 bp, synthetic construct
  misc_feature 1..20: note = CRISPR gRNA sequence
  source 1..20: mol_type = other DNA
ttaacctctttgttctttac

SEQ ID NO: 92621 - DNA, 20 bp, synthetic construct
  misc_feature 1..20: note = CRISPR gRNA sequence
  source 1..20: mol_type = other DNA
actggcctctgagttatcta

SEQ ID NO: 92622 - DNA, 20 bp, synthetic construct
  misc_feature 1..20: note = CRISPR gRNA sequence
  source 1..20: mol_type = other DNA
tcaacatataaaaactgtaa

SEQ ID NO: 92623 - DNA, 20 bp, synthetic construct
  misc_feature 1..20: note = CRISPR gRNA sequence
  source 1..20: mol_type = other DNA
tgaatagctctaacatttcg

SEQ ID NO: 92624 - DNA, 20 bp, synthetic construct
  misc_feature 1..20: note = CRISPR gRNA sequence
  source 1..20: mol_type = other DNA
gcctaagagtcctagttacc

SEQ ID NO: 92625 - DNA, 20 bp, synthetic construct
  misc_feature 1..20: note = CRISPR gRNA sequence
  source 1..20: mol_type = other DNA
tcatttaaccttgacttgtg

SEQ ID NO: 92626 - DNA, 20 bp, synthetic construct
  misc_feature 1..20: note = CRISPR gRNA sequence
  source 1..20: mol_type = other DNA
tttccactcaactattttag

SEQ ID NO: 92627 - DNA, 20 bp, synthetic construct
  misc_feature 1..20: note = CRISPR gRNA sequence
  source 1..20: mol_type = other DNA
cttctctttccttttatcta

SEQ ID NO: 92628 - DNA, 20 bp, synthetic construct
  misc_feature 1..20: note = CRISPR gRNA sequence
  source 1..20: mol_type = other DNA
aggaggtaaaagtgaaagct

SEQ ID NO: 92629 - DNA, 20 bp, synthetic construct
  misc_feature 1..20: note = CRISPR gRNA sequence
  source 1..20: mol_type = other DNA
ttaacacagtgcttgacaca

SEQ ID NO: 92630 - DNA, 20 bp, synthetic construct
  misc_feature 1..20: note = CRISPR gRNA sequence
  source 1..20: mol_type = other DNA
gactctgtctcaaaaaaaaa

SEQ ID NO: 92631 - DNA, 20 bp, synthetic construct
  misc_feature 1..20: note = CRISPR gRNA sequence
  source 1..20: mol_type = other DNA
ctgtctcaaaaaaaaaaaag

SEQ ID NO: 92632 - DNA, 20 bp, synthetic construct
  misc_feature 1..20: note = CRISPR gRNA sequence
  source 1..20: mol_type = other DNA
tattatttttctccctctct

SEQ ID NO: 92633 - DNA, 20 bp, synthetic construct
  misc_feature 1..20: note = CRISPR gRNA sequence
  source 1..20: mol_type = other DNA
cacctgtggaacatactgag

SEQ ID NO: 92634 - DNA, 20 bp, synthetic construct
  misc_feature 1..20: note = CRISPR gRNA sequence
  source 1..20: mol_type = other DNA
agatttggtaaaacatacta

SEQ ID NO: 92635 - DNA, 20 bp, synthetic construct
  misc_feature 1..20: note = CRISPR gRNA sequence
  source 1..20: mol_type = other DNA
cacactggcaactgcaaatt

SEQ ID NO: 92636 - DNA, 20 bp, synthetic construct
  misc_feature 1..20: note = CRISPR gRNA sequence
  source 1..20: mol_type = other DNA
actgcaaattttagaaatat

SEQ ID NO: 92637 - DNA, 20 bp, synthetic construct
  misc_feature 1..20: note = CRISPR gRNA sequence
  source 1..20: mol_type = other DNA
cttcaagttcagcctgaaac

SEQ ID NO: 92638 - DNA, 20 bp, synthetic construct
  misc_feature 1..20: note = CRISPR gRNA sequence
  source 1..20: mol_type = other DNA
aaactaagaaatttaaagac

SEQ ID NO: 92639 - DNA, 20 bp, synthetic construct
  misc_feature 1..20: note = CRISPR gRNA sequence
  source 1..20: mol_type = other DNA
ggattatatagctctcacaa

SEQ ID NO: 92640 - DNA, 20 bp, synthetic construct
  misc_feature 1..20: note = CRISPR gRNA sequence
  source 1..20: mol_type = other DNA
ttttcccccctcaggggtac

SEQ ID NO: 92641 - DNA, 20 bp, synthetic construct
  misc_feature 1..20: note = CRISPR gRNA sequence
  source 1..20: mol_type = other DNA
gggtactgggaacagagttg

SEQ ID NO: 92642 - DNA, 20 bp, synthetic construct
  misc_feature 1..20: note = CRISPR gRNA sequence
  source 1..20: mol_type = other DNA
gggtactgagaactggatac

SEQ ID NO: 92643 - DNA, 20 bp, synthetic construct
  misc_feature 1..20: note = CRISPR gRNA sequence
  source 1..20: mol_type = other DNA
ctgagaatagagtagtgaaa

SEQ ID NO: 92644 - DNA, 20 bp, synthetic construct
  misc_feature 1..20: note = CRISPR gRNA sequence
  source 1..20: mol_type = other DNA
ataatggggtataagtctca

SEQ ID NO: 92645 - DNA, 20 bp, synthetic construct
  misc_feature 1..20: note = CRISPR gRNA sequence
  source 1..20: mol_type = other DNA
gatttgaactgagtcaaagg

SEQ ID NO: 92646 - DNA, 20 bp, synthetic construct
  misc_feature 1..20: note = CRISPR gRNA sequence
  source 1..20: mol_type = other DNA
acagagcaagactttgtctc

SEQ ID NO: 92647 - DNA, 20 bp, synthetic construct
  misc_feature 1..20: note = CRISPR gRNA sequence
  source 1..20: mol_type = other DNA
gacttctgtaatcttagttt

SEQ ID NO: 92648 - DNA, 20 bp, synthetic construct
  misc_feature 1..20: note = CRISPR gRNA sequence
  source 1..20: mol_type = other DNA
gaaagagaagtaggaataca

SEQ ID NO: 92649 - DNA, 20 bp, synthetic construct
  misc_feature 1..20: note = CRISPR gRNA sequence
  source 1..20: mol_type = other DNA
accgaaatgttagagctatt

SEQ ID NO: 92650 - DNA, 20 bp, synthetic construct
  misc_feature 1..20: note = CRISPR gRNA sequence
  source 1..20: mol_type = other DNA
gtagaaagaagcccaagaga

SEQ ID NO: 92651 - DNA, 20 bp, synthetic construct
  misc_feature 1..20: note = CRISPR gRNA sequence
  source 1..20: mol_type = other DNA
tgtaaggtatggctttccgg

SEQ ID NO: 92652 - DNA, 20 bp, synthetic construct
  misc_feature 1..20: note = CRISPR gRNA sequence
  source 1..20: mol_type = other DNA
aattcctgtaatttgatgag

SEQ ID NO: 92653 - DNA, 20 bp, synthetic construct
  misc_feature 1..20: note = CRISPR gRNA sequence
  source 1..20: mol_type = other DNA
cagctaagatgatttttaaa

SEQ ID NO: 92654 - DNA, 20 bp, synthetic construct
  misc_feature 1..20: note = CRISPR gRNA sequence
  source 1..20: mol_type = other DNA
ttatgtaagtattttattat

SEQ ID NO: 92655 - DNA, 20 bp, synthetic construct
  misc_feature 1..20: note = CRISPR gRNA sequence
  source 1..20: mol_type = other DNA
cacatcagagtaattagcat

SEQ ID NO: 92656 - DNA, 20 bp, synthetic construct
  misc_feature 1..20: note = CRISPR gRNA sequence
  source 1..20: mol_type = other DNA
tcatctattacaataagata

SEQ ID NO: 92657 - DNA, 20 bp, synthetic construct
  misc_feature 1..20: note = CRISPR gRNA sequence
  source 1..20: mol_type = other DNA
aactgctgttgtctttgctc

SEQ ID NO: 92658 - DNA, 20 bp, synthetic construct
  misc_feature 1..20: note = CRISPR gRNA sequence
  source 1..20: mol_type = other DNA
gatgtcacacatcaaaatac

SEQ ID NO: 92659 - DNA, 20 bp, synthetic construct
  misc_feature 1..20: note = CRISPR gRNA sequence
  source 1..20: mol_type = other DNA
aggaaaaaatataactgctc

SEQ ID NO: 92660 - DNA, 20 bp, synthetic construct
  misc_feature 1..20: note = CRISPR gRNA sequence
  source 1..20: mol_type = other DNA
ctttttacccagttggcaac

SEQ ID NO: 92661 - DNA, 20 bp, synthetic construct
  misc_feature 1..20: note = CRISPR gRNA sequence
  source 1..20: mol_type = other DNA
tctcctgccaactgtatgaa

SEQ ID NO: 92662 - DNA, 20 bp, synthetic construct
  misc_feature 1..20: note = CRISPR gRNA sequence
  source 1..20: mol_type = other DNA
accctgagatttcactgccc

SEQ ID NO: 92663 - DNA, 20 bp, synthetic construct
  misc_feature 1..20: note = CRISPR gRNA sequence
  source 1..20: mol_type = other DNA
ctgaaatattctgactctta

SEQ ID NO: 92664 - DNA, 20 bp, synthetic construct
  misc_feature 1..20: note = CRISPR gRNA sequence
  source 1..20: mol_type = other DNA
cattttaggcctcaacatat

SEQ ID NO: 92665 - DNA, 20 bp, synthetic construct
  misc_feature 1..20: note = CRISPR gRNA sequence
  source 1..20: mol_type = other DNA
agatgttggaattctttttc

SEQ ID NO: 92666 - DNA, 20 bp, synthetic construct
  misc_feature 1..20: note = CRISPR gRNA sequence
  source 1..20: mol_type = other DNA
gcctggcattcaatactata

SEQ ID NO: 92667 - DNA, 20 bp, synthetic construct
  misc_feature 1..20: note = CRISPR gRNA sequence
  source 1..20: mol_type = other DNA
tctatcctcctctgaactac

SEQ ID NO: 92668 - DNA, 20 bp, synthetic construct
  misc_feature 1..20: note = CRISPR gRNA sequence
  source 1..20: mol_type = other DNA
gaccagactggccaacatgg

SEQ ID NO: 92669 - DNA, 20 bp, synthetic construct
  misc_feature 1..20: note = CRISPR gRNA sequence
  source 1..20: mol_type = other DNA
ccccgtaatcagagatttgg

SEQ ID NO: 92670 - DNA, 20 bp, synthetic construct
  misc_feature 1..20: note = CRISPR gRNA sequence
  source 1..20: mol_type = other DNA
gtcctcttactccaaaagag

SEQ ID NO: 92671 - DNA, 20 bp, synthetic construct
  misc_feature 1..20: note = CRISPR gRNA sequence
  source 1..20: mol_type = other DNA
ggttaacagaacaggacact

SEQ ID NO: 92672 - DNA, 20 bp, synthetic construct
  misc_feature 1..20: note = CRISPR gRNA sequence
  source 1..20: mol_type = other DNA
gatactgagaatagagtagt

SEQ ID NO: 92673 - DNA, 20 bp, synthetic construct
  misc_feature 1..20: note = CRISPR gRNA sequence
  source 1..20: mol_type = other DNA
accccagcgtgtcctgagtc

SEQ ID NO: 92674 - DNA, 20 bp, synthetic construct
  misc_feature 1..20: note = CRISPR gRNA sequence
  source 1..20: mol_type = other DNA
ccccagcgtgtcctgagtct

SEQ ID NO: 92675 - DNA, 20 bp, synthetic construct
  misc_feature 1..20: note = CRISPR gRNA sequence
  source 1..20: mol_type = other DNA
agtctttggttcgcgaagtg

SEQ ID NO: 92676 - DNA, 20 bp, synthetic construct
  misc_feature 1..20: note = CRISPR gRNA sequence
  source 1..20: mol_type = other DNA
tggttcgcgaagtgccgtta

SEQ ID NO: 92677 - DNA, 20 bp, synthetic construct
  misc_feature 1..20: note = CRISPR gRNA sequence
  source 1..20: mol_type = other DNA
ggttcgcgaagtgccgttag

SEQ ID NO: 92678 - DNA, 20 bp, synthetic construct
  misc_feature 1..20: note = CRISPR gRNA sequence
  source 1..20: mol_type = other DNA
gttcgcgaagtgccgttagg

SEQ ID NO: 92679 - DNA, 20 bp, synthetic construct
  misc_feature 1..20: note = CRISPR gRNA sequence
  source 1..20: mol_type = other DNA
gcgaagtgccgttaggccaa

SEQ ID NO: 92680 - DNA, 20 bp, synthetic construct
  misc_feature 1..20: note = CRISPR gRNA sequence
  source 1..20: mol_type = other DNA
ggccaagcaggtgctaaaag

SEQ ID NO: 92681 - DNA, 20 bp, synthetic construct
  misc_feature 1..20: note = CRISPR gRNA sequence
  source 1..20: mol_type = other DNA
aaagcccggggtcgtggacc

SEQ ID NO: 92682 - DNA, 20 bp, synthetic construct
  misc_feature 1..20: note = CRISPR gRNA sequence
  source 1..20: mol_type = other DNA
agcagcatggaggcgcaggg

SEQ ID NO: 92683 - DNA, 20 bp, synthetic construct
  misc_feature 1..20: note = CRISPR gRNA sequence
  source 1..20: mol_type = other DNA
gcagcatggaggcgcagggt

SEQ ID NO: 92684 - DNA, 20 bp, synthetic construct
  misc_feature 1..20: note = CRISPR gRNA sequence
  source 1..20: mol_type = other DNA
gccccggctgcggctcccac

SEQ ID NO: 92685 - DNA, 20 bp, synthetic construct
  misc_feature 1..20: note = CRISPR gRNA sequence
  source 1..20: mol_type = other DNA
cggctcccaccttggcgcca

SEQ ID NO: 92686 - DNA, 20 bp, synthetic construct
  misc_feature 1..20: note = CRISPR gRNA sequence
  source 1..20: mol_type = other DNA
ccaccttggcgccagcctcg

SEQ ID NO: 92687 - DNA, 20 bp, synthetic construct
  misc_feature 1..20: note = CRISPR gRNA sequence
  source 1..20: mol_type = other DNA
ggcgccagcctcggtggcgg

SEQ ID NO: 92688 - DNA, 20 bp, synthetic construct
  misc_feature 1..20: note = CRISPR gRNA sequence
  source 1..20: mol_type = other DNA
gcgccagcctcggtggcggc

SEQ ID NO: 92689 - DNA, 20 bp, synthetic construct
  misc_feature 1..20: note = CRISPR gRNA sequence
  source 1..20: mol_type = other DNA
ggtggcggccgcggcctctc

SEQ ID NO: 92690 - DNA, 20 bp, synthetic construct
  misc_feature 1..20: note = CRISPR gRNA sequence
  source 1..20: mol_type = other DNA
tcaattcaccctgctagtga

SEQ ID NO: 92691 - DNA, 20 bp, synthetic construct
  misc_feature 1..20: note = CRISPR gRNA sequence
  source 1..20: mol_type = other DNA
aattcaccctgctagtgatg

SEQ ID NO: 92692 - DNA, 20 bp, synthetic construct
  misc_feature 1..20: note = CRISPR gRNA sequence
  source 1..20: mol_type = other DNA
accctgctagtgatgcaacc

SEQ ID NO: 92693 - DNA, 20 bp, synthetic construct
  misc_feature 1..20: note = CRISPR gRNA sequence
  source 1..20: mol_type = other DNA
ctagtgatgcaaccctgtgc

SEQ ID NO: 92694 - DNA, 20 bp, synthetic construct
  misc_feature 1..20: note = CRISPR gRNA sequence
  source 1..20: mol_type = other DNA
gtgatgcaaccctgtgctgg

SEQ ID NO: 92695 - DNA, 20 bp, synthetic construct
  misc_feature 1..20: note = CRISPR gRNA sequence
  source 1..20: mol_type = other DNA
tgctgggcaggacgaggctg

SEQ ID NO: 92696 - DNA, 20 bp, synthetic construct
  misc_feature 1..20: note = CRISPR gRNA sequence
  source 1..20: mol_type = other DNA
ggcaggacgaggctgcggcc

SEQ ID NO: 92697 - DNA, 20 bp, synthetic construct
  misc_feature 1..20: note = CRISPR gRNA sequence
  source 1..20: mol_type = other DNA
cggcccccgggggcagcgtt

SEQ ID NO: 92698 - DNA, 20 bp, synthetic construct
  misc_feature 1..20: note = CRISPR gRNA sequence
  source 1..20: mol_type = other DNA
gggcgggcaagcccgttagg

SEQ ID NO: 92699 - DNA, 20 bp, synthetic construct
  misc_feature 1..20: note = CRISPR gRNA sequence
  source 1..20: mol_type = other DNA
ggtacctgtgcgaaggggcc

SEQ ID NO: 92700 - DNA, 20 bp, synthetic construct
  misc_feature 1..20: note = CRISPR gRNA sequence
  source 1..20: mol_type = other DNA
tgcgaaggggccggggatgg

SEQ ID NO: 92701 - DNA, 20 bp, synthetic construct
  misc_feature 1..20: note = CRISPR gRNA sequence
  source 1..20: mol_type = other DNA
gggaggacgaggcggacctg

SEQ ID NO: 92702 - DNA, 20 bp, synthetic construct
  misc_feature 1..20: note = CRISPR gRNA sequence
  source 1..20: mol_type = other DNA
ttagacacttcggaccctcc

SEQ ID NO: 92703 - DNA, 20 bp, synthetic construct
  misc_feature 1..20: note = CRISPR gRNA sequence
  source 1..20: mol_type = other DNA
gacacttcggaccctccggg

SEQ ID NO: 92704 - DNA, 20 bp, synthetic construct
  misc_feature 1..20: note = CRISPR gRNA sequence
  source 1..20: mol_type = other DNA
cggaccctccggggggaggc

SEQ ID NO: 92705 - DNA, 20 bp, synthetic construct
  misc_feature 1..20: note = CRISPR gRNA sequence
  source 1..20: mol_type = other DNA
ggaccctccggggggaggcg

SEQ ID NO: 92706 - DNA, 20 bp, synthetic construct
  misc_feature 1..20: note = CRISPR gRNA sequence
  source 1..20: mol_type = other DNA
cggggggaggcgagagcgcg

SEQ ID NO: 92707 - DNA, 20 bp, synthetic construct
  misc_feature 1..20: note = CRISPR gRNA sequence
  source 1..20: mol_type = other DNA
gtttggaggatctagaggac

SEQ ID NO: 92708 - DNA, 20 bp, synthetic construct
  misc_feature 1..20: note = CRISPR gRNA sequence
  source 1..20: mol_type = other DNA
ggaggatctagaggacgagg

SEQ ID NO: 92709 - DNA, 20 bp, synthetic construct
  misc_feature 1..20: note = CRISPR gRNA sequence
  source 1..20: mol_type = other DNA
gaggatctagaggacgagga

SEQ ID NO: 92710 - DNA, 20 bp, synthetic construct
  misc_feature 1..20: note = CRISPR gRNA sequence
  source 1..20: mol_type = other DNA
gaggacgaggagactcactc

SEQ ID NO: 92711 - DNA, 20 bp, synthetic construct
  misc_feature 1..20: note = CRISPR gRNA sequence
  source 1..20: mol_type = other DNA
actcggggggcgagggcagc

SEQ ID NO: 92712 - DNA, 20 bp, synthetic construct
  misc_feature 1..20: note = CRISPR gRNA sequence
  source 1..20: mol_type = other DNA
ggggggcgagggcagcagcg

SEQ ID NO: 92713 - DNA, 20 bp, synthetic construct
  misc_feature 1..20: note = CRISPR gRNA sequence
  source 1..20: mol_type = other DNA
cacctacgaaggctgcagcg

SEQ ID NO: 92714 - DNA, 20 bp, synthetic construct
  misc_feature 1..20: note = CRISPR gRNA sequence
  source 1..20: mol_type = other DNA
cgaaggctgcagcgagacca

SEQ ID NO: 92715 - DNA, 20 bp, synthetic construct
  misc_feature 1..20: note = CRISPR gRNA sequence
  source 1..20: mol_type = other DNA
cagcgagaccacgagccagg

SEQ ID NO: 92716 - DNA, 20 bp, synthetic construct
  misc_feature 1..20: note = CRISPR gRNA sequence
  source 1..20: mol_type = other DNA
aactgcggtgggactgcctc

SEQ ID NO: 92717 - DNA, 20 bp, synthetic construct
  misc_feature 1..20: note = CRISPR gRNA sequence
  source 1..20: mol_type = other DNA
cggtgggactgcctcgactg

SEQ ID NO: 92718 - DNA, 20 bp, synthetic construct
  misc_feature 1..20: note = CRISPR gRNA sequence
  source 1..20: mol_type = other DNA
cctcgactggcagcgcggga

SEQ ID NO: 92719 - DNA, 20 bp, synthetic construct
  misc_feature 1..20: note = CRISPR gRNA sequence
  source 1..20: mol_type = other DNA
gactggcagcgcgggaaacg

SEQ ID NO: 92720 - DNA, 20 bp, synthetic construct
  misc_feature 1..20: note = CRISPR gRNA sequence
  source 1..20: mol_type = other DNA
gcagcgcgggaaacgtcaaa

SEQ ID NO: 92721 - DNA, 20 bp, synthetic construct
  misc_feature 1..20: note = CRISPR gRNA sequence
  source 1..20: mol_type = other DNA
gaggtatcagacttagctga

SEQ ID NO: 92722 - DNA, 20 bp, synthetic construct
  misc_feature 1..20: note = CRISPR gRNA sequence
  source 1..20: mol_type = other DNA
agctgaggcctggggatggg

SEQ ID NO: 92723 - DNA, 20 bp, synthetic construct
  misc_feature 1..20: note = CRISPR gRNA sequence
  source 1..20: mol_type = other DNA
gctgaggcctggggatggga

SEQ ID NO: 92724 - DNA, 20 bp, synthetic construct
  misc_feature 1..20: note = CRISPR gRNA sequence
  source 1..20: mol_type = other DNA
aggcctggggatgggaggtg

SEQ ID NO: 92725 - DNA, 20 bp, synthetic construct
  misc_feature 1..20: note = CRISPR gRNA sequence
  source 1..20: mol_type = other DNA
gggatgggaggtggaagaag

SEQ ID NO: 92726 - DNA, 20 bp, synthetic construct
  misc_feature 1..20: note = CRISPR gRNA sequence
  source 1..20: mol_type = other DNA
aacgcaaaccgcatctgcag

SEQ ID NO: 92727 - DNA, 20 bp, synthetic construct
  misc_feature 1..20: note = CRISPR gRNA sequence
  source 1..20: mol_type = other DNA
acgcaaaccgcatctgcagg

SEQ ID NO: 92728 - DNA, 20 bp, synthetic construct
  misc_feature 1..20: note = CRISPR gRNA sequence
  source 1..20: mol_type = other DNA
cagggcctgcctccccactt

SEQ ID NO: 92729 - DNA, 20 bp, synthetic construct
  misc_feature 1..20: note = CRISPR gRNA sequence
  source 1..20: mol_type = other DNA
cctccccacttccaaatggg

SEQ ID NO: 92730 - DNA, 20 bp, synthetic construct
  misc_feature 1..20: note = CRISPR gRNA sequence
  source 1..20: mol_type = other DNA
cccacttccaaatgggccgg

SEQ ID NO: 92731 - DNA, 20 bp, synthetic construct
  misc_feature 1..20: note = CRISPR gRNA sequence
  source 1..20: mol_type = other DNA
ccaaatgggccggtttgcag

SEQ ID NO: 92732 - DNA, 20 bp, synthetic construct
  misc_feature 1..20: note = CRISPR gRNA sequence
  source 1..20: mol_type = other DNA
caaatgggccggtttgcagt

SEQ ID NO: 92733 - DNA, 20 bp, synthetic construct
  misc_feature 1..20: note = CRISPR gRNA sequence
  source 1..20: mol_type = other DNA
gcagtgactgggttagtggt

SEQ ID NO: 92734 - DNA, 20 bp, synthetic construct
  misc_feature 1..20: note = CRISPR gRNA sequence
  source 1..20: mol_type = other DNA
cagtgactgggttagtggtt

SEQ ID NO: 92735 - DNA, 20 bp, synthetic construct
  misc_feature 1..20: note = CRISPR gRNA sequence
  source 1..20: mol_type = other DNA
ggttagtggttgagaattag

SEQ ID NO: 92736 - DNA, 20 bp, synthetic construct
  misc_feature 1..20: note = CRISPR gRNA sequence
  source 1..20: mol_type = other DNA
gtggttgagaattagagtgt

SEQ ID NO: 92737 - DNA, 20 bp, synthetic construct
  misc_feature 1..20: note = CRISPR gRNA sequence
  source 1..20: mol_type = other DNA
agaattagagtgtttgccct

SEQ ID NO: 92738 - DNA, 20 bp, synthetic construct
  misc_feature 1..20: note = CRISPR gRNA sequence
  source 1..20: mol_type = other DNA
gagtgtttgccctaaattaa

SEQ ID NO: 92739 - DNA, 20 bp, synthetic construct
  misc_feature 1..20: note = CRISPR gRNA sequence
  source 1..20: mol_type = other DNA
gccctaaattaaagtttata

SEQ ID NO: 92740 - DNA, 20 bp, synthetic construct
  misc_feature 1..20: note = CRISPR gRNA sequence
  source 1..20: mol_type = other DNA
ccctaaattaaagtttatac

SEQ ID NO: 92741 - DNA, 20 bp, synthetic construct
  misc_feature 1..20: note = CRISPR gRNA sequence
  source 1..20: mol_type = other DNA
aattaaagtttataccaaca

SEQ ID NO: 92742 - DNA, 20 bp, synthetic construct
  misc_feature 1..20: note = CRISPR gRNA sequence
  source 1..20: mol_type = other DNA
aagtttataccaacatgtgc

SEQ ID NO: 92743 - DNA, 20 bp, synthetic construct
  misc_feature 1..20: note = CRISPR gRNA sequence
  source 1..20: mol_type = other DNA
ataccaacatgtgcaaagca

SEQ ID NO: 92744 - DNA, 20 bp, synthetic construct
  misc_feature 1..20: note = CRISPR gRNA sequence
  source 1..20: mol_type = other DNA
taccaacatgtgcaaagcaa

SEQ ID NO: 92745 - DNA, 20 bp, synthetic construct
  misc_feature 1..20: note = CRISPR gRNA sequence
  source 1..20: mol_type = other DNA
tgttgaactcatgataggtg

SEQ ID NO: 92746 - DNA, 20 bp, synthetic construct
  misc_feature 1..20: note = CRISPR gRNA sequence
  source 1..20: mol_type = other DNA
ttgaactcatgataggtgca

SEQ ID NO: 92747 - DNA, 20 bp, synthetic construct
  misc_feature 1..20: note = CRISPR gRNA sequence
  source 1..20: mol_type = other DNA
aactcatgataggtgcagaa

SEQ ID NO: 92748 - DNA, 20 bp, synthetic construct
  misc_feature 1..20: note = CRISPR gRNA sequence
  source 1..20: mol_type = other DNA
atgataggtgcagaaatttc

SEQ ID NO: 92749 - DNA, 20 bp, synthetic construct
  misc_feature 1..20: note = CRISPR gRNA sequence
  source 1..20: mol_type = other DNA
cagtaaaaataatgtgacat

SEQ ID NO: 92750 - DNA, 20 bp, synthetic construct
  misc_feature 1..20: note = CRISPR gRNA sequence
  source 1..20: mol_type = other DNA
agtaaaaataatgtgacatc

SEQ ID NO: 92751 - DNA, 20 bp, synthetic construct
  misc_feature 1..20: note = CRISPR gRNA sequence
  source 1..20: mol_type = other DNA
tcatagatctgggatatggc

SEQ ID NO: 92752 - DNA, 20 bp, synthetic construct
  misc_feature 1..20: note = CRISPR gRNA sequence
  source 1..20: mol_type = other DNA
ggatatggctggaaggacat

SEQ ID NO: 92753 - DNA, 20 bp, synthetic construct
  misc_feature 1..20: note = CRISPR gRNA sequence
  source 1..20: mol_type = other DNA
gaaggacatagagtaaatga

SEQ ID NO: 92754 - DNA, 20 bp, synthetic construct
  misc_feature 1..20: note = CRISPR gRNA sequence
  source 1..20: mol_type = other DNA
gttcatcgctaaaggagact

SEQ ID NO: 92755 - DNA, 20 bp, synthetic construct
  misc_feature 1..20: note = CRISPR gRNA sequence
  source 1..20: mol_type = other DNA
atcgctaaaggagacttagg

SEQ ID NO: 92756 - DNA, 20 bp, synthetic construct
  misc_feature 1..20: note = CRISPR gRNA sequence
  source 1..20: mol_type = other DNA
aaggagacttaggaacctag

SEQ ID NO: 92757 - DNA, 20 bp, synthetic construct
  misc_feature 1..20: note = CRISPR gRNA sequence
  source 1..20: mol_type = other DNA
aggaacctagatgaagttgg

SEQ ID NO: 92758 - DNA, 20 bp, synthetic construct
  misc_feature 1..20: note = CRISPR gRNA sequence
  source 1..20: mol_type = other DNA
ggaacctagatgaagttggt

SEQ ID NO: 92759 - DNA, 20 bp, synthetic construct
  misc_feature 1..20: note = CRISPR gRNA sequence
  source 1..20: mol_type = other DNA
gatgaagttggtacttctga

SEQ ID NO: 92760 - DNA, 20 bp, synthetic construct
  misc_feature 1..20: note = CRISPR gRNA sequence
  source 1..20: mol_type = other DNA
gtacttctgagaaagtcatc

SEQ ID NO: 92761 - DNA, 20 bp, synthetic construct
  misc_feature 1..20: note = CRISPR gRNA sequence
  source 1..20: mol_type = other DNA
ctgagaaagtcatctctttc

SEQ ID NO: 92762 - DNA, 20 bp, synthetic construct
  misc_feature 1..20: note = CRISPR gRNA sequence
  source 1..20: mol_type = other DNA
tgagaaagtcatctctttct

SEQ ID NO: 92763 - DNA, 20 bp, synthetic construct
  misc_feature 1..20: note = CRISPR gRNA sequence
  source 1..20: mol_type = other DNA
agaaagtcatctctttctgt

SEQ ID NO: 92764 - DNA, 20 bp, synthetic construct
  misc_feature 1..20: note = CRISPR gRNA sequence
  source 1..20: mol_type = other DNA
tttctgttttcactactcta

SEQ ID NO: 92765 - DNA, 20 bp, synthetic construct
  misc_feature 1..20: note = CRISPR gRNA sequence
  source 1..20: mol_type = other DNA
tctgttttcactactctatt

SEQ ID NO: 92766 - DNA, 20 bp, synthetic construct
  misc_feature 1..20: note = CRISPR gRNA sequence
  source 1..20: mol_type = other DNA
ctgttttcactactctattc

SEQ ID NO: 92767 - DNA, 20 bp, synthetic construct
  misc_feature 1..20: note = CRISPR gRNA sequence
  source 1..20: mol_type = other DNA
tgttttcactactctattct

SEQ ID NO: 92768 - DNA, 20 bp, synthetic construct
  misc_feature 1..20: note = CRISPR gRNA sequence
  source 1..20: mol_type = other DNA
ttttcactactctattctca

SEQ ID NO: 92769 - DNA, 20 bp, synthetic construct
  misc_feature 1..20: note = CRISPR gRNA sequence
  source 1..20: mol_type = other DNA
tcactactctattctcagta

SEQ ID NO: 92770 - DNA, 20 bp, synthetic construct
  misc_feature 1..20: note = CRISPR gRNA sequence
  source 1..20: mol_type = other DNA
cactactctattctcagtat

SEQ ID NO: 92771 - DNA, 20 bp, synthetic construct
  misc_feature 1..20: note = CRISPR gRNA sequence
  source 1..20: mol_type = other DNA
actactctattctcagtatc

SEQ ID NO: 92772 - DNA, 20 bp, synthetic construct
  misc_feature 1..20: note = CRISPR gRNA sequence
  source 1..20: mol_type = other DNA
ctctattctcagtatccagt

SEQ ID NO: 92773 - DNA, 20 bp, synthetic construct
  misc_feature 1..20: note = CRISPR gRNA sequence
  source 1..20: mol_type = other DNA
tattctcagtatccagttct

SEQ ID NO: 92774 - DNA, 20 bp, synthetic construct
  misc_feature 1..20: note = CRISPR gRNA sequence
  source 1..20: mol_type = other DNA
ttctcagtatccagttctca

SEQ ID NO: 92775 - DNA, 20 bp, synthetic construct
  misc_feature 1..20: note = CRISPR gRNA sequence
  source 1..20: mol_type = other DNA
tcagtatccagttctcagta

SEQ ID NO: 92776 - DNA, 20 bp, synthetic construct
  misc_feature 1..20: note = CRISPR gRNA sequence
  source 1..20: mol_type = other DNA
agtatccagttctcagtacc

SEQ ID NO: 92777 - DNA, 20 bp, synthetic construct
  misc_feature 1..20: note = CRISPR gRNA sequence
  source 1..20: mol_type = other DNA
tcagtacccagttctcagta

SEQ ID NO: 92778 - DNA, 20 bp, synthetic construct
  misc_feature 1..20: note = CRISPR gRNA sequence
  source 1..20: mol_type = other DNA
agtacccagttctcagtacc

SEQ ID NO: 92779 - DNA, 20 bp, synthetic construct
  misc_feature 1..20: note = CRISPR gRNA sequence
  source 1..20: mol_type = other DNA
tcagtacctctatttgtaat

SEQ ID NO: 92780 - DNA, 20 bp, synthetic construct
  misc_feature 1..20: note = CRISPR gRNA sequence
  source 1..20: mol_type = other DNA
agtacctctatttgtaatac

SEQ ID NO: 92781 - DNA, 20 bp, synthetic construct
  misc_feature 1..20: note = CRISPR gRNA sequence
  source 1..20: mol_type = other DNA
tatttgtaatactcctgtat

SEQ ID NO: 92782 - DNA, 20 bp, synthetic construct
  misc_feature 1..20: note = CRISPR gRNA sequence
  source 1..20: mol_type = other DNA
tttgtaatactcctgtattt

SEQ ID NO: 92783 - DNA, 20 bp, synthetic construct
  misc_feature 1..20: note = CRISPR gRNA sequence
  source 1..20: mol_type = other DNA
gtaatactcctgtatttagt

SEQ ID NO: 92784 - DNA, 20 bp, synthetic construct
  misc_feature 1..20: note = CRISPR gRNA sequence
  source 1..20: mol_type = other DNA
taatactcctgtatttagta

SEQ ID NO: 92785 - DNA, 20 bp, synthetic construct
  misc_feature 1..20: note = CRISPR gRNA sequence
  source 1..20: mol_type = other DNA
ctgtatttagtactttgttt

SEQ ID NO: 92786 - DNA, 20 bp, synthetic construct
  misc_feature 1..20: note = CRISPR gRNA sequence
  source 1..20: mol_type = other DNA
tatttagtactttgttttta

SEQ ID NO: 92787 - DNA, 20 bp, synthetic construct
  misc_feature 1..20: note = CRISPR gRNA sequence
  source 1..20: mol_type = other DNA
agtactttgtttttagtgtc

SEQ ID NO: 92788 - DNA, 20 bp, synthetic construct
  misc_feature 1..20: note = CRISPR gRNA sequence
  source 1..20: mol_type = other DNA
gtactttgtttttagtgtcc

SEQ ID NO: 92789 - DNA, 20 bp, synthetic construct
  misc_feature 1..20: note = CRISPR gRNA sequence
  source 1..20: mol_type = other DNA
tgtttttagtgtcctgttct

SEQ ID NO: 92790 - DNA, 20 bp, synthetic construct
  misc_feature 1..20: note = CRISPR gRNA sequence
  source 1..20: mol_type = other DNA
gtttttagtgtcctgttctg

SEQ ID NO: 92791 - DNA, 20 bp, synthetic construct
  misc_feature 1..20: note = CRISPR gRNA sequence
  source 1..20: mol_type = other DNA
tttttagtgtcctgttctgt

SEQ ID NO: 92792 - DNA, 20 bp, synthetic construct
  misc_feature 1..20: note = CRISPR gRNA sequence
  source 1..20: mol_type = other DNA
ttagtgtcctgttctgttaa

SEQ ID NO: 92793 - DNA, 20 bp, synthetic construct
  misc_feature 1..20: note = CRISPR gRNA sequence
  source 1..20: mol_type = other DNA
tagtgtcctgttctgttaac

SEQ ID NO: 92794 - DNA, 20 bp, synthetic construct
  misc_feature 1..20: note = CRISPR gRNA sequence
  source 1..20: mol_type = other DNA
agtgtcctgttctgttaacc

SEQ ID NO: 92795 - DNA, 20 bp, synthetic construct
  misc_feature 1..20: note = CRISPR gRNA sequence
  source 1..20: mol_type = other DNA
gtgtcctgttctgttaaccc

SEQ ID NO: 92796 - DNA, 20 bp, synthetic construct
  misc_feature 1..20: note = CRISPR gRNA sequence
  source 1..20: mol_type = other DNA
ttctgttaaccctcttccta

SEQ ID NO: 92797 - DNA, 20 bp, synthetic construct
  misc_feature 1..20: note = CRISPR gRNA sequence
  source 1..20: mol_type = other DNA
tgttaaccctcttcctagta

SEQ ID NO: 92798 - DNA, 20 bp, synthetic construct
  misc_feature 1..20: note = CRISPR gRNA sequence
  source 1..20: mol_type = other DNA
ttaaccctcttcctagtacc

SEQ ID NO: 92799 - DNA, 20 bp, synthetic construct
  misc_feature 1..20: note = CRISPR gRNA sequence
  source 1..20: mol_type = other DNA
accctcttcctagtaccgta

SEQ ID NO: 92800 - DNA, 20 bp, synthetic construct
  misc_feature 1..20: note = CRISPR gRNA sequence
  source 1..20: mol_type = other DNA
ttcctagtaccgtattttta

SEQ ID NO: 92801 - DNA, 20 bp, synthetic construct
  misc_feature 1..20: note = CRISPR gRNA sequence
  source 1..20: mol_type = other DNA
cctagtaccgtatttttagt

SEQ ID NO: 92802 - DNA, 20 bp, synthetic construct
  misc_feature 1..20: note = CRISPR gRNA sequence
  source 1..20: mol_type = other DNA
ctagtaccgtatttttagta

SEQ ID NO: 92803 - DNA, 20 bp, synthetic construct
  misc_feature 1..20: note = CRISPR gRNA sequence
  source 1..20: mol_type = other DNA
gtaccgtatttttagtactg

SEQ ID NO: 92804 - DNA, 20 bp, synthetic construct
  misc_feature 1..20: note = CRISPR gRNA sequence
  source 1..20: mol_type = other DNA
ttagtactgctatactcagt

SEQ ID NO: 92805 - DNA, 20 bp, synthetic construct
  misc_feature 1..20: note = CRISPR gRNA sequence
  source 1..20: mol_type = other DNA
tagtactgctatactcagtt

SEQ ID NO: 92806 - DNA, 20 bp, synthetic construct
  misc_feature 1..20: note = CRISPR gRNA sequence
  source 1..20: mol_type = other DNA
agtactgctatactcagttg

SEQ ID NO: 92807 - DNA, 20 bp, synthetic construct
  misc_feature 1..20: note = CRISPR gRNA sequence
  source 1..20: mol_type = other DNA
gtactgctatactcagttgc

SEQ ID NO: 92808 - DNA, 20 bp, synthetic construct
  misc_feature 1..20: note = CRISPR gRNA sequence
  source 1..20: mol_type = other DNA
ctatactcagttgcctgtct

SEQ ID NO: 92809 - DNA, 20 bp, synthetic construct
  misc_feature 1..20: note = CRISPR gRNA sequence
  source 1..20: mol_type = other DNA
tactcagttgcctgtctgta

SEQ ID NO: 92810 - DNA, 20 bp, synthetic construct
  misc_feature 1..20: note = CRISPR gRNA sequence
  source 1..20: mol_type = other DNA
agttgcctgtctgtagtacc

SEQ ID NO: 92811 - DNA, 20 bp, synthetic construct
  misc_feature 1..20: note = CRISPR gRNA sequence
  source 1..20: mol_type = other DNA
cctgtctgtagtacccctgt

SEQ ID NO: 92812 - DNA, 20 bp, synthetic construct
  misc_feature 1..20: note = CRISPR gRNA sequence
  source 1..20: mol_type = other DNA
tctgtagtacccctgtacgt

SEQ ID NO: 92813 - DNA, 20 bp, synthetic construct
  misc_feature 1..20: note = CRISPR gRNA sequence
  source 1..20: mol_type = other DNA
tagtacccctgtacgtagta

SEQ ID NO: 92814 - DNA, 20 bp, synthetic construct
  misc_feature 1..20: note = CRISPR gRNA sequence
  source 1..20: mol_type = other DNA
tacgtagtactcttttctta

SEQ ID NO: 92815 - DNA, 20 bp, synthetic construct
  misc_feature 1..20: note = CRISPR gRNA sequence
  source 1..20: mol_type = other DNA
ttttcttacaactctgttcc

SEQ ID NO: 92816 - DNA, 20 bp, synthetic construct
  misc_feature 1..20: note = CRISPR gRNA sequence
  source 1..20: mol_type = other DNA
ttcttacaactctgttccca

SEQ ID NO: 92817 - DNA, 20 bp, synthetic construct
  misc_feature 1..20: note = CRISPR gRNA sequence
  source 1..20: mol_type = other DNA
tcttacaactctgttcccag

SEQ ID NO: 92818 - DNA, 20 bp, synthetic construct
  misc_feature 1..20: note = CRISPR gRNA sequence
  source 1..20: mol_type = other DNA
cttacaactctgttcccagt

SEQ ID NO: 92819 - DNA, 20 bp, synthetic construct
  misc_feature 1..20: note = CRISPR gRNA sequence
  source 1..20: mol_type = other DNA
ttacaactctgttcccagta

SEQ ID NO: 92820 - DNA, 20 bp, synthetic construct
  misc_feature 1..20: note = CRISPR gRNA sequence
  source 1..20: mol_type = other DNA
acaactctgttcccagtacc

SEQ ID NO: 92821 - DNA, 20 bp, synthetic construct
  misc_feature 1..20: note = CRISPR gRNA sequence
  source 1..20: mol_type = other DNA
caactctgttcccagtaccc

SEQ ID NO: 92822 - DNA, 20 bp, synthetic construct
  misc_feature 1..20: note = CRISPR gRNA sequence
  source 1..20: mol_type = other DNA
tgttcccagtacccctatgt

SEQ ID NO: 92823 - DNA, 20 bp, synthetic construct
  misc_feature 1..20: note = CRISPR gRNA sequence
  source 1..20: mol_type = other DNA
ttcccagtacccctatgttt

SEQ ID NO: 92824 - DNA, 20 bp, synthetic construct
  misc_feature 1..20: note = CRISPR gRNA sequence
  source 1..20: mol_type = other DNA
ccagtacccctatgtttagt

SEQ ID NO: 92825 - DNA, 20 bp, synthetic construct
  misc_feature 1..20: note = CRISPR gRNA sequence
  source 1..20: mol_type = other DNA
tgtttagtcccttgttctca

SEQ ID NO: 92826 - DNA, 20 bp, synthetic construct
  misc_feature 1..20: note = CRISPR gRNA sequence
  source 1..20: mol_type = other DNA
agtcccttgttctcatgttc

SEQ ID NO: 92827 - DNA, 20 bp, synthetic construct
  misc_feature 1..20: note = CRISPR gRNA sequence
  source 1..20: mol_type = other DNA
gtcccttgttctcatgttct

SEQ ID NO: 92828 - DNA, 20 bp, synthetic construct
  misc_feature 1..20: note = CRISPR gRNA sequence
  source 1..20: mol_type = other DNA
gttctcatgttctcactacc

SEQ ID NO: 92829 - DNA, 20 bp, synthetic construct
  misc_feature 1..20: note = CRISPR gRNA sequence
  source 1..20: mol_type = other DNA
ttctcatgttctcactaccc

SEQ ID NO: 92830 - DNA, 20 bp, synthetic construct
  misc_feature 1..20: note = CRISPR gRNA sequence
  source 1..20: mol_type = other DNA
tcatgttctcactaccccaa

SEQ ID NO: 92831 - DNA, 20 bp, synthetic construct
  misc_feature 1..20: note = CRISPR gRNA sequence
  source 1..20: mol_type = other DNA
atgttctcactaccccaata

SEQ ID NO: 92832 - DNA, 20 bp, synthetic construct
  misc_feature 1..20: note = CRISPR gRNA sequence
  source 1..20: mol_type = other DNA
tcactaccccaatacttaat

SEQ ID NO: 92833 - DNA, 20 bp, synthetic construct
  misc_feature 1..20: note = CRISPR gRNA sequence
  source 1..20: mol_type = other DNA
actaccccaatacttaatat

SEQ ID NO: 92834 - DNA, 20 bp, synthetic construct
  misc_feature 1..20: note = CRISPR gRNA sequence
  source 1..20: mol_type = other DNA
ccccaatacttaatatactt

SEQ ID NO: 92835 - DNA, 20 bp, synthetic construct
  misc_feature 1..20: note = CRISPR gRNA sequence
  source 1..20: mol_type = other DNA
aatatactttgttctcagta

SEQ ID NO: 92836 - DNA, 20 bp, synthetic construct
  misc_feature 1..20: note = CRISPR gRNA sequence
  source 1..20: mol_type = other DNA
atatactttgttctcagtat

SEQ ID NO: 92837 - DNA, 20 bp, synthetic construct
  misc_feature 1..20: note = CRISPR gRNA sequence
  source 1..20: mol_type = other DNA
tgttctcagtatccttgttg

SEQ ID NO: 92838 - DNA, 20 bp, synthetic construct
  misc_feature 1..20: note = CRISPR gRNA sequence
  source 1..20: mol_type = other DNA
gttctcagtatccttgttgt

SEQ ID NO: 92839 - DNA, 20 bp, synthetic construct
  misc_feature 1..20: note = CRISPR gRNA sequence
  source 1..20: mol_type = other DNA
ttctcagtatccttgttgtt

SEQ ID NO: 92840 - DNA, 20 bp, synthetic construct
  misc_feature 1..20: note = CRISPR gRNA sequence
  source 1..20: mol_type = other DNA
tcagtatccttgttgttagt

SEQ ID NO: 92841 - DNA, 20 bp, synthetic construct
  misc_feature 1..20: note = CRISPR gRNA sequence
  source 1..20: mol_type = other DNA
agtatccttgttgttagtac

SEQ ID NO: 92842 - DNA, 20 bp, synthetic construct
  misc_feature 1..20: note = CRISPR gRNA sequence
  source 1..20: mol_type = other DNA
gttgttagtaccctgttctc

SEQ ID NO: 92843 - DNA, 20 bp, synthetic construct
  misc_feature 1..20: note = CRISPR gRNA sequence
  source 1..20: mol_type = other DNA
ttgttagtaccctgttctca

SEQ ID NO: 92844 - DNA, 20 bp, synthetic construct
  misc_feature 1..20: note = CRISPR gRNA sequence
  source 1..20: mol_type = other DNA
ttagtaccctgttctcacta

SEQ ID NO: 92845 - DNA, 20 bp, synthetic construct
  misc_feature 1..20: note = CRISPR gRNA sequence
  source 1..20: mol_type = other DNA
gtaccctgttctcactaccc

SEQ ID NO: 92846 - DNA, 20 bp, synthetic construct
  misc_feature 1..20: note = CRISPR gRNA sequence
  source 1..20: mol_type = other DNA
ttctcactaccccttttctt

SEQ ID NO: 92847 - DNA, 20 bp, synthetic construct
  misc_feature 1..20: note = CRISPR gRNA sequence
  source 1..20: mol_type = other DNA
tcactaccccttttcttagt

SEQ ID NO: 92848 - DNA, 20 bp, synthetic construct
  misc_feature 1..20: note = CRISPR gRNA sequence
  source 1..20: mol_type = other DNA
actaccccttttcttagtac

SEQ ID NO: 92849 - DNA, 20 bp, synthetic construct
  misc_feature 1..20: note = CRISPR gRNA sequence
  source 1..20: mol_type = other DNA
ccccttttcttagtacccct

SEQ ID NO: 92850 - DNA, 20 bp, synthetic construct
  misc_feature 1..20: note = CRISPR gRNA sequence
  source 1..20: mol_type = other DNA
ttcttagtacccctgagggg

SEQ ID NO: 92851 - DNA, 20 bp, synthetic construct
  misc_feature 1..20: note = CRISPR gRNA sequence
  source 1..20: mol_type = other DNA
tcttagtacccctgaggggg

SEQ ID NO: 92852 - DNA, 20 bp, synthetic construct
  misc_feature 1..20: note = CRISPR gRNA sequence
  source 1..20: mol_type = other DNA
cttagtacccctgagggggg

SEQ ID NO: 92853 - DNA, 20 bp, synthetic construct
  misc_feature 1..20: note = CRISPR gRNA sequence
  source 1..20: mol_type = other DNA
ttagtacccctgagggggga

SEQ ID NO: 92854 - DNA, 20 bp, synthetic construct
  misc_feature 1..20: note = CRISPR gRNA sequence
  source 1..20: mol_type = other DNA
agtacccctgaggggggaaa

SEQ ID NO: 92855 - DNA, 20 bp, synthetic construct
  misc_feature 1..20: note = CRISPR gRNA sequence
  source 1..20: mol_type = other DNA
gtacccctgaggggggaaaa

SEQ ID NO: 92856 - DNA, 20 bp, synthetic construct
  misc_feature 1..20: note = CRISPR gRNA sequence
  source 1..20: mol_type = other DNA
aggggggaaaaaaaggatga

SEQ ID NO: 92857 - DNA, 20 bp, synthetic construct
  misc_feature 1..20: note = CRISPR gRNA sequence
  source 1..20: mol_type = other DNA
aaaaaacttttggattgttt

SEQ ID NO: 92858 - DNA, 20 bp, synthetic construct
  misc_feature 1..20: note = CRISPR gRNA sequence
  source 1..20: mol_type = other DNA
ttggattgtttgatttgaac

SEQ ID NO: 92859 - DNA, 20 bp, synthetic construct
  misc_feature 1..20: note = CRISPR gRNA sequence
  source 1..20: mol_type = other DNA
tggattgtttgatttgaact

SEQ ID NO: 92860 - DNA, 20 bp, synthetic construct
  misc_feature 1..20: note = CRISPR gRNA sequence
  source 1..20: mol_type = other DNA
ggattgtttgatttgaactg

SEQ ID NO: 92861 - DNA, 20 bp, synthetic construct
  misc_feature 1..20: note = CRISPR gRNA sequence
  source 1..20: mol_type = other DNA
gattgtttgatttgaactga

SEQ ID NO: 92862 - DNA, 20 bp, synthetic construct
  misc_feature 1..20: note = CRISPR gRNA sequence
  source 1..20: mol_type = other DNA
tttgatttgaactgagtcaa

SEQ ID NO: 92863 - DNA, 20 bp, synthetic construct
  misc_feature 1..20: note = CRISPR gRNA sequence
  source 1..20: mol_type = other DNA
gatttgaactgagtcaaagg

SEQ ID NO: 92864 - DNA, 20 bp, synthetic construct
  misc_feature 1..20: note = CRISPR gRNA sequence
  source 1..20: mol_type = other DNA
atttgaactgagtcaaaggt

SEQ ID NO: 92865 - DNA, 20 bp, synthetic construct
  misc_feature 1..20: note = CRISPR gRNA sequence
  source 1..20: mol_type = other DNA
gaactgagtcaaaggtaaaa

SEQ ID NO: 92866 - DNA, 20 bp, synthetic construct
  misc_feature 1..20: note = CRISPR gRNA sequence
  source 1..20: mol_type = other DNA
aactgagtcaaaggtaaaac

SEQ ID NO: 92867 - DNA, 20 bp, synthetic construct
  misc_feature 1..20: note = CRISPR gRNA sequence
  source 1..20: mol_type = other DNA
agtcaaaggtaaaaccagtg

SEQ ID NO: 92868 - DNA, 20 bp, synthetic construct
  misc_feature 1..20: note = CRISPR gRNA sequence
  source 1..20: mol_type = other DNA
tggagttcgacttctgggtg

SEQ ID NO: 92869 - DNA, 20 bp, synthetic construct
  misc_feature 1..20: note = CRISPR gRNA sequence
  source 1..20: mol_type = other DNA
gagttcgacttctgggtgca

SEQ ID NO: 92870 - DNA, 20 bp, synthetic construct
  misc_feature 1..20: note = CRISPR gRNA sequence
  source 1..20: mol_type = other DNA
gacttctgggtgcaaatccc

SEQ ID NO: 92871 - DNA, 20 bp, synthetic construct
  misc_feature 1..20: note = CRISPR gRNA sequence
  source 1..20: mol_type = other DNA
ctgggtgcaaatccctgttg

SEQ ID NO: 92872 - DNA, 20 bp, synthetic construct
  misc_feature 1..20: note = CRISPR gRNA sequence
  source 1..20: mol_type = other DNA
tgggtgcaaatccctgttgc

SEQ ID NO: 92873 - DNA, 20 bp, synthetic construct
  misc_feature 1..20: note = CRISPR gRNA sequence
  source 1..20: mol_type = other DNA
ggtgcaaatccctgttgcat

SEQ ID NO: 92874 - DNA, 20 bp, synthetic construct
  misc_feature 1..20: note = CRISPR gRNA sequence
  source 1..20: mol_type = other DNA
ttgcatcatttactggcctt

SEQ ID NO: 92875 - DNA, 20 bp, synthetic construct
  misc_feature 1..20: note = CRISPR gRNA sequence
  source 1..20: mol_type = other DNA
catcatttactggccttgtg

SEQ ID NO: 92876 - DNA, 20 bp, synthetic construct
  misc_feature 1..20: note = CRISPR gRNA sequence
  source 1..20: mol_type = other DNA
actggccttgtggcttgaat

SEQ ID NO: 92877 - DNA, 20 bp, synthetic construct
  misc_feature 1..20: note = CRISPR gRNA sequence
  source 1..20: mol_type = other DNA
ctggccttgtggcttgaata

SEQ ID NO: 92878 - DNA, 20 bp, synthetic construct
  misc_feature 1..20: note = CRISPR gRNA sequence
  source 1..20: mol_type = other DNA
gccttgtggcttgaataggt

SEQ ID NO: 92879 - DNA, 20 bp, synthetic construct
  misc_feature 1..20: note = CRISPR gRNA sequence
  source 1..20: mol_type = other DNA
gtggcttgaataggttatta

SEQ ID NO: 92880 - DNA, 20 bp, synthetic construct
  misc_feature 1..20: note = CRISPR gRNA sequence
  source 1..20: mol_type = other DNA
tggcttgaataggttattaa

SEQ ID NO: 92881 - DNA, 20 bp, synthetic construct
  misc_feature 1..20: note = CRISPR gRNA sequence
  source 1..20: mol_type = other DNA
gaataggttattaaactctg

SEQ ID NO: 92882 - DNA, 20 bp, synthetic construct
  misc_feature 1..20: note = CRISPR gRNA sequence
  source 1..20: mol_type = other DNA
aataggttattaaactctgt

SEQ ID NO: 92883 - DNA, 20 bp, synthetic construct
  misc_feature 1..20: note = CRISPR gRNA sequence
  source 1..20: mol_type = other DNA
ttaaactctgtaaaatgggc

SEQ ID NO: 92884 - DNA, 20 bp, synthetic construct
  misc_feature 1..20: note = CRISPR gRNA sequence
  source 1..20: mol_type = other DNA
aactctgtaaaatgggcatt

SEQ ID NO: 92885 - DNA, 20 bp, synthetic construct
  misc_feature 1..20: note = CRISPR gRNA sequence
  source 1..20: mol_type = other DNA
tgtaaaatgggcattaaaat

SEQ ID NO: 92886 - DNA, 20 bp, synthetic construct
  misc_feature 1..20: note = CRISPR gRNA sequence
  source 1..20: mol_type = other DNA
taaaatgggcattaaaatcg

SEQ ID NO: 92887 - DNA, 20 bp, synthetic construct
  misc_feature 1..20: note = CRISPR gRNA sequence
  source 1..20: mol_type = other DNA
aaatcgtgtgtcattcatag

SEQ ID NO: 92888 - DNA, 20 bp, synthetic construct
  misc_feature 1..20: note = CRISPR gRNA sequence
  source 1..20: mol_type = other DNA
atagtgttgctgtgaatatg

SEQ ID NO: 92889 - DNA, 20 bp, synthetic construct
  misc_feature 1..20: note = CRISPR gRNA sequence
  source 1..20: mol_type = other DNA
ctgtgaatatgtgagccatt

SEQ ID NO: 92890 - DNA, 20 bp, synthetic construct
  misc_feature 1..20: note = CRISPR gRNA sequence
  source 1..20: mol_type = other DNA
tgaatatgtgagccattcca

SEQ ID NO: 92891 - DNA, 20 bp, synthetic construct
  misc_feature 1..20: note = CRISPR gRNA sequence
  source 1..20: mol_type = other DNA
catattgagggttcacacag

SEQ ID NO: 92892 - DNA, 20 bp, synthetic construct
  misc_feature 1..20: note = CRISPR gRNA sequence
  source 1..20: mol_type = other DNA
agggttcacacagtgtccag

SEQ ID NO: 92893 - DNA, 20 bp, synthetic construct
  misc_feature 1..20: note = CRISPR gRNA sequence
  source 1..20: mol_type = other DNA
acacagtgtccagcaactgg

SEQ ID NO: 92894 - DNA, 20 bp, synthetic construct
  misc_feature 1..20: note = CRISPR gRNA sequence
  source 1..20: mol_type = other DNA
gctaaagtttgcaaacctta

SEQ ID NO: 92895 - DNA, 20 bp, synthetic construct
  misc_feature 1..20: note = CRISPR gRNA sequence
  source 1..20: mol_type = other DNA
aagtttgcaaaccttaccca

SEQ ID NO: 92896 - DNA, 20 bp, synthetic construct
  misc_feature 1..20: note = CRISPR gRNA sequence
  source 1..20: mol_type = other DNA
gcaaaccttacccattatta

SEQ ID NO: 92897 - DNA, 20 bp, synthetic construct
  misc_feature 1..20: note = CRISPR gRNA sequence
  source 1..20: mol_type = other DNA
caaaccttacccattattat

SEQ ID NO: 92898 - DNA, 20 bp, synthetic construct
  misc_feature 1..20: note = CRISPR gRNA sequence
  source 1..20: mol_type = other DNA
acccattattattgtcattg

SEQ ID NO: 92899 - DNA, 20 bp, synthetic construct
  misc_feature 1..20: note = CRISPR gRNA sequence
  source 1..20: mol_type = other DNA
cccattattattgtcattgt

SEQ ID NO: 92900 - DNA, 20 bp, synthetic construct
  misc_feature 1..20: note = CRISPR gRNA sequence
  source 1..20: mol_type = other DNA
ttattgtcattgttagtggt

SEQ ID NO: 92901 - DNA, 20 bp, synthetic construct
  misc_feature 1..20: note = CRISPR gRNA sequence
  source 1..20: mol_type = other DNA
ttgtcattgttagtggtata

SEQ ID NO: 92902 - DNA, 20 bp, synthetic construct
  misc_feature 1..20: note = CRISPR gRNA sequence
  source 1..20: mol_type = other DNA
tcattgttagtggtatactt

SEQ ID NO: 92903 - DNA, 20 bp, synthetic construct
  misc_feature 1..20: note = CRISPR gRNA sequence
  source 1..20: mol_type = other DNA
ttagtggtatactttgaggc

SEQ ID NO: 92904 - DNA, 20 bp, synthetic construct
  misc_feature 1..20: note = CRISPR gRNA sequence
  source 1..20: mol_type = other DNA
gtggtatactttgaggctgt

SEQ ID NO: 92905 - DNA, 20 bp, synthetic construct
  misc_feature 1..20: note = CRISPR gRNA sequence
  source 1..20: mol_type = other DNA
tgaggctgtcacaaataagc

SEQ ID NO: 92906 - DNA, 20 bp, synthetic construct
  misc_feature 1..20: note = CRISPR gRNA sequence
  source 1..20: mol_type = other DNA
gaggctgtcacaaataagca

SEQ ID NO: 92907 - DNA, 20 bp, synthetic construct
  misc_feature 1..20: note = CRISPR gRNA sequence
  source 1..20: mol_type = other DNA
aggctgtcacaaataagcag

SEQ ID NO: 92908 - DNA, 20 bp, synthetic construct
  misc_feature 1..20: note = CRISPR gRNA sequence
  source 1..20: mol_type = other DNA
tcacaaataagcagatattt

SEQ ID NO: 92909 - DNA, 20 bp, synthetic construct
  misc_feature 1..20: note = CRISPR gRNA sequence
  source 1..20: mol_type = other DNA
cttcttgtgagagctatata

SEQ ID NO: 92910 - DNA, 20 bp, synthetic construct
  misc_feature 1..20: note = CRISPR gRNA sequence
  source 1..20: mol_type = other DNA
ttcttgtgagagctatataa

SEQ ID NO: 92911 - DNA, 20 bp, synthetic construct
  misc_feature 1..20: note = CRISPR gRNA sequence
  source 1..20: mol_type = other DNA
cttgtgagagctatataatc

SEQ ID NO: 92912 - DNA, 20 bp, synthetic construct
  misc_feature 1..20: note = CRISPR gRNA sequence
  source 1..20: mol_type = other DNA
ttgtgagagctatataatcc

SEQ ID NO: 92913 - DNA, 20 bp, synthetic construct
  misc_feature 1..20: note = CRISPR gRNA sequence
  source 1..20: mol_type = other DNA
gtgagagctatataatccct

SEQ ID NO: 92914 - DNA, 20 bp, synthetic construct
  misc_feature 1..20: note = CRISPR gRNA sequence
  source 1..20: mol_type = other DNA
tgagagctatataatccctt

SEQ ID NO: 92915 - DNA, 20 bp, synthetic construct
  misc_feature 1..20: note = CRISPR gRNA sequence
  source 1..20: mol_type = other DNA
tataatcccttagtgtagag

SEQ ID NO: 92916 - DNA, 20 bp, synthetic construct
  misc_feature 1..20: note = CRISPR gRNA sequence
  source 1..20: mol_type = other DNA
agtgtagagaaaaatttaat

SEQ ID NO: 92917 - DNA, 20 bp, synthetic construct
  misc_feature 1..20: note = CRISPR gRNA sequence
  source 1..20: mol_type = other DNA
gtgtagagaaaaatttaatt

SEQ ID NO: 92918 - DNA, 20 bp, synthetic construct
  misc_feature 1..20: note = CRISPR gRNA sequence
  source 1..20: mol_type = other DNA
aattttgttacaagtgatcc

SEQ ID NO: 92919 - DNA, 20 bp, synthetic construct
  misc_feature 1..20: note = CRISPR gRNA sequence
  source 1..20: mol_type = other DNA
attttgttacaagtgatcca

SEQ ID NO: 92920 - DNA, 20 bp, synthetic construct
  misc_feature 1..20: note = CRISPR gRNA sequence
  source 1..20: mol_type = other DNA
tgttacaagtgatccaagcc

SEQ ID NO: 92921 - DNA, 20 bp, synthetic construct
  misc_feature 1..20: note = CRISPR gRNA sequence
  source 1..20: mol_type = other DNA
gttacaagtgatccaagcca

SEQ ID NO: 92922 - DNA, 20 bp, synthetic construct
  misc_feature 1..20: note = CRISPR gRNA sequence
  source 1..20: mol_type = other DNA
ttacaagtgatccaagccag

SEQ ID NO: 92923 - DNA, 20 bp, synthetic construct
  misc_feature 1..20: note = CRISPR gRNA sequence
  source 1..20: mol_type = other DNA
caagtgatccaagccaggta

SEQ ID NO: 92924 - DNA, 20 bp, synthetic construct
  misc_feature 1..20: note = CRISPR gRNA sequence
  source 1..20: mol_type = other DNA
tatacccagctgtacttggg

SEQ ID NO: 92925 - DNA, 20 bp, synthetic construct
  misc_feature 1..20: note = CRISPR gRNA sequence
  source 1..20: mol_type = other DNA
tacttgggagggtgaagtgg

SEQ ID NO: 92926 - DNA, 20 bp, synthetic construct
  misc_feature 1..20: note = CRISPR gRNA sequence
  source 1..20: mol_type = other DNA
gggagggtgaagtgggaaga

SEQ ID NO: 92927 - DNA, 20 bp, synthetic construct
  misc_feature 1..20: note = CRISPR gRNA sequence
  source 1..20: mol_type = other DNA
ggagggtgaagtgggaagat

SEQ ID NO: 92928 - DNA, 20 bp, synthetic construct
  misc_feature 1..20: note = CRISPR gRNA sequence
  source 1..20: mol_type = other DNA
cttgagaccaggggttcgag

SEQ ID NO: 92929 - DNA, 20 bp, synthetic construct
  misc_feature 1..20: note = CRISPR gRNA sequence
  source 1..20: mol_type = other DNA
gagaccaggggttcgaggct

SEQ ID NO: 92930 - DNA, 20 bp, synthetic construct
  misc_feature 1..20: note = CRISPR gRNA sequence
  source 1..20: mol_type = other DNA
agaccaggggttcgaggctg

SEQ ID NO: 92931 - DNA, 20 bp, synthetic construct
  misc_feature 1..20: note = CRISPR gRNA sequence
  source 1..20: mol_type = other DNA
gaggctgccgtgagccttgt

SEQ ID NO: 92932 - DNA, 20 bp, synthetic construct
  misc_feature 1..20: note = CRISPR gRNA sequence
  source 1..20: mol_type = other DNA
ccgtgagccttgtttgcatc

SEQ ID NO: 92933 - DNA, 20 bp, synthetic construct
  misc_feature 1..20: note = CRISPR gRNA sequence
  source 1..20: mol_type = other DNA
gtttgcatcactgcattcca

SEQ ID NO: 92934 - DNA, 20 bp, synthetic construct
  misc_feature 1..20: note = CRISPR gRNA sequence
  source 1..20: mol_type = other DNA
tttgcatcactgcattccag

SEQ ID NO: 92935 - DNA, 20 bp, synthetic construct
  misc_feature 1..20: note = CRISPR gRNA sequence
  source 1..20: mol_type = other DNA
gcatcactgcattccagcct

SEQ ID NO: 92936 - DNA, 20 bp, synthetic construct
  misc_feature 1..20: note = CRISPR gRNA sequence
  source 1..20: mol_type = other DNA
catcactgcattccagcctg

SEQ ID NO: 92937 - DNA, 20 bp, synthetic construct
  misc_feature 1..20: note = CRISPR gRNA sequence
  source 1..20: mol_type = other DNA
cattccagcctggatgacat

SEQ ID NO: 92938 - DNA, 20 bp, synthetic construct
  misc_feature 1..20: note = CRISPR gRNA sequence
  source 1..20: mol_type = other DNA
cagcctggatgacatagcaa

SEQ ID NO: 92939 - DNA, 20 bp, synthetic construct
  misc_feature 1..20: note = CRISPR gRNA sequence
  source 1..20: mol_type = other DNA
gatgacatagcaagaccctg

SEQ ID NO: 92940 - DNA, 20 bp, synthetic construct
  misc_feature 1..20: note = CRISPR gRNA sequence
  source 1..20: mol_type = other DNA
tctccttaaaaaaaaaaaaa

SEQ ID NO: 92941 - DNA, 20 bp, synthetic construct
  misc_feature 1..20: note = CRISPR gRNA sequence
  source 1..20: mol_type = other DNA
cttaaaaaaaaaaaaaaaaa

SEQ ID NO: 92942 - DNA, 20 bp, synthetic construct
  misc_feature 1..20: note = CRISPR gRNA sequence
  source 1..20: mol_type = other DNA
aaaaaaaaaaaaaaaaaaaa

SEQ ID NO: 92943 - DNA, 20 bp, synthetic construct
  misc_feature 1..20: note = CRISPR gRNA sequence
  source 1..20: mol_type = other DNA
aaaaaaaaaaaaaaaaaaaa

SEQ ID NO: 92944 - DNA, 20 bp, synthetic construct
  misc_feature 1..20: note = CRISPR gRNA sequence
  source 1..20: mol_type = other DNA
tttttaactgcaagctgtct

SEQ ID NO: 92945 - DNA, 20 bp, synthetic construct
  misc_feature 1..20: note = CRISPR gRNA sequence
  source 1..20: mol_type = other DNA
ttttaactgcaagctgtctt

SEQ ID NO: 92946 - DNA, 20 bp, synthetic construct
  misc_feature 1..20: note = CRISPR gRNA sequence
  source 1..20: mol_type = other DNA
tttaactgcaagctgtctta

SEQ ID NO: 92947 - DNA, 20 bp, synthetic construct
  misc_feature 1..20: note = CRISPR gRNA sequence
  source 1..20: mol_type = other DNA
ttaactgcaagctgtcttag

SEQ ID NO: 92948 - DNA, 20 bp, synthetic construct
  misc_feature 1..20: note = CRISPR gRNA sequence
  source 1..20: mol_type = other DNA
taactgcaagctgtcttagg

SEQ ID NO: 92949 - DNA, 20 bp, synthetic construct
  misc_feature 1..20: note = CRISPR gRNA sequence
  source 1..20: mol_type = other DNA
aactgcaagctgtcttaggg

SEQ ID NO: 92950 - DNA, 20 bp, synthetic construct
  misc_feature 1..20: note = CRISPR gRNA sequence
  source 1..20: mol_type = other DNA
actgcaagctgtcttagggt

SEQ ID NO: 92951 - DNA, 20 bp, synthetic construct
  misc_feature 1..20: note = CRISPR gRNA sequence
  source 1..20: mol_type = other DNA
caagctgtcttagggtccta

SEQ ID NO: 92952 - DNA, 20 bp, synthetic construct
  misc_feature 1..20: note = CRISPR gRNA sequence
  source 1..20: mol_type = other DNA
tcttagggtcctaggatgta

SEQ ID NO: 92953 - DNA, 20 bp, synthetic construct
  misc_feature 1..20: note = CRISPR gRNA sequence
  source 1..20: mol_type = other DNA
agggtcctaggatgtattct

SEQ ID NO: 92954 - DNA, 20 bp, synthetic construct
  misc_feature 1..20: note = CRISPR gRNA sequence
  source 1..20: mol_type = other DNA
gggtcctaggatgtattcta

SEQ ID NO: 92955 - DNA, 20 bp, synthetic construct
  misc_feature 1..20: note = CRISPR gRNA sequence
  source 1..20: mol_type = other DNA
ggatgtattctaagtcttta

SEQ ID NO: 92956 - DNA, 20 bp, synthetic construct
  misc_feature 1..20: note = CRISPR gRNA sequence
  source 1..20: mol_type = other DNA
taagtctttaaatttcttag

SEQ ID NO: 92957 - DNA, 20 bp, synthetic construct
  misc_feature 1..20: note = CRISPR gRNA sequence
  source 1..20: mol_type = other DNA
agtctttaaatttcttagtt

SEQ ID NO: 92958 - DNA, 20 bp, synthetic construct
  misc_feature 1..20: note = CRISPR gRNA sequence
  source 1..20: mol_type = other DNA
taaatttcttagtttcaggc

SEQ ID NO: 92959 - DNA, 20 bp, synthetic construct
  misc_feature 1..20: note = CRISPR gRNA sequence
  source 1..20: mol_type = other DNA
aaatttcttagtttcaggct

SEQ ID NO: 92960 - DNA, 20 bp, synthetic construct
  misc_feature 1..20: note = CRISPR gRNA sequence
  source 1..20: mol_type = other DNA
aatttcttagtttcaggctg

SEQ ID NO: 92961 - DNA, 20 bp, synthetic construct
  misc_feature 1..20: note = CRISPR gRNA sequence
  source 1..20: mol_type = other DNA
cttagtttcaggctgaactt

SEQ ID NO: 92962 - DNA, 20 bp, synthetic construct
  misc_feature 1..20: note = CRISPR gRNA sequence
  source 1..20: mol_type = other DNA
ttagtttcaggctgaacttg

SEQ ID NO: 92963 - DNA, 20 bp, synthetic construct
  misc_feature 1..20: note = CRISPR gRNA sequence
  source 1..20: mol_type = other DNA
agtttcaggctgaacttgaa

SEQ ID NO: 92964 - DNA, 20 bp, synthetic construct
  misc_feature 1..20: note = CRISPR gRNA sequence
  source 1..20: mol_type = other DNA
gtttcaggctgaacttgaag

SEQ ID NO: 92965 - DNA, 20 bp, synthetic construct
  misc_feature 1..20: note = CRISPR gRNA sequence
  source 1..20: mol_type = other DNA
caggctgaacttgaagtgct

SEQ ID NO: 92966 - DNA, 20 bp, synthetic construct
  misc_feature 1..20: note = CRISPR gRNA sequence
  source 1..20: mol_type = other DNA
aggctgaacttgaagtgctc

SEQ ID NO: 92967 - DNA, 20 bp, synthetic construct
  misc_feature 1..20: note = CRISPR gRNA sequence
  source 1..20: mol_type = other DNA
aacttgaagtgctccatcac

SEQ ID NO: 92968 - DNA, 20 bp, synthetic construct
  misc_feature 1..20: note = CRISPR gRNA sequence
  source 1..20: mol_type = other DNA
gaagtgctccatcactaaaa

SEQ ID NO: 92969 - DNA, 20 bp, synthetic construct
  misc_feature 1..20: note = CRISPR gRNA sequence
  source 1..20: mol_type = other DNA
aagtgctccatcactaaaat

SEQ ID NO: 92970 - DNA, 20 bp, synthetic construct
  misc_feature 1..20: note = CRISPR gRNA sequence
  source 1..20: mol_type = other DNA
catcactaaaatattagacc

SEQ ID NO: 92971 - DNA, 20 bp, synthetic construct
  misc_feature 1..20: note = CRISPR gRNA sequence
  source 1..20: mol_type = other DNA
aaatattagaccttgtaatt

SEQ ID NO: 92972 - DNA, 20 bp, synthetic construct
  misc_feature 1..20: note = CRISPR gRNA sequence
  source 1..20: mol_type = other DNA
gaccttgtaattgtttacaa

SEQ ID NO: 92973 - DNA, 20 bp, synthetic construct
  misc_feature 1..20: note = CRISPR gRNA sequence
  source 1..20: mol_type = other DNA
gtaattgtttacaaatgtaa

SEQ ID NO: 92974 - DNA, 20 bp, synthetic construct
  misc_feature 1..20: note = CRISPR gRNA sequence
  source 1..20: mol_type = other DNA
taattgtttacaaatgtaat

SEQ ID NO: 92975 - DNA, 20 bp, synthetic construct
  misc_feature 1..20: note = CRISPR gRNA sequence
  source 1..20: mol_type = other DNA
tttacaaatgtaatgttcta

SEQ ID NO: 92976 - DNA, 20 bp, synthetic construct
  misc_feature 1..20: note = CRISPR gRNA sequence
  source 1..20: mol_type = other DNA
acaaatgtaatgttctaggc

SEQ ID NO: 92977 - DNA, 20 bp, synthetic construct
  misc_feature 1..20: note = CRISPR gRNA sequence
  source 1..20: mol_type = other DNA
caaatgtaatgttctaggcc

SEQ ID NO: 92978 - DNA, 20 bp, synthetic construct
  misc_feature 1..20: note = CRISPR gRNA sequence
  source 1..20: mol_type = other DNA
taggccaggctcagtggcta

SEQ ID NO: 92979 - DNA, 20 bp, synthetic construct
  misc_feature 1..20: note = CRISPR gRNA sequence
  source 1..20: mol_type = other DNA
ggccaggctcagtggctaat

SEQ ID NO: 92980 - DNA, 20 bp, synthetic construct
  misc_feature 1..20: note = CRISPR gRNA sequence
  source 1..20: mol_type = other DNA
agtggctaatacctgtaagc

SEQ ID NO: 92981 - DNA, 20 bp, synthetic construct
  misc_feature 1..20: note = CRISPR gRNA sequence
  source 1..20: mol_type = other DNA
atacctgtaagcccagaact

SEQ ID NO: 92982 - DNA, 20 bp, synthetic construct
  misc_feature 1..20: note = CRISPR gRNA sequence
  source 1..20: mol_type = other DNA
taagcccagaacttggggag

SEQ ID NO: 92983 - DNA, 20 bp, synthetic construct
  misc_feature 1..20: note = CRISPR gRNA sequence
  source 1..20: mol_type = other DNA
ggggaggcctaggagggagg

SEQ ID NO: 92984 - DNA, 20 bp, synthetic construct
  misc_feature 1..20: note = CRISPR gRNA sequence
  source 1..20: mol_type = other DNA
gggaggcctaggagggagga

SEQ ID NO: 92985 - DNA, 20 bp, synthetic construct
  misc_feature 1..20: note = CRISPR gRNA sequence
  source 1..20: mol_type = other DNA
ggagggaggatcgcttgagc

SEQ ID NO: 92986 - DNA, 20 bp, synthetic construct
  misc_feature 1..20: note = CRISPR gRNA sequence
  source 1..20: mol_type = other DNA
gagcccggaagtttgagacc

SEQ ID NO: 92987 - DNA, 20 bp, synthetic construct
  misc_feature 1..20: note = CRISPR gRNA sequence
  source 1..20: mol_type = other DNA
agcccggaagtttgagacca

SEQ ID NO: 92988 - DNA, 20 bp, synthetic construct
  misc_feature 1..20: note = CRISPR gRNA sequence
  source 1..20: mol_type = other DNA
gagaccagcctgggtaacat

SEQ ID NO: 92989 - DNA, 20 bp, synthetic construct
  misc_feature 1..20: note = CRISPR gRNA sequence
  source 1..20: mol_type = other DNA
agaccagcctgggtaacata

SEQ ID NO: 92990 - DNA, 20 bp, synthetic construct
  misc_feature 1..20: note = CRISPR gRNA sequence
  source 1..20: mol_type = other DNA
ggtaacatagggagacccca

SEQ ID NO: 92991 - DNA, 20 bp, synthetic construct
  misc_feature 1..20: note = CRISPR gRNA sequence
  source 1..20: mol_type = other DNA
aacaaaaaaattttaaaaat

SEQ ID NO: 92992 - DNA, 20 bp, synthetic construct
  misc_feature 1..20: note = CRISPR gRNA sequence
  source 1..20: mol_type = other DNA
taaaaattagccaggtatgt

SEQ ID NO: 92993 - DNA, 20 bp, synthetic construct
  misc_feature 1..20: note = CRISPR gRNA sequence
  source 1..20: mol_type = other DNA
aaaaattagccaggtatgtt

SEQ ID NO: 92994 - DNA, 20 bp, synthetic construct
  misc_feature 1..20: note = CRISPR gRNA sequence
  source 1..20: mol_type = other DNA
aaaattagccaggtatgttg

SEQ ID NO: 92995 - DNA, 20 bp, synthetic construct
  misc_feature 1..20: note = CRISPR gRNA sequence
  source 1..20: mol_type = other DNA
gccaggtatgttggcacatg

SEQ ID NO: 92996 - DNA, 20 bp, synthetic construct
  misc_feature 1..20: note = CRISPR gRNA sequence
  source 1..20: mol_type = other DNA
gcacatgcctgtggtcctag

SEQ ID NO: 92997 - DNA, 20 bp, synthetic construct
  misc_feature 1..20: note = CRISPR gRNA sequence
  source 1..20: mol_type = other DNA
tggtcctagctactcgggag

SEQ ID NO: 92998 - DNA, 20 bp, synthetic construct
  misc_feature 1..20: note = CRISPR gRNA sequence
  source 1..20: mol_type = other DNA
gctactcgggaggctgaggt

SEQ ID NO: 92999 - DNA, 20 bp, synthetic construct
  misc_feature 1..20: note = CRISPR gRNA sequence
  source 1..20: mol_type = other DNA
ctcgggaggctgaggtggaa

SEQ ID NO: 93000 - DNA, 20 bp, synthetic construct
  misc_feature 1..20: note = CRISPR gRNA sequence
  source 1..20: mol_type = other DNA
gggaggctgaggtggaagga

SEQ ID NO: 93001 - DNA, 20 bp, synthetic construct
  misc_feature 1..20: note = CRISPR gRNA sequence
  source 1..20: mol_type = other DNA
aggtggaaggatcattgagc

SEQ ID NO: 93002 - DNA, 20 bp, synthetic construct
  misc_feature 1..20: note = CRISPR gRNA sequence
  source 1..20: mol_type = other DNA
agcccaggagattgaggctg

SEQ ID NO: 93003 - DNA, 20 bp, synthetic construct
  misc_feature 1..20: note = CRISPR gRNA sequence
  source 1..20: mol_type = other DNA
aggctgcagtgagccatggt

SEQ ID NO: 93004 - DNA, 20 bp, synthetic construct
  misc_feature 1..20: note = CRISPR gRNA sequence
  source 1..20: mol_type = other DNA
cagtgagccatggttgtgct

SEQ ID NO: 93005 - DNA, 20 bp, synthetic construct
  misc_feature 1..20: note = CRISPR gRNA sequence
  source 1..20: mol_type = other DNA
tgctacttcactccagcctg

SEQ ID NO: 93006 - DNA, 20 bp, synthetic construct
  misc_feature 1..20: note = CRISPR gRNA sequence
  source 1..20: mol_type = other DNA
cttcactccagcctgggtga

SEQ ID NO: 93007 - DNA, 20 bp, synthetic construct
  misc_feature 1..20: note = CRISPR gRNA sequence
  source 1..20: mol_type = other DNA
cactccagcctgggtgacag

SEQ ID NO: 93008 - DNA, 20 bp, synthetic construct
  misc_feature 1..20: note = CRISPR gRNA sequence
  source 1..20: mol_type = other DNA
actccagcctgggtgacaga

SEQ ID NO: 93009 - DNA, 20 bp, synthetic construct
  misc_feature 1..20: note = CRISPR gRNA sequence
  source 1..20: mol_type = other DNA
cagcctgggtgacagagcaa

SEQ ID NO: 93010 - DNA, 20 bp, synthetic construct
  misc_feature 1..20: note = CRISPR gRNA sequence
  source 1..20: mol_type = other DNA
ggtgacagagcaagactttg

SEQ ID NO: 93011 - DNA, 20 bp, synthetic construct
  misc_feature 1..20: note = CRISPR gRNA sequence
  source 1..20: mol_type = other DNA
tgtctcaaaaacaaaaagta

SEQ ID NO: 93012 - DNA, 20 bp, synthetic construct
  misc_feature 1..20: note = CRISPR gRNA sequence
  source 1..20: mol_type = other DNA
gtctcaaaaacaaaaagtat

SEQ ID NO: 93013 - DNA, 20 bp, synthetic construct
  misc_feature 1..20: note = CRISPR gRNA sequence
  source 1..20: mol_type = other DNA
tctcaaaaacaaaaagtata

SEQ ID NO: 93014 - DNA, 20 bp, synthetic construct
  misc_feature 1..20: note = CRISPR gRNA sequence
  source 1..20: mol_type = other DNA
aaaaacaaaaagtataatat

SEQ ID NO: 93015 - DNA, 20 bp, synthetic construct
  misc_feature 1..20: note = CRISPR gRNA sequence
  source 1..20: mol_type = other DNA
taaatatttctaaaatttgc

SEQ ID NO: 93016 - DNA, 20 bp, synthetic construct
  misc_feature 1..20: note = CRISPR gRNA sequence
  source 1..20: mol_type = other DNA
aatatttctaaaatttgcag

SEQ ID NO: 93017 - DNA, 20 bp, synthetic construct
  misc_feature 1..20: note = CRISPR gRNA sequence
  source 1..20: mol_type = other DNA
ctaaaatttgcagttgccag

SEQ ID NO: 93018 - DNA, 20 bp, synthetic construct
  misc_feature 1..20: note = CRISPR gRNA sequence
  source 1..20: mol_type = other DNA
taaaatttgcagttgccagt

SEQ ID NO: 93019 - DNA, 20 bp, synthetic construct
  misc_feature 1..20: note = CRISPR gRNA sequence
  source 1..20: mol_type = other DNA
aaatttgcagttgccagtgt

SEQ ID NO: 93020 - DNA, 20 bp, synthetic construct
  misc_feature 1..20: note = CRISPR gRNA sequence
  source 1..20: mol_type = other DNA
gcagttgccagtgtgtcata

SEQ ID NO: 93021 - DNA, 20 bp, synthetic construct
  misc_feature 1..20: note = CRISPR gRNA sequence
  source 1..20: mol_type = other DNA
cagttgccagtgtgtcatac

SEQ ID NO: 93022 - DNA, 20 bp, synthetic construct
  misc_feature 1..20: note = CRISPR gRNA sequence
  source 1..20: mol_type = other DNA
ccagtgtgtcatacttaatt

SEQ ID NO: 93023 - DNA, 20 bp, synthetic construct
  misc_feature 1..20: note = CRISPR gRNA sequence
  source 1..20: mol_type = other DNA
aattcacactggttaggact

SEQ ID NO: 93024 - DNA, 20 bp, synthetic construct
  misc_feature 1..20: note = CRISPR gRNA sequence
  source 1..20: mol_type = other DNA
attcacactggttaggactg

SEQ ID NO: 93025 - DNA, 20 bp, synthetic construct
  misc_feature 1..20: note = CRISPR gRNA sequence
  source 1..20: mol_type = other DNA
acactggttaggactgagtg

SEQ ID NO: 93026 - DNA, 20 bp, synthetic construct
  misc_feature 1..20: note = CRISPR gRNA sequence
  source 1..20: mol_type = other DNA
gttaggactgagtgacttct

SEQ ID NO: 93027 - DNA, 20 bp, synthetic construct
  misc_feature 1..20: note = CRISPR gRNA sequence
  source 1..20: mol_type = other DNA
ggactgagtgacttctcttt

SEQ ID NO: 93028 - DNA, 20 bp, synthetic construct
  misc_feature 1..20: note = CRISPR gRNA sequence
  source 1..20: mol_type = other DNA
agtgacttctctttccctta

SEQ ID NO: 93029 - DNA, 20 bp, synthetic construct
  misc_feature 1..20: note = CRISPR gRNA sequence
  source 1..20: mol_type = other DNA
ctctttcccttaagttttac

SEQ ID NO: 93030 - DNA, 20 bp, synthetic construct
  misc_feature 1..20: note = CRISPR gRNA sequence
  source 1..20: mol_type = other DNA
tctttcccttaagttttact

SEQ ID NO: 93031 - DNA, 20 bp, synthetic construct
  misc_feature 1..20: note = CRISPR gRNA sequence
  source 1..20: mol_type = other DNA
tttcccttaagttttactct

SEQ ID NO: 93032 - DNA, 20 bp, synthetic construct
  misc_feature 1..20: note = CRISPR gRNA sequence
  source 1..20: mol_type = other DNA
tcccttaagttttactcttt

SEQ ID NO: 93033 - DNA, 20 bp, synthetic construct
  misc_feature 1..20: note = CRISPR gRNA sequence
  source 1..20: mol_type = other DNA
cccttaagttttactctttt

SEQ ID NO: 93034 - DNA, 20 bp, synthetic construct
  misc_feature 1..20: note = CRISPR gRNA sequence
  source 1..20: mol_type = other DNA
ccttaagttttactcttttg

SEQ ID NO: 93035 - DNA, 20 bp, synthetic construct
  misc_feature 1..20: note = CRISPR gRNA sequence
  source 1..20: mol_type = other DNA
aagttttactcttttggagt

SEQ ID NO: 93036 - DNA, 20 bp, synthetic construct
  misc_feature 1..20: note = CRISPR gRNA sequence
  source 1..20: mol_type = other DNA
agttttactcttttggagta

SEQ ID NO: 93037 - DNA, 20 bp, synthetic construct
  misc_feature 1..20: note = CRISPR gRNA sequence
  source 1..20: mol_type = other DNA
tactcttttggagtaagagg

SEQ ID NO: 93038 - DNA, 20 bp, synthetic construct
  misc_feature 1..20: note = CRISPR gRNA sequence
  source 1..20: mol_type = other DNA
actcttttggagtaagagga

SEQ ID NO: 93039 - DNA, 20 bp, synthetic construct
  misc_feature 1..20: note = CRISPR gRNA sequence
  source 1..20: mol_type = other DNA
ctcttttggagtaagaggac

SEQ ID NO: 93040 - DNA, 20 bp, synthetic construct
  misc_feature 1..20: note = CRISPR gRNA sequence
  source 1..20: mol_type = other DNA
ttttggagtaagaggacttc

SEQ ID NO: 93041 - DNA, 20 bp, synthetic construct
  misc_feature 1..20: note = CRISPR gRNA sequence
  source 1..20: mol_type = other DNA
ttggagtaagaggacttctt

SEQ ID NO: 93042 - DNA, 20 bp, synthetic construct
  misc_feature 1..20: note = CRISPR gRNA sequence
  source 1..20: mol_type = other DNA
tggagtaagaggacttcttt

SEQ ID NO: 93043 - DNA, 20 bp, synthetic construct
  misc_feature 1..20: note = CRISPR gRNA sequence
  source 1..20: mol_type = other DNA
ggagtaagaggacttctttg

SEQ ID NO: 93044 - DNA, 20 bp, synthetic construct
  misc_feature 1..20: note = CRISPR gRNA sequence
  source 1..20: mol_type = other DNA
gagtaagaggacttctttga

SEQ ID NO: 93045 - DNA, 20 bp, synthetic construct
  misc_feature 1..20: note = CRISPR gRNA sequence
  source 1..20: mol_type = other DNA
ctttgagggtctggtgactt

SEQ ID NO: 93046 - DNA, 20 bp, synthetic construct
  misc_feature 1..20: note = CRISPR gRNA sequence
  source 1..20: mol_type = other DNA
tttgagggtctggtgactta

SEQ ID NO: 93047 - DNA, 20 bp, synthetic construct
  misc_feature 1..20: note = CRISPR gRNA sequence
  source 1..20: mol_type = other DNA
tgagggtctggtgacttaat

SEQ ID NO: 93048 - DNA, 20 bp, synthetic construct
  misc_feature 1..20: note = CRISPR gRNA sequence
  source 1..20: mol_type = other DNA
gagggtctggtgacttaatg

SEQ ID NO: 93049 - DNA, 20 bp, synthetic construct
  misc_feature 1..20: note = CRISPR gRNA sequence
  source 1..20: mol_type = other DNA
agggtctggtgacttaatga

SEQ ID NO: 93050 - DNA, 20 bp, synthetic construct
  misc_feature 1..20: note = CRISPR gRNA sequence
  source 1..20: mol_type = other DNA
gtgacttaatgaagactctt

SEQ ID NO: 93051 - DNA, 20 bp, synthetic construct
  misc_feature 1..20: note = CRISPR gRNA sequence
  source 1..20: mol_type = other DNA
aatgaagactcttcctagaa

SEQ ID NO: 93052 - DNA, 20 bp, synthetic construct
  misc_feature 1..20: note = CRISPR gRNA sequence
  source 1..20: mol_type = other DNA
atgaagactcttcctagaaa

SEQ ID NO: 93053 - DNA, 20 bp, synthetic construct
  misc_feature 1..20: note = CRISPR gRNA sequence
  source 1..20: mol_type = other DNA
ttcctagaaaaatccactat

SEQ ID NO: 93054 - DNA, 20 bp, synthetic construct
  misc_feature 1..20: note = CRISPR gRNA sequence
  source 1..20: mol_type = other DNA
cctagaaaaatccactatgt

SEQ ID NO: 93055 - DNA, 20 bp, synthetic construct
  misc_feature 1..20: note = CRISPR gRNA sequence
  source 1..20: mol_type = other DNA
ctagaaaaatccactatgta

SEQ ID NO: 93056 - DNA, 20 bp, synthetic construct
  misc_feature 1..20: note = CRISPR gRNA sequence
  source 1..20: mol_type = other DNA
gaaaaatccactatgtaact

SEQ ID NO: 93057 - DNA, 20 bp, synthetic construct
  misc_feature 1..20: note = CRISPR gRNA sequence
  source 1..20: mol_type = other DNA
tgtaactttaattttgcata

SEQ ID NO: 93058 - DNA, 20 bp, synthetic construct
  misc_feature 1..20: note = CRISPR gRNA sequence
  source 1..20: mol_type = other DNA
taattttgcatactaattaa

SEQ ID NO: 93059 - DNA, 20 bp, synthetic construct
  misc_feature 1..20: note = CRISPR gRNA sequence
  source 1..20: mol_type = other DNA
aattttgcatactaattaat

SEQ ID NO: 93060 - DNA, 20 bp, synthetic construct
  misc_feature 1..20: note = CRISPR gRNA sequence
  source 1..20: mol_type = other DNA
attttgcatactaattaatg

SEQ ID NO: 93061 - DNA, 20 bp, synthetic construct
  misc_feature 1..20: note = CRISPR gRNA sequence
  source 1..20: mol_type = other DNA
tgcatactaattaatgggct

SEQ ID NO: 93062 - DNA, 20 bp, synthetic construct
  misc_feature 1..20: note = CRISPR gRNA sequence
  source 1..20: mol_type = other DNA
gcatactaattaatgggctc

SEQ ID NO: 93063 - DNA, 20 bp, synthetic construct
  misc_feature 1..20: note = CRISPR gRNA sequence
  source 1..20: mol_type = other DNA
catactaattaatgggctca

SEQ ID NO: 93064 - DNA, 20 bp, synthetic construct
  misc_feature 1..20: note = CRISPR gRNA sequence
  source 1..20: mol_type = other DNA
attaatgggctcaggacttc

SEQ ID NO: 93065 - DNA, 20 bp, synthetic construct
  misc_feature 1..20: note = CRISPR gRNA sequence
  source 1..20: mol_type = other DNA
atgggctcaggacttctgta

SEQ ID NO: 93066 - DNA, 20 bp, synthetic construct
  misc_feature 1..20: note = CRISPR gRNA sequence
  source 1..20: mol_type = other DNA
aggacttctgtaatcttagt

SEQ ID NO: 93067 - DNA, 20 bp, synthetic construct
  misc_feature 1..20: note = CRISPR gRNA sequence
  source 1..20: mol_type = other DNA
ctgtaatcttagtttaaaaa

SEQ ID NO: 93068 - DNA, 20 bp, synthetic construct
  misc_feature 1..20: note = CRISPR gRNA sequence
  source 1..20: mol_type = other DNA
tgtaatcttagtttaaaaac

SEQ ID NO: 93069 - DNA, 20 bp, synthetic construct
  misc_feature 1..20: note = CRISPR gRNA sequence
  source 1..20: mol_type = other DNA
taatcttagtttaaaaaccc

SEQ ID NO: 93070 - DNA, 20 bp, synthetic construct
  misc_feature 1..20: note = CRISPR gRNA sequence
  source 1..20: mol_type = other DNA
agtttaaaaaccccctcaat

SEQ ID NO: 93071 - DNA, 20 bp, synthetic construct
  misc_feature 1..20: note = CRISPR gRNA sequence
  source 1..20: mol_type = other DNA
gtttaaaaaccccctcaatc

SEQ ID NO: 93072 - DNA, 20 bp, synthetic construct
  misc_feature 1..20: note = CRISPR gRNA sequence
  source 1..20: mol_type = other DNA
aaaaaccccctcaatccata

SEQ ID NO: 93073 - DNA, 20 bp, synthetic construct
  misc_feature 1..20: note = CRISPR gRNA sequence
  source 1..20: mol_type = other DNA
aaaaccccctcaatccatat

SEQ ID NO: 93074 - DNA, 20 bp, synthetic construct
  misc_feature 1..20: note = CRISPR gRNA sequence
  source 1..20: mol_type = other DNA
aatccatattcttatagtat

SEQ ID NO: 93075 - DNA, 20 bp, synthetic construct
  misc_feature 1..20: note = CRISPR gRNA sequence
  source 1..20: mol_type = other DNA
ttatagtatgttttaccaaa

SEQ ID NO: 93076 - DNA, 20 bp, synthetic construct
  misc_feature 1..20: note = CRISPR gRNA sequence
  source 1..20: mol_type = other DNA
atagtatgttttaccaaatc

SEQ ID NO: 93077 - DNA, 20 bp, synthetic construct
  misc_feature 1..20: note = CRISPR gRNA sequence
  source 1..20: mol_type = other DNA
tagtatgttttaccaaatct

SEQ ID NO: 93078 - DNA, 20 bp, synthetic construct
  misc_feature 1..20: note = CRISPR gRNA sequence
  source 1..20: mol_type = other DNA
taccaaatctctgattacgg

SEQ ID NO: 93079 - DNA, 20 bp, synthetic construct
  misc_feature 1..20: note = CRISPR gRNA sequence
  source 1..20: mol_type = other DNA
accaaatctctgattacggg

SEQ ID NO: 93080 - DNA, 20 bp, synthetic construct
  misc_feature 1..20: note = CRISPR gRNA sequence
  source 1..20: mol_type = other DNA
ccaaatctctgattacgggg

SEQ ID NO: 93081 - DNA, 20 bp, synthetic construct
  misc_feature 1..20: note = CRISPR gRNA sequence
  source 1..20: mol_type = other DNA
tgattacggggatttaggga

SEQ ID NO: 93082 - DNA, 20 bp, synthetic construct
  misc_feature 1..20: note = CRISPR gRNA sequence
  source 1..20: mol_type = other DNA
attacggggatttagggaaa

SEQ ID NO: 93083 - DNA, 20 bp, synthetic construct
  misc_feature 1..20: note = CRISPR gRNA sequence
  source 1..20: mol_type = other DNA
cggggatttagggaaataag

SEQ ID NO: 93084 - DNA, 20 bp, synthetic construct
  misc_feature 1..20: note = CRISPR gRNA sequence
  source 1..20: mol_type = other DNA
agggaaataagcatctggaa

SEQ ID NO: 93085 - DNA, 20 bp, synthetic construct
  misc_feature 1..20: note = CRISPR gRNA sequence
  source 1..20: mol_type = other DNA
gggaaataagcatctggaaa

SEQ ID NO: 93086 - DNA, 20 bp, synthetic construct
  misc_feature 1..20: note = CRISPR gRNA sequence
  source 1..20: mol_type = other DNA
gaaaagaatgaaagttagta

SEQ ID NO: 93087 - DNA, 20 bp, synthetic construct
  misc_feature 1..20: note = CRISPR gRNA sequence
  source 1..20: mol_type = other DNA
gtaaaggtgatcaagtttct

SEQ ID NO: 93088 - DNA, 20 bp, synthetic construct
  misc_feature 1..20: note = CRISPR gRNA sequence
  source 1..20: mol_type = other DNA
cttcctcagtatgttccaca

SEQ ID NO: 93089 - DNA, 20 bp, synthetic construct
  misc_feature 1..20: note = CRISPR gRNA sequence
  source 1..20: mol_type = other DNA
ttcctcagtatgttccacag

SEQ ID NO: 93090 - DNA, 20 bp, synthetic construct
  misc_feature 1..20: note = CRISPR gRNA sequence
  source 1..20: mol_type = other DNA
cctcagtatgttccacaggt

SEQ ID NO: 93091 - DNA, 20 bp, synthetic construct
  misc_feature 1..20: note = CRISPR gRNA sequence
  source 1..20: mol_type = other DNA
ctcagtatgttccacaggtg

SEQ ID NO: 93092 - DNA, 20 bp, synthetic construct
  misc_feature 1..20: note = CRISPR gRNA sequence
  source 1..20: mol_type = other DNA
agtatgttccacaggtgccc

SEQ ID NO: 93093 - DNA, 20 bp, synthetic construct
  misc_feature 1..20: note = CRISPR gRNA sequence
  source 1..20: mol_type = other DNA
cacaggtgcccattcacttc

SEQ ID NO: 93094 - DNA, 20 bp, synthetic construct
  misc_feature 1..20: note = CRISPR gRNA sequence
  source 1..20: mol_type = other DNA
acttcagaattctttagaga

SEQ ID NO: 93095 - DNA, 20 bp, synthetic construct
  misc_feature 1..20: note = CRISPR gRNA sequence
  source 1..20: mol_type = other DNA
cagaattctttagagaggga

SEQ ID NO: 93096 - DNA, 20 bp, synthetic construct
  misc_feature 1..20: note = CRISPR gRNA sequence
  source 1..20: mol_type = other DNA
agaattctttagagagggag

SEQ ID NO: 93097 - DNA, 20 bp, synthetic construct
  misc_feature 1..20: note = CRISPR gRNA sequence
  source 1..20: mol_type = other DNA
tttagagagggagaaaaata

SEQ ID NO: 93098 - DNA, 20 bp, synthetic construct
  misc_feature 1..20: note = CRISPR gRNA sequence
  source 1..20: mol_type = other DNA
tagagagggagaaaaataat

SEQ ID NO: 93099 - DNA, 20 bp, synthetic construct
  misc_feature 1..20: note = CRISPR gRNA sequence
  source 1..20: mol_type = other DNA
agagagggagaaaaataata

SEQ ID NO: 93100 - DNA, 20 bp, synthetic construct
  misc_feature 1..20: note = CRISPR gRNA sequence
  source 1..20: mol_type = other DNA
gagagggagaaaaataatac

SEQ ID NO: 93101 - DNA, 20 bp, synthetic construct
  misc_feature 1..20: note = CRISPR gRNA sequence
  source 1..20: mol_type = other DNA
tttttctttctttttttttt

SEQ ID NO: 93102 - DNA, 20 bp, synthetic construct
  misc_feature 1..20: note = CRISPR gRNA sequence
  source 1..20: mol_type = other DNA
ttttctttcttttttttttt

SEQ ID NO: 93103 - DNA, 20 bp, synthetic construct
  misc_feature 1..20: note = CRISPR gRNA sequence
  source 1..20: mol_type = other DNA
tttctttctttttttttttt

SEQ ID NO: 93104 - DNA, 20 bp, synthetic construct
  misc_feature 1..20: note = CRISPR gRNA sequence
  source 1..20: mol_type = other DNA
ttctttcttttttttttttg

SEQ ID NO: 93105 - DNA, 20 bp, synthetic construct
  misc_feature 1..20: note = CRISPR gRNA sequence
  source 1..20: mol_type = other DNA
tctttcttttttttttttga

SEQ ID NO: 93106 - DNA, 20 bp, synthetic construct
  misc_feature 1..20: note = CRISPR gRNA sequence
  source 1..20: mol_type = other DNA
ctttcttttttttttttgag

SEQ ID NO: 93107 - DNA, 20 bp, synthetic construct
  misc_feature 1..20: note = CRISPR gRNA sequence
  source 1..20: mol_type = other DNA
tttcttttttttttttgaga

SEQ ID NO: 93108 - DNA, 20 bp, synthetic construct
  misc_feature 1..20: note = CRISPR gRNA sequence
  source 1..20: mol_type = other DNA
tcttttttttttttgagaca

SEQ ID NO: 93109 - DNA, 20 bp, synthetic construct
  misc_feature 1..20: note = CRISPR gRNA sequence
  source 1..20: mol_type = other DNA
cttttttttttttgagacag

SEQ ID NO: 93110 - DNA, 20 bp, synthetic construct
  misc_feature 1..20: note = CRISPR gRNA sequence
  source 1..20: mol_type = other DNA
ttttttttttttgagacaga

SEQ ID NO: 93111 - DNA, 20 bp, synthetic construct
  misc_feature 1..20: note = CRISPR gRNA sequence
  source 1..20: mol_type = other DNA
ttttttttttgagacagagt

SEQ ID NO: 93112 - DNA, 20 bp, synthetic construct
  misc_feature 1..20: note = CRISPR gRNA sequence
  source 1..20: mol_type = other DNA
tttttttttgagacagagtc

SEQ ID NO: 93113 - DNA, 20 bp, synthetic construct
  misc_feature 1..20: note = CRISPR gRNA sequence
  source 1..20: mol_type = other DNA
ttttttttgagacagagtct

SEQ ID NO: 93114 - DNA, 20 bp, synthetic construct
  misc_feature 1..20: note = CRISPR gRNA sequence
  source 1..20: mol_type = other DNA
tttttttgagacagagtctt

SEQ ID NO: 93115 - DNA, 20 bp, synthetic construct
  misc_feature 1..20: note = CRISPR gRNA sequence
  source 1..20: mol_type = other DNA
ttttttgagacagagtctta

SEQ ID NO: 93116 - DNA, 20 bp, synthetic construct
  misc_feature 1..20: note = CRISPR gRNA sequence
  source 1..20: mol_type = other DNA
tttttgagacagagtcttac

SEQ ID NO: 93117 - DNA, 20 bp, synthetic construct
  misc_feature 1..20: note = CRISPR gRNA sequence
  source 1..20: mol_type = other DNA
ttttgagacagagtcttact

SEQ ID NO: 93118 - DNA, 20 bp, synthetic construct
  misc_feature 1..20: note = CRISPR gRNA sequence
  source 1..20: mol_type = other DNA
tttgagacagagtcttactc

SEQ ID NO: 93119 - DNA, 20 bp, synthetic construct
  misc_feature 1..20: note = CRISPR gRNA sequence
  source 1..20: mol_type = other DNA
ttgagacagagtcttactct

SEQ ID NO: 93120 - DNA, 20 bp, synthetic construct
  misc_feature 1..20: note = CRISPR gRNA sequence
  source 1..20: mol_type = other DNA
tgagacagagtcttactctg

SEQ ID NO: 93121 - DNA, 20 bp, synthetic construct
  misc_feature 1..20: note = CRISPR gRNA sequence
  source 1..20: mol_type = other DNA
gagacagagtcttactctgt

SEQ ID NO: 93122 - DNA, 20 bp, synthetic construct
  misc_feature 1..20: note = CRISPR gRNA sequence
  source 1..20: mol_type = other DNA
agacagagtcttactctgtg

SEQ ID NO: 93123 - DNA, 20 bp, synthetic construct
  misc_feature 1..20: note = CRISPR gRNA sequence
  source 1..20: mol_type = other DNA
actctgtgtcgctcaggctg

SEQ ID NO: 93124 - DNA, 20 bp, synthetic construct
  misc_feature 1..20: note = CRISPR gRNA sequence
  source 1..20: mol_type = other DNA
ctctgtgtcgctcaggctgg

SEQ ID NO: 93125 - DNA, 20 bp, synthetic construct
  misc_feature 1..20: note = CRISPR gRNA sequence
  source 1..20: mol_type = other DNA
tgtgtcgctcaggctggagt

SEQ ID NO: 93126 - DNA, 20 bp, synthetic construct
  misc_feature 1..20: note = CRISPR gRNA sequence
  source 1..20: mol_type = other DNA
tgtcgctcaggctggagtgc

SEQ ID NO: 93127 - DNA, 20 bp, synthetic construct
  misc_feature 1..20: note = CRISPR gRNA sequence
  source 1..20: mol_type = other DNA
aggctggagtgcagtggtgc

SEQ ID NO: 93128 - DNA, 20 bp, synthetic construct
  misc_feature 1..20: note = CRISPR gRNA sequence
  source 1..20: mol_type = other DNA
gagtgcagtggtgcgatctc

SEQ ID NO: 93129 - DNA, 20 bp, synthetic construct
  misc_feature 1..20: note = CRISPR gRNA sequence
  source 1..20: mol_type = other DNA
ggcccactacaacctccacc

SEQ ID NO: 93130 - DNA, 20 bp, synthetic construct
  misc_feature 1..20: note = CRISPR gRNA sequence
  source 1..20: mol_type = other DNA
caacctccacctcctgggtt

SEQ ID NO: 93131 - DNA, 20 bp, synthetic construct
  misc_feature 1..20: note = CRISPR gRNA sequence
  source 1..20: mol_type = other DNA
cacctcctgggttcaagcag

SEQ ID NO: 93132 - DNA, 20 bp, synthetic construct
  misc_feature 1..20: note = CRISPR gRNA sequence
  source 1..20: mol_type = other DNA
ctgggttcaagcagttcttg

SEQ ID NO: 93133 - DNA, 20 bp, synthetic construct
  misc_feature 1..20: note = CRISPR gRNA sequence
  source 1..20: mol_type = other DNA
ggttcaagcagttcttgtgc

SEQ ID NO: 93134 - DNA, 20 bp, synthetic construct
  misc_feature 1..20: note = CRISPR gRNA sequence
  source 1..20: mol_type = other DNA
aagcagttcttgtgcctcag

SEQ ID NO: 93135 - DNA, 20 bp, synthetic construct
  misc_feature 1..20: note = CRISPR gRNA sequence
  source 1..20: mol_type = other DNA
ttgtgcctcagcctcctgag

SEQ ID NO: 93136 - DNA, 20 bp, synthetic construct
  misc_feature 1..20: note = CRISPR gRNA sequence
  source 1..20: mol_type = other DNA
gtgcctcagcctcctgagta

SEQ ID NO: 93137 - DNA, 20 bp, synthetic construct
  misc_feature 1..20: note = CRISPR gRNA sequence
  source 1..20: mol_type = other DNA
tgcctcagcctcctgagtag

SEQ ID NO: 93138 - DNA, 20 bp, synthetic construct
  misc_feature 1..20: note = CRISPR gRNA sequence
  source 1..20: mol_type = other DNA
agcctcctgagtagctggga

SEQ ID NO: 93139 - DNA, 20 bp, synthetic construct
  misc_feature 1..20: note = CRISPR gRNA sequence
  source 1..20: mol_type = other DNA
ctgagtagctgggattacag

SEQ ID NO: 93140 - DNA, 20 bp, synthetic construct
  misc_feature 1..20: note = CRISPR gRNA sequence
  source 1..20: mol_type = other DNA
agtagctgggattacaggca

SEQ ID NO: 93141 - DNA, 20 bp, synthetic construct
  misc_feature 1..20: note = CRISPR gRNA sequence
  source 1..20: mol_type = other DNA
ggattacaggcatgcaccac

SEQ ID NO: 93142 - DNA, 20 bp, synthetic construct
  misc_feature 1..20: note = CRISPR gRNA sequence
  source 1..20: mol_type = other DNA
caggcatgcaccaccacgcc

SEQ ID NO: 93143 - DNA, 20 bp, synthetic construct
  misc_feature 1..20: note = CRISPR gRNA sequence
  source 1..20: mol_type = other DNA
atttttgtatttttagtaga

SEQ ID NO: 93144 - DNA, 20 bp, synthetic construct
  misc_feature 1..20: note = CRISPR gRNA sequence
  source 1..20: mol_type = other DNA
ttgtatttttagtagagacg

SEQ ID NO: 93145 - DNA, 20 bp, synthetic construct
  misc_feature 1..20: note = CRISPR gRNA sequence
  source 1..20: mol_type = other DNA
tgtatttttagtagagacgc

SEQ ID NO: 93146 - DNA, 20 bp, synthetic construct
  misc_feature 1..20: note = CRISPR gRNA sequence
  source 1..20: mol_type = other DNA
gtatttttagtagagacgcg

SEQ ID NO: 93147 - DNA, 20 bp, synthetic construct
  misc_feature 1..20: note = CRISPR gRNA sequence
  source 1..20: mol_type = other DNA
tatttttagtagagacgcgg

SEQ ID NO: 93148 - DNA, 20 bp, synthetic construct
  misc_feature 1..20: note = CRISPR gRNA sequence
  source 1..20: mol_type = other DNA
ttagtagagacgcggttttg

SEQ ID NO: 93149 - DNA, 20 bp, synthetic construct
  misc_feature 1..20: note = CRISPR gRNA sequence
  source 1..20: mol_type = other DNA
tagtagagacgcggttttgc

SEQ ID NO: 93150 - DNA, 20 bp, synthetic construct
  misc_feature 1..20: note = CRISPR gRNA sequence
  source 1..20: mol_type = other DNA
agtagagacgcggttttgcc

SEQ ID NO: 93151 - DNA, 20 bp, synthetic construct
  misc_feature 1..20: note = CRISPR gRNA sequence
  source 1..20: mol_type = other DNA
gtagagacgcggttttgcca

SEQ ID NO: 93152 - DNA, 20 bp, synthetic construct
  misc_feature 1..20: note = CRISPR gRNA sequence
  source 1..20: mol_type = other DNA
tgccatgttggccagtctgg

SEQ ID NO: 93153 - DNA, 20 bp, synthetic construct
  misc_feature 1..20: note = CRISPR gRNA sequence
  source 1..20: mol_type = other DNA
gccatgttggccagtctggt

SEQ ID NO: 93154 - DNA, 20 bp, synthetic construct
  misc_feature 1..20: note = CRISPR gRNA sequence
  source 1..20: mol_type = other DNA
ccatgttggccagtctggtc

SEQ ID NO: 93155 - DNA, 20 bp, synthetic construct
  misc_feature 1..20: note = CRISPR gRNA sequence
  source 1..20: mol_type = other DNA
gccagtctggtctcgaactc

SEQ ID NO: 93156 - DNA, 20 bp, synthetic construct
  misc_feature 1..20: note = CRISPR gRNA sequence
  source 1..20: mol_type = other DNA
gtctcgaactcctgatcctc

SEQ ID NO: 93157 - DNA, 20 bp, synthetic construct
  misc_feature 1..20: note = CRISPR gRNA sequence
  source 1..20: mol_type = other DNA
gaactcctgatcctcccacc

SEQ ID NO: 93158 - DNA, 20 bp, synthetic construct
  misc_feature 1..20: note = CRISPR gRNA sequence
  source 1..20: mol_type = other DNA
ctgatcctcccacctcagcc

SEQ ID NO: 93159 - DNA, 20 bp, synthetic construct
  misc_feature 1..20: note = CRISPR gRNA sequence
  source 1..20: mol_type = other DNA
atcctcccacctcagcctcc

SEQ ID NO: 93160 - DNA, 20 bp, synthetic construct
  misc_feature 1..20: note = CRISPR gRNA sequence
  source 1..20: mol_type = other DNA
ccacctcagcctcctgaagt

SEQ ID NO: 93161 - DNA, 20 bp, synthetic construct
  misc_feature 1..20: note = CRISPR gRNA sequence
  source 1..20: mol_type = other DNA
agcctcctgaagtgctggga

SEQ ID NO: 93162 - DNA, 20 bp, synthetic construct
  misc_feature 1..20: note = CRISPR gRNA sequence
  source 1..20: mol_type = other DNA
ctgaagtgctgggattacgg

SEQ ID NO: 93163 - DNA, 20 bp, synthetic construct
  misc_feature 1..20: note = CRISPR gRNA sequence
  source 1..20: mol_type = other DNA
aagtgctgggattacgggtg

SEQ ID NO: 93164 - DNA, 20 bp, synthetic construct
  misc_feature 1..20: note = CRISPR gRNA sequence
  source 1..20: mol_type = other DNA
ggattacgggtgagacccac

SEQ ID NO: 93165 - DNA, 20 bp, synthetic construct
  misc_feature 1..20: note = CRISPR gRNA sequence
  source 1..20: mol_type = other DNA
cgggtgagacccaccacgcc

SEQ ID NO: 93166 - DNA, 20 bp, synthetic construct
  misc_feature 1..20: note = CRISPR gRNA sequence
  source 1..20: mol_type = other DNA
ataatacttattttcaagaa

SEQ ID NO: 93167 - DNA, 20 bp, synthetic construct
  misc_feature 1..20: note = CRISPR gRNA sequence
  source 1..20: mol_type = other DNA
attttcaagaaagaagtagt

SEQ ID NO: 93168 - DNA, 20 bp, synthetic construct
  misc_feature 1..20: note = CRISPR gRNA sequence
  source 1..20: mol_type = other DNA
ttttcaagaaagaagtagtt

SEQ ID NO: 93169 - DNA, 20 bp, synthetic construct
  misc_feature 1..20: note = CRISPR gRNA sequence
  source 1..20: mol_type = other DNA
tcaagaaagaagtagttaac

SEQ ID NO: 93170 - DNA, 20 bp, synthetic construct
  misc_feature 1..20: note = CRISPR gRNA sequence
  source 1..20: mol_type = other DNA
caagaaagaagtagttaacc

SEQ ID NO: 93171 - DNA, 20 bp, synthetic construct
  misc_feature 1..20: note = CRISPR gRNA sequence
  source 1..20: mol_type = other DNA
aagaaagaagtagttaacct

SEQ ID NO: 93172 - DNA, 20 bp, synthetic construct
  misc_feature 1..20: note = CRISPR gRNA sequence
  source 1..20: mol_type = other DNA
acctatggctgcttactttt

SEQ ID NO: 93173 - DNA, 20 bp, synthetic construct
  misc_feature 1..20: note = CRISPR gRNA sequence
  source 1..20: mol_type = other DNA
tggctgcttacttttttttt

SEQ ID NO: 93174 - DNA, 20 bp, synthetic construct
  misc_feature 1..20: note = CRISPR gRNA sequence
  source 1..20: mol_type = other DNA
cttacttttttttttttaaa

SEQ ID NO: 93175 - DNA, 20 bp, synthetic construct
  misc_feature 1..20: note = CRISPR gRNA sequence
  source 1..20: mol_type = other DNA
acttttttttttttaaacta

SEQ ID NO: 93176 - DNA, 20 bp, synthetic construct
  misc_feature 1..20: note = CRISPR gRNA sequence
  source 1..20: mol_type = other DNA
cttttttttttttaaactac

SEQ ID NO: 93177 - DNA, 20 bp, synthetic construct
  misc_feature 1..20: note = CRISPR gRNA sequence
  source 1..20: mol_type = other DNA
ttttttttttaaactaccta

SEQ ID NO: 93178 - DNA, 20 bp, synthetic construct
  misc_feature 1..20: note = CRISPR gRNA sequence
  source 1..20: mol_type = other DNA
tttttttttaaactacctaa

SEQ ID NO: 93179 - DNA, 20 bp, synthetic construct
  misc_feature 1..20: note = CRISPR gRNA sequence
  source 1..20: mol_type = other DNA
ttttttttaaactacctaac

SEQ ID NO: 93180 - DNA, 20 bp, synthetic construct
  misc_feature 1..20: note = CRISPR gRNA sequence
  source 1..20: mol_type = other DNA
tttttttaaactacctaaca

SEQ ID NO: 93181 - DNA, 20 bp, synthetic construct
  misc_feature 1..20: note = CRISPR gRNA sequence
  source 1..20: mol_type = other DNA
ttttttaaactacctaacat

SEQ ID NO: 93182 - DNA, 20 bp, synthetic construct
  misc_feature 1..20: note = CRISPR gRNA sequence
  source 1..20: mol_type = other DNA
tttttaaactacctaacatt

SEQ ID NO: 93183 - DNA, 20 bp, synthetic construct
  misc_feature 1..20: note = CRISPR gRNA sequence
  source 1..20: mol_type = other DNA
ttttaaactacctaacattt

SEQ ID NO: 93184 - DNA, 20 bp, synthetic construct
  misc_feature 1..20: note = CRISPR gRNA sequence
  source 1..20: mol_type = other DNA
tttaaactacctaacattta

SEQ ID NO: 93185 - DNA, 20 bp, synthetic construct
  misc_feature 1..20: note = CRISPR gRNA sequence
  source 1..20: mol_type = other DNA
ttaaactacctaacatttac

SEQ ID NO: 93186 - DNA, 20 bp, synthetic construct
  misc_feature 1..20: note = CRISPR gRNA sequence
  source 1..20: mol_type = other DNA
taaactacctaacatttaca

SEQ ID NO: 93187 - DNA, 20 bp, synthetic construct
  misc_feature 1..20: note = CRISPR gRNA sequence
  source 1..20: mol_type = other DNA
aaactacctaacatttacat

SEQ ID NO: 93188 - DNA, 20 bp, synthetic construct
  misc_feature 1..20: note = CRISPR gRNA sequence
  source 1..20: mol_type = other DNA
aactacctaacatttacatc

SEQ ID NO: 93189 - DNA, 20 bp, synthetic construct
  misc_feature 1..20: note = CRISPR gRNA sequence
  source 1..20: mol_type = other DNA
cctaacatttacatctacag

SEQ ID NO: 93190 - DNA, 20 bp, synthetic construct
  misc_feature 1..20: note = CRISPR gRNA sequence
  source 1..20: mol_type = other DNA
acatttacatctacagtgag

SEQ ID NO: 93191 - DNA, 20 bp, synthetic construct
  misc_feature 1..20: note = CRISPR gRNA sequence
  source 1..20: mol_type = other DNA
acatctacagtgaggaaaat

SEQ ID NO: 93192 - DNA, 20 bp, synthetic construct
  misc_feature 1..20: note = CRISPR gRNA sequence
  source 1..20: mol_type = other DNA
catctacagtgaggaaaatg

SEQ ID NO: 93193 - DNA, 20 bp, synthetic construct
  misc_feature 1..20: note = CRISPR gRNA sequence
  source 1..20: mol_type = other DNA
cagtgaggaaaatgtataaa

SEQ ID NO: 93194 - DNA, 20 bp, synthetic construct
  misc_feature 1..20: note = CRISPR gRNA sequence
  source 1..20: mol_type = other DNA
aattagcgtctccctctgca

SEQ ID NO: 93195 - DNA, 20 bp, synthetic construct
  misc_feature 1..20: note = CRISPR gRNA sequence
  source 1..20: mol_type = other DNA
gcgtctccctctgcacctcc

SEQ ID NO: 93196 - DNA, 20 bp, synthetic construct
  misc_feature 1..20: note = CRISPR gRNA sequence
  source 1..20: mol_type = other DNA
cctctgcacctcccacaaaa

SEQ ID NO: 93197 - DNA, 20 bp, synthetic construct
  misc_feature 1..20: note = CRISPR gRNA sequence
  source 1..20: mol_type = other DNA
tgcacctcccacaaaaagaa

SEQ ID NO: 93198 - DNA, 20 bp, synthetic construct
  misc_feature 1..20: note = CRISPR gRNA sequence
  source 1..20: mol_type = other DNA
cacctcccacaaaaagaacc

SEQ ID NO: 93199 - DNA, 20 bp, synthetic construct
  misc_feature 1..20: note = CRISPR gRNA sequence
  source 1..20: mol_type = other DNA
ccacaaaaagaaccttatta

SEQ ID NO: 93200 - DNA, 20 bp, synthetic construct
  misc_feature 1..20: note = CRISPR gRNA sequence
  source 1..20: mol_type = other DNA
attactattttgttatttat

SEQ ID NO: 93201 - DNA, 20 bp, synthetic construct
  misc_feature 1..20: note = CRISPR gRNA sequence
  source 1..20: mol_type = other DNA
ttactattttgttatttatt

SEQ ID NO: 93202 - DNA, 20 bp, synthetic construct
  misc_feature 1..20: note = CRISPR gRNA sequence
  source 1..20: mol_type = other DNA
ctattttgttatttatttac

SEQ ID NO: 93203 - DNA, 20 bp, synthetic construct
  misc_feature 1..20: note = CRISPR gRNA sequence
  source 1..20: mol_type = other DNA
ttttgttatttatttactta

SEQ ID NO: 93204 - DNA, 20 bp, synthetic construct
  misc_feature 1..20: note = CRISPR gRNA sequence
  source 1..20: mol_type = other DNA
tgttatttatttacttatct

SEQ ID NO: 93205 - DNA, 20 bp, synthetic construct
  misc_feature 1..20: note = CRISPR gRNA sequence
  source 1..20: mol_type = other DNA
gttatttatttacttatcta

SEQ ID NO: 93206 - DNA, 20 bp, synthetic construct
  misc_feature 1..20: note = CRISPR gRNA sequence
  source 1..20: mol_type = other DNA
ttatttatttacttatctaa

SEQ ID NO: 93207 - DNA, 20 bp, synthetic construct
  misc_feature 1..20: note = CRISPR gRNA sequence
  source 1..20: mol_type = other DNA
tttatttacttatctaattt

SEQ ID NO: 93208 - DNA, 20 bp, synthetic construct
  misc_feature 1..20: note = CRISPR gRNA sequence
  source 1..20: mol_type = other DNA
atttacttatctaatttttt

SEQ ID NO: 93209 - DNA, 20 bp, synthetic construct
  misc_feature 1..20: note = CRISPR gRNA sequence
  source 1..20: mol_type = other DNA
tttacttatctaatttttta

SEQ ID NO: 93210 - DNA, 20 bp, synthetic construct
  misc_feature 1..20: note = CRISPR gRNA sequence
  source 1..20: mol_type = other DNA
acttatctaattttttagag

SEQ ID NO: 93211 - DNA, 20 bp, synthetic construct
  misc_feature 1..20: note = CRISPR gRNA sequence
  source 1..20: mol_type = other DNA
cttatctaattttttagaga

SEQ ID NO: 93212 - DNA, 20 bp, synthetic construct
  misc_feature 1..20: note = CRISPR gRNA sequence
  source 1..20: mol_type = other DNA
atctaattttttagagatgg

SEQ ID NO: 93213 - DNA, 20 bp, synthetic construct
  misc_feature 1..20: note = CRISPR gRNA sequence
  source 1..20: mol_type = other DNA
tctaattttttagagatggg

SEQ ID NO: 93214 - DNA, 20 bp, synthetic construct
  misc_feature 1..20: note = CRISPR gRNA sequence
  source 1..20: mol_type = other DNA
attttttagagatgggtctc

SEQ ID NO: 93215 - DNA, 20 bp, synthetic construct
  misc_feature 1..20: note = CRISPR gRNA sequence
  source 1..20: mol_type = other DNA
tttagagatgggtctcacag

SEQ ID NO: 93216 - DNA, 20 bp, synthetic construct
  misc_feature 1..20: note = CRISPR gRNA sequence
  source 1..20: mol_type = other DNA
ttagagatgggtctcacagt

SEQ ID NO: 93217 - DNA, 20 bp, synthetic construct
  misc_feature 1..20: note = CRISPR gRNA sequence
  source 1..20: mol_type = other DNA
tagagatgggtctcacagtg

SEQ ID NO: 93218 - DNA, 20 bp, synthetic construct
  misc_feature 1..20: note = CRISPR gRNA sequence
  source 1..20: mol_type = other DNA
agagatgggtctcacagtgt

SEQ ID NO: 93219 - DNA, 20 bp, synthetic construct
  misc_feature 1..20: note = CRISPR gRNA sequence
  source 1..20: mol_type = other DNA
gagatgggtctcacagtgtt

SEQ ID NO: 93220 - DNA, 20 bp, synthetic construct
  misc_feature 1..20: note = CRISPR gRNA sequence
  source 1..20: mol_type = other DNA
acagtgttgcccaggctggc

SEQ ID NO: 93221 - DNA, 20 bp, synthetic construct
  misc_feature 1..20: note = CRISPR gRNA sequence
  source 1..20: mol_type = other DNA
cccaggctggcctcgaattc

SEQ ID NO: 93222 - DNA, 20 bp, synthetic construct
  misc_feature 1..20: note = CRISPR gRNA sequence
  source 1..20: mol_type = other DNA
gcctcgaattcctgggctca

SEQ ID NO: 93223 - DNA, 20 bp, synthetic construct
  misc_feature 1..20: note = CRISPR gRNA sequence
  source 1..20: mol_type = other DNA
gaattcctgggctcaagtga

SEQ ID NO: 93224 - DNA, 20 bp, synthetic construct
  misc_feature 1..20: note = CRISPR gRNA sequence
  source 1..20: mol_type = other DNA
ctgggctcaagtgatcctcc

SEQ ID NO: 93225 - DNA, 20 bp, synthetic construct
  misc_feature 1..20: note = CRISPR gRNA sequence
  source 1..20: mol_type = other DNA
ggctcaagtgatcctcctgc

SEQ ID NO: 93226 - DNA, 20 bp, synthetic construct
  misc_feature 1..20: note = CRISPR gRNA sequence
  source 1..20: mol_type = other DNA
aagtgatcctcctgcctcag

SEQ ID NO: 93227 - DNA, 20 bp, synthetic construct
  misc_feature 1..20: note = CRISPR gRNA sequence
  source 1..20: mol_type = other DNA
ctgcctcagccttcagagta

SEQ ID NO: 93228 - DNA, 20 bp, synthetic construct
  misc_feature 1..20: note = CRISPR gRNA sequence
  source 1..20: mol_type = other DNA
cctcagccttcagagtaact

SEQ ID NO: 93229 - DNA, 20 bp, synthetic construct
  misc_feature 1..20: note = CRISPR gRNA sequence
  source 1..20: mol_type = other DNA
agccttcagagtaactggga

SEQ ID NO: 93230 - DNA, 20 bp, synthetic construct
  misc_feature 1..20: note = CRISPR gRNA sequence
  source 1..20: mol_type = other DNA
cagagtaactgggattattt

SEQ ID NO: 93231 - DNA, 20 bp, synthetic construct
  misc_feature 1..20: note = CRISPR gRNA sequence
  source 1..20: mol_type = other DNA
agagtaactgggattatttc

SEQ ID NO: 93232 - DNA, 20 bp, synthetic construct
  misc_feature 1..20: note = CRISPR gRNA sequence
  source 1..20: mol_type = other DNA
ggattatttcaccactgcac

SEQ ID NO: 93233 - DNA, 20 bp, synthetic construct
  misc_feature 1..20: note = CRISPR gRNA sequence
  source 1..20: mol_type = other DNA
tttcaccactgcacctagct

SEQ ID NO: 93234 - DNA, 20 bp, synthetic construct
  misc_feature 1..20: note = CRISPR gRNA sequence
  source 1..20: mol_type = other DNA
caccactgcacctagcttca

SEQ ID NO: 93235 - DNA, 20 bp, synthetic construct
  misc_feature 1..20: note = CRISPR gRNA sequence
  source 1..20: mol_type = other DNA
accactgcacctagcttcac

SEQ ID NO: 93236 - DNA, 20 bp, synthetic construct
  misc_feature 1..20: note = CRISPR gRNA sequence
  source 1..20: mol_type = other DNA
cacctagcttcactatttta

SEQ ID NO: 93237 - DNA, 20 bp, synthetic construct
  misc_feature 1..20: note = CRISPR gRNA sequence
  source 1..20: mol_type = other DNA
gcttcactattttaaaataa

SEQ ID NO: 93238 - DNA, 20 bp, synthetic construct
  misc_feature 1..20: note = CRISPR gRNA sequence
  source 1..20: mol_type = other DNA
cactattttaaaataatttg

SEQ ID NO: 93239 - DNA, 20 bp, synthetic construct
  misc_feature 1..20: note = CRISPR gRNA sequence
  source 1..20: mol_type = other DNA
actattttaaaataatttgc

SEQ ID NO: 93240 - DNA, 20 bp, synthetic construct
  misc_feature 1..20: note = CRISPR gRNA sequence
  source 1..20: mol_type = other DNA
ttttaaaataatttgcatga

SEQ ID NO: 93241 - DNA, 20 bp, synthetic construct
  misc_feature 1..20: note = CRISPR gRNA sequence
  source 1..20: mol_type = other DNA
taaaataatttgcatgactt

SEQ ID NO: 93242 - DNA, 20 bp, synthetic construct
  misc_feature 1..20: note = CRISPR gRNA sequence
  source 1..20: mol_type = other DNA
aaaataatttgcatgacttt

SEQ ID NO: 93243 - DNA, 20 bp, synthetic construct
  misc_feature 1..20: note = CRISPR gRNA sequence
  source 1..20: mol_type = other DNA
aaataatttgcatgactttt

SEQ ID NO: 93244 - DNA, 20 bp, synthetic construct
  misc_feature 1..20: note = CRISPR gRNA sequence
  source 1..20: mol_type = other DNA
gcatgactttttatggaagg

SEQ ID NO: 93245 - DNA, 20 bp, synthetic construct
  misc_feature 1..20: note = CRISPR gRNA sequence
  source 1..20: mol_type = other DNA
catgactttttatggaaggg

SEQ ID NO: 93246 - DNA, 20 bp, synthetic construct
  misc_feature 1..20: note = CRISPR gRNA sequence
  source 1..20: mol_type = other DNA
tttatggaagggaattaatt

SEQ ID NO: 93247 - DNA, 20 bp, synthetic construct
  misc_feature 1..20: note = CRISPR gRNA sequence
  source 1..20: mol_type = other DNA
ttatggaagggaattaattg

SEQ ID NO: 93248 - DNA, 20 bp, synthetic construct
  misc_feature 1..20: note = CRISPR gRNA sequence
  source 1..20: mol_type = other DNA
tatggaagggaattaattgc

SEQ ID NO: 93249 - DNA, 20 bp, synthetic construct
  misc_feature 1..20: note = CRISPR gRNA sequence
  source 1..20: mol_type = other DNA
atggaagggaattaattgct

SEQ ID NO: 93250 - DNA, 20 bp, synthetic construct
  misc_feature 1..20: note = CRISPR gRNA sequence
  source 1..20: mol_type = other DNA
tggaagggaattaattgcta

SEQ ID NO: 93251 - DNA, 20 bp, synthetic construct
  misc_feature 1..20: note = CRISPR gRNA sequence
  source 1..20: mol_type = other DNA
attgctataagcaacaaata

SEQ ID NO: 93252 - DNA, 20 bp, synthetic construct
  misc_feature 1..20: note = CRISPR gRNA sequence
  source 1..20: mol_type = other DNA
ctataagcaacaaataatac

SEQ ID NO: 93253 - DNA, 20 bp, synthetic construct
  misc_feature 1..20: note = CRISPR gRNA sequence
  source 1..20: mol_type = other DNA
taagcaacaaataatactaa

SEQ ID NO: 93254 - DNA, 20 bp, synthetic construct
  misc_feature 1..20: note = CRISPR gRNA sequence
  source 1..20: mol_type = other DNA
atagtttactatccagtttg

SEQ ID NO: 93255 - DNA, 20 bp, synthetic construct
  misc_feature 1..20: note = CRISPR gRNA sequence
  source 1..20: mol_type = other DNA
actatccagtttgtcttata

SEQ ID NO: 93256 - DNA, 20 bp, synthetic construct
  misc_feature 1..20: note = CRISPR gRNA sequence
  source 1..20: mol_type = other DNA
ctatccagtttgtcttatat

SEQ ID NO: 93257 - DNA, 20 bp, synthetic construct
  misc_feature 1..20: note = CRISPR gRNA sequence
  source 1..20: mol_type = other DNA
tccagtttgtcttatatttt

SEQ ID NO: 93258 - DNA, 20 bp, synthetic construct
  misc_feature 1..20: note = CRISPR gRNA sequence
  source 1..20: mol_type = other DNA
gtcttatattttgggatact

SEQ ID NO: 93259 - DNA, 20 bp, synthetic construct
  misc_feature 1..20: note = CRISPR gRNA sequence
  source 1..20: mol_type = other DNA
tcttatattttgggatactt

SEQ ID NO: 93260 - DNA, 20 bp, synthetic construct
  misc_feature 1..20: note = CRISPR gRNA sequence
  source 1..20: mol_type = other DNA
atattttgggatactttatc

SEQ ID NO: 93261 - DNA, 20 bp, synthetic construct
  misc_feature 1..20: note = CRISPR gRNA sequence
  source 1..20: mol_type = other DNA
tattttgggatactttatca

SEQ ID NO: 93262 - DNA, 20 bp, synthetic construct
  misc_feature 1..20: note = CRISPR gRNA sequence
  source 1..20: mol_type = other DNA
tgggatactttatcagttct

SEQ ID NO: 93263 - DNA, 20 bp, synthetic construct
  misc_feature 1..20: note = CRISPR gRNA sequence
  source 1..20: mol_type = other DNA
gggatactttatcagttctg

SEQ ID NO: 93264 - DNA, 20 bp, synthetic construct
  misc_feature 1..20: note = CRISPR gRNA sequence
  source 1..20: mol_type = other DNA
ggatactttatcagttctga

SEQ ID NO: 93265 - DNA, 20 bp, synthetic construct
  misc_feature 1..20: note = CRISPR gRNA sequence
  source 1..20: mol_type = other DNA
tatcagttctgaggaggtaa

SEQ ID NO: 93266 - DNA, 20 bp, synthetic construct
  misc_feature 1..20: note = CRISPR gRNA sequence
  source 1..20: mol_type = other DNA
atcagttctgaggaggtaac

SEQ ID NO: 93267 - DNA, 20 bp, synthetic construct
  misc_feature 1..20: note = CRISPR gRNA sequence
  source 1..20: mol_type = other DNA
tcagttctgaggaggtaaca

SEQ ID NO: 93268 - DNA, 20 bp, synthetic construct
  misc_feature 1..20: note = CRISPR gRNA sequence
  source 1..20: mol_type = other DNA
tgaggaggtaacaagatctg

SEQ ID NO: 93269 - DNA, 20 bp, synthetic construct
  misc_feature 1..20: note = CRISPR gRNA sequence
  source 1..20: mol_type = other DNA
aggaggtaacaagatctgta

SEQ ID NO: 93270 - DNA, 20 bp, synthetic construct
  misc_feature 1..20: note = CRISPR gRNA sequence
  source 1..20: mol_type = other DNA
taaatctttatctttgttaa

SEQ ID NO: 93271 - DNA, 20 bp, synthetic construct
  misc_feature 1..20: note = CRISPR gRNA sequence
  source 1..20: mol_type = other DNA
tatctttgttaaactgagtg

SEQ ID NO: 93272 - DNA, 20 bp, synthetic construct
  misc_feature 1..20: note = CRISPR gRNA sequence
  source 1..20: mol_type = other DNA
atctttgttaaactgagtgt

SEQ ID NO: 93273 - DNA, 20 bp, synthetic construct
  misc_feature 1..20: note = CRISPR gRNA sequence
  source 1..20: mol_type = other DNA
tctttgttaaactgagtgta

SEQ ID NO: 93274 - DNA, 20 bp, synthetic construct
  misc_feature 1..20: note = CRISPR gRNA sequence
  source 1..20: mol_type = other DNA
tgttaaactgagtgtaaaga

SEQ ID NO: 93275 - DNA, 20 bp, synthetic construct
  misc_feature 1..20: note = CRISPR gRNA sequence
  source 1..20: mol_type = other DNA
gttaaactgagtgtaaagaa

SEQ ID NO: 93276 - DNA, 20 bp, synthetic construct
  misc_feature 1..20: note = CRISPR gRNA sequence
  source 1..20: mol_type = other DNA
ttaaactgagtgtaaagaaa

SEQ ID NO: 93277 - DNA, 20 bp, synthetic construct
  misc_feature 1..20: note = CRISPR gRNA sequence
  source 1..20: mol_type = other DNA
aactgagtgtaaagaaaata

SEQ ID NO: 93278 - DNA, 20 bp, synthetic construct
  misc_feature 1..20: note = CRISPR gRNA sequence
  source 1..20: mol_type = other DNA
agtgtaaagaaaataacagt

SEQ ID NO: 93279 - DNA, 20 bp, synthetic construct
  misc_feature 1..20: note = CRISPR gRNA sequence
  source 1..20: mol_type = other DNA
tatagtccggttttagtagt

SEQ ID NO: 93280 - DNA, 20 bp, synthetic construct
  misc_feature 1..20: note = CRISPR gRNA sequence
  source 1..20: mol_type = other DNA
tagtagttcagaggaggata

SEQ ID NO: 93281 - DNA, 20 bp, synthetic construct
  misc_feature 1..20: note = CRISPR gRNA sequence
  source 1..20: mol_type = other DNA
agtagttcagaggaggatag

SEQ ID NO: 93282 - DNA, 20 bp, synthetic construct
  misc_feature 1..20: note = CRISPR gRNA sequence
  source 1..20: mol_type = other DNA
gtagttcagaggaggataga

SEQ ID NO: 93283 - DNA, 20 bp, synthetic construct
  misc_feature 1..20: note = CRISPR gRNA sequence
  source 1..20: mol_type = other DNA
agaggaggatagatcattgt

SEQ ID NO: 93284 - DNA, 20 bp, synthetic construct
  misc_feature 1..20: note = CRISPR gRNA sequence
  source 1..20: mol_type = other DNA
taggctgagatactccagaa

SEQ ID NO: 93285 - DNA, 20 bp, synthetic construct
  misc_feature 1..20: note = CRISPR gRNA sequence
  source 1..20: mol_type = other DNA
agatactccagaaaggcttt

SEQ ID NO: 93286 - DNA, 20 bp, synthetic construct
  misc_feature 1..20: note = CRISPR gRNA sequence
  source 1..20: mol_type = other DNA
cagaaaggctttgcagagga

SEQ ID NO: 93287 - DNA, 20 bp, synthetic construct
  misc_feature 1..20: note = CRISPR gRNA sequence
  source 1..20: mol_type = other DNA
tgcagaggaaacgtgactca

SEQ ID NO: 93288 - DNA, 20 bp, synthetic construct
  misc_feature 1..20: note = CRISPR gRNA sequence
  source 1..20: mol_type = other DNA
gcagaggaaacgtgactcag

SEQ ID NO: 93289 - DNA, 20 bp, synthetic construct
  misc_feature 1..20: note = CRISPR gRNA sequence
  source 1..20: mol_type = other DNA
cagaggaaacgtgactcagt

SEQ ID NO: 93290 - DNA, 20 bp, synthetic construct
  misc_feature 1..20: note = CRISPR gRNA sequence
  source 1..20: mol_type = other DNA
agtataaaccagaaaggatg

SEQ ID NO: 93291 - DNA, 20 bp, synthetic construct
  misc_feature 1..20: note = CRISPR gRNA sequence
  source 1..20: mol_type = other DNA
acgcttaatgagctgagttt

SEQ ID NO: 93292 - DNA, 20 bp, synthetic construct
  misc_feature 1..20: note = CRISPR gRNA sequence
  source 1..20: mol_type = other DNA
cgcttaatgagctgagtttc

SEQ ID NO: 93293 - DNA, 20 bp, synthetic construct
  misc_feature 1..20: note = CRISPR gRNA sequence
  source 1..20: mol_type = other DNA
aatgagctgagtttcttatg

SEQ ID NO: 93294 - DNA, 20 bp, synthetic construct
  misc_feature 1..20: note = CRISPR gRNA sequence
  source 1..20: mol_type = other DNA
atgagctgagtttcttatgt

SEQ ID NO: 93295 - DNA, 20 bp, synthetic construct
  misc_feature 1..20: note = CRISPR gRNA sequence
  source 1..20: mol_type = other DNA
agtttcttatgtgtcaagca

SEQ ID NO: 93296 - DNA, 20 bp, synthetic construct
  misc_feature 1..20: note = CRISPR gRNA sequence
  source 1..20: mol_type = other DNA
cttatgtgtcaagcactgtg

SEQ ID NO: 93297 - DNA, 20 bp, synthetic construct
  misc_feature 1..20: note = CRISPR gRNA sequence
  source 1..20: mol_type = other DNA
ttatgtgtcaagcactgtgt

SEQ ID NO: 93298 - DNA, 20 bp, synthetic construct
  misc_feature 1..20: note = CRISPR gRNA sequence
  source 1..20: mol_type = other DNA
atgtgtcaagcactgtgtta

SEQ ID NO: 93299 - DNA, 20 bp, synthetic construct
  misc_feature 1..20: note = CRISPR gRNA sequence
  source 1..20: mol_type = other DNA
tgtgtcaagcactgtgttaa

SEQ ID NO: 93300 - DNA, 20 bp, synthetic construct
  misc_feature 1..20: note = CRISPR gRNA sequence
  source 1..20: mol_type = other DNA
tgttaagctataaatggagt

SEQ ID NO: 93301 - DNA, 20 bp, synthetic construct
  misc_feature 1..20: note = CRISPR gRNA sequence
  source 1..20: mol_type = other DNA
agctataaatggagtctcac

SEQ ID NO: 93302 - DNA, 20 bp, synthetic construct
  misc_feature 1..20: note = CRISPR gRNA sequence
  source 1..20: mol_type = other DNA
taaatggagtctcacaaccc

SEQ ID NO: 93303 - DNA, 20 bp, synthetic construct
  misc_feature 1..20: note = CRISPR gRNA sequence
  source 1..20: mol_type = other DNA
acaacccttcagcaatggga

SEQ ID NO: 93304 - DNA, 20 bp, synthetic construct
  misc_feature 1..20: note = CRISPR gRNA sequence
  source 1..20: mol_type = other DNA
cagcaatgggatagatacta

SEQ ID NO: 93305 - DNA, 20 bp, synthetic construct
  misc_feature 1..20: note = CRISPR gRNA sequence
  source 1..20: mol_type = other DNA
agcaatgggatagatactat

SEQ ID NO: 93306 - DNA, 20 bp, synthetic construct
  misc_feature 1..20: note = CRISPR gRNA sequence
  source 1..20: mol_type = other DNA
tattttacatacatggaaac

SEQ ID NO: 93307 - DNA, 20 bp, synthetic construct
  misc_feature 1..20: note = CRISPR gRNA sequence
  source 1..20: mol_type = other DNA
tacatacatggaaactgagg

SEQ ID NO: 93308 - DNA, 20 bp, synthetic construct
  misc_feature 1..20: note = CRISPR gRNA sequence
  source 1..20: mol_type = other DNA
acatacatggaaactgaggc

SEQ ID NO: 93309 - DNA, 20 bp, synthetic construct
  misc_feature 1..20: note = CRISPR gRNA sequence
  source 1..20: mol_type = other DNA
catacatggaaactgaggca

SEQ ID NO: 93310 - DNA, 20 bp, synthetic construct
  misc_feature 1..20: note = CRISPR gRNA sequence
  source 1..20: mol_type = other DNA
aggcacagagaggctaaaga

SEQ ID NO: 93311 - DNA, 20 bp, synthetic construct
  misc_feature 1..20: note = CRISPR gRNA sequence
  source 1..20: mol_type = other DNA
aagaatttggcctaggtcat

SEQ ID NO: 93312 - DNA, 20 bp, synthetic construct
  misc_feature 1..20: note = CRISPR gRNA sequence
  source 1..20: mol_type = other DNA
ggcctaggtcatacagccag

SEQ ID NO: 93313 - DNA, 20 bp, synthetic construct
  misc_feature 1..20: note = CRISPR gRNA sequence
  source 1..20: mol_type = other DNA
gcctaggtcatacagccagc

SEQ ID NO: 93314 - DNA, 20 bp, synthetic construct
  misc_feature 1..20: note = CRISPR gRNA sequence
  source 1..20: mol_type = other DNA
ggtcatacagccagcaagta

SEQ ID NO: 93315 - DNA, 20 bp, synthetic construct
  misc_feature 1..20: note = CRISPR gRNA sequence
  source 1..20: mol_type = other DNA
tactcaaacgcaagcagtct

SEQ ID NO: 93316 - DNA, 20 bp, synthetic construct
  misc_feature 1..20: note = CRISPR gRNA sequence
  source 1..20: mol_type = other DNA
aaacgcaagcagtcttattc

SEQ ID NO: 93317 - DNA, 20 bp, synthetic construct
  misc_feature 1..20: note = CRISPR gRNA sequence
  source 1..20: mol_type = other DNA
attctagagctttcactttt

SEQ ID NO: 93318 - DNA, 20 bp, synthetic construct
  misc_feature 1..20: note = CRISPR gRNA sequence
  source 1..20: mol_type = other DNA
ttctagagctttcactttta

SEQ ID NO: 93319 - DNA, 20 bp, synthetic construct
  misc_feature 1..20: note = CRISPR gRNA sequence
  source 1..20: mol_type = other DNA
tagagctttcacttttacct

SEQ ID NO: 93320 - DNA, 20 bp, synthetic construct
  misc_feature 1..20: note = CRISPR gRNA sequence
  source 1..20: mol_type = other DNA
gagctttcacttttacctcc

SEQ ID NO: 93321 - DNA, 20 bp, synthetic construct
  misc_feature 1..20: note = CRISPR gRNA sequence
  source 1..20: mol_type = other DNA
tcacttttacctccttacta

SEQ ID NO: 93322 - DNA, 20 bp, synthetic construct
  misc_feature 1..20: note = CRISPR gRNA sequence
  source 1..20: mol_type = other DNA
cacttttacctccttactat

SEQ ID NO: 93323 - DNA, 20 bp, synthetic construct
  misc_feature 1..20: note = CRISPR gRNA sequence
  source 1..20: mol_type = other DNA
acttttacctccttactata

SEQ ID NO: 93324 - DNA, 20 bp, synthetic construct
  misc_feature 1..20: note = CRISPR gRNA sequence
  source 1..20: mol_type = other DNA
ttacctccttactatactgc

SEQ ID NO: 93325 - DNA, 20 bp, synthetic construct
  misc_feature 1..20: note = CRISPR gRNA sequence
  source 1..20: mol_type = other DNA
tacctccttactatactgct

SEQ ID NO: 93326 - DNA, 20 bp, synthetic construct
  misc_feature 1..20: note = CRISPR gRNA sequence
  source 1..20: mol_type = other DNA
acctccttactatactgctt

SEQ ID NO: 93327 - DNA, 20 bp, synthetic construct
  misc_feature 1..20: note = CRISPR gRNA sequence
  source 1..20: mol_type = other DNA
cctccttactatactgcttc

SEQ ID NO: 93328 - DNA, 20 bp, synthetic construct
  misc_feature 1..20: note = CRISPR gRNA sequence
  source 1..20: mol_type = other DNA
cttactatactgcttcccta

SEQ ID NO: 93329 - DNA, 20 bp, synthetic construct
  misc_feature 1..20: note = CRISPR gRNA sequence
  source 1..20: mol_type = other DNA
actatactgcttccctagaa

SEQ ID NO: 93330 - DNA, 20 bp, synthetic construct
  misc_feature 1..20: note = CRISPR gRNA sequence
  source 1..20: mol_type = other DNA
ctatactgcttccctagaat

SEQ ID NO: 93331 - DNA, 20 bp, synthetic construct
  misc_feature 1..20: note = CRISPR gRNA sequence
  source 1..20: mol_type = other DNA
tactgcttccctagaattct

SEQ ID NO: 93332 - DNA, 20 bp, synthetic construct
  misc_feature 1..20: note = CRISPR gRNA sequence
  source 1..20: mol_type = other DNA
cttccctagaattctggtag

SEQ ID NO: 93333 - DNA, 20 bp, synthetic construct
  misc_feature 1..20: note = CRISPR gRNA sequence
  source 1..20: mol_type = other DNA
ccctagaattctggtagata

SEQ ID NO: 93334 - DNA, 20 bp, synthetic construct
  misc_feature 1..20: note = CRISPR gRNA sequence
  source 1..20: mol_type = other DNA
cctagaattctggtagataa

SEQ ID NO: 93335 - DNA, 20 bp, synthetic construct
  misc_feature 1..20: note = CRISPR gRNA sequence
  source 1..20: mol_type = other DNA
gaattctggtagataaaagg

SEQ ID NO: 93336 - DNA, 20 bp, synthetic construct
  misc_feature 1..20: note = CRISPR gRNA sequence
  source 1..20: mol_type = other DNA
tggtagataaaaggaaagag

SEQ ID NO: 93337 - DNA, 20 bp, synthetic construct
  misc_feature 1..20: note = CRISPR gRNA sequence
  source 1..20: mol_type = other DNA
gtagataaaaggaaagagaa

SEQ ID NO: 93338 - DNA, 20 bp, synthetic construct
  misc_feature 1..20: note = CRISPR gRNA sequence
  source 1..20: mol_type = other DNA
tagtaaagaaagagaagtag

SEQ ID NO: 93339 - DNA, 20 bp, synthetic construct
  misc_feature 1..20: note = CRISPR gRNA sequence
  source 1..20: mol_type = other DNA
agtaaagaaagagaagtagg

SEQ ID NO: 93340 - DNA, 20 bp, synthetic construct
  misc_feature 1..20: note = CRISPR gRNA sequence
  source 1..20: mol_type = other DNA
gtaaagaaagagaagtagga

SEQ ID NO: 93341 - DNA, 20 bp, synthetic construct
  misc_feature 1..20: note = CRISPR gRNA sequence
  source 1..20: mol_type = other DNA
ttgtgaagatagcaagtgga

SEQ ID NO: 93342 - DNA, 20 bp, synthetic construct
  misc_feature 1..20: note = CRISPR gRNA sequence
  source 1..20: mol_type = other DNA
tgtgaagatagcaagtggac

SEQ ID NO: 93343 - DNA, 20 bp, synthetic construct
  misc_feature 1..20: note = CRISPR gRNA sequence
  source 1..20: mol_type = other DNA
gtgaagatagcaagtggact

SEQ ID NO: 93344 - DNA, 20 bp, synthetic construct
  misc_feature 1..20: note = CRISPR gRNA sequence
  source 1..20: mol_type = other DNA
tgaagatagcaagtggacta

SEQ ID NO: 93345 - DNA, 20 bp, synthetic construct
  misc_feature 1..20: note = CRISPR gRNA sequence
  source 1..20: mol_type = other DNA
ttctagctaaaatagttgag

SEQ ID NO: 93346 - DNA, 20 bp, synthetic construct
  misc_feature 1..20: note = CRISPR gRNA sequence
  source 1..20: mol_type = other DNA
tagctaaaatagttgagtgg

SEQ ID NO: 93347 - DNA, 20 bp, synthetic construct
  misc_feature 1..20: note = CRISPR gRNA sequence
  source 1..20: mol_type = other DNA
gctaaaatagttgagtggaa

SEQ ID NO: 93348 - DNA, 20 bp, synthetic construct
  misc_feature 1..20: note = CRISPR gRNA sequence
  source 1..20: mol_type = other DNA
aaatagttgagtggaaaatt

SEQ ID NO: 93349 - DNA, 20 bp, synthetic construct
  misc_feature 1..20: note = CRISPR gRNA sequence
  source 1..20: mol_type = other DNA
agtggaaaattcatgagaga

SEQ ID NO: 93350 - DNA, 20 bp, synthetic construct
  misc_feature 1..20: note = CRISPR gRNA sequence
  source 1..20: mol_type = other DNA
atgagagagaaatttggaaa

SEQ ID NO: 93351 - DNA, 20 bp, synthetic construct
  misc_feature 1..20: note = CRISPR gRNA sequence
  source 1..20: mol_type = other DNA
ggaaagataggttgaagcca

SEQ ID NO: 93352 - DNA, 20 bp, synthetic construct
  misc_feature 1..20: note = CRISPR gRNA sequence
  source 1..20: mol_type = other DNA
gaaagataggttgaagccag

SEQ ID NO: 93353 - DNA, 20 bp, synthetic construct
  misc_feature 1..20: note = CRISPR gRNA sequence
  source 1..20: mol_type = other DNA
aagccagttttttatagtat

SEQ ID NO: 93354 - DNA, 20 bp, synthetic construct
  misc_feature 1..20: note = CRISPR gRNA sequence
  source 1..20: mol_type = other DNA
tttatagtattgaatgccag

SEQ ID NO: 93355 - DNA, 20 bp, synthetic construct
  misc_feature 1..20: note = CRISPR gRNA sequence
  source 1..20: mol_type = other DNA
ttatagtattgaatgccagg

SEQ ID NO: 93356 - DNA, 20 bp, synthetic construct
  misc_feature 1..20: note = CRISPR gRNA sequence
  source 1..20: mol_type = other DNA
tatagtattgaatgccaggc

SEQ ID NO: 93357 - DNA, 20 bp, synthetic construct
  misc_feature 1..20: note = CRISPR gRNA sequence
  source 1..20: mol_type = other DNA
atagtattgaatgccaggct

SEQ ID NO: 93358 - DNA, 20 bp, synthetic construct
  misc_feature 1..20: note = CRISPR gRNA sequence
  source 1..20: mol_type = other DNA
tagtattgaatgccaggcta

SEQ ID NO: 93359 - DNA, 20 bp, synthetic construct
  misc_feature 1..20: note = CRISPR gRNA sequence
  source 1..20: mol_type = other DNA
aatgccaggctatgggattt

SEQ ID NO: 93360 - DNA, 20 bp, synthetic construct
  misc_feature 1..20: note = CRISPR gRNA sequence
  source 1..20: mol_type = other DNA
tgggatttggatttggagtc

SEQ ID NO: 93361 - DNA, 20 bp, synthetic construct
  misc_feature 1..20: note = CRISPR gRNA sequence
  source 1..20: mol_type = other DNA
ggatttggagtctttaaatg

SEQ ID NO: 93362 - DNA, 20 bp, synthetic construct
  misc_feature 1..20: note = CRISPR gRNA sequence
  source 1..20: mol_type = other DNA
gatttggagtctttaaatga

SEQ ID NO: 93363 - DNA, 20 bp, synthetic construct
  misc_feature 1..20: note = CRISPR gRNA sequence
  source 1..20: mol_type = other DNA
ggagtctttaaatgaaatga

SEQ ID NO: 93364 - DNA, 20 bp, synthetic construct
  misc_feature 1..20: note = CRISPR gRNA sequence
  source 1..20: mol_type = other DNA
gagtctttaaatgaaatgat

SEQ ID NO: 93365 - DNA, 20 bp, synthetic construct
  misc_feature 1..20: note = CRISPR gRNA sequence
  source 1..20: mol_type = other DNA
taaatgaaatgatctaatta

SEQ ID NO: 93366 - DNA, 20 bp, synthetic construct
  misc_feature 1..20: note = CRISPR gRNA sequence
  source 1..20: mol_type = other DNA
aaatgaaatgatctaattag

SEQ ID NO: 93367 - DNA, 20 bp, synthetic construct
  misc_feature 1..20: note = CRISPR gRNA sequence
  source 1..20: mol_type = other DNA
aatgaaatgatctaattagg

SEQ ID NO: 93368 - DNA, 20 bp, synthetic construct
  misc_feature 1..20: note = CRISPR gRNA sequence
  source 1..20: mol_type = other DNA
attaggaagtagcagaggat

SEQ ID NO: 93369 - DNA, 20 bp, synthetic construct
  misc_feature 1..20: note = CRISPR gRNA sequence
  source 1..20: mol_type = other DNA
ggaagtagcagaggatccta

SEQ ID NO: 93370 - DNA, 20 bp, synthetic construct
  misc_feature 1..20: note = CRISPR gRNA sequence
  source 1..20: mol_type = other DNA
ccctgatggagtgggttaaa

SEQ ID NO: 93371 - DNA, 20 bp, synthetic construct
  misc_feature 1..20: note = CRISPR gRNA sequence
  source 1..20: mol_type = other DNA
atggagtgggttaaagttga

SEQ ID NO: 93372 - DNA, 20 bp, synthetic construct
  misc_feature 1..20: note = CRISPR gRNA sequence
  source 1..20: mol_type = other DNA
aagttgagagcctatagatt

SEQ ID NO: 93373 - DNA, 20 bp, synthetic construct
  misc_feature 1..20: note = CRISPR gRNA sequence
  source 1..20: mol_type = other DNA
agagcctatagattttgaga

SEQ ID NO: 93374 - DNA, 20 bp, synthetic construct
  misc_feature 1..20: note = CRISPR gRNA sequence
  source 1..20: mol_type = other DNA
tagattttgagactctttcg

SEQ ID NO: 93375 - DNA, 20 bp, synthetic construct
  misc_feature 1..20: note = CRISPR gRNA sequence
  source 1..20: mol_type = other DNA
tgagactctttcgaagatta

SEQ ID NO: 93376 - DNA, 20 bp, synthetic construct
  misc_feature 1..20: note = CRISPR gRNA sequence
  source 1..20: mol_type = other DNA
gagactctttcgaagattat

SEQ ID NO: 93377 - DNA, 20 bp, synthetic construct
  misc_feature 1..20: note = CRISPR gRNA sequence
  source 1..20: mol_type = other DNA
agactctttcgaagattatt

SEQ ID NO: 93378 - DNA, 20 bp, synthetic construct
  misc_feature 1..20: note = CRISPR gRNA sequence
  source 1..20: mol_type = other DNA
tttcgaagattattatagta

SEQ ID NO: 93379 - DNA, 20 bp, synthetic construct
  misc_feature 1..20: note = CRISPR gRNA sequence
  source 1..20: mol_type = other DNA
tcgaagattattatagtagg

SEQ ID NO: 93380 - DNA, 20 bp, synthetic construct
  misc_feature 1..20: note = CRISPR gRNA sequence
  source 1..20: mol_type = other DNA
cgaagattattatagtagga

SEQ ID NO: 93381 - DNA, 20 bp, synthetic construct
  misc_feature 1..20: note = CRISPR gRNA sequence
  source 1..20: mol_type = other DNA
gaagattattatagtaggac

SEQ ID NO: 93382 - DNA, 20 bp, synthetic construct
  misc_feature 1..20: note = CRISPR gRNA sequence
  source 1..20: mol_type = other DNA
ttatagtaggactgacaggt

SEQ ID NO: 93383 - DNA, 20 bp, synthetic construct
  misc_feature 1..20: note = CRISPR gRNA sequence
  source 1..20: mol_type = other DNA
tagtaggactgacaggtgat

SEQ ID NO: 93384 - DNA, 20 bp, synthetic construct
  misc_feature 1..20: note = CRISPR gRNA sequence
  source 1..20: mol_type = other DNA
acaggtgatgatggtgtctt

SEQ ID NO: 93385 - DNA, 20 bp, synthetic construct
  misc_feature 1..20: note = CRISPR gRNA sequence
  source 1..20: mol_type = other DNA
ctgctatgttgtgagcagca

SEQ ID NO: 93386 - DNA, 20 bp, synthetic construct
  misc_feature 1..20: note = CRISPR gRNA sequence
  source 1..20: mol_type = other DNA
tgctatgttgtgagcagcaa

SEQ ID NO: 93387 - DNA, 20 bp, synthetic construct
  misc_feature 1..20: note = CRISPR gRNA sequence
  source 1..20: mol_type = other DNA
ctatgttgtgagcagcaaga

SEQ ID NO: 93388 - DNA, 20 bp, synthetic construct
  misc_feature 1..20: note = CRISPR gRNA sequence
  source 1..20: mol_type = other DNA
tgttgtgagcagcaagatta

SEQ ID NO: 93389 - DNA, 20 bp, synthetic construct
  misc_feature 1..20: note = CRISPR gRNA sequence
  source 1..20: mol_type = other DNA
tgagcagcaagattagaaat

SEQ ID NO: 93390 - DNA, 20 bp, synthetic construct
  misc_feature 1..20: note = CRISPR gRNA sequence
  source 1..20: mol_type = other DNA
gaaattaagttctctattcc

SEQ ID NO: 93391 - DNA, 20 bp, synthetic construct
  misc_feature 1..20: note = CRISPR gRNA sequence
  source 1..20: mol_type = other DNA
agttctctattccaatgaag

SEQ ID NO: 93392 - DNA, 20 bp, synthetic construct
  misc_feature 1..20: note = CRISPR gRNA sequence
  source 1..20: mol_type = other DNA
tctattccaatgaagaattt

SEQ ID NO: 93393 - DNA, 20 bp, synthetic construct
  misc_feature 1..20: note = CRISPR gRNA sequence
  source 1..20: mol_type = other DNA
tattccaatgaagaatttat

SEQ ID NO: 93394 - DNA, 20 bp, synthetic construct
  misc_feature 1..20: note = CRISPR gRNA sequence
  source 1..20: mol_type = other DNA
ttccaatgaagaatttatta

SEQ ID NO: 93395 - DNA, 20 bp, synthetic construct
  misc_feature 1..20: note = CRISPR gRNA sequence
  source 1..20: mol_type = other DNA
caatgaagaatttattaagg

SEQ ID NO: 93396 - DNA, 20 bp, synthetic construct
  misc_feature 1..20: note = CRISPR gRNA sequence
  source 1..20: mol_type = other DNA
attaaggtaaaaaaattaaa

SEQ ID NO: 93397 - DNA, 20 bp, synthetic construct
  misc_feature 1..20: note = CRISPR gRNA sequence
  source 1..20: mol_type = other DNA
ttaaggtaaaaaaattaaag

SEQ ID NO: 93398 - DNA, 20 bp, synthetic construct
  misc_feature 1..20: note = CRISPR gRNA sequence
  source 1..20: mol_type = other DNA
aggtaaaaaaattaaagaaa

SEQ ID NO: 93399 - DNA, 20 bp, synthetic construct
  misc_feature 1..20: note = CRISPR gRNA sequence
  source 1..20: mol_type = other DNA
aagaaattaaggtatctaaa

SEQ ID NO: 93400 - DNA, 20 bp, synthetic construct
  misc_feature 1..20: note = CRISPR gRNA sequence
  source 1..20: mol_type = other DNA
aggtatctaaaattaatatt

SEQ ID NO: 93401 - DNA, 20 bp, synthetic construct
  misc_feature 1..20: note = CRISPR gRNA sequence
  source 1..20: mol_type = other DNA
aaattaatatttcttacaca

SEQ ID NO: 93402 - DNA, 20 bp, synthetic construct
  misc_feature 1..20: note = CRISPR gRNA sequence
  source 1..20: mol_type = other DNA
atatttcttacacaagtcaa

SEQ ID NO: 93403 - DNA, 20 bp, synthetic construct
  misc_feature 1..20: note = CRISPR gRNA sequence
  source 1..20: mol_type = other DNA
cttacacaagtcaaggttaa

SEQ ID NO: 93404 - DNA, 20 bp, synthetic construct
  misc_feature 1..20: note = CRISPR gRNA sequence
  source 1..20: mol_type = other DNA
ttacacaagtcaaggttaaa

SEQ ID NO: 93405 - DNA, 20 bp, synthetic construct
  misc_feature 1..20: note = CRISPR gRNA sequence
  source 1..20: mol_type = other DNA
acacaagtcaaggttaaatg

SEQ ID NO: 93406 - DNA, 20 bp, synthetic construct
  misc_feature 1..20: note = CRISPR gRNA sequence
  source 1..20: mol_type = other DNA
cacaagtcaaggttaaatga

SEQ ID NO: 93407 - DNA, 20 bp, synthetic construct
  misc_feature 1..20: note = CRISPR gRNA sequence
  source 1..20: mol_type = other DNA
aatgaggaacaaatgtgtat

SEQ ID NO: 93408 - DNA, 20 bp, synthetic construct
  misc_feature 1..20: note = CRISPR gRNA sequence
  source 1..20: mol_type = other DNA
ctccaccaatctaagaacta

SEQ ID NO: 93409 - DNA, 20 bp, synthetic construct
  misc_feature 1..20: note = CRISPR gRNA sequence
  source 1..20: mol_type = other DNA
caccaatctaagaactatgc

SEQ ID NO: 93410 - DNA, 20 bp, synthetic construct
  misc_feature 1..20: note = CRISPR gRNA sequence
  source 1..20: mol_type = other DNA
agaactatgctatatgagag

SEQ ID NO: 93411 - DNA, 20 bp, synthetic construct
  misc_feature 1..20: note = CRISPR gRNA sequence
  source 1..20: mol_type = other DNA
tgctatatgagagacacata

SEQ ID NO: 93412 - DNA, 20 bp, synthetic construct
  misc_feature 1..20: note = CRISPR gRNA sequence
  source 1..20: mol_type = other DNA
tatgagagacacataaaggg

SEQ ID NO: 93413 - DNA, 20 bp, synthetic construct
  misc_feature 1..20: note = CRISPR gRNA sequence
  source 1..20: mol_type = other DNA
gggataaatgaattgacctc

SEQ ID NO: 93414 - DNA, 20 bp, synthetic construct
  misc_feature 1..20: note = CRISPR gRNA sequence
  source 1..20: mol_type = other DNA
acctctgctggtgggattgt

SEQ ID NO: 93415 - DNA, 20 bp, synthetic construct
  misc_feature 1..20: note = CRISPR gRNA sequence
  source 1..20: mol_type = other DNA
tgctggtgggattgttctta

SEQ ID NO: 93416 - DNA, 20 bp, synthetic construct
  misc_feature 1..20: note = CRISPR gRNA sequence
  source 1..20: mol_type = other DNA
ctggtgggattgttcttatt

SEQ ID NO: 93417 - DNA, 20 bp, synthetic construct
  misc_feature 1..20: note = CRISPR gRNA sequence
  source 1..20: mol_type = other DNA
gtgggattgttcttattaaa

SEQ ID NO: 93418 - DNA, 20 bp, synthetic construct
  misc_feature 1..20: note = CRISPR gRNA sequence
  source 1..20: mol_type = other DNA
ttcttattaaatatctaaaa

SEQ ID NO: 93419 - DNA, 20 bp, synthetic construct
  misc_feature 1..20: note = CRISPR gRNA sequence
  source 1..20: mol_type = other DNA
ttattaaatatctaaaaagc

SEQ ID NO: 93420 - DNA, 20 bp, synthetic construct
  misc_feature 1..20: note = CRISPR gRNA sequence
  source 1..20: mol_type = other DNA
attaaatatctaaaaagcta

SEQ ID NO: 93421 - DNA, 20 bp, synthetic construct
  misc_feature 1..20: note = CRISPR gRNA sequence
  source 1..20: mol_type = other DNA
ttaaatatctaaaaagctat

SEQ ID NO: 93422 - DNA, 20 bp, synthetic construct
  misc_feature 1..20: note = CRISPR gRNA sequence
  source 1..20: mol_type = other DNA
aatatctaaaaagctatcat

SEQ ID NO: 93423 - DNA, 20 bp, synthetic construct
  misc_feature 1..20: note = CRISPR gRNA sequence
  source 1..20: mol_type = other DNA
aaaagctatcatttaagaga

SEQ ID NO: 93424 - DNA, 20 bp, synthetic construct
  misc_feature 1..20: note = CRISPR gRNA sequence
  source 1..20: mol_type = other DNA
tcatttaagagaagcagtag

SEQ ID NO: 93425 - DNA, 20 bp, synthetic construct
  misc_feature 1..20: note = CRISPR gRNA sequence
  source 1..20: mol_type = other DNA
aagagaagcagtagacttat

SEQ ID NO: 93426 - DNA, 20 bp, synthetic construct
  misc_feature 1..20: note = CRISPR gRNA sequence
  source 1..20: mol_type = other DNA
agagaagcagtagacttata

SEQ ID NO: 93427 - DNA, 20 bp, synthetic construct
  misc_feature 1..20: note = CRISPR gRNA sequence
  source 1..20: mol_type = other DNA
atatggcatgattctgaggt

SEQ ID NO: 93428 - DNA, 20 bp, synthetic construct
  misc_feature 1..20: note = CRISPR gRNA sequence
  source 1..20: mol_type = other DNA
tatggcatgattctgaggta

SEQ ID NO: 93429 - DNA, 20 bp, synthetic construct
  misc_feature 1..20: note = CRISPR gRNA sequence
  source 1..20: mol_type = other DNA
tgaggtaactaggactctta

SEQ ID NO: 93430 - DNA, 20 bp, synthetic construct
  misc_feature 1..20: note = CRISPR gRNA sequence
  source 1..20: mol_type = other DNA
aggtaactaggactcttagg

SEQ ID NO: 93431 - DNA, 20 bp, synthetic construct
  misc_feature 1..20: note = CRISPR gRNA sequence
  source 1..20: mol_type = other DNA
ggactcttaggcataaatca

SEQ ID NO: 93432 - DNA, 20 bp, synthetic construct
  misc_feature 1..20: note = CRISPR gRNA sequence
  source 1..20: mol_type = other DNA
ttaggcataaatcacaagga

SEQ ID NO: 93433 - DNA, 20 bp, synthetic construct
  misc_feature 1..20: note = CRISPR gRNA sequence
  source 1..20: mol_type = other DNA
aggcataaatcacaaggagt

SEQ ID NO: 93434 - DNA, 20 bp, synthetic construct
  misc_feature 1..20: note = CRISPR gRNA sequence
  source 1..20: mol_type = other DNA
ggcataaatcacaaggagta

SEQ ID NO: 93435 - DNA, 20 bp, synthetic construct
  misc_feature 1..20: note = CRISPR gRNA sequence
  source 1..20: mol_type = other DNA
cagctcagcttaagtaaagc

SEQ ID NO: 93436 - DNA, 20 bp, synthetic construct
  misc_feature 1..20: note = CRISPR gRNA sequence
  source 1..20: mol_type = other DNA
agctcagcttaagtaaagct

SEQ ID NO: 93437 - DNA, 20 bp, synthetic construct
  misc_feature 1..20: note = CRISPR gRNA sequence
  source 1..20: mol_type = other DNA
agcttaagtaaagctaccta

SEQ ID NO: 93438 - DNA, 20 bp, synthetic construct
  misc_feature 1..20: note = CRISPR gRNA sequence
  source 1..20: mol_type = other DNA
aagtaaagctacctaacatt

SEQ ID NO: 93439 - DNA, 20 bp, synthetic construct
  misc_feature 1..20: note = CRISPR gRNA sequence
  source 1..20: mol_type = other DNA
agtaaagctacctaacattc

SEQ ID NO: 93440 - DNA, 20 bp, synthetic construct
  misc_feature 1..20: note = CRISPR gRNA sequence
  source 1..20: mol_type = other DNA
cctaacattctaccgaaatg

SEQ ID NO: 93441 - DNA, 20 bp, synthetic construct
  misc_feature 1..20: note = CRISPR gRNA sequence
  source 1..20: mol_type = other DNA
acattctaccgaaatgttag

SEQ ID NO: 93442 - DNA, 20 bp, synthetic construct
  misc_feature 1..20: note = CRISPR gRNA sequence
  source 1..20: mol_type = other DNA
taccgaaatgttagagctat

SEQ ID NO: 93443 - DNA, 20 bp, synthetic construct
  misc_feature 1..20: note = CRISPR gRNA sequence
  source 1..20: mol_type = other DNA
ccgaaatgttagagctattc

SEQ ID NO: 93444 - DNA, 20 bp, synthetic construct
  misc_feature 1..20: note = CRISPR gRNA sequence
  source 1..20: mol_type = other DNA
gagctattcaaaaccaaatg

SEQ ID NO: 93445 - DNA, 20 bp, synthetic construct
  misc_feature 1..20: note = CRISPR gRNA sequence
  source 1..20: mol_type = other DNA
ttcaaaaccaaatgaaatgt

SEQ ID NO: 93446 - DNA, 20 bp, synthetic construct
  misc_feature 1..20: note = CRISPR gRNA sequence
  source 1..20: mol_type = other DNA
aaaaccaaatgaaatgtggc

SEQ ID NO: 93447 - DNA, 20 bp, synthetic construct
  misc_feature 1..20: note = CRISPR gRNA sequence
  source 1..20: mol_type = other DNA
gtaaactctgtaggacaaaa

SEQ ID NO: 93448 - DNA, 20 bp, synthetic construct
  misc_feature 1..20: note = CRISPR gRNA sequence
  source 1..20: mol_type = other DNA
tgtaggacaaaaagcattgc

SEQ ID NO: 93449 - DNA, 20 bp, synthetic construct
  misc_feature 1..20: note = CRISPR gRNA sequence
  source 1..20: mol_type = other DNA
taggacaaaaagcattgcag

SEQ ID NO: 93450 - DNA, 20 bp, synthetic construct
  misc_feature 1..20: note = CRISPR gRNA sequence
  source 1..20: mol_type = other DNA
caggtttttgaaaaagaatt

SEQ ID NO: 93451 - DNA, 20 bp, synthetic construct
  misc_feature 1..20: note = CRISPR gRNA sequence
  source 1..20: mol_type = other DNA
ttgaaaaagaattccaacat

SEQ ID NO: 93452 - DNA, 20 bp, synthetic construct
  misc_feature 1..20: note = CRISPR gRNA sequence
  source 1..20: mol_type = other DNA
tgaaaaagaattccaacatc

SEQ ID NO: 93453 - DNA, 20 bp, synthetic construct
  misc_feature 1..20: note = CRISPR gRNA sequence
  source 1..20: mol_type = other DNA
gaaaaagaattccaacatct

SEQ ID NO: 93454 - DNA, 20 bp, synthetic construct
  misc_feature 1..20: note = CRISPR gRNA sequence
  source 1..20: mol_type = other DNA
aaaaagaattccaacatctg

SEQ ID NO: 93455 - DNA, 20 bp, synthetic construct
  misc_feature 1..20: note = CRISPR gRNA sequence
  source 1..20: mol_type = other DNA
caacatctgtacaagtttgg

SEQ ID NO: 93456 - DNA, 20 bp, synthetic construct
  misc_feature 1..20: note = CRISPR gRNA sequence
  source 1..20: mol_type = other DNA
tacaagtttggactagatga

SEQ ID NO: 93457 - DNA, 20 bp, synthetic construct
  misc_feature 1..20: note = CRISPR gRNA sequence
  source 1..20: mol_type = other DNA
ggactagatgactaaaggtt

SEQ ID NO: 93458 - DNA, 20 bp, synthetic construct
  misc_feature 1..20: note = CRISPR gRNA sequence
  source 1..20: mol_type = other DNA
gactagatgactaaaggtta

SEQ ID NO: 93459 - DNA, 20 bp, synthetic construct
  misc_feature 1..20: note = CRISPR gRNA sequence
  source 1..20: mol_type = other DNA
gatgactaaaggttattttc

SEQ ID NO: 93460 - DNA, 20 bp, synthetic construct
  misc_feature 1..20: note = CRISPR gRNA sequence
  source 1..20: mol_type = other DNA
aaggttattttcactacaag

SEQ ID NO: 93461 - DNA, 20 bp, synthetic construct
  misc_feature 1..20: note = CRISPR gRNA sequence
  source 1..20: mol_type = other DNA
ttttcactacaagcttcttt

SEQ ID NO: 93462 - DNA, 20 bp, synthetic construct
  misc_feature 1..20: note = CRISPR gRNA sequence
  source 1..20: mol_type = other DNA
tcactacaagcttctttatc

SEQ ID NO: 93463 - DNA, 20 bp, synthetic construct
  misc_feature 1..20: note = CRISPR gRNA sequence
  source 1..20: mol_type = other DNA
cactacaagcttctttatct

SEQ ID NO: 93464 - DNA, 20 bp, synthetic construct
  misc_feature 1..20: note = CRISPR gRNA sequence
  source 1..20: mol_type = other DNA
actacaagcttctttatcta

SEQ ID NO: 93465 - DNA, 20 bp, synthetic construct
  misc_feature 1..20: note = CRISPR gRNA sequence
  source 1..20: mol_type = other DNA
caagcttctttatctaattc

SEQ ID NO: 93466 - DNA, 20 bp, synthetic construct
  misc_feature 1..20: note = CRISPR gRNA sequence
  source 1..20: mol_type = other DNA
ctttatctaattcagtatct

SEQ ID NO: 93467 - DNA, 20 bp, synthetic construct
  misc_feature 1..20: note = CRISPR gRNA sequence
  source 1..20: mol_type = other DNA
tttatctaattcagtatcta

SEQ ID NO: 93468 - DNA, 20 bp, synthetic construct
  misc_feature 1..20: note = CRISPR gRNA sequence
  source 1..20: mol_type = other DNA
tatctaattcagtatctaat

SEQ ID NO: 93469 - DNA, 20 bp, synthetic construct
  misc_feature 1..20: note = CRISPR gRNA sequence
  source 1..20: mol_type = other DNA
atctaattcagtatctaata

SEQ ID NO: 93470 - DNA, 20 bp, synthetic construct
  misc_feature 1..20: note = CRISPR gRNA sequence
  source 1..20: mol_type = other DNA
tctaattcagtatctaatat

SEQ ID NO: 93471 - DNA, 20 bp, synthetic construct
  misc_feature 1..20: note = CRISPR gRNA sequence
  source 1..20: mol_type = other DNA
attcagtatctaatattttg

SEQ ID NO: 93472 - DNA, 20 bp, synthetic construct
  misc_feature 1..20: note = CRISPR gRNA sequence
  source 1..20: mol_type = other DNA
agtatctaatattttgtgaa

SEQ ID NO: 93473 - DNA, 20 bp, synthetic construct
  misc_feature 1..20: note = CRISPR gRNA sequence
  source 1..20: mol_type = other DNA
atattttgtgaattaacctt

SEQ ID NO: 93474 - DNA, 20 bp, synthetic construct
  misc_feature 1..20: note = CRISPR gRNA sequence
  source 1..20: mol_type = other DNA
tgtgaattaaccttttgaat

SEQ ID NO: 93475 - DNA, 20 bp, synthetic construct
  misc_feature 1..20: note = CRISPR gRNA sequence
  source 1..20: mol_type = other DNA
gtgaattaaccttttgaatt

SEQ ID NO: 93476 - DNA, 20 bp, synthetic construct
  misc_feature 1..20: note = CRISPR gRNA sequence
  source 1..20: mol_type = other DNA
tgaattaaccttttgaattt

SEQ ID NO: 93477 - DNA, 20 bp, synthetic construct
  misc_feature 1..20: note = CRISPR gRNA sequence
  source 1..20: mol_type = other DNA
accttttgaatttccatagt

SEQ ID NO: 93478 - DNA, 20 bp, synthetic construct
  misc_feature 1..20: note = CRISPR gRNA sequence
  source 1..20: mol_type = other DNA
ttgaatttccatagtggggt

SEQ ID NO: 93479 - DNA, 20 bp, synthetic construct
  misc_feature 1..20: note = CRISPR gRNA sequence
  source 1..20: mol_type = other DNA
tgaatttccatagtggggtt

SEQ ID NO: 93480 - DNA, 20 bp, synthetic construct
  misc_feature 1..20: note = CRISPR gRNA sequence
  source 1..20: mol_type = other DNA
gaatttccatagtggggttg

SEQ ID NO: 93481 - DNA, 20 bp, synthetic construct
  misc_feature 1..20: note = CRISPR gRNA sequence
  source 1..20: mol_type = other DNA
aatttccatagtggggttgt

SEQ ID NO: 93482 - DNA, 20 bp, synthetic construct
  misc_feature 1..20: note = CRISPR gRNA sequence
  source 1..20: mol_type = other DNA
ccatagtggggttgtgaggg

SEQ ID NO: 93483 - DNA, 20 bp, synthetic construct
  misc_feature 1..20: note = CRISPR gRNA sequence
  source 1..20: mol_type = other DNA
catagtggggttgtgagggc

SEQ ID NO: 93484 - DNA, 20 bp, synthetic construct
  misc_feature 1..20: note = CRISPR gRNA sequence
  source 1..20: mol_type = other DNA
tgagggcagagggtactgta

SEQ ID NO: 93485 - DNA, 20 bp, synthetic construct
  misc_feature 1..20: note = CRISPR gRNA sequence
  source 1..20: mol_type = other DNA
taccatcaagtcaatttcag

SEQ ID NO: 93486 - DNA, 20 bp, synthetic construct
  misc_feature 1..20: note = CRISPR gRNA sequence
  source 1..20: mol_type = other DNA
cagcattccattatcttgca

SEQ ID NO: 93487 - DNA, 20 bp, synthetic construct
  misc_feature 1..20: note = CRISPR gRNA sequence
  source 1..20: mol_type = other DNA
agcattccattatcttgcac

SEQ ID NO: 93488 - DNA, 20 bp, synthetic construct
  misc_feature 1..20: note = CRISPR gRNA sequence
  source 1..20: mol_type = other DNA
cattatcttgcacataaaaa

SEQ ID NO: 93489 - DNA, 20 bp, synthetic construct
  misc_feature 1..20: note = CRISPR gRNA sequence
  source 1..20: mol_type = other DNA
tcttgcacataaaaatgaaa

SEQ ID NO: 93490 - DNA, 20 bp, synthetic construct
  misc_feature 1..20: note = CRISPR gRNA sequence
  source 1..20: mol_type = other DNA
gcacataaaaatgaaagaat

SEQ ID NO: 93491 - DNA, 20 bp, synthetic construct
  misc_feature 1..20: note = CRISPR gRNA sequence
  source 1..20: mol_type = other DNA
cacataaaaatgaaagaatc

SEQ ID NO: 93492 - DNA, 20 bp, synthetic construct
  misc_feature 1..20: note = CRISPR gRNA sequence
  source 1..20: mol_type = other DNA
ataaataaaatcaacttggg

SEQ ID NO: 93493 - DNA, 20 bp, synthetic construct
  misc_feature 1..20: note = CRISPR gRNA sequence
  source 1..20: mol_type = other DNA
gggggttgctggaggaggaa

SEQ ID NO: 93494 - DNA, 20 bp, synthetic construct
  misc_feature 1..20: note = CRISPR gRNA sequence
  source 1..20: mol_type = other DNA
ggggttgctggaggaggaag

SEQ ID NO: 93495 - DNA, 20 bp, synthetic construct
  misc_feature 1..20: note = CRISPR gRNA sequence
  source 1..20: mol_type = other DNA
ctggaggaggaagaaattat

SEQ ID NO: 93496 - DNA, 20 bp, synthetic construct
  misc_feature 1..20: note = CRISPR gRNA sequence
  source 1..20: mol_type = other DNA
gaggaggaagaaattatttt

SEQ ID NO: 93497 - DNA, 20 bp, synthetic construct
  misc_feature 1..20: note = CRISPR gRNA sequence
  source 1..20: mol_type = other DNA
tttttgtttcctctgggtat

SEQ ID NO: 93498 - DNA, 20 bp, synthetic construct
  misc_feature 1..20: note = CRISPR gRNA sequence
  source 1..20: mol_type = other DNA
ttgtttcctctgggtattag

SEQ ID NO: 93499 - DNA, 20 bp, synthetic construct
  misc_feature 1..20: note = CRISPR gRNA sequence
  source 1..20: mol_type = other DNA
tgtttcctctgggtattaga

SEQ ID NO: 93500 - DNA, 20 bp, synthetic construct
  misc_feature 1..20: note = CRISPR gRNA sequence
  source 1..20: mol_type = other DNA
gtttcctctgggtattagaa

SEQ ID NO: 93501 - DNA, 20 bp, synthetic construct
  misc_feature 1..20: note = CRISPR gRNA sequence
  source 1..20: mol_type = other DNA
tttcctctgggtattagaat

SEQ ID NO: 93502 - DNA, 20 bp, synthetic construct
  misc_feature 1..20: note = CRISPR gRNA sequence
  source 1..20: mol_type = other DNA
cctctgggtattagaatttt

SEQ ID NO: 93503 - DNA, 20 bp, synthetic construct
  misc_feature 1..20: note = CRISPR gRNA sequence
  source 1..20: mol_type = other DNA
ctctgggtattagaattttc

SEQ ID NO: 93504 - DNA, 20 bp, synthetic construct
  misc_feature 1..20: note = CRISPR gRNA sequence
  source 1..20: mol_type = other DNA
tgggtattagaattttcttt

SEQ ID NO: 93505 - DNA, 20 bp, synthetic construct
  misc_feature 1..20: note = CRISPR gRNA sequence
  source 1..20: mol_type = other DNA
ggtattagaattttcttttt

SEQ ID NO: 93506 - DNA, 20 bp, synthetic construct
  misc_feature 1..20: note = CRISPR gRNA sequence
  source 1..20: mol_type = other DNA
gaattttctttttacagttt

SEQ ID NO: 93507 - DNA, 20 bp, synthetic construct
  misc_feature 1..20: note = CRISPR gRNA sequence
  source 1..20: mol_type = other DNA
tctttttacagtttttatat

SEQ ID NO: 93508 - DNA, 20 bp, synthetic construct
  misc_feature 1..20: note = CRISPR gRNA sequence
  source 1..20: mol_type = other DNA
ctttttacagtttttatatg

SEQ ID NO: 93509 - DNA, 20 bp, synthetic construct
  misc_feature 1..20: note = CRISPR gRNA sequence
  source 1..20: mol_type = other DNA
tttttacagtttttatatgt

SEQ ID NO: 93510 - DNA, 20 bp, synthetic construct
  misc_feature 1..20: note = CRISPR gRNA sequence
  source 1..20: mol_type = other DNA
tttacagtttttatatgttg

SEQ ID NO: 93511 - DNA, 20 bp, synthetic construct
  misc_feature 1..20: note = CRISPR gRNA sequence
  source 1..20: mol_type = other DNA
ttacagtttttatatgttga

SEQ ID NO: 93512 - DNA, 20 bp, synthetic construct
  misc_feature 1..20: note = CRISPR gRNA sequence
  source 1..20: mol_type = other DNA
tacagtttttatatgttgag

SEQ ID NO: 93513 - DNA, 20 bp, synthetic construct
  misc_feature 1..20: note = CRISPR gRNA sequence
  source 1..20: mol_type = other DNA
acagtttttatatgttgagg

SEQ ID NO: 93514 - DNA, 20 bp, synthetic construct
  misc_feature 1..20: note = CRISPR gRNA sequence
  source 1..20: mol_type = other DNA
cagtttttatatgttgaggc

SEQ ID NO: 93515 - DNA, 20 bp, synthetic construct
  misc_feature 1..20: note = CRISPR gRNA sequence
  source 1..20: mol_type = other DNA
ttatatgttgaggcctaaaa

SEQ ID NO: 93516 - DNA, 20 bp, synthetic construct
  misc_feature 1..20: note = CRISPR gRNA sequence
  source 1..20: mol_type = other DNA
tatatgttgaggcctaaaat

SEQ ID NO: 93517 - DNA, 20 bp, synthetic construct
  misc_feature 1..20: note = CRISPR gRNA sequence
  source 1..20: mol_type = other DNA
atatgttgaggcctaaaatg

SEQ ID NO: 93518 - DNA, 20 bp, synthetic construct
  misc_feature 1..20: note = CRISPR gRNA sequence
  source 1..20: mol_type = other DNA
tatgttgaggcctaaaatgt

SEQ ID NO: 93519 - DNA, 20 bp, synthetic construct
  misc_feature 1..20: note = CRISPR gRNA sequence
  source 1..20: mol_type = other DNA
aggcctaaaatgtttagggg

SEQ ID NO: 93520 - DNA, 20 bp, synthetic construct
  misc_feature 1..20: note = CRISPR gRNA sequence
  source 1..20: mol_type = other DNA
aaatgtttaggggtgaaata

SEQ ID NO: 93521 - DNA, 20 bp, synthetic construct
  misc_feature 1..20: note = CRISPR gRNA sequence
  source 1..20: mol_type = other DNA
aggggtgaaatatttttgta

SEQ ID NO: 93522 - DNA, 20 bp, synthetic construct
  misc_feature 1..20: note = CRISPR gRNA sequence
  source 1..20: mol_type = other DNA
ggggtgaaatatttttgtaa

SEQ ID NO: 93523 - DNA, 20 bp, synthetic construct
  misc_feature 1..20: note = CRISPR gRNA sequence
  source 1..20: mol_type = other DNA
ttgtaatatcaggttggtaa

SEQ ID NO: 93524 - DNA, 20 bp, synthetic construct
  misc_feature 1..20: note = CRISPR gRNA sequence
  source 1..20: mol_type = other DNA
tgtaatatcaggttggtaaa

SEQ ID NO: 93525 - DNA, 20 bp, synthetic construct
  misc_feature 1..20: note = CRISPR gRNA sequence
  source 1..20: mol_type = other DNA
gtaatatcaggttggtaaac

SEQ ID NO: 93526 - DNA, 20 bp, synthetic construct
  misc_feature 1..20: note = CRISPR gRNA sequence
  source 1..20: mol_type = other DNA
taatatcaggttggtaaact

SEQ ID NO: 93527 - DNA, 20 bp, synthetic construct
  misc_feature 1..20: note = CRISPR gRNA sequence
  source 1..20: mol_type = other DNA
gtaaacttctcataatgaaa

SEQ ID NO: 93528 - DNA, 20 bp, synthetic construct
  misc_feature 1..20: note = CRISPR gRNA sequence
  source 1..20: mol_type = other DNA
ctcataatgaaagaaattaa

SEQ ID NO: 93529 - DNA, 20 bp, synthetic construct
  misc_feature 1..20: note = CRISPR gRNA sequence
  source 1..20: mol_type = other DNA
tcataatgaaagaaattaag

SEQ ID NO: 93530 - DNA, 20 bp, synthetic construct
  misc_feature 1..20: note = CRISPR gRNA sequence
  source 1..20: mol_type = other DNA
ataatgaaagaaattaaggg

SEQ ID NO: 93531 - DNA, 20 bp, synthetic construct
  misc_feature 1..20: note = CRISPR gRNA sequence
  source 1..20: mol_type = other DNA
aggggatattctcatagata

SEQ ID NO: 93532 - DNA, 20 bp, synthetic construct
  misc_feature 1..20: note = CRISPR gRNA sequence
  source 1..20: mol_type = other DNA
tcatagataactcagaggcc

SEQ ID NO: 93533 - DNA, 20 bp, synthetic construct
  misc_feature 1..20: note = CRISPR gRNA sequence
  source 1..20: mol_type = other DNA
atagataactcagaggccag

SEQ ID NO: 93534 - DNA, 20 bp, synthetic construct
  misc_feature 1..20: note = CRISPR gRNA sequence
  source 1..20: mol_type = other DNA
agaggccagtagaaagaagc

SEQ ID NO: 93535 - DNA, 20 bp, synthetic construct
  misc_feature 1..20: note = CRISPR gRNA sequence
  source 1..20: mol_type = other DNA
taagtaaagaacaaagaggt

SEQ ID NO: 93536 - DNA, 20 bp, synthetic construct
  misc_feature 1..20: note = CRISPR gRNA sequence
  source 1..20: mol_type = other DNA
agtaaagaacaaagaggtta

SEQ ID NO: 93537 - DNA, 20 bp, synthetic construct
  misc_feature 1..20: note = CRISPR gRNA sequence
  source 1..20: mol_type = other DNA
aattcatgtaaggtatggct

SEQ ID NO: 93538 - DNA, 20 bp, synthetic construct
  misc_feature 1..20: note = CRISPR gRNA sequence
  source 1..20: mol_type = other DNA
atgtaaggtatggctttccg

SEQ ID NO: 93539 - DNA, 20 bp, synthetic construct
  misc_feature 1..20: note = CRISPR gRNA sequence
  source 1..20: mol_type = other DNA
tccggtaaaacatttataat

SEQ ID NO: 93540 - DNA, 20 bp, synthetic construct
  misc_feature 1..20: note = CRISPR gRNA sequence
  source 1..20: mol_type = other DNA
ccggtaaaacatttataatt

SEQ ID NO: 93541 - DNA, 20 bp, synthetic construct
  misc_feature 1..20: note = CRISPR gRNA sequence
  source 1..20: mol_type = other DNA
cggtaaaacatttataattt

SEQ ID NO: 93542 - DNA, 20 bp, synthetic construct
  misc_feature 1..20: note = CRISPR gRNA sequence
  source 1..20: mol_type = other DNA
ataattttatatttgctact

SEQ ID NO: 93543 - DNA, 20 bp, synthetic construct
  misc_feature 1..20: note = CRISPR gRNA sequence
  source 1..20: mol_type = other DNA
taattttatatttgctactt

SEQ ID NO: 93544 - DNA, 20 bp, synthetic construct
  misc_feature 1..20: note = CRISPR gRNA sequence
  source 1..20: mol_type = other DNA
tatatttgctactttagtaa

SEQ ID NO: 93545 - DNA, 20 bp, synthetic construct
  misc_feature 1..20: note = CRISPR gRNA sequence
  source 1..20: mol_type = other DNA
atatttgctactttagtaag

SEQ ID NO: 93546 - DNA, 20 bp, synthetic construct
  misc_feature 1..20: note = CRISPR gRNA sequence
  source 1..20: mol_type = other DNA
tatttgctactttagtaaga

SEQ ID NO: 93547 - DNA, 20 bp, synthetic construct
  misc_feature 1..20: note = CRISPR gRNA sequence
  source 1..20: mol_type = other DNA
gctactttagtaagaatttt

SEQ ID NO: 93548 - DNA, 20 bp, synthetic construct
  misc_feature 1..20: note = CRISPR gRNA sequence
  source 1..20: mol_type = other DNA
ctactttagtaagaattttg

SEQ ID NO: 93549 - DNA, 20 bp, synthetic construct
  misc_feature 1..20: note = CRISPR gRNA sequence
  source 1..20: mol_type = other DNA
ctttagtaagaattttggat

SEQ ID NO: 93550 - DNA, 20 bp, synthetic construct
  misc_feature 1..20: note = CRISPR gRNA sequence
  source 1..20: mol_type = other DNA
tagtaagaattttggatgtg

SEQ ID NO: 93551 - DNA, 20 bp, synthetic construct
  misc_feature 1..20: note = CRISPR gRNA sequence
  source 1..20: mol_type = other DNA
agtaagaattttggatgtgg

SEQ ID NO: 93552 - DNA, 20 bp, synthetic construct
  misc_feature 1..20: note = CRISPR gRNA sequence
  source 1..20: mol_type = other DNA
gtaagaattttggatgtggt

SEQ ID NO: 93553 - DNA, 20 bp, synthetic construct
  misc_feature 1..20: note = CRISPR gRNA sequence
  source 1..20: mol_type = other DNA
tggatgtggtattgtggcat

SEQ ID NO: 93554 - DNA, 20 bp, synthetic construct
  misc_feature 1..20: note = CRISPR gRNA sequence
  source 1..20: mol_type = other DNA
ggatgtggtattgtggcata

SEQ ID NO: 93555 - DNA, 20 bp, synthetic construct
  misc_feature 1..20: note = CRISPR gRNA sequence
  source 1..20: mol_type = other DNA
gatgtggtattgtggcatag

SEQ ID NO: 93556 - DNA, 20 bp, synthetic construct
  misc_feature 1..20: note = CRISPR gRNA sequence
  source 1..20: mol_type = other DNA
tggcatagttttgtaagagt

SEQ ID NO: 93557 - DNA, 20 bp, synthetic construct
  misc_feature 1..20: note = CRISPR gRNA sequence
  source 1..20: mol_type = other DNA
tgtaagagtcagaatatttc

SEQ ID NO: 93558 - DNA, 20 bp, synthetic construct
  misc_feature 1..20: note = CRISPR gRNA sequence
  source 1..20: mol_type = other DNA
gtaagagtcagaatatttca

SEQ ID NO: 93559 - DNA, 20 bp, synthetic construct
  misc_feature 1..20: note = CRISPR gRNA sequence
  source 1..20: mol_type = other DNA
taagagtcagaatatttcag

SEQ ID NO: 93560 - DNA, 20 bp, synthetic construct
  misc_feature 1..20: note = CRISPR gRNA sequence
  source 1..20: mol_type = other DNA
cagtcaactaaacaatattt

SEQ ID NO: 93561 - DNA, 20 bp, synthetic construct
  misc_feature 1..20: note = CRISPR gRNA sequence
  source 1..20: mol_type = other DNA
agtcaactaaacaatatttt

SEQ ID NO: 93562 - DNA, 20 bp, synthetic construct
  misc_feature 1..20: note = CRISPR gRNA sequence
  source 1..20: mol_type = other DNA
aacaatattttgttatgcca

SEQ ID NO: 93563 - DNA, 20 bp, synthetic construct
  misc_feature 1..20: note = CRISPR gRNA sequence
  source 1..20: mol_type = other DNA
tgttatgccagcaaaattac

SEQ ID NO: 93564 - DNA, 20 bp, synthetic construct
  misc_feature 1..20: note = CRISPR gRNA sequence
  source 1..20: mol_type = other DNA
gttatgccagcaaaattaca

SEQ ID NO: 93565 - DNA, 20 bp, synthetic construct
  misc_feature 1..20: note = CRISPR gRNA sequence
  source 1..20: mol_type = other DNA
ttatgccagcaaaattacaa

SEQ ID NO: 93566 - DNA, 20 bp, synthetic construct
  misc_feature 1..20: note = CRISPR gRNA sequence
  source 1..20: mol_type = other DNA
tgccagcaaaattacaagta

SEQ ID NO: 93567 - DNA, 20 bp, synthetic construct
  misc_feature 1..20: note = CRISPR gRNA sequence
  source 1..20: mol_type = other DNA
caagtatttaagatgctgtc

SEQ ID NO: 93568 - DNA, 20 bp, synthetic construct
  misc_feature 1..20: note = CRISPR gRNA sequence
  source 1..20: mol_type = other DNA
aagatgctgtcaggtaactg

SEQ ID NO: 93569 - DNA, 20 bp, synthetic construct
  misc_feature 1..20: note = CRISPR gRNA sequence
  source 1..20: mol_type = other DNA
agatgctgtcaggtaactgg

SEQ ID NO: 93570 - DNA, 20 bp, synthetic construct
  misc_feature 1..20: note = CRISPR gRNA sequence
  source 1..20: mol_type = other DNA
tcaggtaactgggggtacat

SEQ ID NO: 93571 - DNA, 20 bp, synthetic construct
  misc_feature 1..20: note = CRISPR gRNA sequence
  source 1..20: mol_type = other DNA
ggggtacatatttggtaata

SEQ ID NO: 93572 - DNA, 20 bp, synthetic construct
  misc_feature 1..20: note = CRISPR gRNA sequence
  source 1..20: mol_type = other DNA
ggtaataagtgctgctgatt

SEQ ID NO: 93573 - DNA, 20 bp, synthetic construct
  misc_feature 1..20: note = CRISPR gRNA sequence
  source 1..20: mol_type = other DNA
gtaataagtgctgctgattt

SEQ ID NO: 93574 - DNA, 20 bp, synthetic construct
  misc_feature 1..20: note = CRISPR gRNA sequence
  source 1..20: mol_type = other DNA
ctgattttgtttttgggcag

SEQ ID NO: 93575 - DNA, 20 bp, synthetic construct
  misc_feature 1..20: note = CRISPR gRNA sequence
  source 1..20: mol_type = other DNA
attttgtttttgggcagtga

SEQ ID NO: 93576 - DNA, 20 bp, synthetic construct
  misc_feature 1..20: note = CRISPR gRNA sequence
  source 1..20: mol_type = other DNA
tgtttttgggcagtgaaatc

SEQ ID NO: 93577 - DNA, 20 bp, synthetic construct
  misc_feature 1..20: note = CRISPR gRNA sequence
  source 1..20: mol_type = other DNA
gtttttgggcagtgaaatct

SEQ ID NO: 93578 - DNA, 20 bp, synthetic construct
  misc_feature 1..20: note = CRISPR gRNA sequence
  source 1..20: mol_type = other DNA
tttttgggcagtgaaatctc

SEQ ID NO: 93579 - DNA, 20 bp, synthetic construct
  misc_feature 1..20: note = CRISPR gRNA sequence
  source 1..20: mol_type = other DNA
ttgggcagtgaaatctcagg

SEQ ID NO: 93580 - DNA, 20 bp, synthetic construct
  misc_feature 1..20: note = CRISPR gRNA sequence
  source 1..20: mol_type = other DNA
tgggcagtgaaatctcaggg

SEQ ID NO: 93581 - DNA, 20 bp, synthetic construct
  misc_feature 1..20: note = CRISPR gRNA sequence
  source 1..20: mol_type = other DNA
gggcagtgaaatctcagggt

SEQ ID NO: 93582 - DNA, 20 bp, synthetic construct
  misc_feature 1..20: note = CRISPR gRNA sequence
  source 1..20: mol_type = other DNA
ggcagtgaaatctcagggta

SEQ ID NO: 93583 - DNA, 20 bp, synthetic construct
  misc_feature 1..20: note = CRISPR gRNA sequence
  source 1..20: mol_type = other DNA
agggtaatggtatcatttta

SEQ ID NO: 93584 - DNA, 20 bp, synthetic construct
  misc_feature 1..20: note = CRISPR gRNA sequence
  source 1..20: mol_type = other DNA
taggacttacctgttttgtt

SEQ ID NO: 93585 - DNA, 20 bp, synthetic construct
  misc_feature 1..20: note = CRISPR gRNA sequence
  source 1..20: mol_type = other DNA
aggacttacctgttttgttc

SEQ ID NO: 93586 - DNA, 20 bp, synthetic construct
  misc_feature 1..20: note = CRISPR gRNA sequence
  source 1..20: mol_type = other DNA
ggacttacctgttttgttca

SEQ ID NO: 93587 - DNA, 20 bp, synthetic construct
  misc_feature 1..20: note = CRISPR gRNA sequence
  source 1..20: mol_type = other DNA
acctgttttgttcatacagt

SEQ ID NO: 93588 - DNA, 20 bp, synthetic construct
  misc_feature 1..20: note = CRISPR gRNA sequence
  source 1..20: mol_type = other DNA
cctgttttgttcatacagtt

SEQ ID NO: 93589 - DNA, 20 bp, synthetic construct
  misc_feature 1..20: note = CRISPR gRNA sequence
  source 1..20: mol_type = other DNA
ttttgttcatacagttggca

SEQ ID NO: 93590 - DNA, 20 bp, synthetic construct
  misc_feature 1..20: note = CRISPR gRNA sequence
  source 1..20: mol_type = other DNA
tgttcatacagttggcagga

SEQ ID NO: 93591 - DNA, 20 bp, synthetic construct
  misc_feature 1..20: note = CRISPR gRNA sequence
  source 1..20: mol_type = other DNA
gttcatacagttggcaggag

SEQ ID NO: 93592 - DNA, 20 bp, synthetic construct
  misc_feature 1..20: note = CRISPR gRNA sequence
  source 1..20: mol_type = other DNA
ttcatacagttggcaggaga

SEQ ID NO: 93593 - DNA, 20 bp, synthetic construct
  misc_feature 1..20: note = CRISPR gRNA sequence
  source 1..20: mol_type = other DNA
atacagttggcaggagacta

SEQ ID NO: 93594 - DNA, 20 bp, synthetic construct
  misc_feature 1..20: note = CRISPR gRNA sequence
  source 1..20: mol_type = other DNA
gcaggagactatttatacta

SEQ ID NO: 93595 - DNA, 20 bp, synthetic construct
  misc_feature 1..20: note = CRISPR gRNA sequence
  source 1..20: mol_type = other DNA
tttatactagtgctttttca

SEQ ID NO: 93596 - DNA, 20 bp, synthetic construct
  misc_feature 1..20: note = CRISPR gRNA sequence
  source 1..20: mol_type = other DNA
atactagtgctttttcaagc

SEQ ID NO: 93597 - DNA, 20 bp, synthetic construct
  misc_feature 1..20: note = CRISPR gRNA sequence
  source 1..20: mol_type = other DNA
tactagtgctttttcaagca

SEQ ID NO: 93598 - DNA, 20 bp, synthetic construct
  misc_feature 1..20: note = CRISPR gRNA sequence
  source 1..20: mol_type = other DNA
gtgctttttcaagcaagttt

SEQ ID NO: 93599 - DNA, 20 bp, synthetic construct
  misc_feature 1..20: note = CRISPR gRNA sequence
  source 1..20: mol_type = other DNA
tttcaagcaagtttatctaa

SEQ ID NO: 93600 - DNA, 20 bp, synthetic construct
  misc_feature 1..20: note = CRISPR gRNA sequence
  source 1..20: mol_type = other DNA
ttcaagcaagtttatctaaa

SEQ ID NO: 93601 - DNA, 20 bp, synthetic construct
  misc_feature 1..20: note = CRISPR gRNA sequence
  source 1..20: mol_type = other DNA
tcaagcaagtttatctaaat

SEQ ID NO: 93602 - DNA, 20 bp, synthetic construct
  misc_feature 1..20: note = CRISPR gRNA sequence
  source 1..20: mol_type = other DNA
caagcaagtttatctaaatt

SEQ ID NO: 93603 - DNA, 20 bp, synthetic construct
  misc_feature 1..20: note = CRISPR gRNA sequence
  source 1..20: mol_type = other DNA
aagcaagtttatctaaattt

SEQ ID NO: 93604 - DNA, 20 bp, synthetic construct
  misc_feature 1..20: note = CRISPR gRNA sequence
  source 1..20: mol_type = other DNA
atctaaattttgaaagcttt

SEQ ID NO: 93605 - DNA, 20 bp, synthetic construct
  misc_feature 1..20: note = CRISPR gRNA sequence
  source 1..20: mol_type = other DNA
tctaaattttgaaagctttg

SEQ ID NO: 93606 - DNA, 20 bp, synthetic construct
  misc_feature 1..20: note = CRISPR gRNA sequence
  source 1..20: mol_type = other DNA
aattttgaaagctttggtta

SEQ ID NO: 93607 - DNA, 20 bp, synthetic construct
  misc_feature 1..20: note = CRISPR gRNA sequence
  source 1..20: mol_type = other DNA
tgaaagctttggttatcagt

SEQ ID NO: 93608 - DNA, 20 bp, synthetic construct
  misc_feature 1..20: note = CRISPR gRNA sequence
  source 1..20: mol_type = other DNA
gaaagctttggttatcagtt

SEQ ID NO: 93609 - DNA, 20 bp, synthetic construct
  misc_feature 1..20: note = CRISPR gRNA sequence
  source 1..20: mol_type = other DNA
aaagctttggttatcagttg

SEQ ID NO: 93610 - DNA, 20 bp, synthetic construct
  misc_feature 1..20: note = CRISPR gRNA sequence
  source 1..20: mol_type = other DNA
tggttatcagttgcttcttt

SEQ ID NO: 93611 - DNA, 20 bp, synthetic construct
  misc_feature 1..20: note = CRISPR gRNA sequence
  source 1..20: mol_type = other DNA
ggttatcagttgcttcttta

SEQ ID NO: 93612 - DNA, 20 bp, synthetic construct
  misc_feature 1..20: note = CRISPR gRNA sequence
  source 1..20: mol_type = other DNA
gttatcagttgcttctttaa

SEQ ID NO: 93613 - DNA, 20 bp, synthetic construct
  misc_feature 1..20: note = CRISPR gRNA sequence
  source 1..20: mol_type = other DNA
tcagttgcttctttaaacaa

SEQ ID NO: 93614 - DNA, 20 bp, synthetic construct
  misc_feature 1..20: note = CRISPR gRNA sequence
  source 1..20: mol_type = other DNA
cttctttaaacaatatttta

SEQ ID NO: 93615 - DNA, 20 bp, synthetic construct
  misc_feature 1..20: note = CRISPR gRNA sequence
  source 1..20: mol_type = other DNA
ctttaaacaatattttacta

SEQ ID NO: 93616 - DNA, 20 bp, synthetic construct
  misc_feature 1..20: note = CRISPR gRNA sequence
  source 1..20: mol_type = other DNA
tttaaacaatattttactac

SEQ ID NO: 93617 - DNA, 20 bp, synthetic construct
  misc_feature 1..20: note = CRISPR gRNA sequence
  source 1..20: mol_type = other DNA
taaacaatattttactactc

SEQ ID NO: 93618 - DNA, 20 bp, synthetic construct
  misc_feature 1..20: note = CRISPR gRNA sequence
  source 1..20: mol_type = other DNA
aaacaatattttactactcc

SEQ ID NO: 93619 - DNA, 20 bp, synthetic construct
  misc_feature 1..20: note = CRISPR gRNA sequence
  source 1..20: mol_type = other DNA
aacaatattttactactccc

SEQ ID NO: 93620 - DNA, 20 bp, synthetic construct
  misc_feature 1..20: note = CRISPR gRNA sequence
  source 1..20: mol_type = other DNA
tactactcccccatttgttt

SEQ ID NO: 93621 - DNA, 20 bp, synthetic construct
  misc_feature 1..20: note = CRISPR gRNA sequence
  source 1..20: mol_type = other DNA
actactcccccatttgtttt

SEQ ID NO: 93622 - DNA, 20 bp, synthetic construct
  misc_feature 1..20: note = CRISPR gRNA sequence
  source 1..20: mol_type = other DNA
ctactcccccatttgttttg

SEQ ID NO: 93623 - DNA, 20 bp, synthetic construct
  misc_feature 1..20: note = CRISPR gRNA sequence
  source 1..20: mol_type = other DNA
ctcccccatttgttttggtt

SEQ ID NO: 93624 - DNA, 20 bp, synthetic construct
  misc_feature 1..20: note = CRISPR gRNA sequence
  source 1..20: mol_type = other DNA
ccccatttgttttggttgcc

SEQ ID NO: 93625 - DNA, 20 bp, synthetic construct
  misc_feature 1..20: note = CRISPR gRNA sequence
  source 1..20: mol_type = other DNA
gttttggttgccaactgggt

SEQ ID NO: 93626 - DNA, 20 bp, synthetic construct
  misc_feature 1..20: note = CRISPR gRNA sequence
  source 1..20: mol_type = other DNA
ttttggttgccaactgggta

SEQ ID NO: 93627 - DNA, 20 bp, synthetic construct
  misc_feature 1..20: note = CRISPR gRNA sequence
  source 1..20: mol_type = other DNA
tggttgccaactgggtaaaa

SEQ ID NO: 93628 - DNA, 20 bp, synthetic construct
  misc_feature 1..20: note = CRISPR gRNA sequence
  source 1..20: mol_type = other DNA
ggttgccaactgggtaaaaa

SEQ ID NO: 93629 - DNA, 20 bp, synthetic construct
  misc_feature 1..20: note = CRISPR gRNA sequence
  source 1..20: mol_type = other DNA
gttgccaactgggtaaaaag

SEQ ID NO: 93630 - DNA, 20 bp, synthetic construct
  misc_feature 1..20: note = CRISPR gRNA sequence
  source 1..20: mol_type = other DNA
ccaactgggtaaaaagctat

SEQ ID NO: 93631 - DNA, 20 bp, synthetic construct
  misc_feature 1..20: note = CRISPR gRNA sequence
  source 1..20: mol_type = other DNA
ggtaaaaagctatcagatat

SEQ ID NO: 93632 - DNA, 20 bp, synthetic construct
  misc_feature 1..20: note = CRISPR gRNA sequence
  source 1..20: mol_type = other DNA
tcagatatcttattgagcag

SEQ ID NO: 93633 - DNA, 20 bp, synthetic construct
  misc_feature 1..20: note = CRISPR gRNA sequence
  source 1..20: mol_type = other DNA
attgagcagtatataatttg

SEQ ID NO: 93634 - DNA, 20 bp, synthetic construct
  misc_feature 1..20: note = CRISPR gRNA sequence
  source 1..20: mol_type = other DNA
ttgagcagtatataatttgc

SEQ ID NO: 93635 - DNA, 20 bp, synthetic construct
  misc_feature 1..20: note = CRISPR gRNA sequence
  source 1..20: mol_type = other DNA
agcagtatataatttgcctc

SEQ ID NO: 93636 - DNA, 20 bp, synthetic construct
  misc_feature 1..20: note = CRISPR gRNA sequence
  source 1..20: mol_type = other DNA
gcctctgagttcatatattt

SEQ ID NO: 93637 - DNA, 20 bp, synthetic construct
  misc_feature 1..20: note = CRISPR gRNA sequence
  source 1..20: mol_type = other DNA
cctctgagttcatatatttc

SEQ ID NO: 93638 - DNA, 20 bp, synthetic construct
  misc_feature 1..20: note = CRISPR gRNA sequence
  source 1..20: mol_type = other DNA
tgagttcatatatttcatcc

SEQ ID NO: 93639 - DNA, 20 bp, synthetic construct
  misc_feature 1..20: note = CRISPR gRNA sequence
  source 1..20: mol_type = other DNA
agttcatatatttcatccaa

SEQ ID NO: 93640 - DNA, 20 bp, synthetic construct
  misc_feature 1..20: note = CRISPR gRNA sequence
  source 1..20: mol_type = other DNA
atatatttcatccaaaggca

SEQ ID NO: 93641 - DNA, 20 bp, synthetic construct
  misc_feature 1..20: note = CRISPR gRNA sequence
  source 1..20: mol_type = other DNA
catccaaaggcaagcagatt

SEQ ID NO: 93642 - DNA, 20 bp, synthetic construct
  misc_feature 1..20: note = CRISPR gRNA sequence
  source 1..20: mol_type = other DNA
atccaaaggcaagcagatta

SEQ ID NO: 93643 - DNA, 20 bp, synthetic construct
  misc_feature 1..20: note = CRISPR gRNA sequence
  source 1..20: mol_type = other DNA
tgtttcggcctggatagcat

SEQ ID NO: 93644 - DNA, 20 bp, synthetic construct
  misc_feature 1..20: note = CRISPR gRNA sequence
  source 1..20: mol_type = other DNA
cggcctggatagcattatat

SEQ ID NO: 93645 - DNA, 20 bp, synthetic construct
  misc_feature 1..20: note = CRISPR gRNA sequence
  source 1..20: mol_type = other DNA
ggcctggatagcattatata

SEQ ID NO: 93646 - DNA, 20 bp, synthetic construct
  misc_feature 1..20: note = CRISPR gRNA sequence
  source 1..20: mol_type = other DNA
gatagcattatataaagaga

SEQ ID NO: 93647 - DNA, 20 bp, synthetic construct
  misc_feature 1..20: note = CRISPR gRNA sequence
  source 1..20: mol_type = other DNA
tataaagagaatggtcaatt

SEQ ID NO: 93648 - DNA, 20 bp, synthetic construct
  misc_feature 1..20: note = CRISPR gRNA sequence
  source 1..20: mol_type = other DNA
cacttggcattttttgtaat

SEQ ID NO: 93649 - DNA, 20 bp, synthetic construct
  misc_feature 1..20: note = CRISPR gRNA sequence
  source 1..20: mol_type = other DNA
ggcattttttgtaatattga

SEQ ID NO: 93650 - DNA, 20 bp, synthetic construct
  misc_feature 1..20: note = CRISPR gRNA sequence
  source 1..20: mol_type = other DNA
gcattttttgtaatattgaa

SEQ ID NO: 93651 - DNA, 20 bp, synthetic construct
  misc_feature 1..20: note = CRISPR gRNA sequence
  source 1..20: mol_type = other DNA
tttgtaatattgaaaatagc

SEQ ID NO: 93652 - DNA, 20 bp, synthetic construct
  misc_feature 1..20: note = CRISPR gRNA sequence
  source 1..20: mol_type = other DNA
ttgtaatattgaaaatagct

SEQ ID NO: 93653 - DNA, 20 bp, synthetic construct
  misc_feature 1..20: note = CRISPR gRNA sequence
  source 1..20: mol_type = other DNA
tgtaatattgaaaatagctc

SEQ ID NO: 93654 - DNA, 20 bp, synthetic construct
  misc_feature 1..20: note = CRISPR gRNA sequence
  source 1..20: mol_type = other DNA
gtaatattgaaaatagctca

SEQ ID NO: 93655 - DNA, 20 bp, synthetic construct
  misc_feature 1..20: note = CRISPR gRNA sequence
  source 1..20: mol_type = other DNA
taatattgaaaatagctcac

SEQ ID NO: 93656 - DNA, 20 bp, synthetic construct
  misc_feature 1..20: note = CRISPR gRNA sequence
  source 1..20: mol_type = other DNA
aaaatagctcacaagtaact

SEQ ID NO: 93657 - DNA, 20 bp, synthetic construct
  misc_feature 1..20: note = CRISPR gRNA sequence
  source 1..20: mol_type = other DNA
acaagtaactctgcctcaat

SEQ ID NO: 93658 - DNA, 20 bp, synthetic construct
  misc_feature 1..20: note = CRISPR gRNA sequence
  source 1..20: mol_type = other DNA
tgcctcaatcttagtggccc

SEQ ID NO: 93659 - DNA, 20 bp, synthetic construct
  misc_feature 1..20: note = CRISPR gRNA sequence
  source 1..20: mol_type = other DNA
cctcaatcttagtggcccac

SEQ ID NO: 93660 - DNA, 20 bp, synthetic construct
  misc_feature 1..20: note = CRISPR gRNA sequence
  source 1..20: mol_type = other DNA
aatcttagtggcccacctct

SEQ ID NO: 93661 - DNA, 20 bp, synthetic construct
  misc_feature 1..20: note = CRISPR gRNA sequence
  source 1..20: mol_type = other DNA
agtggcccacctctcacagt

SEQ ID NO: 93662 - DNA, 20 bp, synthetic construct
  misc_feature 1..20: note = CRISPR gRNA sequence
  source 1..20: mol_type = other DNA
gtggcccacctctcacagta

SEQ ID NO: 93663 - DNA, 20 bp, synthetic construct
  misc_feature 1..20: note = CRISPR gRNA sequence
  source 1..20: mol_type = other DNA
tcacagtattactatatcac

SEQ ID NO: 93664 - DNA, 20 bp, synthetic construct
  misc_feature 1..20: note = CRISPR gRNA sequence
  source 1..20: mol_type = other DNA
acagtattactatatcacac

SEQ ID NO: 93665 - DNA, 20 bp, synthetic construct
  misc_feature 1..20: note = CRISPR gRNA sequence
  source 1..20: mol_type = other DNA
ctatatcacactctatcaca

SEQ ID NO: 93666 - DNA, 20 bp, synthetic construct
  misc_feature 1..20: note = CRISPR gRNA sequence
  source 1..20: mol_type = other DNA
tatcacactctatcacacac

SEQ ID NO: 93667 - DNA, 20 bp, synthetic construct
  misc_feature 1..20: note = CRISPR gRNA sequence
  source 1..20: mol_type = other DNA
tatcacacacactattaatt

SEQ ID NO: 93668 - DNA, 20 bp, synthetic construct
  misc_feature 1..20: note = CRISPR gRNA sequence
  source 1..20: mol_type = other DNA
tcacacacactattaatttt

SEQ ID NO: 93669 - DNA, 20 bp, synthetic construct
  misc_feature 1..20: note = CRISPR gRNA sequence
  source 1..20: mol_type = other DNA
ttaattttgagacctgccaa

SEQ ID NO: 93670 - DNA, 20 bp, synthetic construct
  misc_feature 1..20: note = CRISPR gRNA sequence
  source 1..20: mol_type = other DNA
attttgagacctgccaagag

SEQ ID NO: 93671 - DNA, 20 bp, synthetic construct
  misc_feature 1..20: note = CRISPR gRNA sequence
  source 1..20: mol_type = other DNA
tgagacctgccaagagacta

SEQ ID NO: 93672 - DNA, 20 bp, synthetic construct
  misc_feature 1..20: note = CRISPR gRNA sequence
  source 1..20: mol_type = other DNA
gagacctgccaagagactaa

SEQ ID NO: 93673 - DNA, 20 bp, synthetic construct
  misc_feature 1..20: note = CRISPR gRNA sequence
  source 1..20: mol_type = other DNA
agacctgccaagagactaaa

SEQ ID NO: 93674 - DNA, 20 bp, synthetic construct
  misc_feature 1..20: note = CRISPR gRNA sequence
  source 1..20: mol_type = other DNA
ccaagagactaaagaaccca

SEQ ID NO: 93675 - DNA, 20 bp, synthetic construct
  misc_feature 1..20: note = CRISPR gRNA sequence
  source 1..20: mol_type = other DNA
aagaacccaggttgaaaatc

SEQ ID NO: 93676 - DNA, 20 bp, synthetic construct
  misc_feature 1..20: note = CRISPR gRNA sequence
  source 1..20: mol_type = other DNA
aaaatctggggggagaggga

SEQ ID NO: 93677 - DNA, 20 bp, synthetic construct
  misc_feature 1..20: note = CRISPR gRNA sequence
  source 1..20: mol_type = other DNA
gggggagagggagcgaggag

SEQ ID NO: 93678 - DNA, 20 bp, synthetic construct
  misc_feature 1..20: note = CRISPR gRNA sequence
  source 1..20: mol_type = other DNA
cattaaattaactgccaata

SEQ ID NO: 93679 - DNA, 20 bp, synthetic construct
  misc_feature 1..20: note = CRISPR gRNA sequence
  source 1..20: mol_type = other DNA
aattaactgccaatactttg

SEQ ID NO: 93680 - DNA, 20 bp, synthetic construct
  misc_feature 1..20: note = CRISPR gRNA sequence
  source 1..20: mol_type = other DNA
actgccaatactttgcctat

SEQ ID NO: 93681 - DNA, 20 bp, synthetic construct
  misc_feature 1..20: note = CRISPR gRNA sequence
  source 1..20: mol_type = other DNA
ccaatactttgcctatgata

SEQ ID NO: 93682 - DNA, 20 bp, synthetic construct
  misc_feature 1..20: note = CRISPR gRNA sequence
  source 1..20: mol_type = other DNA
tgcctatgataatgaagaac

SEQ ID NO: 93683 - DNA, 20 bp, synthetic construct
  misc_feature 1..20: note = CRISPR gRNA sequence
  source 1..20: mol_type = other DNA
gcctatgataatgaagaact

SEQ ID NO: 93684 - DNA, 20 bp, synthetic construct
  misc_feature 1..20: note = CRISPR gRNA sequence
  source 1..20: mol_type = other DNA
cctatgataatgaagaactt

SEQ ID NO: 93685 - DNA, 20 bp, synthetic construct
  misc_feature 1..20: note = CRISPR gRNA sequence
  source 1..20: mol_type = other DNA
tgataatgaagaactttccc

SEQ ID NO: 93686 - DNA, 20 bp, synthetic construct
  misc_feature 1..20: note = CRISPR gRNA sequence
  source 1..20: mol_type = other DNA
tcccagagttgcccagagac

SEQ ID NO: 93687 - DNA, 20 bp, synthetic construct
  misc_feature 1..20: note = CRISPR gRNA sequence
  source 1..20: mol_type = other DNA
cccagagttgcccagagact

SEQ ID NO: 93688 - DNA, 20 bp, synthetic construct
  misc_feature 1..20: note = CRISPR gRNA sequence
  source 1..20: mol_type = other DNA
ccagagttgcccagagactg

SEQ ID NO: 93689 - DNA, 20 bp, synthetic construct
  misc_feature 1..20: note = CRISPR gRNA sequence
  source 1..20: mol_type = other DNA
cccagagactgggcaagaag

SEQ ID NO: 93690 - DNA, 20 bp, synthetic construct
  misc_feature 1..20: note = CRISPR gRNA sequence
  source 1..20: mol_type = other DNA
ggcaagaagaaggaagaaat

SEQ ID NO: 93691 - DNA, 20 bp, synthetic construct
  misc_feature 1..20: note = CRISPR gRNA sequence
  source 1..20: mol_type = other DNA
ttcattacatctttgaaata

SEQ ID NO: 93692 - DNA, 20 bp, synthetic construct
  misc_feature 1..20: note = CRISPR gRNA sequence
  source 1..20: mol_type = other DNA
attacatctttgaaatacct

SEQ ID NO: 93693 - DNA, 20 bp, synthetic construct
  misc_feature 1..20: note = CRISPR gRNA sequence
  source 1..20: mol_type = other DNA
catctttgaaatacctgtaa

SEQ ID NO: 93694 - DNA, 20 bp, synthetic construct
  misc_feature 1..20: note = CRISPR gRNA sequence
  source 1..20: mol_type = other DNA
tgaaatacctgtaatcatga

SEQ ID NO: 93695 - DNA, 20 bp, synthetic construct
  misc_feature 1..20: note = CRISPR gRNA sequence
  source 1..20: mol_type = other DNA
gaaatacctgtaatcatgac

SEQ ID NO: 93696 - DNA, 20 bp, synthetic construct
  misc_feature 1..20: note = CRISPR gRNA sequence
  source 1..20: mol_type = other DNA
aaatacctgtaatcatgact

SEQ ID NO: 93697 - DNA, 20 bp, synthetic construct
  misc_feature 1..20: note = CRISPR gRNA sequence
  source 1..20: mol_type = other DNA
taatcatgacttattacgtt

SEQ ID NO: 93698 - DNA, 20 bp, synthetic construct
  misc_feature 1..20: note = CRISPR gRNA sequence
  source 1..20: mol_type = other DNA
attacgttaactgtttatct

SEQ ID NO: 93699 - DNA, 20 bp, synthetic construct
  misc_feature 1..20: note = CRISPR gRNA sequence
  source 1..20: mol_type = other DNA
ttacgttaactgtttatcta

SEQ ID NO: 93700 - DNA, 20 bp, synthetic construct
  misc_feature 1..20: note = CRISPR gRNA sequence
  source 1..20: mol_type = other DNA
cgttaactgtttatctattt

SEQ ID NO: 93701 - DNA, 20 bp, synthetic construct
  misc_feature 1..20: note = CRISPR gRNA sequence
  source 1..20: mol_type = other DNA
actgtttatctatttgcatt

SEQ ID NO: 93702 - DNA, 20 bp, synthetic construct
  misc_feature 1..20: note = CRISPR gRNA sequence
  source 1..20: mol_type = other DNA
tttatctatttgcattttta

SEQ ID NO: 93703 - DNA, 20 bp, synthetic construct
  misc_feature 1..20: note = CRISPR gRNA sequence
  source 1..20: mol_type = other DNA
atctatttgcatttttatca

SEQ ID NO: 93704 - DNA, 20 bp, synthetic construct
  misc_feature 1..20: note = CRISPR gRNA sequence
  source 1..20: mol_type = other DNA
tctatttgcatttttatcat

SEQ ID NO: 93705 - DNA, 20 bp, synthetic construct
  misc_feature 1..20: note = CRISPR gRNA sequence
  source 1..20: mol_type = other DNA
tttgcatttttatcatttat

SEQ ID NO: 93706 - DNA, 20 bp, synthetic construct
  misc_feature 1..20: note = CRISPR gRNA sequence
  source 1..20: mol_type = other DNA
gcatttttatcatttatccc

SEQ ID NO: 93707 - DNA, 20 bp, synthetic construct
  misc_feature 1..20: note = CRISPR gRNA sequence
  source 1..20: mol_type = other DNA
catttttatcatttatccca

SEQ ID NO: 93708 - DNA, 20 bp, synthetic construct
  misc_feature 1..20: note = CRISPR gRNA sequence
  source 1..20: mol_type = other DNA
ttatcatttatcccaggaaa

SEQ ID NO: 93709 - DNA, 20 bp, synthetic construct
  misc_feature 1..20: note = CRISPR gRNA sequence
  source 1..20: mol_type = other DNA
tatcatttatcccaggaaag

SEQ ID NO: 93710 - DNA, 20 bp, synthetic construct
  misc_feature 1..20: note = CRISPR gRNA sequence
  source 1..20: mol_type = other DNA
atcatttatcccaggaaagt

SEQ ID NO: 93711 - DNA, 20 bp, synthetic construct
  misc_feature 1..20: note = CRISPR gRNA sequence
  source 1..20: mol_type = other DNA
tcatttatcccaggaaagtg

SEQ ID NO: 93712 - DNA, 20 bp, synthetic construct
  misc_feature 1..20: note = CRISPR gRNA sequence
  source 1..20: mol_type = other DNA
atcccaggaaagtgcagata

SEQ ID NO: 93713 - DNA, 20 bp, synthetic construct
  misc_feature 1..20: note = CRISPR gRNA sequence
  source 1..20: mol_type = other DNA
tcccaggaaagtgcagataa

SEQ ID NO: 93714 - DNA, 20 bp, synthetic construct
  misc_feature 1..20: note = CRISPR gRNA sequence
  source 1..20: mol_type = other DNA
tccattgttaaacaaagaac

SEQ ID NO: 93715 - DNA, 20 bp, synthetic construct
  misc_feature 1..20: note = CRISPR gRNA sequence
  source 1..20: mol_type = other DNA
cattgttaaacaaagaacag

SEQ ID NO: 93716 - DNA, 20 bp, synthetic construct
  misc_feature 1..20: note = CRISPR gRNA sequence
  source 1..20: mol_type = other DNA
ttaaacaaagaacaggatct

SEQ ID NO: 93717 - DNA, 20 bp, synthetic construct
  misc_feature 1..20: note = CRISPR gRNA sequence
  source 1..20: mol_type = other DNA
aacaaagaacaggatctttt

SEQ ID NO: 93718 - DNA, 20 bp, synthetic construct
  misc_feature 1..20: note = CRISPR gRNA sequence
  source 1..20: mol_type = other DNA
ttggggatcgtcctgcaaga

SEQ ID NO: 93719 - DNA, 20 bp, synthetic construct
  misc_feature 1..20: note = CRISPR gRNA sequence
  source 1..20: mol_type = other DNA
tggggatcgtcctgcaagac

SEQ ID NO: 93720 - DNA, 20 bp, synthetic construct
  misc_feature 1..20: note = CRISPR gRNA sequence
  source 1..20: mol_type = other DNA
ggggatcgtcctgcaagacc

SEQ ID NO: 93721 - DNA, 20 bp, synthetic construct
  misc_feature 1..20: note = CRISPR gRNA sequence
  source 1..20: mol_type = other DNA
gggatcgtcctgcaagacct

SEQ ID NO: 93722 - DNA, 20 bp, synthetic construct
  misc_feature 1..20: note = CRISPR gRNA sequence
  source 1..20: mol_type = other DNA
caagacctactcttttagaa

SEQ ID NO: 93723 - DNA, 20 bp, synthetic construct
  misc_feature 1..20: note = CRISPR gRNA sequence
  source 1..20: mol_type = other DNA
ctcttttagaacaagtgtta

SEQ ID NO: 93724 - DNA, 20 bp, synthetic construct
  misc_feature 1..20: note = CRISPR gRNA sequence
  source 1..20: mol_type = other DNA
ttttagaacaagtgttaaat

SEQ ID NO: 93725 - DNA, 20 bp, synthetic construct
  misc_feature 1..20: note = CRISPR gRNA sequence
  source 1..20: mol_type = other DNA
ttagaacaagtgttaaatca

SEQ ID NO: 93726 - DNA, 20 bp, synthetic construct
  misc_feature 1..20: note = CRISPR gRNA sequence
  source 1..20: mol_type = other DNA
tagaacaagtgttaaatcaa

SEQ ID NO: 93727 - DNA, 20 bp, synthetic construct
  misc_feature 1..20: note = CRISPR gRNA sequence
  source 1..20: mol_type = other DNA
agaacaagtgttaaatcaaa

SEQ ID NO: 93728 - DNA, 20 bp, synthetic construct
  misc_feature 1..20: note = CRISPR gRNA sequence
  source 1..20: mol_type = other DNA
gaacaagtgttaaatcaaaa

SEQ ID NO: 93729 - DNA, 20 bp, synthetic construct
  misc_feature 1..20: note = CRISPR gRNA sequence
  source 1..20: mol_type = other DNA
aatcaaaaaagactggtaaa

SEQ ID NO: 93730 - DNA, 20 bp, synthetic construct
  misc_feature 1..20: note = CRISPR gRNA sequence
  source 1..20: mol_type = other DNA
gtaaatatctgtttgtaaat

SEQ ID NO: 93731 - DNA, 20 bp, synthetic construct
  misc_feature 1..20: note = CRISPR gRNA sequence
  source 1..20: mol_type = other DNA
tttgtaaatcagttataaat

SEQ ID NO: 93732 - DNA, 20 bp, synthetic construct
  misc_feature 1..20: note = CRISPR gRNA sequence
  source 1..20: mol_type = other DNA
gtaaatcagttataaatgtg

SEQ ID NO: 93733 - DNA, 20 bp, synthetic construct
  misc_feature 1..20: note = CRISPR gRNA sequence
  source 1..20: mol_type = other DNA
taaatcagttataaatgtgt

SEQ ID NO: 93734 - DNA, 20 bp, synthetic construct
  misc_feature 1..20: note = CRISPR gRNA sequence
  source 1..20: mol_type = other DNA
taaatgtgttaacaaacgtt

SEQ ID NO: 93735 - DNA, 20 bp, synthetic construct
  misc_feature 1..20: note = CRISPR gRNA sequence
  source 1..20: mol_type = other DNA
acaaacgtttgttataaatg

SEQ ID NO: 93736 - DNA, 20 bp, synthetic construct
  misc_feature 1..20: note = CRISPR gRNA sequence
  source 1..20: mol_type = other DNA
gttataaatggaacaattga

SEQ ID NO: 93737 - DNA, 20 bp, synthetic construct
  misc_feature 1..20: note = CRISPR gRNA sequence
  source 1..20: mol_type = other DNA
ttataaatggaacaattgag

SEQ ID NO: 93738 - DNA, 20 bp, synthetic construct
  misc_feature 1..20: note = CRISPR gRNA sequence
  source 1..20: mol_type = other DNA
taaatggaacaattgagatt

SEQ ID NO: 93739 - DNA, 20 bp, synthetic construct
  misc_feature 1..20: note = CRISPR gRNA sequence
  source 1..20: mol_type = other DNA
agatttttgagatttttagc

SEQ ID NO: 93740 - DNA, 20 bp, synthetic construct
  misc_feature 1..20: note = CRISPR gRNA sequence
  source 1..20: mol_type = other DNA
ttgagatttttagctcatga

SEQ ID NO: 93741 - DNA, 20 bp, synthetic construct
  misc_feature 1..20: note = CRISPR gRNA sequence
  source 1..20: mol_type = other DNA
tgagatttttagctcatgac

SEQ ID NO: 93742 - DNA, 20 bp, synthetic construct
  misc_feature 1..20: note = CRISPR gRNA sequence
  source 1..20: mol_type = other DNA
gagatttttagctcatgaca

SEQ ID NO: 93743 - DNA, 20 bp, synthetic construct
  misc_feature 1..20: note = CRISPR gRNA sequence
  source 1..20: mol_type = other DNA
agatttttagctcatgacat

SEQ ID NO: 93744 - DNA, 20 bp, synthetic construct
  misc_feature 1..20: note = CRISPR gRNA sequence
  source 1..20: mol_type = other DNA
ttagctcatgacatcacact

SEQ ID NO: 93745 - DNA, 20 bp, synthetic construct
  misc_feature 1..20: note = CRISPR gRNA sequence
  source 1..20: mol_type = other DNA
tagctcatgacatcacacta

SEQ ID NO: 93746 - DNA, 20 bp, synthetic construct
  misc_feature 1..20: note = CRISPR gRNA sequence
  source 1..20: mol_type = other DNA
agctcatgacatcacactat

SEQ ID NO: 93747 - DNA, 20 bp, synthetic construct
  misc_feature 1..20: note = CRISPR gRNA sequence
  source 1..20: mol_type = other DNA
gctcatgacatcacactata

SEQ ID NO: 93748 - DNA, 20 bp, synthetic construct
  misc_feature 1..20: note = CRISPR gRNA sequence
  source 1..20: mol_type = other DNA
atgacatcacactatacatc

SEQ ID NO: 93749 - DNA, 20 bp, synthetic construct
  misc_feature 1..20: note = CRISPR gRNA sequence
  source 1..20: mol_type = other DNA
tacatcaaaataaattccta

SEQ ID NO: 93750 - DNA, 20 bp, synthetic construct
  misc_feature 1..20: note = CRISPR gRNA sequence
  source 1..20: mol_type = other DNA
ctaataagtcaaaattttaa

SEQ ID NO: 93751 - DNA, 20 bp, synthetic construct
  misc_feature 1..20: note = CRISPR gRNA sequence
  source 1..20: mol_type = other DNA
ataagtcaaaattttaaaaa

SEQ ID NO: 93752 - DNA, 20 bp, synthetic construct
  misc_feature 1..20: note = CRISPR gRNA sequence
  source 1..20: mol_type = other DNA
taaaaaaagaatcggaactt

SEQ ID NO: 93753 - DNA, 20 bp, synthetic construct
  misc_feature 1..20: note = CRISPR gRNA sequence
  source 1..20: mol_type = other DNA
aaaaaaagaatcggaacttt

SEQ ID NO: 93754 - DNA, 20 bp, synthetic construct
  misc_feature 1..20: note = CRISPR gRNA sequence
  source 1..20: mol_type = other DNA
aaaaaagaatcggaacttta

SEQ ID NO: 93755 - DNA, 20 bp, synthetic construct
  misc_feature 1..20: note = CRISPR gRNA sequence
  source 1..20: mol_type = other DNA
tacctcaaaaatgtaatgag

SEQ ID NO: 93756 - DNA, 20 bp, synthetic construct
  misc_feature 1..20: note = CRISPR gRNA sequence
  source 1..20: mol_type = other DNA
acctcaaaaatgtaatgaga

SEQ ID NO: 93757 - DNA, 20 bp, synthetic construct
  misc_feature 1..20: note = CRISPR gRNA sequence
  source 1..20: mol_type = other DNA
cctcaaaaatgtaatgagat

SEQ ID NO: 93758 - DNA, 20 bp, synthetic construct
  misc_feature 1..20: note = CRISPR gRNA sequence
  source 1..20: mol_type = other DNA
aaaaatgtaatgagattttt

SEQ ID NO: 93759 - DNA, 20 bp, synthetic construct
  misc_feature 1..20: note = CRISPR gRNA sequence
  source 1..20: mol_type = other DNA
tttttagcttatatagacaa

SEQ ID NO: 93760 - DNA, 20 bp, synthetic construct
  misc_feature 1..20: note = CRISPR gRNA sequence
  source 1..20: mol_type = other DNA
ttttagcttatatagacaaa

SEQ ID NO: 93761 - DNA, 20 bp, synthetic construct
  misc_feature 1..20: note = CRISPR gRNA sequence
  source 1..20: mol_type = other DNA
tttagcttatatagacaaaa

SEQ ID NO: 93762 - DNA, 20 bp, synthetic construct
  misc_feature 1..20: note = CRISPR gRNA sequence
  source 1..20: mol_type = other DNA
ttagcttatatagacaaaat

SEQ ID NO: 93763 - DNA, 20 bp, synthetic construct
  misc_feature 1..20: note = CRISPR gRNA sequence
  source 1..20: mol_type = other DNA
tagcttatatagacaaaatc

SEQ ID NO: 93764 - DNA, 20 bp, synthetic construct
  misc_feature 1..20: note = CRISPR gRNA sequence
  source 1..20: mol_type = other DNA
agcttatatagacaaaatca

SEQ ID NO: 93765 - DNA, 20 bp, synthetic construct
  misc_feature 1..20: note = CRISPR gRNA sequence
  source 1..20: mol_type = other DNA
gcttatatagacaaaatcac

SEQ ID NO: 93766 - DNA, 20 bp, synthetic construct
  misc_feature 1..20: note = CRISPR gRNA sequence
  source 1..20: mol_type = other DNA
atatagacaaaatcacagag

SEQ ID NO: 93767 - DNA, 20 bp, synthetic construct
  misc_feature 1..20: note = CRISPR gRNA sequence
  source 1..20: mol_type = other DNA
tatagacaaaatcacagaga

SEQ ID NO: 93768 - DNA, 20 bp, synthetic construct
  misc_feature 1..20: note = CRISPR gRNA sequence
  source 1..20: mol_type = other DNA
taaacttgactacataaaaa

SEQ ID NO: 93769 - DNA, 20 bp, synthetic construct
  misc_feature 1..20: note = CRISPR gRNA sequence
  source 1..20: mol_type = other DNA
gactacataaaaatgaatgc

SEQ ID NO: 93770 - DNA, 20 bp, synthetic construct
  misc_feature 1..20: note = CRISPR gRNA sequence
  source 1..20: mol_type = other DNA
actacataaaaatgaatgct

SEQ ID NO: 93771 - DNA, 20 bp, synthetic construct
  misc_feature 1..20: note = CRISPR gRNA sequence
  source 1..20: mol_type = other DNA
cataaaaatgaatgctatag

SEQ ID NO: 93772 - DNA, 20 bp, synthetic construct
  misc_feature 1..20: note = CRISPR gRNA sequence
  source 1..20: mol_type = other DNA
tagtcaaaaatggtggcaaa

SEQ ID NO: 93773 - DNA, 20 bp, synthetic construct
  misc_feature 1..20: note = CRISPR gRNA sequence
  source 1..20: mol_type = other DNA
cacaatgacctagagcaaaa

SEQ ID NO: 93774 - DNA, 20 bp, synthetic construct
  misc_feature 1..20: note = CRISPR gRNA sequence
  source 1..20: mol_type = other DNA
gagcaaaaatatgtacaaca

SEQ ID NO: 93775 - DNA, 20 bp, synthetic construct
  misc_feature 1..20: note = CRISPR gRNA sequence
  source 1..20: mol_type = other DNA
tggttaacgtgtctggtatt

SEQ ID NO: 93776 - DNA, 20 bp, synthetic construct
  misc_feature 1..20: note = CRISPR gRNA sequence
  source 1..20: mol_type = other DNA
acgtgtctggtattttatca

SEQ ID NO: 93777 - DNA, 20 bp, synthetic construct
  misc_feature 1..20: note = CRISPR gRNA sequence
  source 1..20: mol_type = other DNA
gtattttatcacataaaata

SEQ ID NO: 93778 - DNA, 20 bp, synthetic construct
  misc_feature 1..20: note = CRISPR gRNA sequence
  source 1..20: mol_type = other DNA
tatcacataaaatattcctg

SEQ ID NO: 93779 - DNA, 20 bp, synthetic construct
  misc_feature 1..20: note = CRISPR gRNA sequence
  source 1..20: mol_type = other DNA
atcacataaaatattcctgg

SEQ ID NO: 93780 - DNA, 20 bp, synthetic construct
  misc_feature 1..20: note = CRISPR gRNA sequence
  source 1..20: mol_type = other DNA
tcacataaaatattcctggt

SEQ ID NO: 93781 - DNA, 20 bp, synthetic construct
  misc_feature 1..20: note = CRISPR gRNA sequence
  source 1..20: mol_type = other DNA
ctggttgggcattgtggttc

SEQ ID NO: 93782 - DNA, 20 bp, synthetic construct
  misc_feature 1..20: note = CRISPR gRNA sequence
  source 1..20: mol_type = other DNA
gttgggcattgtggttcatg

SEQ ID NO: 93783 - DNA, 20 bp, synthetic construct
  misc_feature 1..20: note = CRISPR gRNA sequence
  source 1..20: mol_type = other DNA
ggcattgtggttcatgcctg

SEQ ID NO: 93784 - DNA, 20 bp, synthetic construct
  misc_feature 1..20: note = CRISPR gRNA sequence
  source 1..20: mol_type = other DNA
tggttcatgcctgtaatcct

SEQ ID NO: 93785 - DNA, 20 bp, synthetic construct
  misc_feature 1..20: note = CRISPR gRNA sequence
  source 1..20: mol_type = other DNA
atgcctgtaatcctagcact

SEQ ID NO: 93786 - DNA, 20 bp, synthetic construct
  misc_feature 1..20: note = CRISPR gRNA sequence
  source 1..20: mol_type = other DNA
taatcctagcactttgggag

SEQ ID NO: 93787 - DNA, 20 bp, synthetic construct
  misc_feature 1..20: note = CRISPR gRNA sequence
  source 1..20: mol_type = other DNA
gcactttgggaggccaggtg

SEQ ID NO: 93788 - DNA, 20 bp, synthetic construct
  misc_feature 1..20: note = CRISPR gRNA sequence
  source 1..20: mol_type = other DNA
tgggaggccaggtgggagga

SEQ ID NO: 93789 - DNA, 20 bp, synthetic construct
  misc_feature 1..20: note = CRISPR gRNA sequence
  source 1..20: mol_type = other DNA
gggaggccaggtgggaggat

SEQ ID NO: 93790 - DNA, 20 bp, synthetic construct
  misc_feature 1..20: note = CRISPR gRNA sequence
  source 1..20: mol_type = other DNA
ggaggccaggtgggaggatc

SEQ ID NO: 93791 - DNA, 20 bp, synthetic construct
  misc_feature 1..20: note = CRISPR gRNA sequence
  source 1..20: mol_type = other DNA
gaggctgggaatttgagacc

SEQ ID NO: 93792 - DNA, 20 bp, synthetic construct
  misc_feature 1..20: note = CRISPR gRNA sequence
  source 1..20: mol_type = other DNA
aggctgggaatttgagacca

SEQ ID NO: 93793 - DNA, 20 bp, synthetic construct
  misc_feature 1..20: note = CRISPR gRNA sequence
  source 1..20: mol_type = other DNA
ggaatttgagaccattctgg

SEQ ID NO: 93794 - DNA, 20 bp, synthetic construct
  misc_feature 1..20: note = CRISPR gRNA sequence
  source 1..20: mol_type = other DNA
gagaccattctgggcaacgt

SEQ ID NO: 93795 - DNA, 20 bp, synthetic construct
  misc_feature 1..20: note = CRISPR gRNA sequence
  source 1..20: mol_type = other DNA
agaccattctgggcaacgta

SEQ ID NO: 93796 - DNA, 20 bp, synthetic construct
  misc_feature 1..20: note = CRISPR gRNA sequence
  source 1..20: mol_type = other DNA
tgggcaacgtagcgagaccc

SEQ ID NO: 93797 - DNA, 20 bp, synthetic construct
  misc_feature 1..20: note = CRISPR gRNA sequence
  source 1..20: mol_type = other DNA
ggcaacgtagcgagacccca

SEQ ID NO: 93798 - DNA, 20 bp, synthetic construct
  misc_feature 1..20: note = CRISPR gRNA sequence
  source 1..20: mol_type = other DNA
caaaaaaatttaaaaattag

SEQ ID NO: 93799 - DNA, 20 bp, synthetic construct
  misc_feature 1..20: note = CRISPR gRNA sequence
  source 1..20: mol_type = other DNA
aaaaattagccgagtgtgat

SEQ ID NO: 93800 - DNA, 20 bp, synthetic construct
  misc_feature 1..20: note = CRISPR gRNA sequence
  source 1..20: mol_type = other DNA
aaaattagccgagtgtgatg

SEQ ID NO: 93801 - DNA, 20 bp, synthetic construct
  misc_feature 1..20: note = CRISPR gRNA sequence
  source 1..20: mol_type = other DNA
gccgagtgtgatggtatgta

SEQ ID NO: 93802 - DNA, 20 bp, synthetic construct
  misc_feature 1..20: note = CRISPR gRNA sequence
  source 1..20: mol_type = other DNA
tagtcctggctactcaagag

SEQ ID NO: 93803 - DNA, 20 bp, synthetic construct
  misc_feature 1..20: note = CRISPR gRNA sequence
  source 1..20: mol_type = other DNA
gctactcaagaggctgaaac

SEQ ID NO: 93804 - DNA, 20 bp, synthetic construct
  misc_feature 1..20: note = CRISPR gRNA sequence
  source 1..20: mol_type = other DNA
ctcaagaggctgaaacagga

SEQ ID NO: 93805 - DNA, 20 bp, synthetic construct
  misc_feature 1..20: note = CRISPR gRNA sequence
  source 1..20: mol_type = other DNA
aagaggctgaaacaggagga

SEQ ID NO: 93806 - DNA, 20 bp, synthetic construct
  misc_feature 1..20: note = CRISPR gRNA sequence
  source 1..20: mol_type = other DNA
aaacaggaggattgcttgag

SEQ ID NO: 93807 - DNA, 20 bp, synthetic construct
  misc_feature 1..20: note = CRISPR gRNA sequence
  source 1..20: mol_type = other DNA
cttgagtccaggaattcgag

SEQ ID NO: 93808 - DNA, 20 bp, synthetic construct
  misc_feature 1..20: note = CRISPR gRNA sequence
  source 1..20: mol_type = other DNA
gagtccaggaattcgaggct

SEQ ID NO: 93809 - DNA, 20 bp, synthetic construct
  misc_feature 1..20: note = CRISPR gRNA sequence
  source 1..20: mol_type = other DNA
agtccaggaattcgaggctg

SEQ ID NO: 93810 - DNA, 20 bp, synthetic construct
  misc_feature 1..20: note = CRISPR gRNA sequence
  source 1..20: mol_type = other DNA
gaggctgcaatgagctatga

SEQ ID NO: 93811 - DNA, 20 bp, synthetic construct
  misc_feature 1..20: note = CRISPR gRNA sequence
  source 1..20: mol_type = other DNA
caatgagctatgatcatacc

SEQ ID NO: 93812 - DNA, 20 bp, synthetic construct
  misc_feature 1..20: note = CRISPR gRNA sequence
  source 1..20: mol_type = other DNA
tgatcataccactgtactcc

SEQ ID NO: 93813 - DNA, 20 bp, synthetic construct
  misc_feature 1..20: note = CRISPR gRNA sequence
  source 1..20: mol_type = other DNA
tactccagcctaggcaacag

SEQ ID NO: 93814 - DNA, 20 bp, synthetic construct
  misc_feature 1..20: note = CRISPR gRNA sequence
  source 1..20: mol_type = other DNA
cagcctaggcaacagagcac

SEQ ID NO: 93815 - DNA, 20 bp, synthetic construct
  misc_feature 1..20: note = CRISPR gRNA sequence
  source 1..20: mol_type = other DNA
ggcaacagagcaccctataa

SEQ ID NO: 93816 - DNA, 20 bp, synthetic construct
  misc_feature 1..20: note = CRISPR gRNA sequence
  source 1..20: mol_type = other DNA
taaatcattaaacatgatca

SEQ ID NO: 93817 - DNA, 20 bp, synthetic construct
  misc_feature 1..20: note = CRISPR gRNA sequence
  source 1..20: mol_type = other DNA
aacatgatcagtttccttac

SEQ ID NO: 93818 - DNA, 20 bp, synthetic construct
  misc_feature 1..20: note = CRISPR gRNA sequence
  source 1..20: mol_type = other DNA
ccttacatatatataaaata

SEQ ID NO: 93819 - DNA, 20 bp, synthetic construct
  misc_feature 1..20: note = CRISPR gRNA sequence
  source 1..20: mol_type = other DNA
cttacatatatataaaatat

SEQ ID NO: 93820 - DNA, 20 bp, synthetic construct
  misc_feature 1..20: note = CRISPR gRNA sequence
  source 1..20: mol_type = other DNA
acatatatataaaatatgtt

SEQ ID NO: 93821 - DNA, 20 bp, synthetic construct
  misc_feature 1..20: note = CRISPR gRNA sequence
  source 1..20: mol_type = other DNA
catatatataaaatatgttt

SEQ ID NO: 93822 - DNA, 20 bp, synthetic construct
  misc_feature 1..20: note = CRISPR gRNA sequence
  source 1..20: mol_type = other DNA
gcctctttgacagcttcagt

SEQ ID NO: 93823 - DNA, 20 bp, synthetic construct
  misc_feature 1..20: note = CRISPR gRNA sequence
  source 1..20: mol_type = other DNA
cctctttgacagcttcagtc

SEQ ID NO: 93824 - DNA, 20 bp, synthetic construct
  misc_feature 1..20: note = CRISPR gRNA sequence
  source 1..20: mol_type = other DNA
tttgacagcttcagtcttaa

SEQ ID NO: 93825 - DNA, 20 bp, synthetic construct
  misc_feature 1..20: note = CRISPR gRNA sequence
  source 1..20: mol_type = other DNA
tgacagcttcagtcttaact

SEQ ID NO: 93826 - DNA, 20 bp, synthetic construct
  misc_feature 1..20: note = CRISPR gRNA sequence
  source 1..20: mol_type = other DNA
gacagcttcagtcttaactg

SEQ ID NO: 93827 - DNA, 20 bp, synthetic construct
  misc_feature 1..20: note = CRISPR gRNA sequence
  source 1..20: mol_type = other DNA
acagcttcagtcttaactgc

SEQ ID NO: 93828 - DNA, 20 bp, synthetic construct
  misc_feature 1..20: note = CRISPR gRNA sequence
  source 1..20: mol_type = other DNA
cagtcttaactgcaaagaaa

SEQ ID NO: 93829 - DNA, 20 bp, synthetic construct
  misc_feature 1..20: note = CRISPR gRNA sequence
  source 1..20: mol_type = other DNA
agtcttaactgcaaagaaag

SEQ ID NO: 93830 - DNA, 20 bp, synthetic construct
  misc_feature 1..20: note = CRISPR gRNA sequence
  source 1..20: mol_type = other DNA
aactgcaaagaaagtttatt

SEQ ID NO: 93831 - DNA, 20 bp, synthetic construct
  misc_feature 1..20: note = CRISPR gRNA sequence
  source 1..20: mol_type = other DNA
actgcaaagaaagtttatta

SEQ ID NO: 93832 - DNA, 20 bp, synthetic construct
  misc_feature 1..20: note = CRISPR gRNA sequence
  source 1..20: mol_type = other DNA
caaagaaagtttattacaaa

SEQ ID NO: 93833 - DNA, 20 bp, synthetic construct
  misc_feature 1..20: note = CRISPR gRNA sequence
  source 1..20: mol_type = other DNA
attacaaaaattcctgtaat

SEQ ID NO: 93834 - DNA, 20 bp, synthetic construct
  misc_feature 1..20: note = CRISPR gRNA sequence
  source 1..20: mol_type = other DNA
ttacaaaaattcctgtaatt

SEQ ID NO: 93835 - DNA, 20 bp, synthetic construct
  misc_feature 1..20: note = CRISPR gRNA sequence
  source 1..20: mol_type = other DNA
caaaaattcctgtaatttga

SEQ ID NO: 93836 - DNA, 20 bp, synthetic construct
  misc_feature 1..20: note = CRISPR gRNA sequence
  source 1..20: mol_type = other DNA
ctgtaatttgatgaggaaaa

SEQ ID NO: 93837 - DNA, 20 bp, synthetic construct
  misc_feature 1..20: note = CRISPR gRNA sequence
  source 1..20: mol_type = other DNA
taatttgatgaggaaaacct

SEQ ID NO: 93838 - DNA, 20 bp, synthetic construct
  misc_feature 1..20: note = CRISPR gRNA sequence
  source 1..20: mol_type = other DNA
gatgaggaaaacctttggct

SEQ ID NO: 93839 - DNA, 20 bp, synthetic construct
  misc_feature 1..20: note = CRISPR gRNA sequence
  source 1..20: mol_type = other DNA
atgaggaaaacctttggctt

SEQ ID NO: 93840 - DNA, 20 bp, synthetic construct
  misc_feature 1..20: note = CRISPR gRNA sequence
  source 1..20: mol_type = other DNA
tggcttcaatacattgcaaa

SEQ ID NO: 93841 - DNA, 20 bp, synthetic construct
  misc_feature 1..20: note = CRISPR gRNA sequence
  source 1..20: mol_type = other DNA
ggcttcaatacattgcaaaa

SEQ ID NO: 93842 - DNA, 20 bp, synthetic construct
  misc_feature 1..20: note = CRISPR gRNA sequence
  source 1..20: mol_type = other DNA
gcttcaatacattgcaaaag

SEQ ID NO: 93843 - DNA, 20 bp, synthetic construct
  misc_feature 1..20: note = CRISPR gRNA sequence
  source 1..20: mol_type = other DNA
caatacattgcaaaagatag

SEQ ID NO: 93844 - DNA, 20 bp, synthetic construct
  misc_feature 1..20: note = CRISPR gRNA sequence
  source 1..20: mol_type = other DNA
aatacattgcaaaagataga

SEQ ID NO: 93845 - DNA, 20 bp, synthetic construct
  misc_feature 1..20: note = CRISPR gRNA sequence
  source 1..20: mol_type = other DNA
caaaagatagaaacagaaaa

SEQ ID NO: 93846 - DNA, 20 bp, synthetic construct
  misc_feature 1..20: note = CRISPR gRNA sequence
  source 1..20: mol_type = other DNA
aatgatatggaaaggtattc

SEQ ID NO: 93847 - DNA, 20 bp, synthetic construct
  misc_feature 1..20: note = CRISPR gRNA sequence
  source 1..20: mol_type = other DNA
aatatcagtaaaaataaaca

SEQ ID NO: 93848 - DNA, 20 bp, synthetic construct
  misc_feature 1..20: note = CRISPR gRNA sequence
  source 1..20: mol_type = other DNA
tttaaacgattacgcacaat

SEQ ID NO: 93849 - DNA, 20 bp, synthetic construct
  misc_feature 1..20: note = CRISPR gRNA sequence
  source 1..20: mol_type = other DNA
aaacgattacgcacaatgat

SEQ ID NO: 93850 - DNA, 20 bp, synthetic construct
  misc_feature 1..20: note = CRISPR gRNA sequence
  source 1..20: mol_type = other DNA
aacgattacgcacaatgatg

SEQ ID NO: 93851 - DNA, 20 bp, synthetic construct
  misc_feature 1..20: note = CRISPR gRNA sequence
  source 1..20: mol_type = other DNA
cgcacaatgatgcagtgatg

SEQ ID NO: 93852 - DNA, 20 bp, synthetic construct
  misc_feature 1..20: note = CRISPR gRNA sequence
  source 1..20: mol_type = other DNA
tcatgaaatggacattctca

SEQ ID NO: 93853 - DNA, 20 bp, synthetic construct
  misc_feature 1..20: note = CRISPR gRNA sequence
  source 1..20: mol_type = other DNA
catgaaatggacattctcaa

SEQ ID NO: 93854 - DNA, 20 bp, synthetic construct
  misc_feature 1..20: note = CRISPR gRNA sequence
  source 1..20: mol_type = other DNA
atgaaatggacattctcaag

SEQ ID NO: 93855 - DNA, 20 bp, synthetic construct
  misc_feature 1..20: note = CRISPR gRNA sequence
  source 1..20: mol_type = other DNA
tcaagtagttaatggcatta

SEQ ID NO: 93856 - DNA, 20 bp, synthetic construct
  misc_feature 1..20: note = CRISPR gRNA sequence
  source 1..20: mol_type = other DNA
aagtagttaatggcattata

SEQ ID NO: 93857 - DNA, 20 bp, synthetic construct
  misc_feature 1..20: note = CRISPR gRNA sequence
  source 1..20: mol_type = other DNA
atggcattatatattggtat

SEQ ID NO: 93858 - DNA, 20 bp, synthetic construct
  misc_feature 1..20: note = CRISPR gRNA sequence
  source 1..20: mol_type = other DNA
tatattggtatggcactttc

SEQ ID NO: 93859 - DNA, 20 bp, synthetic construct
  misc_feature 1..20: note = CRISPR gRNA sequence
  source 1..20: mol_type = other DNA
gtatggcactttcagaaagc

SEQ ID NO: 93860 - DNA, 20 bp, synthetic construct
  misc_feature 1..20: note = CRISPR gRNA sequence
  source 1..20: mol_type = other DNA
tcagaaagcagttgggcaat

SEQ ID NO: 93861 - DNA, 20 bp, synthetic construct
  misc_feature 1..20: note = CRISPR gRNA sequence
  source 1..20: mol_type = other DNA
cagaaagcagttgggcaata

SEQ ID NO: 93862 - DNA, 20 bp, synthetic construct
  misc_feature 1..20: note = CRISPR gRNA sequence
  source 1..20: mol_type = other DNA
agaaagcagttgggcaatat

SEQ ID NO: 93863 - DNA, 20 bp, synthetic construct
  misc_feature 1..20: note = CRISPR gRNA sequence
  source 1..20: mol_type = other DNA
ggcaatatgtaccaggagtc

SEQ ID NO: 93864 - DNA, 20 bp, synthetic construct
  misc_feature 1..20: note = CRISPR gRNA sequence
  source 1..20: mol_type = other DNA
tcaactcagacatcacattt

SEQ ID NO: 93865 - DNA, 20 bp, synthetic construct
  misc_feature 1..20: note = CRISPR gRNA sequence
  source 1..20: mol_type = other DNA
caactcagacatcacattta

SEQ ID NO: 93866 - DNA, 20 bp, synthetic construct
  misc_feature 1..20: note = CRISPR gRNA sequence
  source 1..20: mol_type = other DNA
aactcagacatcacatttaa

SEQ ID NO: 93867 - DNA, 20 bp, synthetic construct
  misc_feature 1..20: note = CRISPR gRNA sequence
  source 1..20: mol_type = other DNA
agacatcacatttaatatga

SEQ ID NO: 93868 - DNA, 20 bp, synthetic construct
  misc_feature 1..20: note = CRISPR gRNA sequence
  source 1..20: mol_type = other DNA
aatatgaagacatttacaga

SEQ ID NO: 93869 - DNA, 20 bp, synthetic construct
  misc_feature 1..20: note = CRISPR gRNA sequence
  source 1..20: mol_type = other DNA
atatgaagacatttacagaa

SEQ ID NO: 93870 - DNA, 20 bp, synthetic construct
  misc_feature 1..20: note = CRISPR gRNA sequence
  source 1..20: mol_type = other DNA
acagaatgtaaatcctaaat

SEQ ID NO: 93871 - DNA, 20 bp, synthetic construct
  misc_feature 1..20: note = CRISPR gRNA sequence
  source 1..20: mol_type = other DNA
cagaatgtaaatcctaaata

SEQ ID NO: 93872 - DNA, 20 bp, synthetic construct
  misc_feature 1..20: note = CRISPR gRNA sequence
  source 1..20: mol_type = other DNA
aatatggatagagttaaaca

SEQ ID NO: 93873 - DNA, 20 bp, synthetic construct
  misc_feature 1..20: note = CRISPR gRNA sequence
  source 1..20: mol_type = other DNA
aacataaaggtattgccagg

SEQ ID NO: 93874 - DNA, 20 bp, synthetic construct
  misc_feature 1..20: note = CRISPR gRNA sequence
  source 1..20: mol_type = other DNA
ccaggaatatatttctcata

SEQ ID NO: 93875 - DNA, 20 bp, synthetic construct
  misc_feature 1..20: note = CRISPR gRNA sequence
  source 1..20: mol_type = other DNA
ctcataaatagtaaaaaagg

SEQ ID NO: 93876 - DNA, 20 bp, synthetic construct
  misc_feature 1..20: note = CRISPR gRNA sequence
  source 1..20: mol_type = other DNA
tcataaatagtaaaaaaggt

SEQ ID NO: 93877 - DNA, 20 bp, synthetic construct
  misc_feature 1..20: note = CRISPR gRNA sequence
  source 1..20: mol_type = other DNA
ataaatagtaaaaaaggtag

SEQ ID NO: 93878 - DNA, 20 bp, synthetic construct
  misc_feature 1..20: note = CRISPR gRNA sequence
  source 1..20: mol_type = other DNA
aaacagcctaaatgtccaac

SEQ ID NO: 93879 - DNA, 20 bp, synthetic construct
  misc_feature 1..20: note = CRISPR gRNA sequence
  source 1..20: mol_type = other DNA
aatgtccaacagtgtcataa

SEQ ID NO: 93880 - DNA, 20 bp, synthetic construct
  misc_feature 1..20: note = CRISPR gRNA sequence
  source 1..20: mol_type = other DNA
agatgatttttaaataaaac

SEQ ID NO: 93881 - DNA, 20 bp, synthetic construct
  misc_feature 1..20: note = CRISPR gRNA sequence
  source 1..20: mol_type = other DNA
ttaaataaaactgtttaata

SEQ ID NO: 93882 - DNA, 20 bp, synthetic construct
  misc_feature 1..20: note = CRISPR gRNA sequence
  source 1..20: mol_type = other DNA
taaataaaactgtttaataa

SEQ ID NO: 93883 - DNA, 20 bp, synthetic construct
  misc_feature 1..20: note = CRISPR gRNA sequence
  source 1..20: mol_type = other DNA
aaataaaactgtttaataaa

SEQ ID NO: 93884 - DNA, 20 bp, synthetic construct
  misc_feature 1..20: note = CRISPR gRNA sequence
  source 1..20: mol_type = other DNA
aataaaactgtttaataaat

SEQ ID NO: 93885 - DNA, 20 bp, synthetic construct
  misc_feature 1..20: note = CRISPR gRNA sequence
  source 1..20: mol_type = other DNA
tttaataaatagaaaatgta

SEQ ID NO: 93886 - DNA, 20 bp, synthetic construct
  misc_feature 1..20: note = CRISPR gRNA sequence
  source 1..20: mol_type = other DNA
aataaatagaaaatgtacta

SEQ ID NO: 93887 - DNA, 20 bp, synthetic construct
  misc_feature 1..20: note = CRISPR gRNA sequence
  source 1..20: mol_type = other DNA
ataaatagaaaatgtactaa

SEQ ID NO: 93888 - DNA, 20 bp, synthetic construct
  misc_feature 1..20: note = CRISPR gRNA sequence
  source 1..20: mol_type = other DNA
agatataatacatataatct

SEQ ID NO: 93889 - DNA, 20 bp, synthetic construct
  misc_feature 1..20: note = CRISPR gRNA sequence
  source 1..20: mol_type = other DNA
aaagtcagtatttaatgata

SEQ ID NO: 93890 - DNA, 20 bp, synthetic construct
  misc_feature 1..20: note = CRISPR gRNA sequence
  source 1..20: mol_type = other DNA
aatgatagtatgttcacttt

SEQ ID NO: 93891 - DNA, 20 bp, synthetic construct
  misc_feature 1..20: note = CRISPR gRNA sequence
  source 1..20: mol_type = other DNA
atgatagtatgttcacttta

SEQ ID NO: 93892 - DNA, 20 bp, synthetic construct
  misc_feature 1..20: note = CRISPR gRNA sequence
  source 1..20: mol_type = other DNA
actttattcagtttatcttt

SEQ ID NO: 93893 - DNA, 20 bp, synthetic construct
  misc_feature 1..20: note = CRISPR gRNA sequence
  source 1..20: mol_type = other DNA
tattcagtttatctttttgc

SEQ ID NO: 93894 - DNA, 20 bp, synthetic construct
  misc_feature 1..20: note = CRISPR gRNA sequence
  source 1..20: mol_type = other DNA
attcagtttatctttttgca

SEQ ID NO: 93895 - DNA, 20 bp, synthetic construct
  misc_feature 1..20: note = CRISPR gRNA sequence
  source 1..20: mol_type = other DNA
ttcagtttatctttttgcag

SEQ ID NO: 93896 - DNA, 20 bp, synthetic construct
  misc_feature 1..20: note = CRISPR gRNA sequence
  source 1..20: mol_type = other DNA
agtttatctttttgcagctt

SEQ ID NO: 93897 - DNA, 20 bp, synthetic construct
  misc_feature 1..20: note = CRISPR gRNA sequence
  source 1..20: mol_type = other DNA
atctttttgcagcttattgg

SEQ ID NO: 93898 - DNA, 20 bp, synthetic construct
  misc_feature 1..20: note = CRISPR gRNA sequence
  source 1..20: mol_type = other DNA
tctttttgcagcttattggg

SEQ ID NO: 93899 - DNA, 20 bp, synthetic construct
  misc_feature 1..20: note = CRISPR gRNA sequence
  source 1..20: mol_type = other DNA
tttgcagcttattggggcca

SEQ ID NO: 93900 - DNA, 20 bp, synthetic construct
  misc_feature 1..20: note = CRISPR gRNA sequence
  source 1..20: mol_type = other DNA
ttgcagcttattggggccaa

SEQ ID NO: 93901 - DNA, 20 bp, synthetic construct
  misc_feature 1..20: note = CRISPR gRNA sequence
  source 1..20: mol_type = other DNA
tgcagcttattggggccaaa

SEQ ID NO: 93902 - DNA, 20 bp, synthetic construct
  misc_feature 1..20: note = CRISPR gRNA sequence
  source 1..20: mol_type = other DNA
gcagcttattggggccaaag

SEQ ID NO: 93903 - DNA, 20 bp, synthetic construct
  misc_feature 1..20: note = CRISPR gRNA sequence
  source 1..20: mol_type = other DNA
cagcttattggggccaaaga

SEQ ID NO: 93904 - DNA, 20 bp, synthetic construct
  misc_feature 1..20: note = CRISPR gRNA sequence
  source 1..20: mol_type = other DNA
attggggccaaagatttttt

SEQ ID NO: 93905 - DNA, 20 bp, synthetic construct
  misc_feature 1..20: note = CRISPR gRNA sequence
  source 1..20: mol_type = other DNA
ttggggccaaagattttttt

SEQ ID NO: 93906 - DNA, 20 bp, synthetic construct
  misc_feature 1..20: note = CRISPR gRNA sequence
  source 1..20: mol_type = other DNA
gggccaaagatttttttctc

SEQ ID NO: 93907 - DNA, 20 bp, synthetic construct
  misc_feature 1..20: note = CRISPR gRNA sequence
  source 1..20: mol_type = other DNA
ttttctctataaatttatgt

SEQ ID NO: 93908 - DNA, 20 bp, synthetic construct
  misc_feature 1..20: note = CRISPR gRNA sequence
  source 1..20: mol_type = other DNA
tttctctataaatttatgta

SEQ ID NO: 93909 - DNA, 20 bp, synthetic construct
  misc_feature 1..20: note = CRISPR gRNA sequence
  source 1..20: mol_type = other DNA
ttctctataaatttatgtaa

SEQ ID NO: 93910 - DNA, 20 bp, synthetic construct
  misc_feature 1..20: note = CRISPR gRNA sequence
  source 1..20: mol_type = other DNA
tctctataaatttatgtaag

SEQ ID NO: 93911 - DNA, 20 bp, synthetic construct
  misc_feature 1..20: note = CRISPR gRNA sequence
  source 1..20: mol_type = other DNA
ctctataaatttatgtaagt

SEQ ID NO: 93912 - DNA, 20 bp, synthetic construct
  misc_feature 1..20: note = CRISPR gRNA sequence
  source 1..20: mol_type = other DNA
tctataaatttatgtaagta

SEQ ID NO: 93913 - DNA, 20 bp, synthetic construct
  misc_feature 1..20: note = CRISPR gRNA sequence
  source 1..20: mol_type = other DNA
tataaatttatgtaagtatt

SEQ ID NO: 93914 - DNA, 20 bp, synthetic construct
  misc_feature 1..20: note = CRISPR gRNA sequence
  source 1..20: mol_type = other DNA
taaatttatgtaagtatttt

SEQ ID NO: 93915 - DNA, 20 bp, synthetic construct
  misc_feature 1..20: note = CRISPR gRNA sequence
  source 1..20: mol_type = other DNA
atgtaagtattttattataa

SEQ ID NO: 93916 - DNA, 20 bp, synthetic construct
  misc_feature 1..20: note = CRISPR gRNA sequence
  source 1..20: mol_type = other DNA
tgtaagtattttattataaa

SEQ ID NO: 93917 - DNA, 20 bp, synthetic construct
  misc_feature 1..20: note = CRISPR gRNA sequence
  source 1..20: mol_type = other DNA
tattataaaaacctattaca

SEQ ID NO: 93918 - DNA, 20 bp, synthetic construct
  misc_feature 1..20: note = CRISPR gRNA sequence
  source 1..20: mol_type = other DNA
attataaaaacctattacag

SEQ ID NO: 93919 - DNA, 20 bp, synthetic construct
  misc_feature 1..20: note = CRISPR gRNA sequence
  source 1..20: mol_type = other DNA
ttataaaaacctattacagg

SEQ ID NO: 93920 - DNA, 20 bp, synthetic construct
  misc_feature 1..20: note = CRISPR gRNA sequence
  source 1..20: mol_type = other DNA
taaaaacctattacaggaga

SEQ ID NO: 93921 - DNA, 20 bp, synthetic construct
  misc_feature 1..20: note = CRISPR gRNA sequence
  source 1..20: mol_type = other DNA
ttacaggagactgtggcagg

SEQ ID NO: 93922 - DNA, 20 bp, synthetic construct
  misc_feature 1..20: note = CRISPR gRNA sequence
  source 1..20: mol_type = other DNA
caggagactgtggcaggatg

SEQ ID NO: 93923 - DNA, 20 bp, synthetic construct
  misc_feature 1..20: note = CRISPR gRNA sequence
  source 1..20: mol_type = other DNA
tggcaggatgattgcttgag

SEQ ID NO: 93924 - DNA, 20 bp, synthetic construct
  misc_feature 1..20: note = CRISPR gRNA sequence
  source 1..20: mol_type = other DNA
cttgagccgaggagttcaag

SEQ ID NO: 93925 - DNA, 20 bp, synthetic construct
  misc_feature 1..20: note = CRISPR gRNA sequence
  source 1..20: mol_type = other DNA
gagccgaggagttcaagact

SEQ ID NO: 93926 - DNA, 20 bp, synthetic construct
  misc_feature 1..20: note = CRISPR gRNA sequence
  source 1..20: mol_type = other DNA
agccgaggagttcaagactg

SEQ ID NO: 93927 - DNA, 20 bp, synthetic construct
  misc_feature 1..20: note = CRISPR gRNA sequence
  source 1..20: mol_type = other DNA
aagactgcagtgagctatgc

SEQ ID NO: 93928 - DNA, 20 bp, synthetic construct
  misc_feature 1..20: note = CRISPR gRNA sequence
  source 1..20: mol_type = other DNA
cagtgagctatgctcacgcc

SEQ ID NO: 93929 - DNA, 20 bp, synthetic construct
  misc_feature 1..20: note = CRISPR gRNA sequence
  source 1..20: mol_type = other DNA
tgctcacgccactgcactcc

SEQ ID NO: 93930 - DNA, 20 bp, synthetic construct
  misc_feature 1..20: note = CRISPR gRNA sequence
  source 1..20: mol_type = other DNA
acgccactgcactccagcgt

SEQ ID NO: 93931 - DNA, 20 bp, synthetic construct
  misc_feature 1..20: note = CRISPR gRNA sequence
  source 1..20: mol_type = other DNA
cactccagcgtggggaacag

SEQ ID NO: 93932 - DNA, 20 bp, synthetic construct
  misc_feature 1..20: note = CRISPR gRNA sequence
  source 1..20: mol_type = other DNA
cagcgtggggaacagagtga

SEQ ID NO: 93933 - DNA, 20 bp, synthetic construct
  misc_feature 1..20: note = CRISPR gRNA sequence
  source 1..20: mol_type = other DNA
tctctaataataatatgtta

SEQ ID NO: 93934 - DNA, 20 bp, synthetic construct
  misc_feature 1..20: note = CRISPR gRNA sequence
  source 1..20: mol_type = other DNA
taataataatatgttaatca

SEQ ID NO: 93935 - DNA, 20 bp, synthetic construct
  misc_feature 1..20: note = CRISPR gRNA sequence
  source 1..20: mol_type = other DNA
ataataatatgttaatcata

SEQ ID NO: 93936 - DNA, 20 bp, synthetic construct
  misc_feature 1..20: note = CRISPR gRNA sequence
  source 1..20: mol_type = other DNA
atcatagtctgttatatttg

SEQ ID NO: 93937 - DNA, 20 bp, synthetic construct
  misc_feature 1..20: note = CRISPR gRNA sequence
  source 1..20: mol_type = other DNA
ttatatttgttatattatta

SEQ ID NO: 93938 - DNA, 20 bp, synthetic construct
  misc_feature 1..20: note = CRISPR gRNA sequence
  source 1..20: mol_type = other DNA
tatttgttatattattacaa

SEQ ID NO: 93939 - DNA, 20 bp, synthetic construct
  misc_feature 1..20: note = CRISPR gRNA sequence
  source 1..20: mol_type = other DNA
gttatattattacaactata

SEQ ID NO: 93940 - DNA, 20 bp, synthetic construct
  misc_feature 1..20: note = CRISPR gRNA sequence
  source 1..20: mol_type = other DNA
ttatattattacaactatat

SEQ ID NO: 93941 - DNA, 20 bp, synthetic construct
  misc_feature 1..20: note = CRISPR gRNA sequence
  source 1..20: mol_type = other DNA
tattattacaactatatttt

SEQ ID NO: 93942 - DNA, 20 bp, synthetic construct
  misc_feature 1..20: note = CRISPR gRNA sequence
  source 1..20: mol_type = other DNA
ttacaactatattttaaagt

SEQ ID NO: 93943 - DNA, 20 bp, synthetic construct
  misc_feature 1..20: note = CRISPR gRNA sequence
  source 1..20: mol_type = other DNA
caactatattttaaagtgat

SEQ ID NO: 93944 - DNA, 20 bp, synthetic construct
  misc_feature 1..20: note = CRISPR gRNA sequence
  source 1..20: mol_type = other DNA
tattttaaagtgatgagtgt

SEQ ID NO: 93945 - DNA, 20 bp, synthetic construct
  misc_feature 1..20: note = CRISPR gRNA sequence
  source 1..20: mol_type = other DNA
taaagtgatgagtgtacaaa

SEQ ID NO: 93946 - DNA, 20 bp, synthetic construct
  misc_feature 1..20: note = CRISPR gRNA sequence
  source 1..20: mol_type = other DNA
aaagtgatgagtgtacaaaa

SEQ ID NO: 93947 - DNA, 20 bp, synthetic construct
  misc_feature 1..20: note = CRISPR gRNA sequence
  source 1..20: mol_type = other DNA
aagtgatgagtgtacaaaaa

SEQ ID NO: 93948 - DNA, 20 bp, synthetic construct
  misc_feature 1..20: note = CRISPR gRNA sequence
  source 1..20: mol_type = other DNA
gatgttttagagcagttata

SEQ ID NO: 93949 - DNA, 20 bp, synthetic construct
  misc_feature 1..20: note = CRISPR gRNA sequence
  source 1..20: mol_type = other DNA
tagagcagttatattttttc

SEQ ID NO: 93950 - DNA, 20 bp, synthetic construct
  misc_feature 1..20: note = CRISPR gRNA sequence
  source 1..20: mol_type = other DNA
agagcagttatattttttcc

SEQ ID NO: 93951 - DNA, 20 bp, synthetic construct
  misc_feature 1..20: note = CRISPR gRNA sequence
  source 1..20: mol_type = other DNA
gagcagttatattttttcct

SEQ ID NO: 93952 - DNA, 20 bp, synthetic construct
  misc_feature 1..20: note = CRISPR gRNA sequence
  source 1..20: mol_type = other DNA
tattttttcctgaaattttg

SEQ ID NO: 93953 - DNA, 20 bp, synthetic construct
  misc_feature 1..20: note = CRISPR gRNA sequence
  source 1..20: mol_type = other DNA
tttcctgaaattttggtata

SEQ ID NO: 93954 - DNA, 20 bp, synthetic construct
  misc_feature 1..20: note = CRISPR gRNA sequence
  source 1..20: mol_type = other DNA
ttcctgaaattttggtatat

SEQ ID NO: 93955 - DNA, 20 bp, synthetic construct
  misc_feature 1..20: note = CRISPR gRNA sequence
  source 1..20: mol_type = other DNA
tcctgaaattttggtatata

SEQ ID NO: 93956 - DNA, 20 bp, synthetic construct
  misc_feature 1..20: note = CRISPR gRNA sequence
  source 1..20: mol_type = other DNA
cctgaaattttggtatatac

SEQ ID NO: 93957 - DNA, 20 bp, synthetic construct
  misc_feature 1..20: note = CRISPR gRNA sequence
  source 1..20: mol_type = other DNA
ctgaaattttggtatatacc

SEQ ID NO: 93958 - DNA, 20 bp, synthetic construct
  misc_feature 1..20: note = CRISPR gRNA sequence
  source 1..20: mol_type = other DNA
aaattttggtatataccgat

SEQ ID NO: 93959 - DNA, 20 bp, synthetic construct
  misc_feature 1..20: note = CRISPR gRNA sequence
  source 1..20: mol_type = other DNA
tggtatataccgatatatat

SEQ ID NO: 93960 - DNA, 20 bp, synthetic construct
  misc_feature 1..20: note = CRISPR gRNA sequence
  source 1..20: mol_type = other DNA
ggtatataccgatatatatg

SEQ ID NO: 93961 - DNA, 20 bp, synthetic construct
  misc_feature 1..20: note = CRISPR gRNA sequence
  source 1..20: mol_type = other DNA
gtatataccgatatatatgt

SEQ ID NO: 93962 - DNA, 20 bp, synthetic construct
  misc_feature 1..20: note = CRISPR gRNA sequence
  source 1..20: mol_type = other DNA
tacacacaatttttaatttc

SEQ ID NO: 93963 - DNA, 20 bp, synthetic construct
  misc_feature 1..20: note = CRISPR gRNA sequence
  source 1..20: mol_type = other DNA
ttaatttctttatgaagact

SEQ ID NO: 93964 - DNA, 20 bp, synthetic construct
  misc_feature 1..20: note = CRISPR gRNA sequence
  source 1..20: mol_type = other DNA
taatttctttatgaagactt

SEQ ID NO: 93965 - DNA, 20 bp, synthetic construct
  misc_feature 1..20: note = CRISPR gRNA sequence
  source 1..20: mol_type = other DNA
aatttctttatgaagactta

SEQ ID NO: 93966 - DNA, 20 bp, synthetic construct
  misc_feature 1..20: note = CRISPR gRNA sequence
  source 1..20: mol_type = other DNA
atttctttatgaagacttag

SEQ ID NO: 93967 - DNA, 20 bp, synthetic construct
  misc_feature 1..20: note = CRISPR gRNA sequence
  source 1..20: mol_type = other DNA
ctttatgaagacttagttgc

SEQ ID NO: 93968 - DNA, 20 bp, synthetic construct
  misc_feature 1..20: note = CRISPR gRNA sequence
  source 1..20: mol_type = other DNA
tttatgaagacttagttgcc

SEQ ID NO: 93969 - DNA, 20 bp, synthetic construct
  misc_feature 1..20: note = CRISPR gRNA sequence
  source 1..20: mol_type = other DNA
tatgaagacttagttgccta

SEQ ID NO: 93970 - DNA, 20 bp, synthetic construct
  misc_feature 1..20: note = CRISPR gRNA sequence
  source 1..20: mol_type = other DNA
atgaagacttagttgcctaa

SEQ ID NO: 93971 - DNA, 20 bp, synthetic construct
  misc_feature 1..20: note = CRISPR gRNA sequence
  source 1..20: mol_type = other DNA
tgaagacttagttgcctaat

SEQ ID NO: 93972 - DNA, 20 bp, synthetic construct
  misc_feature 1..20: note = CRISPR gRNA sequence
  source 1..20: mol_type = other DNA
agttgcctaatgagaaactt

SEQ ID NO: 93973 - DNA, 20 bp, synthetic construct
  misc_feature 1..20: note = CRISPR gRNA sequence
  source 1..20: mol_type = other DNA
gttgcctaatgagaaacttg

SEQ ID NO: 93974 - DNA, 20 bp, synthetic construct
  misc_feature 1..20: note = CRISPR gRNA sequence
  source 1..20: mol_type = other DNA
cctaatgagaaacttgactt

SEQ ID NO: 93975 - DNA, 20 bp, synthetic construct
  misc_feature 1..20: note = CRISPR gRNA sequence
  source 1..20: mol_type = other DNA
atgagaaacttgacttctag

SEQ ID NO: 93976 - DNA, 20 bp, synthetic construct
  misc_feature 1..20: note = CRISPR gRNA sequence
  source 1..20: mol_type = other DNA
gacttctagcactagtttgt

SEQ ID NO: 93977 - DNA, 20 bp, synthetic construct
  misc_feature 1..20: note = CRISPR gRNA sequence
  source 1..20: mol_type = other DNA
acttctagcactagtttgta

SEQ ID NO: 93978 - DNA, 20 bp, synthetic construct
  misc_feature 1..20: note = CRISPR gRNA sequence
  source 1..20: mol_type = other DNA
ctagcactagtttgtatgta

SEQ ID NO: 93979 - DNA, 20 bp, synthetic construct
  misc_feature 1..20: note = CRISPR gRNA sequence
  source 1..20: mol_type = other DNA
tagcactagtttgtatgtat

SEQ ID NO: 93980 - DNA, 20 bp, synthetic construct
  misc_feature 1..20: note = CRISPR gRNA sequence
  source 1..20: mol_type = other DNA
gcactagtttgtatgtatgt

SEQ ID NO: 93981 - DNA, 20 bp, synthetic construct
  misc_feature 1..20: note = CRISPR gRNA sequence
  source 1..20: mol_type = other DNA
gtttgtatgtatgtacaaac

SEQ ID NO: 93982 - DNA, 20 bp, synthetic construct
  misc_feature 1..20: note = CRISPR gRNA sequence
  source 1..20: mol_type = other DNA
gtatgtatgtacaaactggc

SEQ ID NO: 93983 - DNA, 20 bp, synthetic construct
  misc_feature 1..20: note = CRISPR gRNA sequence
  source 1..20: mol_type = other DNA
tatgtatgtacaaactggca

SEQ ID NO: 93984 - DNA, 20 bp, synthetic construct
  misc_feature 1..20: note = CRISPR gRNA sequence
  source 1..20: mol_type = other DNA
gcatttagctgctattttca

SEQ ID NO: 93985 - DNA, 20 bp, synthetic construct
  misc_feature 1..20: note = CRISPR gRNA sequence
  source 1..20: mol_type = other DNA
agctgctattttcacatgtg

SEQ ID NO: 93986 - DNA, 20 bp, synthetic construct
  misc_feature 1..20: note = CRISPR gRNA sequence
  source 1..20: mol_type = other DNA
gctgctattttcacatgtgg

SEQ ID NO: 93987 - DNA, 20 bp, synthetic construct
  misc_feature 1..20: note = CRISPR gRNA sequence
  source 1..20: mol_type = other DNA
ctattttcacatgtggcccc

SEQ ID NO: 93988 - DNA, 20 bp, synthetic construct
  misc_feature 1..20: note = CRISPR gRNA sequence
  source 1..20: mol_type = other DNA
ttttcacatgtggccccctt

SEQ ID NO: 93989 - DNA, 20 bp, synthetic construct
  misc_feature 1..20: note = CRISPR gRNA sequence
  source 1..20: mol_type = other DNA
tcacatgtggccccctttca

SEQ ID NO: 93990 - DNA, 20 bp, synthetic construct
  misc_feature 1..20: note = CRISPR gRNA sequence
  source 1..20: mol_type = other DNA
cacatgtggccccctttcat

SEQ ID NO: 93991 - DNA, 20 bp, synthetic construct
  misc_feature 1..20: note = CRISPR gRNA sequence
  source 1..20: mol_type = other DNA
acatgtggccccctttcatc

SEQ ID NO: 93992 - DNA, 20 bp, synthetic construct
  misc_feature 1..20: note = CRISPR gRNA sequence
  source 1..20: mol_type = other DNA
tcatctccattttttttctt

SEQ ID NO: 93993 - DNA, 20 bp, synthetic construct
  misc_feature 1..20: note = CRISPR gRNA sequence
  source 1..20: mol_type = other DNA
catctccattttttttcttg

SEQ ID NO: 93994 - DNA, 20 bp, synthetic construct
  misc_feature 1..20: note = CRISPR gRNA sequence
  source 1..20: mol_type = other DNA
atctccattttttttcttgc

SEQ ID NO: 93995 - DNA, 20 bp, synthetic construct
  misc_feature 1..20: note = CRISPR gRNA sequence
  source 1..20: mol_type = other DNA
cattttttttcttgctataa

SEQ ID NO: 93996 - DNA, 20 bp, synthetic construct
  misc_feature 1..20: note = CRISPR gRNA sequence
  source 1..20: mol_type = other DNA
tttttcttgctataatcctg

SEQ ID NO: 93997 - DNA, 20 bp, synthetic construct
  misc_feature 1..20: note = CRISPR gRNA sequence
  source 1..20: mol_type = other DNA
ttttcttgctataatcctgg

SEQ ID NO: 93998 - DNA, 20 bp, synthetic construct
  misc_feature 1..20: note = CRISPR gRNA sequence
  source 1..20: mol_type = other DNA
tttcttgctataatcctggg

SEQ ID NO: 93999 - DNA, 20 bp, synthetic construct
  misc_feature 1..20: note = CRISPR gRNA sequence
  source 1..20: mol_type = other DNA
ttcttgctataatcctgggt

SEQ ID NO: 94000 - DNA, 20 bp, synthetic construct
  misc_feature 1..20: note = CRISPR gRNA sequence
  source 1..20: mol_type = other DNA
tcttgctataatcctgggtc

SEQ ID NO: 94001 - DNA, 20 bp, synthetic construct
  misc_feature 1..20: note = CRISPR gRNA sequence
  source 1..20: mol_type = other DNA
cttgctataatcctgggtca

SEQ ID NO: 94002 - DNA, 20 bp, synthetic construct
  misc_feature 1..20: note = CRISPR gRNA sequence
  source 1..20: mol_type = other DNA
ttgctataatcctgggtcag

SEQ ID NO: 94003 - DNA, 20 bp, synthetic construct
  misc_feature 1..20: note = CRISPR gRNA sequence
  source 1..20: mol_type = other DNA
gctataatcctgggtcagtg

SEQ ID NO: 94004 - DNA, 20 bp, synthetic construct
  misc_feature 1..20: note = CRISPR gRNA sequence
  source 1..20: mol_type = other DNA
ctataatcctgggtcagtgc

SEQ ID NO: 94005 - DNA, 20 bp, synthetic construct
  misc_feature 1..20: note = CRISPR gRNA sequence
  source 1..20: mol_type = other DNA
taatcctgggtcagtgctac

SEQ ID NO: 94006 - DNA, 20 bp, synthetic construct
  misc_feature 1..20: note = CRISPR gRNA sequence
  source 1..20: mol_type = other DNA
ggtcagtgctacttttagct

SEQ ID NO: 94007 - DNA, 20 bp, synthetic construct
  misc_feature 1..20: note = CRISPR gRNA sequence
  source 1..20: mol_type = other DNA
cttttagctctttgttctta

SEQ ID NO: 94008 - DNA, 20 bp, synthetic construct
  misc_feature 1..20: note = CRISPR gRNA sequence
  source 1..20: mol_type = other DNA
ttagctctttgttcttacat

SEQ ID NO: 94009 - DNA, 20 bp, synthetic construct
  misc_feature 1..20: note = CRISPR gRNA sequence
  source 1..20: mol_type = other DNA
tagctctttgttcttacata

SEQ ID NO: 94010 - DNA, 20 bp, synthetic construct
  misc_feature 1..20: note = CRISPR gRNA sequence
  source 1..20: mol_type = other DNA
agctctttgttcttacatat

SEQ ID NO: 94011 - DNA, 20 bp, synthetic construct
  misc_feature 1..20: note = CRISPR gRNA sequence
  source 1..20: mol_type = other DNA
gctctttgttcttacatatt

SEQ ID NO: 94012 - DNA, 20 bp, synthetic construct
  misc_feature 1..20: note = CRISPR gRNA sequence
  source 1..20: mol_type = other DNA
tttgttcttacatatttcaa

SEQ ID NO: 94013 - DNA, 20 bp, synthetic construct
  misc_feature 1..20: note = CRISPR gRNA sequence
  source 1..20: mol_type = other DNA
tgttcttacatatttcaaga

SEQ ID NO: 94014 - DNA, 20 bp, synthetic construct
  misc_feature 1..20: note = CRISPR gRNA sequence
  source 1..20: mol_type = other DNA
gttcttacatatttcaagag

SEQ ID NO: 94015 - DNA, 20 bp, synthetic construct
  misc_feature 1..20: note = CRISPR gRNA sequence
  source 1..20: mol_type = other DNA
ttcttacatatttcaagaga

SEQ ID NO: 94016 - DNA, 20 bp, synthetic construct
  misc_feature 1..20: note = CRISPR gRNA sequence
  source 1..20: mol_type = other DNA
ttacatatttcaagagagta

SEQ ID NO: 94017 - DNA, 20 bp, synthetic construct
  misc_feature 1..20: note = CRISPR gRNA sequence
  source 1..20: mol_type = other DNA
acatatttcaagagagtata

SEQ ID NO: 94018 - DNA, 20 bp, synthetic construct
  misc_feature 1..20: note = CRISPR gRNA sequence
  source 1..20: mol_type = other DNA
catatttcaagagagtatat

SEQ ID NO: 94019 - DNA, 20 bp, synthetic construct
  misc_feature 1..20: note = CRISPR gRNA sequence
  source 1..20: mol_type = other DNA
caagagagtatatttgctgg

SEQ ID NO: 94020 - DNA, 20 bp, synthetic construct
  misc_feature 1..20: note = CRISPR gRNA sequence
  source 1..20: mol_type = other DNA
aagagagtatatttgctggc

SEQ ID NO: 94021 - DNA, 20 bp, synthetic construct
  misc_feature 1..20: note = CRISPR gRNA sequence
  source 1..20: mol_type = other DNA
gctggcatattagagaaggt

SEQ ID NO: 94022 - DNA, 20 bp, synthetic construct
  misc_feature 1..20: note = CRISPR gRNA sequence
  source 1..20: mol_type = other DNA
ctggcatattagagaaggtg

SEQ ID NO: 94023 - DNA, 20 bp, synthetic construct
  misc_feature 1..20: note = CRISPR gRNA sequence
  source 1..20: mol_type = other DNA
gcatattagagaaggtgttt

SEQ ID NO: 94024 - DNA, 20 bp, synthetic construct
  misc_feature 1..20: note = CRISPR gRNA sequence
  source 1..20: mol_type = other DNA
gagaaggtgtttccttttta

SEQ ID NO: 94025 - DNA, 20 bp, synthetic construct
  misc_feature 1..20: note = CRISPR gRNA sequence
  source 1..20: mol_type = other DNA
cctttttacacaaagtcacc

SEQ ID NO: 94026 - DNA, 20 bp, synthetic construct
  misc_feature 1..20: note = CRISPR gRNA sequence
  source 1..20: mol_type = other DNA
ctttttacacaaagtcacca

SEQ ID NO: 94027 - DNA, 20 bp, synthetic construct
  misc_feature 1..20: note = CRISPR gRNA sequence
  source 1..20: mol_type = other DNA
tttacacaaagtcaccaata

SEQ ID NO: 94028 - DNA, 20 bp, synthetic construct
  misc_feature 1..20: note = CRISPR gRNA sequence
  source 1..20: mol_type = other DNA
ttacacaaagtcaccaataa

SEQ ID NO: 94029 - DNA, 20 bp, synthetic construct
  misc_feature 1..20: note = CRISPR gRNA sequence
  source 1..20: mol_type = other DNA
tacacaaagtcaccaataac

SEQ ID NO: 94030 - DNA, 20 bp, synthetic construct
  misc_feature 1..20: note = CRISPR gRNA sequence
  source 1..20: mol_type = other DNA
acacaaagtcaccaataaca

SEQ ID NO: 94031 - DNA, 20 bp, synthetic construct
  misc_feature 1..20: note = CRISPR gRNA sequence
  source 1..20: mol_type = other DNA
cacaaagtcaccaataacag

SEQ ID NO: 94032 - DNA, 20 bp, synthetic construct
  misc_feature 1..20: note = CRISPR gRNA sequence
  source 1..20: mol_type = other DNA
cacccgttatttttaggttt

SEQ ID NO: 94033 - DNA, 20 bp, synthetic construct
  misc_feature 1..20: note = CRISPR gRNA sequence
  source 1..20: mol_type = other DNA
acccgttatttttaggtttt

SEQ ID NO: 94034 - DNA, 20 bp, synthetic construct
  misc_feature 1..20: note = CRISPR gRNA sequence
  source 1..20: mol_type = other DNA
tttttaggttttagtatttt

SEQ ID NO: 94035 - DNA, 20 bp, synthetic construct
  misc_feature 1..20: note = CRISPR gRNA sequence
  source 1..20: mol_type = other DNA
ttaggttttagtattttgat

SEQ ID NO: 94036 - DNA, 20 bp, synthetic construct
  misc_feature 1..20: note = CRISPR gRNA sequence
  source 1..20: mol_type = other DNA
taggttttagtattttgatg

SEQ ID NO: 94037 - DNA, 20 bp, synthetic construct
  misc_feature 1..20: note = CRISPR gRNA sequence
  source 1..20: mol_type = other DNA
aggttttagtattttgatgt

SEQ ID NO: 94038 - DNA, 20 bp, synthetic construct
  misc_feature 1..20: note = CRISPR gRNA sequence
  source 1..20: mol_type = other DNA
ggttttagtattttgatgtg

SEQ ID NO: 94039 - DNA, 20 bp, synthetic construct
  misc_feature 1..20: note = CRISPR gRNA sequence
  source 1..20: mol_type = other DNA
tagtattttgatgtgtgaca

SEQ ID NO: 94040 - DNA, 20 bp, synthetic construct
  misc_feature 1..20: note = CRISPR gRNA sequence
  source 1..20: mol_type = other DNA
agtattttgatgtgtgacat

SEQ ID NO: 94041 - DNA, 20 bp, synthetic construct
  misc_feature 1..20: note = CRISPR gRNA sequence
  source 1..20: mol_type = other DNA
gtattttgatgtgtgacatc

SEQ ID NO: 94042 - DNA, 20 bp, synthetic construct
  misc_feature 1..20: note = CRISPR gRNA sequence
  source 1..20: mol_type = other DNA
tgatgtgtgacatcacatta

SEQ ID NO: 94043 - DNA, 20 bp, synthetic construct
  misc_feature 1..20: note = CRISPR gRNA sequence
  source 1..20: mol_type = other DNA
gatgtgtgacatcacattat

SEQ ID NO: 94044 - DNA, 20 bp, synthetic construct
  misc_feature 1..20: note = CRISPR gRNA sequence
  source 1..20: mol_type = other DNA
atgtgtgacatcacattatt

SEQ ID NO: 94045 - DNA, 20 bp, synthetic construct
  misc_feature 1..20: note = CRISPR gRNA sequence
  source 1..20: mol_type = other DNA
tttttagtttgcagcttagt

SEQ ID NO: 94046 - DNA, 20 bp, synthetic construct
  misc_feature 1..20: note = CRISPR gRNA sequence
  source 1..20: mol_type = other DNA
ttagtttgcagcttagttgc

SEQ ID NO: 94047 - DNA, 20 bp, synthetic construct
  misc_feature 1..20: note = CRISPR gRNA sequence
  source 1..20: mol_type = other DNA
tagtttgcagcttagttgca

SEQ ID NO: 94048 - DNA, 20 bp, synthetic construct
  misc_feature 1..20: note = CRISPR gRNA sequence
  source 1..20: mol_type = other DNA
agtttgcagcttagttgcag

SEQ ID NO: 94049 - DNA, 20 bp, synthetic construct
  misc_feature 1..20: note = CRISPR gRNA sequence
  source 1..20: mol_type = other DNA
gtttgcagcttagttgcagt

SEQ ID NO: 94050 - DNA, 20 bp, synthetic construct
  misc_feature 1..20: note = CRISPR gRNA sequence
  source 1..20: mol_type = other DNA
gcagcttagttgcagtgcat

SEQ ID NO: 94051 - DNA, 20 bp, synthetic construct
  misc_feature 1..20: note = CRISPR gRNA sequence
  source 1..20: mol_type = other DNA
cagcttagttgcagtgcatc

SEQ ID NO: 94052 - DNA, 20 bp, synthetic construct
  misc_feature 1..20: note = CRISPR gRNA sequence
  source 1..20: mol_type = other DNA
agttgcagtgcatccgatgt

SEQ ID NO: 94053 - DNA, 20 bp, synthetic construct
  misc_feature 1..20: note = CRISPR gRNA sequence
  source 1..20: mol_type = other DNA
gttgcagtgcatccgatgta

SEQ ID NO: 94054 - DNA, 20 bp, synthetic construct
  misc_feature 1..20: note = CRISPR gRNA sequence
  source 1..20: mol_type = other DNA
cagtgcatccgatgtaaaag

SEQ ID NO: 94055 - DNA, 20 bp, synthetic construct
  misc_feature 1..20: note = CRISPR gRNA sequence
  source 1..20: mol_type = other DNA
ttgattcaggcatattcttg

SEQ ID NO: 94056 - DNA, 20 bp, synthetic construct
  misc_feature 1..20: note = CRISPR gRNA sequence
  source 1..20: mol_type = other DNA
tgattcaggcatattcttgt

SEQ ID NO: 94057 - DNA, 20 bp, synthetic construct
  misc_feature 1..20: note = CRISPR gRNA sequence
  source 1..20: mol_type = other DNA
gattcaggcatattcttgtg

SEQ ID NO: 94058 - DNA, 20 bp, synthetic construct
  misc_feature 1..20: note = CRISPR gRNA sequence
  source 1..20: mol_type = other DNA
attcaggcatattcttgtga

SEQ ID NO: 94059 - DNA, 20 bp, synthetic construct
  misc_feature 1..20: note = CRISPR gRNA sequence
  source 1..20: mol_type = other DNA
aggcatattcttgtgaacat

SEQ ID NO: 94060 - DNA, 20 bp, synthetic construct
  misc_feature 1..20: note = CRISPR gRNA sequence
  source 1..20: mol_type = other DNA
ttgtgaacatattgtatcat

SEQ ID NO: 94061 - DNA, 20 bp, synthetic construct
  misc_feature 1..20: note = CRISPR gRNA sequence
  source 1..20: mol_type = other DNA
gtgaacatattgtatcatat

SEQ ID NO: 94062 - DNA, 20 bp, synthetic construct
  misc_feature 1..20: note = CRISPR gRNA sequence
  source 1..20: mol_type = other DNA
tgaacatattgtatcatatg

SEQ ID NO: 94063 - DNA, 20 bp, synthetic construct
  misc_feature 1..20: note = CRISPR gRNA sequence
  source 1..20: mol_type = other DNA
tatcatatgtagggacacat

SEQ ID NO: 94064 - DNA, 20 bp, synthetic construct
  misc_feature 1..20: note = CRISPR gRNA sequence
  source 1..20: mol_type = other DNA
gcatgaaaacagtctaatga

SEQ ID NO: 94065 - DNA, 20 bp, synthetic construct
  misc_feature 1..20: note = CRISPR gRNA sequence
  source 1..20: mol_type = other DNA
atgacatagattaatgctat

SEQ ID NO: 94066 - DNA, 20 bp, synthetic construct
  misc_feature 1..20: note = CRISPR gRNA sequence
  source 1..20: mol_type = other DNA
atgctattaataattttttt

SEQ ID NO: 94067 - DNA, 20 bp, synthetic construct
  misc_feature 1..20: note = CRISPR gRNA sequence
  source 1..20: mol_type = other DNA
ttaataatttttttcttttc

SEQ ID NO: 94068 - DNA, 20 bp, synthetic construct
  misc_feature 1..20: note = CRISPR gRNA sequence
  source 1..20: mol_type = other DNA
ataatttttttcttttcttt

SEQ ID NO: 94069 - DNA, 20 bp, synthetic construct
  misc_feature 1..20: note = CRISPR gRNA sequence
  source 1..20: mol_type = other DNA
ttttcttttctttctaagtc

SEQ ID NO: 94070 - DNA, 20 bp, synthetic construct
  misc_feature 1..20: note = CRISPR gRNA sequence
  source 1..20: mol_type = other DNA
tttcttttctttctaagtcg

SEQ ID NO: 94071 - DNA, 20 bp, synthetic construct
  misc_feature 1..20: note = CRISPR gRNA sequence
  source 1..20: mol_type = other DNA
ttcttttctttctaagtcgt

SEQ ID NO: 94072 - DNA, 20 bp, synthetic construct
  misc_feature 1..20: note = CRISPR gRNA sequence
  source 1..20: mol_type = other DNA
tcttttctttctaagtcgtt

SEQ ID NO: 94073 - DNA, 20 bp, synthetic construct
  misc_feature 1..20: note = CRISPR gRNA sequence
  source 1..20: mol_type = other DNA
cttttctttctaagtcgtta

SEQ ID NO: 94074 - DNA, 20 bp, synthetic construct
  misc_feature 1..20: note = CRISPR gRNA sequence
  source 1..20: mol_type = other DNA
ttttctttctaagtcgttac

SEQ ID NO: 94075 - DNA, 20 bp, synthetic construct
  misc_feature 1..20: note = CRISPR gRNA sequence
  source 1..20: mol_type = other DNA
ttctttctaagtcgttacta

SEQ ID NO: 94076 - DNA, 20 bp, synthetic construct
  misc_feature 1..20: note = CRISPR gRNA sequence
  source 1..20: mol_type = other DNA
tctttctaagtcgttactaa

SEQ ID NO: 94077 - DNA, 20 bp, synthetic construct
  misc_feature 1..20: note = CRISPR gRNA sequence
  source 1..20: mol_type = other DNA
ctttctaagtcgttactaag

SEQ ID NO: 94078 - DNA, 20 bp, synthetic construct
  misc_feature 1..20: note = CRISPR gRNA sequence
  source 1..20: mol_type = other DNA
tttctaagtcgttactaaga

SEQ ID NO: 94079 - DNA, 20 bp, synthetic construct
  misc_feature 1..20: note = CRISPR gRNA sequence
  source 1..20: mol_type = other DNA
tctaagtcgttactaagaag

SEQ ID NO: 94080 - DNA, 20 bp, synthetic construct
  misc_feature 1..20: note = CRISPR gRNA sequence
  source 1..20: mol_type = other DNA
ctaagtcgttactaagaagt

SEQ ID NO: 94081 - DNA, 20 bp, synthetic construct
  misc_feature 1..20: note = CRISPR gRNA sequence
  source 1..20: mol_type = other DNA
taagtcgttactaagaagtc

SEQ ID NO: 94082 - DNA, 20 bp, synthetic construct
  misc_feature 1..20: note = CRISPR gRNA sequence
  source 1..20: mol_type = other DNA
agtcgttactaagaagtcca

SEQ ID NO: 94083 - DNA, 20 bp, synthetic construct
  misc_feature 1..20: note = CRISPR gRNA sequence
  source 1..20: mol_type = other DNA
ctaagaagtccagaagtagt

SEQ ID NO: 94084 - DNA, 20 bp, synthetic construct
  misc_feature 1..20: note = CRISPR gRNA sequence
  source 1..20: mol_type = other DNA
agaagtccagaagtagtgca

SEQ ID NO: 94085 - DNA, 20 bp, synthetic construct
  misc_feature 1..20: note = CRISPR gRNA sequence
  source 1..20: mol_type = other DNA
ttacagaaacagcaacagct

SEQ ID NO: 94086 - DNA, 20 bp, synthetic construct
  misc_feature 1..20: note = CRISPR gRNA sequence
  source 1..20: mol_type = other DNA
tacagaaacagcaacagcta

SEQ ID NO: 94087 - DNA, 20 bp, synthetic construct
  misc_feature 1..20: note = CRISPR gRNA sequence
  source 1..20: mol_type = other DNA
acagaaacagcaacagctat

SEQ ID NO: 94088 - DNA, 20 bp, synthetic construct
  misc_feature 1..20: note = CRISPR gRNA sequence
  source 1..20: mol_type = other DNA
cagaaacagcaacagctatt

SEQ ID NO: 94089 - DNA, 20 bp, synthetic construct
  misc_feature 1..20: note = CRISPR gRNA sequence
  source 1..20: mol_type = other DNA
ttaaatcagcaagttttgga

SEQ ID NO: 94090 - DNA, 20 bp, synthetic construct
  misc_feature 1..20: note = CRISPR gRNA sequence
  source 1..20: mol_type = other DNA
aatcagcaagttttggagca

SEQ ID NO: 94091 - DNA, 20 bp, synthetic construct
  misc_feature 1..20: note = CRISPR gRNA sequence
  source 1..20: mol_type = other DNA
tggagcaaagacaacagcag

SEQ ID NO: 94092 - DNA, 20 bp, synthetic construct
  misc_feature 1..20: note = CRISPR gRNA sequence
  source 1..20: mol_type = other DNA
ggagcaaagacaacagcagt

SEQ ID NO: 94093 - DNA, 20 bp, synthetic construct
  misc_feature 1..20: note = CRISPR gRNA sequence
  source 1..20: mol_type = other DNA
gagcaaagacaacagcagtt

SEQ ID NO: 94094 - DNA, 20 bp, synthetic construct
  misc_feature 1..20: note = CRISPR gRNA sequence
  source 1..20: mol_type = other DNA
ccaggaacatcaatgtgagg

SEQ ID NO: 94095 - DNA, 20 bp, synthetic construct
  misc_feature 1..20: note = CRISPR gRNA sequence
  source 1..20: mol_type = other DNA
caggaacatcaatgtgaggg

SEQ ID NO: 94096 - DNA, 20 bp, synthetic construct
  misc_feature 1..20: note = CRISPR gRNA sequence
  source 1..20: mol_type = other DNA
accaagaacatctacatggt

SEQ ID NO: 94097 - DNA, 20 bp, synthetic construct
  misc_feature 1..20: note = CRISPR gRNA sequence
  source 1..20: mol_type = other DNA
ccaagaacatctacatggtt

SEQ ID NO: 94098 - DNA, 20 bp, synthetic construct
  misc_feature 1..20: note = CRISPR gRNA sequence
  source 1..20: mol_type = other DNA
catggttttttatcttattg

SEQ ID NO: 94099 - DNA, 20 bp, synthetic construct
  misc_feature 1..20: note = CRISPR gRNA sequence
  source 1..20: mol_type = other DNA
tttatcttattgtaatagat

SEQ ID NO: 94100 - DNA, 20 bp, synthetic construct
  misc_feature 1..20: note = CRISPR gRNA sequence
  source 1..20: mol_type = other DNA
ttatcttattgtaatagatg

SEQ ID NO: 94101 - DNA, 20 bp, synthetic construct
  misc_feature 1..20: note = CRISPR gRNA sequence
  source 1..20: mol_type = other DNA
tatcttattgtaatagatga

SEQ ID NO: 94102 - DNA, 20 bp, synthetic construct
  misc_feature 1..20: note = CRISPR gRNA sequence
  source 1..20: mol_type = other DNA
atcttattgtaatagatgag

SEQ ID NO: 94103 - DNA, 20 bp, synthetic construct
  misc_feature 1..20: note = CRISPR gRNA sequence
  source 1..20: mol_type = other DNA
tcttattgtaatagatgagc

SEQ ID NO: 94104 - DNA, 20 bp, synthetic construct
  misc_feature 1..20: note = CRISPR gRNA sequence
  source 1..20: mol_type = other DNA
attgtaatagatgagcatat

SEQ ID NO: 94105 - DNA, 20 bp, synthetic construct
  misc_feature 1..20: note = CRISPR gRNA sequence
  source 1..20: mol_type = other DNA
ttgtaatagatgagcatatt

SEQ ID NO: 94106 - DNA, 20 bp, synthetic construct
  misc_feature 1..20: note = CRISPR gRNA sequence
  source 1..20: mol_type = other DNA
taatagatgagcatattttt

SEQ ID NO: 94107 - DNA, 20 bp, synthetic construct
  misc_feature 1..20: note = CRISPR gRNA sequence
  source 1..20: mol_type = other DNA
ttttaccagacataaatggg

SEQ ID NO: 94108 - DNA, 20 bp, synthetic construct
  misc_feature 1..20: note = CRISPR gRNA sequence
  source 1..20: mol_type = other DNA
tttaccagacataaatgggg

SEQ ID NO: 94109 - DNA, 20 bp, synthetic construct
  misc_feature 1..20: note = CRISPR gRNA sequence
  source 1..20: mol_type = other DNA
ttaccagacataaatggggt

SEQ ID NO: 94110 - DNA, 20 bp, synthetic construct
  misc_feature 1..20: note = CRISPR gRNA sequence
  source 1..20: mol_type = other DNA
taccagacataaatggggta

SEQ ID NO: 94111 - DNA, 20 bp, synthetic construct
  misc_feature 1..20: note = CRISPR gRNA sequence
  source 1..20: mol_type = other DNA
accagacataaatggggtaa

SEQ ID NO: 94112 - DNA, 20 bp, synthetic construct
  misc_feature 1..20: note = CRISPR gRNA sequence
  source 1..20: mol_type = other DNA
ccagacataaatggggtaat

SEQ ID NO: 94113 - DNA, 20 bp, synthetic construct
  misc_feature 1..20: note = CRISPR gRNA sequence
  source 1..20: mol_type = other DNA
caggcatagattattacccc

SEQ ID NO: 94114 - DNA, 20 bp, synthetic construct
  misc_feature 1..20: note = CRISPR gRNA sequence
  source 1..20: mol_type = other DNA
ttaccccatttatgtctggt

SEQ ID NO: 94115 - DNA, 20 bp, synthetic construct
  misc_feature 1..20: note = CRISPR gRNA sequence
  source 1..20: mol_type = other DNA
ccccatttatgtctggtaaa

SEQ ID NO: 94116 - DNA, 20 bp, synthetic construct
  misc_feature 1..20: note = CRISPR gRNA sequence
  source 1..20: mol_type = other DNA
atgtctggtaaaaaaatatg

SEQ ID NO: 94117 - DNA, 20 bp, synthetic construct
  misc_feature 1..20: note = CRISPR gRNA sequence
  source 1..20: mol_type = other DNA
tgtctggtaaaaaaatatgc

SEQ ID NO: 94118 - DNA, 20 bp, synthetic construct
  misc_feature 1..20: note = CRISPR gRNA sequence
  source 1..20: mol_type = other DNA
gtaaaaaaatatgctcatct

SEQ ID NO: 94119 - DNA, 20 bp, synthetic construct
  misc_feature 1..20: note = CRISPR gRNA sequence
  source 1..20: mol_type = other DNA
atctattacaataagataaa

SEQ ID NO: 94120 - DNA, 20 bp, synthetic construct
  misc_feature 1..20: note = CRISPR gRNA sequence
  source 1..20: mol_type = other DNA
ttacaataagataaaaaacc

SEQ ID NO: 94121 - DNA, 20 bp, synthetic construct
  misc_feature 1..20: note = CRISPR gRNA sequence
  source 1..20: mol_type = other DNA
caataagataaaaaaccatg

SEQ ID NO: 94122 - DNA, 20 bp, synthetic construct
  misc_feature 1..20: note = CRISPR gRNA sequence
  source 1..20: mol_type = other DNA
ttggtaagttccctcacatt

SEQ ID NO: 94123 - DNA, 20 bp, synthetic construct
  misc_feature 1..20: note = CRISPR gRNA sequence
  source 1..20: mol_type = other DNA
ggtaagttccctcacattga

SEQ ID NO: 94124 - DNA, 20 bp, synthetic construct
  misc_feature 1..20: note = CRISPR gRNA sequence
  source 1..20: mol_type = other DNA
gtaagttccctcacattgat

SEQ ID NO: 94125 - DNA, 20 bp, synthetic construct
  misc_feature 1..20: note = CRISPR gRNA sequence
  source 1..20: mol_type = other DNA
cctcacattgatgttcctgg

SEQ ID NO: 94126 - DNA, 20 bp, synthetic construct
  misc_feature 1..20: note = CRISPR gRNA sequence
  source 1..20: mol_type = other DNA
acattgatgttcctggaaac

SEQ ID NO: 94127 - DNA, 20 bp, synthetic construct
  misc_feature 1..20: note = CRISPR gRNA sequence
  source 1..20: mol_type = other DNA
atgttcctggaaactgctgt

SEQ ID NO: 94128 - DNA, 20 bp, synthetic construct
  misc_feature 1..20: note = CRISPR gRNA sequence
  source 1..20: mol_type = other DNA
ctggaaactgctgttgtctt

SEQ ID NO: 94129 - DNA, 20 bp, synthetic construct
  misc_feature 1..20: note = CRISPR gRNA sequence
  source 1..20: mol_type = other DNA
gaaactgctgttgtctttgc

SEQ ID NO: 94130 - DNA, 20 bp, synthetic construct
  misc_feature 1..20: note = CRISPR gRNA sequence
  source 1..20: mol_type = other DNA
ctgttgtctttgctccaaaa

SEQ ID NO: 94131 - DNA, 20 bp, synthetic construct
  misc_feature 1..20: note = CRISPR gRNA sequence
  source 1..20: mol_type = other DNA
ttgtctttgctccaaaactt

SEQ ID NO: 94132 - DNA, 20 bp, synthetic construct
  misc_feature 1..20: note = CRISPR gRNA sequence
  source 1..20: mol_type = other DNA
tctttgctccaaaacttgct

SEQ ID NO: 94133 - DNA, 20 bp, synthetic construct
  misc_feature 1..20: note = CRISPR gRNA sequence
  source 1..20: mol_type = other DNA
tgctccaaaacttgctgatt

SEQ ID NO: 94134 - DNA, 20 bp, synthetic construct
  misc_feature 1..20: note = CRISPR gRNA sequence
  source 1..20: mol_type = other DNA
gctccaaaacttgctgattt

SEQ ID NO: 94135 - DNA, 20 bp, synthetic construct
  misc_feature 1..20: note = CRISPR gRNA sequence
  source 1..20: mol_type = other DNA
ctccaaaacttgctgattta

SEQ ID NO: 94136 - DNA, 20 bp, synthetic construct
  misc_feature 1..20: note = CRISPR gRNA sequence
  source 1..20: mol_type = other DNA
caaaacttgctgatttaata

SEQ ID NO: 94137 - DNA, 20 bp, synthetic construct
  misc_feature 1..20: note = CRISPR gRNA sequence
  source 1..20: mol_type = other DNA
gctgatttaatagctgttgc

SEQ ID NO: 94138 - DNA, 20 bp, synthetic construct
  misc_feature 1..20: note = CRISPR gRNA sequence
  source 1..20: mol_type = other DNA
ctgatttaatagctgttgct

SEQ ID NO: 94139 - DNA, 20 bp, synthetic construct
  misc_feature 1..20: note = CRISPR gRNA sequence
  source 1..20: mol_type = other DNA
atttaatagctgttgctgtt

SEQ ID NO: 94140 - DNA, 20 bp, synthetic construct
  misc_feature 1..20: note = CRISPR gRNA sequence
  source 1..20: mol_type = other DNA
aatagctgttgctgtttctg

SEQ ID NO: 94141 - DNA, 20 bp, synthetic construct
  misc_feature 1..20: note = CRISPR gRNA sequence
  source 1..20: mol_type = other DNA
atagctgttgctgtttctgt

SEQ ID NO: 94142 - DNA, 20 bp, synthetic construct
  misc_feature 1..20: note = CRISPR gRNA sequence
  source 1..20: mol_type = other DNA
ttgctgtttctgtaaaaatt

SEQ ID NO: 94143 - DNA, 20 bp, synthetic construct
  misc_feature 1..20: note = CRISPR gRNA sequence
  source 1..20: mol_type = other DNA
ctgtttctgtaaaaattgca

SEQ ID NO: 94144 - DNA, 20 bp, synthetic construct
  misc_feature 1..20: note = CRISPR gRNA sequence
  source 1..20: mol_type = other DNA
tttctgtaaaaattgcacta

SEQ ID NO: 94145 - DNA, 20 bp, synthetic construct
  misc_feature 1..20: note = CRISPR gRNA sequence
  source 1..20: mol_type = other DNA
ctgtaaaaattgcactactt

SEQ ID NO: 94146 - DNA, 20 bp, synthetic construct
  misc_feature 1..20: note = CRISPR gRNA sequence
  source 1..20: mol_type = other DNA
tgtaaaaattgcactacttc

SEQ ID NO: 94147 - DNA, 20 bp, synthetic construct
  misc_feature 1..20: note = CRISPR gRNA sequence
  source 1..20: mol_type = other DNA
taaaaattgcactacttctg

SEQ ID NO: 94148 - DNA, 20 bp, synthetic construct
  misc_feature 1..20: note = CRISPR gRNA sequence
  source 1..20: mol_type = other DNA
cactacttctggacttctta

SEQ ID NO: 94149 - DNA, 20 bp, synthetic construct
  misc_feature 1..20: note = CRISPR gRNA sequence
  source 1..20: mol_type = other DNA
cttctggacttcttagtaac

SEQ ID NO: 94150 - DNA, 20 bp, synthetic construct
  misc_feature 1..20: note = CRISPR gRNA sequence
  source 1..20: mol_type = other DNA
ctggacttcttagtaacgac

SEQ ID NO: 94151 - DNA, 20 bp, synthetic construct
  misc_feature 1..20: note = CRISPR gRNA sequence
  source 1..20: mol_type = other DNA
tggacttcttagtaacgact

SEQ ID NO: 94152 - DNA, 20 bp, synthetic construct
  misc_feature 1..20: note = CRISPR gRNA sequence
  source 1..20: mol_type = other DNA
gacttcttagtaacgactta

SEQ ID NO: 94153 - DNA, 20 bp, synthetic construct
  misc_feature 1..20: note = CRISPR gRNA sequence
  source 1..20: mol_type = other DNA
cttagtaacgacttagaaag

SEQ ID NO: 94154 - DNA, 20 bp, synthetic construct
  misc_feature 1..20: note = CRISPR gRNA sequence
  source 1..20: mol_type = other DNA
ttagtaacgacttagaaaga

SEQ ID NO: 94155 - DNA, 20 bp, synthetic construct
  misc_feature 1..20: note = CRISPR gRNA sequence
  source 1..20: mol_type = other DNA
agtaacgacttagaaagaaa

SEQ ID NO: 94156 - DNA, 20 bp, synthetic construct
  misc_feature 1..20: note = CRISPR gRNA sequence
  source 1..20: mol_type = other DNA
gtaacgacttagaaagaaaa

SEQ ID NO: 94157 - DNA, 20 bp, synthetic construct
  misc_feature 1..20: note = CRISPR gRNA sequence
  source 1..20: mol_type = other DNA
agaaagaaaagaaaaaaatt

SEQ ID NO: 94158 - DNA, 20 bp, synthetic construct
  misc_feature 1..20: note = CRISPR gRNA sequence
  source 1..20: mol_type = other DNA
gaaagaaaagaaaaaaatta

SEQ ID NO: 94159 - DNA, 20 bp, synthetic construct
  misc_feature 1..20: note = CRISPR gRNA sequence
  source 1..20: mol_type = other DNA
ttaatagcattaatctatgt

SEQ ID NO: 94160 - DNA, 20 bp, synthetic construct
  misc_feature 1..20: note = CRISPR gRNA sequence
  source 1..20: mol_type = other DNA
atagcattaatctatgtcat

SEQ ID NO: 94161 - DNA, 20 bp, synthetic construct
  misc_feature 1..20: note = CRISPR gRNA sequence
  source 1..20: mol_type = other DNA
atctatgtcattagactgtt

SEQ ID NO: 94162 - DNA, 20 bp, synthetic construct
  misc_feature 1..20: note = CRISPR gRNA sequence
  source 1..20: mol_type = other DNA
tgtcattagactgttttcat

SEQ ID NO: 94163 - DNA, 20 bp, synthetic construct
  misc_feature 1..20: note = CRISPR gRNA sequence
  source 1..20: mol_type = other DNA
gactgttttcatgctaatta

SEQ ID NO: 94164 - DNA, 20 bp, synthetic construct
  misc_feature 1..20: note = CRISPR gRNA sequence
  source 1..20: mol_type = other DNA
ttttcatgctaattactctg

SEQ ID NO: 94165 - DNA, 20 bp, synthetic construct
  misc_feature 1..20: note = CRISPR gRNA sequence
  source 1..20: mol_type = other DNA
tcatgctaattactctgatg

SEQ ID NO: 94166 - DNA, 20 bp, synthetic construct
  misc_feature 1..20: note = CRISPR gRNA sequence
  source 1..20: mol_type = other DNA
catgctaattactctgatgt

SEQ ID NO: 94167 - DNA, 20 bp, synthetic construct
  misc_feature 1..20: note = CRISPR gRNA sequence
  source 1..20: mol_type = other DNA
atgctaattactctgatgtg

SEQ ID NO: 94168 - DNA, 20 bp, synthetic construct
  misc_feature 1..20: note = CRISPR gRNA sequence
  source 1..20: mol_type = other DNA
attactctgatgtgtcccta

SEQ ID NO: 94169 - DNA, 20 bp, synthetic construct
  misc_feature 1..20: note = CRISPR gRNA sequence
  source 1..20: mol_type = other DNA
ctctgatgtgtccctacata

SEQ ID NO: 94170 - DNA, 20 bp, synthetic construct
  misc_feature 1..20: note = CRISPR gRNA sequence
  source 1..20: mol_type = other DNA
tgatgtgtccctacatatga

SEQ ID NO: 94171 - DNA, 20 bp, synthetic construct
  misc_feature 1..20: note = CRISPR gRNA sequence
  source 1..20: mol_type = other DNA
atgtgtccctacatatgata

SEQ ID NO: 94172 - DNA, 20 bp, synthetic construct
  misc_feature 1..20: note = CRISPR gRNA sequence
  source 1..20: mol_type = other DNA
catatgatacaatatgttca

SEQ ID NO: 94173 - DNA, 20 bp, synthetic construct
  misc_feature 1..20: note = CRISPR gRNA sequence
  source 1..20: mol_type = other DNA
acaagaatatgcctgaatca

SEQ ID NO: 94174 - DNA, 20 bp, synthetic construct
  misc_feature 1..20: note = CRISPR gRNA sequence
  source 1..20: mol_type = other DNA
aatcaaaagcacttttacat

SEQ ID NO: 94175 - DNA, 20 bp, synthetic construct
  misc_feature 1..20: note = CRISPR gRNA sequence
  source 1..20: mol_type = other DNA
ttacatcggatgcactgcaa

SEQ ID NO: 94176 - DNA, 20 bp, synthetic construct
  misc_feature 1..20: note = CRISPR gRNA sequence
  source 1..20: mol_type = other DNA
tacatcggatgcactgcaac

SEQ ID NO: 94177 - DNA, 20 bp, synthetic construct
  misc_feature 1..20: note = CRISPR gRNA sequence
  source 1..20: mol_type = other DNA
acatcggatgcactgcaact

SEQ ID NO: 94178 - DNA, 20 bp, synthetic construct
  misc_feature 1..20: note = CRISPR gRNA sequence
  source 1..20: mol_type = other DNA
catcggatgcactgcaacta

SEQ ID NO: 94179 - DNA, 20 bp, synthetic construct
  misc_feature 1..20: note = CRISPR gRNA sequence
  source 1..20: mol_type = other DNA
caactaagctgcaaactaaa

SEQ ID NO: 94180 - DNA, 20 bp, synthetic construct
  misc_feature 1..20: note = CRISPR gRNA sequence
  source 1..20: mol_type = other DNA
agctgcaaactaaaaataat

SEQ ID NO: 94181 - DNA, 20 bp, synthetic construct
  misc_feature 1..20: note = CRISPR gRNA sequence
  source 1..20: mol_type = other DNA
caaactaaaaataatgtgat

SEQ ID NO: 94182 - DNA, 20 bp, synthetic construct
  misc_feature 1..20: note = CRISPR gRNA sequence
  source 1..20: mol_type = other DNA
aaaataatgtgatgtcacac

SEQ ID NO: 94183 - DNA, 20 bp, synthetic construct
  misc_feature 1..20: note = CRISPR gRNA sequence
  source 1..20: mol_type = other DNA
aaacctaaaaataacgggtg

SEQ ID NO: 94184 - DNA, 20 bp, synthetic construct
  misc_feature 1..20: note = CRISPR gRNA sequence
  source 1..20: mol_type = other DNA
aaaataacgggtgaagtctg

SEQ ID NO: 94185 - DNA, 20 bp, synthetic construct
  misc_feature 1..20: note = CRISPR gRNA sequence
  source 1..20: mol_type = other DNA
ttattggtgactttgtgtaa

SEQ ID NO: 94186 - DNA, 20 bp, synthetic construct
  misc_feature 1..20: note = CRISPR gRNA sequence
  source 1..20: mol_type = other DNA
ttggtgactttgtgtaaaaa

SEQ ID NO: 94187 - DNA, 20 bp, synthetic construct
  misc_feature 1..20: note = CRISPR gRNA sequence
  source 1..20: mol_type = other DNA
gtgactttgtgtaaaaagga

SEQ ID NO: 94188 - DNA, 20 bp, synthetic construct
  misc_feature 1..20: note = CRISPR gRNA sequence
  source 1..20: mol_type = other DNA
tgtgtaaaaaggaaacacct

SEQ ID NO: 94189 - DNA, 20 bp, synthetic construct
  misc_feature 1..20: note = CRISPR gRNA sequence
  source 1..20: mol_type = other DNA
gtgtaaaaaggaaacacctt

SEQ ID NO: 94190 - DNA, 20 bp, synthetic construct
  misc_feature 1..20: note = CRISPR gRNA sequence
  source 1..20: mol_type = other DNA
tgtaaaaaggaaacaccttc

SEQ ID NO: 94191 - DNA, 20 bp, synthetic construct
  misc_feature 1..20: note = CRISPR gRNA sequence
  source 1..20: mol_type = other DNA
ctctaatatgccagcaaata

SEQ ID NO: 94192 - DNA, 20 bp, synthetic construct
  misc_feature 1..20: note = CRISPR gRNA sequence
  source 1..20: mol_type = other DNA
tctaatatgccagcaaatat

SEQ ID NO: 94193 - DNA, 20 bp, synthetic construct
  misc_feature 1..20: note = CRISPR gRNA sequence
  source 1..20: mol_type = other DNA
taatatgccagcaaatatac

SEQ ID NO: 94194 - DNA, 20 bp, synthetic construct
  misc_feature 1..20: note = CRISPR gRNA sequence
  source 1..20: mol_type = other DNA
atatgccagcaaatatactc

SEQ ID NO: 94195 - DNA, 20 bp, synthetic construct
  misc_feature 1..20: note = CRISPR gRNA sequence
  source 1..20: mol_type = other DNA
tcttgaaatatgtaagaaca

SEQ ID NO: 94196 - DNA, 20 bp, synthetic construct
  misc_feature 1..20: note = CRISPR gRNA sequence
  source 1..20: mol_type = other DNA
ttgaaatatgtaagaacaaa

SEQ ID NO: 94197 - DNA, 20 bp, synthetic construct
  misc_feature 1..20: note = CRISPR gRNA sequence
  source 1..20: mol_type = other DNA
gaaatatgtaagaacaaaga

SEQ ID NO: 94198 - DNA, 20 bp, synthetic construct
  misc_feature 1..20: note = CRISPR gRNA sequence
  source 1..20: mol_type = other DNA
aaatatgtaagaacaaagag

SEQ ID NO: 94199 - DNA, 20 bp, synthetic construct
  misc_feature 1..20: note = CRISPR gRNA sequence
  source 1..20: mol_type = other DNA
aaagtagcactgacccagga

SEQ ID NO: 94200 - DNA, 20 bp, synthetic construct
  misc_feature 1..20: note = CRISPR gRNA sequence
  source 1..20: mol_type = other DNA
acccaggattatagcaagaa

SEQ ID NO: 94201 - DNA, 20 bp, synthetic construct
  misc_feature 1..20: note = CRISPR gRNA sequence
  source 1..20: mol_type = other DNA
tagcaagaaaaaaaatggag

SEQ ID NO: 94202 - DNA, 20 bp, synthetic construct
  misc_feature 1..20: note = CRISPR gRNA sequence
  source 1..20: mol_type = other DNA
aatgccagtttgtacataca

SEQ ID NO: 94203 - DNA, 20 bp, synthetic construct
  misc_feature 1..20: note = CRISPR gRNA sequence
  source 1..20: mol_type = other DNA
gtacatacatacaaactagt

SEQ ID NO: 94204 - DNA, 20 bp, synthetic construct
  misc_feature 1..20: note = CRISPR gRNA sequence
  source 1..20: mol_type = other DNA
tacatacatacaaactagtg

SEQ ID NO: 94205 - DNA, 20 bp, synthetic construct
  misc_feature 1..20: note = CRISPR gRNA sequence
  source 1..20: mol_type = other DNA
gtgctagaagtcaagtttct

SEQ ID NO: 94206 - DNA, 20 bp, synthetic construct
  misc_feature 1..20: note = CRISPR gRNA sequence
  source 1..20: mol_type = other DNA
gaagtcaagtttctcattag

SEQ ID NO: 94207 - DNA, 20 bp, synthetic construct
  misc_feature 1..20: note = CRISPR gRNA sequence
  source 1..20: mol_type = other DNA
ctcattaggcaactaagtct

SEQ ID NO: 94208 - DNA, 20 bp, synthetic construct
  misc_feature 1..20: note = CRISPR gRNA sequence
  source 1..20: mol_type = other DNA
tcattaggcaactaagtctt

SEQ ID NO: 94209 - DNA, 20 bp, synthetic construct
  misc_feature 1..20: note = CRISPR gRNA sequence
  source 1..20: mol_type = other DNA
attaggcaactaagtcttca

SEQ ID NO: 94210 - DNA, 20 bp, synthetic construct
  misc_feature 1..20: note = CRISPR gRNA sequence
  source 1..20: mol_type = other DNA
ggcaactaagtcttcataaa

SEQ ID NO: 94211 - DNA, 20 bp, synthetic construct
  misc_feature 1..20: note = CRISPR gRNA sequence
  source 1..20: mol_type = other DNA
agtcttcataaagaaattaa

SEQ ID NO: 94212 - DNA, 20 bp, synthetic construct
  misc_feature 1..20: note = CRISPR gRNA sequence
  source 1..20: mol_type = other DNA
cataaagaaattaaaaattg

SEQ ID NO: 94213 - DNA, 20 bp, synthetic construct
  misc_feature 1..20: note = CRISPR gRNA sequence
  source 1..20: mol_type = other DNA
ataaagaaattaaaaattgt

SEQ ID NO: 94214 - DNA, 20 bp, synthetic construct
  misc_feature 1..20: note = CRISPR gRNA sequence
  source 1..20: mol_type = other DNA
aaaattgtgtgtataggtgt

SEQ ID NO: 94215 - DNA, 20 bp, synthetic construct
  misc_feature 1..20: note = CRISPR gRNA sequence
  source 1..20: mol_type = other DNA
tgtgtataggtgtgtatata

SEQ ID NO: 94216 - DNA, 20 bp, synthetic construct
  misc_feature 1..20: note = CRISPR gRNA sequence
  source 1..20: mol_type = other DNA
caggaaaaaatataactgct

SEQ ID NO: 94217 - DNA, 20 bp, synthetic construct
  misc_feature 1..20: note = CRISPR gRNA sequence
  source 1..20: mol_type = other DNA
aggaaaaaatataactgctc

SEQ ID NO: 94218 - DNA, 20 bp, synthetic construct
  misc_feature 1..20: note = CRISPR gRNA sequence
  source 1..20: mol_type = other DNA
ctctaaaacatccaatacct

SEQ ID NO: 94219 - DNA, 20 bp, synthetic construct
  misc_feature 1..20: note = CRISPR gRNA sequence
  source 1..20: mol_type = other DNA
taaaacatccaatacctttt

SEQ ID NO: 94220 - DNA, 20 bp, synthetic construct
  misc_feature 1..20: note = CRISPR gRNA sequence
  source 1..20: mol_type = other DNA
aaacatccaatacctttttg

SEQ ID NO: 94221 - DNA, 20 bp, synthetic construct
  misc_feature 1..20: note = CRISPR gRNA sequence
  source 1..20: mol_type = other DNA
tttgtacactcatcacttta

SEQ ID NO: 94222 - DNA, 20 bp, synthetic construct
  misc_feature 1..20: note = CRISPR gRNA sequence
  source 1..20: mol_type = other DNA
ttgtacactcatcactttaa

SEQ ID NO: 94223 - DNA, 20 bp, synthetic construct
  misc_feature 1..20: note = CRISPR gRNA sequence
  source 1..20: mol_type = other DNA
tgtacactcatcactttaaa

SEQ ID NO: 94224 - DNA, 20 bp, synthetic construct
  misc_feature 1..20: note = CRISPR gRNA sequence
  source 1..20: mol_type = other DNA
gtacactcatcactttaaaa

SEQ ID NO: 94225 - DNA, 20 bp, synthetic construct
  misc_feature 1..20: note = CRISPR gRNA sequence
  source 1..20: mol_type = other DNA
tacactcatcactttaaaat

SEQ ID NO: 94226 - DNA, 20 bp, synthetic construct
  misc_feature 1..20: note = CRISPR gRNA sequence
  source 1..20: mol_type = other DNA
atcactttaaaatatagttg

SEQ ID NO: 94227 - DNA, 20 bp, synthetic construct
  misc_feature 1..20: note = CRISPR gRNA sequence
  source 1..20: mol_type = other DNA
taaaatatagttgtaataat

SEQ ID NO: 94228 - DNA, 20 bp, synthetic construct
  misc_feature 1..20: note = CRISPR gRNA sequence
  source 1..20: mol_type = other DNA
aaaatatagttgtaataata

SEQ ID NO: 94229 - DNA, 20 bp, synthetic construct
  misc_feature 1..20: note = CRISPR gRNA sequence
  source 1..20: mol_type = other DNA
aaatatagttgtaataatat

SEQ ID NO: 94230 - DNA, 20 bp, synthetic construct
  misc_feature 1..20: note = CRISPR gRNA sequence
  source 1..20: mol_type = other DNA
taataatataacaaatataa

SEQ ID NO: 94231 - DNA, 20 bp, synthetic construct
  misc_feature 1..20: note = CRISPR gRNA sequence
  source 1..20: mol_type = other DNA
tgattaacatattattatta

SEQ ID NO: 94232 - DNA, 20 bp, synthetic construct
  misc_feature 1..20: note = CRISPR gRNA sequence
  source 1..20: mol_type = other DNA
acatattattattagagaca

SEQ ID NO: 94233 - DNA, 20 bp, synthetic construct
  misc_feature 1..20: note = CRISPR gRNA sequence
  source 1..20: mol_type = other DNA
ttattagagacagggtctca

SEQ ID NO: 94234 - DNA, 20 bp, synthetic construct
  misc_feature 1..20: note = CRISPR gRNA sequence
  source 1..20: mol_type = other DNA
ttagagacagggtctcactc

SEQ ID NO: 94235 - DNA, 20 bp, synthetic construct
  misc_feature 1..20: note = CRISPR gRNA sequence
  source 1..20: mol_type = other DNA
gagacagggtctcactctgt

SEQ ID NO: 94236 - DNA, 20 bp, synthetic construct
  misc_feature 1..20: note = CRISPR gRNA sequence
  source 1..20: mol_type = other DNA
actctgttccccacgctgga

SEQ ID NO: 94237 - DNA, 20 bp, synthetic construct
  misc_feature 1..20: note = CRISPR gRNA sequence
  source 1..20: mol_type = other DNA
tgttccccacgctggagtgc

SEQ ID NO: 94238 - DNA, 20 bp, synthetic construct
  misc_feature 1..20: note = CRISPR gRNA sequence
  source 1..20: mol_type = other DNA
ttccccacgctggagtgcag

SEQ ID NO: 94239 - DNA, 20 bp, synthetic construct
  misc_feature 1..20: note = CRISPR gRNA sequence
  source 1..20: mol_type = other DNA
cccacgctggagtgcagtgg

SEQ ID NO: 94240 - DNA, 20 bp, synthetic construct
  misc_feature 1..20: note = CRISPR gRNA sequence
  source 1..20: mol_type = other DNA
gagtgcagtggcgtgagcat

SEQ ID NO: 94241 - DNA, 20 bp, synthetic construct
  misc_feature 1..20: note = CRISPR gRNA sequence
  source 1..20: mol_type = other DNA
actgcagtcttgaactcctc

SEQ ID NO: 94242 - DNA, 20 bp, synthetic construct
  misc_feature 1..20: note = CRISPR gRNA sequence
  source 1..20: mol_type = other DNA
cagtcttgaactcctcggct

SEQ ID NO: 94243 - DNA, 20 bp, synthetic construct
  misc_feature 1..20: note = CRISPR gRNA sequence
  source 1..20: mol_type = other DNA
gaactcctcggctcaagcaa

SEQ ID NO: 94244 - DNA, 20 bp, synthetic construct
  misc_feature 1..20: note = CRISPR gRNA sequence
  source 1..20: mol_type = other DNA
aactcctcggctcaagcaat

SEQ ID NO: 94245 - DNA, 20 bp, synthetic construct
  misc_feature 1..20: note = CRISPR gRNA sequence
  source 1..20: mol_type = other DNA
ctcggctcaagcaatcatcc

SEQ ID NO: 94246 - DNA, 20 bp, synthetic construct
  misc_feature 1..20: note = CRISPR gRNA sequence
  source 1..20: mol_type = other DNA
ggctcaagcaatcatcctgc

SEQ ID NO: 94247 - DNA, 20 bp, synthetic construct
  misc_feature 1..20: note = CRISPR gRNA sequence
  source 1..20: mol_type = other DNA
aagcaatcatcctgccacag

SEQ ID NO: 94248 - DNA, 20 bp, synthetic construct
  misc_feature 1..20: note = CRISPR gRNA sequence
  source 1..20: mol_type = other DNA
ccacagtctcctgtaatagg

SEQ ID NO: 94249 - DNA, 20 bp, synthetic construct
  misc_feature 1..20: note = CRISPR gRNA sequence
  source 1..20: mol_type = other DNA
ctgtaataggtttttataat

SEQ ID NO: 94250 - DNA, 20 bp, synthetic construct
  misc_feature 1..20: note = CRISPR gRNA sequence
  source 1..20: mol_type = other DNA
taataggtttttataataaa

SEQ ID NO: 94251 - DNA, 20 bp, synthetic construct
  misc_feature 1..20: note = CRISPR gRNA sequence
  source 1..20: mol_type = other DNA
ttataataaaatacttacat

SEQ ID NO: 94252 - DNA, 20 bp, synthetic construct
  misc_feature 1..20: note = CRISPR gRNA sequence
  source 1..20: mol_type = other DNA
tataataaaatacttacata

SEQ ID NO: 94253 - DNA, 20 bp, synthetic construct
  misc_feature 1..20: note = CRISPR gRNA sequence
  source 1..20: mol_type = other DNA
ataataaaatacttacataa

SEQ ID NO: 94254 - DNA, 20 bp, synthetic construct
  misc_feature 1..20: note = CRISPR gRNA sequence
  source 1..20: mol_type = other DNA
taataaaatacttacataaa

SEQ ID NO: 94255 - DNA, 20 bp, synthetic construct
  misc_feature 1..20: note = CRISPR gRNA sequence
  source 1..20: mol_type = other DNA
acataaatttatagagaaaa

SEQ ID NO: 94256 - DNA, 20 bp, synthetic construct
  misc_feature 1..20: note = CRISPR gRNA sequence
  source 1..20: mol_type = other DNA
cataaatttatagagaaaaa

SEQ ID NO: 94257 - DNA, 20 bp, synthetic construct
  misc_feature 1..20: note = CRISPR gRNA sequence
  source 1..20: mol_type = other DNA
atagagaaaaaaatctttgg

SEQ ID NO: 94258 - DNA, 20 bp, synthetic construct
  misc_feature 1..20: note = CRISPR gRNA sequence
  source 1..20: mol_type = other DNA
tagagaaaaaaatctttggc

SEQ ID NO: 94259 - DNA, 20 bp, synthetic construct
  misc_feature 1..20: note = CRISPR gRNA sequence
  source 1..20: mol_type = other DNA
tggccccaataagctgcaaa

SEQ ID NO: 94260 - DNA, 20 bp, synthetic construct
  misc_feature 1..20: note = CRISPR gRNA sequence
  source 1..20: mol_type = other DNA
ggccccaataagctgcaaaa

SEQ ID NO: 94261 - DNA, 20 bp, synthetic construct
  misc_feature 1..20: note = CRISPR gRNA sequence
  source 1..20: mol_type = other DNA
gccccaataagctgcaaaaa

SEQ ID NO: 94262 - DNA, 20 bp, synthetic construct
  misc_feature 1..20: note = CRISPR gRNA sequence
  source 1..20: mol_type = other DNA
caaaaagataaactgaataa

SEQ ID NO: 94263 - DNA, 20 bp, synthetic construct
  misc_feature 1..20: note = CRISPR gRNA sequence
  source 1..20: mol_type = other DNA
aataaagtgaacatactatc

SEQ ID NO: 94264 - DNA, 20 bp, synthetic construct
  misc_feature 1..20: note = CRISPR gRNA sequence
  source 1..20: mol_type = other DNA
tcattaaatactgactttca

SEQ ID NO: 94265 - DNA, 20 bp, synthetic construct
  misc_feature 1..20: note = CRISPR gRNA sequence
  source 1..20: mol_type = other DNA
aatactgactttcagattat

SEQ ID NO: 94266 - DNA, 20 bp, synthetic construct
  misc_feature 1..20: note = CRISPR gRNA sequence
  source 1..20: mol_type = other DNA
actttcagattatatgtatt

SEQ ID NO: 94267 - DNA, 20 bp, synthetic construct
  misc_feature 1..20: note = CRISPR gRNA sequence
  source 1..20: mol_type = other DNA
tcagattatatgtattatat

SEQ ID NO: 94268 - DNA, 20 bp, synthetic construct
  misc_feature 1..20: note = CRISPR gRNA sequence
  source 1..20: mol_type = other DNA
cagattatatgtattatatc

SEQ ID NO: 94269 - DNA, 20 bp, synthetic construct
  misc_feature 1..20: note = CRISPR gRNA sequence
  source 1..20: mol_type = other DNA
agattatatgtattatatct

SEQ ID NO: 94270 - DNA, 20 bp, synthetic construct
  misc_feature 1..20: note = CRISPR gRNA sequence
  source 1..20: mol_type = other DNA
tatgtattatatcttagtac

SEQ ID NO: 94271 - DNA, 20 bp, synthetic construct
  misc_feature 1..20: note = CRISPR gRNA sequence
  source 1..20: mol_type = other DNA
tatcttagtacattttctat

SEQ ID NO: 94272 - DNA, 20 bp, synthetic construct
  misc_feature 1..20: note = CRISPR gRNA sequence
  source 1..20: mol_type = other DNA
agtacattttctatttatta

SEQ ID NO: 94273 - DNA, 20 bp, synthetic construct
  misc_feature 1..20: note = CRISPR gRNA sequence
  source 1..20: mol_type = other DNA
gtacattttctatttattaa

SEQ ID NO: 94274 - DNA, 20 bp, synthetic construct
  misc_feature 1..20: note = CRISPR gRNA sequence
  source 1..20: mol_type = other DNA
tctatttattaaacagtttt

SEQ ID NO: 94275 - DNA, 20 bp, synthetic construct
  misc_feature 1..20: note = CRISPR gRNA sequence
  source 1..20: mol_type = other DNA
ctatttattaaacagtttta

SEQ ID NO: 94276 - DNA, 20 bp, synthetic construct
  misc_feature 1..20: note = CRISPR gRNA sequence
  source 1..20: mol_type = other DNA
tatttattaaacagttttat

SEQ ID NO: 94277 - DNA, 20 bp, synthetic construct
  misc_feature 1..20: note = CRISPR gRNA sequence
  source 1..20: mol_type = other DNA
tttattaaacagttttattt

SEQ ID NO: 94278 - DNA, 20 bp, synthetic construct
  misc_feature 1..20: note = CRISPR gRNA sequence
  source 1..20: mol_type = other DNA
attaaacagttttatttaaa

SEQ ID NO: 94279 - DNA, 20 bp, synthetic construct
  misc_feature 1..20: note = CRISPR gRNA sequence
  source 1..20: mol_type = other DNA
ttaaacagttttatttaaaa

SEQ ID NO: 94280 - DNA, 20 bp, synthetic construct
  misc_feature 1..20: note = CRISPR gRNA sequence
  source 1..20: mol_type = other DNA
aacagttttatttaaaaatc

SEQ ID NO: 94281 - DNA, 20 bp, synthetic construct
  misc_feature 1..20: note = CRISPR gRNA sequence
  source 1..20: mol_type = other DNA
tatttaaaaatcatcttagc

SEQ ID NO: 94282 - DNA, 20 bp, synthetic construct
  misc_feature 1..20: note = CRISPR gRNA sequence
  source 1..20: mol_type = other DNA
atttaaaaatcatcttagct

SEQ ID NO: 94283 - DNA, 20 bp, synthetic construct
  misc_feature 1..20: note = CRISPR gRNA sequence
  source 1..20: mol_type = other DNA
tttaaaaatcatcttagctg

SEQ ID NO: 94284 - DNA, 20 bp, synthetic construct
  misc_feature 1..20: note = CRISPR gRNA sequence
  source 1..20: mol_type = other DNA
aaaaatcatcttagctgtta

SEQ ID NO: 94285 - DNA, 20 bp, synthetic construct
  misc_feature 1..20: note = CRISPR gRNA sequence
  source 1..20: mol_type = other DNA
aaaatcatcttagctgttat

SEQ ID NO: 94286 - DNA, 20 bp, synthetic construct
  misc_feature 1..20: note = CRISPR gRNA sequence
  source 1..20: mol_type = other DNA
agctgttatgacactgttgg

SEQ ID NO: 94287 - DNA, 20 bp, synthetic construct
  misc_feature 1..20: note = CRISPR gRNA sequence
  source 1..20: mol_type = other DNA
gctgttatgacactgttgga

SEQ ID NO: 94288 - DNA, 20 bp, synthetic construct
  misc_feature 1..20: note = CRISPR gRNA sequence
  source 1..20: mol_type = other DNA
ttatgacactgttggacatt

SEQ ID NO: 94289 - DNA, 20 bp, synthetic construct
  misc_feature 1..20: note = CRISPR gRNA sequence
  source 1..20: mol_type = other DNA
tgacactgttggacatttag

SEQ ID NO: 94290 - DNA, 20 bp, synthetic construct
  misc_feature 1..20: note = CRISPR gRNA sequence
  source 1..20: mol_type = other DNA
ttggacatttaggctgtttc

SEQ ID NO: 94291 - DNA, 20 bp, synthetic construct
  misc_feature 1..20: note = CRISPR gRNA sequence
  source 1..20: mol_type = other DNA
gacatttaggctgtttcaac

SEQ ID NO: 94292 - DNA, 20 bp, synthetic construct
  misc_feature 1..20: note = CRISPR gRNA sequence
  source 1..20: mol_type = other DNA
aggctgtttcaactaccttt

SEQ ID NO: 94293 - DNA, 20 bp, synthetic construct
  misc_feature 1..20: note = CRISPR gRNA sequence
  source 1..20: mol_type = other DNA
ggctgtttcaactacctttt

SEQ ID NO: 94294 - DNA, 20 bp, synthetic construct
  misc_feature 1..20: note = CRISPR gRNA sequence
  source 1..20: mol_type = other DNA
tttcaactaccttttttact

SEQ ID NO: 94295 - DNA, 20 bp, synthetic construct
  misc_feature 1..20: note = CRISPR gRNA sequence
  source 1..20: mol_type = other DNA
caactaccttttttactatt

SEQ ID NO: 94296 - DNA, 20 bp, synthetic construct
  misc_feature 1..20: note = CRISPR gRNA sequence
  source 1..20: mol_type = other DNA
aactaccttttttactattt

SEQ ID NO: 94297 - DNA, 20 bp, synthetic construct
  misc_feature 1..20: note = CRISPR gRNA sequence
  source 1..20: mol_type = other DNA
ccttttttactatttatgag

SEQ ID NO: 94298 - DNA, 20 bp, synthetic construct
  misc_feature 1..20: note = CRISPR gRNA sequence
  source 1..20: mol_type = other DNA
ttttactatttatgagaaat

SEQ ID NO: 94299 - DNA, 20 bp, synthetic construct
  misc_feature 1..20: note = CRISPR gRNA sequence
  source 1..20: mol_type = other DNA
tttactatttatgagaaata

SEQ ID NO: 94300 - DNA, 20 bp, synthetic construct
  misc_feature 1..20: note = CRISPR gRNA sequence
  source 1..20: mol_type = other DNA
ttactatttatgagaaatat

SEQ ID NO: 94301 - DNA, 20 bp, synthetic construct
  misc_feature 1..20: note = CRISPR gRNA sequence
  source 1..20: mol_type = other DNA
tactatttatgagaaatata

SEQ ID NO: 94302 - DNA, 20 bp, synthetic construct
  misc_feature 1..20: note = CRISPR gRNA sequence
  source 1..20: mol_type = other DNA
actatttatgagaaatatat

SEQ ID NO: 94303 - DNA, 20 bp, synthetic construct
  misc_feature 1..20: note = CRISPR gRNA sequence
  source 1..20: mol_type = other DNA
ctatttatgagaaatatatt

SEQ ID NO: 94304 - DNA, 20 bp, synthetic construct
  misc_feature 1..20: note = CRISPR gRNA sequence
  source 1..20: mol_type = other DNA
tttatgagaaatatattcct

SEQ ID NO: 94305 - DNA, 20 bp, synthetic construct
  misc_feature 1..20: note = CRISPR gRNA sequence
  source 1..20: mol_type = other DNA
atgagaaatatattcctggc

SEQ ID NO: 94306 - DNA, 20 bp, synthetic construct
  misc_feature 1..20: note = CRISPR gRNA sequence
  source 1..20: mol_type = other DNA
tgagaaatatattcctggca

SEQ ID NO: 94307 - DNA, 20 bp, synthetic construct
  misc_feature 1..20: note = CRISPR gRNA sequence
  source 1..20: mol_type = other DNA
ctggcaatacctttatgttt

SEQ ID NO: 94308 - DNA, 20 bp, synthetic construct
  misc_feature 1..20: note = CRISPR gRNA sequence
  source 1..20: mol_type = other DNA
gcaatacctttatgtttaac

SEQ ID NO: 94309 - DNA, 20 bp, synthetic construct
  misc_feature 1..20: note = CRISPR gRNA sequence
  source 1..20: mol_type = other DNA
tatgtttaactctatccata

SEQ ID NO: 94310 - DNA, 20 bp, synthetic construct
  misc_feature 1..20: note = CRISPR gRNA sequence
  source 1..20: mol_type = other DNA
atgtttaactctatccatat

SEQ ID NO: 94311 - DNA, 20 bp, synthetic construct
  misc_feature 1..20: note = CRISPR gRNA sequence
  source 1..20: mol_type = other DNA
tgtttaactctatccatatt

SEQ ID NO: 94312 - DNA, 20 bp, synthetic construct
  misc_feature 1..20: note = CRISPR gRNA sequence
  source 1..20: mol_type = other DNA
aactctatccatatttagga

SEQ ID NO: 94313 - DNA, 20 bp, synthetic construct
  misc_feature 1..20: note = CRISPR gRNA sequence
  source 1..20: mol_type = other DNA
actctatccatatttaggat

SEQ ID NO: 94314 - DNA, 20 bp, synthetic construct
  misc_feature 1..20: note = CRISPR gRNA sequence
  source 1..20: mol_type = other DNA
tatccatatttaggatttac

SEQ ID NO: 94315 - DNA, 20 bp, synthetic construct
  misc_feature 1..20: note = CRISPR gRNA sequence
  source 1..20: mol_type = other DNA
tccatatttaggatttacat

SEQ ID NO: 94316 - DNA, 20 bp, synthetic construct
  misc_feature 1..20: note = CRISPR gRNA sequence
  source 1..20: mol_type = other DNA
aggatttacattctgtaaat

SEQ ID NO: 94317 - DNA, 20 bp, synthetic construct
  misc_feature 1..20: note = CRISPR gRNA sequence
  source 1..20: mol_type = other DNA
ggatttacattctgtaaatg

SEQ ID NO: 94318 - DNA, 20 bp, synthetic construct
  misc_feature 1..20: note = CRISPR gRNA sequence
  source 1..20: mol_type = other DNA
acattctgtaaatgtcttca

SEQ ID NO: 94319 - DNA, 20 bp, synthetic construct
  misc_feature 1..20: note = CRISPR gRNA sequence
  source 1..20: mol_type = other DNA
cattctgtaaatgtcttcat

SEQ ID NO: 94320 - DNA, 20 bp, synthetic construct
  misc_feature 1..20: note = CRISPR gRNA sequence
  source 1..20: mol_type = other DNA
tgtaaatgtcttcatattaa

SEQ ID NO: 94321 - DNA, 20 bp, synthetic construct
  misc_feature 1..20: note = CRISPR gRNA sequence
  source 1..20: mol_type = other DNA
taaatgtcttcatattaaat

SEQ ID NO: 94322 - DNA, 20 bp, synthetic construct
  misc_feature 1..20: note = CRISPR gRNA sequence
  source 1..20: mol_type = other DNA
catattaaatgtgatgtctg

SEQ ID NO: 94323 - DNA, 20 bp, synthetic construct
  misc_feature 1..20: note = CRISPR gRNA sequence
  source 1..20: mol_type = other DNA
atattaaatgtgatgtctga

SEQ ID NO: 94324 - DNA, 20 bp, synthetic construct
  misc_feature 1..20: note = CRISPR gRNA sequence
  source 1..20: mol_type = other DNA
aatgtgatgtctgagttgaa

SEQ ID NO: 94325 - DNA, 20 bp, synthetic construct
  misc_feature 1..20: note = CRISPR gRNA sequence
  source 1..20: mol_type = other DNA
agttgaaagggatgactcct

SEQ ID NO: 94326 - DNA, 20 bp, synthetic construct
  misc_feature 1..20: note = CRISPR gRNA sequence
  source 1..20: mol_type = other DNA
aaagggatgactcctggtac

SEQ ID NO: 94327 - DNA, 20 bp, synthetic construct
  misc_feature 1..20: note = CRISPR gRNA sequence
  source 1..20: mol_type = other DNA
ctggtacatattgcccaact

SEQ ID NO: 94328 - DNA, 20 bp, synthetic construct
  misc_feature 1..20: note = CRISPR gRNA sequence
  source 1..20: mol_type = other DNA
gtacatattgcccaactgct

SEQ ID NO: 94329 - DNA, 20 bp, synthetic construct
  misc_feature 1..20: note = CRISPR gRNA sequence
  source 1..20: mol_type = other DNA
cccaactgctttctgaaagt

SEQ ID NO: 94330 - DNA, 20 bp, synthetic construct
  misc_feature 1..20: note = CRISPR gRNA sequence
  source 1..20: mol_type = other DNA
ctttctgaaagtgccatacc

SEQ ID NO: 94331 - DNA, 20 bp, synthetic construct
  misc_feature 1..20: note = CRISPR gRNA sequence
  source 1..20: mol_type = other DNA
tctgaaagtgccataccaat

SEQ ID NO: 94332 - DNA, 20 bp, synthetic construct
  misc_feature 1..20: note = CRISPR gRNA sequence
  source 1..20: mol_type = other DNA
ctgaaagtgccataccaata

SEQ ID NO: 94333 - DNA, 20 bp, synthetic construct
  misc_feature 1..20: note = CRISPR gRNA sequence
  source 1..20: mol_type = other DNA
tgaaagtgccataccaatat

SEQ ID NO: 94334 - DNA, 20 bp, synthetic construct
  misc_feature 1..20: note = CRISPR gRNA sequence
  source 1..20: mol_type = other DNA
aaagtgccataccaatatat

SEQ ID NO: 94335 - DNA, 20 bp, synthetic construct
  misc_feature 1..20: note = CRISPR gRNA sequence
  source 1..20: mol_type = other DNA
actacttgagaatgtccatt

SEQ ID NO: 94336 - DNA, 20 bp, synthetic construct
  misc_feature 1..20: note = CRISPR gRNA sequence
  source 1..20: mol_type = other DNA
cttgagaatgtccatttcat

SEQ ID NO: 94337 - DNA, 20 bp, synthetic construct
  misc_feature 1..20: note = CRISPR gRNA sequence
  source 1..20: mol_type = other DNA
gagaatgtccatttcatgaa

SEQ ID NO: 94338 - DNA, 20 bp, synthetic construct
  misc_feature 1..20: note = CRISPR gRNA sequence
  source 1..20: mol_type = other DNA
agaatgtccatttcatgaaa

SEQ ID NO: 94339 - DNA, 20 bp, synthetic construct
  misc_feature 1..20: note = CRISPR gRNA sequence
  source 1..20: mol_type = other DNA
catgaaagtctccacatcac

SEQ ID NO: 94340 - DNA, 20 bp, synthetic construct
  misc_feature 1..20: note = CRISPR gRNA sequence
  source 1..20: mol_type = other DNA
atgaaagtctccacatcact

SEQ ID NO: 94341 - DNA, 20 bp, synthetic construct
  misc_feature 1..20: note = CRISPR gRNA sequence
  source 1..20: mol_type = other DNA
cacatcactgcatcattgtg

SEQ ID NO: 94342 - DNA, 20 bp, synthetic construct
  misc_feature 1..20: note = CRISPR gRNA sequence
  source 1..20: mol_type = other DNA
catcattgtgcgtaatcgtt

SEQ ID NO: 94343 - DNA, 20 bp, synthetic construct
  misc_feature 1..20: note = CRISPR gRNA sequence
  source 1..20: mol_type = other DNA
tgcgtaatcgtttaaataat

SEQ ID NO: 94344 - DNA, 20 bp, synthetic construct
  misc_feature 1..20: note = CRISPR gRNA sequence
  source 1..20: mol_type = other DNA
aaataattttcactttttgt

SEQ ID NO: 94345 - DNA, 20 bp, synthetic construct
  misc_feature 1..20: note = CRISPR gRNA sequence
  source 1..20: mol_type = other DNA
aataattttcactttttgtt

SEQ ID NO: 94346 - DNA, 20 bp, synthetic construct
  misc_feature 1..20: note = CRISPR gRNA sequence
  source 1..20: mol_type = other DNA
tcactttttgtttattttta

SEQ ID NO: 94347 - DNA, 20 bp, synthetic construct
  misc_feature 1..20: note = CRISPR gRNA sequence
  source 1..20: mol_type = other DNA
cactttttgtttatttttac

SEQ ID NO: 94348 - DNA, 20 bp, synthetic construct
  misc_feature 1..20: note = CRISPR gRNA sequence
  source 1..20: mol_type = other DNA
actttttgtttatttttact

SEQ ID NO: 94349 - DNA, 20 bp, synthetic construct
  misc_feature 1..20: note = CRISPR gRNA sequence
  source 1..20: mol_type = other DNA
tttgtttatttttactgata

SEQ ID NO: 94350 - DNA, 20 bp, synthetic construct
  misc_feature 1..20: note = CRISPR gRNA sequence
  source 1..20: mol_type = other DNA
ttgtttatttttactgatat

SEQ ID NO: 94351 - DNA, 20 bp, synthetic construct
  misc_feature 1..20: note = CRISPR gRNA sequence
  source 1..20: mol_type = other DNA
tgtttatttttactgatatt

SEQ ID NO: 94352 - DNA, 20 bp, synthetic construct
  misc_feature 1..20: note = CRISPR gRNA sequence
  source 1..20: mol_type = other DNA
gtttatttttactgatattg

SEQ ID NO: 94353 - DNA, 20 bp, synthetic construct
  misc_feature 1..20: note = CRISPR gRNA sequence
  source 1..20: mol_type = other DNA
tttatttttactgatattga

SEQ ID NO: 94354 - DNA, 20 bp, synthetic construct
  misc_feature 1..20: note = CRISPR gRNA sequence
  source 1..20: mol_type = other DNA
atttttactgatattgaata

SEQ ID NO: 94355 - DNA, 20 bp, synthetic construct
  misc_feature 1..20: note = CRISPR gRNA sequence
  source 1..20: mol_type = other DNA
tttttactgatattgaatac

SEQ ID NO: 94356 - DNA, 20 bp, synthetic construct
  misc_feature 1..20: note = CRISPR gRNA sequence
  source 1..20: mol_type = other DNA
ttactgatattgaatacctt

SEQ ID NO: 94357 - DNA, 20 bp, synthetic construct
  misc_feature 1..20: note = CRISPR gRNA sequence
  source 1..20: mol_type = other DNA
tactgatattgaataccttt

SEQ ID NO: 94358 - DNA, 20 bp, synthetic construct
  misc_feature 1..20: note = CRISPR gRNA sequence
  source 1..20: mol_type = other DNA
actgatattgaatacctttc

SEQ ID NO: 94359 - DNA, 20 bp, synthetic construct
  misc_feature 1..20: note = CRISPR gRNA sequence
  source 1..20: mol_type = other DNA
ctgatattgaatacctttcc

SEQ ID NO: 94360 - DNA, 20 bp, synthetic construct
  misc_feature 1..20: note = CRISPR gRNA sequence
  source 1..20: mol_type = other DNA
atattgaatacctttccata

SEQ ID NO: 94361 - DNA, 20 bp, synthetic construct
  misc_feature 1..20: note = CRISPR gRNA sequence
  source 1..20: mol_type = other DNA
aatacctttccatatcattt

SEQ ID NO: 94362 - DNA, 20 bp, synthetic construct
  misc_feature 1..20: note = CRISPR gRNA sequence
  source 1..20: mol_type = other DNA
tccatatcatttaatggtat

SEQ ID NO: 94363 - DNA, 20 bp, synthetic construct
  misc_feature 1..20: note = CRISPR gRNA sequence
  source 1..20: mol_type = other DNA
ccatatcatttaatggtatt

SEQ ID NO: 94364 - DNA, 20 bp, synthetic construct
  misc_feature 1..20: note = CRISPR gRNA sequence
  source 1..20: mol_type = other DNA
catatcatttaatggtattc

SEQ ID NO: 94365 - DNA, 20 bp, synthetic construct
  misc_feature 1..20: note = CRISPR gRNA sequence
  source 1..20: mol_type = other DNA
aatggtattctgcctttttt

SEQ ID NO: 94366 - DNA, 20 bp, synthetic construct
  misc_feature 1..20: note = CRISPR gRNA sequence
  source 1..20: mol_type = other DNA
atggtattctgccttttttt

SEQ ID NO: 94367 - DNA, 20 bp, synthetic construct
  misc_feature 1..20: note = CRISPR gRNA sequence
  source 1..20: mol_type = other DNA
tgccttttttttctgtttct

SEQ ID NO: 94368 - DNA, 20 bp, synthetic construct
  misc_feature 1..20: note = CRISPR gRNA sequence
  source 1..20: mol_type = other DNA
ccttttttttctgtttctat

SEQ ID NO: 94369 - DNA, 20 bp, synthetic construct
  misc_feature 1..20: note = CRISPR gRNA sequence
  source 1..20: mol_type = other DNA
ttttttctgtttctatcttt

SEQ ID NO: 94370 - DNA, 20 bp, synthetic construct
  misc_feature 1..20: note = CRISPR gRNA sequence
  source 1..20: mol_type = other DNA
tttttctgtttctatctttt

SEQ ID NO: 94371 - DNA, 20 bp, synthetic construct
  misc_feature 1..20: note = CRISPR gRNA sequence
  source 1..20: mol_type = other DNA
ttttctgtttctatcttttg

SEQ ID NO: 94372 - DNA, 20 bp, synthetic construct
  misc_feature 1..20: note = CRISPR gRNA sequence
  source 1..20: mol_type = other DNA
tttctgtttctatcttttgc

SEQ ID NO: 94373 - DNA, 20 bp, synthetic construct
  misc_feature 1..20: note = CRISPR gRNA sequence
  source 1..20: mol_type = other DNA
ttctgtttctatcttttgca

SEQ ID NO: 94374 - DNA, 20 bp, synthetic construct
  misc_feature 1..20: note = CRISPR gRNA sequence
  source 1..20: mol_type = other DNA
tctgtttctatcttttgcaa

SEQ ID NO: 94375 - DNA, 20 bp, synthetic construct
  misc_feature 1..20: note = CRISPR gRNA sequence
  source 1..20: mol_type = other DNA
ctgtttctatcttttgcaat

SEQ ID NO: 94376 - DNA, 20 bp, synthetic construct
  misc_feature 1..20: note = CRISPR gRNA sequence
  source 1..20: mol_type = other DNA
tgtttctatcttttgcaatg

SEQ ID NO: 94377 - DNA, 20 bp, synthetic construct
  misc_feature 1..20: note = CRISPR gRNA sequence
  source 1..20: mol_type = other DNA
tttctatcttttgcaatgta

SEQ ID NO: 94378 - DNA, 20 bp, synthetic construct
  misc_feature 1..20: note = CRISPR gRNA sequence
  source 1..20: mol_type = other DNA
ctatcttttgcaatgtattg

SEQ ID NO: 94379 - DNA, 20 bp, synthetic construct
  misc_feature 1..20: note = CRISPR gRNA sequence
  source 1..20: mol_type = other DNA
tatcttttgcaatgtattga

SEQ ID NO: 94380 - DNA, 20 bp, synthetic construct
  misc_feature 1..20: note = CRISPR gRNA sequence
  source 1..20: mol_type = other DNA
tcttttgcaatgtattgaag

SEQ ID NO: 94381 - DNA, 20 bp, synthetic construct
  misc_feature 1..20: note = CRISPR gRNA sequence
  source 1..20: mol_type = other DNA
ttgcaatgtattgaagccaa

SEQ ID NO: 94382 - DNA, 20 bp, synthetic construct
  misc_feature 1..20: note = CRISPR gRNA sequence
  source 1..20: mol_type = other DNA
tgcaatgtattgaagccaaa

SEQ ID NO: 94383 - DNA, 20 bp, synthetic construct
  misc_feature 1..20: note = CRISPR gRNA sequence
  source 1..20: mol_type = other DNA
gcaatgtattgaagccaaag

SEQ ID NO: 94384 - DNA, 20 bp, synthetic construct
  misc_feature 1..20: note = CRISPR gRNA sequence
  source 1..20: mol_type = other DNA
caatgtattgaagccaaagg

SEQ ID NO: 94385 - DNA, 20 bp, synthetic construct
  misc_feature 1..20: note = CRISPR gRNA sequence
  source 1..20: mol_type = other DNA
aagccaaaggttttcctcat

SEQ ID NO: 94386 - DNA, 20 bp, synthetic construct
  misc_feature 1..20: note = CRISPR gRNA sequence
  source 1..20: mol_type = other DNA
tcctcatcaaattacaggaa

SEQ ID NO: 94387 - DNA, 20 bp, synthetic construct
  misc_feature 1..20: note = CRISPR gRNA sequence
  source 1..20: mol_type = other DNA
cctcatcaaattacaggaat

SEQ ID NO: 94388 - DNA, 20 bp, synthetic construct
  misc_feature 1..20: note = CRISPR gRNA sequence
  source 1..20: mol_type = other DNA
ctcatcaaattacaggaatt

SEQ ID NO: 94389 - DNA, 20 bp, synthetic construct
  misc_feature 1..20: note = CRISPR gRNA sequence
  source 1..20: mol_type = other DNA
atcaaattacaggaattttt

SEQ ID NO: 94390 - DNA, 20 bp, synthetic construct
  misc_feature 1..20: note = CRISPR gRNA sequence
  source 1..20: mol_type = other DNA
caggaatttttgtaataaac

SEQ ID NO: 94391 - DNA, 20 bp, synthetic construct
  misc_feature 1..20: note = CRISPR gRNA sequence
  source 1..20: mol_type = other DNA
ttgtaataaactttctttgc

SEQ ID NO: 94392 - DNA, 20 bp, synthetic construct
  misc_feature 1..20: note = CRISPR gRNA sequence
  source 1..20: mol_type = other DNA
tgtaataaactttctttgca

SEQ ID NO: 94393 - DNA, 20 bp, synthetic construct
  misc_feature 1..20: note = CRISPR gRNA sequence
  source 1..20: mol_type = other DNA
gtaataaactttctttgcag

SEQ ID NO: 94394 - DNA, 20 bp, synthetic construct
  misc_feature 1..20: note = CRISPR gRNA sequence
  source 1..20: mol_type = other DNA
taataaactttctttgcagt

SEQ ID NO: 94395 - DNA, 20 bp, synthetic construct
  misc_feature 1..20: note = CRISPR gRNA sequence
  source 1..20: mol_type = other DNA
tctttgcagttaagactgaa

SEQ ID NO: 94396 - DNA, 20 bp, synthetic construct
  misc_feature 1..20: note = CRISPR gRNA sequence
  source 1..20: mol_type = other DNA
ctttgcagttaagactgaag

SEQ ID NO: 94397 - DNA, 20 bp, synthetic construct
  misc_feature 1..20: note = CRISPR gRNA sequence
  source 1..20: mol_type = other DNA
tttgcagttaagactgaagc

SEQ ID NO: 94398 - DNA, 20 bp, synthetic construct
  misc_feature 1..20: note = CRISPR gRNA sequence
  source 1..20: mol_type = other DNA
tgcagttaagactgaagctg

SEQ ID NO: 94399 - DNA, 20 bp, synthetic construct
  misc_feature 1..20: note = CRISPR gRNA sequence
  source 1..20: mol_type = other DNA
gcagttaagactgaagctgt

SEQ ID NO: 94400 - DNA, 20 bp, synthetic construct
  misc_feature 1..20: note = CRISPR gRNA sequence
  source 1..20: mol_type = other DNA
cagttaagactgaagctgtc

SEQ ID NO: 94401 - DNA, 20 bp, synthetic construct
  misc_feature 1..20: note = CRISPR gRNA sequence
  source 1..20: mol_type = other DNA
agactgaagctgtcaaagag

SEQ ID NO: 94402 - DNA, 20 bp, synthetic construct
  misc_feature 1..20: note = CRISPR gRNA sequence
  source 1..20: mol_type = other DNA
aagctgtcaaagaggcaaac

SEQ ID NO: 94403 - DNA, 20 bp, synthetic construct
  misc_feature 1..20: note = CRISPR gRNA sequence
  source 1..20: mol_type = other DNA
tcaaagaggcaaacatattt

SEQ ID NO: 94404 - DNA, 20 bp, synthetic construct
  misc_feature 1..20: note = CRISPR gRNA sequence
  source 1..20: mol_type = other DNA
tatatatatgtaaggaaact

SEQ ID NO: 94405 - DNA, 20 bp, synthetic construct
  misc_feature 1..20: note = CRISPR gRNA sequence
  source 1..20: mol_type = other DNA
atatatatgtaaggaaactg

SEQ ID NO: 94406 - DNA, 20 bp, synthetic construct
  misc_feature 1..20: note = CRISPR gRNA sequence
  source 1..20: mol_type = other DNA
tatatatgtaaggaaactga

SEQ ID NO: 94407 - DNA, 20 bp, synthetic construct
  misc_feature 1..20: note = CRISPR gRNA sequence
  source 1..20: mol_type = other DNA
atcatgtttaatgatttata

SEQ ID NO: 94408 - DNA, 20 bp, synthetic construct
  misc_feature 1..20: note = CRISPR gRNA sequence
  source 1..20: mol_type = other DNA
aatgatttatagggtgctct

SEQ ID NO: 94409 - DNA, 20 bp, synthetic construct
  misc_feature 1..20: note = CRISPR gRNA sequence
  source 1..20: mol_type = other DNA
atgatttatagggtgctctg

SEQ ID NO: 94410 - DNA, 20 bp, synthetic construct
  misc_feature 1..20: note = CRISPR gRNA sequence
  source 1..20: mol_type = other DNA
atagggtgctctgttgccta

SEQ ID NO: 94411 - DNA, 20 bp, synthetic construct
  misc_feature 1..20: note = CRISPR gRNA sequence
  source 1..20: mol_type = other DNA
tagggtgctctgttgcctag

SEQ ID NO: 94412 - DNA, 20 bp, synthetic construct
  misc_feature 1..20: note = CRISPR gRNA sequence
  source 1..20: mol_type = other DNA
tgttgcctaggctggagtac

SEQ ID NO: 94413 - DNA, 20 bp, synthetic construct
  misc_feature 1..20: note = CRISPR gRNA sequence
  source 1..20: mol_type = other DNA
ttgcctaggctggagtacag

SEQ ID NO: 94414 - DNA, 20 bp, synthetic construct
  misc_feature 1..20: note = CRISPR gRNA sequence
  source 1..20: mol_type = other DNA
cctaggctggagtacagtgg

SEQ ID NO: 94415 - DNA, 20 bp, synthetic construct
  misc_feature 1..20: note = CRISPR gRNA sequence
  source 1..20: mol_type = other DNA
ggctggagtacagtggtatg

SEQ ID NO: 94416 - DNA, 20 bp, synthetic construct
  misc_feature 1..20: note = CRISPR gRNA sequence
  source 1..20: mol_type = other DNA
gagtacagtggtatgatcat

SEQ ID NO: 94417 - DNA, 20 bp, synthetic construct
  misc_feature 1..20: note = CRISPR gRNA sequence
  source 1..20: mol_type = other DNA
attgcagcctcgaattcctg

SEQ ID NO: 94418 - DNA, 20 bp, synthetic construct
  misc_feature 1..20: note = CRISPR gRNA sequence
  source 1..20: mol_type = other DNA
cagcctcgaattcctggact

SEQ ID NO: 94419 - DNA, 20 bp, synthetic construct
  misc_feature 1..20: note = CRISPR gRNA sequence
  source 1..20: mol_type = other DNA
gaattcctggactcaagcaa

SEQ ID NO: 94420 - DNA, 20 bp, synthetic construct
  misc_feature 1..20: note = CRISPR gRNA sequence
  source 1..20: mol_type = other DNA
ctggactcaagcaatcctcc

SEQ ID NO: 94421 - DNA, 20 bp, synthetic construct
  misc_feature 1..20: note = CRISPR gRNA sequence
  source 1..20: mol_type = other DNA
gactcaagcaatcctcctgt

SEQ ID NO: 94422 - DNA, 20 bp, synthetic construct
  misc_feature 1..20: note = CRISPR gRNA sequence
  source 1..20: mol_type = other DNA
aagcaatcctcctgtttcag

SEQ ID NO: 94423 - DNA, 20 bp, synthetic construct
  misc_feature 1..20: note = CRISPR gRNA sequence
  source 1..20: mol_type = other DNA
ctgtttcagcctcttgagta

SEQ ID NO: 94424 - DNA, 20 bp, synthetic construct
  misc_feature 1..20: note = CRISPR gRNA sequence
  source 1..20: mol_type = other DNA
tttcagcctcttgagtagcc

SEQ ID NO: 94425 - DNA, 20 bp, synthetic construct
  misc_feature 1..20: note = CRISPR gRNA sequence
  source 1..20: mol_type = other DNA
cagcctcttgagtagccagg

SEQ ID NO: 94426 - DNA, 20 bp, synthetic construct
  misc_feature 1..20: note = CRISPR gRNA sequence
  source 1..20: mol_type = other DNA
agcctcttgagtagccagga

SEQ ID NO: 94427 - DNA, 20 bp, synthetic construct
  misc_feature 1..20: note = CRISPR gRNA sequence
  source 1..20: mol_type = other DNA
ttgagtagccaggactacag

SEQ ID NO: 94428 - DNA, 20 bp, synthetic construct
  misc_feature 1..20: note = CRISPR gRNA sequence
  source 1..20: mol_type = other DNA
gagtagccaggactacagct

SEQ ID NO: 94429 - DNA, 20 bp, synthetic construct
  misc_feature 1..20: note = CRISPR gRNA sequence
  source 1..20: mol_type = other DNA
agtagccaggactacagcta

SEQ ID NO: 94430 - DNA, 20 bp, synthetic construct
  misc_feature 1..20: note = CRISPR gRNA sequence
  source 1..20: mol_type = other DNA
cagctacataccatcacact

SEQ ID NO: 94431 - DNA, 20 bp, synthetic construct
  misc_feature 1..20: note = CRISPR gRNA sequence
  source 1..20: mol_type = other DNA
cataccatcacactcggcta

SEQ ID NO: 94432 - DNA, 20 bp, synthetic construct
  misc_feature 1..20: note = CRISPR gRNA sequence
  source 1..20: mol_type = other DNA
ggctaatttttaaatttttt

SEQ ID NO: 94433 - DNA, 20 bp, synthetic construct
  misc_feature 1..20: note = CRISPR gRNA sequence
  source 1..20: mol_type = other DNA
atttttaaatttttttgtag

SEQ ID NO: 94434 - DNA, 20 bp, synthetic construct
  misc_feature 1..20: note = CRISPR gRNA sequence
  source 1..20: mol_type = other DNA
ttaaatttttttgtagatgg

SEQ ID NO: 94435 - DNA, 20 bp, synthetic construct
  misc_feature 1..20: note = CRISPR gRNA sequence
  source 1..20: mol_type = other DNA
taaatttttttgtagatggg

SEQ ID NO: 94436 - DNA, 20 bp, synthetic construct
  misc_feature 1..20: note = CRISPR gRNA sequence
  source 1..20: mol_type = other DNA
aaatttttttgtagatgggg

SEQ ID NO: 94437 - DNA, 20 bp, synthetic construct
  misc_feature 1..20: note = CRISPR gRNA sequence
  source 1..20: mol_type = other DNA
aatttttttgtagatggggt

SEQ ID NO: 94438 - DNA, 20 bp, synthetic construct
  misc_feature 1..20: note = CRISPR gRNA sequence
  source 1..20: mol_type = other DNA
ttttgtagatggggtctcgc

SEQ ID NO: 94439 - DNA, 20 bp, synthetic construct
  misc_feature 1..20: note = CRISPR gRNA sequence
  source 1..20: mol_type = other DNA
tttgtagatggggtctcgct

SEQ ID NO: 94440 - DNA, 20 bp, synthetic construct
  misc_feature 1..20: note = CRISPR gRNA sequence
  source 1..20: mol_type = other DNA
ttgtagatggggtctcgcta

SEQ ID NO: 94441 - DNA, 20 bp, synthetic construct
  misc_feature 1..20: note = CRISPR gRNA sequence
  source 1..20: mol_type = other DNA
tgtagatggggtctcgctac

SEQ ID NO: 94442 - DNA, 20 bp, synthetic construct
  misc_feature 1..20: note = CRISPR gRNA sequence
  source 1..20: mol_type = other DNA
gtagatggggtctcgctacg

SEQ ID NO: 94443 - DNA, 20 bp, synthetic construct
  misc_feature 1..20: note = CRISPR gRNA sequence
  source 1..20: mol_type = other DNA
tagatggggtctcgctacgt

SEQ ID NO: 94444 - DNA, 20 bp, synthetic construct
  misc_feature 1..20: note = CRISPR gRNA sequence
  source 1..20: mol_type = other DNA
gctacgttgcccagaatggt

SEQ ID NO: 94445 - DNA, 20 bp, synthetic construct
  misc_feature 1..20: note = CRISPR gRNA sequence
  source 1..20: mol_type = other DNA
cgttgcccagaatggtctca

SEQ ID NO: 94446 - DNA, 20 bp, synthetic construct
  misc_feature 1..20: note = CRISPR gRNA sequence
  source 1..20: mol_type = other DNA
cccagaatggtctcaaattc

SEQ ID NO: 94447 - DNA, 20 bp, synthetic construct
  misc_feature 1..20: note = CRISPR gRNA sequence
  source 1..20: mol_type = other DNA
aaattcccagcctcaagtga

SEQ ID NO: 94448 - DNA, 20 bp, synthetic construct
  misc_feature 1..20: note = CRISPR gRNA sequence
  source 1..20: mol_type = other DNA
ccagcctcaagtgatcctcc

SEQ ID NO: 94449 - DNA, 20 bp, synthetic construct
  misc_feature 1..20: note = CRISPR gRNA sequence
  source 1..20: mol_type = other DNA
aagtgatcctcccacctggc

SEQ ID NO: 94450 - DNA, 20 bp, synthetic construct
  misc_feature 1..20: note = CRISPR gRNA sequence
  source 1..20: mol_type = other DNA
ccacctggcctcccaaagtg

SEQ ID NO: 94451 - DNA, 20 bp, synthetic construct
  misc_feature 1..20: note = CRISPR gRNA sequence
  source 1..20: mol_type = other DNA
gcctcccaaagtgctaggat

SEQ ID NO: 94452 - DNA, 20 bp, synthetic construct
  misc_feature 1..20: note = CRISPR gRNA sequence
  source 1..20: mol_type = other DNA
ccaaagtgctaggattacag

SEQ ID NO: 94453 - DNA, 20 bp, synthetic construct
  misc_feature 1..20: note = CRISPR gRNA sequence
  source 1..20: mol_type = other DNA
ggattacaggcatgaaccac

SEQ ID NO: 94454 - DNA, 20 bp, synthetic construct
  misc_feature 1..20: note = CRISPR gRNA sequence
  source 1..20: mol_type = other DNA
caggcatgaaccacaatgcc

SEQ ID NO: 94455 - DNA, 20 bp, synthetic construct
  misc_feature 1..20: note = CRISPR gRNA sequence
  source 1..20: mol_type = other DNA
tatgtgataaaataccagac

SEQ ID NO: 94456 - DNA, 20 bp, synthetic construct
  misc_feature 1..20: note = CRISPR gRNA sequence
  source 1..20: mol_type = other DNA
atgtgataaaataccagaca

SEQ ID NO: 94457 - DNA, 20 bp, synthetic construct
  misc_feature 1..20: note = CRISPR gRNA sequence
  source 1..20: mol_type = other DNA
tgtgataaaataccagacac

SEQ ID NO: 94458 - DNA, 20 bp, synthetic construct
  misc_feature 1..20: note = CRISPR gRNA sequence
  source 1..20: mol_type = other DNA
accatagtcttttatatttg

SEQ ID NO: 94459 - DNA, 20 bp, synthetic construct
  misc_feature 1..20: note = CRISPR gRNA sequence
  source 1..20: mol_type = other DNA
ttatatttgttgtacatatt

SEQ ID NO: 94460 - DNA, 20 bp, synthetic construct
  misc_feature 1..20: note = CRISPR gRNA sequence
  source 1..20: mol_type = other DNA
tatatttgttgtacatattt

SEQ ID NO: 94461 - DNA, 20 bp, synthetic construct
  misc_feature 1..20: note = CRISPR gRNA sequence
  source 1..20: mol_type = other DNA
atatttgttgtacatatttt

SEQ ID NO: 94462 - DNA, 20 bp, synthetic construct
  misc_feature 1..20: note = CRISPR gRNA sequence
  source 1..20: mol_type = other DNA
tatttgttgtacatattttt

SEQ ID NO: 94463 - DNA, 20 bp, synthetic construct
  misc_feature 1..20: note = CRISPR gRNA sequence
  source 1..20: mol_type = other DNA
gttgtacatatttttgctct

SEQ ID NO: 94464 - DNA, 20 bp, synthetic construct
  misc_feature 1..20: note = CRISPR gRNA sequence
  source 1..20: mol_type = other DNA
ttgtacatatttttgctcta

SEQ ID NO: 94465 - DNA, 20 bp, synthetic construct
  misc_feature 1..20: note = CRISPR gRNA sequence
  source 1..20: mol_type = other DNA
tacatatttttgctctaggt

SEQ ID NO: 94466 - DNA, 20 bp, synthetic construct
  misc_feature 1..20: note = CRISPR gRNA sequence
  source 1..20: mol_type = other DNA
ttgctctaggtcattgtgca

SEQ ID NO: 94467 - DNA, 20 bp, synthetic construct
  misc_feature 1..20: note = CRISPR gRNA sequence
  source 1..20: mol_type = other DNA
tgctctaggtcattgtgcaa

SEQ ID NO: 94468 - DNA, 20 bp, synthetic construct
  misc_feature 1..20: note = CRISPR gRNA sequence
  source 1..20: mol_type = other DNA
gctctaggtcattgtgcaat

SEQ ID NO: 94469 - DNA, 20 bp, synthetic construct
  misc_feature 1..20: note = CRISPR gRNA sequence
  source 1..20: mol_type = other DNA
ctctaggtcattgtgcaatt

SEQ ID NO: 94470 - DNA, 20 bp, synthetic construct
  misc_feature 1..20: note = CRISPR gRNA sequence
  source 1..20: mol_type = other DNA
taggtcattgtgcaatttgc

SEQ ID NO: 94471 - DNA, 20 bp, synthetic construct
  misc_feature 1..20: note = CRISPR gRNA sequence
  source 1..20: mol_type = other DNA
ggtcattgtgcaatttgcca

SEQ ID NO: 94472 - DNA, 20 bp, synthetic construct
  misc_feature 1..20: note = CRISPR gRNA sequence
  source 1..20: mol_type = other DNA
tgcaatttgccaccattttt

SEQ ID NO: 94473 - DNA, 20 bp, synthetic construct
  misc_feature 1..20: note = CRISPR gRNA sequence
  source 1..20: mol_type = other DNA
gccaccatttttgactatag

SEQ ID NO: 94474 - DNA, 20 bp, synthetic construct
  misc_feature 1..20: note = CRISPR gRNA sequence
  source 1..20: mol_type = other DNA
ccaccatttttgactatagc

SEQ ID NO: 94475 - DNA, 20 bp, synthetic construct
  misc_feature 1..20: note = CRISPR gRNA sequence
  source 1..20: mol_type = other DNA
ttgactatagcattcatttt

SEQ ID NO: 94476 - DNA, 20 bp, synthetic construct
  misc_feature 1..20: note = CRISPR gRNA sequence
  source 1..20: mol_type = other DNA
tgactatagcattcattttt

SEQ ID NO: 94477 - DNA, 20 bp, synthetic construct
  misc_feature 1..20: note = CRISPR gRNA sequence
  source 1..20: mol_type = other DNA
gactatagcattcattttta

SEQ ID NO: 94478 - DNA, 20 bp, synthetic construct
  misc_feature 1..20: note = CRISPR gRNA sequence
  source 1..20: mol_type = other DNA
actatagcattcatttttat

SEQ ID NO: 94479 - DNA, 20 bp, synthetic construct
  misc_feature 1..20: note = CRISPR gRNA sequence
  source 1..20: mol_type = other DNA
tagcattcatttttatgtag

SEQ ID NO: 94480 - DNA, 20 bp, synthetic construct
  misc_feature 1..20: note = CRISPR gRNA sequence
  source 1..20: mol_type = other DNA
atttttatgtagtcaagttt

SEQ ID NO: 94481 - DNA, 20 bp, synthetic construct
  misc_feature 1..20: note = CRISPR gRNA sequence
  source 1..20: mol_type = other DNA
ttatgtagtcaagtttataa

SEQ ID NO: 94482 - DNA, 20 bp, synthetic construct
  misc_feature 1..20: note = CRISPR gRNA sequence
  source 1..20: mol_type = other DNA
tatgtagtcaagtttataat

SEQ ID NO: 94483 - DNA, 20 bp, synthetic construct
  misc_feature 1..20: note = CRISPR gRNA sequence
  source 1..20: mol_type = other DNA
atgtagtcaagtttataatc

SEQ ID NO: 94484 - DNA, 20 bp, synthetic construct
  misc_feature 1..20: note = CRISPR gRNA sequence
  source 1..20: mol_type = other DNA
tgtagtcaagtttataatct

SEQ ID NO: 94485 - DNA, 20 bp, synthetic construct
  misc_feature 1..20: note = CRISPR gRNA sequence
  source 1..20: mol_type = other DNA
ataatcttttctctgtgatt

SEQ ID NO: 94486 - DNA, 20 bp, synthetic construct
  misc_feature 1..20: note = CRISPR gRNA sequence
  source 1..20: mol_type = other DNA
taatcttttctctgtgattt

SEQ ID NO: 94487 - DNA, 20 bp, synthetic construct
  misc_feature 1..20: note = CRISPR gRNA sequence
  source 1..20: mol_type = other DNA
ttctctgtgattttgtctat

SEQ ID NO: 94488 - DNA, 20 bp, synthetic construct
  misc_feature 1..20: note = CRISPR gRNA sequence
  source 1..20: mol_type = other DNA
tctctgtgattttgtctata

SEQ ID NO: 94489 - DNA, 20 bp, synthetic construct
  misc_feature 1..20: note = CRISPR gRNA sequence
  source 1..20: mol_type = other DNA
ctctgtgattttgtctatat

SEQ ID NO: 94490 - DNA, 20 bp, synthetic construct
  misc_feature 1..20: note = CRISPR gRNA sequence
  source 1..20: mol_type = other DNA
tctgtgattttgtctatata

SEQ ID NO: 94491 - DNA, 20 bp, synthetic construct
  misc_feature 1..20: note = CRISPR gRNA sequence
  source 1..20: mol_type = other DNA
tgtgattttgtctatataag

SEQ ID NO: 94492 - DNA, 20 bp, synthetic construct
  misc_feature 1..20: note = CRISPR gRNA sequence
  source 1..20: mol_type = other DNA
tgattttgtctatataagct

SEQ ID NO: 94493 - DNA, 20 bp, synthetic construct
  misc_feature 1..20: note = CRISPR gRNA sequence
  source 1..20: mol_type = other DNA
tgtctatataagctaaaaaa

SEQ ID NO: 94494 - DNA, 20 bp, synthetic construct
  misc_feature 1..20: note = CRISPR gRNA sequence
  source 1..20: mol_type = other DNA
gtctatataagctaaaaaaa

SEQ ID NO: 94495 - DNA, 20 bp, synthetic construct
  misc_feature 1..20: note = CRISPR gRNA sequence
  source 1..20: mol_type = other DNA
tctatataagctaaaaaaaa

SEQ ID NO: 94496 - DNA, 20 bp, synthetic construct
  misc_feature 1..20: note = CRISPR gRNA sequence
  source 1..20: mol_type = other DNA
tataagctaaaaaaaatctc

SEQ ID NO: 94497 - DNA, 20 bp, synthetic construct
  misc_feature 1..20: note = CRISPR gRNA sequence
  source 1..20: mol_type = other DNA
aaaaaaatctcattacattt

SEQ ID NO: 94498 - DNA, 20 bp, synthetic construct
  misc_feature 1..20: note = CRISPR gRNA sequence
  source 1..20: mol_type = other DNA
attacatttttgaggtaaag

SEQ ID NO: 94499 - DNA, 20 bp, synthetic construct
  misc_feature 1..20: note = CRISPR gRNA sequence
  source 1..20: mol_type = other DNA
catttttgaggtaaagttcc

SEQ ID NO: 94500 - DNA, 20 bp, synthetic construct
  misc_feature 1..20: note = CRISPR gRNA sequence
  source 1..20: mol_type = other DNA
ttgaggtaaagttccgattc

SEQ ID NO: 94501 - DNA, 20 bp, synthetic construct
  misc_feature 1..20: note = CRISPR gRNA sequence
  source 1..20: mol_type = other DNA
tgaggtaaagttccgattct

SEQ ID NO: 94502 - DNA, 20 bp, synthetic construct
  misc_feature 1..20: note = CRISPR gRNA sequence
  source 1..20: mol_type = other DNA
gaggtaaagttccgattctt

SEQ ID NO: 94503 - DNA, 20 bp, synthetic construct
  misc_feature 1..20: note = CRISPR gRNA sequence
  source 1..20: mol_type = other DNA
aggtaaagttccgattcttt

SEQ ID NO: 94504 - DNA, 20 bp, synthetic construct
  misc_feature 1..20: note = CRISPR gRNA sequence
  source 1..20: mol_type = other DNA
cgattctttttttaaaattt

SEQ ID NO: 94505 - DNA, 20 bp, synthetic construct
  misc_feature 1..20: note = CRISPR gRNA sequence
  source 1..20: mol_type = other DNA
tttttttaaaattttgactt

SEQ ID NO: 94506 - DNA, 20 bp, synthetic construct
  misc_feature 1..20: note = CRISPR gRNA sequence
  source 1..20: mol_type = other DNA
tttttaaaattttgacttat

SEQ ID NO: 94507 - DNA, 20 bp, synthetic construct
  misc_feature 1..20: note = CRISPR gRNA sequence
  source 1..20: mol_type = other DNA
ttttaaaattttgacttatt

SEQ ID NO: 94508 - DNA, 20 bp, synthetic construct
  misc_feature 1..20: note = CRISPR gRNA sequence
  source 1..20: mol_type = other DNA
tttaaaattttgacttatta

SEQ ID NO: 94509 - DNA, 20 bp, synthetic construct
  misc_feature 1..20: note = CRISPR gRNA sequence
  source 1..20: mol_type = other DNA
ttaaaattttgacttattag

SEQ ID NO: 94510 - DNA, 20 bp, synthetic construct
  misc_feature 1..20: note = CRISPR gRNA sequence
  source 1..20: mol_type = other DNA
taaaattttgacttattagg

SEQ ID NO: 94511 - DNA, 20 bp, synthetic construct
  misc_feature 1..20: note = CRISPR gRNA sequence
  source 1..20: mol_type = other DNA
aaaattttgacttattagga

SEQ ID NO: 94512 - DNA, 20 bp, synthetic construct
  misc_feature 1..20: note = CRISPR gRNA sequence
  source 1..20: mol_type = other DNA
aaattttgacttattaggaa

SEQ ID NO: 94513 - DNA, 20 bp, synthetic construct
  misc_feature 1..20: note = CRISPR gRNA sequence
  source 1..20: mol_type = other DNA
tgacttattaggaatttatt

SEQ ID NO: 94514 - DNA, 20 bp, synthetic construct
  misc_feature 1..20: note = CRISPR gRNA sequence
  source 1..20: mol_type = other DNA
gacttattaggaatttattt

SEQ ID NO: 94515 - DNA, 20 bp, synthetic construct
  misc_feature 1..20: note = CRISPR gRNA sequence
  source 1..20: mol_type = other DNA
acttattaggaatttatttt

SEQ ID NO: 94516 - DNA, 20 bp, synthetic construct
  misc_feature 1..20: note = CRISPR gRNA sequence
  source 1..20: mol_type = other DNA
attaggaatttattttgatg

SEQ ID NO: 94517 - DNA, 20 bp, synthetic construct
  misc_feature 1..20: note = CRISPR gRNA sequence
  source 1..20: mol_type = other DNA
ttaggaatttattttgatgt

SEQ ID NO: 94518 - DNA, 20 bp, synthetic construct
  misc_feature 1..20: note = CRISPR gRNA sequence
  source 1..20: mol_type = other DNA
ggaatttattttgatgtata

SEQ ID NO: 94519 - DNA, 20 bp, synthetic construct
  misc_feature 1..20: note = CRISPR gRNA sequence
  source 1..20: mol_type = other DNA
attttgatgtatagtgtgat

SEQ ID NO: 94520 - DNA, 20 bp, synthetic construct
  misc_feature 1..20: note = CRISPR gRNA sequence
  source 1..20: mol_type = other DNA
ttttgatgtatagtgtgatg

SEQ ID NO: 94521 - DNA, 20 bp, synthetic construct
  misc_feature 1..20: note = CRISPR gRNA sequence
  source 1..20: mol_type = other DNA
tgatgtatagtgtgatgtca

SEQ ID NO: 94522 - DNA, 20 bp, synthetic construct
  misc_feature 1..20: note = CRISPR gRNA sequence
  source 1..20: mol_type = other DNA
gatgtatagtgtgatgtcat

SEQ ID NO: 94523 - DNA, 20 bp, synthetic construct
  misc_feature 1..20: note = CRISPR gRNA sequence
  source 1..20: mol_type = other DNA
atgtatagtgtgatgtcatg

SEQ ID NO: 94524 - DNA, 20 bp, synthetic construct
  misc_feature 1..20: note = CRISPR gRNA sequence
  source 1..20: mol_type = other DNA
aaaatctcaaaaatctcaat

SEQ ID NO: 94525 - DNA, 20 bp, synthetic construct
  misc_feature 1..20: note = CRISPR gRNA sequence
  source 1..20: mol_type = other DNA
aaaaatctcaattgttccat

SEQ ID NO: 94526 - DNA, 20 bp, synthetic construct
  misc_feature 1..20: note = CRISPR gRNA sequence
  source 1..20: mol_type = other DNA
aattgttccatttataacaa

SEQ ID NO: 94527 - DNA, 20 bp, synthetic construct
  misc_feature 1..20: note = CRISPR gRNA sequence
  source 1..20: mol_type = other DNA
ttccatttataacaaacgtt

SEQ ID NO: 94528 - DNA, 20 bp, synthetic construct
  misc_feature 1..20: note = CRISPR gRNA sequence
  source 1..20: mol_type = other DNA
catttataacaaacgtttgt

SEQ ID NO: 94529 - DNA, 20 bp, synthetic construct
  misc_feature 1..20: note = CRISPR gRNA sequence
  source 1..20: mol_type = other DNA
ataacaaacgtttgttaaca

SEQ ID NO: 94530 - DNA, 20 bp, synthetic construct
  misc_feature 1..20: note = CRISPR gRNA sequence
  source 1..20: mol_type = other DNA
taacaaacgtttgttaacac

SEQ ID NO: 94531 - DNA, 20 bp, synthetic construct
  misc_feature 1..20: note = CRISPR gRNA sequence
  source 1..20: mol_type = other DNA
gttaacacatttataactga

SEQ ID NO: 94532 - DNA, 20 bp, synthetic construct
  misc_feature 1..20: note = CRISPR gRNA sequence
  source 1..20: mol_type = other DNA
ttaacacatttataactgat

SEQ ID NO: 94533 - DNA, 20 bp, synthetic construct
  misc_feature 1..20: note = CRISPR gRNA sequence
  source 1..20: mol_type = other DNA
acacatttataactgattta

SEQ ID NO: 94534 - DNA, 20 bp, synthetic construct
  misc_feature 1..20: note = CRISPR gRNA sequence
  source 1..20: mol_type = other DNA
ataactgatttacaaacaga

SEQ ID NO: 94535 - DNA, 20 bp, synthetic construct
  misc_feature 1..20: note = CRISPR gRNA sequence
  source 1..20: mol_type = other DNA
taactgatttacaaacagat

SEQ ID NO: 94536 - DNA, 20 bp, synthetic construct
  misc_feature 1..20: note = CRISPR gRNA sequence
  source 1..20: mol_type = other DNA
atttacaaacagatatttac

SEQ ID NO: 94537 - DNA, 20 bp, synthetic construct
  misc_feature 1..20: note = CRISPR gRNA sequence
  source 1..20: mol_type = other DNA
acaaacagatatttaccagt

SEQ ID NO: 94538 - DNA, 20 bp, synthetic construct
  misc_feature 1..20: note = CRISPR gRNA sequence
  source 1..20: mol_type = other DNA
caaacagatatttaccagtc

SEQ ID NO: 94539 - DNA, 20 bp, synthetic construct
  misc_feature 1..20: note = CRISPR gRNA sequence
  source 1..20: mol_type = other DNA
accagtcttttttgatttaa

SEQ ID NO: 94540 - DNA, 20 bp, synthetic construct
  misc_feature 1..20: note = CRISPR gRNA sequence
  source 1..20: mol_type = other DNA
ccagtcttttttgatttaac

SEQ ID NO: 94541 - DNA, 20 bp, synthetic construct
  misc_feature 1..20: note = CRISPR gRNA sequence
  source 1..20: mol_type = other DNA
ttttgatttaacacttgttc

SEQ ID NO: 94542 - DNA, 20 bp, synthetic construct
  misc_feature 1..20: note = CRISPR gRNA sequence
  source 1..20: mol_type = other DNA
tttgatttaacacttgttct

SEQ ID NO: 94543 - DNA, 20 bp, synthetic construct
  misc_feature 1..20: note = CRISPR gRNA sequence
  source 1..20: mol_type = other DNA
ttgatttaacacttgttcta

SEQ ID NO: 94544 - DNA, 20 bp, synthetic construct
  misc_feature 1..20: note = CRISPR gRNA sequence
  source 1..20: mol_type = other DNA
tgatttaacacttgttctaa

SEQ ID NO: 94545 - DNA, 20 bp, synthetic construct
  misc_feature 1..20: note = CRISPR gRNA sequence
  source 1..20: mol_type = other DNA
gatttaacacttgttctaaa

SEQ ID NO: 94546 - DNA, 20 bp, synthetic construct
  misc_feature 1..20: note = CRISPR gRNA sequence
  source 1..20: mol_type = other DNA
atttaacacttgttctaaaa

SEQ ID NO: 94547 - DNA, 20 bp, synthetic construct
  misc_feature 1..20: note = CRISPR gRNA sequence
  source 1..20: mol_type = other DNA
aacacttgttctaaaagagt

SEQ ID NO: 94548 - DNA, 20 bp, synthetic construct
  misc_feature 1..20: note = CRISPR gRNA sequence
  source 1..20: mol_type = other DNA
acacttgttctaaaagagta

SEQ ID NO: 94549 - DNA, 20 bp, synthetic construct
  misc_feature 1..20: note = CRISPR gRNA sequence
  source 1..20: mol_type = other DNA
gttctaaaagagtaggtctt

SEQ ID NO: 94550 - DNA, 20 bp, synthetic construct
  misc_feature 1..20: note = CRISPR gRNA sequence
  source 1..20: mol_type = other DNA
ttctaaaagagtaggtcttg

SEQ ID NO: 94551 - DNA, 20 bp, synthetic construct
  misc_feature 1..20: note = CRISPR gRNA sequence
  source 1..20: mol_type = other DNA
taaaagagtaggtcttgcag

SEQ ID NO: 94552 - DNA, 20 bp, synthetic construct
  misc_feature 1..20: note = CRISPR gRNA sequence
  source 1..20: mol_type = other DNA
aaagagtaggtcttgcagga

SEQ ID NO: 94553 - DNA, 20 bp, synthetic construct
  misc_feature 1..20: note = CRISPR gRNA sequence
  source 1..20: mol_type = other DNA
gcaggacgatccccaaaaga

SEQ ID NO: 94554 - DNA, 20 bp, synthetic construct
  misc_feature 1..20: note = CRISPR gRNA sequence
  source 1..20: mol_type = other DNA
caggacgatccccaaaagat

SEQ ID NO: 94555 - DNA, 20 bp, synthetic construct
  misc_feature 1..20: note = CRISPR gRNA sequence
  source 1..20: mol_type = other DNA
ttctttgtttaacaatggag

SEQ ID NO: 94556 - DNA, 20 bp, synthetic construct
  misc_feature 1..20: note = CRISPR gRNA sequence
  source 1..20: mol_type = other DNA
tttgtttaacaatggagagt

SEQ ID NO: 94557 - DNA, 20 bp, synthetic construct
  misc_feature 1..20: note = CRISPR gRNA sequence
  source 1..20: mol_type = other DNA
tgtttaacaatggagagtat

SEQ ID NO: 94558 - DNA, 20 bp, synthetic construct
  misc_feature 1..20: note = CRISPR gRNA sequence
  source 1..20: mol_type = other DNA
gtttaacaatggagagtatg

SEQ ID NO: 94559 - DNA, 20 bp, synthetic construct
  misc_feature 1..20: note = CRISPR gRNA sequence
  source 1..20: mol_type = other DNA
tttaacaatggagagtatgt

SEQ ID NO: 94560 - DNA, 20 bp, synthetic construct
  misc_feature 1..20: note = CRISPR gRNA sequence
  source 1..20: mol_type = other DNA
aacaatggagagtatgttat

SEQ ID NO: 94561 - DNA, 20 bp, synthetic construct
  misc_feature 1..20: note = CRISPR gRNA sequence
  source 1..20: mol_type = other DNA
acaatggagagtatgttatc

SEQ ID NO: 94562 - DNA, 20 bp, synthetic construct
  misc_feature 1..20: note = CRISPR gRNA sequence
  source 1..20: mol_type = other DNA
tctgcactttcctgggataa

SEQ ID NO: 94563 - DNA, 20 bp, synthetic construct
  misc_feature 1..20: note = CRISPR gRNA sequence
  source 1..20: mol_type = other DNA
cactttcctgggataaatga

SEQ ID NO: 94564 - DNA, 20 bp, synthetic construct
  misc_feature 1..20: note = CRISPR gRNA sequence
  source 1..20: mol_type = other DNA
tcctgggataaatgataaaa

SEQ ID NO: 94565 - DNA, 20 bp, synthetic construct
  misc_feature 1..20: note = CRISPR gRNA sequence
  source 1..20: mol_type = other DNA
cctgggataaatgataaaaa

SEQ ID NO: 94566 - DNA, 20 bp, synthetic construct
  misc_feature 1..20: note = CRISPR gRNA sequence
  source 1..20: mol_type = other DNA
ctgggataaatgataaaaat

SEQ ID NO: 94567 - DNA, 20 bp, synthetic construct
  misc_feature 1..20: note = CRISPR gRNA sequence
  source 1..20: mol_type = other DNA
ggataaatgataaaaatgca

SEQ ID NO: 94568 - DNA, 20 bp, synthetic construct
  misc_feature 1..20: note = CRISPR gRNA sequence
  source 1..20: mol_type = other DNA
acgtaataagtcatgattac

SEQ ID NO: 94569 - DNA, 20 bp, synthetic construct
  misc_feature 1..20: note = CRISPR gRNA sequence
  source 1..20: mol_type = other DNA
caggtatttcaaagatgtaa

SEQ ID NO: 94570 - DNA, 20 bp, synthetic construct
  misc_feature 1..20: note = CRISPR gRNA sequence
  source 1..20: mol_type = other DNA
caaagatgtaatgaacaggt

SEQ ID NO: 94571 - DNA, 20 bp, synthetic construct
  misc_feature 1..20: note = CRISPR gRNA sequence
  source 1..20: mol_type = other DNA
aaagatgtaatgaacaggtc

SEQ ID NO: 94572 - DNA, 20 bp, synthetic construct
  misc_feature 1..20: note = CRISPR gRNA sequence
  source 1..20: mol_type = other DNA
tgcatttcttccttcttctt

SEQ ID NO: 94573 - DNA, 20 bp, synthetic construct
  misc_feature 1..20: note = CRISPR gRNA sequence
  source 1..20: mol_type = other DNA
gcatttcttccttcttcttg

SEQ ID NO: 94574 - DNA, 20 bp, synthetic construct
  misc_feature 1..20: note = CRISPR gRNA sequence
  source 1..20: mol_type = other DNA
catttcttccttcttcttgc

SEQ ID NO: 94575 - DNA, 20 bp, synthetic construct
  misc_feature 1..20: note = CRISPR gRNA sequence
  source 1..20: mol_type = other DNA
cttccttcttcttgcccagt

SEQ ID NO: 94576 - DNA, 20 bp, synthetic construct
  misc_feature 1..20: note = CRISPR gRNA sequence
  source 1..20: mol_type = other DNA
ttccttcttcttgcccagtc

SEQ ID NO: 94577 - DNA, 20 bp, synthetic construct
  misc_feature 1..20: note = CRISPR gRNA sequence
  source 1..20: mol_type = other DNA
ccttcttcttgcccagtctc

SEQ ID NO: 94578 - DNA, 20 bp, synthetic construct
  misc_feature 1..20: note = CRISPR gRNA sequence
  source 1..20: mol_type = other DNA
cttcttcttgcccagtctct

SEQ ID NO: 94579 - DNA, 20 bp, synthetic construct
  misc_feature 1..20: note = CRISPR gRNA sequence
  source 1..20: mol_type = other DNA
cttcttgcccagtctctggg

SEQ ID NO: 94580 - DNA, 20 bp, synthetic construct
  misc_feature 1..20: note = CRISPR gRNA sequence
  source 1..20: mol_type = other DNA
ttcttgcccagtctctgggc

SEQ ID NO: 94581 - DNA, 20 bp, synthetic construct
  misc_feature 1..20: note = CRISPR gRNA sequence
  source 1..20: mol_type = other DNA
cttgcccagtctctgggcaa

SEQ ID NO: 94582 - DNA, 20 bp, synthetic construct
  misc_feature 1..20: note = CRISPR gRNA sequence
  source 1..20: mol_type = other DNA
ttgcccagtctctgggcaac

SEQ ID NO: 94583 - DNA, 20 bp, synthetic construct
  misc_feature 1..20: note = CRISPR gRNA sequence
  source 1..20: mol_type = other DNA
gcccagtctctgggcaactc

SEQ ID NO: 94584 - DNA, 20 bp, synthetic construct
  misc_feature 1..20: note = CRISPR gRNA sequence
  source 1..20: mol_type = other DNA
cccagtctctgggcaactct

SEQ ID NO: 94585 - DNA, 20 bp, synthetic construct
  misc_feature 1..20: note = CRISPR gRNA sequence
  source 1..20: mol_type = other DNA
tgggcaactctgggaaagtt

SEQ ID NO: 94586 - DNA, 20 bp, synthetic construct
  misc_feature 1..20: note = CRISPR gRNA sequence
  source 1..20: mol_type = other DNA
ggcaactctgggaaagttct

SEQ ID NO: 94587 - DNA, 20 bp, synthetic construct
  misc_feature 1..20: note = CRISPR gRNA sequence
  source 1..20: mol_type = other DNA
tgggaaagttcttcattatc

SEQ ID NO: 94588 - DNA, 20 bp, synthetic construct
  misc_feature 1..20: note = CRISPR gRNA sequence
  source 1..20: mol_type = other DNA
ggaaagttcttcattatcat

SEQ ID NO: 94589 - DNA, 20 bp, synthetic construct
  misc_feature 1..20: note = CRISPR gRNA sequence
  source 1..20: mol_type = other DNA
ttcattatcataggcaaagt

SEQ ID NO: 94590 - DNA, 20 bp, synthetic construct
  misc_feature 1..20: note = CRISPR gRNA sequence
  source 1..20: mol_type = other DNA
cattatcataggcaaagtat

SEQ ID NO: 94591 - DNA, 20 bp, synthetic construct
  misc_feature 1..20: note = CRISPR gRNA sequence
  source 1..20: mol_type = other DNA
attatcataggcaaagtatt

SEQ ID NO: 94592 - DNA, 20 bp, synthetic construct
  misc_feature 1..20: note = CRISPR gRNA sequence
  source 1..20: mol_type = other DNA
tcataggcaaagtattggca

SEQ ID NO: 94593 - DNA, 20 bp, synthetic construct
  misc_feature 1..20: note = CRISPR gRNA sequence
  source 1..20: mol_type = other DNA
gcagttaatttaatgtaaca

SEQ ID NO: 94594 - DNA, 20 bp, synthetic construct
  misc_feature 1..20: note = CRISPR gRNA sequence
  source 1..20: mol_type = other DNA
atttaatgtaacattcctcc

SEQ ID NO: 94595 - DNA, 20 bp, synthetic construct
  misc_feature 1..20: note = CRISPR gRNA sequence
  source 1..20: mol_type = other DNA
aatgtaacattcctcctcgc

SEQ ID NO: 94596 - DNA, 20 bp, synthetic construct
  misc_feature 1..20: note = CRISPR gRNA sequence
  source 1..20: mol_type = other DNA
atgtaacattcctcctcgct

SEQ ID NO: 94597 - DNA, 20 bp, synthetic construct
  misc_feature 1..20: note = CRISPR gRNA sequence
  source 1..20: mol_type = other DNA
ctcctcgctccctctccccc

SEQ ID NO: 94598 - DNA, 20 bp, synthetic construct
  misc_feature 1..20: note = CRISPR gRNA sequence
  source 1..20: mol_type = other DNA
ctcgctccctctccccccag

SEQ ID NO: 94599 - DNA, 20 bp, synthetic construct
  misc_feature 1..20: note = CRISPR gRNA sequence
  source 1..20: mol_type = other DNA
gctccctctccccccagatt

SEQ ID NO: 94600 - DNA, 20 bp, synthetic construct
  misc_feature 1..20: note = CRISPR gRNA sequence
  source 1..20: mol_type = other DNA
cctctccccccagattttca

SEQ ID NO: 94601 - DNA, 20 bp, synthetic construct
  misc_feature 1..20: note = CRISPR gRNA sequence
  source 1..20: mol_type = other DNA
tccccccagattttcaacct

SEQ ID NO: 94602 - DNA, 20 bp, synthetic construct
  misc_feature 1..20: note = CRISPR gRNA sequence
  source 1..20: mol_type = other DNA
cccccagattttcaacctgg

SEQ ID NO: 94603 - DNA, 20 bp, synthetic construct
  misc_feature 1..20: note = CRISPR gRNA sequence
  source 1..20: mol_type = other DNA
tcaacctgggttctttagtc

SEQ ID NO: 94604 - DNA, 20 bp, synthetic construct
  misc_feature 1..20: note = CRISPR gRNA sequence
  source 1..20: mol_type = other DNA
caacctgggttctttagtct

SEQ ID NO: 94605 - DNA, 20 bp, synthetic construct
  misc_feature 1..20: note = CRISPR gRNA sequence
  source 1..20: mol_type = other DNA
aacctgggttctttagtctc

SEQ ID NO: 94606 - DNA, 20 bp, synthetic construct
  misc_feature 1..20: note = CRISPR gRNA sequence
  source 1..20: mol_type = other DNA
ggttctttagtctcttggca

SEQ ID NO: 94607 - DNA, 20 bp, synthetic construct
  misc_feature 1..20: note = CRISPR gRNA sequence
  source 1..20: mol_type = other DNA
tttagtctcttggcaggtct

SEQ ID NO: 94608 - DNA, 20 bp, synthetic construct
  misc_feature 1..20: note = CRISPR gRNA sequence
  source 1..20: mol_type = other DNA
tagtctcttggcaggtctca

SEQ ID NO: 94609 - DNA, 20 bp, synthetic construct
  misc_feature 1..20: note = CRISPR gRNA sequence
  source 1..20: mol_type = other DNA
agtctcttggcaggtctcaa

SEQ ID NO: 94610 - DNA, 20 bp, synthetic construct
  misc_feature 1..20: note = CRISPR gRNA sequence
  source 1..20: mol_type = other DNA
gtctcttggcaggtctcaaa

SEQ ID NO: 94611 - DNA, 20 bp, synthetic construct
  misc_feature 1..20: note = CRISPR gRNA sequence
  source 1..20: mol_type = other DNA
ttggcaggtctcaaaattaa

SEQ ID NO: 94612 - DNA, 20 bp, synthetic construct
  misc_feature 1..20: note = CRISPR gRNA sequence
  source 1..20: mol_type = other DNA
ggcaggtctcaaaattaata

SEQ ID NO: 94613 - DNA, 20 bp, synthetic construct
  misc_feature 1..20: note = CRISPR gRNA sequence
  source 1..20: mol_type = other DNA
gcaggtctcaaaattaatag

SEQ ID NO: 94614 - DNA, 20 bp, synthetic construct
  misc_feature 1..20: note = CRISPR gRNA sequence
  source 1..20: mol_type = other DNA
aaaattaatagtgtgtgtga

SEQ ID NO: 94615 - DNA, 20 bp, synthetic construct
  misc_feature 1..20: note = CRISPR gRNA sequence
  source 1..20: mol_type = other DNA
atagtgtgtgtgatagagtg

SEQ ID NO: 94616 - DNA, 20 bp, synthetic construct
  misc_feature 1..20: note = CRISPR gRNA sequence
  source 1..20: mol_type = other DNA
tgagaggtgggccactaaga

SEQ ID NO: 94617 - DNA, 20 bp, synthetic construct
  misc_feature 1..20: note = CRISPR gRNA sequence
  source 1..20: mol_type = other DNA
agattgaggcagagttactt

SEQ ID NO: 94618 - DNA, 20 bp, synthetic construct
  misc_feature 1..20: note = CRISPR gRNA sequence
  source 1..20: mol_type = other DNA
aggcagagttacttgtgagc

SEQ ID NO: 94619 - DNA, 20 bp, synthetic construct
  misc_feature 1..20: note = CRISPR gRNA sequence
  source 1..20: mol_type = other DNA
cttgtgagctattttcaata

SEQ ID NO: 94620 - DNA, 20 bp, synthetic construct
  misc_feature 1..20: note = CRISPR gRNA sequence
  source 1..20: mol_type = other DNA
gtgagctattttcaatatta

SEQ ID NO: 94621 - DNA, 20 bp, synthetic construct
  misc_feature 1..20: note = CRISPR gRNA sequence
  source 1..20: mol_type = other DNA
tgagctattttcaatattac

SEQ ID NO: 94622 - DNA, 20 bp, synthetic construct
  misc_feature 1..20: note = CRISPR gRNA sequence
  source 1..20: mol_type = other DNA
ttttcaatattacaaaaaat

SEQ ID NO: 94623 - DNA, 20 bp, synthetic construct
  misc_feature 1..20: note = CRISPR gRNA sequence
  source 1..20: mol_type = other DNA
tcaatattacaaaaaatgcc

SEQ ID NO: 94624 - DNA, 20 bp, synthetic construct
  misc_feature 1..20: note = CRISPR gRNA sequence
  source 1..20: mol_type = other DNA
caatattacaaaaaatgcca

SEQ ID NO: 94625 - DNA, 20 bp, synthetic construct
  misc_feature 1..20: note = CRISPR gRNA sequence
  source 1..20: mol_type = other DNA
aatattacaaaaaatgccaa

SEQ ID NO: 94626 - DNA, 20 bp, synthetic construct
  misc_feature 1..20: note = CRISPR gRNA sequence
  source 1..20: mol_type = other DNA
caaaaaatgccaagtggaat

SEQ ID NO: 94627 - DNA, 20 bp, synthetic construct
  misc_feature 1..20: note = CRISPR gRNA sequence
  source 1..20: mol_type = other DNA
accattctctttatataatg

SEQ ID NO: 94628 - DNA, 20 bp, synthetic construct
  misc_feature 1..20: note = CRISPR gRNA sequence
  source 1..20: mol_type = other DNA
tctttatataatgctatcca

SEQ ID NO: 94629 - DNA, 20 bp, synthetic construct
  misc_feature 1..20: note = CRISPR gRNA sequence
  source 1..20: mol_type = other DNA
tttatataatgctatccagg

SEQ ID NO: 94630 - DNA, 20 bp, synthetic construct
  misc_feature 1..20: note = CRISPR gRNA sequence
  source 1..20: mol_type = other DNA
tatataatgctatccaggcc

SEQ ID NO: 94631 - DNA, 20 bp, synthetic construct
  misc_feature 1..20: note = CRISPR gRNA sequence
  source 1..20: mol_type = other DNA
atataatgctatccaggccg

SEQ ID NO: 94632 - DNA, 20 bp, synthetic construct
  misc_feature 1..20: note = CRISPR gRNA sequence
  source 1..20: mol_type = other DNA
tataatgctatccaggccga

SEQ ID NO: 94633 - DNA, 20 bp, synthetic construct
  misc_feature 1..20: note = CRISPR gRNA sequence
  source 1..20: mol_type = other DNA
tccaggccgaaacataatct

SEQ ID NO: 94634 - DNA, 20 bp, synthetic construct
  misc_feature 1..20: note = CRISPR gRNA sequence
  source 1..20: mol_type = other DNA
cttgcctttggatgaaatat

SEQ ID NO: 94635 - DNA, 20 bp, synthetic construct
  misc_feature 1..20: note = CRISPR gRNA sequence
  source 1..20: mol_type = other DNA
gcctttggatgaaatatatg

SEQ ID NO: 94636 - DNA, 20 bp, synthetic construct
  misc_feature 1..20: note = CRISPR gRNA sequence
  source 1..20: mol_type = other DNA
cctttggatgaaatatatga

SEQ ID NO: 94637 - DNA, 20 bp, synthetic construct
  misc_feature 1..20: note = CRISPR gRNA sequence
  source 1..20: mol_type = other DNA
tggatgaaatatatgaactc

SEQ ID NO: 94638 - DNA, 20 bp, synthetic construct
  misc_feature 1..20: note = CRISPR gRNA sequence
  source 1..20: mol_type = other DNA
ggatgaaatatatgaactca

SEQ ID NO: 94639 - DNA, 20 bp, synthetic construct
  misc_feature 1..20: note = CRISPR gRNA sequence
  source 1..20: mol_type = other DNA
gatgaaatatatgaactcag

SEQ ID NO: 94640 - DNA, 20 bp, synthetic construct
  misc_feature 1..20: note = CRISPR gRNA sequence
  source 1..20: mol_type = other DNA
agaggcaaattatatactgc

SEQ ID NO: 94641 - DNA, 20 bp, synthetic construct
  misc_feature 1..20: note = CRISPR gRNA sequence
  source 1..20: mol_type = other DNA
tatactgctcaataagatat

SEQ ID NO: 94642 - DNA, 20 bp, synthetic construct
  misc_feature 1..20: note = CRISPR gRNA sequence
  source 1..20: mol_type = other DNA
ctcaataagatatctgatag

SEQ ID NO: 94643 - DNA, 20 bp, synthetic construct
  misc_feature 1..20: note = CRISPR gRNA sequence
  source 1..20: mol_type = other DNA
aataagatatctgatagctt

SEQ ID NO: 94644 - DNA, 20 bp, synthetic construct
  misc_feature 1..20: note = CRISPR gRNA sequence
  source 1..20: mol_type = other DNA
atagctttttacccagttgg

SEQ ID NO: 94645 - DNA, 20 bp, synthetic construct
  misc_feature 1..20: note = CRISPR gRNA sequence
  source 1..20: mol_type = other DNA
tttacccagttggcaaccaa

SEQ ID NO: 94646 - DNA, 20 bp, synthetic construct
  misc_feature 1..20: note = CRISPR gRNA sequence
  source 1..20: mol_type = other DNA
ttacccagttggcaaccaaa

SEQ ID NO: 94647 - DNA, 20 bp, synthetic construct
  misc_feature 1..20: note = CRISPR gRNA sequence
  source 1..20: mol_type = other DNA
tacccagttggcaaccaaaa

SEQ ID NO: 94648 - DNA, 20 bp, synthetic construct
  misc_feature 1..20: note = CRISPR gRNA sequence
  source 1..20: mol_type = other DNA
acccagttggcaaccaaaac

SEQ ID NO: 94649 - DNA, 20 bp, synthetic construct
  misc_feature 1..20: note = CRISPR gRNA sequence
  source 1..20: mol_type = other DNA
cccagttggcaaccaaaaca

SEQ ID NO: 94650 - DNA, 20 bp, synthetic construct
  misc_feature 1..20: note = CRISPR gRNA sequence
  source 1..20: mol_type = other DNA
gcaaccaaaacaaatggggg

SEQ ID NO: 94651 - DNA, 20 bp, synthetic construct
  misc_feature 1..20: note = CRISPR gRNA sequence
  source 1..20: mol_type = other DNA
tttaaagaagcaactgataa

SEQ ID NO: 94652 - DNA, 20 bp, synthetic construct
  misc_feature 1..20: note = CRISPR gRNA sequence
  source 1..20: mol_type = other DNA
aaagaagcaactgataacca

SEQ ID NO: 94653 - DNA, 20 bp, synthetic construct
  misc_feature 1..20: note = CRISPR gRNA sequence
  source 1..20: mol_type = other DNA
aagaagcaactgataaccaa

SEQ ID NO: 94654 - DNA, 20 bp, synthetic construct
  misc_feature 1..20: note = CRISPR gRNA sequence
  source 1..20: mol_type = other DNA
ataaccaaagctttcaaaat

SEQ ID NO: 94655 - DNA, 20 bp, synthetic construct
  misc_feature 1..20: note = CRISPR gRNA sequence
  source 1..20: mol_type = other DNA
tcaaaatttagataaacttg

SEQ ID NO: 94656 - DNA, 20 bp, synthetic construct
  misc_feature 1..20: note = CRISPR gRNA sequence
  source 1..20: mol_type = other DNA
caaaatttagataaacttgc

SEQ ID NO: 94657 - DNA, 20 bp, synthetic construct
  misc_feature 1..20: note = CRISPR gRNA sequence
  source 1..20: mol_type = other DNA
aaaatttagataaacttgct

SEQ ID NO: 94658 - DNA, 20 bp, synthetic construct
  misc_feature 1..20: note = CRISPR gRNA sequence
  source 1..20: mol_type = other DNA
agataaacttgcttgaaaaa

SEQ ID NO: 94659 - DNA, 20 bp, synthetic construct
  misc_feature 1..20: note = CRISPR gRNA sequence
  source 1..20: mol_type = other DNA
gataaacttgcttgaaaaag

SEQ ID NO: 94660 - DNA, 20 bp, synthetic construct
  misc_feature 1..20: note = CRISPR gRNA sequence
  source 1..20: mol_type = other DNA
gcttgaaaaagcactagtat

SEQ ID NO: 94661 - DNA, 20 bp, synthetic construct
  misc_feature 1..20: note = CRISPR gRNA sequence
  source 1..20: mol_type = other DNA
cttgaaaaagcactagtata

SEQ ID NO: 94662 - DNA, 20 bp, synthetic construct
  misc_feature 1..20: note = CRISPR gRNA sequence
  source 1..20: mol_type = other DNA
gaaaaagcactagtataaat

SEQ ID NO: 94663 - DNA, 20 bp, synthetic construct
  misc_feature 1..20: note = CRISPR gRNA sequence
  source 1..20: mol_type = other DNA
aaaaagcactagtataaata

SEQ ID NO: 94664 - DNA, 20 bp, synthetic construct
  misc_feature 1..20: note = CRISPR gRNA sequence
  source 1..20: mol_type = other DNA
gtataaatagtctcctgcca

SEQ ID NO: 94665 - DNA, 20 bp, synthetic construct
  misc_feature 1..20: note = CRISPR gRNA sequence
  source 1..20: mol_type = other DNA
ctgccaactgtatgaacaaa

SEQ ID NO: 94666 - DNA, 20 bp, synthetic construct
  misc_feature 1..20: note = CRISPR gRNA sequence
  source 1..20: mol_type = other DNA
ccaactgtatgaacaaaaca

SEQ ID NO: 94667 - DNA, 20 bp, synthetic construct
  misc_feature 1..20: note = CRISPR gRNA sequence
  source 1..20: mol_type = other DNA
tatgaacaaaacaggtaagt

SEQ ID NO: 94668 - DNA, 20 bp, synthetic construct
  misc_feature 1..20: note = CRISPR gRNA sequence
  source 1..20: mol_type = other DNA
aaatgataccattaccctga

SEQ ID NO: 94669 - DNA, 20 bp, synthetic construct
  misc_feature 1..20: note = CRISPR gRNA sequence
  source 1..20: mol_type = other DNA
ccctgagatttcactgccca

SEQ ID NO: 94670 - DNA, 20 bp, synthetic construct
  misc_feature 1..20: note = CRISPR gRNA sequence
  source 1..20: mol_type = other DNA
agatttcactgcccaaaaac

SEQ ID NO: 94671 - DNA, 20 bp, synthetic construct
  misc_feature 1..20: note = CRISPR gRNA sequence
  source 1..20: mol_type = other DNA
cactgcccaaaaacaaaatc

SEQ ID NO: 94672 - DNA, 20 bp, synthetic construct
  misc_feature 1..20: note = CRISPR gRNA sequence
  source 1..20: mol_type = other DNA
actgcccaaaaacaaaatca

SEQ ID NO: 94673 - DNA, 20 bp, synthetic construct
  misc_feature 1..20: note = CRISPR gRNA sequence
  source 1..20: mol_type = other DNA
cccaaaaacaaaatcagcag

SEQ ID NO: 94674 - DNA, 20 bp, synthetic construct
  misc_feature 1..20: note = CRISPR gRNA sequence
  source 1..20: mol_type = other DNA
attaccaaatatgtaccccc

SEQ ID NO: 94675 - DNA, 20 bp, synthetic construct
  misc_feature 1..20: note = CRISPR gRNA sequence
  source 1..20: mol_type = other DNA
ttaccaaatatgtaccccca

SEQ ID NO: 94676 - DNA, 20 bp, synthetic construct
  misc_feature 1..20: note = CRISPR gRNA sequence
  source 1..20: mol_type = other DNA
ccaaatatgtacccccagtt

SEQ ID NO: 94677 - DNA, 20 bp, synthetic construct
  misc_feature 1..20: note = CRISPR gRNA sequence
  source 1..20: mol_type = other DNA
cctgacagcatcttaaatac

SEQ ID NO: 94678 - DNA, 20 bp, synthetic construct
  misc_feature 1..20: note = CRISPR gRNA sequence
  source 1..20: mol_type = other DNA
acagcatcttaaatacttgt

SEQ ID NO: 94679 - DNA, 20 bp, synthetic construct
  misc_feature 1..20: note = CRISPR gRNA sequence
  source 1..20: mol_type = other DNA
aaatacttgtaattttgctg

SEQ ID NO: 94680 - DNA, 20 bp, synthetic construct
  misc_feature 1..20: note = CRISPR gRNA sequence
  source 1..20: mol_type = other DNA
aatacttgtaattttgctgg

SEQ ID NO: 94681 - DNA, 20 bp, synthetic construct
  misc_feature 1..20: note = CRISPR gRNA sequence
  source 1..20: mol_type = other DNA
gtaattttgctggcataaca

SEQ ID NO: 94682 - DNA, 20 bp, synthetic construct
  misc_feature 1..20: note = CRISPR gRNA sequence
  source 1..20: mol_type = other DNA
taattttgctggcataacaa

SEQ ID NO: 94683 - DNA, 20 bp, synthetic construct
  misc_feature 1..20: note = CRISPR gRNA sequence
  source 1..20: mol_type = other DNA
tgctggcataacaaaatatt

SEQ ID NO: 94684 - DNA, 20 bp, synthetic construct
  misc_feature 1..20: note = CRISPR gRNA sequence
  source 1..20: mol_type = other DNA
gctggcataacaaaatattg

SEQ ID NO: 94685 - DNA, 20 bp, synthetic construct
  misc_feature 1..20: note = CRISPR gRNA sequence
  source 1..20: mol_type = other DNA
ctggcataacaaaatattgt

SEQ ID NO: 94686 - DNA, 20 bp, synthetic construct
  misc_feature 1..20: note = CRISPR gRNA sequence
  source 1..20: mol_type = other DNA
gcataacaaaatattgttta

SEQ ID NO: 94687 - DNA, 20 bp, synthetic construct
  misc_feature 1..20: note = CRISPR gRNA sequence
  source 1..20: mol_type = other DNA
tttagttgactgaaatattc

SEQ ID NO: 94688 - DNA, 20 bp, synthetic construct
  misc_feature 1..20: note = CRISPR gRNA sequence
  source 1..20: mol_type = other DNA
agttgactgaaatattctga

SEQ ID NO: 94689 - DNA, 20 bp, synthetic construct
  misc_feature 1..20: note = CRISPR gRNA sequence
  source 1..20: mol_type = other DNA
gttgactgaaatattctgac

SEQ ID NO: 94690 - DNA, 20 bp, synthetic construct
  misc_feature 1..20: note = CRISPR gRNA sequence
  source 1..20: mol_type = other DNA
actgaaatattctgactctt

SEQ ID NO: 94691 - DNA, 20 bp, synthetic construct
  misc_feature 1..20: note = CRISPR gRNA sequence
  source 1..20: mol_type = other DNA
aaatattctgactcttacaa

SEQ ID NO: 94692 - DNA, 20 bp, synthetic construct
  misc_feature 1..20: note = CRISPR gRNA sequence
  source 1..20: mol_type = other DNA
tgactcttacaaaactatgc

SEQ ID NO: 94693 - DNA, 20 bp, synthetic construct
  misc_feature 1..20: note = CRISPR gRNA sequence
  source 1..20: mol_type = other DNA
actcttacaaaactatgcca

SEQ ID NO: 94694 - DNA, 20 bp, synthetic construct
  misc_feature 1..20: note = CRISPR gRNA sequence
  source 1..20: mol_type = other DNA
ttacaaaactatgccacaat

SEQ ID NO: 94695 - DNA, 20 bp, synthetic construct
  misc_feature 1..20: note = CRISPR gRNA sequence
  source 1..20: mol_type = other DNA
acaaaactatgccacaatac

SEQ ID NO: 94696 - DNA, 20 bp, synthetic construct
  misc_feature 1..20: note = CRISPR gRNA sequence
  source 1..20: mol_type = other DNA
caaaactatgccacaatacc

SEQ ID NO: 94697 - DNA, 20 bp, synthetic construct
  misc_feature 1..20: note = CRISPR gRNA sequence
  source 1..20: mol_type = other DNA
tgccacaataccacatccaa

SEQ ID NO: 94698 - DNA, 20 bp, synthetic construct
  misc_feature 1..20: note = CRISPR gRNA sequence
  source 1..20: mol_type = other DNA
ttactaaagtagcaaatata

SEQ ID NO: 94699 - DNA, 20 bp, synthetic construct
  misc_feature 1..20: note = CRISPR gRNA sequence
  source 1..20: mol_type = other DNA
actaaagtagcaaatataaa

SEQ ID NO: 94700 - DNA, 20 bp, synthetic construct
  misc_feature 1..20: note = CRISPR gRNA sequence
  source 1..20: mol_type = other DNA
ctaaagtagcaaatataaaa

SEQ ID NO: 94701 - DNA, 20 bp, synthetic construct
  misc_feature 1..20: note = CRISPR gRNA sequence
  source 1..20: mol_type = other DNA
aagtagcaaatataaaatta

SEQ ID NO: 94702 - DNA, 20 bp, synthetic construct
  misc_feature 1..20: note = CRISPR gRNA sequence
  source 1..20: mol_type = other DNA
taaatgttttaccggaaagc

SEQ ID NO: 94703 - DNA, 20 bp, synthetic construct
  misc_feature 1..20: note = CRISPR gRNA sequence
  source 1..20: mol_type = other DNA
taccggaaagccatacctta

SEQ ID NO: 94704 - DNA, 20 bp, synthetic construct
  misc_feature 1..20: note = CRISPR gRNA sequence
  source 1..20: mol_type = other DNA
accggaaagccataccttac

SEQ ID NO: 94705 - DNA, 20 bp, synthetic construct
  misc_feature 1..20: note = CRISPR gRNA sequence
  source 1..20: mol_type = other DNA
ccggaaagccataccttaca

SEQ ID NO: 94706 - DNA, 20 bp, synthetic construct
  misc_feature 1..20: note = CRISPR gRNA sequence
  source 1..20: mol_type = other DNA
acatgaatttaacctctttg

SEQ ID NO: 94707 - DNA, 20 bp, synthetic construct
  misc_feature 1..20: note = CRISPR gRNA sequence
  source 1..20: mol_type = other DNA
catgaatttaacctctttgt

SEQ ID NO: 94708 - DNA, 20 bp, synthetic construct
  misc_feature 1..20: note = CRISPR gRNA sequence
  source 1..20: mol_type = other DNA
aacctctttgttctttactt

SEQ ID NO: 94709 - DNA, 20 bp, synthetic construct
  misc_feature 1..20: note = CRISPR gRNA sequence
  source 1..20: mol_type = other DNA
acctctttgttctttactta

SEQ ID NO: 94710 - DNA, 20 bp, synthetic construct
  misc_feature 1..20: note = CRISPR gRNA sequence
  source 1..20: mol_type = other DNA
tttgttctttacttagaata

SEQ ID NO: 94711 - DNA, 20 bp, synthetic construct
  misc_feature 1..20: note = CRISPR gRNA sequence
  source 1..20: mol_type = other DNA
tgttctttacttagaatatt

SEQ ID NO: 94712 - DNA, 20 bp, synthetic construct
  misc_feature 1..20: note = CRISPR gRNA sequence
  source 1..20: mol_type = other DNA
gttctttacttagaatatta

SEQ ID NO: 94713 - DNA, 20 bp, synthetic construct
  misc_feature 1..20: note = CRISPR gRNA sequence
  source 1..20: mol_type = other DNA
ttctttacttagaatattat

SEQ ID NO: 94714 - DNA, 20 bp, synthetic construct
  misc_feature 1..20: note = CRISPR gRNA sequence
  source 1..20: mol_type = other DNA
tttacttagaatattatcta

SEQ ID NO: 94715 - DNA, 20 bp, synthetic construct
  misc_feature 1..20: note = CRISPR gRNA sequence
  source 1..20: mol_type = other DNA
tacttagaatattatctatg

SEQ ID NO: 94716 - DNA, 20 bp, synthetic construct
  misc_feature 1..20: note = CRISPR gRNA sequence
  source 1..20: mol_type = other DNA
acttagaatattatctatgc

SEQ ID NO: 94717 - DNA, 20 bp, synthetic construct
  misc_feature 1..20: note = CRISPR gRNA sequence
  source 1..20: mol_type = other DNA
cttagaatattatctatgct

SEQ ID NO: 94718 - DNA, 20 bp, synthetic construct
  misc_feature 1..20: note = CRISPR gRNA sequence
  source 1..20: mol_type = other DNA
agaatattatctatgctgtt

SEQ ID NO: 94719 - DNA, 20 bp, synthetic construct
  misc_feature 1..20: note = CRISPR gRNA sequence
  source 1..20: mol_type = other DNA
gaatattatctatgctgttt

SEQ ID NO: 94720 - DNA, 20 bp, synthetic construct
  misc_feature 1..20: note = CRISPR gRNA sequence
  source 1..20: mol_type = other DNA
tctatgctgttttttctctt

SEQ ID NO: 94721 - DNA, 20 bp, synthetic construct
  misc_feature 1..20: note = CRISPR gRNA sequence
  source 1..20: mol_type = other DNA
tgctgttttttctcttgggc

SEQ ID NO: 94722 - DNA, 20 bp, synthetic construct
  misc_feature 1..20: note = CRISPR gRNA sequence
  source 1..20: mol_type = other DNA
ttttttctcttgggcttctt

SEQ ID NO: 94723 - DNA, 20 bp, synthetic construct
  misc_feature 1..20: note = CRISPR gRNA sequence
  source 1..20: mol_type = other DNA
tttctcttgggcttctttct

SEQ ID NO: 94724 - DNA, 20 bp, synthetic construct
  misc_feature 1..20: note = CRISPR gRNA sequence
  source 1..20: mol_type = other DNA
ttctcttgggcttctttcta

SEQ ID NO: 94725 - DNA, 20 bp, synthetic construct
  misc_feature 1..20: note = CRISPR gRNA sequence
  source 1..20: mol_type = other DNA
tctcttgggcttctttctac

SEQ ID NO: 94726 - DNA, 20 bp, synthetic construct
  misc_feature 1..20: note = CRISPR gRNA sequence
  source 1..20: mol_type = other DNA
ctcttgggcttctttctact

SEQ ID NO: 94727 - DNA, 20 bp, synthetic construct
  misc_feature 1..20: note = CRISPR gRNA sequence
  source 1..20: mol_type = other DNA
tcttgggcttctttctactg

SEQ ID NO: 94728 - DNA, 20 bp, synthetic construct
  misc_feature 1..20: note = CRISPR gRNA sequence
  source 1..20: mol_type = other DNA
ttgggcttctttctactggc

SEQ ID NO: 94729 - DNA, 20 bp, synthetic construct
  misc_feature 1..20: note = CRISPR gRNA sequence
  source 1..20: mol_type = other DNA
gggcttctttctactggcct

SEQ ID NO: 94730 - DNA, 20 bp, synthetic construct
  misc_feature 1..20: note = CRISPR gRNA sequence
  source 1..20: mol_type = other DNA
ggcttctttctactggcctc

SEQ ID NO: 94731 - DNA, 20 bp, synthetic construct
  misc_feature 1..20: note = CRISPR gRNA sequence
  source 1..20: mol_type = other DNA
ctttctactggcctctgagt

SEQ ID NO: 94732 - DNA, 20 bp, synthetic construct
  misc_feature 1..20: note = CRISPR gRNA sequence
  source 1..20: mol_type = other DNA
tttctactggcctctgagtt

SEQ ID NO: 94733 - DNA, 20 bp, synthetic construct
  misc_feature 1..20: note = CRISPR gRNA sequence
  source 1..20: mol_type = other DNA
tctactggcctctgagttat

SEQ ID NO: 94734 - DNA, 20 bp, synthetic construct
  misc_feature 1..20: note = CRISPR gRNA sequence
  source 1..20: mol_type = other DNA
ctactggcctctgagttatc

SEQ ID NO: 94735 - DNA, 20 bp, synthetic construct
  misc_feature 1..20: note = CRISPR gRNA sequence
  source 1..20: mol_type = other DNA
tactggcctctgagttatct

SEQ ID NO: 94736 - DNA, 20 bp, synthetic construct
  misc_feature 1..20: note = CRISPR gRNA sequence
  source 1..20: mol_type = other DNA
ctggcctctgagttatctat

SEQ ID NO: 94737 - DNA, 20 bp, synthetic construct
  misc_feature 1..20: note = CRISPR gRNA sequence
  source 1..20: mol_type = other DNA
gcctctgagttatctatgag

SEQ ID NO: 94738 - DNA, 20 bp, synthetic construct
  misc_feature 1..20: note = CRISPR gRNA sequence
  source 1..20: mol_type = other DNA
tgagttatctatgagaatat

SEQ ID NO: 94739 - DNA, 20 bp, synthetic construct
  misc_feature 1..20: note = CRISPR gRNA sequence
  source 1..20: mol_type = other DNA
agttatctatgagaatatcc

SEQ ID NO: 94740 - DNA, 20 bp, synthetic construct
  misc_feature 1..20: note = CRISPR gRNA sequence
  source 1..20: mol_type = other DNA
tctatgagaatatcccctta

SEQ ID NO: 94741 - DNA, 20 bp, synthetic construct
  misc_feature 1..20: note = CRISPR gRNA sequence
  source 1..20: mol_type = other DNA
tgagaatatccccttaattt

SEQ ID NO: 94742 - DNA, 20 bp, synthetic construct
  misc_feature 1..20: note = CRISPR gRNA sequence
  source 1..20: mol_type = other DNA
aatttctttcattatgagaa

SEQ ID NO: 94743 - DNA, 20 bp, synthetic construct
  misc_feature 1..20: note = CRISPR gRNA sequence
  source 1..20: mol_type = other DNA
atttctttcattatgagaag

SEQ ID NO: 94744 - DNA, 20 bp, synthetic construct
  misc_feature 1..20: note = CRISPR gRNA sequence
  source 1..20: mol_type = other DNA
ctttcattatgagaagttta

SEQ ID NO: 94745 - DNA, 20 bp, synthetic construct
  misc_feature 1..20: note = CRISPR gRNA sequence
  source 1..20: mol_type = other DNA
tttcattatgagaagtttac

SEQ ID NO: 94746 - DNA, 20 bp, synthetic construct
  misc_feature 1..20: note = CRISPR gRNA sequence
  source 1..20: mol_type = other DNA
tcattatgagaagtttacca

SEQ ID NO: 94747 - DNA, 20 bp, synthetic construct
  misc_feature 1..20: note = CRISPR gRNA sequence
  source 1..20: mol_type = other DNA
cattatgagaagtttaccaa

SEQ ID NO: 94748 - DNA, 20 bp, synthetic construct
  misc_feature 1..20: note = CRISPR gRNA sequence
  source 1..20: mol_type = other DNA
attatgagaagtttaccaac

SEQ ID NO: 94749 - DNA, 20 bp, synthetic construct
  misc_feature 1..20: note = CRISPR gRNA sequence
  source 1..20: mol_type = other DNA
tgagaagtttaccaacctga

SEQ ID NO: 94750 - DNA, 20 bp, synthetic construct
  misc_feature 1..20: note = CRISPR gRNA sequence
  source 1..20: mol_type = other DNA
accaacctgatattacaaaa

SEQ ID NO: 94751 - DNA, 20 bp, synthetic construct
  misc_feature 1..20: note = CRISPR gRNA sequence
  source 1..20: mol_type = other DNA
ccaacctgatattacaaaaa

SEQ ID NO: 94752 - DNA, 20 bp, synthetic construct
  misc_feature 1..20: note = CRISPR gRNA sequence
  source 1..20: mol_type = other DNA
atattacaaaaatatttcac

SEQ ID NO: 94753 - DNA, 20 bp, synthetic construct
  misc_feature 1..20: note = CRISPR gRNA sequence
  source 1..20: mol_type = other DNA
caaaaatatttcacccctaa

SEQ ID NO: 94754 - DNA, 20 bp, synthetic construct
  misc_feature 1..20: note = CRISPR gRNA sequence
  source 1..20: mol_type = other DNA
cacccctaaacattttaggc

SEQ ID NO: 94755 - DNA, 20 bp, synthetic construct
  misc_feature 1..20: note = CRISPR gRNA sequence
  source 1..20: mol_type = other DNA
acccctaaacattttaggcc

SEQ ID NO: 94756 - DNA, 20 bp, synthetic construct
  misc_feature 1..20: note = CRISPR gRNA sequence
  source 1..20: mol_type = other DNA
aacattttaggcctcaacat

SEQ ID NO: 94757 - DNA, 20 bp, synthetic construct
  misc_feature 1..20: note = CRISPR gRNA sequence
  source 1..20: mol_type = other DNA
taggcctcaacatataaaaa

SEQ ID NO: 94758 - DNA, 20 bp, synthetic construct
  misc_feature 1..20: note = CRISPR gRNA sequence
  source 1..20: mol_type = other DNA
aggcctcaacatataaaaac

SEQ ID NO: 94759 - DNA, 20 bp, synthetic construct
  misc_feature 1..20: note = CRISPR gRNA sequence
  source 1..20: mol_type = other DNA
ggcctcaacatataaaaact

SEQ ID NO: 94760 - DNA, 20 bp, synthetic construct
  misc_feature 1..20: note = CRISPR gRNA sequence
  source 1..20: mol_type = other DNA
aacatataaaaactgtaaaa

SEQ ID NO: 94761 - DNA, 20 bp, synthetic construct
  misc_feature 1..20: note = CRISPR gRNA sequence
  source 1..20: mol_type = other DNA
taaaaagaaaattctaatac

SEQ ID NO: 94762 - DNA, 20 bp, synthetic construct
  misc_feature 1..20: note = CRISPR gRNA sequence
  source 1..20: mol_type = other DNA
taatacccagaggaaacaaa

SEQ ID NO: 94763 - DNA, 20 bp, synthetic construct
  misc_feature 1..20: note = CRISPR gRNA sequence
  source 1..20: mol_type = other DNA
atacccagaggaaacaaaaa

SEQ ID NO: 94764 - DNA, 20 bp, synthetic construct
  misc_feature 1..20: note = CRISPR gRNA sequence
  source 1..20: mol_type = other DNA
cttcctcctccagcaacccc

SEQ ID NO: 94765 - DNA, 20 bp, synthetic construct
  misc_feature 1..20: note = CRISPR gRNA sequence
  source 1..20: mol_type = other DNA
ttcctcctccagcaaccccc

SEQ ID NO: 94766 - DNA, 20 bp, synthetic construct
  misc_feature 1..20: note = CRISPR gRNA sequence
  source 1..20: mol_type = other DNA
cctcctccagcaacccccaa

SEQ ID NO: 94767 - DNA, 20 bp, synthetic construct
  misc_feature 1..20: note = CRISPR gRNA sequence
  source 1..20: mol_type = other DNA
ctcctccagcaacccccaag

SEQ ID NO: 94768 - DNA, 20 bp, synthetic construct
  misc_feature 1..20: note = CRISPR gRNA sequence
  source 1..20: mol_type = other DNA
ctccagcaacccccaagttg

SEQ ID NO: 94769 - DNA, 20 bp, synthetic construct
  misc_feature 1..20: note = CRISPR gRNA sequence
  source 1..20: mol_type = other DNA
cagcaacccccaagttgatt

SEQ ID NO: 94770 - DNA, 20 bp, synthetic construct
  misc_feature 1..20: note = CRISPR gRNA sequence
  source 1..20: mol_type = other DNA
attttatttatgagattctt

SEQ ID NO: 94771 - DNA, 20 bp, synthetic construct
  misc_feature 1..20: note = CRISPR gRNA sequence
  source 1..20: mol_type = other DNA
tatttatgagattctttcat

SEQ ID NO: 94772 - DNA, 20 bp, synthetic construct
  misc_feature 1..20: note = CRISPR gRNA sequence
  source 1..20: mol_type = other DNA
atttatgagattctttcatt

SEQ ID NO: 94773 - DNA, 20 bp, synthetic construct
  misc_feature 1..20: note = CRISPR gRNA sequence
  source 1..20: mol_type = other DNA
tttatgagattctttcattt

SEQ ID NO: 94774 - DNA, 20 bp, synthetic construct
  misc_feature 1..20: note = CRISPR gRNA sequence
  source 1..20: mol_type = other DNA
atgagattctttcattttta

SEQ ID NO: 94775 - DNA, 20 bp, synthetic construct
  misc_feature 1..20: note = CRISPR gRNA sequence
  source 1..20: mol_type = other DNA
tgagattctttcatttttat

SEQ ID NO: 94776 - DNA, 20 bp, synthetic construct
  misc_feature 1..20: note = CRISPR gRNA sequence
  source 1..20: mol_type = other DNA
tttcatttttatgtgcaaga

SEQ ID NO: 94777 - DNA, 20 bp, synthetic construct
  misc_feature 1..20: note = CRISPR gRNA sequence
  source 1..20: mol_type = other DNA
tcatttttatgtgcaagata

SEQ ID NO: 94778 - DNA, 20 bp, synthetic construct
  misc_feature 1..20: note = CRISPR gRNA sequence
  source 1..20: mol_type = other DNA
catttttatgtgcaagataa

SEQ ID NO: 94779 - DNA, 20 bp, synthetic construct
  misc_feature 1..20: note = CRISPR gRNA sequence
  source 1..20: mol_type = other DNA
atttttatgtgcaagataat

SEQ ID NO: 94780 - DNA, 20 bp, synthetic construct
  misc_feature 1..20: note = CRISPR gRNA sequence
  source 1..20: mol_type = other DNA
ttatgtgcaagataatggaa

SEQ ID NO: 94781 - DNA, 20 bp, synthetic construct
  misc_feature 1..20: note = CRISPR gRNA sequence
  source 1..20: mol_type = other DNA
tatgtgcaagataatggaat

SEQ ID NO: 94782 - DNA, 20 bp, synthetic construct
  misc_feature 1..20: note = CRISPR gRNA sequence
  source 1..20: mol_type = other DNA
atgtgcaagataatggaatg

SEQ ID NO: 94783 - DNA, 20 bp, synthetic construct
  misc_feature 1..20: note = CRISPR gRNA sequence
  source 1..20: mol_type = other DNA
tgtgcaagataatggaatgc

SEQ ID NO: 94784 - DNA, 20 bp, synthetic construct
  misc_feature 1..20: note = CRISPR gRNA sequence
  source 1..20: mol_type = other DNA
aaattgacttgatggtacag

SEQ ID NO: 94785 - DNA, 20 bp, synthetic construct
  misc_feature 1..20: note = CRISPR gRNA sequence
  source 1..20: mol_type = other DNA
acttgatggtacagtaccct

SEQ ID NO: 94786 - DNA, 20 bp, synthetic construct
  misc_feature 1..20: note = CRISPR gRNA sequence
  source 1..20: mol_type = other DNA
gatggtacagtaccctctgc

SEQ ID NO: 94787 - DNA, 20 bp, synthetic construct
  misc_feature 1..20: note = CRISPR gRNA sequence
  source 1..20: mol_type = other DNA
atggtacagtaccctctgcc

SEQ ID NO: 94788 - DNA, 20 bp, synthetic construct
  misc_feature 1..20: note = CRISPR gRNA sequence
  source 1..20: mol_type = other DNA
tgccctcacaaccccactat

SEQ ID NO: 94789 - DNA, 20 bp, synthetic construct
  misc_feature 1..20: note = CRISPR gRNA sequence
  source 1..20: mol_type = other DNA
ccctcacaaccccactatgg

SEQ ID NO: 94790 - DNA, 20 bp, synthetic construct
  misc_feature 1..20: note = CRISPR gRNA sequence
  source 1..20: mol_type = other DNA
acaaccccactatggaaatt

SEQ ID NO: 94791 - DNA, 20 bp, synthetic construct
  misc_feature 1..20: note = CRISPR gRNA sequence
  source 1..20: mol_type = other DNA
tggaaattcaaaaggttaat

SEQ ID NO: 94792 - DNA, 20 bp, synthetic construct
  misc_feature 1..20: note = CRISPR gRNA sequence
  source 1..20: mol_type = other DNA
aaaaggttaattcacaaaat

SEQ ID NO: 94793 - DNA, 20 bp, synthetic construct
  misc_feature 1..20: note = CRISPR gRNA sequence
  source 1..20: mol_type = other DNA
attcacaaaatattagatac

SEQ ID NO: 94794 - DNA, 20 bp, synthetic construct
  misc_feature 1..20: note = CRISPR gRNA sequence
  source 1..20: mol_type = other DNA
acaaaatattagatactgaa

SEQ ID NO: 94795 - DNA, 20 bp, synthetic construct
  misc_feature 1..20: note = CRISPR gRNA sequence
  source 1..20: mol_type = other DNA
gatactgaattagataaaga

SEQ ID NO: 94796 - DNA, 20 bp, synthetic construct
  misc_feature 1..20: note = CRISPR gRNA sequence
  source 1..20: mol_type = other DNA
aattagataaagaagcttgt

SEQ ID NO: 94797 - DNA, 20 bp, synthetic construct
  misc_feature 1..20: note = CRISPR gRNA sequence
  source 1..20: mol_type = other DNA
gataaagaagcttgtagtga

SEQ ID NO: 94798 - DNA, 20 bp, synthetic construct
  misc_feature 1..20: note = CRISPR gRNA sequence
  source 1..20: mol_type = other DNA
gtagtgaaaataacctttag

SEQ ID NO: 94799 - DNA, 20 bp, synthetic construct
  misc_feature 1..20: note = CRISPR gRNA sequence
  source 1..20: mol_type = other DNA
tagtgaaaataacctttagt

SEQ ID NO: 94800 - DNA, 20 bp, synthetic construct
  misc_feature 1..20: note = CRISPR gRNA sequence
  source 1..20: mol_type = other DNA
tagtcatctagtccaaactt

SEQ ID NO: 94801 - DNA, 20 bp, synthetic construct
  misc_feature 1..20: note = CRISPR gRNA sequence
  source 1..20: mol_type = other DNA
agtcatctagtccaaacttg

SEQ ID NO: 94802 - DNA, 20 bp, synthetic construct
  misc_feature 1..20: note = CRISPR gRNA sequence
  source 1..20: mol_type = other DNA
gtcatctagtccaaacttgt

SEQ ID NO: 94803 - DNA, 20 bp, synthetic construct
  misc_feature 1..20: note = CRISPR gRNA sequence
  source 1..20: mol_type = other DNA
gtccaaacttgtacagatgt

SEQ ID NO: 94804 - DNA, 20 bp, synthetic construct
  misc_feature 1..20: note = CRISPR gRNA sequence
  source 1..20: mol_type = other DNA
gtacagatgttggaattctt

SEQ ID NO: 94805 - DNA, 20 bp, synthetic construct
  misc_feature 1..20: note = CRISPR gRNA sequence
  source 1..20: mol_type = other DNA
tacagatgttggaattcttt

SEQ ID NO: 94806 - DNA, 20 bp, synthetic construct
  misc_feature 1..20: note = CRISPR gRNA sequence
  source 1..20: mol_type = other DNA
gaattctttttcaaaaacct

SEQ ID NO: 94807 - DNA, 20 bp, synthetic construct
  misc_feature 1..20: note = CRISPR gRNA sequence
  source 1..20: mol_type = other DNA
tttttcaaaaacctgcaatg

SEQ ID NO: 94808 - DNA, 20 bp, synthetic construct
  misc_feature 1..20: note = CRISPR gRNA sequence
  source 1..20: mol_type = other DNA
tttcaaaaacctgcaatgct

SEQ ID NO: 94809 - DNA, 20 bp, synthetic construct
  misc_feature 1..20: note = CRISPR gRNA sequence
  source 1..20: mol_type = other DNA
ttcaaaaacctgcaatgctt

SEQ ID NO: 94810 - DNA, 20 bp, synthetic construct
  misc_feature 1..20: note = CRISPR gRNA sequence
  source 1..20: mol_type = other DNA
tcaaaaacctgcaatgcttt

SEQ ID NO: 94811 - DNA, 20 bp, synthetic construct
  misc_feature 1..20: note = CRISPR gRNA sequence
  source 1..20: mol_type = other DNA
caaaaacctgcaatgctttt

SEQ ID NO: 94812 - DNA, 20 bp, synthetic construct
  misc_feature 1..20: note = CRISPR gRNA sequence
  source 1..20: mol_type = other DNA
aaaaacctgcaatgcttttt

SEQ ID NO: 94813 - DNA, 20 bp, synthetic construct
  misc_feature 1..20: note = CRISPR gRNA sequence
  source 1..20: mol_type = other DNA
caatgctttttgtcctacag

SEQ ID NO: 94814 - DNA, 20 bp, synthetic construct
  misc_feature 1..20: note = CRISPR gRNA sequence
  source 1..20: mol_type = other DNA
tttgtcctacagagtttacc

SEQ ID NO: 94815 - DNA, 20 bp, synthetic construct
  misc_feature 1..20: note = CRISPR gRNA sequence
  source 1..20: mol_type = other DNA
ttgtcctacagagtttacca

SEQ ID NO: 94816 - DNA, 20 bp, synthetic construct
  misc_feature 1..20: note = CRISPR gRNA sequence
  source 1..20: mol_type = other DNA
tgtcctacagagtttaccaa

SEQ ID NO: 94817 - DNA, 20 bp, synthetic construct
  misc_feature 1..20: note = CRISPR gRNA sequence
  source 1..20: mol_type = other DNA
gtcctacagagtttaccaac

SEQ ID NO: 94818 - DNA, 20 bp, synthetic construct
  misc_feature 1..20: note = CRISPR gRNA sequence
  source 1..20: mol_type = other DNA
tcctacagagtttaccaact

SEQ ID NO: 94819 - DNA, 20 bp, synthetic construct
  misc_feature 1..20: note = CRISPR gRNA sequence
  source 1..20: mol_type = other DNA
cagagtttaccaacttttgc

SEQ ID NO: 94820 - DNA, 20 bp, synthetic construct
  misc_feature 1..20: note = CRISPR gRNA sequence
  source 1..20: mol_type = other DNA
accaacttttgccacatttc

SEQ ID NO: 94821 - DNA, 20 bp, synthetic construct
  misc_feature 1..20: note = CRISPR gRNA sequence
  source 1..20: mol_type = other DNA
ccaacttttgccacatttca

SEQ ID NO: 94822 - DNA, 20 bp, synthetic construct
  misc_feature 1..20: note = CRISPR gRNA sequence
  source 1..20: mol_type = other DNA
ttgccacatttcatttggtt

SEQ ID NO: 94823 - DNA, 20 bp, synthetic construct
  misc_feature 1..20: note = CRISPR gRNA sequence
  source 1..20: mol_type = other DNA
tgccacatttcatttggttt

SEQ ID NO: 94824 - DNA, 20 bp, synthetic construct
  misc_feature 1..20: note = CRISPR gRNA sequence
  source 1..20: mol_type = other DNA
gccacatttcatttggtttt

SEQ ID NO: 94825 - DNA, 20 bp, synthetic construct
  misc_feature 1..20: note = CRISPR gRNA sequence
  source 1..20: mol_type = other DNA
ccacatttcatttggttttg

SEQ ID NO: 94826 - DNA, 20 bp, synthetic construct
  misc_feature 1..20: note = CRISPR gRNA sequence
  source 1..20: mol_type = other DNA
catttggttttgaatagctc

SEQ ID NO: 94827 - DNA, 20 bp, synthetic construct
  misc_feature 1..20: note = CRISPR gRNA sequence
  source 1..20: mol_type = other DNA
atttggttttgaatagctct

SEQ ID NO: 94828 - DNA, 20 bp, synthetic construct
  misc_feature 1..20: note = CRISPR gRNA sequence
  source 1..20: mol_type = other DNA
ggttttgaatagctctaaca

SEQ ID NO: 94829 - DNA, 20 bp, synthetic construct
  misc_feature 1..20: note = CRISPR gRNA sequence
  source 1..20: mol_type = other DNA
gttttgaatagctctaacat

SEQ ID NO: 94830 - DNA, 20 bp, synthetic construct
  misc_feature 1..20: note = CRISPR gRNA sequence
  source 1..20: mol_type = other DNA
tgaatagctctaacatttcg

SEQ ID NO: 94831 - DNA, 20 bp, synthetic construct
  misc_feature 1..20: note = CRISPR gRNA sequence
  source 1..20: mol_type = other DNA
gaatagctctaacatttcgg

SEQ ID NO: 94832 - DNA, 20 bp, synthetic construct
  misc_feature 1..20: note = CRISPR gRNA sequence
  source 1..20: mol_type = other DNA
aatagctctaacatttcggt

SEQ ID NO: 94833 - DNA, 20 bp, synthetic construct
  misc_feature 1..20: note = CRISPR gRNA sequence
  source 1..20: mol_type = other DNA
taacatttcggtagaatgtt

SEQ ID NO: 94834 - DNA, 20 bp, synthetic construct
  misc_feature 1..20: note = CRISPR gRNA sequence
  source 1..20: mol_type = other DNA
acatttcggtagaatgttag

SEQ ID NO: 94835 - DNA, 20 bp, synthetic construct
  misc_feature 1..20: note = CRISPR gRNA sequence
  source 1..20: mol_type = other DNA
cggtagaatgttaggtagct

SEQ ID NO: 94836 - DNA, 20 bp, synthetic construct
  misc_feature 1..20: note = CRISPR gRNA sequence
  source 1..20: mol_type = other DNA
ggtagaatgttaggtagctt

SEQ ID NO: 94837 - DNA, 20 bp, synthetic construct
  misc_feature 1..20: note = CRISPR gRNA sequence
  source 1..20: mol_type = other DNA
ggtagctttacttaagctga

SEQ ID NO: 94838 - DNA, 20 bp, synthetic construct
  misc_feature 1..20: note = CRISPR gRNA sequence
  source 1..20: mol_type = other DNA
tacttaagctgagctgaaat

SEQ ID NO: 94839 - DNA, 20 bp, synthetic construct
  misc_feature 1..20: note = CRISPR gRNA sequence
  source 1..20: mol_type = other DNA
acttaagctgagctgaaata

SEQ ID NO: 94840 - DNA, 20 bp, synthetic construct
  misc_feature 1..20: note = CRISPR gRNA sequence
  source 1..20: mol_type = other DNA
cttaagctgagctgaaatac

SEQ ID NO: 94841 - DNA, 20 bp, synthetic construct
  misc_feature 1..20: note = CRISPR gRNA sequence
  source 1..20: mol_type = other DNA
aagctgagctgaaatacata

SEQ ID NO: 94842 - DNA, 20 bp, synthetic construct
  misc_feature 1..20: note = CRISPR gRNA sequence
  source 1..20: mol_type = other DNA
agctgagctgaaatacatac

SEQ ID NO: 94843 - DNA, 20 bp, synthetic construct
  misc_feature 1..20: note = CRISPR gRNA sequence
  source 1..20: mol_type = other DNA
agctgaaatacatactcctt

SEQ ID NO: 94844 - DNA, 20 bp, synthetic construct
  misc_feature 1..20: note = CRISPR gRNA sequence
  source 1..20: mol_type = other DNA
aaatacatactccttgtgat

SEQ ID NO: 94845 - DNA, 20 bp, synthetic construct
  misc_feature 1..20: note = CRISPR gRNA sequence
  source 1..20: mol_type = other DNA
cttgtgatttatgcctaaga

SEQ ID NO: 94846 - DNA, 20 bp, synthetic construct
  misc_feature 1..20: note = CRISPR gRNA sequence
  source 1..20: mol_type = other DNA
gtgatttatgcctaagagtc

SEQ ID NO: 94847 - DNA, 20 bp, synthetic construct
  misc_feature 1..20: note = CRISPR gRNA sequence
  source 1..20: mol_type = other DNA
tgatttatgcctaagagtcc

SEQ ID NO: 94848 - DNA, 20 bp, synthetic construct
  misc_feature 1..20: note = CRISPR gRNA sequence
  source 1..20: mol_type = other DNA
atgcctaagagtcctagtta

SEQ ID NO: 94849 - DNA, 20 bp, synthetic construct
  misc_feature 1..20: note = CRISPR gRNA sequence
  source 1..20: mol_type = other DNA
tgcctaagagtcctagttac

SEQ ID NO: 94850 - DNA, 20 bp, synthetic construct
  misc_feature 1..20: note = CRISPR gRNA sequence
  source 1..20: mol_type = other DNA
agagtcctagttacctcaga

SEQ ID NO: 94851 - DNA, 20 bp, synthetic construct
  misc_feature 1..20: note = CRISPR gRNA sequence
  source 1..20: mol_type = other DNA
gttacctcagaatcatgcca

SEQ ID NO: 94852 - DNA, 20 bp, synthetic construct
  misc_feature 1..20: note = CRISPR gRNA sequence
  source 1..20: mol_type = other DNA
cctcagaatcatgccatata

SEQ ID NO: 94853 - DNA, 20 bp, synthetic construct
  misc_feature 1..20: note = CRISPR gRNA sequence
  source 1..20: mol_type = other DNA
agaatcatgccatataagtc

SEQ ID NO: 94854 - DNA, 20 bp, synthetic construct
  misc_feature 1..20: note = CRISPR gRNA sequence
  source 1..20: mol_type = other DNA
ctgcttctcttaaatgatag

SEQ ID NO: 94855 - DNA, 20 bp, synthetic construct
  misc_feature 1..20: note = CRISPR gRNA sequence
  source 1..20: mol_type = other DNA
cttctcttaaatgatagctt

SEQ ID NO: 94856 - DNA, 20 bp, synthetic construct
  misc_feature 1..20: note = CRISPR gRNA sequence
  source 1..20: mol_type = other DNA
ctcttaaatgatagcttttt

SEQ ID NO: 94857 - DNA, 20 bp, synthetic construct
  misc_feature 1..20: note = CRISPR gRNA sequence
  source 1..20: mol_type = other DNA
tcttaaatgatagcttttta

SEQ ID NO: 94858 - DNA, 20 bp, synthetic construct
  misc_feature 1..20: note = CRISPR gRNA sequence
  source 1..20: mol_type = other DNA
ttaaatgatagctttttaga

SEQ ID NO: 94859 - DNA, 20 bp, synthetic construct
  misc_feature 1..20: note = CRISPR gRNA sequence
  source 1..20: mol_type = other DNA
aaatgatagctttttagata

SEQ ID NO: 94860 - DNA, 20 bp, synthetic construct
  misc_feature 1..20: note = CRISPR gRNA sequence
  source 1..20: mol_type = other DNA
aatgatagctttttagatat

SEQ ID NO: 94861 - DNA, 20 bp, synthetic construct
  misc_feature 1..20: note = CRISPR gRNA sequence
  source 1..20: mol_type = other DNA
tttagatatttaataagaac

SEQ ID NO: 94862 - DNA, 20 bp, synthetic construct
  misc_feature 1..20: note = CRISPR gRNA sequence
  source 1..20: mol_type = other DNA
ttagatatttaataagaaca

SEQ ID NO: 94863 - DNA, 20 bp, synthetic construct
  misc_feature 1..20: note = CRISPR gRNA sequence
  source 1..20: mol_type = other DNA
tagatatttaataagaacaa

SEQ ID NO: 94864 - DNA, 20 bp, synthetic construct
  misc_feature 1..20: note = CRISPR gRNA sequence
  source 1..20: mol_type = other DNA
agatatttaataagaacaat

SEQ ID NO: 94865 - DNA, 20 bp, synthetic construct
  misc_feature 1..20: note = CRISPR gRNA sequence
  source 1..20: mol_type = other DNA
gatatttaataagaacaatc

SEQ ID NO: 94866 - DNA, 20 bp, synthetic construct
  misc_feature 1..20: note = CRISPR gRNA sequence
  source 1..20: mol_type = other DNA
aataagaacaatcccaccag

SEQ ID NO: 94867 - DNA, 20 bp, synthetic construct
  misc_feature 1..20: note = CRISPR gRNA sequence
  source 1..20: mol_type = other DNA
ataagaacaatcccaccagc

SEQ ID NO: 94868 - DNA, 20 bp, synthetic construct
  misc_feature 1..20: note = CRISPR gRNA sequence
  source 1..20: mol_type = other DNA
atttatccctagtcccttta

SEQ ID NO: 94869 - DNA, 20 bp, synthetic construct
  misc_feature 1..20: note = CRISPR gRNA sequence
  source 1..20: mol_type = other DNA
atccctagtccctttatgtg

SEQ ID NO: 94870 - DNA, 20 bp, synthetic construct
  misc_feature 1..20: note = CRISPR gRNA sequence
  source 1..20: mol_type = other DNA
tccctagtccctttatgtgt

SEQ ID NO: 94871 - DNA, 20 bp, synthetic construct
  misc_feature 1..20: note = CRISPR gRNA sequence
  source 1..20: mol_type = other DNA
gtccctttatgtgtctctca

SEQ ID NO: 94872 - DNA, 20 bp, synthetic construct
  misc_feature 1..20: note = CRISPR gRNA sequence
  source 1..20: mol_type = other DNA
tatgtgtctctcatatagca

SEQ ID NO: 94873 - DNA, 20 bp, synthetic construct
  misc_feature 1..20: note = CRISPR gRNA sequence
  source 1..20: mol_type = other DNA
atgtgtctctcatatagcat

SEQ ID NO: 94874 - DNA, 20 bp, synthetic construct
  misc_feature 1..20: note = CRISPR gRNA sequence
  source 1..20: mol_type = other DNA
tgtgtctctcatatagcata

SEQ ID NO: 94875 - DNA, 20 bp, synthetic construct
  misc_feature 1..20: note = CRISPR gRNA sequence
  source 1..20: mol_type = other DNA
tcatatagcatagttcttag

SEQ ID NO: 94876 - DNA, 20 bp, synthetic construct
  misc_feature 1..20: note = CRISPR gRNA sequence
  source 1..20: mol_type = other DNA
atatagcatagttcttagat

SEQ ID NO: 94877 - DNA, 20 bp, synthetic construct
  misc_feature 1..20: note = CRISPR gRNA sequence
  source 1..20: mol_type = other DNA
ttagattggtggagtagaca

SEQ ID NO: 94878 - DNA, 20 bp, synthetic construct
  misc_feature 1..20: note = CRISPR gRNA sequence
  source 1..20: mol_type = other DNA
agattggtggagtagacatt

SEQ ID NO: 94879 - DNA, 20 bp, synthetic construct
  misc_feature 1..20: note = CRISPR gRNA sequence
  source 1..20: mol_type = other DNA
gattggtggagtagacatta

SEQ ID NO: 94880 - DNA, 20 bp, synthetic construct
  misc_feature 1..20: note = CRISPR gRNA sequence
  source 1..20: mol_type = other DNA
gtggagtagacattatacac

SEQ ID NO: 94881 - DNA, 20 bp, synthetic construct
  misc_feature 1..20: note = CRISPR gRNA sequence
  source 1..20: mol_type = other DNA
tacacatttgttcctcattt

SEQ ID NO: 94882 - DNA, 20 bp, synthetic construct
  misc_feature 1..20: note = CRISPR gRNA sequence
  source 1..20: mol_type = other DNA
gttcctcatttaaccttgac

SEQ ID NO: 94883 - DNA, 20 bp, synthetic construct
  misc_feature 1..20: note = CRISPR gRNA sequence
  source 1..20: mol_type = other DNA
ttcctcatttaaccttgact

SEQ ID NO: 94884 - DNA, 20 bp, synthetic construct
  misc_feature 1..20: note = CRISPR gRNA sequence
  source 1..20: mol_type = other DNA
ctcatttaaccttgacttgt

SEQ ID NO: 94885 - DNA, 20 bp, synthetic construct
  misc_feature 1..20: note = CRISPR gRNA sequence
  source 1..20: mol_type = other DNA
atttaaccttgacttgtgta

SEQ ID NO: 94886 - DNA, 20 bp, synthetic construct
  misc_feature 1..20: note = CRISPR gRNA sequence
  source 1..20: mol_type = other DNA
aaccttgacttgtgtaagaa

SEQ ID NO: 94887 - DNA, 20 bp, synthetic construct
  misc_feature 1..20: note = CRISPR gRNA sequence
  source 1..20: mol_type = other DNA
accttgacttgtgtaagaaa

SEQ ID NO: 94888 - DNA, 20 bp, synthetic construct
  misc_feature 1..20: note = CRISPR gRNA sequence
  source 1..20: mol_type = other DNA
gacttgtgtaagaaatatta

SEQ ID NO: 94889 - DNA, 20 bp, synthetic construct
  misc_feature 1..20: note = CRISPR gRNA sequence
  source 1..20: mol_type = other DNA
acttgtgtaagaaatattaa

SEQ ID NO: 94890 - DNA, 20 bp, synthetic construct
  misc_feature 1..20: note = CRISPR gRNA sequence
  source 1..20: mol_type = other DNA
gtgtaagaaatattaatttt

SEQ ID NO: 94891 - DNA, 20 bp, synthetic construct
  misc_feature 1..20: note = CRISPR gRNA sequence
  source 1..20: mol_type = other DNA
tgtaagaaatattaatttta

SEQ ID NO: 94892 - DNA, 20 bp, synthetic construct
  misc_feature 1..20: note = CRISPR gRNA sequence
  source 1..20: mol_type = other DNA
attttagataccttaatttc

SEQ ID NO: 94893 - DNA, 20 bp, synthetic construct
  misc_feature 1..20: note = CRISPR gRNA sequence
  source 1..20: mol_type = other DNA
tagataccttaatttcttta

SEQ ID NO: 94894 - DNA, 20 bp, synthetic construct
  misc_feature 1..20: note = CRISPR gRNA sequence
  source 1..20: mol_type = other DNA
agataccttaatttctttaa

SEQ ID NO: 94895 - DNA, 20 bp, synthetic construct
  misc_feature 1..20: note = CRISPR gRNA sequence
  source 1..20: mol_type = other DNA
gataccttaatttctttaat

SEQ ID NO: 94896 - DNA, 20 bp, synthetic construct
  misc_feature 1..20: note = CRISPR gRNA sequence
  source 1..20: mol_type = other DNA
aatttctttaatttttttac

SEQ ID NO: 94897 - DNA, 20 bp, synthetic construct
  misc_feature 1..20: note = CRISPR gRNA sequence
  source 1..20: mol_type = other DNA
atttctttaatttttttacc

SEQ ID NO: 94898 - DNA, 20 bp, synthetic construct
  misc_feature 1..20: note = CRISPR gRNA sequence
  source 1..20: mol_type = other DNA
ctttaatttttttaccttaa

SEQ ID NO: 94899 - DNA, 20 bp, synthetic construct
  misc_feature 1..20: note = CRISPR gRNA sequence
  source 1..20: mol_type = other DNA
tttaatttttttaccttaat

SEQ ID NO: 94900 - DNA, 20 bp, synthetic construct
  misc_feature 1..20: note = CRISPR gRNA sequence
  source 1..20: mol_type = other DNA
taatttttttaccttaataa

SEQ ID NO: 94901 - DNA, 20 bp, synthetic construct
  misc_feature 1..20: note = CRISPR gRNA sequence
  source 1..20: mol_type = other DNA
aatttttttaccttaataaa

SEQ ID NO: 94902 - DNA, 20 bp, synthetic construct
  misc_feature 1..20: note = CRISPR gRNA sequence
  source 1..20: mol_type = other DNA
atttttttaccttaataaat

SEQ ID NO: 94903 - DNA, 20 bp, synthetic construct
  misc_feature 1..20: note = CRISPR gRNA sequence
  source 1..20: mol_type = other DNA
ttttaccttaataaattctt

SEQ ID NO: 94904 - DNA, 20 bp, synthetic construct
  misc_feature 1..20: note = CRISPR gRNA sequence
  source 1..20: mol_type = other DNA
tttaccttaataaattcttc

SEQ ID NO: 94905 - DNA, 20 bp, synthetic construct
  misc_feature 1..20: note = CRISPR gRNA sequence
  source 1..20: mol_type = other DNA
ttaccttaataaattcttca

SEQ ID NO: 94906 - DNA, 20 bp, synthetic construct
  misc_feature 1..20: note = CRISPR gRNA sequence
  source 1..20: mol_type = other DNA
taccttaataaattcttcat

SEQ ID NO: 94907 - DNA, 20 bp, synthetic construct
  misc_feature 1..20: note = CRISPR gRNA sequence
  source 1..20: mol_type = other DNA
accttaataaattcttcatt

SEQ ID NO: 94908 - DNA, 20 bp, synthetic construct
  misc_feature 1..20: note = CRISPR gRNA sequence
  source 1..20: mol_type = other DNA
ccttaataaattcttcattg

SEQ ID NO: 94909 - DNA, 20 bp, synthetic construct
  misc_feature 1..20: note = CRISPR gRNA sequence
  source 1..20: mol_type = other DNA
aataaattcttcattggaat

SEQ ID NO: 94910 - DNA, 20 bp, synthetic construct
  misc_feature 1..20: note = CRISPR gRNA sequence
  source 1..20: mol_type = other DNA
ataaattcttcattggaata

SEQ ID NO: 94911 - DNA, 20 bp, synthetic construct
  misc_feature 1..20: note = CRISPR gRNA sequence
  source 1..20: mol_type = other DNA
ttcattggaatagagaactt

SEQ ID NO: 94912 - DNA, 20 bp, synthetic construct
  misc_feature 1..20: note = CRISPR gRNA sequence
  source 1..20: mol_type = other DNA
cattggaatagagaacttaa

SEQ ID NO: 94913 - DNA, 20 bp, synthetic construct
  misc_feature 1..20: note = CRISPR gRNA sequence
  source 1..20: mol_type = other DNA
attggaatagagaacttaat

SEQ ID NO: 94914 - DNA, 20 bp, synthetic construct
  misc_feature 1..20: note = CRISPR gRNA sequence
  source 1..20: mol_type = other DNA
gaatagagaacttaatttct

SEQ ID NO: 94915 - DNA, 20 bp, synthetic construct
  misc_feature 1..20: note = CRISPR gRNA sequence
  source 1..20: mol_type = other DNA
aatttctaatcttgctgctc

SEQ ID NO: 94916 - DNA, 20 bp, synthetic construct
  misc_feature 1..20: note = CRISPR gRNA sequence
  source 1..20: mol_type = other DNA
atttctaatcttgctgctca

SEQ ID NO: 94917 - DNA, 20 bp, synthetic construct
  misc_feature 1..20: note = CRISPR gRNA sequence
  source 1..20: mol_type = other DNA
ctaatcttgctgctcacaac

SEQ ID NO: 94918 - DNA, 20 bp, synthetic construct
  misc_feature 1..20: note = CRISPR gRNA sequence
  source 1..20: mol_type = other DNA
taatcttgctgctcacaaca

SEQ ID NO: 94919 - DNA, 20 bp, synthetic construct
  misc_feature 1..20: note = CRISPR gRNA sequence
  source 1..20: mol_type = other DNA
atcttgctgctcacaacata

SEQ ID NO: 94920 - DNA, 20 bp, synthetic construct
  misc_feature 1..20: note = CRISPR gRNA sequence
  source 1..20: mol_type = other DNA
gctgctcacaacatagcaga

SEQ ID NO: 94921 - DNA, 20 bp, synthetic construct
  misc_feature 1..20: note = CRISPR gRNA sequence
  source 1..20: mol_type = other DNA
ctgctcacaacatagcagaa

SEQ ID NO: 94922 - DNA, 20 bp, synthetic construct
  misc_feature 1..20: note = CRISPR gRNA sequence
  source 1..20: mol_type = other DNA
ctcacaacatagcagaagac

SEQ ID NO: 94923 - DNA, 20 bp, synthetic construct
  misc_feature 1..20: note = CRISPR gRNA sequence
  source 1..20: mol_type = other DNA
acaacatagcagaagacacc

SEQ ID NO: 94924 - DNA, 20 bp, synthetic construct
  misc_feature 1..20: note = CRISPR gRNA sequence
  source 1..20: mol_type = other DNA
tcagtcctactataataatc

SEQ ID NO: 94925 - DNA, 20 bp, synthetic construct
  misc_feature 1..20: note = CRISPR gRNA sequence
  source 1..20: mol_type = other DNA
ctataataatcttcgaaaga

SEQ ID NO: 94926 - DNA, 20 bp, synthetic construct
  misc_feature 1..20: note = CRISPR gRNA sequence
  source 1..20: mol_type = other DNA
taataatcttcgaaagagtc

SEQ ID NO: 94927 - DNA, 20 bp, synthetic construct
  misc_feature 1..20: note = CRISPR gRNA sequence
  source 1..20: mol_type = other DNA
cgaaagagtctcaaaatcta

SEQ ID NO: 94928 - DNA, 20 bp, synthetic construct
  misc_feature 1..20: note = CRISPR gRNA sequence
  source 1..20: mol_type = other DNA
gaaagagtctcaaaatctat

SEQ ID NO: 94929 - DNA, 20 bp, synthetic construct
  misc_feature 1..20: note = CRISPR gRNA sequence
  source 1..20: mol_type = other DNA
aaaatctataggctctcaac

SEQ ID NO: 94930 - DNA, 20 bp, synthetic construct
  misc_feature 1..20: note = CRISPR gRNA sequence
  source 1..20: mol_type = other DNA
taggctctcaactttaaccc

SEQ ID NO: 94931 - DNA, 20 bp, synthetic construct
  misc_feature 1..20: note = CRISPR gRNA sequence
  source 1..20: mol_type = other DNA
tcaactttaacccactccat

SEQ ID NO: 94932 - DNA, 20 bp, synthetic construct
  misc_feature 1..20: note = CRISPR gRNA sequence
  source 1..20: mol_type = other DNA
aactttaacccactccatca

SEQ ID NO: 94933 - DNA, 20 bp, synthetic construct
  misc_feature 1..20: note = CRISPR gRNA sequence
  source 1..20: mol_type = other DNA
taacccactccatcagggta

SEQ ID NO: 94934 - DNA, 20 bp, synthetic construct
  misc_feature 1..20: note = CRISPR gRNA sequence
  source 1..20: mol_type = other DNA
aacccactccatcagggtag

SEQ ID NO: 94935 - DNA, 20 bp, synthetic construct
  misc_feature 1..20: note = CRISPR gRNA sequence
  source 1..20: mol_type = other DNA
acccactccatcagggtagg

SEQ ID NO: 94936 - DNA, 20 bp, synthetic construct
  misc_feature 1..20: note = CRISPR gRNA sequence
  source 1..20: mol_type = other DNA
catcagggtaggatcctctg

SEQ ID NO: 94937 - DNA, 20 bp, synthetic construct
  misc_feature 1..20: note = CRISPR gRNA sequence
  source 1..20: mol_type = other DNA
tgctacttcctaattagatc

SEQ ID NO: 94938 - DNA, 20 bp, synthetic construct
  misc_feature 1..20: note = CRISPR gRNA sequence
  source 1..20: mol_type = other DNA
ctacttcctaattagatcat

SEQ ID NO: 94939 - DNA, 20 bp, synthetic construct
  misc_feature 1..20: note = CRISPR gRNA sequence
  source 1..20: mol_type = other DNA
cttcctaattagatcatttc

SEQ ID NO: 94940 - DNA, 20 bp, synthetic construct
  misc_feature 1..20: note = CRISPR gRNA sequence
  source 1..20: mol_type = other DNA
cctaattagatcatttcatt

SEQ ID NO: 94941 - DNA, 20 bp, synthetic construct
  misc_feature 1..20: note = CRISPR gRNA sequence
  source 1..20: mol_type = other DNA
ctaattagatcatttcattt

SEQ ID NO: 94942 - DNA, 20 bp, synthetic construct
  misc_feature 1..20: note = CRISPR gRNA sequence
  source 1..20: mol_type = other DNA
attagatcatttcatttaaa

SEQ ID NO: 94943 - DNA, 20 bp, synthetic construct
  misc_feature 1..20: note = CRISPR gRNA sequence
  source 1..20: mol_type = other DNA
gatcatttcatttaaagact

SEQ ID NO: 94944 - DNA, 20 bp, synthetic construct
  misc_feature 1..20: note = CRISPR gRNA sequence
  source 1..20: mol_type = other DNA
catttaaagactccaaatcc

SEQ ID NO: 94945 - DNA, 20 bp, synthetic construct
  misc_feature 1..20: note = CRISPR gRNA sequence
  source 1..20: mol_type = other DNA
atttaaagactccaaatcca

SEQ ID NO: 94946 - DNA, 20 bp, synthetic construct
  misc_feature 1..20: note = CRISPR gRNA sequence
  source 1..20: mol_type = other DNA
aaagactccaaatccaaatc

SEQ ID NO: 94947 - DNA, 20 bp, synthetic construct
  misc_feature 1..20: note = CRISPR gRNA sequence
  source 1..20: mol_type = other DNA
aagactccaaatccaaatcc

SEQ ID NO: 94948 - DNA, 20 bp, synthetic construct
  misc_feature 1..20: note = CRISPR gRNA sequence
  source 1..20: mol_type = other DNA
caaatccaaatcccatagcc

SEQ ID NO: 94949 - DNA, 20 bp, synthetic construct
  misc_feature 1..20: note = CRISPR gRNA sequence
  source 1..20: mol_type = other DNA
gcattcaatactataaaaaa

SEQ ID NO: 94950 - DNA, 20 bp, synthetic construct
  misc_feature 1..20: note = CRISPR gRNA sequence
  source 1..20: mol_type = other DNA
aatactataaaaaactggct

SEQ ID NO: 94951 - DNA, 20 bp, synthetic construct
  misc_feature 1..20: note = CRISPR gRNA sequence
  source 1..20: mol_type = other DNA
taaaaaactggcttcaacct

SEQ ID NO: 94952 - DNA, 20 bp, synthetic construct
  misc_feature 1..20: note = CRISPR gRNA sequence
  source 1..20: mol_type = other DNA
gcttcaacctatctttccaa

SEQ ID NO: 94953 - DNA, 20 bp, synthetic construct
  misc_feature 1..20: note = CRISPR gRNA sequence
  source 1..20: mol_type = other DNA
caacctatctttccaaattt

SEQ ID NO: 94954 - DNA, 20 bp, synthetic construct
  misc_feature 1..20: note = CRISPR gRNA sequence
  source 1..20: mol_type = other DNA
aacctatctttccaaatttc

SEQ ID NO: 94955 - DNA, 20 bp, synthetic construct
  misc_feature 1..20: note = CRISPR gRNA sequence
  source 1..20: mol_type = other DNA
tctttccaaatttctctctc

SEQ ID NO: 94956 - DNA, 20 bp, synthetic construct
  misc_feature 1..20: note = CRISPR gRNA sequence
  source 1..20: mol_type = other DNA
tccaaatttctctctcatga

SEQ ID NO: 94957 - DNA, 20 bp, synthetic construct
  misc_feature 1..20: note = CRISPR gRNA sequence
  source 1..20: mol_type = other DNA
ccaaatttctctctcatgaa

SEQ ID NO: 94958 - DNA, 20 bp, synthetic construct
  misc_feature 1..20: note = CRISPR gRNA sequence
  source 1..20: mol_type = other DNA
caaatttctctctcatgaat

SEQ ID NO: 94959 - DNA, 20 bp, synthetic construct
  misc_feature 1..20: note = CRISPR gRNA sequence
  source 1..20: mol_type = other DNA
ctctctcatgaattttccac

SEQ ID NO: 94960 - DNA, 20 bp, synthetic construct
  misc_feature 1..20: note = CRISPR gRNA sequence
  source 1..20: mol_type = other DNA
tctctcatgaattttccact

SEQ ID NO: 94961 - DNA, 20 bp, synthetic construct
  misc_feature 1..20: note = CRISPR gRNA sequence
  source 1..20: mol_type = other DNA
tctcatgaattttccactca

SEQ ID NO: 94962 - DNA, 20 bp, synthetic construct
  misc_feature 1..20: note = CRISPR gRNA sequence
  source 1..20: mol_type = other DNA
tcatgaattttccactcaac

SEQ ID NO: 94963 - DNA, 20 bp, synthetic construct
  misc_feature 1..20: note = CRISPR gRNA sequence
  source 1..20: mol_type = other DNA
atgaattttccactcaacta

SEQ ID NO: 94964 - DNA, 20 bp, synthetic construct
  misc_feature 1..20: note = CRISPR gRNA sequence
  source 1..20: mol_type = other DNA
tccactcaactattttagct

SEQ ID NO: 94965 - DNA, 20 bp, synthetic construct
  misc_feature 1..20: note = CRISPR gRNA sequence
  source 1..20: mol_type = other DNA
ccactcaactattttagcta

SEQ ID NO: 94966 - DNA, 20 bp, synthetic construct
  misc_feature 1..20: note = CRISPR gRNA sequence
  source 1..20: mol_type = other DNA
cactcaactattttagctag

SEQ ID NO: 94967 - DNA, 20 bp, synthetic construct
  misc_feature 1..20: note = CRISPR gRNA sequence
  source 1..20: mol_type = other DNA
aactattttagctagaatag

SEQ ID NO: 94968 - DNA, 20 bp, synthetic construct
  misc_feature 1..20: note = CRISPR gRNA sequence
  source 1..20: mol_type = other DNA
ttttagctagaatagtccac

SEQ ID NO: 94969 - DNA, 20 bp, synthetic construct
  misc_feature 1..20: note = CRISPR gRNA sequence
  source 1..20: mol_type = other DNA
tagctagaatagtccacttg

SEQ ID NO: 94970 - DNA, 20 bp, synthetic construct
  misc_feature 1..20: note = CRISPR gRNA sequence
  source 1..20: mol_type = other DNA
agctagaatagtccacttgc

SEQ ID NO: 94971 - DNA, 20 bp, synthetic construct
  misc_feature 1..20: note = CRISPR gRNA sequence
  source 1..20: mol_type = other DNA
gctagaatagtccacttgct

SEQ ID NO: 94972 - DNA, 20 bp, synthetic construct
  misc_feature 1..20: note = CRISPR gRNA sequence
  source 1..20: mol_type = other DNA
gaatagtccacttgctatct

SEQ ID NO: 94973 - DNA, 20 bp, synthetic construct
  misc_feature 1..20: note = CRISPR gRNA sequence
  source 1..20: mol_type = other DNA
gctatcttcacaaaagtgtt

SEQ ID NO: 94974 - DNA, 20 bp, synthetic construct
  misc_feature 1..20: note = CRISPR gRNA sequence
  source 1..20: mol_type = other DNA
ctatcttcacaaaagtgttt

SEQ ID NO: 94975 - DNA, 20 bp, synthetic construct
  misc_feature 1..20: note = CRISPR gRNA sequence
  source 1..20: mol_type = other DNA
tcttcacaaaagtgttttct

SEQ ID NO: 94976 - DNA, 20 bp, synthetic construct
  misc_feature 1..20: note = CRISPR gRNA sequence
  source 1..20: mol_type = other DNA
cacaaaagtgttttctgtat

SEQ ID NO: 94977 - DNA, 20 bp, synthetic construct
  misc_feature 1..20: note = CRISPR gRNA sequence
  source 1..20: mol_type = other DNA
acaaaagtgttttctgtatt

SEQ ID NO: 94978 - DNA, 20 bp, synthetic construct
  misc_feature 1..20: note = CRISPR gRNA sequence
  source 1..20: mol_type = other DNA
tctgtattcctacttctctt

SEQ ID NO: 94979 - DNA, 20 bp, synthetic construct
  misc_feature 1..20: note = CRISPR gRNA sequence
  source 1..20: mol_type = other DNA
ctgtattcctacttctcttt

SEQ ID NO: 94980 - DNA, 20 bp, synthetic construct
  misc_feature 1..20: note = CRISPR gRNA sequence
  source 1..20: mol_type = other DNA
tgtattcctacttctctttc

SEQ ID NO: 94981 - DNA, 20 bp, synthetic construct
  misc_feature 1..20: note = CRISPR gRNA sequence
  source 1..20: mol_type = other DNA
tattcctacttctctttctt

SEQ ID NO: 94982 - DNA, 20 bp, synthetic construct
  misc_feature 1..20: note = CRISPR gRNA sequence
  source 1..20: mol_type = other DNA
ctacttctctttctttacta

SEQ ID NO: 94983 - DNA, 20 bp, synthetic construct
  misc_feature 1..20: note = CRISPR gRNA sequence
  source 1..20: mol_type = other DNA
cttctctttctttactaaaa

SEQ ID NO: 94984 - DNA, 20 bp, synthetic construct
  misc_feature 1..20: note = CRISPR gRNA sequence
  source 1..20: mol_type = other DNA
ctctttctttactaaaatgt

SEQ ID NO: 94985 - DNA, 20 bp, synthetic construct
  misc_feature 1..20: note = CRISPR gRNA sequence
  source 1..20: mol_type = other DNA
tctttctttactaaaatgtg

SEQ ID NO: 94986 - DNA, 20 bp, synthetic construct
  misc_feature 1..20: note = CRISPR gRNA sequence
  source 1..20: mol_type = other DNA
tttctttactaaaatgtgct

SEQ ID NO: 94987 - DNA, 20 bp, synthetic construct
  misc_feature 1..20: note = CRISPR gRNA sequence
  source 1..20: mol_type = other DNA
tctttactaaaatgtgcttc

SEQ ID NO: 94988 - DNA, 20 bp, synthetic construct
  misc_feature 1..20: note = CRISPR gRNA sequence
  source 1..20: mol_type = other DNA
ctttactaaaatgtgcttct

SEQ ID NO: 94989 - DNA, 20 bp, synthetic construct
  misc_feature 1..20: note = CRISPR gRNA sequence
  source 1..20: mol_type = other DNA
tttactaaaatgtgcttctc

SEQ ID NO: 94990 - DNA, 20 bp, synthetic construct
  misc_feature 1..20: note = CRISPR gRNA sequence
  source 1..20: mol_type = other DNA
tactaaaatgtgcttctctt

SEQ ID NO: 94991 - DNA, 20 bp, synthetic construct
  misc_feature 1..20: note = CRISPR gRNA sequence
  source 1..20: mol_type = other DNA
actaaaatgtgcttctcttt

SEQ ID NO: 94992 - DNA, 20 bp, synthetic construct
  misc_feature 1..20: note = CRISPR gRNA sequence
  source 1..20: mol_type = other DNA
ctaaaatgtgcttctctttc

SEQ ID NO: 94993 - DNA, 20 bp, synthetic construct
  misc_feature 1..20: note = CRISPR gRNA sequence
  source 1..20: mol_type = other DNA
aaatgtgcttctctttcctt

SEQ ID NO: 94994 - DNA, 20 bp, synthetic construct
  misc_feature 1..20: note = CRISPR gRNA sequence
  source 1..20: mol_type = other DNA
ctctttccttttatctacca

SEQ ID NO: 94995 - DNA, 20 bp, synthetic construct
  misc_feature 1..20: note = CRISPR gRNA sequence
  source 1..20: mol_type = other DNA
tctttccttttatctaccag

SEQ ID NO: 94996 - DNA, 20 bp, synthetic construct
  misc_feature 1..20: note = CRISPR gRNA sequence
  source 1..20: mol_type = other DNA
tttccttttatctaccagaa

SEQ ID NO: 94997 - DNA, 20 bp, synthetic construct
  misc_feature 1..20: note = CRISPR gRNA sequence
  source 1..20: mol_type = other DNA
tccttttatctaccagaatt

SEQ ID NO: 94998 - DNA, 20 bp, synthetic construct
  misc_feature 1..20: note = CRISPR gRNA sequence
  source 1..20: mol_type = other DNA
ccttttatctaccagaattc

SEQ ID NO: 94999 - DNA, 20 bp, synthetic construct
  misc_feature 1..20: note = CRISPR gRNA sequence
  source 1..20: mol_type = other DNA
cttttatctaccagaattct

SEQ ID NO: 95000 - DNA, 20 bp, synthetic construct
  misc_feature 1..20: note = CRISPR gRNA sequence
  source 1..20: mol_type = other DNA
ttatctaccagaattctagg

SEQ ID NO: 95001 - DNA, 20 bp, synthetic construct
  misc_feature 1..20: note = CRISPR gRNA sequence
  source 1..20: mol_type = other DNA
tatctaccagaattctaggg

SEQ ID NO: 95002 - DNA, 20 bp, synthetic construct
  misc_feature 1..20: note = CRISPR gRNA sequence
  source 1..20: mol_type = other DNA
atctaccagaattctaggga

SEQ ID NO: 95003 - DNA, 20 bp, synthetic construct
  misc_feature 1..20: note = CRISPR gRNA sequence
  source 1..20: mol_type = other DNA
tctaccagaattctagggaa

SEQ ID NO: 95004 - DNA, 20 bp, synthetic construct
  misc_feature 1..20: note = CRISPR gRNA sequence
  source 1..20: mol_type = other DNA
ccagaattctagggaagcag

SEQ ID NO: 95005 - DNA, 20 bp, synthetic construct
  misc_feature 1..20: note = CRISPR gRNA sequence
  source 1..20: mol_type = other DNA
tagggaagcagtatagtaag

SEQ ID NO: 95006 - DNA, 20 bp, synthetic construct
  misc_feature 1..20: note = CRISPR gRNA sequence
  source 1..20: mol_type = other DNA
gggaagcagtatagtaagga

SEQ ID NO: 95007 - DNA, 20 bp, synthetic construct
  misc_feature 1..20: note = CRISPR gRNA sequence
  source 1..20: mol_type = other DNA
tagaataagactgcttgcgt

SEQ ID NO: 95008 - DNA, 20 bp, synthetic construct
  misc_feature 1..20: note = CRISPR gRNA sequence
  source 1..20: mol_type = other DNA
gaataagactgcttgcgttt

SEQ ID NO: 95009 - DNA, 20 bp, synthetic construct
  misc_feature 1..20: note = CRISPR gRNA sequence
  source 1..20: mol_type = other DNA
cttgcgtttgagtacaatac

SEQ ID NO: 95010 - DNA, 20 bp, synthetic construct
  misc_feature 1..20: note = CRISPR gRNA sequence
  source 1..20: mol_type = other DNA
gcgtttgagtacaatacttg

SEQ ID NO: 95011 - DNA, 20 bp, synthetic construct
  misc_feature 1..20: note = CRISPR gRNA sequence
  source 1..20: mol_type = other DNA
cgtttgagtacaatacttgc

SEQ ID NO: 95012 - DNA, 20 bp, synthetic construct
  misc_feature 1..20: note = CRISPR gRNA sequence
  source 1..20: mol_type = other DNA
gagtacaatacttgctggct

SEQ ID NO: 95013 - DNA, 20 bp, synthetic construct
  misc_feature 1..20: note = CRISPR gRNA sequence
  source 1..20: mol_type = other DNA
agtacaatacttgctggctg

SEQ ID NO: 95014 - DNA, 20 bp, synthetic construct
  misc_feature 1..20: note = CRISPR gRNA sequence
  source 1..20: mol_type = other DNA
gctggctgtatgacctaggc

SEQ ID NO: 95015 - DNA, 20 bp, synthetic construct
  misc_feature 1..20: note = CRISPR gRNA sequence
  source 1..20: mol_type = other DNA
ctggctgtatgacctaggcc

SEQ ID NO: 95016 - DNA, 20 bp, synthetic construct
  misc_feature 1..20: note = CRISPR gRNA sequence
  source 1..20: mol_type = other DNA
gctgtatgacctaggccaaa

SEQ ID NO: 95017 - DNA, 20 bp, synthetic construct
  misc_feature 1..20: note = CRISPR gRNA sequence
  source 1..20: mol_type = other DNA
tatgacctaggccaaattct

SEQ ID NO: 95018 - DNA, 20 bp, synthetic construct
  misc_feature 1..20: note = CRISPR gRNA sequence
  source 1..20: mol_type = other DNA
ggccaaattctttagcctct

SEQ ID NO: 95019 - DNA, 20 bp, synthetic construct
  misc_feature 1..20: note = CRISPR gRNA sequence
  source 1..20: mol_type = other DNA
tttagcctctctgtgcctca

SEQ ID NO: 95020 - DNA, 20 bp, synthetic construct
  misc_feature 1..20: note = CRISPR gRNA sequence
  source 1..20: mol_type = other DNA
tagcctctctgtgcctcagt

SEQ ID NO: 95021 - DNA, 20 bp, synthetic construct
  misc_feature 1..20: note = CRISPR gRNA sequence
  source 1..20: mol_type = other DNA
agcctctctgtgcctcagtt

SEQ ID NO: 95022 - DNA, 20 bp, synthetic construct
  misc_feature 1..20: note = CRISPR gRNA sequence
  source 1..20: mol_type = other DNA
gcctctctgtgcctcagttt

SEQ ID NO: 95023 - DNA, 20 bp, synthetic construct
  misc_feature 1..20: note = CRISPR gRNA sequence
  source 1..20: mol_type = other DNA
tctgtgcctcagtttccatg

SEQ ID NO: 95024 - DNA, 20 bp, synthetic construct
  misc_feature 1..20: note = CRISPR gRNA sequence
  source 1..20: mol_type = other DNA
tgtgcctcagtttccatgta

SEQ ID NO: 95025 - DNA, 20 bp, synthetic construct
  misc_feature 1..20: note = CRISPR gRNA sequence
  source 1..20: mol_type = other DNA
tgcctcagtttccatgtatg

SEQ ID NO: 95026 - DNA, 20 bp, synthetic construct
  misc_feature 1..20: note = CRISPR gRNA sequence
  source 1..20: mol_type = other DNA
agtttccatgtatgtaaaat

SEQ ID NO: 95027 - DNA, 20 bp, synthetic construct
  misc_feature 1..20: note = CRISPR gRNA sequence
  source 1..20: mol_type = other DNA
ccatgtatgtaaaatatagt

SEQ ID NO: 95028 - DNA, 20 bp, synthetic construct
  misc_feature 1..20: note = CRISPR gRNA sequence
  source 1..20: mol_type = other DNA
catgtatgtaaaatatagta

SEQ ID NO: 95029 - DNA, 20 bp, synthetic construct
  misc_feature 1..20: note = CRISPR gRNA sequence
  source 1..20: mol_type = other DNA
tcccattgctgaagggttgt

SEQ ID NO: 95030 - DNA, 20 bp, synthetic construct
  misc_feature 1..20: note = CRISPR gRNA sequence
  source 1..20: mol_type = other DNA
ctgaagggttgtgagactcc

SEQ ID NO: 95031 - DNA, 20 bp, synthetic construct
  misc_feature 1..20: note = CRISPR gRNA sequence
  source 1..20: mol_type = other DNA
aagggttgtgagactccatt

SEQ ID NO: 95032 - DNA, 20 bp, synthetic construct
  misc_feature 1..20: note = CRISPR gRNA sequence
  source 1..20: mol_type = other DNA
tgagactccatttatagctt

SEQ ID NO: 95033 - DNA, 20 bp, synthetic construct
  misc_feature 1..20: note = CRISPR gRNA sequence
  source 1..20: mol_type = other DNA
catttatagcttaacacagt

SEQ ID NO: 95034 - DNA, 20 bp, synthetic construct
  misc_feature 1..20: note = CRISPR gRNA sequence
  source 1..20: mol_type = other DNA
atagcttaacacagtgcttg

SEQ ID NO: 95035 - DNA, 20 bp, synthetic construct
  misc_feature 1..20: note = CRISPR gRNA sequence
  source 1..20: mol_type = other DNA
tagcttaacacagtgcttga

SEQ ID NO: 95036 - DNA, 20 bp, synthetic construct
  misc_feature 1..20: note = CRISPR gRNA sequence
  source 1..20: mol_type = other DNA
aacacagtgcttgacacata

SEQ ID NO: 95037 - DNA, 20 bp, synthetic construct
  misc_feature 1..20: note = CRISPR gRNA sequence
  source 1..20: mol_type = other DNA
acacagtgcttgacacataa

SEQ ID NO: 95038 - DNA, 20 bp, synthetic construct
  misc_feature 1..20: note = CRISPR gRNA sequence
  source 1..20: mol_type = other DNA
gacacataagaaactcagct

SEQ ID NO: 95039 - DNA, 20 bp, synthetic construct
  misc_feature 1..20: note = CRISPR gRNA sequence
  source 1..20: mol_type = other DNA
acacataagaaactcagctc

SEQ ID NO: 95040 - DNA, 20 bp, synthetic construct
  misc_feature 1..20: note = CRISPR gRNA sequence
  source 1..20: mol_type = other DNA
agctcattaagcgtaaacta

SEQ ID NO: 95041 - DNA, 20 bp, synthetic construct
  misc_feature 1..20: note = CRISPR gRNA sequence
  source 1..20: mol_type = other DNA
attaagcgtaaactattgcc

SEQ ID NO: 95042 - DNA, 20 bp, synthetic construct
  misc_feature 1..20: note = CRISPR gRNA sequence
  source 1..20: mol_type = other DNA
agcgtaaactattgcccatc

SEQ ID NO: 95043 - DNA, 20 bp, synthetic construct
  misc_feature 1..20: note = CRISPR gRNA sequence
  source 1..20: mol_type = other DNA
ttgcccatcctttctggttt

SEQ ID NO: 95044 - DNA, 20 bp, synthetic construct
  misc_feature 1..20: note = CRISPR gRNA sequence
  source 1..20: mol_type = other DNA
cccatcctttctggtttata

SEQ ID NO: 95045 - DNA, 20 bp, synthetic construct
  misc_feature 1..20: note = CRISPR gRNA sequence
  source 1..20: mol_type = other DNA
tctggtttatactgagtcac

SEQ ID NO: 95046 - DNA, 20 bp, synthetic construct
  misc_feature 1..20: note = CRISPR gRNA sequence
  source 1..20: mol_type = other DNA
ctggtttatactgagtcacg

SEQ ID NO: 95047 - DNA, 20 bp, synthetic construct
  misc_feature 1..20: note = CRISPR gRNA sequence
  source 1..20: mol_type = other DNA
tggtttatactgagtcacgt

SEQ ID NO: 95048 - DNA, 20 bp, synthetic construct
  misc_feature 1..20: note = CRISPR gRNA sequence
  source 1..20: mol_type = other DNA
gtttatactgagtcacgttt

SEQ ID NO: 95049 - DNA, 20 bp, synthetic construct
  misc_feature 1..20: note = CRISPR gRNA sequence
  source 1..20: mol_type = other DNA
atactgagtcacgtttcctc

SEQ ID NO: 95050 - DNA, 20 bp, synthetic construct
  misc_feature 1..20: note = CRISPR gRNA sequence
  source 1..20: mol_type = other DNA
tactgagtcacgtttcctct

SEQ ID NO: 95051 - DNA, 20 bp, synthetic construct
  misc_feature 1..20: note = CRISPR gRNA sequence
  source 1..20: mol_type = other DNA
agtcacgtttcctctgcaaa

SEQ ID NO: 95052 - DNA, 20 bp, synthetic construct
  misc_feature 1..20: note = CRISPR gRNA sequence
  source 1..20: mol_type = other DNA
cctctgcaaagcctttctgg

SEQ ID NO: 95053 - DNA, 20 bp, synthetic construct
  misc_feature 1..20: note = CRISPR gRNA sequence
  source 1..20: mol_type = other DNA
ctctgcaaagcctttctgga

SEQ ID NO: 95054 - DNA, 20 bp, synthetic construct
  misc_feature 1..20: note = CRISPR gRNA sequence
  source 1..20: mol_type = other DNA
tgcaaagcctttctggagta

SEQ ID NO: 95055 - DNA, 20 bp, synthetic construct
  misc_feature 1..20: note = CRISPR gRNA sequence
  source 1..20: mol_type = other DNA
caaagcctttctggagtatc

SEQ ID NO: 95056 - DNA, 20 bp, synthetic construct
  misc_feature 1..20: note = CRISPR gRNA sequence
  source 1..20: mol_type = other DNA
tctggagtatctcagcctac

SEQ ID NO: 95057 - DNA, 20 bp, synthetic construct
  misc_feature 1..20: note = CRISPR gRNA sequence
  source 1..20: mol_type = other DNA
ctggagtatctcagcctaca

SEQ ID NO: 95058 - DNA, 20 bp, synthetic construct
  misc_feature 1..20: note = CRISPR gRNA sequence
  source 1..20: mol_type = other DNA
tggagtatctcagcctacaa

SEQ ID NO: 95059 - DNA, 20 bp, synthetic construct
  misc_feature 1..20: note = CRISPR gRNA sequence
  source 1..20: mol_type = other DNA
gagtatctcagcctacaatg

SEQ ID NO: 95060 - DNA, 20 bp, synthetic construct
  misc_feature 1..20: note = CRISPR gRNA sequence
  source 1..20: mol_type = other DNA
agcctacaatgatctatcct

SEQ ID NO: 95061 - DNA, 20 bp, synthetic construct
  misc_feature 1..20: note = CRISPR gRNA sequence
  source 1..20: mol_type = other DNA
caatgatctatcctcctctg

SEQ ID NO: 95062 - DNA, 20 bp, synthetic construct
  misc_feature 1..20: note = CRISPR gRNA sequence
  source 1..20: mol_type = other DNA
tcctcctctgaactactaaa

SEQ ID NO: 95063 - DNA, 20 bp, synthetic construct
  misc_feature 1..20: note = CRISPR gRNA sequence
  source 1..20: mol_type = other DNA
ctctgaactactaaaaccgg

SEQ ID NO: 95064 - DNA, 20 bp, synthetic construct
  misc_feature 1..20: note = CRISPR gRNA sequence
  source 1..20: mol_type = other DNA
tgaactactaaaaccggact

SEQ ID NO: 95065 - DNA, 20 bp, synthetic construct
  misc_feature 1..20: note = CRISPR gRNA sequence
  source 1..20: mol_type = other DNA
aactactaaaaccggactat

SEQ ID NO: 95066 - DNA, 20 bp, synthetic construct
  misc_feature 1..20: note = CRISPR gRNA sequence
  source 1..20: mol_type = other DNA
ctaaaaccggactatacagt

SEQ ID NO: 95067 - DNA, 20 bp, synthetic construct
  misc_feature 1..20: note = CRISPR gRNA sequence
  source 1..20: mol_type = other DNA
aaaccggactatacagttgg

SEQ ID NO: 95068 - DNA, 20 bp, synthetic construct
  misc_feature 1..20: note = CRISPR gRNA sequence
  source 1..20: mol_type = other DNA
tacagttggctcttattata

SEQ ID NO: 95069 - DNA, 20 bp, synthetic construct
  misc_feature 1..20: note = CRISPR gRNA sequence
  source 1..20: mol_type = other DNA
gctcttattatatcctggct

SEQ ID NO: 95070 - DNA, 20 bp, synthetic construct
  misc_feature 1..20: note = CRISPR gRNA sequence
  source 1..20: mol_type = other DNA
ttattatatcctggctggca

SEQ ID NO: 95071 - DNA, 20 bp, synthetic construct
  misc_feature 1..20: note = CRISPR gRNA sequence
  source 1..20: mol_type = other DNA
attatatcctggctggcact

SEQ ID NO: 95072 - DNA, 20 bp, synthetic construct
  misc_feature 1..20: note = CRISPR gRNA sequence
  source 1..20: mol_type = other DNA
ttatatcctggctggcactg

SEQ ID NO: 95073 - DNA, 20 bp, synthetic construct
  misc_feature 1..20: note = CRISPR gRNA sequence
  source 1..20: mol_type = other DNA
tatcctggctggcactgtta

SEQ ID NO: 95074 - DNA, 20 bp, synthetic construct
  misc_feature 1..20: note = CRISPR gRNA sequence
  source 1..20: mol_type = other DNA
gctggcactgttattttctt

SEQ ID NO: 95075 - DNA, 20 bp, synthetic construct
  misc_feature 1..20: note = CRISPR gRNA sequence
  source 1..20: mol_type = other DNA
gcactgttattttctttaca

SEQ ID NO: 95076 - DNA, 20 bp, synthetic construct
  misc_feature 1..20: note = CRISPR gRNA sequence
  source 1..20: mol_type = other DNA
ttattttctttacactcagt

SEQ ID NO: 95077 - DNA, 20 bp, synthetic construct
  misc_feature 1..20: note = CRISPR gRNA sequence
  source 1..20: mol_type = other DNA
ttttctttacactcagttta

SEQ ID NO: 95078 - DNA, 20 bp, synthetic construct
  misc_feature 1..20: note = CRISPR gRNA sequence
  source 1..20: mol_type = other DNA
tctttacactcagtttaaca

SEQ ID NO: 95079 - DNA, 20 bp, synthetic construct
  misc_feature 1..20: note = CRISPR gRNA sequence
  source 1..20: mol_type = other DNA
ctttacactcagtttaacaa

SEQ ID NO: 95080 - DNA, 20 bp, synthetic construct
  misc_feature 1..20: note = CRISPR gRNA sequence
  source 1..20: mol_type = other DNA
tttacactcagtttaacaaa

SEQ ID NO: 95081 - DNA, 20 bp, synthetic construct
  misc_feature 1..20: note = CRISPR gRNA sequence
  source 1..20: mol_type = other DNA
tacactcagtttaacaaaga

SEQ ID NO: 95082 - DNA, 20 bp, synthetic construct
  misc_feature 1..20: note = CRISPR gRNA sequence
  source 1..20: mol_type = other DNA
acactcagtttaacaaagat

SEQ ID NO: 95083 - DNA, 20 bp, synthetic construct
  misc_feature 1..20: note = CRISPR gRNA sequence
  source 1..20: mol_type = other DNA
cactcagtttaacaaagata

SEQ ID NO: 95084 - DNA, 20 bp, synthetic construct
  misc_feature 1..20: note = CRISPR gRNA sequence
  source 1..20: mol_type = other DNA
agtttaacaaagataaagat

SEQ ID NO: 95085 - DNA, 20 bp, synthetic construct
  misc_feature 1..20: note = CRISPR gRNA sequence
  source 1..20: mol_type = other DNA
aacaaagataaagatttaca

SEQ ID NO: 95086 - DNA, 20 bp, synthetic construct
  misc_feature 1..20: note = CRISPR gRNA sequence
  source 1..20: mol_type = other DNA
acaaagataaagatttacag

SEQ ID NO: 95087 - DNA, 20 bp, synthetic construct
  misc_feature 1..20: note = CRISPR gRNA sequence
  source 1..20: mol_type = other DNA
acagatcttgttacctcctc

SEQ ID NO: 95088 - DNA, 20 bp, synthetic construct
  misc_feature 1..20: note = CRISPR gRNA sequence
  source 1..20: mol_type = other DNA
cagatcttgttacctcctca

SEQ ID NO: 95089 - DNA, 20 bp, synthetic construct
  misc_feature 1..20: note = CRISPR gRNA sequence
  source 1..20: mol_type = other DNA
gttacctcctcagaactgat

SEQ ID NO: 95090 - DNA, 20 bp, synthetic construct
  misc_feature 1..20: note = CRISPR gRNA sequence
  source 1..20: mol_type = other DNA
ttacctcctcagaactgata

SEQ ID NO: 95091 - DNA, 20 bp, synthetic construct
  misc_feature 1..20: note = CRISPR gRNA sequence
  source 1..20: mol_type = other DNA
cctcctcagaactgataaag

SEQ ID NO: 95092 - DNA, 20 bp, synthetic construct
  misc_feature 1..20: note = CRISPR gRNA sequence
  source 1..20: mol_type = other DNA
ctcagaactgataaagtatc

SEQ ID NO: 95093 - DNA, 20 bp, synthetic construct
  misc_feature 1..20: note = CRISPR gRNA sequence
  source 1..20: mol_type = other DNA
agaactgataaagtatccca

SEQ ID NO: 95094 - DNA, 20 bp, synthetic construct
  misc_feature 1..20: note = CRISPR gRNA sequence
  source 1..20: mol_type = other DNA
ataaagtatcccaaaatata

SEQ ID NO: 95095 - DNA, 20 bp, synthetic construct
  misc_feature 1..20: note = CRISPR gRNA sequence
  source 1..20: mol_type = other DNA
gatagtaaactattagtatt

SEQ ID NO: 95096 - DNA, 20 bp, synthetic construct
  misc_feature 1..20: note = CRISPR gRNA sequence
  source 1..20: mol_type = other DNA
ttagtattatttgttgctta

SEQ ID NO: 95097 - DNA, 20 bp, synthetic construct
  misc_feature 1..20: note = CRISPR gRNA sequence
  source 1..20: mol_type = other DNA
gtattatttgttgcttatag

SEQ ID NO: 95098 - DNA, 20 bp, synthetic construct
  misc_feature 1..20: note = CRISPR gRNA sequence
  source 1..20: mol_type = other DNA
tttgttgcttatagcaatta

SEQ ID NO: 95099 - DNA, 20 bp, synthetic construct
  misc_feature 1..20: note = CRISPR gRNA sequence
  source 1..20: mol_type = other DNA
gttgcttatagcaattaatt

SEQ ID NO: 95100 - DNA, 20 bp, synthetic construct
  misc_feature 1..20: note = CRISPR gRNA sequence
  source 1..20: mol_type = other DNA
ttgcttatagcaattaattc

SEQ ID NO: 95101 - DNA, 20 bp, synthetic construct
  misc_feature 1..20: note = CRISPR gRNA sequence
  source 1..20: mol_type = other DNA
cttatagcaattaattccct

SEQ ID NO: 95102 - DNA, 20 bp, synthetic construct
  misc_feature 1..20: note = CRISPR gRNA sequence
  source 1..20: mol_type = other DNA
atagcaattaattcccttcc

SEQ ID NO: 95103 - DNA, 20 bp, synthetic construct
  misc_feature 1..20: note = CRISPR gRNA sequence
  source 1..20: mol_type = other DNA
tagcaattaattcccttcca

SEQ ID NO: 95104 - DNA, 20 bp, synthetic construct
  misc_feature 1..20: note = CRISPR gRNA sequence
  source 1..20: mol_type = other DNA
attcccttccataaaaagtc

SEQ ID NO: 95105 - DNA, 20 bp, synthetic construct
  misc_feature 1..20: note = CRISPR gRNA sequence
  source 1..20: mol_type = other DNA
ccttccataaaaagtcatgc

SEQ ID NO: 95106 - DNA, 20 bp, synthetic construct
  misc_feature 1..20: note = CRISPR gRNA sequence
  source 1..20: mol_type = other DNA
ccataaaaagtcatgcaaat

SEQ ID NO: 95107 - DNA, 20 bp, synthetic construct
  misc_feature 1..20: note = CRISPR gRNA sequence
  source 1..20: mol_type = other DNA
cataaaaagtcatgcaaatt

SEQ ID NO: 95108 - DNA, 20 bp, synthetic construct
  misc_feature 1..20: note = CRISPR gRNA sequence
  source 1..20: mol_type = other DNA
ttttaaaatagtgaagctag

SEQ ID NO: 95109 - DNA, 20 bp, synthetic construct
  misc_feature 1..20: note = CRISPR gRNA sequence
  source 1..20: mol_type = other DNA
taaaatagtgaagctaggtg

SEQ ID NO: 95110 - DNA, 20 bp, synthetic construct
  misc_feature 1..20: note = CRISPR gRNA sequence
  source 1..20: mol_type = other DNA
aaaatagtgaagctaggtgc

SEQ ID NO: 95111 - DNA, 20 bp, synthetic construct
  misc_feature 1..20: note = CRISPR gRNA sequence
  source 1..20: mol_type = other DNA
aaatagtgaagctaggtgca

SEQ ID NO: 95112 - DNA, 20 bp, synthetic construct
  misc_feature 1..20: note = CRISPR gRNA sequence
  source 1..20: mol_type = other DNA
ggtgcagtggtgaaataatc

SEQ ID NO: 95113 - DNA, 20 bp, synthetic construct
  misc_feature 1..20: note = CRISPR gRNA sequence
  source 1..20: mol_type = other DNA
ctctgaaggctgaggcagga

SEQ ID NO: 95114 - DNA, 20 bp, synthetic construct
  misc_feature 1..20: note = CRISPR gRNA sequence
  source 1..20: mol_type = other DNA
tgaaggctgaggcaggagga

SEQ ID NO: 95115 - DNA, 20 bp, synthetic construct
  misc_feature 1..20: note = CRISPR gRNA sequence
  source 1..20: mol_type = other DNA
aaggctgaggcaggaggatc

SEQ ID NO: 95116 - DNA, 20 bp, synthetic construct
  misc_feature 1..20: note = CRISPR gRNA sequence
  source 1..20: mol_type = other DNA
aggcaggaggatcacttgag

SEQ ID NO: 95117 - DNA, 20 bp, synthetic construct
  misc_feature 1..20: note = CRISPR gRNA sequence
  source 1..20: mol_type = other DNA
gagcccaggaattcgaggcc

SEQ ID NO: 95118 - DNA, 20 bp, synthetic construct
  misc_feature 1..20: note = CRISPR gRNA sequence
  source 1..20: mol_type = other DNA
agcccaggaattcgaggcca

SEQ ID NO: 95119 - DNA, 20 bp, synthetic construct
  misc_feature 1..20: note = CRISPR gRNA sequence
  source 1..20: mol_type = other DNA
gaggccagcctgggcaacac

SEQ ID NO: 95120 - DNA, 20 bp, synthetic construct
  misc_feature 1..20: note = CRISPR gRNA sequence
  source 1..20: mol_type = other DNA
ggcaacactgtgagacccat

SEQ ID NO: 95121 - DNA, 20 bp, synthetic construct
  misc_feature 1..20: note = CRISPR gRNA sequence
  source 1..20: mol_type = other DNA
tgagacccatctctaaaaaa

SEQ ID NO: 95122 - DNA, 20 bp, synthetic construct
  misc_feature 1..20: note = CRISPR gRNA sequence
  source 1..20: mol_type = other DNA
taaaaaattagataagtaaa

SEQ ID NO: 95123 - DNA, 20 bp, synthetic construct
  misc_feature 1..20: note = CRISPR gRNA sequence
  source 1..20: mol_type = other DNA
aaaaattagataagtaaata

SEQ ID NO: 95124 - DNA, 20 bp, synthetic construct
  misc_feature 1..20: note = CRISPR gRNA sequence
  source 1..20: mol_type = other DNA
gataagtaaataaataacaa

SEQ ID NO: 95125 - DNA, 20 bp, synthetic construct
  misc_feature 1..20: note = CRISPR gRNA sequence
  source 1..20: mol_type = other DNA
tttttgtgggaggtgcagag

SEQ ID NO: 95126 - DNA, 20 bp, synthetic construct
  misc_feature 1..20: note = CRISPR gRNA sequence
  source 1..20: mol_type = other DNA
tttgtgggaggtgcagaggg

SEQ ID NO: 95127 - DNA, 20 bp, synthetic construct
  misc_feature 1..20: note = CRISPR gRNA sequence
  source 1..20: mol_type = other DNA
ttgtgggaggtgcagaggga

SEQ ID NO: 95128 - DNA, 20 bp, synthetic construct
  misc_feature 1..20: note = CRISPR gRNA sequence
  source 1..20: mol_type = other DNA
tgtgggaggtgcagagggag

SEQ ID NO: 95129 - DNA, 20 bp, synthetic construct
  misc_feature 1..20: note = CRISPR gRNA sequence
  source 1..20: mol_type = other DNA
gtgggaggtgcagagggaga

SEQ ID NO: 95130 - DNA, 20 bp, synthetic construct
  misc_feature 1..20: note = CRISPR gRNA sequence
  source 1..20: mol_type = other DNA
tgggaggtgcagagggagac

SEQ ID NO: 95131 - DNA, 20 bp, synthetic construct
  misc_feature 1..20: note = CRISPR gRNA sequence
  source 1..20: mol_type = other DNA
attcagtatctatctgcctt

SEQ ID NO: 95132 - DNA, 20 bp, synthetic construct
  misc_feature 1..20: note = CRISPR gRNA sequence
  source 1..20: mol_type = other DNA
agtatctatctgccttttat

SEQ ID NO: 95133 - DNA, 20 bp, synthetic construct
  misc_feature 1..20: note = CRISPR gRNA sequence
  source 1..20: mol_type = other DNA
tctgccttttatacattttc

SEQ ID NO: 95134 - DNA, 20 bp, synthetic construct
  misc_feature 1..20: note = CRISPR gRNA sequence
  source 1..20: mol_type = other DNA
ccttttatacattttcctca

SEQ ID NO: 95135 - DNA, 20 bp, synthetic construct
  misc_feature 1..20: note = CRISPR gRNA sequence
  source 1..20: mol_type = other DNA
ttatacattttcctcactgt

SEQ ID NO: 95136 - DNA, 20 bp, synthetic construct
  misc_feature 1..20: note = CRISPR gRNA sequence
  source 1..20: mol_type = other DNA
tatacattttcctcactgta

SEQ ID NO: 95137 - DNA, 20 bp, synthetic construct
  misc_feature 1..20: note = CRISPR gRNA sequence
  source 1..20: mol_type = other DNA
atacattttcctcactgtag

SEQ ID NO: 95138 - DNA, 20 bp, synthetic construct
  misc_feature 1..20: note = CRISPR gRNA sequence
  source 1..20: mol_type = other DNA
tacattttcctcactgtaga

SEQ ID NO: 95139 - DNA, 20 bp, synthetic construct
  misc_feature 1..20: note = CRISPR gRNA sequence
  source 1..20: mol_type = other DNA
tcctcactgtagatgtaaat

SEQ ID NO: 95140 - DNA, 20 bp, synthetic construct
  misc_feature 1..20: note = CRISPR gRNA sequence
  source 1..20: mol_type = other DNA
cctcactgtagatgtaaatg

SEQ ID NO: 95141 - DNA, 20 bp, synthetic construct
  misc_feature 1..20: note = CRISPR gRNA sequence
  source 1..20: mol_type = other DNA
ctcactgtagatgtaaatgt

SEQ ID NO: 95142 - DNA, 20 bp, synthetic construct
  misc_feature 1..20: note = CRISPR gRNA sequence
  source 1..20: mol_type = other DNA
actgtagatgtaaatgttag

SEQ ID NO: 95143 - DNA, 20 bp, synthetic construct
  misc_feature 1..20: note = CRISPR gRNA sequence
  source 1..20: mol_type = other DNA
tagatgtaaatgttaggtag

SEQ ID NO: 95144 - DNA, 20 bp, synthetic construct
  misc_feature 1..20: note = CRISPR gRNA sequence
  source 1..20: mol_type = other DNA
ggtagtttaaaaaaaaaaaa

SEQ ID NO: 95145 - DNA, 20 bp, synthetic construct
  misc_feature 1..20: note = CRISPR gRNA sequence
  source 1..20: mol_type = other DNA
aaaaaaaaaaaagtaagcag

SEQ ID NO: 95146 - DNA, 20 bp, synthetic construct
  misc_feature 1..20: note = CRISPR gRNA sequence
  source 1..20: mol_type = other DNA
aaaaaaaaaaagtaagcagc

SEQ ID NO: 95147 - DNA, 20 bp, synthetic construct
  misc_feature 1..20: note = CRISPR gRNA sequence
  source 1..20: mol_type = other DNA
actacttctttcttgaaaat

SEQ ID NO: 95148 - DNA, 20 bp, synthetic construct
  misc_feature 1..20: note = CRISPR gRNA sequence
  source 1..20: mol_type = other DNA
cttctttcttgaaaataagt

SEQ ID NO: 95149 - DNA, 20 bp, synthetic construct
  misc_feature 1..20: note = CRISPR gRNA sequence
  source 1..20: mol_type = other DNA
ctttcttgaaaataagtatt

SEQ ID NO: 95150 - DNA, 20 bp, synthetic construct
  misc_feature 1..20: note = CRISPR gRNA sequence
  source 1..20: mol_type = other DNA
tttcttgaaaataagtatta

SEQ ID NO: 95151 - DNA, 20 bp, synthetic construct
  misc_feature 1..20: note = CRISPR gRNA sequence
  source 1..20: mol_type = other DNA
tcttgaaaataagtattatt

SEQ ID NO: 95152 - DNA, 20 bp, synthetic construct
  misc_feature 1..20: note = CRISPR gRNA sequence
  source 1..20: mol_type = other DNA
cttgaaaataagtattatta

SEQ ID NO: 95153 - DNA, 20 bp, synthetic construct
  misc_feature 1..20: note = CRISPR gRNA sequence
  source 1..20: mol_type = other DNA
ttgaaaataagtattattag

SEQ ID NO: 95154 - DNA, 20 bp, synthetic construct
  misc_feature 1..20: note = CRISPR gRNA sequence
  source 1..20: mol_type = other DNA
gaaaataagtattattaggc

SEQ ID NO: 95155 - DNA, 20 bp, synthetic construct
  misc_feature 1..20: note = CRISPR gRNA sequence
  source 1..20: mol_type = other DNA
aaaataagtattattaggcc

SEQ ID NO: 95156 - DNA, 20 bp, synthetic construct
  misc_feature 1..20: note = CRISPR gRNA sequence
  source 1..20: mol_type = other DNA
ttaggccggcgtggtgggtc

SEQ ID NO: 95157 - DNA, 20 bp, synthetic construct
  misc_feature 1..20: note = CRISPR gRNA sequence
  source 1..20: mol_type = other DNA
ggccggcgtggtgggtctca

SEQ ID NO: 95158 - DNA, 20 bp, synthetic construct
  misc_feature 1..20: note = CRISPR gRNA sequence
  source 1..20: mol_type = other DNA
acccgtaatcccagcacttc

SEQ ID NO: 95159 - DNA, 20 bp, synthetic construct
  misc_feature 1..20: note = CRISPR gRNA sequence
  source 1..20: mol_type = other DNA
caggaggctgaggtgggagg

SEQ ID NO: 95160 - DNA, 20 bp, synthetic construct
  misc_feature 1..20: note = CRISPR gRNA sequence
  source 1..20: mol_type = other DNA
aggaggctgaggtgggagga

SEQ ID NO: 95161 - DNA, 20 bp, synthetic construct
  misc_feature 1..20: note = CRISPR gRNA sequence
  source 1..20: mol_type = other DNA
aggtgggaggatcaggagtt

SEQ ID NO: 95162 - DNA, 20 bp, synthetic construct
  misc_feature 1..20: note = CRISPR gRNA sequence
  source 1..20: mol_type = other DNA
gagaccagactggccaacat

SEQ ID NO: 95163 - DNA, 20 bp, synthetic construct
  misc_feature 1..20: note = CRISPR gRNA sequence
  source 1..20: mol_type = other DNA
gccaacatggcaaaaccgcg

SEQ ID NO: 95164 - DNA, 20 bp, synthetic construct
  misc_feature 1..20: note = CRISPR gRNA sequence
  source 1..20: mol_type = other DNA
tactaaaaatacaaaaatta

SEQ ID NO: 95165 - DNA, 20 bp, synthetic construct
  misc_feature 1..20: note = CRISPR gRNA sequence
  source 1..20: mol_type = other DNA
ctaaaaatacaaaaattagc

SEQ ID NO: 95166 - DNA, 20 bp, synthetic construct
  misc_feature 1..20: note = CRISPR gRNA sequence
  source 1..20: mol_type = other DNA
aaaatacaaaaattagccgg

SEQ ID NO: 95167 - DNA, 20 bp, synthetic construct
  misc_feature 1..20: note = CRISPR gRNA sequence
  source 1..20: mol_type = other DNA
gccgggcgtggtggtgcatg

SEQ ID NO: 95168 - DNA, 20 bp, synthetic construct
  misc_feature 1..20: note = CRISPR gRNA sequence
  source 1..20: mol_type = other DNA
taatcccagctactcaggag

SEQ ID NO: 95169 - DNA, 20 bp, synthetic construct
  misc_feature 1..20: note = CRISPR gRNA sequence
  source 1..20: mol_type = other DNA
ctcaggaggctgaggcacaa

SEQ ID NO: 95170 - DNA, 20 bp, synthetic construct
  misc_feature 1..20: note = CRISPR gRNA sequence
  source 1..20: mol_type = other DNA
aggaggctgaggcacaagaa

SEQ ID NO: 95171 - DNA, 20 bp, synthetic construct
  misc_feature 1..20: note = CRISPR gRNA sequence
  source 1..20: mol_type = other DNA
aggcacaagaactgcttgaa

SEQ ID NO: 95172 - DNA, 20 bp, synthetic construct
  misc_feature 1..20: note = CRISPR gRNA sequence
  source 1..20: mol_type = other DNA
cttgaacccaggaggtggag

SEQ ID NO: 95173 - DNA, 20 bp, synthetic construct
  misc_feature 1..20: note = CRISPR gRNA sequence
  source 1..20: mol_type = other DNA
gaacccaggaggtggaggtt

SEQ ID NO: 95174 - DNA, 20 bp, synthetic construct
  misc_feature 1..20: note = CRISPR gRNA sequence
  source 1..20: mol_type = other DNA
aacccaggaggtggaggttg

SEQ ID NO: 95175 - DNA, 20 bp, synthetic construct
  misc_feature 1..20: note = CRISPR gRNA sequence
  source 1..20: mol_type = other DNA
tagtgggccgagatcgcacc

SEQ ID NO: 95176 - DNA, 20 bp, synthetic construct
  misc_feature 1..20: note = CRISPR gRNA sequence
  source 1..20: mol_type = other DNA
cactccagcctgagcgacac

SEQ ID NO: 95177 - DNA, 20 bp, synthetic construct
  misc_feature 1..20: note = CRISPR gRNA sequence
  source 1..20: mol_type = other DNA
cagcctgagcgacacagagt

SEQ ID NO: 95178 - DNA, 20 bp, synthetic construct
  misc_feature 1..20: note = CRISPR gRNA sequence
  source 1..20: mol_type = other DNA
agcgacacagagtaagactc

SEQ ID NO: 95179 - DNA, 20 bp, synthetic construct
  misc_feature 1..20: note = CRISPR gRNA sequence
  source 1..20: mol_type = other DNA
tgtctcaaaaaaaaaaaaga

SEQ ID NO: 95180 - DNA, 20 bp, synthetic construct
  misc_feature 1..20: note = CRISPR gRNA sequence
  source 1..20: mol_type = other DNA
tctcaaaaaaaaaaaagaaa

SEQ ID NO: 95181 - DNA, 20 bp, synthetic construct
  misc_feature 1..20: note = CRISPR gRNA sequence
  source 1..20: mol_type = other DNA
aaaaaaaaaaaagaaagaaa

SEQ ID NO: 95182 - DNA, 20 bp, synthetic construct
  misc_feature 1..20: note = CRISPR gRNA sequence
  source 1..20: mol_type = other DNA
tttttctccctctctaaaga

SEQ ID NO: 95183 - DNA, 20 bp, synthetic construct
  misc_feature 1..20: note = CRISPR gRNA sequence
  source 1..20: mol_type = other DNA
ttctccctctctaaagaatt

SEQ ID NO: 95184 - DNA, 20 bp, synthetic construct
  misc_feature 1..20: note = CRISPR gRNA sequence
  source 1..20: mol_type = other DNA
tctccctctctaaagaattc

SEQ ID NO: 95185 - DNA, 20 bp, synthetic construct
  misc_feature 1..20: note = CRISPR gRNA sequence
  source 1..20: mol_type = other DNA
ctccctctctaaagaattct

SEQ ID NO: 95186 - DNA, 20 bp, synthetic construct
  misc_feature 1..20: note = CRISPR gRNA sequence
  source 1..20: mol_type = other DNA
tccctctctaaagaattctg

SEQ ID NO: 95187 - DNA, 20 bp, synthetic construct
  misc_feature 1..20: note = CRISPR gRNA sequence
  source 1..20: mol_type = other DNA
cctctctaaagaattctgaa

SEQ ID NO: 95188 - DNA, 20 bp, synthetic construct
  misc_feature 1..20: note = CRISPR gRNA sequence
  source 1..20: mol_type = other DNA
tctaaagaattctgaagtga

SEQ ID NO: 95189 - DNA, 20 bp, synthetic construct
  misc_feature 1..20: note = CRISPR gRNA sequence
  source 1..20: mol_type = other DNA
taaagaattctgaagtgaat

SEQ ID NO: 95190 - DNA, 20 bp, synthetic construct
  misc_feature 1..20: note = CRISPR gRNA sequence
  source 1..20: mol_type = other DNA
aagaattctgaagtgaatgg

SEQ ID NO: 95191 - DNA, 20 bp, synthetic construct
  misc_feature 1..20: note = CRISPR gRNA sequence
  source 1..20: mol_type = other DNA
tgaagtgaatgggcacctgt

SEQ ID NO: 95192 - DNA, 20 bp, synthetic construct
  misc_feature 1..20: note = CRISPR gRNA sequence
  source 1..20: mol_type = other DNA
aagtgaatgggcacctgtgg

SEQ ID NO: 95193 - DNA, 20 bp, synthetic construct
  misc_feature 1..20: note = CRISPR gRNA sequence
  source 1..20: mol_type = other DNA
tggaacatactgaggaagaa

SEQ ID NO: 95194 - DNA, 20 bp, synthetic construct
  misc_feature 1..20: note = CRISPR gRNA sequence
  source 1..20: mol_type = other DNA
aggaagaaacttgatcacct

SEQ ID NO: 95195 - DNA, 20 bp, synthetic construct
  misc_feature 1..20: note = CRISPR gRNA sequence
  source 1..20: mol_type = other DNA
gatcacctttactaactttc

SEQ ID NO: 95196 - DNA, 20 bp, synthetic construct
  misc_feature 1..20: note = CRISPR gRNA sequence
  source 1..20: mol_type = other DNA
atcacctttactaactttca

SEQ ID NO: 95197 - DNA, 20 bp, synthetic construct
  misc_feature 1..20: note = CRISPR gRNA sequence
  source 1..20: mol_type = other DNA
tactaactttcattcttttc

SEQ ID NO: 95198 - DNA, 20 bp, synthetic construct
  misc_feature 1..20: note = CRISPR gRNA sequence
  source 1..20: mol_type = other DNA
actaactttcattcttttcc

SEQ ID NO: 95199 - DNA, 20 bp, synthetic construct
  misc_feature 1..20: note = CRISPR gRNA sequence
  source 1..20: mol_type = other DNA
ctaactttcattcttttcca

SEQ ID NO: 95200 - DNA, 20 bp, synthetic construct
  misc_feature 1..20: note = CRISPR gRNA sequence
  source 1..20: mol_type = other DNA
actttcattcttttccagat

SEQ ID NO: 95201 - DNA, 20 bp, synthetic construct
  misc_feature 1..20: note = CRISPR gRNA sequence
  source 1..20: mol_type = other DNA
tcattcttttccagatgctt

SEQ ID NO: 95202 - DNA, 20 bp, synthetic construct
  misc_feature 1..20: note = CRISPR gRNA sequence
  source 1..20: mol_type = other DNA
cattcttttccagatgctta

SEQ ID NO: 95203 - DNA, 20 bp, synthetic construct
  misc_feature 1..20: note = CRISPR gRNA sequence
  source 1..20: mol_type = other DNA
attcttttccagatgcttat

SEQ ID NO: 95204 - DNA, 20 bp, synthetic construct
  misc_feature 1..20: note = CRISPR gRNA sequence
  source 1..20: mol_type = other DNA
ttttccagatgcttatttcc

SEQ ID NO: 95205 - DNA, 20 bp, synthetic construct
  misc_feature 1..20: note = CRISPR gRNA sequence
  source 1..20: mol_type = other DNA
ttccagatgcttatttccct

SEQ ID NO: 95206 - DNA, 20 bp, synthetic construct
  misc_feature 1..20: note = CRISPR gRNA sequence
  source 1..20: mol_type = other DNA
tccagatgcttatttcccta

SEQ ID NO: 95207 - DNA, 20 bp, synthetic construct
  misc_feature 1..20: note = CRISPR gRNA sequence
  source 1..20: mol_type = other DNA
ccagatgcttatttccctaa

SEQ ID NO: 95208 - DNA, 20 bp, synthetic construct
  misc_feature 1..20: note = CRISPR gRNA sequence
  source 1..20: mol_type = other DNA
cagatgcttatttccctaaa

SEQ ID NO: 95209 - DNA, 20 bp, synthetic construct
  misc_feature 1..20: note = CRISPR gRNA sequence
  source 1..20: mol_type = other DNA
atttccctaaatccccgtaa

SEQ ID NO: 95210 - DNA, 20 bp, synthetic construct
  misc_feature 1..20: note = CRISPR gRNA sequence
  source 1..20: mol_type = other DNA
tttccctaaatccccgtaat

SEQ ID NO: 95211 - DNA, 20 bp, synthetic construct
  misc_feature 1..20: note = CRISPR gRNA sequence
  source 1..20: mol_type = other DNA
ccctaaatccccgtaatcag

SEQ ID NO: 95212 - DNA, 20 bp, synthetic construct
  misc_feature 1..20: note = CRISPR gRNA sequence
  source 1..20: mol_type = other DNA
cctaaatccccgtaatcaga

SEQ ID NO: 95213 - DNA, 20 bp, synthetic construct
  misc_feature 1..20: note = CRISPR gRNA sequence
  source 1..20: mol_type = other DNA
aatccccgtaatcagagatt

SEQ ID NO: 95214 - DNA, 20 bp, synthetic construct
  misc_feature 1..20: note = CRISPR gRNA sequence
  source 1..20: mol_type = other DNA
ggtaaaacatactataagaa

SEQ ID NO: 95215 - DNA, 20 bp, synthetic construct
  misc_feature 1..20: note = CRISPR gRNA sequence
  source 1..20: mol_type = other DNA
gtaaaacatactataagaat

SEQ ID NO: 95216 - DNA, 20 bp, synthetic construct
  misc_feature 1..20: note = CRISPR gRNA sequence
  source 1..20: mol_type = other DNA
taagaatatggattgagggg

SEQ ID NO: 95217 - DNA, 20 bp, synthetic construct
  misc_feature 1..20: note = CRISPR gRNA sequence
  source 1..20: mol_type = other DNA
agggggtttttaaactaaga

SEQ ID NO: 95218 - DNA, 20 bp, synthetic construct
  misc_feature 1..20: note = CRISPR gRNA sequence
  source 1..20: mol_type = other DNA
ttaaactaagattacagaag

SEQ ID NO: 95219 - DNA, 20 bp, synthetic construct
  misc_feature 1..20: note = CRISPR gRNA sequence
  source 1..20: mol_type = other DNA
taaactaagattacagaagt

SEQ ID NO: 95220 - DNA, 20 bp, synthetic construct
  misc_feature 1..20: note = CRISPR gRNA sequence
  source 1..20: mol_type = other DNA
aaactaagattacagaagtc

SEQ ID NO: 95221 - DNA, 20 bp, synthetic construct
  misc_feature 1..20: note = CRISPR gRNA sequence
  source 1..20: mol_type = other DNA
aactaagattacagaagtcc

SEQ ID NO: 95222 - DNA, 20 bp, synthetic construct
  misc_feature 1..20: note = CRISPR gRNA sequence
  source 1..20: mol_type = other DNA
agattacagaagtcctgagc

SEQ ID NO: 95223 - DNA, 20 bp, synthetic construct
  misc_feature 1..20: note = CRISPR gRNA sequence
  source 1..20: mol_type = other DNA
cagaagtcctgagcccatta

SEQ ID NO: 95224 - DNA, 20 bp, synthetic construct
  misc_feature 1..20: note = CRISPR gRNA sequence
  source 1..20: mol_type = other DNA
agcccattaattagtatgca

SEQ ID NO: 95225 - DNA, 20 bp, synthetic construct
  misc_feature 1..20: note = CRISPR gRNA sequence
  source 1..20: mol_type = other DNA
attagtatgcaaaattaaag

SEQ ID NO: 95226 - DNA, 20 bp, synthetic construct
  misc_feature 1..20: note = CRISPR gRNA sequence
  source 1..20: mol_type = other DNA
gtatgcaaaattaaagttac

SEQ ID NO: 95227 - DNA, 20 bp, synthetic construct
  misc_feature 1..20: note = CRISPR gRNA sequence
  source 1..20: mol_type = other DNA
aagttacatagtggattttt

SEQ ID NO: 95228 - DNA, 20 bp, synthetic construct
  misc_feature 1..20: note = CRISPR gRNA sequence
  source 1..20: mol_type = other DNA
catagtggatttttctagga

SEQ ID NO: 95229 - DNA, 20 bp, synthetic construct
  misc_feature 1..20: note = CRISPR gRNA sequence
  source 1..20: mol_type = other DNA
ttctaggaagagtcttcatt

SEQ ID NO: 95230 - DNA, 20 bp, synthetic construct
  misc_feature 1..20: note = CRISPR gRNA sequence
  source 1..20: mol_type = other DNA
tctaggaagagtcttcatta

SEQ ID NO: 95231 - DNA, 20 bp, synthetic construct
  misc_feature 1..20: note = CRISPR gRNA sequence
  source 1..20: mol_type = other DNA
ctaggaagagtcttcattaa

SEQ ID NO: 95232 - DNA, 20 bp, synthetic construct
  misc_feature 1..20: note = CRISPR gRNA sequence
  source 1..20: mol_type = other DNA
taggaagagtcttcattaag

SEQ ID NO: 95233 - DNA, 20 bp, synthetic construct
  misc_feature 1..20: note = CRISPR gRNA sequence
  source 1..20: mol_type = other DNA
ggaagagtcttcattaagtc

SEQ ID NO: 95234 - DNA, 20 bp, synthetic construct
  misc_feature 1..20: note = CRISPR gRNA sequence
  source 1..20: mol_type = other DNA
cattaagtcaccagaccctc

SEQ ID NO: 95235 - DNA, 20 bp, synthetic construct
  misc_feature 1..20: note = CRISPR gRNA sequence
  source 1..20: mol_type = other DNA
attaagtcaccagaccctca

SEQ ID NO: 95236 - DNA, 20 bp, synthetic construct
  misc_feature 1..20: note = CRISPR gRNA sequence
  source 1..20: mol_type = other DNA
agtcaccagaccctcaaaga

SEQ ID NO: 95237 - DNA, 20 bp, synthetic construct
  misc_feature 1..20: note = CRISPR gRNA sequence
  source 1..20: mol_type = other DNA
aaagaagtcctcttactcca

SEQ ID NO: 95238 - DNA, 20 bp, synthetic construct
  misc_feature 1..20: note = CRISPR gRNA sequence
  source 1..20: mol_type = other DNA
ttactccaaaagagtaaaac

SEQ ID NO: 95239 - DNA, 20 bp, synthetic construct
  misc_feature 1..20: note = CRISPR gRNA sequence
  source 1..20: mol_type = other DNA
actccaaaagagtaaaactt

SEQ ID NO: 95240 - DNA, 20 bp, synthetic construct
  misc_feature 1..20: note = CRISPR gRNA sequence
  source 1..20: mol_type = other DNA
ctccaaaagagtaaaactta

SEQ ID NO: 95241 - DNA, 20 bp, synthetic construct
  misc_feature 1..20: note = CRISPR gRNA sequence
  source 1..20: mol_type = other DNA
caaaagagtaaaacttaagg

SEQ ID NO: 95242 - DNA, 20 bp, synthetic construct
  misc_feature 1..20: note = CRISPR gRNA sequence
  source 1..20: mol_type = other DNA
aagggaaagagaagtcactc

SEQ ID NO: 95243 - DNA, 20 bp, synthetic construct
  misc_feature 1..20: note = CRISPR gRNA sequence
  source 1..20: mol_type = other DNA
agggaaagagaagtcactca

SEQ ID NO: 95244 - DNA, 20 bp, synthetic construct
  misc_feature 1..20: note = CRISPR gRNA sequence
  source 1..20: mol_type = other DNA
agtcctaaccagtgtgaatt

SEQ ID NO: 95245 - DNA, 20 bp, synthetic construct
  misc_feature 1..20: note = CRISPR gRNA sequence
  source 1..20: mol_type = other DNA
accagtgtgaattaagtatg

SEQ ID NO: 95246 - DNA, 20 bp, synthetic construct
  misc_feature 1..20: note = CRISPR gRNA sequence
  source 1..20: mol_type = other DNA
agtatgacacactggcaact

SEQ ID NO: 95247 - DNA, 20 bp, synthetic construct
  misc_feature 1..20: note = CRISPR gRNA sequence
  source 1..20: mol_type = other DNA
gcaactgcaaattttagaaa

SEQ ID NO: 95248 - DNA, 20 bp, synthetic construct
  misc_feature 1..20: note = CRISPR gRNA sequence
  source 1..20: mol_type = other DNA
caaattttagaaatatttag

SEQ ID NO: 95249 - DNA, 20 bp, synthetic construct
  misc_feature 1..20: note = CRISPR gRNA sequence
  source 1..20: mol_type = other DNA
tagaaatatttagaatatta

SEQ ID NO: 95250 - DNA, 20 bp, synthetic construct
  misc_feature 1..20: note = CRISPR gRNA sequence
  source 1..20: mol_type = other DNA
agaaatatttagaatattat

SEQ ID NO: 95251 - DNA, 20 bp, synthetic construct
  misc_feature 1..20: note = CRISPR gRNA sequence
  source 1..20: mol_type = other DNA
gaaatatttagaatattata

SEQ ID NO: 95252 - DNA, 20 bp, synthetic construct
  misc_feature 1..20: note = CRISPR gRNA sequence
  source 1..20: mol_type = other DNA
agaatattatactttttgtt

SEQ ID NO: 95253 - DNA, 20 bp, synthetic construct
  misc_feature 1..20: note = CRISPR gRNA sequence
  source 1..20: mol_type = other DNA
gaatattatactttttgttt

SEQ ID NO: 95254 - DNA, 20 bp, synthetic construct
  misc_feature 1..20: note = CRISPR gRNA sequence
  source 1..20: mol_type = other DNA
tactttttgtttttgagaca

SEQ ID NO: 95255 - DNA, 20 bp, synthetic construct
  misc_feature 1..20: note = CRISPR gRNA sequence
  source 1..20: mol_type = other DNA
tttgtttttgagacaaagtc

SEQ ID NO: 95256 - DNA, 20 bp, synthetic construct
  misc_feature 1..20: note = CRISPR gRNA sequence
  source 1..20: mol_type = other DNA
ttgtttttgagacaaagtct

SEQ ID NO: 95257 - DNA, 20 bp, synthetic construct
  misc_feature 1..20: note = CRISPR gRNA sequence
  source 1..20: mol_type = other DNA
tgtttttgagacaaagtctt

SEQ ID NO: 95258 - DNA, 20 bp, synthetic construct
  misc_feature 1..20: note = CRISPR gRNA sequence
  source 1..20: mol_type = other DNA
gtttttgagacaaagtcttg

SEQ ID NO: 95259 - DNA, 20 bp, synthetic construct
  misc_feature 1..20: note = CRISPR gRNA sequence
  source 1..20: mol_type = other DNA
tttttgagacaaagtcttgc

SEQ ID NO: 95260 - DNA, 20 bp, synthetic construct
  misc_feature 1..20: note = CRISPR gRNA sequence
  source 1..20: mol_type = other DNA
ttgagacaaagtcttgctct

SEQ ID NO: 95261 - DNA, 20 bp, synthetic construct
  misc_feature 1..20: note = CRISPR gRNA sequence
  source 1..20: mol_type = other DNA
tgagacaaagtcttgctctg

SEQ ID NO: 95262 - DNA, 20 bp, synthetic construct
  misc_feature 1..20: note = CRISPR gRNA sequence
  source 1..20: mol_type = other DNA
gagacaaagtcttgctctgt

SEQ ID NO: 95263 - DNA, 20 bp, synthetic construct
  misc_feature 1..20: note = CRISPR gRNA sequence
  source 1..20: mol_type = other DNA
agacaaagtcttgctctgtc

SEQ ID NO: 95264 - DNA, 20 bp, synthetic construct
  misc_feature 1..20: note = CRISPR gRNA sequence
  source 1..20: mol_type = other DNA
gctctgtcacccaggctgga

SEQ ID NO: 95265 - DNA, 20 bp, synthetic construct
  misc_feature 1..20: note = CRISPR gRNA sequence
  source 1..20: mol_type = other DNA
ctctgtcacccaggctggag

SEQ ID NO: 95266 - DNA, 20 bp, synthetic construct
  misc_feature 1..20: note = CRISPR gRNA sequence
  source 1..20: mol_type = other DNA
tgtcacccaggctggagtga

SEQ ID NO: 95267 - DNA, 20 bp, synthetic construct
  misc_feature 1..20: note = CRISPR gRNA sequence
  source 1..20: mol_type = other DNA
tcacccaggctggagtgaag

SEQ ID NO: 95268 - DNA, 20 bp, synthetic construct
  misc_feature 1..20: note = CRISPR gRNA sequence
  source 1..20: mol_type = other DNA
gagtgaagtagcacaaccat

SEQ ID NO: 95269 - DNA, 20 bp, synthetic construct
  misc_feature 1..20: note = CRISPR gRNA sequence
  source 1..20: mol_type = other DNA
actgcagcctcaatctcctg

SEQ ID NO: 95270 - DNA, 20 bp, synthetic construct
  misc_feature 1..20: note = CRISPR gRNA sequence
  source 1..20: mol_type = other DNA
cagcctcaatctcctgggct

SEQ ID NO: 95271 - DNA, 20 bp, synthetic construct
  misc_feature 1..20: note = CRISPR gRNA sequence
  source 1..20: mol_type = other DNA
aatctcctgggctcaatgat

SEQ ID NO: 95272 - DNA, 20 bp, synthetic construct
  misc_feature 1..20: note = CRISPR gRNA sequence
  source 1..20: mol_type = other DNA
ctgggctcaatgatccttcc

SEQ ID NO: 95273 - DNA, 20 bp, synthetic construct
  misc_feature 1..20: note = CRISPR gRNA sequence
  source 1..20: mol_type = other DNA
ggctcaatgatccttccacc

SEQ ID NO: 95274 - DNA, 20 bp, synthetic construct
  misc_feature 1..20: note = CRISPR gRNA sequence
  source 1..20: mol_type = other DNA
aatgatccttccacctcagc

SEQ ID NO: 95275 - DNA, 20 bp, synthetic construct
  misc_feature 1..20: note = CRISPR gRNA sequence
  source 1..20: mol_type = other DNA
ccacctcagcctcccgagta

SEQ ID NO: 95276 - DNA, 20 bp, synthetic construct
  misc_feature 1..20: note = CRISPR gRNA sequence
  source 1..20: mol_type = other DNA
cacctcagcctcccgagtag

SEQ ID NO: 95277 - DNA, 20 bp, synthetic construct
  misc_feature 1..20: note = CRISPR gRNA sequence
  source 1..20: mol_type = other DNA
agcctcccgagtagctagga

SEQ ID NO: 95278 - DNA, 20 bp, synthetic construct
  misc_feature 1..20: note = CRISPR gRNA sequence
  source 1..20: mol_type = other DNA
ccgagtagctaggaccacag

SEQ ID NO: 95279 - DNA, 20 bp, synthetic construct
  misc_feature 1..20: note = CRISPR gRNA sequence
  source 1..20: mol_type = other DNA
ggaccacaggcatgtgccaa

SEQ ID NO: 95280 - DNA, 20 bp, synthetic construct
  misc_feature 1..20: note = CRISPR gRNA sequence
  source 1..20: mol_type = other DNA
gctaatttttaaaatttttt

SEQ ID NO: 95281 - DNA, 20 bp, synthetic construct
  misc_feature 1..20: note = CRISPR gRNA sequence
  source 1..20: mol_type = other DNA
atttttaaaatttttttgtt

SEQ ID NO: 95282 - DNA, 20 bp, synthetic construct
  misc_feature 1..20: note = CRISPR gRNA sequence
  source 1..20: mol_type = other DNA
ttaaaatttttttgttgaga

SEQ ID NO: 95283 - DNA, 20 bp, synthetic construct
  misc_feature 1..20: note = CRISPR gRNA sequence
  source 1..20: mol_type = other DNA
taaaatttttttgttgagat

SEQ ID NO: 95284 - DNA, 20 bp, synthetic construct
  misc_feature 1..20: note = CRISPR gRNA sequence
  source 1..20: mol_type = other DNA
aaaatttttttgttgagatg

SEQ ID NO: 95285 - DNA, 20 bp, synthetic construct
  misc_feature 1..20: note = CRISPR gRNA sequence
  source 1..20: mol_type = other DNA
aaatttttttgttgagatgg

SEQ ID NO: 95286 - DNA, 20 bp, synthetic construct
  misc_feature 1..20: note = CRISPR gRNA sequence
  source 1..20: mol_type = other DNA
ttttgttgagatggggtctc

SEQ ID NO: 95287 - DNA, 20 bp, synthetic construct
  misc_feature 1..20: note = CRISPR gRNA sequence
  source 1..20: mol_type = other DNA
tttgttgagatggggtctcc

SEQ ID NO: 95288 - DNA, 20 bp, synthetic construct
  misc_feature 1..20: note = CRISPR gRNA sequence
  source 1..20: mol_type = other DNA
ttgttgagatggggtctccc

SEQ ID NO: 95289 - DNA, 20 bp, synthetic construct
  misc_feature 1..20: note = CRISPR gRNA sequence
  source 1..20: mol_type = other DNA
tgttgagatggggtctccct

SEQ ID NO: 95290 - DNA, 20 bp, synthetic construct
  misc_feature 1..20: note = CRISPR gRNA sequence
  source 1..20: mol_type = other DNA
gttgagatggggtctcccta

SEQ ID NO: 95291 - DNA, 20 bp, synthetic construct
  misc_feature 1..20: note = CRISPR gRNA sequence
  source 1..20: mol_type = other DNA
ttgagatggggtctccctat

SEQ ID NO: 95292 - DNA, 20 bp, synthetic construct
  misc_feature 1..20: note = CRISPR gRNA sequence
  source 1..20: mol_type = other DNA
agatggggtctccctatgtt

SEQ ID NO: 95293 - DNA, 20 bp, synthetic construct
  misc_feature 1..20: note = CRISPR gRNA sequence
  source 1..20: mol_type = other DNA
cctatgttacccaggctggt

SEQ ID NO: 95294 - DNA, 20 bp, synthetic construct
  misc_feature 1..20: note = CRISPR gRNA sequence
  source 1..20: mol_type = other DNA
tgttacccaggctggtctca

SEQ ID NO: 95295 - DNA, 20 bp, synthetic construct
  misc_feature 1..20: note = CRISPR gRNA sequence
  source 1..20: mol_type = other DNA
cccaggctggtctcaaactt

SEQ ID NO: 95296 - DNA, 20 bp, synthetic construct
  misc_feature 1..20: note = CRISPR gRNA sequence
  source 1..20: mol_type = other DNA
gtctcaaacttccgggctca

SEQ ID NO: 95297 - DNA, 20 bp, synthetic construct
  misc_feature 1..20: note = CRISPR gRNA sequence
  source 1..20: mol_type = other DNA
aaacttccgggctcaagcga

SEQ ID NO: 95298 - DNA, 20 bp, synthetic construct
  misc_feature 1..20: note = CRISPR gRNA sequence
  source 1..20: mol_type = other DNA
ccgggctcaagcgatcctcc

SEQ ID NO: 95299 - DNA, 20 bp, synthetic construct
  misc_feature 1..20: note = CRISPR gRNA sequence
  source 1..20: mol_type = other DNA
cgggctcaagcgatcctccc

SEQ ID NO: 95300 - DNA, 20 bp, synthetic construct
  misc_feature 1..20: note = CRISPR gRNA sequence
  source 1..20: mol_type = other DNA
aagcgatcctccctcctagg

SEQ ID NO: 95301 - DNA, 20 bp, synthetic construct
  misc_feature 1..20: note = CRISPR gRNA sequence
  source 1..20: mol_type = other DNA
cctcctaggcctccccaagt

SEQ ID NO: 95302 - DNA, 20 bp, synthetic construct
  misc_feature 1..20: note = CRISPR gRNA sequence
  source 1..20: mol_type = other DNA
ctaggcctccccaagttctg

SEQ ID NO: 95303 - DNA, 20 bp, synthetic construct
  misc_feature 1..20: note = CRISPR gRNA sequence
  source 1..20: mol_type = other DNA
ggcctccccaagttctgggc

SEQ ID NO: 95304 - DNA, 20 bp, synthetic construct
  misc_feature 1..20: note = CRISPR gRNA sequence
  source 1..20: mol_type = other DNA
cccaagttctgggcttacag

SEQ ID NO: 95305 - DNA, 20 bp, synthetic construct
  misc_feature 1..20: note = CRISPR gRNA sequence
  source 1..20: mol_type = other DNA
tgggcttacaggtattagcc

SEQ ID NO: 95306 - DNA, 20 bp, synthetic construct
  misc_feature 1..20: note = CRISPR gRNA sequence
  source 1..20: mol_type = other DNA
ggcttacaggtattagccac

SEQ ID NO: 95307 - DNA, 20 bp, synthetic construct
  misc_feature 1..20: note = CRISPR gRNA sequence
  source 1..20: mol_type = other DNA
acaggtattagccactgagc

SEQ ID NO: 95308 - DNA, 20 bp, synthetic construct
  misc_feature 1..20: note = CRISPR gRNA sequence
  source 1..20: mol_type = other DNA
caggtattagccactgagcc

SEQ ID NO: 95309 - DNA, 20 bp, synthetic construct
  misc_feature 1..20: note = CRISPR gRNA sequence
  source 1..20: mol_type = other DNA
gccactgagcctggcctaga

SEQ ID NO: 95310 - DNA, 20 bp, synthetic construct
  misc_feature 1..20: note = CRISPR gRNA sequence
  source 1..20: mol_type = other DNA
agcctggcctagaacattac

SEQ ID NO: 95311 - DNA, 20 bp, synthetic construct
  misc_feature 1..20: note = CRISPR gRNA sequence
  source 1..20: mol_type = other DNA
gcctagaacattacatttgt

SEQ ID NO: 95312 - DNA, 20 bp, synthetic construct
  misc_feature 1..20: note = CRISPR gRNA sequence
  source 1..20: mol_type = other DNA
gaacattacatttgtaaaca

SEQ ID NO: 95313 - DNA, 20 bp, synthetic construct
  misc_feature 1..20: note = CRISPR gRNA sequence
  source 1..20: mol_type = other DNA
catttgtaaacaattacaag

SEQ ID NO: 95314 - DNA, 20 bp, synthetic construct
  misc_feature 1..20: note = CRISPR gRNA sequence
  source 1..20: mol_type = other DNA
gtaaacaattacaaggtcta

SEQ ID NO: 95315 - DNA, 20 bp, synthetic construct
  misc_feature 1..20: note = CRISPR gRNA sequence
  source 1..20: mol_type = other DNA
taaacaattacaaggtctaa

SEQ ID NO: 95316 - DNA, 20 bp, synthetic construct
  misc_feature 1..20: note = CRISPR gRNA sequence
  source 1..20: mol_type = other DNA
caaggtctaatattttagtg

SEQ ID NO: 95317 - DNA, 20 bp, synthetic construct
  misc_feature 1..20: note = CRISPR gRNA sequence
  source 1..20: mol_type = other DNA
atattttagtgatggagcac

SEQ ID NO: 95318 - DNA, 20 bp, synthetic construct
  misc_feature 1..20: note = CRISPR gRNA sequence
  source 1..20: mol_type = other DNA
tagtgatggagcacttcaag

SEQ ID NO: 95319 - DNA, 20 bp, synthetic construct
  misc_feature 1..20: note = CRISPR gRNA sequence
  source 1..20: mol_type = other DNA
agtgatggagcacttcaagt

SEQ ID NO: 95320 - DNA, 20 bp, synthetic construct
  misc_feature 1..20: note = CRISPR gRNA sequence
  source 1..20: mol_type = other DNA
gtgatggagcacttcaagtt

SEQ ID NO: 95321 - DNA, 20 bp, synthetic construct
  misc_feature 1..20: note = CRISPR gRNA sequence
  source 1..20: mol_type = other DNA
caagttcagcctgaaactaa

SEQ ID NO: 95322 - DNA, 20 bp, synthetic construct
  misc_feature 1..20: note = CRISPR gRNA sequence
  source 1..20: mol_type = other DNA
aagttcagcctgaaactaag

SEQ ID NO: 95323 - DNA, 20 bp, synthetic construct
  misc_feature 1..20: note = CRISPR gRNA sequence
  source 1..20: mol_type = other DNA
agcctgaaactaagaaattt

SEQ ID NO: 95324 - DNA, 20 bp, synthetic construct
  misc_feature 1..20: note = CRISPR gRNA sequence
  source 1..20: mol_type = other DNA
aaactaagaaatttaaagac

SEQ ID NO: 95325 - DNA, 20 bp, synthetic construct
  misc_feature 1..20: note = CRISPR gRNA sequence
  source 1..20: mol_type = other DNA
agaaatttaaagacttagaa

SEQ ID NO: 95326 - DNA, 20 bp, synthetic construct
  misc_feature 1..20: note = CRISPR gRNA sequence
  source 1..20: mol_type = other DNA
aaagacttagaatacatcct

SEQ ID NO: 95327 - DNA, 20 bp, synthetic construct
  misc_feature 1..20: note = CRISPR gRNA sequence
  source 1..20: mol_type = other DNA
aagacttagaatacatccta

SEQ ID NO: 95328 - DNA, 20 bp, synthetic construct
  misc_feature 1..20: note = CRISPR gRNA sequence
  source 1..20: mol_type = other DNA
agaatacatcctaggaccct

SEQ ID NO: 95329 - DNA, 20 bp, synthetic construct
  misc_feature 1..20: note = CRISPR gRNA sequence
  source 1..20: mol_type = other DNA
gaatacatcctaggacccta

SEQ ID NO: 95330 - DNA, 20 bp, synthetic construct
  misc_feature 1..20: note = CRISPR gRNA sequence
  source 1..20: mol_type = other DNA
ggaccctaagacagcttgca

SEQ ID NO: 95331 - DNA, 20 bp, synthetic construct
  misc_feature 1..20: note = CRISPR gRNA sequence
  source 1..20: mol_type = other DNA
agacagcttgcagttaaaaa

SEQ ID NO: 95332 - DNA, 20 bp, synthetic construct
  misc_feature 1..20: note = CRISPR gRNA sequence
  source 1..20: mol_type = other DNA
gcagttaaaaaaaatttttt

SEQ ID NO: 95333 - DNA, 20 bp, synthetic construct
  misc_feature 1..20: note = CRISPR gRNA sequence
  source 1..20: mol_type = other DNA
cagttaaaaaaaattttttt

SEQ ID NO: 95334 - DNA, 20 bp, synthetic construct
  misc_feature 1..20: note = CRISPR gRNA sequence
  source 1..20: mol_type = other DNA
aaaaaaattttttttttttt

SEQ ID NO: 95335 - DNA, 20 bp, synthetic construct
  misc_feature 1..20: note = CRISPR gRNA sequence
  source 1..20: mol_type = other DNA
tttttttttttttttttttt

SEQ ID NO: 95336 - DNA, 20 bp, synthetic construct
  misc_feature 1..20: note = CRISPR gRNA sequence
  source 1..20: mol_type = other DNA
tttttttttttttttttttt

SEQ ID NO: 95337 - DNA, 20 bp, synthetic construct
  misc_feature 1..20: note = CRISPR gRNA sequence
  source 1..20: mol_type = other DNA
tttttttttttttttttttt

SEQ ID NO: 95338 - DNA, 20 bp, synthetic construct
  misc_feature 1..20: note = CRISPR gRNA sequence
  source 1..20: mol_type = other DNA
tttttttttttttttttttt

SEQ ID NO: 95339 - DNA, 20 bp, synthetic construct
  misc_feature 1..20: note = CRISPR gRNA sequence
  source 1..20: mol_type = other DNA
tttttttttttttttttttt

SEQ ID NO: 95340 - DNA, 20 bp, synthetic construct
  misc_feature 1..20: note = CRISPR gRNA sequence
  source 1..20: mol_type = other DNA
tttttttttttttttttttt

SEQ ID NO: 95341 - DNA, 20 bp, synthetic construct
  misc_feature 1..20: note = CRISPR gRNA sequence
  source 1..20: mol_type = other DNA
ttttttttttttttttttta

SEQ ID NO: 95342 - DNA, 20 bp, synthetic construct
  misc_feature 1..20: note = CRISPR gRNA sequence
  source 1..20: mol_type = other DNA
ttttttttttttttttttaa

SEQ ID NO: 95343 - DNA, 20 bp, synthetic construct
  misc_feature 1..20: note = CRISPR gRNA sequence
  source 1..20: mol_type = other DNA
tttttttttttttttttaag

SEQ ID NO: 95344 - DNA, 20 bp, synthetic construct
  misc_feature 1..20: note = CRISPR gRNA sequence
  source 1..20: mol_type = other DNA
ttttttttttttttttaagg

SEQ ID NO: 95345 - DNA, 20 bp, synthetic construct
  misc_feature 1..20: note = CRISPR gRNA sequence
  source 1..20: mol_type = other DNA
tttttttttttttttaagga

SEQ ID NO: 95346 - DNA, 20 bp, synthetic construct
  misc_feature 1..20: note = CRISPR gRNA sequence
  source 1..20: mol_type = other DNA
ttttttttttttttaaggag

SEQ ID NO: 95347 - DNA, 20 bp, synthetic construct
  misc_feature 1..20: note = CRISPR gRNA sequence
  source 1..20: mol_type = other DNA
tttttttttttttaaggaga

SEQ ID NO: 95348 - DNA, 20 bp, synthetic construct
  misc_feature 1..20: note = CRISPR gRNA sequence
  source 1..20: mol_type = other DNA
ttttttttttttaaggagac

SEQ ID NO: 95349 - DNA, 20 bp, synthetic construct
  misc_feature 1..20: note = CRISPR gRNA sequence
  source 1..20: mol_type = other DNA
tttttttttttaaggagaca

SEQ ID NO: 95350 - DNA, 20 bp, synthetic construct
  misc_feature 1..20: note = CRISPR gRNA sequence
  source 1..20: mol_type = other DNA
ttttttttttaaggagacag

SEQ ID NO: 95351 - DNA, 20 bp, synthetic construct
  misc_feature 1..20: note = CRISPR gRNA sequence
  source 1..20: mol_type = other DNA
tttttttttaaggagacagg

SEQ ID NO: 95352 - DNA, 20 bp, synthetic construct
  misc_feature 1..20: note = CRISPR gRNA sequence
  source 1..20: mol_type = other DNA
ttttttttaaggagacaggg

SEQ ID NO: 95353 - DNA, 20 bp, synthetic construct
  misc_feature 1..20: note = CRISPR gRNA sequence
  source 1..20: mol_type = other DNA
tttttttaaggagacagggt

SEQ ID NO: 95354 - DNA, 20 bp, synthetic construct
  misc_feature 1..20: note = CRISPR gRNA sequence
  source 1..20: mol_type = other DNA
ttttttaaggagacagggtc

SEQ ID NO: 95355 - DNA, 20 bp, synthetic construct
  misc_feature 1..20: note = CRISPR gRNA sequence
  source 1..20: mol_type = other DNA
tttttaaggagacagggtct

SEQ ID NO: 95356 - DNA, 20 bp, synthetic construct
  misc_feature 1..20: note = CRISPR gRNA sequence
  source 1..20: mol_type = other DNA
ttttaaggagacagggtctt

SEQ ID NO: 95357 - DNA, 20 bp, synthetic construct
  misc_feature 1..20: note = CRISPR gRNA sequence
  source 1..20: mol_type = other DNA
tttaaggagacagggtcttg

SEQ ID NO: 95358 - DNA, 20 bp, synthetic construct
  misc_feature 1..20: note = CRISPR gRNA sequence
  source 1..20: mol_type = other DNA
ttaaggagacagggtcttgc

SEQ ID NO: 95359 - DNA, 20 bp, synthetic construct
  misc_feature 1..20: note = CRISPR gRNA sequence
  source 1..20: mol_type = other DNA
taaggagacagggtcttgct

SEQ ID NO: 95360 - DNA, 20 bp, synthetic construct
  misc_feature 1..20: note = CRISPR gRNA sequence
  source 1..20: mol_type = other DNA
aaggagacagggtcttgcta

SEQ ID NO: 95361 - DNA, 20 bp, synthetic construct
  misc_feature 1..20: note = CRISPR gRNA sequence
  source 1..20: mol_type = other DNA
aggagacagggtcttgctat

SEQ ID NO: 95362 - DNA, 20 bp, synthetic construct
  misc_feature 1..20: note = CRISPR gRNA sequence
  source 1..20: mol_type = other DNA
gctatgtcatccaggctgga

SEQ ID NO: 95363 - DNA, 20 bp, synthetic construct
  misc_feature 1..20: note = CRISPR gRNA sequence
  source 1..20: mol_type = other DNA
ctatgtcatccaggctggaa

SEQ ID NO: 95364 - DNA, 20 bp, synthetic construct
  misc_feature 1..20: note = CRISPR gRNA sequence
  source 1..20: mol_type = other DNA
tgtcatccaggctggaatgc

SEQ ID NO: 95365 - DNA, 20 bp, synthetic construct
  misc_feature 1..20: note = CRISPR gRNA sequence
  source 1..20: mol_type = other DNA
gaatgcagtgatgcaaacaa

SEQ ID NO: 95366 - DNA, 20 bp, synthetic construct
  misc_feature 1..20: note = CRISPR gRNA sequence
  source 1..20: mol_type = other DNA
acggcagcctcgaacccctg

SEQ ID NO: 95367 - DNA, 20 bp, synthetic construct
  misc_feature 1..20: note = CRISPR gRNA sequence
  source 1..20: mol_type = other DNA
gaacccctggtctcaagcaa

SEQ ID NO: 95368 - DNA, 20 bp, synthetic construct
  misc_feature 1..20: note = CRISPR gRNA sequence
  source 1..20: mol_type = other DNA
gtctcaagcaatcttcccac

SEQ ID NO: 95369 - DNA, 20 bp, synthetic construct
  misc_feature 1..20: note = CRISPR gRNA sequence
  source 1..20: mol_type = other DNA
aagcaatcttcccacttcac

SEQ ID NO: 95370 - DNA, 20 bp, synthetic construct
  misc_feature 1..20: note = CRISPR gRNA sequence
  source 1..20: mol_type = other DNA
cccacttcaccctcccaagt

SEQ ID NO: 95371 - DNA, 20 bp, synthetic construct
  misc_feature 1..20: note = CRISPR gRNA sequence
  source 1..20: mol_type = other DNA
ccacttcaccctcccaagta

SEQ ID NO: 95372 - DNA, 20 bp, synthetic construct
  misc_feature 1..20: note = CRISPR gRNA sequence
  source 1..20: mol_type = other DNA
caccctcccaagtacagctg

SEQ ID NO: 95373 - DNA, 20 bp, synthetic construct
  misc_feature 1..20: note = CRISPR gRNA sequence
  source 1..20: mol_type = other DNA
accctcccaagtacagctgg

SEQ ID NO: 95374 - DNA, 20 bp, synthetic construct
  misc_feature 1..20: note = CRISPR gRNA sequence
  source 1..20: mol_type = other DNA
ccaagtacagctgggtatac

SEQ ID NO: 95375 - DNA, 20 bp, synthetic construct
  misc_feature 1..20: note = CRISPR gRNA sequence
  source 1..20: mol_type = other DNA
ggtatacaggcacttgccac

SEQ ID NO: 95376 - DNA, 20 bp, synthetic construct
  misc_feature 1..20: note = CRISPR gRNA sequence
  source 1..20: mol_type = other DNA
gccaccatacctggcttgga

SEQ ID NO: 95377 - DNA, 20 bp, synthetic construct
  misc_feature 1..20: note = CRISPR gRNA sequence
  source 1..20: mol_type = other DNA
ccaccatacctggcttggat

SEQ ID NO: 95378 - DNA, 20 bp, synthetic construct
  misc_feature 1..20: note = CRISPR gRNA sequence
  source 1..20: mol_type = other DNA
gcttggatcacttgtaacaa

SEQ ID NO: 95379 - DNA, 20 bp, synthetic construct
  misc_feature 1..20: note = CRISPR gRNA sequence
  source 1..20: mol_type = other DNA
ggatcacttgtaacaaaatt

SEQ ID NO: 95380 - DNA, 20 bp, synthetic construct
  misc_feature 1..20: note = CRISPR gRNA sequence
  source 1..20: mol_type = other DNA
gatcacttgtaacaaaatta

SEQ ID NO: 95381 - DNA, 20 bp, synthetic construct
  misc_feature 1..20: note = CRISPR gRNA sequence
  source 1..20: mol_type = other DNA
gtaacaaaattaaatttttc

SEQ ID NO: 95382 - DNA, 20 bp, synthetic construct
  misc_feature 1..20: note = CRISPR gRNA sequence
  source 1..20: mol_type = other DNA
taacaaaattaaatttttct

SEQ ID NO: 95383 - DNA, 20 bp, synthetic construct
  misc_feature 1..20: note = CRISPR gRNA sequence
  source 1..20: mol_type = other DNA
aatttttctctacactaagg

SEQ ID NO: 95384 - DNA, 20 bp, synthetic construct
  misc_feature 1..20: note = CRISPR gRNA sequence
  source 1..20: mol_type = other DNA
ttctctacactaagggatta

SEQ ID NO: 95385 - DNA, 20 bp, synthetic construct
  misc_feature 1..20: note = CRISPR gRNA sequence
  source 1..20: mol_type = other DNA
tctctacactaagggattat

SEQ ID NO: 95386 - DNA, 20 bp, synthetic construct
  misc_feature 1..20: note = CRISPR gRNA sequence
  source 1..20: mol_type = other DNA
ctctacactaagggattata

SEQ ID NO: 95387 - DNA, 20 bp, synthetic construct
  misc_feature 1..20: note = CRISPR gRNA sequence
  source 1..20: mol_type = other DNA
tctacactaagggattatat

SEQ ID NO: 95388 - DNA, 20 bp, synthetic construct
  misc_feature 1..20: note = CRISPR gRNA sequence
  source 1..20: mol_type = other DNA
tacactaagggattatatag

SEQ ID NO: 95389 - DNA, 20 bp, synthetic construct
  misc_feature 1..20: note = CRISPR gRNA sequence
  source 1..20: mol_type = other DNA
cactaagggattatatagct

SEQ ID NO: 95390 - DNA, 20 bp, synthetic construct
  misc_feature 1..20: note = CRISPR gRNA sequence
  source 1..20: mol_type = other DNA
agggattatatagctctcac

SEQ ID NO: 95391 - DNA, 20 bp, synthetic construct
  misc_feature 1..20: note = CRISPR gRNA sequence
  source 1..20: mol_type = other DNA
tatagctctcacaagaagaa

SEQ ID NO: 95392 - DNA, 20 bp, synthetic construct
  misc_feature 1..20: note = CRISPR gRNA sequence
  source 1..20: mol_type = other DNA
tcacaagaagaaatatctgc

SEQ ID NO: 95393 - DNA, 20 bp, synthetic construct
  misc_feature 1..20: note = CRISPR gRNA sequence
  source 1..20: mol_type = other DNA
acaagaagaaatatctgctt

SEQ ID NO: 95394 - DNA, 20 bp, synthetic construct
  misc_feature 1..20: note = CRISPR gRNA sequence
  source 1..20: mol_type = other DNA
cttatttgtgacagcctcaa

SEQ ID NO: 95395 - DNA, 20 bp, synthetic construct
  misc_feature 1..20: note = CRISPR gRNA sequence
  source 1..20: mol_type = other DNA
atttgtgacagcctcaaagt

SEQ ID NO: 95396 - DNA, 20 bp, synthetic construct
  misc_feature 1..20: note = CRISPR gRNA sequence
  source 1..20: mol_type = other DNA
tttgtgacagcctcaaagta

SEQ ID NO: 95397 - DNA, 20 bp, synthetic construct
  misc_feature 1..20: note = CRISPR gRNA sequence
  source 1..20: mol_type = other DNA
gtgacagcctcaaagtatac

SEQ ID NO: 95398 - DNA, 20 bp, synthetic construct
  misc_feature 1..20: note = CRISPR gRNA sequence
  source 1..20: mol_type = other DNA
tgacagcctcaaagtatacc

SEQ ID NO: 95399 - DNA, 20 bp, synthetic construct
  misc_feature 1..20: note = CRISPR gRNA sequence
  source 1..20: mol_type = other DNA
aaagtataccactaacaatg

SEQ ID NO: 95400 - DNA, 20 bp, synthetic construct
  misc_feature 1..20: note = CRISPR gRNA sequence
  source 1..20: mol_type = other DNA
acaatgacaataataatggg

SEQ ID NO: 95401 - DNA, 20 bp, synthetic construct
  misc_feature 1..20: note = CRISPR gRNA sequence
  source 1..20: mol_type = other DNA
gcaaactttagccagttgct

SEQ ID NO: 95402 - DNA, 20 bp, synthetic construct
  misc_feature 1..20: note = CRISPR gRNA sequence
  source 1..20: mol_type = other DNA
caaactttagccagttgctg

SEQ ID NO: 95403 - DNA, 20 bp, synthetic construct
  misc_feature 1..20: note = CRISPR gRNA sequence
  source 1..20: mol_type = other DNA
tagccagttgctggacactg

SEQ ID NO: 95404 - DNA, 20 bp, synthetic construct
  misc_feature 1..20: note = CRISPR gRNA sequence
  source 1..20: mol_type = other DNA
agccagttgctggacactgt

SEQ ID NO: 95405 - DNA, 20 bp, synthetic construct
  misc_feature 1..20: note = CRISPR gRNA sequence
  source 1..20: mol_type = other DNA
gccagttgctggacactgtg

SEQ ID NO: 95406 - DNA, 20 bp, synthetic construct
  misc_feature 1..20: note = CRISPR gRNA sequence
  source 1..20: mol_type = other DNA
ctggacactgtgtgaaccct

SEQ ID NO: 95407 - DNA, 20 bp, synthetic construct
  misc_feature 1..20: note = CRISPR gRNA sequence
  source 1..20: mol_type = other DNA
gacactgtgtgaaccctcaa

SEQ ID NO: 95408 - DNA, 20 bp, synthetic construct
  misc_feature 1..20: note = CRISPR gRNA sequence
  source 1..20: mol_type = other DNA
tgtgaaccctcaatatggaa

SEQ ID NO: 95409 - DNA, 20 bp, synthetic construct
  misc_feature 1..20: note = CRISPR gRNA sequence
  source 1..20: mol_type = other DNA
aatatggaatggctcacata

SEQ ID NO: 95410 - DNA, 20 bp, synthetic construct
  misc_feature 1..20: note = CRISPR gRNA sequence
  source 1..20: mol_type = other DNA
acatattcacagcaacacta

SEQ ID NO: 95411 - DNA, 20 bp, synthetic construct
  misc_feature 1..20: note = CRISPR gRNA sequence
  source 1..20: mol_type = other DNA
acagcaacactatgaatgac

SEQ ID NO: 95412 - DNA, 20 bp, synthetic construct
  misc_feature 1..20: note = CRISPR gRNA sequence
  source 1..20: mol_type = other DNA
tgaatgacacacgattttaa

SEQ ID NO: 95413 - DNA, 20 bp, synthetic construct
  misc_feature 1..20: note = CRISPR gRNA sequence
  source 1..20: mol_type = other DNA
taatgcccattttacagagt

SEQ ID NO: 95414 - DNA, 20 bp, synthetic construct
  misc_feature 1..20: note = CRISPR gRNA sequence
  source 1..20: mol_type = other DNA
aatgcccattttacagagtt

SEQ ID NO: 95415 - DNA, 20 bp, synthetic construct
  misc_feature 1..20: note = CRISPR gRNA sequence
  source 1..20: mol_type = other DNA
atgcccattttacagagttt

SEQ ID NO: 95416 - DNA, 20 bp, synthetic construct
  misc_feature 1..20: note = CRISPR gRNA sequence
  source 1..20: mol_type = other DNA
tacagagtttaataacctat

SEQ ID NO: 95417 - DNA, 20 bp, synthetic construct
  misc_feature 1..20: note = CRISPR gRNA sequence
  source 1..20: mol_type = other DNA
acagagtttaataacctatt

SEQ ID NO: 95418 - DNA, 20 bp, synthetic construct
  misc_feature 1..20: note = CRISPR gRNA sequence
  source 1..20: mol_type = other DNA
cagagtttaataacctattc

SEQ ID NO: 95419 - DNA, 20 bp, synthetic construct
  misc_feature 1..20: note = CRISPR gRNA sequence
  source 1..20: mol_type = other DNA
aataacctattcaagccaca

SEQ ID NO: 95420 - DNA, 20 bp, synthetic construct
  misc_feature 1..20: note = CRISPR gRNA sequence
  source 1..20: mol_type = other DNA
ataacctattcaagccacaa

SEQ ID NO: 95421 - DNA, 20 bp, synthetic construct
  misc_feature 1..20: note = CRISPR gRNA sequence
  source 1..20: mol_type = other DNA
ttcaagccacaaggccagta

SEQ ID NO: 95422 - DNA, 20 bp, synthetic construct
  misc_feature 1..20: note = CRISPR gRNA sequence
  source 1..20: mol_type = other DNA
aagccacaaggccagtaaat

SEQ ID NO: 95423 - DNA, 20 bp, synthetic construct
  misc_feature 1..20: note = CRISPR gRNA sequence
  source 1..20: mol_type = other DNA
gcacccagaagtcgaactcc

SEQ ID NO: 95424 - DNA, 20 bp, synthetic construct
  misc_feature 1..20: note = CRISPR gRNA sequence
  source 1..20: mol_type = other DNA
cacccagaagtcgaactcca

SEQ ID NO: 95425 - DNA, 20 bp, synthetic construct
  misc_feature 1..20: note = CRISPR gRNA sequence
  source 1..20: mol_type = other DNA
cagaacactggttttacctt

SEQ ID NO: 95426 - DNA, 20 bp, synthetic construct
  misc_feature 1..20: note = CRISPR gRNA sequence
  source 1..20: mol_type = other DNA
gttttacctttgactcagtt

SEQ ID NO: 95427 - DNA, 20 bp, synthetic construct
  misc_feature 1..20: note = CRISPR gRNA sequence
  source 1..20: mol_type = other DNA
tacctttgactcagttcaaa

SEQ ID NO: 95428 - DNA, 20 bp, synthetic construct
  misc_feature 1..20: note = CRISPR gRNA sequence
  source 1..20: mol_type = other DNA
acctttgactcagttcaaat

SEQ ID NO: 95429 - DNA, 20 bp, synthetic construct
  misc_feature 1..20: note = CRISPR gRNA sequence
  source 1..20: mol_type = other DNA
cctttgactcagttcaaatc

SEQ ID NO: 95430 - DNA, 20 bp, synthetic construct
  misc_feature 1..20: note = CRISPR gRNA sequence
  source 1..20: mol_type = other DNA
tgactcagttcaaatcaaac

SEQ ID NO: 95431 - DNA, 20 bp, synthetic construct
  misc_feature 1..20: note = CRISPR gRNA sequence
  source 1..20: mol_type = other DNA
gactcagttcaaatcaaaca

SEQ ID NO: 95432 - DNA, 20 bp, synthetic construct
  misc_feature 1..20: note = CRISPR gRNA sequence
  source 1..20: mol_type = other DNA
actcagttcaaatcaaacaa

SEQ ID NO: 95433 - DNA, 20 bp, synthetic construct
  misc_feature 1..20: note = CRISPR gRNA sequence
  source 1..20: mol_type = other DNA
agttcaaatcaaacaatcca

SEQ ID NO: 95434 - DNA, 20 bp, synthetic construct
  misc_feature 1..20: note = CRISPR gRNA sequence
  source 1..20: mol_type = other DNA
aaatcaaacaatccaaaagt

SEQ ID NO: 95435 - DNA, 20 bp, synthetic construct
  misc_feature 1..20: note = CRISPR gRNA sequence
  source 1..20: mol_type = other DNA
tttgagacttataccccatt

SEQ ID NO: 95436 - DNA, 20 bp, synthetic construct
  misc_feature 1..20: note = CRISPR gRNA sequence
  source 1..20: mol_type = other DNA
ttgagacttataccccatta

SEQ ID NO: 95437 - DNA, 20 bp, synthetic construct
  misc_feature 1..20: note = CRISPR gRNA sequence
  source 1..20: mol_type = other DNA
tgagacttataccccattat

SEQ ID NO: 95438 - DNA, 20 bp, synthetic construct
  misc_feature 1..20: note = CRISPR gRNA sequence
  source 1..20: mol_type = other DNA
gagacttataccccattatc

SEQ ID NO: 95439 - DNA, 20 bp, synthetic construct
  misc_feature 1..20: note = CRISPR gRNA sequence
  source 1..20: mol_type = other DNA
agacttataccccattatca

SEQ ID NO: 95440 - DNA, 20 bp, synthetic construct
  misc_feature 1..20: note = CRISPR gRNA sequence
  source 1..20: mol_type = other DNA
ataccccattatcatccttt

SEQ ID NO: 95441 - DNA, 20 bp, synthetic construct
  misc_feature 1..20: note = CRISPR gRNA sequence
  source 1..20: mol_type = other DNA
taccccattatcatcctttt

SEQ ID NO: 95442 - DNA, 20 bp, synthetic construct
  misc_feature 1..20: note = CRISPR gRNA sequence
  source 1..20: mol_type = other DNA
tcatcctttttttcccccct

SEQ ID NO: 95443 - DNA, 20 bp, synthetic construct
  misc_feature 1..20: note = CRISPR gRNA sequence
  source 1..20: mol_type = other DNA
tttttcccccctcaggggta

SEQ ID NO: 95444 - DNA, 20 bp, synthetic construct
  misc_feature 1..20: note = CRISPR gRNA sequence
  source 1..20: mol_type = other DNA
ttttcccccctcaggggtac

SEQ ID NO: 95445 - DNA, 20 bp, synthetic construct
  misc_feature 1..20: note = CRISPR gRNA sequence
  source 1..20: mol_type = other DNA
tttcccccctcaggggtact

SEQ ID NO: 95446 - DNA, 20 bp, synthetic construct
  misc_feature 1..20: note = CRISPR gRNA sequence
  source 1..20: mol_type = other DNA
ttcccccctcaggggtacta

SEQ ID NO: 95447 - DNA, 20 bp, synthetic construct
  misc_feature 1..20: note = CRISPR gRNA sequence
  source 1..20: mol_type = other DNA
tcccccctcaggggtactaa

SEQ ID NO: 95448 - DNA, 20 bp, synthetic construct
  misc_feature 1..20: note = CRISPR gRNA sequence
  source 1..20: mol_type = other DNA
cccccctcaggggtactaag

SEQ ID NO: 95449 - DNA, 20 bp, synthetic construct
  misc_feature 1..20: note = CRISPR gRNA sequence
  source 1..20: mol_type = other DNA
ccccctcaggggtactaaga

SEQ ID NO: 95450 - DNA, 20 bp, synthetic construct
  misc_feature 1..20: note = CRISPR gRNA sequence
  source 1..20: mol_type = other DNA
aggggtactaagaaaagggg

SEQ ID NO: 95451 - DNA, 20 bp, synthetic construct
  misc_feature 1..20: note = CRISPR gRNA sequence
  source 1..20: mol_type = other DNA
agaaaaggggtagtgagaac

SEQ ID NO: 95452 - DNA, 20 bp, synthetic construct
  misc_feature 1..20: note = CRISPR gRNA sequence
  source 1..20: mol_type = other DNA
acaacaaggatactgagaac

SEQ ID NO: 95453 - DNA, 20 bp, synthetic construct
  misc_feature 1..20: note = CRISPR gRNA sequence
  source 1..20: mol_type = other DNA
agaacaaagtatattaagta

SEQ ID NO: 95454 - DNA, 20 bp, synthetic construct
  misc_feature 1..20: note = CRISPR gRNA sequence
  source 1..20: mol_type = other DNA
agtattggggtagtgagaac

SEQ ID NO: 95455 - DNA, 20 bp, synthetic construct
  misc_feature 1..20: note = CRISPR gRNA sequence
  source 1..20: mol_type = other DNA
gggtagtgagaacatgagaa

SEQ ID NO: 95456 - DNA, 20 bp, synthetic construct
  misc_feature 1..20: note = CRISPR gRNA sequence
  source 1..20: mol_type = other DNA
aacataggggtactgggaac

SEQ ID NO: 95457 - DNA, 20 bp, synthetic construct
  misc_feature 1..20: note = CRISPR gRNA sequence
  source 1..20: mol_type = other DNA
ggaacagagttgtaagaaaa

SEQ ID NO: 95458 - DNA, 20 bp, synthetic construct
  misc_feature 1..20: note = CRISPR gRNA sequence
  source 1..20: mol_type = other DNA
taagaaaagagtactacgta

SEQ ID NO: 95459 - DNA, 20 bp, synthetic construct
  misc_feature 1..20: note = CRISPR gRNA sequence
  source 1..20: mol_type = other DNA
cgtacaggggtactacagac

SEQ ID NO: 95460 - DNA, 20 bp, synthetic construct
  misc_feature 1..20: note = CRISPR gRNA sequence
  source 1..20: mol_type = other DNA
cagacaggcaactgagtata

SEQ ID NO: 95461 - DNA, 20 bp, synthetic construct
  misc_feature 1..20: note = CRISPR gRNA sequence
  source 1..20: mol_type = other DNA
agtatagcagtactaaaaat

SEQ ID NO: 95462 - DNA, 20 bp, synthetic construct
  misc_feature 1..20: note = CRISPR gRNA sequence
  source 1..20: mol_type = other DNA
aaaatacggtactaggaaga

SEQ ID NO: 95463 - DNA, 20 bp, synthetic construct
  misc_feature 1..20: note = CRISPR gRNA sequence
  source 1..20: mol_type = other DNA
ggaagagggttaacagaaca

SEQ ID NO: 95464 - DNA, 20 bp, synthetic construct
  misc_feature 1..20: note = CRISPR gRNA sequence
  source 1..20: mol_type = other DNA
acagaacaggacactaaaaa

SEQ ID NO: 95465 - DNA, 20 bp, synthetic construct
  misc_feature 1..20: note = CRISPR gRNA sequence
  source 1..20: mol_type = other DNA
aaaacaaagtactaaataca

SEQ ID NO: 95466 - DNA, 20 bp, synthetic construct
  misc_feature 1..20: note = CRISPR gRNA sequence
  source 1..20: mol_type = other DNA
aatacaggagtattacaaat

SEQ ID NO: 95467 - DNA, 20 bp, synthetic construct
  misc_feature 1..20: note = CRISPR gRNA sequence
  source 1..20: mol_type = other DNA
caaatagaggtactgagaac

SEQ ID NO: 95468 - DNA, 20 bp, synthetic construct
  misc_feature 1..20: note = CRISPR gRNA sequence
  source 1..20: mol_type = other DNA
agaactgggtactgagaact

SEQ ID NO: 95469 - DNA, 20 bp, synthetic construct
  misc_feature 1..20: note = CRISPR gRNA sequence
  source 1..20: mol_type = other DNA
ggtactgagaactggatact

SEQ ID NO: 95470 - DNA, 20 bp, synthetic construct
  misc_feature 1..20: note = CRISPR gRNA sequence
  source 1..20: mol_type = other DNA
agaactggatactgagaata

SEQ ID NO: 95471 - DNA, 20 bp, synthetic construct
  misc_feature 1..20: note = CRISPR gRNA sequence
  source 1..20: mol_type = other DNA
gatactgagaatagagtagt

SEQ ID NO: 95472 - DNA, 20 bp, synthetic construct
  misc_feature 1..20: note = CRISPR gRNA sequence
  source 1..20: mol_type = other DNA
agaatagagtagtgaaaaca

SEQ ID NO: 95473 - DNA, 20 bp, synthetic construct
  misc_feature 1..20: note = CRISPR gRNA sequence
  source 1..20: mol_type = other DNA
tctcagaagtaccaacttca

SEQ ID NO: 95474 - DNA, 20 bp, synthetic construct
  misc_feature 1..20: note = CRISPR gRNA sequence
  source 1..20: mol_type = other DNA
ctcagaagtaccaacttcat

SEQ ID NO: 95475 - DNA, 20 bp, synthetic construct
  misc_feature 1..20: note = CRISPR gRNA sequence
  source 1..20: mol_type = other DNA
tcagaagtaccaacttcatc

SEQ ID NO: 95476 - DNA, 20 bp, synthetic construct
  misc_feature 1..20: note = CRISPR gRNA sequence
  source 1..20: mol_type = other DNA
agaagtaccaacttcatcta

SEQ ID NO: 95477 - DNA, 20 bp, synthetic construct
  misc_feature 1..20: note = CRISPR gRNA sequence
  source 1..20: mol_type = other DNA
catctaggttcctaagtctc

SEQ ID NO: 95478 - DNA, 20 bp, synthetic construct
  misc_feature 1..20: note = CRISPR gRNA sequence
  source 1..20: mol_type = other DNA
atctaggttcctaagtctcc

SEQ ID NO: 95479 - DNA, 20 bp, synthetic construct
  misc_feature 1..20: note = CRISPR gRNA sequence
  source 1..20: mol_type = other DNA
ggttcctaagtctcctttag

SEQ ID NO: 95480 - DNA, 20 bp, synthetic construct
  misc_feature 1..20: note = CRISPR gRNA sequence
  source 1..20: mol_type = other DNA
ctaagtctcctttagcgatg

SEQ ID NO: 95481 - DNA, 20 bp, synthetic construct
  misc_feature 1..20: note = CRISPR gRNA sequence
  source 1..20: mol_type = other DNA
agtctcctttagcgatgaac

SEQ ID NO: 95482 - DNA, 20 bp, synthetic construct
  misc_feature 1..20: note = CRISPR gRNA sequence
  source 1..20: mol_type = other DNA
ctttagcgatgaaccagacc

SEQ ID NO: 95483 - DNA, 20 bp, synthetic construct
  misc_feature 1..20: note = CRISPR gRNA sequence
  source 1..20: mol_type = other DNA
tagcgatgaaccagaccgat

SEQ ID NO: 95484 - DNA, 20 bp, synthetic construct
  misc_feature 1..20: note = CRISPR gRNA sequence
  source 1..20: mol_type = other DNA
agcgatgaaccagaccgatc

SEQ ID NO: 95485 - DNA, 20 bp, synthetic construct
  misc_feature 1..20: note = CRISPR gRNA sequence
  source 1..20: mol_type = other DNA
gcgatgaaccagaccgatca

SEQ ID NO: 95486 - DNA, 20 bp, synthetic construct
  misc_feature 1..20: note = CRISPR gRNA sequence
  source 1..20: mol_type = other DNA
actctatgtccttccagcca

SEQ ID NO: 95487 - DNA, 20 bp, synthetic construct
  misc_feature 1..20: note = CRISPR gRNA sequence
  source 1..20: mol_type = other DNA
ctctatgtccttccagccat

SEQ ID NO: 95488 - DNA, 20 bp, synthetic construct
  misc_feature 1..20: note = CRISPR gRNA sequence
  source 1..20: mol_type = other DNA
tatgtccttccagccatatc

SEQ ID NO: 95489 - DNA, 20 bp, synthetic construct
  misc_feature 1..20: note = CRISPR gRNA sequence
  source 1..20: mol_type = other DNA
tgtccttccagccatatccc

SEQ ID NO: 95490 - DNA, 20 bp, synthetic construct
  misc_feature 1..20: note = CRISPR gRNA sequence
  source 1..20: mol_type = other DNA
ccagccatatcccagatcta

SEQ ID NO: 95491 - DNA, 20 bp, synthetic construct
  misc_feature 1..20: note = CRISPR gRNA sequence
  source 1..20: mol_type = other DNA
cagccatatcccagatctat

SEQ ID NO: 95492 - DNA, 20 bp, synthetic construct
  misc_feature 1..20: note = CRISPR gRNA sequence
  source 1..20: mol_type = other DNA
tgacagctctgccgatgtca

SEQ ID NO: 95493 - DNA, 20 bp, synthetic construct
  misc_feature 1..20: note = CRISPR gRNA sequence
  source 1..20: mol_type = other DNA
tgccgatgtcacattatttt

SEQ ID NO: 95494 - DNA, 20 bp, synthetic construct
  misc_feature 1..20: note = CRISPR gRNA sequence
  source 1..20: mol_type = other DNA
ccgatgtcacattattttta

SEQ ID NO: 95495 - DNA, 20 bp, synthetic construct
  misc_feature 1..20: note = CRISPR gRNA sequence
  source 1..20: mol_type = other DNA
tttttactgaaatttctgca

SEQ ID NO: 95496 - DNA, 20 bp, synthetic construct
  misc_feature 1..20: note = CRISPR gRNA sequence
  source 1..20: mol_type = other DNA
ttactgaaatttctgcacct

SEQ ID NO: 95497 - DNA, 20 bp, synthetic construct
  misc_feature 1..20: note = CRISPR gRNA sequence
  source 1..20: mol_type = other DNA
tactgaaatttctgcaccta

SEQ ID NO: 95498 - DNA, 20 bp, synthetic construct
  misc_feature 1..20: note = CRISPR gRNA sequence
  source 1..20: mol_type = other DNA
actgaaatttctgcacctat

SEQ ID NO: 95499 - DNA, 20 bp, synthetic construct
  misc_feature 1..20: note = CRISPR gRNA sequence
  source 1..20: mol_type = other DNA
ctgaaatttctgcacctatc

SEQ ID NO: 95500 - DNA, 20 bp, synthetic construct
  misc_feature 1..20: note = CRISPR gRNA sequence
  source 1..20: mol_type = other DNA
aaatttctgcacctatcatg

SEQ ID NO: 95501 - DNA, 20 bp, synthetic construct
  misc_feature 1..20: note = CRISPR gRNA sequence
  source 1..20: mol_type = other DNA
ctgcacctatcatgagttca

SEQ ID NO: 95502 - DNA, 20 bp, synthetic construct
  misc_feature 1..20: note = CRISPR gRNA sequence
  source 1..20: mol_type = other DNA
tgcacctatcatgagttcaa

SEQ ID NO: 95503 - DNA, 20 bp, synthetic construct
  misc_feature 1..20: note = CRISPR gRNA sequence
  source 1..20: mol_type = other DNA
cacctatcatgagttcaaca

SEQ ID NO: 95504 - DNA, 20 bp, synthetic construct
  misc_feature 1..20: note = CRISPR gRNA sequence
  source 1..20: mol_type = other DNA
tcatgagttcaacagaactg

SEQ ID NO: 95505 - DNA, 20 bp, synthetic construct
  misc_feature 1..20: note = CRISPR gRNA sequence
  source 1..20: mol_type = other DNA
aacagaactgttattgcttt

SEQ ID NO: 95506 - DNA, 20 bp, synthetic construct
  misc_feature 1..20: note = CRISPR gRNA sequence
  source 1..20: mol_type = other DNA
ttattgctttgcacatgttg

SEQ ID NO: 95507 - DNA, 20 bp, synthetic construct
  misc_feature 1..20: note = CRISPR gRNA sequence
  source 1..20: mol_type = other DNA
ttgctttgcacatgttggta

SEQ ID NO: 95508 - DNA, 20 bp, synthetic construct
  misc_feature 1..20: note = CRISPR gRNA sequence
  source 1..20: mol_type = other DNA
ctttgcacatgttggtataa

SEQ ID NO: 95509 - DNA, 20 bp, synthetic construct
  misc_feature 1..20: note = CRISPR gRNA sequence
  source 1..20: mol_type = other DNA
tgcacatgttggtataaact

SEQ ID NO: 95510 - DNA, 20 bp, synthetic construct
  misc_feature 1..20: note = CRISPR gRNA sequence
  source 1..20: mol_type = other DNA
gcacatgttggtataaactt

SEQ ID NO: 95511 - DNA, 20 bp, synthetic construct
  misc_feature 1..20: note = CRISPR gRNA sequence
  source 1..20: mol_type = other DNA
cacatgttggtataaacttt

SEQ ID NO: 95512 - DNA, 20 bp, synthetic construct
  misc_feature 1..20: note = CRISPR gRNA sequence
  source 1..20: mol_type = other DNA
gtataaactttaatttaggg

SEQ ID NO: 95513 - DNA, 20 bp, synthetic construct
  misc_feature 1..20: note = CRISPR gRNA sequence
  source 1..20: mol_type = other DNA
taatttagggcaaacactct

SEQ ID NO: 95514 - DNA, 20 bp, synthetic construct
  misc_feature 1..20: note = CRISPR gRNA sequence
  source 1..20: mol_type = other DNA
aatttagggcaaacactcta

SEQ ID NO: 95515 - DNA, 20 bp, synthetic construct
  misc_feature 1..20: note = CRISPR gRNA sequence
  source 1..20: mol_type = other DNA
atttagggcaaacactctaa

SEQ ID NO: 95516 - DNA, 20 bp, synthetic construct
  misc_feature 1..20: note = CRISPR gRNA sequence
  source 1..20: mol_type = other DNA
agggcaaacactctaattct

SEQ ID NO: 95517 - DNA, 20 bp, synthetic construct
  misc_feature 1..20: note = CRISPR gRNA sequence
  source 1..20: mol_type = other DNA
gggcaaacactctaattctc

SEQ ID NO: 95518 - DNA, 20 bp, synthetic construct
  misc_feature 1..20: note = CRISPR gRNA sequence
  source 1..20: mol_type = other DNA
taattctcaaccactaaccc

SEQ ID NO: 95519 - DNA, 20 bp, synthetic construct
  misc_feature 1..20: note = CRISPR gRNA sequence
  source 1..20: mol_type = other DNA
attctcaaccactaacccag

SEQ ID NO: 95520 - DNA, 20 bp, synthetic construct
  misc_feature 1..20: note = CRISPR gRNA sequence
  source 1..20: mol_type = other DNA
tcaaccactaacccagtcac

SEQ ID NO: 95521 - DNA, 20 bp, synthetic construct
  misc_feature 1..20: note = CRISPR gRNA sequence
  source 1..20: mol_type = other DNA
aaccactaacccagtcactg

SEQ ID NO: 95522 - DNA, 20 bp, synthetic construct
  misc_feature 1..20: note = CRISPR gRNA sequence
  source 1..20: mol_type = other DNA
acccagtcactgcaaaccgg

SEQ ID NO: 95523 - DNA, 20 bp, synthetic construct
  misc_feature 1..20: note = CRISPR gRNA sequence
  source 1..20: mol_type = other DNA
caaaccggcccatttggaag

SEQ ID NO: 95524 - DNA, 20 bp, synthetic construct
  misc_feature 1..20: note = CRISPR gRNA sequence
  source 1..20: mol_type = other DNA
ggaagtggggaggcaggccc

SEQ ID NO: 95525 - DNA, 20 bp, synthetic construct
  misc_feature 1..20: note = CRISPR gRNA sequence
  source 1..20: mol_type = other DNA
gaagtggggaggcaggccct

SEQ ID NO: 95526 - DNA, 20 bp, synthetic construct
  misc_feature 1..20: note = CRISPR gRNA sequence
  source 1..20: mol_type = other DNA
cagatgcggtttgcgttaag

SEQ ID NO: 95527 - DNA, 20 bp, synthetic construct
  misc_feature 1..20: note = CRISPR gRNA sequence
  source 1..20: mol_type = other DNA
gcgttaagatcgggtttctt

SEQ ID NO: 95528 - DNA, 20 bp, synthetic construct
  misc_feature 1..20: note = CRISPR gRNA sequence
  source 1..20: mol_type = other DNA
cgttaagatcgggtttcttc

SEQ ID NO: 95529 - DNA, 20 bp, synthetic construct
  misc_feature 1..20: note = CRISPR gRNA sequence
  source 1..20: mol_type = other DNA
agatcgggtttcttcttcca

SEQ ID NO: 95530 - DNA, 20 bp, synthetic construct
  misc_feature 1..20: note = CRISPR gRNA sequence
  source 1..20: mol_type = other DNA
cttcttccacctcccatccc

SEQ ID NO: 95531 - DNA, 20 bp, synthetic construct
  misc_feature 1..20: note = CRISPR gRNA sequence
  source 1..20: mol_type = other DNA
ttcttccacctcccatcccc

SEQ ID NO: 95532 - DNA, 20 bp, synthetic construct
  misc_feature 1..20: note = CRISPR gRNA sequence
  source 1..20: mol_type = other DNA
cttccacctcccatccccag

SEQ ID NO: 95533 - DNA, 20 bp, synthetic construct
  misc_feature 1..20: note = CRISPR gRNA sequence
  source 1..20: mol_type = other DNA
ttccacctcccatccccagg

SEQ ID NO: 95534 - DNA, 20 bp, synthetic construct
  misc_feature 1..20: note = CRISPR gRNA sequence
  source 1..20: mol_type = other DNA
ccacctcccatccccaggcc

SEQ ID NO: 95535 - DNA, 20 bp, synthetic construct
  misc_feature 1..20: note = CRISPR gRNA sequence
  source 1..20: mol_type = other DNA
cacctcccatccccaggcct

SEQ ID NO: 95536 - DNA, 20 bp, synthetic construct
  misc_feature 1..20: note = CRISPR gRNA sequence
  source 1..20: mol_type = other DNA
ccatccccaggcctcagcta

SEQ ID NO: 95537 - DNA, 20 bp, synthetic construct
  misc_feature 1..20: note = CRISPR gRNA sequence
  source 1..20: mol_type = other DNA
agctaagtctgatacctcga

SEQ ID NO: 95538 - DNA, 20 bp, synthetic construct
  misc_feature 1..20: note = CRISPR gRNA sequence
  source 1..20: mol_type = other DNA
agtctgatacctcgagtttg

SEQ ID NO: 95539 - DNA, 20 bp, synthetic construct
  misc_feature 1..20: note = CRISPR gRNA sequence
  source 1..20: mol_type = other DNA
atacctcgagtttgacgttt

SEQ ID NO: 95540 - DNA, 20 bp, synthetic construct
  misc_feature 1..20: note = CRISPR gRNA sequence
  source 1..20: mol_type = other DNA
gagtttgacgtttcccgcgc

SEQ ID NO: 95541 - DNA, 20 bp, synthetic construct
  misc_feature 1..20: note = CRISPR gRNA sequence
  source 1..20: mol_type = other DNA
gacgtttcccgcgctgccag

SEQ ID NO: 95542 - DNA, 20 bp, synthetic construct
  misc_feature 1..20: note = CRISPR gRNA sequence
  source 1..20: mol_type = other DNA
acgtttcccgcgctgccagt

SEQ ID NO: 95543 - DNA, 20 bp, synthetic construct
  misc_feature 1..20: note = CRISPR gRNA sequence
  source 1..20: mol_type = other DNA
cccgcgctgccagtcgaggc

SEQ ID NO: 95544 - DNA, 20 bp, synthetic construct
  misc_feature 1..20: note = CRISPR gRNA sequence
  source 1..20: mol_type = other DNA
ccgcgctgccagtcgaggca

SEQ ID NO: 95545 - DNA, 20 bp, synthetic construct
  misc_feature 1..20: note = CRISPR gRNA sequence
  source 1..20: mol_type = other DNA
ccagtcgaggcagtcccacc

SEQ ID NO: 95546 - DNA, 20 bp, synthetic construct
  misc_feature 1..20: note = CRISPR gRNA sequence
  source 1..20: mol_type = other DNA
agggcctggtcgctcttctt

SEQ ID NO: 95547 - DNA, 20 bp, synthetic construct
  misc_feature 1..20: note = CRISPR gRNA sequence
  source 1..20: mol_type = other DNA
gtcgctcttcttctttttat

SEQ ID NO: 95548 - DNA, 20 bp, synthetic construct
  misc_feature 1..20: note = CRISPR gRNA sequence
  source 1..20: mol_type = other DNA
ttcttctttttatacttgtc

SEQ ID NO: 95549 - DNA, 20 bp, synthetic construct
  misc_feature 1..20: note = CRISPR gRNA sequence
  source 1..20: mol_type = other DNA
cttctttttatacttgtcct

SEQ ID NO: 95550 - DNA, 20 bp, synthetic construct
  misc_feature 1..20: note = CRISPR gRNA sequence
  source 1..20: mol_type = other DNA
ttctttttatacttgtcctt

SEQ ID NO: 95551 - DNA, 20 bp, synthetic construct
  misc_feature 1..20: note = CRISPR gRNA sequence
  source 1..20: mol_type = other DNA
ctttttatacttgtccttgt

SEQ ID NO: 95552 - DNA, 20 bp, synthetic construct
  misc_feature 1..20: note = CRISPR gRNA sequence
  source 1..20: mol_type = other DNA
tttttatacttgtccttgta

SEQ ID NO: 95553 - DNA, 20 bp, synthetic construct
  misc_feature 1..20: note = CRISPR gRNA sequence
  source 1..20: mol_type = other DNA
tttatacttgtccttgtaca

SEQ ID NO: 95554 - DNA, 20 bp, synthetic construct
  misc_feature 1..20: note = CRISPR gRNA sequence
  source 1..20: mol_type = other DNA
ttatacttgtccttgtacat

SEQ ID NO: 95555 - DNA, 20 bp, synthetic construct
  misc_feature 1..20: note = CRISPR gRNA sequence
  source 1..20: mol_type = other DNA
tatacttgtccttgtacatc

SEQ ID NO: 95556 - DNA, 20 bp, synthetic construct
  misc_feature 1..20: note = CRISPR gRNA sequence
  source 1..20: mol_type = other DNA
atacttgtccttgtacatct

SEQ ID NO: 95557 - DNA, 20 bp, synthetic construct
  misc_feature 1..20: note = CRISPR gRNA sequence
  source 1..20: mol_type = other DNA
tacttgtccttgtacatctt

SEQ ID NO: 95558 - DNA, 20 bp, synthetic construct
  misc_feature 1..20: note = CRISPR gRNA sequence
  source 1..20: mol_type = other DNA
gtccttgtacatcttgttgc

SEQ ID NO: 95559 - DNA, 20 bp, synthetic construct
  misc_feature 1..20: note = CRISPR gRNA sequence
  source 1..20: mol_type = other DNA
tccttgtacatcttgttgcg

SEQ ID NO: 95560 - DNA, 20 bp, synthetic construct
  misc_feature 1..20: note = CRISPR gRNA sequence
  source 1..20: mol_type = other DNA
gtacatcttgttgcggtgtt

SEQ ID NO: 95561 - DNA, 20 bp, synthetic construct
  misc_feature 1..20: note = CRISPR gRNA sequence
  source 1..20: mol_type = other DNA
tacatcttgttgcggtgttt

SEQ ID NO: 95562 - DNA, 20 bp, synthetic construct
  misc_feature 1..20: note = CRISPR gRNA sequence
  source 1..20: mol_type = other DNA
gttgcggtgtttcttgcaca

SEQ ID NO: 95563 - DNA, 20 bp, synthetic construct
  misc_feature 1..20: note = CRISPR gRNA sequence
  source 1..20: mol_type = other DNA
ttgcggtgtttcttgcacat

SEQ ID NO: 95564 - DNA, 20 bp, synthetic construct
  misc_feature 1..20: note = CRISPR gRNA sequence
  source 1..20: mol_type = other DNA
cggtgtttcttgcacatcca

SEQ ID NO: 95565 - DNA, 20 bp, synthetic construct
  misc_feature 1..20: note = CRISPR gRNA sequence
  source 1..20: mol_type = other DNA
cttgcacatccacggtttgc

SEQ ID NO: 95566 - DNA, 20 bp, synthetic construct
  misc_feature 1..20: note = CRISPR gRNA sequence
  source 1..20: mol_type = other DNA
ttgcacatccacggtttgcg

SEQ ID NO: 95567 - DNA, 20 bp, synthetic construct
  misc_feature 1..20: note = CRISPR gRNA sequence
  source 1..20: mol_type = other DNA
gcacatccacggtttgcgct

SEQ ID NO: 95568 - DNA, 20 bp, synthetic construct
  misc_feature 1..20: note = CRISPR gRNA sequence
  source 1..20: mol_type = other DNA
cacatccacggtttgcgctg

SEQ ID NO: 95569 - DNA, 20 bp, synthetic construct
  misc_feature 1..20: note = CRISPR gRNA sequence
  source 1..20: mol_type = other DNA
gcgctgcttggccacctggc

SEQ ID NO: 95570 - DNA, 20 bp, synthetic construct
  misc_feature 1..20: note = CRISPR gRNA sequence
  source 1..20: mol_type = other DNA
cgctgcttggccacctggct

SEQ ID NO: 95571 - DNA, 20 bp, synthetic construct
  misc_feature 1..20: note = CRISPR gRNA sequence
  source 1..20: mol_type = other DNA
cttggccacctggctcgtgg

SEQ ID NO: 95572 - DNA, 20 bp, synthetic construct
  misc_feature 1..20: note = CRISPR gRNA sequence
  source 1..20: mol_type = other DNA
ggccacctggctcgtggtct

SEQ ID NO: 95573 - DNA, 20 bp, synthetic construct
  misc_feature 1..20: note = CRISPR gRNA sequence
  source 1..20: mol_type = other DNA
gccacctggctcgtggtctc

SEQ ID NO: 95574 - DNA, 20 bp, synthetic construct
  misc_feature 1..20: note = CRISPR gRNA sequence
  source 1..20: mol_type = other DNA
gctcgtggtctcgctgcagc

SEQ ID NO: 95575 - DNA, 20 bp, synthetic construct
  misc_feature 1..20: note = CRISPR gRNA sequence
  source 1..20: mol_type = other DNA
gtggtctcgctgcagccttc

SEQ ID NO: 95576 - DNA, 20 bp, synthetic construct
  misc_feature 1..20: note = CRISPR gRNA sequence
  source 1..20: mol_type = other DNA
gctgcagccttcgtaggtgc

SEQ ID NO: 95577 - DNA, 20 bp, synthetic construct
  misc_feature 1..20: note = CRISPR gRNA sequence
  source 1..20: mol_type = other DNA
cagccttcgtaggtgcaggt

SEQ ID NO: 95578 - DNA, 20 bp, synthetic construct
  misc_feature 1..20: note = CRISPR gRNA sequence
  source 1..20: mol_type = other DNA
cgtaggtgcaggtcttgctc

SEQ ID NO: 95579 - DNA, 20 bp, synthetic construct
  misc_feature 1..20: note = CRISPR gRNA sequence
  source 1..20: mol_type = other DNA
gtaggtgcaggtcttgctca

SEQ ID NO: 95580 - DNA, 20 bp, synthetic construct
  misc_feature 1..20: note = CRISPR gRNA sequence
  source 1..20: mol_type = other DNA
gctcatgctgcccccaccgc

SEQ ID NO: 95581 - DNA, 20 bp, synthetic construct
  misc_feature 1..20: note = CRISPR gRNA sequence
  source 1..20: mol_type = other DNA
ctcatgctgcccccaccgct

SEQ ID NO: 95582 - DNA, 20 bp, synthetic construct
  misc_feature 1..20: note = CRISPR gRNA sequence
  source 1..20: mol_type = other DNA
atgctgcccccaccgctgcc

SEQ ID NO: 95583 - DNA, 20 bp, synthetic construct
  misc_feature 1..20: note = CRISPR gRNA sequence
  source 1..20: mol_type = other DNA
cccccaccgctgccccgcct

SEQ ID NO: 95584 - DNA, 20 bp, synthetic construct
  misc_feature 1..20: note = CRISPR gRNA sequence
  source 1..20: mol_type = other DNA
ccccgcctccgggcgccccc

SEQ ID NO: 95585 - DNA, 20 bp, synthetic construct
  misc_feature 1..20: note = CRISPR gRNA sequence
  source 1..20: mol_type = other DNA
cgggcgcccccgctgctgcc

SEQ ID NO: 95586 - DNA, 20 bp, synthetic construct
  misc_feature 1..20: note = CRISPR gRNA sequence
  source 1..20: mol_type = other DNA
ctgccctcgccccccgagtg

SEQ ID NO: 95587 - DNA, 20 bp, synthetic construct
  misc_feature 1..20: note = CRISPR gRNA sequence
  source 1..20: mol_type = other DNA
ccctcgccccccgagtgagt

SEQ ID NO: 95588 - DNA, 20 bp, synthetic construct
  misc_feature 1..20: note = CRISPR gRNA sequence
  source 1..20: mol_type = other DNA
gccccccgagtgagtctcct

SEQ ID NO: 95589 - DNA, 20 bp, synthetic construct
  misc_feature 1..20: note = CRISPR gRNA sequence
  source 1..20: mol_type = other DNA
ctcgtcctctagatcctcca

SEQ ID NO: 95590 - DNA, 20 bp, synthetic construct
  misc_feature 1..20: note = CRISPR gRNA sequence
  source 1..20: mol_type = other DNA
gtcctctagatcctccaaac

SEQ ID NO: 95591 - DNA, 20 bp, synthetic construct
  misc_feature 1..20: note = CRISPR gRNA sequence
  source 1..20: mol_type = other DNA
tagatcctccaaactagccg

SEQ ID NO: 95592 - DNA, 20 bp, synthetic construct
  misc_feature 1..20: note = CRISPR gRNA sequence
  source 1..20: mol_type = other DNA
gatcctccaaactagccgcg

SEQ ID NO: 95593 - DNA, 20 bp, synthetic construct
  misc_feature 1..20: note = CRISPR gRNA sequence
  source 1..20: mol_type = other DNA
caaactagccgcgctctcgc

SEQ ID NO: 95594 - DNA, 20 bp, synthetic construct
  misc_feature 1..20: note = CRISPR gRNA sequence
  source 1..20: mol_type = other DNA
gccgcgctctcgcctccccc

SEQ ID NO: 95595 - DNA, 20 bp, synthetic construct
  misc_feature 1..20: note = CRISPR gRNA sequence
  source 1..20: mol_type = other DNA
tcgcctccccccggagggtc

SEQ ID NO: 95596 - DNA, 20 bp, synthetic construct
  misc_feature 1..20: note = CRISPR gRNA sequence
  source 1..20: mol_type = other DNA
gcctccccccggagggtccg

SEQ ID NO: 95597 - DNA, 20 bp, synthetic construct
  misc_feature 1..20: note = CRISPR gRNA sequence
  source 1..20: mol_type = other DNA
cccccggagggtccgaagtg

SEQ ID NO: 95598 - DNA, 20 bp, synthetic construct
  misc_feature 1..20: note = CRISPR gRNA sequence
  source 1..20: mol_type = other DNA
acaggtccgcctcgtcctcc

SEQ ID NO: 95599 - DNA, 20 bp, synthetic construct
  misc_feature 1..20: note = CRISPR gRNA sequence
  source 1..20: mol_type = other DNA
gtcctccccagcctcctctt

SEQ ID NO: 95600 - DNA, 20 bp, synthetic construct
  misc_feature 1..20: note = CRISPR gRNA sequence
  source 1..20: mol_type = other DNA
cccagcctcctcttcgccat

SEQ ID NO: 95601 - DNA, 20 bp, synthetic construct
  misc_feature 1..20: note = CRISPR gRNA sequence
  source 1..20: mol_type = other DNA
ctcttcgccatccccggccc

SEQ ID NO: 95602 - DNA, 20 bp, synthetic construct
  misc_feature 1..20: note = CRISPR gRNA sequence
  source 1..20: mol_type = other DNA
ttcgccatccccggcccctt

SEQ ID NO: 95603 - DNA, 20 bp, synthetic construct
  misc_feature 1..20: note = CRISPR gRNA sequence
  source 1..20: mol_type = other DNA
cgccatccccggccccttcg

SEQ ID NO: 95604 - DNA, 20 bp, synthetic construct
  misc_feature 1..20: note = CRISPR gRNA sequence
  source 1..20: mol_type = other DNA
gccatccccggccccttcgc

SEQ ID NO: 95605 - DNA, 20 bp, synthetic construct
  misc_feature 1..20: note = CRISPR gRNA sequence
  source 1..20: mol_type = other DNA
cgcacaggtacctaacgggc

SEQ ID NO: 95606 - DNA, 20 bp, synthetic construct
  misc_feature 1..20: note = CRISPR gRNA sequence
  source 1..20: mol_type = other DNA
gcacaggtacctaacgggct

SEQ ID NO: 95607 - DNA, 20 bp, synthetic construct
  misc_feature 1..20: note = CRISPR gRNA sequence
  source 1..20: mol_type = other DNA
acgggcttgcccgccccaac

SEQ ID NO: 95608 - DNA, 20 bp, synthetic construct
  misc_feature 1..20: note = CRISPR gRNA sequence
  source 1..20: mol_type = other DNA
gcccgccccaacgctgcccc

SEQ ID NO: 95609 - DNA, 20 bp, synthetic construct
  misc_feature 1..20: note = CRISPR gRNA sequence
  source 1..20: mol_type = other DNA
cccgccccaacgctgccccc

SEQ ID NO: 95610 - DNA, 20 bp, synthetic construct
  misc_feature 1..20: note = CRISPR gRNA sequence
  source 1..20: mol_type = other DNA
cccccgggggccgcagcctc

SEQ ID NO: 95611 - DNA, 20 bp, synthetic construct
  misc_feature 1..20: note = CRISPR gRNA sequence
  source 1..20: mol_type = other DNA
gtcctgcccagcacagggtt

SEQ ID NO: 95612 - DNA, 20 bp, synthetic construct
  misc_feature 1..20: note = CRISPR gRNA sequence
  source 1..20: mol_type = other DNA
cccagcacagggttgcatca

SEQ ID NO: 95613 - DNA, 20 bp, synthetic construct
  misc_feature 1..20: note = CRISPR gRNA sequence
  source 1..20: mol_type = other DNA
catcactagcagggtgaatt

SEQ ID NO: 95614 - DNA, 20 bp, synthetic construct
  misc_feature 1..20: note = CRISPR gRNA sequence
  source 1..20: mol_type = other DNA
gcagggtgaattgagaggcc

SEQ ID NO: 95615 - DNA, 20 bp, synthetic construct
  misc_feature 1..20: note = CRISPR gRNA sequence
  source 1..20: mol_type = other DNA
agaggccgcggccgccaccg

SEQ ID NO: 95616 - DNA, 20 bp, synthetic construct
  misc_feature 1..20: note = CRISPR gRNA sequence
  source 1..20: mol_type = other DNA
gcgccaaggtgggagccgca

SEQ ID NO: 95617 - DNA, 20 bp, synthetic construct
  misc_feature 1..20: note = CRISPR gRNA sequence
  source 1..20: mol_type = other DNA
gggccgcggggtggggcacg

SEQ ID NO: 95618 - DNA, 20 bp, synthetic construct
  misc_feature 1..20: note = CRISPR gRNA sequence
  source 1..20: mol_type = other DNA
gcggcgcccggccccgcgcc

SEQ ID NO: 95619 - DNA, 20 bp, synthetic construct
  misc_feature 1..20: note = CRISPR gRNA sequence
  source 1..20: mol_type = other DNA
cgctacaccctgcgcctcca

SEQ ID NO: 95620 - DNA, 20 bp, synthetic construct
  misc_feature 1..20: note = CRISPR gRNA sequence
  source 1..20: mol_type = other DNA
caccctgcgcctccatgctg

SEQ ID NO: 95621 - DNA, 20 bp, synthetic construct
  misc_feature 1..20: note = CRISPR gRNA sequence
  source 1..20: mol_type = other DNA
cgcctccatgctgctaagac

SEQ ID NO: 95622 - DNA, 20 bp, synthetic construct
  misc_feature 1..20: note = CRISPR gRNA sequence
  source 1..20: mol_type = other DNA
catgctgctaagacctggcc

SEQ ID NO: 95623 - DNA, 20 bp, synthetic construct
  misc_feature 1..20: note = CRISPR gRNA sequence
  source 1..20: mol_type = other DNA
ctaagacctggccggggtcc

SEQ ID NO: 95624 - DNA, 20 bp, synthetic construct
  misc_feature 1..20: note = CRISPR gRNA sequence
  source 1..20: mol_type = other DNA
agacctggccggggtccacg

SEQ ID NO: 95625 - DNA, 20 bp, synthetic construct
  misc_feature 1..20: note = CRISPR gRNA sequence
  source 1..20: mol_type = other DNA
gccggggtccacgaccccgg

SEQ ID NO: 95626 - DNA, 20 bp, synthetic construct
  misc_feature 1..20: note = CRISPR gRNA sequence
  source 1..20: mol_type = other DNA
ttagcacctgcttggcctaa

SEQ ID NO: 95627 - DNA, 20 bp, synthetic construct
  misc_feature 1..20: note = CRISPR gRNA sequence
  source 1..20: mol_type = other DNA
tagcacctgcttggcctaac

SEQ ID NO: 95628 - DNA, 20 bp, synthetic construct
  misc_feature 1..20: note = CRISPR gRNA sequence
  source 1..20: mol_type = other DNA
agcacctgcttggcctaacg

SEQ ID NO: 95629 - DNA, 20 bp, synthetic construct
  misc_feature 1..20: note = CRISPR gRNA sequence
  source 1..20: mol_type = other DNA
gcacctgcttggcctaacgg

SEQ ID NO: 95630 - DNA, 20 bp, synthetic construct
  misc_feature 1..20: note = CRISPR gRNA sequence
  source 1..20: mol_type = other DNA
cttggcctaacggcacttcg

SEQ ID NO: 95631 - DNA, 20 bp, synthetic construct
  misc_feature 1..20: note = CRISPR gRNA sequence
  source 1..20: mol_type = other DNA
ggcctaacggcacttcgcga

SEQ ID NO: 95632 - DNA, 20 bp, synthetic construct
  misc_feature 1..20: note = CRISPR gRNA sequence
  source 1..20: mol_type = other DNA
gcctaacggcacttcgcgaa

SEQ ID NO: 95633 - DNA, 20 bp, synthetic construct
  misc_feature 1..20: note = CRISPR gRNA sequence
  source 1..20: mol_type = other DNA
acggcacttcgcgaaccaaa

SEQ ID NO: 95634 - DNA, 20 bp, synthetic construct
  misc_feature 1..20: note = CRISPR gRNA sequence
  source 1..20: mol_type = other DNA
cgcgaaccaaagactcagga

SEQ ID NO: 95635 - DNA, 20 bp, synthetic construct
  misc_feature 1..20: note = CRISPR gRNA sequence
  source 1..20: mol_type = other DNA
gcgaaccaaagactcaggac

SEQ ID NO: 95636 - DNA, 20 bp, synthetic construct
  misc_feature 1..20: note = CRISPR gRNA sequence
  source 1..20: mol_type = other DNA
cggctcctccatagcgaccg

SEQ ID NO: 95637 - DNA, 20 bp, synthetic construct
  misc_feature 1..20: note = CRISPR gRNA sequence
  source 1..20: mol_type = other DNA
cctccatagcgaccgcggcc

SEQ ID NO: 95638 - DNA, 20 bp, synthetic construct
  misc_feature 1..20: note = CRISPR gRNA sequence
  source 1..20: mol_type = other DNA
gcgaccgcggccgagcgaac

SEQ ID NO: 95639 - DNA, 20 bp, synthetic construct
  misc_feature 1..20: note = CRISPR gRNA sequence
  source 1..20: mol_type = other DNA
cgaccgcggccgagcgaacc

SEQ ID NO: 95640 - DNA, 20 bp, synthetic construct
  misc_feature 1..20: note = CRISPR gRNA sequence
  source 1..20: mol_type = other DNA
cggccgagcgaaccgggaaa

SEQ ID NO: 95641 - DNA, 20 bp, synthetic construct
  misc_feature 1..20: note = CRISPR gRNA sequence
  source 1..20: mol_type = other DNA
agcgaaccgggaaacggcac

SEQ ID NO: 95642 - DNA, 20 bp, synthetic construct
  misc_feature 1..20: note = CRISPR gRNA sequence
  source 1..20: mol_type = other DNA
gaaccgggaaacggcaccgg

SEQ ID NO: 95643 - DNA, 20 bp, synthetic construct
  misc_feature 1..20: note = CRISPR gRNA sequence
  source 1..20: mol_type = other DNA
gggaaacggcaccggaagcc

SEQ ID NO: 95644 - DNA, 20 bp, synthetic construct
  misc_feature 1..20: note = CRISPR gRNA sequence
  source 1..20: mol_type = other DNA
gaaacggcaccggaagcccg

SEQ ID NO: 95645 - DNA, 20 bp, synthetic construct
  misc_feature 1..20: note = CRISPR gRNA sequence
  source 1..20: mol_type = other DNA
aaacggcaccggaagcccgg

SEQ ID NO: 95646 - DNA, 20 bp, synthetic construct
  misc_feature 1..20: note = CRISPR gRNA sequence
  source 1..20: mol_type = other DNA
ggcaccggaagcccggaggt

SEQ ID NO: 95647 - DNA, 20 bp, synthetic construct
  misc_feature 1..20: note = CRISPR gRNA sequence
  source 1..20: mol_type = other DNA
gcaccggaagcccggaggtt

SEQ ID NO: 95648 - DNA, 20 bp, synthetic construct
  misc_feature 1..20: note = CRISPR gRNA sequence
  source 1..20: mol_type = other DNA
ggaggttgggacgcccgcct

SEQ ID NO: 95649 - DNA, 20 bp, synthetic construct
  misc_feature 1..20: note = CRISPR gRNA sequence
  source 1..20: mol_type = other DNA
taagccttccctgctgaaac

SEQ ID NO: 95650 - DNA, 20 bp, synthetic construct
  misc_feature 1..20: note = CRISPR gRNA sequence
  source 1..20: mol_type = other DNA
tgctgaaaccggacgccgca

SEQ ID NO: 95651 - DNA, 20 bp, synthetic construct
  misc_feature 1..20: note = CRISPR gRNA sequence
  source 1..20: mol_type = other DNA
acgccgcacggctcctgttc

SEQ ID NO: 95652 - DNA, 20 bp, synthetic construct
  misc_feature 1..20: note = CRISPR gRNA sequence
  source 1..20: mol_type = other DNA
cacggctcctgttccggtgt

SEQ ID NO: 95653 - DNA, 20 bp, synthetic construct
  misc_feature 1..20: note = CRISPR gRNA sequence
  source 1..20: mol_type = other DNA
cggctcctgttccggtgtca

SEQ ID NO: 95654 - DNA, 20 bp, synthetic construct
  misc_feature 1..20: note = CRISPR gRNA sequence
  source 1..20: mol_type = other DNA
ggctcctgttccggtgtcag

SEQ ID NO: 95655 - DNA, 20 bp, synthetic construct
  misc_feature 1..20: note = CRISPR gRNA sequence
  source 1..20: mol_type = other DNA
gctcctgttccggtgtcaga

SEQ ID NO: 95656 - DNA, 20 bp, synthetic construct
  misc_feature 1..20: note = CRISPR gRNA sequence
  source 1..20: mol_type = other DNA
ggcccgccctccccgctcct

SEQ ID NO: 95657 - DNA, 20 bp, synthetic construct
  misc_feature 1..20: note = CRISPR gRNA sequence
  source 1..20: mol_type = other DNA
tccccgctcctcagtctttg

SEQ ID NO: 95658 - DNA, 20 bp, synthetic construct
  misc_feature 1..20: note = CRISPR gRNA sequence
  source 1..20: mol_type = other DNA
gctcctcagtctttgcggac

SEQ ID NO: 95659 - DNA, 20 bp, synthetic construct
  misc_feature 1..20: note = CRISPR gRNA sequence
  source 1..20: mol_type = other DNA
ctcagtctttgcggacaaga

SEQ ID NO: 95660 - DNA, 20 bp, synthetic construct
  misc_feature 1..20: note = CRISPR gRNA sequence
  source 1..20: mol_type = other DNA
tcagtctttgcggacaagaa

SEQ ID NO: 95661 - DNA, 20 bp, synthetic construct
  misc_feature 1..20: note = CRISPR gRNA sequence
  source 1..20: mol_type = other DNA
cagtctttgcggacaagaaa

SEQ ID NO: 95662 - DNA, 20 bp, synthetic construct
  misc_feature 1..20: note = CRISPR gRNA sequence
  source 1..20: mol_type = other DNA
agtctttgcggacaagaaag

SEQ ID NO: 95663 - DNA, 20 bp, synthetic construct
  misc_feature 1..20: note = CRISPR gRNA sequence
  source 1..20: mol_type = other DNA
ggacaagaaaggggctgtgt

SEQ ID NO: 95664 - DNA, 20 bp, synthetic construct
  misc_feature 1..20: note = CRISPR gRNA sequence
  source 1..20: mol_type = other DNA
gaaaggggctgtgtgagacg

SEQ ID NO: 95665 - DNA, 20 bp, synthetic construct
  misc_feature 1..20: note = CRISPR gRNA sequence
  source 1..20: mol_type = other DNA
aaaggggctgtgtgagacgc

SEQ ID NO: 95666 - DNA, 20 bp, synthetic construct
  misc_feature 1..20: note = CRISPR gRNA sequence
  source 1..20: mol_type = other DNA
aaggggctgtgtgagacgca

SEQ ID NO: 95667 - DNA, 20 bp, synthetic construct
  misc_feature 1..20: note = CRISPR gRNA sequence
  source 1..20: mol_type = other DNA
gggctgtgtgagacgcaggg

SEQ ID NO: 95668 - DNA, 20 bp, synthetic construct
  misc_feature 1..20: note = CRISPR gRNA sequence
  source 1..20: mol_type = other DNA
ggctgtgtgagacgcaggga

SEQ ID NO: 95669 - DNA, 20 bp, synthetic construct
  misc_feature 1..20: note = CRISPR gRNA sequence
  source 1..20: mol_type = other DNA
ctgtgtgagacgcagggaag

SEQ ID NO: 95670 - DNA, 20 bp, synthetic construct
  misc_feature 1..20: note = CRISPR gRNA sequence
  source 1..20: mol_type = other DNA
tgtgtgagacgcagggaagg

SEQ ID NO: 95671 - DNA, 20 bp, synthetic construct
  misc_feature 1..20: note = CRISPR gRNA sequence
  source 1..20: mol_type = other DNA
cgcagggaaggaggcacacc

SEQ ID NO: 95672 - DNA, 20 bp, synthetic construct
  misc_feature 1..20: note = CRISPR gRNA sequence
  source 1..20: mol_type = other DNA
gcagggaaggaggcacaccc

SEQ ID NO: 95673 - DNA, 20 bp, synthetic construct
  misc_feature 1..20: note = CRISPR gRNA sequence
  source 1..20: mol_type = other DNA
cagggaaggaggcacacccg

SEQ ID NO: 95674 - DNA, 20 bp, synthetic construct
  misc_feature 1..20: note = CRISPR gRNA sequence
  source 1..20: mol_type = other DNA
agggaaggaggcacacccgg

SEQ ID NO: 95675 - DNA, 20 bp, synthetic construct
  misc_feature 1..20: note = CRISPR gRNA sequence
  source 1..20: mol_type = other DNA
gaaggaggcacacccggggg

SEQ ID NO: 95676 - DNA, 20 bp, synthetic construct
  misc_feature 1..20: note = CRISPR gRNA sequence
  source 1..20: mol_type = other DNA
aggcacacccgggggtggcg

SEQ ID NO: 95677 - DNA, 20 bp, synthetic construct
  misc_feature 1..20: note = CRISPR gRNA sequence
  source 1..20: mol_type = other DNA
acacccgggggtggcgcagt

SEQ ID NO: 95678 - DNA, 20 bp, synthetic construct
  misc_feature 1..20: note = CRISPR gRNA sequence
  source 1..20: mol_type = other DNA
cacccgggggtggcgcagtg

SEQ ID NO: 95679 - DNA, 20 bp, synthetic construct
  misc_feature 1..20: note = CRISPR gRNA sequence
  source 1..20: mol_type = other DNA
cccgggggtggcgcagtgag

SEQ ID NO: 95680 - DNA, 20 bp, synthetic construct
  misc_feature 1..20: note = CRISPR gRNA sequence
  source 1..20: mol_type = other DNA
ccgggggtggcgcagtgagg

SEQ ID NO: 95681 - DNA, 20 bp, synthetic construct
  misc_feature 1..20: note = CRISPR gRNA sequence
  source 1..20: mol_type = other DNA
cgggggtggcgcagtgagga

SEQ ID NO: 95682 - DNA, 20 bp, synthetic construct
  misc_feature 1..20: note = CRISPR gRNA sequence
  source 1..20: mol_type = other DNA
gggggtggcgcagtgaggag

SEQ ID NO: 95683 - DNA, 20 bp, synthetic construct
  misc_feature 1..20: note = CRISPR gRNA sequence
  source 1..20: mol_type = other DNA
ggggtggcgcagtgaggagg

SEQ ID NO: 95684 - DNA, 20 bp, synthetic construct
  misc_feature 1..20: note = CRISPR gRNA sequence
  source 1..20: mol_type = other DNA
gcagtgaggagggggcgcga

SEQ ID NO: 95685 - DNA, 20 bp, synthetic construct
  misc_feature 1..20: note = CRISPR gRNA sequence
  source 1..20: mol_type = other DNA
tgaggagggggcgcgacggc

SEQ ID NO: 95686 - DNA, 20 bp, synthetic construct
  misc_feature 1..20: note = CRISPR gRNA sequence
  source 1..20: mol_type = other DNA
gaggagggggcgcgacggcc

SEQ ID NO: 95687 - DNA, 20 bp, synthetic construct
  misc_feature 1..20: note = CRISPR gRNA sequence
  source 1..20: mol_type = other DNA
ggagggggcgcgacggccag

SEQ ID NO: 95688 - DNA, 20 bp, synthetic construct
  misc_feature 1..20: note = CRISPR gRNA sequence
  source 1..20: mol_type = other DNA
gagggggcgcgacggccagg

SEQ ID NO: 95689 - DNA, 20 bp, synthetic construct
  misc_feature 1..20: note = CRISPR gRNA sequence
  source 1..20: mol_type = other DNA
gggcgcgacggccaggaggc

SEQ ID NO: 95690 - DNA, 20 bp, synthetic construct
  misc_feature 1..20: note = CRISPR gRNA sequence
  source 1..20: mol_type = other DNA
cgcgacggccaggaggctgg

SEQ ID NO: 95691 - DNA, 20 bp, synthetic construct
  misc_feature 1..20: note = CRISPR gRNA sequence
  source 1..20: mol_type = other DNA
cgacggccaggaggctggtg

SEQ ID NO: 95692 - DNA, 20 bp, synthetic construct
  misc_feature 1..20: note = CRISPR gRNA sequence
  source 1..20: mol_type = other DNA
gaggctggtggagcgacacc

SEQ ID NO: 95693 - DNA, 20 bp, synthetic construct
  misc_feature 1..20: note = CRISPR gRNA sequence
  source 1..20: mol_type = other DNA
aggctggtggagcgacaccc

SEQ ID NO: 95694 - DNA, 20 bp, synthetic construct
  misc_feature 1..20: note = CRISPR gRNA sequence
  source 1..20: mol_type = other DNA
ctggtggagcgacacccagg

SEQ ID NO: 95695 - DNA, 20 bp, synthetic construct
  misc_feature 1..20: note = CRISPR gRNA sequence
  source 1..20: mol_type = other DNA
tggtggagcgacacccaggc

SEQ ID NO: 95696 - DNA, 20 bp, synthetic construct
  misc_feature 1..20: note = CRISPR gRNA sequence
  source 1..20: mol_type = other DNA
gtggagcgacacccaggcag

SEQ ID NO: 95697 - DNA, 20 bp, synthetic construct
  misc_feature 1..20: note = CRISPR gRNA sequence
  source 1..20: mol_type = other DNA
ggagcgacacccaggcagga

SEQ ID NO: 95698 - DNA, 20 bp, synthetic construct
  misc_feature 1..20: note = CRISPR gRNA sequence
  source 1..20: mol_type = other DNA
gagcgacacccaggcaggag

SEQ ID NO: 95699 - DNA, 20 bp, synthetic construct
  misc_feature 1..20: note = CRISPR gRNA sequence
  source 1..20: mol_type = other DNA
agcgacacccaggcaggaga

SEQ ID NO: 95700 - DNA, 20 bp, synthetic construct
  misc_feature 1..20: note = CRISPR gRNA sequence
  source 1..20: mol_type = other DNA
gcgacacccaggcaggagag

SEQ ID NO: 95701 - DNA, 20 bp, synthetic construct
  misc_feature 1..20: note = CRISPR gRNA sequence
  source 1..20: mol_type = other DNA
cgacacccaggcaggagagg

SEQ ID NO: 95702 - DNA, 20 bp, synthetic construct
  misc_feature 1..20: note = CRISPR gRNA sequence
  source 1..20: mol_type = other DNA
cacccaggcaggagaggggg

SEQ ID NO: 95703 - DNA, 20 bp, synthetic construct
  misc_feature 1..20: note = CRISPR gRNA sequence
  source 1..20: mol_type = other DNA
ttctgaacccccttttcctt

SEQ ID NO: 95704 - DNA, 20 bp, synthetic construct
  misc_feature 1..20: note = CRISPR gRNA sequence
  source 1..20: mol_type = other DNA
ctgaacccccttttccttga

SEQ ID NO: 95705 - DNA, 20 bp, synthetic construct
  misc_feature 1..20: note = CRISPR gRNA sequence
  source 1..20: mol_type = other DNA
cccccttttccttgagagac

SEQ ID NO: 95706 - DNA, 20 bp, synthetic construct
  misc_feature 1..20: note = CRISPR gRNA sequence
  source 1..20: mol_type = other DNA
cttttccttgagagacgagt

SEQ ID NO: 95707 - DNA, 20 bp, synthetic construct
  misc_feature 1..20: note = CRISPR gRNA sequence
  source 1..20: mol_type = other DNA
ttttccttgagagacgagtt

SEQ ID NO: 95708 - DNA, 20 bp, synthetic construct
  misc_feature 1..20: note = CRISPR gRNA sequence
  source 1..20: mol_type = other DNA
tttccttgagagacgagttg

SEQ ID NO: 95709 - DNA, 20 bp, synthetic construct
  misc_feature 1..20: note = CRISPR gRNA sequence
  source 1..20: mol_type = other DNA
ttccttgagagacgagttgg

SEQ ID NO: 95710 - DNA, 20 bp, synthetic construct
  misc_feature 1..20: note = CRISPR gRNA sequence
  source 1..20: mol_type = other DNA
ccttgagagacgagttgggg

SEQ ID NO: 95711 - DNA, 20 bp, synthetic construct
  misc_feature 1..20: note = CRISPR gRNA sequence
  source 1..20: mol_type = other DNA
tcctccacgcattacccact

SEQ ID NO: 95712 - DNA, 20 bp, synthetic construct
  misc_feature 1..20: note = CRISPR gRNA sequence
  source 1..20: mol_type = other DNA
cctccacgcattacccactc

SEQ ID NO: 95713 - DNA, 20 bp, synthetic construct
  misc_feature 1..20: note = CRISPR gRNA sequence
  source 1..20: mol_type = other DNA
gccgcaaaaactcccttctt

SEQ ID NO: 95714 - DNA, 20 bp, synthetic construct
  misc_feature 1..20: note = CRISPR gRNA sequence
  source 1..20: mol_type = other DNA
ctgcccccgcccttgcttat

SEQ ID NO: 95715 - DNA, 20 bp, synthetic construct
  misc_feature 1..20: note = CRISPR gRNA sequence
  source 1..20: mol_type = other DNA
gcccttgcttataagccttt

SEQ ID NO: 95716 - DNA, 20 bp, synthetic construct
  misc_feature 1..20: note = CRISPR gRNA sequence
  source 1..20: mol_type = other DNA
cttataagcctttgagaccg

SEQ ID NO: 95717 - DNA, 20 bp, synthetic construct
  misc_feature 1..20: note = CRISPR gRNA sequence
  source 1..20: mol_type = other DNA
ataagcctttgagaccgcag

SEQ ID NO: 95718 - DNA, 20 bp, synthetic construct
  misc_feature 1..20: note = CRISPR gRNA sequence
  source 1..20: mol_type = other DNA
taagcctttgagaccgcaga

SEQ ID NO: 95719 - DNA, 20 bp, synthetic construct
  misc_feature 1..20: note = CRISPR gRNA sequence
  source 1..20: mol_type = other DNA
aagcctttgagaccgcagaa

SEQ ID NO: 95720 - DNA, 20 bp, synthetic construct
  misc_feature 1..20: note = CRISPR gRNA sequence
  source 1..20: mol_type = other DNA
ccgcagaagggaccttgttg

SEQ ID NO: 95721 - DNA, 20 bp, synthetic construct
  misc_feature 1..20: note = CRISPR gRNA sequence
  source 1..20: mol_type = other DNA
gaagggaccttgttgtggaa

SEQ ID NO: 95722 - DNA, 20 bp, synthetic construct
  misc_feature 1..20: note = CRISPR gRNA sequence
  source 1..20: mol_type = other DNA
aagggaccttgttgtggaac

SEQ ID NO: 95723 - DNA, 20 bp, synthetic construct
  misc_feature 1..20: note = CRISPR gRNA sequence
  source 1..20: mol_type = other DNA
gaccttgttgtggaacggga

SEQ ID NO: 95724 - DNA, 20 bp, synthetic construct
  misc_feature 1..20: note = CRISPR gRNA sequence
  source 1..20: mol_type = other DNA
tgttgtggaacgggacggcc

SEQ ID NO: 95725 - DNA, 20 bp, synthetic construct
  misc_feature 1..20: note = CRISPR gRNA sequence
  source 1..20: mol_type = other DNA
gttgtggaacgggacggcca

SEQ ID NO: 95726 - DNA, 20 bp, synthetic construct
  misc_feature 1..20: note = CRISPR gRNA sequence
  source 1..20: mol_type = other DNA
ccaaggtacgctgccccttt

SEQ ID NO: 95727 - DNA, 20 bp, synthetic construct
  misc_feature 1..20: note = CRISPR gRNA sequence
  source 1..20: mol_type = other DNA
tacgctgcccctttaagttc

SEQ ID NO: 95728 - DNA, 20 bp, synthetic construct
  misc_feature 1..20: note = CRISPR gRNA sequence
  source 1..20: mol_type = other DNA
ttcccctacttcttcttctt

SEQ ID NO: 95729 - DNA, 20 bp, synthetic construct
  misc_feature 1..20: note = CRISPR gRNA sequence
  source 1..20: mol_type = other DNA
cctacttcttcttcttgaga

SEQ ID NO: 95730 - DNA, 20 bp, synthetic construct
  misc_feature 1..20: note = CRISPR gRNA sequence
  source 1..20: mol_type = other DNA
tagccccgcccatctacccg

SEQ ID NO: 95731 - DNA, 20 bp, synthetic construct
  misc_feature 1..20: note = CRISPR gRNA sequence
  source 1..20: mol_type = other DNA
cccgcccatctacccgaagc

SEQ ID NO: 95732 - DNA, 20 bp, synthetic construct
  misc_feature 1..20: note = CRISPR gRNA sequence
  source 1..20: mol_type = other DNA
cgcccatctacccgaagccg

SEQ ID NO: 95733 - DNA, 20 bp, synthetic construct
  misc_feature 1..20: note = CRISPR gRNA sequence
  source 1..20: mol_type = other DNA
tacccgaagccggagccaat

SEQ ID NO: 95734 - DNA, 20 bp, synthetic construct
  misc_feature 1..20: note = CRISPR gRNA sequence
  source 1..20: mol_type = other DNA
cggagccaattggctccctc

SEQ ID NO: 95735 - DNA, 20 bp, synthetic construct
  misc_feature 1..20: note = CRISPR gRNA sequence
  source 1..20: mol_type = other DNA
gctccctctggaaaaatctg

SEQ ID NO: 95736 - DNA, 20 bp, synthetic construct
  misc_feature 1..20: note = CRISPR gRNA sequence
  source 1..20: mol_type = other DNA
ctccctctggaaaaatctgt

SEQ ID NO: 95737 - DNA, 20 bp, synthetic construct
  misc_feature 1..20: note = CRISPR gRNA sequence
  source 1..20: mol_type = other DNA
cctctggaaaaatctgtggg

SEQ ID NO: 95738 - DNA, 20 bp, synthetic construct
  misc_feature 1..20: note = CRISPR gRNA sequence
  source 1..20: mol_type = other DNA
ctctggaaaaatctgtgggc

SEQ ID NO: 95739 - DNA, 20 bp, synthetic construct
  misc_feature 1..20: note = CRISPR gRNA sequence
  source 1..20: mol_type = other DNA
tctggaaaaatctgtgggca

SEQ ID NO: 95740 - DNA, 20 bp, synthetic construct
  misc_feature 1..20: note = CRISPR gRNA sequence
  source 1..20: mol_type = other DNA
aaaaatctgtgggcagggta

SEQ ID NO: 95741 - DNA, 20 bp, synthetic construct
  misc_feature 1..20: note = CRISPR gRNA sequence
  source 1..20: mol_type = other DNA
aaaatctgtgggcagggtaa

SEQ ID NO: 95742 - DNA, 20 bp, synthetic construct
  misc_feature 1..20: note = CRISPR gRNA sequence
  source 1..20: mol_type = other DNA
tctgtgggcagggtaaaggt

SEQ ID NO: 95743 - DNA, 20 bp, synthetic construct
  misc_feature 1..20: note = CRISPR gRNA sequence
  source 1..20: mol_type = other DNA
gtgggcagggtaaaggtgag

SEQ ID NO: 95744 - DNA, 20 bp, synthetic construct
  misc_feature 1..20: note = CRISPR gRNA sequence
  source 1..20: mol_type = other DNA
tgggcagggtaaaggtgagc

SEQ ID NO: 95745 - DNA, 20 bp, synthetic construct
  misc_feature 1..20: note = CRISPR gRNA sequence
  source 1..20: mol_type = other DNA
agggtaaaggtgagcgggcg

SEQ ID NO: 95746 - DNA, 20 bp, synthetic construct
  misc_feature 1..20: note = CRISPR gRNA sequence
  source 1..20: mol_type = other DNA
gggtaaaggtgagcgggcgc

SEQ ID NO: 95747 - DNA, 20 bp, synthetic construct
  misc_feature 1..20: note = CRISPR gRNA sequence
  source 1..20: mol_type = other DNA
aaggtgagcgggcgcaggcg

SEQ ID NO: 95748 - DNA, 20 bp, synthetic construct
  misc_feature 1..20: note = CRISPR gRNA sequence
  source 1..20: mol_type = other DNA
cgcaggcgtagtgaaattct

SEQ ID NO: 95749 - DNA, 20 bp, synthetic construct
  misc_feature 1..20: note = CRISPR gRNA sequence
  source 1..20: mol_type = other DNA
caggcgtagtgaaattctca

SEQ ID NO: 95750 - DNA, 20 bp, synthetic construct
  misc_feature 1..20: note = CRISPR gRNA sequence
  source 1..20: mol_type = other DNA
gtgaaattctcagagccctt

SEQ ID NO: 95751 - DNA, 20 bp, synthetic construct
  misc_feature 1..20: note = CRISPR gRNA sequence
  source 1..20: mol_type = other DNA
tgaaattctcagagcccttt

SEQ ID NO: 95752 - DNA, 20 bp, synthetic construct
  misc_feature 1..20: note = CRISPR gRNA sequence
  source 1..20: mol_type = other DNA
aggccccgcccattccctcc

SEQ ID NO: 95753 - DNA, 20 bp, synthetic construct
  misc_feature 1..20: note = CRISPR gRNA sequence
  source 1..20: mol_type = other DNA
cccgcccattccctccgagt

SEQ ID NO: 95754 - DNA, 20 bp, synthetic construct
  misc_feature 1..20: note = CRISPR gRNA sequence
  source 1..20: mol_type = other DNA
cccattccctccgagtcggt

SEQ ID NO: 95755 - DNA, 20 bp, synthetic construct
  misc_feature 1..20: note = CRISPR gRNA sequence
  source 1..20: mol_type = other DNA
ccattccctccgagtcggtg

SEQ ID NO: 95756 - DNA, 20 bp, synthetic construct
  misc_feature 1..20: note = CRISPR gRNA sequence
  source 1..20: mol_type = other DNA
attccctccgagtcggtgag

SEQ ID NO: 95757 - DNA, 20 bp, synthetic construct
  misc_feature 1..20: note = CRISPR gRNA sequence
  source 1..20: mol_type = other DNA
ttccctccgagtcggtgagg

SEQ ID NO: 95758 - DNA, 20 bp, synthetic construct
  misc_feature 1..20: note = CRISPR gRNA sequence
  source 1..20: mol_type = other DNA
tccctccgagtcggtgagga

SEQ ID NO: 95759 - DNA, 20 bp, synthetic construct
  misc_feature 1..20: note = CRISPR gRNA sequence
  source 1..20: mol_type = other DNA
ccctccgagtcggtgaggag

SEQ ID NO: 95760 - DNA, 20 bp, synthetic construct
  misc_feature 1..20: note = CRISPR gRNA sequence
  source 1..20: mol_type = other DNA
cgagtcggtgaggaggggaa

SEQ ID NO: 95761 - DNA, 20 bp, synthetic construct
  misc_feature 1..20: note = CRISPR gRNA sequence
  source 1..20: mol_type = other DNA
gtcggtgaggaggggaaaag

SEQ ID NO: 95762 - DNA, 20 bp, synthetic construct
  misc_feature 1..20: note = CRISPR gRNA sequence
  source 1..20: mol_type = other DNA
tcggtgaggaggggaaaaga

SEQ ID NO: 95763 - DNA, 20 bp, synthetic construct
  misc_feature 1..20: note = CRISPR gRNA sequence
  source 1..20: mol_type = other DNA
gaggaggggaaaagaaggcg

SEQ ID NO: 95764 - DNA, 20 bp, synthetic construct
  misc_feature 1..20: note = CRISPR gRNA sequence
  source 1..20: mol_type = other DNA
aggaggggaaaagaaggcgc

SEQ ID NO: 95765 - DNA, 20 bp, synthetic construct
  misc_feature 1..20: note = CRISPR gRNA sequence
  source 1..20: mol_type = other DNA
cgcaggcgcaactgccctcc

SEQ ID NO: 95766 - DNA, 20 bp, synthetic construct
  misc_feature 1..20: note = CRISPR gRNA sequence
  source 1..20: mol_type = other DNA
gcaggcgcaactgccctccc

SEQ ID NO: 95767 - DNA, 20 bp, synthetic construct
  misc_feature 1..20: note = CRISPR gRNA sequence
  source 1..20: mol_type = other DNA
caactgccctcccaggaccc

SEQ ID NO: 95768 - DNA, 20 bp, synthetic construct
  misc_feature 1..20: note = CRISPR gRNA sequence
  source 1..20: mol_type = other DNA
ctgccctcccaggaccccag

SEQ ID NO: 95769 - DNA, 20 bp, synthetic construct
  misc_feature 1..20: note = CRISPR gRNA sequence
  source 1..20: mol_type = other DNA
cggaacccacgccctcccct

SEQ ID NO: 95770 - DNA, 20 bp, synthetic construct
  misc_feature 1..20: note = CRISPR gRNA sequence
  source 1..20: mol_type = other DNA
acgccctcccctaagtctta

SEQ ID NO: 95771 - DNA, 20 bp, synthetic construct
  misc_feature 1..20: note = CRISPR gRNA sequence
  source 1..20: mol_type = other DNA
cgccctcccctaagtcttaa

SEQ ID NO: 95772 - DNA, 20 bp, synthetic construct
  misc_feature 1..20: note = CRISPR gRNA sequence
  source 1..20: mol_type = other DNA
gccctcccctaagtcttaaa

SEQ ID NO: 95773 - DNA, 20 bp, synthetic construct
  misc_feature 1..20: note = CRISPR gRNA sequence
  source 1..20: mol_type = other DNA
tcccctaagtcttaaagggc

SEQ ID NO: 95774 - DNA, 20 bp, synthetic construct
  misc_feature 1..20: note = CRISPR gRNA sequence
  source 1..20: mol_type = other DNA
ccctaagtcttaaagggcca

SEQ ID NO: 95775 - DNA, 20 bp, synthetic construct
  misc_feature 1..20: note = CRISPR gRNA sequence
  source 1..20: mol_type = other DNA
cctaagtcttaaagggccag

SEQ ID NO: 95776 - DNA, 20 bp, synthetic construct
  misc_feature 1..20: note = CRISPR gRNA sequence
  source 1..20: mol_type = other DNA
aagtcttaaagggccagagg

SEQ ID NO: 95777 - DNA, 20 bp, synthetic construct
  misc_feature 1..20: note = CRISPR gRNA sequence
  source 1..20: mol_type = other DNA
cagaggcagcacttactgcc

SEQ ID NO: 95778 - DNA, 20 bp, synthetic construct
  misc_feature 1..20: note = CRISPR gRNA sequence
  source 1..20: mol_type = other DNA
agaggcagcacttactgccc

SEQ ID NO: 95779 - DNA, 20 bp, synthetic construct
  misc_feature 1..20: note = CRISPR gRNA sequence
  source 1..20: mol_type = other DNA
cccgggcccttcctcacttt

SEQ ID NO: 95780 - DNA, 20 bp, synthetic construct
  misc_feature 1..20: note = CRISPR gRNA sequence
  source 1..20: mol_type = other DNA
ccgggcccttcctcactttt

SEQ ID NO: 95781 - DNA, 20 bp, synthetic construct
  misc_feature 1..20: note = CRISPR gRNA sequence
  source 1..20: mol_type = other DNA
cgggcccttcctcacttttg

SEQ ID NO: 95782 - DNA, 20 bp, synthetic construct
  misc_feature 1..20: note = CRISPR gRNA sequence
  source 1..20: mol_type = other DNA
gggcccttcctcacttttgg

SEQ ID NO: 95783 - DNA, 20 bp, synthetic construct
  misc_feature 1..20: note = CRISPR gRNA sequence
  source 1..20: mol_type = other DNA
ggcccttcctcacttttggg

SEQ ID NO: 95784 - DNA, 20 bp, synthetic construct
  misc_feature 1..20: note = CRISPR gRNA sequence
  source 1..20: mol_type = other DNA
ccttcctcacttttgggggg

SEQ ID NO: 95785 - DNA, 20 bp, synthetic construct
  misc_feature 1..20: note = CRISPR gRNA sequence
  source 1..20: mol_type = other DNA
cttcctcacttttggggggc

SEQ ID NO: 95786 - DNA, 20 bp, synthetic construct
  misc_feature 1..20: note = CRISPR gRNA sequence
  source 1..20: mol_type = other DNA
ttcctcacttttggggggcg

SEQ ID NO: 95787 - DNA, 20 bp, synthetic construct
  misc_feature 1..20: note = CRISPR gRNA sequence
  source 1..20: mol_type = other DNA
tcctcacttttggggggcgg

SEQ ID NO: 95788 - DNA, 20 bp, synthetic construct
  misc_feature 1..20: note = CRISPR gRNA sequence
  source 1..20: mol_type = other DNA
tttggggggcgggggtgcgc

SEQ ID NO: 95789 - DNA, 20 bp, synthetic construct
  misc_feature 1..20: note = CRISPR gRNA sequence
  source 1..20: mol_type = other DNA
ggggcgggggtgcgcaagcg

SEQ ID NO: 95790 - DNA, 20 bp, synthetic construct
  misc_feature 1..20: note = CRISPR gRNA sequence
  source 1..20: mol_type = other DNA
gcgggggtgcgcaagcgcag

SEQ ID NO: 95791 - DNA, 20 bp, synthetic construct
  misc_feature 1..20: note = CRISPR gRNA sequence
  source 1..20: mol_type = other DNA
cgggggtgcgcaagcgcagt

SEQ ID NO: 95792 - DNA, 20 bp, synthetic construct
  misc_feature 1..20: note = CRISPR gRNA sequence
  source 1..20: mol_type = other DNA
gggggtgcgcaagcgcagtg

SEQ ID NO: 95793 - DNA, 20 bp, synthetic construct
  misc_feature 1..20: note = CRISPR gRNA sequence
  source 1..20: mol_type = other DNA
ggggtgcgcaagcgcagtgg

SEQ ID NO: 95794 - DNA, 20 bp, synthetic construct
  misc_feature 1..20: note = CRISPR gRNA sequence
  source 1..20: mol_type = other DNA
ggtgcgcaagcgcagtgggg

SEQ ID NO: 95795 - DNA, 20 bp, synthetic construct
  misc_feature 1..20: note = CRISPR gRNA sequence
  source 1..20: mol_type = other DNA
caagcgcagtgggggagctc

SEQ ID NO: 95796 - DNA, 20 bp, synthetic construct
  misc_feature 1..20: note = CRISPR gRNA sequence
  source 1..20: mol_type = other DNA
aagcgcagtgggggagctct

SEQ ID NO: 95797 - DNA, 20 bp, synthetic construct
  misc_feature 1..20: note = CRISPR gRNA sequence
  source 1..20: mol_type = other DNA
agcgcagtgggggagctctg

SEQ ID NO: 95798 - DNA, 20 bp, synthetic construct
  misc_feature 1..20: note = CRISPR gRNA sequence
  source 1..20: mol_type = other DNA
gcagtgggggagctctgggg

SEQ ID NO: 95799 - DNA, 20 bp, synthetic construct
  misc_feature 1..20: note = CRISPR gRNA sequence
  source 1..20: mol_type = other DNA
cagtgggggagctctggggt

SEQ ID NO: 95800 - DNA, 20 bp, synthetic construct
  misc_feature 1..20: note = CRISPR gRNA sequence
  source 1..20: mol_type = other DNA
agtgggggagctctggggtg

SEQ ID NO: 95801 - DNA, 20 bp, synthetic construct
  misc_feature 1..20: note = CRISPR gRNA sequence
  source 1..20: mol_type = other DNA
gtgggggagctctggggtgg

SEQ ID NO: 95802 - DNA, 20 bp, synthetic construct
  misc_feature 1..20: note = CRISPR gRNA sequence
  source 1..20: mol_type = other DNA
ggggagctctggggtggggg

SEQ ID NO: 95803 - DNA, 20 bp, synthetic construct
  misc_feature 1..20: note = CRISPR gRNA sequence
  source 1..20: mol_type = other DNA
gagctctggggtgggggtag

SEQ ID NO: 95804 - DNA, 20 bp, synthetic construct
  misc_feature 1..20: note = CRISPR gRNA sequence
  source 1..20: mol_type = other DNA
ctggggtgggggtagcggtc

SEQ ID NO: 95805 - DNA, 20 bp, synthetic construct
  misc_feature 1..20: note = CRISPR gRNA sequence
  source 1..20: mol_type = other DNA
gggggtagcggtcgagtatc

SEQ ID NO: 95806 - DNA, 20 bp, synthetic construct
  misc_feature 1..20: note = CRISPR gRNA sequence
  source 1..20: mol_type = other DNA
tatcaagttgctttctgtcc

SEQ ID NO: 95807 - DNA, 20 bp, synthetic construct
  misc_feature 1..20: note = CRISPR gRNA sequence
  source 1..20: mol_type = other DNA
caagttgctttctgtcccgg

SEQ ID NO: 95808 - DNA, 20 bp, synthetic construct
  misc_feature 1..20: note = CRISPR gRNA sequence
  source 1..20: mol_type = other DNA
agttgctttctgtcccggca

SEQ ID NO: 95809 - DNA, 20 bp, synthetic construct
  misc_feature 1..20: note = CRISPR gRNA sequence
  source 1..20: mol_type = other DNA
gttgctttctgtcccggcag

SEQ ID NO: 95810 - DNA, 20 bp, synthetic construct
  misc_feature 1..20: note = CRISPR gRNA sequence
  source 1..20: mol_type = other DNA
gctttctgtcccggcagagg

SEQ ID NO: 95811 - DNA, 20 bp, synthetic construct
  misc_feature 1..20: note = CRISPR gRNA sequence
  source 1..20: mol_type = other DNA
tctgtcccggcagaggaagc

SEQ ID NO: 95812 - DNA, 20 bp, synthetic construct
  misc_feature 1..20: note = CRISPR gRNA sequence
  source 1..20: mol_type = other DNA
gcagaggaagccagatcgct

SEQ ID NO: 95813 - DNA, 20 bp, synthetic construct
  misc_feature 1..20: note = CRISPR gRNA sequence
  source 1..20: mol_type = other DNA
cagaggaagccagatcgctg

SEQ ID NO: 95814 - DNA, 20 bp, synthetic construct
  misc_feature 1..20: note = CRISPR gRNA sequence
  source 1..20: mol_type = other DNA
agaggaagccagatcgctga

SEQ ID NO: 95815 - DNA, 20 bp, synthetic construct
  misc_feature 1..20: note = CRISPR gRNA sequence
  source 1..20: mol_type = other DNA
aagccagatcgctgagggtc

SEQ ID NO: 95816 - DNA, 20 bp, synthetic construct
  misc_feature 1..20: note = CRISPR gRNA sequence
  source 1..20: mol_type = other DNA
atcgctgagggtccggtctc

SEQ ID NO: 95817 - DNA, 20 bp, synthetic construct
  misc_feature 1..20: note = CRISPR gRNA sequence
  source 1..20: mol_type = other DNA
ttgcctcctgctatatccat

SEQ ID NO: 95818 - DNA, 20 bp, synthetic construct
  misc_feature 1..20: note = CRISPR gRNA sequence
  source 1..20: mol_type = other DNA
cctcctgctatatccattgg

SEQ ID NO: 95819 - DNA, 20 bp, synthetic construct
  misc_feature 1..20: note = CRISPR gRNA sequence
  source 1..20: mol_type = other DNA
tcctgctatatccattggaa

SEQ ID NO: 95820 - DNA, 20 bp, synthetic construct
  misc_feature 1..20: note = CRISPR gRNA sequence
  source 1..20: mol_type = other DNA
ctatatccattggaagagaa

SEQ ID NO: 95821 - DNA, 20 bp, synthetic construct
  misc_feature 1..20: note = CRISPR gRNA sequence
  source 1..20: mol_type = other DNA
gaagagaaaagtttgtgact

SEQ ID NO: 95822 - DNA, 20 bp, synthetic construct
  misc_feature 1..20: note = CRISPR gRNA sequence
  source 1..20: mol_type = other DNA
aagagaaaagtttgtgactt

SEQ ID NO: 95823 - DNA, 20 bp, synthetic construct
  misc_feature 1..20: note = CRISPR gRNA sequence
  source 1..20: mol_type = other DNA
agtttgtgacttgggccccc

SEQ ID NO: 95824 - DNA, 20 bp, synthetic construct
  misc_feature 1..20: note = CRISPR gRNA sequence
  source 1..20: mol_type = other DNA
gacttgggcccccaagtttt

SEQ ID NO: 95825 - DNA, 20 bp, synthetic construct
  misc_feature 1..20: note = CRISPR gRNA sequence
  source 1..20: mol_type = other DNA
cttgggcccccaagttttga

SEQ ID NO: 95826 - DNA, 20 bp, synthetic construct
  misc_feature 1..20: note = CRISPR gRNA sequence
  source 1..20: mol_type = other DNA
cccccaagttttgagagaac

SEQ ID NO: 95827 - DNA, 20 bp, synthetic construct
  misc_feature 1..20: note = CRISPR gRNA sequence
  source 1..20: mol_type = other DNA
ccccaagttttgagagaact

SEQ ID NO: 95828 - DNA, 20 bp, synthetic construct
  misc_feature 1..20: note = CRISPR gRNA sequence
  source 1..20: mol_type = other DNA
ttttgagagaactgggcttt

SEQ ID NO: 95829 - DNA, 20 bp, synthetic construct
  misc_feature 1..20: note = CRISPR gRNA sequence
  source 1..20: mol_type = other DNA
agagaactgggctttcggcg

SEQ ID NO: 95830 - DNA, 20 bp, synthetic construct
  misc_feature 1..20: note = CRISPR gRNA sequence
  source 1..20: mol_type = other DNA
gagaactgggctttcggcgc

SEQ ID NO: 95831 - DNA, 20 bp, synthetic construct
  misc_feature 1..20: note = CRISPR gRNA sequence
  source 1..20: mol_type = other DNA
agaactgggctttcggcgcg

SEQ ID NO: 95832 - DNA, 20 bp, synthetic construct
  misc_feature 1..20: note = CRISPR gRNA sequence
  source 1..20: mol_type = other DNA
gaactgggctttcggcgcgg

SEQ ID NO: 95833 - DNA, 20 bp, synthetic construct
  misc_feature 1..20: note = CRISPR gRNA sequence
  source 1..20: mol_type = other DNA
aactgggctttcggcgcggg

SEQ ID NO: 95834 - DNA, 20 bp, synthetic construct
  misc_feature 1..20: note = CRISPR gRNA sequence
  source 1..20: mol_type = other DNA
gggctttcggcgcgggggga

SEQ ID NO: 95835 - DNA, 20 bp, synthetic construct
  misc_feature 1..20: note = CRISPR gRNA sequence
  source 1..20: mol_type = other DNA
gctttcggcgcggggggaca

SEQ ID NO: 95836 - DNA, 20 bp, synthetic construct
  misc_feature 1..20: note = CRISPR gRNA sequence
  source 1..20: mol_type = other DNA
ctttcggcgcggggggacag

SEQ ID NO: 95837 - DNA, 20 bp, synthetic construct
  misc_feature 1..20: note = CRISPR gRNA sequence
  source 1..20: mol_type = other DNA
ttcggcgcggggggacagag

SEQ ID NO: 95838 - DNA, 20 bp, synthetic construct
  misc_feature 1..20: note = CRISPR gRNA sequence
  source 1..20: mol_type = other DNA
tcggcgcggggggacagagg

SEQ ID NO: 95839 - DNA, 20 bp, synthetic construct
  misc_feature 1..20: note = CRISPR gRNA sequence
  source 1..20: mol_type = other DNA
ggggggacagaggaggctcg

SEQ ID NO: 95840 - DNA, 20 bp, synthetic construct
  misc_feature 1..20: note = CRISPR gRNA sequence
  source 1..20: mol_type = other DNA
gggggacagaggaggctcgt

SEQ ID NO: 95841 - DNA, 20 bp, synthetic construct
  misc_feature 1..20: note = CRISPR gRNA sequence
  source 1..20: mol_type = other DNA
ggggacagaggaggctcgtg

SEQ ID NO: 95842 - DNA, 20 bp, synthetic construct
  misc_feature 1..20: note = CRISPR gRNA sequence
  source 1..20: mol_type = other DNA
ggacagaggaggctcgtggg

SEQ ID NO: 95843 - DNA, 20 bp, synthetic construct
  misc_feature 1..20: note = CRISPR gRNA sequence
  source 1..20: mol_type = other DNA
gacagaggaggctcgtgggg

SEQ ID NO: 95844 - DNA, 20 bp, synthetic construct
  misc_feature 1..20: note = CRISPR gRNA sequence
  source 1..20: mol_type = other DNA
gaggaggctcgtggggaggt

SEQ ID NO: 95845 - DNA, 20 bp, synthetic construct
  misc_feature 1..20: note = CRISPR gRNA sequence
  source 1..20: mol_type = other DNA
gaggctcgtggggaggtgag

SEQ ID NO: 95846 - DNA, 20 bp, synthetic construct
  misc_feature 1..20: note = CRISPR gRNA sequence
  source 1..20: mol_type = other DNA
ggggaggtgagtggacctcc

SEQ ID NO: 95847 - DNA, 20 bp, synthetic construct
  misc_feature 1..20: note = CRISPR gRNA sequence
  source 1..20: mol_type = other DNA
gtggacctcctggatcgatt

SEQ ID NO: 95848 - DNA, 20 bp, synthetic construct
  misc_feature 1..20: note = CRISPR gRNA sequence
  source 1..20: mol_type = other DNA
tggacctcctggatcgattt

SEQ ID NO: 95849 - DNA, 20 bp, synthetic construct
  misc_feature 1..20: note = CRISPR gRNA sequence
  source 1..20: mol_type = other DNA
gacctcctggatcgatttag

SEQ ID NO: 95850 - DNA, 20 bp, synthetic construct
  misc_feature 1..20: note = CRISPR gRNA sequence
  source 1..20: mol_type = other DNA
acctcctggatcgatttagg

SEQ ID NO: 95851 - DNA, 20 bp, synthetic construct
  misc_feature 1..20: note = CRISPR gRNA sequence
  source 1..20: mol_type = other DNA
ctggatcgatttaggaggct

SEQ ID NO: 95852 - DNA, 20 bp, synthetic construct
  misc_feature 1..20: note = CRISPR gRNA sequence
  source 1..20: mol_type = other DNA
tggatcgatttaggaggctc

SEQ ID NO: 95853 - DNA, 20 bp, synthetic construct
  misc_feature 1..20: note = CRISPR gRNA sequence
  source 1..20: mol_type = other DNA
atcgatttaggaggctcggg

SEQ ID NO: 95854 - DNA, 20 bp, synthetic construct
  misc_feature 1..20: note = CRISPR gRNA sequence
  source 1..20: mol_type = other DNA
tcgatttaggaggctcgggt

SEQ ID NO: 95855 - DNA, 20 bp, synthetic construct
  misc_feature 1..20: note = CRISPR gRNA sequence
  source 1..20: mol_type = other DNA
ttaggaggctcgggtgggac

SEQ ID NO: 95856 - DNA, 20 bp, synthetic construct
  misc_feature 1..20: note = CRISPR gRNA sequence
  source 1..20: mol_type = other DNA
taggaggctcgggtgggact

SEQ ID NO: 95857 - DNA, 20 bp, synthetic construct
  misc_feature 1..20: note = CRISPR gRNA sequence
  source 1..20: mol_type = other DNA
ggaccaatcgcacctttgtt

SEQ ID NO: 95858 - DNA, 20 bp, synthetic construct
  misc_feature 1..20: note = CRISPR gRNA sequence
  source 1..20: mol_type = other DNA
tgttgagccgtcactcatta

SEQ ID NO: 95859 - DNA, 20 bp, synthetic construct
  misc_feature 1..20: note = CRISPR gRNA sequence
  source 1..20: mol_type = other DNA
gttgagccgtcactcattat

SEQ ID NO: 95860 - DNA, 20 bp, synthetic construct
  misc_feature 1..20: note = CRISPR gRNA sequence
  source 1..20: mol_type = other DNA
ttgagccgtcactcattatg

SEQ ID NO: 95861 - DNA, 20 bp, synthetic construct
  misc_feature 1..20: note = CRISPR gRNA sequence
  source 1..20: mol_type = other DNA
gagccgtcactcattatggg

SEQ ID NO: 95862 - DNA, 20 bp, synthetic construct
  misc_feature 1..20: note = CRISPR gRNA sequence
  source 1..20: mol_type = other DNA
ggagcccctcccaacaacca

SEQ ID NO: 95863 - DNA, 20 bp, synthetic construct
  misc_feature 1..20: note = CRISPR gRNA sequence
  source 1..20: mol_type = other DNA
aaccatagcgaatatttatt

SEQ ID NO: 95864 - DNA, 20 bp, synthetic construct
  misc_feature 1..20: note = CRISPR gRNA sequence
  source 1..20: mol_type = other DNA
tatttattgagctccacgct

SEQ ID NO: 95865 - DNA, 20 bp, synthetic construct
  misc_feature 1..20: note = CRISPR gRNA sequence
  source 1..20: mol_type = other DNA
ttattgagctccacgcttag

SEQ ID NO: 95866 - DNA, 20 bp, synthetic construct
  misc_feature 1..20: note = CRISPR gRNA sequence
  source 1..20: mol_type = other DNA
cgcttagcagatcccccgat

SEQ ID NO: 95867 - DNA, 20 bp, synthetic construct
  misc_feature 1..20: note = CRISPR gRNA sequence
  source 1..20: mol_type = other DNA
atcccccgataagctatgta

SEQ ID NO: 95868 - DNA, 20 bp, synthetic construct
  misc_feature 1..20: note = CRISPR gRNA sequence
  source 1..20: mol_type = other DNA
tgtacagacataattcgttg

SEQ ID NO: 95869 - DNA, 20 bp, synthetic construct
  misc_feature 1..20: note = CRISPR gRNA sequence
  source 1..20: mol_type = other DNA
gtacagacataattcgttgt

SEQ ID NO: 95870 - DNA, 20 bp, synthetic construct
  misc_feature 1..20: note = CRISPR gRNA sequence
  source 1..20: mol_type = other DNA
ctcatttccacattttgtcg

SEQ ID NO: 95871 - DNA, 20 bp, synthetic construct
  misc_feature 1..20: note = CRISPR gRNA sequence
  source 1..20: mol_type = other DNA
catttccacattttgtcgtg

SEQ ID NO: 95872 - DNA, 20 bp, synthetic construct
  misc_feature 1..20: note = CRISPR gRNA sequence
  source 1..20: mol_type = other DNA
atttccacattttgtcgtgg

SEQ ID NO: 95873 - DNA, 20 bp, synthetic construct
  misc_feature 1..20: note = CRISPR gRNA sequence
  source 1..20: mol_type = other DNA
attttgtcgtggaggaaact

SEQ ID NO: 95874 - DNA, 20 bp, synthetic construct
  misc_feature 1..20: note = CRISPR gRNA sequence
  source 1..20: mol_type = other DNA
ttttgtcgtggaggaaactg

SEQ ID NO: 95875 - DNA, 20 bp, synthetic construct
  misc_feature 1..20: note = CRISPR gRNA sequence
  source 1..20: mol_type = other DNA
gtggaggaaactgaggctca

SEQ ID NO: 95876 - DNA, 20 bp, synthetic construct
  misc_feature 1..20: note = CRISPR gRNA sequence
  source 1..20: mol_type = other DNA
tggaggaaactgaggctcaa

SEQ ID NO: 95877 - DNA, 20 bp, synthetic construct
  misc_feature 1..20: note = CRISPR gRNA sequence
  source 1..20: mol_type = other DNA
gaaactgaggctcaaaggtt

SEQ ID NO: 95878 - DNA, 20 bp, synthetic construct
  misc_feature 1..20: note = CRISPR gRNA sequence
  source 1..20: mol_type = other DNA
aaaggttaagtcacgtgccc

SEQ ID NO: 95879 - DNA, 20 bp, synthetic construct
  misc_feature 1..20: note = CRISPR gRNA sequence
  source 1..20: mol_type = other DNA
gtcacgtgcccaagttctca

SEQ ID NO: 95880 - DNA, 20 bp, synthetic construct
  misc_feature 1..20: note = CRISPR gRNA sequence
  source 1..20: mol_type = other DNA
gttctcacggcctataaatt

SEQ ID NO: 95881 - DNA, 20 bp, synthetic construct
  misc_feature 1..20: note = CRISPR gRNA sequence
  source 1..20: mol_type = other DNA
ttctcacggcctataaattg

SEQ ID NO: 95882 - DNA, 20 bp, synthetic construct
  misc_feature 1..20: note = CRISPR gRNA sequence
  source 1..20: mol_type = other DNA
tctcacggcctataaattga

SEQ ID NO: 95883 - DNA, 20 bp, synthetic construct
  misc_feature 1..20: note = CRISPR gRNA sequence
  source 1..20: mol_type = other DNA
taaattgagggattcgaacc

SEQ ID NO: 95884 - DNA, 20 bp, synthetic construct
  misc_feature 1..20: note = CRISPR gRNA sequence
  source 1..20: mol_type = other DNA
ttgagggattcgaacccaga

SEQ ID NO: 95885 - DNA, 20 bp, synthetic construct
  misc_feature 1..20: note = CRISPR gRNA sequence
  source 1..20: mol_type = other DNA
cgaacccagacagctgaccc

SEQ ID NO: 95886 - DNA, 20 bp, synthetic construct
  misc_feature 1..20: note = CRISPR gRNA sequence
  source 1..20: mol_type = other DNA
aacccagacagctgacccca

SEQ ID NO: 95887 - DNA, 20 bp, synthetic construct
  misc_feature 1..20: note = CRISPR gRNA sequence
  source 1..20: mol_type = other DNA
gacagctgaccccagagccc

SEQ ID NO: 95888 - DNA, 20 bp, synthetic construct
  misc_feature 1..20: note = CRISPR gRNA sequence
  source 1..20: mol_type = other DNA
tttttttttttttttttttt

SEQ ID NO: 95889 - DNA, 20 bp, synthetic construct
  misc_feature 1..20: note = CRISPR gRNA sequence
  source 1..20: mol_type = other DNA
ttttttttttttttttgaga

SEQ ID NO: 95890 - DNA, 20 bp, synthetic construct
  misc_feature 1..20: note = CRISPR gRNA sequence
  source 1..20: mol_type = other DNA
ttttttttttttttgagaca

SEQ ID NO: 95891 - DNA, 20 bp, synthetic construct
  misc_feature 1..20: note = CRISPR gRNA sequence
  source 1..20: mol_type = other DNA
agagtcttgctctgtcgccc

SEQ ID NO: 95892 - DNA, 20 bp, synthetic construct
  misc_feature 1..20: note = CRISPR gRNA sequence
  source 1..20: mol_type = other DNA
ttgctctgtcgccccagcta

SEQ ID NO: 95893 - DNA, 20 bp, synthetic construct
  misc_feature 1..20: note = CRISPR gRNA sequence
  source 1..20: mol_type = other DNA
ctgtcgccccagctacagtg

SEQ ID NO: 95894 - DNA, 20 bp, synthetic construct
  misc_feature 1..20: note = CRISPR gRNA sequence
  source 1..20: mol_type = other DNA
tcgccccagctacagtgcag

SEQ ID NO: 95895 - DNA, 20 bp, synthetic construct
  misc_feature 1..20: note = CRISPR gRNA sequence
  source 1..20: mol_type = other DNA
caccgcaacctccacctccc

SEQ ID NO: 95896 - DNA, 20 bp, synthetic construct
  misc_feature 1..20: note = CRISPR gRNA sequence
  source 1..20: mol_type = other DNA
aacctccacctcccgagttc

SEQ ID NO: 95897 - DNA, 20 bp, synthetic construct
  misc_feature 1..20: note = CRISPR gRNA sequence
  source 1..20: mol_type = other DNA
gagttcaagcaattctgcct

SEQ ID NO: 95898 - DNA, 20 bp, synthetic construct
  misc_feature 1..20: note = CRISPR gRNA sequence
  source 1..20: mol_type = other DNA
caattctgcctcagcctccc

SEQ ID NO: 95899 - DNA, 20 bp, synthetic construct
  misc_feature 1..20: note = CRISPR gRNA sequence
  source 1..20: mol_type = other DNA
ttctgcctcagcctcccgag

SEQ ID NO: 95900 - DNA, 20 bp, synthetic construct
  misc_feature 1..20: note = CRISPR gRNA sequence
  source 1..20: mol_type = other DNA
gcctcagcctcccgagtagc

SEQ ID NO: 95901 - DNA, 20 bp, synthetic construct
  misc_feature 1..20: note = CRISPR gRNA sequence
  source 1..20: mol_type = other DNA
cctcagcctcccgagtagct

SEQ ID NO: 95902 - DNA, 20 bp, synthetic construct
  misc_feature 1..20: note = CRISPR gRNA sequence
  source 1..20: mol_type = other DNA
ctcccgagtagctgggatca

SEQ ID NO: 95903 - DNA, 20 bp, synthetic construct
  misc_feature 1..20: note = CRISPR gRNA sequence
  source 1..20: mol_type = other DNA
tcccgagtagctgggatcac

SEQ ID NO: 95904 - DNA, 20 bp, synthetic construct
  misc_feature 1..20: note = CRISPR gRNA sequence
  source 1..20: mol_type = other DNA
caggcgcccgccaccgcgct

SEQ ID NO: 95905 - DNA, 20 bp, synthetic construct
  misc_feature 1..20: note = CRISPR gRNA sequence
  source 1..20: mol_type = other DNA
ttggctaatttttgtatttt

SEQ ID NO: 95906 - DNA, 20 bp, synthetic construct
  misc_feature 1..20: note = CRISPR gRNA sequence
  source 1..20: mol_type = other DNA
taatttttgtatttttagta

SEQ ID NO: 95907 - DNA, 20 bp, synthetic construct
  misc_feature 1..20: note = CRISPR gRNA sequence
  source 1..20: mol_type = other DNA
ttttgtatttttagtacaga

SEQ ID NO: 95908 - DNA, 20 bp, synthetic construct
  misc_feature 1..20: note = CRISPR gRNA sequence
  source 1..20: mol_type = other DNA
tttgtatttttagtacagat

SEQ ID NO: 95909 - DNA, 20 bp, synthetic construct
  misc_feature 1..20: note = CRISPR gRNA sequence
  source 1..20: mol_type = other DNA
ttgtatttttagtacagatg

SEQ ID NO: 95910 - DNA, 20 bp, synthetic construct
  misc_feature 1..20: note = CRISPR gRNA sequence
  source 1..20: mol_type = other DNA
gtacagatggggtttcacca

SEQ ID NO: 95911 - DNA, 20 bp, synthetic construct
  misc_feature 1..20: note = CRISPR gRNA sequence
  source 1..20: mol_type = other DNA
cagatggggtttcaccatgg

SEQ ID NO: 95912 - DNA, 20 bp, synthetic construct
  misc_feature 1..20: note = CRISPR gRNA sequence
  source 1..20: mol_type = other DNA
tggggtttcaccatggtggc

SEQ ID NO: 95913 - DNA, 20 bp, synthetic construct
  misc_feature 1..20: note = CRISPR gRNA sequence
  source 1..20: mol_type = other DNA
tttcaccatggtggccagcc

SEQ ID NO: 95914 - DNA, 20 bp, synthetic construct
  misc_feature 1..20: note = CRISPR gRNA sequence
  source 1..20: mol_type = other DNA
acctcatgatccaccctcct

SEQ ID NO: 95915 - DNA, 20 bp, synthetic construct
  misc_feature 1..20: note = CRISPR gRNA sequence
  source 1..20: mol_type = other DNA
ccaccctcctcggcctccca

SEQ ID NO: 95916 - DNA, 20 bp, synthetic construct
  misc_feature 1..20: note = CRISPR gRNA sequence
  source 1..20: mol_type = other DNA
tcctcggcctcccaaagtgc

SEQ ID NO: 95917 - DNA, 20 bp, synthetic construct
  misc_feature 1..20: note = CRISPR gRNA sequence
  source 1..20: mol_type = other DNA
cctcggcctcccaaagtgct

SEQ ID NO: 95918 - DNA, 20 bp, synthetic construct
  misc_feature 1..20: note = CRISPR gRNA sequence
  source 1..20: mol_type = other DNA
ctcccaaagtgctgggatta

SEQ ID NO: 95919 - DNA, 20 bp, synthetic construct
  misc_feature 1..20: note = CRISPR gRNA sequence
  source 1..20: mol_type = other DNA
agtgctgggattacagccgt

SEQ ID NO: 95920 - DNA, 20 bp, synthetic construct
  misc_feature 1..20: note = CRISPR gRNA sequence
  source 1..20: mol_type = other DNA
cgtgagccactgtgccctgc

SEQ ID NO: 95921 - DNA, 20 bp, synthetic construct
  misc_feature 1..20: note = CRISPR gRNA sequence
  source 1..20: mol_type = other DNA
tgagccactgtgccctgcca

SEQ ID NO: 95922 - DNA, 20 bp, synthetic construct
  misc_feature 1..20: note = CRISPR gRNA sequence
  source 1..20: mol_type = other DNA
cactgtgccctgccagagcc

SEQ ID NO: 95923 - DNA, 20 bp, synthetic construct
  misc_feature 1..20: note = CRISPR gRNA sequence
  source 1..20: mol_type = other DNA
actgtgccctgccagagccc

SEQ ID NO: 95924 - DNA, 20 bp, synthetic construct
  misc_feature 1..20: note = CRISPR gRNA sequence
  source 1..20: mol_type = other DNA
ctcttaaacattgcacattg

SEQ ID NO: 95925 - DNA, 20 bp, synthetic construct
  misc_feature 1..20: note = CRISPR gRNA sequence
  source 1..20: mol_type = other DNA
tcttaaacattgcacattgt

SEQ ID NO: 95926 - DNA, 20 bp, synthetic construct
  misc_feature 1..20: note = CRISPR gRNA sequence
  source 1..20: mol_type = other DNA
attgcacattgtaggtgctt

SEQ ID NO: 95927 - DNA, 20 bp, synthetic construct
  misc_feature 1..20: note = CRISPR gRNA sequence
  source 1..20: mol_type = other DNA
gcacattgtaggtgctttgg

SEQ ID NO: 95928 - DNA, 20 bp, synthetic construct
  misc_feature 1..20: note = CRISPR gRNA sequence
  source 1..20: mol_type = other DNA
cattgtaggtgctttggtgg

SEQ ID NO: 95929 - DNA, 20 bp, synthetic construct
  misc_feature 1..20: note = CRISPR gRNA sequence
  source 1..20: mol_type = other DNA
attgtaggtgctttggtggt

SEQ ID NO: 95930 - DNA, 20 bp, synthetic construct
  misc_feature 1..20: note = CRISPR gRNA sequence
  source 1..20: mol_type = other DNA
ttgtaggtgctttggtggtg

SEQ ID NO: 95931 - DNA, 20 bp, synthetic construct
  misc_feature 1..20: note = CRISPR gRNA sequence
  source 1..20: mol_type = other DNA
ggtgctttggtggtggggaa

SEQ ID NO: 95932 - DNA, 20 bp, synthetic construct
  misc_feature 1..20: note = CRISPR gRNA sequence
  source 1..20: mol_type = other DNA
gctttggtggtggggaatgg

SEQ ID NO: 95933 - DNA, 20 bp, synthetic construct
  misc_feature 1..20: note = CRISPR gRNA sequence
  source 1..20: mol_type = other DNA
tggggaatggtagacctcga

SEQ ID NO: 95934 - DNA, 20 bp, synthetic construct
  misc_feature 1..20: note = CRISPR gRNA sequence
  source 1..20: mol_type = other DNA
ggaatggtagacctcgaaag

SEQ ID NO: 95935 - DNA, 20 bp, synthetic construct
  misc_feature 1..20: note = CRISPR gRNA sequence
  source 1..20: mol_type = other DNA
tggtagacctcgaaagcagt

SEQ ID NO: 95936 - DNA, 20 bp, synthetic construct
  misc_feature 1..20: note = CRISPR gRNA sequence
  source 1..20: mol_type = other DNA
cctcgaaagcagttggactc

SEQ ID NO: 95937 - DNA, 20 bp, synthetic construct
  misc_feature 1..20: note = CRISPR gRNA sequence
  source 1..20: mol_type = other DNA
gactctggttttcatttccc

SEQ ID NO: 95938 - DNA, 20 bp, synthetic construct
  misc_feature 1..20: note = CRISPR gRNA sequence
  source 1..20: mol_type = other DNA
ggttttcatttccctggctc

SEQ ID NO: 95939 - DNA, 20 bp, synthetic construct
  misc_feature 1..20: note = CRISPR gRNA sequence
  source 1..20: mol_type = other DNA
cctggctctggtaattaacc

SEQ ID NO: 95940 - DNA, 20 bp, synthetic construct
  misc_feature 1..20: note = CRISPR gRNA sequence
  source 1..20: mol_type = other DNA
ctggtaattaacctggacct

SEQ ID NO: 95941 - DNA, 20 bp, synthetic construct
  misc_feature 1..20: note = CRISPR gRNA sequence
  source 1..20: mol_type = other DNA
cctcagtttacccaccctca

SEQ ID NO: 95942 - DNA, 20 bp, synthetic construct
  misc_feature 1..20: note = CRISPR gRNA sequence
  source 1..20: mol_type = other DNA
tttacccaccctcacagtgc

SEQ ID NO: 95943 - DNA, 20 bp, synthetic construct
  misc_feature 1..20: note = CRISPR gRNA sequence
  source 1..20: mol_type = other DNA
ttacccaccctcacagtgca

SEQ ID NO: 95944 - DNA, 20 bp, synthetic construct
  misc_feature 1..20: note = CRISPR gRNA sequence
  source 1..20: mol_type = other DNA
ccaccctcacagtgcaaggc

SEQ ID NO: 95945 - DNA, 20 bp, synthetic construct
  misc_feature 1..20: note = CRISPR gRNA sequence
  source 1..20: mol_type = other DNA
caccctcacagtgcaaggct

SEQ ID NO: 95946 - DNA, 20 bp, synthetic construct
  misc_feature 1..20: note = CRISPR gRNA sequence
  source 1..20: mol_type = other DNA
acagtgcaaggctaggtatg

SEQ ID NO: 95947 - DNA, 20 bp, synthetic construct
  misc_feature 1..20: note = CRISPR gRNA sequence
  source 1..20: mol_type = other DNA
tgcaaggctaggtatgcagt

SEQ ID NO: 95948 - DNA, 20 bp, synthetic construct
  misc_feature 1..20: note = CRISPR gRNA sequence
  source 1..20: mol_type = other DNA
tccccttctgacacctccgc

SEQ ID NO: 95949 - DNA, 20 bp, synthetic construct
  misc_feature 1..20: note = CRISPR gRNA sequence
  source 1..20: mol_type = other DNA
acctccgccagctttcccca

SEQ ID NO: 95950 - DNA, 20 bp, synthetic construct
  misc_feature 1..20: note = CRISPR gRNA sequence
  source 1..20: mol_type = other DNA
ctccgccagctttccccatg

SEQ ID NO: 95951 - DNA, 20 bp, synthetic construct
  misc_feature 1..20: note = CRISPR gRNA sequence
  source 1..20: mol_type = other DNA
ctttccccatggagcttacc

SEQ ID NO: 95952 - DNA, 20 bp, synthetic construct
  misc_feature 1..20: note = CRISPR gRNA sequence
  source 1..20: mol_type = other DNA
catggagcttacccagcctg

SEQ ID NO: 95953 - DNA, 20 bp, synthetic construct
  misc_feature 1..20: note = CRISPR gRNA sequence
  source 1..20: mol_type = other DNA
ggagcttacccagcctgcag

SEQ ID NO: 95954 - DNA, 20 bp, synthetic construct
  misc_feature 1..20: note = CRISPR gRNA sequence
  source 1..20: mol_type = other DNA
agcctgcagaagacctcatc

SEQ ID NO: 95955 - DNA, 20 bp, synthetic construct
  misc_feature 1..20: note = CRISPR gRNA sequence
  source 1..20: mol_type = other DNA
cagaagacctcatccagacc

SEQ ID NO: 95956 - DNA, 20 bp, synthetic construct
  misc_feature 1..20: note = CRISPR gRNA sequence
  source 1..20: mol_type = other DNA
aagacctcatccagacccag

SEQ ID NO: 95957 - DNA, 20 bp, synthetic construct
  misc_feature 1..20: note = CRISPR gRNA sequence
  source 1..20: mol_type = other DNA
gacccagcagacccctgcct

SEQ ID NO: 95958 - DNA, 20 bp, synthetic construct
  misc_feature 1..20: note = CRISPR gRNA sequence
  source 1..20: mol_type = other DNA
cagacccctgcctcagaact

SEQ ID NO: 95959 - DNA, 20 bp, synthetic construct
  misc_feature 1..20: note = CRISPR gRNA sequence
  source 1..20: mol_type = other DNA
agacccctgcctcagaactt

SEQ ID NO: 95960 - DNA, 20 bp, synthetic construct
  misc_feature 1..20: note = CRISPR gRNA sequence
  source 1..20: mol_type = other DNA
gacccctgcctcagaacttg

SEQ ID NO: 95961 - DNA, 20 bp, synthetic construct
  misc_feature 1..20: note = CRISPR gRNA sequence
  source 1..20: mol_type = other DNA
ctcagaacttggggaccctg

SEQ ID NO: 95962 - DNA, 20 bp, synthetic construct
  misc_feature 1..20: note = CRISPR gRNA sequence
  source 1..20: mol_type = other DNA
cttggggaccctgaagaccc

SEQ ID NO: 95963 - DNA, 20 bp, synthetic construct
  misc_feature 1..20: note = CRISPR gRNA sequence
  source 1..20: mol_type = other DNA
tggggaccctgaagaccccg

SEQ ID NO: 95964 - DNA, 20 bp, synthetic construct
  misc_feature 1..20: note = CRISPR gRNA sequence
  source 1..20: mol_type = other DNA
gggaccctgaagaccccgga

SEQ ID NO: 95965 - DNA, 20 bp, synthetic construct
  misc_feature 1..20: note = CRISPR gRNA sequence
  source 1..20: mol_type = other DNA
ggaccctgaagaccccggag

SEQ ID NO: 95966 - DNA, 20 bp, synthetic construct
  misc_feature 1..20: note = CRISPR gRNA sequence
  source 1..20: mol_type = other DNA
accctgaagaccccggagag

SEQ ID NO: 95967 - DNA, 20 bp, synthetic construct
  misc_feature 1..20: note = CRISPR gRNA sequence
  source 1..20: mol_type = other DNA
ccctgaagaccccggagagg

SEQ ID NO: 95968 - DNA, 20 bp, synthetic construct
  misc_feature 1..20: note = CRISPR gRNA sequence
  source 1..20: mol_type = other DNA
agaccccggagaggaggctg

SEQ ID NO: 95969 - DNA, 20 bp, synthetic construct
  misc_feature 1..20: note = CRISPR gRNA sequence
  source 1..20: mol_type = other DNA
cccggagaggaggctgcaga

SEQ ID NO: 95970 - DNA, 20 bp, synthetic construct
  misc_feature 1..20: note = CRISPR gRNA sequence
  source 1..20: mol_type = other DNA
agaggaggctgcagatggct

SEQ ID NO: 95971 - DNA, 20 bp, synthetic construct
  misc_feature 1..20: note = CRISPR gRNA sequence
  source 1..20: mol_type = other DNA
tgcagatggctcagacactg

SEQ ID NO: 95972 - DNA, 20 bp, synthetic construct
  misc_feature 1..20: note = CRISPR gRNA sequence
  source 1..20: mol_type = other DNA
ggctcagacactgtggtcct

SEQ ID NO: 95973 - DNA, 20 bp, synthetic construct
  misc_feature 1..20: note = CRISPR gRNA sequence
  source 1..20: mol_type = other DNA
agtctctttccctgcacaac

SEQ ID NO: 95974 - DNA, 20 bp, synthetic construct
  misc_feature 1..20: note = CRISPR gRNA sequence
  source 1..20: mol_type = other DNA
ttccctgcacaaccggatgc

SEQ ID NO: 95975 - DNA, 20 bp, synthetic construct
  misc_feature 1..20: note = CRISPR gRNA sequence
  source 1..20: mol_type = other DNA
atgccagtgtttcctctcca

SEQ ID NO: 95976 - DNA, 20 bp, synthetic construct
  misc_feature 1..20: note = CRISPR gRNA sequence
  source 1..20: mol_type = other DNA
tgccagtgtttcctctccac

SEQ ID NO: 95977 - DNA, 20 bp, synthetic construct
  misc_feature 1..20: note = CRISPR gRNA sequence
  source 1..20: mol_type = other DNA
gccagtgtttcctctccaca

SEQ ID NO: 95978 - DNA, 20 bp, synthetic construct
  misc_feature 1..20: note = CRISPR gRNA sequence
  source 1..20: mol_type = other DNA
agtgtttcctctccacaggg

SEQ ID NO: 95979 - DNA, 20 bp, synthetic construct
  misc_feature 1..20: note = CRISPR gRNA sequence
  source 1..20: mol_type = other DNA
gtgtttcctctccacagggt

SEQ ID NO: 95980 - DNA, 20 bp, synthetic construct
  misc_feature 1..20: note = CRISPR gRNA sequence
  source 1..20: mol_type = other DNA
acagggtaggatacctcctc

SEQ ID NO: 95981 - DNA, 20 bp, synthetic construct
  misc_feature 1..20: note = CRISPR gRNA sequence
  source 1..20: mol_type = other DNA
cagggtaggatacctcctct

SEQ ID NO: 95982 - DNA, 20 bp, synthetic construct
  misc_feature 1..20: note = CRISPR gRNA sequence
  source 1..20: mol_type = other DNA
taggatacctcctctgggat

SEQ ID NO: 95983 - DNA, 20 bp, synthetic construct
  misc_feature 1..20: note = CRISPR gRNA sequence
  source 1..20: mol_type = other DNA
ctcctctgggattagccctc

SEQ ID NO: 95984 - DNA, 20 bp, synthetic construct
  misc_feature 1..20: note = CRISPR gRNA sequence
  source 1..20: mol_type = other DNA
tcctctgggattagccctct

SEQ ID NO: 95985 - DNA, 20 bp, synthetic construct
  misc_feature 1..20: note = CRISPR gRNA sequence
  source 1..20: mol_type = other DNA
cctctgggattccatgatga

SEQ ID NO: 95986 - DNA, 20 bp, synthetic construct
  misc_feature 1..20: note = CRISPR gRNA sequence
  source 1..20: mol_type = other DNA
attccatgatgatggaatgt

SEQ ID NO: 95987 - DNA, 20 bp, synthetic construct
  misc_feature 1..20: note = CRISPR gRNA sequence
  source 1..20: mol_type = other DNA
ttccatgatgatggaatgtc

SEQ ID NO: 95988 - DNA, 20 bp, synthetic construct
  misc_feature 1..20: note = CRISPR gRNA sequence
  source 1..20: mol_type = other DNA
atggaatgtcaggcctcaca

SEQ ID NO: 95989 - DNA, 20 bp, synthetic construct
  misc_feature 1..20: note = CRISPR gRNA sequence
  source 1..20: mol_type = other DNA
gttttgttttgttgtttttt

SEQ ID NO: 95990 - DNA, 20 bp, synthetic construct
  misc_feature 1..20: note = CRISPR gRNA sequence
  source 1..20: mol_type = other DNA
tgttttgttgttttttgaga

SEQ ID NO: 95991 - DNA, 20 bp, synthetic construct
  misc_feature 1..20: note = CRISPR gRNA sequence
  source 1..20: mol_type = other DNA
ttttgttgttttttgagatg

SEQ ID NO: 95992 - DNA, 20 bp, synthetic construct
  misc_feature 1..20: note = CRISPR gRNA sequence
  source 1..20: mol_type = other DNA
tttgctcttgttgcccatgc

SEQ ID NO: 95993 - DNA, 20 bp, synthetic construct
  misc_feature 1..20: note = CRISPR gRNA sequence
  source 1..20: mol_type = other DNA
tgctcttgttgcccatgctg

SEQ ID NO: 95994 - DNA, 20 bp, synthetic construct
  misc_feature 1..20: note = CRISPR gRNA sequence
  source 1..20: mol_type = other DNA
ttgcccatgctggagtgcaa

SEQ ID NO: 95995 - DNA, 20 bp, synthetic construct
  misc_feature 1..20: note = CRISPR gRNA sequence
  source 1..20: mol_type = other DNA
ggagtgcaatggcgtgatct

SEQ ID NO: 95996 - DNA, 20 bp, synthetic construct
  misc_feature 1..20: note = CRISPR gRNA sequence
  source 1..20: mol_type = other DNA
tcactgcaacctctgcctcc

SEQ ID NO: 95997 - DNA, 20 bp, synthetic construct
  misc_feature 1..20: note = CRISPR gRNA sequence
  source 1..20: mol_type = other DNA
cactgcaacctctgcctcct

SEQ ID NO: 95998 - DNA, 20 bp, synthetic construct
  misc_feature 1..20: note = CRISPR gRNA sequence
  source 1..20: mol_type = other DNA
ttcaactgattctcctgtct

SEQ ID NO: 95999 - DNA, 20 bp, synthetic construct
  misc_feature 1..20: note = CRISPR gRNA sequence
  source 1..20: mol_type = other DNA
ttctcctgtctcagcctcct

SEQ ID NO: 96000 - DNA, 20 bp, synthetic construct
  misc_feature 1..20: note = CRISPR gRNA sequence
  source 1..20: mol_type = other DNA
tcctgtctcagcctcctgag

SEQ ID NO: 96001 - DNA, 20 bp, synthetic construct
  misc_feature 1..20: note = CRISPR gRNA sequence
  source 1..20: mol_type = other DNA
gtctcagcctcctgagtagc

SEQ ID NO: 96002 - DNA, 20 bp, synthetic construct
  misc_feature 1..20: note = CRISPR gRNA sequence
  source 1..20: mol_type = other DNA
tctcagcctcctgagtagct

SEQ ID NO: 96003 - DNA, 20 bp, synthetic construct
  misc_feature 1..20: note = CRISPR gRNA sequence
  source 1..20: mol_type = other DNA
ctcctgagtagctgggatta

SEQ ID NO: 96004 - DNA, 20 bp, synthetic construct
  misc_feature 1..20: note = CRISPR gRNA sequence
  source 1..20: mol_type = other DNA
tcctgagtagctgggattac

SEQ ID NO: 96005 - DNA, 20 bp, synthetic construct
  misc_feature 1..20: note = CRISPR gRNA sequence
  source 1..20: mol_type = other DNA
caggcttccgccactacgcc

SEQ ID NO: 96006 - DNA, 20 bp, synthetic construct
  misc_feature 1..20: note = CRISPR gRNA sequence
  source 1..20: mol_type = other DNA
actacgcccagctaattttt

SEQ ID NO: 96007 - DNA, 20 bp, synthetic construct
  misc_feature 1..20: note = CRISPR gRNA sequence
  source 1..20: mol_type = other DNA
ctacgcccagctaatttttt

SEQ ID NO: 96008 - DNA, 20 bp, synthetic construct
  misc_feature 1..20: note = CRISPR gRNA sequence
  source 1..20: mol_type = other DNA
gctaattttttgggtatttt

SEQ ID NO: 96009 - DNA, 20 bp, synthetic construct
  misc_feature 1..20: note = CRISPR gRNA sequence
  source 1..20: mol_type = other DNA
aattttttgggtatttttag

SEQ ID NO: 96010 - DNA, 20 bp, synthetic construct
  misc_feature 1..20: note = CRISPR gRNA sequence
  source 1..20: mol_type = other DNA
ttttttgggtatttttagta

SEQ ID NO: 96011 - DNA, 20 bp, synthetic construct
  misc_feature 1..20: note = CRISPR gRNA sequence
  source 1..20: mol_type = other DNA
ttgggtatttttagtagaga

SEQ ID NO: 96012 - DNA, 20 bp, synthetic construct
  misc_feature 1..20: note = CRISPR gRNA sequence
  source 1..20: mol_type = other DNA
tgggtatttttagtagagac

SEQ ID NO: 96013 - DNA, 20 bp, synthetic construct
  misc_feature 1..20: note = CRISPR gRNA sequence
  source 1..20: mol_type = other DNA
gggtatttttagtagagacg

SEQ ID NO: 96014 - DNA, 20 bp, synthetic construct
  misc_feature 1..20: note = CRISPR gRNA sequence
  source 1..20: mol_type = other DNA
gagacggggtttcaccatgt

SEQ ID NO: 96015 - DNA, 20 bp, synthetic construct
  misc_feature 1..20: note = CRISPR gRNA sequence
  source 1..20: mol_type = other DNA
cggggtttcaccatgttggc

SEQ ID NO: 96016 - DNA, 20 bp, synthetic construct
  misc_feature 1..20: note = CRISPR gRNA sequence
  source 1..20: mol_type = other DNA
ggggtttcaccatgttggcc

SEQ ID NO: 96017 - DNA, 20 bp, synthetic construct
  misc_feature 1..20: note = CRISPR gRNA sequence
  source 1..20: mol_type = other DNA
tttcaccatgttggccaggc

SEQ ID NO: 96018 - DNA, 20 bp, synthetic construct
  misc_feature 1..20: note = CRISPR gRNA sequence
  source 1..20: mol_type = other DNA
tggtcttgaactcctgacct

SEQ ID NO: 96019 - DNA, 20 bp, synthetic construct
  misc_feature 1..20: note = CRISPR gRNA sequence
  source 1..20: mol_type = other DNA
ggtcttgaactcctgacctc

SEQ ID NO: 96020 - DNA, 20 bp, synthetic construct
  misc_feature 1..20: note = CRISPR gRNA sequence
  source 1..20: mol_type = other DNA
ctcaggtgatccgcccacct

SEQ ID NO: 96021 - DNA, 20 bp, synthetic construct
  misc_feature 1..20: note = CRISPR gRNA sequence
  source 1..20: mol_type = other DNA
ccgcccacctcggcctccca

SEQ ID NO: 96022 - DNA, 20 bp, synthetic construct
  misc_feature 1..20: note = CRISPR gRNA sequence
  source 1..20: mol_type = other DNA
acctcggcctcccaaagtgc

SEQ ID NO: 96023 - DNA, 20 bp, synthetic construct
  misc_feature 1..20: note = CRISPR gRNA sequence
  source 1..20: mol_type = other DNA
cctcggcctcccaaagtgct

SEQ ID NO: 96024 - DNA, 20 bp, synthetic construct
  misc_feature 1..20: note = CRISPR gRNA sequence
  source 1..20: mol_type = other DNA
ctcccaaagtgctgggatta

SEQ ID NO: 96025 - DNA, 20 bp, synthetic construct
  misc_feature 1..20: note = CRISPR gRNA sequence
  source 1..20: mol_type = other DNA
tcccaaagtgctgggattac

SEQ ID NO: 96026 - DNA, 20 bp, synthetic construct
  misc_feature 1..20: note = CRISPR gRNA sequence
  source 1..20: mol_type = other DNA
agtgctgggattacaggcat

SEQ ID NO: 96027 - DNA, 20 bp, synthetic construct
  misc_feature 1..20: note = CRISPR gRNA sequence
  source 1..20: mol_type = other DNA
caggcatgagccactgtgcc

SEQ ID NO: 96028 - DNA, 20 bp, synthetic construct
  misc_feature 1..20: note = CRISPR gRNA sequence
  source 1..20: mol_type = other DNA
cctgtttttgttttttgata

SEQ ID NO: 96029 - DNA, 20 bp, synthetic construct
  misc_feature 1..20: note = CRISPR gRNA sequence
  source 1..20: mol_type = other DNA
ctgtttttgttttttgatac

SEQ ID NO: 96030 - DNA, 20 bp, synthetic construct
  misc_feature 1..20: note = CRISPR gRNA sequence
  source 1..20: mol_type = other DNA
tgtttttgttttttgataca

SEQ ID NO: 96031 - DNA, 20 bp, synthetic construct
  misc_feature 1..20: note = CRISPR gRNA sequence
  source 1..20: mol_type = other DNA
cagggtctcgctctgttact

SEQ ID NO: 96032 - DNA, 20 bp, synthetic construct
  misc_feature 1..20: note = CRISPR gRNA sequence
  source 1..20: mol_type = other DNA
agggtctcgctctgttacta

SEQ ID NO: 96033 - DNA, 20 bp, synthetic construct
  misc_feature 1..20: note = CRISPR gRNA sequence
  source 1..20: mol_type = other DNA
tctcgctctgttactaaggc

SEQ ID NO: 96034 - DNA, 20 bp, synthetic construct
  misc_feature 1..20: note = CRISPR gRNA sequence
  source 1..20: mol_type = other DNA
tcgctctgttactaaggctg

SEQ ID NO: 96035 - DNA, 20 bp, synthetic construct
  misc_feature 1..20: note = CRISPR gRNA sequence
  source 1..20: mol_type = other DNA
ctgttactaaggctggagtg

SEQ ID NO: 96036 - DNA, 20 bp, synthetic construct
  misc_feature 1..20: note = CRISPR gRNA sequence
  source 1..20: mol_type = other DNA
ggagtgcagtgatgcaatca

SEQ ID NO: 96037 - DNA, 20 bp, synthetic construct
  misc_feature 1..20: note = CRISPR gRNA sequence
  source 1..20: mol_type = other DNA
gatgcaatcatagttcactg

SEQ ID NO: 96038 - DNA, 20 bp, synthetic construct
  misc_feature 1..20: note = CRISPR gRNA sequence
  source 1..20: mol_type = other DNA
tcactgcagcctcaacttcc

SEQ ID NO: 96039 - DNA, 20 bp, synthetic construct
  misc_feature 1..20: note = CRISPR gRNA sequence
  source 1..20: mol_type = other DNA
cactgcagcctcaacttcct

SEQ ID NO: 96040 - DNA, 20 bp, synthetic construct
  misc_feature 1..20: note = CRISPR gRNA sequence
  source 1..20: mol_type = other DNA
agcctcaacttcctgggctg

SEQ ID NO: 96041 - DNA, 20 bp, synthetic construct
  misc_feature 1..20: note = CRISPR gRNA sequence
  source 1..20: mol_type = other DNA
cctgggctgaagccatcact

SEQ ID NO: 96042 - DNA, 20 bp, synthetic construct
  misc_feature 1..20: note = CRISPR gRNA sequence
  source 1..20: mol_type = other DNA
aagccatcactcagcctccc

SEQ ID NO: 96043 - DNA, 20 bp, synthetic construct
  misc_feature 1..20: note = CRISPR gRNA sequence
  source 1..20: mol_type = other DNA
agccatcactcagcctccct

SEQ ID NO: 96044 - DNA, 20 bp, synthetic construct
  misc_feature 1..20: note = CRISPR gRNA sequence
  source 1..20: mol_type = other DNA
ccatcactcagcctccctag

SEQ ID NO: 96045 - DNA, 20 bp, synthetic construct
  misc_feature 1..20: note = CRISPR gRNA sequence
  source 1..20: mol_type = other DNA
cactcagcctccctaggagc

SEQ ID NO: 96046 - DNA, 20 bp, synthetic construct
  misc_feature 1..20: note = CRISPR gRNA sequence
  source 1..20: mol_type = other DNA
actcagcctccctaggagct

SEQ ID NO: 96047 - DNA, 20 bp, synthetic construct
  misc_feature 1..20: note = CRISPR gRNA sequence
  source 1..20: mol_type = other DNA
ctccctaggagctgggacta

SEQ ID NO: 96048 - DNA, 20 bp, synthetic construct
  misc_feature 1..20: note = CRISPR gRNA sequence
  source 1..20: mol_type = other DNA
tccctaggagctgggactat

SEQ ID NO: 96049 - DNA, 20 bp, synthetic construct
  misc_feature 1..20: note = CRISPR gRNA sequence
  source 1..20: mol_type = other DNA
tataggcatgcaaccacacc

SEQ ID NO: 96050 - DNA, 20 bp, synthetic construct
  misc_feature 1..20: note = CRISPR gRNA sequence
  source 1..20: mol_type = other DNA
gctaattttttttttttttt

SEQ ID NO: 96051 - DNA, 20 bp, synthetic construct
  misc_feature 1..20: note = CRISPR gRNA sequence
  source 1..20: mol_type = other DNA
ctaatttttttttttttttt

SEQ ID NO: 96052 - DNA, 20 bp, synthetic construct
  misc_feature 1..20: note = CRISPR gRNA sequence
  source 1..20: mol_type = other DNA
aattttttttttttttttgg

SEQ ID NO: 96053 - DNA, 20 bp, synthetic construct
  misc_feature 1..20: note = CRISPR gRNA sequence
  source 1..20: mol_type = other DNA
attttttttttttttttggg

SEQ ID NO: 96054 - DNA, 20 bp, synthetic construct
  misc_feature 1..20: note = CRISPR gRNA sequence
  source 1..20: mol_type = other DNA
tttttttttttttgggaggc

SEQ ID NO: 96055 - DNA, 20 bp, synthetic construct
  misc_feature 1..20: note = CRISPR gRNA sequence
  source 1..20: mol_type = other DNA
ggaggctggtctccacctcc

SEQ ID NO: 96056 - DNA, 20 bp, synthetic construct
  misc_feature 1..20: note = CRISPR gRNA sequence
  source 1..20: mol_type = other DNA
gaggctggtctccacctcct

SEQ ID NO: 96057 - DNA, 20 bp, synthetic construct
  misc_feature 1..20: note = CRISPR gRNA sequence
  source 1..20: mol_type = other DNA
ggtctccacctcctgggctc

SEQ ID NO: 96058 - DNA, 20 bp, synthetic construct
  misc_feature 1..20: note = CRISPR gRNA sequence
  source 1..20: mol_type = other DNA
tcctgggctcaagtgatctg

SEQ ID NO: 96059 - DNA, 20 bp, synthetic construct
  misc_feature 1..20: note = CRISPR gRNA sequence
  source 1..20: mol_type = other DNA
cctgggctcaagtgatctgc

SEQ ID NO: 96060 - DNA, 20 bp, synthetic construct
  misc_feature 1..20: note = CRISPR gRNA sequence
  source 1..20: mol_type = other DNA
ctgcaggcctccacttccga

SEQ ID NO: 96061 - DNA, 20 bp, synthetic construct
  misc_feature 1..20: note = CRISPR gRNA sequence
  source 1..20: mol_type = other DNA
gcctccacttccgaaagtgc

SEQ ID NO: 96062 - DNA, 20 bp, synthetic construct
  misc_feature 1..20: note = CRISPR gRNA sequence
  source 1..20: mol_type = other DNA
cctccacttccgaaagtgct

SEQ ID NO: 96063 - DNA, 20 bp, synthetic construct
  misc_feature 1..20: note = CRISPR gRNA sequence
  source 1..20: mol_type = other DNA
ttccgaaagtgctgggatta

SEQ ID NO: 96064 - DNA, 20 bp, synthetic construct
  misc_feature 1..20: note = CRISPR gRNA sequence
  source 1..20: mol_type = other DNA
tccgaaagtgctgggattac

SEQ ID NO: 96065 - DNA, 20 bp, synthetic construct
  misc_feature 1..20: note = CRISPR gRNA sequence
  source 1..20: mol_type = other DNA
agtgctgggattacaggtgt

SEQ ID NO: 96066 - DNA, 20 bp, synthetic construct
  misc_feature 1..20: note = CRISPR gRNA sequence
  source 1..20: mol_type = other DNA
gggattacaggtgtgagcca

SEQ ID NO: 96067 - DNA, 20 bp, synthetic construct
  misc_feature 1..20: note = CRISPR gRNA sequence
  source 1..20: mol_type = other DNA
caggtgtgagccacagtgcc

SEQ ID NO: 96068 - DNA, 20 bp, synthetic construct
  misc_feature 1..20: note = CRISPR gRNA sequence
  source 1..20: mol_type = other DNA
acacctgtttttaactcttt

SEQ ID NO: 96069 - DNA, 20 bp, synthetic construct
  misc_feature 1..20: note = CRISPR gRNA sequence
  source 1..20: mol_type = other DNA
cacctgtttttaactctttg

SEQ ID NO: 96070 - DNA, 20 bp, synthetic construct
  misc_feature 1..20: note = CRISPR gRNA sequence
  source 1..20: mol_type = other DNA
acctgtttttaactctttga

SEQ ID NO: 96071 - DNA, 20 bp, synthetic construct
  misc_feature 1..20: note = CRISPR gRNA sequence
  source 1..20: mol_type = other DNA
tgtttttaactctttgaggg

SEQ ID NO: 96072 - DNA, 20 bp, synthetic construct
  misc_feature 1..20: note = CRISPR gRNA sequence
  source 1..20: mol_type = other DNA
tttaactctttgagggtaga

SEQ ID NO: 96073 - DNA, 20 bp, synthetic construct
  misc_feature 1..20: note = CRISPR gRNA sequence
  source 1..20: mol_type = other DNA
actctttgagggtagatagc

SEQ ID NO: 96074 - DNA, 20 bp, synthetic construct
  misc_feature 1..20: note = CRISPR gRNA sequence
  source 1..20: mol_type = other DNA
ctctttgagggtagatagct

SEQ ID NO: 96075 - DNA, 20 bp, synthetic construct
  misc_feature 1..20: note = CRISPR gRNA sequence
  source 1..20: mol_type = other DNA
ctttgagggtagatagctag

SEQ ID NO: 96076 - DNA, 20 bp, synthetic construct
  misc_feature 1..20: note = CRISPR gRNA sequence
  source 1..20: mol_type = other DNA
atagctaggagtgaaattac

SEQ ID NO: 96077 - DNA, 20 bp, synthetic construct
  misc_feature 1..20: note = CRISPR gRNA sequence
  source 1..20: mol_type = other DNA
tagctaggagtgaaattact

SEQ ID NO: 96078 - DNA, 20 bp, synthetic construct
  misc_feature 1..20: note = CRISPR gRNA sequence
  source 1..20: mol_type = other DNA
taggagtgaaattactgggt

SEQ ID NO: 96079 - DNA, 20 bp, synthetic construct
  misc_feature 1..20: note = CRISPR gRNA sequence
  source 1..20: mol_type = other DNA
agtgaaattactgggtcaga

SEQ ID NO: 96080 - DNA, 20 bp, synthetic construct
  misc_feature 1..20: note = CRISPR gRNA sequence
  source 1..20: mol_type = other DNA
gtcatcctgttttacttact

SEQ ID NO: 96081 - DNA, 20 bp, synthetic construct
  misc_feature 1..20: note = CRISPR gRNA sequence
  source 1..20: mol_type = other DNA
tcatcctgttttacttactg

SEQ ID NO: 96082 - DNA, 20 bp, synthetic construct
  misc_feature 1..20: note = CRISPR gRNA sequence
  source 1..20: mol_type = other DNA
gttttacttactgaggaact

SEQ ID NO: 96083 - DNA, 20 bp, synthetic construct
  misc_feature 1..20: note = CRISPR gRNA sequence
  source 1..20: mol_type = other DNA
ttttacttactgaggaactg

SEQ ID NO: 96084 - DNA, 20 bp, synthetic construct
  misc_feature 1..20: note = CRISPR gRNA sequence
  source 1..20: mol_type = other DNA
actgaggatttatttttgat

SEQ ID NO: 96085 - DNA, 20 bp, synthetic construct
  misc_feature 1..20: note = CRISPR gRNA sequence
  source 1..20: mol_type = other DNA
tgaggatttatttttgattg

SEQ ID NO: 96086 - DNA, 20 bp, synthetic construct
  misc_feature 1..20: note = CRISPR gRNA sequence
  source 1..20: mol_type = other DNA
tttatttttgattggagtcc

SEQ ID NO: 96087 - DNA, 20 bp, synthetic construct
  misc_feature 1..20: note = CRISPR gRNA sequence
  source 1..20: mol_type = other DNA
gtccaagaatatgcctaatt

SEQ ID NO: 96088 - DNA, 20 bp, synthetic construct
  misc_feature 1..20: note = CRISPR gRNA sequence
  source 1..20: mol_type = other DNA
ttgttgctgccactcctgtc

SEQ ID NO: 96089 - DNA, 20 bp, synthetic construct
  misc_feature 1..20: note = CRISPR gRNA sequence
  source 1..20: mol_type = other DNA
tcttcctacacttcttccta

SEQ ID NO: 96090 - DNA, 20 bp, synthetic construct
  misc_feature 1..20: note = CRISPR gRNA sequence
  source 1..20: mol_type = other DNA
ctttctttctttcttttttt

SEQ ID NO: 96091 - DNA, 20 bp, synthetic construct
  misc_feature 1..20: note = CRISPR gRNA sequence
  source 1..20: mol_type = other DNA
ctttctttctttttttgaga

SEQ ID NO: 96092 - DNA, 20 bp, synthetic construct
  misc_feature 1..20: note = CRISPR gRNA sequence
  source 1..20: mol_type = other DNA
ttctttctttttttgagatg

SEQ ID NO: 96093 - DNA, 20 bp, synthetic construct
  misc_feature 1..20: note = CRISPR gRNA sequence
  source 1..20: mol_type = other DNA
tggagtctcgctctgtcgcc

SEQ ID NO: 96094 - DNA, 20 bp, synthetic construct
  misc_feature 1..20: note = CRISPR gRNA sequence
  source 1..20: mol_type = other DNA
ggagtctcgctctgtcgccc

SEQ ID NO: 96095 - DNA, 20 bp, synthetic construct
  misc_feature 1..20: note = CRISPR gRNA sequence
  source 1..20: mol_type = other DNA
tctcgctctgtcgcccaggc

SEQ ID NO: 96096 - DNA, 20 bp, synthetic construct
  misc_feature 1..20: note = CRISPR gRNA sequence
  source 1..20: mol_type = other DNA
tcgctctgtcgcccaggctg

SEQ ID NO: 96097 - DNA, 20 bp, synthetic construct
  misc_feature 1..20: note = CRISPR gRNA sequence
  source 1..20: mol_type = other DNA
gtcgcccaggctggagtgca

SEQ ID NO: 96098 - DNA, 20 bp, synthetic construct
  misc_feature 1..20: note = CRISPR gRNA sequence
  source 1..20: mol_type = other DNA
cgcccaggctggagtgcatg

SEQ ID NO: 96099 - DNA, 20 bp, synthetic construct
  misc_feature 1..20: note = CRISPR gRNA sequence
  source 1..20: mol_type = other DNA
aggctggagtgcatggagtg

SEQ ID NO: 96100 - DNA, 20 bp, synthetic construct
  misc_feature 1..20: note = CRISPR gRNA sequence
  source 1..20: mol_type = other DNA
ctggagtgcatggagtgcag

SEQ ID NO: 96101 - DNA, 20 bp, synthetic construct
  misc_feature 1..20: note = CRISPR gRNA sequence
  source 1..20: mol_type = other DNA
ggagtgcagtggcgcaatct

SEQ ID NO: 96102 - DNA, 20 bp, synthetic construct
  misc_feature 1..20: note = CRISPR gRNA sequence
  source 1..20: mol_type = other DNA
gcgcaatcttggctcactgc

SEQ ID NO: 96103 - DNA, 20 bp, synthetic construct
  misc_feature 1..20: note = CRISPR gRNA sequence
  source 1..20: mol_type = other DNA
ttcacgccattctcctgctt

SEQ ID NO: 96104 - DNA, 20 bp, synthetic construct
  misc_feature 1..20: note = CRISPR gRNA sequence
  source 1..20: mol_type = other DNA
ttctcctgcttcagcctccc

SEQ ID NO: 96105 - DNA, 20 bp, synthetic construct
  misc_feature 1..20: note = CRISPR gRNA sequence
  source 1..20: mol_type = other DNA
tcctgcttcagcctcccgag

SEQ ID NO: 96106 - DNA, 20 bp, synthetic construct
  misc_feature 1..20: note = CRISPR gRNA sequence
  source 1..20: mol_type = other DNA
gcttcagcctcccgagtagc

SEQ ID NO: 96107 - DNA, 20 bp, synthetic construct
  misc_feature 1..20: note = CRISPR gRNA sequence
  source 1..20: mol_type = other DNA
cttcagcctcccgagtagct

SEQ ID NO: 96108 - DNA, 20 bp, synthetic construct
  misc_feature 1..20: note = CRISPR gRNA sequence
  source 1..20: mol_type = other DNA
ctcccgagtagctgggacta

SEQ ID NO: 96109 - DNA, 20 bp, synthetic construct
  misc_feature 1..20: note = CRISPR gRNA sequence
  source 1..20: mol_type = other DNA
tttttttttttttttttaaa

SEQ ID NO: 96110 - DNA, 20 bp, synthetic construct
  misc_feature 1..20: note = CRISPR gRNA sequence
  source 1..20: mol_type = other DNA
tttttttttttttttaaatg

SEQ ID NO: 96111 - DNA, 20 bp, synthetic construct
  misc_feature 1..20: note = CRISPR gRNA sequence
  source 1..20: mol_type = other DNA
ttttttttttttttaaatgg

SEQ ID NO: 96112 - DNA, 20 bp, synthetic construct
  misc_feature 1..20: note = CRISPR gRNA sequence
  source 1..20: mol_type = other DNA
ggaggtttgcttttgttgcc

SEQ ID NO: 96113 - DNA, 20 bp, synthetic construct
  misc_feature 1..20: note = CRISPR gRNA sequence
  source 1..20: mol_type = other DNA
gaggtttgcttttgttgccc

SEQ ID NO: 96114 - DNA, 20 bp, synthetic construct
  misc_feature 1..20: note = CRISPR gRNA sequence
  source 1..20: mol_type = other DNA
tttcccctctccccactctc

SEQ ID NO: 96115 - DNA, 20 bp, synthetic construct
  misc_feature 1..20: note = CRISPR gRNA sequence
  source 1..20: mol_type = other DNA
cccactctcgagacgcctcc

SEQ ID NO: 96116 - DNA, 20 bp, synthetic construct
  misc_feature 1..20: note = CRISPR gRNA sequence
  source 1..20: mol_type = other DNA
cctggatcccctctcttctt

SEQ ID NO: 96117 - DNA, 20 bp, synthetic construct
  misc_feature 1..20: note = CRISPR gRNA sequence
  source 1..20: mol_type = other DNA
gatcccctctcttcttgaga

SEQ ID NO: 96118 - DNA, 20 bp, synthetic construct
  misc_feature 1..20: note = CRISPR gRNA sequence
  source 1..20: mol_type = other DNA
cagaatcttgctctgttgtc

SEQ ID NO: 96119 - DNA, 20 bp, synthetic construct
  misc_feature 1..20: note = CRISPR gRNA sequence
  source 1..20: mol_type = other DNA
agaatcttgctctgttgtcc

SEQ ID NO: 96120 - DNA, 20 bp, synthetic construct
  misc_feature 1..20: note = CRISPR gRNA sequence
  source 1..20: mol_type = other DNA
gaatcttgctctgttgtcca

SEQ ID NO: 96121 - DNA, 20 bp, synthetic construct
  misc_feature 1..20: note = CRISPR gRNA sequence
  source 1..20: mol_type = other DNA
tcttgctctgttgtccaggg

SEQ ID NO: 96122 - DNA, 20 bp, synthetic construct
  misc_feature 1..20: note = CRISPR gRNA sequence
  source 1..20: mol_type = other DNA
ttgctctgttgtccagggtg

SEQ ID NO: 96123 - DNA, 20 bp, synthetic construct
  misc_feature 1..20: note = CRISPR gRNA sequence
  source 1..20: mol_type = other DNA
ctgttgtccagggtggagtg

SEQ ID NO: 96124 - DNA, 20 bp, synthetic construct
  misc_feature 1..20: note = CRISPR gRNA sequence
  source 1..20: mol_type = other DNA
ttgtccagggtggagtgcag

SEQ ID NO: 96125 - DNA, 20 bp, synthetic construct
  misc_feature 1..20: note = CRISPR gRNA sequence
  source 1..20: mol_type = other DNA
ctcactgcaactccctctcc

SEQ ID NO: 96126 - DNA, 20 bp, synthetic construct
  misc_feature 1..20: note = CRISPR gRNA sequence
  source 1..20: mol_type = other DNA
tcactgcaactccctctcct

SEQ ID NO: 96127 - DNA, 20 bp, synthetic construct
  misc_feature 1..20: note = CRISPR gRNA sequence
  source 1..20: mol_type = other DNA
gcaactccctctcctgggtt

SEQ ID NO: 96128 - DNA, 20 bp, synthetic construct
  misc_feature 1..20: note = CRISPR gRNA sequence
  source 1..20: mol_type = other DNA
caactccctctcctgggtta

SEQ ID NO: 96129 - DNA, 20 bp, synthetic construct
  misc_feature 1..20: note = CRISPR gRNA sequence
  source 1..20: mol_type = other DNA
ttaaggtgattctcctgcct

SEQ ID NO: 96130 - DNA, 20 bp, synthetic construct
  misc_feature 1..20: note = CRISPR gRNA sequence
  source 1..20: mol_type = other DNA
ttctcctgcctcagcctccc

SEQ ID NO: 96131 - DNA, 20 bp, synthetic construct
  misc_feature 1..20: note = CRISPR gRNA sequence
  source 1..20: mol_type = other DNA
tcctgcctcagcctcccaag

SEQ ID NO: 96132 - DNA, 20 bp, synthetic construct
  misc_feature 1..20: note = CRISPR gRNA sequence
  source 1..20: mol_type = other DNA
gcctcagcctcccaagtagc

SEQ ID NO: 96133 - DNA, 20 bp, synthetic construct
  misc_feature 1..20: note = CRISPR gRNA sequence
  source 1..20: mol_type = other DNA
ctggcatgcaccaccacatc

SEQ ID NO: 96134 - DNA, 20 bp, synthetic construct
  misc_feature 1..20: note = CRISPR gRNA sequence
  source 1..20: mol_type = other DNA
ccagctaatttttgtgtttt

SEQ ID NO: 96135 - DNA, 20 bp, synthetic construct
  misc_feature 1..20: note = CRISPR gRNA sequence
  source 1..20: mol_type = other DNA
gctaatttttgtgtttttag

SEQ ID NO: 96136 - DNA, 20 bp, synthetic construct
  misc_feature 1..20: note = CRISPR gRNA sequence
  source 1..20: mol_type = other DNA
taatttttgtgtttttagta

SEQ ID NO: 96137 - DNA, 20 bp, synthetic construct
  misc_feature 1..20: note = CRISPR gRNA sequence
  source 1..20: mol_type = other DNA
ttttgtgtttttagtagaga

SEQ ID NO: 96138 - DNA, 20 bp, synthetic construct
  misc_feature 1..20: note = CRISPR gRNA sequence
  source 1..20: mol_type = other DNA
ttgtgtttttagtagagatg

SEQ ID NO: 96139 - DNA, 20 bp, synthetic construct
  misc_feature 1..20: note = CRISPR gRNA sequence
  source 1..20: mol_type = other DNA
tggagttttgccatgttgcc

SEQ ID NO: 96140 - DNA, 20 bp, synthetic construct
  misc_feature 1..20: note = CRISPR gRNA sequence
  source 1..20: mol_type = other DNA
ggagttttgccatgttgccc

SEQ ID NO: 96141 - DNA, 20 bp, synthetic construct
  misc_feature 1..20: note = CRISPR gRNA sequence
  source 1..20: mol_type = other DNA
ttttgccatgttgcccaggc

SEQ ID NO: 96142 - DNA, 20 bp, synthetic construct
  misc_feature 1..20: note = CRISPR gRNA sequence
  source 1..20: mol_type = other DNA
tggtctcgaactcctgacct

SEQ ID NO: 96143 - DNA, 20 bp, synthetic construct
  misc_feature 1..20: note = CRISPR gRNA sequence
  source 1..20: mol_type = other DNA
ggtctcgaactcctgacctc

SEQ ID NO: 96144 - DNA, 20 bp, synthetic construct
  misc_feature 1..20: note = CRISPR gRNA sequence
  source 1..20: mol_type = other DNA
cctcaggtgattgcccgcct

SEQ ID NO: 96145 - DNA, 20 bp, synthetic construct
  misc_feature 1..20: note = CRISPR gRNA sequence
  source 1..20: mol_type = other DNA
ttgcccgcctcggcctccca

SEQ ID NO: 96146 - DNA, 20 bp, synthetic construct
  misc_feature 1..20: note = CRISPR gRNA sequence
  source 1..20: mol_type = other DNA
gcctcggcctcccaaagtgc

SEQ ID NO: 96147 - DNA, 20 bp, synthetic construct
  misc_feature 1..20: note = CRISPR gRNA sequence
  source 1..20: mol_type = other DNA
cctcggcctcccaaagtgct

SEQ ID NO: 96148 - DNA, 20 bp, synthetic construct
  misc_feature 1..20: note = CRISPR gRNA sequence
  source 1..20: mol_type = other DNA
ctcccaaagtgctgggatta

SEQ ID NO: 96149 - DNA, 20 bp, synthetic construct
  misc_feature 1..20: note = CRISPR gRNA sequence
  source 1..20: mol_type = other DNA
tcccaaagtgctgggattac

SEQ ID NO: 96150 - DNA, 20 bp, synthetic construct
  misc_feature 1..20: note = CRISPR gRNA sequence
  source 1..20: mol_type = other DNA
agtgctgggattacaggcgt

SEQ ID NO: 96151 - DNA, 20 bp, synthetic construct
  misc_feature 1..20: note = CRISPR gRNA sequence
  source 1..20: mol_type = other DNA
caggcgtgagccaccgcgcc

SEQ ID NO: 96152 - DNA, 20 bp, synthetic construct
  misc_feature 1..20: note = CRISPR gRNA sequence
  source 1..20: mol_type = other DNA
gccaccgcgcccagtccctg

SEQ ID NO: 96153 - DNA, 20 bp, synthetic construct
  misc_feature 1..20: note = CRISPR gRNA sequence
  source 1..20: mol_type = other DNA
accgcgcccagtccctgtag

SEQ ID NO: 96154 - DNA, 20 bp, synthetic construct
  misc_feature 1..20: note = CRISPR gRNA sequence
  source 1..20: mol_type = other DNA
gcggatttctttgacttcct

SEQ ID NO: 96155 - DNA, 20 bp, synthetic construct
  misc_feature 1..20: note = CRISPR gRNA sequence
  source 1..20: mol_type = other DNA
tctttgacttcctaagatct

SEQ ID NO: 96156 - DNA, 20 bp, synthetic construct
  misc_feature 1..20: note = CRISPR gRNA sequence
  source 1..20: mol_type = other DNA
ttgacttcctaagatctcgg

SEQ ID NO: 96157 - DNA, 20 bp, synthetic construct
  misc_feature 1..20: note = CRISPR gRNA sequence
  source 1..20: mol_type = other DNA
agatctcggtggtgtcacct

SEQ ID NO: 96158 - DNA, 20 bp, synthetic construct
  misc_feature 1..20: note = CRISPR gRNA sequence
  source 1..20: mol_type = other DNA
gatctcggtggtgtcacctt

SEQ ID NO: 96159 - DNA, 20 bp, synthetic construct
  misc_feature 1..20: note = CRISPR gRNA sequence
  source 1..20: mol_type = other DNA
atctcggtggtgtcaccttg

SEQ ID NO: 96160 - DNA, 20 bp, synthetic construct
  misc_feature 1..20: note = CRISPR gRNA sequence
  source 1..20: mol_type = other DNA
ctcggtggtgtcaccttggg

SEQ ID NO: 96161 - DNA, 20 bp, synthetic construct
  misc_feature 1..20: note = CRISPR gRNA sequence
  source 1..20: mol_type = other DNA
tcggtggtgtcaccttgggg

SEQ ID NO: 96162 - DNA, 20 bp, synthetic construct
  misc_feature 1..20: note = CRISPR gRNA sequence
  source 1..20: mol_type = other DNA
ctcctgttaccaccttgtct

SEQ ID NO: 96163 - DNA, 20 bp, synthetic construct
  misc_feature 1..20: note = CRISPR gRNA sequence
  source 1..20: mol_type = other DNA
ctgttaccaccttgtctaag

SEQ ID NO: 96164 - DNA, 20 bp, synthetic construct
  misc_feature 1..20: note = CRISPR gRNA sequence
  source 1..20: mol_type = other DNA
tgttaccaccttgtctaaga

SEQ ID NO: 96165 - DNA, 20 bp, synthetic construct
  misc_feature 1..20: note = CRISPR gRNA sequence
  source 1..20: mol_type = other DNA
tttttttttttttttttttt

SEQ ID NO: 96166 - DNA, 20 bp, synthetic construct
  misc_feature 1..20: note = CRISPR gRNA sequence
  source 1..20: mol_type = other DNA
ttttttttttttttttgaga

SEQ ID NO: 96167 - DNA, 20 bp, synthetic construct
  misc_feature 1..20: note = CRISPR gRNA sequence
  source 1..20: mol_type = other DNA
ttttttttttttttgagatg

SEQ ID NO: 96168 - DNA, 20 bp, synthetic construct
  misc_feature 1..20: note = CRISPR gRNA sequence
  source 1..20: mol_type = other DNA
ggagtctcactcttgttgcc

SEQ ID NO: 96169 - DNA, 20 bp, synthetic construct
  misc_feature 1..20: note = CRISPR gRNA sequence
  source 1..20: mol_type = other DNA
gagtctcactcttgttgccc

SEQ ID NO: 96170 - DNA, 20 bp, synthetic construct
  misc_feature 1..20: note = CRISPR gRNA sequence
  source 1..20: mol_type = other DNA
ctcactcttgttgcccaggc

SEQ ID NO: 96171 - DNA, 20 bp, synthetic construct
  misc_feature 1..20: note = CRISPR gRNA sequence
  source 1..20: mol_type = other DNA
cactcttgttgcccaggctg

SEQ ID NO: 96172 - DNA, 20 bp, synthetic construct
  misc_feature 1..20: note = CRISPR gRNA sequence
  source 1..20: mol_type = other DNA
ttgttgcccaggctggagtg

SEQ ID NO: 96173 - DNA, 20 bp, synthetic construct
  misc_feature 1..20: note = CRISPR gRNA sequence
  source 1..20: mol_type = other DNA
ttgcccaggctggagtgcag

SEQ ID NO: 96174 - DNA, 20 bp, synthetic construct
  misc_feature 1..20: note = CRISPR gRNA sequence
  source 1..20: mol_type = other DNA
tcactgcaacctccacctcc

SEQ ID NO: 96175 - DNA, 20 bp, synthetic construct
  misc_feature 1..20: note = CRISPR gRNA sequence
  source 1..20: mol_type = other DNA
aacctccacctcctggattc

SEQ ID NO: 96176 - DNA, 20 bp, synthetic construct
  misc_feature 1..20: note = CRISPR gRNA sequence
  source 1..20: mol_type = other DNA
ttcaagcgattctcctgcct

SEQ ID NO: 96177 - DNA, 20 bp, synthetic construct
  misc_feature 1..20: note = CRISPR gRNA sequence
  source 1..20: mol_type = other DNA
ttctcctgcctcagcctccc

SEQ ID NO: 96178 - DNA, 20 bp, synthetic construct
  misc_feature 1..20: note = CRISPR gRNA sequence
  source 1..20: mol_type = other DNA
tcctgcctcagcctcccgag

SEQ ID NO: 96179 - DNA, 20 bp, synthetic construct
  misc_feature 1..20: note = CRISPR gRNA sequence
  source 1..20: mol_type = other DNA
gcctcagcctcccgagtagc

SEQ ID NO: 96180 - DNA, 20 bp, synthetic construct
  misc_feature 1..20: note = CRISPR gRNA sequence
  source 1..20: mol_type = other DNA
cctcagcctcccgagtagct

SEQ ID NO: 96181 - DNA, 20 bp, synthetic construct
  misc_feature 1..20: note = CRISPR gRNA sequence
  source 1..20: mol_type = other DNA
ctcccgagtagctgggatta

SEQ ID NO: 96182 - DNA, 20 bp, synthetic construct
  misc_feature 1..20: note = CRISPR gRNA sequence
  source 1..20: mol_type = other DNA
tcccgagtagctgggattac

SEQ ID NO: 96183 - DNA, 20 bp, synthetic construct
  misc_feature 1..20: note = CRISPR gRNA sequence
  source 1..20: mol_type = other DNA
caggcatctgccaccatgca

SEQ ID NO: 96184 - DNA, 20 bp, synthetic construct
  misc_feature 1..20: note = CRISPR gRNA sequence
  source 1..20: mol_type = other DNA
catggctaattttgtgtttt

SEQ ID NO: 96185 - DNA, 20 bp, synthetic construct
  misc_feature 1..20: note = CRISPR gRNA sequence
  source 1..20: mol_type = other DNA
ggctaattttgtgtttttag

SEQ ID NO: 96186 - DNA, 20 bp, synthetic construct
  misc_feature 1..20: note = CRISPR gRNA sequence
  source 1..20: mol_type = other DNA
ctaattttgtgtttttagta

SEQ ID NO: 96187 - DNA, 20 bp, synthetic construct
  misc_feature 1..20: note = CRISPR gRNA sequence
  source 1..20: mol_type = other DNA
taattttgtgtttttagtag

SEQ ID NO: 96188 - DNA, 20 bp, synthetic construct
  misc_feature 1..20: note = CRISPR gRNA sequence
  source 1..20: mol_type = other DNA
ttttgtgtttttagtagagg

SEQ ID NO: 96189 - DNA, 20 bp, synthetic construct
  misc_feature 1..20: note = CRISPR gRNA sequence
  source 1..20: mol_type = other DNA
gaggtggaatttcaccatgt

SEQ ID NO: 96190 - DNA, 20 bp, synthetic construct
  misc_feature 1..20: note = CRISPR gRNA sequence
  source 1..20: mol_type = other DNA
tggaatttcaccatgttagt

SEQ ID NO: 96191 - DNA, 20 bp, synthetic construct
  misc_feature 1..20: note = CRISPR gRNA sequence
  source 1..20: mol_type = other DNA
ggaatttcaccatgttagtc

SEQ ID NO: 96192 - DNA, 20 bp, synthetic construct
  misc_feature 1..20: note = CRISPR gRNA sequence
  source 1..20: mol_type = other DNA
tttcaccatgttagtcaggc

SEQ ID NO: 96193 - DNA, 20 bp, synthetic construct
  misc_feature 1..20: note = CRISPR gRNA sequence
  source 1..20: mol_type = other DNA
tggtctcaaactcctgacct

SEQ ID NO: 96194 - DNA, 20 bp, synthetic construct
  misc_feature 1..20: note = CRISPR gRNA sequence
  source 1..20: mol_type = other DNA
ggtctcaaactcctgacctc

SEQ ID NO: 96195 - DNA, 20 bp, synthetic construct
  misc_feature 1..20: note = CRISPR gRNA sequence
  source 1..20: mol_type = other DNA
ctcaggtgatccacccacct

SEQ ID NO: 96196 - DNA, 20 bp, synthetic construct
  misc_feature 1..20: note = CRISPR gRNA sequence
  source 1..20: mol_type = other DNA
ccacccacctcagcctccca

SEQ ID NO: 96197 - DNA, 20 bp, synthetic construct
  misc_feature 1..20: note = CRISPR gRNA sequence
  source 1..20: mol_type = other DNA
acctcagcctcccaaagtgc

SEQ ID NO: 96198 - DNA, 20 bp, synthetic construct
  misc_feature 1..20: note = CRISPR gRNA sequence
  source 1..20: mol_type = other DNA
cctcagcctcccaaagtgct

SEQ ID NO: 96199 - DNA, 20 bp, synthetic construct
  misc_feature 1..20: note = CRISPR gRNA sequence
  source 1..20: mol_type = other DNA
ctcccaaagtgctgggatta

SEQ ID NO: 96200 - DNA, 20 bp, synthetic construct
  misc_feature 1..20: note = CRISPR gRNA sequence
  source 1..20: mol_type = other DNA
tcccaaagtgctgggattac

SEQ ID NO: 96201 - DNA, 20 bp, synthetic construct
  misc_feature 1..20: note = CRISPR gRNA sequence
  source 1..20: mol_type = other DNA
agtgctgggattacaggcat

SEQ ID NO: 96202 - DNA, 20 bp, synthetic construct
  misc_feature 1..20: note = CRISPR gRNA sequence
  source 1..20: mol_type = other DNA
caggcatgagccactgtgcc

SEQ ID NO: 96203 - DNA, 20 bp, synthetic construct
  misc_feature 1..20: note = CRISPR gRNA sequence
  source 1..20: mol_type = other DNA
gagccactgtgcccggcctt

SEQ ID NO: 96204 - DNA, 20 bp, synthetic construct
  misc_feature 1..20: note = CRISPR gRNA sequence
  source 1..20: mol_type = other DNA
tgaacacttatttcaacttg

SEQ ID NO: 96205 - DNA, 20 bp, synthetic construct
  misc_feature 1..20: note = CRISPR gRNA sequence
  source 1..20: mol_type = other DNA
ctacttgacccccgactccc

SEQ ID NO: 96206 - DNA, 20 bp, synthetic construct
  misc_feature 1..20: note = CRISPR gRNA sequence
  source 1..20: mol_type = other DNA
acttgacccccgactcccta

SEQ ID NO: 96207 - DNA, 20 bp, synthetic construct
  misc_feature 1..20: note = CRISPR gRNA sequence
  source 1..20: mol_type = other DNA
cttgacccccgactccctag

SEQ ID NO: 96208 - DNA, 20 bp, synthetic construct
  misc_feature 1..20: note = CRISPR gRNA sequence
  source 1..20: mol_type = other DNA
ttgacccccgactccctaga

SEQ ID NO: 96209 - DNA, 20 bp, synthetic construct
  misc_feature 1..20: note = CRISPR gRNA sequence
  source 1..20: mol_type = other DNA
aaaactatgtcttgtttgct

SEQ ID NO: 96210 - DNA, 20 bp, synthetic construct
  misc_feature 1..20: note = CRISPR gRNA sequence
  source 1..20: mol_type = other DNA
ttgtttgctcagaacattgc

SEQ ID NO: 96211 - DNA, 20 bp, synthetic construct
  misc_feature 1..20: note = CRISPR gRNA sequence
  source 1..20: mol_type = other DNA
tgtttgctcagaacattgcc

SEQ ID NO: 96212 - DNA, 20 bp, synthetic construct
  misc_feature 1..20: note = CRISPR gRNA sequence
  source 1..20: mol_type = other DNA
ttgctcagaacattgccagg

SEQ ID NO: 96213 - DNA, 20 bp, synthetic construct
  misc_feature 1..20: note = CRISPR gRNA sequence
  source 1..20: mol_type = other DNA
tgctcagaacattgccaggc

SEQ ID NO: 96214 - DNA, 20 bp, synthetic construct
  misc_feature 1..20: note = CRISPR gRNA sequence
  source 1..20: mol_type = other DNA
gctcagaacattgccaggca

SEQ ID NO: 96215 - DNA, 20 bp, synthetic construct
  misc_feature 1..20: note = CRISPR gRNA sequence
  source 1..20: mol_type = other DNA
tcagaacattgccaggcagg

SEQ ID NO: 96216 - DNA, 20 bp, synthetic construct
  misc_feature 1..20: note = CRISPR gRNA sequence
  source 1..20: mol_type = other DNA
cagaacattgccaggcaggg

SEQ ID NO: 96217 - DNA, 20 bp, synthetic construct
  misc_feature 1..20: note = CRISPR gRNA sequence
  source 1..20: mol_type = other DNA
gaacattgccaggcagggag

SEQ ID NO: 96218 - DNA, 20 bp, synthetic construct
  misc_feature 1..20: note = CRISPR gRNA sequence
  source 1..20: mol_type = other DNA
attgccaggcagggaggaga

SEQ ID NO: 96219 - DNA, 20 bp, synthetic construct
  misc_feature 1..20: note = CRISPR gRNA sequence
  source 1..20: mol_type = other DNA
gggaggagaaagatgcaccc

SEQ ID NO: 96220 - DNA, 20 bp, synthetic construct
  misc_feature 1..20: note = CRISPR gRNA sequence
  source 1..20: mol_type = other DNA
ggaggagaaagatgcaccct

SEQ ID NO: 96221 - DNA, 20 bp, synthetic construct
  misc_feature 1..20: note = CRISPR gRNA sequence
  source 1..20: mol_type = other DNA
aagatgcaccctgggtattc

SEQ ID NO: 96222 - DNA, 20 bp, synthetic construct
  misc_feature 1..20: note = CRISPR gRNA sequence
  source 1..20: mol_type = other DNA
gatgcaccctgggtattcaa

SEQ ID NO: 96223 - DNA, 20 bp, synthetic construct
  misc_feature 1..20: note = CRISPR gRNA sequence
  source 1..20: mol_type = other DNA
tgcaccctgggtattcaaga

SEQ ID NO: 96224 - DNA, 20 bp, synthetic construct
  misc_feature 1..20: note = CRISPR gRNA sequence
  source 1..20: mol_type = other DNA
accctgggtattcaagagag

SEQ ID NO: 96225 - DNA, 20 bp, synthetic construct
  misc_feature 1..20: note = CRISPR gRNA sequence
  source 1..20: mol_type = other DNA
cctgggtattcaagagagta

SEQ ID NO: 96226 - DNA, 20 bp, synthetic construct
  misc_feature 1..20: note = CRISPR gRNA sequence
  source 1..20: mol_type = other DNA
ggtattcaagagagtagagt

SEQ ID NO: 96227 - DNA, 20 bp, synthetic construct
  misc_feature 1..20: note = CRISPR gRNA sequence
  source 1..20: mol_type = other DNA
aagagagtagagtgagtgaa

SEQ ID NO: 96228 - DNA, 20 bp, synthetic construct
  misc_feature 1..20: note = CRISPR gRNA sequence
  source 1..20: mol_type = other DNA
agagtagagtgagtgaatgg

SEQ ID NO: 96229 - DNA, 20 bp, synthetic construct
  misc_feature 1..20: note = CRISPR gRNA sequence
  source 1..20: mol_type = other DNA
agtagagtgagtgaatggtg

SEQ ID NO: 96230 - DNA, 20 bp, synthetic construct
  misc_feature 1..20: note = CRISPR gRNA sequence
  source 1..20: mol_type = other DNA
gtgagtgaatggtggagtcc

SEQ ID NO: 96231 - DNA, 20 bp, synthetic construct
  misc_feature 1..20: note = CRISPR gRNA sequence
  source 1..20: mol_type = other DNA
tgagtgaatggtggagtccc

SEQ ID NO: 96232 - DNA, 20 bp, synthetic construct
  misc_feature 1..20: note = CRISPR gRNA sequence
  source 1..20: mol_type = other DNA
ggagtcccaggcactgcctt

SEQ ID NO: 96233 - DNA, 20 bp, synthetic construct
  misc_feature 1..20: note = CRISPR gRNA sequence
  source 1..20: mol_type = other DNA
gtcccaggcactgcctttgg

SEQ ID NO: 96234 - DNA, 20 bp, synthetic construct
  misc_feature 1..20: note = CRISPR gRNA sequence
  source 1..20: mol_type = other DNA
gcactgcctttggtagctcc

SEQ ID NO: 96235 - DNA, 20 bp, synthetic construct
  misc_feature 1..20: note = CRISPR gRNA sequence
  source 1..20: mol_type = other DNA
ctttggtagctccaagaccc

SEQ ID NO: 96236 - DNA, 20 bp, synthetic construct
  misc_feature 1..20: note = CRISPR gRNA sequence
  source 1..20: mol_type = other DNA
tttggtagctccaagacccc

SEQ ID NO: 96237 - DNA, 20 bp, synthetic construct
  misc_feature 1..20: note = CRISPR gRNA sequence
  source 1..20: mol_type = other DNA
ttggtagctccaagacccca

SEQ ID NO: 96238 - DNA, 20 bp, synthetic construct
  misc_feature 1..20: note = CRISPR gRNA sequence
  source 1..20: mol_type = other DNA
ggtagctccaagaccccagg

SEQ ID NO: 96239 - DNA, 20 bp, synthetic construct
  misc_feature 1..20: note = CRISPR gRNA sequence
  source 1..20: mol_type = other DNA
aagaccccagggagataccg

SEQ ID NO: 96240 - DNA, 20 bp, synthetic construct
  misc_feature 1..20: note = CRISPR gRNA sequence
  source 1..20: mol_type = other DNA
agaccccagggagataccga

SEQ ID NO: 96241 - DNA, 20 bp, synthetic construct
  misc_feature 1..20: note = CRISPR gRNA sequence
  source 1..20: mol_type = other DNA
ccccagggagataccgaagg

SEQ ID NO: 96242 - DNA, 20 bp, synthetic construct
  misc_feature 1..20: note = CRISPR gRNA sequence
  source 1..20: mol_type = other DNA
cagggagataccgaaggcag

SEQ ID NO: 96243 - DNA, 20 bp, synthetic construct
  misc_feature 1..20: note = CRISPR gRNA sequence
  source 1..20: mol_type = other DNA
agataccgaaggcagtagca

SEQ ID NO: 96244 - DNA, 20 bp, synthetic construct
  misc_feature 1..20: note = CRISPR gRNA sequence
  source 1..20: mol_type = other DNA
taccgaaggcagtagcatgg

SEQ ID NO: 96245 - DNA, 20 bp, synthetic construct
  misc_feature 1..20: note = CRISPR gRNA sequence
  source 1..20: mol_type = other DNA
gtagctcatgcctgtaatcc

SEQ ID NO: 96246 - DNA, 20 bp, synthetic construct
  misc_feature 1..20: note = CRISPR gRNA sequence
  source 1..20: mol_type = other DNA
tgcctgtaatcccagcactt

SEQ ID NO: 96247 - DNA, 20 bp, synthetic construct
  misc_feature 1..20: note = CRISPR gRNA sequence
  source 1..20: mol_type = other DNA
gcctgtaatcccagcacttt

SEQ ID NO: 96248 - DNA, 20 bp, synthetic construct
  misc_feature 1..20: note = CRISPR gRNA sequence
  source 1..20: mol_type = other DNA
ctgtaatcccagcactttgg

SEQ ID NO: 96249 - DNA, 20 bp, synthetic construct
  misc_feature 1..20: note = CRISPR gRNA sequence
  source 1..20: mol_type = other DNA
tgtaatcccagcactttggg

SEQ ID NO: 96250 - DNA, 20 bp, synthetic construct
  misc_feature 1..20: note = CRISPR gRNA sequence
  source 1..20: mol_type = other DNA
cccagcactttgggaggcca

SEQ ID NO: 96251 - DNA, 20 bp, synthetic construct
  misc_feature 1..20: note = CRISPR gRNA sequence
  source 1..20: mol_type = other DNA
agcactttgggaggccacgg

SEQ ID NO: 96252 - DNA, 20 bp, synthetic construct
  misc_feature 1..20: note = CRISPR gRNA sequence
  source 1..20: mol_type = other DNA
gcactttgggaggccacggc

SEQ ID NO: 96253 - DNA, 20 bp, synthetic construct
  misc_feature 1..20: note = CRISPR gRNA sequence
  source 1..20: mol_type = other DNA
actttgggaggccacggcag

SEQ ID NO: 96254 - DNA, 20 bp, synthetic construct
  misc_feature 1..20: note = CRISPR gRNA sequence
  source 1..20: mol_type = other DNA
ccacggcaggagaattgctt

SEQ ID NO: 96255 - DNA, 20 bp, synthetic construct
  misc_feature 1..20: note = CRISPR gRNA sequence
  source 1..20: mol_type = other DNA
gcaggagaattgcttgagcc

SEQ ID NO: 96256 - DNA, 20 bp, synthetic construct
  misc_feature 1..20: note = CRISPR gRNA sequence
  source 1..20: mol_type = other DNA
caggagaattgcttgagccc

SEQ ID NO: 96257 - DNA, 20 bp, synthetic construct
  misc_feature 1..20: note = CRISPR gRNA sequence
  source 1..20: mol_type = other DNA
ggagaattgcttgagcccag

SEQ ID NO: 96258 - DNA, 20 bp, synthetic construct
  misc_feature 1..20: note = CRISPR gRNA sequence
  source 1..20: mol_type = other DNA
ttgcttgagcccaggagttt

SEQ ID NO: 96259 - DNA, 20 bp, synthetic construct
  misc_feature 1..20: note = CRISPR gRNA sequence
  source 1..20: mol_type = other DNA
tgagcccaggagtttgagac

SEQ ID NO: 96260 - DNA, 20 bp, synthetic construct
  misc_feature 1..20: note = CRISPR gRNA sequence
  source 1..20: mol_type = other DNA
ccaggagtttgagaccagcc

SEQ ID NO: 96261 - DNA, 20 bp, synthetic construct
  misc_feature 1..20: note = CRISPR gRNA sequence
  source 1..20: mol_type = other DNA
caggagtttgagaccagcct

SEQ ID NO: 96262 - DNA, 20 bp, synthetic construct
  misc_feature 1..20: note = CRISPR gRNA sequence
  source 1..20: mol_type = other DNA
tttgagaccagcctgggcga

SEQ ID NO: 96263 - DNA, 20 bp, synthetic construct
  misc_feature 1..20: note = CRISPR gRNA sequence
  source 1..20: mol_type = other DNA
tgagaccagcctgggcgaca

SEQ ID NO: 96264 - DNA, 20 bp, synthetic construct
  misc_feature 1..20: note = CRISPR gRNA sequence
  source 1..20: mol_type = other DNA
accagcctgggcgacagagc

SEQ ID NO: 96265 - DNA, 20 bp, synthetic construct
  misc_feature 1..20: note = CRISPR gRNA sequence
  source 1..20: mol_type = other DNA
tatatatatttttaatttgc

SEQ ID NO: 96266 - DNA, 20 bp, synthetic construct
  misc_feature 1..20: note = CRISPR gRNA sequence
  source 1..20: mol_type = other DNA
atatatatttttaatttgct

SEQ ID NO: 96267 - DNA, 20 bp, synthetic construct
  misc_feature 1..20: note = CRISPR gRNA sequence
  source 1..20: mol_type = other DNA
tatttttaatttgctgggta

SEQ ID NO: 96268 - DNA, 20 bp, synthetic construct
  misc_feature 1..20: note = CRISPR gRNA sequence
  source 1..20: mol_type = other DNA
ttttaatttgctgggtatgg

SEQ ID NO: 96269 - DNA, 20 bp, synthetic construct
  misc_feature 1..20: note = CRISPR gRNA sequence
  source 1..20: mol_type = other DNA
gctgggtatggtggcacctg

SEQ ID NO: 96270 - DNA, 20 bp, synthetic construct
  misc_feature 1..20: note = CRISPR gRNA sequence
  source 1..20: mol_type = other DNA
tatggtggcacctgtagttt

SEQ ID NO: 96271 - DNA, 20 bp, synthetic construct
  misc_feature 1..20: note = CRISPR gRNA sequence
  source 1..20: mol_type = other DNA
cacctgtagtttcagctgct

SEQ ID NO: 96272 - DNA, 20 bp, synthetic construct
  misc_feature 1..20: note = CRISPR gRNA sequence
  source 1..20: mol_type = other DNA
acctgtagtttcagctgctc

SEQ ID NO: 96273 - DNA, 20 bp, synthetic construct
  misc_feature 1..20: note = CRISPR gRNA sequence
  source 1..20: mol_type = other DNA
ctgtagtttcagctgctcag

SEQ ID NO: 96274 - DNA, 20 bp, synthetic construct
  misc_feature 1..20: note = CRISPR gRNA sequence
  source 1..20: mol_type = other DNA
tgtagtttcagctgctcagg

SEQ ID NO: 96275 - DNA, 20 bp, synthetic construct
  misc_feature 1..20: note = CRISPR gRNA sequence
  source 1..20: mol_type = other DNA
tttcagctgctcaggaggct

SEQ ID NO: 96276 - DNA, 20 bp, synthetic construct
  misc_feature 1..20: note = CRISPR gRNA sequence
  source 1..20: mol_type = other DNA
ttcagctgctcaggaggctg

SEQ ID NO: 96277 - DNA, 20 bp, synthetic construct
  misc_feature 1..20: note = CRISPR gRNA sequence
  source 1..20: mol_type = other DNA
agctgctcaggaggctgagg

SEQ ID NO: 96278 - DNA, 20 bp, synthetic construct
  misc_feature 1..20: note = CRISPR gRNA sequence
  source 1..20: mol_type = other DNA
gctgctcaggaggctgaggt

SEQ ID NO: 96279 - DNA, 20 bp, synthetic construct
  misc_feature 1..20: note = CRISPR gRNA sequence
  source 1..20: mol_type = other DNA
tgctcaggaggctgaggtgg

SEQ ID NO: 96280 - DNA, 20 bp, synthetic construct
  misc_feature 1..20: note = CRISPR gRNA sequence
  source 1..20: mol_type = other DNA
gctcaggaggctgaggtggg

SEQ ID NO: 96281 - DNA, 20 bp, synthetic construct
  misc_feature 1..20: note = CRISPR gRNA sequence
  source 1..20: mol_type = other DNA
aggaggctgaggtgggaggt

SEQ ID NO: 96282 - DNA, 20 bp, synthetic construct
  misc_feature 1..20: note = CRISPR gRNA sequence
  source 1..20: mol_type = other DNA
ctgaggtgggaggttggctt

SEQ ID NO: 96283 - DNA, 20 bp, synthetic construct
  misc_feature 1..20: note = CRISPR gRNA sequence
  source 1..20: mol_type = other DNA
gtgggaggttggcttgagcc

SEQ ID NO: 96284 - DNA, 20 bp, synthetic construct
  misc_feature 1..20: note = CRISPR gRNA sequence
  source 1..20: mol_type = other DNA
tgggaggttggcttgagccc

SEQ ID NO: 96285 - DNA, 20 bp, synthetic construct
  misc_feature 1..20: note = CRISPR gRNA sequence
  source 1..20: mol_type = other DNA
ggaggttggcttgagcccag

SEQ ID NO: 96286 - DNA, 20 bp, synthetic construct
  misc_feature 1..20: note = CRISPR gRNA sequence
  source 1..20: mol_type = other DNA
gaggttggcttgagcccagg

SEQ ID NO: 96287 - DNA, 20 bp, synthetic construct
  misc_feature 1..20: note = CRISPR gRNA sequence
  source 1..20: mol_type = other DNA
tggcttgagcccaggaggtt

SEQ ID NO: 96288 - DNA, 20 bp, synthetic construct
  misc_feature 1..20: note = CRISPR gRNA sequence
  source 1..20: mol_type = other DNA
ggcttgagcccaggaggttg

SEQ ID NO: 96289 - DNA, 20 bp, synthetic construct
  misc_feature 1..20: note = CRISPR gRNA sequence
  source 1..20: mol_type = other DNA
agcccaggaggttgaggctg

SEQ ID NO: 96290 - DNA, 20 bp, synthetic construct
  misc_feature 1..20: note = CRISPR gRNA sequence
  source 1..20: mol_type = other DNA
gtgatcacaccaccgcactc

SEQ ID NO: 96291 - DNA, 20 bp, synthetic construct
  misc_feature 1..20: note = CRISPR gRNA sequence
  source 1..20: mol_type = other DNA
cacaccaccgcactccagcc

SEQ ID NO: 96292 - DNA, 20 bp, synthetic construct
  misc_feature 1..20: note = CRISPR gRNA sequence
  source 1..20: mol_type = other DNA
ccgcactccagcctggacaa

SEQ ID NO: 96293 - DNA, 20 bp, synthetic construct
  misc_feature 1..20: note = CRISPR gRNA sequence
  source 1..20: mol_type = other DNA
gcactccagcctggacaaca

SEQ ID NO: 96294 - DNA, 20 bp, synthetic construct
  misc_feature 1..20: note = CRISPR gRNA sequence
  source 1..20: mol_type = other DNA
tccagcctggacaacagagc

SEQ ID NO: 96295 - DNA, 20 bp, synthetic construct
  misc_feature 1..20: note = CRISPR gRNA sequence
  source 1..20: mol_type = other DNA
aaaaaaaaaaaaaaccccaa

SEQ ID NO: 96296 - DNA, 20 bp, synthetic construct
  misc_feature 1..20: note = CRISPR gRNA sequence
  source 1..20: mol_type = other DNA
aaaaaaaaaaccccaatagc

SEQ ID NO: 96297 - DNA, 20 bp, synthetic construct
  misc_feature 1..20: note = CRISPR gRNA sequence
  source 1..20: mol_type = other DNA
aaaaaaaaaccccaatagct

SEQ ID NO: 96298 - DNA, 20 bp, synthetic construct
  misc_feature 1..20: note = CRISPR gRNA sequence
  source 1..20: mol_type = other DNA
aaaaccccaatagctgggtg

SEQ ID NO: 96299 - DNA, 20 bp, synthetic construct
  misc_feature 1..20: note = CRISPR gRNA sequence
  source 1..20: mol_type = other DNA
accccaatagctgggtgtgg

SEQ ID NO: 96300 - DNA, 20 bp, synthetic construct
  misc_feature 1..20: note = CRISPR gRNA sequence
  source 1..20: mol_type = other DNA
gtggctcatgcctataatcc

SEQ ID NO: 96301 - DNA, 20 bp, synthetic construct
  misc_feature 1..20: note = CRISPR gRNA sequence
  source 1..20: mol_type = other DNA
tgcctataatcccagcactt

SEQ ID NO: 96302 - DNA, 20 bp, synthetic construct
  misc_feature 1..20: note = CRISPR gRNA sequence
  source 1..20: mol_type = other DNA
gcctataatcccagcacttt

SEQ ID NO: 96303 - DNA, 20 bp, synthetic construct
  misc_feature 1..20: note = CRISPR gRNA sequence
  source 1..20: mol_type = other DNA
ctataatcccagcactttgg

SEQ ID NO: 96304 - DNA, 20 bp, synthetic construct
  misc_feature 1..20: note = CRISPR gRNA sequence
  source 1..20: mol_type = other DNA
tataatcccagcactttggg

SEQ ID NO: 96305 - DNA, 20 bp, synthetic construct
  misc_feature 1..20: note = CRISPR gRNA sequence
  source 1..20: mol_type = other DNA
tcccagcactttgggaggct

SEQ ID NO: 96306 - DNA, 20 bp, synthetic construct
  misc_feature 1..20: note = CRISPR gRNA sequence
  source 1..20: mol_type = other DNA
cccagcactttgggaggctg

SEQ ID NO: 96307 - DNA, 20 bp, synthetic construct
  misc_feature 1..20: note = CRISPR gRNA sequence
  source 1..20: mol_type = other DNA
agcactttgggaggctgagg

SEQ ID NO: 96308 - DNA, 20 bp, synthetic construct
  misc_feature 1..20: note = CRISPR gRNA sequence
  source 1..20: mol_type = other DNA
gcactttgggaggctgaggc

SEQ ID NO: 96309 - DNA, 20 bp, synthetic construct
  misc_feature 1..20: note = CRISPR gRNA sequence
  source 1..20: mol_type = other DNA
ctttgggaggctgaggcagg

SEQ ID NO: 96310 - DNA, 20 bp, synthetic construct
  misc_feature 1..20: note = CRISPR gRNA sequence
  source 1..20: mol_type = other DNA
ctgaggcaggtggatgattt

SEQ ID NO: 96311 - DNA, 20 bp, synthetic construct
  misc_feature 1..20: note = CRISPR gRNA sequence
  source 1..20: mol_type = other DNA
tgaggcaggtggatgatttg

SEQ ID NO: 96312 - DNA, 20 bp, synthetic construct
  misc_feature 1..20: note = CRISPR gRNA sequence
  source 1..20: mol_type = other DNA
gcaggtggatgatttgaggt

SEQ ID NO: 96313 - DNA, 20 bp, synthetic construct
  misc_feature 1..20: note = CRISPR gRNA sequence
  source 1..20: mol_type = other DNA
caggtggatgatttgaggtc

SEQ ID NO: 96314 - DNA, 20 bp, synthetic construct
  misc_feature 1..20: note = CRISPR gRNA sequence
  source 1..20: mol_type = other DNA
ggtggatgatttgaggtcag

SEQ ID NO: 96315 - DNA, 20 bp, synthetic construct
  misc_feature 1..20: note = CRISPR gRNA sequence
  source 1..20: mol_type = other DNA
tgaggtcaggagtttgaaat

SEQ ID NO: 96316 - DNA, 20 bp, synthetic construct
  misc_feature 1..20: note = CRISPR gRNA sequence
  source 1..20: mol_type = other DNA
tcaggagtttgaaattagcc

SEQ ID NO: 96317 - DNA, 20 bp, synthetic construct
  misc_feature 1..20: note = CRISPR gRNA sequence
  source 1..20: mol_type = other DNA
tgaaattagcctggccaaca

SEQ ID NO: 96318 - DNA, 20 bp, synthetic construct
  misc_feature 1..20: note = CRISPR gRNA sequence
  source 1..20: mol_type = other DNA
tctacttaaaatacaaaaat

SEQ ID NO: 96319 - DNA, 20 bp, synthetic construct
  misc_feature 1..20: note = CRISPR gRNA sequence
  source 1..20: mol_type = other DNA
cttaaaatacaaaaattagc

SEQ ID NO: 96320 - DNA, 20 bp, synthetic construct
  misc_feature 1..20: note = CRISPR gRNA sequence
  source 1..20: mol_type = other DNA
ttaaaatacaaaaattagcc

SEQ ID NO: 96321 - DNA, 20 bp, synthetic construct
  misc_feature 1..20: note = CRISPR gRNA sequence
  source 1..20: mol_type = other DNA
atacaaaaattagccaggtg

SEQ ID NO: 96322 - DNA, 20 bp, synthetic construct
  misc_feature 1..20: note = CRISPR gRNA sequence
  source 1..20: mol_type = other DNA
caaaaattagccaggtgtgg

SEQ ID NO: 96323 - DNA, 20 bp, synthetic construct
  misc_feature 1..20: note = CRISPR gRNA sequence
  source 1..20: mol_type = other DNA
aaattagccaggtgtggtgg

SEQ ID NO: 96324 - DNA, 20 bp, synthetic construct
  misc_feature 1..20: note = CRISPR gRNA sequence
  source 1..20: mol_type = other DNA
aattagccaggtgtggtggt

SEQ ID NO: 96325 - DNA, 20 bp, synthetic construct
  misc_feature 1..20: note = CRISPR gRNA sequence
  source 1..20: mol_type = other DNA
gtggtgggcgcctatgatcc

SEQ ID NO: 96326 - DNA, 20 bp, synthetic construct
  misc_feature 1..20: note = CRISPR gRNA sequence
  source 1..20: mol_type = other DNA
cgcctatgatcccagctact

SEQ ID NO: 96327 - DNA, 20 bp, synthetic construct
  misc_feature 1..20: note = CRISPR gRNA sequence
  source 1..20: mol_type = other DNA
gcctatgatcccagctactc

SEQ ID NO: 96328 - DNA, 20 bp, synthetic construct
  misc_feature 1..20: note = CRISPR gRNA sequence
  source 1..20: mol_type = other DNA
ctatgatcccagctactcgg

SEQ ID NO: 96329 - DNA, 20 bp, synthetic construct
  misc_feature 1..20: note = CRISPR gRNA sequence
  source 1..20: mol_type = other DNA
tatgatcccagctactcggg

SEQ ID NO: 96330 - DNA, 20 bp, synthetic construct
  misc_feature 1..20: note = CRISPR gRNA sequence
  source 1..20: mol_type = other DNA
tcccagctactcgggaggct

SEQ ID NO: 96331 - DNA, 20 bp, synthetic construct
  misc_feature 1..20: note = CRISPR gRNA sequence
  source 1..20: mol_type = other DNA
cccagctactcgggaggctg

SEQ ID NO: 96332 - DNA, 20 bp, synthetic construct
  misc_feature 1..20: note = CRISPR gRNA sequence
  source 1..20: mol_type = other DNA
tactcgggaggctgaggcac

SEQ ID NO: 96333 - DNA, 20 bp, synthetic construct
  misc_feature 1..20: note = CRISPR gRNA sequence
  source 1..20: mol_type = other DNA
gcacaagaatcgcttgaacc

SEQ ID NO: 96334 - DNA, 20 bp, synthetic construct
  misc_feature 1..20: note = CRISPR gRNA sequence
  source 1..20: mol_type = other DNA
cacaagaatcgcttgaaccc

SEQ ID NO: 96335 - DNA, 20 bp, synthetic construct
  misc_feature 1..20: note = CRISPR gRNA sequence
  source 1..20: mol_type = other DNA
caagaatcgcttgaacccag

SEQ ID NO: 96336 - DNA, 20 bp, synthetic construct
  misc_feature 1..20: note = CRISPR gRNA sequence
  source 1..20: mol_type = other DNA
aagaatcgcttgaacccagg

SEQ ID NO: 96337 - DNA, 20 bp, synthetic construct
  misc_feature 1..20: note = CRISPR gRNA sequence
  source 1..20: mol_type = other DNA
aatcgcttgaacccaggagg

SEQ ID NO: 96338 - DNA, 20 bp, synthetic construct
  misc_feature 1..20: note = CRISPR gRNA sequence
  source 1..20: mol_type = other DNA
tcgcttgaacccaggaggca

SEQ ID NO: 96339 - DNA, 20 bp, synthetic construct
  misc_feature 1..20: note = CRISPR gRNA sequence
  source 1..20: mol_type = other DNA
cgcttgaacccaggaggcag

SEQ ID NO: 96340 - DNA, 20 bp, synthetic construct
  misc_feature 1..20: note = CRISPR gRNA sequence
  source 1..20: mol_type = other DNA
aacccaggaggcagaggttg

SEQ ID NO: 96341 - DNA, 20 bp, synthetic construct
  misc_feature 1..20: note = CRISPR gRNA sequence
  source 1..20: mol_type = other DNA
caggaggcagaggttgcagt

SEQ ID NO: 96342 - DNA, 20 bp, synthetic construct
  misc_feature 1..20: note = CRISPR gRNA sequence
  source 1..20: mol_type = other DNA
ggcagaggttgcagtgagcc

SEQ ID NO: 96343 - DNA, 20 bp, synthetic construct
  misc_feature 1..20: note = CRISPR gRNA sequence
  source 1..20: mol_type = other DNA
gagatcacgccactgtactc

SEQ ID NO: 96344 - DNA, 20 bp, synthetic construct
  misc_feature 1..20: note = CRISPR gRNA sequence
  source 1..20: mol_type = other DNA
cacgccactgtactccagcc

SEQ ID NO: 96345 - DNA, 20 bp, synthetic construct
  misc_feature 1..20: note = CRISPR gRNA sequence
  source 1..20: mol_type = other DNA
acgccactgtactccagcct

SEQ ID NO: 96346 - DNA, 20 bp, synthetic construct
  misc_feature 1..20: note = CRISPR gRNA sequence
  source 1..20: mol_type = other DNA
cgccactgtactccagcctg

SEQ ID NO: 96347 - DNA, 20 bp, synthetic construct
  misc_feature 1..20: note = CRISPR gRNA sequence
  source 1..20: mol_type = other DNA
gccactgtactccagcctgg

SEQ ID NO: 96348 - DNA, 20 bp, synthetic construct
  misc_feature 1..20: note = CRISPR gRNA sequence
  source 1..20: mol_type = other DNA
ctgtactccagcctggggga

SEQ ID NO: 96349 - DNA, 20 bp, synthetic construct
  misc_feature 1..20: note = CRISPR gRNA sequence
  source 1..20: mol_type = other DNA
actccagcctgggggacaga

SEQ ID NO: 96350 - DNA, 20 bp, synthetic construct
  misc_feature 1..20: note = CRISPR gRNA sequence
  source 1..20: mol_type = other DNA
tccagcctgggggacagacg

SEQ ID NO: 96351 - DNA, 20 bp, synthetic construct
  misc_feature 1..20: note = CRISPR gRNA sequence
  source 1..20: mol_type = other DNA
gactccatctcaaacaacaa

SEQ ID NO: 96352 - DNA, 20 bp, synthetic construct
  misc_feature 1..20: note = CRISPR gRNA sequence
  source 1..20: mol_type = other DNA
acaacagcaacaaaaaaaaa

SEQ ID NO: 96353 - DNA, 20 bp, synthetic construct
  misc_feature 1..20: note = CRISPR gRNA sequence
  source 1..20: mol_type = other DNA
cagcaacaaaaaaaaacaga

SEQ ID NO: 96354 - DNA, 20 bp, synthetic construct
  misc_feature 1..20: note = CRISPR gRNA sequence
  source 1..20: mol_type = other DNA
agcaacaaaaaaaaacagat

SEQ ID NO: 96355 - DNA, 20 bp, synthetic construct
  misc_feature 1..20: note = CRISPR gRNA sequence
  source 1..20: mol_type = other DNA
acagatgggcttctgtcctg

SEQ ID NO: 96356 - DNA, 20 bp, synthetic construct
  misc_feature 1..20: note = CRISPR gRNA sequence
  source 1..20: mol_type = other DNA
gggcttctgtcctgaagcct

SEQ ID NO: 96357 - DNA, 20 bp, synthetic construct
  misc_feature 1..20: note = CRISPR gRNA sequence
  source 1..20: mol_type = other DNA
gcttctgtcctgaagcctca

SEQ ID NO: 96358 - DNA, 20 bp, synthetic construct
  misc_feature 1..20: note = CRISPR gRNA sequence
  source 1..20: mol_type = other DNA
aagcctcagagacatctact

SEQ ID NO: 96359 - DNA, 20 bp, synthetic construct
  misc_feature 1..20: note = CRISPR gRNA sequence
  source 1..20: mol_type = other DNA
agcctcagagacatctactg

SEQ ID NO: 96360 - DNA, 20 bp, synthetic construct
  misc_feature 1..20: note = CRISPR gRNA sequence
  source 1..20: mol_type = other DNA
gcctcagagacatctactga

SEQ ID NO: 96361 - DNA, 20 bp, synthetic construct
  misc_feature 1..20: note = CRISPR gRNA sequence
  source 1..20: mol_type = other DNA
cctcagagacatctactgag

SEQ ID NO: 96362 - DNA, 20 bp, synthetic construct
  misc_feature 1..20: note = CRISPR gRNA sequence
  source 1..20: mol_type = other DNA
gacgcctgttgtctgtttcc

SEQ ID NO: 96363 - DNA, 20 bp, synthetic construct
  misc_feature 1..20: note = CRISPR gRNA sequence
  source 1..20: mol_type = other DNA
gcctgttgtctgtttcccag

SEQ ID NO: 96364 - DNA, 20 bp, synthetic construct
  misc_feature 1..20: note = CRISPR gRNA sequence
  source 1..20: mol_type = other DNA
cctgttgtctgtttcccagc

SEQ ID NO: 96365 - DNA, 20 bp, synthetic construct
  misc_feature 1..20: note = CRISPR gRNA sequence
  source 1..20: mol_type = other DNA
gttgtctgtttcccagcagg

SEQ ID NO: 96366 - DNA, 20 bp, synthetic construct
  misc_feature 1..20: note = CRISPR gRNA sequence
  source 1..20: mol_type = other DNA
tcccagcaggcagctccctg

SEQ ID NO: 96367 - DNA, 20 bp, synthetic construct
  misc_feature 1..20: note = CRISPR gRNA sequence
  source 1..20: mol_type = other DNA
actccaccactctcaccaac

SEQ ID NO: 96368 - DNA, 20 bp, synthetic construct
  misc_feature 1..20: note = CRISPR gRNA sequence
  source 1..20: mol_type = other DNA
ccaccactctcaccaaccgg

SEQ ID NO: 96369 - DNA, 20 bp, synthetic construct
  misc_feature 1..20: note = CRISPR gRNA sequence
  source 1..20: mol_type = other DNA
cactctcaccaaccggcagc

SEQ ID NO: 96370 - DNA, 20 bp, synthetic construct
  misc_feature 1..20: note = CRISPR gRNA sequence
  source 1..20: mol_type = other DNA
actctcaccaaccggcagcg

SEQ ID NO: 96371 - DNA, 20 bp, synthetic construct
  misc_feature 1..20: note = CRISPR gRNA sequence
  source 1..20: mol_type = other DNA
ctctcaccaaccggcagcga

SEQ ID NO: 96372 - DNA, 20 bp, synthetic construct
  misc_feature 1..20: note = CRISPR gRNA sequence
  source 1..20: mol_type = other DNA
ccaaccggcagcgagggaac

SEQ ID NO: 96373 - DNA, 20 bp, synthetic construct
  misc_feature 1..20: note = CRISPR gRNA sequence
  source 1..20: mol_type = other DNA
caaccggcagcgagggaacg

SEQ ID NO: 96374 - DNA, 20 bp, synthetic construct
  misc_feature 1..20: note = CRISPR gRNA sequence
  source 1..20: mol_type = other DNA
gcagcgagggaacgaggtgt

SEQ ID NO: 96375 - DNA, 20 bp, synthetic construct
  misc_feature 1..20: note = CRISPR gRNA sequence
  source 1..20: mol_type = other DNA
gaacgaggtgtcagctctgc

SEQ ID NO: 96376 - DNA, 20 bp, synthetic construct
  misc_feature 1..20: note = CRISPR gRNA sequence
  source 1..20: mol_type = other DNA
gtcagctctgccggccaccc

SEQ ID NO: 96377 - DNA, 20 bp, synthetic construct
  misc_feature 1..20: note = CRISPR gRNA sequence
  source 1..20: mol_type = other DNA
tgccggccaccctagactgt

SEQ ID NO: 96378 - DNA, 20 bp, synthetic construct
  misc_feature 1..20: note = CRISPR gRNA sequence
  source 1..20: mol_type = other DNA
cggccaccctagactgtgag

SEQ ID NO: 96379 - DNA, 20 bp, synthetic construct
  misc_feature 1..20: note = CRISPR gRNA sequence
  source 1..20: mol_type = other DNA
ggccaccctagactgtgagt

SEQ ID NO: 96380 - DNA, 20 bp, synthetic construct
  misc_feature 1..20: note = CRISPR gRNA sequence
  source 1..20: mol_type = other DNA
ctagactgtgagtgggccca

SEQ ID NO: 96381 - DNA, 20 bp, synthetic construct
  misc_feature 1..20: note = CRISPR gRNA sequence
  source 1..20: mol_type = other DNA
gtgggcccacggtccccaac

SEQ ID NO: 96382 - DNA, 20 bp, synthetic construct
  misc_feature 1..20: note = CRISPR gRNA sequence
  source 1..20: mol_type = other DNA
tgggcccacggtccccaaca

SEQ ID NO: 96383 - DNA, 20 bp, synthetic construct
  misc_feature 1..20: note = CRISPR gRNA sequence
  source 1..20: mol_type = other DNA
ggcccacggtccccaacaag

SEQ ID NO: 96384 - DNA, 20 bp, synthetic construct
  misc_feature 1..20: note = CRISPR gRNA sequence
  source 1..20: mol_type = other DNA
cccacggtccccaacaagga

SEQ ID NO: 96385 - DNA, 20 bp, synthetic construct
  misc_feature 1..20: note = CRISPR gRNA sequence
  source 1..20: mol_type = other DNA
ccacggtccccaacaaggag

SEQ ID NO: 96386 - DNA, 20 bp, synthetic construct
  misc_feature 1..20: note = CRISPR gRNA sequence
  source 1..20: mol_type = other DNA
acggtccccaacaaggagag

SEQ ID NO: 96387 - DNA, 20 bp, synthetic construct
  misc_feature 1..20: note = CRISPR gRNA sequence
  source 1..20: mol_type = other DNA
gtccccaacaaggagaggag

SEQ ID NO: 96388 - DNA, 20 bp, synthetic construct
  misc_feature 1..20: note = CRISPR gRNA sequence
  source 1..20: mol_type = other DNA
tccccaacaaggagaggagt

SEQ ID NO: 96389 - DNA, 20 bp, synthetic construct
  misc_feature 1..20: note = CRISPR gRNA sequence
  source 1..20: mol_type = other DNA
cccaacaaggagaggagtag

SEQ ID NO: 96390 - DNA, 20 bp, synthetic construct
  misc_feature 1..20: note = CRISPR gRNA sequence
  source 1..20: mol_type = other DNA
ccaacaaggagaggagtagg

SEQ ID NO: 96391 - DNA, 20 bp, synthetic construct
  misc_feature 1..20: note = CRISPR gRNA sequence
  source 1..20: mol_type = other DNA
caacaaggagaggagtagga

SEQ ID NO: 96392 - DNA, 20 bp, synthetic construct
  misc_feature 1..20: note = CRISPR gRNA sequence
  source 1..20: mol_type = other DNA
caaggagaggagtaggaggg

SEQ ID NO: 96393 - DNA, 20 bp, synthetic construct
  misc_feature 1..20: note = CRISPR gRNA sequence
  source 1..20: mol_type = other DNA
aaggagaggagtaggagggt

SEQ ID NO: 96394 - DNA, 20 bp, synthetic construct
  misc_feature 1..20: note = CRISPR gRNA sequence
  source 1..20: mol_type = other DNA
ggagaggagtaggagggtgg

SEQ ID NO: 96395 - DNA, 20 bp, synthetic construct
  misc_feature 1..20: note = CRISPR gRNA sequence
  source 1..20: mol_type = other DNA
gagaggagtaggagggtggg

SEQ ID NO: 96396 - DNA, 20 bp, synthetic construct
  misc_feature 1..20: note = CRISPR gRNA sequence
  source 1..20: mol_type = other DNA
agaggagtaggagggtggga

SEQ ID NO: 96397 - DNA, 20 bp, synthetic construct
  misc_feature 1..20: note = CRISPR gRNA sequence
  source 1..20: mol_type = other DNA
aggagggtgggagggcctgt

SEQ ID NO: 96398 - DNA, 20 bp, synthetic construct
  misc_feature 1..20: note = CRISPR gRNA sequence
  source 1..20: mol_type = other DNA
ggagggtgggagggcctgtg

SEQ ID NO: 96399 - DNA, 20 bp, synthetic construct
  misc_feature 1..20: note = CRISPR gRNA sequence
  source 1..20: mol_type = other DNA
agggtgggagggcctgtgag

SEQ ID NO: 96400 - DNA, 20 bp, synthetic construct
  misc_feature 1..20: note = CRISPR gRNA sequence
  source 1..20: mol_type = other DNA
gggcctgtgaggagcaatcg

SEQ ID NO: 96401 - DNA, 20 bp, synthetic construct
  misc_feature 1..20: note = CRISPR gRNA sequence
  source 1..20: mol_type = other DNA
ctgtgaggagcaatcgtgga

SEQ ID NO: 96402 - DNA, 20 bp, synthetic construct
  misc_feature 1..20: note = CRISPR gRNA sequence
  source 1..20: mol_type = other DNA
gtgaggagcaatcgtggaca

SEQ ID NO: 96403 - DNA, 20 bp, synthetic construct
  misc_feature 1..20: note = CRISPR gRNA sequence
  source 1..20: mol_type = other DNA
tgaggagcaatcgtggacag

SEQ ID NO: 96404 - DNA, 20 bp, synthetic construct
  misc_feature 1..20: note = CRISPR gRNA sequence
  source 1..20: mol_type = other DNA
gaggagcaatcgtggacaga

SEQ ID NO: 96405 - DNA, 20 bp, synthetic construct
  misc_feature 1..20: note = CRISPR gRNA sequence
  source 1..20: mol_type = other DNA
tcgtggacagagggtaaact

SEQ ID NO: 96406 - DNA, 20 bp, synthetic construct
  misc_feature 1..20: note = CRISPR gRNA sequence
  source 1..20: mol_type = other DNA
cgtggacagagggtaaactg

SEQ ID NO: 96407 - DNA, 20 bp, synthetic construct
  misc_feature 1..20: note = CRISPR gRNA sequence
  source 1..20: mol_type = other DNA
acagagggtaaactgaggca

SEQ ID NO: 96408 - DNA, 20 bp, synthetic construct
  misc_feature 1..20: note = CRISPR gRNA sequence
  source 1..20: mol_type = other DNA
agagggtaaactgaggcaca

SEQ ID NO: 96409 - DNA, 20 bp, synthetic construct
  misc_feature 1..20: note = CRISPR gRNA sequence
  source 1..20: mol_type = other DNA
gggtaaactgaggcacagag

SEQ ID NO: 96410 - DNA, 20 bp, synthetic construct
  misc_feature 1..20: note = CRISPR gRNA sequence
  source 1..20: mol_type = other DNA
aaactgaggcacagagaagc

SEQ ID NO: 96411 - DNA, 20 bp, synthetic construct
  misc_feature 1..20: note = CRISPR gRNA sequence
  source 1..20: mol_type = other DNA
aactgaggcacagagaagca

SEQ ID NO: 96412 - DNA, 20 bp, synthetic construct
  misc_feature 1..20: note = CRISPR gRNA sequence
  source 1..20: mol_type = other DNA
actgaggcacagagaagcaa

SEQ ID NO: 96413 - DNA, 20 bp, synthetic construct
  misc_feature 1..20: note = CRISPR gRNA sequence
  source 1..20: mol_type = other DNA
ctgaggcacagagaagcaag

SEQ ID NO: 96414 - DNA, 20 bp, synthetic construct
  misc_feature 1..20: note = CRISPR gRNA sequence
  source 1..20: mol_type = other DNA
gcacagagaagcaaggggat

SEQ ID NO: 96415 - DNA, 20 bp, synthetic construct
  misc_feature 1..20: note = CRISPR gRNA sequence
  source 1..20: mol_type = other DNA
agagaagcaaggggatgagt

SEQ ID NO: 96416 - DNA, 20 bp, synthetic construct
  misc_feature 1..20: note = CRISPR gRNA sequence
  source 1..20: mol_type = other DNA
gagaagcaaggggatgagtg

SEQ ID NO: 96417 - DNA, 20 bp, synthetic construct
  misc_feature 1..20: note = CRISPR gRNA sequence
  source 1..20: mol_type = other DNA
actctgcctctgtcctgccc

SEQ ID NO: 96418 - DNA, 20 bp, synthetic construct
  misc_feature 1..20: note = CRISPR gRNA sequence
  source 1..20: mol_type = other DNA
ccccagccctgtccatccac

SEQ ID NO: 96419 - DNA, 20 bp, synthetic construct
  misc_feature 1..20: note = CRISPR gRNA sequence
  source 1..20: mol_type = other DNA
cctgtccatccaccagctcg

SEQ ID NO: 96420 - DNA, 20 bp, synthetic construct
  misc_feature 1..20: note = CRISPR gRNA sequence
  source 1..20: mol_type = other DNA
ccatccaccagctcgcagca

SEQ ID NO: 96421 - DNA, 20 bp, synthetic construct
  misc_feature 1..20: note = CRISPR gRNA sequence
  source 1..20: mol_type = other DNA
catccaccagctcgcagcac

SEQ ID NO: 96422 - DNA, 20 bp, synthetic construct
  misc_feature 1..20: note = CRISPR gRNA sequence
  source 1..20: mol_type = other DNA
atccaccagctcgcagcaca

SEQ ID NO: 96423 - DNA, 20 bp, synthetic construct
  misc_feature 1..20: note = CRISPR gRNA sequence
  source 1..20: mol_type = other DNA
tccaccagctcgcagcacag

SEQ ID NO: 96424 - DNA, 20 bp, synthetic construct
  misc_feature 1..20: note = CRISPR gRNA sequence
  source 1..20: mol_type = other DNA
ccaccagctcgcagcacagg

SEQ ID NO: 96425 - DNA, 20 bp, synthetic construct
  misc_feature 1..20: note = CRISPR gRNA sequence
  source 1..20: mol_type = other DNA
accagctcgcagcacagggg

SEQ ID NO: 96426 - DNA, 20 bp, synthetic construct
  misc_feature 1..20: note = CRISPR gRNA sequence
  source 1..20: mol_type = other DNA
gctcgcagcacagggggagc

SEQ ID NO: 96427 - DNA, 20 bp, synthetic construct
  misc_feature 1..20: note = CRISPR gRNA sequence
  source 1..20: mol_type = other DNA
cagcacagggggagctggac

SEQ ID NO: 96428 - DNA, 20 bp, synthetic construct
  misc_feature 1..20: note = CRISPR gRNA sequence
  source 1..20: mol_type = other DNA
agggggagctggaccagctg

SEQ ID NO: 96429 - DNA, 20 bp, synthetic construct
  misc_feature 1..20: note = CRISPR gRNA sequence
  source 1..20: mol_type = other DNA
gggggagctggaccagctga

SEQ ID NO: 96430 - DNA, 20 bp, synthetic construct
  misc_feature 1..20: note = CRISPR gRNA sequence
  source 1..20: mol_type = other DNA
gggagctggaccagctgaag

SEQ ID NO: 96431 - DNA, 20 bp, synthetic construct
  misc_feature 1..20: note = CRISPR gRNA sequence
  source 1..20: mol_type = other DNA
accagctgaaggagcatttg

SEQ ID NO: 96432 - DNA, 20 bp, synthetic construct
  misc_feature 1..20: note = CRISPR gRNA sequence
  source 1..20: mol_type = other DNA
gctgaaggagcatttgcgga

SEQ ID NO: 96433 - DNA, 20 bp, synthetic construct
  misc_feature 1..20: note = CRISPR gRNA sequence
  source 1..20: mol_type = other DNA
ctgaaggagcatttgcggaa

SEQ ID NO: 96434 - DNA, 20 bp, synthetic construct
  misc_feature 1..20: note = CRISPR gRNA sequence
  source 1..20: mol_type = other DNA
gcgtgtccacacacatgtgc

SEQ ID NO: 96435 - DNA, 20 bp, synthetic construct
  misc_feature 1..20: note = CRISPR gRNA sequence
  source 1..20: mol_type = other DNA
tgtgctggcatgtctgcacc

SEQ ID NO: 96436 - DNA, 20 bp, synthetic construct
  misc_feature 1..20: note = CRISPR gRNA sequence
  source 1..20: mol_type = other DNA
ctggcatgtctgcacctggc

SEQ ID NO: 96437 - DNA, 20 bp, synthetic construct
  misc_feature 1..20: note = CRISPR gRNA sequence
  source 1..20: mol_type = other DNA
acctggctggtgtgtgcata

SEQ ID NO: 96438 - DNA, 20 bp, synthetic construct
  misc_feature 1..20: note = CRISPR gRNA sequence
  source 1..20: mol_type = other DNA
cctggctggtgtgtgcatat

SEQ ID NO: 96439 - DNA, 20 bp, synthetic construct
  misc_feature 1..20: note = CRISPR gRNA sequence
  source 1..20: mol_type = other DNA
ccactcatgacgtgacctgt

SEQ ID NO: 96440 - DNA, 20 bp, synthetic construct
  misc_feature 1..20: note = CRISPR gRNA sequence
  source 1..20: mol_type = other DNA
ctcattcccctgtctaaccc

SEQ ID NO: 96441 - DNA, 20 bp, synthetic construct
  misc_feature 1..20: note = CRISPR gRNA sequence
  source 1..20: mol_type = other DNA
ccccccacctcgtccccatt

SEQ ID NO: 96442 - DNA, 20 bp, synthetic construct
  misc_feature 1..20: note = CRISPR gRNA sequence
  source 1..20: mol_type = other DNA
cccacctcgtccccatttgg

SEQ ID NO: 96443 - DNA, 20 bp, synthetic construct
  misc_feature 1..20: note = CRISPR gRNA sequence
  source 1..20: mol_type = other DNA
tcgtccccatttggcagcac

SEQ ID NO: 96444 - DNA, 20 bp, synthetic construct
  misc_feature 1..20: note = CRISPR gRNA sequence
  source 1..20: mol_type = other DNA
cgtccccatttggcagcact

SEQ ID NO: 96445 - DNA, 20 bp, synthetic construct
  misc_feature 1..20: note = CRISPR gRNA sequence
  source 1..20: mol_type = other DNA
gtccccatttggcagcactg

SEQ ID NO: 96446 - DNA, 20 bp, synthetic construct
  misc_feature 1..20: note = CRISPR gRNA sequence
  source 1..20: mol_type = other DNA
ccatttggcagcactgggga

SEQ ID NO: 96447 - DNA, 20 bp, synthetic construct
  misc_feature 1..20: note = CRISPR gRNA sequence
  source 1..20: mol_type = other DNA
catttggcagcactggggat

SEQ ID NO: 96448 - DNA, 20 bp, synthetic construct
  misc_feature 1..20: note = CRISPR gRNA sequence
  source 1..20: mol_type = other DNA
atttggcagcactggggata

SEQ ID NO: 96449 - DNA, 20 bp, synthetic construct
  misc_feature 1..20: note = CRISPR gRNA sequence
  source 1..20: mol_type = other DNA
tttggcagcactggggatag

SEQ ID NO: 96450 - DNA, 20 bp, synthetic construct
  misc_feature 1..20: note = CRISPR gRNA sequence
  source 1..20: mol_type = other DNA
ttggcagcactggggatagg

SEQ ID NO: 96451 - DNA, 20 bp, synthetic construct
  misc_feature 1..20: note = CRISPR gRNA sequence
  source 1..20: mol_type = other DNA
gcagcactggggataggggg

SEQ ID NO: 96452 - DNA, 20 bp, synthetic construct
  misc_feature 1..20: note = CRISPR gRNA sequence
  source 1..20: mol_type = other DNA
cagcactggggatagggggc

SEQ ID NO: 96453 - DNA, 20 bp, synthetic construct
  misc_feature 1..20: note = CRISPR gRNA sequence
  source 1..20: mol_type = other DNA
agcactggggatagggggca

SEQ ID NO: 96454 - DNA, 20 bp, synthetic construct
  misc_feature 1..20: note = CRISPR gRNA sequence
  source 1..20: mol_type = other DNA
gcactggggatagggggcag

SEQ ID NO: 96455 - DNA, 20 bp, synthetic construct
  misc_feature 1..20: note = CRISPR gRNA sequence
  source 1..20: mol_type = other DNA
ggggatagggggcaggggtg

SEQ ID NO: 96456 - DNA, 20 bp, synthetic construct
  misc_feature 1..20: note = CRISPR gRNA sequence
  source 1..20: mol_type = other DNA
tagggggcaggggtgcagcc

SEQ ID NO: 96457 - DNA, 20 bp, synthetic construct
  misc_feature 1..20: note = CRISPR gRNA sequence
  source 1..20: mol_type = other DNA
ggggcaggggtgcagcctgg

SEQ ID NO: 96458 - DNA, 20 bp, synthetic construct
  misc_feature 1..20: note = CRISPR gRNA sequence
  source 1..20: mol_type = other DNA
tattgcccgcctcctcctgc

SEQ ID NO: 96459 - DNA, 20 bp, synthetic construct
  misc_feature 1..20: note = CRISPR gRNA sequence
  source 1..20: mol_type = other DNA
attgcccgcctcctcctgcc

SEQ ID NO: 96460 - DNA, 20 bp, synthetic construct
  misc_feature 1..20: note = CRISPR gRNA sequence
  source 1..20: mol_type = other DNA
caggtgacaacctcgtcaac

SEQ ID NO: 96461 - DNA, 20 bp, synthetic construct
  misc_feature 1..20: note = CRISPR gRNA sequence
  source 1..20: mol_type = other DNA
tgacaacctcgtcaacaagc

SEQ ID NO: 96462 - DNA, 20 bp, synthetic construct
  misc_feature 1..20: note = CRISPR gRNA sequence
  source 1..20: mol_type = other DNA
acctcgtcaacaagccagac

SEQ ID NO: 96463 - DNA, 20 bp, synthetic construct
  misc_feature 1..20: note = CRISPR gRNA sequence
  source 1..20: mol_type = other DNA
gtcaacaagccagacgagcg

SEQ ID NO: 96464 - DNA, 20 bp, synthetic construct
  misc_feature 1..20: note = CRISPR gRNA sequence
  source 1..20: mol_type = other DNA
gcggcttcacccccctcatc

SEQ ID NO: 96465 - DNA, 20 bp, synthetic construct
  misc_feature 1..20: note = CRISPR gRNA sequence
  source 1..20: mol_type = other DNA
cggcttcacccccctcatct

SEQ ID NO: 96466 - DNA, 20 bp, synthetic construct
  misc_feature 1..20: note = CRISPR gRNA sequence
  source 1..20: mol_type = other DNA
ctcatctgggcctccgcctt

SEQ ID NO: 96467 - DNA, 20 bp, synthetic construct
  misc_feature 1..20: note = CRISPR gRNA sequence
  source 1..20: mol_type = other DNA
catctgggcctccgcctttg

SEQ ID NO: 96468 - DNA, 20 bp, synthetic construct
  misc_feature 1..20: note = CRISPR gRNA sequence
  source 1..20: mol_type = other DNA
tctgggcctccgcctttgga

SEQ ID NO: 96469 - DNA, 20 bp, synthetic construct
  misc_feature 1..20: note = CRISPR gRNA sequence
  source 1..20: mol_type = other DNA
cctccgcctttggagagatt

SEQ ID NO: 96470 - DNA, 20 bp, synthetic construct
  misc_feature 1..20: note = CRISPR gRNA sequence
  source 1..20: mol_type = other DNA
tgagaccgttcgcttcctgc

SEQ ID NO: 96471 - DNA, 20 bp, synthetic construct
  misc_feature 1..20: note = CRISPR gRNA sequence
  source 1..20: mol_type = other DNA
agaccgttcgcttcctgctg

SEQ ID NO: 96472 - DNA, 20 bp, synthetic construct
  misc_feature 1..20: note = CRISPR gRNA sequence
  source 1..20: mol_type = other DNA
ccgttcgcttcctgctggag

SEQ ID NO: 96473 - DNA, 20 bp, synthetic construct
  misc_feature 1..20: note = CRISPR gRNA sequence
  source 1..20: mol_type = other DNA
cgttcgcttcctgctggagt

SEQ ID NO: 96474 - DNA, 20 bp, synthetic construct
  misc_feature 1..20: note = CRISPR gRNA sequence
  source 1..20: mol_type = other DNA
ctgctggagtgggtgcgtcc

SEQ ID NO: 96475 - DNA, 20 bp, synthetic construct
  misc_feature 1..20: note = CRISPR gRNA sequence
  source 1..20: mol_type = other DNA
ggagtgggtgcgtcccagcc

SEQ ID NO: 96476 - DNA, 20 bp, synthetic construct
  misc_feature 1..20: note = CRISPR gRNA sequence
  source 1..20: mol_type = other DNA
tgggtgcgtcccagcccagc

SEQ ID NO: 96477 - DNA, 20 bp, synthetic construct
  misc_feature 1..20: note = CRISPR gRNA sequence
  source 1..20: mol_type = other DNA
gggtgcgtcccagcccagct

SEQ ID NO: 96478 - DNA, 20 bp, synthetic construct
  misc_feature 1..20: note = CRISPR gRNA sequence
  source 1..20: mol_type = other DNA
tgcgtcccagcccagctggg

SEQ ID NO: 96479 - DNA, 20 bp, synthetic construct
  misc_feature 1..20: note = CRISPR gRNA sequence
  source 1..20: mol_type = other DNA
tcccagcccagctgggcagc

SEQ ID NO: 96480 - DNA, 20 bp, synthetic construct
  misc_feature 1..20: note = CRISPR gRNA sequence
  source 1..20: mol_type = other DNA
cccagcccagctgggcagct

SEQ ID NO: 96481 - DNA, 20 bp, synthetic construct
  misc_feature 1..20: note = CRISPR gRNA sequence
  source 1..20: mol_type = other DNA
ccagcccagctgggcagctg

SEQ ID NO: 96482 - DNA, 20 bp, synthetic construct
  misc_feature 1..20: note = CRISPR gRNA sequence
  source 1..20: mol_type = other DNA
cagcccagctgggcagctgg

SEQ ID NO: 96483 - DNA, 20 bp, synthetic construct
  misc_feature 1..20: note = CRISPR gRNA sequence
  source 1..20: mol_type = other DNA
agcccagctgggcagctggg

SEQ ID NO: 96484 - DNA, 20 bp, synthetic construct
  misc_feature 1..20: note = CRISPR gRNA sequence
  source 1..20: mol_type = other DNA
ctgggcagctggggggttcc

SEQ ID NO: 96485 - DNA, 20 bp, synthetic construct
  misc_feature 1..20: note = CRISPR gRNA sequence
  source 1..20: mol_type = other DNA
tgggcagctggggggttccc

SEQ ID NO: 96486 - DNA, 20 bp, synthetic construct
  misc_feature 1..20: note = CRISPR gRNA sequence
  source 1..20: mol_type = other DNA
gggcagctggggggttcccg

SEQ ID NO: 96487 - DNA, 20 bp, synthetic construct
  misc_feature 1..20: note = CRISPR gRNA sequence
  source 1..20: mol_type = other DNA
ggcagctggggggttcccgg

SEQ ID NO: 96488 - DNA, 20 bp, synthetic construct
  misc_feature 1..20: note = CRISPR gRNA sequence
  source 1..20: mol_type = other DNA
tggggggttcccgggggcct

SEQ ID NO: 96489 - DNA, 20 bp, synthetic construct
  misc_feature 1..20: note = CRISPR gRNA sequence
  source 1..20: mol_type = other DNA
ggggggttcccgggggcctt

SEQ ID NO: 96490 - DNA, 20 bp, synthetic construct
  misc_feature 1..20: note = CRISPR gRNA sequence
  source 1..20: mol_type = other DNA
gggggttcccgggggcctta

SEQ ID NO: 96491 - DNA, 20 bp, synthetic construct
  misc_feature 1..20: note = CRISPR gRNA sequence
  source 1..20: mol_type = other DNA
ggttcccgggggccttaggg

SEQ ID NO: 96492 - DNA, 20 bp, synthetic construct
  misc_feature 1..20: note = CRISPR gRNA sequence
  source 1..20: mol_type = other DNA
gttcccgggggccttagggt

SEQ ID NO: 96493 - DNA, 20 bp, synthetic construct
  misc_feature 1..20: note = CRISPR gRNA sequence
  source 1..20: mol_type = other DNA
ccgggggccttagggtgggc

SEQ ID NO: 96494 - DNA, 20 bp, synthetic construct
  misc_feature 1..20: note = CRISPR gRNA sequence
  source 1..20: mol_type = other DNA
cgggggccttagggtgggct

SEQ ID NO: 96495 - DNA, 20 bp, synthetic construct
  misc_feature 1..20: note = CRISPR gRNA sequence
  source 1..20: mol_type = other DNA
gggggccttagggtgggctg

SEQ ID NO: 96496 - DNA, 20 bp, synthetic construct
  misc_feature 1..20: note = CRISPR gRNA sequence
  source 1..20: mol_type = other DNA
cttagggtgggctggggttt

SEQ ID NO: 96497 - DNA, 20 bp, synthetic construct
  misc_feature 1..20: note = CRISPR gRNA sequence
  source 1..20: mol_type = other DNA
ggggttttggctgtgtctgc

SEQ ID NO: 96498 - DNA, 20 bp, synthetic construct
  misc_feature 1..20: note = CRISPR gRNA sequence
  source 1..20: mol_type = other DNA
tctgctggcgccttgtcttt

SEQ ID NO: 96499 - DNA, 20 bp, synthetic construct
  misc_feature 1..20: note = CRISPR gRNA sequence
  source 1..20: mol_type = other DNA
ggcgccttgtctttgagatg

SEQ ID NO: 96500 - DNA, 20 bp, synthetic construct
  misc_feature 1..20: note = CRISPR gRNA sequence
  source 1..20: mol_type = other DNA
tgtctttgagatgcggctgc

SEQ ID NO: 96501 - DNA, 20 bp, synthetic construct
  misc_feature 1..20: note = CRISPR gRNA sequence
  source 1..20: mol_type = other DNA
tttgagatgcggctgctggc

SEQ ID NO: 96502 - DNA, 20 bp, synthetic construct
  misc_feature 1..20: note = CRISPR gRNA sequence
  source 1..20: mol_type = other DNA
ttgagatgcggctgctggct

SEQ ID NO: 96503 - DNA, 20 bp, synthetic construct
  misc_feature 1..20: note = CRISPR gRNA sequence
  source 1..20: mol_type = other DNA
atgcggctgctggctgggtg

SEQ ID NO: 96504 - DNA, 20 bp, synthetic construct
  misc_feature 1..20: note = CRISPR gRNA sequence
  source 1..20: mol_type = other DNA
cggctgctggctgggtgcag

SEQ ID NO: 96505 - DNA, 20 bp, synthetic construct
  misc_feature 1..20: note = CRISPR gRNA sequence
  source 1..20: mol_type = other DNA
gtggctcatgcctgtaatcc

SEQ ID NO: 96506 - DNA, 20 bp, synthetic construct
  misc_feature 1..20: note = CRISPR gRNA sequence
  source 1..20: mol_type = other DNA
tgcctgtaatcccagcactt

SEQ ID NO: 96507 - DNA, 20 bp, synthetic construct
  misc_feature 1..20: note = CRISPR gRNA sequence
  source 1..20: mol_type = other DNA
gcctgtaatcccagcacttt

SEQ ID NO: 96508 - DNA, 20 bp, synthetic construct
  misc_feature 1..20: note = CRISPR gRNA sequence
  source 1..20: mol_type = other DNA
ctgtaatcccagcactttgg

SEQ ID NO: 96509 - DNA, 20 bp, synthetic construct
  misc_feature 1..20: note = CRISPR gRNA sequence
  source 1..20: mol_type = other DNA
tgtaatcccagcactttggg

SEQ ID NO: 96510 - DNA, 20 bp, synthetic construct
  misc_feature 1..20: note = CRISPR gRNA sequence
  source 1..20: mol_type = other DNA
tcccagcactttgggaggcc

SEQ ID NO: 96511 - DNA, 20 bp, synthetic construct
  misc_feature 1..20: note = CRISPR gRNA sequence
  source 1..20: mol_type = other DNA
cccagcactttgggaggccg

SEQ ID NO: 96512 - DNA, 20 bp, synthetic construct
  misc_feature 1..20: note = CRISPR gRNA sequence
  source 1..20: mol_type = other DNA
agcactttgggaggccgagg

SEQ ID NO: 96513 - DNA, 20 bp, synthetic construct
  misc_feature 1..20: note = CRISPR gRNA sequence
  source 1..20: mol_type = other DNA
gcactttgggaggccgaggc

SEQ ID NO: 96514 - DNA, 20 bp, synthetic construct
  misc_feature 1..20: note = CRISPR gRNA sequence
  source 1..20: mol_type = other DNA
ctttgggaggccgaggcggg

SEQ ID NO: 96515 - DNA, 20 bp, synthetic construct
  misc_feature 1..20: note = CRISPR gRNA sequence
  source 1..20: mol_type = other DNA
ccgaggcgggtggatcactt

SEQ ID NO: 96516 - DNA, 20 bp, synthetic construct
  misc_feature 1..20: note = CRISPR gRNA sequence
  source 1..20: mol_type = other DNA
cgaggcgggtggatcacttg

SEQ ID NO: 96517 - DNA, 20 bp, synthetic construct
  misc_feature 1..20: note = CRISPR gRNA sequence
  source 1..20: mol_type = other DNA
gcgggtggatcacttgaggt

SEQ ID NO: 96518 - DNA, 20 bp, synthetic construct
  misc_feature 1..20: note = CRISPR gRNA sequence
  source 1..20: mol_type = other DNA
cgggtggatcacttgaggtc

SEQ ID NO: 96519 - DNA, 20 bp, synthetic construct
  misc_feature 1..20: note = CRISPR gRNA sequence
  source 1..20: mol_type = other DNA
ggtggatcacttgaggtcag

SEQ ID NO: 96520 - DNA, 20 bp, synthetic construct
  misc_feature 1..20: note = CRISPR gRNA sequence
  source 1..20: mol_type = other DNA
tcacttgaggtcaggagttc

SEQ ID NO: 96521 - DNA, 20 bp, synthetic construct
  misc_feature 1..20: note = CRISPR gRNA sequence
  source 1..20: mol_type = other DNA
tgaggtcaggagttcaagac

SEQ ID NO: 96522 - DNA, 20 bp, synthetic construct
  misc_feature 1..20: note = CRISPR gRNA sequence
  source 1..20: mol_type = other DNA
tcaggagttcaagaccagcc

SEQ ID NO: 96523 - DNA, 20 bp, synthetic construct
  misc_feature 1..20: note = CRISPR gRNA sequence
  source 1..20: mol_type = other DNA
caagaccagcccggccaaca

SEQ ID NO: 96524 - DNA, 20 bp, synthetic construct
  misc_feature 1..20: note = CRISPR gRNA sequence
  source 1..20: mol_type = other DNA
aagaccagcccggccaacat

SEQ ID NO: 96525 - DNA, 20 bp, synthetic construct
  misc_feature 1..20: note = CRISPR gRNA sequence
  source 1..20: mol_type = other DNA
tactaaaaaaatacaaaaat

SEQ ID NO: 96526 - DNA, 20 bp, synthetic construct
  misc_feature 1..20: note = CRISPR gRNA sequence
  source 1..20: mol_type = other DNA
aaaaaaatacaaaaattagc

SEQ ID NO: 96527 - DNA, 20 bp, synthetic construct
  misc_feature 1..20: note = CRISPR gRNA sequence
  source 1..20: mol_type = other DNA
aaaaaatacaaaaattagcc

SEQ ID NO: 96528 - DNA, 20 bp, synthetic construct
  misc_feature 1..20: note = CRISPR gRNA sequence
  source 1..20: mol_type = other DNA
caaaaattagccaggcgtcg

SEQ ID NO: 96529 - DNA, 20 bp, synthetic construct
  misc_feature 1..20: note = CRISPR gRNA sequence
  source 1..20: mol_type = other DNA
aaattagccaggcgtcgtgg

SEQ ID NO: 96530 - DNA, 20 bp, synthetic construct
  misc_feature 1..20: note = CRISPR gRNA sequence
  source 1..20: mol_type = other DNA
aattagccaggcgtcgtggt

SEQ ID NO: 96531 - DNA, 20 bp, synthetic construct
  misc_feature 1..20: note = CRISPR gRNA sequence
  source 1..20: mol_type = other DNA
gtggtgggtgcctgtaatcc

SEQ ID NO: 96532 - DNA, 20 bp, synthetic construct
  misc_feature 1..20: note = CRISPR gRNA sequence
  source 1..20: mol_type = other DNA
tggtgggtgcctgtaatccc

SEQ ID NO: 96533 - DNA, 20 bp, synthetic construct
  misc_feature 1..20: note = CRISPR gRNA sequence
  source 1..20: mol_type = other DNA
gcctgtaatcccaggtactc

SEQ ID NO: 96534 - DNA, 20 bp, synthetic construct
  misc_feature 1..20: note = CRISPR gRNA sequence
  source 1..20: mol_type = other DNA
ctgtaatcccaggtactctg

SEQ ID NO: 96535 - DNA, 20 bp, synthetic construct
  misc_feature 1..20: note = CRISPR gRNA sequence
  source 1..20: mol_type = other DNA
tgtaatcccaggtactctgg

SEQ ID NO: 96536 - DNA, 20 bp, synthetic construct
  misc_feature 1..20: note = CRISPR gRNA sequence
  source 1..20: mol_type = other DNA
tcccaggtactctggaggct

SEQ ID NO: 96537 - DNA, 20 bp, synthetic construct
  misc_feature 1..20: note = CRISPR gRNA sequence
  source 1..20: mol_type = other DNA
cccaggtactctggaggctg

SEQ ID NO: 96538 - DNA, 20 bp, synthetic construct
  misc_feature 1..20: note = CRISPR gRNA sequence
  source 1..20: mol_type = other DNA
aggtactctggaggctgagg

SEQ ID NO: 96539 - DNA, 20 bp, synthetic construct
  misc_feature 1..20: note = CRISPR gRNA sequence
  source 1..20: mol_type = other DNA
ggtactctggaggctgaggt

SEQ ID NO: 96540 - DNA, 20 bp, synthetic construct
  misc_feature 1..20: note = CRISPR gRNA sequence
  source 1..20: mol_type = other DNA
tactctggaggctgaggtgg

SEQ ID NO: 96541 - DNA, 20 bp, synthetic construct
  misc_feature 1..20: note = CRISPR gRNA sequence
  source 1..20: mol_type = other DNA
gtgggagaactgtgtgaacc

SEQ ID NO: 96542 - DNA, 20 bp, synthetic construct
  misc_feature 1..20: note = CRISPR gRNA sequence
  source 1..20: mol_type = other DNA
tgggagaactgtgtgaacct

SEQ ID NO: 96543 - DNA, 20 bp, synthetic construct
  misc_feature 1..20: note = CRISPR gRNA sequence
  source 1..20: mol_type = other DNA
ggagaactgtgtgaacctgg

SEQ ID NO: 96544 - DNA, 20 bp, synthetic construct
  misc_feature 1..20: note = CRISPR gRNA sequence
  source 1..20: mol_type = other DNA
gagaactgtgtgaacctggg

SEQ ID NO: 96545 - DNA, 20 bp, synthetic construct
  misc_feature 1..20: note = CRISPR gRNA sequence
  source 1..20: mol_type = other DNA
aactgtgtgaacctgggagg

SEQ ID NO: 96546 - DNA, 20 bp, synthetic construct
  misc_feature 1..20: note = CRISPR gRNA sequence
  source 1..20: mol_type = other DNA
ctgtgtgaacctgggaggcg

SEQ ID NO: 96547 - DNA, 20 bp, synthetic construct
  misc_feature 1..20: note = CRISPR gRNA sequence
  source 1..20: mol_type = other DNA
tgtgtgaacctgggaggcgg

SEQ ID NO: 96548 - DNA, 20 bp, synthetic construct
  misc_feature 1..20: note = CRISPR gRNA sequence
  source 1..20: mol_type = other DNA
gtgaacctgggaggcggagg

SEQ ID NO: 96549 - DNA, 20 bp, synthetic construct
  misc_feature 1..20: note = CRISPR gRNA sequence
  source 1..20: mol_type = other DNA
aacctgggaggcggaggtag

SEQ ID NO: 96550 - DNA, 20 bp, synthetic construct
  misc_feature 1..20: note = CRISPR gRNA sequence
  source 1..20: mol_type = other DNA
tgggaggcggaggtagcagt

SEQ ID NO: 96551 - DNA, 20 bp, synthetic construct
  misc_feature 1..20: note = CRISPR gRNA sequence
  source 1..20: mol_type = other DNA
ggcggaggtagcagtgagcc

SEQ ID NO: 96552 - DNA, 20 bp, synthetic construct
  misc_feature 1..20: note = CRISPR gRNA sequence
  source 1..20: mol_type = other DNA
gagattgcgccactgcactc

SEQ ID NO: 96553 - DNA, 20 bp, synthetic construct
  misc_feature 1..20: note = CRISPR gRNA sequence
  source 1..20: mol_type = other DNA
tgcgccactgcactccagcc

SEQ ID NO: 96554 - DNA, 20 bp, synthetic construct
  misc_feature 1..20: note = CRISPR gRNA sequence
  source 1..20: mol_type = other DNA
gcgccactgcactccagcct

SEQ ID NO: 96555 - DNA, 20 bp, synthetic construct
  misc_feature 1..20: note = CRISPR gRNA sequence
  source 1..20: mol_type = other DNA
ctgcactccagcctgggcaa

SEQ ID NO: 96556 - DNA, 20 bp, synthetic construct
  misc_feature 1..20: note = CRISPR gRNA sequence
  source 1..20: mol_type = other DNA
gcactccagcctgggcaaca

SEQ ID NO: 96557 - DNA, 20 bp, synthetic construct
  misc_feature 1..20: note = CRISPR gRNA sequence
  source 1..20: mol_type = other DNA
tccagcctgggcaacagagc

SEQ ID NO: 96558 - DNA, 20 bp, synthetic construct
  misc_feature 1..20: note = CRISPR gRNA sequence
  source 1..20: mol_type = other DNA
tatctccaaaaaaaaaaaaa

SEQ ID NO: 96559 - DNA, 20 bp, synthetic construct
  misc_feature 1..20: note = CRISPR gRNA sequence
  source 1..20: mol_type = other DNA
caaaaaaaaaaaaaaagatg

SEQ ID NO: 96560 - DNA, 20 bp, synthetic construct
  misc_feature 1..20: note = CRISPR gRNA sequence
  source 1..20: mol_type = other DNA
aaaaaaagatgcggctgctg

SEQ ID NO: 96561 - DNA, 20 bp, synthetic construct
  misc_feature 1..20: note = CRISPR gRNA sequence
  source 1..20: mol_type = other DNA
aaaaaagatgcggctgctgt

SEQ ID NO: 96562 - DNA, 20 bp, synthetic construct
  misc_feature 1..20: note = CRISPR gRNA sequence
  source 1..20: mol_type = other DNA
tgcggctgctgtgggtaccc

SEQ ID NO: 96563 - DNA, 20 bp, synthetic construct
  misc_feature 1..20: note = CRISPR gRNA sequence
  source 1..20: mol_type = other DNA
gcggctgctgtgggtacccc

SEQ ID NO: 96564 - DNA, 20 bp, synthetic construct
  misc_feature 1..20: note = CRISPR gRNA sequence
  source 1..20: mol_type = other DNA
tgtgggtaccccaggattcc

SEQ ID NO: 96565 - DNA, 20 bp, synthetic construct
  misc_feature 1..20: note = CRISPR gRNA sequence
  source 1..20: mol_type = other DNA
actgtcccttcttctccctg

SEQ ID NO: 96566 - DNA, 20 bp, synthetic construct
  misc_feature 1..20: note = CRISPR gRNA sequence
  source 1..20: mol_type = other DNA
ctgtcccttcttctccctgc

SEQ ID NO: 96567 - DNA, 20 bp, synthetic construct
  misc_feature 1..20: note = CRISPR gRNA sequence
  source 1..20: mol_type = other DNA
tgtcccttcttctccctgca

SEQ ID NO: 96568 - DNA, 20 bp, synthetic construct
  misc_feature 1..20: note = CRISPR gRNA sequence
  source 1..20: mol_type = other DNA
gggtgccgacccccacatcc

SEQ ID NO: 96569 - DNA, 20 bp, synthetic construct
  misc_feature 1..20: note = CRISPR gRNA sequence
  source 1..20: mol_type = other DNA
cgacccccacatcctggcaa

SEQ ID NO: 96570 - DNA, 20 bp, synthetic construct
  misc_feature 1..20: note = CRISPR gRNA sequence
  source 1..20: mol_type = other DNA
acccccacatcctggcaaaa

SEQ ID NO: 96571 - DNA, 20 bp, synthetic construct
  misc_feature 1..20: note = CRISPR gRNA sequence
  source 1..20: mol_type = other DNA
ccacatcctggcaaaagagc

SEQ ID NO: 96572 - DNA, 20 bp, synthetic construct
  misc_feature 1..20: note = CRISPR gRNA sequence
  source 1..20: mol_type = other DNA
acatcctggcaaaagagcga

SEQ ID NO: 96573 - DNA, 20 bp, synthetic construct
  misc_feature 1..20: note = CRISPR gRNA sequence
  source 1..20: mol_type = other DNA
atcctggcaaaagagcgaga

SEQ ID NO: 96574 - DNA, 20 bp, synthetic construct
  misc_feature 1..20: note = CRISPR gRNA sequence
  source 1..20: mol_type = other DNA
gcgagagagcgccctgtcgc

SEQ ID NO: 96575 - DNA, 20 bp, synthetic construct
  misc_feature 1..20: note = CRISPR gRNA sequence
  source 1..20: mol_type = other DNA
gagagcgccctgtcgctggc

SEQ ID NO: 96576 - DNA, 20 bp, synthetic construct
  misc_feature 1..20: note = CRISPR gRNA sequence
  source 1..20: mol_type = other DNA
cgccctgtcgctggccagca

SEQ ID NO: 96577 - DNA, 20 bp, synthetic construct
  misc_feature 1..20: note = CRISPR gRNA sequence
  source 1..20: mol_type = other DNA
gccctgtcgctggccagcac

SEQ ID NO: 96578 - DNA, 20 bp, synthetic construct
  misc_feature 1..20: note = CRISPR gRNA sequence
  source 1..20: mol_type = other DNA
ctgtcgctggccagcacagg

SEQ ID NO: 96579 - DNA, 20 bp, synthetic construct
  misc_feature 1..20: note = CRISPR gRNA sequence
  source 1..20: mol_type = other DNA
ggccagcacaggcggctaca

SEQ ID NO: 96580 - DNA, 20 bp, synthetic construct
  misc_feature 1..20: note = CRISPR gRNA sequence
  source 1..20: mol_type = other DNA
aggcggctacacagacattg

SEQ ID NO: 96581 - DNA, 20 bp, synthetic construct
  misc_feature 1..20: note = CRISPR gRNA sequence
  source 1..20: mol_type = other DNA
ggcggctacacagacattgt

SEQ ID NO: 96582 - DNA, 20 bp, synthetic construct
  misc_feature 1..20: note = CRISPR gRNA sequence
  source 1..20: mol_type = other DNA
gcggctacacagacattgtg

SEQ ID NO: 96583 - DNA, 20 bp, synthetic construct
  misc_feature 1..20: note = CRISPR gRNA sequence
  source 1..20: mol_type = other DNA
agacattgtggggctgctgc

SEQ ID NO: 96584 - DNA, 20 bp, synthetic construct
  misc_feature 1..20: note = CRISPR gRNA sequence
  source 1..20: mol_type = other DNA
acattgtggggctgctgctg

SEQ ID NO: 96585 - DNA, 20 bp, synthetic construct
  misc_feature 1..20: note = CRISPR gRNA sequence
  source 1..20: mol_type = other DNA
gctgctgctggagcgtgacg

SEQ ID NO: 96586 - DNA, 20 bp, synthetic construct
  misc_feature 1..20: note = CRISPR gRNA sequence
  source 1..20: mol_type = other DNA
tggacatcaacatctatgat

SEQ ID NO: 96587 - DNA, 20 bp, synthetic construct
  misc_feature 1..20: note = CRISPR gRNA sequence
  source 1..20: mol_type = other DNA
ggacatcaacatctatgatt

SEQ ID NO: 96588 - DNA, 20 bp, synthetic construct
  misc_feature 1..20: note = CRISPR gRNA sequence
  source 1..20: mol_type = other DNA
atcaacatctatgattgggt

SEQ ID NO: 96589 - DNA, 20 bp, synthetic construct
  misc_feature 1..20: note = CRISPR gRNA sequence
  source 1..20: mol_type = other DNA
tcaacatctatgattgggtg

SEQ ID NO: 96590 - DNA, 20 bp, synthetic construct
  misc_feature 1..20: note = CRISPR gRNA sequence
  source 1..20: mol_type = other DNA
caacatctatgattgggtga

SEQ ID NO: 96591 - DNA, 20 bp, synthetic construct
  misc_feature 1..20: note = CRISPR gRNA sequence
  source 1..20: mol_type = other DNA
ggtgagggactgcccatccc

SEQ ID NO: 96592 - DNA, 20 bp, synthetic construct
  misc_feature 1..20: note = CRISPR gRNA sequence
  source 1..20: mol_type = other DNA
gtgagggactgcccatcccc

SEQ ID NO: 96593 - DNA, 20 bp, synthetic construct
  misc_feature 1..20: note = CRISPR gRNA sequence
  source 1..20: mol_type = other DNA
tgcccatccccaggacctct

SEQ ID NO: 96594 - DNA, 20 bp, synthetic construct
  misc_feature 1..20: note = CRISPR gRNA sequence
  source 1..20: mol_type = other DNA
cccaggacctctcagcctcc

SEQ ID NO: 96595 - DNA, 20 bp, synthetic construct
  misc_feature 1..20: note = CRISPR gRNA sequence
  source 1..20: mol_type = other DNA
attcctgcctcaaatgttca

SEQ ID NO: 96596 - DNA, 20 bp, synthetic construct
  misc_feature 1..20: note = CRISPR gRNA sequence
  source 1..20: mol_type = other DNA
tcctgcctcaaatgttcaca

SEQ ID NO: 96597 - DNA, 20 bp, synthetic construct
  misc_feature 1..20: note = CRISPR gRNA sequence
  source 1..20: mol_type = other DNA
aatgttcacagagtacttga

SEQ ID NO: 96598 - DNA, 20 bp, synthetic construct
  misc_feature 1..20: note = CRISPR gRNA sequence
  source 1..20: mol_type = other DNA
atgttcacagagtacttgaa

SEQ ID NO: 96599 - DNA, 20 bp, synthetic construct
  misc_feature 1..20: note = CRISPR gRNA sequence
  source 1..20: mol_type = other DNA
cacagagtacttgaaaggtg

SEQ ID NO: 96600 - DNA, 20 bp, synthetic construct
  misc_feature 1..20: note = CRISPR gRNA sequence
  source 1..20: mol_type = other DNA
acagagtacttgaaaggtgc

SEQ ID NO: 96601 - DNA, 20 bp, synthetic construct
  misc_feature 1..20: note = CRISPR gRNA sequence
  source 1..20: mol_type = other DNA
tgaaaggtgcaggcctgctc

SEQ ID NO: 96602 - DNA, 20 bp, synthetic construct
  misc_feature 1..20: note = CRISPR gRNA sequence
  source 1..20: mol_type = other DNA
gaaaggtgcaggcctgctct

SEQ ID NO: 96603 - DNA, 20 bp, synthetic construct
  misc_feature 1..20: note = CRISPR gRNA sequence
  source 1..20: mol_type = other DNA
gcaggcctgctctaggtgcc

SEQ ID NO: 96604 - DNA, 20 bp, synthetic construct
  misc_feature 1..20: note = CRISPR gRNA sequence
  source 1..20: mol_type = other DNA
gctctaggtgccgagaacac

SEQ ID NO: 96605 - DNA, 20 bp, synthetic construct
  misc_feature 1..20: note = CRISPR gRNA sequence
  source 1..20: mol_type = other DNA
taggtgccgagaacacgaga

SEQ ID NO: 96606 - DNA, 20 bp, synthetic construct
  misc_feature 1..20: note = CRISPR gRNA sequence
  source 1..20: mol_type = other DNA
acacgagacagccccattcc

SEQ ID NO: 96607 - DNA, 20 bp, synthetic construct
  misc_feature 1..20: note = CRISPR gRNA sequence
  source 1..20: mol_type = other DNA
cagccccattcccagcctca

SEQ ID NO: 96608 - DNA, 20 bp, synthetic construct
  misc_feature 1..20: note = CRISPR gRNA sequence
  source 1..20: mol_type = other DNA
gccccattcccagcctcaca

SEQ ID NO: 96609 - DNA, 20 bp, synthetic construct
  misc_feature 1..20: note = CRISPR gRNA sequence
  source 1..20: mol_type = other DNA
ccattcccagcctcacagag

SEQ ID NO: 96610 - DNA, 20 bp, synthetic construct
  misc_feature 1..20: note = CRISPR gRNA sequence
  source 1..20: mol_type = other DNA
attcccagcctcacagagca

SEQ ID NO: 96611 - DNA, 20 bp, synthetic construct
  misc_feature 1..20: note = CRISPR gRNA sequence
  source 1..20: mol_type = other DNA
acagagcagagctccccatg

SEQ ID NO: 96612 - DNA, 20 bp, synthetic construct
  misc_feature 1..20: note = CRISPR gRNA sequence
  source 1..20: mol_type = other DNA
cagagcagagctccccatgc

SEQ ID NO: 96613 - DNA, 20 bp, synthetic construct
  misc_feature 1..20: note = CRISPR gRNA sequence
  source 1..20: mol_type = other DNA
agagcagagctccccatgca

SEQ ID NO: 96614 - DNA, 20 bp, synthetic construct
  misc_feature 1..20: note = CRISPR gRNA sequence
  source 1..20: mol_type = other DNA
gcagagctccccatgcaggg

SEQ ID NO: 96615 - DNA, 20 bp, synthetic construct
  misc_feature 1..20: note = CRISPR gRNA sequence
  source 1..20: mol_type = other DNA
cagagctccccatgcaggga

SEQ ID NO: 96616 - DNA, 20 bp, synthetic construct
  misc_feature 1..20: note = CRISPR gRNA sequence
  source 1..20: mol_type = other DNA
agctccccatgcagggaagg

SEQ ID NO: 96617 - DNA, 20 bp, synthetic construct
  misc_feature 1..20: note = CRISPR gRNA sequence
  source 1..20: mol_type = other DNA
ccatgcagggaaggcagaca

SEQ ID NO: 96618 - DNA, 20 bp, synthetic construct
  misc_feature 1..20: note = CRISPR gRNA sequence
  source 1..20: mol_type = other DNA
agggaaggcagacatggaaa

SEQ ID NO: 96619 - DNA, 20 bp, synthetic construct
  misc_feature 1..20: note = CRISPR gRNA sequence
  source 1..20: mol_type = other DNA
gggaaggcagacatggaaac

SEQ ID NO: 96620 - DNA, 20 bp, synthetic construct
  misc_feature 1..20: note = CRISPR gRNA sequence
  source 1..20: mol_type = other DNA
aaggcagacatggaaacagg

SEQ ID NO: 96621 - DNA, 20 bp, synthetic construct
  misc_feature 1..20: note = CRISPR gRNA sequence
  source 1..20: mol_type = other DNA
agacatggaaacaggcagct

SEQ ID NO: 96622 - DNA, 20 bp, synthetic construct
  misc_feature 1..20: note = CRISPR gRNA sequence
  source 1..20: mol_type = other DNA
ggaaacaggcagctgagatg

SEQ ID NO: 96623 - DNA, 20 bp, synthetic construct
  misc_feature 1..20: note = CRISPR gRNA sequence
  source 1..20: mol_type = other DNA
tgcagtgaactgcgctgcga

SEQ ID NO: 96624 - DNA, 20 bp, synthetic construct
  misc_feature 1..20: note = CRISPR gRNA sequence
  source 1..20: mol_type = other DNA
agtgaactgcgctgcgatgg

SEQ ID NO: 96625 - DNA, 20 bp, synthetic construct
  misc_feature 1..20: note = CRISPR gRNA sequence
  source 1..20: mol_type = other DNA
gcgctgcgatggcagatgca

SEQ ID NO: 96626 - DNA, 20 bp, synthetic construct
  misc_feature 1..20: note = CRISPR gRNA sequence
  source 1..20: mol_type = other DNA
cgctgcgatggcagatgcac

SEQ ID NO: 96627 - DNA, 20 bp, synthetic construct
  misc_feature 1..20: note = CRISPR gRNA sequence
  source 1..20: mol_type = other DNA
tgcgatggcagatgcacagg

SEQ ID NO: 96628 - DNA, 20 bp, synthetic construct
  misc_feature 1..20: note = CRISPR gRNA sequence
  source 1..20: mol_type = other DNA
gcagatgcacaggtggctac

SEQ ID NO: 96629 - DNA, 20 bp, synthetic construct
  misc_feature 1..20: note = CRISPR gRNA sequence
  source 1..20: mol_type = other DNA
agatgcacaggtggctacaa

SEQ ID NO: 96630 - DNA, 20 bp, synthetic construct
  misc_feature 1..20: note = CRISPR gRNA sequence
  source 1..20: mol_type = other DNA
gtggctacaagagccccatg

SEQ ID NO: 96631 - DNA, 20 bp, synthetic construct
  misc_feature 1..20: note = CRISPR gRNA sequence
  source 1..20: mol_type = other DNA
tggctacaagagccccatgt

SEQ ID NO: 96632 - DNA, 20 bp, synthetic construct
  misc_feature 1..20: note = CRISPR gRNA sequence
  source 1..20: mol_type = other DNA
tacaagagccccatgtgggc

SEQ ID NO: 96633 - DNA, 20 bp, synthetic construct
  misc_feature 1..20: note = CRISPR gRNA sequence
  source 1..20: mol_type = other DNA
acaagagccccatgtgggca

SEQ ID NO: 96634 - DNA, 20 bp, synthetic construct
  misc_feature 1..20: note = CRISPR gRNA sequence
  source 1..20: mol_type = other DNA
caagagccccatgtgggcaa

SEQ ID NO: 96635 - DNA, 20 bp, synthetic construct
  misc_feature 1..20: note = CRISPR gRNA sequence
  source 1..20: mol_type = other DNA
cccatgtgggcaagggaaat

SEQ ID NO: 96636 - DNA, 20 bp, synthetic construct
  misc_feature 1..20: note = CRISPR gRNA sequence
  source 1..20: mol_type = other DNA
catgtgggcaagggaaatca

SEQ ID NO: 96637 - DNA, 20 bp, synthetic construct
  misc_feature 1..20: note = CRISPR gRNA sequence
  source 1..20: mol_type = other DNA
tgtgggcaagggaaatcaga

SEQ ID NO: 96638 - DNA, 20 bp, synthetic construct
  misc_feature 1..20: note = CRISPR gRNA sequence
  source 1..20: mol_type = other DNA
gtgggcaagggaaatcagag

SEQ ID NO: 96639 - DNA, 20 bp, synthetic construct
  misc_feature 1..20: note = CRISPR gRNA sequence
  source 1..20: mol_type = other DNA
ggaaatcagagaggtcttcc

SEQ ID NO: 96640 - DNA, 20 bp, synthetic construct
  misc_feature 1..20: note = CRISPR gRNA sequence
  source 1..20: mol_type = other DNA
aaatcagagaggtcttcctg

SEQ ID NO: 96641 - DNA, 20 bp, synthetic construct
  misc_feature 1..20: note = CRISPR gRNA sequence
  source 1..20: mol_type = other DNA
aatcagagaggtcttcctgg

SEQ ID NO: 96642 - DNA, 20 bp, synthetic construct
  misc_feature 1..20: note = CRISPR gRNA sequence
  source 1..20: mol_type = other DNA
cagagaggtcttcctggagg

SEQ ID NO: 96643 - DNA, 20 bp, synthetic construct
  misc_feature 1..20: note = CRISPR gRNA sequence
  source 1..20: mol_type = other DNA
agagaggtcttcctggagga

SEQ ID NO: 96644 - DNA, 20 bp, synthetic construct
  misc_feature 1..20: note = CRISPR gRNA sequence
  source 1..20: mol_type = other DNA
cttcctggaggaaggtgtct

SEQ ID NO: 96645 - DNA, 20 bp, synthetic construct
  misc_feature 1..20: note = CRISPR gRNA sequence
  source 1..20: mol_type = other DNA
ggaggaaggtgtctaagctt

SEQ ID NO: 96646 - DNA, 20 bp, synthetic construct
  misc_feature 1..20: note = CRISPR gRNA sequence
  source 1..20: mol_type = other DNA
ggtgtctaagcttgagaccc

SEQ ID NO: 96647 - DNA, 20 bp, synthetic construct
  misc_feature 1..20: note = CRISPR gRNA sequence
  source 1..20: mol_type = other DNA
tctaagcttgagaccccaga

SEQ ID NO: 96648 - DNA, 20 bp, synthetic construct
  misc_feature 1..20: note = CRISPR gRNA sequence
  source 1..20: mol_type = other DNA
agcttgagaccccagaaagt

SEQ ID NO: 96649 - DNA, 20 bp, synthetic construct
  misc_feature 1..20: note = CRISPR gRNA sequence
  source 1..20: mol_type = other DNA
tgagaccccagaaagtgaga

SEQ ID NO: 96650 - DNA, 20 bp, synthetic construct
  misc_feature 1..20: note = CRISPR gRNA sequence
  source 1..20: mol_type = other DNA
gagaccccagaaagtgagat

SEQ ID NO: 96651 - DNA, 20 bp, synthetic construct
  misc_feature 1..20: note = CRISPR gRNA sequence
  source 1..20: mol_type = other DNA
cccagaaagtgagatgggcc

SEQ ID NO: 96652 - DNA, 20 bp, synthetic construct
  misc_feature 1..20: note = CRISPR gRNA sequence
  source 1..20: mol_type = other DNA
agtgagatgggcccagtgat

SEQ ID NO: 96653 - DNA, 20 bp, synthetic construct
  misc_feature 1..20: note = CRISPR gRNA sequence
  source 1..20: mol_type = other DNA
gagatgggcccagtgatgag

SEQ ID NO: 96654 - DNA, 20 bp, synthetic construct
  misc_feature 1..20: note = CRISPR gRNA sequence
  source 1..20: mol_type = other DNA
agatgggcccagtgatgagc

SEQ ID NO: 96655 - DNA, 20 bp, synthetic construct
  misc_feature 1..20: note = CRISPR gRNA sequence
  source 1..20: mol_type = other DNA
atgggcccagtgatgagcag

SEQ ID NO: 96656 - DNA, 20 bp, synthetic construct
  misc_feature 1..20: note = CRISPR gRNA sequence
  source 1..20: mol_type = other DNA
tgggcccagtgatgagcagg

SEQ ID NO: 96657 - DNA, 20 bp, synthetic construct
  misc_feature 1..20: note = CRISPR gRNA sequence
  source 1..20: mol_type = other DNA
caggaggaaccacgttcaac

SEQ ID NO: 96658 - DNA, 20 bp, synthetic construct
  misc_feature 1..20: note = CRISPR gRNA sequence
  source 1..20: mol_type = other DNA
ggaggaaccacgttcaactg

SEQ ID NO: 96659 - DNA, 20 bp, synthetic construct
  misc_feature 1..20: note = CRISPR gRNA sequence
  source 1..20: mol_type = other DNA
gaggaaccacgttcaactgg

SEQ ID NO: 96660 - DNA, 20 bp, synthetic construct
  misc_feature 1..20: note = CRISPR gRNA sequence
  source 1..20: mol_type = other DNA
aaccacgttcaactggaggc

SEQ ID NO: 96661 - DNA, 20 bp, synthetic construct
  misc_feature 1..20: note = CRISPR gRNA sequence
  source 1..20: mol_type = other DNA
ccacgttcaactggaggcca

SEQ ID NO: 96662 - DNA, 20 bp, synthetic construct
  misc_feature 1..20: note = CRISPR gRNA sequence
  source 1..20: mol_type = other DNA
acgttcaactggaggccaga

SEQ ID NO: 96663 - DNA, 20 bp, synthetic construct
  misc_feature 1..20: note = CRISPR gRNA sequence
  source 1..20: mol_type = other DNA
aactggaggccagagagtac

SEQ ID NO: 96664 - DNA, 20 bp, synthetic construct
  misc_feature 1..20: note = CRISPR gRNA sequence
  source 1..20: mol_type = other DNA
actggaggccagagagtaca

SEQ ID NO: 96665 - DNA, 20 bp, synthetic construct
  misc_feature 1..20: note = CRISPR gRNA sequence
  source 1..20: mol_type = other DNA
cagagagtacaaggcatttt

SEQ ID NO: 96666 - DNA, 20 bp, synthetic construct
  misc_feature 1..20: note = CRISPR gRNA sequence
  source 1..20: mol_type = other DNA
gtacaaggcattttgagaat

SEQ ID NO: 96667 - DNA, 20 bp, synthetic construct
  misc_feature 1..20: note = CRISPR gRNA sequence
  source 1..20: mol_type = other DNA
tacaaggcattttgagaatg

SEQ ID NO: 96668 - DNA, 20 bp, synthetic construct
  misc_feature 1..20: note = CRISPR gRNA sequence
  source 1..20: mol_type = other DNA
aaggcattttgagaatgagg

SEQ ID NO: 96669 - DNA, 20 bp, synthetic construct
  misc_feature 1..20: note = CRISPR gRNA sequence
  source 1..20: mol_type = other DNA
ggcattttgagaatgaggaa

SEQ ID NO: 96670 - DNA, 20 bp, synthetic construct
  misc_feature 1..20: note = CRISPR gRNA sequence
  source 1..20: mol_type = other DNA
gcattttgagaatgaggaag

SEQ ID NO: 96671 - DNA, 20 bp, synthetic construct
  misc_feature 1..20: note = CRISPR gRNA sequence
  source 1..20: mol_type = other DNA
atgaggaagaggtaaacctt

SEQ ID NO: 96672 - DNA, 20 bp, synthetic construct
  misc_feature 1..20: note = CRISPR gRNA sequence
  source 1..20: mol_type = other DNA
tctcctgcccctacccacga

SEQ ID NO: 96673 - DNA, 20 bp, synthetic construct
  misc_feature 1..20: note = CRISPR gRNA sequence
  source 1..20: mol_type = other DNA
tgcccctacccacgacagaa

SEQ ID NO: 96674 - DNA, 20 bp, synthetic construct
  misc_feature 1..20: note = CRISPR gRNA sequence
  source 1..20: mol_type = other DNA
cccctacccacgacagaatg

SEQ ID NO: 96675 - DNA, 20 bp, synthetic construct
  misc_feature 1..20: note = CRISPR gRNA sequence
  source 1..20: mol_type = other DNA
ccctacccacgacagaatgg

SEQ ID NO: 96676 - DNA, 20 bp, synthetic construct
  misc_feature 1..20: note = CRISPR gRNA sequence
  source 1..20: mol_type = other DNA
cctacccacgacagaatgga

SEQ ID NO: 96677 - DNA, 20 bp, synthetic construct
  misc_feature 1..20: note = CRISPR gRNA sequence
  source 1..20: mol_type = other DNA
ccactgctgtacgctgtgcg

SEQ ID NO: 96678 - DNA, 20 bp, synthetic construct
  misc_feature 1..20: note = CRISPR gRNA sequence
  source 1..20: mol_type = other DNA
cactgctgtacgctgtgcgc

SEQ ID NO: 96679 - DNA, 20 bp, synthetic construct
  misc_feature 1..20: note = CRISPR gRNA sequence
  source 1..20: mol_type = other DNA
ggaaccacgtgaaatgcgtt

SEQ ID NO: 96680 - DNA, 20 bp, synthetic construct
  misc_feature 1..20: note = CRISPR gRNA sequence
  source 1..20: mol_type = other DNA
gaaccacgtgaaatgcgttg

SEQ ID NO: 96681 - DNA, 20 bp, synthetic construct
  misc_feature 1..20: note = CRISPR gRNA sequence
  source 1..20: mol_type = other DNA
gaaatgcgttgaggccttgc

SEQ ID NO: 96682 - DNA, 20 bp, synthetic construct
  misc_feature 1..20: note = CRISPR gRNA sequence
  source 1..20: mol_type = other DNA
aaatgcgttgaggccttgct

SEQ ID NO: 96683 - DNA, 20 bp, synthetic construct
  misc_feature 1..20: note = CRISPR gRNA sequence
  source 1..20: mol_type = other DNA
gcgttgaggccttgctgggt

SEQ ID NO: 96684 - DNA, 20 bp, synthetic construct
  misc_feature 1..20: note = CRISPR gRNA sequence
  source 1..20: mol_type = other DNA
ttgaggccttgctgggtgag

SEQ ID NO: 96685 - DNA, 20 bp, synthetic construct
  misc_feature 1..20: note = CRISPR gRNA sequence
  source 1..20: mol_type = other DNA
tgaggccttgctgggtgagt

SEQ ID NO: 96686 - DNA, 20 bp, synthetic construct
  misc_feature 1..20: note = CRISPR gRNA sequence
  source 1..20: mol_type = other DNA
aggccttgctgggtgagtgg

SEQ ID NO: 96687 - DNA, 20 bp, synthetic construct
  misc_feature 1..20: note = CRISPR gRNA sequence
  source 1..20: mol_type = other DNA
cttgctgggtgagtgggagt

SEQ ID NO: 96688 - DNA, 20 bp, synthetic construct
  misc_feature 1..20: note = CRISPR gRNA sequence
  source 1..20: mol_type = other DNA
ttgctgggtgagtgggagtc

SEQ ID NO: 96689 - DNA, 20 bp, synthetic construct
  misc_feature 1..20: note = CRISPR gRNA sequence
  source 1..20: mol_type = other DNA
gctgggtgagtgggagtcgg

SEQ ID NO: 96690 - DNA, 20 bp, synthetic construct
  misc_feature 1..20: note = CRISPR gRNA sequence
  source 1..20: mol_type = other DNA
gggtgagtgggagtcgggag

SEQ ID NO: 96691 - DNA, 20 bp, synthetic construct
  misc_feature 1..20: note = CRISPR gRNA sequence
  source 1..20: mol_type = other DNA
gtgggagtcgggagtggccc

SEQ ID NO: 96692 - DNA, 20 bp, synthetic construct
  misc_feature 1..20: note = CRISPR gRNA sequence
  source 1..20: mol_type = other DNA
tgggagtcgggagtggccct

SEQ ID NO: 96693 - DNA, 20 bp, synthetic construct
  misc_feature 1..20: note = CRISPR gRNA sequence
  source 1..20: mol_type = other DNA
gggagtcgggagtggccctg

SEQ ID NO: 96694 - DNA, 20 bp, synthetic construct
  misc_feature 1..20: note = CRISPR gRNA sequence
  source 1..20: mol_type = other DNA
ggagtcgggagtggccctgg

SEQ ID NO: 96695 - DNA, 20 bp, synthetic construct
  misc_feature 1..20: note = CRISPR gRNA sequence
  source 1..20: mol_type = other DNA
gggagtggccctgggggccc

SEQ ID NO: 96696 - DNA, 20 bp, synthetic construct
  misc_feature 1..20: note = CRISPR gRNA sequence
  source 1..20: mol_type = other DNA
ccctgggggccccagcactc

SEQ ID NO: 96697 - DNA, 20 bp, synthetic construct
  misc_feature 1..20: note = CRISPR gRNA sequence
  source 1..20: mol_type = other DNA
tgggggccccagcactccag

SEQ ID NO: 96698 - DNA, 20 bp, synthetic construct
  misc_feature 1..20: note = CRISPR gRNA sequence
  source 1..20: mol_type = other DNA
gggggccccagcactccagc

SEQ ID NO: 96699 - DNA, 20 bp, synthetic construct
  misc_feature 1..20: note = CRISPR gRNA sequence
  source 1..20: mol_type = other DNA
cagcactccagcgggccctg

SEQ ID NO: 96700 - DNA, 20 bp, synthetic construct
  misc_feature 1..20: note = CRISPR gRNA sequence
  source 1..20: mol_type = other DNA
agcactccagcgggccctgc

SEQ ID NO: 96701 - DNA, 20 bp, synthetic construct
  misc_feature 1..20: note = CRISPR gRNA sequence
  source 1..20: mol_type = other DNA
gcgggccctgcgggaatcct

SEQ ID NO: 96702 - DNA, 20 bp, synthetic construct
  misc_feature 1..20: note = CRISPR gRNA sequence
  source 1..20: mol_type = other DNA
cgggccctgcgggaatcctg

SEQ ID NO: 96703 - DNA, 20 bp, synthetic construct
  misc_feature 1..20: note = CRISPR gRNA sequence
  source 1..20: mol_type = other DNA
gggccctgcgggaatcctga

SEQ ID NO: 96704 - DNA, 20 bp, synthetic construct
  misc_feature 1..20: note = CRISPR gRNA sequence
  source 1..20: mol_type = other DNA
ccctgcgggaatcctgaggg

SEQ ID NO: 96705 - DNA, 20 bp, synthetic construct
  misc_feature 1..20: note = CRISPR gRNA sequence
  source 1..20: mol_type = other DNA
cctgcgggaatcctgagggc

SEQ ID NO: 96706 - DNA, 20 bp, synthetic construct
  misc_feature 1..20: note = CRISPR gRNA sequence
  source 1..20: mol_type = other DNA
ctgcgggaatcctgagggca

SEQ ID NO: 96707 - DNA, 20 bp, synthetic construct
  misc_feature 1..20: note = CRISPR gRNA sequence
  source 1..20: mol_type = other DNA
gcgggaatcctgagggcagg

SEQ ID NO: 96708 - DNA, 20 bp, synthetic construct
  misc_feature 1..20: note = CRISPR gRNA sequence
  source 1..20: mol_type = other DNA
ctgagggcagggagacgccc

SEQ ID NO: 96709 - DNA, 20 bp, synthetic construct
  misc_feature 1..20: note = CRISPR gRNA sequence
  source 1..20: mol_type = other DNA
agacgcccaagtgttgcttg

SEQ ID NO: 96710 - DNA, 20 bp, synthetic construct
  misc_feature 1..20: note = CRISPR gRNA sequence
  source 1..20: mol_type = other DNA
acgcccaagtgttgcttgaa

SEQ ID NO: 96711 - DNA, 20 bp, synthetic construct
  misc_feature 1..20: note = CRISPR gRNA sequence
  source 1..20: mol_type = other DNA
agtgttgcttgaagagttct

SEQ ID NO: 96712 - DNA, 20 bp, synthetic construct
  misc_feature 1..20: note = CRISPR gRNA sequence
  source 1..20: mol_type = other DNA
tgttgcttgaagagttcttg

SEQ ID NO: 96713 - DNA, 20 bp, synthetic construct
  misc_feature 1..20: note = CRISPR gRNA sequence
  source 1..20: mol_type = other DNA
tgcttgaagagttcttggag

SEQ ID NO: 96714 - DNA, 20 bp, synthetic construct
  misc_feature 1..20: note = CRISPR gRNA sequence
  source 1..20: mol_type = other DNA
gcttgaagagttcttggagc

SEQ ID NO: 96715 - DNA, 20 bp, synthetic construct
  misc_feature 1..20: note = CRISPR gRNA sequence
  source 1..20: mol_type = other DNA
tgaagagttcttggagcagg

SEQ ID NO: 96716 - DNA, 20 bp, synthetic construct
  misc_feature 1..20: note = CRISPR gRNA sequence
  source 1..20: mol_type = other DNA
tagtccctgcctgctcttct

SEQ ID NO: 96717 - DNA, 20 bp, synthetic construct
  misc_feature 1..20: note = CRISPR gRNA sequence
  source 1..20: mol_type = other DNA
gtccctgcctgctcttctcg

SEQ ID NO: 96718 - DNA, 20 bp, synthetic construct
  misc_feature 1..20: note = CRISPR gRNA sequence
  source 1..20: mol_type = other DNA
tccctgcctgctcttctcgg

SEQ ID NO: 96719 - DNA, 20 bp, synthetic construct
  misc_feature 1..20: note = CRISPR gRNA sequence
  source 1..20: mol_type = other DNA
tgcctgctcttctcggagga

SEQ ID NO: 96720 - DNA, 20 bp, synthetic construct
  misc_feature 1..20: note = CRISPR gRNA sequence
  source 1..20: mol_type = other DNA
gctcttctcggaggatggat

SEQ ID NO: 96721 - DNA, 20 bp, synthetic construct
  misc_feature 1..20: note = CRISPR gRNA sequence
  source 1..20: mol_type = other DNA
tcttctcggaggatggatca

SEQ ID NO: 96722 - DNA, 20 bp, synthetic construct
  misc_feature 1..20: note = CRISPR gRNA sequence
  source 1..20: mol_type = other DNA
cttctcggaggatggatcag

SEQ ID NO: 96723 - DNA, 20 bp, synthetic construct
  misc_feature 1..20: note = CRISPR gRNA sequence
  source 1..20: mol_type = other DNA
ttctcggaggatggatcaga

SEQ ID NO: 96724 - DNA, 20 bp, synthetic construct
  misc_feature 1..20: note = CRISPR gRNA sequence
  source 1..20: mol_type = other DNA
tctcggaggatggatcagag

SEQ ID NO: 96725 - DNA, 20 bp, synthetic construct
  misc_feature 1..20: note = CRISPR gRNA sequence
  source 1..20: mol_type = other DNA
tcggaggatggatcagaggg

SEQ ID NO: 96726 - DNA, 20 bp, synthetic construct
  misc_feature 1..20: note = CRISPR gRNA sequence
  source 1..20: mol_type = other DNA
cggaggatggatcagagggg

SEQ ID NO: 96727 - DNA, 20 bp, synthetic construct
  misc_feature 1..20: note = CRISPR gRNA sequence
  source 1..20: mol_type = other DNA
gaggatggatcagaggggag

SEQ ID NO: 96728 - DNA, 20 bp, synthetic construct
  misc_feature 1..20: note = CRISPR gRNA sequence
  source 1..20: mol_type = other DNA
aggatggatcagaggggagg

SEQ ID NO: 96729 - DNA, 20 bp, synthetic construct
  misc_feature 1..20: note = CRISPR gRNA sequence
  source 1..20: mol_type = other DNA
atggatcagaggggaggagg

SEQ ID NO: 96730 - DNA, 20 bp, synthetic construct
  misc_feature 1..20: note = CRISPR gRNA sequence
  source 1..20: mol_type = other DNA
gatcagaggggaggaggtgg

SEQ ID NO: 96731 - DNA, 20 bp, synthetic construct
  misc_feature 1..20: note = CRISPR gRNA sequence
  source 1..20: mol_type = other DNA
atcagaggggaggaggtggt

SEQ ID NO: 96732 - DNA, 20 bp, synthetic construct
  misc_feature 1..20: note = CRISPR gRNA sequence
  source 1..20: mol_type = other DNA
gaggaggtggtaggaccaca

SEQ ID NO: 96733 - DNA, 20 bp, synthetic construct
  misc_feature 1..20: note = CRISPR gRNA sequence
  source 1..20: mol_type = other DNA
aggaggtggtaggaccacac

SEQ ID NO: 96734 - DNA, 20 bp, synthetic construct
  misc_feature 1..20: note = CRISPR gRNA sequence
  source 1..20: mol_type = other DNA
gaggtggtaggaccacacgg

SEQ ID NO: 96735 - DNA, 20 bp, synthetic construct
  misc_feature 1..20: note = CRISPR gRNA sequence
  source 1..20: mol_type = other DNA
tggtaggaccacacgggagt

SEQ ID NO: 96736 - DNA, 20 bp, synthetic construct
  misc_feature 1..20: note = CRISPR gRNA sequence
  source 1..20: mol_type = other DNA
ggtaggaccacacgggagtc

SEQ ID NO: 96737 - DNA, 20 bp, synthetic construct
  misc_feature 1..20: note = CRISPR gRNA sequence
  source 1..20: mol_type = other DNA
gtaggaccacacgggagtcg

SEQ ID NO: 96738 - DNA, 20 bp, synthetic construct
  misc_feature 1..20: note = CRISPR gRNA sequence
  source 1..20: mol_type = other DNA
accacacgggagtcggggtc

SEQ ID NO: 96739 - DNA, 20 bp, synthetic construct
  misc_feature 1..20: note = CRISPR gRNA sequence
  source 1..20: mol_type = other DNA
ccacacgggagtcggggtct

SEQ ID NO: 96740 - DNA, 20 bp, synthetic construct
  misc_feature 1..20: note = CRISPR gRNA sequence
  source 1..20: mol_type = other DNA
cgggagtcggggtctgggtt

SEQ ID NO: 96741 - DNA, 20 bp, synthetic construct
  misc_feature 1..20: note = CRISPR gRNA sequence
  source 1..20: mol_type = other DNA
gggagtcggggtctgggttt

SEQ ID NO: 96742 - DNA, 20 bp, synthetic construct
  misc_feature 1..20: note = CRISPR gRNA sequence
  source 1..20: mol_type = other DNA
cggggtctgggtttaggatc

SEQ ID NO: 96743 - DNA, 20 bp, synthetic construct
  misc_feature 1..20: note = CRISPR gRNA sequence
  source 1..20: mol_type = other DNA
tctgggtttaggatctggcc

SEQ ID NO: 96744 - DNA, 20 bp, synthetic construct
  misc_feature 1..20: note = CRISPR gRNA sequence
  source 1..20: mol_type = other DNA
tgggtttaggatctggccaa

SEQ ID NO: 96745 - DNA, 20 bp, synthetic construct
  misc_feature 1..20: note = CRISPR gRNA sequence
  source 1..20: mol_type = other DNA
gggtttaggatctggccaag

SEQ ID NO: 96746 - DNA, 20 bp, synthetic construct
  misc_feature 1..20: note = CRISPR gRNA sequence
  source 1..20: mol_type = other DNA
taggatctggccaagaggct

SEQ ID NO: 96747 - DNA, 20 bp, synthetic construct
  misc_feature 1..20: note = CRISPR gRNA sequence
  source 1..20: mol_type = other DNA
ctaagcacctccatcctcca

SEQ ID NO: 96748 - DNA, 20 bp, synthetic construct
  misc_feature 1..20: note = CRISPR gRNA sequence
  source 1..20: mol_type = other DNA
cacctccatcctccatggtt

SEQ ID NO: 96749 - DNA, 20 bp, synthetic construct
  misc_feature 1..20: note = CRISPR gRNA sequence
  source 1..20: mol_type = other DNA
cctccatcctccatggttca

SEQ ID NO: 96750 - DNA, 20 bp, synthetic construct
  misc_feature 1..20: note = CRISPR gRNA sequence
  source 1..20: mol_type = other DNA
tccatggttcagagaccctt

SEQ ID NO: 96751 - DNA, 20 bp, synthetic construct
  misc_feature 1..20: note = CRISPR gRNA sequence
  source 1..20: mol_type = other DNA
gacccttcagccacgttctt

SEQ ID NO: 96752 - DNA, 20 bp, synthetic construct
  misc_feature 1..20: note = CRISPR gRNA sequence
  source 1..20: mol_type = other DNA
ccttcagccacgttcttcag

SEQ ID NO: 96753 - DNA, 20 bp, synthetic construct
  misc_feature 1..20: note = CRISPR gRNA sequence
  source 1..20: mol_type = other DNA
ttcagccacgttcttcagtg

SEQ ID NO: 96754 - DNA, 20 bp, synthetic construct
  misc_feature 1..20: note = CRISPR gRNA sequence
  source 1..20: mol_type = other DNA
cacgttcttcagtggagacc

SEQ ID NO: 96755 - DNA, 20 bp, synthetic construct
  misc_feature 1..20: note = CRISPR gRNA sequence
  source 1..20: mol_type = other DNA
ttcttcagtggagaccaaga

SEQ ID NO: 96756 - DNA, 20 bp, synthetic construct
  misc_feature 1..20: note = CRISPR gRNA sequence
  source 1..20: mol_type = other DNA
ttcagtggagaccaagatag

SEQ ID NO: 96757 - DNA, 20 bp, synthetic construct
  misc_feature 1..20: note = CRISPR gRNA sequence
  source 1..20: mol_type = other DNA
cagtggagaccaagatagca

SEQ ID NO: 96758 - DNA, 20 bp, synthetic construct
  misc_feature 1..20: note = CRISPR gRNA sequence
  source 1..20: mol_type = other DNA
agtggagaccaagatagcag

SEQ ID NO: 96759 - DNA, 20 bp, synthetic construct
  misc_feature 1..20: note = CRISPR gRNA sequence
  source 1..20: mol_type = other DNA
gagaccaagatagcagaggt

SEQ ID NO: 96760 - DNA, 20 bp, synthetic construct
  misc_feature 1..20: note = CRISPR gRNA sequence
  source 1..20: mol_type = other DNA
cagaggttggacccttgtca

SEQ ID NO: 96761 - DNA, 20 bp, synthetic construct
  misc_feature 1..20: note = CRISPR gRNA sequence
  source 1..20: mol_type = other DNA
agaggttggacccttgtcaa

SEQ ID NO: 96762 - DNA, 20 bp, synthetic construct
  misc_feature 1..20: note = CRISPR gRNA sequence
  source 1..20: mol_type = other DNA
gacccttgtcaaaggccaca

SEQ ID NO: 96763 - DNA, 20 bp, synthetic construct
  misc_feature 1..20: note = CRISPR gRNA sequence
  source 1..20: mol_type = other DNA
acccttgtcaaaggccacat

SEQ ID NO: 96764 - DNA, 20 bp, synthetic construct
  misc_feature 1..20: note = CRISPR gRNA sequence
  source 1..20: mol_type = other DNA
gtcaaaggccacatgggcaa

SEQ ID NO: 96765 - DNA, 20 bp, synthetic construct
  misc_feature 1..20: note = CRISPR gRNA sequence
  source 1..20: mol_type = other DNA
tcaaaggccacatgggcaac

SEQ ID NO: 96766 - DNA, 20 bp, synthetic construct
  misc_feature 1..20: note = CRISPR gRNA sequence
  source 1..20: mol_type = other DNA
aaggccacatgggcaacggg

SEQ ID NO: 96767 - DNA, 20 bp, synthetic construct
  misc_feature 1..20: note = CRISPR gRNA sequence
  source 1..20: mol_type = other DNA
atgggcaacgggcagaccca

SEQ ID NO: 96768 - DNA, 20 bp, synthetic construct
  misc_feature 1..20: note = CRISPR gRNA sequence
  source 1..20: mol_type = other DNA
gcagacccacggctgcattg

SEQ ID NO: 96769 - DNA, 20 bp, synthetic construct
  misc_feature 1..20: note = CRISPR gRNA sequence
  source 1..20: mol_type = other DNA
cagacccacggctgcattgt

SEQ ID NO: 96770 - DNA, 20 bp, synthetic construct
  misc_feature 1..20: note = CRISPR gRNA sequence
  source 1..20: mol_type = other DNA
agacccacggctgcattgtg

SEQ ID NO: 96771 - DNA, 20 bp, synthetic construct
  misc_feature 1..20: note = CRISPR gRNA sequence
  source 1..20: mol_type = other DNA
acggctgcattgtggggaat

SEQ ID NO: 96772 - DNA, 20 bp, synthetic construct
  misc_feature 1..20: note = CRISPR gRNA sequence
  source 1..20: mol_type = other DNA
cggctgcattgtggggaatg

SEQ ID NO: 96773 - DNA, 20 bp, synthetic construct
  misc_feature 1..20: note = CRISPR gRNA sequence
  source 1..20: mol_type = other DNA
ggctgcattgtggggaatga

SEQ ID NO: 96774 - DNA, 20 bp, synthetic construct
  misc_feature 1..20: note = CRISPR gRNA sequence
  source 1..20: mol_type = other DNA
gctgcattgtggggaatgag

SEQ ID NO: 96775 - DNA, 20 bp, synthetic construct
  misc_feature 1..20: note = CRISPR gRNA sequence
  source 1..20: mol_type = other DNA
gtggggaatgaggggtgcca

SEQ ID NO: 96776 - DNA, 20 bp, synthetic construct
  misc_feature 1..20: note = CRISPR gRNA sequence
  source 1..20: mol_type = other DNA
tggggaatgaggggtgccat

SEQ ID NO: 96777 - DNA, 20 bp, synthetic construct
  misc_feature 1..20: note = CRISPR gRNA sequence
  source 1..20: mol_type = other DNA
aggggtgccatgggatctcc

SEQ ID NO: 96778 - DNA, 20 bp, synthetic construct
  misc_feature 1..20: note = CRISPR gRNA sequence
  source 1..20: mol_type = other DNA
ggggtgccatgggatctccc

SEQ ID NO: 96779 - DNA, 20 bp, synthetic construct
  misc_feature 1..20: note = CRISPR gRNA sequence
  source 1..20: mol_type = other DNA
catgggatctcccaggtccc

SEQ ID NO: 96780 - DNA, 20 bp, synthetic construct
  misc_feature 1..20: note = CRISPR gRNA sequence
  source 1..20: mol_type = other DNA
caggtccccagaccccattc

SEQ ID NO: 96781 - DNA, 20 bp, synthetic construct
  misc_feature 1..20: note = CRISPR gRNA sequence
  source 1..20: mol_type = other DNA
cagaccccattctggactcc

SEQ ID NO: 96782 - DNA, 20 bp, synthetic construct
  misc_feature 1..20: note = CRISPR gRNA sequence
  source 1..20: mol_type = other DNA
agaccccattctggactccc

SEQ ID NO: 96783 - DNA, 20 bp, synthetic construct
  misc_feature 1..20: note = CRISPR gRNA sequence
  source 1..20: mol_type = other DNA
gactcccaggccccaccctc

SEQ ID NO: 96784 - DNA, 20 bp, synthetic construct
  misc_feature 1..20: note = CRISPR gRNA sequence
  source 1..20: mol_type = other DNA
gcgccctcccctctcctttg

SEQ ID NO: 96785 - DNA, 20 bp, synthetic construct
  misc_feature 1..20: note = CRISPR gRNA sequence
  source 1..20: mol_type = other DNA
tcccctctcctttgcagccc

SEQ ID NO: 96786 - DNA, 20 bp, synthetic construct
  misc_feature 1..20: note = CRISPR gRNA sequence
  source 1..20: mol_type = other DNA
cccctctcctttgcagcccg

SEQ ID NO: 96787 - DNA, 20 bp, synthetic construct
  misc_feature 1..20: note = CRISPR gRNA sequence
  source 1..20: mol_type = other DNA
aggcgctgacctcaccaccg

SEQ ID NO: 96788 - DNA, 20 bp, synthetic construct
  misc_feature 1..20: note = CRISPR gRNA sequence
  source 1..20: mol_type = other DNA
ctcaccaccgaagccgactc

SEQ ID NO: 96789 - DNA, 20 bp, synthetic construct
  misc_feature 1..20: note = CRISPR gRNA sequence
  source 1..20: mol_type = other DNA
cgactctggctacaccccga

SEQ ID NO: 96790 - DNA, 20 bp, synthetic construct
  misc_feature 1..20: note = CRISPR gRNA sequence
  source 1..20: mol_type = other DNA
caccccgatggaccttgccg

SEQ ID NO: 96791 - DNA, 20 bp, synthetic construct
  misc_feature 1..20: note = CRISPR gRNA sequence
  source 1..20: mol_type = other DNA
gatggaccttgccgtggccc

SEQ ID NO: 96792 - DNA, 20 bp, synthetic construct
  misc_feature 1..20: note = CRISPR gRNA sequence
  source 1..20: mol_type = other DNA
atggaccttgccgtggccct

SEQ ID NO: 96793 - DNA, 20 bp, synthetic construct
  misc_feature 1..20: note = CRISPR gRNA sequence
  source 1..20: mol_type = other DNA
ttgccgtggccctgggatac

SEQ ID NO: 96794 - DNA, 20 bp, synthetic construct
  misc_feature 1..20: note = CRISPR gRNA sequence
  source 1..20: mol_type = other DNA
cgtggccctgggataccgga

SEQ ID NO: 96795 - DNA, 20 bp, synthetic construct
  misc_feature 1..20: note = CRISPR gRNA sequence
  source 1..20: mol_type = other DNA
gtggccctgggataccggaa

SEQ ID NO: 96796 - DNA, 20 bp, synthetic construct
  misc_feature 1..20: note = CRISPR gRNA sequence
  source 1..20: mol_type = other DNA
ccctgggataccggaaaggt

SEQ ID NO: 96797 - DNA, 20 bp, synthetic construct
  misc_feature 1..20: note = CRISPR gRNA sequence
  source 1..20: mol_type = other DNA
gataccggaaaggtcagcct

SEQ ID NO: 96798 - DNA, 20 bp, synthetic construct
  misc_feature 1..20: note = CRISPR gRNA sequence
  source 1..20: mol_type = other DNA
aaaggtcagcctgagacaca

SEQ ID NO: 96799 - DNA, 20 bp, synthetic construct
  misc_feature 1..20: note = CRISPR gRNA sequence
  source 1..20: mol_type = other DNA
aggtcagcctgagacacaca

SEQ ID NO: 96800 - DNA, 20 bp, synthetic construct
  misc_feature 1..20: note = CRISPR gRNA sequence
  source 1..20: mol_type = other DNA
tcagcctgagacacacagag

SEQ ID NO: 96801 - DNA, 20 bp, synthetic construct
  misc_feature 1..20: note = CRISPR gRNA sequence
  source 1..20: mol_type = other DNA
cagcctgagacacacagagc

SEQ ID NO: 96802 - DNA, 20 bp, synthetic construct
  misc_feature 1..20: note = CRISPR gRNA sequence
  source 1..20: mol_type = other DNA
agcctgagacacacagagca

SEQ ID NO: 96803 - DNA, 20 bp, synthetic construct
  misc_feature 1..20: note = CRISPR gRNA sequence
  source 1..20: mol_type = other DNA
gcctgagacacacagagcag

SEQ ID NO: 96804 - DNA, 20 bp, synthetic construct
  misc_feature 1..20: note = CRISPR gRNA sequence
  source 1..20: mol_type = other DNA
tgagacacacagagcagggg

SEQ ID NO: 96805 - DNA, 20 bp, synthetic construct
  misc_feature 1..20: note = CRISPR gRNA sequence
  source 1..20: mol_type = other DNA
gagacacacagagcaggggt

SEQ ID NO: 96806 - DNA, 20 bp, synthetic construct
  misc_feature 1..20: note = CRISPR gRNA sequence
  source 1..20: mol_type = other DNA
agacacacagagcaggggtg

SEQ ID NO: 96807 - DNA, 20 bp, synthetic construct
  misc_feature 1..20: note = CRISPR gRNA sequence
  source 1..20: mol_type = other DNA
caggggtggggtcccttcca

SEQ ID NO: 96808 - DNA, 20 bp, synthetic construct
  misc_feature 1..20: note = CRISPR gRNA sequence
  source 1..20: mol_type = other DNA
aggggtggggtcccttccat

SEQ ID NO: 96809 - DNA, 20 bp, synthetic construct
  misc_feature 1..20: note = CRISPR gRNA sequence
  source 1..20: mol_type = other DNA
ggtggggtcccttccatagg

SEQ ID NO: 96810 - DNA, 20 bp, synthetic construct
  misc_feature 1..20: note = CRISPR gRNA sequence
  source 1..20: mol_type = other DNA
gtggggtcccttccataggc

SEQ ID NO: 96811 - DNA, 20 bp, synthetic construct
  misc_feature 1..20: note = CRISPR gRNA sequence
  source 1..20: mol_type = other DNA
tggggtcccttccataggca

SEQ ID NO: 96812 - DNA, 20 bp, synthetic construct
  misc_feature 1..20: note = CRISPR gRNA sequence
  source 1..20: mol_type = other DNA
ccataggcagggtgaccata

SEQ ID NO: 96813 - DNA, 20 bp, synthetic construct
  misc_feature 1..20: note = CRISPR gRNA sequence
  source 1..20: mol_type = other DNA
cataggcagggtgaccataa

SEQ ID NO: 96814 - DNA, 20 bp, synthetic construct
  misc_feature 1..20: note = CRISPR gRNA sequence
  source 1..20: mol_type = other DNA
ataggcagggtgaccataaa

SEQ ID NO: 96815 - DNA, 20 bp, synthetic construct
  misc_feature 1..20: note = CRISPR gRNA sequence
  source 1..20: mol_type = other DNA
taggcagggtgaccataaag

SEQ ID NO: 96816 - DNA, 20 bp, synthetic construct
  misc_feature 1..20: note = CRISPR gRNA sequence
  source 1..20: mol_type = other DNA
ggtgaccataaaggggtaca

SEQ ID NO: 96817 - DNA, 20 bp, synthetic construct
  misc_feature 1..20: note = CRISPR gRNA sequence
  source 1..20: mol_type = other DNA
gtgaccataaaggggtacat

SEQ ID NO: 96818 - DNA, 20 bp, synthetic construct
  misc_feature 1..20: note = CRISPR gRNA sequence
  source 1..20: mol_type = other DNA
gggtacatgggacacccctt

SEQ ID NO: 96819 - DNA, 20 bp, synthetic construct
  misc_feature 1..20: note = CRISPR gRNA sequence
  source 1..20: mol_type = other DNA
tacatgggacaccccttcag

SEQ ID NO: 96820 - DNA, 20 bp, synthetic construct
  misc_feature 1..20: note = CRISPR gRNA sequence
  source 1..20: mol_type = other DNA
ccccttcagtggtcatacgc

SEQ ID NO: 96821 - DNA, 20 bp, synthetic construct
  misc_feature 1..20: note = CRISPR gRNA sequence
  source 1..20: mol_type = other DNA
cttcagtggtcatacgccgg

SEQ ID NO: 96822 - DNA, 20 bp, synthetic construct
  misc_feature 1..20: note = CRISPR gRNA sequence
  source 1..20: mol_type = other DNA
agtggtcatacgccggcagc

SEQ ID NO: 96823 - DNA, 20 bp, synthetic construct
  misc_feature 1..20: note = CRISPR gRNA sequence
  source 1..20: mol_type = other DNA
tggtcatacgccggcagcga

SEQ ID NO: 96824 - DNA, 20 bp, synthetic construct
  misc_feature 1..20: note = CRISPR gRNA sequence
  source 1..20: mol_type = other DNA
cggcagcgagagtgtgttga

SEQ ID NO: 96825 - DNA, 20 bp, synthetic construct
  misc_feature 1..20: note = CRISPR gRNA sequence
  source 1..20: mol_type = other DNA
ggcagcgagagtgtgttgac

SEQ ID NO: 96826 - DNA, 20 bp, synthetic construct
  misc_feature 1..20: note = CRISPR gRNA sequence
  source 1..20: mol_type = other DNA
agagtgtgttgacaggtgtt

SEQ ID NO: 96827 - DNA, 20 bp, synthetic construct
  misc_feature 1..20: note = CRISPR gRNA sequence
  source 1..20: mol_type = other DNA
gcactgctgtgtatcccgcc

SEQ ID NO: 96828 - DNA, 20 bp, synthetic construct
  misc_feature 1..20: note = CRISPR gRNA sequence
  source 1..20: mol_type = other DNA
cactgctgtgtatcccgcct

SEQ ID NO: 96829 - DNA, 20 bp, synthetic construct
  misc_feature 1..20: note = CRISPR gRNA sequence
  source 1..20: mol_type = other DNA
tatcccgcctgggaacatcc

SEQ ID NO: 96830 - DNA, 20 bp, synthetic construct
  misc_feature 1..20: note = CRISPR gRNA sequence
  source 1..20: mol_type = other DNA
gcctgggaacatcccagtcc

SEQ ID NO: 96831 - DNA, 20 bp, synthetic construct
  misc_feature 1..20: note = CRISPR gRNA sequence
  source 1..20: mol_type = other DNA
aacatcccagtcctggctcc

SEQ ID NO: 96832 - DNA, 20 bp, synthetic construct
  misc_feature 1..20: note = CRISPR gRNA sequence
  source 1..20: mol_type = other DNA
acatcccagtcctggctcct

SEQ ID NO: 96833 - DNA, 20 bp, synthetic construct
  misc_feature 1..20: note = CRISPR gRNA sequence
  source 1..20: mol_type = other DNA
catcccagtcctggctcctg

SEQ ID NO: 96834 - DNA, 20 bp, synthetic construct
  misc_feature 1..20: note = CRISPR gRNA sequence
  source 1..20: mol_type = other DNA
tcctggggctccacatgtgc

SEQ ID NO: 96835 - DNA, 20 bp, synthetic construct
  misc_feature 1..20: note = CRISPR gRNA sequence
  source 1..20: mol_type = other DNA
cctggggctccacatgtgct

SEQ ID NO: 96836 - DNA, 20 bp, synthetic construct
  misc_feature 1..20: note = CRISPR gRNA sequence
  source 1..20: mol_type = other DNA
ctggggctccacatgtgctg

SEQ ID NO: 96837 - DNA, 20 bp, synthetic construct
  misc_feature 1..20: note = CRISPR gRNA sequence
  source 1..20: mol_type = other DNA
gggctccacatgtgctgggg

SEQ ID NO: 96838 - DNA, 20 bp, synthetic construct
  misc_feature 1..20: note = CRISPR gRNA sequence
  source 1..20: mol_type = other DNA
ggctccacatgtgctggggt

SEQ ID NO: 96839 - DNA, 20 bp, synthetic construct
  misc_feature 1..20: note = CRISPR gRNA sequence
  source 1..20: mol_type = other DNA
gctccacatgtgctggggta

SEQ ID NO: 96840 - DNA, 20 bp, synthetic construct
  misc_feature 1..20: note = CRISPR gRNA sequence
  source 1..20: mol_type = other DNA
tccacatgtgctggggtagg

SEQ ID NO: 96841 - DNA, 20 bp, synthetic construct
  misc_feature 1..20: note = CRISPR gRNA sequence
  source 1..20: mol_type = other DNA
ccacatgtgctggggtaggg

SEQ ID NO: 96842 - DNA, 20 bp, synthetic construct
  misc_feature 1..20: note = CRISPR gRNA sequence
  source 1..20: mol_type = other DNA
tgctggggtagggaggacaa

SEQ ID NO: 96843 - DNA, 20 bp, synthetic construct
  misc_feature 1..20: note = CRISPR gRNA sequence
  source 1..20: mol_type = other DNA
gctggggtagggaggacaat

SEQ ID NO: 96844 - DNA, 20 bp, synthetic construct
  misc_feature 1..20: note = CRISPR gRNA sequence
  source 1..20: mol_type = other DNA
gtagggaggacaatgggtgt

SEQ ID NO: 96845 - DNA, 20 bp, synthetic construct
  misc_feature 1..20: note = CRISPR gRNA sequence
  source 1..20: mol_type = other DNA
gggaggacaatgggtgtcag

SEQ ID NO: 96846 - DNA, 20 bp, synthetic construct
  misc_feature 1..20: note = CRISPR gRNA sequence
  source 1..20: mol_type = other DNA
acaatgggtgtcagtggctg

SEQ ID NO: 96847 - DNA, 20 bp, synthetic construct
  misc_feature 1..20: note = CRISPR gRNA sequence
  source 1..20: mol_type = other DNA
gtcagtggctgtggccatga

SEQ ID NO: 96848 - DNA, 20 bp, synthetic construct
  misc_feature 1..20: note = CRISPR gRNA sequence
  source 1..20: mol_type = other DNA
tcagtggctgtggccatgat

SEQ ID NO: 96849 - DNA, 20 bp, synthetic construct
  misc_feature 1..20: note = CRISPR gRNA sequence
  source 1..20: mol_type = other DNA
cagtggctgtggccatgatg

SEQ ID NO: 96850 - DNA, 20 bp, synthetic construct
  misc_feature 1..20: note = CRISPR gRNA sequence
  source 1..20: mol_type = other DNA
agtggctgtggccatgatgg

SEQ ID NO: 96851 - DNA, 20 bp, synthetic construct
  misc_feature 1..20: note = CRISPR gRNA sequence
  source 1..20: mol_type = other DNA
tggccatgatgggggacaca

SEQ ID NO: 96852 - DNA, 20 bp, synthetic construct
  misc_feature 1..20: note = CRISPR gRNA sequence
  source 1..20: mol_type = other DNA
ggccatgatgggggacacat

SEQ ID NO: 96853 - DNA, 20 bp, synthetic construct
  misc_feature 1..20: note = CRISPR gRNA sequence
  source 1..20: mol_type = other DNA
gatgggggacacataggcat

SEQ ID NO: 96854 - DNA, 20 bp, synthetic construct
  misc_feature 1..20: note = CRISPR gRNA sequence
  source 1..20: mol_type = other DNA
tgggggacacataggcatga

SEQ ID NO: 96855 - DNA, 20 bp, synthetic construct
  misc_feature 1..20: note = CRISPR gRNA sequence
  source 1..20: mol_type = other DNA
gggggacacataggcatgag

SEQ ID NO: 96856 - DNA, 20 bp, synthetic construct
  misc_feature 1..20: note = CRISPR gRNA sequence
  source 1..20: mol_type = other DNA
acataggcatgagaggccga

SEQ ID NO: 96857 - DNA, 20 bp, synthetic construct
  misc_feature 1..20: note = CRISPR gRNA sequence
  source 1..20: mol_type = other DNA
ataggcatgagaggccgaaa

SEQ ID NO: 96858 - DNA, 20 bp, synthetic construct
  misc_feature 1..20: note = CRISPR gRNA sequence
  source 1..20: mol_type = other DNA
taggcatgagaggccgaaag

SEQ ID NO: 96859 - DNA, 20 bp, synthetic construct
  misc_feature 1..20: note = CRISPR gRNA sequence
  source 1..20: mol_type = other DNA
aggcatgagaggccgaaaga

SEQ ID NO: 96860 - DNA, 20 bp, synthetic construct
  misc_feature 1..20: note = CRISPR gRNA sequence
  source 1..20: mol_type = other DNA
ggcatgagaggccgaaagag

SEQ ID NO: 96861 - DNA, 20 bp, synthetic construct
  misc_feature 1..20: note = CRISPR gRNA sequence
  source 1..20: mol_type = other DNA
gaaagaggggcctctcatca

SEQ ID NO: 96862 - DNA, 20 bp, synthetic construct
  misc_feature 1..20: note = CRISPR gRNA sequence
  source 1..20: mol_type = other DNA
aagaggggcctctcatcaaa

SEQ ID NO: 96863 - DNA, 20 bp, synthetic construct
  misc_feature 1..20: note = CRISPR gRNA sequence
  source 1..20: mol_type = other DNA
cctctcatcaaagagcccca

SEQ ID NO: 96864 - DNA, 20 bp, synthetic construct
  misc_feature 1..20: note = CRISPR gRNA sequence
  source 1..20: mol_type = other DNA
ctcatcaaagagccccaaag

SEQ ID NO: 96865 - DNA, 20 bp, synthetic construct
  misc_feature 1..20: note = CRISPR gRNA sequence
  source 1..20: mol_type = other DNA
aagagccccaaagtggccaa

SEQ ID NO: 96866 - DNA, 20 bp, synthetic construct
  misc_feature 1..20: note = CRISPR gRNA sequence
  source 1..20: mol_type = other DNA
agccccaaagtggccaacag

SEQ ID NO: 96867 - DNA, 20 bp, synthetic construct
  misc_feature 1..20: note = CRISPR gRNA sequence
  source 1..20: mol_type = other DNA
ccaaagtggccaacagaagt

SEQ ID NO: 96868 - DNA, 20 bp, synthetic construct
  misc_feature 1..20: note = CRISPR gRNA sequence
  source 1..20: mol_type = other DNA
aaagtggccaacagaagtca

SEQ ID NO: 96869 - DNA, 20 bp, synthetic construct
  misc_feature 1..20: note = CRISPR gRNA sequence
  source 1..20: mol_type = other DNA
agtggccaacagaagtcaga

SEQ ID NO: 96870 - DNA, 20 bp, synthetic construct
  misc_feature 1..20: note = CRISPR gRNA sequence
  source 1..20: mol_type = other DNA
gtggccaacagaagtcagag

SEQ ID NO: 96871 - DNA, 20 bp, synthetic construct
  misc_feature 1..20: note = CRISPR gRNA sequence
  source 1..20: mol_type = other DNA
cagaagtcagagaggcttcc

SEQ ID NO: 96872 - DNA, 20 bp, synthetic construct
  misc_feature 1..20: note = CRISPR gRNA sequence
  source 1..20: mol_type = other DNA
gaagtcagagaggcttcctg

SEQ ID NO: 96873 - DNA, 20 bp, synthetic construct
  misc_feature 1..20: note = CRISPR gRNA sequence
  source 1..20: mol_type = other DNA
aagtcagagaggcttcctgg

SEQ ID NO: 96874 - DNA, 20 bp, synthetic construct
  misc_feature 1..20: note = CRISPR gRNA sequence
  source 1..20: mol_type = other DNA
tcagagaggcttcctggagg

SEQ ID NO: 96875 - DNA, 20 bp, synthetic construct
  misc_feature 1..20: note = CRISPR gRNA sequence
  source 1..20: mol_type = other DNA
cagagaggcttcctggagga

SEQ ID NO: 96876 - DNA, 20 bp, synthetic construct
  misc_feature 1..20: note = CRISPR gRNA sequence
  source 1..20: mol_type = other DNA
ttcctggaggaaggtgtctt

SEQ ID NO: 96877 - DNA, 20 bp, synthetic construct
  misc_feature 1..20: note = CRISPR gRNA sequence
  source 1..20: mol_type = other DNA
tcctggaggaaggtgtctta

SEQ ID NO: 96878 - DNA, 20 bp, synthetic construct
  misc_feature 1..20: note = CRISPR gRNA sequence
  source 1..20: mol_type = other DNA
gaggaaggtgtcttaaggtt

SEQ ID NO: 96879 - DNA, 20 bp, synthetic construct
  misc_feature 1..20: note = CRISPR gRNA sequence
  source 1..20: mol_type = other DNA
tgtcttaaggttgagacccc

SEQ ID NO: 96880 - DNA, 20 bp, synthetic construct
  misc_feature 1..20: note = CRISPR gRNA sequence
  source 1..20: mol_type = other DNA
cttaaggttgagaccccgag

SEQ ID NO: 96881 - DNA, 20 bp, synthetic construct
  misc_feature 1..20: note = CRISPR gRNA sequence
  source 1..20: mol_type = other DNA
aggttgagaccccgagaagt

SEQ ID NO: 96882 - DNA, 20 bp, synthetic construct
  misc_feature 1..20: note = CRISPR gRNA sequence
  source 1..20: mol_type = other DNA
ggttgagaccccgagaagtg

SEQ ID NO: 96883 - DNA, 20 bp, synthetic construct
  misc_feature 1..20: note = CRISPR gRNA sequence
  source 1..20: mol_type = other DNA
tgagaccccgagaagtgagg

SEQ ID NO: 96884 - DNA, 20 bp, synthetic construct
  misc_feature 1..20: note = CRISPR gRNA sequence
  source 1..20: mol_type = other DNA
gagaccccgagaagtgaggt

SEQ ID NO: 96885 - DNA, 20 bp, synthetic construct
  misc_feature 1..20: note = CRISPR gRNA sequence
  source 1..20: mol_type = other DNA
cccgagaagtgaggtgggcc

SEQ ID NO: 96886 - DNA, 20 bp, synthetic construct
  misc_feature 1..20: note = CRISPR gRNA sequence
  source 1..20: mol_type = other DNA
aagtgaggtgggcccagccc

SEQ ID NO: 96887 - DNA, 20 bp, synthetic construct
  misc_feature 1..20: note = CRISPR gRNA sequence
  source 1..20: mol_type = other DNA
agtgaggtgggcccagccct

SEQ ID NO: 96888 - DNA, 20 bp, synthetic construct
  misc_feature 1..20: note = CRISPR gRNA sequence
  source 1..20: mol_type = other DNA
aggtgggcccagccctggga

SEQ ID NO: 96889 - DNA, 20 bp, synthetic construct
  misc_feature 1..20: note = CRISPR gRNA sequence
  source 1..20: mol_type = other DNA
ggtgggcccagccctgggat

SEQ ID NO: 96890 - DNA, 20 bp, synthetic construct
  misc_feature 1..20: note = CRISPR gRNA sequence
  source 1..20: mol_type = other DNA
gtgggcccagccctgggatg

SEQ ID NO: 96891 - DNA, 20 bp, synthetic construct
  misc_feature 1..20: note = CRISPR gRNA sequence
  source 1..20: mol_type = other DNA
gggcccagccctgggatggg

SEQ ID NO: 96892 - DNA, 20 bp, synthetic construct
  misc_feature 1..20: note = CRISPR gRNA sequence
  source 1..20: mol_type = other DNA
ggcccagccctgggatgggg

SEQ ID NO: 96893 - DNA, 20 bp, synthetic construct
  misc_feature 1..20: note = CRISPR gRNA sequence
  source 1..20: mol_type = other DNA
cagccctgggatggggaggt

SEQ ID NO: 96894 - DNA, 20 bp, synthetic construct
  misc_feature 1..20: note = CRISPR gRNA sequence
  source 1..20: mol_type = other DNA
agccctgggatggggaggtc

SEQ ID NO: 96895 - DNA, 20 bp, synthetic construct
  misc_feature 1..20: note = CRISPR gRNA sequence
  source 1..20: mol_type = other DNA
gccctgggatggggaggtca

SEQ ID NO: 96896 - DNA, 20 bp, synthetic construct
  misc_feature 1..20: note = CRISPR gRNA sequence
  source 1..20: mol_type = other DNA
ctgggatggggaggtcaggg

SEQ ID NO: 96897 - DNA, 20 bp, synthetic construct
  misc_feature 1..20: note = CRISPR gRNA sequence
  source 1..20: mol_type = other DNA
tgggatggggaggtcaggga

SEQ ID NO: 96898 - DNA, 20 bp, synthetic construct
  misc_feature 1..20: note = CRISPR gRNA sequence
  source 1..20: mol_type = other DNA
gggaggtcagggaaggattc

SEQ ID NO: 96899 - DNA, 20 bp, synthetic construct
  misc_feature 1..20: note = CRISPR gRNA sequence
  source 1..20: mol_type = other DNA
ggaggtcagggaaggattct

SEQ ID NO: 96900 - DNA, 20 bp, synthetic construct
  misc_feature 1..20: note = CRISPR gRNA sequence
  source 1..20: mol_type = other DNA
gaggtcagggaaggattctg

SEQ ID NO: 96901 - DNA, 20 bp, synthetic construct
  misc_feature 1..20: note = CRISPR gRNA sequence
  source 1..20: mol_type = other DNA
aggtcagggaaggattctgg

SEQ ID NO: 96902 - DNA, 20 bp, synthetic construct
  misc_feature 1..20: note = CRISPR gRNA sequence
  source 1..20: mol_type = other DNA
gaaggattctgggggacctg

SEQ ID NO: 96903 - DNA, 20 bp, synthetic construct
  misc_feature 1..20: note = CRISPR gRNA sequence
  source 1..20: mol_type = other DNA
aaggattctgggggacctga

SEQ ID NO: 96904 - DNA, 20 bp, synthetic construct
  misc_feature 1..20: note = CRISPR gRNA sequence
  source 1..20: mol_type = other DNA
aggattctgggggacctgaa

SEQ ID NO: 96905 - DNA, 20 bp, synthetic construct
  misc_feature 1..20: note = CRISPR gRNA sequence
  source 1..20: mol_type = other DNA
gattctgggggacctgaagg

SEQ ID NO: 96906 - DNA, 20 bp, synthetic construct
  misc_feature 1..20: note = CRISPR gRNA sequence
  source 1..20: mol_type = other DNA
attctgggggacctgaaggg

SEQ ID NO: 96907 - DNA, 20 bp, synthetic construct
  misc_feature 1..20: note = CRISPR gRNA sequence
  source 1..20: mol_type = other DNA
ttctgggggacctgaaggga

SEQ ID NO: 96908 - DNA, 20 bp, synthetic construct
  misc_feature 1..20: note = CRISPR gRNA sequence
  source 1..20: mol_type = other DNA
ctgggggacctgaagggagg

SEQ ID NO: 96909 - DNA, 20 bp, synthetic construct
  misc_feature 1..20: note = CRISPR gRNA sequence
  source 1..20: mol_type = other DNA
ggacctgaagggagggagaa

SEQ ID NO: 96910 - DNA, 20 bp, synthetic construct
  misc_feature 1..20: note = CRISPR gRNA sequence
  source 1..20: mol_type = other DNA
aagggagggagaatggcatc

SEQ ID NO: 96911 - DNA, 20 bp, synthetic construct
  misc_feature 1..20: note = CRISPR gRNA sequence
  source 1..20: mol_type = other DNA
agggagggagaatggcatcc

SEQ ID NO: 96912 - DNA, 20 bp, synthetic construct
  misc_feature 1..20: note = CRISPR gRNA sequence
  source 1..20: mol_type = other DNA
gagggagaatggcatccagg

SEQ ID NO: 96913 - DNA, 20 bp, synthetic construct
  misc_feature 1..20: note = CRISPR gRNA sequence
  source 1..20: mol_type = other DNA
agggagaatggcatccaggt

SEQ ID NO: 96914 - DNA, 20 bp, synthetic construct
  misc_feature 1..20: note = CRISPR gRNA sequence
  source 1..20: mol_type = other DNA
ggagaatggcatccaggtgg

SEQ ID NO: 96915 - DNA, 20 bp, synthetic construct
  misc_feature 1..20: note = CRISPR gRNA sequence
  source 1..20: mol_type = other DNA
gagaatggcatccaggtggg

SEQ ID NO: 96916 - DNA, 20 bp, synthetic construct
  misc_feature 1..20: note = CRISPR gRNA sequence
  source 1..20: mol_type = other DNA
gaatggcatccaggtgggag

SEQ ID NO: 96917 - DNA, 20 bp, synthetic construct
  misc_feature 1..20: note = CRISPR gRNA sequence
  source 1..20: mol_type = other DNA
tggcatccaggtgggaggag

SEQ ID NO: 96918 - DNA, 20 bp, synthetic construct
  misc_feature 1..20: note = CRISPR gRNA sequence
  source 1..20: mol_type = other DNA
ggtgggaggagtggcccctg

SEQ ID NO: 96919 - DNA, 20 bp, synthetic construct
  misc_feature 1..20: note = CRISPR gRNA sequence
  source 1..20: mol_type = other DNA
tgggaggagtggcccctgcg

SEQ ID NO: 96920 - DNA, 20 bp, synthetic construct
  misc_feature 1..20: note = CRISPR gRNA sequence
  source 1..20: mol_type = other DNA
gggaggagtggcccctgcgg

SEQ ID NO: 96921 - DNA, 20 bp, synthetic construct
  misc_feature 1..20: note = CRISPR gRNA sequence
  source 1..20: mol_type = other DNA
gagtggcccctgcggaggcc

SEQ ID NO: 96922 - DNA, 20 bp, synthetic construct
  misc_feature 1..20: note = CRISPR gRNA sequence
  source 1..20: mol_type = other DNA
tggcccctgcggaggcctgg

SEQ ID NO: 96923 - DNA, 20 bp, synthetic construct
  misc_feature 1..20: note = CRISPR gRNA sequence
  source 1..20: mol_type = other DNA
ccctgcggaggcctggcagt

SEQ ID NO: 96924 - DNA, 20 bp, synthetic construct
  misc_feature 1..20: note = CRISPR gRNA sequence
  source 1..20: mol_type = other DNA
cctgcggaggcctggcagtg

SEQ ID NO: 96925 - DNA, 20 bp, synthetic construct
  misc_feature 1..20: note = CRISPR gRNA sequence
  source 1..20: mol_type = other DNA
ggcctggcagtgaggacacc

SEQ ID NO: 96926 - DNA, 20 bp, synthetic construct
  misc_feature 1..20: note = CRISPR gRNA sequence
  source 1..20: mol_type = other DNA
gcctggcagtgaggacacca

SEQ ID NO: 96927 - DNA, 20 bp, synthetic construct
  misc_feature 1..20: note = CRISPR gRNA sequence
  source 1..20: mol_type = other DNA
cctggcagtgaggacaccaa

SEQ ID NO: 96928 - DNA, 20 bp, synthetic construct
  misc_feature 1..20: note = CRISPR gRNA sequence
  source 1..20: mol_type = other DNA
ctggcagtgaggacaccaag

SEQ ID NO: 96929 - DNA, 20 bp, synthetic construct
  misc_feature 1..20: note = CRISPR gRNA sequence
  source 1..20: mol_type = other DNA
gcagtgaggacaccaagggg

SEQ ID NO: 96930 - DNA, 20 bp, synthetic construct
  misc_feature 1..20: note = CRISPR gRNA sequence
  source 1..20: mol_type = other DNA
cagtgaggacaccaaggggt

SEQ ID NO: 96931 - DNA, 20 bp, synthetic construct
  misc_feature 1..20: note = CRISPR gRNA sequence
  source 1..20: mol_type = other DNA
gacaccaaggggtaggcgac

SEQ ID NO: 96932 - DNA, 20 bp, synthetic construct
  misc_feature 1..20: note = CRISPR gRNA sequence
  source 1..20: mol_type = other DNA
acaccaaggggtaggcgacc

SEQ ID NO: 96933 - DNA, 20 bp, synthetic construct
  misc_feature 1..20: note = CRISPR gRNA sequence
  source 1..20: mol_type = other DNA
aggggtaggcgaccaggcca

SEQ ID NO: 96934 - DNA, 20 bp, synthetic construct
  misc_feature 1..20: note = CRISPR gRNA sequence
  source 1..20: mol_type = other DNA
ggcgaccaggccatagtgca

SEQ ID NO: 96935 - DNA, 20 bp, synthetic construct
  misc_feature 1..20: note = CRISPR gRNA sequence
  source 1..20: mol_type = other DNA
cgaccaggccatagtgcaca

SEQ ID NO: 96936 - DNA, 20 bp, synthetic construct
  misc_feature 1..20: note = CRISPR gRNA sequence
  source 1..20: mol_type = other DNA
ggccatagtgcacagagcca

SEQ ID NO: 96937 - DNA, 20 bp, synthetic construct
  misc_feature 1..20: note = CRISPR gRNA sequence
  source 1..20: mol_type = other DNA
ccatagtgcacagagccaca

SEQ ID NO: 96938 - DNA, 20 bp, synthetic construct
  misc_feature 1..20: note = CRISPR gRNA sequence
  source 1..20: mol_type = other DNA
catagtgcacagagccacag

SEQ ID NO: 96939 - DNA, 20 bp, synthetic construct
  misc_feature 1..20: note = CRISPR gRNA sequence
  source 1..20: mol_type = other DNA
acagaggccatccctctccg

SEQ ID NO: 96940 - DNA, 20 bp, synthetic construct
  misc_feature 1..20: note = CRISPR gRNA sequence
  source 1..20: mol_type = other DNA
gaggccatccctctccgtgg

SEQ ID NO: 96941 - DNA, 20 bp, synthetic construct
  misc_feature 1..20: note = CRISPR gRNA sequence
  source 1..20: mol_type = other DNA
aggccatccctctccgtggc

SEQ ID NO: 96942 - DNA, 20 bp, synthetic construct
  misc_feature 1..20: note = CRISPR gRNA sequence
  source 1..20: mol_type = other DNA
ccatccctctccgtggcggg

SEQ ID NO: 96943 - DNA, 20 bp, synthetic construct
  misc_feature 1..20: note = CRISPR gRNA sequence
  source 1..20: mol_type = other DNA
tccctctccgtggcgggcag

SEQ ID NO: 96944 - DNA, 20 bp, synthetic construct
  misc_feature 1..20: note = CRISPR gRNA sequence
  source 1..20: mol_type = other DNA
ccctctccgtggcgggcagt

SEQ ID NO: 96945 - DNA, 20 bp, synthetic construct
  misc_feature 1..20: note = CRISPR gRNA sequence
  source 1..20: mol_type = other DNA
tggcgggcagtgggtttgaa

SEQ ID NO: 96946 - DNA, 20 bp, synthetic construct
  misc_feature 1..20: note = CRISPR gRNA sequence
  source 1..20: mol_type = other DNA
ggcgggcagtgggtttgaac

SEQ ID NO: 96947 - DNA, 20 bp, synthetic construct
  misc_feature 1..20: note = CRISPR gRNA sequence
  source 1..20: mol_type = other DNA
gcgggcagtgggtttgaaca

SEQ ID NO: 96948 - DNA, 20 bp, synthetic construct
  misc_feature 1..20: note = CRISPR gRNA sequence
  source 1..20: mol_type = other DNA
cgggcagtgggtttgaacag

SEQ ID NO: 96949 - DNA, 20 bp, synthetic construct
  misc_feature 1..20: note = CRISPR gRNA sequence
  source 1..20: mol_type = other DNA
gtgggtttgaacaggggcca

SEQ ID NO: 96950 - DNA, 20 bp, synthetic construct
  misc_feature 1..20: note = CRISPR gRNA sequence
  source 1..20: mol_type = other DNA
tgggtttgaacaggggccat

SEQ ID NO: 96951 - DNA, 20 bp, synthetic construct
  misc_feature 1..20: note = CRISPR gRNA sequence
  source 1..20: mol_type = other DNA
gtttgaacaggggccatagg

SEQ ID NO: 96952 - DNA, 20 bp, synthetic construct
  misc_feature 1..20: note = CRISPR gRNA sequence
  source 1..20: mol_type = other DNA
caggggccataggcagaccc

SEQ ID NO: 96953 - DNA, 20 bp, synthetic construct
  misc_feature 1..20: note = CRISPR gRNA sequence
  source 1..20: mol_type = other DNA
ctccattttctctgtcacaa

SEQ ID NO: 96954 - DNA, 20 bp, synthetic construct
  misc_feature 1..20: note = CRISPR gRNA sequence
  source 1..20: mol_type = other DNA
tccattttctctgtcacaat

SEQ ID NO: 96955 - DNA, 20 bp, synthetic construct
  misc_feature 1..20: note = CRISPR gRNA sequence
  source 1..20: mol_type = other DNA
caacttccccatccataaaa

SEQ ID NO: 96956 - DNA, 20 bp, synthetic construct
  misc_feature 1..20: note = CRISPR gRNA sequence
  source 1..20: mol_type = other DNA
aacttccccatccataaaat

SEQ ID NO: 96957 - DNA, 20 bp, synthetic construct
  misc_feature 1..20: note = CRISPR gRNA sequence
  source 1..20: mol_type = other DNA
acttccccatccataaaatg

SEQ ID NO: 96958 - DNA, 20 bp, synthetic construct
  misc_feature 1..20: note = CRISPR gRNA sequence
  source 1..20: mol_type = other DNA
ttccccatccataaaatggg

SEQ ID NO: 96959 - DNA, 20 bp, synthetic construct
  misc_feature 1..20: note = CRISPR gRNA sequence
  source 1..20: mol_type = other DNA
tcccaattgaaccgaccccc

SEQ ID NO: 96960 - DNA, 20 bp, synthetic construct
  misc_feature 1..20: note = CRISPR gRNA sequence
  source 1..20: mol_type = other DNA
cccaattgaaccgaccccct

SEQ ID NO: 96961 - DNA, 20 bp, synthetic construct
  misc_feature 1..20: note = CRISPR gRNA sequence
  source 1..20: mol_type = other DNA
ccaattgaaccgaccccctg

SEQ ID NO: 96962 - DNA, 20 bp, synthetic construct
  misc_feature 1..20: note = CRISPR gRNA sequence
  source 1..20: mol_type = other DNA
gaaccgaccccctggggtca

SEQ ID NO: 96963 - DNA, 20 bp, synthetic construct
  misc_feature 1..20: note = CRISPR gRNA sequence
  source 1..20: mol_type = other DNA
ccgaccccctggggtcatgg

SEQ ID NO: 96964 - DNA, 20 bp, synthetic construct
  misc_feature 1..20: note = CRISPR gRNA sequence
  source 1..20: mol_type = other DNA
gaccccctggggtcatggta

SEQ ID NO: 96965 - DNA, 20 bp, synthetic construct
  misc_feature 1..20: note = CRISPR gRNA sequence
  source 1..20: mol_type = other DNA
ccctggggtcatggtagaga

SEQ ID NO: 96966 - DNA, 20 bp, synthetic construct
  misc_feature 1..20: note = CRISPR gRNA sequence
  source 1..20: mol_type = other DNA
cctggggtcatggtagagat

SEQ ID NO: 96967 - DNA, 20 bp, synthetic construct
  misc_feature 1..20: note = CRISPR gRNA sequence
  source 1..20: mol_type = other DNA
ctggggtcatggtagagatg

SEQ ID NO: 96968 - DNA, 20 bp, synthetic construct
  misc_feature 1..20: note = CRISPR gRNA sequence
  source 1..20: mol_type = other DNA
catggtagagatggggtgct

SEQ ID NO: 96969 - DNA, 20 bp, synthetic construct
  misc_feature 1..20: note = CRISPR gRNA sequence
  source 1..20: mol_type = other DNA
atggtagagatggggtgctt

SEQ ID NO: 96970 - DNA, 20 bp, synthetic construct
  misc_feature 1..20: note = CRISPR gRNA sequence
  source 1..20: mol_type = other DNA
aaatatccccctccttcctt

SEQ ID NO: 96971 - DNA, 20 bp, synthetic construct
  misc_feature 1..20: note = CRISPR gRNA sequence
  source 1..20: mol_type = other DNA
atatccccctccttccttca

SEQ ID NO: 96972 - DNA, 20 bp, synthetic construct
  misc_feature 1..20: note = CRISPR gRNA sequence
  source 1..20: mol_type = other DNA
cttcagagttttactgtgtt

SEQ ID NO: 96973 - DNA, 20 bp, synthetic construct
  misc_feature 1..20: note = CRISPR gRNA sequence
  source 1..20: mol_type = other DNA
ttcagagttttactgtgttt

SEQ ID NO: 96974 - DNA, 20 bp, synthetic construct
  misc_feature 1..20: note = CRISPR gRNA sequence
  source 1..20: mol_type = other DNA
gagttttactgtgtttggga

SEQ ID NO: 96975 - DNA, 20 bp, synthetic construct
  misc_feature 1..20: note = CRISPR gRNA sequence
  source 1..20: mol_type = other DNA
ctcttccctcctcatgtttt

SEQ ID NO: 96976 - DNA, 20 bp, synthetic construct
  misc_feature 1..20: note = CRISPR gRNA sequence
  source 1..20: mol_type = other DNA
tcttccctcctcatgttttc

SEQ ID NO: 96977 - DNA, 20 bp, synthetic construct
  misc_feature 1..20: note = CRISPR gRNA sequence
  source 1..20: mol_type = other DNA
cttccctcctcatgttttcg

SEQ ID NO: 96978 - DNA, 20 bp, synthetic construct
  misc_feature 1..20: note = CRISPR gRNA sequence
  source 1..20: mol_type = other DNA
ttccctcctcatgttttcgg

SEQ ID NO: 96979 - DNA, 20 bp, synthetic construct
  misc_feature 1..20: note = CRISPR gRNA sequence
  source 1..20: mol_type = other DNA
tccctcctcatgttttcggg

SEQ ID NO: 96980 - DNA, 20 bp, synthetic construct
  misc_feature 1..20: note = CRISPR gRNA sequence
  source 1..20: mol_type = other DNA
gggggtttgtttttttgttc

SEQ ID NO: 96981 - DNA, 20 bp, synthetic construct
  misc_feature 1..20: note = CRISPR gRNA sequence
  source 1..20: mol_type = other DNA
ggggtttgtttttttgttcg

SEQ ID NO: 96982 - DNA, 20 bp, synthetic construct
  misc_feature 1..20: note = CRISPR gRNA sequence
  source 1..20: mol_type = other DNA
gtttgtttttttgttcgagg

SEQ ID NO: 96983 - DNA, 20 bp, synthetic construct
  misc_feature 1..20: note = CRISPR gRNA sequence
  source 1..20: mol_type = other DNA
gtttttttgttcgaggcaga

SEQ ID NO: 96984 - DNA, 20 bp, synthetic construct
  misc_feature 1..20: note = CRISPR gRNA sequence
  source 1..20: mol_type = other DNA
gaaagtcttgctctatcacc

SEQ ID NO: 96985 - DNA, 20 bp, synthetic construct
  misc_feature 1..20: note = CRISPR gRNA sequence
  source 1..20: mol_type = other DNA
aaagtcttgctctatcaccc

SEQ ID NO: 96986 - DNA, 20 bp, synthetic construct
  misc_feature 1..20: note = CRISPR gRNA sequence
  source 1..20: mol_type = other DNA
tcttgctctatcacccaggc

SEQ ID NO: 96987 - DNA, 20 bp, synthetic construct
  misc_feature 1..20: note = CRISPR gRNA sequence
  source 1..20: mol_type = other DNA
ctatcacccaggctggaatg

SEQ ID NO: 96988 - DNA, 20 bp, synthetic construct
  misc_feature 1..20: note = CRISPR gRNA sequence
  source 1..20: mol_type = other DNA
tcacccaggctggaatgaag

SEQ ID NO: 96989 - DNA, 20 bp, synthetic construct
  misc_feature 1..20: note = CRISPR gRNA sequence
  source 1..20: mol_type = other DNA
caggctggaatgaagtggtg

SEQ ID NO: 96990 - DNA, 20 bp, synthetic construct
  misc_feature 1..20: note = CRISPR gRNA sequence
  source 1..20: mol_type = other DNA
aggctggaatgaagtggtgc

SEQ ID NO: 96991 - DNA, 20 bp, synthetic construct
  misc_feature 1..20: note = CRISPR gRNA sequence
  source 1..20: mol_type = other DNA
ggaatgaagtggtgcaggca

SEQ ID NO: 96992 - DNA, 20 bp, synthetic construct
  misc_feature 1..20: note = CRISPR gRNA sequence
  source 1..20: mol_type = other DNA
ggtgcaggcacagcttactg

SEQ ID NO: 96993 - DNA, 20 bp, synthetic construct
  misc_feature 1..20: note = CRISPR gRNA sequence
  source 1..20: mol_type = other DNA
ttactgcagcctcgatctcc

SEQ ID NO: 96994 - DNA, 20 bp, synthetic construct
  misc_feature 1..20: note = CRISPR gRNA sequence
  source 1..20: mol_type = other DNA
tactgcagcctcgatctccc

SEQ ID NO: 96995 - DNA, 20 bp, synthetic construct
  misc_feature 1..20: note = CRISPR gRNA sequence
  source 1..20: mol_type = other DNA
agcctcgatctcccaggctc

SEQ ID NO: 96996 - DNA, 20 bp, synthetic construct
  misc_feature 1..20: note = CRISPR gRNA sequence
  source 1..20: mol_type = other DNA
ctcaagtgatcctcccacca

SEQ ID NO: 96997 - DNA, 20 bp, synthetic construct
  misc_feature 1..20: note = CRISPR gRNA sequence
  source 1..20: mol_type = other DNA
tcctcccaccacagcctccc

SEQ ID NO: 96998 - DNA, 20 bp, synthetic construct
  misc_feature 1..20: note = CRISPR gRNA sequence
  source 1..20: mol_type = other DNA
tcccaccacagcctcccgag

SEQ ID NO: 96999 - DNA, 20 bp, synthetic construct
  misc_feature 1..20: note = CRISPR gRNA sequence
  source 1..20: mol_type = other DNA
accacagcctcccgagtagc

SEQ ID NO: 97000 - DNA, 20 bp, synthetic construct
  misc_feature 1..20: note = CRISPR gRNA sequence
  source 1..20: mol_type = other DNA
ccacagcctcccgagtagct

SEQ ID NO: 97001 - DNA, 20 bp, synthetic construct
  misc_feature 1..20: note = CRISPR gRNA sequence
  source 1..20: mol_type = other DNA
ctcccgagtagctgggacca

SEQ ID NO: 97002 - DNA, 20 bp, synthetic construct
  misc_feature 1..20: note = CRISPR gRNA sequence
  source 1..20: mol_type = other DNA
tcccgagtagctgggaccac

SEQ ID NO: 97003 - DNA, 20 bp, synthetic construct
  misc_feature 1..20: note = CRISPR gRNA sequence
  source 1..20: mol_type = other DNA
caggcattcgtcaccatgcc

SEQ ID NO: 97004 - DNA, 20 bp, synthetic construct
  misc_feature 1..20: note = CRISPR gRNA sequence
  source 1..20: mol_type = other DNA
gctttttttttttttttttt

SEQ ID NO: 97005 - DNA, 20 bp, synthetic construct
  misc_feature 1..20: note = CRISPR gRNA sequence
  source 1..20: mol_type = other DNA
tttttttttttttttggaca

SEQ ID NO: 97006 - DNA, 20 bp, synthetic construct
  misc_feature 1..20: note = CRISPR gRNA sequence
  source 1..20: mol_type = other DNA
tttttttttttttggacatg

SEQ ID NO: 97007 - DNA, 20 bp, synthetic construct
  misc_feature 1..20: note = CRISPR gRNA sequence
  source 1..20: mol_type = other DNA
tggagtctcgcgctgtcacc

SEQ ID NO: 97008 - DNA, 20 bp, synthetic construct
  misc_feature 1..20: note = CRISPR gRNA sequence
  source 1..20: mol_type = other DNA
ggagtctcgcgctgtcaccc

SEQ ID NO: 97009 - DNA, 20 bp, synthetic construct
  misc_feature 1..20: note = CRISPR gRNA sequence
  source 1..20: mol_type = other DNA
tctcgcgctgtcacccaggc

SEQ ID NO: 97010 - DNA, 20 bp, synthetic construct
  misc_feature 1..20: note = CRISPR gRNA sequence
  source 1..20: mol_type = other DNA
tcgcgctgtcacccaggctg

SEQ ID NO: 97011 - DNA, 20 bp, synthetic construct
  misc_feature 1..20: note = CRISPR gRNA sequence
  source 1..20: mol_type = other DNA
tcacccaggctggagtgcaa

SEQ ID NO: 97012 - DNA, 20 bp, synthetic construct
  misc_feature 1..20: note = CRISPR gRNA sequence
  source 1..20: mol_type = other DNA
ggagtgcaatggcgccatct

SEQ ID NO: 97013 - DNA, 20 bp, synthetic construct
  misc_feature 1..20: note = CRISPR gRNA sequence
  source 1..20: mol_type = other DNA
tcactgcaacttccacctcc

SEQ ID NO: 97014 - DNA, 20 bp, synthetic construct
  misc_feature 1..20: note = CRISPR gRNA sequence
  source 1..20: mol_type = other DNA
cactgcaacttccacctccc

SEQ ID NO: 97015 - DNA, 20 bp, synthetic construct
  misc_feature 1..20: note = CRISPR gRNA sequence
  source 1..20: mol_type = other DNA
aacttccacctcccaggttc

SEQ ID NO: 97016 - DNA, 20 bp, synthetic construct
  misc_feature 1..20: note = CRISPR gRNA sequence
  source 1..20: mol_type = other DNA
ttcaagcgattctcctgcct

SEQ ID NO: 97017 - DNA, 20 bp, synthetic construct
  misc_feature 1..20: note = CRISPR gRNA sequence
  source 1..20: mol_type = other DNA
ttctcctgcctcagcctcct

SEQ ID NO: 97018 - DNA, 20 bp, synthetic construct
  misc_feature 1..20: note = CRISPR gRNA sequence
  source 1..20: mol_type = other DNA
tcctgcctcagcctcctgag

SEQ ID NO: 97019 - DNA, 20 bp, synthetic construct
  misc_feature 1..20: note = CRISPR gRNA sequence
  source 1..20: mol_type = other DNA
gcctcagcctcctgagtagc

SEQ ID NO: 97020 - DNA, 20 bp, synthetic construct
  misc_feature 1..20: note = CRISPR gRNA sequence
  source 1..20: mol_type = other DNA
cctcagcctcctgagtagct

SEQ ID NO: 97021 - DNA, 20 bp, synthetic construct
  misc_feature 1..20: note = CRISPR gRNA sequence
  source 1..20: mol_type = other DNA
ctcctgagtagctgggacca

SEQ ID NO: 97022 - DNA, 20 bp, synthetic construct
  misc_feature 1..20: note = CRISPR gRNA sequence
  source 1..20: mol_type = other DNA
tcctgagtagctgggaccac

SEQ ID NO: 97023 - DNA, 20 bp, synthetic construct
  misc_feature 1..20: note = CRISPR gRNA sequence
  source 1..20: mol_type = other DNA
caggtgcacaccatgacgcc

SEQ ID NO: 97024 - DNA, 20 bp, synthetic construct
  misc_feature 1..20: note = CRISPR gRNA sequence
  source 1..20: mol_type = other DNA
ccggctaatttttatatttt

SEQ ID NO: 97025 - DNA, 20 bp, synthetic construct
  misc_feature 1..20: note = CRISPR gRNA sequence
  source 1..20: mol_type = other DNA
gctaatttttatatttttag

SEQ ID NO: 97026 - DNA, 20 bp, synthetic construct
  misc_feature 1..20: note = CRISPR gRNA sequence
  source 1..20: mol_type = other DNA
taatttttatatttttagta

SEQ ID NO: 97027 - DNA, 20 bp, synthetic construct
  misc_feature 1..20: note = CRISPR gRNA sequence
  source 1..20: mol_type = other DNA
ttttatatttttagtagaga

SEQ ID NO: 97028 - DNA, 20 bp, synthetic construct
  misc_feature 1..20: note = CRISPR gRNA sequence
  source 1..20: mol_type = other DNA
tttatatttttagtagagac

SEQ ID NO: 97029 - DNA, 20 bp, synthetic construct
  misc_feature 1..20: note = CRISPR gRNA sequence
  source 1..20: mol_type = other DNA
ttatatttttagtagagacg

SEQ ID NO: 97030 - DNA, 20 bp, synthetic construct
  misc_feature 1..20: note = CRISPR gRNA sequence
  source 1..20: mol_type = other DNA
gagacggggtttcaccatgt

SEQ ID NO: 97031 - DNA, 20 bp, synthetic construct
  misc_feature 1..20: note = CRISPR gRNA sequence
  source 1..20: mol_type = other DNA
cggggtttcaccatgttggt

SEQ ID NO: 97032 - DNA, 20 bp, synthetic construct
  misc_feature 1..20: note = CRISPR gRNA sequence
  source 1..20: mol_type = other DNA
ggggtttcaccatgttggtc

SEQ ID NO: 97033 - DNA, 20 bp, synthetic construct
  misc_feature 1..20: note = CRISPR gRNA sequence
  source 1..20: mol_type = other DNA
tttcaccatgttggtcaggc

SEQ ID NO: 97034 - DNA, 20 bp, synthetic construct
  misc_feature 1..20: note = CRISPR gRNA sequence
  source 1..20: mol_type = other DNA
accttgtgatccgcctgtgt

SEQ ID NO: 97035 - DNA, 20 bp, synthetic construct
  misc_feature 1..20: note = CRISPR gRNA sequence
  source 1..20: mol_type = other DNA
ccgcctgtgttggcctccca

SEQ ID NO: 97036 - DNA, 20 bp, synthetic construct
  misc_feature 1..20: note = CRISPR gRNA sequence
  source 1..20: mol_type = other DNA
gtgttggcctcccaaagtgc

SEQ ID NO: 97037 - DNA, 20 bp, synthetic construct
  misc_feature 1..20: note = CRISPR gRNA sequence
  source 1..20: mol_type = other DNA
tgttggcctcccaaagtgct

SEQ ID NO: 97038 - DNA, 20 bp, synthetic construct
  misc_feature 1..20: note = CRISPR gRNA sequence
  source 1..20: mol_type = other DNA
ctcccaaagtgctgggatta

SEQ ID NO: 97039 - DNA, 20 bp, synthetic construct
  misc_feature 1..20: note = CRISPR gRNA sequence
  source 1..20: mol_type = other DNA
tcccaaagtgctgggattac

SEQ ID NO: 97040 - DNA, 20 bp, synthetic construct
  misc_feature 1..20: note = CRISPR gRNA sequence
  source 1..20: mol_type = other DNA
agtgctgggattacaggtgt

SEQ ID NO: 97041 - DNA, 20 bp, synthetic construct
  misc_feature 1..20: note = CRISPR gRNA sequence
  source 1..20: mol_type = other DNA
caggtgtgagccaccacgcc

SEQ ID NO: 97042 - DNA, 20 bp, synthetic construct
  misc_feature 1..20: note = CRISPR gRNA sequence
  source 1..20: mol_type = other DNA
tggctgtgttgttgtttttt

SEQ ID NO: 97043 - DNA, 20 bp, synthetic construct
  misc_feature 1..20: note = CRISPR gRNA sequence
  source 1..20: mol_type = other DNA
ctgtgttgttgtttttttag

SEQ ID NO: 97044 - DNA, 20 bp, synthetic construct
  misc_feature 1..20: note = CRISPR gRNA sequence
  source 1..20: mol_type = other DNA
gtgttgttgtttttttagaa

SEQ ID NO: 97045 - DNA, 20 bp, synthetic construct
  misc_feature 1..20: note = CRISPR gRNA sequence
  source 1..20: mol_type = other DNA
tgttgtttttttagaagaga

SEQ ID NO: 97046 - DNA, 20 bp, synthetic construct
  misc_feature 1..20: note = CRISPR gRNA sequence
  source 1..20: mol_type = other DNA
gttgtttttttagaagagac

SEQ ID NO: 97047 - DNA, 20 bp, synthetic construct
  misc_feature 1..20: note = CRISPR gRNA sequence
  source 1..20: mol_type = other DNA
ttgtttttttagaagagaca

SEQ ID NO: 97048 - DNA, 20 bp, synthetic construct
  misc_feature 1..20: note = CRISPR gRNA sequence
  source 1..20: mol_type = other DNA
cagggtctcgctatgttgcc

SEQ ID NO: 97049 - DNA, 20 bp, synthetic construct
  misc_feature 1..20: note = CRISPR gRNA sequence
  source 1..20: mol_type = other DNA
agggtctcgctatgttgccc

SEQ ID NO: 97050 - DNA, 20 bp, synthetic construct
  misc_feature 1..20: note = CRISPR gRNA sequence
  source 1..20: mol_type = other DNA
tctcgctatgttgcccaggc

SEQ ID NO: 97051 - DNA, 20 bp, synthetic construct
  misc_feature 1..20: note = CRISPR gRNA sequence
  source 1..20: mol_type = other DNA
ccaggctggtctcaaactcc

SEQ ID NO: 97052 - DNA, 20 bp, synthetic construct
  misc_feature 1..20: note = CRISPR gRNA sequence
  source 1..20: mol_type = other DNA
caggctggtctcaaactcct

SEQ ID NO: 97053 - DNA, 20 bp, synthetic construct
  misc_feature 1..20: note = CRISPR gRNA sequence
  source 1..20: mol_type = other DNA
ggtctcaaactcctgggctc

SEQ ID NO: 97054 - DNA, 20 bp, synthetic construct
  misc_feature 1..20: note = CRISPR gRNA sequence
  source 1..20: mol_type = other DNA
ctcaagtgatccttcttccc

SEQ ID NO: 97055 - DNA, 20 bp, synthetic construct
  misc_feature 1..20: note = CRISPR gRNA sequence
  source 1..20: mol_type = other DNA
tccttcttccccagcctcct

SEQ ID NO: 97056 - DNA, 20 bp, synthetic construct
  misc_feature 1..20: note = CRISPR gRNA sequence
  source 1..20: mol_type = other DNA
ttcttccccagcctcctgag

SEQ ID NO: 97057 - DNA, 20 bp, synthetic construct
  misc_feature 1..20: note = CRISPR gRNA sequence
  source 1..20: mol_type = other DNA
tccccagcctcctgagtagc

SEQ ID NO: 97058 - DNA, 20 bp, synthetic construct
  misc_feature 1..20: note = CRISPR gRNA sequence
  source 1..20: mol_type = other DNA
ccccagcctcctgagtagct

SEQ ID NO: 97059 - DNA, 20 bp, synthetic construct
  misc_feature 1..20: note = CRISPR gRNA sequence
  source 1..20: mol_type = other DNA
ctcctgagtagctgggacta

SEQ ID NO: 97060 - DNA, 20 bp, synthetic construct
  misc_feature 1..20: note = CRISPR gRNA sequence
  source 1..20: mol_type = other DNA
tcctgagtagctgggactac

SEQ ID NO: 97061 - DNA, 20 bp, synthetic construct
  misc_feature 1..20: note = CRISPR gRNA sequence
  source 1..20: mol_type = other DNA
caggcatgtaccactctacc

SEQ ID NO: 97062 - DNA, 20 bp, synthetic construct
  misc_feature 1..20: note = CRISPR gRNA sequence
  source 1..20: mol_type = other DNA
atcttttttatttatttttt

SEQ ID NO: 97063 - DNA, 20 bp, synthetic construct
  misc_feature 1..20: note = CRISPR gRNA sequence
  source 1..20: mol_type = other DNA
tttttatttattttttgaga

SEQ ID NO: 97064 - DNA, 20 bp, synthetic construct
  misc_feature 1..20: note = CRISPR gRNA sequence
  source 1..20: mol_type = other DNA
tttatttattttttgagaca

SEQ ID NO: 97065 - DNA, 20 bp, synthetic construct
  misc_feature 1..20: note = CRISPR gRNA sequence
  source 1..20: mol_type = other DNA
cagagtctcgctctgtcacc

SEQ ID NO: 97066 - DNA, 20 bp, synthetic construct
  misc_feature 1..20: note = CRISPR gRNA sequence
  source 1..20: mol_type = other DNA
agagtctcgctctgtcaccc

SEQ ID NO: 97067 - DNA, 20 bp, synthetic construct
  misc_feature 1..20: note = CRISPR gRNA sequence
  source 1..20: mol_type = other DNA
tctcgctctgtcacccaggc

SEQ ID NO: 97068 - DNA, 20 bp, synthetic construct
  misc_feature 1..20: note = CRISPR gRNA sequence
  source 1..20: mol_type = other DNA
tcgctctgtcacccaggctg

SEQ ID NO: 97069 - DNA, 20 bp, synthetic construct
  misc_feature 1..20: note = CRISPR gRNA sequence
  source 1..20: mol_type = other DNA
ctgtcacccaggctggagtg

SEQ ID NO: 97070 - DNA, 20 bp, synthetic construct
  misc_feature 1..20: note = CRISPR gRNA sequence
  source 1..20: mol_type = other DNA
tcacccaggctggagtgcag

SEQ ID NO: 97071 - DNA, 20 bp, synthetic construct
  misc_feature 1..20: note = CRISPR gRNA sequence
  source 1..20: mol_type = other DNA
ggagtgcagtggcacaatct

SEQ ID NO: 97072 - DNA, 20 bp, synthetic construct
  misc_feature 1..20: note = CRISPR gRNA sequence
  source 1..20: mol_type = other DNA
tcactgcaacctctgcctcc

SEQ ID NO: 97073 - DNA, 20 bp, synthetic construct
  misc_feature 1..20: note = CRISPR gRNA sequence
  source 1..20: mol_type = other DNA
cactgcaacctctgcctccc

SEQ ID NO: 97074 - DNA, 20 bp, synthetic construct
  misc_feature 1..20: note = CRISPR gRNA sequence
  source 1..20: mol_type = other DNA
ggcaaacaattctcctgcct

SEQ ID NO: 97075 - DNA, 20 bp, synthetic construct
  misc_feature 1..20: note = CRISPR gRNA sequence
  source 1..20: mol_type = other DNA
tcctgcctcagcctcctgaa

SEQ ID NO: 97076 - DNA, 20 bp, synthetic construct
  misc_feature 1..20: note = CRISPR gRNA sequence
  source 1..20: mol_type = other DNA
gcctcagcctcctgaatagc

SEQ ID NO: 97077 - DNA, 20 bp, synthetic construct
  misc_feature 1..20: note = CRISPR gRNA sequence
  source 1..20: mol_type = other DNA
cctcagcctcctgaatagct

SEQ ID NO: 97078 - DNA, 20 bp, synthetic construct
  misc_feature 1..20: note = CRISPR gRNA sequence
  source 1..20: mol_type = other DNA
tcctgaatagctgggattac

SEQ ID NO: 97079 - DNA, 20 bp, synthetic construct
  misc_feature 1..20: note = CRISPR gRNA sequence
  source 1..20: mol_type = other DNA
caagtgcctgccaccacacc

SEQ ID NO: 97080 - DNA, 20 bp, synthetic construct
  misc_feature 1..20: note = CRISPR gRNA sequence
  source 1..20: mol_type = other DNA
tttttttttttttttttttt

SEQ ID NO: 97081 - DNA, 20 bp, synthetic construct
  misc_feature 1..20: note = CRISPR gRNA sequence
  source 1..20: mol_type = other DNA
ttttttttttttttttgaga

SEQ ID NO: 97082 - DNA, 20 bp, synthetic construct
  misc_feature 1..20: note = CRISPR gRNA sequence
  source 1..20: mol_type = other DNA
ttttttttttttttgagatg

SEQ ID NO: 97083 - DNA, 20 bp, synthetic construct
  misc_feature 1..20: note = CRISPR gRNA sequence
  source 1..20: mol_type = other DNA
ggagtttcgctcttgttgcc

SEQ ID NO: 97084 - DNA, 20 bp, synthetic construct
  misc_feature 1..20: note = CRISPR gRNA sequence
  source 1..20: mol_type = other DNA
gagtttcgctcttgttgccc

SEQ ID NO: 97085 - DNA, 20 bp, synthetic construct
  misc_feature 1..20: note = CRISPR gRNA sequence
  source 1..20: mol_type = other DNA
ttcgctcttgttgcccaggc

SEQ ID NO: 97086 - DNA, 20 bp, synthetic construct
  misc_feature 1..20: note = CRISPR gRNA sequence
  source 1..20: mol_type = other DNA
cgctcttgttgcccaggctg

SEQ ID NO: 97087 - DNA, 20 bp, synthetic construct
  misc_feature 1..20: note = CRISPR gRNA sequence
  source 1..20: mol_type = other DNA
ttgcccaggctggagtgcta

SEQ ID NO: 97088 - DNA, 20 bp, synthetic construct
  misc_feature 1..20: note = CRISPR gRNA sequence
  source 1..20: mol_type = other DNA
ggagtgctatggcgtgatct

SEQ ID NO: 97089 - DNA, 20 bp, synthetic construct
  misc_feature 1..20: note = CRISPR gRNA sequence
  source 1..20: mol_type = other DNA
tcactgcaacttccgcctcc

SEQ ID NO: 97090 - DNA, 20 bp, synthetic construct
  misc_feature 1..20: note = CRISPR gRNA sequence
  source 1..20: mol_type = other DNA
cactgcaacttccgcctccc

SEQ ID NO: 97091 - DNA, 20 bp, synthetic construct
  misc_feature 1..20: note = CRISPR gRNA sequence
  source 1..20: mol_type = other DNA
aacttccgcctcccaggttc

SEQ ID NO: 97092 - DNA, 20 bp, synthetic construct
  misc_feature 1..20: note = CRISPR gRNA sequence
  source 1..20: mol_type = other DNA
ttcaagcaattctcctgcct

SEQ ID NO: 97093 - DNA, 20 bp, synthetic construct
  misc_feature 1..20: note = CRISPR gRNA sequence
  source 1..20: mol_type = other DNA
ttctcctgcctcagcctccc

SEQ ID NO: 97094 - DNA, 20 bp, synthetic construct
  misc_feature 1..20: note = CRISPR gRNA sequence
  source 1..20: mol_type = other DNA
tcctgcctcagcctcccaag

SEQ ID NO: 97095 - DNA, 20 bp, synthetic construct
  misc_feature 1..20: note = CRISPR gRNA sequence
  source 1..20: mol_type = other DNA
gcctcagcctcccaagtagc

SEQ ID NO: 97096 - DNA, 20 bp, synthetic construct
  misc_feature 1..20: note = CRISPR gRNA sequence
  source 1..20: mol_type = other DNA
cctcagcctcccaagtagct

SEQ ID NO: 97097 - DNA, 20 bp, synthetic construct
  misc_feature 1..20: note = CRISPR gRNA sequence
  source 1..20: mol_type = other DNA
ctcccaagtagctgggatta

SEQ ID NO: 97098 - DNA, 20 bp, synthetic construct
  misc_feature 1..20: note = CRISPR gRNA sequence
  source 1..20: mol_type = other DNA
tcccaagtagctgggattac

SEQ ID NO: 97099 - DNA, 20 bp, synthetic construct
  misc_feature 1..20: note = CRISPR gRNA sequence
  source 1..20: mol_type = other DNA
caactaattttttgcatttt

SEQ ID NO: 97100 - DNA, 20 bp, synthetic construct
  misc_feature 1..20: note = CRISPR gRNA sequence
  source 1..20: mol_type = other DNA
ctaattttttgcatttttag

SEQ ID NO: 97101 - DNA, 20 bp, synthetic construct
  misc_feature 1..20: note = CRISPR gRNA sequence
  source 1..20: mol_type = other DNA
aattttttgcatttttagta

SEQ ID NO: 97102 - DNA, 20 bp, synthetic construct
  misc_feature 1..20: note = CRISPR gRNA sequence
  source 1..20: mol_type = other DNA
ttttgcatttttagtagagt

SEQ ID NO: 97103 - DNA, 20 bp, synthetic construct
  misc_feature 1..20: note = CRISPR gRNA sequence
  source 1..20: mol_type = other DNA
tttgcatttttagtagagtc

SEQ ID NO: 97104 - DNA, 20 bp, synthetic construct
  misc_feature 1..20: note = CRISPR gRNA sequence
  source 1..20: mol_type = other DNA
ttgcatttttagtagagtca

SEQ ID NO: 97105 - DNA, 20 bp, synthetic construct
  misc_feature 1..20: note = CRISPR gRNA sequence
  source 1..20: mol_type = other DNA
gagtcagggtttctccatgt

SEQ ID NO: 97106 - DNA, 20 bp, synthetic construct
  misc_feature 1..20: note = CRISPR gRNA sequence
  source 1..20: mol_type = other DNA
cagggtttctccatgttggt

SEQ ID NO: 97107 - DNA, 20 bp, synthetic construct
  misc_feature 1..20: note = CRISPR gRNA sequence
  source 1..20: mol_type = other DNA
agggtttctccatgttggtc

SEQ ID NO: 97108 - DNA, 20 bp, synthetic construct
  misc_feature 1..20: note = CRISPR gRNA sequence
  source 1..20: mol_type = other DNA
tgatctcaaactcccgacct

SEQ ID NO: 97109 - DNA, 20 bp, synthetic construct
  misc_feature 1..20: note = CRISPR gRNA sequence
  source 1..20: mol_type = other DNA
gatctcaaactcccgacctc

SEQ ID NO: 97110 - DNA, 20 bp, synthetic construct
  misc_feature 1..20: note = CRISPR gRNA sequence
  source 1..20: mol_type = other DNA
ctcaggtgatccacccgcct

SEQ ID NO: 97111 - DNA, 20 bp, synthetic construct
  misc_feature 1..20: note = CRISPR gRNA sequence
  source 1..20: mol_type = other DNA
ccacccgcctcagcttccca

SEQ ID NO: 97112 - DNA, 20 bp, synthetic construct
  misc_feature 1..20: note = CRISPR gRNA sequence
  source 1..20: mol_type = other DNA
gcctcagcttcccaaagtgc

SEQ ID NO: 97113 - DNA, 20 bp, synthetic construct
  misc_feature 1..20: note = CRISPR gRNA sequence
  source 1..20: mol_type = other DNA
cctcagcttcccaaagtgct

SEQ ID NO: 97114 - DNA, 20 bp, synthetic construct
  misc_feature 1..20: note = CRISPR gRNA sequence
  source 1..20: mol_type = other DNA
ttcccaaagtgctgggatta

SEQ ID NO: 97115 - DNA, 20 bp, synthetic construct
  misc_feature 1..20: note = CRISPR gRNA sequence
  source 1..20: mol_type = other DNA
tcccaaagtgctgggattac

SEQ ID NO: 97116 - DNA, 20 bp, synthetic construct
  misc_feature 1..20: note = CRISPR gRNA sequence
  source 1..20: mol_type = other DNA
agtgctgggattacaggcat

SEQ ID NO: 97117 - DNA, 20 bp, synthetic construct
  misc_feature 1..20: note = CRISPR gRNA sequence
  source 1..20: mol_type = other DNA
caggcatgagccaccacacc

SEQ ID NO: 97118 - DNA, 20 bp, synthetic construct
  misc_feature 1..20: note = CRISPR gRNA sequence
  source 1..20: mol_type = other DNA
ccaccacacccggctgcacc

SEQ ID NO: 97119 - DNA, 20 bp, synthetic construct
  misc_feature 1..20: note = CRISPR gRNA sequence
  source 1..20: mol_type = other DNA
ctgcacctggctaatttttg

SEQ ID NO: 97120 - DNA, 20 bp, synthetic construct
  misc_feature 1..20: note = CRISPR gRNA sequence
  source 1..20: mol_type = other DNA
ctggctaatttttgtagttt

SEQ ID NO: 97121 - DNA, 20 bp, synthetic construct
  misc_feature 1..20: note = CRISPR gRNA sequence
  source 1..20: mol_type = other DNA
gctaatttttgtagttttag

SEQ ID NO: 97122 - DNA, 20 bp, synthetic construct
  misc_feature 1..20: note = CRISPR gRNA sequence
  source 1..20: mol_type = other DNA
taatttttgtagttttagta

SEQ ID NO: 97123 - DNA, 20 bp, synthetic construct
  misc_feature 1..20: note = CRISPR gRNA sequence
  source 1..20: mol_type = other DNA
ttttgtagttttagtagaga

SEQ ID NO: 97124 - DNA, 20 bp, synthetic construct
  misc_feature 1..20: note = CRISPR gRNA sequence
  source 1..20: mol_type = other DNA
tttgtagttttagtagagat

SEQ ID NO: 97125 - DNA, 20 bp, synthetic construct
  misc_feature 1..20: note = CRISPR gRNA sequence
  source 1..20: mol_type = other DNA
ttgtagttttagtagagatg

SEQ ID NO: 97126 - DNA, 20 bp, synthetic construct
  misc_feature 1..20: note = CRISPR gRNA sequence
  source 1..20: mol_type = other DNA
gagatggggtttcatcatgt

SEQ ID NO: 97127 - DNA, 20 bp, synthetic construct
  misc_feature 1..20: note = CRISPR gRNA sequence
  source 1..20: mol_type = other DNA
tggggtttcatcatgttggt

SEQ ID NO: 97128 - DNA, 20 bp, synthetic construct
  misc_feature 1..20: note = CRISPR gRNA sequence
  source 1..20: mol_type = other DNA
ggggtttcatcatgttggtc

SEQ ID NO: 97129 - DNA, 20 bp, synthetic construct
  misc_feature 1..20: note = CRISPR gRNA sequence
  source 1..20: mol_type = other DNA
tttcatcatgttggtcaggc

SEQ ID NO: 97130 - DNA, 20 bp, synthetic construct
  misc_feature 1..20: note = CRISPR gRNA sequence
  source 1..20: mol_type = other DNA
ggctggcctttcctgacttc

SEQ ID NO: 97131 - DNA, 20 bp, synthetic construct
  misc_feature 1..20: note = CRISPR gRNA sequence
  source 1..20: mol_type = other DNA
ttcaagtgatccacctacct

SEQ ID NO: 97132 - DNA, 20 bp, synthetic construct
  misc_feature 1..20: note = CRISPR gRNA sequence
  source 1..20: mol_type = other DNA
ccacctaccttggcctccca

SEQ ID NO: 97133 - DNA, 20 bp, synthetic construct
  misc_feature 1..20: note = CRISPR gRNA sequence
  source 1..20: mol_type = other DNA
accttggcctcccaaagtgc

SEQ ID NO: 97134 - DNA, 20 bp, synthetic construct
  misc_feature 1..20: note = CRISPR gRNA sequence
  source 1..20: mol_type = other DNA
ccttggcctcccaaagtgct

SEQ ID NO: 97135 - DNA, 20 bp, synthetic construct
  misc_feature 1..20: note = CRISPR gRNA sequence
  source 1..20: mol_type = other DNA
ctcccaaagtgctaggatta

SEQ ID NO: 97136 - DNA, 20 bp, synthetic construct
  misc_feature 1..20: note = CRISPR gRNA sequence
  source 1..20: mol_type = other DNA
tcccaaagtgctaggattac

SEQ ID NO: 97137 - DNA, 20 bp, synthetic construct
  misc_feature 1..20: note = CRISPR gRNA sequence
  source 1..20: mol_type = other DNA
agtgctaggattacaggtgt

SEQ ID NO: 97138 - DNA, 20 bp, synthetic construct
  misc_feature 1..20: note = CRISPR gRNA sequence
  source 1..20: mol_type = other DNA
gattacaggtgtgagccacc

SEQ ID NO: 97139 - DNA, 20 bp, synthetic construct
  misc_feature 1..20: note = CRISPR gRNA sequence
  source 1..20: mol_type = other DNA
caggtgtgagccaccaagcc

SEQ ID NO: 97140 - DNA, 20 bp, synthetic construct
  misc_feature 1..20: note = CRISPR gRNA sequence
  source 1..20: mol_type = other DNA
gcctaatttttaaatttttt

SEQ ID NO: 97141 - DNA, 20 bp, synthetic construct
  misc_feature 1..20: note = CRISPR gRNA sequence
  source 1..20: mol_type = other DNA
taatttttaaatttttttgg

SEQ ID NO: 97142 - DNA, 20 bp, synthetic construct
  misc_feature 1..20: note = CRISPR gRNA sequence
  source 1..20: mol_type = other DNA
atttttaaatttttttggta

SEQ ID NO: 97143 - DNA, 20 bp, synthetic construct
  misc_feature 1..20: note = CRISPR gRNA sequence
  source 1..20: mol_type = other DNA
ttaaatttttttggtagaga

SEQ ID NO: 97144 - DNA, 20 bp, synthetic construct
  misc_feature 1..20: note = CRISPR gRNA sequence
  source 1..20: mol_type = other DNA
agcgttttgctctgttgccc

SEQ ID NO: 97145 - DNA, 20 bp, synthetic construct
  misc_feature 1..20: note = CRISPR gRNA sequence
  source 1..20: mol_type = other DNA
ttttgctctgttgcccaagc

SEQ ID NO: 97146 - DNA, 20 bp, synthetic construct
  misc_feature 1..20: note = CRISPR gRNA sequence
  source 1..20: mol_type = other DNA
caagctggcctcaaattcct

SEQ ID NO: 97147 - DNA, 20 bp, synthetic construct
  misc_feature 1..20: note = CRISPR gRNA sequence
  source 1..20: mol_type = other DNA
ggcctcaaattcctgagctc

SEQ ID NO: 97148 - DNA, 20 bp, synthetic construct
  misc_feature 1..20: note = CRISPR gRNA sequence
  source 1..20: mol_type = other DNA
ctcaaattcctgagctcaag

SEQ ID NO: 97149 - DNA, 20 bp, synthetic construct
  misc_feature 1..20: note = CRISPR gRNA sequence
  source 1..20: mol_type = other DNA
gctcaagcagtcctccccac

SEQ ID NO: 97150 - DNA, 20 bp, synthetic construct
  misc_feature 1..20: note = CRISPR gRNA sequence
  source 1..20: mol_type = other DNA
cctccccactggacctccca

SEQ ID NO: 97151 - DNA, 20 bp, synthetic construct
  misc_feature 1..20: note = CRISPR gRNA sequence
  source 1..20: mol_type = other DNA
cactggacctcccaaagtgc

SEQ ID NO: 97152 - DNA, 20 bp, synthetic construct
  misc_feature 1..20: note = CRISPR gRNA sequence
  source 1..20: mol_type = other DNA
actggacctcccaaagtgct

SEQ ID NO: 97153 - DNA, 20 bp, synthetic construct
  misc_feature 1..20: note = CRISPR gRNA sequence
  source 1..20: mol_type = other DNA
ctcccaaagtgctgggatta

SEQ ID NO: 97154 - DNA, 20 bp, synthetic construct
  misc_feature 1..20: note = CRISPR gRNA sequence
  source 1..20: mol_type = other DNA
tcccaaagtgctgggattat

SEQ ID NO: 97155 - DNA, 20 bp, synthetic construct
  misc_feature 1..20: note = CRISPR gRNA sequence
  source 1..20: mol_type = other DNA
agtgctgggattataggtgt

SEQ ID NO: 97156 - DNA, 20 bp, synthetic construct
  misc_feature 1..20: note = CRISPR gRNA sequence
  source 1..20: mol_type = other DNA
taggtgtgagccaccatgcc

SEQ ID NO: 97157 - DNA, 20 bp, synthetic construct
  misc_feature 1..20: note = CRISPR gRNA sequence
  source 1..20: mol_type = other DNA
aggtgtgagccaccatgccc

SEQ ID NO: 97158 - DNA, 20 bp, synthetic construct
  misc_feature 1..20: note = CRISPR gRNA sequence
  source 1..20: mol_type = other DNA
ccaggctcatcttttcatga

SEQ ID NO: 97159 - DNA, 20 bp, synthetic construct
  misc_feature 1..20: note = CRISPR gRNA sequence
  source 1..20: mol_type = other DNA
cacaattcacacattttgct

SEQ ID NO: 97160 - DNA, 20 bp, synthetic construct
  misc_feature 1..20: note = CRISPR gRNA sequence
  source 1..20: mol_type = other DNA
aattcacacattttgcttgg

SEQ ID NO: 97161 - DNA, 20 bp, synthetic construct
  misc_feature 1..20: note = CRISPR gRNA sequence
  source 1..20: mol_type = other DNA
attcacacattttgcttggt

SEQ ID NO: 97162 - DNA, 20 bp, synthetic construct
  misc_feature 1..20: note = CRISPR gRNA sequence
  source 1..20: mol_type = other DNA
atttttatattaattctgaa

SEQ ID NO: 97163 - DNA, 20 bp, synthetic construct
  misc_feature 1..20: note = CRISPR gRNA sequence
  source 1..20: mol_type = other DNA
ttaattctgaaaagctacaa

SEQ ID NO: 97164 - DNA, 20 bp, synthetic construct
  misc_feature 1..20: note = CRISPR gRNA sequence
  source 1..20: mol_type = other DNA
aaagtgcatttttacaaact

SEQ ID NO: 97165 - DNA, 20 bp, synthetic construct
  misc_feature 1..20: note = CRISPR gRNA sequence
  source 1..20: mol_type = other DNA
aagtgcatttttacaaactt

SEQ ID NO: 97166 - DNA, 20 bp, synthetic construct
  misc_feature 1..20: note = CRISPR gRNA sequence
  source 1..20: mol_type = other DNA
agtgcatttttacaaactta

SEQ ID NO: 97167 - DNA, 20 bp, synthetic construct
  misc_feature 1..20: note = CRISPR gRNA sequence
  source 1..20: mol_type = other DNA
gtgcatttttacaaacttag

SEQ ID NO: 97168 - DNA, 20 bp, synthetic construct
  misc_feature 1..20: note = CRISPR gRNA sequence
  source 1..20: mol_type = other DNA
catttttacaaacttagggg

SEQ ID NO: 97169 - DNA, 20 bp, synthetic construct
  misc_feature 1..20: note = CRISPR gRNA sequence
  source 1..20: mol_type = other DNA
ttacaaacttaggggaagtt

SEQ ID NO: 97170 - DNA, 20 bp, synthetic construct
  misc_feature 1..20: note = CRISPR gRNA sequence
  source 1..20: mol_type = other DNA
tacaaacttaggggaagttg

SEQ ID NO: 97171 - DNA, 20 bp, synthetic construct
  misc_feature 1..20: note = CRISPR gRNA sequence
  source 1..20: mol_type = other DNA
ttaggggaagttgaggttcc

SEQ ID NO: 97172 - DNA, 20 bp, synthetic construct
  misc_feature 1..20: note = CRISPR gRNA sequence
  source 1..20: mol_type = other DNA
taggggaagttgaggttcct

SEQ ID NO: 97173 - DNA, 20 bp, synthetic construct
  misc_feature 1..20: note = CRISPR gRNA sequence
  source 1..20: mol_type = other DNA
aggggaagttgaggttcctg

SEQ ID NO: 97174 - DNA, 20 bp, synthetic construct
  misc_feature 1..20: note = CRISPR gRNA sequence
  source 1..20: mol_type = other DNA
gaagttgaggttcctggggt

SEQ ID NO: 97175 - DNA, 20 bp, synthetic construct
  misc_feature 1..20: note = CRISPR gRNA sequence
  source 1..20: mol_type = other DNA
aggttcctggggtgagtcct

SEQ ID NO: 97176 - DNA, 20 bp, synthetic construct
  misc_feature 1..20: note = CRISPR gRNA sequence
  source 1..20: mol_type = other DNA
gggtgagtcctcggttctcc

SEQ ID NO: 97177 - DNA, 20 bp, synthetic construct
  misc_feature 1..20: note = CRISPR gRNA sequence
  source 1..20: mol_type = other DNA
cccagctttgctctgtaatg

SEQ ID NO: 97178 - DNA, 20 bp, synthetic construct
  misc_feature 1..20: note = CRISPR gRNA sequence
  source 1..20: mol_type = other DNA
ccagctttgctctgtaatgc

SEQ ID NO: 97179 - DNA, 20 bp, synthetic construct
  misc_feature 1..20: note = CRISPR gRNA sequence
  source 1..20: mol_type = other DNA
tctgtaatgcaggtctctgc

SEQ ID NO: 97180 - DNA, 20 bp, synthetic construct
  misc_feature 1..20: note = CRISPR gRNA sequence
  source 1..20: mol_type = other DNA
ctgtaatgcaggtctctgca

SEQ ID NO: 97181 - DNA, 20 bp, synthetic construct
  misc_feature 1..20: note = CRISPR gRNA sequence
  source 1..20: mol_type = other DNA
tgtaatgcaggtctctgcaa

SEQ ID NO: 97182 - DNA, 20 bp, synthetic construct
  misc_feature 1..20: note = CRISPR gRNA sequence
  source 1..20: mol_type = other DNA
agggtccctgtttgtcccct

SEQ ID NO: 97183 - DNA, 20 bp, synthetic construct
  misc_feature 1..20: note = CRISPR gRNA sequence
  source 1..20: mol_type = other DNA
gggtccctgtttgtccccta

SEQ ID NO: 97184 - DNA, 20 bp, synthetic construct
  misc_feature 1..20: note = CRISPR gRNA sequence
  source 1..20: mol_type = other DNA
ggtccctgtttgtcccctaa

SEQ ID NO: 97185 - DNA, 20 bp, synthetic construct
  misc_feature 1..20: note = CRISPR gRNA sequence
  source 1..20: mol_type = other DNA
gtccctgtttgtcccctaag

SEQ ID NO: 97186 - DNA, 20 bp, synthetic construct
  misc_feature 1..20: note = CRISPR gRNA sequence
  source 1..20: mol_type = other DNA
ccctgtttgtcccctaaggg

SEQ ID NO: 97187 - DNA, 20 bp, synthetic construct
  misc_feature 1..20: note = CRISPR gRNA sequence
  source 1..20: mol_type = other DNA
ctgtttgtcccctaagggga

SEQ ID NO: 97188 - DNA, 20 bp, synthetic construct
  misc_feature 1..20: note = CRISPR gRNA sequence
  source 1..20: mol_type = other DNA
tgtcccctaaggggagagcg

SEQ ID NO: 97189 - DNA, 20 bp, synthetic construct
  misc_feature 1..20: note = CRISPR gRNA sequence
  source 1..20: mol_type = other DNA
gtcccctaaggggagagcgc

SEQ ID NO: 97190 - DNA, 20 bp, synthetic construct
  misc_feature 1..20: note = CRISPR gRNA sequence
  source 1..20: mol_type = other DNA
cctaaggggagagcgcaggt

SEQ ID NO: 97191 - DNA, 20 bp, synthetic construct
  misc_feature 1..20: note = CRISPR gRNA sequence
  source 1..20: mol_type = other DNA
ctccaccccactcccgattc

SEQ ID NO: 97192 - DNA, 20 bp, synthetic construct
  misc_feature 1..20: note = CRISPR gRNA sequence
  source 1..20: mol_type = other DNA
ccactcccgattcaagctca

SEQ ID NO: 97193 - DNA, 20 bp, synthetic construct
  misc_feature 1..20: note = CRISPR gRNA sequence
  source 1..20: mol_type = other DNA
accttttccctgccccatct

SEQ ID NO: 97194 - DNA, 20 bp, synthetic construct
  misc_feature 1..20: note = CRISPR gRNA sequence
  source 1..20: mol_type = other DNA
cctgccccatctcagtgcaa

SEQ ID NO: 97195 - DNA, 20 bp, synthetic construct
  misc_feature 1..20: note = CRISPR gRNA sequence
  source 1..20: mol_type = other DNA
ctgccccatctcagtgcaac

SEQ ID NO: 97196 - DNA, 20 bp, synthetic construct
  misc_feature 1..20: note = CRISPR gRNA sequence
  source 1..20: mol_type = other DNA
tctcagtgcaacaggtgatc

SEQ ID NO: 97197 - DNA, 20 bp, synthetic construct
  misc_feature 1..20: note = CRISPR gRNA sequence
  source 1..20: mol_type = other DNA
tgatcgagaaccacatcctc

SEQ ID NO: 97198 - DNA, 20 bp, synthetic construct
  misc_feature 1..20: note = CRISPR gRNA sequence
  source 1..20: mol_type = other DNA
accacatcctcaagctcttc

SEQ ID NO: 97199 - DNA, 20 bp, synthetic construct
  misc_feature 1..20: note = CRISPR gRNA sequence
  source 1..20: mol_type = other DNA
cacatcctcaagctcttcca

SEQ ID NO: 97200 - DNA, 20 bp, synthetic construct
  misc_feature 1..20: note = CRISPR gRNA sequence
  source 1..20: mol_type = other DNA
caagctcttccagagcaacc

SEQ ID NO: 97201 - DNA, 20 bp, synthetic construct
  misc_feature 1..20: note = CRISPR gRNA sequence
  source 1..20: mol_type = other DNA
acctggtgcccgctgaccct

SEQ ID NO: 97202 - DNA, 20 bp, synthetic construct
  misc_feature 1..20: note = CRISPR gRNA sequence
  source 1..20: mol_type = other DNA
gtgcccgctgaccctgagtg

SEQ ID NO: 97203 - DNA, 20 bp, synthetic construct
  misc_feature 1..20: note = CRISPR gRNA sequence
  source 1..20: mol_type = other DNA
tgcccgctgaccctgagtga

SEQ ID NO: 97204 - DNA, 20 bp, synthetic construct
  misc_feature 1..20: note = CRISPR gRNA sequence
  source 1..20: mol_type = other DNA
cctgagtgaaggccgcctgc

SEQ ID NO: 97205 - DNA, 20 bp, synthetic construct
  misc_feature 1..20: note = CRISPR gRNA sequence
  source 1..20: mol_type = other DNA
ctgagtgaaggccgcctgcc

SEQ ID NO: 97206 - DNA, 20 bp, synthetic construct
  misc_feature 1..20: note = CRISPR gRNA sequence
  source 1..20: mol_type = other DNA
tgagtgaaggccgcctgccg

SEQ ID NO: 97207 - DNA, 20 bp, synthetic construct
  misc_feature 1..20: note = CRISPR gRNA sequence
  source 1..20: mol_type = other DNA
aaggccgcctgccggggact

SEQ ID NO: 97208 - DNA, 20 bp, synthetic construct
  misc_feature 1..20: note = CRISPR gRNA sequence
  source 1..20: mol_type = other DNA
ctgccggggactcagacact

SEQ ID NO: 97209 - DNA, 20 bp, synthetic construct
  misc_feature 1..20: note = CRISPR gRNA sequence
  source 1..20: mol_type = other DNA
tgccggggactcagacactc

SEQ ID NO: 97210 - DNA, 20 bp, synthetic construct
  misc_feature 1..20: note = CRISPR gRNA sequence
  source 1..20: mol_type = other DNA
gccggggactcagacactca

SEQ ID NO: 97211 - DNA, 20 bp, synthetic construct
  misc_feature 1..20: note = CRISPR gRNA sequence
  source 1..20: mol_type = other DNA
cagacactcagggaacaaaa

SEQ ID NO: 97212 - DNA, 20 bp, synthetic construct
  misc_feature 1..20: note = CRISPR gRNA sequence
  source 1..20: mol_type = other DNA
cactcagggaacaaaatggt

SEQ ID NO: 97213 - DNA, 20 bp, synthetic construct
  misc_feature 1..20: note = CRISPR gRNA sequence
  source 1..20: mol_type = other DNA
cagggaacaaaatggtcagc

SEQ ID NO: 97214 - DNA, 20 bp, synthetic construct
  misc_feature 1..20: note = CRISPR gRNA sequence
  source 1..20: mol_type = other DNA
gggaacaaaatggtcagcca

SEQ ID NO: 97215 - DNA, 20 bp, synthetic construct
  misc_feature 1..20: note = CRISPR gRNA sequence
  source 1..20: mol_type = other DNA
acaaaatggtcagccagagc

SEQ ID NO: 97216 - DNA, 20 bp, synthetic construct
  misc_feature 1..20: note = CRISPR gRNA sequence
  source 1..20: mol_type = other DNA
caaaatggtcagccagagct

SEQ ID NO: 97217 - DNA, 20 bp, synthetic construct
  misc_feature 1..20: note = CRISPR gRNA sequence
  source 1..20: mol_type = other DNA
aaaatggtcagccagagctg

SEQ ID NO: 97218 - DNA, 20 bp, synthetic construct
  misc_feature 1..20: note = CRISPR gRNA sequence
  source 1..20: mol_type = other DNA
cagccagagctggggaaacc

SEQ ID NO: 97219 - DNA, 20 bp, synthetic construct
  misc_feature 1..20: note = CRISPR gRNA sequence
  source 1..20: mol_type = other DNA
gaaacccagaactgacttca

SEQ ID NO: 97220 - DNA, 20 bp, synthetic construct
  misc_feature 1..20: note = CRISPR gRNA sequence
  source 1..20: mol_type = other DNA
aaacccagaactgacttcaa

SEQ ID NO: 97221 - DNA, 20 bp, synthetic construct
  misc_feature 1..20: note = CRISPR gRNA sequence
  source 1..20: mol_type = other DNA
cccagaactgacttcaaagg

SEQ ID NO: 97222 - DNA, 20 bp, synthetic construct
  misc_feature 1..20: note = CRISPR gRNA sequence
  source 1..20: mol_type = other DNA
ctgacttcaaaggcagcttc

SEQ ID NO: 97223 - DNA, 20 bp, synthetic construct
  misc_feature 1..20: note = CRISPR gRNA sequence
  source 1..20: mol_type = other DNA
cttcaaaggcagcttctgga

SEQ ID NO: 97224 - DNA, 20 bp, synthetic construct
  misc_feature 1..20: note = CRISPR gRNA sequence
  source 1..20: mol_type = other DNA
ttcaaaggcagcttctggac

SEQ ID NO: 97225 - DNA, 20 bp, synthetic construct
  misc_feature 1..20: note = CRISPR gRNA sequence
  source 1..20: mol_type = other DNA
aaaggcagcttctggacagg

SEQ ID NO: 97226 - DNA, 20 bp, synthetic construct
  misc_feature 1..20: note = CRISPR gRNA sequence
  source 1..20: mol_type = other DNA
ggcagcttctggacaggtgg

SEQ ID NO: 97227 - DNA, 20 bp, synthetic construct
  misc_feature 1..20: note = CRISPR gRNA sequence
  source 1..20: mol_type = other DNA
gcagcttctggacaggtggt

SEQ ID NO: 97228 - DNA, 20 bp, synthetic construct
  misc_feature 1..20: note = CRISPR gRNA sequence
  source 1..20: mol_type = other DNA
agcttctggacaggtggtgg

SEQ ID NO: 97229 - DNA, 20 bp, synthetic construct
  misc_feature 1..20: note = CRISPR gRNA sequence
  source 1..20: mol_type = other DNA
gcttctggacaggtggtggg

SEQ ID NO: 97230 - DNA, 20 bp, synthetic construct
  misc_feature 1..20: note = CRISPR gRNA sequence
  source 1..20: mol_type = other DNA
cttctggacaggtggtggga

SEQ ID NO: 97231 - DNA, 20 bp, synthetic construct
  misc_feature 1..20: note = CRISPR gRNA sequence
  source 1..20: mol_type = other DNA
ttctggacaggtggtgggag

SEQ ID NO: 97232 - DNA, 20 bp, synthetic construct
  misc_feature 1..20: note = CRISPR gRNA sequence
  source 1..20: mol_type = other DNA
ggtgggaggggacccttccc

SEQ ID NO: 97233 - DNA, 20 bp, synthetic construct
  misc_feature 1..20: note = CRISPR gRNA sequence
  source 1..20: mol_type = other DNA
tgggaggggacccttcccaa

SEQ ID NO: 97234 - DNA, 20 bp, synthetic construct
  misc_feature 1..20: note = CRISPR gRNA sequence
  source 1..20: mol_type = other DNA
gggaggggacccttcccaag

SEQ ID NO: 97235 - DNA, 20 bp, synthetic construct
  misc_feature 1..20: note = CRISPR gRNA sequence
  source 1..20: mol_type = other DNA
gaaccaataaaccttctgtg

SEQ ID NO: 97236 - DNA, 20 bp, synthetic construct
  misc_feature 1..20: note = CRISPR gRNA sequence
  source 1..20: mol_type = other DNA
ataaaccttctgtgcagaat

SEQ ID NO: 97237 - DNA, 20 bp, synthetic construct
  misc_feature 1..20: note = CRISPR gRNA sequence
  source 1..20: mol_type = other DNA
taaaccttctgtgcagaatg

SEQ ID NO: 97238 - DNA, 20 bp, synthetic construct
  misc_feature 1..20: note = CRISPR gRNA sequence
  source 1..20: mol_type = other DNA
aaaccttctgtgcagaatga

SEQ ID NO: 97239 - DNA, 20 bp, synthetic construct
  misc_feature 1..20: note = CRISPR gRNA sequence
  source 1..20: mol_type = other DNA
agggactttgctgtgcttcc

SEQ ID NO: 97240 - DNA, 20 bp, synthetic construct
  misc_feature 1..20: note = CRISPR gRNA sequence
  source 1..20: mol_type = other DNA
ggactttgctgtgcttcccg

SEQ ID NO: 97241 - DNA, 20 bp, synthetic construct
  misc_feature 1..20: note = CRISPR gRNA sequence
  source 1..20: mol_type = other DNA
gactttgctgtgcttcccgg

SEQ ID NO: 97242 - DNA, 20 bp, synthetic construct
  misc_feature 1..20: note = CRISPR gRNA sequence
  source 1..20: mol_type = other DNA
actttgctgtgcttcccgga

SEQ ID NO: 97243 - DNA, 20 bp, synthetic construct
  misc_feature 1..20: note = CRISPR gRNA sequence
  source 1..20: mol_type = other DNA
gtgcttcccggagggcttcc

SEQ ID NO: 97244 - DNA, 20 bp, synthetic construct
  misc_feature 1..20: note = CRISPR gRNA sequence
  source 1..20: mol_type = other DNA
gcttcccggagggcttcctg

SEQ ID NO: 97245 - DNA, 20 bp, synthetic construct
  misc_feature 1..20: note = CRISPR gRNA sequence
  source 1..20: mol_type = other DNA
cttcccggagggcttcctgg

SEQ ID NO: 97246 - DNA, 20 bp, synthetic construct
  misc_feature 1..20: note = CRISPR gRNA sequence
  source 1..20: mol_type = other DNA
tcccggagggcttcctggag

SEQ ID NO: 97247 - DNA, 20 bp, synthetic construct
  misc_feature 1..20: note = CRISPR gRNA sequence
  source 1..20: mol_type = other DNA
ggagggcttcctggaggaga

SEQ ID NO: 97248 - DNA, 20 bp, synthetic construct
  misc_feature 1..20: note = CRISPR gRNA sequence
  source 1..20: mol_type = other DNA
ttcctggaggagacagcccc

SEQ ID NO: 97249 - DNA, 20 bp, synthetic construct
  misc_feature 1..20: note = CRISPR gRNA sequence
  source 1..20: mol_type = other DNA
cctggaggagacagccccta

SEQ ID NO: 97250 - DNA, 20 bp, synthetic construct
  misc_feature 1..20: note = CRISPR gRNA sequence
  source 1..20: mol_type = other DNA
ctggaggagacagcccctag

SEQ ID NO: 97251 - DNA, 20 bp, synthetic construct
  misc_feature 1..20: note = CRISPR gRNA sequence
  source 1..20: mol_type = other DNA
aggtctcacaccttctcccc

SEQ ID NO: 97252 - DNA, 20 bp, synthetic construct
  misc_feature 1..20: note = CRISPR gRNA sequence
  source 1..20: mol_type = other DNA
accttctccccaagcacccg

SEQ ID NO: 97253 - DNA, 20 bp, synthetic construct
  misc_feature 1..20: note = CRISPR gRNA sequence
  source 1..20: mol_type = other DNA
ccttctccccaagcacccgc

SEQ ID NO: 97254 - DNA, 20 bp, synthetic construct
  misc_feature 1..20: note = CRISPR gRNA sequence
  source 1..20: mol_type = other DNA
tctccccaagcacccgcagg

SEQ ID NO: 97255 - DNA, 20 bp, synthetic construct
  misc_feature 1..20: note = CRISPR gRNA sequence
  source 1..20: mol_type = other DNA
ccccaagcacccgcaggtgg

SEQ ID NO: 97256 - DNA, 20 bp, synthetic construct
  misc_feature 1..20: note = CRISPR gRNA sequence
  source 1..20: mol_type = other DNA
gtgtggtcatctaccacctg

SEQ ID NO: 97257 - DNA, 20 bp, synthetic construct
  misc_feature 1..20: note = CRISPR gRNA sequence
  source 1..20: mol_type = other DNA
tgtggtcatctaccacctgc

SEQ ID NO: 97258 - DNA, 20 bp, synthetic construct
  misc_feature 1..20: note = CRISPR gRNA sequence
  source 1..20: mol_type = other DNA
atctaccacctgcgggtgct

SEQ ID NO: 97259 - DNA, 20 bp, synthetic construct
  misc_feature 1..20: note = CRISPR gRNA sequence
  source 1..20: mol_type = other DNA
tctaccacctgcgggtgctt

SEQ ID NO: 97260 - DNA, 20 bp, synthetic construct
  misc_feature 1..20: note = CRISPR gRNA sequence
  source 1..20: mol_type = other DNA
ctaccacctgcgggtgcttg

SEQ ID NO: 97261 - DNA, 20 bp, synthetic construct
  misc_feature 1..20: note = CRISPR gRNA sequence
  source 1..20: mol_type = other DNA
accacctgcgggtgcttggg

SEQ ID NO: 97262 - DNA, 20 bp, synthetic construct
  misc_feature 1..20: note = CRISPR gRNA sequence
  source 1..20: mol_type = other DNA
acctgcgggtgcttggggag

SEQ ID NO: 97263 - DNA, 20 bp, synthetic construct
  misc_feature 1..20: note = CRISPR gRNA sequence
  source 1..20: mol_type = other DNA
cctgcgggtgcttggggaga

SEQ ID NO: 97264 - DNA, 20 bp, synthetic construct
  misc_feature 1..20: note = CRISPR gRNA sequence
  source 1..20: mol_type = other DNA
ggtgcttggggagaaggtgt

SEQ ID NO: 97265 - DNA, 20 bp, synthetic construct
  misc_feature 1..20: note = CRISPR gRNA sequence
  source 1..20: mol_type = other DNA
gggagaaggtgtgagacctc

SEQ ID NO: 97266 - DNA, 20 bp, synthetic construct
  misc_feature 1..20: note = CRISPR gRNA sequence
  source 1..20: mol_type = other DNA
ggagaaggtgtgagacctct

SEQ ID NO: 97267 - DNA, 20 bp, synthetic construct
  misc_feature 1..20: note = CRISPR gRNA sequence
  source 1..20: mol_type = other DNA
gagaaggtgtgagacctcta

SEQ ID NO: 97268 - DNA, 20 bp, synthetic construct
  misc_feature 1..20: note = CRISPR gRNA sequence
  source 1..20: mol_type = other DNA
agaaggtgtgagacctctag

SEQ ID NO: 97269 - DNA, 20 bp, synthetic construct
  misc_feature 1..20: note = CRISPR gRNA sequence
  source 1..20: mol_type = other DNA
cctctaggggctgtctcctc

SEQ ID NO: 97270 - DNA, 20 bp, synthetic construct
  misc_feature 1..20: note = CRISPR gRNA sequence
  source 1..20: mol_type = other DNA
ctctaggggctgtctcctcc

SEQ ID NO: 97271 - DNA, 20 bp, synthetic construct
  misc_feature 1..20: note = CRISPR gRNA sequence
  source 1..20: mol_type = other DNA
taggggctgtctcctccagg

SEQ ID NO: 97272 - DNA, 20 bp, synthetic construct
  misc_feature 1..20: note = CRISPR gRNA sequence
  source 1..20: mol_type = other DNA
gtctcctccaggaagccctc

SEQ ID NO: 97273 - DNA, 20 bp, synthetic construct
  misc_feature 1..20: note = CRISPR gRNA sequence
  source 1..20: mol_type = other DNA
tctcctccaggaagccctcc

SEQ ID NO: 97274 - DNA, 20 bp, synthetic construct
  misc_feature 1..20: note = CRISPR gRNA sequence
  source 1..20: mol_type = other DNA
cctccaggaagccctccggg

SEQ ID NO: 97275 - DNA, 20 bp, synthetic construct
  misc_feature 1..20: note = CRISPR gRNA sequence
  source 1..20: mol_type = other DNA
aggaagccctccgggaagca

SEQ ID NO: 97276 - DNA, 20 bp, synthetic construct
  misc_feature 1..20: note = CRISPR gRNA sequence
  source 1..20: mol_type = other DNA
gccctccgggaagcacagca

SEQ ID NO: 97277 - DNA, 20 bp, synthetic construct
  misc_feature 1..20: note = CRISPR gRNA sequence
  source 1..20: mol_type = other DNA
gcaaagtccctcattctgca

SEQ ID NO: 97278 - DNA, 20 bp, synthetic construct
  misc_feature 1..20: note = CRISPR gRNA sequence
  source 1..20: mol_type = other DNA
aagtccctcattctgcacag

SEQ ID NO: 97279 - DNA, 20 bp, synthetic construct
  misc_feature 1..20: note = CRISPR gRNA sequence
  source 1..20: mol_type = other DNA
agtccctcattctgcacaga

SEQ ID NO: 97280 - DNA, 20 bp, synthetic construct
  misc_feature 1..20: note = CRISPR gRNA sequence
  source 1..20: mol_type = other DNA
attctgcacagaaggtttat

SEQ ID NO: 97281 - DNA, 20 bp, synthetic construct
  misc_feature 1..20: note = CRISPR gRNA sequence
  source 1..20: mol_type = other DNA
gaaggtttattggttcctct

SEQ ID NO: 97282 - DNA, 20 bp, synthetic construct
  misc_feature 1..20: note = CRISPR gRNA sequence
  source 1..20: mol_type = other DNA
aaggtttattggttcctctt

SEQ ID NO: 97283 - DNA, 20 bp, synthetic construct
  misc_feature 1..20: note = CRISPR gRNA sequence
  source 1..20: mol_type = other DNA
gtttattggttcctcttggg

SEQ ID NO: 97284 - DNA, 20 bp, synthetic construct
  misc_feature 1..20: note = CRISPR gRNA sequence
  source 1..20: mol_type = other DNA
tttattggttcctcttggga

SEQ ID NO: 97285 - DNA, 20 bp, synthetic construct
  misc_feature 1..20: note = CRISPR gRNA sequence
  source 1..20: mol_type = other DNA
ttattggttcctcttgggaa

SEQ ID NO: 97286 - DNA, 20 bp, synthetic construct
  misc_feature 1..20: note = CRISPR gRNA sequence
  source 1..20: mol_type = other DNA
gtcccctcccaccacctgtc

SEQ ID NO: 97287 - DNA, 20 bp, synthetic construct
  misc_feature 1..20: note = CRISPR gRNA sequence
  source 1..20: mol_type = other DNA
ccctcccaccacctgtccag

SEQ ID NO: 97288 - DNA, 20 bp, synthetic construct
  misc_feature 1..20: note = CRISPR gRNA sequence
  source 1..20: mol_type = other DNA
ctgtccagaagctgcctttg

SEQ ID NO: 97289 - DNA, 20 bp, synthetic construct
  misc_feature 1..20: note = CRISPR gRNA sequence
  source 1..20: mol_type = other DNA
ccagaagctgcctttgaagt

SEQ ID NO: 97290 - DNA, 20 bp, synthetic construct
  misc_feature 1..20: note = CRISPR gRNA sequence
  source 1..20: mol_type = other DNA
gctgcctttgaagtcagttc

SEQ ID NO: 97291 - DNA, 20 bp, synthetic construct
  misc_feature 1..20: note = CRISPR gRNA sequence
  source 1..20: mol_type = other DNA
ctgcctttgaagtcagttct

SEQ ID NO: 97292 - DNA, 20 bp, synthetic construct
  misc_feature 1..20: note = CRISPR gRNA sequence
  source 1..20: mol_type = other DNA
aagtcagttctgggtttccc

SEQ ID NO: 97293 - DNA, 20 bp, synthetic construct
  misc_feature 1..20: note = CRISPR gRNA sequence
  source 1..20: mol_type = other DNA
gttctgggtttccccagctc

SEQ ID NO: 97294 - DNA, 20 bp, synthetic construct
  misc_feature 1..20: note = CRISPR gRNA sequence
  source 1..20: mol_type = other DNA
ggctgaccattttgttccct

SEQ ID NO: 97295 - DNA, 20 bp, synthetic construct
  misc_feature 1..20: note = CRISPR gRNA sequence
  source 1..20: mol_type = other DNA
attttgttccctgagtgtct

SEQ ID NO: 97296 - DNA, 20 bp, synthetic construct
  misc_feature 1..20: note = CRISPR gRNA sequence
  source 1..20: mol_type = other DNA
tccctgagtgtctgagtccc

SEQ ID NO: 97297 - DNA, 20 bp, synthetic construct
  misc_feature 1..20: note = CRISPR gRNA sequence
  source 1..20: mol_type = other DNA
ctgagtgtctgagtccccgg

SEQ ID NO: 97298 - DNA, 20 bp, synthetic construct
  misc_feature 1..20: note = CRISPR gRNA sequence
  source 1..20: mol_type = other DNA
tgagtgtctgagtccccggc

SEQ ID NO: 97299 - DNA, 20 bp, synthetic construct
  misc_feature 1..20: note = CRISPR gRNA sequence
  source 1..20: mol_type = other DNA
gtgtctgagtccccggcagg

SEQ ID NO: 97300 - DNA, 20 bp, synthetic construct
  misc_feature 1..20: note = CRISPR gRNA sequence
  source 1..20: mol_type = other DNA
cccggcaggcggccttcact

SEQ ID NO: 97301 - DNA, 20 bp, synthetic construct
  misc_feature 1..20: note = CRISPR gRNA sequence
  source 1..20: mol_type = other DNA
ccggcaggcggccttcactc

SEQ ID NO: 97302 - DNA, 20 bp, synthetic construct
  misc_feature 1..20: note = CRISPR gRNA sequence
  source 1..20: mol_type = other DNA
cggcaggcggccttcactca

SEQ ID NO: 97303 - DNA, 20 bp, synthetic construct
  misc_feature 1..20: note = CRISPR gRNA sequence
  source 1..20: mol_type = other DNA
aggcggccttcactcagggt

SEQ ID NO: 97304 - DNA, 20 bp, synthetic construct
  misc_feature 1..20: note = CRISPR gRNA sequence
  source 1..20: mol_type = other DNA
cggccttcactcagggtcag

SEQ ID NO: 97305 - DNA, 20 bp, synthetic construct
  misc_feature 1..20: note = CRISPR gRNA sequence
  source 1..20: mol_type = other DNA
ggccttcactcagggtcagc

SEQ ID NO: 97306 - DNA, 20 bp, synthetic construct
  misc_feature 1..20: note = CRISPR gRNA sequence
  source 1..20: mol_type = other DNA
cactcagggtcagcgggcac

SEQ ID NO: 97307 - DNA, 20 bp, synthetic construct
  misc_feature 1..20: note = CRISPR gRNA sequence
  source 1..20: mol_type = other DNA
actcagggtcagcgggcacc

SEQ ID NO: 97308 - DNA, 20 bp, synthetic construct
  misc_feature 1..20: note = CRISPR gRNA sequence
  source 1..20: mol_type = other DNA
cagcgggcaccaggttgctc

SEQ ID NO: 97309 - DNA, 20 bp, synthetic construct
  misc_feature 1..20: note = CRISPR gRNA sequence
  source 1..20: mol_type = other DNA
cgggcaccaggttgctctgg

SEQ ID NO: 97310 - DNA, 20 bp, synthetic construct
  misc_feature 1..20: note = CRISPR gRNA sequence
  source 1..20: mol_type = other DNA
ggcaccaggttgctctggaa

SEQ ID NO: 97311 - DNA, 20 bp, synthetic construct
  misc_feature 1..20: note = CRISPR gRNA sequence
  source 1..20: mol_type = other DNA
aggttgctctggaagagctt

SEQ ID NO: 97312 - DNA, 20 bp, synthetic construct
  misc_feature 1..20: note = CRISPR gRNA sequence
  source 1..20: mol_type = other DNA
ggttgctctggaagagcttg

SEQ ID NO: 97313 - DNA, 20 bp, synthetic construct
  misc_feature 1..20: note = CRISPR gRNA sequence
  source 1..20: mol_type = other DNA
tctggaagagcttgaggatg

SEQ ID NO: 97314 - DNA, 20 bp, synthetic construct
  misc_feature 1..20: note = CRISPR gRNA sequence
  source 1..20: mol_type = other DNA
tctcgatcacctgttgcact

SEQ ID NO: 97315 - DNA, 20 bp, synthetic construct
  misc_feature 1..20: note = CRISPR gRNA sequence
  source 1..20: mol_type = other DNA
gatcacctgttgcactgaga

SEQ ID NO: 97316 - DNA, 20 bp, synthetic construct
  misc_feature 1..20: note = CRISPR gRNA sequence
  source 1..20: mol_type = other DNA
atcacctgttgcactgagat

SEQ ID NO: 97317 - DNA, 20 bp, synthetic construct
  misc_feature 1..20: note = CRISPR gRNA sequence
  source 1..20: mol_type = other DNA
tcacctgttgcactgagatg

SEQ ID NO: 97318 - DNA, 20 bp, synthetic construct
  misc_feature 1..20: note = CRISPR gRNA sequence
  source 1..20: mol_type = other DNA
cctgttgcactgagatgggg

SEQ ID NO: 97319 - DNA, 20 bp, synthetic construct
  misc_feature 1..20: note = CRISPR gRNA sequence
  source 1..20: mol_type = other DNA
ctgttgcactgagatggggc

SEQ ID NO: 97320 - DNA, 20 bp, synthetic construct
  misc_feature 1..20: note = CRISPR gRNA sequence
  source 1..20: mol_type = other DNA
tgttgcactgagatggggca

SEQ ID NO: 97321 - DNA, 20 bp, synthetic construct
  misc_feature 1..20: note = CRISPR gRNA sequence
  source 1..20: mol_type = other DNA
cactgagatggggcagggaa

SEQ ID NO: 97322 - DNA, 20 bp, synthetic construct
  misc_feature 1..20: note = CRISPR gRNA sequence
  source 1..20: mol_type = other DNA
actgagatggggcagggaaa

SEQ ID NO: 97323 - DNA, 20 bp, synthetic construct
  misc_feature 1..20: note = CRISPR gRNA sequence
  source 1..20: mol_type = other DNA
gagatggggcagggaaaagg

SEQ ID NO: 97324 - DNA, 20 bp, synthetic construct
  misc_feature 1..20: note = CRISPR gRNA sequence
  source 1..20: mol_type = other DNA
agatggggcagggaaaaggt

SEQ ID NO: 97325 - DNA, 20 bp, synthetic construct
  misc_feature 1..20: note = CRISPR gRNA sequence
  source 1..20: mol_type = other DNA
gcagggaaaaggtgggctgt

SEQ ID NO: 97326 - DNA, 20 bp, synthetic construct
  misc_feature 1..20: note = CRISPR gRNA sequence
  source 1..20: mol_type = other DNA
ggtgggctgtgagcttgaat

SEQ ID NO: 97327 - DNA, 20 bp, synthetic construct
  misc_feature 1..20: note = CRISPR gRNA sequence
  source 1..20: mol_type = other DNA
gtgggctgtgagcttgaatc

SEQ ID NO: 97328 - DNA, 20 bp, synthetic construct
  misc_feature 1..20: note = CRISPR gRNA sequence
  source 1..20: mol_type = other DNA
gggctgtgagcttgaatcgg

SEQ ID NO: 97329 - DNA, 20 bp, synthetic construct
  misc_feature 1..20: note = CRISPR gRNA sequence
  source 1..20: mol_type = other DNA
ctgtgagcttgaatcgggag

SEQ ID NO: 97330 - DNA, 20 bp, synthetic construct
  misc_feature 1..20: note = CRISPR gRNA sequence
  source 1..20: mol_type = other DNA
tgtgagcttgaatcgggagt

SEQ ID NO: 97331 - DNA, 20 bp, synthetic construct
  misc_feature 1..20: note = CRISPR gRNA sequence
  source 1..20: mol_type = other DNA
gtgagcttgaatcgggagtg

SEQ ID NO: 97332 - DNA, 20 bp, synthetic construct
  misc_feature 1..20: note = CRISPR gRNA sequence
  source 1..20: mol_type = other DNA
agcttgaatcgggagtgggg

SEQ ID NO: 97333 - DNA, 20 bp, synthetic construct
  misc_feature 1..20: note = CRISPR gRNA sequence
  source 1..20: mol_type = other DNA
cttgaatcgggagtggggtg

SEQ ID NO: 97334 - DNA, 20 bp, synthetic construct
  misc_feature 1..20: note = CRISPR gRNA sequence
  source 1..20: mol_type = other DNA
ttgaatcgggagtggggtgg

SEQ ID NO: 97335 - DNA, 20 bp, synthetic construct
  misc_feature 1..20: note = CRISPR gRNA sequence
  source 1..20: mol_type = other DNA
tcgggagtggggtggaggca

SEQ ID NO: 97336 - DNA, 20 bp, synthetic construct
  misc_feature 1..20: note = CRISPR gRNA sequence
  source 1..20: mol_type = other DNA
cgggagtggggtggaggcac

SEQ ID NO: 97337 - DNA, 20 bp, synthetic construct
  misc_feature 1..20: note = CRISPR gRNA sequence
  source 1..20: mol_type = other DNA
gccaacctgcgctctcccct

SEQ ID NO: 97338 - DNA, 20 bp, synthetic construct
  misc_feature 1..20: note = CRISPR gRNA sequence
  source 1..20: mol_type = other DNA
ccaacctgcgctctcccctt

SEQ ID NO: 97339 - DNA, 20 bp, synthetic construct
  misc_feature 1..20: note = CRISPR gRNA sequence
  source 1..20: mol_type = other DNA
caacctgcgctctcccctta

SEQ ID NO: 97340 - DNA, 20 bp, synthetic construct
  misc_feature 1..20: note = CRISPR gRNA sequence
  source 1..20: mol_type = other DNA
aacctgcgctctccccttag

SEQ ID NO: 97341 - DNA, 20 bp, synthetic construct
  misc_feature 1..20: note = CRISPR gRNA sequence
  source 1..20: mol_type = other DNA
ctctccccttaggggacaaa

SEQ ID NO: 97342 - DNA, 20 bp, synthetic construct
  misc_feature 1..20: note = CRISPR gRNA sequence
  source 1..20: mol_type = other DNA
tctccccttaggggacaaac

SEQ ID NO: 97343 - DNA, 20 bp, synthetic construct
  misc_feature 1..20: note = CRISPR gRNA sequence
  source 1..20: mol_type = other DNA
ctccccttaggggacaaaca

SEQ ID NO: 97344 - DNA, 20 bp, synthetic construct
  misc_feature 1..20: note = CRISPR gRNA sequence
  source 1..20: mol_type = other DNA
gggacaaacagggacccttg

SEQ ID NO: 97345 - DNA, 20 bp, synthetic construct
  misc_feature 1..20: note = CRISPR gRNA sequence
  source 1..20: mol_type = other DNA
gacaaacagggacccttgca

SEQ ID NO: 97346 - DNA, 20 bp, synthetic construct
  misc_feature 1..20: note = CRISPR gRNA sequence
  source 1..20: mol_type = other DNA
ccttgcagagacctgcatta

SEQ ID NO: 97347 - DNA, 20 bp, synthetic construct
  misc_feature 1..20: note = CRISPR gRNA sequence
  source 1..20: mol_type = other DNA
ttgcagagacctgcattaca

SEQ ID NO: 97348 - DNA, 20 bp, synthetic construct
  misc_feature 1..20: note = CRISPR gRNA sequence
  source 1..20: mol_type = other DNA
gagacctgcattacagagca

SEQ ID NO: 97349 - DNA, 20 bp, synthetic construct
  misc_feature 1..20: note = CRISPR gRNA sequence
  source 1..20: mol_type = other DNA
cctgcattacagagcaaagc

SEQ ID NO: 97350 - DNA, 20 bp, synthetic construct
  misc_feature 1..20: note = CRISPR gRNA sequence
  source 1..20: mol_type = other DNA
ctgcattacagagcaaagct

SEQ ID NO: 97351 - DNA, 20 bp, synthetic construct
  misc_feature 1..20: note = CRISPR gRNA sequence
  source 1..20: mol_type = other DNA
gcattacagagcaaagctgg

SEQ ID NO: 97352 - DNA, 20 bp, synthetic construct
  misc_feature 1..20: note = CRISPR gRNA sequence
  source 1..20: mol_type = other DNA
agagcaaagctgggagaacc

SEQ ID NO: 97353 - DNA, 20 bp, synthetic construct
  misc_feature 1..20: note = CRISPR gRNA sequence
  source 1..20: mol_type = other DNA
gagcaaagctgggagaaccg

SEQ ID NO: 97354 - DNA, 20 bp, synthetic construct
  misc_feature 1..20: note = CRISPR gRNA sequence
  source 1..20: mol_type = other DNA
ggagaaccgaggactcaccc

SEQ ID NO: 97355 - DNA, 20 bp, synthetic construct
  misc_feature 1..20: note = CRISPR gRNA sequence
  source 1..20: mol_type = other DNA
gagaaccgaggactcacccc

SEQ ID NO: 97356 - DNA, 20 bp, synthetic construct
  misc_feature 1..20: note = CRISPR gRNA sequence
  source 1..20: mol_type = other DNA
caggaacctcaacttcccct

SEQ ID NO: 97357 - DNA, 20 bp, synthetic construct
  misc_feature 1..20: note = CRISPR gRNA sequence
  source 1..20: mol_type = other DNA
tttgtaaaaatgcacttttg

SEQ ID NO: 97358 - DNA, 20 bp, synthetic construct
  misc_feature 1..20: note = CRISPR gRNA sequence
  source 1..20: mol_type = other DNA
aatgcacttttgtagctttt

SEQ ID NO: 97359 - DNA, 20 bp, synthetic construct
  misc_feature 1..20: note = CRISPR gRNA sequence
  source 1..20: mol_type = other DNA
atataaaaatatttcctacc

SEQ ID NO: 97360 - DNA, 20 bp, synthetic construct
  misc_feature 1..20: note = CRISPR gRNA sequence
  source 1..20: mol_type = other DNA
tgaattgtgactttcatgaa

SEQ ID NO: 97361 - DNA, 20 bp, synthetic construct
  misc_feature 1..20: note = CRISPR gRNA sequence
  source 1..20: mol_type = other DNA
tgtgactttcatgaaaagat

SEQ ID NO: 97362 - DNA, 20 bp, synthetic construct
  misc_feature 1..20: note = CRISPR gRNA sequence
  source 1..20: mol_type = other DNA
ctttcatgaaaagatgagcc

SEQ ID NO: 97363 - DNA, 20 bp, synthetic construct
  misc_feature 1..20: note = CRISPR gRNA sequence
  source 1..20: mol_type = other DNA
tttcatgaaaagatgagcct

SEQ ID NO: 97364 - DNA, 20 bp, synthetic construct
  misc_feature 1..20: note = CRISPR gRNA sequence
  source 1..20: mol_type = other DNA
tgaaaagatgagcctgggca

SEQ ID NO: 97365 - DNA, 20 bp, synthetic construct
  misc_feature 1..20: note = CRISPR gRNA sequence
  source 1..20: mol_type = other DNA
aaagatgagcctgggcatgg

SEQ ID NO: 97366 - DNA, 20 bp, synthetic construct
  misc_feature 1..20: note = CRISPR gRNA sequence
  source 1..20: mol_type = other DNA
gtggctcacacctataatcc

SEQ ID NO: 97367 - DNA, 20 bp, synthetic construct
  misc_feature 1..20: note = CRISPR gRNA sequence
  source 1..20: mol_type = other DNA
cacctataatcccagcactt

SEQ ID NO: 97368 - DNA, 20 bp, synthetic construct
  misc_feature 1..20: note = CRISPR gRNA sequence
  source 1..20: mol_type = other DNA
acctataatcccagcacttt

SEQ ID NO: 97369 - DNA, 20 bp, synthetic construct
  misc_feature 1..20: note = CRISPR gRNA sequence
  source 1..20: mol_type = other DNA
ctataatcccagcactttgg

SEQ ID NO: 97370 - DNA, 20 bp, synthetic construct
  misc_feature 1..20: note = CRISPR gRNA sequence
  source 1..20: mol_type = other DNA
tataatcccagcactttggg

SEQ ID NO: 97371 - DNA, 20 bp, synthetic construct
  misc_feature 1..20: note = CRISPR gRNA sequence
  source 1..20: mol_type = other DNA
tcccagcactttgggaggtc

SEQ ID NO: 97372 - DNA, 20 bp, synthetic construct
  misc_feature 1..20: note = CRISPR gRNA sequence
  source 1..20: mol_type = other DNA
cagcactttgggaggtccag

SEQ ID NO: 97373 - DNA, 20 bp, synthetic construct
  misc_feature 1..20: note = CRISPR gRNA sequence
  source 1..20: mol_type = other DNA
agcactttgggaggtccagt

SEQ ID NO: 97374 - DNA, 20 bp, synthetic construct
  misc_feature 1..20: note = CRISPR gRNA sequence
  source 1..20: mol_type = other DNA
gcactttgggaggtccagtg

SEQ ID NO: 97375 - DNA, 20 bp, synthetic construct
  misc_feature 1..20: note = CRISPR gRNA sequence
  source 1..20: mol_type = other DNA
actttgggaggtccagtggg

SEQ ID NO: 97376 - DNA, 20 bp, synthetic construct
  misc_feature 1..20: note = CRISPR gRNA sequence
  source 1..20: mol_type = other DNA
ctttgggaggtccagtgggg

SEQ ID NO: 97377 - DNA, 20 bp, synthetic construct
  misc_feature 1..20: note = CRISPR gRNA sequence
  source 1..20: mol_type = other DNA
tccagtggggaggactgctt

SEQ ID NO: 97378 - DNA, 20 bp, synthetic construct
  misc_feature 1..20: note = CRISPR gRNA sequence
  source 1..20: mol_type = other DNA
tggggaggactgcttgagct

SEQ ID NO: 97379 - DNA, 20 bp, synthetic construct
  misc_feature 1..20: note = CRISPR gRNA sequence
  source 1..20: mol_type = other DNA
ggggaggactgcttgagctc

SEQ ID NO: 97380 - DNA, 20 bp, synthetic construct
  misc_feature 1..20: note = CRISPR gRNA sequence
  source 1..20: mol_type = other DNA
ctgcttgagctcaggaattt

SEQ ID NO: 97381 - DNA, 20 bp, synthetic construct
  misc_feature 1..20: note = CRISPR gRNA sequence
  source 1..20: mol_type = other DNA
tgcttgagctcaggaatttg

SEQ ID NO: 97382 - DNA, 20 bp, synthetic construct
  misc_feature 1..20: note = CRISPR gRNA sequence
  source 1..20: mol_type = other DNA
tgagctcaggaatttgaggc

SEQ ID NO: 97383 - DNA, 20 bp, synthetic construct
  misc_feature 1..20: note = CRISPR gRNA sequence
  source 1..20: mol_type = other DNA
tcaggaatttgaggccagct

SEQ ID NO: 97384 - DNA, 20 bp, synthetic construct
  misc_feature 1..20: note = CRISPR gRNA sequence
  source 1..20: mol_type = other DNA
caggaatttgaggccagctt

SEQ ID NO: 97385 - DNA, 20 bp, synthetic construct
  misc_feature 1..20: note = CRISPR gRNA sequence
  source 1..20: mol_type = other DNA
tttgaggccagcttgggcaa

SEQ ID NO: 97386 - DNA, 20 bp, synthetic construct
  misc_feature 1..20: note = CRISPR gRNA sequence
  source 1..20: mol_type = other DNA
tgaggccagcttgggcaaca

SEQ ID NO: 97387 - DNA, 20 bp, synthetic construct
  misc_feature 1..20: note = CRISPR gRNA sequence
  source 1..20: mol_type = other DNA
taccaaaaaaatttaaaaat

SEQ ID NO: 97388 - DNA, 20 bp, synthetic construct
  misc_feature 1..20: note = CRISPR gRNA sequence
  source 1..20: mol_type = other DNA
accaaaaaaatttaaaaatt

SEQ ID NO: 97389 - DNA, 20 bp, synthetic construct
  misc_feature 1..20: note = CRISPR gRNA sequence
  source 1..20: mol_type = other DNA
aaaaaatttaaaaattaggc

SEQ ID NO: 97390 - DNA, 20 bp, synthetic construct
  misc_feature 1..20: note = CRISPR gRNA sequence
  source 1..20: mol_type = other DNA
aaaaatttaaaaattaggct

SEQ ID NO: 97391 - DNA, 20 bp, synthetic construct
  misc_feature 1..20: note = CRISPR gRNA sequence
  source 1..20: mol_type = other DNA
tttaaaaattaggctgggct

SEQ ID NO: 97392 - DNA, 20 bp, synthetic construct
  misc_feature 1..20: note = CRISPR gRNA sequence
  source 1..20: mol_type = other DNA
aaaaattaggctgggcttgg

SEQ ID NO: 97393 - DNA, 20 bp, synthetic construct
  misc_feature 1..20: note = CRISPR gRNA sequence
  source 1..20: mol_type = other DNA
gtggctcacacctgtaatcc

SEQ ID NO: 97394 - DNA, 20 bp, synthetic construct
  misc_feature 1..20: note = CRISPR gRNA sequence
  source 1..20: mol_type = other DNA
cacctgtaatcctagcactt

SEQ ID NO: 97395 - DNA, 20 bp, synthetic construct
  misc_feature 1..20: note = CRISPR gRNA sequence
  source 1..20: mol_type = other DNA
acctgtaatcctagcacttt

SEQ ID NO: 97396 - DNA, 20 bp, synthetic construct
  misc_feature 1..20: note = CRISPR gRNA sequence
  source 1..20: mol_type = other DNA
ctgtaatcctagcactttgg

SEQ ID NO: 97397 - DNA, 20 bp, synthetic construct
  misc_feature 1..20: note = CRISPR gRNA sequence
  source 1..20: mol_type = other DNA
tgtaatcctagcactttggg

SEQ ID NO: 97398 - DNA, 20 bp, synthetic construct
  misc_feature 1..20: note = CRISPR gRNA sequence
  source 1..20: mol_type = other DNA
tcctagcactttgggaggcc

SEQ ID NO: 97399 - DNA, 20 bp, synthetic construct
  misc_feature 1..20: note = CRISPR gRNA sequence
  source 1..20: mol_type = other DNA
cctagcactttgggaggcca

SEQ ID NO: 97400 - DNA, 20 bp, synthetic construct
  misc_feature 1..20: note = CRISPR gRNA sequence
  source 1..20: mol_type = other DNA
agcactttgggaggccaagg

SEQ ID NO: 97401 - DNA, 20 bp, synthetic construct
  misc_feature 1..20: note = CRISPR gRNA sequence
  source 1..20: mol_type = other DNA
gcactttgggaggccaaggt

SEQ ID NO: 97402 - DNA, 20 bp, synthetic construct
  misc_feature 1..20: note = CRISPR gRNA sequence
  source 1..20: mol_type = other DNA
ctttgggaggccaaggtagg

SEQ ID NO: 97403 - DNA, 20 bp, synthetic construct
  misc_feature 1..20: note = CRISPR gRNA sequence
  source 1..20: mol_type = other DNA
caaggtaggtggatcacttg

SEQ ID NO: 97404 - DNA, 20 bp, synthetic construct
  misc_feature 1..20: note = CRISPR gRNA sequence
  source 1..20: mol_type = other DNA
gtaggtggatcacttgaagt

SEQ ID NO: 97405 - DNA, 20 bp, synthetic construct
  misc_feature 1..20: note = CRISPR gRNA sequence
  source 1..20: mol_type = other DNA
taggtggatcacttgaagtc

SEQ ID NO: 97406 - DNA, 20 bp, synthetic construct
  misc_feature 1..20: note = CRISPR gRNA sequence
  source 1..20: mol_type = other DNA
tggatcacttgaagtcagga

SEQ ID NO: 97407 - DNA, 20 bp, synthetic construct
  misc_feature 1..20: note = CRISPR gRNA sequence
  source 1..20: mol_type = other DNA
ggatcacttgaagtcaggaa

SEQ ID NO: 97408 - DNA, 20 bp, synthetic construct
  misc_feature 1..20: note = CRISPR gRNA sequence
  source 1..20: mol_type = other DNA
cacttgaagtcaggaaaggc

SEQ ID NO: 97409 - DNA, 20 bp, synthetic construct
  misc_feature 1..20: note = CRISPR gRNA sequence
  source 1..20: mol_type = other DNA
tctactaaaactacaaaaat

SEQ ID NO: 97410 - DNA, 20 bp, synthetic construct
  misc_feature 1..20: note = CRISPR gRNA sequence
  source 1..20: mol_type = other DNA
ctaaaactacaaaaattagc

SEQ ID NO: 97411 - DNA, 20 bp, synthetic construct
  misc_feature 1..20: note = CRISPR gRNA sequence
  source 1..20: mol_type = other DNA
taaaactacaaaaattagcc

SEQ ID NO: 97412 - DNA, 20 bp, synthetic construct
  misc_feature 1..20: note = CRISPR gRNA sequence
  source 1..20: mol_type = other DNA
ctacaaaaattagccaggtg

SEQ ID NO: 97413 - DNA, 20 bp, synthetic construct
  misc_feature 1..20: note = CRISPR gRNA sequence
  source 1..20: mol_type = other DNA
aaaaattagccaggtgcagc

SEQ ID NO: 97414 - DNA, 20 bp, synthetic construct
  misc_feature 1..20: note = CRISPR gRNA sequence
  source 1..20: mol_type = other DNA
aaaattagccaggtgcagcc

SEQ ID NO: 97415 - DNA, 20 bp, synthetic construct
  misc_feature 1..20: note = CRISPR gRNA sequence
  source 1..20: mol_type = other DNA
tagccaggtgcagccgggtg

SEQ ID NO: 97416 - DNA, 20 bp, synthetic construct
  misc_feature 1..20: note = CRISPR gRNA sequence
  source 1..20: mol_type = other DNA
ccaggtgcagccgggtgtgg

SEQ ID NO: 97417 - DNA, 20 bp, synthetic construct
  misc_feature 1..20: note = CRISPR gRNA sequence
  source 1..20: mol_type = other DNA
gtggctcatgcctgtaatcc

SEQ ID NO: 97418 - DNA, 20 bp, synthetic construct
  misc_feature 1..20: note = CRISPR gRNA sequence
  source 1..20: mol_type = other DNA
tgcctgtaatcccagcactt

SEQ ID NO: 97419 - DNA, 20 bp, synthetic construct
  misc_feature 1..20: note = CRISPR gRNA sequence
  source 1..20: mol_type = other DNA
gcctgtaatcccagcacttt

SEQ ID NO: 97420 - DNA, 20 bp, synthetic construct
  misc_feature 1..20: note = CRISPR gRNA sequence
  source 1..20: mol_type = other DNA
tgtaatcccagcactttggg

SEQ ID NO: 97421 - DNA, 20 bp, synthetic construct
  misc_feature 1..20: note = CRISPR gRNA sequence
  source 1..20: mol_type = other DNA
tcccagcactttgggaagct

SEQ ID NO: 97422 - DNA, 20 bp, synthetic construct
  misc_feature 1..20: note = CRISPR gRNA sequence
  source 1..20: mol_type = other DNA
cccagcactttgggaagctg

SEQ ID NO: 97423 - DNA, 20 bp, synthetic construct
  misc_feature 1..20: note = CRISPR gRNA sequence
  source 1..20: mol_type = other DNA
agcactttgggaagctgagg

SEQ ID NO: 97424 - DNA, 20 bp, synthetic construct
  misc_feature 1..20: note = CRISPR gRNA sequence
  source 1..20: mol_type = other DNA
gcactttgggaagctgaggc

SEQ ID NO: 97425 - DNA, 20 bp, synthetic construct
  misc_feature 1..20: note = CRISPR gRNA sequence
  source 1..20: mol_type = other DNA
ctttgggaagctgaggcggg

SEQ ID NO: 97426 - DNA, 20 bp, synthetic construct
  misc_feature 1..20: note = CRISPR gRNA sequence
  source 1..20: mol_type = other DNA
ctgaggcgggtggatcacct

SEQ ID NO: 97427 - DNA, 20 bp, synthetic construct
  misc_feature 1..20: note = CRISPR gRNA sequence
  source 1..20: mol_type = other DNA
tgaggcgggtggatcacctg

SEQ ID NO: 97428 - DNA, 20 bp, synthetic construct
  misc_feature 1..20: note = CRISPR gRNA sequence
  source 1..20: mol_type = other DNA
gcgggtggatcacctgaggt

SEQ ID NO: 97429 - DNA, 20 bp, synthetic construct
  misc_feature 1..20: note = CRISPR gRNA sequence
  source 1..20: mol_type = other DNA
cgggtggatcacctgaggtc

SEQ ID NO: 97430 - DNA, 20 bp, synthetic construct
  misc_feature 1..20: note = CRISPR gRNA sequence
  source 1..20: mol_type = other DNA
ggtggatcacctgaggtcgg

SEQ ID NO: 97431 - DNA, 20 bp, synthetic construct
  misc_feature 1..20: note = CRISPR gRNA sequence
  source 1..20: mol_type = other DNA
tcacctgaggtcgggagttt

SEQ ID NO: 97432 - DNA, 20 bp, synthetic construct
  misc_feature 1..20: note = CRISPR gRNA sequence
  source 1..20: mol_type = other DNA
ttgagatcacctgaccaaca

SEQ ID NO: 97433 - DNA, 20 bp, synthetic construct
  misc_feature 1..20: note = CRISPR gRNA sequence
  source 1..20: mol_type = other DNA
gagatcacctgaccaacatg

SEQ ID NO: 97434 - DNA, 20 bp, synthetic construct
  misc_feature 1..20: note = CRISPR gRNA sequence
  source 1..20: mol_type = other DNA
ctactaaaaatgcaaaaaat

SEQ ID NO: 97435 - DNA, 20 bp, synthetic construct
  misc_feature 1..20: note = CRISPR gRNA sequence
  source 1..20: mol_type = other DNA
taaaaatgcaaaaaattagt

SEQ ID NO: 97436 - DNA, 20 bp, synthetic construct
  misc_feature 1..20: note = CRISPR gRNA sequence
  source 1..20: mol_type = other DNA
aaaaatgcaaaaaattagtt

SEQ ID NO: 97437 - DNA, 20 bp, synthetic construct
  misc_feature 1..20: note = CRISPR gRNA sequence
  source 1..20: mol_type = other DNA
tgcaaaaaattagttgggca

SEQ ID NO: 97438 - DNA, 20 bp, synthetic construct
  misc_feature 1..20: note = CRISPR gRNA sequence
  source 1..20: mol_type = other DNA
aaaaaattagttgggcatgg

SEQ ID NO: 97439 - DNA, 20 bp, synthetic construct
  misc_feature 1..20: note = CRISPR gRNA sequence
  source 1..20: mol_type = other DNA
gtggtgcatgcctgtaatcc

SEQ ID NO: 97440 - DNA, 20 bp, synthetic construct
  misc_feature 1..20: note = CRISPR gRNA sequence
  source 1..20: mol_type = other DNA
tgcctgtaatcccagctact

SEQ ID NO: 97441 - DNA, 20 bp, synthetic construct
  misc_feature 1..20: note = CRISPR gRNA sequence
  source 1..20: mol_type = other DNA
gcctgtaatcccagctactt

SEQ ID NO: 97442 - DNA, 20 bp, synthetic construct
  misc_feature 1..20: note = CRISPR gRNA sequence
  source 1..20: mol_type = other DNA
ctgtaatcccagctacttgg

SEQ ID NO: 97443 - DNA, 20 bp, synthetic construct
  misc_feature 1..20: note = CRISPR gRNA sequence
  source 1..20: mol_type = other DNA
tgtaatcccagctacttggg

SEQ ID NO: 97444 - DNA, 20 bp, synthetic construct
  misc_feature 1..20: note = CRISPR gRNA sequence
  source 1..20: mol_type = other DNA
tcccagctacttgggaggct

SEQ ID NO: 97445 - DNA, 20 bp, synthetic construct
  misc_feature 1..20: note = CRISPR gRNA sequence
  source 1..20: mol_type = other DNA
cccagctacttgggaggctg

SEQ ID NO: 97446 - DNA, 20 bp, synthetic construct
  misc_feature 1..20: note = CRISPR gRNA sequence
  source 1..20: mol_type = other DNA
agctacttgggaggctgagg

SEQ ID NO: 97447 - DNA, 20 bp, synthetic construct
  misc_feature 1..20: note = CRISPR gRNA sequence
  source 1..20: mol_type = other DNA
gctacttgggaggctgaggc

SEQ ID NO: 97448 - DNA, 20 bp, synthetic construct
  misc_feature 1..20: note = CRISPR gRNA sequence
  source 1..20: mol_type = other DNA
tacttgggaggctgaggcag

SEQ ID NO: 97449 - DNA, 20 bp, synthetic construct
  misc_feature 1..20: note = CRISPR gRNA sequence
  source 1..20: mol_type = other DNA
gcaggagaattgcttgaacc

SEQ ID NO: 97450 - DNA, 20 bp, synthetic construct
  misc_feature 1..20: note = CRISPR gRNA sequence
  source 1..20: mol_type = other DNA
caggagaattgcttgaacct

SEQ ID NO: 97451 - DNA, 20 bp, synthetic construct
  misc_feature 1..20: note = CRISPR gRNA sequence
  source 1..20: mol_type = other DNA
ggagaattgcttgaacctgg

SEQ ID NO: 97452 - DNA, 20 bp, synthetic construct
  misc_feature 1..20: note = CRISPR gRNA sequence
  source 1..20: mol_type = other DNA
gagaattgcttgaacctggg

SEQ ID NO: 97453 - DNA, 20 bp, synthetic construct
  misc_feature 1..20: note = CRISPR gRNA sequence
  source 1..20: mol_type = other DNA
aattgcttgaacctgggagg

SEQ ID NO: 97454 - DNA, 20 bp, synthetic construct
  misc_feature 1..20: note = CRISPR gRNA sequence
  source 1..20: mol_type = other DNA
tgcttgaacctgggaggcgg

SEQ ID NO: 97455 - DNA, 20 bp, synthetic construct
  misc_feature 1..20: note = CRISPR gRNA sequence
  source 1..20: mol_type = other DNA
aacctgggaggcggaagttg

SEQ ID NO: 97456 - DNA, 20 bp, synthetic construct
  misc_feature 1..20: note = CRISPR gRNA sequence
  source 1..20: mol_type = other DNA
tgggaggcggaagttgcagt

SEQ ID NO: 97457 - DNA, 20 bp, synthetic construct
  misc_feature 1..20: note = CRISPR gRNA sequence
  source 1..20: mol_type = other DNA
ggcggaagttgcagtgagcc

SEQ ID NO: 97458 - DNA, 20 bp, synthetic construct
  misc_feature 1..20: note = CRISPR gRNA sequence
  source 1..20: mol_type = other DNA
agtgagccgagatcacgcca

SEQ ID NO: 97459 - DNA, 20 bp, synthetic construct
  misc_feature 1..20: note = CRISPR gRNA sequence
  source 1..20: mol_type = other DNA
gagatcacgccatagcactc

SEQ ID NO: 97460 - DNA, 20 bp, synthetic construct
  misc_feature 1..20: note = CRISPR gRNA sequence
  source 1..20: mol_type = other DNA
cacgccatagcactccagcc

SEQ ID NO: 97461 - DNA, 20 bp, synthetic construct
  misc_feature 1..20: note = CRISPR gRNA sequence
  source 1..20: mol_type = other DNA
acgccatagcactccagcct

SEQ ID NO: 97462 - DNA, 20 bp, synthetic construct
  misc_feature 1..20: note = CRISPR gRNA sequence
  source 1..20: mol_type = other DNA
agcactccagcctgggcaac

SEQ ID NO: 97463 - DNA, 20 bp, synthetic construct
  misc_feature 1..20: note = CRISPR gRNA sequence
  source 1..20: mol_type = other DNA
cactccagcctgggcaacaa

SEQ ID NO: 97464 - DNA, 20 bp, synthetic construct
  misc_feature 1..20: note = CRISPR gRNA sequence
  source 1..20: mol_type = other DNA
aaaaaaaaaaaaaaaaaaat

SEQ ID NO: 97465 - DNA, 20 bp, synthetic construct
  misc_feature 1..20: note = CRISPR gRNA sequence
  source 1..20: mol_type = other DNA
aaaaaaaaaaaaaaattagc

SEQ ID NO: 97466 - DNA, 20 bp, synthetic construct
  misc_feature 1..20: note = CRISPR gRNA sequence
  source 1..20: mol_type = other DNA
aaaaaaaaaaaaaattagcc

SEQ ID NO: 97467 - DNA, 20 bp, synthetic construct
  misc_feature 1..20: note = CRISPR gRNA sequence
  source 1..20: mol_type = other DNA
aaaaaaaaattagccaggtg

SEQ ID NO: 97468 - DNA, 20 bp, synthetic construct
  misc_feature 1..20: note = CRISPR gRNA sequence
  source 1..20: mol_type = other DNA
aaaaaattagccaggtgtgg

SEQ ID NO: 97469 - DNA, 20 bp, synthetic construct
  misc_feature 1..20: note = CRISPR gRNA sequence
  source 1..20: mol_type = other DNA
aaattagccaggtgtggtgg

SEQ ID NO: 97470 - DNA, 20 bp, synthetic construct
  misc_feature 1..20: note = CRISPR gRNA sequence
  source 1..20: mol_type = other DNA
aattagccaggtgtggtggc

SEQ ID NO: 97471 - DNA, 20 bp, synthetic construct
  misc_feature 1..20: note = CRISPR gRNA sequence
  source 1..20: mol_type = other DNA
gtggcaggcacttgtaatcc

SEQ ID NO: 97472 - DNA, 20 bp, synthetic construct
  misc_feature 1..20: note = CRISPR gRNA sequence
  source 1..20: mol_type = other DNA
cacttgtaatcccagctatt

SEQ ID NO: 97473 - DNA, 20 bp, synthetic construct
  misc_feature 1..20: note = CRISPR gRNA sequence
  source 1..20: mol_type = other DNA
acttgtaatcccagctattc

SEQ ID NO: 97474 - DNA, 20 bp, synthetic construct
  misc_feature 1..20: note = CRISPR gRNA sequence
  source 1..20: mol_type = other DNA
ttgtaatcccagctattcag

SEQ ID NO: 97475 - DNA, 20 bp, synthetic construct
  misc_feature 1..20: note = CRISPR gRNA sequence
  source 1..20: mol_type = other DNA
tgtaatcccagctattcagg

SEQ ID NO: 97476 - DNA, 20 bp, synthetic construct
  misc_feature 1..20: note = CRISPR gRNA sequence
  source 1..20: mol_type = other DNA
tcccagctattcaggaggct

SEQ ID NO: 97477 - DNA, 20 bp, synthetic construct
  misc_feature 1..20: note = CRISPR gRNA sequence
  source 1..20: mol_type = other DNA
cccagctattcaggaggctg

SEQ ID NO: 97478 - DNA, 20 bp, synthetic construct
  misc_feature 1..20: note = CRISPR gRNA sequence
  source 1..20: mol_type = other DNA
agctattcaggaggctgagg

SEQ ID NO: 97479 - DNA, 20 bp, synthetic construct
  misc_feature 1..20: note = CRISPR gRNA sequence
  source 1..20: mol_type = other DNA
gctattcaggaggctgaggc

SEQ ID NO: 97480 - DNA, 20 bp, synthetic construct
  misc_feature 1..20: note = CRISPR gRNA sequence
  source 1..20: mol_type = other DNA
tattcaggaggctgaggcag

SEQ ID NO: 97481 - DNA, 20 bp, synthetic construct
  misc_feature 1..20: note = CRISPR gRNA sequence
  source 1..20: mol_type = other DNA
aggcaggagaattgtttgcc

SEQ ID NO: 97482 - DNA, 20 bp, synthetic construct
  misc_feature 1..20: note = CRISPR gRNA sequence
  source 1..20: mol_type = other DNA
ggcaggagaattgtttgcct

SEQ ID NO: 97483 - DNA, 20 bp, synthetic construct
  misc_feature 1..20: note = CRISPR gRNA sequence
  source 1..20: mol_type = other DNA
caggagaattgtttgcctgg

SEQ ID NO: 97484 - DNA, 20 bp, synthetic construct
  misc_feature 1..20: note = CRISPR gRNA sequence
  source 1..20: mol_type = other DNA
aggagaattgtttgcctggg

SEQ ID NO: 97485 - DNA, 20 bp, synthetic construct
  misc_feature 1..20: note = CRISPR gRNA sequence
  source 1..20: mol_type = other DNA
agaattgtttgcctgggagg

SEQ ID NO: 97486 - DNA, 20 bp, synthetic construct
  misc_feature 1..20: note = CRISPR gRNA sequence
  source 1..20: mol_type = other DNA
aattgtttgcctgggaggca

SEQ ID NO: 97487 - DNA, 20 bp, synthetic construct
  misc_feature 1..20: note = CRISPR gRNA sequence
  source 1..20: mol_type = other DNA
attgtttgcctgggaggcag

SEQ ID NO: 97488 - DNA, 20 bp, synthetic construct
  misc_feature 1..20: note = CRISPR gRNA sequence
  source 1..20: mol_type = other DNA
tgcctgggaggcagaggttg

SEQ ID NO: 97489 - DNA, 20 bp, synthetic construct
  misc_feature 1..20: note = CRISPR gRNA sequence
  source 1..20: mol_type = other DNA
tgggaggcagaggttgcagt

SEQ ID NO: 97490 - DNA, 20 bp, synthetic construct
  misc_feature 1..20: note = CRISPR gRNA sequence
  source 1..20: mol_type = other DNA
ggcagaggttgcagtgagcc

SEQ ID NO: 97491 - DNA, 20 bp, synthetic construct
  misc_feature 1..20: note = CRISPR gRNA sequence
  source 1..20: mol_type = other DNA
gagattgtgccactgcactc

SEQ ID NO: 97492 - DNA, 20 bp, synthetic construct
  misc_feature 1..20: note = CRISPR gRNA sequence
  source 1..20: mol_type = other DNA
tgtgccactgcactccagcc

SEQ ID NO: 97493 - DNA, 20 bp, synthetic construct
  misc_feature 1..20: note = CRISPR gRNA sequence
  source 1..20: mol_type = other DNA
gtgccactgcactccagcct

SEQ ID NO: 97494 - DNA, 20 bp, synthetic construct
  misc_feature 1..20: note = CRISPR gRNA sequence
  source 1..20: mol_type = other DNA
ctgcactccagcctgggtga

SEQ ID NO: 97495 - DNA, 20 bp, synthetic construct
  misc_feature 1..20: note = CRISPR gRNA sequence
  source 1..20: mol_type = other DNA
gcactccagcctgggtgaca

SEQ ID NO: 97496 - DNA, 20 bp, synthetic construct
  misc_feature 1..20: note = CRISPR gRNA sequence
  source 1..20: mol_type = other DNA
tccagcctgggtgacagagc

SEQ ID NO: 97497 - DNA, 20 bp, synthetic construct
  misc_feature 1..20: note = CRISPR gRNA sequence
  source 1..20: mol_type = other DNA
gtctcaaaaaataaataaaa

SEQ ID NO: 97498 - DNA, 20 bp, synthetic construct
  misc_feature 1..20: note = CRISPR gRNA sequence
  source 1..20: mol_type = other DNA
ataaaaaagattttaaaaat

SEQ ID NO: 97499 - DNA, 20 bp, synthetic construct
  misc_feature 1..20: note = CRISPR gRNA sequence
  source 1..20: mol_type = other DNA
aaaagattttaaaaattagc

SEQ ID NO: 97500 - DNA, 20 bp, synthetic construct
  misc_feature 1..20: note = CRISPR gRNA sequence
  source 1..20: mol_type = other DNA
aaagattttaaaaattagct

SEQ ID NO: 97501 - DNA, 20 bp, synthetic construct
  misc_feature 1..20: note = CRISPR gRNA sequence
  source 1..20: mol_type = other DNA
gattttaaaaattagctggg

SEQ ID NO: 97502 - DNA, 20 bp, synthetic construct
  misc_feature 1..20: note = CRISPR gRNA sequence
  source 1..20: mol_type = other DNA
ttttaaaaattagctgggta

SEQ ID NO: 97503 - DNA, 20 bp, synthetic construct
  misc_feature 1..20: note = CRISPR gRNA sequence
  source 1..20: mol_type = other DNA
taaaaattagctgggtagag

SEQ ID NO: 97504 - DNA, 20 bp, synthetic construct
  misc_feature 1..20: note = CRISPR gRNA sequence
  source 1..20: mol_type = other DNA
ggtagagtggtacatgcctg

SEQ ID NO: 97505 - DNA, 20 bp, synthetic construct
  misc_feature 1..20: note = CRISPR gRNA sequence
  source 1..20: mol_type = other DNA
gtggtacatgcctgtagtcc

SEQ ID NO: 97506 - DNA, 20 bp, synthetic construct
  misc_feature 1..20: note = CRISPR gRNA sequence
  source 1..20: mol_type = other DNA
tgcctgtagtcccagctact

SEQ ID NO: 97507 - DNA, 20 bp, synthetic construct
  misc_feature 1..20: note = CRISPR gRNA sequence
  source 1..20: mol_type = other DNA
gcctgtagtcccagctactc

SEQ ID NO: 97508 - DNA, 20 bp, synthetic construct
  misc_feature 1..20: note = CRISPR gRNA sequence
  source 1..20: mol_type = other DNA
ctgtagtcccagctactcag

SEQ ID NO: 97509 - DNA, 20 bp, synthetic construct
  misc_feature 1..20: note = CRISPR gRNA sequence
  source 1..20: mol_type = other DNA
tgtagtcccagctactcagg

SEQ ID NO: 97510 - DNA, 20 bp, synthetic construct
  misc_feature 1..20: note = CRISPR gRNA sequence
  source 1..20: mol_type = other DNA
gtcccagctactcaggaggc

SEQ ID NO: 97511 - DNA, 20 bp, synthetic construct
  misc_feature 1..20: note = CRISPR gRNA sequence
  source 1..20: mol_type = other DNA
tcccagctactcaggaggct

SEQ ID NO: 97512 - DNA, 20 bp, synthetic construct
  misc_feature 1..20: note = CRISPR gRNA sequence
  source 1..20: mol_type = other DNA
cccagctactcaggaggctg

SEQ ID NO: 97513 - DNA, 20 bp, synthetic construct
  misc_feature 1..20: note = CRISPR gRNA sequence
  source 1..20: mol_type = other DNA
agctactcaggaggctgggg

SEQ ID NO: 97514 - DNA, 20 bp, synthetic construct
  misc_feature 1..20: note = CRISPR gRNA sequence
  source 1..20: mol_type = other DNA
tactcaggaggctggggaag

SEQ ID NO: 97515 - DNA, 20 bp, synthetic construct
  misc_feature 1..20: note = CRISPR gRNA sequence
  source 1..20: mol_type = other DNA
actcaggaggctggggaaga

SEQ ID NO: 97516 - DNA, 20 bp, synthetic construct
  misc_feature 1..20: note = CRISPR gRNA sequence
  source 1..20: mol_type = other DNA
ctggggaagaaggatcactt

SEQ ID NO: 97517 - DNA, 20 bp, synthetic construct
  misc_feature 1..20: note = CRISPR gRNA sequence
  source 1..20: mol_type = other DNA
gaagaaggatcacttgagcc

SEQ ID NO: 97518 - DNA, 20 bp, synthetic construct
  misc_feature 1..20: note = CRISPR gRNA sequence
  source 1..20: mol_type = other DNA
aagaaggatcacttgagccc

SEQ ID NO: 97519 - DNA, 20 bp, synthetic construct
  misc_feature 1..20: note = CRISPR gRNA sequence
  source 1..20: mol_type = other DNA
gaaggatcacttgagcccag

SEQ ID NO: 97520 - DNA, 20 bp, synthetic construct
  misc_feature 1..20: note = CRISPR gRNA sequence
  source 1..20: mol_type = other DNA
tcacttgagcccaggagttt

SEQ ID NO: 97521 - DNA, 20 bp, synthetic construct
  misc_feature 1..20: note = CRISPR gRNA sequence
  source 1..20: mol_type = other DNA
tgagcccaggagtttgagac

SEQ ID NO: 97522 - DNA, 20 bp, synthetic construct
  misc_feature 1..20: note = CRISPR gRNA sequence
  source 1..20: mol_type = other DNA
ccaggagtttgagaccagcc

SEQ ID NO: 97523 - DNA, 20 bp, synthetic construct
  misc_feature 1..20: note = CRISPR gRNA sequence
  source 1..20: mol_type = other DNA
caggagtttgagaccagcct

SEQ ID NO: 97524 - DNA, 20 bp, synthetic construct
  misc_feature 1..20: note = CRISPR gRNA sequence
  source 1..20: mol_type = other DNA
tgagaccagcctgggcaaca

SEQ ID NO: 97525 - DNA, 20 bp, synthetic construct
  misc_feature 1..20: note = CRISPR gRNA sequence
  source 1..20: mol_type = other DNA
accagcctgggcaacatagc

SEQ ID NO: 97526 - DNA, 20 bp, synthetic construct
  misc_feature 1..20: note = CRISPR gRNA sequence
  source 1..20: mol_type = other DNA
cttctaaaaaaacaacaaca

SEQ ID NO: 97527 - DNA, 20 bp, synthetic construct
  misc_feature 1..20: note = CRISPR gRNA sequence
  source 1..20: mol_type = other DNA
taaaaaaacaacaacacagc

SEQ ID NO: 97528 - DNA, 20 bp, synthetic construct
  misc_feature 1..20: note = CRISPR gRNA sequence
  source 1..20: mol_type = other DNA
aaaaaaacaacaacacagcc

SEQ ID NO: 97529 - DNA, 20 bp, synthetic construct
  misc_feature 1..20: note = CRISPR gRNA sequence
  source 1..20: mol_type = other DNA
aacaacaacacagccaggcg

SEQ ID NO: 97530 - DNA, 20 bp, synthetic construct
  misc_feature 1..20: note = CRISPR gRNA sequence
  source 1..20: mol_type = other DNA
aacaacacagccaggcgtgg

SEQ ID NO: 97531 - DNA, 20 bp, synthetic construct
  misc_feature 1..20: note = CRISPR gRNA sequence
  source 1..20: mol_type = other DNA
gtggctcacacctgtaatcc

SEQ ID NO: 97532 - DNA, 20 bp, synthetic construct
  misc_feature 1..20: note = CRISPR gRNA sequence
  source 1..20: mol_type = other DNA
cacctgtaatcccagcactt

SEQ ID NO: 97533 - DNA, 20 bp, synthetic construct
  misc_feature 1..20: note = CRISPR gRNA sequence
  source 1..20: mol_type = other DNA
acctgtaatcccagcacttt

SEQ ID NO: 97534 - DNA, 20 bp, synthetic construct
  misc_feature 1..20: note = CRISPR gRNA sequence
  source 1..20: mol_type = other DNA
ctgtaatcccagcactttgg

SEQ ID NO: 97535 - DNA, 20 bp, synthetic construct
  misc_feature 1..20: note = CRISPR gRNA sequence
  source 1..20: mol_type = other DNA
tgtaatcccagcactttggg

SEQ ID NO: 97536 - DNA, 20 bp, synthetic construct
  misc_feature 1..20: note = CRISPR gRNA sequence
  source 1..20: mol_type = other DNA
agcactttgggaggccaaca

SEQ ID NO: 97537 - DNA, 20 bp, synthetic construct
  misc_feature 1..20: note = CRISPR gRNA sequence
  source 1..20: mol_type = other DNA
gcactttgggaggccaacac

SEQ ID NO: 97538 - DNA, 20 bp, synthetic construct
  misc_feature 1..20: note = CRISPR gRNA sequence
  source 1..20: mol_type = other DNA
ctttgggaggccaacacagg

SEQ ID NO: 97539 - DNA, 20 bp, synthetic construct
  misc_feature 1..20: note = CRISPR gRNA sequence
  source 1..20: mol_type = other DNA
ggccaacacaggcggatcac

SEQ ID NO: 97540 - DNA, 20 bp, synthetic construct
  misc_feature 1..20: note = CRISPR gRNA sequence
  source 1..20: mol_type = other DNA
gccaacacaggcggatcaca

SEQ ID NO: 97541 - DNA, 20 bp, synthetic construct
  misc_feature 1..20: note = CRISPR gRNA sequence
  source 1..20: mol_type = other DNA
acacaggcggatcacaaggt

SEQ ID NO: 97542 - DNA, 20 bp, synthetic construct
  misc_feature 1..20: note = CRISPR gRNA sequence
  source 1..20: mol_type = other DNA
cacaggcggatcacaaggtc

SEQ ID NO: 97543 - DNA, 20 bp, synthetic construct
  misc_feature 1..20: note = CRISPR gRNA sequence
  source 1..20: mol_type = other DNA
caggcggatcacaaggtcag

SEQ ID NO: 97544 - DNA, 20 bp, synthetic construct
  misc_feature 1..20: note = CRISPR gRNA sequence
  source 1..20: mol_type = other DNA
gatcacaaggtcaggagttc

SEQ ID NO: 97545 - DNA, 20 bp, synthetic construct
  misc_feature 1..20: note = CRISPR gRNA sequence
  source 1..20: mol_type = other DNA
caaggtcaggagttcaagac

SEQ ID NO: 97546 - DNA, 20 bp, synthetic construct
  misc_feature 1..20: note = CRISPR gRNA sequence
  source 1..20: mol_type = other DNA
caagaccagcctgaccaaca

SEQ ID NO: 97547 - DNA, 20 bp, synthetic construct
  misc_feature 1..20: note = CRISPR gRNA sequence
  source 1..20: mol_type = other DNA
tctactaaaaatataaaaat

SEQ ID NO: 97548 - DNA, 20 bp, synthetic construct
  misc_feature 1..20: note = CRISPR gRNA sequence
  source 1..20: mol_type = other DNA
ctaaaaatataaaaattagc

SEQ ID NO: 97549 - DNA, 20 bp, synthetic construct
  misc_feature 1..20: note = CRISPR gRNA sequence
  source 1..20: mol_type = other DNA
taaaaatataaaaattagcc

SEQ ID NO: 97550 - DNA, 20 bp, synthetic construct
  misc_feature 1..20: note = CRISPR gRNA sequence
  source 1..20: mol_type = other DNA
taaaaattagccgggcgtca

SEQ ID NO: 97551 - DNA, 20 bp, synthetic construct
  misc_feature 1..20: note = CRISPR gRNA sequence
  source 1..20: mol_type = other DNA
ggcgtcatggtgtgcacctg

SEQ ID NO: 97552 - DNA, 20 bp, synthetic construct
  misc_feature 1..20: note = CRISPR gRNA sequence
  source 1..20: mol_type = other DNA
atggtgtgcacctgtggtcc

SEQ ID NO: 97553 - DNA, 20 bp, synthetic construct
  misc_feature 1..20: note = CRISPR gRNA sequence
  source 1..20: mol_type = other DNA
cacctgtggtcccagctact

SEQ ID NO: 97554 - DNA, 20 bp, synthetic construct
  misc_feature 1..20: note = CRISPR gRNA sequence
  source 1..20: mol_type = other DNA
acctgtggtcccagctactc

SEQ ID NO: 97555 - DNA, 20 bp, synthetic construct
  misc_feature 1..20: note = CRISPR gRNA sequence
  source 1..20: mol_type = other DNA
ctgtggtcccagctactcag

SEQ ID NO: 97556 - DNA, 20 bp, synthetic construct
  misc_feature 1..20: note = CRISPR gRNA sequence
  source 1..20: mol_type = other DNA
tgtggtcccagctactcagg

SEQ ID NO: 97557 - DNA, 20 bp, synthetic construct
  misc_feature 1..20: note = CRISPR gRNA sequence
  source 1..20: mol_type = other DNA
tcccagctactcaggaggct

SEQ ID NO: 97558 - DNA, 20 bp, synthetic construct
  misc_feature 1..20: note = CRISPR gRNA sequence
  source 1..20: mol_type = other DNA
cccagctactcaggaggctg

SEQ ID NO: 97559 - DNA, 20 bp, synthetic construct
  misc_feature 1..20: note = CRISPR gRNA sequence
  source 1..20: mol_type = other DNA
agctactcaggaggctgagg

SEQ ID NO: 97560 - DNA, 20 bp, synthetic construct
  misc_feature 1..20: note = CRISPR gRNA sequence
  source 1..20: mol_type = other DNA
gctactcaggaggctgaggc

SEQ ID NO: 97561 - DNA, 20 bp, synthetic construct
  misc_feature 1..20: note = CRISPR gRNA sequence
  source 1..20: mol_type = other DNA
tactcaggaggctgaggcag

SEQ ID NO: 97562 - DNA, 20 bp, synthetic construct
  misc_feature 1..20: note = CRISPR gRNA sequence
  source 1..20: mol_type = other DNA
gcaggagaatcgcttgaacc

SEQ ID NO: 97563 - DNA, 20 bp, synthetic construct
  misc_feature 1..20: note = CRISPR gRNA sequence
  source 1..20: mol_type = other DNA
caggagaatcgcttgaacct

SEQ ID NO: 97564 - DNA, 20 bp, synthetic construct
  misc_feature 1..20: note = CRISPR gRNA sequence
  source 1..20: mol_type = other DNA
ggagaatcgcttgaacctgg

SEQ ID NO: 97565 - DNA, 20 bp, synthetic construct
  misc_feature 1..20: note = CRISPR gRNA sequence
  source 1..20: mol_type = other DNA
gagaatcgcttgaacctggg

SEQ ID NO: 97566 - DNA, 20 bp, synthetic construct
  misc_feature 1..20: note = CRISPR gRNA sequence
  source 1..20: mol_type = other DNA
aatcgcttgaacctgggagg

SEQ ID NO: 97567 - DNA, 20 bp, synthetic construct
  misc_feature 1..20: note = CRISPR gRNA sequence
  source 1..20: mol_type = other DNA
cgcttgaacctgggaggtgg

SEQ ID NO: 97568 - DNA, 20 bp, synthetic construct
  misc_feature 1..20: note = CRISPR gRNA sequence
  source 1..20: mol_type = other DNA
aacctgggaggtggaagttg

SEQ ID NO: 97569 - DNA, 20 bp, synthetic construct
  misc_feature 1..20: note = CRISPR gRNA sequence
  source 1..20: mol_type = other DNA
tgggaggtggaagttgcagt

SEQ ID NO: 97570 - DNA, 20 bp, synthetic construct
  misc_feature 1..20: note = CRISPR gRNA sequence
  source 1..20: mol_type = other DNA
ggtggaagttgcagtgagcc

SEQ ID NO: 97571 - DNA, 20 bp, synthetic construct
  misc_feature 1..20: note = CRISPR gRNA sequence
  source 1..20: mol_type = other DNA
gaagttgcagtgagccgaga

SEQ ID NO: 97572 - DNA, 20 bp, synthetic construct
  misc_feature 1..20: note = CRISPR gRNA sequence
  source 1..20: mol_type = other DNA
gagatggcgccattgcactc

SEQ ID NO: 97573 - DNA, 20 bp, synthetic construct
  misc_feature 1..20: note = CRISPR gRNA sequence
  source 1..20: mol_type = other DNA
ggcgccattgcactccagcc

SEQ ID NO: 97574 - DNA, 20 bp, synthetic construct
  misc_feature 1..20: note = CRISPR gRNA sequence
  source 1..20: mol_type = other DNA
gcgccattgcactccagcct

SEQ ID NO: 97575 - DNA, 20 bp, synthetic construct
  misc_feature 1..20: note = CRISPR gRNA sequence
  source 1..20: mol_type = other DNA
ttgcactccagcctgggtga

SEQ ID NO: 97576 - DNA, 20 bp, synthetic construct
  misc_feature 1..20: note = CRISPR gRNA sequence
  source 1..20: mol_type = other DNA
tccagcctgggtgacagcgc

SEQ ID NO: 97577 - DNA, 20 bp, synthetic construct
  misc_feature 1..20: note = CRISPR gRNA sequence
  source 1..20: mol_type = other DNA
tccaaaaaaaaaaaaaaaaa

SEQ ID NO: 97578 - DNA, 20 bp, synthetic construct
  misc_feature 1..20: note = CRISPR gRNA sequence
  source 1..20: mol_type = other DNA
aaaaagcaacaacaaaaaat

SEQ ID NO: 97579 - DNA, 20 bp, synthetic construct
  misc_feature 1..20: note = CRISPR gRNA sequence
  source 1..20: mol_type = other DNA
agcaacaacaaaaaattagc

SEQ ID NO: 97580 - DNA, 20 bp, synthetic construct
  misc_feature 1..20: note = CRISPR gRNA sequence
  source 1..20: mol_type = other DNA
gcaacaacaaaaaattagcc

SEQ ID NO: 97581 - DNA, 20 bp, synthetic construct
  misc_feature 1..20: note = CRISPR gRNA sequence
  source 1..20: mol_type = other DNA
aacaaaaaattagccaggca

SEQ ID NO: 97582 - DNA, 20 bp, synthetic construct
  misc_feature 1..20: note = CRISPR gRNA sequence
  source 1..20: mol_type = other DNA
ggcatggtgacgaatgcctg

SEQ ID NO: 97583 - DNA, 20 bp, synthetic construct
  misc_feature 1..20: note = CRISPR gRNA sequence
  source 1..20: mol_type = other DNA
gtgacgaatgcctgtggtcc

SEQ ID NO: 97584 - DNA, 20 bp, synthetic construct
  misc_feature 1..20: note = CRISPR gRNA sequence
  source 1..20: mol_type = other DNA
tgcctgtggtcccagctact

SEQ ID NO: 97585 - DNA, 20 bp, synthetic construct
  misc_feature 1..20: note = CRISPR gRNA sequence
  source 1..20: mol_type = other DNA
gcctgtggtcccagctactc

SEQ ID NO: 97586 - DNA, 20 bp, synthetic construct
  misc_feature 1..20: note = CRISPR gRNA sequence
  source 1..20: mol_type = other DNA
ctgtggtcccagctactcgg

SEQ ID NO: 97587 - DNA, 20 bp, synthetic construct
  misc_feature 1..20: note = CRISPR gRNA sequence
  source 1..20: mol_type = other DNA
tgtggtcccagctactcggg

SEQ ID NO: 97588 - DNA, 20 bp, synthetic construct
  misc_feature 1..20: note = CRISPR gRNA sequence
  source 1..20: mol_type = other DNA
cccagctactcgggaggctg

SEQ ID NO: 97589 - DNA, 20 bp, synthetic construct
  misc_feature 1..20: note = CRISPR gRNA sequence
  source 1..20: mol_type = other DNA
agctactcgggaggctgtgg

SEQ ID NO: 97590 - DNA, 20 bp, synthetic construct
  misc_feature 1..20: note = CRISPR gRNA sequence
  source 1..20: mol_type = other DNA
gctactcgggaggctgtggt

SEQ ID NO: 97591 - DNA, 20 bp, synthetic construct
  misc_feature 1..20: note = CRISPR gRNA sequence
  source 1..20: mol_type = other DNA
tactcgggaggctgtggtgg

SEQ ID NO: 97592 - DNA, 20 bp, synthetic construct
  misc_feature 1..20: note = CRISPR gRNA sequence
  source 1..20: mol_type = other DNA
actcgggaggctgtggtggg

SEQ ID NO: 97593 - DNA, 20 bp, synthetic construct
  misc_feature 1..20: note = CRISPR gRNA sequence
  source 1..20: mol_type = other DNA
ctgtggtgggaggatcactt

SEQ ID NO: 97594 - DNA, 20 bp, synthetic construct
  misc_feature 1..20: note = CRISPR gRNA sequence
  source 1..20: mol_type = other DNA
gtgggaggatcacttgagcc

SEQ ID NO: 97595 - DNA, 20 bp, synthetic construct
  misc_feature 1..20: note = CRISPR gRNA sequence
  source 1..20: mol_type = other DNA
tgggaggatcacttgagcct

SEQ ID NO: 97596 - DNA, 20 bp, synthetic construct
  misc_feature 1..20: note = CRISPR gRNA sequence
  source 1..20: mol_type = other DNA
ggaggatcacttgagcctgg

SEQ ID NO: 97597 - DNA, 20 bp, synthetic construct
  misc_feature 1..20: note = CRISPR gRNA sequence
  source 1..20: mol_type = other DNA
tcacttgagcctgggagatc

SEQ ID NO: 97598 - DNA, 20 bp, synthetic construct
  misc_feature 1..20: note = CRISPR gRNA sequence
  source 1..20: mol_type = other DNA
cacttgagcctgggagatcg

SEQ ID NO: 97599 - DNA, 20 bp, synthetic construct
  misc_feature 1..20: note = CRISPR gRNA sequence
  source 1..20: mol_type = other DNA
agcctgggagatcgaggctg

SEQ ID NO: 97600 - DNA, 20 bp, synthetic construct
  misc_feature 1..20: note = CRISPR gRNA sequence
  source 1..20: mol_type = other DNA
tgggagatcgaggctgcagt

SEQ ID NO: 97601 - DNA, 20 bp, synthetic construct
  misc_feature 1..20: note = CRISPR gRNA sequence
  source 1..20: mol_type = other DNA
gtgcctgcaccacttcattc

SEQ ID NO: 97602 - DNA, 20 bp, synthetic construct
  misc_feature 1..20: note = CRISPR gRNA sequence
  source 1..20: mol_type = other DNA
tgcaccacttcattccagcc

SEQ ID NO: 97603 - DNA, 20 bp, synthetic construct
  misc_feature 1..20: note = CRISPR gRNA sequence
  source 1..20: mol_type = other DNA
gcaccacttcattccagcct

SEQ ID NO: 97604 - DNA, 20 bp, synthetic construct
  misc_feature 1..20: note = CRISPR gRNA sequence
  source 1..20: mol_type = other DNA
cttcattccagcctgggtga

SEQ ID NO: 97605 - DNA, 20 bp, synthetic construct
  misc_feature 1..20: note = CRISPR gRNA sequence
  source 1..20: mol_type = other DNA
tcattccagcctgggtgata

SEQ ID NO: 97606 - DNA, 20 bp, synthetic construct
  misc_feature 1..20: note = CRISPR gRNA sequence
  source 1..20: mol_type = other DNA
tccagcctgggtgatagagc

SEQ ID NO: 97607 - DNA, 20 bp, synthetic construct
  misc_feature 1..20: note = CRISPR gRNA sequence
  source 1..20: mol_type = other DNA
aacaaaccccccgaaaacat

SEQ ID NO: 97608 - DNA, 20 bp, synthetic construct
  misc_feature 1..20: note = CRISPR gRNA sequence
  source 1..20: mol_type = other DNA
acaaaccccccgaaaacatg

SEQ ID NO: 97609 - DNA, 20 bp, synthetic construct
  misc_feature 1..20: note = CRISPR gRNA sequence
  source 1..20: mol_type = other DNA
aaaccccccgaaaacatgag

SEQ ID NO: 97610 - DNA, 20 bp, synthetic construct
  misc_feature 1..20: note = CRISPR gRNA sequence
  source 1..20: mol_type = other DNA
aaccccccgaaaacatgagg

SEQ ID NO: 97611 - DNA, 20 bp, synthetic construct
  misc_feature 1..20: note = CRISPR gRNA sequence
  source 1..20: mol_type = other DNA
accccccgaaaacatgagga

SEQ ID NO: 97612 - DNA, 20 bp, synthetic construct
  misc_feature 1..20: note = CRISPR gRNA sequence
  source 1..20: mol_type = other DNA
ccccgaaaacatgaggaggg

SEQ ID NO: 97613 - DNA, 20 bp, synthetic construct
  misc_feature 1..20: note = CRISPR gRNA sequence
  source 1..20: mol_type = other DNA
ccgaaaacatgaggagggaa

SEQ ID NO: 97614 - DNA, 20 bp, synthetic construct
  misc_feature 1..20: note = CRISPR gRNA sequence
  source 1..20: mol_type = other DNA
cgaaaacatgaggagggaag

SEQ ID NO: 97615 - DNA, 20 bp, synthetic construct
  misc_feature 1..20: note = CRISPR gRNA sequence
  source 1..20: mol_type = other DNA
aatgatttctgtcccaaaca

SEQ ID NO: 97616 - DNA, 20 bp, synthetic construct
  misc_feature 1..20: note = CRISPR gRNA sequence
  source 1..20: mol_type = other DNA
ccaaacacagtaaaactctg

SEQ ID NO: 97617 - DNA, 20 bp, synthetic construct
  misc_feature 1..20: note = CRISPR gRNA sequence
  source 1..20: mol_type = other DNA
caaacacagtaaaactctga

SEQ ID NO: 97618 - DNA, 20 bp, synthetic construct
  misc_feature 1..20: note = CRISPR gRNA sequence
  source 1..20: mol_type = other DNA
acacagtaaaactctgaagg

SEQ ID NO: 97619 - DNA, 20 bp, synthetic construct
  misc_feature 1..20: note = CRISPR gRNA sequence
  source 1..20: mol_type = other DNA
cacagtaaaactctgaagga

SEQ ID NO: 97620 - DNA, 20 bp, synthetic construct
  misc_feature 1..20: note = CRISPR gRNA sequence
  source 1..20: mol_type = other DNA
cagtaaaactctgaaggaag

SEQ ID NO: 97621 - DNA, 20 bp, synthetic construct
  misc_feature 1..20: note = CRISPR gRNA sequence
  source 1..20: mol_type = other DNA
agtaaaactctgaaggaagg

SEQ ID NO: 97622 - DNA, 20 bp, synthetic construct
  misc_feature 1..20: note = CRISPR gRNA sequence
  source 1..20: mol_type = other DNA
gtaaaactctgaaggaagga

SEQ ID NO: 97623 - DNA, 20 bp, synthetic construct
  misc_feature 1..20: note = CRISPR gRNA sequence
  source 1..20: mol_type = other DNA
taaaactctgaaggaaggag

SEQ ID NO: 97624 - DNA, 20 bp, synthetic construct
  misc_feature 1..20: note = CRISPR gRNA sequence
  source 1..20: mol_type = other DNA
aaaactctgaaggaaggagg

SEQ ID NO: 97625 - DNA, 20 bp, synthetic construct
  misc_feature 1..20: note = CRISPR gRNA sequence
  source 1..20: mol_type = other DNA
gaaggagggggatatttcct

SEQ ID NO: 97626 - DNA, 20 bp, synthetic construct
  misc_feature 1..20: note = CRISPR gRNA sequence
  source 1..20: mol_type = other DNA
ccccatctctaccatgaccc

SEQ ID NO: 97627 - DNA, 20 bp, synthetic construct
  misc_feature 1..20: note = CRISPR gRNA sequence
  source 1..20: mol_type = other DNA
cccatctctaccatgacccc

SEQ ID NO: 97628 - DNA, 20 bp, synthetic construct
  misc_feature 1..20: note = CRISPR gRNA sequence
  source 1..20: mol_type = other DNA
ccatctctaccatgacccca

SEQ ID NO: 97629 - DNA, 20 bp, synthetic construct
  misc_feature 1..20: note = CRISPR gRNA sequence
  source 1..20: mol_type = other DNA
catctctaccatgaccccag

SEQ ID NO: 97630 - DNA, 20 bp, synthetic construct
  misc_feature 1..20: note = CRISPR gRNA sequence
  source 1..20: mol_type = other DNA
atctctaccatgaccccagg

SEQ ID NO: 97631 - DNA, 20 bp, synthetic construct
  misc_feature 1..20: note = CRISPR gRNA sequence
  source 1..20: mol_type = other DNA
ctaccatgaccccagggggt

SEQ ID NO: 97632 - DNA, 20 bp, synthetic construct
  misc_feature 1..20: note = CRISPR gRNA sequence
  source 1..20: mol_type = other DNA
ccccagggggtcggttcaat

SEQ ID NO: 97633 - DNA, 20 bp, synthetic construct
  misc_feature 1..20: note = CRISPR gRNA sequence
  source 1..20: mol_type = other DNA
cccagggggtcggttcaatt

SEQ ID NO: 97634 - DNA, 20 bp, synthetic construct
  misc_feature 1..20: note = CRISPR gRNA sequence
  source 1..20: mol_type = other DNA
attgggatctccccatttta

SEQ ID NO: 97635 - DNA, 20 bp, synthetic construct
  misc_feature 1..20: note = CRISPR gRNA sequence
  source 1..20: mol_type = other DNA
ggatctccccattttatgga

SEQ ID NO: 97636 - DNA, 20 bp, synthetic construct
  misc_feature 1..20: note = CRISPR gRNA sequence
  source 1..20: mol_type = other DNA
gatctccccattttatggat

SEQ ID NO: 97637 - DNA, 20 bp, synthetic construct
  misc_feature 1..20: note = CRISPR gRNA sequence
  source 1..20: mol_type = other DNA
atctccccattttatggatg

SEQ ID NO: 97638 - DNA, 20 bp, synthetic construct
  misc_feature 1..20: note = CRISPR gRNA sequence
  source 1..20: mol_type = other DNA
tccccattttatggatgggg

SEQ ID NO: 97639 - DNA, 20 bp, synthetic construct
  misc_feature 1..20: note = CRISPR gRNA sequence
  source 1..20: mol_type = other DNA
cattttatggatggggaagt

SEQ ID NO: 97640 - DNA, 20 bp, synthetic construct
  misc_feature 1..20: note = CRISPR gRNA sequence
  source 1..20: mol_type = other DNA
attttatggatggggaagtt

SEQ ID NO: 97641 - DNA, 20 bp, synthetic construct
  misc_feature 1..20: note = CRISPR gRNA sequence
  source 1..20: mol_type = other DNA
ttttatggatggggaagttg

SEQ ID NO: 97642 - DNA, 20 bp, synthetic construct
  misc_feature 1..20: note = CRISPR gRNA sequence
  source 1..20: mol_type = other DNA
aagttggggtcccattgtga

SEQ ID NO: 97643 - DNA, 20 bp, synthetic construct
  misc_feature 1..20: note = CRISPR gRNA sequence
  source 1..20: mol_type = other DNA
gttggggtcccattgtgaca

SEQ ID NO: 97644 - DNA, 20 bp, synthetic construct
  misc_feature 1..20: note = CRISPR gRNA sequence
  source 1..20: mol_type = other DNA
tcccattgtgacagagaaaa

SEQ ID NO: 97645 - DNA, 20 bp, synthetic construct
  misc_feature 1..20: note = CRISPR gRNA sequence
  source 1..20: mol_type = other DNA
ccattgtgacagagaaaatg

SEQ ID NO: 97646 - DNA, 20 bp, synthetic construct
  misc_feature 1..20: note = CRISPR gRNA sequence
  source 1..20: mol_type = other DNA
cagagaaaatggagtcaaac

SEQ ID NO: 97647 - DNA, 20 bp, synthetic construct
  misc_feature 1..20: note = CRISPR gRNA sequence
  source 1..20: mol_type = other DNA
agagaaaatggagtcaaact

SEQ ID NO: 97648 - DNA, 20 bp, synthetic construct
  misc_feature 1..20: note = CRISPR gRNA sequence
  source 1..20: mol_type = other DNA
gagaaaatggagtcaaactg

SEQ ID NO: 97649 - DNA, 20 bp, synthetic construct
  misc_feature 1..20: note = CRISPR gRNA sequence
  source 1..20: mol_type = other DNA
gtcaaactggggtctgccta

SEQ ID NO: 97650 - DNA, 20 bp, synthetic construct
  misc_feature 1..20: note = CRISPR gRNA sequence
  source 1..20: mol_type = other DNA
ttcaaacccactgcccgcca

SEQ ID NO: 97651 - DNA, 20 bp, synthetic construct
  misc_feature 1..20: note = CRISPR gRNA sequence
  source 1..20: mol_type = other DNA
caaacccactgcccgccacg

SEQ ID NO: 97652 - DNA, 20 bp, synthetic construct
  misc_feature 1..20: note = CRISPR gRNA sequence
  source 1..20: mol_type = other DNA
aacccactgcccgccacgga

SEQ ID NO: 97653 - DNA, 20 bp, synthetic construct
  misc_feature 1..20: note = CRISPR gRNA sequence
  source 1..20: mol_type = other DNA
acccactgcccgccacggag

SEQ ID NO: 97654 - DNA, 20 bp, synthetic construct
  misc_feature 1..20: note = CRISPR gRNA sequence
  source 1..20: mol_type = other DNA
cccactgcccgccacggaga

SEQ ID NO: 97655 - DNA, 20 bp, synthetic construct
  misc_feature 1..20: note = CRISPR gRNA sequence
  source 1..20: mol_type = other DNA
ctgcccgccacggagaggga

SEQ ID NO: 97656 - DNA, 20 bp, synthetic construct
  misc_feature 1..20: note = CRISPR gRNA sequence
  source 1..20: mol_type = other DNA
acggagagggatggcctctg

SEQ ID NO: 97657 - DNA, 20 bp, synthetic construct
  misc_feature 1..20: note = CRISPR gRNA sequence
  source 1..20: mol_type = other DNA
ctctgtggctctgtgcacta

SEQ ID NO: 97658 - DNA, 20 bp, synthetic construct
  misc_feature 1..20: note = CRISPR gRNA sequence
  source 1..20: mol_type = other DNA
tggctctgtgcactatggcc

SEQ ID NO: 97659 - DNA, 20 bp, synthetic construct
  misc_feature 1..20: note = CRISPR gRNA sequence
  source 1..20: mol_type = other DNA
tggcctggtcgcctacccct

SEQ ID NO: 97660 - DNA, 20 bp, synthetic construct
  misc_feature 1..20: note = CRISPR gRNA sequence
  source 1..20: mol_type = other DNA
ccccttggtgtcctcactgc

SEQ ID NO: 97661 - DNA, 20 bp, synthetic construct
  misc_feature 1..20: note = CRISPR gRNA sequence
  source 1..20: mol_type = other DNA
cccttggtgtcctcactgcc

SEQ ID NO: 97662 - DNA, 20 bp, synthetic construct
  misc_feature 1..20: note = CRISPR gRNA sequence
  source 1..20: mol_type = other DNA
tcctcactgccaggcctccg

SEQ ID NO: 97663 - DNA, 20 bp, synthetic construct
  misc_feature 1..20: note = CRISPR gRNA sequence
  source 1..20: mol_type = other DNA
cctcactgccaggcctccgc

SEQ ID NO: 97664 - DNA, 20 bp, synthetic construct
  misc_feature 1..20: note = CRISPR gRNA sequence
  source 1..20: mol_type = other DNA
ctcactgccaggcctccgca

SEQ ID NO: 97665 - DNA, 20 bp, synthetic construct
  misc_feature 1..20: note = CRISPR gRNA sequence
  source 1..20: mol_type = other DNA
tcactgccaggcctccgcag

SEQ ID NO: 97666 - DNA, 20 bp, synthetic construct
  misc_feature 1..20: note = CRISPR gRNA sequence
  source 1..20: mol_type = other DNA
caggggccactcctcccacc

SEQ ID NO: 97667 - DNA, 20 bp, synthetic construct
  misc_feature 1..20: note = CRISPR gRNA sequence
  source 1..20: mol_type = other DNA
gatgccattctccctccctt

SEQ ID NO: 97668 - DNA, 20 bp, synthetic construct
  misc_feature 1..20: note = CRISPR gRNA sequence
  source 1..20: mol_type = other DNA
atgccattctccctcccttc

SEQ ID NO: 97669 - DNA, 20 bp, synthetic construct
  misc_feature 1..20: note = CRISPR gRNA sequence
  source 1..20: mol_type = other DNA
ctccctcccttcaggtcccc

SEQ ID NO: 97670 - DNA, 20 bp, synthetic construct
  misc_feature 1..20: note = CRISPR gRNA sequence
  source 1..20: mol_type = other DNA
cttccctgacctccccatcc

SEQ ID NO: 97671 - DNA, 20 bp, synthetic construct
  misc_feature 1..20: note = CRISPR gRNA sequence
  source 1..20: mol_type = other DNA
ttccctgacctccccatccc

SEQ ID NO: 97672 - DNA, 20 bp, synthetic construct
  misc_feature 1..20: note = CRISPR gRNA sequence
  source 1..20: mol_type = other DNA
tccctgacctccccatccca

SEQ ID NO: 97673 - DNA, 20 bp, synthetic construct
  misc_feature 1..20: note = CRISPR gRNA sequence
  source 1..20: mol_type = other DNA
tgacctccccatcccagggc

SEQ ID NO: 97674 - DNA, 20 bp, synthetic construct
  misc_feature 1..20: note = CRISPR gRNA sequence
  source 1..20: mol_type = other DNA
gacctccccatcccagggct

SEQ ID NO: 97675 - DNA, 20 bp, synthetic construct
  misc_feature 1..20: note = CRISPR gRNA sequence
  source 1..20: mol_type = other DNA
gctgggcccacctcacttct

SEQ ID NO: 97676 - DNA, 20 bp, synthetic construct
  misc_feature 1..20: note = CRISPR gRNA sequence
  source 1..20: mol_type = other DNA
ctgggcccacctcacttctc

SEQ ID NO: 97677 - DNA, 20 bp, synthetic construct
  misc_feature 1..20: note = CRISPR gRNA sequence
  source 1..20: mol_type = other DNA
tgggcccacctcacttctcg

SEQ ID NO: 97678 - DNA, 20 bp, synthetic construct
  misc_feature 1..20: note = CRISPR gRNA sequence
  source 1..20: mol_type = other DNA
cttctcggggtctcaacctt

SEQ ID NO: 97679 - DNA, 20 bp, synthetic construct
  misc_feature 1..20: note = CRISPR gRNA sequence
  source 1..20: mol_type = other DNA
aaccttaagacaccttcctc

SEQ ID NO: 97680 - DNA, 20 bp, synthetic construct
  misc_feature 1..20: note = CRISPR gRNA sequence
  source 1..20: mol_type = other DNA
accttaagacaccttcctcc

SEQ ID NO: 97681 - DNA, 20 bp, synthetic construct
  misc_feature 1..20: note = CRISPR gRNA sequence
  source 1..20: mol_type = other DNA
ttaagacaccttcctccagg

SEQ ID NO: 97682 - DNA, 20 bp, synthetic construct
  misc_feature 1..20: note = CRISPR gRNA sequence
  source 1..20: mol_type = other DNA
gaagcctctctgacttctgt

SEQ ID NO: 97683 - DNA, 20 bp, synthetic construct
  misc_feature 1..20: note = CRISPR gRNA sequence
  source 1..20: mol_type = other DNA
ctgacttctgttggccactt

SEQ ID NO: 97684 - DNA, 20 bp, synthetic construct
  misc_feature 1..20: note = CRISPR gRNA sequence
  source 1..20: mol_type = other DNA
tgacttctgttggccacttt

SEQ ID NO: 97685 - DNA, 20 bp, synthetic construct
  misc_feature 1..20: note = CRISPR gRNA sequence
  source 1..20: mol_type = other DNA
gacttctgttggccactttg

SEQ ID NO: 97686 - DNA, 20 bp, synthetic construct
  misc_feature 1..20: note = CRISPR gRNA sequence
  source 1..20: mol_type = other DNA
ccactttggggctctttgat

SEQ ID NO: 97687 - DNA, 20 bp, synthetic construct
  misc_feature 1..20: note = CRISPR gRNA sequence
  source 1..20: mol_type = other DNA
actttggggctctttgatga

SEQ ID NO: 97688 - DNA, 20 bp, synthetic construct
  misc_feature 1..20: note = CRISPR gRNA sequence
  source 1..20: mol_type = other DNA
ctttggggctctttgatgag

SEQ ID NO: 97689 - DNA, 20 bp, synthetic construct
  misc_feature 1..20: note = CRISPR gRNA sequence
  source 1..20: mol_type = other DNA
ttgatgagaggcccctcttt

SEQ ID NO: 97690 - DNA, 20 bp, synthetic construct
  misc_feature 1..20: note = CRISPR gRNA sequence
  source 1..20: mol_type = other DNA
tgcctatgtgtcccccatca

SEQ ID NO: 97691 - DNA, 20 bp, synthetic construct
  misc_feature 1..20: note = CRISPR gRNA sequence
  source 1..20: mol_type = other DNA
tgtgtcccccatcatggcca

SEQ ID NO: 97692 - DNA, 20 bp, synthetic construct
  misc_feature 1..20: note = CRISPR gRNA sequence
  source 1..20: mol_type = other DNA
acccattgtcctccctaccc

SEQ ID NO: 97693 - DNA, 20 bp, synthetic construct
  misc_feature 1..20: note = CRISPR gRNA sequence
  source 1..20: mol_type = other DNA
cctccctaccccagcacatg

SEQ ID NO: 97694 - DNA, 20 bp, synthetic construct
  misc_feature 1..20: note = CRISPR gRNA sequence
  source 1..20: mol_type = other DNA
tccctaccccagcacatgtg

SEQ ID NO: 97695 - DNA, 20 bp, synthetic construct
  misc_feature 1..20: note = CRISPR gRNA sequence
  source 1..20: mol_type = other DNA
ccccagcacatgtggagccc

SEQ ID NO: 97696 - DNA, 20 bp, synthetic construct
  misc_feature 1..20: note = CRISPR gRNA sequence
  source 1..20: mol_type = other DNA
cccagcacatgtggagcccc

SEQ ID NO: 97697 - DNA, 20 bp, synthetic construct
  misc_feature 1..20: note = CRISPR gRNA sequence
  source 1..20: mol_type = other DNA
cagcacatgtggagccccag

SEQ ID NO: 97698 - DNA, 20 bp, synthetic construct
  misc_feature 1..20: note = CRISPR gRNA sequence
  source 1..20: mol_type = other DNA
acatgtggagccccaggagc

SEQ ID NO: 97699 - DNA, 20 bp, synthetic construct
  misc_feature 1..20: note = CRISPR gRNA sequence
  source 1..20: mol_type = other DNA
catgtggagccccaggagcc

SEQ ID NO: 97700 - DNA, 20 bp, synthetic construct
  misc_feature 1..20: note = CRISPR gRNA sequence
  source 1..20: mol_type = other DNA
ggagccccaggagccaggac

SEQ ID NO: 97701 - DNA, 20 bp, synthetic construct
  misc_feature 1..20: note = CRISPR gRNA sequence
  source 1..20: mol_type = other DNA
gagccccaggagccaggact

SEQ ID NO: 97702 - DNA, 20 bp, synthetic construct
  misc_feature 1..20: note = CRISPR gRNA sequence
  source 1..20: mol_type = other DNA
agccaggactgggatgttcc

SEQ ID NO: 97703 - DNA, 20 bp, synthetic construct
  misc_feature 1..20: note = CRISPR gRNA sequence
  source 1..20: mol_type = other DNA
gccaggactgggatgttccc

SEQ ID NO: 97704 - DNA, 20 bp, synthetic construct
  misc_feature 1..20: note = CRISPR gRNA sequence
  source 1..20: mol_type = other DNA
aggactgggatgttcccagg

SEQ ID NO: 97705 - DNA, 20 bp, synthetic construct
  misc_feature 1..20: note = CRISPR gRNA sequence
  source 1..20: mol_type = other DNA
ggactgggatgttcccaggc

SEQ ID NO: 97706 - DNA, 20 bp, synthetic construct
  misc_feature 1..20: note = CRISPR gRNA sequence
  source 1..20: mol_type = other DNA
atgttcccaggcgggataca

SEQ ID NO: 97707 - DNA, 20 bp, synthetic construct
  misc_feature 1..20: note = CRISPR gRNA sequence
  source 1..20: mol_type = other DNA
ttcccaggcgggatacacag

SEQ ID NO: 97708 - DNA, 20 bp, synthetic construct
  misc_feature 1..20: note = CRISPR gRNA sequence
  source 1..20: mol_type = other DNA
tgtcaacacactctcgctgc

SEQ ID NO: 97709 - DNA, 20 bp, synthetic construct
  misc_feature 1..20: note = CRISPR gRNA sequence
  source 1..20: mol_type = other DNA
ctgccggcgtatgaccactg

SEQ ID NO: 97710 - DNA, 20 bp, synthetic construct
  misc_feature 1..20: note = CRISPR gRNA sequence
  source 1..20: mol_type = other DNA
tgccggcgtatgaccactga

SEQ ID NO: 97711 - DNA, 20 bp, synthetic construct
  misc_feature 1..20: note = CRISPR gRNA sequence
  source 1..20: mol_type = other DNA
gccggcgtatgaccactgaa

SEQ ID NO: 97712 - DNA, 20 bp, synthetic construct
  misc_feature 1..20: note = CRISPR gRNA sequence
  source 1..20: mol_type = other DNA
ccggcgtatgaccactgaag

SEQ ID NO: 97713 - DNA, 20 bp, synthetic construct
  misc_feature 1..20: note = CRISPR gRNA sequence
  source 1..20: mol_type = other DNA
gtgtcccatgtaccccttta

SEQ ID NO: 97714 - DNA, 20 bp, synthetic construct
  misc_feature 1..20: note = CRISPR gRNA sequence
  source 1..20: mol_type = other DNA
ctttatggtcaccctgccta

SEQ ID NO: 97715 - DNA, 20 bp, synthetic construct
  misc_feature 1..20: note = CRISPR gRNA sequence
  source 1..20: mol_type = other DNA
tatggtcaccctgcctatgg

SEQ ID NO: 97716 - DNA, 20 bp, synthetic construct
  misc_feature 1..20: note = CRISPR gRNA sequence
  source 1..20: mol_type = other DNA
atggtcaccctgcctatgga

SEQ ID NO: 97717 - DNA, 20 bp, synthetic construct
  misc_feature 1..20: note = CRISPR gRNA sequence
  source 1..20: mol_type = other DNA
tggtcaccctgcctatggaa

SEQ ID NO: 97718 - DNA, 20 bp, synthetic construct
  misc_feature 1..20: note = CRISPR gRNA sequence
  source 1..20: mol_type = other DNA
cacccctgctctgtgtgtct

SEQ ID NO: 97719 - DNA, 20 bp, synthetic construct
  misc_feature 1..20: note = CRISPR gRNA sequence
  source 1..20: mol_type = other DNA
acccctgctctgtgtgtctc

SEQ ID NO: 97720 - DNA, 20 bp, synthetic construct
  misc_feature 1..20: note = CRISPR gRNA sequence
  source 1..20: mol_type = other DNA
gtgtctcaggctgacctttc

SEQ ID NO: 97721 - DNA, 20 bp, synthetic construct
  misc_feature 1..20: note = CRISPR gRNA sequence
  source 1..20: mol_type = other DNA
ggctgacctttccggtatcc

SEQ ID NO: 97722 - DNA, 20 bp, synthetic construct
  misc_feature 1..20: note = CRISPR gRNA sequence
  source 1..20: mol_type = other DNA
gctgacctttccggtatccc

SEQ ID NO: 97723 - DNA, 20 bp, synthetic construct
  misc_feature 1..20: note = CRISPR gRNA sequence
  source 1..20: mol_type = other DNA
ctgacctttccggtatccca

SEQ ID NO: 97724 - DNA, 20 bp, synthetic construct
  misc_feature 1..20: note = CRISPR gRNA sequence
  source 1..20: mol_type = other DNA
tttccggtatcccagggcca

SEQ ID NO: 97725 - DNA, 20 bp, synthetic construct
  misc_feature 1..20: note = CRISPR gRNA sequence
  source 1..20: mol_type = other DNA
cggtatcccagggccacggc

SEQ ID NO: 97726 - DNA, 20 bp, synthetic construct
  misc_feature 1..20: note = CRISPR gRNA sequence
  source 1..20: mol_type = other DNA
ggtatcccagggccacggca

SEQ ID NO: 97727 - DNA, 20 bp, synthetic construct
  misc_feature 1..20: note = CRISPR gRNA sequence
  source 1..20: mol_type = other DNA
agggccacggcaaggtccat

SEQ ID NO: 97728 - DNA, 20 bp, synthetic construct
  misc_feature 1..20: note = CRISPR gRNA sequence
  source 1..20: mol_type = other DNA
gggccacggcaaggtccatc

SEQ ID NO: 97729 - DNA, 20 bp, synthetic construct
  misc_feature 1..20: note = CRISPR gRNA sequence
  source 1..20: mol_type = other DNA
ggccacggcaaggtccatcg

SEQ ID NO: 97730 - DNA, 20 bp, synthetic construct
  misc_feature 1..20: note = CRISPR gRNA sequence
  source 1..20: mol_type = other DNA
cggcaaggtccatcggggtg

SEQ ID NO: 97731 - DNA, 20 bp, synthetic construct
  misc_feature 1..20: note = CRISPR gRNA sequence
  source 1..20: mol_type = other DNA
aaggtccatcggggtgtagc

SEQ ID NO: 97732 - DNA, 20 bp, synthetic construct
  misc_feature 1..20: note = CRISPR gRNA sequence
  source 1..20: mol_type = other DNA
ggtccatcggggtgtagcca

SEQ ID NO: 97733 - DNA, 20 bp, synthetic construct
  misc_feature 1..20: note = CRISPR gRNA sequence
  source 1..20: mol_type = other DNA
catcggggtgtagccagagt

SEQ ID NO: 97734 - DNA, 20 bp, synthetic construct
  misc_feature 1..20: note = CRISPR gRNA sequence
  source 1..20: mol_type = other DNA
ggtgtagccagagtcggctt

SEQ ID NO: 97735 - DNA, 20 bp, synthetic construct
  misc_feature 1..20: note = CRISPR gRNA sequence
  source 1..20: mol_type = other DNA
gtagccagagtcggcttcgg

SEQ ID NO: 97736 - DNA, 20 bp, synthetic construct
  misc_feature 1..20: note = CRISPR gRNA sequence
  source 1..20: mol_type = other DNA
ccagagtcggcttcggtggt

SEQ ID NO: 97737 - DNA, 20 bp, synthetic construct
  misc_feature 1..20: note = CRISPR gRNA sequence
  source 1..20: mol_type = other DNA
cagagtcggcttcggtggtg

SEQ ID NO: 97738 - DNA, 20 bp, synthetic construct
  misc_feature 1..20: note = CRISPR gRNA sequence
  source 1..20: mol_type = other DNA
gtcggcttcggtggtgaggt

SEQ ID NO: 97739 - DNA, 20 bp, synthetic construct
  misc_feature 1..20: note = CRISPR gRNA sequence
  source 1..20: mol_type = other DNA
cggtggtgaggtcagcgcct

SEQ ID NO: 97740 - DNA, 20 bp, synthetic construct
  misc_feature 1..20: note = CRISPR gRNA sequence
  source 1..20: mol_type = other DNA
ggtggtgaggtcagcgcctc

SEQ ID NO: 97741 - DNA, 20 bp, synthetic construct
  misc_feature 1..20: note = CRISPR gRNA sequence
  source 1..20: mol_type = other DNA
ggtcagcgcctcgggctgca

SEQ ID NO: 97742 - DNA, 20 bp, synthetic construct
  misc_feature 1..20: note = CRISPR gRNA sequence
  source 1..20: mol_type = other DNA
gtcagcgcctcgggctgcaa

SEQ ID NO: 97743 - DNA, 20 bp, synthetic construct
  misc_feature 1..20: note = CRISPR gRNA sequence
  source 1..20: mol_type = other DNA
cagcgcctcgggctgcaaag

SEQ ID NO: 97744 - DNA, 20 bp, synthetic construct
  misc_feature 1..20: note = CRISPR gRNA sequence
  source 1..20: mol_type = other DNA
gcgcctcgggctgcaaagga

SEQ ID NO: 97745 - DNA, 20 bp, synthetic construct
  misc_feature 1..20: note = CRISPR gRNA sequence
  source 1..20: mol_type = other DNA
cgcctcgggctgcaaaggag

SEQ ID NO: 97746 - DNA, 20 bp, synthetic construct
  misc_feature 1..20: note = CRISPR gRNA sequence
  source 1..20: mol_type = other DNA
gcctcgggctgcaaaggaga

SEQ ID NO: 97747 - DNA, 20 bp, synthetic construct
  misc_feature 1..20: note = CRISPR gRNA sequence
  source 1..20: mol_type = other DNA
cctcgggctgcaaaggagag

SEQ ID NO: 97748 - DNA, 20 bp, synthetic construct
  misc_feature 1..20: note = CRISPR gRNA sequence
  source 1..20: mol_type = other DNA
tcgggctgcaaaggagaggg

SEQ ID NO: 97749 - DNA, 20 bp, synthetic construct
  misc_feature 1..20: note = CRISPR gRNA sequence
  source 1..20: mol_type = other DNA
cgggctgcaaaggagagggg

SEQ ID NO: 97750 - DNA, 20 bp, synthetic construct
  misc_feature 1..20: note = CRISPR gRNA sequence
  source 1..20: mol_type = other DNA
gggctgcaaaggagagggga

SEQ ID NO: 97751 - DNA, 20 bp, synthetic construct
  misc_feature 1..20: note = CRISPR gRNA sequence
  source 1..20: mol_type = other DNA
caaaggagaggggagggcgc

SEQ ID NO: 97752 - DNA, 20 bp, synthetic construct
  misc_feature 1..20: note = CRISPR gRNA sequence
  source 1..20: mol_type = other DNA
aaggagaggggagggcgctg

SEQ ID NO: 97753 - DNA, 20 bp, synthetic construct
  misc_feature 1..20: note = CRISPR gRNA sequence
  source 1..20: mol_type = other DNA
aggagaggggagggcgctgg

SEQ ID NO: 97754 - DNA, 20 bp, synthetic construct
  misc_feature 1..20: note = CRISPR gRNA sequence
  source 1..20: mol_type = other DNA
ggagaggggagggcgctgga

SEQ ID NO: 97755 - DNA, 20 bp, synthetic construct
  misc_feature 1..20: note = CRISPR gRNA sequence
  source 1..20: mol_type = other DNA
gaggggagggcgctggaggg

SEQ ID NO: 97756 - DNA, 20 bp, synthetic construct
  misc_feature 1..20: note = CRISPR gRNA sequence
  source 1..20: mol_type = other DNA
aggggagggcgctggagggt

SEQ ID NO: 97757 - DNA, 20 bp, synthetic construct
  misc_feature 1..20: note = CRISPR gRNA sequence
  source 1..20: mol_type = other DNA
ggggagggcgctggagggtg

SEQ ID NO: 97758 - DNA, 20 bp, synthetic construct
  misc_feature 1..20: note = CRISPR gRNA sequence
  source 1..20: mol_type = other DNA
gggcgctggagggtggggcc

SEQ ID NO: 97759 - DNA, 20 bp, synthetic construct
  misc_feature 1..20: note = CRISPR gRNA sequence
  source 1..20: mol_type = other DNA
ggcgctggagggtggggcct

SEQ ID NO: 97760 - DNA, 20 bp, synthetic construct
  misc_feature 1..20: note = CRISPR gRNA sequence
  source 1..20: mol_type = other DNA
cgctggagggtggggcctgg

SEQ ID NO: 97761 - DNA, 20 bp, synthetic construct
  misc_feature 1..20: note = CRISPR gRNA sequence
  source 1..20: mol_type = other DNA
gagggtggggcctgggagtc

SEQ ID NO: 97762 - DNA, 20 bp, synthetic construct
  misc_feature 1..20: note = CRISPR gRNA sequence
  source 1..20: mol_type = other DNA
tggggcctgggagtccagaa

SEQ ID NO: 97763 - DNA, 20 bp, synthetic construct
  misc_feature 1..20: note = CRISPR gRNA sequence
  source 1..20: mol_type = other DNA
ggggcctgggagtccagaat

SEQ ID NO: 97764 - DNA, 20 bp, synthetic construct
  misc_feature 1..20: note = CRISPR gRNA sequence
  source 1..20: mol_type = other DNA
gggcctgggagtccagaatg

SEQ ID NO: 97765 - DNA, 20 bp, synthetic construct
  misc_feature 1..20: note = CRISPR gRNA sequence
  source 1..20: mol_type = other DNA
tgggagtccagaatggggtc

SEQ ID NO: 97766 - DNA, 20 bp, synthetic construct
  misc_feature 1..20: note = CRISPR gRNA sequence
  source 1..20: mol_type = other DNA
gggagtccagaatggggtct

SEQ ID NO: 97767 - DNA, 20 bp, synthetic construct
  misc_feature 1..20: note = CRISPR gRNA sequence
  source 1..20: mol_type = other DNA
ggagtccagaatggggtctg

SEQ ID NO: 97768 - DNA, 20 bp, synthetic construct
  misc_feature 1..20: note = CRISPR gRNA sequence
  source 1..20: mol_type = other DNA
cagaatggggtctggggacc

SEQ ID NO: 97769 - DNA, 20 bp, synthetic construct
  misc_feature 1..20: note = CRISPR gRNA sequence
  source 1..20: mol_type = other DNA
agaatggggtctggggacct

SEQ ID NO: 97770 - DNA, 20 bp, synthetic construct
  misc_feature 1..20: note = CRISPR gRNA sequence
  source 1..20: mol_type = other DNA
aatggggtctggggacctgg

SEQ ID NO: 97771 - DNA, 20 bp, synthetic construct
  misc_feature 1..20: note = CRISPR gRNA sequence
  source 1..20: mol_type = other DNA
tggggacctgggagatccca

SEQ ID NO: 97772 - DNA, 20 bp, synthetic construct
  misc_feature 1..20: note = CRISPR gRNA sequence
  source 1..20: mol_type = other DNA
acccctcattccccacaatg

SEQ ID NO: 97773 - DNA, 20 bp, synthetic construct
  misc_feature 1..20: note = CRISPR gRNA sequence
  source 1..20: mol_type = other DNA
cattccccacaatgcagccg

SEQ ID NO: 97774 - DNA, 20 bp, synthetic construct
  misc_feature 1..20: note = CRISPR gRNA sequence
  source 1..20: mol_type = other DNA
attccccacaatgcagccgt

SEQ ID NO: 97775 - DNA, 20 bp, synthetic construct
  misc_feature 1..20: note = CRISPR gRNA sequence
  source 1..20: mol_type = other DNA
gggtctgcccgttgcccatg

SEQ ID NO: 97776 - DNA, 20 bp, synthetic construct
  misc_feature 1..20: note = CRISPR gRNA sequence
  source 1..20: mol_type = other DNA
ttgcccatgtggcctttgac

SEQ ID NO: 97777 - DNA, 20 bp, synthetic construct
  misc_feature 1..20: note = CRISPR gRNA sequence
  source 1..20: mol_type = other DNA
tgcccatgtggcctttgaca

SEQ ID NO: 97778 - DNA, 20 bp, synthetic construct
  misc_feature 1..20: note = CRISPR gRNA sequence
  source 1..20: mol_type = other DNA
gcccatgtggcctttgacaa

SEQ ID NO: 97779 - DNA, 20 bp, synthetic construct
  misc_feature 1..20: note = CRISPR gRNA sequence
  source 1..20: mol_type = other DNA
gggtccaacctctgctatct

SEQ ID NO: 97780 - DNA, 20 bp, synthetic construct
  misc_feature 1..20: note = CRISPR gRNA sequence
  source 1..20: mol_type = other DNA
tgctatcttggtctccactg

SEQ ID NO: 97781 - DNA, 20 bp, synthetic construct
  misc_feature 1..20: note = CRISPR gRNA sequence
  source 1..20: mol_type = other DNA
ttggtctccactgaagaacg

SEQ ID NO: 97782 - DNA, 20 bp, synthetic construct
  misc_feature 1..20: note = CRISPR gRNA sequence
  source 1..20: mol_type = other DNA
tccactgaagaacgtggctg

SEQ ID NO: 97783 - DNA, 20 bp, synthetic construct
  misc_feature 1..20: note = CRISPR gRNA sequence
  source 1..20: mol_type = other DNA
ccactgaagaacgtggctga

SEQ ID NO: 97784 - DNA, 20 bp, synthetic construct
  misc_feature 1..20: note = CRISPR gRNA sequence
  source 1..20: mol_type = other DNA
cactgaagaacgtggctgaa

SEQ ID NO: 97785 - DNA, 20 bp, synthetic construct
  misc_feature 1..20: note = CRISPR gRNA sequence
  source 1..20: mol_type = other DNA
gctgaagggtctctgaacca

SEQ ID NO: 97786 - DNA, 20 bp, synthetic construct
  misc_feature 1..20: note = CRISPR gRNA sequence
  source 1..20: mol_type = other DNA
tgaagggtctctgaaccatg

SEQ ID NO: 97787 - DNA, 20 bp, synthetic construct
  misc_feature 1..20: note = CRISPR gRNA sequence
  source 1..20: mol_type = other DNA
gaagggtctctgaaccatgg

SEQ ID NO: 97788 - DNA, 20 bp, synthetic construct
  misc_feature 1..20: note = CRISPR gRNA sequence
  source 1..20: mol_type = other DNA
ggtctctgaaccatggagga

SEQ ID NO: 97789 - DNA, 20 bp, synthetic construct
  misc_feature 1..20: note = CRISPR gRNA sequence
  source 1..20: mol_type = other DNA
tctctgaaccatggaggatg

SEQ ID NO: 97790 - DNA, 20 bp, synthetic construct
  misc_feature 1..20: note = CRISPR gRNA sequence
  source 1..20: mol_type = other DNA
ctctgaaccatggaggatgg

SEQ ID NO: 97791 - DNA, 20 bp, synthetic construct
  misc_feature 1..20: note = CRISPR gRNA sequence
  source 1..20: mol_type = other DNA
ccatggaggatggaggtgct

SEQ ID NO: 97792 - DNA, 20 bp, synthetic construct
  misc_feature 1..20: note = CRISPR gRNA sequence
  source 1..20: mol_type = other DNA
gatggaggtgcttagcctct

SEQ ID NO: 97793 - DNA, 20 bp, synthetic construct
  misc_feature 1..20: note = CRISPR gRNA sequence
  source 1..20: mol_type = other DNA
gaggtgcttagcctcttggc

SEQ ID NO: 97794 - DNA, 20 bp, synthetic construct
  misc_feature 1..20: note = CRISPR gRNA sequence
  source 1..20: mol_type = other DNA
tcttggccagatcctaaacc

SEQ ID NO: 97795 - DNA, 20 bp, synthetic construct
  misc_feature 1..20: note = CRISPR gRNA sequence
  source 1..20: mol_type = other DNA
cccagaccccgactcccgtg

SEQ ID NO: 97796 - DNA, 20 bp, synthetic construct
  misc_feature 1..20: note = CRISPR gRNA sequence
  source 1..20: mol_type = other DNA
tcccctctgatccatcctcc

SEQ ID NO: 97797 - DNA, 20 bp, synthetic construct
  misc_feature 1..20: note = CRISPR gRNA sequence
  source 1..20: mol_type = other DNA
cctctgatccatcctccgag

SEQ ID NO: 97798 - DNA, 20 bp, synthetic construct
  misc_feature 1..20: note = CRISPR gRNA sequence
  source 1..20: mol_type = other DNA
tctgatccatcctccgagaa

SEQ ID NO: 97799 - DNA, 20 bp, synthetic construct
  misc_feature 1..20: note = CRISPR gRNA sequence
  source 1..20: mol_type = other DNA
gatccatcctccgagaagag

SEQ ID NO: 97800 - DNA, 20 bp, synthetic construct
  misc_feature 1..20: note = CRISPR gRNA sequence
  source 1..20: mol_type = other DNA
atccatcctccgagaagagc

SEQ ID NO: 97801 - DNA, 20 bp, synthetic construct
  misc_feature 1..20: note = CRISPR gRNA sequence
  source 1..20: mol_type = other DNA
catcctccgagaagagcagg

SEQ ID NO: 97802 - DNA, 20 bp, synthetic construct
  misc_feature 1..20: note = CRISPR gRNA sequence
  source 1..20: mol_type = other DNA
atcctccgagaagagcaggc

SEQ ID NO: 97803 - DNA, 20 bp, synthetic construct
  misc_feature 1..20: note = CRISPR gRNA sequence
  source 1..20: mol_type = other DNA
tcctccgagaagagcaggca

SEQ ID NO: 97804 - DNA, 20 bp, synthetic construct
  misc_feature 1..20: note = CRISPR gRNA sequence
  source 1..20: mol_type = other DNA
aggcagggactacctgctcc

SEQ ID NO: 97805 - DNA, 20 bp, synthetic construct
  misc_feature 1..20: note = CRISPR gRNA sequence
  source 1..20: mol_type = other DNA
acctgctccaagaactcttc

SEQ ID NO: 97806 - DNA, 20 bp, synthetic construct
  misc_feature 1..20: note = CRISPR gRNA sequence
  source 1..20: mol_type = other DNA
agaactcttcaagcaacact

SEQ ID NO: 97807 - DNA, 20 bp, synthetic construct
  misc_feature 1..20: note = CRISPR gRNA sequence
  source 1..20: mol_type = other DNA
gaactcttcaagcaacactt

SEQ ID NO: 97808 - DNA, 20 bp, synthetic construct
  misc_feature 1..20: note = CRISPR gRNA sequence
  source 1..20: mol_type = other DNA
cttgggcgtctccctgccct

SEQ ID NO: 97809 - DNA, 20 bp, synthetic construct
  misc_feature 1..20: note = CRISPR gRNA sequence
  source 1..20: mol_type = other DNA
ttgggcgtctccctgccctc

SEQ ID NO: 97810 - DNA, 20 bp, synthetic construct
  misc_feature 1..20: note = CRISPR gRNA sequence
  source 1..20: mol_type = other DNA
ccctgccctcaggattcccg

SEQ ID NO: 97811 - DNA, 20 bp, synthetic construct
  misc_feature 1..20: note = CRISPR gRNA sequence
  source 1..20: mol_type = other DNA
cctgccctcaggattcccgc

SEQ ID NO: 97812 - DNA, 20 bp, synthetic construct
  misc_feature 1..20: note = CRISPR gRNA sequence
  source 1..20: mol_type = other DNA
ctgccctcaggattcccgca

SEQ ID NO: 97813 - DNA, 20 bp, synthetic construct
  misc_feature 1..20: note = CRISPR gRNA sequence
  source 1..20: mol_type = other DNA
aggattcccgcagggcccgc

SEQ ID NO: 97814 - DNA, 20 bp, synthetic construct
  misc_feature 1..20: note = CRISPR gRNA sequence
  source 1..20: mol_type = other DNA
gattcccgcagggcccgctg

SEQ ID NO: 97815 - DNA, 20 bp, synthetic construct
  misc_feature 1..20: note = CRISPR gRNA sequence
  source 1..20: mol_type = other DNA
cgcagggcccgctggagtgc

SEQ ID NO: 97816 - DNA, 20 bp, synthetic construct
  misc_feature 1..20: note = CRISPR gRNA sequence
  source 1..20: mol_type = other DNA
gcagggcccgctggagtgct

SEQ ID NO: 97817 - DNA, 20 bp, synthetic construct
  misc_feature 1..20: note = CRISPR gRNA sequence
  source 1..20: mol_type = other DNA
cagggcccgctggagtgctg

SEQ ID NO: 97818 - DNA, 20 bp, synthetic construct
  misc_feature 1..20: note = CRISPR gRNA sequence
  source 1..20: mol_type = other DNA
cgctggagtgctggggcccc

SEQ ID NO: 97819 - DNA, 20 bp, synthetic construct
  misc_feature 1..20: note = CRISPR gRNA sequence
  source 1..20: mol_type = other DNA
gctggagtgctggggccccc

SEQ ID NO: 97820 - DNA, 20 bp, synthetic construct
  misc_feature 1..20: note = CRISPR gRNA sequence
  source 1..20: mol_type = other DNA
ctggagtgctggggccccca

SEQ ID NO: 97821 - DNA, 20 bp, synthetic construct
  misc_feature 1..20: note = CRISPR gRNA sequence
  source 1..20: mol_type = other DNA
actcccgactcccactcacc

SEQ ID NO: 97822 - DNA, 20 bp, synthetic construct
  misc_feature 1..20: note = CRISPR gRNA sequence
  source 1..20: mol_type = other DNA
ccgactcccactcacccagc

SEQ ID NO: 97823 - DNA, 20 bp, synthetic construct
  misc_feature 1..20: note = CRISPR gRNA sequence
  source 1..20: mol_type = other DNA
cgactcccactcacccagca

SEQ ID NO: 97824 - DNA, 20 bp, synthetic construct
  misc_feature 1..20: note = CRISPR gRNA sequence
  source 1..20: mol_type = other DNA
aggcctcaacgcatttcacg

SEQ ID NO: 97825 - DNA, 20 bp, synthetic construct
  misc_feature 1..20: note = CRISPR gRNA sequence
  source 1..20: mol_type = other DNA
tttcacgtggttcccgcgca

SEQ ID NO: 97826 - DNA, 20 bp, synthetic construct
  misc_feature 1..20: note = CRISPR gRNA sequence
  source 1..20: mol_type = other DNA
tggttcccgcgcacagcgta

SEQ ID NO: 97827 - DNA, 20 bp, synthetic construct
  misc_feature 1..20: note = CRISPR gRNA sequence
  source 1..20: mol_type = other DNA
ttcccgcgcacagcgtacag

SEQ ID NO: 97828 - DNA, 20 bp, synthetic construct
  misc_feature 1..20: note = CRISPR gRNA sequence
  source 1..20: mol_type = other DNA
ccgcgcacagcgtacagcag

SEQ ID NO: 97829 - DNA, 20 bp, synthetic construct
  misc_feature 1..20: note = CRISPR gRNA sequence
  source 1..20: mol_type = other DNA
ggcgtccctccattctgtcg

SEQ ID NO: 97830 - DNA, 20 bp, synthetic construct
  misc_feature 1..20: note = CRISPR gRNA sequence
  source 1..20: mol_type = other DNA
gcgtccctccattctgtcgt

SEQ ID NO: 97831 - DNA, 20 bp, synthetic construct
  misc_feature 1..20: note = CRISPR gRNA sequence
  source 1..20: mol_type = other DNA
tccctccattctgtcgtggg

SEQ ID NO: 97832 - DNA, 20 bp, synthetic construct
  misc_feature 1..20: note = CRISPR gRNA sequence
  source 1..20: mol_type = other DNA
ccctccattctgtcgtgggt

SEQ ID NO: 97833 - DNA, 20 bp, synthetic construct
  misc_feature 1..20: note = CRISPR gRNA sequence
  source 1..20: mol_type = other DNA
cctccattctgtcgtgggta

SEQ ID NO: 97834 - DNA, 20 bp, synthetic construct
  misc_feature 1..20: note = CRISPR gRNA sequence
  source 1..20: mol_type = other DNA
ctccattctgtcgtgggtag

SEQ ID NO: 97835 - DNA, 20 bp, synthetic construct
  misc_feature 1..20: note = CRISPR gRNA sequence
  source 1..20: mol_type = other DNA
cattctgtcgtgggtagggg

SEQ ID NO: 97836 - DNA, 20 bp, synthetic construct
  misc_feature 1..20: note = CRISPR gRNA sequence
  source 1..20: mol_type = other DNA
attctgtcgtgggtaggggc

SEQ ID NO: 97837 - DNA, 20 bp, synthetic construct
  misc_feature 1..20: note = CRISPR gRNA sequence
  source 1..20: mol_type = other DNA
tctgtcgtgggtaggggcag

SEQ ID NO: 97838 - DNA, 20 bp, synthetic construct
  misc_feature 1..20: note = CRISPR gRNA sequence
  source 1..20: mol_type = other DNA
ggtaggggcaggagaaacca

SEQ ID NO: 97839 - DNA, 20 bp, synthetic construct
  misc_feature 1..20: note = CRISPR gRNA sequence
  source 1..20: mol_type = other DNA
gtaggggcaggagaaaccaa

SEQ ID NO: 97840 - DNA, 20 bp, synthetic construct
  misc_feature 1..20: note = CRISPR gRNA sequence
  source 1..20: mol_type = other DNA
tcaaaatgccttgtactctc

SEQ ID NO: 97841 - DNA, 20 bp, synthetic construct
  misc_feature 1..20: note = CRISPR gRNA sequence
  source 1..20: mol_type = other DNA
gccttgtactctctggcctc

SEQ ID NO: 97842 - DNA, 20 bp, synthetic construct
  misc_feature 1..20: note = CRISPR gRNA sequence
  source 1..20: mol_type = other DNA
ctctggcctccagttgaacg

SEQ ID NO: 97843 - DNA, 20 bp, synthetic construct
  misc_feature 1..20: note = CRISPR gRNA sequence
  source 1..20: mol_type = other DNA
tggttcctcctgctcatcac

SEQ ID NO: 97844 - DNA, 20 bp, synthetic construct
  misc_feature 1..20: note = CRISPR gRNA sequence
  source 1..20: mol_type = other DNA
ggttcctcctgctcatcact

SEQ ID NO: 97845 - DNA, 20 bp, synthetic construct
  misc_feature 1..20: note = CRISPR gRNA sequence
  source 1..20: mol_type = other DNA
actgggcccatctcactttc

SEQ ID NO: 97846 - DNA, 20 bp, synthetic construct
  misc_feature 1..20: note = CRISPR gRNA sequence
  source 1..20: mol_type = other DNA
ctgggcccatctcactttct

SEQ ID NO: 97847 - DNA, 20 bp, synthetic construct
  misc_feature 1..20: note = CRISPR gRNA sequence
  source 1..20: mol_type = other DNA
tgggcccatctcactttctg

SEQ ID NO: 97848 - DNA, 20 bp, synthetic construct
  misc_feature 1..20: note = CRISPR gRNA sequence
  source 1..20: mol_type = other DNA
atctcactttctggggtctc

SEQ ID NO: 97849 - DNA, 20 bp, synthetic construct
  misc_feature 1..20: note = CRISPR gRNA sequence
  source 1..20: mol_type = other DNA
actttctggggtctcaagct

SEQ ID NO: 97850 - DNA, 20 bp, synthetic construct
  misc_feature 1..20: note = CRISPR gRNA sequence
  source 1..20: mol_type = other DNA
caagcttagacaccttcctc

SEQ ID NO: 97851 - DNA, 20 bp, synthetic construct
  misc_feature 1..20: note = CRISPR gRNA sequence
  source 1..20: mol_type = other DNA
aagcttagacaccttcctcc

SEQ ID NO: 97852 - DNA, 20 bp, synthetic construct
  misc_feature 1..20: note = CRISPR gRNA sequence
  source 1..20: mol_type = other DNA
cttagacaccttcctccagg

SEQ ID NO: 97853 - DNA, 20 bp, synthetic construct
  misc_feature 1..20: note = CRISPR gRNA sequence
  source 1..20: mol_type = other DNA
tctgatttcccttgcccaca

SEQ ID NO: 97854 - DNA, 20 bp, synthetic construct
  misc_feature 1..20: note = CRISPR gRNA sequence
  source 1..20: mol_type = other DNA
ctgatttcccttgcccacat

SEQ ID NO: 97855 - DNA, 20 bp, synthetic construct
  misc_feature 1..20: note = CRISPR gRNA sequence
  source 1..20: mol_type = other DNA
tgatttcccttgcccacatg

SEQ ID NO: 97856 - DNA, 20 bp, synthetic construct
  misc_feature 1..20: note = CRISPR gRNA sequence
  source 1..20: mol_type = other DNA
ttgcccacatggggctcttg

SEQ ID NO: 97857 - DNA, 20 bp, synthetic construct
  misc_feature 1..20: note = CRISPR gRNA sequence
  source 1..20: mol_type = other DNA
cacctgtgcatctgccatcg

SEQ ID NO: 97858 - DNA, 20 bp, synthetic construct
  misc_feature 1..20: note = CRISPR gRNA sequence
  source 1..20: mol_type = other DNA
gtgcatctgccatcgcagcg

SEQ ID NO: 97859 - DNA, 20 bp, synthetic construct
  misc_feature 1..20: note = CRISPR gRNA sequence
  source 1..20: mol_type = other DNA
cagcgcagttcactgcatct

SEQ ID NO: 97860 - DNA, 20 bp, synthetic construct
  misc_feature 1..20: note = CRISPR gRNA sequence
  source 1..20: mol_type = other DNA
ccatgtctgccttccctgca

SEQ ID NO: 97861 - DNA, 20 bp, synthetic construct
  misc_feature 1..20: note = CRISPR gRNA sequence
  source 1..20: mol_type = other DNA
catgtctgccttccctgcat

SEQ ID NO: 97862 - DNA, 20 bp, synthetic construct
  misc_feature 1..20: note = CRISPR gRNA sequence
  source 1..20: mol_type = other DNA
atgtctgccttccctgcatg

SEQ ID NO: 97863 - DNA, 20 bp, synthetic construct
  misc_feature 1..20: note = CRISPR gRNA sequence
  source 1..20: mol_type = other DNA
gtctgccttccctgcatggg

SEQ ID NO: 97864 - DNA, 20 bp, synthetic construct
  misc_feature 1..20: note = CRISPR gRNA sequence
  source 1..20: mol_type = other DNA
catggggagctctgctctgt

SEQ ID NO: 97865 - DNA, 20 bp, synthetic construct
  misc_feature 1..20: note = CRISPR gRNA sequence
  source 1..20: mol_type = other DNA
atggggagctctgctctgtg

SEQ ID NO: 97866 - DNA, 20 bp, synthetic construct
  misc_feature 1..20: note = CRISPR gRNA sequence
  source 1..20: mol_type = other DNA
ggagctctgctctgtgaggc

SEQ ID NO: 97867 - DNA, 20 bp, synthetic construct
  misc_feature 1..20: note = CRISPR gRNA sequence
  source 1..20: mol_type = other DNA
gagctctgctctgtgaggct

SEQ ID NO: 97868 - DNA, 20 bp, synthetic construct
  misc_feature 1..20: note = CRISPR gRNA sequence
  source 1..20: mol_type = other DNA
ctgctctgtgaggctgggaa

SEQ ID NO: 97869 - DNA, 20 bp, synthetic construct
  misc_feature 1..20: note = CRISPR gRNA sequence
  source 1..20: mol_type = other DNA
tgctctgtgaggctgggaat

SEQ ID NO: 97870 - DNA, 20 bp, synthetic construct
  misc_feature 1..20: note = CRISPR gRNA sequence
  source 1..20: mol_type = other DNA
gctctgtgaggctgggaatg

SEQ ID NO: 97871 - DNA, 20 bp, synthetic construct
  misc_feature 1..20: note = CRISPR gRNA sequence
  source 1..20: mol_type = other DNA
atggggctgtctcgtgttct

SEQ ID NO: 97872 - DNA, 20 bp, synthetic construct
  misc_feature 1..20: note = CRISPR gRNA sequence
  source 1..20: mol_type = other DNA
tgtctcgtgttctcggcacc

SEQ ID NO: 97873 - DNA, 20 bp, synthetic construct
  misc_feature 1..20: note = CRISPR gRNA sequence
  source 1..20: mol_type = other DNA
tctcgtgttctcggcaccta

SEQ ID NO: 97874 - DNA, 20 bp, synthetic construct
  misc_feature 1..20: note = CRISPR gRNA sequence
  source 1..20: mol_type = other DNA
cgtgttctcggcacctagag

SEQ ID NO: 97875 - DNA, 20 bp, synthetic construct
  misc_feature 1..20: note = CRISPR gRNA sequence
  source 1..20: mol_type = other DNA
gtgttctcggcacctagagc

SEQ ID NO: 97876 - DNA, 20 bp, synthetic construct
  misc_feature 1..20: note = CRISPR gRNA sequence
  source 1..20: mol_type = other DNA
agagcaggcctgcacctttc

SEQ ID NO: 97877 - DNA, 20 bp, synthetic construct
  misc_feature 1..20: note = CRISPR gRNA sequence
  source 1..20: mol_type = other DNA
caagtactctgtgaacattt

SEQ ID NO: 97878 - DNA, 20 bp, synthetic construct
  misc_feature 1..20: note = CRISPR gRNA sequence
  source 1..20: mol_type = other DNA
aagtactctgtgaacatttg

SEQ ID NO: 97879 - DNA, 20 bp, synthetic construct
  misc_feature 1..20: note = CRISPR gRNA sequence
  source 1..20: mol_type = other DNA
tactctgtgaacatttgagg

SEQ ID NO: 97880 - DNA, 20 bp, synthetic construct
  misc_feature 1..20: note = CRISPR gRNA sequence
  source 1..20: mol_type = other DNA
actctgtgaacatttgaggc

SEQ ID NO: 97881 - DNA, 20 bp, synthetic construct
  misc_feature 1..20: note = CRISPR gRNA sequence
  source 1..20: mol_type = other DNA
gaacatttgaggcaggaatg

SEQ ID NO: 97882 - DNA, 20 bp, synthetic construct
  misc_feature 1..20: note = CRISPR gRNA sequence
  source 1..20: mol_type = other DNA
aacatttgaggcaggaatga

SEQ ID NO: 97883 - DNA, 20 bp, synthetic construct
  misc_feature 1..20: note = CRISPR gRNA sequence
  source 1..20: mol_type = other DNA
tttgaggcaggaatgaaggc

SEQ ID NO: 97884 - DNA, 20 bp, synthetic construct
  misc_feature 1..20: note = CRISPR gRNA sequence
  source 1..20: mol_type = other DNA
ttgaggcaggaatgaaggcc

SEQ ID NO: 97885 - DNA, 20 bp, synthetic construct
  misc_feature 1..20: note = CRISPR gRNA sequence
  source 1..20: mol_type = other DNA
gaggcaggaatgaaggccag

SEQ ID NO: 97886 - DNA, 20 bp, synthetic construct
  misc_feature 1..20: note = CRISPR gRNA sequence
  source 1..20: mol_type = other DNA
aggcaggaatgaaggccagg

SEQ ID NO: 97887 - DNA, 20 bp, synthetic construct
  misc_feature 1..20: note = CRISPR gRNA sequence
  source 1..20: mol_type = other DNA
ggaatgaaggccaggaggct

SEQ ID NO: 97888 - DNA, 20 bp, synthetic construct
  misc_feature 1..20: note = CRISPR gRNA sequence
  source 1..20: mol_type = other DNA
aatgaaggccaggaggctga

SEQ ID NO: 97889 - DNA, 20 bp, synthetic construct
  misc_feature 1..20: note = CRISPR gRNA sequence
  source 1..20: mol_type = other DNA
atgaaggccaggaggctgag

SEQ ID NO: 97890 - DNA, 20 bp, synthetic construct
  misc_feature 1..20: note = CRISPR gRNA sequence
  source 1..20: mol_type = other DNA
gccaggaggctgagaggtcc

SEQ ID NO: 97891 - DNA, 20 bp, synthetic construct
  misc_feature 1..20: note = CRISPR gRNA sequence
  source 1..20: mol_type = other DNA
ccaggaggctgagaggtcct

SEQ ID NO: 97892 - DNA, 20 bp, synthetic construct
  misc_feature 1..20: note = CRISPR gRNA sequence
  source 1..20: mol_type = other DNA
caggaggctgagaggtcctg

SEQ ID NO: 97893 - DNA, 20 bp, synthetic construct
  misc_feature 1..20: note = CRISPR gRNA sequence
  source 1..20: mol_type = other DNA
aggctgagaggtcctgggga

SEQ ID NO: 97894 - DNA, 20 bp, synthetic construct
  misc_feature 1..20: note = CRISPR gRNA sequence
  source 1..20: mol_type = other DNA
ggctgagaggtcctggggat

SEQ ID NO: 97895 - DNA, 20 bp, synthetic construct
  misc_feature 1..20: note = CRISPR gRNA sequence
  source 1..20: mol_type = other DNA
tgagaggtcctggggatggg

SEQ ID NO: 97896 - DNA, 20 bp, synthetic construct
  misc_feature 1..20: note = CRISPR gRNA sequence
  source 1..20: mol_type = other DNA
ggcagtccctcacccaatca

SEQ ID NO: 97897 - DNA, 20 bp, synthetic construct
  misc_feature 1..20: note = CRISPR gRNA sequence
  source 1..20: mol_type = other DNA
ttgatgtccacgtcacgctc

SEQ ID NO: 97898 - DNA, 20 bp, synthetic construct
  misc_feature 1..20: note = CRISPR gRNA sequence
  source 1..20: mol_type = other DNA
atgtccacgtcacgctccag

SEQ ID NO: 97899 - DNA, 20 bp, synthetic construct
  misc_feature 1..20: note = CRISPR gRNA sequence
  source 1..20: mol_type = other DNA
tccacgtcacgctccagcag

SEQ ID NO: 97900 - DNA, 20 bp, synthetic construct
  misc_feature 1..20: note = CRISPR gRNA sequence
  source 1..20: mol_type = other DNA
gcagccccacaatgtctgtg

SEQ ID NO: 97901 - DNA, 20 bp, synthetic construct
  misc_feature 1..20: note = CRISPR gRNA sequence
  source 1..20: mol_type = other DNA
gtctgtgtagccgcctgtgc

SEQ ID NO: 97902 - DNA, 20 bp, synthetic construct
  misc_feature 1..20: note = CRISPR gRNA sequence
  source 1..20: mol_type = other DNA
gtgtagccgcctgtgctggc

SEQ ID NO: 97903 - DNA, 20 bp, synthetic construct
  misc_feature 1..20: note = CRISPR gRNA sequence
  source 1..20: mol_type = other DNA
ccgcctgtgctggccagcga

SEQ ID NO: 97904 - DNA, 20 bp, synthetic construct
  misc_feature 1..20: note = CRISPR gRNA sequence
  source 1..20: mol_type = other DNA
cgcctgtgctggccagcgac

SEQ ID NO: 97905 - DNA, 20 bp, synthetic construct
  misc_feature 1..20: note = CRISPR gRNA sequence
  source 1..20: mol_type = other DNA
gcctgtgctggccagcgaca

SEQ ID NO: 97906 - DNA, 20 bp, synthetic construct
  misc_feature 1..20: note = CRISPR gRNA sequence
  source 1..20: mol_type = other DNA
gcgctctctcgctcttttgc

SEQ ID NO: 97907 - DNA, 20 bp, synthetic construct
  misc_feature 1..20: note = CRISPR gRNA sequence
  source 1..20: mol_type = other DNA
cgctctctcgctcttttgcc

SEQ ID NO: 97908 - DNA, 20 bp, synthetic construct
  misc_feature 1..20: note = CRISPR gRNA sequence
  source 1..20: mol_type = other DNA
ctcgctcttttgccaggatg

SEQ ID NO: 97909 - DNA, 20 bp, synthetic construct
  misc_feature 1..20: note = CRISPR gRNA sequence
  source 1..20: mol_type = other DNA
tcgctcttttgccaggatgt

SEQ ID NO: 97910 - DNA, 20 bp, synthetic construct
  misc_feature 1..20: note = CRISPR gRNA sequence
  source 1..20: mol_type = other DNA
cgctcttttgccaggatgtg

SEQ ID NO: 97911 - DNA, 20 bp, synthetic construct
  misc_feature 1..20: note = CRISPR gRNA sequence
  source 1..20: mol_type = other DNA
gctcttttgccaggatgtgg

SEQ ID NO: 97912 - DNA, 20 bp, synthetic construct
  misc_feature 1..20: note = CRISPR gRNA sequence
  source 1..20: mol_type = other DNA
ttttgccaggatgtgggggt

SEQ ID NO: 97913 - DNA, 20 bp, synthetic construct
  misc_feature 1..20: note = CRISPR gRNA sequence
  source 1..20: mol_type = other DNA
atgtgggggtcggcaccctg

SEQ ID NO: 97914 - DNA, 20 bp, synthetic construct
  misc_feature 1..20: note = CRISPR gRNA sequence
  source 1..20: mol_type = other DNA
tgtgggggtcggcaccctgc

SEQ ID NO: 97915 - DNA, 20 bp, synthetic construct
  misc_feature 1..20: note = CRISPR gRNA sequence
  source 1..20: mol_type = other DNA
gtgggggtcggcaccctgca

SEQ ID NO: 97916 - DNA, 20 bp, synthetic construct
  misc_feature 1..20: note = CRISPR gRNA sequence
  source 1..20: mol_type = other DNA
gggggtcggcaccctgcagg

SEQ ID NO: 97917 - DNA, 20 bp, synthetic construct
  misc_feature 1..20: note = CRISPR gRNA sequence
  source 1..20: mol_type = other DNA
ggtcggcaccctgcagggag

SEQ ID NO: 97918 - DNA, 20 bp, synthetic construct
  misc_feature 1..20: note = CRISPR gRNA sequence
  source 1..20: mol_type = other DNA
cggcaccctgcagggagaag

SEQ ID NO: 97919 - DNA, 20 bp, synthetic construct
  misc_feature 1..20: note = CRISPR gRNA sequence
  source 1..20: mol_type = other DNA
ggcaccctgcagggagaaga

SEQ ID NO: 97920 - DNA, 20 bp, synthetic construct
  misc_feature 1..20: note = CRISPR gRNA sequence
  source 1..20: mol_type = other DNA
gcaccctgcagggagaagaa

SEQ ID NO: 97921 - DNA, 20 bp, synthetic construct
  misc_feature 1..20: note = CRISPR gRNA sequence
  source 1..20: mol_type = other DNA
cctgcagggagaagaaggga

SEQ ID NO: 97922 - DNA, 20 bp, synthetic construct
  misc_feature 1..20: note = CRISPR gRNA sequence
  source 1..20: mol_type = other DNA
gcagggagaagaagggacag

SEQ ID NO: 97923 - DNA, 20 bp, synthetic construct
  misc_feature 1..20: note = CRISPR gRNA sequence
  source 1..20: mol_type = other DNA
gggagaagaagggacagtgg

SEQ ID NO: 97924 - DNA, 20 bp, synthetic construct
  misc_feature 1..20: note = CRISPR gRNA sequence
  source 1..20: mol_type = other DNA
ggagaagaagggacagtggt

SEQ ID NO: 97925 - DNA, 20 bp, synthetic construct
  misc_feature 1..20: note = CRISPR gRNA sequence
  source 1..20: mol_type = other DNA
aagaagggacagtggtagga

SEQ ID NO: 97926 - DNA, 20 bp, synthetic construct
  misc_feature 1..20: note = CRISPR gRNA sequence
  source 1..20: mol_type = other DNA
gggacagtggtaggatggat

SEQ ID NO: 97927 - DNA, 20 bp, synthetic construct
  misc_feature 1..20: note = CRISPR gRNA sequence
  source 1..20: mol_type = other DNA
ggacagtggtaggatggatt

SEQ ID NO: 97928 - DNA, 20 bp, synthetic construct
  misc_feature 1..20: note = CRISPR gRNA sequence
  source 1..20: mol_type = other DNA
gacagtggtaggatggattg

SEQ ID NO: 97929 - DNA, 20 bp, synthetic construct
  misc_feature 1..20: note = CRISPR gRNA sequence
  source 1..20: mol_type = other DNA
aggatggattggggcataac

SEQ ID NO: 97930 - DNA, 20 bp, synthetic construct
  misc_feature 1..20: note = CRISPR gRNA sequence
  source 1..20: mol_type = other DNA
ggatggattggggcataacc

SEQ ID NO: 97931 - DNA, 20 bp, synthetic construct
  misc_feature 1..20: note = CRISPR gRNA sequence
  source 1..20: mol_type = other DNA
tggggcataaccaggaatcc

SEQ ID NO: 97932 - DNA, 20 bp, synthetic construct
  misc_feature 1..20: note = CRISPR gRNA sequence
  source 1..20: mol_type = other DNA
ggggcataaccaggaatcct

SEQ ID NO: 97933 - DNA, 20 bp, synthetic construct
  misc_feature 1..20: note = CRISPR gRNA sequence
  source 1..20: mol_type = other DNA
gggcataaccaggaatcctg

SEQ ID NO: 97934 - DNA, 20 bp, synthetic construct
  misc_feature 1..20: note = CRISPR gRNA sequence
  source 1..20: mol_type = other DNA
caggaatcctggggtaccca

SEQ ID NO: 97935 - DNA, 20 bp, synthetic construct
  misc_feature 1..20: note = CRISPR gRNA sequence
  source 1..20: mol_type = other DNA
gaatcctggggtacccacag

SEQ ID NO: 97936 - DNA, 20 bp, synthetic construct
  misc_feature 1..20: note = CRISPR gRNA sequence
  source 1..20: mol_type = other DNA
cgcatctttttttttttttt

SEQ ID NO: 97937 - DNA, 20 bp, synthetic construct
  misc_feature 1..20: note = CRISPR gRNA sequence
  source 1..20: mol_type = other DNA
catctttttttttttttttg

SEQ ID NO: 97938 - DNA, 20 bp, synthetic construct
  misc_feature 1..20: note = CRISPR gRNA sequence
  source 1..20: mol_type = other DNA
tttttttttttttttggaga

SEQ ID NO: 97939 - DNA, 20 bp, synthetic construct
  misc_feature 1..20: note = CRISPR gRNA sequence
  source 1..20: mol_type = other DNA
tttttttttttttggagata

SEQ ID NO: 97940 - DNA, 20 bp, synthetic construct
  misc_feature 1..20: note = CRISPR gRNA sequence
  source 1..20: mol_type = other DNA
tagagtcttgctctgttgcc

SEQ ID NO: 97941 - DNA, 20 bp, synthetic construct
  misc_feature 1..20: note = CRISPR gRNA sequence
  source 1..20: mol_type = other DNA
agagtcttgctctgttgccc

SEQ ID NO: 97942 - DNA, 20 bp, synthetic construct
  misc_feature 1..20: note = CRISPR gRNA sequence
  source 1..20: mol_type = other DNA
tcttgctctgttgcccaggc

SEQ ID NO: 97943 - DNA, 20 bp, synthetic construct
  misc_feature 1..20: note = CRISPR gRNA sequence
  source 1..20: mol_type = other DNA
ttgctctgttgcccaggctg

SEQ ID NO: 97944 - DNA, 20 bp, synthetic construct
  misc_feature 1..20: note = CRISPR gRNA sequence
  source 1..20: mol_type = other DNA
ctgttgcccaggctggagtg

SEQ ID NO: 97945 - DNA, 20 bp, synthetic construct
  misc_feature 1..20: note = CRISPR gRNA sequence
  source 1..20: mol_type = other DNA
ttgcccaggctggagtgcag

SEQ ID NO: 97946 - DNA, 20 bp, synthetic construct
  misc_feature 1..20: note = CRISPR gRNA sequence
  source 1..20: mol_type = other DNA
ggagtgcagtggcgcaatct

SEQ ID NO: 97947 - DNA, 20 bp, synthetic construct
  misc_feature 1..20: note = CRISPR gRNA sequence
  source 1..20: mol_type = other DNA
tcactgctacctccgcctcc

SEQ ID NO: 97948 - DNA, 20 bp, synthetic construct
  misc_feature 1..20: note = CRISPR gRNA sequence
  source 1..20: mol_type = other DNA
cactgctacctccgcctccc

SEQ ID NO: 97949 - DNA, 20 bp, synthetic construct
  misc_feature 1..20: note = CRISPR gRNA sequence
  source 1..20: mol_type = other DNA
ctccgcctcccaggttcaca

SEQ ID NO: 97950 - DNA, 20 bp, synthetic construct
  misc_feature 1..20: note = CRISPR gRNA sequence
  source 1..20: mol_type = other DNA
ttcacacagttctcccacct

SEQ ID NO: 97951 - DNA, 20 bp, synthetic construct
  misc_feature 1..20: note = CRISPR gRNA sequence
  source 1..20: mol_type = other DNA
agttctcccacctcagcctc

SEQ ID NO: 97952 - DNA, 20 bp, synthetic construct
  misc_feature 1..20: note = CRISPR gRNA sequence
  source 1..20: mol_type = other DNA
ttctcccacctcagcctcca

SEQ ID NO: 97953 - DNA, 20 bp, synthetic construct
  misc_feature 1..20: note = CRISPR gRNA sequence
  source 1..20: mol_type = other DNA
acctcagcctccagagtacc

SEQ ID NO: 97954 - DNA, 20 bp, synthetic construct
  misc_feature 1..20: note = CRISPR gRNA sequence
  source 1..20: mol_type = other DNA
cctcagcctccagagtacct

SEQ ID NO: 97955 - DNA, 20 bp, synthetic construct
  misc_feature 1..20: note = CRISPR gRNA sequence
  source 1..20: mol_type = other DNA
ctccagagtacctgggatta

SEQ ID NO: 97956 - DNA, 20 bp, synthetic construct
  misc_feature 1..20: note = CRISPR gRNA sequence
  source 1..20: mol_type = other DNA
tccagagtacctgggattac

SEQ ID NO: 97957 - DNA, 20 bp, synthetic construct
  misc_feature 1..20: note = CRISPR gRNA sequence
  source 1..20: mol_type = other DNA
caggcacccaccacgacgcc

SEQ ID NO: 97958 - DNA, 20 bp, synthetic construct
  misc_feature 1..20: note = CRISPR gRNA sequence
  source 1..20: mol_type = other DNA
ggctaatttttgtatttttt

SEQ ID NO: 97959 - DNA, 20 bp, synthetic construct
  misc_feature 1..20: note = CRISPR gRNA sequence
  source 1..20: mol_type = other DNA
taatttttgtatttttttag

SEQ ID NO: 97960 - DNA, 20 bp, synthetic construct
  misc_feature 1..20: note = CRISPR gRNA sequence
  source 1..20: mol_type = other DNA
atttttgtatttttttagta

SEQ ID NO: 97961 - DNA, 20 bp, synthetic construct
  misc_feature 1..20: note = CRISPR gRNA sequence
  source 1..20: mol_type = other DNA
ttgtatttttttagtagaga

SEQ ID NO: 97962 - DNA, 20 bp, synthetic construct
  misc_feature 1..20: note = CRISPR gRNA sequence
  source 1..20: mol_type = other DNA
tgtatttttttagtagagac

SEQ ID NO: 97963 - DNA, 20 bp, synthetic construct
  misc_feature 1..20: note = CRISPR gRNA sequence
  source 1..20: mol_type = other DNA
gtatttttttagtagagaca

SEQ ID NO: 97964 - DNA, 20 bp, synthetic construct
  misc_feature 1..20: note = CRISPR gRNA sequence
  source 1..20: mol_type = other DNA
agacagggtttcacccatgt

SEQ ID NO: 97965 - DNA, 20 bp, synthetic construct
  misc_feature 1..20: note = CRISPR gRNA sequence
  source 1..20: mol_type = other DNA
agggtttcacccatgttggc

SEQ ID NO: 97966 - DNA, 20 bp, synthetic construct
  misc_feature 1..20: note = CRISPR gRNA sequence
  source 1..20: mol_type = other DNA
gggtttcacccatgttggcc

SEQ ID NO: 97967 - DNA, 20 bp, synthetic construct
  misc_feature 1..20: note = CRISPR gRNA sequence
  source 1..20: mol_type = other DNA
ttcacccatgttggccgggc

SEQ ID NO: 97968 - DNA, 20 bp, synthetic construct
  misc_feature 1..20: note = CRISPR gRNA sequence
  source 1..20: mol_type = other DNA
ggtcttgaactcctgacctc

SEQ ID NO: 97969 - DNA, 20 bp, synthetic construct
  misc_feature 1..20: note = CRISPR gRNA sequence
  source 1..20: mol_type = other DNA
ctcaagtgatccacccgcct

SEQ ID NO: 97970 - DNA, 20 bp, synthetic construct
  misc_feature 1..20: note = CRISPR gRNA sequence
  source 1..20: mol_type = other DNA
ccacccgcctcggcctccca

SEQ ID NO: 97971 - DNA, 20 bp, synthetic construct
  misc_feature 1..20: note = CRISPR gRNA sequence
  source 1..20: mol_type = other DNA
gcctcggcctcccaaagtgc

SEQ ID NO: 97972 - DNA, 20 bp, synthetic construct
  misc_feature 1..20: note = CRISPR gRNA sequence
  source 1..20: mol_type = other DNA
cctcggcctcccaaagtgct

SEQ ID NO: 97973 - DNA, 20 bp, synthetic construct
  misc_feature 1..20: note = CRISPR gRNA sequence
  source 1..20: mol_type = other DNA
ctcccaaagtgctgggatta

SEQ ID NO: 97974 - DNA, 20 bp, synthetic construct
  misc_feature 1..20: note = CRISPR gRNA sequence
  source 1..20: mol_type = other DNA
tcccaaagtgctgggattac

SEQ ID NO: 97975 - DNA, 20 bp, synthetic construct
  misc_feature 1..20: note = CRISPR gRNA sequence
  source 1..20: mol_type = other DNA
agtgctgggattacaggcat

SEQ ID NO: 97976 - DNA, 20 bp, synthetic construct
  misc_feature 1..20: note = CRISPR gRNA sequence
  source 1..20: mol_type = other DNA
caggcatgagccactgcacc

SEQ ID NO: 97977 - DNA, 20 bp, synthetic construct
  misc_feature 1..20: note = CRISPR gRNA sequence
  source 1..20: mol_type = other DNA
catgagccactgcacccagc

SEQ ID NO: 97978 - DNA, 20 bp, synthetic construct
  misc_feature 1..20: note = CRISPR gRNA sequence
  source 1..20: mol_type = other DNA
gagccactgcacccagccag

SEQ ID NO: 97979 - DNA, 20 bp, synthetic construct
  misc_feature 1..20: note = CRISPR gRNA sequence
  source 1..20: mol_type = other DNA
cagccagcagccgcatctca

SEQ ID NO: 97980 - DNA, 20 bp, synthetic construct
  misc_feature 1..20: note = CRISPR gRNA sequence
  source 1..20: mol_type = other DNA
agcagccgcatctcaaagac

SEQ ID NO: 97981 - DNA, 20 bp, synthetic construct
  misc_feature 1..20: note = CRISPR gRNA sequence
  source 1..20: mol_type = other DNA
gcagccgcatctcaaagaca

SEQ ID NO: 97982 - DNA, 20 bp, synthetic construct
  misc_feature 1..20: note = CRISPR gRNA sequence
  source 1..20: mol_type = other DNA
gcatctcaaagacaaggcgc

SEQ ID NO: 97983 - DNA, 20 bp, synthetic construct
  misc_feature 1..20: note = CRISPR gRNA sequence
  source 1..20: mol_type = other DNA
tctcaaagacaaggcgccag

SEQ ID NO: 97984 - DNA, 20 bp, synthetic construct
  misc_feature 1..20: note = CRISPR gRNA sequence
  source 1..20: mol_type = other DNA
agacaaggcgccagcagaca

SEQ ID NO: 97985 - DNA, 20 bp, synthetic construct
  misc_feature 1..20: note = CRISPR gRNA sequence
  source 1..20: mol_type = other DNA
agcagacacagccaaaaccc

SEQ ID NO: 97986 - DNA, 20 bp, synthetic construct
  misc_feature 1..20: note = CRISPR gRNA sequence
  source 1..20: mol_type = other DNA
ccaaaaccccagcccaccct

SEQ ID NO: 97987 - DNA, 20 bp, synthetic construct
  misc_feature 1..20: note = CRISPR gRNA sequence
  source 1..20: mol_type = other DNA
caaaaccccagcccacccta

SEQ ID NO: 97988 - DNA, 20 bp, synthetic construct
  misc_feature 1..20: note = CRISPR gRNA sequence
  source 1..20: mol_type = other DNA
ccagcccaccctaaggcccc

SEQ ID NO: 97989 - DNA, 20 bp, synthetic construct
  misc_feature 1..20: note = CRISPR gRNA sequence
  source 1..20: mol_type = other DNA
cagcccaccctaaggccccc

SEQ ID NO: 97990 - DNA, 20 bp, synthetic construct
  misc_feature 1..20: note = CRISPR gRNA sequence
  source 1..20: mol_type = other DNA
taaggcccccgggaaccccc

SEQ ID NO: 97991 - DNA, 20 bp, synthetic construct
  misc_feature 1..20: note = CRISPR gRNA sequence
  source 1..20: mol_type = other DNA
ccgggaaccccccagctgcc

SEQ ID NO: 97992 - DNA, 20 bp, synthetic construct
  misc_feature 1..20: note = CRISPR gRNA sequence
  source 1..20: mol_type = other DNA
gaaccccccagctgcccagc

SEQ ID NO: 97993 - DNA, 20 bp, synthetic construct
  misc_feature 1..20: note = CRISPR gRNA sequence
  source 1..20: mol_type = other DNA
aaccccccagctgcccagct

SEQ ID NO: 97994 - DNA, 20 bp, synthetic construct
  misc_feature 1..20: note = CRISPR gRNA sequence
  source 1..20: mol_type = other DNA
ccccagctgcccagctgggc

SEQ ID NO: 97995 - DNA, 20 bp, synthetic construct
  misc_feature 1..20: note = CRISPR gRNA sequence
  source 1..20: mol_type = other DNA
cccagctgcccagctgggct

SEQ ID NO: 97996 - DNA, 20 bp, synthetic construct
  misc_feature 1..20: note = CRISPR gRNA sequence
  source 1..20: mol_type = other DNA
gggctgggacgcacccactc

SEQ ID NO: 97997 - DNA, 20 bp, synthetic construct
  misc_feature 1..20: note = CRISPR gRNA sequence
  source 1..20: mol_type = other DNA
ctgggacgcacccactccag

SEQ ID NO: 97998 - DNA, 20 bp, synthetic construct
  misc_feature 1..20: note = CRISPR gRNA sequence
  source 1..20: mol_type = other DNA
tgggacgcacccactccagc

SEQ ID NO: 97999 - DNA, 20 bp, synthetic construct
  misc_feature 1..20: note = CRISPR gRNA sequence
  source 1..20: mol_type = other DNA
gacgcacccactccagcagg

SEQ ID NO: 98000 - DNA, 20 bp, synthetic construct
  misc_feature 1..20: note = CRISPR gRNA sequence
  source 1..20: mol_type = other DNA
ccactccagcaggaagcgaa

SEQ ID NO: 98001 - DNA, 20 bp, synthetic construct
  misc_feature 1..20: note = CRISPR gRNA sequence
  source 1..20: mol_type = other DNA
gaacggtctcaatctctcca

SEQ ID NO: 98002 - DNA, 20 bp, synthetic construct
  misc_feature 1..20: note = CRISPR gRNA sequence
  source 1..20: mol_type = other DNA
aacggtctcaatctctccaa

SEQ ID NO: 98003 - DNA, 20 bp, synthetic construct
  misc_feature 1..20: note = CRISPR gRNA sequence
  source 1..20: mol_type = other DNA
ggtctcaatctctccaaagg

SEQ ID NO: 98004 - DNA, 20 bp, synthetic construct
  misc_feature 1..20: note = CRISPR gRNA sequence
  source 1..20: mol_type = other DNA
tctcaatctctccaaaggcg

SEQ ID NO: 98005 - DNA, 20 bp, synthetic construct
  misc_feature 1..20: note = CRISPR gRNA sequence
  source 1..20: mol_type = other DNA
ctcaatctctccaaaggcgg

SEQ ID NO: 98006 - DNA, 20 bp, synthetic construct
  misc_feature 1..20: note = CRISPR gRNA sequence
  source 1..20: mol_type = other DNA
tctctccaaaggcggaggcc

SEQ ID NO: 98007 - DNA, 20 bp, synthetic construct
  misc_feature 1..20: note = CRISPR gRNA sequence
  source 1..20: mol_type = other DNA
ccaaaggcggaggcccagat

SEQ ID NO: 98008 - DNA, 20 bp, synthetic construct
  misc_feature 1..20: note = CRISPR gRNA sequence
  source 1..20: mol_type = other DNA
caaaggcggaggcccagatg

SEQ ID NO: 98009 - DNA, 20 bp, synthetic construct
  misc_feature 1..20: note = CRISPR gRNA sequence
  source 1..20: mol_type = other DNA
aaaggcggaggcccagatga

SEQ ID NO: 98010 - DNA, 20 bp, synthetic construct
  misc_feature 1..20: note = CRISPR gRNA sequence
  source 1..20: mol_type = other DNA
aaggcggaggcccagatgag

SEQ ID NO: 98011 - DNA, 20 bp, synthetic construct
  misc_feature 1..20: note = CRISPR gRNA sequence
  source 1..20: mol_type = other DNA
aggcggaggcccagatgagg

SEQ ID NO: 98012 - DNA, 20 bp, synthetic construct
  misc_feature 1..20: note = CRISPR gRNA sequence
  source 1..20: mol_type = other DNA
ggcggaggcccagatgaggg

SEQ ID NO: 98013 - DNA, 20 bp, synthetic construct
  misc_feature 1..20: note = CRISPR gRNA sequence
  source 1..20: mol_type = other DNA
aggcccagatgaggggggtg

SEQ ID NO: 98014 - DNA, 20 bp, synthetic construct
  misc_feature 1..20: note = CRISPR gRNA sequence
  source 1..20: mol_type = other DNA
ggggtgaagccgcgctcgtc

SEQ ID NO: 98015 - DNA, 20 bp, synthetic construct
  misc_feature 1..20: note = CRISPR gRNA sequence
  source 1..20: mol_type = other DNA
cgctcgtctggcttgttgac

SEQ ID NO: 98016 - DNA, 20 bp, synthetic construct
  misc_feature 1..20: note = CRISPR gRNA sequence
  source 1..20: mol_type = other DNA
gctcgtctggcttgttgacg

SEQ ID NO: 98017 - DNA, 20 bp, synthetic construct
  misc_feature 1..20: note = CRISPR gRNA sequence
  source 1..20: mol_type = other DNA
ttgttgacgaggttgtcacc

SEQ ID NO: 98018 - DNA, 20 bp, synthetic construct
  misc_feature 1..20: note = CRISPR gRNA sequence
  source 1..20: mol_type = other DNA
ttgacgaggttgtcacctgg

SEQ ID NO: 98019 - DNA, 20 bp, synthetic construct
  misc_feature 1..20: note = CRISPR gRNA sequence
  source 1..20: mol_type = other DNA
tgacgaggttgtcacctggc

SEQ ID NO: 98020 - DNA, 20 bp, synthetic construct
  misc_feature 1..20: note = CRISPR gRNA sequence
  source 1..20: mol_type = other DNA
acgaggttgtcacctggcag

SEQ ID NO: 98021 - DNA, 20 bp, synthetic construct
  misc_feature 1..20: note = CRISPR gRNA sequence
  source 1..20: mol_type = other DNA
cgaggttgtcacctggcagg

SEQ ID NO: 98022 - DNA, 20 bp, synthetic construct
  misc_feature 1..20: note = CRISPR gRNA sequence
  source 1..20: mol_type = other DNA
aggttgtcacctggcaggag

SEQ ID NO: 98023 - DNA, 20 bp, synthetic construct
  misc_feature 1..20: note = CRISPR gRNA sequence
  source 1..20: mol_type = other DNA
ggttgtcacctggcaggagg

SEQ ID NO: 98024 - DNA, 20 bp, synthetic construct
  misc_feature 1..20: note = CRISPR gRNA sequence
  source 1..20: mol_type = other DNA
tgtcacctggcaggaggagg

SEQ ID NO: 98025 - DNA, 20 bp, synthetic construct
  misc_feature 1..20: note = CRISPR gRNA sequence
  source 1..20: mol_type = other DNA
gtcacctggcaggaggaggc

SEQ ID NO: 98026 - DNA, 20 bp, synthetic construct
  misc_feature 1..20: note = CRISPR gRNA sequence
  source 1..20: mol_type = other DNA
gaggaggcgggcaataccac

SEQ ID NO: 98027 - DNA, 20 bp, synthetic construct
  misc_feature 1..20: note = CRISPR gRNA sequence
  source 1..20: mol_type = other DNA
aggaggcgggcaataccacc

SEQ ID NO: 98028 - DNA, 20 bp, synthetic construct
  misc_feature 1..20: note = CRISPR gRNA sequence
  source 1..20: mol_type = other DNA
gcacccctgccccctatccc

SEQ ID NO: 98029 - DNA, 20 bp, synthetic construct
  misc_feature 1..20: note = CRISPR gRNA sequence
  source 1..20: mol_type = other DNA
ctatccccagtgctgccaaa

SEQ ID NO: 98030 - DNA, 20 bp, synthetic construct
  misc_feature 1..20: note = CRISPR gRNA sequence
  source 1..20: mol_type = other DNA
tatccccagtgctgccaaat

SEQ ID NO: 98031 - DNA, 20 bp, synthetic construct
  misc_feature 1..20: note = CRISPR gRNA sequence
  source 1..20: mol_type = other DNA
atccccagtgctgccaaatg

SEQ ID NO: 98032 - DNA, 20 bp, synthetic construct
  misc_feature 1..20: note = CRISPR gRNA sequence
  source 1..20: mol_type = other DNA
cagtgctgccaaatggggac

SEQ ID NO: 98033 - DNA, 20 bp, synthetic construct
  misc_feature 1..20: note = CRISPR gRNA sequence
  source 1..20: mol_type = other DNA
agtgctgccaaatggggacg

SEQ ID NO: 98034 - DNA, 20 bp, synthetic construct
  misc_feature 1..20: note = CRISPR gRNA sequence
  source 1..20: mol_type = other DNA
gctgccaaatggggacgagg

SEQ ID NO: 98035 - DNA, 20 bp, synthetic construct
  misc_feature 1..20: note = CRISPR gRNA sequence
  source 1..20: mol_type = other DNA
ctgccaaatggggacgaggt

SEQ ID NO: 98036 - DNA, 20 bp, synthetic construct
  misc_feature 1..20: note = CRISPR gRNA sequence
  source 1..20: mol_type = other DNA
tgccaaatggggacgaggtg

SEQ ID NO: 98037 - DNA, 20 bp, synthetic construct
  misc_feature 1..20: note = CRISPR gRNA sequence
  source 1..20: mol_type = other DNA
gccaaatggggacgaggtgg

SEQ ID NO: 98038 - DNA, 20 bp, synthetic construct
  misc_feature 1..20: note = CRISPR gRNA sequence
  source 1..20: mol_type = other DNA
ccaaatggggacgaggtggg

SEQ ID NO: 98039 - DNA, 20 bp, synthetic construct
  misc_feature 1..20: note = CRISPR gRNA sequence
  source 1..20: mol_type = other DNA
atggggacgaggtggggggc

SEQ ID NO: 98040 - DNA, 20 bp, synthetic construct
  misc_feature 1..20: note = CRISPR gRNA sequence
  source 1..20: mol_type = other DNA
tggggacgaggtggggggct

SEQ ID NO: 98041 - DNA, 20 bp, synthetic construct
  misc_feature 1..20: note = CRISPR gRNA sequence
  source 1..20: mol_type = other DNA
ggggacgaggtggggggctg

SEQ ID NO: 98042 - DNA, 20 bp, synthetic construct
  misc_feature 1..20: note = CRISPR gRNA sequence
  source 1..20: mol_type = other DNA
acgaggtggggggctggggt

SEQ ID NO: 98043 - DNA, 20 bp, synthetic construct
  misc_feature 1..20: note = CRISPR gRNA sequence
  source 1..20: mol_type = other DNA
ggtggggggctggggttaga

SEQ ID NO: 98044 - DNA, 20 bp, synthetic construct
  misc_feature 1..20: note = CRISPR gRNA sequence
  source 1..20: mol_type = other DNA
gtggggggctggggttagac

SEQ ID NO: 98045 - DNA, 20 bp, synthetic construct
  misc_feature 1..20: note = CRISPR gRNA sequence
  source 1..20: mol_type = other DNA
tggggggctggggttagaca

SEQ ID NO: 98046 - DNA, 20 bp, synthetic construct
  misc_feature 1..20: note = CRISPR gRNA sequence
  source 1..20: mol_type = other DNA
ggggggctggggttagacag

SEQ ID NO: 98047 - DNA, 20 bp, synthetic construct
  misc_feature 1..20: note = CRISPR gRNA sequence
  source 1..20: mol_type = other DNA
ctggggttagacaggggaat

SEQ ID NO: 98048 - DNA, 20 bp, synthetic construct
  misc_feature 1..20: note = CRISPR gRNA sequence
  source 1..20: mol_type = other DNA
tggggttagacaggggaatg

SEQ ID NO: 98049 - DNA, 20 bp, synthetic construct
  misc_feature 1..20: note = CRISPR gRNA sequence
  source 1..20: mol_type = other DNA
ggggttagacaggggaatga

SEQ ID NO: 98050 - DNA, 20 bp, synthetic construct
  misc_feature 1..20: note = CRISPR gRNA sequence
  source 1..20: mol_type = other DNA
gggttagacaggggaatgag

SEQ ID NO: 98051 - DNA, 20 bp, synthetic construct
  misc_feature 1..20: note = CRISPR gRNA sequence
  source 1..20: mol_type = other DNA
ggttagacaggggaatgagg

SEQ ID NO: 98052 - DNA, 20 bp, synthetic construct
  misc_feature 1..20: note = CRISPR gRNA sequence
  source 1..20: mol_type = other DNA
ttagacaggggaatgagggg

SEQ ID NO: 98053 - DNA, 20 bp, synthetic construct
  misc_feature 1..20: note = CRISPR gRNA sequence
  source 1..20: mol_type = other DNA
tgagggggagcgtatgttga

SEQ ID NO: 98054 - DNA, 20 bp, synthetic construct
  misc_feature 1..20: note = CRISPR gRNA sequence
  source 1..20: mol_type = other DNA
ttgatggacatacatgaaca

SEQ ID NO: 98055 - DNA, 20 bp, synthetic construct
  misc_feature 1..20: note = CRISPR gRNA sequence
  source 1..20: mol_type = other DNA
catgaacacggtcacacaca

SEQ ID NO: 98056 - DNA, 20 bp, synthetic construct
  misc_feature 1..20: note = CRISPR gRNA sequence
  source 1..20: mol_type = other DNA
aacacggtcacacacacagt

SEQ ID NO: 98057 - DNA, 20 bp, synthetic construct
  misc_feature 1..20: note = CRISPR gRNA sequence
  source 1..20: mol_type = other DNA
gttagatacaatcatacacg

SEQ ID NO: 98058 - DNA, 20 bp, synthetic construct
  misc_feature 1..20: note = CRISPR gRNA sequence
  source 1..20: mol_type = other DNA
atcatacacgtggacactca

SEQ ID NO: 98059 - DNA, 20 bp, synthetic construct
  misc_feature 1..20: note = CRISPR gRNA sequence
  source 1..20: mol_type = other DNA
tcatacacgtggacactcac

SEQ ID NO: 98060 - DNA, 20 bp, synthetic construct
  misc_feature 1..20: note = CRISPR gRNA sequence
  source 1..20: mol_type = other DNA
acactcacaggtcacgtcat

SEQ ID NO: 98061 - DNA, 20 bp, synthetic construct
  misc_feature 1..20: note = CRISPR gRNA sequence
  source 1..20: mol_type = other DNA
ctcacaggtcacgtcatgag

SEQ ID NO: 98062 - DNA, 20 bp, synthetic construct
  misc_feature 1..20: note = CRISPR gRNA sequence
  source 1..20: mol_type = other DNA
tcacaggtcacgtcatgagt

SEQ ID NO: 98063 - DNA, 20 bp, synthetic construct
  misc_feature 1..20: note = CRISPR gRNA sequence
  source 1..20: mol_type = other DNA
ggtcacgtcatgagtgggta

SEQ ID NO: 98064 - DNA, 20 bp, synthetic construct
  misc_feature 1..20: note = CRISPR gRNA sequence
  source 1..20: mol_type = other DNA
ggacacccatatgcacacac

SEQ ID NO: 98065 - DNA, 20 bp, synthetic construct
  misc_feature 1..20: note = CRISPR gRNA sequence
  source 1..20: mol_type = other DNA
acccatatgcacacaccagc

SEQ ID NO: 98066 - DNA, 20 bp, synthetic construct
  misc_feature 1..20: note = CRISPR gRNA sequence
  source 1..20: mol_type = other DNA
cccatatgcacacaccagcc

SEQ ID NO: 98067 - DNA, 20 bp, synthetic construct
  misc_feature 1..20: note = CRISPR gRNA sequence
  source 1..20: mol_type = other DNA
atgcacacaccagccaggtg

SEQ ID NO: 98068 - DNA, 20 bp, synthetic construct
  misc_feature 1..20: note = CRISPR gRNA sequence
  source 1..20: mol_type = other DNA
ccagccaggtgcagacatgc

SEQ ID NO: 98069 - DNA, 20 bp, synthetic construct
  misc_feature 1..20: note = CRISPR gRNA sequence
  source 1..20: mol_type = other DNA
gacatgccagcacatgtgtg

SEQ ID NO: 98070 - DNA, 20 bp, synthetic construct
  misc_feature 1..20: note = CRISPR gRNA sequence
  source 1..20: mol_type = other DNA
cctttccgcaaatgctcctt

SEQ ID NO: 98071 - DNA, 20 bp, synthetic construct
  misc_feature 1..20: note = CRISPR gRNA sequence
  source 1..20: mol_type = other DNA
tccgcaaatgctccttcagc

SEQ ID NO: 98072 - DNA, 20 bp, synthetic construct
  misc_feature 1..20: note = CRISPR gRNA sequence
  source 1..20: mol_type = other DNA
aaatgctccttcagctggtc

SEQ ID NO: 98073 - DNA, 20 bp, synthetic construct
  misc_feature 1..20: note = CRISPR gRNA sequence
  source 1..20: mol_type = other DNA
tccagctccccctgtgctgc

SEQ ID NO: 98074 - DNA, 20 bp, synthetic construct
  misc_feature 1..20: note = CRISPR gRNA sequence
  source 1..20: mol_type = other DNA
gctccccctgtgctgcgagc

SEQ ID NO: 98075 - DNA, 20 bp, synthetic construct
  misc_feature 1..20: note = CRISPR gRNA sequence
  source 1..20: mol_type = other DNA
ccccctgtgctgcgagctgg

SEQ ID NO: 98076 - DNA, 20 bp, synthetic construct
  misc_feature 1..20: note = CRISPR gRNA sequence
  source 1..20: mol_type = other DNA
ctgtgctgcgagctggtgga

SEQ ID NO: 98077 - DNA, 20 bp, synthetic construct
  misc_feature 1..20: note = CRISPR gRNA sequence
  source 1..20: mol_type = other DNA
gctgcgagctggtggatgga

SEQ ID NO: 98078 - DNA, 20 bp, synthetic construct
  misc_feature 1..20: note = CRISPR gRNA sequence
  source 1..20: mol_type = other DNA
ctgcgagctggtggatggac

SEQ ID NO: 98079 - DNA, 20 bp, synthetic construct
  misc_feature 1..20: note = CRISPR gRNA sequence
  source 1..20: mol_type = other DNA
tgcgagctggtggatggaca

SEQ ID NO: 98080 - DNA, 20 bp, synthetic construct
  misc_feature 1..20: note = CRISPR gRNA sequence
  source 1..20: mol_type = other DNA
agctggtggatggacagggc

SEQ ID NO: 98081 - DNA, 20 bp, synthetic construct
  misc_feature 1..20: note = CRISPR gRNA sequence
  source 1..20: mol_type = other DNA
gctggtggatggacagggct

SEQ ID NO: 98082 - DNA, 20 bp, synthetic construct
  misc_feature 1..20: note = CRISPR gRNA sequence
  source 1..20: mol_type = other DNA
ctggtggatggacagggctg

SEQ ID NO: 98083 - DNA, 20 bp, synthetic construct
  misc_feature 1..20: note = CRISPR gRNA sequence
  source 1..20: mol_type = other DNA
gtggatggacagggctgggg

SEQ ID NO: 98084 - DNA, 20 bp, synthetic construct
  misc_feature 1..20: note = CRISPR gRNA sequence
  source 1..20: mol_type = other DNA
tggatggacagggctggggc

SEQ ID NO: 98085 - DNA, 20 bp, synthetic construct
  misc_feature 1..20: note = CRISPR gRNA sequence
  source 1..20: mol_type = other DNA
tggacagggctggggcagga

SEQ ID NO: 98086 - DNA, 20 bp, synthetic construct
  misc_feature 1..20: note = CRISPR gRNA sequence
  source 1..20: mol_type = other DNA
gacagggctggggcaggaca

SEQ ID NO: 98087 - DNA, 20 bp, synthetic construct
  misc_feature 1..20: note = CRISPR gRNA sequence
  source 1..20: mol_type = other DNA
acagggctggggcaggacag

SEQ ID NO: 98088 - DNA, 20 bp, synthetic construct
  misc_feature 1..20: note = CRISPR gRNA sequence
  source 1..20: mol_type = other DNA
gggctggggcaggacagagg

SEQ ID NO: 98089 - DNA, 20 bp, synthetic construct
  misc_feature 1..20: note = CRISPR gRNA sequence
  source 1..20: mol_type = other DNA
gctggggcaggacagaggca

SEQ ID NO: 98090 - DNA, 20 bp, synthetic construct
  misc_feature 1..20: note = CRISPR gRNA sequence
  source 1..20: mol_type = other DNA
ccccttgcttctctgtgcct

SEQ ID NO: 98091 - DNA, 20 bp, synthetic construct
  misc_feature 1..20: note = CRISPR gRNA sequence
  source 1..20: mol_type = other DNA
ctgtccacgattgctcctca

SEQ ID NO: 98092 - DNA, 20 bp, synthetic construct
  misc_feature 1..20: note = CRISPR gRNA sequence
  source 1..20: mol_type = other DNA
tgtccacgattgctcctcac

SEQ ID NO: 98093 - DNA, 20 bp, synthetic construct
  misc_feature 1..20: note = CRISPR gRNA sequence
  source 1..20: mol_type = other DNA
cctcctactcctctccttgt

SEQ ID NO: 98094 - DNA, 20 bp, synthetic construct
  misc_feature 1..20: note = CRISPR gRNA sequence
  source 1..20: mol_type = other DNA
ctcctactcctctccttgtt

SEQ ID NO: 98095 - DNA, 20 bp, synthetic construct
  misc_feature 1..20: note = CRISPR gRNA sequence
  source 1..20: mol_type = other DNA
tcctactcctctccttgttg

SEQ ID NO: 98096 - DNA, 20 bp, synthetic construct
  misc_feature 1..20: note = CRISPR gRNA sequence
  source 1..20: mol_type = other DNA
cctctccttgttggggaccg

SEQ ID NO: 98097 - DNA, 20 bp, synthetic construct
  misc_feature 1..20: note = CRISPR gRNA sequence
  source 1..20: mol_type = other DNA
ctctccttgttggggaccgt

SEQ ID NO: 98098 - DNA, 20 bp, synthetic construct
  misc_feature 1..20: note = CRISPR gRNA sequence
  source 1..20: mol_type = other DNA
ggggaccgtgggcccactca

SEQ ID NO: 98099 - DNA, 20 bp, synthetic construct
  misc_feature 1..20: note = CRISPR gRNA sequence
  source 1..20: mol_type = other DNA
ccgtgggcccactcacagtc

SEQ ID NO: 98100 - DNA, 20 bp, synthetic construct
  misc_feature 1..20: note = CRISPR gRNA sequence
  source 1..20: mol_type = other DNA
cgtgggcccactcacagtct

SEQ ID NO: 98101 - DNA, 20 bp, synthetic construct
  misc_feature 1..20: note = CRISPR gRNA sequence
  source 1..20: mol_type = other DNA
gtgggcccactcacagtcta

SEQ ID NO: 98102 - DNA, 20 bp, synthetic construct
  misc_feature 1..20: note = CRISPR gRNA sequence
  source 1..20: mol_type = other DNA
ggcccactcacagtctaggg

SEQ ID NO: 98103 - DNA, 20 bp, synthetic construct
  misc_feature 1..20: note = CRISPR gRNA sequence
  source 1..20: mol_type = other DNA
cactcacagtctagggtggc

SEQ ID NO: 98104 - DNA, 20 bp, synthetic construct
  misc_feature 1..20: note = CRISPR gRNA sequence
  source 1..20: mol_type = other DNA
tcacagtctagggtggccgg

SEQ ID NO: 98105 - DNA, 20 bp, synthetic construct
  misc_feature 1..20: note = CRISPR gRNA sequence
  source 1..20: mol_type = other DNA
acagtctagggtggccggca

SEQ ID NO: 98106 - DNA, 20 bp, synthetic construct
  misc_feature 1..20: note = CRISPR gRNA sequence
  source 1..20: mol_type = other DNA
acacctcgttccctcgctgc

SEQ ID NO: 98107 - DNA, 20 bp, synthetic construct
  misc_feature 1..20: note = CRISPR gRNA sequence
  source 1..20: mol_type = other DNA
ctcgttccctcgctgccggt

SEQ ID NO: 98108 - DNA, 20 bp, synthetic construct
  misc_feature 1..20: note = CRISPR gRNA sequence
  source 1..20: mol_type = other DNA
ttccctcgctgccggttggt

SEQ ID NO: 98109 - DNA, 20 bp, synthetic construct
  misc_feature 1..20: note = CRISPR gRNA sequence
  source 1..20: mol_type = other DNA
ccctcgctgccggttggtga

SEQ ID NO: 98110 - DNA, 20 bp, synthetic construct
  misc_feature 1..20: note = CRISPR gRNA sequence
  source 1..20: mol_type = other DNA
tcgctgccggttggtgagag

SEQ ID NO: 98111 - DNA, 20 bp, synthetic construct
  misc_feature 1..20: note = CRISPR gRNA sequence
  source 1..20: mol_type = other DNA
ctgccggttggtgagagtgg

SEQ ID NO: 98112 - DNA, 20 bp, synthetic construct
  misc_feature 1..20: note = CRISPR gRNA sequence
  source 1..20: mol_type = other DNA
gccggttggtgagagtggtg

SEQ ID NO: 98113 - DNA, 20 bp, synthetic construct
  misc_feature 1..20: note = CRISPR gRNA sequence
  source 1..20: mol_type = other DNA
gtgagagtggtggagtgctt

SEQ ID NO: 98114 - DNA, 20 bp, synthetic construct
  misc_feature 1..20: note = CRISPR gRNA sequence
  source 1..20: mol_type = other DNA
tgagagtggtggagtgcttc

SEQ ID NO: 98115 - DNA, 20 bp, synthetic construct
  misc_feature 1..20: note = CRISPR gRNA sequence
  source 1..20: mol_type = other DNA
gagagtggtggagtgcttca

SEQ ID NO: 98116 - DNA, 20 bp, synthetic construct
  misc_feature 1..20: note = CRISPR gRNA sequence
  source 1..20: mol_type = other DNA
gagtggtggagtgcttcagg

SEQ ID NO: 98117 - DNA, 20 bp, synthetic construct
  misc_feature 1..20: note = CRISPR gRNA sequence
  source 1..20: mol_type = other DNA
tgcttcagggagctgcctgc

SEQ ID NO: 98118 - DNA, 20 bp, synthetic construct
  misc_feature 1..20: note = CRISPR gRNA sequence
  source 1..20: mol_type = other DNA
gcttcagggagctgcctgct

SEQ ID NO: 98119 - DNA, 20 bp, synthetic construct
  misc_feature 1..20: note = CRISPR gRNA sequence
  source 1..20: mol_type = other DNA
gggagctgcctgctgggaaa

SEQ ID NO: 98120 - DNA, 20 bp, synthetic construct
  misc_feature 1..20: note = CRISPR gRNA sequence
  source 1..20: mol_type = other DNA
gcctgctgggaaacagacaa

SEQ ID NO: 98121 - DNA, 20 bp, synthetic construct
  misc_feature 1..20: note = CRISPR gRNA sequence
  source 1..20: mol_type = other DNA
cctgctgggaaacagacaac

SEQ ID NO: 98122 - DNA, 20 bp, synthetic construct
  misc_feature 1..20: note = CRISPR gRNA sequence
  source 1..20: mol_type = other DNA
gggaaacagacaacaggcgt

SEQ ID NO: 98123 - DNA, 20 bp, synthetic construct
  misc_feature 1..20: note = CRISPR gRNA sequence
  source 1..20: mol_type = other DNA
aacaggcgtcagtttcccct

SEQ ID NO: 98124 - DNA, 20 bp, synthetic construct
  misc_feature 1..20: note = CRISPR gRNA sequence
  source 1..20: mol_type = other DNA
aggcgtcagtttcccctcag

SEQ ID NO: 98125 - DNA, 20 bp, synthetic construct
  misc_feature 1..20: note = CRISPR gRNA sequence
  source 1..20: mol_type = other DNA
tcccctcagtagatgtctct

SEQ ID NO: 98126 - DNA, 20 bp, synthetic construct
  misc_feature 1..20: note = CRISPR gRNA sequence
  source 1..20: mol_type = other DNA
cccctcagtagatgtctctg

SEQ ID NO: 98127 - DNA, 20 bp, synthetic construct
  misc_feature 1..20: note = CRISPR gRNA sequence
  source 1..20: mol_type = other DNA
agtagatgtctctgaggctt

SEQ ID NO: 98128 - DNA, 20 bp, synthetic construct
  misc_feature 1..20: note = CRISPR gRNA sequence
  source 1..20: mol_type = other DNA
gtagatgtctctgaggcttc

SEQ ID NO: 98129 - DNA, 20 bp, synthetic construct
  misc_feature 1..20: note = CRISPR gRNA sequence
  source 1..20: mol_type = other DNA
atgtctctgaggcttcagga

SEQ ID NO: 98130 - DNA, 20 bp, synthetic construct
  misc_feature 1..20: note = CRISPR gRNA sequence
  source 1..20: mol_type = other DNA
tctctgaggcttcaggacag

SEQ ID NO: 98131 - DNA, 20 bp, synthetic construct
  misc_feature 1..20: note = CRISPR gRNA sequence
  source 1..20: mol_type = other DNA
ttttgttgctgttgttgttt

SEQ ID NO: 98132 - DNA, 20 bp, synthetic construct
  misc_feature 1..20: note = CRISPR gRNA sequence
  source 1..20: mol_type = other DNA
gttgctgttgttgtttgaga

SEQ ID NO: 98133 - DNA, 20 bp, synthetic construct
  misc_feature 1..20: note = CRISPR gRNA sequence
  source 1..20: mol_type = other DNA
tgctgttgttgtttgagatg

SEQ ID NO: 98134 - DNA, 20 bp, synthetic construct
  misc_feature 1..20: note = CRISPR gRNA sequence
  source 1..20: mol_type = other DNA
tggagtctccgtctgtcccc

SEQ ID NO: 98135 - DNA, 20 bp, synthetic construct
  misc_feature 1..20: note = CRISPR gRNA sequence
  source 1..20: mol_type = other DNA
ggagtctccgtctgtccccc

SEQ ID NO: 98136 - DNA, 20 bp, synthetic construct
  misc_feature 1..20: note = CRISPR gRNA sequence
  source 1..20: mol_type = other DNA
tctccgtctgtcccccaggc

SEQ ID NO: 98137 - DNA, 20 bp, synthetic construct
  misc_feature 1..20: note = CRISPR gRNA sequence
  source 1..20: mol_type = other DNA
tccgtctgtcccccaggctg

SEQ ID NO: 98138 - DNA, 20 bp, synthetic construct
  misc_feature 1..20: note = CRISPR gRNA sequence
  source 1..20: mol_type = other DNA
ctgtcccccaggctggagta

SEQ ID NO: 98139 - DNA, 20 bp, synthetic construct
  misc_feature 1..20: note = CRISPR gRNA sequence
  source 1..20: mol_type = other DNA
tcccccaggctggagtacag

SEQ ID NO: 98140 - DNA, 20 bp, synthetic construct
  misc_feature 1..20: note = CRISPR gRNA sequence
  source 1..20: mol_type = other DNA
ggagtacagtggcgtgatct

SEQ ID NO: 98141 - DNA, 20 bp, synthetic construct
  misc_feature 1..20: note = CRISPR gRNA sequence
  source 1..20: mol_type = other DNA
tcactgcaacctctgcctcc

SEQ ID NO: 98142 - DNA, 20 bp, synthetic construct
  misc_feature 1..20: note = CRISPR gRNA sequence
  source 1..20: mol_type = other DNA
cactgcaacctctgcctcct

SEQ ID NO: 98143 - DNA, 20 bp, synthetic construct
  misc_feature 1..20: note = CRISPR gRNA sequence
  source 1..20: mol_type = other DNA
aacctctgcctcctgggttc

SEQ ID NO: 98144 - DNA, 20 bp, synthetic construct
  misc_feature 1..20: note = CRISPR gRNA sequence
  source 1..20: mol_type = other DNA
ttcaagcgattcttgtgcct

SEQ ID NO: 98145 - DNA, 20 bp, synthetic construct
  misc_feature 1..20: note = CRISPR gRNA sequence
  source 1..20: mol_type = other DNA
ttcttgtgcctcagcctccc

SEQ ID NO: 98146 - DNA, 20 bp, synthetic construct
  misc_feature 1..20: note = CRISPR gRNA sequence
  source 1..20: mol_type = other DNA
ttgtgcctcagcctcccgag

SEQ ID NO: 98147 - DNA, 20 bp, synthetic construct
  misc_feature 1..20: note = CRISPR gRNA sequence
  source 1..20: mol_type = other DNA
gcctcagcctcccgagtagc

SEQ ID NO: 98148 - DNA, 20 bp, synthetic construct
  misc_feature 1..20: note = CRISPR gRNA sequence
  source 1..20: mol_type = other DNA
cctcagcctcccgagtagct

SEQ ID NO: 98149 - DNA, 20 bp, synthetic construct
  misc_feature 1..20: note = CRISPR gRNA sequence
  source 1..20: mol_type = other DNA
ctcccgagtagctgggatca

SEQ ID NO: 98150 - DNA, 20 bp, synthetic construct
  misc_feature 1..20: note = CRISPR gRNA sequence
  source 1..20: mol_type = other DNA
tcccgagtagctgggatcat

SEQ ID NO: 98151 - DNA, 20 bp, synthetic construct
  misc_feature 1..20: note = CRISPR gRNA sequence
  source 1..20: mol_type = other DNA
taggcgcccaccaccacacc

SEQ ID NO: 98152 - DNA, 20 bp, synthetic construct
  misc_feature 1..20: note = CRISPR gRNA sequence
  source 1..20: mol_type = other DNA
ctggctaatttttgtatttt

SEQ ID NO: 98153 - DNA, 20 bp, synthetic construct
  misc_feature 1..20: note = CRISPR gRNA sequence
  source 1..20: mol_type = other DNA
gctaatttttgtattttaag

SEQ ID NO: 98154 - DNA, 20 bp, synthetic construct
  misc_feature 1..20: note = CRISPR gRNA sequence
  source 1..20: mol_type = other DNA
taatttttgtattttaagta

SEQ ID NO: 98155 - DNA, 20 bp, synthetic construct
  misc_feature 1..20: note = CRISPR gRNA sequence
  source 1..20: mol_type = other DNA
ttttgtattttaagtagaga

SEQ ID NO: 98156 - DNA, 20 bp, synthetic construct
  misc_feature 1..20: note = CRISPR gRNA sequence
  source 1..20: mol_type = other DNA
tttgtattttaagtagagac

SEQ ID NO: 98157 - DNA, 20 bp, synthetic construct
  misc_feature 1..20: note = CRISPR gRNA sequence
  source 1..20: mol_type = other DNA
ttgtattttaagtagagacg

SEQ ID NO: 98158 - DNA, 20 bp, synthetic construct
  misc_feature 1..20: note = CRISPR gRNA sequence
  source 1..20: mol_type = other DNA
gagacggggtttcgctatgt

SEQ ID NO: 98159 - DNA, 20 bp, synthetic construct
  misc_feature 1..20: note = CRISPR gRNA sequence
  source 1..20: mol_type = other DNA
cggggtttcgctatgttggc

SEQ ID NO: 98160 - DNA, 20 bp, synthetic construct
  misc_feature 1..20: note = CRISPR gRNA sequence
  source 1..20: mol_type = other DNA
ggggtttcgctatgttggcc

SEQ ID NO: 98161 - DNA, 20 bp, synthetic construct
  misc_feature 1..20: note = CRISPR gRNA sequence
  source 1..20: mol_type = other DNA
ctcaaatcatccacctgcct

SEQ ID NO: 98162 - DNA, 20 bp, synthetic construct
  misc_feature 1..20: note = CRISPR gRNA sequence
  source 1..20: mol_type = other DNA
ccacctgcctcagcctccca

SEQ ID NO: 98163 - DNA, 20 bp, synthetic construct
  misc_feature 1..20: note = CRISPR gRNA sequence
  source 1..20: mol_type = other DNA
gcctcagcctcccaaagtgc

SEQ ID NO: 98164 - DNA, 20 bp, synthetic construct
  misc_feature 1..20: note = CRISPR gRNA sequence
  source 1..20: mol_type = other DNA
cctcagcctcccaaagtgct

SEQ ID NO: 98165 - DNA, 20 bp, synthetic construct
  misc_feature 1..20: note = CRISPR gRNA sequence
  source 1..20: mol_type = other DNA
ctcccaaagtgctgggatta

SEQ ID NO: 98166 - DNA, 20 bp, synthetic construct
  misc_feature 1..20: note = CRISPR gRNA sequence
  source 1..20: mol_type = other DNA
tcccaaagtgctgggattat

SEQ ID NO: 98167 - DNA, 20 bp, synthetic construct
  misc_feature 1..20: note = CRISPR gRNA sequence
  source 1..20: mol_type = other DNA
agtgctgggattataggcat

SEQ ID NO: 98168 - DNA, 20 bp, synthetic construct
  misc_feature 1..20: note = CRISPR gRNA sequence
  source 1..20: mol_type = other DNA
taggcatgagccaccacacc

SEQ ID NO: 98169 - DNA, 20 bp, synthetic construct
  misc_feature 1..20: note = CRISPR gRNA sequence
  source 1..20: mol_type = other DNA
gagccaccacacccagctat

SEQ ID NO: 98170 - DNA, 20 bp, synthetic construct
  misc_feature 1..20: note = CRISPR gRNA sequence
  source 1..20: mol_type = other DNA
agccaccacacccagctatt

SEQ ID NO: 98171 - DNA, 20 bp, synthetic construct
  misc_feature 1..20: note = CRISPR gRNA sequence
  source 1..20: mol_type = other DNA
gccaccacacccagctattg

SEQ ID NO: 98172 - DNA, 20 bp, synthetic construct
  misc_feature 1..20: note = CRISPR gRNA sequence
  source 1..20: mol_type = other DNA
ttggggtttttttttttttt

SEQ ID NO: 98173 - DNA, 20 bp, synthetic construct
  misc_feature 1..20: note = CRISPR gRNA sequence
  source 1..20: mol_type = other DNA
ggttttttttttttttgaga

SEQ ID NO: 98174 - DNA, 20 bp, synthetic construct
  misc_feature 1..20: note = CRISPR gRNA sequence
  source 1..20: mol_type = other DNA
ttttttttttttttgagaca

SEQ ID NO: 98175 - DNA, 20 bp, synthetic construct
  misc_feature 1..20: note = CRISPR gRNA sequence
  source 1..20: mol_type = other DNA
cagagtcttgctctgttgtc

SEQ ID NO: 98176 - DNA, 20 bp, synthetic construct
  misc_feature 1..20: note = CRISPR gRNA sequence
  source 1..20: mol_type = other DNA
agagtcttgctctgttgtcc

SEQ ID NO: 98177 - DNA, 20 bp, synthetic construct
  misc_feature 1..20: note = CRISPR gRNA sequence
  source 1..20: mol_type = other DNA
tcttgctctgttgtccaggc

SEQ ID NO: 98178 - DNA, 20 bp, synthetic construct
  misc_feature 1..20: note = CRISPR gRNA sequence
  source 1..20: mol_type = other DNA
ttgctctgttgtccaggctg

SEQ ID NO: 98179 - DNA, 20 bp, synthetic construct
  misc_feature 1..20: note = CRISPR gRNA sequence
  source 1..20: mol_type = other DNA
ctgttgtccaggctggagtg

SEQ ID NO: 98180 - DNA, 20 bp, synthetic construct
  misc_feature 1..20: note = CRISPR gRNA sequence
  source 1..20: mol_type = other DNA
ttgtccaggctggagtgcgg

SEQ ID NO: 98181 - DNA, 20 bp, synthetic construct
  misc_feature 1..20: note = CRISPR gRNA sequence
  source 1..20: mol_type = other DNA
ggagtgcggtggtgtgatca

SEQ ID NO: 98182 - DNA, 20 bp, synthetic construct
  misc_feature 1..20: note = CRISPR gRNA sequence
  source 1..20: mol_type = other DNA
ggtgtgatcacagttcactt

SEQ ID NO: 98183 - DNA, 20 bp, synthetic construct
  misc_feature 1..20: note = CRISPR gRNA sequence
  source 1..20: mol_type = other DNA
tcacttcagcctcaacctcc

SEQ ID NO: 98184 - DNA, 20 bp, synthetic construct
  misc_feature 1..20: note = CRISPR gRNA sequence
  source 1..20: mol_type = other DNA
cacttcagcctcaacctcct

SEQ ID NO: 98185 - DNA, 20 bp, synthetic construct
  misc_feature 1..20: note = CRISPR gRNA sequence
  source 1..20: mol_type = other DNA
agcctcaacctcctgggctc

SEQ ID NO: 98186 - DNA, 20 bp, synthetic construct
  misc_feature 1..20: note = CRISPR gRNA sequence
  source 1..20: mol_type = other DNA
ctcaagccaacctcccacct

SEQ ID NO: 98187 - DNA, 20 bp, synthetic construct
  misc_feature 1..20: note = CRISPR gRNA sequence
  source 1..20: mol_type = other DNA
acctcccacctcagcctcct

SEQ ID NO: 98188 - DNA, 20 bp, synthetic construct
  misc_feature 1..20: note = CRISPR gRNA sequence
  source 1..20: mol_type = other DNA
tcccacctcagcctcctgag

SEQ ID NO: 98189 - DNA, 20 bp, synthetic construct
  misc_feature 1..20: note = CRISPR gRNA sequence
  source 1..20: mol_type = other DNA
ctcctgagcagctgaaacta

SEQ ID NO: 98190 - DNA, 20 bp, synthetic construct
  misc_feature 1..20: note = CRISPR gRNA sequence
  source 1..20: mol_type = other DNA
tcctgagcagctgaaactac

SEQ ID NO: 98191 - DNA, 20 bp, synthetic construct
  misc_feature 1..20: note = CRISPR gRNA sequence
  source 1..20: mol_type = other DNA
actacaggtgccaccatacc

SEQ ID NO: 98192 - DNA, 20 bp, synthetic construct
  misc_feature 1..20: note = CRISPR gRNA sequence
  source 1..20: mol_type = other DNA
aattaaaaatatatatatat

SEQ ID NO: 98193 - DNA, 20 bp, synthetic construct
  misc_feature 1..20: note = CRISPR gRNA sequence
  source 1..20: mol_type = other DNA
taaaaatatatatatattgg

SEQ ID NO: 98194 - DNA, 20 bp, synthetic construct
  misc_feature 1..20: note = CRISPR gRNA sequence
  source 1..20: mol_type = other DNA
aaaatatatatatattggta

SEQ ID NO: 98195 - DNA, 20 bp, synthetic construct
  misc_feature 1..20: note = CRISPR gRNA sequence
  source 1..20: mol_type = other DNA
tatatatatattggtagaga

SEQ ID NO: 98196 - DNA, 20 bp, synthetic construct
  misc_feature 1..20: note = CRISPR gRNA sequence
  source 1..20: mol_type = other DNA
tatatatattggtagagatg

SEQ ID NO: 98197 - DNA, 20 bp, synthetic construct
  misc_feature 1..20: note = CRISPR gRNA sequence
  source 1..20: mol_type = other DNA
tggagtcttgctctgtcgcc

SEQ ID NO: 98198 - DNA, 20 bp, synthetic construct
  misc_feature 1..20: note = CRISPR gRNA sequence
  source 1..20: mol_type = other DNA
ggagtcttgctctgtcgccc

SEQ ID NO: 98199 - DNA, 20 bp, synthetic construct
  misc_feature 1..20: note = CRISPR gRNA sequence
  source 1..20: mol_type = other DNA
tcttgctctgtcgcccaggc

SEQ ID NO: 98200 - DNA, 20 bp, synthetic construct
  misc_feature 1..20: note = CRISPR gRNA sequence
  source 1..20: mol_type = other DNA
ccaggctggtctcaaactcc

SEQ ID NO: 98201 - DNA, 20 bp, synthetic construct
  misc_feature 1..20: note = CRISPR gRNA sequence
  source 1..20: mol_type = other DNA
caggctggtctcaaactcct

SEQ ID NO: 98202 - DNA, 20 bp, synthetic construct
  misc_feature 1..20: note = CRISPR gRNA sequence
  source 1..20: mol_type = other DNA
ggtctcaaactcctgggctc

SEQ ID NO: 98203 - DNA, 20 bp, synthetic construct
  misc_feature 1..20: note = CRISPR gRNA sequence
  source 1..20: mol_type = other DNA
ctcaagcaattctcctgccg

SEQ ID NO: 98204 - DNA, 20 bp, synthetic construct
  misc_feature 1..20: note = CRISPR gRNA sequence
  source 1..20: mol_type = other DNA
tctcctgccgtggcctccca

SEQ ID NO: 98205 - DNA, 20 bp, synthetic construct
  misc_feature 1..20: note = CRISPR gRNA sequence
  source 1..20: mol_type = other DNA
gccgtggcctcccaaagtgc

SEQ ID NO: 98206 - DNA, 20 bp, synthetic construct
  misc_feature 1..20: note = CRISPR gRNA sequence
  source 1..20: mol_type = other DNA
ccgtggcctcccaaagtgct

SEQ ID NO: 98207 - DNA, 20 bp, synthetic construct
  misc_feature 1..20: note = CRISPR gRNA sequence
  source 1..20: mol_type = other DNA
ctcccaaagtgctgggatta

SEQ ID NO: 98208 - DNA, 20 bp, synthetic construct
  misc_feature 1..20: note = CRISPR gRNA sequence
  source 1..20: mol_type = other DNA
tcccaaagtgctgggattac

SEQ ID NO: 98209 - DNA, 20 bp, synthetic construct
  misc_feature 1..20: note = CRISPR gRNA sequence
  source 1..20: mol_type = other DNA
agtgctgggattacaggcat

SEQ ID NO: 98210 - DNA, 20 bp, synthetic construct
  misc_feature 1..20: note = CRISPR gRNA sequence
  source 1..20: mol_type = other DNA
agctaccatgctactgcctt

SEQ ID NO: 98211 - DNA, 20 bp, synthetic construct
  misc_feature 1..20: note = CRISPR gRNA sequence
  source 1..20: mol_type = other DNA
tactgccttcggtatctccc

SEQ ID NO: 98212 - DNA, 20 bp, synthetic construct
  misc_feature 1..20: note = CRISPR gRNA sequence
  source 1..20: mol_type = other DNA
actgccttcggtatctccct

SEQ ID NO: 98213 - DNA, 20 bp, synthetic construct
  misc_feature 1..20: note = CRISPR gRNA sequence
  source 1..20: mol_type = other DNA
ctgccttcggtatctccctg

SEQ ID NO: 98214 - DNA, 20 bp, synthetic construct
  misc_feature 1..20: note = CRISPR gRNA sequence
  source 1..20: mol_type = other DNA
tcggtatctccctggggtct

SEQ ID NO: 98215 - DNA, 20 bp, synthetic construct
  misc_feature 1..20: note = CRISPR gRNA sequence
  source 1..20: mol_type = other DNA
ggtatctccctggggtcttg

SEQ ID NO: 98216 - DNA, 20 bp, synthetic construct
  misc_feature 1..20: note = CRISPR gRNA sequence
  source 1..20: mol_type = other DNA
ctggggtcttggagctacca

SEQ ID NO: 98217 - DNA, 20 bp, synthetic construct
  misc_feature 1..20: note = CRISPR gRNA sequence
  source 1..20: mol_type = other DNA
tggggtcttggagctaccaa

SEQ ID NO: 98218 - DNA, 20 bp, synthetic construct
  misc_feature 1..20: note = CRISPR gRNA sequence
  source 1..20: mol_type = other DNA
ggtcttggagctaccaaagg

SEQ ID NO: 98219 - DNA, 20 bp, synthetic construct
  misc_feature 1..20: note = CRISPR gRNA sequence
  source 1..20: mol_type = other DNA
gagctaccaaaggcagtgcc

SEQ ID NO: 98220 - DNA, 20 bp, synthetic construct
  misc_feature 1..20: note = CRISPR gRNA sequence
  source 1..20: mol_type = other DNA
agctaccaaaggcagtgcct

SEQ ID NO: 98221 - DNA, 20 bp, synthetic construct
  misc_feature 1..20: note = CRISPR gRNA sequence
  source 1..20: mol_type = other DNA
actctactctcttgaatacc

SEQ ID NO: 98222 - DNA, 20 bp, synthetic construct
  misc_feature 1..20: note = CRISPR gRNA sequence
  source 1..20: mol_type = other DNA
ctctactctcttgaataccc

SEQ ID NO: 98223 - DNA, 20 bp, synthetic construct
  misc_feature 1..20: note = CRISPR gRNA sequence
  source 1..20: mol_type = other DNA
tctactctcttgaataccca

SEQ ID NO: 98224 - DNA, 20 bp, synthetic construct
  misc_feature 1..20: note = CRISPR gRNA sequence
  source 1..20: mol_type = other DNA
gcatctttctcctccctgcc

SEQ ID NO: 98225 - DNA, 20 bp, synthetic construct
  misc_feature 1..20: note = CRISPR gRNA sequence
  source 1..20: mol_type = other DNA
tccctgcctggcaatgttct

SEQ ID NO: 98226 - DNA, 20 bp, synthetic construct
  misc_feature 1..20: note = CRISPR gRNA sequence
  source 1..20: mol_type = other DNA
tggcaatgttctgagcaaac

SEQ ID NO: 98227 - DNA, 20 bp, synthetic construct
  misc_feature 1..20: note = CRISPR gRNA sequence
  source 1..20: mol_type = other DNA
tgttctgagcaaacaagaca

SEQ ID NO: 98228 - DNA, 20 bp, synthetic construct
  misc_feature 1..20: note = CRISPR gRNA sequence
  source 1..20: mol_type = other DNA
aagacatagtttttgccctc

SEQ ID NO: 98229 - DNA, 20 bp, synthetic construct
  misc_feature 1..20: note = CRISPR gRNA sequence
  source 1..20: mol_type = other DNA
agacatagtttttgccctct

SEQ ID NO: 98230 - DNA, 20 bp, synthetic construct
  misc_feature 1..20: note = CRISPR gRNA sequence
  source 1..20: mol_type = other DNA
gacatagtttttgccctcta

SEQ ID NO: 98231 - DNA, 20 bp, synthetic construct
  misc_feature 1..20: note = CRISPR gRNA sequence
  source 1..20: mol_type = other DNA
catagtttttgccctctagg

SEQ ID NO: 98232 - DNA, 20 bp, synthetic construct
  misc_feature 1..20: note = CRISPR gRNA sequence
  source 1..20: mol_type = other DNA
gtttttgccctctagggagt

SEQ ID NO: 98233 - DNA, 20 bp, synthetic construct
  misc_feature 1..20: note = CRISPR gRNA sequence
  source 1..20: mol_type = other DNA
tttttgccctctagggagtc

SEQ ID NO: 98234 - DNA, 20 bp, synthetic construct
  misc_feature 1..20: note = CRISPR gRNA sequence
  source 1..20: mol_type = other DNA
ttttgccctctagggagtcg

SEQ ID NO: 98235 - DNA, 20 bp, synthetic construct
  misc_feature 1..20: note = CRISPR gRNA sequence
  source 1..20: mol_type = other DNA
tttgccctctagggagtcgg

SEQ ID NO: 98236 - DNA, 20 bp, synthetic construct
  misc_feature 1..20: note = CRISPR gRNA sequence
  source 1..20: mol_type = other DNA
cctctagggagtcgggggtc

SEQ ID NO: 98237 - DNA, 20 bp, synthetic construct
  misc_feature 1..20: note = CRISPR gRNA sequence
  source 1..20: mol_type = other DNA
ctagggagtcgggggtcaag

SEQ ID NO: 98238 - DNA, 20 bp, synthetic construct
  misc_feature 1..20: note = CRISPR gRNA sequence
  source 1..20: mol_type = other DNA
tagggagtcgggggtcaagt

SEQ ID NO: 98239 - DNA, 20 bp, synthetic construct
  misc_feature 1..20: note = CRISPR gRNA sequence
  source 1..20: mol_type = other DNA
cgggggtcaagtaggtgcat

SEQ ID NO: 98240 - DNA, 20 bp, synthetic construct
  misc_feature 1..20: note = CRISPR gRNA sequence
  source 1..20: mol_type = other DNA
tcaagtaggtgcatcagaca

SEQ ID NO: 98241 - DNA, 20 bp, synthetic construct
  misc_feature 1..20: note = CRISPR gRNA sequence
  source 1..20: mol_type = other DNA
aagtaggtgcatcagacata

SEQ ID NO: 98242 - DNA, 20 bp, synthetic construct
  misc_feature 1..20: note = CRISPR gRNA sequence
  source 1..20: mol_type = other DNA
gagaaataataaaaaacttc

SEQ ID NO: 98243 - DNA, 20 bp, synthetic construct
  misc_feature 1..20: note = CRISPR gRNA sequence
  source 1..20: mol_type = other DNA
aaaaaacttcaagttgaaat

SEQ ID NO: 98244 - DNA, 20 bp, synthetic construct
  misc_feature 1..20: note = CRISPR gRNA sequence
  source 1..20: mol_type = other DNA
aagttgaaataagtgttcaa

SEQ ID NO: 98245 - DNA, 20 bp, synthetic construct
  misc_feature 1..20: note = CRISPR gRNA sequence
  source 1..20: mol_type = other DNA
ataagtgttcaaaagaactt

SEQ ID NO: 98246 - DNA, 20 bp, synthetic construct
  misc_feature 1..20: note = CRISPR gRNA sequence
  source 1..20: mol_type = other DNA
taagtgttcaaaagaactta

SEQ ID NO: 98247 - DNA, 20 bp, synthetic construct
  misc_feature 1..20: note = CRISPR gRNA sequence
  source 1..20: mol_type = other DNA
tgttcaaaagaacttaaggc

SEQ ID NO: 98248 - DNA, 20 bp, synthetic construct
  misc_feature 1..20: note = CRISPR gRNA sequence
  source 1..20: mol_type = other DNA
gttcaaaagaacttaaggcc

SEQ ID NO: 98249 - DNA, 20 bp, synthetic construct
  misc_feature 1..20: note = CRISPR gRNA sequence
  source 1..20: mol_type = other DNA
aaagaacttaaggccgggca

SEQ ID NO: 98250 - DNA, 20 bp, synthetic construct
  misc_feature 1..20: note = CRISPR gRNA sequence
  source 1..20: mol_type = other DNA
gaacttaaggccgggcacag

SEQ ID NO: 98251 - DNA, 20 bp, synthetic construct
  misc_feature 1..20: note = CRISPR gRNA sequence
  source 1..20: mol_type = other DNA
gtggctcatgcctgtaatcc

SEQ ID NO: 98252 - DNA, 20 bp, synthetic construct
  misc_feature 1..20: note = CRISPR gRNA sequence
  source 1..20: mol_type = other DNA
tgcctgtaatcccagcactt

SEQ ID NO: 98253 - DNA, 20 bp, synthetic construct
  misc_feature 1..20: note = CRISPR gRNA sequence
  source 1..20: mol_type = other DNA
gcctgtaatcccagcacttt

SEQ ID NO: 98254 - DNA, 20 bp, synthetic construct
  misc_feature 1..20: note = CRISPR gRNA sequence
  source 1..20: mol_type = other DNA
ctgtaatcccagcactttgg

SEQ ID NO: 98255 - DNA, 20 bp, synthetic construct
  misc_feature 1..20: note = CRISPR gRNA sequence
  source 1..20: mol_type = other DNA
tgtaatcccagcactttggg

SEQ ID NO: 98256 - DNA, 20 bp, synthetic construct
  misc_feature 1..20: note = CRISPR gRNA sequence
  source 1..20: mol_type = other DNA
tcccagcactttgggaggct

SEQ ID NO: 98257 - DNA, 20 bp, synthetic construct
  misc_feature 1..20: note = CRISPR gRNA sequence
  source 1..20: mol_type = other DNA
cccagcactttgggaggctg

SEQ ID NO: 98258 - DNA, 20 bp, synthetic construct
  misc_feature 1..20: note = CRISPR gRNA sequence
  source 1..20: mol_type = other DNA
agcactttgggaggctgagg

SEQ ID NO: 98259 - DNA, 20 bp, synthetic construct
  misc_feature 1..20: note = CRISPR gRNA sequence
  source 1..20: mol_type = other DNA
gcactttgggaggctgaggt

SEQ ID NO: 98260 - DNA, 20 bp, synthetic construct
  misc_feature 1..20: note = CRISPR gRNA sequence
  source 1..20: mol_type = other DNA
ctttgggaggctgaggtggg

SEQ ID NO: 98261 - DNA, 20 bp, synthetic construct
  misc_feature 1..20: note = CRISPR gRNA sequence
  source 1..20: mol_type = other DNA
ctgaggtgggtggatcacct

SEQ ID NO: 98262 - DNA, 20 bp, synthetic construct
  misc_feature 1..20: note = CRISPR gRNA sequence
  source 1..20: mol_type = other DNA
tgaggtgggtggatcacctg

SEQ ID NO: 98263 - DNA, 20 bp, synthetic construct
  misc_feature 1..20: note = CRISPR gRNA sequence
  source 1..20: mol_type = other DNA
gtgggtggatcacctgaggt

SEQ ID NO: 98264 - DNA, 20 bp, synthetic construct
  misc_feature 1..20: note = CRISPR gRNA sequence
  source 1..20: mol_type = other DNA
tgggtggatcacctgaggtc

SEQ ID NO: 98265 - DNA, 20 bp, synthetic construct
  misc_feature 1..20: note = CRISPR gRNA sequence
  source 1..20: mol_type = other DNA
ggtggatcacctgaggtcag

SEQ ID NO: 98266 - DNA, 20 bp, synthetic construct
  misc_feature 1..20: note = CRISPR gRNA sequence
  source 1..20: mol_type = other DNA
tcacctgaggtcaggagttt

SEQ ID NO: 98267 - DNA, 20 bp, synthetic construct
  misc_feature 1..20: note = CRISPR gRNA sequence
  source 1..20: mol_type = other DNA
tgaggtcaggagtttgagac

SEQ ID NO: 98268 - DNA, 20 bp, synthetic construct
  misc_feature 1..20: note = CRISPR gRNA sequence
  source 1..20: mol_type = other DNA
tgagaccagcctgactaaca

SEQ ID NO: 98269 - DNA, 20 bp, synthetic construct
  misc_feature 1..20: note = CRISPR gRNA sequence
  source 1..20: mol_type = other DNA
ctctactaaaaacacaaaat

SEQ ID NO: 98270 - DNA, 20 bp, synthetic construct
  misc_feature 1..20: note = CRISPR gRNA sequence
  source 1..20: mol_type = other DNA
aacacaaaattagccatgca

SEQ ID NO: 98271 - DNA, 20 bp, synthetic construct
  misc_feature 1..20: note = CRISPR gRNA sequence
  source 1..20: mol_type = other DNA
acaaaattagccatgcatgg

SEQ ID NO: 98272 - DNA, 20 bp, synthetic construct
  misc_feature 1..20: note = CRISPR gRNA sequence
  source 1..20: mol_type = other DNA
aaattagccatgcatggtgg

SEQ ID NO: 98273 - DNA, 20 bp, synthetic construct
  misc_feature 1..20: note = CRISPR gRNA sequence
  source 1..20: mol_type = other DNA
gtggcagatgcctgtaatcc

SEQ ID NO: 98274 - DNA, 20 bp, synthetic construct
  misc_feature 1..20: note = CRISPR gRNA sequence
  source 1..20: mol_type = other DNA
tgcctgtaatcccagctact

SEQ ID NO: 98275 - DNA, 20 bp, synthetic construct
  misc_feature 1..20: note = CRISPR gRNA sequence
  source 1..20: mol_type = other DNA
gcctgtaatcccagctactc

SEQ ID NO: 98276 - DNA, 20 bp, synthetic construct
  misc_feature 1..20: note = CRISPR gRNA sequence
  source 1..20: mol_type = other DNA
ctgtaatcccagctactcgg

SEQ ID NO: 98277 - DNA, 20 bp, synthetic construct
  misc_feature 1..20: note = CRISPR gRNA sequence
  source 1..20: mol_type = other DNA
tgtaatcccagctactcggg

SEQ ID NO: 98278 - DNA, 20 bp, synthetic construct
  misc_feature 1..20: note = CRISPR gRNA sequence
  source 1..20: mol_type = other DNA
tcccagctactcgggaggct

SEQ ID NO: 98279 - DNA, 20 bp, synthetic construct
  misc_feature 1..20: note = CRISPR gRNA sequence
  source 1..20: mol_type = other DNA
cccagctactcgggaggctg

SEQ ID NO: 98280 - DNA, 20 bp, synthetic construct
  misc_feature 1..20: note = CRISPR gRNA sequence
  source 1..20: mol_type = other DNA
agctactcgggaggctgagg

SEQ ID NO: 98281 - DNA, 20 bp, synthetic construct
  misc_feature 1..20: note = CRISPR gRNA sequence
  source 1..20: mol_type = other DNA
gctactcgggaggctgaggc

SEQ ID NO: 98282 - DNA, 20 bp, synthetic construct
  misc_feature 1..20: note = CRISPR gRNA sequence
  source 1..20: mol_type = other DNA
tactcgggaggctgaggcag

SEQ ID NO: 98283 - DNA, 20 bp, synthetic construct
  misc_feature 1..20: note = CRISPR gRNA sequence
  source 1..20: mol_type = other DNA
gcaggagaatcgcttgaatc

SEQ ID NO: 98284 - DNA, 20 bp, synthetic construct
  misc_feature 1..20: note = CRISPR gRNA sequence
  source 1..20: mol_type = other DNA
caggagaatcgcttgaatcc

SEQ ID NO: 98285 - DNA, 20 bp, synthetic construct
  misc_feature 1..20: note = CRISPR gRNA sequence
  source 1..20: mol_type = other DNA
ggagaatcgcttgaatccag

SEQ ID NO: 98286 - DNA, 20 bp, synthetic construct
  misc_feature 1..20: note = CRISPR gRNA sequence
  source 1..20: mol_type = other DNA
gagaatcgcttgaatccagg

SEQ ID NO: 98287 - DNA, 20 bp, synthetic construct
  misc_feature 1..20: note = CRISPR gRNA sequence
  source 1..20: mol_type = other DNA
aatcgcttgaatccaggagg

SEQ ID NO: 98288 - DNA, 20 bp, synthetic construct
  misc_feature 1..20: note = CRISPR gRNA sequence
  source 1..20: mol_type = other DNA
tcgcttgaatccaggaggtg

SEQ ID NO: 98289 - DNA, 20 bp, synthetic construct
  misc_feature 1..20: note = CRISPR gRNA sequence
  source 1..20: mol_type = other DNA
cgcttgaatccaggaggtgg

SEQ ID NO: 98290 - DNA, 20 bp, synthetic construct
  misc_feature 1..20: note = CRISPR gRNA sequence
  source 1..20: mol_type = other DNA
aatccaggaggtggaggttg

SEQ ID NO: 98291 - DNA, 20 bp, synthetic construct
  misc_feature 1..20: note = CRISPR gRNA sequence
  source 1..20: mol_type = other DNA
caggaggtggaggttgcagt

SEQ ID NO: 98292 - DNA, 20 bp, synthetic construct
  misc_feature 1..20: note = CRISPR gRNA sequence
  source 1..20: mol_type = other DNA
ggaggtggaggttgcagtga

SEQ ID NO: 98293 - DNA, 20 bp, synthetic construct
  misc_feature 1..20: note = CRISPR gRNA sequence
  source 1..20: mol_type = other DNA
aggtggaggttgcagtgaga

SEQ ID NO: 98294 - DNA, 20 bp, synthetic construct
  misc_feature 1..20: note = CRISPR gRNA sequence
  source 1..20: mol_type = other DNA
gagatcacgccactgcactc

SEQ ID NO: 98295 - DNA, 20 bp, synthetic construct
  misc_feature 1..20: note = CRISPR gRNA sequence
  source 1..20: mol_type = other DNA
cacgccactgcactccagcc

SEQ ID NO: 98296 - DNA, 20 bp, synthetic construct
  misc_feature 1..20: note = CRISPR gRNA sequence
  source 1..20: mol_type = other DNA
acgccactgcactccagcct

SEQ ID NO: 98297 - DNA, 20 bp, synthetic construct
  misc_feature 1..20: note = CRISPR gRNA sequence
  source 1..20: mol_type = other DNA
tgcactccagcctgggcaac

SEQ ID NO: 98298 - DNA, 20 bp, synthetic construct
  misc_feature 1..20: note = CRISPR gRNA sequence
  source 1..20: mol_type = other DNA
cactccagcctgggcaacaa

SEQ ID NO: 98299 - DNA, 20 bp, synthetic construct
  misc_feature 1..20: note = CRISPR gRNA sequence
  source 1..20: mol_type = other DNA
ccagcctgggcaacaagagt

SEQ ID NO: 98300 - DNA, 20 bp, synthetic construct
  misc_feature 1..20: note = CRISPR gRNA sequence
  source 1..20: mol_type = other DNA
aaaaaaaaaaaaaaatttaa

SEQ ID NO: 98301 - DNA, 20 bp, synthetic construct
  misc_feature 1..20: note = CRISPR gRNA sequence
  source 1..20: mol_type = other DNA
aaaaaaaaaaaatttaaaag

SEQ ID NO: 98302 - DNA, 20 bp, synthetic construct
  misc_feature 1..20: note = CRISPR gRNA sequence
  source 1..20: mol_type = other DNA
aaaaaaaaaaatttaaaagc

SEQ ID NO: 98303 - DNA, 20 bp, synthetic construct
  misc_feature 1..20: note = CRISPR gRNA sequence
  source 1..20: mol_type = other DNA
aaaaaaaatttaaaagcagg

SEQ ID NO: 98304 - DNA, 20 bp, synthetic construct
  misc_feature 1..20: note = CRISPR gRNA sequence
  source 1..20: mol_type = other DNA
aaaaatttaaaagcaggtag

SEQ ID NO: 98305 - DNA, 20 bp, synthetic construct
  misc_feature 1..20: note = CRISPR gRNA sequence
  source 1..20: mol_type = other DNA
aaatttaaaagcaggtagaa

SEQ ID NO: 98306 - DNA, 20 bp, synthetic construct
  misc_feature 1..20: note = CRISPR gRNA sequence
  source 1..20: mol_type = other DNA
aatttaaaagcaggtagaag

SEQ ID NO: 98307 - DNA, 20 bp, synthetic construct
  misc_feature 1..20: note = CRISPR gRNA sequence
  source 1..20: mol_type = other DNA
agcaggtagaagaggatgaa

SEQ ID NO: 98308 - DNA, 20 bp, synthetic construct
  misc_feature 1..20: note = CRISPR gRNA sequence
  source 1..20: mol_type = other DNA
gtagaagaggatgaaaagaa

SEQ ID NO: 98309 - DNA, 20 bp, synthetic construct
  misc_feature 1..20: note = CRISPR gRNA sequence
  source 1..20: mol_type = other DNA
agaagaggatgaaaagaacg

SEQ ID NO: 98310 - DNA, 20 bp, synthetic construct
  misc_feature 1..20: note = CRISPR gRNA sequence
  source 1..20: mol_type = other DNA
ggatgaaaagaacggagcac

SEQ ID NO: 98311 - DNA, 20 bp, synthetic construct
  misc_feature 1..20: note = CRISPR gRNA sequence
  source 1..20: mol_type = other DNA
gatgaaaagaacggagcaca

SEQ ID NO: 98312 - DNA, 20 bp, synthetic construct
  misc_feature 1..20: note = CRISPR gRNA sequence
  source 1..20: mol_type = other DNA
aagaacggagcacaaggaat

SEQ ID NO: 98313 - DNA, 20 bp, synthetic construct
  misc_feature 1..20: note = CRISPR gRNA sequence
  source 1..20: mol_type = other DNA
cacaaggaataagtccttct

SEQ ID NO: 98314 - DNA, 20 bp, synthetic construct
  misc_feature 1..20: note = CRISPR gRNA sequence
  source 1..20: mol_type = other DNA
ggaataagtccttcttagac

SEQ ID NO: 98315 - DNA, 20 bp, synthetic construct
  misc_feature 1..20: note = CRISPR gRNA sequence
  source 1..20: mol_type = other DNA
gaataagtccttcttagaca

SEQ ID NO: 98316 - DNA, 20 bp, synthetic construct
  misc_feature 1..20: note = CRISPR gRNA sequence
  source 1..20: mol_type = other DNA
taagtccttcttagacaagg

SEQ ID NO: 98317 - DNA, 20 bp, synthetic construct
  misc_feature 1..20: note = CRISPR gRNA sequence
  source 1..20: mol_type = other DNA
cttcttagacaaggtggtaa

SEQ ID NO: 98318 - DNA, 20 bp, synthetic construct
  misc_feature 1..20: note = CRISPR gRNA sequence
  source 1..20: mol_type = other DNA
ttcttagacaaggtggtaac

SEQ ID NO: 98319 - DNA, 20 bp, synthetic construct
  misc_feature 1..20: note = CRISPR gRNA sequence
  source 1..20: mol_type = other DNA
cttagacaaggtggtaacag

SEQ ID NO: 98320 - DNA, 20 bp, synthetic construct
  misc_feature 1..20: note = CRISPR gRNA sequence
  source 1..20: mol_type = other DNA
ttagacaaggtggtaacagg

SEQ ID NO: 98321 - DNA, 20 bp, synthetic construct
  misc_feature 1..20: note = CRISPR gRNA sequence
  source 1..20: mol_type = other DNA
tagacaaggtggtaacagga

SEQ ID NO: 98322 - DNA, 20 bp, synthetic construct
  misc_feature 1..20: note = CRISPR gRNA sequence
  source 1..20: mol_type = other DNA
ggtaacaggagggcctcccc

SEQ ID NO: 98323 - DNA, 20 bp, synthetic construct
  misc_feature 1..20: note = CRISPR gRNA sequence
  source 1..20: mol_type = other DNA
gtaacaggagggcctcccca

SEQ ID NO: 98324 - DNA, 20 bp, synthetic construct
  misc_feature 1..20: note = CRISPR gRNA sequence
  source 1..20: mol_type = other DNA
ctccccaaggtgacaccacc

SEQ ID NO: 98325 - DNA, 20 bp, synthetic construct
  misc_feature 1..20: note = CRISPR gRNA sequence
  source 1..20: mol_type = other DNA
aggtgacaccaccgagatct

SEQ ID NO: 98326 - DNA, 20 bp, synthetic construct
  misc_feature 1..20: note = CRISPR gRNA sequence
  source 1..20: mol_type = other DNA
ggtgacaccaccgagatctt

SEQ ID NO: 98327 - DNA, 20 bp, synthetic construct
  misc_feature 1..20: note = CRISPR gRNA sequence
  source 1..20: mol_type = other DNA
gacaccaccgagatcttagg

SEQ ID NO: 98328 - DNA, 20 bp, synthetic construct
  misc_feature 1..20: note = CRISPR gRNA sequence
  source 1..20: mol_type = other DNA
accgagatcttaggaagtca

SEQ ID NO: 98329 - DNA, 20 bp, synthetic construct
  misc_feature 1..20: note = CRISPR gRNA sequence
  source 1..20: mol_type = other DNA
gaagtcaaagaaatccgcta

SEQ ID NO: 98330 - DNA, 20 bp, synthetic construct
  misc_feature 1..20: note = CRISPR gRNA sequence
  source 1..20: mol_type = other DNA
aagtcaaagaaatccgctac

SEQ ID NO: 98331 - DNA, 20 bp, synthetic construct
  misc_feature 1..20: note = CRISPR gRNA sequence
  source 1..20: mol_type = other DNA
agtcaaagaaatccgctaca

SEQ ID NO: 98332 - DNA, 20 bp, synthetic construct
  misc_feature 1..20: note = CRISPR gRNA sequence
  source 1..20: mol_type = other DNA
aagaaatccgctacagggac

SEQ ID NO: 98333 - DNA, 20 bp, synthetic construct
  misc_feature 1..20: note = CRISPR gRNA sequence
  source 1..20: mol_type = other DNA
agaaatccgctacagggact

SEQ ID NO: 98334 - DNA, 20 bp, synthetic construct
  misc_feature 1..20: note = CRISPR gRNA sequence
  source 1..20: mol_type = other DNA
tccgctacagggactgggcg

SEQ ID NO: 98335 - DNA, 20 bp, synthetic construct
  misc_feature 1..20: note = CRISPR gRNA sequence
  source 1..20: mol_type = other DNA
gctacagggactgggcgcgg

SEQ ID NO: 98336 - DNA, 20 bp, synthetic construct
  misc_feature 1..20: note = CRISPR gRNA sequence
  source 1..20: mol_type = other DNA
gtggctcacgcctgtaatcc

SEQ ID NO: 98337 - DNA, 20 bp, synthetic construct
  misc_feature 1..20: note = CRISPR gRNA sequence
  source 1..20: mol_type = other DNA
cgcctgtaatcccagcactt

SEQ ID NO: 98338 - DNA, 20 bp, synthetic construct
  misc_feature 1..20: note = CRISPR gRNA sequence
  source 1..20: mol_type = other DNA
gcctgtaatcccagcacttt

SEQ ID NO: 98339 - DNA, 20 bp, synthetic construct
  misc_feature 1..20: note = CRISPR gRNA sequence
  source 1..20: mol_type = other DNA
ctgtaatcccagcactttgg

SEQ ID NO: 98340 - DNA, 20 bp, synthetic construct
  misc_feature 1..20: note = CRISPR gRNA sequence
  source 1..20: mol_type = other DNA
tgtaatcccagcactttggg

SEQ ID NO: 98341 - DNA, 20 bp, synthetic construct
  misc_feature 1..20: note = CRISPR gRNA sequence
  source 1..20: mol_type = other DNA
tcccagcactttgggaggcc

SEQ ID NO: 98342 - DNA, 20 bp, synthetic construct
  misc_feature 1..20: note = CRISPR gRNA sequence
  source 1..20: mol_type = other DNA
cccagcactttgggaggccg

SEQ ID NO: 98343 - DNA, 20 bp, synthetic construct
  misc_feature 1..20: note = CRISPR gRNA sequence
  source 1..20: mol_type = other DNA
agcactttgggaggccgagg

SEQ ID NO: 98344 - DNA, 20 bp, synthetic construct
  misc_feature 1..20: note = CRISPR gRNA sequence
  source 1..20: mol_type = other DNA
gcactttgggaggccgaggc

SEQ ID NO: 98345 - DNA, 20 bp, synthetic construct
  misc_feature 1..20: note = CRISPR gRNA sequence
  source 1..20: mol_type = other DNA
gccgaggcgggcaatcacct

SEQ ID NO: 98346 - DNA, 20 bp, synthetic construct
  misc_feature 1..20: note = CRISPR gRNA sequence
  source 1..20: mol_type = other DNA
ccgaggcgggcaatcacctg

SEQ ID NO: 98347 - DNA, 20 bp, synthetic construct
  misc_feature 1..20: note = CRISPR gRNA sequence
  source 1..20: mol_type = other DNA
ggcgggcaatcacctgaggt

SEQ ID NO: 98348 - DNA, 20 bp, synthetic construct
  misc_feature 1..20: note = CRISPR gRNA sequence
  source 1..20: mol_type = other DNA
gcgggcaatcacctgaggtc

SEQ ID NO: 98349 - DNA, 20 bp, synthetic construct
  misc_feature 1..20: note = CRISPR gRNA sequence
  source 1..20: mol_type = other DNA
gggcaatcacctgaggtcag

SEQ ID NO: 98350 - DNA, 20 bp, synthetic construct
  misc_feature 1..20: note = CRISPR gRNA sequence
  source 1..20: mol_type = other DNA
tcacctgaggtcaggagttc

SEQ ID NO: 98351 - DNA, 20 bp, synthetic construct
  misc_feature 1..20: note = CRISPR gRNA sequence
  source 1..20: mol_type = other DNA
tgaggtcaggagttcgagac

SEQ ID NO: 98352 - DNA, 20 bp, synthetic construct
  misc_feature 1..20: note = CRISPR gRNA sequence
  source 1..20: mol_type = other DNA
tcaggagttcgagaccagcc

SEQ ID NO: 98353 - DNA, 20 bp, synthetic construct
  misc_feature 1..20: note = CRISPR gRNA sequence
  source 1..20: mol_type = other DNA
caggagttcgagaccagcct

SEQ ID NO: 98354 - DNA, 20 bp, synthetic construct
  misc_feature 1..20: note = CRISPR gRNA sequence
  source 1..20: mol_type = other DNA
cgagaccagcctgggcaaca

SEQ ID NO: 98355 - DNA, 20 bp, synthetic construct
  misc_feature 1..20: note = CRISPR gRNA sequence
  source 1..20: mol_type = other DNA
tctactaaaaacacaaaaat

SEQ ID NO: 98356 - DNA, 20 bp, synthetic construct
  misc_feature 1..20: note = CRISPR gRNA sequence
  source 1..20: mol_type = other DNA
ctaaaaacacaaaaattagc

SEQ ID NO: 98357 - DNA, 20 bp, synthetic construct
  misc_feature 1..20: note = CRISPR gRNA sequence
  source 1..20: mol_type = other DNA
acacaaaaattagctggatg

SEQ ID NO: 98358 - DNA, 20 bp, synthetic construct
  misc_feature 1..20: note = CRISPR gRNA sequence
  source 1..20: mol_type = other DNA
caaaaattagctggatgtgg

SEQ ID NO: 98359 - DNA, 20 bp, synthetic construct
  misc_feature 1..20: note = CRISPR gRNA sequence
  source 1..20: mol_type = other DNA
ctggatgtggtggtgcatgc

SEQ ID NO: 98360 - DNA, 20 bp, synthetic construct
  misc_feature 1..20: note = CRISPR gRNA sequence
  source 1..20: mol_type = other DNA
ggtggtgcatgccagctact

SEQ ID NO: 98361 - DNA, 20 bp, synthetic construct
  misc_feature 1..20: note = CRISPR gRNA sequence
  source 1..20: mol_type = other DNA
gtggtgcatgccagctactt

SEQ ID NO: 98362 - DNA, 20 bp, synthetic construct
  misc_feature 1..20: note = CRISPR gRNA sequence
  source 1..20: mol_type = other DNA
ggtgcatgccagctacttgg

SEQ ID NO: 98363 - DNA, 20 bp, synthetic construct
  misc_feature 1..20: note = CRISPR gRNA sequence
  source 1..20: mol_type = other DNA
gtgcatgccagctacttggg

SEQ ID NO: 98364 - DNA, 20 bp, synthetic construct
  misc_feature 1..20: note = CRISPR gRNA sequence
  source 1..20: mol_type = other DNA
tgccagctacttgggaggct

SEQ ID NO: 98365 - DNA, 20 bp, synthetic construct
  misc_feature 1..20: note = CRISPR gRNA sequence
  source 1..20: mol_type = other DNA
gccagctacttgggaggctg

SEQ ID NO: 98366 - DNA, 20 bp, synthetic construct
  misc_feature 1..20: note = CRISPR gRNA sequence
  source 1..20: mol_type = other DNA
agctacttgggaggctgagg

SEQ ID NO: 98367 - DNA, 20 bp, synthetic construct
  misc_feature 1..20: note = CRISPR gRNA sequence
  source 1..20: mol_type = other DNA
gctacttgggaggctgaggc

SEQ ID NO: 98368 - DNA, 20 bp, synthetic construct
  misc_feature 1..20: note = CRISPR gRNA sequence
  source 1..20: mol_type = other DNA
tacttgggaggctgaggcag

SEQ ID NO: 98369 - DNA, 20 bp, synthetic construct
  misc_feature 1..20: note = CRISPR gRNA sequence
  source 1..20: mol_type = other DNA
gcaggagaatcaccttaacc

SEQ ID NO: 98370 - DNA, 20 bp, synthetic construct
  misc_feature 1..20: note = CRISPR gRNA sequence
  source 1..20: mol_type = other DNA
caggagaatcaccttaaccc

SEQ ID NO: 98371 - DNA, 20 bp, synthetic construct
  misc_feature 1..20: note = CRISPR gRNA sequence
  source 1..20: mol_type = other DNA
ggagaatcaccttaacccag

SEQ ID NO: 98372 - DNA, 20 bp, synthetic construct
  misc_feature 1..20: note = CRISPR gRNA sequence
  source 1..20: mol_type = other DNA
agaatcaccttaacccagga

SEQ ID NO: 98373 - DNA, 20 bp, synthetic construct
  misc_feature 1..20: note = CRISPR gRNA sequence
  source 1..20: mol_type = other DNA
gaatcaccttaacccaggag

SEQ ID NO: 98374 - DNA, 20 bp, synthetic construct
  misc_feature 1..20: note = CRISPR gRNA sequence
  source 1..20: mol_type = other DNA
aatcaccttaacccaggaga

SEQ ID NO: 98375 - DNA, 20 bp, synthetic construct
  misc_feature 1..20: note = CRISPR gRNA sequence
  source 1..20: mol_type = other DNA
tcaccttaacccaggagagg

SEQ ID NO: 98376 - DNA, 20 bp, synthetic construct
  misc_feature 1..20: note = CRISPR gRNA sequence
  source 1..20: mol_type = other DNA
taacccaggagagggagttg

SEQ ID NO: 98377 - DNA, 20 bp, synthetic construct
  misc_feature 1..20: note = CRISPR gRNA sequence
  source 1..20: mol_type = other DNA
ccaggagagggagttgcagt

SEQ ID NO: 98378 - DNA, 20 bp, synthetic construct
  misc_feature 1..20: note = CRISPR gRNA sequence
  source 1..20: mol_type = other DNA
agagggagttgcagtgagtc

SEQ ID NO: 98379 - DNA, 20 bp, synthetic construct
  misc_feature 1..20: note = CRISPR gRNA sequence
  source 1..20: mol_type = other DNA
ggagttgcagtgagtcaaga

SEQ ID NO: 98380 - DNA, 20 bp, synthetic construct
  misc_feature 1..20: note = CRISPR gRNA sequence
  source 1..20: mol_type = other DNA
agtgccactgcactccaccc

SEQ ID NO: 98381 - DNA, 20 bp, synthetic construct
  misc_feature 1..20: note = CRISPR gRNA sequence
  source 1..20: mol_type = other DNA
ctgcactccaccctggacaa

SEQ ID NO: 98382 - DNA, 20 bp, synthetic construct
  misc_feature 1..20: note = CRISPR gRNA sequence
  source 1..20: mol_type = other DNA
gcactccaccctggacaaca

SEQ ID NO: 98383 - DNA, 20 bp, synthetic construct
  misc_feature 1..20: note = CRISPR gRNA sequence
  source 1..20: mol_type = other DNA
tccaccctggacaacagagc

SEQ ID NO: 98384 - DNA, 20 bp, synthetic construct
  misc_feature 1..20: note = CRISPR gRNA sequence
  source 1..20: mol_type = other DNA
acagagcaagattctgtctc

SEQ ID NO: 98385 - DNA, 20 bp, synthetic construct
  misc_feature 1..20: note = CRISPR gRNA sequence
  source 1..20: mol_type = other DNA
gagcaagattctgtctcaag

SEQ ID NO: 98386 - DNA, 20 bp, synthetic construct
  misc_feature 1..20: note = CRISPR gRNA sequence
  source 1..20: mol_type = other DNA
gcaagattctgtctcaagaa

SEQ ID NO: 98387 - DNA, 20 bp, synthetic construct
  misc_feature 1..20: note = CRISPR gRNA sequence
  source 1..20: mol_type = other DNA
aagattctgtctcaagaaga

SEQ ID NO: 98388 - DNA, 20 bp, synthetic construct
  misc_feature 1..20: note = CRISPR gRNA sequence
  source 1..20: mol_type = other DNA
agattctgtctcaagaagag

SEQ ID NO: 98389 - DNA, 20 bp, synthetic construct
  misc_feature 1..20: note = CRISPR gRNA sequence
  source 1..20: mol_type = other DNA
gattctgtctcaagaagaga

SEQ ID NO: 98390 - DNA, 20 bp, synthetic construct
  misc_feature 1..20: note = CRISPR gRNA sequence
  source 1..20: mol_type = other DNA
attctgtctcaagaagagag

SEQ ID NO: 98391 - DNA, 20 bp, synthetic construct
  misc_feature 1..20: note = CRISPR gRNA sequence
  source 1..20: mol_type = other DNA
tctcaagaagagaggggatc

SEQ ID NO: 98392 - DNA, 20 bp, synthetic construct
  misc_feature 1..20: note = CRISPR gRNA sequence
  source 1..20: mol_type = other DNA
ctcaagaagagaggggatcc

SEQ ID NO: 98393 - DNA, 20 bp, synthetic construct
  misc_feature 1..20: note = CRISPR gRNA sequence
  source 1..20: mol_type = other DNA
caagaagagaggggatccag

SEQ ID NO: 98394 - DNA, 20 bp, synthetic construct
  misc_feature 1..20: note = CRISPR gRNA sequence
  source 1..20: mol_type = other DNA
aagaagagaggggatccagg

SEQ ID NO: 98395 - DNA, 20 bp, synthetic construct
  misc_feature 1..20: note = CRISPR gRNA sequence
  source 1..20: mol_type = other DNA
ggggatccaggaggcgtctc

SEQ ID NO: 98396 - DNA, 20 bp, synthetic construct
  misc_feature 1..20: note = CRISPR gRNA sequence
  source 1..20: mol_type = other DNA
ggatccaggaggcgtctcga

SEQ ID NO: 98397 - DNA, 20 bp, synthetic construct
  misc_feature 1..20: note = CRISPR gRNA sequence
  source 1..20: mol_type = other DNA
tccaggaggcgtctcgagag

SEQ ID NO: 98398 - DNA, 20 bp, synthetic construct
  misc_feature 1..20: note = CRISPR gRNA sequence
  source 1..20: mol_type = other DNA
ccaggaggcgtctcgagagt

SEQ ID NO: 98399 - DNA, 20 bp, synthetic construct
  misc_feature 1..20: note = CRISPR gRNA sequence
  source 1..20: mol_type = other DNA
caggaggcgtctcgagagtg

SEQ ID NO: 98400 - DNA, 20 bp, synthetic construct
  misc_feature 1..20: note = CRISPR gRNA sequence
  source 1..20: mol_type = other DNA
ggaggcgtctcgagagtggg

SEQ ID NO: 98401 - DNA, 20 bp, synthetic construct
  misc_feature 1..20: note = CRISPR gRNA sequence
  source 1..20: mol_type = other DNA
aggcgtctcgagagtgggga

SEQ ID NO: 98402 - DNA, 20 bp, synthetic construct
  misc_feature 1..20: note = CRISPR gRNA sequence
  source 1..20: mol_type = other DNA
ggcgtctcgagagtggggag

SEQ ID NO: 98403 - DNA, 20 bp, synthetic construct
  misc_feature 1..20: note = CRISPR gRNA sequence
  source 1..20: mol_type = other DNA
gcgtctcgagagtggggaga

SEQ ID NO: 98404 - DNA, 20 bp, synthetic construct
  misc_feature 1..20: note = CRISPR gRNA sequence
  source 1..20: mol_type = other DNA
cgtctcgagagtggggagag

SEQ ID NO: 98405 - DNA, 20 bp, synthetic construct
  misc_feature 1..20: note = CRISPR gRNA sequence
  source 1..20: mol_type = other DNA
tcgagagtggggagagggga

SEQ ID NO: 98406 - DNA, 20 bp, synthetic construct
  misc_feature 1..20: note = CRISPR gRNA sequence
  source 1..20: mol_type = other DNA
cgagagtggggagaggggaa

SEQ ID NO: 98407 - DNA, 20 bp, synthetic construct
  misc_feature 1..20: note = CRISPR gRNA sequence
  source 1..20: mol_type = other DNA
agagtggggagaggggaaag

SEQ ID NO: 98408 - DNA, 20 bp, synthetic construct
  misc_feature 1..20: note = CRISPR gRNA sequence
  source 1..20: mol_type = other DNA
gagtggggagaggggaaagg

SEQ ID NO: 98409 - DNA, 20 bp, synthetic construct
  misc_feature 1..20: note = CRISPR gRNA sequence
  source 1..20: mol_type = other DNA
agtggggagaggggaaagga

SEQ ID NO: 98410 - DNA, 20 bp, synthetic construct
  misc_feature 1..20: note = CRISPR gRNA sequence
  source 1..20: mol_type = other DNA
gtggggagaggggaaaggag

SEQ ID NO: 98411 - DNA, 20 bp, synthetic construct
  misc_feature 1..20: note = CRISPR gRNA sequence
  source 1..20: mol_type = other DNA
ggggagaggggaaaggaggg

SEQ ID NO: 98412 - DNA, 20 bp, synthetic construct
  misc_feature 1..20: note = CRISPR gRNA sequence
  source 1..20: mol_type = other DNA
gggagaggggaaaggagggg

SEQ ID NO: 98413 - DNA, 20 bp, synthetic construct
  misc_feature 1..20: note = CRISPR gRNA sequence
  source 1..20: mol_type = other DNA
ggagaggggaaaggagggga

SEQ ID NO: 98414 - DNA, 20 bp, synthetic construct
  misc_feature 1..20: note = CRISPR gRNA sequence
  source 1..20: mol_type = other DNA
gagaggggaaaggaggggag

SEQ ID NO: 98415 - DNA, 20 bp, synthetic construct
  misc_feature 1..20: note = CRISPR gRNA sequence
  source 1..20: mol_type = other DNA
gaggggaaaggaggggaggg

SEQ ID NO: 98416 - DNA, 20 bp, synthetic construct
  misc_feature 1..20: note = CRISPR gRNA sequence
  source 1..20: mol_type = other DNA
aggggaaaggaggggagggg

SEQ ID NO: 98417 - DNA, 20 bp, synthetic construct
  misc_feature 1..20: note = CRISPR gRNA sequence
  source 1..20: mol_type = other DNA
gaaaggaggggaggggaggc

SEQ ID NO: 98418 - DNA, 20 bp, synthetic construct
  misc_feature 1..20: note = CRISPR gRNA sequence
  source 1..20: mol_type = other DNA
aaaggaggggaggggaggcg

SEQ ID NO: 98419 - DNA, 20 bp, synthetic construct
  misc_feature 1..20: note = CRISPR gRNA sequence
  source 1..20: mol_type = other DNA
aaggaggggaggggaggcga

SEQ ID NO: 98420 - DNA, 20 bp, synthetic construct
  misc_feature 1..20: note = CRISPR gRNA sequence
  source 1..20: mol_type = other DNA
aggaggggaggggaggcgag

SEQ ID NO: 98421 - DNA, 20 bp, synthetic construct
  misc_feature 1..20: note = CRISPR gRNA sequence
  source 1..20: mol_type = other DNA
gaggggaggggaggcgaggg

SEQ ID NO: 98422 - DNA, 20 bp, synthetic construct
  misc_feature 1..20: note = CRISPR gRNA sequence
  source 1..20: mol_type = other DNA
aggggaggggaggcgagggg

SEQ ID NO: 98423 - DNA, 20 bp, synthetic construct
  misc_feature 1..20: note = CRISPR gRNA sequence
  source 1..20: mol_type = other DNA
ggggaggggaggcgagggga

SEQ ID NO: 98424 - DNA, 20 bp, synthetic construct
  misc_feature 1..20: note = CRISPR gRNA sequence
  source 1..20: mol_type = other DNA
gggaggggaggcgaggggag

SEQ ID NO: 98425 - DNA, 20 bp, synthetic construct
  misc_feature 1..20: note = CRISPR gRNA sequence
  source 1..20: mol_type = other DNA
gaggggaggcgaggggaggg

SEQ ID NO: 98426 - DNA, 20 bp, synthetic construct
  misc_feature 1..20: note = CRISPR gRNA sequence
  source 1..20: mol_type = other DNA
aggggaggcgaggggagggg

SEQ ID NO: 98427 - DNA, 20 bp, synthetic construct
  misc_feature 1..20: note = CRISPR gRNA sequence
  source 1..20: mol_type = other DNA
ggggaggcgaggggagggga

SEQ ID NO: 98428 - DNA, 20 bp, synthetic construct
  misc_feature 1..20: note = CRISPR gRNA sequence
  source 1..20: mol_type = other DNA
ggaggcgaggggaggggagg

SEQ ID NO: 98429 - DNA, 20 bp, synthetic construct
  misc_feature 1..20: note = CRISPR gRNA sequence
  source 1..20: mol_type = other DNA
cgaggggaggggagggagcc

SEQ ID NO: 98430 - DNA, 20 bp, synthetic construct
  misc_feature 1..20: note = CRISPR gRNA sequence
  source 1..20: mol_type = other DNA
gaggggaggggagggagcct

SEQ ID NO: 98431 - DNA, 20 bp, synthetic construct
  misc_feature 1..20: note = CRISPR gRNA sequence
  source 1..20: mol_type = other DNA
ggagggagcctgggcaacaa

SEQ ID NO: 98432 - DNA, 20 bp, synthetic construct
  misc_feature 1..20: note = CRISPR gRNA sequence
  source 1..20: mol_type = other DNA
tttaaaaaaaaaaaaaaaaa

SEQ ID NO: 98433 - DNA, 20 bp, synthetic construct
  misc_feature 1..20: note = CRISPR gRNA sequence
  source 1..20: mol_type = other DNA
aaaaaaaaaaaaacggactg

SEQ ID NO: 98434 - DNA, 20 bp, synthetic construct
  misc_feature 1..20: note = CRISPR gRNA sequence
  source 1..20: mol_type = other DNA
aaaaaaacggactgtagtcc

SEQ ID NO: 98435 - DNA, 20 bp, synthetic construct
  misc_feature 1..20: note = CRISPR gRNA sequence
  source 1..20: mol_type = other DNA
ggactgtagtcccagctact

SEQ ID NO: 98436 - DNA, 20 bp, synthetic construct
  misc_feature 1..20: note = CRISPR gRNA sequence
  source 1..20: mol_type = other DNA
gactgtagtcccagctactc

SEQ ID NO: 98437 - DNA, 20 bp, synthetic construct
  misc_feature 1..20: note = CRISPR gRNA sequence
  source 1..20: mol_type = other DNA
ctgtagtcccagctactcgg

SEQ ID NO: 98438 - DNA, 20 bp, synthetic construct
  misc_feature 1..20: note = CRISPR gRNA sequence
  source 1..20: mol_type = other DNA
tgtagtcccagctactcggg

SEQ ID NO: 98439 - DNA, 20 bp, synthetic construct
  misc_feature 1..20: note = CRISPR gRNA sequence
  source 1..20: mol_type = other DNA
cccagctactcgggaggctg

SEQ ID NO: 98440 - DNA, 20 bp, synthetic construct
  misc_feature 1..20: note = CRISPR gRNA sequence
  source 1..20: mol_type = other DNA
agctactcgggaggctgaag

SEQ ID NO: 98441 - DNA, 20 bp, synthetic construct
  misc_feature 1..20: note = CRISPR gRNA sequence
  source 1..20: mol_type = other DNA
gctactcgggaggctgaagc

SEQ ID NO: 98442 - DNA, 20 bp, synthetic construct
  misc_feature 1..20: note = CRISPR gRNA sequence
  source 1..20: mol_type = other DNA
tactcgggaggctgaagcag

SEQ ID NO: 98443 - DNA, 20 bp, synthetic construct
  misc_feature 1..20: note = CRISPR gRNA sequence
  source 1..20: mol_type = other DNA
gggaggctgaagcaggagaa

SEQ ID NO: 98444 - DNA, 20 bp, synthetic construct
  misc_feature 1..20: note = CRISPR gRNA sequence
  source 1..20: mol_type = other DNA
gcaggagaatggcgtgaaca

SEQ ID NO: 98445 - DNA, 20 bp, synthetic construct
  misc_feature 1..20: note = CRISPR gRNA sequence
  source 1..20: mol_type = other DNA
caggagaatggcgtgaacac

SEQ ID NO: 98446 - DNA, 20 bp, synthetic construct
  misc_feature 1..20: note = CRISPR gRNA sequence
  source 1..20: mol_type = other DNA
ggagaatggcgtgaacacgg

SEQ ID NO: 98447 - DNA, 20 bp, synthetic construct
  misc_feature 1..20: note = CRISPR gRNA sequence
  source 1..20: mol_type = other DNA
gagaatggcgtgaacacggg

SEQ ID NO: 98448 - DNA, 20 bp, synthetic construct
  misc_feature 1..20: note = CRISPR gRNA sequence
  source 1..20: mol_type = other DNA
aatggcgtgaacacgggagg

SEQ ID NO: 98449 - DNA, 20 bp, synthetic construct
  misc_feature 1..20: note = CRISPR gRNA sequence
  source 1..20: mol_type = other DNA
tggcgtgaacacgggaggtg

SEQ ID NO: 98450 - DNA, 20 bp, synthetic construct
  misc_feature 1..20: note = CRISPR gRNA sequence
  source 1..20: mol_type = other DNA
aacacgggaggtggagcttg

SEQ ID NO: 98451 - DNA, 20 bp, synthetic construct
  misc_feature 1..20: note = CRISPR gRNA sequence
  source 1..20: mol_type = other DNA
cgggaggtggagcttgcagt

SEQ ID NO: 98452 - DNA, 20 bp, synthetic construct
  misc_feature 1..20: note = CRISPR gRNA sequence
  source 1..20: mol_type = other DNA
ggtggagcttgcagtgagcc

SEQ ID NO: 98453 - DNA, 20 bp, synthetic construct
  misc_feature 1..20: note = CRISPR gRNA sequence
  source 1..20: mol_type = other DNA
ccactgcactccatgcactc

SEQ ID NO: 98454 - DNA, 20 bp, synthetic construct
  misc_feature 1..20: note = CRISPR gRNA sequence
  source 1..20: mol_type = other DNA
gcactccatgcactccagcc

SEQ ID NO: 98455 - DNA, 20 bp, synthetic construct
  misc_feature 1..20: note = CRISPR gRNA sequence
  source 1..20: mol_type = other DNA
cactccatgcactccagcct

SEQ ID NO: 98456 - DNA, 20 bp, synthetic construct
  misc_feature 1..20: note = CRISPR gRNA sequence
  source 1..20: mol_type = other DNA
atgcactccagcctgggcga

SEQ ID NO: 98457 - DNA, 20 bp, synthetic construct
  misc_feature 1..20: note = CRISPR gRNA sequence
  source 1..20: mol_type = other DNA
gcactccagcctgggcgaca

SEQ ID NO: 98458 - DNA, 20 bp, synthetic construct
  misc_feature 1..20: note = CRISPR gRNA sequence
  source 1..20: mol_type = other DNA
tccagcctgggcgacagagc

SEQ ID NO: 98459 - DNA, 20 bp, synthetic construct
  misc_feature 1..20: note = CRISPR gRNA sequence
  source 1..20: mol_type = other DNA
gcgagactccatctcaaaaa

SEQ ID NO: 98460 - DNA, 20 bp, synthetic construct
  misc_feature 1..20: note = CRISPR gRNA sequence
  source 1..20: mol_type = other DNA
gactccatctcaaaaaaaga

SEQ ID NO: 98461 - DNA, 20 bp, synthetic construct
  misc_feature 1..20: note = CRISPR gRNA sequence
  source 1..20: mol_type = other DNA
ccatctcaaaaaaagaaaga

SEQ ID NO: 98462 - DNA, 20 bp, synthetic construct
  misc_feature 1..20: note = CRISPR gRNA sequence
  source 1..20: mol_type = other DNA
ctcaaaaaaagaaagaaaga

SEQ ID NO: 98463 - DNA, 20 bp, synthetic construct
  misc_feature 1..20: note = CRISPR gRNA sequence
  source 1..20: mol_type = other DNA
agaaagaaagaaaaaaaaaa

SEQ ID NO: 98464 - DNA, 20 bp, synthetic construct
  misc_feature 1..20: note = CRISPR gRNA sequence
  source 1..20: mol_type = other DNA
aaagaaagaaaaaaaaaacg

SEQ ID NO: 98465 - DNA, 20 bp, synthetic construct
  misc_feature 1..20: note = CRISPR gRNA sequence
  source 1..20: mol_type = other DNA
aagaaagaaaaaaaaaacgg

SEQ ID NO: 98466 - DNA, 20 bp, synthetic construct
  misc_feature 1..20: note = CRISPR gRNA sequence
  source 1..20: mol_type = other DNA
aaagaaaaaaaaaacggagg

SEQ ID NO: 98467 - DNA, 20 bp, synthetic construct
  misc_feature 1..20: note = CRISPR gRNA sequence
  source 1..20: mol_type = other DNA
aagaaaaaaaaaacggaggc

SEQ ID NO: 98468 - DNA, 20 bp, synthetic construct
  misc_feature 1..20: note = CRISPR gRNA sequence
  source 1..20: mol_type = other DNA
aaaaaaaaaacggaggcggg

SEQ ID NO: 98469 - DNA, 20 bp, synthetic construct
  misc_feature 1..20: note = CRISPR gRNA sequence
  source 1..20: mol_type = other DNA
aaaaaaaaacggaggcggga

SEQ ID NO: 98470 - DNA, 20 bp, synthetic construct
  misc_feature 1..20: note = CRISPR gRNA sequence
  source 1..20: mol_type = other DNA
aaaaaaaacggaggcgggaa

SEQ ID NO: 98471 - DNA, 20 bp, synthetic construct
  misc_feature 1..20: note = CRISPR gRNA sequence
  source 1..20: mol_type = other DNA
aaaaaacggaggcgggaagg

SEQ ID NO: 98472 - DNA, 20 bp, synthetic construct
  misc_feature 1..20: note = CRISPR gRNA sequence
  source 1..20: mol_type = other DNA
aaaaacggaggcgggaaggg

SEQ ID NO: 98473 - DNA, 20 bp, synthetic construct
  misc_feature 1..20: note = CRISPR gRNA sequence
  source 1..20: mol_type = other DNA
aaaacggaggcgggaaggga

SEQ ID NO: 98474 - DNA, 20 bp, synthetic construct
  misc_feature 1..20: note = CRISPR gRNA sequence
  source 1..20: mol_type = other DNA
aacggaggcgggaagggagg

SEQ ID NO: 98475 - DNA, 20 bp, synthetic construct
  misc_feature 1..20: note = CRISPR gRNA sequence
  source 1..20: mol_type = other DNA
acggaggcgggaagggaggg

SEQ ID NO: 98476 - DNA, 20 bp, synthetic construct
  misc_feature 1..20: note = CRISPR gRNA sequence
  source 1..20: mol_type = other DNA
cggaggcgggaagggaggga

SEQ ID NO: 98477 - DNA, 20 bp, synthetic construct
  misc_feature 1..20: note = CRISPR gRNA sequence
  source 1..20: mol_type = other DNA
ggaggcgggaagggagggag

SEQ ID NO: 98478 - DNA, 20 bp, synthetic construct
  misc_feature 1..20: note = CRISPR gRNA sequence
  source 1..20: mol_type = other DNA
aggcgggaagggagggaggg

SEQ ID NO: 98479 - DNA, 20 bp, synthetic construct
  misc_feature 1..20: note = CRISPR gRNA sequence
  source 1..20: mol_type = other DNA
ggcgggaagggagggagggg

SEQ ID NO: 98480 - DNA, 20 bp, synthetic construct
  misc_feature 1..20: note = CRISPR gRNA sequence
  source 1..20: mol_type = other DNA
gcgggaagggagggagggga

SEQ ID NO: 98481 - DNA, 20 bp, synthetic construct
  misc_feature 1..20: note = CRISPR gRNA sequence
  source 1..20: mol_type = other DNA
cgggaagggagggaggggag

SEQ ID NO: 98482 - DNA, 20 bp, synthetic construct
  misc_feature 1..20: note = CRISPR gRNA sequence
  source 1..20: mol_type = other DNA
ggaagggagggaggggaggg

SEQ ID NO: 98483 - DNA, 20 bp, synthetic construct
  misc_feature 1..20: note = CRISPR gRNA sequence
  source 1..20: mol_type = other DNA
gggagggaggggaggggagt

SEQ ID NO: 98484 - DNA, 20 bp, synthetic construct
  misc_feature 1..20: note = CRISPR gRNA sequence
  source 1..20: mol_type = other DNA
gaggggaggggagtcagcta

SEQ ID NO: 98485 - DNA, 20 bp, synthetic construct
  misc_feature 1..20: note = CRISPR gRNA sequence
  source 1..20: mol_type = other DNA
aggggaggggagtcagctat

SEQ ID NO: 98486 - DNA, 20 bp, synthetic construct
  misc_feature 1..20: note = CRISPR gRNA sequence
  source 1..20: mol_type = other DNA
ggaggggagtcagctatagg

SEQ ID NO: 98487 - DNA, 20 bp, synthetic construct
  misc_feature 1..20: note = CRISPR gRNA sequence
  source 1..20: mol_type = other DNA
ggggagtcagctataggaag

SEQ ID NO: 98488 - DNA, 20 bp, synthetic construct
  misc_feature 1..20: note = CRISPR gRNA sequence
  source 1..20: mol_type = other DNA
gtcagctataggaagaagtg

SEQ ID NO: 98489 - DNA, 20 bp, synthetic construct
  misc_feature 1..20: note = CRISPR gRNA sequence
  source 1..20: mol_type = other DNA
tcagctataggaagaagtgt

SEQ ID NO: 98490 - DNA, 20 bp, synthetic construct
  misc_feature 1..20: note = CRISPR gRNA sequence
  source 1..20: mol_type = other DNA
gctataggaagaagtgtagg

SEQ ID NO: 98491 - DNA, 20 bp, synthetic construct
  misc_feature 1..20: note = CRISPR gRNA sequence
  source 1..20: mol_type = other DNA
tataggaagaagtgtaggaa

SEQ ID NO: 98492 - DNA, 20 bp, synthetic construct
  misc_feature 1..20: note = CRISPR gRNA sequence
  source 1..20: mol_type = other DNA
gaagtgtaggaagagcattc

SEQ ID NO: 98493 - DNA, 20 bp, synthetic construct
  misc_feature 1..20: note = CRISPR gRNA sequence
  source 1..20: mol_type = other DNA
tgtaggaagagcattccaga

SEQ ID NO: 98494 - DNA, 20 bp, synthetic construct
  misc_feature 1..20: note = CRISPR gRNA sequence
  source 1..20: mol_type = other DNA
gtaggaagagcattccagac

SEQ ID NO: 98495 - DNA, 20 bp, synthetic construct
  misc_feature 1..20: note = CRISPR gRNA sequence
  source 1..20: mol_type = other DNA
aggaagagcattccagacag

SEQ ID NO: 98496 - DNA, 20 bp, synthetic construct
  misc_feature 1..20: note = CRISPR gRNA sequence
  source 1..20: mol_type = other DNA
aagagcattccagacaggag

SEQ ID NO: 98497 - DNA, 20 bp, synthetic construct
  misc_feature 1..20: note = CRISPR gRNA sequence
  source 1..20: mol_type = other DNA
agcattccagacaggagtgg

SEQ ID NO: 98498 - DNA, 20 bp, synthetic construct
  misc_feature 1..20: note = CRISPR gRNA sequence
  source 1..20: mol_type = other DNA
agacaggagtggcagcaaca

SEQ ID NO: 98499 - DNA, 20 bp, synthetic construct
  misc_feature 1..20: note = CRISPR gRNA sequence
  source 1..20: mol_type = other DNA
gacaggagtggcagcaacaa

SEQ ID NO: 98500 - DNA, 20 bp, synthetic construct
  misc_feature 1..20: note = CRISPR gRNA sequence
  source 1..20: mol_type = other DNA
agtggcagcaacaaaggtcg

SEQ ID NO: 98501 - DNA, 20 bp, synthetic construct
  misc_feature 1..20: note = CRISPR gRNA sequence
  source 1..20: mol_type = other DNA
gtggcagcaacaaaggtcgt

SEQ ID NO: 98502 - DNA, 20 bp, synthetic construct
  misc_feature 1..20: note = CRISPR gRNA sequence
  source 1..20: mol_type = other DNA
ggcagcaacaaaggtcgtgg

SEQ ID NO: 98503 - DNA, 20 bp, synthetic construct
  misc_feature 1..20: note = CRISPR gRNA sequence
  source 1..20: mol_type = other DNA
gcagcaacaaaggtcgtggg

SEQ ID NO: 98504 - DNA, 20 bp, synthetic construct
  misc_feature 1..20: note = CRISPR gRNA sequence
  source 1..20: mol_type = other DNA
cagcaacaaaggtcgtggga

SEQ ID NO: 98505 - DNA, 20 bp, synthetic construct
  misc_feature 1..20: note = CRISPR gRNA sequence
  source 1..20: mol_type = other DNA
gtcgtgggagggaactaaat

SEQ ID NO: 98506 - DNA, 20 bp, synthetic construct
  misc_feature 1..20: note = CRISPR gRNA sequence
  source 1..20: mol_type = other DNA
tcgtgggagggaactaaatt

SEQ ID NO: 98507 - DNA, 20 bp, synthetic construct
  misc_feature 1..20: note = CRISPR gRNA sequence
  source 1..20: mol_type = other DNA
aactaaattaggcatattct

SEQ ID NO: 98508 - DNA, 20 bp, synthetic construct
  misc_feature 1..20: note = CRISPR gRNA sequence
  source 1..20: mol_type = other DNA
tccaatcaaaaataaatcct

SEQ ID NO: 98509 - DNA, 20 bp, synthetic construct
  misc_feature 1..20: note = CRISPR gRNA sequence
  source 1..20: mol_type = other DNA
aaaataaatcctcagttcct

SEQ ID NO: 98510 - DNA, 20 bp, synthetic construct
  misc_feature 1..20: note = CRISPR gRNA sequence
  source 1..20: mol_type = other DNA
taaatcctcagttcctcagt

SEQ ID NO: 98511 - DNA, 20 bp, synthetic construct
  misc_feature 1..20: note = CRISPR gRNA sequence
  source 1..20: mol_type = other DNA
cagttcctcagtaagtaaaa

SEQ ID NO: 98512 - DNA, 20 bp, synthetic construct
  misc_feature 1..20: note = CRISPR gRNA sequence
  source 1..20: mol_type = other DNA
agttcctcagtaagtaaaac

SEQ ID NO: 98513 - DNA, 20 bp, synthetic construct
  misc_feature 1..20: note = CRISPR gRNA sequence
  source 1..20: mol_type = other DNA
aacaggatgaccatctgacc

SEQ ID NO: 98514 - DNA, 20 bp, synthetic construct
  misc_feature 1..20: note = CRISPR gRNA sequence
  source 1..20: mol_type = other DNA
tgacccagtaatttcactcc

SEQ ID NO: 98515 - DNA, 20 bp, synthetic construct
  misc_feature 1..20: note = CRISPR gRNA sequence
  source 1..20: mol_type = other DNA
ctcctagctatctaccctca

SEQ ID NO: 98516 - DNA, 20 bp, synthetic construct
  misc_feature 1..20: note = CRISPR gRNA sequence
  source 1..20: mol_type = other DNA
cctagctatctaccctcaaa

SEQ ID NO: 98517 - DNA, 20 bp, synthetic construct
  misc_feature 1..20: note = CRISPR gRNA sequence
  source 1..20: mol_type = other DNA
taccctcaaagagttaaaaa

SEQ ID NO: 98518 - DNA, 20 bp, synthetic construct
  misc_feature 1..20: note = CRISPR gRNA sequence
  source 1..20: mol_type = other DNA
accctcaaagagttaaaaac

SEQ ID NO: 98519 - DNA, 20 bp, synthetic construct
  misc_feature 1..20: note = CRISPR gRNA sequence
  source 1..20: mol_type = other DNA
aagagttaaaaacaggtgtg

SEQ ID NO: 98520 - DNA, 20 bp, synthetic construct
  misc_feature 1..20: note = CRISPR gRNA sequence
  source 1..20: mol_type = other DNA
agagttaaaaacaggtgtga

SEQ ID NO: 98521 - DNA, 20 bp, synthetic construct
  misc_feature 1..20: note = CRISPR gRNA sequence
  source 1..20: mol_type = other DNA
gagttaaaaacaggtgtgaa

SEQ ID NO: 98522 - DNA, 20 bp, synthetic construct
  misc_feature 1..20: note = CRISPR gRNA sequence
  source 1..20: mol_type = other DNA
taaaaacaggtgtgaagggc

SEQ ID NO: 98523 - DNA, 20 bp, synthetic construct
  misc_feature 1..20: note = CRISPR gRNA sequence
  source 1..20: mol_type = other DNA
aaaaacaggtgtgaagggcc

SEQ ID NO: 98524 - DNA, 20 bp, synthetic construct
  misc_feature 1..20: note = CRISPR gRNA sequence
  source 1..20: mol_type = other DNA
gtgtgaagggccgggcactg

SEQ ID NO: 98525 - DNA, 20 bp, synthetic construct
  misc_feature 1..20: note = CRISPR gRNA sequence
  source 1..20: mol_type = other DNA
gtggctcacacctgtaatcc

SEQ ID NO: 98526 - DNA, 20 bp, synthetic construct
  misc_feature 1..20: note = CRISPR gRNA sequence
  source 1..20: mol_type = other DNA
acctgtaatcccagcacttt

SEQ ID NO: 98527 - DNA, 20 bp, synthetic construct
  misc_feature 1..20: note = CRISPR gRNA sequence
  source 1..20: mol_type = other DNA
tgtaatcccagcactttcgg

SEQ ID NO: 98528 - DNA, 20 bp, synthetic construct
  misc_feature 1..20: note = CRISPR gRNA sequence
  source 1..20: mol_type = other DNA
aatcccagcactttcggaag

SEQ ID NO: 98529 - DNA, 20 bp, synthetic construct
  misc_feature 1..20: note = CRISPR gRNA sequence
  source 1..20: mol_type = other DNA
tcccagcactttcggaagtg

SEQ ID NO: 98530 - DNA, 20 bp, synthetic construct
  misc_feature 1..20: note = CRISPR gRNA sequence
  source 1..20: mol_type = other DNA
cccagcactttcggaagtgg

SEQ ID NO: 98531 - DNA, 20 bp, synthetic construct
  misc_feature 1..20: note = CRISPR gRNA sequence
  source 1..20: mol_type = other DNA
ctttcggaagtggaggcctg

SEQ ID NO: 98532 - DNA, 20 bp, synthetic construct
  misc_feature 1..20: note = CRISPR gRNA sequence
  source 1..20: mol_type = other DNA
tggaggcctgcagatcactt

SEQ ID NO: 98533 - DNA, 20 bp, synthetic construct
  misc_feature 1..20: note = CRISPR gRNA sequence
  source 1..20: mol_type = other DNA
gcctgcagatcacttgagcc

SEQ ID NO: 98534 - DNA, 20 bp, synthetic construct
  misc_feature 1..20: note = CRISPR gRNA sequence
  source 1..20: mol_type = other DNA
cctgcagatcacttgagccc

SEQ ID NO: 98535 - DNA, 20 bp, synthetic construct
  misc_feature 1..20: note = CRISPR gRNA sequence
  source 1..20: mol_type = other DNA
tgcagatcacttgagcccag

SEQ ID NO: 98536 - DNA, 20 bp, synthetic construct
  misc_feature 1..20: note = CRISPR gRNA sequence
  source 1..20: mol_type = other DNA
gcagatcacttgagcccagg

SEQ ID NO: 98537 - DNA, 20 bp, synthetic construct
  misc_feature 1..20: note = CRISPR gRNA sequence
  source 1..20: mol_type = other DNA
gatcacttgagcccaggagg

SEQ ID NO: 98538 - DNA, 20 bp, synthetic construct
  misc_feature 1..20: note = CRISPR gRNA sequence
  source 1..20: mol_type = other DNA
tcacttgagcccaggaggtg

SEQ ID NO: 98539 - DNA, 20 bp, synthetic construct
  misc_feature 1..20: note = CRISPR gRNA sequence
  source 1..20: mol_type = other DNA
tgagcccaggaggtggagac

SEQ ID NO: 98540 - DNA, 20 bp, synthetic construct
  misc_feature 1..20: note = CRISPR gRNA sequence
  source 1..20: mol_type = other DNA
cccaaaaaaaaaaaaaaaat

SEQ ID NO: 98541 - DNA, 20 bp, synthetic construct
  misc_feature 1..20: note = CRISPR gRNA sequence
  source 1..20: mol_type = other DNA
aaaaaaaaaaaaaaattagc

SEQ ID NO: 98542 - DNA, 20 bp, synthetic construct
  misc_feature 1..20: note = CRISPR gRNA sequence
  source 1..20: mol_type = other DNA
aaaaaaaaaaaaaattagcc

SEQ ID NO: 98543 - DNA, 20 bp, synthetic construct
  misc_feature 1..20: note = CRISPR gRNA sequence
  source 1..20: mol_type = other DNA
aaaaaaaaattagccaggtg

SEQ ID NO: 98544 - DNA, 20 bp, synthetic construct
  misc_feature 1..20: note = CRISPR gRNA sequence
  source 1..20: mol_type = other DNA
caggtgtggttgcatgccta

SEQ ID NO: 98545 - DNA, 20 bp, synthetic construct
  misc_feature 1..20: note = CRISPR gRNA sequence
  source 1..20: mol_type = other DNA
tggttgcatgcctatagtcc

SEQ ID NO: 98546 - DNA, 20 bp, synthetic construct
  misc_feature 1..20: note = CRISPR gRNA sequence
  source 1..20: mol_type = other DNA
atgcctatagtcccagctcc

SEQ ID NO: 98547 - DNA, 20 bp, synthetic construct
  misc_feature 1..20: note = CRISPR gRNA sequence
  source 1..20: mol_type = other DNA
tgcctatagtcccagctcct

SEQ ID NO: 98548 - DNA, 20 bp, synthetic construct
  misc_feature 1..20: note = CRISPR gRNA sequence
  source 1..20: mol_type = other DNA
gcctatagtcccagctccta

SEQ ID NO: 98549 - DNA, 20 bp, synthetic construct
  misc_feature 1..20: note = CRISPR gRNA sequence
  source 1..20: mol_type = other DNA
ctatagtcccagctcctagg

SEQ ID NO: 98550 - DNA, 20 bp, synthetic construct
  misc_feature 1..20: note = CRISPR gRNA sequence
  source 1..20: mol_type = other DNA
tatagtcccagctcctaggg

SEQ ID NO: 98551 - DNA, 20 bp, synthetic construct
  misc_feature 1..20: note = CRISPR gRNA sequence
  source 1..20: mol_type = other DNA
tcccagctcctagggaggct

SEQ ID NO: 98552 - DNA, 20 bp, synthetic construct
  misc_feature 1..20: note = CRISPR gRNA sequence
  source 1..20: mol_type = other DNA
ctcctagggaggctgagtga

SEQ ID NO: 98553 - DNA, 20 bp, synthetic construct
  misc_feature 1..20: note = CRISPR gRNA sequence
  source 1..20: mol_type = other DNA
gggaggctgagtgatggctt

SEQ ID NO: 98554 - DNA, 20 bp, synthetic construct
  misc_feature 1..20: note = CRISPR gRNA sequence
  source 1..20: mol_type = other DNA
gctgagtgatggcttcagcc

SEQ ID NO: 98555 - DNA, 20 bp, synthetic construct
  misc_feature 1..20: note = CRISPR gRNA sequence
  source 1..20: mol_type = other DNA
ctgagtgatggcttcagccc

SEQ ID NO: 98556 - DNA, 20 bp, synthetic construct
  misc_feature 1..20: note = CRISPR gRNA sequence
  source 1..20: mol_type = other DNA
agtgatggcttcagcccagg

SEQ ID NO: 98557 - DNA, 20 bp, synthetic construct
  misc_feature 1..20: note = CRISPR gRNA sequence
  source 1..20: mol_type = other DNA
tggcttcagcccaggaagtt

SEQ ID NO: 98558 - DNA, 20 bp, synthetic construct
  misc_feature 1..20: note = CRISPR gRNA sequence
  source 1..20: mol_type = other DNA
ggcttcagcccaggaagttg

SEQ ID NO: 98559 - DNA, 20 bp, synthetic construct
  misc_feature 1..20: note = CRISPR gRNA sequence
  source 1..20: mol_type = other DNA
agcccaggaagttgaggctg

SEQ ID NO: 98560 - DNA, 20 bp, synthetic construct
  misc_feature 1..20: note = CRISPR gRNA sequence
  source 1..20: mol_type = other DNA
atgattgcatcactgcactc

SEQ ID NO: 98561 - DNA, 20 bp, synthetic construct
  misc_feature 1..20: note = CRISPR gRNA sequence
  source 1..20: mol_type = other DNA
gcatcactgcactccagcct

SEQ ID NO: 98562 - DNA, 20 bp, synthetic construct
  misc_feature 1..20: note = CRISPR gRNA sequence
  source 1..20: mol_type = other DNA
ctgcactccagccttagtaa

SEQ ID NO: 98563 - DNA, 20 bp, synthetic construct
  misc_feature 1..20: note = CRISPR gRNA sequence
  source 1..20: mol_type = other DNA
gcactccagccttagtaaca

SEQ ID NO: 98564 - DNA, 20 bp, synthetic construct
  misc_feature 1..20: note = CRISPR gRNA sequence
  source 1..20: mol_type = other DNA
tccagccttagtaacagagc

SEQ ID NO: 98565 - DNA, 20 bp, synthetic construct
  misc_feature 1..20: note = CRISPR gRNA sequence
  source 1..20: mol_type = other DNA
cctgtatcaaaaaacaaaaa

SEQ ID NO: 98566 - DNA, 20 bp, synthetic construct
  misc_feature 1..20: note = CRISPR gRNA sequence
  source 1..20: mol_type = other DNA
ctgtatcaaaaaacaaaaac

SEQ ID NO: 98567 - DNA, 20 bp, synthetic construct
  misc_feature 1..20: note = CRISPR gRNA sequence
  source 1..20: mol_type = other DNA
atcaaaaaacaaaaacaggc

SEQ ID NO: 98568 - DNA, 20 bp, synthetic construct
  misc_feature 1..20: note = CRISPR gRNA sequence
  source 1..20: mol_type = other DNA
tcaaaaaacaaaaacaggcc

SEQ ID NO: 98569 - DNA, 20 bp, synthetic construct
  misc_feature 1..20: note = CRISPR gRNA sequence
  source 1..20: mol_type = other DNA
aaacaaaaacaggccgggca

SEQ ID NO: 98570 - DNA, 20 bp, synthetic construct
  misc_feature 1..20: note = CRISPR gRNA sequence
  source 1..20: mol_type = other DNA
caaaaacaggccgggcacag

SEQ ID NO: 98571 - DNA, 20 bp, synthetic construct
  misc_feature 1..20: note = CRISPR gRNA sequence
  source 1..20: mol_type = other DNA
gtggctcatgcctgtaatcc

SEQ ID NO: 98572 - DNA, 20 bp, synthetic construct
  misc_feature 1..20: note = CRISPR gRNA sequence
  source 1..20: mol_type = other DNA
tgcctgtaatcccagcactt

SEQ ID NO: 98573 - DNA, 20 bp, synthetic construct
  misc_feature 1..20: note = CRISPR gRNA sequence
  source 1..20: mol_type = other DNA
gcctgtaatcccagcacttt

SEQ ID NO: 98574 - DNA, 20 bp, synthetic construct
  misc_feature 1..20: note = CRISPR gRNA sequence
  source 1..20: mol_type = other DNA
ctgtaatcccagcactttgg

SEQ ID NO: 98575 - DNA, 20 bp, synthetic construct
  misc_feature 1..20: note = CRISPR gRNA sequence
  source 1..20: mol_type = other DNA
tgtaatcccagcactttggg

SEQ ID NO: 98576 - DNA, 20 bp, synthetic construct
  misc_feature 1..20: note = CRISPR gRNA sequence
  source 1..20: mol_type = other DNA
tcccagcactttgggaggcc

SEQ ID NO: 98577 - DNA, 20 bp, synthetic construct
  misc_feature 1..20: note = CRISPR gRNA sequence
  source 1..20: mol_type = other DNA
cccagcactttgggaggccg

SEQ ID NO: 98578 - DNA, 20 bp, synthetic construct
  misc_feature 1..20: note = CRISPR gRNA sequence
  source 1..20: mol_type = other DNA
agcactttgggaggccgagg

SEQ ID NO: 98579 - DNA, 20 bp, synthetic construct
  misc_feature 1..20: note = CRISPR gRNA sequence
  source 1..20: mol_type = other DNA
gcactttgggaggccgaggt

SEQ ID NO: 98580 - DNA, 20 bp, synthetic construct
  misc_feature 1..20: note = CRISPR gRNA sequence
  source 1..20: mol_type = other DNA
ctttgggaggccgaggtggg

SEQ ID NO: 98581 - DNA, 20 bp, synthetic construct
  misc_feature 1..20: note = CRISPR gRNA sequence
  source 1..20: mol_type = other DNA
ccgaggtgggcggatcacct

SEQ ID NO: 98582 - DNA, 20 bp, synthetic construct
  misc_feature 1..20: note = CRISPR gRNA sequence
  source 1..20: mol_type = other DNA
cgaggtgggcggatcacctg

SEQ ID NO: 98583 - DNA, 20 bp, synthetic construct
  misc_feature 1..20: note = CRISPR gRNA sequence
  source 1..20: mol_type = other DNA
gtgggcggatcacctgaggt

SEQ ID NO: 98584 - DNA, 20 bp, synthetic construct
  misc_feature 1..20: note = CRISPR gRNA sequence
  source 1..20: mol_type = other DNA
tgggcggatcacctgaggtc

SEQ ID NO: 98585 - DNA, 20 bp, synthetic construct
  misc_feature 1..20: note = CRISPR gRNA sequence
  source 1..20: mol_type = other DNA
ggcggatcacctgaggtcag

SEQ ID NO: 98586 - DNA, 20 bp, synthetic construct
  misc_feature 1..20: note = CRISPR gRNA sequence
  source 1..20: mol_type = other DNA
tcacctgaggtcaggagttc

SEQ ID NO: 98587 - DNA, 20 bp, synthetic construct
  misc_feature 1..20: note = CRISPR gRNA sequence
  source 1..20: mol_type = other DNA
tgaggtcaggagttcaagac

SEQ ID NO: 98588 - DNA, 20 bp, synthetic construct
  misc_feature 1..20: note = CRISPR gRNA sequence
  source 1..20: mol_type = other DNA
tcaggagttcaagaccagcc

SEQ ID NO: 98589 - DNA, 20 bp, synthetic construct
  misc_feature 1..20: note = CRISPR gRNA sequence
  source 1..20: mol_type = other DNA
caagaccagcctggccaaca

SEQ ID NO: 98590 - DNA, 20 bp, synthetic construct
  misc_feature 1..20: note = CRISPR gRNA sequence
  source 1..20: mol_type = other DNA
actaaaaatacccaaaaaat

SEQ ID NO: 98591 - DNA, 20 bp, synthetic construct
  misc_feature 1..20: note = CRISPR gRNA sequence
  source 1..20: mol_type = other DNA
aaaatacccaaaaaattagc

SEQ ID NO: 98592 - DNA, 20 bp, synthetic construct
  misc_feature 1..20: note = CRISPR gRNA sequence
  source 1..20: mol_type = other DNA
aaatacccaaaaaattagct

SEQ ID NO: 98593 - DNA, 20 bp, synthetic construct
  misc_feature 1..20: note = CRISPR gRNA sequence
  source 1..20: mol_type = other DNA
cccaaaaaattagctgggcg

SEQ ID NO: 98594 - DNA, 20 bp, synthetic construct
  misc_feature 1..20: note = CRISPR gRNA sequence
  source 1..20: mol_type = other DNA
aaaaaattagctgggcgtag

SEQ ID NO: 98595 - DNA, 20 bp, synthetic construct
  misc_feature 1..20: note = CRISPR gRNA sequence
  source 1..20: mol_type = other DNA
aaattagctgggcgtagtgg

SEQ ID NO: 98596 - DNA, 20 bp, synthetic construct
  misc_feature 1..20: note = CRISPR gRNA sequence
  source 1..20: mol_type = other DNA
ttagctgggcgtagtggcgg

SEQ ID NO: 98597 - DNA, 20 bp, synthetic construct
  misc_feature 1..20: note = CRISPR gRNA sequence
  source 1..20: mol_type = other DNA
gtggcggaagcctgtaatcc

SEQ ID NO: 98598 - DNA, 20 bp, synthetic construct
  misc_feature 1..20: note = CRISPR gRNA sequence
  source 1..20: mol_type = other DNA
agcctgtaatcccagctact

SEQ ID NO: 98599 - DNA, 20 bp, synthetic construct
  misc_feature 1..20: note = CRISPR gRNA sequence
  source 1..20: mol_type = other DNA
gcctgtaatcccagctactc

SEQ ID NO: 98600 - DNA, 20 bp, synthetic construct
  misc_feature 1..20: note = CRISPR gRNA sequence
  source 1..20: mol_type = other DNA
ctgtaatcccagctactcag

SEQ ID NO: 98601 - DNA, 20 bp, synthetic construct
  misc_feature 1..20: note = CRISPR gRNA sequence
  source 1..20: mol_type = other DNA
tgtaatcccagctactcagg

SEQ ID NO: 98602 - DNA, 20 bp, synthetic construct
  misc_feature 1..20: note = CRISPR gRNA sequence
  source 1..20: mol_type = other DNA
tcccagctactcaggaggct

SEQ ID NO: 98603 - DNA, 20 bp, synthetic construct
  misc_feature 1..20: note = CRISPR gRNA sequence
  source 1..20: mol_type = other DNA
agctactcaggaggctgaga

SEQ ID NO: 98604 - DNA, 20 bp, synthetic construct
  misc_feature 1..20: note = CRISPR gRNA sequence
  source 1..20: mol_type = other DNA
gctactcaggaggctgagac

SEQ ID NO: 98605 - DNA, 20 bp, synthetic construct
  misc_feature 1..20: note = CRISPR gRNA sequence
  source 1..20: mol_type = other DNA
tactcaggaggctgagacag

SEQ ID NO: 98606 - DNA, 20 bp, synthetic construct
  misc_feature 1..20: note = CRISPR gRNA sequence
  source 1..20: mol_type = other DNA
ggaggctgagacaggagaat

SEQ ID NO: 98607 - DNA, 20 bp, synthetic construct
  misc_feature 1..20: note = CRISPR gRNA sequence
  source 1..20: mol_type = other DNA
acaggagaatcagttgaacc

SEQ ID NO: 98608 - DNA, 20 bp, synthetic construct
  misc_feature 1..20: note = CRISPR gRNA sequence
  source 1..20: mol_type = other DNA
caggagaatcagttgaaccc

SEQ ID NO: 98609 - DNA, 20 bp, synthetic construct
  misc_feature 1..20: note = CRISPR gRNA sequence
  source 1..20: mol_type = other DNA
ggagaatcagttgaacccag

SEQ ID NO: 98610 - DNA, 20 bp, synthetic construct
  misc_feature 1..20: note = CRISPR gRNA sequence
  source 1..20: mol_type = other DNA
gagaatcagttgaacccagg

SEQ ID NO: 98611 - DNA, 20 bp, synthetic construct
  misc_feature 1..20: note = CRISPR gRNA sequence
  source 1..20: mol_type = other DNA
aatcagttgaacccaggagg

SEQ ID NO: 98612 - DNA, 20 bp, synthetic construct
  misc_feature 1..20: note = CRISPR gRNA sequence
  source 1..20: mol_type = other DNA
tcagttgaacccaggaggca

SEQ ID NO: 98613 - DNA, 20 bp, synthetic construct
  misc_feature 1..20: note = CRISPR gRNA sequence
  source 1..20: mol_type = other DNA
cagttgaacccaggaggcag

SEQ ID NO: 98614 - DNA, 20 bp, synthetic construct
  misc_feature 1..20: note = CRISPR gRNA sequence
  source 1..20: mol_type = other DNA
aacccaggaggcagaggttg

SEQ ID NO: 98615 - DNA, 20 bp, synthetic construct
  misc_feature 1..20: note = CRISPR gRNA sequence
  source 1..20: mol_type = other DNA
caggaggcagaggttgcagt

SEQ ID NO: 98616 - DNA, 20 bp, synthetic construct
  misc_feature 1..20: note = CRISPR gRNA sequence
  source 1..20: mol_type = other DNA
ggcagaggttgcagtgagct

SEQ ID NO: 98617 - DNA, 20 bp, synthetic construct
  misc_feature 1..20: note = CRISPR gRNA sequence
  source 1..20: mol_type = other DNA
gagatcacgccattgcactc

SEQ ID NO: 98618 - DNA, 20 bp, synthetic construct
  misc_feature 1..20: note = CRISPR gRNA sequence
  source 1..20: mol_type = other DNA
cacgccattgcactccagca

SEQ ID NO: 98619 - DNA, 20 bp, synthetic construct
  misc_feature 1..20: note = CRISPR gRNA sequence
  source 1..20: mol_type = other DNA
acgccattgcactccagcat

SEQ ID NO: 98620 - DNA, 20 bp, synthetic construct
  misc_feature 1..20: note = CRISPR gRNA sequence
  source 1..20: mol_type = other DNA
tgcactccagcatgggcaac

SEQ ID NO: 98621 - DNA, 20 bp, synthetic construct
  misc_feature 1..20: note = CRISPR gRNA sequence
  source 1..20: mol_type = other DNA
cactccagcatgggcaacaa

SEQ ID NO: 98622 - DNA, 20 bp, synthetic construct
  misc_feature 1..20: note = CRISPR gRNA sequence
  source 1..20: mol_type = other DNA
acaaaacaaaacaaaaacga

SEQ ID NO: 98623 - DNA, 20 bp, synthetic construct
  misc_feature 1..20: note = CRISPR gRNA sequence
  source 1..20: mol_type = other DNA
aacaaaacaaaaacgaaagc

SEQ ID NO: 98624 - DNA, 20 bp, synthetic construct
  misc_feature 1..20: note = CRISPR gRNA sequence
  source 1..20: mol_type = other DNA
acaaaaacgaaagcaagaca

SEQ ID NO: 98625 - DNA, 20 bp, synthetic construct
  misc_feature 1..20: note = CRISPR gRNA sequence
  source 1..20: mol_type = other DNA
caaaaacgaaagcaagacac

SEQ ID NO: 98626 - DNA, 20 bp, synthetic construct
  misc_feature 1..20: note = CRISPR gRNA sequence
  source 1..20: mol_type = other DNA
gcaagacacaggttccatgt

SEQ ID NO: 98627 - DNA, 20 bp, synthetic construct
  misc_feature 1..20: note = CRISPR gRNA sequence
  source 1..20: mol_type = other DNA
caagacacaggttccatgtg

SEQ ID NO: 98628 - DNA, 20 bp, synthetic construct
  misc_feature 1..20: note = CRISPR gRNA sequence
  source 1..20: mol_type = other DNA
ggcctgacattccatcatca

SEQ ID NO: 98629 - DNA, 20 bp, synthetic construct
  misc_feature 1..20: note = CRISPR gRNA sequence
  source 1..20: mol_type = other DNA
attccatcatcatggaatcc

SEQ ID NO: 98630 - DNA, 20 bp, synthetic construct
  misc_feature 1..20: note = CRISPR gRNA sequence
  source 1..20: mol_type = other DNA
tccatcatcatggaatccca

SEQ ID NO: 98631 - DNA, 20 bp, synthetic construct
  misc_feature 1..20: note = CRISPR gRNA sequence
  source 1..20: mol_type = other DNA
ccatcatcatggaatcccag

SEQ ID NO: 98632 - DNA, 20 bp, synthetic construct
  misc_feature 1..20: note = CRISPR gRNA sequence
  source 1..20: mol_type = other DNA
catcatcatggaatcccaga

SEQ ID NO: 98633 - DNA, 20 bp, synthetic construct
  misc_feature 1..20: note = CRISPR gRNA sequence
  source 1..20: mol_type = other DNA
gaatcccagagggctaatcc

SEQ ID NO: 98634 - DNA, 20 bp, synthetic construct
  misc_feature 1..20: note = CRISPR gRNA sequence
  source 1..20: mol_type = other DNA
atcccagagggctaatccca

SEQ ID NO: 98635 - DNA, 20 bp, synthetic construct
  misc_feature 1..20: note = CRISPR gRNA sequence
  source 1..20: mol_type = other DNA
tcccagagggctaatcccag

SEQ ID NO: 98636 - DNA, 20 bp, synthetic construct
  misc_feature 1..20: note = CRISPR gRNA sequence
  source 1..20: mol_type = other DNA
ccagagggctaatcccagag

SEQ ID NO: 98637 - DNA, 20 bp, synthetic construct
  misc_feature 1..20: note = CRISPR gRNA sequence
  source 1..20: mol_type = other DNA
cagagggctaatcccagagg

SEQ ID NO: 98638 - DNA, 20 bp, synthetic construct
  misc_feature 1..20: note = CRISPR gRNA sequence
  source 1..20: mol_type = other DNA
agaggaggtatcctaccctg

SEQ ID NO: 98639 - DNA, 20 bp, synthetic construct
  misc_feature 1..20: note = CRISPR gRNA sequence
  source 1..20: mol_type = other DNA
aggaggtatcctaccctgtg

SEQ ID NO: 98640 - DNA, 20 bp, synthetic construct
  misc_feature 1..20: note = CRISPR gRNA sequence
  source 1..20: mol_type = other DNA
gaggtatcctaccctgtgga

SEQ ID NO: 98641 - DNA, 20 bp, synthetic construct
  misc_feature 1..20: note = CRISPR gRNA sequence
  source 1..20: mol_type = other DNA
aggtatcctaccctgtggag

SEQ ID NO: 98642 - DNA, 20 bp, synthetic construct
  misc_feature 1..20: note = CRISPR gRNA sequence
  source 1..20: mol_type = other DNA
accctgtggagaggaaacac

SEQ ID NO: 98643 - DNA, 20 bp, synthetic construct
  misc_feature 1..20: note = CRISPR gRNA sequence
  source 1..20: mol_type = other DNA
ggagaggaaacactggcatc

SEQ ID NO: 98644 - DNA, 20 bp, synthetic construct
  misc_feature 1..20: note = CRISPR gRNA sequence
  source 1..20: mol_type = other DNA
aacactggcatccggttgtg

SEQ ID NO: 98645 - DNA, 20 bp, synthetic construct
  misc_feature 1..20: note = CRISPR gRNA sequence
  source 1..20: mol_type = other DNA
acactggcatccggttgtgc

SEQ ID NO: 98646 - DNA, 20 bp, synthetic construct
  misc_feature 1..20: note = CRISPR gRNA sequence
  source 1..20: mol_type = other DNA
cactggcatccggttgtgca

SEQ ID NO: 98647 - DNA, 20 bp, synthetic construct
  misc_feature 1..20: note = CRISPR gRNA sequence
  source 1..20: mol_type = other DNA
ggcatccggttgtgcaggga

SEQ ID NO: 98648 - DNA, 20 bp, synthetic construct
  misc_feature 1..20: note = CRISPR gRNA sequence
  source 1..20: mol_type = other DNA
catccggttgtgcagggaaa

SEQ ID NO: 98649 - DNA, 20 bp, synthetic construct
  misc_feature 1..20: note = CRISPR gRNA sequence
  source 1..20: mol_type = other DNA
gttgtgcagggaaagagact

SEQ ID NO: 98650 - DNA, 20 bp, synthetic construct
  misc_feature 1..20: note = CRISPR gRNA sequence
  source 1..20: mol_type = other DNA
ttgtgcagggaaagagactg

SEQ ID NO: 98651 - DNA, 20 bp, synthetic construct
  misc_feature 1..20: note = CRISPR gRNA sequence
  source 1..20: mol_type = other DNA
gggaaagagactgaggacca

SEQ ID NO: 98652 - DNA, 20 bp, synthetic construct
  misc_feature 1..20: note = CRISPR gRNA sequence
  source 1..20: mol_type = other DNA
gactgaggaccacagtgtct

SEQ ID NO: 98653 - DNA, 20 bp, synthetic construct
  misc_feature 1..20: note = CRISPR gRNA sequence
  source 1..20: mol_type = other DNA
cacagtgtctgagccatctg

SEQ ID NO: 98654 - DNA, 20 bp, synthetic construct
  misc_feature 1..20: note = CRISPR gRNA sequence
  source 1..20: mol_type = other DNA
gccatctgcagcctcctctc

SEQ ID NO: 98655 - DNA, 20 bp, synthetic construct
  misc_feature 1..20: note = CRISPR gRNA sequence
  source 1..20: mol_type = other DNA
ccatctgcagcctcctctcc

SEQ ID NO: 98656 - DNA, 20 bp, synthetic construct
  misc_feature 1..20: note = CRISPR gRNA sequence
  source 1..20: mol_type = other DNA
catctgcagcctcctctccg

SEQ ID NO: 98657 - DNA, 20 bp, synthetic construct
  misc_feature 1..20: note = CRISPR gRNA sequence
  source 1..20: mol_type = other DNA
agcctcctctccggggtctt

SEQ ID NO: 98658 - DNA, 20 bp, synthetic construct
  misc_feature 1..20: note = CRISPR gRNA sequence
  source 1..20: mol_type = other DNA
gcctcctctccggggtcttc

SEQ ID NO: 98659 - DNA, 20 bp, synthetic construct
  misc_feature 1..20: note = CRISPR gRNA sequence
  source 1..20: mol_type = other DNA
cctcctctccggggtcttca

SEQ ID NO: 98660 - DNA, 20 bp, synthetic construct
  misc_feature 1..20: note = CRISPR gRNA sequence
  source 1..20: mol_type = other DNA
ccggggtcttcagggtcccc

SEQ ID NO: 98661 - DNA, 20 bp, synthetic construct
  misc_feature 1..20: note = CRISPR gRNA sequence
  source 1..20: mol_type = other DNA
cttcagggtccccaagttct

SEQ ID NO: 98662 - DNA, 20 bp, synthetic construct
  misc_feature 1..20: note = CRISPR gRNA sequence
  source 1..20: mol_type = other DNA
ttcagggtccccaagttctg

SEQ ID NO: 98663 - DNA, 20 bp, synthetic construct
  misc_feature 1..20: note = CRISPR gRNA sequence
  source 1..20: mol_type = other DNA
agggtccccaagttctgagg

SEQ ID NO: 98664 - DNA, 20 bp, synthetic construct
  misc_feature 1..20: note = CRISPR gRNA sequence
  source 1..20: mol_type = other DNA
gggtccccaagttctgaggc

SEQ ID NO: 98665 - DNA, 20 bp, synthetic construct
  misc_feature 1..20: note = CRISPR gRNA sequence
  source 1..20: mol_type = other DNA
ggtccccaagttctgaggca

SEQ ID NO: 98666 - DNA, 20 bp, synthetic construct
  misc_feature 1..20: note = CRISPR gRNA sequence
  source 1..20: mol_type = other DNA
gtccccaagttctgaggcag

SEQ ID NO: 98667 - DNA, 20 bp, synthetic construct
  misc_feature 1..20: note = CRISPR gRNA sequence
  source 1..20: mol_type = other DNA
gttctgaggcaggggtctgc

SEQ ID NO: 98668 - DNA, 20 bp, synthetic construct
  misc_feature 1..20: note = CRISPR gRNA sequence
  source 1..20: mol_type = other DNA
ttctgaggcaggggtctgct

SEQ ID NO: 98669 - DNA, 20 bp, synthetic construct
  misc_feature 1..20: note = CRISPR gRNA sequence
  source 1..20: mol_type = other DNA
aggcaggggtctgctgggtc

SEQ ID NO: 98670 - DNA, 20 bp, synthetic construct
  misc_feature 1..20: note = CRISPR gRNA sequence
  source 1..20: mol_type = other DNA
ggggtctgctgggtctggat

SEQ ID NO: 98671 - DNA, 20 bp, synthetic construct
  misc_feature 1..20: note = CRISPR gRNA sequence
  source 1..20: mol_type = other DNA
gggtctgctgggtctggatg

SEQ ID NO: 98672 - DNA, 20 bp, synthetic construct
  misc_feature 1..20: note = CRISPR gRNA sequence
  source 1..20: mol_type = other DNA
ggtctggatgaggtcttctg

SEQ ID NO: 98673 - DNA, 20 bp, synthetic construct
  misc_feature 1..20: note = CRISPR gRNA sequence
  source 1..20: mol_type = other DNA
gtctggatgaggtcttctgc

SEQ ID NO: 98674 - DNA, 20 bp, synthetic construct
  misc_feature 1..20: note = CRISPR gRNA sequence
  source 1..20: mol_type = other DNA
ggatgaggtcttctgcaggc

SEQ ID NO: 98675 - DNA, 20 bp, synthetic construct
  misc_feature 1..20: note = CRISPR gRNA sequence
  source 1..20: mol_type = other DNA
gatgaggtcttctgcaggct

SEQ ID NO: 98676 - DNA, 20 bp, synthetic construct
  misc_feature 1..20: note = CRISPR gRNA sequence
  source 1..20: mol_type = other DNA
aggtcttctgcaggctgggt

SEQ ID NO: 98677 - DNA, 20 bp, synthetic construct
  misc_feature 1..20: note = CRISPR gRNA sequence
  source 1..20: mol_type = other DNA
tgcaggctgggtaagctcca

SEQ ID NO: 98678 - DNA, 20 bp, synthetic construct
  misc_feature 1..20: note = CRISPR gRNA sequence
  source 1..20: mol_type = other DNA
gcaggctgggtaagctccat

SEQ ID NO: 98679 - DNA, 20 bp, synthetic construct
  misc_feature 1..20: note = CRISPR gRNA sequence
  source 1..20: mol_type = other DNA
caggctgggtaagctccatg

SEQ ID NO: 98680 - DNA, 20 bp, synthetic construct
  misc_feature 1..20: note = CRISPR gRNA sequence
  source 1..20: mol_type = other DNA
ctgggtaagctccatgggga

SEQ ID NO: 98681 - DNA, 20 bp, synthetic construct
  misc_feature 1..20: note = CRISPR gRNA sequence
  source 1..20: mol_type = other DNA
gtaagctccatggggaaagc

SEQ ID NO: 98682 - DNA, 20 bp, synthetic construct
  misc_feature 1..20: note = CRISPR gRNA sequence
  source 1..20: mol_type = other DNA
agctccatggggaaagctgg

SEQ ID NO: 98683 - DNA, 20 bp, synthetic construct
  misc_feature 1..20: note = CRISPR gRNA sequence
  source 1..20: mol_type = other DNA
ctccatggggaaagctggcg

SEQ ID NO: 98684 - DNA, 20 bp, synthetic construct
  misc_feature 1..20: note = CRISPR gRNA sequence
  source 1..20: mol_type = other DNA
tccatggggaaagctggcgg

SEQ ID NO: 98685 - DNA, 20 bp, synthetic construct
  misc_feature 1..20: note = CRISPR gRNA sequence
  source 1..20: mol_type = other DNA
gggaaagctggcggaggtgt

SEQ ID NO: 98686 - DNA, 20 bp, synthetic construct
  misc_feature 1..20: note = CRISPR gRNA sequence
  source 1..20: mol_type = other DNA
aaagctggcggaggtgtcag

SEQ ID NO: 98687 - DNA, 20 bp, synthetic construct
  misc_feature 1..20: note = CRISPR gRNA sequence
  source 1..20: mol_type = other DNA
aagctggcggaggtgtcaga

SEQ ID NO: 98688 - DNA, 20 bp, synthetic construct
  misc_feature 1..20: note = CRISPR gRNA sequence
  source 1..20: mol_type = other DNA
agctggcggaggtgtcagaa

SEQ ID NO: 98689 - DNA, 20 bp, synthetic construct
  misc_feature 1..20: note = CRISPR gRNA sequence
  source 1..20: mol_type = other DNA
gctggcggaggtgtcagaag

SEQ ID NO: 98690 - DNA, 20 bp, synthetic construct
  misc_feature 1..20: note = CRISPR gRNA sequence
  source 1..20: mol_type = other DNA
tggcggaggtgtcagaaggg

SEQ ID NO: 98691 - DNA, 20 bp, synthetic construct
  misc_feature 1..20: note = CRISPR gRNA sequence
  source 1..20: mol_type = other DNA
gcggaggtgtcagaagggga

SEQ ID NO: 98692 - DNA, 20 bp, synthetic construct
  misc_feature 1..20: note = CRISPR gRNA sequence
  source 1..20: mol_type = other DNA
gagatgacaataattatcaa

SEQ ID NO: 98693 - DNA, 20 bp, synthetic construct
  misc_feature 1..20: note = CRISPR gRNA sequence
  source 1..20: mol_type = other DNA
aattatcaacagttataata

SEQ ID NO: 98694 - DNA, 20 bp, synthetic construct
  misc_feature 1..20: note = CRISPR gRNA sequence
  source 1..20: mol_type = other DNA
tatcaacagttataataaag

SEQ ID NO: 98695 - DNA, 20 bp, synthetic construct
  misc_feature 1..20: note = CRISPR gRNA sequence
  source 1..20: mol_type = other DNA
atcaacagttataataaagt

SEQ ID NO: 98696 - DNA, 20 bp, synthetic construct
  misc_feature 1..20: note = CRISPR gRNA sequence
  source 1..20: mol_type = other DNA
gtaggcaccgactgcatacc

SEQ ID NO: 98697 - DNA, 20 bp, synthetic construct
  misc_feature 1..20: note = CRISPR gRNA sequence
  source 1..20: mol_type = other DNA
catacctagccttgcactgt

SEQ ID NO: 98698 - DNA, 20 bp, synthetic construct
  misc_feature 1..20: note = CRISPR gRNA sequence
  source 1..20: mol_type = other DNA
atacctagccttgcactgtg

SEQ ID NO: 98699 - DNA, 20 bp, synthetic construct
  misc_feature 1..20: note = CRISPR gRNA sequence
  source 1..20: mol_type = other DNA
tacctagccttgcactgtga

SEQ ID NO: 98700 - DNA, 20 bp, synthetic construct
  misc_feature 1..20: note = CRISPR gRNA sequence
  source 1..20: mol_type = other DNA
ctagccttgcactgtgaggg

SEQ ID NO: 98701 - DNA, 20 bp, synthetic construct
  misc_feature 1..20: note = CRISPR gRNA sequence
  source 1..20: mol_type = other DNA
tagccttgcactgtgagggt

SEQ ID NO: 98702 - DNA, 20 bp, synthetic construct
  misc_feature 1..20: note = CRISPR gRNA sequence
  source 1..20: mol_type = other DNA
actgtgagggtgggtaaact

SEQ ID NO: 98703 - DNA, 20 bp, synthetic construct
  misc_feature 1..20: note = CRISPR gRNA sequence
  source 1..20: mol_type = other DNA
ctgtgagggtgggtaaactg

SEQ ID NO: 98704 - DNA, 20 bp, synthetic construct
  misc_feature 1..20: note = CRISPR gRNA sequence
  source 1..20: mol_type = other DNA
agggtgggtaaactgaggtc

SEQ ID NO: 98705 - DNA, 20 bp, synthetic construct
  misc_feature 1..20: note = CRISPR gRNA sequence
  source 1..20: mol_type = other DNA
gggtgggtaaactgaggtcc

SEQ ID NO: 98706 - DNA, 20 bp, synthetic construct
  misc_feature 1..20: note = CRISPR gRNA sequence
  source 1..20: mol_type = other DNA
ctgaggtccaggttaattac

SEQ ID NO: 98707 - DNA, 20 bp, synthetic construct
  misc_feature 1..20: note = CRISPR gRNA sequence
  source 1..20: mol_type = other DNA
gaggtccaggttaattacca

SEQ ID NO: 98708 - DNA, 20 bp, synthetic construct
  misc_feature 1..20: note = CRISPR gRNA sequence
  source 1..20: mol_type = other DNA
tccaggttaattaccagagc

SEQ ID NO: 98709 - DNA, 20 bp, synthetic construct
  misc_feature 1..20: note = CRISPR gRNA sequence
  source 1..20: mol_type = other DNA
ccaggttaattaccagagcc

SEQ ID NO: 98710 - DNA, 20 bp, synthetic construct
  misc_feature 1..20: note = CRISPR gRNA sequence
  source 1..20: mol_type = other DNA
caggttaattaccagagcca

SEQ ID NO: 98711 - DNA, 20 bp, synthetic construct
  misc_feature 1..20: note = CRISPR gRNA sequence
  source 1..20: mol_type = other DNA
agagccagggaaatgaaaac

SEQ ID NO: 98712 - DNA, 20 bp, synthetic construct
  misc_feature 1..20: note = CRISPR gRNA sequence
  source 1..20: mol_type = other DNA
agccagggaaatgaaaacca

SEQ ID NO: 98713 - DNA, 20 bp, synthetic construct
  misc_feature 1..20: note = CRISPR gRNA sequence
  source 1..20: mol_type = other DNA
accagagtccaactgctttc

SEQ ID NO: 98714 - DNA, 20 bp, synthetic construct
  misc_feature 1..20: note = CRISPR gRNA sequence
  source 1..20: mol_type = other DNA
ccagagtccaactgctttcg

SEQ ID NO: 98715 - DNA, 20 bp, synthetic construct
  misc_feature 1..20: note = CRISPR gRNA sequence
  source 1..20: mol_type = other DNA
tctaccattccccaccacca

SEQ ID NO: 98716 - DNA, 20 bp, synthetic construct
  misc_feature 1..20: note = CRISPR gRNA sequence
  source 1..20: mol_type = other DNA
acctacaatgtgcaatgttt

SEQ ID NO: 98717 - DNA, 20 bp, synthetic construct
  misc_feature 1..20: note = CRISPR gRNA sequence
  source 1..20: mol_type = other DNA
ctacaatgtgcaatgtttaa

SEQ ID NO: 98718 - DNA, 20 bp, synthetic construct
  misc_feature 1..20: note = CRISPR gRNA sequence
  source 1..20: mol_type = other DNA
atgtgcaatgtttaagagcc

SEQ ID NO: 98719 - DNA, 20 bp, synthetic construct
  misc_feature 1..20: note = CRISPR gRNA sequence
  source 1..20: mol_type = other DNA
tgtgcaatgtttaagagcct

SEQ ID NO: 98720 - DNA, 20 bp, synthetic construct
  misc_feature 1..20: note = CRISPR gRNA sequence
  source 1..20: mol_type = other DNA
atgtttaagagcctgggctc

SEQ ID NO: 98721 - DNA, 20 bp, synthetic construct
  misc_feature 1..20: note = CRISPR gRNA sequence
  source 1..20: mol_type = other DNA
tttaagagcctgggctctgg

SEQ ID NO: 98722 - DNA, 20 bp, synthetic construct
  misc_feature 1..20: note = CRISPR gRNA sequence
  source 1..20: mol_type = other DNA
ttaagagcctgggctctggc

SEQ ID NO: 98723 - DNA, 20 bp, synthetic construct
  misc_feature 1..20: note = CRISPR gRNA sequence
  source 1..20: mol_type = other DNA
taagagcctgggctctggca

SEQ ID NO: 98724 - DNA, 20 bp, synthetic construct
  misc_feature 1..20: note = CRISPR gRNA sequence
  source 1..20: mol_type = other DNA
gcctgggctctggcagggca

SEQ ID NO: 98725 - DNA, 20 bp, synthetic construct
  misc_feature 1..20: note = CRISPR gRNA sequence
  source 1..20: mol_type = other DNA
tgggctctggcagggcacag

SEQ ID NO: 98726 - DNA, 20 bp, synthetic construct
  misc_feature 1..20: note = CRISPR gRNA sequence
  source 1..20: mol_type = other DNA
tggcagggcacagtggctca

SEQ ID NO: 98727 - DNA, 20 bp, synthetic construct
  misc_feature 1..20: note = CRISPR gRNA sequence
  source 1..20: mol_type = other DNA
gtggctcacggctgtaatcc

SEQ ID NO: 98728 - DNA, 20 bp, synthetic construct
  misc_feature 1..20: note = CRISPR gRNA sequence
  source 1..20: mol_type = other DNA
cggctgtaatcccagcactt

SEQ ID NO: 98729 - DNA, 20 bp, synthetic construct
  misc_feature 1..20: note = CRISPR gRNA sequence
  source 1..20: mol_type = other DNA
ggctgtaatcccagcacttt

SEQ ID NO: 98730 - DNA, 20 bp, synthetic construct
  misc_feature 1..20: note = CRISPR gRNA sequence
  source 1..20: mol_type = other DNA
ctgtaatcccagcactttgg

SEQ ID NO: 98731 - DNA, 20 bp, synthetic construct
  misc_feature 1..20: note = CRISPR gRNA sequence
  source 1..20: mol_type = other DNA
tgtaatcccagcactttggg

SEQ ID NO: 98732 - DNA, 20 bp, synthetic construct
  misc_feature 1..20: note = CRISPR gRNA sequence
  source 1..20: mol_type = other DNA
tcccagcactttgggaggcc

SEQ ID NO: 98733 - DNA, 20 bp, synthetic construct
  misc_feature 1..20: note = CRISPR gRNA sequence
  source 1..20: mol_type = other DNA
cccagcactttgggaggccg

SEQ ID NO: 98734 - DNA, 20 bp, synthetic construct
  misc_feature 1..20: note = CRISPR gRNA sequence
  source 1..20: mol_type = other DNA
cagcactttgggaggccgag

SEQ ID NO: 98735 - DNA, 20 bp, synthetic construct
  misc_feature 1..20: note = CRISPR gRNA sequence
  source 1..20: mol_type = other DNA
agcactttgggaggccgagg

SEQ ID NO: 98736 - DNA, 20 bp, synthetic construct
  misc_feature 1..20: note = CRISPR gRNA sequence
  source 1..20: mol_type = other DNA
gcactttgggaggccgagga

SEQ ID NO: 98737 - DNA, 20 bp, synthetic construct
  misc_feature 1..20: note = CRISPR gRNA sequence
  source 1..20: mol_type = other DNA
ctttgggaggccgaggaggg

SEQ ID NO: 98738 - DNA, 20 bp, synthetic construct
  misc_feature 1..20: note = CRISPR gRNA sequence
  source 1..20: mol_type = other DNA
ggccgaggagggtggatcat

SEQ ID NO: 98739 - DNA, 20 bp, synthetic construct
  misc_feature 1..20: note = CRISPR gRNA sequence
  source 1..20: mol_type = other DNA
gccgaggagggtggatcatg

SEQ ID NO: 98740 - DNA, 20 bp, synthetic construct
  misc_feature 1..20: note = CRISPR gRNA sequence
  source 1..20: mol_type = other DNA
aggagggtggatcatgaggt

SEQ ID NO: 98741 - DNA, 20 bp, synthetic construct
  misc_feature 1..20: note = CRISPR gRNA sequence
  source 1..20: mol_type = other DNA
ggagggtggatcatgaggtc

SEQ ID NO: 98742 - DNA, 20 bp, synthetic construct
  misc_feature 1..20: note = CRISPR gRNA sequence
  source 1..20: mol_type = other DNA
agggtggatcatgaggtcag

SEQ ID NO: 98743 - DNA, 20 bp, synthetic construct
  misc_feature 1..20: note = CRISPR gRNA sequence
  source 1..20: mol_type = other DNA
gatcatgaggtcaggagttc

SEQ ID NO: 98744 - DNA, 20 bp, synthetic construct
  misc_feature 1..20: note = CRISPR gRNA sequence
  source 1..20: mol_type = other DNA
tgaggtcaggagttcgagac

SEQ ID NO: 98745 - DNA, 20 bp, synthetic construct
  misc_feature 1..20: note = CRISPR gRNA sequence
  source 1..20: mol_type = other DNA
gaggtcaggagttcgagacc

SEQ ID NO: 98746 - DNA, 20 bp, synthetic construct
  misc_feature 1..20: note = CRISPR gRNA sequence
  source 1..20: mol_type = other DNA
tcaggagttcgagaccaggc

SEQ ID NO: 98747 - DNA, 20 bp, synthetic construct
  misc_feature 1..20: note = CRISPR gRNA sequence
  source 1..20: mol_type = other DNA
cgagaccaggctggccacca

SEQ ID NO: 98748 - DNA, 20 bp, synthetic construct
  misc_feature 1..20: note = CRISPR gRNA sequence
  source 1..20: mol_type = other DNA
tgtactaaaaatacaaaaat

SEQ ID NO: 98749 - DNA, 20 bp, synthetic construct
  misc_feature 1..20: note = CRISPR gRNA sequence
  source 1..20: mol_type = other DNA
taaaaatacaaaaattagcc

SEQ ID NO: 98750 - DNA, 20 bp, synthetic construct
  misc_feature 1..20: note = CRISPR gRNA sequence
  source 1..20: mol_type = other DNA
atacaaaaattagccaagcg

SEQ ID NO: 98751 - DNA, 20 bp, synthetic construct
  misc_feature 1..20: note = CRISPR gRNA sequence
  source 1..20: mol_type = other DNA
caaaaattagccaagcgcgg

SEQ ID NO: 98752 - DNA, 20 bp, synthetic construct
  misc_feature 1..20: note = CRISPR gRNA sequence
  source 1..20: mol_type = other DNA
aaattagccaagcgcggtgg

SEQ ID NO: 98753 - DNA, 20 bp, synthetic construct
  misc_feature 1..20: note = CRISPR gRNA sequence
  source 1..20: mol_type = other DNA
aattagccaagcgcggtggc

SEQ ID NO: 98754 - DNA, 20 bp, synthetic construct
  misc_feature 1..20: note = CRISPR gRNA sequence
  source 1..20: mol_type = other DNA
gtggcgggcgcctgtgatcc

SEQ ID NO: 98755 - DNA, 20 bp, synthetic construct
  misc_feature 1..20: note = CRISPR gRNA sequence
  source 1..20: mol_type = other DNA
cgcctgtgatcccagctact

SEQ ID NO: 98756 - DNA, 20 bp, synthetic construct
  misc_feature 1..20: note = CRISPR gRNA sequence
  source 1..20: mol_type = other DNA
gcctgtgatcccagctactc

SEQ ID NO: 98757 - DNA, 20 bp, synthetic construct
  misc_feature 1..20: note = CRISPR gRNA sequence
  source 1..20: mol_type = other DNA
ctgtgatcccagctactcgg

SEQ ID NO: 98758 - DNA, 20 bp, synthetic construct
  misc_feature 1..20: note = CRISPR gRNA sequence
  source 1..20: mol_type = other DNA
tgtgatcccagctactcggg

SEQ ID NO: 98759 - DNA, 20 bp, synthetic construct
  misc_feature 1..20: note = CRISPR gRNA sequence
  source 1..20: mol_type = other DNA
tcccagctactcgggaggct

SEQ ID NO: 98760 - DNA, 20 bp, synthetic construct
  misc_feature 1..20: note = CRISPR gRNA sequence
  source 1..20: mol_type = other DNA
cccagctactcgggaggctg

SEQ ID NO: 98761 - DNA, 20 bp, synthetic construct
  misc_feature 1..20: note = CRISPR gRNA sequence
  source 1..20: mol_type = other DNA
agctactcgggaggctgagg

SEQ ID NO: 98762 - DNA, 20 bp, synthetic construct
  misc_feature 1..20: note = CRISPR gRNA sequence
  source 1..20: mol_type = other DNA
gaggcagaattgcttgaact

SEQ ID NO: 98763 - DNA, 20 bp, synthetic construct
  misc_feature 1..20: note = CRISPR gRNA sequence
  source 1..20: mol_type = other DNA
aggcagaattgcttgaactc

SEQ ID NO: 98764 - DNA, 20 bp, synthetic construct
  misc_feature 1..20: note = CRISPR gRNA sequence
  source 1..20: mol_type = other DNA
gcagaattgcttgaactcgg

SEQ ID NO: 98765 - DNA, 20 bp, synthetic construct
  misc_feature 1..20: note = CRISPR gRNA sequence
  source 1..20: mol_type = other DNA
cagaattgcttgaactcggg

SEQ ID NO: 98766 - DNA, 20 bp, synthetic construct
  misc_feature 1..20: note = CRISPR gRNA sequence
  source 1..20: mol_type = other DNA
aattgcttgaactcgggagg

SEQ ID NO: 98767 - DNA, 20 bp, synthetic construct
  misc_feature 1..20: note = CRISPR gRNA sequence
  source 1..20: mol_type = other DNA
ttgcttgaactcgggaggtg

SEQ ID NO: 98768 - DNA, 20 bp, synthetic construct
  misc_feature 1..20: note = CRISPR gRNA sequence
  source 1..20: mol_type = other DNA
tgcttgaactcgggaggtgg

SEQ ID NO: 98769 - DNA, 20 bp, synthetic construct
  misc_feature 1..20: note = CRISPR gRNA sequence
  source 1..20: mol_type = other DNA
aactcgggaggtggaggttg

SEQ ID NO: 98770 - DNA, 20 bp, synthetic construct
  misc_feature 1..20: note = CRISPR gRNA sequence
  source 1..20: mol_type = other DNA
cgggaggtggaggttgcggt

SEQ ID NO: 98771 - DNA, 20 bp, synthetic construct
  misc_feature 1..20: note = CRISPR gRNA sequence
  source 1..20: mol_type = other DNA
gaggtggaggttgcggtgag

SEQ ID NO: 98772 - DNA, 20 bp, synthetic construct
  misc_feature 1..20: note = CRISPR gRNA sequence
  source 1..20: mol_type = other DNA
ggtggaggttgcggtgagca

SEQ ID NO: 98773 - DNA, 20 bp, synthetic construct
  misc_feature 1..20: note = CRISPR gRNA sequence
  source 1..20: mol_type = other DNA
gagatcgcaccactgcactg

SEQ ID NO: 98774 - DNA, 20 bp, synthetic construct
  misc_feature 1..20: note = CRISPR gRNA sequence
  source 1..20: mol_type = other DNA
tcgcaccactgcactgtagc

SEQ ID NO: 98775 - DNA, 20 bp, synthetic construct
  misc_feature 1..20: note = CRISPR gRNA sequence
  source 1..20: mol_type = other DNA
cgcaccactgcactgtagct

SEQ ID NO: 98776 - DNA, 20 bp, synthetic construct
  misc_feature 1..20: note = CRISPR gRNA sequence
  source 1..20: mol_type = other DNA
gcaccactgcactgtagctg

SEQ ID NO: 98777 - DNA, 20 bp, synthetic construct
  misc_feature 1..20: note = CRISPR gRNA sequence
  source 1..20: mol_type = other DNA
ctgcactgtagctggggcga

SEQ ID NO: 98778 - DNA, 20 bp, synthetic construct
  misc_feature 1..20: note = CRISPR gRNA sequence
  source 1..20: mol_type = other DNA
gcactgtagctggggcgaca

SEQ ID NO: 98779 - DNA, 20 bp, synthetic construct
  misc_feature 1..20: note = CRISPR gRNA sequence
  source 1..20: mol_type = other DNA
tgtagctggggcgacagagc

SEQ ID NO: 98780 - DNA, 20 bp, synthetic construct
  misc_feature 1..20: note = CRISPR gRNA sequence
  source 1..20: mol_type = other DNA
aaaaaaaaaaaaaaaaaaaa

SEQ ID NO: 98781 - DNA, 20 bp, synthetic construct
  misc_feature 1..20: note = CRISPR gRNA sequence
  source 1..20: mol_type = other DNA
aaaaaaaaaaaaaaaaaaga

SEQ ID NO: 98782 - DNA, 20 bp, synthetic construct
  misc_feature 1..20: note = CRISPR gRNA sequence
  source 1..20: mol_type = other DNA
aaaaaaaaaaaaaaaaagaa

SEQ ID NO: 98783 - DNA, 20 bp, synthetic construct
  misc_feature 1..20: note = CRISPR gRNA sequence
  source 1..20: mol_type = other DNA
aaaaaaaagaaaggaaaaaa

SEQ ID NO: 98784 - DNA, 20 bp, synthetic construct
  misc_feature 1..20: note = CRISPR gRNA sequence
  source 1..20: mol_type = other DNA
aaaagaaaggaaaaaaaagc

SEQ ID NO: 98785 - DNA, 20 bp, synthetic construct
  misc_feature 1..20: note = CRISPR gRNA sequence
  source 1..20: mol_type = other DNA
aaagaaaggaaaaaaaagcc

SEQ ID NO: 98786 - DNA, 20 bp, synthetic construct
  misc_feature 1..20: note = CRISPR gRNA sequence
  source 1..20: mol_type = other DNA
aagaaaggaaaaaaaagccg

SEQ ID NO: 98787 - DNA, 20 bp, synthetic construct
  misc_feature 1..20: note = CRISPR gRNA sequence
  source 1..20: mol_type = other DNA
ggaaaaaaaagccggggctc

SEQ ID NO: 98788 - DNA, 20 bp, synthetic construct
  misc_feature 1..20: note = CRISPR gRNA sequence
  source 1..20: mol_type = other DNA
gaaaaaaaagccggggctct

SEQ ID NO: 98789 - DNA, 20 bp, synthetic construct
  misc_feature 1..20: note = CRISPR gRNA sequence
  source 1..20: mol_type = other DNA
aaaaaaaagccggggctctg

SEQ ID NO: 98790 - DNA, 20 bp, synthetic construct
  misc_feature 1..20: note = CRISPR gRNA sequence
  source 1..20: mol_type = other DNA
aaaagccggggctctggggt

SEQ ID NO: 98791 - DNA, 20 bp, synthetic construct
  misc_feature 1..20: note = CRISPR gRNA sequence
  source 1..20: mol_type = other DNA
gggctctggggtcagctgtc

SEQ ID NO: 98792 - DNA, 20 bp, synthetic construct
  misc_feature 1..20: note = CRISPR gRNA sequence
  source 1..20: mol_type = other DNA
ggctctggggtcagctgtct

SEQ ID NO: 98793 - DNA, 20 bp, synthetic construct
  misc_feature 1..20: note = CRISPR gRNA sequence
  source 1..20: mol_type = other DNA
ggttcgaatccctcaattta

SEQ ID NO: 98794 - DNA, 20 bp, synthetic construct
  misc_feature 1..20: note = CRISPR gRNA sequence
  source 1..20: mol_type = other DNA
gttcgaatccctcaatttat

SEQ ID NO: 98795 - DNA, 20 bp, synthetic construct
  misc_feature 1..20: note = CRISPR gRNA sequence
  source 1..20: mol_type = other DNA
tccctcaatttataggccgt

SEQ ID NO: 98796 - DNA, 20 bp, synthetic construct
  misc_feature 1..20: note = CRISPR gRNA sequence
  source 1..20: mol_type = other DNA
atttataggccgtgagaact

SEQ ID NO: 98797 - DNA, 20 bp, synthetic construct
  misc_feature 1..20: note = CRISPR gRNA sequence
  source 1..20: mol_type = other DNA
tttataggccgtgagaactt

SEQ ID NO: 98798 - DNA, 20 bp, synthetic construct
  misc_feature 1..20: note = CRISPR gRNA sequence
  source 1..20: mol_type = other DNA
gggcacgtgacttaaccttt

SEQ ID NO: 98799 - DNA, 20 bp, synthetic construct
  misc_feature 1..20: note = CRISPR gRNA sequence
  source 1..20: mol_type = other DNA
gtgacttaacctttgagcct

SEQ ID NO: 98800 - DNA, 20 bp, synthetic construct
  misc_feature 1..20: note = CRISPR gRNA sequence
  source 1..20: mol_type = other DNA
gtttcctccacgacaaaatg

SEQ ID NO: 98801 - DNA, 20 bp, synthetic construct
  misc_feature 1..20: note = CRISPR gRNA sequence
  source 1..20: mol_type = other DNA
ccacgacaaaatgtggaaat

SEQ ID NO: 98802 - DNA, 20 bp, synthetic construct
  misc_feature 1..20: note = CRISPR gRNA sequence
  source 1..20: mol_type = other DNA
caacgaattatgtctgtaca

SEQ ID NO: 98803 - DNA, 20 bp, synthetic construct
  misc_feature 1..20: note = CRISPR gRNA sequence
  source 1..20: mol_type = other DNA
tatgtctgtacatagcttat

SEQ ID NO: 98804 - DNA, 20 bp, synthetic construct
  misc_feature 1..20: note = CRISPR gRNA sequence
  source 1..20: mol_type = other DNA
atgtctgtacatagcttatc

SEQ ID NO: 98805 - DNA, 20 bp, synthetic construct
  misc_feature 1..20: note = CRISPR gRNA sequence
  source 1..20: mol_type = other DNA
tgtctgtacatagcttatcg

SEQ ID NO: 98806 - DNA, 20 bp, synthetic construct
  misc_feature 1..20: note = CRISPR gRNA sequence
  source 1..20: mol_type = other DNA
gtctgtacatagcttatcgg

SEQ ID NO: 98807 - DNA, 20 bp, synthetic construct
  misc_feature 1..20: note = CRISPR gRNA sequence
  source 1..20: mol_type = other DNA
agcttatcgggggatctgct

SEQ ID NO: 98808 - DNA, 20 bp, synthetic construct
  misc_feature 1..20: note = CRISPR gRNA sequence
  source 1..20: mol_type = other DNA
atcgggggatctgctaagcg

SEQ ID NO: 98809 - DNA, 20 bp, synthetic construct
  misc_feature 1..20: note = CRISPR gRNA sequence
  source 1..20: mol_type = other DNA
cgggggatctgctaagcgtg

SEQ ID NO: 98810 - DNA, 20 bp, synthetic construct
  misc_feature 1..20: note = CRISPR gRNA sequence
  source 1..20: mol_type = other DNA
agctcaataaatattcgcta

SEQ ID NO: 98811 - DNA, 20 bp, synthetic construct
  misc_feature 1..20: note = CRISPR gRNA sequence
  source 1..20: mol_type = other DNA
taaatattcgctatggttgt

SEQ ID NO: 98812 - DNA, 20 bp, synthetic construct
  misc_feature 1..20: note = CRISPR gRNA sequence
  source 1..20: mol_type = other DNA
aaatattcgctatggttgtt

SEQ ID NO: 98813 - DNA, 20 bp, synthetic construct
  misc_feature 1..20: note = CRISPR gRNA sequence
  source 1..20: mol_type = other DNA
atattcgctatggttgttgg

SEQ ID NO: 98814 - DNA, 20 bp, synthetic construct
  misc_feature 1..20: note = CRISPR gRNA sequence
  source 1..20: mol_type = other DNA
tattcgctatggttgttggg

SEQ ID NO: 98815 - DNA, 20 bp, synthetic construct
  misc_feature 1..20: note = CRISPR gRNA sequence
  source 1..20: mol_type = other DNA
attcgctatggttgttggga

SEQ ID NO: 98816 - DNA, 20 bp, synthetic construct
  misc_feature 1..20: note = CRISPR gRNA sequence
  source 1..20: mol_type = other DNA
ttcgctatggttgttgggag

SEQ ID NO: 98817 - DNA, 20 bp, synthetic construct
  misc_feature 1..20: note = CRISPR gRNA sequence
  source 1..20: mol_type = other DNA
tgggaggggctccccataat

SEQ ID NO: 98818 - DNA, 20 bp, synthetic construct
  misc_feature 1..20: note = CRISPR gRNA sequence
  source 1..20: mol_type = other DNA
gggctccccataatgagtga

SEQ ID NO: 98819 - DNA, 20 bp, synthetic construct
  misc_feature 1..20: note = CRISPR gRNA sequence
  source 1..20: mol_type = other DNA
taatgagtgacggctcaaca

SEQ ID NO: 98820 - DNA, 20 bp, synthetic construct
  misc_feature 1..20: note = CRISPR gRNA sequence
  source 1..20: mol_type = other DNA
aatgagtgacggctcaacaa

SEQ ID NO: 98821 - DNA, 20 bp, synthetic construct
  misc_feature 1..20: note = CRISPR gRNA sequence
  source 1..20: mol_type = other DNA
cggctcaacaaaggtgcgat

SEQ ID NO: 98822 - DNA, 20 bp, synthetic construct
  misc_feature 1..20: note = CRISPR gRNA sequence
  source 1..20: mol_type = other DNA
aacaaaggtgcgattggtcc

SEQ ID NO: 98823 - DNA, 20 bp, synthetic construct
  misc_feature 1..20: note = CRISPR gRNA sequence
  source 1..20: mol_type = other DNA
gattggtcccagtcccaccc

SEQ ID NO: 98824 - DNA, 20 bp, synthetic construct
  misc_feature 1..20: note = CRISPR gRNA sequence
  source 1..20: mol_type = other DNA
ccgagcctcctaaatcgatc

SEQ ID NO: 98825 - DNA, 20 bp, synthetic construct
  misc_feature 1..20: note = CRISPR gRNA sequence
  source 1..20: mol_type = other DNA
cgagcctcctaaatcgatcc

SEQ ID NO: 98826 - DNA, 20 bp, synthetic construct
  misc_feature 1..20: note = CRISPR gRNA sequence
  source 1..20: mol_type = other DNA
agcctcctaaatcgatccag

SEQ ID NO: 98827 - DNA, 20 bp, synthetic construct
  misc_feature 1..20: note = CRISPR gRNA sequence
  source 1..20: mol_type = other DNA
gcctcctaaatcgatccagg

SEQ ID NO: 98828 - DNA, 20 bp, synthetic construct
  misc_feature 1..20: note = CRISPR gRNA sequence
  source 1..20: mol_type = other DNA
aggtccactcacctccccac

SEQ ID NO: 98829 - DNA, 20 bp, synthetic construct
  misc_feature 1..20: note = CRISPR gRNA sequence
  source 1..20: mol_type = other DNA
cctctgtccccccgcgccga

SEQ ID NO: 98830 - DNA, 20 bp, synthetic construct
  misc_feature 1..20: note = CRISPR gRNA sequence
  source 1..20: mol_type = other DNA
gtccccccgcgccgaaagcc

SEQ ID NO: 98831 - DNA, 20 bp, synthetic construct
  misc_feature 1..20: note = CRISPR gRNA sequence
  source 1..20: mol_type = other DNA
agcccagttctctcaaaact

SEQ ID NO: 98832 - DNA, 20 bp, synthetic construct
  misc_feature 1..20: note = CRISPR gRNA sequence
  source 1..20: mol_type = other DNA
gcccagttctctcaaaactt

SEQ ID NO: 98833 - DNA, 20 bp, synthetic construct
  misc_feature 1..20: note = CRISPR gRNA sequence
  source 1..20: mol_type = other DNA
cccagttctctcaaaacttg

SEQ ID NO: 98834 - DNA, 20 bp, synthetic construct
  misc_feature 1..20: note = CRISPR gRNA sequence
  source 1..20: mol_type = other DNA
ccagttctctcaaaacttgg

SEQ ID NO: 98835 - DNA, 20 bp, synthetic construct
  misc_feature 1..20: note = CRISPR gRNA sequence
  source 1..20: mol_type = other DNA
ctctcaaaacttgggggccc

SEQ ID NO: 98836 - DNA, 20 bp, synthetic construct
  misc_feature 1..20: note = CRISPR gRNA sequence
  source 1..20: mol_type = other DNA
cacaaacttttctcttccaa

SEQ ID NO: 98837 - DNA, 20 bp, synthetic construct
  misc_feature 1..20: note = CRISPR gRNA sequence
  source 1..20: mol_type = other DNA
cttttctcttccaatggata

SEQ ID NO: 98838 - DNA, 20 bp, synthetic construct
  misc_feature 1..20: note = CRISPR gRNA sequence
  source 1..20: mol_type = other DNA
ttctcttccaatggatatag

SEQ ID NO: 98839 - DNA, 20 bp, synthetic construct
  misc_feature 1..20: note = CRISPR gRNA sequence
  source 1..20: mol_type = other DNA
tctcttccaatggatatagc

SEQ ID NO: 98840 - DNA, 20 bp, synthetic construct
  misc_feature 1..20: note = CRISPR gRNA sequence
  source 1..20: mol_type = other DNA
tcttccaatggatatagcag

SEQ ID NO: 98841 - DNA, 20 bp, synthetic construct
  misc_feature 1..20: note = CRISPR gRNA sequence
  source 1..20: mol_type = other DNA
cttccaatggatatagcagg

SEQ ID NO: 98842 - DNA, 20 bp, synthetic construct
  misc_feature 1..20: note = CRISPR gRNA sequence
  source 1..20: mol_type = other DNA
ggatatagcaggaggcaaac

SEQ ID NO: 98843 - DNA, 20 bp, synthetic construct
  misc_feature 1..20: note = CRISPR gRNA sequence
  source 1..20: mol_type = other DNA
atatagcaggaggcaaactg

SEQ ID NO: 98844 - DNA, 20 bp, synthetic construct
  misc_feature 1..20: note = CRISPR gRNA sequence
  source 1..20: mol_type = other DNA
gcaggaggcaaactggagac

SEQ ID NO: 98845 - DNA, 20 bp, synthetic construct
  misc_feature 1..20: note = CRISPR gRNA sequence
  source 1..20: mol_type = other DNA
caaactggagaccggaccct

SEQ ID NO: 98846 - DNA, 20 bp, synthetic construct
  misc_feature 1..20: note = CRISPR gRNA sequence
  source 1..20: mol_type = other DNA
agaccggaccctcagcgatc

SEQ ID NO: 98847 - DNA, 20 bp, synthetic construct
  misc_feature 1..20: note = CRISPR gRNA sequence
  source 1..20: mol_type = other DNA
agcgatctggcttcctctgc

SEQ ID NO: 98848 - DNA, 20 bp, synthetic construct
  misc_feature 1..20: note = CRISPR gRNA sequence
  source 1..20: mol_type = other DNA
gcgatctggcttcctctgcc

SEQ ID NO: 98849 - DNA, 20 bp, synthetic construct
  misc_feature 1..20: note = CRISPR gRNA sequence
  source 1..20: mol_type = other DNA
tctggcttcctctgccggga

SEQ ID NO: 98850 - DNA, 20 bp, synthetic construct
  misc_feature 1..20: note = CRISPR gRNA sequence
  source 1..20: mol_type = other DNA
gcttcctctgccgggacaga

SEQ ID NO: 98851 - DNA, 20 bp, synthetic construct
  misc_feature 1..20: note = CRISPR gRNA sequence
  source 1..20: mol_type = other DNA
ctcgaccgctacccccaccc

SEQ ID NO: 98852 - DNA, 20 bp, synthetic construct
  misc_feature 1..20: note = CRISPR gRNA sequence
  source 1..20: mol_type = other DNA
cgaccgctacccccacccca

SEQ ID NO: 98853 - DNA, 20 bp, synthetic construct
  misc_feature 1..20: note = CRISPR gRNA sequence
  source 1..20: mol_type = other DNA
tgcgcacccccgccccccaa

SEQ ID NO: 98854 - DNA, 20 bp, synthetic construct
  misc_feature 1..20: note = CRISPR gRNA sequence
  source 1..20: mol_type = other DNA
cacccccgccccccaaaagt

SEQ ID NO: 98855 - DNA, 20 bp, synthetic construct
  misc_feature 1..20: note = CRISPR gRNA sequence
  source 1..20: mol_type = other DNA
acccccgccccccaaaagtg

SEQ ID NO: 98856 - DNA, 20 bp, synthetic construct
  misc_feature 1..20: note = CRISPR gRNA sequence
  source 1..20: mol_type = other DNA
cccgccccccaaaagtgagg

SEQ ID NO: 98857 - DNA, 20 bp, synthetic construct
  misc_feature 1..20: note = CRISPR gRNA sequence
  source 1..20: mol_type = other DNA
ccgccccccaaaagtgagga

SEQ ID NO: 98858 - DNA, 20 bp, synthetic construct
  misc_feature 1..20: note = CRISPR gRNA sequence
  source 1..20: mol_type = other DNA
cgccccccaaaagtgaggaa

SEQ ID NO: 98859 - DNA, 20 bp, synthetic construct
  misc_feature 1..20: note = CRISPR gRNA sequence
  source 1..20: mol_type = other DNA
cccaaaagtgaggaagggcc

SEQ ID NO: 98860 - DNA, 20 bp, synthetic construct
  misc_feature 1..20: note = CRISPR gRNA sequence
  source 1..20: mol_type = other DNA
ccaaaagtgaggaagggccc

SEQ ID NO: 98861 - DNA, 20 bp, synthetic construct
  misc_feature 1..20: note = CRISPR gRNA sequence
  source 1..20: mol_type = other DNA
aaagtgaggaagggcccggg

SEQ ID NO: 98862 - DNA, 20 bp, synthetic construct
  misc_feature 1..20: note = CRISPR gRNA sequence
  source 1..20: mol_type = other DNA
tgaggaagggcccgggcagt

SEQ ID NO: 98863 - DNA, 20 bp, synthetic construct
  misc_feature 1..20: note = CRISPR gRNA sequence
  source 1..20: mol_type = other DNA
cgggcagtaagtgctgcctc

SEQ ID NO: 98864 - DNA, 20 bp, synthetic construct
  misc_feature 1..20: note = CRISPR gRNA sequence
  source 1..20: mol_type = other DNA
agtgctgcctctggcccttt

SEQ ID NO: 98865 - DNA, 20 bp, synthetic construct
  misc_feature 1..20: note = CRISPR gRNA sequence
  source 1..20: mol_type = other DNA
gcctctggccctttaagact

SEQ ID NO: 98866 - DNA, 20 bp, synthetic construct
  misc_feature 1..20: note = CRISPR gRNA sequence
  source 1..20: mol_type = other DNA
cctctggccctttaagactt

SEQ ID NO: 98867 - DNA, 20 bp, synthetic construct
  misc_feature 1..20: note = CRISPR gRNA sequence
  source 1..20: mol_type = other DNA
ctctggccctttaagactta

SEQ ID NO: 98868 - DNA, 20 bp, synthetic construct
  misc_feature 1..20: note = CRISPR gRNA sequence
  source 1..20: mol_type = other DNA
tctggccctttaagacttag

SEQ ID NO: 98869 - DNA, 20 bp, synthetic construct
  misc_feature 1..20: note = CRISPR gRNA sequence
  source 1..20: mol_type = other DNA
tggccctttaagacttaggg

SEQ ID NO: 98870 - DNA, 20 bp, synthetic construct
  misc_feature 1..20: note = CRISPR gRNA sequence
  source 1..20: mol_type = other DNA
ggccctttaagacttagggg

SEQ ID NO: 98871 - DNA, 20 bp, synthetic construct
  misc_feature 1..20: note = CRISPR gRNA sequence
  source 1..20: mol_type = other DNA
gccctttaagacttagggga

SEQ ID NO: 98872 - DNA, 20 bp, synthetic construct
  misc_feature 1..20: note = CRISPR gRNA sequence
  source 1..20: mol_type = other DNA
ttaagacttaggggagggcg

SEQ ID NO: 98873 - DNA, 20 bp, synthetic construct
  misc_feature 1..20: note = CRISPR gRNA sequence
  source 1..20: mol_type = other DNA
taagacttaggggagggcgt

SEQ ID NO: 98874 - DNA, 20 bp, synthetic construct
  misc_feature 1..20: note = CRISPR gRNA sequence
  source 1..20: mol_type = other DNA
ggggagggcgtgggttccgc

SEQ ID NO: 98875 - DNA, 20 bp, synthetic construct
  misc_feature 1..20: note = CRISPR gRNA sequence
  source 1..20: mol_type = other DNA
gggagggcgtgggttccgct

SEQ ID NO: 98876 - DNA, 20 bp, synthetic construct
  misc_feature 1..20: note = CRISPR gRNA sequence
  source 1..20: mol_type = other DNA
ggagggcgtgggttccgctg

SEQ ID NO: 98877 - DNA, 20 bp, synthetic construct
  misc_feature 1..20: note = CRISPR gRNA sequence
  source 1..20: mol_type = other DNA
cgtgggttccgctggggtcc

SEQ ID NO: 98878 - DNA, 20 bp, synthetic construct
  misc_feature 1..20: note = CRISPR gRNA sequence
  source 1..20: mol_type = other DNA
gtgggttccgctggggtcct

SEQ ID NO: 98879 - DNA, 20 bp, synthetic construct
  misc_feature 1..20: note = CRISPR gRNA sequence
  source 1..20: mol_type = other DNA
gggttccgctggggtcctgg

SEQ ID NO: 98880 - DNA, 20 bp, synthetic construct
  misc_feature 1..20: note = CRISPR gRNA sequence
  source 1..20: mol_type = other DNA
ggttccgctggggtcctggg

SEQ ID NO: 98881 - DNA, 20 bp, synthetic construct
  misc_feature 1..20: note = CRISPR gRNA sequence
  source 1..20: mol_type = other DNA
gttccgctggggtcctggga

SEQ ID NO: 98882 - DNA, 20 bp, synthetic construct
  misc_feature 1..20: note = CRISPR gRNA sequence
  source 1..20: mol_type = other DNA
ccgctggggtcctgggaggg

SEQ ID NO: 98883 - DNA, 20 bp, synthetic construct
  misc_feature 1..20: note = CRISPR gRNA sequence
  source 1..20: mol_type = other DNA
ttttcccctcctcaccgact

SEQ ID NO: 98884 - DNA, 20 bp, synthetic construct
  misc_feature 1..20: note = CRISPR gRNA sequence
  source 1..20: mol_type = other DNA
ttcccctcctcaccgactcg

SEQ ID NO: 98885 - DNA, 20 bp, synthetic construct
  misc_feature 1..20: note = CRISPR gRNA sequence
  source 1..20: mol_type = other DNA
tcccctcctcaccgactcgg

SEQ ID NO: 98886 - DNA, 20 bp, synthetic construct
  misc_feature 1..20: note = CRISPR gRNA sequence
  source 1..20: mol_type = other DNA
cccctcctcaccgactcgga

SEQ ID NO: 98887 - DNA, 20 bp, synthetic construct
  misc_feature 1..20: note = CRISPR gRNA sequence
  source 1..20: mol_type = other DNA
cctcaccgactcggagggaa

SEQ ID NO: 98888 - DNA, 20 bp, synthetic construct
  misc_feature 1..20: note = CRISPR gRNA sequence
  source 1..20: mol_type = other DNA
ctcaccgactcggagggaat

SEQ ID NO: 98889 - DNA, 20 bp, synthetic construct
  misc_feature 1..20: note = CRISPR gRNA sequence
  source 1..20: mol_type = other DNA
accgactcggagggaatggg

SEQ ID NO: 98890 - DNA, 20 bp, synthetic construct
  misc_feature 1..20: note = CRISPR gRNA sequence
  source 1..20: mol_type = other DNA
ccgactcggagggaatgggc

SEQ ID NO: 98891 - DNA, 20 bp, synthetic construct
  misc_feature 1..20: note = CRISPR gRNA sequence
  source 1..20: mol_type = other DNA
cgactcggagggaatgggcg

SEQ ID NO: 98892 - DNA, 20 bp, synthetic construct
  misc_feature 1..20: note = CRISPR gRNA sequence
  source 1..20: mol_type = other DNA
gagggaatgggcggggccta

SEQ ID NO: 98893 - DNA, 20 bp, synthetic construct
  misc_feature 1..20: note = CRISPR gRNA sequence
  source 1..20: mol_type = other DNA
agggaatgggcggggcctaa

SEQ ID NO: 98894 - DNA, 20 bp, synthetic construct
  misc_feature 1..20: note = CRISPR gRNA sequence
  source 1..20: mol_type = other DNA
gggaatgggcggggcctaaa

SEQ ID NO: 98895 - DNA, 20 bp, synthetic construct
  misc_feature 1..20: note = CRISPR gRNA sequence
  source 1..20: mol_type = other DNA
ggcggggcctaaagggctct

SEQ ID NO: 98896 - DNA, 20 bp, synthetic construct
  misc_feature 1..20: note = CRISPR gRNA sequence
  source 1..20: mol_type = other DNA
gctcacctttaccctgccca

SEQ ID NO: 98897 - DNA, 20 bp, synthetic construct
  misc_feature 1..20: note = CRISPR gRNA sequence
  source 1..20: mol_type = other DNA
accctgcccacagatttttc

SEQ ID NO: 98898 - DNA, 20 bp, synthetic construct
  misc_feature 1..20: note = CRISPR gRNA sequence
  source 1..20: mol_type = other DNA
cctgcccacagatttttcca

SEQ ID NO: 98899 - DNA, 20 bp, synthetic construct
  misc_feature 1..20: note = CRISPR gRNA sequence
  source 1..20: mol_type = other DNA
ctgcccacagatttttccag

SEQ ID NO: 98900 - DNA, 20 bp, synthetic construct
  misc_feature 1..20: note = CRISPR gRNA sequence
  source 1..20: mol_type = other DNA
tgcccacagatttttccaga

SEQ ID NO: 98901 - DNA, 20 bp, synthetic construct
  misc_feature 1..20: note = CRISPR gRNA sequence
  source 1..20: mol_type = other DNA
cccacagatttttccagagg

SEQ ID NO: 98902 - DNA, 20 bp, synthetic construct
  misc_feature 1..20: note = CRISPR gRNA sequence
  source 1..20: mol_type = other DNA
tttttccagagggagccaat

SEQ ID NO: 98903 - DNA, 20 bp, synthetic construct
  misc_feature 1..20: note = CRISPR gRNA sequence
  source 1..20: mol_type = other DNA
cagagggagccaattggctc

SEQ ID NO: 98904 - DNA, 20 bp, synthetic construct
  misc_feature 1..20: note = CRISPR gRNA sequence
  source 1..20: mol_type = other DNA
gagccaattggctccggctt

SEQ ID NO: 98905 - DNA, 20 bp, synthetic construct
  misc_feature 1..20: note = CRISPR gRNA sequence
  source 1..20: mol_type = other DNA
agccaattggctccggcttc

SEQ ID NO: 98906 - DNA, 20 bp, synthetic construct
  misc_feature 1..20: note = CRISPR gRNA sequence
  source 1..20: mol_type = other DNA
caattggctccggcttcggg

SEQ ID NO: 98907 - DNA, 20 bp, synthetic construct
  misc_feature 1..20: note = CRISPR gRNA sequence
  source 1..20: mol_type = other DNA
tggctccggcttcgggtaga

SEQ ID NO: 98908 - DNA, 20 bp, synthetic construct
  misc_feature 1..20: note = CRISPR gRNA sequence
  source 1..20: mol_type = other DNA
ggctccggcttcgggtagat

SEQ ID NO: 98909 - DNA, 20 bp, synthetic construct
  misc_feature 1..20: note = CRISPR gRNA sequence
  source 1..20: mol_type = other DNA
tccggcttcgggtagatggg

SEQ ID NO: 98910 - DNA, 20 bp, synthetic construct
  misc_feature 1..20: note = CRISPR gRNA sequence
  source 1..20: mol_type = other DNA
ccggcttcgggtagatgggc

SEQ ID NO: 98911 - DNA, 20 bp, synthetic construct
  misc_feature 1..20: note = CRISPR gRNA sequence
  source 1..20: mol_type = other DNA
cggcttcgggtagatgggcg

SEQ ID NO: 98912 - DNA, 20 bp, synthetic construct
  misc_feature 1..20: note = CRISPR gRNA sequence
  source 1..20: mol_type = other DNA
tagatgggcggggctatctc

SEQ ID NO: 98913 - DNA, 20 bp, synthetic construct
  misc_feature 1..20: note = CRISPR gRNA sequence
  source 1..20: mol_type = other DNA
atgggcggggctatctcaag

SEQ ID NO: 98914 - DNA, 20 bp, synthetic construct
  misc_feature 1..20: note = CRISPR gRNA sequence
  source 1..20: mol_type = other DNA
ggcggggctatctcaagaag

SEQ ID NO: 98915 - DNA, 20 bp, synthetic construct
  misc_feature 1..20: note = CRISPR gRNA sequence
  source 1..20: mol_type = other DNA
ggggctatctcaagaagaag

SEQ ID NO: 98916 - DNA, 20 bp, synthetic construct
  misc_feature 1..20: note = CRISPR gRNA sequence
  source 1..20: mol_type = other DNA
gctatctcaagaagaagaag

SEQ ID NO: 98917 - DNA, 20 bp, synthetic construct
  misc_feature 1..20: note = CRISPR gRNA sequence
  source 1..20: mol_type = other DNA
ctatctcaagaagaagaagt

SEQ ID NO: 98918 - DNA, 20 bp, synthetic construct
  misc_feature 1..20: note = CRISPR gRNA sequence
  source 1..20: mol_type = other DNA
tatctcaagaagaagaagta

SEQ ID NO: 98919 - DNA, 20 bp, synthetic construct
  misc_feature 1..20: note = CRISPR gRNA sequence
  source 1..20: mol_type = other DNA
atctcaagaagaagaagtag

SEQ ID NO: 98920 - DNA, 20 bp, synthetic construct
  misc_feature 1..20: note = CRISPR gRNA sequence
  source 1..20: mol_type = other DNA
tcaagaagaagaagtagggg

SEQ ID NO: 98921 - DNA, 20 bp, synthetic construct
  misc_feature 1..20: note = CRISPR gRNA sequence
  source 1..20: mol_type = other DNA
gaagaagtaggggaagtacg

SEQ ID NO: 98922 - DNA, 20 bp, synthetic construct
  misc_feature 1..20: note = CRISPR gRNA sequence
  source 1..20: mol_type = other DNA
aagaagtaggggaagtacgc

SEQ ID NO: 98923 - DNA, 20 bp, synthetic construct
  misc_feature 1..20: note = CRISPR gRNA sequence
  source 1..20: mol_type = other DNA
agaagtaggggaagtacgcg

SEQ ID NO: 98924 - DNA, 20 bp, synthetic construct
  misc_feature 1..20: note = CRISPR gRNA sequence
  source 1..20: mol_type = other DNA
ggggaagtacgcggggcgtc

SEQ ID NO: 98925 - DNA, 20 bp, synthetic construct
  misc_feature 1..20: note = CRISPR gRNA sequence
  source 1..20: mol_type = other DNA
cgcggggcgtctggaactta

SEQ ID NO: 98926 - DNA, 20 bp, synthetic construct
  misc_feature 1..20: note = CRISPR gRNA sequence
  source 1..20: mol_type = other DNA
gcggggcgtctggaacttaa

SEQ ID NO: 98927 - DNA, 20 bp, synthetic construct
  misc_feature 1..20: note = CRISPR gRNA sequence
  source 1..20: mol_type = other DNA
cggggcgtctggaacttaaa

SEQ ID NO: 98928 - DNA, 20 bp, synthetic construct
  misc_feature 1..20: note = CRISPR gRNA sequence
  source 1..20: mol_type = other DNA
ggggcgtctggaacttaaag

SEQ ID NO: 98929 - DNA, 20 bp, synthetic construct
  misc_feature 1..20: note = CRISPR gRNA sequence
  source 1..20: mol_type = other DNA
gcgtctggaacttaaagggg

SEQ ID NO: 98930 - DNA, 20 bp, synthetic construct
  misc_feature 1..20: note = CRISPR gRNA sequence
  source 1..20: mol_type = other DNA
cttaaaggggcagcgtacct

SEQ ID NO: 98931 - DNA, 20 bp, synthetic construct
  misc_feature 1..20: note = CRISPR gRNA sequence
  source 1..20: mol_type = other DNA
tggccgtcccgttccacaac

SEQ ID NO: 98932 - DNA, 20 bp, synthetic construct
  misc_feature 1..20: note = CRISPR gRNA sequence
  source 1..20: mol_type = other DNA
ggccgtcccgttccacaaca

SEQ ID NO: 98933 - DNA, 20 bp, synthetic construct
  misc_feature 1..20: note = CRISPR gRNA sequence
  source 1..20: mol_type = other DNA
ccacaacaaggtcccttctg

SEQ ID NO: 98934 - DNA, 20 bp, synthetic construct
  misc_feature 1..20: note = CRISPR gRNA sequence
  source 1..20: mol_type = other DNA
aggtcccttctgcggtctca

SEQ ID NO: 98935 - DNA, 20 bp, synthetic construct
  misc_feature 1..20: note = CRISPR gRNA sequence
  source 1..20: mol_type = other DNA
ggtcccttctgcggtctcaa

SEQ ID NO: 98936 - DNA, 20 bp, synthetic construct
  misc_feature 1..20: note = CRISPR gRNA sequence
  source 1..20: mol_type = other DNA
ctgcggtctcaaaggcttat

SEQ ID NO: 98937 - DNA, 20 bp, synthetic construct
  misc_feature 1..20: note = CRISPR gRNA sequence
  source 1..20: mol_type = other DNA
ggtctcaaaggcttataagc

SEQ ID NO: 98938 - DNA, 20 bp, synthetic construct
  misc_feature 1..20: note = CRISPR gRNA sequence
  source 1..20: mol_type = other DNA
gtctcaaaggcttataagca

SEQ ID NO: 98939 - DNA, 20 bp, synthetic construct
  misc_feature 1..20: note = CRISPR gRNA sequence
  source 1..20: mol_type = other DNA
tctcaaaggcttataagcaa

SEQ ID NO: 98940 - DNA, 20 bp, synthetic construct
  misc_feature 1..20: note = CRISPR gRNA sequence
  source 1..20: mol_type = other DNA
caaaggcttataagcaaggg

SEQ ID NO: 98941 - DNA, 20 bp, synthetic construct
  misc_feature 1..20: note = CRISPR gRNA sequence
  source 1..20: mol_type = other DNA
aaaggcttataagcaagggc

SEQ ID NO: 98942 - DNA, 20 bp, synthetic construct
  misc_feature 1..20: note = CRISPR gRNA sequence
  source 1..20: mol_type = other DNA
aaggcttataagcaagggcg

SEQ ID NO: 98943 - DNA, 20 bp, synthetic construct
  misc_feature 1..20: note = CRISPR gRNA sequence
  source 1..20: mol_type = other DNA
aggcttataagcaagggcgg

SEQ ID NO: 98944 - DNA, 20 bp, synthetic construct
  misc_feature 1..20: note = CRISPR gRNA sequence
  source 1..20: mol_type = other DNA
cttataagcaagggcggggg

SEQ ID NO: 98945 - DNA, 20 bp, synthetic construct
  misc_feature 1..20: note = CRISPR gRNA sequence
  source 1..20: mol_type = other DNA
tataagcaagggcgggggca

SEQ ID NO: 98946 - DNA, 20 bp, synthetic construct
  misc_feature 1..20: note = CRISPR gRNA sequence
  source 1..20: mol_type = other DNA
ataagcaagggcgggggcag

SEQ ID NO: 98947 - DNA, 20 bp, synthetic construct
  misc_feature 1..20: note = CRISPR gRNA sequence
  source 1..20: mol_type = other DNA
taagcaagggcgggggcaga

SEQ ID NO: 98948 - DNA, 20 bp, synthetic construct
  misc_feature 1..20: note = CRISPR gRNA sequence
  source 1..20: mol_type = other DNA
agggcgggggcagagggcta

SEQ ID NO: 98949 - DNA, 20 bp, synthetic construct
  misc_feature 1..20: note = CRISPR gRNA sequence
  source 1..20: mol_type = other DNA
gcgggggcagagggctaaag

SEQ ID NO: 98950 - DNA, 20 bp, synthetic construct
  misc_feature 1..20: note = CRISPR gRNA sequence
  source 1..20: mol_type = other DNA
cgggggcagagggctaaaga

SEQ ID NO: 98951 - DNA, 20 bp, synthetic construct
  misc_feature 1..20: note = CRISPR gRNA sequence
  source 1..20: mol_type = other DNA
gggggcagagggctaaagaa

SEQ ID NO: 98952 - DNA, 20 bp, synthetic construct
  misc_feature 1..20: note = CRISPR gRNA sequence
  source 1..20: mol_type = other DNA
gggcagagggctaaagaagg

SEQ ID NO: 98953 - DNA, 20 bp, synthetic construct
  misc_feature 1..20: note = CRISPR gRNA sequence
  source 1..20: mol_type = other DNA
gctaaagaagggagtttttg

SEQ ID NO: 98954 - DNA, 20 bp, synthetic construct
  misc_feature 1..20: note = CRISPR gRNA sequence
  source 1..20: mol_type = other DNA
gaagggagtttttgcggccc

SEQ ID NO: 98955 - DNA, 20 bp, synthetic construct
  misc_feature 1..20: note = CRISPR gRNA sequence
  source 1..20: mol_type = other DNA
gggagtttttgcggcccgag

SEQ ID NO: 98956 - DNA, 20 bp, synthetic construct
  misc_feature 1..20: note = CRISPR gRNA sequence
  source 1..20: mol_type = other DNA
ggagtttttgcggcccgagt

SEQ ID NO: 98957 - DNA, 20 bp, synthetic construct
  misc_feature 1..20: note = CRISPR gRNA sequence
  source 1..20: mol_type = other DNA
cggcccgagtgggtaatgcg

SEQ ID NO: 98958 - DNA, 20 bp, synthetic construct
  misc_feature 1..20: note = CRISPR gRNA sequence
  source 1..20: mol_type = other DNA
gcccgagtgggtaatgcgtg

SEQ ID NO: 98959 - DNA, 20 bp, synthetic construct
  misc_feature 1..20: note = CRISPR gRNA sequence
  source 1..20: mol_type = other DNA
cccgagtgggtaatgcgtgg

SEQ ID NO: 98960 - DNA, 20 bp, synthetic construct
  misc_feature 1..20: note = CRISPR gRNA sequence
  source 1..20: mol_type = other DNA
actcccccaactcgtctctc

SEQ ID NO: 98961 - DNA, 20 bp, synthetic construct
  misc_feature 1..20: note = CRISPR gRNA sequence
  source 1..20: mol_type = other DNA
ctcccccaactcgtctctca

SEQ ID NO: 98962 - DNA, 20 bp, synthetic construct
  misc_feature 1..20: note = CRISPR gRNA sequence
  source 1..20: mol_type = other DNA
ccaactcgtctctcaaggaa

SEQ ID NO: 98963 - DNA, 20 bp, synthetic construct
  misc_feature 1..20: note = CRISPR gRNA sequence
  source 1..20: mol_type = other DNA
caactcgtctctcaaggaaa

SEQ ID NO: 98964 - DNA, 20 bp, synthetic construct
  misc_feature 1..20: note = CRISPR gRNA sequence
  source 1..20: mol_type = other DNA
aactcgtctctcaaggaaaa

SEQ ID NO: 98965 - DNA, 20 bp, synthetic construct
  misc_feature 1..20: note = CRISPR gRNA sequence
  source 1..20: mol_type = other DNA
actcgtctctcaaggaaaag

SEQ ID NO: 98966 - DNA, 20 bp, synthetic construct
  misc_feature 1..20: note = CRISPR gRNA sequence
  source 1..20: mol_type = other DNA
ctcgtctctcaaggaaaagg

SEQ ID NO: 98967 - DNA, 20 bp, synthetic construct
  misc_feature 1..20: note = CRISPR gRNA sequence
  source 1..20: mol_type = other DNA
ctctcaaggaaaagggggtt

SEQ ID NO: 98968 - DNA, 20 bp, synthetic construct
  misc_feature 1..20: note = CRISPR gRNA sequence
  source 1..20: mol_type = other DNA
caaggaaaagggggttcaga

SEQ ID NO: 98969 - DNA, 20 bp, synthetic construct
  misc_feature 1..20: note = CRISPR gRNA sequence
  source 1..20: mol_type = other DNA
aaggaaaagggggttcagaa

SEQ ID NO: 98970 - DNA, 20 bp, synthetic construct
  misc_feature 1..20: note = CRISPR gRNA sequence
  source 1..20: mol_type = other DNA
aggaaaagggggttcagaaa

SEQ ID NO: 98971 - DNA, 20 bp, synthetic construct
  misc_feature 1..20: note = CRISPR gRNA sequence
  source 1..20: mol_type = other DNA
gaaaagggggttcagaaagg

SEQ ID NO: 98972 - DNA, 20 bp, synthetic construct
  misc_feature 1..20: note = CRISPR gRNA sequence
  source 1..20: mol_type = other DNA
aaagggggttcagaaaggga

SEQ ID NO: 98973 - DNA, 20 bp, synthetic construct
  misc_feature 1..20: note = CRISPR gRNA sequence
  source 1..20: mol_type = other DNA
agggggttcagaaagggaga

SEQ ID NO: 98974 - DNA, 20 bp, synthetic construct
  misc_feature 1..20: note = CRISPR gRNA sequence
  source 1..20: mol_type = other DNA
gttcttccccctctcctgcc

SEQ ID NO: 98975 - DNA, 20 bp, synthetic construct
  misc_feature 1..20: note = CRISPR gRNA sequence
  source 1..20: mol_type = other DNA
ttcttccccctctcctgcct

SEQ ID NO: 98976 - DNA, 20 bp, synthetic construct
  misc_feature 1..20: note = CRISPR gRNA sequence
  source 1..20: mol_type = other DNA
ctgcctgggtgtcgctccac

SEQ ID NO: 98977 - DNA, 20 bp, synthetic construct
  misc_feature 1..20: note = CRISPR gRNA sequence
  source 1..20: mol_type = other DNA
gtgtcgctccaccagcctcc

SEQ ID NO: 98978 - DNA, 20 bp, synthetic construct
  misc_feature 1..20: note = CRISPR gRNA sequence
  source 1..20: mol_type = other DNA
cctcctcactgcgccacccc

SEQ ID NO: 98979 - DNA, 20 bp, synthetic construct
  misc_feature 1..20: note = CRISPR gRNA sequence
  source 1..20: mol_type = other DNA
ctcctcactgcgccaccccc

SEQ ID NO: 98980 - DNA, 20 bp, synthetic construct
  misc_feature 1..20: note = CRISPR gRNA sequence
  source 1..20: mol_type = other DNA
ctccttccctgcgtctcaca

SEQ ID NO: 98981 - DNA, 20 bp, synthetic construct
  misc_feature 1..20: note = CRISPR gRNA sequence
  source 1..20: mol_type = other DNA
cagcccctttcttgtccgca

SEQ ID NO: 98982 - DNA, 20 bp, synthetic construct
  misc_feature 1..20: note = CRISPR gRNA sequence
  source 1..20: mol_type = other DNA
ctttcttgtccgcaaagact

SEQ ID NO: 98983 - DNA, 20 bp, synthetic construct
  misc_feature 1..20: note = CRISPR gRNA sequence
  source 1..20: mol_type = other DNA
tttcttgtccgcaaagactg

SEQ ID NO: 98984 - DNA, 20 bp, synthetic construct
  misc_feature 1..20: note = CRISPR gRNA sequence
  source 1..20: mol_type = other DNA
tcttgtccgcaaagactgag

SEQ ID NO: 98985 - DNA, 20 bp, synthetic construct
  misc_feature 1..20: note = CRISPR gRNA sequence
  source 1..20: mol_type = other DNA
tgtccgcaaagactgaggag

SEQ ID NO: 98986 - DNA, 20 bp, synthetic construct
  misc_feature 1..20: note = CRISPR gRNA sequence
  source 1..20: mol_type = other DNA
gtccgcaaagactgaggagc

SEQ ID NO: 98987 - DNA, 20 bp, synthetic construct
  misc_feature 1..20: note = CRISPR gRNA sequence
  source 1..20: mol_type = other DNA
tccgcaaagactgaggagcg

SEQ ID NO: 98988 - DNA, 20 bp, synthetic construct
  misc_feature 1..20: note = CRISPR gRNA sequence
  source 1..20: mol_type = other DNA
cgcaaagactgaggagcggg

SEQ ID NO: 98989 - DNA, 20 bp, synthetic construct
  misc_feature 1..20: note = CRISPR gRNA sequence
  source 1..20: mol_type = other DNA
gcaaagactgaggagcgggg

SEQ ID NO: 98990 - DNA, 20 bp, synthetic construct
  misc_feature 1..20: note = CRISPR gRNA sequence
  source 1..20: mol_type = other DNA
caaagactgaggagcgggga

SEQ ID NO: 98991 - DNA, 20 bp, synthetic construct
  misc_feature 1..20: note = CRISPR gRNA sequence
  source 1..20: mol_type = other DNA
agactgaggagcggggaggg

SEQ ID NO: 98992 - DNA, 20 bp, synthetic construct
  misc_feature 1..20: note = CRISPR gRNA sequence
  source 1..20: mol_type = other DNA
gactgaggagcggggagggc

SEQ ID NO: 98993 - DNA, 20 bp, synthetic construct
  misc_feature 1..20: note = CRISPR gRNA sequence
  source 1..20: mol_type = other DNA
gagggcgggccctctgacac

SEQ ID NO: 98994 - DNA, 20 bp, synthetic construct
  misc_feature 1..20: note = CRISPR gRNA sequence
  source 1..20: mol_type = other DNA
cgggccctctgacaccggaa

SEQ ID NO: 98995 - DNA, 20 bp, synthetic construct
  misc_feature 1..20: note = CRISPR gRNA sequence
  source 1..20: mol_type = other DNA
gggccctctgacaccggaac

SEQ ID NO: 98996 - DNA, 20 bp, synthetic construct
  misc_feature 1..20: note = CRISPR gRNA sequence
  source 1..20: mol_type = other DNA
gccctctgacaccggaacag

SEQ ID NO: 98997 - DNA, 20 bp, synthetic construct
  misc_feature 1..20: note = CRISPR gRNA sequence
  source 1..20: mol_type = other DNA
acaccggaacaggagccgtg

SEQ ID NO: 98998 - DNA, 20 bp, synthetic construct
  misc_feature 1..20: note = CRISPR gRNA sequence
  source 1..20: mol_type = other DNA
aacaggagccgtgcggcgtc

SEQ ID NO: 98999 - DNA, 20 bp, synthetic construct
  misc_feature 1..20: note = CRISPR gRNA sequence
  source 1..20: mol_type = other DNA
agccgtgcggcgtccggttt

SEQ ID NO: 99000 - DNA, 20 bp, synthetic construct
  misc_feature 1..20: note = CRISPR gRNA sequence
  source 1..20: mol_type = other DNA
cgtgcggcgtccggtttcag

SEQ ID NO: 99001 - DNA, 20 bp, synthetic construct
  misc_feature 1..20: note = CRISPR gRNA sequence
  source 1..20: mol_type = other DNA
gtgcggcgtccggtttcagc

SEQ ID NO: 99002 - DNA, 20 bp, synthetic construct
  misc_feature 1..20: note = CRISPR gRNA sequence
  source 1..20: mol_type = other DNA
tgcggcgtccggtttcagca

SEQ ID NO: 99003 - DNA, 20 bp, synthetic construct
  misc_feature 1..20: note = CRISPR gRNA sequence
  source 1..20: mol_type = other DNA
ggcgtccggtttcagcaggg

SEQ ID NO: 99004 - DNA, 20 bp, synthetic construct
  misc_feature 1..20: note = CRISPR gRNA sequence
  source 1..20: mol_type = other DNA
gcgtccggtttcagcaggga

SEQ ID NO: 99005 - DNA, 20 bp, synthetic construct
  misc_feature 1..20: note = CRISPR gRNA sequence
  source 1..20: mol_type = other DNA
cggtttcagcagggaaggct

SEQ ID NO: 99006 - DNA, 20 bp, synthetic construct
  misc_feature 1..20: note = CRISPR gRNA sequence
  source 1..20: mol_type = other DNA
ggtttcagcagggaaggctt

SEQ ID NO: 99007 - DNA, 20 bp, synthetic construct
  misc_feature 1..20: note = CRISPR gRNA sequence
  source 1..20: mol_type = other DNA
ttcagcagggaaggcttagg

SEQ ID NO: 99008 - DNA, 20 bp, synthetic construct
  misc_feature 1..20: note = CRISPR gRNA sequence
  source 1..20: mol_type = other DNA
tcagcagggaaggcttaggc

SEQ ID NO: 99009 - DNA, 20 bp, synthetic construct
  misc_feature 1..20: note = CRISPR gRNA sequence
  source 1..20: mol_type = other DNA
taggcgggcgtcccaacctc

SEQ ID NO: 99010 - DNA, 20 bp, synthetic construct
  misc_feature 1..20: note = CRISPR gRNA sequence
  source 1..20: mol_type = other DNA
aggcgggcgtcccaacctcc

SEQ ID NO: 99011 - DNA, 20 bp, synthetic construct
  misc_feature 1..20: note = CRISPR gRNA sequence
  source 1..20: mol_type = other DNA
cgtcccaacctccgggcttc

SEQ ID NO: 99012 - DNA, 20 bp, synthetic construct
  misc_feature 1..20: note = CRISPR gRNA sequence
  source 1..20: mol_type = other DNA
gggcttccggtgccgtttcc

SEQ ID NO: 99013 - DNA, 20 bp, synthetic construct
  misc_feature 1..20: note = CRISPR gRNA sequence
  source 1..20: mol_type = other DNA
gtgccgtttcccggttcgct

SEQ ID NO: 99014 - DNA, 20 bp, synthetic construct
  misc_feature 1..20: note = CRISPR gRNA sequence
  source 1..20: mol_type = other DNA
tttcccggttcgctcggccg

SEQ ID NO: 99015 - DNA, 20 bp, synthetic construct
  misc_feature 1..20: note = CRISPR gRNA sequence
  source 1..20: mol_type = other DNA
tcgctcggccgcggtcgcta

SEQ ID NO: 99016 - DNA, 20 bp, synthetic construct
  misc_feature 1..20: note = CRISPR gRNA sequence
  source 1..20: mol_type = other DNA
gctcggccgcggtcgctatg

SEQ ID NO: 99017 - DNA, 20 bp, synthetic construct
  misc_feature 1..20: note = CRISPR gRNA sequence
  source 1..20: mol_type = other DNA
ctcggccgcggtcgctatgg

SEQ ID NO: 99018 - DNA, 20 bp, synthetic construct
  misc_feature 1..20: note = CRISPR gRNA sequence
  source 1..20: mol_type = other DNA
cggccgcggtcgctatggag

SEQ ID NO: 99019 - DNA, 20 bp, synthetic construct
  misc_feature 1..20: note = CRISPR gRNA sequence
  source 1..20: mol_type = other DNA
cgcggtcgctatggaggagc

SEQ ID NO: 99020 - DNA, 20 bp, synthetic construct
  misc_feature 1..20: note = CRISPR gRNA sequence
  source 1..20: mol_type = other DNA
cggtcgctatggaggagccg

SEQ ID NO: 99021 - DNA, 20 bp, synthetic construct
  misc_feature 1..20: note = CRISPR gRNA sequence
  source 1..20: mol_type = other DNA
gcagggaaggaggcacaccc

SEQ ID NO: 99022 - DNA, 20 bp, synthetic construct
  misc_feature 1..20: note = CRISPR gRNA sequence
  source 1..20: mol_type = other DNA
aacccccttttccttgagag

SEQ ID NO: 99023 - DNA, 20 bp, synthetic construct
  misc_feature 1..20: note = CRISPR gRNA sequence
  source 1..20: mol_type = other DNA
ttccttgagagacgagttgg

SEQ ID NO: 99024 - DNA, 20 bp, synthetic construct
  misc_feature 1..20: note = CRISPR gRNA sequence
  source 1..20: mol_type = other DNA
cctctggaaaaatctgtggg

SEQ ID NO: 99025 - DNA, 20 bp, synthetic construct
  misc_feature 1..20: note = CRISPR gRNA sequence
  source 1..20: mol_type = other DNA
ttaggccccgcccattccct

SEQ ID NO: 99026 - DNA, 20 bp, synthetic construct
  misc_feature 1..20: note = CRISPR gRNA sequence
  source 1..20: mol_type = other DNA
cttcctcacttttggggggc

SEQ ID NO: 99027 - DNA, 20 bp, synthetic construct
  misc_feature 1..20: note = CRISPR gRNA sequence
  source 1..20: mol_type = other DNA
caagcgcagtgggggagctc

SEQ ID NO: 99028 - DNA, 20 bp, synthetic construct
  misc_feature 1..20: note = CRISPR gRNA sequence
  source 1..20: mol_type = other DNA
cagtgggggagctctggggt

SEQ ID NO: 99029 - DNA, 20 bp, synthetic construct
  misc_feature 1..20: note = CRISPR gRNA sequence
  source 1..20: mol_type = other DNA
ctctggggtgggggtagcgg

SEQ ID NO: 99030 - DNA, 20 bp, synthetic construct
  misc_feature 1..20: note = CRISPR gRNA sequence
  source 1..20: mol_type = other DNA
gcagaggaagccagatcgct

SEQ ID NO: 99031 - DNA, 20 bp, synthetic construct
  misc_feature 1..20: note = CRISPR gRNA sequence
  source 1..20: mol_type = other DNA
cagaggaggctcgtggggag

SEQ ID NO: 99032 - DNA, 20 bp, synthetic construct
  misc_feature 1..20: note = CRISPR gRNA sequence
  source 1..20: mol_type = other DNA
tggggaggtgagtggacctc

SEQ ID NO: 99033 - DNA, 20 bp, synthetic construct
  misc_feature 1..20: note = CRISPR gRNA sequence
  source 1..20: mol_type = other DNA
cctggatcgatttaggaggc

SEQ ID NO: 99034 - DNA, 20 bp, synthetic construct
  misc_feature 1..20: note = CRISPR gRNA sequence
  source 1..20: mol_type = other DNA
agcccctcccaacaaccata

SEQ ID NO: 99035 - DNA, 20 bp, synthetic construct
  misc_feature 1..20: note = CRISPR gRNA sequence
  source 1..20: mol_type = other DNA
ttctcacggcctataaattg

SEQ ID NO: 99036 - DNA, 20 bp, synthetic construct
  misc_feature 1..20: note = CRISPR gRNA sequence
  source 1..20: mol_type = other DNA
ttttttttttttttttgaga

SEQ ID NO: 99037 - DNA, 20 bp, synthetic construct
  misc_feature 1..20: note = CRISPR gRNA sequence
  source 1..20: mol_type = other DNA
ctcaccgcaacctccacctc

SEQ ID NO: 99038 - DNA, 20 bp, synthetic construct
  misc_feature 1..20: note = CRISPR gRNA sequence
  source 1..20: mol_type = other DNA
agcaattctgcctcagcctc

SEQ ID NO: 99039 - DNA, 20 bp, synthetic construct
  misc_feature 1..20: note = CRISPR gRNA sequence
  source 1..20: mol_type = other DNA
gcctcagcctcccgagtagc

SEQ ID NO: 99040 - DNA, 20 bp, synthetic construct
  misc_feature 1..20: note = CRISPR gRNA sequence
  source 1..20: mol_type = other DNA
ttttgtatttttagtacaga

SEQ ID NO: 99041 - DNA, 20 bp, synthetic construct
  misc_feature 1..20: note = CRISPR gRNA sequence
  source 1..20: mol_type = other DNA
tcctcggcctcccaaagtgc

SEQ ID NO: 99042 - DNA, 20 bp, synthetic construct
  misc_feature 1..20: note = CRISPR gRNA sequence
  source 1..20: mol_type = other DNA
ttgtaggtgctttggtggtg

SEQ ID NO: 99043 - DNA, 20 bp, synthetic construct
  misc_feature 1..20: note = CRISPR gRNA sequence
  source 1..20: mol_type = other DNA
cagtctctttccctgcacaa

SEQ ID NO: 99044 - DNA, 20 bp, synthetic construct
  misc_feature 1..20: note = CRISPR gRNA sequence
  source 1..20: mol_type = other DNA
atgccagtgtttcctctcca

SEQ ID NO: 99045 - DNA, 20 bp, synthetic construct
  misc_feature 1..20: note = CRISPR gRNA sequence
  source 1..20: mol_type = other DNA
agtgtttcctctccacaggg

SEQ ID NO: 99046 - DNA, 20 bp, synthetic construct
  misc_feature 1..20: note = CRISPR gRNA sequence
  source 1..20: mol_type = other DNA
acagggtaggatacctcctc

SEQ ID NO: 99047 - DNA, 20 bp, synthetic construct
  misc_feature 1..20: note = CRISPR gRNA sequence
  source 1..20: mol_type = other DNA
ctcctctgggattagccctc

SEQ ID NO: 99048 - DNA, 20 bp, synthetic construct
  misc_feature 1..20: note = CRISPR gRNA sequence
  source 1..20: mol_type = other DNA
cctctgggattccatgatga

SEQ ID NO: 99049 - DNA, 20 bp, synthetic construct
  misc_feature 1..20: note = CRISPR gRNA sequence
  source 1..20: mol_type = other DNA
tgttttgttgttttttgaga

SEQ ID NO: 99050 - DNA, 20 bp, synthetic construct
  misc_feature 1..20: note = CRISPR gRNA sequence
  source 1..20: mol_type = other DNA
tttgctcttgttgcccatgc

SEQ ID NO: 99051 - DNA, 20 bp, synthetic construct
  misc_feature 1..20: note = CRISPR gRNA sequence
  source 1..20: mol_type = other DNA
ctcactgcaacctctgcctc

SEQ ID NO: 99052 - DNA, 20 bp, synthetic construct
  misc_feature 1..20: note = CRISPR gRNA sequence
  source 1..20: mol_type = other DNA
gattctcctgtctcagcctc

SEQ ID NO: 99053 - DNA, 20 bp, synthetic construct
  misc_feature 1..20: note = CRISPR gRNA sequence
  source 1..20: mol_type = other DNA
gtctcagcctcctgagtagc

SEQ ID NO: 99054 - DNA, 20 bp, synthetic construct
  misc_feature 1..20: note = CRISPR gRNA sequence
  source 1..20: mol_type = other DNA
cactacgcccagctaatttt

SEQ ID NO: 99055 - DNA, 20 bp, synthetic construct
  misc_feature 1..20: note = CRISPR gRNA sequence
  source 1..20: mol_type = other DNA
ttgggtatttttagtagaga

SEQ ID NO: 99056 - DNA, 20 bp, synthetic construct
  misc_feature 1..20: note = CRISPR gRNA sequence
  source 1..20: mol_type = other DNA
acctcggcctcccaaagtgc

SEQ ID NO: 99057 - DNA, 20 bp, synthetic construct
  misc_feature 1..20: note = CRISPR gRNA sequence
  source 1..20: mol_type = other DNA
cctgtttttgttttttgata

SEQ ID NO: 99058 - DNA, 20 bp, synthetic construct
  misc_feature 1..20: note = CRISPR gRNA sequence
  source 1..20: mol_type = other DNA
tctcgctctgttactaaggc

SEQ ID NO: 99059 - DNA, 20 bp, synthetic construct
  misc_feature 1..20: note = CRISPR gRNA sequence
  source 1..20: mol_type = other DNA
gcctccacttccgaaagtgc

SEQ ID NO: 99060 - DNA, 20 bp, synthetic construct
  misc_feature 1..20: note = CRISPR gRNA sequence
  source 1..20: mol_type = other DNA
acacctgtttttaactcttt

SEQ ID NO: 99061 - DNA, 20 bp, synthetic construct
  misc_feature 1..20: note = CRISPR gRNA sequence
  source 1..20: mol_type = other DNA
ctctttgagggtagatagct

SEQ ID NO: 99062 - DNA, 20 bp, synthetic construct
  misc_feature 1..20: note = CRISPR gRNA sequence
  source 1..20: mol_type = other DNA
gatagctaggagtgaaatta

SEQ ID NO: 99063 - DNA, 20 bp, synthetic construct
  misc_feature 1..20: note = CRISPR gRNA sequence
  source 1..20: mol_type = other DNA
gttttacttactgaggaact

SEQ ID NO: 99064 - DNA, 20 bp, synthetic construct
  misc_feature 1..20: note = CRISPR gRNA sequence
  source 1..20: mol_type = other DNA
actgaggatttatttttgat

SEQ ID NO: 99065 - DNA, 20 bp, synthetic construct
  misc_feature 1..20: note = CRISPR gRNA sequence
  source 1..20: mol_type = other DNA
tttatttttgattggagtcc

SEQ ID NO: 99066 - DNA, 20 bp, synthetic construct
  misc_feature 1..20: note = CRISPR gRNA sequence
  source 1..20: mol_type = other DNA
ttgttgctgccactcctgtc

SEQ ID NO: 99067 - DNA, 20 bp, synthetic construct
  misc_feature 1..20: note = CRISPR gRNA sequence
  source 1..20: mol_type = other DNA
ctttctttctttttttgaga

SEQ ID NO: 99068 - DNA, 20 bp, synthetic construct
  misc_feature 1..20: note = CRISPR gRNA sequence
  source 1..20: mol_type = other DNA
tctcgctctgtcgcccaggc

SEQ ID NO: 99069 - DNA, 20 bp, synthetic construct
  misc_feature 1..20: note = CRISPR gRNA sequence
  source 1..20: mol_type = other DNA
gtcgcccaggctggagtgca

SEQ ID NO: 99070 - DNA, 20 bp, synthetic construct
  misc_feature 1..20: note = CRISPR gRNA sequence
  source 1..20: mol_type = other DNA
cattctcctgcttcagcctc

SEQ ID NO: 99071 - DNA, 20 bp, synthetic construct
  misc_feature 1..20: note = CRISPR gRNA sequence
  source 1..20: mol_type = other DNA
ccccactctcgagacgcctc

SEQ ID NO: 99072 - DNA, 20 bp, synthetic construct
  misc_feature 1..20: note = CRISPR gRNA sequence
  source 1..20: mol_type = other DNA
gatcccctctcttcttgaga

SEQ ID NO: 99073 - DNA, 20 bp, synthetic construct
  misc_feature 1..20: note = CRISPR gRNA sequence
  source 1..20: mol_type = other DNA
cagaatcttgctctgttgtc

SEQ ID NO: 99074 - DNA, 20 bp, synthetic construct
  misc_feature 1..20: note = CRISPR gRNA sequence
  source 1..20: mol_type = other DNA
tcttgctctgttgtccaggg

SEQ ID NO: 99075 - DNA, 20 bp, synthetic construct
  misc_feature 1..20: note = CRISPR gRNA sequence
  source 1..20: mol_type = other DNA
actcactgcaactccctctc

SEQ ID NO: 99076 - DNA, 20 bp, synthetic construct
  misc_feature 1..20: note = CRISPR gRNA sequence
  source 1..20: mol_type = other DNA
ttttgtgtttttagtagaga

SEQ ID NO: 99077 - DNA, 20 bp, synthetic construct
  misc_feature 1..20: note = CRISPR gRNA sequence
  source 1..20: mol_type = other DNA
gcctcggcctcccaaagtgc

SEQ ID NO: 99078 - DNA, 20 bp, synthetic construct
  misc_feature 1..20: note = CRISPR gRNA sequence
  source 1..20: mol_type = other DNA
caccgcgcccagtccctgta

SEQ ID NO: 99079 - DNA, 20 bp, synthetic construct
  misc_feature 1..20: note = CRISPR gRNA sequence
  source 1..20: mol_type = other DNA
ttttttttttttttttgaga

SEQ ID NO: 99080 - DNA, 20 bp, synthetic construct
  misc_feature 1..20: note = CRISPR gRNA sequence
  source 1..20: mol_type = other DNA
ctcactcttgttgcccaggc

SEQ ID NO: 99081 - DNA, 20 bp, synthetic construct
  misc_feature 1..20: note = CRISPR gRNA sequence
  source 1..20: mol_type = other DNA
ctcactgcaacctccacctc

SEQ ID NO: 99082 - DNA, 20 bp, synthetic construct
  misc_feature 1..20: note = CRISPR gRNA sequence
  source 1..20: mol_type = other DNA
gattctcctgcctcagcctc

SEQ ID NO: 99083 - DNA, 20 bp, synthetic construct
  misc_feature 1..20: note = CRISPR gRNA sequence
  source 1..20: mol_type = other DNA
gcctcagcctcccgagtagc

SEQ ID NO: 99084 - DNA, 20 bp, synthetic construct
  misc_feature 1..20: note = CRISPR gRNA sequence
  source 1..20: mol_type = other DNA
ttttgtgtttttagtagagg

SEQ ID NO: 99085 - DNA, 20 bp, synthetic construct
  misc_feature 1..20: note = CRISPR gRNA sequence
  source 1..20: mol_type = other DNA
acctcagcctcccaaagtgc

SEQ ID NO: 99086 - DNA, 20 bp, synthetic construct
  misc_feature 1..20: note = CRISPR gRNA sequence
  source 1..20: mol_type = other DNA
agggaggagaaagatgcacc

SEQ ID NO: 99087 - DNA, 20 bp, synthetic construct
  misc_feature 1..20: note = CRISPR gRNA sequence
  source 1..20: mol_type = other DNA
gatgcaccctgggtattcaa

SEQ ID NO: 99088 - DNA, 20 bp, synthetic construct
  misc_feature 1..20: note = CRISPR gRNA sequence
  source 1..20: mol_type = other DNA
accctgggtattcaagagag

SEQ ID NO: 99089 - DNA, 20 bp, synthetic construct
  misc_feature 1..20: note = CRISPR gRNA sequence
  source 1..20: mol_type = other DNA
tgggtattcaagagagtaga

SEQ ID NO: 99090 - DNA, 20 bp, synthetic construct
  misc_feature 1..20: note = CRISPR gRNA sequence
  source 1..20: mol_type = other DNA
tattcaagagagtagagtga

SEQ ID NO: 99091 - DNA, 20 bp, synthetic construct
  misc_feature 1..20: note = CRISPR gRNA sequence
  source 1..20: mol_type = other DNA
agagtagagtgagtgaatgg

SEQ ID NO: 99092 - DNA, 20 bp, synthetic construct
  misc_feature 1..20: note = CRISPR gRNA sequence
  source 1..20: mol_type = other DNA
actttgggaggccacggcag

SEQ ID NO: 99093 - DNA, 20 bp, synthetic construct
  misc_feature 1..20: note = CRISPR gRNA sequence
  source 1..20: mol_type = other DNA
caggagaattgcttgagccc

SEQ ID NO: 99094 - DNA, 20 bp, synthetic construct
  misc_feature 1..20: note = CRISPR gRNA sequence
  source 1..20: mol_type = other DNA
atatatatatttttaatttg

SEQ ID NO: 99095 - DNA, 20 bp, synthetic construct
  misc_feature 1..20: note = CRISPR gRNA sequence
  source 1..20: mol_type = other DNA
aaaaaaaaaaaccccaatag

SEQ ID NO: 99096 - DNA, 20 bp, synthetic construct
  misc_feature 1..20: note = CRISPR gRNA sequence
  source 1..20: mol_type = other DNA
actttgggaggctgaggcag

SEQ ID NO: 99097 - DNA, 20 bp, synthetic construct
  misc_feature 1..20: note = CRISPR gRNA sequence
  source 1..20: mol_type = other DNA
caggtggatgatttgaggtc

SEQ ID NO: 99098 - DNA, 20 bp, synthetic construct
  misc_feature 1..20: note = CRISPR gRNA sequence
  source 1..20: mol_type = other DNA
tactcgggaggctgaggcac

SEQ ID NO: 99099 - DNA, 20 bp, synthetic construct
  misc_feature 1..20: note = CRISPR gRNA sequence
  source 1..20: mol_type = other DNA
tctgccggccaccctagact

SEQ ID NO: 99100 - DNA, 20 bp, synthetic construct
  misc_feature 1..20: note = CRISPR gRNA sequence
  source 1..20: mol_type = other DNA
ccacggtccccaacaaggag

SEQ ID NO: 99101 - DNA, 20 bp, synthetic construct
  misc_feature 1..20: note = CRISPR gRNA sequence
  source 1..20: mol_type = other DNA
cccaacaaggagaggagtag

SEQ ID NO: 99102 - DNA, 20 bp, synthetic construct
  misc_feature 1..20: note = CRISPR gRNA sequence
  source 1..20: mol_type = other DNA
gtgaggagcaatcgtggaca

SEQ ID NO: 99103 - DNA, 20 bp, synthetic construct
  misc_feature 1..20: note = CRISPR gRNA sequence
  source 1..20: mol_type = other DNA
actgaggcacagagaagcaa

SEQ ID NO: 99104 - DNA, 20 bp, synthetic construct
  misc_feature 1..20: note = CRISPR gRNA sequence
  source 1..20: mol_type = other DNA
aggcacagagaagcaagggg

SEQ ID NO: 99105 - DNA, 20 bp, synthetic construct
  misc_feature 1..20: note = CRISPR gRNA sequence
  source 1..20: mol_type = other DNA
cacctggctggtgtgtgcat

SEQ ID NO: 99106 - DNA, 20 bp, synthetic construct
  misc_feature 1..20: note = CRISPR gRNA sequence
  source 1..20: mol_type = other DNA
acccactcatgacgtgacct

SEQ ID NO: 99107 - DNA, 20 bp, synthetic construct
  misc_feature 1..20: note = CRISPR gRNA sequence
  source 1..20: mol_type = other DNA
cgtccccatttggcagcact

SEQ ID NO: 99108 - DNA, 20 bp, synthetic construct
  misc_feature 1..20: note = CRISPR gRNA sequence
  source 1..20: mol_type = other DNA
cagcactggggatagggggc

SEQ ID NO: 99109 - DNA, 20 bp, synthetic construct
  misc_feature 1..20: note = CRISPR gRNA sequence
  source 1..20: mol_type = other DNA
tgagaccgttcgcttcctgc

SEQ ID NO: 99110 - DNA, 20 bp, synthetic construct
  misc_feature 1..20: note = CRISPR gRNA sequence
  source 1..20: mol_type = other DNA
accgttcgcttcctgctgga

SEQ ID NO: 99111 - DNA, 20 bp, synthetic construct
  misc_feature 1..20: note = CRISPR gRNA sequence
  source 1..20: mol_type = other DNA
ccagcccagctgggcagctg

SEQ ID NO: 99112 - DNA, 20 bp, synthetic construct
  misc_feature 1..20: note = CRISPR gRNA sequence
  source 1..20: mol_type = other DNA
tggggggttcccgggggcct

SEQ ID NO: 99113 - DNA, 20 bp, synthetic construct
  misc_feature 1..20: note = CRISPR gRNA sequence
  source 1..20: mol_type = other DNA
ccgggggccttagggtgggc

SEQ ID NO: 99114 - DNA, 20 bp, synthetic construct
  misc_feature 1..20: note = CRISPR gRNA sequence
  source 1..20: mol_type = other DNA
ctttgagatgcggctgctgg

SEQ ID NO: 99115 - DNA, 20 bp, synthetic construct
  misc_feature 1..20: note = CRISPR gRNA sequence
  source 1..20: mol_type = other DNA
cagcactttgggaggccgag

SEQ ID NO: 99116 - DNA, 20 bp, synthetic construct
  misc_feature 1..20: note = CRISPR gRNA sequence
  source 1..20: mol_type = other DNA
actttgggaggccgaggcgg

SEQ ID NO: 99117 - DNA, 20 bp, synthetic construct
  misc_feature 1..20: note = CRISPR gRNA sequence
  source 1..20: mol_type = other DNA
cgggtggatcacttgaggtc

SEQ ID NO: 99118 - DNA, 20 bp, synthetic construct
  misc_feature 1..20: note = CRISPR gRNA sequence
  source 1..20: mol_type = other DNA
tcaagaccagcccggccaac

SEQ ID NO: 99119 - DNA, 20 bp, synthetic construct
  misc_feature 1..20: note = CRISPR gRNA sequence
  source 1..20: mol_type = other DNA
aaaattagccaggcgtcgtg

SEQ ID NO: 99120 - DNA, 20 bp, synthetic construct
  misc_feature 1..20: note = CRISPR gRNA sequence
  source 1..20: mol_type = other DNA
aaaaaaaagatgcggctgct

SEQ ID NO: 99121 - DNA, 20 bp, synthetic construct
  misc_feature 1..20: note = CRISPR gRNA sequence
  source 1..20: mol_type = other DNA
tgcggctgctgtgggtaccc

SEQ ID NO: 99122 - DNA, 20 bp, synthetic construct
  misc_feature 1..20: note = CRISPR gRNA sequence
  source 1..20: mol_type = other DNA
actgtcccttcttctccctg

SEQ ID NO: 99123 - DNA, 20 bp, synthetic construct
  misc_feature 1..20: note = CRISPR gRNA sequence
  source 1..20: mol_type = other DNA
gtggacatcaacatctatga

SEQ ID NO: 99124 - DNA, 20 bp, synthetic construct
  misc_feature 1..20: note = CRISPR gRNA sequence
  source 1..20: mol_type = other DNA
attcctgcctcaaatgttca

SEQ ID NO: 99125 - DNA, 20 bp, synthetic construct
  misc_feature 1..20: note = CRISPR gRNA sequence
  source 1..20: mol_type = other DNA
ccacgttcaactggaggcca

SEQ ID NO: 99126 - DNA, 20 bp, synthetic construct
  misc_feature 1..20: note = CRISPR gRNA sequence
  source 1..20: mol_type = other DNA
cagagagtacaaggcatttt

SEQ ID NO: 99127 - DNA, 20 bp, synthetic construct
  misc_feature 1..20: note = CRISPR gRNA sequence
  source 1..20: mol_type = other DNA
tctcctgcccctacccacga

SEQ ID NO: 99128 - DNA, 20 bp, synthetic construct
  misc_feature 1..20: note = CRISPR gRNA sequence
  source 1..20: mol_type = other DNA
tgaaatgcgttgaggccttg

SEQ ID NO: 99129 - DNA, 20 bp, synthetic construct
  misc_feature 1..20: note = CRISPR gRNA sequence
  source 1..20: mol_type = other DNA
atgcgttgaggccttgctgg

SEQ ID NO: 99130 - DNA, 20 bp, synthetic construct
  misc_feature 1..20: note = CRISPR gRNA sequence
  source 1..20: mol_type = other DNA
tgaggccttgctgggtgagt

SEQ ID NO: 99131 - DNA, 20 bp, synthetic construct
  misc_feature 1..20: note = CRISPR gRNA sequence
  source 1..20: mol_type = other DNA
ttgctgggtgagtgggagtc

SEQ ID NO: 99132 - DNA, 20 bp, synthetic construct
  misc_feature 1..20: note = CRISPR gRNA sequence
  source 1..20: mol_type = other DNA
agcactccagcgggccctgc

SEQ ID NO: 99133 - DNA, 20 bp, synthetic construct
  misc_feature 1..20: note = CRISPR gRNA sequence
  source 1..20: mol_type = other DNA
agacgcccaagtgttgcttg

SEQ ID NO: 99134 - DNA, 20 bp, synthetic construct
  misc_feature 1..20: note = CRISPR gRNA sequence
  source 1..20: mol_type = other DNA
gtccctgcctgctcttctcg

SEQ ID NO: 99135 - DNA, 20 bp, synthetic construct
  misc_feature 1..20: note = CRISPR gRNA sequence
  source 1..20: mol_type = other DNA
ctgcctgctcttctcggagg

SEQ ID NO: 99136 - DNA, 20 bp, synthetic construct
  misc_feature 1..20: note = CRISPR gRNA sequence
  source 1..20: mol_type = other DNA
aggaggtggtaggaccacac

SEQ ID NO: 99137 - DNA, 20 bp, synthetic construct
  misc_feature 1..20: note = CRISPR gRNA sequence
  source 1..20: mol_type = other DNA
tggtaggaccacacgggagt

SEQ ID NO: 99138 - DNA, 20 bp, synthetic construct
  misc_feature 1..20: note = CRISPR gRNA sequence
  source 1..20: mol_type = other DNA
gaccacacgggagtcggggt

SEQ ID NO: 99139 - DNA, 20 bp, synthetic construct
  misc_feature 1..20: note = CRISPR gRNA sequence
  source 1..20: mol_type = other DNA
cgggagtcggggtctgggtt

SEQ ID NO: 99140 - DNA, 20 bp, synthetic construct
  misc_feature 1..20: note = CRISPR gRNA sequence
  source 1..20: mol_type = other DNA
agacccacggctgcattgtg

SEQ ID NO: 99141 - DNA, 20 bp, synthetic construct
  misc_feature 1..20: note = CRISPR gRNA sequence
  source 1..20: mol_type = other DNA
cggctgcattgtggggaatg

SEQ ID NO: 99142 - DNA, 20 bp, synthetic construct
  misc_feature 1..20: note = CRISPR gRNA sequence
  source 1..20: mol_type = other DNA
gtggggaatgaggggtgcca

SEQ ID NO: 99143 - DNA, 20 bp, synthetic construct
  misc_feature 1..20: note = CRISPR gRNA sequence
  source 1..20: mol_type = other DNA
gatggaccttgccgtggccc

SEQ ID NO: 99144 - DNA, 20 bp, synthetic construct
  misc_feature 1..20: note = CRISPR gRNA sequence
  source 1..20: mol_type = other DNA
cagcctgagacacacagagc

SEQ ID NO: 99145 - DNA, 20 bp, synthetic construct
  misc_feature 1..20: note = CRISPR gRNA sequence
  source 1..20: mol_type = other DNA
tgagacacacagagcagggg

SEQ ID NO: 99146 - DNA, 20 bp, synthetic construct
  misc_feature 1..20: note = CRISPR gRNA sequence
  source 1..20: mol_type = other DNA
ggtggggtcccttccatagg

SEQ ID NO: 99147 - DNA, 20 bp, synthetic construct
  misc_feature 1..20: note = CRISPR gRNA sequence
  source 1..20: mol_type = other DNA
cataggcagggtgaccataa

SEQ ID NO: 99148 - DNA, 20 bp, synthetic construct
  misc_feature 1..20: note = CRISPR gRNA sequence
  source 1..20: mol_type = other DNA
agtggtcatacgccggcagc

SEQ ID NO: 99149 - DNA, 20 bp, synthetic construct
  misc_feature 1..20: note = CRISPR gRNA sequence
  source 1..20: mol_type = other DNA
tcctggggctccacatgtgc

SEQ ID NO: 99150 - DNA, 20 bp, synthetic construct
  misc_feature 1..20: note = CRISPR gRNA sequence
  source 1..20: mol_type = other DNA
gtgctggggtagggaggaca

SEQ ID NO: 99151 - DNA, 20 bp, synthetic construct
  misc_feature 1..20: note = CRISPR gRNA sequence
  source 1..20: mol_type = other DNA
aagtgaggtgggcccagccc

SEQ ID NO: 99152 - DNA, 20 bp, synthetic construct
  misc_feature 1..20: note = CRISPR gRNA sequence
  source 1..20: mol_type = other DNA
ctgggatggggaggtcaggg

SEQ ID NO: 99153 - DNA, 20 bp, synthetic construct
  misc_feature 1..20: note = CRISPR gRNA sequence
  source 1..20: mol_type = other DNA
ctgggggacctgaagggagg

SEQ ID NO: 99154 - DNA, 20 bp, synthetic construct
  misc_feature 1..20: note = CRISPR gRNA sequence
  source 1..20: mol_type = other DNA
gagaatggcatccaggtggg

SEQ ID NO: 99155 - DNA, 20 bp, synthetic construct
  misc_feature 1..20: note = CRISPR gRNA sequence
  source 1..20: mol_type = other DNA
gcctggcagtgaggacacca

SEQ ID NO: 99156 - DNA, 20 bp, synthetic construct
  misc_feature 1..20: note = CRISPR gRNA sequence
  source 1..20: mol_type = other DNA
atccctctccgtggcgggca

SEQ ID NO: 99157 - DNA, 20 bp, synthetic construct
  misc_feature 1..20: note = CRISPR gRNA sequence
  source 1..20: mol_type = other DNA
tcccaattgaaccgaccccc

SEQ ID NO: 99158 - DNA, 20 bp, synthetic construct
  misc_feature 1..20: note = CRISPR gRNA sequence
  source 1..20: mol_type = other DNA
ccctggggtcatggtagaga

SEQ ID NO: 99159 - DNA, 20 bp, synthetic construct
  misc_feature 1..20: note = CRISPR gRNA sequence
  source 1..20: mol_type = other DNA
aaatatccccctccttcctt

SEQ ID NO: 99160 - DNA, 20 bp, synthetic construct
  misc_feature 1..20: note = CRISPR gRNA sequence
  source 1..20: mol_type = other DNA
cttccctcctcatgttttcg

SEQ ID NO: 99161 - DNA, 20 bp, synthetic construct
  misc_feature 1..20: note = CRISPR gRNA sequence
  source 1..20: mol_type = other DNA
tcttgctctatcacccaggc

SEQ ID NO: 99162 - DNA, 20 bp, synthetic construct
  misc_feature 1..20: note = CRISPR gRNA sequence
  source 1..20: mol_type = other DNA
gatcctcccaccacagcctc

SEQ ID NO: 99163 - DNA, 20 bp, synthetic construct
  misc_feature 1..20: note = CRISPR gRNA sequence
  source 1..20: mol_type = other DNA
tttttttttttttttggaca

SEQ ID NO: 99164 - DNA, 20 bp, synthetic construct
  misc_feature 1..20: note = CRISPR gRNA sequence
  source 1..20: mol_type = other DNA
tctcgcgctgtcacccaggc

SEQ ID NO: 99165 - DNA, 20 bp, synthetic construct
  misc_feature 1..20: note = CRISPR gRNA sequence
  source 1..20: mol_type = other DNA
gattctcctgcctcagcctc

SEQ ID NO: 99166 - DNA, 20 bp, synthetic construct
  misc_feature 1..20: note = CRISPR gRNA sequence
  source 1..20: mol_type = other DNA
ttttatatttttagtagaga

SEQ ID NO: 99167 - DNA, 20 bp, synthetic construct
  misc_feature 1..20: note = CRISPR gRNA sequence
  source 1..20: mol_type = other DNA
gtgttggcctcccaaagtgc

SEQ ID NO: 99168 - DNA, 20 bp, synthetic construct
  misc_feature 1..20: note = CRISPR gRNA sequence
  source 1..20: mol_type = other DNA
tgttgtttttttagaagaga

SEQ ID NO: 99169 - DNA, 20 bp, synthetic construct
  misc_feature 1..20: note = CRISPR gRNA sequence
  source 1..20: mol_type = other DNA
gatccttcttccccagcctc

SEQ ID NO: 99170 - DNA, 20 bp, synthetic construct
  misc_feature 1..20: note = CRISPR gRNA sequence
  source 1..20: mol_type = other DNA
tttttatttattttttgaga

SEQ ID NO: 99171 - DNA, 20 bp, synthetic construct
  misc_feature 1..20: note = CRISPR gRNA sequence
  source 1..20: mol_type = other DNA
tctcgctctgtcacccaggc

SEQ ID NO: 99172 - DNA, 20 bp, synthetic construct
  misc_feature 1..20: note = CRISPR gRNA sequence
  source 1..20: mol_type = other DNA
aattctcctgcctcagcctc

SEQ ID NO: 99173 - DNA, 20 bp, synthetic construct
  misc_feature 1..20: note = CRISPR gRNA sequence
  source 1..20: mol_type = other DNA
gcctcagcctcctgaatagc

SEQ ID NO: 99174 - DNA, 20 bp, synthetic construct
  misc_feature 1..20: note = CRISPR gRNA sequence
  source 1..20: mol_type = other DNA
ttttttttttttttttgaga

SEQ ID NO: 99175 - DNA, 20 bp, synthetic construct
  misc_feature 1..20: note = CRISPR gRNA sequence
  source 1..20: mol_type = other DNA
ttcgctcttgttgcccaggc

SEQ ID NO: 99176 - DNA, 20 bp, synthetic construct
  misc_feature 1..20: note = CRISPR gRNA sequence
  source 1..20: mol_type = other DNA
gcctcagcctcccaagtagc

SEQ ID NO: 99177 - DNA, 20 bp, synthetic construct
  misc_feature 1..20: note = CRISPR gRNA sequence
  source 1..20: mol_type = other DNA
ctaattttttgcatttttag

SEQ ID NO: 99178 - DNA, 20 bp, synthetic construct
  misc_feature 1..20: note = CRISPR gRNA sequence
  source 1..20: mol_type = other DNA
ttttgcatttttagtagagt

SEQ ID NO: 99179 - DNA, 20 bp, synthetic construct
  misc_feature 1..20: note = CRISPR gRNA sequence
  source 1..20: mol_type = other DNA
gcctcagcttcccaaagtgc

SEQ ID NO: 99180 - DNA, 20 bp, synthetic construct
  misc_feature 1..20: note = CRISPR gRNA sequence
  source 1..20: mol_type = other DNA
ttttgtagttttagtagaga

SEQ ID NO: 99181 - DNA, 20 bp, synthetic construct
  misc_feature 1..20: note = CRISPR gRNA sequence
  source 1..20: mol_type = other DNA
accttggcctcccaaagtgc

SEQ ID NO: 99182 - DNA, 20 bp, synthetic construct
  misc_feature 1..20: note = CRISPR gRNA sequence
  source 1..20: mol_type = other DNA
cactggacctcccaaagtgc

SEQ ID NO: 99183 - DNA, 20 bp, synthetic construct
  misc_feature 1..20: note = CRISPR gRNA sequence
  source 1..20: mol_type = other DNA
ttaggggaagttgaggttcc

SEQ ID NO: 99184 - DNA, 20 bp, synthetic construct
  misc_feature 1..20: note = CRISPR gRNA sequence
  source 1..20: mol_type = other DNA
gggaagttgaggttcctggg

SEQ ID NO: 99185 - DNA, 20 bp, synthetic construct
  misc_feature 1..20: note = CRISPR gRNA sequence
  source 1..20: mol_type = other DNA
tctgtaatgcaggtctctgc

SEQ ID NO: 99186 - DNA, 20 bp, synthetic construct
  misc_feature 1..20: note = CRISPR gRNA sequence
  source 1..20: mol_type = other DNA
caacctggtgcccgctgacc

SEQ ID NO: 99187 - DNA, 20 bp, synthetic construct
  misc_feature 1..20: note = CRISPR gRNA sequence
  source 1..20: mol_type = other DNA
gaaccaataaaccttctgtg

SEQ ID NO: 99188 - DNA, 20 bp, synthetic construct
  misc_feature 1..20: note = CRISPR gRNA sequence
  source 1..20: mol_type = other DNA
cgtgtggtcatctaccacct

SEQ ID NO: 99189 - DNA, 20 bp, synthetic construct
  misc_feature 1..20: note = CRISPR gRNA sequence
  source 1..20: mol_type = other DNA
gtttattggttcctcttggg

SEQ ID NO: 99190 - DNA, 20 bp, synthetic construct
  misc_feature 1..20: note = CRISPR gRNA sequence
  source 1..20: mol_type = other DNA
agctgcctttgaagtcagtt

SEQ ID NO: 99191 - DNA, 20 bp, synthetic construct
  misc_feature 1..20: note = CRISPR gRNA sequence
  source 1..20: mol_type = other DNA
ctggctgaccattttgttcc

SEQ ID NO: 99192 - DNA, 20 bp, synthetic construct
  misc_feature 1..20: note = CRISPR gRNA sequence
  source 1..20: mol_type = other DNA
ccattttgttccctgagtgt

SEQ ID NO: 99193 - DNA, 20 bp, synthetic construct
  misc_feature 1..20: note = CRISPR gRNA sequence
  source 1..20: mol_type = other DNA
cccggcaggcggccttcact

SEQ ID NO: 99194 - DNA, 20 bp, synthetic construct
  misc_feature 1..20: note = CRISPR gRNA sequence
  source 1..20: mol_type = other DNA
aggttgctctggaagagctt

SEQ ID NO: 99195 - DNA, 20 bp, synthetic construct
  misc_feature 1..20: note = CRISPR gRNA sequence
  source 1..20: mol_type = other DNA
ggaaaaggtgggctgtgagc

SEQ ID NO: 99196 - DNA, 20 bp, synthetic construct
  misc_feature 1..20: note = CRISPR gRNA sequence
  source 1..20: mol_type = other DNA
gtgggctgtgagcttgaatc

SEQ ID NO: 99197 - DNA, 20 bp, synthetic construct
  misc_feature 1..20: note = CRISPR gRNA sequence
  source 1..20: mol_type = other DNA
ctgtgagcttgaatcgggag

SEQ ID NO: 99198 - DNA, 20 bp, synthetic construct
  misc_feature 1..20: note = CRISPR gRNA sequence
  source 1..20: mol_type = other DNA
aatgcacttttgtagctttt

SEQ ID NO: 99199 - DNA, 20 bp, synthetic construct
  misc_feature 1..20: note = CRISPR gRNA sequence
  source 1..20: mol_type = other DNA
tttcctaccaagcaaaatgt

SEQ ID NO: 99200 - DNA, 20 bp, synthetic construct
  misc_feature 1..20: note = CRISPR gRNA sequence
  source 1..20: mol_type = other DNA
ggggaggactgcttgagctc

SEQ ID NO: 99201 - DNA, 20 bp, synthetic construct
  misc_feature 1..20: note = CRISPR gRNA sequence
  source 1..20: mol_type = other DNA
actttgggaggccaaggtag

SEQ ID NO: 99202 - DNA, 20 bp, synthetic construct
  misc_feature 1..20: note = CRISPR gRNA sequence
  source 1..20: mol_type = other DNA
caaaaattagccaggtgcag

SEQ ID NO: 99203 - DNA, 20 bp, synthetic construct
  misc_feature 1..20: note = CRISPR gRNA sequence
  source 1..20: mol_type = other DNA
cagcactttgggaagctgag

SEQ ID NO: 99204 - DNA, 20 bp, synthetic construct
  misc_feature 1..20: note = CRISPR gRNA sequence
  source 1..20: mol_type = other DNA
actttgggaagctgaggcgg

SEQ ID NO: 99205 - DNA, 20 bp, synthetic construct
  misc_feature 1..20: note = CRISPR gRNA sequence
  source 1..20: mol_type = other DNA
cgggtggatcacctgaggtc

SEQ ID NO: 99206 - DNA, 20 bp, synthetic construct
  misc_feature 1..20: note = CRISPR gRNA sequence
  source 1..20: mol_type = other DNA
tacttgggaggctgaggcag

SEQ ID NO: 99207 - DNA, 20 bp, synthetic construct
  misc_feature 1..20: note = CRISPR gRNA sequence
  source 1..20: mol_type = other DNA
tattcaggaggctgaggcag

SEQ ID NO: 99208 - DNA, 20 bp, synthetic construct
  misc_feature 1..20: note = CRISPR gRNA sequence
  source 1..20: mol_type = other DNA
ttgtgccactgcactccagc

SEQ ID NO: 99209 - DNA, 20 bp, synthetic construct
  misc_feature 1..20: note = CRISPR gRNA sequence
  source 1..20: mol_type = other DNA
aaaaagattttaaaaattag

SEQ ID NO: 99210 - DNA, 20 bp, synthetic construct
  misc_feature 1..20: note = CRISPR gRNA sequence
  source 1..20: mol_type = other DNA
gattttaaaaattagctggg

SEQ ID NO: 99211 - DNA, 20 bp, synthetic construct
  misc_feature 1..20: note = CRISPR gRNA sequence
  source 1..20: mol_type = other DNA
tactcaggaggctggggaag

SEQ ID NO: 99212 - DNA, 20 bp, synthetic construct
  misc_feature 1..20: note = CRISPR gRNA sequence
  source 1..20: mol_type = other DNA
aagaaggatcacttgagccc

SEQ ID NO: 99213 - DNA, 20 bp, synthetic construct
  misc_feature 1..20: note = CRISPR gRNA sequence
  source 1..20: mol_type = other DNA
actttgggaggccaacacag

SEQ ID NO: 99214 - DNA, 20 bp, synthetic construct
  misc_feature 1..20: note = CRISPR gRNA sequence
  source 1..20: mol_type = other DNA
cacaggcggatcacaaggtc

SEQ ID NO: 99215 - DNA, 20 bp, synthetic construct
  misc_feature 1..20: note = CRISPR gRNA sequence
  source 1..20: mol_type = other DNA
tactcaggaggctgaggcag

SEQ ID NO: 99216 - DNA, 20 bp, synthetic construct
  misc_feature 1..20: note = CRISPR gRNA sequence
  source 1..20: mol_type = other DNA
tggcgccattgcactccagc

SEQ ID NO: 99217 - DNA, 20 bp, synthetic construct
  misc_feature 1..20: note = CRISPR gRNA sequence
  source 1..20: mol_type = other DNA
aaaattagccaggcatggtg

SEQ ID NO: 99218 - DNA, 20 bp, synthetic construct
  misc_feature 1..20: note = CRISPR gRNA sequence
  source 1..20: mol_type = other DNA
tactcgggaggctgtggtgg

SEQ ID NO: 99219 - DNA, 20 bp, synthetic construct
  misc_feature 1..20: note = CRISPR gRNA sequence
  source 1..20: mol_type = other DNA
ctgcaccacttcattccagc

SEQ ID NO: 99220 - DNA, 20 bp, synthetic construct
  misc_feature 1..20: note = CRISPR gRNA sequence
  source 1..20: mol_type = other DNA
cgaaaacatgaggagggaag

SEQ ID NO: 99221 - DNA, 20 bp, synthetic construct
  misc_feature 1..20: note = CRISPR gRNA sequence
  source 1..20: mol_type = other DNA
taaaactctgaaggaaggag

SEQ ID NO: 99222 - DNA, 20 bp, synthetic construct
  misc_feature 1..20: note = CRISPR gRNA sequence
  source 1..20: mol_type = other DNA
ccatctctaccatgacccca

SEQ ID NO: 99223 - DNA, 20 bp, synthetic construct
  misc_feature 1..20: note = CRISPR gRNA sequence
  source 1..20: mol_type = other DNA
ccccagggggtcggttcaat

SEQ ID NO: 99224 - DNA, 20 bp, synthetic construct
  misc_feature 1..20: note = CRISPR gRNA sequence
  source 1..20: mol_type = other DNA
aattgggatctccccatttt

SEQ ID NO: 99225 - DNA, 20 bp, synthetic construct
  misc_feature 1..20: note = CRISPR gRNA sequence
  source 1..20: mol_type = other DNA
cattttatggatggggaagt

SEQ ID NO: 99226 - DNA, 20 bp, synthetic construct
  misc_feature 1..20: note = CRISPR gRNA sequence
  source 1..20: mol_type = other DNA
tcccattgtgacagagaaaa

SEQ ID NO: 99227 - DNA, 20 bp, synthetic construct
  misc_feature 1..20: note = CRISPR gRNA sequence
  source 1..20: mol_type = other DNA
cagagaaaatggagtcaaac

SEQ ID NO: 99228 - DNA, 20 bp, synthetic construct
  misc_feature 1..20: note = CRISPR gRNA sequence
  source 1..20: mol_type = other DNA
acccactgcccgccacggag

SEQ ID NO: 99229 - DNA, 20 bp, synthetic construct
  misc_feature 1..20: note = CRISPR gRNA sequence
  source 1..20: mol_type = other DNA
gcaggggccactcctcccac

SEQ ID NO: 99230 - DNA, 20 bp, synthetic construct
  misc_feature 1..20: note = CRISPR gRNA sequence
  source 1..20: mol_type = other DNA
ctccctcccttcaggtcccc

SEQ ID NO: 99231 - DNA, 20 bp, synthetic construct
  misc_feature 1..20: note = CRISPR gRNA sequence
  source 1..20: mol_type = other DNA
gctgggcccacctcacttct

SEQ ID NO: 99232 - DNA, 20 bp, synthetic construct
  misc_feature 1..20: note = CRISPR gRNA sequence
  source 1..20: mol_type = other DNA
ggagccccaggagccaggac

SEQ ID NO: 99233 - DNA, 20 bp, synthetic construct
  misc_feature 1..20: note = CRISPR gRNA sequence
  source 1..20: mol_type = other DNA
aggactgggatgttcccagg

SEQ ID NO: 99234 - DNA, 20 bp, synthetic construct
  misc_feature 1..20: note = CRISPR gRNA sequence
  source 1..20: mol_type = other DNA
tgccggcgtatgaccactga

SEQ ID NO: 99235 - DNA, 20 bp, synthetic construct
  misc_feature 1..20: note = CRISPR gRNA sequence
  source 1..20: mol_type = other DNA
agggccacggcaaggtccat

SEQ ID NO: 99236 - DNA, 20 bp, synthetic construct
  misc_feature 1..20: note = CRISPR gRNA sequence
  source 1..20: mol_type = other DNA
aaggtccatcggggtgtagc

SEQ ID NO: 99237 - DNA, 20 bp, synthetic construct
  misc_feature 1..20: note = CRISPR gRNA sequence
  source 1..20: mol_type = other DNA
aaggagaggggagggcgctg

SEQ ID NO: 99238 - DNA, 20 bp, synthetic construct
  misc_feature 1..20: note = CRISPR gRNA sequence
  source 1..20: mol_type = other DNA
ggcgctggagggtggggcct

SEQ ID NO: 99239 - DNA, 20 bp, synthetic construct
  misc_feature 1..20: note = CRISPR gRNA sequence
  source 1..20: mol_type = other DNA
gagggtggggcctgggagtc

SEQ ID NO: 99240 - DNA, 20 bp, synthetic construct
  misc_feature 1..20: note = CRISPR gRNA sequence
  source 1..20: mol_type = other DNA
tggggcctgggagtccagaa

SEQ ID NO: 99241 - DNA, 20 bp, synthetic construct
  misc_feature 1..20: note = CRISPR gRNA sequence
  source 1..20: mol_type = other DNA
tcattccccacaatgcagcc

SEQ ID NO: 99242 - DNA, 20 bp, synthetic construct
  misc_feature 1..20: note = CRISPR gRNA sequence
  source 1..20: mol_type = other DNA
ttgcccatgtggcctttgac

SEQ ID NO: 99243 - DNA, 20 bp, synthetic construct
  misc_feature 1..20: note = CRISPR gRNA sequence
  source 1..20: mol_type = other DNA
tccactgaagaacgtggctg

SEQ ID NO: 99244 - DNA, 20 bp, synthetic construct
  misc_feature 1..20: note = CRISPR gRNA sequence
  source 1..20: mol_type = other DNA
tgaagggtctctgaaccatg

SEQ ID NO: 99245 - DNA, 20 bp, synthetic construct
  misc_feature 1..20: note = CRISPR gRNA sequence
  source 1..20: mol_type = other DNA
cttgggcgtctccctgccct

SEQ ID NO: 99246 - DNA, 20 bp, synthetic construct
  misc_feature 1..20: note = CRISPR gRNA sequence
  source 1..20: mol_type = other DNA
aggattcccgcagggcccgc

SEQ ID NO: 99247 - DNA, 20 bp, synthetic construct
  misc_feature 1..20: note = CRISPR gRNA sequence
  source 1..20: mol_type = other DNA
tggcgtccctccattctgtc

SEQ ID NO: 99248 - DNA, 20 bp, synthetic construct
  misc_feature 1..20: note = CRISPR gRNA sequence
  source 1..20: mol_type = other DNA
actgggcccatctcactttc

SEQ ID NO: 99249 - DNA, 20 bp, synthetic construct
  misc_feature 1..20: note = CRISPR gRNA sequence
  source 1..20: mol_type = other DNA
gagctctgctctgtgaggct

SEQ ID NO: 99250 - DNA, 20 bp, synthetic construct
  misc_feature 1..20: note = CRISPR gRNA sequence
  source 1..20: mol_type = other DNA
actctgtgaacatttgaggc

SEQ ID NO: 99251 - DNA, 20 bp, synthetic construct
  misc_feature 1..20: note = CRISPR gRNA sequence
  source 1..20: mol_type = other DNA
ccaggaggctgagaggtcct

SEQ ID NO: 99252 - DNA, 20 bp, synthetic construct
  misc_feature 1..20: note = CRISPR gRNA sequence
  source 1..20: mol_type = other DNA
gcgctctctcgctcttttgc

SEQ ID NO: 99253 - DNA, 20 bp, synthetic construct
  misc_feature 1..20: note = CRISPR gRNA sequence
  source 1..20: mol_type = other DNA
tcgctcttttgccaggatgt

SEQ ID NO: 99254 - DNA, 20 bp, synthetic construct
  misc_feature 1..20: note = CRISPR gRNA sequence
  source 1..20: mol_type = other DNA
gggagaagaagggacagtgg

SEQ ID NO: 99255 - DNA, 20 bp, synthetic construct
  misc_feature 1..20: note = CRISPR gRNA sequence
  source 1..20: mol_type = other DNA
gaagaagggacagtggtagg

SEQ ID NO: 99256 - DNA, 20 bp, synthetic construct
  misc_feature 1..20: note = CRISPR gRNA sequence
  source 1..20: mol_type = other DNA
ggatggattggggcataacc

SEQ ID NO: 99257 - DNA, 20 bp, synthetic construct
  misc_feature 1..20: note = CRISPR gRNA sequence
  source 1..20: mol_type = other DNA
tggggcataaccaggaatcc

SEQ ID NO: 99258 - DNA, 20 bp, synthetic construct
  misc_feature 1..20: note = CRISPR gRNA sequence
  source 1..20: mol_type = other DNA
tttttttttttttttggaga

SEQ ID NO: 99259 - DNA, 20 bp, synthetic construct
  misc_feature 1..20: note = CRISPR gRNA sequence
  source 1..20: mol_type = other DNA
tcttgctctgttgcccaggc

SEQ ID NO: 99260 - DNA, 20 bp, synthetic construct
  misc_feature 1..20: note = CRISPR gRNA sequence
  source 1..20: mol_type = other DNA
agttctcccacctcagcctc

SEQ ID NO: 99261 - DNA, 20 bp, synthetic construct
  misc_feature 1..20: note = CRISPR gRNA sequence
  source 1..20: mol_type = other DNA
acctcagcctccagagtacc

SEQ ID NO: 99262 - DNA, 20 bp, synthetic construct
  misc_feature 1..20: note = CRISPR gRNA sequence
  source 1..20: mol_type = other DNA
ttgtatttttttagtagaga

SEQ ID NO: 99263 - DNA, 20 bp, synthetic construct
  misc_feature 1..20: note = CRISPR gRNA sequence
  source 1..20: mol_type = other DNA
gcctcggcctcccaaagtgc

SEQ ID NO: 99264 - DNA, 20 bp, synthetic construct
  misc_feature 1..20: note = CRISPR gRNA sequence
  source 1..20: mol_type = other DNA
aaggcggaggcccagatgag

SEQ ID NO: 99265 - DNA, 20 bp, synthetic construct
  misc_feature 1..20: note = CRISPR gRNA sequence
  source 1..20: mol_type = other DNA
atggggacgaggtggggggc

SEQ ID NO: 99266 - DNA, 20 bp, synthetic construct
  misc_feature 1..20: note = CRISPR gRNA sequence
  source 1..20: mol_type = other DNA
ggggggctggggttagacag

SEQ ID NO: 99267 - DNA, 20 bp, synthetic construct
  misc_feature 1..20: note = CRISPR gRNA sequence
  source 1..20: mol_type = other DNA
ggacactcacaggtcacgtc

SEQ ID NO: 99268 - DNA, 20 bp, synthetic construct
  misc_feature 1..20: note = CRISPR gRNA sequence
  source 1..20: mol_type = other DNA
actcacaggtcacgtcatga

SEQ ID NO: 99269 - DNA, 20 bp, synthetic construct
  misc_feature 1..20: note = CRISPR gRNA sequence
  source 1..20: mol_type = other DNA
tccccctgtgctgcgagctg

SEQ ID NO: 99270 - DNA, 20 bp, synthetic construct
  misc_feature 1..20: note = CRISPR gRNA sequence
  source 1..20: mol_type = other DNA
gggctggggcaggacagagg

SEQ ID NO: 99271 - DNA, 20 bp, synthetic construct
  misc_feature 1..20: note = CRISPR gRNA sequence
  source 1..20: mol_type = other DNA
ccgtgggcccactcacagtc

SEQ ID NO: 99272 - DNA, 20 bp, synthetic construct
  misc_feature 1..20: note = CRISPR gRNA sequence
  source 1..20: mol_type = other DNA
ttccctcgctgccggttggt

SEQ ID NO: 99273 - DNA, 20 bp, synthetic construct
  misc_feature 1..20: note = CRISPR gRNA sequence
  source 1..20: mol_type = other DNA
ctgccggttggtgagagtgg

SEQ ID NO: 99274 - DNA, 20 bp, synthetic construct
  misc_feature 1..20: note = CRISPR gRNA sequence
  source 1..20: mol_type = other DNA
gttgctgttgttgtttgaga

SEQ ID NO: 99275 - DNA, 20 bp, synthetic construct
  misc_feature 1..20: note = CRISPR gRNA sequence
  source 1..20: mol_type = other DNA
tctccgtctgtcccccaggc

SEQ ID NO: 99276 - DNA, 20 bp, synthetic construct
  misc_feature 1..20: note = CRISPR gRNA sequence
  source 1..20: mol_type = other DNA
ctcactgcaacctctgcctc

SEQ ID NO: 99277 - DNA, 20 bp, synthetic construct
  misc_feature 1..20: note = CRISPR gRNA sequence
  source 1..20: mol_type = other DNA
gattcttgtgcctcagcctc

SEQ ID NO: 99278 - DNA, 20 bp, synthetic construct
  misc_feature 1..20: note = CRISPR gRNA sequence
  source 1..20: mol_type = other DNA
gcctcagcctcccgagtagc

SEQ ID NO: 99279 - DNA, 20 bp, synthetic construct
  misc_feature 1..20: note = CRISPR gRNA sequence
  source 1..20: mol_type = other DNA
ttttgtattttaagtagaga

SEQ ID NO: 99280 - DNA, 20 bp, synthetic construct
  misc_feature 1..20: note = CRISPR gRNA sequence
  source 1..20: mol_type = other DNA
gcctcagcctcccaaagtgc

SEQ ID NO: 99281 - DNA, 20 bp, synthetic construct
  misc_feature 1..20: note = CRISPR gRNA sequence
  source 1..20: mol_type = other DNA
gagccaccacacccagctat

SEQ ID NO: 99282 - DNA, 20 bp, synthetic construct
  misc_feature 1..20: note = CRISPR gRNA sequence
  source 1..20: mol_type = other DNA
ggttttttttttttttgaga

SEQ ID NO: 99283 - DNA, 20 bp, synthetic construct
  misc_feature 1..20: note = CRISPR gRNA sequence
  source 1..20: mol_type = other DNA
tcttgctctgttgtccaggc

SEQ ID NO: 99284 - DNA, 20 bp, synthetic construct
  misc_feature 1..20: note = CRISPR gRNA sequence
  source 1..20: mol_type = other DNA
tatatatatattggtagaga

SEQ ID NO: 99285 - DNA, 20 bp, synthetic construct
  misc_feature 1..20: note = CRISPR gRNA sequence
  source 1..20: mol_type = other DNA
gccgtggcctcccaaagtgc

SEQ ID NO: 99286 - DNA, 20 bp, synthetic construct
  misc_feature 1..20: note = CRISPR gRNA sequence
  source 1..20: mol_type = other DNA
tactgccttcggtatctccc

SEQ ID NO: 99287 - DNA, 20 bp, synthetic construct
  misc_feature 1..20: note = CRISPR gRNA sequence
  source 1..20: mol_type = other DNA
cattcactcactctactctc

SEQ ID NO: 99288 - DNA, 20 bp, synthetic construct
  misc_feature 1..20: note = CRISPR gRNA sequence
  source 1..20: mol_type = other DNA
actctactctcttgaatacc

SEQ ID NO: 99289 - DNA, 20 bp, synthetic construct
  misc_feature 1..20: note = CRISPR gRNA sequence
  source 1..20: mol_type = other DNA
gacatagtttttgccctcta

SEQ ID NO: 99290 - DNA, 20 bp, synthetic construct
  misc_feature 1..20: note = CRISPR gRNA sequence
  source 1..20: mol_type = other DNA
tttttgccctctagggagtc

SEQ ID NO: 99291 - DNA, 20 bp, synthetic construct
  misc_feature 1..20: note = CRISPR gRNA sequence
  source 1..20: mol_type = other DNA
cagcactttgggaggctgag

SEQ ID NO: 99292 - DNA, 20 bp, synthetic construct
  misc_feature 1..20: note = CRISPR gRNA sequence
  source 1..20: mol_type = other DNA
actttgggaggctgaggtgg

SEQ ID NO: 99293 - DNA, 20 bp, synthetic construct
  misc_feature 1..20: note = CRISPR gRNA sequence
  source 1..20: mol_type = other DNA
tgggtggatcacctgaggtc

SEQ ID NO: 99294 - DNA, 20 bp, synthetic construct
  misc_feature 1..20: note = CRISPR gRNA sequence
  source 1..20: mol_type = other DNA
tactcgggaggctgaggcag

SEQ ID NO: 99295 - DNA, 20 bp, synthetic construct
  misc_feature 1..20: note = CRISPR gRNA sequence
  source 1..20: mol_type = other DNA
ggctgaggcaggagaatcgc

SEQ ID NO: 99296 - DNA, 20 bp, synthetic construct
  misc_feature 1..20: note = CRISPR gRNA sequence
  source 1..20: mol_type = other DNA
tgcactccagcctgggcaac

SEQ ID NO: 99297 - DNA, 20 bp, synthetic construct
  misc_feature 1..20: note = CRISPR gRNA sequence
  source 1..20: mol_type = other DNA
aaatttaaaagcaggtagaa

SEQ ID NO: 99298 - DNA, 20 bp, synthetic construct
  misc_feature 1..20: note = CRISPR gRNA sequence
  source 1..20: mol_type = other DNA
gatgaaaagaacggagcaca

SEQ ID NO: 99299 - DNA, 20 bp, synthetic construct
  misc_feature 1..20: note = CRISPR gRNA sequence
  source 1..20: mol_type = other DNA
gcgggcaatcacctgaggtc

SEQ ID NO: 99300 - DNA, 20 bp, synthetic construct
  misc_feature 1..20: note = CRISPR gRNA sequence
  source 1..20: mol_type = other DNA
actaaaaacacaaaaattag

SEQ ID NO: 99301 - DNA, 20 bp, synthetic construct
  misc_feature 1..20: note = CRISPR gRNA sequence
  source 1..20: mol_type = other DNA
tacttgggaggctgaggcag

SEQ ID NO: 99302 - DNA, 20 bp, synthetic construct
  misc_feature 1..20: note = CRISPR gRNA sequence
  source 1..20: mol_type = other DNA
aatcaccttaacccaggaga

SEQ ID NO: 99303 - DNA, 20 bp, synthetic construct
  misc_feature 1..20: note = CRISPR gRNA sequence
  source 1..20: mol_type = other DNA
acccaggagagggagttgca

SEQ ID NO: 99304 - DNA, 20 bp, synthetic construct
  misc_feature 1..20: note = CRISPR gRNA sequence
  source 1..20: mol_type = other DNA
gattctgtctcaagaagaga

SEQ ID NO: 99305 - DNA, 20 bp, synthetic construct
  misc_feature 1..20: note = CRISPR gRNA sequence
  source 1..20: mol_type = other DNA
ggggatccaggaggcgtctc

SEQ ID NO: 99306 - DNA, 20 bp, synthetic construct
  misc_feature 1..20: note = CRISPR gRNA sequence
  source 1..20: mol_type = other DNA
tactcgggaggctgaagcag

SEQ ID NO: 99307 - DNA, 20 bp, synthetic construct
  misc_feature 1..20: note = CRISPR gRNA sequence
  source 1..20: mol_type = other DNA
cgggaagggagggaggggag

SEQ ID NO: 99308 - DNA, 20 bp, synthetic construct
  misc_feature 1..20: note = CRISPR gRNA sequence
  source 1..20: mol_type = other DNA
gtaggaagagcattccagac

SEQ ID NO: 99309 - DNA, 20 bp, synthetic construct
  misc_feature 1..20: note = CRISPR gRNA sequence
  source 1..20: mol_type = other DNA
cagttcctcagtaagtaaaa

SEQ ID NO: 99310 - DNA, 20 bp, synthetic construct
  misc_feature 1..20: note = CRISPR gRNA sequence
  source 1..20: mol_type = other DNA
ctcctagctatctaccctca

SEQ ID NO: 99311 - DNA, 20 bp, synthetic construct
  misc_feature 1..20: note = CRISPR gRNA sequence
  source 1..20: mol_type = other DNA
agtcccagctcctagggagg

SEQ ID NO: 99312 - DNA, 20 bp, synthetic construct
  misc_feature 1..20: note = CRISPR gRNA sequence
  source 1..20: mol_type = other DNA
actttgggaggccgaggtgg

SEQ ID NO: 99313 - DNA, 20 bp, synthetic construct
  misc_feature 1..20: note = CRISPR gRNA sequence
  source 1..20: mol_type = other DNA
tgggcggatcacctgaggtc

SEQ ID NO: 99314 - DNA, 20 bp, synthetic construct
  misc_feature 1..20: note = CRISPR gRNA sequence
  source 1..20: mol_type = other DNA
tactcaggaggctgagacag

SEQ ID NO: 99315 - DNA, 20 bp, synthetic construct
  misc_feature 1..20: note = CRISPR gRNA sequence
  source 1..20: mol_type = other DNA
ggcctgacattccatcatca

SEQ ID NO: 99316 - DNA, 20 bp, synthetic construct
  misc_feature 1..20: note = CRISPR gRNA sequence
  source 1..20: mol_type = other DNA
gccatctgcagcctcctctc

SEQ ID NO: 99317 - DNA, 20 bp, synthetic construct
  misc_feature 1..20: note = CRISPR gRNA sequence
  source 1..20: mol_type = other DNA
agcctcctctccggggtctt

SEQ ID NO: 99318 - DNA, 20 bp, synthetic construct
  misc_feature 1..20: note = CRISPR gRNA sequence
  source 1..20: mol_type = other DNA
gggtccccaagttctgaggc

SEQ ID NO: 99319 - DNA, 20 bp, synthetic construct
  misc_feature 1..20: note = CRISPR gRNA sequence
  source 1..20: mol_type = other DNA
agttctgaggcaggggtctg

SEQ ID NO: 99320 - DNA, 20 bp, synthetic construct
  misc_feature 1..20: note = CRISPR gRNA sequence
  source 1..20: mol_type = other DNA
gaggcaggggtctgctgggt

SEQ ID NO: 99321 - DNA, 20 bp, synthetic construct
  misc_feature 1..20: note = CRISPR gRNA sequence
  source 1..20: mol_type = other DNA
tggatgaggtcttctgcagg

SEQ ID NO: 99322 - DNA, 20 bp, synthetic construct
  misc_feature 1..20: note = CRISPR gRNA sequence
  source 1..20: mol_type = other DNA
catacctagccttgcactgt

SEQ ID NO: 99323 - DNA, 20 bp, synthetic construct
  misc_feature 1..20: note = CRISPR gRNA sequence
  source 1..20: mol_type = other DNA
cctagccttgcactgtgagg

SEQ ID NO: 99324 - DNA, 20 bp, synthetic construct
  misc_feature 1..20: note = CRISPR gRNA sequence
  source 1..20: mol_type = other DNA
agagccagggaaatgaaaac

SEQ ID NO: 99325 - DNA, 20 bp, synthetic construct
  misc_feature 1..20: note = CRISPR gRNA sequence
  source 1..20: mol_type = other DNA
cagcactttgggaggccgag

SEQ ID NO: 99326 - DNA, 20 bp, synthetic construct
  misc_feature 1..20: note = CRISPR gRNA sequence
  source 1..20: mol_type = other DNA
actttgggaggccgaggagg

SEQ ID NO: 99327 - DNA, 20 bp, synthetic construct
  misc_feature 1..20: note = CRISPR gRNA sequence
  source 1..20: mol_type = other DNA
ggagggtggatcatgaggtc

SEQ ID NO: 99328 - DNA, 20 bp, synthetic construct
  misc_feature 1..20: note = CRISPR gRNA sequence
  source 1..20: mol_type = other DNA
agctactcgggaggctgagg

SEQ ID NO: 99329 - DNA, 20 bp, synthetic construct
  misc_feature 1..20: note = CRISPR gRNA sequence
  source 1..20: mol_type = other DNA
ggaaaaaaaagccggggctc

SEQ ID NO: 99330 - DNA, 20 bp, synthetic construct
  misc_feature 1..20: note = CRISPR gRNA sequence
  source 1..20: mol_type = other DNA
ggggctctggggtcagctgt

SEQ ID NO: 99331 - DNA, 20 bp, synthetic construct
  misc_feature 1..20: note = CRISPR gRNA sequence
  source 1..20: mol_type = other DNA
ctggggtcagctgtctgggt

SEQ ID NO: 99332 - DNA, 20 bp, synthetic construct
  misc_feature 1..20: note = CRISPR gRNA sequence
  source 1..20: mol_type = other DNA
atgtggaaatgagacctaca

SEQ ID NO: 99333 - DNA, 20 bp, synthetic construct
  misc_feature 1..20: note = CRISPR gRNA sequence
  source 1..20: mol_type = other DNA
tgtctgtacatagcttatcg

SEQ ID NO: 99334 - DNA, 20 bp, synthetic construct
  misc_feature 1..20: note = CRISPR gRNA sequence
  source 1..20: mol_type = other DNA
gttgggaggggctccccata

SEQ ID NO: 99335 - DNA, 20 bp, synthetic construct
  misc_feature 1..20: note = CRISPR gRNA sequence
  source 1..20: mol_type = other DNA
tcacaaacttttctcttcca

SEQ ID NO: 99336 - DNA, 20 bp, synthetic construct
  misc_feature 1..20: note = CRISPR gRNA sequence
  source 1..20: mol_type = other DNA
tttaagacttaggggagggc

SEQ ID NO: 99337 - DNA, 20 bp, synthetic construct
  misc_feature 1..20: note = CRISPR gRNA sequence
  source 1..20: mol_type = other DNA
ggggagggcgtgggttccgc

SEQ ID NO: 99338 - DNA, 20 bp, synthetic construct
  misc_feature 1..20: note = CRISPR gRNA sequence
  source 1..20: mol_type = other DNA
cccctcctcaccgactcgga

SEQ ID NO: 99339 - DNA, 20 bp, synthetic construct
  misc_feature 1..20: note = CRISPR gRNA sequence
  source 1..20: mol_type = other DNA
ggcggggcctaaagggctct

SEQ ID NO: 99340 - DNA, 20 bp, synthetic construct
  misc_feature 1..20: note = CRISPR gRNA sequence
  source 1..20: mol_type = other DNA
ggagccaattggctccggct

SEQ ID NO: 99341 - DNA, 20 bp, synthetic construct
  misc_feature 1..20: note = CRISPR gRNA sequence
  source 1..20: mol_type = other DNA
gggggcagagggctaaagaa

SEQ ID NO: 99342 - DNA, 20 bp, synthetic construct
  misc_feature 1..20: note = CRISPR gRNA sequence
  source 1..20: mol_type = other DNA
aagaagggagtttttgcggc

SEQ ID NO: 99343 - DNA, 20 bp, synthetic construct
  misc_feature 1..20: note = CRISPR gRNA sequence
  source 1..20: mol_type = other DNA
agggagtttttgcggcccga

SEQ ID NO: 99344 - DNA, 20 bp, synthetic construct
  misc_feature 1..20: note = CRISPR gRNA sequence
  source 1..20: mol_type = other DNA
aactcgtctctcaaggaaaa

SEQ ID NO: 99345 - DNA, 20 bp, synthetic construct
  misc_feature 1..20: note = CRISPR gRNA sequence
  source 1..20: mol_type = other DNA
aaagggggttcagaaaggga

SEQ ID NO: 99346 - DNA, 20 bp, synthetic construct
  misc_feature 1..20: note = CRISPR gRNA sequence
  source 1..20: mol_type = other DNA
agttcttccccctctcctgc

SEQ ID NO: 99347 - DNA, 20 bp, synthetic construct
  misc_feature 1..20: note = CRISPR gRNA sequence
  source 1..20: mol_type = other DNA
ccctcctcactgcgccaccc

SEQ ID NO: 99348 - DNA, 20 bp, synthetic construct
  misc_feature 1..20: note = CRISPR gRNA sequence
  source 1..20: mol_type = other DNA
ctttagccctctgcccccgc

SEQ ID NO: 99349 - DNA, 20 bp, synthetic construct
  misc_feature 1..20: note = CRISPR gRNA sequence
  source 1..20: mol_type = other DNA
ggggtagcggtcgagtatca

SEQ ID NO: 99350 - DNA, 20 bp, synthetic construct
  misc_feature 1..20: note = CRISPR gRNA sequence
  source 1..20: mol_type = other DNA
agatcgctgagggtccggtc

SEQ ID NO: 99351 - DNA, 20 bp, synthetic construct
  misc_feature 1..20: note = CRISPR gRNA sequence
  source 1..20: mol_type = other DNA
tgctatatccattggaagag

SEQ ID NO: 99352 - DNA, 20 bp, synthetic construct
  misc_feature 1..20: note = CRISPR gRNA sequence
  source 1..20: mol_type = other DNA
aaagtttgtgacttgggccc

SEQ ID NO: 99353 - DNA, 20 bp, synthetic construct
  misc_feature 1..20: note = CRISPR gRNA sequence
  source 1..20: mol_type = other DNA
gcccccaagttttgagagaa

SEQ ID NO: 99354 - DNA, 20 bp, synthetic construct
  misc_feature 1..20: note = CRISPR gRNA sequence
  source 1..20: mol_type = other DNA
ggaggtgagtggacctcctg

SEQ ID NO: 99355 - DNA, 20 bp, synthetic construct
  misc_feature 1..20: note = CRISPR gRNA sequence
  source 1..20: mol_type = other DNA
tagcgaatatttattgagct

SEQ ID NO: 99356 - DNA, 20 bp, synthetic construct
  misc_feature 1..20: note = CRISPR gRNA sequence
  source 1..20: mol_type = other DNA
gttctcacggcctataaatt

SEQ ID NO: 99357 - DNA, 20 bp, synthetic construct
  misc_feature 1..20: note = CRISPR gRNA sequence
  source 1..20: mol_type = other DNA
cagacagctgaccccagagc

SEQ ID NO: 99358 - DNA, 20 bp, synthetic construct
  misc_feature 1..20: note = CRISPR gRNA sequence
  source 1..20: mol_type = other DNA
gggatcacaggcgcccgcca

SEQ ID NO: 99359 - DNA, 20 bp, synthetic construct
  misc_feature 1..20: note = CRISPR gRNA sequence
  source 1..20: mol_type = other DNA
ttttgtatttttagtacaga

SEQ ID NO: 99360 - DNA, 20 bp, synthetic construct
  misc_feature 1..20: note = CRISPR gRNA sequence
  source 1..20: mol_type = other DNA
ctcctcggcctcccaaagtg

SEQ ID NO: 99361 - DNA, 20 bp, synthetic construct
  misc_feature 1..20: note = CRISPR gRNA sequence
  source 1..20: mol_type = other DNA
tcttaaacattgcacattgt

SEQ ID NO: 99362 - DNA, 20 bp, synthetic construct
  misc_feature 1..20: note = CRISPR gRNA sequence
  source 1..20: mol_type = other DNA
gacctcgaaagcagttggac

SEQ ID NO: 99363 - DNA, 20 bp, synthetic construct
  misc_feature 1..20: note = CRISPR gRNA sequence
  source 1..20: mol_type = other DNA
ctctggtaattaacctggac

SEQ ID NO: 99364 - DNA, 20 bp, synthetic construct
  misc_feature 1..20: note = CRISPR gRNA sequence
  source 1..20: mol_type = other DNA
tctccccttctgacacctcc

SEQ ID NO: 99365 - DNA, 20 bp, synthetic construct
  misc_feature 1..20: note = CRISPR gRNA sequence
  source 1..20: mol_type = other DNA
acctccgccagctttcccca

SEQ ID NO: 99366 - DNA, 20 bp, synthetic construct
  misc_feature 1..20: note = CRISPR gRNA sequence
  source 1..20: mol_type = other DNA
ttccctgcacaaccggatgc

SEQ ID NO: 99367 - DNA, 20 bp, synthetic construct
  misc_feature 1..20: note = CRISPR gRNA sequence
  source 1..20: mol_type = other DNA
cacagggtaggatacctcct

SEQ ID NO: 99368 - DNA, 20 bp, synthetic construct
  misc_feature 1..20: note = CRISPR gRNA sequence
  source 1..20: mol_type = other DNA
cctcctctgggattagccct

SEQ ID NO: 99369 - DNA, 20 bp, synthetic construct
  misc_feature 1..20: note = CRISPR gRNA sequence
  source 1..20: mol_type = other DNA
ggcctcacatggaacctgtg

SEQ ID NO: 99370 - DNA, 20 bp, synthetic construct
  misc_feature 1..20: note = CRISPR gRNA sequence
  source 1..20: mol_type = other DNA
acatggaacctgtgtcttgc

SEQ ID NO: 99371 - DNA, 20 bp, synthetic construct
  misc_feature 1..20: note = CRISPR gRNA sequence
  source 1..20: mol_type = other DNA
aacctgtgtcttgctttcgt

SEQ ID NO: 99372 - DNA, 20 bp, synthetic construct
  misc_feature 1..20: note = CRISPR gRNA sequence
  source 1..20: mol_type = other DNA
gtgtcttgctttcgtttttg

SEQ ID NO: 99373 - DNA, 20 bp, synthetic construct
  misc_feature 1..20: note = CRISPR gRNA sequence
  source 1..20: mol_type = other DNA
ttgctttcgtttttgttttg

SEQ ID NO: 99374 - DNA, 20 bp, synthetic construct
  misc_feature 1..20: note = CRISPR gRNA sequence
  source 1..20: mol_type = other DNA
gtttttgttttgttttgttt

SEQ ID NO: 99375 - DNA, 20 bp, synthetic construct
  misc_feature 1..20: note = CRISPR gRNA sequence
  source 1..20: mol_type = other DNA
tgttttgttgttttttgaga

SEQ ID NO: 99376 - DNA, 20 bp, synthetic construct
  misc_feature 1..20: note = CRISPR gRNA sequence
  source 1..20: mol_type = other DNA
aacctctgcctcctgggttc

SEQ ID NO: 99377 - DNA, 20 bp, synthetic construct
  misc_feature 1..20: note = CRISPR gRNA sequence
  source 1..20: mol_type = other DNA
tgtctcagcctcctgagtag

SEQ ID NO: 99378 - DNA, 20 bp, synthetic construct
  misc_feature 1..20: note = CRISPR gRNA sequence
  source 1..20: mol_type = other DNA
cctcctgagtagctgggatt

SEQ ID NO: 99379 - DNA, 20 bp, synthetic construct
  misc_feature 1..20: note = CRISPR gRNA sequence
  source 1..20: mol_type = other DNA
ttgggtatttttagtagaga

SEQ ID NO: 99380 - DNA, 20 bp, synthetic construct
  misc_feature 1..20: note = CRISPR gRNA sequence
  source 1..20: mol_type = other DNA
cacctcggcctcccaaagtg

SEQ ID NO: 99381 - DNA, 20 bp, synthetic construct
  misc_feature 1..20: note = CRISPR gRNA sequence
  source 1..20: mol_type = other DNA
ggcatgagccactgtgcccg

SEQ ID NO: 99382 - DNA, 20 bp, synthetic construct
  misc_feature 1..20: note = CRISPR gRNA sequence
  source 1..20: mol_type = other DNA
agccactgtgcccggcctgt

SEQ ID NO: 99383 - DNA, 20 bp, synthetic construct
  misc_feature 1..20: note = CRISPR gRNA sequence
  source 1..20: mol_type = other DNA
ggcctccacttccgaaagtg

SEQ ID NO: 99384 - DNA, 20 bp, synthetic construct
  misc_feature 1..20: note = CRISPR gRNA sequence
  source 1..20: mol_type = other DNA
cacagtgcccggcccttcac

SEQ ID NO: 99385 - DNA, 20 bp, synthetic construct
  misc_feature 1..20: note = CRISPR gRNA sequence
  source 1..20: mol_type = other DNA
attactgggtcagatggtca

SEQ ID NO: 99386 - DNA, 20 bp, synthetic construct
  misc_feature 1..20: note = CRISPR gRNA sequence
  source 1..20: mol_type = other DNA
tgttttacttactgaggaac

SEQ ID NO: 99387 - DNA, 20 bp, synthetic construct
  misc_feature 1..20: note = CRISPR gRNA sequence
  source 1..20: mol_type = other DNA
ctgaggaactgaggatttat

SEQ ID NO: 99388 - DNA, 20 bp, synthetic construct
  misc_feature 1..20: note = CRISPR gRNA sequence
  source 1..20: mol_type = other DNA
tcccctccctcccttcccgc

SEQ ID NO: 99389 - DNA, 20 bp, synthetic construct
  misc_feature 1..20: note = CRISPR gRNA sequence
  source 1..20: mol_type = other DNA
ctcccgtgttcacgccattc

SEQ ID NO: 99390 - DNA, 20 bp, synthetic construct
  misc_feature 1..20: note = CRISPR gRNA sequence
  source 1..20: mol_type = other DNA
cccgagtagctgggactaca

SEQ ID NO: 99391 - DNA, 20 bp, synthetic construct
  misc_feature 1..20: note = CRISPR gRNA sequence
  source 1..20: mol_type = other DNA
ttttttttttttttttaaat

SEQ ID NO: 99392 - DNA, 20 bp, synthetic construct
  misc_feature 1..20: note = CRISPR gRNA sequence
  source 1..20: mol_type = other DNA
ttttttttttttaaatggag

SEQ ID NO: 99393 - DNA, 20 bp, synthetic construct
  misc_feature 1..20: note = CRISPR gRNA sequence
  source 1..20: mol_type = other DNA
caactccctctcctgggtta

SEQ ID NO: 99394 - DNA, 20 bp, synthetic construct
  misc_feature 1..20: note = CRISPR gRNA sequence
  source 1..20: mol_type = other DNA
ccaccacatccagctaattt

SEQ ID NO: 99395 - DNA, 20 bp, synthetic construct
  misc_feature 1..20: note = CRISPR gRNA sequence
  source 1..20: mol_type = other DNA
ttttgtgtttttagtagaga

SEQ ID NO: 99396 - DNA, 20 bp, synthetic construct
  misc_feature 1..20: note = CRISPR gRNA sequence
  source 1..20: mol_type = other DNA
ggtctcgaactcctgacctc

SEQ ID NO: 99397 - DNA, 20 bp, synthetic construct
  misc_feature 1..20: note = CRISPR gRNA sequence
  source 1..20: mol_type = other DNA
cgcctcggcctcccaaagtg

SEQ ID NO: 99398 - DNA, 20 bp, synthetic construct
  misc_feature 1..20: note = CRISPR gRNA sequence
  source 1..20: mol_type = other DNA
ccaccgcgcccagtccctgt

SEQ ID NO: 99399 - DNA, 20 bp, synthetic construct
  misc_feature 1..20: note = CRISPR gRNA sequence
  source 1..20: mol_type = other DNA
cgttcttttcatcctcttct

SEQ ID NO: 99400 - DNA, 20 bp, synthetic construct
  misc_feature 1..20: note = CRISPR gRNA sequence
  source 1..20: mol_type = other DNA
tctcactgcaacctccacct

SEQ ID NO: 99401 - DNA, 20 bp, synthetic construct
  misc_feature 1..20: note = CRISPR gRNA sequence
  source 1..20: mol_type = other DNA
aacctccacctcctggattc

SEQ ID NO: 99402 - DNA, 20 bp, synthetic construct
  misc_feature 1..20: note = CRISPR gRNA sequence
  source 1..20: mol_type = other DNA
tgcctcagcctcccgagtag

SEQ ID NO: 99403 - DNA, 20 bp, synthetic construct
  misc_feature 1..20: note = CRISPR gRNA sequence
  source 1..20: mol_type = other DNA
gccaccatgcatggctaatt

SEQ ID NO: 99404 - DNA, 20 bp, synthetic construct
  misc_feature 1..20: note = CRISPR gRNA sequence
  source 1..20: mol_type = other DNA
cacctcagcctcccaaagtg

SEQ ID NO: 99405 - DNA, 20 bp, synthetic construct
  misc_feature 1..20: note = CRISPR gRNA sequence
  source 1..20: mol_type = other DNA
tttgaacacttatttcaact

SEQ ID NO: 99406 - DNA, 20 bp, synthetic construct
  misc_feature 1..20: note = CRISPR gRNA sequence
  source 1..20: mol_type = other DNA
cctagagggcaaaaactatg

SEQ ID NO: 99407 - DNA, 20 bp, synthetic construct
  misc_feature 1..20: note = CRISPR gRNA sequence
  source 1..20: mol_type = other DNA
ttgggaggccacggcaggag

SEQ ID NO: 99408 - DNA, 20 bp, synthetic construct
  misc_feature 1..20: note = CRISPR gRNA sequence
  source 1..20: mol_type = other DNA
caggagaattgcttgagccc

SEQ ID NO: 99409 - DNA, 20 bp, synthetic construct
  misc_feature 1..20: note = CRISPR gRNA sequence
  source 1..20: mol_type = other DNA
ttgctgggtatggtggcacc

SEQ ID NO: 99410 - DNA, 20 bp, synthetic construct
  misc_feature 1..20: note = CRISPR gRNA sequence
  source 1..20: mol_type = other DNA
tcaggaggctgaggtgggag

SEQ ID NO: 99411 - DNA, 20 bp, synthetic construct
  misc_feature 1..20: note = CRISPR gRNA sequence
  source 1..20: mol_type = other DNA
tttgggaggctgaggcaggt

SEQ ID NO: 99412 - DNA, 20 bp, synthetic construct
  misc_feature 1..20: note = CRISPR gRNA sequence
  source 1..20: mol_type = other DNA
caggtggatgatttgaggtc

SEQ ID NO: 99413 - DNA, 20 bp, synthetic construct
  misc_feature 1..20: note = CRISPR gRNA sequence
  source 1..20: mol_type = other DNA
tcgggaggctgaggcacaag

SEQ ID NO: 99414 - DNA, 20 bp, synthetic construct
  misc_feature 1..20: note = CRISPR gRNA sequence
  source 1..20: mol_type = other DNA
acagcaacaaaaaaaaacag

SEQ ID NO: 99415 - DNA, 20 bp, synthetic construct
  misc_feature 1..20: note = CRISPR gRNA sequence
  source 1..20: mol_type = other DNA
aggggaaactgacgcctgtt

SEQ ID NO: 99416 - DNA, 20 bp, synthetic construct
  misc_feature 1..20: note = CRISPR gRNA sequence
  source 1..20: mol_type = other DNA
tgacctgtgagtgtccacgt

SEQ ID NO: 99417 - DNA, 20 bp, synthetic construct
  misc_feature 1..20: note = CRISPR gRNA sequence
  source 1..20: mol_type = other DNA
tcgtcaacaagccagacgag

SEQ ID NO: 99418 - DNA, 20 bp, synthetic construct
  misc_feature 1..20: note = CRISPR gRNA sequence
  source 1..20: mol_type = other DNA
catctgggcctccgcctttg

SEQ ID NO: 99419 - DNA, 20 bp, synthetic construct
  misc_feature 1..20: note = CRISPR gRNA sequence
  source 1..20: mol_type = other DNA
cctttggagagattgagacc

SEQ ID NO: 99420 - DNA, 20 bp, synthetic construct
  misc_feature 1..20: note = CRISPR gRNA sequence
  source 1..20: mol_type = other DNA
ccgggggccttagggtgggc

SEQ ID NO: 99421 - DNA, 20 bp, synthetic construct
  misc_feature 1..20: note = CRISPR gRNA sequence
  source 1..20: mol_type = other DNA
gaggcggaggtagcagtgag

SEQ ID NO: 99422 - DNA, 20 bp, synthetic construct
  misc_feature 1..20: note = CRISPR gRNA sequence
  source 1..20: mol_type = other DNA
atgcggctgctgtgggtacc

SEQ ID NO: 99423 - DNA, 20 bp, synthetic construct
  misc_feature 1..20: note = CRISPR gRNA sequence
  source 1..20: mol_type = other DNA
cgtgacgtggacatcaacat

SEQ ID NO: 99424 - DNA, 20 bp, synthetic construct
  misc_feature 1..20: note = CRISPR gRNA sequence
  source 1..20: mol_type = other DNA
gtcttcctggaggaaggtgt

SEQ ID NO: 99425 - DNA, 20 bp, synthetic construct
  misc_feature 1..20: note = CRISPR gRNA sequence
  source 1..20: mol_type = other DNA
gaatgaggaagaggtaaacc

SEQ ID NO: 99426 - DNA, 20 bp, synthetic construct
  misc_feature 1..20: note = CRISPR gRNA sequence
  source 1..20: mol_type = other DNA
agggcagggagacgcccaag

SEQ ID NO: 99427 - DNA, 20 bp, synthetic construct
  misc_feature 1..20: note = CRISPR gRNA sequence
  source 1..20: mol_type = other DNA
gaccacacgggagtcggggt

SEQ ID NO: 99428 - DNA, 20 bp, synthetic construct
  misc_feature 1..20: note = CRISPR gRNA sequence
  source 1..20: mol_type = other DNA
aagtggccaacagaagtcag

SEQ ID NO: 99429 - DNA, 20 bp, synthetic construct
  misc_feature 1..20: note = CRISPR gRNA sequence
  source 1..20: mol_type = other DNA
cctgggatggggaggtcagg

SEQ ID NO: 99430 - DNA, 20 bp, synthetic construct
  misc_feature 1..20: note = CRISPR gRNA sequence
  source 1..20: mol_type = other DNA
atccctctccgtggcgggca

SEQ ID NO: 99431 - DNA, 20 bp, synthetic construct
  misc_feature 1..20: note = CRISPR gRNA sequence
  source 1..20: mol_type = other DNA
aacaggggccataggcagac

SEQ ID NO: 99432 - DNA, 20 bp, synthetic construct
  misc_feature 1..20: note = CRISPR gRNA sequence
  source 1..20: mol_type = other DNA
ctggggtcatggtagagatg

SEQ ID NO: 99433 - DNA, 20 bp, synthetic construct
  misc_feature 1..20: note = CRISPR gRNA sequence
  source 1..20: mol_type = other DNA
aaatatccccctccttcctt

SEQ ID NO: 99434 - DNA, 20 bp, synthetic construct
  misc_feature 1..20: note = CRISPR gRNA sequence
  source 1..20: mol_type = other DNA
ctccttccttcagagtttta

SEQ ID NO: 99435 - DNA, 20 bp, synthetic construct
  misc_feature 1..20: note = CRISPR gRNA sequence
  source 1..20: mol_type = other DNA
aaatcattcctcttccctcc

SEQ ID NO: 99436 - DNA, 20 bp, synthetic construct
  misc_feature 1..20: note = CRISPR gRNA sequence
  source 1..20: mol_type = other DNA
cttccctcctcatgttttcg

SEQ ID NO: 99437 - DNA, 20 bp, synthetic construct
  misc_feature 1..20: note = CRISPR gRNA sequence
  source 1..20: mol_type = other DNA
cctcctcatgttttcggggg

SEQ ID NO: 99438 - DNA, 20 bp, synthetic construct
  misc_feature 1..20: note = CRISPR gRNA sequence
  source 1..20: mol_type = other DNA
ctggaatgaagtggtgcagg

SEQ ID NO: 99439 - DNA, 20 bp, synthetic construct
  misc_feature 1..20: note = CRISPR gRNA sequence
  source 1..20: mol_type = other DNA
atgcctggctaattttttgt

SEQ ID NO: 99440 - DNA, 20 bp, synthetic construct
  misc_feature 1..20: note = CRISPR gRNA sequence
  source 1..20: mol_type = other DNA
aacttccacctcccaggttc

SEQ ID NO: 99441 - DNA, 20 bp, synthetic construct
  misc_feature 1..20: note = CRISPR gRNA sequence
  source 1..20: mol_type = other DNA
ttttatatttttagtagaga

SEQ ID NO: 99442 - DNA, 20 bp, synthetic construct
  misc_feature 1..20: note = CRISPR gRNA sequence
  source 1..20: mol_type = other DNA
tgtgttggcctcccaaagtg

SEQ ID NO: 99443 - DNA, 20 bp, synthetic construct
  misc_feature 1..20: note = CRISPR gRNA sequence
  source 1..20: mol_type = other DNA
gccaccacgcctggctgtgt

SEQ ID NO: 99444 - DNA, 20 bp, synthetic construct
  misc_feature 1..20: note = CRISPR gRNA sequence
  source 1..20: mol_type = other DNA
tgcctcagcctcctgaatag

SEQ ID NO: 99445 - DNA, 20 bp, synthetic construct
  misc_feature 1..20: note = CRISPR gRNA sequence
  source 1..20: mol_type = other DNA
ttttttttttttttttgaga

SEQ ID NO: 99446 - DNA, 20 bp, synthetic construct
  misc_feature 1..20: note = CRISPR gRNA sequence
  source 1..20: mol_type = other DNA
tgcctcagcctcccaagtag

SEQ ID NO: 99447 - DNA, 20 bp, synthetic construct
  misc_feature 1..20: note = CRISPR gRNA sequence
  source 1..20: mol_type = other DNA
ttttgcatttttagtagagt

SEQ ID NO: 99448 - DNA, 20 bp, synthetic construct
  misc_feature 1..20: note = CRISPR gRNA sequence
  source 1..20: mol_type = other DNA
acctcaggtgatccacccgc

SEQ ID NO: 99449 - DNA, 20 bp, synthetic construct
  misc_feature 1..20: note = CRISPR gRNA sequence
  source 1..20: mol_type = other DNA
cgcctcagcttcccaaagtg

SEQ ID NO: 99450 - DNA, 20 bp, synthetic construct
  misc_feature 1..20: note = CRISPR gRNA sequence
  source 1..20: mol_type = other DNA
ggctgcacctggctaatttt

SEQ ID NO: 99451 - DNA, 20 bp, synthetic construct
  misc_feature 1..20: note = CRISPR gRNA sequence
  source 1..20: mol_type = other DNA
ttttgtagttttagtagaga

SEQ ID NO: 99452 - DNA, 20 bp, synthetic construct
  misc_feature 1..20: note = CRISPR gRNA sequence
  source 1..20: mol_type = other DNA
taccttggcctcccaaagtg

SEQ ID NO: 99453 - DNA, 20 bp, synthetic construct
  misc_feature 1..20: note = CRISPR gRNA sequence
  source 1..20: mol_type = other DNA
ttaaatttttttggtagaga

SEQ ID NO: 99454 - DNA, 20 bp, synthetic construct
  misc_feature 1..20: note = CRISPR gRNA sequence
  source 1..20: mol_type = other DNA
ccactggacctcccaaagtg

SEQ ID NO: 99455 - DNA, 20 bp, synthetic construct
  misc_feature 1..20: note = CRISPR gRNA sequence
  source 1..20: mol_type = other DNA
tgaaagtcacaattcacaca

SEQ ID NO: 99456 - DNA, 20 bp, synthetic construct
  misc_feature 1..20: note = CRISPR gRNA sequence
  source 1..20: mol_type = other DNA
tggggtgagtcctcggttct

SEQ ID NO: 99457 - DNA, 20 bp, synthetic construct
  misc_feature 1..20: note = CRISPR gRNA sequence
  source 1..20: mol_type = other DNA
atgcaggtctctgcaagggt

SEQ ID NO: 99458 - DNA, 20 bp, synthetic construct
  misc_feature 1..20: note = CRISPR gRNA sequence
  source 1..20: mol_type = other DNA
ggcctgtgcctccaccccac

SEQ ID NO: 99459 - DNA, 20 bp, synthetic construct
  misc_feature 1..20: note = CRISPR gRNA sequence
  source 1..20: mol_type = other DNA
aacccagaactgacttcaaa

SEQ ID NO: 99460 - DNA, 20 bp, synthetic construct
  misc_feature 1..20: note = CRISPR gRNA sequence
  source 1..20: mol_type = other DNA
gtgcagaatgagggactttg

SEQ ID NO: 99461 - DNA, 20 bp, synthetic construct
  misc_feature 1..20: note = CRISPR gRNA sequence
  source 1..20: mol_type = other DNA
ggactttgctgtgcttcccg

SEQ ID NO: 99462 - DNA, 20 bp, synthetic construct
  misc_feature 1..20: note = CRISPR gRNA sequence
  source 1..20: mol_type = other DNA
tgtggtcatctaccacctgc

SEQ ID NO: 99463 - DNA, 20 bp, synthetic construct
  misc_feature 1..20: note = CRISPR gRNA sequence
  source 1..20: mol_type = other DNA
aaagtccctcattctgcaca

SEQ ID NO: 99464 - DNA, 20 bp, synthetic construct
  misc_feature 1..20: note = CRISPR gRNA sequence
  source 1..20: mol_type = other DNA
agctgcctttgaagtcagtt

SEQ ID NO: 99465 - DNA, 20 bp, synthetic construct
  misc_feature 1..20: note = CRISPR gRNA sequence
  source 1..20: mol_type = other DNA
cgggcaccaggttgctctgg

SEQ ID NO: 99466 - DNA, 20 bp, synthetic construct
  misc_feature 1..20: note = CRISPR gRNA sequence
  source 1..20: mol_type = other DNA
gggcagggaaaaggtgggct

SEQ ID NO: 99467 - DNA, 20 bp, synthetic construct
  misc_feature 1..20: note = CRISPR gRNA sequence
  source 1..20: mol_type = other DNA
cccaggaacctcaacttccc

SEQ ID NO: 99468 - DNA, 20 bp, synthetic construct
  misc_feature 1..20: note = CRISPR gRNA sequence
  source 1..20: mol_type = other DNA
agtttgtaaaaatgcacttt

SEQ ID NO: 99469 - DNA, 20 bp, synthetic construct
  misc_feature 1..20: note = CRISPR gRNA sequence
  source 1..20: mol_type = other DNA
ttgggaggtccagtggggag

SEQ ID NO: 99470 - DNA, 20 bp, synthetic construct
  misc_feature 1..20: note = CRISPR gRNA sequence
  source 1..20: mol_type = other DNA
cttgagctcaggaatttgag

SEQ ID NO: 99471 - DNA, 20 bp, synthetic construct
  misc_feature 1..20: note = CRISPR gRNA sequence
  source 1..20: mol_type = other DNA
aaaaaaatttaaaaattagg

SEQ ID NO: 99472 - DNA, 20 bp, synthetic construct
  misc_feature 1..20: note = CRISPR gRNA sequence
  source 1..20: mol_type = other DNA
cgggtggatcacctgaggtc

SEQ ID NO: 99473 - DNA, 20 bp, synthetic construct
  misc_feature 1..20: note = CRISPR gRNA sequence
  source 1..20: mol_type = other DNA
ttgggaggctgaggcaggag

SEQ ID NO: 99474 - DNA, 20 bp, synthetic construct
  misc_feature 1..20: note = CRISPR gRNA sequence
  source 1..20: mol_type = other DNA
tcaggaggctgaggcaggag

SEQ ID NO: 99475 - DNA, 20 bp, synthetic construct
  misc_feature 1..20: note = CRISPR gRNA sequence
  source 1..20: mol_type = other DNA
gaggcagaggttgcagtgag

SEQ ID NO: 99476 - DNA, 20 bp, synthetic construct
  misc_feature 1..20: note = CRISPR gRNA sequence
  source 1..20: mol_type = other DNA
ctgtctcaaaaaataaataa

SEQ ID NO: 99477 - DNA, 20 bp, synthetic construct
  misc_feature 1..20: note = CRISPR gRNA sequence
  source 1..20: mol_type = other DNA
aagaaggatcacttgagccc

SEQ ID NO: 99478 - DNA, 20 bp, synthetic construct
  misc_feature 1..20: note = CRISPR gRNA sequence
  source 1..20: mol_type = other DNA
tcaggaggctgaggcaggag

SEQ ID NO: 99479 - DNA, 20 bp, synthetic construct
  misc_feature 1..20: note = CRISPR gRNA sequence
  source 1..20: mol_type = other DNA
aaaacatgaggagggaagag

SEQ ID NO: 99480 - DNA, 20 bp, synthetic construct
  misc_feature 1..20: note = CRISPR gRNA sequence
  source 1..20: mol_type = other DNA
tccatcggggtgtagccaga

SEQ ID NO: 99481 - DNA, 20 bp, synthetic construct
  misc_feature 1..20: note = CRISPR gRNA sequence
  source 1..20: mol_type = other DNA
ctctgaaccatggaggatgg

SEQ ID NO: 99482 - DNA, 20 bp, synthetic construct
  misc_feature 1..20: note = CRISPR gRNA sequence
  source 1..20: mol_type = other DNA
acttgggcgtctccctgccc

SEQ ID NO: 99483 - DNA, 20 bp, synthetic construct
  misc_feature 1..20: note = CRISPR gRNA sequence
  source 1..20: mol_type = other DNA
gggtaggggcaggagaaacc

SEQ ID NO: 99484 - DNA, 20 bp, synthetic construct
  misc_feature 1..20: note = CRISPR gRNA sequence
  source 1..20: mol_type = other DNA
ccatctcactttctggggtc

SEQ ID NO: 99485 - DNA, 20 bp, synthetic construct
  misc_feature 1..20: note = CRISPR gRNA sequence
  source 1..20: mol_type = other DNA
accttcctccaggaagacct

SEQ ID NO: 99486 - DNA, 20 bp, synthetic construct
  misc_feature 1..20: note = CRISPR gRNA sequence
  source 1..20: mol_type = other DNA
cagttcactgcatctcagct

SEQ ID NO: 99487 - DNA, 20 bp, synthetic construct
  misc_feature 1..20: note = CRISPR gRNA sequence
  source 1..20: mol_type = other DNA
agaagaagggacagtggtag

SEQ ID NO: 99488 - DNA, 20 bp, synthetic construct
  misc_feature 1..20: note = CRISPR gRNA sequence
  source 1..20: mol_type = other DNA
cacctcagcctccagagtac

SEQ ID NO: 99489 - DNA, 20 bp, synthetic construct
  misc_feature 1..20: note = CRISPR gRNA sequence
  source 1..20: mol_type = other DNA
ttgtatttttttagtagaga

SEQ ID NO: 99490 - DNA, 20 bp, synthetic construct
  misc_feature 1..20: note = CRISPR gRNA sequence
  source 1..20: mol_type = other DNA
cgcctcggcctcccaaagtg

SEQ ID NO: 99491 - DNA, 20 bp, synthetic construct
  misc_feature 1..20: note = CRISPR gRNA sequence
  source 1..20: mol_type = other DNA
ggggggtgaagccgcgctcg

SEQ ID NO: 99492 - DNA, 20 bp, synthetic construct
  misc_feature 1..20: note = CRISPR gRNA sequence
  source 1..20: mol_type = other DNA
ggcagagtcctcactcatcc

SEQ ID NO: 99493 - DNA, 20 bp, synthetic construct
  misc_feature 1..20: note = CRISPR gRNA sequence
  source 1..20: mol_type = other DNA
atccccttgcttctctgtgc

SEQ ID NO: 99494 - DNA, 20 bp, synthetic construct
  misc_feature 1..20: note = CRISPR gRNA sequence
  source 1..20: mol_type = other DNA
tgcctcagtttaccctctgt

SEQ ID NO: 99495 - DNA, 20 bp, synthetic construct
  misc_feature 1..20: note = CRISPR gRNA sequence
  source 1..20: mol_type = other DNA
gccggttggtgagagtggtg

SEQ ID NO: 99496 - DNA, 20 bp, synthetic construct
  misc_feature 1..20: note = CRISPR gRNA sequence
  source 1..20: mol_type = other DNA
ctgggaaacagacaacaggc

SEQ ID NO: 99497 - DNA, 20 bp, synthetic construct
  misc_feature 1..20: note = CRISPR gRNA sequence
  source 1..20: mol_type = other DNA
ttcccctcagtagatgtctc

SEQ ID NO: 99498 - DNA, 20 bp, synthetic construct
  misc_feature 1..20: note = CRISPR gRNA sequence
  source 1..20: mol_type = other DNA
aggcttcaggacagaagccc

SEQ ID NO: 99499 - DNA, 20 bp, synthetic construct
  misc_feature 1..20: note = CRISPR gRNA sequence
  source 1..20: mol_type = other DNA
ctgtttttttttgttgctgt

SEQ ID NO: 99500 - DNA, 20 bp, synthetic construct
  misc_feature 1..20: note = CRISPR gRNA sequence
  source 1..20: mol_type = other DNA
aacctctgcctcctgggttc

SEQ ID NO: 99501 - DNA, 20 bp, synthetic construct
  misc_feature 1..20: note = CRISPR gRNA sequence
  source 1..20: mol_type = other DNA
ttttgtattttaagtagaga

SEQ ID NO: 99502 - DNA, 20 bp, synthetic construct
  misc_feature 1..20: note = CRISPR gRNA sequence
  source 1..20: mol_type = other DNA
tgcctcagcctcccaaagtg

SEQ ID NO: 99503 - DNA, 20 bp, synthetic construct
  misc_feature 1..20: note = CRISPR gRNA sequence
  source 1..20: mol_type = other DNA
gagccaccacacccagctat

SEQ ID NO: 99504 - DNA, 20 bp, synthetic construct
  misc_feature 1..20: note = CRISPR gRNA sequence
  source 1..20: mol_type = other DNA
tgccgtggcctcccaaagtg

SEQ ID NO: 99505 - DNA, 20 bp, synthetic construct
  misc_feature 1..20: note = CRISPR gRNA sequence
  source 1..20: mol_type = other DNA
aatgttctgagcaaacaaga

SEQ ID NO: 99506 - DNA, 20 bp, synthetic construct
  misc_feature 1..20: note = CRISPR gRNA sequence
  source 1..20: mol_type = other DNA
tgggtggatcacctgaggtc

SEQ ID NO: 99507 - DNA, 20 bp, synthetic construct
  misc_feature 1..20: note = CRISPR gRNA sequence
  source 1..20: mol_type = other DNA
tcgggaggctgaggcaggag

SEQ ID NO: 99508 - DNA, 20 bp, synthetic construct
  misc_feature 1..20: note = CRISPR gRNA sequence
  source 1..20: mol_type = other DNA
actccaccctggacaacaga

SEQ ID NO: 99509 - DNA, 20 bp, synthetic construct
  misc_feature 1..20: note = CRISPR gRNA sequence
  source 1..20: mol_type = other DNA
aatggcgtgaacacgggagg

SEQ ID NO: 99510 - DNA, 20 bp, synthetic construct
  misc_feature 1..20: note = CRISPR gRNA sequence
  source 1..20: mol_type = other DNA
gaggtggagcttgcagtgag

SEQ ID NO: 99511 - DNA, 20 bp, synthetic construct
  misc_feature 1..20: note = CRISPR gRNA sequence
  source 1..20: mol_type = other DNA
agctcctagggaggctgagt

SEQ ID NO: 99512 - DNA, 20 bp, synthetic construct
  misc_feature 1..20: note = CRISPR gRNA sequence
  source 1..20: mol_type = other DNA
gaagttgaggctgcagtgaa

SEQ ID NO: 99513 - DNA, 20 bp, synthetic construct
  misc_feature 1..20: note = CRISPR gRNA sequence
  source 1..20: mol_type = other DNA
ggaaatgaaaaccagagtcc

SEQ ID NO: 99514 - DNA, 20 bp, synthetic construct
  misc_feature 1..20: note = CRISPR gRNA sequence
  source 1..20: mol_type = other DNA
accaaagcacctacaatgtg

SEQ ID NO: 99515 - DNA, 20 bp, synthetic construct
  misc_feature 1..20: note = CRISPR gRNA sequence
  source 1..20: mol_type = other DNA
tactcgggaggctgaggcag

SEQ ID NO: 99516 - DNA, 20 bp, synthetic construct
  misc_feature 1..20: note = CRISPR gRNA sequence
  source 1..20: mol_type = other DNA
acgtgacttaacctttgagc

SEQ ID NO: 99517 - DNA, 20 bp, synthetic construct
  misc_feature 1..20: note = CRISPR gRNA sequence
  source 1..20: mol_type = other DNA
tacaacgaattatgtctgta

SEQ ID NO: 99518 - DNA, 20 bp, synthetic construct
  misc_feature 1..20: note = CRISPR gRNA sequence
  source 1..20: mol_type = other DNA
tgagtgacggctcaacaaag

SEQ ID NO: 99519 - DNA, 20 bp, synthetic construct
  misc_feature 1..20: note = CRISPR gRNA sequence
  source 1..20: mol_type = other DNA
ggagaccggaccctcagcga

SEQ ID NO: 99520 - DNA, 20 bp, synthetic construct
  misc_feature 1..20: note = CRISPR gRNA sequence
  source 1..20: mol_type = other DNA
cccaccccagagctccccca

SEQ ID NO: 99521 - DNA, 20 bp, synthetic construct
  misc_feature 1..20: note = CRISPR gRNA sequence
  source 1..20: mol_type = other DNA
ccgctcacctttaccctgcc

SEQ ID NO: 99522 - DNA, 20 bp, synthetic construct
  misc_feature 1..20: note = CRISPR gRNA sequence
  source 1..20: mol_type = other DNA
tccagagggagccaattggc

SEQ ID NO: 99523 - DNA, 20 bp, synthetic construct
  misc_feature 1..20: note = CRISPR gRNA sequence
  source 1..20: mol_type = other DNA
aaggtcccttctgcggtctc

SEQ ID NO: 99524 - DNA, 20 bp, synthetic construct
  misc_feature 1..20: note = CRISPR gRNA sequence
  source 1..20: mol_type = other DNA
gggggcagagggctaaagaa

SEQ ID NO: 99525 - DNA, 20 bp, synthetic construct
  misc_feature 1..20: note = CRISPR gRNA sequence
  source 1..20: mol_type = other DNA
ggaacaggagccgtgcggcg

SEQ ID NO: 99526 - DNA, 20 bp, synthetic construct
  misc_feature 1..20: note = CRISPR gRNA sequence
  source 1..20: mol_type = other DNA
cggcgtccggtttcagcagg

SEQ ID NO: 99527 - DNA, 20 bp, synthetic construct
  misc_feature 1..20: note = CRISPR gRNA sequence
  source 1..20: mol_type = other DNA
ttaggcgggcgtcccaacct

SEQ ID NO: 99528 - DNA, 20 bp, synthetic construct
  misc_feature 1..20: note = CRISPR gRNA sequence
  source 1..20: mol_type = other DNA
cccaacctccgggcttccgg

SEQ ID NO: 99529 - DNA, 20 bp, synthetic construct
  misc_feature 1..20: note = CRISPR gRNA sequence
  source 1..20: mol_type = other DNA
cgctcctcagtctttgcgga

SEQ ID NO: 99530 - DNA, 20 bp, synthetic construct
  misc_feature 1..20: note = CRISPR gRNA sequence
  source 1..20: mol_type = other DNA
ctcctgctatatccattgga

SEQ ID NO: 99531 - DNA, 20 bp, synthetic construct
  misc_feature 1..20: note = CRISPR gRNA sequence
  source 1..20: mol_type = other DNA
atttatttttgattggagtc

SEQ ID NO: 99532 - DNA, 20 bp, synthetic construct
  misc_feature 1..20: note = CRISPR gRNA sequence
  source 1..20: mol_type = other DNA
ggatcccctctcttcttgag

SEQ ID NO: 99533 - DNA, 20 bp, synthetic construct
  misc_feature 1..20: note = CRISPR gRNA sequence
  source 1..20: mol_type = other DNA
agaacattgccaggcaggga

SEQ ID NO: 99534 - DNA, 20 bp, synthetic construct
  misc_feature 1..20: note = CRISPR gRNA sequence
  source 1..20: mol_type = other DNA
cactttgggaggccacggca

SEQ ID NO: 99535 - DNA, 20 bp, synthetic construct
  misc_feature 1..20: note = CRISPR gRNA sequence
  source 1..20: mol_type = other DNA
ctactcgggaggctgaggca

SEQ ID NO: 99536 - DNA, 20 bp, synthetic construct
  misc_feature 1..20: note = CRISPR gRNA sequence
  source 1..20: mol_type = other DNA
aggtgtctaagcttgagacc

SEQ ID NO: 99537 - DNA, 20 bp, synthetic construct
  misc_feature 1..20: note = CRISPR gRNA sequence
  source 1..20: mol_type = other DNA
ccagagagtacaaggcattt

SEQ ID NO: 99538 - DNA, 20 bp, synthetic construct
  misc_feature 1..20: note = CRISPR gRNA sequence
  source 1..20: mol_type = other DNA
ttctcctgcccctacccacg

SEQ ID NO: 99539 - DNA, 20 bp, synthetic construct
  misc_feature 1..20: note = CRISPR gRNA sequence
  source 1..20: mol_type = other DNA
tctgggggacctgaagggag

SEQ ID NO: 99540 - DNA, 20 bp, synthetic construct
  misc_feature 1..20: note = CRISPR gRNA sequence
  source 1..20: mol_type = other DNA
agagttttactgtgtttggg

SEQ ID NO: 99541 - DNA, 20 bp, synthetic construct
  misc_feature 1..20: note = CRISPR gRNA sequence
  source 1..20: mol_type = other DNA
ggtttgtttttttgttcgag

SEQ ID NO: 99542 - DNA, 20 bp, synthetic construct
  misc_feature 1..20: note = CRISPR gRNA sequence
  source 1..20: mol_type = other DNA
ggaaccaataaaccttctgt

SEQ ID NO: 99543 - DNA, 20 bp, synthetic construct
  misc_feature 1..20: note = CRISPR gRNA sequence
  source 1..20: mol_type = other DNA
aaatgcacttttgtagcttt

SEQ ID NO: 99544 - DNA, 20 bp, synthetic construct
  misc_feature 1..20: note = CRISPR gRNA sequence
  source 1..20: mol_type = other DNA
tgagatcacctgaccaacat

SEQ ID NO: 99545 - DNA, 20 bp, synthetic construct
  misc_feature 1..20: note = CRISPR gRNA sequence
  source 1..20: mol_type = other DNA
ctacttgggaggctgaggca

SEQ ID NO: 99546 - DNA, 20 bp, synthetic construct
  misc_feature 1..20: note = CRISPR gRNA sequence
  source 1..20: mol_type = other DNA
ctattcaggaggctgaggca

SEQ ID NO: 99547 - DNA, 20 bp, synthetic construct
  misc_feature 1..20: note = CRISPR gRNA sequence
  source 1..20: mol_type = other DNA
ctactcaggaggctgaggca

SEQ ID NO: 99548 - DNA, 20 bp, synthetic construct
  misc_feature 1..20: note = CRISPR gRNA sequence
  source 1..20: mol_type = other DNA
agttggggtcccattgtgac

SEQ ID NO: 99549 - DNA, 20 bp, synthetic construct
  misc_feature 1..20: note = CRISPR gRNA sequence
  source 1..20: mol_type = other DNA
tctccctcccttcaggtccc

SEQ ID NO: 99550 - DNA, 20 bp, synthetic construct
  misc_feature 1..20: note = CRISPR gRNA sequence
  source 1..20: mol_type = other DNA
ggagggtggggcctgggagt

SEQ ID NO: 99551 - DNA, 20 bp, synthetic construct
  misc_feature 1..20: note = CRISPR gRNA sequence
  source 1..20: mol_type = other DNA
ttctgtcgtgggtaggggca

SEQ ID NO: 99552 - DNA, 20 bp, synthetic construct
  misc_feature 1..20: note = CRISPR gRNA sequence
  source 1..20: mol_type = other DNA
caagtaggtgcatcagacat

SEQ ID NO: 99553 - DNA, 20 bp, synthetic construct
  misc_feature 1..20: note = CRISPR gRNA sequence
  source 1..20: mol_type = other DNA
ctactcgggaggctgaggca

SEQ ID NO: 99554 - DNA, 20 bp, synthetic construct
  misc_feature 1..20: note = CRISPR gRNA sequence
  source 1..20: mol_type = other DNA
caccgagatcttaggaagtc

SEQ ID NO: 99555 - DNA, 20 bp, synthetic construct
  misc_feature 1..20: note = CRISPR gRNA sequence
  source 1..20: mol_type = other DNA
ctacttgggaggctgaggca

SEQ ID NO: 99556 - DNA, 20 bp, synthetic construct
  misc_feature 1..20: note = CRISPR gRNA sequence
  source 1..20: mol_type = other DNA
ctactcgggaggctgaagca

SEQ ID NO: 99557 - DNA, 20 bp, synthetic construct
  misc_feature 1..20: note = CRISPR gRNA sequence
  source 1..20: mol_type = other DNA
agcgagactccatctcaaaa

SEQ ID NO: 99558 - DNA, 20 bp, synthetic construct
  misc_feature 1..20: note = CRISPR gRNA sequence
  source 1..20: mol_type = other DNA
agactccatctcaaaaaaag

SEQ ID NO: 99559 - DNA, 20 bp, synthetic construct
  misc_feature 1..20: note = CRISPR gRNA sequence
  source 1..20: mol_type = other DNA
tccatctcaaaaaaagaaag

SEQ ID NO: 99560 - DNA, 20 bp, synthetic construct
  misc_feature 1..20: note = CRISPR gRNA sequence
  source 1..20: mol_type = other DNA
tctcaaaaaaagaaagaaag

SEQ ID NO: 99561 - DNA, 20 bp, synthetic construct
  misc_feature 1..20: note = CRISPR gRNA sequence
  source 1..20: mol_type = other DNA
ctactcaggaggctgagaca

SEQ ID NO: 99562 - DNA, 20 bp, synthetic construct
  misc_feature 1..20: note = CRISPR gRNA sequence
  source 1..20: mol_type = other DNA
cagctactcgggaggctgag

SEQ ID NO: 99563 - DNA, 20 bp, synthetic construct
  misc_feature 1..20: note = CRISPR gRNA sequence
  source 1..20: mol_type = other DNA
aaaaaaaaaaaaaaaaaaaa

SEQ ID NO: 99564 - DNA, 20 bp, synthetic construct
  misc_feature 1..20: note = CRISPR gRNA sequence
  source 1..20: mol_type = other DNA
atctggcttcctctgccggg

SEQ ID NO: 99565 - DNA, 20 bp, synthetic construct
  misc_feature 1..20: note = CRISPR gRNA sequence
  source 1..20: mol_type = other DNA
gggcggggcctaaagggctc

SEQ ID NO: 99566 - DNA, 20 bp, synthetic construct
  misc_feature 1..20: note = CRISPR gRNA sequence
  source 1..20: mol_type = other DNA
tctctcaaggaaaagggggt

SEQ ID NO: 99567 - DNA, 20 bp, synthetic construct
  misc_feature 1..20: note = CRISPR gRNA sequence
  source 1..20: mol_type = other DNA
gcattacccactcgggccgc

SEQ ID NO: 99568 - DNA, 20 bp, synthetic construct
  misc_feature 1..20: note = CRISPR gRNA sequence
  source 1..20: mol_type = other DNA
cccccgactccctagagggc

SEQ ID NO: 99569 - DNA, 20 bp, synthetic construct
  misc_feature 1..20: note = CRISPR gRNA sequence
  source 1..20: mol_type = other DNA
gactctgtctcaaaaaaaaa

SEQ ID NO: 99570 - DNA, 20 bp, synthetic construct
  misc_feature 1..20: note = CRISPR gRNA sequence
  source 1..20: mol_type = other DNA
aaacaacaacagcaacaaaa

SEQ ID NO: 99571 - DNA, 20 bp, synthetic construct
  misc_feature 1..20: note = CRISPR gRNA sequence
  source 1..20: mol_type = other DNA
ggccagcttgggcaacagag

SEQ ID NO: 99572 - DNA, 20 bp, synthetic construct
  misc_feature 1..20: note = CRISPR gRNA sequence
  source 1..20: mol_type = other DNA
tgatgaaaccccatctctac

SEQ ID NO: 99573 - DNA, 20 bp, synthetic construct
  misc_feature 1..20: note = CRISPR gRNA sequence
  source 1..20: mol_type = other DNA
cgagaccctgtctcttctaa

SEQ ID NO: 99574 - DNA, 20 bp, synthetic construct
  misc_feature 1..20: note = CRISPR gRNA sequence
  source 1..20: mol_type = other DNA
agactttctgcctcgaacaa

SEQ ID NO: 99575 - DNA, 20 bp, synthetic construct
  misc_feature 1..20: note = CRISPR gRNA sequence
  source 1..20: mol_type = other DNA
aacaaaaaaacaaacccccc

SEQ ID NO: 99576 - DNA, 20 bp, synthetic construct
  misc_feature 1..20: note = CRISPR gRNA sequence
  source 1..20: mol_type = other DNA
gatttctgtcccaaacacag

SEQ ID NO: 99577 - DNA, 20 bp, synthetic construct
  misc_feature 1..20: note = CRISPR gRNA sequence
  source 1..20: mol_type = other DNA
aaggcgccagcagacacagc

SEQ ID NO: 99578 - DNA, 20 bp, synthetic construct
  misc_feature 1..20: note = CRISPR gRNA sequence
  source 1..20: mol_type = other DNA
tcagacatagagaaataata

SEQ ID NO: 99579 - DNA, 20 bp, synthetic construct
  misc_feature 1..20: note = CRISPR gRNA sequence
  source 1..20: mol_type = other DNA
ggtgaaattccacctctact

SEQ ID NO: 99580 - DNA, 20 bp, synthetic construct
  misc_feature 1..20: note = CRISPR gRNA sequence
  source 1..20: mol_type = other DNA
gaccagcctgggcaacatgg

SEQ ID NO: 99581 - DNA, 20 bp, synthetic construct
  misc_feature 1..20: note = CRISPR gRNA sequence
  source 1..20: mol_type = other DNA
ggcaaaactccatctctact

SEQ ID NO: 99582 - DNA, 20 bp, synthetic construct
  misc_feature 1..20: note = CRISPR gRNA sequence
  source 1..20: mol_type = other DNA
ctccatttaaaaaaaaaaaa

SEQ ID NO: 99583 - DNA, 20 bp, synthetic construct
  misc_feature 1..20: note = CRISPR gRNA sequence
  source 1..20: mol_type = other DNA
aagaaagaaagaaagaaaaa

SEQ ID NO: 99584 - DNA, 20 bp, synthetic construct
  misc_feature 1..20: note = CRISPR gRNA sequence
  source 1..20: mol_type = other DNA
atcctcagttcctcagtaag

SEQ ID NO: 99585 - DNA, 20 bp, synthetic construct
  misc_feature 1..20: note = CRISPR gRNA sequence
  source 1..20: mol_type = other DNA
ctatctaccctcaaagagtt

SEQ ID NO: 99586 - DNA, 20 bp, synthetic construct
  misc_feature 1..20: note = CRISPR gRNA sequence
  source 1..20: mol_type = other DNA
cagagcgagaccctgtatca

SEQ ID NO: 99587 - DNA, 20 bp, synthetic construct
  misc_feature 1..20: note = CRISPR gRNA sequence
  source 1..20: mol_type = other DNA
gagaccctgtatcaaaaaac

SEQ ID NO: 99588 - DNA, 20 bp, synthetic construct
  misc_feature 1..20: note = CRISPR gRNA sequence
  source 1..20: mol_type = other DNA
tccagcatgggcaacaagag

SEQ ID NO: 99589 - DNA, 20 bp, synthetic construct
  misc_feature 1..20: note = CRISPR gRNA sequence
  source 1..20: mol_type = other DNA
aagagcaaaactccatctca

SEQ ID NO: 99590 - DNA, 20 bp, synthetic construct
  misc_feature 1..20: note = CRISPR gRNA sequence
  source 1..20: mol_type = other DNA
aactccatctcaaaaaacaa

SEQ ID NO: 99591 - DNA, 20 bp, synthetic construct
  misc_feature 1..20: note = CRISPR gRNA sequence
  source 1..20: mol_type = other DNA
catctcaaaaaacaacaaaa

SEQ ID NO: 99592 - DNA, 20 bp, synthetic construct
  misc_feature 1..20: note = CRISPR gRNA sequence
  source 1..20: mol_type = other DNA
caaaaaacaacaaaacaaaa

SEQ ID NO: 99593 - DNA, 20 bp, synthetic construct
  misc_feature 1..20: note = CRISPR gRNA sequence
  source 1..20: mol_type = other DNA
acaacaaaacaaaacaaaac

SEQ ID NO: 99594 - DNA, 20 bp, synthetic construct
  misc_feature 1..20: note = CRISPR gRNA sequence
  source 1..20: mol_type = other DNA
attaccagagccagggaaat

SEQ ID NO: 99595 - DNA, 20 bp, synthetic construct
  misc_feature 1..20: note = CRISPR gRNA sequence
  source 1..20: mol_type = other DNA
cgccgaaagcccagttctct

SEQ ID NO: 99596 - DNA, 20 bp, synthetic construct
  misc_feature 1..20: note = CRISPR gRNA sequence
  source 1..20: mol_type = other DNA
cggctcctccatagcgaccg

SEQ ID NO: 99597 - DNA, 20 bp, synthetic construct
  misc_feature 1..20: note = CRISPR gRNA sequence
  source 1..20: mol_type = other DNA
ctccatagcgaccgcggccg

SEQ ID NO: 99598 - DNA, 20 bp, synthetic construct
  misc_feature 1..20: note = CRISPR gRNA sequence
  source 1..20: mol_type = other DNA
catagcgaccgcggccgagc

SEQ ID NO: 99599 - DNA, 20 bp, synthetic construct
  misc_feature 1..20: note = CRISPR gRNA sequence
  source 1..20: mol_type = other DNA
ggacgcccgcctaagccttc

SEQ ID NO: 99600 - DNA, 20 bp, synthetic construct
  misc_feature 1..20: note = CRISPR gRNA sequence
  source 1..20: mol_type = other DNA
agccttccctgctgaaaccg

SEQ ID NO: 99601 - DNA, 20 bp, synthetic construct
  misc_feature 1..20: note = CRISPR gRNA sequence
  source 1..20: mol_type = other DNA
ccctgctgaaaccggacgcc

SEQ ID NO: 99602 - DNA, 20 bp, synthetic construct
  misc_feature 1..20: note = CRISPR gRNA sequence
  source 1..20: mol_type = other DNA
cctgctgaaaccggacgccg

SEQ ID NO: 99603 - DNA, 20 bp, synthetic construct
  misc_feature 1..20: note = CRISPR gRNA sequence
  source 1..20: mol_type = other DNA
ctgaaaccggacgccgcacg

SEQ ID NO: 99604 - DNA, 20 bp, synthetic construct
  misc_feature 1..20: note = CRISPR gRNA sequence
  source 1..20: mol_type = other DNA
aaaccggacgccgcacggct

SEQ ID NO: 99605 - DNA, 20 bp, synthetic construct
  misc_feature 1..20: note = CRISPR gRNA sequence
  source 1..20: mol_type = other DNA
ctgttccggtgtcagagggc

SEQ ID NO: 99606 - DNA, 20 bp, synthetic construct
  misc_feature 1..20: note = CRISPR gRNA sequence
  source 1..20: mol_type = other DNA
ttccggtgtcagagggcccg

SEQ ID NO: 99607 - DNA, 20 bp, synthetic construct
  misc_feature 1..20: note = CRISPR gRNA sequence
  source 1..20: mol_type = other DNA
cggtgtcagagggcccgccc

SEQ ID NO: 99608 - DNA, 20 bp, synthetic construct
  misc_feature 1..20: note = CRISPR gRNA sequence
  source 1..20: mol_type = other DNA
cccgctcctcagtctttgcg

SEQ ID NO: 99609 - DNA, 20 bp, synthetic construct
  misc_feature 1..20: note = CRISPR gRNA sequence
  source 1..20: mol_type = other DNA
ctcagtctttgcggacaaga

SEQ ID NO: 99610 - DNA, 20 bp, synthetic construct
  misc_feature 1..20: note = CRISPR gRNA sequence
  source 1..20: mol_type = other DNA
agtctttgcggacaagaaag

SEQ ID NO: 99611 - DNA, 20 bp, synthetic construct
  misc_feature 1..20: note = CRISPR gRNA sequence
  source 1..20: mol_type = other DNA
tgcggacaagaaaggggctg

SEQ ID NO: 99612 - DNA, 20 bp, synthetic construct
  misc_feature 1..20: note = CRISPR gRNA sequence
  source 1..20: mol_type = other DNA
gcggacaagaaaggggctgt

SEQ ID NO: 99613 - DNA, 20 bp, synthetic construct
  misc_feature 1..20: note = CRISPR gRNA sequence
  source 1..20: mol_type = other DNA
cggacaagaaaggggctgtg

SEQ ID NO: 99614 - DNA, 20 bp, synthetic construct
  misc_feature 1..20: note = CRISPR gRNA sequence
  source 1..20: mol_type = other DNA
tgtgagacgcagggaaggag

SEQ ID NO: 99615 - DNA, 20 bp, synthetic construct
  misc_feature 1..20: note = CRISPR gRNA sequence
  source 1..20: mol_type = other DNA
gtggagcgacacccaggcag

SEQ ID NO: 99616 - DNA, 20 bp, synthetic construct
  misc_feature 1..20: note = CRISPR gRNA sequence
  source 1..20: mol_type = other DNA
tctccctttctgaaccccct

SEQ ID NO: 99617 - DNA, 20 bp, synthetic construct
  misc_feature 1..20: note = CRISPR gRNA sequence
  source 1..20: mol_type = other DNA
tccctttctgaacccccttt

SEQ ID NO: 99618 - DNA, 20 bp, synthetic construct
  misc_feature 1..20: note = CRISPR gRNA sequence
  source 1..20: mol_type = other DNA
cctttctgaacccccttttc

SEQ ID NO: 99619 - DNA, 20 bp, synthetic construct
  misc_feature 1..20: note = CRISPR gRNA sequence
  source 1..20: mol_type = other DNA
tctgaacccccttttccttg

SEQ ID NO: 99620 - DNA, 20 bp, synthetic construct
  misc_feature 1..20: note = CRISPR gRNA sequence
  source 1..20: mol_type = other DNA
ctgaacccccttttccttga

SEQ ID NO: 99621 - DNA, 20 bp, synthetic construct
  misc_feature 1..20: note = CRISPR gRNA sequence
  source 1..20: mol_type = other DNA
tgaacccccttttccttgag

SEQ ID NO: 99622 - DNA, 20 bp, synthetic construct
  misc_feature 1..20: note = CRISPR gRNA sequence
  source 1..20: mol_type = other DNA
aacccccttttccttgagag

SEQ ID NO: 99623 - DNA, 20 bp, synthetic construct
  misc_feature 1..20: note = CRISPR gRNA sequence
  source 1..20: mol_type = other DNA
ttccttgagagacgagttgg

SEQ ID NO: 99624 - DNA, 20 bp, synthetic construct
  misc_feature 1..20: note = CRISPR gRNA sequence
  source 1..20: mol_type = other DNA
tccttgagagacgagttggg

SEQ ID NO: 99625 - DNA, 20 bp, synthetic construct
  misc_feature 1..20: note = CRISPR gRNA sequence
  source 1..20: mol_type = other DNA
ccttgagagacgagttgggg

SEQ ID NO: 99626 - DNA, 20 bp, synthetic construct
  misc_feature 1..20: note = CRISPR gRNA sequence
  source 1..20: mol_type = other DNA
cttgagagacgagttggggg

SEQ ID NO: 99627 - DNA, 20 bp, synthetic construct
  misc_feature 1..20: note = CRISPR gRNA sequence
  source 1..20: mol_type = other DNA
gagagacgagttgggggagt

SEQ ID NO: 99628 - DNA, 20 bp, synthetic construct
  misc_feature 1..20: note = CRISPR gRNA sequence
  source 1..20: mol_type = other DNA
agagacgagttgggggagtc

SEQ ID NO: 99629 - DNA, 20 bp, synthetic construct
  misc_feature 1..20: note = CRISPR gRNA sequence
  source 1..20: mol_type = other DNA
ggggagtcctccacgcatta

SEQ ID NO: 99630 - DNA, 20 bp, synthetic construct
  misc_feature 1..20: note = CRISPR gRNA sequence
  source 1..20: mol_type = other DNA
cacgcattacccactcgggc

SEQ ID NO: 99631 - DNA, 20 bp, synthetic construct
  misc_feature 1..20: note = CRISPR gRNA sequence
  source 1..20: mol_type = other DNA
cccactcgggccgcaaaaac

SEQ ID NO: 99632 - DNA, 20 bp, synthetic construct
  misc_feature 1..20: note = CRISPR gRNA sequence
  source 1..20: mol_type = other DNA
gggccgcaaaaactcccttc

SEQ ID NO: 99633 - DNA, 20 bp, synthetic construct
  misc_feature 1..20: note = CRISPR gRNA sequence
  source 1..20: mol_type = other DNA
ccttctttagccctctgccc

SEQ ID NO: 99634 - DNA, 20 bp, synthetic construct
  misc_feature 1..20: note = CRISPR gRNA sequence
  source 1..20: mol_type = other DNA
ctttagccctctgcccccgc

SEQ ID NO: 99635 - DNA, 20 bp, synthetic construct
  misc_feature 1..20: note = CRISPR gRNA sequence
  source 1..20: mol_type = other DNA
tttagccctctgcccccgcc

SEQ ID NO: 99636 - DNA, 20 bp, synthetic construct
  misc_feature 1..20: note = CRISPR gRNA sequence
  source 1..20: mol_type = other DNA
tagccctctgcccccgccct

SEQ ID NO: 99637 - DNA, 20 bp, synthetic construct
  misc_feature 1..20: note = CRISPR gRNA sequence
  source 1..20: mol_type = other DNA
agccctctgcccccgccctt

SEQ ID NO: 99638 - DNA, 20 bp, synthetic construct
  misc_feature 1..20: note = CRISPR gRNA sequence
  source 1..20: mol_type = other DNA
gccctctgcccccgcccttg

SEQ ID NO: 99639 - DNA, 20 bp, synthetic construct
  misc_feature 1..20: note = CRISPR gRNA sequence
  source 1..20: mol_type = other DNA
tgcccccgcccttgcttata

SEQ ID NO: 99640 - DNA, 20 bp, synthetic construct
  misc_feature 1..20: note = CRISPR gRNA sequence
  source 1..20: mol_type = other DNA
cccccgcccttgcttataag

SEQ ID NO: 99641 - DNA, 20 bp, synthetic construct
  misc_feature 1..20: note = CRISPR gRNA sequence
  source 1..20: mol_type = other DNA
gcttataagcctttgagacc

SEQ ID NO: 99642 - DNA, 20 bp, synthetic construct
  misc_feature 1..20: note = CRISPR gRNA sequence
  source 1..20: mol_type = other DNA
cttataagcctttgagaccg

SEQ ID NO: 99643 - DNA, 20 bp, synthetic construct
  misc_feature 1..20: note = CRISPR gRNA sequence
  source 1..20: mol_type = other DNA
ataagcctttgagaccgcag

SEQ ID NO: 99644 - DNA, 20 bp, synthetic construct
  misc_feature 1..20: note = CRISPR gRNA sequence
  source 1..20: mol_type = other DNA
taagcctttgagaccgcaga

SEQ ID NO: 99645 - DNA, 20 bp, synthetic construct
  misc_feature 1..20: note = CRISPR gRNA sequence
  source 1..20: mol_type = other DNA
tgagaccgcagaagggacct

SEQ ID NO: 99646 - DNA, 20 bp, synthetic construct
  misc_feature 1..20: note = CRISPR gRNA sequence
  source 1..20: mol_type = other DNA
gagaccgcagaagggacctt

SEQ ID NO: 99647 - DNA, 20 bp, synthetic construct
  misc_feature 1..20: note = CRISPR gRNA sequence
  source 1..20: mol_type = other DNA
agaccgcagaagggaccttg

SEQ ID NO: 99648 - DNA, 20 bp, synthetic construct
  misc_feature 1..20: note = CRISPR gRNA sequence
  source 1..20: mol_type = other DNA
gttgtggaacgggacggcca

SEQ ID NO: 99649 - DNA, 20 bp, synthetic construct
  misc_feature 1..20: note = CRISPR gRNA sequence
  source 1..20: mol_type = other DNA
ttgtggaacgggacggccaa

SEQ ID NO: 99650 - DNA, 20 bp, synthetic construct
  misc_feature 1..20: note = CRISPR gRNA sequence
  source 1..20: mol_type = other DNA
tggaacgggacggccaaggt

SEQ ID NO: 99651 - DNA, 20 bp, synthetic construct
  misc_feature 1..20: note = CRISPR gRNA sequence
  source 1..20: mol_type = other DNA
cccctttaagttccagacgc

SEQ ID NO: 99652 - DNA, 20 bp, synthetic construct
  misc_feature 1..20: note = CRISPR gRNA sequence
  source 1..20: mol_type = other DNA
taagttccagacgccccgcg

SEQ ID NO: 99653 - DNA, 20 bp, synthetic construct
  misc_feature 1..20: note = CRISPR gRNA sequence
  source 1..20: mol_type = other DNA
aagttccagacgccccgcgt

SEQ ID NO: 99654 - DNA, 20 bp, synthetic construct
  misc_feature 1..20: note = CRISPR gRNA sequence
  source 1..20: mol_type = other DNA
agttccagacgccccgcgta

SEQ ID NO: 99655 - DNA, 20 bp, synthetic construct
  misc_feature 1..20: note = CRISPR gRNA sequence
  source 1..20: mol_type = other DNA
cagacgccccgcgtacttcc

SEQ ID NO: 99656 - DNA, 20 bp, synthetic construct
  misc_feature 1..20: note = CRISPR gRNA sequence
  source 1..20: mol_type = other DNA
cccctacttcttcttcttga

SEQ ID NO: 99657 - DNA, 20 bp, synthetic construct
  misc_feature 1..20: note = CRISPR gRNA sequence
  source 1..20: mol_type = other DNA
ccctacttcttcttcttgag

SEQ ID NO: 99658 - DNA, 20 bp, synthetic construct
  misc_feature 1..20: note = CRISPR gRNA sequence
  source 1..20: mol_type = other DNA
cttcttcttcttgagatagc

SEQ ID NO: 99659 - DNA, 20 bp, synthetic construct
  misc_feature 1..20: note = CRISPR gRNA sequence
  source 1..20: mol_type = other DNA
cttcttcttgagatagcccc

SEQ ID NO: 99660 - DNA, 20 bp, synthetic construct
  misc_feature 1..20: note = CRISPR gRNA sequence
  source 1..20: mol_type = other DNA
ttcttcttgagatagccccg

SEQ ID NO: 99661 - DNA, 20 bp, synthetic construct
  misc_feature 1..20: note = CRISPR gRNA sequence
  source 1..20: mol_type = other DNA
cttcttgagatagccccgcc

SEQ ID NO: 99662 - DNA, 20 bp, synthetic construct
  misc_feature 1..20: note = CRISPR gRNA sequence
  source 1..20: mol_type = other DNA
ttcttgagatagccccgccc

SEQ ID NO: 99663 - DNA, 20 bp, synthetic construct
  misc_feature 1..20: note = CRISPR gRNA sequence
  source 1..20: mol_type = other DNA
cttgagatagccccgcccat

SEQ ID NO: 99664 - DNA, 20 bp, synthetic construct
  misc_feature 1..20: note = CRISPR gRNA sequence
  source 1..20: mol_type = other DNA
ttgagatagccccgcccatc

SEQ ID NO: 99665 - DNA, 20 bp, synthetic construct
  misc_feature 1..20: note = CRISPR gRNA sequence
  source 1..20: mol_type = other DNA
gagatagccccgcccatcta

SEQ ID NO: 99666 - DNA, 20 bp, synthetic construct
  misc_feature 1..20: note = CRISPR gRNA sequence
  source 1..20: mol_type = other DNA
agatagccccgcccatctac

SEQ ID NO: 99667 - DNA, 20 bp, synthetic construct
  misc_feature 1..20: note = CRISPR gRNA sequence
  source 1..20: mol_type = other DNA
cccgaagccggagccaattg

SEQ ID NO: 99668 - DNA, 20 bp, synthetic construct
  misc_feature 1..20: note = CRISPR gRNA sequence
  source 1..20: mol_type = other DNA
gctccctctggaaaaatctg

SEQ ID NO: 99669 - DNA, 20 bp, synthetic construct
  misc_feature 1..20: note = CRISPR gRNA sequence
  source 1..20: mol_type = other DNA
cctctggaaaaatctgtggg

SEQ ID NO: 99670 - DNA, 20 bp, synthetic construct
  misc_feature 1..20: note = CRISPR gRNA sequence
  source 1..20: mol_type = other DNA
tggaaaaatctgtgggcagg

SEQ ID NO: 99671 - DNA, 20 bp, synthetic construct
  misc_feature 1..20: note = CRISPR gRNA sequence
  source 1..20: mol_type = other DNA
gaaaaatctgtgggcagggt

SEQ ID NO: 99672 - DNA, 20 bp, synthetic construct
  misc_feature 1..20: note = CRISPR gRNA sequence
  source 1..20: mol_type = other DNA
tgggcagggtaaaggtgagc

SEQ ID NO: 99673 - DNA, 20 bp, synthetic construct
  misc_feature 1..20: note = CRISPR gRNA sequence
  source 1..20: mol_type = other DNA
tcagagccctttaggccccg

SEQ ID NO: 99674 - DNA, 20 bp, synthetic construct
  misc_feature 1..20: note = CRISPR gRNA sequence
  source 1..20: mol_type = other DNA
agagccctttaggccccgcc

SEQ ID NO: 99675 - DNA, 20 bp, synthetic construct
  misc_feature 1..20: note = CRISPR gRNA sequence
  source 1..20: mol_type = other DNA
taggccccgcccattccctc

SEQ ID NO: 99676 - DNA, 20 bp, synthetic construct
  misc_feature 1..20: note = CRISPR gRNA sequence
  source 1..20: mol_type = other DNA
aggccccgcccattccctcc

SEQ ID NO: 99677 - DNA, 20 bp, synthetic construct
  misc_feature 1..20: note = CRISPR gRNA sequence
  source 1..20: mol_type = other DNA
ggccccgcccattccctccg

SEQ ID NO: 99678 - DNA, 20 bp, synthetic construct
  misc_feature 1..20: note = CRISPR gRNA sequence
  source 1..20: mol_type = other DNA
cctccgagtcggtgaggagg

SEQ ID NO: 99679 - DNA, 20 bp, synthetic construct
  misc_feature 1..20: note = CRISPR gRNA sequence
  source 1..20: mol_type = other DNA
cgagtcggtgaggaggggaa

SEQ ID NO: 99680 - DNA, 20 bp, synthetic construct
  misc_feature 1..20: note = CRISPR gRNA sequence
  source 1..20: mol_type = other DNA
ccctcccaggaccccagcgg

SEQ ID NO: 99681 - DNA, 20 bp, synthetic construct
  misc_feature 1..20: note = CRISPR gRNA sequence
  source 1..20: mol_type = other DNA
ccaggaccccagcggaaccc

SEQ ID NO: 99682 - DNA, 20 bp, synthetic construct
  misc_feature 1..20: note = CRISPR gRNA sequence
  source 1..20: mol_type = other DNA
ccctaagtcttaaagggcca

SEQ ID NO: 99683 - DNA, 20 bp, synthetic construct
  misc_feature 1..20: note = CRISPR gRNA sequence
  source 1..20: mol_type = other DNA
agtcttaaagggccagaggc

SEQ ID NO: 99684 - DNA, 20 bp, synthetic construct
  misc_feature 1..20: note = CRISPR gRNA sequence
  source 1..20: mol_type = other DNA
aaagggccagaggcagcact

SEQ ID NO: 99685 - DNA, 20 bp, synthetic construct
  misc_feature 1..20: note = CRISPR gRNA sequence
  source 1..20: mol_type = other DNA
aagggccagaggcagcactt

SEQ ID NO: 99686 - DNA, 20 bp, synthetic construct
  misc_feature 1..20: note = CRISPR gRNA sequence
  source 1..20: mol_type = other DNA
actgcccgggcccttcctca

SEQ ID NO: 99687 - DNA, 20 bp, synthetic construct
  misc_feature 1..20: note = CRISPR gRNA sequence
  source 1..20: mol_type = other DNA
ctgcccgggcccttcctcac

SEQ ID NO: 99688 - DNA, 20 bp, synthetic construct
  misc_feature 1..20: note = CRISPR gRNA sequence
  source 1..20: mol_type = other DNA
cccgggcccttcctcacttt

SEQ ID NO: 99689 - DNA, 20 bp, synthetic construct
  misc_feature 1..20: note = CRISPR gRNA sequence
  source 1..20: mol_type = other DNA
cctcacttttggggggcggg

SEQ ID NO: 99690 - DNA, 20 bp, synthetic construct
  misc_feature 1..20: note = CRISPR gRNA sequence
  source 1..20: mol_type = other DNA
ctcacttttggggggcgggg

SEQ ID NO: 99691 - DNA, 20 bp, synthetic construct
  misc_feature 1..20: note = CRISPR gRNA sequence
  source 1..20: mol_type = other DNA
acttttggggggcgggggtg

SEQ ID NO: 99692 - DNA, 20 bp, synthetic construct
  misc_feature 1..20: note = CRISPR gRNA sequence
  source 1..20: mol_type = other DNA
ttggggggcgggggtgcgca

SEQ ID NO: 99693 - DNA, 20 bp, synthetic construct
  misc_feature 1..20: note = CRISPR gRNA sequence
  source 1..20: mol_type = other DNA
tggggggcgggggtgcgcaa

SEQ ID NO: 99694 - DNA, 20 bp, synthetic construct
  misc_feature 1..20: note = CRISPR gRNA sequence
  source 1..20: mol_type = other DNA
ggggggcgggggtgcgcaag

SEQ ID NO: 99695 - DNA, 20 bp, synthetic construct
  misc_feature 1..20: note = CRISPR gRNA sequence
  source 1..20: mol_type = other DNA
gggggcgggggtgcgcaagc

SEQ ID NO: 99696 - DNA, 20 bp, synthetic construct
  misc_feature 1..20: note = CRISPR gRNA sequence
  source 1..20: mol_type = other DNA
tggggtgggggtagcggtcg

SEQ ID NO: 99697 - DNA, 20 bp, synthetic construct
  misc_feature 1..20: note = CRISPR gRNA sequence
  source 1..20: mol_type = other DNA
gggtgggggtagcggtcgag

SEQ ID NO: 99698 - DNA, 20 bp, synthetic construct
  misc_feature 1..20: note = CRISPR gRNA sequence
  source 1..20: mol_type = other DNA
ctttctgtcccggcagagga

SEQ ID NO: 99699 - DNA, 20 bp, synthetic construct
  misc_feature 1..20: note = CRISPR gRNA sequence
  source 1..20: mol_type = other DNA
tctgtcccggcagaggaagc

SEQ ID NO: 99700 - DNA, 20 bp, synthetic construct
  misc_feature 1..20: note = CRISPR gRNA sequence
  source 1..20: mol_type = other DNA
ctgtcccggcagaggaagcc

SEQ ID NO: 99701 - DNA, 20 bp, synthetic construct
  misc_feature 1..20: note = CRISPR gRNA sequence
  source 1..20: mol_type = other DNA
tgtcccggcagaggaagcca

SEQ ID NO: 99702 - DNA, 20 bp, synthetic construct
  misc_feature 1..20: note = CRISPR gRNA sequence
  source 1..20: mol_type = other DNA
tcccggcagaggaagccaga

SEQ ID NO: 99703 - DNA, 20 bp, synthetic construct
  misc_feature 1..20: note = CRISPR gRNA sequence
  source 1..20: mol_type = other DNA
agggtccggtctccagtttg

SEQ ID NO: 99704 - DNA, 20 bp, synthetic construct
  misc_feature 1..20: note = CRISPR gRNA sequence
  source 1..20: mol_type = other DNA
cagtttgcctcctgctatat

SEQ ID NO: 99705 - DNA, 20 bp, synthetic construct
  misc_feature 1..20: note = CRISPR gRNA sequence
  source 1..20: mol_type = other DNA
gcctcctgctatatccattg

SEQ ID NO: 99706 - DNA, 20 bp, synthetic construct
  misc_feature 1..20: note = CRISPR gRNA sequence
  source 1..20: mol_type = other DNA
cctcctgctatatccattgg

SEQ ID NO: 99707 - DNA, 20 bp, synthetic construct
  misc_feature 1..20: note = CRISPR gRNA sequence
  source 1..20: mol_type = other DNA
ctgctatatccattggaaga

SEQ ID NO: 99708 - DNA, 20 bp, synthetic construct
  misc_feature 1..20: note = CRISPR gRNA sequence
  source 1..20: mol_type = other DNA
ctatatccattggaagagaa

SEQ ID NO: 99709 - DNA, 20 bp, synthetic construct
  misc_feature 1..20: note = CRISPR gRNA sequence
  source 1..20: mol_type = other DNA
tatccattggaagagaaaag

SEQ ID NO: 99710 - DNA, 20 bp, synthetic construct
  misc_feature 1..20: note = CRISPR gRNA sequence
  source 1..20: mol_type = other DNA
gaagagaaaagtttgtgact

SEQ ID NO: 99711 - DNA, 20 bp, synthetic construct
  misc_feature 1..20: note = CRISPR gRNA sequence
  source 1..20: mol_type = other DNA
gtgacttgggcccccaagtt

SEQ ID NO: 99712 - DNA, 20 bp, synthetic construct
  misc_feature 1..20: note = CRISPR gRNA sequence
  source 1..20: mol_type = other DNA
tgacttgggcccccaagttt

SEQ ID NO: 99713 - DNA, 20 bp, synthetic construct
  misc_feature 1..20: note = CRISPR gRNA sequence
  source 1..20: mol_type = other DNA
gggcccccaagttttgagag

SEQ ID NO: 99714 - DNA, 20 bp, synthetic construct
  misc_feature 1..20: note = CRISPR gRNA sequence
  source 1..20: mol_type = other DNA
ggcccccaagttttgagaga

SEQ ID NO: 99715 - DNA, 20 bp, synthetic construct
  misc_feature 1..20: note = CRISPR gRNA sequence
  source 1..20: mol_type = other DNA
tgagagaactgggctttcgg

SEQ ID NO: 99716 - DNA, 20 bp, synthetic construct
  misc_feature 1..20: note = CRISPR gRNA sequence
  source 1..20: mol_type = other DNA
gagagaactgggctttcggc

SEQ ID NO: 99717 - DNA, 20 bp, synthetic construct
  misc_feature 1..20: note = CRISPR gRNA sequence
  source 1..20: mol_type = other DNA
agagaactgggctttcggcg

SEQ ID NO: 99718 - DNA, 20 bp, synthetic construct
  misc_feature 1..20: note = CRISPR gRNA sequence
  source 1..20: mol_type = other DNA
ggctttcggcgcggggggac

SEQ ID NO: 99719 - DNA, 20 bp, synthetic construct
  misc_feature 1..20: note = CRISPR gRNA sequence
  source 1..20: mol_type = other DNA
tcggcgcggggggacagagg

SEQ ID NO: 99720 - DNA, 20 bp, synthetic construct
  misc_feature 1..20: note = CRISPR gRNA sequence
  source 1..20: mol_type = other DNA
cggcgcggggggacagagga

SEQ ID NO: 99721 - DNA, 20 bp, synthetic construct
  misc_feature 1..20: note = CRISPR gRNA sequence
  source 1..20: mol_type = other DNA
ggcgcggggggacagaggag

SEQ ID NO: 99722 - DNA, 20 bp, synthetic construct
  misc_feature 1..20: note = CRISPR gRNA sequence
  source 1..20: mol_type = other DNA
gtggggaggtgagtggacct

SEQ ID NO: 99723 - DNA, 20 bp, synthetic construct
  misc_feature 1..20: note = CRISPR gRNA sequence
  source 1..20: mol_type = other DNA
ctggatcgatttaggaggct

SEQ ID NO: 99724 - DNA, 20 bp, synthetic construct
  misc_feature 1..20: note = CRISPR gRNA sequence
  source 1..20: mol_type = other DNA
gatcgatttaggaggctcgg

SEQ ID NO: 99725 - DNA, 20 bp, synthetic construct
  misc_feature 1..20: note = CRISPR gRNA sequence
  source 1..20: mol_type = other DNA
aggaggctcgggtgggactg

SEQ ID NO: 99726 - DNA, 20 bp, synthetic construct
  misc_feature 1..20: note = CRISPR gRNA sequence
  source 1..20: mol_type = other DNA
ggaggctcgggtgggactgg

SEQ ID NO: 99727 - DNA, 20 bp, synthetic construct
  misc_feature 1..20: note = CRISPR gRNA sequence
  source 1..20: mol_type = other DNA
gggtgggactgggaccaatc

SEQ ID NO: 99728 - DNA, 20 bp, synthetic construct
  misc_feature 1..20: note = CRISPR gRNA sequence
  source 1..20: mol_type = other DNA
ggaccaatcgcacctttgtt

SEQ ID NO: 99729 - DNA, 20 bp, synthetic construct
  misc_feature 1..20: note = CRISPR gRNA sequence
  source 1..20: mol_type = other DNA
tgttgagccgtcactcatta

SEQ ID NO: 99730 - DNA, 20 bp, synthetic construct
  misc_feature 1..20: note = CRISPR gRNA sequence
  source 1..20: mol_type = other DNA
gttgagccgtcactcattat

SEQ ID NO: 99731 - DNA, 20 bp, synthetic construct
  misc_feature 1..20: note = CRISPR gRNA sequence
  source 1..20: mol_type = other DNA
ttgagccgtcactcattatg

SEQ ID NO: 99732 - DNA, 20 bp, synthetic construct
  misc_feature 1..20: note = CRISPR gRNA sequence
  source 1..20: mol_type = other DNA
agccgtcactcattatgggg

SEQ ID NO: 99733 - DNA, 20 bp, synthetic construct
  misc_feature 1..20: note = CRISPR gRNA sequence
  source 1..20: mol_type = other DNA
attatggggagcccctccca

SEQ ID NO: 99734 - DNA, 20 bp, synthetic construct
  misc_feature 1..20: note = CRISPR gRNA sequence
  source 1..20: mol_type = other DNA
tggggagcccctcccaacaa

SEQ ID NO: 99735 - DNA, 20 bp, synthetic construct
  misc_feature 1..20: note = CRISPR gRNA sequence
  source 1..20: mol_type = other DNA
ccaacaaccatagcgaatat

SEQ ID NO: 99736 - DNA, 20 bp, synthetic construct
  misc_feature 1..20: note = CRISPR gRNA sequence
  source 1..20: mol_type = other DNA
attgagctccacgcttagca

SEQ ID NO: 99737 - DNA, 20 bp, synthetic construct
  misc_feature 1..20: note = CRISPR gRNA sequence
  source 1..20: mol_type = other DNA
ttgagctccacgcttagcag

SEQ ID NO: 99738 - DNA, 20 bp, synthetic construct
  misc_feature 1..20: note = CRISPR gRNA sequence
  source 1..20: mol_type = other DNA
agctccacgcttagcagatc

SEQ ID NO: 99739 - DNA, 20 bp, synthetic construct
  misc_feature 1..20: note = CRISPR gRNA sequence
  source 1..20: mol_type = other DNA
cacgcttagcagatcccccg

SEQ ID NO: 99740 - DNA, 20 bp, synthetic construct
  misc_feature 1..20: note = CRISPR gRNA sequence
  source 1..20: mol_type = other DNA
agcagatcccccgataagct

SEQ ID NO: 99741 - DNA, 20 bp, synthetic construct
  misc_feature 1..20: note = CRISPR gRNA sequence
  source 1..20: mol_type = other DNA
gcagatcccccgataagcta

SEQ ID NO: 99742 - DNA, 20 bp, synthetic construct
  misc_feature 1..20: note = CRISPR gRNA sequence
  source 1..20: mol_type = other DNA
tgtacagacataattcgttg

SEQ ID NO: 99743 - DNA, 20 bp, synthetic construct
  misc_feature 1..20: note = CRISPR gRNA sequence
  source 1..20: mol_type = other DNA
gttgtaggtctcatttccac

SEQ ID NO: 99744 - DNA, 20 bp, synthetic construct
  misc_feature 1..20: note = CRISPR gRNA sequence
  source 1..20: mol_type = other DNA
taggtctcatttccacattt

SEQ ID NO: 99745 - DNA, 20 bp, synthetic construct
  misc_feature 1..20: note = CRISPR gRNA sequence
  source 1..20: mol_type = other DNA
atttccacattttgtcgtgg

SEQ ID NO: 99746 - DNA, 20 bp, synthetic construct
  misc_feature 1..20: note = CRISPR gRNA sequence
  source 1..20: mol_type = other DNA
ccacattttgtcgtggagga

SEQ ID NO: 99747 - DNA, 20 bp, synthetic construct
  misc_feature 1..20: note = CRISPR gRNA sequence
  source 1..20: mol_type = other DNA
cacattttgtcgtggaggaa

SEQ ID NO: 99748 - DNA, 20 bp, synthetic construct
  misc_feature 1..20: note = CRISPR gRNA sequence
  source 1..20: mol_type = other DNA
tgtcgtggaggaaactgagg

SEQ ID NO: 99749 - DNA, 20 bp, synthetic construct
  misc_feature 1..20: note = CRISPR gRNA sequence
  source 1..20: mol_type = other DNA
gtcgtggaggaaactgaggc

SEQ ID NO: 99750 - DNA, 20 bp, synthetic construct
  misc_feature 1..20: note = CRISPR gRNA sequence
  source 1..20: mol_type = other DNA
tcgtggaggaaactgaggct

SEQ ID NO: 99751 - DNA, 20 bp, synthetic construct
  misc_feature 1..20: note = CRISPR gRNA sequence
  source 1..20: mol_type = other DNA
aggctcaaaggttaagtcac

SEQ ID NO: 99752 - DNA, 20 bp, synthetic construct
  misc_feature 1..20: note = CRISPR gRNA sequence
  source 1..20: mol_type = other DNA
aaaggttaagtcacgtgccc

SEQ ID NO: 99753 - DNA, 20 bp, synthetic construct
  misc_feature 1..20: note = CRISPR gRNA sequence
  source 1..20: mol_type = other DNA
agtcacgtgcccaagttctc

SEQ ID NO: 99754 - DNA, 20 bp, synthetic construct
  misc_feature 1..20: note = CRISPR gRNA sequence
  source 1..20: mol_type = other DNA
tcacggcctataaattgagg

SEQ ID NO: 99755 - DNA, 20 bp, synthetic construct
  misc_feature 1..20: note = CRISPR gRNA sequence
  source 1..20: mol_type = other DNA
acggcctataaattgaggga

SEQ ID NO: 99756 - DNA, 20 bp, synthetic construct
  misc_feature 1..20: note = CRISPR gRNA sequence
  source 1..20: mol_type = other DNA
taaattgagggattcgaacc

SEQ ID NO: 99757 - DNA, 20 bp, synthetic construct
  misc_feature 1..20: note = CRISPR gRNA sequence
  source 1..20: mol_type = other DNA
agggattcgaacccagacag

SEQ ID NO: 99758 - DNA, 20 bp, synthetic construct
  misc_feature 1..20: note = CRISPR gRNA sequence
  source 1..20: mol_type = other DNA
gaacccagacagctgacccc

SEQ ID NO: 99759 - DNA, 20 bp, synthetic construct
  misc_feature 1..20: note = CRISPR gRNA sequence
  source 1..20: mol_type = other DNA
accccagagccccggctttt

SEQ ID NO: 99760 - DNA, 20 bp, synthetic construct
  misc_feature 1..20: note = CRISPR gRNA sequence
  source 1..20: mol_type = other DNA
ttttttcctttctttttttt

SEQ ID NO: 99761 - DNA, 20 bp, synthetic construct
  misc_feature 1..20: note = CRISPR gRNA sequence
  source 1..20: mol_type = other DNA
tttttcctttcttttttttt

SEQ ID NO: 99762 - DNA, 20 bp, synthetic construct
  misc_feature 1..20: note = CRISPR gRNA sequence
  source 1..20: mol_type = other DNA
ttttcctttctttttttttt

SEQ ID NO: 99763 - DNA, 20 bp, synthetic construct
  misc_feature 1..20: note = CRISPR gRNA sequence
  source 1..20: mol_type = other DNA
tttcctttcttttttttttt

SEQ ID NO: 99764 - DNA, 20 bp, synthetic construct
  misc_feature 1..20: note = CRISPR gRNA sequence
  source 1..20: mol_type = other DNA
ttcctttctttttttttttt

SEQ ID NO: 99765 - DNA, 20 bp, synthetic construct
  misc_feature 1..20: note = CRISPR gRNA sequence
  source 1..20: mol_type = other DNA
tcctttcttttttttttttt

SEQ ID NO: 99766 - DNA, 20 bp, synthetic construct
  misc_feature 1..20: note = CRISPR gRNA sequence
  source 1..20: mol_type = other DNA
cctttctttttttttttttt

SEQ ID NO: 99767 - DNA, 20 bp, synthetic construct
  misc_feature 1..20: note = CRISPR gRNA sequence
  source 1..20: mol_type = other DNA
ctttcttttttttttttttt

SEQ ID NO: 99768 - DNA, 20 bp, synthetic construct
  misc_feature 1..20: note = CRISPR gRNA sequence
  source 1..20: mol_type = other DNA
tctttttttttttttttttt

SEQ ID NO: 99769 - DNA, 20 bp, synthetic construct
  misc_feature 1..20: note = CRISPR gRNA sequence
  source 1..20: mol_type = other DNA
cttttttttttttttttttt

SEQ ID NO: 99770 - DNA, 20 bp, synthetic construct
  misc_feature 1..20: note = CRISPR gRNA sequence
  source 1..20: mol_type = other DNA
tttttttttttttttttttt

SEQ ID NO: 99771 - DNA, 20 bp, synthetic construct
  misc_feature 1..20: note = CRISPR gRNA sequence
  source 1..20: mol_type = other DNA
tttttttttttttttttttt

SEQ ID NO: 99772 - DNA, 20 bp, synthetic construct
  misc_feature 1..20: note = CRISPR gRNA sequence
  source 1..20: mol_type = other DNA
tttttttttttttttttttt

SEQ ID NO: 99773 - DNA, 20 bp, synthetic construct
  misc_feature 1..20: note = CRISPR gRNA sequence
  source 1..20: mol_type = other DNA
tttttttttttttttttttt

SEQ ID NO: 99774 - DNA, 20 bp, synthetic construct
  misc_feature 1..20: note = CRISPR gRNA sequence
  source 1..20: mol_type = other DNA
tttttttttttttttttttg

SEQ ID NO: 99775 - DNA, 20 bp, synthetic construct
  misc_feature 1..20: note = CRISPR gRNA sequence
  source 1..20: mol_type = other DNA
ttttttttttttttttttga

SEQ ID NO: 99776 - DNA, 20 bp, synthetic construct
  misc_feature 1..20: note = CRISPR gRNA sequence
  source 1..20: mol_type = other DNA
tttttttttttttttttgag

SEQ ID NO: 99777 - DNA, 20 bp, synthetic construct
  misc_feature 1..20: note = CRISPR gRNA sequence
  source 1..20: mol_type = other DNA
ttttttttttttttttgaga

SEQ ID NO: 99778 - DNA, 20 bp, synthetic construct
  misc_feature 1..20: note = CRISPR gRNA sequence
  source 1..20: mol_type = other DNA
tttttttttttttttgagac

SEQ ID NO: 99779 - DNA, 20 bp, synthetic construct
  misc_feature 1..20: note = CRISPR gRNA sequence
  source 1..20: mol_type = other DNA
ttttttttttttttgagaca

SEQ ID NO: 99780 - DNA, 20 bp, synthetic construct
  misc_feature 1..20: note = CRISPR gRNA sequence
  source 1..20: mol_type = other DNA
tttttttttttttgagacag

SEQ ID NO: 99781 - DNA, 20 bp, synthetic construct
  misc_feature 1..20: note = CRISPR gRNA sequence
  source 1..20: mol_type = other DNA
ttttttttttttgagacaga

SEQ ID NO: 99782 - DNA, 20 bp, synthetic construct
  misc_feature 1..20: note = CRISPR gRNA sequence
  source 1..20: mol_type = other DNA
tttttttttttgagacagag

SEQ ID NO: 99783 - DNA, 20 bp, synthetic construct
  misc_feature 1..20: note = CRISPR gRNA sequence
  source 1..20: mol_type = other DNA
ttttttttttgagacagagt

SEQ ID NO: 99784 - DNA, 20 bp, synthetic construct
  misc_feature 1..20: note = CRISPR gRNA sequence
  source 1..20: mol_type = other DNA
tttttttttgagacagagtc

SEQ ID NO: 99785 - DNA, 20 bp, synthetic construct
  misc_feature 1..20: note = CRISPR gRNA sequence
  source 1..20: mol_type = other DNA
ttttttttgagacagagtct

SEQ ID NO: 99786 - DNA, 20 bp, synthetic construct
  misc_feature 1..20: note = CRISPR gRNA sequence
  source 1..20: mol_type = other DNA
tttttttgagacagagtctt

SEQ ID NO: 99787 - DNA, 20 bp, synthetic construct
  misc_feature 1..20: note = CRISPR gRNA sequence
  source 1..20: mol_type = other DNA
ttttttgagacagagtcttg

SEQ ID NO: 99788 - DNA, 20 bp, synthetic construct
  misc_feature 1..20: note = CRISPR gRNA sequence
  source 1..20: mol_type = other DNA
tttttgagacagagtcttgc

SEQ ID NO: 99789 - DNA, 20 bp, synthetic construct
  misc_feature 1..20: note = CRISPR gRNA sequence
  source 1..20: mol_type = other DNA
ttttgagacagagtcttgct

SEQ ID NO: 99790 - DNA, 20 bp, synthetic construct
  misc_feature 1..20: note = CRISPR gRNA sequence
  source 1..20: mol_type = other DNA
tttgagacagagtcttgctc

SEQ ID NO: 99791 - DNA, 20 bp, synthetic construct
  misc_feature 1..20: note = CRISPR gRNA sequence
  source 1..20: mol_type = other DNA
ttgagacagagtcttgctct

SEQ ID NO: 99792 - DNA, 20 bp, synthetic construct
  misc_feature 1..20: note = CRISPR gRNA sequence
  source 1..20: mol_type = other DNA
tgagacagagtcttgctctg

SEQ ID NO: 99793 - DNA, 20 bp, synthetic construct
  misc_feature 1..20: note = CRISPR gRNA sequence
  source 1..20: mol_type = other DNA
gagacagagtcttgctctgt

SEQ ID NO: 99794 - DNA, 20 bp, synthetic construct
  misc_feature 1..20: note = CRISPR gRNA sequence
  source 1..20: mol_type = other DNA
agacagagtcttgctctgtc

SEQ ID NO: 99795 - DNA, 20 bp, synthetic construct
  misc_feature 1..20: note = CRISPR gRNA sequence
  source 1..20: mol_type = other DNA
gctctgtcgccccagctaca

SEQ ID NO: 99796 - DNA, 20 bp, synthetic construct
  misc_feature 1..20: note = CRISPR gRNA sequence
  source 1..20: mol_type = other DNA
ctctgtcgccccagctacag

SEQ ID NO: 99797 - DNA, 20 bp, synthetic construct
  misc_feature 1..20: note = CRISPR gRNA sequence
  source 1..20: mol_type = other DNA
tgtcgccccagctacagtgc

SEQ ID NO: 99798 - DNA, 20 bp, synthetic construct
  misc_feature 1..20: note = CRISPR gRNA sequence
  source 1..20: mol_type = other DNA
tcgccccagctacagtgcag

SEQ ID NO: 99799 - DNA, 20 bp, synthetic construct
  misc_feature 1..20: note = CRISPR gRNA sequence
  source 1..20: mol_type = other DNA
cagtgcagtggtgcgatctc

SEQ ID NO: 99800 - DNA, 20 bp, synthetic construct
  misc_feature 1..20: note = CRISPR gRNA sequence
  source 1..20: mol_type = other DNA
tgctcaccgcaacctccacc

SEQ ID NO: 99801 - DNA, 20 bp, synthetic construct
  misc_feature 1..20: note = CRISPR gRNA sequence
  source 1..20: mol_type = other DNA
ctcaccgcaacctccacctc

SEQ ID NO: 99802 - DNA, 20 bp, synthetic construct
  misc_feature 1..20: note = CRISPR gRNA sequence
  source 1..20: mol_type = other DNA
accgcaacctccacctcccg

SEQ ID NO: 99803 - DNA, 20 bp, synthetic construct
  misc_feature 1..20: note = CRISPR gRNA sequence
  source 1..20: mol_type = other DNA
cacctcccgagttcaagcaa

SEQ ID NO: 99804 - DNA, 20 bp, synthetic construct
  misc_feature 1..20: note = CRISPR gRNA sequence
  source 1..20: mol_type = other DNA
ccgagttcaagcaattctgc

SEQ ID NO: 99805 - DNA, 20 bp, synthetic construct
  misc_feature 1..20: note = CRISPR gRNA sequence
  source 1..20: mol_type = other DNA
aagcaattctgcctcagcct

SEQ ID NO: 99806 - DNA, 20 bp, synthetic construct
  misc_feature 1..20: note = CRISPR gRNA sequence
  source 1..20: mol_type = other DNA
tgcctcagcctcccgagtag

SEQ ID NO: 99807 - DNA, 20 bp, synthetic construct
  misc_feature 1..20: note = CRISPR gRNA sequence
  source 1..20: mol_type = other DNA
cctcagcctcccgagtagct

SEQ ID NO: 99808 - DNA, 20 bp, synthetic construct
  misc_feature 1..20: note = CRISPR gRNA sequence
  source 1..20: mol_type = other DNA
agcctcccgagtagctggga

SEQ ID NO: 99809 - DNA, 20 bp, synthetic construct
  misc_feature 1..20: note = CRISPR gRNA sequence
  source 1..20: mol_type = other DNA
ccgagtagctgggatcacag

SEQ ID NO: 99810 - DNA, 20 bp, synthetic construct
  misc_feature 1..20: note = CRISPR gRNA sequence
  source 1..20: mol_type = other DNA
ggatcacaggcgcccgccac

SEQ ID NO: 99811 - DNA, 20 bp, synthetic construct
  misc_feature 1..20: note = CRISPR gRNA sequence
  source 1..20: mol_type = other DNA
ggctaatttttgtattttta

SEQ ID NO: 99812 - DNA, 20 bp, synthetic construct
  misc_feature 1..20: note = CRISPR gRNA sequence
  source 1..20: mol_type = other DNA
gctaatttttgtatttttag

SEQ ID NO: 99813 - DNA, 20 bp, synthetic construct
  misc_feature 1..20: note = CRISPR gRNA sequence
  source 1..20: mol_type = other DNA
atttttgtatttttagtaca

SEQ ID NO: 99814 - DNA, 20 bp, synthetic construct
  misc_feature 1..20: note = CRISPR gRNA sequence
  source 1..20: mol_type = other DNA
ttgtatttttagtacagatg

SEQ ID NO: 99815 - DNA, 20 bp, synthetic construct
  misc_feature 1..20: note = CRISPR gRNA sequence
  source 1..20: mol_type = other DNA
tgtatttttagtacagatgg

SEQ ID NO: 99816 - DNA, 20 bp, synthetic construct
  misc_feature 1..20: note = CRISPR gRNA sequence
  source 1..20: mol_type = other DNA
gtatttttagtacagatggg

SEQ ID NO: 99817 - DNA, 20 bp, synthetic construct
  misc_feature 1..20: note = CRISPR gRNA sequence
  source 1..20: mol_type = other DNA
tatttttagtacagatgggg

SEQ ID NO: 99818 - DNA, 20 bp, synthetic construct
  misc_feature 1..20: note = CRISPR gRNA sequence
  source 1..20: mol_type = other DNA
ttagtacagatggggtttca

SEQ ID NO: 99819 - DNA, 20 bp, synthetic construct
  misc_feature 1..20: note = CRISPR gRNA sequence
  source 1..20: mol_type = other DNA
tagtacagatggggtttcac

SEQ ID NO: 99820 - DNA, 20 bp, synthetic construct
  misc_feature 1..20: note = CRISPR gRNA sequence
  source 1..20: mol_type = other DNA
agtacagatggggtttcacc

SEQ ID NO: 99821 - DNA, 20 bp, synthetic construct
  misc_feature 1..20: note = CRISPR gRNA sequence
  source 1..20: mol_type = other DNA
gtacagatggggtttcacca

SEQ ID NO: 99822 - DNA, 20 bp, synthetic construct
  misc_feature 1..20: note = CRISPR gRNA sequence
  source 1..20: mol_type = other DNA
caccatggtggccagcctgg

SEQ ID NO: 99823 - DNA, 20 bp, synthetic construct
  misc_feature 1..20: note = CRISPR gRNA sequence
  source 1..20: mol_type = other DNA
accatggtggccagcctggt

SEQ ID NO: 99824 - DNA, 20 bp, synthetic construct
  misc_feature 1..20: note = CRISPR gRNA sequence
  source 1..20: mol_type = other DNA
gtctcgaactcctgacctca

SEQ ID NO: 99825 - DNA, 20 bp, synthetic construct
  misc_feature 1..20: note = CRISPR gRNA sequence
  source 1..20: mol_type = other DNA
gaactcctgacctcatgatc

SEQ ID NO: 99826 - DNA, 20 bp, synthetic construct
  misc_feature 1..20: note = CRISPR gRNA sequence
  source 1..20: mol_type = other DNA
ctgacctcatgatccaccct

SEQ ID NO: 99827 - DNA, 20 bp, synthetic construct
  misc_feature 1..20: note = CRISPR gRNA sequence
  source 1..20: mol_type = other DNA
acctcatgatccaccctcct

SEQ ID NO: 99828 - DNA, 20 bp, synthetic construct
  misc_feature 1..20: note = CRISPR gRNA sequence
  source 1..20: mol_type = other DNA
atgatccaccctcctcggcc

SEQ ID NO: 99829 - DNA, 20 bp, synthetic construct
  misc_feature 1..20: note = CRISPR gRNA sequence
  source 1..20: mol_type = other DNA
ctcggcctcccaaagtgctg

SEQ ID NO: 99830 - DNA, 20 bp, synthetic construct
  misc_feature 1..20: note = CRISPR gRNA sequence
  source 1..20: mol_type = other DNA
ggcctcccaaagtgctggga

SEQ ID NO: 99831 - DNA, 20 bp, synthetic construct
  misc_feature 1..20: note = CRISPR gRNA sequence
  source 1..20: mol_type = other DNA
ccaaagtgctgggattacag

SEQ ID NO: 99832 - DNA, 20 bp, synthetic construct
  misc_feature 1..20: note = CRISPR gRNA sequence
  source 1..20: mol_type = other DNA
ggattacagccgtgagccac

SEQ ID NO: 99833 - DNA, 20 bp, synthetic construct
  misc_feature 1..20: note = CRISPR gRNA sequence
  source 1..20: mol_type = other DNA
cagccgtgagccactgtgcc

SEQ ID NO: 99834 - DNA, 20 bp, synthetic construct
  misc_feature 1..20: note = CRISPR gRNA sequence
  source 1..20: mol_type = other DNA
tgccctgccagagcccaggc

SEQ ID NO: 99835 - DNA, 20 bp, synthetic construct
  misc_feature 1..20: note = CRISPR gRNA sequence
  source 1..20: mol_type = other DNA
ccagagcccaggctcttaaa

SEQ ID NO: 99836 - DNA, 20 bp, synthetic construct
  misc_feature 1..20: note = CRISPR gRNA sequence
  source 1..20: mol_type = other DNA
ttaaacattgcacattgtag

SEQ ID NO: 99837 - DNA, 20 bp, synthetic construct
  misc_feature 1..20: note = CRISPR gRNA sequence
  source 1..20: mol_type = other DNA
aaacattgcacattgtaggt

SEQ ID NO: 99838 - DNA, 20 bp, synthetic construct
  misc_feature 1..20: note = CRISPR gRNA sequence
  source 1..20: mol_type = other DNA
aacattgcacattgtaggtg

SEQ ID NO: 99839 - DNA, 20 bp, synthetic construct
  misc_feature 1..20: note = CRISPR gRNA sequence
  source 1..20: mol_type = other DNA
cacattgtaggtgctttggt

SEQ ID NO: 99840 - DNA, 20 bp, synthetic construct
  misc_feature 1..20: note = CRISPR gRNA sequence
  source 1..20: mol_type = other DNA
taggtgctttggtggtgggg

SEQ ID NO: 99841 - DNA, 20 bp, synthetic construct
  misc_feature 1..20: note = CRISPR gRNA sequence
  source 1..20: mol_type = other DNA
tggtggtggggaatggtaga

SEQ ID NO: 99842 - DNA, 20 bp, synthetic construct
  misc_feature 1..20: note = CRISPR gRNA sequence
  source 1..20: mol_type = other DNA
ggtggtggggaatggtagac

SEQ ID NO: 99843 - DNA, 20 bp, synthetic construct
  misc_feature 1..20: note = CRISPR gRNA sequence
  source 1..20: mol_type = other DNA
gtggtggggaatggtagacc

SEQ ID NO: 99844 - DNA, 20 bp, synthetic construct
  misc_feature 1..20: note = CRISPR gRNA sequence
  source 1..20: mol_type = other DNA
gaaagcagttggactctggt

SEQ ID NO: 99845 - DNA, 20 bp, synthetic construct
  misc_feature 1..20: note = CRISPR gRNA sequence
  source 1..20: mol_type = other DNA
gactctggttttcatttccc

SEQ ID NO: 99846 - DNA, 20 bp, synthetic construct
  misc_feature 1..20: note = CRISPR gRNA sequence
  source 1..20: mol_type = other DNA
tggttttcatttccctggct

SEQ ID NO: 99847 - DNA, 20 bp, synthetic construct
  misc_feature 1..20: note = CRISPR gRNA sequence
  source 1..20: mol_type = other DNA
gttttcatttccctggctct

SEQ ID NO: 99848 - DNA, 20 bp, synthetic construct
  misc_feature 1..20: note = CRISPR gRNA sequence
  source 1..20: mol_type = other DNA
tcatttccctggctctggta

SEQ ID NO: 99849 - DNA, 20 bp, synthetic construct
  misc_feature 1..20: note = CRISPR gRNA sequence
  source 1..20: mol_type = other DNA
catttccctggctctggtaa

SEQ ID NO: 99850 - DNA, 20 bp, synthetic construct
  misc_feature 1..20: note = CRISPR gRNA sequence
  source 1..20: mol_type = other DNA
atttccctggctctggtaat

SEQ ID NO: 99851 - DNA, 20 bp, synthetic construct
  misc_feature 1..20: note = CRISPR gRNA sequence
  source 1..20: mol_type = other DNA
ccctggctctggtaattaac

SEQ ID NO: 99852 - DNA, 20 bp, synthetic construct
  misc_feature 1..20: note = CRISPR gRNA sequence
  source 1..20: mol_type = other DNA
cctggctctggtaattaacc

SEQ ID NO: 99853 - DNA, 20 bp, synthetic construct
  misc_feature 1..20: note = CRISPR gRNA sequence
  source 1..20: mol_type = other DNA
gctctggtaattaacctgga

SEQ ID NO: 99854 - DNA, 20 bp, synthetic construct
  misc_feature 1..20: note = CRISPR gRNA sequence
  source 1..20: mol_type = other DNA
tggtaattaacctggacctc

SEQ ID NO: 99855 - DNA, 20 bp, synthetic construct
  misc_feature 1..20: note = CRISPR gRNA sequence
  source 1..20: mol_type = other DNA
gtaattaacctggacctcag

SEQ ID NO: 99856 - DNA, 20 bp, synthetic construct
  misc_feature 1..20: note = CRISPR gRNA sequence
  source 1..20: mol_type = other DNA
acctggacctcagtttaccc

SEQ ID NO: 99857 - DNA, 20 bp, synthetic construct
  misc_feature 1..20: note = CRISPR gRNA sequence
  source 1..20: mol_type = other DNA
gacctcagtttacccaccct

SEQ ID NO: 99858 - DNA, 20 bp, synthetic construct
  misc_feature 1..20: note = CRISPR gRNA sequence
  source 1..20: mol_type = other DNA
agtttacccaccctcacagt

SEQ ID NO: 99859 - DNA, 20 bp, synthetic construct
  misc_feature 1..20: note = CRISPR gRNA sequence
  source 1..20: mol_type = other DNA
acccaccctcacagtgcaag

SEQ ID NO: 99860 - DNA, 20 bp, synthetic construct
  misc_feature 1..20: note = CRISPR gRNA sequence
  source 1..20: mol_type = other DNA
cccaccctcacagtgcaagg

SEQ ID NO: 99861 - DNA, 20 bp, synthetic construct
  misc_feature 1..20: note = CRISPR gRNA sequence
  source 1..20: mol_type = other DNA
acagtgcaaggctaggtatg

SEQ ID NO: 99862 - DNA, 20 bp, synthetic construct
  misc_feature 1..20: note = CRISPR gRNA sequence
  source 1..20: mol_type = other DNA
ggtatgcagtcggtgcctac

SEQ ID NO: 99863 - DNA, 20 bp, synthetic construct
  misc_feature 1..20: note = CRISPR gRNA sequence
  source 1..20: mol_type = other DNA
ctttattataactgttgata

SEQ ID NO: 99864 - DNA, 20 bp, synthetic construct
  misc_feature 1..20: note = CRISPR gRNA sequence
  source 1..20: mol_type = other DNA
tattataactgttgataatt

SEQ ID NO: 99865 - DNA, 20 bp, synthetic construct
  misc_feature 1..20: note = CRISPR gRNA sequence
  source 1..20: mol_type = other DNA
attataactgttgataatta

SEQ ID NO: 99866 - DNA, 20 bp, synthetic construct
  misc_feature 1..20: note = CRISPR gRNA sequence
  source 1..20: mol_type = other DNA
ttataactgttgataattat

SEQ ID NO: 99867 - DNA, 20 bp, synthetic construct
  misc_feature 1..20: note = CRISPR gRNA sequence
  source 1..20: mol_type = other DNA
taactgttgataattattgt

SEQ ID NO: 99868 - DNA, 20 bp, synthetic construct
  misc_feature 1..20: note = CRISPR gRNA sequence
  source 1..20: mol_type = other DNA
ttgataattattgtcatctc

SEQ ID NO: 99869 - DNA, 20 bp, synthetic construct
  misc_feature 1..20: note = CRISPR gRNA sequence
  source 1..20: mol_type = other DNA
ataattattgtcatctctcc

SEQ ID NO: 99870 - DNA, 20 bp, synthetic construct
  misc_feature 1..20: note = CRISPR gRNA sequence
  source 1..20: mol_type = other DNA
ttgtcatctctccccttctg

SEQ ID NO: 99871 - DNA, 20 bp, synthetic construct
  misc_feature 1..20: note = CRISPR gRNA sequence
  source 1..20: mol_type = other DNA
tcatctctccccttctgaca

SEQ ID NO: 99872 - DNA, 20 bp, synthetic construct
  misc_feature 1..20: note = CRISPR gRNA sequence
  source 1..20: mol_type = other DNA
tccccttctgacacctccgc

SEQ ID NO: 99873 - DNA, 20 bp, synthetic construct
  misc_feature 1..20: note = CRISPR gRNA sequence
  source 1..20: mol_type = other DNA
cccttctgacacctccgcca

SEQ ID NO: 99874 - DNA, 20 bp, synthetic construct
  misc_feature 1..20: note = CRISPR gRNA sequence
  source 1..20: mol_type = other DNA
ctgacacctccgccagcttt

SEQ ID NO: 99875 - DNA, 20 bp, synthetic construct
  misc_feature 1..20: note = CRISPR gRNA sequence
  source 1..20: mol_type = other DNA
tgacacctccgccagctttc

SEQ ID NO: 99876 - DNA, 20 bp, synthetic construct
  misc_feature 1..20: note = CRISPR gRNA sequence
  source 1..20: mol_type = other DNA
acacctccgccagctttccc

SEQ ID NO: 99877 - DNA, 20 bp, synthetic construct
  misc_feature 1..20: note = CRISPR gRNA sequence
  source 1..20: mol_type = other DNA
cgccagctttccccatggag

SEQ ID NO: 99878 - DNA, 20 bp, synthetic construct
  misc_feature 1..20: note = CRISPR gRNA sequence
  source 1..20: mol_type = other DNA
tccccatggagcttacccag

SEQ ID NO: 99879 - DNA, 20 bp, synthetic construct
  misc_feature 1..20: note = CRISPR gRNA sequence
  source 1..20: mol_type = other DNA
ccccatggagcttacccagc

SEQ ID NO: 99880 - DNA, 20 bp, synthetic construct
  misc_feature 1..20: note = CRISPR gRNA sequence
  source 1..20: mol_type = other DNA
cccatggagcttacccagcc

SEQ ID NO: 99881 - DNA, 20 bp, synthetic construct
  misc_feature 1..20: note = CRISPR gRNA sequence
  source 1..20: mol_type = other DNA
acccagcctgcagaagacct

SEQ ID NO: 99882 - DNA, 20 bp, synthetic construct
  misc_feature 1..20: note = CRISPR gRNA sequence
  source 1..20: mol_type = other DNA
cccagcctgcagaagacctc

SEQ ID NO: 99883 - DNA, 20 bp, synthetic construct
  misc_feature 1..20: note = CRISPR gRNA sequence
  source 1..20: mol_type = other DNA
cagaagacctcatccagacc

SEQ ID NO: 99884 - DNA, 20 bp, synthetic construct
  misc_feature 1..20: note = CRISPR gRNA sequence
  source 1..20: mol_type = other DNA
atccagacccagcagacccc

SEQ ID NO: 99885 - DNA, 20 bp, synthetic construct
  misc_feature 1..20: note = CRISPR gRNA sequence
  source 1..20: mol_type = other DNA
cctcagaacttggggaccct

SEQ ID NO: 99886 - DNA, 20 bp, synthetic construct
  misc_feature 1..20: note = CRISPR gRNA sequence
  source 1..20: mol_type = other DNA
agaacttggggaccctgaag

SEQ ID NO: 99887 - DNA, 20 bp, synthetic construct
  misc_feature 1..20: note = CRISPR gRNA sequence
  source 1..20: mol_type = other DNA
ggggaccctgaagaccccgg

SEQ ID NO: 99888 - DNA, 20 bp, synthetic construct
  misc_feature 1..20: note = CRISPR gRNA sequence
  source 1..20: mol_type = other DNA
gggaccctgaagaccccgga

SEQ ID NO: 99889 - DNA, 20 bp, synthetic construct
  misc_feature 1..20: note = CRISPR gRNA sequence
  source 1..20: mol_type = other DNA
aagaccccggagaggaggct

SEQ ID NO: 99890 - DNA, 20 bp, synthetic construct
  misc_feature 1..20: note = CRISPR gRNA sequence
  source 1..20: mol_type = other DNA
cagatggctcagacactgtg

SEQ ID NO: 99891 - DNA, 20 bp, synthetic construct
  misc_feature 1..20: note = CRISPR gRNA sequence
  source 1..20: mol_type = other DNA
agacactgtggtcctcagtc

SEQ ID NO: 99892 - DNA, 20 bp, synthetic construct
  misc_feature 1..20: note = CRISPR gRNA sequence
  source 1..20: mol_type = other DNA
tggtcctcagtctctttccc

SEQ ID NO: 99893 - DNA, 20 bp, synthetic construct
  misc_feature 1..20: note = CRISPR gRNA sequence
  source 1..20: mol_type = other DNA
agtctctttccctgcacaac

SEQ ID NO: 99894 - DNA, 20 bp, synthetic construct
  misc_feature 1..20: note = CRISPR gRNA sequence
  source 1..20: mol_type = other DNA
tttccctgcacaaccggatg

SEQ ID NO: 99895 - DNA, 20 bp, synthetic construct
  misc_feature 1..20: note = CRISPR gRNA sequence
  source 1..20: mol_type = other DNA
tccctgcacaaccggatgcc

SEQ ID NO: 99896 - DNA, 20 bp, synthetic construct
  misc_feature 1..20: note = CRISPR gRNA sequence
  source 1..20: mol_type = other DNA
ccctgcacaaccggatgcca

SEQ ID NO: 99897 - DNA, 20 bp, synthetic construct
  misc_feature 1..20: note = CRISPR gRNA sequence
  source 1..20: mol_type = other DNA
cctgcacaaccggatgccag

SEQ ID NO: 99898 - DNA, 20 bp, synthetic construct
  misc_feature 1..20: note = CRISPR gRNA sequence
  source 1..20: mol_type = other DNA
cacaaccggatgccagtgtt

SEQ ID NO: 99899 - DNA, 20 bp, synthetic construct
  misc_feature 1..20: note = CRISPR gRNA sequence
  source 1..20: mol_type = other DNA
cctctccacagggtaggata

SEQ ID NO: 99900 - DNA, 20 bp, synthetic construct
  misc_feature 1..20: note = CRISPR gRNA sequence
  source 1..20: mol_type = other DNA
ctctccacagggtaggatac

SEQ ID NO: 99901 - DNA, 20 bp, synthetic construct
  misc_feature 1..20: note = CRISPR gRNA sequence
  source 1..20: mol_type = other DNA
tccacagggtaggatacctc

SEQ ID NO: 99902 - DNA, 20 bp, synthetic construct
  misc_feature 1..20: note = CRISPR gRNA sequence
  source 1..20: mol_type = other DNA
cacagggtaggatacctcct

SEQ ID NO: 99903 - DNA, 20 bp, synthetic construct
  misc_feature 1..20: note = CRISPR gRNA sequence
  source 1..20: mol_type = other DNA
ctctgggattagccctctgg

SEQ ID NO: 99904 - DNA, 20 bp, synthetic construct
  misc_feature 1..20: note = CRISPR gRNA sequence
  source 1..20: mol_type = other DNA
tgggattagccctctgggat

SEQ ID NO: 99905 - DNA, 20 bp, synthetic construct
  misc_feature 1..20: note = CRISPR gRNA sequence
  source 1..20: mol_type = other DNA
ggattagccctctgggattc

SEQ ID NO: 99906 - DNA, 20 bp, synthetic construct
  misc_feature 1..20: note = CRISPR gRNA sequence
  source 1..20: mol_type = other DNA
gccctctgggattccatgat

SEQ ID NO: 99907 - DNA, 20 bp, synthetic construct
  misc_feature 1..20: note = CRISPR gRNA sequence
  source 1..20: mol_type = other DNA
tgggattccatgatgatgga

SEQ ID NO: 99908 - DNA, 20 bp, synthetic construct
  misc_feature 1..20: note = CRISPR gRNA sequence
  source 1..20: mol_type = other DNA
ggattccatgatgatggaat

SEQ ID NO: 99909 - DNA, 20 bp, synthetic construct
  misc_feature 1..20: note = CRISPR gRNA sequence
  source 1..20: mol_type = other DNA
catgatgatggaatgtcagg

SEQ ID NO: 99910 - DNA, 20 bp, synthetic construct
  misc_feature 1..20: note = CRISPR gRNA sequence
  source 1..20: mol_type = other DNA
acatggaacctgtgtcttgc

SEQ ID NO: 99911 - DNA, 20 bp, synthetic construct
  misc_feature 1..20: note = CRISPR gRNA sequence
  source 1..20: mol_type = other DNA
tgtcttgctttcgtttttgt

SEQ ID NO: 99912 - DNA, 20 bp, synthetic construct
  misc_feature 1..20: note = CRISPR gRNA sequence
  source 1..20: mol_type = other DNA
gctttcgtttttgttttgtt

SEQ ID NO: 99913 - DNA, 20 bp, synthetic construct
  misc_feature 1..20: note = CRISPR gRNA sequence
  source 1..20: mol_type = other DNA
ctttcgtttttgttttgttt

SEQ ID NO: 99914 - DNA, 20 bp, synthetic construct
  misc_feature 1..20: note = CRISPR gRNA sequence
  source 1..20: mol_type = other DNA
tcgtttttgttttgttttgt

SEQ ID NO: 99915 - DNA, 20 bp, synthetic construct
  misc_feature 1..20: note = CRISPR gRNA sequence
  source 1..20: mol_type = other DNA
cgtttttgttttgttttgtt

SEQ ID NO: 99916 - DNA, 20 bp, synthetic construct
  misc_feature 1..20: note = CRISPR gRNA sequence
  source 1..20: mol_type = other DNA
gtttttgttttgttttgttt

SEQ ID NO: 99917 - DNA, 20 bp, synthetic construct
  misc_feature 1..20: note = CRISPR gRNA sequence
  source 1..20: mol_type = other DNA
ttgttttgttttgttttgtt

SEQ ID NO: 99918 - DNA, 20 bp, synthetic construct
  misc_feature 1..20: note = CRISPR gRNA sequence
  source 1..20: mol_type = other DNA
tgttttgttttgttttgttg

SEQ ID NO: 99919 - DNA, 20 bp, synthetic construct
  misc_feature 1..20: note = CRISPR gRNA sequence
  source 1..20: mol_type = other DNA
gttttgttttgttttgttgt

SEQ ID NO: 99920 - DNA, 20 bp, synthetic construct
  misc_feature 1..20: note = CRISPR gRNA sequence
  source 1..20: mol_type = other DNA
ttttgttttgttttgttgtt

SEQ ID NO: 99921 - DNA, 20 bp, synthetic construct
  misc_feature 1..20: note = CRISPR gRNA sequence
  source 1..20: mol_type = other DNA
tgttttgttttgttgttttt

SEQ ID NO: 99922 - DNA, 20 bp, synthetic construct
  misc_feature 1..20: note = CRISPR gRNA sequence
  source 1..20: mol_type = other DNA
gttttgttttgttgtttttt

SEQ ID NO: 99923 - DNA, 20 bp, synthetic construct
  misc_feature 1..20: note = CRISPR gRNA sequence
  source 1..20: mol_type = other DNA
ttttgttttgttgttttttg

SEQ ID NO: 99924 - DNA, 20 bp, synthetic construct
  misc_feature 1..20: note = CRISPR gRNA sequence
  source 1..20: mol_type = other DNA
tgttttgttgttttttgaga

SEQ ID NO: 99925 - DNA, 20 bp, synthetic construct
  misc_feature 1..20: note = CRISPR gRNA sequence
  source 1..20: mol_type = other DNA
gttttgttgttttttgagat

SEQ ID NO: 99926 - DNA, 20 bp, synthetic construct
  misc_feature 1..20: note = CRISPR gRNA sequence
  source 1..20: mol_type = other DNA
ttttgttgttttttgagatg

SEQ ID NO: 99927 - DNA, 20 bp, synthetic construct
  misc_feature 1..20: note = CRISPR gRNA sequence
  source 1..20: mol_type = other DNA
tgttgttttttgagatggag

SEQ ID NO: 99928 - DNA, 20 bp, synthetic construct
  misc_feature 1..20: note = CRISPR gRNA sequence
  source 1..20: mol_type = other DNA
gttgttttttgagatggagt

SEQ ID NO: 99929 - DNA, 20 bp, synthetic construct
  misc_feature 1..20: note = CRISPR gRNA sequence
  source 1..20: mol_type = other DNA
ttgttttttgagatggagtt

SEQ ID NO: 99930 - DNA, 20 bp, synthetic construct
  misc_feature 1..20: note = CRISPR gRNA sequence
  source 1..20: mol_type = other DNA
ttttttgagatggagttttg

SEQ ID NO: 99931 - DNA, 20 bp, synthetic construct
  misc_feature 1..20: note = CRISPR gRNA sequence
  source 1..20: mol_type = other DNA
tttgagatggagttttgctc

SEQ ID NO: 99932 - DNA, 20 bp, synthetic construct
  misc_feature 1..20: note = CRISPR gRNA sequence
  source 1..20: mol_type = other DNA
ttgagatggagttttgctct

SEQ ID NO: 99933 - DNA, 20 bp, synthetic construct
  misc_feature 1..20: note = CRISPR gRNA sequence
  source 1..20: mol_type = other DNA
tgagatggagttttgctctt

SEQ ID NO: 99934 - DNA, 20 bp, synthetic construct
  misc_feature 1..20: note = CRISPR gRNA sequence
  source 1..20: mol_type = other DNA
gagatggagttttgctcttg

SEQ ID NO: 99935 - DNA, 20 bp, synthetic construct
  misc_feature 1..20: note = CRISPR gRNA sequence
  source 1..20: mol_type = other DNA
agatggagttttgctcttgt

SEQ ID NO: 99936 - DNA, 20 bp, synthetic construct
  misc_feature 1..20: note = CRISPR gRNA sequence
  source 1..20: mol_type = other DNA
tgctcttgttgcccatgctg

SEQ ID NO: 99937 - DNA, 20 bp, synthetic construct
  misc_feature 1..20: note = CRISPR gRNA sequence
  source 1..20: mol_type = other DNA
gctcttgttgcccatgctgg

SEQ ID NO: 99938 - DNA, 20 bp, synthetic construct
  misc_feature 1..20: note = CRISPR gRNA sequence
  source 1..20: mol_type = other DNA
ctcttgttgcccatgctgga

SEQ ID NO: 99939 - DNA, 20 bp, synthetic construct
  misc_feature 1..20: note = CRISPR gRNA sequence
  source 1..20: mol_type = other DNA
ttgttgcccatgctggagtg

SEQ ID NO: 99940 - DNA, 20 bp, synthetic construct
  misc_feature 1..20: note = CRISPR gRNA sequence
  source 1..20: mol_type = other DNA
gttgcccatgctggagtgca

SEQ ID NO: 99941 - DNA, 20 bp, synthetic construct
  misc_feature 1..20: note = CRISPR gRNA sequence
  source 1..20: mol_type = other DNA
ttgcccatgctggagtgcaa

SEQ ID NO: 99942 - DNA, 20 bp, synthetic construct
  misc_feature 1..20: note = CRISPR gRNA sequence
  source 1..20: mol_type = other DNA
cccatgctggagtgcaatgg

SEQ ID NO: 99943 - DNA, 20 bp, synthetic construct
  misc_feature 1..20: note = CRISPR gRNA sequence
  source 1..20: mol_type = other DNA
gagtgcaatggcgtgatctc

SEQ ID NO: 99944 - DNA, 20 bp, synthetic construct
  misc_feature 1..20: note = CRISPR gRNA sequence
  source 1..20: mol_type = other DNA
agctcactgcaacctctgcc

SEQ ID NO: 99945 - DNA, 20 bp, synthetic construct
  misc_feature 1..20: note = CRISPR gRNA sequence
  source 1..20: mol_type = other DNA
actgcaacctctgcctcctg

SEQ ID NO: 99946 - DNA, 20 bp, synthetic construct
  misc_feature 1..20: note = CRISPR gRNA sequence
  source 1..20: mol_type = other DNA
caacctctgcctcctgggtt

SEQ ID NO: 99947 - DNA, 20 bp, synthetic construct
  misc_feature 1..20: note = CRISPR gRNA sequence
  source 1..20: mol_type = other DNA
tgcctcctgggttcaactga

SEQ ID NO: 99948 - DNA, 20 bp, synthetic construct
  misc_feature 1..20: note = CRISPR gRNA sequence
  source 1..20: mol_type = other DNA
cctcctgggttcaactgatt

SEQ ID NO: 99949 - DNA, 20 bp, synthetic construct
  misc_feature 1..20: note = CRISPR gRNA sequence
  source 1..20: mol_type = other DNA
ctgggttcaactgattctcc

SEQ ID NO: 99950 - DNA, 20 bp, synthetic construct
  misc_feature 1..20: note = CRISPR gRNA sequence
  source 1..20: mol_type = other DNA
ggttcaactgattctcctgt

SEQ ID NO: 99951 - DNA, 20 bp, synthetic construct
  misc_feature 1..20: note = CRISPR gRNA sequence
  source 1..20: mol_type = other DNA
aactgattctcctgtctcag

SEQ ID NO: 99952 - DNA, 20 bp, synthetic construct
  misc_feature 1..20: note = CRISPR gRNA sequence
  source 1..20: mol_type = other DNA
attctcctgtctcagcctcc

SEQ ID NO: 99953 - DNA, 20 bp, synthetic construct
  misc_feature 1..20: note = CRISPR gRNA sequence
  source 1..20: mol_type = other DNA
tcctgtctcagcctcctgag

SEQ ID NO: 99954 - DNA, 20 bp, synthetic construct
  misc_feature 1..20: note = CRISPR gRNA sequence
  source 1..20: mol_type = other DNA
ctgtctcagcctcctgagta

SEQ ID NO: 99955 - DNA, 20 bp, synthetic construct
  misc_feature 1..20: note = CRISPR gRNA sequence
  source 1..20: mol_type = other DNA
tctcagcctcctgagtagct

SEQ ID NO: 99956 - DNA, 20 bp, synthetic construct
  misc_feature 1..20: note = CRISPR gRNA sequence
  source 1..20: mol_type = other DNA
agcctcctgagtagctggga

SEQ ID NO: 99957 - DNA, 20 bp, synthetic construct
  misc_feature 1..20: note = CRISPR gRNA sequence
  source 1..20: mol_type = other DNA
ctgagtagctgggattacag

SEQ ID NO: 99958 - DNA, 20 bp, synthetic construct
  misc_feature 1..20: note = CRISPR gRNA sequence
  source 1..20: mol_type = other DNA
agtagctgggattacaggct

SEQ ID NO: 99959 - DNA, 20 bp, synthetic construct
  misc_feature 1..20: note = CRISPR gRNA sequence
  source 1..20: mol_type = other DNA
ggattacaggcttccgccac

SEQ ID NO: 99960 - DNA, 20 bp, synthetic construct
  misc_feature 1..20: note = CRISPR gRNA sequence
  source 1..20: mol_type = other DNA
caggcttccgccactacgcc

SEQ ID NO: 99961 - DNA, 20 bp, synthetic construct
  misc_feature 1..20: note = CRISPR gRNA sequence
  source 1..20: mol_type = other DNA
ccgccactacgcccagctaa

SEQ ID NO: 99962 - DNA, 20 bp, synthetic construct
  misc_feature 1..20: note = CRISPR gRNA sequence
  source 1..20: mol_type = other DNA
cgccactacgcccagctaat

SEQ ID NO: 99963 - DNA, 20 bp, synthetic construct
  misc_feature 1..20: note = CRISPR gRNA sequence
  source 1..20: mol_type = other DNA
cgcccagctaattttttggg

SEQ ID NO: 99964 - DNA, 20 bp, synthetic construct
  misc_feature 1..20: note = CRISPR gRNA sequence
  source 1..20: mol_type = other DNA
attttttgggtatttttagt

SEQ ID NO: 99965 - DNA, 20 bp, synthetic construct
  misc_feature 1..20: note = CRISPR gRNA sequence
  source 1..20: mol_type = other DNA
tttgggtatttttagtagag

SEQ ID NO: 99966 - DNA, 20 bp, synthetic construct
  misc_feature 1..20: note = CRISPR gRNA sequence
  source 1..20: mol_type = other DNA
ttgggtatttttagtagaga

SEQ ID NO: 99967 - DNA, 20 bp, synthetic construct
  misc_feature 1..20: note = CRISPR gRNA sequence
  source 1..20: mol_type = other DNA
tgggtatttttagtagagac

SEQ ID NO: 99968 - DNA, 20 bp, synthetic construct
  misc_feature 1..20: note = CRISPR gRNA sequence
  source 1..20: mol_type = other DNA
gggtatttttagtagagacg

SEQ ID NO: 99969 - DNA, 20 bp, synthetic construct
  misc_feature 1..20: note = CRISPR gRNA sequence
  source 1..20: mol_type = other DNA
ggtatttttagtagagacgg

SEQ ID NO: 99970 - DNA, 20 bp, synthetic construct
  misc_feature 1..20: note = CRISPR gRNA sequence
  source 1..20: mol_type = other DNA
ttagtagagacggggtttca

SEQ ID NO: 99971 - DNA, 20 bp, synthetic construct
  misc_feature 1..20: note = CRISPR gRNA sequence
  source 1..20: mol_type = other DNA
tagtagagacggggtttcac

SEQ ID NO: 99972 - DNA, 20 bp, synthetic construct
  misc_feature 1..20: note = CRISPR gRNA sequence
  source 1..20: mol_type = other DNA
agtagagacggggtttcacc

SEQ ID NO: 99973 - DNA, 20 bp, synthetic construct
  misc_feature 1..20: note = CRISPR gRNA sequence
  source 1..20: mol_type = other DNA
gtagagacggggtttcacca

SEQ ID NO: 99974 - DNA, 20 bp, synthetic construct
  misc_feature 1..20: note = CRISPR gRNA sequence
  source 1..20: mol_type = other DNA
caccatgttggccaggctgg

SEQ ID NO: 99975 - DNA, 20 bp, synthetic construct
  misc_feature 1..20: note = CRISPR gRNA sequence
  source 1..20: mol_type = other DNA
accatgttggccaggctggt

SEQ ID NO: 99976 - DNA, 20 bp, synthetic construct
  misc_feature 1..20: note = CRISPR gRNA sequence
  source 1..20: mol_type = other DNA
gccaggctggtcttgaactc

SEQ ID NO: 99977 - DNA, 20 bp, synthetic construct
  misc_feature 1..20: note = CRISPR gRNA sequence
  source 1..20: mol_type = other DNA
gtcttgaactcctgacctca

SEQ ID NO: 99978 - DNA, 20 bp, synthetic construct
  misc_feature 1..20: note = CRISPR gRNA sequence
  source 1..20: mol_type = other DNA
gaactcctgacctcaggtga

SEQ ID NO: 99979 - DNA, 20 bp, synthetic construct
  misc_feature 1..20: note = CRISPR gRNA sequence
  source 1..20: mol_type = other DNA
aactcctgacctcaggtgat

SEQ ID NO: 99980 - DNA, 20 bp, synthetic construct
  misc_feature 1..20: note = CRISPR gRNA sequence
  source 1..20: mol_type = other DNA
ctgacctcaggtgatccgcc

SEQ ID NO: 99981 - DNA, 20 bp, synthetic construct
  misc_feature 1..20: note = CRISPR gRNA sequence
  source 1..20: mol_type = other DNA
acctcaggtgatccgcccac

SEQ ID NO: 99982 - DNA, 20 bp, synthetic construct
  misc_feature 1..20: note = CRISPR gRNA sequence
  source 1..20: mol_type = other DNA
aggtgatccgcccacctcgg

SEQ ID NO: 99983 - DNA, 20 bp, synthetic construct
  misc_feature 1..20: note = CRISPR gRNA sequence
  source 1..20: mol_type = other DNA
ggcctcccaaagtgctggga

SEQ ID NO: 99984 - DNA, 20 bp, synthetic construct
  misc_feature 1..20: note = CRISPR gRNA sequence
  source 1..20: mol_type = other DNA
ccaaagtgctgggattacag

SEQ ID NO: 99985 - DNA, 20 bp, synthetic construct
  misc_feature 1..20: note = CRISPR gRNA sequence
  source 1..20: mol_type = other DNA
ggattacaggcatgagccac

SEQ ID NO: 99986 - DNA, 20 bp, synthetic construct
  misc_feature 1..20: note = CRISPR gRNA sequence
  source 1..20: mol_type = other DNA
caggcatgagccactgtgcc

SEQ ID NO: 99987 - DNA, 20 bp, synthetic construct
  misc_feature 1..20: note = CRISPR gRNA sequence
  source 1..20: mol_type = other DNA
tgcccggcctgtttttgttt

SEQ ID NO: 99988 - DNA, 20 bp, synthetic construct
  misc_feature 1..20: note = CRISPR gRNA sequence
  source 1..20: mol_type = other DNA
tttttgttttttgatacagg

SEQ ID NO: 99989 - DNA, 20 bp, synthetic construct
  misc_feature 1..20: note = CRISPR gRNA sequence
  source 1..20: mol_type = other DNA
ttgttttttgatacagggtc

SEQ ID NO: 99990 - DNA, 20 bp, synthetic construct
  misc_feature 1..20: note = CRISPR gRNA sequence
  source 1..20: mol_type = other DNA
tgttttttgatacagggtct

SEQ ID NO: 99991 - DNA, 20 bp, synthetic construct
  misc_feature 1..20: note = CRISPR gRNA sequence
  source 1..20: mol_type = other DNA
gttttttgatacagggtctc

SEQ ID NO: 99992 - DNA, 20 bp, synthetic construct
  misc_feature 1..20: note = CRISPR gRNA sequence
  source 1..20: mol_type = other DNA
ttttttgatacagggtctcg

SEQ ID NO: 99993 - DNA, 20 bp, synthetic construct
  misc_feature 1..20: note = CRISPR gRNA sequence
  source 1..20: mol_type = other DNA
tttgatacagggtctcgctc

SEQ ID NO: 99994 - DNA, 20 bp, synthetic construct
  misc_feature 1..20: note = CRISPR gRNA sequence
  source 1..20: mol_type = other DNA
ttgatacagggtctcgctct

SEQ ID NO: 99995 - DNA, 20 bp, synthetic construct
  misc_feature 1..20: note = CRISPR gRNA sequence
  source 1..20: mol_type = other DNA
tgatacagggtctcgctctg

SEQ ID NO: 99996 - DNA, 20 bp, synthetic construct
  misc_feature 1..20: note = CRISPR gRNA sequence
  source 1..20: mol_type = other DNA
gatacagggtctcgctctgt

SEQ ID NO: 99997 - DNA, 20 bp, synthetic construct
  misc_feature 1..20: note = CRISPR gRNA sequence
  source 1..20: mol_type = other DNA
atacagggtctcgctctgtt

SEQ ID NO: 99998 - DNA, 20 bp, synthetic construct
  misc_feature 1..20: note = CRISPR gRNA sequence
  source 1..20: mol_type = other DNA
gctctgttactaaggctgga

SEQ ID NO: 99999 - DNA, 20 bp, synthetic construct
  misc_feature 1..20: note = CRISPR gRNA sequence
  source 1..20: mol_type = other DNA
tgttactaaggctggagtgc

SEQ ID NO: 100000 - DNA, 20 bp, synthetic construct
  misc_feature 1..20: note = CRISPR gRNA sequence
  source 1..20: mol_type = other DNA
ttactaaggctggagtgcag

SEQ ID NO: 100001 - DNA, 20 bp, synthetic construct
  misc_feature 1..20: note = CRISPR gRNA sequence
  source 1..20: mol_type = other DNA
ctaaggctggagtgcagtga

SEQ ID NO: 100002 - DNA, 20 bp, synthetic construct
  misc_feature 1..20: note = CRISPR gRNA sequence
  source 1..20: mol_type = other DNA
aggctggagtgcagtgatgc

SEQ ID NO: 100003 - DNA, 20 bp, synthetic construct
  misc_feature 1..20: note = CRISPR gRNA sequence
  source 1..20: mol_type = other DNA
gagtgcagtgatgcaatcat

SEQ ID NO: 100004 - DNA, 20 bp, synthetic construct
  misc_feature 1..20: note = CRISPR gRNA sequence
  source 1..20: mol_type = other DNA
actgcagcctcaacttcctg

SEQ ID NO: 100005 - DNA, 20 bp, synthetic construct
  misc_feature 1..20: note = CRISPR gRNA sequence
  source 1..20: mol_type = other DNA
cagcctcaacttcctgggct

SEQ ID NO: 100006 - DNA, 20 bp, synthetic construct
  misc_feature 1..20: note = CRISPR gRNA sequence
  source 1..20: mol_type = other DNA
aacttcctgggctgaagcca

SEQ ID NO: 100007 - DNA, 20 bp, synthetic construct
  misc_feature 1..20: note = CRISPR gRNA sequence
  source 1..20: mol_type = other DNA
cctgggctgaagccatcact

SEQ ID NO: 100008 - DNA, 20 bp, synthetic construct
  misc_feature 1..20: note = CRISPR gRNA sequence
  source 1..20: mol_type = other DNA
ctgggctgaagccatcactc

SEQ ID NO: 100009 - DNA, 20 bp, synthetic construct
  misc_feature 1..20: note = CRISPR gRNA sequence
  source 1..20: mol_type = other DNA
ggctgaagccatcactcagc

SEQ ID NO: 100010 - DNA, 20 bp, synthetic construct
  misc_feature 1..20: note = CRISPR gRNA sequence
  source 1..20: mol_type = other DNA
aagccatcactcagcctccc

SEQ ID NO: 100011 - DNA, 20 bp, synthetic construct
  misc_feature 1..20: note = CRISPR gRNA sequence
  source 1..20: mol_type = other DNA
agcctccctaggagctggga

SEQ ID NO: 100012 - DNA, 20 bp, synthetic construct
  misc_feature 1..20: note = CRISPR gRNA sequence
  source 1..20: mol_type = other DNA
cctaggagctgggactatag

SEQ ID NO: 100013 - DNA, 20 bp, synthetic construct
  misc_feature 1..20: note = CRISPR gRNA sequence
  source 1..20: mol_type = other DNA
ggagctgggactataggcat

SEQ ID NO: 100014 - DNA, 20 bp, synthetic construct
  misc_feature 1..20: note = CRISPR gRNA sequence
  source 1..20: mol_type = other DNA
ggactataggcatgcaacca

SEQ ID NO: 100015 - DNA, 20 bp, synthetic construct
  misc_feature 1..20: note = CRISPR gRNA sequence
  source 1..20: mol_type = other DNA
taggcatgcaaccacacctg

SEQ ID NO: 100016 - DNA, 20 bp, synthetic construct
  misc_feature 1..20: note = CRISPR gRNA sequence
  source 1..20: mol_type = other DNA
gctaattttttttttttttt

SEQ ID NO: 100017 - DNA, 20 bp, synthetic construct
  misc_feature 1..20: note = CRISPR gRNA sequence
  source 1..20: mol_type = other DNA
attttttttttttttttggg

SEQ ID NO: 100018 - DNA, 20 bp, synthetic construct
  misc_feature 1..20: note = CRISPR gRNA sequence
  source 1..20: mol_type = other DNA
tttttttttttttgggaggc

SEQ ID NO: 100019 - DNA, 20 bp, synthetic construct
  misc_feature 1..20: note = CRISPR gRNA sequence
  source 1..20: mol_type = other DNA
ttttttttttttgggaggct

SEQ ID NO: 100020 - DNA, 20 bp, synthetic construct
  misc_feature 1..20: note = CRISPR gRNA sequence
  source 1..20: mol_type = other DNA
tttttttttttgggaggctg

SEQ ID NO: 100021 - DNA, 20 bp, synthetic construct
  misc_feature 1..20: note = CRISPR gRNA sequence
  source 1..20: mol_type = other DNA
ttttttttttgggaggctgg

SEQ ID NO: 100022 - DNA, 20 bp, synthetic construct
  misc_feature 1..20: note = CRISPR gRNA sequence
  source 1..20: mol_type = other DNA
tttttttttgggaggctggt

SEQ ID NO: 100023 - DNA, 20 bp, synthetic construct
  misc_feature 1..20: note = CRISPR gRNA sequence
  source 1..20: mol_type = other DNA
ttttttttgggaggctggtc

SEQ ID NO: 100024 - DNA, 20 bp, synthetic construct
  misc_feature 1..20: note = CRISPR gRNA sequence
  source 1..20: mol_type = other DNA
tttttttgggaggctggtct

SEQ ID NO: 100025 - DNA, 20 bp, synthetic construct
  misc_feature 1..20: note = CRISPR gRNA sequence
  source 1..20: mol_type = other DNA
ttttttgggaggctggtctc

SEQ ID NO: 100026 - DNA, 20 bp, synthetic construct
  misc_feature 1..20: note = CRISPR gRNA sequence
  source 1..20: mol_type = other DNA
tttttgggaggctggtctcc

SEQ ID NO: 100027 - DNA, 20 bp, synthetic construct
  misc_feature 1..20: note = CRISPR gRNA sequence
  source 1..20: mol_type = other DNA
ttttgggaggctggtctcca

SEQ ID NO: 100028 - DNA, 20 bp, synthetic construct
  misc_feature 1..20: note = CRISPR gRNA sequence
  source 1..20: mol_type = other DNA
tttgggaggctggtctccac

SEQ ID NO: 100029 - DNA, 20 bp, synthetic construct
  misc_feature 1..20: note = CRISPR gRNA sequence
  source 1..20: mol_type = other DNA
ttgggaggctggtctccacc

SEQ ID NO: 100030 - DNA, 20 bp, synthetic construct
  misc_feature 1..20: note = CRISPR gRNA sequence
  source 1..20: mol_type = other DNA
tgggaggctggtctccacct

SEQ ID NO: 100031 - DNA, 20 bp, synthetic construct
  misc_feature 1..20: note = CRISPR gRNA sequence
  source 1..20: mol_type = other DNA
gggaggctggtctccacctc

SEQ ID NO: 100032 - DNA, 20 bp, synthetic construct
  misc_feature 1..20: note = CRISPR gRNA sequence
  source 1..20: mol_type = other DNA
ggaggctggtctccacctcc

SEQ ID NO: 100033 - DNA, 20 bp, synthetic construct
  misc_feature 1..20: note = CRISPR gRNA sequence
  source 1..20: mol_type = other DNA
gtctccacctcctgggctca

SEQ ID NO: 100034 - DNA, 20 bp, synthetic construct
  misc_feature 1..20: note = CRISPR gRNA sequence
  source 1..20: mol_type = other DNA
cacctcctgggctcaagtga

SEQ ID NO: 100035 - DNA, 20 bp, synthetic construct
  misc_feature 1..20: note = CRISPR gRNA sequence
  source 1..20: mol_type = other DNA
ctgggctcaagtgatctgca

SEQ ID NO: 100036 - DNA, 20 bp, synthetic construct
  misc_feature 1..20: note = CRISPR gRNA sequence
  source 1..20: mol_type = other DNA
ggctcaagtgatctgcaggc

SEQ ID NO: 100037 - DNA, 20 bp, synthetic construct
  misc_feature 1..20: note = CRISPR gRNA sequence
  source 1..20: mol_type = other DNA
aagtgatctgcaggcctcca

SEQ ID NO: 100038 - DNA, 20 bp, synthetic construct
  misc_feature 1..20: note = CRISPR gRNA sequence
  source 1..20: mol_type = other DNA
caggcctccacttccgaaag

SEQ ID NO: 100039 - DNA, 20 bp, synthetic construct
  misc_feature 1..20: note = CRISPR gRNA sequence
  source 1..20: mol_type = other DNA
cacttccgaaagtgctggga

SEQ ID NO: 100040 - DNA, 20 bp, synthetic construct
  misc_feature 1..20: note = CRISPR gRNA sequence
  source 1..20: mol_type = other DNA
ccgaaagtgctgggattaca

SEQ ID NO: 100041 - DNA, 20 bp, synthetic construct
  misc_feature 1..20: note = CRISPR gRNA sequence
  source 1..20: mol_type = other DNA
cgaaagtgctgggattacag

SEQ ID NO: 100042 - DNA, 20 bp, synthetic construct
  misc_feature 1..20: note = CRISPR gRNA sequence
  source 1..20: mol_type = other DNA
ggattacaggtgtgagccac

SEQ ID NO: 100043 - DNA, 20 bp, synthetic construct
  misc_feature 1..20: note = CRISPR gRNA sequence
  source 1..20: mol_type = other DNA
caggtgtgagccacagtgcc

SEQ ID NO: 100044 - DNA, 20 bp, synthetic construct
  misc_feature 1..20: note = CRISPR gRNA sequence
  source 1..20: mol_type = other DNA
cacacctgtttttaactctt

SEQ ID NO: 100045 - DNA, 20 bp, synthetic construct
  misc_feature 1..20: note = CRISPR gRNA sequence
  source 1..20: mol_type = other DNA
acacctgtttttaactcttt

SEQ ID NO: 100046 - DNA, 20 bp, synthetic construct
  misc_feature 1..20: note = CRISPR gRNA sequence
  source 1..20: mol_type = other DNA
tttttaactctttgagggta

SEQ ID NO: 100047 - DNA, 20 bp, synthetic construct
  misc_feature 1..20: note = CRISPR gRNA sequence
  source 1..20: mol_type = other DNA
ttaactctttgagggtagat

SEQ ID NO: 100048 - DNA, 20 bp, synthetic construct
  misc_feature 1..20: note = CRISPR gRNA sequence
  source 1..20: mol_type = other DNA
taactctttgagggtagata

SEQ ID NO: 100049 - DNA, 20 bp, synthetic construct
  misc_feature 1..20: note = CRISPR gRNA sequence
  source 1..20: mol_type = other DNA
aactctttgagggtagatag

SEQ ID NO: 100050 - DNA, 20 bp, synthetic construct
  misc_feature 1..20: note = CRISPR gRNA sequence
  source 1..20: mol_type = other DNA
actctttgagggtagatagc

SEQ ID NO: 100051 - DNA, 20 bp, synthetic construct
  misc_feature 1..20: note = CRISPR gRNA sequence
  source 1..20: mol_type = other DNA
tttgagggtagatagctagg

SEQ ID NO: 100052 - DNA, 20 bp, synthetic construct
  misc_feature 1..20: note = CRISPR gRNA sequence
  source 1..20: mol_type = other DNA
tgagggtagatagctaggag

SEQ ID NO: 100053 - DNA, 20 bp, synthetic construct
  misc_feature 1..20: note = CRISPR gRNA sequence
  source 1..20: mol_type = other DNA
gagggtagatagctaggagt

SEQ ID NO: 100054 - DNA, 20 bp, synthetic construct
  misc_feature 1..20: note = CRISPR gRNA sequence
  source 1..20: mol_type = other DNA
agggtagatagctaggagtg

SEQ ID NO: 100055 - DNA, 20 bp, synthetic construct
  misc_feature 1..20: note = CRISPR gRNA sequence
  source 1..20: mol_type = other DNA
ggagtgaaattactgggtca

SEQ ID NO: 100056 - DNA, 20 bp, synthetic construct
  misc_feature 1..20: note = CRISPR gRNA sequence
  source 1..20: mol_type = other DNA
ctgggtcagatggtcatcct

SEQ ID NO: 100057 - DNA, 20 bp, synthetic construct
  misc_feature 1..20: note = CRISPR gRNA sequence
  source 1..20: mol_type = other DNA
ggtcagatggtcatcctgtt

SEQ ID NO: 100058 - DNA, 20 bp, synthetic construct
  misc_feature 1..20: note = CRISPR gRNA sequence
  source 1..20: mol_type = other DNA
ttttacttactgaggaactg

SEQ ID NO: 100059 - DNA, 20 bp, synthetic construct
  misc_feature 1..20: note = CRISPR gRNA sequence
  source 1..20: mol_type = other DNA
tacttactgaggaactgagg

SEQ ID NO: 100060 - DNA, 20 bp, synthetic construct
  misc_feature 1..20: note = CRISPR gRNA sequence
  source 1..20: mol_type = other DNA
acttactgaggaactgagga

SEQ ID NO: 100061 - DNA, 20 bp, synthetic construct
  misc_feature 1..20: note = CRISPR gRNA sequence
  source 1..20: mol_type = other DNA
cttactgaggaactgaggat

SEQ ID NO: 100062 - DNA, 20 bp, synthetic construct
  misc_feature 1..20: note = CRISPR gRNA sequence
  source 1..20: mol_type = other DNA
actgaggaactgaggattta

SEQ ID NO: 100063 - DNA, 20 bp, synthetic construct
  misc_feature 1..20: note = CRISPR gRNA sequence
  source 1..20: mol_type = other DNA
ctgaggaactgaggatttat

SEQ ID NO: 100064 - DNA, 20 bp, synthetic construct
  misc_feature 1..20: note = CRISPR gRNA sequence
  source 1..20: mol_type = other DNA
aggaactgaggatttatttt

SEQ ID NO: 100065 - DNA, 20 bp, synthetic construct
  misc_feature 1..20: note = CRISPR gRNA sequence
  source 1..20: mol_type = other DNA
aggatttatttttgattgga

SEQ ID NO: 100066 - DNA, 20 bp, synthetic construct
  misc_feature 1..20: note = CRISPR gRNA sequence
  source 1..20: mol_type = other DNA
atttttgattggagtccaag

SEQ ID NO: 100067 - DNA, 20 bp, synthetic construct
  misc_feature 1..20: note = CRISPR gRNA sequence
  source 1..20: mol_type = other DNA
tttttgattggagtccaaga

SEQ ID NO: 100068 - DNA, 20 bp, synthetic construct
  misc_feature 1..20: note = CRISPR gRNA sequence
  source 1..20: mol_type = other DNA
ttgattggagtccaagaata

SEQ ID NO: 100069 - DNA, 20 bp, synthetic construct
  misc_feature 1..20: note = CRISPR gRNA sequence
  source 1..20: mol_type = other DNA
tgattggagtccaagaatat

SEQ ID NO: 100070 - DNA, 20 bp, synthetic construct
  misc_feature 1..20: note = CRISPR gRNA sequence
  source 1..20: mol_type = other DNA
gattggagtccaagaatatg

SEQ ID NO: 100071 - DNA, 20 bp, synthetic construct
  misc_feature 1..20: note = CRISPR gRNA sequence
  source 1..20: mol_type = other DNA
attggagtccaagaatatgc

SEQ ID NO: 100072 - DNA, 20 bp, synthetic construct
  misc_feature 1..20: note = CRISPR gRNA sequence
  source 1..20: mol_type = other DNA
gagtccaagaatatgcctaa

SEQ ID NO: 100073 - DNA, 20 bp, synthetic construct
  misc_feature 1..20: note = CRISPR gRNA sequence
  source 1..20: mol_type = other DNA
atttagttccctcccacgac

SEQ ID NO: 100074 - DNA, 20 bp, synthetic construct
  misc_feature 1..20: note = CRISPR gRNA sequence
  source 1..20: mol_type = other DNA
agttccctcccacgaccttt

SEQ ID NO: 100075 - DNA, 20 bp, synthetic construct
  misc_feature 1..20: note = CRISPR gRNA sequence
  source 1..20: mol_type = other DNA
gttccctcccacgacctttg

SEQ ID NO: 100076 - DNA, 20 bp, synthetic construct
  misc_feature 1..20: note = CRISPR gRNA sequence
  source 1..20: mol_type = other DNA
cctcccacgacctttgttgc

SEQ ID NO: 100077 - DNA, 20 bp, synthetic construct
  misc_feature 1..20: note = CRISPR gRNA sequence
  source 1..20: mol_type = other DNA
ccacgacctttgttgctgcc

SEQ ID NO: 100078 - DNA, 20 bp, synthetic construct
  misc_feature 1..20: note = CRISPR gRNA sequence
  source 1..20: mol_type = other DNA
tgttgctgccactcctgtct

SEQ ID NO: 100079 - DNA, 20 bp, synthetic construct
  misc_feature 1..20: note = CRISPR gRNA sequence
  source 1..20: mol_type = other DNA
gttgctgccactcctgtctg

SEQ ID NO: 100080 - DNA, 20 bp, synthetic construct
  misc_feature 1..20: note = CRISPR gRNA sequence
  source 1..20: mol_type = other DNA
ttgctgccactcctgtctgg

SEQ ID NO: 100081 - DNA, 20 bp, synthetic construct
  misc_feature 1..20: note = CRISPR gRNA sequence
  source 1..20: mol_type = other DNA
ctgccactcctgtctggaat

SEQ ID NO: 100082 - DNA, 20 bp, synthetic construct
  misc_feature 1..20: note = CRISPR gRNA sequence
  source 1..20: mol_type = other DNA
ccactcctgtctggaatgct

SEQ ID NO: 100083 - DNA, 20 bp, synthetic construct
  misc_feature 1..20: note = CRISPR gRNA sequence
  source 1..20: mol_type = other DNA
ctgtctggaatgctcttcct

SEQ ID NO: 100084 - DNA, 20 bp, synthetic construct
  misc_feature 1..20: note = CRISPR gRNA sequence
  source 1..20: mol_type = other DNA
tctggaatgctcttcctaca

SEQ ID NO: 100085 - DNA, 20 bp, synthetic construct
  misc_feature 1..20: note = CRISPR gRNA sequence
  source 1..20: mol_type = other DNA
gaatgctcttcctacacttc

SEQ ID NO: 100086 - DNA, 20 bp, synthetic construct
  misc_feature 1..20: note = CRISPR gRNA sequence
  source 1..20: mol_type = other DNA
ttcctacacttcttcctata

SEQ ID NO: 100087 - DNA, 20 bp, synthetic construct
  misc_feature 1..20: note = CRISPR gRNA sequence
  source 1..20: mol_type = other DNA
cctacacttcttcctatagc

SEQ ID NO: 100088 - DNA, 20 bp, synthetic construct
  misc_feature 1..20: note = CRISPR gRNA sequence
  source 1..20: mol_type = other DNA
ctacacttcttcctatagct

SEQ ID NO: 100089 - DNA, 20 bp, synthetic construct
  misc_feature 1..20: note = CRISPR gRNA sequence
  source 1..20: mol_type = other DNA
cacttcttcctatagctgac

SEQ ID NO: 100090 - DNA, 20 bp, synthetic construct
  misc_feature 1..20: note = CRISPR gRNA sequence
  source 1..20: mol_type = other DNA
cttcctatagctgactcccc

SEQ ID NO: 100091 - DNA, 20 bp, synthetic construct
  misc_feature 1..20: note = CRISPR gRNA sequence
  source 1..20: mol_type = other DNA
ttcctatagctgactcccct

SEQ ID NO: 100092 - DNA, 20 bp, synthetic construct
  misc_feature 1..20: note = CRISPR gRNA sequence
  source 1..20: mol_type = other DNA
cctatagctgactcccctcc

SEQ ID NO: 100093 - DNA, 20 bp, synthetic construct
  misc_feature 1..20: note = CRISPR gRNA sequence
  source 1..20: mol_type = other DNA
ctatagctgactcccctccc

SEQ ID NO: 100094 - DNA, 20 bp, synthetic construct
  misc_feature 1..20: note = CRISPR gRNA sequence
  source 1..20: mol_type = other DNA
tagctgactcccctcccctc

SEQ ID NO: 100095 - DNA, 20 bp, synthetic construct
  misc_feature 1..20: note = CRISPR gRNA sequence
  source 1..20: mol_type = other DNA
actcccctcccctccctccc

SEQ ID NO: 100096 - DNA, 20 bp, synthetic construct
  misc_feature 1..20: note = CRISPR gRNA sequence
  source 1..20: mol_type = other DNA
ccctcccctccctcccttcc

SEQ ID NO: 100097 - DNA, 20 bp, synthetic construct
  misc_feature 1..20: note = CRISPR gRNA sequence
  source 1..20: mol_type = other DNA
ccctccctcccttcccgcct

SEQ ID NO: 100098 - DNA, 20 bp, synthetic construct
  misc_feature 1..20: note = CRISPR gRNA sequence
  source 1..20: mol_type = other DNA
cctcccttcccgcctccgtt

SEQ ID NO: 100099 - DNA, 20 bp, synthetic construct
  misc_feature 1..20: note = CRISPR gRNA sequence
  source 1..20: mol_type = other DNA
ccttcccgcctccgtttttt

SEQ ID NO: 100100 - DNA, 20 bp, synthetic construct
  misc_feature 1..20: note = CRISPR gRNA sequence
  source 1..20: mol_type = other DNA
cccgcctccgtttttttttt

SEQ ID NO: 100101 - DNA, 20 bp, synthetic construct
  misc_feature 1..20: note = CRISPR gRNA sequence
  source 1..20: mol_type = other DNA
ccgcctccgttttttttttc

SEQ ID NO: 100102 - DNA, 20 bp, synthetic construct
  misc_feature 1..20: note = CRISPR gRNA sequence
  source 1..20: mol_type = other DNA
cgttttttttttctttcttt

SEQ ID NO: 100103 - DNA, 20 bp, synthetic construct
  misc_feature 1..20: note = CRISPR gRNA sequence
  source 1..20: mol_type = other DNA
tttttttctttctttctttc

SEQ ID NO: 100104 - DNA, 20 bp, synthetic construct
  misc_feature 1..20: note = CRISPR gRNA sequence
  source 1..20: mol_type = other DNA
ttttttctttctttctttct

SEQ ID NO: 100105 - DNA, 20 bp, synthetic construct
  misc_feature 1..20: note = CRISPR gRNA sequence
  source 1..20: mol_type = other DNA
tttttctttctttctttctt

SEQ ID NO: 100106 - DNA, 20 bp, synthetic construct
  misc_feature 1..20: note = CRISPR gRNA sequence
  source 1..20: mol_type = other DNA
ttttctttctttctttcttt

SEQ ID NO: 100107 - DNA, 20 bp, synthetic construct
  misc_feature 1..20: note = CRISPR gRNA sequence
  source 1..20: mol_type = other DNA
tttctttctttctttctttt

SEQ ID NO: 100108 - DNA, 20 bp, synthetic construct
  misc_feature 1..20: note = CRISPR gRNA sequence
  source 1..20: mol_type = other DNA
ttctttctttctttcttttt

SEQ ID NO: 100109 - DNA, 20 bp, synthetic construct
  misc_feature 1..20: note = CRISPR gRNA sequence
  source 1..20: mol_type = other DNA
tctttctttctttctttttt

SEQ ID NO: 100110 - DNA, 20 bp, synthetic construct
  misc_feature 1..20: note = CRISPR gRNA sequence
  source 1..20: mol_type = other DNA
ctttctttctttcttttttt

SEQ ID NO: 100111 - DNA, 20 bp, synthetic construct
  misc_feature 1..20: note = CRISPR gRNA sequence
  source 1..20: mol_type = other DNA
tttctttctttctttttttg

SEQ ID NO: 100112 - DNA, 20 bp, synthetic construct
  misc_feature 1..20: note = CRISPR gRNA sequence
  source 1..20: mol_type = other DNA
tctttctttctttttttgag

SEQ ID NO: 100113 - DNA, 20 bp, synthetic construct
  misc_feature 1..20: note = CRISPR gRNA sequence
  source 1..20: mol_type = other DNA
ctttctttctttttttgaga

SEQ ID NO: 100114 - DNA, 20 bp, synthetic construct
  misc_feature 1..20: note = CRISPR gRNA sequence
  source 1..20: mol_type = other DNA
tttctttctttttttgagat

SEQ ID NO: 100115 - DNA, 20 bp, synthetic construct
  misc_feature 1..20: note = CRISPR gRNA sequence
  source 1..20: mol_type = other DNA
tctttctttttttgagatgg

SEQ ID NO: 100116 - DNA, 20 bp, synthetic construct
  misc_feature 1..20: note = CRISPR gRNA sequence
  source 1..20: mol_type = other DNA
ctttctttttttgagatgga

SEQ ID NO: 100117 - DNA, 20 bp, synthetic construct
  misc_feature 1..20: note = CRISPR gRNA sequence
  source 1..20: mol_type = other DNA
tttctttttttgagatggag

SEQ ID NO: 100118 - DNA, 20 bp, synthetic construct
  misc_feature 1..20: note = CRISPR gRNA sequence
  source 1..20: mol_type = other DNA
tctttttttgagatggagtc

SEQ ID NO: 100119 - DNA, 20 bp, synthetic construct
  misc_feature 1..20: note = CRISPR gRNA sequence
  source 1..20: mol_type = other DNA
ctttttttgagatggagtct

SEQ ID NO: 100120 - DNA, 20 bp, synthetic construct
  misc_feature 1..20: note = CRISPR gRNA sequence
  source 1..20: mol_type = other DNA
tttttttgagatggagtctc

SEQ ID NO: 100121 - DNA, 20 bp, synthetic construct
  misc_feature 1..20: note = CRISPR gRNA sequence
  source 1..20: mol_type = other DNA
tttttgagatggagtctcgc

SEQ ID NO: 100122 - DNA, 20 bp, synthetic construct
  misc_feature 1..20: note = CRISPR gRNA sequence
  source 1..20: mol_type = other DNA
ttttgagatggagtctcgct

SEQ ID NO: 100123 - DNA, 20 bp, synthetic construct
  misc_feature 1..20: note = CRISPR gRNA sequence
  source 1..20: mol_type = other DNA
tttgagatggagtctcgctc

SEQ ID NO: 100124 - DNA, 20 bp, synthetic construct
  misc_feature 1..20: note = CRISPR gRNA sequence
  source 1..20: mol_type = other DNA
ttgagatggagtctcgctct

SEQ ID NO: 100125 - DNA, 20 bp, synthetic construct
  misc_feature 1..20: note = CRISPR gRNA sequence
  source 1..20: mol_type = other DNA
tgagatggagtctcgctctg

SEQ ID NO: 100126 - DNA, 20 bp, synthetic construct
  misc_feature 1..20: note = CRISPR gRNA sequence
  source 1..20: mol_type = other DNA
gagatggagtctcgctctgt

SEQ ID NO: 100127 - DNA, 20 bp, synthetic construct
  misc_feature 1..20: note = CRISPR gRNA sequence
  source 1..20: mol_type = other DNA
agatggagtctcgctctgtc

SEQ ID NO: 100128 - DNA, 20 bp, synthetic construct
  misc_feature 1..20: note = CRISPR gRNA sequence
  source 1..20: mol_type = other DNA
gctctgtcgcccaggctgga

SEQ ID NO: 100129 - DNA, 20 bp, synthetic construct
  misc_feature 1..20: note = CRISPR gRNA sequence
  source 1..20: mol_type = other DNA
tgtcgcccaggctggagtgc

SEQ ID NO: 100130 - DNA, 20 bp, synthetic construct
  misc_feature 1..20: note = CRISPR gRNA sequence
  source 1..20: mol_type = other DNA
tcgcccaggctggagtgcat

SEQ ID NO: 100131 - DNA, 20 bp, synthetic construct
  misc_feature 1..20: note = CRISPR gRNA sequence
  source 1..20: mol_type = other DNA
gagtgcatggagtgcagtgg

SEQ ID NO: 100132 - DNA, 20 bp, synthetic construct
  misc_feature 1..20: note = CRISPR gRNA sequence
  source 1..20: mol_type = other DNA
ggctcactgcaagctccacc

SEQ ID NO: 100133 - DNA, 20 bp, synthetic construct
  misc_feature 1..20: note = CRISPR gRNA sequence
  source 1..20: mol_type = other DNA
gctcactgcaagctccacct

SEQ ID NO: 100134 - DNA, 20 bp, synthetic construct
  misc_feature 1..20: note = CRISPR gRNA sequence
  source 1..20: mol_type = other DNA
actgcaagctccacctcccg

SEQ ID NO: 100135 - DNA, 20 bp, synthetic construct
  misc_feature 1..20: note = CRISPR gRNA sequence
  source 1..20: mol_type = other DNA
caagctccacctcccgtgtt

SEQ ID NO: 100136 - DNA, 20 bp, synthetic construct
  misc_feature 1..20: note = CRISPR gRNA sequence
  source 1..20: mol_type = other DNA
cacctcccgtgttcacgcca

SEQ ID NO: 100137 - DNA, 20 bp, synthetic construct
  misc_feature 1..20: note = CRISPR gRNA sequence
  source 1..20: mol_type = other DNA
ccgtgttcacgccattctcc

SEQ ID NO: 100138 - DNA, 20 bp, synthetic construct
  misc_feature 1..20: note = CRISPR gRNA sequence
  source 1..20: mol_type = other DNA
acgccattctcctgcttcag

SEQ ID NO: 100139 - DNA, 20 bp, synthetic construct
  misc_feature 1..20: note = CRISPR gRNA sequence
  source 1..20: mol_type = other DNA
tcctgcttcagcctcccgag

SEQ ID NO: 100140 - DNA, 20 bp, synthetic construct
  misc_feature 1..20: note = CRISPR gRNA sequence
  source 1..20: mol_type = other DNA
ctgcttcagcctcccgagta

SEQ ID NO: 100141 - DNA, 20 bp, synthetic construct
  misc_feature 1..20: note = CRISPR gRNA sequence
  source 1..20: mol_type = other DNA
cttcagcctcccgagtagct

SEQ ID NO: 100142 - DNA, 20 bp, synthetic construct
  misc_feature 1..20: note = CRISPR gRNA sequence
  source 1..20: mol_type = other DNA
cagcctcccgagtagctggg

SEQ ID NO: 100143 - DNA, 20 bp, synthetic construct
  misc_feature 1..20: note = CRISPR gRNA sequence
  source 1..20: mol_type = other DNA
agcctcccgagtagctggga

SEQ ID NO: 100144 - DNA, 20 bp, synthetic construct
  misc_feature 1..20: note = CRISPR gRNA sequence
  source 1..20: mol_type = other DNA
ccgagtagctgggactacag

SEQ ID NO: 100145 - DNA, 20 bp, synthetic construct
  misc_feature 1..20: note = CRISPR gRNA sequence
  source 1..20: mol_type = other DNA
ggactacagtccgttttttt

SEQ ID NO: 100146 - DNA, 20 bp, synthetic construct
  misc_feature 1..20: note = CRISPR gRNA sequence
  source 1..20: mol_type = other DNA
cagtccgttttttttttttt

SEQ ID NO: 100147 - DNA, 20 bp, synthetic construct
  misc_feature 1..20: note = CRISPR gRNA sequence
  source 1..20: mol_type = other DNA
ttttttttttttttaaatgg

SEQ ID NO: 100148 - DNA, 20 bp, synthetic construct
  misc_feature 1..20: note = CRISPR gRNA sequence
  source 1..20: mol_type = other DNA
tttttttttttttaaatgga

SEQ ID NO: 100149 - DNA, 20 bp, synthetic construct
  misc_feature 1..20: note = CRISPR gRNA sequence
  source 1..20: mol_type = other DNA
ttttttttttttaaatggag

SEQ ID NO: 100150 - DNA, 20 bp, synthetic construct
  misc_feature 1..20: note = CRISPR gRNA sequence
  source 1..20: mol_type = other DNA
tttttttttttaaatggagg

SEQ ID NO: 100151 - DNA, 20 bp, synthetic construct
  misc_feature 1..20: note = CRISPR gRNA sequence
  source 1..20: mol_type = other DNA
ttttttttttaaatggaggt

SEQ ID NO: 100152 - DNA, 20 bp, synthetic construct
  misc_feature 1..20: note = CRISPR gRNA sequence
  source 1..20: mol_type = other DNA
tttttttttaaatggaggtt

SEQ ID NO: 100153 - DNA, 20 bp, synthetic construct
  misc_feature 1..20: note = CRISPR gRNA sequence
  source 1..20: mol_type = other DNA
ttttttttaaatggaggttt

SEQ ID NO: 100154 - DNA, 20 bp, synthetic construct
  misc_feature 1..20: note = CRISPR gRNA sequence
  source 1..20: mol_type = other DNA
tttttttaaatggaggtttg

SEQ ID NO: 100155 - DNA, 20 bp, synthetic construct
  misc_feature 1..20: note = CRISPR gRNA sequence
  source 1..20: mol_type = other DNA
ttttttaaatggaggtttgc

SEQ ID NO: 100156 - DNA, 20 bp, synthetic construct
  misc_feature 1..20: note = CRISPR gRNA sequence
  source 1..20: mol_type = other DNA
tttttaaatggaggtttgct

SEQ ID NO: 100157 - DNA, 20 bp, synthetic construct
  misc_feature 1..20: note = CRISPR gRNA sequence
  source 1..20: mol_type = other DNA
ttttaaatggaggtttgctt

SEQ ID NO: 100158 - DNA, 20 bp, synthetic construct
  misc_feature 1..20: note = CRISPR gRNA sequence
  source 1..20: mol_type = other DNA
tttaaatggaggtttgcttt

SEQ ID NO: 100159 - DNA, 20 bp, synthetic construct
  misc_feature 1..20: note = CRISPR gRNA sequence
  source 1..20: mol_type = other DNA
ttaaatggaggtttgctttt

SEQ ID NO: 100160 - DNA, 20 bp, synthetic construct
  misc_feature 1..20: note = CRISPR gRNA sequence
  source 1..20: mol_type = other DNA
taaatggaggtttgcttttg

SEQ ID NO: 100161 - DNA, 20 bp, synthetic construct
  misc_feature 1..20: note = CRISPR gRNA sequence
  source 1..20: mol_type = other DNA
aaatggaggtttgcttttgt

SEQ ID NO: 100162 - DNA, 20 bp, synthetic construct
  misc_feature 1..20: note = CRISPR gRNA sequence
  source 1..20: mol_type = other DNA
aatggaggtttgcttttgtt

SEQ ID NO: 100163 - DNA, 20 bp, synthetic construct
  misc_feature 1..20: note = CRISPR gRNA sequence
  source 1..20: mol_type = other DNA
gcttttgttgcccaggctcc

SEQ ID NO: 100164 - DNA, 20 bp, synthetic construct
  misc_feature 1..20: note = CRISPR gRNA sequence
  source 1..20: mol_type = other DNA
cttttgttgcccaggctccc

SEQ ID NO: 100165 - DNA, 20 bp, synthetic construct
  misc_feature 1..20: note = CRISPR gRNA sequence
  source 1..20: mol_type = other DNA
ttgttgcccaggctccctcc

SEQ ID NO: 100166 - DNA, 20 bp, synthetic construct
  misc_feature 1..20: note = CRISPR gRNA sequence
  source 1..20: mol_type = other DNA
tgttgcccaggctccctccc

SEQ ID NO: 100167 - DNA, 20 bp, synthetic construct
  misc_feature 1..20: note = CRISPR gRNA sequence
  source 1..20: mol_type = other DNA
gttgcccaggctccctcccc

SEQ ID NO: 100168 - DNA, 20 bp, synthetic construct
  misc_feature 1..20: note = CRISPR gRNA sequence
  source 1..20: mol_type = other DNA
ttgcccaggctccctcccct

SEQ ID NO: 100169 - DNA, 20 bp, synthetic construct
  misc_feature 1..20: note = CRISPR gRNA sequence
  source 1..20: mol_type = other DNA
cccaggctccctcccctccc

SEQ ID NO: 100170 - DNA, 20 bp, synthetic construct
  misc_feature 1..20: note = CRISPR gRNA sequence
  source 1..20: mol_type = other DNA
cctcccctcccctcgcctcc

SEQ ID NO: 100171 - DNA, 20 bp, synthetic construct
  misc_feature 1..20: note = CRISPR gRNA sequence
  source 1..20: mol_type = other DNA
ccctcccctcgcctcccctc

SEQ ID NO: 100172 - DNA, 20 bp, synthetic construct
  misc_feature 1..20: note = CRISPR gRNA sequence
  source 1..20: mol_type = other DNA
ccctcgcctcccctcccctc

SEQ ID NO: 100173 - DNA, 20 bp, synthetic construct
  misc_feature 1..20: note = CRISPR gRNA sequence
  source 1..20: mol_type = other DNA
gcctcccctcccctcctttc

SEQ ID NO: 100174 - DNA, 20 bp, synthetic construct
  misc_feature 1..20: note = CRISPR gRNA sequence
  source 1..20: mol_type = other DNA
ccctcccctcctttcccctc

SEQ ID NO: 100175 - DNA, 20 bp, synthetic construct
  misc_feature 1..20: note = CRISPR gRNA sequence
  source 1..20: mol_type = other DNA
ccctcctttcccctctcccc

SEQ ID NO: 100176 - DNA, 20 bp, synthetic construct
  misc_feature 1..20: note = CRISPR gRNA sequence
  source 1..20: mol_type = other DNA
ctttcccctctccccactct

SEQ ID NO: 100177 - DNA, 20 bp, synthetic construct
  misc_feature 1..20: note = CRISPR gRNA sequence
  source 1..20: mol_type = other DNA
tcccctctccccactctcga

SEQ ID NO: 100178 - DNA, 20 bp, synthetic construct
  misc_feature 1..20: note = CRISPR gRNA sequence
  source 1..20: mol_type = other DNA
cccctctccccactctcgag

SEQ ID NO: 100179 - DNA, 20 bp, synthetic construct
  misc_feature 1..20: note = CRISPR gRNA sequence
  source 1..20: mol_type = other DNA
ccctctccccactctcgaga

SEQ ID NO: 100180 - DNA, 20 bp, synthetic construct
  misc_feature 1..20: note = CRISPR gRNA sequence
  source 1..20: mol_type = other DNA
tccccactctcgagacgcct

SEQ ID NO: 100181 - DNA, 20 bp, synthetic construct
  misc_feature 1..20: note = CRISPR gRNA sequence
  source 1..20: mol_type = other DNA
cccactctcgagacgcctcc

SEQ ID NO: 100182 - DNA, 20 bp, synthetic construct
  misc_feature 1..20: note = CRISPR gRNA sequence
  source 1..20: mol_type = other DNA
tcgagacgcctcctggatcc

SEQ ID NO: 100183 - DNA, 20 bp, synthetic construct
  misc_feature 1..20: note = CRISPR gRNA sequence
  source 1..20: mol_type = other DNA
gagacgcctcctggatcccc

SEQ ID NO: 100184 - DNA, 20 bp, synthetic construct
  misc_feature 1..20: note = CRISPR gRNA sequence
  source 1..20: mol_type = other DNA
ctggatcccctctcttcttg

SEQ ID NO: 100185 - DNA, 20 bp, synthetic construct
  misc_feature 1..20: note = CRISPR gRNA sequence
  source 1..20: mol_type = other DNA
gatcccctctcttcttgaga

SEQ ID NO: 100186 - DNA, 20 bp, synthetic construct
  misc_feature 1..20: note = CRISPR gRNA sequence
  source 1..20: mol_type = other DNA
tcttcttgagacagaatctt

SEQ ID NO: 100187 - DNA, 20 bp, synthetic construct
  misc_feature 1..20: note = CRISPR gRNA sequence
  source 1..20: mol_type = other DNA
ttcttgagacagaatcttgc

SEQ ID NO: 100188 - DNA, 20 bp, synthetic construct
  misc_feature 1..20: note = CRISPR gRNA sequence
  source 1..20: mol_type = other DNA
cttgagacagaatcttgctc

SEQ ID NO: 100189 - DNA, 20 bp, synthetic construct
  misc_feature 1..20: note = CRISPR gRNA sequence
  source 1..20: mol_type = other DNA
ttgagacagaatcttgctct

SEQ ID NO: 100190 - DNA, 20 bp, synthetic construct
  misc_feature 1..20: note = CRISPR gRNA sequence
  source 1..20: mol_type = other DNA
gagacagaatcttgctctgt

SEQ ID NO: 100191 - DNA, 20 bp, synthetic construct
  misc_feature 1..20: note = CRISPR gRNA sequence
  source 1..20: mol_type = other DNA
agacagaatcttgctctgtt

SEQ ID NO: 100192 - DNA, 20 bp, synthetic construct
  misc_feature 1..20: note = CRISPR gRNA sequence
  source 1..20: mol_type = other DNA
gctctgttgtccagggtgga

SEQ ID NO: 100193 - DNA, 20 bp, synthetic construct
  misc_feature 1..20: note = CRISPR gRNA sequence
  source 1..20: mol_type = other DNA
ctctgttgtccagggtggag

SEQ ID NO: 100194 - DNA, 20 bp, synthetic construct
  misc_feature 1..20: note = CRISPR gRNA sequence
  source 1..20: mol_type = other DNA
tgttgtccagggtggagtgc

SEQ ID NO: 100195 - DNA, 20 bp, synthetic construct
  misc_feature 1..20: note = CRISPR gRNA sequence
  source 1..20: mol_type = other DNA
ttgtccagggtggagtgcag

SEQ ID NO: 100196 - DNA, 20 bp, synthetic construct
  misc_feature 1..20: note = CRISPR gRNA sequence
  source 1..20: mol_type = other DNA
tccagggtggagtgcagtgg

SEQ ID NO: 100197 - DNA, 20 bp, synthetic construct
  misc_feature 1..20: note = CRISPR gRNA sequence
  source 1..20: mol_type = other DNA
tcttgactcactgcaactcc

SEQ ID NO: 100198 - DNA, 20 bp, synthetic construct
  misc_feature 1..20: note = CRISPR gRNA sequence
  source 1..20: mol_type = other DNA
gactcactgcaactccctct

SEQ ID NO: 100199 - DNA, 20 bp, synthetic construct
  misc_feature 1..20: note = CRISPR gRNA sequence
  source 1..20: mol_type = other DNA
actcactgcaactccctctc

SEQ ID NO: 100200 - DNA, 20 bp, synthetic construct
  misc_feature 1..20: note = CRISPR gRNA sequence
  source 1..20: mol_type = other DNA
actgcaactccctctcctgg

SEQ ID NO: 100201 - DNA, 20 bp, synthetic construct
  misc_feature 1..20: note = CRISPR gRNA sequence
  source 1..20: mol_type = other DNA
caactccctctcctgggtta

SEQ ID NO: 100202 - DNA, 20 bp, synthetic construct
  misc_feature 1..20: note = CRISPR gRNA sequence
  source 1..20: mol_type = other DNA
cctctcctgggttaaggtga

SEQ ID NO: 100203 - DNA, 20 bp, synthetic construct
  misc_feature 1..20: note = CRISPR gRNA sequence
  source 1..20: mol_type = other DNA
tcctgggttaaggtgattct

SEQ ID NO: 100204 - DNA, 20 bp, synthetic construct
  misc_feature 1..20: note = CRISPR gRNA sequence
  source 1..20: mol_type = other DNA
ctgggttaaggtgattctcc

SEQ ID NO: 100205 - DNA, 20 bp, synthetic construct
  misc_feature 1..20: note = CRISPR gRNA sequence
  source 1..20: mol_type = other DNA
ggttaaggtgattctcctgc

SEQ ID NO: 100206 - DNA, 20 bp, synthetic construct
  misc_feature 1..20: note = CRISPR gRNA sequence
  source 1..20: mol_type = other DNA
aggtgattctcctgcctcag

SEQ ID NO: 100207 - DNA, 20 bp, synthetic construct
  misc_feature 1..20: note = CRISPR gRNA sequence
  source 1..20: mol_type = other DNA
tcctgcctcagcctcccaag

SEQ ID NO: 100208 - DNA, 20 bp, synthetic construct
  misc_feature 1..20: note = CRISPR gRNA sequence
  source 1..20: mol_type = other DNA
ctgcctcagcctcccaagta

SEQ ID NO: 100209 - DNA, 20 bp, synthetic construct
  misc_feature 1..20: note = CRISPR gRNA sequence
  source 1..20: mol_type = other DNA
cctcagcctcccaagtagct

SEQ ID NO: 100210 - DNA, 20 bp, synthetic construct
  misc_feature 1..20: note = CRISPR gRNA sequence
  source 1..20: mol_type = other DNA
agcctcccaagtagctggca

SEQ ID NO: 100211 - DNA, 20 bp, synthetic construct
  misc_feature 1..20: note = CRISPR gRNA sequence
  source 1..20: mol_type = other DNA
ccaagtagctggcatgcacc

SEQ ID NO: 100212 - DNA, 20 bp, synthetic construct
  misc_feature 1..20: note = CRISPR gRNA sequence
  source 1..20: mol_type = other DNA
gcatgcaccaccacatccag

SEQ ID NO: 100213 - DNA, 20 bp, synthetic construct
  misc_feature 1..20: note = CRISPR gRNA sequence
  source 1..20: mol_type = other DNA
atttttgtgtttttagtaga

SEQ ID NO: 100214 - DNA, 20 bp, synthetic construct
  misc_feature 1..20: note = CRISPR gRNA sequence
  source 1..20: mol_type = other DNA
ttgtgtttttagtagagatg

SEQ ID NO: 100215 - DNA, 20 bp, synthetic construct
  misc_feature 1..20: note = CRISPR gRNA sequence
  source 1..20: mol_type = other DNA
tgtgtttttagtagagatgg

SEQ ID NO: 100216 - DNA, 20 bp, synthetic construct
  misc_feature 1..20: note = CRISPR gRNA sequence
  source 1..20: mol_type = other DNA
gtgtttttagtagagatgga

SEQ ID NO: 100217 - DNA, 20 bp, synthetic construct
  misc_feature 1..20: note = CRISPR gRNA sequence
  source 1..20: mol_type = other DNA
tgtttttagtagagatggag

SEQ ID NO: 100218 - DNA, 20 bp, synthetic construct
  misc_feature 1..20: note = CRISPR gRNA sequence
  source 1..20: mol_type = other DNA
ttagtagagatggagttttg

SEQ ID NO: 100219 - DNA, 20 bp, synthetic construct
  misc_feature 1..20: note = CRISPR gRNA sequence
  source 1..20: mol_type = other DNA
tagtagagatggagttttgc

SEQ ID NO: 100220 - DNA, 20 bp, synthetic construct
  misc_feature 1..20: note = CRISPR gRNA sequence
  source 1..20: mol_type = other DNA
agtagagatggagttttgcc

SEQ ID NO: 100221 - DNA, 20 bp, synthetic construct
  misc_feature 1..20: note = CRISPR gRNA sequence
  source 1..20: mol_type = other DNA
gtagagatggagttttgcca

SEQ ID NO: 100222 - DNA, 20 bp, synthetic construct
  misc_feature 1..20: note = CRISPR gRNA sequence
  source 1..20: mol_type = other DNA
tgccatgttgcccaggctgg

SEQ ID NO: 100223 - DNA, 20 bp, synthetic construct
  misc_feature 1..20: note = CRISPR gRNA sequence
  source 1..20: mol_type = other DNA
gccatgttgcccaggctggt

SEQ ID NO: 100224 - DNA, 20 bp, synthetic construct
  misc_feature 1..20: note = CRISPR gRNA sequence
  source 1..20: mol_type = other DNA
ccatgttgcccaggctggtc

SEQ ID NO: 100225 - DNA, 20 bp, synthetic construct
  misc_feature 1..20: note = CRISPR gRNA sequence
  source 1..20: mol_type = other DNA
cccaggctggtctcgaactc

SEQ ID NO: 100226 - DNA, 20 bp, synthetic construct
  misc_feature 1..20: note = CRISPR gRNA sequence
  source 1..20: mol_type = other DNA
gtctcgaactcctgacctca

SEQ ID NO: 100227 - DNA, 20 bp, synthetic construct
  misc_feature 1..20: note = CRISPR gRNA sequence
  source 1..20: mol_type = other DNA
gaactcctgacctcaggtga

SEQ ID NO: 100228 - DNA, 20 bp, synthetic construct
  misc_feature 1..20: note = CRISPR gRNA sequence
  source 1..20: mol_type = other DNA
ctgacctcaggtgattgccc

SEQ ID NO: 100229 - DNA, 20 bp, synthetic construct
  misc_feature 1..20: note = CRISPR gRNA sequence
  source 1..20: mol_type = other DNA
acctcaggtgattgcccgcc

SEQ ID NO: 100230 - DNA, 20 bp, synthetic construct
  misc_feature 1..20: note = CRISPR gRNA sequence
  source 1..20: mol_type = other DNA
aggtgattgcccgcctcggc

SEQ ID NO: 100231 - DNA, 20 bp, synthetic construct
  misc_feature 1..20: note = CRISPR gRNA sequence
  source 1..20: mol_type = other DNA
cccgcctcggcctcccaaag

SEQ ID NO: 100232 - DNA, 20 bp, synthetic construct
  misc_feature 1..20: note = CRISPR gRNA sequence
  source 1..20: mol_type = other DNA
ggcctcccaaagtgctggga

SEQ ID NO: 100233 - DNA, 20 bp, synthetic construct
  misc_feature 1..20: note = CRISPR gRNA sequence
  source 1..20: mol_type = other DNA
ccaaagtgctgggattacag

SEQ ID NO: 100234 - DNA, 20 bp, synthetic construct
  misc_feature 1..20: note = CRISPR gRNA sequence
  source 1..20: mol_type = other DNA
ggattacaggcgtgagccac

SEQ ID NO: 100235 - DNA, 20 bp, synthetic construct
  misc_feature 1..20: note = CRISPR gRNA sequence
  source 1..20: mol_type = other DNA
caggcgtgagccaccgcgcc

SEQ ID NO: 100236 - DNA, 20 bp, synthetic construct
  misc_feature 1..20: note = CRISPR gRNA sequence
  source 1..20: mol_type = other DNA
tagcggatttctttgacttc

SEQ ID NO: 100237 - DNA, 20 bp, synthetic construct
  misc_feature 1..20: note = CRISPR gRNA sequence
  source 1..20: mol_type = other DNA
ctttgacttcctaagatctc

SEQ ID NO: 100238 - DNA, 20 bp, synthetic construct
  misc_feature 1..20: note = CRISPR gRNA sequence
  source 1..20: mol_type = other DNA
tttgacttcctaagatctcg

SEQ ID NO: 100239 - DNA, 20 bp, synthetic construct
  misc_feature 1..20: note = CRISPR gRNA sequence
  source 1..20: mol_type = other DNA
tgacttcctaagatctcggt

SEQ ID NO: 100240 - DNA, 20 bp, synthetic construct
  misc_feature 1..20: note = CRISPR gRNA sequence
  source 1..20: mol_type = other DNA
gacttcctaagatctcggtg

SEQ ID NO: 100241 - DNA, 20 bp, synthetic construct
  misc_feature 1..20: note = CRISPR gRNA sequence
  source 1..20: mol_type = other DNA
acttcctaagatctcggtgg

SEQ ID NO: 100242 - DNA, 20 bp, synthetic construct
  misc_feature 1..20: note = CRISPR gRNA sequence
  source 1..20: mol_type = other DNA
cctaagatctcggtggtgtc

SEQ ID NO: 100243 - DNA, 20 bp, synthetic construct
  misc_feature 1..20: note = CRISPR gRNA sequence
  source 1..20: mol_type = other DNA
ctaagatctcggtggtgtca

SEQ ID NO: 100244 - DNA, 20 bp, synthetic construct
  misc_feature 1..20: note = CRISPR gRNA sequence
  source 1..20: mol_type = other DNA
agatctcggtggtgtcacct

SEQ ID NO: 100245 - DNA, 20 bp, synthetic construct
  misc_feature 1..20: note = CRISPR gRNA sequence
  source 1..20: mol_type = other DNA
ggtggtgtcaccttggggag

SEQ ID NO: 100246 - DNA, 20 bp, synthetic construct
  misc_feature 1..20: note = CRISPR gRNA sequence
  source 1..20: mol_type = other DNA
ggggaggccctcctgttacc

SEQ ID NO: 100247 - DNA, 20 bp, synthetic construct
  misc_feature 1..20: note = CRISPR gRNA sequence
  source 1..20: mol_type = other DNA
gggaggccctcctgttacca

SEQ ID NO: 100248 - DNA, 20 bp, synthetic construct
  misc_feature 1..20: note = CRISPR gRNA sequence
  source 1..20: mol_type = other DNA
ctgttaccaccttgtctaag

SEQ ID NO: 100249 - DNA, 20 bp, synthetic construct
  misc_feature 1..20: note = CRISPR gRNA sequence
  source 1..20: mol_type = other DNA
ttaccaccttgtctaagaag

SEQ ID NO: 100250 - DNA, 20 bp, synthetic construct
  misc_feature 1..20: note = CRISPR gRNA sequence
  source 1..20: mol_type = other DNA
ccaccttgtctaagaaggac

SEQ ID NO: 100251 - DNA, 20 bp, synthetic construct
  misc_feature 1..20: note = CRISPR gRNA sequence
  source 1..20: mol_type = other DNA
gtctaagaaggacttattcc

SEQ ID NO: 100252 - DNA, 20 bp, synthetic construct
  misc_feature 1..20: note = CRISPR gRNA sequence
  source 1..20: mol_type = other DNA
tctaagaaggacttattcct

SEQ ID NO: 100253 - DNA, 20 bp, synthetic construct
  misc_feature 1..20: note = CRISPR gRNA sequence
  source 1..20: mol_type = other DNA
agaaggacttattccttgtg

SEQ ID NO: 100254 - DNA, 20 bp, synthetic construct
  misc_feature 1..20: note = CRISPR gRNA sequence
  source 1..20: mol_type = other DNA
attccttgtgctccgttctt

SEQ ID NO: 100255 - DNA, 20 bp, synthetic construct
  misc_feature 1..20: note = CRISPR gRNA sequence
  source 1..20: mol_type = other DNA
ttccttgtgctccgttcttt

SEQ ID NO: 100256 - DNA, 20 bp, synthetic construct
  misc_feature 1..20: note = CRISPR gRNA sequence
  source 1..20: mol_type = other DNA
cttgtgctccgttcttttca

SEQ ID NO: 100257 - DNA, 20 bp, synthetic construct
  misc_feature 1..20: note = CRISPR gRNA sequence
  source 1..20: mol_type = other DNA
gtgctccgttcttttcatcc

SEQ ID NO: 100258 - DNA, 20 bp, synthetic construct
  misc_feature 1..20: note = CRISPR gRNA sequence
  source 1..20: mol_type = other DNA
tgctccgttcttttcatcct

SEQ ID NO: 100259 - DNA, 20 bp, synthetic construct
  misc_feature 1..20: note = CRISPR gRNA sequence
  source 1..20: mol_type = other DNA
cgttcttttcatcctcttct

SEQ ID NO: 100260 - DNA, 20 bp, synthetic construct
  misc_feature 1..20: note = CRISPR gRNA sequence
  source 1..20: mol_type = other DNA
ttttcatcctcttctacctg

SEQ ID NO: 100261 - DNA, 20 bp, synthetic construct
  misc_feature 1..20: note = CRISPR gRNA sequence
  source 1..20: mol_type = other DNA
ttcatcctcttctacctgct

SEQ ID NO: 100262 - DNA, 20 bp, synthetic construct
  misc_feature 1..20: note = CRISPR gRNA sequence
  source 1..20: mol_type = other DNA
tcatcctcttctacctgctt

SEQ ID NO: 100263 - DNA, 20 bp, synthetic construct
  misc_feature 1..20: note = CRISPR gRNA sequence
  source 1..20: mol_type = other DNA
catcctcttctacctgcttt

SEQ ID NO: 100264 - DNA, 20 bp, synthetic construct
  misc_feature 1..20: note = CRISPR gRNA sequence
  source 1..20: mol_type = other DNA
atcctcttctacctgctttt

SEQ ID NO: 100265 - DNA, 20 bp, synthetic construct
  misc_feature 1..20: note = CRISPR gRNA sequence
  source 1..20: mol_type = other DNA
ttctacctgcttttaaattt

SEQ ID NO: 100266 - DNA, 20 bp, synthetic construct
  misc_feature 1..20: note = CRISPR gRNA sequence
  source 1..20: mol_type = other DNA
ctacctgcttttaaattttt

SEQ ID NO: 100267 - DNA, 20 bp, synthetic construct
  misc_feature 1..20: note = CRISPR gRNA sequence
  source 1..20: mol_type = other DNA
tacctgcttttaaatttttt

SEQ ID NO: 100268 - DNA, 20 bp, synthetic construct
  misc_feature 1..20: note = CRISPR gRNA sequence
  source 1..20: mol_type = other DNA
cctgcttttaaatttttttt

SEQ ID NO: 100269 - DNA, 20 bp, synthetic construct
  misc_feature 1..20: note = CRISPR gRNA sequence
  source 1..20: mol_type = other DNA
cttttaaatttttttttttt

SEQ ID NO: 100270 - DNA, 20 bp, synthetic construct
  misc_feature 1..20: note = CRISPR gRNA sequence
  source 1..20: mol_type = other DNA
ttaaattttttttttttttt

SEQ ID NO: 100271 - DNA, 20 bp, synthetic construct
  misc_feature 1..20: note = CRISPR gRNA sequence
  source 1..20: mol_type = other DNA
taaatttttttttttttttt

SEQ ID NO: 100272 - DNA, 20 bp, synthetic construct
  misc_feature 1..20: note = CRISPR gRNA sequence
  source 1..20: mol_type = other DNA
aaattttttttttttttttt

SEQ ID NO: 100273 - DNA, 20 bp, synthetic construct
  misc_feature 1..20: note = CRISPR gRNA sequence
  source 1..20: mol_type = other DNA
aatttttttttttttttttt

SEQ ID NO: 100274 - DNA, 20 bp, synthetic construct
  misc_feature 1..20: note = CRISPR gRNA sequence
  source 1..20: mol_type = other DNA
tttttttttttttttttttt

SEQ ID NO: 100275 - DNA, 20 bp, synthetic construct
  misc_feature 1..20: note = CRISPR gRNA sequence
  source 1..20: mol_type = other DNA
tttttttttttttttttttg

SEQ ID NO: 100276 - DNA, 20 bp, synthetic construct
  misc_feature 1..20: note = CRISPR gRNA sequence
  source 1..20: mol_type = other DNA
ttttttttttttttttttga

SEQ ID NO: 100277 - DNA, 20 bp, synthetic construct
  misc_feature 1..20: note = CRISPR gRNA sequence
  source 1..20: mol_type = other DNA
tttttttttttttttttgag

SEQ ID NO: 100278 - DNA, 20 bp, synthetic construct
  misc_feature 1..20: note = CRISPR gRNA sequence
  source 1..20: mol_type = other DNA
ttttttttttttttttgaga

SEQ ID NO: 100279 - DNA, 20 bp, synthetic construct
  misc_feature 1..20: note = CRISPR gRNA sequence
  source 1..20: mol_type = other DNA
tttttttttttttttgagat

SEQ ID NO: 100280 - DNA, 20 bp, synthetic construct
  misc_feature 1..20: note = CRISPR gRNA sequence
  source 1..20: mol_type = other DNA
ttttttttttttttgagatg

SEQ ID NO: 100281 - DNA, 20 bp, synthetic construct
  misc_feature 1..20: note = CRISPR gRNA sequence
  source 1..20: mol_type = other DNA
tttttttttttttgagatgg

SEQ ID NO: 100282 - DNA, 20 bp, synthetic construct
  misc_feature 1..20: note = CRISPR gRNA sequence
  source 1..20: mol_type = other DNA
ttttttttttttgagatgga

SEQ ID NO: 100283 - DNA, 20 bp, synthetic construct
  misc_feature 1..20: note = CRISPR gRNA sequence
  source 1..20: mol_type = other DNA
tttttttttttgagatggag

SEQ ID NO: 100284 - DNA, 20 bp, synthetic construct
  misc_feature 1..20: note = CRISPR gRNA sequence
  source 1..20: mol_type = other DNA
ttttttttttgagatggagt

SEQ ID NO: 100285 - DNA, 20 bp, synthetic construct
  misc_feature 1..20: note = CRISPR gRNA sequence
  source 1..20: mol_type = other DNA
tttttttttgagatggagtc

SEQ ID NO: 100286 - DNA, 20 bp, synthetic construct
  misc_feature 1..20: note = CRISPR gRNA sequence
  source 1..20: mol_type = other DNA
ttttttttgagatggagtct

SEQ ID NO: 100287 - DNA, 20 bp, synthetic construct
  misc_feature 1..20: note = CRISPR gRNA sequence
  source 1..20: mol_type = other DNA
tttttttgagatggagtctc

SEQ ID NO: 100288 - DNA, 20 bp, synthetic construct
  misc_feature 1..20: note = CRISPR gRNA sequence
  source 1..20: mol_type = other DNA
ttttttgagatggagtctca

SEQ ID NO: 100289 - DNA, 20 bp, synthetic construct
  misc_feature 1..20: note = CRISPR gRNA sequence
  source 1..20: mol_type = other DNA
tttttgagatggagtctcac

SEQ ID NO: 100290 - DNA, 20 bp, synthetic construct
  misc_feature 1..20: note = CRISPR gRNA sequence
  source 1..20: mol_type = other DNA
ttttgagatggagtctcact

SEQ ID NO: 100291 - DNA, 20 bp, synthetic construct
  misc_feature 1..20: note = CRISPR gRNA sequence
  source 1..20: mol_type = other DNA
tttgagatggagtctcactc

SEQ ID NO: 100292 - DNA, 20 bp, synthetic construct
  misc_feature 1..20: note = CRISPR gRNA sequence
  source 1..20: mol_type = other DNA
ttgagatggagtctcactct

SEQ ID NO: 100293 - DNA, 20 bp, synthetic construct
  misc_feature 1..20: note = CRISPR gRNA sequence
  source 1..20: mol_type = other DNA
tgagatggagtctcactctt

SEQ ID NO: 100294 - DNA, 20 bp, synthetic construct
  misc_feature 1..20: note = CRISPR gRNA sequence
  source 1..20: mol_type = other DNA
gagatggagtctcactcttg

SEQ ID NO: 100295 - DNA, 20 bp, synthetic construct
  misc_feature 1..20: note = CRISPR gRNA sequence
  source 1..20: mol_type = other DNA
agatggagtctcactcttgt

SEQ ID NO: 100296 - DNA, 20 bp, synthetic construct
  misc_feature 1..20: note = CRISPR gRNA sequence
  source 1..20: mol_type = other DNA
actcttgttgcccaggctgg

SEQ ID NO: 100297 - DNA, 20 bp, synthetic construct
  misc_feature 1..20: note = CRISPR gRNA sequence
  source 1..20: mol_type = other DNA
ttgttgcccaggctggagtg

SEQ ID NO: 100298 - DNA, 20 bp, synthetic construct
  misc_feature 1..20: note = CRISPR gRNA sequence
  source 1..20: mol_type = other DNA
gttgcccaggctggagtgca

SEQ ID NO: 100299 - DNA, 20 bp, synthetic construct
  misc_feature 1..20: note = CRISPR gRNA sequence
  source 1..20: mol_type = other DNA
ttgcccaggctggagtgcag

SEQ ID NO: 100300 - DNA, 20 bp, synthetic construct
  misc_feature 1..20: note = CRISPR gRNA sequence
  source 1..20: mol_type = other DNA
cccaggctggagtgcagtgg

SEQ ID NO: 100301 - DNA, 20 bp, synthetic construct
  misc_feature 1..20: note = CRISPR gRNA sequence
  source 1..20: mol_type = other DNA
gagtgcagtggcgtgatctc

SEQ ID NO: 100302 - DNA, 20 bp, synthetic construct
  misc_feature 1..20: note = CRISPR gRNA sequence
  source 1..20: mol_type = other DNA
tctcactgcaacctccacct

SEQ ID NO: 100303 - DNA, 20 bp, synthetic construct
  misc_feature 1..20: note = CRISPR gRNA sequence
  source 1..20: mol_type = other DNA
tcactgcaacctccacctcc

SEQ ID NO: 100304 - DNA, 20 bp, synthetic construct
  misc_feature 1..20: note = CRISPR gRNA sequence
  source 1..20: mol_type = other DNA
actgcaacctccacctcctg

SEQ ID NO: 100305 - DNA, 20 bp, synthetic construct
  misc_feature 1..20: note = CRISPR gRNA sequence
  source 1..20: mol_type = other DNA
caacctccacctcctggatt

SEQ ID NO: 100306 - DNA, 20 bp, synthetic construct
  misc_feature 1..20: note = CRISPR gRNA sequence
  source 1..20: mol_type = other DNA
cacctcctggattcaagcga

SEQ ID NO: 100307 - DNA, 20 bp, synthetic construct
  misc_feature 1..20: note = CRISPR gRNA sequence
  source 1..20: mol_type = other DNA
ctggattcaagcgattctcc

SEQ ID NO: 100308 - DNA, 20 bp, synthetic construct
  misc_feature 1..20: note = CRISPR gRNA sequence
  source 1..20: mol_type = other DNA
gattcaagcgattctcctgc

SEQ ID NO: 100309 - DNA, 20 bp, synthetic construct
  misc_feature 1..20: note = CRISPR gRNA sequence
  source 1..20: mol_type = other DNA
aagcgattctcctgcctcag

SEQ ID NO: 100310 - DNA, 20 bp, synthetic construct
  misc_feature 1..20: note = CRISPR gRNA sequence
  source 1..20: mol_type = other DNA
tcctgcctcagcctcccgag

SEQ ID NO: 100311 - DNA, 20 bp, synthetic construct
  misc_feature 1..20: note = CRISPR gRNA sequence
  source 1..20: mol_type = other DNA
ctgcctcagcctcccgagta

SEQ ID NO: 100312 - DNA, 20 bp, synthetic construct
  misc_feature 1..20: note = CRISPR gRNA sequence
  source 1..20: mol_type = other DNA
cctcagcctcccgagtagct

SEQ ID NO: 100313 - DNA, 20 bp, synthetic construct
  misc_feature 1..20: note = CRISPR gRNA sequence
  source 1..20: mol_type = other DNA
agcctcccgagtagctggga

SEQ ID NO: 100314 - DNA, 20 bp, synthetic construct
  misc_feature 1..20: note = CRISPR gRNA sequence
  source 1..20: mol_type = other DNA
ccgagtagctgggattacag

SEQ ID NO: 100315 - DNA, 20 bp, synthetic construct
  misc_feature 1..20: note = CRISPR gRNA sequence
  source 1..20: mol_type = other DNA
ggattacaggcatctgccac

SEQ ID NO: 100316 - DNA, 20 bp, synthetic construct
  misc_feature 1..20: note = CRISPR gRNA sequence
  source 1..20: mol_type = other DNA
caggcatctgccaccatgca

SEQ ID NO: 100317 - DNA, 20 bp, synthetic construct
  misc_feature 1..20: note = CRISPR gRNA sequence
  source 1..20: mol_type = other DNA
ccaccatgcatggctaattt

SEQ ID NO: 100318 - DNA, 20 bp, synthetic construct
  misc_feature 1..20: note = CRISPR gRNA sequence
  source 1..20: mol_type = other DNA
attttgtgtttttagtagag

SEQ ID NO: 100319 - DNA, 20 bp, synthetic construct
  misc_feature 1..20: note = CRISPR gRNA sequence
  source 1..20: mol_type = other DNA
tgtgtttttagtagaggtgg

SEQ ID NO: 100320 - DNA, 20 bp, synthetic construct
  misc_feature 1..20: note = CRISPR gRNA sequence
  source 1..20: mol_type = other DNA
gtgtttttagtagaggtgga

SEQ ID NO: 100321 - DNA, 20 bp, synthetic construct
  misc_feature 1..20: note = CRISPR gRNA sequence
  source 1..20: mol_type = other DNA
tgtttttagtagaggtggaa

SEQ ID NO: 100322 - DNA, 20 bp, synthetic construct
  misc_feature 1..20: note = CRISPR gRNA sequence
  source 1..20: mol_type = other DNA
ttagtagaggtggaatttca

SEQ ID NO: 100323 - DNA, 20 bp, synthetic construct
  misc_feature 1..20: note = CRISPR gRNA sequence
  source 1..20: mol_type = other DNA
tagtagaggtggaatttcac

SEQ ID NO: 100324 - DNA, 20 bp, synthetic construct
  misc_feature 1..20: note = CRISPR gRNA sequence
  source 1..20: mol_type = other DNA
agtagaggtggaatttcacc

SEQ ID NO: 100325 - DNA, 20 bp, synthetic construct
  misc_feature 1..20: note = CRISPR gRNA sequence
  source 1..20: mol_type = other DNA
gtagaggtggaatttcacca

SEQ ID NO: 100326 - DNA, 20 bp, synthetic construct
  misc_feature 1..20: note = CRISPR gRNA sequence
  source 1..20: mol_type = other DNA
caccatgttagtcaggctgg

SEQ ID NO: 100327 - DNA, 20 bp, synthetic construct
  misc_feature 1..20: note = CRISPR gRNA sequence
  source 1..20: mol_type = other DNA
accatgttagtcaggctggt

SEQ ID NO: 100328 - DNA, 20 bp, synthetic construct
  misc_feature 1..20: note = CRISPR gRNA sequence
  source 1..20: mol_type = other DNA
gtcaggctggtctcaaactc

SEQ ID NO: 100329 - DNA, 20 bp, synthetic construct
  misc_feature 1..20: note = CRISPR gRNA sequence
  source 1..20: mol_type = other DNA
gtctcaaactcctgacctca

SEQ ID NO: 100330 - DNA, 20 bp, synthetic construct
  misc_feature 1..20: note = CRISPR gRNA sequence
  source 1..20: mol_type = other DNA
aaactcctgacctcaggtga

SEQ ID NO: 100331 - DNA, 20 bp, synthetic construct
  misc_feature 1..20: note = CRISPR gRNA sequence
  source 1..20: mol_type = other DNA
ctgacctcaggtgatccacc

SEQ ID NO: 100332 - DNA, 20 bp, synthetic construct
  misc_feature 1..20: note = CRISPR gRNA sequence
  source 1..20: mol_type = other DNA
acctcaggtgatccacccac

SEQ ID NO: 100333 - DNA, 20 bp, synthetic construct
  misc_feature 1..20: note = CRISPR gRNA sequence
  source 1..20: mol_type = other DNA
aggtgatccacccacctcag

SEQ ID NO: 100334 - DNA, 20 bp, synthetic construct
  misc_feature 1..20: note = CRISPR gRNA sequence
  source 1..20: mol_type = other DNA
agcctcccaaagtgctggga

SEQ ID NO: 100335 - DNA, 20 bp, synthetic construct
  misc_feature 1..20: note = CRISPR gRNA sequence
  source 1..20: mol_type = other DNA
ccaaagtgctgggattacag

SEQ ID NO: 100336 - DNA, 20 bp, synthetic construct
  misc_feature 1..20: note = CRISPR gRNA sequence
  source 1..20: mol_type = other DNA
ggattacaggcatgagccac

SEQ ID NO: 100337 - DNA, 20 bp, synthetic construct
  misc_feature 1..20: note = CRISPR gRNA sequence
  source 1..20: mol_type = other DNA
caggcatgagccactgtgcc

SEQ ID NO: 100338 - DNA, 20 bp, synthetic construct
  misc_feature 1..20: note = CRISPR gRNA sequence
  source 1..20: mol_type = other DNA
tgcccggccttaagttcttt

SEQ ID NO: 100339 - DNA, 20 bp, synthetic construct
  misc_feature 1..20: note = CRISPR gRNA sequence
  source 1..20: mol_type = other DNA
aagttcttttgaacacttat

SEQ ID NO: 100340 - DNA, 20 bp, synthetic construct
  misc_feature 1..20: note = CRISPR gRNA sequence
  source 1..20: mol_type = other DNA
agttcttttgaacacttatt

SEQ ID NO: 100341 - DNA, 20 bp, synthetic construct
  misc_feature 1..20: note = CRISPR gRNA sequence
  source 1..20: mol_type = other DNA
ttttgaacacttatttcaac

SEQ ID NO: 100342 - DNA, 20 bp, synthetic construct
  misc_feature 1..20: note = CRISPR gRNA sequence
  source 1..20: mol_type = other DNA
ttgaacacttatttcaactt

SEQ ID NO: 100343 - DNA, 20 bp, synthetic construct
  misc_feature 1..20: note = CRISPR gRNA sequence
  source 1..20: mol_type = other DNA
tgaacacttatttcaacttg

SEQ ID NO: 100344 - DNA, 20 bp, synthetic construct
  misc_feature 1..20: note = CRISPR gRNA sequence
  source 1..20: mol_type = other DNA
gaacacttatttcaacttga

SEQ ID NO: 100345 - DNA, 20 bp, synthetic construct
  misc_feature 1..20: note = CRISPR gRNA sequence
  source 1..20: mol_type = other DNA
aacacttatttcaacttgaa

SEQ ID NO: 100346 - DNA, 20 bp, synthetic construct
  misc_feature 1..20: note = CRISPR gRNA sequence
  source 1..20: mol_type = other DNA
atttcaacttgaagtttttt

SEQ ID NO: 100347 - DNA, 20 bp, synthetic construct
  misc_feature 1..20: note = CRISPR gRNA sequence
  source 1..20: mol_type = other DNA
tttcaacttgaagtttttta

SEQ ID NO: 100348 - DNA, 20 bp, synthetic construct
  misc_feature 1..20: note = CRISPR gRNA sequence
  source 1..20: mol_type = other DNA
caacttgaagttttttatta

SEQ ID NO: 100349 - DNA, 20 bp, synthetic construct
  misc_feature 1..20: note = CRISPR gRNA sequence
  source 1..20: mol_type = other DNA
aacttgaagttttttattat

SEQ ID NO: 100350 - DNA, 20 bp, synthetic construct
  misc_feature 1..20: note = CRISPR gRNA sequence
  source 1..20: mol_type = other DNA
gaagttttttattatttctc

SEQ ID NO: 100351 - DNA, 20 bp, synthetic construct
  misc_feature 1..20: note = CRISPR gRNA sequence
  source 1..20: mol_type = other DNA
aagttttttattatttctct

SEQ ID NO: 100352 - DNA, 20 bp, synthetic construct
  misc_feature 1..20: note = CRISPR gRNA sequence
  source 1..20: mol_type = other DNA
tttattatttctctatgtct

SEQ ID NO: 100353 - DNA, 20 bp, synthetic construct
  misc_feature 1..20: note = CRISPR gRNA sequence
  source 1..20: mol_type = other DNA
ttattatttctctatgtctg

SEQ ID NO: 100354 - DNA, 20 bp, synthetic construct
  misc_feature 1..20: note = CRISPR gRNA sequence
  source 1..20: mol_type = other DNA
tattatttctctatgtctga

SEQ ID NO: 100355 - DNA, 20 bp, synthetic construct
  misc_feature 1..20: note = CRISPR gRNA sequence
  source 1..20: mol_type = other DNA
attatttctctatgtctgat

SEQ ID NO: 100356 - DNA, 20 bp, synthetic construct
  misc_feature 1..20: note = CRISPR gRNA sequence
  source 1..20: mol_type = other DNA
ttatttctctatgtctgatg

SEQ ID NO: 100357 - DNA, 20 bp, synthetic construct
  misc_feature 1..20: note = CRISPR gRNA sequence
  source 1..20: mol_type = other DNA
tttctctatgtctgatgcac

SEQ ID NO: 100358 - DNA, 20 bp, synthetic construct
  misc_feature 1..20: note = CRISPR gRNA sequence
  source 1..20: mol_type = other DNA
ctctatgtctgatgcaccta

SEQ ID NO: 100359 - DNA, 20 bp, synthetic construct
  misc_feature 1..20: note = CRISPR gRNA sequence
  source 1..20: mol_type = other DNA
tctatgtctgatgcacctac

SEQ ID NO: 100360 - DNA, 20 bp, synthetic construct
  misc_feature 1..20: note = CRISPR gRNA sequence
  source 1..20: mol_type = other DNA
tatgtctgatgcacctactt

SEQ ID NO: 100361 - DNA, 20 bp, synthetic construct
  misc_feature 1..20: note = CRISPR gRNA sequence
  source 1..20: mol_type = other DNA
tgtctgatgcacctacttga

SEQ ID NO: 100362 - DNA, 20 bp, synthetic construct
  misc_feature 1..20: note = CRISPR gRNA sequence
  source 1..20: mol_type = other DNA
atgcacctacttgacccccg

SEQ ID NO: 100363 - DNA, 20 bp, synthetic construct
  misc_feature 1..20: note = CRISPR gRNA sequence
  source 1..20: mol_type = other DNA
cttgacccccgactccctag

SEQ ID NO: 100364 - DNA, 20 bp, synthetic construct
  misc_feature 1..20: note = CRISPR gRNA sequence
  source 1..20: mol_type = other DNA
gacccccgactccctagagg

SEQ ID NO: 100365 - DNA, 20 bp, synthetic construct
  misc_feature 1..20: note = CRISPR gRNA sequence
  source 1..20: mol_type = other DNA
acccccgactccctagaggg

SEQ ID NO: 100366 - DNA, 20 bp, synthetic construct
  misc_feature 1..20: note = CRISPR gRNA sequence
  source 1..20: mol_type = other DNA
cctagagggcaaaaactatg

SEQ ID NO: 100367 - DNA, 20 bp, synthetic construct
  misc_feature 1..20: note = CRISPR gRNA sequence
  source 1..20: mol_type = other DNA
gagggcaaaaactatgtctt

SEQ ID NO: 100368 - DNA, 20 bp, synthetic construct
  misc_feature 1..20: note = CRISPR gRNA sequence
  source 1..20: mol_type = other DNA
tgtcttgtttgctcagaaca

SEQ ID NO: 100369 - DNA, 20 bp, synthetic construct
  misc_feature 1..20: note = CRISPR gRNA sequence
  source 1..20: mol_type = other DNA
gtttgctcagaacattgcca

SEQ ID NO: 100370 - DNA, 20 bp, synthetic construct
  misc_feature 1..20: note = CRISPR gRNA sequence
  source 1..20: mol_type = other DNA
tttgctcagaacattgccag

SEQ ID NO: 100371 - DNA, 20 bp, synthetic construct
  misc_feature 1..20: note = CRISPR gRNA sequence
  source 1..20: mol_type = other DNA
gctcagaacattgccaggca

SEQ ID NO: 100372 - DNA, 20 bp, synthetic construct
  misc_feature 1..20: note = CRISPR gRNA sequence
  source 1..20: mol_type = other DNA
ctcagaacattgccaggcag

SEQ ID NO: 100373 - DNA, 20 bp, synthetic construct
  misc_feature 1..20: note = CRISPR gRNA sequence
  source 1..20: mol_type = other DNA
agaacattgccaggcaggga

SEQ ID NO: 100374 - DNA, 20 bp, synthetic construct
  misc_feature 1..20: note = CRISPR gRNA sequence
  source 1..20: mol_type = other DNA
ccaggcagggaggagaaaga

SEQ ID NO: 100375 - DNA, 20 bp, synthetic construct
  misc_feature 1..20: note = CRISPR gRNA sequence
  source 1..20: mol_type = other DNA
ggtattcaagagagtagagt

SEQ ID NO: 100376 - DNA, 20 bp, synthetic construct
  misc_feature 1..20: note = CRISPR gRNA sequence
  source 1..20: mol_type = other DNA
aagagagtagagtgagtgaa

SEQ ID NO: 100377 - DNA, 20 bp, synthetic construct
  misc_feature 1..20: note = CRISPR gRNA sequence
  source 1..20: mol_type = other DNA
cctttggtagctccaagacc

SEQ ID NO: 100378 - DNA, 20 bp, synthetic construct
  misc_feature 1..20: note = CRISPR gRNA sequence
  source 1..20: mol_type = other DNA
tggtagctccaagaccccag

SEQ ID NO: 100379 - DNA, 20 bp, synthetic construct
  misc_feature 1..20: note = CRISPR gRNA sequence
  source 1..20: mol_type = other DNA
ggtagctccaagaccccagg

SEQ ID NO: 100380 - DNA, 20 bp, synthetic construct
  misc_feature 1..20: note = CRISPR gRNA sequence
  source 1..20: mol_type = other DNA
gtagctccaagaccccaggg

SEQ ID NO: 100381 - DNA, 20 bp, synthetic construct
  misc_feature 1..20: note = CRISPR gRNA sequence
  source 1..20: mol_type = other DNA
caagaccccagggagatacc

SEQ ID NO: 100382 - DNA, 20 bp, synthetic construct
  misc_feature 1..20: note = CRISPR gRNA sequence
  source 1..20: mol_type = other DNA
atgcctgtaatcccagcact

SEQ ID NO: 100383 - DNA, 20 bp, synthetic construct
  misc_feature 1..20: note = CRISPR gRNA sequence
  source 1..20: mol_type = other DNA
taatcccagcactttgggag

SEQ ID NO: 100384 - DNA, 20 bp, synthetic construct
  misc_feature 1..20: note = CRISPR gRNA sequence
  source 1..20: mol_type = other DNA
tgggaggccacggcaggaga

SEQ ID NO: 100385 - DNA, 20 bp, synthetic construct
  misc_feature 1..20: note = CRISPR gRNA sequence
  source 1..20: mol_type = other DNA
gggaggccacggcaggagaa

SEQ ID NO: 100386 - DNA, 20 bp, synthetic construct
  misc_feature 1..20: note = CRISPR gRNA sequence
  source 1..20: mol_type = other DNA
ggaggccacggcaggagaat

SEQ ID NO: 100387 - DNA, 20 bp, synthetic construct
  misc_feature 1..20: note = CRISPR gRNA sequence
  source 1..20: mol_type = other DNA
cttgagcccaggagtttgag

SEQ ID NO: 100388 - DNA, 20 bp, synthetic construct
  misc_feature 1..20: note = CRISPR gRNA sequence
  source 1..20: mol_type = other DNA
gagcccaggagtttgagacc

SEQ ID NO: 100389 - DNA, 20 bp, synthetic construct
  misc_feature 1..20: note = CRISPR gRNA sequence
  source 1..20: mol_type = other DNA
agcccaggagtttgagacca

SEQ ID NO: 100390 - DNA, 20 bp, synthetic construct
  misc_feature 1..20: note = CRISPR gRNA sequence
  source 1..20: mol_type = other DNA
gagaccagcctgggcgacag

SEQ ID NO: 100391 - DNA, 20 bp, synthetic construct
  misc_feature 1..20: note = CRISPR gRNA sequence
  source 1..20: mol_type = other DNA
agaccagcctgggcgacaga

SEQ ID NO: 100392 - DNA, 20 bp, synthetic construct
  misc_feature 1..20: note = CRISPR gRNA sequence
  source 1..20: mol_type = other DNA
ggcgacagagcaagactcca

SEQ ID NO: 100393 - DNA, 20 bp, synthetic construct
  misc_feature 1..20: note = CRISPR gRNA sequence
  source 1..20: mol_type = other DNA
catctctaccaatatatata

SEQ ID NO: 100394 - DNA, 20 bp, synthetic construct
  misc_feature 1..20: note = CRISPR gRNA sequence
  source 1..20: mol_type = other DNA
taccaatatatatatatttt

SEQ ID NO: 100395 - DNA, 20 bp, synthetic construct
  misc_feature 1..20: note = CRISPR gRNA sequence
  source 1..20: mol_type = other DNA
ccaatatatatatattttta

SEQ ID NO: 100396 - DNA, 20 bp, synthetic construct
  misc_feature 1..20: note = CRISPR gRNA sequence
  source 1..20: mol_type = other DNA
ttaatttgctgggtatggtg

SEQ ID NO: 100397 - DNA, 20 bp, synthetic construct
  misc_feature 1..20: note = CRISPR gRNA sequence
  source 1..20: mol_type = other DNA
taatttgctgggtatggtgg

SEQ ID NO: 100398 - DNA, 20 bp, synthetic construct
  misc_feature 1..20: note = CRISPR gRNA sequence
  source 1..20: mol_type = other DNA
aatttgctgggtatggtggc

SEQ ID NO: 100399 - DNA, 20 bp, synthetic construct
  misc_feature 1..20: note = CRISPR gRNA sequence
  source 1..20: mol_type = other DNA
atttgctgggtatggtggca

SEQ ID NO: 100400 - DNA, 20 bp, synthetic construct
  misc_feature 1..20: note = CRISPR gRNA sequence
  source 1..20: mol_type = other DNA
gctgggtatggtggcacctg

SEQ ID NO: 100401 - DNA, 20 bp, synthetic construct
  misc_feature 1..20: note = CRISPR gRNA sequence
  source 1..20: mol_type = other DNA
ctgggtatggtggcacctgt

SEQ ID NO: 100402 - DNA, 20 bp, synthetic construct
  misc_feature 1..20: note = CRISPR gRNA sequence
  source 1..20: mol_type = other DNA
ggtatggtggcacctgtagt

SEQ ID NO: 100403 - DNA, 20 bp, synthetic construct
  misc_feature 1..20: note = CRISPR gRNA sequence
  source 1..20: mol_type = other DNA
tagtttcagctgctcaggag

SEQ ID NO: 100404 - DNA, 20 bp, synthetic construct
  misc_feature 1..20: note = CRISPR gRNA sequence
  source 1..20: mol_type = other DNA
cagctgctcaggaggctgag

SEQ ID NO: 100405 - DNA, 20 bp, synthetic construct
  misc_feature 1..20: note = CRISPR gRNA sequence
  source 1..20: mol_type = other DNA
agctgctcaggaggctgagg

SEQ ID NO: 100406 - DNA, 20 bp, synthetic construct
  misc_feature 1..20: note = CRISPR gRNA sequence
  source 1..20: mol_type = other DNA
ctcaggaggctgaggtggga

SEQ ID NO: 100407 - DNA, 20 bp, synthetic construct
  misc_feature 1..20: note = CRISPR gRNA sequence
  source 1..20: mol_type = other DNA
aggaggctgaggtgggaggt

SEQ ID NO: 100408 - DNA, 20 bp, synthetic construct
  misc_feature 1..20: note = CRISPR gRNA sequence
  source 1..20: mol_type = other DNA
aggtgggaggttggcttgag

SEQ ID NO: 100409 - DNA, 20 bp, synthetic construct
  misc_feature 1..20: note = CRISPR gRNA sequence
  source 1..20: mol_type = other DNA
gcttgagcccaggaggttga

SEQ ID NO: 100410 - DNA, 20 bp, synthetic construct
  misc_feature 1..20: note = CRISPR gRNA sequence
  source 1..20: mol_type = other DNA
gagcccaggaggttgaggct

SEQ ID NO: 100411 - DNA, 20 bp, synthetic construct
  misc_feature 1..20: note = CRISPR gRNA sequence
  source 1..20: mol_type = other DNA
agcccaggaggttgaggctg

SEQ ID NO: 100412 - DNA, 20 bp, synthetic construct
  misc_feature 1..20: note = CRISPR gRNA sequence
  source 1..20: mol_type = other DNA
aggctgaagtgaactgtgat

SEQ ID NO: 100413 - DNA, 20 bp, synthetic construct
  misc_feature 1..20: note = CRISPR gRNA sequence
  source 1..20: mol_type = other DNA
aagtgaactgtgatcacacc

SEQ ID NO: 100414 - DNA, 20 bp, synthetic construct
  misc_feature 1..20: note = CRISPR gRNA sequence
  source 1..20: mol_type = other DNA
tgatcacaccaccgcactcc

SEQ ID NO: 100415 - DNA, 20 bp, synthetic construct
  misc_feature 1..20: note = CRISPR gRNA sequence
  source 1..20: mol_type = other DNA
cagcctggacaacagagcaa

SEQ ID NO: 100416 - DNA, 20 bp, synthetic construct
  misc_feature 1..20: note = CRISPR gRNA sequence
  source 1..20: mol_type = other DNA
gacaacagagcaagactctg

SEQ ID NO: 100417 - DNA, 20 bp, synthetic construct
  misc_feature 1..20: note = CRISPR gRNA sequence
  source 1..20: mol_type = other DNA
tgtctcaaaaaaaaaaaaaa

SEQ ID NO: 100418 - DNA, 20 bp, synthetic construct
  misc_feature 1..20: note = CRISPR gRNA sequence
  source 1..20: mol_type = other DNA
tctcaaaaaaaaaaaaaacc

SEQ ID NO: 100419 - DNA, 20 bp, synthetic construct
  misc_feature 1..20: note = CRISPR gRNA sequence
  source 1..20: mol_type = other DNA
aaaaaaaaaaaaaaccccaa

SEQ ID NO: 100420 - DNA, 20 bp, synthetic construct
  misc_feature 1..20: note = CRISPR gRNA sequence
  source 1..20: mol_type = other DNA
ggtgtggtggctcatgccta

SEQ ID NO: 100421 - DNA, 20 bp, synthetic construct
  misc_feature 1..20: note = CRISPR gRNA sequence
  source 1..20: mol_type = other DNA
atgcctataatcccagcact

SEQ ID NO: 100422 - DNA, 20 bp, synthetic construct
  misc_feature 1..20: note = CRISPR gRNA sequence
  source 1..20: mol_type = other DNA
taatcccagcactttgggag

SEQ ID NO: 100423 - DNA, 20 bp, synthetic construct
  misc_feature 1..20: note = CRISPR gRNA sequence
  source 1..20: mol_type = other DNA
tgggaggctgaggcaggtgg

SEQ ID NO: 100424 - DNA, 20 bp, synthetic construct
  misc_feature 1..20: note = CRISPR gRNA sequence
  source 1..20: mol_type = other DNA
gggaggctgaggcaggtgga

SEQ ID NO: 100425 - DNA, 20 bp, synthetic construct
  misc_feature 1..20: note = CRISPR gRNA sequence
  source 1..20: mol_type = other DNA
ggaggctgaggcaggtggat

SEQ ID NO: 100426 - DNA, 20 bp, synthetic construct
  misc_feature 1..20: note = CRISPR gRNA sequence
  source 1..20: mol_type = other DNA
aggcaggtggatgatttgag

SEQ ID NO: 100427 - DNA, 20 bp, synthetic construct
  misc_feature 1..20: note = CRISPR gRNA sequence
  source 1..20: mol_type = other DNA
gaggtcaggagtttgaaatt

SEQ ID NO: 100428 - DNA, 20 bp, synthetic construct
  misc_feature 1..20: note = CRISPR gRNA sequence
  source 1..20: mol_type = other DNA
aggtcaggagtttgaaatta

SEQ ID NO: 100429 - DNA, 20 bp, synthetic construct
  misc_feature 1..20: note = CRISPR gRNA sequence
  source 1..20: mol_type = other DNA
gaaattagcctggccaacat

SEQ ID NO: 100430 - DNA, 20 bp, synthetic construct
  misc_feature 1..20: note = CRISPR gRNA sequence
  source 1..20: mol_type = other DNA
aaattagcctggccaacata

SEQ ID NO: 100431 - DNA, 20 bp, synthetic construct
  misc_feature 1..20: note = CRISPR gRNA sequence
  source 1..20: mol_type = other DNA
gcctggccaacatagcgaaa

SEQ ID NO: 100432 - DNA, 20 bp, synthetic construct
  misc_feature 1..20: note = CRISPR gRNA sequence
  source 1..20: mol_type = other DNA
gccaacatagcgaaaccccg

SEQ ID NO: 100433 - DNA, 20 bp, synthetic construct
  misc_feature 1..20: note = CRISPR gRNA sequence
  source 1..20: mol_type = other DNA
tacttaaaatacaaaaatta

SEQ ID NO: 100434 - DNA, 20 bp, synthetic construct
  misc_feature 1..20: note = CRISPR gRNA sequence
  source 1..20: mol_type = other DNA
cttaaaatacaaaaattagc

SEQ ID NO: 100435 - DNA, 20 bp, synthetic construct
  misc_feature 1..20: note = CRISPR gRNA sequence
  source 1..20: mol_type = other DNA
aaaatacaaaaattagccag

SEQ ID NO: 100436 - DNA, 20 bp, synthetic construct
  misc_feature 1..20: note = CRISPR gRNA sequence
  source 1..20: mol_type = other DNA
aaatacaaaaattagccagg

SEQ ID NO: 100437 - DNA, 20 bp, synthetic construct
  misc_feature 1..20: note = CRISPR gRNA sequence
  source 1..20: mol_type = other DNA
gccaggtgtggtggtgggcg

SEQ ID NO: 100438 - DNA, 20 bp, synthetic construct
  misc_feature 1..20: note = CRISPR gRNA sequence
  source 1..20: mol_type = other DNA
tgatcccagctactcgggag

SEQ ID NO: 100439 - DNA, 20 bp, synthetic construct
  misc_feature 1..20: note = CRISPR gRNA sequence
  source 1..20: mol_type = other DNA
ctcgggaggctgaggcacaa

SEQ ID NO: 100440 - DNA, 20 bp, synthetic construct
  misc_feature 1..20: note = CRISPR gRNA sequence
  source 1..20: mol_type = other DNA
gggaggctgaggcacaagaa

SEQ ID NO: 100441 - DNA, 20 bp, synthetic construct
  misc_feature 1..20: note = CRISPR gRNA sequence
  source 1..20: mol_type = other DNA
aggcacaagaatcgcttgaa

SEQ ID NO: 100442 - DNA, 20 bp, synthetic construct
  misc_feature 1..20: note = CRISPR gRNA sequence
  source 1..20: mol_type = other DNA
gaacccaggaggcagaggtt

SEQ ID NO: 100443 - DNA, 20 bp, synthetic construct
  misc_feature 1..20: note = CRISPR gRNA sequence
  source 1..20: mol_type = other DNA
aacccaggaggcagaggttg

SEQ ID NO: 100444 - DNA, 20 bp, synthetic construct
  misc_feature 1..20: note = CRISPR gRNA sequence
  source 1..20: mol_type = other DNA
cagtgagccgagatcacgcc

SEQ ID NO: 100445 - DNA, 20 bp, synthetic construct
  misc_feature 1..20: note = CRISPR gRNA sequence
  source 1..20: mol_type = other DNA
tactccagcctgggggacag

SEQ ID NO: 100446 - DNA, 20 bp, synthetic construct
  misc_feature 1..20: note = CRISPR gRNA sequence
  source 1..20: mol_type = other DNA
cagcctgggggacagacgga

SEQ ID NO: 100447 - DNA, 20 bp, synthetic construct
  misc_feature 1..20: note = CRISPR gRNA sequence
  source 1..20: mol_type = other DNA
ggggacagacggagactcca

SEQ ID NO: 100448 - DNA, 20 bp, synthetic construct
  misc_feature 1..20: note = CRISPR gRNA sequence
  source 1..20: mol_type = other DNA
catctcaaacaacaacagca

SEQ ID NO: 100449 - DNA, 20 bp, synthetic construct
  misc_feature 1..20: note = CRISPR gRNA sequence
  source 1..20: mol_type = other DNA
aaacaacaacagcaacaaaa

SEQ ID NO: 100450 - DNA, 20 bp, synthetic construct
  misc_feature 1..20: note = CRISPR gRNA sequence
  source 1..20: mol_type = other DNA
ctgtcctgaagcctcagaga

SEQ ID NO: 100451 - DNA, 20 bp, synthetic construct
  misc_feature 1..20: note = CRISPR gRNA sequence
  source 1..20: mol_type = other DNA
tgtcctgaagcctcagagac

SEQ ID NO: 100452 - DNA, 20 bp, synthetic construct
  misc_feature 1..20: note = CRISPR gRNA sequence
  source 1..20: mol_type = other DNA
tcctgaagcctcagagacat

SEQ ID NO: 100453 - DNA, 20 bp, synthetic construct
  misc_feature 1..20: note = CRISPR gRNA sequence
  source 1..20: mol_type = other DNA
aagcctcagagacatctact

SEQ ID NO: 100454 - DNA, 20 bp, synthetic construct
  misc_feature 1..20: note = CRISPR gRNA sequence
  source 1..20: mol_type = other DNA
agagacatctactgagggga

SEQ ID NO: 100455 - DNA, 20 bp, synthetic construct
  misc_feature 1..20: note = CRISPR gRNA sequence
  source 1..20: mol_type = other DNA
ctgaggggaaactgacgcct

SEQ ID NO: 100456 - DNA, 20 bp, synthetic construct
  misc_feature 1..20: note = CRISPR gRNA sequence
  source 1..20: mol_type = other DNA
aggggaaactgacgcctgtt

SEQ ID NO: 100457 - DNA, 20 bp, synthetic construct
  misc_feature 1..20: note = CRISPR gRNA sequence
  source 1..20: mol_type = other DNA
acgcctgttgtctgtttccc

SEQ ID NO: 100458 - DNA, 20 bp, synthetic construct
  misc_feature 1..20: note = CRISPR gRNA sequence
  source 1..20: mol_type = other DNA
ttgtctgtttcccagcaggc

SEQ ID NO: 100459 - DNA, 20 bp, synthetic construct
  misc_feature 1..20: note = CRISPR gRNA sequence
  source 1..20: mol_type = other DNA
tctgtttcccagcaggcagc

SEQ ID NO: 100460 - DNA, 20 bp, synthetic construct
  misc_feature 1..20: note = CRISPR gRNA sequence
  source 1..20: mol_type = other DNA
tttcccagcaggcagctccc

SEQ ID NO: 100461 - DNA, 20 bp, synthetic construct
  misc_feature 1..20: note = CRISPR gRNA sequence
  source 1..20: mol_type = other DNA
cccagcaggcagctccctga

SEQ ID NO: 100462 - DNA, 20 bp, synthetic construct
  misc_feature 1..20: note = CRISPR gRNA sequence
  source 1..20: mol_type = other DNA
ccagcaggcagctccctgaa

SEQ ID NO: 100463 - DNA, 20 bp, synthetic construct
  misc_feature 1..20: note = CRISPR gRNA sequence
  source 1..20: mol_type = other DNA
cctgaagcactccaccactc

SEQ ID NO: 100464 - DNA, 20 bp, synthetic construct
  misc_feature 1..20: note = CRISPR gRNA sequence
  source 1..20: mol_type = other DNA
aagcactccaccactctcac

SEQ ID NO: 100465 - DNA, 20 bp, synthetic construct
  misc_feature 1..20: note = CRISPR gRNA sequence
  source 1..20: mol_type = other DNA
caccactctcaccaaccggc

SEQ ID NO: 100466 - DNA, 20 bp, synthetic construct
  misc_feature 1..20: note = CRISPR gRNA sequence
  source 1..20: mol_type = other DNA
tcaccaaccggcagcgaggg

SEQ ID NO: 100467 - DNA, 20 bp, synthetic construct
  misc_feature 1..20: note = CRISPR gRNA sequence
  source 1..20: mol_type = other DNA
accaaccggcagcgagggaa

SEQ ID NO: 100468 - DNA, 20 bp, synthetic construct
  misc_feature 1..20: note = CRISPR gRNA sequence
  source 1..20: mol_type = other DNA
tgccggccaccctagactgt

SEQ ID NO: 100469 - DNA, 20 bp, synthetic construct
  misc_feature 1..20: note = CRISPR gRNA sequence
  source 1..20: mol_type = other DNA
ccggccaccctagactgtga

SEQ ID NO: 100470 - DNA, 20 bp, synthetic construct
  misc_feature 1..20: note = CRISPR gRNA sequence
  source 1..20: mol_type = other DNA
gactgtgagtgggcccacgg

SEQ ID NO: 100471 - DNA, 20 bp, synthetic construct
  misc_feature 1..20: note = CRISPR gRNA sequence
  source 1..20: mol_type = other DNA
tgagtgggcccacggtcccc

SEQ ID NO: 100472 - DNA, 20 bp, synthetic construct
  misc_feature 1..20: note = CRISPR gRNA sequence
  source 1..20: mol_type = other DNA
tgaggagcaatcgtggacag

SEQ ID NO: 100473 - DNA, 20 bp, synthetic construct
  misc_feature 1..20: note = CRISPR gRNA sequence
  source 1..20: mol_type = other DNA
aggcacagagaagcaagggg

SEQ ID NO: 100474 - DNA, 20 bp, synthetic construct
  misc_feature 1..20: note = CRISPR gRNA sequence
  source 1..20: mol_type = other DNA
tgcctctgtcctgccccagc

SEQ ID NO: 100475 - DNA, 20 bp, synthetic construct
  misc_feature 1..20: note = CRISPR gRNA sequence
  source 1..20: mol_type = other DNA
cctctgtcctgccccagccc

SEQ ID NO: 100476 - DNA, 20 bp, synthetic construct
  misc_feature 1..20: note = CRISPR gRNA sequence
  source 1..20: mol_type = other DNA
tgtcctgccccagccctgtc

SEQ ID NO: 100477 - DNA, 20 bp, synthetic construct
  misc_feature 1..20: note = CRISPR gRNA sequence
  source 1..20: mol_type = other DNA
tcctgccccagccctgtcca

SEQ ID NO: 100478 - DNA, 20 bp, synthetic construct
  misc_feature 1..20: note = CRISPR gRNA sequence
  source 1..20: mol_type = other DNA
ccccagccctgtccatccac

SEQ ID NO: 100479 - DNA, 20 bp, synthetic construct
  misc_feature 1..20: note = CRISPR gRNA sequence
  source 1..20: mol_type = other DNA
tccatccaccagctcgcagc

SEQ ID NO: 100480 - DNA, 20 bp, synthetic construct
  misc_feature 1..20: note = CRISPR gRNA sequence
  source 1..20: mol_type = other DNA
gcagcacagggggagctgga

SEQ ID NO: 100481 - DNA, 20 bp, synthetic construct
  misc_feature 1..20: note = CRISPR gRNA sequence
  source 1..20: mol_type = other DNA
gaccagctgaaggagcattt

SEQ ID NO: 100482 - DNA, 20 bp, synthetic construct
  misc_feature 1..20: note = CRISPR gRNA sequence
  source 1..20: mol_type = other DNA
aaggagcatttgcggaaagg

SEQ ID NO: 100483 - DNA, 20 bp, synthetic construct
  misc_feature 1..20: note = CRISPR gRNA sequence
  source 1..20: mol_type = other DNA
gcggaaaggtgcgtgtccac

SEQ ID NO: 100484 - DNA, 20 bp, synthetic construct
  misc_feature 1..20: note = CRISPR gRNA sequence
  source 1..20: mol_type = other DNA
cggaaaggtgcgtgtccaca

SEQ ID NO: 100485 - DNA, 20 bp, synthetic construct
  misc_feature 1..20: note = CRISPR gRNA sequence
  source 1..20: mol_type = other DNA
gcatgtctgcacctggctgg

SEQ ID NO: 100486 - DNA, 20 bp, synthetic construct
  misc_feature 1..20: note = CRISPR gRNA sequence
  source 1..20: mol_type = other DNA
cacctggctggtgtgtgcat

SEQ ID NO: 100487 - DNA, 20 bp, synthetic construct
  misc_feature 1..20: note = CRISPR gRNA sequence
  source 1..20: mol_type = other DNA
gctggtgtgtgcatatgggt

SEQ ID NO: 100488 - DNA, 20 bp, synthetic construct
  misc_feature 1..20: note = CRISPR gRNA sequence
  source 1..20: mol_type = other DNA
gtgtgtgcatatgggtgtcc

SEQ ID NO: 100489 - DNA, 20 bp, synthetic construct
  misc_feature 1..20: note = CRISPR gRNA sequence
  source 1..20: mol_type = other DNA
atgacgtgacctgtgagtgt

SEQ ID NO: 100490 - DNA, 20 bp, synthetic construct
  misc_feature 1..20: note = CRISPR gRNA sequence
  source 1..20: mol_type = other DNA
tgagtgtccacgtgtatgat

SEQ ID NO: 100491 - DNA, 20 bp, synthetic construct
  misc_feature 1..20: note = CRISPR gRNA sequence
  source 1..20: mol_type = other DNA
tatctaactgtgtgtgtgac

SEQ ID NO: 100492 - DNA, 20 bp, synthetic construct
  misc_feature 1..20: note = CRISPR gRNA sequence
  source 1..20: mol_type = other DNA
actgtgtgtgtgaccgtgtt

SEQ ID NO: 100493 - DNA, 20 bp, synthetic construct
  misc_feature 1..20: note = CRISPR gRNA sequence
  source 1..20: mol_type = other DNA
tgtgtgtgaccgtgttcatg

SEQ ID NO: 100494 - DNA, 20 bp, synthetic construct
  misc_feature 1..20: note = CRISPR gRNA sequence
  source 1..20: mol_type = other DNA
atgtatgtccatcaacatac

SEQ ID NO: 100495 - DNA, 20 bp, synthetic construct
  misc_feature 1..20: note = CRISPR gRNA sequence
  source 1..20: mol_type = other DNA
cccctcattcccctgtctaa

SEQ ID NO: 100496 - DNA, 20 bp, synthetic construct
  misc_feature 1..20: note = CRISPR gRNA sequence
  source 1..20: mol_type = other DNA
attcccctgtctaaccccag

SEQ ID NO: 100497 - DNA, 20 bp, synthetic construct
  misc_feature 1..20: note = CRISPR gRNA sequence
  source 1..20: mol_type = other DNA
ccctgtctaaccccagcccc

SEQ ID NO: 100498 - DNA, 20 bp, synthetic construct
  misc_feature 1..20: note = CRISPR gRNA sequence
  source 1..20: mol_type = other DNA
tctaaccccagccccccacc

SEQ ID NO: 100499 - DNA, 20 bp, synthetic construct
  misc_feature 1..20: note = CRISPR gRNA sequence
  source 1..20: mol_type = other DNA
accccagccccccacctcgt

SEQ ID NO: 100500 - DNA, 20 bp, synthetic construct
  misc_feature 1..20: note = CRISPR gRNA sequence
  source 1..20: mol_type = other DNA
gtccccatttggcagcactg

SEQ ID NO: 100501 - DNA, 20 bp, synthetic construct
  misc_feature 1..20: note = CRISPR gRNA sequence
  source 1..20: mol_type = other DNA
ggcagcactggggatagggg

SEQ ID NO: 100502 - DNA, 20 bp, synthetic construct
  misc_feature 1..20: note = CRISPR gRNA sequence
  source 1..20: mol_type = other DNA
gcagcactggggataggggg

SEQ ID NO: 100503 - DNA, 20 bp, synthetic construct
  misc_feature 1..20: note = CRISPR gRNA sequence
  source 1..20: mol_type = other DNA
gggatagggggcaggggtgc

SEQ ID NO: 100504 - DNA, 20 bp, synthetic construct
  misc_feature 1..20: note = CRISPR gRNA sequence
  source 1..20: mol_type = other DNA
gtggtattgcccgcctcctc

SEQ ID NO: 100505 - DNA, 20 bp, synthetic construct
  misc_feature 1..20: note = CRISPR gRNA sequence
  source 1..20: mol_type = other DNA
cccgcctcctcctgccaggt

SEQ ID NO: 100506 - DNA, 20 bp, synthetic construct
  misc_feature 1..20: note = CRISPR gRNA sequence
  source 1..20: mol_type = other DNA
ctcctgccaggtgacaacct

SEQ ID NO: 100507 - DNA, 20 bp, synthetic construct
  misc_feature 1..20: note = CRISPR gRNA sequence
  source 1..20: mol_type = other DNA
ctgccaggtgacaacctcgt

SEQ ID NO: 100508 - DNA, 20 bp, synthetic construct
  misc_feature 1..20: note = CRISPR gRNA sequence
  source 1..20: mol_type = other DNA
ccaggtgacaacctcgtcaa

SEQ ID NO: 100509 - DNA, 20 bp, synthetic construct
  misc_feature 1..20: note = CRISPR gRNA sequence
  source 1..20: mol_type = other DNA
gtcaacaagccagacgagcg

SEQ ID NO: 100510 - DNA, 20 bp, synthetic construct
  misc_feature 1..20: note = CRISPR gRNA sequence
  source 1..20: mol_type = other DNA
cacccccctcatctgggcct

SEQ ID NO: 100511 - DNA, 20 bp, synthetic construct
  misc_feature 1..20: note = CRISPR gRNA sequence
  source 1..20: mol_type = other DNA
acccccctcatctgggcctc

SEQ ID NO: 100512 - DNA, 20 bp, synthetic construct
  misc_feature 1..20: note = CRISPR gRNA sequence
  source 1..20: mol_type = other DNA
atctgggcctccgcctttgg

SEQ ID NO: 100513 - DNA, 20 bp, synthetic construct
  misc_feature 1..20: note = CRISPR gRNA sequence
  source 1..20: mol_type = other DNA
ggcctccgcctttggagaga

SEQ ID NO: 100514 - DNA, 20 bp, synthetic construct
  misc_feature 1..20: note = CRISPR gRNA sequence
  source 1..20: mol_type = other DNA
cgcctttggagagattgaga

SEQ ID NO: 100515 - DNA, 20 bp, synthetic construct
  misc_feature 1..20: note = CRISPR gRNA sequence
  source 1..20: mol_type = other DNA
tggagagattgagaccgttc

SEQ ID NO: 100516 - DNA, 20 bp, synthetic construct
  misc_feature 1..20: note = CRISPR gRNA sequence
  source 1..20: mol_type = other DNA
ggagagattgagaccgttcg

SEQ ID NO: 100517 - DNA, 20 bp, synthetic construct
  misc_feature 1..20: note = CRISPR gRNA sequence
  source 1..20: mol_type = other DNA
gagagattgagaccgttcgc

SEQ ID NO: 100518 - DNA, 20 bp, synthetic construct
  misc_feature 1..20: note = CRISPR gRNA sequence
  source 1..20: mol_type = other DNA
agaccgttcgcttcctgctg

SEQ ID NO: 100519 - DNA, 20 bp, synthetic construct
  misc_feature 1..20: note = CRISPR gRNA sequence
  source 1..20: mol_type = other DNA
gcttcctgctggagtgggtg

SEQ ID NO: 100520 - DNA, 20 bp, synthetic construct
  misc_feature 1..20: note = CRISPR gRNA sequence
  source 1..20: mol_type = other DNA
cctgctggagtgggtgcgtc

SEQ ID NO: 100521 - DNA, 20 bp, synthetic construct
  misc_feature 1..20: note = CRISPR gRNA sequence
  source 1..20: mol_type = other DNA
ctgctggagtgggtgcgtcc

SEQ ID NO: 100522 - DNA, 20 bp, synthetic construct
  misc_feature 1..20: note = CRISPR gRNA sequence
  source 1..20: mol_type = other DNA
ctggagtgggtgcgtcccag

SEQ ID NO: 100523 - DNA, 20 bp, synthetic construct
  misc_feature 1..20: note = CRISPR gRNA sequence
  source 1..20: mol_type = other DNA
gagtgggtgcgtcccagccc

SEQ ID NO: 100524 - DNA, 20 bp, synthetic construct
  misc_feature 1..20: note = CRISPR gRNA sequence
  source 1..20: mol_type = other DNA
ggcagctggggggttcccgg

SEQ ID NO: 100525 - DNA, 20 bp, synthetic construct
  misc_feature 1..20: note = CRISPR gRNA sequence
  source 1..20: mol_type = other DNA
gggggttcccgggggcctta

SEQ ID NO: 100526 - DNA, 20 bp, synthetic construct
  misc_feature 1..20: note = CRISPR gRNA sequence
  source 1..20: mol_type = other DNA
ccgggggccttagggtgggc

SEQ ID NO: 100527 - DNA, 20 bp, synthetic construct
  misc_feature 1..20: note = CRISPR gRNA sequence
  source 1..20: mol_type = other DNA
agggtgggctggggttttgg

SEQ ID NO: 100528 - DNA, 20 bp, synthetic construct
  misc_feature 1..20: note = CRISPR gRNA sequence
  source 1..20: mol_type = other DNA
gggtgggctggggttttggc

SEQ ID NO: 100529 - DNA, 20 bp, synthetic construct
  misc_feature 1..20: note = CRISPR gRNA sequence
  source 1..20: mol_type = other DNA
gggttttggctgtgtctgct

SEQ ID NO: 100530 - DNA, 20 bp, synthetic construct
  misc_feature 1..20: note = CRISPR gRNA sequence
  source 1..20: mol_type = other DNA
tggctgtgtctgctggcgcc

SEQ ID NO: 100531 - DNA, 20 bp, synthetic construct
  misc_feature 1..20: note = CRISPR gRNA sequence
  source 1..20: mol_type = other DNA
ggctgtgtctgctggcgcct

SEQ ID NO: 100532 - DNA, 20 bp, synthetic construct
  misc_feature 1..20: note = CRISPR gRNA sequence
  source 1..20: mol_type = other DNA
gctgtgtctgctggcgcctt

SEQ ID NO: 100533 - DNA, 20 bp, synthetic construct
  misc_feature 1..20: note = CRISPR gRNA sequence
  source 1..20: mol_type = other DNA
tgtctgctggcgccttgtct

SEQ ID NO: 100534 - DNA, 20 bp, synthetic construct
  misc_feature 1..20: note = CRISPR gRNA sequence
  source 1..20: mol_type = other DNA
ctggcgccttgtctttgaga

SEQ ID NO: 100535 - DNA, 20 bp, synthetic construct
  misc_feature 1..20: note = CRISPR gRNA sequence
  source 1..20: mol_type = other DNA
gcgccttgtctttgagatgc

SEQ ID NO: 100536 - DNA, 20 bp, synthetic construct
  misc_feature 1..20: note = CRISPR gRNA sequence
  source 1..20: mol_type = other DNA
gtctttgagatgcggctgct

SEQ ID NO: 100537 - DNA, 20 bp, synthetic construct
  misc_feature 1..20: note = CRISPR gRNA sequence
  source 1..20: mol_type = other DNA
tctttgagatgcggctgctg

SEQ ID NO: 100538 - DNA, 20 bp, synthetic construct
  misc_feature 1..20: note = CRISPR gRNA sequence
  source 1..20: mol_type = other DNA
tgagatgcggctgctggctg

SEQ ID NO: 100539 - DNA, 20 bp, synthetic construct
  misc_feature 1..20: note = CRISPR gRNA sequence
  source 1..20: mol_type = other DNA
gagatgcggctgctggctgg

SEQ ID NO: 100540 - DNA, 20 bp, synthetic construct
  misc_feature 1..20: note = CRISPR gRNA sequence
  source 1..20: mol_type = other DNA
agatgcggctgctggctggg

SEQ ID NO: 100541 - DNA, 20 bp, synthetic construct
  misc_feature 1..20: note = CRISPR gRNA sequence
  source 1..20: mol_type = other DNA
ctggctgggtgcagtggctc

SEQ ID NO: 100542 - DNA, 20 bp, synthetic construct
  misc_feature 1..20: note = CRISPR gRNA sequence
  source 1..20: mol_type = other DNA
gctgggtgcagtggctcatg

SEQ ID NO: 100543 - DNA, 20 bp, synthetic construct
  misc_feature 1..20: note = CRISPR gRNA sequence
  source 1..20: mol_type = other DNA
ggtgcagtggctcatgcctg

SEQ ID NO: 100544 - DNA, 20 bp, synthetic construct
  misc_feature 1..20: note = CRISPR gRNA sequence
  source 1..20: mol_type = other DNA
atgcctgtaatcccagcact

SEQ ID NO: 100545 - DNA, 20 bp, synthetic construct
  misc_feature 1..20: note = CRISPR gRNA sequence
  source 1..20: mol_type = other DNA
taatcccagcactttgggag

SEQ ID NO: 100546 - DNA, 20 bp, synthetic construct
  misc_feature 1..20: note = CRISPR gRNA sequence
  source 1..20: mol_type = other DNA
tgggaggccgaggcgggtgg

SEQ ID NO: 100547 - DNA, 20 bp, synthetic construct
  misc_feature 1..20: note = CRISPR gRNA sequence
  source 1..20: mol_type = other DNA
gggaggccgaggcgggtgga

SEQ ID NO: 100548 - DNA, 20 bp, synthetic construct
  misc_feature 1..20: note = CRISPR gRNA sequence
  source 1..20: mol_type = other DNA
ggaggccgaggcgggtggat

SEQ ID NO: 100549 - DNA, 20 bp, synthetic construct
  misc_feature 1..20: note = CRISPR gRNA sequence
  source 1..20: mol_type = other DNA
gaggtcaggagttcaagacc

SEQ ID NO: 100550 - DNA, 20 bp, synthetic construct
  misc_feature 1..20: note = CRISPR gRNA sequence
  source 1..20: mol_type = other DNA
aggtcaggagttcaagacca

SEQ ID NO: 100551 - DNA, 20 bp, synthetic construct
  misc_feature 1..20: note = CRISPR gRNA sequence
  source 1..20: mol_type = other DNA
aagaccagcccggccaacat

SEQ ID NO: 100552 - DNA, 20 bp, synthetic construct
  misc_feature 1..20: note = CRISPR gRNA sequence
  source 1..20: mol_type = other DNA
tctctactaaaaaaatacaa

SEQ ID NO: 100553 - DNA, 20 bp, synthetic construct
  misc_feature 1..20: note = CRISPR gRNA sequence
  source 1..20: mol_type = other DNA
tactaaaaaaatacaaaaat

SEQ ID NO: 100554 - DNA, 20 bp, synthetic construct
  misc_feature 1..20: note = CRISPR gRNA sequence
  source 1..20: mol_type = other DNA
ctaaaaaaatacaaaaatta

SEQ ID NO: 100555 - DNA, 20 bp, synthetic construct
  misc_feature 1..20: note = CRISPR gRNA sequence
  source 1..20: mol_type = other DNA
aaaaaatacaaaaattagcc

SEQ ID NO: 100556 - DNA, 20 bp, synthetic construct
  misc_feature 1..20: note = CRISPR gRNA sequence
  source 1..20: mol_type = other DNA
gccaggcgtcgtggtgggtg

SEQ ID NO: 100557 - DNA, 20 bp, synthetic construct
  misc_feature 1..20: note = CRISPR gRNA sequence
  source 1..20: mol_type = other DNA
taatcccaggtactctggag

SEQ ID NO: 100558 - DNA, 20 bp, synthetic construct
  misc_feature 1..20: note = CRISPR gRNA sequence
  source 1..20: mol_type = other DNA
tggaggctgaggtgggagaa

SEQ ID NO: 100559 - DNA, 20 bp, synthetic construct
  misc_feature 1..20: note = CRISPR gRNA sequence
  source 1..20: mol_type = other DNA
gaggctgaggtgggagaact

SEQ ID NO: 100560 - DNA, 20 bp, synthetic construct
  misc_feature 1..20: note = CRISPR gRNA sequence
  source 1..20: mol_type = other DNA
aggtgggagaactgtgtgaa

SEQ ID NO: 100561 - DNA, 20 bp, synthetic construct
  misc_feature 1..20: note = CRISPR gRNA sequence
  source 1..20: mol_type = other DNA
tgtgaacctgggaggcggag

SEQ ID NO: 100562 - DNA, 20 bp, synthetic construct
  misc_feature 1..20: note = CRISPR gRNA sequence
  source 1..20: mol_type = other DNA
ggaggcggaggtagcagtga

SEQ ID NO: 100563 - DNA, 20 bp, synthetic construct
  misc_feature 1..20: note = CRISPR gRNA sequence
  source 1..20: mol_type = other DNA
cgccactgcactccagcctg

SEQ ID NO: 100564 - DNA, 20 bp, synthetic construct
  misc_feature 1..20: note = CRISPR gRNA sequence
  source 1..20: mol_type = other DNA
cactccagcctgggcaacag

SEQ ID NO: 100565 - DNA, 20 bp, synthetic construct
  misc_feature 1..20: note = CRISPR gRNA sequence
  source 1..20: mol_type = other DNA
cagcctgggcaacagagcaa

SEQ ID NO: 100566 - DNA, 20 bp, synthetic construct
  misc_feature 1..20: note = CRISPR gRNA sequence
  source 1..20: mol_type = other DNA
ggcaacagagcaagactcta

SEQ ID NO: 100567 - DNA, 20 bp, synthetic construct
  misc_feature 1..20: note = CRISPR gRNA sequence
  source 1..20: mol_type = other DNA
tatctccaaaaaaaaaaaaa

SEQ ID NO: 100568 - DNA, 20 bp, synthetic construct
  misc_feature 1..20: note = CRISPR gRNA sequence
  source 1..20: mol_type = other DNA
tctccaaaaaaaaaaaaaaa

SEQ ID NO: 100569 - DNA, 20 bp, synthetic construct
  misc_feature 1..20: note = CRISPR gRNA sequence
  source 1..20: mol_type = other DNA
caaaaaaaaaaaaaaagatg

SEQ ID NO: 100570 - DNA, 20 bp, synthetic construct
  misc_feature 1..20: note = CRISPR gRNA sequence
  source 1..20: mol_type = other DNA
ctgtgggtaccccaggattc

SEQ ID NO: 100571 - DNA, 20 bp, synthetic construct
  misc_feature 1..20: note = CRISPR gRNA sequence
  source 1..20: mol_type = other DNA
tgggtaccccaggattcctg

SEQ ID NO: 100572 - DNA, 20 bp, synthetic construct
  misc_feature 1..20: note = CRISPR gRNA sequence
  source 1..20: mol_type = other DNA
ctggttatgccccaatccat

SEQ ID NO: 100573 - DNA, 20 bp, synthetic construct
  misc_feature 1..20: note = CRISPR gRNA sequence
  source 1..20: mol_type = other DNA
gttatgccccaatccatcct

SEQ ID NO: 100574 - DNA, 20 bp, synthetic construct
  misc_feature 1..20: note = CRISPR gRNA sequence
  source 1..20: mol_type = other DNA
tgccccaatccatcctacca

SEQ ID NO: 100575 - DNA, 20 bp, synthetic construct
  misc_feature 1..20: note = CRISPR gRNA sequence
  source 1..20: mol_type = other DNA
ccactgtcccttcttctccc

SEQ ID NO: 100576 - DNA, 20 bp, synthetic construct
  misc_feature 1..20: note = CRISPR gRNA sequence
  source 1..20: mol_type = other DNA
tcccttcttctccctgcagg

SEQ ID NO: 100577 - DNA, 20 bp, synthetic construct
  misc_feature 1..20: note = CRISPR gRNA sequence
  source 1..20: mol_type = other DNA
cttctccctgcagggtgccg

SEQ ID NO: 100578 - DNA, 20 bp, synthetic construct
  misc_feature 1..20: note = CRISPR gRNA sequence
  source 1..20: mol_type = other DNA
ttctccctgcagggtgccga

SEQ ID NO: 100579 - DNA, 20 bp, synthetic construct
  misc_feature 1..20: note = CRISPR gRNA sequence
  source 1..20: mol_type = other DNA
ctccctgcagggtgccgacc

SEQ ID NO: 100580 - DNA, 20 bp, synthetic construct
  misc_feature 1..20: note = CRISPR gRNA sequence
  source 1..20: mol_type = other DNA
tccctgcagggtgccgaccc

SEQ ID NO: 100581 - DNA, 20 bp, synthetic construct
  misc_feature 1..20: note = CRISPR gRNA sequence
  source 1..20: mol_type = other DNA
cctgcagggtgccgaccccc

SEQ ID NO: 100582 - DNA, 20 bp, synthetic construct
  misc_feature 1..20: note = CRISPR gRNA sequence
  source 1..20: mol_type = other DNA
cagggtgccgacccccacat

SEQ ID NO: 100583 - DNA, 20 bp, synthetic construct
  misc_feature 1..20: note = CRISPR gRNA sequence
  source 1..20: mol_type = other DNA
gcaaaagagcgagagagcgc

SEQ ID NO: 100584 - DNA, 20 bp, synthetic construct
  misc_feature 1..20: note = CRISPR gRNA sequence
  source 1..20: mol_type = other DNA
tcgctggccagcacaggcgg

SEQ ID NO: 100585 - DNA, 20 bp, synthetic construct
  misc_feature 1..20: note = CRISPR gRNA sequence
  source 1..20: mol_type = other DNA
gccagcacaggcggctacac

SEQ ID NO: 100586 - DNA, 20 bp, synthetic construct
  misc_feature 1..20: note = CRISPR gRNA sequence
  source 1..20: mol_type = other DNA
cacagacattgtggggctgc

SEQ ID NO: 100587 - DNA, 20 bp, synthetic construct
  misc_feature 1..20: note = CRISPR gRNA sequence
  source 1..20: mol_type = other DNA
tggggctgctgctggagcgt

SEQ ID NO: 100588 - DNA, 20 bp, synthetic construct
  misc_feature 1..20: note = CRISPR gRNA sequence
  source 1..20: mol_type = other DNA
ctgctggagcgtgacgtgga

SEQ ID NO: 100589 - DNA, 20 bp, synthetic construct
  misc_feature 1..20: note = CRISPR gRNA sequence
  source 1..20: mol_type = other DNA
ctggagcgtgacgtggacat

SEQ ID NO: 100590 - DNA, 20 bp, synthetic construct
  misc_feature 1..20: note = CRISPR gRNA sequence
  source 1..20: mol_type = other DNA
gagcgtgacgtggacatcaa

SEQ ID NO: 100591 - DNA, 20 bp, synthetic construct
  misc_feature 1..20: note = CRISPR gRNA sequence
  source 1..20: mol_type = other DNA
tgattgggtgagggactgcc

SEQ ID NO: 100592 - DNA, 20 bp, synthetic construct
  misc_feature 1..20: note = CRISPR gRNA sequence
  source 1..20: mol_type = other DNA
ggtgagggactgcccatccc

SEQ ID NO: 100593 - DNA, 20 bp, synthetic construct
  misc_feature 1..20: note = CRISPR gRNA sequence
  source 1..20: mol_type = other DNA
cccatccccaggacctctca

SEQ ID NO: 100594 - DNA, 20 bp, synthetic construct
  misc_feature 1..20: note = CRISPR gRNA sequence
  source 1..20: mol_type = other DNA
tcagcctcctggccttcatt

SEQ ID NO: 100595 - DNA, 20 bp, synthetic construct
  misc_feature 1..20: note = CRISPR gRNA sequence
  source 1..20: mol_type = other DNA
agcctcctggccttcattcc

SEQ ID NO: 100596 - DNA, 20 bp, synthetic construct
  misc_feature 1..20: note = CRISPR gRNA sequence
  source 1..20: mol_type = other DNA
ctggccttcattcctgcctc

SEQ ID NO: 100597 - DNA, 20 bp, synthetic construct
  misc_feature 1..20: note = CRISPR gRNA sequence
  source 1..20: mol_type = other DNA
gccttcattcctgcctcaaa

SEQ ID NO: 100598 - DNA, 20 bp, synthetic construct
  misc_feature 1..20: note = CRISPR gRNA sequence
  source 1..20: mol_type = other DNA
cattcctgcctcaaatgttc

SEQ ID NO: 100599 - DNA, 20 bp, synthetic construct
  misc_feature 1..20: note = CRISPR gRNA sequence
  source 1..20: mol_type = other DNA
attcctgcctcaaatgttca

SEQ ID NO: 100600 - DNA, 20 bp, synthetic construct
  misc_feature 1..20: note = CRISPR gRNA sequence
  source 1..20: mol_type = other DNA
ctgcctcaaatgttcacaga

SEQ ID NO: 100601 - DNA, 20 bp, synthetic construct
  misc_feature 1..20: note = CRISPR gRNA sequence
  source 1..20: mol_type = other DNA
cctcaaatgttcacagagta

SEQ ID NO: 100602 - DNA, 20 bp, synthetic construct
  misc_feature 1..20: note = CRISPR gRNA sequence
  source 1..20: mol_type = other DNA
aaatgttcacagagtacttg

SEQ ID NO: 100603 - DNA, 20 bp, synthetic construct
  misc_feature 1..20: note = CRISPR gRNA sequence
  source 1..20: mol_type = other DNA
acagagtacttgaaaggtgc

SEQ ID NO: 100604 - DNA, 20 bp, synthetic construct
  misc_feature 1..20: note = CRISPR gRNA sequence
  source 1..20: mol_type = other DNA
gaaaggtgcaggcctgctct

SEQ ID NO: 100605 - DNA, 20 bp, synthetic construct
  misc_feature 1..20: note = CRISPR gRNA sequence
  source 1..20: mol_type = other DNA
aaaggtgcaggcctgctcta

SEQ ID NO: 100606 - DNA, 20 bp, synthetic construct
  misc_feature 1..20: note = CRISPR gRNA sequence
  source 1..20: mol_type = other DNA
ctctaggtgccgagaacacg

SEQ ID NO: 100607 - DNA, 20 bp, synthetic construct
  misc_feature 1..20: note = CRISPR gRNA sequence
  source 1..20: mol_type = other DNA
taggtgccgagaacacgaga

SEQ ID NO: 100608 - DNA, 20 bp, synthetic construct
  misc_feature 1..20: note = CRISPR gRNA sequence
  source 1..20: mol_type = other DNA
ggtgccgagaacacgagaca

SEQ ID NO: 100609 - DNA, 20 bp, synthetic construct
  misc_feature 1..20: note = CRISPR gRNA sequence
  source 1..20: mol_type = other DNA
ccagcctcacagagcagagc

SEQ ID NO: 100610 - DNA, 20 bp, synthetic construct
  misc_feature 1..20: note = CRISPR gRNA sequence
  source 1..20: mol_type = other DNA
acagagcagagctccccatg

SEQ ID NO: 100611 - DNA, 20 bp, synthetic construct
  misc_feature 1..20: note = CRISPR gRNA sequence
  source 1..20: mol_type = other DNA
cccatgcagggaaggcagac

SEQ ID NO: 100612 - DNA, 20 bp, synthetic construct
  misc_feature 1..20: note = CRISPR gRNA sequence
  source 1..20: mol_type = other DNA
agatgcagtgaactgcgctg

SEQ ID NO: 100613 - DNA, 20 bp, synthetic construct
  misc_feature 1..20: note = CRISPR gRNA sequence
  source 1..20: mol_type = other DNA
cgctgcgatggcagatgcac

SEQ ID NO: 100614 - DNA, 20 bp, synthetic construct
  misc_feature 1..20: note = CRISPR gRNA sequence
  source 1..20: mol_type = other DNA
cgatggcagatgcacaggtg

SEQ ID NO: 100615 - DNA, 20 bp, synthetic construct
  misc_feature 1..20: note = CRISPR gRNA sequence
  source 1..20: mol_type = other DNA
caagagccccatgtgggcaa

SEQ ID NO: 100616 - DNA, 20 bp, synthetic construct
  misc_feature 1..20: note = CRISPR gRNA sequence
  source 1..20: mol_type = other DNA
cctggaggaaggtgtctaag

SEQ ID NO: 100617 - DNA, 20 bp, synthetic construct
  misc_feature 1..20: note = CRISPR gRNA sequence
  source 1..20: mol_type = other DNA
ctggaggaaggtgtctaagc

SEQ ID NO: 100618 - DNA, 20 bp, synthetic construct
  misc_feature 1..20: note = CRISPR gRNA sequence
  source 1..20: mol_type = other DNA
gaggaaggtgtctaagcttg

SEQ ID NO: 100619 - DNA, 20 bp, synthetic construct
  misc_feature 1..20: note = CRISPR gRNA sequence
  source 1..20: mol_type = other DNA
agcttgagaccccagaaagt

SEQ ID NO: 100620 - DNA, 20 bp, synthetic construct
  misc_feature 1..20: note = CRISPR gRNA sequence
  source 1..20: mol_type = other DNA
gagaccccagaaagtgagat

SEQ ID NO: 100621 - DNA, 20 bp, synthetic construct
  misc_feature 1..20: note = CRISPR gRNA sequence
  source 1..20: mol_type = other DNA
agaccccagaaagtgagatg

SEQ ID NO: 100622 - DNA, 20 bp, synthetic construct
  misc_feature 1..20: note = CRISPR gRNA sequence
  source 1..20: mol_type = other DNA
aactggaggccagagagtac

SEQ ID NO: 100623 - DNA, 20 bp, synthetic construct
  misc_feature 1..20: note = CRISPR gRNA sequence
  source 1..20: mol_type = other DNA
gaggccagagagtacaaggc

SEQ ID NO: 100624 - DNA, 20 bp, synthetic construct
  misc_feature 1..20: note = CRISPR gRNA sequence
  source 1..20: mol_type = other DNA
tgagaatgaggaagaggtaa

SEQ ID NO: 100625 - DNA, 20 bp, synthetic construct
  misc_feature 1..20: note = CRISPR gRNA sequence
  source 1..20: mol_type = other DNA
gagaatgaggaagaggtaaa

SEQ ID NO: 100626 - DNA, 20 bp, synthetic construct
  misc_feature 1..20: note = CRISPR gRNA sequence
  source 1..20: mol_type = other DNA
agaatgaggaagaggtaaac

SEQ ID NO: 100627 - DNA, 20 bp, synthetic construct
  misc_feature 1..20: note = CRISPR gRNA sequence
  source 1..20: mol_type = other DNA
tggtttctcctgcccctacc

SEQ ID NO: 100628 - DNA, 20 bp, synthetic construct
  misc_feature 1..20: note = CRISPR gRNA sequence
  source 1..20: mol_type = other DNA
ggtttctcctgcccctaccc

SEQ ID NO: 100629 - DNA, 20 bp, synthetic construct
  misc_feature 1..20: note = CRISPR gRNA sequence
  source 1..20: mol_type = other DNA
gtttctcctgcccctaccca

SEQ ID NO: 100630 - DNA, 20 bp, synthetic construct
  misc_feature 1..20: note = CRISPR gRNA sequence
  source 1..20: mol_type = other DNA
ctcctgcccctacccacgac

SEQ ID NO: 100631 - DNA, 20 bp, synthetic construct
  misc_feature 1..20: note = CRISPR gRNA sequence
  source 1..20: mol_type = other DNA
tcctgcccctacccacgaca

SEQ ID NO: 100632 - DNA, 20 bp, synthetic construct
  misc_feature 1..20: note = CRISPR gRNA sequence
  source 1..20: mol_type = other DNA
ctgcccctacccacgacaga

SEQ ID NO: 100633 - DNA, 20 bp, synthetic construct
  misc_feature 1..20: note = CRISPR gRNA sequence
  source 1..20: mol_type = other DNA
cccctacccacgacagaatg

SEQ ID NO: 100634 - DNA, 20 bp, synthetic construct
  misc_feature 1..20: note = CRISPR gRNA sequence
  source 1..20: mol_type = other DNA
cccacgacagaatggaggga

SEQ ID NO: 100635 - DNA, 20 bp, synthetic construct
  misc_feature 1..20: note = CRISPR gRNA sequence
  source 1..20: mol_type = other DNA
ctgtacgctgtgcgcgggaa

SEQ ID NO: 100636 - DNA, 20 bp, synthetic construct
  misc_feature 1..20: note = CRISPR gRNA sequence
  source 1..20: mol_type = other DNA
tacgctgtgcgcgggaacca

SEQ ID NO: 100637 - DNA, 20 bp, synthetic construct
  misc_feature 1..20: note = CRISPR gRNA sequence
  source 1..20: mol_type = other DNA
tgcgcgggaaccacgtgaaa

SEQ ID NO: 100638 - DNA, 20 bp, synthetic construct
  misc_feature 1..20: note = CRISPR gRNA sequence
  source 1..20: mol_type = other DNA
aggccttgctgggtgagtgg

SEQ ID NO: 100639 - DNA, 20 bp, synthetic construct
  misc_feature 1..20: note = CRISPR gRNA sequence
  source 1..20: mol_type = other DNA
gctgggtgagtgggagtcgg

SEQ ID NO: 100640 - DNA, 20 bp, synthetic construct
  misc_feature 1..20: note = CRISPR gRNA sequence
  source 1..20: mol_type = other DNA
ctgggtgagtgggagtcggg

SEQ ID NO: 100641 - DNA, 20 bp, synthetic construct
  misc_feature 1..20: note = CRISPR gRNA sequence
  source 1..20: mol_type = other DNA
ggtgagtgggagtcgggagt

SEQ ID NO: 100642 - DNA, 20 bp, synthetic construct
  misc_feature 1..20: note = CRISPR gRNA sequence
  source 1..20: mol_type = other DNA
ggggccccagcactccagcg

SEQ ID NO: 100643 - DNA, 20 bp, synthetic construct
  misc_feature 1..20: note = CRISPR gRNA sequence
  source 1..20: mol_type = other DNA
cagcgggccctgcgggaatc

SEQ ID NO: 100644 - DNA, 20 bp, synthetic construct
  misc_feature 1..20: note = CRISPR gRNA sequence
  source 1..20: mol_type = other DNA
cgggaatcctgagggcaggg

SEQ ID NO: 100645 - DNA, 20 bp, synthetic construct
  misc_feature 1..20: note = CRISPR gRNA sequence
  source 1..20: mol_type = other DNA
agggcagggagacgcccaag

SEQ ID NO: 100646 - DNA, 20 bp, synthetic construct
  misc_feature 1..20: note = CRISPR gRNA sequence
  source 1..20: mol_type = other DNA
cttgaagagttcttggagca

SEQ ID NO: 100647 - DNA, 20 bp, synthetic construct
  misc_feature 1..20: note = CRISPR gRNA sequence
  source 1..20: mol_type = other DNA
gaagagttcttggagcaggt

SEQ ID NO: 100648 - DNA, 20 bp, synthetic construct
  misc_feature 1..20: note = CRISPR gRNA sequence
  source 1..20: mol_type = other DNA
aagagttcttggagcaggta

SEQ ID NO: 100649 - DNA, 20 bp, synthetic construct
  misc_feature 1..20: note = CRISPR gRNA sequence
  source 1..20: mol_type = other DNA
ttggagcaggtagtccctgc

SEQ ID NO: 100650 - DNA, 20 bp, synthetic construct
  misc_feature 1..20: note = CRISPR gRNA sequence
  source 1..20: mol_type = other DNA
ggagcaggtagtccctgcct

SEQ ID NO: 100651 - DNA, 20 bp, synthetic construct
  misc_feature 1..20: note = CRISPR gRNA sequence
  source 1..20: mol_type = other DNA
gagcaggtagtccctgcctg

SEQ ID NO: 100652 - DNA, 20 bp, synthetic construct
  misc_feature 1..20: note = CRISPR gRNA sequence
  source 1..20: mol_type = other DNA
cctgctcttctcggaggatg

SEQ ID NO: 100653 - DNA, 20 bp, synthetic construct
  misc_feature 1..20: note = CRISPR gRNA sequence
  source 1..20: mol_type = other DNA
ctcttctcggaggatggatc

SEQ ID NO: 100654 - DNA, 20 bp, synthetic construct
  misc_feature 1..20: note = CRISPR gRNA sequence
  source 1..20: mol_type = other DNA
ttctcggaggatggatcaga

SEQ ID NO: 100655 - DNA, 20 bp, synthetic construct
  misc_feature 1..20: note = CRISPR gRNA sequence
  source 1..20: mol_type = other DNA
ctcggaggatggatcagagg

SEQ ID NO: 100656 - DNA, 20 bp, synthetic construct
  misc_feature 1..20: note = CRISPR gRNA sequence
  source 1..20: mol_type = other DNA
tcggaggatggatcagaggg

SEQ ID NO: 100657 - DNA, 20 bp, synthetic construct
  misc_feature 1..20: note = CRISPR gRNA sequence
  source 1..20: mol_type = other DNA
ggaggatggatcagagggga

SEQ ID NO: 100658 - DNA, 20 bp, synthetic construct
  misc_feature 1..20: note = CRISPR gRNA sequence
  source 1..20: mol_type = other DNA
ggtttaggatctggccaaga

SEQ ID NO: 100659 - DNA, 20 bp, synthetic construct
  misc_feature 1..20: note = CRISPR gRNA sequence
  source 1..20: mol_type = other DNA
aggatctggccaagaggcta

SEQ ID NO: 100660 - DNA, 20 bp, synthetic construct
  misc_feature 1..20: note = CRISPR gRNA sequence
  source 1..20: mol_type = other DNA
ggatctggccaagaggctaa

SEQ ID NO: 100661 - DNA, 20 bp, synthetic construct
  misc_feature 1..20: note = CRISPR gRNA sequence
  source 1..20: mol_type = other DNA
gccaagaggctaagcacctc

SEQ ID NO: 100662 - DNA, 20 bp, synthetic construct
  misc_feature 1..20: note = CRISPR gRNA sequence
  source 1..20: mol_type = other DNA
agcacctccatcctccatgg

SEQ ID NO: 100663 - DNA, 20 bp, synthetic construct
  misc_feature 1..20: note = CRISPR gRNA sequence
  source 1..20: mol_type = other DNA
catcctccatggttcagaga

SEQ ID NO: 100664 - DNA, 20 bp, synthetic construct
  misc_feature 1..20: note = CRISPR gRNA sequence
  source 1..20: mol_type = other DNA
catggttcagagacccttca

SEQ ID NO: 100665 - DNA, 20 bp, synthetic construct
  misc_feature 1..20: note = CRISPR gRNA sequence
  source 1..20: mol_type = other DNA
agagacccttcagccacgtt

SEQ ID NO: 100666 - DNA, 20 bp, synthetic construct
  misc_feature 1..20: note = CRISPR gRNA sequence
  source 1..20: mol_type = other DNA
cagccacgttcttcagtgga

SEQ ID NO: 100667 - DNA, 20 bp, synthetic construct
  misc_feature 1..20: note = CRISPR gRNA sequence
  source 1..20: mol_type = other DNA
agccacgttcttcagtggag

SEQ ID NO: 100668 - DNA, 20 bp, synthetic construct
  misc_feature 1..20: note = CRISPR gRNA sequence
  source 1..20: mol_type = other DNA
ttcagtggagaccaagatag

SEQ ID NO: 100669 - DNA, 20 bp, synthetic construct
  misc_feature 1..20: note = CRISPR gRNA sequence
  source 1..20: mol_type = other DNA
cagtggagaccaagatagca

SEQ ID NO: 100670 - DNA, 20 bp, synthetic construct
  misc_feature 1..20: note = CRISPR gRNA sequence
  source 1..20: mol_type = other DNA
agtggagaccaagatagcag

SEQ ID NO: 100671 - DNA, 20 bp, synthetic construct
  misc_feature 1..20: note = CRISPR gRNA sequence
  source 1..20: mol_type = other DNA
gacccttgtcaaaggccaca

SEQ ID NO: 100672 - DNA, 20 bp, synthetic construct
  misc_feature 1..20: note = CRISPR gRNA sequence
  source 1..20: mol_type = other DNA
gtcaaaggccacatgggcaa

SEQ ID NO: 100673 - DNA, 20 bp, synthetic construct
  misc_feature 1..20: note = CRISPR gRNA sequence
  source 1..20: mol_type = other DNA
tcaaaggccacatgggcaac

SEQ ID NO: 100674 - DNA, 20 bp, synthetic construct
  misc_feature 1..20: note = CRISPR gRNA sequence
  source 1..20: mol_type = other DNA
cattgtggggaatgaggggt

SEQ ID NO: 100675 - DNA, 20 bp, synthetic construct
  misc_feature 1..20: note = CRISPR gRNA sequence
  source 1..20: mol_type = other DNA
tggggaatgaggggtgccat

SEQ ID NO: 100676 - DNA, 20 bp, synthetic construct
  misc_feature 1..20: note = CRISPR gRNA sequence
  source 1..20: mol_type = other DNA
ccaggtccccagaccccatt

SEQ ID NO: 100677 - DNA, 20 bp, synthetic construct
  misc_feature 1..20: note = CRISPR gRNA sequence
  source 1..20: mol_type = other DNA
tggactcccaggccccaccc

SEQ ID NO: 100678 - DNA, 20 bp, synthetic construct
  misc_feature 1..20: note = CRISPR gRNA sequence
  source 1..20: mol_type = other DNA
gactcccaggccccaccctc

SEQ ID NO: 100679 - DNA, 20 bp, synthetic construct
  misc_feature 1..20: note = CRISPR gRNA sequence
  source 1..20: mol_type = other DNA
ccaggccccaccctccagcg

SEQ ID NO: 100680 - DNA, 20 bp, synthetic construct
  misc_feature 1..20: note = CRISPR gRNA sequence
  source 1..20: mol_type = other DNA
cagcgccctcccctctcctt

SEQ ID NO: 100681 - DNA, 20 bp, synthetic construct
  misc_feature 1..20: note = CRISPR gRNA sequence
  source 1..20: mol_type = other DNA
ccctctcctttgcagcccga

SEQ ID NO: 100682 - DNA, 20 bp, synthetic construct
  misc_feature 1..20: note = CRISPR gRNA sequence
  source 1..20: mol_type = other DNA
tcctttgcagcccgaggcgc

SEQ ID NO: 100683 - DNA, 20 bp, synthetic construct
  misc_feature 1..20: note = CRISPR gRNA sequence
  source 1..20: mol_type = other DNA
ctttgcagcccgaggcgctg

SEQ ID NO: 100684 - DNA, 20 bp, synthetic construct
  misc_feature 1..20: note = CRISPR gRNA sequence
  source 1..20: mol_type = other DNA
tgcagcccgaggcgctgacc

SEQ ID NO: 100685 - DNA, 20 bp, synthetic construct
  misc_feature 1..20: note = CRISPR gRNA sequence
  source 1..20: mol_type = other DNA
gcagcccgaggcgctgacct

SEQ ID NO: 100686 - DNA, 20 bp, synthetic construct
  misc_feature 1..20: note = CRISPR gRNA sequence
  source 1..20: mol_type = other DNA
cagcccgaggcgctgacctc

SEQ ID NO: 100687 - DNA, 20 bp, synthetic construct
  misc_feature 1..20: note = CRISPR gRNA sequence
  source 1..20: mol_type = other DNA
acctcaccaccgaagccgac

SEQ ID NO: 100688 - DNA, 20 bp, synthetic construct
  misc_feature 1..20: note = CRISPR gRNA sequence
  source 1..20: mol_type = other DNA
accaccgaagccgactctgg

SEQ ID NO: 100689 - DNA, 20 bp, synthetic construct
  misc_feature 1..20: note = CRISPR gRNA sequence
  source 1..20: mol_type = other DNA
tggctacaccccgatggacc

SEQ ID NO: 100690 - DNA, 20 bp, synthetic construct
  misc_feature 1..20: note = CRISPR gRNA sequence
  source 1..20: mol_type = other DNA
gctacaccccgatggacctt

SEQ ID NO: 100691 - DNA, 20 bp, synthetic construct
  misc_feature 1..20: note = CRISPR gRNA sequence
  source 1..20: mol_type = other DNA
caccccgatggaccttgccg

SEQ ID NO: 100692 - DNA, 20 bp, synthetic construct
  misc_feature 1..20: note = CRISPR gRNA sequence
  source 1..20: mol_type = other DNA
gccgtggccctgggataccg

SEQ ID NO: 100693 - DNA, 20 bp, synthetic construct
  misc_feature 1..20: note = CRISPR gRNA sequence
  source 1..20: mol_type = other DNA
ccgtggccctgggataccgg

SEQ ID NO: 100694 - DNA, 20 bp, synthetic construct
  misc_feature 1..20: note = CRISPR gRNA sequence
  source 1..20: mol_type = other DNA
ggataccggaaaggtcagcc

SEQ ID NO: 100695 - DNA, 20 bp, synthetic construct
  misc_feature 1..20: note = CRISPR gRNA sequence
  source 1..20: mol_type = other DNA
agacacacagagcaggggtg

SEQ ID NO: 100696 - DNA, 20 bp, synthetic construct
  misc_feature 1..20: note = CRISPR gRNA sequence
  source 1..20: mol_type = other DNA
ccataggcagggtgaccata

SEQ ID NO: 100697 - DNA, 20 bp, synthetic construct
  misc_feature 1..20: note = CRISPR gRNA sequence
  source 1..20: mol_type = other DNA
cataggcagggtgaccataa

SEQ ID NO: 100698 - DNA, 20 bp, synthetic construct
  misc_feature 1..20: note = CRISPR gRNA sequence
  source 1..20: mol_type = other DNA
cagtggtcatacgccggcag

SEQ ID NO: 100699 - DNA, 20 bp, synthetic construct
  misc_feature 1..20: note = CRISPR gRNA sequence
  source 1..20: mol_type = other DNA
agtggtcatacgccggcagc

SEQ ID NO: 100700 - DNA, 20 bp, synthetic construct
  misc_feature 1..20: note = CRISPR gRNA sequence
  source 1..20: mol_type = other DNA
acaggtgttgagcactgctg

SEQ ID NO: 100701 - DNA, 20 bp, synthetic construct
  misc_feature 1..20: note = CRISPR gRNA sequence
  source 1..20: mol_type = other DNA
agcactgctgtgtatcccgc

SEQ ID NO: 100702 - DNA, 20 bp, synthetic construct
  misc_feature 1..20: note = CRISPR gRNA sequence
  source 1..20: mol_type = other DNA
ctgtgtatcccgcctgggaa

SEQ ID NO: 100703 - DNA, 20 bp, synthetic construct
  misc_feature 1..20: note = CRISPR gRNA sequence
  source 1..20: mol_type = other DNA
tgtatcccgcctgggaacat

SEQ ID NO: 100704 - DNA, 20 bp, synthetic construct
  misc_feature 1..20: note = CRISPR gRNA sequence
  source 1..20: mol_type = other DNA
ggaacatcccagtcctggct

SEQ ID NO: 100705 - DNA, 20 bp, synthetic construct
  misc_feature 1..20: note = CRISPR gRNA sequence
  source 1..20: mol_type = other DNA
gctcctggggctccacatgt

SEQ ID NO: 100706 - DNA, 20 bp, synthetic construct
  misc_feature 1..20: note = CRISPR gRNA sequence
  source 1..20: mol_type = other DNA
ctggggctccacatgtgctg

SEQ ID NO: 100707 - DNA, 20 bp, synthetic construct
  misc_feature 1..20: note = CRISPR gRNA sequence
  source 1..20: mol_type = other DNA
gggctccacatgtgctgggg

SEQ ID NO: 100708 - DNA, 20 bp, synthetic construct
  misc_feature 1..20: note = CRISPR gRNA sequence
  source 1..20: mol_type = other DNA
cacatgtgctggggtaggga

SEQ ID NO: 100709 - DNA, 20 bp, synthetic construct
  misc_feature 1..20: note = CRISPR gRNA sequence
  source 1..20: mol_type = other DNA
gggtagggaggacaatgggt

SEQ ID NO: 100710 - DNA, 20 bp, synthetic construct
  misc_feature 1..20: note = CRISPR gRNA sequence
  source 1..20: mol_type = other DNA
tggccatgatgggggacaca

SEQ ID NO: 100711 - DNA, 20 bp, synthetic construct
  misc_feature 1..20: note = CRISPR gRNA sequence
  source 1..20: mol_type = other DNA
tcatcaaagagccccaaagt

SEQ ID NO: 100712 - DNA, 20 bp, synthetic construct
  misc_feature 1..20: note = CRISPR gRNA sequence
  source 1..20: mol_type = other DNA
atcaaagagccccaaagtgg

SEQ ID NO: 100713 - DNA, 20 bp, synthetic construct
  misc_feature 1..20: note = CRISPR gRNA sequence
  source 1..20: mol_type = other DNA
cctggaggaaggtgtcttaa

SEQ ID NO: 100714 - DNA, 20 bp, synthetic construct
  misc_feature 1..20: note = CRISPR gRNA sequence
  source 1..20: mol_type = other DNA
ctggaggaaggtgtcttaag

SEQ ID NO: 100715 - DNA, 20 bp, synthetic construct
  misc_feature 1..20: note = CRISPR gRNA sequence
  source 1..20: mol_type = other DNA
gaggaaggtgtcttaaggtt

SEQ ID NO: 100716 - DNA, 20 bp, synthetic construct
  misc_feature 1..20: note = CRISPR gRNA sequence
  source 1..20: mol_type = other DNA
aaggttgagaccccgagaag

SEQ ID NO: 100717 - DNA, 20 bp, synthetic construct
  misc_feature 1..20: note = CRISPR gRNA sequence
  source 1..20: mol_type = other DNA
aggttgagaccccgagaagt

SEQ ID NO: 100718 - DNA, 20 bp, synthetic construct
  misc_feature 1..20: note = CRISPR gRNA sequence
  source 1..20: mol_type = other DNA
agaccccgagaagtgaggtg

SEQ ID NO: 100719 - DNA, 20 bp, synthetic construct
  misc_feature 1..20: note = CRISPR gRNA sequence
  source 1..20: mol_type = other DNA
ggatggggaggtcagggaag

SEQ ID NO: 100720 - DNA, 20 bp, synthetic construct
  misc_feature 1..20: note = CRISPR gRNA sequence
  source 1..20: mol_type = other DNA
tgggggacctgaagggaggg

SEQ ID NO: 100721 - DNA, 20 bp, synthetic construct
  misc_feature 1..20: note = CRISPR gRNA sequence
  source 1..20: mol_type = other DNA
ggggacctgaagggagggag

SEQ ID NO: 100722 - DNA, 20 bp, synthetic construct
  misc_feature 1..20: note = CRISPR gRNA sequence
  source 1..20: mol_type = other DNA
aagggagggagaatggcatc

SEQ ID NO: 100723 - DNA, 20 bp, synthetic construct
  misc_feature 1..20: note = CRISPR gRNA sequence
  source 1..20: mol_type = other DNA
cggaggcctggcagtgagga

SEQ ID NO: 100724 - DNA, 20 bp, synthetic construct
  misc_feature 1..20: note = CRISPR gRNA sequence
  source 1..20: mol_type = other DNA
gcagtgaggacaccaagggg

SEQ ID NO: 100725 - DNA, 20 bp, synthetic construct
  misc_feature 1..20: note = CRISPR gRNA sequence
  source 1..20: mol_type = other DNA
tccgtggcgggcagtgggtt

SEQ ID NO: 100726 - DNA, 20 bp, synthetic construct
  misc_feature 1..20: note = CRISPR gRNA sequence
  source 1..20: mol_type = other DNA
cgtggcgggcagtgggtttg

SEQ ID NO: 100727 - DNA, 20 bp, synthetic construct
  misc_feature 1..20: note = CRISPR gRNA sequence
  source 1..20: mol_type = other DNA
gaacaggggccataggcaga

SEQ ID NO: 100728 - DNA, 20 bp, synthetic construct
  misc_feature 1..20: note = CRISPR gRNA sequence
  source 1..20: mol_type = other DNA
aacaggggccataggcagac

SEQ ID NO: 100729 - DNA, 20 bp, synthetic construct
  misc_feature 1..20: note = CRISPR gRNA sequence
  source 1..20: mol_type = other DNA
gactccattttctctgtcac

SEQ ID NO: 100730 - DNA, 20 bp, synthetic construct
  misc_feature 1..20: note = CRISPR gRNA sequence
  source 1..20: mol_type = other DNA
actccattttctctgtcaca

SEQ ID NO: 100731 - DNA, 20 bp, synthetic construct
  misc_feature 1..20: note = CRISPR gRNA sequence
  source 1..20: mol_type = other DNA
cattttctctgtcacaatgg

SEQ ID NO: 100732 - DNA, 20 bp, synthetic construct
  misc_feature 1..20: note = CRISPR gRNA sequence
  source 1..20: mol_type = other DNA
tctctgtcacaatgggaccc

SEQ ID NO: 100733 - DNA, 20 bp, synthetic construct
  misc_feature 1..20: note = CRISPR gRNA sequence
  source 1..20: mol_type = other DNA
ctctgtcacaatgggacccc

SEQ ID NO: 100734 - DNA, 20 bp, synthetic construct
  misc_feature 1..20: note = CRISPR gRNA sequence
  source 1..20: mol_type = other DNA
tctgtcacaatgggacccca

SEQ ID NO: 100735 - DNA, 20 bp, synthetic construct
  misc_feature 1..20: note = CRISPR gRNA sequence
  source 1..20: mol_type = other DNA
tgtcacaatgggaccccaac

SEQ ID NO: 100736 - DNA, 20 bp, synthetic construct
  misc_feature 1..20: note = CRISPR gRNA sequence
  source 1..20: mol_type = other DNA
tcacaatgggaccccaactt

SEQ ID NO: 100737 - DNA, 20 bp, synthetic construct
  misc_feature 1..20: note = CRISPR gRNA sequence
  source 1..20: mol_type = other DNA
ccccatccataaaatgggga

SEQ ID NO: 100738 - DNA, 20 bp, synthetic construct
  misc_feature 1..20: note = CRISPR gRNA sequence
  source 1..20: mol_type = other DNA
cccatccataaaatggggag

SEQ ID NO: 100739 - DNA, 20 bp, synthetic construct
  misc_feature 1..20: note = CRISPR gRNA sequence
  source 1..20: mol_type = other DNA
aaccgaccccctggggtcat

SEQ ID NO: 100740 - DNA, 20 bp, synthetic construct
  misc_feature 1..20: note = CRISPR gRNA sequence
  source 1..20: mol_type = other DNA
gggtcatggtagagatgggg

SEQ ID NO: 100741 - DNA, 20 bp, synthetic construct
  misc_feature 1..20: note = CRISPR gRNA sequence
  source 1..20: mol_type = other DNA
aggaaatatccccctccttc

SEQ ID NO: 100742 - DNA, 20 bp, synthetic construct
  misc_feature 1..20: note = CRISPR gRNA sequence
  source 1..20: mol_type = other DNA
ggaaatatccccctccttcc

SEQ ID NO: 100743 - DNA, 20 bp, synthetic construct
  misc_feature 1..20: note = CRISPR gRNA sequence
  source 1..20: mol_type = other DNA
cttccttcagagttttactg

SEQ ID NO: 100744 - DNA, 20 bp, synthetic construct
  misc_feature 1..20: note = CRISPR gRNA sequence
  source 1..20: mol_type = other DNA
ccttcagagttttactgtgt

SEQ ID NO: 100745 - DNA, 20 bp, synthetic construct
  misc_feature 1..20: note = CRISPR gRNA sequence
  source 1..20: mol_type = other DNA
cttcagagttttactgtgtt

SEQ ID NO: 100746 - DNA, 20 bp, synthetic construct
  misc_feature 1..20: note = CRISPR gRNA sequence
  source 1..20: mol_type = other DNA
cagagttttactgtgtttgg

SEQ ID NO: 100747 - DNA, 20 bp, synthetic construct
  misc_feature 1..20: note = CRISPR gRNA sequence
  source 1..20: mol_type = other DNA
agagttttactgtgtttggg

SEQ ID NO: 100748 - DNA, 20 bp, synthetic construct
  misc_feature 1..20: note = CRISPR gRNA sequence
  source 1..20: mol_type = other DNA
tactgtgtttgggacagaaa

SEQ ID NO: 100749 - DNA, 20 bp, synthetic construct
  misc_feature 1..20: note = CRISPR gRNA sequence
  source 1..20: mol_type = other DNA
actgtgtttgggacagaaat

SEQ ID NO: 100750 - DNA, 20 bp, synthetic construct
  misc_feature 1..20: note = CRISPR gRNA sequence
  source 1..20: mol_type = other DNA
ctgtgtttgggacagaaatc

SEQ ID NO: 100751 - DNA, 20 bp, synthetic construct
  misc_feature 1..20: note = CRISPR gRNA sequence
  source 1..20: mol_type = other DNA
tgtttgggacagaaatcatt

SEQ ID NO: 100752 - DNA, 20 bp, synthetic construct
  misc_feature 1..20: note = CRISPR gRNA sequence
  source 1..20: mol_type = other DNA
gggacagaaatcattcctct

SEQ ID NO: 100753 - DNA, 20 bp, synthetic construct
  misc_feature 1..20: note = CRISPR gRNA sequence
  source 1..20: mol_type = other DNA
ggacagaaatcattcctctt

SEQ ID NO: 100754 - DNA, 20 bp, synthetic construct
  misc_feature 1..20: note = CRISPR gRNA sequence
  source 1..20: mol_type = other DNA
ctcttccctcctcatgtttt

SEQ ID NO: 100755 - DNA, 20 bp, synthetic construct
  misc_feature 1..20: note = CRISPR gRNA sequence
  source 1..20: mol_type = other DNA
ttccctcctcatgttttcgg

SEQ ID NO: 100756 - DNA, 20 bp, synthetic construct
  misc_feature 1..20: note = CRISPR gRNA sequence
  source 1..20: mol_type = other DNA
ccctcctcatgttttcgggg

SEQ ID NO: 100757 - DNA, 20 bp, synthetic construct
  misc_feature 1..20: note = CRISPR gRNA sequence
  source 1..20: mol_type = other DNA
cctcctcatgttttcggggg

SEQ ID NO: 100758 - DNA, 20 bp, synthetic construct
  misc_feature 1..20: note = CRISPR gRNA sequence
  source 1..20: mol_type = other DNA
ctcatgttttcggggggttt

SEQ ID NO: 100759 - DNA, 20 bp, synthetic construct
  misc_feature 1..20: note = CRISPR gRNA sequence
  source 1..20: mol_type = other DNA
atgttttcggggggtttgtt

SEQ ID NO: 100760 - DNA, 20 bp, synthetic construct
  misc_feature 1..20: note = CRISPR gRNA sequence
  source 1..20: mol_type = other DNA
tcggggggtttgtttttttg

SEQ ID NO: 100761 - DNA, 20 bp, synthetic construct
  misc_feature 1..20: note = CRISPR gRNA sequence
  source 1..20: mol_type = other DNA
cggggggtttgtttttttgt

SEQ ID NO: 100762 - DNA, 20 bp, synthetic construct
  misc_feature 1..20: note = CRISPR gRNA sequence
  source 1..20: mol_type = other DNA
ggggggtttgtttttttgtt

SEQ ID NO: 100763 - DNA, 20 bp, synthetic construct
  misc_feature 1..20: note = CRISPR gRNA sequence
  source 1..20: mol_type = other DNA
gtttttttgttcgaggcaga

SEQ ID NO: 100764 - DNA, 20 bp, synthetic construct
  misc_feature 1..20: note = CRISPR gRNA sequence
  source 1..20: mol_type = other DNA
tttttttgttcgaggcagaa

SEQ ID NO: 100765 - DNA, 20 bp, synthetic construct
  misc_feature 1..20: note = CRISPR gRNA sequence
  source 1..20: mol_type = other DNA
ttttgttcgaggcagaaagt

SEQ ID NO: 100766 - DNA, 20 bp, synthetic construct
  misc_feature 1..20: note = CRISPR gRNA sequence
  source 1..20: mol_type = other DNA
tttgttcgaggcagaaagtc

SEQ ID NO: 100767 - DNA, 20 bp, synthetic construct
  misc_feature 1..20: note = CRISPR gRNA sequence
  source 1..20: mol_type = other DNA
ttgttcgaggcagaaagtct

SEQ ID NO: 100768 - DNA, 20 bp, synthetic construct
  misc_feature 1..20: note = CRISPR gRNA sequence
  source 1..20: mol_type = other DNA
tgttcgaggcagaaagtctt

SEQ ID NO: 100769 - DNA, 20 bp, synthetic construct
  misc_feature 1..20: note = CRISPR gRNA sequence
  source 1..20: mol_type = other DNA
gttcgaggcagaaagtcttg

SEQ ID NO: 100770 - DNA, 20 bp, synthetic construct
  misc_feature 1..20: note = CRISPR gRNA sequence
  source 1..20: mol_type = other DNA
ttcgaggcagaaagtcttgc

SEQ ID NO: 100771 - DNA, 20 bp, synthetic construct
  misc_feature 1..20: note = CRISPR gRNA sequence
  source 1..20: mol_type = other DNA
gaggcagaaagtcttgctct

SEQ ID NO: 100772 - DNA, 20 bp, synthetic construct
  misc_feature 1..20: note = CRISPR gRNA sequence
  source 1..20: mol_type = other DNA
gctctatcacccaggctgga

SEQ ID NO: 100773 - DNA, 20 bp, synthetic construct
  misc_feature 1..20: note = CRISPR gRNA sequence
  source 1..20: mol_type = other DNA
ctctatcacccaggctggaa

SEQ ID NO: 100774 - DNA, 20 bp, synthetic construct
  misc_feature 1..20: note = CRISPR gRNA sequence
  source 1..20: mol_type = other DNA
tatcacccaggctggaatga

SEQ ID NO: 100775 - DNA, 20 bp, synthetic construct
  misc_feature 1..20: note = CRISPR gRNA sequence
  source 1..20: mol_type = other DNA
tcacccaggctggaatgaag

SEQ ID NO: 100776 - DNA, 20 bp, synthetic construct
  misc_feature 1..20: note = CRISPR gRNA sequence
  source 1..20: mol_type = other DNA
gaatgaagtggtgcaggcac

SEQ ID NO: 100777 - DNA, 20 bp, synthetic construct
  misc_feature 1..20: note = CRISPR gRNA sequence
  source 1..20: mol_type = other DNA
actgcagcctcgatctccca

SEQ ID NO: 100778 - DNA, 20 bp, synthetic construct
  misc_feature 1..20: note = CRISPR gRNA sequence
  source 1..20: mol_type = other DNA
ctgcagcctcgatctcccag

SEQ ID NO: 100779 - DNA, 20 bp, synthetic construct
  misc_feature 1..20: note = CRISPR gRNA sequence
  source 1..20: mol_type = other DNA
cagcctcgatctcccaggct

SEQ ID NO: 100780 - DNA, 20 bp, synthetic construct
  misc_feature 1..20: note = CRISPR gRNA sequence
  source 1..20: mol_type = other DNA
gatctcccaggctcaagtga

SEQ ID NO: 100781 - DNA, 20 bp, synthetic construct
  misc_feature 1..20: note = CRISPR gRNA sequence
  source 1..20: mol_type = other DNA
ccaggctcaagtgatcctcc

SEQ ID NO: 100782 - DNA, 20 bp, synthetic construct
  misc_feature 1..20: note = CRISPR gRNA sequence
  source 1..20: mol_type = other DNA
aagtgatcctcccaccacag

SEQ ID NO: 100783 - DNA, 20 bp, synthetic construct
  misc_feature 1..20: note = CRISPR gRNA sequence
  source 1..20: mol_type = other DNA
ccaccacagcctcccgagta

SEQ ID NO: 100784 - DNA, 20 bp, synthetic construct
  misc_feature 1..20: note = CRISPR gRNA sequence
  source 1..20: mol_type = other DNA
ccgagtagctgggaccacag

SEQ ID NO: 100785 - DNA, 20 bp, synthetic construct
  misc_feature 1..20: note = CRISPR gRNA sequence
  source 1..20: mol_type = other DNA
ggaccacaggcattcgtcac

SEQ ID NO: 100786 - DNA, 20 bp, synthetic construct
  misc_feature 1..20: note = CRISPR gRNA sequence
  source 1..20: mol_type = other DNA
gtcaccatgcctggctaatt

SEQ ID NO: 100787 - DNA, 20 bp, synthetic construct
  misc_feature 1..20: note = CRISPR gRNA sequence
  source 1..20: mol_type = other DNA
gctaattttttgttgttgct

SEQ ID NO: 100788 - DNA, 20 bp, synthetic construct
  misc_feature 1..20: note = CRISPR gRNA sequence
  source 1..20: mol_type = other DNA
attttttgttgttgcttttt

SEQ ID NO: 100789 - DNA, 20 bp, synthetic construct
  misc_feature 1..20: note = CRISPR gRNA sequence
  source 1..20: mol_type = other DNA
tttgttgttgcttttttttt

SEQ ID NO: 100790 - DNA, 20 bp, synthetic construct
  misc_feature 1..20: note = CRISPR gRNA sequence
  source 1..20: mol_type = other DNA
ttgttgttgctttttttttt

SEQ ID NO: 100791 - DNA, 20 bp, synthetic construct
  misc_feature 1..20: note = CRISPR gRNA sequence
  source 1..20: mol_type = other DNA
tgttgttgcttttttttttt

SEQ ID NO: 100792 - DNA, 20 bp, synthetic construct
  misc_feature 1..20: note = CRISPR gRNA sequence
  source 1..20: mol_type = other DNA
gttgttgctttttttttttt

SEQ ID NO: 100793 - DNA, 20 bp, synthetic construct
  misc_feature 1..20: note = CRISPR gRNA sequence
  source 1..20: mol_type = other DNA
ttgttgcttttttttttttt

SEQ ID NO: 100794 - DNA, 20 bp, synthetic construct
  misc_feature 1..20: note = CRISPR gRNA sequence
  source 1..20: mol_type = other DNA
ttgctttttttttttttttt

SEQ ID NO: 100795 - DNA, 20 bp, synthetic construct
  misc_feature 1..20: note = CRISPR gRNA sequence
  source 1..20: mol_type = other DNA
cttttttttttttttttttt

SEQ ID NO: 100796 - DNA, 20 bp, synthetic construct
  misc_feature 1..20: note = CRISPR gRNA sequence
  source 1..20: mol_type = other DNA
tttttttttttttttttgga

SEQ ID NO: 100797 - DNA, 20 bp, synthetic construct
  misc_feature 1..20: note = CRISPR gRNA sequence
  source 1..20: mol_type = other DNA
ttttttttttttttttggac

SEQ ID NO: 100798 - DNA, 20 bp, synthetic construct
  misc_feature 1..20: note = CRISPR gRNA sequence
  source 1..20: mol_type = other DNA
tttttttttttttttggaca

SEQ ID NO: 100799 - DNA, 20 bp, synthetic construct
  misc_feature 1..20: note = CRISPR gRNA sequence
  source 1..20: mol_type = other DNA
ttttttttttttttggacat

SEQ ID NO: 100800 - DNA, 20 bp, synthetic construct
  misc_feature 1..20: note = CRISPR gRNA sequence
  source 1..20: mol_type = other DNA
tttttttttttttggacatg

SEQ ID NO: 100801 - DNA, 20 bp, synthetic construct
  misc_feature 1..20: note = CRISPR gRNA sequence
  source 1..20: mol_type = other DNA
ttttttttttttggacatgg

SEQ ID NO: 100802 - DNA, 20 bp, synthetic construct
  misc_feature 1..20: note = CRISPR gRNA sequence
  source 1..20: mol_type = other DNA
tttttttttttggacatgga

SEQ ID NO: 100803 - DNA, 20 bp, synthetic construct
  misc_feature 1..20: note = CRISPR gRNA sequence
  source 1..20: mol_type = other DNA
ttttttttttggacatggag

SEQ ID NO: 100804 - DNA, 20 bp, synthetic construct
  misc_feature 1..20: note = CRISPR gRNA sequence
  source 1..20: mol_type = other DNA
tttttttttggacatggagt

SEQ ID NO: 100805 - DNA, 20 bp, synthetic construct
  misc_feature 1..20: note = CRISPR gRNA sequence
  source 1..20: mol_type = other DNA
ttttttttggacatggagtc

SEQ ID NO: 100806 - DNA, 20 bp, synthetic construct
  misc_feature 1..20: note = CRISPR gRNA sequence
  source 1..20: mol_type = other DNA
tttttttggacatggagtct

SEQ ID NO: 100807 - DNA, 20 bp, synthetic construct
  misc_feature 1..20: note = CRISPR gRNA sequence
  source 1..20: mol_type = other DNA
ttttttggacatggagtctc

SEQ ID NO: 100808 - DNA, 20 bp, synthetic construct
  misc_feature 1..20: note = CRISPR gRNA sequence
  source 1..20: mol_type = other DNA
tttttggacatggagtctcg

SEQ ID NO: 100809 - DNA, 20 bp, synthetic construct
  misc_feature 1..20: note = CRISPR gRNA sequence
  source 1..20: mol_type = other DNA
ttttggacatggagtctcgc

SEQ ID NO: 100810 - DNA, 20 bp, synthetic construct
  misc_feature 1..20: note = CRISPR gRNA sequence
  source 1..20: mol_type = other DNA
tttggacatggagtctcgcg

SEQ ID NO: 100811 - DNA, 20 bp, synthetic construct
  misc_feature 1..20: note = CRISPR gRNA sequence
  source 1..20: mol_type = other DNA
ttggacatggagtctcgcgc

SEQ ID NO: 100812 - DNA, 20 bp, synthetic construct
  misc_feature 1..20: note = CRISPR gRNA sequence
  source 1..20: mol_type = other DNA
tggacatggagtctcgcgct

SEQ ID NO: 100813 - DNA, 20 bp, synthetic construct
  misc_feature 1..20: note = CRISPR gRNA sequence
  source 1..20: mol_type = other DNA
ggacatggagtctcgcgctg

SEQ ID NO: 100814 - DNA, 20 bp, synthetic construct
  misc_feature 1..20: note = CRISPR gRNA sequence
  source 1..20: mol_type = other DNA
gacatggagtctcgcgctgt

SEQ ID NO: 100815 - DNA, 20 bp, synthetic construct
  misc_feature 1..20: note = CRISPR gRNA sequence
  source 1..20: mol_type = other DNA
gcgctgtcacccaggctgga

SEQ ID NO: 100816 - DNA, 20 bp, synthetic construct
  misc_feature 1..20: note = CRISPR gRNA sequence
  source 1..20: mol_type = other DNA
tcacccaggctggagtgcaa

SEQ ID NO: 100817 - DNA, 20 bp, synthetic construct
  misc_feature 1..20: note = CRISPR gRNA sequence
  source 1..20: mol_type = other DNA
gagtgcaatggcgccatctc

SEQ ID NO: 100818 - DNA, 20 bp, synthetic construct
  misc_feature 1..20: note = CRISPR gRNA sequence
  source 1..20: mol_type = other DNA
ggctcactgcaacttccacc

SEQ ID NO: 100819 - DNA, 20 bp, synthetic construct
  misc_feature 1..20: note = CRISPR gRNA sequence
  source 1..20: mol_type = other DNA
actgcaacttccacctccca

SEQ ID NO: 100820 - DNA, 20 bp, synthetic construct
  misc_feature 1..20: note = CRISPR gRNA sequence
  source 1..20: mol_type = other DNA
caacttccacctcccaggtt

SEQ ID NO: 100821 - DNA, 20 bp, synthetic construct
  misc_feature 1..20: note = CRISPR gRNA sequence
  source 1..20: mol_type = other DNA
ccacctcccaggttcaagcg

SEQ ID NO: 100822 - DNA, 20 bp, synthetic construct
  misc_feature 1..20: note = CRISPR gRNA sequence
  source 1..20: mol_type = other DNA
cacctcccaggttcaagcga

SEQ ID NO: 100823 - DNA, 20 bp, synthetic construct
  misc_feature 1..20: note = CRISPR gRNA sequence
  source 1..20: mol_type = other DNA
ccaggttcaagcgattctcc

SEQ ID NO: 100824 - DNA, 20 bp, synthetic construct
  misc_feature 1..20: note = CRISPR gRNA sequence
  source 1..20: mol_type = other DNA
aagcgattctcctgcctcag

SEQ ID NO: 100825 - DNA, 20 bp, synthetic construct
  misc_feature 1..20: note = CRISPR gRNA sequence
  source 1..20: mol_type = other DNA
tcctgcctcagcctcctgag

SEQ ID NO: 100826 - DNA, 20 bp, synthetic construct
  misc_feature 1..20: note = CRISPR gRNA sequence
  source 1..20: mol_type = other DNA
ctgcctcagcctcctgagta

SEQ ID NO: 100827 - DNA, 20 bp, synthetic construct
  misc_feature 1..20: note = CRISPR gRNA sequence
  source 1..20: mol_type = other DNA
cctcagcctcctgagtagct

SEQ ID NO: 100828 - DNA, 20 bp, synthetic construct
  misc_feature 1..20: note = CRISPR gRNA sequence
  source 1..20: mol_type = other DNA
agcctcctgagtagctggga

SEQ ID NO: 100829 - DNA, 20 bp, synthetic construct
  misc_feature 1..20: note = CRISPR gRNA sequence
  source 1..20: mol_type = other DNA
ctgagtagctgggaccacag

SEQ ID NO: 100830 - DNA, 20 bp, synthetic construct
  misc_feature 1..20: note = CRISPR gRNA sequence
  source 1..20: mol_type = other DNA
agtagctgggaccacaggtg

SEQ ID NO: 100831 - DNA, 20 bp, synthetic construct
  misc_feature 1..20: note = CRISPR gRNA sequence
  source 1..20: mol_type = other DNA
ggaccacaggtgcacaccat

SEQ ID NO: 100832 - DNA, 20 bp, synthetic construct
  misc_feature 1..20: note = CRISPR gRNA sequence
  source 1..20: mol_type = other DNA
atttttatatttttagtaga

SEQ ID NO: 100833 - DNA, 20 bp, synthetic construct
  misc_feature 1..20: note = CRISPR gRNA sequence
  source 1..20: mol_type = other DNA
ttatatttttagtagagacg

SEQ ID NO: 100834 - DNA, 20 bp, synthetic construct
  misc_feature 1..20: note = CRISPR gRNA sequence
  source 1..20: mol_type = other DNA
tatatttttagtagagacgg

SEQ ID NO: 100835 - DNA, 20 bp, synthetic construct
  misc_feature 1..20: note = CRISPR gRNA sequence
  source 1..20: mol_type = other DNA
atatttttagtagagacggg

SEQ ID NO: 100836 - DNA, 20 bp, synthetic construct
  misc_feature 1..20: note = CRISPR gRNA sequence
  source 1..20: mol_type = other DNA
tatttttagtagagacgggg

SEQ ID NO: 100837 - DNA, 20 bp, synthetic construct
  misc_feature 1..20: note = CRISPR gRNA sequence
  source 1..20: mol_type = other DNA
ttagtagagacggggtttca

SEQ ID NO: 100838 - DNA, 20 bp, synthetic construct
  misc_feature 1..20: note = CRISPR gRNA sequence
  source 1..20: mol_type = other DNA
tagtagagacggggtttcac

SEQ ID NO: 100839 - DNA, 20 bp, synthetic construct
  misc_feature 1..20: note = CRISPR gRNA sequence
  source 1..20: mol_type = other DNA
agtagagacggggtttcacc

SEQ ID NO: 100840 - DNA, 20 bp, synthetic construct
  misc_feature 1..20: note = CRISPR gRNA sequence
  source 1..20: mol_type = other DNA
gtagagacggggtttcacca

SEQ ID NO: 100841 - DNA, 20 bp, synthetic construct
  misc_feature 1..20: note = CRISPR gRNA sequence
  source 1..20: mol_type = other DNA
caccatgttggtcaggctgg

SEQ ID NO: 100842 - DNA, 20 bp, synthetic construct
  misc_feature 1..20: note = CRISPR gRNA sequence
  source 1..20: mol_type = other DNA
accatgttggtcaggctggt

SEQ ID NO: 100843 - DNA, 20 bp, synthetic construct
  misc_feature 1..20: note = CRISPR gRNA sequence
  source 1..20: mol_type = other DNA
gtcaggctggtcttgaactc

SEQ ID NO: 100844 - DNA, 20 bp, synthetic construct
  misc_feature 1..20: note = CRISPR gRNA sequence
  source 1..20: mol_type = other DNA
gtcttgaactcctgaccttg

SEQ ID NO: 100845 - DNA, 20 bp, synthetic construct
  misc_feature 1..20: note = CRISPR gRNA sequence
  source 1..20: mol_type = other DNA
gaactcctgaccttgtgatc

SEQ ID NO: 100846 - DNA, 20 bp, synthetic construct
  misc_feature 1..20: note = CRISPR gRNA sequence
  source 1..20: mol_type = other DNA
aactcctgaccttgtgatcc

SEQ ID NO: 100847 - DNA, 20 bp, synthetic construct
  misc_feature 1..20: note = CRISPR gRNA sequence
  source 1..20: mol_type = other DNA
ctgaccttgtgatccgcctg

SEQ ID NO: 100848 - DNA, 20 bp, synthetic construct
  misc_feature 1..20: note = CRISPR gRNA sequence
  source 1..20: mol_type = other DNA
accttgtgatccgcctgtgt

SEQ ID NO: 100849 - DNA, 20 bp, synthetic construct
  misc_feature 1..20: note = CRISPR gRNA sequence
  source 1..20: mol_type = other DNA
gtgatccgcctgtgttggcc

SEQ ID NO: 100850 - DNA, 20 bp, synthetic construct
  misc_feature 1..20: note = CRISPR gRNA sequence
  source 1..20: mol_type = other DNA
tgatccgcctgtgttggcct

SEQ ID NO: 100851 - DNA, 20 bp, synthetic construct
  misc_feature 1..20: note = CRISPR gRNA sequence
  source 1..20: mol_type = other DNA
tgttggcctcccaaagtgct

SEQ ID NO: 100852 - DNA, 20 bp, synthetic construct
  misc_feature 1..20: note = CRISPR gRNA sequence
  source 1..20: mol_type = other DNA
gcctcccaaagtgctgggat

SEQ ID NO: 100853 - DNA, 20 bp, synthetic construct
  misc_feature 1..20: note = CRISPR gRNA sequence
  source 1..20: mol_type = other DNA
ccaaagtgctgggattacag

SEQ ID NO: 100854 - DNA, 20 bp, synthetic construct
  misc_feature 1..20: note = CRISPR gRNA sequence
  source 1..20: mol_type = other DNA
ggattacaggtgtgagccac

SEQ ID NO: 100855 - DNA, 20 bp, synthetic construct
  misc_feature 1..20: note = CRISPR gRNA sequence
  source 1..20: mol_type = other DNA
caggtgtgagccaccacgcc

SEQ ID NO: 100856 - DNA, 20 bp, synthetic construct
  misc_feature 1..20: note = CRISPR gRNA sequence
  source 1..20: mol_type = other DNA
gctgtgttgttgttttttta

SEQ ID NO: 100857 - DNA, 20 bp, synthetic construct
  misc_feature 1..20: note = CRISPR gRNA sequence
  source 1..20: mol_type = other DNA
tgttgttgtttttttagaag

SEQ ID NO: 100858 - DNA, 20 bp, synthetic construct
  misc_feature 1..20: note = CRISPR gRNA sequence
  source 1..20: mol_type = other DNA
ttgtttttttagaagagaca

SEQ ID NO: 100859 - DNA, 20 bp, synthetic construct
  misc_feature 1..20: note = CRISPR gRNA sequence
  source 1..20: mol_type = other DNA
tttttttagaagagacaggg

SEQ ID NO: 100860 - DNA, 20 bp, synthetic construct
  misc_feature 1..20: note = CRISPR gRNA sequence
  source 1..20: mol_type = other DNA
ttttagaagagacagggtct

SEQ ID NO: 100861 - DNA, 20 bp, synthetic construct
  misc_feature 1..20: note = CRISPR gRNA sequence
  source 1..20: mol_type = other DNA
tttagaagagacagggtctc

SEQ ID NO: 100862 - DNA, 20 bp, synthetic construct
  misc_feature 1..20: note = CRISPR gRNA sequence
  source 1..20: mol_type = other DNA
ttagaagagacagggtctcg

SEQ ID NO: 100863 - DNA, 20 bp, synthetic construct
  misc_feature 1..20: note = CRISPR gRNA sequence
  source 1..20: mol_type = other DNA
tagaagagacagggtctcgc

SEQ ID NO: 100864 - DNA, 20 bp, synthetic construct
  misc_feature 1..20: note = CRISPR gRNA sequence
  source 1..20: mol_type = other DNA
agaagagacagggtctcgct

SEQ ID NO: 100865 - DNA, 20 bp, synthetic construct
  misc_feature 1..20: note = CRISPR gRNA sequence
  source 1..20: mol_type = other DNA
gaagagacagggtctcgcta

SEQ ID NO: 100866 - DNA, 20 bp, synthetic construct
  misc_feature 1..20: note = CRISPR gRNA sequence
  source 1..20: mol_type = other DNA
gctatgttgcccaggctggt

SEQ ID NO: 100867 - DNA, 20 bp, synthetic construct
  misc_feature 1..20: note = CRISPR gRNA sequence
  source 1..20: mol_type = other DNA
tgttgcccaggctggtctca

SEQ ID NO: 100868 - DNA, 20 bp, synthetic construct
  misc_feature 1..20: note = CRISPR gRNA sequence
  source 1..20: mol_type = other DNA
cccaggctggtctcaaactc

SEQ ID NO: 100869 - DNA, 20 bp, synthetic construct
  misc_feature 1..20: note = CRISPR gRNA sequence
  source 1..20: mol_type = other DNA
gtctcaaactcctgggctca

SEQ ID NO: 100870 - DNA, 20 bp, synthetic construct
  misc_feature 1..20: note = CRISPR gRNA sequence
  source 1..20: mol_type = other DNA
aaactcctgggctcaagtga

SEQ ID NO: 100871 - DNA, 20 bp, synthetic construct
  misc_feature 1..20: note = CRISPR gRNA sequence
  source 1..20: mol_type = other DNA
ctgggctcaagtgatccttc

SEQ ID NO: 100872 - DNA, 20 bp, synthetic construct
  misc_feature 1..20: note = CRISPR gRNA sequence
  source 1..20: mol_type = other DNA
ggctcaagtgatccttcttc

SEQ ID NO: 100873 - DNA, 20 bp, synthetic construct
  misc_feature 1..20: note = CRISPR gRNA sequence
  source 1..20: mol_type = other DNA
aagtgatccttcttccccag

SEQ ID NO: 100874 - DNA, 20 bp, synthetic construct
  misc_feature 1..20: note = CRISPR gRNA sequence
  source 1..20: mol_type = other DNA
cttccccagcctcctgagta

SEQ ID NO: 100875 - DNA, 20 bp, synthetic construct
  misc_feature 1..20: note = CRISPR gRNA sequence
  source 1..20: mol_type = other DNA
ttccccagcctcctgagtag

SEQ ID NO: 100876 - DNA, 20 bp, synthetic construct
  misc_feature 1..20: note = CRISPR gRNA sequence
  source 1..20: mol_type = other DNA
ccccagcctcctgagtagct

SEQ ID NO: 100877 - DNA, 20 bp, synthetic construct
  misc_feature 1..20: note = CRISPR gRNA sequence
  source 1..20: mol_type = other DNA
cccagcctcctgagtagctg

SEQ ID NO: 100878 - DNA, 20 bp, synthetic construct
  misc_feature 1..20: note = CRISPR gRNA sequence
  source 1..20: mol_type = other DNA
ctgagtagctgggactacag

SEQ ID NO: 100879 - DNA, 20 bp, synthetic construct
  misc_feature 1..20: note = CRISPR gRNA sequence
  source 1..20: mol_type = other DNA
agtagctgggactacaggca

SEQ ID NO: 100880 - DNA, 20 bp, synthetic construct
  misc_feature 1..20: note = CRISPR gRNA sequence
  source 1..20: mol_type = other DNA
ggactacaggcatgtaccac

SEQ ID NO: 100881 - DNA, 20 bp, synthetic construct
  misc_feature 1..20: note = CRISPR gRNA sequence
  source 1..20: mol_type = other DNA
caggcatgtaccactctacc

SEQ ID NO: 100882 - DNA, 20 bp, synthetic construct
  misc_feature 1..20: note = CRISPR gRNA sequence
  source 1..20: mol_type = other DNA
tacccagctaatttttaaaa

SEQ ID NO: 100883 - DNA, 20 bp, synthetic construct
  misc_feature 1..20: note = CRISPR gRNA sequence
  source 1..20: mol_type = other DNA
cccagctaatttttaaaatc

SEQ ID NO: 100884 - DNA, 20 bp, synthetic construct
  misc_feature 1..20: note = CRISPR gRNA sequence
  source 1..20: mol_type = other DNA
atttttaaaatcttttttat

SEQ ID NO: 100885 - DNA, 20 bp, synthetic construct
  misc_feature 1..20: note = CRISPR gRNA sequence
  source 1..20: mol_type = other DNA
ttaaaatcttttttatttat

SEQ ID NO: 100886 - DNA, 20 bp, synthetic construct
  misc_feature 1..20: note = CRISPR gRNA sequence
  source 1..20: mol_type = other DNA
taaaatcttttttatttatt

SEQ ID NO: 100887 - DNA, 20 bp, synthetic construct
  misc_feature 1..20: note = CRISPR gRNA sequence
  source 1..20: mol_type = other DNA
aaaatcttttttatttattt

SEQ ID NO: 100888 - DNA, 20 bp, synthetic construct
  misc_feature 1..20: note = CRISPR gRNA sequence
  source 1..20: mol_type = other DNA
aaatcttttttatttatttt

SEQ ID NO: 100889 - DNA, 20 bp, synthetic construct
  misc_feature 1..20: note = CRISPR gRNA sequence
  source 1..20: mol_type = other DNA
ttttatttattttttgagac

SEQ ID NO: 100890 - DNA, 20 bp, synthetic construct
  misc_feature 1..20: note = CRISPR gRNA sequence
  source 1..20: mol_type = other DNA
tttatttattttttgagaca

SEQ ID NO: 100891 - DNA, 20 bp, synthetic construct
  misc_feature 1..20: note = CRISPR gRNA sequence
  source 1..20: mol_type = other DNA
ttatttattttttgagacag

SEQ ID NO: 100892 - DNA, 20 bp, synthetic construct
  misc_feature 1..20: note = CRISPR gRNA sequence
  source 1..20: mol_type = other DNA
tatttattttttgagacaga

SEQ ID NO: 100893 - DNA, 20 bp, synthetic construct
  misc_feature 1..20: note = CRISPR gRNA sequence
  source 1..20: mol_type = other DNA
atttattttttgagacagag

SEQ ID NO: 100894 - DNA, 20 bp, synthetic construct
  misc_feature 1..20: note = CRISPR gRNA sequence
  source 1..20: mol_type = other DNA
tttattttttgagacagagt

SEQ ID NO: 100895 - DNA, 20 bp, synthetic construct
  misc_feature 1..20: note = CRISPR gRNA sequence
  source 1..20: mol_type = other DNA
attttttgagacagagtctc

SEQ ID NO: 100896 - DNA, 20 bp, synthetic construct
  misc_feature 1..20: note = CRISPR gRNA sequence
  source 1..20: mol_type = other DNA
ttttttgagacagagtctcg

SEQ ID NO: 100897 - DNA, 20 bp, synthetic construct
  misc_feature 1..20: note = CRISPR gRNA sequence
  source 1..20: mol_type = other DNA
tttgagacagagtctcgctc

SEQ ID NO: 100898 - DNA, 20 bp, synthetic construct
  misc_feature 1..20: note = CRISPR gRNA sequence
  source 1..20: mol_type = other DNA
ttgagacagagtctcgctct

SEQ ID NO: 100899 - DNA, 20 bp, synthetic construct
  misc_feature 1..20: note = CRISPR gRNA sequence
  source 1..20: mol_type = other DNA
tgagacagagtctcgctctg

SEQ ID NO: 100900 - DNA, 20 bp, synthetic construct
  misc_feature 1..20: note = CRISPR gRNA sequence
  source 1..20: mol_type = other DNA
gagacagagtctcgctctgt

SEQ ID NO: 100901 - DNA, 20 bp, synthetic construct
  misc_feature 1..20: note = CRISPR gRNA sequence
  source 1..20: mol_type = other DNA
agacagagtctcgctctgtc

SEQ ID NO: 100902 - DNA, 20 bp, synthetic construct
  misc_feature 1..20: note = CRISPR gRNA sequence
  source 1..20: mol_type = other DNA
gctctgtcacccaggctgga

SEQ ID NO: 100903 - DNA, 20 bp, synthetic construct
  misc_feature 1..20: note = CRISPR gRNA sequence
  source 1..20: mol_type = other DNA
tgtcacccaggctggagtgc

SEQ ID NO: 100904 - DNA, 20 bp, synthetic construct
  misc_feature 1..20: note = CRISPR gRNA sequence
  source 1..20: mol_type = other DNA
tcacccaggctggagtgcag

SEQ ID NO: 100905 - DNA, 20 bp, synthetic construct
  misc_feature 1..20: note = CRISPR gRNA sequence
  source 1..20: mol_type = other DNA
gagtgcagtggcacaatctc

SEQ ID NO: 100906 - DNA, 20 bp, synthetic construct
  misc_feature 1..20: note = CRISPR gRNA sequence
  source 1..20: mol_type = other DNA
ggctcactgcaacctctgcc

SEQ ID NO: 100907 - DNA, 20 bp, synthetic construct
  misc_feature 1..20: note = CRISPR gRNA sequence
  source 1..20: mol_type = other DNA
actgcaacctctgcctccca

SEQ ID NO: 100908 - DNA, 20 bp, synthetic construct
  misc_feature 1..20: note = CRISPR gRNA sequence
  source 1..20: mol_type = other DNA
caacctctgcctcccaggca

SEQ ID NO: 100909 - DNA, 20 bp, synthetic construct
  misc_feature 1..20: note = CRISPR gRNA sequence
  source 1..20: mol_type = other DNA
tgcctcccaggcaaacaatt

SEQ ID NO: 100910 - DNA, 20 bp, synthetic construct
  misc_feature 1..20: note = CRISPR gRNA sequence
  source 1..20: mol_type = other DNA
cctcccaggcaaacaattct

SEQ ID NO: 100911 - DNA, 20 bp, synthetic construct
  misc_feature 1..20: note = CRISPR gRNA sequence
  source 1..20: mol_type = other DNA
ccaggcaaacaattctcctg

SEQ ID NO: 100912 - DNA, 20 bp, synthetic construct
  misc_feature 1..20: note = CRISPR gRNA sequence
  source 1..20: mol_type = other DNA
tcctgcctcagcctcctgaa

SEQ ID NO: 100913 - DNA, 20 bp, synthetic construct
  misc_feature 1..20: note = CRISPR gRNA sequence
  source 1..20: mol_type = other DNA
ctgcctcagcctcctgaata

SEQ ID NO: 100914 - DNA, 20 bp, synthetic construct
  misc_feature 1..20: note = CRISPR gRNA sequence
  source 1..20: mol_type = other DNA
cctcagcctcctgaatagct

SEQ ID NO: 100915 - DNA, 20 bp, synthetic construct
  misc_feature 1..20: note = CRISPR gRNA sequence
  source 1..20: mol_type = other DNA
agcctcctgaatagctggga

SEQ ID NO: 100916 - DNA, 20 bp, synthetic construct
  misc_feature 1..20: note = CRISPR gRNA sequence
  source 1..20: mol_type = other DNA
ctgaatagctgggattacaa

SEQ ID NO: 100917 - DNA, 20 bp, synthetic construct
  misc_feature 1..20: note = CRISPR gRNA sequence
  source 1..20: mol_type = other DNA
aatagctgggattacaagtg

SEQ ID NO: 100918 - DNA, 20 bp, synthetic construct
  misc_feature 1..20: note = CRISPR gRNA sequence
  source 1..20: mol_type = other DNA
ggattacaagtgcctgccac

SEQ ID NO: 100919 - DNA, 20 bp, synthetic construct
  misc_feature 1..20: note = CRISPR gRNA sequence
  source 1..20: mol_type = other DNA
caagtgcctgccaccacacc

SEQ ID NO: 100920 - DNA, 20 bp, synthetic construct
  misc_feature 1..20: note = CRISPR gRNA sequence
  source 1..20: mol_type = other DNA
ccaccacacctggctaattt

SEQ ID NO: 100921 - DNA, 20 bp, synthetic construct
  misc_feature 1..20: note = CRISPR gRNA sequence
  source 1..20: mol_type = other DNA
gctaattttttttttttttt

SEQ ID NO: 100922 - DNA, 20 bp, synthetic construct
  misc_feature 1..20: note = CRISPR gRNA sequence
  source 1..20: mol_type = other DNA
attttttttttttttttttt

SEQ ID NO: 100923 - DNA, 20 bp, synthetic construct
  misc_feature 1..20: note = CRISPR gRNA sequence
  source 1..20: mol_type = other DNA
tttttttttttttttttttt

SEQ ID NO: 100924 - DNA, 20 bp, synthetic construct
  misc_feature 1..20: note = CRISPR gRNA sequence
  source 1..20: mol_type = other DNA
tttttttttttttttttttt

SEQ ID NO: 100925 - DNA, 20 bp, synthetic construct
  misc_feature 1..20: note = CRISPR gRNA sequence
  source 1..20: mol_type = other DNA
tttttttttttttttttttt

SEQ ID NO: 100926 - DNA, 20 bp, synthetic construct
  misc_feature 1..20: note = CRISPR gRNA sequence
  source 1..20: mol_type = other DNA
tttttttttttttttttttt

SEQ ID NO: 100927 - DNA, 20 bp, synthetic construct
  misc_feature 1..20: note = CRISPR gRNA sequence
  source 1..20: mol_type = other DNA
tttttttttttttttttttt

SEQ ID NO: 100928 - DNA, 20 bp, synthetic construct
  misc_feature 1..20: note = CRISPR gRNA sequence
  source 1..20: mol_type = other DNA
tttttttttttttttttttg

SEQ ID NO: 100929 - DNA, 20 bp, synthetic construct
  misc_feature 1..20: note = CRISPR gRNA sequence
  source 1..20: mol_type = other DNA
ttttttttttttttttttga

SEQ ID NO: 100930 - DNA, 20 bp, synthetic construct
  misc_feature 1..20: note = CRISPR gRNA sequence
  source 1..20: mol_type = other DNA
tttttttttttttttttgag

SEQ ID NO: 100931 - DNA, 20 bp, synthetic construct
  misc_feature 1..20: note = CRISPR gRNA sequence
  source 1..20: mol_type = other DNA
ttttttttttttttttgaga

SEQ ID NO: 100932 - DNA, 20 bp, synthetic construct
  misc_feature 1..20: note = CRISPR gRNA sequence
  source 1..20: mol_type = other DNA
tttttttttttttttgagat

SEQ ID NO: 100933 - DNA, 20 bp, synthetic construct
  misc_feature 1..20: note = CRISPR gRNA sequence
  source 1..20: mol_type = other DNA
ttttttttttttttgagatg

SEQ ID NO: 100934 - DNA, 20 bp, synthetic construct
  misc_feature 1..20: note = CRISPR gRNA sequence
  source 1..20: mol_type = other DNA
tttttttttttttgagatgg

SEQ ID NO: 100935 - DNA, 20 bp, synthetic construct
  misc_feature 1..20: note = CRISPR gRNA sequence
  source 1..20: mol_type = other DNA
ttttttttttttgagatgga

SEQ ID NO: 100936 - DNA, 20 bp, synthetic construct
  misc_feature 1..20: note = CRISPR gRNA sequence
  source 1..20: mol_type = other DNA
tttttttttttgagatggag

SEQ ID NO: 100937 - DNA, 20 bp, synthetic construct
  misc_feature 1..20: note = CRISPR gRNA sequence
  source 1..20: mol_type = other DNA
ttttttttttgagatggagt

SEQ ID NO: 100938 - DNA, 20 bp, synthetic construct
  misc_feature 1..20: note = CRISPR gRNA sequence
  source 1..20: mol_type = other DNA
tttttttttgagatggagtt

SEQ ID NO: 100939 - DNA, 20 bp, synthetic construct
  misc_feature 1..20: note = CRISPR gRNA sequence
  source 1..20: mol_type = other DNA
ttttttttgagatggagttt

SEQ ID NO: 100940 - DNA, 20 bp, synthetic construct
  misc_feature 1..20: note = CRISPR gRNA sequence
  source 1..20: mol_type = other DNA
tttttttgagatggagtttc

SEQ ID NO: 100941 - DNA, 20 bp, synthetic construct
  misc_feature 1..20: note = CRISPR gRNA sequence
  source 1..20: mol_type = other DNA
ttttttgagatggagtttcg

SEQ ID NO: 100942 - DNA, 20 bp, synthetic construct
  misc_feature 1..20: note = CRISPR gRNA sequence
  source 1..20: mol_type = other DNA
tttttgagatggagtttcgc

SEQ ID NO: 100943 - DNA, 20 bp, synthetic construct
  misc_feature 1..20: note = CRISPR gRNA sequence
  source 1..20: mol_type = other DNA
ttttgagatggagtttcgct

SEQ ID NO: 100944 - DNA, 20 bp, synthetic construct
  misc_feature 1..20: note = CRISPR gRNA sequence
  source 1..20: mol_type = other DNA
tttgagatggagtttcgctc

SEQ ID NO: 100945 - DNA, 20 bp, synthetic construct
  misc_feature 1..20: note = CRISPR gRNA sequence
  source 1..20: mol_type = other DNA
ttgagatggagtttcgctct

SEQ ID NO: 100946 - DNA, 20 bp, synthetic construct
  misc_feature 1..20: note = CRISPR gRNA sequence
  source 1..20: mol_type = other DNA
tgagatggagtttcgctctt

SEQ ID NO: 100947 - DNA, 20 bp, synthetic construct
  misc_feature 1..20: note = CRISPR gRNA sequence
  source 1..20: mol_type = other DNA
gagatggagtttcgctcttg

SEQ ID NO: 100948 - DNA, 20 bp, synthetic construct
  misc_feature 1..20: note = CRISPR gRNA sequence
  source 1..20: mol_type = other DNA
agatggagtttcgctcttgt

SEQ ID NO: 100949 - DNA, 20 bp, synthetic construct
  misc_feature 1..20: note = CRISPR gRNA sequence
  source 1..20: mol_type = other DNA
cgctcttgttgcccaggctg

SEQ ID NO: 100950 - DNA, 20 bp, synthetic construct
  misc_feature 1..20: note = CRISPR gRNA sequence
  source 1..20: mol_type = other DNA
gctcttgttgcccaggctgg

SEQ ID NO: 100951 - DNA, 20 bp, synthetic construct
  misc_feature 1..20: note = CRISPR gRNA sequence
  source 1..20: mol_type = other DNA
ttgttgcccaggctggagtg

SEQ ID NO: 100952 - DNA, 20 bp, synthetic construct
  misc_feature 1..20: note = CRISPR gRNA sequence
  source 1..20: mol_type = other DNA
gttgcccaggctggagtgct

SEQ ID NO: 100953 - DNA, 20 bp, synthetic construct
  misc_feature 1..20: note = CRISPR gRNA sequence
  source 1..20: mol_type = other DNA
ttgcccaggctggagtgcta

SEQ ID NO: 100954 - DNA, 20 bp, synthetic construct
  misc_feature 1..20: note = CRISPR gRNA sequence
  source 1..20: mol_type = other DNA
cccaggctggagtgctatgg

SEQ ID NO: 100955 - DNA, 20 bp, synthetic construct
  misc_feature 1..20: note = CRISPR gRNA sequence
  source 1..20: mol_type = other DNA
gagtgctatggcgtgatctc

SEQ ID NO: 100956 - DNA, 20 bp, synthetic construct
  misc_feature 1..20: note = CRISPR gRNA sequence
  source 1..20: mol_type = other DNA
tggcgtgatctcggctcact

SEQ ID NO: 100957 - DNA, 20 bp, synthetic construct
  misc_feature 1..20: note = CRISPR gRNA sequence
  source 1..20: mol_type = other DNA
ggctcactgcaacttccgcc

SEQ ID NO: 100958 - DNA, 20 bp, synthetic construct
  misc_feature 1..20: note = CRISPR gRNA sequence
  source 1..20: mol_type = other DNA
actgcaacttccgcctccca

SEQ ID NO: 100959 - DNA, 20 bp, synthetic construct
  misc_feature 1..20: note = CRISPR gRNA sequence
  source 1..20: mol_type = other DNA
caacttccgcctcccaggtt

SEQ ID NO: 100960 - DNA, 20 bp, synthetic construct
  misc_feature 1..20: note = CRISPR gRNA sequence
  source 1..20: mol_type = other DNA
ccgcctcccaggttcaagca

SEQ ID NO: 100961 - DNA, 20 bp, synthetic construct
  misc_feature 1..20: note = CRISPR gRNA sequence
  source 1..20: mol_type = other DNA
cgcctcccaggttcaagcaa

SEQ ID NO: 100962 - DNA, 20 bp, synthetic construct
  misc_feature 1..20: note = CRISPR gRNA sequence
  source 1..20: mol_type = other DNA
ccaggttcaagcaattctcc

SEQ ID NO: 100963 - DNA, 20 bp, synthetic construct
  misc_feature 1..20: note = CRISPR gRNA sequence
  source 1..20: mol_type = other DNA
aagcaattctcctgcctcag

SEQ ID NO: 100964 - DNA, 20 bp, synthetic construct
  misc_feature 1..20: note = CRISPR gRNA sequence
  source 1..20: mol_type = other DNA
tcctgcctcagcctcccaag

SEQ ID NO: 100965 - DNA, 20 bp, synthetic construct
  misc_feature 1..20: note = CRISPR gRNA sequence
  source 1..20: mol_type = other DNA
ctgcctcagcctcccaagta

SEQ ID NO: 100966 - DNA, 20 bp, synthetic construct
  misc_feature 1..20: note = CRISPR gRNA sequence
  source 1..20: mol_type = other DNA
cctcagcctcccaagtagct

SEQ ID NO: 100967 - DNA, 20 bp, synthetic construct
  misc_feature 1..20: note = CRISPR gRNA sequence
  source 1..20: mol_type = other DNA
agcctcccaagtagctggga

SEQ ID NO: 100968 - DNA, 20 bp, synthetic construct
  misc_feature 1..20: note = CRISPR gRNA sequence
  source 1..20: mol_type = other DNA
ccaagtagctgggattacag

SEQ ID NO: 100969 - DNA, 20 bp, synthetic construct
  misc_feature 1..20: note = CRISPR gRNA sequence
  source 1..20: mol_type = other DNA
ggattacaggcatgcaccac

SEQ ID NO: 100970 - DNA, 20 bp, synthetic construct
  misc_feature 1..20: note = CRISPR gRNA sequence
  source 1..20: mol_type = other DNA
caggcatgcaccaccatgcc

SEQ ID NO: 100971 - DNA, 20 bp, synthetic construct
  misc_feature 1..20: note = CRISPR gRNA sequence
  source 1..20: mol_type = other DNA
attttttgcatttttagtag

SEQ ID NO: 100972 - DNA, 20 bp, synthetic construct
  misc_feature 1..20: note = CRISPR gRNA sequence
  source 1..20: mol_type = other DNA
tttgcatttttagtagagtc

SEQ ID NO: 100973 - DNA, 20 bp, synthetic construct
  misc_feature 1..20: note = CRISPR gRNA sequence
  source 1..20: mol_type = other DNA
ttgcatttttagtagagtca

SEQ ID NO: 100974 - DNA, 20 bp, synthetic construct
  misc_feature 1..20: note = CRISPR gRNA sequence
  source 1..20: mol_type = other DNA
tgcatttttagtagagtcag

SEQ ID NO: 100975 - DNA, 20 bp, synthetic construct
  misc_feature 1..20: note = CRISPR gRNA sequence
  source 1..20: mol_type = other DNA
gcatttttagtagagtcagg

SEQ ID NO: 100976 - DNA, 20 bp, synthetic construct
  misc_feature 1..20: note = CRISPR gRNA sequence
  source 1..20: mol_type = other DNA
catttttagtagagtcaggg

SEQ ID NO: 100977 - DNA, 20 bp, synthetic construct
  misc_feature 1..20: note = CRISPR gRNA sequence
  source 1..20: mol_type = other DNA
ttagtagagtcagggtttct

SEQ ID NO: 100978 - DNA, 20 bp, synthetic construct
  misc_feature 1..20: note = CRISPR gRNA sequence
  source 1..20: mol_type = other DNA
tagtagagtcagggtttctc

SEQ ID NO: 100979 - DNA, 20 bp, synthetic construct
  misc_feature 1..20: note = CRISPR gRNA sequence
  source 1..20: mol_type = other DNA
agtagagtcagggtttctcc

SEQ ID NO: 100980 - DNA, 20 bp, synthetic construct
  misc_feature 1..20: note = CRISPR gRNA sequence
  source 1..20: mol_type = other DNA
gtagagtcagggtttctcca

SEQ ID NO: 100981 - DNA, 20 bp, synthetic construct
  misc_feature 1..20: note = CRISPR gRNA sequence
  source 1..20: mol_type = other DNA
ctccatgttggtcaggtgat

SEQ ID NO: 100982 - DNA, 20 bp, synthetic construct
  misc_feature 1..20: note = CRISPR gRNA sequence
  source 1..20: mol_type = other DNA
tccatgttggtcaggtgatc

SEQ ID NO: 100983 - DNA, 20 bp, synthetic construct
  misc_feature 1..20: note = CRISPR gRNA sequence
  source 1..20: mol_type = other DNA
catgttggtcaggtgatctc

SEQ ID NO: 100984 - DNA, 20 bp, synthetic construct
  misc_feature 1..20: note = CRISPR gRNA sequence
  source 1..20: mol_type = other DNA
gtcaggtgatctcaaactcc

SEQ ID NO: 100985 - DNA, 20 bp, synthetic construct
  misc_feature 1..20: note = CRISPR gRNA sequence
  source 1..20: mol_type = other DNA
aaactcccgacctcaggtga

SEQ ID NO: 100986 - DNA, 20 bp, synthetic construct
  misc_feature 1..20: note = CRISPR gRNA sequence
  source 1..20: mol_type = other DNA
ccgacctcaggtgatccacc

SEQ ID NO: 100987 - DNA, 20 bp, synthetic construct
  misc_feature 1..20: note = CRISPR gRNA sequence
  source 1..20: mol_type = other DNA
aggtgatccacccgcctcag

SEQ ID NO: 100988 - DNA, 20 bp, synthetic construct
  misc_feature 1..20: note = CRISPR gRNA sequence
  source 1..20: mol_type = other DNA
agcttcccaaagtgctggga

SEQ ID NO: 100989 - DNA, 20 bp, synthetic construct
  misc_feature 1..20: note = CRISPR gRNA sequence
  source 1..20: mol_type = other DNA
cccaaagtgctgggattaca

SEQ ID NO: 100990 - DNA, 20 bp, synthetic construct
  misc_feature 1..20: note = CRISPR gRNA sequence
  source 1..20: mol_type = other DNA
ccaaagtgctgggattacag

SEQ ID NO: 100991 - DNA, 20 bp, synthetic construct
  misc_feature 1..20: note = CRISPR gRNA sequence
  source 1..20: mol_type = other DNA
ggattacaggcatgagccac

SEQ ID NO: 100992 - DNA, 20 bp, synthetic construct
  misc_feature 1..20: note = CRISPR gRNA sequence
  source 1..20: mol_type = other DNA
caggcatgagccaccacacc

SEQ ID NO: 100993 - DNA, 20 bp, synthetic construct
  misc_feature 1..20: note = CRISPR gRNA sequence
  source 1..20: mol_type = other DNA
cacctggctaatttttgtag

SEQ ID NO: 100994 - DNA, 20 bp, synthetic construct
  misc_feature 1..20: note = CRISPR gRNA sequence
  source 1..20: mol_type = other DNA
gctaatttttgtagttttag

SEQ ID NO: 100995 - DNA, 20 bp, synthetic construct
  misc_feature 1..20: note = CRISPR gRNA sequence
  source 1..20: mol_type = other DNA
atttttgtagttttagtaga

SEQ ID NO: 100996 - DNA, 20 bp, synthetic construct
  misc_feature 1..20: note = CRISPR gRNA sequence
  source 1..20: mol_type = other DNA
ttgtagttttagtagagatg

SEQ ID NO: 100997 - DNA, 20 bp, synthetic construct
  misc_feature 1..20: note = CRISPR gRNA sequence
  source 1..20: mol_type = other DNA
tgtagttttagtagagatgg

SEQ ID NO: 100998 - DNA, 20 bp, synthetic construct
  misc_feature 1..20: note = CRISPR gRNA sequence
  source 1..20: mol_type = other DNA
gtagttttagtagagatggg

SEQ ID NO: 100999 - DNA, 20 bp, synthetic construct
  misc_feature 1..20: note = CRISPR gRNA sequence
  source 1..20: mol_type = other DNA
tagttttagtagagatgggg

SEQ ID NO: 101000 - DNA, 20 bp, synthetic construct
  misc_feature 1..20: note = CRISPR gRNA sequence
  source 1..20: mol_type = other DNA
tagtagagatggggtttcat

SEQ ID NO: 101001 - DNA, 20 bp, synthetic construct
  misc_feature 1..20: note = CRISPR gRNA sequence
  source 1..20: mol_type = other DNA
agtagagatggggtttcatc

SEQ ID NO: 101002 - DNA, 20 bp, synthetic construct
  misc_feature 1..20: note = CRISPR gRNA sequence
  source 1..20: mol_type = other DNA
gtagagatggggtttcatca

SEQ ID NO: 101003 - DNA, 20 bp, synthetic construct
  misc_feature 1..20: note = CRISPR gRNA sequence
  source 1..20: mol_type = other DNA
catcatgttggtcaggctgg

SEQ ID NO: 101004 - DNA, 20 bp, synthetic construct
  misc_feature 1..20: note = CRISPR gRNA sequence
  source 1..20: mol_type = other DNA
atcatgttggtcaggctggc

SEQ ID NO: 101005 - DNA, 20 bp, synthetic construct
  misc_feature 1..20: note = CRISPR gRNA sequence
  source 1..20: mol_type = other DNA
gtcaggctggcctttcctga

SEQ ID NO: 101006 - DNA, 20 bp, synthetic construct
  misc_feature 1..20: note = CRISPR gRNA sequence
  source 1..20: mol_type = other DNA
gcctttcctgacttcaagtg

SEQ ID NO: 101007 - DNA, 20 bp, synthetic construct
  misc_feature 1..20: note = CRISPR gRNA sequence
  source 1..20: mol_type = other DNA
tcctgacttcaagtgatcca

SEQ ID NO: 101008 - DNA, 20 bp, synthetic construct
  misc_feature 1..20: note = CRISPR gRNA sequence
  source 1..20: mol_type = other DNA
cctgacttcaagtgatccac

SEQ ID NO: 101009 - DNA, 20 bp, synthetic construct
  misc_feature 1..20: note = CRISPR gRNA sequence
  source 1..20: mol_type = other DNA
ctgacttcaagtgatccacc

SEQ ID NO: 101010 - DNA, 20 bp, synthetic construct
  misc_feature 1..20: note = CRISPR gRNA sequence
  source 1..20: mol_type = other DNA
acttcaagtgatccacctac

SEQ ID NO: 101011 - DNA, 20 bp, synthetic construct
  misc_feature 1..20: note = CRISPR gRNA sequence
  source 1..20: mol_type = other DNA
caagtgatccacctaccttg

SEQ ID NO: 101012 - DNA, 20 bp, synthetic construct
  misc_feature 1..20: note = CRISPR gRNA sequence
  source 1..20: mol_type = other DNA
aagtgatccacctaccttgg

SEQ ID NO: 101013 - DNA, 20 bp, synthetic construct
  misc_feature 1..20: note = CRISPR gRNA sequence
  source 1..20: mol_type = other DNA
ccttggcctcccaaagtgct

SEQ ID NO: 101014 - DNA, 20 bp, synthetic construct
  misc_feature 1..20: note = CRISPR gRNA sequence
  source 1..20: mol_type = other DNA
ggcctcccaaagtgctagga

SEQ ID NO: 101015 - DNA, 20 bp, synthetic construct
  misc_feature 1..20: note = CRISPR gRNA sequence
  source 1..20: mol_type = other DNA
gcctcccaaagtgctaggat

SEQ ID NO: 101016 - DNA, 20 bp, synthetic construct
  misc_feature 1..20: note = CRISPR gRNA sequence
  source 1..20: mol_type = other DNA
ccaaagtgctaggattacag

SEQ ID NO: 101017 - DNA, 20 bp, synthetic construct
  misc_feature 1..20: note = CRISPR gRNA sequence
  source 1..20: mol_type = other DNA
ggattacaggtgtgagccac

SEQ ID NO: 101018 - DNA, 20 bp, synthetic construct
  misc_feature 1..20: note = CRISPR gRNA sequence
  source 1..20: mol_type = other DNA
caggtgtgagccaccaagcc

SEQ ID NO: 101019 - DNA, 20 bp, synthetic construct
  misc_feature 1..20: note = CRISPR gRNA sequence
  source 1..20: mol_type = other DNA
atttttaaatttttttggta

SEQ ID NO: 101020 - DNA, 20 bp, synthetic construct
  misc_feature 1..20: note = CRISPR gRNA sequence
  source 1..20: mol_type = other DNA
ttaaatttttttggtagaga

SEQ ID NO: 101021 - DNA, 20 bp, synthetic construct
  misc_feature 1..20: note = CRISPR gRNA sequence
  source 1..20: mol_type = other DNA
taaatttttttggtagagac

SEQ ID NO: 101022 - DNA, 20 bp, synthetic construct
  misc_feature 1..20: note = CRISPR gRNA sequence
  source 1..20: mol_type = other DNA
aaatttttttggtagagaca

SEQ ID NO: 101023 - DNA, 20 bp, synthetic construct
  misc_feature 1..20: note = CRISPR gRNA sequence
  source 1..20: mol_type = other DNA
aatttttttggtagagacag

SEQ ID NO: 101024 - DNA, 20 bp, synthetic construct
  misc_feature 1..20: note = CRISPR gRNA sequence
  source 1..20: mol_type = other DNA
ttttggtagagacagcgttt

SEQ ID NO: 101025 - DNA, 20 bp, synthetic construct
  misc_feature 1..20: note = CRISPR gRNA sequence
  source 1..20: mol_type = other DNA
tttggtagagacagcgtttt

SEQ ID NO: 101026 - DNA, 20 bp, synthetic construct
  misc_feature 1..20: note = CRISPR gRNA sequence
  source 1..20: mol_type = other DNA
ttggtagagacagcgttttg

SEQ ID NO: 101027 - DNA, 20 bp, synthetic construct
  misc_feature 1..20: note = CRISPR gRNA sequence
  source 1..20: mol_type = other DNA
tggtagagacagcgttttgc

SEQ ID NO: 101028 - DNA, 20 bp, synthetic construct
  misc_feature 1..20: note = CRISPR gRNA sequence
  source 1..20: mol_type = other DNA
ggtagagacagcgttttgct

SEQ ID NO: 101029 - DNA, 20 bp, synthetic construct
  misc_feature 1..20: note = CRISPR gRNA sequence
  source 1..20: mol_type = other DNA
gtagagacagcgttttgctc

SEQ ID NO: 101030 - DNA, 20 bp, synthetic construct
  misc_feature 1..20: note = CRISPR gRNA sequence
  source 1..20: mol_type = other DNA
tgctctgttgcccaagctgg

SEQ ID NO: 101031 - DNA, 20 bp, synthetic construct
  misc_feature 1..20: note = CRISPR gRNA sequence
  source 1..20: mol_type = other DNA
gctctgttgcccaagctggc

SEQ ID NO: 101032 - DNA, 20 bp, synthetic construct
  misc_feature 1..20: note = CRISPR gRNA sequence
  source 1..20: mol_type = other DNA
ctctgttgcccaagctggcc

SEQ ID NO: 101033 - DNA, 20 bp, synthetic construct
  misc_feature 1..20: note = CRISPR gRNA sequence
  source 1..20: mol_type = other DNA
tgttgcccaagctggcctca

SEQ ID NO: 101034 - DNA, 20 bp, synthetic construct
  misc_feature 1..20: note = CRISPR gRNA sequence
  source 1..20: mol_type = other DNA
ttgcccaagctggcctcaaa

SEQ ID NO: 101035 - DNA, 20 bp, synthetic construct
  misc_feature 1..20: note = CRISPR gRNA sequence
  source 1..20: mol_type = other DNA
cccaagctggcctcaaattc

SEQ ID NO: 101036 - DNA, 20 bp, synthetic construct
  misc_feature 1..20: note = CRISPR gRNA sequence
  source 1..20: mol_type = other DNA
gcctcaaattcctgagctca

SEQ ID NO: 101037 - DNA, 20 bp, synthetic construct
  misc_feature 1..20: note = CRISPR gRNA sequence
  source 1..20: mol_type = other DNA
aaattcctgagctcaagcag

SEQ ID NO: 101038 - DNA, 20 bp, synthetic construct
  misc_feature 1..20: note = CRISPR gRNA sequence
  source 1..20: mol_type = other DNA
ctgagctcaagcagtcctcc

SEQ ID NO: 101039 - DNA, 20 bp, synthetic construct
  misc_feature 1..20: note = CRISPR gRNA sequence
  source 1..20: mol_type = other DNA
agctcaagcagtcctcccca

SEQ ID NO: 101040 - DNA, 20 bp, synthetic construct
  misc_feature 1..20: note = CRISPR gRNA sequence
  source 1..20: mol_type = other DNA
aagcagtcctccccactgga

SEQ ID NO: 101041 - DNA, 20 bp, synthetic construct
  misc_feature 1..20: note = CRISPR gRNA sequence
  source 1..20: mol_type = other DNA
cccactggacctcccaaagt

SEQ ID NO: 101042 - DNA, 20 bp, synthetic construct
  misc_feature 1..20: note = CRISPR gRNA sequence
  source 1..20: mol_type = other DNA
gacctcccaaagtgctggga

SEQ ID NO: 101043 - DNA, 20 bp, synthetic construct
  misc_feature 1..20: note = CRISPR gRNA sequence
  source 1..20: mol_type = other DNA
ccaaagtgctgggattatag

SEQ ID NO: 101044 - DNA, 20 bp, synthetic construct
  misc_feature 1..20: note = CRISPR gRNA sequence
  source 1..20: mol_type = other DNA
ggattataggtgtgagccac

SEQ ID NO: 101045 - DNA, 20 bp, synthetic construct
  misc_feature 1..20: note = CRISPR gRNA sequence
  source 1..20: mol_type = other DNA
taggtgtgagccaccatgcc

SEQ ID NO: 101046 - DNA, 20 bp, synthetic construct
  misc_feature 1..20: note = CRISPR gRNA sequence
  source 1..20: mol_type = other DNA
atcttttcatgaaagtcaca

SEQ ID NO: 101047 - DNA, 20 bp, synthetic construct
  misc_feature 1..20: note = CRISPR gRNA sequence
  source 1..20: mol_type = other DNA
ttcatgaaagtcacaattca

SEQ ID NO: 101048 - DNA, 20 bp, synthetic construct
  misc_feature 1..20: note = CRISPR gRNA sequence
  source 1..20: mol_type = other DNA
tcatgaaagtcacaattcac

SEQ ID NO: 101049 - DNA, 20 bp, synthetic construct
  misc_feature 1..20: note = CRISPR gRNA sequence
  source 1..20: mol_type = other DNA
catgaaagtcacaattcaca

SEQ ID NO: 101050 - DNA, 20 bp, synthetic construct
  misc_feature 1..20: note = CRISPR gRNA sequence
  source 1..20: mol_type = other DNA
atgaaagtcacaattcacac

SEQ ID NO: 101051 - DNA, 20 bp, synthetic construct
  misc_feature 1..20: note = CRISPR gRNA sequence
  source 1..20: mol_type = other DNA
acacattttgcttggtagga

SEQ ID NO: 101052 - DNA, 20 bp, synthetic construct
  misc_feature 1..20: note = CRISPR gRNA sequence
  source 1..20: mol_type = other DNA
tgcttggtaggaaatatttt

SEQ ID NO: 101053 - DNA, 20 bp, synthetic construct
  misc_feature 1..20: note = CRISPR gRNA sequence
  source 1..20: mol_type = other DNA
gcttggtaggaaatattttt

SEQ ID NO: 101054 - DNA, 20 bp, synthetic construct
  misc_feature 1..20: note = CRISPR gRNA sequence
  source 1..20: mol_type = other DNA
cttggtaggaaatattttta

SEQ ID NO: 101055 - DNA, 20 bp, synthetic construct
  misc_feature 1..20: note = CRISPR gRNA sequence
  source 1..20: mol_type = other DNA
ggtaggaaatatttttatat

SEQ ID NO: 101056 - DNA, 20 bp, synthetic construct
  misc_feature 1..20: note = CRISPR gRNA sequence
  source 1..20: mol_type = other DNA
gtaggaaatatttttatatt

SEQ ID NO: 101057 - DNA, 20 bp, synthetic construct
  misc_feature 1..20: note = CRISPR gRNA sequence
  source 1..20: mol_type = other DNA
ttatattaattctgaaaagc

SEQ ID NO: 101058 - DNA, 20 bp, synthetic construct
  misc_feature 1..20: note = CRISPR gRNA sequence
  source 1..20: mol_type = other DNA
tatattaattctgaaaagct

SEQ ID NO: 101059 - DNA, 20 bp, synthetic construct
  misc_feature 1..20: note = CRISPR gRNA sequence
  source 1..20: mol_type = other DNA
atattaattctgaaaagcta

SEQ ID NO: 101060 - DNA, 20 bp, synthetic construct
  misc_feature 1..20: note = CRISPR gRNA sequence
  source 1..20: mol_type = other DNA
tattaattctgaaaagctac

SEQ ID NO: 101061 - DNA, 20 bp, synthetic construct
  misc_feature 1..20: note = CRISPR gRNA sequence
  source 1..20: mol_type = other DNA
attctgaaaagctacaaaag

SEQ ID NO: 101062 - DNA, 20 bp, synthetic construct
  misc_feature 1..20: note = CRISPR gRNA sequence
  source 1..20: mol_type = other DNA
tgaaaagctacaaaagtgca

SEQ ID NO: 101063 - DNA, 20 bp, synthetic construct
  misc_feature 1..20: note = CRISPR gRNA sequence
  source 1..20: mol_type = other DNA
aaaagctacaaaagtgcatt

SEQ ID NO: 101064 - DNA, 20 bp, synthetic construct
  misc_feature 1..20: note = CRISPR gRNA sequence
  source 1..20: mol_type = other DNA
caaaagtgcatttttacaaa

SEQ ID NO: 101065 - DNA, 20 bp, synthetic construct
  misc_feature 1..20: note = CRISPR gRNA sequence
  source 1..20: mol_type = other DNA
ttacaaacttaggggaagtt

SEQ ID NO: 101066 - DNA, 20 bp, synthetic construct
  misc_feature 1..20: note = CRISPR gRNA sequence
  source 1..20: mol_type = other DNA
tacaaacttaggggaagttg

SEQ ID NO: 101067 - DNA, 20 bp, synthetic construct
  misc_feature 1..20: note = CRISPR gRNA sequence
  source 1..20: mol_type = other DNA
acaaacttaggggaagttga

SEQ ID NO: 101068 - DNA, 20 bp, synthetic construct
  misc_feature 1..20: note = CRISPR gRNA sequence
  source 1..20: mol_type = other DNA
caaacttaggggaagttgag

SEQ ID NO: 101069 - DNA, 20 bp, synthetic construct
  misc_feature 1..20: note = CRISPR gRNA sequence
  source 1..20: mol_type = other DNA
aggggaagttgaggttcctg

SEQ ID NO: 101070 - DNA, 20 bp, synthetic construct
  misc_feature 1..20: note = CRISPR gRNA sequence
  source 1..20: mol_type = other DNA
ggggaagttgaggttcctgg

SEQ ID NO: 101071 - DNA, 20 bp, synthetic construct
  misc_feature 1..20: note = CRISPR gRNA sequence
  source 1..20: mol_type = other DNA
aggttcctggggtgagtcct

SEQ ID NO: 101072 - DNA, 20 bp, synthetic construct
  misc_feature 1..20: note = CRISPR gRNA sequence
  source 1..20: mol_type = other DNA
ctggggtgagtcctcggttc

SEQ ID NO: 101073 - DNA, 20 bp, synthetic construct
  misc_feature 1..20: note = CRISPR gRNA sequence
  source 1..20: mol_type = other DNA
gggtgagtcctcggttctcc

SEQ ID NO: 101074 - DNA, 20 bp, synthetic construct
  misc_feature 1..20: note = CRISPR gRNA sequence
  source 1..20: mol_type = other DNA
ggttctcccagctttgctct

SEQ ID NO: 101075 - DNA, 20 bp, synthetic construct
  misc_feature 1..20: note = CRISPR gRNA sequence
  source 1..20: mol_type = other DNA
tcccagctttgctctgtaat

SEQ ID NO: 101076 - DNA, 20 bp, synthetic construct
  misc_feature 1..20: note = CRISPR gRNA sequence
  source 1..20: mol_type = other DNA
ccagctttgctctgtaatgc

SEQ ID NO: 101077 - DNA, 20 bp, synthetic construct
  misc_feature 1..20: note = CRISPR gRNA sequence
  source 1..20: mol_type = other DNA
tgctctgtaatgcaggtctc

SEQ ID NO: 101078 - DNA, 20 bp, synthetic construct
  misc_feature 1..20: note = CRISPR gRNA sequence
  source 1..20: mol_type = other DNA
gctctgtaatgcaggtctct

SEQ ID NO: 101079 - DNA, 20 bp, synthetic construct
  misc_feature 1..20: note = CRISPR gRNA sequence
  source 1..20: mol_type = other DNA
ctctgtaatgcaggtctctg

SEQ ID NO: 101080 - DNA, 20 bp, synthetic construct
  misc_feature 1..20: note = CRISPR gRNA sequence
  source 1..20: mol_type = other DNA
tgtaatgcaggtctctgcaa

SEQ ID NO: 101081 - DNA, 20 bp, synthetic construct
  misc_feature 1..20: note = CRISPR gRNA sequence
  source 1..20: mol_type = other DNA
taatgcaggtctctgcaagg

SEQ ID NO: 101082 - DNA, 20 bp, synthetic construct
  misc_feature 1..20: note = CRISPR gRNA sequence
  source 1..20: mol_type = other DNA
tgcaagggtccctgtttgtc

SEQ ID NO: 101083 - DNA, 20 bp, synthetic construct
  misc_feature 1..20: note = CRISPR gRNA sequence
  source 1..20: mol_type = other DNA
caagggtccctgtttgtccc

SEQ ID NO: 101084 - DNA, 20 bp, synthetic construct
  misc_feature 1..20: note = CRISPR gRNA sequence
  source 1..20: mol_type = other DNA
tttgtcccctaaggggagag

SEQ ID NO: 101085 - DNA, 20 bp, synthetic construct
  misc_feature 1..20: note = CRISPR gRNA sequence
  source 1..20: mol_type = other DNA
gtcccctaaggggagagcgc

SEQ ID NO: 101086 - DNA, 20 bp, synthetic construct
  misc_feature 1..20: note = CRISPR gRNA sequence
  source 1..20: mol_type = other DNA
tcccctaaggggagagcgca

SEQ ID NO: 101087 - DNA, 20 bp, synthetic construct
  misc_feature 1..20: note = CRISPR gRNA sequence
  source 1..20: mol_type = other DNA
aggggagagcgcaggttggc

SEQ ID NO: 101088 - DNA, 20 bp, synthetic construct
  misc_feature 1..20: note = CRISPR gRNA sequence
  source 1..20: mol_type = other DNA
gcctgtgcctccaccccact

SEQ ID NO: 101089 - DNA, 20 bp, synthetic construct
  misc_feature 1..20: note = CRISPR gRNA sequence
  source 1..20: mol_type = other DNA
tgcctccaccccactcccga

SEQ ID NO: 101090 - DNA, 20 bp, synthetic construct
  misc_feature 1..20: note = CRISPR gRNA sequence
  source 1..20: mol_type = other DNA
caccccactcccgattcaag

SEQ ID NO: 101091 - DNA, 20 bp, synthetic construct
  misc_feature 1..20: note = CRISPR gRNA sequence
  source 1..20: mol_type = other DNA
ccgattcaagctcacagccc

SEQ ID NO: 101092 - DNA, 20 bp, synthetic construct
  misc_feature 1..20: note = CRISPR gRNA sequence
  source 1..20: mol_type = other DNA
aagctcacagcccacctttt

SEQ ID NO: 101093 - DNA, 20 bp, synthetic construct
  misc_feature 1..20: note = CRISPR gRNA sequence
  source 1..20: mol_type = other DNA
acagcccaccttttccctgc

SEQ ID NO: 101094 - DNA, 20 bp, synthetic construct
  misc_feature 1..20: note = CRISPR gRNA sequence
  source 1..20: mol_type = other DNA
ttccctgccccatctcagtg

SEQ ID NO: 101095 - DNA, 20 bp, synthetic construct
  misc_feature 1..20: note = CRISPR gRNA sequence
  source 1..20: mol_type = other DNA
tccctgccccatctcagtgc

SEQ ID NO: 101096 - DNA, 20 bp, synthetic construct
  misc_feature 1..20: note = CRISPR gRNA sequence
  source 1..20: mol_type = other DNA
ccctgccccatctcagtgca

SEQ ID NO: 101097 - DNA, 20 bp, synthetic construct
  misc_feature 1..20: note = CRISPR gRNA sequence
  source 1..20: mol_type = other DNA
cctgccccatctcagtgcaa

SEQ ID NO: 101098 - DNA, 20 bp, synthetic construct
  misc_feature 1..20: note = CRISPR gRNA sequence
  source 1..20: mol_type = other DNA
ccccatctcagtgcaacagg

SEQ ID NO: 101099 - DNA, 20 bp, synthetic construct
  misc_feature 1..20: note = CRISPR gRNA sequence
  source 1..20: mol_type = other DNA
agtgcaacaggtgatcgaga

SEQ ID NO: 101100 - DNA, 20 bp, synthetic construct
  misc_feature 1..20: note = CRISPR gRNA sequence
  source 1..20: mol_type = other DNA
aagctcttccagagcaacct

SEQ ID NO: 101101 - DNA, 20 bp, synthetic construct
  misc_feature 1..20: note = CRISPR gRNA sequence
  source 1..20: mol_type = other DNA
ttccagagcaacctggtgcc

SEQ ID NO: 101102 - DNA, 20 bp, synthetic construct
  misc_feature 1..20: note = CRISPR gRNA sequence
  source 1..20: mol_type = other DNA
ccagagcaacctggtgcccg

SEQ ID NO: 101103 - DNA, 20 bp, synthetic construct
  misc_feature 1..20: note = CRISPR gRNA sequence
  source 1..20: mol_type = other DNA
cagagcaacctggtgcccgc

SEQ ID NO: 101104 - DNA, 20 bp, synthetic construct
  misc_feature 1..20: note = CRISPR gRNA sequence
  source 1..20: mol_type = other DNA
gtgcccgctgaccctgagtg

SEQ ID NO: 101105 - DNA, 20 bp, synthetic construct
  misc_feature 1..20: note = CRISPR gRNA sequence
  source 1..20: mol_type = other DNA
accctgagtgaaggccgcct

SEQ ID NO: 101106 - DNA, 20 bp, synthetic construct
  misc_feature 1..20: note = CRISPR gRNA sequence
  source 1..20: mol_type = other DNA
agtgaaggccgcctgccggg

SEQ ID NO: 101107 - DNA, 20 bp, synthetic construct
  misc_feature 1..20: note = CRISPR gRNA sequence
  source 1..20: mol_type = other DNA
ccggggactcagacactcag

SEQ ID NO: 101108 - DNA, 20 bp, synthetic construct
  misc_feature 1..20: note = CRISPR gRNA sequence
  source 1..20: mol_type = other DNA
agacactcagggaacaaaat

SEQ ID NO: 101109 - DNA, 20 bp, synthetic construct
  misc_feature 1..20: note = CRISPR gRNA sequence
  source 1..20: mol_type = other DNA
agggaacaaaatggtcagcc

SEQ ID NO: 101110 - DNA, 20 bp, synthetic construct
  misc_feature 1..20: note = CRISPR gRNA sequence
  source 1..20: mol_type = other DNA
gggaaacccagaactgactt

SEQ ID NO: 101111 - DNA, 20 bp, synthetic construct
  misc_feature 1..20: note = CRISPR gRNA sequence
  source 1..20: mol_type = other DNA
acttcaaaggcagcttctgg

SEQ ID NO: 101112 - DNA, 20 bp, synthetic construct
  misc_feature 1..20: note = CRISPR gRNA sequence
  source 1..20: mol_type = other DNA
caaaggcagcttctggacag

SEQ ID NO: 101113 - DNA, 20 bp, synthetic construct
  misc_feature 1..20: note = CRISPR gRNA sequence
  source 1..20: mol_type = other DNA
aaaggcagcttctggacagg

SEQ ID NO: 101114 - DNA, 20 bp, synthetic construct
  misc_feature 1..20: note = CRISPR gRNA sequence
  source 1..20: mol_type = other DNA
ctggacaggtggtgggaggg

SEQ ID NO: 101115 - DNA, 20 bp, synthetic construct
  misc_feature 1..20: note = CRISPR gRNA sequence
  source 1..20: mol_type = other DNA
tggacaggtggtgggagggg

SEQ ID NO: 101116 - DNA, 20 bp, synthetic construct
  misc_feature 1..20: note = CRISPR gRNA sequence
  source 1..20: mol_type = other DNA
gacaggtggtgggaggggac

SEQ ID NO: 101117 - DNA, 20 bp, synthetic construct
  misc_feature 1..20: note = CRISPR gRNA sequence
  source 1..20: mol_type = other DNA
cccaagaggaaccaataaac

SEQ ID NO: 101118 - DNA, 20 bp, synthetic construct
  misc_feature 1..20: note = CRISPR gRNA sequence
  source 1..20: mol_type = other DNA
ccaagaggaaccaataaacc

SEQ ID NO: 101119 - DNA, 20 bp, synthetic construct
  misc_feature 1..20: note = CRISPR gRNA sequence
  source 1..20: mol_type = other DNA
ctgtgcagaatgagggactt

SEQ ID NO: 101120 - DNA, 20 bp, synthetic construct
  misc_feature 1..20: note = CRISPR gRNA sequence
  source 1..20: mol_type = other DNA
tgtgcagaatgagggacttt

SEQ ID NO: 101121 - DNA, 20 bp, synthetic construct
  misc_feature 1..20: note = CRISPR gRNA sequence
  source 1..20: mol_type = other DNA
tgcagaatgagggactttgc

SEQ ID NO: 101122 - DNA, 20 bp, synthetic construct
  misc_feature 1..20: note = CRISPR gRNA sequence
  source 1..20: mol_type = other DNA
tgctgtgcttcccggagggc

SEQ ID NO: 101123 - DNA, 20 bp, synthetic construct
  misc_feature 1..20: note = CRISPR gRNA sequence
  source 1..20: mol_type = other DNA
gctgtgcttcccggagggct

SEQ ID NO: 101124 - DNA, 20 bp, synthetic construct
  misc_feature 1..20: note = CRISPR gRNA sequence
  source 1..20: mol_type = other DNA
ctgtgcttcccggagggctt

SEQ ID NO: 101125 - DNA, 20 bp, synthetic construct
  misc_feature 1..20: note = CRISPR gRNA sequence
  source 1..20: mol_type = other DNA
tgcttcccggagggcttcct

SEQ ID NO: 101126 - DNA, 20 bp, synthetic construct
  misc_feature 1..20: note = CRISPR gRNA sequence
  source 1..20: mol_type = other DNA
cccggagggcttcctggagg

SEQ ID NO: 101127 - DNA, 20 bp, synthetic construct
  misc_feature 1..20: note = CRISPR gRNA sequence
  source 1..20: mol_type = other DNA
ccggagggcttcctggagga

SEQ ID NO: 101128 - DNA, 20 bp, synthetic construct
  misc_feature 1..20: note = CRISPR gRNA sequence
  source 1..20: mol_type = other DNA
cctggaggagacagccccta

SEQ ID NO: 101129 - DNA, 20 bp, synthetic construct
  misc_feature 1..20: note = CRISPR gRNA sequence
  source 1..20: mol_type = other DNA
ctggaggagacagcccctag

SEQ ID NO: 101130 - DNA, 20 bp, synthetic construct
  misc_feature 1..20: note = CRISPR gRNA sequence
  source 1..20: mol_type = other DNA
gaggagacagcccctagagg

SEQ ID NO: 101131 - DNA, 20 bp, synthetic construct
  misc_feature 1..20: note = CRISPR gRNA sequence
  source 1..20: mol_type = other DNA
gaggtctcacaccttctccc

SEQ ID NO: 101132 - DNA, 20 bp, synthetic construct
  misc_feature 1..20: note = CRISPR gRNA sequence
  source 1..20: mol_type = other DNA
acaccttctccccaagcacc

SEQ ID NO: 101133 - DNA, 20 bp, synthetic construct
  misc_feature 1..20: note = CRISPR gRNA sequence
  source 1..20: mol_type = other DNA
ctccccaagcacccgcaggt

SEQ ID NO: 101134 - DNA, 20 bp, synthetic construct
  misc_feature 1..20: note = CRISPR gRNA sequence
  source 1..20: mol_type = other DNA
tccccaagcacccgcaggtg

SEQ ID NO: 101135 - DNA, 20 bp, synthetic construct
  misc_feature 1..20: note = CRISPR gRNA sequence
  source 1..20: mol_type = other DNA
cccaagcacccgcaggtggt

SEQ ID NO: 101136 - DNA, 20 bp, synthetic construct
  misc_feature 1..20: note = CRISPR gRNA sequence
  source 1..20: mol_type = other DNA
ccacctgcgggtgcttgggg

SEQ ID NO: 101137 - DNA, 20 bp, synthetic construct
  misc_feature 1..20: note = CRISPR gRNA sequence
  source 1..20: mol_type = other DNA
cgggtgcttggggagaaggt

SEQ ID NO: 101138 - DNA, 20 bp, synthetic construct
  misc_feature 1..20: note = CRISPR gRNA sequence
  source 1..20: mol_type = other DNA
ggggagaaggtgtgagacct

SEQ ID NO: 101139 - DNA, 20 bp, synthetic construct
  misc_feature 1..20: note = CRISPR gRNA sequence
  source 1..20: mol_type = other DNA
gggagaaggtgtgagacctc

SEQ ID NO: 101140 - DNA, 20 bp, synthetic construct
  misc_feature 1..20: note = CRISPR gRNA sequence
  source 1..20: mol_type = other DNA
taggggctgtctcctccagg

SEQ ID NO: 101141 - DNA, 20 bp, synthetic construct
  misc_feature 1..20: note = CRISPR gRNA sequence
  source 1..20: mol_type = other DNA
ggggctgtctcctccaggaa

SEQ ID NO: 101142 - DNA, 20 bp, synthetic construct
  misc_feature 1..20: note = CRISPR gRNA sequence
  source 1..20: mol_type = other DNA
tctcctccaggaagccctcc

SEQ ID NO: 101143 - DNA, 20 bp, synthetic construct
  misc_feature 1..20: note = CRISPR gRNA sequence
  source 1..20: mol_type = other DNA
ctccaggaagccctccggga

SEQ ID NO: 101144 - DNA, 20 bp, synthetic construct
  misc_feature 1..20: note = CRISPR gRNA sequence
  source 1..20: mol_type = other DNA
caggaagccctccgggaagc

SEQ ID NO: 101145 - DNA, 20 bp, synthetic construct
  misc_feature 1..20: note = CRISPR gRNA sequence
  source 1..20: mol_type = other DNA
cgggaagcacagcaaagtcc

SEQ ID NO: 101146 - DNA, 20 bp, synthetic construct
  misc_feature 1..20: note = CRISPR gRNA sequence
  source 1..20: mol_type = other DNA
attctgcacagaaggtttat

SEQ ID NO: 101147 - DNA, 20 bp, synthetic construct
  misc_feature 1..20: note = CRISPR gRNA sequence
  source 1..20: mol_type = other DNA
tgcacagaaggtttattggt

SEQ ID NO: 101148 - DNA, 20 bp, synthetic construct
  misc_feature 1..20: note = CRISPR gRNA sequence
  source 1..20: mol_type = other DNA
cacagaaggtttattggttc

SEQ ID NO: 101149 - DNA, 20 bp, synthetic construct
  misc_feature 1..20: note = CRISPR gRNA sequence
  source 1..20: mol_type = other DNA
attggttcctcttgggaagg

SEQ ID NO: 101150 - DNA, 20 bp, synthetic construct
  misc_feature 1..20: note = CRISPR gRNA sequence
  source 1..20: mol_type = other DNA
ttggttcctcttgggaaggg

SEQ ID NO: 101151 - DNA, 20 bp, synthetic construct
  misc_feature 1..20: note = CRISPR gRNA sequence
  source 1..20: mol_type = other DNA
gttcctcttgggaagggtcc

SEQ ID NO: 101152 - DNA, 20 bp, synthetic construct
  misc_feature 1..20: note = CRISPR gRNA sequence
  source 1..20: mol_type = other DNA
ctcttgggaagggtcccctc

SEQ ID NO: 101153 - DNA, 20 bp, synthetic construct
  misc_feature 1..20: note = CRISPR gRNA sequence
  source 1..20: mol_type = other DNA
ttgggaagggtcccctccca

SEQ ID NO: 101154 - DNA, 20 bp, synthetic construct
  misc_feature 1..20: note = CRISPR gRNA sequence
  source 1..20: mol_type = other DNA
gggaagggtcccctcccacc

SEQ ID NO: 101155 - DNA, 20 bp, synthetic construct
  misc_feature 1..20: note = CRISPR gRNA sequence
  source 1..20: mol_type = other DNA
ggaagggtcccctcccacca

SEQ ID NO: 101156 - DNA, 20 bp, synthetic construct
  misc_feature 1..20: note = CRISPR gRNA sequence
  source 1..20: mol_type = other DNA
ccaccacctgtccagaagct

SEQ ID NO: 101157 - DNA, 20 bp, synthetic construct
  misc_feature 1..20: note = CRISPR gRNA sequence
  source 1..20: mol_type = other DNA
tccagaagctgcctttgaag

SEQ ID NO: 101158 - DNA, 20 bp, synthetic construct
  misc_feature 1..20: note = CRISPR gRNA sequence
  source 1..20: mol_type = other DNA
cctttgaagtcagttctggg

SEQ ID NO: 101159 - DNA, 20 bp, synthetic construct
  misc_feature 1..20: note = CRISPR gRNA sequence
  source 1..20: mol_type = other DNA
tgaagtcagttctgggtttc

SEQ ID NO: 101160 - DNA, 20 bp, synthetic construct
  misc_feature 1..20: note = CRISPR gRNA sequence
  source 1..20: mol_type = other DNA
gaagtcagttctgggtttcc

SEQ ID NO: 101161 - DNA, 20 bp, synthetic construct
  misc_feature 1..20: note = CRISPR gRNA sequence
  source 1..20: mol_type = other DNA
aagtcagttctgggtttccc

SEQ ID NO: 101162 - DNA, 20 bp, synthetic construct
  misc_feature 1..20: note = CRISPR gRNA sequence
  source 1..20: mol_type = other DNA
tgggtttccccagctctggc

SEQ ID NO: 101163 - DNA, 20 bp, synthetic construct
  misc_feature 1..20: note = CRISPR gRNA sequence
  source 1..20: mol_type = other DNA
ggtttccccagctctggctg

SEQ ID NO: 101164 - DNA, 20 bp, synthetic construct
  misc_feature 1..20: note = CRISPR gRNA sequence
  source 1..20: mol_type = other DNA
ccccagctctggctgaccat

SEQ ID NO: 101165 - DNA, 20 bp, synthetic construct
  misc_feature 1..20: note = CRISPR gRNA sequence
  source 1..20: mol_type = other DNA
cccagctctggctgaccatt

SEQ ID NO: 101166 - DNA, 20 bp, synthetic construct
  misc_feature 1..20: note = CRISPR gRNA sequence
  source 1..20: mol_type = other DNA
tggctgaccattttgttccc

SEQ ID NO: 101167 - DNA, 20 bp, synthetic construct
  misc_feature 1..20: note = CRISPR gRNA sequence
  source 1..20: mol_type = other DNA
gctgaccattttgttccctg

SEQ ID NO: 101168 - DNA, 20 bp, synthetic construct
  misc_feature 1..20: note = CRISPR gRNA sequence
  source 1..20: mol_type = other DNA
accattttgttccctgagtg

SEQ ID NO: 101169 - DNA, 20 bp, synthetic construct
  misc_feature 1..20: note = CRISPR gRNA sequence
  source 1..20: mol_type = other DNA
tgttccctgagtgtctgagt

SEQ ID NO: 101170 - DNA, 20 bp, synthetic construct
  misc_feature 1..20: note = CRISPR gRNA sequence
  source 1..20: mol_type = other DNA
gttccctgagtgtctgagtc

SEQ ID NO: 101171 - DNA, 20 bp, synthetic construct
  misc_feature 1..20: note = CRISPR gRNA sequence
  source 1..20: mol_type = other DNA
ttccctgagtgtctgagtcc

SEQ ID NO: 101172 - DNA, 20 bp, synthetic construct
  misc_feature 1..20: note = CRISPR gRNA sequence
  source 1..20: mol_type = other DNA
cctgagtgtctgagtccccg

SEQ ID NO: 101173 - DNA, 20 bp, synthetic construct
  misc_feature 1..20: note = CRISPR gRNA sequence
  source 1..20: mol_type = other DNA
agtgtctgagtccccggcag

SEQ ID NO: 101174 - DNA, 20 bp, synthetic construct
  misc_feature 1..20: note = CRISPR gRNA sequence
  source 1..20: mol_type = other DNA
agtccccggcaggcggcctt

SEQ ID NO: 101175 - DNA, 20 bp, synthetic construct
  misc_feature 1..20: note = CRISPR gRNA sequence
  source 1..20: mol_type = other DNA
cactcagggtcagcgggcac

SEQ ID NO: 101176 - DNA, 20 bp, synthetic construct
  misc_feature 1..20: note = CRISPR gRNA sequence
  source 1..20: mol_type = other DNA
actcagggtcagcgggcacc

SEQ ID NO: 101177 - DNA, 20 bp, synthetic construct
  misc_feature 1..20: note = CRISPR gRNA sequence
  source 1..20: mol_type = other DNA
agggtcagcgggcaccaggt

SEQ ID NO: 101178 - DNA, 20 bp, synthetic construct
  misc_feature 1..20: note = CRISPR gRNA sequence
  source 1..20: mol_type = other DNA
ctctggaagagcttgaggat

SEQ ID NO: 101179 - DNA, 20 bp, synthetic construct
  misc_feature 1..20: note = CRISPR gRNA sequence
  source 1..20: mol_type = other DNA
tggaagagcttgaggatgtg

SEQ ID NO: 101180 - DNA, 20 bp, synthetic construct
  misc_feature 1..20: note = CRISPR gRNA sequence
  source 1..20: mol_type = other DNA
gaagagcttgaggatgtggt

SEQ ID NO: 101181 - DNA, 20 bp, synthetic construct
  misc_feature 1..20: note = CRISPR gRNA sequence
  source 1..20: mol_type = other DNA
gaggatgtggttctcgatca

SEQ ID NO: 101182 - DNA, 20 bp, synthetic construct
  misc_feature 1..20: note = CRISPR gRNA sequence
  source 1..20: mol_type = other DNA
aggatgtggttctcgatcac

SEQ ID NO: 101183 - DNA, 20 bp, synthetic construct
  misc_feature 1..20: note = CRISPR gRNA sequence
  source 1..20: mol_type = other DNA
tcgatcacctgttgcactga

SEQ ID NO: 101184 - DNA, 20 bp, synthetic construct
  misc_feature 1..20: note = CRISPR gRNA sequence
  source 1..20: mol_type = other DNA
gatcacctgttgcactgaga

SEQ ID NO: 101185 - DNA, 20 bp, synthetic construct
  misc_feature 1..20: note = CRISPR gRNA sequence
  source 1..20: mol_type = other DNA
ttgcactgagatggggcagg

SEQ ID NO: 101186 - DNA, 20 bp, synthetic construct
  misc_feature 1..20: note = CRISPR gRNA sequence
  source 1..20: mol_type = other DNA
cactgagatggggcagggaa

SEQ ID NO: 101187 - DNA, 20 bp, synthetic construct
  misc_feature 1..20: note = CRISPR gRNA sequence
  source 1..20: mol_type = other DNA
agatggggcagggaaaaggt

SEQ ID NO: 101188 - DNA, 20 bp, synthetic construct
  misc_feature 1..20: note = CRISPR gRNA sequence
  source 1..20: mol_type = other DNA
tgagcttgaatcgggagtgg

SEQ ID NO: 101189 - DNA, 20 bp, synthetic construct
  misc_feature 1..20: note = CRISPR gRNA sequence
  source 1..20: mol_type = other DNA
gaatcgggagtggggtggag

SEQ ID NO: 101190 - DNA, 20 bp, synthetic construct
  misc_feature 1..20: note = CRISPR gRNA sequence
  source 1..20: mol_type = other DNA
aatcgggagtggggtggagg

SEQ ID NO: 101191 - DNA, 20 bp, synthetic construct
  misc_feature 1..20: note = CRISPR gRNA sequence
  source 1..20: mol_type = other DNA
cgctctccccttaggggaca

SEQ ID NO: 101192 - DNA, 20 bp, synthetic construct
  misc_feature 1..20: note = CRISPR gRNA sequence
  source 1..20: mol_type = other DNA
tccccttaggggacaaacag

SEQ ID NO: 101193 - DNA, 20 bp, synthetic construct
  misc_feature 1..20: note = CRISPR gRNA sequence
  source 1..20: mol_type = other DNA
cccttaggggacaaacaggg

SEQ ID NO: 101194 - DNA, 20 bp, synthetic construct
  misc_feature 1..20: note = CRISPR gRNA sequence
  source 1..20: mol_type = other DNA
aggggacaaacagggaccct

SEQ ID NO: 101195 - DNA, 20 bp, synthetic construct
  misc_feature 1..20: note = CRISPR gRNA sequence
  source 1..20: mol_type = other DNA
ggggacaaacagggaccctt

SEQ ID NO: 101196 - DNA, 20 bp, synthetic construct
  misc_feature 1..20: note = CRISPR gRNA sequence
  source 1..20: mol_type = other DNA
gcagagacctgcattacaga

SEQ ID NO: 101197 - DNA, 20 bp, synthetic construct
  misc_feature 1..20: note = CRISPR gRNA sequence
  source 1..20: mol_type = other DNA
cagagacctgcattacagag

SEQ ID NO: 101198 - DNA, 20 bp, synthetic construct
  misc_feature 1..20: note = CRISPR gRNA sequence
  source 1..20: mol_type = other DNA
cattacagagcaaagctggg

SEQ ID NO: 101199 - DNA, 20 bp, synthetic construct
  misc_feature 1..20: note = CRISPR gRNA sequence
  source 1..20: mol_type = other DNA
cagagcaaagctgggagaac

SEQ ID NO: 101200 - DNA, 20 bp, synthetic construct
  misc_feature 1..20: note = CRISPR gRNA sequence
  source 1..20: mol_type = other DNA
ggagaaccgaggactcaccc

SEQ ID NO: 101201 - DNA, 20 bp, synthetic construct
  misc_feature 1..20: note = CRISPR gRNA sequence
  source 1..20: mol_type = other DNA
accccaggaacctcaacttc

SEQ ID NO: 101202 - DNA, 20 bp, synthetic construct
  misc_feature 1..20: note = CRISPR gRNA sequence
  source 1..20: mol_type = other DNA
aacttcccctaagtttgtaa

SEQ ID NO: 101203 - DNA, 20 bp, synthetic construct
  misc_feature 1..20: note = CRISPR gRNA sequence
  source 1..20: mol_type = other DNA
cccctaagtttgtaaaaatg

SEQ ID NO: 101204 - DNA, 20 bp, synthetic construct
  misc_feature 1..20: note = CRISPR gRNA sequence
  source 1..20: mol_type = other DNA
ccctaagtttgtaaaaatgc

SEQ ID NO: 101205 - DNA, 20 bp, synthetic construct
  misc_feature 1..20: note = CRISPR gRNA sequence
  source 1..20: mol_type = other DNA
agtttgtaaaaatgcacttt

SEQ ID NO: 101206 - DNA, 20 bp, synthetic construct
  misc_feature 1..20: note = CRISPR gRNA sequence
  source 1..20: mol_type = other DNA
gtaaaaatgcacttttgtag

SEQ ID NO: 101207 - DNA, 20 bp, synthetic construct
  misc_feature 1..20: note = CRISPR gRNA sequence
  source 1..20: mol_type = other DNA
taaaaatgcacttttgtagc

SEQ ID NO: 101208 - DNA, 20 bp, synthetic construct
  misc_feature 1..20: note = CRISPR gRNA sequence
  source 1..20: mol_type = other DNA
ttgtagcttttcagaattaa

SEQ ID NO: 101209 - DNA, 20 bp, synthetic construct
  misc_feature 1..20: note = CRISPR gRNA sequence
  source 1..20: mol_type = other DNA
tgtagcttttcagaattaat

SEQ ID NO: 101210 - DNA, 20 bp, synthetic construct
  misc_feature 1..20: note = CRISPR gRNA sequence
  source 1..20: mol_type = other DNA
gtagcttttcagaattaata

SEQ ID NO: 101211 - DNA, 20 bp, synthetic construct
  misc_feature 1..20: note = CRISPR gRNA sequence
  source 1..20: mol_type = other DNA
tagcttttcagaattaatat

SEQ ID NO: 101212 - DNA, 20 bp, synthetic construct
  misc_feature 1..20: note = CRISPR gRNA sequence
  source 1..20: mol_type = other DNA
ttcagaattaatataaaaat

SEQ ID NO: 101213 - DNA, 20 bp, synthetic construct
  misc_feature 1..20: note = CRISPR gRNA sequence
  source 1..20: mol_type = other DNA
tcagaattaatataaaaata

SEQ ID NO: 101214 - DNA, 20 bp, synthetic construct
  misc_feature 1..20: note = CRISPR gRNA sequence
  source 1..20: mol_type = other DNA
cagaattaatataaaaatat

SEQ ID NO: 101215 - DNA, 20 bp, synthetic construct
  misc_feature 1..20: note = CRISPR gRNA sequence
  source 1..20: mol_type = other DNA
agaattaatataaaaatatt

SEQ ID NO: 101216 - DNA, 20 bp, synthetic construct
  misc_feature 1..20: note = CRISPR gRNA sequence
  source 1..20: mol_type = other DNA
atataaaaatatttcctacc

SEQ ID NO: 101217 - DNA, 20 bp, synthetic construct
  misc_feature 1..20: note = CRISPR gRNA sequence
  source 1..20: mol_type = other DNA
cctaccaagcaaaatgtgtg

SEQ ID NO: 101218 - DNA, 20 bp, synthetic construct
  misc_feature 1..20: note = CRISPR gRNA sequence
  source 1..20: mol_type = other DNA
ctaccaagcaaaatgtgtga

SEQ ID NO: 101219 - DNA, 20 bp, synthetic construct
  misc_feature 1..20: note = CRISPR gRNA sequence
  source 1..20: mol_type = other DNA
ccaagcaaaatgtgtgaatt

SEQ ID NO: 101220 - DNA, 20 bp, synthetic construct
  misc_feature 1..20: note = CRISPR gRNA sequence
  source 1..20: mol_type = other DNA
tgactttcatgaaaagatga

SEQ ID NO: 101221 - DNA, 20 bp, synthetic construct
  misc_feature 1..20: note = CRISPR gRNA sequence
  source 1..20: mol_type = other DNA
tcatgaaaagatgagcctgg

SEQ ID NO: 101222 - DNA, 20 bp, synthetic construct
  misc_feature 1..20: note = CRISPR gRNA sequence
  source 1..20: mol_type = other DNA
catgaaaagatgagcctggg

SEQ ID NO: 101223 - DNA, 20 bp, synthetic construct
  misc_feature 1..20: note = CRISPR gRNA sequence
  source 1..20: mol_type = other DNA
atgaaaagatgagcctgggc

SEQ ID NO: 101224 - DNA, 20 bp, synthetic construct
  misc_feature 1..20: note = CRISPR gRNA sequence
  source 1..20: mol_type = other DNA
ggcatggtggctcacaccta

SEQ ID NO: 101225 - DNA, 20 bp, synthetic construct
  misc_feature 1..20: note = CRISPR gRNA sequence
  source 1..20: mol_type = other DNA
acacctataatcccagcact

SEQ ID NO: 101226 - DNA, 20 bp, synthetic construct
  misc_feature 1..20: note = CRISPR gRNA sequence
  source 1..20: mol_type = other DNA
taatcccagcactttgggag

SEQ ID NO: 101227 - DNA, 20 bp, synthetic construct
  misc_feature 1..20: note = CRISPR gRNA sequence
  source 1..20: mol_type = other DNA
tgggaggtccagtggggagg

SEQ ID NO: 101228 - DNA, 20 bp, synthetic construct
  misc_feature 1..20: note = CRISPR gRNA sequence
  source 1..20: mol_type = other DNA
gggaggtccagtggggagga

SEQ ID NO: 101229 - DNA, 20 bp, synthetic construct
  misc_feature 1..20: note = CRISPR gRNA sequence
  source 1..20: mol_type = other DNA
ggaggtccagtggggaggac

SEQ ID NO: 101230 - DNA, 20 bp, synthetic construct
  misc_feature 1..20: note = CRISPR gRNA sequence
  source 1..20: mol_type = other DNA
cttgagctcaggaatttgag

SEQ ID NO: 101231 - DNA, 20 bp, synthetic construct
  misc_feature 1..20: note = CRISPR gRNA sequence
  source 1..20: mol_type = other DNA
gagctcaggaatttgaggcc

SEQ ID NO: 101232 - DNA, 20 bp, synthetic construct
  misc_feature 1..20: note = CRISPR gRNA sequence
  source 1..20: mol_type = other DNA
agctcaggaatttgaggcca

SEQ ID NO: 101233 - DNA, 20 bp, synthetic construct
  misc_feature 1..20: note = CRISPR gRNA sequence
  source 1..20: mol_type = other DNA
aggaatttgaggccagcttg

SEQ ID NO: 101234 - DNA, 20 bp, synthetic construct
  misc_feature 1..20: note = CRISPR gRNA sequence
  source 1..20: mol_type = other DNA
gaggccagcttgggcaacag

SEQ ID NO: 101235 - DNA, 20 bp, synthetic construct
  misc_feature 1..20: note = CRISPR gRNA sequence
  source 1..20: mol_type = other DNA
aggccagcttgggcaacaga

SEQ ID NO: 101236 - DNA, 20 bp, synthetic construct
  misc_feature 1..20: note = CRISPR gRNA sequence
  source 1..20: mol_type = other DNA
gggcaacagagcaaaacgct

SEQ ID NO: 101237 - DNA, 20 bp, synthetic construct
  misc_feature 1..20: note = CRISPR gRNA sequence
  source 1..20: mol_type = other DNA
ggcaacagagcaaaacgctg

SEQ ID NO: 101238 - DNA, 20 bp, synthetic construct
  misc_feature 1..20: note = CRISPR gRNA sequence
  source 1..20: mol_type = other DNA
tctctaccaaaaaaatttaa

SEQ ID NO: 101239 - DNA, 20 bp, synthetic construct
  misc_feature 1..20: note = CRISPR gRNA sequence
  source 1..20: mol_type = other DNA
taccaaaaaaatttaaaaat

SEQ ID NO: 101240 - DNA, 20 bp, synthetic construct
  misc_feature 1..20: note = CRISPR gRNA sequence
  source 1..20: mol_type = other DNA
ccaaaaaaatttaaaaatta

SEQ ID NO: 101241 - DNA, 20 bp, synthetic construct
  misc_feature 1..20: note = CRISPR gRNA sequence
  source 1..20: mol_type = other DNA
aaaaattaggctgggcttgg

SEQ ID NO: 101242 - DNA, 20 bp, synthetic construct
  misc_feature 1..20: note = CRISPR gRNA sequence
  source 1..20: mol_type = other DNA
aaaattaggctgggcttggt

SEQ ID NO: 101243 - DNA, 20 bp, synthetic construct
  misc_feature 1..20: note = CRISPR gRNA sequence
  source 1..20: mol_type = other DNA
ggctgggcttggtggctcac

SEQ ID NO: 101244 - DNA, 20 bp, synthetic construct
  misc_feature 1..20: note = CRISPR gRNA sequence
  source 1..20: mol_type = other DNA
ggcttggtggctcacacctg

SEQ ID NO: 101245 - DNA, 20 bp, synthetic construct
  misc_feature 1..20: note = CRISPR gRNA sequence
  source 1..20: mol_type = other DNA
ggtggctcacacctgtaatc

SEQ ID NO: 101246 - DNA, 20 bp, synthetic construct
  misc_feature 1..20: note = CRISPR gRNA sequence
  source 1..20: mol_type = other DNA
gtggctcacacctgtaatcc

SEQ ID NO: 101247 - DNA, 20 bp, synthetic construct
  misc_feature 1..20: note = CRISPR gRNA sequence
  source 1..20: mol_type = other DNA
acacctgtaatcctagcact

SEQ ID NO: 101248 - DNA, 20 bp, synthetic construct
  misc_feature 1..20: note = CRISPR gRNA sequence
  source 1..20: mol_type = other DNA
taatcctagcactttgggag

SEQ ID NO: 101249 - DNA, 20 bp, synthetic construct
  misc_feature 1..20: note = CRISPR gRNA sequence
  source 1..20: mol_type = other DNA
gcactttgggaggccaaggt

SEQ ID NO: 101250 - DNA, 20 bp, synthetic construct
  misc_feature 1..20: note = CRISPR gRNA sequence
  source 1..20: mol_type = other DNA
tgggaggccaaggtaggtgg

SEQ ID NO: 101251 - DNA, 20 bp, synthetic construct
  misc_feature 1..20: note = CRISPR gRNA sequence
  source 1..20: mol_type = other DNA
gggaggccaaggtaggtgga

SEQ ID NO: 101252 - DNA, 20 bp, synthetic construct
  misc_feature 1..20: note = CRISPR gRNA sequence
  source 1..20: mol_type = other DNA
ggaggccaaggtaggtggat

SEQ ID NO: 101253 - DNA, 20 bp, synthetic construct
  misc_feature 1..20: note = CRISPR gRNA sequence
  source 1..20: mol_type = other DNA
gaagtcaggaaaggccagcc

SEQ ID NO: 101254 - DNA, 20 bp, synthetic construct
  misc_feature 1..20: note = CRISPR gRNA sequence
  source 1..20: mol_type = other DNA
aagtcaggaaaggccagcct

SEQ ID NO: 101255 - DNA, 20 bp, synthetic construct
  misc_feature 1..20: note = CRISPR gRNA sequence
  source 1..20: mol_type = other DNA
accaacatgatgaaacccca

SEQ ID NO: 101256 - DNA, 20 bp, synthetic construct
  misc_feature 1..20: note = CRISPR gRNA sequence
  source 1..20: mol_type = other DNA
tactaaaactacaaaaatta

SEQ ID NO: 101257 - DNA, 20 bp, synthetic construct
  misc_feature 1..20: note = CRISPR gRNA sequence
  source 1..20: mol_type = other DNA
ctaaaactacaaaaattagc

SEQ ID NO: 101258 - DNA, 20 bp, synthetic construct
  misc_feature 1..20: note = CRISPR gRNA sequence
  source 1..20: mol_type = other DNA
aaactacaaaaattagccag

SEQ ID NO: 101259 - DNA, 20 bp, synthetic construct
  misc_feature 1..20: note = CRISPR gRNA sequence
  source 1..20: mol_type = other DNA
caaaaattagccaggtgcag

SEQ ID NO: 101260 - DNA, 20 bp, synthetic construct
  misc_feature 1..20: note = CRISPR gRNA sequence
  source 1..20: mol_type = other DNA
gccaggtgcagccgggtgtg

SEQ ID NO: 101261 - DNA, 20 bp, synthetic construct
  misc_feature 1..20: note = CRISPR gRNA sequence
  source 1..20: mol_type = other DNA
atgcctgtaatcccagcact

SEQ ID NO: 101262 - DNA, 20 bp, synthetic construct
  misc_feature 1..20: note = CRISPR gRNA sequence
  source 1..20: mol_type = other DNA
taatcccagcactttgggaa

SEQ ID NO: 101263 - DNA, 20 bp, synthetic construct
  misc_feature 1..20: note = CRISPR gRNA sequence
  source 1..20: mol_type = other DNA
tgggaagctgaggcgggtgg

SEQ ID NO: 101264 - DNA, 20 bp, synthetic construct
  misc_feature 1..20: note = CRISPR gRNA sequence
  source 1..20: mol_type = other DNA
gggaagctgaggcgggtgga

SEQ ID NO: 101265 - DNA, 20 bp, synthetic construct
  misc_feature 1..20: note = CRISPR gRNA sequence
  source 1..20: mol_type = other DNA
ggaagctgaggcgggtggat

SEQ ID NO: 101266 - DNA, 20 bp, synthetic construct
  misc_feature 1..20: note = CRISPR gRNA sequence
  source 1..20: mol_type = other DNA
aggcgggtggatcacctgag

SEQ ID NO: 101267 - DNA, 20 bp, synthetic construct
  misc_feature 1..20: note = CRISPR gRNA sequence
  source 1..20: mol_type = other DNA
aggtcgggagtttgagatca

SEQ ID NO: 101268 - DNA, 20 bp, synthetic construct
  misc_feature 1..20: note = CRISPR gRNA sequence
  source 1..20: mol_type = other DNA
gagatcacctgaccaacatg

SEQ ID NO: 101269 - DNA, 20 bp, synthetic construct
  misc_feature 1..20: note = CRISPR gRNA sequence
  source 1..20: mol_type = other DNA
agatcacctgaccaacatgg

SEQ ID NO: 101270 - DNA, 20 bp, synthetic construct
  misc_feature 1..20: note = CRISPR gRNA sequence
  source 1..20: mol_type = other DNA
accaacatggagaaaccctg

SEQ ID NO: 101271 - DNA, 20 bp, synthetic construct
  misc_feature 1..20: note = CRISPR gRNA sequence
  source 1..20: mol_type = other DNA
actctactaaaaatgcaaaa

SEQ ID NO: 101272 - DNA, 20 bp, synthetic construct
  misc_feature 1..20: note = CRISPR gRNA sequence
  source 1..20: mol_type = other DNA
tactaaaaatgcaaaaaatt

SEQ ID NO: 101273 - DNA, 20 bp, synthetic construct
  misc_feature 1..20: note = CRISPR gRNA sequence
  source 1..20: mol_type = other DNA
ctaaaaatgcaaaaaattag

SEQ ID NO: 101274 - DNA, 20 bp, synthetic construct
  misc_feature 1..20: note = CRISPR gRNA sequence
  source 1..20: mol_type = other DNA
aaaatgcaaaaaattagttg

SEQ ID NO: 101275 - DNA, 20 bp, synthetic construct
  misc_feature 1..20: note = CRISPR gRNA sequence
  source 1..20: mol_type = other DNA
gttgggcatggtggtgcatg

SEQ ID NO: 101276 - DNA, 20 bp, synthetic construct
  misc_feature 1..20: note = CRISPR gRNA sequence
  source 1..20: mol_type = other DNA
ggcatggtggtgcatgcctg

SEQ ID NO: 101277 - DNA, 20 bp, synthetic construct
  misc_feature 1..20: note = CRISPR gRNA sequence
  source 1..20: mol_type = other DNA
taatcccagctacttgggag

SEQ ID NO: 101278 - DNA, 20 bp, synthetic construct
  misc_feature 1..20: note = CRISPR gRNA sequence
  source 1..20: mol_type = other DNA
cttgggaggctgaggcagga

SEQ ID NO: 101279 - DNA, 20 bp, synthetic construct
  misc_feature 1..20: note = CRISPR gRNA sequence
  source 1..20: mol_type = other DNA
gggaggctgaggcaggagaa

SEQ ID NO: 101280 - DNA, 20 bp, synthetic construct
  misc_feature 1..20: note = CRISPR gRNA sequence
  source 1..20: mol_type = other DNA
ggaggctgaggcaggagaat

SEQ ID NO: 101281 - DNA, 20 bp, synthetic construct
  misc_feature 1..20: note = CRISPR gRNA sequence
  source 1..20: mol_type = other DNA
aggcaggagaattgcttgaa

SEQ ID NO: 101282 - DNA, 20 bp, synthetic construct
  misc_feature 1..20: note = CRISPR gRNA sequence
  source 1..20: mol_type = other DNA
cttgaacctgggaggcggaa

SEQ ID NO: 101283 - DNA, 20 bp, synthetic construct
  misc_feature 1..20: note = CRISPR gRNA sequence
  source 1..20: mol_type = other DNA
gaacctgggaggcggaagtt

SEQ ID NO: 101284 - DNA, 20 bp, synthetic construct
  misc_feature 1..20: note = CRISPR gRNA sequence
  source 1..20: mol_type = other DNA
aacctgggaggcggaagttg

SEQ ID NO: 101285 - DNA, 20 bp, synthetic construct
  misc_feature 1..20: note = CRISPR gRNA sequence
  source 1..20: mol_type = other DNA
ggaggcggaagttgcagtga

SEQ ID NO: 101286 - DNA, 20 bp, synthetic construct
  misc_feature 1..20: note = CRISPR gRNA sequence
  source 1..20: mol_type = other DNA
cagtgagccgagatcacgcc

SEQ ID NO: 101287 - DNA, 20 bp, synthetic construct
  misc_feature 1..20: note = CRISPR gRNA sequence
  source 1..20: mol_type = other DNA
cagcctgggcaacaagagcg

SEQ ID NO: 101288 - DNA, 20 bp, synthetic construct
  misc_feature 1..20: note = CRISPR gRNA sequence
  source 1..20: mol_type = other DNA
ggcaacaagagcgaaactcc

SEQ ID NO: 101289 - DNA, 20 bp, synthetic construct
  misc_feature 1..20: note = CRISPR gRNA sequence
  source 1..20: mol_type = other DNA
catctcaaaaaaaaaaaaaa

SEQ ID NO: 101290 - DNA, 20 bp, synthetic construct
  misc_feature 1..20: note = CRISPR gRNA sequence
  source 1..20: mol_type = other DNA
aaaaaaaaaaaaaaaaaaaa

SEQ ID NO: 101291 - DNA, 20 bp, synthetic construct
  misc_feature 1..20: note = CRISPR gRNA sequence
  source 1..20: mol_type = other DNA
gccaggtgtggtggcaggca

SEQ ID NO: 101292 - DNA, 20 bp, synthetic construct
  misc_feature 1..20: note = CRISPR gRNA sequence
  source 1..20: mol_type = other DNA
gtaatcccagctattcagga

SEQ ID NO: 101293 - DNA, 20 bp, synthetic construct
  misc_feature 1..20: note = CRISPR gRNA sequence
  source 1..20: mol_type = other DNA
taatcccagctattcaggag

SEQ ID NO: 101294 - DNA, 20 bp, synthetic construct
  misc_feature 1..20: note = CRISPR gRNA sequence
  source 1..20: mol_type = other DNA
ttcaggaggctgaggcagga

SEQ ID NO: 101295 - DNA, 20 bp, synthetic construct
  misc_feature 1..20: note = CRISPR gRNA sequence
  source 1..20: mol_type = other DNA
aggaggctgaggcaggagaa

SEQ ID NO: 101296 - DNA, 20 bp, synthetic construct
  misc_feature 1..20: note = CRISPR gRNA sequence
  source 1..20: mol_type = other DNA
aggcaggagaattgtttgcc

SEQ ID NO: 101297 - DNA, 20 bp, synthetic construct
  misc_feature 1..20: note = CRISPR gRNA sequence
  source 1..20: mol_type = other DNA
tttgcctgggaggcagaggt

SEQ ID NO: 101298 - DNA, 20 bp, synthetic construct
  misc_feature 1..20: note = CRISPR gRNA sequence
  source 1..20: mol_type = other DNA
gcctgggaggcagaggttgc

SEQ ID NO: 101299 - DNA, 20 bp, synthetic construct
  misc_feature 1..20: note = CRISPR gRNA sequence
  source 1..20: mol_type = other DNA
cctgggaggcagaggttgca

SEQ ID NO: 101300 - DNA, 20 bp, synthetic construct
  misc_feature 1..20: note = CRISPR gRNA sequence
  source 1..20: mol_type = other DNA
ggaggcagaggttgcagtga

SEQ ID NO: 101301 - DNA, 20 bp, synthetic construct
  misc_feature 1..20: note = CRISPR gRNA sequence
  source 1..20: mol_type = other DNA
cagtgagccgagattgtgcc

SEQ ID NO: 101302 - DNA, 20 bp, synthetic construct
  misc_feature 1..20: note = CRISPR gRNA sequence
  source 1..20: mol_type = other DNA
tgccactgcactccagcctg

SEQ ID NO: 101303 - DNA, 20 bp, synthetic construct
  misc_feature 1..20: note = CRISPR gRNA sequence
  source 1..20: mol_type = other DNA
cactccagcctgggtgacag

SEQ ID NO: 101304 - DNA, 20 bp, synthetic construct
  misc_feature 1..20: note = CRISPR gRNA sequence
  source 1..20: mol_type = other DNA
cagcctgggtgacagagcga

SEQ ID NO: 101305 - DNA, 20 bp, synthetic construct
  misc_feature 1..20: note = CRISPR gRNA sequence
  source 1..20: mol_type = other DNA
ggtgacagagcgagactctg

SEQ ID NO: 101306 - DNA, 20 bp, synthetic construct
  misc_feature 1..20: note = CRISPR gRNA sequence
  source 1..20: mol_type = other DNA
tgtctcaaaaaataaataaa

SEQ ID NO: 101307 - DNA, 20 bp, synthetic construct
  misc_feature 1..20: note = CRISPR gRNA sequence
  source 1..20: mol_type = other DNA
tctcaaaaaataaataaaaa

SEQ ID NO: 101308 - DNA, 20 bp, synthetic construct
  misc_feature 1..20: note = CRISPR gRNA sequence
  source 1..20: mol_type = other DNA
aaaaaataaataaaaaagat

SEQ ID NO: 101309 - DNA, 20 bp, synthetic construct
  misc_feature 1..20: note = CRISPR gRNA sequence
  source 1..20: mol_type = other DNA
taaaaattagctgggtagag

SEQ ID NO: 101310 - DNA, 20 bp, synthetic construct
  misc_feature 1..20: note = CRISPR gRNA sequence
  source 1..20: mol_type = other DNA
aaaaattagctgggtagagt

SEQ ID NO: 101311 - DNA, 20 bp, synthetic construct
  misc_feature 1..20: note = CRISPR gRNA sequence
  source 1..20: mol_type = other DNA
aaaattagctgggtagagtg

SEQ ID NO: 101312 - DNA, 20 bp, synthetic construct
  misc_feature 1..20: note = CRISPR gRNA sequence
  source 1..20: mol_type = other DNA
gctgggtagagtggtacatg

SEQ ID NO: 101313 - DNA, 20 bp, synthetic construct
  misc_feature 1..20: note = CRISPR gRNA sequence
  source 1..20: mol_type = other DNA
ggtagagtggtacatgcctg

SEQ ID NO: 101314 - DNA, 20 bp, synthetic construct
  misc_feature 1..20: note = CRISPR gRNA sequence
  source 1..20: mol_type = other DNA
tagtcccagctactcaggag

SEQ ID NO: 101315 - DNA, 20 bp, synthetic construct
  misc_feature 1..20: note = CRISPR gRNA sequence
  source 1..20: mol_type = other DNA
ctcaggaggctggggaagaa

SEQ ID NO: 101316 - DNA, 20 bp, synthetic construct
  misc_feature 1..20: note = CRISPR gRNA sequence
  source 1..20: mol_type = other DNA
aggaggctggggaagaagga

SEQ ID NO: 101317 - DNA, 20 bp, synthetic construct
  misc_feature 1..20: note = CRISPR gRNA sequence
  source 1..20: mol_type = other DNA
gggaagaaggatcacttgag

SEQ ID NO: 101318 - DNA, 20 bp, synthetic construct
  misc_feature 1..20: note = CRISPR gRNA sequence
  source 1..20: mol_type = other DNA
gagcccaggagtttgagacc

SEQ ID NO: 101319 - DNA, 20 bp, synthetic construct
  misc_feature 1..20: note = CRISPR gRNA sequence
  source 1..20: mol_type = other DNA
agcccaggagtttgagacca

SEQ ID NO: 101320 - DNA, 20 bp, synthetic construct
  misc_feature 1..20: note = CRISPR gRNA sequence
  source 1..20: mol_type = other DNA
gagaccagcctgggcaacat

SEQ ID NO: 101321 - DNA, 20 bp, synthetic construct
  misc_feature 1..20: note = CRISPR gRNA sequence
  source 1..20: mol_type = other DNA
agaccagcctgggcaacata

SEQ ID NO: 101322 - DNA, 20 bp, synthetic construct
  misc_feature 1..20: note = CRISPR gRNA sequence
  source 1..20: mol_type = other DNA
ggcaacatagcgagaccctg

SEQ ID NO: 101323 - DNA, 20 bp, synthetic construct
  misc_feature 1..20: note = CRISPR gRNA sequence
  source 1..20: mol_type = other DNA
tctcttctaaaaaaacaaca

SEQ ID NO: 101324 - DNA, 20 bp, synthetic construct
  misc_feature 1..20: note = CRISPR gRNA sequence
  source 1..20: mol_type = other DNA
ttctaaaaaaacaacaacac

SEQ ID NO: 101325 - DNA, 20 bp, synthetic construct
  misc_feature 1..20: note = CRISPR gRNA sequence
  source 1..20: mol_type = other DNA
ctaaaaaaacaacaacacag

SEQ ID NO: 101326 - DNA, 20 bp, synthetic construct
  misc_feature 1..20: note = CRISPR gRNA sequence
  source 1..20: mol_type = other DNA
taaaaaaacaacaacacagc

SEQ ID NO: 101327 - DNA, 20 bp, synthetic construct
  misc_feature 1..20: note = CRISPR gRNA sequence
  source 1..20: mol_type = other DNA
aaaaaacaacaacacagcca

SEQ ID NO: 101328 - DNA, 20 bp, synthetic construct
  misc_feature 1..20: note = CRISPR gRNA sequence
  source 1..20: mol_type = other DNA
acacctgtaatcccagcact

SEQ ID NO: 101329 - DNA, 20 bp, synthetic construct
  misc_feature 1..20: note = CRISPR gRNA sequence
  source 1..20: mol_type = other DNA
taatcccagcactttgggag

SEQ ID NO: 101330 - DNA, 20 bp, synthetic construct
  misc_feature 1..20: note = CRISPR gRNA sequence
  source 1..20: mol_type = other DNA
tgggaggccaacacaggcgg

SEQ ID NO: 101331 - DNA, 20 bp, synthetic construct
  misc_feature 1..20: note = CRISPR gRNA sequence
  source 1..20: mol_type = other DNA
gggaggccaacacaggcgga

SEQ ID NO: 101332 - DNA, 20 bp, synthetic construct
  misc_feature 1..20: note = CRISPR gRNA sequence
  source 1..20: mol_type = other DNA
ggaggccaacacaggcggat

SEQ ID NO: 101333 - DNA, 20 bp, synthetic construct
  misc_feature 1..20: note = CRISPR gRNA sequence
  source 1..20: mol_type = other DNA
aagaccagcctgaccaacat

SEQ ID NO: 101334 - DNA, 20 bp, synthetic construct
  misc_feature 1..20: note = CRISPR gRNA sequence
  source 1..20: mol_type = other DNA
accaacatggtgaaaccccg

SEQ ID NO: 101335 - DNA, 20 bp, synthetic construct
  misc_feature 1..20: note = CRISPR gRNA sequence
  source 1..20: mol_type = other DNA
tactaaaaatataaaaatta

SEQ ID NO: 101336 - DNA, 20 bp, synthetic construct
  misc_feature 1..20: note = CRISPR gRNA sequence
  source 1..20: mol_type = other DNA
ctaaaaatataaaaattagc

SEQ ID NO: 101337 - DNA, 20 bp, synthetic construct
  misc_feature 1..20: note = CRISPR gRNA sequence
  source 1..20: mol_type = other DNA
aaaatataaaaattagccgg

SEQ ID NO: 101338 - DNA, 20 bp, synthetic construct
  misc_feature 1..20: note = CRISPR gRNA sequence
  source 1..20: mol_type = other DNA
gccgggcgtcatggtgtgca

SEQ ID NO: 101339 - DNA, 20 bp, synthetic construct
  misc_feature 1..20: note = CRISPR gRNA sequence
  source 1..20: mol_type = other DNA
tggtcccagctactcaggag

SEQ ID NO: 101340 - DNA, 20 bp, synthetic construct
  misc_feature 1..20: note = CRISPR gRNA sequence
  source 1..20: mol_type = other DNA
ctcaggaggctgaggcagga

SEQ ID NO: 101341 - DNA, 20 bp, synthetic construct
  misc_feature 1..20: note = CRISPR gRNA sequence
  source 1..20: mol_type = other DNA
aggaggctgaggcaggagaa

SEQ ID NO: 101342 - DNA, 20 bp, synthetic construct
  misc_feature 1..20: note = CRISPR gRNA sequence
  source 1..20: mol_type = other DNA
aggcaggagaatcgcttgaa

SEQ ID NO: 101343 - DNA, 20 bp, synthetic construct
  misc_feature 1..20: note = CRISPR gRNA sequence
  source 1..20: mol_type = other DNA
gaacctgggaggtggaagtt

SEQ ID NO: 101344 - DNA, 20 bp, synthetic construct
  misc_feature 1..20: note = CRISPR gRNA sequence
  source 1..20: mol_type = other DNA
aacctgggaggtggaagttg

SEQ ID NO: 101345 - DNA, 20 bp, synthetic construct
  misc_feature 1..20: note = CRISPR gRNA sequence
  source 1..20: mol_type = other DNA
ggaggtggaagttgcagtga

SEQ ID NO: 101346 - DNA, 20 bp, synthetic construct
  misc_feature 1..20: note = CRISPR gRNA sequence
  source 1..20: mol_type = other DNA
cagtgagccgagatggcgcc

SEQ ID NO: 101347 - DNA, 20 bp, synthetic construct
  misc_feature 1..20: note = CRISPR gRNA sequence
  source 1..20: mol_type = other DNA
cactccagcctgggtgacag

SEQ ID NO: 101348 - DNA, 20 bp, synthetic construct
  misc_feature 1..20: note = CRISPR gRNA sequence
  source 1..20: mol_type = other DNA
cagcctgggtgacagcgcga

SEQ ID NO: 101349 - DNA, 20 bp, synthetic construct
  misc_feature 1..20: note = CRISPR gRNA sequence
  source 1..20: mol_type = other DNA
ggtgacagcgcgagactcca

SEQ ID NO: 101350 - DNA, 20 bp, synthetic construct
  misc_feature 1..20: note = CRISPR gRNA sequence
  source 1..20: mol_type = other DNA
catgtccaaaaaaaaaaaaa

SEQ ID NO: 101351 - DNA, 20 bp, synthetic construct
  misc_feature 1..20: note = CRISPR gRNA sequence
  source 1..20: mol_type = other DNA
gccaggcatggtgacgaatg

SEQ ID NO: 101352 - DNA, 20 bp, synthetic construct
  misc_feature 1..20: note = CRISPR gRNA sequence
  source 1..20: mol_type = other DNA
tggtcccagctactcgggag

SEQ ID NO: 101353 - DNA, 20 bp, synthetic construct
  misc_feature 1..20: note = CRISPR gRNA sequence
  source 1..20: mol_type = other DNA
ctcgggaggctgtggtggga

SEQ ID NO: 101354 - DNA, 20 bp, synthetic construct
  misc_feature 1..20: note = CRISPR gRNA sequence
  source 1..20: mol_type = other DNA
gggaggctgtggtgggagga

SEQ ID NO: 101355 - DNA, 20 bp, synthetic construct
  misc_feature 1..20: note = CRISPR gRNA sequence
  source 1..20: mol_type = other DNA
tggtgggaggatcacttgag

SEQ ID NO: 101356 - DNA, 20 bp, synthetic construct
  misc_feature 1..20: note = CRISPR gRNA sequence
  source 1..20: mol_type = other DNA
gagcctgggagatcgaggct

SEQ ID NO: 101357 - DNA, 20 bp, synthetic construct
  misc_feature 1..20: note = CRISPR gRNA sequence
  source 1..20: mol_type = other DNA
agcctgggagatcgaggctg

SEQ ID NO: 101358 - DNA, 20 bp, synthetic construct
  misc_feature 1..20: note = CRISPR gRNA sequence
  source 1..20: mol_type = other DNA
ggagatcgaggctgcagtaa

SEQ ID NO: 101359 - DNA, 20 bp, synthetic construct
  misc_feature 1..20: note = CRISPR gRNA sequence
  source 1..20: mol_type = other DNA
cagtaagctgtgcctgcacc

SEQ ID NO: 101360 - DNA, 20 bp, synthetic construct
  misc_feature 1..20: note = CRISPR gRNA sequence
  source 1..20: mol_type = other DNA
tgcctgcaccacttcattcc

SEQ ID NO: 101361 - DNA, 20 bp, synthetic construct
  misc_feature 1..20: note = CRISPR gRNA sequence
  source 1..20: mol_type = other DNA
caccacttcattccagcctg

SEQ ID NO: 101362 - DNA, 20 bp, synthetic construct
  misc_feature 1..20: note = CRISPR gRNA sequence
  source 1..20: mol_type = other DNA
cattccagcctgggtgatag

SEQ ID NO: 101363 - DNA, 20 bp, synthetic construct
  misc_feature 1..20: note = CRISPR gRNA sequence
  source 1..20: mol_type = other DNA
attccagcctgggtgataga

SEQ ID NO: 101364 - DNA, 20 bp, synthetic construct
  misc_feature 1..20: note = CRISPR gRNA sequence
  source 1..20: mol_type = other DNA
cagcctgggtgatagagcaa

SEQ ID NO: 101365 - DNA, 20 bp, synthetic construct
  misc_feature 1..20: note = CRISPR gRNA sequence
  source 1..20: mol_type = other DNA
ggtgatagagcaagactttc

SEQ ID NO: 101366 - DNA, 20 bp, synthetic construct
  misc_feature 1..20: note = CRISPR gRNA sequence
  source 1..20: mol_type = other DNA
tctgcctcgaacaaaaaaac

SEQ ID NO: 101367 - DNA, 20 bp, synthetic construct
  misc_feature 1..20: note = CRISPR gRNA sequence
  source 1..20: mol_type = other DNA
ctgcctcgaacaaaaaaaca

SEQ ID NO: 101368 - DNA, 20 bp, synthetic construct
  misc_feature 1..20: note = CRISPR gRNA sequence
  source 1..20: mol_type = other DNA
tgcctcgaacaaaaaaacaa

SEQ ID NO: 101369 - DNA, 20 bp, synthetic construct
  misc_feature 1..20: note = CRISPR gRNA sequence
  source 1..20: mol_type = other DNA
cctcgaacaaaaaaacaaac

SEQ ID NO: 101370 - DNA, 20 bp, synthetic construct
  misc_feature 1..20: note = CRISPR gRNA sequence
  source 1..20: mol_type = other DNA
gaacaaaaaaacaaaccccc

SEQ ID NO: 101371 - DNA, 20 bp, synthetic construct
  misc_feature 1..20: note = CRISPR gRNA sequence
  source 1..20: mol_type = other DNA
ctgtcccaaacacagtaaaa

SEQ ID NO: 101372 - DNA, 20 bp, synthetic construct
  misc_feature 1..20: note = CRISPR gRNA sequence
  source 1..20: mol_type = other DNA
tgtcccaaacacagtaaaac

SEQ ID NO: 101373 - DNA, 20 bp, synthetic construct
  misc_feature 1..20: note = CRISPR gRNA sequence
  source 1..20: mol_type = other DNA
tcccaaacacagtaaaactc

SEQ ID NO: 101374 - DNA, 20 bp, synthetic construct
  misc_feature 1..20: note = CRISPR gRNA sequence
  source 1..20: mol_type = other DNA
tgaaggaaggagggggatat

SEQ ID NO: 101375 - DNA, 20 bp, synthetic construct
  misc_feature 1..20: note = CRISPR gRNA sequence
  source 1..20: mol_type = other DNA
aaggaaggagggggatattt

SEQ ID NO: 101376 - DNA, 20 bp, synthetic construct
  misc_feature 1..20: note = CRISPR gRNA sequence
  source 1..20: mol_type = other DNA
cctaagcaccccatctctac

SEQ ID NO: 101377 - DNA, 20 bp, synthetic construct
  misc_feature 1..20: note = CRISPR gRNA sequence
  source 1..20: mol_type = other DNA
ctaagcaccccatctctacc

SEQ ID NO: 101378 - DNA, 20 bp, synthetic construct
  misc_feature 1..20: note = CRISPR gRNA sequence
  source 1..20: mol_type = other DNA
agcaccccatctctaccatg

SEQ ID NO: 101379 - DNA, 20 bp, synthetic construct
  misc_feature 1..20: note = CRISPR gRNA sequence
  source 1..20: mol_type = other DNA
taccatgaccccagggggtc

SEQ ID NO: 101380 - DNA, 20 bp, synthetic construct
  misc_feature 1..20: note = CRISPR gRNA sequence
  source 1..20: mol_type = other DNA
ccatgaccccagggggtcgg

SEQ ID NO: 101381 - DNA, 20 bp, synthetic construct
  misc_feature 1..20: note = CRISPR gRNA sequence
  source 1..20: mol_type = other DNA
aattgggatctccccatttt

SEQ ID NO: 101382 - DNA, 20 bp, synthetic construct
  misc_feature 1..20: note = CRISPR gRNA sequence
  source 1..20: mol_type = other DNA
ggatctccccattttatgga

SEQ ID NO: 101383 - DNA, 20 bp, synthetic construct
  misc_feature 1..20: note = CRISPR gRNA sequence
  source 1..20: mol_type = other DNA
cccattttatggatggggaa

SEQ ID NO: 101384 - DNA, 20 bp, synthetic construct
  misc_feature 1..20: note = CRISPR gRNA sequence
  source 1..20: mol_type = other DNA
tatggatggggaagttgggg

SEQ ID NO: 101385 - DNA, 20 bp, synthetic construct
  misc_feature 1..20: note = CRISPR gRNA sequence
  source 1..20: mol_type = other DNA
atggatggggaagttggggt

SEQ ID NO: 101386 - DNA, 20 bp, synthetic construct
  misc_feature 1..20: note = CRISPR gRNA sequence
  source 1..20: mol_type = other DNA
tggatggggaagttggggtc

SEQ ID NO: 101387 - DNA, 20 bp, synthetic construct
  misc_feature 1..20: note = CRISPR gRNA sequence
  source 1..20: mol_type = other DNA
gggtcccattgtgacagaga

SEQ ID NO: 101388 - DNA, 20 bp, synthetic construct
  misc_feature 1..20: note = CRISPR gRNA sequence
  source 1..20: mol_type = other DNA
tgacagagaaaatggagtca

SEQ ID NO: 101389 - DNA, 20 bp, synthetic construct
  misc_feature 1..20: note = CRISPR gRNA sequence
  source 1..20: mol_type = other DNA
gggtctgcctatggcccctg

SEQ ID NO: 101390 - DNA, 20 bp, synthetic construct
  misc_feature 1..20: note = CRISPR gRNA sequence
  source 1..20: mol_type = other DNA
cctatggcccctgttcaaac

SEQ ID NO: 101391 - DNA, 20 bp, synthetic construct
  misc_feature 1..20: note = CRISPR gRNA sequence
  source 1..20: mol_type = other DNA
tggcccctgttcaaacccac

SEQ ID NO: 101392 - DNA, 20 bp, synthetic construct
  misc_feature 1..20: note = CRISPR gRNA sequence
  source 1..20: mol_type = other DNA
ttcaaacccactgcccgcca

SEQ ID NO: 101393 - DNA, 20 bp, synthetic construct
  misc_feature 1..20: note = CRISPR gRNA sequence
  source 1..20: mol_type = other DNA
aaacccactgcccgccacgg

SEQ ID NO: 101394 - DNA, 20 bp, synthetic construct
  misc_feature 1..20: note = CRISPR gRNA sequence
  source 1..20: mol_type = other DNA
cccgccacggagagggatgg

SEQ ID NO: 101395 - DNA, 20 bp, synthetic construct
  misc_feature 1..20: note = CRISPR gRNA sequence
  source 1..20: mol_type = other DNA
tgtggctctgtgcactatgg

SEQ ID NO: 101396 - DNA, 20 bp, synthetic construct
  misc_feature 1..20: note = CRISPR gRNA sequence
  source 1..20: mol_type = other DNA
tggctctgtgcactatggcc

SEQ ID NO: 101397 - DNA, 20 bp, synthetic construct
  misc_feature 1..20: note = CRISPR gRNA sequence
  source 1..20: mol_type = other DNA
tgtgcactatggcctggtcg

SEQ ID NO: 101398 - DNA, 20 bp, synthetic construct
  misc_feature 1..20: note = CRISPR gRNA sequence
  source 1..20: mol_type = other DNA
tgcactatggcctggtcgcc

SEQ ID NO: 101399 - DNA, 20 bp, synthetic construct
  misc_feature 1..20: note = CRISPR gRNA sequence
  source 1..20: mol_type = other DNA
tggcctggtcgcctacccct

SEQ ID NO: 101400 - DNA, 20 bp, synthetic construct
  misc_feature 1..20: note = CRISPR gRNA sequence
  source 1..20: mol_type = other DNA
gtcgcctaccccttggtgtc

SEQ ID NO: 101401 - DNA, 20 bp, synthetic construct
  misc_feature 1..20: note = CRISPR gRNA sequence
  source 1..20: mol_type = other DNA
ccccttggtgtcctcactgc

SEQ ID NO: 101402 - DNA, 20 bp, synthetic construct
  misc_feature 1..20: note = CRISPR gRNA sequence
  source 1..20: mol_type = other DNA
ggtgtcctcactgccaggcc

SEQ ID NO: 101403 - DNA, 20 bp, synthetic construct
  misc_feature 1..20: note = CRISPR gRNA sequence
  source 1..20: mol_type = other DNA
gtgtcctcactgccaggcct

SEQ ID NO: 101404 - DNA, 20 bp, synthetic construct
  misc_feature 1..20: note = CRISPR gRNA sequence
  source 1..20: mol_type = other DNA
actgccaggcctccgcaggg

SEQ ID NO: 101405 - DNA, 20 bp, synthetic construct
  misc_feature 1..20: note = CRISPR gRNA sequence
  source 1..20: mol_type = other DNA
ccaggcctccgcaggggcca

SEQ ID NO: 101406 - DNA, 20 bp, synthetic construct
  misc_feature 1..20: note = CRISPR gRNA sequence
  source 1..20: mol_type = other DNA
cgcaggggccactcctccca

SEQ ID NO: 101407 - DNA, 20 bp, synthetic construct
  misc_feature 1..20: note = CRISPR gRNA sequence
  source 1..20: mol_type = other DNA
ctcccacctggatgccattc

SEQ ID NO: 101408 - DNA, 20 bp, synthetic construct
  misc_feature 1..20: note = CRISPR gRNA sequence
  source 1..20: mol_type = other DNA
ccacctggatgccattctcc

SEQ ID NO: 101409 - DNA, 20 bp, synthetic construct
  misc_feature 1..20: note = CRISPR gRNA sequence
  source 1..20: mol_type = other DNA
gatgccattctccctccctt

SEQ ID NO: 101410 - DNA, 20 bp, synthetic construct
  misc_feature 1..20: note = CRISPR gRNA sequence
  source 1..20: mol_type = other DNA
tccctcccttcaggtccccc

SEQ ID NO: 101411 - DNA, 20 bp, synthetic construct
  misc_feature 1..20: note = CRISPR gRNA sequence
  source 1..20: mol_type = other DNA
cctcccttcaggtcccccag

SEQ ID NO: 101412 - DNA, 20 bp, synthetic construct
  misc_feature 1..20: note = CRISPR gRNA sequence
  source 1..20: mol_type = other DNA
ccttcaggtcccccagaatc

SEQ ID NO: 101413 - DNA, 20 bp, synthetic construct
  misc_feature 1..20: note = CRISPR gRNA sequence
  source 1..20: mol_type = other DNA
caggtcccccagaatccttc

SEQ ID NO: 101414 - DNA, 20 bp, synthetic construct
  misc_feature 1..20: note = CRISPR gRNA sequence
  source 1..20: mol_type = other DNA
aggtcccccagaatccttcc

SEQ ID NO: 101415 - DNA, 20 bp, synthetic construct
  misc_feature 1..20: note = CRISPR gRNA sequence
  source 1..20: mol_type = other DNA
ccctgacctccccatcccag

SEQ ID NO: 101416 - DNA, 20 bp, synthetic construct
  misc_feature 1..20: note = CRISPR gRNA sequence
  source 1..20: mol_type = other DNA
cctgacctccccatcccagg

SEQ ID NO: 101417 - DNA, 20 bp, synthetic construct
  misc_feature 1..20: note = CRISPR gRNA sequence
  source 1..20: mol_type = other DNA
acctccccatcccagggctg

SEQ ID NO: 101418 - DNA, 20 bp, synthetic construct
  misc_feature 1..20: note = CRISPR gRNA sequence
  source 1..20: mol_type = other DNA
cccatcccagggctgggccc

SEQ ID NO: 101419 - DNA, 20 bp, synthetic construct
  misc_feature 1..20: note = CRISPR gRNA sequence
  source 1..20: mol_type = other DNA
ggcccacctcacttctcggg

SEQ ID NO: 101420 - DNA, 20 bp, synthetic construct
  misc_feature 1..20: note = CRISPR gRNA sequence
  source 1..20: mol_type = other DNA
acttctcggggtctcaacct

SEQ ID NO: 101421 - DNA, 20 bp, synthetic construct
  misc_feature 1..20: note = CRISPR gRNA sequence
  source 1..20: mol_type = other DNA
ctcggggtctcaaccttaag

SEQ ID NO: 101422 - DNA, 20 bp, synthetic construct
  misc_feature 1..20: note = CRISPR gRNA sequence
  source 1..20: mol_type = other DNA
tcggggtctcaaccttaaga

SEQ ID NO: 101423 - DNA, 20 bp, synthetic construct
  misc_feature 1..20: note = CRISPR gRNA sequence
  source 1..20: mol_type = other DNA
ggggtctcaaccttaagaca

SEQ ID NO: 101424 - DNA, 20 bp, synthetic construct
  misc_feature 1..20: note = CRISPR gRNA sequence
  source 1..20: mol_type = other DNA
aaccttaagacaccttcctc

SEQ ID NO: 101425 - DNA, 20 bp, synthetic construct
  misc_feature 1..20: note = CRISPR gRNA sequence
  source 1..20: mol_type = other DNA
aagacaccttcctccaggaa

SEQ ID NO: 101426 - DNA, 20 bp, synthetic construct
  misc_feature 1..20: note = CRISPR gRNA sequence
  source 1..20: mol_type = other DNA
agacaccttcctccaggaag

SEQ ID NO: 101427 - DNA, 20 bp, synthetic construct
  misc_feature 1..20: note = CRISPR gRNA sequence
  source 1..20: mol_type = other DNA
cctccaggaagcctctctga

SEQ ID NO: 101428 - DNA, 20 bp, synthetic construct
  misc_feature 1..20: note = CRISPR gRNA sequence
  source 1..20: mol_type = other DNA
ctccaggaagcctctctgac

SEQ ID NO: 101429 - DNA, 20 bp, synthetic construct
  misc_feature 1..20: note = CRISPR gRNA sequence
  source 1..20: mol_type = other DNA
caggaagcctctctgacttc

SEQ ID NO: 101430 - DNA, 20 bp, synthetic construct
  misc_feature 1..20: note = CRISPR gRNA sequence
  source 1..20: mol_type = other DNA
tctgacttctgttggccact

SEQ ID NO: 101431 - DNA, 20 bp, synthetic construct
  misc_feature 1..20: note = CRISPR gRNA sequence
  source 1..20: mol_type = other DNA
tgacttctgttggccacttt

SEQ ID NO: 101432 - DNA, 20 bp, synthetic construct
  misc_feature 1..20: note = CRISPR gRNA sequence
  source 1..20: mol_type = other DNA
acttctgttggccactttgg

SEQ ID NO: 101433 - DNA, 20 bp, synthetic construct
  misc_feature 1..20: note = CRISPR gRNA sequence
  source 1..20: mol_type = other DNA
ctgttggccactttggggct

SEQ ID NO: 101434 - DNA, 20 bp, synthetic construct
  misc_feature 1..20: note = CRISPR gRNA sequence
  source 1..20: mol_type = other DNA
tgttggccactttggggctc

SEQ ID NO: 101435 - DNA, 20 bp, synthetic construct
  misc_feature 1..20: note = CRISPR gRNA sequence
  source 1..20: mol_type = other DNA
ttggccactttggggctctt

SEQ ID NO: 101436 - DNA, 20 bp, synthetic construct
  misc_feature 1..20: note = CRISPR gRNA sequence
  source 1..20: mol_type = other DNA
gccactttggggctctttga

SEQ ID NO: 101437 - DNA, 20 bp, synthetic construct
  misc_feature 1..20: note = CRISPR gRNA sequence
  source 1..20: mol_type = other DNA
tggggctctttgatgagagg

SEQ ID NO: 101438 - DNA, 20 bp, synthetic construct
  misc_feature 1..20: note = CRISPR gRNA sequence
  source 1..20: mol_type = other DNA
ggggctctttgatgagaggc

SEQ ID NO: 101439 - DNA, 20 bp, synthetic construct
  misc_feature 1..20: note = CRISPR gRNA sequence
  source 1..20: mol_type = other DNA
gggctctttgatgagaggcc

SEQ ID NO: 101440 - DNA, 20 bp, synthetic construct
  misc_feature 1..20: note = CRISPR gRNA sequence
  source 1..20: mol_type = other DNA
tttgatgagaggcccctctt

SEQ ID NO: 101441 - DNA, 20 bp, synthetic construct
  misc_feature 1..20: note = CRISPR gRNA sequence
  source 1..20: mol_type = other DNA
tgatgagaggcccctctttc

SEQ ID NO: 101442 - DNA, 20 bp, synthetic construct
  misc_feature 1..20: note = CRISPR gRNA sequence
  source 1..20: mol_type = other DNA
gatgagaggcccctctttcg

SEQ ID NO: 101443 - DNA, 20 bp, synthetic construct
  misc_feature 1..20: note = CRISPR gRNA sequence
  source 1..20: mol_type = other DNA
atgagaggcccctctttcgg

SEQ ID NO: 101444 - DNA, 20 bp, synthetic construct
  misc_feature 1..20: note = CRISPR gRNA sequence
  source 1..20: mol_type = other DNA
tttcggcctctcatgcctat

SEQ ID NO: 101445 - DNA, 20 bp, synthetic construct
  misc_feature 1..20: note = CRISPR gRNA sequence
  source 1..20: mol_type = other DNA
tcggcctctcatgcctatgt

SEQ ID NO: 101446 - DNA, 20 bp, synthetic construct
  misc_feature 1..20: note = CRISPR gRNA sequence
  source 1..20: mol_type = other DNA
cggcctctcatgcctatgtg

SEQ ID NO: 101447 - DNA, 20 bp, synthetic construct
  misc_feature 1..20: note = CRISPR gRNA sequence
  source 1..20: mol_type = other DNA
ggcctctcatgcctatgtgt

SEQ ID NO: 101448 - DNA, 20 bp, synthetic construct
  misc_feature 1..20: note = CRISPR gRNA sequence
  source 1..20: mol_type = other DNA
tcatgcctatgtgtccccca

SEQ ID NO: 101449 - DNA, 20 bp, synthetic construct
  misc_feature 1..20: note = CRISPR gRNA sequence
  source 1..20: mol_type = other DNA
atgcctatgtgtcccccatc

SEQ ID NO: 101450 - DNA, 20 bp, synthetic construct
  misc_feature 1..20: note = CRISPR gRNA sequence
  source 1..20: mol_type = other DNA
tgtgtcccccatcatggcca

SEQ ID NO: 101451 - DNA, 20 bp, synthetic construct
  misc_feature 1..20: note = CRISPR gRNA sequence
  source 1..20: mol_type = other DNA
acacccattgtcctccctac

SEQ ID NO: 101452 - DNA, 20 bp, synthetic construct
  misc_feature 1..20: note = CRISPR gRNA sequence
  source 1..20: mol_type = other DNA
tcctccctaccccagcacat

SEQ ID NO: 101453 - DNA, 20 bp, synthetic construct
  misc_feature 1..20: note = CRISPR gRNA sequence
  source 1..20: mol_type = other DNA
cctaccccagcacatgtgga

SEQ ID NO: 101454 - DNA, 20 bp, synthetic construct
  misc_feature 1..20: note = CRISPR gRNA sequence
  source 1..20: mol_type = other DNA
ccccagcacatgtggagccc

SEQ ID NO: 101455 - DNA, 20 bp, synthetic construct
  misc_feature 1..20: note = CRISPR gRNA sequence
  source 1..20: mol_type = other DNA
ggatgttcccaggcgggata

SEQ ID NO: 101456 - DNA, 20 bp, synthetic construct
  misc_feature 1..20: note = CRISPR gRNA sequence
  source 1..20: mol_type = other DNA
ccaggcgggatacacagcag

SEQ ID NO: 101457 - DNA, 20 bp, synthetic construct
  misc_feature 1..20: note = CRISPR gRNA sequence
  source 1..20: mol_type = other DNA
aacacctgtcaacacactct

SEQ ID NO: 101458 - DNA, 20 bp, synthetic construct
  misc_feature 1..20: note = CRISPR gRNA sequence
  source 1..20: mol_type = other DNA
tcaacacactctcgctgccg

SEQ ID NO: 101459 - DNA, 20 bp, synthetic construct
  misc_feature 1..20: note = CRISPR gRNA sequence
  source 1..20: mol_type = other DNA
tcgctgccggcgtatgacca

SEQ ID NO: 101460 - DNA, 20 bp, synthetic construct
  misc_feature 1..20: note = CRISPR gRNA sequence
  source 1..20: mol_type = other DNA
gctgccggcgtatgaccact

SEQ ID NO: 101461 - DNA, 20 bp, synthetic construct
  misc_feature 1..20: note = CRISPR gRNA sequence
  source 1..20: mol_type = other DNA
ccggcgtatgaccactgaag

SEQ ID NO: 101462 - DNA, 20 bp, synthetic construct
  misc_feature 1..20: note = CRISPR gRNA sequence
  source 1..20: mol_type = other DNA
aaggggtgtcccatgtaccc

SEQ ID NO: 101463 - DNA, 20 bp, synthetic construct
  misc_feature 1..20: note = CRISPR gRNA sequence
  source 1..20: mol_type = other DNA
tatggtcaccctgcctatgg

SEQ ID NO: 101464 - DNA, 20 bp, synthetic construct
  misc_feature 1..20: note = CRISPR gRNA sequence
  source 1..20: mol_type = other DNA
atggtcaccctgcctatgga

SEQ ID NO: 101465 - DNA, 20 bp, synthetic construct
  misc_feature 1..20: note = CRISPR gRNA sequence
  source 1..20: mol_type = other DNA
tggtcaccctgcctatggaa

SEQ ID NO: 101466 - DNA, 20 bp, synthetic construct
  misc_feature 1..20: note = CRISPR gRNA sequence
  source 1..20: mol_type = other DNA
cctatggaagggaccccacc

SEQ ID NO: 101467 - DNA, 20 bp, synthetic construct
  misc_feature 1..20: note = CRISPR gRNA sequence
  source 1..20: mol_type = other DNA
tggaagggaccccacccctg

SEQ ID NO: 101468 - DNA, 20 bp, synthetic construct
  misc_feature 1..20: note = CRISPR gRNA sequence
  source 1..20: mol_type = other DNA
ctctgtgtgtctcaggctga

SEQ ID NO: 101469 - DNA, 20 bp, synthetic construct
  misc_feature 1..20: note = CRISPR gRNA sequence
  source 1..20: mol_type = other DNA
tgtgtgtctcaggctgacct

SEQ ID NO: 101470 - DNA, 20 bp, synthetic construct
  misc_feature 1..20: note = CRISPR gRNA sequence
  source 1..20: mol_type = other DNA
tgtgtctcaggctgaccttt

SEQ ID NO: 101471 - DNA, 20 bp, synthetic construct
  misc_feature 1..20: note = CRISPR gRNA sequence
  source 1..20: mol_type = other DNA
aggctgacctttccggtatc

SEQ ID NO: 101472 - DNA, 20 bp, synthetic construct
  misc_feature 1..20: note = CRISPR gRNA sequence
  source 1..20: mol_type = other DNA
acctttccggtatcccaggg

SEQ ID NO: 101473 - DNA, 20 bp, synthetic construct
  misc_feature 1..20: note = CRISPR gRNA sequence
  source 1..20: mol_type = other DNA
tccggtatcccagggccacg

SEQ ID NO: 101474 - DNA, 20 bp, synthetic construct
  misc_feature 1..20: note = CRISPR gRNA sequence
  source 1..20: mol_type = other DNA
ccggtatcccagggccacgg

SEQ ID NO: 101475 - DNA, 20 bp, synthetic construct
  misc_feature 1..20: note = CRISPR gRNA sequence
  source 1..20: mol_type = other DNA
cggtatcccagggccacggc

SEQ ID NO: 101476 - DNA, 20 bp, synthetic construct
  misc_feature 1..20: note = CRISPR gRNA sequence
  source 1..20: mol_type = other DNA
cggtggtgaggtcagcgcct

SEQ ID NO: 101477 - DNA, 20 bp, synthetic construct
  misc_feature 1..20: note = CRISPR gRNA sequence
  source 1..20: mol_type = other DNA
ggtggtgaggtcagcgcctc

SEQ ID NO: 101478 - DNA, 20 bp, synthetic construct
  misc_feature 1..20: note = CRISPR gRNA sequence
  source 1..20: mol_type = other DNA
gggctgcaaaggagagggga

SEQ ID NO: 101479 - DNA, 20 bp, synthetic construct
  misc_feature 1..20: note = CRISPR gRNA sequence
  source 1..20: mol_type = other DNA
caaaggagaggggagggcgc

SEQ ID NO: 101480 - DNA, 20 bp, synthetic construct
  misc_feature 1..20: note = CRISPR gRNA sequence
  source 1..20: mol_type = other DNA
gagggtggggcctgggagtc

SEQ ID NO: 101481 - DNA, 20 bp, synthetic construct
  misc_feature 1..20: note = CRISPR gRNA sequence
  source 1..20: mol_type = other DNA
ggagtccagaatggggtctg

SEQ ID NO: 101482 - DNA, 20 bp, synthetic construct
  misc_feature 1..20: note = CRISPR gRNA sequence
  source 1..20: mol_type = other DNA
gggacctgggagatcccatg

SEQ ID NO: 101483 - DNA, 20 bp, synthetic construct
  misc_feature 1..20: note = CRISPR gRNA sequence
  source 1..20: mol_type = other DNA
ggagatcccatggcacccct

SEQ ID NO: 101484 - DNA, 20 bp, synthetic construct
  misc_feature 1..20: note = CRISPR gRNA sequence
  source 1..20: mol_type = other DNA
attccccacaatgcagccgt

SEQ ID NO: 101485 - DNA, 20 bp, synthetic construct
  misc_feature 1..20: note = CRISPR gRNA sequence
  source 1..20: mol_type = other DNA
cccacaatgcagccgtgggt

SEQ ID NO: 101486 - DNA, 20 bp, synthetic construct
  misc_feature 1..20: note = CRISPR gRNA sequence
  source 1..20: mol_type = other DNA
cccgttgcccatgtggcctt

SEQ ID NO: 101487 - DNA, 20 bp, synthetic construct
  misc_feature 1..20: note = CRISPR gRNA sequence
  source 1..20: mol_type = other DNA
cccatgtggcctttgacaag

SEQ ID NO: 101488 - DNA, 20 bp, synthetic construct
  misc_feature 1..20: note = CRISPR gRNA sequence
  source 1..20: mol_type = other DNA
tgacaagggtccaacctctg

SEQ ID NO: 101489 - DNA, 20 bp, synthetic construct
  misc_feature 1..20: note = CRISPR gRNA sequence
  source 1..20: mol_type = other DNA
gacaagggtccaacctctgc

SEQ ID NO: 101490 - DNA, 20 bp, synthetic construct
  misc_feature 1..20: note = CRISPR gRNA sequence
  source 1..20: mol_type = other DNA
acaagggtccaacctctgct

SEQ ID NO: 101491 - DNA, 20 bp, synthetic construct
  misc_feature 1..20: note = CRISPR gRNA sequence
  source 1..20: mol_type = other DNA
tgctatcttggtctccactg

SEQ ID NO: 101492 - DNA, 20 bp, synthetic construct
  misc_feature 1..20: note = CRISPR gRNA sequence
  source 1..20: mol_type = other DNA
ctatcttggtctccactgaa

SEQ ID NO: 101493 - DNA, 20 bp, synthetic construct
  misc_feature 1..20: note = CRISPR gRNA sequence
  source 1..20: mol_type = other DNA
tcttggtctccactgaagaa

SEQ ID NO: 101494 - DNA, 20 bp, synthetic construct
  misc_feature 1..20: note = CRISPR gRNA sequence
  source 1..20: mol_type = other DNA
ggtctccactgaagaacgtg

SEQ ID NO: 101495 - DNA, 20 bp, synthetic construct
  misc_feature 1..20: note = CRISPR gRNA sequence
  source 1..20: mol_type = other DNA
gtctccactgaagaacgtgg

SEQ ID NO: 101496 - DNA, 20 bp, synthetic construct
  misc_feature 1..20: note = CRISPR gRNA sequence
  source 1..20: mol_type = other DNA
cactgaagaacgtggctgaa

SEQ ID NO: 101497 - DNA, 20 bp, synthetic construct
  misc_feature 1..20: note = CRISPR gRNA sequence
  source 1..20: mol_type = other DNA
aagaacgtggctgaagggtc

SEQ ID NO: 101498 - DNA, 20 bp, synthetic construct
  misc_feature 1..20: note = CRISPR gRNA sequence
  source 1..20: mol_type = other DNA
aagggtctctgaaccatgga

SEQ ID NO: 101499 - DNA, 20 bp, synthetic construct
  misc_feature 1..20: note = CRISPR gRNA sequence
  source 1..20: mol_type = other DNA
tgaaccatggaggatggagg

SEQ ID NO: 101500 - DNA, 20 bp, synthetic construct
  misc_feature 1..20: note = CRISPR gRNA sequence
  source 1..20: mol_type = other DNA
aaccatggaggatggaggtg

SEQ ID NO: 101501 - DNA, 20 bp, synthetic construct
  misc_feature 1..20: note = CRISPR gRNA sequence
  source 1..20: mol_type = other DNA
agcctcttggccagatccta

SEQ ID NO: 101502 - DNA, 20 bp, synthetic construct
  misc_feature 1..20: note = CRISPR gRNA sequence
  source 1..20: mol_type = other DNA
gcctcttggccagatcctaa

SEQ ID NO: 101503 - DNA, 20 bp, synthetic construct
  misc_feature 1..20: note = CRISPR gRNA sequence
  source 1..20: mol_type = other DNA
ttggccagatcctaaaccca

SEQ ID NO: 101504 - DNA, 20 bp, synthetic construct
  misc_feature 1..20: note = CRISPR gRNA sequence
  source 1..20: mol_type = other DNA
ggccagatcctaaacccaga

SEQ ID NO: 101505 - DNA, 20 bp, synthetic construct
  misc_feature 1..20: note = CRISPR gRNA sequence
  source 1..20: mol_type = other DNA
gccagatcctaaacccagac

SEQ ID NO: 101506 - DNA, 20 bp, synthetic construct
  misc_feature 1..20: note = CRISPR gRNA sequence
  source 1..20: mol_type = other DNA
aacccagaccccgactcccg

SEQ ID NO: 101507 - DNA, 20 bp, synthetic construct
  misc_feature 1..20: note = CRISPR gRNA sequence
  source 1..20: mol_type = other DNA
ccgtgtggtcctaccacctc

SEQ ID NO: 101508 - DNA, 20 bp, synthetic construct
  misc_feature 1..20: note = CRISPR gRNA sequence
  source 1..20: mol_type = other DNA
ccacctcctcccctctgatc

SEQ ID NO: 101509 - DNA, 20 bp, synthetic construct
  misc_feature 1..20: note = CRISPR gRNA sequence
  source 1..20: mol_type = other DNA
ctcccctctgatccatcctc

SEQ ID NO: 101510 - DNA, 20 bp, synthetic construct
  misc_feature 1..20: note = CRISPR gRNA sequence
  source 1..20: mol_type = other DNA
ccctctgatccatcctccga

SEQ ID NO: 101511 - DNA, 20 bp, synthetic construct
  misc_feature 1..20: note = CRISPR gRNA sequence
  source 1..20: mol_type = other DNA
tgatccatcctccgagaaga

SEQ ID NO: 101512 - DNA, 20 bp, synthetic construct
  misc_feature 1..20: note = CRISPR gRNA sequence
  source 1..20: mol_type = other DNA
atccatcctccgagaagagc

SEQ ID NO: 101513 - DNA, 20 bp, synthetic construct
  misc_feature 1..20: note = CRISPR gRNA sequence
  source 1..20: mol_type = other DNA
cgagaagagcaggcagggac

SEQ ID NO: 101514 - DNA, 20 bp, synthetic construct
  misc_feature 1..20: note = CRISPR gRNA sequence
  source 1..20: mol_type = other DNA
cctgctccaagaactcttca

SEQ ID NO: 101515 - DNA, 20 bp, synthetic construct
  misc_feature 1..20: note = CRISPR gRNA sequence
  source 1..20: mol_type = other DNA
ctccaagaactcttcaagca

SEQ ID NO: 101516 - DNA, 20 bp, synthetic construct
  misc_feature 1..20: note = CRISPR gRNA sequence
  source 1..20: mol_type = other DNA
caagaactcttcaagcaaca

SEQ ID NO: 101517 - DNA, 20 bp, synthetic construct
  misc_feature 1..20: note = CRISPR gRNA sequence
  source 1..20: mol_type = other DNA
ttcaagcaacacttgggcgt

SEQ ID NO: 101518 - DNA, 20 bp, synthetic construct
  misc_feature 1..20: note = CRISPR gRNA sequence
  source 1..20: mol_type = other DNA
caagcaacacttgggcgtct

SEQ ID NO: 101519 - DNA, 20 bp, synthetic construct
  misc_feature 1..20: note = CRISPR gRNA sequence
  source 1..20: mol_type = other DNA
aagcaacacttgggcgtctc

SEQ ID NO: 101520 - DNA, 20 bp, synthetic construct
  misc_feature 1..20: note = CRISPR gRNA sequence
  source 1..20: mol_type = other DNA
gggcgtctccctgccctcag

SEQ ID NO: 101521 - DNA, 20 bp, synthetic construct
  misc_feature 1..20: note = CRISPR gRNA sequence
  source 1..20: mol_type = other DNA
ggcgtctccctgccctcagg

SEQ ID NO: 101522 - DNA, 20 bp, synthetic construct
  misc_feature 1..20: note = CRISPR gRNA sequence
  source 1..20: mol_type = other DNA
cctgccctcaggattcccgc

SEQ ID NO: 101523 - DNA, 20 bp, synthetic construct
  misc_feature 1..20: note = CRISPR gRNA sequence
  source 1..20: mol_type = other DNA
ccctcaggattcccgcaggg

SEQ ID NO: 101524 - DNA, 20 bp, synthetic construct
  misc_feature 1..20: note = CRISPR gRNA sequence
  source 1..20: mol_type = other DNA
aggattcccgcagggcccgc

SEQ ID NO: 101525 - DNA, 20 bp, synthetic construct
  misc_feature 1..20: note = CRISPR gRNA sequence
  source 1..20: mol_type = other DNA
ccgcagggcccgctggagtg

SEQ ID NO: 101526 - DNA, 20 bp, synthetic construct
  misc_feature 1..20: note = CRISPR gRNA sequence
  source 1..20: mol_type = other DNA
gagtgctggggcccccaggg

SEQ ID NO: 101527 - DNA, 20 bp, synthetic construct
  misc_feature 1..20: note = CRISPR gRNA sequence
  source 1..20: mol_type = other DNA
gggcccccagggccactccc

SEQ ID NO: 101528 - DNA, 20 bp, synthetic construct
  misc_feature 1..20: note = CRISPR gRNA sequence
  source 1..20: mol_type = other DNA
ccgactcccactcacccagc

SEQ ID NO: 101529 - DNA, 20 bp, synthetic construct
  misc_feature 1..20: note = CRISPR gRNA sequence
  source 1..20: mol_type = other DNA
ccactcacccagcaaggcct

SEQ ID NO: 101530 - DNA, 20 bp, synthetic construct
  misc_feature 1..20: note = CRISPR gRNA sequence
  source 1..20: mol_type = other DNA
acccagcaaggcctcaacgc

SEQ ID NO: 101531 - DNA, 20 bp, synthetic construct
  misc_feature 1..20: note = CRISPR gRNA sequence
  source 1..20: mol_type = other DNA
aacgcatttcacgtggttcc

SEQ ID NO: 101532 - DNA, 20 bp, synthetic construct
  misc_feature 1..20: note = CRISPR gRNA sequence
  source 1..20: mol_type = other DNA
cacgtggttcccgcgcacag

SEQ ID NO: 101533 - DNA, 20 bp, synthetic construct
  misc_feature 1..20: note = CRISPR gRNA sequence
  source 1..20: mol_type = other DNA
acgtggttcccgcgcacagc

SEQ ID NO: 101534 - DNA, 20 bp, synthetic construct
  misc_feature 1..20: note = CRISPR gRNA sequence
  source 1..20: mol_type = other DNA
ccgcgcacagcgtacagcag

SEQ ID NO: 101535 - DNA, 20 bp, synthetic construct
  misc_feature 1..20: note = CRISPR gRNA sequence
  source 1..20: mol_type = other DNA
cattctgtcgtgggtagggg

SEQ ID NO: 101536 - DNA, 20 bp, synthetic construct
  misc_feature 1..20: note = CRISPR gRNA sequence
  source 1..20: mol_type = other DNA
tgtcgtgggtaggggcagga

SEQ ID NO: 101537 - DNA, 20 bp, synthetic construct
  misc_feature 1..20: note = CRISPR gRNA sequence
  source 1..20: mol_type = other DNA
tcgtgggtaggggcaggaga

SEQ ID NO: 101538 - DNA, 20 bp, synthetic construct
  misc_feature 1..20: note = CRISPR gRNA sequence
  source 1..20: mol_type = other DNA
acctcttcctcattctcaaa

SEQ ID NO: 101539 - DNA, 20 bp, synthetic construct
  misc_feature 1..20: note = CRISPR gRNA sequence
  source 1..20: mol_type = other DNA
cctcttcctcattctcaaaa

SEQ ID NO: 101540 - DNA, 20 bp, synthetic construct
  misc_feature 1..20: note = CRISPR gRNA sequence
  source 1..20: mol_type = other DNA
ttcctcattctcaaaatgcc

SEQ ID NO: 101541 - DNA, 20 bp, synthetic construct
  misc_feature 1..20: note = CRISPR gRNA sequence
  source 1..20: mol_type = other DNA
cctcattctcaaaatgcctt

SEQ ID NO: 101542 - DNA, 20 bp, synthetic construct
  misc_feature 1..20: note = CRISPR gRNA sequence
  source 1..20: mol_type = other DNA
ctcattctcaaaatgccttg

SEQ ID NO: 101543 - DNA, 20 bp, synthetic construct
  misc_feature 1..20: note = CRISPR gRNA sequence
  source 1..20: mol_type = other DNA
attctcaaaatgccttgtac

SEQ ID NO: 101544 - DNA, 20 bp, synthetic construct
  misc_feature 1..20: note = CRISPR gRNA sequence
  source 1..20: mol_type = other DNA
tcaaaatgccttgtactctc

SEQ ID NO: 101545 - DNA, 20 bp, synthetic construct
  misc_feature 1..20: note = CRISPR gRNA sequence
  source 1..20: mol_type = other DNA
aaaatgccttgtactctctg

SEQ ID NO: 101546 - DNA, 20 bp, synthetic construct
  misc_feature 1..20: note = CRISPR gRNA sequence
  source 1..20: mol_type = other DNA
gtactctctggcctccagtt

SEQ ID NO: 101547 - DNA, 20 bp, synthetic construct
  misc_feature 1..20: note = CRISPR gRNA sequence
  source 1..20: mol_type = other DNA
tactctctggcctccagttg

SEQ ID NO: 101548 - DNA, 20 bp, synthetic construct
  misc_feature 1..20: note = CRISPR gRNA sequence
  source 1..20: mol_type = other DNA
tctggcctccagttgaacgt

SEQ ID NO: 101549 - DNA, 20 bp, synthetic construct
  misc_feature 1..20: note = CRISPR gRNA sequence
  source 1..20: mol_type = other DNA
tggcctccagttgaacgtgg

SEQ ID NO: 101550 - DNA, 20 bp, synthetic construct
  misc_feature 1..20: note = CRISPR gRNA sequence
  source 1..20: mol_type = other DNA
gcctccagttgaacgtggtt

SEQ ID NO: 101551 - DNA, 20 bp, synthetic construct
  misc_feature 1..20: note = CRISPR gRNA sequence
  source 1..20: mol_type = other DNA
cagttgaacgtggttcctcc

SEQ ID NO: 101552 - DNA, 20 bp, synthetic construct
  misc_feature 1..20: note = CRISPR gRNA sequence
  source 1..20: mol_type = other DNA
aacgtggttcctcctgctca

SEQ ID NO: 101553 - DNA, 20 bp, synthetic construct
  misc_feature 1..20: note = CRISPR gRNA sequence
  source 1..20: mol_type = other DNA
ctcctgctcatcactgggcc

SEQ ID NO: 101554 - DNA, 20 bp, synthetic construct
  misc_feature 1..20: note = CRISPR gRNA sequence
  source 1..20: mol_type = other DNA
ctgctcatcactgggcccat

SEQ ID NO: 101555 - DNA, 20 bp, synthetic construct
  misc_feature 1..20: note = CRISPR gRNA sequence
  source 1..20: mol_type = other DNA
ctcatcactgggcccatctc

SEQ ID NO: 101556 - DNA, 20 bp, synthetic construct
  misc_feature 1..20: note = CRISPR gRNA sequence
  source 1..20: mol_type = other DNA
atcactgggcccatctcact

SEQ ID NO: 101557 - DNA, 20 bp, synthetic construct
  misc_feature 1..20: note = CRISPR gRNA sequence
  source 1..20: mol_type = other DNA
ggcccatctcactttctggg

SEQ ID NO: 101558 - DNA, 20 bp, synthetic construct
  misc_feature 1..20: note = CRISPR gRNA sequence
  source 1..20: mol_type = other DNA
actttctggggtctcaagct

SEQ ID NO: 101559 - DNA, 20 bp, synthetic construct
  misc_feature 1..20: note = CRISPR gRNA sequence
  source 1..20: mol_type = other DNA
tctggggtctcaagcttaga

SEQ ID NO: 101560 - DNA, 20 bp, synthetic construct
  misc_feature 1..20: note = CRISPR gRNA sequence
  source 1..20: mol_type = other DNA
ctggggtctcaagcttagac

SEQ ID NO: 101561 - DNA, 20 bp, synthetic construct
  misc_feature 1..20: note = CRISPR gRNA sequence
  source 1..20: mol_type = other DNA
tggggtctcaagcttagaca

SEQ ID NO: 101562 - DNA, 20 bp, synthetic construct
  misc_feature 1..20: note = CRISPR gRNA sequence
  source 1..20: mol_type = other DNA
gggtctcaagcttagacacc

SEQ ID NO: 101563 - DNA, 20 bp, synthetic construct
  misc_feature 1..20: note = CRISPR gRNA sequence
  source 1..20: mol_type = other DNA
aagcttagacaccttcctcc

SEQ ID NO: 101564 - DNA, 20 bp, synthetic construct
  misc_feature 1..20: note = CRISPR gRNA sequence
  source 1..20: mol_type = other DNA
agacaccttcctccaggaag

SEQ ID NO: 101565 - DNA, 20 bp, synthetic construct
  misc_feature 1..20: note = CRISPR gRNA sequence
  source 1..20: mol_type = other DNA
gacaccttcctccaggaaga

SEQ ID NO: 101566 - DNA, 20 bp, synthetic construct
  misc_feature 1..20: note = CRISPR gRNA sequence
  source 1..20: mol_type = other DNA
cctccaggaagacctctctg

SEQ ID NO: 101567 - DNA, 20 bp, synthetic construct
  misc_feature 1..20: note = CRISPR gRNA sequence
  source 1..20: mol_type = other DNA
ctccaggaagacctctctga

SEQ ID NO: 101568 - DNA, 20 bp, synthetic construct
  misc_feature 1..20: note = CRISPR gRNA sequence
  source 1..20: mol_type = other DNA
caggaagacctctctgattt

SEQ ID NO: 101569 - DNA, 20 bp, synthetic construct
  misc_feature 1..20: note = CRISPR gRNA sequence
  source 1..20: mol_type = other DNA
tctgatttcccttgcccaca

SEQ ID NO: 101570 - DNA, 20 bp, synthetic construct
  misc_feature 1..20: note = CRISPR gRNA sequence
  source 1..20: mol_type = other DNA
tgatttcccttgcccacatg

SEQ ID NO: 101571 - DNA, 20 bp, synthetic construct
  misc_feature 1..20: note = CRISPR gRNA sequence
  source 1..20: mol_type = other DNA
atttcccttgcccacatggg

SEQ ID NO: 101572 - DNA, 20 bp, synthetic construct
  misc_feature 1..20: note = CRISPR gRNA sequence
  source 1..20: mol_type = other DNA
cccttgcccacatggggctc

SEQ ID NO: 101573 - DNA, 20 bp, synthetic construct
  misc_feature 1..20: note = CRISPR gRNA sequence
  source 1..20: mol_type = other DNA
ccttgcccacatggggctct

SEQ ID NO: 101574 - DNA, 20 bp, synthetic construct
  misc_feature 1..20: note = CRISPR gRNA sequence
  source 1..20: mol_type = other DNA
gcccacatggggctcttgta

SEQ ID NO: 101575 - DNA, 20 bp, synthetic construct
  misc_feature 1..20: note = CRISPR gRNA sequence
  source 1..20: mol_type = other DNA
cccacatggggctcttgtag

SEQ ID NO: 101576 - DNA, 20 bp, synthetic construct
  misc_feature 1..20: note = CRISPR gRNA sequence
  source 1..20: mol_type = other DNA
ttgtagccacctgtgcatct

SEQ ID NO: 101577 - DNA, 20 bp, synthetic construct
  misc_feature 1..20: note = CRISPR gRNA sequence
  source 1..20: mol_type = other DNA
gtagccacctgtgcatctgc

SEQ ID NO: 101578 - DNA, 20 bp, synthetic construct
  misc_feature 1..20: note = CRISPR gRNA sequence
  source 1..20: mol_type = other DNA
tagccacctgtgcatctgcc

SEQ ID NO: 101579 - DNA, 20 bp, synthetic construct
  misc_feature 1..20: note = CRISPR gRNA sequence
  source 1..20: mol_type = other DNA
tgcatctgccatcgcagcgc

SEQ ID NO: 101580 - DNA, 20 bp, synthetic construct
  misc_feature 1..20: note = CRISPR gRNA sequence
  source 1..20: mol_type = other DNA
ccatcgcagcgcagttcact

SEQ ID NO: 101581 - DNA, 20 bp, synthetic construct
  misc_feature 1..20: note = CRISPR gRNA sequence
  source 1..20: mol_type = other DNA
actgcatctcagctgcctgt

SEQ ID NO: 101582 - DNA, 20 bp, synthetic construct
  misc_feature 1..20: note = CRISPR gRNA sequence
  source 1..20: mol_type = other DNA
catctcagctgcctgtttcc

SEQ ID NO: 101583 - DNA, 20 bp, synthetic construct
  misc_feature 1..20: note = CRISPR gRNA sequence
  source 1..20: mol_type = other DNA
agctgcctgtttccatgtct

SEQ ID NO: 101584 - DNA, 20 bp, synthetic construct
  misc_feature 1..20: note = CRISPR gRNA sequence
  source 1..20: mol_type = other DNA
cctgtttccatgtctgcctt

SEQ ID NO: 101585 - DNA, 20 bp, synthetic construct
  misc_feature 1..20: note = CRISPR gRNA sequence
  source 1..20: mol_type = other DNA
tttccatgtctgccttccct

SEQ ID NO: 101586 - DNA, 20 bp, synthetic construct
  misc_feature 1..20: note = CRISPR gRNA sequence
  source 1..20: mol_type = other DNA
ccatgtctgccttccctgca

SEQ ID NO: 101587 - DNA, 20 bp, synthetic construct
  misc_feature 1..20: note = CRISPR gRNA sequence
  source 1..20: mol_type = other DNA
catgtctgccttccctgcat

SEQ ID NO: 101588 - DNA, 20 bp, synthetic construct
  misc_feature 1..20: note = CRISPR gRNA sequence
  source 1..20: mol_type = other DNA
ccttccctgcatggggagct

SEQ ID NO: 101589 - DNA, 20 bp, synthetic construct
  misc_feature 1..20: note = CRISPR gRNA sequence
  source 1..20: mol_type = other DNA
ccctgcatggggagctctgc

SEQ ID NO: 101590 - DNA, 20 bp, synthetic construct
  misc_feature 1..20: note = CRISPR gRNA sequence
  source 1..20: mol_type = other DNA
cctgcatggggagctctgct

SEQ ID NO: 101591 - DNA, 20 bp, synthetic construct
  misc_feature 1..20: note = CRISPR gRNA sequence
  source 1..20: mol_type = other DNA
catggggagctctgctctgt

SEQ ID NO: 101592 - DNA, 20 bp, synthetic construct
  misc_feature 1..20: note = CRISPR gRNA sequence
  source 1..20: mol_type = other DNA
tgctctgtgaggctgggaat

SEQ ID NO: 101593 - DNA, 20 bp, synthetic construct
  misc_feature 1..20: note = CRISPR gRNA sequence
  source 1..20: mol_type = other DNA
ctctgtgaggctgggaatgg

SEQ ID NO: 101594 - DNA, 20 bp, synthetic construct
  misc_feature 1..20: note = CRISPR gRNA sequence
  source 1..20: mol_type = other DNA
tgtgaggctgggaatggggc

SEQ ID NO: 101595 - DNA, 20 bp, synthetic construct
  misc_feature 1..20: note = CRISPR gRNA sequence
  source 1..20: mol_type = other DNA
tgaggctgggaatggggctg

SEQ ID NO: 101596 - DNA, 20 bp, synthetic construct
  misc_feature 1..20: note = CRISPR gRNA sequence
  source 1..20: mol_type = other DNA
ggaatggggctgtctcgtgt

SEQ ID NO: 101597 - DNA, 20 bp, synthetic construct
  misc_feature 1..20: note = CRISPR gRNA sequence
  source 1..20: mol_type = other DNA
tctcgtgttctcggcaccta

SEQ ID NO: 101598 - DNA, 20 bp, synthetic construct
  misc_feature 1..20: note = CRISPR gRNA sequence
  source 1..20: mol_type = other DNA
gtgttctcggcacctagagc

SEQ ID NO: 101599 - DNA, 20 bp, synthetic construct
  misc_feature 1..20: note = CRISPR gRNA sequence
  source 1..20: mol_type = other DNA
tcggcacctagagcaggcct

SEQ ID NO: 101600 - DNA, 20 bp, synthetic construct
  misc_feature 1..20: note = CRISPR gRNA sequence
  source 1..20: mol_type = other DNA
ggcacctagagcaggcctgc

SEQ ID NO: 101601 - DNA, 20 bp, synthetic construct
  misc_feature 1..20: note = CRISPR gRNA sequence
  source 1..20: mol_type = other DNA
gagcaggcctgcacctttca

SEQ ID NO: 101602 - DNA, 20 bp, synthetic construct
  misc_feature 1..20: note = CRISPR gRNA sequence
  source 1..20: mol_type = other DNA
cacctttcaagtactctgtg

SEQ ID NO: 101603 - DNA, 20 bp, synthetic construct
  misc_feature 1..20: note = CRISPR gRNA sequence
  source 1..20: mol_type = other DNA
tcaagtactctgtgaacatt

SEQ ID NO: 101604 - DNA, 20 bp, synthetic construct
  misc_feature 1..20: note = CRISPR gRNA sequence
  source 1..20: mol_type = other DNA
caagtactctgtgaacattt

SEQ ID NO: 101605 - DNA, 20 bp, synthetic construct
  misc_feature 1..20: note = CRISPR gRNA sequence
  source 1..20: mol_type = other DNA
aagtactctgtgaacatttg

SEQ ID NO: 101606 - DNA, 20 bp, synthetic construct
  misc_feature 1..20: note = CRISPR gRNA sequence
  source 1..20: mol_type = other DNA
tgtgaacatttgaggcagga

SEQ ID NO: 101607 - DNA, 20 bp, synthetic construct
  misc_feature 1..20: note = CRISPR gRNA sequence
  source 1..20: mol_type = other DNA
tgaacatttgaggcaggaat

SEQ ID NO: 101608 - DNA, 20 bp, synthetic construct
  misc_feature 1..20: note = CRISPR gRNA sequence
  source 1..20: mol_type = other DNA
gaggcaggaatgaaggccag

SEQ ID NO: 101609 - DNA, 20 bp, synthetic construct
  misc_feature 1..20: note = CRISPR gRNA sequence
  source 1..20: mol_type = other DNA
aggcaggaatgaaggccagg

SEQ ID NO: 101610 - DNA, 20 bp, synthetic construct
  misc_feature 1..20: note = CRISPR gRNA sequence
  source 1..20: mol_type = other DNA
agaggtcctggggatgggca

SEQ ID NO: 101611 - DNA, 20 bp, synthetic construct
  misc_feature 1..20: note = CRISPR gRNA sequence
  source 1..20: mol_type = other DNA
gggatgggcagtccctcacc

SEQ ID NO: 101612 - DNA, 20 bp, synthetic construct
  misc_feature 1..20: note = CRISPR gRNA sequence
  source 1..20: mol_type = other DNA
acccaatcatagatgttgat

SEQ ID NO: 101613 - DNA, 20 bp, synthetic construct
  misc_feature 1..20: note = CRISPR gRNA sequence
  source 1..20: mol_type = other DNA
atgtccacgtcacgctccag

SEQ ID NO: 101614 - DNA, 20 bp, synthetic construct
  misc_feature 1..20: note = CRISPR gRNA sequence
  source 1..20: mol_type = other DNA
cagcagcagccccacaatgt

SEQ ID NO: 101615 - DNA, 20 bp, synthetic construct
  misc_feature 1..20: note = CRISPR gRNA sequence
  source 1..20: mol_type = other DNA
tgtagccgcctgtgctggcc

SEQ ID NO: 101616 - DNA, 20 bp, synthetic construct
  misc_feature 1..20: note = CRISPR gRNA sequence
  source 1..20: mol_type = other DNA
tgctggccagcgacagggcg

SEQ ID NO: 101617 - DNA, 20 bp, synthetic construct
  misc_feature 1..20: note = CRISPR gRNA sequence
  source 1..20: mol_type = other DNA
gccagcgacagggcgctctc

SEQ ID NO: 101618 - DNA, 20 bp, synthetic construct
  misc_feature 1..20: note = CRISPR gRNA sequence
  source 1..20: mol_type = other DNA
tctcgctcttttgccaggat

SEQ ID NO: 101619 - DNA, 20 bp, synthetic construct
  misc_feature 1..20: note = CRISPR gRNA sequence
  source 1..20: mol_type = other DNA
tcgctcttttgccaggatgt

SEQ ID NO: 101620 - DNA, 20 bp, synthetic construct
  misc_feature 1..20: note = CRISPR gRNA sequence
  source 1..20: mol_type = other DNA
gctcttttgccaggatgtgg

SEQ ID NO: 101621 - DNA, 20 bp, synthetic construct
  misc_feature 1..20: note = CRISPR gRNA sequence
  source 1..20: mol_type = other DNA
ttttgccaggatgtgggggt

SEQ ID NO: 101622 - DNA, 20 bp, synthetic construct
  misc_feature 1..20: note = CRISPR gRNA sequence
  source 1..20: mol_type = other DNA
ttgccaggatgtgggggtcg

SEQ ID NO: 101623 - DNA, 20 bp, synthetic construct
  misc_feature 1..20: note = CRISPR gRNA sequence
  source 1..20: mol_type = other DNA
tgccaggatgtgggggtcgg

SEQ ID NO: 101624 - DNA, 20 bp, synthetic construct
  misc_feature 1..20: note = CRISPR gRNA sequence
  source 1..20: mol_type = other DNA
gccaggatgtgggggtcggc

SEQ ID NO: 101625 - DNA, 20 bp, synthetic construct
  misc_feature 1..20: note = CRISPR gRNA sequence
  source 1..20: mol_type = other DNA
ccaggatgtgggggtcggca

SEQ ID NO: 101626 - DNA, 20 bp, synthetic construct
  misc_feature 1..20: note = CRISPR gRNA sequence
  source 1..20: mol_type = other DNA
cagggagaagaagggacagt

SEQ ID NO: 101627 - DNA, 20 bp, synthetic construct
  misc_feature 1..20: note = CRISPR gRNA sequence
  source 1..20: mol_type = other DNA
gggcataaccaggaatcctg

SEQ ID NO: 101628 - DNA, 20 bp, synthetic construct
  misc_feature 1..20: note = CRISPR gRNA sequence
  source 1..20: mol_type = other DNA
gggtacccacagcagccgca

SEQ ID NO: 101629 - DNA, 20 bp, synthetic construct
  misc_feature 1..20: note = CRISPR gRNA sequence
  source 1..20: mol_type = other DNA
tttttttttttttggagata

SEQ ID NO: 101630 - DNA, 20 bp, synthetic construct
  misc_feature 1..20: note = CRISPR gRNA sequence
  source 1..20: mol_type = other DNA
ttttttttttttggagatag

SEQ ID NO: 101631 - DNA, 20 bp, synthetic construct
  misc_feature 1..20: note = CRISPR gRNA sequence
  source 1..20: mol_type = other DNA
tttttttttttggagataga

SEQ ID NO: 101632 - DNA, 20 bp, synthetic construct
  misc_feature 1..20: note = CRISPR gRNA sequence
  source 1..20: mol_type = other DNA
ttttttttttggagatagag

SEQ ID NO: 101633 - DNA, 20 bp, synthetic construct
  misc_feature 1..20: note = CRISPR gRNA sequence
  source 1..20: mol_type = other DNA
tttttttttggagatagagt

SEQ ID NO: 101634 - DNA, 20 bp, synthetic construct
  misc_feature 1..20: note = CRISPR gRNA sequence
  source 1..20: mol_type = other DNA
ttttttttggagatagagtc

SEQ ID NO: 101635 - DNA, 20 bp, synthetic construct
  misc_feature 1..20: note = CRISPR gRNA sequence
  source 1..20: mol_type = other DNA
tttttttggagatagagtct

SEQ ID NO: 101636 - DNA, 20 bp, synthetic construct
  misc_feature 1..20: note = CRISPR gRNA sequence
  source 1..20: mol_type = other DNA
ttttttggagatagagtctt

SEQ ID NO: 101637 - DNA, 20 bp, synthetic construct
  misc_feature 1..20: note = CRISPR gRNA sequence
  source 1..20: mol_type = other DNA
tttttggagatagagtcttg

SEQ ID NO: 101638 - DNA, 20 bp, synthetic construct
  misc_feature 1..20: note = CRISPR gRNA sequence
  source 1..20: mol_type = other DNA
ttttggagatagagtcttgc

SEQ ID NO: 101639 - DNA, 20 bp, synthetic construct
  misc_feature 1..20: note = CRISPR gRNA sequence
  source 1..20: mol_type = other DNA
tttggagatagagtcttgct

SEQ ID NO: 101640 - DNA, 20 bp, synthetic construct
  misc_feature 1..20: note = CRISPR gRNA sequence
  source 1..20: mol_type = other DNA
ttggagatagagtcttgctc

SEQ ID NO: 101641 - DNA, 20 bp, synthetic construct
  misc_feature 1..20: note = CRISPR gRNA sequence
  source 1..20: mol_type = other DNA
tggagatagagtcttgctct

SEQ ID NO: 101642 - DNA, 20 bp, synthetic construct
  misc_feature 1..20: note = CRISPR gRNA sequence
  source 1..20: mol_type = other DNA
ggagatagagtcttgctctg

SEQ ID NO: 101643 - DNA, 20 bp, synthetic construct
  misc_feature 1..20: note = CRISPR gRNA sequence
  source 1..20: mol_type = other DNA
gagatagagtcttgctctgt

SEQ ID NO: 101644 - DNA, 20 bp, synthetic construct
  misc_feature 1..20: note = CRISPR gRNA sequence
  source 1..20: mol_type = other DNA
gctctgttgcccaggctgga

SEQ ID NO: 101645 - DNA, 20 bp, synthetic construct
  misc_feature 1..20: note = CRISPR gRNA sequence
  source 1..20: mol_type = other DNA
ctctgttgcccaggctggag

SEQ ID NO: 101646 - DNA, 20 bp, synthetic construct
  misc_feature 1..20: note = CRISPR gRNA sequence
  source 1..20: mol_type = other DNA
tgttgcccaggctggagtgc

SEQ ID NO: 101647 - DNA, 20 bp, synthetic construct
  misc_feature 1..20: note = CRISPR gRNA sequence
  source 1..20: mol_type = other DNA
ttgcccaggctggagtgcag

SEQ ID NO: 101648 - DNA, 20 bp, synthetic construct
  misc_feature 1..20: note = CRISPR gRNA sequence
  source 1..20: mol_type = other DNA
cccaggctggagtgcagtgg

SEQ ID NO: 101649 - DNA, 20 bp, synthetic construct
  misc_feature 1..20: note = CRISPR gRNA sequence
  source 1..20: mol_type = other DNA
gagtgcagtggcgcaatctc

SEQ ID NO: 101650 - DNA, 20 bp, synthetic construct
  misc_feature 1..20: note = CRISPR gRNA sequence
  source 1..20: mol_type = other DNA
ggctcactgctacctccgcc

SEQ ID NO: 101651 - DNA, 20 bp, synthetic construct
  misc_feature 1..20: note = CRISPR gRNA sequence
  source 1..20: mol_type = other DNA
actgctacctccgcctccca

SEQ ID NO: 101652 - DNA, 20 bp, synthetic construct
  misc_feature 1..20: note = CRISPR gRNA sequence
  source 1..20: mol_type = other DNA
ctacctccgcctcccaggtt

SEQ ID NO: 101653 - DNA, 20 bp, synthetic construct
  misc_feature 1..20: note = CRISPR gRNA sequence
  source 1..20: mol_type = other DNA
cctccgcctcccaggttcac

SEQ ID NO: 101654 - DNA, 20 bp, synthetic construct
  misc_feature 1..20: note = CRISPR gRNA sequence
  source 1..20: mol_type = other DNA
cgcctcccaggttcacacag

SEQ ID NO: 101655 - DNA, 20 bp, synthetic construct
  misc_feature 1..20: note = CRISPR gRNA sequence
  source 1..20: mol_type = other DNA
ccaggttcacacagttctcc

SEQ ID NO: 101656 - DNA, 20 bp, synthetic construct
  misc_feature 1..20: note = CRISPR gRNA sequence
  source 1..20: mol_type = other DNA
acacagttctcccacctcag

SEQ ID NO: 101657 - DNA, 20 bp, synthetic construct
  misc_feature 1..20: note = CRISPR gRNA sequence
  source 1..20: mol_type = other DNA
tcccacctcagcctccagag

SEQ ID NO: 101658 - DNA, 20 bp, synthetic construct
  misc_feature 1..20: note = CRISPR gRNA sequence
  source 1..20: mol_type = other DNA
ccacctcagcctccagagta

SEQ ID NO: 101659 - DNA, 20 bp, synthetic construct
  misc_feature 1..20: note = CRISPR gRNA sequence
  source 1..20: mol_type = other DNA
agcctccagagtacctggga

SEQ ID NO: 101660 - DNA, 20 bp, synthetic construct
  misc_feature 1..20: note = CRISPR gRNA sequence
  source 1..20: mol_type = other DNA
cagagtacctgggattacag

SEQ ID NO: 101661 - DNA, 20 bp, synthetic construct
  misc_feature 1..20: note = CRISPR gRNA sequence
  source 1..20: mol_type = other DNA
ggattacaggcacccaccac

SEQ ID NO: 101662 - DNA, 20 bp, synthetic construct
  misc_feature 1..20: note = CRISPR gRNA sequence
  source 1..20: mol_type = other DNA
caggcacccaccacgacgcc

SEQ ID NO: 101663 - DNA, 20 bp, synthetic construct
  misc_feature 1..20: note = CRISPR gRNA sequence
  source 1..20: mol_type = other DNA
gctaatttttgtattttttt

SEQ ID NO: 101664 - DNA, 20 bp, synthetic construct
  misc_feature 1..20: note = CRISPR gRNA sequence
  source 1..20: mol_type = other DNA
atttttgtatttttttagta

SEQ ID NO: 101665 - DNA, 20 bp, synthetic construct
  misc_feature 1..20: note = CRISPR gRNA sequence
  source 1..20: mol_type = other DNA
ttgtatttttttagtagaga

SEQ ID NO: 101666 - DNA, 20 bp, synthetic construct
  misc_feature 1..20: note = CRISPR gRNA sequence
  source 1..20: mol_type = other DNA
tgtatttttttagtagagac

SEQ ID NO: 101667 - DNA, 20 bp, synthetic construct
  misc_feature 1..20: note = CRISPR gRNA sequence
  source 1..20: mol_type = other DNA
gtatttttttagtagagaca

SEQ ID NO: 101668 - DNA, 20 bp, synthetic construct
  misc_feature 1..20: note = CRISPR gRNA sequence
  source 1..20: mol_type = other DNA
tatttttttagtagagacag

SEQ ID NO: 101669 - DNA, 20 bp, synthetic construct
  misc_feature 1..20: note = CRISPR gRNA sequence
  source 1..20: mol_type = other DNA
ttttagtagagacagggttt

SEQ ID NO: 101670 - DNA, 20 bp, synthetic construct
  misc_feature 1..20: note = CRISPR gRNA sequence
  source 1..20: mol_type = other DNA
tttagtagagacagggtttc

SEQ ID NO: 101671 - DNA, 20 bp, synthetic construct
  misc_feature 1..20: note = CRISPR gRNA sequence
  source 1..20: mol_type = other DNA
ttagtagagacagggtttca

SEQ ID NO: 101672 - DNA, 20 bp, synthetic construct
  misc_feature 1..20: note = CRISPR gRNA sequence
  source 1..20: mol_type = other DNA
tagtagagacagggtttcac

SEQ ID NO: 101673 - DNA, 20 bp, synthetic construct
  misc_feature 1..20: note = CRISPR gRNA sequence
  source 1..20: mol_type = other DNA
agtagagacagggtttcacc

SEQ ID NO: 101674 - DNA, 20 bp, synthetic construct
  misc_feature 1..20: note = CRISPR gRNA sequence
  source 1..20: mol_type = other DNA
gtagagacagggtttcaccc

SEQ ID NO: 101675 - DNA, 20 bp, synthetic construct
  misc_feature 1..20: note = CRISPR gRNA sequence
  source 1..20: mol_type = other DNA
cacccatgttggccgggctg

SEQ ID NO: 101676 - DNA, 20 bp, synthetic construct
  misc_feature 1..20: note = CRISPR gRNA sequence
  source 1..20: mol_type = other DNA
acccatgttggccgggctgg

SEQ ID NO: 101677 - DNA, 20 bp, synthetic construct
  misc_feature 1..20: note = CRISPR gRNA sequence
  source 1..20: mol_type = other DNA
gccgggctggtcttgaactc

SEQ ID NO: 101678 - DNA, 20 bp, synthetic construct
  misc_feature 1..20: note = CRISPR gRNA sequence
  source 1..20: mol_type = other DNA
gtcttgaactcctgacctca

SEQ ID NO: 101679 - DNA, 20 bp, synthetic construct
  misc_feature 1..20: note = CRISPR gRNA sequence
  source 1..20: mol_type = other DNA
gaactcctgacctcaagtga

SEQ ID NO: 101680 - DNA, 20 bp, synthetic construct
  misc_feature 1..20: note = CRISPR gRNA sequence
  source 1..20: mol_type = other DNA
aactcctgacctcaagtgat

SEQ ID NO: 101681 - DNA, 20 bp, synthetic construct
  misc_feature 1..20: note = CRISPR gRNA sequence
  source 1..20: mol_type = other DNA
ctgacctcaagtgatccacc

SEQ ID NO: 101682 - DNA, 20 bp, synthetic construct
  misc_feature 1..20: note = CRISPR gRNA sequence
  source 1..20: mol_type = other DNA
acctcaagtgatccacccgc

SEQ ID NO: 101683 - DNA, 20 bp, synthetic construct
  misc_feature 1..20: note = CRISPR gRNA sequence
  source 1..20: mol_type = other DNA
aagtgatccacccgcctcgg

SEQ ID NO: 101684 - DNA, 20 bp, synthetic construct
  misc_feature 1..20: note = CRISPR gRNA sequence
  source 1..20: mol_type = other DNA
ggcctcccaaagtgctggga

SEQ ID NO: 101685 - DNA, 20 bp, synthetic construct
  misc_feature 1..20: note = CRISPR gRNA sequence
  source 1..20: mol_type = other DNA
ccaaagtgctgggattacag

SEQ ID NO: 101686 - DNA, 20 bp, synthetic construct
  misc_feature 1..20: note = CRISPR gRNA sequence
  source 1..20: mol_type = other DNA
ggattacaggcatgagccac

SEQ ID NO: 101687 - DNA, 20 bp, synthetic construct
  misc_feature 1..20: note = CRISPR gRNA sequence
  source 1..20: mol_type = other DNA
caggcatgagccactgcacc

SEQ ID NO: 101688 - DNA, 20 bp, synthetic construct
  misc_feature 1..20: note = CRISPR gRNA sequence
  source 1..20: mol_type = other DNA
cacccagccagcagccgcat

SEQ ID NO: 101689 - DNA, 20 bp, synthetic construct
  misc_feature 1..20: note = CRISPR gRNA sequence
  source 1..20: mol_type = other DNA
aaagacaaggcgccagcaga

SEQ ID NO: 101690 - DNA, 20 bp, synthetic construct
  misc_feature 1..20: note = CRISPR gRNA sequence
  source 1..20: mol_type = other DNA
aggcccccgggaacccccca

SEQ ID NO: 101691 - DNA, 20 bp, synthetic construct
  misc_feature 1..20: note = CRISPR gRNA sequence
  source 1..20: mol_type = other DNA
cccagctgggctgggacgca

SEQ ID NO: 101692 - DNA, 20 bp, synthetic construct
  misc_feature 1..20: note = CRISPR gRNA sequence
  source 1..20: mol_type = other DNA
ggctgggacgcacccactcc

SEQ ID NO: 101693 - DNA, 20 bp, synthetic construct
  misc_feature 1..20: note = CRISPR gRNA sequence
  source 1..20: mol_type = other DNA
ggacgcacccactccagcag

SEQ ID NO: 101694 - DNA, 20 bp, synthetic construct
  misc_feature 1..20: note = CRISPR gRNA sequence
  source 1..20: mol_type = other DNA
cagcaggaagcgaacggtct

SEQ ID NO: 101695 - DNA, 20 bp, synthetic construct
  misc_feature 1..20: note = CRISPR gRNA sequence
  source 1..20: mol_type = other DNA
aatctctccaaaggcggagg

SEQ ID NO: 101696 - DNA, 20 bp, synthetic construct
  misc_feature 1..20: note = CRISPR gRNA sequence
  source 1..20: mol_type = other DNA
tccaaaggcggaggcccaga

SEQ ID NO: 101697 - DNA, 20 bp, synthetic construct
  misc_feature 1..20: note = CRISPR gRNA sequence
  source 1..20: mol_type = other DNA
caaaggcggaggcccagatg

SEQ ID NO: 101698 - DNA, 20 bp, synthetic construct
  misc_feature 1..20: note = CRISPR gRNA sequence
  source 1..20: mol_type = other DNA
gtctggcttgttgacgaggt

SEQ ID NO: 101699 - DNA, 20 bp, synthetic construct
  misc_feature 1..20: note = CRISPR gRNA sequence
  source 1..20: mol_type = other DNA
gcttgttgacgaggttgtca

SEQ ID NO: 101700 - DNA, 20 bp, synthetic construct
  misc_feature 1..20: note = CRISPR gRNA sequence
  source 1..20: mol_type = other DNA
gttgacgaggttgtcacctg

SEQ ID NO: 101701 - DNA, 20 bp, synthetic construct
  misc_feature 1..20: note = CRISPR gRNA sequence
  source 1..20: mol_type = other DNA
ttgacgaggttgtcacctgg

SEQ ID NO: 101702 - DNA, 20 bp, synthetic construct
  misc_feature 1..20: note = CRISPR gRNA sequence
  source 1..20: mol_type = other DNA
acgaggttgtcacctggcag

SEQ ID NO: 101703 - DNA, 20 bp, synthetic construct
  misc_feature 1..20: note = CRISPR gRNA sequence
  source 1..20: mol_type = other DNA
tcacctggcaggaggaggcg

SEQ ID NO: 101704 - DNA, 20 bp, synthetic construct
  misc_feature 1..20: note = CRISPR gRNA sequence
  source 1..20: mol_type = other DNA
gcaggaggaggcgggcaata

SEQ ID NO: 101705 - DNA, 20 bp, synthetic construct
  misc_feature 1..20: note = CRISPR gRNA sequence
  source 1..20: mol_type = other DNA
cacccctgccccctatcccc

SEQ ID NO: 101706 - DNA, 20 bp, synthetic construct
  misc_feature 1..20: note = CRISPR gRNA sequence
  source 1..20: mol_type = other DNA
ccccctatccccagtgctgc

SEQ ID NO: 101707 - DNA, 20 bp, synthetic construct
  misc_feature 1..20: note = CRISPR gRNA sequence
  source 1..20: mol_type = other DNA
tccccagtgctgccaaatgg

SEQ ID NO: 101708 - DNA, 20 bp, synthetic construct
  misc_feature 1..20: note = CRISPR gRNA sequence
  source 1..20: mol_type = other DNA
ccaaatggggacgaggtggg

SEQ ID NO: 101709 - DNA, 20 bp, synthetic construct
  misc_feature 1..20: note = CRISPR gRNA sequence
  source 1..20: mol_type = other DNA
gggttagacaggggaatgag

SEQ ID NO: 101710 - DNA, 20 bp, synthetic construct
  misc_feature 1..20: note = CRISPR gRNA sequence
  source 1..20: mol_type = other DNA
gacaggggaatgagggggag

SEQ ID NO: 101711 - DNA, 20 bp, synthetic construct
  misc_feature 1..20: note = CRISPR gRNA sequence
  source 1..20: mol_type = other DNA
atggacatacatgaacacgg

SEQ ID NO: 101712 - DNA, 20 bp, synthetic construct
  misc_feature 1..20: note = CRISPR gRNA sequence
  source 1..20: mol_type = other DNA
gatacaatcatacacgtgga

SEQ ID NO: 101713 - DNA, 20 bp, synthetic construct
  misc_feature 1..20: note = CRISPR gRNA sequence
  source 1..20: mol_type = other DNA
acaggtcacgtcatgagtgg

SEQ ID NO: 101714 - DNA, 20 bp, synthetic construct
  misc_feature 1..20: note = CRISPR gRNA sequence
  source 1..20: mol_type = other DNA
tccgcaaatgctccttcagc

SEQ ID NO: 101715 - DNA, 20 bp, synthetic construct
  misc_feature 1..20: note = CRISPR gRNA sequence
  source 1..20: mol_type = other DNA
ccgcaaatgctccttcagct

SEQ ID NO: 101716 - DNA, 20 bp, synthetic construct
  misc_feature 1..20: note = CRISPR gRNA sequence
  source 1..20: mol_type = other DNA
cgcaaatgctccttcagctg

SEQ ID NO: 101717 - DNA, 20 bp, synthetic construct
  misc_feature 1..20: note = CRISPR gRNA sequence
  source 1..20: mol_type = other DNA
cttcagctggtccagctccc

SEQ ID NO: 101718 - DNA, 20 bp, synthetic construct
  misc_feature 1..20: note = CRISPR gRNA sequence
  source 1..20: mol_type = other DNA
cagctggtccagctccccct

SEQ ID NO: 101719 - DNA, 20 bp, synthetic construct
  misc_feature 1..20: note = CRISPR gRNA sequence
  source 1..20: mol_type = other DNA
agctggtccagctccccctg

SEQ ID NO: 101720 - DNA, 20 bp, synthetic construct
  misc_feature 1..20: note = CRISPR gRNA sequence
  source 1..20: mol_type = other DNA
gtccagctccccctgtgctg

SEQ ID NO: 101721 - DNA, 20 bp, synthetic construct
  misc_feature 1..20: note = CRISPR gRNA sequence
  source 1..20: mol_type = other DNA
cccctgtgctgcgagctggt

SEQ ID NO: 101722 - DNA, 20 bp, synthetic construct
  misc_feature 1..20: note = CRISPR gRNA sequence
  source 1..20: mol_type = other DNA
tgctgcgagctggtggatgg

SEQ ID NO: 101723 - DNA, 20 bp, synthetic construct
  misc_feature 1..20: note = CRISPR gRNA sequence
  source 1..20: mol_type = other DNA
cgagctggtggatggacagg

SEQ ID NO: 101724 - DNA, 20 bp, synthetic construct
  misc_feature 1..20: note = CRISPR gRNA sequence
  source 1..20: mol_type = other DNA
gtggatggacagggctgggg

SEQ ID NO: 101725 - DNA, 20 bp, synthetic construct
  misc_feature 1..20: note = CRISPR gRNA sequence
  source 1..20: mol_type = other DNA
gggcaggacagaggcagagt

SEQ ID NO: 101726 - DNA, 20 bp, synthetic construct
  misc_feature 1..20: note = CRISPR gRNA sequence
  source 1..20: mol_type = other DNA
actcatccccttgcttctct

SEQ ID NO: 101727 - DNA, 20 bp, synthetic construct
  misc_feature 1..20: note = CRISPR gRNA sequence
  source 1..20: mol_type = other DNA
atccccttgcttctctgtgc

SEQ ID NO: 101728 - DNA, 20 bp, synthetic construct
  misc_feature 1..20: note = CRISPR gRNA sequence
  source 1..20: mol_type = other DNA
gcttctctgtgcctcagttt

SEQ ID NO: 101729 - DNA, 20 bp, synthetic construct
  misc_feature 1..20: note = CRISPR gRNA sequence
  source 1..20: mol_type = other DNA
cttctctgtgcctcagttta

SEQ ID NO: 101730 - DNA, 20 bp, synthetic construct
  misc_feature 1..20: note = CRISPR gRNA sequence
  source 1..20: mol_type = other DNA
ctctgtgcctcagtttaccc

SEQ ID NO: 101731 - DNA, 20 bp, synthetic construct
  misc_feature 1..20: note = CRISPR gRNA sequence
  source 1..20: mol_type = other DNA
tctgtgcctcagtttaccct

SEQ ID NO: 101732 - DNA, 20 bp, synthetic construct
  misc_feature 1..20: note = CRISPR gRNA sequence
  source 1..20: mol_type = other DNA
tgtgcctcagtttaccctct

SEQ ID NO: 101733 - DNA, 20 bp, synthetic construct
  misc_feature 1..20: note = CRISPR gRNA sequence
  source 1..20: mol_type = other DNA
tgcctcagtttaccctctgt

SEQ ID NO: 101734 - DNA, 20 bp, synthetic construct
  misc_feature 1..20: note = CRISPR gRNA sequence
  source 1..20: mol_type = other DNA
agtttaccctctgtccacga

SEQ ID NO: 101735 - DNA, 20 bp, synthetic construct
  misc_feature 1..20: note = CRISPR gRNA sequence
  source 1..20: mol_type = other DNA
accctctgtccacgattgct

SEQ ID NO: 101736 - DNA, 20 bp, synthetic construct
  misc_feature 1..20: note = CRISPR gRNA sequence
  source 1..20: mol_type = other DNA
ccctctgtccacgattgctc

SEQ ID NO: 101737 - DNA, 20 bp, synthetic construct
  misc_feature 1..20: note = CRISPR gRNA sequence
  source 1..20: mol_type = other DNA
tgtccacgattgctcctcac

SEQ ID NO: 101738 - DNA, 20 bp, synthetic construct
  misc_feature 1..20: note = CRISPR gRNA sequence
  source 1..20: mol_type = other DNA
tccacgattgctcctcacag

SEQ ID NO: 101739 - DNA, 20 bp, synthetic construct
  misc_feature 1..20: note = CRISPR gRNA sequence
  source 1..20: mol_type = other DNA
ctcctcacaggccctcccac

SEQ ID NO: 101740 - DNA, 20 bp, synthetic construct
  misc_feature 1..20: note = CRISPR gRNA sequence
  source 1..20: mol_type = other DNA
ctcacaggccctcccaccct

SEQ ID NO: 101741 - DNA, 20 bp, synthetic construct
  misc_feature 1..20: note = CRISPR gRNA sequence
  source 1..20: mol_type = other DNA
acaggccctcccaccctcct

SEQ ID NO: 101742 - DNA, 20 bp, synthetic construct
  misc_feature 1..20: note = CRISPR gRNA sequence
  source 1..20: mol_type = other DNA
ccaccctcctactcctctcc

SEQ ID NO: 101743 - DNA, 20 bp, synthetic construct
  misc_feature 1..20: note = CRISPR gRNA sequence
  source 1..20: mol_type = other DNA
ctactcctctccttgttggg

SEQ ID NO: 101744 - DNA, 20 bp, synthetic construct
  misc_feature 1..20: note = CRISPR gRNA sequence
  source 1..20: mol_type = other DNA
ctcctctccttgttggggac

SEQ ID NO: 101745 - DNA, 20 bp, synthetic construct
  misc_feature 1..20: note = CRISPR gRNA sequence
  source 1..20: mol_type = other DNA
ctctccttgttggggaccgt

SEQ ID NO: 101746 - DNA, 20 bp, synthetic construct
  misc_feature 1..20: note = CRISPR gRNA sequence
  source 1..20: mol_type = other DNA
tccttgttggggaccgtggg

SEQ ID NO: 101747 - DNA, 20 bp, synthetic construct
  misc_feature 1..20: note = CRISPR gRNA sequence
  source 1..20: mol_type = other DNA
cttgttggggaccgtgggcc

SEQ ID NO: 101748 - DNA, 20 bp, synthetic construct
  misc_feature 1..20: note = CRISPR gRNA sequence
  source 1..20: mol_type = other DNA
gttggggaccgtgggcccac

SEQ ID NO: 101749 - DNA, 20 bp, synthetic construct
  misc_feature 1..20: note = CRISPR gRNA sequence
  source 1..20: mol_type = other DNA
ttggggaccgtgggcccact

SEQ ID NO: 101750 - DNA, 20 bp, synthetic construct
  misc_feature 1..20: note = CRISPR gRNA sequence
  source 1..20: mol_type = other DNA
gggaccgtgggcccactcac

SEQ ID NO: 101751 - DNA, 20 bp, synthetic construct
  misc_feature 1..20: note = CRISPR gRNA sequence
  source 1..20: mol_type = other DNA
acagtctagggtggccggca

SEQ ID NO: 101752 - DNA, 20 bp, synthetic construct
  misc_feature 1..20: note = CRISPR gRNA sequence
  source 1..20: mol_type = other DNA
gggtggccggcagagctgac

SEQ ID NO: 101753 - DNA, 20 bp, synthetic construct
  misc_feature 1..20: note = CRISPR gRNA sequence
  source 1..20: mol_type = other DNA
acacctcgttccctcgctgc

SEQ ID NO: 101754 - DNA, 20 bp, synthetic construct
  misc_feature 1..20: note = CRISPR gRNA sequence
  source 1..20: mol_type = other DNA
gttccctcgctgccggttgg

SEQ ID NO: 101755 - DNA, 20 bp, synthetic construct
  misc_feature 1..20: note = CRISPR gRNA sequence
  source 1..20: mol_type = other DNA
cctcgctgccggttggtgag

SEQ ID NO: 101756 - DNA, 20 bp, synthetic construct
  misc_feature 1..20: note = CRISPR gRNA sequence
  source 1..20: mol_type = other DNA
gctgccggttggtgagagtg

SEQ ID NO: 101757 - DNA, 20 bp, synthetic construct
  misc_feature 1..20: note = CRISPR gRNA sequence
  source 1..20: mol_type = other DNA
ccggttggtgagagtggtgg

SEQ ID NO: 101758 - DNA, 20 bp, synthetic construct
  misc_feature 1..20: note = CRISPR gRNA sequence
  source 1..20: mol_type = other DNA
gtgagagtggtggagtgctt

SEQ ID NO: 101759 - DNA, 20 bp, synthetic construct
  misc_feature 1..20: note = CRISPR gRNA sequence
  source 1..20: mol_type = other DNA
cagggagctgcctgctggga

SEQ ID NO: 101760 - DNA, 20 bp, synthetic construct
  misc_feature 1..20: note = CRISPR gRNA sequence
  source 1..20: mol_type = other DNA
agggagctgcctgctgggaa

SEQ ID NO: 101761 - DNA, 20 bp, synthetic construct
  misc_feature 1..20: note = CRISPR gRNA sequence
  source 1..20: mol_type = other DNA
cctgctgggaaacagacaac

SEQ ID NO: 101762 - DNA, 20 bp, synthetic construct
  misc_feature 1..20: note = CRISPR gRNA sequence
  source 1..20: mol_type = other DNA
ctgggaaacagacaacaggc

SEQ ID NO: 101763 - DNA, 20 bp, synthetic construct
  misc_feature 1..20: note = CRISPR gRNA sequence
  source 1..20: mol_type = other DNA
ggaaacagacaacaggcgtc

SEQ ID NO: 101764 - DNA, 20 bp, synthetic construct
  misc_feature 1..20: note = CRISPR gRNA sequence
  source 1..20: mol_type = other DNA
cccctcagtagatgtctctg

SEQ ID NO: 101765 - DNA, 20 bp, synthetic construct
  misc_feature 1..20: note = CRISPR gRNA sequence
  source 1..20: mol_type = other DNA
ccctcagtagatgtctctga

SEQ ID NO: 101766 - DNA, 20 bp, synthetic construct
  misc_feature 1..20: note = CRISPR gRNA sequence
  source 1..20: mol_type = other DNA
agtagatgtctctgaggctt

SEQ ID NO: 101767 - DNA, 20 bp, synthetic construct
  misc_feature 1..20: note = CRISPR gRNA sequence
  source 1..20: mol_type = other DNA
tgaggcttcaggacagaagc

SEQ ID NO: 101768 - DNA, 20 bp, synthetic construct
  misc_feature 1..20: note = CRISPR gRNA sequence
  source 1..20: mol_type = other DNA
aggcttcaggacagaagccc

SEQ ID NO: 101769 - DNA, 20 bp, synthetic construct
  misc_feature 1..20: note = CRISPR gRNA sequence
  source 1..20: mol_type = other DNA
caggacagaagcccatctgt

SEQ ID NO: 101770 - DNA, 20 bp, synthetic construct
  misc_feature 1..20: note = CRISPR gRNA sequence
  source 1..20: mol_type = other DNA
aggacagaagcccatctgtt

SEQ ID NO: 101771 - DNA, 20 bp, synthetic construct
  misc_feature 1..20: note = CRISPR gRNA sequence
  source 1..20: mol_type = other DNA
tttttttttgttgctgttgt

SEQ ID NO: 101772 - DNA, 20 bp, synthetic construct
  misc_feature 1..20: note = CRISPR gRNA sequence
  source 1..20: mol_type = other DNA
ttttttgttgctgttgttgt

SEQ ID NO: 101773 - DNA, 20 bp, synthetic construct
  misc_feature 1..20: note = CRISPR gRNA sequence
  source 1..20: mol_type = other DNA
tttttgttgctgttgttgtt

SEQ ID NO: 101774 - DNA, 20 bp, synthetic construct
  misc_feature 1..20: note = CRISPR gRNA sequence
  source 1..20: mol_type = other DNA
ttttgttgctgttgttgttt

SEQ ID NO: 101775 - DNA, 20 bp, synthetic construct
  misc_feature 1..20: note = CRISPR gRNA sequence
  source 1..20: mol_type = other DNA
tttgttgctgttgttgtttg

SEQ ID NO: 101776 - DNA, 20 bp, synthetic construct
  misc_feature 1..20: note = CRISPR gRNA sequence
  source 1..20: mol_type = other DNA
ttgttgctgttgttgtttga

SEQ ID NO: 101777 - DNA, 20 bp, synthetic construct
  misc_feature 1..20: note = CRISPR gRNA sequence
  source 1..20: mol_type = other DNA
tgttgctgttgttgtttgag

SEQ ID NO: 101778 - DNA, 20 bp, synthetic construct
  misc_feature 1..20: note = CRISPR gRNA sequence
  source 1..20: mol_type = other DNA
gttgctgttgttgtttgaga

SEQ ID NO: 101779 - DNA, 20 bp, synthetic construct
  misc_feature 1..20: note = CRISPR gRNA sequence
  source 1..20: mol_type = other DNA
ttgctgttgttgtttgagat

SEQ ID NO: 101780 - DNA, 20 bp, synthetic construct
  misc_feature 1..20: note = CRISPR gRNA sequence
  source 1..20: mol_type = other DNA
ctgttgttgtttgagatgga

SEQ ID NO: 101781 - DNA, 20 bp, synthetic construct
  misc_feature 1..20: note = CRISPR gRNA sequence
  source 1..20: mol_type = other DNA
ttgttgtttgagatggagtc

SEQ ID NO: 101782 - DNA, 20 bp, synthetic construct
  misc_feature 1..20: note = CRISPR gRNA sequence
  source 1..20: mol_type = other DNA
ttgtttgagatggagtctcc

SEQ ID NO: 101783 - DNA, 20 bp, synthetic construct
  misc_feature 1..20: note = CRISPR gRNA sequence
  source 1..20: mol_type = other DNA
tttgagatggagtctccgtc

SEQ ID NO: 101784 - DNA, 20 bp, synthetic construct
  misc_feature 1..20: note = CRISPR gRNA sequence
  source 1..20: mol_type = other DNA
gagatggagtctccgtctgt

SEQ ID NO: 101785 - DNA, 20 bp, synthetic construct
  misc_feature 1..20: note = CRISPR gRNA sequence
  source 1..20: mol_type = other DNA
agatggagtctccgtctgtc

SEQ ID NO: 101786 - DNA, 20 bp, synthetic construct
  misc_feature 1..20: note = CRISPR gRNA sequence
  source 1..20: mol_type = other DNA
cgtctgtcccccaggctgga

SEQ ID NO: 101787 - DNA, 20 bp, synthetic construct
  misc_feature 1..20: note = CRISPR gRNA sequence
  source 1..20: mol_type = other DNA
tcccccaggctggagtacag

SEQ ID NO: 101788 - DNA, 20 bp, synthetic construct
  misc_feature 1..20: note = CRISPR gRNA sequence
  source 1..20: mol_type = other DNA
gagtacagtggcgtgatctc

SEQ ID NO: 101789 - DNA, 20 bp, synthetic construct
  misc_feature 1..20: note = CRISPR gRNA sequence
  source 1..20: mol_type = other DNA
ggctcactgcaacctctgcc

SEQ ID NO: 101790 - DNA, 20 bp, synthetic construct
  misc_feature 1..20: note = CRISPR gRNA sequence
  source 1..20: mol_type = other DNA
actgcaacctctgcctcctg

SEQ ID NO: 101791 - DNA, 20 bp, synthetic construct
  misc_feature 1..20: note = CRISPR gRNA sequence
  source 1..20: mol_type = other DNA
caacctctgcctcctgggtt

SEQ ID NO: 101792 - DNA, 20 bp, synthetic construct
  misc_feature 1..20: note = CRISPR gRNA sequence
  source 1..20: mol_type = other DNA
tgcctcctgggttcaagcga

SEQ ID NO: 101793 - DNA, 20 bp, synthetic construct
  misc_feature 1..20: note = CRISPR gRNA sequence
  source 1..20: mol_type = other DNA
cctcctgggttcaagcgatt

SEQ ID NO: 101794 - DNA, 20 bp, synthetic construct
  misc_feature 1..20: note = CRISPR gRNA sequence
  source 1..20: mol_type = other DNA
ctgggttcaagcgattcttg

SEQ ID NO: 101795 - DNA, 20 bp, synthetic construct
  misc_feature 1..20: note = CRISPR gRNA sequence
  source 1..20: mol_type = other DNA
ggttcaagcgattcttgtgc

SEQ ID NO: 101796 - DNA, 20 bp, synthetic construct
  misc_feature 1..20: note = CRISPR gRNA sequence
  source 1..20: mol_type = other DNA
aagcgattcttgtgcctcag

SEQ ID NO: 101797 - DNA, 20 bp, synthetic construct
  misc_feature 1..20: note = CRISPR gRNA sequence
  source 1..20: mol_type = other DNA
ttgtgcctcagcctcccgag

SEQ ID NO: 101798 - DNA, 20 bp, synthetic construct
  misc_feature 1..20: note = CRISPR gRNA sequence
  source 1..20: mol_type = other DNA
gtgcctcagcctcccgagta

SEQ ID NO: 101799 - DNA, 20 bp, synthetic construct
  misc_feature 1..20: note = CRISPR gRNA sequence
  source 1..20: mol_type = other DNA
tgcctcagcctcccgagtag

SEQ ID NO: 101800 - DNA, 20 bp, synthetic construct
  misc_feature 1..20: note = CRISPR gRNA sequence
  source 1..20: mol_type = other DNA
agcctcccgagtagctggga

SEQ ID NO: 101801 - DNA, 20 bp, synthetic construct
  misc_feature 1..20: note = CRISPR gRNA sequence
  source 1..20: mol_type = other DNA
ccgagtagctgggatcatag

SEQ ID NO: 101802 - DNA, 20 bp, synthetic construct
  misc_feature 1..20: note = CRISPR gRNA sequence
  source 1..20: mol_type = other DNA
ggatcataggcgcccaccac

SEQ ID NO: 101803 - DNA, 20 bp, synthetic construct
  misc_feature 1..20: note = CRISPR gRNA sequence
  source 1..20: mol_type = other DNA
gctaatttttgtattttaag

SEQ ID NO: 101804 - DNA, 20 bp, synthetic construct
  misc_feature 1..20: note = CRISPR gRNA sequence
  source 1..20: mol_type = other DNA
atttttgtattttaagtaga

SEQ ID NO: 101805 - DNA, 20 bp, synthetic construct
  misc_feature 1..20: note = CRISPR gRNA sequence
  source 1..20: mol_type = other DNA
ttgtattttaagtagagacg

SEQ ID NO: 101806 - DNA, 20 bp, synthetic construct
  misc_feature 1..20: note = CRISPR gRNA sequence
  source 1..20: mol_type = other DNA
tgtattttaagtagagacgg

SEQ ID NO: 101807 - DNA, 20 bp, synthetic construct
  misc_feature 1..20: note = CRISPR gRNA sequence
  source 1..20: mol_type = other DNA
gtattttaagtagagacggg

SEQ ID NO: 101808 - DNA, 20 bp, synthetic construct
  misc_feature 1..20: note = CRISPR gRNA sequence
  source 1..20: mol_type = other DNA
tattttaagtagagacgggg

SEQ ID NO: 101809 - DNA, 20 bp, synthetic construct
  misc_feature 1..20: note = CRISPR gRNA sequence
  source 1..20: mol_type = other DNA
taagtagagacggggtttcg

SEQ ID NO: 101810 - DNA, 20 bp, synthetic construct
  misc_feature 1..20: note = CRISPR gRNA sequence
  source 1..20: mol_type = other DNA
aagtagagacggggtttcgc

SEQ ID NO: 101811 - DNA, 20 bp, synthetic construct
  misc_feature 1..20: note = CRISPR gRNA sequence
  source 1..20: mol_type = other DNA
agtagagacggggtttcgct

SEQ ID NO: 101812 - DNA, 20 bp, synthetic construct
  misc_feature 1..20: note = CRISPR gRNA sequence
  source 1..20: mol_type = other DNA
cgctatgttggccaggctaa

SEQ ID NO: 101813 - DNA, 20 bp, synthetic construct
  misc_feature 1..20: note = CRISPR gRNA sequence
  source 1..20: mol_type = other DNA
gctatgttggccaggctaat

SEQ ID NO: 101814 - DNA, 20 bp, synthetic construct
  misc_feature 1..20: note = CRISPR gRNA sequence
  source 1..20: mol_type = other DNA
tgttggccaggctaatttca

SEQ ID NO: 101815 - DNA, 20 bp, synthetic construct
  misc_feature 1..20: note = CRISPR gRNA sequence
  source 1..20: mol_type = other DNA
gccaggctaatttcaaactc

SEQ ID NO: 101816 - DNA, 20 bp, synthetic construct
  misc_feature 1..20: note = CRISPR gRNA sequence
  source 1..20: mol_type = other DNA
atttcaaactcctgacctca

SEQ ID NO: 101817 - DNA, 20 bp, synthetic construct
  misc_feature 1..20: note = CRISPR gRNA sequence
  source 1..20: mol_type = other DNA
caaactcctgacctcaaatc

SEQ ID NO: 101818 - DNA, 20 bp, synthetic construct
  misc_feature 1..20: note = CRISPR gRNA sequence
  source 1..20: mol_type = other DNA
aaactcctgacctcaaatca

SEQ ID NO: 101819 - DNA, 20 bp, synthetic construct
  misc_feature 1..20: note = CRISPR gRNA sequence
  source 1..20: mol_type = other DNA
ctgacctcaaatcatccacc

SEQ ID NO: 101820 - DNA, 20 bp, synthetic construct
  misc_feature 1..20: note = CRISPR gRNA sequence
  source 1..20: mol_type = other DNA
acctcaaatcatccacctgc

SEQ ID NO: 101821 - DNA, 20 bp, synthetic construct
  misc_feature 1..20: note = CRISPR gRNA sequence
  source 1..20: mol_type = other DNA
aaatcatccacctgcctcag

SEQ ID NO: 101822 - DNA, 20 bp, synthetic construct
  misc_feature 1..20: note = CRISPR gRNA sequence
  source 1..20: mol_type = other DNA
cctcagcctcccaaagtgct

SEQ ID NO: 101823 - DNA, 20 bp, synthetic construct
  misc_feature 1..20: note = CRISPR gRNA sequence
  source 1..20: mol_type = other DNA
agcctcccaaagtgctggga

SEQ ID NO: 101824 - DNA, 20 bp, synthetic construct
  misc_feature 1..20: note = CRISPR gRNA sequence
  source 1..20: mol_type = other DNA
ccaaagtgctgggattatag

SEQ ID NO: 101825 - DNA, 20 bp, synthetic construct
  misc_feature 1..20: note = CRISPR gRNA sequence
  source 1..20: mol_type = other DNA
ggattataggcatgagccac

SEQ ID NO: 101826 - DNA, 20 bp, synthetic construct
  misc_feature 1..20: note = CRISPR gRNA sequence
  source 1..20: mol_type = other DNA
taggcatgagccaccacacc

SEQ ID NO: 101827 - DNA, 20 bp, synthetic construct
  misc_feature 1..20: note = CRISPR gRNA sequence
  source 1..20: mol_type = other DNA
ttggggtttttttttttttt

SEQ ID NO: 101828 - DNA, 20 bp, synthetic construct
  misc_feature 1..20: note = CRISPR gRNA sequence
  source 1..20: mol_type = other DNA
gggttttttttttttttgag

SEQ ID NO: 101829 - DNA, 20 bp, synthetic construct
  misc_feature 1..20: note = CRISPR gRNA sequence
  source 1..20: mol_type = other DNA
tttttttttttgagacagag

SEQ ID NO: 101830 - DNA, 20 bp, synthetic construct
  misc_feature 1..20: note = CRISPR gRNA sequence
  source 1..20: mol_type = other DNA
ttttttttttgagacagagt

SEQ ID NO: 101831 - DNA, 20 bp, synthetic construct
  misc_feature 1..20: note = CRISPR gRNA sequence
  source 1..20: mol_type = other DNA
tttttttttgagacagagtc

SEQ ID NO: 101832 - DNA, 20 bp, synthetic construct
  misc_feature 1..20: note = CRISPR gRNA sequence
  source 1..20: mol_type = other DNA
ttttttttgagacagagtct

SEQ ID NO: 101833 - DNA, 20 bp, synthetic construct
  misc_feature 1..20: note = CRISPR gRNA sequence
  source 1..20: mol_type = other DNA
tttttttgagacagagtctt

SEQ ID NO: 101834 - DNA, 20 bp, synthetic construct
  misc_feature 1..20: note = CRISPR gRNA sequence
  source 1..20: mol_type = other DNA
ttttttgagacagagtcttg

SEQ ID NO: 101835 - DNA, 20 bp, synthetic construct
  misc_feature 1..20: note = CRISPR gRNA sequence
  source 1..20: mol_type = other DNA
tttttgagacagagtcttgc

SEQ ID NO: 101836 - DNA, 20 bp, synthetic construct
  misc_feature 1..20: note = CRISPR gRNA sequence
  source 1..20: mol_type = other DNA
ttttgagacagagtcttgct

SEQ ID NO: 101837 - DNA, 20 bp, synthetic construct
  misc_feature 1..20: note = CRISPR gRNA sequence
  source 1..20: mol_type = other DNA
tttgagacagagtcttgctc

SEQ ID NO: 101838 - DNA, 20 bp, synthetic construct
  misc_feature 1..20: note = CRISPR gRNA sequence
  source 1..20: mol_type = other DNA
ttgagacagagtcttgctct

SEQ ID NO: 101839 - DNA, 20 bp, synthetic construct
  misc_feature 1..20: note = CRISPR gRNA sequence
  source 1..20: mol_type = other DNA
tgagacagagtcttgctctg

SEQ ID NO: 101840 - DNA, 20 bp, synthetic construct
  misc_feature 1..20: note = CRISPR gRNA sequence
  source 1..20: mol_type = other DNA
gagacagagtcttgctctgt

SEQ ID NO: 101841 - DNA, 20 bp, synthetic construct
  misc_feature 1..20: note = CRISPR gRNA sequence
  source 1..20: mol_type = other DNA
agacagagtcttgctctgtt

SEQ ID NO: 101842 - DNA, 20 bp, synthetic construct
  misc_feature 1..20: note = CRISPR gRNA sequence
  source 1..20: mol_type = other DNA
gctctgttgtccaggctgga

SEQ ID NO: 101843 - DNA, 20 bp, synthetic construct
  misc_feature 1..20: note = CRISPR gRNA sequence
  source 1..20: mol_type = other DNA
ctctgttgtccaggctggag

SEQ ID NO: 101844 - DNA, 20 bp, synthetic construct
  misc_feature 1..20: note = CRISPR gRNA sequence
  source 1..20: mol_type = other DNA
tgttgtccaggctggagtgc

SEQ ID NO: 101845 - DNA, 20 bp, synthetic construct
  misc_feature 1..20: note = CRISPR gRNA sequence
  source 1..20: mol_type = other DNA
ttgtccaggctggagtgcgg

SEQ ID NO: 101846 - DNA, 20 bp, synthetic construct
  misc_feature 1..20: note = CRISPR gRNA sequence
  source 1..20: mol_type = other DNA
tccaggctggagtgcggtgg

SEQ ID NO: 101847 - DNA, 20 bp, synthetic construct
  misc_feature 1..20: note = CRISPR gRNA sequence
  source 1..20: mol_type = other DNA
gagtgcggtggtgtgatcac

SEQ ID NO: 101848 - DNA, 20 bp, synthetic construct
  misc_feature 1..20: note = CRISPR gRNA sequence
  source 1..20: mol_type = other DNA
acttcagcctcaacctcctg

SEQ ID NO: 101849 - DNA, 20 bp, synthetic construct
  misc_feature 1..20: note = CRISPR gRNA sequence
  source 1..20: mol_type = other DNA
cagcctcaacctcctgggct

SEQ ID NO: 101850 - DNA, 20 bp, synthetic construct
  misc_feature 1..20: note = CRISPR gRNA sequence
  source 1..20: mol_type = other DNA
agcctcaacctcctgggctc

SEQ ID NO: 101851 - DNA, 20 bp, synthetic construct
  misc_feature 1..20: note = CRISPR gRNA sequence
  source 1..20: mol_type = other DNA
aacctcctgggctcaagcca

SEQ ID NO: 101852 - DNA, 20 bp, synthetic construct
  misc_feature 1..20: note = CRISPR gRNA sequence
  source 1..20: mol_type = other DNA
ctgggctcaagccaacctcc

SEQ ID NO: 101853 - DNA, 20 bp, synthetic construct
  misc_feature 1..20: note = CRISPR gRNA sequence
  source 1..20: mol_type = other DNA
ggctcaagccaacctcccac

SEQ ID NO: 101854 - DNA, 20 bp, synthetic construct
  misc_feature 1..20: note = CRISPR gRNA sequence
  source 1..20: mol_type = other DNA
aagccaacctcccacctcag

SEQ ID NO: 101855 - DNA, 20 bp, synthetic construct
  misc_feature 1..20: note = CRISPR gRNA sequence
  source 1..20: mol_type = other DNA
ccacctcagcctcctgagca

SEQ ID NO: 101856 - DNA, 20 bp, synthetic construct
  misc_feature 1..20: note = CRISPR gRNA sequence
  source 1..20: mol_type = other DNA
agcctcctgagcagctgaaa

SEQ ID NO: 101857 - DNA, 20 bp, synthetic construct
  misc_feature 1..20: note = CRISPR gRNA sequence
  source 1..20: mol_type = other DNA
ctgagcagctgaaactacag

SEQ ID NO: 101858 - DNA, 20 bp, synthetic construct
  misc_feature 1..20: note = CRISPR gRNA sequence
  source 1..20: mol_type = other DNA
agcagctgaaactacaggtg

SEQ ID NO: 101859 - DNA, 20 bp, synthetic construct
  misc_feature 1..20: note = CRISPR gRNA sequence
  source 1..20: mol_type = other DNA
aaactacaggtgccaccata

SEQ ID NO: 101860 - DNA, 20 bp, synthetic construct
  misc_feature 1..20: note = CRISPR gRNA sequence
  source 1..20: mol_type = other DNA
caggtgccaccatacccagc

SEQ ID NO: 101861 - DNA, 20 bp, synthetic construct
  misc_feature 1..20: note = CRISPR gRNA sequence
  source 1..20: mol_type = other DNA
aaaatatatatatattggta

SEQ ID NO: 101862 - DNA, 20 bp, synthetic construct
  misc_feature 1..20: note = CRISPR gRNA sequence
  source 1..20: mol_type = other DNA
gtagagatggagtcttgctc

SEQ ID NO: 101863 - DNA, 20 bp, synthetic construct
  misc_feature 1..20: note = CRISPR gRNA sequence
  source 1..20: mol_type = other DNA
gctctgtcgcccaggctggt

SEQ ID NO: 101864 - DNA, 20 bp, synthetic construct
  misc_feature 1..20: note = CRISPR gRNA sequence
  source 1..20: mol_type = other DNA
ctctgtcgcccaggctggtc

SEQ ID NO: 101865 - DNA, 20 bp, synthetic construct
  misc_feature 1..20: note = CRISPR gRNA sequence
  source 1..20: mol_type = other DNA
tgtcgcccaggctggtctca

SEQ ID NO: 101866 - DNA, 20 bp, synthetic construct
  misc_feature 1..20: note = CRISPR gRNA sequence
  source 1..20: mol_type = other DNA
tcgcccaggctggtctcaaa

SEQ ID NO: 101867 - DNA, 20 bp, synthetic construct
  misc_feature 1..20: note = CRISPR gRNA sequence
  source 1..20: mol_type = other DNA
gtctcaaactcctgggctca

SEQ ID NO: 101868 - DNA, 20 bp, synthetic construct
  misc_feature 1..20: note = CRISPR gRNA sequence
  source 1..20: mol_type = other DNA
aaactcctgggctcaagcaa

SEQ ID NO: 101869 - DNA, 20 bp, synthetic construct
  misc_feature 1..20: note = CRISPR gRNA sequence
  source 1..20: mol_type = other DNA
ctgggctcaagcaattctcc

SEQ ID NO: 101870 - DNA, 20 bp, synthetic construct
  misc_feature 1..20: note = CRISPR gRNA sequence
  source 1..20: mol_type = other DNA
ggctcaagcaattctcctgc

SEQ ID NO: 101871 - DNA, 20 bp, synthetic construct
  misc_feature 1..20: note = CRISPR gRNA sequence
  source 1..20: mol_type = other DNA
aagcaattctcctgccgtgg

SEQ ID NO: 101872 - DNA, 20 bp, synthetic construct
  misc_feature 1..20: note = CRISPR gRNA sequence
  source 1..20: mol_type = other DNA
tcctgccgtggcctcccaaa

SEQ ID NO: 101873 - DNA, 20 bp, synthetic construct
  misc_feature 1..20: note = CRISPR gRNA sequence
  source 1..20: mol_type = other DNA
ctgccgtggcctcccaaagt

SEQ ID NO: 101874 - DNA, 20 bp, synthetic construct
  misc_feature 1..20: note = CRISPR gRNA sequence
  source 1..20: mol_type = other DNA
ccgtggcctcccaaagtgct

SEQ ID NO: 101875 - DNA, 20 bp, synthetic construct
  misc_feature 1..20: note = CRISPR gRNA sequence
  source 1..20: mol_type = other DNA
ccaaagtgctgggattacag

SEQ ID NO: 101876 - DNA, 20 bp, synthetic construct
  misc_feature 1..20: note = CRISPR gRNA sequence
  source 1..20: mol_type = other DNA
ggattacaggcatgagctac

SEQ ID NO: 101877 - DNA, 20 bp, synthetic construct
  misc_feature 1..20: note = CRISPR gRNA sequence
  source 1..20: mol_type = other DNA
caggcatgagctaccatgct

SEQ ID NO: 101878 - DNA, 20 bp, synthetic construct
  misc_feature 1..20: note = CRISPR gRNA sequence
  source 1..20: mol_type = other DNA
ccatgctactgccttcggta

SEQ ID NO: 101879 - DNA, 20 bp, synthetic construct
  misc_feature 1..20: note = CRISPR gRNA sequence
  source 1..20: mol_type = other DNA
ctgccttcggtatctccctg

SEQ ID NO: 101880 - DNA, 20 bp, synthetic construct
  misc_feature 1..20: note = CRISPR gRNA sequence
  source 1..20: mol_type = other DNA
ccttcggtatctccctgggg

SEQ ID NO: 101881 - DNA, 20 bp, synthetic construct
  misc_feature 1..20: note = CRISPR gRNA sequence
  source 1..20: mol_type = other DNA
cggtatctccctggggtctt

SEQ ID NO: 101882 - DNA, 20 bp, synthetic construct
  misc_feature 1..20: note = CRISPR gRNA sequence
  source 1..20: mol_type = other DNA
ggtatctccctggggtcttg

SEQ ID NO: 101883 - DNA, 20 bp, synthetic construct
  misc_feature 1..20: note = CRISPR gRNA sequence
  source 1..20: mol_type = other DNA
cctggggtcttggagctacc

SEQ ID NO: 101884 - DNA, 20 bp, synthetic construct
  misc_feature 1..20: note = CRISPR gRNA sequence
  source 1..20: mol_type = other DNA
gggtcttggagctaccaaag

SEQ ID NO: 101885 - DNA, 20 bp, synthetic construct
  misc_feature 1..20: note = CRISPR gRNA sequence
  source 1..20: mol_type = other DNA
ggagctaccaaaggcagtgc

SEQ ID NO: 101886 - DNA, 20 bp, synthetic construct
  misc_feature 1..20: note = CRISPR gRNA sequence
  source 1..20: mol_type = other DNA
gagctaccaaaggcagtgcc

SEQ ID NO: 101887 - DNA, 20 bp, synthetic construct
  misc_feature 1..20: note = CRISPR gRNA sequence
  source 1..20: mol_type = other DNA
ccaaaggcagtgcctgggac

SEQ ID NO: 101888 - DNA, 20 bp, synthetic construct
  misc_feature 1..20: note = CRISPR gRNA sequence
  source 1..20: mol_type = other DNA
ggactccaccattcactcac

SEQ ID NO: 101889 - DNA, 20 bp, synthetic construct
  misc_feature 1..20: note = CRISPR gRNA sequence
  source 1..20: mol_type = other DNA
caccattcactcactctact

SEQ ID NO: 101890 - DNA, 20 bp, synthetic construct
  misc_feature 1..20: note = CRISPR gRNA sequence
  source 1..20: mol_type = other DNA
actcactctactctcttgaa

SEQ ID NO: 101891 - DNA, 20 bp, synthetic construct
  misc_feature 1..20: note = CRISPR gRNA sequence
  source 1..20: mol_type = other DNA
actctactctcttgaatacc

SEQ ID NO: 101892 - DNA, 20 bp, synthetic construct
  misc_feature 1..20: note = CRISPR gRNA sequence
  source 1..20: mol_type = other DNA
tactctcttgaatacccagg

SEQ ID NO: 101893 - DNA, 20 bp, synthetic construct
  misc_feature 1..20: note = CRISPR gRNA sequence
  source 1..20: mol_type = other DNA
ctctcttgaatacccagggt

SEQ ID NO: 101894 - DNA, 20 bp, synthetic construct
  misc_feature 1..20: note = CRISPR gRNA sequence
  source 1..20: mol_type = other DNA
tcttgaatacccagggtgca

SEQ ID NO: 101895 - DNA, 20 bp, synthetic construct
  misc_feature 1..20: note = CRISPR gRNA sequence
  source 1..20: mol_type = other DNA
ttgaatacccagggtgcatc

SEQ ID NO: 101896 - DNA, 20 bp, synthetic construct
  misc_feature 1..20: note = CRISPR gRNA sequence
  source 1..20: mol_type = other DNA
gaatacccagggtgcatctt

SEQ ID NO: 101897 - DNA, 20 bp, synthetic construct
  misc_feature 1..20: note = CRISPR gRNA sequence
  source 1..20: mol_type = other DNA
aatacccagggtgcatcttt

SEQ ID NO: 101898 - DNA, 20 bp, synthetic construct
  misc_feature 1..20: note = CRISPR gRNA sequence
  source 1..20: mol_type = other DNA
tctcctccctgcctggcaat

SEQ ID NO: 101899 - DNA, 20 bp, synthetic construct
  misc_feature 1..20: note = CRISPR gRNA sequence
  source 1..20: mol_type = other DNA
ctcctccctgcctggcaatg

SEQ ID NO: 101900 - DNA, 20 bp, synthetic construct
  misc_feature 1..20: note = CRISPR gRNA sequence
  source 1..20: mol_type = other DNA
tcctccctgcctggcaatgt

SEQ ID NO: 101901 - DNA, 20 bp, synthetic construct
  misc_feature 1..20: note = CRISPR gRNA sequence
  source 1..20: mol_type = other DNA
ctccctgcctggcaatgttc

SEQ ID NO: 101902 - DNA, 20 bp, synthetic construct
  misc_feature 1..20: note = CRISPR gRNA sequence
  source 1..20: mol_type = other DNA
cctgcctggcaatgttctga

SEQ ID NO: 101903 - DNA, 20 bp, synthetic construct
  misc_feature 1..20: note = CRISPR gRNA sequence
  source 1..20: mol_type = other DNA
cctggcaatgttctgagcaa

SEQ ID NO: 101904 - DNA, 20 bp, synthetic construct
  misc_feature 1..20: note = CRISPR gRNA sequence
  source 1..20: mol_type = other DNA
gcaatgttctgagcaaacaa

SEQ ID NO: 101905 - DNA, 20 bp, synthetic construct
  misc_feature 1..20: note = CRISPR gRNA sequence
  source 1..20: mol_type = other DNA
tgagcaaacaagacatagtt

SEQ ID NO: 101906 - DNA, 20 bp, synthetic construct
  misc_feature 1..20: note = CRISPR gRNA sequence
  source 1..20: mol_type = other DNA
agcaaacaagacatagtttt

SEQ ID NO: 101907 - DNA, 20 bp, synthetic construct
  misc_feature 1..20: note = CRISPR gRNA sequence
  source 1..20: mol_type = other DNA
ttgccctctagggagtcggg

SEQ ID NO: 101908 - DNA, 20 bp, synthetic construct
  misc_feature 1..20: note = CRISPR gRNA sequence
  source 1..20: mol_type = other DNA
tgccctctagggagtcgggg

SEQ ID NO: 101909 - DNA, 20 bp, synthetic construct
  misc_feature 1..20: note = CRISPR gRNA sequence
  source 1..20: mol_type = other DNA
gccctctagggagtcggggg

SEQ ID NO: 101910 - DNA, 20 bp, synthetic construct
  misc_feature 1..20: note = CRISPR gRNA sequence
  source 1..20: mol_type = other DNA
ccctctagggagtcgggggt

SEQ ID NO: 101911 - DNA, 20 bp, synthetic construct
  misc_feature 1..20: note = CRISPR gRNA sequence
  source 1..20: mol_type = other DNA
tagggagtcgggggtcaagt

SEQ ID NO: 101912 - DNA, 20 bp, synthetic construct
  misc_feature 1..20: note = CRISPR gRNA sequence
  source 1..20: mol_type = other DNA
gggagtcgggggtcaagtag

SEQ ID NO: 101913 - DNA, 20 bp, synthetic construct
  misc_feature 1..20: note = CRISPR gRNA sequence
  source 1..20: mol_type = other DNA
caagttgaaataagtgttca

SEQ ID NO: 101914 - DNA, 20 bp, synthetic construct
  misc_feature 1..20: note = CRISPR gRNA sequence
  source 1..20: mol_type = other DNA
aagttgaaataagtgttcaa

SEQ ID NO: 101915 - DNA, 20 bp, synthetic construct
  misc_feature 1..20: note = CRISPR gRNA sequence
  source 1..20: mol_type = other DNA
aaataagtgttcaaaagaac

SEQ ID NO: 101916 - DNA, 20 bp, synthetic construct
  misc_feature 1..20: note = CRISPR gRNA sequence
  source 1..20: mol_type = other DNA
aaaagaacttaaggccgggc

SEQ ID NO: 101917 - DNA, 20 bp, synthetic construct
  misc_feature 1..20: note = CRISPR gRNA sequence
  source 1..20: mol_type = other DNA
aaggccgggcacagtggctc

SEQ ID NO: 101918 - DNA, 20 bp, synthetic construct
  misc_feature 1..20: note = CRISPR gRNA sequence
  source 1..20: mol_type = other DNA
aggccgggcacagtggctca

SEQ ID NO: 101919 - DNA, 20 bp, synthetic construct
  misc_feature 1..20: note = CRISPR gRNA sequence
  source 1..20: mol_type = other DNA
atgcctgtaatcccagcact

SEQ ID NO: 101920 - DNA, 20 bp, synthetic construct
  misc_feature 1..20: note = CRISPR gRNA sequence
  source 1..20: mol_type = other DNA
taatcccagcactttgggag

SEQ ID NO: 101921 - DNA, 20 bp, synthetic construct
  misc_feature 1..20: note = CRISPR gRNA sequence
  source 1..20: mol_type = other DNA
tgggaggctgaggtgggtgg

SEQ ID NO: 101922 - DNA, 20 bp, synthetic construct
  misc_feature 1..20: note = CRISPR gRNA sequence
  source 1..20: mol_type = other DNA
gggaggctgaggtgggtgga

SEQ ID NO: 101923 - DNA, 20 bp, synthetic construct
  misc_feature 1..20: note = CRISPR gRNA sequence
  source 1..20: mol_type = other DNA
ggaggctgaggtgggtggat

SEQ ID NO: 101924 - DNA, 20 bp, synthetic construct
  misc_feature 1..20: note = CRISPR gRNA sequence
  source 1..20: mol_type = other DNA
aggtgggtggatcacctgag

SEQ ID NO: 101925 - DNA, 20 bp, synthetic construct
  misc_feature 1..20: note = CRISPR gRNA sequence
  source 1..20: mol_type = other DNA
aggtcaggagtttgagacca

SEQ ID NO: 101926 - DNA, 20 bp, synthetic construct
  misc_feature 1..20: note = CRISPR gRNA sequence
  source 1..20: mol_type = other DNA
gagaccagcctgactaacat

SEQ ID NO: 101927 - DNA, 20 bp, synthetic construct
  misc_feature 1..20: note = CRISPR gRNA sequence
  source 1..20: mol_type = other DNA
agaccagcctgactaacatg

SEQ ID NO: 101928 - DNA, 20 bp, synthetic construct
  misc_feature 1..20: note = CRISPR gRNA sequence
  source 1..20: mol_type = other DNA
actaacatggtgaaattcca

SEQ ID NO: 101929 - DNA, 20 bp, synthetic construct
  misc_feature 1..20: note = CRISPR gRNA sequence
  source 1..20: mol_type = other DNA
acatggtgaaattccacctc

SEQ ID NO: 101930 - DNA, 20 bp, synthetic construct
  misc_feature 1..20: note = CRISPR gRNA sequence
  source 1..20: mol_type = other DNA
cacctctactaaaaacacaa

SEQ ID NO: 101931 - DNA, 20 bp, synthetic construct
  misc_feature 1..20: note = CRISPR gRNA sequence
  source 1..20: mol_type = other DNA
tactaaaaacacaaaattag

SEQ ID NO: 101932 - DNA, 20 bp, synthetic construct
  misc_feature 1..20: note = CRISPR gRNA sequence
  source 1..20: mol_type = other DNA
ctaaaaacacaaaattagcc

SEQ ID NO: 101933 - DNA, 20 bp, synthetic construct
  misc_feature 1..20: note = CRISPR gRNA sequence
  source 1..20: mol_type = other DNA
aaaacacaaaattagccatg

SEQ ID NO: 101934 - DNA, 20 bp, synthetic construct
  misc_feature 1..20: note = CRISPR gRNA sequence
  source 1..20: mol_type = other DNA
gccatgcatggtggcagatg

SEQ ID NO: 101935 - DNA, 20 bp, synthetic construct
  misc_feature 1..20: note = CRISPR gRNA sequence
  source 1..20: mol_type = other DNA
taatcccagctactcgggag

SEQ ID NO: 101936 - DNA, 20 bp, synthetic construct
  misc_feature 1..20: note = CRISPR gRNA sequence
  source 1..20: mol_type = other DNA
ctcgggaggctgaggcagga

SEQ ID NO: 101937 - DNA, 20 bp, synthetic construct
  misc_feature 1..20: note = CRISPR gRNA sequence
  source 1..20: mol_type = other DNA
gggaggctgaggcaggagaa

SEQ ID NO: 101938 - DNA, 20 bp, synthetic construct
  misc_feature 1..20: note = CRISPR gRNA sequence
  source 1..20: mol_type = other DNA
aggcaggagaatcgcttgaa

SEQ ID NO: 101939 - DNA, 20 bp, synthetic construct
  misc_feature 1..20: note = CRISPR gRNA sequence
  source 1..20: mol_type = other DNA
gaatccaggaggtggaggtt

SEQ ID NO: 101940 - DNA, 20 bp, synthetic construct
  misc_feature 1..20: note = CRISPR gRNA sequence
  source 1..20: mol_type = other DNA
aatccaggaggtggaggttg

SEQ ID NO: 101941 - DNA, 20 bp, synthetic construct
  misc_feature 1..20: note = CRISPR gRNA sequence
  source 1..20: mol_type = other DNA
cagtgagagagatcacgcca

SEQ ID NO: 101942 - DNA, 20 bp, synthetic construct
  misc_feature 1..20: note = CRISPR gRNA sequence
  source 1..20: mol_type = other DNA
cactccagcctgggcaacaa

SEQ ID NO: 101943 - DNA, 20 bp, synthetic construct
  misc_feature 1..20: note = CRISPR gRNA sequence
  source 1..20: mol_type = other DNA
cagcctgggcaacaagagtg

SEQ ID NO: 101944 - DNA, 20 bp, synthetic construct
  misc_feature 1..20: note = CRISPR gRNA sequence
  source 1..20: mol_type = other DNA
ggcaacaagagtgagactcc

SEQ ID NO: 101945 - DNA, 20 bp, synthetic construct
  misc_feature 1..20: note = CRISPR gRNA sequence
  source 1..20: mol_type = other DNA
catctcaaaaaaaaaaaaaa

SEQ ID NO: 101946 - DNA, 20 bp, synthetic construct
  misc_feature 1..20: note = CRISPR gRNA sequence
  source 1..20: mol_type = other DNA
aaaaaaaaaaaaaaaaaaaa

SEQ ID NO: 101947 - DNA, 20 bp, synthetic construct
  misc_feature 1..20: note = CRISPR gRNA sequence
  source 1..20: mol_type = other DNA
aaaagcaggtagaagaggat

SEQ ID NO: 101948 - DNA, 20 bp, synthetic construct
  misc_feature 1..20: note = CRISPR gRNA sequence
  source 1..20: mol_type = other DNA
aaagcaggtagaagaggatg

SEQ ID NO: 101949 - DNA, 20 bp, synthetic construct
  misc_feature 1..20: note = CRISPR gRNA sequence
  source 1..20: mol_type = other DNA
cttagacaaggtggtaacag

SEQ ID NO: 101950 - DNA, 20 bp, synthetic construct
  misc_feature 1..20: note = CRISPR gRNA sequence
  source 1..20: mol_type = other DNA
ttagacaaggtggtaacagg

SEQ ID NO: 101951 - DNA, 20 bp, synthetic construct
  misc_feature 1..20: note = CRISPR gRNA sequence
  source 1..20: mol_type = other DNA
agacaaggtggtaacaggag

SEQ ID NO: 101952 - DNA, 20 bp, synthetic construct
  misc_feature 1..20: note = CRISPR gRNA sequence
  source 1..20: mol_type = other DNA
gacaaggtggtaacaggagg

SEQ ID NO: 101953 - DNA, 20 bp, synthetic construct
  misc_feature 1..20: note = CRISPR gRNA sequence
  source 1..20: mol_type = other DNA
cccaaggtgacaccaccgag

SEQ ID NO: 101954 - DNA, 20 bp, synthetic construct
  misc_feature 1..20: note = CRISPR gRNA sequence
  source 1..20: mol_type = other DNA
aggaagtcaaagaaatccgc

SEQ ID NO: 101955 - DNA, 20 bp, synthetic construct
  misc_feature 1..20: note = CRISPR gRNA sequence
  source 1..20: mol_type = other DNA
ggaagtcaaagaaatccgct

SEQ ID NO: 101956 - DNA, 20 bp, synthetic construct
  misc_feature 1..20: note = CRISPR gRNA sequence
  source 1..20: mol_type = other DNA
cagggactgggcgcggtggc

SEQ ID NO: 101957 - DNA, 20 bp, synthetic construct
  misc_feature 1..20: note = CRISPR gRNA sequence
  source 1..20: mol_type = other DNA
ggcgcggtggctcacgcctg

SEQ ID NO: 101958 - DNA, 20 bp, synthetic construct
  misc_feature 1..20: note = CRISPR gRNA sequence
  source 1..20: mol_type = other DNA
acgcctgtaatcccagcact

SEQ ID NO: 101959 - DNA, 20 bp, synthetic construct
  misc_feature 1..20: note = CRISPR gRNA sequence
  source 1..20: mol_type = other DNA
taatcccagcactttgggag

SEQ ID NO: 101960 - DNA, 20 bp, synthetic construct
  misc_feature 1..20: note = CRISPR gRNA sequence
  source 1..20: mol_type = other DNA
tgggaggccgaggcgggcaa

SEQ ID NO: 101961 - DNA, 20 bp, synthetic construct
  misc_feature 1..20: note = CRISPR gRNA sequence
  source 1..20: mol_type = other DNA
gggaggccgaggcgggcaat

SEQ ID NO: 101962 - DNA, 20 bp, synthetic construct
  misc_feature 1..20: note = CRISPR gRNA sequence
  source 1..20: mol_type = other DNA
ggaggccgaggcgggcaatc

SEQ ID NO: 101963 - DNA, 20 bp, synthetic construct
  misc_feature 1..20: note = CRISPR gRNA sequence
  source 1..20: mol_type = other DNA
aggtcaggagttcgagacca

SEQ ID NO: 101964 - DNA, 20 bp, synthetic construct
  misc_feature 1..20: note = CRISPR gRNA sequence
  source 1..20: mol_type = other DNA
gagaccagcctgggcaacat

SEQ ID NO: 101965 - DNA, 20 bp, synthetic construct
  misc_feature 1..20: note = CRISPR gRNA sequence
  source 1..20: mol_type = other DNA
ggcaacatggcaaaactcca

SEQ ID NO: 101966 - DNA, 20 bp, synthetic construct
  misc_feature 1..20: note = CRISPR gRNA sequence
  source 1..20: mol_type = other DNA
catctctactaaaaacacaa

SEQ ID NO: 101967 - DNA, 20 bp, synthetic construct
  misc_feature 1..20: note = CRISPR gRNA sequence
  source 1..20: mol_type = other DNA
tactaaaaacacaaaaatta

SEQ ID NO: 101968 - DNA, 20 bp, synthetic construct
  misc_feature 1..20: note = CRISPR gRNA sequence
  source 1..20: mol_type = other DNA
ctaaaaacacaaaaattagc

SEQ ID NO: 101969 - DNA, 20 bp, synthetic construct
  misc_feature 1..20: note = CRISPR gRNA sequence
  source 1..20: mol_type = other DNA
aaaacacaaaaattagctgg

SEQ ID NO: 101970 - DNA, 20 bp, synthetic construct
  misc_feature 1..20: note = CRISPR gRNA sequence
  source 1..20: mol_type = other DNA
gctggatgtggtggtgcatg

SEQ ID NO: 101971 - DNA, 20 bp, synthetic construct
  misc_feature 1..20: note = CRISPR gRNA sequence
  source 1..20: mol_type = other DNA
gatgtggtggtgcatgccag

SEQ ID NO: 101972 - DNA, 20 bp, synthetic construct
  misc_feature 1..20: note = CRISPR gRNA sequence
  source 1..20: mol_type = other DNA
cttgggaggctgaggcagga

SEQ ID NO: 101973 - DNA, 20 bp, synthetic construct
  misc_feature 1..20: note = CRISPR gRNA sequence
  source 1..20: mol_type = other DNA
gggaggctgaggcaggagaa

SEQ ID NO: 101974 - DNA, 20 bp, synthetic construct
  misc_feature 1..20: note = CRISPR gRNA sequence
  source 1..20: mol_type = other DNA
ggaggctgaggcaggagaat

SEQ ID NO: 101975 - DNA, 20 bp, synthetic construct
  misc_feature 1..20: note = CRISPR gRNA sequence
  source 1..20: mol_type = other DNA
aggcaggagaatcaccttaa

SEQ ID NO: 101976 - DNA, 20 bp, synthetic construct
  misc_feature 1..20: note = CRISPR gRNA sequence
  source 1..20: mol_type = other DNA
aacccaggagagggagttgc

SEQ ID NO: 101977 - DNA, 20 bp, synthetic construct
  misc_feature 1..20: note = CRISPR gRNA sequence
  source 1..20: mol_type = other DNA
acccaggagagggagttgca

SEQ ID NO: 101978 - DNA, 20 bp, synthetic construct
  misc_feature 1..20: note = CRISPR gRNA sequence
  source 1..20: mol_type = other DNA
cagtgagtcaagatagtgcc

SEQ ID NO: 101979 - DNA, 20 bp, synthetic construct
  misc_feature 1..20: note = CRISPR gRNA sequence
  source 1..20: mol_type = other DNA
cactccaccctggacaacag

SEQ ID NO: 101980 - DNA, 20 bp, synthetic construct
  misc_feature 1..20: note = CRISPR gRNA sequence
  source 1..20: mol_type = other DNA
caccctggacaacagagcaa

SEQ ID NO: 101981 - DNA, 20 bp, synthetic construct
  misc_feature 1..20: note = CRISPR gRNA sequence
  source 1..20: mol_type = other DNA
gacaacagagcaagattctg

SEQ ID NO: 101982 - DNA, 20 bp, synthetic construct
  misc_feature 1..20: note = CRISPR gRNA sequence
  source 1..20: mol_type = other DNA
tgtctcaagaagagagggga

SEQ ID NO: 101983 - DNA, 20 bp, synthetic construct
  misc_feature 1..20: note = CRISPR gRNA sequence
  source 1..20: mol_type = other DNA
tctcaagaagagaggggatc

SEQ ID NO: 101984 - DNA, 20 bp, synthetic construct
  misc_feature 1..20: note = CRISPR gRNA sequence
  source 1..20: mol_type = other DNA
aagaagagaggggatccagg

SEQ ID NO: 101985 - DNA, 20 bp, synthetic construct
  misc_feature 1..20: note = CRISPR gRNA sequence
  source 1..20: mol_type = other DNA
gagagtggggagaggggaaa

SEQ ID NO: 101986 - DNA, 20 bp, synthetic construct
  misc_feature 1..20: note = CRISPR gRNA sequence
  source 1..20: mol_type = other DNA
ggcaacaaaagcaaacctcc

SEQ ID NO: 101987 - DNA, 20 bp, synthetic construct
  misc_feature 1..20: note = CRISPR gRNA sequence
  source 1..20: mol_type = other DNA
catttaaaaaaaaaaaaaaa

SEQ ID NO: 101988 - DNA, 20 bp, synthetic construct
  misc_feature 1..20: note = CRISPR gRNA sequence
  source 1..20: mol_type = other DNA
aaaaaaaaaaaaaaaaacgg

SEQ ID NO: 101989 - DNA, 20 bp, synthetic construct
  misc_feature 1..20: note = CRISPR gRNA sequence
  source 1..20: mol_type = other DNA
aaaaaaaaaaaaaaaacgga

SEQ ID NO: 101990 - DNA, 20 bp, synthetic construct
  misc_feature 1..20: note = CRISPR gRNA sequence
  source 1..20: mol_type = other DNA
tagtcccagctactcgggag

SEQ ID NO: 101991 - DNA, 20 bp, synthetic construct
  misc_feature 1..20: note = CRISPR gRNA sequence
  source 1..20: mol_type = other DNA
ctcgggaggctgaagcagga

SEQ ID NO: 101992 - DNA, 20 bp, synthetic construct
  misc_feature 1..20: note = CRISPR gRNA sequence
  source 1..20: mol_type = other DNA
gggaggctgaagcaggagaa

SEQ ID NO: 101993 - DNA, 20 bp, synthetic construct
  misc_feature 1..20: note = CRISPR gRNA sequence
  source 1..20: mol_type = other DNA
aagcaggagaatggcgtgaa

SEQ ID NO: 101994 - DNA, 20 bp, synthetic construct
  misc_feature 1..20: note = CRISPR gRNA sequence
  source 1..20: mol_type = other DNA
gcagtgagccaagattgcgc

SEQ ID NO: 101995 - DNA, 20 bp, synthetic construct
  misc_feature 1..20: note = CRISPR gRNA sequence
  source 1..20: mol_type = other DNA
cagtgagccaagattgcgcc

SEQ ID NO: 101996 - DNA, 20 bp, synthetic construct
  misc_feature 1..20: note = CRISPR gRNA sequence
  source 1..20: mol_type = other DNA
cgccactgcactccatgcac

SEQ ID NO: 101997 - DNA, 20 bp, synthetic construct
  misc_feature 1..20: note = CRISPR gRNA sequence
  source 1..20: mol_type = other DNA
cactccatgcactccagcct

SEQ ID NO: 101998 - DNA, 20 bp, synthetic construct
  misc_feature 1..20: note = CRISPR gRNA sequence
  source 1..20: mol_type = other DNA
catgcactccagcctgggcg

SEQ ID NO: 101999 - DNA, 20 bp, synthetic construct
  misc_feature 1..20: note = CRISPR gRNA sequence
  source 1..20: mol_type = other DNA
cagcctgggcgacagagcga

SEQ ID NO: 102000 - DNA, 20 bp, synthetic construct
  misc_feature 1..20: note = CRISPR gRNA sequence
  source 1..20: mol_type = other DNA
ggcgacagagcgagactcca

SEQ ID NO: 102001 - DNA, 20 bp, synthetic construct
  misc_feature 1..20: note = CRISPR gRNA sequence
  source 1..20: mol_type = other DNA
catctcaaaaaaagaaagaa

SEQ ID NO: 102002 - DNA, 20 bp, synthetic construct
  misc_feature 1..20: note = CRISPR gRNA sequence
  source 1..20: mol_type = other DNA
aaaaaaagaaagaaagaaag

SEQ ID NO: 102003 - DNA, 20 bp, synthetic construct
  misc_feature 1..20: note = CRISPR gRNA sequence
  source 1..20: mol_type = other DNA
taggaagaagtgtaggaaga

SEQ ID NO: 102004 - DNA, 20 bp, synthetic construct
  misc_feature 1..20: note = CRISPR gRNA sequence
  source 1..20: mol_type = other DNA
cagacaggagtggcagcaac

SEQ ID NO: 102005 - DNA, 20 bp, synthetic construct
  misc_feature 1..20: note = CRISPR gRNA sequence
  source 1..20: mol_type = other DNA
aattaggcatattcttggac

SEQ ID NO: 102006 - DNA, 20 bp, synthetic construct
  misc_feature 1..20: note = CRISPR gRNA sequence
  source 1..20: mol_type = other DNA
ggcatattcttggactccaa

SEQ ID NO: 102007 - DNA, 20 bp, synthetic construct
  misc_feature 1..20: note = CRISPR gRNA sequence
  source 1..20: mol_type = other DNA
ttggactccaatcaaaaata

SEQ ID NO: 102008 - DNA, 20 bp, synthetic construct
  misc_feature 1..20: note = CRISPR gRNA sequence
  source 1..20: mol_type = other DNA
ggactccaatcaaaaataaa

SEQ ID NO: 102009 - DNA, 20 bp, synthetic construct
  misc_feature 1..20: note = CRISPR gRNA sequence
  source 1..20: mol_type = other DNA
gactccaatcaaaaataaat

SEQ ID NO: 102010 - DNA, 20 bp, synthetic construct
  misc_feature 1..20: note = CRISPR gRNA sequence
  source 1..20: mol_type = other DNA
caatcaaaaataaatcctca

SEQ ID NO: 102011 - DNA, 20 bp, synthetic construct
  misc_feature 1..20: note = CRISPR gRNA sequence
  source 1..20: mol_type = other DNA
agttcctcagtaagtaaaac

SEQ ID NO: 102012 - DNA, 20 bp, synthetic construct
  misc_feature 1..20: note = CRISPR gRNA sequence
  source 1..20: mol_type = other DNA
ctcagtaagtaaaacaggat

SEQ ID NO: 102013 - DNA, 20 bp, synthetic construct
  misc_feature 1..20: note = CRISPR gRNA sequence
  source 1..20: mol_type = other DNA
agtaagtaaaacaggatgac

SEQ ID NO: 102014 - DNA, 20 bp, synthetic construct
  misc_feature 1..20: note = CRISPR gRNA sequence
  source 1..20: mol_type = other DNA
acccagtaatttcactccta

SEQ ID NO: 102015 - DNA, 20 bp, synthetic construct
  misc_feature 1..20: note = CRISPR gRNA sequence
  source 1..20: mol_type = other DNA
cactcctagctatctaccct

SEQ ID NO: 102016 - DNA, 20 bp, synthetic construct
  misc_feature 1..20: note = CRISPR gRNA sequence
  source 1..20: mol_type = other DNA
actcctagctatctaccctc

SEQ ID NO: 102017 - DNA, 20 bp, synthetic construct
  misc_feature 1..20: note = CRISPR gRNA sequence
  source 1..20: mol_type = other DNA
ctagctatctaccctcaaag

SEQ ID NO: 102018 - DNA, 20 bp, synthetic construct
  misc_feature 1..20: note = CRISPR gRNA sequence
  source 1..20: mol_type = other DNA
gctatctaccctcaaagagt

SEQ ID NO: 102019 - DNA, 20 bp, synthetic construct
  misc_feature 1..20: note = CRISPR gRNA sequence
  source 1..20: mol_type = other DNA
tctaccctcaaagagttaaa

SEQ ID NO: 102020 - DNA, 20 bp, synthetic construct
  misc_feature 1..20: note = CRISPR gRNA sequence
  source 1..20: mol_type = other DNA
ccctcaaagagttaaaaaca

SEQ ID NO: 102021 - DNA, 20 bp, synthetic construct
  misc_feature 1..20: note = CRISPR gRNA sequence
  source 1..20: mol_type = other DNA
aaagagttaaaaacaggtgt

SEQ ID NO: 102022 - DNA, 20 bp, synthetic construct
  misc_feature 1..20: note = CRISPR gRNA sequence
  source 1..20: mol_type = other DNA
aaaacaggtgtgaagggccg

SEQ ID NO: 102023 - DNA, 20 bp, synthetic construct
  misc_feature 1..20: note = CRISPR gRNA sequence
  source 1..20: mol_type = other DNA
tggctcacacctgtaatccc

SEQ ID NO: 102024 - DNA, 20 bp, synthetic construct
  misc_feature 1..20: note = CRISPR gRNA sequence
  source 1..20: mol_type = other DNA
acacctgtaatcccagcact

SEQ ID NO: 102025 - DNA, 20 bp, synthetic construct
  misc_feature 1..20: note = CRISPR gRNA sequence
  source 1..20: mol_type = other DNA
taatcccagcactttcggaa

SEQ ID NO: 102026 - DNA, 20 bp, synthetic construct
  misc_feature 1..20: note = CRISPR gRNA sequence
  source 1..20: mol_type = other DNA
tcggaagtggaggcctgcag

SEQ ID NO: 102027 - DNA, 20 bp, synthetic construct
  misc_feature 1..20: note = CRISPR gRNA sequence
  source 1..20: mol_type = other DNA
cggaagtggaggcctgcaga

SEQ ID NO: 102028 - DNA, 20 bp, synthetic construct
  misc_feature 1..20: note = CRISPR gRNA sequence
  source 1..20: mol_type = other DNA
ggaagtggaggcctgcagat

SEQ ID NO: 102029 - DNA, 20 bp, synthetic construct
  misc_feature 1..20: note = CRISPR gRNA sequence
  source 1..20: mol_type = other DNA
cagatcacttgagcccagga

SEQ ID NO: 102030 - DNA, 20 bp, synthetic construct
  misc_feature 1..20: note = CRISPR gRNA sequence
  source 1..20: mol_type = other DNA
gagcccaggaggtggagacc

SEQ ID NO: 102031 - DNA, 20 bp, synthetic construct
  misc_feature 1..20: note = CRISPR gRNA sequence
  source 1..20: mol_type = other DNA
agcccaggaggtggagacca

SEQ ID NO: 102032 - DNA, 20 bp, synthetic construct
  misc_feature 1..20: note = CRISPR gRNA sequence
  source 1..20: mol_type = other DNA
ccaaaaaaaaaaaaaaaatt

SEQ ID NO: 102033 - DNA, 20 bp, synthetic construct
  misc_feature 1..20: note = CRISPR gRNA sequence
  source 1..20: mol_type = other DNA
gccaggtgtggttgcatgcc

SEQ ID NO: 102034 - DNA, 20 bp, synthetic construct
  misc_feature 1..20: note = CRISPR gRNA sequence
  source 1..20: mol_type = other DNA
catgcctatagtcccagctc

SEQ ID NO: 102035 - DNA, 20 bp, synthetic construct
  misc_feature 1..20: note = CRISPR gRNA sequence
  source 1..20: mol_type = other DNA
tagtcccagctcctagggag

SEQ ID NO: 102036 - DNA, 20 bp, synthetic construct
  misc_feature 1..20: note = CRISPR gRNA sequence
  source 1..20: mol_type = other DNA
ctagggaggctgagtgatgg

SEQ ID NO: 102037 - DNA, 20 bp, synthetic construct
  misc_feature 1..20: note = CRISPR gRNA sequence
  source 1..20: mol_type = other DNA
gggaggctgagtgatggctt

SEQ ID NO: 102038 - DNA, 20 bp, synthetic construct
  misc_feature 1..20: note = CRISPR gRNA sequence
  source 1..20: mol_type = other DNA
agtgatggcttcagcccagg

SEQ ID NO: 102039 - DNA, 20 bp, synthetic construct
  misc_feature 1..20: note = CRISPR gRNA sequence
  source 1..20: mol_type = other DNA
cagcccaggaagttgaggct

SEQ ID NO: 102040 - DNA, 20 bp, synthetic construct
  misc_feature 1..20: note = CRISPR gRNA sequence
  source 1..20: mol_type = other DNA
agcccaggaagttgaggctg

SEQ ID NO: 102041 - DNA, 20 bp, synthetic construct
  misc_feature 1..20: note = CRISPR gRNA sequence
  source 1..20: mol_type = other DNA
aggctgcagtgaactatgat

SEQ ID NO: 102042 - DNA, 20 bp, synthetic construct
  misc_feature 1..20: note = CRISPR gRNA sequence
  source 1..20: mol_type = other DNA
cagtgaactatgattgcatc

SEQ ID NO: 102043 - DNA, 20 bp, synthetic construct
  misc_feature 1..20: note = CRISPR gRNA sequence
  source 1..20: mol_type = other DNA
tgattgcatcactgcactcc

SEQ ID NO: 102044 - DNA, 20 bp, synthetic construct
  misc_feature 1..20: note = CRISPR gRNA sequence
  source 1..20: mol_type = other DNA
catcactgcactccagcctt

SEQ ID NO: 102045 - DNA, 20 bp, synthetic construct
  misc_feature 1..20: note = CRISPR gRNA sequence
  source 1..20: mol_type = other DNA
cactccagccttagtaacag

SEQ ID NO: 102046 - DNA, 20 bp, synthetic construct
  misc_feature 1..20: note = CRISPR gRNA sequence
  source 1..20: mol_type = other DNA
cagccttagtaacagagcga

SEQ ID NO: 102047 - DNA, 20 bp, synthetic construct
  misc_feature 1..20: note = CRISPR gRNA sequence
  source 1..20: mol_type = other DNA
agtaacagagcgagaccctg

SEQ ID NO: 102048 - DNA, 20 bp, synthetic construct
  misc_feature 1..20: note = CRISPR gRNA sequence
  source 1..20: mol_type = other DNA
gtaacagagcgagaccctgt

SEQ ID NO: 102049 - DNA, 20 bp, synthetic construct
  misc_feature 1..20: note = CRISPR gRNA sequence
  source 1..20: mol_type = other DNA
tatcaaaaaacaaaaacagg

SEQ ID NO: 102050 - DNA, 20 bp, synthetic construct
  misc_feature 1..20: note = CRISPR gRNA sequence
  source 1..20: mol_type = other DNA
atgcctgtaatcccagcact

SEQ ID NO: 102051 - DNA, 20 bp, synthetic construct
  misc_feature 1..20: note = CRISPR gRNA sequence
  source 1..20: mol_type = other DNA
taatcccagcactttgggag

SEQ ID NO: 102052 - DNA, 20 bp, synthetic construct
  misc_feature 1..20: note = CRISPR gRNA sequence
  source 1..20: mol_type = other DNA
tgggaggccgaggtgggcgg

SEQ ID NO: 102053 - DNA, 20 bp, synthetic construct
  misc_feature 1..20: note = CRISPR gRNA sequence
  source 1..20: mol_type = other DNA
gggaggccgaggtgggcgga

SEQ ID NO: 102054 - DNA, 20 bp, synthetic construct
  misc_feature 1..20: note = CRISPR gRNA sequence
  source 1..20: mol_type = other DNA
ggaggccgaggtgggcggat

SEQ ID NO: 102055 - DNA, 20 bp, synthetic construct
  misc_feature 1..20: note = CRISPR gRNA sequence
  source 1..20: mol_type = other DNA
aggtcaggagttcaagacca

SEQ ID NO: 102056 - DNA, 20 bp, synthetic construct
  misc_feature 1..20: note = CRISPR gRNA sequence
  source 1..20: mol_type = other DNA
aagaccagcctggccaacat

SEQ ID NO: 102057 - DNA, 20 bp, synthetic construct
  misc_feature 1..20: note = CRISPR gRNA sequence
  source 1..20: mol_type = other DNA
gccaacatggtgaaaccccg

SEQ ID NO: 102058 - DNA, 20 bp, synthetic construct
  misc_feature 1..20: note = CRISPR gRNA sequence
  source 1..20: mol_type = other DNA
tactaaaaatacccaaaaaa

SEQ ID NO: 102059 - DNA, 20 bp, synthetic construct
  misc_feature 1..20: note = CRISPR gRNA sequence
  source 1..20: mol_type = other DNA
ctaaaaatacccaaaaaatt

SEQ ID NO: 102060 - DNA, 20 bp, synthetic construct
  misc_feature 1..20: note = CRISPR gRNA sequence
  source 1..20: mol_type = other DNA
aaaatacccaaaaaattagc

SEQ ID NO: 102061 - DNA, 20 bp, synthetic construct
  misc_feature 1..20: note = CRISPR gRNA sequence
  source 1..20: mol_type = other DNA
gctgggcgtagtggcggaag

SEQ ID NO: 102062 - DNA, 20 bp, synthetic construct
  misc_feature 1..20: note = CRISPR gRNA sequence
  source 1..20: mol_type = other DNA
ggcgtagtggcggaagcctg

SEQ ID NO: 102063 - DNA, 20 bp, synthetic construct
  misc_feature 1..20: note = CRISPR gRNA sequence
  source 1..20: mol_type = other DNA
taatcccagctactcaggag

SEQ ID NO: 102064 - DNA, 20 bp, synthetic construct
  misc_feature 1..20: note = CRISPR gRNA sequence
  source 1..20: mol_type = other DNA
ctcaggaggctgagacagga

SEQ ID NO: 102065 - DNA, 20 bp, synthetic construct
  misc_feature 1..20: note = CRISPR gRNA sequence
  source 1..20: mol_type = other DNA
aggaggctgagacaggagaa

SEQ ID NO: 102066 - DNA, 20 bp, synthetic construct
  misc_feature 1..20: note = CRISPR gRNA sequence
  source 1..20: mol_type = other DNA
agacaggagaatcagttgaa

SEQ ID NO: 102067 - DNA, 20 bp, synthetic construct
  misc_feature 1..20: note = CRISPR gRNA sequence
  source 1..20: mol_type = other DNA
aacccaggaggcagaggttg

SEQ ID NO: 102068 - DNA, 20 bp, synthetic construct
  misc_feature 1..20: note = CRISPR gRNA sequence
  source 1..20: mol_type = other DNA
cagtgagctgagatcacgcc

SEQ ID NO: 102069 - DNA, 20 bp, synthetic construct
  misc_feature 1..20: note = CRISPR gRNA sequence
  source 1..20: mol_type = other DNA
agatcacgccattgcactcc

SEQ ID NO: 102070 - DNA, 20 bp, synthetic construct
  misc_feature 1..20: note = CRISPR gRNA sequence
  source 1..20: mol_type = other DNA
cactccagcatgggcaacaa

SEQ ID NO: 102071 - DNA, 20 bp, synthetic construct
  misc_feature 1..20: note = CRISPR gRNA sequence
  source 1..20: mol_type = other DNA
cagcatgggcaacaagagca

SEQ ID NO: 102072 - DNA, 20 bp, synthetic construct
  misc_feature 1..20: note = CRISPR gRNA sequence
  source 1..20: mol_type = other DNA
catctcaaaaaacaacaaaa

SEQ ID NO: 102073 - DNA, 20 bp, synthetic construct
  misc_feature 1..20: note = CRISPR gRNA sequence
  source 1..20: mol_type = other DNA
aaaaaacaacaaaacaaaac

SEQ ID NO: 102074 - DNA, 20 bp, synthetic construct
  misc_feature 1..20: note = CRISPR gRNA sequence
  source 1..20: mol_type = other DNA
catgtgaggcctgacattcc

SEQ ID NO: 102075 - DNA, 20 bp, synthetic construct
  misc_feature 1..20: note = CRISPR gRNA sequence
  source 1..20: mol_type = other DNA
acattccatcatcatggaat

SEQ ID NO: 102076 - DNA, 20 bp, synthetic construct
  misc_feature 1..20: note = CRISPR gRNA sequence
  source 1..20: mol_type = other DNA
catcatcatggaatcccaga

SEQ ID NO: 102077 - DNA, 20 bp, synthetic construct
  misc_feature 1..20: note = CRISPR gRNA sequence
  source 1..20: mol_type = other DNA
atcccagaggaggtatccta

SEQ ID NO: 102078 - DNA, 20 bp, synthetic construct
  misc_feature 1..20: note = CRISPR gRNA sequence
  source 1..20: mol_type = other DNA
ccctgtggagaggaaacact

SEQ ID NO: 102079 - DNA, 20 bp, synthetic construct
  misc_feature 1..20: note = CRISPR gRNA sequence
  source 1..20: mol_type = other DNA
tggagaggaaacactggcat

SEQ ID NO: 102080 - DNA, 20 bp, synthetic construct
  misc_feature 1..20: note = CRISPR gRNA sequence
  source 1..20: mol_type = other DNA
gcatccggttgtgcagggaa

SEQ ID NO: 102081 - DNA, 20 bp, synthetic construct
  misc_feature 1..20: note = CRISPR gRNA sequence
  source 1..20: mol_type = other DNA
tgcagggaaagagactgagg

SEQ ID NO: 102082 - DNA, 20 bp, synthetic construct
  misc_feature 1..20: note = CRISPR gRNA sequence
  source 1..20: mol_type = other DNA
aggaccacagtgtctgagcc

SEQ ID NO: 102083 - DNA, 20 bp, synthetic construct
  misc_feature 1..20: note = CRISPR gRNA sequence
  source 1..20: mol_type = other DNA
agccatctgcagcctcctct

SEQ ID NO: 102084 - DNA, 20 bp, synthetic construct
  misc_feature 1..20: note = CRISPR gRNA sequence
  source 1..20: mol_type = other DNA
cagcctcctctccggggtct

SEQ ID NO: 102085 - DNA, 20 bp, synthetic construct
  misc_feature 1..20: note = CRISPR gRNA sequence
  source 1..20: mol_type = other DNA
ctctccggggtcttcagggt

SEQ ID NO: 102086 - DNA, 20 bp, synthetic construct
  misc_feature 1..20: note = CRISPR gRNA sequence
  source 1..20: mol_type = other DNA
tccggggtcttcagggtccc

SEQ ID NO: 102087 - DNA, 20 bp, synthetic construct
  misc_feature 1..20: note = CRISPR gRNA sequence
  source 1..20: mol_type = other DNA
cggggtcttcagggtcccca

SEQ ID NO: 102088 - DNA, 20 bp, synthetic construct
  misc_feature 1..20: note = CRISPR gRNA sequence
  source 1..20: mol_type = other DNA
cagggtccccaagttctgag

SEQ ID NO: 102089 - DNA, 20 bp, synthetic construct
  misc_feature 1..20: note = CRISPR gRNA sequence
  source 1..20: mol_type = other DNA
agggtccccaagttctgagg

SEQ ID NO: 102090 - DNA, 20 bp, synthetic construct
  misc_feature 1..20: note = CRISPR gRNA sequence
  source 1..20: mol_type = other DNA
tgaggcaggggtctgctggg

SEQ ID NO: 102091 - DNA, 20 bp, synthetic construct
  misc_feature 1..20: note = CRISPR gRNA sequence
  source 1..20: mol_type = other DNA
aggcaggggtctgctgggtc

SEQ ID NO: 102092 - DNA, 20 bp, synthetic construct
  misc_feature 1..20: note = CRISPR gRNA sequence
  source 1..20: mol_type = other DNA
ctgggtctggatgaggtctt

SEQ ID NO: 102093 - DNA, 20 bp, synthetic construct
  misc_feature 1..20: note = CRISPR gRNA sequence
  source 1..20: mol_type = other DNA
ggtctggatgaggtcttctg

SEQ ID NO: 102094 - DNA, 20 bp, synthetic construct
  misc_feature 1..20: note = CRISPR gRNA sequence
  source 1..20: mol_type = other DNA
gatgaggtcttctgcaggct

SEQ ID NO: 102095 - DNA, 20 bp, synthetic construct
  misc_feature 1..20: note = CRISPR gRNA sequence
  source 1..20: mol_type = other DNA
ctgcaggctgggtaagctcc

SEQ ID NO: 102096 - DNA, 20 bp, synthetic construct
  misc_feature 1..20: note = CRISPR gRNA sequence
  source 1..20: mol_type = other DNA
tgcaggctgggtaagctcca

SEQ ID NO: 102097 - DNA, 20 bp, synthetic construct
  misc_feature 1..20: note = CRISPR gRNA sequence
  source 1..20: mol_type = other DNA
caggctgggtaagctccatg

SEQ ID NO: 102098 - DNA, 20 bp, synthetic construct
  misc_feature 1..20: note = CRISPR gRNA sequence
  source 1..20: mol_type = other DNA
ggtaagctccatggggaaag

SEQ ID NO: 102099 - DNA, 20 bp, synthetic construct
  misc_feature 1..20: note = CRISPR gRNA sequence
  source 1..20: mol_type = other DNA
catggggaaagctggcggag

SEQ ID NO: 102100 - DNA, 20 bp, synthetic construct
  misc_feature 1..20: note = CRISPR gRNA sequence
  source 1..20: mol_type = other DNA
gcggaggtgtcagaagggga

SEQ ID NO: 102101 - DNA, 20 bp, synthetic construct
  misc_feature 1..20: note = CRISPR gRNA sequence
  source 1..20: mol_type = other DNA
tcaacagttataataaagta

SEQ ID NO: 102102 - DNA, 20 bp, synthetic construct
  misc_feature 1..20: note = CRISPR gRNA sequence
  source 1..20: mol_type = other DNA
taataaagtaggcaccgact

SEQ ID NO: 102103 - DNA, 20 bp, synthetic construct
  misc_feature 1..20: note = CRISPR gRNA sequence
  source 1..20: mol_type = other DNA
catacctagccttgcactgt

SEQ ID NO: 102104 - DNA, 20 bp, synthetic construct
  misc_feature 1..20: note = CRISPR gRNA sequence
  source 1..20: mol_type = other DNA
gccttgcactgtgagggtgg

SEQ ID NO: 102105 - DNA, 20 bp, synthetic construct
  misc_feature 1..20: note = CRISPR gRNA sequence
  source 1..20: mol_type = other DNA
gcactgtgagggtgggtaaa

SEQ ID NO: 102106 - DNA, 20 bp, synthetic construct
  misc_feature 1..20: note = CRISPR gRNA sequence
  source 1..20: mol_type = other DNA
cactgtgagggtgggtaaac

SEQ ID NO: 102107 - DNA, 20 bp, synthetic construct
  misc_feature 1..20: note = CRISPR gRNA sequence
  source 1..20: mol_type = other DNA
tgagggtgggtaaactgagg

SEQ ID NO: 102108 - DNA, 20 bp, synthetic construct
  misc_feature 1..20: note = CRISPR gRNA sequence
  source 1..20: mol_type = other DNA
aggtccaggttaattaccag

SEQ ID NO: 102109 - DNA, 20 bp, synthetic construct
  misc_feature 1..20: note = CRISPR gRNA sequence
  source 1..20: mol_type = other DNA
attaccagagccagggaaat

SEQ ID NO: 102110 - DNA, 20 bp, synthetic construct
  misc_feature 1..20: note = CRISPR gRNA sequence
  source 1..20: mol_type = other DNA
ccagagccagggaaatgaaa

SEQ ID NO: 102111 - DNA, 20 bp, synthetic construct
  misc_feature 1..20: note = CRISPR gRNA sequence
  source 1..20: mol_type = other DNA
ctttcgaggtctaccattcc

SEQ ID NO: 102112 - DNA, 20 bp, synthetic construct
  misc_feature 1..20: note = CRISPR gRNA sequence
  source 1..20: mol_type = other DNA
tcgaggtctaccattcccca

SEQ ID NO: 102113 - DNA, 20 bp, synthetic construct
  misc_feature 1..20: note = CRISPR gRNA sequence
  source 1..20: mol_type = other DNA
cgaggtctaccattccccac

SEQ ID NO: 102114 - DNA, 20 bp, synthetic construct
  misc_feature 1..20: note = CRISPR gRNA sequence
  source 1..20: mol_type = other DNA
gaggtctaccattccccacc

SEQ ID NO: 102115 - DNA, 20 bp, synthetic construct
  misc_feature 1..20: note = CRISPR gRNA sequence
  source 1..20: mol_type = other DNA
ccattccccaccaccaaagc

SEQ ID NO: 102116 - DNA, 20 bp, synthetic construct
  misc_feature 1..20: note = CRISPR gRNA sequence
  source 1..20: mol_type = other DNA
cccaccaccaaagcacctac

SEQ ID NO: 102117 - DNA, 20 bp, synthetic construct
  misc_feature 1..20: note = CRISPR gRNA sequence
  source 1..20: mol_type = other DNA
caatgtgcaatgtttaagag

SEQ ID NO: 102118 - DNA, 20 bp, synthetic construct
  misc_feature 1..20: note = CRISPR gRNA sequence
  source 1..20: mol_type = other DNA
aagagcctgggctctggcag

SEQ ID NO: 102119 - DNA, 20 bp, synthetic construct
  misc_feature 1..20: note = CRISPR gRNA sequence
  source 1..20: mol_type = other DNA
agagcctgggctctggcagg

SEQ ID NO: 102120 - DNA, 20 bp, synthetic construct
  misc_feature 1..20: note = CRISPR gRNA sequence
  source 1..20: mol_type = other DNA
ggctctggcagggcacagtg

SEQ ID NO: 102121 - DNA, 20 bp, synthetic construct
  misc_feature 1..20: note = CRISPR gRNA sequence
  source 1..20: mol_type = other DNA
tggcagggcacagtggctca

SEQ ID NO: 102122 - DNA, 20 bp, synthetic construct
  misc_feature 1..20: note = CRISPR gRNA sequence
  source 1..20: mol_type = other DNA
gcagggcacagtggctcacg

SEQ ID NO: 102123 - DNA, 20 bp, synthetic construct
  misc_feature 1..20: note = CRISPR gRNA sequence
  source 1..20: mol_type = other DNA
acggctgtaatcccagcact

SEQ ID NO: 102124 - DNA, 20 bp, synthetic construct
  misc_feature 1..20: note = CRISPR gRNA sequence
  source 1..20: mol_type = other DNA
taatcccagcactttgggag

SEQ ID NO: 102125 - DNA, 20 bp, synthetic construct
  misc_feature 1..20: note = CRISPR gRNA sequence
  source 1..20: mol_type = other DNA
tgggaggccgaggagggtgg

SEQ ID NO: 102126 - DNA, 20 bp, synthetic construct
  misc_feature 1..20: note = CRISPR gRNA sequence
  source 1..20: mol_type = other DNA
gggaggccgaggagggtgga

SEQ ID NO: 102127 - DNA, 20 bp, synthetic construct
  misc_feature 1..20: note = CRISPR gRNA sequence
  source 1..20: mol_type = other DNA
ggaggccgaggagggtggat

SEQ ID NO: 102128 - DNA, 20 bp, synthetic construct
  misc_feature 1..20: note = CRISPR gRNA sequence
  source 1..20: mol_type = other DNA
gagaccaggctggccaccat

SEQ ID NO: 102129 - DNA, 20 bp, synthetic construct
  misc_feature 1..20: note = CRISPR gRNA sequence
  source 1..20: mol_type = other DNA
gccaccatggtgaaacccca

SEQ ID NO: 102130 - DNA, 20 bp, synthetic construct
  misc_feature 1..20: note = CRISPR gRNA sequence
  source 1..20: mol_type = other DNA
tactaaaaatacaaaaatta

SEQ ID NO: 102131 - DNA, 20 bp, synthetic construct
  misc_feature 1..20: note = CRISPR gRNA sequence
  source 1..20: mol_type = other DNA
aaaatacaaaaattagccaa

SEQ ID NO: 102132 - DNA, 20 bp, synthetic construct
  misc_feature 1..20: note = CRISPR gRNA sequence
  source 1..20: mol_type = other DNA
gccaagcgcggtggcgggcg

SEQ ID NO: 102133 - DNA, 20 bp, synthetic construct
  misc_feature 1..20: note = CRISPR gRNA sequence
  source 1..20: mol_type = other DNA
tgatcccagctactcgggag

SEQ ID NO: 102134 - DNA, 20 bp, synthetic construct
  misc_feature 1..20: note = CRISPR gRNA sequence
  source 1..20: mol_type = other DNA
ctcgggaggctgaggcagaa

SEQ ID NO: 102135 - DNA, 20 bp, synthetic construct
  misc_feature 1..20: note = CRISPR gRNA sequence
  source 1..20: mol_type = other DNA
gggaggctgaggcagaattg

SEQ ID NO: 102136 - DNA, 20 bp, synthetic construct
  misc_feature 1..20: note = CRISPR gRNA sequence
  source 1..20: mol_type = other DNA
aggcagaattgcttgaactc

SEQ ID NO: 102137 - DNA, 20 bp, synthetic construct
  misc_feature 1..20: note = CRISPR gRNA sequence
  source 1..20: mol_type = other DNA
cttgaactcgggaggtggag

SEQ ID NO: 102138 - DNA, 20 bp, synthetic construct
  misc_feature 1..20: note = CRISPR gRNA sequence
  source 1..20: mol_type = other DNA
gaactcgggaggtggaggtt

SEQ ID NO: 102139 - DNA, 20 bp, synthetic construct
  misc_feature 1..20: note = CRISPR gRNA sequence
  source 1..20: mol_type = other DNA
aactcgggaggtggaggttg

SEQ ID NO: 102140 - DNA, 20 bp, synthetic construct
  misc_feature 1..20: note = CRISPR gRNA sequence
  source 1..20: mol_type = other DNA
gggaggtggaggttgcggtg

SEQ ID NO: 102141 - DNA, 20 bp, synthetic construct
  misc_feature 1..20: note = CRISPR gRNA sequence
  source 1..20: mol_type = other DNA
cggtgagcagagatcgcacc

SEQ ID NO: 102142 - DNA, 20 bp, synthetic construct
  misc_feature 1..20: note = CRISPR gRNA sequence
  source 1..20: mol_type = other DNA
cactgtagctggggcgacag

SEQ ID NO: 102143 - DNA, 20 bp, synthetic construct
  misc_feature 1..20: note = CRISPR gRNA sequence
  source 1..20: mol_type = other DNA
tagctggggcgacagagcaa

SEQ ID NO: 102144 - DNA, 20 bp, synthetic construct
  misc_feature 1..20: note = CRISPR gRNA sequence
  source 1..20: mol_type = other DNA
gggcgacagagcaagactct

SEQ ID NO: 102145 - DNA, 20 bp, synthetic construct
  misc_feature 1..20: note = CRISPR gRNA sequence
  source 1..20: mol_type = other DNA
tgtctcaaaaaaaaaaaaaa

SEQ ID NO: 102146 - DNA, 20 bp, synthetic construct
  misc_feature 1..20: note = CRISPR gRNA sequence
  source 1..20: mol_type = other DNA
tctcaaaaaaaaaaaaaaaa

SEQ ID NO: 102147 - DNA, 20 bp, synthetic construct
  misc_feature 1..20: note = CRISPR gRNA sequence
  source 1..20: mol_type = other DNA
aaaaaaaaaaaaaaaaaaaa

SEQ ID NO: 102148 - DNA, 20 bp, synthetic construct
  misc_feature 1..20: note = CRISPR gRNA sequence
  source 1..20: mol_type = other DNA
tggggtcagctgtctgggtt

SEQ ID NO: 102149 - DNA, 20 bp, synthetic construct
  misc_feature 1..20: note = CRISPR gRNA sequence
  source 1..20: mol_type = other DNA
gggtcagctgtctgggttcg

SEQ ID NO: 102150 - DNA, 20 bp, synthetic construct
  misc_feature 1..20: note = CRISPR gRNA sequence
  source 1..20: mol_type = other DNA
tctgggttcgaatccctcaa

SEQ ID NO: 102151 - DNA, 20 bp, synthetic construct
  misc_feature 1..20: note = CRISPR gRNA sequence
  source 1..20: mol_type = other DNA
ggttcgaatccctcaattta

SEQ ID NO: 102152 - DNA, 20 bp, synthetic construct
  misc_feature 1..20: note = CRISPR gRNA sequence
  source 1..20: mol_type = other DNA
gaatccctcaatttataggc

SEQ ID NO: 102153 - DNA, 20 bp, synthetic construct
  misc_feature 1..20: note = CRISPR gRNA sequence
  source 1..20: mol_type = other DNA
aatttataggccgtgagaac

SEQ ID NO: 102154 - DNA, 20 bp, synthetic construct
  misc_feature 1..20: note = CRISPR gRNA sequence
  source 1..20: mol_type = other DNA
ataggccgtgagaacttggg

SEQ ID NO: 102155 - DNA, 20 bp, synthetic construct
  misc_feature 1..20: note = CRISPR gRNA sequence
  source 1..20: mol_type = other DNA
taggccgtgagaacttgggc

SEQ ID NO: 102156 - DNA, 20 bp, synthetic construct
  misc_feature 1..20: note = CRISPR gRNA sequence
  source 1..20: mol_type = other DNA
gggcacgtgacttaaccttt

SEQ ID NO: 102157 - DNA, 20 bp, synthetic construct
  misc_feature 1..20: note = CRISPR gRNA sequence
  source 1..20: mol_type = other DNA
ggcacgtgacttaacctttg

SEQ ID NO: 102158 - DNA, 20 bp, synthetic construct
  misc_feature 1..20: note = CRISPR gRNA sequence
  source 1..20: mol_type = other DNA
aacctttgagcctcagtttc

SEQ ID NO: 102159 - DNA, 20 bp, synthetic construct
  misc_feature 1..20: note = CRISPR gRNA sequence
  source 1..20: mol_type = other DNA
acctttgagcctcagtttcc

SEQ ID NO: 102160 - DNA, 20 bp, synthetic construct
  misc_feature 1..20: note = CRISPR gRNA sequence
  source 1..20: mol_type = other DNA
tgagcctcagtttcctccac

SEQ ID NO: 102161 - DNA, 20 bp, synthetic construct
  misc_feature 1..20: note = CRISPR gRNA sequence
  source 1..20: mol_type = other DNA
gagcctcagtttcctccacg

SEQ ID NO: 102162 - DNA, 20 bp, synthetic construct
  misc_feature 1..20: note = CRISPR gRNA sequence
  source 1..20: mol_type = other DNA
agcctcagtttcctccacga

SEQ ID NO: 102163 - DNA, 20 bp, synthetic construct
  misc_feature 1..20: note = CRISPR gRNA sequence
  source 1..20: mol_type = other DNA
agtttcctccacgacaaaat

SEQ ID NO: 102164 - DNA, 20 bp, synthetic construct
  misc_feature 1..20: note = CRISPR gRNA sequence
  source 1..20: mol_type = other DNA
cctccacgacaaaatgtgga

SEQ ID NO: 102165 - DNA, 20 bp, synthetic construct
  misc_feature 1..20: note = CRISPR gRNA sequence
  source 1..20: mol_type = other DNA
ctccacgacaaaatgtggaa

SEQ ID NO: 102166 - DNA, 20 bp, synthetic construct
  misc_feature 1..20: note = CRISPR gRNA sequence
  source 1..20: mol_type = other DNA
cacgacaaaatgtggaaatg

SEQ ID NO: 102167 - DNA, 20 bp, synthetic construct
  misc_feature 1..20: note = CRISPR gRNA sequence
  source 1..20: mol_type = other DNA
caacgaattatgtctgtaca

SEQ ID NO: 102168 - DNA, 20 bp, synthetic construct
  misc_feature 1..20: note = CRISPR gRNA sequence
  source 1..20: mol_type = other DNA
tgtctgtacatagcttatcg

SEQ ID NO: 102169 - DNA, 20 bp, synthetic construct
  misc_feature 1..20: note = CRISPR gRNA sequence
  source 1..20: mol_type = other DNA
tacatagcttatcgggggat

SEQ ID NO: 102170 - DNA, 20 bp, synthetic construct
  misc_feature 1..20: note = CRISPR gRNA sequence
  source 1..20: mol_type = other DNA
atcgggggatctgctaagcg

SEQ ID NO: 102171 - DNA, 20 bp, synthetic construct
  misc_feature 1..20: note = CRISPR gRNA sequence
  source 1..20: mol_type = other DNA
tcgggggatctgctaagcgt

SEQ ID NO: 102172 - DNA, 20 bp, synthetic construct
  misc_feature 1..20: note = CRISPR gRNA sequence
  source 1..20: mol_type = other DNA
ctaagcgtggagctcaataa

SEQ ID NO: 102173 - DNA, 20 bp, synthetic construct
  misc_feature 1..20: note = CRISPR gRNA sequence
  source 1..20: mol_type = other DNA
agcgtggagctcaataaata

SEQ ID NO: 102174 - DNA, 20 bp, synthetic construct
  misc_feature 1..20: note = CRISPR gRNA sequence
  source 1..20: mol_type = other DNA
aataaatattcgctatggtt

SEQ ID NO: 102175 - DNA, 20 bp, synthetic construct
  misc_feature 1..20: note = CRISPR gRNA sequence
  source 1..20: mol_type = other DNA
gctatggttgttgggagggg

SEQ ID NO: 102176 - DNA, 20 bp, synthetic construct
  misc_feature 1..20: note = CRISPR gRNA sequence
  source 1..20: mol_type = other DNA
tggttgttgggaggggctcc

SEQ ID NO: 102177 - DNA, 20 bp, synthetic construct
  misc_feature 1..20: note = CRISPR gRNA sequence
  source 1..20: mol_type = other DNA
ttgggaggggctccccataa

SEQ ID NO: 102178 - DNA, 20 bp, synthetic construct
  misc_feature 1..20: note = CRISPR gRNA sequence
  source 1..20: mol_type = other DNA
ggaggggctccccataatga

SEQ ID NO: 102179 - DNA, 20 bp, synthetic construct
  misc_feature 1..20: note = CRISPR gRNA sequence
  source 1..20: mol_type = other DNA
cccataatgagtgacggctc

SEQ ID NO: 102180 - DNA, 20 bp, synthetic construct
  misc_feature 1..20: note = CRISPR gRNA sequence
  source 1..20: mol_type = other DNA
aacaaaggtgcgattggtcc

SEQ ID NO: 102181 - DNA, 20 bp, synthetic construct
  misc_feature 1..20: note = CRISPR gRNA sequence
  source 1..20: mol_type = other DNA
gtcccagtcccacccgagcc

SEQ ID NO: 102182 - DNA, 20 bp, synthetic construct
  misc_feature 1..20: note = CRISPR gRNA sequence
  source 1..20: mol_type = other DNA
ctaaatcgatccaggaggtc

SEQ ID NO: 102183 - DNA, 20 bp, synthetic construct
  misc_feature 1..20: note = CRISPR gRNA sequence
  source 1..20: mol_type = other DNA
aatcgatccaggaggtccac

SEQ ID NO: 102184 - DNA, 20 bp, synthetic construct
  misc_feature 1..20: note = CRISPR gRNA sequence
  source 1..20: mol_type = other DNA
acctccccacgagcctcctc

SEQ ID NO: 102185 - DNA, 20 bp, synthetic construct
  misc_feature 1..20: note = CRISPR gRNA sequence
  source 1..20: mol_type = other DNA
cccacgagcctcctctgtcc

SEQ ID NO: 102186 - DNA, 20 bp, synthetic construct
  misc_feature 1..20: note = CRISPR gRNA sequence
  source 1..20: mol_type = other DNA
ctctgtccccccgcgccgaa

SEQ ID NO: 102187 - DNA, 20 bp, synthetic construct
  misc_feature 1..20: note = CRISPR gRNA sequence
  source 1..20: mol_type = other DNA
tgtccccccgcgccgaaagc

SEQ ID NO: 102188 - DNA, 20 bp, synthetic construct
  misc_feature 1..20: note = CRISPR gRNA sequence
  source 1..20: mol_type = other DNA
tccccccgcgccgaaagccc

SEQ ID NO: 102189 - DNA, 20 bp, synthetic construct
  misc_feature 1..20: note = CRISPR gRNA sequence
  source 1..20: mol_type = other DNA
tctcaaaacttgggggccca

SEQ ID NO: 102190 - DNA, 20 bp, synthetic construct
  misc_feature 1..20: note = CRISPR gRNA sequence
  source 1..20: mol_type = other DNA
tcaaaacttgggggcccaag

SEQ ID NO: 102191 - DNA, 20 bp, synthetic construct
  misc_feature 1..20: note = CRISPR gRNA sequence
  source 1..20: mol_type = other DNA
aaaacttgggggcccaagtc

SEQ ID NO: 102192 - DNA, 20 bp, synthetic construct
  misc_feature 1..20: note = CRISPR gRNA sequence
  source 1..20: mol_type = other DNA
gggggcccaagtcacaaact

SEQ ID NO: 102193 - DNA, 20 bp, synthetic construct
  misc_feature 1..20: note = CRISPR gRNA sequence
  source 1..20: mol_type = other DNA
ggggcccaagtcacaaactt

SEQ ID NO: 102194 - DNA, 20 bp, synthetic construct
  misc_feature 1..20: note = CRISPR gRNA sequence
  source 1..20: mol_type = other DNA
ttctcttccaatggatatag

SEQ ID NO: 102195 - DNA, 20 bp, synthetic construct
  misc_feature 1..20: note = CRISPR gRNA sequence
  source 1..20: mol_type = other DNA
tctcttccaatggatatagc

SEQ ID NO: 102196 - DNA, 20 bp, synthetic construct
  misc_feature 1..20: note = CRISPR gRNA sequence
  source 1..20: mol_type = other DNA
ctcttccaatggatatagca

SEQ ID NO: 102197 - DNA, 20 bp, synthetic construct
  misc_feature 1..20: note = CRISPR gRNA sequence
  source 1..20: mol_type = other DNA
tcttccaatggatatagcag

SEQ ID NO: 102198 - DNA, 20 bp, synthetic construct
  misc_feature 1..20: note = CRISPR gRNA sequence
  source 1..20: mol_type = other DNA
ttccaatggatatagcagga

SEQ ID NO: 102199 - DNA, 20 bp, synthetic construct
  misc_feature 1..20: note = CRISPR gRNA sequence
  source 1..20: mol_type = other DNA
ccaatggatatagcaggagg

SEQ ID NO: 102200 - DNA, 20 bp, synthetic construct
  misc_feature 1..20: note = CRISPR gRNA sequence
  source 1..20: mol_type = other DNA
caatggatatagcaggaggc

SEQ ID NO: 102201 - DNA, 20 bp, synthetic construct
  misc_feature 1..20: note = CRISPR gRNA sequence
  source 1..20: mol_type = other DNA
gagaccggaccctcagcgat

SEQ ID NO: 102202 - DNA, 20 bp, synthetic construct
  misc_feature 1..20: note = CRISPR gRNA sequence
  source 1..20: mol_type = other DNA
agcgatctggcttcctctgc

SEQ ID NO: 102203 - DNA, 20 bp, synthetic construct
  misc_feature 1..20: note = CRISPR gRNA sequence
  source 1..20: mol_type = other DNA
gcttcctctgccgggacaga

SEQ ID NO: 102204 - DNA, 20 bp, synthetic construct
  misc_feature 1..20: note = CRISPR gRNA sequence
  source 1..20: mol_type = other DNA
cctctgccgggacagaaagc

SEQ ID NO: 102205 - DNA, 20 bp, synthetic construct
  misc_feature 1..20: note = CRISPR gRNA sequence
  source 1..20: mol_type = other DNA
ctctgccgggacagaaagca

SEQ ID NO: 102206 - DNA, 20 bp, synthetic construct
  misc_feature 1..20: note = CRISPR gRNA sequence
  source 1..20: mol_type = other DNA
tgccgggacagaaagcaact

SEQ ID NO: 102207 - DNA, 20 bp, synthetic construct
  misc_feature 1..20: note = CRISPR gRNA sequence
  source 1..20: mol_type = other DNA
ccgggacagaaagcaacttg

SEQ ID NO: 102208 - DNA, 20 bp, synthetic construct
  misc_feature 1..20: note = CRISPR gRNA sequence
  source 1..20: mol_type = other DNA
gatactcgaccgctaccccc

SEQ ID NO: 102209 - DNA, 20 bp, synthetic construct
  misc_feature 1..20: note = CRISPR gRNA sequence
  source 1..20: mol_type = other DNA
atactcgaccgctaccccca

SEQ ID NO: 102210 - DNA, 20 bp, synthetic construct
  misc_feature 1..20: note = CRISPR gRNA sequence
  source 1..20: mol_type = other DNA
gaccgctacccccaccccag

SEQ ID NO: 102211 - DNA, 20 bp, synthetic construct
  misc_feature 1..20: note = CRISPR gRNA sequence
  source 1..20: mol_type = other DNA
cccccaccccagagctcccc

SEQ ID NO: 102212 - DNA, 20 bp, synthetic construct
  misc_feature 1..20: note = CRISPR gRNA sequence
  source 1..20: mol_type = other DNA
ccccactgcgcttgcgcacc

SEQ ID NO: 102213 - DNA, 20 bp, synthetic construct
  misc_feature 1..20: note = CRISPR gRNA sequence
  source 1..20: mol_type = other DNA
cgcttgcgcacccccgcccc

SEQ ID NO: 102214 - DNA, 20 bp, synthetic construct
  misc_feature 1..20: note = CRISPR gRNA sequence
  source 1..20: mol_type = other DNA
gcgcacccccgccccccaaa

SEQ ID NO: 102215 - DNA, 20 bp, synthetic construct
  misc_feature 1..20: note = CRISPR gRNA sequence
  source 1..20: mol_type = other DNA
cgcacccccgccccccaaaa

SEQ ID NO: 102216 - DNA, 20 bp, synthetic construct
  misc_feature 1..20: note = CRISPR gRNA sequence
  source 1..20: mol_type = other DNA
cctctggccctttaagactt

SEQ ID NO: 102217 - DNA, 20 bp, synthetic construct
  misc_feature 1..20: note = CRISPR gRNA sequence
  source 1..20: mol_type = other DNA
tggccctttaagacttaggg

SEQ ID NO: 102218 - DNA, 20 bp, synthetic construct
  misc_feature 1..20: note = CRISPR gRNA sequence
  source 1..20: mol_type = other DNA
gccctttaagacttagggga

SEQ ID NO: 102219 - DNA, 20 bp, synthetic construct
  misc_feature 1..20: note = CRISPR gRNA sequence
  source 1..20: mol_type = other DNA
taagacttaggggagggcgt

SEQ ID NO: 102220 - DNA, 20 bp, synthetic construct
  misc_feature 1..20: note = CRISPR gRNA sequence
  source 1..20: mol_type = other DNA
aagacttaggggagggcgtg

SEQ ID NO: 102221 - DNA, 20 bp, synthetic construct
  misc_feature 1..20: note = CRISPR gRNA sequence
  source 1..20: mol_type = other DNA
agacttaggggagggcgtgg

SEQ ID NO: 102222 - DNA, 20 bp, synthetic construct
  misc_feature 1..20: note = CRISPR gRNA sequence
  source 1..20: mol_type = other DNA
aggggagggcgtgggttccg

SEQ ID NO: 102223 - DNA, 20 bp, synthetic construct
  misc_feature 1..20: note = CRISPR gRNA sequence
  source 1..20: mol_type = other DNA
ggggagggcgtgggttccgc

SEQ ID NO: 102224 - DNA, 20 bp, synthetic construct
  misc_feature 1..20: note = CRISPR gRNA sequence
  source 1..20: mol_type = other DNA
cgctggggtcctgggagggc

SEQ ID NO: 102225 - DNA, 20 bp, synthetic construct
  misc_feature 1..20: note = CRISPR gRNA sequence
  source 1..20: mol_type = other DNA
gggtcctgggagggcagttg

SEQ ID NO: 102226 - DNA, 20 bp, synthetic construct
  misc_feature 1..20: note = CRISPR gRNA sequence
  source 1..20: mol_type = other DNA
ggagggcagttgcgcctgcg

SEQ ID NO: 102227 - DNA, 20 bp, synthetic construct
  misc_feature 1..20: note = CRISPR gRNA sequence
  source 1..20: mol_type = other DNA
cgcctgcgccttcttttccc

SEQ ID NO: 102228 - DNA, 20 bp, synthetic construct
  misc_feature 1..20: note = CRISPR gRNA sequence
  source 1..20: mol_type = other DNA
cgccttcttttcccctcctc

SEQ ID NO: 102229 - DNA, 20 bp, synthetic construct
  misc_feature 1..20: note = CRISPR gRNA sequence
  source 1..20: mol_type = other DNA
cttttcccctcctcaccgac

SEQ ID NO: 102230 - DNA, 20 bp, synthetic construct
  misc_feature 1..20: note = CRISPR gRNA sequence
  source 1..20: mol_type = other DNA
ttttcccctcctcaccgact

SEQ ID NO: 102231 - DNA, 20 bp, synthetic construct
  misc_feature 1..20: note = CRISPR gRNA sequence
  source 1..20: mol_type = other DNA
ttcccctcctcaccgactcg

SEQ ID NO: 102232 - DNA, 20 bp, synthetic construct
  misc_feature 1..20: note = CRISPR gRNA sequence
  source 1..20: mol_type = other DNA
tcccctcctcaccgactcgg

SEQ ID NO: 102233 - DNA, 20 bp, synthetic construct
  misc_feature 1..20: note = CRISPR gRNA sequence
  source 1..20: mol_type = other DNA
cccctcctcaccgactcgga

SEQ ID NO: 102234 - DNA, 20 bp, synthetic construct
  misc_feature 1..20: note = CRISPR gRNA sequence
  source 1..20: mol_type = other DNA
ccctcctcaccgactcggag

SEQ ID NO: 102235 - DNA, 20 bp, synthetic construct
  misc_feature 1..20: note = CRISPR gRNA sequence
  source 1..20: mol_type = other DNA
ctcaccgactcggagggaat

SEQ ID NO: 102236 - DNA, 20 bp, synthetic construct
  misc_feature 1..20: note = CRISPR gRNA sequence
  source 1..20: mol_type = other DNA
accgactcggagggaatggg

SEQ ID NO: 102237 - DNA, 20 bp, synthetic construct
  misc_feature 1..20: note = CRISPR gRNA sequence
  source 1..20: mol_type = other DNA
ggagggaatgggcggggcct

SEQ ID NO: 102238 - DNA, 20 bp, synthetic construct
  misc_feature 1..20: note = CRISPR gRNA sequence
  source 1..20: mol_type = other DNA
aagggctctgagaatttcac

SEQ ID NO: 102239 - DNA, 20 bp, synthetic construct
  misc_feature 1..20: note = CRISPR gRNA sequence
  source 1..20: mol_type = other DNA
tgagaatttcactacgcctg

SEQ ID NO: 102240 - DNA, 20 bp, synthetic construct
  misc_feature 1..20: note = CRISPR gRNA sequence
  source 1..20: mol_type = other DNA
agaatttcactacgcctgcg

SEQ ID NO: 102241 - DNA, 20 bp, synthetic construct
  misc_feature 1..20: note = CRISPR gRNA sequence
  source 1..20: mol_type = other DNA
cactacgcctgcgcccgctc

SEQ ID NO: 102242 - DNA, 20 bp, synthetic construct
  misc_feature 1..20: note = CRISPR gRNA sequence
  source 1..20: mol_type = other DNA
actacgcctgcgcccgctca

SEQ ID NO: 102243 - DNA, 20 bp, synthetic construct
  misc_feature 1..20: note = CRISPR gRNA sequence
  source 1..20: mol_type = other DNA
cgcctgcgcccgctcacctt

SEQ ID NO: 102244 - DNA, 20 bp, synthetic construct
  misc_feature 1..20: note = CRISPR gRNA sequence
  source 1..20: mol_type = other DNA
cgcccgctcacctttaccct

SEQ ID NO: 102245 - DNA, 20 bp, synthetic construct
  misc_feature 1..20: note = CRISPR gRNA sequence
  source 1..20: mol_type = other DNA
acctttaccctgcccacaga

SEQ ID NO: 102246 - DNA, 20 bp, synthetic construct
  misc_feature 1..20: note = CRISPR gRNA sequence
  source 1..20: mol_type = other DNA
taccctgcccacagattttt

SEQ ID NO: 102247 - DNA, 20 bp, synthetic construct
  misc_feature 1..20: note = CRISPR gRNA sequence
  source 1..20: mol_type = other DNA
accctgcccacagatttttc

SEQ ID NO: 102248 - DNA, 20 bp, synthetic construct
  misc_feature 1..20: note = CRISPR gRNA sequence
  source 1..20: mol_type = other DNA
ccctgcccacagatttttcc

SEQ ID NO: 102249 - DNA, 20 bp, synthetic construct
  misc_feature 1..20: note = CRISPR gRNA sequence
  source 1..20: mol_type = other DNA
cccacagatttttccagagg

SEQ ID NO: 102250 - DNA, 20 bp, synthetic construct
  misc_feature 1..20: note = CRISPR gRNA sequence
  source 1..20: mol_type = other DNA
ttccagagggagccaattgg

SEQ ID NO: 102251 - DNA, 20 bp, synthetic construct
  misc_feature 1..20: note = CRISPR gRNA sequence
  source 1..20: mol_type = other DNA
tccagagggagccaattggc

SEQ ID NO: 102252 - DNA, 20 bp, synthetic construct
  misc_feature 1..20: note = CRISPR gRNA sequence
  source 1..20: mol_type = other DNA
ccagagggagccaattggct

SEQ ID NO: 102253 - DNA, 20 bp, synthetic construct
  misc_feature 1..20: note = CRISPR gRNA sequence
  source 1..20: mol_type = other DNA
cagagggagccaattggctc

SEQ ID NO: 102254 - DNA, 20 bp, synthetic construct
  misc_feature 1..20: note = CRISPR gRNA sequence
  source 1..20: mol_type = other DNA
gctccggcttcgggtagatg

SEQ ID NO: 102255 - DNA, 20 bp, synthetic construct
  misc_feature 1..20: note = CRISPR gRNA sequence
  source 1..20: mol_type = other DNA
cggcttcgggtagatgggcg

SEQ ID NO: 102256 - DNA, 20 bp, synthetic construct
  misc_feature 1..20: note = CRISPR gRNA sequence
  source 1..20: mol_type = other DNA
cgggtagatgggcggggcta

SEQ ID NO: 102257 - DNA, 20 bp, synthetic construct
  misc_feature 1..20: note = CRISPR gRNA sequence
  source 1..20: mol_type = other DNA
gggtagatgggcggggctat

SEQ ID NO: 102258 - DNA, 20 bp, synthetic construct
  misc_feature 1..20: note = CRISPR gRNA sequence
  source 1..20: mol_type = other DNA
tctcaagaagaagaagtagg

SEQ ID NO: 102259 - DNA, 20 bp, synthetic construct
  misc_feature 1..20: note = CRISPR gRNA sequence
  source 1..20: mol_type = other DNA
aagaagaagaagtaggggaa

SEQ ID NO: 102260 - DNA, 20 bp, synthetic construct
  misc_feature 1..20: note = CRISPR gRNA sequence
  source 1..20: mol_type = other DNA
gaacttaaaggggcagcgta

SEQ ID NO: 102261 - DNA, 20 bp, synthetic construct
  misc_feature 1..20: note = CRISPR gRNA sequence
  source 1..20: mol_type = other DNA
aaaggggcagcgtaccttgg

SEQ ID NO: 102262 - DNA, 20 bp, synthetic construct
  misc_feature 1..20: note = CRISPR gRNA sequence
  source 1..20: mol_type = other DNA
aaggggcagcgtaccttggc

SEQ ID NO: 102263 - DNA, 20 bp, synthetic construct
  misc_feature 1..20: note = CRISPR gRNA sequence
  source 1..20: mol_type = other DNA
ggccgtcccgttccacaaca

SEQ ID NO: 102264 - DNA, 20 bp, synthetic construct
  misc_feature 1..20: note = CRISPR gRNA sequence
  source 1..20: mol_type = other DNA
gccgtcccgttccacaacaa

SEQ ID NO: 102265 - DNA, 20 bp, synthetic construct
  misc_feature 1..20: note = CRISPR gRNA sequence
  source 1..20: mol_type = other DNA
cacaacaaggtcccttctgc

SEQ ID NO: 102266 - DNA, 20 bp, synthetic construct
  misc_feature 1..20: note = CRISPR gRNA sequence
  source 1..20: mol_type = other DNA
ctgcggtctcaaaggcttat

SEQ ID NO: 102267 - DNA, 20 bp, synthetic construct
  misc_feature 1..20: note = CRISPR gRNA sequence
  source 1..20: mol_type = other DNA
tgcggtctcaaaggcttata

SEQ ID NO: 102268 - DNA, 20 bp, synthetic construct
  misc_feature 1..20: note = CRISPR gRNA sequence
  source 1..20: mol_type = other DNA
cggtctcaaaggcttataag

SEQ ID NO: 102269 - DNA, 20 bp, synthetic construct
  misc_feature 1..20: note = CRISPR gRNA sequence
  source 1..20: mol_type = other DNA
aaaggcttataagcaagggc

SEQ ID NO: 102270 - DNA, 20 bp, synthetic construct
  misc_feature 1..20: note = CRISPR gRNA sequence
  source 1..20: mol_type = other DNA
ataagcaagggcgggggcag

SEQ ID NO: 102271 - DNA, 20 bp, synthetic construct
  misc_feature 1..20: note = CRISPR gRNA sequence
  source 1..20: mol_type = other DNA
taagcaagggcgggggcaga

SEQ ID NO: 102272 - DNA, 20 bp, synthetic construct
  misc_feature 1..20: note = CRISPR gRNA sequence
  source 1..20: mol_type = other DNA
aagaagggagtttttgcggc

SEQ ID NO: 102273 - DNA, 20 bp, synthetic construct
  misc_feature 1..20: note = CRISPR gRNA sequence
  source 1..20: mol_type = other DNA
ttgcggcccgagtgggtaat

SEQ ID NO: 102274 - DNA, 20 bp, synthetic construct
  misc_feature 1..20: note = CRISPR gRNA sequence
  source 1..20: mol_type = other DNA
tgcggcccgagtgggtaatg

SEQ ID NO: 102275 - DNA, 20 bp, synthetic construct
  misc_feature 1..20: note = CRISPR gRNA sequence
  source 1..20: mol_type = other DNA
gcggcccgagtgggtaatgc

SEQ ID NO: 102276 - DNA, 20 bp, synthetic construct
  misc_feature 1..20: note = CRISPR gRNA sequence
  source 1..20: mol_type = other DNA
cggcccgagtgggtaatgcg

SEQ ID NO: 102277 - DNA, 20 bp, synthetic construct
  misc_feature 1..20: note = CRISPR gRNA sequence
  source 1..20: mol_type = other DNA
ccccaactcgtctctcaagg

SEQ ID NO: 102278 - DNA, 20 bp, synthetic construct
  misc_feature 1..20: note = CRISPR gRNA sequence
  source 1..20: mol_type = other DNA
gtctctcaaggaaaaggggg

SEQ ID NO: 102279 - DNA, 20 bp, synthetic construct
  misc_feature 1..20: note = CRISPR gRNA sequence
  source 1..20: mol_type = other DNA
tcaaggaaaagggggttcag

SEQ ID NO: 102280 - DNA, 20 bp, synthetic construct
  misc_feature 1..20: note = CRISPR gRNA sequence
  source 1..20: mol_type = other DNA
aaggaaaagggggttcagaa

SEQ ID NO: 102281 - DNA, 20 bp, synthetic construct
  misc_feature 1..20: note = CRISPR gRNA sequence
  source 1..20: mol_type = other DNA
agaaagggagagagttcttc

SEQ ID NO: 102282 - DNA, 20 bp, synthetic construct
  misc_feature 1..20: note = CRISPR gRNA sequence
  source 1..20: mol_type = other DNA
ttccccctctcctgcctggg

SEQ ID NO: 102283 - DNA, 20 bp, synthetic construct
  misc_feature 1..20: note = CRISPR gRNA sequence
  source 1..20: mol_type = other DNA
ccccctctcctgcctgggtg

SEQ ID NO: 102284 - DNA, 20 bp, synthetic construct
  misc_feature 1..20: note = CRISPR gRNA sequence
  source 1..20: mol_type = other DNA
cccctctcctgcctgggtgt

SEQ ID NO: 102285 - DNA, 20 bp, synthetic construct
  misc_feature 1..20: note = CRISPR gRNA sequence
  source 1..20: mol_type = other DNA
tcctgcctgggtgtcgctcc

SEQ ID NO: 102286 - DNA, 20 bp, synthetic construct
  misc_feature 1..20: note = CRISPR gRNA sequence
  source 1..20: mol_type = other DNA
ctgcctgggtgtcgctccac

SEQ ID NO: 102287 - DNA, 20 bp, synthetic construct
  misc_feature 1..20: note = CRISPR gRNA sequence
  source 1..20: mol_type = other DNA
cctgggtgtcgctccaccag

SEQ ID NO: 102288 - DNA, 20 bp, synthetic construct
  misc_feature 1..20: note = CRISPR gRNA sequence
  source 1..20: mol_type = other DNA
ggtgtcgctccaccagcctc

SEQ ID NO: 102289 - DNA, 20 bp, synthetic construct
  misc_feature 1..20: note = CRISPR gRNA sequence
  source 1..20: mol_type = other DNA
caccagcctcctggccgtcg

SEQ ID NO: 102290 - DNA, 20 bp, synthetic construct
  misc_feature 1..20: note = CRISPR gRNA sequence
  source 1..20: mol_type = other DNA
ctggccgtcgcgccccctcc

SEQ ID NO: 102291 - DNA, 20 bp, synthetic construct
  misc_feature 1..20: note = CRISPR gRNA sequence
  source 1..20: mol_type = other DNA
gccgtcgcgccccctcctca

SEQ ID NO: 102292 - DNA, 20 bp, synthetic construct
  misc_feature 1..20: note = CRISPR gRNA sequence
  source 1..20: mol_type = other DNA
ctcactgcgccacccccggg

SEQ ID NO: 102293 - DNA, 20 bp, synthetic construct
  misc_feature 1..20: note = CRISPR gRNA sequence
  source 1..20: mol_type = other DNA
actgcgccacccccgggtgt

SEQ ID NO: 102294 - DNA, 20 bp, synthetic construct
  misc_feature 1..20: note = CRISPR gRNA sequence
  source 1..20: mol_type = other DNA
cgccacccccgggtgtgcct

SEQ ID NO: 102295 - DNA, 20 bp, synthetic construct
  misc_feature 1..20: note = CRISPR gRNA sequence
  source 1..20: mol_type = other DNA
cttccctgcgtctcacacag

SEQ ID NO: 102296 - DNA, 20 bp, synthetic construct
  misc_feature 1..20: note = CRISPR gRNA sequence
  source 1..20: mol_type = other DNA
ccctgcgtctcacacagccc

SEQ ID NO: 102297 - DNA, 20 bp, synthetic construct
  misc_feature 1..20: note = CRISPR gRNA sequence
  source 1..20: mol_type = other DNA
cctgcgtctcacacagcccc

SEQ ID NO: 102298 - DNA, 20 bp, synthetic construct
  misc_feature 1..20: note = CRISPR gRNA sequence
  source 1..20: mol_type = other DNA
cgtctcacacagcccctttc

SEQ ID NO: 102299 - DNA, 20 bp, synthetic construct
  misc_feature 1..20: note = CRISPR gRNA sequence
  source 1..20: mol_type = other DNA
acacagcccctttcttgtcc

SEQ ID NO: 102300 - DNA, 20 bp, synthetic construct
  misc_feature 1..20: note = CRISPR gRNA sequence
  source 1..20: mol_type = other DNA
tcttgtccgcaaagactgag

SEQ ID NO: 102301 - DNA, 20 bp, synthetic construct
  misc_feature 1..20: note = CRISPR gRNA sequence
  source 1..20: mol_type = other DNA
cttgtccgcaaagactgagg

SEQ ID NO: 102302 - DNA, 20 bp, synthetic construct
  misc_feature 1..20: note = CRISPR gRNA sequence
  source 1..20: mol_type = other DNA
ttgtccgcaaagactgagga

SEQ ID NO: 102303 - DNA, 20 bp, synthetic construct
  misc_feature 1..20: note = CRISPR gRNA sequence
  source 1..20: mol_type = other DNA
gtccgcaaagactgaggagc

SEQ ID NO: 102304 - DNA, 20 bp, synthetic construct
  misc_feature 1..20: note = CRISPR gRNA sequence
  source 1..20: mol_type = other DNA
tccgcaaagactgaggagcg

SEQ ID NO: 102305 - DNA, 20 bp, synthetic construct
  misc_feature 1..20: note = CRISPR gRNA sequence
  source 1..20: mol_type = other DNA
aggagcggggagggcgggcc

SEQ ID NO: 102306 - DNA, 20 bp, synthetic construct
  misc_feature 1..20: note = CRISPR gRNA sequence
  source 1..20: mol_type = other DNA
tgacaccggaacaggagccg

SEQ ID NO: 102307 - DNA, 20 bp, synthetic construct
  misc_feature 1..20: note = CRISPR gRNA sequence
  source 1..20: mol_type = other DNA
acaccggaacaggagccgtg

SEQ ID NO: 102308 - DNA, 20 bp, synthetic construct
  misc_feature 1..20: note = CRISPR gRNA sequence
  source 1..20: mol_type = other DNA
cagcagggaaggcttaggcg

SEQ ID NO: 102309 - DNA, 20 bp, synthetic construct
  misc_feature 1..20: note = CRISPR gRNA sequence
  source 1..20: mol_type = other DNA
agcagggaaggcttaggcgg

SEQ ID NO: 102310 - DNA, 20 bp, synthetic construct
  misc_feature 1..20: note = CRISPR gRNA sequence
  source 1..20: mol_type = other DNA
aggcgggcgtcccaacctcc

SEQ ID NO: 102311 - DNA, 20 bp, synthetic construct
  misc_feature 1..20: note = CRISPR gRNA sequence
  source 1..20: mol_type = other DNA
ggcgggcgtcccaacctccg

SEQ ID NO: 102312 - DNA, 20 bp, synthetic construct
  misc_feature 1..20: note = CRISPR gRNA sequence
  source 1..20: mol_type = other DNA
cgggcttccggtgccgtttc

SEQ ID NO: 102313 - DNA, 20 bp, synthetic construct
  misc_feature 1..20: note = CRISPR gRNA sequence
  source 1..20: mol_type = other DNA
ccggtgccgtttcccggttc

SEQ ID NO: 102314 - DNA, 20 bp, synthetic construct
  misc_feature 1..20: note = CRISPR gRNA sequence
  source 1..20: mol_type = other DNA
cggtgccgtttcccggttcg

SEQ ID NO: 102315 - DNA, 20 bp, synthetic construct
  misc_feature 1..20: note = CRISPR gRNA sequence
  source 1..20: mol_type = other DNA
cccggttcgctcggccgcgg

SEQ ID NO: 102316 - DNA, 20 bp, synthetic construct
  misc_feature 1..20: note = CRISPR gRNA sequence
  source 1..20: mol_type = other DNA
ccggttcgctcggccgcggt

SEQ ID NO: 102317 - DNA, 20 bp, synthetic construct
  misc_feature 1..20: note = CRISPR gRNA sequence
  source 1..20: mol_type = other DNA
gctcggccgcggtcgctatg

SEQ ID NO: 102318 - DNA, 20 bp, synthetic construct
  misc_feature 1..20: note = CRISPR gRNA sequence
  source 1..20: mol_type = other DNA
ggccgcggtcgctatggagg

SEQ ID NO: 102319 - DNA, 20 bp, synthetic construct
  misc_feature 1..20: note = CRISPR gRNA sequence
  source 1..20: mol_type = other DNA
gtggggcgatccctgaactg

SEQ ID NO: 102320 - DNA, 20 bp, synthetic construct
  misc_feature 1..20: note = CRISPR gRNA sequence
  source 1..20: mol_type = other DNA
ggcgatccctgaactggagt

SEQ ID NO: 102321 - DNA, 20 bp, synthetic construct
  misc_feature 1..20: note = CRISPR gRNA sequence
  source 1..20: mol_type = other DNA
gatccctgaactggagttag

SEQ ID NO: 102322 - DNA, 20 bp, synthetic construct
  misc_feature 1..20: note = CRISPR gRNA sequence
  source 1..20: mol_type = other DNA
atccctgaactggagttagt

SEQ ID NO: 102323 - DNA, 20 bp, synthetic construct
  misc_feature 1..20: note = CRISPR gRNA sequence
  source 1..20: mol_type = other DNA
tgaactggagttagtgggcg

SEQ ID NO: 102324 - DNA, 20 bp, synthetic construct
  misc_feature 1..20: note = CRISPR gRNA sequence
  source 1..20: mol_type = other DNA
ggagttagtgggcgtggcct

SEQ ID NO: 102325 - DNA, 20 bp, synthetic construct
  misc_feature 1..20: note = CRISPR gRNA sequence
  source 1..20: mol_type = other DNA
agttagtgggcgtggcctca

SEQ ID NO: 102326 - DNA, 20 bp, synthetic construct
  misc_feature 1..20: note = CRISPR gRNA sequence
  source 1..20: mol_type = other DNA
gttagtgggcgtggcctcag

SEQ ID NO: 102327 - DNA, 20 bp, synthetic construct
  misc_feature 1..20: note = CRISPR gRNA sequence
  source 1..20: mol_type = other DNA
tggcctcagaggcgcctgcg

SEQ ID NO: 102328 - DNA, 20 bp, synthetic construct
  misc_feature 1..20: note = CRISPR gRNA sequence
  source 1..20: mol_type = other DNA
gcctcagaggcgcctgcgcg

SEQ ID NO: 102329 - DNA, 20 bp, synthetic construct
  misc_feature 1..20: note = CRISPR gRNA sequence
  source 1..20: mol_type = other DNA
cctcagaggcgcctgcgcgg

SEQ ID NO: 102330 - DNA, 20 bp, synthetic construct
  misc_feature 1..20: note = CRISPR gRNA sequence
  source 1..20: mol_type = other DNA
cagaggcgcctgcgcggagg

SEQ ID NO: 102331 - DNA, 20 bp, synthetic construct
  misc_feature 1..20: note = CRISPR gRNA sequence
  source 1..20: mol_type = other DNA
ggcgcctgcgcggaggcggt

SEQ ID NO: 102332 - DNA, 20 bp, synthetic construct
  misc_feature 1..20: note = CRISPR gRNA sequence
  source 1..20: mol_type = other DNA
cgcctgcgcggaggcggttg

SEQ ID NO: 102333 - DNA, 20 bp, synthetic construct
  misc_feature 1..20: note = CRISPR gRNA sequence
  source 1..20: mol_type = other DNA
gcctgcgcggaggcggttgg

SEQ ID NO: 102334 - DNA, 20 bp, synthetic construct
  misc_feature 1..20: note = CRISPR gRNA sequence
  source 1..20: mol_type = other DNA
cctgcgcggaggcggttgga

SEQ ID NO: 102335 - DNA, 20 bp, synthetic construct
  misc_feature 1..20: note = CRISPR gRNA sequence
  source 1..20: mol_type = other DNA
tgcgcggaggcggttggagg

SEQ ID NO: 102336 - DNA, 20 bp, synthetic construct
  misc_feature 1..20: note = CRISPR gRNA sequence
  source 1..20: mol_type = other DNA
gcgcggaggcggttggaggg

SEQ ID NO: 102337 - DNA, 20 bp, synthetic construct
  misc_feature 1..20: note = CRISPR gRNA sequence
  source 1..20: mol_type = other DNA
aggcccgattcccctttgtt

SEQ ID NO: 102338 - DNA, 20 bp, synthetic construct
  misc_feature 1..20: note = CRISPR gRNA sequence
  source 1..20: mol_type = other DNA
ggcccgattcccctttgttc

SEQ ID NO: 102339 - DNA, 20 bp, synthetic construct
  misc_feature 1..20: note = CRISPR gRNA sequence
  source 1..20: mol_type = other DNA
gttcgggttcgccattttgc

SEQ ID NO: 102340 - DNA, 20 bp, synthetic construct
  misc_feature 1..20: note = CRISPR gRNA sequence
  source 1..20: mol_type = other DNA
ttcgggttcgccattttgct

SEQ ID NO: 102341 - DNA, 20 bp, synthetic construct
  misc_feature 1..20: note = CRISPR gRNA sequence
  source 1..20: mol_type = other DNA
gggttcgccattttgctagg

SEQ ID NO: 102342 - DNA, 20 bp, synthetic construct
  misc_feature 1..20: note = CRISPR gRNA sequence
  source 1..20: mol_type = other DNA
ttcgccattttgctaggcag

SEQ ID NO: 102343 - DNA, 20 bp, synthetic construct
  misc_feature 1..20: note = CRISPR gRNA sequence
  source 1..20: mol_type = other DNA
gccattttgctaggcagcgg

SEQ ID NO: 102344 - DNA, 20 bp, synthetic construct
  misc_feature 1..20: note = CRISPR gRNA sequence
  source 1..20: mol_type = other DNA
attttgctaggcagcggcag

SEQ ID NO: 102345 - DNA, 20 bp, synthetic construct
  misc_feature 1..20: note = CRISPR gRNA sequence
  source 1..20: mol_type = other DNA
ttgctaggcagcggcagtgg

SEQ ID NO: 102346 - DNA, 20 bp, synthetic construct
  misc_feature 1..20: note = CRISPR gRNA sequence
  source 1..20: mol_type = other DNA
ctaggcagcggcagtggcgg

SEQ ID NO: 102347 - DNA, 20 bp, synthetic construct
  misc_feature 1..20: note = CRISPR gRNA sequence
  source 1..20: mol_type = other DNA
ggcagcggcagtggcggcgg

SEQ ID NO: 102348 - DNA, 20 bp, synthetic construct
  misc_feature 1..20: note = CRISPR gRNA sequence
  source 1..20: mol_type = other DNA
agcggcagtggcggcggcag

SEQ ID NO: 102349 - DNA, 20 bp, synthetic construct
  misc_feature 1..20: note = CRISPR gRNA sequence
  source 1..20: mol_type = other DNA
ggcagtggcggcggcagcgg

SEQ ID NO: 102350 - DNA, 20 bp, synthetic construct
  misc_feature 1..20: note = CRISPR gRNA sequence
  source 1..20: mol_type = other DNA
gtggcggcggcagcggcggc

SEQ ID NO: 102351 - DNA, 20 bp, synthetic construct
  misc_feature 1..20: note = CRISPR gRNA sequence
  source 1..20: mol_type = other DNA
ggcggcggcagcggcggctg

SEQ ID NO: 102352 - DNA, 20 bp, synthetic construct
  misc_feature 1..20: note = CRISPR gRNA sequence
  source 1..20: mol_type = other DNA
cggcggctggagcctctgat

SEQ ID NO: 102353 - DNA, 20 bp, synthetic construct
  misc_feature 1..20: note = CRISPR gRNA sequence
  source 1..20: mol_type = other DNA
ggcggctggagcctctgatt

SEQ ID NO: 102354 - DNA, 20 bp, synthetic construct
  misc_feature 1..20: note = CRISPR gRNA sequence
  source 1..20: mol_type = other DNA
tggagcctctgattgggttt

SEQ ID NO: 102355 - DNA, 20 bp, synthetic construct
  misc_feature 1..20: note = CRISPR gRNA sequence
  source 1..20: mol_type = other DNA
gagcctctgattgggtttcg

SEQ ID NO: 102356 - DNA, 20 bp, synthetic construct
  misc_feature 1..20: note = CRISPR gRNA sequence
  source 1..20: mol_type = other DNA
tctgattgggtttcggagtc

SEQ ID NO: 102357 - DNA, 20 bp, synthetic construct
  misc_feature 1..20: note = CRISPR gRNA sequence
  source 1..20: mol_type = other DNA
tgggtttcggagtccggtac

SEQ ID NO: 102358 - DNA, 20 bp, synthetic construct
  misc_feature 1..20: note = CRISPR gRNA sequence
  source 1..20: mol_type = other DNA
ggtttcggagtccggtactg

SEQ ID NO: 102359 - DNA, 20 bp, synthetic construct
  misc_feature 1..20: note = CRISPR gRNA sequence
  source 1..20: mol_type = other DNA
agtccggtactggagccaat

SEQ ID NO: 102360 - DNA, 20 bp, synthetic construct
  misc_feature 1..20: note = CRISPR gRNA sequence
  source 1..20: mol_type = other DNA
ggtactggagccaatcagcg

SEQ ID NO: 102361 - DNA, 20 bp, synthetic construct
  misc_feature 1..20: note = CRISPR gRNA sequence
  source 1..20: mol_type = other DNA
gtactggagccaatcagcgc

SEQ ID NO: 102362 - DNA, 20 bp, synthetic construct
  misc_feature 1..20: note = CRISPR gRNA sequence
  source 1..20: mol_type = other DNA
ctggagccaatcagcgcggg

SEQ ID NO: 102363 - DNA, 20 bp, synthetic construct
  misc_feature 1..20: note = CRISPR gRNA sequence
  source 1..20: mol_type = other DNA
aatcagcgcgggcagcgaac

SEQ ID NO: 102364 - DNA, 20 bp, synthetic construct
  misc_feature 1..20: note = CRISPR gRNA sequence
  source 1..20: mol_type = other DNA
atcagcgcgggcagcgaacc

SEQ ID NO: 102365 - DNA, 20 bp, synthetic construct
  misc_feature 1..20: note = CRISPR gRNA sequence
  source 1..20: mol_type = other DNA
tcagcgcgggcagcgaaccg

SEQ ID NO: 102366 - DNA, 20 bp, synthetic construct
  misc_feature 1..20: note = CRISPR gRNA sequence
  source 1..20: mol_type = other DNA
cagcgcgggcagcgaaccgg

SEQ ID NO: 102367 - DNA, 20 bp, synthetic construct
  misc_feature 1..20: note = CRISPR gRNA sequence
  source 1..20: mol_type = other DNA
gcgcgggcagcgaaccgggg

SEQ ID NO: 102368 - DNA, 20 bp, synthetic construct
  misc_feature 1..20: note = CRISPR gRNA sequence
  source 1..20: mol_type = other DNA
gggcagcgaaccgggggagc

SEQ ID NO: 102369 - DNA, 20 bp, synthetic construct
  misc_feature 1..20: note = CRISPR gRNA sequence
  source 1..20: mol_type = other DNA
ggcagcgaaccgggggagcg

SEQ ID NO: 102370 - DNA, 20 bp, synthetic construct
  misc_feature 1..20: note = CRISPR gRNA sequence
  source 1..20: mol_type = other DNA
cgaaccgggggagcgaggca

SEQ ID NO: 102371 - DNA, 20 bp, synthetic construct
  misc_feature 1..20: note = CRISPR gRNA sequence
  source 1..20: mol_type = other DNA
ccgggggagcgaggcacggt

SEQ ID NO: 102372 - DNA, 20 bp, synthetic construct
  misc_feature 1..20: note = CRISPR gRNA sequence
  source 1..20: mol_type = other DNA
gagcgaggcacggtgagtgt

SEQ ID NO: 102373 - DNA, 20 bp, synthetic construct
  misc_feature 1..20: note = CRISPR gRNA sequence
  source 1..20: mol_type = other DNA
agcgaggcacggtgagtgtg

SEQ ID NO: 102374 - DNA, 20 bp, synthetic construct
  misc_feature 1..20: note = CRISPR gRNA sequence
  source 1..20: mol_type = other DNA
cgaggcacggtgagtgtgag

SEQ ID NO: 102375 - DNA, 20 bp, synthetic construct
  misc_feature 1..20: note = CRISPR gRNA sequence
  source 1..20: mol_type = other DNA
gagtgtgaggagccaatatc

SEQ ID NO: 102376 - DNA, 20 bp, synthetic construct
  misc_feature 1..20: note = CRISPR gRNA sequence
  source 1..20: mol_type = other DNA
tgtgaggagccaatatccag

SEQ ID NO: 102377 - DNA, 20 bp, synthetic construct
  misc_feature 1..20: note = CRISPR gRNA sequence
  source 1..20: mol_type = other DNA
ggagccaatatccagcggcc

SEQ ID NO: 102378 - DNA, 20 bp, synthetic construct
  misc_feature 1..20: note = CRISPR gRNA sequence
  source 1..20: mol_type = other DNA
agccaatatccagcggccca

SEQ ID NO: 102379 - DNA, 20 bp, synthetic construct
  misc_feature 1..20: note = CRISPR gRNA sequence
  source 1..20: mol_type = other DNA
aatatccagcggcccagagc

SEQ ID NO: 102380 - DNA, 20 bp, synthetic construct
  misc_feature 1..20: note = CRISPR gRNA sequence
  source 1..20: mol_type = other DNA
cagcggcccagagccggccc

SEQ ID NO: 102381 - DNA, 20 bp, synthetic construct
  misc_feature 1..20: note = CRISPR gRNA sequence
  source 1..20: mol_type = other DNA
gccggccccagcgccccgat

SEQ ID NO: 102382 - DNA, 20 bp, synthetic construct
  misc_feature 1..20: note = CRISPR gRNA sequence
  source 1..20: mol_type = other DNA
ggccccagcgccccgattgg

SEQ ID NO: 102383 - DNA, 20 bp, synthetic construct
  misc_feature 1..20: note = CRISPR gRNA sequence
  source 1..20: mol_type = other DNA
gccccagcgccccgattggc

SEQ ID NO: 102384 - DNA, 20 bp, synthetic construct
  misc_feature 1..20: note = CRISPR gRNA sequence
  source 1..20: mol_type = other DNA
ggcgggtctcgctgaccact

SEQ ID NO: 102385 - DNA, 20 bp, synthetic construct
  misc_feature 1..20: note = CRISPR gRNA sequence
  source 1..20: mol_type = other DNA
gcgggtctcgctgaccactc

SEQ ID NO: 102386 - DNA, 20 bp, synthetic construct
  misc_feature 1..20: note = CRISPR gRNA sequence
  source 1..20: mol_type = other DNA
gggtctcgctgaccactcag

SEQ ID NO: 102387 - DNA, 20 bp, synthetic construct
  misc_feature 1..20: note = CRISPR gRNA sequence
  source 1..20: mol_type = other DNA
gtctcgctgaccactcagga

SEQ ID NO: 102388 - DNA, 20 bp, synthetic construct
  misc_feature 1..20: note = CRISPR gRNA sequence
  source 1..20: mol_type = other DNA
tctcgctgaccactcaggag

SEQ ID NO: 102389 - DNA, 20 bp, synthetic construct
  misc_feature 1..20: note = CRISPR gRNA sequence
  source 1..20: mol_type = other DNA
ctgaccactcaggagaggcc

SEQ ID NO: 102390 - DNA, 20 bp, synthetic construct
  misc_feature 1..20: note = CRISPR gRNA sequence
  source 1..20: mol_type = other DNA
tgaccactcaggagaggccc

SEQ ID NO: 102391 - DNA, 20 bp, synthetic construct
  misc_feature 1..20: note = CRISPR gRNA sequence
  source 1..20: mol_type = other DNA
gagaggcccaggcgcccgtc

SEQ ID NO: 102392 - DNA, 20 bp, synthetic construct
  misc_feature 1..20: note = CRISPR gRNA sequence
  source 1..20: mol_type = other DNA
gcccaggcgcccgtcgagcc

SEQ ID NO: 102393 - DNA, 20 bp, synthetic construct
  misc_feature 1..20: note = CRISPR gRNA sequence
  source 1..20: mol_type = other DNA
cccaggcgcccgtcgagccc

SEQ ID NO: 102394 - DNA, 20 bp, synthetic construct
  misc_feature 1..20: note = CRISPR gRNA sequence
  source 1..20: mol_type = other DNA
ccaggcgcccgtcgagcccg

SEQ ID NO: 102395 - DNA, 20 bp, synthetic construct
  misc_feature 1..20: note = CRISPR gRNA sequence
  source 1..20: mol_type = other DNA
aggcgcccgtcgagcccggg

SEQ ID NO: 102396 - DNA, 20 bp, synthetic construct
  misc_feature 1..20: note = CRISPR gRNA sequence
  source 1..20: mol_type = other DNA
cccgtcgagcccggggagtc

SEQ ID NO: 102397 - DNA, 20 bp, synthetic construct
  misc_feature 1..20: note = CRISPR gRNA sequence
  source 1..20: mol_type = other DNA
cgagcccggggagtcgagct

SEQ ID NO: 102398 - DNA, 20 bp, synthetic construct
  misc_feature 1..20: note = CRISPR gRNA sequence
  source 1..20: mol_type = other DNA
ccggggagtcgagctgagcc

SEQ ID NO: 102399 - DNA, 20 bp, synthetic construct
  misc_feature 1..20: note = CRISPR gRNA sequence
  source 1..20: mol_type = other DNA
gagtcgagctgagcctagcc

SEQ ID NO: 102400 - DNA, 20 bp, synthetic construct
  misc_feature 1..20: note = CRISPR gRNA sequence
  source 1..20: mol_type = other DNA
cgagctgagcctagccgagc

SEQ ID NO: 102401 - DNA, 20 bp, synthetic construct
  misc_feature 1..20: note = CRISPR gRNA sequence
  source 1..20: mol_type = other DNA
gagctgagcctagccgagcc

SEQ ID NO: 102402 - DNA, 20 bp, synthetic construct
  misc_feature 1..20: note = CRISPR gRNA sequence
  source 1..20: mol_type = other DNA
ctgagcctagccgagccggg

SEQ ID NO: 102403 - DNA, 20 bp, synthetic construct
  misc_feature 1..20: note = CRISPR gRNA sequence
  source 1..20: mol_type = other DNA
gcctagccgagccgggcggc

SEQ ID NO: 102404 - DNA, 20 bp, synthetic construct
  misc_feature 1..20: note = CRISPR gRNA sequence
  source 1..20: mol_type = other DNA
tagccgagccgggcggccag

SEQ ID NO: 102405 - DNA, 20 bp, synthetic construct
  misc_feature 1..20: note = CRISPR gRNA sequence
  source 1..20: mol_type = other DNA
agccgggcggccagcggccc

SEQ ID NO: 102406 - DNA, 20 bp, synthetic construct
  misc_feature 1..20: note = CRISPR gRNA sequence
  source 1..20: mol_type = other DNA
ggcggccagcggccccggcc

SEQ ID NO: 102407 - DNA, 20 bp, synthetic construct
  misc_feature 1..20: note = CRISPR gRNA sequence
  source 1..20: mol_type = other DNA
gcggccagcggccccggccc

SEQ ID NO: 102408 - DNA, 20 bp, synthetic construct
  misc_feature 1..20: note = CRISPR gRNA sequence
  source 1..20: mol_type = other DNA
cggccagcggccccggcccg

SEQ ID NO: 102409 - DNA, 20 bp, synthetic construct
  misc_feature 1..20: note = CRISPR gRNA sequence
  source 1..20: mol_type = other DNA
ggccccggcccggggcctgc

SEQ ID NO: 102410 - DNA, 20 bp, synthetic construct
  misc_feature 1..20: note = CRISPR gRNA sequence
  source 1..20: mol_type = other DNA
cccggggcctgcgagcgcct

SEQ ID NO: 102411 - DNA, 20 bp, synthetic construct
  misc_feature 1..20: note = CRISPR gRNA sequence
  source 1..20: mol_type = other DNA
ccggggcctgcgagcgcctc

SEQ ID NO: 102412 - DNA, 20 bp, synthetic construct
  misc_feature 1..20: note = CRISPR gRNA sequence
  source 1..20: mol_type = other DNA
cggggcctgcgagcgcctcg

SEQ ID NO: 102413 - DNA, 20 bp, synthetic construct
  misc_feature 1..20: note = CRISPR gRNA sequence
  source 1..20: mol_type = other DNA
cgagcgcctcggggcactcc

SEQ ID NO: 102414 - DNA, 20 bp, synthetic construct
  misc_feature 1..20: note = CRISPR gRNA sequence
  source 1..20: mol_type = other DNA
gcctcggggcactcccggcc

SEQ ID NO: 102415 - DNA, 20 bp, synthetic construct
  misc_feature 1..20: note = CRISPR gRNA sequence
  source 1..20: mol_type = other DNA
cctcggggcactcccggccg

SEQ ID NO: 102416 - DNA, 20 bp, synthetic construct
  misc_feature 1..20: note = CRISPR gRNA sequence
  source 1..20: mol_type = other DNA
gcactcccggccgaggcctg

SEQ ID NO: 102417 - DNA, 20 bp, synthetic construct
  misc_feature 1..20: note = CRISPR gRNA sequence
  source 1..20: mol_type = other DNA
cactcccggccgaggcctgc

SEQ ID NO: 102418 - DNA, 20 bp, synthetic construct
  misc_feature 1..20: note = CRISPR gRNA sequence
  source 1..20: mol_type = other DNA
actcccggccgaggcctgca

SEQ ID NO: 102419 - DNA, 20 bp, synthetic construct
  misc_feature 1..20: note = CRISPR gRNA sequence
  source 1..20: mol_type = other DNA
ctcccggccgaggcctgcag

SEQ ID NO: 102420 - DNA, 20 bp, synthetic construct
  misc_feature 1..20: note = CRISPR gRNA sequence
  source 1..20: mol_type = other DNA
cctgcaggggccgccccgcg

SEQ ID NO: 102421 - DNA, 20 bp, synthetic construct
  misc_feature 1..20: note = CRISPR gRNA sequence
  source 1..20: mol_type = other DNA
ctgcaggggccgccccgcgc

SEQ ID NO: 102422 - DNA, 20 bp, synthetic construct
  misc_feature 1..20: note = CRISPR gRNA sequence
  source 1..20: mol_type = other DNA
tgcaggggccgccccgcgcg

SEQ ID NO: 102423 - DNA, 20 bp, synthetic construct
  misc_feature 1..20: note = CRISPR gRNA sequence
  source 1..20: mol_type = other DNA
ggggccgccccgcgcgggga

SEQ ID NO: 102424 - DNA, 20 bp, synthetic construct
  misc_feature 1..20: note = CRISPR gRNA sequence
  source 1..20: mol_type = other DNA
cccgcgcggggatggcgcct

SEQ ID NO: 102425 - DNA, 20 bp, synthetic construct
  misc_feature 1..20: note = CRISPR gRNA sequence
  source 1..20: mol_type = other DNA
ccgcgcggggatggcgcctc

SEQ ID NO: 102426 - DNA, 20 bp, synthetic construct
  misc_feature 1..20: note = CRISPR gRNA sequence
  source 1..20: mol_type = other DNA
cgcgcggggatggcgcctcg

SEQ ID NO: 102427 - DNA, 20 bp, synthetic construct
  misc_feature 1..20: note = CRISPR gRNA sequence
  source 1..20: mol_type = other DNA
cgcggggatggcgcctcggg

SEQ ID NO: 102428 - DNA, 20 bp, synthetic construct
  misc_feature 1..20: note = CRISPR gRNA sequence
  source 1..20: mol_type = other DNA
ggggatggcgcctcggggag

SEQ ID NO: 102429 - DNA, 20 bp, synthetic construct
  misc_feature 1..20: note = CRISPR gRNA sequence
  source 1..20: mol_type = other DNA
gggatggcgcctcggggagc

SEQ ID NO: 102430 - DNA, 20 bp, synthetic construct
  misc_feature 1..20: note = CRISPR gRNA sequence
  source 1..20: mol_type = other DNA
gcctcggggagcaggcacct

SEQ ID NO: 102431 - DNA, 20 bp, synthetic construct
  misc_feature 1..20: note = CRISPR gRNA sequence
  source 1..20: mol_type = other DNA
cctcggggagcaggcacctc

SEQ ID NO: 102432 - DNA, 20 bp, synthetic construct
  misc_feature 1..20: note = CRISPR gRNA sequence
  source 1..20: mol_type = other DNA
ctcggggagcaggcacctcg

SEQ ID NO: 102433 - DNA, 20 bp, synthetic construct
  misc_feature 1..20: note = CRISPR gRNA sequence
  source 1..20: mol_type = other DNA
cctcggggctccgaccctcg

SEQ ID NO: 102434 - DNA, 20 bp, synthetic construct
  misc_feature 1..20: note = CRISPR gRNA sequence
  source 1..20: mol_type = other DNA
ctcggggctccgaccctcgc

SEQ ID NO: 102435 - DNA, 20 bp, synthetic construct
  misc_feature 1..20: note = CRISPR gRNA sequence
  source 1..20: mol_type = other DNA
tcggggctccgaccctcgca

SEQ ID NO: 102436 - DNA, 20 bp, synthetic construct
  misc_feature 1..20: note = CRISPR gRNA sequence
  source 1..20: mol_type = other DNA
ctccgaccctcgcagggtgc

SEQ ID NO: 102437 - DNA, 20 bp, synthetic construct
  misc_feature 1..20: note = CRISPR gRNA sequence
  source 1..20: mol_type = other DNA
tccgaccctcgcagggtgcc

SEQ ID NO: 102438 - DNA, 20 bp, synthetic construct
  misc_feature 1..20: note = CRISPR gRNA sequence
  source 1..20: mol_type = other DNA
ccgaccctcgcagggtgcca

SEQ ID NO: 102439 - DNA, 20 bp, synthetic construct
  misc_feature 1..20: note = CRISPR gRNA sequence
  source 1..20: mol_type = other DNA
ccctcgcagggtgccagggc

SEQ ID NO: 102440 - DNA, 20 bp, synthetic construct
  misc_feature 1..20: note = CRISPR gRNA sequence
  source 1..20: mol_type = other DNA
cgcagggtgccagggccagt

SEQ ID NO: 102441 - DNA, 20 bp, synthetic construct
  misc_feature 1..20: note = CRISPR gRNA sequence
  source 1..20: mol_type = other DNA
gcagggtgccagggccagtt

SEQ ID NO: 102442 - DNA, 20 bp, synthetic construct
  misc_feature 1..20: note = CRISPR gRNA sequence
  source 1..20: mol_type = other DNA
tgcgtccctgttccccgact

SEQ ID NO: 102443 - DNA, 20 bp, synthetic construct
  misc_feature 1..20: note = CRISPR gRNA sequence
  source 1..20: mol_type = other DNA
gcgtccctgttccccgactc

SEQ ID NO: 102444 - DNA, 20 bp, synthetic construct
  misc_feature 1..20: note = CRISPR gRNA sequence
  source 1..20: mol_type = other DNA
cctgttccccgactcaggcc

SEQ ID NO: 102445 - DNA, 20 bp, synthetic construct
  misc_feature 1..20: note = CRISPR gRNA sequence
  source 1..20: mol_type = other DNA
ctgttccccgactcaggccc

SEQ ID NO: 102446 - DNA, 20 bp, synthetic construct
  misc_feature 1..20: note = CRISPR gRNA sequence
  source 1..20: mol_type = other DNA
ccgactcaggcccaggttct

SEQ ID NO: 102447 - DNA, 20 bp, synthetic construct
  misc_feature 1..20: note = CRISPR gRNA sequence
  source 1..20: mol_type = other DNA
cgactcaggcccaggttctc

SEQ ID NO: 102448 - DNA, 20 bp, synthetic construct
  misc_feature 1..20: note = CRISPR gRNA sequence
  source 1..20: mol_type = other DNA
aggcccaggttctcaggccc

SEQ ID NO: 102449 - DNA, 20 bp, synthetic construct
  misc_feature 1..20: note = CRISPR gRNA sequence
  source 1..20: mol_type = other DNA
ggcccaggttctcaggcccc

SEQ ID NO: 102450 - DNA, 20 bp, synthetic construct
  misc_feature 1..20: note = CRISPR gRNA sequence
  source 1..20: mol_type = other DNA
aggttctcaggccccaggcc

SEQ ID NO: 102451 - DNA, 20 bp, synthetic construct
  misc_feature 1..20: note = CRISPR gRNA sequence
  source 1..20: mol_type = other DNA
ggttctcaggccccaggcct

SEQ ID NO: 102452 - DNA, 20 bp, synthetic construct
  misc_feature 1..20: note = CRISPR gRNA sequence
  source 1..20: mol_type = other DNA
gttctcaggccccaggcctg

SEQ ID NO: 102453 - DNA, 20 bp, synthetic construct
  misc_feature 1..20: note = CRISPR gRNA sequence
  source 1..20: mol_type = other DNA
cccaggcctggggccacgaa

SEQ ID NO: 102454 - DNA, 20 bp, synthetic construct
  misc_feature 1..20: note = CRISPR gRNA sequence
  source 1..20: mol_type = other DNA
ggccacgaatggccctacac

SEQ ID NO: 102455 - DNA, 20 bp, synthetic construct
  misc_feature 1..20: note = CRISPR gRNA sequence
  source 1..20: mol_type = other DNA
gccacgaatggccctacact

SEQ ID NO: 102456 - DNA, 20 bp, synthetic construct
  misc_feature 1..20: note = CRISPR gRNA sequence
  source 1..20: mol_type = other DNA
ccacgaatggccctacacta

SEQ ID NO: 102457 - DNA, 20 bp, synthetic construct
  misc_feature 1..20: note = CRISPR gRNA sequence
  source 1..20: mol_type = other DNA
cacgaatggccctacactag

SEQ ID NO: 102458 - DNA, 20 bp, synthetic construct
  misc_feature 1..20: note = CRISPR gRNA sequence
  source 1..20: mol_type = other DNA
taggggacacatgcgcgccc

SEQ ID NO: 102459 - DNA, 20 bp, synthetic construct
  misc_feature 1..20: note = CRISPR gRNA sequence
  source 1..20: mol_type = other DNA
aggggacacatgcgcgccct

SEQ ID NO: 102460 - DNA, 20 bp, synthetic construct
  misc_feature 1..20: note = CRISPR gRNA sequence
  source 1..20: mol_type = other DNA
cacatgcgcgccctgggcct

SEQ ID NO: 102461 - DNA, 20 bp, synthetic construct
  misc_feature 1..20: note = CRISPR gRNA sequence
  source 1..20: mol_type = other DNA
gggcctcggcgatttcctcc

SEQ ID NO: 102462 - DNA, 20 bp, synthetic construct
  misc_feature 1..20: note = CRISPR gRNA sequence
  source 1..20: mol_type = other DNA
cgatttcctcctggtcgttc

SEQ ID NO: 102463 - DNA, 20 bp, synthetic construct
  misc_feature 1..20: note = CRISPR gRNA sequence
  source 1..20: mol_type = other DNA
cccttgcactctccactctc

SEQ ID NO: 102464 - DNA, 20 bp, synthetic construct
  misc_feature 1..20: note = CRISPR gRNA sequence
  source 1..20: mol_type = other DNA
actctccactctccggccct

SEQ ID NO: 102465 - DNA, 20 bp, synthetic construct
  misc_feature 1..20: note = CRISPR gRNA sequence
  source 1..20: mol_type = other DNA
ctctccactctccggccctt

SEQ ID NO: 102466 - DNA, 20 bp, synthetic construct
  misc_feature 1..20: note = CRISPR gRNA sequence
  source 1..20: mol_type = other DNA
ccactctccggcccttggga

SEQ ID NO: 102467 - DNA, 20 bp, synthetic construct
  misc_feature 1..20: note = CRISPR gRNA sequence
  source 1..20: mol_type = other DNA
cactctccggcccttgggac

SEQ ID NO: 102468 - DNA, 20 bp, synthetic construct
  misc_feature 1..20: note = CRISPR gRNA sequence
  source 1..20: mol_type = other DNA
tctccggcccttgggacagg

SEQ ID NO: 102469 - DNA, 20 bp, synthetic construct
  misc_feature 1..20: note = CRISPR gRNA sequence
  source 1..20: mol_type = other DNA
cttgggacaggaagcctccc

SEQ ID NO: 102470 - DNA, 20 bp, synthetic construct
  misc_feature 1..20: note = CRISPR gRNA sequence
  source 1..20: mol_type = other DNA
ttgggacaggaagcctcccc

SEQ ID NO: 102471 - DNA, 20 bp, synthetic construct
  misc_feature 1..20: note = CRISPR gRNA sequence
  source 1..20: mol_type = other DNA
tgggacaggaagcctccccg

SEQ ID NO: 102472 - DNA, 20 bp, synthetic construct
  misc_feature 1..20: note = CRISPR gRNA sequence
  source 1..20: mol_type = other DNA
cgccccccgctccccgctcc

SEQ ID NO: 102473 - DNA, 20 bp, synthetic construct
  misc_feature 1..20: note = CRISPR gRNA sequence
  source 1..20: mol_type = other DNA
ccccgctccccgctcccagc

SEQ ID NO: 102474 - DNA, 20 bp, synthetic construct
  misc_feature 1..20: note = CRISPR gRNA sequence
  source 1..20: mol_type = other DNA
gctccccgctcccagcgagc

SEQ ID NO: 102475 - DNA, 20 bp, synthetic construct
  misc_feature 1..20: note = CRISPR gRNA sequence
  source 1..20: mol_type = other DNA
ctccccgctcccagcgagcc

SEQ ID NO: 102476 - DNA, 20 bp, synthetic construct
  misc_feature 1..20: note = CRISPR gRNA sequence
  source 1..20: mol_type = other DNA
agccgggtctgtcttatctg

SEQ ID NO: 102477 - DNA, 20 bp, synthetic construct
  misc_feature 1..20: note = CRISPR gRNA sequence
  source 1..20: mol_type = other DNA
tgtcttatctgcagcccctc

SEQ ID NO: 102478 - DNA, 20 bp, synthetic construct
  misc_feature 1..20: note = CRISPR gRNA sequence
  source 1..20: mol_type = other DNA
gtcttatctgcagcccctct

SEQ ID NO: 102479 - DNA, 20 bp, synthetic construct
  misc_feature 1..20: note = CRISPR gRNA sequence
  source 1..20: mol_type = other DNA
tatctgcagcccctctaggt

SEQ ID NO: 102480 - DNA, 20 bp, synthetic construct
  misc_feature 1..20: note = CRISPR gRNA sequence
  source 1..20: mol_type = other DNA
atctgcagcccctctaggtc

SEQ ID NO: 102481 - DNA, 20 bp, synthetic construct
  misc_feature 1..20: note = CRISPR gRNA sequence
  source 1..20: mol_type = other DNA
ctgcagcccctctaggtcgg

SEQ ID NO: 102482 - DNA, 20 bp, synthetic construct
  misc_feature 1..20: note = CRISPR gRNA sequence
  source 1..20: mol_type = other DNA
tgcagcccctctaggtcggg

SEQ ID NO: 102483 - DNA, 20 bp, synthetic construct
  misc_feature 1..20: note = CRISPR gRNA sequence
  source 1..20: mol_type = other DNA
gcagcccctctaggtcggga

SEQ ID NO: 102484 - DNA, 20 bp, synthetic construct
  misc_feature 1..20: note = CRISPR gRNA sequence
  source 1..20: mol_type = other DNA
agcccctctaggtcgggagg

SEQ ID NO: 102485 - DNA, 20 bp, synthetic construct
  misc_feature 1..20: note = CRISPR gRNA sequence
  source 1..20: mol_type = other DNA
gcccctctaggtcgggaggg

SEQ ID NO: 102486 - DNA, 20 bp, synthetic construct
  misc_feature 1..20: note = CRISPR gRNA sequence
  source 1..20: mol_type = other DNA
tctaggtcgggagggaggcc

SEQ ID NO: 102487 - DNA, 20 bp, synthetic construct
  misc_feature 1..20: note = CRISPR gRNA sequence
  source 1..20: mol_type = other DNA
ctaggtcgggagggaggcct

SEQ ID NO: 102488 - DNA, 20 bp, synthetic construct
  misc_feature 1..20: note = CRISPR gRNA sequence
  source 1..20: mol_type = other DNA
taggtcgggagggaggcctg

SEQ ID NO: 102489 - DNA, 20 bp, synthetic construct
  misc_feature 1..20: note = CRISPR gRNA sequence
  source 1..20: mol_type = other DNA
ggtcgggagggaggcctggg

SEQ ID NO: 102490 - DNA, 20 bp, synthetic construct
  misc_feature 1..20: note = CRISPR gRNA sequence
  source 1..20: mol_type = other DNA
gtcgggagggaggcctgggg

SEQ ID NO: 102491 - DNA, 20 bp, synthetic construct
  misc_feature 1..20: note = CRISPR gRNA sequence
  source 1..20: mol_type = other DNA
tcgggagggaggcctgggga

SEQ ID NO: 102492 - DNA, 20 bp, synthetic construct
  misc_feature 1..20: note = CRISPR gRNA sequence
  source 1..20: mol_type = other DNA
cctggggagggtgcgcgccg

SEQ ID NO: 102493 - DNA, 20 bp, synthetic construct
  misc_feature 1..20: note = CRISPR gRNA sequence
  source 1..20: mol_type = other DNA
gagggtgcgcgccgcggccg

SEQ ID NO: 102494 - DNA, 20 bp, synthetic construct
  misc_feature 1..20: note = CRISPR gRNA sequence
  source 1..20: mol_type = other DNA
agggtgcgcgccgcggccgc

SEQ ID NO: 102495 - DNA, 20 bp, synthetic construct
  misc_feature 1..20: note = CRISPR gRNA sequence
  source 1..20: mol_type = other DNA
gggtgcgcgccgcggccgcg

SEQ ID NO: 102496 - DNA, 20 bp, synthetic construct
  misc_feature 1..20: note = CRISPR gRNA sequence
  source 1..20: mol_type = other DNA
cggccgcggggtcccgtgtg

SEQ ID NO: 102497 - DNA, 20 bp, synthetic construct
  misc_feature 1..20: note = CRISPR gRNA sequence
  source 1..20: mol_type = other DNA
cgcggggtcccgtgtgcggc

SEQ ID NO: 102498 - DNA, 20 bp, synthetic construct
  misc_feature 1..20: note = CRISPR gRNA sequence
  source 1..20: mol_type = other DNA
gtcccgtgtgcggctggcaa

SEQ ID NO: 102499 - DNA, 20 bp, synthetic construct
  misc_feature 1..20: note = CRISPR gRNA sequence
  source 1..20: mol_type = other DNA
tcccgtgtgcggctggcaac

SEQ ID NO: 102500 - DNA, 20 bp, synthetic construct
  misc_feature 1..20: note = CRISPR gRNA sequence
  source 1..20: mol_type = other DNA
cccgtgtgcggctggcaacg

SEQ ID NO: 102501 - DNA, 20 bp, synthetic construct
  misc_feature 1..20: note = CRISPR gRNA sequence
  source 1..20: mol_type = other DNA
tgtgcggctggcaacggggc

SEQ ID NO: 102502 - DNA, 20 bp, synthetic construct
  misc_feature 1..20: note = CRISPR gRNA sequence
  source 1..20: mol_type = other DNA
gggctggcccgcccacgcct

SEQ ID NO: 102503 - DNA, 20 bp, synthetic construct
  misc_feature 1..20: note = CRISPR gRNA sequence
  source 1..20: mol_type = other DNA
gctggcccgcccacgcctcg

SEQ ID NO: 102504 - DNA, 20 bp, synthetic construct
  misc_feature 1..20: note = CRISPR gRNA sequence
  source 1..20: mol_type = other DNA
gcccacgcctcggagcccta

SEQ ID NO: 102505 - DNA, 20 bp, synthetic construct
  misc_feature 1..20: note = CRISPR gRNA sequence
  source 1..20: mol_type = other DNA
cccacgcctcggagccctat

SEQ ID NO: 102506 - DNA, 20 bp, synthetic construct
  misc_feature 1..20: note = CRISPR gRNA sequence
  source 1..20: mol_type = other DNA
gcccgcccccgctgtctccc

SEQ ID NO: 102507 - DNA, 20 bp, synthetic construct
  misc_feature 1..20: note = CRISPR gRNA sequence
  source 1..20: mol_type = other DNA
cgcccccgctgtctccctgg

SEQ ID NO: 102508 - DNA, 20 bp, synthetic construct
  misc_feature 1..20: note = CRISPR gRNA sequence
  source 1..20: mol_type = other DNA
gcccccgctgtctccctggt

SEQ ID NO: 102509 - DNA, 20 bp, synthetic construct
  misc_feature 1..20: note = CRISPR gRNA sequence
  source 1..20: mol_type = other DNA
cccccgctgtctccctggtg

SEQ ID NO: 102510 - DNA, 20 bp, synthetic construct
  misc_feature 1..20: note = CRISPR gRNA sequence
  source 1..20: mol_type = other DNA
cccgctgtctccctggtggg

SEQ ID NO: 102511 - DNA, 20 bp, synthetic construct
  misc_feature 1..20: note = CRISPR gRNA sequence
  source 1..20: mol_type = other DNA
cgctgtctccctggtgggga

SEQ ID NO: 102512 - DNA, 20 bp, synthetic construct
  misc_feature 1..20: note = CRISPR gRNA sequence
  source 1..20: mol_type = other DNA
gctgtctccctggtggggag

SEQ ID NO: 102513 - DNA, 20 bp, synthetic construct
  misc_feature 1..20: note = CRISPR gRNA sequence
  source 1..20: mol_type = other DNA
ctgtctccctggtggggaga

SEQ ID NO: 102514 - DNA, 20 bp, synthetic construct
  misc_feature 1..20: note = CRISPR gRNA sequence
  source 1..20: mol_type = other DNA
tgtctccctggtggggagag

SEQ ID NO: 102515 - DNA, 20 bp, synthetic construct
  misc_feature 1..20: note = CRISPR gRNA sequence
  source 1..20: mol_type = other DNA
gtctccctggtggggagagg

SEQ ID NO: 102516 - DNA, 20 bp, synthetic construct
  misc_feature 1..20: note = CRISPR gRNA sequence
  source 1..20: mol_type = other DNA
tggtggggagagggggccgt

SEQ ID NO: 102517 - DNA, 20 bp, synthetic construct
  misc_feature 1..20: note = CRISPR gRNA sequence
  source 1..20: mol_type = other DNA
ctccgccgcgcccctcctcc

SEQ ID NO: 102518 - DNA, 20 bp, synthetic construct
  misc_feature 1..20: note = CRISPR gRNA sequence
  source 1..20: mol_type = other DNA
tcctcccagcccgctccgcc

SEQ ID NO: 102519 - DNA, 20 bp, synthetic construct
  misc_feature 1..20: note = CRISPR gRNA sequence
  source 1..20: mol_type = other DNA
cctcccagcccgctccgccc

SEQ ID NO: 102520 - DNA, 20 bp, synthetic construct
  misc_feature 1..20: note = CRISPR gRNA sequence
  source 1..20: mol_type = other DNA
gcccgctccgcccgggtctc

SEQ ID NO: 102521 - DNA, 20 bp, synthetic construct
  misc_feature 1..20: note = CRISPR gRNA sequence
  source 1..20: mol_type = other DNA
ctccgcccgggtctccggcc

SEQ ID NO: 102522 - DNA, 20 bp, synthetic construct
  misc_feature 1..20: note = CRISPR gRNA sequence
  source 1..20: mol_type = other DNA
ggcgccgttaccaccccttt

SEQ ID NO: 102523 - DNA, 20 bp, synthetic construct
  misc_feature 1..20: note = CRISPR gRNA sequence
  source 1..20: mol_type = other DNA
tctcttccccgccccgttcg

SEQ ID NO: 102524 - DNA, 20 bp, synthetic construct
  misc_feature 1..20: note = CRISPR gRNA sequence
  source 1..20: mol_type = other DNA
cttccccgccccgttcgcag

SEQ ID NO: 102525 - DNA, 20 bp, synthetic construct
  misc_feature 1..20: note = CRISPR gRNA sequence
  source 1..20: mol_type = other DNA
ccccgccccgttcgcagtgg

SEQ ID NO: 102526 - DNA, 20 bp, synthetic construct
  misc_feature 1..20: note = CRISPR gRNA sequence
  source 1..20: mol_type = other DNA
cccgccccgttcgcagtggc

SEQ ID NO: 102527 - DNA, 20 bp, synthetic construct
  misc_feature 1..20: note = CRISPR gRNA sequence
  source 1..20: mol_type = other DNA
aggaccgcacacctccgtct

SEQ ID NO: 102528 - DNA, 20 bp, synthetic construct
  misc_feature 1..20: note = CRISPR gRNA sequence
  source 1..20: mol_type = other DNA
gaccgcacacctccgtcttg

SEQ ID NO: 102529 - DNA, 20 bp, synthetic construct
  misc_feature 1..20: note = CRISPR gRNA sequence
  source 1..20: mol_type = other DNA
ctccgtcttggagcccaacc

SEQ ID NO: 102530 - DNA, 20 bp, synthetic construct
  misc_feature 1..20: note = CRISPR gRNA sequence
  source 1..20: mol_type = other DNA
cgtcttggagcccaaccaag

SEQ ID NO: 102531 - DNA, 20 bp, synthetic construct
  misc_feature 1..20: note = CRISPR gRNA sequence
  source 1..20: mol_type = other DNA
agcggtctccgtttcttgtc

SEQ ID NO: 102532 - DNA, 20 bp, synthetic construct
  misc_feature 1..20: note = CRISPR gRNA sequence
  source 1..20: mol_type = other DNA
gcggtctccgtttcttgtcc

SEQ ID NO: 102533 - DNA, 20 bp, synthetic construct
  misc_feature 1..20: note = CRISPR gRNA sequence
  source 1..20: mol_type = other DNA
ccgtttcttgtccgggctgt

SEQ ID NO: 102534 - DNA, 20 bp, synthetic construct
  misc_feature 1..20: note = CRISPR gRNA sequence
  source 1..20: mol_type = other DNA
tcttgtccgggctgtaagac

SEQ ID NO: 102535 - DNA, 20 bp, synthetic construct
  misc_feature 1..20: note = CRISPR gRNA sequence
  source 1..20: mol_type = other DNA
ggctgtaagaccagtccatt

SEQ ID NO: 102536 - DNA, 20 bp, synthetic construct
  misc_feature 1..20: note = CRISPR gRNA sequence
  source 1..20: mol_type = other DNA
agaccagtccattcggtgcc

SEQ ID NO: 102537 - DNA, 20 bp, synthetic construct
  misc_feature 1..20: note = CRISPR gRNA sequence
  source 1..20: mol_type = other DNA
ggtgcctggaacctcactct

SEQ ID NO: 102538 - DNA, 20 bp, synthetic construct
  misc_feature 1..20: note = CRISPR gRNA sequence
  source 1..20: mol_type = other DNA
gcctggaacctcactcttag

SEQ ID NO: 102539 - DNA, 20 bp, synthetic construct
  misc_feature 1..20: note = CRISPR gRNA sequence
  source 1..20: mol_type = other DNA
atacccttgcgcattctttc

SEQ ID NO: 102540 - DNA, 20 bp, synthetic construct
  misc_feature 1..20: note = CRISPR gRNA sequence
  source 1..20: mol_type = other DNA
acccttgcgcattctttccg

SEQ ID NO: 102541 - DNA, 20 bp, synthetic construct
  misc_feature 1..20: note = CRISPR gRNA sequence
  source 1..20: mol_type = other DNA
cccttgcgcattctttccgg

SEQ ID NO: 102542 - DNA, 20 bp, synthetic construct
  misc_feature 1..20: note = CRISPR gRNA sequence
  source 1..20: mol_type = other DNA
tttgtgaaatctccctccct

SEQ ID NO: 102543 - DNA, 20 bp, synthetic construct
  misc_feature 1..20: note = CRISPR gRNA sequence
  source 1..20: mol_type = other DNA
ttgtgaaatctccctccctt

SEQ ID NO: 102544 - DNA, 20 bp, synthetic construct
  misc_feature 1..20: note = CRISPR gRNA sequence
  source 1..20: mol_type = other DNA
atctccctcccttgggaata

SEQ ID NO: 102545 - DNA, 20 bp, synthetic construct
  misc_feature 1..20: note = CRISPR gRNA sequence
  source 1..20: mol_type = other DNA
cctcccttgggaatatagta

SEQ ID NO: 102546 - DNA, 20 bp, synthetic construct
  misc_feature 1..20: note = CRISPR gRNA sequence
  source 1..20: mol_type = other DNA
ttgggaatatagtacagttt

SEQ ID NO: 102547 - DNA, 20 bp, synthetic construct
  misc_feature 1..20: note = CRISPR gRNA sequence
  source 1..20: mol_type = other DNA
tgggaatatagtacagtttt

SEQ ID NO: 102548 - DNA, 20 bp, synthetic construct
  misc_feature 1..20: note = CRISPR gRNA sequence
  source 1..20: mol_type = other DNA
gggaatatagtacagttttg

SEQ ID NO: 102549 - DNA, 20 bp, synthetic construct
  misc_feature 1..20: note = CRISPR gRNA sequence
  source 1..20: mol_type = other DNA
ggaatatagtacagttttgg

SEQ ID NO: 102550 - DNA, 20 bp, synthetic construct
  misc_feature 1..20: note = CRISPR gRNA sequence
  source 1..20: mol_type = other DNA
ctttctatgttactttgtgt

SEQ ID NO: 102551 - DNA, 20 bp, synthetic construct
  misc_feature 1..20: note = CRISPR gRNA sequence
  source 1..20: mol_type = other DNA
tttctatgttactttgtgtc

SEQ ID NO: 102552 - DNA, 20 bp, synthetic construct
  misc_feature 1..20: note = CRISPR gRNA sequence
  source 1..20: mol_type = other DNA
actttgtgtcaggcttgacc

SEQ ID NO: 102553 - DNA, 20 bp, synthetic construct
  misc_feature 1..20: note = CRISPR gRNA sequence
  source 1..20: mol_type = other DNA
gacccagtccactcatctct

SEQ ID NO: 102554 - DNA, 20 bp, synthetic construct
  misc_feature 1..20: note = CRISPR gRNA sequence
  source 1..20: mol_type = other DNA
tgtttttctgatacactttc

SEQ ID NO: 102555 - DNA, 20 bp, synthetic construct
  misc_feature 1..20: note = CRISPR gRNA sequence
  source 1..20: mol_type = other DNA
gtcctgtgttaacgttttct

SEQ ID NO: 102556 - DNA, 20 bp, synthetic construct
  misc_feature 1..20: note = CRISPR gRNA sequence
  source 1..20: mol_type = other DNA
ctgtgttaacgttttctcag

SEQ ID NO: 102557 - DNA, 20 bp, synthetic construct
  misc_feature 1..20: note = CRISPR gRNA sequence
  source 1..20: mol_type = other DNA
acgttttctcagcagatgtt

SEQ ID NO: 102558 - DNA, 20 bp, synthetic construct
  misc_feature 1..20: note = CRISPR gRNA sequence
  source 1..20: mol_type = other DNA
agcagatgtttagaaactaa

SEQ ID NO: 102559 - DNA, 20 bp, synthetic construct
  misc_feature 1..20: note = CRISPR gRNA sequence
  source 1..20: mol_type = other DNA
tttagaaactaacagtgttg

SEQ ID NO: 102560 - DNA, 20 bp, synthetic construct
  misc_feature 1..20: note = CRISPR gRNA sequence
  source 1..20: mol_type = other DNA
ttagaaactaacagtgttgt

SEQ ID NO: 102561 - DNA, 20 bp, synthetic construct
  misc_feature 1..20: note = CRISPR gRNA sequence
  source 1..20: mol_type = other DNA
tagaaactaacagtgttgtg

SEQ ID NO: 102562 - DNA, 20 bp, synthetic construct
  misc_feature 1..20: note = CRISPR gRNA sequence
  source 1..20: mol_type = other DNA
cagtgttgtggggttttcct

SEQ ID NO: 102563 - DNA, 20 bp, synthetic construct
  misc_feature 1..20: note = CRISPR gRNA sequence
  source 1..20: mol_type = other DNA
agtgttgtggggttttcctt

SEQ ID NO: 102564 - DNA, 20 bp, synthetic construct
  misc_feature 1..20: note = CRISPR gRNA sequence
  source 1..20: mol_type = other DNA
gtgttgtggggttttcctta

SEQ ID NO: 102565 - DNA, 20 bp, synthetic construct
  misc_feature 1..20: note = CRISPR gRNA sequence
  source 1..20: mol_type = other DNA
tgtggggttttccttagggt

SEQ ID NO: 102566 - DNA, 20 bp, synthetic construct
  misc_feature 1..20: note = CRISPR gRNA sequence
  source 1..20: mol_type = other DNA
tggggttttccttagggtga

SEQ ID NO: 102567 - DNA, 20 bp, synthetic construct
  misc_feature 1..20: note = CRISPR gRNA sequence
  source 1..20: mol_type = other DNA
ggggttttccttagggtgag

SEQ ID NO: 102568 - DNA, 20 bp, synthetic construct
  misc_feature 1..20: note = CRISPR gRNA sequence
  source 1..20: mol_type = other DNA
ttagggtgagaggttgctgt

SEQ ID NO: 102569 - DNA, 20 bp, synthetic construct
  misc_feature 1..20: note = CRISPR gRNA sequence
  source 1..20: mol_type = other DNA
gctgttggcaaccaattatc

SEQ ID NO: 102570 - DNA, 20 bp, synthetic construct
  misc_feature 1..20: note = CRISPR gRNA sequence
  source 1..20: mol_type = other DNA
gttggcaaccaattatccag

SEQ ID NO: 102571 - DNA, 20 bp, synthetic construct
  misc_feature 1..20: note = CRISPR gRNA sequence
  source 1..20: mol_type = other DNA
gcaaccaattatccagcagt

SEQ ID NO: 102572 - DNA, 20 bp, synthetic construct
  misc_feature 1..20: note = CRISPR gRNA sequence
  source 1..20: mol_type = other DNA
atccagcagttagtatatgc

SEQ ID NO: 102573 - DNA, 20 bp, synthetic construct
  misc_feature 1..20: note = CRISPR gRNA sequence
  source 1..20: mol_type = other DNA
tccagcagttagtatatgcc

SEQ ID NO: 102574 - DNA, 20 bp, synthetic construct
  misc_feature 1..20: note = CRISPR gRNA sequence
  source 1..20: mol_type = other DNA
gccaggtataatccgtgtgt

SEQ ID NO: 102575 - DNA, 20 bp, synthetic construct
  misc_feature 1..20: note = CRISPR gRNA sequence
  source 1..20: mol_type = other DNA
ccaggtataatccgtgtgtt

SEQ ID NO: 102576 - DNA, 20 bp, synthetic construct
  misc_feature 1..20: note = CRISPR gRNA sequence
  source 1..20: mol_type = other DNA
caggtataatccgtgtgtta

SEQ ID NO: 102577 - DNA, 20 bp, synthetic construct
  misc_feature 1..20: note = CRISPR gRNA sequence
  source 1..20: mol_type = other DNA
ggtataatccgtgtgttagg

SEQ ID NO: 102578 - DNA, 20 bp, synthetic construct
  misc_feature 1..20: note = CRISPR gRNA sequence
  source 1..20: mol_type = other DNA
gtataatccgtgtgttaggg

SEQ ID NO: 102579 - DNA, 20 bp, synthetic construct
  misc_feature 1..20: note = CRISPR gRNA sequence
  source 1..20: mol_type = other DNA
tataatccgtgtgttaggga

SEQ ID NO: 102580 - DNA, 20 bp, synthetic construct
  misc_feature 1..20: note = CRISPR gRNA sequence
  source 1..20: mol_type = other DNA
taatccgtgtgttagggagg

SEQ ID NO: 102581 - DNA, 20 bp, synthetic construct
  misc_feature 1..20: note = CRISPR gRNA sequence
  source 1..20: mol_type = other DNA
tgtgttagggagggagtacg

SEQ ID NO: 102582 - DNA, 20 bp, synthetic construct
  misc_feature 1..20: note = CRISPR gRNA sequence
  source 1..20: mol_type = other DNA
tgttagggagggagtacgta

SEQ ID NO: 102583 - DNA, 20 bp, synthetic construct
  misc_feature 1..20: note = CRISPR gRNA sequence
  source 1..20: mol_type = other DNA
gttagggagggagtacgtag

SEQ ID NO: 102584 - DNA, 20 bp, synthetic construct
  misc_feature 1..20: note = CRISPR gRNA sequence
  source 1..20: mol_type = other DNA
gggagtacgtagaggtcaat

SEQ ID NO: 102585 - DNA, 20 bp, synthetic construct
  misc_feature 1..20: note = CRISPR gRNA sequence
  source 1..20: mol_type = other DNA
taagaactgtgcctacctga

SEQ ID NO: 102586 - DNA, 20 bp, synthetic construct
  misc_feature 1..20: note = CRISPR gRNA sequence
  source 1..20: mol_type = other DNA
gcctacctgatggaaattga

SEQ ID NO: 102587 - DNA, 20 bp, synthetic construct
  misc_feature 1..20: note = CRISPR gRNA sequence
  source 1..20: mol_type = other DNA
cctacctgatggaaattgac

SEQ ID NO: 102588 - DNA, 20 bp, synthetic construct
  misc_feature 1..20: note = CRISPR gRNA sequence
  source 1..20: mol_type = other DNA
gatggaaattgacaggtgaa

SEQ ID NO: 102589 - DNA, 20 bp, synthetic construct
  misc_feature 1..20: note = CRISPR gRNA sequence
  source 1..20: mol_type = other DNA
atggaaattgacaggtgaac

SEQ ID NO: 102590 - DNA, 20 bp, synthetic construct
  misc_feature 1..20: note = CRISPR gRNA sequence
  source 1..20: mol_type = other DNA
gaaattgacaggtgaacagg

SEQ ID NO: 102591 - DNA, 20 bp, synthetic construct
  misc_feature 1..20: note = CRISPR gRNA sequence
  source 1..20: mol_type = other DNA
aacaggtagttaatacctaa

SEQ ID NO: 102592 - DNA, 20 bp, synthetic construct
  misc_feature 1..20: note = CRISPR gRNA sequence
  source 1..20: mol_type = other DNA
ggtagttaatacctaacggt

SEQ ID NO: 102593 - DNA, 20 bp, synthetic construct
  misc_feature 1..20: note = CRISPR gRNA sequence
  source 1..20: mol_type = other DNA
acctaacggttagtgctata

SEQ ID NO: 102594 - DNA, 20 bp, synthetic construct
  misc_feature 1..20: note = CRISPR gRNA sequence
  source 1..20: mol_type = other DNA
cctaacggttagtgctataa

SEQ ID NO: 102595 - DNA, 20 bp, synthetic construct
  misc_feature 1..20: note = CRISPR gRNA sequence
  source 1..20: mol_type = other DNA
ctaacggttagtgctataaa

SEQ ID NO: 102596 - DNA, 20 bp, synthetic construct
  misc_feature 1..20: note = CRISPR gRNA sequence
  source 1..20: mol_type = other DNA
taacggttagtgctataaag

SEQ ID NO: 102597 - DNA, 20 bp, synthetic construct
  misc_feature 1..20: note = CRISPR gRNA sequence
  source 1..20: mol_type = other DNA
gttagtgctataaaggggcc

SEQ ID NO: 102598 - DNA, 20 bp, synthetic construct
  misc_feature 1..20: note = CRISPR gRNA sequence
  source 1..20: mol_type = other DNA
tgctataaaggggccaagtt

SEQ ID NO: 102599 - DNA, 20 bp, synthetic construct
  misc_feature 1..20: note = CRISPR gRNA sequence
  source 1..20: mol_type = other DNA
ggccaagttcagttgctgtg

SEQ ID NO: 102600 - DNA, 20 bp, synthetic construct
  misc_feature 1..20: note = CRISPR gRNA sequence
  source 1..20: mol_type = other DNA
gctgtgaagtatccatgcgt

SEQ ID NO: 102601 - DNA, 20 bp, synthetic construct
  misc_feature 1..20: note = CRISPR gRNA sequence
  source 1..20: mol_type = other DNA
tgaagtatccatgcgtgagc

SEQ ID NO: 102602 - DNA, 20 bp, synthetic construct
  misc_feature 1..20: note = CRISPR gRNA sequence
  source 1..20: mol_type = other DNA
gcgtgagctagcctccgtga

SEQ ID NO: 102603 - DNA, 20 bp, synthetic construct
  misc_feature 1..20: note = CRISPR gRNA sequence
  source 1..20: mol_type = other DNA
cgtgagctagcctccgtgaa

SEQ ID NO: 102604 - DNA, 20 bp, synthetic construct
  misc_feature 1..20: note = CRISPR gRNA sequence
  source 1..20: mol_type = other DNA
atcaccaccgcacttttgac

SEQ ID NO: 102605 - DNA, 20 bp, synthetic construct
  misc_feature 1..20: note = CRISPR gRNA sequence
  source 1..20: mol_type = other DNA
cgcacttttgactggccttg

SEQ ID NO: 102606 - DNA, 20 bp, synthetic construct
  misc_feature 1..20: note = CRISPR gRNA sequence
  source 1..20: mol_type = other DNA
tgactggccttgaagaatga

SEQ ID NO: 102607 - DNA, 20 bp, synthetic construct
  misc_feature 1..20: note = CRISPR gRNA sequence
  source 1..20: mol_type = other DNA
gaatgatggtaattcttcca

SEQ ID NO: 102608 - DNA, 20 bp, synthetic construct
  misc_feature 1..20: note = CRISPR gRNA sequence
  source 1..20: mol_type = other DNA
aatgatggtaattcttccac

SEQ ID NO: 102609 - DNA, 20 bp, synthetic construct
  misc_feature 1..20: note = CRISPR gRNA sequence
  source 1..20: mol_type = other DNA
atggtaattcttccacagga

SEQ ID NO: 102610 - DNA, 20 bp, synthetic construct
  misc_feature 1..20: note = CRISPR gRNA sequence
  source 1..20: mol_type = other DNA
taattcttccacaggaaaga

SEQ ID NO: 102611 - DNA, 20 bp, synthetic construct
  misc_feature 1..20: note = CRISPR gRNA sequence
  source 1..20: mol_type = other DNA
ttcttccacaggaaagatgg

SEQ ID NO: 102612 - DNA, 20 bp, synthetic construct
  misc_feature 1..20: note = CRISPR gRNA sequence
  source 1..20: mol_type = other DNA
cttccacaggaaagatggaa

SEQ ID NO: 102613 - DNA, 20 bp, synthetic construct
  misc_feature 1..20: note = CRISPR gRNA sequence
  source 1..20: mol_type = other DNA
aagatggaagagcttgctcg

SEQ ID NO: 102614 - DNA, 20 bp, synthetic construct
  misc_feature 1..20: note = CRISPR gRNA sequence
  source 1..20: mol_type = other DNA
gatggaagagcttgctcgaa

SEQ ID NO: 102615 - DNA, 20 bp, synthetic construct
  misc_feature 1..20: note = CRISPR gRNA sequence
  source 1..20: mol_type = other DNA
ggaagagcttgctcgaagag

SEQ ID NO: 102616 - DNA, 20 bp, synthetic construct
  misc_feature 1..20: note = CRISPR gRNA sequence
  source 1..20: mol_type = other DNA
agcttgctcgaagagaagaa

SEQ ID NO: 102617 - DNA, 20 bp, synthetic construct
  misc_feature 1..20: note = CRISPR gRNA sequence
  source 1..20: mol_type = other DNA
gaagagaagaaaagcatgtg

SEQ ID NO: 102618 - DNA, 20 bp, synthetic construct
  misc_feature 1..20: note = CRISPR gRNA sequence
  source 1..20: mol_type = other DNA
agagaagaaaagcatgtgca

SEQ ID NO: 102619 - DNA, 20 bp, synthetic construct
  misc_feature 1..20: note = CRISPR gRNA sequence
  source 1..20: mol_type = other DNA
gagaagaaaagcatgtgcag

SEQ ID NO: 102620 - DNA, 20 bp, synthetic construct
  misc_feature 1..20: note = CRISPR gRNA sequence
  source 1..20: mol_type = other DNA
gaggaatcaaattacactgt

SEQ ID NO: 102621 - DNA, 20 bp, synthetic construct
  misc_feature 1..20: note = CRISPR gRNA sequence
  source 1..20: mol_type = other DNA
ggaatcaaattacactgttg

SEQ ID NO: 102622 - DNA, 20 bp, synthetic construct
  misc_feature 1..20: note = CRISPR gRNA sequence
  source 1..20: mol_type = other DNA
gaatcaaattacactgttgg

SEQ ID NO: 102623 - DNA, 20 bp, synthetic construct
  misc_feature 1..20: note = CRISPR gRNA sequence
  source 1..20: mol_type = other DNA
tcaaattacactgttggagg

SEQ ID NO: 102624 - DNA, 20 bp, synthetic construct
  misc_feature 1..20: note = CRISPR gRNA sequence
  source 1..20: mol_type = other DNA
caaattacactgttggaggc

SEQ ID NO: 102625 - DNA, 20 bp, synthetic construct
  misc_feature 1..20: note = CRISPR gRNA sequence
  source 1..20: mol_type = other DNA
attacactgttggaggcagg

SEQ ID NO: 102626 - DNA, 20 bp, synthetic construct
  misc_feature 1..20: note = CRISPR gRNA sequence
  source 1..20: mol_type = other DNA
cactgttggaggcaggaaga

SEQ ID NO: 102627 - DNA, 20 bp, synthetic construct
  misc_feature 1..20: note = CRISPR gRNA sequence
  source 1..20: mol_type = other DNA
actgttggaggcaggaagat

SEQ ID NO: 102628 - DNA, 20 bp, synthetic construct
  misc_feature 1..20: note = CRISPR gRNA sequence
  source 1..20: mol_type = other DNA
ttggaggcaggaagatggga

SEQ ID NO: 102629 - DNA, 20 bp, synthetic construct
  misc_feature 1..20: note = CRISPR gRNA sequence
  source 1..20: mol_type = other DNA
tggaggcaggaagatgggat

SEQ ID NO: 102630 - DNA, 20 bp, synthetic construct
  misc_feature 1..20: note = CRISPR gRNA sequence
  source 1..20: mol_type = other DNA
ggaggcaggaagatgggata

SEQ ID NO: 102631 - DNA, 20 bp, synthetic construct
  misc_feature 1..20: note = CRISPR gRNA sequence
  source 1..20: mol_type = other DNA
ggcaggaagatgggataggg

SEQ ID NO: 102632 - DNA, 20 bp, synthetic construct
  misc_feature 1..20: note = CRISPR gRNA sequence
  source 1..20: mol_type = other DNA
aggaagatgggatagggaag

SEQ ID NO: 102633 - DNA, 20 bp, synthetic construct
  misc_feature 1..20: note = CRISPR gRNA sequence
  source 1..20: mol_type = other DNA
ggaagatgggatagggaagt

SEQ ID NO: 102634 - DNA, 20 bp, synthetic construct
  misc_feature 1..20: note = CRISPR gRNA sequence
  source 1..20: mol_type = other DNA
agatgggatagggaagtggg

SEQ ID NO: 102635 - DNA, 20 bp, synthetic construct
  misc_feature 1..20: note = CRISPR gRNA sequence
  source 1..20: mol_type = other DNA
tgggatagggaagtgggcag

SEQ ID NO: 102636 - DNA, 20 bp, synthetic construct
  misc_feature 1..20: note = CRISPR gRNA sequence
  source 1..20: mol_type = other DNA
gaagtgggcagtagttgtga

SEQ ID NO: 102637 - DNA, 20 bp, synthetic construct
  misc_feature 1..20: note = CRISPR gRNA sequence
  source 1..20: mol_type = other DNA
gggcagtagttgtgatagtt

SEQ ID NO: 102638 - DNA, 20 bp, synthetic construct
  misc_feature 1..20: note = CRISPR gRNA sequence
  source 1..20: mol_type = other DNA
ggcagtagttgtgatagttt

SEQ ID NO: 102639 - DNA, 20 bp, synthetic construct
  misc_feature 1..20: note = CRISPR gRNA sequence
  source 1..20: mol_type = other DNA
gcagtagttgtgatagttta

SEQ ID NO: 102640 - DNA, 20 bp, synthetic construct
  misc_feature 1..20: note = CRISPR gRNA sequence
  source 1..20: mol_type = other DNA
cagtagttgtgatagtttag

SEQ ID NO: 102641 - DNA, 20 bp, synthetic construct
  misc_feature 1..20: note = CRISPR gRNA sequence
  source 1..20: mol_type = other DNA
agtagttgtgatagtttagg

SEQ ID NO: 102642 - DNA, 20 bp, synthetic construct
  misc_feature 1..20: note = CRISPR gRNA sequence
  source 1..20: mol_type = other DNA
gtagttgtgatagtttaggg

SEQ ID NO: 102643 - DNA, 20 bp, synthetic construct
  misc_feature 1..20: note = CRISPR gRNA sequence
  source 1..20: mol_type = other DNA
ttgtgatagtttagggggga

SEQ ID NO: 102644 - DNA, 20 bp, synthetic construct
  misc_feature 1..20: note = CRISPR gRNA sequence
  source 1..20: mol_type = other DNA
atagtttaggggggaaagcc

SEQ ID NO: 102645 - DNA, 20 bp, synthetic construct
  misc_feature 1..20: note = CRISPR gRNA sequence
  source 1..20: mol_type = other DNA
tttaggggggaaagcccagt

SEQ ID NO: 102646 - DNA, 20 bp, synthetic construct
  misc_feature 1..20: note = CRISPR gRNA sequence
  source 1..20: mol_type = other DNA
aaatacttgtatatcttgct

SEQ ID NO: 102647 - DNA, 20 bp, synthetic construct
  misc_feature 1..20: note = CRISPR gRNA sequence
  source 1..20: mol_type = other DNA
aatacttgtatatcttgcta

SEQ ID NO: 102648 - DNA, 20 bp, synthetic construct
  misc_feature 1..20: note = CRISPR gRNA sequence
  source 1..20: mol_type = other DNA
tatcttgctaaggaatattt

SEQ ID NO: 102649 - DNA, 20 bp, synthetic construct
  misc_feature 1..20: note = CRISPR gRNA sequence
  source 1..20: mol_type = other DNA
gctaaggaatattttggaaa

SEQ ID NO: 102650 - DNA, 20 bp, synthetic construct
  misc_feature 1..20: note = CRISPR gRNA sequence
  source 1..20: mol_type = other DNA
gaaacagttattattttgta

SEQ ID NO: 102651 - DNA, 20 bp, synthetic construct
  misc_feature 1..20: note = CRISPR gRNA sequence
  source 1..20: mol_type = other DNA
aacagttattattttgtatg

SEQ ID NO: 102652 - DNA, 20 bp, synthetic construct
  misc_feature 1..20: note = CRISPR gRNA sequence
  source 1..20: mol_type = other DNA
acagttattattttgtatgg

SEQ ID NO: 102653 - DNA, 20 bp, synthetic construct
  misc_feature 1..20: note = CRISPR gRNA sequence
  source 1..20: mol_type = other DNA
attattttgtatggaggttc

SEQ ID NO: 102654 - DNA, 20 bp, synthetic construct
  misc_feature 1..20: note = CRISPR gRNA sequence
  source 1..20: mol_type = other DNA
attttgtatggaggttcaag

SEQ ID NO: 102655 - DNA, 20 bp, synthetic construct
  misc_feature 1..20: note = CRISPR gRNA sequence
  source 1..20: mol_type = other DNA
ttgtatggaggttcaagtag

SEQ ID NO: 102656 - DNA, 20 bp, synthetic construct
  misc_feature 1..20: note = CRISPR gRNA sequence
  source 1..20: mol_type = other DNA
tgtatggaggttcaagtaga

SEQ ID NO: 102657 - DNA, 20 bp, synthetic construct
  misc_feature 1..20: note = CRISPR gRNA sequence
  source 1..20: mol_type = other DNA
gtatggaggttcaagtagaa

SEQ ID NO: 102658 - DNA, 20 bp, synthetic construct
  misc_feature 1..20: note = CRISPR gRNA sequence
  source 1..20: mol_type = other DNA
aggttcaagtagaagggatc

SEQ ID NO: 102659 - DNA, 20 bp, synthetic construct
  misc_feature 1..20: note = CRISPR gRNA sequence
  source 1..20: mol_type = other DNA
gttcaagtagaagggatcta

SEQ ID NO: 102660 - DNA, 20 bp, synthetic construct
  misc_feature 1..20: note = CRISPR gRNA sequence
  source 1..20: mol_type = other DNA
ctagagctatattttttcct

SEQ ID NO: 102661 - DNA, 20 bp, synthetic construct
  misc_feature 1..20: note = CRISPR gRNA sequence
  source 1..20: mol_type = other DNA
tttcctaagattgaaaaaac

SEQ ID NO: 102662 - DNA, 20 bp, synthetic construct
  misc_feature 1..20: note = CRISPR gRNA sequence
  source 1..20: mol_type = other DNA
acgagtttctgacttgttta

SEQ ID NO: 102663 - DNA, 20 bp, synthetic construct
  misc_feature 1..20: note = CRISPR gRNA sequence
  source 1..20: mol_type = other DNA
cgagtttctgacttgtttat

SEQ ID NO: 102664 - DNA, 20 bp, synthetic construct
  misc_feature 1..20: note = CRISPR gRNA sequence
  source 1..20: mol_type = other DNA
ttatgggttctgccccgtga

SEQ ID NO: 102665 - DNA, 20 bp, synthetic construct
  misc_feature 1..20: note = CRISPR gRNA sequence
  source 1..20: mol_type = other DNA
tgggttctgccccgtgatag

SEQ ID NO: 102666 - DNA, 20 bp, synthetic construct
  misc_feature 1..20: note = CRISPR gRNA sequence
  source 1..20: mol_type = other DNA
tctgccccgtgatagtggct

SEQ ID NO: 102667 - DNA, 20 bp, synthetic construct
  misc_feature 1..20: note = CRISPR gRNA sequence
  source 1..20: mol_type = other DNA
gtgatagtggctgagttctt

SEQ ID NO: 102668 - DNA, 20 bp, synthetic construct
  misc_feature 1..20: note = CRISPR gRNA sequence
  source 1..20: mol_type = other DNA
tgatagtggctgagttcttt

SEQ ID NO: 102669 - DNA, 20 bp, synthetic construct
  misc_feature 1..20: note = CRISPR gRNA sequence
  source 1..20: mol_type = other DNA
gatagtggctgagttctttg

SEQ ID NO: 102670 - DNA, 20 bp, synthetic construct
  misc_feature 1..20: note = CRISPR gRNA sequence
  source 1..20: mol_type = other DNA
ggctgagttctttggggatg

SEQ ID NO: 102671 - DNA, 20 bp, synthetic construct
  misc_feature 1..20: note = CRISPR gRNA sequence
  source 1..20: mol_type = other DNA
ctgagttctttggggatgaa

SEQ ID NO: 102672 - DNA, 20 bp, synthetic construct
  misc_feature 1..20: note = CRISPR gRNA sequence
  source 1..20: mol_type = other DNA
tgagttctttggggatgaag

SEQ ID NO: 102673 - DNA, 20 bp, synthetic construct
  misc_feature 1..20: note = CRISPR gRNA sequence
  source 1..20: mol_type = other DNA
agttctttggggatgaagag

SEQ ID NO: 102674 - DNA, 20 bp, synthetic construct
  misc_feature 1..20: note = CRISPR gRNA sequence
  source 1..20: mol_type = other DNA
gatgaagaggagacttgtcc

SEQ ID NO: 102675 - DNA, 20 bp, synthetic construct
  misc_feature 1..20: note = CRISPR gRNA sequence
  source 1..20: mol_type = other DNA
atgaagaggagacttgtcct

SEQ ID NO: 102676 - DNA, 20 bp, synthetic construct
  misc_feature 1..20: note = CRISPR gRNA sequence
  source 1..20: mol_type = other DNA
ttttactcatgtgaatcatc

SEQ ID NO: 102677 - DNA, 20 bp, synthetic construct
  misc_feature 1..20: note = CRISPR gRNA sequence
  source 1..20: mol_type = other DNA
gaatcatctagtgcattccc

SEQ ID NO: 102678 - DNA, 20 bp, synthetic construct
  misc_feature 1..20: note = CRISPR gRNA sequence
  source 1..20: mol_type = other DNA
agtgcattccctggcacata

SEQ ID NO: 102679 - DNA, 20 bp, synthetic construct
  misc_feature 1..20: note = CRISPR gRNA sequence
  source 1..20: mol_type = other DNA
gtgcattccctggcacataa

SEQ ID NO: 102680 - DNA, 20 bp, synthetic construct
  misc_feature 1..20: note = CRISPR gRNA sequence
  source 1..20: mol_type = other DNA
ccctggcacataaaggtctt

SEQ ID NO: 102681 - DNA, 20 bp, synthetic construct
  misc_feature 1..20: note = CRISPR gRNA sequence
  source 1..20: mol_type = other DNA
acataaaggtcttaagtatc

SEQ ID NO: 102682 - DNA, 20 bp, synthetic construct
  misc_feature 1..20: note = CRISPR gRNA sequence
  source 1..20: mol_type = other DNA
atttaatgttatacaactaa

SEQ ID NO: 102683 - DNA, 20 bp, synthetic construct
  misc_feature 1..20: note = CRISPR gRNA sequence
  source 1..20: mol_type = other DNA
tttaatgttatacaactaat

SEQ ID NO: 102684 - DNA, 20 bp, synthetic construct
  misc_feature 1..20: note = CRISPR gRNA sequence
  source 1..20: mol_type = other DNA
gttatacaactaataggttt

SEQ ID NO: 102685 - DNA, 20 bp, synthetic construct
  misc_feature 1..20: note = CRISPR gRNA sequence
  source 1..20: mol_type = other DNA
gtttcagaaaactcgtattc

SEQ ID NO: 102686 - DNA, 20 bp, synthetic construct
  misc_feature 1..20: note = CRISPR gRNA sequence
  source 1..20: mol_type = other DNA
ctctttcattactaaaactt

SEQ ID NO: 102687 - DNA, 20 bp, synthetic construct
  misc_feature 1..20: note = CRISPR gRNA sequence
  source 1..20: mol_type = other DNA
tctttcattactaaaacttc

SEQ ID NO: 102688 - DNA, 20 bp, synthetic construct
  misc_feature 1..20: note = CRISPR gRNA sequence
  source 1..20: mol_type = other DNA
ctttcattactaaaacttcg

SEQ ID NO: 102689 - DNA, 20 bp, synthetic construct
  misc_feature 1..20: note = CRISPR gRNA sequence
  source 1..20: mol_type = other DNA
cattactaaaacttcgggga

SEQ ID NO: 102690 - DNA, 20 bp, synthetic construct
  misc_feature 1..20: note = CRISPR gRNA sequence
  source 1..20: mol_type = other DNA
attactaaaacttcggggac

SEQ ID NO: 102691 - DNA, 20 bp, synthetic construct
  misc_feature 1..20: note = CRISPR gRNA sequence
  source 1..20: mol_type = other DNA
caggttttattttcactttt

SEQ ID NO: 102692 - DNA, 20 bp, synthetic construct
  misc_feature 1..20: note = CRISPR gRNA sequence
  source 1..20: mol_type = other DNA
aggttttattttcacttttt

SEQ ID NO: 102693 - DNA, 20 bp, synthetic construct
  misc_feature 1..20: note = CRISPR gRNA sequence
  source 1..20: mol_type = other DNA
ggttttattttcacttttta

SEQ ID NO: 102694 - DNA, 20 bp, synthetic construct
  misc_feature 1..20: note = CRISPR gRNA sequence
  source 1..20: mol_type = other DNA
ttattttcactttttagggt

SEQ ID NO: 102695 - DNA, 20 bp, synthetic construct
  misc_feature 1..20: note = CRISPR gRNA sequence
  source 1..20: mol_type = other DNA
tgagtttttcattgttgctt

SEQ ID NO: 102696 - DNA, 20 bp, synthetic construct
  misc_feature 1..20: note = CRISPR gRNA sequence
  source 1..20: mol_type = other DNA
gattgtcacgttatccgcat

SEQ ID NO: 102697 - DNA, 20 bp, synthetic construct
  misc_feature 1..20: note = CRISPR gRNA sequence
  source 1..20: mol_type = other DNA
tgtcacgttatccgcattag

SEQ ID NO: 102698 - DNA, 20 bp, synthetic construct
  misc_feature 1..20: note = CRISPR gRNA sequence
  source 1..20: mol_type = other DNA
cgttatccgcattagcagat

SEQ ID NO: 102699 - DNA, 20 bp, synthetic construct
  misc_feature 1..20: note = CRISPR gRNA sequence
  source 1..20: mol_type = other DNA
cgcattagcagatgagatga

SEQ ID NO: 102700 - DNA, 20 bp, synthetic construct
  misc_feature 1..20: note = CRISPR gRNA sequence
  source 1..20: mol_type = other DNA
cattagcagatgagatgata

SEQ ID NO: 102701 - DNA, 20 bp, synthetic construct
  misc_feature 1..20: note = CRISPR gRNA sequence
  source 1..20: mol_type = other DNA
cagatgagatgatagagctt

SEQ ID NO: 102702 - DNA, 20 bp, synthetic construct
  misc_feature 1..20: note = CRISPR gRNA sequence
  source 1..20: mol_type = other DNA
atgagatgatagagcttaag

SEQ ID NO: 102703 - DNA, 20 bp, synthetic construct
  misc_feature 1..20: note = CRISPR gRNA sequence
  source 1..20: mol_type = other DNA
aaaacatgtatatttgcctt

SEQ ID NO: 102704 - DNA, 20 bp, synthetic construct
  misc_feature 1..20: note = CRISPR gRNA sequence
  source 1..20: mol_type = other DNA
aacgtttttttgtttgtttt

SEQ ID NO: 102705 - DNA, 20 bp, synthetic construct
  misc_feature 1..20: note = CRISPR gRNA sequence
  source 1..20: mol_type = other DNA
tttttgtttgtttttggata

SEQ ID NO: 102706 - DNA, 20 bp, synthetic construct
  misc_feature 1..20: note = CRISPR gRNA sequence
  source 1..20: mol_type = other DNA
ttttgtttgtttttggatac

SEQ ID NO: 102707 - DNA, 20 bp, synthetic construct
  misc_feature 1..20: note = CRISPR gRNA sequence
  source 1..20: mol_type = other DNA
tttgtttgtttttggataca

SEQ ID NO: 102708 - DNA, 20 bp, synthetic construct
  misc_feature 1..20: note = CRISPR gRNA sequence
  source 1..20: mol_type = other DNA
cagggctttcctctgtcatc

SEQ ID NO: 102709 - DNA, 20 bp, synthetic construct
  misc_feature 1..20: note = CRISPR gRNA sequence
  source 1..20: mol_type = other DNA
agggctttcctctgtcatcc

SEQ ID NO: 102710 - DNA, 20 bp, synthetic construct
  misc_feature 1..20: note = CRISPR gRNA sequence
  source 1..20: mol_type = other DNA
ctttcctctgtcatccaggc

SEQ ID NO: 102711 - DNA, 20 bp, synthetic construct
  misc_feature 1..20: note = CRISPR gRNA sequence
  source 1..20: mol_type = other DNA
ttcctctgtcatccaggctg

SEQ ID NO: 102712 - DNA, 20 bp, synthetic construct
  misc_feature 1..20: note = CRISPR gRNA sequence
  source 1..20: mol_type = other DNA
ctgtcatccaggctggagta

SEQ ID NO: 102713 - DNA, 20 bp, synthetic construct
  misc_feature 1..20: note = CRISPR gRNA sequence
  source 1..20: mol_type = other DNA
tcatccaggctggagtacag

SEQ ID NO: 102714 - DNA, 20 bp, synthetic construct
  misc_feature 1..20: note = CRISPR gRNA sequence
  source 1..20: mol_type = other DNA
ggagtacagtggcgcaatcg

SEQ ID NO: 102715 - DNA, 20 bp, synthetic construct
  misc_feature 1..20: note = CRISPR gRNA sequence
  source 1..20: mol_type = other DNA
gcaatcgtagctcactaacc

SEQ ID NO: 102716 - DNA, 20 bp, synthetic construct
  misc_feature 1..20: note = CRISPR gRNA sequence
  source 1..20: mol_type = other DNA
gctcactaacctggaactcc

SEQ ID NO: 102717 - DNA, 20 bp, synthetic construct
  misc_feature 1..20: note = CRISPR gRNA sequence
  source 1..20: mol_type = other DNA
ctcactaacctggaactcct

SEQ ID NO: 102718 - DNA, 20 bp, synthetic construct
  misc_feature 1..20: note = CRISPR gRNA sequence
  source 1..20: mol_type = other DNA
aacctggaactcctgggctc

SEQ ID NO: 102719 - DNA, 20 bp, synthetic construct
  misc_feature 1..20: note = CRISPR gRNA sequence
  source 1..20: mol_type = other DNA
ttcttgttctcccaaaacgt

SEQ ID NO: 102720 - DNA, 20 bp, synthetic construct
  misc_feature 1..20: note = CRISPR gRNA sequence
  source 1..20: mol_type = other DNA
tcttgttctcccaaaacgtt

SEQ ID NO: 102721 - DNA, 20 bp, synthetic construct
  misc_feature 1..20: note = CRISPR gRNA sequence
  source 1..20: mol_type = other DNA
ctcccaaaacgttgggatta

SEQ ID NO: 102722 - DNA, 20 bp, synthetic construct
  misc_feature 1..20: note = CRISPR gRNA sequence
  source 1..20: mol_type = other DNA
tcccaaaacgttgggattac

SEQ ID NO: 102723 - DNA, 20 bp, synthetic construct
  misc_feature 1..20: note = CRISPR gRNA sequence
  source 1..20: mol_type = other DNA
aacgttgggattacaggcat

SEQ ID NO: 102724 - DNA, 20 bp, synthetic construct
  misc_feature 1..20: note = CRISPR gRNA sequence
  source 1..20: mol_type = other DNA
cactgcgtcctgacctgaaa

SEQ ID NO: 102725 - DNA, 20 bp, synthetic construct
  misc_feature 1..20: note = CRISPR gRNA sequence
  source 1..20: mol_type = other DNA
tgaaatagatgttttaacct

SEQ ID NO: 102726 - DNA, 20 bp, synthetic construct
  misc_feature 1..20: note = CRISPR gRNA sequence
  source 1..20: mol_type = other DNA
ttaaccttagtatttaaaaa

SEQ ID NO: 102727 - DNA, 20 bp, synthetic construct
  misc_feature 1..20: note = CRISPR gRNA sequence
  source 1..20: mol_type = other DNA
taaccttagtatttaaaaat

SEQ ID NO: 102728 - DNA, 20 bp, synthetic construct
  misc_feature 1..20: note = CRISPR gRNA sequence
  source 1..20: mol_type = other DNA
atttaaaaataggtatgttc

SEQ ID NO: 102729 - DNA, 20 bp, synthetic construct
  misc_feature 1..20: note = CRISPR gRNA sequence
  source 1..20: mol_type = other DNA
aatcactaaatacttttgct

SEQ ID NO: 102730 - DNA, 20 bp, synthetic construct
  misc_feature 1..20: note = CRISPR gRNA sequence
  source 1..20: mol_type = other DNA
tttgcttggcatctttctaa

SEQ ID NO: 102731 - DNA, 20 bp, synthetic construct
  misc_feature 1..20: note = CRISPR gRNA sequence
  source 1..20: mol_type = other DNA
ttgcttggcatctttctaaa

SEQ ID NO: 102732 - DNA, 20 bp, synthetic construct
  misc_feature 1..20: note = CRISPR gRNA sequence
  source 1..20: mol_type = other DNA
ttctaaaaggcattataatc

SEQ ID NO: 102733 - DNA, 20 bp, synthetic construct
  misc_feature 1..20: note = CRISPR gRNA sequence
  source 1..20: mol_type = other DNA
ttttttgctaaataccttac

SEQ ID NO: 102734 - DNA, 20 bp, synthetic construct
  misc_feature 1..20: note = CRISPR gRNA sequence
  source 1..20: mol_type = other DNA
aataccttacaagcttccac

SEQ ID NO: 102735 - DNA, 20 bp, synthetic construct
  misc_feature 1..20: note = CRISPR gRNA sequence
  source 1..20: mol_type = other DNA
tacaagcttccaccagtctg

SEQ ID NO: 102736 - DNA, 20 bp, synthetic construct
  misc_feature 1..20: note = CRISPR gRNA sequence
  source 1..20: mol_type = other DNA
aagcttccaccagtctgcag

SEQ ID NO: 102737 - DNA, 20 bp, synthetic construct
  misc_feature 1..20: note = CRISPR gRNA sequence
  source 1..20: mol_type = other DNA
atttctttgtctgacatttt

SEQ ID NO: 102738 - DNA, 20 bp, synthetic construct
  misc_feature 1..20: note = CRISPR gRNA sequence
  source 1..20: mol_type = other DNA
ttctttgtctgacattttga

SEQ ID NO: 102739 - DNA, 20 bp, synthetic construct
  misc_feature 1..20: note = CRISPR gRNA sequence
  source 1..20: mol_type = other DNA
ttgtctgacattttgagaga

SEQ ID NO: 102740 - DNA, 20 bp, synthetic construct
  misc_feature 1..20: note = CRISPR gRNA sequence
  source 1..20: mol_type = other DNA
tctgacattttgagagaaag

SEQ ID NO: 102741 - DNA, 20 bp, synthetic construct
  misc_feature 1..20: note = CRISPR gRNA sequence
  source 1..20: mol_type = other DNA
cattttgagagaaagtagtg

SEQ ID NO: 102742 - DNA, 20 bp, synthetic construct
  misc_feature 1..20: note = CRISPR gRNA sequence
  source 1..20: mol_type = other DNA
agagaaagtagtgtggcccc

SEQ ID NO: 102743 - DNA, 20 bp, synthetic construct
  misc_feature 1..20: note = CRISPR gRNA sequence
  source 1..20: mol_type = other DNA
cccaagctttttttcctgtt

SEQ ID NO: 102744 - DNA, 20 bp, synthetic construct
  misc_feature 1..20: note = CRISPR gRNA sequence
  source 1..20: mol_type = other DNA
ttttatgctctcttgatttg

SEQ ID NO: 102745 - DNA, 20 bp, synthetic construct
  misc_feature 1..20: note = CRISPR gRNA sequence
  source 1..20: mol_type = other DNA
ccttcctccacatcatcaca

SEQ ID NO: 102746 - DNA, 20 bp, synthetic construct
  misc_feature 1..20: note = CRISPR gRNA sequence
  source 1..20: mol_type = other DNA
gctaaatctttctcacactt

SEQ ID NO: 102747 - DNA, 20 bp, synthetic construct
  misc_feature 1..20: note = CRISPR gRNA sequence
  source 1..20: mol_type = other DNA
atctttctcacacttaagac

SEQ ID NO: 102748 - DNA, 20 bp, synthetic construct
  misc_feature 1..20: note = CRISPR gRNA sequence
  source 1..20: mol_type = other DNA
cttaagaccagttcatcctg

SEQ ID NO: 102749 - DNA, 20 bp, synthetic construct
  misc_feature 1..20: note = CRISPR gRNA sequence
  source 1..20: mol_type = other DNA
ttaagaccagttcatcctgc

SEQ ID NO: 102750 - DNA, 20 bp, synthetic construct
  misc_feature 1..20: note = CRISPR gRNA sequence
  source 1..20: mol_type = other DNA
ttcatcctgcaggcctctga

SEQ ID NO: 102751 - DNA, 20 bp, synthetic construct
  misc_feature 1..20: note = CRISPR gRNA sequence
  source 1..20: mol_type = other DNA
cctgcaggcctctgatagca

SEQ ID NO: 102752 - DNA, 20 bp, synthetic construct
  misc_feature 1..20: note = CRISPR gRNA sequence
  source 1..20: mol_type = other DNA
tctgatagcaaagaaaaaaa

SEQ ID NO: 102753 - DNA, 20 bp, synthetic construct
  misc_feature 1..20: note = CRISPR gRNA sequence
  source 1..20: mol_type = other DNA
agcaaagaaaaaaaaagttc

SEQ ID NO: 102754 - DNA, 20 bp, synthetic construct
  misc_feature 1..20: note = CRISPR gRNA sequence
  source 1..20: mol_type = other DNA
aaagaaaaaaaaagttcaag

SEQ ID NO: 102755 - DNA, 20 bp, synthetic construct
  misc_feature 1..20: note = CRISPR gRNA sequence
  source 1..20: mol_type = other DNA
agtagtaccttttttttttt

SEQ ID NO: 102756 - DNA, 20 bp, synthetic construct
  misc_feature 1..20: note = CRISPR gRNA sequence
  source 1..20: mol_type = other DNA
aagccttgttgatttatccc

SEQ ID NO: 102757 - DNA, 20 bp, synthetic construct
  misc_feature 1..20: note = CRISPR gRNA sequence
  source 1..20: mol_type = other DNA
cttgttgatttatccccagc

SEQ ID NO: 102758 - DNA, 20 bp, synthetic construct
  misc_feature 1..20: note = CRISPR gRNA sequence
  source 1..20: mol_type = other DNA
tcccatatcactttatctct

SEQ ID NO: 102759 - DNA, 20 bp, synthetic construct
  misc_feature 1..20: note = CRISPR gRNA sequence
  source 1..20: mol_type = other DNA
cccatatcactttatctctt

SEQ ID NO: 102760 - DNA, 20 bp, synthetic construct
  misc_feature 1..20: note = CRISPR gRNA sequence
  source 1..20: mol_type = other DNA
cactttatctcttaggattc

SEQ ID NO: 102761 - DNA, 20 bp, synthetic construct
  misc_feature 1..20: note = CRISPR gRNA sequence
  source 1..20: mol_type = other DNA
tatctcttaggattccagta

SEQ ID NO: 102762 - DNA, 20 bp, synthetic construct
  misc_feature 1..20: note = CRISPR gRNA sequence
  source 1..20: mol_type = other DNA
atctcttaggattccagtat

SEQ ID NO: 102763 - DNA, 20 bp, synthetic construct
  misc_feature 1..20: note = CRISPR gRNA sequence
  source 1..20: mol_type = other DNA
aggattccagtataggtttt

SEQ ID NO: 102764 - DNA, 20 bp, synthetic construct
  misc_feature 1..20: note = CRISPR gRNA sequence
  source 1..20: mol_type = other DNA
ttagtccattactaaactta

SEQ ID NO: 102765 - DNA, 20 bp, synthetic construct
  misc_feature 1..20: note = CRISPR gRNA sequence
  source 1..20: mol_type = other DNA
ctaaacttaaagactctttg

SEQ ID NO: 102766 - DNA, 20 bp, synthetic construct
  misc_feature 1..20: note = CRISPR gRNA sequence
  source 1..20: mol_type = other DNA
tttgaagtttgaatcttcgt

SEQ ID NO: 102767 - DNA, 20 bp, synthetic construct
  misc_feature 1..20: note = CRISPR gRNA sequence
  source 1..20: mol_type = other DNA
tgaagtttgaatcttcgtca

SEQ ID NO: 102768 - DNA, 20 bp, synthetic construct
  misc_feature 1..20: note = CRISPR gRNA sequence
  source 1..20: mol_type = other DNA
ctttttatttttaaaacctt

SEQ ID NO: 102769 - DNA, 20 bp, synthetic construct
  misc_feature 1..20: note = CRISPR gRNA sequence
  source 1..20: mol_type = other DNA
tatttttaaaaccttcagaa

SEQ ID NO: 102770 - DNA, 20 bp, synthetic construct
  misc_feature 1..20: note = CRISPR gRNA sequence
  source 1..20: mol_type = other DNA
aaaaccttcagaacagtgtc

SEQ ID NO: 102771 - DNA, 20 bp, synthetic construct
  misc_feature 1..20: note = CRISPR gRNA sequence
  source 1..20: mol_type = other DNA
tcagaacagtgtctggcaca

SEQ ID NO: 102772 - DNA, 20 bp, synthetic construct
  misc_feature 1..20: note = CRISPR gRNA sequence
  source 1..20: mol_type = other DNA
tctggcacatggtacataat

SEQ ID NO: 102773 - DNA, 20 bp, synthetic construct
  misc_feature 1..20: note = CRISPR gRNA sequence
  source 1..20: mol_type = other DNA
ggcacatggtacataattag

SEQ ID NO: 102774 - DNA, 20 bp, synthetic construct
  misc_feature 1..20: note = CRISPR gRNA sequence
  source 1..20: mol_type = other DNA
cacatggtacataattagtg

SEQ ID NO: 102775 - DNA, 20 bp, synthetic construct
  misc_feature 1..20: note = CRISPR gRNA sequence
  source 1..20: mol_type = other DNA
catggtacataattagtgga

SEQ ID NO: 102776 - DNA, 20 bp, synthetic construct
  misc_feature 1..20: note = CRISPR gRNA sequence
  source 1..20: mol_type = other DNA
ggtacataattagtggagag

SEQ ID NO: 102777 - DNA, 20 bp, synthetic construct
  misc_feature 1..20: note = CRISPR gRNA sequence
  source 1..20: mol_type = other DNA
attagtggagagaagtgcat

SEQ ID NO: 102778 - DNA, 20 bp, synthetic construct
  misc_feature 1..20: note = CRISPR gRNA sequence
  source 1..20: mol_type = other DNA
gtggagagaagtgcattaga

SEQ ID NO: 102779 - DNA, 20 bp, synthetic construct
  misc_feature 1..20: note = CRISPR gRNA sequence
  source 1..20: mol_type = other DNA
tgcattagaaagctccaatc

SEQ ID NO: 102780 - DNA, 20 bp, synthetic construct
  misc_feature 1..20: note = CRISPR gRNA sequence
  source 1..20: mol_type = other DNA
agctccaatccagaaatctg

SEQ ID NO: 102781 - DNA, 20 bp, synthetic construct
  misc_feature 1..20: note = CRISPR gRNA sequence
  source 1..20: mol_type = other DNA
gctccaatccagaaatctgt

SEQ ID NO: 102782 - DNA, 20 bp, synthetic construct
  misc_feature 1..20: note = CRISPR gRNA sequence
  source 1..20: mol_type = other DNA
tccagaaatctgtaggatga

SEQ ID NO: 102783 - DNA, 20 bp, synthetic construct
  misc_feature 1..20: note = CRISPR gRNA sequence
  source 1..20: mol_type = other DNA
ccagaaatctgtaggatgat

SEQ ID NO: 102784 - DNA, 20 bp, synthetic construct
  misc_feature 1..20: note = CRISPR gRNA sequence
  source 1..20: mol_type = other DNA
cagaaatctgtaggatgatg

SEQ ID NO: 102785 - DNA, 20 bp, synthetic construct
  misc_feature 1..20: note = CRISPR gRNA sequence
  source 1..20: mol_type = other DNA
aaatctgtaggatgatgggg

SEQ ID NO: 102786 - DNA, 20 bp, synthetic construct
  misc_feature 1..20: note = CRISPR gRNA sequence
  source 1..20: mol_type = other DNA
ctgtaggatgatggggaagc

SEQ ID NO: 102787 - DNA, 20 bp, synthetic construct
  misc_feature 1..20: note = CRISPR gRNA sequence
  source 1..20: mol_type = other DNA
aggatgatggggaagctgga

SEQ ID NO: 102788 - DNA, 20 bp, synthetic construct
  misc_feature 1..20: note = CRISPR gRNA sequence
  source 1..20: mol_type = other DNA
agctggacagccctttgttg

SEQ ID NO: 102789 - DNA, 20 bp, synthetic construct
  misc_feature 1..20: note = CRISPR gRNA sequence
  source 1..20: mol_type = other DNA
gacagccctttgttgtagtc

SEQ ID NO: 102790 - DNA, 20 bp, synthetic construct
  misc_feature 1..20: note = CRISPR gRNA sequence
  source 1..20: mol_type = other DNA
ttgtagtctagtctttcatc

SEQ ID NO: 102791 - DNA, 20 bp, synthetic construct
  misc_feature 1..20: note = CRISPR gRNA sequence
  source 1..20: mol_type = other DNA
gtctttcatcaagcgtctat

SEQ ID NO: 102792 - DNA, 20 bp, synthetic construct
  misc_feature 1..20: note = CRISPR gRNA sequence
  source 1..20: mol_type = other DNA
tctttcatcaagcgtctatc

SEQ ID NO: 102793 - DNA, 20 bp, synthetic construct
  misc_feature 1..20: note = CRISPR gRNA sequence
  source 1..20: mol_type = other DNA
tctatcaggacccacttgtt

SEQ ID NO: 102794 - DNA, 20 bp, synthetic construct
  misc_feature 1..20: note = CRISPR gRNA sequence
  source 1..20: mol_type = other DNA
acccacttgttgagttgtga

SEQ ID NO: 102795 - DNA, 20 bp, synthetic construct
  misc_feature 1..20: note = CRISPR gRNA sequence
  source 1..20: mol_type = other DNA
gttgagttgtgaaagaaatt

SEQ ID NO: 102796 - DNA, 20 bp, synthetic construct
  misc_feature 1..20: note = CRISPR gRNA sequence
  source 1..20: mol_type = other DNA
agttgtgaaagaaattgagt

SEQ ID NO: 102797 - DNA, 20 bp, synthetic construct
  misc_feature 1..20: note = CRISPR gRNA sequence
  source 1..20: mol_type = other DNA
gaaattgagtgagccaatgc

SEQ ID NO: 102798 - DNA, 20 bp, synthetic construct
  misc_feature 1..20: note = CRISPR gRNA sequence
  source 1..20: mol_type = other DNA
aaattgagtgagccaatgct

SEQ ID NO: 102799 - DNA, 20 bp, synthetic construct
  misc_feature 1..20: note = CRISPR gRNA sequence
  source 1..20: mol_type = other DNA
tgctgggaatttttaaataa

SEQ ID NO: 102800 - DNA, 20 bp, synthetic construct
  misc_feature 1..20: note = CRISPR gRNA sequence
  source 1..20: mol_type = other DNA
ggaatttttaaataatagaa

SEQ ID NO: 102801 - DNA, 20 bp, synthetic construct
  misc_feature 1..20: note = CRISPR gRNA sequence
  source 1..20: mol_type = other DNA
atagaatagaaaatatctgc

SEQ ID NO: 102802 - DNA, 20 bp, synthetic construct
  misc_feature 1..20: note = CRISPR gRNA sequence
  source 1..20: mol_type = other DNA
tagaatagaaaatatctgcc

SEQ ID NO: 102803 - DNA, 20 bp, synthetic construct
  misc_feature 1..20: note = CRISPR gRNA sequence
  source 1..20: mol_type = other DNA
atatctgccaggcatgatga

SEQ ID NO: 102804 - DNA, 20 bp, synthetic construct
  misc_feature 1..20: note = CRISPR gRNA sequence
  source 1..20: mol_type = other DNA
atggctcacgactgtaatcc

SEQ ID NO: 102805 - DNA, 20 bp, synthetic construct
  misc_feature 1..20: note = CRISPR gRNA sequence
  source 1..20: mol_type = other DNA
cgactgtaatcccagcactt

SEQ ID NO: 102806 - DNA, 20 bp, synthetic construct
  misc_feature 1..20: note = CRISPR gRNA sequence
  source 1..20: mol_type = other DNA
gactgtaatcccagcacttt

SEQ ID NO: 102807 - DNA, 20 bp, synthetic construct
  misc_feature 1..20: note = CRISPR gRNA sequence
  source 1..20: mol_type = other DNA
tgtaatcccagcactttggg

SEQ ID NO: 102808 - DNA, 20 bp, synthetic construct
  misc_feature 1..20: note = CRISPR gRNA sequence
  source 1..20: mol_type = other DNA
cccagcactttgggaagccg

SEQ ID NO: 102809 - DNA, 20 bp, synthetic construct
  misc_feature 1..20: note = CRISPR gRNA sequence
  source 1..20: mol_type = other DNA
agcactttgggaagccgaag

SEQ ID NO: 102810 - DNA, 20 bp, synthetic construct
  misc_feature 1..20: note = CRISPR gRNA sequence
  source 1..20: mol_type = other DNA
gcactttgggaagccgaagt

SEQ ID NO: 102811 - DNA, 20 bp, synthetic construct
  misc_feature 1..20: note = CRISPR gRNA sequence
  source 1..20: mol_type = other DNA
actttgggaagccgaagtgg

SEQ ID NO: 102812 - DNA, 20 bp, synthetic construct
  misc_feature 1..20: note = CRISPR gRNA sequence
  source 1..20: mol_type = other DNA
ccgaagtgggagaatccttt

SEQ ID NO: 102813 - DNA, 20 bp, synthetic construct
  misc_feature 1..20: note = CRISPR gRNA sequence
  source 1..20: mol_type = other DNA
gtgggagaatcctttgagct

SEQ ID NO: 102814 - DNA, 20 bp, synthetic construct
  misc_feature 1..20: note = CRISPR gRNA sequence
  source 1..20: mol_type = other DNA
tgggagaatcctttgagctc

SEQ ID NO: 102815 - DNA, 20 bp, synthetic construct
  misc_feature 1..20: note = CRISPR gRNA sequence
  source 1..20: mol_type = other DNA
ggagaatcctttgagctcag

SEQ ID NO: 102816 - DNA, 20 bp, synthetic construct
  misc_feature 1..20: note = CRISPR gRNA sequence
  source 1..20: mol_type = other DNA
tcctttgagctcaggagttt

SEQ ID NO: 102817 - DNA, 20 bp, synthetic construct
  misc_feature 1..20: note = CRISPR gRNA sequence
  source 1..20: mol_type = other DNA
tgagctcaggagtttgagac

SEQ ID NO: 102818 - DNA, 20 bp, synthetic construct
  misc_feature 1..20: note = CRISPR gRNA sequence
  source 1..20: mol_type = other DNA
tcaggagtttgagaccagcc

SEQ ID NO: 102819 - DNA, 20 bp, synthetic construct
  misc_feature 1..20: note = CRISPR gRNA sequence
  source 1..20: mol_type = other DNA
caggagtttgagaccagcct

SEQ ID NO: 102820 - DNA, 20 bp, synthetic construct
  misc_feature 1..20: note = CRISPR gRNA sequence
  source 1..20: mol_type = other DNA
gagtttgagaccagcctggg

SEQ ID NO: 102821 - DNA, 20 bp, synthetic construct
  misc_feature 1..20: note = CRISPR gRNA sequence
  source 1..20: mol_type = other DNA
tgagaccagcctgggtagca

SEQ ID NO: 102822 - DNA, 20 bp, synthetic construct
  misc_feature 1..20: note = CRISPR gRNA sequence
  source 1..20: mol_type = other DNA
gagaccagcctgggtagcat

SEQ ID NO: 102823 - DNA, 20 bp, synthetic construct
  misc_feature 1..20: note = CRISPR gRNA sequence
  source 1..20: mol_type = other DNA
agaccagcctgggtagcata

SEQ ID NO: 102824 - DNA, 20 bp, synthetic construct
  misc_feature 1..20: note = CRISPR gRNA sequence
  source 1..20: mol_type = other DNA
accagcctgggtagcatagg

SEQ ID NO: 102825 - DNA, 20 bp, synthetic construct
  misc_feature 1..20: note = CRISPR gRNA sequence
  source 1..20: mol_type = other DNA
agggagaccccctctcttaa

SEQ ID NO: 102826 - DNA, 20 bp, synthetic construct
  misc_feature 1..20: note = CRISPR gRNA sequence
  source 1..20: mol_type = other DNA
ccctctcttaaaagaaaaaa

SEQ ID NO: 102827 - DNA, 20 bp, synthetic construct
  misc_feature 1..20: note = CRISPR gRNA sequence
  source 1..20: mol_type = other DNA
tcttaaaagaaaaaaaagaa

SEQ ID NO: 102828 - DNA, 20 bp, synthetic construct
  misc_feature 1..20: note = CRISPR gRNA sequence
  source 1..20: mol_type = other DNA
aaaaagaatagaaaatacca

SEQ ID NO: 102829 - DNA, 20 bp, synthetic construct
  misc_feature 1..20: note = CRISPR gRNA sequence
  source 1..20: mol_type = other DNA
agtgcatcttgtgttgtata

SEQ ID NO: 102830 - DNA, 20 bp, synthetic construct
  misc_feature 1..20: note = CRISPR gRNA sequence
  source 1..20: mol_type = other DNA
gtgcatcttgtgttgtataa

SEQ ID NO: 102831 - DNA, 20 bp, synthetic construct
  misc_feature 1..20: note = CRISPR gRNA sequence
  source 1..20: mol_type = other DNA
gtttcatgaaactttcattt

SEQ ID NO: 102832 - DNA, 20 bp, synthetic construct
  misc_feature 1..20: note = CRISPR gRNA sequence
  source 1..20: mol_type = other DNA
gctttatacatgtgtgcact

SEQ ID NO: 102833 - DNA, 20 bp, synthetic construct
  misc_feature 1..20: note = CRISPR gRNA sequence
  source 1..20: mol_type = other DNA
aatgaaatgtgtttcttact

SEQ ID NO: 102834 - DNA, 20 bp, synthetic construct
  misc_feature 1..20: note = CRISPR gRNA sequence
  source 1..20: mol_type = other DNA
atgaaatgtgtttcttacta

SEQ ID NO: 102835 - DNA, 20 bp, synthetic construct
  misc_feature 1..20: note = CRISPR gRNA sequence
  source 1..20: mol_type = other DNA
tgaaatgtgtttcttactaa

SEQ ID NO: 102836 - DNA, 20 bp, synthetic construct
  misc_feature 1..20: note = CRISPR gRNA sequence
  source 1..20: mol_type = other DNA
gtgtttcttactaagggttg

SEQ ID NO: 102837 - DNA, 20 bp, synthetic construct
  misc_feature 1..20: note = CRISPR gRNA sequence
  source 1..20: mol_type = other DNA
actaagggttgtggtcaaaa

SEQ ID NO: 102838 - DNA, 20 bp, synthetic construct
  misc_feature 1..20: note = CRISPR gRNA sequence
  source 1..20: mol_type = other DNA
ttgtggtcaaaaaagttaaa

SEQ ID NO: 102839 - DNA, 20 bp, synthetic construct
  misc_feature 1..20: note = CRISPR gRNA sequence
  source 1..20: mol_type = other DNA
aagttaaaaagctactgttc

SEQ ID NO: 102840 - DNA, 20 bp, synthetic construct
  misc_feature 1..20: note = CRISPR gRNA sequence
  source 1..20: mol_type = other DNA
agttaaaaagctactgttct

SEQ ID NO: 102841 - DNA, 20 bp, synthetic construct
  misc_feature 1..20: note = CRISPR gRNA sequence
  source 1..20: mol_type = other DNA
ctactgttctaggctttgcc

SEQ ID NO: 102842 - DNA, 20 bp, synthetic construct
  misc_feature 1..20: note = CRISPR gRNA sequence
  source 1..20: mol_type = other DNA
ctgttctaggctttgcctgg

SEQ ID NO: 102843 - DNA, 20 bp, synthetic construct
  misc_feature 1..20: note = CRISPR gRNA sequence
  source 1..20: mol_type = other DNA
tatcaactgtgataatccta

SEQ ID NO: 102844 - DNA, 20 bp, synthetic construct
  misc_feature 1..20: note = CRISPR gRNA sequence
  source 1..20: mol_type = other DNA
ggcttttcatatgcttacac

SEQ ID NO: 102845 - DNA, 20 bp, synthetic construct
  misc_feature 1..20: note = CRISPR gRNA sequence
  source 1..20: mol_type = other DNA
ttcatatgcttacactagtt

SEQ ID NO: 102846 - DNA, 20 bp, synthetic construct
  misc_feature 1..20: note = CRISPR gRNA sequence
  source 1..20: mol_type = other DNA
ttacactagttgagtttctg

SEQ ID NO: 102847 - DNA, 20 bp, synthetic construct
  misc_feature 1..20: note = CRISPR gRNA sequence
  source 1..20: mol_type = other DNA
acactagttgagtttctgaa

SEQ ID NO: 102848 - DNA, 20 bp, synthetic construct
  misc_feature 1..20: note = CRISPR gRNA sequence
  source 1..20: mol_type = other DNA
cactagttgagtttctgaag

SEQ ID NO: 102849 - DNA, 20 bp, synthetic construct
  misc_feature 1..20: note = CRISPR gRNA sequence
  source 1..20: mol_type = other DNA
ttgagtttctgaagaggttt

SEQ ID NO: 102850 - DNA, 20 bp, synthetic construct
  misc_feature 1..20: note = CRISPR gRNA sequence
  source 1..20: mol_type = other DNA
ttctgaagaggttttagctt

SEQ ID NO: 102851 - DNA, 20 bp, synthetic construct
  misc_feature 1..20: note = CRISPR gRNA sequence
  source 1..20: mol_type = other DNA
ctgaagaggttttagctttg

SEQ ID NO: 102852 - DNA, 20 bp, synthetic construct
  misc_feature 1..20: note = CRISPR gRNA sequence
  source 1..20: mol_type = other DNA
ttttagctttggagtttgtg

SEQ ID NO: 102853 - DNA, 20 bp, synthetic construct
  misc_feature 1..20: note = CRISPR gRNA sequence
  source 1..20: mol_type = other DNA
tttagctttggagtttgtgt

SEQ ID NO: 102854 - DNA, 20 bp, synthetic construct
  misc_feature 1..20: note = CRISPR gRNA sequence
  source 1..20: mol_type = other DNA
ggagtttgtgtaggtccaca

SEQ ID NO: 102855 - DNA, 20 bp, synthetic construct
  misc_feature 1..20: note = CRISPR gRNA sequence
  source 1..20: mol_type = other DNA
ttgtgtaggtccacatagaa

SEQ ID NO: 102856 - DNA, 20 bp, synthetic construct
  misc_feature 1..20: note = CRISPR gRNA sequence
  source 1..20: mol_type = other DNA
tgtgtaggtccacatagaat

SEQ ID NO: 102857 - DNA, 20 bp, synthetic construct
  misc_feature 1..20: note = CRISPR gRNA sequence
  source 1..20: mol_type = other DNA
gtccacatagaatgggttcc

SEQ ID NO: 102858 - DNA, 20 bp, synthetic construct
  misc_feature 1..20: note = CRISPR gRNA sequence
  source 1..20: mol_type = other DNA
acatagaatgggttcctagt

SEQ ID NO: 102859 - DNA, 20 bp, synthetic construct
  misc_feature 1..20: note = CRISPR gRNA sequence
  source 1..20: mol_type = other DNA
tagaatgggttcctagtaag

SEQ ID NO: 102860 - DNA, 20 bp, synthetic construct
  misc_feature 1..20: note = CRISPR gRNA sequence
  source 1..20: mol_type = other DNA
atgggttcctagtaagtggt

SEQ ID NO: 102861 - DNA, 20 bp, synthetic construct
  misc_feature 1..20: note = CRISPR gRNA sequence
  source 1..20: mol_type = other DNA
ttcctagtaagtggttggct

SEQ ID NO: 102862 - DNA, 20 bp, synthetic construct
  misc_feature 1..20: note = CRISPR gRNA sequence
  source 1..20: mol_type = other DNA
gtaagtggttggctaagtct

SEQ ID NO: 102863 - DNA, 20 bp, synthetic construct
  misc_feature 1..20: note = CRISPR gRNA sequence
  source 1..20: mol_type = other DNA
aagtctcagcttttgcacct

SEQ ID NO: 102864 - DNA, 20 bp, synthetic construct
  misc_feature 1..20: note = CRISPR gRNA sequence
  source 1..20: mol_type = other DNA
tcagcttttgcaccttggaa

SEQ ID NO: 102865 - DNA, 20 bp, synthetic construct
  misc_feature 1..20: note = CRISPR gRNA sequence
  source 1..20: mol_type = other DNA
gcttttgcaccttggaatag

SEQ ID NO: 102866 - DNA, 20 bp, synthetic construct
  misc_feature 1..20: note = CRISPR gRNA sequence
  source 1..20: mol_type = other DNA
cttttgcaccttggaatagt

SEQ ID NO: 102867 - DNA, 20 bp, synthetic construct
  misc_feature 1..20: note = CRISPR gRNA sequence
  source 1..20: mol_type = other DNA
ttttgcaccttggaatagtg

SEQ ID NO: 102868 - DNA, 20 bp, synthetic construct
  misc_feature 1..20: note = CRISPR gRNA sequence
  source 1..20: mol_type = other DNA
caccttggaatagtggggca

SEQ ID NO: 102869 - DNA, 20 bp, synthetic construct
  misc_feature 1..20: note = CRISPR gRNA sequence
  source 1..20: mol_type = other DNA
ccttggaatagtggggcaaa

SEQ ID NO: 102870 - DNA, 20 bp, synthetic construct
  misc_feature 1..20: note = CRISPR gRNA sequence
  source 1..20: mol_type = other DNA
ggggcaaagagaattgcact

SEQ ID NO: 102871 - DNA, 20 bp, synthetic construct
  misc_feature 1..20: note = CRISPR gRNA sequence
  source 1..20: mol_type = other DNA
gcaaagagaattgcactgag

SEQ ID NO: 102872 - DNA, 20 bp, synthetic construct
  misc_feature 1..20: note = CRISPR gRNA sequence
  source 1..20: mol_type = other DNA
aaagagaattgcactgagaa

SEQ ID NO: 102873 - DNA, 20 bp, synthetic construct
  misc_feature 1..20: note = CRISPR gRNA sequence
  source 1..20: mol_type = other DNA
gcactgagaagagaatgcac

SEQ ID NO: 102874 - DNA, 20 bp, synthetic construct
  misc_feature 1..20: note = CRISPR gRNA sequence
  source 1..20: mol_type = other DNA
cactgagaagagaatgcact

SEQ ID NO: 102875 - DNA, 20 bp, synthetic construct
  misc_feature 1..20: note = CRISPR gRNA sequence
  source 1..20: mol_type = other DNA
tgagaagagaatgcactagg

SEQ ID NO: 102876 - DNA, 20 bp, synthetic construct
  misc_feature 1..20: note = CRISPR gRNA sequence
  source 1..20: mol_type = other DNA
agaagagaatgcactaggaa

SEQ ID NO: 102877 - DNA, 20 bp, synthetic construct
  misc_feature 1..20: note = CRISPR gRNA sequence
  source 1..20: mol_type = other DNA
taggaagagaattttcatgc

SEQ ID NO: 102878 - DNA, 20 bp, synthetic construct
  misc_feature 1..20: note = CRISPR gRNA sequence
  source 1..20: mol_type = other DNA
aagagaattttcatgctagc

SEQ ID NO: 102879 - DNA, 20 bp, synthetic construct
  misc_feature 1..20: note = CRISPR gRNA sequence
  source 1..20: mol_type = other DNA
ttatttgtttctctctcttt

SEQ ID NO: 102880 - DNA, 20 bp, synthetic construct
  misc_feature 1..20: note = CRISPR gRNA sequence
  source 1..20: mol_type = other DNA
tatttgtttctctctctttg

SEQ ID NO: 102881 - DNA, 20 bp, synthetic construct
  misc_feature 1..20: note = CRISPR gRNA sequence
  source 1..20: mol_type = other DNA
accattcaaaactttgtgtt

SEQ ID NO: 102882 - DNA, 20 bp, synthetic construct
  misc_feature 1..20: note = CRISPR gRNA sequence
  source 1..20: mol_type = other DNA
cattcaaaactttgtgttaa

SEQ ID NO: 102883 - DNA, 20 bp, synthetic construct
  misc_feature 1..20: note = CRISPR gRNA sequence
  source 1..20: mol_type = other DNA
caaaactttgtgttaagagc

SEQ ID NO: 102884 - DNA, 20 bp, synthetic construct
  misc_feature 1..20: note = CRISPR gRNA sequence
  source 1..20: mol_type = other DNA
aaactttgtgttaagagcaa

SEQ ID NO: 102885 - DNA, 20 bp, synthetic construct
  misc_feature 1..20: note = CRISPR gRNA sequence
  source 1..20: mol_type = other DNA
tttgtgttaagagcaagagc

SEQ ID NO: 102886 - DNA, 20 bp, synthetic construct
  misc_feature 1..20: note = CRISPR gRNA sequence
  source 1..20: mol_type = other DNA
tgttaagagcaagagctaga

SEQ ID NO: 102887 - DNA, 20 bp, synthetic construct
  misc_feature 1..20: note = CRISPR gRNA sequence
  source 1..20: mol_type = other DNA
agagctagacagactaaatc

SEQ ID NO: 102888 - DNA, 20 bp, synthetic construct
  misc_feature 1..20: note = CRISPR gRNA sequence
  source 1..20: mol_type = other DNA
tagacagactaaatctggct

SEQ ID NO: 102889 - DNA, 20 bp, synthetic construct
  misc_feature 1..20: note = CRISPR gRNA sequence
  source 1..20: mol_type = other DNA
ggcttagtttgtcataatct

SEQ ID NO: 102890 - DNA, 20 bp, synthetic construct
  misc_feature 1..20: note = CRISPR gRNA sequence
  source 1..20: mol_type = other DNA
gcttagtttgtcataatctt

SEQ ID NO: 102891 - DNA, 20 bp, synthetic construct
  misc_feature 1..20: note = CRISPR gRNA sequence
  source 1..20: mol_type = other DNA
gtttgtcataatcttgggca

SEQ ID NO: 102892 - DNA, 20 bp, synthetic construct
  misc_feature 1..20: note = CRISPR gRNA sequence
  source 1..20: mol_type = other DNA
ttgtcataatcttgggcaaa

SEQ ID NO: 102893 - DNA, 20 bp, synthetic construct
  misc_feature 1..20: note = CRISPR gRNA sequence
  source 1..20: mol_type = other DNA
tgtcataatcttgggcaaag

SEQ ID NO: 102894 - DNA, 20 bp, synthetic construct
  misc_feature 1..20: note = CRISPR gRNA sequence
  source 1..20: mol_type = other DNA
tcttgggcaaagaggcactt

SEQ ID NO: 102895 - DNA, 20 bp, synthetic construct
  misc_feature 1..20: note = CRISPR gRNA sequence
  source 1..20: mol_type = other DNA
cttgggcaaagaggcacttt

SEQ ID NO: 102896 - DNA, 20 bp, synthetic construct
  misc_feature 1..20: note = CRISPR gRNA sequence
  source 1..20: mol_type = other DNA
ggcaaagaggcactttggga

SEQ ID NO: 102897 - DNA, 20 bp, synthetic construct
  misc_feature 1..20: note = CRISPR gRNA sequence
  source 1..20: mol_type = other DNA
aagactatcgaattgtattg

SEQ ID NO: 102898 - DNA, 20 bp, synthetic construct
  misc_feature 1..20: note = CRISPR gRNA sequence
  source 1..20: mol_type = other DNA
tattgcagtcttgctaactg

SEQ ID NO: 102899 - DNA, 20 bp, synthetic construct
  misc_feature 1..20: note = CRISPR gRNA sequence
  source 1..20: mol_type = other DNA
gtcttgctaactgaagctca

SEQ ID NO: 102900 - DNA, 20 bp, synthetic construct
  misc_feature 1..20: note = CRISPR gRNA sequence
  source 1..20: mol_type = other DNA
ttgctaactgaagctcacag

SEQ ID NO: 102901 - DNA, 20 bp, synthetic construct
  misc_feature 1..20: note = CRISPR gRNA sequence
  source 1..20: mol_type = other DNA
ctaactgaagctcacagtag

SEQ ID NO: 102902 - DNA, 20 bp, synthetic construct
  misc_feature 1..20: note = CRISPR gRNA sequence
  source 1..20: mol_type = other DNA
taactgaagctcacagtagt

SEQ ID NO: 102903 - DNA, 20 bp, synthetic construct
  misc_feature 1..20: note = CRISPR gRNA sequence
  source 1..20: mol_type = other DNA
aggaacatatgactttactg

SEQ ID NO: 102904 - DNA, 20 bp, synthetic construct
  misc_feature 1..20: note = CRISPR gRNA sequence
  source 1..20: mol_type = other DNA
acatatgactttactgaagc

SEQ ID NO: 102905 - DNA, 20 bp, synthetic construct
  misc_feature 1..20: note = CRISPR gRNA sequence
  source 1..20: mol_type = other DNA
ttactgaagccagttgctta

SEQ ID NO: 102906 - DNA, 20 bp, synthetic construct
  misc_feature 1..20: note = CRISPR gRNA sequence
  source 1..20: mol_type = other DNA
cttatagcattaaccattaa

SEQ ID NO: 102907 - DNA, 20 bp, synthetic construct
  misc_feature 1..20: note = CRISPR gRNA sequence
  source 1..20: mol_type = other DNA
acagtatcaatatcatgata

SEQ ID NO: 102908 - DNA, 20 bp, synthetic construct
  misc_feature 1..20: note = CRISPR gRNA sequence
  source 1..20: mol_type = other DNA
cagtatcaatatcatgatac

SEQ ID NO: 102909 - DNA, 20 bp, synthetic construct
  misc_feature 1..20: note = CRISPR gRNA sequence
  source 1..20: mol_type = other DNA
aatcactctgtcattaatgt

SEQ ID NO: 102910 - DNA, 20 bp, synthetic construct
  misc_feature 1..20: note = CRISPR gRNA sequence
  source 1..20: mol_type = other DNA
tcactctgtcattaatgtga

SEQ ID NO: 102911 - DNA, 20 bp, synthetic construct
  misc_feature 1..20: note = CRISPR gRNA sequence
  source 1..20: mol_type = other DNA
actctgtcattaatgtgaga

SEQ ID NO: 102912 - DNA, 20 bp, synthetic construct
  misc_feature 1..20: note = CRISPR gRNA sequence
  source 1..20: mol_type = other DNA
atgtgagagagaattgctgc

SEQ ID NO: 102913 - DNA, 20 bp, synthetic construct
  misc_feature 1..20: note = CRISPR gRNA sequence
  source 1..20: mol_type = other DNA
gagaattgctgctagatttg

SEQ ID NO: 102914 - DNA, 20 bp, synthetic construct
  misc_feature 1..20: note = CRISPR gRNA sequence
  source 1..20: mol_type = other DNA
tcaaatcttgatactcttca

SEQ ID NO: 102915 - DNA, 20 bp, synthetic construct
  misc_feature 1..20: note = CRISPR gRNA sequence
  source 1..20: mol_type = other DNA
aaatttaaatattgctaaat

SEQ ID NO: 102916 - DNA, 20 bp, synthetic construct
  misc_feature 1..20: note = CRISPR gRNA sequence
  source 1..20: mol_type = other DNA
aattggttcatttgtattac

SEQ ID NO: 102917 - DNA, 20 bp, synthetic construct
  misc_feature 1..20: note = CRISPR gRNA sequence
  source 1..20: mol_type = other DNA
tttgtattaccagaataaac

SEQ ID NO: 102918 - DNA, 20 bp, synthetic construct
  misc_feature 1..20: note = CRISPR gRNA sequence
  source 1..20: mol_type = other DNA
attaccagaataaactagtt

SEQ ID NO: 102919 - DNA, 20 bp, synthetic construct
  misc_feature 1..20: note = CRISPR gRNA sequence
  source 1..20: mol_type = other DNA
accagaataaactagttaag

SEQ ID NO: 102920 - DNA, 20 bp, synthetic construct
  misc_feature 1..20: note = CRISPR gRNA sequence
  source 1..20: mol_type = other DNA
aatctgtacgttacatatat

SEQ ID NO: 102921 - DNA, 20 bp, synthetic construct
  misc_feature 1..20: note = CRISPR gRNA sequence
  source 1..20: mol_type = other DNA
tattagtcattatgtgcttc

SEQ ID NO: 102922 - DNA, 20 bp, synthetic construct
  misc_feature 1..20: note = CRISPR gRNA sequence
  source 1..20: mol_type = other DNA
tatgtgcttcaagttatatt

SEQ ID NO: 102923 - DNA, 20 bp, synthetic construct
  misc_feature 1..20: note = CRISPR gRNA sequence
  source 1..20: mol_type = other DNA
aagttatatttagtcttgta

SEQ ID NO: 102924 - DNA, 20 bp, synthetic construct
  misc_feature 1..20: note = CRISPR gRNA sequence
  source 1..20: mol_type = other DNA
cttgtaaagatgtaaacttc

SEQ ID NO: 102925 - DNA, 20 bp, synthetic construct
  misc_feature 1..20: note = CRISPR gRNA sequence
  source 1..20: mol_type = other DNA
agatgtaaacttctggatat

SEQ ID NO: 102926 - DNA, 20 bp, synthetic construct
  misc_feature 1..20: note = CRISPR gRNA sequence
  source 1..20: mol_type = other DNA
taaacttctggatattagtc

SEQ ID NO: 102927 - DNA, 20 bp, synthetic construct
  misc_feature 1..20: note = CRISPR gRNA sequence
  source 1..20: mol_type = other DNA
aaacttctggatattagtca

SEQ ID NO: 102928 - DNA, 20 bp, synthetic construct
  misc_feature 1..20: note = CRISPR gRNA sequence
  source 1..20: mol_type = other DNA
tcaaggaaaaaatctcatat

SEQ ID NO: 102929 - DNA, 20 bp, synthetic construct
  misc_feature 1..20: note = CRISPR gRNA sequence
  source 1..20: mol_type = other DNA
aggaaaaaatctcatataag

SEQ ID NO: 102930 - DNA, 20 bp, synthetic construct
  misc_feature 1..20: note = CRISPR gRNA sequence
  source 1..20: mol_type = other DNA
ggaaaaaatctcatataaga

SEQ ID NO: 102931 - DNA, 20 bp, synthetic construct
  misc_feature 1..20: note = CRISPR gRNA sequence
  source 1..20: mol_type = other DNA
tctcatataagaaggaaatt

SEQ ID NO: 102932 - DNA, 20 bp, synthetic construct
  misc_feature 1..20: note = CRISPR gRNA sequence
  source 1..20: mol_type = other DNA
tcatataagaaggaaatttg

SEQ ID NO: 102933 - DNA, 20 bp, synthetic construct
  misc_feature 1..20: note = CRISPR gRNA sequence
  source 1..20: mol_type = other DNA
ataagaaggaaatttggagt

SEQ ID NO: 102934 - DNA, 20 bp, synthetic construct
  misc_feature 1..20: note = CRISPR gRNA sequence
  source 1..20: mol_type = other DNA
taagaaggaaatttggagtt

SEQ ID NO: 102935 - DNA, 20 bp, synthetic construct
  misc_feature 1..20: note = CRISPR gRNA sequence
  source 1..20: mol_type = other DNA
aagaaggaaatttggagttg

SEQ ID NO: 102936 - DNA, 20 bp, synthetic construct
  misc_feature 1..20: note = CRISPR gRNA sequence
  source 1..20: mol_type = other DNA
gaaggaaatttggagttggg

SEQ ID NO: 102937 - DNA, 20 bp, synthetic construct
  misc_feature 1..20: note = CRISPR gRNA sequence
  source 1..20: mol_type = other DNA
aaggaaatttggagttgggg

SEQ ID NO: 102938 - DNA, 20 bp, synthetic construct
  misc_feature 1..20: note = CRISPR gRNA sequence
  source 1..20: mol_type = other DNA
ggggaggcgttgaaacctaa

SEQ ID NO: 102939 - DNA, 20 bp, synthetic construct
  misc_feature 1..20: note = CRISPR gRNA sequence
  source 1..20: mol_type = other DNA
ttttttaaaatcaatttatt

SEQ ID NO: 102940 - DNA, 20 bp, synthetic construct
  misc_feature 1..20: note = CRISPR gRNA sequence
  source 1..20: mol_type = other DNA
ttttaaaatcaatttattga

SEQ ID NO: 102941 - DNA, 20 bp, synthetic construct
  misc_feature 1..20: note = CRISPR gRNA sequence
  source 1..20: mol_type = other DNA
caatttattgagagatactt

SEQ ID NO: 102942 - DNA, 20 bp, synthetic construct
  misc_feature 1..20: note = CRISPR gRNA sequence
  source 1..20: mol_type = other DNA
tgagagatactttagaaaca

SEQ ID NO: 102943 - DNA, 20 bp, synthetic construct
  misc_feature 1..20: note = CRISPR gRNA sequence
  source 1..20: mol_type = other DNA
ttttaaatgtgtattttgat

SEQ ID NO: 102944 - DNA, 20 bp, synthetic construct
  misc_feature 1..20: note = CRISPR gRNA sequence
  source 1..20: mol_type = other DNA
gtgcaactgctaccacaatg

SEQ ID NO: 102945 - DNA, 20 bp, synthetic construct
  misc_feature 1..20: note = CRISPR gRNA sequence
  source 1..20: mol_type = other DNA
catcaccctacaatgttcct

SEQ ID NO: 102946 - DNA, 20 bp, synthetic construct
  misc_feature 1..20: note = CRISPR gRNA sequence
  source 1..20: mol_type = other DNA
atcaccctacaatgttccta

SEQ ID NO: 102947 - DNA, 20 bp, synthetic construct
  misc_feature 1..20: note = CRISPR gRNA sequence
  source 1..20: mol_type = other DNA
atgttcctaaggctccatgc

SEQ ID NO: 102948 - DNA, 20 bp, synthetic construct
  misc_feature 1..20: note = CRISPR gRNA sequence
  source 1..20: mol_type = other DNA
tccctgtattctccactccc

SEQ ID NO: 102949 - DNA, 20 bp, synthetic construct
  misc_feature 1..20: note = CRISPR gRNA sequence
  source 1..20: mol_type = other DNA
ccctgtattctccactccca

SEQ ID NO: 102950 - DNA, 20 bp, synthetic construct
  misc_feature 1..20: note = CRISPR gRNA sequence
  source 1..20: mol_type = other DNA
actgatccattttctgtctc

SEQ ID NO: 102951 - DNA, 20 bp, synthetic construct
  misc_feature 1..20: note = CRISPR gRNA sequence
  source 1..20: mol_type = other DNA
tctagattactgatgtcttt

SEQ ID NO: 102952 - DNA, 20 bp, synthetic construct
  misc_feature 1..20: note = CRISPR gRNA sequence
  source 1..20: mol_type = other DNA
tagattactgatgtcttttg

SEQ ID NO: 102953 - DNA, 20 bp, synthetic construct
  misc_feature 1..20: note = CRISPR gRNA sequence
  source 1..20: mol_type = other DNA
ttttggagattttatataaa

SEQ ID NO: 102954 - DNA, 20 bp, synthetic construct
  misc_feature 1..20: note = CRISPR gRNA sequence
  source 1..20: mol_type = other DNA
catcataaccttaattttat

SEQ ID NO: 102955 - DNA, 20 bp, synthetic construct
  misc_feature 1..20: note = CRISPR gRNA sequence
  source 1..20: mol_type = other DNA
accttaattttattagttta

SEQ ID NO: 102956 - DNA, 20 bp, synthetic construct
  misc_feature 1..20: note = CRISPR gRNA sequence
  source 1..20: mol_type = other DNA
gccataaatgtattgtgtat

SEQ ID NO: 102957 - DNA, 20 bp, synthetic construct
  misc_feature 1..20: note = CRISPR gRNA sequence
  source 1..20: mol_type = other DNA
cataaatgtattgtgtatta

SEQ ID NO: 102958 - DNA, 20 bp, synthetic construct
  misc_feature 1..20: note = CRISPR gRNA sequence
  source 1..20: mol_type = other DNA
atgtattgtgtattagagac

SEQ ID NO: 102959 - DNA, 20 bp, synthetic construct
  misc_feature 1..20: note = CRISPR gRNA sequence
  source 1..20: mol_type = other DNA
attgtgtattagagacaaga

SEQ ID NO: 102960 - DNA, 20 bp, synthetic construct
  misc_feature 1..20: note = CRISPR gRNA sequence
  source 1..20: mol_type = other DNA
attagagacaagatagaatt

SEQ ID NO: 102961 - DNA, 20 bp, synthetic construct
  misc_feature 1..20: note = CRISPR gRNA sequence
  source 1..20: mol_type = other DNA
ttagagacaagatagaattt

SEQ ID NO: 102962 - DNA, 20 bp, synthetic construct
  misc_feature 1..20: note = CRISPR gRNA sequence
  source 1..20: mol_type = other DNA
tagagacaagatagaattta

SEQ ID NO: 102963 - DNA, 20 bp, synthetic construct
  misc_feature 1..20: note = CRISPR gRNA sequence
  source 1..20: mol_type = other DNA
agacaagatagaatttaggg

SEQ ID NO: 102964 - DNA, 20 bp, synthetic construct
  misc_feature 1..20: note = CRISPR gRNA sequence
  source 1..20: mol_type = other DNA
tagaatttagggaagcctgt

SEQ ID NO: 102965 - DNA, 20 bp, synthetic construct
  misc_feature 1..20: note = CRISPR gRNA sequence
  source 1..20: mol_type = other DNA
aagcctgttagtgcccctaa

SEQ ID NO: 102966 - DNA, 20 bp, synthetic construct
  misc_feature 1..20: note = CRISPR gRNA sequence
  source 1..20: mol_type = other DNA
tagtgcccctaacagactca

SEQ ID NO: 102967 - DNA, 20 bp, synthetic construct
  misc_feature 1..20: note = CRISPR gRNA sequence
  source 1..20: mol_type = other DNA
cccctaacagactcacagtc

SEQ ID NO: 102968 - DNA, 20 bp, synthetic construct
  misc_feature 1..20: note = CRISPR gRNA sequence
  source 1..20: mol_type = other DNA
ctgattttctattctatacc

SEQ ID NO: 102969 - DNA, 20 bp, synthetic construct
  misc_feature 1..20: note = CRISPR gRNA sequence
  source 1..20: mol_type = other DNA
attctatacccagaatctct

SEQ ID NO: 102970 - DNA, 20 bp, synthetic construct
  misc_feature 1..20: note = CRISPR gRNA sequence
  source 1..20: mol_type = other DNA
ttctatacccagaatctctg

SEQ ID NO: 102971 - DNA, 20 bp, synthetic construct
  misc_feature 1..20: note = CRISPR gRNA sequence
  source 1..20: mol_type = other DNA
ctatacccagaatctctgag

SEQ ID NO: 102972 - DNA, 20 bp, synthetic construct
  misc_feature 1..20: note = CRISPR gRNA sequence
  source 1..20: mol_type = other DNA
tacccagaatctctgaggag

SEQ ID NO: 102973 - DNA, 20 bp, synthetic construct
  misc_feature 1..20: note = CRISPR gRNA sequence
  source 1..20: mol_type = other DNA
gaatctctgaggagcagact

SEQ ID NO: 102974 - DNA, 20 bp, synthetic construct
  misc_feature 1..20: note = CRISPR gRNA sequence
  source 1..20: mol_type = other DNA
gacttagtcaaccaattcca

SEQ ID NO: 102975 - DNA, 20 bp, synthetic construct
  misc_feature 1..20: note = CRISPR gRNA sequence
  source 1..20: mol_type = other DNA
cttagtcaaccaattccaaa

SEQ ID NO: 102976 - DNA, 20 bp, synthetic construct
  misc_feature 1..20: note = CRISPR gRNA sequence
  source 1..20: mol_type = other DNA
tcaaccaattccaaagagac

SEQ ID NO: 102977 - DNA, 20 bp, synthetic construct
  misc_feature 1..20: note = CRISPR gRNA sequence
  source 1..20: mol_type = other DNA
aaagagactggtgtaaaaat

SEQ ID NO: 102978 - DNA, 20 bp, synthetic construct
  misc_feature 1..20: note = CRISPR gRNA sequence
  source 1..20: mol_type = other DNA
tggtgtaaaaatcagaaaac

SEQ ID NO: 102979 - DNA, 20 bp, synthetic construct
  misc_feature 1..20: note = CRISPR gRNA sequence
  source 1..20: mol_type = other DNA
tgattatatttgctccctgt

SEQ ID NO: 102980 - DNA, 20 bp, synthetic construct
  misc_feature 1..20: note = CRISPR gRNA sequence
  source 1..20: mol_type = other DNA
ctatatgtaaatccaaatta

SEQ ID NO: 102981 - DNA, 20 bp, synthetic construct
  misc_feature 1..20: note = CRISPR gRNA sequence
  source 1..20: mol_type = other DNA
atgtaaatccaaattatagc

SEQ ID NO: 102982 - DNA, 20 bp, synthetic construct
  misc_feature 1..20: note = CRISPR gRNA sequence
  source 1..20: mol_type = other DNA
attatagctagaaatttacc

SEQ ID NO: 102983 - DNA, 20 bp, synthetic construct
  misc_feature 1..20: note = CRISPR gRNA sequence
  source 1..20: mol_type = other DNA
tagctagaaatttacctagc

SEQ ID NO: 102984 - DNA, 20 bp, synthetic construct
  misc_feature 1..20: note = CRISPR gRNA sequence
  source 1..20: mol_type = other DNA
ttacctagcgagcattccat

SEQ ID NO: 102985 - DNA, 20 bp, synthetic construct
  misc_feature 1..20: note = CRISPR gRNA sequence
  source 1..20: mol_type = other DNA
agcgagcattccattagatc

SEQ ID NO: 102986 - DNA, 20 bp, synthetic construct
  misc_feature 1..20: note = CRISPR gRNA sequence
  source 1..20: mol_type = other DNA
gcgagcattccattagatca

SEQ ID NO: 102987 - DNA, 20 bp, synthetic construct
  misc_feature 1..20: note = CRISPR gRNA sequence
  source 1..20: mol_type = other DNA
cgagcattccattagatcaa

SEQ ID NO: 102988 - DNA, 20 bp, synthetic construct
  misc_feature 1..20: note = CRISPR gRNA sequence
  source 1..20: mol_type = other DNA
gcattccattagatcaaggg

SEQ ID NO: 102989 - DNA, 20 bp, synthetic construct
  misc_feature 1..20: note = CRISPR gRNA sequence
  source 1..20: mol_type = other DNA
ttagatcaagggcagtgctt

SEQ ID NO: 102990 - DNA, 20 bp, synthetic construct
  misc_feature 1..20: note = CRISPR gRNA sequence
  source 1..20: mol_type = other DNA
agatcaagggcagtgctttg

SEQ ID NO: 102991 - DNA, 20 bp, synthetic construct
  misc_feature 1..20: note = CRISPR gRNA sequence
  source 1..20: mol_type = other DNA
cagtgctttggagaaccata

SEQ ID NO: 102992 - DNA, 20 bp, synthetic construct
  misc_feature 1..20: note = CRISPR gRNA sequence
  source 1..20: mol_type = other DNA
ttggagaaccatatggccac

SEQ ID NO: 102993 - DNA, 20 bp, synthetic construct
  misc_feature 1..20: note = CRISPR gRNA sequence
  source 1..20: mol_type = other DNA
gtcctcttgctgtgatgaca

SEQ ID NO: 102994 - DNA, 20 bp, synthetic construct
  misc_feature 1..20: note = CRISPR gRNA sequence
  source 1..20: mol_type = other DNA
atgacatagcctgttattta

SEQ ID NO: 102995 - DNA, 20 bp, synthetic construct
  misc_feature 1..20: note = CRISPR gRNA sequence
  source 1..20: mol_type = other DNA
agcctgttatttatggctca

SEQ ID NO: 102996 - DNA, 20 bp, synthetic construct
  misc_feature 1..20: note = CRISPR gRNA sequence
  source 1..20: mol_type = other DNA
ttcttatgttgtatccattt

SEQ ID NO: 102997 - DNA, 20 bp, synthetic construct
  misc_feature 1..20: note = CRISPR gRNA sequence
  source 1..20: mol_type = other DNA
gttgtatccattttggttat

SEQ ID NO: 102998 - DNA, 20 bp, synthetic construct
  misc_feature 1..20: note = CRISPR gRNA sequence
  source 1..20: mol_type = other DNA
tccattttggttatgagtaa

SEQ ID NO: 102999 - DNA, 20 bp, synthetic construct
  misc_feature 1..20: note = CRISPR gRNA sequence
  source 1..20: mol_type = other DNA
ccattttggttatgagtaat

SEQ ID NO: 103000 - DNA, 20 bp, synthetic construct
  misc_feature 1..20: note = CRISPR gRNA sequence
  source 1..20: mol_type = other DNA
cattttggttatgagtaatg

SEQ ID NO: 103001 - DNA, 20 bp, synthetic construct
  misc_feature 1..20: note = CRISPR gRNA sequence
  source 1..20: mol_type = other DNA
ctaacattccaacattcatt

SEQ ID NO: 103002 - DNA, 20 bp, synthetic construct
  misc_feature 1..20: note = CRISPR gRNA sequence
  source 1..20: mol_type = other DNA
taacattccaacattcattt

SEQ ID NO: 103003 - DNA, 20 bp, synthetic construct
  misc_feature 1..20: note = CRISPR gRNA sequence
  source 1..20: mol_type = other DNA
ccaacattcatttgggaaat

SEQ ID NO: 103004 - DNA, 20 bp, synthetic construct
  misc_feature 1..20: note = CRISPR gRNA sequence
  source 1..20: mol_type = other DNA
atttctcaaaattcttattc

SEQ ID NO: 103005 - DNA, 20 bp, synthetic construct
  misc_feature 1..20: note = CRISPR gRNA sequence
  source 1..20: mol_type = other DNA
aaaattcttattctagaaat

SEQ ID NO: 103006 - DNA, 20 bp, synthetic construct
  misc_feature 1..20: note = CRISPR gRNA sequence
  source 1..20: mol_type = other DNA
ttctagaaataagaattttc

SEQ ID NO: 103007 - DNA, 20 bp, synthetic construct
  misc_feature 1..20: note = CRISPR gRNA sequence
  source 1..20: mol_type = other DNA
aataagaattttcaagtgtg

SEQ ID NO: 103008 - DNA, 20 bp, synthetic construct
  misc_feature 1..20: note = CRISPR gRNA sequence
  source 1..20: mol_type = other DNA
tcaagtgtgcagtgaaatca

SEQ ID NO: 103009 - DNA, 20 bp, synthetic construct
  misc_feature 1..20: note = CRISPR gRNA sequence
  source 1..20: mol_type = other DNA
caagtgtgcagtgaaatcaa

SEQ ID NO: 103010 - DNA, 20 bp, synthetic construct
  misc_feature 1..20: note = CRISPR gRNA sequence
  source 1..20: mol_type = other DNA
ataaacacctgtatacctgc

SEQ ID NO: 103011 - DNA, 20 bp, synthetic construct
  misc_feature 1..20: note = CRISPR gRNA sequence
  source 1..20: mol_type = other DNA
acacctgtatacctgccagt

SEQ ID NO: 103012 - DNA, 20 bp, synthetic construct
  misc_feature 1..20: note = CRISPR gRNA sequence
  source 1..20: mol_type = other DNA
cacctgtatacctgccagtt

SEQ ID NO: 103013 - DNA, 20 bp, synthetic construct
  misc_feature 1..20: note = CRISPR gRNA sequence
  source 1..20: mol_type = other DNA
acctgtatacctgccagtta

SEQ ID NO: 103014 - DNA, 20 bp, synthetic construct
  misc_feature 1..20: note = CRISPR gRNA sequence
  source 1..20: mol_type = other DNA
tcttactataattgccttac

SEQ ID NO: 103015 - DNA, 20 bp, synthetic construct
  misc_feature 1..20: note = CRISPR gRNA sequence
  source 1..20: mol_type = other DNA
ccattttttgatgcatttca

SEQ ID NO: 103016 - DNA, 20 bp, synthetic construct
  misc_feature 1..20: note = CRISPR gRNA sequence
  source 1..20: mol_type = other DNA
atgcatttcaaagtaaattt

SEQ ID NO: 103017 - DNA, 20 bp, synthetic construct
  misc_feature 1..20: note = CRISPR gRNA sequence
  source 1..20: mol_type = other DNA
atatcaatacacttctttct

SEQ ID NO: 103018 - DNA, 20 bp, synthetic construct
  misc_feature 1..20: note = CRISPR gRNA sequence
  source 1..20: mol_type = other DNA
tacacttctttctaagtact

SEQ ID NO: 103019 - DNA, 20 bp, synthetic construct
  misc_feature 1..20: note = CRISPR gRNA sequence
  source 1..20: mol_type = other DNA
tttctaagtacttggacata

SEQ ID NO: 103020 - DNA, 20 bp, synthetic construct
  misc_feature 1..20: note = CRISPR gRNA sequence
  source 1..20: mol_type = other DNA
acatatagttgcacatattt

SEQ ID NO: 103021 - DNA, 20 bp, synthetic construct
  misc_feature 1..20: note = CRISPR gRNA sequence
  source 1..20: mol_type = other DNA
ttcttctttcacactgtatt

SEQ ID NO: 103022 - DNA, 20 bp, synthetic construct
  misc_feature 1..20: note = CRISPR gRNA sequence
  source 1..20: mol_type = other DNA
ttgcaaatgattaattccac

SEQ ID NO: 103023 - DNA, 20 bp, synthetic construct
  misc_feature 1..20: note = CRISPR gRNA sequence
  source 1..20: mol_type = other DNA
attaattccaccagcatgtg

SEQ ID NO: 103024 - DNA, 20 bp, synthetic construct
  misc_feature 1..20: note = CRISPR gRNA sequence
  source 1..20: mol_type = other DNA
caccagcatgtgtggattta

SEQ ID NO: 103025 - DNA, 20 bp, synthetic construct
  misc_feature 1..20: note = CRISPR gRNA sequence
  source 1..20: mol_type = other DNA
ccagcatgtgtggatttatg

SEQ ID NO: 103026 - DNA, 20 bp, synthetic construct
  misc_feature 1..20: note = CRISPR gRNA sequence
  source 1..20: mol_type = other DNA
agcatgtgtggatttatgga

SEQ ID NO: 103027 - DNA, 20 bp, synthetic construct
  misc_feature 1..20: note = CRISPR gRNA sequence
  source 1..20: mol_type = other DNA
atgtgtggatttatggagag

SEQ ID NO: 103028 - DNA, 20 bp, synthetic construct
  misc_feature 1..20: note = CRISPR gRNA sequence
  source 1..20: mol_type = other DNA
ctgtactttgccacgataat

SEQ ID NO: 103029 - DNA, 20 bp, synthetic construct
  misc_feature 1..20: note = CRISPR gRNA sequence
  source 1..20: mol_type = other DNA
tactttgccacgataatgag

SEQ ID NO: 103030 - DNA, 20 bp, synthetic construct
  misc_feature 1..20: note = CRISPR gRNA sequence
  source 1..20: mol_type = other DNA
tgccacgataatgagcagct

SEQ ID NO: 103031 - DNA, 20 bp, synthetic construct
  misc_feature 1..20: note = CRISPR gRNA sequence
  source 1..20: mol_type = other DNA
acgataatgagcagctcagt

SEQ ID NO: 103032 - DNA, 20 bp, synthetic construct
  misc_feature 1..20: note = CRISPR gRNA sequence
  source 1..20: mol_type = other DNA
cgataatgagcagctcagtt

SEQ ID NO: 103033 - DNA, 20 bp, synthetic construct
  misc_feature 1..20: note = CRISPR gRNA sequence
  source 1..20: mol_type = other DNA
ggtcacgtcattttattatt

SEQ ID NO: 103034 - DNA, 20 bp, synthetic construct
  misc_feature 1..20: note = CRISPR gRNA sequence
  source 1..20: mol_type = other DNA
tcattttattattcagatgt

SEQ ID NO: 103035 - DNA, 20 bp, synthetic construct
  misc_feature 1..20: note = CRISPR gRNA sequence
  source 1..20: mol_type = other DNA
attcagatgttggaatttat

SEQ ID NO: 103036 - DNA, 20 bp, synthetic construct
  misc_feature 1..20: note = CRISPR gRNA sequence
  source 1..20: mol_type = other DNA
ttcagatgttggaatttatg

SEQ ID NO: 103037 - DNA, 20 bp, synthetic construct
  misc_feature 1..20: note = CRISPR gRNA sequence
  source 1..20: mol_type = other DNA
tcagatgttggaatttatga

SEQ ID NO: 103038 - DNA, 20 bp, synthetic construct
  misc_feature 1..20: note = CRISPR gRNA sequence
  source 1..20: mol_type = other DNA
tgttggaatttatgagggcc

SEQ ID NO: 103039 - DNA, 20 bp, synthetic construct
  misc_feature 1..20: note = CRISPR gRNA sequence
  source 1..20: mol_type = other DNA
atgagggcctagtgaaaaat

SEQ ID NO: 103040 - DNA, 20 bp, synthetic construct
  misc_feature 1..20: note = CRISPR gRNA sequence
  source 1..20: mol_type = other DNA
gagggcctagtgaaaaatca

SEQ ID NO: 103041 - DNA, 20 bp, synthetic construct
  misc_feature 1..20: note = CRISPR gRNA sequence
  source 1..20: mol_type = other DNA
gggcctagtgaaaaatcaga

SEQ ID NO: 103042 - DNA, 20 bp, synthetic construct
  misc_feature 1..20: note = CRISPR gRNA sequence
  source 1..20: mol_type = other DNA
ctagtgaaaaatcagagaga

SEQ ID NO: 103043 - DNA, 20 bp, synthetic construct
  misc_feature 1..20: note = CRISPR gRNA sequence
  source 1..20: mol_type = other DNA
gtcctccctcccatatttcc

SEQ ID NO: 103044 - DNA, 20 bp, synthetic construct
  misc_feature 1..20: note = CRISPR gRNA sequence
  source 1..20: mol_type = other DNA
atcattttaattttttaatg

SEQ ID NO: 103045 - DNA, 20 bp, synthetic construct
  misc_feature 1..20: note = CRISPR gRNA sequence
  source 1..20: mol_type = other DNA
ttttaatgaagtctttatta

SEQ ID NO: 103046 - DNA, 20 bp, synthetic construct
  misc_feature 1..20: note = CRISPR gRNA sequence
  source 1..20: mol_type = other DNA
tttaatgaagtctttattaa

SEQ ID NO: 103047 - DNA, 20 bp, synthetic construct
  misc_feature 1..20: note = CRISPR gRNA sequence
  source 1..20: mol_type = other DNA
aagtctttattaaaggttct

SEQ ID NO: 103048 - DNA, 20 bp, synthetic construct
  misc_feature 1..20: note = CRISPR gRNA sequence
  source 1..20: mol_type = other DNA
aaaggttctcagatatcatt

SEQ ID NO: 103049 - DNA, 20 bp, synthetic construct
  misc_feature 1..20: note = CRISPR gRNA sequence
  source 1..20: mol_type = other DNA
aattgtatccttatttttaa

SEQ ID NO: 103050 - DNA, 20 bp, synthetic construct
  misc_feature 1..20: note = CRISPR gRNA sequence
  source 1..20: mol_type = other DNA
tgtatccttatttttaaaag

SEQ ID NO: 103051 - DNA, 20 bp, synthetic construct
  misc_feature 1..20: note = CRISPR gRNA sequence
  source 1..20: mol_type = other DNA
aagtggatcttcaactctta

SEQ ID NO: 103052 - DNA, 20 bp, synthetic construct
  misc_feature 1..20: note = CRISPR gRNA sequence
  source 1..20: mol_type = other DNA
cttcaactcttaaagtctat

SEQ ID NO: 103053 - DNA, 20 bp, synthetic construct
  misc_feature 1..20: note = CRISPR gRNA sequence
  source 1..20: mol_type = other DNA
caactcttaaagtctatgag

SEQ ID NO: 103054 - DNA, 20 bp, synthetic construct
  misc_feature 1..20: note = CRISPR gRNA sequence
  source 1..20: mol_type = other DNA
aactcttaaagtctatgaga

SEQ ID NO: 103055 - DNA, 20 bp, synthetic construct
  misc_feature 1..20: note = CRISPR gRNA sequence
  source 1..20: mol_type = other DNA
actcttaaagtctatgagaa

SEQ ID NO: 103056 - DNA, 20 bp, synthetic construct
  misc_feature 1..20: note = CRISPR gRNA sequence
  source 1..20: mol_type = other DNA
taaattttgcctaccatatg

SEQ ID NO: 103057 - DNA, 20 bp, synthetic construct
  misc_feature 1..20: note = CRISPR gRNA sequence
  source 1..20: mol_type = other DNA
attttgcctaccatatgtag

SEQ ID NO: 103058 - DNA, 20 bp, synthetic construct
  misc_feature 1..20: note = CRISPR gRNA sequence
  source 1..20: mol_type = other DNA
ctaccatatgtagtggacct

SEQ ID NO: 103059 - DNA, 20 bp, synthetic construct
  misc_feature 1..20: note = CRISPR gRNA sequence
  source 1..20: mol_type = other DNA
gtggacctgagtaacatgtt

SEQ ID NO: 103060 - DNA, 20 bp, synthetic construct
  misc_feature 1..20: note = CRISPR gRNA sequence
  source 1..20: mol_type = other DNA
gacctgagtaacatgtttgg

SEQ ID NO: 103061 - DNA, 20 bp, synthetic construct
  misc_feature 1..20: note = CRISPR gRNA sequence
  source 1..20: mol_type = other DNA
acctgagtaacatgtttggt

SEQ ID NO: 103062 - DNA, 20 bp, synthetic construct
  misc_feature 1..20: note = CRISPR gRNA sequence
  source 1..20: mol_type = other DNA
tgagtaacatgtttggtggg

SEQ ID NO: 103063 - DNA, 20 bp, synthetic construct
  misc_feature 1..20: note = CRISPR gRNA sequence
  source 1..20: mol_type = other DNA
caattacgtgttacaactta

SEQ ID NO: 103064 - DNA, 20 bp, synthetic construct
  misc_feature 1..20: note = CRISPR gRNA sequence
  source 1..20: mol_type = other DNA
ttacgtgttacaacttaaag

SEQ ID NO: 103065 - DNA, 20 bp, synthetic construct
  misc_feature 1..20: note = CRISPR gRNA sequence
  source 1..20: mol_type = other DNA
taaagaagctttattctcta

SEQ ID NO: 103066 - DNA, 20 bp, synthetic construct
  misc_feature 1..20: note = CRISPR gRNA sequence
  source 1..20: mol_type = other DNA
atatgtgcaaacctgaaaat

SEQ ID NO: 103067 - DNA, 20 bp, synthetic construct
  misc_feature 1..20: note = CRISPR gRNA sequence
  source 1..20: mol_type = other DNA
gcaaacctgaaaatcagtgt

SEQ ID NO: 103068 - DNA, 20 bp, synthetic construct
  misc_feature 1..20: note = CRISPR gRNA sequence
  source 1..20: mol_type = other DNA
caaacctgaaaatcagtgtt

SEQ ID NO: 103069 - DNA, 20 bp, synthetic construct
  misc_feature 1..20: note = CRISPR gRNA sequence
  source 1..20: mol_type = other DNA
gttaggtatgccttgtatca

SEQ ID NO: 103070 - DNA, 20 bp, synthetic construct
  misc_feature 1..20: note = CRISPR gRNA sequence
  source 1..20: mol_type = other DNA
tgccttgtatcaaagtgatg

SEQ ID NO: 103071 - DNA, 20 bp, synthetic construct
  misc_feature 1..20: note = CRISPR gRNA sequence
  source 1..20: mol_type = other DNA
tcaaagtgatgtagcttaac

SEQ ID NO: 103072 - DNA, 20 bp, synthetic construct
  misc_feature 1..20: note = CRISPR gRNA sequence
  source 1..20: mol_type = other DNA
gtagcttaacgagtatctct

SEQ ID NO: 103073 - DNA, 20 bp, synthetic construct
  misc_feature 1..20: note = CRISPR gRNA sequence
  source 1..20: mol_type = other DNA
tagcttaacgagtatctctt

SEQ ID NO: 103074 - DNA, 20 bp, synthetic construct
  misc_feature 1..20: note = CRISPR gRNA sequence
  source 1..20: mol_type = other DNA
aacgagtatctcttaggtgc

SEQ ID NO: 103075 - DNA, 20 bp, synthetic construct
  misc_feature 1..20: note = CRISPR gRNA sequence
  source 1..20: mol_type = other DNA
aggtgcaagtattgctctga

SEQ ID NO: 103076 - DNA, 20 bp, synthetic construct
  misc_feature 1..20: note = CRISPR gRNA sequence
  source 1..20: mol_type = other DNA
tattgctctgacagtattga

SEQ ID NO: 103077 - DNA, 20 bp, synthetic construct
  misc_feature 1..20: note = CRISPR gRNA sequence
  source 1..20: mol_type = other DNA
attgctctgacagtattgaa

SEQ ID NO: 103078 - DNA, 20 bp, synthetic construct
  misc_feature 1..20: note = CRISPR gRNA sequence
  source 1..20: mol_type = other DNA
ctctgacagtattgaaaggt

SEQ ID NO: 103079 - DNA, 20 bp, synthetic construct
  misc_feature 1..20: note = CRISPR gRNA sequence
  source 1..20: mol_type = other DNA
tctgacagtattgaaaggta

SEQ ID NO: 103080 - DNA, 20 bp, synthetic construct
  misc_feature 1..20: note = CRISPR gRNA sequence
  source 1..20: mol_type = other DNA
gtattgaaaggtaaggttgc

SEQ ID NO: 103081 - DNA, 20 bp, synthetic construct
  misc_feature 1..20: note = CRISPR gRNA sequence
  source 1..20: mol_type = other DNA
taaggttgccagtatactga

SEQ ID NO: 103082 - DNA, 20 bp, synthetic construct
  misc_feature 1..20: note = CRISPR gRNA sequence
  source 1..20: mol_type = other DNA
ccagtatactgaaagcattt

SEQ ID NO: 103083 - DNA, 20 bp, synthetic construct
  misc_feature 1..20: note = CRISPR gRNA sequence
  source 1..20: mol_type = other DNA
gcattttagaaacgtgaaaa

SEQ ID NO: 103084 - DNA, 20 bp, synthetic construct
  misc_feature 1..20: note = CRISPR gRNA sequence
  source 1..20: mol_type = other DNA
atgattgtgccatgtaatcc

SEQ ID NO: 103085 - DNA, 20 bp, synthetic construct
  misc_feature 1..20: note = CRISPR gRNA sequence
  source 1..20: mol_type = other DNA
ttaaaaatgatactgaatat

SEQ ID NO: 103086 - DNA, 20 bp, synthetic construct
  misc_feature 1..20: note = CRISPR gRNA sequence
  source 1..20: mol_type = other DNA
atcctgttttcttgcaaata

SEQ ID NO: 103087 - DNA, 20 bp, synthetic construct
  misc_feature 1..20: note = CRISPR gRNA sequence
  source 1..20: mol_type = other DNA
gttttcttgcaaataaagta

SEQ ID NO: 103088 - DNA, 20 bp, synthetic construct
  misc_feature 1..20: note = CRISPR gRNA sequence
  source 1..20: mol_type = other DNA
aagtacagtgataaattatc

SEQ ID NO: 103089 - DNA, 20 bp, synthetic construct
  misc_feature 1..20: note = CRISPR gRNA sequence
  source 1..20: mol_type = other DNA
agtacagtgataaattatcc

SEQ ID NO: 103090 - DNA, 20 bp, synthetic construct
  misc_feature 1..20: note = CRISPR gRNA sequence
  source 1..20: mol_type = other DNA
aattatccaggttaattgtc

SEQ ID NO: 103091 - DNA, 20 bp, synthetic construct
  misc_feature 1..20: note = CRISPR gRNA sequence
  source 1..20: mol_type = other DNA
atccaggttaattgtctggt

SEQ ID NO: 103092 - DNA, 20 bp, synthetic construct
  misc_feature 1..20: note = CRISPR gRNA sequence
  source 1..20: mol_type = other DNA
tccaggttaattgtctggta

SEQ ID NO: 103093 - DNA, 20 bp, synthetic construct
  misc_feature 1..20: note = CRISPR gRNA sequence
  source 1..20: mol_type = other DNA
ctttattgacaatctcactt

SEQ ID NO: 103094 - DNA, 20 bp, synthetic construct
  misc_feature 1..20: note = CRISPR gRNA sequence
  source 1..20: mol_type = other DNA
ttctttccccacctttctaa

SEQ ID NO: 103095 - DNA, 20 bp, synthetic construct
  misc_feature 1..20: note = CRISPR gRNA sequence
  source 1..20: mol_type = other DNA
tctttccccacctttctaac

SEQ ID NO: 103096 - DNA, 20 bp, synthetic construct
  misc_feature 1..20: note = CRISPR gRNA sequence
  source 1..20: mol_type = other DNA
tttccccacctttctaacag

SEQ ID NO: 103097 - DNA, 20 bp, synthetic construct
  misc_feature 1..20: note = CRISPR gRNA sequence
  source 1..20: mol_type = other DNA
tctaacaggagtgtacctca

SEQ ID NO: 103098 - DNA, 20 bp, synthetic construct
  misc_feature 1..20: note = CRISPR gRNA sequence
  source 1..20: mol_type = other DNA
gagtgtacctcacagccttc

SEQ ID NO: 103099 - DNA, 20 bp, synthetic construct
  misc_feature 1..20: note = CRISPR gRNA sequence
  source 1..20: mol_type = other DNA
agtgtacctcacagccttct

SEQ ID NO: 103100 - DNA, 20 bp, synthetic construct
  misc_feature 1..20: note = CRISPR gRNA sequence
  source 1..20: mol_type = other DNA
tcacagccttctaggatctc

SEQ ID NO: 103101 - DNA, 20 bp, synthetic construct
  misc_feature 1..20: note = CRISPR gRNA sequence
  source 1..20: mol_type = other DNA
acagccttctaggatctcca

SEQ ID NO: 103102 - DNA, 20 bp, synthetic construct
  misc_feature 1..20: note = CRISPR gRNA sequence
  source 1..20: mol_type = other DNA
gccttctaggatctccagag

SEQ ID NO: 103103 - DNA, 20 bp, synthetic construct
  misc_feature 1..20: note = CRISPR gRNA sequence
  source 1..20: mol_type = other DNA
tctaggatctccagagtgga

SEQ ID NO: 103104 - DNA, 20 bp, synthetic construct
  misc_feature 1..20: note = CRISPR gRNA sequence
  source 1..20: mol_type = other DNA
ctaggatctccagagtggac

SEQ ID NO: 103105 - DNA, 20 bp, synthetic construct
  misc_feature 1..20: note = CRISPR gRNA sequence
  source 1..20: mol_type = other DNA
gagtggacaggaatctcact

SEQ ID NO: 103106 - DNA, 20 bp, synthetic construct
  misc_feature 1..20: note = CRISPR gRNA sequence
  source 1..20: mol_type = other DNA
gtggacaggaatctcacttg

SEQ ID NO: 103107 - DNA, 20 bp, synthetic construct
  misc_feature 1..20: note = CRISPR gRNA sequence
  source 1..20: mol_type = other DNA
tggacaggaatctcacttgg

SEQ ID NO: 103108 - DNA, 20 bp, synthetic construct
  misc_feature 1..20: note = CRISPR gRNA sequence
  source 1..20: mol_type = other DNA
ggacaggaatctcacttgga

SEQ ID NO: 103109 - DNA, 20 bp, synthetic construct
  misc_feature 1..20: note = CRISPR gRNA sequence
  source 1..20: mol_type = other DNA
aatctcacttggagggacca

SEQ ID NO: 103110 - DNA, 20 bp, synthetic construct
  misc_feature 1..20: note = CRISPR gRNA sequence
  source 1..20: mol_type = other DNA
tctcacttggagggaccatg

SEQ ID NO: 103111 - DNA, 20 bp, synthetic construct
  misc_feature 1..20: note = CRISPR gRNA sequence
  source 1..20: mol_type = other DNA
cacttggagggaccatggag

SEQ ID NO: 103112 - DNA, 20 bp, synthetic construct
  misc_feature 1..20: note = CRISPR gRNA sequence
  source 1..20: mol_type = other DNA
agggaccatggagcagtata

SEQ ID NO: 103113 - DNA, 20 bp, synthetic construct
  misc_feature 1..20: note = CRISPR gRNA sequence
  source 1..20: mol_type = other DNA
atggagcagtatacagcaaa

SEQ ID NO: 103114 - DNA, 20 bp, synthetic construct
  misc_feature 1..20: note = CRISPR gRNA sequence
  source 1..20: mol_type = other DNA
cagtatacagcaaacagcaa

SEQ ID NO: 103115 - DNA, 20 bp, synthetic construct
  misc_feature 1..20: note = CRISPR gRNA sequence
  source 1..20: mol_type = other DNA
agcaaacagcaatagttcga

SEQ ID NO: 103116 - DNA, 20 bp, synthetic construct
  misc_feature 1..20: note = CRISPR gRNA sequence
  source 1..20: mol_type = other DNA
caaacagcaatagttcgaca

SEQ ID NO: 103117 - DNA, 20 bp, synthetic construct
  misc_feature 1..20: note = CRISPR gRNA sequence
  source 1..20: mol_type = other DNA
acagcaatagttcgacagag

SEQ ID NO: 103118 - DNA, 20 bp, synthetic construct
  misc_feature 1..20: note = CRISPR gRNA sequence
  source 1..20: mol_type = other DNA
cgacagagcagattgttgtc

SEQ ID NO: 103119 - DNA, 20 bp, synthetic construct
  misc_feature 1..20: note = CRISPR gRNA sequence
  source 1..20: mol_type = other DNA
gacagagcagattgttgtcc

SEQ ID NO: 103120 - DNA, 20 bp, synthetic construct
  misc_feature 1..20: note = CRISPR gRNA sequence
  source 1..20: mol_type = other DNA
agagcagattgttgtccagg

SEQ ID NO: 103121 - DNA, 20 bp, synthetic construct
  misc_feature 1..20: note = CRISPR gRNA sequence
  source 1..20: mol_type = other DNA
gagcagattgttgtccaggc

SEQ ID NO: 103122 - DNA, 20 bp, synthetic construct
  misc_feature 1..20: note = CRISPR gRNA sequence
  source 1..20: mol_type = other DNA
agattgttgtccaggcagga

SEQ ID NO: 103123 - DNA, 20 bp, synthetic construct
  misc_feature 1..20: note = CRISPR gRNA sequence
  source 1..20: mol_type = other DNA
ttgtccaggcaggacagatt

SEQ ID NO: 103124 - DNA, 20 bp, synthetic construct
  misc_feature 1..20: note = CRISPR gRNA sequence
  source 1..20: mol_type = other DNA
tccaggcaggacagattcag

SEQ ID NO: 103125 - DNA, 20 bp, synthetic construct
  misc_feature 1..20: note = CRISPR gRNA sequence
  source 1..20: mol_type = other DNA
aggcaggacagattcagcag

SEQ ID NO: 103126 - DNA, 20 bp, synthetic construct
  misc_feature 1..20: note = CRISPR gRNA sequence
  source 1..20: mol_type = other DNA
ggcaggacagattcagcagc

SEQ ID NO: 103127 - DNA, 20 bp, synthetic construct
  misc_feature 1..20: note = CRISPR gRNA sequence
  source 1..20: mol_type = other DNA
gacagattcagcagcaggta

SEQ ID NO: 103128 - DNA, 20 bp, synthetic construct
  misc_feature 1..20: note = CRISPR gRNA sequence
  source 1..20: mol_type = other DNA
agattcagcagcaggtatgg

SEQ ID NO: 103129 - DNA, 20 bp, synthetic construct
  misc_feature 1..20: note = CRISPR gRNA sequence
  source 1..20: mol_type = other DNA
caaaactgctttaaacatta

SEQ ID NO: 103130 - DNA, 20 bp, synthetic construct
  misc_feature 1..20: note = CRISPR gRNA sequence
  source 1..20: mol_type = other DNA
tacagcaatgaaactgataa

SEQ ID NO: 103131 - DNA, 20 bp, synthetic construct
  misc_feature 1..20: note = CRISPR gRNA sequence
  source 1..20: mol_type = other DNA
tgataacagcaccactcaat

SEQ ID NO: 103132 - DNA, 20 bp, synthetic construct
  misc_feature 1..20: note = CRISPR gRNA sequence
  source 1..20: mol_type = other DNA
aacagcaccactcaattggt

SEQ ID NO: 103133 - DNA, 20 bp, synthetic construct
  misc_feature 1..20: note = CRISPR gRNA sequence
  source 1..20: mol_type = other DNA
aattggttggtctattgccc

SEQ ID NO: 103134 - DNA, 20 bp, synthetic construct
  misc_feature 1..20: note = CRISPR gRNA sequence
  source 1..20: mol_type = other DNA
attggttggtctattgccct

SEQ ID NO: 103135 - DNA, 20 bp, synthetic construct
  misc_feature 1..20: note = CRISPR gRNA sequence
  source 1..20: mol_type = other DNA
ttggttggtctattgccctg

SEQ ID NO: 103136 - DNA, 20 bp, synthetic construct
  misc_feature 1..20: note = CRISPR gRNA sequence
  source 1..20: mol_type = other DNA
tgccctggggaattatttga

SEQ ID NO: 103137 - DNA, 20 bp, synthetic construct
  misc_feature 1..20: note = CRISPR gRNA sequence
  source 1..20: mol_type = other DNA
gggaattatttgaaagatac

SEQ ID NO: 103138 - DNA, 20 bp, synthetic construct
  misc_feature 1..20: note = CRISPR gRNA sequence
  source 1..20: mol_type = other DNA
tgaaagataccagatcttgt

SEQ ID NO: 103139 - DNA, 20 bp, synthetic construct
  misc_feature 1..20: note = CRISPR gRNA sequence
  source 1..20: mol_type = other DNA
taccagatcttgtgagatat

SEQ ID NO: 103140 - DNA, 20 bp, synthetic construct
  misc_feature 1..20: note = CRISPR gRNA sequence
  source 1..20: mol_type = other DNA
accagatcttgtgagatatt

SEQ ID NO: 103141 - DNA, 20 bp, synthetic construct
  misc_feature 1..20: note = CRISPR gRNA sequence
  source 1..20: mol_type = other DNA
ttgtgagatattgggtctga

SEQ ID NO: 103142 - DNA, 20 bp, synthetic construct
  misc_feature 1..20: note = CRISPR gRNA sequence
  source 1..20: mol_type = other DNA
ttgtgctgaaatgccatgtc

SEQ ID NO: 103143 - DNA, 20 bp, synthetic construct
  misc_feature 1..20: note = CRISPR gRNA sequence
  source 1..20: mol_type = other DNA
atgtctagcccatgaccact

SEQ ID NO: 103144 - DNA, 20 bp, synthetic construct
  misc_feature 1..20: note = CRISPR gRNA sequence
  source 1..20: mol_type = other DNA
cacttagaatctactcttca

SEQ ID NO: 103145 - DNA, 20 bp, synthetic construct
  misc_feature 1..20: note = CRISPR gRNA sequence
  source 1..20: mol_type = other DNA
acttagaatctactcttcat

SEQ ID NO: 103146 - DNA, 20 bp, synthetic construct
  misc_feature 1..20: note = CRISPR gRNA sequence
  source 1..20: mol_type = other DNA
atctactcttcatgggtgcc

SEQ ID NO: 103147 - DNA, 20 bp, synthetic construct
  misc_feature 1..20: note = CRISPR gRNA sequence
  source 1..20: mol_type = other DNA
tcttcatgggtgcctggtta

SEQ ID NO: 103148 - DNA, 20 bp, synthetic construct
  misc_feature 1..20: note = CRISPR gRNA sequence
  source 1..20: mol_type = other DNA
tgcctcttttatctcatttt

SEQ ID NO: 103149 - DNA, 20 bp, synthetic construct
  misc_feature 1..20: note = CRISPR gRNA sequence
  source 1..20: mol_type = other DNA
tcattttaagtaaaaacatc

SEQ ID NO: 103150 - DNA, 20 bp, synthetic construct
  misc_feature 1..20: note = CRISPR gRNA sequence
  source 1..20: mol_type = other DNA
ttaagtaaaaacatctagtc

SEQ ID NO: 103151 - DNA, 20 bp, synthetic construct
  misc_feature 1..20: note = CRISPR gRNA sequence
  source 1..20: mol_type = other DNA
aaaacatctagtctggtttt

SEQ ID NO: 103152 - DNA, 20 bp, synthetic construct
  misc_feature 1..20: note = CRISPR gRNA sequence
  source 1..20: mol_type = other DNA
catctagtctggttttcaga

SEQ ID NO: 103153 - DNA, 20 bp, synthetic construct
  misc_feature 1..20: note = CRISPR gRNA sequence
  source 1..20: mol_type = other DNA
ctggttttcagatggaaatt

SEQ ID NO: 103154 - DNA, 20 bp, synthetic construct
  misc_feature 1..20: note = CRISPR gRNA sequence
  source 1..20: mol_type = other DNA
tttggactttaaaatttttc

SEQ ID NO: 103155 - DNA, 20 bp, synthetic construct
  misc_feature 1..20: note = CRISPR gRNA sequence
  source 1..20: mol_type = other DNA
aaatttttctggattctatt

SEQ ID NO: 103156 - DNA, 20 bp, synthetic construct
  misc_feature 1..20: note = CRISPR gRNA sequence
  source 1..20: mol_type = other DNA
gtctttttctcttcttgttt

SEQ ID NO: 103157 - DNA, 20 bp, synthetic construct
  misc_feature 1..20: note = CRISPR gRNA sequence
  source 1..20: mol_type = other DNA
gtttgagctaacttgtgatt

SEQ ID NO: 103158 - DNA, 20 bp, synthetic construct
  misc_feature 1..20: note = CRISPR gRNA sequence
  source 1..20: mol_type = other DNA
gagctaacttgtgatttagt

SEQ ID NO: 103159 - DNA, 20 bp, synthetic construct
  misc_feature 1..20: note = CRISPR gRNA sequence
  source 1..20: mol_type = other DNA
cttgtgatttagtaagtctt

SEQ ID NO: 103160 - DNA, 20 bp, synthetic construct
  misc_feature 1..20: note = CRISPR gRNA sequence
  source 1..20: mol_type = other DNA
tagtaagtctttggccacaa

SEQ ID NO: 103161 - DNA, 20 bp, synthetic construct
  misc_feature 1..20: note = CRISPR gRNA sequence
  source 1..20: mol_type = other DNA
ccacaacagacaaaccaaca

SEQ ID NO: 103162 - DNA, 20 bp, synthetic construct
  misc_feature 1..20: note = CRISPR gRNA sequence
  source 1..20: mol_type = other DNA
aaatcttctgttttttgatt

SEQ ID NO: 103163 - DNA, 20 bp, synthetic construct
  misc_feature 1..20: note = CRISPR gRNA sequence
  source 1..20: mol_type = other DNA
ggtctgccacattttttatt

SEQ ID NO: 103164 - DNA, 20 bp, synthetic construct
  misc_feature 1..20: note = CRISPR gRNA sequence
  source 1..20: mol_type = other DNA
gccacattttttattcagaa

SEQ ID NO: 103165 - DNA, 20 bp, synthetic construct
  misc_feature 1..20: note = CRISPR gRNA sequence
  source 1..20: mol_type = other DNA
ttttttattcagaaaagctc

SEQ ID NO: 103166 - DNA, 20 bp, synthetic construct
  misc_feature 1..20: note = CRISPR gRNA sequence
  source 1..20: mol_type = other DNA
gaaaagctctggtttaacat

SEQ ID NO: 103167 - DNA, 20 bp, synthetic construct
  misc_feature 1..20: note = CRISPR gRNA sequence
  source 1..20: mol_type = other DNA
aaaagctctggtttaacatt

SEQ ID NO: 103168 - DNA, 20 bp, synthetic construct
  misc_feature 1..20: note = CRISPR gRNA sequence
  source 1..20: mol_type = other DNA
tttaacattaggataatatt

SEQ ID NO: 103169 - DNA, 20 bp, synthetic construct
  misc_feature 1..20: note = CRISPR gRNA sequence
  source 1..20: mol_type = other DNA
acattaggataatatttaga

SEQ ID NO: 103170 - DNA, 20 bp, synthetic construct
  misc_feature 1..20: note = CRISPR gRNA sequence
  source 1..20: mol_type = other DNA
tatttagacagccattctta

SEQ ID NO: 103171 - DNA, 20 bp, synthetic construct
  misc_feature 1..20: note = CRISPR gRNA sequence
  source 1..20: mol_type = other DNA
agacagccattcttatggat

SEQ ID NO: 103172 - DNA, 20 bp, synthetic construct
  misc_feature 1..20: note = CRISPR gRNA sequence
  source 1..20: mol_type = other DNA
ttcttatggataagacatac

SEQ ID NO: 103173 - DNA, 20 bp, synthetic construct
  misc_feature 1..20: note = CRISPR gRNA sequence
  source 1..20: mol_type = other DNA
tatggataagacatactaga

SEQ ID NO: 103174 - DNA, 20 bp, synthetic construct
  misc_feature 1..20: note = CRISPR gRNA sequence
  source 1..20: mol_type = other DNA
atggataagacatactagaa

SEQ ID NO: 103175 - DNA, 20 bp, synthetic construct
  misc_feature 1..20: note = CRISPR gRNA sequence
  source 1..20: mol_type = other DNA
agaaaggaattccctgctgc

SEQ ID NO: 103176 - DNA, 20 bp, synthetic construct
  misc_feature 1..20: note = CRISPR gRNA sequence
  source 1..20: mol_type = other DNA
gctggtttattcctaattaa

SEQ ID NO: 103177 - DNA, 20 bp, synthetic construct
  misc_feature 1..20: note = CRISPR gRNA sequence
  source 1..20: mol_type = other DNA
tgctttcttgaatttataca

SEQ ID NO: 103178 - DNA, 20 bp, synthetic construct
  misc_feature 1..20: note = CRISPR gRNA sequence
  source 1..20: mol_type = other DNA
gctttcttgaatttatacac

SEQ ID NO: 103179 - DNA, 20 bp, synthetic construct
  misc_feature 1..20: note = CRISPR gRNA sequence
  source 1..20: mol_type = other DNA
attttctgatgctttatgct

SEQ ID NO: 103180 - DNA, 20 bp, synthetic construct
  misc_feature 1..20: note = CRISPR gRNA sequence
  source 1..20: mol_type = other DNA
ttttctgatgctttatgctt

SEQ ID NO: 103181 - DNA, 20 bp, synthetic construct
  misc_feature 1..20: note = CRISPR gRNA sequence
  source 1..20: mol_type = other DNA
ctttatgcttgggtttatta

SEQ ID NO: 103182 - DNA, 20 bp, synthetic construct
  misc_feature 1..20: note = CRISPR gRNA sequence
  source 1..20: mol_type = other DNA
tttcacttttttccccaccc

SEQ ID NO: 103183 - DNA, 20 bp, synthetic construct
  misc_feature 1..20: note = CRISPR gRNA sequence
  source 1..20: mol_type = other DNA
cacttttttccccaccccag

SEQ ID NO: 103184 - DNA, 20 bp, synthetic construct
  misc_feature 1..20: note = CRISPR gRNA sequence
  source 1..20: mol_type = other DNA
attatgtttctatttgacct

SEQ ID NO: 103185 - DNA, 20 bp, synthetic construct
  misc_feature 1..20: note = CRISPR gRNA sequence
  source 1..20: mol_type = other DNA
ttatgtttctatttgacctt

SEQ ID NO: 103186 - DNA, 20 bp, synthetic construct
  misc_feature 1..20: note = CRISPR gRNA sequence
  source 1..20: mol_type = other DNA
tttctatttgaccttaggcc

SEQ ID NO: 103187 - DNA, 20 bp, synthetic construct
  misc_feature 1..20: note = CRISPR gRNA sequence
  source 1..20: mol_type = other DNA
ttaggccaagattgatattt

SEQ ID NO: 103188 - DNA, 20 bp, synthetic construct
  misc_feature 1..20: note = CRISPR gRNA sequence
  source 1..20: mol_type = other DNA
gaaatactttgttttcaaaa

SEQ ID NO: 103189 - DNA, 20 bp, synthetic construct
  misc_feature 1..20: note = CRISPR gRNA sequence
  source 1..20: mol_type = other DNA
tttgttttcaaaatggaatt

SEQ ID NO: 103190 - DNA, 20 bp, synthetic construct
  misc_feature 1..20: note = CRISPR gRNA sequence
  source 1..20: mol_type = other DNA
aaaatggaatttagctaata

SEQ ID NO: 103191 - DNA, 20 bp, synthetic construct
  misc_feature 1..20: note = CRISPR gRNA sequence
  source 1..20: mol_type = other DNA
ggaatttagctaatatagaa

SEQ ID NO: 103192 - DNA, 20 bp, synthetic construct
  misc_feature 1..20: note = CRISPR gRNA sequence
  source 1..20: mol_type = other DNA
atttagctaatatagaaaag

SEQ ID NO: 103193 - DNA, 20 bp, synthetic construct
  misc_feature 1..20: note = CRISPR gRNA sequence
  source 1..20: mol_type = other DNA
tagctaatatagaaaagtag

SEQ ID NO: 103194 - DNA, 20 bp, synthetic construct
  misc_feature 1..20: note = CRISPR gRNA sequence
  source 1..20: mol_type = other DNA
agctaatatagaaaagtagt

SEQ ID NO: 103195 - DNA, 20 bp, synthetic construct
  misc_feature 1..20: note = CRISPR gRNA sequence
  source 1..20: mol_type = other DNA
gctaatatagaaaagtagta

SEQ ID NO: 103196 - DNA, 20 bp, synthetic construct
  misc_feature 1..20: note = CRISPR gRNA sequence
  source 1..20: mol_type = other DNA
aatatagaaaagtagtaggg

SEQ ID NO: 103197 - DNA, 20 bp, synthetic construct
  misc_feature 1..20: note = CRISPR gRNA sequence
  source 1..20: mol_type = other DNA
atatagaaaagtagtaggga

SEQ ID NO: 103198 - DNA, 20 bp, synthetic construct
  misc_feature 1..20: note = CRISPR gRNA sequence
  source 1..20: mol_type = other DNA
tatagaaaagtagtagggaa

SEQ ID NO: 103199 - DNA, 20 bp, synthetic construct
  misc_feature 1..20: note = CRISPR gRNA sequence
  source 1..20: mol_type = other DNA
gaaaagtagtagggaaggga

SEQ ID NO: 103200 - DNA, 20 bp, synthetic construct
  misc_feature 1..20: note = CRISPR gRNA sequence
  source 1..20: mol_type = other DNA
aaaagtagtagggaagggaa

SEQ ID NO: 103201 - DNA, 20 bp, synthetic construct
  misc_feature 1..20: note = CRISPR gRNA sequence
  source 1..20: mol_type = other DNA
agtagtagggaagggaaagg

SEQ ID NO: 103202 - DNA, 20 bp, synthetic construct
  misc_feature 1..20: note = CRISPR gRNA sequence
  source 1..20: mol_type = other DNA
ggaaaggtagtattgatgat

SEQ ID NO: 103203 - DNA, 20 bp, synthetic construct
  misc_feature 1..20: note = CRISPR gRNA sequence
  source 1..20: mol_type = other DNA
tttttcccgtctaatgatca

SEQ ID NO: 103204 - DNA, 20 bp, synthetic construct
  misc_feature 1..20: note = CRISPR gRNA sequence
  source 1..20: mol_type = other DNA
tcaaagacgaactcccctga

SEQ ID NO: 103205 - DNA, 20 bp, synthetic construct
  misc_feature 1..20: note = CRISPR gRNA sequence
  source 1..20: mol_type = other DNA
tgatagctttcccttccata

SEQ ID NO: 103206 - DNA, 20 bp, synthetic construct
  misc_feature 1..20: note = CRISPR gRNA sequence
  source 1..20: mol_type = other DNA
tcccttccatacagctgctg

SEQ ID NO: 103207 - DNA, 20 bp, synthetic construct
  misc_feature 1..20: note = CRISPR gRNA sequence
  source 1..20: mol_type = other DNA
ccatacagctgctgtggctc

SEQ ID NO: 103208 - DNA, 20 bp, synthetic construct
  misc_feature 1..20: note = CRISPR gRNA sequence
  source 1..20: mol_type = other DNA
tacagctgctgtggctctgg

SEQ ID NO: 103209 - DNA, 20 bp, synthetic construct
  misc_feature 1..20: note = CRISPR gRNA sequence
  source 1..20: mol_type = other DNA
gtttccttcaactgcctttt

SEQ ID NO: 103210 - DNA, 20 bp, synthetic construct
  misc_feature 1..20: note = CRISPR gRNA sequence
  source 1..20: mol_type = other DNA
ttccttcaactgccttttta

SEQ ID NO: 103211 - DNA, 20 bp, synthetic construct
  misc_feature 1..20: note = CRISPR gRNA sequence
  source 1..20: mol_type = other DNA
tccttcaactgcctttttag

SEQ ID NO: 103212 - DNA, 20 bp, synthetic construct
  misc_feature 1..20: note = CRISPR gRNA sequence
  source 1..20: mol_type = other DNA
ttcaactgcctttttagagg

SEQ ID NO: 103213 - DNA, 20 bp, synthetic construct
  misc_feature 1..20: note = CRISPR gRNA sequence
  source 1..20: mol_type = other DNA
tcaactgcctttttagagga

SEQ ID NO: 103214 - DNA, 20 bp, synthetic construct
  misc_feature 1..20: note = CRISPR gRNA sequence
  source 1..20: mol_type = other DNA
caactgcctttttagaggaa

SEQ ID NO: 103215 - DNA, 20 bp, synthetic construct
  misc_feature 1..20: note = CRISPR gRNA sequence
  source 1..20: mol_type = other DNA
ttagaggaagggattccaca

SEQ ID NO: 103216 - DNA, 20 bp, synthetic construct
  misc_feature 1..20: note = CRISPR gRNA sequence
  source 1..20: mol_type = other DNA
tagaggaagggattccacaa

SEQ ID NO: 103217 - DNA, 20 bp, synthetic construct
  misc_feature 1..20: note = CRISPR gRNA sequence
  source 1..20: mol_type = other DNA
agaggaagggattccacaaa

SEQ ID NO: 103218 - DNA, 20 bp, synthetic construct
  misc_feature 1..20: note = CRISPR gRNA sequence
  source 1..20: mol_type = other DNA
aaagggccctccattcacac

SEQ ID NO: 103219 - DNA, 20 bp, synthetic construct
  misc_feature 1..20: note = CRISPR gRNA sequence
  source 1..20: mol_type = other DNA
ctccattcacaccagtgccc

SEQ ID NO: 103220 - DNA, 20 bp, synthetic construct
  misc_feature 1..20: note = CRISPR gRNA sequence
  source 1..20: mol_type = other DNA
ccattcacaccagtgccctg

SEQ ID NO: 103221 - DNA, 20 bp, synthetic construct
  misc_feature 1..20: note = CRISPR gRNA sequence
  source 1..20: mol_type = other DNA
cattcacaccagtgccctgg

SEQ ID NO: 103222 - DNA, 20 bp, synthetic construct
  misc_feature 1..20: note = CRISPR gRNA sequence
  source 1..20: mol_type = other DNA
attcacaccagtgccctgga

SEQ ID NO: 103223 - DNA, 20 bp, synthetic construct
  misc_feature 1..20: note = CRISPR gRNA sequence
  source 1..20: mol_type = other DNA
cacaccagtgccctggaggg

SEQ ID NO: 103224 - DNA, 20 bp, synthetic construct
  misc_feature 1..20: note = CRISPR gRNA sequence
  source 1..20: mol_type = other DNA
acaccagtgccctggagggt

SEQ ID NO: 103225 - DNA, 20 bp, synthetic construct
  misc_feature 1..20: note = CRISPR gRNA sequence
  source 1..20: mol_type = other DNA
agggtgggtttttattcttt

SEQ ID NO: 103226 - DNA, 20 bp, synthetic construct
  misc_feature 1..20: note = CRISPR gRNA sequence
  source 1..20: mol_type = other DNA
attctttcagaatttgccat

SEQ ID NO: 103227 - DNA, 20 bp, synthetic construct
  misc_feature 1..20: note = CRISPR gRNA sequence
  source 1..20: mol_type = other DNA
ctttcagaatttgccattag

SEQ ID NO: 103228 - DNA, 20 bp, synthetic construct
  misc_feature 1..20: note = CRISPR gRNA sequence
  source 1..20: mol_type = other DNA
ccattagtggatgtaaaaat

SEQ ID NO: 103229 - DNA, 20 bp, synthetic construct
  misc_feature 1..20: note = CRISPR gRNA sequence
  source 1..20: mol_type = other DNA
cattagtggatgtaaaaata

SEQ ID NO: 103230 - DNA, 20 bp, synthetic construct
  misc_feature 1..20: note = CRISPR gRNA sequence
  source 1..20: mol_type = other DNA
aggttgaatcattgaaaaca

SEQ ID NO: 103231 - DNA, 20 bp, synthetic construct
  misc_feature 1..20: note = CRISPR gRNA sequence
  source 1..20: mol_type = other DNA
cattgaaaacatggctctta

SEQ ID NO: 103232 - DNA, 20 bp, synthetic construct
  misc_feature 1..20: note = CRISPR gRNA sequence
  source 1..20: mol_type = other DNA
tgaaaacatggctcttaaag

SEQ ID NO: 103233 - DNA, 20 bp, synthetic construct
  misc_feature 1..20: note = CRISPR gRNA sequence
  source 1..20: mol_type = other DNA
acatggctcttaaagcagtc

SEQ ID NO: 103234 - DNA, 20 bp, synthetic construct
  misc_feature 1..20: note = CRISPR gRNA sequence
  source 1..20: mol_type = other DNA
ggctcttaaagcagtccagt

SEQ ID NO: 103235 - DNA, 20 bp, synthetic construct
  misc_feature 1..20: note = CRISPR gRNA sequence
  source 1..20: mol_type = other DNA
gctcttaaagcagtccagtt

SEQ ID NO: 103236 - DNA, 20 bp, synthetic construct
  misc_feature 1..20: note = CRISPR gRNA sequence
  source 1..20: mol_type = other DNA
cttaaagcagtccagttggg

SEQ ID NO: 103237 - DNA, 20 bp, synthetic construct
  misc_feature 1..20: note = CRISPR gRNA sequence
  source 1..20: mol_type = other DNA
cagttgggtagaaataatct

SEQ ID NO: 103238 - DNA, 20 bp, synthetic construct
  misc_feature 1..20: note = CRISPR gRNA sequence
  source 1..20: mol_type = other DNA
tagaaataatcttagttttg

SEQ ID NO: 103239 - DNA, 20 bp, synthetic construct
  misc_feature 1..20: note = CRISPR gRNA sequence
  source 1..20: mol_type = other DNA
aataatcttagttttgaagc

SEQ ID NO: 103240 - DNA, 20 bp, synthetic construct
  misc_feature 1..20: note = CRISPR gRNA sequence
  source 1..20: mol_type = other DNA
ataatcttagttttgaagct

SEQ ID NO: 103241 - DNA, 20 bp, synthetic construct
  misc_feature 1..20: note = CRISPR gRNA sequence
  source 1..20: mol_type = other DNA
cttagttttgaagctgggca

SEQ ID NO: 103242 - DNA, 20 bp, synthetic construct
  misc_feature 1..20: note = CRISPR gRNA sequence
  source 1..20: mol_type = other DNA
gtgctgcatgcctgtaatcc

SEQ ID NO: 103243 - DNA, 20 bp, synthetic construct
  misc_feature 1..20: note = CRISPR gRNA sequence
  source 1..20: mol_type = other DNA
gcctgtaatcccagctactc

SEQ ID NO: 103244 - DNA, 20 bp, synthetic construct
  misc_feature 1..20: note = CRISPR gRNA sequence
  source 1..20: mol_type = other DNA
ctgtaatcccagctactctg

SEQ ID NO: 103245 - DNA, 20 bp, synthetic construct
  misc_feature 1..20: note = CRISPR gRNA sequence
  source 1..20: mol_type = other DNA
tgtaatcccagctactctgg

SEQ ID NO: 103246 - DNA, 20 bp, synthetic construct
  misc_feature 1..20: note = CRISPR gRNA sequence
  source 1..20: mol_type = other DNA
tcccagctactctggaggct

SEQ ID NO: 103247 - DNA, 20 bp, synthetic construct
  misc_feature 1..20: note = CRISPR gRNA sequence
  source 1..20: mol_type = other DNA
agctactctggaggctgaga

SEQ ID NO: 103248 - DNA, 20 bp, synthetic construct
  misc_feature 1..20: note = CRISPR gRNA sequence
  source 1..20: mol_type = other DNA
gctactctggaggctgagac

SEQ ID NO: 103249 - DNA, 20 bp, synthetic construct
  misc_feature 1..20: note = CRISPR gRNA sequence
  source 1..20: mol_type = other DNA
actctggaggctgagacagg

SEQ ID NO: 103250 - DNA, 20 bp, synthetic construct
  misc_feature 1..20: note = CRISPR gRNA sequence
  source 1..20: mol_type = other DNA
ctctggaggctgagacagga

SEQ ID NO: 103251 - DNA, 20 bp, synthetic construct
  misc_feature 1..20: note = CRISPR gRNA sequence
  source 1..20: mol_type = other DNA
ggaggctgagacaggaaggt

SEQ ID NO: 103252 - DNA, 20 bp, synthetic construct
  misc_feature 1..20: note = CRISPR gRNA sequence
  source 1..20: mol_type = other DNA
tgagacaggaaggttggctt

SEQ ID NO: 103253 - DNA, 20 bp, synthetic construct
  misc_feature 1..20: note = CRISPR gRNA sequence
  source 1..20: mol_type = other DNA
caggaaggttggcttaagcc

SEQ ID NO: 103254 - DNA, 20 bp, synthetic construct
  misc_feature 1..20: note = CRISPR gRNA sequence
  source 1..20: mol_type = other DNA
aggaaggttggcttaagccc

SEQ ID NO: 103255 - DNA, 20 bp, synthetic construct
  misc_feature 1..20: note = CRISPR gRNA sequence
  source 1..20: mol_type = other DNA
tggcttaagcccaggaattc

SEQ ID NO: 103256 - DNA, 20 bp, synthetic construct
  misc_feature 1..20: note = CRISPR gRNA sequence
  source 1..20: mol_type = other DNA
taagcccaggaattcaagac

SEQ ID NO: 103257 - DNA, 20 bp, synthetic construct
  misc_feature 1..20: note = CRISPR gRNA sequence
  source 1..20: mol_type = other DNA
ccaggaattcaagaccagcc

SEQ ID NO: 103258 - DNA, 20 bp, synthetic construct
  misc_feature 1..20: note = CRISPR gRNA sequence
  source 1..20: mol_type = other DNA
caggaattcaagaccagcct

SEQ ID NO: 103259 - DNA, 20 bp, synthetic construct
  misc_feature 1..20: note = CRISPR gRNA sequence
  source 1..20: mol_type = other DNA
caagaccagcctgggcaaaa

SEQ ID NO: 103260 - DNA, 20 bp, synthetic construct
  misc_feature 1..20: note = CRISPR gRNA sequence
  source 1..20: mol_type = other DNA
accagcctgggcaaaacagc

SEQ ID NO: 103261 - DNA, 20 bp, synthetic construct
  misc_feature 1..20: note = CRISPR gRNA sequence
  source 1..20: mol_type = other DNA
gcaagaccccatctcaaaat

SEQ ID NO: 103262 - DNA, 20 bp, synthetic construct
  misc_feature 1..20: note = CRISPR gRNA sequence
  source 1..20: mol_type = other DNA
tcaaaataagtacataaata

SEQ ID NO: 103263 - DNA, 20 bp, synthetic construct
  misc_feature 1..20: note = CRISPR gRNA sequence
  source 1..20: mol_type = other DNA
taaataaagtttaaaaaaaa

SEQ ID NO: 103264 - DNA, 20 bp, synthetic construct
  misc_feature 1..20: note = CRISPR gRNA sequence
  source 1..20: mol_type = other DNA
gtttaaaaaaaaaagaatct

SEQ ID NO: 103265 - DNA, 20 bp, synthetic construct
  misc_feature 1..20: note = CRISPR gRNA sequence
  source 1..20: mol_type = other DNA
aaaaaaaagaatcttagttt

SEQ ID NO: 103266 - DNA, 20 bp, synthetic construct
  misc_feature 1..20: note = CRISPR gRNA sequence
  source 1..20: mol_type = other DNA
aaaaaaagaatcttagtttt

SEQ ID NO: 103267 - DNA, 20 bp, synthetic construct
  misc_feature 1..20: note = CRISPR gRNA sequence
  source 1..20: mol_type = other DNA
gaatcttagttttgggacat

SEQ ID NO: 103268 - DNA, 20 bp, synthetic construct
  misc_feature 1..20: note = CRISPR gRNA sequence
  source 1..20: mol_type = other DNA
atcttagttttgggacatga

SEQ ID NO: 103269 - DNA, 20 bp, synthetic construct
  misc_feature 1..20: note = CRISPR gRNA sequence
  source 1..20: mol_type = other DNA
atgagagcattgacgtcatg

SEQ ID NO: 103270 - DNA, 20 bp, synthetic construct
  misc_feature 1..20: note = CRISPR gRNA sequence
  source 1..20: mol_type = other DNA
tgacgtcatgaagatgattt

SEQ ID NO: 103271 - DNA, 20 bp, synthetic construct
  misc_feature 1..20: note = CRISPR gRNA sequence
  source 1..20: mol_type = other DNA
atgaagatgatttcggttca

SEQ ID NO: 103272 - DNA, 20 bp, synthetic construct
  misc_feature 1..20: note = CRISPR gRNA sequence
  source 1..20: mol_type = other DNA
attaattactcctcctttct

SEQ ID NO: 103273 - DNA, 20 bp, synthetic construct
  misc_feature 1..20: note = CRISPR gRNA sequence
  source 1..20: mol_type = other DNA
ctttcttggtgattgcattt

SEQ ID NO: 103274 - DNA, 20 bp, synthetic construct
  misc_feature 1..20: note = CRISPR gRNA sequence
  source 1..20: mol_type = other DNA
ttggtgattgcatttaagcc

SEQ ID NO: 103275 - DNA, 20 bp, synthetic construct
  misc_feature 1..20: note = CRISPR gRNA sequence
  source 1..20: mol_type = other DNA
tttaagcccagaatttttta

SEQ ID NO: 103276 - DNA, 20 bp, synthetic construct
  misc_feature 1..20: note = CRISPR gRNA sequence
  source 1..20: mol_type = other DNA
aagcccagaattttttatgg

SEQ ID NO: 103277 - DNA, 20 bp, synthetic construct
  misc_feature 1..20: note = CRISPR gRNA sequence
  source 1..20: mol_type = other DNA
agaattttttatggtagttt

SEQ ID NO: 103278 - DNA, 20 bp, synthetic construct
  misc_feature 1..20: note = CRISPR gRNA sequence
  source 1..20: mol_type = other DNA
gaattttttatggtagtttc

SEQ ID NO: 103279 - DNA, 20 bp, synthetic construct
  misc_feature 1..20: note = CRISPR gRNA sequence
  source 1..20: mol_type = other DNA
aattttttatggtagtttca

SEQ ID NO: 103280 - DNA, 20 bp, synthetic construct
  misc_feature 1..20: note = CRISPR gRNA sequence
  source 1..20: mol_type = other DNA
tttttcttgtgaactcatct

SEQ ID NO: 103281 - DNA, 20 bp, synthetic construct
  misc_feature 1..20: note = CRISPR gRNA sequence
  source 1..20: mol_type = other DNA
ttttcttgtgaactcatctg

SEQ ID NO: 103282 - DNA, 20 bp, synthetic construct
  misc_feature 1..20: note = CRISPR gRNA sequence
  source 1..20: mol_type = other DNA
ttcttgtgaactcatctgag

SEQ ID NO: 103283 - DNA, 20 bp, synthetic construct
  misc_feature 1..20: note = CRISPR gRNA sequence
  source 1..20: mol_type = other DNA
aactcatctgaggagataaa

SEQ ID NO: 103284 - DNA, 20 bp, synthetic construct
  misc_feature 1..20: note = CRISPR gRNA sequence
  source 1..20: mol_type = other DNA
actcatctgaggagataaaa

SEQ ID NO: 103285 - DNA, 20 bp, synthetic construct
  misc_feature 1..20: note = CRISPR gRNA sequence
  source 1..20: mol_type = other DNA
ctcatctgaggagataaaaa

SEQ ID NO: 103286 - DNA, 20 bp, synthetic construct
  misc_feature 1..20: note = CRISPR gRNA sequence
  source 1..20: mol_type = other DNA
agggcattaaacaattgtgt

SEQ ID NO: 103287 - DNA, 20 bp, synthetic construct
  misc_feature 1..20: note = CRISPR gRNA sequence
  source 1..20: mol_type = other DNA
gcattaaacaattgtgtaag

SEQ ID NO: 103288 - DNA, 20 bp, synthetic construct
  misc_feature 1..20: note = CRISPR gRNA sequence
  source 1..20: mol_type = other DNA
ttaaacaattgtgtaagtag

SEQ ID NO: 103289 - DNA, 20 bp, synthetic construct
  misc_feature 1..20: note = CRISPR gRNA sequence
  source 1..20: mol_type = other DNA
aattgtgtaagtagaagtgt

SEQ ID NO: 103290 - DNA, 20 bp, synthetic construct
  misc_feature 1..20: note = CRISPR gRNA sequence
  source 1..20: mol_type = other DNA
aagtgtcagattcctgtttc

SEQ ID NO: 103291 - DNA, 20 bp, synthetic construct
  misc_feature 1..20: note = CRISPR gRNA sequence
  source 1..20: mol_type = other DNA
gtgtcagattcctgtttctg

SEQ ID NO: 103292 - DNA, 20 bp, synthetic construct
  misc_feature 1..20: note = CRISPR gRNA sequence
  source 1..20: mol_type = other DNA
tgtcagattcctgtttctgg

SEQ ID NO: 103293 - DNA, 20 bp, synthetic construct
  misc_feature 1..20: note = CRISPR gRNA sequence
  source 1..20: mol_type = other DNA
gtcagattcctgtttctgga

SEQ ID NO: 103294 - DNA, 20 bp, synthetic construct
  misc_feature 1..20: note = CRISPR gRNA sequence
  source 1..20: mol_type = other DNA
gattcctgtttctggaggga

SEQ ID NO: 103295 - DNA, 20 bp, synthetic construct
  misc_feature 1..20: note = CRISPR gRNA sequence
  source 1..20: mol_type = other DNA
ttaatgatgacaactgtttt

SEQ ID NO: 103296 - DNA, 20 bp, synthetic construct
  misc_feature 1..20: note = CRISPR gRNA sequence
  source 1..20: mol_type = other DNA
gacaactgttttgagttttt

SEQ ID NO: 103297 - DNA, 20 bp, synthetic construct
  misc_feature 1..20: note = CRISPR gRNA sequence
  source 1..20: mol_type = other DNA
agtttttgagtcaaattttt

SEQ ID NO: 103298 - DNA, 20 bp, synthetic construct
  misc_feature 1..20: note = CRISPR gRNA sequence
  source 1..20: mol_type = other DNA
gtttttgagtcaaatttttg

SEQ ID NO: 103299 - DNA, 20 bp, synthetic construct
  misc_feature 1..20: note = CRISPR gRNA sequence
  source 1..20: mol_type = other DNA
caaatttttgaggtccactc

SEQ ID NO: 103300 - DNA, 20 bp, synthetic construct
  misc_feature 1..20: note = CRISPR gRNA sequence
  source 1..20: mol_type = other DNA
aatttttgaggtccactctg

SEQ ID NO: 103301 - DNA, 20 bp, synthetic construct
  misc_feature 1..20: note = CRISPR gRNA sequence
  source 1..20: mol_type = other DNA
tgaggtccactctggagaca

SEQ ID NO: 103302 - DNA, 20 bp, synthetic construct
  misc_feature 1..20: note = CRISPR gRNA sequence
  source 1..20: mol_type = other DNA
gaggtccactctggagacaa

SEQ ID NO: 103303 - DNA, 20 bp, synthetic construct
  misc_feature 1..20: note = CRISPR gRNA sequence
  source 1..20: mol_type = other DNA
aggtccactctggagacaaa

SEQ ID NO: 103304 - DNA, 20 bp, synthetic construct
  misc_feature 1..20: note = CRISPR gRNA sequence
  source 1..20: mol_type = other DNA
tcctactaccttcaacaaaa

SEQ ID NO: 103305 - DNA, 20 bp, synthetic construct
  misc_feature 1..20: note = CRISPR gRNA sequence
  source 1..20: mol_type = other DNA
tcaacaaaacagcttcaata

SEQ ID NO: 103306 - DNA, 20 bp, synthetic construct
  misc_feature 1..20: note = CRISPR gRNA sequence
  source 1..20: mol_type = other DNA
caacaaaacagcttcaatat

SEQ ID NO: 103307 - DNA, 20 bp, synthetic construct
  misc_feature 1..20: note = CRISPR gRNA sequence
  source 1..20: mol_type = other DNA
aacaaaacagcttcaatata

SEQ ID NO: 103308 - DNA, 20 bp, synthetic construct
  misc_feature 1..20: note = CRISPR gRNA sequence
  source 1..20: mol_type = other DNA
caaaacagcttcaatatagg

SEQ ID NO: 103309 - DNA, 20 bp, synthetic construct
  misc_feature 1..20: note = CRISPR gRNA sequence
  source 1..20: mol_type = other DNA
agggagtctgtacattttga

SEQ ID NO: 103310 - DNA, 20 bp, synthetic construct
  misc_feature 1..20: note = CRISPR gRNA sequence
  source 1..20: mol_type = other DNA
tgtacattttgaaagtcctt

SEQ ID NO: 103311 - DNA, 20 bp, synthetic construct
  misc_feature 1..20: note = CRISPR gRNA sequence
  source 1..20: mol_type = other DNA
gtacattttgaaagtccttc

SEQ ID NO: 103312 - DNA, 20 bp, synthetic construct
  misc_feature 1..20: note = CRISPR gRNA sequence
  source 1..20: mol_type = other DNA
ggcttccgtctctctcctcc

SEQ ID NO: 103313 - DNA, 20 bp, synthetic construct
  misc_feature 1..20: note = CRISPR gRNA sequence
  source 1..20: mol_type = other DNA
cttccgtctctctcctccaa

SEQ ID NO: 103314 - DNA, 20 bp, synthetic construct
  misc_feature 1..20: note = CRISPR gRNA sequence
  source 1..20: mol_type = other DNA
ttccgtctctctcctccaag

SEQ ID NO: 103315 - DNA, 20 bp, synthetic construct
  misc_feature 1..20: note = CRISPR gRNA sequence
  source 1..20: mol_type = other DNA
gtctctctcctccaagaggt

SEQ ID NO: 103316 - DNA, 20 bp, synthetic construct
  misc_feature 1..20: note = CRISPR gRNA sequence
  source 1..20: mol_type = other DNA
tctctctcctccaagaggta

SEQ ID NO: 103317 - DNA, 20 bp, synthetic construct
  misc_feature 1..20: note = CRISPR gRNA sequence
  source 1..20: mol_type = other DNA
tttccttcctgacatatttc

SEQ ID NO: 103318 - DNA, 20 bp, synthetic construct
  misc_feature 1..20: note = CRISPR gRNA sequence
  source 1..20: mol_type = other DNA
gctcttcctgttcctgttct

SEQ ID NO: 103319 - DNA, 20 bp, synthetic construct
  misc_feature 1..20: note = CRISPR gRNA sequence
  source 1..20: mol_type = other DNA
cttcctgttcctgttctcag

SEQ ID NO: 103320 - DNA, 20 bp, synthetic construct
  misc_feature 1..20: note = CRISPR gRNA sequence
  source 1..20: mol_type = other DNA
cctgttcctgttctcagcag

SEQ ID NO: 103321 - DNA, 20 bp, synthetic construct
  misc_feature 1..20: note = CRISPR gRNA sequence
  source 1..20: mol_type = other DNA
ctgttcctgttctcagcagc

SEQ ID NO: 103322 - DNA, 20 bp, synthetic construct
  misc_feature 1..20: note = CRISPR gRNA sequence
  source 1..20: mol_type = other DNA
tgttcctgttctcagcagca

SEQ ID NO: 103323 - DNA, 20 bp, synthetic construct
  misc_feature 1..20: note = CRISPR gRNA sequence
  source 1..20: mol_type = other DNA
tcctgttctcagcagcaggg

SEQ ID NO: 103324 - DNA, 20 bp, synthetic construct
  misc_feature 1..20: note = CRISPR gRNA sequence
  source 1..20: mol_type = other DNA
agggtggtgtcactgctgtg

SEQ ID NO: 103325 - DNA, 20 bp, synthetic construct
  misc_feature 1..20: note = CRISPR gRNA sequence
  source 1..20: mol_type = other DNA
gtgtcactgctgtgcagttg

SEQ ID NO: 103326 - DNA, 20 bp, synthetic construct
  misc_feature 1..20: note = CRISPR gRNA sequence
  source 1..20: mol_type = other DNA
ctgctgtgcagttgcagact

SEQ ID NO: 103327 - DNA, 20 bp, synthetic construct
  misc_feature 1..20: note = CRISPR gRNA sequence
  source 1..20: mol_type = other DNA
tgctgtgcagttgcagactg

SEQ ID NO: 103328 - DNA, 20 bp, synthetic construct
  misc_feature 1..20: note = CRISPR gRNA sequence
  source 1..20: mol_type = other DNA
tgcagttgcagactgaggcc

SEQ ID NO: 103329 - DNA, 20 bp, synthetic construct
  misc_feature 1..20: note = CRISPR gRNA sequence
  source 1..20: mol_type = other DNA
gcagttgcagactgaggccc

SEQ ID NO: 103330 - DNA, 20 bp, synthetic construct
  misc_feature 1..20: note = CRISPR gRNA sequence
  source 1..20: mol_type = other DNA
gttgcagactgaggcccagg

SEQ ID NO: 103331 - DNA, 20 bp, synthetic construct
  misc_feature 1..20: note = CRISPR gRNA sequence
  source 1..20: mol_type = other DNA
ggcccaggtggcatccgcct

SEQ ID NO: 103332 - DNA, 20 bp, synthetic construct
  misc_feature 1..20: note = CRISPR gRNA sequence
  source 1..20: mol_type = other DNA
gcccaggtggcatccgcctc

SEQ ID NO: 103333 - DNA, 20 bp, synthetic construct
  misc_feature 1..20: note = CRISPR gRNA sequence
  source 1..20: mol_type = other DNA
aggtggcatccgcctcaggc

SEQ ID NO: 103334 - DNA, 20 bp, synthetic construct
  misc_feature 1..20: note = CRISPR gRNA sequence
  source 1..20: mol_type = other DNA
ggcatccgcctcaggccagc

SEQ ID NO: 103335 - DNA, 20 bp, synthetic construct
  misc_feature 1..20: note = CRISPR gRNA sequence
  source 1..20: mol_type = other DNA
ccgcctcaggccagcaagtc

SEQ ID NO: 103336 - DNA, 20 bp, synthetic construct
  misc_feature 1..20: note = CRISPR gRNA sequence
  source 1..20: mol_type = other DNA
gccagcaagtccagaccctc

SEQ ID NO: 103337 - DNA, 20 bp, synthetic construct
  misc_feature 1..20: note = CRISPR gRNA sequence
  source 1..20: mol_type = other DNA
ccagcaagtccagaccctcc

SEQ ID NO: 103338 - DNA, 20 bp, synthetic construct
  misc_feature 1..20: note = CRISPR gRNA sequence
  source 1..20: mol_type = other DNA
gcaagtccagaccctccagg

SEQ ID NO: 103339 - DNA, 20 bp, synthetic construct
  misc_feature 1..20: note = CRISPR gRNA sequence
  source 1..20: mol_type = other DNA
agtccagaccctccaggtag

SEQ ID NO: 103340 - DNA, 20 bp, synthetic construct
  misc_feature 1..20: note = CRISPR gRNA sequence
  source 1..20: mol_type = other DNA
taccctctctgattctctgt

SEQ ID NO: 103341 - DNA, 20 bp, synthetic construct
  misc_feature 1..20: note = CRISPR gRNA sequence
  source 1..20: mol_type = other DNA
acttctcctctcctcatgtc

SEQ ID NO: 103342 - DNA, 20 bp, synthetic construct
  misc_feature 1..20: note = CRISPR gRNA sequence
  source 1..20: mol_type = other DNA
atgtctggtgctgtttgtgt

SEQ ID NO: 103343 - DNA, 20 bp, synthetic construct
  misc_feature 1..20: note = CRISPR gRNA sequence
  source 1..20: mol_type = other DNA
tgtctggtgctgtttgtgtt

SEQ ID NO: 103344 - DNA, 20 bp, synthetic construct
  misc_feature 1..20: note = CRISPR gRNA sequence
  source 1..20: mol_type = other DNA
gctgtttgtgttaggatctc

SEQ ID NO: 103345 - DNA, 20 bp, synthetic construct
  misc_feature 1..20: note = CRISPR gRNA sequence
  source 1..20: mol_type = other DNA
gtttgtgttaggatctccag

SEQ ID NO: 103346 - DNA, 20 bp, synthetic construct
  misc_feature 1..20: note = CRISPR gRNA sequence
  source 1..20: mol_type = other DNA
tttgtgttaggatctccagt

SEQ ID NO: 103347 - DNA, 20 bp, synthetic construct
  misc_feature 1..20: note = CRISPR gRNA sequence
  source 1..20: mol_type = other DNA
gttaggatctccagtaggaa

SEQ ID NO: 103348 - DNA, 20 bp, synthetic construct
  misc_feature 1..20: note = CRISPR gRNA sequence
  source 1..20: mol_type = other DNA
gatctccagtaggaatggca

SEQ ID NO: 103349 - DNA, 20 bp, synthetic construct
  misc_feature 1..20: note = CRISPR gRNA sequence
  source 1..20: mol_type = other DNA
tccagtaggaatggcaaagt

SEQ ID NO: 103350 - DNA, 20 bp, synthetic construct
  misc_feature 1..20: note = CRISPR gRNA sequence
  source 1..20: mol_type = other DNA
gatgctgctaacttgtcttt

SEQ ID NO: 103351 - DNA, 20 bp, synthetic construct
  misc_feature 1..20: note = CRISPR gRNA sequence
  source 1..20: mol_type = other DNA
atgctgctaacttgtctttg

SEQ ID NO: 103352 - DNA, 20 bp, synthetic construct
  misc_feature 1..20: note = CRISPR gRNA sequence
  source 1..20: mol_type = other DNA
aacttgtctttgaggcttat

SEQ ID NO: 103353 - DNA, 20 bp, synthetic construct
  misc_feature 1..20: note = CRISPR gRNA sequence
  source 1..20: mol_type = other DNA
ctttgaggcttataagatgc

SEQ ID NO: 103354 - DNA, 20 bp, synthetic construct
  misc_feature 1..20: note = CRISPR gRNA sequence
  source 1..20: mol_type = other DNA
gtttcctaatatttcatgcc

SEQ ID NO: 103355 - DNA, 20 bp, synthetic construct
  misc_feature 1..20: note = CRISPR gRNA sequence
  source 1..20: mol_type = other DNA
atatttcatgccaagtcata

SEQ ID NO: 103356 - DNA, 20 bp, synthetic construct
  misc_feature 1..20: note = CRISPR gRNA sequence
  source 1..20: mol_type = other DNA
atttcatgccaagtcatata

SEQ ID NO: 103357 - DNA, 20 bp, synthetic construct
  misc_feature 1..20: note = CRISPR gRNA sequence
  source 1..20: mol_type = other DNA
agaccccgtatcaactttct

SEQ ID NO: 103358 - DNA, 20 bp, synthetic construct
  misc_feature 1..20: note = CRISPR gRNA sequence
  source 1..20: mol_type = other DNA
cgtatcaactttctgagaat

SEQ ID NO: 103359 - DNA, 20 bp, synthetic construct
  misc_feature 1..20: note = CRISPR gRNA sequence
  source 1..20: mol_type = other DNA
ttctgagaattggatttgac

SEQ ID NO: 103360 - DNA, 20 bp, synthetic construct
  misc_feature 1..20: note = CRISPR gRNA sequence
  source 1..20: mol_type = other DNA
tttgactagcatgtttcttt

SEQ ID NO: 103361 - DNA, 20 bp, synthetic construct
  misc_feature 1..20: note = CRISPR gRNA sequence
  source 1..20: mol_type = other DNA
catgtttctttgagaatgcc

SEQ ID NO: 103362 - DNA, 20 bp, synthetic construct
  misc_feature 1..20: note = CRISPR gRNA sequence
  source 1..20: mol_type = other DNA
ttctttgagaatgcctggaa

SEQ ID NO: 103363 - DNA, 20 bp, synthetic construct
  misc_feature 1..20: note = CRISPR gRNA sequence
  source 1..20: mol_type = other DNA
gagaatgcctggaaaagaaa

SEQ ID NO: 103364 - DNA, 20 bp, synthetic construct
  misc_feature 1..20: note = CRISPR gRNA sequence
  source 1..20: mol_type = other DNA
gcctggaaaagaaatggtat

SEQ ID NO: 103365 - DNA, 20 bp, synthetic construct
  misc_feature 1..20: note = CRISPR gRNA sequence
  source 1..20: mol_type = other DNA
aaaagaaatggtataagtga

SEQ ID NO: 103366 - DNA, 20 bp, synthetic construct
  misc_feature 1..20: note = CRISPR gRNA sequence
  source 1..20: mol_type = other DNA
aaagaaatggtataagtgac

SEQ ID NO: 103367 - DNA, 20 bp, synthetic construct
  misc_feature 1..20: note = CRISPR gRNA sequence
  source 1..20: mol_type = other DNA
gaaatggtataagtgacagg

SEQ ID NO: 103368 - DNA, 20 bp, synthetic construct
  misc_feature 1..20: note = CRISPR gRNA sequence
  source 1..20: mol_type = other DNA
tgacaggaagaaattcttat

SEQ ID NO: 103369 - DNA, 20 bp, synthetic construct
  misc_feature 1..20: note = CRISPR gRNA sequence
  source 1..20: mol_type = other DNA
gaaattcttataagtgacat

SEQ ID NO: 103370 - DNA, 20 bp, synthetic construct
  misc_feature 1..20: note = CRISPR gRNA sequence
  source 1..20: mol_type = other DNA
aagtgacattagaatttatt

SEQ ID NO: 103371 - DNA, 20 bp, synthetic construct
  misc_feature 1..20: note = CRISPR gRNA sequence
  source 1..20: mol_type = other DNA
agtgacattagaatttattc

SEQ ID NO: 103372 - DNA, 20 bp, synthetic construct
  misc_feature 1..20: note = CRISPR gRNA sequence
  source 1..20: mol_type = other DNA
gtgacattagaatttattca

SEQ ID NO: 103373 - DNA, 20 bp, synthetic construct
  misc_feature 1..20: note = CRISPR gRNA sequence
  source 1..20: mol_type = other DNA
attagaatttattcagggct

SEQ ID NO: 103374 - DNA, 20 bp, synthetic construct
  misc_feature 1..20: note = CRISPR gRNA sequence
  source 1..20: mol_type = other DNA
gaatttattcagggctcggc

SEQ ID NO: 103375 - DNA, 20 bp, synthetic construct
  misc_feature 1..20: note = CRISPR gRNA sequence
  source 1..20: mol_type = other DNA
aatttattcagggctcggcc

SEQ ID NO: 103376 - DNA, 20 bp, synthetic construct
  misc_feature 1..20: note = CRISPR gRNA sequence
  source 1..20: mol_type = other DNA
attcagggctcggccgggcg

SEQ ID NO: 103377 - DNA, 20 bp, synthetic construct
  misc_feature 1..20: note = CRISPR gRNA sequence
  source 1..20: mol_type = other DNA
cagggctcggccgggcgcgg

SEQ ID NO: 103378 - DNA, 20 bp, synthetic construct
  misc_feature 1..20: note = CRISPR gRNA sequence
  source 1..20: mol_type = other DNA
gtggctcacgcctgtaatcc

SEQ ID NO: 103379 - DNA, 20 bp, synthetic construct
  misc_feature 1..20: note = CRISPR gRNA sequence
  source 1..20: mol_type = other DNA
cgcctgtaatcccagcactt

SEQ ID NO: 103380 - DNA, 20 bp, synthetic construct
  misc_feature 1..20: note = CRISPR gRNA sequence
  source 1..20: mol_type = other DNA
gcctgtaatcccagcacttt

SEQ ID NO: 103381 - DNA, 20 bp, synthetic construct
  misc_feature 1..20: note = CRISPR gRNA sequence
  source 1..20: mol_type = other DNA
ctgtaatcccagcactttgg

SEQ ID NO: 103382 - DNA, 20 bp, synthetic construct
  misc_feature 1..20: note = CRISPR gRNA sequence
  source 1..20: mol_type = other DNA
tgtaatcccagcactttggg

SEQ ID NO: 103383 - DNA, 20 bp, synthetic construct
  misc_feature 1..20: note = CRISPR gRNA sequence
  source 1..20: mol_type = other DNA
tcccagcactttgggaggcc

SEQ ID NO: 103384 - DNA, 20 bp, synthetic construct
  misc_feature 1..20: note = CRISPR gRNA sequence
  source 1..20: mol_type = other DNA
cccagcactttgggaggccg

SEQ ID NO: 103385 - DNA, 20 bp, synthetic construct
  misc_feature 1..20: note = CRISPR gRNA sequence
  source 1..20: mol_type = other DNA
agcactttgggaggccgagg

SEQ ID NO: 103386 - DNA, 20 bp, synthetic construct
  misc_feature 1..20: note = CRISPR gRNA sequence
  source 1..20: mol_type = other DNA
gcactttgggaggccgaggc

SEQ ID NO: 103387 - DNA, 20 bp, synthetic construct
  misc_feature 1..20: note = CRISPR gRNA sequence
  source 1..20: mol_type = other DNA
ctttgggaggccgaggcagg

SEQ ID NO: 103388 - DNA, 20 bp, synthetic construct
  misc_feature 1..20: note = CRISPR gRNA sequence
  source 1..20: mol_type = other DNA
ggccgaggcaggcggatcac

SEQ ID NO: 103389 - DNA, 20 bp, synthetic construct
  misc_feature 1..20: note = CRISPR gRNA sequence
  source 1..20: mol_type = other DNA
gccgaggcaggcggatcacg

SEQ ID NO: 103390 - DNA, 20 bp, synthetic construct
  misc_feature 1..20: note = CRISPR gRNA sequence
  source 1..20: mol_type = other DNA
aggcaggcggatcacgaggt

SEQ ID NO: 103391 - DNA, 20 bp, synthetic construct
  misc_feature 1..20: note = CRISPR gRNA sequence
  source 1..20: mol_type = other DNA
ggcaggcggatcacgaggtc

SEQ ID NO: 103392 - DNA, 20 bp, synthetic construct
  misc_feature 1..20: note = CRISPR gRNA sequence
  source 1..20: mol_type = other DNA
caggcggatcacgaggtcag

SEQ ID NO: 103393 - DNA, 20 bp, synthetic construct
  misc_feature 1..20: note = CRISPR gRNA sequence
  source 1..20: mol_type = other DNA
gatcacgaggtcaggagatc

SEQ ID NO: 103394 - DNA, 20 bp, synthetic construct
  misc_feature 1..20: note = CRISPR gRNA sequence
  source 1..20: mol_type = other DNA
tcaggagatcgagaccatcc

SEQ ID NO: 103395 - DNA, 20 bp, synthetic construct
  misc_feature 1..20: note = CRISPR gRNA sequence
  source 1..20: mol_type = other DNA
cgagaccatcctggcaaaca

SEQ ID NO: 103396 - DNA, 20 bp, synthetic construct
  misc_feature 1..20: note = CRISPR gRNA sequence
  source 1..20: mol_type = other DNA
tactaaaaatacaaaaaaat

SEQ ID NO: 103397 - DNA, 20 bp, synthetic construct
  misc_feature 1..20: note = CRISPR gRNA sequence
  source 1..20: mol_type = other DNA
aaaaatacaaaaaaattagc

SEQ ID NO: 103398 - DNA, 20 bp, synthetic construct
  misc_feature 1..20: note = CRISPR gRNA sequence
  source 1..20: mol_type = other DNA
aaaatacaaaaaaattagcc

SEQ ID NO: 103399 - DNA, 20 bp, synthetic construct
  misc_feature 1..20: note = CRISPR gRNA sequence
  source 1..20: mol_type = other DNA
acaaaaaaattagccgggca

SEQ ID NO: 103400 - DNA, 20 bp, synthetic construct
  misc_feature 1..20: note = CRISPR gRNA sequence
  source 1..20: mol_type = other DNA
aaaaaattagccgggcatgg

SEQ ID NO: 103401 - DNA, 20 bp, synthetic construct
  misc_feature 1..20: note = CRISPR gRNA sequence
  source 1..20: mol_type = other DNA
aaattagccgggcatggtgg

SEQ ID NO: 103402 - DNA, 20 bp, synthetic construct
  misc_feature 1..20: note = CRISPR gRNA sequence
  source 1..20: mol_type = other DNA
aattagccgggcatggtggc

SEQ ID NO: 103403 - DNA, 20 bp, synthetic construct
  misc_feature 1..20: note = CRISPR gRNA sequence
  source 1..20: mol_type = other DNA
ggcatggtggcgggcacctg

SEQ ID NO: 103404 - DNA, 20 bp, synthetic construct
  misc_feature 1..20: note = CRISPR gRNA sequence
  source 1..20: mol_type = other DNA
gtggcgggcacctgtagtcc

SEQ ID NO: 103405 - DNA, 20 bp, synthetic construct
  misc_feature 1..20: note = CRISPR gRNA sequence
  source 1..20: mol_type = other DNA
cacctgtagtcccagctact

SEQ ID NO: 103406 - DNA, 20 bp, synthetic construct
  misc_feature 1..20: note = CRISPR gRNA sequence
  source 1..20: mol_type = other DNA
acctgtagtcccagctactt

SEQ ID NO: 103407 - DNA, 20 bp, synthetic construct
  misc_feature 1..20: note = CRISPR gRNA sequence
  source 1..20: mol_type = other DNA
ctgtagtcccagctacttgg

SEQ ID NO: 103408 - DNA, 20 bp, synthetic construct
  misc_feature 1..20: note = CRISPR gRNA sequence
  source 1..20: mol_type = other DNA
tgtagtcccagctacttggg

SEQ ID NO: 103409 - DNA, 20 bp, synthetic construct
  misc_feature 1..20: note = CRISPR gRNA sequence
  source 1..20: mol_type = other DNA
gtcccagctacttgggaggc

SEQ ID NO: 103410 - DNA, 20 bp, synthetic construct
  misc_feature 1..20: note = CRISPR gRNA sequence
  source 1..20: mol_type = other DNA
cccagctacttgggaggctg

SEQ ID NO: 103411 - DNA, 20 bp, synthetic construct
  misc_feature 1..20: note = CRISPR gRNA sequence
  source 1..20: mol_type = other DNA
agctacttgggaggctggag

SEQ ID NO: 103412 - DNA, 20 bp, synthetic construct
  misc_feature 1..20: note = CRISPR gRNA sequence
  source 1..20: mol_type = other DNA
gctacttgggaggctggagc

SEQ ID NO: 103413 - DNA, 20 bp, synthetic construct
  misc_feature 1..20: note = CRISPR gRNA sequence
  source 1..20: mol_type = other DNA
tacttgggaggctggagcag

SEQ ID NO: 103414 - DNA, 20 bp, synthetic construct
  misc_feature 1..20: note = CRISPR gRNA sequence
  source 1..20: mol_type = other DNA
gggaggctggagcaggagaa

SEQ ID NO: 103415 - DNA, 20 bp, synthetic construct
  misc_feature 1..20: note = CRISPR gRNA sequence
  source 1..20: mol_type = other DNA
gcaggagaatggcgtgaacc

SEQ ID NO: 103416 - DNA, 20 bp, synthetic construct
  misc_feature 1..20: note = CRISPR gRNA sequence
  source 1..20: mol_type = other DNA
caggagaatggcgtgaaccc

SEQ ID NO: 103417 - DNA, 20 bp, synthetic construct
  misc_feature 1..20: note = CRISPR gRNA sequence
  source 1..20: mol_type = other DNA
ggagaatggcgtgaacccag

SEQ ID NO: 103418 - DNA, 20 bp, synthetic construct
  misc_feature 1..20: note = CRISPR gRNA sequence
  source 1..20: mol_type = other DNA
gagaatggcgtgaacccagg

SEQ ID NO: 103419 - DNA, 20 bp, synthetic construct
  misc_feature 1..20: note = CRISPR gRNA sequence
  source 1..20: mol_type = other DNA
aatggcgtgaacccaggagg

SEQ ID NO: 103420 - DNA, 20 bp, synthetic construct
  misc_feature 1..20: note = CRISPR gRNA sequence
  source 1..20: mol_type = other DNA
tggcgtgaacccaggaggca

SEQ ID NO: 103421 - DNA, 20 bp, synthetic construct
  misc_feature 1..20: note = CRISPR gRNA sequence
  source 1..20: mol_type = other DNA
aacccaggaggcagagcttg

SEQ ID NO: 103422 - DNA, 20 bp, synthetic construct
  misc_feature 1..20: note = CRISPR gRNA sequence
  source 1..20: mol_type = other DNA
caggaggcagagcttgcagt

SEQ ID NO: 103423 - DNA, 20 bp, synthetic construct
  misc_feature 1..20: note = CRISPR gRNA sequence
  source 1..20: mol_type = other DNA
gaggcagagcttgcagtgag

SEQ ID NO: 103424 - DNA, 20 bp, synthetic construct
  misc_feature 1..20: note = CRISPR gRNA sequence
  source 1..20: mol_type = other DNA
ggcagagcttgcagtgagca

SEQ ID NO: 103425 - DNA, 20 bp, synthetic construct
  misc_feature 1..20: note = CRISPR gRNA sequence
  source 1..20: mol_type = other DNA
gagattgcgccactgcactc

SEQ ID NO: 103426 - DNA, 20 bp, synthetic construct
  misc_feature 1..20: note = CRISPR gRNA sequence
  source 1..20: mol_type = other DNA
tgcgccactgcactccagcc

SEQ ID NO: 103427 - DNA, 20 bp, synthetic construct
  misc_feature 1..20: note = CRISPR gRNA sequence
  source 1..20: mol_type = other DNA
gcgccactgcactccagcct

SEQ ID NO: 103428 - DNA, 20 bp, synthetic construct
  misc_feature 1..20: note = CRISPR gRNA sequence
  source 1..20: mol_type = other DNA
ctgcactccagcctgggtga

SEQ ID NO: 103429 - DNA, 20 bp, synthetic construct
  misc_feature 1..20: note = CRISPR gRNA sequence
  source 1..20: mol_type = other DNA
gcactccagcctgggtgaca

SEQ ID NO: 103430 - DNA, 20 bp, synthetic construct
  misc_feature 1..20: note = CRISPR gRNA sequence
  source 1..20: mol_type = other DNA
tccagcctgggtgacagagc

SEQ ID NO: 103431 - DNA, 20 bp, synthetic construct
  misc_feature 1..20: note = CRISPR gRNA sequence
  source 1..20: mol_type = other DNA
tccgtctcaaaaaaaaaaaa

SEQ ID NO: 103432 - DNA, 20 bp, synthetic construct
  misc_feature 1..20: note = CRISPR gRNA sequence
  source 1..20: mol_type = other DNA
aaaaaaaaaaagaatttatt

SEQ ID NO: 103433 - DNA, 20 bp, synthetic construct
  misc_feature 1..20: note = CRISPR gRNA sequence
  source 1..20: mol_type = other DNA
aaaaaaaaaagaatttattc

SEQ ID NO: 103434 - DNA, 20 bp, synthetic construct
  misc_feature 1..20: note = CRISPR gRNA sequence
  source 1..20: mol_type = other DNA
aaaaaaaaagaatttattca

SEQ ID NO: 103435 - DNA, 20 bp, synthetic construct
  misc_feature 1..20: note = CRISPR gRNA sequence
  source 1..20: mol_type = other DNA
ctctgatccaattaattgca

SEQ ID NO: 103436 - DNA, 20 bp, synthetic construct
  misc_feature 1..20: note = CRISPR gRNA sequence
  source 1..20: mol_type = other DNA
tttgtgtatttgtgttacaa

SEQ ID NO: 103437 - DNA, 20 bp, synthetic construct
  misc_feature 1..20: note = CRISPR gRNA sequence
  source 1..20: mol_type = other DNA
tgtgtatttgtgttacaatg

SEQ ID NO: 103438 - DNA, 20 bp, synthetic construct
  misc_feature 1..20: note = CRISPR gRNA sequence
  source 1..20: mol_type = other DNA
gtatttgtgttacaatggag

SEQ ID NO: 103439 - DNA, 20 bp, synthetic construct
  misc_feature 1..20: note = CRISPR gRNA sequence
  source 1..20: mol_type = other DNA
tatttgtgttacaatggaga

SEQ ID NO: 103440 - DNA, 20 bp, synthetic construct
  misc_feature 1..20: note = CRISPR gRNA sequence
  source 1..20: mol_type = other DNA
gaaggaaatatatacatata

SEQ ID NO: 103441 - DNA, 20 bp, synthetic construct
  misc_feature 1..20: note = CRISPR gRNA sequence
  source 1..20: mol_type = other DNA
atatacagacacacataaac

SEQ ID NO: 103442 - DNA, 20 bp, synthetic construct
  misc_feature 1..20: note = CRISPR gRNA sequence
  source 1..20: mol_type = other DNA
tatacagacacacataaact

SEQ ID NO: 103443 - DNA, 20 bp, synthetic construct
  misc_feature 1..20: note = CRISPR gRNA sequence
  source 1..20: mol_type = other DNA
cagacacacataaactaggc

SEQ ID NO: 103444 - DNA, 20 bp, synthetic construct
  misc_feature 1..20: note = CRISPR gRNA sequence
  source 1..20: mol_type = other DNA
agacacacataaactaggct

SEQ ID NO: 103445 - DNA, 20 bp, synthetic construct
  misc_feature 1..20: note = CRISPR gRNA sequence
  source 1..20: mol_type = other DNA
gctgtgctttatttttattc

SEQ ID NO: 103446 - DNA, 20 bp, synthetic construct
  misc_feature 1..20: note = CRISPR gRNA sequence
  source 1..20: mol_type = other DNA
ctgtgctttatttttattca

SEQ ID NO: 103447 - DNA, 20 bp, synthetic construct
  misc_feature 1..20: note = CRISPR gRNA sequence
  source 1..20: mol_type = other DNA
tgtgctttatttttattcaa

SEQ ID NO: 103448 - DNA, 20 bp, synthetic construct
  misc_feature 1..20: note = CRISPR gRNA sequence
  source 1..20: mol_type = other DNA
gtgctttatttttattcaag

SEQ ID NO: 103449 - DNA, 20 bp, synthetic construct
  misc_feature 1..20: note = CRISPR gRNA sequence
  source 1..20: mol_type = other DNA
tgaaaaataatcattgcact

SEQ ID NO: 103450 - DNA, 20 bp, synthetic construct
  misc_feature 1..20: note = CRISPR gRNA sequence
  source 1..20: mol_type = other DNA
aaataatcattgcacttggc

SEQ ID NO: 103451 - DNA, 20 bp, synthetic construct
  misc_feature 1..20: note = CRISPR gRNA sequence
  source 1..20: mol_type = other DNA
aataatcattgcacttggca

SEQ ID NO: 103452 - DNA, 20 bp, synthetic construct
  misc_feature 1..20: note = CRISPR gRNA sequence
  source 1..20: mol_type = other DNA
gcacttggcaaggtttatct

SEQ ID NO: 103453 - DNA, 20 bp, synthetic construct
  misc_feature 1..20: note = CRISPR gRNA sequence
  source 1..20: mol_type = other DNA
attgtttccactacctttcc

SEQ ID NO: 103454 - DNA, 20 bp, synthetic construct
  misc_feature 1..20: note = CRISPR gRNA sequence
  source 1..20: mol_type = other DNA
ttgtttccactacctttcct

SEQ ID NO: 103455 - DNA, 20 bp, synthetic construct
  misc_feature 1..20: note = CRISPR gRNA sequence
  source 1..20: mol_type = other DNA
tgtttccactacctttcctg

SEQ ID NO: 103456 - DNA, 20 bp, synthetic construct
  misc_feature 1..20: note = CRISPR gRNA sequence
  source 1..20: mol_type = other DNA
gtttccactacctttcctgg

SEQ ID NO: 103457 - DNA, 20 bp, synthetic construct
  misc_feature 1..20: note = CRISPR gRNA sequence
  source 1..20: mol_type = other DNA
cactacctttcctgggggaa

SEQ ID NO: 103458 - DNA, 20 bp, synthetic construct
  misc_feature 1..20: note = CRISPR gRNA sequence
  source 1..20: mol_type = other DNA
atagtgacctgtcttattac

SEQ ID NO: 103459 - DNA, 20 bp, synthetic construct
  misc_feature 1..20: note = CRISPR gRNA sequence
  source 1..20: mol_type = other DNA
gtcttattactagatctgca

SEQ ID NO: 103460 - DNA, 20 bp, synthetic construct
  misc_feature 1..20: note = CRISPR gRNA sequence
  source 1..20: mol_type = other DNA
tagatctgcaaagattaccc

SEQ ID NO: 103461 - DNA, 20 bp, synthetic construct
  misc_feature 1..20: note = CRISPR gRNA sequence
  source 1..20: mol_type = other DNA
agattaccccagatacctct

SEQ ID NO: 103462 - DNA, 20 bp, synthetic construct
  misc_feature 1..20: note = CRISPR gRNA sequence
  source 1..20: mol_type = other DNA
taccccagatacctcttggt

SEQ ID NO: 103463 - DNA, 20 bp, synthetic construct
  misc_feature 1..20: note = CRISPR gRNA sequence
  source 1..20: mol_type = other DNA
accccagatacctcttggtt

SEQ ID NO: 103464 - DNA, 20 bp, synthetic construct
  misc_feature 1..20: note = CRISPR gRNA sequence
  source 1..20: mol_type = other DNA
ccagatacctcttggttagg

SEQ ID NO: 103465 - DNA, 20 bp, synthetic construct
  misc_feature 1..20: note = CRISPR gRNA sequence
  source 1..20: mol_type = other DNA
gatacctcttggttaggcag

SEQ ID NO: 103466 - DNA, 20 bp, synthetic construct
  misc_feature 1..20: note = CRISPR gRNA sequence
  source 1..20: mol_type = other DNA
acctcttggttaggcagaag

SEQ ID NO: 103467 - DNA, 20 bp, synthetic construct
  misc_feature 1..20: note = CRISPR gRNA sequence
  source 1..20: mol_type = other DNA
cctcttggttaggcagaagc

SEQ ID NO: 103468 - DNA, 20 bp, synthetic construct
  misc_feature 1..20: note = CRISPR gRNA sequence
  source 1..20: mol_type = other DNA
aagcaggatgtgctttctgt

SEQ ID NO: 103469 - DNA, 20 bp, synthetic construct
  misc_feature 1..20: note = CRISPR gRNA sequence
  source 1..20: mol_type = other DNA
gatgtgctttctgtaagtct

SEQ ID NO: 103470 - DNA, 20 bp, synthetic construct
  misc_feature 1..20: note = CRISPR gRNA sequence
  source 1..20: mol_type = other DNA
atgtgctttctgtaagtctt

SEQ ID NO: 103471 - DNA, 20 bp, synthetic construct
  misc_feature 1..20: note = CRISPR gRNA sequence
  source 1..20: mol_type = other DNA
tctgtaagtcttaggtgtta

SEQ ID NO: 103472 - DNA, 20 bp, synthetic construct
  misc_feature 1..20: note = CRISPR gRNA sequence
  source 1..20: mol_type = other DNA
aaagccactgtgataattct

SEQ ID NO: 103473 - DNA, 20 bp, synthetic construct
  misc_feature 1..20: note = CRISPR gRNA sequence
  source 1..20: mol_type = other DNA
taattcttggttaatcaata

SEQ ID NO: 103474 - DNA, 20 bp, synthetic construct
  misc_feature 1..20: note = CRISPR gRNA sequence
  source 1..20: mol_type = other DNA
ggttaatcaatacagttctt

SEQ ID NO: 103475 - DNA, 20 bp, synthetic construct
  misc_feature 1..20: note = CRISPR gRNA sequence
  source 1..20: mol_type = other DNA
cagttctttagcatcgtgta

SEQ ID NO: 103476 - DNA, 20 bp, synthetic construct
  misc_feature 1..20: note = CRISPR gRNA sequence
  source 1..20: mol_type = other DNA
ctttagcatcgtgtatggct

SEQ ID NO: 103477 - DNA, 20 bp, synthetic construct
  misc_feature 1..20: note = CRISPR gRNA sequence
  source 1..20: mol_type = other DNA
tatggctaagtatcctaaat

SEQ ID NO: 103478 - DNA, 20 bp, synthetic construct
  misc_feature 1..20: note = CRISPR gRNA sequence
  source 1..20: mol_type = other DNA
atggctaagtatcctaaatt

SEQ ID NO: 103479 - DNA, 20 bp, synthetic construct
  misc_feature 1..20: note = CRISPR gRNA sequence
  source 1..20: mol_type = other DNA
tcctaaattgggttctaatt

SEQ ID NO: 103480 - DNA, 20 bp, synthetic construct
  misc_feature 1..20: note = CRISPR gRNA sequence
  source 1..20: mol_type = other DNA
aaattgggttctaatttggc

SEQ ID NO: 103481 - DNA, 20 bp, synthetic construct
  misc_feature 1..20: note = CRISPR gRNA sequence
  source 1..20: mol_type = other DNA
tggccagttcctataaaaca

SEQ ID NO: 103482 - DNA, 20 bp, synthetic construct
  misc_feature 1..20: note = CRISPR gRNA sequence
  source 1..20: mol_type = other DNA
ggccagttcctataaaacac

SEQ ID NO: 103483 - DNA, 20 bp, synthetic construct
  misc_feature 1..20: note = CRISPR gRNA sequence
  source 1..20: mol_type = other DNA
ccagttcctataaaacacag

SEQ ID NO: 103484 - DNA, 20 bp, synthetic construct
  misc_feature 1..20: note = CRISPR gRNA sequence
  source 1..20: mol_type = other DNA
gttcctataaaacacaggag

SEQ ID NO: 103485 - DNA, 20 bp, synthetic construct
  misc_feature 1..20: note = CRISPR gRNA sequence
  source 1..20: mol_type = other DNA
cctataaaacacaggagtag

SEQ ID NO: 103486 - DNA, 20 bp, synthetic construct
  misc_feature 1..20: note = CRISPR gRNA sequence
  source 1..20: mol_type = other DNA
aaacacaggagtagcagcac

SEQ ID NO: 103487 - DNA, 20 bp, synthetic construct
  misc_feature 1..20: note = CRISPR gRNA sequence
  source 1..20: mol_type = other DNA
actagtctactctgtgtatg

SEQ ID NO: 103488 - DNA, 20 bp, synthetic construct
  misc_feature 1..20: note = CRISPR gRNA sequence
  source 1..20: mol_type = other DNA
ctagtctactctgtgtatgt

SEQ ID NO: 103489 - DNA, 20 bp, synthetic construct
  misc_feature 1..20: note = CRISPR gRNA sequence
  source 1..20: mol_type = other DNA
attaaaataactctattttt

SEQ ID NO: 103490 - DNA, 20 bp, synthetic construct
  misc_feature 1..20: note = CRISPR gRNA sequence
  source 1..20: mol_type = other DNA
taactctatttttgagaaat

SEQ ID NO: 103491 - DNA, 20 bp, synthetic construct
  misc_feature 1..20: note = CRISPR gRNA sequence
  source 1..20: mol_type = other DNA
tctatttttgagaaattggc

SEQ ID NO: 103492 - DNA, 20 bp, synthetic construct
  misc_feature 1..20: note = CRISPR gRNA sequence
  source 1..20: mol_type = other DNA
tttgagaaattggcaagatt

SEQ ID NO: 103493 - DNA, 20 bp, synthetic construct
  misc_feature 1..20: note = CRISPR gRNA sequence
  source 1..20: mol_type = other DNA
ttgagaaattggcaagattt

SEQ ID NO: 103494 - DNA, 20 bp, synthetic construct
  misc_feature 1..20: note = CRISPR gRNA sequence
  source 1..20: mol_type = other DNA
actttttccctccattgaat

SEQ ID NO: 103495 - DNA, 20 bp, synthetic construct
  misc_feature 1..20: note = CRISPR gRNA sequence
  source 1..20: mol_type = other DNA
attgaattagaaatgattca

SEQ ID NO: 103496 - DNA, 20 bp, synthetic construct
  misc_feature 1..20: note = CRISPR gRNA sequence
  source 1..20: mol_type = other DNA
gaattagaaatgattcaaag

SEQ ID NO: 103497 - DNA, 20 bp, synthetic construct
  misc_feature 1..20: note = CRISPR gRNA sequence
  source 1..20: mol_type = other DNA
aaatgattcaaagtagaatc

SEQ ID NO: 103498 - DNA, 20 bp, synthetic construct
  misc_feature 1..20: note = CRISPR gRNA sequence
  source 1..20: mol_type = other DNA
tcaaagtagaatctagaatg

SEQ ID NO: 103499 - DNA, 20 bp, synthetic construct
  misc_feature 1..20: note = CRISPR gRNA sequence
  source 1..20: mol_type = other DNA
tagaatctagaatgtagaac

SEQ ID NO: 103500 - DNA, 20 bp, synthetic construct
  misc_feature 1..20: note = CRISPR gRNA sequence
  source 1..20: mol_type = other DNA
ctggcatctcactttattgc

SEQ ID NO: 103501 - DNA, 20 bp, synthetic construct
  misc_feature 1..20: note = CRISPR gRNA sequence
  source 1..20: mol_type = other DNA
actttattgctagtgctgct

SEQ ID NO: 103502 - DNA, 20 bp, synthetic construct
  misc_feature 1..20: note = CRISPR gRNA sequence
  source 1..20: mol_type = other DNA
tgctagtgctgctaagcatc

SEQ ID NO: 103503 - DNA, 20 bp, synthetic construct
  misc_feature 1..20: note = CRISPR gRNA sequence
  source 1..20: mol_type = other DNA
tagtgctgctaagcatccag

SEQ ID NO: 103504 - DNA, 20 bp, synthetic construct
  misc_feature 1..20: note = CRISPR gRNA sequence
  source 1..20: mol_type = other DNA
acccctacccctgccaccaa

SEQ ID NO: 103505 - DNA, 20 bp, synthetic construct
  misc_feature 1..20: note = CRISPR gRNA sequence
  source 1..20: mol_type = other DNA
cccctgccaccaatagtgtt

SEQ ID NO: 103506 - DNA, 20 bp, synthetic construct
  misc_feature 1..20: note = CRISPR gRNA sequence
  source 1..20: mol_type = other DNA
tagtgtttggtaatgatgta

SEQ ID NO: 103507 - DNA, 20 bp, synthetic construct
  misc_feature 1..20: note = CRISPR gRNA sequence
  source 1..20: mol_type = other DNA
gccaactttgaacataaatt

SEQ ID NO: 103508 - DNA, 20 bp, synthetic construct
  misc_feature 1..20: note = CRISPR gRNA sequence
  source 1..20: mol_type = other DNA
ttgaacataaattaagccga

SEQ ID NO: 103509 - DNA, 20 bp, synthetic construct
  misc_feature 1..20: note = CRISPR gRNA sequence
  source 1..20: mol_type = other DNA
aaattaagccgaaagaaact

SEQ ID NO: 103510 - DNA, 20 bp, synthetic construct
  misc_feature 1..20: note = CRISPR gRNA sequence
  source 1..20: mol_type = other DNA
gccgaaagaaactgagcttg

SEQ ID NO: 103511 - DNA, 20 bp, synthetic construct
  misc_feature 1..20: note = CRISPR gRNA sequence
  source 1..20: mol_type = other DNA
ccgaaagaaactgagcttgt

SEQ ID NO: 103512 - DNA, 20 bp, synthetic construct
  misc_feature 1..20: note = CRISPR gRNA sequence
  source 1..20: mol_type = other DNA
aaaattgtgttcaaatctca

SEQ ID NO: 103513 - DNA, 20 bp, synthetic construct
  misc_feature 1..20: note = CRISPR gRNA sequence
  source 1..20: mol_type = other DNA
gttcaaatctcacagtccaa

SEQ ID NO: 103514 - DNA, 20 bp, synthetic construct
  misc_feature 1..20: note = CRISPR gRNA sequence
  source 1..20: mol_type = other DNA
catcttactcatatataaaa

SEQ ID NO: 103515 - DNA, 20 bp, synthetic construct
  misc_feature 1..20: note = CRISPR gRNA sequence
  source 1..20: mol_type = other DNA
tcatatataaaacagtattt

SEQ ID NO: 103516 - DNA, 20 bp, synthetic construct
  misc_feature 1..20: note = CRISPR gRNA sequence
  source 1..20: mol_type = other DNA
ggattgtcattaaccccttg

SEQ ID NO: 103517 - DNA, 20 bp, synthetic construct
  misc_feature 1..20: note = CRISPR gRNA sequence
  source 1..20: mol_type = other DNA
gtcattaaccccttgtggaa

SEQ ID NO: 103518 - DNA, 20 bp, synthetic construct
  misc_feature 1..20: note = CRISPR gRNA sequence
  source 1..20: mol_type = other DNA
tcattaaccccttgtggaat

SEQ ID NO: 103519 - DNA, 20 bp, synthetic construct
  misc_feature 1..20: note = CRISPR gRNA sequence
  source 1..20: mol_type = other DNA
gtaacatgctcttaactgta

SEQ ID NO: 103520 - DNA, 20 bp, synthetic construct
  misc_feature 1..20: note = CRISPR gRNA sequence
  source 1..20: mol_type = other DNA
acatttttctgttgtaaata

SEQ ID NO: 103521 - DNA, 20 bp, synthetic construct
  misc_feature 1..20: note = CRISPR gRNA sequence
  source 1..20: mol_type = other DNA
ttttctgttgtaaatacagt

SEQ ID NO: 103522 - DNA, 20 bp, synthetic construct
  misc_feature 1..20: note = CRISPR gRNA sequence
  source 1..20: mol_type = other DNA
tgtaaatacagtgagctctt

SEQ ID NO: 103523 - DNA, 20 bp, synthetic construct
  misc_feature 1..20: note = CRISPR gRNA sequence
  source 1..20: mol_type = other DNA
taaatacagtgagctctttg

SEQ ID NO: 103524 - DNA, 20 bp, synthetic construct
  misc_feature 1..20: note = CRISPR gRNA sequence
  source 1..20: mol_type = other DNA
tcatttatcatgtgcacgaa

SEQ ID NO: 103525 - DNA, 20 bp, synthetic construct
  misc_feature 1..20: note = CRISPR gRNA sequence
  source 1..20: mol_type = other DNA
tgcacgaatagcacatcaat

SEQ ID NO: 103526 - DNA, 20 bp, synthetic construct
  misc_feature 1..20: note = CRISPR gRNA sequence
  source 1..20: mol_type = other DNA
gcacgaatagcacatcaatt

SEQ ID NO: 103527 - DNA, 20 bp, synthetic construct
  misc_feature 1..20: note = CRISPR gRNA sequence
  source 1..20: mol_type = other DNA
cacgaatagcacatcaattg

SEQ ID NO: 103528 - DNA, 20 bp, synthetic construct
  misc_feature 1..20: note = CRISPR gRNA sequence
  source 1..20: mol_type = other DNA
cgaatagcacatcaattggg

SEQ ID NO: 103529 - DNA, 20 bp, synthetic construct
  misc_feature 1..20: note = CRISPR gRNA sequence
  source 1..20: mol_type = other DNA
gaatagcacatcaattgggg

SEQ ID NO: 103530 - DNA, 20 bp, synthetic construct
  misc_feature 1..20: note = CRISPR gRNA sequence
  source 1..20: mol_type = other DNA
catcaattggggaggaaatt

SEQ ID NO: 103531 - DNA, 20 bp, synthetic construct
  misc_feature 1..20: note = CRISPR gRNA sequence
  source 1..20: mol_type = other DNA
gaggaaattaagatgatgaa

SEQ ID NO: 103532 - DNA, 20 bp, synthetic construct
  misc_feature 1..20: note = CRISPR gRNA sequence
  source 1..20: mol_type = other DNA
aaattaagatgatgaataga

SEQ ID NO: 103533 - DNA, 20 bp, synthetic construct
  misc_feature 1..20: note = CRISPR gRNA sequence
  source 1..20: mol_type = other DNA
aatagatagaaaattattaa

SEQ ID NO: 103534 - DNA, 20 bp, synthetic construct
  misc_feature 1..20: note = CRISPR gRNA sequence
  source 1..20: mol_type = other DNA
acttgtgtttcctacttaca

SEQ ID NO: 103535 - DNA, 20 bp, synthetic construct
  misc_feature 1..20: note = CRISPR gRNA sequence
  source 1..20: mol_type = other DNA
cttacatagattttatttaa

SEQ ID NO: 103536 - DNA, 20 bp, synthetic construct
  misc_feature 1..20: note = CRISPR gRNA sequence
  source 1..20: mol_type = other DNA
acatagattttatttaaaag

SEQ ID NO: 103537 - DNA, 20 bp, synthetic construct
  misc_feature 1..20: note = CRISPR gRNA sequence
  source 1..20: mol_type = other DNA
tagattttatttaaaagaag

SEQ ID NO: 103538 - DNA, 20 bp, synthetic construct
  misc_feature 1..20: note = CRISPR gRNA sequence
  source 1..20: mol_type = other DNA
aaagaagtggaaacacttta

SEQ ID NO: 103539 - DNA, 20 bp, synthetic construct
  misc_feature 1..20: note = CRISPR gRNA sequence
  source 1..20: mol_type = other DNA
gaaacactttatggaaataa

SEQ ID NO: 103540 - DNA, 20 bp, synthetic construct
  misc_feature 1..20: note = CRISPR gRNA sequence
  source 1..20: mol_type = other DNA
aataatagaaacctttcctc

SEQ ID NO: 103541 - DNA, 20 bp, synthetic construct
  misc_feature 1..20: note = CRISPR gRNA sequence
  source 1..20: mol_type = other DNA
ataatagaaacctttcctct

SEQ ID NO: 103542 - DNA, 20 bp, synthetic construct
  misc_feature 1..20: note = CRISPR gRNA sequence
  source 1..20: mol_type = other DNA
taatagaaacctttcctcta

SEQ ID NO: 103543 - DNA, 20 bp, synthetic construct
  misc_feature 1..20: note = CRISPR gRNA sequence
  source 1..20: mol_type = other DNA
ctctagggatctgattattt

SEQ ID NO: 103544 - DNA, 20 bp, synthetic construct
  misc_feature 1..20: note = CRISPR gRNA sequence
  source 1..20: mol_type = other DNA
tctagggatctgattatttt

SEQ ID NO: 103545 - DNA, 20 bp, synthetic construct
  misc_feature 1..20: note = CRISPR gRNA sequence
  source 1..20: mol_type = other DNA
tagggatctgattattttgg

SEQ ID NO: 103546 - DNA, 20 bp, synthetic construct
  misc_feature 1..20: note = CRISPR gRNA sequence
  source 1..20: mol_type = other DNA
tattttgggagaattttaaa

SEQ ID NO: 103547 - DNA, 20 bp, synthetic construct
  misc_feature 1..20: note = CRISPR gRNA sequence
  source 1..20: mol_type = other DNA
agaattttaaatagttattt

SEQ ID NO: 103548 - DNA, 20 bp, synthetic construct
  misc_feature 1..20: note = CRISPR gRNA sequence
  source 1..20: mol_type = other DNA
attcttgctatatgtattct

SEQ ID NO: 103549 - DNA, 20 bp, synthetic construct
  misc_feature 1..20: note = CRISPR gRNA sequence
  source 1..20: mol_type = other DNA
ctgagaaatctttcttgata

SEQ ID NO: 103550 - DNA, 20 bp, synthetic construct
  misc_feature 1..20: note = CRISPR gRNA sequence
  source 1..20: mol_type = other DNA
tttcttgatacagaatatgc

SEQ ID NO: 103551 - DNA, 20 bp, synthetic construct
  misc_feature 1..20: note = CRISPR gRNA sequence
  source 1..20: mol_type = other DNA
atacagaatatgcaagcatt

SEQ ID NO: 103552 - DNA, 20 bp, synthetic construct
  misc_feature 1..20: note = CRISPR gRNA sequence
  source 1..20: mol_type = other DNA
gaatatgcaagcatttggtg

SEQ ID NO: 103553 - DNA, 20 bp, synthetic construct
  misc_feature 1..20: note = CRISPR gRNA sequence
  source 1..20: mol_type = other DNA
tgcaagcatttggtgtagca

SEQ ID NO: 103554 - DNA, 20 bp, synthetic construct
  misc_feature 1..20: note = CRISPR gRNA sequence
  source 1..20: mol_type = other DNA
gcaagcatttggtgtagcaa

SEQ ID NO: 103555 - DNA, 20 bp, synthetic construct
  misc_feature 1..20: note = CRISPR gRNA sequence
  source 1..20: mol_type = other DNA
caagcatttggtgtagcaaa

SEQ ID NO: 103556 - DNA, 20 bp, synthetic construct
  misc_feature 1..20: note = CRISPR gRNA sequence
  source 1..20: mol_type = other DNA
aagcatttggtgtagcaaag

SEQ ID NO: 103557 - DNA, 20 bp, synthetic construct
  misc_feature 1..20: note = CRISPR gRNA sequence
  source 1..20: mol_type = other DNA
gtagcaaaggggatttgatt

SEQ ID NO: 103558 - DNA, 20 bp, synthetic construct
  misc_feature 1..20: note = CRISPR gRNA sequence
  source 1..20: mol_type = other DNA
aaaggggatttgatttggaa

SEQ ID NO: 103559 - DNA, 20 bp, synthetic construct
  misc_feature 1..20: note = CRISPR gRNA sequence
  source 1..20: mol_type = other DNA
aaggggatttgatttggaat

SEQ ID NO: 103560 - DNA, 20 bp, synthetic construct
  misc_feature 1..20: note = CRISPR gRNA sequence
  source 1..20: mol_type = other DNA
aggggatttgatttggaatg

SEQ ID NO: 103561 - DNA, 20 bp, synthetic construct
  misc_feature 1..20: note = CRISPR gRNA sequence
  source 1..20: mol_type = other DNA
ttgatttggaatggggaaat

SEQ ID NO: 103562 - DNA, 20 bp, synthetic construct
  misc_feature 1..20: note = CRISPR gRNA sequence
  source 1..20: mol_type = other DNA
tgatttggaatggggaaata

SEQ ID NO: 103563 - DNA, 20 bp, synthetic construct
  misc_feature 1..20: note = CRISPR gRNA sequence
  source 1..20: mol_type = other DNA
gatttggaatggggaaataa

SEQ ID NO: 103564 - DNA, 20 bp, synthetic construct
  misc_feature 1..20: note = CRISPR gRNA sequence
  source 1..20: mol_type = other DNA
tggaatggggaaataaggga

SEQ ID NO: 103565 - DNA, 20 bp, synthetic construct
  misc_feature 1..20: note = CRISPR gRNA sequence
  source 1..20: mol_type = other DNA
gaatggggaaataagggaaa

SEQ ID NO: 103566 - DNA, 20 bp, synthetic construct
  misc_feature 1..20: note = CRISPR gRNA sequence
  source 1..20: mol_type = other DNA
ggggaaataagggaaagaga

SEQ ID NO: 103567 - DNA, 20 bp, synthetic construct
  misc_feature 1..20: note = CRISPR gRNA sequence
  source 1..20: mol_type = other DNA
ataagggaaagagatagcat

SEQ ID NO: 103568 - DNA, 20 bp, synthetic construct
  misc_feature 1..20: note = CRISPR gRNA sequence
  source 1..20: mol_type = other DNA
aagggaaagagatagcatga

SEQ ID NO: 103569 - DNA, 20 bp, synthetic construct
  misc_feature 1..20: note = CRISPR gRNA sequence
  source 1..20: mol_type = other DNA
gggaaagagatagcatgaga

SEQ ID NO: 103570 - DNA, 20 bp, synthetic construct
  misc_feature 1..20: note = CRISPR gRNA sequence
  source 1..20: mol_type = other DNA
aagagatagcatgagagagt

SEQ ID NO: 103571 - DNA, 20 bp, synthetic construct
  misc_feature 1..20: note = CRISPR gRNA sequence
  source 1..20: mol_type = other DNA
agagatagcatgagagagtc

SEQ ID NO: 103572 - DNA, 20 bp, synthetic construct
  misc_feature 1..20: note = CRISPR gRNA sequence
  source 1..20: mol_type = other DNA
catgagagagtcaggctgta

SEQ ID NO: 103573 - DNA, 20 bp, synthetic construct
  misc_feature 1..20: note = CRISPR gRNA sequence
  source 1..20: mol_type = other DNA
aggctgtaaagtccttaaaa

SEQ ID NO: 103574 - DNA, 20 bp, synthetic construct
  misc_feature 1..20: note = CRISPR gRNA sequence
  source 1..20: mol_type = other DNA
gtaaagtccttaaaaaagta

SEQ ID NO: 103575 - DNA, 20 bp, synthetic construct
  misc_feature 1..20: note = CRISPR gRNA sequence
  source 1..20: mol_type = other DNA
gtccttaaaaaagtaaagta

SEQ ID NO: 103576 - DNA, 20 bp, synthetic construct
  misc_feature 1..20: note = CRISPR gRNA sequence
  source 1..20: mol_type = other DNA
tccttaaaaaagtaaagtaa

SEQ ID NO: 103577 - DNA, 20 bp, synthetic construct
  misc_feature 1..20: note = CRISPR gRNA sequence
  source 1..20: mol_type = other DNA
agtaaagtaaaggttctcaa

SEQ ID NO: 103578 - DNA, 20 bp, synthetic construct
  misc_feature 1..20: note = CRISPR gRNA sequence
  source 1..20: mol_type = other DNA
aagtaaaggttctcaatgga

SEQ ID NO: 103579 - DNA, 20 bp, synthetic construct
  misc_feature 1..20: note = CRISPR gRNA sequence
  source 1..20: mol_type = other DNA
atggacagtttaacaaaact

SEQ ID NO: 103580 - DNA, 20 bp, synthetic construct
  misc_feature 1..20: note = CRISPR gRNA sequence
  source 1..20: mol_type = other DNA
tggacagtttaacaaaactt

SEQ ID NO: 103581 - DNA, 20 bp, synthetic construct
  misc_feature 1..20: note = CRISPR gRNA sequence
  source 1..20: mol_type = other DNA
acttaggatttcaatgttcc

SEQ ID NO: 103582 - DNA, 20 bp, synthetic construct
  misc_feature 1..20: note = CRISPR gRNA sequence
  source 1..20: mol_type = other DNA
tcctggtgattctaatacat

SEQ ID NO: 103583 - DNA, 20 bp, synthetic construct
  misc_feature 1..20: note = CRISPR gRNA sequence
  source 1..20: mol_type = other DNA
tggtgattctaatacattag

SEQ ID NO: 103584 - DNA, 20 bp, synthetic construct
  misc_feature 1..20: note = CRISPR gRNA sequence
  source 1..20: mol_type = other DNA
tgattctaatacattagtgg

SEQ ID NO: 103585 - DNA, 20 bp, synthetic construct
  misc_feature 1..20: note = CRISPR gRNA sequence
  source 1..20: mol_type = other DNA
ttctaatacattagtggtgg

SEQ ID NO: 103586 - DNA, 20 bp, synthetic construct
  misc_feature 1..20: note = CRISPR gRNA sequence
  source 1..20: mol_type = other DNA
taatacattagtggtggtgg

SEQ ID NO: 103587 - DNA, 20 bp, synthetic construct
  misc_feature 1..20: note = CRISPR gRNA sequence
  source 1..20: mol_type = other DNA
tacattagtggtggtggcag

SEQ ID NO: 103588 - DNA, 20 bp, synthetic construct
  misc_feature 1..20: note = CRISPR gRNA sequence
  source 1..20: mol_type = other DNA
attagtggtggtggcagtgg

SEQ ID NO: 103589 - DNA, 20 bp, synthetic construct
  misc_feature 1..20: note = CRISPR gRNA sequence
  source 1..20: mol_type = other DNA
agtggtggtggcagtggcgg

SEQ ID NO: 103590 - DNA, 20 bp, synthetic construct
  misc_feature 1..20: note = CRISPR gRNA sequence
  source 1..20: mol_type = other DNA
ggtggtggcagtggcggcgg

SEQ ID NO: 103591 - DNA, 20 bp, synthetic construct
  misc_feature 1..20: note = CRISPR gRNA sequence
  source 1..20: mol_type = other DNA
ggtggcagtggcggcggtgg

SEQ ID NO: 103592 - DNA, 20 bp, synthetic construct
  misc_feature 1..20: note = CRISPR gRNA sequence
  source 1..20: mol_type = other DNA
ggcagtggcggcggtggtgg

SEQ ID NO: 103593 - DNA, 20 bp, synthetic construct
  misc_feature 1..20: note = CRISPR gRNA sequence
  source 1..20: mol_type = other DNA
ggcggtggtggtggtgattg

SEQ ID NO: 103594 - DNA, 20 bp, synthetic construct
  misc_feature 1..20: note = CRISPR gRNA sequence
  source 1..20: mol_type = other DNA
gcggtggtggtggtgattgt

SEQ ID NO: 103595 - DNA, 20 bp, synthetic construct
  misc_feature 1..20: note = CRISPR gRNA sequence
  source 1..20: mol_type = other DNA
ggtggtggtggtgattgtag

SEQ ID NO: 103596 - DNA, 20 bp, synthetic construct
  misc_feature 1..20: note = CRISPR gRNA sequence
  source 1..20: mol_type = other DNA
gtggtggtggtgattgtagg

SEQ ID NO: 103597 - DNA, 20 bp, synthetic construct
  misc_feature 1..20: note = CRISPR gRNA sequence
  source 1..20: mol_type = other DNA
tactatctaacctactcatc

SEQ ID NO: 103598 - DNA, 20 bp, synthetic construct
  misc_feature 1..20: note = CRISPR gRNA sequence
  source 1..20: mol_type = other DNA
actatctaacctactcatct

SEQ ID NO: 103599 - DNA, 20 bp, synthetic construct
  misc_feature 1..20: note = CRISPR gRNA sequence
  source 1..20: mol_type = other DNA
tctaacctactcatctagga

SEQ ID NO: 103600 - DNA, 20 bp, synthetic construct
  misc_feature 1..20: note = CRISPR gRNA sequence
  source 1..20: mol_type = other DNA
tacttgcacatactttcatt

SEQ ID NO: 103601 - DNA, 20 bp, synthetic construct
  misc_feature 1..20: note = CRISPR gRNA sequence
  source 1..20: mol_type = other DNA
ttcattaagtgtgaatattt

SEQ ID NO: 103602 - DNA, 20 bp, synthetic construct
  misc_feature 1..20: note = CRISPR gRNA sequence
  source 1..20: mol_type = other DNA
agtcatgaatattctgttct

SEQ ID NO: 103603 - DNA, 20 bp, synthetic construct
  misc_feature 1..20: note = CRISPR gRNA sequence
  source 1..20: mol_type = other DNA
gttctaagtaatttctgtca

SEQ ID NO: 103604 - DNA, 20 bp, synthetic construct
  misc_feature 1..20: note = CRISPR gRNA sequence
  source 1..20: mol_type = other DNA
taagtaatttctgtcaaaga

SEQ ID NO: 103605 - DNA, 20 bp, synthetic construct
  misc_feature 1..20: note = CRISPR gRNA sequence
  source 1..20: mol_type = other DNA
agtaatttctgtcaaagata

SEQ ID NO: 103606 - DNA, 20 bp, synthetic construct
  misc_feature 1..20: note = CRISPR gRNA sequence
  source 1..20: mol_type = other DNA
gagtctgaaaatgaaaattt

SEQ ID NO: 103607 - DNA, 20 bp, synthetic construct
  misc_feature 1..20: note = CRISPR gRNA sequence
  source 1..20: mol_type = other DNA
gaaaattttggactattcca

SEQ ID NO: 103608 - DNA, 20 bp, synthetic construct
  misc_feature 1..20: note = CRISPR gRNA sequence
  source 1..20: mol_type = other DNA
gactattccatggatcatta

SEQ ID NO: 103609 - DNA, 20 bp, synthetic construct
  misc_feature 1..20: note = CRISPR gRNA sequence
  source 1..20: mol_type = other DNA
atcattacagtttacttcta

SEQ ID NO: 103610 - DNA, 20 bp, synthetic construct
  misc_feature 1..20: note = CRISPR gRNA sequence
  source 1..20: mol_type = other DNA
ttacttctaaagcactttta

SEQ ID NO: 103611 - DNA, 20 bp, synthetic construct
  misc_feature 1..20: note = CRISPR gRNA sequence
  source 1..20: mol_type = other DNA
aagcacttttaaagtgcttc

SEQ ID NO: 103612 - DNA, 20 bp, synthetic construct
  misc_feature 1..20: note = CRISPR gRNA sequence
  source 1..20: mol_type = other DNA
acttttaaagtgcttccaga

SEQ ID NO: 103613 - DNA, 20 bp, synthetic construct
  misc_feature 1..20: note = CRISPR gRNA sequence
  source 1..20: mol_type = other DNA
gcttccagaaagcattctat

SEQ ID NO: 103614 - DNA, 20 bp, synthetic construct
  misc_feature 1..20: note = CRISPR gRNA sequence
  source 1..20: mol_type = other DNA
cttccagaaagcattctatt

SEQ ID NO: 103615 - DNA, 20 bp, synthetic construct
  misc_feature 1..20: note = CRISPR gRNA sequence
  source 1..20: mol_type = other DNA
tctattaggtatttttgtat

SEQ ID NO: 103616 - DNA, 20 bp, synthetic construct
  misc_feature 1..20: note = CRISPR gRNA sequence
  source 1..20: mol_type = other DNA
ctattaggtatttttgtatt

SEQ ID NO: 103617 - DNA, 20 bp, synthetic construct
  misc_feature 1..20: note = CRISPR gRNA sequence
  source 1..20: mol_type = other DNA
gtatttttgtattgggactt

SEQ ID NO: 103618 - DNA, 20 bp, synthetic construct
  misc_feature 1..20: note = CRISPR gRNA sequence
  source 1..20: mol_type = other DNA
tattgggacttaagatgtga

SEQ ID NO: 103619 - DNA, 20 bp, synthetic construct
  misc_feature 1..20: note = CRISPR gRNA sequence
  source 1..20: mol_type = other DNA
ttgggacttaagatgtgaca

SEQ ID NO: 103620 - DNA, 20 bp, synthetic construct
  misc_feature 1..20: note = CRISPR gRNA sequence
  source 1..20: mol_type = other DNA
aagatgtgacagagcacttg

SEQ ID NO: 103621 - DNA, 20 bp, synthetic construct
  misc_feature 1..20: note = CRISPR gRNA sequence
  source 1..20: mol_type = other DNA
acagagcacttgtagtgacc

SEQ ID NO: 103622 - DNA, 20 bp, synthetic construct
  misc_feature 1..20: note = CRISPR gRNA sequence
  source 1..20: mol_type = other DNA
ttgtagtgacctggctccta

SEQ ID NO: 103623 - DNA, 20 bp, synthetic construct
  misc_feature 1..20: note = CRISPR gRNA sequence
  source 1..20: mol_type = other DNA
tagtgacctggctcctacag

SEQ ID NO: 103624 - DNA, 20 bp, synthetic construct
  misc_feature 1..20: note = CRISPR gRNA sequence
  source 1..20: mol_type = other DNA
tacagtagtctgtttactca

SEQ ID NO: 103625 - DNA, 20 bp, synthetic construct
  misc_feature 1..20: note = CRISPR gRNA sequence
  source 1..20: mol_type = other DNA
acagtagtctgtttactcat

SEQ ID NO: 103626 - DNA, 20 bp, synthetic construct
  misc_feature 1..20: note = CRISPR gRNA sequence
  source 1..20: mol_type = other DNA
agtagtctgtttactcatag

SEQ ID NO: 103627 - DNA, 20 bp, synthetic construct
  misc_feature 1..20: note = CRISPR gRNA sequence
  source 1..20: mol_type = other DNA
atttgttgttgcttctgata

SEQ ID NO: 103628 - DNA, 20 bp, synthetic construct
  misc_feature 1..20: note = CRISPR gRNA sequence
  source 1..20: mol_type = other DNA
ataaagctaaaataaccatg

SEQ ID NO: 103629 - DNA, 20 bp, synthetic construct
  misc_feature 1..20: note = CRISPR gRNA sequence
  source 1..20: mol_type = other DNA
aaataaccatgtggatatta

SEQ ID NO: 103630 - DNA, 20 bp, synthetic construct
  misc_feature 1..20: note = CRISPR gRNA sequence
  source 1..20: mol_type = other DNA
ataaccatgtggatattata

SEQ ID NO: 103631 - DNA, 20 bp, synthetic construct
  misc_feature 1..20: note = CRISPR gRNA sequence
  source 1..20: mol_type = other DNA
taaccatgtggatattatag

SEQ ID NO: 103632 - DNA, 20 bp, synthetic construct
  misc_feature 1..20: note = CRISPR gRNA sequence
  source 1..20: mol_type = other DNA
catgtggatattatagaggc

SEQ ID NO: 103633 - DNA, 20 bp, synthetic construct
  misc_feature 1..20: note = CRISPR gRNA sequence
  source 1..20: mol_type = other DNA
tggatattatagaggccagt

SEQ ID NO: 103634 - DNA, 20 bp, synthetic construct
  misc_feature 1..20: note = CRISPR gRNA sequence
  source 1..20: mol_type = other DNA
ggatattatagaggccagtg

SEQ ID NO: 103635 - DNA, 20 bp, synthetic construct
  misc_feature 1..20: note = CRISPR gRNA sequence
  source 1..20: mol_type = other DNA
gccagtgaggaattccacca

SEQ ID NO: 103636 - DNA, 20 bp, synthetic construct
  misc_feature 1..20: note = CRISPR gRNA sequence
  source 1..20: mol_type = other DNA
cagtgaggaattccaccatg

SEQ ID NO: 103637 - DNA, 20 bp, synthetic construct
  misc_feature 1..20: note = CRISPR gRNA sequence
  source 1..20: mol_type = other DNA
catggagactgcaaactgac

SEQ ID NO: 103638 - DNA, 20 bp, synthetic construct
  misc_feature 1..20: note = CRISPR gRNA sequence
  source 1..20: mol_type = other DNA
gagactgcaaactgaccaga

SEQ ID NO: 103639 - DNA, 20 bp, synthetic construct
  misc_feature 1..20: note = CRISPR gRNA sequence
  source 1..20: mol_type = other DNA
actgaccagaaagtgctttt

SEQ ID NO: 103640 - DNA, 20 bp, synthetic construct
  misc_feature 1..20: note = CRISPR gRNA sequence
  source 1..20: mol_type = other DNA
aagtgcttttaagaaatctt

SEQ ID NO: 103641 - DNA, 20 bp, synthetic construct
  misc_feature 1..20: note = CRISPR gRNA sequence
  source 1..20: mol_type = other DNA
tgcttttaagaaatctttag

SEQ ID NO: 103642 - DNA, 20 bp, synthetic construct
  misc_feature 1..20: note = CRISPR gRNA sequence
  source 1..20: mol_type = other DNA
tttaagaaatctttagtagt

SEQ ID NO: 103643 - DNA, 20 bp, synthetic construct
  misc_feature 1..20: note = CRISPR gRNA sequence
  source 1..20: mol_type = other DNA
gtttaaacaacaaacatatc

SEQ ID NO: 103644 - DNA, 20 bp, synthetic construct
  misc_feature 1..20: note = CRISPR gRNA sequence
  source 1..20: mol_type = other DNA
acaaacatatctagaattca

SEQ ID NO: 103645 - DNA, 20 bp, synthetic construct
  misc_feature 1..20: note = CRISPR gRNA sequence
  source 1..20: mol_type = other DNA
aaacatatctagaattcaca

SEQ ID NO: 103646 - DNA, 20 bp, synthetic construct
  misc_feature 1..20: note = CRISPR gRNA sequence
  source 1..20: mol_type = other DNA
tagaattcacagagtaaaat

SEQ ID NO: 103647 - DNA, 20 bp, synthetic construct
  misc_feature 1..20: note = CRISPR gRNA sequence
  source 1..20: mol_type = other DNA
aattcacagagtaaaatgag

SEQ ID NO: 103648 - DNA, 20 bp, synthetic construct
  misc_feature 1..20: note = CRISPR gRNA sequence
  source 1..20: mol_type = other DNA
attcacagagtaaaatgagc

SEQ ID NO: 103649 - DNA, 20 bp, synthetic construct
  misc_feature 1..20: note = CRISPR gRNA sequence
  source 1..20: mol_type = other DNA
agagtaaaatgagcaggata

SEQ ID NO: 103650 - DNA, 20 bp, synthetic construct
  misc_feature 1..20: note = CRISPR gRNA sequence
  source 1..20: mol_type = other DNA
gagtaaaatgagcaggataa

SEQ ID NO: 103651 - DNA, 20 bp, synthetic construct
  misc_feature 1..20: note = CRISPR gRNA sequence
  source 1..20: mol_type = other DNA
atacatttgacatttcattt

SEQ ID NO: 103652 - DNA, 20 bp, synthetic construct
  misc_feature 1..20: note = CRISPR gRNA sequence
  source 1..20: mol_type = other DNA
ttgacatttcattttagctt

SEQ ID NO: 103653 - DNA, 20 bp, synthetic construct
  misc_feature 1..20: note = CRISPR gRNA sequence
  source 1..20: mol_type = other DNA
gacatttcattttagcttga

SEQ ID NO: 103654 - DNA, 20 bp, synthetic construct
  misc_feature 1..20: note = CRISPR gRNA sequence
  source 1..20: mol_type = other DNA
cattttagcttgagagactg

SEQ ID NO: 103655 - DNA, 20 bp, synthetic construct
  misc_feature 1..20: note = CRISPR gRNA sequence
  source 1..20: mol_type = other DNA
attttagcttgagagactgt

SEQ ID NO: 103656 - DNA, 20 bp, synthetic construct
  misc_feature 1..20: note = CRISPR gRNA sequence
  source 1..20: mol_type = other DNA
ttttagcttgagagactgta

SEQ ID NO: 103657 - DNA, 20 bp, synthetic construct
  misc_feature 1..20: note = CRISPR gRNA sequence
  source 1..20: mol_type = other DNA
ttgagagactgtagggaaaa

SEQ ID NO: 103658 - DNA, 20 bp, synthetic construct
  misc_feature 1..20: note = CRISPR gRNA sequence
  source 1..20: mol_type = other DNA
tgagagactgtagggaaaaa

SEQ ID NO: 103659 - DNA, 20 bp, synthetic construct
  misc_feature 1..20: note = CRISPR gRNA sequence
  source 1..20: mol_type = other DNA
gagagactgtagggaaaaaa

SEQ ID NO: 103660 - DNA, 20 bp, synthetic construct
  misc_feature 1..20: note = CRISPR gRNA sequence
  source 1..20: mol_type = other DNA
aaaagggtcatcctctacat

SEQ ID NO: 103661 - DNA, 20 bp, synthetic construct
  misc_feature 1..20: note = CRISPR gRNA sequence
  source 1..20: mol_type = other DNA
tcatcctctacataagcttc

SEQ ID NO: 103662 - DNA, 20 bp, synthetic construct
  misc_feature 1..20: note = CRISPR gRNA sequence
  source 1..20: mol_type = other DNA
atcctctacataagcttcca

SEQ ID NO: 103663 - DNA, 20 bp, synthetic construct
  misc_feature 1..20: note = CRISPR gRNA sequence
  source 1..20: mol_type = other DNA
ttccagagctgcttgctacc

SEQ ID NO: 103664 - DNA, 20 bp, synthetic construct
  misc_feature 1..20: note = CRISPR gRNA sequence
  source 1..20: mol_type = other DNA
ctgcttgctacccagcctcc

SEQ ID NO: 103665 - DNA, 20 bp, synthetic construct
  misc_feature 1..20: note = CRISPR gRNA sequence
  source 1..20: mol_type = other DNA
gcttgctacccagcctccta

SEQ ID NO: 103666 - DNA, 20 bp, synthetic construct
  misc_feature 1..20: note = CRISPR gRNA sequence
  source 1..20: mol_type = other DNA
cagcctcctagagtcattgc

SEQ ID NO: 103667 - DNA, 20 bp, synthetic construct
  misc_feature 1..20: note = CRISPR gRNA sequence
  source 1..20: mol_type = other DNA
agcctcctagagtcattgct

SEQ ID NO: 103668 - DNA, 20 bp, synthetic construct
  misc_feature 1..20: note = CRISPR gRNA sequence
  source 1..20: mol_type = other DNA
cctagagtcattgctgggta

SEQ ID NO: 103669 - DNA, 20 bp, synthetic construct
  misc_feature 1..20: note = CRISPR gRNA sequence
  source 1..20: mol_type = other DNA
tttaccttcttcactttatt

SEQ ID NO: 103670 - DNA, 20 bp, synthetic construct
  misc_feature 1..20: note = CRISPR gRNA sequence
  source 1..20: mol_type = other DNA
ccctctcattgccttctctc

SEQ ID NO: 103671 - DNA, 20 bp, synthetic construct
  misc_feature 1..20: note = CRISPR gRNA sequence
  source 1..20: mol_type = other DNA
cttctctccagccttcacta

SEQ ID NO: 103672 - DNA, 20 bp, synthetic construct
  misc_feature 1..20: note = CRISPR gRNA sequence
  source 1..20: mol_type = other DNA
ccttcactacagaccattcc

SEQ ID NO: 103673 - DNA, 20 bp, synthetic construct
  misc_feature 1..20: note = CRISPR gRNA sequence
  source 1..20: mol_type = other DNA
actacagaccattcctggat

SEQ ID NO: 103674 - DNA, 20 bp, synthetic construct
  misc_feature 1..20: note = CRISPR gRNA sequence
  source 1..20: mol_type = other DNA
cattcctggattggtttaaa

SEQ ID NO: 103675 - DNA, 20 bp, synthetic construct
  misc_feature 1..20: note = CRISPR gRNA sequence
  source 1..20: mol_type = other DNA
attcctggattggtttaaac

SEQ ID NO: 103676 - DNA, 20 bp, synthetic construct
  misc_feature 1..20: note = CRISPR gRNA sequence
  source 1..20: mol_type = other DNA
ttatgattaaatgtttgtca

SEQ ID NO: 103677 - DNA, 20 bp, synthetic construct
  misc_feature 1..20: note = CRISPR gRNA sequence
  source 1..20: mol_type = other DNA
ttaaatgtttgtcatggatt

SEQ ID NO: 103678 - DNA, 20 bp, synthetic construct
  misc_feature 1..20: note = CRISPR gRNA sequence
  source 1..20: mol_type = other DNA
tcatggatttagcccgtgtt

SEQ ID NO: 103679 - DNA, 20 bp, synthetic construct
  misc_feature 1..20: note = CRISPR gRNA sequence
  source 1..20: mol_type = other DNA
acaaatgccttatatctatt

SEQ ID NO: 103680 - DNA, 20 bp, synthetic construct
  misc_feature 1..20: note = CRISPR gRNA sequence
  source 1..20: mol_type = other DNA
atatctattgagacttctca

SEQ ID NO: 103681 - DNA, 20 bp, synthetic construct
  misc_feature 1..20: note = CRISPR gRNA sequence
  source 1..20: mol_type = other DNA
ttgagacttctcaaagactc

SEQ ID NO: 103682 - DNA, 20 bp, synthetic construct
  misc_feature 1..20: note = CRISPR gRNA sequence
  source 1..20: mol_type = other DNA
ctccattatgtctgacctta

SEQ ID NO: 103683 - DNA, 20 bp, synthetic construct
  misc_feature 1..20: note = CRISPR gRNA sequence
  source 1..20: mol_type = other DNA
atgtctgaccttaaagtatt

SEQ ID NO: 103684 - DNA, 20 bp, synthetic construct
  misc_feature 1..20: note = CRISPR gRNA sequence
  source 1..20: mol_type = other DNA
tgaccttaaagtattgagct

SEQ ID NO: 103685 - DNA, 20 bp, synthetic construct
  misc_feature 1..20: note = CRISPR gRNA sequence
  source 1..20: mol_type = other DNA
aaagtattgagcttggcatt

SEQ ID NO: 103686 - DNA, 20 bp, synthetic construct
  misc_feature 1..20: note = CRISPR gRNA sequence
  source 1..20: mol_type = other DNA
ttgagcttggcatttagtaa

SEQ ID NO: 103687 - DNA, 20 bp, synthetic construct
  misc_feature 1..20: note = CRISPR gRNA sequence
  source 1..20: mol_type = other DNA
tgagcttggcatttagtaac

SEQ ID NO: 103688 - DNA, 20 bp, synthetic construct
  misc_feature 1..20: note = CRISPR gRNA sequence
  source 1..20: mol_type = other DNA
gcatttagtaacaggattca

SEQ ID NO: 103689 - DNA, 20 bp, synthetic construct
  misc_feature 1..20: note = CRISPR gRNA sequence
  source 1..20: mol_type = other DNA
acaggattcatagatattta

SEQ ID NO: 103690 - DNA, 20 bp, synthetic construct
  misc_feature 1..20: note = CRISPR gRNA sequence
  source 1..20: mol_type = other DNA
tagatatttaaagataactt

SEQ ID NO: 103691 - DNA, 20 bp, synthetic construct
  misc_feature 1..20: note = CRISPR gRNA sequence
  source 1..20: mol_type = other DNA
agatatttaaagataacttg

SEQ ID NO: 103692 - DNA, 20 bp, synthetic construct
  misc_feature 1..20: note = CRISPR gRNA sequence
  source 1..20: mol_type = other DNA
taaagataacttgaggactt

SEQ ID NO: 103693 - DNA, 20 bp, synthetic construct
  misc_feature 1..20: note = CRISPR gRNA sequence
  source 1..20: mol_type = other DNA
acttgagacatatattttct

SEQ ID NO: 103694 - DNA, 20 bp, synthetic construct
  misc_feature 1..20: note = CRISPR gRNA sequence
  source 1..20: mol_type = other DNA
ttttctaccttttccttttc

SEQ ID NO: 103695 - DNA, 20 bp, synthetic construct
  misc_feature 1..20: note = CRISPR gRNA sequence
  source 1..20: mol_type = other DNA
ctaccttttccttttctagc

SEQ ID NO: 103696 - DNA, 20 bp, synthetic construct
  misc_feature 1..20: note = CRISPR gRNA sequence
  source 1..20: mol_type = other DNA
taccttttccttttctagca

SEQ ID NO: 103697 - DNA, 20 bp, synthetic construct
  misc_feature 1..20: note = CRISPR gRNA sequence
  source 1..20: mol_type = other DNA
cttttccttttctagcaagg

SEQ ID NO: 103698 - DNA, 20 bp, synthetic construct
  misc_feature 1..20: note = CRISPR gRNA sequence
  source 1..20: mol_type = other DNA
ttccttttctagcaaggcag

SEQ ID NO: 103699 - DNA, 20 bp, synthetic construct
  misc_feature 1..20: note = CRISPR gRNA sequence
  source 1..20: mol_type = other DNA
tttctagcaaggcagcagaa

SEQ ID NO: 103700 - DNA, 20 bp, synthetic construct
  misc_feature 1..20: note = CRISPR gRNA sequence
  source 1..20: mol_type = other DNA
gcaaggcagcagaatagttc

SEQ ID NO: 103701 - DNA, 20 bp, synthetic construct
  misc_feature 1..20: note = CRISPR gRNA sequence
  source 1..20: mol_type = other DNA
tagttccagtgattgtcttt

SEQ ID NO: 103702 - DNA, 20 bp, synthetic construct
  misc_feature 1..20: note = CRISPR gRNA sequence
  source 1..20: mol_type = other DNA
gttcttattttatttcattc

SEQ ID NO: 103703 - DNA, 20 bp, synthetic construct
  misc_feature 1..20: note = CRISPR gRNA sequence
  source 1..20: mol_type = other DNA
ttcttattttatttcattct

SEQ ID NO: 103704 - DNA, 20 bp, synthetic construct
  misc_feature 1..20: note = CRISPR gRNA sequence
  source 1..20: mol_type = other DNA
ttttatttcattctaggtcc

SEQ ID NO: 103705 - DNA, 20 bp, synthetic construct
  misc_feature 1..20: note = CRISPR gRNA sequence
  source 1..20: mol_type = other DNA
tttatttcattctaggtcca

SEQ ID NO: 103706 - DNA, 20 bp, synthetic construct
  misc_feature 1..20: note = CRISPR gRNA sequence
  source 1..20: mol_type = other DNA
ttatttcattctaggtccaa

SEQ ID NO: 103707 - DNA, 20 bp, synthetic construct
  misc_feature 1..20: note = CRISPR gRNA sequence
  source 1..20: mol_type = other DNA
tttcattctaggtccaaggg

SEQ ID NO: 103708 - DNA, 20 bp, synthetic construct
  misc_feature 1..20: note = CRISPR gRNA sequence
  source 1..20: mol_type = other DNA
ggtccaagggcagccattaa

SEQ ID NO: 103709 - DNA, 20 bp, synthetic construct
  misc_feature 1..20: note = CRISPR gRNA sequence
  source 1..20: mol_type = other DNA
aagggcagccattaatggtg

SEQ ID NO: 103710 - DNA, 20 bp, synthetic construct
  misc_feature 1..20: note = CRISPR gRNA sequence
  source 1..20: mol_type = other DNA
agggcagccattaatggtgc

SEQ ID NO: 103711 - DNA, 20 bp, synthetic construct
  misc_feature 1..20: note = CRISPR gRNA sequence
  source 1..20: mol_type = other DNA
cagccattaatggtgcaggt

SEQ ID NO: 103712 - DNA, 20 bp, synthetic construct
  misc_feature 1..20: note = CRISPR gRNA sequence
  source 1..20: mol_type = other DNA
ccattaatggtgcaggtcag

SEQ ID NO: 103713 - DNA, 20 bp, synthetic construct
  misc_feature 1..20: note = CRISPR gRNA sequence
  source 1..20: mol_type = other DNA
attaatggtgcaggtcagtg

SEQ ID NO: 103714 - DNA, 20 bp, synthetic construct
  misc_feature 1..20: note = CRISPR gRNA sequence
  source 1..20: mol_type = other DNA
ttaatggtgcaggtcagtgg

SEQ ID NO: 103715 - DNA, 20 bp, synthetic construct
  misc_feature 1..20: note = CRISPR gRNA sequence
  source 1..20: mol_type = other DNA
tggtgcaggtcagtggaggc

SEQ ID NO: 103716 - DNA, 20 bp, synthetic construct
  misc_feature 1..20: note = CRISPR gRNA sequence
  source 1..20: mol_type = other DNA
ggccagctaatcacatcaac

SEQ ID NO: 103717 - DNA, 20 bp, synthetic construct
  misc_feature 1..20: note = CRISPR gRNA sequence
  source 1..20: mol_type = other DNA
atcaactggccaacccatca

SEQ ID NO: 103718 - DNA, 20 bp, synthetic construct
  misc_feature 1..20: note = CRISPR gRNA sequence
  source 1..20: mol_type = other DNA
ctggccaacccatcatggtc

SEQ ID NO: 103719 - DNA, 20 bp, synthetic construct
  misc_feature 1..20: note = CRISPR gRNA sequence
  source 1..20: mol_type = other DNA
tggccaacccatcatggtcc

SEQ ID NO: 103720 - DNA, 20 bp, synthetic construct
  misc_feature 1..20: note = CRISPR gRNA sequence
  source 1..20: mol_type = other DNA
atcatggtccaggctgtccc

SEQ ID NO: 103721 - DNA, 20 bp, synthetic construct
  misc_feature 1..20: note = CRISPR gRNA sequence
  source 1..20: mol_type = other DNA
atggtccaggctgtccctgg

SEQ ID NO: 103722 - DNA, 20 bp, synthetic construct
  misc_feature 1..20: note = CRISPR gRNA sequence
  source 1..20: mol_type = other DNA
ccaggctgtccctggtggac

SEQ ID NO: 103723 - DNA, 20 bp, synthetic construct
  misc_feature 1..20: note = CRISPR gRNA sequence
  source 1..20: mol_type = other DNA
caggctgtccctggtggaca

SEQ ID NO: 103724 - DNA, 20 bp, synthetic construct
  misc_feature 1..20: note = CRISPR gRNA sequence
  source 1..20: mol_type = other DNA
acaaggtcaaaccatcatgc

SEQ ID NO: 103725 - DNA, 20 bp, synthetic construct
  misc_feature 1..20: note = CRISPR gRNA sequence
  source 1..20: mol_type = other DNA
atcatgcaagtacctgtttc

SEQ ID NO: 103726 - DNA, 20 bp, synthetic construct
  misc_feature 1..20: note = CRISPR gRNA sequence
  source 1..20: mol_type = other DNA
aagtacctgtttctggaaca

SEQ ID NO: 103727 - DNA, 20 bp, synthetic construct
  misc_feature 1..20: note = CRISPR gRNA sequence
  source 1..20: mol_type = other DNA
agtacctgtttctggaacac

SEQ ID NO: 103728 - DNA, 20 bp, synthetic construct
  misc_feature 1..20: note = CRISPR gRNA sequence
  source 1..20: mol_type = other DNA
gtacctgtttctggaacaca

SEQ ID NO: 103729 - DNA, 20 bp, synthetic construct
  misc_feature 1..20: note = CRISPR gRNA sequence
  source 1..20: mol_type = other DNA
tttctggaacacagggtttg

SEQ ID NO: 103730 - DNA, 20 bp, synthetic construct
  misc_feature 1..20: note = CRISPR gRNA sequence
  source 1..20: mol_type = other DNA
tggaacacagggtttgcagc

SEQ ID NO: 103731 - DNA, 20 bp, synthetic construct
  misc_feature 1..20: note = CRISPR gRNA sequence
  source 1..20: mol_type = other DNA
acacagggtttgcagcaagt

SEQ ID NO: 103732 - DNA, 20 bp, synthetic construct
  misc_feature 1..20: note = CRISPR gRNA sequence
  source 1..20: mol_type = other DNA
gagtaatatttaaaaatatt

SEQ ID NO: 103733 - DNA, 20 bp, synthetic construct
  misc_feature 1..20: note = CRISPR gRNA sequence
  source 1..20: mol_type = other DNA
taatatttaaaaatattgag

SEQ ID NO: 103734 - DNA, 20 bp, synthetic construct
  misc_feature 1..20: note = CRISPR gRNA sequence
  source 1..20: mol_type = other DNA
aaaaatattgagcagtatat

SEQ ID NO: 103735 - DNA, 20 bp, synthetic construct
  misc_feature 1..20: note = CRISPR gRNA sequence
  source 1..20: mol_type = other DNA
aaatattgagcagtatatca

SEQ ID NO: 103736 - DNA, 20 bp, synthetic construct
  misc_feature 1..20: note = CRISPR gRNA sequence
  source 1..20: mol_type = other DNA
aatattgagcagtatatcag

SEQ ID NO: 103737 - DNA, 20 bp, synthetic construct
  misc_feature 1..20: note = CRISPR gRNA sequence
  source 1..20: mol_type = other DNA
tattgagcagtatatcagag

SEQ ID NO: 103738 - DNA, 20 bp, synthetic construct
  misc_feature 1..20: note = CRISPR gRNA sequence
  source 1..20: mol_type = other DNA
ttgagcagtatatcagagga

SEQ ID NO: 103739 - DNA, 20 bp, synthetic construct
  misc_feature 1..20: note = CRISPR gRNA sequence
  source 1..20: mol_type = other DNA
tgagcagtatatcagaggag

SEQ ID NO: 103740 - DNA, 20 bp, synthetic construct
  misc_feature 1..20: note = CRISPR gRNA sequence
  source 1..20: mol_type = other DNA
atatcagaggagaggtttca

SEQ ID NO: 103741 - DNA, 20 bp, synthetic construct
  misc_feature 1..20: note = CRISPR gRNA sequence
  source 1..20: mol_type = other DNA
agaggagaggtttcaaagaa

SEQ ID NO: 103742 - DNA, 20 bp, synthetic construct
  misc_feature 1..20: note = CRISPR gRNA sequence
  source 1..20: mol_type = other DNA
cctaacccacattttgcatt

SEQ ID NO: 103743 - DNA, 20 bp, synthetic construct
  misc_feature 1..20: note = CRISPR gRNA sequence
  source 1..20: mol_type = other DNA
cagttgattttctgccttta

SEQ ID NO: 103744 - DNA, 20 bp, synthetic construct
  misc_feature 1..20: note = CRISPR gRNA sequence
  source 1..20: mol_type = other DNA
attttctgcctttatagtac

SEQ ID NO: 103745 - DNA, 20 bp, synthetic construct
  misc_feature 1..20: note = CRISPR gRNA sequence
  source 1..20: mol_type = other DNA
atagtaccagtgatataaac

SEQ ID NO: 103746 - DNA, 20 bp, synthetic construct
  misc_feature 1..20: note = CRISPR gRNA sequence
  source 1..20: mol_type = other DNA
tgatataaactagaactatg

SEQ ID NO: 103747 - DNA, 20 bp, synthetic construct
  misc_feature 1..20: note = CRISPR gRNA sequence
  source 1..20: mol_type = other DNA
aactagaactatgcagaaat

SEQ ID NO: 103748 - DNA, 20 bp, synthetic construct
  misc_feature 1..20: note = CRISPR gRNA sequence
  source 1..20: mol_type = other DNA
agaactatgcagaaattgga

SEQ ID NO: 103749 - DNA, 20 bp, synthetic construct
  misc_feature 1..20: note = CRISPR gRNA sequence
  source 1..20: mol_type = other DNA
atgcagaaattggacagctc

SEQ ID NO: 103750 - DNA, 20 bp, synthetic construct
  misc_feature 1..20: note = CRISPR gRNA sequence
  source 1..20: mol_type = other DNA
ggacagctccagtaatgact

SEQ ID NO: 103751 - DNA, 20 bp, synthetic construct
  misc_feature 1..20: note = CRISPR gRNA sequence
  source 1..20: mol_type = other DNA
tccagtaatgactaagatat

SEQ ID NO: 103752 - DNA, 20 bp, synthetic construct
  misc_feature 1..20: note = CRISPR gRNA sequence
  source 1..20: mol_type = other DNA
ccagtaatgactaagatatt

SEQ ID NO: 103753 - DNA, 20 bp, synthetic construct
  misc_feature 1..20: note = CRISPR gRNA sequence
  source 1..20: mol_type = other DNA
catgatcttgaattgctgta

SEQ ID NO: 103754 - DNA, 20 bp, synthetic construct
  misc_feature 1..20: note = CRISPR gRNA sequence
  source 1..20: mol_type = other DNA
gaattgctgtaaagtatatg

SEQ ID NO: 103755 - DNA, 20 bp, synthetic construct
  misc_feature 1..20: note = CRISPR gRNA sequence
  source 1..20: mol_type = other DNA
attgctgtaaagtatatgaa

SEQ ID NO: 103756 - DNA, 20 bp, synthetic construct
  misc_feature 1..20: note = CRISPR gRNA sequence
  source 1..20: mol_type = other DNA
ttgctgtaaagtatatgaag

SEQ ID NO: 103757 - DNA, 20 bp, synthetic construct
  misc_feature 1..20: note = CRISPR gRNA sequence
  source 1..20: mol_type = other DNA
tgtaaagtatatgaagaggt

SEQ ID NO: 103758 - DNA, 20 bp, synthetic construct
  misc_feature 1..20: note = CRISPR gRNA sequence
  source 1..20: mol_type = other DNA
tatatgaagaggttagaatc

SEQ ID NO: 103759 - DNA, 20 bp, synthetic construct
  misc_feature 1..20: note = CRISPR gRNA sequence
  source 1..20: mol_type = other DNA
agaggttagaatctagttta

SEQ ID NO: 103760 - DNA, 20 bp, synthetic construct
  misc_feature 1..20: note = CRISPR gRNA sequence
  source 1..20: mol_type = other DNA
tatagtatattttattttaa

SEQ ID NO: 103761 - DNA, 20 bp, synthetic construct
  misc_feature 1..20: note = CRISPR gRNA sequence
  source 1..20: mol_type = other DNA
attttaaaagaaacaaaaat

SEQ ID NO: 103762 - DNA, 20 bp, synthetic construct
  misc_feature 1..20: note = CRISPR gRNA sequence
  source 1..20: mol_type = other DNA
aagaaacaaaaatgagtatt

SEQ ID NO: 103763 - DNA, 20 bp, synthetic construct
  misc_feature 1..20: note = CRISPR gRNA sequence
  source 1..20: mol_type = other DNA
aacaaaaatgagtatttaga

SEQ ID NO: 103764 - DNA, 20 bp, synthetic construct
  misc_feature 1..20: note = CRISPR gRNA sequence
  source 1..20: mol_type = other DNA
aaaatgagtatttagaaagt

SEQ ID NO: 103765 - DNA, 20 bp, synthetic construct
  misc_feature 1..20: note = CRISPR gRNA sequence
  source 1..20: mol_type = other DNA
agttagaaaaataacaaaac

SEQ ID NO: 103766 - DNA, 20 bp, synthetic construct
  misc_feature 1..20: note = CRISPR gRNA sequence
  source 1..20: mol_type = other DNA
aaaataacaaaacgagcaaa

SEQ ID NO: 103767 - DNA, 20 bp, synthetic construct
  misc_feature 1..20: note = CRISPR gRNA sequence
  source 1..20: mol_type = other DNA
ataacaaaacgagcaaaaag

SEQ ID NO: 103768 - DNA, 20 bp, synthetic construct
  misc_feature 1..20: note = CRISPR gRNA sequence
  source 1..20: mol_type = other DNA
taacaaaacgagcaaaaagt

SEQ ID NO: 103769 - DNA, 20 bp, synthetic construct
  misc_feature 1..20: note = CRISPR gRNA sequence
  source 1..20: mol_type = other DNA
aaagtgggtccaaattaatt

SEQ ID NO: 103770 - DNA, 20 bp, synthetic construct
  misc_feature 1..20: note = CRISPR gRNA sequence
  source 1..20: mol_type = other DNA
gtgggtccaaattaattaag

SEQ ID NO: 103771 - DNA, 20 bp, synthetic construct
  misc_feature 1..20: note = CRISPR gRNA sequence
  source 1..20: mol_type = other DNA
ttaagtagaaaactgacgta

SEQ ID NO: 103772 - DNA, 20 bp, synthetic construct
  misc_feature 1..20: note = CRISPR gRNA sequence
  source 1..20: mol_type = other DNA
gtagaaaactgacgtataga

SEQ ID NO: 103773 - DNA, 20 bp, synthetic construct
  misc_feature 1..20: note = CRISPR gRNA sequence
  source 1..20: mol_type = other DNA
tagaaaactgacgtatagaa

SEQ ID NO: 103774 - DNA, 20 bp, synthetic construct
  misc_feature 1..20: note = CRISPR gRNA sequence
  source 1..20: mol_type = other DNA
tagaaaggataaataaaatc

SEQ ID NO: 103775 - DNA, 20 bp, synthetic construct
  misc_feature 1..20: note = CRISPR gRNA sequence
  source 1..20: mol_type = other DNA
aaataaaatctagattgttt

SEQ ID NO: 103776 - DNA, 20 bp, synthetic construct
  misc_feature 1..20: note = CRISPR gRNA sequence
  source 1..20: mol_type = other DNA
taaaatctagattgtttaag

SEQ ID NO: 103777 - DNA, 20 bp, synthetic construct
  misc_feature 1..20: note = CRISPR gRNA sequence
  source 1..20: mol_type = other DNA
gtttaagcagaccaataaaa

SEQ ID NO: 103778 - DNA, 20 bp, synthetic construct
  misc_feature 1..20: note = CRISPR gRNA sequence
  source 1..20: mol_type = other DNA
tttaagcagaccaataaaac

SEQ ID NO: 103779 - DNA, 20 bp, synthetic construct
  misc_feature 1..20: note = CRISPR gRNA sequence
  source 1..20: mol_type = other DNA
accaataaaacaggtaaatc

SEQ ID NO: 103780 - DNA, 20 bp, synthetic construct
  misc_feature 1..20: note = CRISPR gRNA sequence
  source 1..20: mol_type = other DNA
atccagttgaaacactgatt

SEQ ID NO: 103781 - DNA, 20 bp, synthetic construct
  misc_feature 1..20: note = CRISPR gRNA sequence
  source 1..20: mol_type = other DNA
ttgaaacactgattgagaaa

SEQ ID NO: 103782 - DNA, 20 bp, synthetic construct
  misc_feature 1..20: note = CRISPR gRNA sequence
  source 1..20: mol_type = other DNA
gattgagaaacagaaaacaa

SEQ ID NO: 103783 - DNA, 20 bp, synthetic construct
  misc_feature 1..20: note = CRISPR gRNA sequence
  source 1..20: mol_type = other DNA
gagaaacagaaaacaaaagt

SEQ ID NO: 103784 - DNA, 20 bp, synthetic construct
  misc_feature 1..20: note = CRISPR gRNA sequence
  source 1..20: mol_type = other DNA
acagaaaacaaaagtaagca

SEQ ID NO: 103785 - DNA, 20 bp, synthetic construct
  misc_feature 1..20: note = CRISPR gRNA sequence
  source 1..20: mol_type = other DNA
aacaaaagtaagcaaagatg

SEQ ID NO: 103786 - DNA, 20 bp, synthetic construct
  misc_feature 1..20: note = CRISPR gRNA sequence
  source 1..20: mol_type = other DNA
aaaagtaagcaaagatgtag

SEQ ID NO: 103787 - DNA, 20 bp, synthetic construct
  misc_feature 1..20: note = CRISPR gRNA sequence
  source 1..20: mol_type = other DNA
aagtaagcaaagatgtagaa

SEQ ID NO: 103788 - DNA, 20 bp, synthetic construct
  misc_feature 1..20: note = CRISPR gRNA sequence
  source 1..20: mol_type = other DNA
caaagatgtagaagagatta

SEQ ID NO: 103789 - DNA, 20 bp, synthetic construct
  misc_feature 1..20: note = CRISPR gRNA sequence
  source 1..20: mol_type = other DNA
aaagatgtagaagagattaa

SEQ ID NO: 103790 - DNA, 20 bp, synthetic construct
  misc_feature 1..20: note = CRISPR gRNA sequence
  source 1..20: mol_type = other DNA
gatgtagaagagattaaagg

SEQ ID NO: 103791 - DNA, 20 bp, synthetic construct
  misc_feature 1..20: note = CRISPR gRNA sequence
  source 1..20: mol_type = other DNA
atgtagaagagattaaagga

SEQ ID NO: 103792 - DNA, 20 bp, synthetic construct
  misc_feature 1..20: note = CRISPR gRNA sequence
  source 1..20: mol_type = other DNA
agaagagattaaaggaaggc

SEQ ID NO: 103793 - DNA, 20 bp, synthetic construct
  misc_feature 1..20: note = CRISPR gRNA sequence
  source 1..20: mol_type = other DNA
gaagagattaaaggaaggcc

SEQ ID NO: 103794 - DNA, 20 bp, synthetic construct
  misc_feature 1..20: note = CRISPR gRNA sequence
  source 1..20: mol_type = other DNA
gattaaaggaaggccaggcg

SEQ ID NO: 103795 - DNA, 20 bp, synthetic construct
  misc_feature 1..20: note = CRISPR gRNA sequence
  source 1..20: mol_type = other DNA
taaaggaaggccaggcgcag

SEQ ID NO: 103796 - DNA, 20 bp, synthetic construct
  misc_feature 1..20: note = CRISPR gRNA sequence
  source 1..20: mol_type = other DNA
gtggctcatgcctgtgatcc

SEQ ID NO: 103797 - DNA, 20 bp, synthetic construct
  misc_feature 1..20: note = CRISPR gRNA sequence
  source 1..20: mol_type = other DNA
atgcctgtgatcccagcact

SEQ ID NO: 103798 - DNA, 20 bp, synthetic construct
  misc_feature 1..20: note = CRISPR gRNA sequence
  source 1..20: mol_type = other DNA
tgcctgtgatcccagcactt

SEQ ID NO: 103799 - DNA, 20 bp, synthetic construct
  misc_feature 1..20: note = CRISPR gRNA sequence
  source 1..20: mol_type = other DNA
gcctgtgatcccagcacttg

SEQ ID NO: 103800 - DNA, 20 bp, synthetic construct
  misc_feature 1..20: note = CRISPR gRNA sequence
  source 1..20: mol_type = other DNA
ctgtgatcccagcacttggg

SEQ ID NO: 103801 - DNA, 20 bp, synthetic construct
  misc_feature 1..20: note = CRISPR gRNA sequence
  source 1..20: mol_type = other DNA
tgtgatcccagcacttgggg

SEQ ID NO: 103802 - DNA, 20 bp, synthetic construct
  misc_feature 1..20: note = CRISPR gRNA sequence
  source 1..20: mol_type = other DNA
tcccagcacttggggaggcc

SEQ ID NO: 103803 - DNA, 20 bp, synthetic construct
  misc_feature 1..20: note = CRISPR gRNA sequence
  source 1..20: mol_type = other DNA
cccagcacttggggaggcca

SEQ ID NO: 103804 - DNA, 20 bp, synthetic construct
  misc_feature 1..20: note = CRISPR gRNA sequence
  source 1..20: mol_type = other DNA
agcacttggggaggccaagg

SEQ ID NO: 103805 - DNA, 20 bp, synthetic construct
  misc_feature 1..20: note = CRISPR gRNA sequence
  source 1..20: mol_type = other DNA
gcacttggggaggccaaggc

SEQ ID NO: 103806 - DNA, 20 bp, synthetic construct
  misc_feature 1..20: note = CRISPR gRNA sequence
  source 1..20: mol_type = other DNA
cttggggaggccaaggcagg

SEQ ID NO: 103807 - DNA, 20 bp, synthetic construct
  misc_feature 1..20: note = CRISPR gRNA sequence
  source 1..20: mol_type = other DNA
ccaaggcaggtggatcactt

SEQ ID NO: 103808 - DNA, 20 bp, synthetic construct
  misc_feature 1..20: note = CRISPR gRNA sequence
  source 1..20: mol_type = other DNA
caaggcaggtggatcacttg

SEQ ID NO: 103809 - DNA, 20 bp, synthetic construct
  misc_feature 1..20: note = CRISPR gRNA sequence
  source 1..20: mol_type = other DNA
gcaggtggatcacttgaggc

SEQ ID NO: 103810 - DNA, 20 bp, synthetic construct
  misc_feature 1..20: note = CRISPR gRNA sequence
  source 1..20: mol_type = other DNA
caggtggatcacttgaggcc

SEQ ID NO: 103811 - DNA, 20 bp, synthetic construct
  misc_feature 1..20: note = CRISPR gRNA sequence
  source 1..20: mol_type = other DNA
ggtggatcacttgaggccag

SEQ ID NO: 103812 - DNA, 20 bp, synthetic construct
  misc_feature 1..20: note = CRISPR gRNA sequence
  source 1..20: mol_type = other DNA
tcacttgaggccaggagttc

SEQ ID NO: 103813 - DNA, 20 bp, synthetic construct
  misc_feature 1..20: note = CRISPR gRNA sequence
  source 1..20: mol_type = other DNA
tgaggccaggagttcaagac

SEQ ID NO: 103814 - DNA, 20 bp, synthetic construct
  misc_feature 1..20: note = CRISPR gRNA sequence
  source 1..20: mol_type = other DNA
ccaggagttcaagaccagcc

SEQ ID NO: 103815 - DNA, 20 bp, synthetic construct
  misc_feature 1..20: note = CRISPR gRNA sequence
  source 1..20: mol_type = other DNA
ctctactaaaaataaaaaat

SEQ ID NO: 103816 - DNA, 20 bp, synthetic construct
  misc_feature 1..20: note = CRISPR gRNA sequence
  source 1..20: mol_type = other DNA
actaaaaataaaaaattagc

SEQ ID NO: 103817 - DNA, 20 bp, synthetic construct
  misc_feature 1..20: note = CRISPR gRNA sequence
  source 1..20: mol_type = other DNA
ctaaaaataaaaaattagcc

SEQ ID NO: 103818 - DNA, 20 bp, synthetic construct
  misc_feature 1..20: note = CRISPR gRNA sequence
  source 1..20: mol_type = other DNA
aataaaaaattagccgggcg

SEQ ID NO: 103819 - DNA, 20 bp, synthetic construct
  misc_feature 1..20: note = CRISPR gRNA sequence
  source 1..20: mol_type = other DNA
aaaaaattagccgggcgtgg

SEQ ID NO: 103820 - DNA, 20 bp, synthetic construct
  misc_feature 1..20: note = CRISPR gRNA sequence
  source 1..20: mol_type = other DNA
gtggcacgcacctgtaatcc

SEQ ID NO: 103821 - DNA, 20 bp, synthetic construct
  misc_feature 1..20: note = CRISPR gRNA sequence
  source 1..20: mol_type = other DNA
cacctgtaatcccagctact

SEQ ID NO: 103822 - DNA, 20 bp, synthetic construct
  misc_feature 1..20: note = CRISPR gRNA sequence
  source 1..20: mol_type = other DNA
acctgtaatcccagctactt

SEQ ID NO: 103823 - DNA, 20 bp, synthetic construct
  misc_feature 1..20: note = CRISPR gRNA sequence
  source 1..20: mol_type = other DNA
cctgtaatcccagctacttg

SEQ ID NO: 103824 - DNA, 20 bp, synthetic construct
  misc_feature 1..20: note = CRISPR gRNA sequence
  source 1..20: mol_type = other DNA
ctgtaatcccagctacttgg

SEQ ID NO: 103825 - DNA, 20 bp, synthetic construct
  misc_feature 1..20: note = CRISPR gRNA sequence
  source 1..20: mol_type = other DNA
tgtaatcccagctacttggg

SEQ ID NO: 103826 - DNA, 20 bp, synthetic construct
  misc_feature 1..20: note = CRISPR gRNA sequence
  source 1..20: mol_type = other DNA
tcccagctacttggggggtt

SEQ ID NO: 103827 - DNA, 20 bp, synthetic construct
  misc_feature 1..20: note = CRISPR gRNA sequence
  source 1..20: mol_type = other DNA
cccagctacttggggggttg

SEQ ID NO: 103828 - DNA, 20 bp, synthetic construct
  misc_feature 1..20: note = CRISPR gRNA sequence
  source 1..20: mol_type = other DNA
tacttggggggttgaggcat

SEQ ID NO: 103829 - DNA, 20 bp, synthetic construct
  misc_feature 1..20: note = CRISPR gRNA sequence
  source 1..20: mol_type = other DNA
ggcataagatatcttgaacc

SEQ ID NO: 103830 - DNA, 20 bp, synthetic construct
  misc_feature 1..20: note = CRISPR gRNA sequence
  source 1..20: mol_type = other DNA
gcataagatatcttgaaccc

SEQ ID NO: 103831 - DNA, 20 bp, synthetic construct
  misc_feature 1..20: note = CRISPR gRNA sequence
  source 1..20: mol_type = other DNA
ataagatatcttgaacccag

SEQ ID NO: 103832 - DNA, 20 bp, synthetic construct
  misc_feature 1..20: note = CRISPR gRNA sequence
  source 1..20: mol_type = other DNA
taagatatcttgaacccagg

SEQ ID NO: 103833 - DNA, 20 bp, synthetic construct
  misc_feature 1..20: note = CRISPR gRNA sequence
  source 1..20: mol_type = other DNA
gatatcttgaacccaggagg

SEQ ID NO: 103834 - DNA, 20 bp, synthetic construct
  misc_feature 1..20: note = CRISPR gRNA sequence
  source 1..20: mol_type = other DNA
tatcttgaacccaggaggcg

SEQ ID NO: 103835 - DNA, 20 bp, synthetic construct
  misc_feature 1..20: note = CRISPR gRNA sequence
  source 1..20: mol_type = other DNA
atcttgaacccaggaggcgg

SEQ ID NO: 103836 - DNA, 20 bp, synthetic construct
  misc_feature 1..20: note = CRISPR gRNA sequence
  source 1..20: mol_type = other DNA
aacccaggaggcggaggttg

SEQ ID NO: 103837 - DNA, 20 bp, synthetic construct
  misc_feature 1..20: note = CRISPR gRNA sequence
  source 1..20: mol_type = other DNA
caggaggcggaggttgcagt

SEQ ID NO: 103838 - DNA, 20 bp, synthetic construct
  misc_feature 1..20: note = CRISPR gRNA sequence
  source 1..20: mol_type = other DNA
ggcggaggttgcagtaagcc

SEQ ID NO: 103839 - DNA, 20 bp, synthetic construct
  misc_feature 1..20: note = CRISPR gRNA sequence
  source 1..20: mol_type = other DNA
aagattgtgccactgcactc

SEQ ID NO: 103840 - DNA, 20 bp, synthetic construct
  misc_feature 1..20: note = CRISPR gRNA sequence
  source 1..20: mol_type = other DNA
agattgtgccactgcactcc

SEQ ID NO: 103841 - DNA, 20 bp, synthetic construct
  misc_feature 1..20: note = CRISPR gRNA sequence
  source 1..20: mol_type = other DNA
tgtgccactgcactccaggc

SEQ ID NO: 103842 - DNA, 20 bp, synthetic construct
  misc_feature 1..20: note = CRISPR gRNA sequence
  source 1..20: mol_type = other DNA
gtgccactgcactccaggct

SEQ ID NO: 103843 - DNA, 20 bp, synthetic construct
  misc_feature 1..20: note = CRISPR gRNA sequence
  source 1..20: mol_type = other DNA
ctgcactccaggctgggcac

SEQ ID NO: 103844 - DNA, 20 bp, synthetic construct
  misc_feature 1..20: note = CRISPR gRNA sequence
  source 1..20: mol_type = other DNA
gcactccaggctgggcacca

SEQ ID NO: 103845 - DNA, 20 bp, synthetic construct
  misc_feature 1..20: note = CRISPR gRNA sequence
  source 1..20: mol_type = other DNA
tccaggctgggcaccagagc

SEQ ID NO: 103846 - DNA, 20 bp, synthetic construct
  misc_feature 1..20: note = CRISPR gRNA sequence
  source 1..20: mol_type = other DNA
aagattctgtctcaaaaaaa

SEQ ID NO: 103847 - DNA, 20 bp, synthetic construct
  misc_feature 1..20: note = CRISPR gRNA sequence
  source 1..20: mol_type = other DNA
attctgtctcaaaaaaaaag

SEQ ID NO: 103848 - DNA, 20 bp, synthetic construct
  misc_feature 1..20: note = CRISPR gRNA sequence
  source 1..20: mol_type = other DNA
tctgtctcaaaaaaaaagaa

SEQ ID NO: 103849 - DNA, 20 bp, synthetic construct
  misc_feature 1..20: note = CRISPR gRNA sequence
  source 1..20: mol_type = other DNA
aaaaaaaaagaagagattaa

SEQ ID NO: 103850 - DNA, 20 bp, synthetic construct
  misc_feature 1..20: note = CRISPR gRNA sequence
  source 1..20: mol_type = other DNA
aagagattaacagaaatatg

SEQ ID NO: 103851 - DNA, 20 bp, synthetic construct
  misc_feature 1..20: note = CRISPR gRNA sequence
  source 1..20: mol_type = other DNA
aaatgttacatacaactctg

SEQ ID NO: 103852 - DNA, 20 bp, synthetic construct
  misc_feature 1..20: note = CRISPR gRNA sequence
  source 1..20: mol_type = other DNA
gtggcatcatattttaaaat

SEQ ID NO: 103853 - DNA, 20 bp, synthetic construct
  misc_feature 1..20: note = CRISPR gRNA sequence
  source 1..20: mol_type = other DNA
aaaattagatatttctcatc

SEQ ID NO: 103854 - DNA, 20 bp, synthetic construct
  misc_feature 1..20: note = CRISPR gRNA sequence
  source 1..20: mol_type = other DNA
ttagatatttctcatcgaga

SEQ ID NO: 103855 - DNA, 20 bp, synthetic construct
  misc_feature 1..20: note = CRISPR gRNA sequence
  source 1..20: mol_type = other DNA
agatggcaaaaaaaaacaaa

SEQ ID NO: 103856 - DNA, 20 bp, synthetic construct
  misc_feature 1..20: note = CRISPR gRNA sequence
  source 1..20: mol_type = other DNA
aaagtcattatatccactgt

SEQ ID NO: 103857 - DNA, 20 bp, synthetic construct
  misc_feature 1..20: note = CRISPR gRNA sequence
  source 1..20: mol_type = other DNA
aagtcattatatccactgtt

SEQ ID NO: 103858 - DNA, 20 bp, synthetic construct
  misc_feature 1..20: note = CRISPR gRNA sequence
  source 1..20: mol_type = other DNA
cattatatccactgttagga

SEQ ID NO: 103859 - DNA, 20 bp, synthetic construct
  misc_feature 1..20: note = CRISPR gRNA sequence
  source 1..20: mol_type = other DNA
atccactgttaggatggatg

SEQ ID NO: 103860 - DNA, 20 bp, synthetic construct
  misc_feature 1..20: note = CRISPR gRNA sequence
  source 1..20: mol_type = other DNA
ccactgttaggatggatgtg

SEQ ID NO: 103861 - DNA, 20 bp, synthetic construct
  misc_feature 1..20: note = CRISPR gRNA sequence
  source 1..20: mol_type = other DNA
ttaggatggatgtggagaaa

SEQ ID NO: 103862 - DNA, 20 bp, synthetic construct
  misc_feature 1..20: note = CRISPR gRNA sequence
  source 1..20: mol_type = other DNA
aaagaattaatcattatttt

SEQ ID NO: 103863 - DNA, 20 bp, synthetic construct
  misc_feature 1..20: note = CRISPR gRNA sequence
  source 1..20: mol_type = other DNA
tttttggtaatttaaaactg

SEQ ID NO: 103864 - DNA, 20 bp, synthetic construct
  misc_feature 1..20: note = CRISPR gRNA sequence
  source 1..20: mol_type = other DNA
tttggtaatttaaaactgta

SEQ ID NO: 103865 - DNA, 20 bp, synthetic construct
  misc_feature 1..20: note = CRISPR gRNA sequence
  source 1..20: mol_type = other DNA
ttaaaactgtagagttattt

SEQ ID NO: 103866 - DNA, 20 bp, synthetic construct
  misc_feature 1..20: note = CRISPR gRNA sequence
  source 1..20: mol_type = other DNA
aactgtagagttattttgga

SEQ ID NO: 103867 - DNA, 20 bp, synthetic construct
  misc_feature 1..20: note = CRISPR gRNA sequence
  source 1..20: mol_type = other DNA
actgtagagttattttggaa

SEQ ID NO: 103868 - DNA, 20 bp, synthetic construct
  misc_feature 1..20: note = CRISPR gRNA sequence
  source 1..20: mol_type = other DNA
gttaaatacaatgaatattt

SEQ ID NO: 103869 - DNA, 20 bp, synthetic construct
  misc_feature 1..20: note = CRISPR gRNA sequence
  source 1..20: mol_type = other DNA
aatacaatgaatatttgagc

SEQ ID NO: 103870 - DNA, 20 bp, synthetic construct
  misc_feature 1..20: note = CRISPR gRNA sequence
  source 1..20: mol_type = other DNA
acaatgaatatttgagctag

SEQ ID NO: 103871 - DNA, 20 bp, synthetic construct
  misc_feature 1..20: note = CRISPR gRNA sequence
  source 1..20: mol_type = other DNA
gagctagcagtcccacttct

SEQ ID NO: 103872 - DNA, 20 bp, synthetic construct
  misc_feature 1..20: note = CRISPR gRNA sequence
  source 1..20: mol_type = other DNA
acttctgagaatctgtccta

SEQ ID NO: 103873 - DNA, 20 bp, synthetic construct
  misc_feature 1..20: note = CRISPR gRNA sequence
  source 1..20: mol_type = other DNA
cttctgagaatctgtcctat

SEQ ID NO: 103874 - DNA, 20 bp, synthetic construct
  misc_feature 1..20: note = CRISPR gRNA sequence
  source 1..20: mol_type = other DNA
ctgagaatctgtcctatagg

SEQ ID NO: 103875 - DNA, 20 bp, synthetic construct
  misc_feature 1..20: note = CRISPR gRNA sequence
  source 1..20: mol_type = other DNA
aatctgtcctataggaagaa

SEQ ID NO: 103876 - DNA, 20 bp, synthetic construct
  misc_feature 1..20: note = CRISPR gRNA sequence
  source 1..20: mol_type = other DNA
tataggaagaaaagcatcaa

SEQ ID NO: 103877 - DNA, 20 bp, synthetic construct
  misc_feature 1..20: note = CRISPR gRNA sequence
  source 1..20: mol_type = other DNA
aggaagaaaagcatcaatag

SEQ ID NO: 103878 - DNA, 20 bp, synthetic construct
  misc_feature 1..20: note = CRISPR gRNA sequence
  source 1..20: mol_type = other DNA
ggaagaaaagcatcaatagt

SEQ ID NO: 103879 - DNA, 20 bp, synthetic construct
  misc_feature 1..20: note = CRISPR gRNA sequence
  source 1..20: mol_type = other DNA
gaagaaaagcatcaatagta

SEQ ID NO: 103880 - DNA, 20 bp, synthetic construct
  misc_feature 1..20: note = CRISPR gRNA sequence
  source 1..20: mol_type = other DNA
aagaaaagcatcaatagtag

SEQ ID NO: 103881 - DNA, 20 bp, synthetic construct
  misc_feature 1..20: note = CRISPR gRNA sequence
  source 1..20: mol_type = other DNA
agaaaagcatcaatagtagg

SEQ ID NO: 103882 - DNA, 20 bp, synthetic construct
  misc_feature 1..20: note = CRISPR gRNA sequence
  source 1..20: mol_type = other DNA
aatagtagggggaaattaca

SEQ ID NO: 103883 - DNA, 20 bp, synthetic construct
  misc_feature 1..20: note = CRISPR gRNA sequence
  source 1..20: mol_type = other DNA
aattacaaagacacttttca

SEQ ID NO: 103884 - DNA, 20 bp, synthetic construct
  misc_feature 1..20: note = CRISPR gRNA sequence
  source 1..20: mol_type = other DNA
cacttttcatagcattgtac

SEQ ID NO: 103885 - DNA, 20 bp, synthetic construct
  misc_feature 1..20: note = CRISPR gRNA sequence
  source 1..20: mol_type = other DNA
aaaaaataaaattgcaatct

SEQ ID NO: 103886 - DNA, 20 bp, synthetic construct
  misc_feature 1..20: note = CRISPR gRNA sequence
  source 1..20: mol_type = other DNA
caatctgagtgtccattaat

SEQ ID NO: 103887 - DNA, 20 bp, synthetic construct
  misc_feature 1..20: note = CRISPR gRNA sequence
  source 1..20: mol_type = other DNA
gagtgtccattaataagaat

SEQ ID NO: 103888 - DNA, 20 bp, synthetic construct
  misc_feature 1..20: note = CRISPR gRNA sequence
  source 1..20: mol_type = other DNA
agtgtccattaataagaata

SEQ ID NO: 103889 - DNA, 20 bp, synthetic construct
  misc_feature 1..20: note = CRISPR gRNA sequence
  source 1..20: mol_type = other DNA
cattaataagaataaggaaa

SEQ ID NO: 103890 - DNA, 20 bp, synthetic construct
  misc_feature 1..20: note = CRISPR gRNA sequence
  source 1..20: mol_type = other DNA
aataagaataaggaaatggt

SEQ ID NO: 103891 - DNA, 20 bp, synthetic construct
  misc_feature 1..20: note = CRISPR gRNA sequence
  source 1..20: mol_type = other DNA
aataaatcataatatattca

SEQ ID NO: 103892 - DNA, 20 bp, synthetic construct
  misc_feature 1..20: note = CRISPR gRNA sequence
  source 1..20: mol_type = other DNA
ataaatcataatatattcat

SEQ ID NO: 103893 - DNA, 20 bp, synthetic construct
  misc_feature 1..20: note = CRISPR gRNA sequence
  source 1..20: mol_type = other DNA
taaatcataatatattcata

SEQ ID NO: 103894 - DNA, 20 bp, synthetic construct
  misc_feature 1..20: note = CRISPR gRNA sequence
  source 1..20: mol_type = other DNA
gaatattgcatcatcattaa

SEQ ID NO: 103895 - DNA, 20 bp, synthetic construct
  misc_feature 1..20: note = CRISPR gRNA sequence
  source 1..20: mol_type = other DNA
aaagaaatgaactgttgact

SEQ ID NO: 103896 - DNA, 20 bp, synthetic construct
  misc_feature 1..20: note = CRISPR gRNA sequence
  source 1..20: mol_type = other DNA
aagaaatgaactgttgactt

SEQ ID NO: 103897 - DNA, 20 bp, synthetic construct
  misc_feature 1..20: note = CRISPR gRNA sequence
  source 1..20: mol_type = other DNA
agaaatgaactgttgacttg

SEQ ID NO: 103898 - DNA, 20 bp, synthetic construct
  misc_feature 1..20: note = CRISPR gRNA sequence
  source 1..20: mol_type = other DNA
aatgaactgttgacttgggg

SEQ ID NO: 103899 - DNA, 20 bp, synthetic construct
  misc_feature 1..20: note = CRISPR gRNA sequence
  source 1..20: mol_type = other DNA
atgaactgttgacttggggt

SEQ ID NO: 103900 - DNA, 20 bp, synthetic construct
  misc_feature 1..20: note = CRISPR gRNA sequence
  source 1..20: mol_type = other DNA
ggttaatattgaaatatttt

SEQ ID NO: 103901 - DNA, 20 bp, synthetic construct
  misc_feature 1..20: note = CRISPR gRNA sequence
  source 1..20: mol_type = other DNA
taatattgaaatatttttag

SEQ ID NO: 103902 - DNA, 20 bp, synthetic construct
  misc_feature 1..20: note = CRISPR gRNA sequence
  source 1..20: mol_type = other DNA
tttttagtggaaataatttg

SEQ ID NO: 103903 - DNA, 20 bp, synthetic construct
  misc_feature 1..20: note = CRISPR gRNA sequence
  source 1..20: mol_type = other DNA
tttagtggaaataatttgca

SEQ ID NO: 103904 - DNA, 20 bp, synthetic construct
  misc_feature 1..20: note = CRISPR gRNA sequence
  source 1..20: mol_type = other DNA
ggaaataatttgcagagaaa

SEQ ID NO: 103905 - DNA, 20 bp, synthetic construct
  misc_feature 1..20: note = CRISPR gRNA sequence
  source 1..20: mol_type = other DNA
attcataaccaaccccccat

SEQ ID NO: 103906 - DNA, 20 bp, synthetic construct
  misc_feature 1..20: note = CRISPR gRNA sequence
  source 1..20: mol_type = other DNA
cccccatgagtatatgttta

SEQ ID NO: 103907 - DNA, 20 bp, synthetic construct
  misc_feature 1..20: note = CRISPR gRNA sequence
  source 1..20: mol_type = other DNA
tgagtatatgtttatagtca

SEQ ID NO: 103908 - DNA, 20 bp, synthetic construct
  misc_feature 1..20: note = CRISPR gRNA sequence
  source 1..20: mol_type = other DNA
atatgtttatagtcatggaa

SEQ ID NO: 103909 - DNA, 20 bp, synthetic construct
  misc_feature 1..20: note = CRISPR gRNA sequence
  source 1..20: mol_type = other DNA
atgtttatagtcatggaaaa

SEQ ID NO: 103910 - DNA, 20 bp, synthetic construct
  misc_feature 1..20: note = CRISPR gRNA sequence
  source 1..20: mol_type = other DNA
gtttatagtcatggaaaaga

SEQ ID NO: 103911 - DNA, 20 bp, synthetic construct
  misc_feature 1..20: note = CRISPR gRNA sequence
  source 1..20: mol_type = other DNA
agtcatggaaaagagagtat

SEQ ID NO: 103912 - DNA, 20 bp, synthetic construct
  misc_feature 1..20: note = CRISPR gRNA sequence
  source 1..20: mol_type = other DNA
agagagtatgagataactat

SEQ ID NO: 103913 - DNA, 20 bp, synthetic construct
  misc_feature 1..20: note = CRISPR gRNA sequence
  source 1..20: mol_type = other DNA
aaatgtttatattgtttcaa

SEQ ID NO: 103914 - DNA, 20 bp, synthetic construct
  misc_feature 1..20: note = CRISPR gRNA sequence
  source 1..20: mol_type = other DNA
ttatattgtttcaacagtta

SEQ ID NO: 103915 - DNA, 20 bp, synthetic construct
  misc_feature 1..20: note = CRISPR gRNA sequence
  source 1..20: mol_type = other DNA
tattgtttcaacagttacag

SEQ ID NO: 103916 - DNA, 20 bp, synthetic construct
  misc_feature 1..20: note = CRISPR gRNA sequence
  source 1..20: mol_type = other DNA
cagcagtcatattaatgtct

SEQ ID NO: 103917 - DNA, 20 bp, synthetic construct
  misc_feature 1..20: note = CRISPR gRNA sequence
  source 1..20: mol_type = other DNA
atattaatgtcttagttttc

SEQ ID NO: 103918 - DNA, 20 bp, synthetic construct
  misc_feature 1..20: note = CRISPR gRNA sequence
  source 1..20: mol_type = other DNA
attaatgtcttagttttctg

SEQ ID NO: 103919 - DNA, 20 bp, synthetic construct
  misc_feature 1..20: note = CRISPR gRNA sequence
  source 1..20: mol_type = other DNA
ttaatgtcttagttttctgg

SEQ ID NO: 103920 - DNA, 20 bp, synthetic construct
  misc_feature 1..20: note = CRISPR gRNA sequence
  source 1..20: mol_type = other DNA
ttagttttctggaggaattt

SEQ ID NO: 103921 - DNA, 20 bp, synthetic construct
  misc_feature 1..20: note = CRISPR gRNA sequence
  source 1..20: mol_type = other DNA
ggaggaatttaagttgaaaa

SEQ ID NO: 103922 - DNA, 20 bp, synthetic construct
  misc_feature 1..20: note = CRISPR gRNA sequence
  source 1..20: mol_type = other DNA
ggaatttaagttgaaaaaag

SEQ ID NO: 103923 - DNA, 20 bp, synthetic construct
  misc_feature 1..20: note = CRISPR gRNA sequence
  source 1..20: mol_type = other DNA
gtgtttttatgcataatttt

SEQ ID NO: 103924 - DNA, 20 bp, synthetic construct
  misc_feature 1..20: note = CRISPR gRNA sequence
  source 1..20: mol_type = other DNA
tgtttttatgcataattttt

SEQ ID NO: 103925 - DNA, 20 bp, synthetic construct
  misc_feature 1..20: note = CRISPR gRNA sequence
  source 1..20: mol_type = other DNA
gcataattgtaccatgcatg

SEQ ID NO: 103926 - DNA, 20 bp, synthetic construct
  misc_feature 1..20: note = CRISPR gRNA sequence
  source 1..20: mol_type = other DNA
cataattgtaccatgcatgt

SEQ ID NO: 103927 - DNA, 20 bp, synthetic construct
  misc_feature 1..20: note = CRISPR gRNA sequence
  source 1..20: mol_type = other DNA
ataattgtaccatgcatgtg

SEQ ID NO: 103928 - DNA, 20 bp, synthetic construct
  misc_feature 1..20: note = CRISPR gRNA sequence
  source 1..20: mol_type = other DNA
tttaattctttcataatgtt

SEQ ID NO: 103929 - DNA, 20 bp, synthetic construct
  misc_feature 1..20: note = CRISPR gRNA sequence
  source 1..20: mol_type = other DNA
gttcagtcaacttgatgaat

SEQ ID NO: 103930 - DNA, 20 bp, synthetic construct
  misc_feature 1..20: note = CRISPR gRNA sequence
  source 1..20: mol_type = other DNA
aatttctaatttataaaata

SEQ ID NO: 103931 - DNA, 20 bp, synthetic construct
  misc_feature 1..20: note = CRISPR gRNA sequence
  source 1..20: mol_type = other DNA
ctaatttataaaatatagtt

SEQ ID NO: 103932 - DNA, 20 bp, synthetic construct
  misc_feature 1..20: note = CRISPR gRNA sequence
  source 1..20: mol_type = other DNA
taatttataaaatatagtta

SEQ ID NO: 103933 - DNA, 20 bp, synthetic construct
  misc_feature 1..20: note = CRISPR gRNA sequence
  source 1..20: mol_type = other DNA
taaaatatagttaaggattt

SEQ ID NO: 103934 - DNA, 20 bp, synthetic construct
  misc_feature 1..20: note = CRISPR gRNA sequence
  source 1..20: mol_type = other DNA
ttggttttcatttgcctttg

SEQ ID NO: 103935 - DNA, 20 bp, synthetic construct
  misc_feature 1..20: note = CRISPR gRNA sequence
  source 1..20: mol_type = other DNA
tggttttcatttgcctttgt

SEQ ID NO: 103936 - DNA, 20 bp, synthetic construct
  misc_feature 1..20: note = CRISPR gRNA sequence
  source 1..20: mol_type = other DNA
tgcctttgtaggtaaacatt

SEQ ID NO: 103937 - DNA, 20 bp, synthetic construct
  misc_feature 1..20: note = CRISPR gRNA sequence
  source 1..20: mol_type = other DNA
gcctttgtaggtaaacattt

SEQ ID NO: 103938 - DNA, 20 bp, synthetic construct
  misc_feature 1..20: note = CRISPR gRNA sequence
  source 1..20: mol_type = other DNA
aggtaaacatttgggcacga

SEQ ID NO: 103939 - DNA, 20 bp, synthetic construct
  misc_feature 1..20: note = CRISPR gRNA sequence
  source 1..20: mol_type = other DNA
ttatttttcaactgaattct

SEQ ID NO: 103940 - DNA, 20 bp, synthetic construct
  misc_feature 1..20: note = CRISPR gRNA sequence
  source 1..20: mol_type = other DNA
tatttttcaactgaattctc

SEQ ID NO: 103941 - DNA, 20 bp, synthetic construct
  misc_feature 1..20: note = CRISPR gRNA sequence
  source 1..20: mol_type = other DNA
aattctcaggataatttctt

SEQ ID NO: 103942 - DNA, 20 bp, synthetic construct
  misc_feature 1..20: note = CRISPR gRNA sequence
  source 1..20: mol_type = other DNA
tcaggataatttctttggat

SEQ ID NO: 103943 - DNA, 20 bp, synthetic construct
  misc_feature 1..20: note = CRISPR gRNA sequence
  source 1..20: mol_type = other DNA
caggataatttctttggatt

SEQ ID NO: 103944 - DNA, 20 bp, synthetic construct
  misc_feature 1..20: note = CRISPR gRNA sequence
  source 1..20: mol_type = other DNA
aggataatttctttggattg

SEQ ID NO: 103945 - DNA, 20 bp, synthetic construct
  misc_feature 1..20: note = CRISPR gRNA sequence
  source 1..20: mol_type = other DNA
tctttggattggggattgct

SEQ ID NO: 103946 - DNA, 20 bp, synthetic construct
  misc_feature 1..20: note = CRISPR gRNA sequence
  source 1..20: mol_type = other DNA
ctttggattggggattgctt

SEQ ID NO: 103947 - DNA, 20 bp, synthetic construct
  misc_feature 1..20: note = CRISPR gRNA sequence
  source 1..20: mol_type = other DNA
gattggggattgcttgggta

SEQ ID NO: 103948 - DNA, 20 bp, synthetic construct
  misc_feature 1..20: note = CRISPR gRNA sequence
  source 1..20: mol_type = other DNA
attggggattgcttgggtaa

SEQ ID NO: 103949 - DNA, 20 bp, synthetic construct
  misc_feature 1..20: note = CRISPR gRNA sequence
  source 1..20: mol_type = other DNA
ttggggattgcttgggtaaa

SEQ ID NO: 103950 - DNA, 20 bp, synthetic construct
  misc_feature 1..20: note = CRISPR gRNA sequence
  source 1..20: mol_type = other DNA
ggattgcttgggtaaagggt

SEQ ID NO: 103951 - DNA, 20 bp, synthetic construct
  misc_feature 1..20: note = CRISPR gRNA sequence
  source 1..20: mol_type = other DNA
attgcttgggtaaagggtaa

SEQ ID NO: 103952 - DNA, 20 bp, synthetic construct
  misc_feature 1..20: note = CRISPR gRNA sequence
  source 1..20: mol_type = other DNA
taaagggtaagagtatattt

SEQ ID NO: 103953 - DNA, 20 bp, synthetic construct
  misc_feature 1..20: note = CRISPR gRNA sequence
  source 1..20: mol_type = other DNA
aagagtatatttgagcccac

SEQ ID NO: 103954 - DNA, 20 bp, synthetic construct
  misc_feature 1..20: note = CRISPR gRNA sequence
  source 1..20: mol_type = other DNA
cccactggcatatttttgcc

SEQ ID NO: 103955 - DNA, 20 bp, synthetic construct
  misc_feature 1..20: note = CRISPR gRNA sequence
  source 1..20: mol_type = other DNA
ctggcatatttttgccaaga

SEQ ID NO: 103956 - DNA, 20 bp, synthetic construct
  misc_feature 1..20: note = CRISPR gRNA sequence
  source 1..20: mol_type = other DNA
tgccaagatagaattgtact

SEQ ID NO: 103957 - DNA, 20 bp, synthetic construct
  misc_feature 1..20: note = CRISPR gRNA sequence
  source 1..20: mol_type = other DNA
gccaagatagaattgtactt

SEQ ID NO: 103958 - DNA, 20 bp, synthetic construct
  misc_feature 1..20: note = CRISPR gRNA sequence
  source 1..20: mol_type = other DNA
attgtacttgggattaaaaa

SEQ ID NO: 103959 - DNA, 20 bp, synthetic construct
  misc_feature 1..20: note = CRISPR gRNA sequence
  source 1..20: mol_type = other DNA
ttctctttgcataaatatat

SEQ ID NO: 103960 - DNA, 20 bp, synthetic construct
  misc_feature 1..20: note = CRISPR gRNA sequence
  source 1..20: mol_type = other DNA
tctctttgcataaatatatg

SEQ ID NO: 103961 - DNA, 20 bp, synthetic construct
  misc_feature 1..20: note = CRISPR gRNA sequence
  source 1..20: mol_type = other DNA
tgaggctttaaatatctttt

SEQ ID NO: 103962 - DNA, 20 bp, synthetic construct
  misc_feature 1..20: note = CRISPR gRNA sequence
  source 1..20: mol_type = other DNA
ttctctctttgcttcctctc

SEQ ID NO: 103963 - DNA, 20 bp, synthetic construct
  misc_feature 1..20: note = CRISPR gRNA sequence
  source 1..20: mol_type = other DNA
gctgcgccttctccactgtt

SEQ ID NO: 103964 - DNA, 20 bp, synthetic construct
  misc_feature 1..20: note = CRISPR gRNA sequence
  source 1..20: mol_type = other DNA
gcgccttctccactgttgag

SEQ ID NO: 103965 - DNA, 20 bp, synthetic construct
  misc_feature 1..20: note = CRISPR gRNA sequence
  source 1..20: mol_type = other DNA
gccttctccactgttgagta

SEQ ID NO: 103966 - DNA, 20 bp, synthetic construct
  misc_feature 1..20: note = CRISPR gRNA sequence
  source 1..20: mol_type = other DNA
actgttgagtagagacaatg

SEQ ID NO: 103967 - DNA, 20 bp, synthetic construct
  misc_feature 1..20: note = CRISPR gRNA sequence
  source 1..20: mol_type = other DNA
tgagtagagacaatgtggta

SEQ ID NO: 103968 - DNA, 20 bp, synthetic construct
  misc_feature 1..20: note = CRISPR gRNA sequence
  source 1..20: mol_type = other DNA
tagagacaatgtggtatagt

SEQ ID NO: 103969 - DNA, 20 bp, synthetic construct
  misc_feature 1..20: note = CRISPR gRNA sequence
  source 1..20: mol_type = other DNA
agagacaatgtggtatagtt

SEQ ID NO: 103970 - DNA, 20 bp, synthetic construct
  misc_feature 1..20: note = CRISPR gRNA sequence
  source 1..20: mol_type = other DNA
caatgtggtatagttaggaa

SEQ ID NO: 103971 - DNA, 20 bp, synthetic construct
  misc_feature 1..20: note = CRISPR gRNA sequence
  source 1..20: mol_type = other DNA
agttaggaacagtatactgt

SEQ ID NO: 103972 - DNA, 20 bp, synthetic construct
  misc_feature 1..20: note = CRISPR gRNA sequence
  source 1..20: mol_type = other DNA
ggaacagtatactgtgagtg

SEQ ID NO: 103973 - DNA, 20 bp, synthetic construct
  misc_feature 1..20: note = CRISPR gRNA sequence
  source 1..20: mol_type = other DNA
acagtatactgtgagtgtag

SEQ ID NO: 103974 - DNA, 20 bp, synthetic construct
  misc_feature 1..20: note = CRISPR gRNA sequence
  source 1..20: mol_type = other DNA
tactgtgagtgtagtggtcc

SEQ ID NO: 103975 - DNA, 20 bp, synthetic construct
  misc_feature 1..20: note = CRISPR gRNA sequence
  source 1..20: mol_type = other DNA
gtggtccaagctttcattac

SEQ ID NO: 103976 - DNA, 20 bp, synthetic construct
  misc_feature 1..20: note = CRISPR gRNA sequence
  source 1..20: mol_type = other DNA
tggtccaagctttcattacc

SEQ ID NO: 103977 - DNA, 20 bp, synthetic construct
  misc_feature 1..20: note = CRISPR gRNA sequence
  source 1..20: mol_type = other DNA
taccaggtctgccattaaat

SEQ ID NO: 103978 - DNA, 20 bp, synthetic construct
  misc_feature 1..20: note = CRISPR gRNA sequence
  source 1..20: mol_type = other DNA
ttaaataagcattctgatct

SEQ ID NO: 103979 - DNA, 20 bp, synthetic construct
  misc_feature 1..20: note = CRISPR gRNA sequence
  source 1..20: mol_type = other DNA
taagcattctgatcttggcc

SEQ ID NO: 103980 - DNA, 20 bp, synthetic construct
  misc_feature 1..20: note = CRISPR gRNA sequence
  source 1..20: mol_type = other DNA
tggccaagttatttaattgt

SEQ ID NO: 103981 - DNA, 20 bp, synthetic construct
  misc_feature 1..20: note = CRISPR gRNA sequence
  source 1..20: mol_type = other DNA
tccaaaaataaaatttatat

SEQ ID NO: 103982 - DNA, 20 bp, synthetic construct
  misc_feature 1..20: note = CRISPR gRNA sequence
  source 1..20: mol_type = other DNA
aatttatatgagatgatatc

SEQ ID NO: 103983 - DNA, 20 bp, synthetic construct
  misc_feature 1..20: note = CRISPR gRNA sequence
  source 1..20: mol_type = other DNA
atttatatgagatgatatct

SEQ ID NO: 103984 - DNA, 20 bp, synthetic construct
  misc_feature 1..20: note = CRISPR gRNA sequence
  source 1..20: mol_type = other DNA
tttatatgagatgatatcta

SEQ ID NO: 103985 - DNA, 20 bp, synthetic construct
  misc_feature 1..20: note = CRISPR gRNA sequence
  source 1..20: mol_type = other DNA
atgatatctagggttcattc

SEQ ID NO: 103986 - DNA, 20 bp, synthetic construct
  misc_feature 1..20: note = CRISPR gRNA sequence
  source 1..20: mol_type = other DNA
tctaaattctgtgattttta

SEQ ID NO: 103987 - DNA, 20 bp, synthetic construct
  misc_feature 1..20: note = CRISPR gRNA sequence
  source 1..20: mol_type = other DNA
ctaaattctgtgatttttat

SEQ ID NO: 103988 - DNA, 20 bp, synthetic construct
  misc_feature 1..20: note = CRISPR gRNA sequence
  source 1..20: mol_type = other DNA
taaattctgtgatttttatg

SEQ ID NO: 103989 - DNA, 20 bp, synthetic construct
  misc_feature 1..20: note = CRISPR gRNA sequence
  source 1..20: mol_type = other DNA
atggggttttattttgctat

SEQ ID NO: 103990 - DNA, 20 bp, synthetic construct
  misc_feature 1..20: note = CRISPR gRNA sequence
  source 1..20: mol_type = other DNA
tggggttttattttgctata

SEQ ID NO: 103991 - DNA, 20 bp, synthetic construct
  misc_feature 1..20: note = CRISPR gRNA sequence
  source 1..20: mol_type = other DNA
tgctataaggaaccttcaaa

SEQ ID NO: 103992 - DNA, 20 bp, synthetic construct
  misc_feature 1..20: note = CRISPR gRNA sequence
  source 1..20: mol_type = other DNA
atagttatttccctgcttcc

SEQ ID NO: 103993 - DNA, 20 bp, synthetic construct
  misc_feature 1..20: note = CRISPR gRNA sequence
  source 1..20: mol_type = other DNA
gttatttccctgcttccaag

SEQ ID NO: 103994 - DNA, 20 bp, synthetic construct
  misc_feature 1..20: note = CRISPR gRNA sequence
  source 1..20: mol_type = other DNA
ttatttccctgcttccaagt

SEQ ID NO: 103995 - DNA, 20 bp, synthetic construct
  misc_feature 1..20: note = CRISPR gRNA sequence
  source 1..20: mol_type = other DNA
tatttccctgcttccaagta

SEQ ID NO: 103996 - DNA, 20 bp, synthetic construct
  misc_feature 1..20: note = CRISPR gRNA sequence
  source 1..20: mol_type = other DNA
aagtagggctataactaacc

SEQ ID NO: 103997 - DNA, 20 bp, synthetic construct
  misc_feature 1..20: note = CRISPR gRNA sequence
  source 1..20: mol_type = other DNA
tatattctgttacgtaaata

SEQ ID NO: 103998 - DNA, 20 bp, synthetic construct
  misc_feature 1..20: note = CRISPR gRNA sequence
  source 1..20: mol_type = other DNA
gttacgtaaataaagctctc

SEQ ID NO: 103999 - DNA, 20 bp, synthetic construct
  misc_feature 1..20: note = CRISPR gRNA sequence
  source 1..20: mol_type = other DNA
ttacgtaaataaagctctct

SEQ ID NO: 104000 - DNA, 20 bp, synthetic construct
  misc_feature 1..20: note = CRISPR gRNA sequence
  source 1..20: mol_type = other DNA
gtaaataaagctctctaggt

SEQ ID NO: 104001 - DNA, 20 bp, synthetic construct
  misc_feature 1..20: note = CRISPR gRNA sequence
  source 1..20: mol_type = other DNA
gctctctaggtgagattcca

SEQ ID NO: 104002 - DNA, 20 bp, synthetic construct
  misc_feature 1..20: note = CRISPR gRNA sequence
  source 1..20: mol_type = other DNA
tagcctcccttacaatactt

SEQ ID NO: 104003 - DNA, 20 bp, synthetic construct
  misc_feature 1..20: note = CRISPR gRNA sequence
  source 1..20: mol_type = other DNA
agcctcccttacaatactta

SEQ ID NO: 104004 - DNA, 20 bp, synthetic construct
  misc_feature 1..20: note = CRISPR gRNA sequence
  source 1..20: mol_type = other DNA
aggctttaatcccctttgta

SEQ ID NO: 104005 - DNA, 20 bp, synthetic construct
  misc_feature 1..20: note = CRISPR gRNA sequence
  source 1..20: mol_type = other DNA
ggctttaatcccctttgtat

SEQ ID NO: 104006 - DNA, 20 bp, synthetic construct
  misc_feature 1..20: note = CRISPR gRNA sequence
  source 1..20: mol_type = other DNA
ctttaatcccctttgtatag

SEQ ID NO: 104007 - DNA, 20 bp, synthetic construct
  misc_feature 1..20: note = CRISPR gRNA sequence
  source 1..20: mol_type = other DNA
ataggagttttttttctcat

SEQ ID NO: 104008 - DNA, 20 bp, synthetic construct
  misc_feature 1..20: note = CRISPR gRNA sequence
  source 1..20: mol_type = other DNA
ttttttttctcattagtgtt

SEQ ID NO: 104009 - DNA, 20 bp, synthetic construct
  misc_feature 1..20: note = CRISPR gRNA sequence
  source 1..20: mol_type = other DNA
tttttctcattagtgttgag

SEQ ID NO: 104010 - DNA, 20 bp, synthetic construct
  misc_feature 1..20: note = CRISPR gRNA sequence
  source 1..20: mol_type = other DNA
tgttgagtagccatttttta

SEQ ID NO: 104011 - DNA, 20 bp, synthetic construct
  misc_feature 1..20: note = CRISPR gRNA sequence
  source 1..20: mol_type = other DNA
tgagtagccattttttaaag

SEQ ID NO: 104012 - DNA, 20 bp, synthetic construct
  misc_feature 1..20: note = CRISPR gRNA sequence
  source 1..20: mol_type = other DNA
ttgaattgtattctctattt

SEQ ID NO: 104013 - DNA, 20 bp, synthetic construct
  misc_feature 1..20: note = CRISPR gRNA sequence
  source 1..20: mol_type = other DNA
tattctctattttagaatcc

SEQ ID NO: 104014 - DNA, 20 bp, synthetic construct
  misc_feature 1..20: note = CRISPR gRNA sequence
  source 1..20: mol_type = other DNA
tctattttagaatcctagta

SEQ ID NO: 104015 - DNA, 20 bp, synthetic construct
  misc_feature 1..20: note = CRISPR gRNA sequence
  source 1..20: mol_type = other DNA
tagtaaagcttgcaccctct

SEQ ID NO: 104016 - DNA, 20 bp, synthetic construct
  misc_feature 1..20: note = CRISPR gRNA sequence
  source 1..20: mol_type = other DNA
agcttgcaccctctaagaaa

SEQ ID NO: 104017 - DNA, 20 bp, synthetic construct
  misc_feature 1..20: note = CRISPR gRNA sequence
  source 1..20: mol_type = other DNA
ttgcaccctctaagaaaaag

SEQ ID NO: 104018 - DNA, 20 bp, synthetic construct
  misc_feature 1..20: note = CRISPR gRNA sequence
  source 1..20: mol_type = other DNA
gcaccctctaagaaaaagta

SEQ ID NO: 104019 - DNA, 20 bp, synthetic construct
  misc_feature 1..20: note = CRISPR gRNA sequence
  source 1..20: mol_type = other DNA
taagaaaaagtagagatgtc

SEQ ID NO: 104020 - DNA, 20 bp, synthetic construct
  misc_feature 1..20: note = CRISPR gRNA sequence
  source 1..20: mol_type = other DNA
aaaaattctgcatataattt

SEQ ID NO: 104021 - DNA, 20 bp, synthetic construct
  misc_feature 1..20: note = CRISPR gRNA sequence
  source 1..20: mol_type = other DNA
taattttagattaaaatcct

SEQ ID NO: 104022 - DNA, 20 bp, synthetic construct
  misc_feature 1..20: note = CRISPR gRNA sequence
  source 1..20: mol_type = other DNA
tagattaaaatccttggcct

SEQ ID NO: 104023 - DNA, 20 bp, synthetic construct
  misc_feature 1..20: note = CRISPR gRNA sequence
  source 1..20: mol_type = other DNA
ttaaaatccttggcctgaga

SEQ ID NO: 104024 - DNA, 20 bp, synthetic construct
  misc_feature 1..20: note = CRISPR gRNA sequence
  source 1..20: mol_type = other DNA
ccttggcctgagaaagatac

SEQ ID NO: 104025 - DNA, 20 bp, synthetic construct
  misc_feature 1..20: note = CRISPR gRNA sequence
  source 1..20: mol_type = other DNA
cctgagaaagatactggaac

SEQ ID NO: 104026 - DNA, 20 bp, synthetic construct
  misc_feature 1..20: note = CRISPR gRNA sequence
  source 1..20: mol_type = other DNA
tgagaaagatactggaacca

SEQ ID NO: 104027 - DNA, 20 bp, synthetic construct
  misc_feature 1..20: note = CRISPR gRNA sequence
  source 1..20: mol_type = other DNA
agaaagatactggaaccaga

SEQ ID NO: 104028 - DNA, 20 bp, synthetic construct
  misc_feature 1..20: note = CRISPR gRNA sequence
  source 1..20: mol_type = other DNA
agatactggaaccagagaga

SEQ ID NO: 104029 - DNA, 20 bp, synthetic construct
  misc_feature 1..20: note = CRISPR gRNA sequence
  source 1..20: mol_type = other DNA
ctggaaccagagagacagcc

SEQ ID NO: 104030 - DNA, 20 bp, synthetic construct
  misc_feature 1..20: note = CRISPR gRNA sequence
  source 1..20: mol_type = other DNA
ccagagagacagccaagaaa

SEQ ID NO: 104031 - DNA, 20 bp, synthetic construct
  misc_feature 1..20: note = CRISPR gRNA sequence
  source 1..20: mol_type = other DNA
agagacagccaagaaataga

SEQ ID NO: 104032 - DNA, 20 bp, synthetic construct
  misc_feature 1..20: note = CRISPR gRNA sequence
  source 1..20: mol_type = other DNA
gacagccaagaaatagatag

SEQ ID NO: 104033 - DNA, 20 bp, synthetic construct
  misc_feature 1..20: note = CRISPR gRNA sequence
  source 1..20: mol_type = other DNA
agaaatagatagaagaatat

SEQ ID NO: 104034 - DNA, 20 bp, synthetic construct
  misc_feature 1..20: note = CRISPR gRNA sequence
  source 1..20: mol_type = other DNA
aatagatagaagaatattgg

SEQ ID NO: 104035 - DNA, 20 bp, synthetic construct
  misc_feature 1..20: note = CRISPR gRNA sequence
  source 1..20: mol_type = other DNA
gatagaagaatattggaagt

SEQ ID NO: 104036 - DNA, 20 bp, synthetic construct
  misc_feature 1..20: note = CRISPR gRNA sequence
  source 1..20: mol_type = other DNA
tggaagttggcatataataa

SEQ ID NO: 104037 - DNA, 20 bp, synthetic construct
  misc_feature 1..20: note = CRISPR gRNA sequence
  source 1..20: mol_type = other DNA
aagttggcatataataaaag

SEQ ID NO: 104038 - DNA, 20 bp, synthetic construct
  misc_feature 1..20: note = CRISPR gRNA sequence
  source 1..20: mol_type = other DNA
gtggtataaacatatcaatg

SEQ ID NO: 104039 - DNA, 20 bp, synthetic construct
  misc_feature 1..20: note = CRISPR gRNA sequence
  source 1..20: mol_type = other DNA
taaacatatcaatgaagaaa

SEQ ID NO: 104040 - DNA, 20 bp, synthetic construct
  misc_feature 1..20: note = CRISPR gRNA sequence
  source 1..20: mol_type = other DNA
tatcaatgaagaaatggctg

SEQ ID NO: 104041 - DNA, 20 bp, synthetic construct
  misc_feature 1..20: note = CRISPR gRNA sequence
  source 1..20: mol_type = other DNA
gaaatggctgaagaatgata

SEQ ID NO: 104042 - DNA, 20 bp, synthetic construct
  misc_feature 1..20: note = CRISPR gRNA sequence
  source 1..20: mol_type = other DNA
ggctgaagaatgatacagaa

SEQ ID NO: 104043 - DNA, 20 bp, synthetic construct
  misc_feature 1..20: note = CRISPR gRNA sequence
  source 1..20: mol_type = other DNA
gtattttaaaaaatatttgc

SEQ ID NO: 104044 - DNA, 20 bp, synthetic construct
  misc_feature 1..20: note = CRISPR gRNA sequence
  source 1..20: mol_type = other DNA
tattttaaaaaatatttgct

SEQ ID NO: 104045 - DNA, 20 bp, synthetic construct
  misc_feature 1..20: note = CRISPR gRNA sequence
  source 1..20: mol_type = other DNA
tttaaaaaatatttgctagg

SEQ ID NO: 104046 - DNA, 20 bp, synthetic construct
  misc_feature 1..20: note = CRISPR gRNA sequence
  source 1..20: mol_type = other DNA
aatatttgctaggtggatta

SEQ ID NO: 104047 - DNA, 20 bp, synthetic construct
  misc_feature 1..20: note = CRISPR gRNA sequence
  source 1..20: mol_type = other DNA
gtggattaaagatctaaatg

SEQ ID NO: 104048 - DNA, 20 bp, synthetic construct
  misc_feature 1..20: note = CRISPR gRNA sequence
  source 1..20: mol_type = other DNA
ttaaagatctaaatgtagaa

SEQ ID NO: 104049 - DNA, 20 bp, synthetic construct
  misc_feature 1..20: note = CRISPR gRNA sequence
  source 1..20: mol_type = other DNA
taaatgtagaaaagtaaact

SEQ ID NO: 104050 - DNA, 20 bp, synthetic construct
  misc_feature 1..20: note = CRISPR gRNA sequence
  source 1..20: mol_type = other DNA
agtaaacttggaaaattcaa

SEQ ID NO: 104051 - DNA, 20 bp, synthetic construct
  misc_feature 1..20: note = CRISPR gRNA sequence
  source 1..20: mol_type = other DNA
gaaaattcaaaagaaaatat

SEQ ID NO: 104052 - DNA, 20 bp, synthetic construct
  misc_feature 1..20: note = CRISPR gRNA sequence
  source 1..20: mol_type = other DNA
atataagaatttttatgcta

SEQ ID NO: 104053 - DNA, 20 bp, synthetic construct
  misc_feature 1..20: note = CRISPR gRNA sequence
  source 1..20: mol_type = other DNA
ataagaatttttatgctata

SEQ ID NO: 104054 - DNA, 20 bp, synthetic construct
  misc_feature 1..20: note = CRISPR gRNA sequence
  source 1..20: mol_type = other DNA
agaatttttatgctatagag

SEQ ID NO: 104055 - DNA, 20 bp, synthetic construct
  misc_feature 1..20: note = CRISPR gRNA sequence
  source 1..20: mol_type = other DNA
gaatttttatgctatagaga

SEQ ID NO: 104056 - DNA, 20 bp, synthetic construct
  misc_feature 1..20: note = CRISPR gRNA sequence
  source 1..20: mol_type = other DNA
cattgaaatacatcaaataa

SEQ ID NO: 104057 - DNA, 20 bp, synthetic construct
  misc_feature 1..20: note = CRISPR gRNA sequence
  source 1..20: mol_type = other DNA
tacatcaaataaaagtaaac

SEQ ID NO: 104058 - DNA, 20 bp, synthetic construct
  misc_feature 1..20: note = CRISPR gRNA sequence
  source 1..20: mol_type = other DNA
acatcaaataaaagtaaaca

SEQ ID NO: 104059 - DNA, 20 bp, synthetic construct
  misc_feature 1..20: note = CRISPR gRNA sequence
  source 1..20: mol_type = other DNA
aagtaaacaaggtgaaaact

SEQ ID NO: 104060 - DNA, 20 bp, synthetic construct
  misc_feature 1..20: note = CRISPR gRNA sequence
  source 1..20: mol_type = other DNA
aacaaggtgaaaacttggaa

SEQ ID NO: 104061 - DNA, 20 bp, synthetic construct
  misc_feature 1..20: note = CRISPR gRNA sequence
  source 1..20: mol_type = other DNA
tatttttaatacatacaacc

SEQ ID NO: 104062 - DNA, 20 bp, synthetic construct
  misc_feature 1..20: note = CRISPR gRNA sequence
  source 1..20: mol_type = other DNA
catacaaccgagtttgtatt

SEQ ID NO: 104063 - DNA, 20 bp, synthetic construct
  misc_feature 1..20: note = CRISPR gRNA sequence
  source 1..20: mol_type = other DNA
tttatgtatttatacaaaaa

SEQ ID NO: 104064 - DNA, 20 bp, synthetic construct
  misc_feature 1..20: note = CRISPR gRNA sequence
  source 1..20: mol_type = other DNA
ttatgtatttatacaaaaat

SEQ ID NO: 104065 - DNA, 20 bp, synthetic construct
  misc_feature 1..20: note = CRISPR gRNA sequence
  source 1..20: mol_type = other DNA
tttatacaaaaataggaaaa

SEQ ID NO: 104066 - DNA, 20 bp, synthetic construct
  misc_feature 1..20: note = CRISPR gRNA sequence
  source 1..20: mol_type = other DNA
ttatacaaaaataggaaaat

SEQ ID NO: 104067 - DNA, 20 bp, synthetic construct
  misc_feature 1..20: note = CRISPR gRNA sequence
  source 1..20: mol_type = other DNA
caaaaataggaaaatgggcg

SEQ ID NO: 104068 - DNA, 20 bp, synthetic construct
  misc_feature 1..20: note = CRISPR gRNA sequence
  source 1..20: mol_type = other DNA
aaatgggcgaagaatatgaa

SEQ ID NO: 104069 - DNA, 20 bp, synthetic construct
  misc_feature 1..20: note = CRISPR gRNA sequence
  source 1..20: mol_type = other DNA
gggcgaagaatatgaataga

SEQ ID NO: 104070 - DNA, 20 bp, synthetic construct
  misc_feature 1..20: note = CRISPR gRNA sequence
  source 1..20: mol_type = other DNA
cgaagaatatgaatagatgg

SEQ ID NO: 104071 - DNA, 20 bp, synthetic construct
  misc_feature 1..20: note = CRISPR gRNA sequence
  source 1..20: mol_type = other DNA
aagaatatgaatagatggaa

SEQ ID NO: 104072 - DNA, 20 bp, synthetic construct
  misc_feature 1..20: note = CRISPR gRNA sequence
  source 1..20: mol_type = other DNA
agaatatgaatagatggaag

SEQ ID NO: 104073 - DNA, 20 bp, synthetic construct
  misc_feature 1..20: note = CRISPR gRNA sequence
  source 1..20: mol_type = other DNA
gatggaagaggaaatcctaa

SEQ ID NO: 104074 - DNA, 20 bp, synthetic construct
  misc_feature 1..20: note = CRISPR gRNA sequence
  source 1..20: mol_type = other DNA
cctaacagccaatataaact

SEQ ID NO: 104075 - DNA, 20 bp, synthetic construct
  misc_feature 1..20: note = CRISPR gRNA sequence
  source 1..20: mol_type = other DNA
ccaatataaacttagaaatg

SEQ ID NO: 104076 - DNA, 20 bp, synthetic construct
  misc_feature 1..20: note = CRISPR gRNA sequence
  source 1..20: mol_type = other DNA
tataaacttagaaatgaagt

SEQ ID NO: 104077 - DNA, 20 bp, synthetic construct
  misc_feature 1..20: note = CRISPR gRNA sequence
  source 1..20: mol_type = other DNA
atgaagttggttcacataac

SEQ ID NO: 104078 - DNA, 20 bp, synthetic construct
  misc_feature 1..20: note = CRISPR gRNA sequence
  source 1..20: mol_type = other DNA
actttctgaatgccaattat

SEQ ID NO: 104079 - DNA, 20 bp, synthetic construct
  misc_feature 1..20: note = CRISPR gRNA sequence
  source 1..20: mol_type = other DNA
ctgaatgccaattatgagct

SEQ ID NO: 104080 - DNA, 20 bp, synthetic construct
  misc_feature 1..20: note = CRISPR gRNA sequence
  source 1..20: mol_type = other DNA
ccaattatgagctgagtatt

SEQ ID NO: 104081 - DNA, 20 bp, synthetic construct
  misc_feature 1..20: note = CRISPR gRNA sequence
  source 1..20: mol_type = other DNA
agtatttggaaaaaataatt

SEQ ID NO: 104082 - DNA, 20 bp, synthetic construct
  misc_feature 1..20: note = CRISPR gRNA sequence
  source 1..20: mol_type = other DNA
atttggaaaaaataattcag

SEQ ID NO: 104083 - DNA, 20 bp, synthetic construct
  misc_feature 1..20: note = CRISPR gRNA sequence
  source 1..20: mol_type = other DNA
aaaaaataattcagaagacc

SEQ ID NO: 104084 - DNA, 20 bp, synthetic construct
  misc_feature 1..20: note = CRISPR gRNA sequence
  source 1..20: mol_type = other DNA
aaaaataattcagaagacct

SEQ ID NO: 104085 - DNA, 20 bp, synthetic construct
  misc_feature 1..20: note = CRISPR gRNA sequence
  source 1..20: mol_type = other DNA
aggcaatctatcccctaaca

SEQ ID NO: 104086 - DNA, 20 bp, synthetic construct
  misc_feature 1..20: note = CRISPR gRNA sequence
  source 1..20: mol_type = other DNA
caatctatcccctaacaaag

SEQ ID NO: 104087 - DNA, 20 bp, synthetic construct
  misc_feature 1..20: note = CRISPR gRNA sequence
  source 1..20: mol_type = other DNA
aatctatcccctaacaaagt

SEQ ID NO: 104088 - DNA, 20 bp, synthetic construct
  misc_feature 1..20: note = CRISPR gRNA sequence
  source 1..20: mol_type = other DNA
taggatccatgaatgtctct

SEQ ID NO: 104089 - DNA, 20 bp, synthetic construct
  misc_feature 1..20: note = CRISPR gRNA sequence
  source 1..20: mol_type = other DNA
ccatgaatgtctctaagaca

SEQ ID NO: 104090 - DNA, 20 bp, synthetic construct
  misc_feature 1..20: note = CRISPR gRNA sequence
  source 1..20: mol_type = other DNA
ttttttcaccttccttccat

SEQ ID NO: 104091 - DNA, 20 bp, synthetic construct
  misc_feature 1..20: note = CRISPR gRNA sequence
  source 1..20: mol_type = other DNA
tttcaccttccttccatcag

SEQ ID NO: 104092 - DNA, 20 bp, synthetic construct
  misc_feature 1..20: note = CRISPR gRNA sequence
  source 1..20: mol_type = other DNA
tcagtagtcctttttcctat

SEQ ID NO: 104093 - DNA, 20 bp, synthetic construct
  misc_feature 1..20: note = CRISPR gRNA sequence
  source 1..20: mol_type = other DNA
tagtcctttttcctatcagc

SEQ ID NO: 104094 - DNA, 20 bp, synthetic construct
  misc_feature 1..20: note = CRISPR gRNA sequence
  source 1..20: mol_type = other DNA
tcctttttcctatcagctgg

SEQ ID NO: 104095 - DNA, 20 bp, synthetic construct
  misc_feature 1..20: note = CRISPR gRNA sequence
  source 1..20: mol_type = other DNA
ggtagactttgtgataactt

SEQ ID NO: 104096 - DNA, 20 bp, synthetic construct
  misc_feature 1..20: note = CRISPR gRNA sequence
  source 1..20: mol_type = other DNA
gtagactttgtgataactta

SEQ ID NO: 104097 - DNA, 20 bp, synthetic construct
  misc_feature 1..20: note = CRISPR gRNA sequence
  source 1..20: mol_type = other DNA
tttgtgataacttaaggttc

SEQ ID NO: 104098 - DNA, 20 bp, synthetic construct
  misc_feature 1..20: note = CRISPR gRNA sequence
  source 1..20: mol_type = other DNA
ttgtgataacttaaggttct

SEQ ID NO: 104099 - DNA, 20 bp, synthetic construct
  misc_feature 1..20: note = CRISPR gRNA sequence
  source 1..20: mol_type = other DNA
tctaggcatgttcttctttc

SEQ ID NO: 104100 - DNA, 20 bp, synthetic construct
  misc_feature 1..20: note = CRISPR gRNA sequence
  source 1..20: mol_type = other DNA
catgttcttctttccagacc

SEQ ID NO: 104101 - DNA, 20 bp, synthetic construct
  misc_feature 1..20: note = CRISPR gRNA sequence
  source 1..20: mol_type = other DNA
atgttcttctttccagacca

SEQ ID NO: 104102 - DNA, 20 bp, synthetic construct
  misc_feature 1..20: note = CRISPR gRNA sequence
  source 1..20: mol_type = other DNA
ttcttctttccagaccaagg

SEQ ID NO: 104103 - DNA, 20 bp, synthetic construct
  misc_feature 1..20: note = CRISPR gRNA sequence
  source 1..20: mol_type = other DNA
ttccagaccaaggtggtccc

SEQ ID NO: 104104 - DNA, 20 bp, synthetic construct
  misc_feature 1..20: note = CRISPR gRNA sequence
  source 1..20: mol_type = other DNA
gtggtcccaagttgaaatta

SEQ ID NO: 104105 - DNA, 20 bp, synthetic construct
  misc_feature 1..20: note = CRISPR gRNA sequence
  source 1..20: mol_type = other DNA
tcccaagttgaaattatgga

SEQ ID NO: 104106 - DNA, 20 bp, synthetic construct
  misc_feature 1..20: note = CRISPR gRNA sequence
  source 1..20: mol_type = other DNA
aagttgaaattatggatgga

SEQ ID NO: 104107 - DNA, 20 bp, synthetic construct
  misc_feature 1..20: note = CRISPR gRNA sequence
  source 1..20: mol_type = other DNA
attatggatggaaagtgacc

SEQ ID NO: 104108 - DNA, 20 bp, synthetic construct
  misc_feature 1..20: note = CRISPR gRNA sequence
  source 1..20: mol_type = other DNA
ataaaaatctatctttctga

SEQ ID NO: 104109 - DNA, 20 bp, synthetic construct
  misc_feature 1..20: note = CRISPR gRNA sequence
  source 1..20: mol_type = other DNA
ttctgaaagtatcctccttc

SEQ ID NO: 104110 - DNA, 20 bp, synthetic construct
  misc_feature 1..20: note = CRISPR gRNA sequence
  source 1..20: mol_type = other DNA
ccagactgccatctatgttg

SEQ ID NO: 104111 - DNA, 20 bp, synthetic construct
  misc_feature 1..20: note = CRISPR gRNA sequence
  source 1..20: mol_type = other DNA
aagcaatgctcaaataaaaa

SEQ ID NO: 104112 - DNA, 20 bp, synthetic construct
  misc_feature 1..20: note = CRISPR gRNA sequence
  source 1..20: mol_type = other DNA
aaataaaaaaagtttgttga

SEQ ID NO: 104113 - DNA, 20 bp, synthetic construct
  misc_feature 1..20: note = CRISPR gRNA sequence
  source 1..20: mol_type = other DNA
aagtttgttgatggaattaa

SEQ ID NO: 104114 - DNA, 20 bp, synthetic construct
  misc_feature 1..20: note = CRISPR gRNA sequence
  source 1..20: mol_type = other DNA
gttgatggaattaatggtca

SEQ ID NO: 104115 - DNA, 20 bp, synthetic construct
  misc_feature 1..20: note = CRISPR gRNA sequence
  source 1..20: mol_type = other DNA
gatggaattaatggtcaaag

SEQ ID NO: 104116 - DNA, 20 bp, synthetic construct
  misc_feature 1..20: note = CRISPR gRNA sequence
  source 1..20: mol_type = other DNA
aattaatggtcaaagaagca

SEQ ID NO: 104117 - DNA, 20 bp, synthetic construct
  misc_feature 1..20: note = CRISPR gRNA sequence
  source 1..20: mol_type = other DNA
ttaatggtcaaagaagcaaa

SEQ ID NO: 104118 - DNA, 20 bp, synthetic construct
  misc_feature 1..20: note = CRISPR gRNA sequence
  source 1..20: mol_type = other DNA
atggtcaaagaagcaaagag

SEQ ID NO: 104119 - DNA, 20 bp, synthetic construct
  misc_feature 1..20: note = CRISPR gRNA sequence
  source 1..20: mol_type = other DNA
tggtcaaagaagcaaagaga

SEQ ID NO: 104120 - DNA, 20 bp, synthetic construct
  misc_feature 1..20: note = CRISPR gRNA sequence
  source 1..20: mol_type = other DNA
gaagcaaagagaaggttact

SEQ ID NO: 104121 - DNA, 20 bp, synthetic construct
  misc_feature 1..20: note = CRISPR gRNA sequence
  source 1..20: mol_type = other DNA
aagagaaggttacttagtac

SEQ ID NO: 104122 - DNA, 20 bp, synthetic construct
  misc_feature 1..20: note = CRISPR gRNA sequence
  source 1..20: mol_type = other DNA
ttagtactagccatgtattc

SEQ ID NO: 104123 - DNA, 20 bp, synthetic construct
  misc_feature 1..20: note = CRISPR gRNA sequence
  source 1..20: mol_type = other DNA
agccatgtattctggctttt

SEQ ID NO: 104124 - DNA, 20 bp, synthetic construct
  misc_feature 1..20: note = CRISPR gRNA sequence
  source 1..20: mol_type = other DNA
tgtattctggcttttaagtt

SEQ ID NO: 104125 - DNA, 20 bp, synthetic construct
  misc_feature 1..20: note = CRISPR gRNA sequence
  source 1..20: mol_type = other DNA
gtattctggcttttaagttt

SEQ ID NO: 104126 - DNA, 20 bp, synthetic construct
  misc_feature 1..20: note = CRISPR gRNA sequence
  source 1..20: mol_type = other DNA
attctggcttttaagtttgg

SEQ ID NO: 104127 - DNA, 20 bp, synthetic construct
  misc_feature 1..20: note = CRISPR gRNA sequence
  source 1..20: mol_type = other DNA
ttctggcttttaagtttggg

SEQ ID NO: 104128 - DNA, 20 bp, synthetic construct
  misc_feature 1..20: note = CRISPR gRNA sequence
  source 1..20: mol_type = other DNA
tattcttgaatataaaatac

SEQ ID NO: 104129 - DNA, 20 bp, synthetic construct
  misc_feature 1..20: note = CRISPR gRNA sequence
  source 1..20: mol_type = other DNA
tataaaatacaagacatttt

SEQ ID NO: 104130 - DNA, 20 bp, synthetic construct
  misc_feature 1..20: note = CRISPR gRNA sequence
  source 1..20: mol_type = other DNA
atacaagacattttgagcta

SEQ ID NO: 104131 - DNA, 20 bp, synthetic construct
  misc_feature 1..20: note = CRISPR gRNA sequence
  source 1..20: mol_type = other DNA
tacaagacattttgagctat

SEQ ID NO: 104132 - DNA, 20 bp, synthetic construct
  misc_feature 1..20: note = CRISPR gRNA sequence
  source 1..20: mol_type = other DNA
acaagacattttgagctatg

SEQ ID NO: 104133 - DNA, 20 bp, synthetic construct
  misc_feature 1..20: note = CRISPR gRNA sequence
  source 1..20: mol_type = other DNA
tcttttgcacttaaaaaaaa

SEQ ID NO: 104134 - DNA, 20 bp, synthetic construct
  misc_feature 1..20: note = CRISPR gRNA sequence
  source 1..20: mol_type = other DNA
ttaaaaaaaaaagtgttcac

SEQ ID NO: 104135 - DNA, 20 bp, synthetic construct
  misc_feature 1..20: note = CRISPR gRNA sequence
  source 1..20: mol_type = other DNA
gttcactagttatatgaaaa

SEQ ID NO: 104136 - DNA, 20 bp, synthetic construct
  misc_feature 1..20: note = CRISPR gRNA sequence
  source 1..20: mol_type = other DNA
ttcactagttatatgaaaat

SEQ ID NO: 104137 - DNA, 20 bp, synthetic construct
  misc_feature 1..20: note = CRISPR gRNA sequence
  source 1..20: mol_type = other DNA
ttttgtacacccaacattta

SEQ ID NO: 104138 - DNA, 20 bp, synthetic construct
  misc_feature 1..20: note = CRISPR gRNA sequence
  source 1..20: mol_type = other DNA
tttgtacacccaacatttaa

SEQ ID NO: 104139 - DNA, 20 bp, synthetic construct
  misc_feature 1..20: note = CRISPR gRNA sequence
  source 1..20: mol_type = other DNA
ttgtacacccaacatttaaa

SEQ ID NO: 104140 - DNA, 20 bp, synthetic construct
  misc_feature 1..20: note = CRISPR gRNA sequence
  source 1..20: mol_type = other DNA
acatttaaagggttgtattg

SEQ ID NO: 104141 - DNA, 20 bp, synthetic construct
  misc_feature 1..20: note = CRISPR gRNA sequence
  source 1..20: mol_type = other DNA
agggttgtattgcagttttt

SEQ ID NO: 104142 - DNA, 20 bp, synthetic construct
  misc_feature 1..20: note = CRISPR gRNA sequence
  source 1..20: mol_type = other DNA
agttttttagttccaaaatt

SEQ ID NO: 104143 - DNA, 20 bp, synthetic construct
  misc_feature 1..20: note = CRISPR gRNA sequence
  source 1..20: mol_type = other DNA
ttttttagttccaaaattta

SEQ ID NO: 104144 - DNA, 20 bp, synthetic construct
  misc_feature 1..20: note = CRISPR gRNA sequence
  source 1..20: mol_type = other DNA
aatttagagaaatatttttc

SEQ ID NO: 104145 - DNA, 20 bp, synthetic construct
  misc_feature 1..20: note = CRISPR gRNA sequence
  source 1..20: mol_type = other DNA
atatttttcaagcttcttgt

SEQ ID NO: 104146 - DNA, 20 bp, synthetic construct
  misc_feature 1..20: note = CRISPR gRNA sequence
  source 1..20: mol_type = other DNA
tatttttcaagcttcttgtc

SEQ ID NO: 104147 - DNA, 20 bp, synthetic construct
  misc_feature 1..20: note = CRISPR gRNA sequence
  source 1..20: mol_type = other DNA
ttctgataacactcctaata

SEQ ID NO: 104148 - DNA, 20 bp, synthetic construct
  misc_feature 1..20: note = CRISPR gRNA sequence
  source 1..20: mol_type = other DNA
tgataacactcctaataaag

SEQ ID NO: 104149 - DNA, 20 bp, synthetic construct
  misc_feature 1..20: note = CRISPR gRNA sequence
  source 1..20: mol_type = other DNA
cactcctaataaagtggcta

SEQ ID NO: 104150 - DNA, 20 bp, synthetic construct
  misc_feature 1..20: note = CRISPR gRNA sequence
  source 1..20: mol_type = other DNA
tggctatagccattaaaaaa

SEQ ID NO: 104151 - DNA, 20 bp, synthetic construct
  misc_feature 1..20: note = CRISPR gRNA sequence
  source 1..20: mol_type = other DNA
tatagccattaaaaaaaaga

SEQ ID NO: 104152 - DNA, 20 bp, synthetic construct
  misc_feature 1..20: note = CRISPR gRNA sequence
  source 1..20: mol_type = other DNA
agccattaaaaaaaagaaag

SEQ ID NO: 104153 - DNA, 20 bp, synthetic construct
  misc_feature 1..20: note = CRISPR gRNA sequence
  source 1..20: mol_type = other DNA
attaaaaaaaagaaagaaga

SEQ ID NO: 104154 - DNA, 20 bp, synthetic construct
  misc_feature 1..20: note = CRISPR gRNA sequence
  source 1..20: mol_type = other DNA
aaaaagaaagaagatagatt

SEQ ID NO: 104155 - DNA, 20 bp, synthetic construct
  misc_feature 1..20: note = CRISPR gRNA sequence
  source 1..20: mol_type = other DNA
agaaagaagatagatttgga

SEQ ID NO: 104156 - DNA, 20 bp, synthetic construct
  misc_feature 1..20: note = CRISPR gRNA sequence
  source 1..20: mol_type = other DNA
gctttccataattgctttat

SEQ ID NO: 104157 - DNA, 20 bp, synthetic construct
  misc_feature 1..20: note = CRISPR gRNA sequence
  source 1..20: mol_type = other DNA
ctttccataattgctttata

SEQ ID NO: 104158 - DNA, 20 bp, synthetic construct
  misc_feature 1..20: note = CRISPR gRNA sequence
  source 1..20: mol_type = other DNA
cataattgctttataaggtt

SEQ ID NO: 104159 - DNA, 20 bp, synthetic construct
  misc_feature 1..20: note = CRISPR gRNA sequence
  source 1..20: mol_type = other DNA
aaggtttagctatccaatcc

SEQ ID NO: 104160 - DNA, 20 bp, synthetic construct
  misc_feature 1..20: note = CRISPR gRNA sequence
  source 1..20: mol_type = other DNA
aggtttagctatccaatcct

SEQ ID NO: 104161 - DNA, 20 bp, synthetic construct
  misc_feature 1..20: note = CRISPR gRNA sequence
  source 1..20: mol_type = other DNA
tatccaatcctaggaccaaa

SEQ ID NO: 104162 - DNA, 20 bp, synthetic construct
  misc_feature 1..20: note = CRISPR gRNA sequence
  source 1..20: mol_type = other DNA
atccaatcctaggaccaaat

SEQ ID NO: 104163 - DNA, 20 bp, synthetic construct
  misc_feature 1..20: note = CRISPR gRNA sequence
  source 1..20: mol_type = other DNA
ccaatcctaggaccaaatag

SEQ ID NO: 104164 - DNA, 20 bp, synthetic construct
  misc_feature 1..20: note = CRISPR gRNA sequence
  source 1..20: mol_type = other DNA
aatttgacaaacattaatga

SEQ ID NO: 104165 - DNA, 20 bp, synthetic construct
  misc_feature 1..20: note = CRISPR gRNA sequence
  source 1..20: mol_type = other DNA
ttgacaaacattaatgacag

SEQ ID NO: 104166 - DNA, 20 bp, synthetic construct
  misc_feature 1..20: note = CRISPR gRNA sequence
  source 1..20: mol_type = other DNA
caaacattaatgacagtagt

SEQ ID NO: 104167 - DNA, 20 bp, synthetic construct
  misc_feature 1..20: note = CRISPR gRNA sequence
  source 1..20: mol_type = other DNA
ttaatgacagtagtgagtat

SEQ ID NO: 104168 - DNA, 20 bp, synthetic construct
  misc_feature 1..20: note = CRISPR gRNA sequence
  source 1..20: mol_type = other DNA
cagtagtgagtattggtaat

SEQ ID NO: 104169 - DNA, 20 bp, synthetic construct
  misc_feature 1..20: note = CRISPR gRNA sequence
  source 1..20: mol_type = other DNA
tattggtaattggaaactaa

SEQ ID NO: 104170 - DNA, 20 bp, synthetic construct
  misc_feature 1..20: note = CRISPR gRNA sequence
  source 1..20: mol_type = other DNA
attggtaattggaaactaat

SEQ ID NO: 104171 - DNA, 20 bp, synthetic construct
  misc_feature 1..20: note = CRISPR gRNA sequence
  source 1..20: mol_type = other DNA
tggtaattggaaactaatag

SEQ ID NO: 104172 - DNA, 20 bp, synthetic construct
  misc_feature 1..20: note = CRISPR gRNA sequence
  source 1..20: mol_type = other DNA
ggtaattggaaactaatagg

SEQ ID NO: 104173 - DNA, 20 bp, synthetic construct
  misc_feature 1..20: note = CRISPR gRNA sequence
  source 1..20: mol_type = other DNA
taccatataacaaattatcc

SEQ ID NO: 104174 - DNA, 20 bp, synthetic construct
  misc_feature 1..20: note = CRISPR gRNA sequence
  source 1..20: mol_type = other DNA
catataacaaattatcctag

SEQ ID NO: 104175 - DNA, 20 bp, synthetic construct
  misc_feature 1..20: note = CRISPR gRNA sequence
  source 1..20: mol_type = other DNA
taacaaattatcctagaagt

SEQ ID NO: 104176 - DNA, 20 bp, synthetic construct
  misc_feature 1..20: note = CRISPR gRNA sequence
  source 1..20: mol_type = other DNA
caaattatcctagaagttag

SEQ ID NO: 104177 - DNA, 20 bp, synthetic construct
  misc_feature 1..20: note = CRISPR gRNA sequence
  source 1..20: mol_type = other DNA
agcttaaaacaacaaacatt

SEQ ID NO: 104178 - DNA, 20 bp, synthetic construct
  misc_feature 1..20: note = CRISPR gRNA sequence
  source 1..20: mol_type = other DNA
taaaacaacaaacatttggc

SEQ ID NO: 104179 - DNA, 20 bp, synthetic construct
  misc_feature 1..20: note = CRISPR gRNA sequence
  source 1..20: mol_type = other DNA
caacaaacatttggccggtg

SEQ ID NO: 104180 - DNA, 20 bp, synthetic construct
  misc_feature 1..20: note = CRISPR gRNA sequence
  source 1..20: mol_type = other DNA
caaacatttggccggtgcgg

SEQ ID NO: 104181 - DNA, 20 bp, synthetic construct
  misc_feature 1..20: note = CRISPR gRNA sequence
  source 1..20: mol_type = other DNA
gtggcccacacctgtaatcc

SEQ ID NO: 104182 - DNA, 20 bp, synthetic construct
  misc_feature 1..20: note = CRISPR gRNA sequence
  source 1..20: mol_type = other DNA
cacctgtaatcccagcactt

SEQ ID NO: 104183 - DNA, 20 bp, synthetic construct
  misc_feature 1..20: note = CRISPR gRNA sequence
  source 1..20: mol_type = other DNA
acctgtaatcccagcacttt

SEQ ID NO: 104184 - DNA, 20 bp, synthetic construct
  misc_feature 1..20: note = CRISPR gRNA sequence
  source 1..20: mol_type = other DNA
tgtaatcccagcactttggg

SEQ ID NO: 104185 - DNA, 20 bp, synthetic construct
  misc_feature 1..20: note = CRISPR gRNA sequence
  source 1..20: mol_type = other DNA
tcccagcactttgggtggcc

SEQ ID NO: 104186 - DNA, 20 bp, synthetic construct
  misc_feature 1..20: note = CRISPR gRNA sequence
  source 1..20: mol_type = other DNA
cccagcactttgggtggccg

SEQ ID NO: 104187 - DNA, 20 bp, synthetic construct
  misc_feature 1..20: note = CRISPR gRNA sequence
  source 1..20: mol_type = other DNA
agcactttgggtggccgagg

SEQ ID NO: 104188 - DNA, 20 bp, synthetic construct
  misc_feature 1..20: note = CRISPR gRNA sequence
  source 1..20: mol_type = other DNA
gcactttgggtggccgaggc

SEQ ID NO: 104189 - DNA, 20 bp, synthetic construct
  misc_feature 1..20: note = CRISPR gRNA sequence
  source 1..20: mol_type = other DNA
ctttgggtggccgaggcggg

SEQ ID NO: 104190 - DNA, 20 bp, synthetic construct
  misc_feature 1..20: note = CRISPR gRNA sequence
  source 1..20: mol_type = other DNA
ggccgaggcgggtggatcac

SEQ ID NO: 104191 - DNA, 20 bp, synthetic construct
  misc_feature 1..20: note = CRISPR gRNA sequence
  source 1..20: mol_type = other DNA
gccgaggcgggtggatcaca

SEQ ID NO: 104192 - DNA, 20 bp, synthetic construct
  misc_feature 1..20: note = CRISPR gRNA sequence
  source 1..20: mol_type = other DNA
aggcgggtggatcacaaggt

SEQ ID NO: 104193 - DNA, 20 bp, synthetic construct
  misc_feature 1..20: note = CRISPR gRNA sequence
  source 1..20: mol_type = other DNA
ggcgggtggatcacaaggtc

SEQ ID NO: 104194 - DNA, 20 bp, synthetic construct
  misc_feature 1..20: note = CRISPR gRNA sequence
  source 1..20: mol_type = other DNA
cgggtggatcacaaggtcag

SEQ ID NO: 104195 - DNA, 20 bp, synthetic construct
  misc_feature 1..20: note = CRISPR gRNA sequence
  source 1..20: mol_type = other DNA
gatcacaaggtcaggagatc

SEQ ID NO: 104196 - DNA, 20 bp, synthetic construct
  misc_feature 1..20: note = CRISPR gRNA sequence
  source 1..20: mol_type = other DNA
tcaggagatcgagaccatcc

SEQ ID NO: 104197 - DNA, 20 bp, synthetic construct
  misc_feature 1..20: note = CRISPR gRNA sequence
  source 1..20: mol_type = other DNA
cgagaccatcctggttaaca

SEQ ID NO: 104198 - DNA, 20 bp, synthetic construct
  misc_feature 1..20: note = CRISPR gRNA sequence
  source 1..20: mol_type = other DNA
gaaaccccgtctctactaaa

SEQ ID NO: 104199 - DNA, 20 bp, synthetic construct
  misc_feature 1..20: note = CRISPR gRNA sequence
  source 1..20: mol_type = other DNA
aaaaagacaaaaaaaaaatt

SEQ ID NO: 104200 - DNA, 20 bp, synthetic construct
  misc_feature 1..20: note = CRISPR gRNA sequence
  source 1..20: mol_type = other DNA
agacaaaaaaaaaattaagc

SEQ ID NO: 104201 - DNA, 20 bp, synthetic construct
  misc_feature 1..20: note = CRISPR gRNA sequence
  source 1..20: mol_type = other DNA
gacaaaaaaaaaattaagcc

SEQ ID NO: 104202 - DNA, 20 bp, synthetic construct
  misc_feature 1..20: note = CRISPR gRNA sequence
  source 1..20: mol_type = other DNA
aaaaattaagccaggcgtga

SEQ ID NO: 104203 - DNA, 20 bp, synthetic construct
  misc_feature 1..20: note = CRISPR gRNA sequence
  source 1..20: mol_type = other DNA
aattaagccaggcgtgatgg

SEQ ID NO: 104204 - DNA, 20 bp, synthetic construct
  misc_feature 1..20: note = CRISPR gRNA sequence
  source 1..20: mol_type = other DNA
ggcgtgatggcggacgcctg

SEQ ID NO: 104205 - DNA, 20 bp, synthetic construct
  misc_feature 1..20: note = CRISPR gRNA sequence
  source 1..20: mol_type = other DNA
atggcggacgcctgtagtcc

SEQ ID NO: 104206 - DNA, 20 bp, synthetic construct
  misc_feature 1..20: note = CRISPR gRNA sequence
  source 1..20: mol_type = other DNA
cgcctgtagtcccagctact

SEQ ID NO: 104207 - DNA, 20 bp, synthetic construct
  misc_feature 1..20: note = CRISPR gRNA sequence
  source 1..20: mol_type = other DNA
gcctgtagtcccagctactc

SEQ ID NO: 104208 - DNA, 20 bp, synthetic construct
  misc_feature 1..20: note = CRISPR gRNA sequence
  source 1..20: mol_type = other DNA
ctgtagtcccagctactcgg

SEQ ID NO: 104209 - DNA, 20 bp, synthetic construct
  misc_feature 1..20: note = CRISPR gRNA sequence
  source 1..20: mol_type = other DNA
tgtagtcccagctactcggg

SEQ ID NO: 104210 - DNA, 20 bp, synthetic construct
  misc_feature 1..20: note = CRISPR gRNA sequence
  source 1..20: mol_type = other DNA
tcccagctactcgggaggct

SEQ ID NO: 104211 - DNA, 20 bp, synthetic construct
  misc_feature 1..20: note = CRISPR gRNA sequence
  source 1..20: mol_type = other DNA
cccagctactcgggaggctg

SEQ ID NO: 104212 - DNA, 20 bp, synthetic construct
  misc_feature 1..20: note = CRISPR gRNA sequence
  source 1..20: mol_type = other DNA
agctactcgggaggctgagg

SEQ ID NO: 104213 - DNA, 20 bp, synthetic construct
  misc_feature 1..20: note = CRISPR gRNA sequence
  source 1..20: mol_type = other DNA
gctactcgggaggctgaggc

SEQ ID NO: 104214 - DNA, 20 bp, synthetic construct
  misc_feature 1..20: note = CRISPR gRNA sequence
  source 1..20: mol_type = other DNA
tactcgggaggctgaggcag

SEQ ID NO: 104215 - DNA, 20 bp, synthetic construct
  misc_feature 1..20: note = CRISPR gRNA sequence
  source 1..20: mol_type = other DNA
gggaggctgaggcaggagaa

SEQ ID NO: 104216 - DNA, 20 bp, synthetic construct
  misc_feature 1..20: note = CRISPR gRNA sequence
  source 1..20: mol_type = other DNA
gcaggagaatggcatgaacc

SEQ ID NO: 104217 - DNA, 20 bp, synthetic construct
  misc_feature 1..20: note = CRISPR gRNA sequence
  source 1..20: mol_type = other DNA
caggagaatggcatgaaccc

SEQ ID NO: 104218 - DNA, 20 bp, synthetic construct
  misc_feature 1..20: note = CRISPR gRNA sequence
  source 1..20: mol_type = other DNA
ggagaatggcatgaacccag

SEQ ID NO: 104219 - DNA, 20 bp, synthetic construct
  misc_feature 1..20: note = CRISPR gRNA sequence
  source 1..20: mol_type = other DNA
gagaatggcatgaacccagg

SEQ ID NO: 104220 - DNA, 20 bp, synthetic construct
  misc_feature 1..20: note = CRISPR gRNA sequence
  source 1..20: mol_type = other DNA
aatggcatgaacccaggagg

SEQ ID NO: 104221 - DNA, 20 bp, synthetic construct
  misc_feature 1..20: note = CRISPR gRNA sequence
  source 1..20: mol_type = other DNA
tggcatgaacccaggaggcg

SEQ ID NO: 104222 - DNA, 20 bp, synthetic construct
  misc_feature 1..20: note = CRISPR gRNA sequence
  source 1..20: mol_type = other DNA
aacccaggaggcggagcttg

SEQ ID NO: 104223 - DNA, 20 bp, synthetic construct
  misc_feature 1..20: note = CRISPR gRNA sequence
  source 1..20: mol_type = other DNA
caggaggcggagcttgcagt

SEQ ID NO: 104224 - DNA, 20 bp, synthetic construct
  misc_feature 1..20: note = CRISPR gRNA sequence
  source 1..20: mol_type = other DNA
ggcggagcttgcagtgagcc

SEQ ID NO: 104225 - DNA, 20 bp, synthetic construct
  misc_feature 1..20: note = CRISPR gRNA sequence
  source 1..20: mol_type = other DNA
aagatcacaccactgcactc

SEQ ID NO: 104226 - DNA, 20 bp, synthetic construct
  misc_feature 1..20: note = CRISPR gRNA sequence
  source 1..20: mol_type = other DNA
acaccactgcactccagcct

SEQ ID NO: 104227 - DNA, 20 bp, synthetic construct
  misc_feature 1..20: note = CRISPR gRNA sequence
  source 1..20: mol_type = other DNA
ctgcactccagcctgagcca

SEQ ID NO: 104228 - DNA, 20 bp, synthetic construct
  misc_feature 1..20: note = CRISPR gRNA sequence
  source 1..20: mol_type = other DNA
gcactccagcctgagccaca

SEQ ID NO: 104229 - DNA, 20 bp, synthetic construct
  misc_feature 1..20: note = CRISPR gRNA sequence
  source 1..20: mol_type = other DNA
aaaaaaaaaaatttatttta

SEQ ID NO: 104230 - DNA, 20 bp, synthetic construct
  misc_feature 1..20: note = CRISPR gRNA sequence
  source 1..20: mol_type = other DNA
atttattttatagtttctgt

SEQ ID NO: 104231 - DNA, 20 bp, synthetic construct
  misc_feature 1..20: note = CRISPR gRNA sequence
  source 1..20: mol_type = other DNA
attttatagtttctgtgagt

SEQ ID NO: 104232 - DNA, 20 bp, synthetic construct
  misc_feature 1..20: note = CRISPR gRNA sequence
  source 1..20: mol_type = other DNA
ttttatagtttctgtgagtt

SEQ ID NO: 104233 - DNA, 20 bp, synthetic construct
  misc_feature 1..20: note = CRISPR gRNA sequence
  source 1..20: mol_type = other DNA
gtgagttaggaatcctgaca

SEQ ID NO: 104234 - DNA, 20 bp, synthetic construct
  misc_feature 1..20: note = CRISPR gRNA sequence
  source 1..20: mol_type = other DNA
gaatcctgacacagctgtgt

SEQ ID NO: 104235 - DNA, 20 bp, synthetic construct
  misc_feature 1..20: note = CRISPR gRNA sequence
  source 1..20: mol_type = other DNA
cagctgtgttggattctttc

SEQ ID NO: 104236 - DNA, 20 bp, synthetic construct
  misc_feature 1..20: note = CRISPR gRNA sequence
  source 1..20: mol_type = other DNA
agctgtgttggattctttca

SEQ ID NO: 104237 - DNA, 20 bp, synthetic construct
  misc_feature 1..20: note = CRISPR gRNA sequence
  source 1..20: mol_type = other DNA
gattctttcaaggtcctctc

SEQ ID NO: 104238 - DNA, 20 bp, synthetic construct
  misc_feature 1..20: note = CRISPR gRNA sequence
  source 1..20: mol_type = other DNA
attctttcaaggtcctctca

SEQ ID NO: 104239 - DNA, 20 bp, synthetic construct
  misc_feature 1..20: note = CRISPR gRNA sequence
  source 1..20: mol_type = other DNA
gtcctctcaaggcccttatc

SEQ ID NO: 104240 - DNA, 20 bp, synthetic construct
  misc_feature 1..20: note = CRISPR gRNA sequence
  source 1..20: mol_type = other DNA
tcctctcaaggcccttatca

SEQ ID NO: 104241 - DNA, 20 bp, synthetic construct
  misc_feature 1..20: note = CRISPR gRNA sequence
  source 1..20: mol_type = other DNA
cccttatcaaggtgttgtcc

SEQ ID NO: 104242 - DNA, 20 bp, synthetic construct
  misc_feature 1..20: note = CRISPR gRNA sequence
  source 1..20: mol_type = other DNA
ccttatcaaggtgttgtcct

SEQ ID NO: 104243 - DNA, 20 bp, synthetic construct
  misc_feature 1..20: note = CRISPR gRNA sequence
  source 1..20: mol_type = other DNA
caaggtgttgtcctgggctg

SEQ ID NO: 104244 - DNA, 20 bp, synthetic construct
  misc_feature 1..20: note = CRISPR gRNA sequence
  source 1..20: mol_type = other DNA
gggctgcagtcacatttgac

SEQ ID NO: 104245 - DNA, 20 bp, synthetic construct
  misc_feature 1..20: note = CRISPR gRNA sequence
  source 1..20: mol_type = other DNA
gctgcagtcacatttgacta

SEQ ID NO: 104246 - DNA, 20 bp, synthetic construct
  misc_feature 1..20: note = CRISPR gRNA sequence
  source 1..20: mol_type = other DNA
gcagtcacatttgactagag

SEQ ID NO: 104247 - DNA, 20 bp, synthetic construct
  misc_feature 1..20: note = CRISPR gRNA sequence
  source 1..20: mol_type = other DNA
gactagagtagaatacattt

SEQ ID NO: 104248 - DNA, 20 bp, synthetic construct
  misc_feature 1..20: note = CRISPR gRNA sequence
  source 1..20: mol_type = other DNA
actagagtagaatacatttt

SEQ ID NO: 104249 - DNA, 20 bp, synthetic construct
  misc_feature 1..20: note = CRISPR gRNA sequence
  source 1..20: mol_type = other DNA
ttttctttgtttgttttttt

SEQ ID NO: 104250 - DNA, 20 bp, synthetic construct
  misc_feature 1..20: note = CRISPR gRNA sequence
  source 1..20: mol_type = other DNA
ctttgtttgtttttttgaga

SEQ ID NO: 104251 - DNA, 20 bp, synthetic construct
  misc_feature 1..20: note = CRISPR gRNA sequence
  source 1..20: mol_type = other DNA
cagttactcgctctgttgcc

SEQ ID NO: 104252 - DNA, 20 bp, synthetic construct
  misc_feature 1..20: note = CRISPR gRNA sequence
  source 1..20: mol_type = other DNA
agttactcgctctgttgcct

SEQ ID NO: 104253 - DNA, 20 bp, synthetic construct
  misc_feature 1..20: note = CRISPR gRNA sequence
  source 1..20: mol_type = other DNA
actcgctctgttgcctaggc

SEQ ID NO: 104254 - DNA, 20 bp, synthetic construct
  misc_feature 1..20: note = CRISPR gRNA sequence
  source 1..20: mol_type = other DNA
ctgttgcctaggctggaatg

SEQ ID NO: 104255 - DNA, 20 bp, synthetic construct
  misc_feature 1..20: note = CRISPR gRNA sequence
  source 1..20: mol_type = other DNA
ttgcctaggctggaatgcag

SEQ ID NO: 104256 - DNA, 20 bp, synthetic construct
  misc_feature 1..20: note = CRISPR gRNA sequence
  source 1..20: mol_type = other DNA
taggctggaatgcagtggtg

SEQ ID NO: 104257 - DNA, 20 bp, synthetic construct
  misc_feature 1..20: note = CRISPR gRNA sequence
  source 1..20: mol_type = other DNA
gaatgcagtggtgcggatct

SEQ ID NO: 104258 - DNA, 20 bp, synthetic construct
  misc_feature 1..20: note = CRISPR gRNA sequence
  source 1..20: mol_type = other DNA
tcactgcaacctctgcctcc

SEQ ID NO: 104259 - DNA, 20 bp, synthetic construct
  misc_feature 1..20: note = CRISPR gRNA sequence
  source 1..20: mol_type = other DNA
cactgcaacctctgcctccc

SEQ ID NO: 104260 - DNA, 20 bp, synthetic construct
  misc_feature 1..20: note = CRISPR gRNA sequence
  source 1..20: mol_type = other DNA
ctcaaatgatcctcccacct

SEQ ID NO: 104261 - DNA, 20 bp, synthetic construct
  misc_feature 1..20: note = CRISPR gRNA sequence
  source 1..20: mol_type = other DNA
tcctcccacctcagttcccc

SEQ ID NO: 104262 - DNA, 20 bp, synthetic construct
  misc_feature 1..20: note = CRISPR gRNA sequence
  source 1..20: mol_type = other DNA
tcccacctcagttccccaag

SEQ ID NO: 104263 - DNA, 20 bp, synthetic construct
  misc_feature 1..20: note = CRISPR gRNA sequence
  source 1..20: mol_type = other DNA
acctcagttccccaagtagc

SEQ ID NO: 104264 - DNA, 20 bp, synthetic construct
  misc_feature 1..20: note = CRISPR gRNA sequence
  source 1..20: mol_type = other DNA
cctcagttccccaagtagct

SEQ ID NO: 104265 - DNA, 20 bp, synthetic construct
  misc_feature 1..20: note = CRISPR gRNA sequence
  source 1..20: mol_type = other DNA
tccccaagtagctgggacca

SEQ ID NO: 104266 - DNA, 20 bp, synthetic construct
  misc_feature 1..20: note = CRISPR gRNA sequence
  source 1..20: mol_type = other DNA
ccccaagtagctgggaccac

SEQ ID NO: 104267 - DNA, 20 bp, synthetic construct
  misc_feature 1..20: note = CRISPR gRNA sequence
  source 1..20: mol_type = other DNA
caggcatgtcctaccatgcc

SEQ ID NO: 104268 - DNA, 20 bp, synthetic construct
  misc_feature 1..20: note = CRISPR gRNA sequence
  source 1..20: mol_type = other DNA
tggataatttttgtattttt

SEQ ID NO: 104269 - DNA, 20 bp, synthetic construct
  misc_feature 1..20: note = CRISPR gRNA sequence
  source 1..20: mol_type = other DNA
ataatttttgtatttttcag

SEQ ID NO: 104270 - DNA, 20 bp, synthetic construct
  misc_feature 1..20: note = CRISPR gRNA sequence
  source 1..20: mol_type = other DNA
tttgtatttttcagtagata

SEQ ID NO: 104271 - DNA, 20 bp, synthetic construct
  misc_feature 1..20: note = CRISPR gRNA sequence
  source 1..20: mol_type = other DNA
ttgtatttttcagtagatac

SEQ ID NO: 104272 - DNA, 20 bp, synthetic construct
  misc_feature 1..20: note = CRISPR gRNA sequence
  source 1..20: mol_type = other DNA
tgtatttttcagtagataca

SEQ ID NO: 104273 - DNA, 20 bp, synthetic construct
  misc_feature 1..20: note = CRISPR gRNA sequence
  source 1..20: mol_type = other DNA
cagggttttgccatgttgcc

SEQ ID NO: 104274 - DNA, 20 bp, synthetic construct
  misc_feature 1..20: note = CRISPR gRNA sequence
  source 1..20: mol_type = other DNA
agggttttgccatgttgccc

SEQ ID NO: 104275 - DNA, 20 bp, synthetic construct
  misc_feature 1..20: note = CRISPR gRNA sequence
  source 1..20: mol_type = other DNA
ttttgccatgttgcccaggc

SEQ ID NO: 104276 - DNA, 20 bp, synthetic construct
  misc_feature 1..20: note = CRISPR gRNA sequence
  source 1..20: mol_type = other DNA
ctgacctaatctgctcgcct

SEQ ID NO: 104277 - DNA, 20 bp, synthetic construct
  misc_feature 1..20: note = CRISPR gRNA sequence
  source 1..20: mol_type = other DNA
ctgctcgcctcagcctcctg

SEQ ID NO: 104278 - DNA, 20 bp, synthetic construct
  misc_feature 1..20: note = CRISPR gRNA sequence
  source 1..20: mol_type = other DNA
gcctcagcctcctgaagtgc

SEQ ID NO: 104279 - DNA, 20 bp, synthetic construct
  misc_feature 1..20: note = CRISPR gRNA sequence
  source 1..20: mol_type = other DNA
cctcagcctcctgaagtgct

SEQ ID NO: 104280 - DNA, 20 bp, synthetic construct
  misc_feature 1..20: note = CRISPR gRNA sequence
  source 1..20: mol_type = other DNA
ctcctgaagtgctgggatta

SEQ ID NO: 104281 - DNA, 20 bp, synthetic construct
  misc_feature 1..20: note = CRISPR gRNA sequence
  source 1..20: mol_type = other DNA
tcctgaagtgctgggattat

SEQ ID NO: 104282 - DNA, 20 bp, synthetic construct
  misc_feature 1..20: note = CRISPR gRNA sequence
  source 1..20: mol_type = other DNA
agtgctgggattatgggcat

SEQ ID NO: 104283 - DNA, 20 bp, synthetic construct
  misc_feature 1..20: note = CRISPR gRNA sequence
  source 1..20: mol_type = other DNA
tgggcataagccattgtacc

SEQ ID NO: 104284 - DNA, 20 bp, synthetic construct
  misc_feature 1..20: note = CRISPR gRNA sequence
  source 1..20: mol_type = other DNA
aagccattgtacccggcttt

SEQ ID NO: 104285 - DNA, 20 bp, synthetic construct
  misc_feature 1..20: note = CRISPR gRNA sequence
  source 1..20: mol_type = other DNA
ttcagcatttttaatatata

SEQ ID NO: 104286 - DNA, 20 bp, synthetic construct
  misc_feature 1..20: note = CRISPR gRNA sequence
  source 1..20: mol_type = other DNA
atagtatttcctctgtaaaa

SEQ ID NO: 104287 - DNA, 20 bp, synthetic construct
  misc_feature 1..20: note = CRISPR gRNA sequence
  source 1..20: mol_type = other DNA
tacttcatcattcaccaaaa

SEQ ID NO: 104288 - DNA, 20 bp, synthetic construct
  misc_feature 1..20: note = CRISPR gRNA sequence
  source 1..20: mol_type = other DNA
tcatcattcaccaaaatggc

SEQ ID NO: 104289 - DNA, 20 bp, synthetic construct
  misc_feature 1..20: note = CRISPR gRNA sequence
  source 1..20: mol_type = other DNA
aagattaaaaaataataata

SEQ ID NO: 104290 - DNA, 20 bp, synthetic construct
  misc_feature 1..20: note = CRISPR gRNA sequence
  source 1..20: mol_type = other DNA
aaaataataataaagcactt

SEQ ID NO: 104291 - DNA, 20 bp, synthetic construct
  misc_feature 1..20: note = CRISPR gRNA sequence
  source 1..20: mol_type = other DNA
aataataataaagcacttta

SEQ ID NO: 104292 - DNA, 20 bp, synthetic construct
  misc_feature 1..20: note = CRISPR gRNA sequence
  source 1..20: mol_type = other DNA
ttttatttttttattttttt

SEQ ID NO: 104293 - DNA, 20 bp, synthetic construct
  misc_feature 1..20: note = CRISPR gRNA sequence
  source 1..20: mol_type = other DNA
atttttttatttttttgaga

SEQ ID NO: 104294 - DNA, 20 bp, synthetic construct
  misc_feature 1..20: note = CRISPR gRNA sequence
  source 1..20: mol_type = other DNA
cggaatctcgctctgtcgcc

SEQ ID NO: 104295 - DNA, 20 bp, synthetic construct
  misc_feature 1..20: note = CRISPR gRNA sequence
  source 1..20: mol_type = other DNA
ggaatctcgctctgtcgccc

SEQ ID NO: 104296 - DNA, 20 bp, synthetic construct
  misc_feature 1..20: note = CRISPR gRNA sequence
  source 1..20: mol_type = other DNA
tctcgctctgtcgcccaggc

SEQ ID NO: 104297 - DNA, 20 bp, synthetic construct
  misc_feature 1..20: note = CRISPR gRNA sequence
  source 1..20: mol_type = other DNA
tcgctctgtcgcccaggctg

SEQ ID NO: 104298 - DNA, 20 bp, synthetic construct
  misc_feature 1..20: note = CRISPR gRNA sequence
  source 1..20: mol_type = other DNA
ctgtcgcccaggctggagtg

SEQ ID NO: 104299 - DNA, 20 bp, synthetic construct
  misc_feature 1..20: note = CRISPR gRNA sequence
  source 1..20: mol_type = other DNA
tcgcccaggctggagtgcag

SEQ ID NO: 104300 - DNA, 20 bp, synthetic construct
  misc_feature 1..20: note = CRISPR gRNA sequence
  source 1..20: mol_type = other DNA
ggagtgcagtggcgtgatct

SEQ ID NO: 104301 - DNA, 20 bp, synthetic construct
  misc_feature 1..20: note = CRISPR gRNA sequence
  source 1..20: mol_type = other DNA
ctcactgcaacctccgcctc

SEQ ID NO: 104302 - DNA, 20 bp, synthetic construct
  misc_feature 1..20: note = CRISPR gRNA sequence
  source 1..20: mol_type = other DNA
gcaacctccgcctccggttc

SEQ ID NO: 104303 - DNA, 20 bp, synthetic construct
  misc_feature 1..20: note = CRISPR gRNA sequence
  source 1..20: mol_type = other DNA
ctccggttcaagtgattttc

SEQ ID NO: 104304 - DNA, 20 bp, synthetic construct
  misc_feature 1..20: note = CRISPR gRNA sequence
  source 1..20: mol_type = other DNA
ttcaagtgattttccggcct

SEQ ID NO: 104305 - DNA, 20 bp, synthetic construct
  misc_feature 1..20: note = CRISPR gRNA sequence
  source 1..20: mol_type = other DNA
ttttccggcctcagtctccc

SEQ ID NO: 104306 - DNA, 20 bp, synthetic construct
  misc_feature 1..20: note = CRISPR gRNA sequence
  source 1..20: mol_type = other DNA
tccggcctcagtctcccaag

SEQ ID NO: 104307 - DNA, 20 bp, synthetic construct
  misc_feature 1..20: note = CRISPR gRNA sequence
  source 1..20: mol_type = other DNA
gcctcagtctcccaagtagc

SEQ ID NO: 104308 - DNA, 20 bp, synthetic construct
  misc_feature 1..20: note = CRISPR gRNA sequence
  source 1..20: mol_type = other DNA
cctcagtctcccaagtagct

SEQ ID NO: 104309 - DNA, 20 bp, synthetic construct
  misc_feature 1..20: note = CRISPR gRNA sequence
  source 1..20: mol_type = other DNA
ctcccaagtagctgggatta

SEQ ID NO: 104310 - DNA, 20 bp, synthetic construct
  misc_feature 1..20: note = CRISPR gRNA sequence
  source 1..20: mol_type = other DNA
tcccaagtagctgggattac

SEQ ID NO: 104311 - DNA, 20 bp, synthetic construct
  misc_feature 1..20: note = CRISPR gRNA sequence
  source 1..20: mol_type = other DNA
caggcatgcaccaccatgcc

SEQ ID NO: 104312 - DNA, 20 bp, synthetic construct
  misc_feature 1..20: note = CRISPR gRNA sequence
  source 1..20: mol_type = other DNA
ccggctaatctttgtatttt

SEQ ID NO: 104313 - DNA, 20 bp, synthetic construct
  misc_feature 1..20: note = CRISPR gRNA sequence
  source 1..20: mol_type = other DNA
gctaatctttgtatttttag

SEQ ID NO: 104314 - DNA, 20 bp, synthetic construct
  misc_feature 1..20: note = CRISPR gRNA sequence
  source 1..20: mol_type = other DNA
taatctttgtatttttagta

SEQ ID NO: 104315 - DNA, 20 bp, synthetic construct
  misc_feature 1..20: note = CRISPR gRNA sequence
  source 1..20: mol_type = other DNA
ctttgtatttttagtagaga

SEQ ID NO: 104316 - DNA, 20 bp, synthetic construct
  misc_feature 1..20: note = CRISPR gRNA sequence
  source 1..20: mol_type = other DNA
tttgtatttttagtagagac

SEQ ID NO: 104317 - DNA, 20 bp, synthetic construct
  misc_feature 1..20: note = CRISPR gRNA sequence
  source 1..20: mol_type = other DNA
ttgtatttttagtagagaca

SEQ ID NO: 104318 - DNA, 20 bp, synthetic construct
  misc_feature 1..20: note = CRISPR gRNA sequence
  source 1..20: mol_type = other DNA
gagacagggtttcatcatgt

SEQ ID NO: 104319 - DNA, 20 bp, synthetic construct
  misc_feature 1..20: note = CRISPR gRNA sequence
  source 1..20: mol_type = other DNA
cagggtttcatcatgttggc

SEQ ID NO: 104320 - DNA, 20 bp, synthetic construct
  misc_feature 1..20: note = CRISPR gRNA sequence
  source 1..20: mol_type = other DNA
agggtttcatcatgttggcc

SEQ ID NO: 104321 - DNA, 20 bp, synthetic construct
  misc_feature 1..20: note = CRISPR gRNA sequence
  source 1..20: mol_type = other DNA
tttcatcatgttggccaggc

SEQ ID NO: 104322 - DNA, 20 bp, synthetic construct
  misc_feature 1..20: note = CRISPR gRNA sequence
  source 1..20: mol_type = other DNA
ggtctcgaactcctgacctc

SEQ ID NO: 104323 - DNA, 20 bp, synthetic construct
  misc_feature 1..20: note = CRISPR gRNA sequence
  source 1..20: mol_type = other DNA
ctcaagtgatccacccacct

SEQ ID NO: 104324 - DNA, 20 bp, synthetic construct
  misc_feature 1..20: note = CRISPR gRNA sequence
  source 1..20: mol_type = other DNA
ccacccacctcggccttcca

SEQ ID NO: 104325 - DNA, 20 bp, synthetic construct
  misc_feature 1..20: note = CRISPR gRNA sequence
  source 1..20: mol_type = other DNA
acctcggccttccaaagtgc

SEQ ID NO: 104326 - DNA, 20 bp, synthetic construct
  misc_feature 1..20: note = CRISPR gRNA sequence
  source 1..20: mol_type = other DNA
cctcggccttccaaagtgca

SEQ ID NO: 104327 - DNA, 20 bp, synthetic construct
  misc_feature 1..20: note = CRISPR gRNA sequence
  source 1..20: mol_type = other DNA
cttccaaagtgcaaggatta

SEQ ID NO: 104328 - DNA, 20 bp, synthetic construct
  misc_feature 1..20: note = CRISPR gRNA sequence
  source 1..20: mol_type = other DNA
ttccaaagtgcaaggattac

SEQ ID NO: 104329 - DNA, 20 bp, synthetic construct
  misc_feature 1..20: note = CRISPR gRNA sequence
  source 1..20: mol_type = other DNA
agtgcaaggattacaggcgt

SEQ ID NO: 104330 - DNA, 20 bp, synthetic construct
  misc_feature 1..20: note = CRISPR gRNA sequence
  source 1..20: mol_type = other DNA
caggcgtgagccaccacacc

SEQ ID NO: 104331 - DNA, 20 bp, synthetic construct
  misc_feature 1..20: note = CRISPR gRNA sequence
  source 1..20: mol_type = other DNA
gtgagccaccacacccagcc

SEQ ID NO: 104332 - DNA, 20 bp, synthetic construct
  misc_feature 1..20: note = CRISPR gRNA sequence
  source 1..20: mol_type = other DNA
gagccaccacacccagccca

SEQ ID NO: 104333 - DNA, 20 bp, synthetic construct
  misc_feature 1..20: note = CRISPR gRNA sequence
  source 1..20: mol_type = other DNA
cgacattgatttgttaatat

SEQ ID NO: 104334 - DNA, 20 bp, synthetic construct
  misc_feature 1..20: note = CRISPR gRNA sequence
  source 1..20: mol_type = other DNA
gacattgatttgttaatatc

SEQ ID NO: 104335 - DNA, 20 bp, synthetic construct
  misc_feature 1..20: note = CRISPR gRNA sequence
  source 1..20: mol_type = other DNA
atttgttaatatcaggtatc

SEQ ID NO: 104336 - DNA, 20 bp, synthetic construct
  misc_feature 1..20: note = CRISPR gRNA sequence
  source 1..20: mol_type = other DNA
gttaatatcaggtatccaga

SEQ ID NO: 104337 - DNA, 20 bp, synthetic construct
  misc_feature 1..20: note = CRISPR gRNA sequence
  source 1..20: mol_type = other DNA
ttccctatttgtttcataaa

SEQ ID NO: 104338 - DNA, 20 bp, synthetic construct
  misc_feature 1..20: note = CRISPR gRNA sequence
  source 1..20: mol_type = other DNA
ttgtttcataaatggaaaat

SEQ ID NO: 104339 - DNA, 20 bp, synthetic construct
  misc_feature 1..20: note = CRISPR gRNA sequence
  source 1..20: mol_type = other DNA
aagttgtgtctacttcataa

SEQ ID NO: 104340 - DNA, 20 bp, synthetic construct
  misc_feature 1..20: note = CRISPR gRNA sequence
  source 1..20: mol_type = other DNA
gttgtgtctacttcataatg

SEQ ID NO: 104341 - DNA, 20 bp, synthetic construct
  misc_feature 1..20: note = CRISPR gRNA sequence
  source 1..20: mol_type = other DNA
ttgtgtctacttcataatgg

SEQ ID NO: 104342 - DNA, 20 bp, synthetic construct
  misc_feature 1..20: note = CRISPR gRNA sequence
  source 1..20: mol_type = other DNA
tgtgtctacttcataatgga

SEQ ID NO: 104343 - DNA, 20 bp, synthetic construct
  misc_feature 1..20: note = CRISPR gRNA sequence
  source 1..20: mol_type = other DNA
gtctacttcataatggaggg

SEQ ID NO: 104344 - DNA, 20 bp, synthetic construct
  misc_feature 1..20: note = CRISPR gRNA sequence
  source 1..20: mol_type = other DNA
ctacttcataatggagggca

SEQ ID NO: 104345 - DNA, 20 bp, synthetic construct
  misc_feature 1..20: note = CRISPR gRNA sequence
  source 1..20: mol_type = other DNA
cttcataatggagggcagag

SEQ ID NO: 104346 - DNA, 20 bp, synthetic construct
  misc_feature 1..20: note = CRISPR gRNA sequence
  source 1..20: mol_type = other DNA
ttcataatggagggcagagc

SEQ ID NO: 104347 - DNA, 20 bp, synthetic construct
  misc_feature 1..20: note = CRISPR gRNA sequence
  source 1..20: mol_type = other DNA
aggacttcttttttcctctt

SEQ ID NO: 104348 - DNA, 20 bp, synthetic construct
  misc_feature 1..20: note = CRISPR gRNA sequence
  source 1..20: mol_type = other DNA
tcagaacattttctgctttc

SEQ ID NO: 104349 - DNA, 20 bp, synthetic construct
  misc_feature 1..20: note = CRISPR gRNA sequence
  source 1..20: mol_type = other DNA
agaacattttctgctttcta

SEQ ID NO: 104350 - DNA, 20 bp, synthetic construct
  misc_feature 1..20: note = CRISPR gRNA sequence
  source 1..20: mol_type = other DNA
ttctgctttctagagaaatg

SEQ ID NO: 104351 - DNA, 20 bp, synthetic construct
  misc_feature 1..20: note = CRISPR gRNA sequence
  source 1..20: mol_type = other DNA
agagaaatgtggataactct

SEQ ID NO: 104352 - DNA, 20 bp, synthetic construct
  misc_feature 1..20: note = CRISPR gRNA sequence
  source 1..20: mol_type = other DNA
gagaaatgtggataactctc

SEQ ID NO: 104353 - DNA, 20 bp, synthetic construct
  misc_feature 1..20: note = CRISPR gRNA sequence
  source 1..20: mol_type = other DNA
agaaatgtggataactctcg

SEQ ID NO: 104354 - DNA, 20 bp, synthetic construct
  misc_feature 1..20: note = CRISPR gRNA sequence
  source 1..20: mol_type = other DNA
tggataactctcggggacca

SEQ ID NO: 104355 - DNA, 20 bp, synthetic construct
  misc_feature 1..20: note = CRISPR gRNA sequence
  source 1..20: mol_type = other DNA
ggataactctcggggaccaa

SEQ ID NO: 104356 - DNA, 20 bp, synthetic construct
  misc_feature 1..20: note = CRISPR gRNA sequence
  source 1..20: mol_type = other DNA
ataactctcggggaccaaag

SEQ ID NO: 104357 - DNA, 20 bp, synthetic construct
  misc_feature 1..20: note = CRISPR gRNA sequence
  source 1..20: mol_type = other DNA
tctcggggaccaaaggagac

SEQ ID NO: 104358 - DNA, 20 bp, synthetic construct
  misc_feature 1..20: note = CRISPR gRNA sequence
  source 1..20: mol_type = other DNA
ggaccaaaggagaccagtgt

SEQ ID NO: 104359 - DNA, 20 bp, synthetic construct
  misc_feature 1..20: note = CRISPR gRNA sequence
  source 1..20: mol_type = other DNA
ccaaaggagaccagtgtcag

SEQ ID NO: 104360 - DNA, 20 bp, synthetic construct
  misc_feature 1..20: note = CRISPR gRNA sequence
  source 1..20: mol_type = other DNA
aaaggagaccagtgtcagta

SEQ ID NO: 104361 - DNA, 20 bp, synthetic construct
  misc_feature 1..20: note = CRISPR gRNA sequence
  source 1..20: mol_type = other DNA
tttttttatgttcttttctg

SEQ ID NO: 104362 - DNA, 20 bp, synthetic construct
  misc_feature 1..20: note = CRISPR gRNA sequence
  source 1..20: mol_type = other DNA
tatgttcttttctgcagata

SEQ ID NO: 104363 - DNA, 20 bp, synthetic construct
  misc_feature 1..20: note = CRISPR gRNA sequence
  source 1..20: mol_type = other DNA
ttcttttctgcagatacagt

SEQ ID NO: 104364 - DNA, 20 bp, synthetic construct
  misc_feature 1..20: note = CRISPR gRNA sequence
  source 1..20: mol_type = other DNA
cagatacagttggtcccacc

SEQ ID NO: 104365 - DNA, 20 bp, synthetic construct
  misc_feature 1..20: note = CRISPR gRNA sequence
  source 1..20: mol_type = other DNA
tacagttggtcccacctgga

SEQ ID NO: 104366 - DNA, 20 bp, synthetic construct
  misc_feature 1..20: note = CRISPR gRNA sequence
  source 1..20: mol_type = other DNA
tggtcccacctggacagatc

SEQ ID NO: 104367 - DNA, 20 bp, synthetic construct
  misc_feature 1..20: note = CRISPR gRNA sequence
  source 1..20: mol_type = other DNA
cacctggacagatccagatc

SEQ ID NO: 104368 - DNA, 20 bp, synthetic construct
  misc_feature 1..20: note = CRISPR gRNA sequence
  source 1..20: mol_type = other DNA
acctggacagatccagatcc

SEQ ID NO: 104369 - DNA, 20 bp, synthetic construct
  misc_feature 1..20: note = CRISPR gRNA sequence
  source 1..20: mol_type = other DNA
cctggacagatccagatcca

SEQ ID NO: 104370 - DNA, 20 bp, synthetic construct
  misc_feature 1..20: note = CRISPR gRNA sequence
  source 1..20: mol_type = other DNA
ggacagatccagatccaggg

SEQ ID NO: 104371 - DNA, 20 bp, synthetic construct
  misc_feature 1..20: note = CRISPR gRNA sequence
  source 1..20: mol_type = other DNA
agatccagatccagggtgga

SEQ ID NO: 104372 - DNA, 20 bp, synthetic construct
  misc_feature 1..20: note = CRISPR gRNA sequence
  source 1..20: mol_type = other DNA
gatccagatccagggtggac

SEQ ID NO: 104373 - DNA, 20 bp, synthetic construct
  misc_feature 1..20: note = CRISPR gRNA sequence
  source 1..20: mol_type = other DNA
tccagggtggacaggctgtg

SEQ ID NO: 104374 - DNA, 20 bp, synthetic construct
  misc_feature 1..20: note = CRISPR gRNA sequence
  source 1..20: mol_type = other DNA
ccagggtggacaggctgtgc

SEQ ID NO: 104375 - DNA, 20 bp, synthetic construct
  misc_feature 1..20: note = CRISPR gRNA sequence
  source 1..20: mol_type = other DNA
gtggacaggctgtgcaggtg

SEQ ID NO: 104376 - DNA, 20 bp, synthetic construct
  misc_feature 1..20: note = CRISPR gRNA sequence
  source 1..20: mol_type = other DNA
tggacaggctgtgcaggtgc

SEQ ID NO: 104377 - DNA, 20 bp, synthetic construct
  misc_feature 1..20: note = CRISPR gRNA sequence
  source 1..20: mol_type = other DNA
ggacaggctgtgcaggtgca

SEQ ID NO: 104378 - DNA, 20 bp, synthetic construct
  misc_feature 1..20: note = CRISPR gRNA sequence
  source 1..20: mol_type = other DNA
aggctgtgcaggtgcagggc

SEQ ID NO: 104379 - DNA, 20 bp, synthetic construct
  misc_feature 1..20: note = CRISPR gRNA sequence
  source 1..20: mol_type = other DNA
ctgtgcaggtgcagggccag

SEQ ID NO: 104380 - DNA, 20 bp, synthetic construct
  misc_feature 1..20: note = CRISPR gRNA sequence
  source 1..20: mol_type = other DNA
tgtgcaggtgcagggccagc

SEQ ID NO: 104381 - DNA, 20 bp, synthetic construct
  misc_feature 1..20: note = CRISPR gRNA sequence
  source 1..20: mol_type = other DNA
gtgcaggtgcagggccagca

SEQ ID NO: 104382 - DNA, 20 bp, synthetic construct
  misc_feature 1..20: note = CRISPR gRNA sequence
  source 1..20: mol_type = other DNA
aggtgcagggccagcagggc

SEQ ID NO: 104383 - DNA, 20 bp, synthetic construct
  misc_feature 1..20: note = CRISPR gRNA sequence
  source 1..20: mol_type = other DNA
agggccagcagggccagacc

SEQ ID NO: 104384 - DNA, 20 bp, synthetic construct
  misc_feature 1..20: note = CRISPR gRNA sequence
  source 1..20: mol_type = other DNA
gccagcagggccagacccag

SEQ ID NO: 104385 - DNA, 20 bp, synthetic construct
  misc_feature 1..20: note = CRISPR gRNA sequence
  source 1..20: mol_type = other DNA
agacccagcagatcatcatc

SEQ ID NO: 104386 - DNA, 20 bp, synthetic construct
  misc_feature 1..20: note = CRISPR gRNA sequence
  source 1..20: mol_type = other DNA
cccagcagatcatcatccag

SEQ ID NO: 104387 - DNA, 20 bp, synthetic construct
  misc_feature 1..20: note = CRISPR gRNA sequence
  source 1..20: mol_type = other DNA
agatcatcatccagcagccc

SEQ ID NO: 104388 - DNA, 20 bp, synthetic construct
  misc_feature 1..20: note = CRISPR gRNA sequence
  source 1..20: mol_type = other DNA
catcatccagcagccccaga

SEQ ID NO: 104389 - DNA, 20 bp, synthetic construct
  misc_feature 1..20: note = CRISPR gRNA sequence
  source 1..20: mol_type = other DNA
ccccagacggctgtcactgc

SEQ ID NO: 104390 - DNA, 20 bp, synthetic construct
  misc_feature 1..20: note = CRISPR gRNA sequence
  source 1..20: mol_type = other DNA
agacggctgtcactgctggc

SEQ ID NO: 104391 - DNA, 20 bp, synthetic construct
  misc_feature 1..20: note = CRISPR gRNA sequence
  source 1..20: mol_type = other DNA
ctgtcactgctggccagact

SEQ ID NO: 104392 - DNA, 20 bp, synthetic construct
  misc_feature 1..20: note = CRISPR gRNA sequence
  source 1..20: mol_type = other DNA
tgtcactgctggccagactc

SEQ ID NO: 104393 - DNA, 20 bp, synthetic construct
  misc_feature 1..20: note = CRISPR gRNA sequence
  source 1..20: mol_type = other DNA
ccagactcaggtaattccac

SEQ ID NO: 104394 - DNA, 20 bp, synthetic construct
  misc_feature 1..20: note = CRISPR gRNA sequence
  source 1..20: mol_type = other DNA
attccactagctctgtcaca

SEQ ID NO: 104395 - DNA, 20 bp, synthetic construct
  misc_feature 1..20: note = CRISPR gRNA sequence
  source 1..20: mol_type = other DNA
ttccactagctctgtcacac

SEQ ID NO: 104396 - DNA, 20 bp, synthetic construct
  misc_feature 1..20: note = CRISPR gRNA sequence
  source 1..20: mol_type = other DNA
ccactagctctgtcacacag

SEQ ID NO: 104397 - DNA, 20 bp, synthetic construct
  misc_feature 1..20: note = CRISPR gRNA sequence
  source 1..20: mol_type = other DNA
acacaggagcaaaactgatt

SEQ ID NO: 104398 - DNA, 20 bp, synthetic construct
  misc_feature 1..20: note = CRISPR gRNA sequence
  source 1..20: mol_type = other DNA
caggagcaaaactgatttgg

SEQ ID NO: 104399 - DNA, 20 bp, synthetic construct
  misc_feature 1..20: note = CRISPR gRNA sequence
  source 1..20: mol_type = other DNA
ggagcaaaactgatttggaa

SEQ ID NO: 104400 - DNA, 20 bp, synthetic construct
  misc_feature 1..20: note = CRISPR gRNA sequence
  source 1..20: mol_type = other DNA
caaaactgatttggaagagt

SEQ ID NO: 104401 - DNA, 20 bp, synthetic construct
  misc_feature 1..20: note = CRISPR gRNA sequence
  source 1..20: mol_type = other DNA
tttggaagagtcagataact

SEQ ID NO: 104402 - DNA, 20 bp, synthetic construct
  misc_feature 1..20: note = CRISPR gRNA sequence
  source 1..20: mol_type = other DNA
gaagagtcagataactgagt

SEQ ID NO: 104403 - DNA, 20 bp, synthetic construct
  misc_feature 1..20: note = CRISPR gRNA sequence
  source 1..20: mol_type = other DNA
tgagtcagatatttcatgta

SEQ ID NO: 104404 - DNA, 20 bp, synthetic construct
  misc_feature 1..20: note = CRISPR gRNA sequence
  source 1..20: mol_type = other DNA
tatttcatgtatagcatgta

SEQ ID NO: 104405 - DNA, 20 bp, synthetic construct
  misc_feature 1..20: note = CRISPR gRNA sequence
  source 1..20: mol_type = other DNA
ttcatgtatagcatgtatag

SEQ ID NO: 104406 - DNA, 20 bp, synthetic construct
  misc_feature 1..20: note = CRISPR gRNA sequence
  source 1..20: mol_type = other DNA
gtatagcatgtatagtagaa

SEQ ID NO: 104407 - DNA, 20 bp, synthetic construct
  misc_feature 1..20: note = CRISPR gRNA sequence
  source 1..20: mol_type = other DNA
tatagcatgtatagtagaaa

SEQ ID NO: 104408 - DNA, 20 bp, synthetic construct
  misc_feature 1..20: note = CRISPR gRNA sequence
  source 1..20: mol_type = other DNA
atagcatgtatagtagaaaa

SEQ ID NO: 104409 - DNA, 20 bp, synthetic construct
  misc_feature 1..20: note = CRISPR gRNA sequence
  source 1..20: mol_type = other DNA
tagcatgtatagtagaaaag

SEQ ID NO: 104410 - DNA, 20 bp, synthetic construct
  misc_feature 1..20: note = CRISPR gRNA sequence
  source 1..20: mol_type = other DNA
accataaaaaaatatatttt

SEQ ID NO: 104411 - DNA, 20 bp, synthetic construct
  misc_feature 1..20: note = CRISPR gRNA sequence
  source 1..20: mol_type = other DNA
taaaaaaatatatttttggc

SEQ ID NO: 104412 - DNA, 20 bp, synthetic construct
  misc_feature 1..20: note = CRISPR gRNA sequence
  source 1..20: mol_type = other DNA
aaaaaaatatatttttggcc

SEQ ID NO: 104413 - DNA, 20 bp, synthetic construct
  misc_feature 1..20: note = CRISPR gRNA sequence
  source 1..20: mol_type = other DNA
aatatatttttggccgggcg

SEQ ID NO: 104414 - DNA, 20 bp, synthetic construct
  misc_feature 1..20: note = CRISPR gRNA sequence
  source 1..20: mol_type = other DNA
atatttttggccgggcgcgg

SEQ ID NO: 104415 - DNA, 20 bp, synthetic construct
  misc_feature 1..20: note = CRISPR gRNA sequence
  source 1..20: mol_type = other DNA
gtggctcatgcctgtaatcc

SEQ ID NO: 104416 - DNA, 20 bp, synthetic construct
  misc_feature 1..20: note = CRISPR gRNA sequence
  source 1..20: mol_type = other DNA
gcctgtaatcccagcacttt

SEQ ID NO: 104417 - DNA, 20 bp, synthetic construct
  misc_feature 1..20: note = CRISPR gRNA sequence
  source 1..20: mol_type = other DNA
ctgtaatcccagcactttga

SEQ ID NO: 104418 - DNA, 20 bp, synthetic construct
  misc_feature 1..20: note = CRISPR gRNA sequence
  source 1..20: mol_type = other DNA
tgtaatcccagcactttgag

SEQ ID NO: 104419 - DNA, 20 bp, synthetic construct
  misc_feature 1..20: note = CRISPR gRNA sequence
  source 1..20: mol_type = other DNA
tcccagcactttgagaggcc

SEQ ID NO: 104420 - DNA, 20 bp, synthetic construct
  misc_feature 1..20: note = CRISPR gRNA sequence
  source 1..20: mol_type = other DNA
cccagcactttgagaggccg

SEQ ID NO: 104421 - DNA, 20 bp, synthetic construct
  misc_feature 1..20: note = CRISPR gRNA sequence
  source 1..20: mol_type = other DNA
gcactttgagaggccgaggc

SEQ ID NO: 104422 - DNA, 20 bp, synthetic construct
  misc_feature 1..20: note = CRISPR gRNA sequence
  source 1..20: mol_type = other DNA
ggccgaggcaagctgatcac

SEQ ID NO: 104423 - DNA, 20 bp, synthetic construct
  misc_feature 1..20: note = CRISPR gRNA sequence
  source 1..20: mol_type = other DNA
gccgaggcaagctgatcaca

SEQ ID NO: 104424 - DNA, 20 bp, synthetic construct
  misc_feature 1..20: note = CRISPR gRNA sequence
  source 1..20: mol_type = other DNA
ggcaagctgatcacaaggtc

SEQ ID NO: 104425 - DNA, 20 bp, synthetic construct
  misc_feature 1..20: note = CRISPR gRNA sequence
  source 1..20: mol_type = other DNA
caagctgatcacaaggtcaa

SEQ ID NO: 104426 - DNA, 20 bp, synthetic construct
  misc_feature 1..20: note = CRISPR gRNA sequence
  source 1..20: mol_type = other DNA
gatcacaaggtcaagagatc

SEQ ID NO: 104427 - DNA, 20 bp, synthetic construct
  misc_feature 1..20: note = CRISPR gRNA sequence
  source 1..20: mol_type = other DNA
tcaagagatcaagaacatcc

SEQ ID NO: 104428 - DNA, 20 bp, synthetic construct
  misc_feature 1..20: note = CRISPR gRNA sequence
  source 1..20: mol_type = other DNA
caagaacatcctggccaaca

SEQ ID NO: 104429 - DNA, 20 bp, synthetic construct
  misc_feature 1..20: note = CRISPR gRNA sequence
  source 1..20: mol_type = other DNA
acatcctggccaacatggtg

SEQ ID NO: 104430 - DNA, 20 bp, synthetic construct
  misc_feature 1..20: note = CRISPR gRNA sequence
  source 1..20: mol_type = other DNA
ccccgtcaaaatacaaaaat

SEQ ID NO: 104431 - DNA, 20 bp, synthetic construct
  misc_feature 1..20: note = CRISPR gRNA sequence
  source 1..20: mol_type = other DNA
cccgtcaaaatacaaaaatt

SEQ ID NO: 104432 - DNA, 20 bp, synthetic construct
  misc_feature 1..20: note = CRISPR gRNA sequence
  source 1..20: mol_type = other DNA
gtcaaaatacaaaaattagg

SEQ ID NO: 104433 - DNA, 20 bp, synthetic construct
  misc_feature 1..20: note = CRISPR gRNA sequence
  source 1..20: mol_type = other DNA
tcaaaatacaaaaattaggt

SEQ ID NO: 104434 - DNA, 20 bp, synthetic construct
  misc_feature 1..20: note = CRISPR gRNA sequence
  source 1..20: mol_type = other DNA
atacaaaaattaggtgggca

SEQ ID NO: 104435 - DNA, 20 bp, synthetic construct
  misc_feature 1..20: note = CRISPR gRNA sequence
  source 1..20: mol_type = other DNA
caaaaattaggtgggcatgg

SEQ ID NO: 104436 - DNA, 20 bp, synthetic construct
  misc_feature 1..20: note = CRISPR gRNA sequence
  source 1..20: mol_type = other DNA
gtggcgcatgcctgtaatcc

SEQ ID NO: 104437 - DNA, 20 bp, synthetic construct
  misc_feature 1..20: note = CRISPR gRNA sequence
  source 1..20: mol_type = other DNA
tgcctgtaatcccagctact

SEQ ID NO: 104438 - DNA, 20 bp, synthetic construct
  misc_feature 1..20: note = CRISPR gRNA sequence
  source 1..20: mol_type = other DNA
gcctgtaatcccagctactc

SEQ ID NO: 104439 - DNA, 20 bp, synthetic construct
  misc_feature 1..20: note = CRISPR gRNA sequence
  source 1..20: mol_type = other DNA
ctgtaatcccagctactcgg

SEQ ID NO: 104440 - DNA, 20 bp, synthetic construct
  misc_feature 1..20: note = CRISPR gRNA sequence
  source 1..20: mol_type = other DNA
tgtaatcccagctactcggg

SEQ ID NO: 104441 - DNA, 20 bp, synthetic construct
  misc_feature 1..20: note = CRISPR gRNA sequence
  source 1..20: mol_type = other DNA
tcccagctactcgggaggct

SEQ ID NO: 104442 - DNA, 20 bp, synthetic construct
  misc_feature 1..20: note = CRISPR gRNA sequence
  source 1..20: mol_type = other DNA
cccagctactcgggaggctg

SEQ ID NO: 104443 - DNA, 20 bp, synthetic construct
  misc_feature 1..20: note = CRISPR gRNA sequence
  source 1..20: mol_type = other DNA
agctactcgggaggctgagg

SEQ ID NO: 104444 - DNA, 20 bp, synthetic construct
  misc_feature 1..20: note = CRISPR gRNA sequence
  source 1..20: mol_type = other DNA
ctactcgggaggctgaggca

SEQ ID NO: 104445 - DNA, 20 bp, synthetic construct
  misc_feature 1..20: note = CRISPR gRNA sequence
  source 1..20: mol_type = other DNA
ggcagagaatcgcttgaacc

SEQ ID NO: 104446 - DNA, 20 bp, synthetic construct
  misc_feature 1..20: note = CRISPR gRNA sequence
  source 1..20: mol_type = other DNA
gcagagaatcgcttgaaccc

SEQ ID NO: 104447 - DNA, 20 bp, synthetic construct
  misc_feature 1..20: note = CRISPR gRNA sequence
  source 1..20: mol_type = other DNA
agagaatcgcttgaacccag

SEQ ID NO: 104448 - DNA, 20 bp, synthetic construct
  misc_feature 1..20: note = CRISPR gRNA sequence
  source 1..20: mol_type = other DNA
gagaatcgcttgaacccagg

SEQ ID NO: 104449 - DNA, 20 bp, synthetic construct
  misc_feature 1..20: note = CRISPR gRNA sequence
  source 1..20: mol_type = other DNA
aatcgcttgaacccaggagg

SEQ ID NO: 104450 - DNA, 20 bp, synthetic construct
  misc_feature 1..20: note = CRISPR gRNA sequence
  source 1..20: mol_type = other DNA
tcgcttgaacccaggaggcg

SEQ ID NO: 104451 - DNA, 20 bp, synthetic construct
  misc_feature 1..20: note = CRISPR gRNA sequence
  source 1..20: mol_type = other DNA
cgcttgaacccaggaggcgg

SEQ ID NO: 104452 - DNA, 20 bp, synthetic construct
  misc_feature 1..20: note = CRISPR gRNA sequence
  source 1..20: mol_type = other DNA
aacccaggaggcggaggttg

SEQ ID NO: 104453 - DNA, 20 bp, synthetic construct
  misc_feature 1..20: note = CRISPR gRNA sequence
  source 1..20: mol_type = other DNA
caggaggcggaggttgcagt

SEQ ID NO: 104454 - DNA, 20 bp, synthetic construct
  misc_feature 1..20: note = CRISPR gRNA sequence
  source 1..20: mol_type = other DNA
ggcggaggttgcagtgagct

SEQ ID NO: 104455 - DNA, 20 bp, synthetic construct
  misc_feature 1..20: note = CRISPR gRNA sequence
  source 1..20: mol_type = other DNA
tgcgccactgcactgcactc

SEQ ID NO: 104456 - DNA, 20 bp, synthetic construct
  misc_feature 1..20: note = CRISPR gRNA sequence
  source 1..20: mol_type = other DNA
cactgcactgcactccagcc

SEQ ID NO: 104457 - DNA, 20 bp, synthetic construct
  misc_feature 1..20: note = CRISPR gRNA sequence
  source 1..20: mol_type = other DNA
actgcactccagcctggcga

SEQ ID NO: 104458 - DNA, 20 bp, synthetic construct
  misc_feature 1..20: note = CRISPR gRNA sequence
  source 1..20: mol_type = other DNA
tgcactccagcctggcgaca

SEQ ID NO: 104459 - DNA, 20 bp, synthetic construct
  misc_feature 1..20: note = CRISPR gRNA sequence
  source 1..20: mol_type = other DNA
ctccagcctggcgacagagt

SEQ ID NO: 104460 - DNA, 20 bp, synthetic construct
  misc_feature 1..20: note = CRISPR gRNA sequence
  source 1..20: mol_type = other DNA
aaaaaataattttttttttt

SEQ ID NO: 104461 - DNA, 20 bp, synthetic construct
  misc_feature 1..20: note = CRISPR gRNA sequence
  source 1..20: mol_type = other DNA
aaaaataattttttttttta

SEQ ID NO: 104462 - DNA, 20 bp, synthetic construct
  misc_feature 1..20: note = CRISPR gRNA sequence
  source 1..20: mol_type = other DNA
aggactacatcgttctttgt

SEQ ID NO: 104463 - DNA, 20 bp, synthetic construct
  misc_feature 1..20: note = CRISPR gRNA sequence
  source 1..20: mol_type = other DNA
tcgttctttgttagtatctt

SEQ ID NO: 104464 - DNA, 20 bp, synthetic construct
  misc_feature 1..20: note = CRISPR gRNA sequence
  source 1..20: mol_type = other DNA
cgttctttgttagtatcttt

SEQ ID NO: 104465 - DNA, 20 bp, synthetic construct
  misc_feature 1..20: note = CRISPR gRNA sequence
  source 1..20: mol_type = other DNA
gtgtcattacttatttcctc

SEQ ID NO: 104466 - DNA, 20 bp, synthetic construct
  misc_feature 1..20: note = CRISPR gRNA sequence
  source 1..20: mol_type = other DNA
ttacttatttcctccagaca

SEQ ID NO: 104467 - DNA, 20 bp, synthetic construct
  misc_feature 1..20: note = CRISPR gRNA sequence
  source 1..20: mol_type = other DNA
cttatttcctccagacacag

SEQ ID NO: 104468 - DNA, 20 bp, synthetic construct
  misc_feature 1..20: note = CRISPR gRNA sequence
  source 1..20: mol_type = other DNA
atttcctccagacacagcag

SEQ ID NO: 104469 - DNA, 20 bp, synthetic construct
  misc_feature 1..20: note = CRISPR gRNA sequence
  source 1..20: mol_type = other DNA
cacagcagcagattgctgtc

SEQ ID NO: 104470 - DNA, 20 bp, synthetic construct
  misc_feature 1..20: note = CRISPR gRNA sequence
  source 1..20: mol_type = other DNA
acagcagcagattgctgtcc

SEQ ID NO: 104471 - DNA, 20 bp, synthetic construct
  misc_feature 1..20: note = CRISPR gRNA sequence
  source 1..20: mol_type = other DNA
cagcagcagattgctgtcca

SEQ ID NO: 104472 - DNA, 20 bp, synthetic construct
  misc_feature 1..20: note = CRISPR gRNA sequence
  source 1..20: mol_type = other DNA
agcagattgctgtccaggga

SEQ ID NO: 104473 - DNA, 20 bp, synthetic construct
  misc_feature 1..20: note = CRISPR gRNA sequence
  source 1..20: mol_type = other DNA
gattgctgtccagggacagc

SEQ ID NO: 104474 - DNA, 20 bp, synthetic construct
  misc_feature 1..20: note = CRISPR gRNA sequence
  source 1..20: mol_type = other DNA
tgctgtccagggacagcaag

SEQ ID NO: 104475 - DNA, 20 bp, synthetic construct
  misc_feature 1..20: note = CRISPR gRNA sequence
  source 1..20: mol_type = other DNA
tccagggacagcaagtggca

SEQ ID NO: 104476 - DNA, 20 bp, synthetic construct
  misc_feature 1..20: note = CRISPR gRNA sequence
  source 1..20: mol_type = other DNA
gcaagtggcacagactgctg

SEQ ID NO: 104477 - DNA, 20 bp, synthetic construct
  misc_feature 1..20: note = CRISPR gRNA sequence
  source 1..20: mol_type = other DNA
caagtggcacagactgctga

SEQ ID NO: 104478 - DNA, 20 bp, synthetic construct
  misc_feature 1..20: note = CRISPR gRNA sequence
  source 1..20: mol_type = other DNA
aagtggcacagactgctgaa

SEQ ID NO: 104479 - DNA, 20 bp, synthetic construct
  misc_feature 1..20: note = CRISPR gRNA sequence
  source 1..20: mol_type = other DNA
tggcacagactgctgaaggg

SEQ ID NO: 104480 - DNA, 20 bp, synthetic construct
  misc_feature 1..20: note = CRISPR gRNA sequence
  source 1..20: mol_type = other DNA
gcagaccatcgtctatcaac

SEQ ID NO: 104481 - DNA, 20 bp, synthetic construct
  misc_feature 1..20: note = CRISPR gRNA sequence
  source 1..20: mol_type = other DNA
cgtctatcaaccagttaatg

SEQ ID NO: 104482 - DNA, 20 bp, synthetic construct
  misc_feature 1..20: note = CRISPR gRNA sequence
  source 1..20: mol_type = other DNA
tatcaaccagttaatgcaga

SEQ ID NO: 104483 - DNA, 20 bp, synthetic construct
  misc_feature 1..20: note = CRISPR gRNA sequence
  source 1..20: mol_type = other DNA
atgcagatggcaccattctc

SEQ ID NO: 104484 - DNA, 20 bp, synthetic construct
  misc_feature 1..20: note = CRISPR gRNA sequence
  source 1..20: mol_type = other DNA
agatggcaccattctccagc

SEQ ID NO: 104485 - DNA, 20 bp, synthetic construct
  misc_feature 1..20: note = CRISPR gRNA sequence
  source 1..20: mol_type = other DNA
gatggcaccattctccagca

SEQ ID NO: 104486 - DNA, 20 bp, synthetic construct
  misc_feature 1..20: note = CRISPR gRNA sequence
  source 1..20: mol_type = other DNA
gcaccattctccagcaaggt

SEQ ID NO: 104487 - DNA, 20 bp, synthetic construct
  misc_feature 1..20: note = CRISPR gRNA sequence
  source 1..20: mol_type = other DNA
agcaaggtaagtgtacccat

SEQ ID NO: 104488 - DNA, 20 bp, synthetic construct
  misc_feature 1..20: note = CRISPR gRNA sequence
  source 1..20: mol_type = other DNA
agtgtacccataagcttccc

SEQ ID NO: 104489 - DNA, 20 bp, synthetic construct
  misc_feature 1..20: note = CRISPR gRNA sequence
  source 1..20: mol_type = other DNA
gtgtacccataagcttccct

SEQ ID NO: 104490 - DNA, 20 bp, synthetic construct
  misc_feature 1..20: note = CRISPR gRNA sequence
  source 1..20: mol_type = other DNA
taagcttccctaggactttt

SEQ ID NO: 104491 - DNA, 20 bp, synthetic construct
  misc_feature 1..20: note = CRISPR gRNA sequence
  source 1..20: mol_type = other DNA
aagcttccctaggacttttt

SEQ ID NO: 104492 - DNA, 20 bp, synthetic construct
  misc_feature 1..20: note = CRISPR gRNA sequence
  source 1..20: mol_type = other DNA
agcttccctaggactttttg

SEQ ID NO: 104493 - DNA, 20 bp, synthetic construct
  misc_feature 1..20: note = CRISPR gRNA sequence
  source 1..20: mol_type = other DNA
ggggcaacttttttgtccct

SEQ ID NO: 104494 - DNA, 20 bp, synthetic construct
  misc_feature 1..20: note = CRISPR gRNA sequence
  source 1..20: mol_type = other DNA
ccttagacaactgacatctt

SEQ ID NO: 104495 - DNA, 20 bp, synthetic construct
  misc_feature 1..20: note = CRISPR gRNA sequence
  source 1..20: mol_type = other DNA
aactgacatctttagaattt

SEQ ID NO: 104496 - DNA, 20 bp, synthetic construct
  misc_feature 1..20: note = CRISPR gRNA sequence
  source 1..20: mol_type = other DNA
tgacatctttagaatttgag

SEQ ID NO: 104497 - DNA, 20 bp, synthetic construct
  misc_feature 1..20: note = CRISPR gRNA sequence
  source 1..20: mol_type = other DNA
acttgacactacatattttt

SEQ ID NO: 104498 - DNA, 20 bp, synthetic construct
  misc_feature 1..20: note = CRISPR gRNA sequence
  source 1..20: mol_type = other DNA
ttttttggacaaaaaaaaaa

SEQ ID NO: 104499 - DNA, 20 bp, synthetic construct
  misc_feature 1..20: note = CRISPR gRNA sequence
  source 1..20: mol_type = other DNA
aaaaaaaaaaagatttcctc

SEQ ID NO: 104500 - DNA, 20 bp, synthetic construct
  misc_feature 1..20: note = CRISPR gRNA sequence
  source 1..20: mol_type = other DNA
tctagctctccattgattgt

SEQ ID NO: 104501 - DNA, 20 bp, synthetic construct
  misc_feature 1..20: note = CRISPR gRNA sequence
  source 1..20: mol_type = other DNA
ttgtcaccatctgtgaccaa

SEQ ID NO: 104502 - DNA, 20 bp, synthetic construct
  misc_feature 1..20: note = CRISPR gRNA sequence
  source 1..20: mol_type = other DNA
accaacagtgattccatgtg

SEQ ID NO: 104503 - DNA, 20 bp, synthetic construct
  misc_feature 1..20: note = CRISPR gRNA sequence
  source 1..20: mol_type = other DNA
aacagtgattccatgtgtag

SEQ ID NO: 104504 - DNA, 20 bp, synthetic construct
  misc_feature 1..20: note = CRISPR gRNA sequence
  source 1..20: mol_type = other DNA
tccatgtgtagcagtttcta

SEQ ID NO: 104505 - DNA, 20 bp, synthetic construct
  misc_feature 1..20: note = CRISPR gRNA sequence
  source 1..20: mol_type = other DNA
atgtgtagcagtttctatag

SEQ ID NO: 104506 - DNA, 20 bp, synthetic construct
  misc_feature 1..20: note = CRISPR gRNA sequence
  source 1..20: mol_type = other DNA
ttctatagtggttgctaatc

SEQ ID NO: 104507 - DNA, 20 bp, synthetic construct
  misc_feature 1..20: note = CRISPR gRNA sequence
  source 1..20: mol_type = other DNA
tctatagtggttgctaatct

SEQ ID NO: 104508 - DNA, 20 bp, synthetic construct
  misc_feature 1..20: note = CRISPR gRNA sequence
  source 1..20: mol_type = other DNA
ctatagtggttgctaatcta

SEQ ID NO: 104509 - DNA, 20 bp, synthetic construct
  misc_feature 1..20: note = CRISPR gRNA sequence
  source 1..20: mol_type = other DNA
tgctaatctagggattgtgt

SEQ ID NO: 104510 - DNA, 20 bp, synthetic construct
  misc_feature 1..20: note = CRISPR gRNA sequence
  source 1..20: mol_type = other DNA
ctagggattgtgtaagcttt

SEQ ID NO: 104511 - DNA, 20 bp, synthetic construct
  misc_feature 1..20: note = CRISPR gRNA sequence
  source 1..20: mol_type = other DNA
tagggattgtgtaagctttt

SEQ ID NO: 104512 - DNA, 20 bp, synthetic construct
  misc_feature 1..20: note = CRISPR gRNA sequence
  source 1..20: mol_type = other DNA
agggattgtgtaagctttta

SEQ ID NO: 104513 - DNA, 20 bp, synthetic construct
  misc_feature 1..20: note = CRISPR gRNA sequence
  source 1..20: mol_type = other DNA
gattgtgtaagcttttaggg

SEQ ID NO: 104514 - DNA, 20 bp, synthetic construct
  misc_feature 1..20: note = CRISPR gRNA sequence
  source 1..20: mol_type = other DNA
tgtgtaagcttttagggaag

SEQ ID NO: 104515 - DNA, 20 bp, synthetic construct
  misc_feature 1..20: note = CRISPR gRNA sequence
  source 1..20: mol_type = other DNA
agggaagaagtgtttctaaa

SEQ ID NO: 104516 - DNA, 20 bp, synthetic construct
  misc_feature 1..20: note = CRISPR gRNA sequence
  source 1..20: mol_type = other DNA
gaagaagtgtttctaaacag

SEQ ID NO: 104517 - DNA, 20 bp, synthetic construct
  misc_feature 1..20: note = CRISPR gRNA sequence
  source 1..20: mol_type = other DNA
agtgtttctaaacagaagaa

SEQ ID NO: 104518 - DNA, 20 bp, synthetic construct
  misc_feature 1..20: note = CRISPR gRNA sequence
  source 1..20: mol_type = other DNA
tctaaacagaagaatagaaa

SEQ ID NO: 104519 - DNA, 20 bp, synthetic construct
  misc_feature 1..20: note = CRISPR gRNA sequence
  source 1..20: mol_type = other DNA
ctaaacagaagaatagaaat

SEQ ID NO: 104520 - DNA, 20 bp, synthetic construct
  misc_feature 1..20: note = CRISPR gRNA sequence
  source 1..20: mol_type = other DNA
taaacagaagaatagaaata

SEQ ID NO: 104521 - DNA, 20 bp, synthetic construct
  misc_feature 1..20: note = CRISPR gRNA sequence
  source 1..20: mol_type = other DNA
aacagaagaatagaaatagg

SEQ ID NO: 104522 - DNA, 20 bp, synthetic construct
  misc_feature 1..20: note = CRISPR gRNA sequence
  source 1..20: mol_type = other DNA
aatagaaatagggagttcat

SEQ ID NO: 104523 - DNA, 20 bp, synthetic construct
  misc_feature 1..20: note = CRISPR gRNA sequence
  source 1..20: mol_type = other DNA
aaatagggagttcattggta

SEQ ID NO: 104524 - DNA, 20 bp, synthetic construct
  misc_feature 1..20: note = CRISPR gRNA sequence
  source 1..20: mol_type = other DNA
atagggagttcattggtaaa

SEQ ID NO: 104525 - DNA, 20 bp, synthetic construct
  misc_feature 1..20: note = CRISPR gRNA sequence
  source 1..20: mol_type = other DNA
agggagttcattggtaaaga

SEQ ID NO: 104526 - DNA, 20 bp, synthetic construct
  misc_feature 1..20: note = CRISPR gRNA sequence
  source 1..20: mol_type = other DNA
ttcattggtaaagagagaaa

SEQ ID NO: 104527 - DNA, 20 bp, synthetic construct
  misc_feature 1..20: note = CRISPR gRNA sequence
  source 1..20: mol_type = other DNA
agagaaatagatcaaaaatc

SEQ ID NO: 104528 - DNA, 20 bp, synthetic construct
  misc_feature 1..20: note = CRISPR gRNA sequence
  source 1..20: mol_type = other DNA
aaatagatcaaaaatcaagt

SEQ ID NO: 104529 - DNA, 20 bp, synthetic construct
  misc_feature 1..20: note = CRISPR gRNA sequence
  source 1..20: mol_type = other DNA
atcaaaaatcaagttggctt

SEQ ID NO: 104530 - DNA, 20 bp, synthetic construct
  misc_feature 1..20: note = CRISPR gRNA sequence
  source 1..20: mol_type = other DNA
caaaaatcaagttggcttta

SEQ ID NO: 104531 - DNA, 20 bp, synthetic construct
  misc_feature 1..20: note = CRISPR gRNA sequence
  source 1..20: mol_type = other DNA
ttgctgcttatgtttttttc

SEQ ID NO: 104532 - DNA, 20 bp, synthetic construct
  misc_feature 1..20: note = CRISPR gRNA sequence
  source 1..20: mol_type = other DNA
tgctgcttatgtttttttct

SEQ ID NO: 104533 - DNA, 20 bp, synthetic construct
  misc_feature 1..20: note = CRISPR gRNA sequence
  source 1..20: mol_type = other DNA
ttaaatgactattatgtata

SEQ ID NO: 104534 - DNA, 20 bp, synthetic construct
  misc_feature 1..20: note = CRISPR gRNA sequence
  source 1..20: mol_type = other DNA
atgtatacagcacttttact

SEQ ID NO: 104535 - DNA, 20 bp, synthetic construct
  misc_feature 1..20: note = CRISPR gRNA sequence
  source 1..20: mol_type = other DNA
tatacagcacttttactaag

SEQ ID NO: 104536 - DNA, 20 bp, synthetic construct
  misc_feature 1..20: note = CRISPR gRNA sequence
  source 1..20: mol_type = other DNA
atacagcacttttactaaga

SEQ ID NO: 104537 - DNA, 20 bp, synthetic construct
  misc_feature 1..20: note = CRISPR gRNA sequence
  source 1..20: mol_type = other DNA
tacagcacttttactaagaa

SEQ ID NO: 104538 - DNA, 20 bp, synthetic construct
  misc_feature 1..20: note = CRISPR gRNA sequence
  source 1..20: mol_type = other DNA
tttactaagaagggtcctca

SEQ ID NO: 104539 - DNA, 20 bp, synthetic construct
  misc_feature 1..20: note = CRISPR gRNA sequence
  source 1..20: mol_type = other DNA
tactaagaagggtcctcaaa

SEQ ID NO: 104540 - DNA, 20 bp, synthetic construct
  misc_feature 1..20: note = CRISPR gRNA sequence
  source 1..20: mol_type = other DNA
aagggtcctcaaagagcctc

SEQ ID NO: 104541 - DNA, 20 bp, synthetic construct
  misc_feature 1..20: note = CRISPR gRNA sequence
  source 1..20: mol_type = other DNA
tcctcaaagagcctctagtc

SEQ ID NO: 104542 - DNA, 20 bp, synthetic construct
  misc_feature 1..20: note = CRISPR gRNA sequence
  source 1..20: mol_type = other DNA
caaagagcctctagtctagt

SEQ ID NO: 104543 - DNA, 20 bp, synthetic construct
  misc_feature 1..20: note = CRISPR gRNA sequence
  source 1..20: mol_type = other DNA
gagcctctagtctagtaaga

SEQ ID NO: 104544 - DNA, 20 bp, synthetic construct
  misc_feature 1..20: note = CRISPR gRNA sequence
  source 1..20: mol_type = other DNA
gtgaacaaataaatacaatg

SEQ ID NO: 104545 - DNA, 20 bp, synthetic construct
  misc_feature 1..20: note = CRISPR gRNA sequence
  source 1..20: mol_type = other DNA
tgaacaaataaatacaatgc

SEQ ID NO: 104546 - DNA, 20 bp, synthetic construct
  misc_feature 1..20: note = CRISPR gRNA sequence
  source 1..20: mol_type = other DNA
gaacaaataaatacaatgca

SEQ ID NO: 104547 - DNA, 20 bp, synthetic construct
  misc_feature 1..20: note = CRISPR gRNA sequence
  source 1..20: mol_type = other DNA
aatacaatgcagggccctca

SEQ ID NO: 104548 - DNA, 20 bp, synthetic construct
  misc_feature 1..20: note = CRISPR gRNA sequence
  source 1..20: mol_type = other DNA
acaatgcagggccctcatgg

SEQ ID NO: 104549 - DNA, 20 bp, synthetic construct
  misc_feature 1..20: note = CRISPR gRNA sequence
  source 1..20: mol_type = other DNA
gccctcatggaagtatgttc

SEQ ID NO: 104550 - DNA, 20 bp, synthetic construct
  misc_feature 1..20: note = CRISPR gRNA sequence
  source 1..20: mol_type = other DNA
ccctcatggaagtatgttct

SEQ ID NO: 104551 - DNA, 20 bp, synthetic construct
  misc_feature 1..20: note = CRISPR gRNA sequence
  source 1..20: mol_type = other DNA
atggaagtatgttctaggaa

SEQ ID NO: 104552 - DNA, 20 bp, synthetic construct
  misc_feature 1..20: note = CRISPR gRNA sequence
  source 1..20: mol_type = other DNA
ggaatagataacataaataa

SEQ ID NO: 104553 - DNA, 20 bp, synthetic construct
  misc_feature 1..20: note = CRISPR gRNA sequence
  source 1..20: mol_type = other DNA
taacataaataatagatgtt

SEQ ID NO: 104554 - DNA, 20 bp, synthetic construct
  misc_feature 1..20: note = CRISPR gRNA sequence
  source 1..20: mol_type = other DNA
taaataatagatgtttggtc

SEQ ID NO: 104555 - DNA, 20 bp, synthetic construct
  misc_feature 1..20: note = CRISPR gRNA sequence
  source 1..20: mol_type = other DNA
aaataatagatgtttggtct

SEQ ID NO: 104556 - DNA, 20 bp, synthetic construct
  misc_feature 1..20: note = CRISPR gRNA sequence
  source 1..20: mol_type = other DNA
ataatagatgtttggtctgg

SEQ ID NO: 104557 - DNA, 20 bp, synthetic construct
  misc_feature 1..20: note = CRISPR gRNA sequence
  source 1..20: mol_type = other DNA
taatagatgtttggtctggg

SEQ ID NO: 104558 - DNA, 20 bp, synthetic construct
  misc_feature 1..20: note = CRISPR gRNA sequence
  source 1..20: mol_type = other DNA
atagatgtttggtctgggag

SEQ ID NO: 104559 - DNA, 20 bp, synthetic construct
  misc_feature 1..20: note = CRISPR gRNA sequence
  source 1..20: mol_type = other DNA
tagatgtttggtctgggagg

SEQ ID NO: 104560 - DNA, 20 bp, synthetic construct
  misc_feature 1..20: note = CRISPR gRNA sequence
  source 1..20: mol_type = other DNA
gatgtttggtctgggaggag

SEQ ID NO: 104561 - DNA, 20 bp, synthetic construct
  misc_feature 1..20: note = CRISPR gRNA sequence
  source 1..20: mol_type = other DNA
ttggtctgggaggaggagtg

SEQ ID NO: 104562 - DNA, 20 bp, synthetic construct
  misc_feature 1..20: note = CRISPR gRNA sequence
  source 1..20: mol_type = other DNA
gagtgcagaaactgaacttg

SEQ ID NO: 104563 - DNA, 20 bp, synthetic construct
  misc_feature 1..20: note = CRISPR gRNA sequence
  source 1..20: mol_type = other DNA
agtgcagaaactgaacttga

SEQ ID NO: 104564 - DNA, 20 bp, synthetic construct
  misc_feature 1..20: note = CRISPR gRNA sequence
  source 1..20: mol_type = other DNA
aaactgaacttgaaggcttt

SEQ ID NO: 104565 - DNA, 20 bp, synthetic construct
  misc_feature 1..20: note = CRISPR gRNA sequence
  source 1..20: mol_type = other DNA
ctgaacttgaaggcttttgg

SEQ ID NO: 104566 - DNA, 20 bp, synthetic construct
  misc_feature 1..20: note = CRISPR gRNA sequence
  source 1..20: mol_type = other DNA
aggcttttggaagcacctgt

SEQ ID NO: 104567 - DNA, 20 bp, synthetic construct
  misc_feature 1..20: note = CRISPR gRNA sequence
  source 1..20: mol_type = other DNA
ggaagcacctgttagtcaaa

SEQ ID NO: 104568 - DNA, 20 bp, synthetic construct
  misc_feature 1..20: note = CRISPR gRNA sequence
  source 1..20: mol_type = other DNA
gtcaaatagttaaatcaaaa

SEQ ID NO: 104569 - DNA, 20 bp, synthetic construct
  misc_feature 1..20: note = CRISPR gRNA sequence
  source 1..20: mol_type = other DNA
tcaaatagttaaatcaaaaa

SEQ ID NO: 104570 - DNA, 20 bp, synthetic construct
  misc_feature 1..20: note = CRISPR gRNA sequence
  source 1..20: mol_type = other DNA
tcaaaaaaggacatctttgt

SEQ ID NO: 104571 - DNA, 20 bp, synthetic construct
  misc_feature 1..20: note = CRISPR gRNA sequence
  source 1..20: mol_type = other DNA
gattgcaaatttgcaatata

SEQ ID NO: 104572 - DNA, 20 bp, synthetic construct
  misc_feature 1..20: note = CRISPR gRNA sequence
  source 1..20: mol_type = other DNA
attgcaaatttgcaatatac

SEQ ID NO: 104573 - DNA, 20 bp, synthetic construct
  misc_feature 1..20: note = CRISPR gRNA sequence
  source 1..20: mol_type = other DNA
aatttgcaatatacaggatc

SEQ ID NO: 104574 - DNA, 20 bp, synthetic construct
  misc_feature 1..20: note = CRISPR gRNA sequence
  source 1..20: mol_type = other DNA
tttgcaatatacaggatcca

SEQ ID NO: 104575 - DNA, 20 bp, synthetic construct
  misc_feature 1..20: note = CRISPR gRNA sequence
  source 1..20: mol_type = other DNA
tgcaatatacaggatccaga

SEQ ID NO: 104576 - DNA, 20 bp, synthetic construct
  misc_feature 1..20: note = CRISPR gRNA sequence
  source 1..20: mol_type = other DNA
tgtgtgctcttgtattactc

SEQ ID NO: 104577 - DNA, 20 bp, synthetic construct
  misc_feature 1..20: note = CRISPR gRNA sequence
  source 1..20: mol_type = other DNA
gtgtgctcttgtattactcc

SEQ ID NO: 104578 - DNA, 20 bp, synthetic construct
  misc_feature 1..20: note = CRISPR gRNA sequence
  source 1..20: mol_type = other DNA
tgtgctcttgtattactcca

SEQ ID NO: 104579 - DNA, 20 bp, synthetic construct
  misc_feature 1..20: note = CRISPR gRNA sequence
  source 1..20: mol_type = other DNA
tgctcttgtattactccagg

SEQ ID NO: 104580 - DNA, 20 bp, synthetic construct
  misc_feature 1..20: note = CRISPR gRNA sequence
  source 1..20: mol_type = other DNA
gctcttgtattactccaggg

SEQ ID NO: 104581 - DNA, 20 bp, synthetic construct
  misc_feature 1..20: note = CRISPR gRNA sequence
  source 1..20: mol_type = other DNA
actccagggaggccctgaac

SEQ ID NO: 104582 - DNA, 20 bp, synthetic construct
  misc_feature 1..20: note = CRISPR gRNA sequence
  source 1..20: mol_type = other DNA
gggaggccctgaactggatt

SEQ ID NO: 104583 - DNA, 20 bp, synthetic construct
  misc_feature 1..20: note = CRISPR gRNA sequence
  source 1..20: mol_type = other DNA
gccctgaactggattgagcc

SEQ ID NO: 104584 - DNA, 20 bp, synthetic construct
  misc_feature 1..20: note = CRISPR gRNA sequence
  source 1..20: mol_type = other DNA
ccctgaactggattgagccc

SEQ ID NO: 104585 - DNA, 20 bp, synthetic construct
  misc_feature 1..20: note = CRISPR gRNA sequence
  source 1..20: mol_type = other DNA
gaactggattgagcccaggc

SEQ ID NO: 104586 - DNA, 20 bp, synthetic construct
  misc_feature 1..20: note = CRISPR gRNA sequence
  source 1..20: mol_type = other DNA
actggattgagcccaggcaa

SEQ ID NO: 104587 - DNA, 20 bp, synthetic construct
  misc_feature 1..20: note = CRISPR gRNA sequence
  source 1..20: mol_type = other DNA
agcccaggcaagagctcaaa

SEQ ID NO: 104588 - DNA, 20 bp, synthetic construct
  misc_feature 1..20: note = CRISPR gRNA sequence
  source 1..20: mol_type = other DNA
aggcaagagctcaaacagaa

SEQ ID NO: 104589 - DNA, 20 bp, synthetic construct
  misc_feature 1..20: note = CRISPR gRNA sequence
  source 1..20: mol_type = other DNA
agaatggtgaacaaatcctc

SEQ ID NO: 104590 - DNA, 20 bp, synthetic construct
  misc_feature 1..20: note = CRISPR gRNA sequence
  source 1..20: mol_type = other DNA
tcctcaagtgctgctattga

SEQ ID NO: 104591 - DNA, 20 bp, synthetic construct
  misc_feature 1..20: note = CRISPR gRNA sequence
  source 1..20: mol_type = other DNA
aagtgctgctattgatagtc

SEQ ID NO: 104592 - DNA, 20 bp, synthetic construct
  misc_feature 1..20: note = CRISPR gRNA sequence
  source 1..20: mol_type = other DNA
agtgctgctattgatagtct

SEQ ID NO: 104593 - DNA, 20 bp, synthetic construct
  misc_feature 1..20: note = CRISPR gRNA sequence
  source 1..20: mol_type = other DNA
gtgctgctattgatagtctg

SEQ ID NO: 104594 - DNA, 20 bp, synthetic construct
  misc_feature 1..20: note = CRISPR gRNA sequence
  source 1..20: mol_type = other DNA
ctattgatagtctggggact

SEQ ID NO: 104595 - DNA, 20 bp, synthetic construct
  misc_feature 1..20: note = CRISPR gRNA sequence
  source 1..20: mol_type = other DNA
gtctggggacttggaatgct

SEQ ID NO: 104596 - DNA, 20 bp, synthetic construct
  misc_feature 1..20: note = CRISPR gRNA sequence
  source 1..20: mol_type = other DNA
ggaatgcttggtttaatttt

SEQ ID NO: 104597 - DNA, 20 bp, synthetic construct
  misc_feature 1..20: note = CRISPR gRNA sequence
  source 1..20: mol_type = other DNA
tactacaactgactcattgt

SEQ ID NO: 104598 - DNA, 20 bp, synthetic construct
  misc_feature 1..20: note = CRISPR gRNA sequence
  source 1..20: mol_type = other DNA
aactgactcattgtcagttt

SEQ ID NO: 104599 - DNA, 20 bp, synthetic construct
  misc_feature 1..20: note = CRISPR gRNA sequence
  source 1..20: mol_type = other DNA
ttgtcagtttgagataaaca

SEQ ID NO: 104600 - DNA, 20 bp, synthetic construct
  misc_feature 1..20: note = CRISPR gRNA sequence
  source 1..20: mol_type = other DNA
gtttgagataaacaaagtat

SEQ ID NO: 104601 - DNA, 20 bp, synthetic construct
  misc_feature 1..20: note = CRISPR gRNA sequence
  source 1..20: mol_type = other DNA
gttttaaaatctctgtcctg

SEQ ID NO: 104602 - DNA, 20 bp, synthetic construct
  misc_feature 1..20: note = CRISPR gRNA sequence
  source 1..20: mol_type = other DNA
ttaaaatctctgtcctgaag

SEQ ID NO: 104603 - DNA, 20 bp, synthetic construct
  misc_feature 1..20: note = CRISPR gRNA sequence
  source 1..20: mol_type = other DNA
gcagattgctcattatgtac

SEQ ID NO: 104604 - DNA, 20 bp, synthetic construct
  misc_feature 1..20: note = CRISPR gRNA sequence
  source 1..20: mol_type = other DNA
agattgctcattatgtacaa

SEQ ID NO: 104605 - DNA, 20 bp, synthetic construct
  misc_feature 1..20: note = CRISPR gRNA sequence
  source 1..20: mol_type = other DNA
ttgctcattatgtacaagag

SEQ ID NO: 104606 - DNA, 20 bp, synthetic construct
  misc_feature 1..20: note = CRISPR gRNA sequence
  source 1..20: mol_type = other DNA
ctcattatgtacaagagcag

SEQ ID NO: 104607 - DNA, 20 bp, synthetic construct
  misc_feature 1..20: note = CRISPR gRNA sequence
  source 1..20: mol_type = other DNA
tcattatgtacaagagcagt

SEQ ID NO: 104608 - DNA, 20 bp, synthetic construct
  misc_feature 1..20: note = CRISPR gRNA sequence
  source 1..20: mol_type = other DNA
atgtacaagagcagtaggta

SEQ ID NO: 104609 - DNA, 20 bp, synthetic construct
  misc_feature 1..20: note = CRISPR gRNA sequence
  source 1..20: mol_type = other DNA
aagagcagtaggtatagctg

SEQ ID NO: 104610 - DNA, 20 bp, synthetic construct
  misc_feature 1..20: note = CRISPR gRNA sequence
  source 1..20: mol_type = other DNA
gcagtaggtatagctgtagt

SEQ ID NO: 104611 - DNA, 20 bp, synthetic construct
  misc_feature 1..20: note = CRISPR gRNA sequence
  source 1..20: mol_type = other DNA
gctgtagtcagactgacctg

SEQ ID NO: 104612 - DNA, 20 bp, synthetic construct
  misc_feature 1..20: note = CRISPR gRNA sequence
  source 1..20: mol_type = other DNA
gtagtcagactgacctgtag

SEQ ID NO: 104613 - DNA, 20 bp, synthetic construct
  misc_feature 1..20: note = CRISPR gRNA sequence
  source 1..20: mol_type = other DNA
agtcagactgacctgtagaa

SEQ ID NO: 104614 - DNA, 20 bp, synthetic construct
  misc_feature 1..20: note = CRISPR gRNA sequence
  source 1..20: mol_type = other DNA
gtcagactgacctgtagaag

SEQ ID NO: 104615 - DNA, 20 bp, synthetic construct
  misc_feature 1..20: note = CRISPR gRNA sequence
  source 1..20: mol_type = other DNA
cagactgacctgtagaagag

SEQ ID NO: 104616 - DNA, 20 bp, synthetic construct
  misc_feature 1..20: note = CRISPR gRNA sequence
  source 1..20: mol_type = other DNA
agactgacctgtagaagagg

SEQ ID NO: 104617 - DNA, 20 bp, synthetic construct
  misc_feature 1..20: note = CRISPR gRNA sequence
  source 1..20: mol_type = other DNA
ttcaccttttgaaaactgct

SEQ ID NO: 104618 - DNA, 20 bp, synthetic construct
  misc_feature 1..20: note = CRISPR gRNA sequence
  source 1..20: mol_type = other DNA
tcaccttttgaaaactgcta

SEQ ID NO: 104619 - DNA, 20 bp, synthetic construct
  misc_feature 1..20: note = CRISPR gRNA sequence
  source 1..20: mol_type = other DNA
cttttgaaaactgctaagga

SEQ ID NO: 104620 - DNA, 20 bp, synthetic construct
  misc_feature 1..20: note = CRISPR gRNA sequence
  source 1..20: mol_type = other DNA
tttgaaaactgctaaggata

SEQ ID NO: 104621 - DNA, 20 bp, synthetic construct
  misc_feature 1..20: note = CRISPR gRNA sequence
  source 1..20: mol_type = other DNA
aggatagagttactcaaaac

SEQ ID NO: 104622 - DNA, 20 bp, synthetic construct
  misc_feature 1..20: note = CRISPR gRNA sequence
  source 1..20: mol_type = other DNA
ggatagagttactcaaaact

SEQ ID NO: 104623 - DNA, 20 bp, synthetic construct
  misc_feature 1..20: note = CRISPR gRNA sequence
  source 1..20: mol_type = other DNA
agttactcaaaactgggacc

SEQ ID NO: 104624 - DNA, 20 bp, synthetic construct
  misc_feature 1..20: note = CRISPR gRNA sequence
  source 1..20: mol_type = other DNA
actcaaaactgggacctaga

SEQ ID NO: 104625 - DNA, 20 bp, synthetic construct
  misc_feature 1..20: note = CRISPR gRNA sequence
  source 1..20: mol_type = other DNA
actgggacctagacagttaa

SEQ ID NO: 104626 - DNA, 20 bp, synthetic construct
  misc_feature 1..20: note = CRISPR gRNA sequence
  source 1..20: mol_type = other DNA
agacagttaatagaatttca

SEQ ID NO: 104627 - DNA, 20 bp, synthetic construct
  misc_feature 1..20: note = CRISPR gRNA sequence
  source 1..20: mol_type = other DNA
tttcaaagattgtgattact

SEQ ID NO: 104628 - DNA, 20 bp, synthetic construct
  misc_feature 1..20: note = CRISPR gRNA sequence
  source 1..20: mol_type = other DNA
gtgattacttagattatata

SEQ ID NO: 104629 - DNA, 20 bp, synthetic construct
  misc_feature 1..20: note = CRISPR gRNA sequence
  source 1..20: mol_type = other DNA
agattatatatagcacacca

SEQ ID NO: 104630 - DNA, 20 bp, synthetic construct
  misc_feature 1..20: note = CRISPR gRNA sequence
  source 1..20: mol_type = other DNA
ttatatatagcacaccacag

SEQ ID NO: 104631 - DNA, 20 bp, synthetic construct
  misc_feature 1..20: note = CRISPR gRNA sequence
  source 1..20: mol_type = other DNA
tatatatagcacaccacagt

SEQ ID NO: 104632 - DNA, 20 bp, synthetic construct
  misc_feature 1..20: note = CRISPR gRNA sequence
  source 1..20: mol_type = other DNA
tatatagcacaccacagtgg

SEQ ID NO: 104633 - DNA, 20 bp, synthetic construct
  misc_feature 1..20: note = CRISPR gRNA sequence
  source 1..20: mol_type = other DNA
tatagcacaccacagtggga

SEQ ID NO: 104634 - DNA, 20 bp, synthetic construct
  misc_feature 1..20: note = CRISPR gRNA sequence
  source 1..20: mol_type = other DNA
ttttctccccttgtgttttt

SEQ ID NO: 104635 - DNA, 20 bp, synthetic construct
  misc_feature 1..20: note = CRISPR gRNA sequence
  source 1..20: mol_type = other DNA
tgtttttcagtgtgttttgc

SEQ ID NO: 104636 - DNA, 20 bp, synthetic construct
  misc_feature 1..20: note = CRISPR gRNA sequence
  source 1..20: mol_type = other DNA
gtttttcagtgtgttttgcc

SEQ ID NO: 104637 - DNA, 20 bp, synthetic construct
  misc_feature 1..20: note = CRISPR gRNA sequence
  source 1..20: mol_type = other DNA
tcagtgtgttttgccaggat

SEQ ID NO: 104638 - DNA, 20 bp, synthetic construct
  misc_feature 1..20: note = CRISPR gRNA sequence
  source 1..20: mol_type = other DNA
tgtgttttgccaggatcggt

SEQ ID NO: 104639 - DNA, 20 bp, synthetic construct
  misc_feature 1..20: note = CRISPR gRNA sequence
  source 1..20: mol_type = other DNA
caggatcggtgagtgtatac

SEQ ID NO: 104640 - DNA, 20 bp, synthetic construct
  misc_feature 1..20: note = CRISPR gRNA sequence
  source 1..20: mol_type = other DNA
atcggtgagtgtataccaga

SEQ ID NO: 104641 - DNA, 20 bp, synthetic construct
  misc_feature 1..20: note = CRISPR gRNA sequence
  source 1..20: mol_type = other DNA
ggtgagtgtataccagatag

SEQ ID NO: 104642 - DNA, 20 bp, synthetic construct
  misc_feature 1..20: note = CRISPR gRNA sequence
  source 1..20: mol_type = other DNA
tgagtgtataccagatagaa

SEQ ID NO: 104643 - DNA, 20 bp, synthetic construct
  misc_feature 1..20: note = CRISPR gRNA sequence
  source 1..20: mol_type = other DNA
gagtgtataccagatagaag

SEQ ID NO: 104644 - DNA, 20 bp, synthetic construct
  misc_feature 1..20: note = CRISPR gRNA sequence
  source 1..20: mol_type = other DNA
agtgtataccagatagaaga

SEQ ID NO: 104645 - DNA, 20 bp, synthetic construct
  misc_feature 1..20: note = CRISPR gRNA sequence
  source 1..20: mol_type = other DNA
ttttatgttttgttttctta

SEQ ID NO: 104646 - DNA, 20 bp, synthetic construct
  misc_feature 1..20: note = CRISPR gRNA sequence
  source 1..20: mol_type = other DNA
gttttgttttcttaaagtta

SEQ ID NO: 104647 - DNA, 20 bp, synthetic construct
  misc_feature 1..20: note = CRISPR gRNA sequence
  source 1..20: mol_type = other DNA
taaagttacagtccctgttt

SEQ ID NO: 104648 - DNA, 20 bp, synthetic construct
  misc_feature 1..20: note = CRISPR gRNA sequence
  source 1..20: mol_type = other DNA
aaagttacagtccctgtttc

SEQ ID NO: 104649 - DNA, 20 bp, synthetic construct
  misc_feature 1..20: note = CRISPR gRNA sequence
  source 1..20: mol_type = other DNA
ttcaggcatgatcactatcc

SEQ ID NO: 104650 - DNA, 20 bp, synthetic construct
  misc_feature 1..20: note = CRISPR gRNA sequence
  source 1..20: mol_type = other DNA
aggcatgatcactatcccag

SEQ ID NO: 104651 - DNA, 20 bp, synthetic construct
  misc_feature 1..20: note = CRISPR gRNA sequence
  source 1..20: mol_type = other DNA
atgatcactatcccagcagc

SEQ ID NO: 104652 - DNA, 20 bp, synthetic construct
  misc_feature 1..20: note = CRISPR gRNA sequence
  source 1..20: mol_type = other DNA
cactatcccagcagccagtt

SEQ ID NO: 104653 - DNA, 20 bp, synthetic construct
  misc_feature 1..20: note = CRISPR gRNA sequence
  source 1..20: mol_type = other DNA
tatcccagcagccagtttgg

SEQ ID NO: 104654 - DNA, 20 bp, synthetic construct
  misc_feature 1..20: note = CRISPR gRNA sequence
  source 1..20: mol_type = other DNA
atcccagcagccagtttggc

SEQ ID NO: 104655 - DNA, 20 bp, synthetic construct
  misc_feature 1..20: note = CRISPR gRNA sequence
  source 1..20: mol_type = other DNA
cccagcagccagtttggcag

SEQ ID NO: 104656 - DNA, 20 bp, synthetic construct
  misc_feature 1..20: note = CRISPR gRNA sequence
  source 1..20: mol_type = other DNA
cagccagtttggcaggagca

SEQ ID NO: 104657 - DNA, 20 bp, synthetic construct
  misc_feature 1..20: note = CRISPR gRNA sequence
  source 1..20: mol_type = other DNA
aggagcacagattgttcaaa

SEQ ID NO: 104658 - DNA, 20 bp, synthetic construct
  misc_feature 1..20: note = CRISPR gRNA sequence
  source 1..20: mol_type = other DNA
ggagcacagattgttcaaac

SEQ ID NO: 104659 - DNA, 20 bp, synthetic construct
  misc_feature 1..20: note = CRISPR gRNA sequence
  source 1..20: mol_type = other DNA
agcacagattgttcaaacag

SEQ ID NO: 104660 - DNA, 20 bp, synthetic construct
  misc_feature 1..20: note = CRISPR gRNA sequence
  source 1..20: mol_type = other DNA
ggagccaataccaacacaac

SEQ ID NO: 104661 - DNA, 20 bp, synthetic construct
  misc_feature 1..20: note = CRISPR gRNA sequence
  source 1..20: mol_type = other DNA
gccaataccaacacaaccag

SEQ ID NO: 104662 - DNA, 20 bp, synthetic construct
  misc_feature 1..20: note = CRISPR gRNA sequence
  source 1..20: mol_type = other DNA
aataccaacacaaccagcag

SEQ ID NO: 104663 - DNA, 20 bp, synthetic construct
  misc_feature 1..20: note = CRISPR gRNA sequence
  source 1..20: mol_type = other DNA
ataccaacacaaccagcagt

SEQ ID NO: 104664 - DNA, 20 bp, synthetic construct
  misc_feature 1..20: note = CRISPR gRNA sequence
  source 1..20: mol_type = other DNA
caacacaaccagcagtgggc

SEQ ID NO: 104665 - DNA, 20 bp, synthetic construct
  misc_feature 1..20: note = CRISPR gRNA sequence
  source 1..20: mol_type = other DNA
aacacaaccagcagtgggca

SEQ ID NO: 104666 - DNA, 20 bp, synthetic construct
  misc_feature 1..20: note = CRISPR gRNA sequence
  source 1..20: mol_type = other DNA
acacaaccagcagtgggcaa

SEQ ID NO: 104667 - DNA, 20 bp, synthetic construct
  misc_feature 1..20: note = CRISPR gRNA sequence
  source 1..20: mol_type = other DNA
gactgtcactgtgacactac

SEQ ID NO: 104668 - DNA, 20 bp, synthetic construct
  misc_feature 1..20: note = CRISPR gRNA sequence
  source 1..20: mol_type = other DNA
tgtcactgtgacactaccag

SEQ ID NO: 104669 - DNA, 20 bp, synthetic construct
  misc_feature 1..20: note = CRISPR gRNA sequence
  source 1..20: mol_type = other DNA
cactgtgacactaccagtgg

SEQ ID NO: 104670 - DNA, 20 bp, synthetic construct
  misc_feature 1..20: note = CRISPR gRNA sequence
  source 1..20: mol_type = other DNA
actgtgacactaccagtggc

SEQ ID NO: 104671 - DNA, 20 bp, synthetic construct
  misc_feature 1..20: note = CRISPR gRNA sequence
  source 1..20: mol_type = other DNA
actaccagtggcaggcaatg

SEQ ID NO: 104672 - DNA, 20 bp, synthetic construct
  misc_feature 1..20: note = CRISPR gRNA sequence
  source 1..20: mol_type = other DNA
ggcaggcaatgtggtcaatt

SEQ ID NO: 104673 - DNA, 20 bp, synthetic construct
  misc_feature 1..20: note = CRISPR gRNA sequence
  source 1..20: mol_type = other DNA
gcaggcaatgtggtcaattc

SEQ ID NO: 104674 - DNA, 20 bp, synthetic construct
  misc_feature 1..20: note = CRISPR gRNA sequence
  source 1..20: mol_type = other DNA
aggcaatgtggtcaattcag

SEQ ID NO: 104675 - DNA, 20 bp, synthetic construct
  misc_feature 1..20: note = CRISPR gRNA sequence
  source 1..20: mol_type = other DNA
ggcaatgtggtcaattcagg

SEQ ID NO: 104676 - DNA, 20 bp, synthetic construct
  misc_feature 1..20: note = CRISPR gRNA sequence
  source 1..20: mol_type = other DNA
gcaatgtggtcaattcagga

SEQ ID NO: 104677 - DNA, 20 bp, synthetic construct
  misc_feature 1..20: note = CRISPR gRNA sequence
  source 1..20: mol_type = other DNA
tgtggtcaattcaggaggga

SEQ ID NO: 104678 - DNA, 20 bp, synthetic construct
  misc_feature 1..20: note = CRISPR gRNA sequence
  source 1..20: mol_type = other DNA
caattcaggagggatggtca

SEQ ID NO: 104679 - DNA, 20 bp, synthetic construct
  misc_feature 1..20: note = CRISPR gRNA sequence
  source 1..20: mol_type = other DNA
tcaggagggatggtcatggt

SEQ ID NO: 104680 - DNA, 20 bp, synthetic construct
  misc_feature 1..20: note = CRISPR gRNA sequence
  source 1..20: mol_type = other DNA
tggtaagaaaatgtattttt

SEQ ID NO: 104681 - DNA, 20 bp, synthetic construct
  misc_feature 1..20: note = CRISPR gRNA sequence
  source 1..20: mol_type = other DNA
aatttattatgttgacctct

SEQ ID NO: 104682 - DNA, 20 bp, synthetic construct
  misc_feature 1..20: note = CRISPR gRNA sequence
  source 1..20: mol_type = other DNA
atttattatgttgacctctt

SEQ ID NO: 104683 - DNA, 20 bp, synthetic construct
  misc_feature 1..20: note = CRISPR gRNA sequence
  source 1..20: mol_type = other DNA
tatgttgacctcttgggatt

SEQ ID NO: 104684 - DNA, 20 bp, synthetic construct
  misc_feature 1..20: note = CRISPR gRNA sequence
  source 1..20: mol_type = other DNA
tgggattgagatcgatcctt

SEQ ID NO: 104685 - DNA, 20 bp, synthetic construct
  misc_feature 1..20: note = CRISPR gRNA sequence
  source 1..20: mol_type = other DNA
gggattgagatcgatcctta

SEQ ID NO: 104686 - DNA, 20 bp, synthetic construct
  misc_feature 1..20: note = CRISPR gRNA sequence
  source 1..20: mol_type = other DNA
atcgatccttaaggcactgt

SEQ ID NO: 104687 - DNA, 20 bp, synthetic construct
  misc_feature 1..20: note = CRISPR gRNA sequence
  source 1..20: mol_type = other DNA
gacaaaccataattcattct

SEQ ID NO: 104688 - DNA, 20 bp, synthetic construct
  misc_feature 1..20: note = CRISPR gRNA sequence
  source 1..20: mol_type = other DNA
tctgagcacctactatgtgc

SEQ ID NO: 104689 - DNA, 20 bp, synthetic construct
  misc_feature 1..20: note = CRISPR gRNA sequence
  source 1..20: mol_type = other DNA
ctgagcacctactatgtgcc

SEQ ID NO: 104690 - DNA, 20 bp, synthetic construct
  misc_feature 1..20: note = CRISPR gRNA sequence
  source 1..20: mol_type = other DNA
tgagcacctactatgtgcca

SEQ ID NO: 104691 - DNA, 20 bp, synthetic construct
  misc_feature 1..20: note = CRISPR gRNA sequence
  source 1..20: mol_type = other DNA
atgtgccagggactattcac

SEQ ID NO: 104692 - DNA, 20 bp, synthetic construct
  misc_feature 1..20: note = CRISPR gRNA sequence
  source 1..20: mol_type = other DNA
tgtgccagggactattcacc

SEQ ID NO: 104693 - DNA, 20 bp, synthetic construct
  misc_feature 1..20: note = CRISPR gRNA sequence
  source 1..20: mol_type = other DNA
gtgccagggactattcacca

SEQ ID NO: 104694 - DNA, 20 bp, synthetic construct
  misc_feature 1..20: note = CRISPR gRNA sequence
  source 1..20: mol_type = other DNA
ctattcaccagggactattc

SEQ ID NO: 104695 - DNA, 20 bp, synthetic construct
  misc_feature 1..20: note = CRISPR gRNA sequence
  source 1..20: mol_type = other DNA
ccagggactattctagatgc

SEQ ID NO: 104696 - DNA, 20 bp, synthetic construct
  misc_feature 1..20: note = CRISPR gRNA sequence
  source 1..20: mol_type = other DNA
agggactattctagatgctg

SEQ ID NO: 104697 - DNA, 20 bp, synthetic construct
  misc_feature 1..20: note = CRISPR gRNA sequence
  source 1..20: mol_type = other DNA
tattctagatgctggagata

SEQ ID NO: 104698 - DNA, 20 bp, synthetic construct
  misc_feature 1..20: note = CRISPR gRNA sequence
  source 1..20: mol_type = other DNA
agatgctggagataaagcaa

SEQ ID NO: 104699 - DNA, 20 bp, synthetic construct
  misc_feature 1..20: note = CRISPR gRNA sequence
  source 1..20: mol_type = other DNA
gagataaagcaatggataaa

SEQ ID NO: 104700 - DNA, 20 bp, synthetic construct
  misc_feature 1..20: note = CRISPR gRNA sequence
  source 1..20: mol_type = other DNA
atggataaatagtgatttta

SEQ ID NO: 104701 - DNA, 20 bp, synthetic construct
  misc_feature 1..20: note = CRISPR gRNA sequence
  source 1..20: mol_type = other DNA
tgattttatggaattctttt

SEQ ID NO: 104702 - DNA, 20 bp, synthetic construct
  misc_feature 1..20: note = CRISPR gRNA sequence
  source 1..20: mol_type = other DNA
ttttcagaattcaaataacg

SEQ ID NO: 104703 - DNA, 20 bp, synthetic construct
  misc_feature 1..20: note = CRISPR gRNA sequence
  source 1..20: mol_type = other DNA
tttcagaattcaaataacga

SEQ ID NO: 104704 - DNA, 20 bp, synthetic construct
  misc_feature 1..20: note = CRISPR gRNA sequence
  source 1..20: mol_type = other DNA
ttcagaattcaaataacgaa

SEQ ID NO: 104705 - DNA, 20 bp, synthetic construct
  misc_feature 1..20: note = CRISPR gRNA sequence
  source 1..20: mol_type = other DNA
ggaattatatactaatcttt

SEQ ID NO: 104706 - DNA, 20 bp, synthetic construct
  misc_feature 1..20: note = CRISPR gRNA sequence
  source 1..20: mol_type = other DNA
attatatactaatctttgag

SEQ ID NO: 104707 - DNA, 20 bp, synthetic construct
  misc_feature 1..20: note = CRISPR gRNA sequence
  source 1..20: mol_type = other DNA
atatactaatctttgagaag

SEQ ID NO: 104708 - DNA, 20 bp, synthetic construct
  misc_feature 1..20: note = CRISPR gRNA sequence
  source 1..20: mol_type = other DNA
actaatctttgagaagtgga

SEQ ID NO: 104709 - DNA, 20 bp, synthetic construct
  misc_feature 1..20: note = CRISPR gRNA sequence
  source 1..20: mol_type = other DNA
aatctttgagaagtggaaag

SEQ ID NO: 104710 - DNA, 20 bp, synthetic construct
  misc_feature 1..20: note = CRISPR gRNA sequence
  source 1..20: mol_type = other DNA
gaaagtagtattgcccatga

SEQ ID NO: 104711 - DNA, 20 bp, synthetic construct
  misc_feature 1..20: note = CRISPR gRNA sequence
  source 1..20: mol_type = other DNA
ttgcccatgatggacaaaat

SEQ ID NO: 104712 - DNA, 20 bp, synthetic construct
  misc_feature 1..20: note = CRISPR gRNA sequence
  source 1..20: mol_type = other DNA
tgatggacaaaataagaaat

SEQ ID NO: 104713 - DNA, 20 bp, synthetic construct
  misc_feature 1..20: note = CRISPR gRNA sequence
  source 1..20: mol_type = other DNA
ataagaaataagctaaaaat

SEQ ID NO: 104714 - DNA, 20 bp, synthetic construct
  misc_feature 1..20: note = CRISPR gRNA sequence
  source 1..20: mol_type = other DNA
gaaataagctaaaaattaga

SEQ ID NO: 104715 - DNA, 20 bp, synthetic construct
  misc_feature 1..20: note = CRISPR gRNA sequence
  source 1..20: mol_type = other DNA
attagaaagattgtaattga

SEQ ID NO: 104716 - DNA, 20 bp, synthetic construct
  misc_feature 1..20: note = CRISPR gRNA sequence
  source 1..20: mol_type = other DNA
tagaaagattgtaattgata

SEQ ID NO: 104717 - DNA, 20 bp, synthetic construct
  misc_feature 1..20: note = CRISPR gRNA sequence
  source 1..20: mol_type = other DNA
tgatagagaaaccaaaaaaa

SEQ ID NO: 104718 - DNA, 20 bp, synthetic construct
  misc_feature 1..20: note = CRISPR gRNA sequence
  source 1..20: mol_type = other DNA
aaagtgtcatgtaaatgtat

SEQ ID NO: 104719 - DNA, 20 bp, synthetic construct
  misc_feature 1..20: note = CRISPR gRNA sequence
  source 1..20: mol_type = other DNA
aagtgtcatgtaaatgtatt

SEQ ID NO: 104720 - DNA, 20 bp, synthetic construct
  misc_feature 1..20: note = CRISPR gRNA sequence
  source 1..20: mol_type = other DNA
tgtcatgtaaatgtattggg

SEQ ID NO: 104721 - DNA, 20 bp, synthetic construct
  misc_feature 1..20: note = CRISPR gRNA sequence
  source 1..20: mol_type = other DNA
atgtaaatgtattgggaaga

SEQ ID NO: 104722 - DNA, 20 bp, synthetic construct
  misc_feature 1..20: note = CRISPR gRNA sequence
  source 1..20: mol_type = other DNA
tgtaaatgtattgggaagat

SEQ ID NO: 104723 - DNA, 20 bp, synthetic construct
  misc_feature 1..20: note = CRISPR gRNA sequence
  source 1..20: mol_type = other DNA
aaatgtattgggaagatagg

SEQ ID NO: 104724 - DNA, 20 bp, synthetic construct
  misc_feature 1..20: note = CRISPR gRNA sequence
  source 1..20: mol_type = other DNA
attgggaagataggaagatt

SEQ ID NO: 104725 - DNA, 20 bp, synthetic construct
  misc_feature 1..20: note = CRISPR gRNA sequence
  source 1..20: mol_type = other DNA
ttgggaagataggaagattt

SEQ ID NO: 104726 - DNA, 20 bp, synthetic construct
  misc_feature 1..20: note = CRISPR gRNA sequence
  source 1..20: mol_type = other DNA
ggaagataggaagatttggg

SEQ ID NO: 104727 - DNA, 20 bp, synthetic construct
  misc_feature 1..20: note = CRISPR gRNA sequence
  source 1..20: mol_type = other DNA
gatttgggtggtgtaactga

SEQ ID NO: 104728 - DNA, 20 bp, synthetic construct
  misc_feature 1..20: note = CRISPR gRNA sequence
  source 1..20: mol_type = other DNA
taaatcctcatatgtcaaaa

SEQ ID NO: 104729 - DNA, 20 bp, synthetic construct
  misc_feature 1..20: note = CRISPR gRNA sequence
  source 1..20: mol_type = other DNA
aaatcctcatatgtcaaaat

SEQ ID NO: 104730 - DNA, 20 bp, synthetic construct
  misc_feature 1..20: note = CRISPR gRNA sequence
  source 1..20: mol_type = other DNA
gatgttaaaatgcataaatt

SEQ ID NO: 104731 - DNA, 20 bp, synthetic construct
  misc_feature 1..20: note = CRISPR gRNA sequence
  source 1..20: mol_type = other DNA
aaaatgcataaattaagaat

SEQ ID NO: 104732 - DNA, 20 bp, synthetic construct
  misc_feature 1..20: note = CRISPR gRNA sequence
  source 1..20: mol_type = other DNA
cataaattaagaatgagtaa

SEQ ID NO: 104733 - DNA, 20 bp, synthetic construct
  misc_feature 1..20: note = CRISPR gRNA sequence
  source 1..20: mol_type = other DNA
aaattaagaatgagtaacag

SEQ ID NO: 104734 - DNA, 20 bp, synthetic construct
  misc_feature 1..20: note = CRISPR gRNA sequence
  source 1..20: mol_type = other DNA
atgagtaacagaagtctgca

SEQ ID NO: 104735 - DNA, 20 bp, synthetic construct
  misc_feature 1..20: note = CRISPR gRNA sequence
  source 1..20: mol_type = other DNA
gagtaacagaagtctgcaca

SEQ ID NO: 104736 - DNA, 20 bp, synthetic construct
  misc_feature 1..20: note = CRISPR gRNA sequence
  source 1..20: mol_type = other DNA
agtaacagaagtctgcacag

SEQ ID NO: 104737 - DNA, 20 bp, synthetic construct
  misc_feature 1..20: note = CRISPR gRNA sequence
  source 1..20: mol_type = other DNA
aacagaagtctgcacagagg

SEQ ID NO: 104738 - DNA, 20 bp, synthetic construct
  misc_feature 1..20: note = CRISPR gRNA sequence
  source 1..20: mol_type = other DNA
cagaagtctgcacagaggtg

SEQ ID NO: 104739 - DNA, 20 bp, synthetic construct
  misc_feature 1..20: note = CRISPR gRNA sequence
  source 1..20: mol_type = other DNA
agaagtctgcacagaggtgg

SEQ ID NO: 104740 - DNA, 20 bp, synthetic construct
  misc_feature 1..20: note = CRISPR gRNA sequence
  source 1..20: mol_type = other DNA
agtctgcacagaggtggagg

SEQ ID NO: 104741 - DNA, 20 bp, synthetic construct
  misc_feature 1..20: note = CRISPR gRNA sequence
  source 1..20: mol_type = other DNA
gaggtggaggaagctatgaa

SEQ ID NO: 104742 - DNA, 20 bp, synthetic construct
  misc_feature 1..20: note = CRISPR gRNA sequence
  source 1..20: mol_type = other DNA
gaggaagctatgaaaagaaa

SEQ ID NO: 104743 - DNA, 20 bp, synthetic construct
  misc_feature 1..20: note = CRISPR gRNA sequence
  source 1..20: mol_type = other DNA
aaaagaaacagaaccaaccc

SEQ ID NO: 104744 - DNA, 20 bp, synthetic construct
  misc_feature 1..20: note = CRISPR gRNA sequence
  source 1..20: mol_type = other DNA
aaacagaaccaaccctggct

SEQ ID NO: 104745 - DNA, 20 bp, synthetic construct
  misc_feature 1..20: note = CRISPR gRNA sequence
  source 1..20: mol_type = other DNA
cagaaccaaccctggctcag

SEQ ID NO: 104746 - DNA, 20 bp, synthetic construct
  misc_feature 1..20: note = CRISPR gRNA sequence
  source 1..20: mol_type = other DNA
ggctcagtggcatgcacctg

SEQ ID NO: 104747 - DNA, 20 bp, synthetic construct
  misc_feature 1..20: note = CRISPR gRNA sequence
  source 1..20: mol_type = other DNA
gtggcatgcacctgtagtcc

SEQ ID NO: 104748 - DNA, 20 bp, synthetic construct
  misc_feature 1..20: note = CRISPR gRNA sequence
  source 1..20: mol_type = other DNA
cacctgtagtcctagctact

SEQ ID NO: 104749 - DNA, 20 bp, synthetic construct
  misc_feature 1..20: note = CRISPR gRNA sequence
  source 1..20: mol_type = other DNA
acctgtagtcctagctactt

SEQ ID NO: 104750 - DNA, 20 bp, synthetic construct
  misc_feature 1..20: note = CRISPR gRNA sequence
  source 1..20: mol_type = other DNA
ctgtagtcctagctacttgg

SEQ ID NO: 104751 - DNA, 20 bp, synthetic construct
  misc_feature 1..20: note = CRISPR gRNA sequence
  source 1..20: mol_type = other DNA
tgtagtcctagctacttggg

SEQ ID NO: 104752 - DNA, 20 bp, synthetic construct
  misc_feature 1..20: note = CRISPR gRNA sequence
  source 1..20: mol_type = other DNA
agctacttgggaggctaatc

SEQ ID NO: 104753 - DNA, 20 bp, synthetic construct
  misc_feature 1..20: note = CRISPR gRNA sequence
  source 1..20: mol_type = other DNA
gctacttgggaggctaatcc

SEQ ID NO: 104754 - DNA, 20 bp, synthetic construct
  misc_feature 1..20: note = CRISPR gRNA sequence
  source 1..20: mol_type = other DNA
tacttgggaggctaatccag

SEQ ID NO: 104755 - DNA, 20 bp, synthetic construct
  misc_feature 1..20: note = CRISPR gRNA sequence
  source 1..20: mol_type = other DNA
acttgggaggctaatccagg

SEQ ID NO: 104756 - DNA, 20 bp, synthetic construct
  misc_feature 1..20: note = CRISPR gRNA sequence
  source 1..20: mol_type = other DNA
gggaggctaatccaggagga

SEQ ID NO: 104757 - DNA, 20 bp, synthetic construct
  misc_feature 1..20: note = CRISPR gRNA sequence
  source 1..20: mol_type = other DNA
ctaatccaggaggatggctt

SEQ ID NO: 104758 - DNA, 20 bp, synthetic construct
  misc_feature 1..20: note = CRISPR gRNA sequence
  source 1..20: mol_type = other DNA
ccaggaggatggcttaagtc

SEQ ID NO: 104759 - DNA, 20 bp, synthetic construct
  misc_feature 1..20: note = CRISPR gRNA sequence
  source 1..20: mol_type = other DNA
caggaggatggcttaagtcc

SEQ ID NO: 104760 - DNA, 20 bp, synthetic construct
  misc_feature 1..20: note = CRISPR gRNA sequence
  source 1..20: mol_type = other DNA
ggaggatggcttaagtccag

SEQ ID NO: 104761 - DNA, 20 bp, synthetic construct
  misc_feature 1..20: note = CRISPR gRNA sequence
  source 1..20: mol_type = other DNA
tggcttaagtccaggagttt

SEQ ID NO: 104762 - DNA, 20 bp, synthetic construct
  misc_feature 1..20: note = CRISPR gRNA sequence
  source 1..20: mol_type = other DNA
taagtccaggagtttgagct

SEQ ID NO: 104763 - DNA, 20 bp, synthetic construct
  misc_feature 1..20: note = CRISPR gRNA sequence
  source 1..20: mol_type = other DNA
ccaggagtttgagctcagcc

SEQ ID NO: 104764 - DNA, 20 bp, synthetic construct
  misc_feature 1..20: note = CRISPR gRNA sequence
  source 1..20: mol_type = other DNA
caggagtttgagctcagcct

SEQ ID NO: 104765 - DNA, 20 bp, synthetic construct
  misc_feature 1..20: note = CRISPR gRNA sequence
  source 1..20: mol_type = other DNA
tgagctcagcctgggcaatg

SEQ ID NO: 104766 - DNA, 20 bp, synthetic construct
  misc_feature 1..20: note = CRISPR gRNA sequence
  source 1..20: mol_type = other DNA
agctcagcctgggcaatgta

SEQ ID NO: 104767 - DNA, 20 bp, synthetic construct
  misc_feature 1..20: note = CRISPR gRNA sequence
  source 1..20: mol_type = other DNA
ctcagcctgggcaatgtaga

SEQ ID NO: 104768 - DNA, 20 bp, synthetic construct
  misc_feature 1..20: note = CRISPR gRNA sequence
  source 1..20: mol_type = other DNA
aaaataaataatttttataa

SEQ ID NO: 104769 - DNA, 20 bp, synthetic construct
  misc_feature 1..20: note = CRISPR gRNA sequence
  source 1..20: mol_type = other DNA
tttttataaaagattcaata

SEQ ID NO: 104770 - DNA, 20 bp, synthetic construct
  misc_feature 1..20: note = CRISPR gRNA sequence
  source 1..20: mol_type = other DNA
agattcaatacagttattca

SEQ ID NO: 104771 - DNA, 20 bp, synthetic construct
  misc_feature 1..20: note = CRISPR gRNA sequence
  source 1..20: mol_type = other DNA
ttcaatacagttattcaaag

SEQ ID NO: 104772 - DNA, 20 bp, synthetic construct
  misc_feature 1..20: note = CRISPR gRNA sequence
  source 1..20: mol_type = other DNA
ttattcaaagcggttgtatt

SEQ ID NO: 104773 - DNA, 20 bp, synthetic construct
  misc_feature 1..20: note = CRISPR gRNA sequence
  source 1..20: mol_type = other DNA
tattcaaagcggttgtattt

SEQ ID NO: 104774 - DNA, 20 bp, synthetic construct
  misc_feature 1..20: note = CRISPR gRNA sequence
  source 1..20: mol_type = other DNA
caaagcggttgtatttggga

SEQ ID NO: 104775 - DNA, 20 bp, synthetic construct
  misc_feature 1..20: note = CRISPR gRNA sequence
  source 1..20: mol_type = other DNA
aagcggttgtatttgggaaa

SEQ ID NO: 104776 - DNA, 20 bp, synthetic construct
  misc_feature 1..20: note = CRISPR gRNA sequence
  source 1..20: mol_type = other DNA
ttgtatttgggaaagagctg

SEQ ID NO: 104777 - DNA, 20 bp, synthetic construct
  misc_feature 1..20: note = CRISPR gRNA sequence
  source 1..20: mol_type = other DNA
tgtatttgggaaagagctgt

SEQ ID NO: 104778 - DNA, 20 bp, synthetic construct
  misc_feature 1..20: note = CRISPR gRNA sequence
  source 1..20: mol_type = other DNA
gtatttgggaaagagctgtg

SEQ ID NO: 104779 - DNA, 20 bp, synthetic construct
  misc_feature 1..20: note = CRISPR gRNA sequence
  source 1..20: mol_type = other DNA
tgggaaagagctgtggggta

SEQ ID NO: 104780 - DNA, 20 bp, synthetic construct
  misc_feature 1..20: note = CRISPR gRNA sequence
  source 1..20: mol_type = other DNA
gggaaagagctgtggggtac

SEQ ID NO: 104781 - DNA, 20 bp, synthetic construct
  misc_feature 1..20: note = CRISPR gRNA sequence
  source 1..20: mol_type = other DNA
tacttgtttttacctacatt

SEQ ID NO: 104782 - DNA, 20 bp, synthetic construct
  misc_feature 1..20: note = CRISPR gRNA sequence
  source 1..20: mol_type = other DNA
gtttttacctacatttagta

SEQ ID NO: 104783 - DNA, 20 bp, synthetic construct
  misc_feature 1..20: note = CRISPR gRNA sequence
  source 1..20: mol_type = other DNA
ctacatttagtacagtgttt

SEQ ID NO: 104784 - DNA, 20 bp, synthetic construct
  misc_feature 1..20: note = CRISPR gRNA sequence
  source 1..20: mol_type = other DNA
acagtgttttggtgtttttt

SEQ ID NO: 104785 - DNA, 20 bp, synthetic construct
  misc_feature 1..20: note = CRISPR gRNA sequence
  source 1..20: mol_type = other DNA
tggtgttttttaagaaaaat

SEQ ID NO: 104786 - DNA, 20 bp, synthetic construct
  misc_feature 1..20: note = CRISPR gRNA sequence
  source 1..20: mol_type = other DNA
ggtgttttttaagaaaaatt

SEQ ID NO: 104787 - DNA, 20 bp, synthetic construct
  misc_feature 1..20: note = CRISPR gRNA sequence
  source 1..20: mol_type = other DNA
aaaaattaggattgaattat

SEQ ID NO: 104788 - DNA, 20 bp, synthetic construct
  misc_feature 1..20: note = CRISPR gRNA sequence
  source 1..20: mol_type = other DNA
aactattatttttataaata

SEQ ID NO: 104789 - DNA, 20 bp, synthetic construct
  misc_feature 1..20: note = CRISPR gRNA sequence
  source 1..20: mol_type = other DNA
actattatttttataaatat

SEQ ID NO: 104790 - DNA, 20 bp, synthetic construct
  misc_feature 1..20: note = CRISPR gRNA sequence
  source 1..20: mol_type = other DNA
tttttataaatataggcatt

SEQ ID NO: 104791 - DNA, 20 bp, synthetic construct
  misc_feature 1..20: note = CRISPR gRNA sequence
  source 1..20: mol_type = other DNA
ttataaatataggcatttag

SEQ ID NO: 104792 - DNA, 20 bp, synthetic construct
  misc_feature 1..20: note = CRISPR gRNA sequence
  source 1..20: mol_type = other DNA
tataggcatttagtagcact

SEQ ID NO: 104793 - DNA, 20 bp, synthetic construct
  misc_feature 1..20: note = CRISPR gRNA sequence
  source 1..20: mol_type = other DNA
tgactactgttcctgaccat

SEQ ID NO: 104794 - DNA, 20 bp, synthetic construct
  misc_feature 1..20: note = CRISPR gRNA sequence
  source 1..20: mol_type = other DNA
tactgttcctgaccattaga

SEQ ID NO: 104795 - DNA, 20 bp, synthetic construct
  misc_feature 1..20: note = CRISPR gRNA sequence
  source 1..20: mol_type = other DNA
tgttcctgaccattagatgg

SEQ ID NO: 104796 - DNA, 20 bp, synthetic construct
  misc_feature 1..20: note = CRISPR gRNA sequence
  source 1..20: mol_type = other DNA
tcctgaccattagatggcag

SEQ ID NO: 104797 - DNA, 20 bp, synthetic construct
  misc_feature 1..20: note = CRISPR gRNA sequence
  source 1..20: mol_type = other DNA
tagatggcagcagaaatatc

SEQ ID NO: 104798 - DNA, 20 bp, synthetic construct
  misc_feature 1..20: note = CRISPR gRNA sequence
  source 1..20: mol_type = other DNA
gatggcagcagaaatatcta

SEQ ID NO: 104799 - DNA, 20 bp, synthetic construct
  misc_feature 1..20: note = CRISPR gRNA sequence
  source 1..20: mol_type = other DNA
agcagaaatatctagagcca

SEQ ID NO: 104800 - DNA, 20 bp, synthetic construct
  misc_feature 1..20: note = CRISPR gRNA sequence
  source 1..20: mol_type = other DNA
gcagaaatatctagagccat

SEQ ID NO: 104801 - DNA, 20 bp, synthetic construct
  misc_feature 1..20: note = CRISPR gRNA sequence
  source 1..20: mol_type = other DNA
gaaatatctagagccatggg

SEQ ID NO: 104802 - DNA, 20 bp, synthetic construct
  misc_feature 1..20: note = CRISPR gRNA sequence
  source 1..20: mol_type = other DNA
agccatgggtggacatgaat

SEQ ID NO: 104803 - DNA, 20 bp, synthetic construct
  misc_feature 1..20: note = CRISPR gRNA sequence
  source 1..20: mol_type = other DNA
gccatgggtggacatgaatt

SEQ ID NO: 104804 - DNA, 20 bp, synthetic construct
  misc_feature 1..20: note = CRISPR gRNA sequence
  source 1..20: mol_type = other DNA
ccatgggtggacatgaatta

SEQ ID NO: 104805 - DNA, 20 bp, synthetic construct
  misc_feature 1..20: note = CRISPR gRNA sequence
  source 1..20: mol_type = other DNA
ggtggacatgaattagggca

SEQ ID NO: 104806 - DNA, 20 bp, synthetic construct
  misc_feature 1..20: note = CRISPR gRNA sequence
  source 1..20: mol_type = other DNA
tgaattagggcatggttata

SEQ ID NO: 104807 - DNA, 20 bp, synthetic construct
  misc_feature 1..20: note = CRISPR gRNA sequence
  source 1..20: mol_type = other DNA
ggcatggttatatagtttct

SEQ ID NO: 104808 - DNA, 20 bp, synthetic construct
  misc_feature 1..20: note = CRISPR gRNA sequence
  source 1..20: mol_type = other DNA
catggttatatagtttctca

SEQ ID NO: 104809 - DNA, 20 bp, synthetic construct
  misc_feature 1..20: note = CRISPR gRNA sequence
  source 1..20: mol_type = other DNA
ggttatatagtttctcagag

SEQ ID NO: 104810 - DNA, 20 bp, synthetic construct
  misc_feature 1..20: note = CRISPR gRNA sequence
  source 1..20: mol_type = other DNA
cacctgaatctcctatgaca

SEQ ID NO: 104811 - DNA, 20 bp, synthetic construct
  misc_feature 1..20: note = CRISPR gRNA sequence
  source 1..20: mol_type = other DNA
tctcctatgacacagtcatc

SEQ ID NO: 104812 - DNA, 20 bp, synthetic construct
  misc_feature 1..20: note = CRISPR gRNA sequence
  source 1..20: mol_type = other DNA
ctcctatgacacagtcatct

SEQ ID NO: 104813 - DNA, 20 bp, synthetic construct
  misc_feature 1..20: note = CRISPR gRNA sequence
  source 1..20: mol_type = other DNA
tcctatgacacagtcatctg

SEQ ID NO: 104814 - DNA, 20 bp, synthetic construct
  misc_feature 1..20: note = CRISPR gRNA sequence
  source 1..20: mol_type = other DNA
tcatctggggtgtttgttta

SEQ ID NO: 104815 - DNA, 20 bp, synthetic construct
  misc_feature 1..20: note = CRISPR gRNA sequence
  source 1..20: mol_type = other DNA
tggggtgtttgtttaaagtg

SEQ ID NO: 104816 - DNA, 20 bp, synthetic construct
  misc_feature 1..20: note = CRISPR gRNA sequence
  source 1..20: mol_type = other DNA
ttgtttaaagtgcagatctt

SEQ ID NO: 104817 - DNA, 20 bp, synthetic construct
  misc_feature 1..20: note = CRISPR gRNA sequence
  source 1..20: mol_type = other DNA
atctttagtataaatttctc

SEQ ID NO: 104818 - DNA, 20 bp, synthetic construct
  misc_feature 1..20: note = CRISPR gRNA sequence
  source 1..20: mol_type = other DNA
tctttagtataaatttctcc

SEQ ID NO: 104819 - DNA, 20 bp, synthetic construct
  misc_feature 1..20: note = CRISPR gRNA sequence
  source 1..20: mol_type = other DNA
ctttagtataaatttctcca

SEQ ID NO: 104820 - DNA, 20 bp, synthetic construct
  misc_feature 1..20: note = CRISPR gRNA sequence
  source 1..20: mol_type = other DNA
ccagggatccgcatttaccc

SEQ ID NO: 104821 - DNA, 20 bp, synthetic construct
  misc_feature 1..20: note = CRISPR gRNA sequence
  source 1..20: mol_type = other DNA
cctataaaaattactttttg

SEQ ID NO: 104822 - DNA, 20 bp, synthetic construct
  misc_feature 1..20: note = CRISPR gRNA sequence
  source 1..20: mol_type = other DNA
tgtggcatttacaaaaaaaa

SEQ ID NO: 104823 - DNA, 20 bp, synthetic construct
  misc_feature 1..20: note = CRISPR gRNA sequence
  source 1..20: mol_type = other DNA
atttacaaaaaaaatggatg

SEQ ID NO: 104824 - DNA, 20 bp, synthetic construct
  misc_feature 1..20: note = CRISPR gRNA sequence
  source 1..20: mol_type = other DNA
ttacaaaaaaaatggatgaa

SEQ ID NO: 104825 - DNA, 20 bp, synthetic construct
  misc_feature 1..20: note = CRISPR gRNA sequence
  source 1..20: mol_type = other DNA
tacaaaaaaaatggatgaag

SEQ ID NO: 104826 - DNA, 20 bp, synthetic construct
  misc_feature 1..20: note = CRISPR gRNA sequence
  source 1..20: mol_type = other DNA
aaaatggatgaagaggaacc

SEQ ID NO: 104827 - DNA, 20 bp, synthetic construct
  misc_feature 1..20: note = CRISPR gRNA sequence
  source 1..20: mol_type = other DNA
ccatacttcatgccaccaat

SEQ ID NO: 104828 - DNA, 20 bp, synthetic construct
  misc_feature 1..20: note = CRISPR gRNA sequence
  source 1..20: mol_type = other DNA
ttcatgccaccaataagctc

SEQ ID NO: 104829 - DNA, 20 bp, synthetic construct
  misc_feature 1..20: note = CRISPR gRNA sequence
  source 1..20: mol_type = other DNA
gctctggtttcctgttcaca

SEQ ID NO: 104830 - DNA, 20 bp, synthetic construct
  misc_feature 1..20: note = CRISPR gRNA sequence
  source 1..20: mol_type = other DNA
tggtttcctgttcacacaga

SEQ ID NO: 104831 - DNA, 20 bp, synthetic construct
  misc_feature 1..20: note = CRISPR gRNA sequence
  source 1..20: mol_type = other DNA
ctgttcacacagatggttcc

SEQ ID NO: 104832 - DNA, 20 bp, synthetic construct
  misc_feature 1..20: note = CRISPR gRNA sequence
  source 1..20: mol_type = other DNA
tgttcacacagatggttcct

SEQ ID NO: 104833 - DNA, 20 bp, synthetic construct
  misc_feature 1..20: note = CRISPR gRNA sequence
  source 1..20: mol_type = other DNA
gttcacacagatggttcctg

SEQ ID NO: 104834 - DNA, 20 bp, synthetic construct
  misc_feature 1..20: note = CRISPR gRNA sequence
  source 1..20: mol_type = other DNA
acacagatggttcctggggc

SEQ ID NO: 104835 - DNA, 20 bp, synthetic construct
  misc_feature 1..20: note = CRISPR gRNA sequence
  source 1..20: mol_type = other DNA
ggctctgtgcctgctatcca

SEQ ID NO: 104836 - DNA, 20 bp, synthetic construct
  misc_feature 1..20: note = CRISPR gRNA sequence
  source 1..20: mol_type = other DNA
atccaaagaatccctctacc

SEQ ID NO: 104837 - DNA, 20 bp, synthetic construct
  misc_feature 1..20: note = CRISPR gRNA sequence
  source 1..20: mol_type = other DNA
ccaaagaatccctctacctg

SEQ ID NO: 104838 - DNA, 20 bp, synthetic construct
  misc_feature 1..20: note = CRISPR gRNA sequence
  source 1..20: mol_type = other DNA
aagaatccctctacctggag

SEQ ID NO: 104839 - DNA, 20 bp, synthetic construct
  misc_feature 1..20: note = CRISPR gRNA sequence
  source 1..20: mol_type = other DNA
gaatccctctacctggagca

SEQ ID NO: 104840 - DNA, 20 bp, synthetic construct
  misc_feature 1..20: note = CRISPR gRNA sequence
  source 1..20: mol_type = other DNA
acctggagcagagatgcttg

SEQ ID NO: 104841 - DNA, 20 bp, synthetic construct
  misc_feature 1..20: note = CRISPR gRNA sequence
  source 1..20: mol_type = other DNA
tggagcagagatgcttgaag

SEQ ID NO: 104842 - DNA, 20 bp, synthetic construct
  misc_feature 1..20: note = CRISPR gRNA sequence
  source 1..20: mol_type = other DNA
gagcagagatgcttgaagaa

SEQ ID NO: 104843 - DNA, 20 bp, synthetic construct
  misc_feature 1..20: note = CRISPR gRNA sequence
  source 1..20: mol_type = other DNA
aacaataccaccgtattctt

SEQ ID NO: 104844 - DNA, 20 bp, synthetic construct
  misc_feature 1..20: note = CRISPR gRNA sequence
  source 1..20: mol_type = other DNA
caataccaccgtattcttaa

SEQ ID NO: 104845 - DNA, 20 bp, synthetic construct
  misc_feature 1..20: note = CRISPR gRNA sequence
  source 1..20: mol_type = other DNA
aataccaccgtattcttaag

SEQ ID NO: 104846 - DNA, 20 bp, synthetic construct
  misc_feature 1..20: note = CRISPR gRNA sequence
  source 1..20: mol_type = other DNA
taccaccgtattcttaagag

SEQ ID NO: 104847 - DNA, 20 bp, synthetic construct
  misc_feature 1..20: note = CRISPR gRNA sequence
  source 1..20: mol_type = other DNA
accaccgtattcttaagagg

SEQ ID NO: 104848 - DNA, 20 bp, synthetic construct
  misc_feature 1..20: note = CRISPR gRNA sequence
  source 1..20: mol_type = other DNA
ccgtattcttaagaggaggc

SEQ ID NO: 104849 - DNA, 20 bp, synthetic construct
  misc_feature 1..20: note = CRISPR gRNA sequence
  source 1..20: mol_type = other DNA
tcttaagaggaggcaagccc

SEQ ID NO: 104850 - DNA, 20 bp, synthetic construct
  misc_feature 1..20: note = CRISPR gRNA sequence
  source 1..20: mol_type = other DNA
gaggcaagcccgagctaaac

SEQ ID NO: 104851 - DNA, 20 bp, synthetic construct
  misc_feature 1..20: note = CRISPR gRNA sequence
  source 1..20: mol_type = other DNA
ggcaagcccgagctaaacta

SEQ ID NO: 104852 - DNA, 20 bp, synthetic construct
  misc_feature 1..20: note = CRISPR gRNA sequence
  source 1..20: mol_type = other DNA
gcaagcccgagctaaactag

SEQ ID NO: 104853 - DNA, 20 bp, synthetic construct
  misc_feature 1..20: note = CRISPR gRNA sequence
  source 1..20: mol_type = other DNA
agcccgagctaaactagagg

SEQ ID NO: 104854 - DNA, 20 bp, synthetic construct
  misc_feature 1..20: note = CRISPR gRNA sequence
  source 1..20: mol_type = other DNA
ccgagctaaactagaggcag

SEQ ID NO: 104855 - DNA, 20 bp, synthetic construct
  misc_feature 1..20: note = CRISPR gRNA sequence
  source 1..20: mol_type = other DNA
cgagctaaactagaggcaga

SEQ ID NO: 104856 - DNA, 20 bp, synthetic construct
  misc_feature 1..20: note = CRISPR gRNA sequence
  source 1..20: mol_type = other DNA
gagctaaactagaggcagaa

SEQ ID NO: 104857 - DNA, 20 bp, synthetic construct
  misc_feature 1..20: note = CRISPR gRNA sequence
  source 1..20: mol_type = other DNA
aggcagaagggaaaattcca

SEQ ID NO: 104858 - DNA, 20 bp, synthetic construct
  misc_feature 1..20: note = CRISPR gRNA sequence
  source 1..20: mol_type = other DNA
ggcagaagggaaaattccaa

SEQ ID NO: 104859 - DNA, 20 bp, synthetic construct
  misc_feature 1..20: note = CRISPR gRNA sequence
  source 1..20: mol_type = other DNA
cagaagggaaaattccaaag

SEQ ID NO: 104860 - DNA, 20 bp, synthetic construct
  misc_feature 1..20: note = CRISPR gRNA sequence
  source 1..20: mol_type = other DNA
gaagggaaaattccaaagga

SEQ ID NO: 104861 - DNA, 20 bp, synthetic construct
  misc_feature 1..20: note = CRISPR gRNA sequence
  source 1..20: mol_type = other DNA
gggaaaattccaaaggagag

SEQ ID NO: 104862 - DNA, 20 bp, synthetic construct
  misc_feature 1..20: note = CRISPR gRNA sequence
  source 1..20: mol_type = other DNA
ggaaaattccaaaggagaga

SEQ ID NO: 104863 - DNA, 20 bp, synthetic construct
  misc_feature 1..20: note = CRISPR gRNA sequence
  source 1..20: mol_type = other DNA
gaaaattccaaaggagagaa

SEQ ID NO: 104864 - DNA, 20 bp, synthetic construct
  misc_feature 1..20: note = CRISPR gRNA sequence
  source 1..20: mol_type = other DNA
gagaagggtatgtataacat

SEQ ID NO: 104865 - DNA, 20 bp, synthetic construct
  misc_feature 1..20: note = CRISPR gRNA sequence
  source 1..20: mol_type = other DNA
agaagggtatgtataacatt

SEQ ID NO: 104866 - DNA, 20 bp, synthetic construct
  misc_feature 1..20: note = CRISPR gRNA sequence
  source 1..20: mol_type = other DNA
agggtatgtataacattggg

SEQ ID NO: 104867 - DNA, 20 bp, synthetic construct
  misc_feature 1..20: note = CRISPR gRNA sequence
  source 1..20: mol_type = other DNA
gggtatgtataacattggga

SEQ ID NO: 104868 - DNA, 20 bp, synthetic construct
  misc_feature 1..20: note = CRISPR gRNA sequence
  source 1..20: mol_type = other DNA
gtataacattgggaaggata

SEQ ID NO: 104869 - DNA, 20 bp, synthetic construct
  misc_feature 1..20: note = CRISPR gRNA sequence
  source 1..20: mol_type = other DNA
tataacattgggaaggatat

SEQ ID NO: 104870 - DNA, 20 bp, synthetic construct
  misc_feature 1..20: note = CRISPR gRNA sequence
  source 1..20: mol_type = other DNA
acattgggaaggatatagga

SEQ ID NO: 104871 - DNA, 20 bp, synthetic construct
  misc_feature 1..20: note = CRISPR gRNA sequence
  source 1..20: mol_type = other DNA
cattgggaaggatataggaa

SEQ ID NO: 104872 - DNA, 20 bp, synthetic construct
  misc_feature 1..20: note = CRISPR gRNA sequence
  source 1..20: mol_type = other DNA
ttgggaaggatataggaaag

SEQ ID NO: 104873 - DNA, 20 bp, synthetic construct
  misc_feature 1..20: note = CRISPR gRNA sequence
  source 1..20: mol_type = other DNA
aaggatataggaaaggagaa

SEQ ID NO: 104874 - DNA, 20 bp, synthetic construct
  misc_feature 1..20: note = CRISPR gRNA sequence
  source 1..20: mol_type = other DNA
gatataggaaaggagaatag

SEQ ID NO: 104875 - DNA, 20 bp, synthetic construct
  misc_feature 1..20: note = CRISPR gRNA sequence
  source 1..20: mol_type = other DNA
atataggaaaggagaatagc

SEQ ID NO: 104876 - DNA, 20 bp, synthetic construct
  misc_feature 1..20: note = CRISPR gRNA sequence
  source 1..20: mol_type = other DNA
tataggaaaggagaatagca

SEQ ID NO: 104877 - DNA, 20 bp, synthetic construct
  misc_feature 1..20: note = CRISPR gRNA sequence
  source 1..20: mol_type = other DNA
ttttgaaattatcttttata

SEQ ID NO: 104878 - DNA, 20 bp, synthetic construct
  misc_feature 1..20: note = CRISPR gRNA sequence
  source 1..20: mol_type = other DNA
accttccaaacaattgacgt

SEQ ID NO: 104879 - DNA, 20 bp, synthetic construct
  misc_feature 1..20: note = CRISPR gRNA sequence
  source 1..20: mol_type = other DNA
atacttgttgtctcttttgt

SEQ ID NO: 104880 - DNA, 20 bp, synthetic construct
  misc_feature 1..20: note = CRISPR gRNA sequence
  source 1..20: mol_type = other DNA
acttgttgtctcttttgtaa

SEQ ID NO: 104881 - DNA, 20 bp, synthetic construct
  misc_feature 1..20: note = CRISPR gRNA sequence
  source 1..20: mol_type = other DNA
gttgtctcttttgtaagagt

SEQ ID NO: 104882 - DNA, 20 bp, synthetic construct
  misc_feature 1..20: note = CRISPR gRNA sequence
  source 1..20: mol_type = other DNA
catttgttattactaatatg

SEQ ID NO: 104883 - DNA, 20 bp, synthetic construct
  misc_feature 1..20: note = CRISPR gRNA sequence
  source 1..20: mol_type = other DNA
ttattactaatatgcagctg

SEQ ID NO: 104884 - DNA, 20 bp, synthetic construct
  misc_feature 1..20: note = CRISPR gRNA sequence
  source 1..20: mol_type = other DNA
gttataataacgaaaacaaa

SEQ ID NO: 104885 - DNA, 20 bp, synthetic construct
  misc_feature 1..20: note = CRISPR gRNA sequence
  source 1..20: mol_type = other DNA
ataataacgaaaacaaacag

SEQ ID NO: 104886 - DNA, 20 bp, synthetic construct
  misc_feature 1..20: note = CRISPR gRNA sequence
  source 1..20: mol_type = other DNA
aaacaaacagtggcttaaat

SEQ ID NO: 104887 - DNA, 20 bp, synthetic construct
  misc_feature 1..20: note = CRISPR gRNA sequence
  source 1..20: mol_type = other DNA
ttattccttttcatacataa

SEQ ID NO: 104888 - DNA, 20 bp, synthetic construct
  misc_feature 1..20: note = CRISPR gRNA sequence
  source 1..20: mol_type = other DNA
ttccttttcatacataaaag

SEQ ID NO: 104889 - DNA, 20 bp, synthetic construct
  misc_feature 1..20: note = CRISPR gRNA sequence
  source 1..20: mol_type = other DNA
tttcatacataaaagtagtc

SEQ ID NO: 104890 - DNA, 20 bp, synthetic construct
  misc_feature 1..20: note = CRISPR gRNA sequence
  source 1..20: mol_type = other DNA
tcatacataaaagtagtcca

SEQ ID NO: 104891 - DNA, 20 bp, synthetic construct
  misc_feature 1..20: note = CRISPR gRNA sequence
  source 1..20: mol_type = other DNA
agtccagagataaattatcc

SEQ ID NO: 104892 - DNA, 20 bp, synthetic construct
  misc_feature 1..20: note = CRISPR gRNA sequence
  source 1..20: mol_type = other DNA
agagataaattatcctggac

SEQ ID NO: 104893 - DNA, 20 bp, synthetic construct
  misc_feature 1..20: note = CRISPR gRNA sequence
  source 1..20: mol_type = other DNA
gataaattatcctggactgg

SEQ ID NO: 104894 - DNA, 20 bp, synthetic construct
  misc_feature 1..20: note = CRISPR gRNA sequence
  source 1..20: mol_type = other DNA
ggactggtagcacattttca

SEQ ID NO: 104895 - DNA, 20 bp, synthetic construct
  misc_feature 1..20: note = CRISPR gRNA sequence
  source 1..20: mol_type = other DNA
agcacattttcacagttctc

SEQ ID NO: 104896 - DNA, 20 bp, synthetic construct
  misc_feature 1..20: note = CRISPR gRNA sequence
  source 1..20: mol_type = other DNA
tttcactgctttaatattgc

SEQ ID NO: 104897 - DNA, 20 bp, synthetic construct
  misc_feature 1..20: note = CRISPR gRNA sequence
  source 1..20: mol_type = other DNA
tattgctagtgtgctgttca

SEQ ID NO: 104898 - DNA, 20 bp, synthetic construct
  misc_feature 1..20: note = CRISPR gRNA sequence
  source 1..20: mol_type = other DNA
tagtgtgctgttcatggtcc

SEQ ID NO: 104899 - DNA, 20 bp, synthetic construct
  misc_feature 1..20: note = CRISPR gRNA sequence
  source 1..20: mol_type = other DNA
catggtccaagattcctgct

SEQ ID NO: 104900 - DNA, 20 bp, synthetic construct
  misc_feature 1..20: note = CRISPR gRNA sequence
  source 1..20: mol_type = other DNA
atggtccaagattcctgctt

SEQ ID NO: 104901 - DNA, 20 bp, synthetic construct
  misc_feature 1..20: note = CRISPR gRNA sequence
  source 1..20: mol_type = other DNA
caagattcctgcttaggctc

SEQ ID NO: 104902 - DNA, 20 bp, synthetic construct
  misc_feature 1..20: note = CRISPR gRNA sequence
  source 1..20: mol_type = other DNA
ttcctgcttaggctccagcc

SEQ ID NO: 104903 - DNA, 20 bp, synthetic construct
  misc_feature 1..20: note = CRISPR gRNA sequence
  source 1..20: mol_type = other DNA
tcctgcttaggctccagcct

SEQ ID NO: 104904 - DNA, 20 bp, synthetic construct
  misc_feature 1..20: note = CRISPR gRNA sequence
  source 1..20: mol_type = other DNA
tgcttaggctccagcctagg

SEQ ID NO: 104905 - DNA, 20 bp, synthetic construct
  misc_feature 1..20: note = CRISPR gRNA sequence
  source 1..20: mol_type = other DNA
taggctccagcctaggaaga

SEQ ID NO: 104906 - DNA, 20 bp, synthetic construct
  misc_feature 1..20: note = CRISPR gRNA sequence
  source 1..20: mol_type = other DNA
aggctccagcctaggaagaa

SEQ ID NO: 104907 - DNA, 20 bp, synthetic construct
  misc_feature 1..20: note = CRISPR gRNA sequence
  source 1..20: mol_type = other DNA
ggctccagcctaggaagaaa

SEQ ID NO: 104908 - DNA, 20 bp, synthetic construct
  misc_feature 1..20: note = CRISPR gRNA sequence
  source 1..20: mol_type = other DNA
agcctaggaagaaagggaac

SEQ ID NO: 104909 - DNA, 20 bp, synthetic construct
  misc_feature 1..20: note = CRISPR gRNA sequence
  source 1..20: mol_type = other DNA
taggaagaaagggaacaaga

SEQ ID NO: 104910 - DNA, 20 bp, synthetic construct
  misc_feature 1..20: note = CRISPR gRNA sequence
  source 1..20: mol_type = other DNA
aggaagaaagggaacaagaa

SEQ ID NO: 104911 - DNA, 20 bp, synthetic construct
  misc_feature 1..20: note = CRISPR gRNA sequence
  source 1..20: mol_type = other DNA
ttcttttttttttttttcct

SEQ ID NO: 104912 - DNA, 20 bp, synthetic construct
  misc_feature 1..20: note = CRISPR gRNA sequence
  source 1..20: mol_type = other DNA
tttttttttttcctgagact

SEQ ID NO: 104913 - DNA, 20 bp, synthetic construct
  misc_feature 1..20: note = CRISPR gRNA sequence
  source 1..20: mol_type = other DNA
ctcagtcttgctctgtcatc

SEQ ID NO: 104914 - DNA, 20 bp, synthetic construct
  misc_feature 1..20: note = CRISPR gRNA sequence
  source 1..20: mol_type = other DNA
tcagtcttgctctgtcatcc

SEQ ID NO: 104915 - DNA, 20 bp, synthetic construct
  misc_feature 1..20: note = CRISPR gRNA sequence
  source 1..20: mol_type = other DNA
tcttgctctgtcatccaggc

SEQ ID NO: 104916 - DNA, 20 bp, synthetic construct
  misc_feature 1..20: note = CRISPR gRNA sequence
  source 1..20: mol_type = other DNA
ttgctctgtcatccaggccg

SEQ ID NO: 104917 - DNA, 20 bp, synthetic construct
  misc_feature 1..20: note = CRISPR gRNA sequence
  source 1..20: mol_type = other DNA
ctgtcatccaggccggagtg

SEQ ID NO: 104918 - DNA, 20 bp, synthetic construct
  misc_feature 1..20: note = CRISPR gRNA sequence
  source 1..20: mol_type = other DNA
tcatccaggccggagtgcag

SEQ ID NO: 104919 - DNA, 20 bp, synthetic construct
  misc_feature 1..20: note = CRISPR gRNA sequence
  source 1..20: mol_type = other DNA
ggagtgcagtggcacaatct

SEQ ID NO: 104920 - DNA, 20 bp, synthetic construct
  misc_feature 1..20: note = CRISPR gRNA sequence
  source 1..20: mol_type = other DNA
aacctgcaccttccatgttc

SEQ ID NO: 104921 - DNA, 20 bp, synthetic construct
  misc_feature 1..20: note = CRISPR gRNA sequence
  source 1..20: mol_type = other DNA
ttcaagtgattctcctgcct

SEQ ID NO: 104922 - DNA, 20 bp, synthetic construct
  misc_feature 1..20: note = CRISPR gRNA sequence
  source 1..20: mol_type = other DNA
ttctcctgcctcagcctcct

SEQ ID NO: 104923 - DNA, 20 bp, synthetic construct
  misc_feature 1..20: note = CRISPR gRNA sequence
  source 1..20: mol_type = other DNA
tcctgcctcagcctcctgag

SEQ ID NO: 104924 - DNA, 20 bp, synthetic construct
  misc_feature 1..20: note = CRISPR gRNA sequence
  source 1..20: mol_type = other DNA
gcctcagcctcctgagtagc

SEQ ID NO: 104925 - DNA, 20 bp, synthetic construct
  misc_feature 1..20: note = CRISPR gRNA sequence
  source 1..20: mol_type = other DNA
cctcagcctcctgagtagct

SEQ ID NO: 104926 - DNA, 20 bp, synthetic construct
  misc_feature 1..20: note = CRISPR gRNA sequence
  source 1..20: mol_type = other DNA
ctcctgagtagctgggatta

SEQ ID NO: 104927 - DNA, 20 bp, synthetic construct
  misc_feature 1..20: note = CRISPR gRNA sequence
  source 1..20: mol_type = other DNA
tcctgagtagctgggattac

SEQ ID NO: 104928 - DNA, 20 bp, synthetic construct
  misc_feature 1..20: note = CRISPR gRNA sequence
  source 1..20: mol_type = other DNA
caggtgtgcgccaccacgcc

SEQ ID NO: 104929 - DNA, 20 bp, synthetic construct
  misc_feature 1..20: note = CRISPR gRNA sequence
  source 1..20: mol_type = other DNA
ccagcttatttttgtgtttt

SEQ ID NO: 104930 - DNA, 20 bp, synthetic construct
  misc_feature 1..20: note = CRISPR gRNA sequence
  source 1..20: mol_type = other DNA
gcttatttttgtgtttttag

SEQ ID NO: 104931 - DNA, 20 bp, synthetic construct
  misc_feature 1..20: note = CRISPR gRNA sequence
  source 1..20: mol_type = other DNA
ttatttttgtgtttttagta

SEQ ID NO: 104932 - DNA, 20 bp, synthetic construct
  misc_feature 1..20: note = CRISPR gRNA sequence
  source 1..20: mol_type = other DNA
ttttgtgtttttagtagaga

SEQ ID NO: 104933 - DNA, 20 bp, synthetic construct
  misc_feature 1..20: note = CRISPR gRNA sequence
  source 1..20: mol_type = other DNA
tttgtgtttttagtagagac

SEQ ID NO: 104934 - DNA, 20 bp, synthetic construct
  misc_feature 1..20: note = CRISPR gRNA sequence
  source 1..20: mol_type = other DNA
ttgtgtttttagtagagacg

SEQ ID NO: 104935 - DNA, 20 bp, synthetic construct
  misc_feature 1..20: note = CRISPR gRNA sequence
  source 1..20: mol_type = other DNA
gagacggggtttcaccatgt

SEQ ID NO: 104936 - DNA, 20 bp, synthetic construct
  misc_feature 1..20: note = CRISPR gRNA sequence
  source 1..20: mol_type = other DNA
cggggtttcaccatgttggc

SEQ ID NO: 104937 - DNA, 20 bp, synthetic construct
  misc_feature 1..20: note = CRISPR gRNA sequence
  source 1..20: mol_type = other DNA
ggggtttcaccatgttggcc

SEQ ID NO: 104938 - DNA, 20 bp, synthetic construct
  misc_feature 1..20: note = CRISPR gRNA sequence
  source 1..20: mol_type = other DNA
tttcaccatgttggccaggc

SEQ ID NO: 104939 - DNA, 20 bp, synthetic construct
  misc_feature 1..20: note = CRISPR gRNA sequence
  source 1..20: mol_type = other DNA
tggtctcgaactcctgacct

SEQ ID NO: 104940 - DNA, 20 bp, synthetic construct
  misc_feature 1..20: note = CRISPR gRNA sequence
  source 1..20: mol_type = other DNA
ggtctcgaactcctgacctc

SEQ ID NO: 104941 - DNA, 20 bp, synthetic construct
  misc_feature 1..20: note = CRISPR gRNA sequence
  source 1..20: mol_type = other DNA
cctcaggtgatccacctgcc

SEQ ID NO: 104942 - DNA, 20 bp, synthetic construct
  misc_feature 1..20: note = CRISPR gRNA sequence
  source 1..20: mol_type = other DNA
ctcaggtgatccacctgcct

SEQ ID NO: 104943 - DNA, 20 bp, synthetic construct
  misc_feature 1..20: note = CRISPR gRNA sequence
  source 1..20: mol_type = other DNA
ccacctgcctgggcctccca

SEQ ID NO: 104944 - DNA, 20 bp, synthetic construct
  misc_feature 1..20: note = CRISPR gRNA sequence
  source 1..20: mol_type = other DNA
gcctgggcctcccaaagtgc

SEQ ID NO: 104945 - DNA, 20 bp, synthetic construct
  misc_feature 1..20: note = CRISPR gRNA sequence
  source 1..20: mol_type = other DNA
cctgggcctcccaaagtgcc

SEQ ID NO: 104946 - DNA, 20 bp, synthetic construct
  misc_feature 1..20: note = CRISPR gRNA sequence
  source 1..20: mol_type = other DNA
ctcccaaagtgccgggatta

SEQ ID NO: 104947 - DNA, 20 bp, synthetic construct
  misc_feature 1..20: note = CRISPR gRNA sequence
  source 1..20: mol_type = other DNA
tcccaaagtgccgggattat

SEQ ID NO: 104948 - DNA, 20 bp, synthetic construct
  misc_feature 1..20: note = CRISPR gRNA sequence
  source 1..20: mol_type = other DNA
agtgccgggattataggcgt

SEQ ID NO: 104949 - DNA, 20 bp, synthetic construct
  misc_feature 1..20: note = CRISPR gRNA sequence
  source 1..20: mol_type = other DNA
taggcgtgagccaccatacc

SEQ ID NO: 104950 - DNA, 20 bp, synthetic construct
  misc_feature 1..20: note = CRISPR gRNA sequence
  source 1..20: mol_type = other DNA
cgtgagccaccatacccggc

SEQ ID NO: 104951 - DNA, 20 bp, synthetic construct
  misc_feature 1..20: note = CRISPR gRNA sequence
  source 1..20: mol_type = other DNA
gtgagccaccatacccggcc

SEQ ID NO: 104952 - DNA, 20 bp, synthetic construct
  misc_feature 1..20: note = CRISPR gRNA sequence
  source 1..20: mol_type = other DNA
ggccaggtaccctttctttc

SEQ ID NO: 104953 - DNA, 20 bp, synthetic construct
  misc_feature 1..20: note = CRISPR gRNA sequence
  source 1..20: mol_type = other DNA
gccaggtaccctttctttca

SEQ ID NO: 104954 - DNA, 20 bp, synthetic construct
  misc_feature 1..20: note = CRISPR gRNA sequence
  source 1..20: mol_type = other DNA
tttctttcaaggaaactttg

SEQ ID NO: 104955 - DNA, 20 bp, synthetic construct
  misc_feature 1..20: note = CRISPR gRNA sequence
  source 1..20: mol_type = other DNA
ctttcaaggaaactttgaag

SEQ ID NO: 104956 - DNA, 20 bp, synthetic construct
  misc_feature 1..20: note = CRISPR gRNA sequence
  source 1..20: mol_type = other DNA
agaagttgtgtaccttccac

SEQ ID NO: 104957 - DNA, 20 bp, synthetic construct
  misc_feature 1..20: note = CRISPR gRNA sequence
  source 1..20: mol_type = other DNA
gttgtgtaccttccactagc

SEQ ID NO: 104958 - DNA, 20 bp, synthetic construct
  misc_feature 1..20: note = CRISPR gRNA sequence
  source 1..20: mol_type = other DNA
accttccactagccggaatt

SEQ ID NO: 104959 - DNA, 20 bp, synthetic construct
  misc_feature 1..20: note = CRISPR gRNA sequence
  source 1..20: mol_type = other DNA
acctgatcacacctaacatg

SEQ ID NO: 104960 - DNA, 20 bp, synthetic construct
  misc_feature 1..20: note = CRISPR gRNA sequence
  source 1..20: mol_type = other DNA
atcacacctaacatgcagat

SEQ ID NO: 104961 - DNA, 20 bp, synthetic construct
  misc_feature 1..20: note = CRISPR gRNA sequence
  source 1..20: mol_type = other DNA
tcacacctaacatgcagata

SEQ ID NO: 104962 - DNA, 20 bp, synthetic construct
  misc_feature 1..20: note = CRISPR gRNA sequence
  source 1..20: mol_type = other DNA
acctaacatgcagataaggc

SEQ ID NO: 104963 - DNA, 20 bp, synthetic construct
  misc_feature 1..20: note = CRISPR gRNA sequence
  source 1..20: mol_type = other DNA
cctaacatgcagataaggct

SEQ ID NO: 104964 - DNA, 20 bp, synthetic construct
  misc_feature 1..20: note = CRISPR gRNA sequence
  source 1..20: mol_type = other DNA
acatgcagataaggctagga

SEQ ID NO: 104965 - DNA, 20 bp, synthetic construct
  misc_feature 1..20: note = CRISPR gRNA sequence
  source 1..20: mol_type = other DNA
cagataaggctaggaaagtc

SEQ ID NO: 104966 - DNA, 20 bp, synthetic construct
  misc_feature 1..20: note = CRISPR gRNA sequence
  source 1..20: mol_type = other DNA
aaggctaggaaagtccagcc

SEQ ID NO: 104967 - DNA, 20 bp, synthetic construct
  misc_feature 1..20: note = CRISPR gRNA sequence
  source 1..20: mol_type = other DNA
taggaaagtccagcctggtg

SEQ ID NO: 104968 - DNA, 20 bp, synthetic construct
  misc_feature 1..20: note = CRISPR gRNA sequence
  source 1..20: mol_type = other DNA
gaaagtccagcctggtgtgg

SEQ ID NO: 104969 - DNA, 20 bp, synthetic construct
  misc_feature 1..20: note = CRISPR gRNA sequence
  source 1..20: mol_type = other DNA
ggtgtggtggcaaatgcctg

SEQ ID NO: 104970 - DNA, 20 bp, synthetic construct
  misc_feature 1..20: note = CRISPR gRNA sequence
  source 1..20: mol_type = other DNA
caaatgcctgtagtcctact

SEQ ID NO: 104971 - DNA, 20 bp, synthetic construct
  misc_feature 1..20: note = CRISPR gRNA sequence
  source 1..20: mol_type = other DNA
atgcctgtagtcctacttgg

SEQ ID NO: 104972 - DNA, 20 bp, synthetic construct
  misc_feature 1..20: note = CRISPR gRNA sequence
  source 1..20: mol_type = other DNA
tgcctgtagtcctacttgga

SEQ ID NO: 104973 - DNA, 20 bp, synthetic construct
  misc_feature 1..20: note = CRISPR gRNA sequence
  source 1..20: mol_type = other DNA
ctgtagtcctacttggaagg

SEQ ID NO: 104974 - DNA, 20 bp, synthetic construct
  misc_feature 1..20: note = CRISPR gRNA sequence
  source 1..20: mol_type = other DNA
gtagtcctacttggaaggca

SEQ ID NO: 104975 - DNA, 20 bp, synthetic construct
  misc_feature 1..20: note = CRISPR gRNA sequence
  source 1..20: mol_type = other DNA
tagtcctacttggaaggcag

SEQ ID NO: 104976 - DNA, 20 bp, synthetic construct
  misc_feature 1..20: note = CRISPR gRNA sequence
  source 1..20: mol_type = other DNA
tcctacttggaaggcagagg

SEQ ID NO: 104977 - DNA, 20 bp, synthetic construct
  misc_feature 1..20: note = CRISPR gRNA sequence
  source 1..20: mol_type = other DNA
cctacttggaaggcagaggc

SEQ ID NO: 104978 - DNA, 20 bp, synthetic construct
  misc_feature 1..20: note = CRISPR gRNA sequence
  source 1..20: mol_type = other DNA
tacttggaaggcagaggcag

SEQ ID NO: 104979 - DNA, 20 bp, synthetic construct
  misc_feature 1..20: note = CRISPR gRNA sequence
  source 1..20: mol_type = other DNA
acttggaaggcagaggcagg

SEQ ID NO: 104980 - DNA, 20 bp, synthetic construct
  misc_feature 1..20: note = CRISPR gRNA sequence
  source 1..20: mol_type = other DNA
cagaggcaggaggatcacat

SEQ ID NO: 104981 - DNA, 20 bp, synthetic construct
  misc_feature 1..20: note = CRISPR gRNA sequence
  source 1..20: mol_type = other DNA
gcaggaggatcacatgagcc

SEQ ID NO: 104982 - DNA, 20 bp, synthetic construct
  misc_feature 1..20: note = CRISPR gRNA sequence
  source 1..20: mol_type = other DNA
caggaggatcacatgagccg

SEQ ID NO: 104983 - DNA, 20 bp, synthetic construct
  misc_feature 1..20: note = CRISPR gRNA sequence
  source 1..20: mol_type = other DNA
tcacatgagccgaggaattc

SEQ ID NO: 104984 - DNA, 20 bp, synthetic construct
  misc_feature 1..20: note = CRISPR gRNA sequence
  source 1..20: mol_type = other DNA
cacatgagccgaggaattca

SEQ ID NO: 104985 - DNA, 20 bp, synthetic construct
  misc_feature 1..20: note = CRISPR gRNA sequence
  source 1..20: mol_type = other DNA
agccgaggaattcaaggctg

SEQ ID NO: 104986 - DNA, 20 bp, synthetic construct
  misc_feature 1..20: note = CRISPR gRNA sequence
  source 1..20: mol_type = other DNA
gattcatgatcatgccactg

SEQ ID NO: 104987 - DNA, 20 bp, synthetic construct
  misc_feature 1..20: note = CRISPR gRNA sequence
  source 1..20: mol_type = other DNA
atcatgccactgcagtccaa

SEQ ID NO: 104988 - DNA, 20 bp, synthetic construct
  misc_feature 1..20: note = CRISPR gRNA sequence
  source 1..20: mol_type = other DNA
tgccactgcagtccaacagc

SEQ ID NO: 104989 - DNA, 20 bp, synthetic construct
  misc_feature 1..20: note = CRISPR gRNA sequence
  source 1..20: mol_type = other DNA
gccactgcagtccaacagca

SEQ ID NO: 104990 - DNA, 20 bp, synthetic construct
  misc_feature 1..20: note = CRISPR gRNA sequence
  source 1..20: mol_type = other DNA
ccactgcagtccaacagcaa

SEQ ID NO: 104991 - DNA, 20 bp, synthetic construct
  misc_feature 1..20: note = CRISPR gRNA sequence
  source 1..20: mol_type = other DNA
cagtccaacagcaagggtgt

SEQ ID NO: 104992 - DNA, 20 bp, synthetic construct
  misc_feature 1..20: note = CRISPR gRNA sequence
  source 1..20: mol_type = other DNA
gtccaacagcaagggtgtca

SEQ ID NO: 104993 - DNA, 20 bp, synthetic construct
  misc_feature 1..20: note = CRISPR gRNA sequence
  source 1..20: mol_type = other DNA
tcagagtgaaaccctgtttc

SEQ ID NO: 104994 - DNA, 20 bp, synthetic construct
  misc_feature 1..20: note = CRISPR gRNA sequence
  source 1..20: mol_type = other DNA
ataataataaactttaatgc

SEQ ID NO: 104995 - DNA, 20 bp, synthetic construct
  misc_feature 1..20: note = CRISPR gRNA sequence
  source 1..20: mol_type = other DNA
taataataaactttaatgct

SEQ ID NO: 104996 - DNA, 20 bp, synthetic construct
  misc_feature 1..20: note = CRISPR gRNA sequence
  source 1..20: mol_type = other DNA
aataaactttaatgctagga

SEQ ID NO: 104997 - DNA, 20 bp, synthetic construct
  misc_feature 1..20: note = CRISPR gRNA sequence
  source 1..20: mol_type = other DNA
tcatttgctcaaacgaaatt

SEQ ID NO: 104998 - DNA, 20 bp, synthetic construct
  misc_feature 1..20: note = CRISPR gRNA sequence
  source 1..20: mol_type = other DNA
cgaaatttggcctgttatta

SEQ ID NO: 104999 - DNA, 20 bp, synthetic construct
  misc_feature 1..20: note = CRISPR gRNA sequence
  source 1..20: mol_type = other DNA
aatttggcctgttattaaag

SEQ ID NO: 105000 - DNA, 20 bp, synthetic construct
  misc_feature 1..20: note = CRISPR gRNA sequence
  source 1..20: mol_type = other DNA
tttggcctgttattaaagca

SEQ ID NO: 105001 - DNA, 20 bp, synthetic construct
  misc_feature 1..20: note = CRISPR gRNA sequence
  source 1..20: mol_type = other DNA
ttggcctgttattaaagcag

SEQ ID NO: 105002 - DNA, 20 bp, synthetic construct
  misc_feature 1..20: note = CRISPR gRNA sequence
  source 1..20: mol_type = other DNA
cctgttattaaagcagagga

SEQ ID NO: 105003 - DNA, 20 bp, synthetic construct
  misc_feature 1..20: note = CRISPR gRNA sequence
  source 1..20: mol_type = other DNA
aggaaagtgtatatattgtg

SEQ ID NO: 105004 - DNA, 20 bp, synthetic construct
  misc_feature 1..20: note = CRISPR gRNA sequence
  source 1..20: mol_type = other DNA
agtgtatatattgtgaagtg

SEQ ID NO: 105005 - DNA, 20 bp, synthetic construct
  misc_feature 1..20: note = CRISPR gRNA sequence
  source 1..20: mol_type = other DNA
gtgtatatattgtgaagtgt

SEQ ID NO: 105006 - DNA, 20 bp, synthetic construct
  misc_feature 1..20: note = CRISPR gRNA sequence
  source 1..20: mol_type = other DNA
tatatattgtgaagtgtagg

SEQ ID NO: 105007 - DNA, 20 bp, synthetic construct
  misc_feature 1..20: note = CRISPR gRNA sequence
  source 1..20: mol_type = other DNA
atattgtgaagtgtaggtgg

SEQ ID NO: 105008 - DNA, 20 bp, synthetic construct
  misc_feature 1..20: note = CRISPR gRNA sequence
  source 1..20: mol_type = other DNA
ttaaaaaaaattcatactat

SEQ ID NO: 105009 - DNA, 20 bp, synthetic construct
  misc_feature 1..20: note = CRISPR gRNA sequence
  source 1..20: mol_type = other DNA
attcatactataagcattca

SEQ ID NO: 105010 - DNA, 20 bp, synthetic construct
  misc_feature 1..20: note = CRISPR gRNA sequence
  source 1..20: mol_type = other DNA
tataagcattcacagtctta

SEQ ID NO: 105011 - DNA, 20 bp, synthetic construct
  misc_feature 1..20: note = CRISPR gRNA sequence
  source 1..20: mol_type = other DNA
aagcattcacagtcttacag

SEQ ID NO: 105012 - DNA, 20 bp, synthetic construct
  misc_feature 1..20: note = CRISPR gRNA sequence
  source 1..20: mol_type = other DNA
agtcttacagtagttatata

SEQ ID NO: 105013 - DNA, 20 bp, synthetic construct
  misc_feature 1..20: note = CRISPR gRNA sequence
  source 1..20: mol_type = other DNA
ttacagtagttatatatggt

SEQ ID NO: 105014 - DNA, 20 bp, synthetic construct
  misc_feature 1..20: note = CRISPR gRNA sequence
  source 1..20: mol_type = other DNA
tggttagctatattacttac

SEQ ID NO: 105015 - DNA, 20 bp, synthetic construct
  misc_feature 1..20: note = CRISPR gRNA sequence
  source 1..20: mol_type = other DNA
ggttagctatattacttact

SEQ ID NO: 105016 - DNA, 20 bp, synthetic construct
  misc_feature 1..20: note = CRISPR gRNA sequence
  source 1..20: mol_type = other DNA
cttactaggtgttttctcca

SEQ ID NO: 105017 - DNA, 20 bp, synthetic construct
  misc_feature 1..20: note = CRISPR gRNA sequence
  source 1..20: mol_type = other DNA
aaagcttccatcgtcattct

SEQ ID NO: 105018 - DNA, 20 bp, synthetic construct
  misc_feature 1..20: note = CRISPR gRNA sequence
  source 1..20: mol_type = other DNA
gtcccttgtgactttgatcc

SEQ ID NO: 105019 - DNA, 20 bp, synthetic construct
  misc_feature 1..20: note = CRISPR gRNA sequence
  source 1..20: mol_type = other DNA
atcccagctgtcttaaactt

SEQ ID NO: 105020 - DNA, 20 bp, synthetic construct
  misc_feature 1..20: note = CRISPR gRNA sequence
  source 1..20: mol_type = other DNA
cccagctgtcttaaactttg

SEQ ID NO: 105021 - DNA, 20 bp, synthetic construct
  misc_feature 1..20: note = CRISPR gRNA sequence
  source 1..20: mol_type = other DNA
ctgtcttaaactttggagaa

SEQ ID NO: 105022 - DNA, 20 bp, synthetic construct
  misc_feature 1..20: note = CRISPR gRNA sequence
  source 1..20: mol_type = other DNA
ggagaatggaatttgtgcac

SEQ ID NO: 105023 - DNA, 20 bp, synthetic construct
  misc_feature 1..20: note = CRISPR gRNA sequence
  source 1..20: mol_type = other DNA
tgtgcactagataactgtgc

SEQ ID NO: 105024 - DNA, 20 bp, synthetic construct
  misc_feature 1..20: note = CRISPR gRNA sequence
  source 1..20: mol_type = other DNA
ctagataactgtgctggttc

SEQ ID NO: 105025 - DNA, 20 bp, synthetic construct
  misc_feature 1..20: note = CRISPR gRNA sequence
  source 1..20: mol_type = other DNA
ataactgtgctggttctgga

SEQ ID NO: 105026 - DNA, 20 bp, synthetic construct
  misc_feature 1..20: note = CRISPR gRNA sequence
  source 1..20: mol_type = other DNA
ctggttctggatagtattaa

SEQ ID NO: 105027 - DNA, 20 bp, synthetic construct
  misc_feature 1..20: note = CRISPR gRNA sequence
  source 1..20: mol_type = other DNA
ggatagtattaatagttaaa

SEQ ID NO: 105028 - DNA, 20 bp, synthetic construct
  misc_feature 1..20: note = CRISPR gRNA sequence
  source 1..20: mol_type = other DNA
aatggttttatttctcgttt

SEQ ID NO: 105029 - DNA, 20 bp, synthetic construct
  misc_feature 1..20: note = CRISPR gRNA sequence
  source 1..20: mol_type = other DNA
cgttttagaaatacctgcat

SEQ ID NO: 105030 - DNA, 20 bp, synthetic construct
  misc_feature 1..20: note = CRISPR gRNA sequence
  source 1..20: mol_type = other DNA
agaaatacctgcatgagtct

SEQ ID NO: 105031 - DNA, 20 bp, synthetic construct
  misc_feature 1..20: note = CRISPR gRNA sequence
  source 1..20: mol_type = other DNA
gtctcggcaccgtcatgcca

SEQ ID NO: 105032 - DNA, 20 bp, synthetic construct
  misc_feature 1..20: note = CRISPR gRNA sequence
  source 1..20: mol_type = other DNA
ggcaccgtcatgccatggca

SEQ ID NO: 105033 - DNA, 20 bp, synthetic construct
  misc_feature 1..20: note = CRISPR gRNA sequence
  source 1..20: mol_type = other DNA
accgtcatgccatggcacgg

SEQ ID NO: 105034 - DNA, 20 bp, synthetic construct
  misc_feature 1..20: note = CRISPR gRNA sequence
  source 1..20: mol_type = other DNA
catgccatggcacggaagcg

SEQ ID NO: 105035 - DNA, 20 bp, synthetic construct
  misc_feature 1..20: note = CRISPR gRNA sequence
  source 1..20: mol_type = other DNA
catggcacggaagcgtggtg

SEQ ID NO: 105036 - DNA, 20 bp, synthetic construct
  misc_feature 1..20: note = CRISPR gRNA sequence
  source 1..20: mol_type = other DNA
atggcacggaagcgtggtga

SEQ ID NO: 105037 - DNA, 20 bp, synthetic construct
  misc_feature 1..20: note = CRISPR gRNA sequence
  source 1..20: mol_type = other DNA
gcacggaagcgtggtgaagg

SEQ ID NO: 105038 - DNA, 20 bp, synthetic construct
  misc_feature 1..20: note = CRISPR gRNA sequence
  source 1..20: mol_type = other DNA
gtggacgatttttctctcca

SEQ ID NO: 105039 - DNA, 20 bp, synthetic construct
  misc_feature 1..20: note = CRISPR gRNA sequence
  source 1..20: mol_type = other DNA
tggacgatttttctctccaa

SEQ ID NO: 105040 - DNA, 20 bp, synthetic construct
  misc_feature 1..20: note = CRISPR gRNA sequence
  source 1..20: mol_type = other DNA
gatttttctctccaaaggaa

SEQ ID NO: 105041 - DNA, 20 bp, synthetic construct
  misc_feature 1..20: note = CRISPR gRNA sequence
  source 1..20: mol_type = other DNA
atttttctctccaaaggaaa

SEQ ID NO: 105042 - DNA, 20 bp, synthetic construct
  misc_feature 1..20: note = CRISPR gRNA sequence
  source 1..20: mol_type = other DNA
ttctctccaaaggaaaagga

SEQ ID NO: 105043 - DNA, 20 bp, synthetic construct
  misc_feature 1..20: note = CRISPR gRNA sequence
  source 1..20: mol_type = other DNA
aaaaggatagtccccatatg

SEQ ID NO: 105044 - DNA, 20 bp, synthetic construct
  misc_feature 1..20: note = CRISPR gRNA sequence
  source 1..20: mol_type = other DNA
aaaggatagtccccatatgc

SEQ ID NO: 105045 - DNA, 20 bp, synthetic construct
  misc_feature 1..20: note = CRISPR gRNA sequence
  source 1..20: mol_type = other DNA
ggatagtccccatatgcagg

SEQ ID NO: 105046 - DNA, 20 bp, synthetic construct
  misc_feature 1..20: note = CRISPR gRNA sequence
  source 1..20: mol_type = other DNA
gatagtccccatatgcaggt

SEQ ID NO: 105047 - DNA, 20 bp, synthetic construct
  misc_feature 1..20: note = CRISPR gRNA sequence
  source 1..20: mol_type = other DNA
agtccccatatgcaggtagg

SEQ ID NO: 105048 - DNA, 20 bp, synthetic construct
  misc_feature 1..20: note = CRISPR gRNA sequence
  source 1..20: mol_type = other DNA
ttattaccttgtattgactt

SEQ ID NO: 105049 - DNA, 20 bp, synthetic construct
  misc_feature 1..20: note = CRISPR gRNA sequence
  source 1..20: mol_type = other DNA
ccttgtattgacttgagttg

SEQ ID NO: 105050 - DNA, 20 bp, synthetic construct
  misc_feature 1..20: note = CRISPR gRNA sequence
  source 1..20: mol_type = other DNA
ttgacttgagttgaagcctt

SEQ ID NO: 105051 - DNA, 20 bp, synthetic construct
  misc_feature 1..20: note = CRISPR gRNA sequence
  source 1..20: mol_type = other DNA
acttgagttgaagccttcag

SEQ ID NO: 105052 - DNA, 20 bp, synthetic construct
  misc_feature 1..20: note = CRISPR gRNA sequence
  source 1..20: mol_type = other DNA
ctcttgctattttcctactc

SEQ ID NO: 105053 - DNA, 20 bp, synthetic construct
  misc_feature 1..20: note = CRISPR gRNA sequence
  source 1..20: mol_type = other DNA
tcttgctattttcctactct

SEQ ID NO: 105054 - DNA, 20 bp, synthetic construct
  misc_feature 1..20: note = CRISPR gRNA sequence
  source 1..20: mol_type = other DNA
actactcacattctctaaac

SEQ ID NO: 105055 - DNA, 20 bp, synthetic construct
  misc_feature 1..20: note = CRISPR gRNA sequence
  source 1..20: mol_type = other DNA
gatgcaatcttatgtctctt

SEQ ID NO: 105056 - DNA, 20 bp, synthetic construct
  misc_feature 1..20: note = CRISPR gRNA sequence
  source 1..20: mol_type = other DNA
atcttttatcttaaaaccac

SEQ ID NO: 105057 - DNA, 20 bp, synthetic construct
  misc_feature 1..20: note = CRISPR gRNA sequence
  source 1..20: mol_type = other DNA
tcttttatcttaaaaccact

SEQ ID NO: 105058 - DNA, 20 bp, synthetic construct
  misc_feature 1..20: note = CRISPR gRNA sequence
  source 1..20: mol_type = other DNA
ttatcttaaaaccactaggc

SEQ ID NO: 105059 - DNA, 20 bp, synthetic construct
  misc_feature 1..20: note = CRISPR gRNA sequence
  source 1..20: mol_type = other DNA
taaaaccactaggccagact

SEQ ID NO: 105060 - DNA, 20 bp, synthetic construct
  misc_feature 1..20: note = CRISPR gRNA sequence
  source 1..20: mol_type = other DNA
aaccactaggccagacttgg

SEQ ID NO: 105061 - DNA, 20 bp, synthetic construct
  misc_feature 1..20: note = CRISPR gRNA sequence
  source 1..20: mol_type = other DNA
tgcctgtaatcccaacactt

SEQ ID NO: 105062 - DNA, 20 bp, synthetic construct
  misc_feature 1..20: note = CRISPR gRNA sequence
  source 1..20: mol_type = other DNA
gcctgtaatcccaacacttt

SEQ ID NO: 105063 - DNA, 20 bp, synthetic construct
  misc_feature 1..20: note = CRISPR gRNA sequence
  source 1..20: mol_type = other DNA
ctgtaatcccaacactttgg

SEQ ID NO: 105064 - DNA, 20 bp, synthetic construct
  misc_feature 1..20: note = CRISPR gRNA sequence
  source 1..20: mol_type = other DNA
tgtaatcccaacactttggg

SEQ ID NO: 105065 - DNA, 20 bp, synthetic construct
  misc_feature 1..20: note = CRISPR gRNA sequence
  source 1..20: mol_type = other DNA
tcccaacactttgggaggct

SEQ ID NO: 105066 - DNA, 20 bp, synthetic construct
  misc_feature 1..20: note = CRISPR gRNA sequence
  source 1..20: mol_type = other DNA
cccaacactttgggaggctg

SEQ ID NO: 105067 - DNA, 20 bp, synthetic construct
  misc_feature 1..20: note = CRISPR gRNA sequence
  source 1..20: mol_type = other DNA
aacactttgggaggctgagg

SEQ ID NO: 105068 - DNA, 20 bp, synthetic construct
  misc_feature 1..20: note = CRISPR gRNA sequence
  source 1..20: mol_type = other DNA
acactttgggaggctgaggt

SEQ ID NO: 105069 - DNA, 20 bp, synthetic construct
  misc_feature 1..20: note = CRISPR gRNA sequence
  source 1..20: mol_type = other DNA
ctttgggaggctgaggtggg

SEQ ID NO: 105070 - DNA, 20 bp, synthetic construct
  misc_feature 1..20: note = CRISPR gRNA sequence
  source 1..20: mol_type = other DNA
ggaggctgaggtgggaagcc

SEQ ID NO: 105071 - DNA, 20 bp, synthetic construct
  misc_feature 1..20: note = CRISPR gRNA sequence
  source 1..20: mol_type = other DNA
gaggctgaggtgggaagccc

SEQ ID NO: 105072 - DNA, 20 bp, synthetic construct
  misc_feature 1..20: note = CRISPR gRNA sequence
  source 1..20: mol_type = other DNA
ggtgggaagcccaggatttc

SEQ ID NO: 105073 - DNA, 20 bp, synthetic construct
  misc_feature 1..20: note = CRISPR gRNA sequence
  source 1..20: mol_type = other DNA
gaagcccaggatttcaagac

SEQ ID NO: 105074 - DNA, 20 bp, synthetic construct
  misc_feature 1..20: note = CRISPR gRNA sequence
  source 1..20: mol_type = other DNA
ccaggatttcaagaccagcc

SEQ ID NO: 105075 - DNA, 20 bp, synthetic construct
  misc_feature 1..20: note = CRISPR gRNA sequence
  source 1..20: mol_type = other DNA
caggatttcaagaccagcct

SEQ ID NO: 105076 - DNA, 20 bp, synthetic construct
  misc_feature 1..20: note = CRISPR gRNA sequence
  source 1..20: mol_type = other DNA
caagaccagcctgggcaaca

SEQ ID NO: 105077 - DNA, 20 bp, synthetic construct
  misc_feature 1..20: note = CRISPR gRNA sequence
  source 1..20: mol_type = other DNA
ctacaaaaaaatacaaaaac

SEQ ID NO: 105078 - DNA, 20 bp, synthetic construct
  misc_feature 1..20: note = CRISPR gRNA sequence
  source 1..20: mol_type = other DNA
aaaaaaatacaaaaactagc

SEQ ID NO: 105079 - DNA, 20 bp, synthetic construct
  misc_feature 1..20: note = CRISPR gRNA sequence
  source 1..20: mol_type = other DNA
aaaaaatacaaaaactagcc

SEQ ID NO: 105080 - DNA, 20 bp, synthetic construct
  misc_feature 1..20: note = CRISPR gRNA sequence
  source 1..20: mol_type = other DNA
atacaaaaactagccaggcc

SEQ ID NO: 105081 - DNA, 20 bp, synthetic construct
  misc_feature 1..20: note = CRISPR gRNA sequence
  source 1..20: mol_type = other DNA
ggcctggtgatgcatgcctg

SEQ ID NO: 105082 - DNA, 20 bp, synthetic construct
  misc_feature 1..20: note = CRISPR gRNA sequence
  source 1..20: mol_type = other DNA
gtgatgcatgcctgtagtcc

SEQ ID NO: 105083 - DNA, 20 bp, synthetic construct
  misc_feature 1..20: note = CRISPR gRNA sequence
  source 1..20: mol_type = other DNA
tgcctgtagtcccagctact

SEQ ID NO: 105084 - DNA, 20 bp, synthetic construct
  misc_feature 1..20: note = CRISPR gRNA sequence
  source 1..20: mol_type = other DNA
cctgtagtcccagctacttg

SEQ ID NO: 105085 - DNA, 20 bp, synthetic construct
  misc_feature 1..20: note = CRISPR gRNA sequence
  source 1..20: mol_type = other DNA
ctgtagtcccagctacttgg

SEQ ID NO: 105086 - DNA, 20 bp, synthetic construct
  misc_feature 1..20: note = CRISPR gRNA sequence
  source 1..20: mol_type = other DNA
tgtagtcccagctacttgga

SEQ ID NO: 105087 - DNA, 20 bp, synthetic construct
  misc_feature 1..20: note = CRISPR gRNA sequence
  source 1..20: mol_type = other DNA
tcccagctacttggagggtt

SEQ ID NO: 105088 - DNA, 20 bp, synthetic construct
  misc_feature 1..20: note = CRISPR gRNA sequence
  source 1..20: mol_type = other DNA
tcacacttttcttaattttc

SEQ ID NO: 105089 - DNA, 20 bp, synthetic construct
  misc_feature 1..20: note = CRISPR gRNA sequence
  source 1..20: mol_type = other DNA
cacacttttcttaattttca

SEQ ID NO: 105090 - DNA, 20 bp, synthetic construct
  misc_feature 1..20: note = CRISPR gRNA sequence
  source 1..20: mol_type = other DNA
tttcttaattttcaaggaac

SEQ ID NO: 105091 - DNA, 20 bp, synthetic construct
  misc_feature 1..20: note = CRISPR gRNA sequence
  source 1..20: mol_type = other DNA
caagttttatttttattgaa

SEQ ID NO: 105092 - DNA, 20 bp, synthetic construct
  misc_feature 1..20: note = CRISPR gRNA sequence
  source 1..20: mol_type = other DNA
aagttttatttttattgaac

SEQ ID NO: 105093 - DNA, 20 bp, synthetic construct
  misc_feature 1..20: note = CRISPR gRNA sequence
  source 1..20: mol_type = other DNA
ttttcccttctaactgatgt

SEQ ID NO: 105094 - DNA, 20 bp, synthetic construct
  misc_feature 1..20: note = CRISPR gRNA sequence
  source 1..20: mol_type = other DNA
ccttctaactgatgtgagcc

SEQ ID NO: 105095 - DNA, 20 bp, synthetic construct
  misc_feature 1..20: note = CRISPR gRNA sequence
  source 1..20: mol_type = other DNA
tggtctaatcctctcttctt

SEQ ID NO: 105096 - DNA, 20 bp, synthetic construct
  misc_feature 1..20: note = CRISPR gRNA sequence
  source 1..20: mol_type = other DNA
taatcctctcttctttggct

SEQ ID NO: 105097 - DNA, 20 bp, synthetic construct
  misc_feature 1..20: note = CRISPR gRNA sequence
  source 1..20: mol_type = other DNA
tttggcttagatttataaaa

SEQ ID NO: 105098 - DNA, 20 bp, synthetic construct
  misc_feature 1..20: note = CRISPR gRNA sequence
  source 1..20: mol_type = other DNA
tataaaatagctgcttaatt

SEQ ID NO: 105099 - DNA, 20 bp, synthetic construct
  misc_feature 1..20: note = CRISPR gRNA sequence
  source 1..20: mol_type = other DNA
cttccacttttgttcccctc

SEQ ID NO: 105100 - DNA, 20 bp, synthetic construct
  misc_feature 1..20: note = CRISPR gRNA sequence
  source 1..20: mol_type = other DNA
ctagcctactctccacatcc

SEQ ID NO: 105101 - DNA, 20 bp, synthetic construct
  misc_feature 1..20: note = CRISPR gRNA sequence
  source 1..20: mol_type = other DNA
tttaaaatgtttatcctatc

SEQ ID NO: 105102 - DNA, 20 bp, synthetic construct
  misc_feature 1..20: note = CRISPR gRNA sequence
  source 1..20: mol_type = other DNA
atcaagtccctgttctgctc

SEQ ID NO: 105103 - DNA, 20 bp, synthetic construct
  misc_feature 1..20: note = CRISPR gRNA sequence
  source 1..20: mol_type = other DNA
taccctttcccatttgcact

SEQ ID NO: 105104 - DNA, 20 bp, synthetic construct
  misc_feature 1..20: note = CRISPR gRNA sequence
  source 1..20: mol_type = other DNA
tgcacttagactgacatcca

SEQ ID NO: 105105 - DNA, 20 bp, synthetic construct
  misc_feature 1..20: note = CRISPR gRNA sequence
  source 1..20: mol_type = other DNA
aaagtgcttactactatgcc

SEQ ID NO: 105106 - DNA, 20 bp, synthetic construct
  misc_feature 1..20: note = CRISPR gRNA sequence
  source 1..20: mol_type = other DNA
gcttactactatgcccagca

SEQ ID NO: 105107 - DNA, 20 bp, synthetic construct
  misc_feature 1..20: note = CRISPR gRNA sequence
  source 1..20: mol_type = other DNA
cagcaaagccttacatgctc

SEQ ID NO: 105108 - DNA, 20 bp, synthetic construct
  misc_feature 1..20: note = CRISPR gRNA sequence
  source 1..20: mol_type = other DNA
ctaactgcatttctacttct

SEQ ID NO: 105109 - DNA, 20 bp, synthetic construct
  misc_feature 1..20: note = CRISPR gRNA sequence
  source 1..20: mol_type = other DNA
tgctgctgtttactgttcat

SEQ ID NO: 105110 - DNA, 20 bp, synthetic construct
  misc_feature 1..20: note = CRISPR gRNA sequence
  source 1..20: mol_type = other DNA
cattggtctacttcctgcca

SEQ ID NO: 105111 - DNA, 20 bp, synthetic construct
  misc_feature 1..20: note = CRISPR gRNA sequence
  source 1..20: mol_type = other DNA
attggtctacttcctgccac

SEQ ID NO: 105112 - DNA, 20 bp, synthetic construct
  misc_feature 1..20: note = CRISPR gRNA sequence
  source 1..20: mol_type = other DNA
ctgccacgggtctttgtcct

SEQ ID NO: 105113 - DNA, 20 bp, synthetic construct
  misc_feature 1..20: note = CRISPR gRNA sequence
  source 1..20: mol_type = other DNA
gtctttgtccttagaatttt

SEQ ID NO: 105114 - DNA, 20 bp, synthetic construct
  misc_feature 1..20: note = CRISPR gRNA sequence
  source 1..20: mol_type = other DNA
atgtctatctccctatctgt

SEQ ID NO: 105115 - DNA, 20 bp, synthetic construct
  misc_feature 1..20: note = CRISPR gRNA sequence
  source 1..20: mol_type = other DNA
tgtctatctccctatctgtt

SEQ ID NO: 105116 - DNA, 20 bp, synthetic construct
  misc_feature 1..20: note = CRISPR gRNA sequence
  source 1..20: mol_type = other DNA
atctccctatctgttaggtc

SEQ ID NO: 105117 - DNA, 20 bp, synthetic construct
  misc_feature 1..20: note = CRISPR gRNA sequence
  source 1..20: mol_type = other DNA
tctccctatctgttaggtct

SEQ ID NO: 105118 - DNA, 20 bp, synthetic construct
  misc_feature 1..20: note = CRISPR gRNA sequence
  source 1..20: mol_type = other DNA
gtttaattaaataccctatc

SEQ ID NO: 105119 - DNA, 20 bp, synthetic construct
  misc_feature 1..20: note = CRISPR gRNA sequence
  source 1..20: mol_type = other DNA
attaaataccctatctagaa

SEQ ID NO: 105120 - DNA, 20 bp, synthetic construct
  misc_feature 1..20: note = CRISPR gRNA sequence
  source 1..20: mol_type = other DNA
agaatagatctcttctctct

SEQ ID NO: 105121 - DNA, 20 bp, synthetic construct
  misc_feature 1..20: note = CRISPR gRNA sequence
  source 1..20: mol_type = other DNA
tacaacatcttttctttttt

SEQ ID NO: 105122 - DNA, 20 bp, synthetic construct
  misc_feature 1..20: note = CRISPR gRNA sequence
  source 1..20: mol_type = other DNA
caacatcttttctttttttg

SEQ ID NO: 105123 - DNA, 20 bp, synthetic construct
  misc_feature 1..20: note = CRISPR gRNA sequence
  source 1..20: mol_type = other DNA
aacatcttttctttttttgg

SEQ ID NO: 105124 - DNA, 20 bp, synthetic construct
  misc_feature 1..20: note = CRISPR gRNA sequence
  source 1..20: mol_type = other DNA
atcttttctttttttggagg

SEQ ID NO: 105125 - DNA, 20 bp, synthetic construct
  misc_feature 1..20: note = CRISPR gRNA sequence
  source 1..20: mol_type = other DNA
ttttctttttttggaggcag

SEQ ID NO: 105126 - DNA, 20 bp, synthetic construct
  misc_feature 1..20: note = CRISPR gRNA sequence
  source 1..20: mol_type = other DNA
tggaggcagtggtgtgatta

SEQ ID NO: 105127 - DNA, 20 bp, synthetic construct
  misc_feature 1..20: note = CRISPR gRNA sequence
  source 1..20: mol_type = other DNA
ggtgtgattatggctcactt

SEQ ID NO: 105128 - DNA, 20 bp, synthetic construct
  misc_feature 1..20: note = CRISPR gRNA sequence
  source 1..20: mol_type = other DNA
tcactttagtcttgacctcc

SEQ ID NO: 105129 - DNA, 20 bp, synthetic construct
  misc_feature 1..20: note = CRISPR gRNA sequence
  source 1..20: mol_type = other DNA
tagtcttgacctcccagctc

SEQ ID NO: 105130 - DNA, 20 bp, synthetic construct
  misc_feature 1..20: note = CRISPR gRNA sequence
  source 1..20: mol_type = other DNA
ctcaagtgatcctcccactt

SEQ ID NO: 105131 - DNA, 20 bp, synthetic construct
  misc_feature 1..20: note = CRISPR gRNA sequence
  source 1..20: mol_type = other DNA
tcaagtgatcctcccacttt

SEQ ID NO: 105132 - DNA, 20 bp, synthetic construct
  misc_feature 1..20: note = CRISPR gRNA sequence
  source 1..20: mol_type = other DNA
tcctcccactttaggctccc

SEQ ID NO: 105133 - DNA, 20 bp, synthetic construct
  misc_feature 1..20: note = CRISPR gRNA sequence
  source 1..20: mol_type = other DNA
tcccactttaggctcccgag

SEQ ID NO: 105134 - DNA, 20 bp, synthetic construct
  misc_feature 1..20: note = CRISPR gRNA sequence
  source 1..20: mol_type = other DNA
actttaggctcccgagtagc

SEQ ID NO: 105135 - DNA, 20 bp, synthetic construct
  misc_feature 1..20: note = CRISPR gRNA sequence
  source 1..20: mol_type = other DNA
ctttaggctcccgagtagct

SEQ ID NO: 105136 - DNA, 20 bp, synthetic construct
  misc_feature 1..20: note = CRISPR gRNA sequence
  source 1..20: mol_type = other DNA
ctcccgagtagctgggacta

SEQ ID NO: 105137 - DNA, 20 bp, synthetic construct
  misc_feature 1..20: note = CRISPR gRNA sequence
  source 1..20: mol_type = other DNA
tagccacgcaccaccatgcc

SEQ ID NO: 105138 - DNA, 20 bp, synthetic construct
  misc_feature 1..20: note = CRISPR gRNA sequence
  source 1..20: mol_type = other DNA
gctaatttttaaattttttg

SEQ ID NO: 105139 - DNA, 20 bp, synthetic construct
  misc_feature 1..20: note = CRISPR gRNA sequence
  source 1..20: mol_type = other DNA
ttttaaattttttgtagaaa

SEQ ID NO: 105140 - DNA, 20 bp, synthetic construct
  misc_feature 1..20: note = CRISPR gRNA sequence
  source 1..20: mol_type = other DNA
ttaaattttttgtagaaatg

SEQ ID NO: 105141 - DNA, 20 bp, synthetic construct
  misc_feature 1..20: note = CRISPR gRNA sequence
  source 1..20: mol_type = other DNA
tggagtctcactttgttgcc

SEQ ID NO: 105142 - DNA, 20 bp, synthetic construct
  misc_feature 1..20: note = CRISPR gRNA sequence
  source 1..20: mol_type = other DNA
ggagtctcactttgttgccc

SEQ ID NO: 105143 - DNA, 20 bp, synthetic construct
  misc_feature 1..20: note = CRISPR gRNA sequence
  source 1..20: mol_type = other DNA
gtctcactttgttgcccagg

SEQ ID NO: 105144 - DNA, 20 bp, synthetic construct
  misc_feature 1..20: note = CRISPR gRNA sequence
  source 1..20: mol_type = other DNA
tctcactttgttgcccaggc

SEQ ID NO: 105145 - DNA, 20 bp, synthetic construct
  misc_feature 1..20: note = CRISPR gRNA sequence
  source 1..20: mol_type = other DNA
ccaggcaggtctcaaactcc

SEQ ID NO: 105146 - DNA, 20 bp, synthetic construct
  misc_feature 1..20: note = CRISPR gRNA sequence
  source 1..20: mol_type = other DNA
caggcaggtctcaaactcct

SEQ ID NO: 105147 - DNA, 20 bp, synthetic construct
  misc_feature 1..20: note = CRISPR gRNA sequence
  source 1..20: mol_type = other DNA
ggtctcaaactcctaggctc

SEQ ID NO: 105148 - DNA, 20 bp, synthetic construct
  misc_feature 1..20: note = CRISPR gRNA sequence
  source 1..20: mol_type = other DNA
ctcaagcgatcctctcgcct

SEQ ID NO: 105149 - DNA, 20 bp, synthetic construct
  misc_feature 1..20: note = CRISPR gRNA sequence
  source 1..20: mol_type = other DNA
cctctcgccttggcctccca

SEQ ID NO: 105150 - DNA, 20 bp, synthetic construct
  misc_feature 1..20: note = CRISPR gRNA sequence
  source 1..20: mol_type = other DNA
gccttggcctcccaaagtgc

SEQ ID NO: 105151 - DNA, 20 bp, synthetic construct
  misc_feature 1..20: note = CRISPR gRNA sequence
  source 1..20: mol_type = other DNA
ccttggcctcccaaagtgct

SEQ ID NO: 105152 - DNA, 20 bp, synthetic construct
  misc_feature 1..20: note = CRISPR gRNA sequence
  source 1..20: mol_type = other DNA
ctcccaaagtgctaggatta

SEQ ID NO: 105153 - DNA, 20 bp, synthetic construct
  misc_feature 1..20: note = CRISPR gRNA sequence
  source 1..20: mol_type = other DNA
tcccaaagtgctaggattac

SEQ ID NO: 105154 - DNA, 20 bp, synthetic construct
  misc_feature 1..20: note = CRISPR gRNA sequence
  source 1..20: mol_type = other DNA
caggcgcacaccattgcact

SEQ ID NO: 105155 - DNA, 20 bp, synthetic construct
  misc_feature 1..20: note = CRISPR gRNA sequence
  source 1..20: mol_type = other DNA
gcacttggcccttttcttta

SEQ ID NO: 105156 - DNA, 20 bp, synthetic construct
  misc_feature 1..20: note = CRISPR gRNA sequence
  source 1..20: mol_type = other DNA
tttacagtgtaataatattt

SEQ ID NO: 105157 - DNA, 20 bp, synthetic construct
  misc_feature 1..20: note = CRISPR gRNA sequence
  source 1..20: mol_type = other DNA
tttaagttgttgaatttttc

SEQ ID NO: 105158 - DNA, 20 bp, synthetic construct
  misc_feature 1..20: note = CRISPR gRNA sequence
  source 1..20: mol_type = other DNA
ttcaagattgtttccttcac

SEQ ID NO: 105159 - DNA, 20 bp, synthetic construct
  misc_feature 1..20: note = CRISPR gRNA sequence
  source 1..20: mol_type = other DNA
tgtttccttcactagactgt

SEQ ID NO: 105160 - DNA, 20 bp, synthetic construct
  misc_feature 1..20: note = CRISPR gRNA sequence
  source 1..20: mol_type = other DNA
tcactagactgtaagttgta

SEQ ID NO: 105161 - DNA, 20 bp, synthetic construct
  misc_feature 1..20: note = CRISPR gRNA sequence
  source 1..20: mol_type = other DNA
actagactgtaagttgtata

SEQ ID NO: 105162 - DNA, 20 bp, synthetic construct
  misc_feature 1..20: note = CRISPR gRNA sequence
  source 1..20: mol_type = other DNA
ctagactgtaagttgtatag

SEQ ID NO: 105163 - DNA, 20 bp, synthetic construct
  misc_feature 1..20: note = CRISPR gRNA sequence
  source 1..20: mol_type = other DNA
tagactgtaagttgtataga

SEQ ID NO: 105164 - DNA, 20 bp, synthetic construct
  misc_feature 1..20: note = CRISPR gRNA sequence
  source 1..20: mol_type = other DNA
actgtaagttgtatagaggg

SEQ ID NO: 105165 - DNA, 20 bp, synthetic construct
  misc_feature 1..20: note = CRISPR gRNA sequence
  source 1..20: mol_type = other DNA
tgtaagttgtatagagggta

SEQ ID NO: 105166 - DNA, 20 bp, synthetic construct
  misc_feature 1..20: note = CRISPR gRNA sequence
  source 1..20: mol_type = other DNA
gtaagttgtatagagggtag

SEQ ID NO: 105167 - DNA, 20 bp, synthetic construct
  misc_feature 1..20: note = CRISPR gRNA sequence
  source 1..20: mol_type = other DNA
tcgttctctgttatatttat

SEQ ID NO: 105168 - DNA, 20 bp, synthetic construct
  misc_feature 1..20: note = CRISPR gRNA sequence
  source 1..20: mol_type = other DNA
tattggacttaattctattt

SEQ ID NO: 105169 - DNA, 20 bp, synthetic construct
  misc_feature 1..20: note = CRISPR gRNA sequence
  source 1..20: mol_type = other DNA
ggacttaattctatttaagt

SEQ ID NO: 105170 - DNA, 20 bp, synthetic construct
  misc_feature 1..20: note = CRISPR gRNA sequence
  source 1..20: mol_type = other DNA
tatttaagtaagttgtattt

SEQ ID NO: 105171 - DNA, 20 bp, synthetic construct
  misc_feature 1..20: note = CRISPR gRNA sequence
  source 1..20: mol_type = other DNA
gttgtatttaagtactgact

SEQ ID NO: 105172 - DNA, 20 bp, synthetic construct
  misc_feature 1..20: note = CRISPR gRNA sequence
  source 1..20: mol_type = other DNA
actgacttagatgtatttgt

SEQ ID NO: 105173 - DNA, 20 bp, synthetic construct
  misc_feature 1..20: note = CRISPR gRNA sequence
  source 1..20: mol_type = other DNA
ctgacttagatgtatttgtt

SEQ ID NO: 105174 - DNA, 20 bp, synthetic construct
  misc_feature 1..20: note = CRISPR gRNA sequence
  source 1..20: mol_type = other DNA
ttagatgtatttgttgggtt

SEQ ID NO: 105175 - DNA, 20 bp, synthetic construct
  misc_feature 1..20: note = CRISPR gRNA sequence
  source 1..20: mol_type = other DNA
tatttgttgggtttagtatc

SEQ ID NO: 105176 - DNA, 20 bp, synthetic construct
  misc_feature 1..20: note = CRISPR gRNA sequence
  source 1..20: mol_type = other DNA
ttagtatccagttctgaacc

SEQ ID NO: 105177 - DNA, 20 bp, synthetic construct
  misc_feature 1..20: note = CRISPR gRNA sequence
  source 1..20: mol_type = other DNA
ccagttctgaaccaagcaat

SEQ ID NO: 105178 - DNA, 20 bp, synthetic construct
  misc_feature 1..20: note = CRISPR gRNA sequence
  source 1..20: mol_type = other DNA
atcagtgtttcttgaattaa

SEQ ID NO: 105179 - DNA, 20 bp, synthetic construct
  misc_feature 1..20: note = CRISPR gRNA sequence
  source 1..20: mol_type = other DNA
atatccatcaaattaatctc

SEQ ID NO: 105180 - DNA, 20 bp, synthetic construct
  misc_feature 1..20: note = CRISPR gRNA sequence
  source 1..20: mol_type = other DNA
aatctccagtctcctctaat

SEQ ID NO: 105181 - DNA, 20 bp, synthetic construct
  misc_feature 1..20: note = CRISPR gRNA sequence
  source 1..20: mol_type = other DNA
ctcctctaattggccttata

SEQ ID NO: 105182 - DNA, 20 bp, synthetic construct
  misc_feature 1..20: note = CRISPR gRNA sequence
  source 1..20: mol_type = other DNA
ggccttatatagtacttata

SEQ ID NO: 105183 - DNA, 20 bp, synthetic construct
  misc_feature 1..20: note = CRISPR gRNA sequence
  source 1..20: mol_type = other DNA
tatagtacttatacagtaca

SEQ ID NO: 105184 - DNA, 20 bp, synthetic construct
  misc_feature 1..20: note = CRISPR gRNA sequence
  source 1..20: mol_type = other DNA
acttatacagtacatggtta

SEQ ID NO: 105185 - DNA, 20 bp, synthetic construct
  misc_feature 1..20: note = CRISPR gRNA sequence
  source 1..20: mol_type = other DNA
aagtgttttttttaacctgc

SEQ ID NO: 105186 - DNA, 20 bp, synthetic construct
  misc_feature 1..20: note = CRISPR gRNA sequence
  source 1..20: mol_type = other DNA
ttttttaacctgccagtccc

SEQ ID NO: 105187 - DNA, 20 bp, synthetic construct
  misc_feature 1..20: note = CRISPR gRNA sequence
  source 1..20: mol_type = other DNA
tttttaacctgccagtcccc

SEQ ID NO: 105188 - DNA, 20 bp, synthetic construct
  misc_feature 1..20: note = CRISPR gRNA sequence
  source 1..20: mol_type = other DNA
aacctgccagtccccaggtc

SEQ ID NO: 105189 - DNA, 20 bp, synthetic construct
  misc_feature 1..20: note = CRISPR gRNA sequence
  source 1..20: mol_type = other DNA
acctgccagtccccaggtca

SEQ ID NO: 105190 - DNA, 20 bp, synthetic construct
  misc_feature 1..20: note = CRISPR gRNA sequence
  source 1..20: mol_type = other DNA
tcaaggatgcatgctattaa

SEQ ID NO: 105191 - DNA, 20 bp, synthetic construct
  misc_feature 1..20: note = CRISPR gRNA sequence
  source 1..20: mol_type = other DNA
actatttctgtataacatct

SEQ ID NO: 105192 - DNA, 20 bp, synthetic construct
  misc_feature 1..20: note = CRISPR gRNA sequence
  source 1..20: mol_type = other DNA
caccccctcaacaatcaaac

SEQ ID NO: 105193 - DNA, 20 bp, synthetic construct
  misc_feature 1..20: note = CRISPR gRNA sequence
  source 1..20: mol_type = other DNA
accccctcaacaatcaaact

SEQ ID NO: 105194 - DNA, 20 bp, synthetic construct
  misc_feature 1..20: note = CRISPR gRNA sequence
  source 1..20: mol_type = other DNA
acaatcaaactaggtttcct

SEQ ID NO: 105195 - DNA, 20 bp, synthetic construct
  misc_feature 1..20: note = CRISPR gRNA sequence
  source 1..20: mol_type = other DNA
atgaacactaacaactcttt

SEQ ID NO: 105196 - DNA, 20 bp, synthetic construct
  misc_feature 1..20: note = CRISPR gRNA sequence
  source 1..20: mol_type = other DNA
gtgctattaatcctcacctg

SEQ ID NO: 105197 - DNA, 20 bp, synthetic construct
  misc_feature 1..20: note = CRISPR gRNA sequence
  source 1..20: mol_type = other DNA
ttaatcctcacctgtagtgt

SEQ ID NO: 105198 - DNA, 20 bp, synthetic construct
  misc_feature 1..20: note = CRISPR gRNA sequence
  source 1..20: mol_type = other DNA
aatcctcacctgtagtgtga

SEQ ID NO: 105199 - DNA, 20 bp, synthetic construct
  misc_feature 1..20: note = CRISPR gRNA sequence
  source 1..20: mol_type = other DNA
tcattgctattcattcataa

SEQ ID NO: 105200 - DNA, 20 bp, synthetic construct
  misc_feature 1..20: note = CRISPR gRNA sequence
  source 1..20: mol_type = other DNA
ttcataacggtgtatgaatg

SEQ ID NO: 105201 - DNA, 20 bp, synthetic construct
  misc_feature 1..20: note = CRISPR gRNA sequence
  source 1..20: mol_type = other DNA
tcataacggtgtatgaatgt

SEQ ID NO: 105202 - DNA, 20 bp, synthetic construct
  misc_feature 1..20: note = CRISPR gRNA sequence
  source 1..20: mol_type = other DNA
gtgtatgaatgtgggcctga

SEQ ID NO: 105203 - DNA, 20 bp, synthetic construct
  misc_feature 1..20: note = CRISPR gRNA sequence
  source 1..20: mol_type = other DNA
tgtgggcctgacagctattg

SEQ ID NO: 105204 - DNA, 20 bp, synthetic construct
  misc_feature 1..20: note = CRISPR gRNA sequence
  source 1..20: mol_type = other DNA
gggcctgacagctattgtgg

SEQ ID NO: 105205 - DNA, 20 bp, synthetic construct
  misc_feature 1..20: note = CRISPR gRNA sequence
  source 1..20: mol_type = other DNA
ggcctgacagctattgtggc

SEQ ID NO: 105206 - DNA, 20 bp, synthetic construct
  misc_feature 1..20: note = CRISPR gRNA sequence
  source 1..20: mol_type = other DNA
cctgacagctattgtggcag

SEQ ID NO: 105207 - DNA, 20 bp, synthetic construct
  misc_feature 1..20: note = CRISPR gRNA sequence
  source 1..20: mol_type = other DNA
ctgacagctattgtggcagg

SEQ ID NO: 105208 - DNA, 20 bp, synthetic construct
  misc_feature 1..20: note = CRISPR gRNA sequence
  source 1..20: mol_type = other DNA
tgacagctattgtggcagga

SEQ ID NO: 105209 - DNA, 20 bp, synthetic construct
  misc_feature 1..20: note = CRISPR gRNA sequence
  source 1..20: mol_type = other DNA
gtggcaggagggcattgtgc

SEQ ID NO: 105210 - DNA, 20 bp, synthetic construct
  misc_feature 1..20: note = CRISPR gRNA sequence
  source 1..20: mol_type = other DNA
tggcaggagggcattgtgcc

SEQ ID NO: 105211 - DNA, 20 bp, synthetic construct
  misc_feature 1..20: note = CRISPR gRNA sequence
  source 1..20: mol_type = other DNA
gtgtgctaacaatatgatct

SEQ ID NO: 105212 - DNA, 20 bp, synthetic construct
  misc_feature 1..20: note = CRISPR gRNA sequence
  source 1..20: mol_type = other DNA
caatatgatcttggtcaatt

SEQ ID NO: 105213 - DNA, 20 bp, synthetic construct
  misc_feature 1..20: note = CRISPR gRNA sequence
  source 1..20: mol_type = other DNA
ctcttttatttttatctgta

SEQ ID NO: 105214 - DNA, 20 bp, synthetic construct
  misc_feature 1..20: note = CRISPR gRNA sequence
  source 1..20: mol_type = other DNA
ttttatttttatctgtaaag

SEQ ID NO: 105215 - DNA, 20 bp, synthetic construct
  misc_feature 1..20: note = CRISPR gRNA sequence
  source 1..20: mol_type = other DNA
ggaatactgttgatacttca

SEQ ID NO: 105216 - DNA, 20 bp, synthetic construct
  misc_feature 1..20: note = CRISPR gRNA sequence
  source 1..20: mol_type = other DNA
gatacttcacagcaatgttg

SEQ ID NO: 105217 - DNA, 20 bp, synthetic construct
  misc_feature 1..20: note = CRISPR gRNA sequence
  source 1..20: mol_type = other DNA
atacttcacagcaatgttgt

SEQ ID NO: 105218 - DNA, 20 bp, synthetic construct
  misc_feature 1..20: note = CRISPR gRNA sequence
  source 1..20: mol_type = other DNA
tacttcacagcaatgttgta

SEQ ID NO: 105219 - DNA, 20 bp, synthetic construct
  misc_feature 1..20: note = CRISPR gRNA sequence
  source 1..20: mol_type = other DNA
aatgttgtagggatttcatt

SEQ ID NO: 105220 - DNA, 20 bp, synthetic construct
  misc_feature 1..20: note = CRISPR gRNA sequence
  source 1..20: mol_type = other DNA
tttcattcagtaatccacat

SEQ ID NO: 105221 - DNA, 20 bp, synthetic construct
  misc_feature 1..20: note = CRISPR gRNA sequence
  source 1..20: mol_type = other DNA
ttcattcagtaatccacatt

SEQ ID NO: 105222 - DNA, 20 bp, synthetic construct
  misc_feature 1..20: note = CRISPR gRNA sequence
  source 1..20: mol_type = other DNA
atccacattaggcatctgtg

SEQ ID NO: 105223 - DNA, 20 bp, synthetic construct
  misc_feature 1..20: note = CRISPR gRNA sequence
  source 1..20: mol_type = other DNA
catctgtgtagcaccatacc

SEQ ID NO: 105224 - DNA, 20 bp, synthetic construct
  misc_feature 1..20: note = CRISPR gRNA sequence
  source 1..20: mol_type = other DNA
gtagcaccatacctagtgca

SEQ ID NO: 105225 - DNA, 20 bp, synthetic construct
  misc_feature 1..20: note = CRISPR gRNA sequence
  source 1..20: mol_type = other DNA
caccatacctagtgcatggt

SEQ ID NO: 105226 - DNA, 20 bp, synthetic construct
  misc_feature 1..20: note = CRISPR gRNA sequence
  source 1..20: mol_type = other DNA
tacctagtgcatggtgagtt

SEQ ID NO: 105227 - DNA, 20 bp, synthetic construct
  misc_feature 1..20: note = CRISPR gRNA sequence
  source 1..20: mol_type = other DNA
atggtgagttcagtaaatgc

SEQ ID NO: 105228 - DNA, 20 bp, synthetic construct
  misc_feature 1..20: note = CRISPR gRNA sequence
  source 1..20: mol_type = other DNA
gttgtttttgctcattgttc

SEQ ID NO: 105229 - DNA, 20 bp, synthetic construct
  misc_feature 1..20: note = CRISPR gRNA sequence
  source 1..20: mol_type = other DNA
tttgctcattgttcaagacc

SEQ ID NO: 105230 - DNA, 20 bp, synthetic construct
  misc_feature 1..20: note = CRISPR gRNA sequence
  source 1..20: mol_type = other DNA
cattgttcaagacccagttc

SEQ ID NO: 105231 - DNA, 20 bp, synthetic construct
  misc_feature 1..20: note = CRISPR gRNA sequence
  source 1..20: mol_type = other DNA
cagttccagtcttccatctc

SEQ ID NO: 105232 - DNA, 20 bp, synthetic construct
  misc_feature 1..20: note = CRISPR gRNA sequence
  source 1..20: mol_type = other DNA
ttccagtcttccatctccag

SEQ ID NO: 105233 - DNA, 20 bp, synthetic construct
  misc_feature 1..20: note = CRISPR gRNA sequence
  source 1..20: mol_type = other DNA
tccagtcttccatctccaga

SEQ ID NO: 105234 - DNA, 20 bp, synthetic construct
  misc_feature 1..20: note = CRISPR gRNA sequence
  source 1..20: mol_type = other DNA
ttccatctccagaaggcttt

SEQ ID NO: 105235 - DNA, 20 bp, synthetic construct
  misc_feature 1..20: note = CRISPR gRNA sequence
  source 1..20: mol_type = other DNA
gaaggctttcagctttttct

SEQ ID NO: 105236 - DNA, 20 bp, synthetic construct
  misc_feature 1..20: note = CRISPR gRNA sequence
  source 1..20: mol_type = other DNA
tttctcagatcctgcctacc

SEQ ID NO: 105237 - DNA, 20 bp, synthetic construct
  misc_feature 1..20: note = CRISPR gRNA sequence
  source 1..20: mol_type = other DNA
ttctcagatcctgcctacca

SEQ ID NO: 105238 - DNA, 20 bp, synthetic construct
  misc_feature 1..20: note = CRISPR gRNA sequence
  source 1..20: mol_type = other DNA
gatcctgcctaccaaggctt

SEQ ID NO: 105239 - DNA, 20 bp, synthetic construct
  misc_feature 1..20: note = CRISPR gRNA sequence
  source 1..20: mol_type = other DNA
tcctgcctaccaaggcttca

SEQ ID NO: 105240 - DNA, 20 bp, synthetic construct
  misc_feature 1..20: note = CRISPR gRNA sequence
  source 1..20: mol_type = other DNA
ctaccaaggcttcagagcct

SEQ ID NO: 105241 - DNA, 20 bp, synthetic construct
  misc_feature 1..20: note = CRISPR gRNA sequence
  source 1..20: mol_type = other DNA
aaggcttcagagccttggta

SEQ ID NO: 105242 - DNA, 20 bp, synthetic construct
  misc_feature 1..20: note = CRISPR gRNA sequence
  source 1..20: mol_type = other DNA
aggcttcagagccttggtat

SEQ ID NO: 105243 - DNA, 20 bp, synthetic construct
  misc_feature 1..20: note = CRISPR gRNA sequence
  source 1..20: mol_type = other DNA
ggcttcagagccttggtatg

SEQ ID NO: 105244 - DNA, 20 bp, synthetic construct
  misc_feature 1..20: note = CRISPR gRNA sequence
  source 1..20: mol_type = other DNA
gcttcagagccttggtatgg

SEQ ID NO: 105245 - DNA, 20 bp, synthetic construct
  misc_feature 1..20: note = CRISPR gRNA sequence
  source 1..20: mol_type = other DNA
gccttggtatgggggaacta

SEQ ID NO: 105246 - DNA, 20 bp, synthetic construct
  misc_feature 1..20: note = CRISPR gRNA sequence
  source 1..20: mol_type = other DNA
ccttggtatgggggaactaa

SEQ ID NO: 105247 - DNA, 20 bp, synthetic construct
  misc_feature 1..20: note = CRISPR gRNA sequence
  source 1..20: mol_type = other DNA
tggtatgggggaactaaagg

SEQ ID NO: 105248 - DNA, 20 bp, synthetic construct
  misc_feature 1..20: note = CRISPR gRNA sequence
  source 1..20: mol_type = other DNA
ggaactaaaggtggttcttg

SEQ ID NO: 105249 - DNA, 20 bp, synthetic construct
  misc_feature 1..20: note = CRISPR gRNA sequence
  source 1..20: mol_type = other DNA
aactaaaggtggttcttgcg

SEQ ID NO: 105250 - DNA, 20 bp, synthetic construct
  misc_feature 1..20: note = CRISPR gRNA sequence
  source 1..20: mol_type = other DNA
ttcttgcggagtgttgcaaa

SEQ ID NO: 105251 - DNA, 20 bp, synthetic construct
  misc_feature 1..20: note = CRISPR gRNA sequence
  source 1..20: mol_type = other DNA
gagtgttgcaaaaagcttcc

SEQ ID NO: 105252 - DNA, 20 bp, synthetic construct
  misc_feature 1..20: note = CRISPR gRNA sequence
  source 1..20: mol_type = other DNA
agtgttgcaaaaagcttcca

SEQ ID NO: 105253 - DNA, 20 bp, synthetic construct
  misc_feature 1..20: note = CRISPR gRNA sequence
  source 1..20: mol_type = other DNA
gatttatccttgtgttaaca

SEQ ID NO: 105254 - DNA, 20 bp, synthetic construct
  misc_feature 1..20: note = CRISPR gRNA sequence
  source 1..20: mol_type = other DNA
ttatccttgtgttaacacgg

SEQ ID NO: 105255 - DNA, 20 bp, synthetic construct
  misc_feature 1..20: note = CRISPR gRNA sequence
  source 1..20: mol_type = other DNA
tatccttgtgttaacacggt

SEQ ID NO: 105256 - DNA, 20 bp, synthetic construct
  misc_feature 1..20: note = CRISPR gRNA sequence
  source 1..20: mol_type = other DNA
gtgttaacacggtaggtctt

SEQ ID NO: 105257 - DNA, 20 bp, synthetic construct
  misc_feature 1..20: note = CRISPR gRNA sequence
  source 1..20: mol_type = other DNA
taacacggtaggtcttaagt

SEQ ID NO: 105258 - DNA, 20 bp, synthetic construct
  misc_feature 1..20: note = CRISPR gRNA sequence
  source 1..20: mol_type = other DNA
ggtaggtcttaagtgagaaa

SEQ ID NO: 105259 - DNA, 20 bp, synthetic construct
  misc_feature 1..20: note = CRISPR gRNA sequence
  source 1..20: mol_type = other DNA
cttaagtgagaaacagcata

SEQ ID NO: 105260 - DNA, 20 bp, synthetic construct
  misc_feature 1..20: note = CRISPR gRNA sequence
  source 1..20: mol_type = other DNA
taagtgagaaacagcatata

SEQ ID NO: 105261 - DNA, 20 bp, synthetic construct
  misc_feature 1..20: note = CRISPR gRNA sequence
  source 1..20: mol_type = other DNA
gagaaacagcatatagagtt

SEQ ID NO: 105262 - DNA, 20 bp, synthetic construct
  misc_feature 1..20: note = CRISPR gRNA sequence
  source 1..20: mol_type = other DNA
aaacagcatatagagtttag

SEQ ID NO: 105263 - DNA, 20 bp, synthetic construct
  misc_feature 1..20: note = CRISPR gRNA sequence
  source 1..20: mol_type = other DNA
agcatatagagtttagtgga

SEQ ID NO: 105264 - DNA, 20 bp, synthetic construct
  misc_feature 1..20: note = CRISPR gRNA sequence
  source 1..20: mol_type = other DNA
atatagagtttagtggaaag

SEQ ID NO: 105265 - DNA, 20 bp, synthetic construct
  misc_feature 1..20: note = CRISPR gRNA sequence
  source 1..20: mol_type = other DNA
ttagtggaaagaagatgaaa

SEQ ID NO: 105266 - DNA, 20 bp, synthetic construct
  misc_feature 1..20: note = CRISPR gRNA sequence
  source 1..20: mol_type = other DNA
tagtggaaagaagatgaaat

SEQ ID NO: 105267 - DNA, 20 bp, synthetic construct
  misc_feature 1..20: note = CRISPR gRNA sequence
  source 1..20: mol_type = other DNA
gtggaaagaagatgaaatgg

SEQ ID NO: 105268 - DNA, 20 bp, synthetic construct
  misc_feature 1..20: note = CRISPR gRNA sequence
  source 1..20: mol_type = other DNA
aaagaagatgaaatgggagt

SEQ ID NO: 105269 - DNA, 20 bp, synthetic construct
  misc_feature 1..20: note = CRISPR gRNA sequence
  source 1..20: mol_type = other DNA
aagaagatgaaatgggagtc

SEQ ID NO: 105270 - DNA, 20 bp, synthetic construct
  misc_feature 1..20: note = CRISPR gRNA sequence
  source 1..20: mol_type = other DNA
gaagatgaaatgggagtcag

SEQ ID NO: 105271 - DNA, 20 bp, synthetic construct
  misc_feature 1..20: note = CRISPR gRNA sequence
  source 1..20: mol_type = other DNA
gaaatgggagtcaggagatt

SEQ ID NO: 105272 - DNA, 20 bp, synthetic construct
  misc_feature 1..20: note = CRISPR gRNA sequence
  source 1..20: mol_type = other DNA
aaatgggagtcaggagattt

SEQ ID NO: 105273 - DNA, 20 bp, synthetic construct
  misc_feature 1..20: note = CRISPR gRNA sequence
  source 1..20: mol_type = other DNA
atgggagtcaggagatttgg

SEQ ID NO: 105274 - DNA, 20 bp, synthetic construct
  misc_feature 1..20: note = CRISPR gRNA sequence
  source 1..20: mol_type = other DNA
gagtcaggagatttgggagt

SEQ ID NO: 105275 - DNA, 20 bp, synthetic construct
  misc_feature 1..20: note = CRISPR gRNA sequence
  source 1..20: mol_type = other DNA
atttgggagttagcccttgc

SEQ ID NO: 105276 - DNA, 20 bp, synthetic construct
  misc_feature 1..20: note = CRISPR gRNA sequence
  source 1..20: mol_type = other DNA
taactttctgaccctgaccc

SEQ ID NO: 105277 - DNA, 20 bp, synthetic construct
  misc_feature 1..20: note = CRISPR gRNA sequence
  source 1..20: mol_type = other DNA
cgcaaatcactttacccatc

SEQ ID NO: 105278 - DNA, 20 bp, synthetic construct
  misc_feature 1..20: note = CRISPR gRNA sequence
  source 1..20: mol_type = other DNA
cactttacccatctggcctt

SEQ ID NO: 105279 - DNA, 20 bp, synthetic construct
  misc_feature 1..20: note = CRISPR gRNA sequence
  source 1..20: mol_type = other DNA
ttcagatttatctgtaaaac

SEQ ID NO: 105280 - DNA, 20 bp, synthetic construct
  misc_feature 1..20: note = CRISPR gRNA sequence
  source 1..20: mol_type = other DNA
tctgtaaaacgagtacatta

SEQ ID NO: 105281 - DNA, 20 bp, synthetic construct
  misc_feature 1..20: note = CRISPR gRNA sequence
  source 1..20: mol_type = other DNA
aacgagtacattaaagtgta

SEQ ID NO: 105282 - DNA, 20 bp, synthetic construct
  misc_feature 1..20: note = CRISPR gRNA sequence
  source 1..20: mol_type = other DNA
tagattctaatgattctttc

SEQ ID NO: 105283 - DNA, 20 bp, synthetic construct
  misc_feature 1..20: note = CRISPR gRNA sequence
  source 1..20: mol_type = other DNA
tgattctttctagccctgct

SEQ ID NO: 105284 - DNA, 20 bp, synthetic construct
  misc_feature 1..20: note = CRISPR gRNA sequence
  source 1..20: mol_type = other DNA
ttctagccctgctaagtact

SEQ ID NO: 105285 - DNA, 20 bp, synthetic construct
  misc_feature 1..20: note = CRISPR gRNA sequence
  source 1..20: mol_type = other DNA
tttaaatgatgatcaaaaaa

SEQ ID NO: 105286 - DNA, 20 bp, synthetic construct
  misc_feature 1..20: note = CRISPR gRNA sequence
  source 1..20: mol_type = other DNA
aaaaaacagtgacaaaaata

SEQ ID NO: 105287 - DNA, 20 bp, synthetic construct
  misc_feature 1..20: note = CRISPR gRNA sequence
  source 1..20: mol_type = other DNA
gacaaaaatacagcatgaca

SEQ ID NO: 105288 - DNA, 20 bp, synthetic construct
  misc_feature 1..20: note = CRISPR gRNA sequence
  source 1..20: mol_type = other DNA
acagcatgacatggtttctc

SEQ ID NO: 105289 - DNA, 20 bp, synthetic construct
  misc_feature 1..20: note = CRISPR gRNA sequence
  source 1..20: mol_type = other DNA
cagcatgacatggtttctct

SEQ ID NO: 105290 - DNA, 20 bp, synthetic construct
  misc_feature 1..20: note = CRISPR gRNA sequence
  source 1..20: mol_type = other DNA
gtttctctgggtcttttcct

SEQ ID NO: 105291 - DNA, 20 bp, synthetic construct
  misc_feature 1..20: note = CRISPR gRNA sequence
  source 1..20: mol_type = other DNA
tctgaatactcttaaccctt

SEQ ID NO: 105292 - DNA, 20 bp, synthetic construct
  misc_feature 1..20: note = CRISPR gRNA sequence
  source 1..20: mol_type = other DNA
atactcttaacccttaagta

SEQ ID NO: 105293 - DNA, 20 bp, synthetic construct
  misc_feature 1..20: note = CRISPR gRNA sequence
  source 1..20: mol_type = other DNA
actcttaacccttaagtata

SEQ ID NO: 105294 - DNA, 20 bp, synthetic construct
  misc_feature 1..20: note = CRISPR gRNA sequence
  source 1..20: mol_type = other DNA
ttaagtatagagaacaacac

SEQ ID NO: 105295 - DNA, 20 bp, synthetic construct
  misc_feature 1..20: note = CRISPR gRNA sequence
  source 1..20: mol_type = other DNA
taagtatagagaacaacaca

SEQ ID NO: 105296 - DNA, 20 bp, synthetic construct
  misc_feature 1..20: note = CRISPR gRNA sequence
  source 1..20: mol_type = other DNA
agagaacaacacaaggttct

SEQ ID NO: 105297 - DNA, 20 bp, synthetic construct
  misc_feature 1..20: note = CRISPR gRNA sequence
  source 1..20: mol_type = other DNA
gagaacaacacaaggttctt

SEQ ID NO: 105298 - DNA, 20 bp, synthetic construct
  misc_feature 1..20: note = CRISPR gRNA sequence
  source 1..20: mol_type = other DNA
acaacacaaggttcttagga

SEQ ID NO: 105299 - DNA, 20 bp, synthetic construct
  misc_feature 1..20: note = CRISPR gRNA sequence
  source 1..20: mol_type = other DNA
aacacaaggttcttaggaaa

SEQ ID NO: 105300 - DNA, 20 bp, synthetic construct
  misc_feature 1..20: note = CRISPR gRNA sequence
  source 1..20: mol_type = other DNA
ttaggaaagagatacactaa

SEQ ID NO: 105301 - DNA, 20 bp, synthetic construct
  misc_feature 1..20: note = CRISPR gRNA sequence
  source 1..20: mol_type = other DNA
gagatacactaacagccctg

SEQ ID NO: 105302 - DNA, 20 bp, synthetic construct
  misc_feature 1..20: note = CRISPR gRNA sequence
  source 1..20: mol_type = other DNA
agccctgcagtgtttcacca

SEQ ID NO: 105303 - DNA, 20 bp, synthetic construct
  misc_feature 1..20: note = CRISPR gRNA sequence
  source 1..20: mol_type = other DNA
ccctgcagtgtttcaccatg

SEQ ID NO: 105304 - DNA, 20 bp, synthetic construct
  misc_feature 1..20: note = CRISPR gRNA sequence
  source 1..20: mol_type = other DNA
cagtgtttcaccatggagtg

SEQ ID NO: 105305 - DNA, 20 bp, synthetic construct
  misc_feature 1..20: note = CRISPR gRNA sequence
  source 1..20: mol_type = other DNA
agtgtttcaccatggagtgc

SEQ ID NO: 105306 - DNA, 20 bp, synthetic construct
  misc_feature 1..20: note = CRISPR gRNA sequence
  source 1..20: mol_type = other DNA
tttcaccatggagtgcaggc

SEQ ID NO: 105307 - DNA, 20 bp, synthetic construct
  misc_feature 1..20: note = CRISPR gRNA sequence
  source 1..20: mol_type = other DNA
gccagactttaaattatttt

SEQ ID NO: 105308 - DNA, 20 bp, synthetic construct
  misc_feature 1..20: note = CRISPR gRNA sequence
  source 1..20: mol_type = other DNA
ctttaaattattttaagaat

SEQ ID NO: 105309 - DNA, 20 bp, synthetic construct
  misc_feature 1..20: note = CRISPR gRNA sequence
  source 1..20: mol_type = other DNA
tttaaattattttaagaata

SEQ ID NO: 105310 - DNA, 20 bp, synthetic construct
  misc_feature 1..20: note = CRISPR gRNA sequence
  source 1..20: mol_type = other DNA
tattgtctcttctttcctaa

SEQ ID NO: 105311 - DNA, 20 bp, synthetic construct
  misc_feature 1..20: note = CRISPR gRNA sequence
  source 1..20: mol_type = other DNA
attgtctcttctttcctaat

SEQ ID NO: 105312 - DNA, 20 bp, synthetic construct
  misc_feature 1..20: note = CRISPR gRNA sequence
  source 1..20: mol_type = other DNA
ttgtctcttctttcctaatg

SEQ ID NO: 105313 - DNA, 20 bp, synthetic construct
  misc_feature 1..20: note = CRISPR gRNA sequence
  source 1..20: mol_type = other DNA
tcctaatggggctacacttt

SEQ ID NO: 105314 - DNA, 20 bp, synthetic construct
  misc_feature 1..20: note = CRISPR gRNA sequence
  source 1..20: mol_type = other DNA
tacactttaagccatgtatg

SEQ ID NO: 105315 - DNA, 20 bp, synthetic construct
  misc_feature 1..20: note = CRISPR gRNA sequence
  source 1..20: mol_type = other DNA
taagccatgtatgcagactt

SEQ ID NO: 105316 - DNA, 20 bp, synthetic construct
  misc_feature 1..20: note = CRISPR gRNA sequence
  source 1..20: mol_type = other DNA
gcagacttaagatgtattac

SEQ ID NO: 105317 - DNA, 20 bp, synthetic construct
  misc_feature 1..20: note = CRISPR gRNA sequence
  source 1..20: mol_type = other DNA
ttacaagcctttgatttact

SEQ ID NO: 105318 - DNA, 20 bp, synthetic construct
  misc_feature 1..20: note = CRISPR gRNA sequence
  source 1..20: mol_type = other DNA
agcctttgatttacttggta

SEQ ID NO: 105319 - DNA, 20 bp, synthetic construct
  misc_feature 1..20: note = CRISPR gRNA sequence
  source 1..20: mol_type = other DNA
taaagttatgtgtattctct

SEQ ID NO: 105320 - DNA, 20 bp, synthetic construct
  misc_feature 1..20: note = CRISPR gRNA sequence
  source 1..20: mol_type = other DNA
aaagttatgtgtattctctt

SEQ ID NO: 105321 - DNA, 20 bp, synthetic construct
  misc_feature 1..20: note = CRISPR gRNA sequence
  source 1..20: mol_type = other DNA
aagttatgtgtattctcttg

SEQ ID NO: 105322 - DNA, 20 bp, synthetic construct
  misc_feature 1..20: note = CRISPR gRNA sequence
  source 1..20: mol_type = other DNA
agttatgtgtattctcttgg

SEQ ID NO: 105323 - DNA, 20 bp, synthetic construct
  misc_feature 1..20: note = CRISPR gRNA sequence
  source 1..20: mol_type = other DNA
gttatgtgtattctcttggg

SEQ ID NO: 105324 - DNA, 20 bp, synthetic construct
  misc_feature 1..20: note = CRISPR gRNA sequence
  source 1..20: mol_type = other DNA
gtgtattctcttggggggat

SEQ ID NO: 105325 - DNA, 20 bp, synthetic construct
  misc_feature 1..20: note = CRISPR gRNA sequence
  source 1..20: mol_type = other DNA
tattctcttggggggataag

SEQ ID NO: 105326 - DNA, 20 bp, synthetic construct
  misc_feature 1..20: note = CRISPR gRNA sequence
  source 1..20: mol_type = other DNA
ctcttggggggataagtagt

SEQ ID NO: 105327 - DNA, 20 bp, synthetic construct
  misc_feature 1..20: note = CRISPR gRNA sequence
  source 1..20: mol_type = other DNA
cttggggggataagtagtga

SEQ ID NO: 105328 - DNA, 20 bp, synthetic construct
  misc_feature 1..20: note = CRISPR gRNA sequence
  source 1..20: mol_type = other DNA
ggataagtagtgagagccat

SEQ ID NO: 105329 - DNA, 20 bp, synthetic construct
  misc_feature 1..20: note = CRISPR gRNA sequence
  source 1..20: mol_type = other DNA
gagttcctgttgcttttgca

SEQ ID NO: 105330 - DNA, 20 bp, synthetic construct
  misc_feature 1..20: note = CRISPR gRNA sequence
  source 1..20: mol_type = other DNA
agttcctgttgcttttgcaa

SEQ ID NO: 105331 - DNA, 20 bp, synthetic construct
  misc_feature 1..20: note = CRISPR gRNA sequence
  source 1..20: mol_type = other DNA
catcatgtcatctttgtctc

SEQ ID NO: 105332 - DNA, 20 bp, synthetic construct
  misc_feature 1..20: note = CRISPR gRNA sequence
  source 1..20: mol_type = other DNA
atcatgtcatctttgtctct

SEQ ID NO: 105333 - DNA, 20 bp, synthetic construct
  misc_feature 1..20: note = CRISPR gRNA sequence
  source 1..20: mol_type = other DNA
ttgtctctaggatccaaacc

SEQ ID NO: 105334 - DNA, 20 bp, synthetic construct
  misc_feature 1..20: note = CRISPR gRNA sequence
  source 1..20: mol_type = other DNA
ggatccaaaccaagccgatg

SEQ ID NO: 105335 - DNA, 20 bp, synthetic construct
  misc_feature 1..20: note = CRISPR gRNA sequence
  source 1..20: mol_type = other DNA
tccaaaccaagccgatgaag

SEQ ID NO: 105336 - DNA, 20 bp, synthetic construct
  misc_feature 1..20: note = CRISPR gRNA sequence
  source 1..20: mol_type = other DNA
ccgatgaagaagcaatgaca

SEQ ID NO: 105337 - DNA, 20 bp, synthetic construct
  misc_feature 1..20: note = CRISPR gRNA sequence
  source 1..20: mol_type = other DNA
agcaatgacacagatcatcc

SEQ ID NO: 105338 - DNA, 20 bp, synthetic construct
  misc_feature 1..20: note = CRISPR gRNA sequence
  source 1..20: mol_type = other DNA
cctaaccccacgccatgtga

SEQ ID NO: 105339 - DNA, 20 bp, synthetic construct
  misc_feature 1..20: note = CRISPR gRNA sequence
  source 1..20: mol_type = other DNA
taaccccacgccatgtgatg

SEQ ID NO: 105340 - DNA, 20 bp, synthetic construct
  misc_feature 1..20: note = CRISPR gRNA sequence
  source 1..20: mol_type = other DNA
gccatgtgatggagctgatc

SEQ ID NO: 105341 - DNA, 20 bp, synthetic construct
  misc_feature 1..20: note = CRISPR gRNA sequence
  source 1..20: mol_type = other DNA
ccatgtgatggagctgatca

SEQ ID NO: 105342 - DNA, 20 bp, synthetic construct
  misc_feature 1..20: note = CRISPR gRNA sequence
  source 1..20: mol_type = other DNA
ggtcatgtttctcactgttc

SEQ ID NO: 105343 - DNA, 20 bp, synthetic construct
  misc_feature 1..20: note = CRISPR gRNA sequence
  source 1..20: mol_type = other DNA
gtcatgtttctcactgttcc

SEQ ID NO: 105344 - DNA, 20 bp, synthetic construct
  misc_feature 1..20: note = CRISPR gRNA sequence
  source 1..20: mol_type = other DNA
aaattgatcaactcttccaa

SEQ ID NO: 105345 - DNA, 20 bp, synthetic construct
  misc_feature 1..20: note = CRISPR gRNA sequence
  source 1..20: mol_type = other DNA
aattgatcaactcttccaat

SEQ ID NO: 105346 - DNA, 20 bp, synthetic construct
  misc_feature 1..20: note = CRISPR gRNA sequence
  source 1..20: mol_type = other DNA
tcacattctgccctttacta

SEQ ID NO: 105347 - DNA, 20 bp, synthetic construct
  misc_feature 1..20: note = CRISPR gRNA sequence
  source 1..20: mol_type = other DNA
cacattctgccctttactac

SEQ ID NO: 105348 - DNA, 20 bp, synthetic construct
  misc_feature 1..20: note = CRISPR gRNA sequence
  source 1..20: mol_type = other DNA
ttctgccctttactacagga

SEQ ID NO: 105349 - DNA, 20 bp, synthetic construct
  misc_feature 1..20: note = CRISPR gRNA sequence
  source 1..20: mol_type = other DNA
actacaggacagaaaccact

SEQ ID NO: 105350 - DNA, 20 bp, synthetic construct
  misc_feature 1..20: note = CRISPR gRNA sequence
  source 1..20: mol_type = other DNA
gaaaccacttagtttttaat

SEQ ID NO: 105351 - DNA, 20 bp, synthetic construct
  misc_feature 1..20: note = CRISPR gRNA sequence
  source 1..20: mol_type = other DNA
accacttagtttttaataag

SEQ ID NO: 105352 - DNA, 20 bp, synthetic construct
  misc_feature 1..20: note = CRISPR gRNA sequence
  source 1..20: mol_type = other DNA
ttagtttttaataagtggct

SEQ ID NO: 105353 - DNA, 20 bp, synthetic construct
  misc_feature 1..20: note = CRISPR gRNA sequence
  source 1..20: mol_type = other DNA
gtggctcagtattacaattg

SEQ ID NO: 105354 - DNA, 20 bp, synthetic construct
  misc_feature 1..20: note = CRISPR gRNA sequence
  source 1..20: mol_type = other DNA
attacaattgcagcgatgcc

SEQ ID NO: 105355 - DNA, 20 bp, synthetic construct
  misc_feature 1..20: note = CRISPR gRNA sequence
  source 1..20: mol_type = other DNA
cagcgatgcctggcaaattg

SEQ ID NO: 105356 - DNA, 20 bp, synthetic construct
  misc_feature 1..20: note = CRISPR gRNA sequence
  source 1..20: mol_type = other DNA
gcctggcaaattgaagttgc

SEQ ID NO: 105357 - DNA, 20 bp, synthetic construct
  misc_feature 1..20: note = CRISPR gRNA sequence
  source 1..20: mol_type = other DNA
aagcctttgtcttactcttt

SEQ ID NO: 105358 - DNA, 20 bp, synthetic construct
  misc_feature 1..20: note = CRISPR gRNA sequence
  source 1..20: mol_type = other DNA
ctttgtcttactctttcagt

SEQ ID NO: 105359 - DNA, 20 bp, synthetic construct
  misc_feature 1..20: note = CRISPR gRNA sequence
  source 1..20: mol_type = other DNA
tttgtcttactctttcagtc

SEQ ID NO: 105360 - DNA, 20 bp, synthetic construct
  misc_feature 1..20: note = CRISPR gRNA sequence
  source 1..20: mol_type = other DNA
ctttcagtcaggacctattt

SEQ ID NO: 105361 - DNA, 20 bp, synthetic construct
  misc_feature 1..20: note = CRISPR gRNA sequence
  source 1..20: mol_type = other DNA
ttgatgacattgacatttca

SEQ ID NO: 105362 - DNA, 20 bp, synthetic construct
  misc_feature 1..20: note = CRISPR gRNA sequence
  source 1..20: mol_type = other DNA
acattgacatttcatggatt

SEQ ID NO: 105363 - DNA, 20 bp, synthetic construct
  misc_feature 1..20: note = CRISPR gRNA sequence
  source 1..20: mol_type = other DNA
ttcatggattcggatgatgc

SEQ ID NO: 105364 - DNA, 20 bp, synthetic construct
  misc_feature 1..20: note = CRISPR gRNA sequence
  source 1..20: mol_type = other DNA
tcatggattcggatgatgca

SEQ ID NO: 105365 - DNA, 20 bp, synthetic construct
  misc_feature 1..20: note = CRISPR gRNA sequence
  source 1..20: mol_type = other DNA
atggattcggatgatgcaag

SEQ ID NO: 105366 - DNA, 20 bp, synthetic construct
  misc_feature 1..20: note = CRISPR gRNA sequence
  source 1..20: mol_type = other DNA
caaggagacacatgccaccc

SEQ ID NO: 105367 - DNA, 20 bp, synthetic construct
  misc_feature 1..20: note = CRISPR gRNA sequence
  source 1..20: mol_type = other DNA
ggagacacatgccaccccag

SEQ ID NO: 105368 - DNA, 20 bp, synthetic construct
  misc_feature 1..20: note = CRISPR gRNA sequence
  source 1..20: mol_type = other DNA
tgccaccccagcagtacaca

SEQ ID NO: 105369 - DNA, 20 bp, synthetic construct
  misc_feature 1..20: note = CRISPR gRNA sequence
  source 1..20: mol_type = other DNA
cacaaagcacttaccttgac

SEQ ID NO: 105370 - DNA, 20 bp, synthetic construct
  misc_feature 1..20: note = CRISPR gRNA sequence
  source 1..20: mol_type = other DNA
agcacttaccttgactggtg

SEQ ID NO: 105371 - DNA, 20 bp, synthetic construct
  misc_feature 1..20: note = CRISPR gRNA sequence
  source 1..20: mol_type = other DNA
cttaccttgactggtgaagt

SEQ ID NO: 105372 - DNA, 20 bp, synthetic construct
  misc_feature 1..20: note = CRISPR gRNA sequence
  source 1..20: mol_type = other DNA
ccttgactggtgaagtcagc

SEQ ID NO: 105373 - DNA, 20 bp, synthetic construct
  misc_feature 1..20: note = CRISPR gRNA sequence
  source 1..20: mol_type = other DNA
gtgaagtcagccagccatct

SEQ ID NO: 105374 - DNA, 20 bp, synthetic construct
  misc_feature 1..20: note = CRISPR gRNA sequence
  source 1..20: mol_type = other DNA
aagtcagccagccatctcag

SEQ ID NO: 105375 - DNA, 20 bp, synthetic construct
  misc_feature 1..20: note = CRISPR gRNA sequence
  source 1..20: mol_type = other DNA
agtcagccagccatctcagc

SEQ ID NO: 105376 - DNA, 20 bp, synthetic construct
  misc_feature 1..20: note = CRISPR gRNA sequence
  source 1..20: mol_type = other DNA
gtcagccagccatctcagca

SEQ ID NO: 105377 - DNA, 20 bp, synthetic construct
  misc_feature 1..20: note = CRISPR gRNA sequence
  source 1..20: mol_type = other DNA
agccagccatctcagcaggg

SEQ ID NO: 105378 - DNA, 20 bp, synthetic construct
  misc_feature 1..20: note = CRISPR gRNA sequence
  source 1..20: mol_type = other DNA
ttctcaaccaaaactgcaat

SEQ ID NO: 105379 - DNA, 20 bp, synthetic construct
  misc_feature 1..20: note = CRISPR gRNA sequence
  source 1..20: mol_type = other DNA
tctcaaccaaaactgcaatc

SEQ ID NO: 105380 - DNA, 20 bp, synthetic construct
  misc_feature 1..20: note = CRISPR gRNA sequence
  source 1..20: mol_type = other DNA
aaccaaaactgcaatcagga

SEQ ID NO: 105381 - DNA, 20 bp, synthetic construct
  misc_feature 1..20: note = CRISPR gRNA sequence
  source 1..20: mol_type = other DNA
caaaactgcaatcaggaaag

SEQ ID NO: 105382 - DNA, 20 bp, synthetic construct
  misc_feature 1..20: note = CRISPR gRNA sequence
  source 1..20: mol_type = other DNA
aactgcaatcaggaaagcag

SEQ ID NO: 105383 - DNA, 20 bp, synthetic construct
  misc_feature 1..20: note = CRISPR gRNA sequence
  source 1..20: mol_type = other DNA
cagcagcccactccttccca

SEQ ID NO: 105384 - DNA, 20 bp, synthetic construct
  misc_feature 1..20: note = CRISPR gRNA sequence
  source 1..20: mol_type = other DNA
ccactccttcccatggaatc

SEQ ID NO: 105385 - DNA, 20 bp, synthetic construct
  misc_feature 1..20: note = CRISPR gRNA sequence
  source 1..20: mol_type = other DNA
tccttcccatggaatctaga

SEQ ID NO: 105386 - DNA, 20 bp, synthetic construct
  misc_feature 1..20: note = CRISPR gRNA sequence
  source 1..20: mol_type = other DNA
ctagacagcatttatccctc

SEQ ID NO: 105387 - DNA, 20 bp, synthetic construct
  misc_feature 1..20: note = CRISPR gRNA sequence
  source 1..20: mol_type = other DNA
gacagcatttatccctctgg

SEQ ID NO: 105388 - DNA, 20 bp, synthetic construct
  misc_feature 1..20: note = CRISPR gRNA sequence
  source 1..20: mol_type = other DNA
acagcatttatccctctggt

SEQ ID NO: 105389 - DNA, 20 bp, synthetic construct
  misc_feature 1..20: note = CRISPR gRNA sequence
  source 1..20: mol_type = other DNA
cagcatttatccctctggtg

SEQ ID NO: 105390 - DNA, 20 bp, synthetic construct
  misc_feature 1..20: note = CRISPR gRNA sequence
  source 1..20: mol_type = other DNA
agcatttatccctctggtgg

SEQ ID NO: 105391 - DNA, 20 bp, synthetic construct
  misc_feature 1..20: note = CRISPR gRNA sequence
  source 1..20: mol_type = other DNA
tctcacactgactaactgaa

SEQ ID NO: 105392 - DNA, 20 bp, synthetic construct
  misc_feature 1..20: note = CRISPR gRNA sequence
  source 1..20: mol_type = other DNA
ctgaatggacgctttgtatt

SEQ ID NO: 105393 - DNA, 20 bp, synthetic construct
  misc_feature 1..20: note = CRISPR gRNA sequence
  source 1..20: mol_type = other DNA
gaatggacgctttgtattca

SEQ ID NO: 105394 - DNA, 20 bp, synthetic construct
  misc_feature 1..20: note = CRISPR gRNA sequence
  source 1..20: mol_type = other DNA
ggacgctttgtattcagaga

SEQ ID NO: 105395 - DNA, 20 bp, synthetic construct
  misc_feature 1..20: note = CRISPR gRNA sequence
  source 1..20: mol_type = other DNA
ttgtattcagagatggcttc

SEQ ID NO: 105396 - DNA, 20 bp, synthetic construct
  misc_feature 1..20: note = CRISPR gRNA sequence
  source 1..20: mol_type = other DNA
tgtattcagagatggcttcc

SEQ ID NO: 105397 - DNA, 20 bp, synthetic construct
  misc_feature 1..20: note = CRISPR gRNA sequence
  source 1..20: mol_type = other DNA
ttcagagatggcttccaggc

SEQ ID NO: 105398 - DNA, 20 bp, synthetic construct
  misc_feature 1..20: note = CRISPR gRNA sequence
  source 1..20: mol_type = other DNA
tcagagatggcttccaggca

SEQ ID NO: 105399 - DNA, 20 bp, synthetic construct
  misc_feature 1..20: note = CRISPR gRNA sequence
  source 1..20: mol_type = other DNA
gagatggcttccaggcaagg

SEQ ID NO: 105400 - DNA, 20 bp, synthetic construct
  misc_feature 1..20: note = CRISPR gRNA sequence
  source 1..20: mol_type = other DNA
ggaagttctatcttgtgata

SEQ ID NO: 105401 - DNA, 20 bp, synthetic construct
  misc_feature 1..20: note = CRISPR gRNA sequence
  source 1..20: mol_type = other DNA
tacggaaacaataaattcct

SEQ ID NO: 105402 - DNA, 20 bp, synthetic construct
  misc_feature 1..20: note = CRISPR gRNA sequence
  source 1..20: mol_type = other DNA
agatacattcttccaatctg

SEQ ID NO: 105403 - DNA, 20 bp, synthetic construct
  misc_feature 1..20: note = CRISPR gRNA sequence
  source 1..20: mol_type = other DNA
ttccaatctgtggtaataat

SEQ ID NO: 105404 - DNA, 20 bp, synthetic construct
  misc_feature 1..20: note = CRISPR gRNA sequence
  source 1..20: mol_type = other DNA
aataagaattcctctctgcc

SEQ ID NO: 105405 - DNA, 20 bp, synthetic construct
  misc_feature 1..20: note = CRISPR gRNA sequence
  source 1..20: mol_type = other DNA
agaattcctctctgcccaga

SEQ ID NO: 105406 - DNA, 20 bp, synthetic construct
  misc_feature 1..20: note = CRISPR gRNA sequence
  source 1..20: mol_type = other DNA
attcctctctgcccagatgg

SEQ ID NO: 105407 - DNA, 20 bp, synthetic construct
  misc_feature 1..20: note = CRISPR gRNA sequence
  source 1..20: mol_type = other DNA
ttcctctctgcccagatggt

SEQ ID NO: 105408 - DNA, 20 bp, synthetic construct
  misc_feature 1..20: note = CRISPR gRNA sequence
  source 1..20: mol_type = other DNA
agatggtaggttgatatttc

SEQ ID NO: 105409 - DNA, 20 bp, synthetic construct
  misc_feature 1..20: note = CRISPR gRNA sequence
  source 1..20: mol_type = other DNA
aggttgatatttctggactc

SEQ ID NO: 105410 - DNA, 20 bp, synthetic construct
  misc_feature 1..20: note = CRISPR gRNA sequence
  source 1..20: mol_type = other DNA
gatatttctggactctagcc

SEQ ID NO: 105411 - DNA, 20 bp, synthetic construct
  misc_feature 1..20: note = CRISPR gRNA sequence
  source 1..20: mol_type = other DNA
tctggactctagccaagaaa

SEQ ID NO: 105412 - DNA, 20 bp, synthetic construct
  misc_feature 1..20: note = CRISPR gRNA sequence
  source 1..20: mol_type = other DNA
agccaagaaaaagctaattc

SEQ ID NO: 105413 - DNA, 20 bp, synthetic construct
  misc_feature 1..20: note = CRISPR gRNA sequence
  source 1..20: mol_type = other DNA
gccaagaaaaagctaattct

SEQ ID NO: 105414 - DNA, 20 bp, synthetic construct
  misc_feature 1..20: note = CRISPR gRNA sequence
  source 1..20: mol_type = other DNA
ccaagaaaaagctaattctg

SEQ ID NO: 105415 - DNA, 20 bp, synthetic construct
  misc_feature 1..20: note = CRISPR gRNA sequence
  source 1..20: mol_type = other DNA
gaaaaagctaattctgggga

SEQ ID NO: 105416 - DNA, 20 bp, synthetic construct
  misc_feature 1..20: note = CRISPR gRNA sequence
  source 1..20: mol_type = other DNA
ttctggggatagaatgataa

SEQ ID NO: 105417 - DNA, 20 bp, synthetic construct
  misc_feature 1..20: note = CRISPR gRNA sequence
  source 1..20: mol_type = other DNA
gatagaatgataaaagactc

SEQ ID NO: 105418 - DNA, 20 bp, synthetic construct
  misc_feature 1..20: note = CRISPR gRNA sequence
  source 1..20: mol_type = other DNA
cattgccgaatctctttttc

SEQ ID NO: 105419 - DNA, 20 bp, synthetic construct
  misc_feature 1..20: note = CRISPR gRNA sequence
  source 1..20: mol_type = other DNA
tctctttttctagctttgaa

SEQ ID NO: 105420 - DNA, 20 bp, synthetic construct
  misc_feature 1..20: note = CRISPR gRNA sequence
  source 1..20: mol_type = other DNA
tttctagctttgaaaagttg

SEQ ID NO: 105421 - DNA, 20 bp, synthetic construct
  misc_feature 1..20: note = CRISPR gRNA sequence
  source 1..20: mol_type = other DNA
ctgcttgtccctctgttgac

SEQ ID NO: 105422 - DNA, 20 bp, synthetic construct
  misc_feature 1..20: note = CRISPR gRNA sequence
  source 1..20: mol_type = other DNA
ccctctgttgactggtcatc

SEQ ID NO: 105423 - DNA, 20 bp, synthetic construct
  misc_feature 1..20: note = CRISPR gRNA sequence
  source 1..20: mol_type = other DNA
ctggaccatcgtacttgctg

SEQ ID NO: 105424 - DNA, 20 bp, synthetic construct
  misc_feature 1..20: note = CRISPR gRNA sequence
  source 1..20: mol_type = other DNA
tacttgctgtggctacttct

SEQ ID NO: 105425 - DNA, 20 bp, synthetic construct
  misc_feature 1..20: note = CRISPR gRNA sequence
  source 1..20: mol_type = other DNA
tggctacttctaagacaatg

SEQ ID NO: 105426 - DNA, 20 bp, synthetic construct
  misc_feature 1..20: note = CRISPR gRNA sequence
  source 1..20: mol_type = other DNA
gctacttctaagacaatgta

SEQ ID NO: 105427 - DNA, 20 bp, synthetic construct
  misc_feature 1..20: note = CRISPR gRNA sequence
  source 1..20: mol_type = other DNA
ctacttctaagacaatgtag

SEQ ID NO: 105428 - DNA, 20 bp, synthetic construct
  misc_feature 1..20: note = CRISPR gRNA sequence
  source 1..20: mol_type = other DNA
tacttctaagacaatgtaga

SEQ ID NO: 105429 - DNA, 20 bp, synthetic construct
  misc_feature 1..20: note = CRISPR gRNA sequence
  source 1..20: mol_type = other DNA
accttgaaactgcctttcct

SEQ ID NO: 105430 - DNA, 20 bp, synthetic construct
  misc_feature 1..20: note = CRISPR gRNA sequence
  source 1..20: mol_type = other DNA
ttgaaactgcctttcctaag

SEQ ID NO: 105431 - DNA, 20 bp, synthetic construct
  misc_feature 1..20: note = CRISPR gRNA sequence
  source 1..20: mol_type = other DNA
gaaactgcctttcctaagta

SEQ ID NO: 105432 - DNA, 20 bp, synthetic construct
  misc_feature 1..20: note = CRISPR gRNA sequence
  source 1..20: mol_type = other DNA
gcctttcctaagtagagaac

SEQ ID NO: 105433 - DNA, 20 bp, synthetic construct
  misc_feature 1..20: note = CRISPR gRNA sequence
  source 1..20: mol_type = other DNA
attcaacaacttctttgctg

SEQ ID NO: 105434 - DNA, 20 bp, synthetic construct
  misc_feature 1..20: note = CRISPR gRNA sequence
  source 1..20: mol_type = other DNA
aacttctttgctgaagcact

SEQ ID NO: 105435 - DNA, 20 bp, synthetic construct
  misc_feature 1..20: note = CRISPR gRNA sequence
  source 1..20: mol_type = other DNA
acttctttgctgaagcactg

SEQ ID NO: 105436 - DNA, 20 bp, synthetic construct
  misc_feature 1..20: note = CRISPR gRNA sequence
  source 1..20: mol_type = other DNA
ttctttgctgaagcactgag

SEQ ID NO: 105437 - DNA, 20 bp, synthetic construct
  misc_feature 1..20: note = CRISPR gRNA sequence
  source 1..20: mol_type = other DNA
ggagatttgtaatactccta

SEQ ID NO: 105438 - DNA, 20 bp, synthetic construct
  misc_feature 1..20: note = CRISPR gRNA sequence
  source 1..20: mol_type = other DNA
gagatttgtaatactcctaa

SEQ ID NO: 105439 - DNA, 20 bp, synthetic construct
  misc_feature 1..20: note = CRISPR gRNA sequence
  source 1..20: mol_type = other DNA
atttgtaatactcctaaagg

SEQ ID NO: 105440 - DNA, 20 bp, synthetic construct
  misc_feature 1..20: note = CRISPR gRNA sequence
  source 1..20: mol_type = other DNA
tttgtaatactcctaaagga

SEQ ID NO: 105441 - DNA, 20 bp, synthetic construct
  misc_feature 1..20: note = CRISPR gRNA sequence
  source 1..20: mol_type = other DNA
ttgtaatactcctaaaggaa

SEQ ID NO: 105442 - DNA, 20 bp, synthetic construct
  misc_feature 1..20: note = CRISPR gRNA sequence
  source 1..20: mol_type = other DNA
tcctaaaggaagggccaaac

SEQ ID NO: 105443 - DNA, 20 bp, synthetic construct
  misc_feature 1..20: note = CRISPR gRNA sequence
  source 1..20: mol_type = other DNA
ctaaaggaagggccaaacta

SEQ ID NO: 105444 - DNA, 20 bp, synthetic construct
  misc_feature 1..20: note = CRISPR gRNA sequence
  source 1..20: mol_type = other DNA
aaactagagattttcaatca

SEQ ID NO: 105445 - DNA, 20 bp, synthetic construct
  misc_feature 1..20: note = CRISPR gRNA sequence
  source 1..20: mol_type = other DNA
ttcaatcatagactttgtga

SEQ ID NO: 105446 - DNA, 20 bp, synthetic construct
  misc_feature 1..20: note = CRISPR gRNA sequence
  source 1..20: mol_type = other DNA
atagactttgtgacagcatt

SEQ ID NO: 105447 - DNA, 20 bp, synthetic construct
  misc_feature 1..20: note = CRISPR gRNA sequence
  source 1..20: mol_type = other DNA
tagactttgtgacagcattt

SEQ ID NO: 105448 - DNA, 20 bp, synthetic construct
  misc_feature 1..20: note = CRISPR gRNA sequence
  source 1..20: mol_type = other DNA
agactttgtgacagcatttg

SEQ ID NO: 105449 - DNA, 20 bp, synthetic construct
  misc_feature 1..20: note = CRISPR gRNA sequence
  source 1..20: mol_type = other DNA
gacagcatttggggaactaa

SEQ ID NO: 105450 - DNA, 20 bp, synthetic construct
  misc_feature 1..20: note = CRISPR gRNA sequence
  source 1..20: mol_type = other DNA
actaaaagattcatgtgttt

SEQ ID NO: 105451 - DNA, 20 bp, synthetic construct
  misc_feature 1..20: note = CRISPR gRNA sequence
  source 1..20: mol_type = other DNA
aagattcatgtgtttcagcc

SEQ ID NO: 105452 - DNA, 20 bp, synthetic construct
  misc_feature 1..20: note = CRISPR gRNA sequence
  source 1..20: mol_type = other DNA
attcatgtgtttcagcctag

SEQ ID NO: 105453 - DNA, 20 bp, synthetic construct
  misc_feature 1..20: note = CRISPR gRNA sequence
  source 1..20: mol_type = other DNA
ttcatgtgtttcagcctagt

SEQ ID NO: 105454 - DNA, 20 bp, synthetic construct
  misc_feature 1..20: note = CRISPR gRNA sequence
  source 1..20: mol_type = other DNA
catgtgtttcagcctagtgg

SEQ ID NO: 105455 - DNA, 20 bp, synthetic construct
  misc_feature 1..20: note = CRISPR gRNA sequence
  source 1..20: mol_type = other DNA
tgtgtttcagcctagtggga

SEQ ID NO: 105456 - DNA, 20 bp, synthetic construct
  misc_feature 1..20: note = CRISPR gRNA sequence
  source 1..20: mol_type = other DNA
tgtttcagcctagtgggaga

SEQ ID NO: 105457 - DNA, 20 bp, synthetic construct
  misc_feature 1..20: note = CRISPR gRNA sequence
  source 1..20: mol_type = other DNA
ttcagcctagtgggagagag

SEQ ID NO: 105458 - DNA, 20 bp, synthetic construct
  misc_feature 1..20: note = CRISPR gRNA sequence
  source 1..20: mol_type = other DNA
tcagcctagtgggagagagt

SEQ ID NO: 105459 - DNA, 20 bp, synthetic construct
  misc_feature 1..20: note = CRISPR gRNA sequence
  source 1..20: mol_type = other DNA
cagcctagtgggagagagtg

SEQ ID NO: 105460 - DNA, 20 bp, synthetic construct
  misc_feature 1..20: note = CRISPR gRNA sequence
  source 1..20: mol_type = other DNA
agcctagtgggagagagtgg

SEQ ID NO: 105461 - DNA, 20 bp, synthetic construct
  misc_feature 1..20: note = CRISPR gRNA sequence
  source 1..20: mol_type = other DNA
cctagtgggagagagtgggg

SEQ ID NO: 105462 - DNA, 20 bp, synthetic construct
  misc_feature 1..20: note = CRISPR gRNA sequence
  source 1..20: mol_type = other DNA
tagtgggagagagtggggga

SEQ ID NO: 105463 - DNA, 20 bp, synthetic construct
  misc_feature 1..20: note = CRISPR gRNA sequence
  source 1..20: mol_type = other DNA
agtgggagagagtgggggag

SEQ ID NO: 105464 - DNA, 20 bp, synthetic construct
  misc_feature 1..20: note = CRISPR gRNA sequence
  source 1..20: mol_type = other DNA
gggagagagtgggggagagg

SEQ ID NO: 105465 - DNA, 20 bp, synthetic construct
  misc_feature 1..20: note = CRISPR gRNA sequence
  source 1..20: mol_type = other DNA
gagagagtgggggagaggaa

SEQ ID NO: 105466 - DNA, 20 bp, synthetic construct
  misc_feature 1..20: note = CRISPR gRNA sequence
  source 1..20: mol_type = other DNA
gagagtgggggagaggaaga

SEQ ID NO: 105467 - DNA, 20 bp, synthetic construct
  misc_feature 1..20: note = CRISPR gRNA sequence
  source 1..20: mol_type = other DNA
gagtgggggagaggaagaga

SEQ ID NO: 105468 - DNA, 20 bp, synthetic construct
  misc_feature 1..20: note = CRISPR gRNA sequence
  source 1..20: mol_type = other DNA
gtgggggagaggaagagaga

SEQ ID NO: 105469 - DNA, 20 bp, synthetic construct
  misc_feature 1..20: note = CRISPR gRNA sequence
  source 1..20: mol_type = other DNA
gggggagaggaagagagaga

SEQ ID NO: 105470 - DNA, 20 bp, synthetic construct
  misc_feature 1..20: note = CRISPR gRNA sequence
  source 1..20: mol_type = other DNA
gggagaggaagagagagaga

SEQ ID NO: 105471 - DNA, 20 bp, synthetic construct
  misc_feature 1..20: note = CRISPR gRNA sequence
  source 1..20: mol_type = other DNA
tgtatacccgtatgttatca

SEQ ID NO: 105472 - DNA, 20 bp, synthetic construct
  misc_feature 1..20: note = CRISPR gRNA sequence
  source 1..20: mol_type = other DNA
tatacccgtatgttatcata

SEQ ID NO: 105473 - DNA, 20 bp, synthetic construct
  misc_feature 1..20: note = CRISPR gRNA sequence
  source 1..20: mol_type = other DNA
tatcatagagcacgattctc

SEQ ID NO: 105474 - DNA, 20 bp, synthetic construct
  misc_feature 1..20: note = CRISPR gRNA sequence
  source 1..20: mol_type = other DNA
catagagcacgattctccag

SEQ ID NO: 105475 - DNA, 20 bp, synthetic construct
  misc_feature 1..20: note = CRISPR gRNA sequence
  source 1..20: mol_type = other DNA
gagcacgattctccagtgga

SEQ ID NO: 105476 - DNA, 20 bp, synthetic construct
  misc_feature 1..20: note = CRISPR gRNA sequence
  source 1..20: mol_type = other DNA
ttctccagtggatggatacc

SEQ ID NO: 105477 - DNA, 20 bp, synthetic construct
  misc_feature 1..20: note = CRISPR gRNA sequence
  source 1..20: mol_type = other DNA
cagtggatggatacctggaa

SEQ ID NO: 105478 - DNA, 20 bp, synthetic construct
  misc_feature 1..20: note = CRISPR gRNA sequence
  source 1..20: mol_type = other DNA
gatacctggaatggatcatt

SEQ ID NO: 105479 - DNA, 20 bp, synthetic construct
  misc_feature 1..20: note = CRISPR gRNA sequence
  source 1..20: mol_type = other DNA
tggaatggatcattaagatg

SEQ ID NO: 105480 - DNA, 20 bp, synthetic construct
  misc_feature 1..20: note = CRISPR gRNA sequence
  source 1..20: mol_type = other DNA
gaatggatcattaagatgaa

SEQ ID NO: 105481 - DNA, 20 bp, synthetic construct
  misc_feature 1..20: note = CRISPR gRNA sequence
  source 1..20: mol_type = other DNA
atggatcattaagatgaaga

SEQ ID NO: 105482 - DNA, 20 bp, synthetic construct
  misc_feature 1..20: note = CRISPR gRNA sequence
  source 1..20: mol_type = other DNA
agagtaattcacatttactc

SEQ ID NO: 105483 - DNA, 20 bp, synthetic construct
  misc_feature 1..20: note = CRISPR gRNA sequence
  source 1..20: mol_type = other DNA
tttactctagaacctttaac

SEQ ID NO: 105484 - DNA, 20 bp, synthetic construct
  misc_feature 1..20: note = CRISPR gRNA sequence
  source 1..20: mol_type = other DNA
gaacctttaacaagcactga

SEQ ID NO: 105485 - DNA, 20 bp, synthetic construct
  misc_feature 1..20: note = CRISPR gRNA sequence
  source 1..20: mol_type = other DNA
aacctttaacaagcactgaa

SEQ ID NO: 105486 - DNA, 20 bp, synthetic construct
  misc_feature 1..20: note = CRISPR gRNA sequence
  source 1..20: mol_type = other DNA
ctttaacaagcactgaaagg

SEQ ID NO: 105487 - DNA, 20 bp, synthetic construct
  misc_feature 1..20: note = CRISPR gRNA sequence
  source 1..20: mol_type = other DNA
taacaagcactgaaaggaag

SEQ ID NO: 105488 - DNA, 20 bp, synthetic construct
  misc_feature 1..20: note = CRISPR gRNA sequence
  source 1..20: mol_type = other DNA
gcactgaaaggaagaagcct

SEQ ID NO: 105489 - DNA, 20 bp, synthetic construct
  misc_feature 1..20: note = CRISPR gRNA sequence
  source 1..20: mol_type = other DNA
atttgatccttgacaatttc

SEQ ID NO: 105490 - DNA, 20 bp, synthetic construct
  misc_feature 1..20: note = CRISPR gRNA sequence
  source 1..20: mol_type = other DNA
gatccttgacaatttctgga

SEQ ID NO: 105491 - DNA, 20 bp, synthetic construct
  misc_feature 1..20: note = CRISPR gRNA sequence
  source 1..20: mol_type = other DNA
tgacaatttctggaaagcac

SEQ ID NO: 105492 - DNA, 20 bp, synthetic construct
  misc_feature 1..20: note = CRISPR gRNA sequence
  source 1..20: mol_type = other DNA
aatttctggaaagcactggt

SEQ ID NO: 105493 - DNA, 20 bp, synthetic construct
  misc_feature 1..20: note = CRISPR gRNA sequence
  source 1..20: mol_type = other DNA
actggtcagtcacactgtcc

SEQ ID NO: 105494 - DNA, 20 bp, synthetic construct
  misc_feature 1..20: note = CRISPR gRNA sequence
  source 1..20: mol_type = other DNA
gtcagtcacactgtcctgga

SEQ ID NO: 105495 - DNA, 20 bp, synthetic construct
  misc_feature 1..20: note = CRISPR gRNA sequence
  source 1..20: mol_type = other DNA
cagtcacactgtcctggaca

SEQ ID NO: 105496 - DNA, 20 bp, synthetic construct
  misc_feature 1..20: note = CRISPR gRNA sequence
  source 1..20: mol_type = other DNA
cactgtcctggacagagtcc

SEQ ID NO: 105497 - DNA, 20 bp, synthetic construct
  misc_feature 1..20: note = CRISPR gRNA sequence
  source 1..20: mol_type = other DNA
agagtccaagttacccacta

SEQ ID NO: 105498 - DNA, 20 bp, synthetic construct
  misc_feature 1..20: note = CRISPR gRNA sequence
  source 1..20: mol_type = other DNA
caagttacccactaaagctt

SEQ ID NO: 105499 - DNA, 20 bp, synthetic construct
  misc_feature 1..20: note = CRISPR gRNA sequence
  source 1..20: mol_type = other DNA
aagttacccactaaagcttg

SEQ ID NO: 105500 - DNA, 20 bp, synthetic construct
  misc_feature 1..20: note = CRISPR gRNA sequence
  source 1..20: mol_type = other DNA
ttacccactaaagcttgagg

SEQ ID NO: 105501 - DNA, 20 bp, synthetic construct
  misc_feature 1..20: note = CRISPR gRNA sequence
  source 1..20: mol_type = other DNA
ctaaagcttgaggtggatgt

SEQ ID NO: 105502 - DNA, 20 bp, synthetic construct
  misc_feature 1..20: note = CRISPR gRNA sequence
  source 1..20: mol_type = other DNA
ggatgttggcttcactcctg

SEQ ID NO: 105503 - DNA, 20 bp, synthetic construct
  misc_feature 1..20: note = CRISPR gRNA sequence
  source 1..20: mol_type = other DNA
tcactcctgcagcacaatgc

SEQ ID NO: 105504 - DNA, 20 bp, synthetic construct
  misc_feature 1..20: note = CRISPR gRNA sequence
  source 1..20: mol_type = other DNA
ctgcagcacaatgctggccc

SEQ ID NO: 105505 - DNA, 20 bp, synthetic construct
  misc_feature 1..20: note = CRISPR gRNA sequence
  source 1..20: mol_type = other DNA
agcacaatgctggccctaga

SEQ ID NO: 105506 - DNA, 20 bp, synthetic construct
  misc_feature 1..20: note = CRISPR gRNA sequence
  source 1..20: mol_type = other DNA
caatgctggccctagaaagc

SEQ ID NO: 105507 - DNA, 20 bp, synthetic construct
  misc_feature 1..20: note = CRISPR gRNA sequence
  source 1..20: mol_type = other DNA
gagcattttcattcttccca

SEQ ID NO: 105508 - DNA, 20 bp, synthetic construct
  misc_feature 1..20: note = CRISPR gRNA sequence
  source 1..20: mol_type = other DNA
cattttcattcttcccatgg

SEQ ID NO: 105509 - DNA, 20 bp, synthetic construct
  misc_feature 1..20: note = CRISPR gRNA sequence
  source 1..20: mol_type = other DNA
tcccatggcagctgattctt

SEQ ID NO: 105510 - DNA, 20 bp, synthetic construct
  misc_feature 1..20: note = CRISPR gRNA sequence
  source 1..20: mol_type = other DNA
ggcagctgattctttggtgc

SEQ ID NO: 105511 - DNA, 20 bp, synthetic construct
  misc_feature 1..20: note = CRISPR gRNA sequence
  source 1..20: mol_type = other DNA
cagttttcatgttttctcca

SEQ ID NO: 105512 - DNA, 20 bp, synthetic construct
  misc_feature 1..20: note = CRISPR gRNA sequence
  source 1..20: mol_type = other DNA
agttttcatgttttctccat

SEQ ID NO: 105513 - DNA, 20 bp, synthetic construct
  misc_feature 1..20: note = CRISPR gRNA sequence
  source 1..20: mol_type = other DNA
ttttctccataggccttgtg

SEQ ID NO: 105514 - DNA, 20 bp, synthetic construct
  misc_feature 1..20: note = CRISPR gRNA sequence
  source 1..20: mol_type = other DNA
ctccataggccttgtgcaga

SEQ ID NO: 105515 - DNA, 20 bp, synthetic construct
  misc_feature 1..20: note = CRISPR gRNA sequence
  source 1..20: mol_type = other DNA
tccataggccttgtgcagaa

SEQ ID NO: 105516 - DNA, 20 bp, synthetic construct
  misc_feature 1..20: note = CRISPR gRNA sequence
  source 1..20: mol_type = other DNA
tctcattgcatccatactgt

SEQ ID NO: 105517 - DNA, 20 bp, synthetic construct
  misc_feature 1..20: note = CRISPR gRNA sequence
  source 1..20: mol_type = other DNA
catactgtgagaataaactg

SEQ ID NO: 105518 - DNA, 20 bp, synthetic construct
  misc_feature 1..20: note = CRISPR gRNA sequence
  source 1..20: mol_type = other DNA
gagaataaactgcagactga

SEQ ID NO: 105519 - DNA, 20 bp, synthetic construct
  misc_feature 1..20: note = CRISPR gRNA sequence
  source 1..20: mol_type = other DNA
gactgaaagaaacatgcctg

SEQ ID NO: 105520 - DNA, 20 bp, synthetic construct
  misc_feature 1..20: note = CRISPR gRNA sequence
  source 1..20: mol_type = other DNA
actgaaagaaacatgcctgc

SEQ ID NO: 105521 - DNA, 20 bp, synthetic construct
  misc_feature 1..20: note = CRISPR gRNA sequence
  source 1..20: mol_type = other DNA
ctgaaagaaacatgcctgca

SEQ ID NO: 105522 - DNA, 20 bp, synthetic construct
  misc_feature 1..20: note = CRISPR gRNA sequence
  source 1..20: mol_type = other DNA
aagaaacatgcctgcagggt

SEQ ID NO: 105523 - DNA, 20 bp, synthetic construct
  misc_feature 1..20: note = CRISPR gRNA sequence
  source 1..20: mol_type = other DNA
agaaacatgcctgcagggtc

SEQ ID NO: 105524 - DNA, 20 bp, synthetic construct
  misc_feature 1..20: note = CRISPR gRNA sequence
  source 1..20: mol_type = other DNA
atgcctgcagggtcaggaac

SEQ ID NO: 105525 - DNA, 20 bp, synthetic construct
  misc_feature 1..20: note = CRISPR gRNA sequence
  source 1..20: mol_type = other DNA
tgcctgcagggtcaggaact

SEQ ID NO: 105526 - DNA, 20 bp, synthetic construct
  misc_feature 1..20: note = CRISPR gRNA sequence
  source 1..20: mol_type = other DNA
aggaactgggccactgttcc

SEQ ID NO: 105527 - DNA, 20 bp, synthetic construct
  misc_feature 1..20: note = CRISPR gRNA sequence
  source 1..20: mol_type = other DNA
ctgggccactgttcccagaa

SEQ ID NO: 105528 - DNA, 20 bp, synthetic construct
  misc_feature 1..20: note = CRISPR gRNA sequence
  source 1..20: mol_type = other DNA
tgggccactgttcccagaac

SEQ ID NO: 105529 - DNA, 20 bp, synthetic construct
  misc_feature 1..20: note = CRISPR gRNA sequence
  source 1..20: mol_type = other DNA
tcccagaacgggttgtgcct

SEQ ID NO: 105530 - DNA, 20 bp, synthetic construct
  misc_feature 1..20: note = CRISPR gRNA sequence
  source 1..20: mol_type = other DNA
tcagaaatctatttctcttt

SEQ ID NO: 105531 - DNA, 20 bp, synthetic construct
  misc_feature 1..20: note = CRISPR gRNA sequence
  source 1..20: mol_type = other DNA
tcttttagatgttgaaccct

SEQ ID NO: 105532 - DNA, 20 bp, synthetic construct
  misc_feature 1..20: note = CRISPR gRNA sequence
  source 1..20: mol_type = other DNA
ttttagatgttgaaccctga

SEQ ID NO: 105533 - DNA, 20 bp, synthetic construct
  misc_feature 1..20: note = CRISPR gRNA sequence
  source 1..20: mol_type = other DNA
tgttgaaccctgagagaact

SEQ ID NO: 105534 - DNA, 20 bp, synthetic construct
  misc_feature 1..20: note = CRISPR gRNA sequence
  source 1..20: mol_type = other DNA
agagaactaagatgatattt

SEQ ID NO: 105535 - DNA, 20 bp, synthetic construct
  misc_feature 1..20: note = CRISPR gRNA sequence
  source 1..20: mol_type = other DNA
gaactaagatgatatttcag

SEQ ID NO: 105536 - DNA, 20 bp, synthetic construct
  misc_feature 1..20: note = CRISPR gRNA sequence
  source 1..20: mol_type = other DNA
actaagatgatatttcagaa

SEQ ID NO: 105537 - DNA, 20 bp, synthetic construct
  misc_feature 1..20: note = CRISPR gRNA sequence
  source 1..20: mol_type = other DNA
agatgatatttcagaagagt

SEQ ID NO: 105538 - DNA, 20 bp, synthetic construct
  misc_feature 1..20: note = CRISPR gRNA sequence
  source 1..20: mol_type = other DNA
gaagagttggctgccttctc

SEQ ID NO: 105539 - DNA, 20 bp, synthetic construct
  misc_feature 1..20: note = CRISPR gRNA sequence
  source 1..20: mol_type = other DNA
tggctgccttctctggaaac

SEQ ID NO: 105540 - DNA, 20 bp, synthetic construct
  misc_feature 1..20: note = CRISPR gRNA sequence
  source 1..20: mol_type = other DNA
ggctgccttctctggaaaca

SEQ ID NO: 105541 - DNA, 20 bp, synthetic construct
  misc_feature 1..20: note = CRISPR gRNA sequence
  source 1..20: mol_type = other DNA
aaggaaaacccaataattcc

SEQ ID NO: 105542 - DNA, 20 bp, synthetic construct
  misc_feature 1..20: note = CRISPR gRNA sequence
  source 1..20: mol_type = other DNA
aggaaaacccaataattccg

SEQ ID NO: 105543 - DNA, 20 bp, synthetic construct
  misc_feature 1..20: note = CRISPR gRNA sequence
  source 1..20: mol_type = other DNA
ccaataattccgaggaacat

SEQ ID NO: 105544 - DNA, 20 bp, synthetic construct
  misc_feature 1..20: note = CRISPR gRNA sequence
  source 1..20: mol_type = other DNA
caataattccgaggaacatt

SEQ ID NO: 105545 - DNA, 20 bp, synthetic construct
  misc_feature 1..20: note = CRISPR gRNA sequence
  source 1..20: mol_type = other DNA
aataattccgaggaacattg

SEQ ID NO: 105546 - DNA, 20 bp, synthetic construct
  misc_feature 1..20: note = CRISPR gRNA sequence
  source 1..20: mol_type = other DNA
ataattccgaggaacattgg

SEQ ID NO: 105547 - DNA, 20 bp, synthetic construct
  misc_feature 1..20: note = CRISPR gRNA sequence
  source 1..20: mol_type = other DNA
aacattgggggttaaatacc

SEQ ID NO: 105548 - DNA, 20 bp, synthetic construct
  misc_feature 1..20: note = CRISPR gRNA sequence
  source 1..20: mol_type = other DNA
taaataccaagaataaaaat

SEQ ID NO: 105549 - DNA, 20 bp, synthetic construct
  misc_feature 1..20: note = CRISPR gRNA sequence
  source 1..20: mol_type = other DNA
aattggttcttctttgactt

SEQ ID NO: 105550 - DNA, 20 bp, synthetic construct
  misc_feature 1..20: note = CRISPR gRNA sequence
  source 1..20: mol_type = other DNA
gacttcagcttaactgtatt

SEQ ID NO: 105551 - DNA, 20 bp, synthetic construct
  misc_feature 1..20: note = CRISPR gRNA sequence
  source 1..20: mol_type = other DNA
tcagcttaactgtattaaga

SEQ ID NO: 105552 - DNA, 20 bp, synthetic construct
  misc_feature 1..20: note = CRISPR gRNA sequence
  source 1..20: mol_type = other DNA
actgtattaagacagaaatt

SEQ ID NO: 105553 - DNA, 20 bp, synthetic construct
  misc_feature 1..20: note = CRISPR gRNA sequence
  source 1..20: mol_type = other DNA
agccctctaaaaacaccaca

SEQ ID NO: 105554 - DNA, 20 bp, synthetic construct
  misc_feature 1..20: note = CRISPR gRNA sequence
  source 1..20: mol_type = other DNA
ccctctaaaaacaccacaaa

SEQ ID NO: 105555 - DNA, 20 bp, synthetic construct
  misc_feature 1..20: note = CRISPR gRNA sequence
  source 1..20: mol_type = other DNA
ctctaaaaacaccacaaaga

SEQ ID NO: 105556 - DNA, 20 bp, synthetic construct
  misc_feature 1..20: note = CRISPR gRNA sequence
  source 1..20: mol_type = other DNA
aagagagatgattgtaatga

SEQ ID NO: 105557 - DNA, 20 bp, synthetic construct
  misc_feature 1..20: note = CRISPR gRNA sequence
  source 1..20: mol_type = other DNA
gatgattgtaatgatagaaa

SEQ ID NO: 105558 - DNA, 20 bp, synthetic construct
  misc_feature 1..20: note = CRISPR gRNA sequence
  source 1..20: mol_type = other DNA
tgattgtaatgatagaaata

SEQ ID NO: 105559 - DNA, 20 bp, synthetic construct
  misc_feature 1..20: note = CRISPR gRNA sequence
  source 1..20: mol_type = other DNA
gattgtaatgatagaaatag

SEQ ID NO: 105560 - DNA, 20 bp, synthetic construct
  misc_feature 1..20: note = CRISPR gRNA sequence
  source 1..20: mol_type = other DNA
taatgatagaaatagaggta

SEQ ID NO: 105561 - DNA, 20 bp, synthetic construct
  misc_feature 1..20: note = CRISPR gRNA sequence
  source 1..20: mol_type = other DNA
atgatagaaatagaggtaca

SEQ ID NO: 105562 - DNA, 20 bp, synthetic construct
  misc_feature 1..20: note = CRISPR gRNA sequence
  source 1..20: mol_type = other DNA
tagaggtacagagctatgca

SEQ ID NO: 105563 - DNA, 20 bp, synthetic construct
  misc_feature 1..20: note = CRISPR gRNA sequence
  source 1..20: mol_type = other DNA
agaggtacagagctatgcaa

SEQ ID NO: 105564 - DNA, 20 bp, synthetic construct
  misc_feature 1..20: note = CRISPR gRNA sequence
  source 1..20: mol_type = other DNA
acagagctatgcaaaggaaa

SEQ ID NO: 105565 - DNA, 20 bp, synthetic construct
  misc_feature 1..20: note = CRISPR gRNA sequence
  source 1..20: mol_type = other DNA
cagagctatgcaaaggaaac

SEQ ID NO: 105566 - DNA, 20 bp, synthetic construct
  misc_feature 1..20: note = CRISPR gRNA sequence
  source 1..20: mol_type = other DNA
agctatgcaaaggaaacagg

SEQ ID NO: 105567 - DNA, 20 bp, synthetic construct
  misc_feature 1..20: note = CRISPR gRNA sequence
  source 1..20: mol_type = other DNA
aacaggaagtgaaatattcc

SEQ ID NO: 105568 - DNA, 20 bp, synthetic construct
  misc_feature 1..20: note = CRISPR gRNA sequence
  source 1..20: mol_type = other DNA
aagtgaaatattcctagtcc

SEQ ID NO: 105569 - DNA, 20 bp, synthetic construct
  misc_feature 1..20: note = CRISPR gRNA sequence
  source 1..20: mol_type = other DNA
agtgaaatattcctagtccc

SEQ ID NO: 105570 - DNA, 20 bp, synthetic construct
  misc_feature 1..20: note = CRISPR gRNA sequence
  source 1..20: mol_type = other DNA
gtgaaatattcctagtccca

SEQ ID NO: 105571 - DNA, 20 bp, synthetic construct
  misc_feature 1..20: note = CRISPR gRNA sequence
  source 1..20: mol_type = other DNA
tattcctagtcccagggatc

SEQ ID NO: 105572 - DNA, 20 bp, synthetic construct
  misc_feature 1..20: note = CRISPR gRNA sequence
  source 1..20: mol_type = other DNA
agggatctggtaatcgctcc

SEQ ID NO: 105573 - DNA, 20 bp, synthetic construct
  misc_feature 1..20: note = CRISPR gRNA sequence
  source 1..20: mol_type = other DNA
tggtaatcgctcctggcttc

SEQ ID NO: 105574 - DNA, 20 bp, synthetic construct
  misc_feature 1..20: note = CRISPR gRNA sequence
  source 1..20: mol_type = other DNA
ctcctggcttccagatgtca

SEQ ID NO: 105575 - DNA, 20 bp, synthetic construct
  misc_feature 1..20: note = CRISPR gRNA sequence
  source 1..20: mol_type = other DNA
tcctggcttccagatgtcaa

SEQ ID NO: 105576 - DNA, 20 bp, synthetic construct
  misc_feature 1..20: note = CRISPR gRNA sequence
  source 1..20: mol_type = other DNA
atgtcaaaggactgatcctt

SEQ ID NO: 105577 - DNA, 20 bp, synthetic construct
  misc_feature 1..20: note = CRISPR gRNA sequence
  source 1..20: mol_type = other DNA
caaaggactgatcctttggt

SEQ ID NO: 105578 - DNA, 20 bp, synthetic construct
  misc_feature 1..20: note = CRISPR gRNA sequence
  source 1..20: mol_type = other DNA
tgatcctttggtaagctcac

SEQ ID NO: 105579 - DNA, 20 bp, synthetic construct
  misc_feature 1..20: note = CRISPR gRNA sequence
  source 1..20: mol_type = other DNA
gtaagctcactagaaacttc

SEQ ID NO: 105580 - DNA, 20 bp, synthetic construct
  misc_feature 1..20: note = CRISPR gRNA sequence
  source 1..20: mol_type = other DNA
ctagaaacttctagctctac

SEQ ID NO: 105581 - DNA, 20 bp, synthetic construct
  misc_feature 1..20: note = CRISPR gRNA sequence
  source 1..20: mol_type = other DNA
agaaacttctagctctacaa

SEQ ID NO: 105582 - DNA, 20 bp, synthetic construct
  misc_feature 1..20: note = CRISPR gRNA sequence
  source 1..20: mol_type = other DNA
cttctagctctacaagagtt

SEQ ID NO: 105583 - DNA, 20 bp, synthetic construct
  misc_feature 1..20: note = CRISPR gRNA sequence
  source 1..20: mol_type = other DNA
ttctagctctacaagagttt

SEQ ID NO: 105584 - DNA, 20 bp, synthetic construct
  misc_feature 1..20: note = CRISPR gRNA sequence
  source 1..20: mol_type = other DNA
tttgggatattaatgttatt

SEQ ID NO: 105585 - DNA, 20 bp, synthetic construct
  misc_feature 1..20: note = CRISPR gRNA sequence
  source 1..20: mol_type = other DNA
ggatattaatgttattcagt

SEQ ID NO: 105586 - DNA, 20 bp, synthetic construct
  misc_feature 1..20: note = CRISPR gRNA sequence
  source 1..20: mol_type = other DNA
aatgttattcagtaagtccc

SEQ ID NO: 105587 - DNA, 20 bp, synthetic construct
  misc_feature 1..20: note = CRISPR gRNA sequence
  source 1..20: mol_type = other DNA
tcagtaagtcccaagttttt

SEQ ID NO: 105588 - DNA, 20 bp, synthetic construct
  misc_feature 1..20: note = CRISPR gRNA sequence
  source 1..20: mol_type = other DNA
agtaagtcccaagtttttca

SEQ ID NO: 105589 - DNA, 20 bp, synthetic construct
  misc_feature 1..20: note = CRISPR gRNA sequence
  source 1..20: mol_type = other DNA
gtcccaagtttttcagagaa

SEQ ID NO: 105590 - DNA, 20 bp, synthetic construct
  misc_feature 1..20: note = CRISPR gRNA sequence
  source 1..20: mol_type = other DNA
gagaatagattactaacaat

SEQ ID NO: 105591 - DNA, 20 bp, synthetic construct
  misc_feature 1..20: note = CRISPR gRNA sequence
  source 1..20: mol_type = other DNA
agaatagattactaacaatg

SEQ ID NO: 105592 - DNA, 20 bp, synthetic construct
  misc_feature 1..20: note = CRISPR gRNA sequence
  source 1..20: mol_type = other DNA
aatgaggaatttatattcct

SEQ ID NO: 105593 - DNA, 20 bp, synthetic construct
  misc_feature 1..20: note = CRISPR gRNA sequence
  source 1..20: mol_type = other DNA
tttatattccttggttaatt

SEQ ID NO: 105594 - DNA, 20 bp, synthetic construct
  misc_feature 1..20: note = CRISPR gRNA sequence
  source 1..20: mol_type = other DNA
ttatattccttggttaattt

SEQ ID NO: 105595 - DNA, 20 bp, synthetic construct
  misc_feature 1..20: note = CRISPR gRNA sequence
  source 1..20: mol_type = other DNA
atattccttggttaatttag

SEQ ID NO: 105596 - DNA, 20 bp, synthetic construct
  misc_feature 1..20: note = CRISPR gRNA sequence
  source 1..20: mol_type = other DNA
cttggttaatttaggagtct

SEQ ID NO: 105597 - DNA, 20 bp, synthetic construct
  misc_feature 1..20: note = CRISPR gRNA sequence
  source 1..20: mol_type = other DNA
taatttaggagtctaagatg

SEQ ID NO: 105598 - DNA, 20 bp, synthetic construct
  misc_feature 1..20: note = CRISPR gRNA sequence
  source 1..20: mol_type = other DNA
atttaggagtctaagatgca

SEQ ID NO: 105599 - DNA, 20 bp, synthetic construct
  misc_feature 1..20: note = CRISPR gRNA sequence
  source 1..20: mol_type = other DNA
ggagtctaagatgcagagtt

SEQ ID NO: 105600 - DNA, 20 bp, synthetic construct
  misc_feature 1..20: note = CRISPR gRNA sequence
  source 1..20: mol_type = other DNA
tctaagatgcagagttcaga

SEQ ID NO: 105601 - DNA, 20 bp, synthetic construct
  misc_feature 1..20: note = CRISPR gRNA sequence
  source 1..20: mol_type = other DNA
gagttcagaaagaaattact

SEQ ID NO: 105602 - DNA, 20 bp, synthetic construct
  misc_feature 1..20: note = CRISPR gRNA sequence
  source 1..20: mol_type = other DNA
aattactcagacctaacttt

SEQ ID NO: 105603 - DNA, 20 bp, synthetic construct
  misc_feature 1..20: note = CRISPR gRNA sequence
  source 1..20: mol_type = other DNA
agacctaactttgagtgctt

SEQ ID NO: 105604 - DNA, 20 bp, synthetic construct
  misc_feature 1..20: note = CRISPR gRNA sequence
  source 1..20: mol_type = other DNA
ttgagtgcttaagctgccaa

SEQ ID NO: 105605 - DNA, 20 bp, synthetic construct
  misc_feature 1..20: note = CRISPR gRNA sequence
  source 1..20: mol_type = other DNA
gtgcttaagctgccaacagt

SEQ ID NO: 105606 - DNA, 20 bp, synthetic construct
  misc_feature 1..20: note = CRISPR gRNA sequence
  source 1..20: mol_type = other DNA
cttaagctgccaacagttag

SEQ ID NO: 105607 - DNA, 20 bp, synthetic construct
  misc_feature 1..20: note = CRISPR gRNA sequence
  source 1..20: mol_type = other DNA
tgctatttatttgtgtctgt

SEQ ID NO: 105608 - DNA, 20 bp, synthetic construct
  misc_feature 1..20: note = CRISPR gRNA sequence
  source 1..20: mol_type = other DNA
tgtgtctgtaagtttgtaca

SEQ ID NO: 105609 - DNA, 20 bp, synthetic construct
  misc_feature 1..20: note = CRISPR gRNA sequence
  source 1..20: mol_type = other DNA
aagtttgtacatagtaatgc

SEQ ID NO: 105610 - DNA, 20 bp, synthetic construct
  misc_feature 1..20: note = CRISPR gRNA sequence
  source 1..20: mol_type = other DNA
ttgttgctgaattttttatt

SEQ ID NO: 105611 - DNA, 20 bp, synthetic construct
  misc_feature 1..20: note = CRISPR gRNA sequence
  source 1..20: mol_type = other DNA
tgttgctgaattttttattt

SEQ ID NO: 105612 - DNA, 20 bp, synthetic construct
  misc_feature 1..20: note = CRISPR gRNA sequence
  source 1..20: mol_type = other DNA
gttgctgaattttttatttg

SEQ ID NO: 105613 - DNA, 20 bp, synthetic construct
  misc_feature 1..20: note = CRISPR gRNA sequence
  source 1..20: mol_type = other DNA
ttgctgaattttttatttgg

SEQ ID NO: 105614 - DNA, 20 bp, synthetic construct
  misc_feature 1..20: note = CRISPR gRNA sequence
  source 1..20: mol_type = other DNA
tgctgaattttttatttggg

SEQ ID NO: 105615 - DNA, 20 bp, synthetic construct
  misc_feature 1..20: note = CRISPR gRNA sequence
  source 1..20: mol_type = other DNA
ctgaattttttatttggggg

SEQ ID NO: 105616 - DNA, 20 bp, synthetic construct
  misc_feature 1..20: note = CRISPR gRNA sequence
  source 1..20: mol_type = other DNA
gaattttgtttgaaatgctt

SEQ ID NO: 105617 - DNA, 20 bp, synthetic construct
  misc_feature 1..20: note = CRISPR gRNA sequence
  source 1..20: mol_type = other DNA
ttttgtcattgcatttcaaa

SEQ ID NO: 105618 - DNA, 20 bp, synthetic construct
  misc_feature 1..20: note = CRISPR gRNA sequence
  source 1..20: mol_type = other DNA
agctcatgacccttttcttg

SEQ ID NO: 105619 - DNA, 20 bp, synthetic construct
  misc_feature 1..20: note = CRISPR gRNA sequence
  source 1..20: mol_type = other DNA
cccttttcttgtggtcactt

SEQ ID NO: 105620 - DNA, 20 bp, synthetic construct
  misc_feature 1..20: note = CRISPR gRNA sequence
  source 1..20: mol_type = other DNA
gtggtcactttggcacacca

SEQ ID NO: 105621 - DNA, 20 bp, synthetic construct
  misc_feature 1..20: note = CRISPR gRNA sequence
  source 1..20: mol_type = other DNA
gtcactttggcacaccatag

SEQ ID NO: 105622 - DNA, 20 bp, synthetic construct
  misc_feature 1..20: note = CRISPR gRNA sequence
  source 1..20: mol_type = other DNA
gcacaccatagtagcccaca

SEQ ID NO: 105623 - DNA, 20 bp, synthetic construct
  misc_feature 1..20: note = CRISPR gRNA sequence
  source 1..20: mol_type = other DNA
caccatagtagcccacaaag

SEQ ID NO: 105624 - DNA, 20 bp, synthetic construct
  misc_feature 1..20: note = CRISPR gRNA sequence
  source 1..20: mol_type = other DNA
accatagtagcccacaaagt

SEQ ID NO: 105625 - DNA, 20 bp, synthetic construct
  misc_feature 1..20: note = CRISPR gRNA sequence
  source 1..20: mol_type = other DNA
ccatagtagcccacaaagtg

SEQ ID NO: 105626 - DNA, 20 bp, synthetic construct
  misc_feature 1..20: note = CRISPR gRNA sequence
  source 1..20: mol_type = other DNA
catagtagcccacaaagtgg

SEQ ID NO: 105627 - DNA, 20 bp, synthetic construct
  misc_feature 1..20: note = CRISPR gRNA sequence
  source 1..20: mol_type = other DNA
agtagcccacaaagtggggg

SEQ ID NO: 105628 - DNA, 20 bp, synthetic construct
  misc_feature 1..20: note = CRISPR gRNA sequence
  source 1..20: mol_type = other DNA
gtagcccacaaagtgggggc

SEQ ID NO: 105629 - DNA, 20 bp, synthetic construct
  misc_feature 1..20: note = CRISPR gRNA sequence
  source 1..20: mol_type = other DNA
tagcccacaaagtgggggca

SEQ ID NO: 105630 - DNA, 20 bp, synthetic construct
  misc_feature 1..20: note = CRISPR gRNA sequence
  source 1..20: mol_type = other DNA
gggggcagggtattgacatt

SEQ ID NO: 105631 - DNA, 20 bp, synthetic construct
  misc_feature 1..20: note = CRISPR gRNA sequence
  source 1..20: mol_type = other DNA
ttggattttttctttgatac

SEQ ID NO: 105632 - DNA, 20 bp, synthetic construct
  misc_feature 1..20: note = CRISPR gRNA sequence
  source 1..20: mol_type = other DNA
ttcatttttatttgtgactg

SEQ ID NO: 105633 - DNA, 20 bp, synthetic construct
  misc_feature 1..20: note = CRISPR gRNA sequence
  source 1..20: mol_type = other DNA
tgactgtagtgataacttta

SEQ ID NO: 105634 - DNA, 20 bp, synthetic construct
  misc_feature 1..20: note = CRISPR gRNA sequence
  source 1..20: mol_type = other DNA
tgtagtgataactttacaga

SEQ ID NO: 105635 - DNA, 20 bp, synthetic construct
  misc_feature 1..20: note = CRISPR gRNA sequence
  source 1..20: mol_type = other DNA
tagtgataactttacagatg

SEQ ID NO: 105636 - DNA, 20 bp, synthetic construct
  misc_feature 1..20: note = CRISPR gRNA sequence
  source 1..20: mol_type = other DNA
gataactttacagatggaga

SEQ ID NO: 105637 - DNA, 20 bp, synthetic construct
  misc_feature 1..20: note = CRISPR gRNA sequence
  source 1..20: mol_type = other DNA
taactttacagatggagaaa

SEQ ID NO: 105638 - DNA, 20 bp, synthetic construct
  misc_feature 1..20: note = CRISPR gRNA sequence
  source 1..20: mol_type = other DNA
acagatggagaaagagtgaa

SEQ ID NO: 105639 - DNA, 20 bp, synthetic construct
  misc_feature 1..20: note = CRISPR gRNA sequence
  source 1..20: mol_type = other DNA
tgaatggatgaatgaataat

SEQ ID NO: 105640 - DNA, 20 bp, synthetic construct
  misc_feature 1..20: note = CRISPR gRNA sequence
  source 1..20: mol_type = other DNA
tgaataattggtttaatgcc

SEQ ID NO: 105641 - DNA, 20 bp, synthetic construct
  misc_feature 1..20: note = CRISPR gRNA sequence
  source 1..20: mol_type = other DNA
aatgcctagttatgcaactt

SEQ ID NO: 105642 - DNA, 20 bp, synthetic construct
  misc_feature 1..20: note = CRISPR gRNA sequence
  source 1..20: mol_type = other DNA
agtgcttttttttttttttg

SEQ ID NO: 105643 - DNA, 20 bp, synthetic construct
  misc_feature 1..20: note = CRISPR gRNA sequence
  source 1..20: mol_type = other DNA
gtgcttttttttttttttgc

SEQ ID NO: 105644 - DNA, 20 bp, synthetic construct
  misc_feature 1..20: note = CRISPR gRNA sequence
  source 1..20: mol_type = other DNA
tttttttgcaggataatttt

SEQ ID NO: 105645 - DNA, 20 bp, synthetic construct
  misc_feature 1..20: note = CRISPR gRNA sequence
  source 1..20: mol_type = other DNA
tgtatatattttaactgcac

SEQ ID NO: 105646 - DNA, 20 bp, synthetic construct
  misc_feature 1..20: note = CRISPR gRNA sequence
  source 1..20: mol_type = other DNA
cactggtacattgaacatgt

SEQ ID NO: 105647 - DNA, 20 bp, synthetic construct
  misc_feature 1..20: note = CRISPR gRNA sequence
  source 1..20: mol_type = other DNA
catgtcagtgtcgatgccac

SEQ ID NO: 105648 - DNA, 20 bp, synthetic construct
  misc_feature 1..20: note = CRISPR gRNA sequence
  source 1..20: mol_type = other DNA
tgtcgatgccactggaccaa

SEQ ID NO: 105649 - DNA, 20 bp, synthetic construct
  misc_feature 1..20: note = CRISPR gRNA sequence
  source 1..20: mol_type = other DNA
tcgatgccactggaccaaca

SEQ ID NO: 105650 - DNA, 20 bp, synthetic construct
  misc_feature 1..20: note = CRISPR gRNA sequence
  source 1..20: mol_type = other DNA
tggaccaacagagcattttg

SEQ ID NO: 105651 - DNA, 20 bp, synthetic construct
  misc_feature 1..20: note = CRISPR gRNA sequence
  source 1..20: mol_type = other DNA
aacagagcattttgtggcta

SEQ ID NO: 105652 - DNA, 20 bp, synthetic construct
  misc_feature 1..20: note = CRISPR gRNA sequence
  source 1..20: mol_type = other DNA
acagagcattttgtggctat

SEQ ID NO: 105653 - DNA, 20 bp, synthetic construct
  misc_feature 1..20: note = CRISPR gRNA sequence
  source 1..20: mol_type = other DNA
cagagcattttgtggctata

SEQ ID NO: 105654 - DNA, 20 bp, synthetic construct
  misc_feature 1..20: note = CRISPR gRNA sequence
  source 1..20: mol_type = other DNA
ataatgtcttgatttttctt

SEQ ID NO: 105655 - DNA, 20 bp, synthetic construct
  misc_feature 1..20: note = CRISPR gRNA sequence
  source 1..20: mol_type = other DNA
taatgtcttgatttttcttt

SEQ ID NO: 105656 - DNA, 20 bp, synthetic construct
  misc_feature 1..20: note = CRISPR gRNA sequence
  source 1..20: mol_type = other DNA
tttgggattcaactatatcg

SEQ ID NO: 105657 - DNA, 20 bp, synthetic construct
  misc_feature 1..20: note = CRISPR gRNA sequence
  source 1..20: mol_type = other DNA
ttgggattcaactatatcga

SEQ ID NO: 105658 - DNA, 20 bp, synthetic construct
  misc_feature 1..20: note = CRISPR gRNA sequence
  source 1..20: mol_type = other DNA
tatatcgaaggtttttcccc

SEQ ID NO: 105659 - DNA, 20 bp, synthetic construct
  misc_feature 1..20: note = CRISPR gRNA sequence
  source 1..20: mol_type = other DNA
atcgaaggtttttcccccag

SEQ ID NO: 105660 - DNA, 20 bp, synthetic construct
  misc_feature 1..20: note = CRISPR gRNA sequence
  source 1..20: mol_type = other DNA
aggtttttcccccagcagta

SEQ ID NO: 105661 - DNA, 20 bp, synthetic construct
  misc_feature 1..20: note = CRISPR gRNA sequence
  source 1..20: mol_type = other DNA
ggtttttcccccagcagtat

SEQ ID NO: 105662 - DNA, 20 bp, synthetic construct
  misc_feature 1..20: note = CRISPR gRNA sequence
  source 1..20: mol_type = other DNA
gtttttcccccagcagtatg

SEQ ID NO: 105663 - DNA, 20 bp, synthetic construct
  misc_feature 1..20: note = CRISPR gRNA sequence
  source 1..20: mol_type = other DNA
tttttcccccagcagtatgg

SEQ ID NO: 105664 - DNA, 20 bp, synthetic construct
  misc_feature 1..20: note = CRISPR gRNA sequence
  source 1..20: mol_type = other DNA
cccagcagtatgggggcgta

SEQ ID NO: 105665 - DNA, 20 bp, synthetic construct
  misc_feature 1..20: note = CRISPR gRNA sequence
  source 1..20: mol_type = other DNA
ccagcagtatgggggcgtac

SEQ ID NO: 105666 - DNA, 20 bp, synthetic construct
  misc_feature 1..20: note = CRISPR gRNA sequence
  source 1..20: mol_type = other DNA
aatttataaaaataaccgaa

SEQ ID NO: 105667 - DNA, 20 bp, synthetic construct
  misc_feature 1..20: note = CRISPR gRNA sequence
  source 1..20: mol_type = other DNA
cgaaaagtaatgtgactttt

SEQ ID NO: 105668 - DNA, 20 bp, synthetic construct
  misc_feature 1..20: note = CRISPR gRNA sequence
  source 1..20: mol_type = other DNA
gaaaagtaatgtgacttttg

SEQ ID NO: 105669 - DNA, 20 bp, synthetic construct
  misc_feature 1..20: note = CRISPR gRNA sequence
  source 1..20: mol_type = other DNA
tttgaggaatctgcaactcc

SEQ ID NO: 105670 - DNA, 20 bp, synthetic construct
  misc_feature 1..20: note = CRISPR gRNA sequence
  source 1..20: mol_type = other DNA
ttgaggaatctgcaactcct

SEQ ID NO: 105671 - DNA, 20 bp, synthetic construct
  misc_feature 1..20: note = CRISPR gRNA sequence
  source 1..20: mol_type = other DNA
aatctgcaactcctgggttc

SEQ ID NO: 105672 - DNA, 20 bp, synthetic construct
  misc_feature 1..20: note = CRISPR gRNA sequence
  source 1..20: mol_type = other DNA
tgggttctagtttgtgtttc

SEQ ID NO: 105673 - DNA, 20 bp, synthetic construct
  misc_feature 1..20: note = CRISPR gRNA sequence
  source 1..20: mol_type = other DNA
aaattttgatctcccccgac

SEQ ID NO: 105674 - DNA, 20 bp, synthetic construct
  misc_feature 1..20: note = CRISPR gRNA sequence
  source 1..20: mol_type = other DNA
cccgacaagacttgtctgca

SEQ ID NO: 105675 - DNA, 20 bp, synthetic construct
  misc_feature 1..20: note = CRISPR gRNA sequence
  source 1..20: mol_type = other DNA
acaagacttgtctgcatgga

SEQ ID NO: 105676 - DNA, 20 bp, synthetic construct
  misc_feature 1..20: note = CRISPR gRNA sequence
  source 1..20: mol_type = other DNA
atggacggtgtctctgtaaa

SEQ ID NO: 105677 - DNA, 20 bp, synthetic construct
  misc_feature 1..20: note = CRISPR gRNA sequence
  source 1..20: mol_type = other DNA
gtatcaaacttgtaatgtct

SEQ ID NO: 105678 - DNA, 20 bp, synthetic construct
  misc_feature 1..20: note = CRISPR gRNA sequence
  source 1..20: mol_type = other DNA
cttgtaatgtctgagcctct

SEQ ID NO: 105679 - DNA, 20 bp, synthetic construct
  misc_feature 1..20: note = CRISPR gRNA sequence
  source 1..20: mol_type = other DNA
ccccttaatttcttcccttt

SEQ ID NO: 105680 - DNA, 20 bp, synthetic construct
  misc_feature 1..20: note = CRISPR gRNA sequence
  source 1..20: mol_type = other DNA
tttggcccttccaccctgtt

SEQ ID NO: 105681 - DNA, 20 bp, synthetic construct
  misc_feature 1..20: note = CRISPR gRNA sequence
  source 1..20: mol_type = other DNA
ttggcccttccaccctgttg

SEQ ID NO: 105682 - DNA, 20 bp, synthetic construct
  misc_feature 1..20: note = CRISPR gRNA sequence
  source 1..20: mol_type = other DNA
ggcccttccaccctgttgag

SEQ ID NO: 105683 - DNA, 20 bp, synthetic construct
  misc_feature 1..20: note = CRISPR gRNA sequence
  source 1..20: mol_type = other DNA
gagattttttctgtcacctg

SEQ ID NO: 105684 - DNA, 20 bp, synthetic construct
  misc_feature 1..20: note = CRISPR gRNA sequence
  source 1..20: mol_type = other DNA
agattttttctgtcacctgc

SEQ ID NO: 105685 - DNA, 20 bp, synthetic construct
  misc_feature 1..20: note = CRISPR gRNA sequence
  source 1..20: mol_type = other DNA
acatttgatgctactactga

SEQ ID NO: 105686 - DNA, 20 bp, synthetic construct
  misc_feature 1..20: note = CRISPR gRNA sequence
  source 1..20: mol_type = other DNA
gtgtttatcaaaatgtgatg

SEQ ID NO: 105687 - DNA, 20 bp, synthetic construct
  misc_feature 1..20: note = CRISPR gRNA sequence
  source 1..20: mol_type = other DNA
atgtgatgaagtaattccat

SEQ ID NO: 105688 - DNA, 20 bp, synthetic construct
  misc_feature 1..20: note = CRISPR gRNA sequence
  source 1..20: mol_type = other DNA
tgtgatgaagtaattccatg

SEQ ID NO: 105689 - DNA, 20 bp, synthetic construct
  misc_feature 1..20: note = CRISPR gRNA sequence
  source 1..20: mol_type = other DNA
agtaattccatgaggaaaat

SEQ ID NO: 105690 - DNA, 20 bp, synthetic construct
  misc_feature 1..20: note = CRISPR gRNA sequence
  source 1..20: mol_type = other DNA
attagccgttatcacaaaaa

SEQ ID NO: 105691 - DNA, 20 bp, synthetic construct
  misc_feature 1..20: note = CRISPR gRNA sequence
  source 1..20: mol_type = other DNA
gttatcacaaaaacagcctt

SEQ ID NO: 105692 - DNA, 20 bp, synthetic construct
  misc_feature 1..20: note = CRISPR gRNA sequence
  source 1..20: mol_type = other DNA
aaaaacagccttaagtattg

SEQ ID NO: 105693 - DNA, 20 bp, synthetic construct
  misc_feature 1..20: note = CRISPR gRNA sequence
  source 1..20: mol_type = other DNA
ccttaagtattgtagaattt

SEQ ID NO: 105694 - DNA, 20 bp, synthetic construct
  misc_feature 1..20: note = CRISPR gRNA sequence
  source 1..20: mol_type = other DNA
cttaagtattgtagaatttc

SEQ ID NO: 105695 - DNA, 20 bp, synthetic construct
  misc_feature 1..20: note = CRISPR gRNA sequence
  source 1..20: mol_type = other DNA
aagtattgtagaatttcagg

SEQ ID NO: 105696 - DNA, 20 bp, synthetic construct
  misc_feature 1..20: note = CRISPR gRNA sequence
  source 1..20: mol_type = other DNA
ttgtagaatttcaggtagtg

SEQ ID NO: 105697 - DNA, 20 bp, synthetic construct
  misc_feature 1..20: note = CRISPR gRNA sequence
  source 1..20: mol_type = other DNA
atgtactatttacgttttgt

SEQ ID NO: 105698 - DNA, 20 bp, synthetic construct
  misc_feature 1..20: note = CRISPR gRNA sequence
  source 1..20: mol_type = other DNA
cgttttgttagattttgttt

SEQ ID NO: 105699 - DNA, 20 bp, synthetic construct
  misc_feature 1..20: note = CRISPR gRNA sequence
  source 1..20: mol_type = other DNA
tttgttagattttgttttgg

SEQ ID NO: 105700 - DNA, 20 bp, synthetic construct
  misc_feature 1..20: note = CRISPR gRNA sequence
  source 1..20: mol_type = other DNA
gttagattttgttttggcag

SEQ ID NO: 105701 - DNA, 20 bp, synthetic construct
  misc_feature 1..20: note = CRISPR gRNA sequence
  source 1..20: mol_type = other DNA
ttggcagaagaccaaaacaa

SEQ ID NO: 105702 - DNA, 20 bp, synthetic construct
  misc_feature 1..20: note = CRISPR gRNA sequence
  source 1..20: mol_type = other DNA
ttctgattgttaaaaatcca

SEQ ID NO: 105703 - DNA, 20 bp, synthetic construct
  misc_feature 1..20: note = CRISPR gRNA sequence
  source 1..20: mol_type = other DNA
cttgttactgttttacctta

SEQ ID NO: 105704 - DNA, 20 bp, synthetic construct
  misc_feature 1..20: note = CRISPR gRNA sequence
  source 1..20: mol_type = other DNA
ctgttttaccttacggtcgc

SEQ ID NO: 105705 - DNA, 20 bp, synthetic construct
  misc_feature 1..20: note = CRISPR gRNA sequence
  source 1..20: mol_type = other DNA
tgttttaccttacggtcgct

SEQ ID NO: 105706 - DNA, 20 bp, synthetic construct
  misc_feature 1..20: note = CRISPR gRNA sequence
  source 1..20: mol_type = other DNA
cttacggtcgctgggaatct

SEQ ID NO: 105707 - DNA, 20 bp, synthetic construct
  misc_feature 1..20: note = CRISPR gRNA sequence
  source 1..20: mol_type = other DNA
cgctgggaatctaagcaaca

SEQ ID NO: 105708 - DNA, 20 bp, synthetic construct
  misc_feature 1..20: note = CRISPR gRNA sequence
  source 1..20: mol_type = other DNA
ggaatctaagcaacaaagac

SEQ ID NO: 105709 - DNA, 20 bp, synthetic construct
  misc_feature 1..20: note = CRISPR gRNA sequence
  source 1..20: mol_type = other DNA
atctaagcaacaaagactag

SEQ ID NO: 105710 - DNA, 20 bp, synthetic construct
  misc_feature 1..20: note = CRISPR gRNA sequence
  source 1..20: mol_type = other DNA
atatgccattatcaacacac

SEQ ID NO: 105711 - DNA, 20 bp, synthetic construct
  misc_feature 1..20: note = CRISPR gRNA sequence
  source 1..20: mol_type = other DNA
atgccattatcaacacacaa

SEQ ID NO: 105712 - DNA, 20 bp, synthetic construct
  misc_feature 1..20: note = CRISPR gRNA sequence
  source 1..20: mol_type = other DNA
atcaacacacaagagacaaa

SEQ ID NO: 105713 - DNA, 20 bp, synthetic construct
  misc_feature 1..20: note = CRISPR gRNA sequence
  source 1..20: mol_type = other DNA
acacaagagacaaacagccc

SEQ ID NO: 105714 - DNA, 20 bp, synthetic construct
  misc_feature 1..20: note = CRISPR gRNA sequence
  source 1..20: mol_type = other DNA
cacaagagacaaacagcccg

SEQ ID NO: 105715 - DNA, 20 bp, synthetic construct
  misc_feature 1..20: note = CRISPR gRNA sequence
  source 1..20: mol_type = other DNA
aagagacaaacagcccgagg

SEQ ID NO: 105716 - DNA, 20 bp, synthetic construct
  misc_feature 1..20: note = CRISPR gRNA sequence
  source 1..20: mol_type = other DNA
ccgaggaagcactcaatgat

SEQ ID NO: 105717 - DNA, 20 bp, synthetic construct
  misc_feature 1..20: note = CRISPR gRNA sequence
  source 1..20: mol_type = other DNA
gaggaagcactcaatgatga

SEQ ID NO: 105718 - DNA, 20 bp, synthetic construct
  misc_feature 1..20: note = CRISPR gRNA sequence
  source 1..20: mol_type = other DNA
gaagcactcaatgatgagag

SEQ ID NO: 105719 - DNA, 20 bp, synthetic construct
  misc_feature 1..20: note = CRISPR gRNA sequence
  source 1..20: mol_type = other DNA
gcactcaatgatgagagcag

SEQ ID NO: 105720 - DNA, 20 bp, synthetic construct
  misc_feature 1..20: note = CRISPR gRNA sequence
  source 1..20: mol_type = other DNA
tgagagcagtagacctgccc

SEQ ID NO: 105721 - DNA, 20 bp, synthetic construct
  misc_feature 1..20: note = CRISPR gRNA sequence
  source 1..20: mol_type = other DNA
gagcagtagacctgccctgg

SEQ ID NO: 105722 - DNA, 20 bp, synthetic construct
  misc_feature 1..20: note = CRISPR gRNA sequence
  source 1..20: mol_type = other DNA
gtagacctgccctggcagat

SEQ ID NO: 105723 - DNA, 20 bp, synthetic construct
  misc_feature 1..20: note = CRISPR gRNA sequence
  source 1..20: mol_type = other DNA
agacctgccctggcagatga

SEQ ID NO: 105724 - DNA, 20 bp, synthetic construct
  misc_feature 1..20: note = CRISPR gRNA sequence
  source 1..20: mol_type = other DNA
acctgccctggcagatgaga

SEQ ID NO: 105725 - DNA, 20 bp, synthetic construct
  misc_feature 1..20: note = CRISPR gRNA sequence
  source 1..20: mol_type = other DNA
cctgccctggcagatgagag

SEQ ID NO: 105726 - DNA, 20 bp, synthetic construct
  misc_feature 1..20: note = CRISPR gRNA sequence
  source 1..20: mol_type = other DNA
tgccctggcagatgagagag

SEQ ID NO: 105727 - DNA, 20 bp, synthetic construct
  misc_feature 1..20: note = CRISPR gRNA sequence
  source 1..20: mol_type = other DNA
aggagaaactctccacaatg

SEQ ID NO: 105728 - DNA, 20 bp, synthetic construct
  misc_feature 1..20: note = CRISPR gRNA sequence
  source 1..20: mol_type = other DNA
ggagaaactctccacaatga

SEQ ID NO: 105729 - DNA, 20 bp, synthetic construct
  misc_feature 1..20: note = CRISPR gRNA sequence
  source 1..20: mol_type = other DNA
aactctccacaatgaaggaa

SEQ ID NO: 105730 - DNA, 20 bp, synthetic construct
  misc_feature 1..20: note = CRISPR gRNA sequence
  source 1..20: mol_type = other DNA
caatgaaggaaaagcactga

SEQ ID NO: 105731 - DNA, 20 bp, synthetic construct
  misc_feature 1..20: note = CRISPR gRNA sequence
  source 1..20: mol_type = other DNA
aaagcactgacagtatttga

SEQ ID NO: 105732 - DNA, 20 bp, synthetic construct
  misc_feature 1..20: note = CRISPR gRNA sequence
  source 1..20: mol_type = other DNA
ctgacagtatttgatagctt

SEQ ID NO: 105733 - DNA, 20 bp, synthetic construct
  misc_feature 1..20: note = CRISPR gRNA sequence
  source 1..20: mol_type = other DNA
gctttagtcaaactgtgctt

SEQ ID NO: 105734 - DNA, 20 bp, synthetic construct
  misc_feature 1..20: note = CRISPR gRNA sequence
  source 1..20: mol_type = other DNA
agtcaaactgtgcttgagtt

SEQ ID NO: 105735 - DNA, 20 bp, synthetic construct
  misc_feature 1..20: note = CRISPR gRNA sequence
  source 1..20: mol_type = other DNA
aactgtgcttgagtttggct

SEQ ID NO: 105736 - DNA, 20 bp, synthetic construct
  misc_feature 1..20: note = CRISPR gRNA sequence
  source 1..20: mol_type = other DNA
agtttggcttagatttatgc

SEQ ID NO: 105737 - DNA, 20 bp, synthetic construct
  misc_feature 1..20: note = CRISPR gRNA sequence
  source 1..20: mol_type = other DNA
ttggcttagatttatgccag

SEQ ID NO: 105738 - DNA, 20 bp, synthetic construct
  misc_feature 1..20: note = CRISPR gRNA sequence
  source 1..20: mol_type = other DNA
gaacctgtccttaccaaatt

SEQ ID NO: 105739 - DNA, 20 bp, synthetic construct
  misc_feature 1..20: note = CRISPR gRNA sequence
  source 1..20: mol_type = other DNA
acctgtccttaccaaattca

SEQ ID NO: 105740 - DNA, 20 bp, synthetic construct
  misc_feature 1..20: note = CRISPR gRNA sequence
  source 1..20: mol_type = other DNA
accaaattcagagatgaccc

SEQ ID NO: 105741 - DNA, 20 bp, synthetic construct
  misc_feature 1..20: note = CRISPR gRNA sequence
  source 1..20: mol_type = other DNA
tgacccaagattctactctg

SEQ ID NO: 105742 - DNA, 20 bp, synthetic construct
  misc_feature 1..20: note = CRISPR gRNA sequence
  source 1..20: mol_type = other DNA
aagattctactctgtggtat

SEQ ID NO: 105743 - DNA, 20 bp, synthetic construct
  misc_feature 1..20: note = CRISPR gRNA sequence
  source 1..20: mol_type = other DNA
agattctactctgtggtatg

SEQ ID NO: 105744 - DNA, 20 bp, synthetic construct
  misc_feature 1..20: note = CRISPR gRNA sequence
  source 1..20: mol_type = other DNA
gattctactctgtggtatga

SEQ ID NO: 105745 - DNA, 20 bp, synthetic construct
  misc_feature 1..20: note = CRISPR gRNA sequence
  source 1..20: mol_type = other DNA
ctactctgtggtatgaggga

SEQ ID NO: 105746 - DNA, 20 bp, synthetic construct
  misc_feature 1..20: note = CRISPR gRNA sequence
  source 1..20: mol_type = other DNA
cgatatttatctcacaccaa

SEQ ID NO: 105747 - DNA, 20 bp, synthetic construct
  misc_feature 1..20: note = CRISPR gRNA sequence
  source 1..20: mol_type = other DNA
tcacaccaacggctttatcg

SEQ ID NO: 105748 - DNA, 20 bp, synthetic construct
  misc_feature 1..20: note = CRISPR gRNA sequence
  source 1..20: mol_type = other DNA
cacaccaacggctttatcgt

SEQ ID NO: 105749 - DNA, 20 bp, synthetic construct
  misc_feature 1..20: note = CRISPR gRNA sequence
  source 1..20: mol_type = other DNA
caccaacggctttatcgtag

SEQ ID NO: 105750 - DNA, 20 bp, synthetic construct
  misc_feature 1..20: note = CRISPR gRNA sequence
  source 1..20: mol_type = other DNA
gtcttcgcctcccccgtttc

SEQ ID NO: 105751 - DNA, 20 bp, synthetic construct
  misc_feature 1..20: note = CRISPR gRNA sequence
  source 1..20: mol_type = other DNA
ttcgcctcccccgtttccag

SEQ ID NO: 105752 - DNA, 20 bp, synthetic construct
  misc_feature 1..20: note = CRISPR gRNA sequence
  source 1..20: mol_type = other DNA
ctcccccgtttccagtagaa

SEQ ID NO: 105753 - DNA, 20 bp, synthetic construct
  misc_feature 1..20: note = CRISPR gRNA sequence
  source 1..20: mol_type = other DNA
cccgtttccagtagaaaaga

SEQ ID NO: 105754 - DNA, 20 bp, synthetic construct
  misc_feature 1..20: note = CRISPR gRNA sequence
  source 1..20: mol_type = other DNA
agacagctttgctcctttga

SEQ ID NO: 105755 - DNA, 20 bp, synthetic construct
  misc_feature 1..20: note = CRISPR gRNA sequence
  source 1..20: mol_type = other DNA
gctttgctcctttgaaagcg

SEQ ID NO: 105756 - DNA, 20 bp, synthetic construct
  misc_feature 1..20: note = CRISPR gRNA sequence
  source 1..20: mol_type = other DNA
agcgcagaccgccgcacctc

SEQ ID NO: 105757 - DNA, 20 bp, synthetic construct
  misc_feature 1..20: note = CRISPR gRNA sequence
  source 1..20: mol_type = other DNA
cacctccagccccttctccc

SEQ ID NO: 105758 - DNA, 20 bp, synthetic construct
  misc_feature 1..20: note = CRISPR gRNA sequence
  source 1..20: mol_type = other DNA
acctccagccccttctcccc

SEQ ID NO: 105759 - DNA, 20 bp, synthetic construct
  misc_feature 1..20: note = CRISPR gRNA sequence
  source 1..20: mol_type = other DNA
cctccagccccttctccccg

SEQ ID NO: 105760 - DNA, 20 bp, synthetic construct
  misc_feature 1..20: note = CRISPR gRNA sequence
  source 1..20: mol_type = other DNA
ccagccccttctccccgggg

SEQ ID NO: 105761 - DNA, 20 bp, synthetic construct
  misc_feature 1..20: note = CRISPR gRNA sequence
  source 1..20: mol_type = other DNA
gccccttctccccggggaag

SEQ ID NO: 105762 - DNA, 20 bp, synthetic construct
  misc_feature 1..20: note = CRISPR gRNA sequence
  source 1..20: mol_type = other DNA
ccccttctccccggggaagt

SEQ ID NO: 105763 - DNA, 20 bp, synthetic construct
  misc_feature 1..20: note = CRISPR gRNA sequence
  source 1..20: mol_type = other DNA
ccggggaagtaggccccgct

SEQ ID NO: 105764 - DNA, 20 bp, synthetic construct
  misc_feature 1..20: note = CRISPR gRNA sequence
  source 1..20: mol_type = other DNA
agtaggccccgctaagaatg

SEQ ID NO: 105765 - DNA, 20 bp, synthetic construct
  misc_feature 1..20: note = CRISPR gRNA sequence
  source 1..20: mol_type = other DNA
gtaggccccgctaagaatgt

SEQ ID NO: 105766 - DNA, 20 bp, synthetic construct
  misc_feature 1..20: note = CRISPR gRNA sequence
  source 1..20: mol_type = other DNA
ggccccgctaagaatgtggg

SEQ ID NO: 105767 - DNA, 20 bp, synthetic construct
  misc_feature 1..20: note = CRISPR gRNA sequence
  source 1..20: mol_type = other DNA
gccccgctaagaatgtggga

SEQ ID NO: 105768 - DNA, 20 bp, synthetic construct
  misc_feature 1..20: note = CRISPR gRNA sequence
  source 1..20: mol_type = other DNA
ccgctaagaatgtgggaagg

SEQ ID NO: 105769 - DNA, 20 bp, synthetic construct
  misc_feature 1..20: note = CRISPR gRNA sequence
  source 1..20: mol_type = other DNA
ctaagaatgtgggaaggtgg

SEQ ID NO: 105770 - DNA, 20 bp, synthetic construct
  misc_feature 1..20: note = CRISPR gRNA sequence
  source 1..20: mol_type = other DNA
taagaatgtgggaaggtggt

SEQ ID NO: 105771 - DNA, 20 bp, synthetic construct
  misc_feature 1..20: note = CRISPR gRNA sequence
  source 1..20: mol_type = other DNA
aagaatgtgggaaggtggtg

SEQ ID NO: 105772 - DNA, 20 bp, synthetic construct
  misc_feature 1..20: note = CRISPR gRNA sequence
  source 1..20: mol_type = other DNA
aatgtgggaaggtggtgggg

SEQ ID NO: 105773 - DNA, 20 bp, synthetic construct
  misc_feature 1..20: note = CRISPR gRNA sequence
  source 1..20: mol_type = other DNA
aggtggtggggcggcgactg

SEQ ID NO: 105774 - DNA, 20 bp, synthetic construct
  misc_feature 1..20: note = CRISPR gRNA sequence
  source 1..20: mol_type = other DNA
cgactgaagtcgcttccgat

SEQ ID NO: 105775 - DNA, 20 bp, synthetic construct
  misc_feature 1..20: note = CRISPR gRNA sequence
  source 1..20: mol_type = other DNA
cttccgattggcgttgtccc

SEQ ID NO: 105776 - DNA, 20 bp, synthetic construct
  misc_feature 1..20: note = CRISPR gRNA sequence
  source 1..20: mol_type = other DNA
ttccgattggcgttgtccca

SEQ ID NO: 105777 - DNA, 20 bp, synthetic construct
  misc_feature 1..20: note = CRISPR gRNA sequence
  source 1..20: mol_type = other DNA
cgattggcgttgtcccaagg

SEQ ID NO: 105778 - DNA, 20 bp, synthetic construct
  misc_feature 1..20: note = CRISPR gRNA sequence
  source 1..20: mol_type = other DNA
ttgtcccaaggaagcctgcg

SEQ ID NO: 105779 - DNA, 20 bp, synthetic construct
  misc_feature 1..20: note = CRISPR gRNA sequence
  source 1..20: mol_type = other DNA
ggaagcctgcgcggattgat

SEQ ID NO: 105780 - DNA, 20 bp, synthetic construct
  misc_feature 1..20: note = CRISPR gRNA sequence
  source 1..20: mol_type = other DNA
agcctgcgcggattgatcgg

SEQ ID NO: 105781 - DNA, 20 bp, synthetic construct
  misc_feature 1..20: note = CRISPR gRNA sequence
  source 1..20: mol_type = other DNA
ctgcgcggattgatcggcgg

SEQ ID NO: 105782 - DNA, 20 bp, synthetic construct
  misc_feature 1..20: note = CRISPR gRNA sequence
  source 1..20: mol_type = other DNA
tgcgcggattgatcggcggc

SEQ ID NO: 105783 - DNA, 20 bp, synthetic construct
  misc_feature 1..20: note = CRISPR gRNA sequence
  source 1..20: mol_type = other DNA
gatcggcggcaggcctccaa

SEQ ID NO: 105784 - DNA, 20 bp, synthetic construct
  misc_feature 1..20: note = CRISPR gRNA sequence
  source 1..20: mol_type = other DNA
tcggcggcaggcctccaata

SEQ ID NO: 105785 - DNA, 20 bp, synthetic construct
  misc_feature 1..20: note = CRISPR gRNA sequence
  source 1..20: mol_type = other DNA
aggcctccaatagagcctgc

SEQ ID NO: 105786 - DNA, 20 bp, synthetic construct
  misc_feature 1..20: note = CRISPR gRNA sequence
  source 1..20: mol_type = other DNA
ggcctccaatagagcctgct

SEQ ID NO: 105787 - DNA, 20 bp, synthetic construct
  misc_feature 1..20: note = CRISPR gRNA sequence
  source 1..20: mol_type = other DNA
ctccaatagagcctgctagg

SEQ ID NO: 105788 - DNA, 20 bp, synthetic construct
  misc_feature 1..20: note = CRISPR gRNA sequence
  source 1..20: mol_type = other DNA
atagagcctgctaggcggat

SEQ ID NO: 105789 - DNA, 20 bp, synthetic construct
  misc_feature 1..20: note = CRISPR gRNA sequence
  source 1..20: mol_type = other DNA
taggcggattggctgctacg

SEQ ID NO: 105790 - DNA, 20 bp, synthetic construct
  misc_feature 1..20: note = CRISPR gRNA sequence
  source 1..20: mol_type = other DNA
cggattggctgctacgcggc

SEQ ID NO: 105791 - DNA, 20 bp, synthetic construct
  misc_feature 1..20: note = CRISPR gRNA sequence
  source 1..20: mol_type = other DNA
ggattggctgctacgcggct

SEQ ID NO: 105792 - DNA, 20 bp, synthetic construct
  misc_feature 1..20: note = CRISPR gRNA sequence
  source 1..20: mol_type = other DNA
acgcggctgggccctgtttc

SEQ ID NO: 105793 - DNA, 20 bp, synthetic construct
  misc_feature 1..20: note = CRISPR gRNA sequence
  source 1..20: mol_type = other DNA
tgggccctgtttccggtacc

SEQ ID NO: 105794 - DNA, 20 bp, synthetic construct
  misc_feature 1..20: note = CRISPR gRNA sequence
  source 1..20: mol_type = other DNA
gggccctgtttccggtacct

SEQ ID NO: 105795 - DNA, 20 bp, synthetic construct
  misc_feature 1..20: note = CRISPR gRNA sequence
  source 1..20: mol_type = other DNA
ccctgtttccggtacctagg

SEQ ID NO: 105796 - DNA, 20 bp, synthetic construct
  misc_feature 1..20: note = CRISPR gRNA sequence
  source 1..20: mol_type = other DNA
cctgtttccggtacctaggc

SEQ ID NO: 105797 - DNA, 20 bp, synthetic construct
  misc_feature 1..20: note = CRISPR gRNA sequence
  source 1..20: mol_type = other DNA
gtttccggtacctaggcggg

SEQ ID NO: 105798 - DNA, 20 bp, synthetic construct
  misc_feature 1..20: note = CRISPR gRNA sequence
  source 1..20: mol_type = other DNA
ggtacctaggcgggcagcca

SEQ ID NO: 105799 - DNA, 20 bp, synthetic construct
  misc_feature 1..20: note = CRISPR gRNA sequence
  source 1..20: mol_type = other DNA
aggcgggcagccatggtgac

SEQ ID NO: 105800 - DNA, 20 bp, synthetic construct
  misc_feature 1..20: note = CRISPR gRNA sequence
  source 1..20: mol_type = other DNA
gggcagccatggtgaccggc

SEQ ID NO: 105801 - DNA, 20 bp, synthetic construct
  misc_feature 1..20: note = CRISPR gRNA sequence
  source 1..20: mol_type = other DNA
cagccatggtgaccggcgag

SEQ ID NO: 105802 - DNA, 20 bp, synthetic construct
  misc_feature 1..20: note = CRISPR gRNA sequence
  source 1..20: mol_type = other DNA
ggcatgcgacgccgcctctg

SEQ ID NO: 105803 - DNA, 20 bp, synthetic construct
  misc_feature 1..20: note = CRISPR gRNA sequence
  source 1..20: mol_type = other DNA
gacgccgcctctgtggcctg

SEQ ID NO: 105804 - DNA, 20 bp, synthetic construct
  misc_feature 1..20: note = CRISPR gRNA sequence
  source 1..20: mol_type = other DNA
cgccgcctctgtggcctgtg

SEQ ID NO: 105805 - DNA, 20 bp, synthetic construct
  misc_feature 1..20: note = CRISPR gRNA sequence
  source 1..20: mol_type = other DNA
gccgcctctgtggcctgtgg

SEQ ID NO: 105806 - DNA, 20 bp, synthetic construct
  misc_feature 1..20: note = CRISPR gRNA sequence
  source 1..20: mol_type = other DNA
gtggcctgtggaggcccgct

SEQ ID NO: 105807 - DNA, 20 bp, synthetic construct
  misc_feature 1..20: note = CRISPR gRNA sequence
  source 1..20: mol_type = other DNA
gcctgtggaggcccgcttgg

SEQ ID NO: 105808 - DNA, 20 bp, synthetic construct
  misc_feature 1..20: note = CRISPR gRNA sequence
  source 1..20: mol_type = other DNA
ggcgctgcttcccgacctac

SEQ ID NO: 105809 - DNA, 20 bp, synthetic construct
  misc_feature 1..20: note = CRISPR gRNA sequence
  source 1..20: mol_type = other DNA
ttcccgacctactggtcttt

SEQ ID NO: 105810 - DNA, 20 bp, synthetic construct
  misc_feature 1..20: note = CRISPR gRNA sequence
  source 1..20: mol_type = other DNA
ccgacctactggtctttcgg

SEQ ID NO: 105811 - DNA, 20 bp, synthetic construct
  misc_feature 1..20: note = CRISPR gRNA sequence
  source 1..20: mol_type = other DNA
tactggtctttcggaagcct

SEQ ID NO: 105812 - DNA, 20 bp, synthetic construct
  misc_feature 1..20: note = CRISPR gRNA sequence
  source 1..20: mol_type = other DNA
actggtctttcggaagcctc

SEQ ID NO: 105813 - DNA, 20 bp, synthetic construct
  misc_feature 1..20: note = CRISPR gRNA sequence
  source 1..20: mol_type = other DNA
ctggtctttcggaagcctcg

SEQ ID NO: 105814 - DNA, 20 bp, synthetic construct
  misc_feature 1..20: note = CRISPR gRNA sequence
  source 1..20: mol_type = other DNA
tctttcggaagcctcgggga

SEQ ID NO: 105815 - DNA, 20 bp, synthetic construct
  misc_feature 1..20: note = CRISPR gRNA sequence
  source 1..20: mol_type = other DNA
ctttcggaagcctcggggat

SEQ ID NO: 105816 - DNA, 20 bp, synthetic construct
  misc_feature 1..20: note = CRISPR gRNA sequence
  source 1..20: mol_type = other DNA
agcctcggggatgggaaccc
